United States Patent 11,421,016 (CANCER NEOEPITOPES) - sequence listing, part 23

SEQ ID NO: 1018429 - protein, 9 aa, Homo Sapiens
TSSHCPQVE

SEQ ID NO: 1018430 - protein, 9 aa, Homo Sapiens
KSTEDWMES

SEQ ID NO: 1018431 - protein, 9 aa, Homo Sapiens
AENEMLGLM

SEQ ID NO: 1018432 - protein, 9 aa, Homo Sapiens
PGSASGGSK

SEQ ID NO: 1018433 - protein, 9 aa, Homo Sapiens
VLHVSLSTD

SEQ ID NO: 1018434 - protein, 9 aa, Homo Sapiens
SNKIAALFI

SEQ ID NO: 1018435 - protein, 9 aa, Homo Sapiens
DKPKVWFAA

SEQ ID NO: 1018436 - protein, 9 aa, Homo Sapiens
KMSSSGRKQ

SEQ ID NO: 1018437 - protein, 9 aa, Homo Sapiens
CDDYGSRYL

SEQ ID NO: 1018438 - protein, 9 aa, Homo Sapiens
RNVAIEFSL

SEQ ID NO: 1018439 - protein, 9 aa, Homo Sapiens
LKQQNVRGI

SEQ ID NO: 1018440 - protein, 9 aa, Homo Sapiens
EYKGHQVKK

SEQ ID NO: 1018441 - protein, 9 aa, Homo Sapiens
MRYLNGLDS

SEQ ID NO: 1018442 - protein, 9 aa, Homo Sapiens
FSKPCFTAY

SEQ ID NO: 1018443 - protein, 9 aa, Homo Sapiens
NRIFVEGID

SEQ ID NO: 1018444 - protein, 9 aa, Homo Sapiens
SPMAKGCQR

SEQ ID NO: 1018445 - protein, 9 aa, Homo Sapiens
LSKKTIRRR

SEQ ID NO: 1018446 - protein, 9 aa, Homo Sapiens
DAYQDGFGR

SEQ ID NO: 1018447 - protein, 9 aa, Homo Sapiens
LNKIDAGVC

SEQ ID NO: 1018448 - protein, 9 aa, Homo Sapiens
SKKISGSSV

SEQ ID NO: 1018449 - protein, 9 aa, Homo Sapiens
QPYCRGLPN

SEQ ID NO: 1018450 - protein, 9 aa, Homo Sapiens
MSLQNMKRT

SEQ ID NO: 1018451 - protein, 9 aa, Homo Sapiens
QMRTSQKNV

SEQ ID NO: 1018452 - protein, 9 aa, Homo Sapiens
RPLIAIFQL

SEQ ID NO: 1018453 - protein, 9 aa, Homo Sapiens
PCAIPEQFR

SEQ ID NO: 1018454 - protein, 9 aa, Homo Sapiens
PNNLPAQES

SEQ ID NO: 1018455 - protein, 9 aa, Homo Sapiens
GQMRSQVCI

SEQ ID NO: 1018456 - protein, 9 aa, Homo Sapiens
TRQNESWGP

SEQ ID NO: 1018457 - protein, 9 aa, Homo Sapiens
EKTSEEKCG

SEQ ID NO: 1018458 - protein, 9 aa, Homo Sapiens
YLNGLDSEP

SEQ ID NO: 1018459 - protein, 9 aa, Homo Sapiens
IQGGNEESP

SEQ ID NO: 1018460 - protein, 9 aa, Homo Sapiens
LPPARKQKS

SEQ ID NO: 1018461 - protein, 9 aa, Homo Sapiens
LDAQTWLFQ

SEQ ID NO: 1018462 - protein, 9 aa, Homo Sapiens
CSINKLIRI

SEQ ID NO: 1018463 - protein, 9 aa, Homo Sapiens
INAIIGNVL

SEQ ID NO: 1018464 - protein, 9 aa, Homo Sapiens
VESFWEKVA

SEQ ID NO: 1018465 - protein, 9 aa, Homo Sapiens
VLTVGSSSC

SEQ ID NO: 1018466 - protein, 9 aa, Homo Sapiens
ITSSMSTIR

SEQ ID NO: 1018467 - protein, 9 aa, Homo Sapiens
RAEAAAATA

SEQ ID NO: 1018468 - protein, 9 aa, Homo Sapiens
WDAYQDGFG

SEQ ID NO: 1018469 - protein, 9 aa, Homo Sapiens
VGVVGGDVR

SEQ ID NO: 1018470 - protein, 9 aa, Homo Sapiens
QKFPCYIPI

SEQ ID NO: 1018471 - protein, 9 aa, Homo Sapiens
ELCTPASLE

SEQ ID NO: 1018472 - protein, 9 aa, Homo Sapiens
PTSQRSAYG

SEQ ID NO: 1018473 - protein, 9 aa, Homo Sapiens
GKVVQKLQA

SEQ ID NO: 1018474 - protein, 9 aa, Homo Sapiens
YCFTKPKLI

SEQ ID NO: 1018475 - protein, 9 aa, Homo Sapiens
VFLKDDANL

SEQ ID NO: 1018476 - protein, 9 aa, Homo Sapiens
RENFHKCEE

SEQ ID NO: 1018477 - protein, 9 aa, Homo Sapiens
GDQQGLLKV

SEQ ID NO: 1018478 - protein, 9 aa, Homo Sapiens
WYKDGVFLK

SEQ ID NO: 1018479 - protein, 9 aa, Homo Sapiens
LKKEFQPGS

SEQ ID NO: 1018480 - protein, 9 aa, Homo Sapiens
ELIRDHFGH

SEQ ID NO: 1018481 - protein, 9 aa, Homo Sapiens
EDAERYLCG

SEQ ID NO: 1018482 - protein, 9 aa, Homo Sapiens
HIFDFLGYQ

SEQ ID NO: 1018483 - protein, 9 aa, Homo Sapiens
GPPFPLQDQ

SEQ ID NO: 1018484 - protein, 9 aa, Homo Sapiens
LFECSNCRK

SEQ ID NO: 1018485 - protein, 9 aa, Homo Sapiens
DDEEDFSSP

SEQ ID NO: 1018486 - protein, 9 aa, Homo Sapiens
GRPISWVKG

SEQ ID NO: 1018487 - protein, 9 aa, Homo Sapiens
DLIIISSPL

SEQ ID NO: 1018488 - protein, 9 aa, Homo Sapiens
REKLLQVNS

SEQ ID NO: 1018489 - protein, 9 aa, Homo Sapiens
FCVGKKIGC

SEQ ID NO: 1018490 - protein, 9 aa, Homo Sapiens
AGPNGPPGS

SEQ ID NO: 1018491 - protein, 9 aa, Homo Sapiens
GSAPSQADP

SEQ ID NO: 1018492 - protein, 9 aa, Homo Sapiens
SNLYFLADD

SEQ ID NO: 1018493 - protein, 9 aa, Homo Sapiens
LNSEEGDGA

SEQ ID NO: 1018494 - protein, 9 aa, Homo Sapiens
KERKVSLFV

SEQ ID NO: 1018495 - protein, 9 aa, Homo Sapiens
VKWRVVGGT

SEQ ID NO: 1018496 - protein, 9 aa, Homo Sapiens
NNMKQELTT

SEQ ID NO: 1018497 - protein, 9 aa, Homo Sapiens
QVCCSADQQ

SEQ ID NO: 1018498 - protein, 9 aa, Homo Sapiens
PLIAIFQLI

SEQ ID NO: 1018499 - protein, 9 aa, Homo Sapiens
TTACVCKCP

SEQ ID NO: 1018500 - protein, 9 aa, Homo Sapiens
ILLFYAFIV

SEQ ID NO: 1018501 - protein, 9 aa, Homo Sapiens
NPAGLEGGP

SEQ ID NO: 1018502 - protein, 9 aa, Homo Sapiens
LNGLDSEPL

SEQ ID NO: 1018503 - protein, 9 aa, Homo Sapiens
AAAVATTTS

SEQ ID NO: 1018504 - protein, 9 aa, Homo Sapiens
DLDQIMEHI

SEQ ID NO: 1018505 - protein, 9 aa, Homo Sapiens
VVGGDVRIL

SEQ ID NO: 1018506 - protein, 9 aa, Homo Sapiens
ALLEGEIEH

SEQ ID NO: 1018507 - protein, 9 aa, Homo Sapiens
GHFLLGPDR

SEQ ID NO: 1018508 - protein, 9 aa, Homo Sapiens
IDELYLGNS

SEQ ID NO: 1018509 - protein, 9 aa, Homo Sapiens
MSSVVGFFL

SEQ ID NO: 1018510 - protein, 9 aa, Homo Sapiens
CKWNGEKMS

SEQ ID NO: 1018511 - protein, 9 aa, Homo Sapiens
QDTDSLLSA

SEQ ID NO: 1018512 - protein, 9 aa, Homo Sapiens
KSSLVYLLC

SEQ ID NO: 1018513 - protein, 9 aa, Homo Sapiens
NKIDAGVCE

SEQ ID NO: 1018514 - protein, 9 aa, Homo Sapiens
PTSSTRINM

SEQ ID NO: 1018515 - protein, 9 aa, Homo Sapiens
AVATTTSTA

SEQ ID NO: 1018516 - protein, 9 aa, Homo Sapiens
QPDTLSQPQ

SEQ ID NO: 1018517 - protein, 9 aa, Homo Sapiens
SLGQVAVKW

SEQ ID NO: 1018518 - protein, 9 aa, Homo Sapiens
AIPEQFRDM

SEQ ID NO: 1018519 - protein, 9 aa, Homo Sapiens
SICIFPDKT

SEQ ID NO: 1018520 - protein, 9 aa, Homo Sapiens
NSGNPGVVY

SEQ ID NO: 1018521 - protein, 9 aa, Homo Sapiens
GPRGLQRDP

SEQ ID NO: 1018522 - protein, 9 aa, Homo Sapiens
LPQMFSPPS

SEQ ID NO: 1018523 - protein, 9 aa, Homo Sapiens
PDDIYHSPF

SEQ ID NO: 1018524 - protein, 9 aa, Homo Sapiens
KQKVQRRER

SEQ ID NO: 1018525 - protein, 9 aa, Homo Sapiens
ASSLKMNPA

SEQ ID NO: 1018526 - protein, 9 aa, Homo Sapiens
PNPQDIISQ

SEQ ID NO: 1018527 - protein, 9 aa, Homo Sapiens
NPGAGSLAP

SEQ ID NO: 1018528 - protein, 9 aa, Homo Sapiens
DMSLQNMKR

SEQ ID NO: 1018529 - protein, 9 aa, Homo Sapiens
IVGSTLMVF

SEQ ID NO: 1018530 - protein, 9 aa, Homo Sapiens
RGGLKSREF

SEQ ID NO: 1018531 - protein, 9 aa, Homo Sapiens
MVTPDPSTS

SEQ ID NO: 1018532 - protein, 9 aa, Homo Sapiens
ASQIWNLNP

SEQ ID NO: 1018533 - protein, 9 aa, Homo Sapiens
LPEDNLVLP

SEQ ID NO: 1018534 - protein, 9 aa, Homo Sapiens
QEEGQRQGE

SEQ ID NO: 1018535 - protein, 9 aa, Homo Sapiens
VFLANALLE

SEQ ID NO: 1018536 - protein, 9 aa, Homo Sapiens
SRFISYTEE

SEQ ID NO: 1018537 - protein, 9 aa, Homo Sapiens
LHGSAYLIV

SEQ ID NO: 1018538 - protein, 9 aa, Homo Sapiens
GNEQKWKIK

SEQ ID NO: 1018539 - protein, 9 aa, Homo Sapiens
LSSAAAGLR

SEQ ID NO: 1018540 - protein, 9 aa, Homo Sapiens
VGSTLMVFL

SEQ ID NO: 1018541 - protein, 9 aa, Homo Sapiens
EDPRVGVVG

SEQ ID NO: 1018542 - protein, 9 aa, Homo Sapiens
ECWTPASSA

SEQ ID NO: 1018543 - protein, 9 aa, Homo Sapiens
LRGTHSSFA

SEQ ID NO: 1018544 - protein, 9 aa, Homo Sapiens
VKILKHWTG

SEQ ID NO: 1018545 - protein, 9 aa, Homo Sapiens
GALTSPGTA

SEQ ID NO: 1018546 - protein, 9 aa, Homo Sapiens
SERIEIKFQ

SEQ ID NO: 1018547 - protein, 9 aa, Homo Sapiens
HMFFRDRYE

SEQ ID NO: 1018548 - protein, 9 aa, Homo Sapiens
KRGDPDWPE

SEQ ID NO: 1018549 - protein, 9 aa, Homo Sapiens
GVQSPERSR

SEQ ID NO: 1018550 - protein, 9 aa, Homo Sapiens
HIAQHQFED

SEQ ID NO: 1018551 - protein, 9 aa, Homo Sapiens
GGTTRIILT

SEQ ID NO: 1018552 - protein, 9 aa, Homo Sapiens
KPTDPTSQR

SEQ ID NO: 1018553 - protein, 9 aa, Homo Sapiens
LKHWTGGCP

SEQ ID NO: 1018554 - protein, 9 aa, Homo Sapiens
PEIPQVKPE

SEQ ID NO: 1018555 - protein, 9 aa, Homo Sapiens
KNKELFVHG

SEQ ID NO: 1018556 - protein, 9 aa, Homo Sapiens
SSTRINMLK

SEQ ID NO: 1018557 - protein, 9 aa, Homo Sapiens
HFLKPLERF

SEQ ID NO: 1018558 - protein, 9 aa, Homo Sapiens
TFRLPPPLS

SEQ ID NO: 1018559 - protein, 9 aa, Homo Sapiens
PDLYFDAFT

SEQ ID NO: 1018560 - protein, 9 aa, Homo Sapiens
HIKAHKVAQ

SEQ ID NO: 1018561 - protein, 9 aa, Homo Sapiens
INAMLEGLE

SEQ ID NO: 1018562 - protein, 9 aa, Homo Sapiens
KPESSEGEA

SEQ ID NO: 1018563 - protein, 9 aa, Homo Sapiens
PKKKKKKNW

SEQ ID NO: 1018564 - protein, 9 aa, Homo Sapiens
LNGPWISTS

SEQ ID NO: 1018565 - protein, 9 aa, Homo Sapiens
KQQNVRGIK

SEQ ID NO: 1018566 - protein, 9 aa, Homo Sapiens
FSKGTPRSY

SEQ ID NO: 1018567 - protein, 9 aa, Homo Sapiens
ESPHSGRRT

SEQ ID NO: 1018568 - protein, 9 aa, Homo Sapiens
VTPLDIYDS

SEQ ID NO: 1018569 - protein, 9 aa, Homo Sapiens
LAYMACMII

SEQ ID NO: 1018570 - protein, 9 aa, Homo Sapiens
YVSFFVPAC

SEQ ID NO: 1018571 - protein, 9 aa, Homo Sapiens
EALVNIAPP

SEQ ID NO: 1018572 - protein, 9 aa, Homo Sapiens
VIDANIFLV

SEQ ID NO: 1018573 - protein, 9 aa, Homo Sapiens
INTKKQNFL

SEQ ID NO: 1018574 - protein, 9 aa, Homo Sapiens
LFIKVGKNF

SEQ ID NO: 1018575 - protein, 9 aa, Homo Sapiens
GFHLLFFFM

SEQ ID NO: 1018576 - protein, 9 aa, Homo Sapiens
YTPITSSMS

SEQ ID NO: 1018577 - protein, 9 aa, Homo Sapiens
RLPPPLSQY

SEQ ID NO: 1018578 - protein, 9 aa, Homo Sapiens
WWTGRPISW

SEQ ID NO: 1018579 - protein, 9 aa, Homo Sapiens
TVDCLDPEK

SEQ ID NO: 1018580 - protein, 9 aa, Homo Sapiens
QELADRPLI

SEQ ID NO: 1018581 - protein, 9 aa, Homo Sapiens
RGRLSLYVQ

SEQ ID NO: 1018582 - protein, 9 aa, Homo Sapiens
KDTSASAVT

SEQ ID NO: 1018583 - protein, 9 aa, Homo Sapiens
HFGHHVARN

SEQ ID NO: 1018584 - protein, 9 aa, Homo Sapiens
PNRIFVEGI

SEQ ID NO: 1018585 - protein, 9 aa, Homo Sapiens
HLQQERRFL

SEQ ID NO: 1018586 - protein, 9 aa, Homo Sapiens
NQELIRDHF

SEQ ID NO: 1018587 - protein, 9 aa, Homo Sapiens
QMFSPPSAA

SEQ ID NO: 1018588 - protein, 9 aa, Homo Sapiens
LQAPRTQAM

SEQ ID NO: 1018589 - protein, 9 aa, Homo Sapiens
DEEDDEEDF

SEQ ID NO: 1018590 - protein, 9 aa, Homo Sapiens
PITSSMSTI

SEQ ID NO: 1018591 - protein, 9 aa, Homo Sapiens
TPLDIYDSK

SEQ ID NO: 1018592 - protein, 9 aa, Homo Sapiens
LVKSGRFKA

SEQ ID NO: 1018593 - protein, 9 aa, Homo Sapiens
KKFYTLKVE

SEQ ID NO: 1018594 - protein, 9 aa, Homo Sapiens
FTYPSSLCR

SEQ ID NO: 1018595 - protein, 9 aa, Homo Sapiens
GNEESPFVN

SEQ ID NO: 1018596 - protein, 9 aa, Homo Sapiens
SGQEQGQVC

SEQ ID NO: 1018597 - protein, 9 aa, Homo Sapiens
NTLKCSAKN

SEQ ID NO: 1018598 - protein, 9 aa, Homo Sapiens
PPPKPHASL

SEQ ID NO: 1018599 - protein, 9 aa, Homo Sapiens
EKKEEKPEP

SEQ ID NO: 1018600 - protein, 9 aa, Homo Sapiens
SRMKDLNDF

SEQ ID NO: 1018601 - protein, 9 aa, Homo Sapiens
PQTLRKLGQ

SEQ ID NO: 1018602 - protein, 9 aa, Homo Sapiens
DEDDDENGE

SEQ ID NO: 1018603 - protein, 9 aa, Homo Sapiens
RPLNNMKQE

SEQ ID NO: 1018604 - protein, 9 aa, Homo Sapiens
LGLMRMRER

SEQ ID NO: 1018605 - protein, 9 aa, Homo Sapiens
SWLRNVLRK

SEQ ID NO: 1018606 - protein, 9 aa, Homo Sapiens
ILDAQTWLF

SEQ ID NO: 1018607 - protein, 9 aa, Homo Sapiens
PTLCLLLRL

SEQ ID NO: 1018608 - protein, 9 aa, Homo Sapiens
LLILLFYAF

SEQ ID NO: 1018609 - protein, 9 aa, Homo Sapiens
RLTFRNVAI

SEQ ID NO: 1018610 - protein, 9 aa, Homo Sapiens
GAGHTGTSE

SEQ ID NO: 1018611 - protein, 9 aa, Homo Sapiens
APSQDTDSL

SEQ ID NO: 1018612 - protein, 9 aa, Homo Sapiens
LATIKGMQE

SEQ ID NO: 1018613 - protein, 9 aa, Homo Sapiens
IGLPGTKAE

SEQ ID NO: 1018614 - protein, 9 aa, Homo Sapiens
DCLDPEKIL

SEQ ID NO: 1018615 - protein, 9 aa, Homo Sapiens
IPNRIFVEG

SEQ ID NO: 1018616 - protein, 9 aa, Homo Sapiens
QTLRKLGQL

SEQ ID NO: 1018617 - protein, 9 aa, Homo Sapiens
RKNKELFVH

SEQ ID NO: 1018618 - protein, 9 aa, Homo Sapiens
TDSRFISYT

SEQ ID NO: 1018619 - protein, 9 aa, Homo Sapiens
KDVSQKVTH

SEQ ID NO: 1018620 - protein, 9 aa, Homo Sapiens
VRAQKAAGG

SEQ ID NO: 1018621 - protein, 9 aa, Homo Sapiens
FLVMRSPHW

SEQ ID NO: 1018622 - protein, 9 aa, Homo Sapiens
AGSESPHSG

SEQ ID NO: 1018623 - protein, 9 aa, Homo Sapiens
AVLRVAATT

SEQ ID NO: 1018624 - protein, 9 aa, Homo Sapiens
HLHTRDRPY

SEQ ID NO: 1018625 - protein, 9 aa, Homo Sapiens
KKEFQPGSG

SEQ ID NO: 1018626 - protein, 9 aa, Homo Sapiens
HGYIEETCI

SEQ ID NO: 1018627 - protein, 9 aa, Homo Sapiens
PVQLGILNV

SEQ ID NO: 1018628 - protein, 9 aa, Homo Sapiens
ISPPPKPHA

SEQ ID NO: 1018629 - protein, 9 aa, Homo Sapiens
SGSYYCECY

SEQ ID NO: 1018630 - protein, 9 aa, Homo Sapiens
LCTPASLET

SEQ ID NO: 1018631 - protein, 9 aa, Homo Sapiens
RRDSFLGEG

SEQ ID NO: 1018632 - protein, 9 aa, Homo Sapiens
IFLPLSAIW

SEQ ID NO: 1018633 - protein, 9 aa, Homo Sapiens
GHQVKKVLI

SEQ ID NO: 1018634 - protein, 9 aa, Homo Sapiens
ARKQKSKLG

SEQ ID NO: 1018635 - protein, 9 aa, Homo Sapiens
NQPSSSSSG

SEQ ID NO: 1018636 - protein, 9 aa, Homo Sapiens
IKPLPYYSY

SEQ ID NO: 1018637 - protein, 9 aa, Homo Sapiens
QSESRSASR

SEQ ID NO: 1018638 - protein, 9 aa, Homo Sapiens
DENGEDVED

SEQ ID NO: 1018639 - protein, 9 aa, Homo Sapiens
ADEDAADEE

SEQ ID NO: 1018640 - protein, 9 aa, Homo Sapiens
KVIEFLSPY

SEQ ID NO: 1018641 - protein, 9 aa, Homo Sapiens
QQERRFLEP

SEQ ID NO: 1018642 - protein, 9 aa, Homo Sapiens
PESLRNGCV

SEQ ID NO: 1018643 - protein, 9 aa, Homo Sapiens
EYVQPVQLG

SEQ ID NO: 1018644 - protein, 9 aa, Homo Sapiens
VLQATRTFY

SEQ ID NO: 1018645 - protein, 9 aa, Homo Sapiens
MGELSGTTT

SEQ ID NO: 1018646 - protein, 9 aa, Homo Sapiens
PDPSTSSRL

SEQ ID NO: 1018647 - protein, 9 aa, Homo Sapiens
EDWMESFFL

SEQ ID NO: 1018648 - protein, 9 aa, Homo Sapiens
GSKEYKVVM

SEQ ID NO: 1018649 - protein, 9 aa, Homo Sapiens
PTLEWDNYN

SEQ ID NO: 1018650 - protein, 9 aa, Homo Sapiens
SGRFKAERD

SEQ ID NO: 1018651 - protein, 9 aa, Homo Sapiens
LVYLLCQNQ

SEQ ID NO: 1018652 - protein, 9 aa, Homo Sapiens
CQRYMVSTG

SEQ ID NO: 1018653 - protein, 9 aa, Homo Sapiens
AKGCQRYMV

SEQ ID NO: 1018654 - protein, 9 aa, Homo Sapiens
KYEFSENEQ

SEQ ID NO: 1018655 - protein, 9 aa, Homo Sapiens
IKKFDTKAS

SEQ ID NO: 1018656 - protein, 9 aa, Homo Sapiens
LYFDAFTSP

SEQ ID NO: 1018657 - protein, 9 aa, Homo Sapiens
SPHSGRRTP

SEQ ID NO: 1018658 - protein, 9 aa, Homo Sapiens
FSYSLNEAP

SEQ ID NO: 1018659 - protein, 9 aa, Homo Sapiens
AYLIVQVMG

SEQ ID NO: 1018660 - protein, 9 aa, Homo Sapiens
MATEALVNI

SEQ ID NO: 1018661 - protein, 9 aa, Homo Sapiens
CPQVECWTP

SEQ ID NO: 1018662 - protein, 9 aa, Homo Sapiens
SRYLGVIEL

SEQ ID NO: 1018663 - protein, 9 aa, Homo Sapiens
SRENSLFFR

SEQ ID NO: 1018664 - protein, 9 aa, Homo Sapiens
HLDHDPEKL

SEQ ID NO: 1018665 - protein, 9 aa, Homo Sapiens
ARQGWAVGT

SEQ ID NO: 1018666 - protein, 9 aa, Homo Sapiens
PSRPIVPLF

SEQ ID NO: 1018667 - protein, 9 aa, Homo Sapiens
FTTACVCKC

SEQ ID NO: 1018668 - protein, 9 aa, Homo Sapiens
CPAVLSKKT

SEQ ID NO: 1018669 - protein, 9 aa, Homo Sapiens
FLVLIEILQ

SEQ ID NO: 1018670 - protein, 9 aa, Homo Sapiens
GYTMKLNGS

SEQ ID NO: 1018671 - protein, 9 aa, Homo Sapiens
LQEALVLQE

SEQ ID NO: 1018672 - protein, 9 aa, Homo Sapiens
EGKYEFSDK

SEQ ID NO: 1018673 - protein, 9 aa, Homo Sapiens
PEKTSEEKC

SEQ ID NO: 1018674 - protein, 9 aa, Homo Sapiens
STLLQSHSS

SEQ ID NO: 1018675 - protein, 9 aa, Homo Sapiens
LILLFYAFI

SEQ ID NO: 1018676 - protein, 9 aa, Homo Sapiens
RRATMAMKD

SEQ ID NO: 1018677 - protein, 9 aa, Homo Sapiens
PMEANSDES

SEQ ID NO: 1018678 - protein, 9 aa, Homo Sapiens
PKPPQLQEK

SEQ ID NO: 1018679 - protein, 9 aa, Homo Sapiens
SNRLSLKGY

SEQ ID NO: 1018680 - protein, 9 aa, Homo Sapiens
TSTLLQSHS

SEQ ID NO: 1018681 - protein, 9 aa, Homo Sapiens
TTFPISDKP

SEQ ID NO: 1018682 - protein, 9 aa, Homo Sapiens
GLCDPPPHN

SEQ ID NO: 1018683 - protein, 9 aa, Homo Sapiens
LPNGLGESP

SEQ ID NO: 1018684 - protein, 9 aa, Homo Sapiens
LTFDREIQQ

SEQ ID NO: 1018685 - protein, 9 aa, Homo Sapiens
NEKVIEFLS

SEQ ID NO: 1018686 - protein, 9 aa, Homo Sapiens
PLHEFMALE

SEQ ID NO: 1018687 - protein, 9 aa, Homo Sapiens
YLFSLGSEF

SEQ ID NO: 1018688 - protein, 9 aa, Homo Sapiens
KVASGEEPA

SEQ ID NO: 1018689 - protein, 9 aa, Homo Sapiens
SSMSTIRQY

SEQ ID NO: 1018690 - protein, 9 aa, Homo Sapiens
NLNTELVTF

SEQ ID NO: 1018691 - protein, 9 aa, Homo Sapiens
WLRCYYYKD

SEQ ID NO: 1018692 - protein, 9 aa, Homo Sapiens
HASPNKSAY

SEQ ID NO: 1018693 - protein, 9 aa, Homo Sapiens
STSCEVRPG

SEQ ID NO: 1018694 - protein, 9 aa, Homo Sapiens
FLKNPEALA

SEQ ID NO: 1018695 - protein, 9 aa, Homo Sapiens
YYPPSIGFS

SEQ ID NO: 1018696 - protein, 9 aa, Homo Sapiens
QLTWLEDHS

SEQ ID NO: 1018697 - protein, 9 aa, Homo Sapiens
ILFRAGVLA

SEQ ID NO: 1018698 - protein, 9 aa, Homo Sapiens
PGYEYDPGP

SEQ ID NO: 1018699 - protein, 9 aa, Homo Sapiens
LADRPLIAI

SEQ ID NO: 1018700 - protein, 9 aa, Homo Sapiens
DELKDAKKD

SEQ ID NO: 1018701 - protein, 9 aa, Homo Sapiens
FLPPARKQK

SEQ ID NO: 1018702 - protein, 9 aa, Homo Sapiens
SGPALTSDS

SEQ ID NO: 1018703 - protein, 9 aa, Homo Sapiens
LLFGRLVVR

SEQ ID NO: 1018704 - protein, 9 aa, Homo Sapiens
KKQKVQRRE

SEQ ID NO: 1018705 - protein, 9 aa, Homo Sapiens
NRMQKFPCY

SEQ ID NO: 1018706 - protein, 9 aa, Homo Sapiens
ICIFPDKTT

SEQ ID NO: 1018707 - protein, 9 aa, Homo Sapiens
RGGNMCSER

SEQ ID NO: 1018708 - protein, 9 aa, Homo Sapiens
GVVGTFSKP

SEQ ID NO: 1018709 - protein, 9 aa, Homo Sapiens
FFLCFTSCS

SEQ ID NO: 1018710 - protein, 9 aa, Homo Sapiens
ASAVTVGLK

SEQ ID NO: 1018711 - protein, 9 aa, Homo Sapiens
MVPTSAAEA

SEQ ID NO: 1018712 - protein, 9 aa, Homo Sapiens
IKSRYLEDT

SEQ ID NO: 1018713 - protein, 9 aa, Homo Sapiens
MSIVAVSYE

SEQ ID NO: 1018714 - protein, 9 aa, Homo Sapiens
PMAKGCQRY

SEQ ID NO: 1018715 - protein, 9 aa, Homo Sapiens
FSRSLRKNK

SEQ ID NO: 1018716 - protein, 9 aa, Homo Sapiens
GDFGLATMK

SEQ ID NO: 1018717 - protein, 9 aa, Homo Sapiens
AVKHSRPRR

SEQ ID NO: 1018718 - protein, 9 aa, Homo Sapiens
FHLLFFFMY

SEQ ID NO: 1018719 - protein, 9 aa, Homo Sapiens
MACMIIWVL

SEQ ID NO: 1018720 - protein, 9 aa, Homo Sapiens
DEDADEDGI

SEQ ID NO: 1018721 - protein, 9 aa, Homo Sapiens
EDEGFIKKE

SEQ ID NO: 1018722 - protein, 9 aa, Homo Sapiens
GPTTFDIYK

SEQ ID NO: 1018723 - protein, 9 aa, Homo Sapiens
NRLSLKGYG

SEQ ID NO: 1018724 - protein, 9 aa, Homo Sapiens
GVILPNGLG

SEQ ID NO: 1018725 - protein, 9 aa, Homo Sapiens
REIQQALRE

SEQ ID NO: 1018726 - protein, 9 aa, Homo Sapiens
RGARMGVPQ

SEQ ID NO: 1018727 - protein, 9 aa, Homo Sapiens
SADQQEEGQ

SEQ ID NO: 1018728 - protein, 9 aa, Homo Sapiens
VGYMKHLDH

SEQ ID NO: 1018729 - protein, 9 aa, Homo Sapiens
RVGQSKILF

SEQ ID NO: 1018730 - protein, 9 aa, Homo Sapiens
CRLFFEIGS

SEQ ID NO: 1018731 - protein, 9 aa, Homo Sapiens
RAQKAAGGS

SEQ ID NO: 1018732 - protein, 9 aa, Homo Sapiens
IIGNVLIVV

SEQ ID NO: 1018733 - protein, 9 aa, Homo Sapiens
CVCKCPQNI

SEQ ID NO: 1018734 - protein, 9 aa, Homo Sapiens
LSRRNALYE

SEQ ID NO: 1018735 - protein, 9 aa, Homo Sapiens
PLCSGQEQG

SEQ ID NO: 1018736 - protein, 9 aa, Homo Sapiens
GYLATIKGM

SEQ ID NO: 1018737 - protein, 9 aa, Homo Sapiens
FKVEALSTE

SEQ ID NO: 1018738 - protein, 9 aa, Homo Sapiens
NVAQRCLYR

SEQ ID NO: 1018739 - protein, 9 aa, Homo Sapiens
LHKKKLEQG

SEQ ID NO: 1018740 - protein, 9 aa, Homo Sapiens
LKRGDPDWP

SEQ ID NO: 1018741 - protein, 9 aa, Homo Sapiens
LDAILILFF

SEQ ID NO: 1018742 - protein, 9 aa, Homo Sapiens
KKLQGISQI

SEQ ID NO: 1018743 - protein, 9 aa, Homo Sapiens
LLQEALVLQ

SEQ ID NO: 1018744 - protein, 9 aa, Homo Sapiens
GFLHETVLD

SEQ ID NO: 1018745 - protein, 9 aa, Homo Sapiens
TKPKLIFTL

SEQ ID NO: 1018746 - protein, 9 aa, Homo Sapiens
AEFTRSNRL

SEQ ID NO: 1018747 - protein, 9 aa, Homo Sapiens
TWLFQATDH

SEQ ID NO: 1018748 - protein, 9 aa, Homo Sapiens
DELYLGNSM

SEQ ID NO: 1018749 - protein, 9 aa, Homo Sapiens
EEIYNVPGI

SEQ ID NO: 1018750 - protein, 9 aa, Homo Sapiens
GLQTPATLE

SEQ ID NO: 1018751 - protein, 9 aa, Homo Sapiens
FKDDKSECS

SEQ ID NO: 1018752 - protein, 9 aa, Homo Sapiens
NATVMNKTR

SEQ ID NO: 1018753 - protein, 9 aa, Homo Sapiens
KDDKSECSC

SEQ ID NO: 1018754 - protein, 9 aa, Homo Sapiens
IMDEEHSGL

SEQ ID NO: 1018755 - protein, 9 aa, Homo Sapiens
SSSGRKQKA

SEQ ID NO: 1018756 - protein, 9 aa, Homo Sapiens
NDKPKVWFA

SEQ ID NO: 1018757 - protein, 9 aa, Homo Sapiens
HSGRRTPGN

SEQ ID NO: 1018758 - protein, 9 aa, Homo Sapiens
RTEKDVSQK

SEQ ID NO: 1018759 - protein, 9 aa, Homo Sapiens
ISDPRLHFL

SEQ ID NO: 1018760 - protein, 9 aa, Homo Sapiens
DAILILFFY

SEQ ID NO: 1018761 - protein, 9 aa, Homo Sapiens
LIAIFQLIQ

SEQ ID NO: 1018762 - protein, 9 aa, Homo Sapiens
FCSPSRKKR

SEQ ID NO: 1018763 - protein, 9 aa, Homo Sapiens
EMIFKKLQG

SEQ ID NO: 1018764 - protein, 9 aa, Homo Sapiens
QISPPPKPH

SEQ ID NO: 1018765 - protein, 9 aa, Homo Sapiens
RRICSINKL

SEQ ID NO: 1018766 - protein, 9 aa, Homo Sapiens
RIFVEGIDF

SEQ ID NO: 1018767 - protein, 9 aa, Homo Sapiens
QPGYTMKLN

SEQ ID NO: 1018768 - protein, 9 aa, Homo Sapiens
KSRYLEDTD

SEQ ID NO: 1018769 - protein, 9 aa, Homo Sapiens
FLANALLEI

SEQ ID NO: 1018770 - protein, 9 aa, Homo Sapiens
KDFVLKIYT

SEQ ID NO: 1018771 - protein, 9 aa, Homo Sapiens
RDLASAENL

SEQ ID NO: 1018772 - protein, 9 aa, Homo Sapiens
RPGRLTSTL

SEQ ID NO: 1018773 - protein, 9 aa, Homo Sapiens
KKISGSSVV

SEQ ID NO: 1018774 - protein, 9 aa, Homo Sapiens
DPEKTSEEK

SEQ ID NO: 1018775 - protein, 9 aa, Homo Sapiens
SESLKIIFG

SEQ ID NO: 1018776 - protein, 9 aa, Homo Sapiens
TINEKVIEF

SEQ ID NO: 1018777 - protein, 9 aa, Homo Sapiens
AYNVFVITI

SEQ ID NO: 1018778 - protein, 9 aa, Homo Sapiens
LILFFYILI

SEQ ID NO: 1018779 - protein, 9 aa, Homo Sapiens
RYNFSQENI

SEQ ID NO: 1018780 - protein, 9 aa, Homo Sapiens
FVEREANEF

SEQ ID NO: 1018781 - protein, 9 aa, Homo Sapiens
RATMAMKDS

SEQ ID NO: 1018782 - protein, 9 aa, Homo Sapiens
ATLESQNDF

SEQ ID NO: 1018783 - protein, 9 aa, Homo Sapiens
AYQDGFGRL

SEQ ID NO: 1018784 - protein, 9 aa, Homo Sapiens
EPQGIGKTT

SEQ ID NO: 1018785 - protein, 9 aa, Homo Sapiens
KVVQKLQAP

SEQ ID NO: 1018786 - protein, 9 aa, Homo Sapiens
SPMARGLFH

SEQ ID NO: 1018787 - protein, 9 aa, Homo Sapiens
GAKPSTAPA

SEQ ID NO: 1018788 - protein, 9 aa, Homo Sapiens
PSSSSSGLL

SEQ ID NO: 1018789 - protein, 9 aa, Homo Sapiens
RYSCCHSSC

SEQ ID NO: 1018790 - protein, 9 aa, Homo Sapiens
SATAQKIIK

SEQ ID NO: 1018791 - protein, 9 aa, Homo Sapiens
WTGRPISWV

SEQ ID NO: 1018792 - protein, 9 aa, Homo Sapiens
LASIQKLLS

SEQ ID NO: 1018793 - protein, 9 aa, Homo Sapiens
VSQKVTHRR

SEQ ID NO: 1018794 - protein, 9 aa, Homo Sapiens
QQNVRGIKK

SEQ ID NO: 1018795 - protein, 9 aa, Homo Sapiens
HIDWDSREK

SEQ ID NO: 1018796 - protein, 9 aa, Homo Sapiens
TGSLLSAEF

SEQ ID NO: 1018797 - protein, 9 aa, Homo Sapiens
LNVAQRCLY

SEQ ID NO: 1018798 - protein, 9 aa, Homo Sapiens
FLKDDANLQ

SEQ ID NO: 1018799 - protein, 9 aa, Homo Sapiens
FFEIGSISL

SEQ ID NO: 1018800 - protein, 9 aa, Homo Sapiens
SIQESVKDQ

SEQ ID NO: 1018801 - protein, 9 aa, Homo Sapiens
SIQKLLSPQ

SEQ ID NO: 1018802 - protein, 9 aa, Homo Sapiens
CSERIEIKF

SEQ ID NO: 1018803 - protein, 9 aa, Homo Sapiens
NGLDSEPLP

SEQ ID NO: 1018804 - protein, 9 aa, Homo Sapiens
DILGDTSGD

SEQ ID NO: 1018805 - protein, 9 aa, Homo Sapiens
VSEVCVSTT

SEQ ID NO: 1018806 - protein, 9 aa, Homo Sapiens
LYKKKKPKK

SEQ ID NO: 1018807 - protein, 9 aa, Homo Sapiens
YVQPVQLGI

SEQ ID NO: 1018808 - protein, 9 aa, Homo Sapiens
DPDWPEDQV

SEQ ID NO: 1018809 - protein, 9 aa, Homo Sapiens
TACVCKCPQ

SEQ ID NO: 1018810 - protein, 9 aa, Homo Sapiens
LFRAGVLAQ

SEQ ID NO: 1018811 - protein, 9 aa, Homo Sapiens
GPNFCVGKK

SEQ ID NO: 1018812 - protein, 9 aa, Homo Sapiens
LQATRTFYT

SEQ ID NO: 1018813 - protein, 9 aa, Homo Sapiens
VKPESSEGE

SEQ ID NO: 1018814 - protein, 9 aa, Homo Sapiens
GVFLKDDAN

SEQ ID NO: 1018815 - protein, 9 aa, Homo Sapiens
MARGLFHKA

SEQ ID NO: 1018816 - protein, 9 aa, Homo Sapiens
KSECSCPEE

SEQ ID NO: 1018817 - protein, 9 aa, Homo Sapiens
KKWKMSGKA

SEQ ID NO: 1018818 - protein, 9 aa, Homo Sapiens
SSHCPQVEC

SEQ ID NO: 1018819 - protein, 9 aa, Homo Sapiens
YFQKITLYL

SEQ ID NO: 1018820 - protein, 9 aa, Homo Sapiens
SCLSICIFP

SEQ ID NO: 1018821 - protein, 9 aa, Homo Sapiens
GRNTLTRPS

SEQ ID NO: 1018822 - protein, 9 aa, Homo Sapiens
QGVVGTFSK

SEQ ID NO: 1018823 - protein, 9 aa, Homo Sapiens
LESSSAQAA

SEQ ID NO: 1018824 - protein, 9 aa, Homo Sapiens
IVQVMGELF

SEQ ID NO: 1018825 - protein, 9 aa, Homo Sapiens
TNWHLPQMF

SEQ ID NO: 1018826 - protein, 9 aa, Homo Sapiens
ADLGLPEDN

SEQ ID NO: 1018827 - protein, 9 aa, Homo Sapiens
ATGEEIYNV

SEQ ID NO: 1018828 - protein, 9 aa, Homo Sapiens
MSKKISGSS

SEQ ID NO: 1018829 - protein, 9 aa, Homo Sapiens
FFVPACSLV

SEQ ID NO: 1018830 - protein, 9 aa, Homo Sapiens
SLASIQKLL

SEQ ID NO: 1018831 - protein, 9 aa, Homo Sapiens
YGRLNSEEG

SEQ ID NO: 1018832 - protein, 9 aa, Homo Sapiens
HSSILRAEG

SEQ ID NO: 1018833 - protein, 9 aa, Homo Sapiens
LVLIEILQK

SEQ ID NO: 1018834 - protein, 9 aa, Homo Sapiens
MWVPVVFLI

SEQ ID NO: 1018835 - protein, 9 aa, Homo Sapiens
CNTRQNESW

SEQ ID NO: 1018836 - protein, 9 aa, Homo Sapiens
FPDPMPYEP

SEQ ID NO: 1018837 - protein, 9 aa, Homo Sapiens
YDADIESKN

SEQ ID NO: 1018838 - protein, 9 aa, Homo Sapiens
ENLNTELVT

SEQ ID NO: 1018839 - protein, 9 aa, Homo Sapiens
HSFYMPLNP

SEQ ID NO: 1018840 - protein, 9 aa, Homo Sapiens
TGLVCTKAF

SEQ ID NO: 1018841 - protein, 9 aa, Homo Sapiens
AREDVFLAN

SEQ ID NO: 1018842 - protein, 9 aa, Homo Sapiens
GKKIPSFFT

SEQ ID NO: 1018843 - protein, 9 aa, Homo Sapiens
PNNGEQKVP

SEQ ID NO: 1018844 - protein, 9 aa, Homo Sapiens
LNLMKKLNE

SEQ ID NO: 1018845 - protein, 9 aa, Homo Sapiens
TQKDAQSVY

SEQ ID NO: 1018846 - protein, 9 aa, Homo Sapiens
QSALAYALQ

SEQ ID NO: 1018847 - protein, 9 aa, Homo Sapiens
WLFQATDHT

SEQ ID NO: 1018848 - protein, 9 aa, Homo Sapiens
VVQKLQAPR

SEQ ID NO: 1018849 - protein, 9 aa, Homo Sapiens
SVFFPDPMP

SEQ ID NO: 1018850 - protein, 9 aa, Homo Sapiens
LGDTSGDYR

SEQ ID NO: 1018851 - protein, 9 aa, Homo Sapiens
QGGNEESPF

SEQ ID NO: 1018852 - protein, 9 aa, Homo Sapiens
CGFDGEKGD

SEQ ID NO: 1018853 - protein, 9 aa, Homo Sapiens
TKVFKYEFS

SEQ ID NO: 1018854 - protein, 9 aa, Homo Sapiens
PGRLTSTLL

SEQ ID NO: 1018855 - protein, 9 aa, Homo Sapiens
IVHRDSSLA

SEQ ID NO: 1018856 - protein, 9 aa, Homo Sapiens
GGEERGARM

SEQ ID NO: 1018857 - protein, 9 aa, Homo Sapiens
DIYDSKDYS

SEQ ID NO: 1018858 - protein, 9 aa, Homo Sapiens
KDPNKPQKP

SEQ ID NO: 1018859 - protein, 9 aa, Homo Sapiens
AVSYELIAT

SEQ ID NO: 1018860 - protein, 9 aa, Homo Sapiens
QPWADPEKT

SEQ ID NO: 1018861 - protein, 9 aa, Homo Sapiens
DEDAADEEG

SEQ ID NO: 1018862 - protein, 9 aa, Homo Sapiens
VIYINAIIG

SEQ ID NO: 1018863 - protein, 9 aa, Homo Sapiens
DADEDGILN

SEQ ID NO: 1018864 - protein, 9 aa, Homo Sapiens
RMGVPQGRI

SEQ ID NO: 1018865 - protein, 9 aa, Homo Sapiens
QGQVCCSAD

SEQ ID NO: 1018866 - protein, 9 aa, Homo Sapiens
PPQLQEKKE

SEQ ID NO: 1018867 - protein, 9 aa, Homo Sapiens
GLDSEPLPL

SEQ ID NO: 1018868 - protein, 9 aa, Homo Sapiens
LEWDNYNLR

SEQ ID NO: 1018869 - protein, 9 aa, Homo Sapiens
LQNMKRTER

SEQ ID NO: 1018870 - protein, 9 aa, Homo Sapiens
VTRHVIEVS

SEQ ID NO: 1018871 - protein, 9 aa, Homo Sapiens
PLREFLHKV

SEQ ID NO: 1018872 - protein, 9 aa, Homo Sapiens
REIQISPPP

SEQ ID NO: 1018873 - protein, 9 aa, Homo Sapiens
LGSEFPKGA

SEQ ID NO: 1018874 - protein, 9 aa, Homo Sapiens
GQMGELSGT

SEQ ID NO: 1018875 - protein, 9 aa, Homo Sapiens
TVAKKITRE

SEQ ID NO: 1018876 - protein, 9 aa, Homo Sapiens
TEENFTKEA

SEQ ID NO: 1018877 - protein, 9 aa, Homo Sapiens
LFESDLDQI

SEQ ID NO: 1018878 - protein, 9 aa, Homo Sapiens
RMQKFPCYI

SEQ ID NO: 1018879 - protein, 9 aa, Homo Sapiens
LPAPHLLFG

SEQ ID NO: 1018880 - protein, 9 aa, Homo Sapiens
PSILCPPPP

SEQ ID NO: 1018881 - protein, 9 aa, Homo Sapiens
RKQKSKLGN

SEQ ID NO: 1018882 - protein, 9 aa, Homo Sapiens
PESKGEPGD

SEQ ID NO: 1018883 - protein, 9 aa, Homo Sapiens
NEFRRGRST

SEQ ID NO: 1018884 - protein, 9 aa, Homo Sapiens
AWTDRGMEF

SEQ ID NO: 1018885 - protein, 9 aa, Homo Sapiens
SPPKEFLLE

SEQ ID NO: 1018886 - protein, 9 aa, Homo Sapiens
AGHTGTSED

SEQ ID NO: 1018887 - protein, 9 aa, Homo Sapiens
DTQLWIFFP

SEQ ID NO: 1018888 - protein, 9 aa, Homo Sapiens
IAGQFRGGP

SEQ ID NO: 1018889 - protein, 9 aa, Homo Sapiens
VGYCFTKPK

SEQ ID NO: 1018890 - protein, 9 aa, Homo Sapiens
VAASLCLCS

SEQ ID NO: 1018891 - protein, 9 aa, Homo Sapiens
PNLVPDLYF

SEQ ID NO: 1018892 - protein, 9 aa, Homo Sapiens
YKDGVFLKD

SEQ ID NO: 1018893 - protein, 9 aa, Homo Sapiens
HNRYVLGMR

SEQ ID NO: 1018894 - protein, 9 aa, Homo Sapiens
QLGILNVFR

SEQ ID NO: 1018895 - protein, 9 aa, Homo Sapiens
PWISTSCEV

SEQ ID NO: 1018896 - protein, 9 aa, Homo Sapiens
TKMSENLNT

SEQ ID NO: 1018897 - protein, 9 aa, Homo Sapiens
LLEWNVWGS

SEQ ID NO: 1018898 - protein, 9 aa, Homo Sapiens
TKAEKGRPG

SEQ ID NO: 1018899 - protein, 9 aa, Homo Sapiens
DEGFIKKEE

SEQ ID NO: 1018900 - protein, 9 aa, Homo Sapiens
GLRPMALRP

SEQ ID NO: 1018901 - protein, 9 aa, Homo Sapiens
PAQAHWASE

SEQ ID NO: 1018902 - protein, 9 aa, Homo Sapiens
TETKENVIC

SEQ ID NO: 1018903 - protein, 9 aa, Homo Sapiens
ESDLDQIME

SEQ ID NO: 1018904 - protein, 9 aa, Homo Sapiens
SDASRGQSE

SEQ ID NO: 1018905 - protein, 9 aa, Homo Sapiens
SLLNVAQRC

SEQ ID NO: 1018906 - protein, 9 aa, Homo Sapiens
DPEKILRKI

SEQ ID NO: 1018907 - protein, 9 aa, Homo Sapiens
LIGLPGTKA

SEQ ID NO: 1018908 - protein, 9 aa, Homo Sapiens
ELFFHLQQE

SEQ ID NO: 1018909 - protein, 9 aa, Homo Sapiens
PSSYVQARN

SEQ ID NO: 1018910 - protein, 9 aa, Homo Sapiens
GARMGVPQG

SEQ ID NO: 1018911 - protein, 9 aa, Homo Sapiens
GTHSSFANG

SEQ ID NO: 1018912 - protein, 9 aa, Homo Sapiens
QSKILFRAG

SEQ ID NO: 1018913 - protein, 9 aa, Homo Sapiens
VILINSPME

SEQ ID NO: 1018914 - protein, 9 aa, Homo Sapiens
GEERGARMG

SEQ ID NO: 1018915 - protein, 9 aa, Homo Sapiens
SAYLIVQVM

SEQ ID NO: 1018916 - protein, 9 aa, Homo Sapiens
DRPPGSMVP

SEQ ID NO: 1018917 - protein, 9 aa, Homo Sapiens
FLFTISASY

SEQ ID NO: 1018918 - protein, 9 aa, Homo Sapiens
ALYERAMRR

SEQ ID NO: 1018919 - protein, 9 aa, Homo Sapiens
CCSADQQEE

SEQ ID NO: 1018920 - protein, 9 aa, Homo Sapiens
FVYKLGEQF

SEQ ID NO: 1018921 - protein, 9 aa, Homo Sapiens
GSAGSRGDG

SEQ ID NO: 1018922 - protein, 9 aa, Homo Sapiens
SDKDWAHIS

SEQ ID NO: 1018923 - protein, 9 aa, Homo Sapiens
FHRVTKEGS

SEQ ID NO: 1018924 - protein, 9 aa, Homo Sapiens
SQPQPGHAN

SEQ ID NO: 1018925 - protein, 9 aa, Homo Sapiens
GLQRDPGIP

SEQ ID NO: 1018926 - protein, 9 aa, Homo Sapiens
GKSLYHDIL

SEQ ID NO: 1018927 - protein, 9 aa, Homo Sapiens
KILKHWTGG

SEQ ID NO: 1018928 - protein, 9 aa, Homo Sapiens
YERAMRRRA

SEQ ID NO: 1018929 - protein, 9 aa, Homo Sapiens
AGALCENPE

SEQ ID NO: 1018930 - protein, 9 aa, Homo Sapiens
IIFGIDVKE

SEQ ID NO: 1018931 - protein, 9 aa, Homo Sapiens
YANLAKAAS

SEQ ID NO: 1018932 - protein, 9 aa, Homo Sapiens
HWASERLDI

SEQ ID NO: 1018933 - protein, 9 aa, Homo Sapiens
PLDIYDSKD

SEQ ID NO: 1018934 - protein, 9 aa, Homo Sapiens
VVGINITDL

SEQ ID NO: 1018935 - protein, 9 aa, Homo Sapiens
PQLQEKKEE

SEQ ID NO: 1018936 - protein, 9 aa, Homo Sapiens
AAEEEDDSD

SEQ ID NO: 1018937 - protein, 9 aa, Homo Sapiens
HKVLHVSLS

SEQ ID NO: 1018938 - protein, 9 aa, Homo Sapiens
KIIKSQAIA

SEQ ID NO: 1018939 - protein, 9 aa, Homo Sapiens
EGIDFKTNE

SEQ ID NO: 1018940 - protein, 9 aa, Homo Sapiens
TIKGMQEAS

SEQ ID NO: 1018941 - protein, 9 aa, Homo Sapiens
LTLNDSSVI

SEQ ID NO: 1018942 - protein, 9 aa, Homo Sapiens
KVSLFVHVL

SEQ ID NO: 1018943 - protein, 9 aa, Homo Sapiens
VYKLGEQFF

SEQ ID NO: 1018944 - protein, 9 aa, Homo Sapiens
GRLSLYVQR

SEQ ID NO: 1018945 - protein, 9 aa, Homo Sapiens
AATTGVPGQ

SEQ ID NO: 1018946 - protein, 9 aa, Homo Sapiens
MVFLFTISA

SEQ ID NO: 1018947 - protein, 9 aa, Homo Sapiens
FSPMAKGCQ

SEQ ID NO: 1018948 - protein, 9 aa, Homo Sapiens
ILINSPMEA

SEQ ID NO: 1018949 - protein, 9 aa, Homo Sapiens
IKLGFHLLF

SEQ ID NO: 1018950 - protein, 9 aa, Homo Sapiens
SENLNTELV

SEQ ID NO: 1018951 - protein, 9 aa, Homo Sapiens
DVMEMIFKK

SEQ ID NO: 1018952 - protein, 9 aa, Homo Sapiens
FESDLDQIM

SEQ ID NO: 1018953 - protein, 9 aa, Homo Sapiens
DIYKFHFSD

SEQ ID NO: 1018954 - protein, 9 aa, Homo Sapiens
LFSLGSEFP

SEQ ID NO: 1018955 - protein, 9 aa, Homo Sapiens
LIAGQFRGG

SEQ ID NO: 1018956 - protein, 9 aa, Homo Sapiens
PSSATCDTC

SEQ ID NO: 1018957 - protein, 9 aa, Homo Sapiens
MSRENSLFF

SEQ ID NO: 1018958 - protein, 9 aa, Homo Sapiens
PIVPLFSRS

SEQ ID NO: 1018959 - protein, 9 aa, Homo Sapiens
DAMRHTIVL

SEQ ID NO: 1018960 - protein, 9 aa, Homo Sapiens
QQMRTSQKN

SEQ ID NO: 1018961 - protein, 9 aa, Homo Sapiens
SQENIHCSD

SEQ ID NO: 1018962 - protein, 9 aa, Homo Sapiens
LRKEPPHCP

SEQ ID NO: 1018963 - protein, 9 aa, Homo Sapiens
YCRGLPNPQ

SEQ ID NO: 1018964 - protein, 9 aa, Homo Sapiens
QDYGLCDPP

SEQ ID NO: 1018965 - protein, 9 aa, Homo Sapiens
MRSQVCIKL

SEQ ID NO: 1018966 - protein, 9 aa, Homo Sapiens
FQQPPNISQ

SEQ ID NO: 1018967 - protein, 9 aa, Homo Sapiens
SATCDTCHF

SEQ ID NO: 1018968 - protein, 9 aa, Homo Sapiens
PARKQKSKL

SEQ ID NO: 1018969 - protein, 9 aa, Homo Sapiens
YIMDEEHSG

SEQ ID NO: 1018970 - protein, 9 aa, Homo Sapiens
GSASGGSKE

SEQ ID NO: 1018971 - protein, 9 aa, Homo Sapiens
EENFTKEAS

SEQ ID NO: 1018972 - protein, 9 aa, Homo Sapiens
TPAPFKVEA

SEQ ID NO: 1018973 - protein, 9 aa, Homo Sapiens
QDGFGRLTG

SEQ ID NO: 1018974 - protein, 9 aa, Homo Sapiens
SSTVVQEFS

SEQ ID NO: 1018975 - protein, 9 aa, Homo Sapiens
RKMSSSGRK

SEQ ID NO: 1018976 - protein, 9 aa, Homo Sapiens
PQGRLTFRN

SEQ ID NO: 1018977 - protein, 9 aa, Homo Sapiens
EQGQVCCSA

SEQ ID NO: 1018978 - protein, 9 aa, Homo Sapiens
SPRDLAVLL

SEQ ID NO: 1018979 - protein, 9 aa, Homo Sapiens
LILFFSTIF

SEQ ID NO: 1018980 - protein, 9 aa, Homo Sapiens
GRQTVAAAV

SEQ ID NO: 1018981 - protein, 9 aa, Homo Sapiens
TLLQSHSSV

SEQ ID NO: 1018982 - protein, 9 aa, Homo Sapiens
EDNLVLPDD

SEQ ID NO: 1018983 - protein, 9 aa, Homo Sapiens
PGKSQKIKS

SEQ ID NO: 1018984 - protein, 9 aa, Homo Sapiens
GELLASFKL

SEQ ID NO: 1018985 - protein, 9 aa, Homo Sapiens
KALNKIDAG

SEQ ID NO: 1018986 - protein, 9 aa, Homo Sapiens
WTDRGMEFK

SEQ ID NO: 1018987 - protein, 9 aa, Homo Sapiens
AQRIQEIKR

SEQ ID NO: 1018988 - protein, 9 aa, Homo Sapiens
KKRGADFGE

SEQ ID NO: 1018989 - protein, 9 aa, Homo Sapiens
FGLATMKSR

SEQ ID NO: 1018990 - protein, 9 aa, Homo Sapiens
KKKDPNKPQ

SEQ ID NO: 1018991 - protein, 9 aa, Homo Sapiens
FQPGSGAVE

SEQ ID NO: 1018992 - protein, 9 aa, Homo Sapiens
PSQDTDSLL

SEQ ID NO: 1018993 - protein, 9 aa, Homo Sapiens
QPQTLRKLG

SEQ ID NO: 1018994 - protein, 9 aa, Homo Sapiens
YNVPGIRHV

SEQ ID NO: 1018995 - protein, 9 aa, Homo Sapiens
KSGRRAQIP

SEQ ID NO: 1018996 - protein, 9 aa, Homo Sapiens
EETLGGREK

SEQ ID NO: 1018997 - protein, 9 aa, Homo Sapiens
GFVRPDLII

SEQ ID NO: 1018998 - protein, 9 aa, Homo Sapiens
YGLCDPPPH

SEQ ID NO: 1018999 - protein, 9 aa, Homo Sapiens
GILHKKKLE

SEQ ID NO: 1019000 - protein, 9 aa, Homo Sapiens
SASGGSKEY

SEQ ID NO: 1019001 - protein, 9 aa, Homo Sapiens
GDGDMFKKL

SEQ ID NO: 1019002 - protein, 9 aa, Homo Sapiens
QFSPMAKGC

SEQ ID NO: 1019003 - protein, 9 aa, Homo Sapiens
LKVIQNDKL

SEQ ID NO: 1019004 - protein, 9 aa, Homo Sapiens
PGSMVPTSA

SEQ ID NO: 1019005 - protein, 9 aa, Homo Sapiens
VEENTLKCS

SEQ ID NO: 1019006 - protein, 9 aa, Homo Sapiens
ACARHDAPT

SEQ ID NO: 1019007 - protein, 9 aa, Homo Sapiens
DIYHSPFWE

SEQ ID NO: 1019008 - protein, 9 aa, Homo Sapiens
LDHDPEKLT

SEQ ID NO: 1019009 - protein, 9 aa, Homo Sapiens
MGRNTLTRP

SEQ ID NO: 1019010 - protein, 9 aa, Homo Sapiens
LRDKKWKMS

SEQ ID NO: 1019011 - protein, 9 aa, Homo Sapiens
PDTLSQPQP

SEQ ID NO: 1019012 - protein, 9 aa, Homo Sapiens
ELLASFKLI

SEQ ID NO: 1019013 - protein, 9 aa, Homo Sapiens
TSSRLACHV

SEQ ID NO: 1019014 - protein, 9 aa, Homo Sapiens
SCPRGNAPW

SEQ ID NO: 1019015 - protein, 9 aa, Homo Sapiens
VIVHRDSSL

SEQ ID NO: 1019016 - protein, 9 aa, Homo Sapiens
LRCYYYKDT

SEQ ID NO: 1019017 - protein, 9 aa, Homo Sapiens
PAAAAGLLW

SEQ ID NO: 1019018 - protein, 9 aa, Homo Sapiens
GSYYCECYE

SEQ ID NO: 1019019 - protein, 9 aa, Homo Sapiens
GDQRQEITS

SEQ ID NO: 1019020 - protein, 9 aa, Homo Sapiens
LFYAFIVAA

SEQ ID NO: 1019021 - protein, 9 aa, Homo Sapiens
YSNPWPSSY

SEQ ID NO: 1019022 - protein, 9 aa, Homo Sapiens
STSEELCTP

SEQ ID NO: 1019023 - protein, 9 aa, Homo Sapiens
NLREDALDD

SEQ ID NO: 1019024 - protein, 9 aa, Homo Sapiens
SSCYGGYWS

SEQ ID NO: 1019025 - protein, 9 aa, Homo Sapiens
RQQQQQQQR

SEQ ID NO: 1019026 - protein, 9 aa, Homo Sapiens
KSVSEVCVS

SEQ ID NO: 1019027 - protein, 9 aa, Homo Sapiens
GQVAVKWRV

SEQ ID NO: 1019028 - protein, 9 aa, Homo Sapiens
CFLLILLFY

SEQ ID NO: 1019029 - protein, 9 aa, Homo Sapiens
SQKVTHRRW

SEQ ID NO: 1019030 - protein, 9 aa, Homo Sapiens
RCYYYKDTI

SEQ ID NO: 1019031 - protein, 9 aa, Homo Sapiens
EAGLVKSGR

SEQ ID NO: 1019032 - protein, 9 aa, Homo Sapiens
CYYYKDTIS

SEQ ID NO: 1019033 - protein, 9 aa, Homo Sapiens
TSPGTATTL

SEQ ID NO: 1019034 - protein, 9 aa, Homo Sapiens
LDWLVRAQK

SEQ ID NO: 1019035 - protein, 9 aa, Homo Sapiens
YHSRMKDLN

SEQ ID NO: 1019036 - protein, 9 aa, Homo Sapiens
RTGTYIGIN

SEQ ID NO: 1019037 - protein, 9 aa, Homo Sapiens
PFKVEALST

SEQ ID NO: 1019038 - protein, 9 aa, Homo Sapiens
WHLPQMFSP

SEQ ID NO: 1019039 - protein, 9 aa, Homo Sapiens
MSENLNTEL

SEQ ID NO: 1019040 - protein, 9 aa, Homo Sapiens
YPSSLCRHE

SEQ ID NO: 1019041 - protein, 9 aa, Homo Sapiens
NKSTLVQRQ

SEQ ID NO: 1019042 - protein, 9 aa, Homo Sapiens
TRSNRLSLK

SEQ ID NO: 1019043 - protein, 9 aa, Homo Sapiens
HSGLAGLLE

SEQ ID NO: 1019044 - protein, 9 aa, Homo Sapiens
ERKVSLFVH

SEQ ID NO: 1019045 - protein, 9 aa, Homo Sapiens
DHFGHHVAR

SEQ ID NO: 1019046 - protein, 9 aa, Homo Sapiens
MRHTIVLFT

SEQ ID NO: 1019047 - protein, 9 aa, Homo Sapiens
GTSFQGMVT

SEQ ID NO: 1019048 - protein, 9 aa, Homo Sapiens
DPGPDDLHY

SEQ ID NO: 1019049 - protein, 9 aa, Homo Sapiens
GSGRPTGSL

SEQ ID NO: 1019050 - protein, 9 aa, Homo Sapiens
SQSALAYAL

SEQ ID NO: 1019051 - protein, 9 aa, Homo Sapiens
YKDTISTIK

SEQ ID NO: 1019052 - protein, 9 aa, Homo Sapiens
HDAPTLCLL

SEQ ID NO: 1019053 - protein, 9 aa, Homo Sapiens
FEIGSISLA

SEQ ID NO: 1019054 - protein, 9 aa, Homo Sapiens
PSQHSNILD

SEQ ID NO: 1019055 - protein, 9 aa, Homo Sapiens
AMKDSRIMR

SEQ ID NO: 1019056 - protein, 9 aa, Homo Sapiens
HFLLGPDRE

SEQ ID NO: 1019057 - protein, 9 aa, Homo Sapiens
NNGEQKVPN

SEQ ID NO: 1019058 - protein, 9 aa, Homo Sapiens
ERLDISNKT

SEQ ID NO: 1019059 - protein, 9 aa, Homo Sapiens
DRPLIAIFQ

SEQ ID NO: 1019060 - protein, 9 aa, Homo Sapiens
WDSREKLLQ

SEQ ID NO: 1019061 - protein, 9 aa, Homo Sapiens
LFLLEWNVW

SEQ ID NO: 1019062 - protein, 9 aa, Homo Sapiens
GPRGGLKSR

SEQ ID NO: 1019063 - protein, 9 aa, Homo Sapiens
TVAAAVATT

SEQ ID NO: 1019064 - protein, 9 aa, Homo Sapiens
TTGVPGQLP

SEQ ID NO: 1019065 - protein, 9 aa, Homo Sapiens
FRVKWLRRS

SEQ ID NO: 1019066 - protein, 9 aa, Homo Sapiens
PMARGLFHK

SEQ ID NO: 1019067 - protein, 9 aa, Homo Sapiens
SFKLIQREK

SEQ ID NO: 1019068 - protein, 9 aa, Homo Sapiens
APPPAAPSS

SEQ ID NO: 1019069 - protein, 9 aa, Homo Sapiens
EHSGLAGLL

SEQ ID NO: 1019070 - protein, 9 aa, Homo Sapiens
KEPPHCPNS

SEQ ID NO: 1019071 - protein, 9 aa, Homo Sapiens
SGALTSPGT

SEQ ID NO: 1019072 - protein, 9 aa, Homo Sapiens
NKSAYDVKN

SEQ ID NO: 1019073 - protein, 9 aa, Homo Sapiens
FQDYGLCDP

SEQ ID NO: 1019074 - protein, 9 aa, Homo Sapiens
NGEDVEDEE

SEQ ID NO: 1019075 - protein, 9 aa, Homo Sapiens
AGLLWEAGS

SEQ ID NO: 1019076 - protein, 9 aa, Homo Sapiens
WIFFPFCSM

SEQ ID NO: 1019077 - protein, 9 aa, Homo Sapiens
GSSNLYFLA

SEQ ID NO: 1019078 - protein, 9 aa, Homo Sapiens
NNRVRLAPA

SEQ ID NO: 1019079 - protein, 9 aa, Homo Sapiens
CPRGNAPWE

SEQ ID NO: 1019080 - protein, 9 aa, Homo Sapiens
FKTGKPGNK

SEQ ID NO: 1019081 - protein, 9 aa, Homo Sapiens
FQKITLYLT

SEQ ID NO: 1019082 - protein, 9 aa, Homo Sapiens
DWDSREKLL

SEQ ID NO: 1019083 - protein, 9 aa, Homo Sapiens
KLIFTLEQG

SEQ ID NO: 1019084 - protein, 9 aa, Homo Sapiens
MCSERIEIK

SEQ ID NO: 1019085 - protein, 9 aa, Homo Sapiens
FVITIKNIL

SEQ ID NO: 1019086 - protein, 9 aa, Homo Sapiens
LILSVTWIG

SEQ ID NO: 1019087 - protein, 9 aa, Homo Sapiens
LHFLMYFFL

SEQ ID NO: 1019088 - protein, 9 aa, Homo Sapiens
SKEYKVVML

SEQ ID NO: 1019089 - protein, 9 aa, Homo Sapiens
LQPQTLRKL

SEQ ID NO: 1019090 - protein, 9 aa, Homo Sapiens
VMEMIFKKL

SEQ ID NO: 1019091 - protein, 9 aa, Homo Sapiens
TQGVVGTFS

SEQ ID NO: 1019092 - protein, 9 aa, Homo Sapiens
IFFPFCSMY

SEQ ID NO: 1019093 - protein, 9 aa, Homo Sapiens
ASESLKIIF

SEQ ID NO: 1019094 - protein, 9 aa, Homo Sapiens
WKALNKIDA

SEQ ID NO: 1019095 - protein, 9 aa, Homo Sapiens
ACVCKCPQN

SEQ ID NO: 1019096 - protein, 9 aa, Homo Sapiens
ESKGEPGDI

SEQ ID NO: 1019097 - protein, 9 aa, Homo Sapiens
AAKYGRLNS

SEQ ID NO: 1019098 - protein, 9 aa, Homo Sapiens
RFISYTEEF

SEQ ID NO: 1019099 - protein, 9 aa, Homo Sapiens
IYHSPFWEA

SEQ ID NO: 1019100 - protein, 9 aa, Homo Sapiens
LLSAASSSR

SEQ ID NO: 1019101 - protein, 9 aa, Homo Sapiens
ERGRLSLYV

SEQ ID NO: 1019102 - protein, 9 aa, Homo Sapiens
NNKSTLVQR

SEQ ID NO: 1019103 - protein, 9 aa, Homo Sapiens
EQKVPNESC

SEQ ID NO: 1019104 - protein, 9 aa, Homo Sapiens
ELIATKIHK

SEQ ID NO: 1019105 - protein, 9 aa, Homo Sapiens
SLYKKKKPK

SEQ ID NO: 1019106 - protein, 9 aa, Homo Sapiens
HFRPGYEYD

SEQ ID NO: 1019107 - protein, 9 aa, Homo Sapiens
QCCLMGFLA

SEQ ID NO: 1019108 - protein, 9 aa, Homo Sapiens
FPCYIPIVS

SEQ ID NO: 1019109 - protein, 9 aa, Homo Sapiens
LDYSNPWPS

SEQ ID NO: 1019110 - protein, 9 aa, Homo Sapiens
CGKSFGRRS

SEQ ID NO: 1019111 - protein, 9 aa, Homo Sapiens
QPRTVIIQE

SEQ ID NO: 1019112 - protein, 9 aa, Homo Sapiens
FPESKGEPG

SEQ ID NO: 1019113 - protein, 9 aa, Homo Sapiens
ALLKKWNLI

SEQ ID NO: 1019114 - protein, 9 aa, Homo Sapiens
SEADEDAAD

SEQ ID NO: 1019115 - protein, 9 aa, Homo Sapiens
RKVSLFVHV

SEQ ID NO: 1019116 - protein, 9 aa, Homo Sapiens
VGTFSKPCF

SEQ ID NO: 1019117 - protein, 9 aa, Homo Sapiens
LQTPATLES

SEQ ID NO: 1019118 - protein, 9 aa, Homo Sapiens
GRLTSTLLQ

SEQ ID NO: 1019119 - protein, 9 aa, Homo Sapiens
GVLTVGSSS

SEQ ID NO: 1019120 - protein, 9 aa, Homo Sapiens
PFANRMQKF

SEQ ID NO: 1019121 - protein, 9 aa, Homo Sapiens
LSPMARGLF

SEQ ID NO: 1019122 - protein, 9 aa, Homo Sapiens
KTSEEKCGF

SEQ ID NO: 1019123 - protein, 9 aa, Homo Sapiens
IRENFHKCE

SEQ ID NO: 1019124 - protein, 9 aa, Homo Sapiens
VNDRSGSYY

SEQ ID NO: 1019125 - protein, 9 aa, Homo Sapiens
VILPNGLGE

SEQ ID NO: 1019126 - protein, 9 aa, Homo Sapiens
GASEADEDA

SEQ ID NO: 1019127 - protein, 9 aa, Homo Sapiens
KLGQLLLPS

SEQ ID NO: 1019128 - protein, 9 aa, Homo Sapiens
PNGLGESPP

SEQ ID NO: 1019129 - protein, 9 aa, Homo Sapiens
ELRGYLATI

SEQ ID NO: 1019130 - protein, 9 aa, Homo Sapiens
YKGHQVKKV

SEQ ID NO: 1019131 - protein, 9 aa, Homo Sapiens
DTDSRFISY

SEQ ID NO: 1019132 - protein, 9 aa, Homo Sapiens
HMHLHTRDR

SEQ ID NO: 1019133 - protein, 9 aa, Homo Sapiens
LQDQAGNEL

SEQ ID NO: 1019134 - protein, 9 aa, Homo Sapiens
FAVVGINIT

SEQ ID NO: 1019135 - protein, 9 aa, Homo Sapiens
EDTQLWIFF

SEQ ID NO: 1019136 - protein, 9 aa, Homo Sapiens
LYERAMRRR

SEQ ID NO: 1019137 - protein, 9 aa, Homo Sapiens
HWDVGSTDD

SEQ ID NO: 1019138 - protein, 9 aa, Homo Sapiens
SFGRRSHLA

SEQ ID NO: 1019139 - protein, 9 aa, Homo Sapiens
FWEKVASGE

SEQ ID NO: 1019140 - protein, 9 aa, Homo Sapiens
MEANSDESD

SEQ ID NO: 1019141 - protein, 9 aa, Homo Sapiens
NQLGDQRQE

SEQ ID NO: 1019142 - protein, 9 aa, Homo Sapiens
QEPQGIGKT

SEQ ID NO: 1019143 - protein, 9 aa, Homo Sapiens
VQPVQLGIL

SEQ ID NO: 1019144 - protein, 9 aa, Homo Sapiens
RRAEAQQGH

SEQ ID NO: 1019145 - protein, 9 aa, Homo Sapiens
YLNIKNFGA

SEQ ID NO: 1019146 - protein, 9 aa, Homo Sapiens
SECSCPEEI

SEQ ID NO: 1019147 - protein, 9 aa, Homo Sapiens
GRFKAERDV

SEQ ID NO: 1019148 - protein, 9 aa, Homo Sapiens
PGVVYFDKN

SEQ ID NO: 1019149 - protein, 9 aa, Homo Sapiens
REDEGFIKK

SEQ ID NO: 1019150 - protein, 9 aa, Homo Sapiens
TFDREIQQA

SEQ ID NO: 1019151 - protein, 9 aa, Homo Sapiens
VSPRDLAVL

SEQ ID NO: 1019152 - protein, 9 aa, Homo Sapiens
TLSQPQPGH

SEQ ID NO: 1019153 - protein, 9 aa, Homo Sapiens
MKDLNDFIR

SEQ ID NO: 1019154 - protein, 9 aa, Homo Sapiens
LREFLHKVL

SEQ ID NO: 1019155 - protein, 9 aa, Homo Sapiens
ADPGSAPSS

SEQ ID NO: 1019156 - protein, 9 aa, Homo Sapiens
STVVQEFSK

SEQ ID NO: 1019157 - protein, 9 aa, Homo Sapiens
TAQKIIKSQ

SEQ ID NO: 1019158 - protein, 9 aa, Homo Sapiens
NALYERAMR

SEQ ID NO: 1019159 - protein, 9 aa, Homo Sapiens
GPCAIPEQF

SEQ ID NO: 1019160 - protein, 9 aa, Homo Sapiens
FFPFCSMYV

SEQ ID NO: 1019161 - protein, 9 aa, Homo Sapiens
SSIGGIFSR

SEQ ID NO: 1019162 - protein, 9 aa, Homo Sapiens
MFKKLDSEL

SEQ ID NO: 1019163 - protein, 9 aa, Homo Sapiens
EGNMSRENS

SEQ ID NO: 1019164 - protein, 9 aa, Homo Sapiens
SSSCLHSHA

SEQ ID NO: 1019165 - protein, 9 aa, Homo Sapiens
REKFENLLN

SEQ ID NO: 1019166 - protein, 9 aa, Homo Sapiens
FVLKIYTCN

SEQ ID NO: 1019167 - protein, 9 aa, Homo Sapiens
NIQGGNEES

SEQ ID NO: 1019168 - protein, 9 aa, Homo Sapiens
DLNDFIRVH

SEQ ID NO: 1019169 - protein, 9 aa, Homo Sapiens
GSSKSRSLD

SEQ ID NO: 1019170 - protein, 9 aa, Homo Sapiens
NWLRCYYYK

SEQ ID NO: 1019171 - protein, 9 aa, Homo Sapiens
AKKITREYG

SEQ ID NO: 1019172 - protein, 9 aa, Homo Sapiens
HSRMKDLND

SEQ ID NO: 1019173 - protein, 9 aa, Homo Sapiens
NPGVVYFDK

SEQ ID NO: 1019174 - protein, 9 aa, Homo Sapiens
REFLHKVLH

SEQ ID NO: 1019175 - protein, 9 aa, Homo Sapiens
YGSRYLGVI

SEQ ID NO: 1019176 - protein, 9 aa, Homo Sapiens
CVEENTLKC

SEQ ID NO: 1019177 - protein, 9 aa, Homo Sapiens
RPGYEYDPG

SEQ ID NO: 1019178 - protein, 9 aa, Homo Sapiens
QSSRHDCNL

SEQ ID NO: 1019179 - protein, 9 aa, Homo Sapiens
FSVIYINAI

SEQ ID NO: 1019180 - protein, 9 aa, Homo Sapiens
ANIFLVLIE

SEQ ID NO: 1019181 - protein, 9 aa, Homo Sapiens
APRRERGRL

SEQ ID NO: 1019182 - protein, 9 aa, Homo Sapiens
ENLLKKHQL

SEQ ID NO: 1019183 - protein, 9 aa, Homo Sapiens
SFLGEGPGP

SEQ ID NO: 1019184 - protein, 9 aa, Homo Sapiens
QKWKIKLQV

SEQ ID NO: 1019185 - protein, 9 aa, Homo Sapiens
TWLEDHSFA

SEQ ID NO: 1019186 - protein, 9 aa, Homo Sapiens
VQLGILNVF

SEQ ID NO: 1019187 - protein, 9 aa, Homo Sapiens
GGNMCSERI

SEQ ID NO: 1019188 - protein, 9 aa, Homo Sapiens
APSQADPGS

SEQ ID NO: 1019189 - protein, 9 aa, Homo Sapiens
CRHERTHSA

SEQ ID NO: 1019190 - protein, 9 aa, Homo Sapiens
GLPEDNLVL

SEQ ID NO: 1019191 - protein, 9 aa, Homo Sapiens
ALTSPGTAT

SEQ ID NO: 1019192 - protein, 9 aa, Homo Sapiens
STEDWMESF

SEQ ID NO: 1019193 - protein, 9 aa, Homo Sapiens
KKIPSFFTS

SEQ ID NO: 1019194 - protein, 9 aa, Homo Sapiens
KLGFHLLFF

SEQ ID NO: 1019195 - protein, 9 aa, Homo Sapiens
GAGSLAPAS

SEQ ID NO: 1019196 - protein, 9 aa, Homo Sapiens
LYNNNRVKL

SEQ ID NO: 1019197 - protein, 9 aa, Homo Sapiens
FLMDYQFIK

SEQ ID NO: 1019198 - protein, 9 aa, Homo Sapiens
EQKWKIKLQ

SEQ ID NO: 1019199 - protein, 9 aa, Homo Sapiens
PNKPQKPVS

SEQ ID NO: 1019200 - protein, 9 aa, Homo Sapiens
IHIRENFHK

SEQ ID NO: 1019201 - protein, 9 aa, Homo Sapiens
LADDDWETI

SEQ ID NO: 1019202 - protein, 9 aa, Homo Sapiens
CVSTTNSKE

SEQ ID NO: 1019203 - protein, 9 aa, Homo Sapiens
LIVQVMGEL

SEQ ID NO: 1019204 - protein, 9 aa, Homo Sapiens
SCCHSSCYG

SEQ ID NO: 1019205 - protein, 9 aa, Homo Sapiens
DPNNLPAQE

SEQ ID NO: 1019206 - protein, 9 aa, Homo Sapiens
RPPGSMVPT

SEQ ID NO: 1019207 - protein, 9 aa, Homo Sapiens
MRTSQKNVR

SEQ ID NO: 1019208 - protein, 9 aa, Homo Sapiens
RMKDLNDFI

SEQ ID NO: 1019209 - protein, 9 aa, Homo Sapiens
SGRRAQIPD

SEQ ID NO: 1019210 - protein, 9 aa, Homo Sapiens
VEVTEERAE

SEQ ID NO: 1019211 - protein, 9 aa, Homo Sapiens
PISDKPKRV

SEQ ID NO: 1019212 - protein, 9 aa, Homo Sapiens
TVMNKTRAL

SEQ ID NO: 1019213 - protein, 9 aa, Homo Sapiens
KPKVWFAAG

SEQ ID NO: 1019214 - protein, 9 aa, Homo Sapiens
GYMKHLDHD

SEQ ID NO: 1019215 - protein, 9 aa, Homo Sapiens
QEILVLRKE

SEQ ID NO: 1019216 - protein, 9 aa, Homo Sapiens
GHTGTSEDL

SEQ ID NO: 1019217 - protein, 9 aa, Homo Sapiens
HIVHRDLKI

SEQ ID NO: 1019218 - protein, 9 aa, Homo Sapiens
WLRNVLRKG

SEQ ID NO: 1019219 - protein, 9 aa, Homo Sapiens
APGAPGFPE

SEQ ID NO: 1019220 - protein, 9 aa, Homo Sapiens
TGNEQKWKI

SEQ ID NO: 1019221 - protein, 9 aa, Homo Sapiens
APHLLFGRL

SEQ ID NO: 1019222 - protein, 9 aa, Homo Sapiens
PHHIKPLPY

SEQ ID NO: 1019223 - protein, 9 aa, Homo Sapiens
LLKVIQNDK

SEQ ID NO: 1019224 - protein, 9 aa, Homo Sapiens
AQAHWASER

SEQ ID NO: 1019225 - protein, 9 aa, Homo Sapiens
YRYSCCHSS

SEQ ID NO: 1019226 - protein, 9 aa, Homo Sapiens
GREKFENLL

SEQ ID NO: 1019227 - protein, 9 aa, Homo Sapiens
ILPNGLGES

SEQ ID NO: 1019228 - protein, 9 aa, Homo Sapiens
RQGWAVGTF

SEQ ID NO: 1019229 - protein, 9 aa, Homo Sapiens
YNFSQENIH

SEQ ID NO: 1019230 - protein, 9 aa, Homo Sapiens
QPSSSSSGL

SEQ ID NO: 1019231 - protein, 9 aa, Homo Sapiens
LEENQLTWL

SEQ ID NO: 1019232 - protein, 9 aa, Homo Sapiens
LKIIFGIDV

SEQ ID NO: 1019233 - protein, 9 aa, Homo Sapiens
ERYLCGAHS

SEQ ID NO: 1019234 - protein, 9 aa, Homo Sapiens
LHEFMALEH

SEQ ID NO: 1019235 - protein, 9 aa, Homo Sapiens
TGGVGVAAS

SEQ ID NO: 1019236 - protein, 9 aa, Homo Sapiens
AGLRPSSAT

SEQ ID NO: 1019237 - protein, 9 aa, Homo Sapiens
TVICKWNGE

SEQ ID NO: 1019238 - protein, 9 aa, Homo Sapiens
SSGLLDTIG

SEQ ID NO: 1019239 - protein, 9 aa, Homo Sapiens
NVFVITIKN

SEQ ID NO: 1019240 - protein, 9 aa, Homo Sapiens
TDPTSQRSA

SEQ ID NO: 1019241 - protein, 9 aa, Homo Sapiens
SKKTIRRRE

SEQ ID NO: 1019242 - protein, 9 aa, Homo Sapiens
QKDAQSVYD

SEQ ID NO: 1019243 - protein, 9 aa, Homo Sapiens
VGDGDMFKK

SEQ ID NO: 1019244 - protein, 9 aa, Homo Sapiens
VYLLCQNQV

SEQ ID NO: 1019245 - protein, 9 aa, Homo Sapiens
FVGDGDMFK

SEQ ID NO: 1019246 - protein, 9 aa, Homo Sapiens
MNPAGLEGG

SEQ ID NO: 1019247 - protein, 9 aa, Homo Sapiens
SYELIATKI

SEQ ID NO: 1019248 - protein, 9 aa, Homo Sapiens
QDQAGNELV

SEQ ID NO: 1019249 - protein, 9 aa, Homo Sapiens
WGPCAIPEQ

SEQ ID NO: 1019250 - protein, 9 aa, Homo Sapiens
SSKSRSLDS

SEQ ID NO: 1019251 - protein, 9 aa, Homo Sapiens
VFVITIKNI

SEQ ID NO: 1019252 - protein, 9 aa, Homo Sapiens
LGILNVFRH

SEQ ID NO: 1019253 - protein, 9 aa, Homo Sapiens
SSFVGDGDM

SEQ ID NO: 1019254 - protein, 9 aa, Homo Sapiens
VCIKLSMST

SEQ ID NO: 1019255 - protein, 9 aa, Homo Sapiens
WLLLFFLKN

SEQ ID NO: 1019256 - protein, 9 aa, Homo Sapiens
RKEDAERYL

SEQ ID NO: 1019257 - protein, 9 aa, Homo Sapiens
PNIKLYNNN

SEQ ID NO: 1019258 - protein, 9 aa, Homo Sapiens
KITREYGLK

SEQ ID NO: 1019259 - protein, 9 aa, Homo Sapiens
VVQEFSKGT

SEQ ID NO: 1019260 - protein, 9 aa, Homo Sapiens
GLPNPQDII

SEQ ID NO: 1019261 - protein, 9 aa, Homo Sapiens
QRDPGIPGP

SEQ ID NO: 1019262 - protein, 9 aa, Homo Sapiens
GSISLAMPQ

SEQ ID NO: 1019263 - protein, 9 aa, Homo Sapiens
QLWIFFPFC

SEQ ID NO: 1019264 - protein, 9 aa, Homo Sapiens
SESPHSGRR

SEQ ID NO: 1019265 - protein, 9 aa, Homo Sapiens
CRRATMAMK

SEQ ID NO: 1019266 - protein, 9 aa, Homo Sapiens
FLVFVLTHV

SEQ ID NO: 1019267 - protein, 9 aa, Homo Sapiens
KKDPNKPQK

SEQ ID NO: 1019268 - protein, 9 aa, Homo Sapiens
EFSKGTPRS

SEQ ID NO: 1019269 - protein, 9 aa, Homo Sapiens
SILCPPPPS

SEQ ID NO: 1019270 - protein, 9 aa, Homo Sapiens
WMESFFLSE

SEQ ID NO: 1019271 - protein, 9 aa, Homo Sapiens
FRGWDAYQD

SEQ ID NO: 1019272 - protein, 9 aa, Homo Sapiens
LTQKDAQSV

SEQ ID NO: 1019273 - protein, 9 aa, Homo Sapiens
LDEDPRVGV

SEQ ID NO: 1019274 - protein, 9 aa, Homo Sapiens
QERRAEAQQ

SEQ ID NO: 1019275 - protein, 9 aa, Homo Sapiens
TFQQPPNIS

SEQ ID NO: 1019276 - protein, 9 aa, Homo Sapiens
QALLKKWNL

SEQ ID NO: 1019277 - protein, 9 aa, Homo Sapiens
FGPLNSPFM

SEQ ID NO: 1019278 - protein, 9 aa, Homo Sapiens
NLLPTSSTR

SEQ ID NO: 1019279 - protein, 9 aa, Homo Sapiens
NIKNFGAKV

SEQ ID NO: 1019280 - protein, 9 aa, Homo Sapiens
ATAFREERL

SEQ ID NO: 1019281 - protein, 9 aa, Homo Sapiens
KDTISTIKD

SEQ ID NO: 1019282 - protein, 9 aa, Homo Sapiens
AVLSKKTIR

SEQ ID NO: 1019283 - protein, 9 aa, Homo Sapiens
GLLKVIQND

SEQ ID NO: 1019284 - protein, 9 aa, Homo Sapiens
LRNVLRKGL

SEQ ID NO: 1019285 - protein, 9 aa, Homo Sapiens
VNNQPSSSS

SEQ ID NO: 1019286 - protein, 9 aa, Homo Sapiens
EIQISPPPK

SEQ ID NO: 1019287 - protein, 9 aa, Homo Sapiens
FPKDTINEK

SEQ ID NO: 1019288 - protein, 9 aa, Homo Sapiens
DSRFISYTE

SEQ ID NO: 1019289 - protein, 9 aa, Homo Sapiens
QLTQKKQKV

SEQ ID NO: 1019290 - protein, 9 aa, Homo Sapiens
KLFECSNCR

SEQ ID NO: 1019291 - protein, 9 aa, Homo Sapiens
ILSPMARGL

SEQ ID NO: 1019292 - protein, 9 aa, Homo Sapiens
NLMKKLNEN

SEQ ID NO: 1019293 - protein, 9 aa, Homo Sapiens
DRGMEFKLI

SEQ ID NO: 1019294 - protein, 9 aa, Homo Sapiens
EFQPGSGAV

SEQ ID NO: 1019295 - protein, 9 aa, Homo Sapiens
IAALFIKVG

SEQ ID NO: 1019296 - protein, 9 aa, Homo Sapiens
LGQVAVKWR

SEQ ID NO: 1019297 - protein, 9 aa, Homo Sapiens
FSSDPYGGR

SEQ ID NO: 1019298 - protein, 9 aa, Homo Sapiens
GVVLEDYLN

SEQ ID NO: 1019299 - protein, 9 aa, Homo Sapiens
SVVGFFLCF

SEQ ID NO: 1019300 - protein, 9 aa, Homo Sapiens
NKSGSLLQE

SEQ ID NO: 1019301 - protein, 9 aa, Homo Sapiens
RLHFLMYFF

SEQ ID NO: 1019302 - protein, 9 aa, Homo Sapiens
QQFLNLMKK

SEQ ID NO: 1019303 - protein, 9 aa, Homo Sapiens
HLPQMFSPP

SEQ ID NO: 1019304 - protein, 9 aa, Homo Sapiens
PAFYGAKPS

SEQ ID NO: 1019305 - protein, 9 aa, Homo Sapiens
QTVAAAVAT

SEQ ID NO: 1019306 - protein, 9 aa, Homo Sapiens
LNDFIRVHR

SEQ ID NO: 1019307 - protein, 9 aa, Homo Sapiens
LQRDPGIPG

SEQ ID NO: 1019308 - protein, 9 aa, Homo Sapiens
VDCLDPEKI

SEQ ID NO: 1019309 - protein, 9 aa, Homo Sapiens
LRKNKELFV

SEQ ID NO: 1019310 - protein, 9 aa, Homo Sapiens
GCFLLILLF

SEQ ID NO: 1019311 - protein, 9 aa, Homo Sapiens
IKATYRNFM

SEQ ID NO: 1019312 - protein, 9 aa, Homo Sapiens
VQRQRIHSR

SEQ ID NO: 1019313 - protein, 9 aa, Homo Sapiens
GYNILTQKD

SEQ ID NO: 1019314 - protein, 9 aa, Homo Sapiens
GNMCSERIE

SEQ ID NO: 1019315 - protein, 9 aa, Homo Sapiens
AENLLKKHQ

SEQ ID NO: 1019316 - protein, 9 aa, Homo Sapiens
GVVGGDVRI

SEQ ID NO: 1019317 - protein, 9 aa, Homo Sapiens
DEDPRVGVV

SEQ ID NO: 1019318 - protein, 9 aa, Homo Sapiens
GILNVFRHW

SEQ ID NO: 1019319 - protein, 9 aa, Homo Sapiens
GEEIYNVPG

SEQ ID NO: 1019320 - protein, 9 aa, Homo Sapiens
AMMSFKTGK

SEQ ID NO: 1019321 - protein, 9 aa, Homo Sapiens
QIWNLNPVF

SEQ ID NO: 1019322 - protein, 9 aa, Homo Sapiens
AFWLLLFFL

SEQ ID NO: 1019323 - protein, 9 aa, Homo Sapiens
LIIISSPLS

SEQ ID NO: 1019324 - protein, 9 aa, Homo Sapiens
EIFLPLSAI

SEQ ID NO: 1019325 - protein, 9 aa, Homo Sapiens
RNFMRQSRI

SEQ ID NO: 1019326 - protein, 9 aa, Homo Sapiens
HKKKLEQGT

SEQ ID NO: 1019327 - protein, 9 aa, Homo Sapiens
SAENLLKKH

SEQ ID NO: 1019328 - protein, 9 aa, Homo Sapiens
SESRSASRT

SEQ ID NO: 1019329 - protein, 9 aa, Homo Sapiens
KVIQNDKLA

SEQ ID NO: 1019330 - protein, 9 aa, Homo Sapiens
TSCEVRPGP

SEQ ID NO: 1019331 - protein, 9 aa, Homo Sapiens
HHNRYVLGM

SEQ ID NO: 1019332 - protein, 9 aa, Homo Sapiens
QKVPNESCY

SEQ ID NO: 1019333 - protein, 9 aa, Homo Sapiens
LRSVMATAF

SEQ ID NO: 1019334 - protein, 9 aa, Homo Sapiens
LYANLAKAA

SEQ ID NO: 1019335 - protein, 9 aa, Homo Sapiens
SNHASPNKS

SEQ ID NO: 1019336 - protein, 9 aa, Homo Sapiens
ACDEDADED

SEQ ID NO: 1019337 - protein, 9 aa, Homo Sapiens
NNQPSSSSS

SEQ ID NO: 1019338 - protein, 9 aa, Homo Sapiens
DADIESKNK

SEQ ID NO: 1019339 - protein, 9 aa, Homo Sapiens
EDGILNEQD

SEQ ID NO: 1019340 - protein, 9 aa, Homo Sapiens
RIHIRENFH

SEQ ID NO: 1019341 - protein, 9 aa, Homo Sapiens
EDDVILDDV

SEQ ID NO: 1019342 - protein, 9 aa, Homo Sapiens
SHDEDAGAL

SEQ ID NO: 1019343 - protein, 9 aa, Homo Sapiens
RPISWVKGA

SEQ ID NO: 1019344 - protein, 9 aa, Homo Sapiens
KPKKKKKKN

SEQ ID NO: 1019345 - protein, 9 aa, Homo Sapiens
AERYLCGAH

SEQ ID NO: 1019346 - protein, 9 aa, Homo Sapiens
EFLHKVLHV

SEQ ID NO: 1019347 - protein, 9 aa, Homo Sapiens
QQGLLKVIQ

SEQ ID NO: 1019348 - protein, 9 aa, Homo Sapiens
TSFQGMVTF

SEQ ID NO: 1019349 - protein, 9 aa, Homo Sapiens
TEERAEAAA

SEQ ID NO: 1019350 - protein, 9 aa, Homo Sapiens
STSSIGGIF

SEQ ID NO: 1019351 - protein, 9 aa, Homo Sapiens
LRGYLATIK

SEQ ID NO: 1019352 - protein, 9 aa, Homo Sapiens
GGQMGELSG

SEQ ID NO: 1019353 - protein, 9 aa, Homo Sapiens
KVLHVSLST

SEQ ID NO: 1019354 - protein, 9 aa, Homo Sapiens
KLNGSRIRT

SEQ ID NO: 1019355 - protein, 9 aa, Homo Sapiens
TVGLKQGKV

SEQ ID NO: 1019356 - protein, 9 aa, Homo Sapiens
LILSPMARG

SEQ ID NO: 1019357 - protein, 9 aa, Homo Sapiens
GPNGPPGSA

SEQ ID NO: 1019358 - protein, 9 aa, Homo Sapiens
AAVATTTST

SEQ ID NO: 1019359 - protein, 9 aa, Homo Sapiens
LLLYDADIE

SEQ ID NO: 1019360 - protein, 9 aa, Homo Sapiens
GWAVGTFLH

SEQ ID NO: 1019361 - protein, 9 aa, Homo Sapiens
NGEQKVPNE

SEQ ID NO: 1019362 - protein, 9 aa, Homo Sapiens
SPSRKKRGA

SEQ ID NO: 1019363 - protein, 9 aa, Homo Sapiens
IIQEPQGIG

SEQ ID NO: 1019364 - protein, 9 aa, Homo Sapiens
KLGTVICKW

SEQ ID NO: 1019365 - protein, 9 aa, Homo Sapiens
RSGSYYCEC

SEQ ID NO: 1019366 - protein, 9 aa, Homo Sapiens
WNVWGSWYD

SEQ ID NO: 1019367 - protein, 9 aa, Homo Sapiens
RQRIHSRER

SEQ ID NO: 1019368 - protein, 9 aa, Homo Sapiens
MRAAQLHHQ

SEQ ID NO: 1019369 - protein, 9 aa, Homo Sapiens
QHSNILDNG

SEQ ID NO: 1019370 - protein, 9 aa, Homo Sapiens
DQQEEGQRQ

SEQ ID NO: 1019371 - protein, 9 aa, Homo Sapiens
RLSLYVQRD

SEQ ID NO: 1019372 - protein, 9 aa, Homo Sapiens
RGVKGACGF

SEQ ID NO: 1019373 - protein, 9 aa, Homo Sapiens
AVTYAAVKH

SEQ ID NO: 1019374 - protein, 9 aa, Homo Sapiens
SQKIKSRYL

SEQ ID NO: 1019375 - protein, 9 aa, Homo Sapiens
IHHKKPTGI

SEQ ID NO: 1019376 - protein, 9 aa, Homo Sapiens
CRMQHITGL

SEQ ID NO: 1019377 - protein, 9 aa, Homo Sapiens
RIILTTNGG

SEQ ID NO: 1019378 - protein, 9 aa, Homo Sapiens
HEFMALEHF

SEQ ID NO: 1019379 - protein, 9 aa, Homo Sapiens
TSQRSAYGP

SEQ ID NO: 1019380 - protein, 9 aa, Homo Sapiens
VLMVGPNFC

SEQ ID NO: 1019381 - protein, 9 aa, Homo Sapiens
WDNYNLRED

SEQ ID NO: 1019382 - protein, 9 aa, Homo Sapiens
SGRKQKALS

SEQ ID NO: 1019383 - protein, 9 aa, Homo Sapiens
IKLYNNNRV

SEQ ID NO: 1019384 - protein, 9 aa, Homo Sapiens
VCVSTTNSK

SEQ ID NO: 1019385 - protein, 9 aa, Homo Sapiens
GTCSLYANL

SEQ ID NO: 1019386 - protein, 9 aa, Homo Sapiens
HLEENQLTW

SEQ ID NO: 1019387 - protein, 9 aa, Homo Sapiens
QKEGNMSRE

SEQ ID NO: 1019388 - protein, 9 aa, Homo Sapiens
ELKDAKKDA

SEQ ID NO: 1019389 - protein, 9 aa, Homo Sapiens
IENLLLDGN

SEQ ID NO: 1019390 - protein, 9 aa, Homo Sapiens
VLSTNYANS

SEQ ID NO: 1019391 - protein, 9 aa, Homo Sapiens
RTLGKQLNA

SEQ ID NO: 1019392 - protein, 9 aa, Homo Sapiens
FSLGSEFPK

SEQ ID NO: 1019393 - protein, 9 aa, Homo Sapiens
AAAAGLLWE

SEQ ID NO: 1019394 - protein, 9 aa, Homo Sapiens
ALFIKVGKN

SEQ ID NO: 1019395 - protein, 9 aa, Homo Sapiens
FLILSVTWI

SEQ ID NO: 1019396 - protein, 9 aa, Homo Sapiens
MSNNCISVQ

SEQ ID NO: 1019397 - protein, 9 aa, Homo Sapiens
KVLIQDSSE

SEQ ID NO: 1019398 - protein, 9 aa, Homo Sapiens
IPQVKPESS

SEQ ID NO: 1019399 - protein, 9 aa, Homo Sapiens
HFIAWTDRG

SEQ ID NO: 1019400 - protein, 9 aa, Homo Sapiens
VKKVLIQDS

SEQ ID NO: 1019401 - protein, 9 aa, Homo Sapiens
KLTFDREIQ

SEQ ID NO: 1019402 - protein, 9 aa, Homo Sapiens
APGFPESKG

SEQ ID NO: 1019403 - protein, 9 aa, Homo Sapiens
TPITSSMST

SEQ ID NO: 1019404 - protein, 9 aa, Homo Sapiens
DTDSLLSAA

SEQ ID NO: 1019405 - protein, 9 aa, Homo Sapiens
SPHWDVGST

SEQ ID NO: 1019406 - protein, 9 aa, Homo Sapiens
NMKRTERVW

SEQ ID NO: 1019407 - protein, 9 aa, Homo Sapiens
TSTPPINMN

SEQ ID NO: 1019408 - protein, 9 aa, Homo Sapiens
SASQIWNLN

SEQ ID NO: 1019409 - protein, 9 aa, Homo Sapiens
RFKAERDVG

SEQ ID NO: 1019410 - protein, 9 aa, Homo Sapiens
GTVVQYLST

SEQ ID NO: 1019411 - protein, 9 aa, Homo Sapiens
WASERLDIS

SEQ ID NO: 1019412 - protein, 9 aa, Homo Sapiens
LLGPDREKV

SEQ ID NO: 1019413 - protein, 9 aa, Homo Sapiens
ESRSASRTT

SEQ ID NO: 1019414 - protein, 9 aa, Homo Sapiens
QFGPLNSPF

SEQ ID NO: 1019415 - protein, 9 aa, Homo Sapiens
QQEILVLRK

SEQ ID NO: 1019416 - protein, 9 aa, Homo Sapiens
FLHKVLHVS

SEQ ID NO: 1019417 - protein, 9 aa, Homo Sapiens
TRINMLKLP

SEQ ID NO: 1019418 - protein, 9 aa, Homo Sapiens
KTGNEQKWK

SEQ ID NO: 1019419 - protein, 9 aa, Homo Sapiens
QFIKLIYFL

SEQ ID NO: 1019420 - protein, 9 aa, Homo Sapiens
ECEMPHHIK

SEQ ID NO: 1019421 - protein, 9 aa, Homo Sapiens
SFFTSVDKV

SEQ ID NO: 1019422 - protein, 9 aa, Homo Sapiens
ENTLKCSAK

SEQ ID NO: 1019423 - protein, 9 aa, Homo Sapiens
SEVCVSTTN

SEQ ID NO: 1019424 - protein, 9 aa, Homo Sapiens
VAFSGNLQL

SEQ ID NO: 1019425 - protein, 9 aa, Homo Sapiens
YRQAQLAGV

SEQ ID NO: 1019426 - protein, 9 aa, Homo Sapiens
FKLIQREKP

SEQ ID NO: 1019427 - protein, 9 aa, Homo Sapiens
FYGPPFPLQ

SEQ ID NO: 1019428 - protein, 9 aa, Homo Sapiens
QELIRDHFG

SEQ ID NO: 1019429 - protein, 9 aa, Homo Sapiens
VVLEDYLNI

SEQ ID NO: 1019430 - protein, 9 aa, Homo Sapiens
ISTSCEVRP

SEQ ID NO: 1019431 - protein, 9 aa, Homo Sapiens
RENSLFFRK

SEQ ID NO: 1019432 - protein, 9 aa, Homo Sapiens
VSYELIATK

SEQ ID NO: 1019433 - protein, 9 aa, Homo Sapiens
SGFVRPDLI

SEQ ID NO: 1019434 - protein, 9 aa, Homo Sapiens
RVSPRDLAV

SEQ ID NO: 1019435 - protein, 9 aa, Homo Sapiens
HLLFGRLVV

SEQ ID NO: 1019436 - protein, 9 aa, Homo Sapiens
TVPNNGEQK

SEQ ID NO: 1019437 - protein, 9 aa, Homo Sapiens
QRQRIHSRE

SEQ ID NO: 1019438 - protein, 9 aa, Homo Sapiens
QQCDDYGSR

SEQ ID NO: 1019439 - protein, 9 aa, Homo Sapiens
DAGALCENP

SEQ ID NO: 1019440 - protein, 9 aa, Homo Sapiens
EMLGLMRMR

SEQ ID NO: 1019441 - protein, 9 aa, Homo Sapiens
GHKPEPTDK

SEQ ID NO: 1019442 - protein, 9 aa, Homo Sapiens
TGGSSKSRS

SEQ ID NO: 1019443 - protein, 9 aa, Homo Sapiens
QRTKLRDKK

SEQ ID NO: 1019444 - protein, 9 aa, Homo Sapiens
RINMLKLPE

SEQ ID NO: 1019445 - protein, 9 aa, Homo Sapiens
GSTLMVFLF

SEQ ID NO: 1019446 - protein, 9 aa, Homo Sapiens
LPAQESILP

SEQ ID NO: 1019447 - protein, 9 aa, Homo Sapiens
EKVASGEEP

SEQ ID NO: 1019448 - protein, 9 aa, Homo Sapiens
AVIDANIFL

SEQ ID NO: 1019449 - protein, 9 aa, Homo Sapiens
CAIPEQFRD

SEQ ID NO: 1019450 - protein, 9 aa, Homo Sapiens
NKTRALIDS

SEQ ID NO: 1019451 - protein, 9 aa, Homo Sapiens
DPRAARVSP

SEQ ID NO: 1019452 - protein, 9 aa, Homo Sapiens
ENVICLGKE

SEQ ID NO: 1019453 - protein, 9 aa, Homo Sapiens
KSTSRIFPL

SEQ ID NO: 1019454 - protein, 9 aa, Homo Sapiens
GSEFPKGAI

SEQ ID NO: 1019455 - protein, 9 aa, Homo Sapiens
NVPGIRHVH

SEQ ID NO: 1019456 - protein, 9 aa, Homo Sapiens
NDFIRVHRL

SEQ ID NO: 1019457 - protein, 9 aa, Homo Sapiens
EIREIFLPL

SEQ ID NO: 1019458 - protein, 9 aa, Homo Sapiens
EKLLQVNSG

SEQ ID NO: 1019459 - protein, 9 aa, Homo Sapiens
VEREANEFR

SEQ ID NO: 1019460 - protein, 9 aa, Homo Sapiens
CRGLPNPQD

SEQ ID NO: 1019461 - protein, 9 aa, Homo Sapiens
TAFREERLK

SEQ ID NO: 1019462 - protein, 9 aa, Homo Sapiens
KYEFSDKDW

SEQ ID NO: 1019463 - protein, 9 aa, Homo Sapiens
LTFRNVAIE

SEQ ID NO: 1019464 - protein, 9 aa, Homo Sapiens
IGSISLAMP

SEQ ID NO: 1019465 - protein, 9 aa, Homo Sapiens
SNDKPKVWF

SEQ ID NO: 1019466 - protein, 9 aa, Homo Sapiens
CIKLSMSTV

SEQ ID NO: 1019467 - protein, 9 aa, Homo Sapiens
DFGLATMKS

SEQ ID NO: 1019468 - protein, 9 aa, Homo Sapiens
ESTGGSSKS

SEQ ID NO: 1019469 - protein, 9 aa, Homo Sapiens
KLRDKKWKM

SEQ ID NO: 1019470 - protein, 9 aa, Homo Sapiens
KLQGISQIE

SEQ ID NO: 1019471 - protein, 9 aa, Homo Sapiens
CMIIWVLAF

SEQ ID NO: 1019472 - protein, 9 aa, Homo Sapiens
AEEEDDSDR

SEQ ID NO: 1019473 - protein, 9 aa, Homo Sapiens
PLDFETKKF

SEQ ID NO: 1019474 - protein, 9 aa, Homo Sapiens
DLGLPEDNL

SEQ ID NO: 1019475 - protein, 9 aa, Homo Sapiens
SSFANGINW

SEQ ID NO: 1019476 - protein, 9 aa, Homo Sapiens
SKSGRRAQI

SEQ ID NO: 1019477 - protein, 9 aa, Homo Sapiens
VKKYFQKIT

SEQ ID NO: 1019478 - protein, 9 aa, Homo Sapiens
GVESFWEKV

SEQ ID NO: 1019479 - protein, 9 aa, Homo Sapiens
FVEGIDFKT

SEQ ID NO: 1019480 - protein, 9 aa, Homo Sapiens
RHIFDFLGY

SEQ ID NO: 1019481 - protein, 9 aa, Homo Sapiens
WNLNPVFGG

SEQ ID NO: 1019482 - protein, 9 aa, Homo Sapiens
FKYEFSENE

SEQ ID NO: 1019483 - protein, 9 aa, Homo Sapiens
SHCPQVECW

SEQ ID NO: 1019484 - protein, 9 aa, Homo Sapiens
DRSGSYYCE

SEQ ID NO: 1019485 - protein, 9 aa, Homo Sapiens
QKVQRRERA

SEQ ID NO: 1019486 - protein, 9 aa, Homo Sapiens
SFQGMVTFE

SEQ ID NO: 1019487 - protein, 9 aa, Homo Sapiens
FSGNLQLIF

SEQ ID NO: 1019488 - protein, 9 aa, Homo Sapiens
PPGSMVPTS

SEQ ID NO: 1019489 - protein, 9 aa, Homo Sapiens
SCPEEIRDQ

SEQ ID NO: 1019490 - protein, 9 aa, Homo Sapiens
YKLGEQFFP

SEQ ID NO: 1019491 - protein, 9 aa, Homo Sapiens
VQLTQKKQK

SEQ ID NO: 1019492 - protein, 9 aa, Homo Sapiens
MFSPPSAAR

SEQ ID NO: 1019493 - protein, 9 aa, Homo Sapiens
HTVILLSEG

SEQ ID NO: 1019494 - protein, 9 aa, Homo Sapiens
LWIFFPFCS

SEQ ID NO: 1019495 - protein, 9 aa, Homo Sapiens
PQMFSPPSA

SEQ ID NO: 1019496 - protein, 9 aa, Homo Sapiens
PSFFTSVDK

SEQ ID NO: 1019497 - protein, 9 aa, Homo Sapiens
RVTKEGSTE

SEQ ID NO: 1019498 - protein, 9 aa, Homo Sapiens
PVVFLILSV

SEQ ID NO: 1019499 - protein, 9 aa, Homo Sapiens
FLLESSSAQ

SEQ ID NO: 1019500 - protein, 9 aa, Homo Sapiens
TDSLLSAAS

SEQ ID NO: 1019501 - protein, 9 aa, Homo Sapiens
KGCQRYMVS

SEQ ID NO: 1019502 - protein, 9 aa, Homo Sapiens
PLNNMKQEL

SEQ ID NO: 1019503 - protein, 9 aa, Homo Sapiens
KKLNENIRI

SEQ ID NO: 1019504 - protein, 9 aa, Homo Sapiens
VFLFTISAS

SEQ ID NO: 1019505 - protein, 9 aa, Homo Sapiens
DLYFDAFTS

SEQ ID NO: 1019506 - protein, 9 aa, Homo Sapiens
SSLASIQKL

SEQ ID NO: 1019507 - protein, 9 aa, Homo Sapiens
FFFMYLYSM

SEQ ID NO: 1019508 - protein, 9 aa, Homo Sapiens
RHVIEVSNE

SEQ ID NO: 1019509 - protein, 9 aa, Homo Sapiens
APSSLNTAL

SEQ ID NO: 1019510 - protein, 9 aa, Homo Sapiens
ILIKATYRN

SEQ ID NO: 1019511 - protein, 9 aa, Homo Sapiens
RGWDAYQDG

SEQ ID NO: 1019512 - protein, 9 aa, Homo Sapiens
KQGRPLNNM

SEQ ID NO: 1019513 - protein, 9 aa, Homo Sapiens
ALAYALQKA

SEQ ID NO: 1019514 - protein, 9 aa, Homo Sapiens
QRIQEIKRL

SEQ ID NO: 1019515 - protein, 9 aa, Homo Sapiens
PGYTMKLNG

SEQ ID NO: 1019516 - protein, 9 aa, Homo Sapiens
GKQLNANRR

SEQ ID NO: 1019517 - protein, 9 aa, Homo Sapiens
REKVCLSLP

SEQ ID NO: 1019518 - protein, 9 aa, Homo Sapiens
GLRKEDAER

SEQ ID NO: 1019519 - protein, 9 aa, Homo Sapiens
PPPSILCPP

SEQ ID NO: 1019520 - protein, 9 aa, Homo Sapiens
ATAQKIIKS

SEQ ID NO: 1019521 - protein, 9 aa, Homo Sapiens
TGLRKEDAE

SEQ ID NO: 1019522 - protein, 9 aa, Homo Sapiens
DKSECSCPE

SEQ ID NO: 1019523 - protein, 9 aa, Homo Sapiens
YEDRPPGSM

SEQ ID NO: 1019524 - protein, 9 aa, Homo Sapiens
SFLPPARKQ

SEQ ID NO: 1019525 - protein, 9 aa, Homo Sapiens
QKIKSRYLE

SEQ ID NO: 1019526 - protein, 9 aa, Homo Sapiens
GVGVAASLC

SEQ ID NO: 1019527 - protein, 9 aa, Homo Sapiens
IFSRARLLQ

SEQ ID NO: 1019528 - protein, 9 aa, Homo Sapiens
LGQLLLPSL

SEQ ID NO: 1019529 - protein, 9 aa, Homo Sapiens
DFVLKIYTC

SEQ ID NO: 1019530 - protein, 9 aa, Homo Sapiens
DVSQKVTHR

SEQ ID NO: 1019531 - protein, 9 aa, Homo Sapiens
RVNIQGGNE

SEQ ID NO: 1019532 - protein, 9 aa, Homo Sapiens
ENQLTWLED

SEQ ID NO: 1019533 - protein, 9 aa, Homo Sapiens
DQQGLLKVI

SEQ ID NO: 1019534 - protein, 9 aa, Homo Sapiens
PRGGLKSRE

SEQ ID NO: 1019535 - protein, 9 aa, Homo Sapiens
TQKKQKVQR

SEQ ID NO: 1019536 - protein, 9 aa, Homo Sapiens
KNVRCPWCR

SEQ ID NO: 1019537 - protein, 9 aa, Homo Sapiens
FFTSVDKVN

SEQ ID NO: 1019538 - protein, 9 aa, Homo Sapiens
KSRSLDSES

SEQ ID NO: 1019539 - protein, 9 aa, Homo Sapiens
SISLAMPQC

SEQ ID NO: 1019540 - protein, 9 aa, Homo Sapiens
KNRFPNIKL

SEQ ID NO: 1019541 - protein, 9 aa, Homo Sapiens
RYLGVIELI

SEQ ID NO: 1019542 - protein, 9 aa, Homo Sapiens
FFTTACVCK

SEQ ID NO: 1019543 - protein, 9 aa, Homo Sapiens
YLRGTHSSF

SEQ ID NO: 1019544 - protein, 9 aa, Homo Sapiens
MAMKDSRIM

SEQ ID NO: 1019545 - protein, 9 aa, Homo Sapiens
GSSSCLHSH

SEQ ID NO: 1019546 - protein, 9 aa, Homo Sapiens
NHASPNKSA

SEQ ID NO: 1019547 - protein, 9 aa, Homo Sapiens
ECPAVLSKK

SEQ ID NO: 1019548 - protein, 9 aa, Homo Sapiens
AGLVKSGRF

SEQ ID NO: 1019549 - protein, 9 aa, Homo Sapiens
RKLGQLLLP

SEQ ID NO: 1019550 - protein, 9 aa, Homo Sapiens
AVKWRVVGG

SEQ ID NO: 1019551 - protein, 9 aa, Homo Sapiens
YETKQRELL

SEQ ID NO: 1019552 - protein, 9 aa, Homo Sapiens
SVPNLVPDL

SEQ ID NO: 1019553 - protein, 9 aa, Homo Sapiens
ARDLASAEN

SEQ ID NO: 1019554 - protein, 9 aa, Homo Sapiens
TEKDVSQKV

SEQ ID NO: 1019555 - protein, 9 aa, Homo Sapiens
KKKPKKKKK

SEQ ID NO: 1019556 - protein, 9 aa, Homo Sapiens
RNHSFYMPL

SEQ ID NO: 1019557 - protein, 9 aa, Homo Sapiens
NANRREILI

SEQ ID NO: 1019558 - protein, 9 aa, Homo Sapiens
DTSASAVTV

SEQ ID NO: 1019559 - protein, 9 aa, Homo Sapiens
INEKVIEFL

SEQ ID NO: 1019560 - protein, 9 aa, Homo Sapiens
GRPTGSLLS

SEQ ID NO: 1019561 - protein, 9 aa, Homo Sapiens
TREYGLKHL

SEQ ID NO: 1019562 - protein, 9 aa, Homo Sapiens
PGPLPAPHL

SEQ ID NO: 1019563 - protein, 9 aa, Homo Sapiens
SFYMPLNPT

SEQ ID NO: 1019564 - protein, 9 aa, Homo Sapiens
VECWTPASS

SEQ ID NO: 1019565 - protein, 9 aa, Homo Sapiens
PLAMQSSLR

SEQ ID NO: 1019566 - protein, 9 aa, Homo Sapiens
AAFWLLLFF

SEQ ID NO: 1019567 - protein, 9 aa, Homo Sapiens
HSPFWEARE

SEQ ID NO: 1019568 - protein, 9 aa, Homo Sapiens
YTMKLNGSR

SEQ ID NO: 1019569 - protein, 9 aa, Homo Sapiens
HDFQDYGLC

SEQ ID NO: 1019570 - protein, 9 aa, Homo Sapiens
EWDNYNLRE

SEQ ID NO: 1019571 - protein, 9 aa, Homo Sapiens
PTNRNHSFY

SEQ ID NO: 1019572 - protein, 9 aa, Homo Sapiens
SVIVHRDSS

SEQ ID NO: 1019573 - protein, 9 aa, Homo Sapiens
CSCPEEIRD

SEQ ID NO: 1019574 - protein, 9 aa, Homo Sapiens
PSGPALTSD

SEQ ID NO: 1019575 - protein, 9 aa, Homo Sapiens
TFRNVAIEF

SEQ ID NO: 1019576 - protein, 9 aa, Homo Sapiens
LEDYLNIKN

SEQ ID NO: 1019577 - protein, 9 aa, Homo Sapiens
RQTVAAAVA

SEQ ID NO: 1019578 - protein, 9 aa, Homo Sapiens
KEFQPGSGA

SEQ ID NO: 1019579 - protein, 9 aa, Homo Sapiens
VAQRCLYRD

SEQ ID NO: 1019580 - protein, 9 aa, Homo Sapiens
GGCPFREGV

SEQ ID NO: 1019581 - protein, 9 aa, Homo Sapiens
MKLNGSRIR

SEQ ID NO: 1019582 - protein, 9 aa, Homo Sapiens
FREERLKAL

SEQ ID NO: 1019583 - protein, 9 aa, Homo Sapiens
SLGSEFPKG

SEQ ID NO: 1019584 - protein, 9 aa, Homo Sapiens
QYKSVSEVC

SEQ ID NO: 1019585 - protein, 9 aa, Homo Sapiens
SGDDSVFFP

SEQ ID NO: 1019586 - protein, 9 aa, Homo Sapiens
FDRGNNRVR

SEQ ID NO: 1019587 - protein, 9 aa, Homo Sapiens
SSLDQFGPL

SEQ ID NO: 1019588 - protein, 9 aa, Homo Sapiens
KSGRFKAER

SEQ ID NO: 1019589 - protein, 9 aa, Homo Sapiens
DQIMEHIKA

SEQ ID NO: 1019590 - protein, 9 aa, Homo Sapiens
VEALSTEVL

SEQ ID NO: 1019591 - protein, 9 aa, Homo Sapiens
RVAATTGVP

SEQ ID NO: 1019592 - protein, 9 aa, Homo Sapiens
ALDGTSFQG

SEQ ID NO: 1019593 - protein, 9 aa, Homo Sapiens
EDDSDRPIE

SEQ ID NO: 1019594 - protein, 9 aa, Homo Sapiens
VPNLVPDLY

SEQ ID NO: 1019595 - protein, 9 aa, Homo Sapiens
AEKGRPGEP

SEQ ID NO: 1019596 - protein, 9 aa, Homo Sapiens
RTRTSSTEE

SEQ ID NO: 1019597 - protein, 9 aa, Homo Sapiens
LANALLEIR

SEQ ID NO: 1019598 - protein, 9 aa, Homo Sapiens
EPTDKEWEL

SEQ ID NO: 1019599 - protein, 9 aa, Homo Sapiens
LYLGNSMDP

SEQ ID NO: 1019600 - protein, 9 aa, Homo Sapiens
THIDWDSRE

SEQ ID NO: 1019601 - protein, 9 aa, Homo Sapiens
LIRDHFGHH

SEQ ID NO: 1019602 - protein, 9 aa, Homo Sapiens
SRPIVPLFS

SEQ ID NO: 1019603 - protein, 9 aa, Homo Sapiens
ETVLDRVSV

SEQ ID NO: 1019604 - protein, 9 aa, Homo Sapiens
PGTKAEKGR

SEQ ID NO: 1019605 - protein, 9 aa, Homo Sapiens
ASLCLCSLL

SEQ ID NO: 1019606 - protein, 9 aa, Homo Sapiens
NSMDPPDLL

SEQ ID NO: 1019607 - protein, 9 aa, Homo Sapiens
TYPSSLCRH

SEQ ID NO: 1019608 - protein, 9 aa, Homo Sapiens
ERFLKPQDI

SEQ ID NO: 1019609 - protein, 9 aa, Homo Sapiens
STLQEKKVI

SEQ ID NO: 1019610 - protein, 9 aa, Homo Sapiens
NEESPFVNI

SEQ ID NO: 1019611 - protein, 9 aa, Homo Sapiens
CGGTTRIIL

SEQ ID NO: 1019612 - protein, 9 aa, Homo Sapiens
GPWISTSCE

SEQ ID NO: 1019613 - protein, 9 aa, Homo Sapiens
RKEPPHCPN

SEQ ID NO: 1019614 - protein, 9 aa, Homo Sapiens
SIVAVSYEL

SEQ ID NO: 1019615 - protein, 9 aa, Homo Sapiens
LMDYQFIKL

SEQ ID NO: 1019616 - protein, 9 aa, Homo Sapiens
KTIRRRETE

SEQ ID NO: 1019617 - protein, 9 aa, Homo Sapiens
NGLGESPPN

SEQ ID NO: 1019618 - protein, 9 aa, Homo Sapiens
EIGSISLAM

SEQ ID NO: 1019619 - protein, 9 aa, Homo Sapiens
EFTRSNRLS

SEQ ID NO: 1019620 - protein, 9 aa, Homo Sapiens
IQAINTKKQ

SEQ ID NO: 1019621 - protein, 9 aa, Homo Sapiens
SFFVPACSL

SEQ ID NO: 1019622 - protein, 9 aa, Homo Sapiens
PQPGHANLK

SEQ ID NO: 1019623 - protein, 9 aa, Homo Sapiens
GYCFTKPKL

SEQ ID NO: 1019624 - protein, 9 aa, Homo Sapiens
TTFRLPPPL

SEQ ID NO: 1019625 - protein, 9 aa, Homo Sapiens
RENATVMNK

SEQ ID NO: 1019626 - protein, 9 aa, Homo Sapiens
SAVTVGLKQ

SEQ ID NO: 1019627 - protein, 9 aa, Homo Sapiens
DYGSRYLGV

SEQ ID NO: 1019628 - protein, 9 aa, Homo Sapiens
PGVAKYRQA

SEQ ID NO: 1019629 - protein, 9 aa, Homo Sapiens
FSENEQRRM

SEQ ID NO: 1019630 - protein, 9 aa, Homo Sapiens
KKQNFLQGH

SEQ ID NO: 1019631 - protein, 9 aa, Homo Sapiens
ERAEAAAAT

SEQ ID NO: 1019632 - protein, 9 aa, Homo Sapiens
CLDPEKILR

SEQ ID NO: 1019633 - protein, 9 aa, Homo Sapiens
KWRVVGGTA

SEQ ID NO: 1019634 - protein, 9 aa, Homo Sapiens
VHVLKTNDK

SEQ ID NO: 1019635 - protein, 9 aa, Homo Sapiens
IQTAMMSFK

SEQ ID NO: 1019636 - protein, 9 aa, Homo Sapiens
GCVKSCVSP

SEQ ID NO: 1019637 - protein, 9 aa, Homo Sapiens
KEFLLESSS

SEQ ID NO: 1019638 - protein, 9 aa, Homo Sapiens
NSHFIAWTD

SEQ ID NO: 1019639 - protein, 9 aa, Homo Sapiens
ANEFRRGRS

SEQ ID NO: 1019640 - protein, 9 aa, Homo Sapiens
ICKWNGEKM

SEQ ID NO: 1019641 - protein, 9 aa, Homo Sapiens
GLATMKSRW

SEQ ID NO: 1019642 - protein, 9 aa, Homo Sapiens
WEKVASGEE

SEQ ID NO: 1019643 - protein, 9 aa, Homo Sapiens
MKSWLRNVL

SEQ ID NO: 1019644 - protein, 9 aa, Homo Sapiens
DREIQQALR

SEQ ID NO: 1019645 - protein, 9 aa, Homo Sapiens
EEDEDDDEN

SEQ ID NO: 1019646 - protein, 9 aa, Homo Sapiens
SWVKGAPPS

SEQ ID NO: 1019647 - protein, 9 aa, Homo Sapiens
NVLRKGLVK

SEQ ID NO: 1019648 - protein, 9 aa, Homo Sapiens
HWTGGCPFR

SEQ ID NO: 1019649 - protein, 9 aa, Homo Sapiens
SASAVTVGL

SEQ ID NO: 1019650 - protein, 9 aa, Homo Sapiens
QESVKDQVI

SEQ ID NO: 1019651 - protein, 9 aa, Homo Sapiens
RLSASQIWN

SEQ ID NO: 1019652 - protein, 9 aa, Homo Sapiens
ILCPPPPSA

SEQ ID NO: 1019653 - protein, 9 aa, Homo Sapiens
LTTNGGQER

SEQ ID NO: 1019654 - protein, 9 aa, Homo Sapiens
AIIGNVLIV

SEQ ID NO: 1019655 - protein, 9 aa, Homo Sapiens
YPPSIGFSY

SEQ ID NO: 1019656 - protein, 9 aa, Homo Sapiens
STAPATPAP

SEQ ID NO: 1019657 - protein, 9 aa, Homo Sapiens
GESPPNELS

SEQ ID NO: 1019658 - protein, 9 aa, Homo Sapiens
GSRYLGVIE

SEQ ID NO: 1019659 - protein, 9 aa, Homo Sapiens
KAEKGRPGE

SEQ ID NO: 1019660 - protein, 9 aa, Homo Sapiens
SDLDQIMEH

SEQ ID NO: 1019661 - protein, 9 aa, Homo Sapiens
TIKNILSIG

SEQ ID NO: 1019662 - protein, 9 aa, Homo Sapiens
SPGTATTLT

SEQ ID NO: 1019663 - protein, 9 aa, Homo Sapiens
TLRKLGQLL

SEQ ID NO: 1019664 - protein, 9 aa, Homo Sapiens
TMKSRWSGS

SEQ ID NO: 1019665 - protein, 9 aa, Homo Sapiens
QHIAQHQFE

SEQ ID NO: 1019666 - protein, 9 aa, Homo Sapiens
PTPAPFKVE

SEQ ID NO: 1019667 - protein, 9 aa, Homo Sapiens
EDRPPGSMV

SEQ ID NO: 1019668 - protein, 9 aa, Homo Sapiens
LGPDREKVC

SEQ ID NO: 1019669 - protein, 9 aa, Homo Sapiens
YLGNSMDPP

SEQ ID NO: 1019670 - protein, 9 aa, Homo Sapiens
LCRHERTHS

SEQ ID NO: 1019671 - protein, 9 aa, Homo Sapiens
EEKDFVLKI

SEQ ID NO: 1019672 - protein, 9 aa, Homo Sapiens
QHIKAHKVA

SEQ ID NO: 1019673 - protein, 9 aa, Homo Sapiens
EIPQVKPES

SEQ ID NO: 1019674 - protein, 9 aa, Homo Sapiens
VVCNTRQNE

SEQ ID NO: 1019675 - protein, 9 aa, Homo Sapiens
FVRPDLIII

SEQ ID NO: 1019676 - protein, 9 aa, Homo Sapiens
FFLKNPEAL

SEQ ID NO: 1019677 - protein, 9 aa, Homo Sapiens
YNILTQKDA

SEQ ID NO: 1019678 - protein, 9 aa, Homo Sapiens
PDREKVCLS

SEQ ID NO: 1019679 - protein, 9 aa, Homo Sapiens
SELSRRRIC

SEQ ID NO: 1019680 - protein, 9 aa, Homo Sapiens
FFRDRYETK

SEQ ID NO: 1019681 - protein, 9 aa, Homo Sapiens
VMNKTRALI

SEQ ID NO: 1019682 - protein, 9 aa, Homo Sapiens
IYTCNNESE

SEQ ID NO: 1019683 - protein, 9 aa, Homo Sapiens
GRYLRGTHS

SEQ ID NO: 1019684 - protein, 9 aa, Homo Sapiens
GQVCCSADQ

SEQ ID NO: 1019685 - protein, 9 aa, Homo Sapiens
LSGFVRPDL

SEQ ID NO: 1019686 - protein, 9 aa, Homo Sapiens
DEEDFSSPE

SEQ ID NO: 1019687 - protein, 9 aa, Homo Sapiens
HDILGDTSG

SEQ ID NO: 1019688 - protein, 9 aa, Homo Sapiens
GVVYFDKNE

SEQ ID NO: 1019689 - protein, 9 aa, Homo Sapiens
KIKSRYLED

SEQ ID NO: 1019690 - protein, 9 aa, Homo Sapiens
TGEEIYNVP

SEQ ID NO: 1019691 - protein, 9 aa, Homo Sapiens
MNKTRALID

SEQ ID NO: 1019692 - protein, 9 aa, Homo Sapiens
DMGGQMGEL

SEQ ID NO: 1019693 - protein, 9 aa, Homo Sapiens
HHIKPLPYY

SEQ ID NO: 1019694 - protein, 9 aa, Homo Sapiens
SGRRTPGNS

SEQ ID NO: 1019695 - protein, 9 aa, Homo Sapiens
DACDEDADE

SEQ ID NO: 1019696 - protein, 9 aa, Homo Sapiens
TKLRDKKWK

SEQ ID NO: 1019697 - protein, 9 aa, Homo Sapiens
SYSNDKPKV

SEQ ID NO: 1019698 - protein, 9 aa, Homo Sapiens
DFQDYGLCD

SEQ ID NO: 1019699 - protein, 9 aa, Homo Sapiens
FLLGPDREK

SEQ ID NO: 1019700 - protein, 9 aa, Homo Sapiens
KVFKYEFSE

SEQ ID NO: 1019701 - protein, 9 aa, Homo Sapiens
KMSENLNTE

SEQ ID NO: 1019702 - protein, 9 aa, Homo Sapiens
DNYNLREDA

SEQ ID NO: 1019703 - protein, 9 aa, Homo Sapiens
NSHGYIEET

SEQ ID NO: 1019704 - protein, 9 aa, Homo Sapiens
RYLNGLDSE

SEQ ID NO: 1019705 - protein, 9 aa, Homo Sapiens
RIQEIKRLS

SEQ ID NO: 1019706 - protein, 9 aa, Homo Sapiens
AGQFRGGPF

SEQ ID NO: 1019707 - protein, 9 aa, Homo Sapiens
LYDADIESK

SEQ ID NO: 1019708 - protein, 9 aa, Homo Sapiens
KGHQVKKVL

SEQ ID NO: 1019709 - protein, 9 aa, Homo Sapiens
AVKKYFQKI

SEQ ID NO: 1019710 - protein, 9 aa, Homo Sapiens
DRGNNRVRL

SEQ ID NO: 1019711 - protein, 9 aa, Homo Sapiens
GPDREKVCL

SEQ ID NO: 1019712 - protein, 9 aa, Homo Sapiens
KSWLRNVLR

SEQ ID NO: 1019713 - protein, 9 aa, Homo Sapiens
NPWPSSYVQ

SEQ ID NO: 1019714 - protein, 9 aa, Homo Sapiens
PRLHFLMYF

SEQ ID NO: 1019715 - protein, 9 aa, Homo Sapiens
DDSVFFPDP

SEQ ID NO: 1019716 - protein, 9 aa, Homo Sapiens
ILGDTSGDY

SEQ ID NO: 1019717 - protein, 9 aa, Homo Sapiens
AASLCLCSL

SEQ ID NO: 1019718 - protein, 9 aa, Homo Sapiens
TAMMSFKTG

SEQ ID NO: 1019719 - protein, 9 aa, Homo Sapiens
VISDPRLHF

SEQ ID NO: 1019720 - protein, 9 aa, Homo Sapiens
SIGFSYSLN

SEQ ID NO: 1019721 - protein, 9 aa, Homo Sapiens
VAKYRQAQL

SEQ ID NO: 1019722 - protein, 9 aa, Homo Sapiens
CSGQEQGQV

SEQ ID NO: 1019723 - protein, 9 aa, Homo Sapiens
GELSGTTTV

SEQ ID NO: 1019724 - protein, 9 aa, Homo Sapiens
ESLRNGCVK

SEQ ID NO: 1019725 - protein, 9 aa, Homo Sapiens
DPTSQRSAY

SEQ ID NO: 1019726 - protein, 9 aa, Homo Sapiens
SDPRLHFLM

SEQ ID NO: 1019727 - protein, 9 aa, Homo Sapiens
FFPDPMPYE

SEQ ID NO: 1019728 - protein, 9 aa, Homo Sapiens
VGPNFCVGK

SEQ ID NO: 1019729 - protein, 9 aa, Homo Sapiens
ETLGGREKF

SEQ ID NO: 1019730 - protein, 9 aa, Homo Sapiens
ELSATAQKI

SEQ ID NO: 1019731 - protein, 9 aa, Homo Sapiens
DHDPEKLTH

SEQ ID NO: 1019732 - protein, 9 aa, Homo Sapiens
PTGSLLSAE

SEQ ID NO: 1019733 - protein, 9 aa, Homo Sapiens
PGFPESKGE

SEQ ID NO: 1019734 - protein, 9 aa, Homo Sapiens
PNKSAYDVK

SEQ ID NO: 1019735 - protein, 9 aa, Homo Sapiens
EDLGSRGPS

SEQ ID NO: 1019736 - protein, 9 aa, Homo Sapiens
YYKDTISTI

SEQ ID NO: 1019737 - protein, 9 aa, Homo Sapiens
RPTGSLLSA

SEQ ID NO: 1019738 - protein, 9 aa, Homo Sapiens
STPPINMNP

SEQ ID NO: 1019739 - protein, 9 aa, Homo Sapiens
DYSNPWPSS

SEQ ID NO: 1019740 - protein, 9 aa, Homo Sapiens
GQALLKKWN

SEQ ID NO: 1019741 - protein, 9 aa, Homo Sapiens
AVGGSAEAP

SEQ ID NO: 1019742 - protein, 9 aa, Homo Sapiens
HHSSILRAE

SEQ ID NO: 1019743 - protein, 9 aa, Homo Sapiens
ILFFYILIL

SEQ ID NO: 1019744 - protein, 9 aa, Homo Sapiens
INSPMEANS

SEQ ID NO: 1019745 - protein, 9 aa, Homo Sapiens
DCNLLREQY

SEQ ID NO: 1019746 - protein, 9 aa, Homo Sapiens
RPFSSDPYG

SEQ ID NO: 1019747 - protein, 9 aa, Homo Sapiens
LEETLGGRE

SEQ ID NO: 1019748 - protein, 9 aa, Homo Sapiens
PDPNNLPAQ

SEQ ID NO: 1019749 - protein, 9 aa, Homo Sapiens
KKPTGIIRI

SEQ ID NO: 1019750 - protein, 9 aa, Homo Sapiens
ALVNIAPPE

SEQ ID NO: 1019751 - protein, 9 aa, Homo Sapiens
LGYNILTQK

SEQ ID NO: 1019752 - protein, 9 aa, Homo Sapiens
QLGDQRQEI

SEQ ID NO: 1019753 - protein, 9 aa, Homo Sapiens
QFLNLMKKL

SEQ ID NO: 1019754 - protein, 9 aa, Homo Sapiens
LEAGGYVSF

SEQ ID NO: 1019755 - protein, 9 aa, Homo Sapiens
SRKKRGADF

SEQ ID NO: 1019756 - protein, 9 aa, Homo Sapiens
ILVLRKEPP

SEQ ID NO: 1019757 - protein, 9 aa, Homo Sapiens
GLPGTKAEK

SEQ ID NO: 1019758 - protein, 9 aa, Homo Sapiens
LGKQLNANR

SEQ ID NO: 1019759 - protein, 9 aa, Homo Sapiens
FSRARLLQD

SEQ ID NO: 1019760 - protein, 9 aa, Homo Sapiens
SPGPSGPAL

SEQ ID NO: 1019761 - protein, 9 aa, Homo Sapiens
QVECWTPAS

SEQ ID NO: 1019762 - protein, 9 aa, Homo Sapiens
PTDKEWELI

SEQ ID NO: 1019763 - protein, 9 aa, Homo Sapiens
GSLAPASPP

SEQ ID NO: 1019764 - protein, 9 aa, Homo Sapiens
RHDCNLLRE

SEQ ID NO: 1019765 - protein, 9 aa, Homo Sapiens
RRRICSINK

SEQ ID NO: 1019766 - protein, 9 aa, Homo Sapiens
PESSEGEAE

SEQ ID NO: 1019767 - protein, 9 aa, Homo Sapiens
GTKAEKGRP

SEQ ID NO: 1019768 - protein, 9 aa, Homo Sapiens
QEITSILGY

SEQ ID NO: 1019769 - protein, 9 aa, Homo Sapiens
DIAENEMLG

SEQ ID NO: 1019770 - protein, 9 aa, Homo Sapiens
LDKDNSASL

SEQ ID NO: 1019771 - protein, 9 aa, Homo Sapiens
VQEFSKGTP

SEQ ID NO: 1019772 - protein, 9 aa, Homo Sapiens
QYLSTLQEK

SEQ ID NO: 1019773 - protein, 9 aa, Homo Sapiens
LSRRRICSI

SEQ ID NO: 1019774 - protein, 9 aa, Homo Sapiens
VKDQVIDSR

SEQ ID NO: 1019775 - protein, 9 aa, Homo Sapiens
VICKWNGEK

SEQ ID NO: 1019776 - protein, 9 aa, Homo Sapiens
ANRREILIN

SEQ ID NO: 1019777 - protein, 9 aa, Homo Sapiens
ARGLFHKAI

SEQ ID NO: 1019778 - protein, 9 aa, Homo Sapiens
FRGGPFISV

SEQ ID NO: 1019779 - protein, 9 aa, Homo Sapiens
TFPISDKPK

SEQ ID NO: 1019780 - protein, 9 aa, Homo Sapiens
ERHIFDFLG

SEQ ID NO: 1019781 - protein, 9 aa, Homo Sapiens
HSNILDNGQ

SEQ ID NO: 1019782 - protein, 9 aa, Homo Sapiens
IFKKLQGIS

SEQ ID NO: 1019783 - protein, 9 aa, Homo Sapiens
QHQFEDDVI

SEQ ID NO: 1019784 - protein, 9 aa, Homo Sapiens
PWADPEKTS

SEQ ID NO: 1019785 - protein, 9 aa, Homo Sapiens
PAPFKVEAL

SEQ ID NO: 1019786 - protein, 9 aa, Homo Sapiens
LAREDVFLA

SEQ ID NO: 1019787 - protein, 9 aa, Homo Sapiens
QGRLTFRNV

SEQ ID NO: 1019788 - protein, 9 aa, Homo Sapiens
LKKTGNEQK

SEQ ID NO: 1019789 - protein, 9 aa, Homo Sapiens
DYGLCDPPP

SEQ ID NO: 1019790 - protein, 9 aa, Homo Sapiens
EHLDLLECY

SEQ ID NO: 1019791 - protein, 9 aa, Homo Sapiens
RYVLGMRAA

SEQ ID NO: 1019792 - protein, 9 aa, Homo Sapiens
LVPDLYFDA

SEQ ID NO: 1019793 - protein, 9 aa, Homo Sapiens
IDKSTEDWM

SEQ ID NO: 1019794 - protein, 9 aa, Homo Sapiens
RTFYTGQPH

SEQ ID NO: 1019795 - protein, 9 aa, Homo Sapiens
QKLQAPRTQ

SEQ ID NO: 1019796 - protein, 9 aa, Homo Sapiens
VKSGRFKAE

SEQ ID NO: 1019797 - protein, 9 aa, Homo Sapiens
QAQLAGVLL

SEQ ID NO: 1019798 - protein, 9 aa, Homo Sapiens
FYAFIVAAI

SEQ ID NO: 1019799 - protein, 9 aa, Homo Sapiens
HLDLLECYF

SEQ ID NO: 1019800 - protein, 9 aa, Homo Sapiens
GFPESKGEP

SEQ ID NO: 1019801 - protein, 9 aa, Homo Sapiens
DTINEKVIE

SEQ ID NO: 1019802 - protein, 9 aa, Homo Sapiens
EEDDSDRPI

SEQ ID NO: 1019803 - protein, 9 aa, Homo Sapiens
YSNDKPKVW

SEQ ID NO: 1019804 - protein, 9 aa, Homo Sapiens
IVHRDLKIE

SEQ ID NO: 1019805 - protein, 9 aa, Homo Sapiens
LESLDKDNS

SEQ ID NO: 1019806 - protein, 9 aa, Homo Sapiens
TVVLSTNYA

SEQ ID NO: 1019807 - protein, 9 aa, Homo Sapiens
RVKWLRRSR

SEQ ID NO: 1019808 - protein, 9 aa, Homo Sapiens
EAPPLGPSQ

SEQ ID NO: 1019809 - protein, 9 aa, Homo Sapiens
FRLPPPLSQ

SEQ ID NO: 1019810 - protein, 9 aa, Homo Sapiens
VSYGEMVGW

SEQ ID NO: 1019811 - protein, 9 aa, Homo Sapiens
KNHMHLHTR

SEQ ID NO: 1019812 - protein, 9 aa, Homo Sapiens
KGACGFDGE

SEQ ID NO: 1019813 - protein, 9 aa, Homo Sapiens
PRGLQRDPG

SEQ ID NO: 1019814 - protein, 9 aa, Homo Sapiens
LVCTKAFCC

SEQ ID NO: 1019815 - protein, 9 aa, Homo Sapiens
TSQKNVRCP

SEQ ID NO: 1019816 - protein, 9 aa, Homo Sapiens
KHLDHDPEK

SEQ ID NO: 1019817 - protein, 9 aa, Homo Sapiens
GGSSKSRSL

SEQ ID NO: 1019818 - protein, 9 aa, Homo Sapiens
EVTEERAEA

SEQ ID NO: 1019819 - protein, 9 aa, Homo Sapiens
SHGYIEETC

SEQ ID NO: 1019820 - protein, 9 aa, Homo Sapiens
VPLAMQSSL

SEQ ID NO: 1019821 - protein, 9 aa, Homo Sapiens
IKNILSIGA

SEQ ID NO: 1019822 - protein, 9 aa, Homo Sapiens
DTLSQPQPG

SEQ ID NO: 1019823 - protein, 9 aa, Homo Sapiens
FYGAKPSTA

SEQ ID NO: 1019824 - protein, 9 aa, Homo Sapiens
DAPTLCLLL

SEQ ID NO: 1019825 - protein, 9 aa, Homo Sapiens
DDIYHSPFW

SEQ ID NO: 1019826 - protein, 9 aa, Homo Sapiens
DSSVIVHRD

SEQ ID NO: 1019827 - protein, 9 aa, Homo Sapiens
FSRSMEISE

SEQ ID NO: 1019828 - protein, 9 aa, Homo Sapiens
ESFWEKVAS

SEQ ID NO: 1019829 - protein, 9 aa, Homo Sapiens
KPLERFLKP

SEQ ID NO: 1019830 - protein, 9 aa, Homo Sapiens
VNCRMQHIT

SEQ ID NO: 1019831 - protein, 9 aa, Homo Sapiens
LSTLQEKKV

SEQ ID NO: 1019832 - protein, 9 aa, Homo Sapiens
SADSGALTS

SEQ ID NO: 1019833 - protein, 9 aa, Homo Sapiens
MIIWVLAFF

SEQ ID NO: 1019834 - protein, 9 aa, Homo Sapiens
QVAVKWRVV

SEQ ID NO: 1019835 - protein, 9 aa, Homo Sapiens
MKHLDHDPE

SEQ ID NO: 1019836 - protein, 9 aa, Homo Sapiens
GHARQGWAV

SEQ ID NO: 1019837 - protein, 9 aa, Homo Sapiens
ADRPLIAIF

SEQ ID NO: 1019838 - protein, 9 aa, Homo Sapiens
VLGMRAAQL

SEQ ID NO: 1019839 - protein, 9 aa, Homo Sapiens
VGVAASLCL

SEQ ID NO: 1019840 - protein, 9 aa, Homo Sapiens
PHWDVGSTD

SEQ ID NO: 1019841 - protein, 9 aa, Homo Sapiens
TKAFCCATV

SEQ ID NO: 1019842 - protein, 9 aa, Homo Sapiens
RELRGYLAT

SEQ ID NO: 1019843 - protein, 9 aa, Homo Sapiens
PSAGLRPSS

SEQ ID NO: 1019844 - protein, 9 aa, Homo Sapiens
PPNISQPDK

SEQ ID NO: 1019845 - protein, 9 aa, Homo Sapiens
ENEMLGLMR

SEQ ID NO: 1019846 - protein, 9 aa, Homo Sapiens
MMSFKTGKP

SEQ ID NO: 1019847 - protein, 9 aa, Homo Sapiens
HKVAQAKHK

SEQ ID NO: 1019848 - protein, 9 aa, Homo Sapiens
LDGTSFQGM

SEQ ID NO: 1019849 - protein, 9 aa, Homo Sapiens
GEKLFECSN

SEQ ID NO: 1019850 - protein, 9 aa, Homo Sapiens
YLATIKGMQ

SEQ ID NO: 1019851 - protein, 9 aa, Homo Sapiens
ASRGQSESR

SEQ ID NO: 1019852 - protein, 9 aa, Homo Sapiens
FQATDHTFL

SEQ ID NO: 1019853 - protein, 9 aa, Homo Sapiens
MSPTNRNHS

SEQ ID NO: 1019854 - protein, 9 aa, Homo Sapiens
VATTTSTAT

SEQ ID NO: 1019855 - protein, 9 aa, Homo Sapiens
KSQSALAYA

SEQ ID NO: 1019856 - protein, 9 aa, Homo Sapiens
LEDTQLWIF

SEQ ID NO: 1019857 - protein, 9 aa, Homo Sapiens
REQHIKAHK

SEQ ID NO: 1019858 - protein, 9 aa, Homo Sapiens
SYSLNEAPW

SEQ ID NO: 1019859 - protein, 9 aa, Homo Sapiens
FANRMQKFP

SEQ ID NO: 1019860 - protein, 9 aa, Homo Sapiens
LFFEIGSIS

SEQ ID NO: 1019861 - protein, 9 aa, Homo Sapiens
LDPEKILRK

SEQ ID NO: 1019862 - protein, 9 aa, Homo Sapiens
EVSNEVVTD

SEQ ID NO: 1019863 - protein, 9 aa, Homo Sapiens
TPDPSTSSR

SEQ ID NO: 1019864 - protein, 9 aa, Homo Sapiens
DDSDRPIEF

SEQ ID NO: 1019865 - protein, 9 aa, Homo Sapiens
LMKKLNENI

SEQ ID NO: 1019866 - protein, 9 aa, Homo Sapiens
WASSLKMNP

SEQ ID NO: 1019867 - protein, 9 aa, Homo Sapiens
APPLHEFMA

SEQ ID NO: 1019868 - protein, 9 aa, Homo Sapiens
PSSLCRHER

SEQ ID NO: 1019869 - protein, 9 aa, Homo Sapiens
FLNLMKKLN

SEQ ID NO: 1019870 - protein, 9 aa, Homo Sapiens
SFWEKVASG

SEQ ID NO: 1019871 - protein, 9 aa, Homo Sapiens
RLHGSAYLI

SEQ ID NO: 1019872 - protein, 9 aa, Homo Sapiens
CCHSSCYGG

SEQ ID NO: 1019873 - protein, 9 aa, Homo Sapiens
CHDFQDYGL

SEQ ID NO: 1019874 - protein, 9 aa, Homo Sapiens
PSSLNTALL

SEQ ID NO: 1019875 - protein, 9 aa, Homo Sapiens
SPMEANSDE

SEQ ID NO: 1019876 - protein, 9 aa, Homo Sapiens
YIGINAMLE

SEQ ID NO: 1019877 - protein, 9 aa, Homo Sapiens
FIKVGKNFP

SEQ ID NO: 1019878 - protein, 9 aa, Homo Sapiens
IPEQFRDMP

SEQ ID NO: 1019879 - protein, 9 aa, Homo Sapiens
DYLNIKNFG

SEQ ID NO: 1019880 - protein, 9 aa, Homo Sapiens
GGREKFENL

SEQ ID NO: 1019881 - protein, 9 aa, Homo Sapiens
PPGSAGSRG

SEQ ID NO: 1019882 - protein, 9 aa, Homo Sapiens
DGLQTPATL

SEQ ID NO: 1019883 - protein, 9 aa, Homo Sapiens
EILVLRKEP

SEQ ID NO: 1019884 - protein, 9 aa, Homo Sapiens
YMACMIIWV

SEQ ID NO: 1019885 - protein, 9 aa, Homo Sapiens
LMVGPNFCV

SEQ ID NO: 1019886 - protein, 9 aa, Homo Sapiens
GYIEETCII

SEQ ID NO: 1019887 - protein, 9 aa, Homo Sapiens
CNLLREQYE

SEQ ID NO: 1019888 - protein, 9 aa, Homo Sapiens
KSSTVVQEF

SEQ ID NO: 1019889 - protein, 9 aa, Homo Sapiens
VTKEGSTED

SEQ ID NO: 1019890 - protein, 9 aa, Homo Sapiens
KDSRIMRLC

SEQ ID NO: 1019891 - protein, 9 aa, Homo Sapiens
SLKIIFGID

SEQ ID NO: 1019892 - protein, 9 aa, Homo Sapiens
YLSTLQEKK

SEQ ID NO: 1019893 - protein, 9 aa, Homo Sapiens
QRQEITSIL

SEQ ID NO: 1019894 - protein, 9 aa, Homo Sapiens
QQPPNISQP

SEQ ID NO: 1019895 - protein, 9 aa, Homo Sapiens
DGVFLKDDA

SEQ ID NO: 1019896 - protein, 9 aa, Homo Sapiens
KELFVHGLP

SEQ ID NO: 1019897 - protein, 9 aa, Homo Sapiens
RSQVCIKLS

SEQ ID NO: 1019898 - protein, 9 aa, Homo Sapiens
SLDQFGPLN

SEQ ID NO: 1019899 - protein, 9 aa, Homo Sapiens
AFSGNLQLI

SEQ ID NO: 1019900 - protein, 9 aa, Homo Sapiens
IYKFHFSDL

SEQ ID NO: 1019901 - protein, 9 aa, Homo Sapiens
GFVYKLGEQ

SEQ ID NO: 1019902 - protein, 9 aa, Homo Sapiens
GTTRIILTT

SEQ ID NO: 1019903 - protein, 9 aa, Homo Sapiens
AAGLLWEAG

SEQ ID NO: 1019904 - protein, 9 aa, Homo Sapiens
FLPLSAIWA

SEQ ID NO: 1019905 - protein, 9 aa, Homo Sapiens
KMNPAGLEG

SEQ ID NO: 1019906 - protein, 9 aa, Homo Sapiens
ASGGSKEYK

SEQ ID NO: 1019907 - protein, 9 aa, Homo Sapiens
IKAHKVAQA

SEQ ID NO: 1019908 - protein, 9 aa, Homo Sapiens
LQSSRHDCN

SEQ ID NO: 1019909 - protein, 9 aa, Homo Sapiens
GELFFHLQQ

SEQ ID NO: 1019910 - protein, 9 aa, Homo Sapiens
IKKLDNYKK

SEQ ID NO: 1019911 - protein, 9 aa, Homo Sapiens
QFLMDYQFI

SEQ ID NO: 1019912 - protein, 9 aa, Homo Sapiens
GGPFISVHP

SEQ ID NO: 1019913 - protein, 9 aa, Homo Sapiens
YSCCHSSCY

SEQ ID NO: 1019914 - protein, 9 aa, Homo Sapiens
YVLGMRAAQ

SEQ ID NO: 1019915 - protein, 9 aa, Homo Sapiens
DMFKKLDSE

SEQ ID NO: 1019916 - protein, 9 aa, Homo Sapiens
SAGSRGDGG

SEQ ID NO: 1019917 - protein, 9 aa, Homo Sapiens
AQKIIKSQA

SEQ ID NO: 1019918 - protein, 9 aa, Homo Sapiens
ATMKSRWSG

SEQ ID NO: 1019919 - protein, 9 aa, Homo Sapiens
KKVLIQDSS

SEQ ID NO: 1019920 - protein, 9 aa, Homo Sapiens
AGLRPMALR

SEQ ID NO: 1019921 - protein, 9 aa, Homo Sapiens
SLKMNPAGL

SEQ ID NO: 1019922 - protein, 9 aa, Homo Sapiens
KEDAERYLC

SEQ ID NO: 1019923 - protein, 9 aa, Homo Sapiens
LHTRDRPYE

SEQ ID NO: 1019924 - protein, 9 aa, Homo Sapiens
NEQKWKIKL

SEQ ID NO: 1019925 - protein, 9 aa, Homo Sapiens
IVPLFSRSM

SEQ ID NO: 1019926 - protein, 9 aa, Homo Sapiens
DPGSAPSSA

SEQ ID NO: 1019927 - protein, 9 aa, Homo Sapiens
ATTGVPGQL

SEQ ID NO: 1019928 - protein, 9 aa, Homo Sapiens
DPNKPQKPV

SEQ ID NO: 1019929 - protein, 9 aa, Homo Sapiens
LKIYTCNNE

SEQ ID NO: 1019930 - protein, 9 aa, Homo Sapiens
FQGMVTFED

SEQ ID NO: 1019931 - protein, 9 aa, Homo Sapiens
FIAWTDRGM

SEQ ID NO: 1019932 - protein, 9 aa, Homo Sapiens
SVVNTATTS

SEQ ID NO: 1019933 - protein, 9 aa, Homo Sapiens
IEVSNEVVT

SEQ ID NO: 1019934 - protein, 9 aa, Homo Sapiens
YKSVSEVCV

SEQ ID NO: 1019935 - protein, 9 aa, Homo Sapiens
VNIQGGNEE

SEQ ID NO: 1019936 - protein, 9 aa, Homo Sapiens
SAAAGLRPM

SEQ ID NO: 1019937 - protein, 9 aa, Homo Sapiens
PKEFLLESS

SEQ ID NO: 1019938 - protein, 9 aa, Homo Sapiens
FSTIFLVFV

SEQ ID NO: 1019939 - protein, 9 aa, Homo Sapiens
IIQTAMMSF

SEQ ID NO: 1019940 - protein, 9 aa, Homo Sapiens
KEGNMSREN

SEQ ID NO: 1019941 - protein, 9 aa, Homo Sapiens
TSSIGGIFS

SEQ ID NO: 1019942 - protein, 9 aa, Homo Sapiens
VLFLLEWNV

SEQ ID NO: 1019943 - protein, 9 aa, Homo Sapiens
LPNPQDIIS

SEQ ID NO: 1019944 - protein, 9 aa, Homo Sapiens
KDAQSVYDA

SEQ ID NO: 1019945 - protein, 9 aa, Homo Sapiens
WSLLNVAQR

SEQ ID NO: 1019946 - protein, 9 aa, Homo Sapiens
QKNVRCPWC

SEQ ID NO: 1019947 - protein, 9 aa, Homo Sapiens
QEIKRLSPE

SEQ ID NO: 1019948 - protein, 9 aa, Homo Sapiens
FTRSNRLSL

SEQ ID NO: 1019949 - protein, 9 aa, Homo Sapiens
YVTVPLAMQ

SEQ ID NO: 1019950 - protein, 9 aa, Homo Sapiens
KCSAKNGSC

SEQ ID NO: 1019951 - protein, 9 aa, Homo Sapiens
ALNKIDAGV

SEQ ID NO: 1019952 - protein, 9 aa, Homo Sapiens
DWPEDQVLM

SEQ ID NO: 1019953 - protein, 9 aa, Homo Sapiens
SKDYSVTVS

SEQ ID NO: 1019954 - protein, 9 aa, Homo Sapiens
LVLRKEPPH

SEQ ID NO: 1019955 - protein, 9 aa, Homo Sapiens
KPQKPVSAY

SEQ ID NO: 1019956 - protein, 9 aa, Homo Sapiens
LEGEIEHLD

SEQ ID NO: 1019957 - protein, 9 aa, Homo Sapiens
EIEHLDLLE

SEQ ID NO: 1019958 - protein, 9 aa, Homo Sapiens
NNLPAQESI

SEQ ID NO: 1019959 - protein, 9 aa, Homo Sapiens
CSLYANLAK

SEQ ID NO: 1019960 - protein, 9 aa, Homo Sapiens
ILKHWTGGC

SEQ ID NO: 1019961 - protein, 9 aa, Homo Sapiens
VVGFFLCFT

SEQ ID NO: 1019962 - protein, 9 aa, Homo Sapiens
VPNNGEQKV

SEQ ID NO: 1019963 - protein, 9 aa, Homo Sapiens
NVAIEFSLA

SEQ ID NO: 1019964 - protein, 9 aa, Homo Sapiens
VAAAVATTT

SEQ ID NO: 1019965 - protein, 9 aa, Homo Sapiens
DPGPRGLQR

SEQ ID NO: 1019966 - protein, 9 aa, Homo Sapiens
QEKKEEKPE

SEQ ID NO: 1019967 - protein, 9 aa, Homo Sapiens
EFSENEQRR

SEQ ID NO: 1019968 - protein, 9 aa, Homo Sapiens
TQLWIFFPF

SEQ ID NO: 1019969 - protein, 9 aa, Homo Sapiens
WPGKSQKIK

SEQ ID NO: 1019970 - protein, 9 aa, Homo Sapiens
SCLHSHAEA

SEQ ID NO: 1019971 - protein, 9 aa, Homo Sapiens
HHTVILLSE

SEQ ID NO: 1019972 - protein, 9 aa, Homo Sapiens
MGGQMGELS

SEQ ID NO: 1019973 - protein, 9 aa, Homo Sapiens
AKPSTAPAT

SEQ ID NO: 1019974 - protein, 9 aa, Homo Sapiens
GFSYSLNEA

SEQ ID NO: 1019975 - protein, 9 aa, Homo Sapiens
KLLSPQEPP

SEQ ID NO: 1019976 - protein, 9 aa, Homo Sapiens
SVQCCLMGF

SEQ ID NO: 1019977 - protein, 9 aa, Homo Sapiens
FLHETVLDR

SEQ ID NO: 1019978 - protein, 9 aa, Homo Sapiens
EDAMRHTIV

SEQ ID NO: 1019979 - protein, 9 aa, Homo Sapiens
ELSRRRICS

SEQ ID NO: 1019980 - protein, 9 aa, Homo Sapiens
VPLFSRSME

SEQ ID NO: 1019981 - protein, 9 aa, Homo Sapiens
VTPDPSTSS

SEQ ID NO: 1019982 - protein, 9 aa, Homo Sapiens
GVAKYRQAQ

SEQ ID NO: 1019983 - protein, 9 aa, Homo Sapiens
QNESWGPEE

SEQ ID NO: 1019984 - protein, 9 aa, Homo Sapiens
SRSLRKNKE

SEQ ID NO: 1019985 - protein, 9 aa, Homo Sapiens
FDEIREIFL

SEQ ID NO: 1019986 - protein, 9 aa, Homo Sapiens
LSKSGRRAQ

SEQ ID NO: 1019987 - protein, 9 aa, Homo Sapiens
PATLESQND

SEQ ID NO: 1019988 - protein, 9 aa, Homo Sapiens
LCENPESSF

SEQ ID NO: 1019989 - protein, 9 aa, Homo Sapiens
KENVICLGK

SEQ ID NO: 1019990 - protein, 9 aa, Homo Sapiens
MEMIFKKLQ

SEQ ID NO: 1019991 - protein, 9 aa, Homo Sapiens
APVPDPNNL

SEQ ID NO: 1019992 - protein, 9 aa, Homo Sapiens
HDPEKLTHH

SEQ ID NO: 1019993 - protein, 9 aa, Homo Sapiens
HQFEDDVIL

SEQ ID NO: 1019994 - protein, 9 aa, Homo Sapiens
FDIYKFHFS

SEQ ID NO: 1019995 - protein, 9 aa, Homo Sapiens
LLQSHSSVE

SEQ ID NO: 1019996 - protein, 9 aa, Homo Sapiens
QEQGQVCCS

SEQ ID NO: 1019997 - protein, 9 aa, Homo Sapiens
LPRGQALLK

SEQ ID NO: 1019998 - protein, 9 aa, Homo Sapiens
NNSSISIKK

SEQ ID NO: 1019999 - protein, 9 aa, Homo Sapiens
GGRTTFRLP

SEQ ID NO: 1020000 - protein, 9 aa, Homo Sapiens
RDKKWKMSG

SEQ ID NO: 1020001 - protein, 9 aa, Homo Sapiens
NMSRENSLF

SEQ ID NO: 1020002 - protein, 9 aa, Homo Sapiens
THSSFANGI

SEQ ID NO: 1020003 - protein, 9 aa, Homo Sapiens
IDANIFLVL

SEQ ID NO: 1020004 - protein, 9 aa, Homo Sapiens
GFIKKEERP

SEQ ID NO: 1020005 - protein, 9 aa, Homo Sapiens
QAVTYAAVK

SEQ ID NO: 1020006 - protein, 9 aa, Homo Sapiens
MHLHTRDRP

SEQ ID NO: 1020007 - protein, 9 aa, Homo Sapiens
ARVSPRDLA

SEQ ID NO: 1020008 - protein, 9 aa, Homo Sapiens
AWASSLKMN

SEQ ID NO: 1020009 - protein, 9 aa, Homo Sapiens
RLTSTLLQS

SEQ ID NO: 1020010 - protein, 9 aa, Homo Sapiens
TRTSSTEEN

SEQ ID NO: 1020011 - protein, 9 aa, Homo Sapiens
FGEDAMRHT

SEQ ID NO: 1020012 - protein, 9 aa, Homo Sapiens
PGAPGFPES

SEQ ID NO: 1020013 - protein, 9 aa, Homo Sapiens
GFDGEKGDK

SEQ ID NO: 1020014 - protein, 9 aa, Homo Sapiens
ATIKGMQEA

SEQ ID NO: 1020015 - protein, 9 aa, Homo Sapiens
LVRAQKAAG

SEQ ID NO: 1020016 - protein, 9 aa, Homo Sapiens
TLEWDNYNL

SEQ ID NO: 1020017 - protein, 9 aa, Homo Sapiens
ASAENLLKK

SEQ ID NO: 1020018 - protein, 9 aa, Homo Sapiens
VPDPNNLPA

SEQ ID NO: 1020019 - protein, 9 aa, Homo Sapiens
IWWTGRPIS

SEQ ID NO: 1020020 - protein, 9 aa, Homo Sapiens
TVIIQEPQG

SEQ ID NO: 1020021 - protein, 9 aa, Homo Sapiens
DMSNNCISV

SEQ ID NO: 1020022 - protein, 9 aa, Homo Sapiens
DVFLANALL

SEQ ID NO: 1020023 - protein, 9 aa, Homo Sapiens
IWNLNPVFG

SEQ ID NO: 1020024 - protein, 9 aa, Homo Sapiens
FEDDVILDD

SEQ ID NO: 1020025 - protein, 9 aa, Homo Sapiens
EDEDDDENG

SEQ ID NO: 1020026 - protein, 9 aa, Homo Sapiens
NAMLEGLEA

SEQ ID NO: 1020027 - protein, 9 aa, Homo Sapiens
TPSQHSNIL

SEQ ID NO: 1020028 - protein, 9 aa, Homo Sapiens
ATRTFYTGQ

SEQ ID NO: 1020029 - protein, 9 aa, Homo Sapiens
GLVKSGRFK

SEQ ID NO: 1020030 - protein, 9 aa, Homo Sapiens
ETKKFYTLK

SEQ ID NO: 1020031 - protein, 9 aa, Homo Sapiens
GSESPHSGR

SEQ ID NO: 1020032 - protein, 9 aa, Homo Sapiens
QTWLFQATD

SEQ ID NO: 1020033 - protein, 9 aa, Homo Sapiens
TGGCPFREG

SEQ ID NO: 1020034 - protein, 9 aa, Homo Sapiens
PNISQPDKV

SEQ ID NO: 1020035 - protein, 9 aa, Homo Sapiens
NVRGIKKLD

SEQ ID NO: 1020036 - protein, 9 aa, Homo Sapiens
SEFPKGAIG

SEQ ID NO: 1020037 - protein, 9 aa, Homo Sapiens
LRPMALRPP

SEQ ID NO: 1020038 - protein, 9 aa, Homo Sapiens
MKSRWSGSH

SEQ ID NO: 1020039 - protein, 9 aa, Homo Sapiens
SSSSGLLDT

SEQ ID NO: 1020040 - protein, 9 aa, Homo Sapiens
VGSSSCLHS

SEQ ID NO: 1020041 - protein, 9 aa, Homo Sapiens
LGEQFFPGH

SEQ ID NO: 1020042 - protein, 9 aa, Homo Sapiens
RSLRKNKEL

SEQ ID NO: 1020043 - protein, 9 aa, Homo Sapiens
AAAGLLWEA

SEQ ID NO: 1020044 - protein, 9 aa, Homo Sapiens
FSQENIHCS

SEQ ID NO: 1020045 - protein, 9 aa, Homo Sapiens
LKQERRAEA

SEQ ID NO: 1020046 - protein, 9 aa, Homo Sapiens
ATEALVNIA

SEQ ID NO: 1020047 - protein, 9 aa, Homo Sapiens
RGIKKLDNY

SEQ ID NO: 1020048 - protein, 9 aa, Homo Sapiens
NRTEKDVSQ

SEQ ID NO: 1020049 - protein, 9 aa, Homo Sapiens
DANKGDELK

SEQ ID NO: 1020050 - protein, 9 aa, Homo Sapiens
FFSTIFLVF

SEQ ID NO: 1020051 - protein, 9 aa, Homo Sapiens
PPKEFLLES

SEQ ID NO: 1020052 - protein, 9 aa, Homo Sapiens
RGLPNPQDI

SEQ ID NO: 1020053 - protein, 9 aa, Homo Sapiens
FPISDKPKR

SEQ ID NO: 1020054 - protein, 9 aa, Homo Sapiens
SWYKDGVFL

SEQ ID NO: 1020055 - protein, 9 aa, Homo Sapiens
QPPNISQPD

SEQ ID NO: 1020056 - protein, 9 aa, Homo Sapiens
LTWLEDHSF

SEQ ID NO: 1020057 - protein, 9 aa, Homo Sapiens
KQERRAEAQ

SEQ ID NO: 1020058 - protein, 9 aa, Homo Sapiens
SDRPIEFSS

SEQ ID NO: 1020059 - protein, 9 aa, Homo Sapiens
SRRRICSIN

SEQ ID NO: 1020060 - protein, 9 aa, Homo Sapiens
VSCLSICIF

SEQ ID NO: 1020061 - protein, 9 aa, Homo Sapiens
YHSPFWEAR

SEQ ID NO: 1020062 - protein, 9 aa, Homo Sapiens
WDPRAARVS

SEQ ID NO: 1020063 - protein, 9 aa, Homo Sapiens
KYGRLNSEE

SEQ ID NO: 1020064 - protein, 9 aa, Homo Sapiens
LWEAGSGGR

SEQ ID NO: 1020065 - protein, 9 aa, Homo Sapiens
LEWNVWGSW

SEQ ID NO: 1020066 - protein, 9 aa, Homo Sapiens
IPSFFTSVD

SEQ ID NO: 1020067 - protein, 9 aa, Homo Sapiens
AVTVGLKQG

SEQ ID NO: 1020068 - protein, 9 aa, Homo Sapiens
SFVGDGDMF

SEQ ID NO: 1020069 - protein, 9 aa, Homo Sapiens
PGPSGPALT

SEQ ID NO: 1020070 - protein, 9 aa, Homo Sapiens
SFRVKWLRR

SEQ ID NO: 1020071 - protein, 9 aa, Homo Sapiens
PVVARVNCR

SEQ ID NO: 1020072 - protein, 9 aa, Homo Sapiens
RVNCRMQHI

SEQ ID NO: 1020073 - protein, 9 aa, Homo Sapiens
CSADQQEEG

SEQ ID NO: 1020074 - protein, 9 aa, Homo Sapiens
PPPLSQYSV

SEQ ID NO: 1020075 - protein, 9 aa, Homo Sapiens
SLDKDNSAS

SEQ ID NO: 1020076 - protein, 9 aa, Homo Sapiens
HERGHHTVI

SEQ ID NO: 1020077 - protein, 9 aa, Homo Sapiens
QADPGSAPS

SEQ ID NO: 1020078 - protein, 9 aa, Homo Sapiens
FPKGAIGHI

SEQ ID NO: 1020079 - protein, 9 aa, Homo Sapiens
TLLESLDKD

SEQ ID NO: 1020080 - protein, 9 aa, Homo Sapiens
RHDAPTLCL

SEQ ID NO: 1020081 - protein, 9 aa, Homo Sapiens
FDREIQQAL

SEQ ID NO: 1020082 - protein, 9 aa, Homo Sapiens
EEHSGLAGL

SEQ ID NO: 1020083 - protein, 9 aa, Homo Sapiens
IDWDSREKL

SEQ ID NO: 1020084 - protein, 9 aa, Homo Sapiens
VIQNDKLAF

SEQ ID NO: 1020085 - protein, 9 aa, Homo Sapiens
MDYQFIKLI

SEQ ID NO: 1020086 - protein, 9 aa, Homo Sapiens
NLLREQYEE

SEQ ID NO: 1020087 - protein, 9 aa, Homo Sapiens
ILRAEGINC

SEQ ID NO: 1020088 - protein, 9 aa, Homo Sapiens
ENFTKEAST

SEQ ID NO: 1020089 - protein, 9 aa, Homo Sapiens
FVHVLKTND

SEQ ID NO: 1020090 - protein, 9 aa, Homo Sapiens
RRNALYERA

SEQ ID NO: 1020091 - protein, 9 aa, Homo Sapiens
RTTFRLPPP

SEQ ID NO: 1020092 - protein, 9 aa, Homo Sapiens
VLKIYTCNN

SEQ ID NO: 1020093 - protein, 9 aa, Homo Sapiens
LGGREKFEN

SEQ ID NO: 1020094 - protein, 9 aa, Homo Sapiens
EAQQGHRPY

SEQ ID NO: 1020095 - protein, 9 aa, Homo Sapiens
TFSKPCFTA

SEQ ID NO: 1020096 - protein, 9 aa, Homo Sapiens
NAIIGNVLI

SEQ ID NO: 1020097 - protein, 9 aa, Homo Sapiens
QGWAVGTFL

SEQ ID NO: 1020098 - protein, 9 aa, Homo Sapiens
SVHHSSILR

SEQ ID NO: 1020099 - protein, 9 aa, Homo Sapiens
KKKKDPNKP

SEQ ID NO: 1020100 - protein, 9 aa, Homo Sapiens
WLVRAQKAA

SEQ ID NO: 1020101 - protein, 9 aa, Homo Sapiens
GLVCTKAFC

SEQ ID NO: 1020102 - protein, 9 aa, Homo Sapiens
EENQLTWLE

SEQ ID NO: 1020103 - protein, 9 aa, Homo Sapiens
TYRNFMRQS

SEQ ID NO: 1020104 - protein, 9 aa, Homo Sapiens
REANEFRRG

SEQ ID NO: 1020105 - protein, 9 aa, Homo Sapiens
QGRPLNNMK

SEQ ID NO: 1020106 - protein, 9 aa, Homo Sapiens
YLLCQNQVL

SEQ ID NO: 1020107 - protein, 9 aa, Homo Sapiens
GEQKVPNES

SEQ ID NO: 1020108 - protein, 9 aa, Homo Sapiens
ASEADEDAA

SEQ ID NO: 1020109 - protein, 9 aa, Homo Sapiens
SFKTGKPGN

SEQ ID NO: 1020110 - protein, 9 aa, Homo Sapiens
IILTTNGGQ

SEQ ID NO: 1020111 - protein, 9 aa, Homo Sapiens
DDFHRVTKE

SEQ ID NO: 1020112 - protein, 9 aa, Homo Sapiens
VIDKSTEDW

SEQ ID NO: 1020113 - protein, 9 aa, Homo Sapiens
PKDTINEKV

SEQ ID NO: 1020114 - protein, 9 aa, Homo Sapiens
ILLSEGRDI

SEQ ID NO: 1020115 - protein, 9 aa, Homo Sapiens
KVVSCLSIC

SEQ ID NO: 1020116 - protein, 9 aa, Homo Sapiens
LQEKKEEKP

SEQ ID NO: 1020117 - protein, 9 aa, Homo Sapiens
GLDYSNPWP

SEQ ID NO: 1020118 - protein, 9 aa, Homo Sapiens
SGELLASFK

SEQ ID NO: 1020119 - protein, 9 aa, Homo Sapiens
PPESLRNGC

SEQ ID NO: 1020120 - protein, 9 aa, Homo Sapiens
RYETKQREL

SEQ ID NO: 1020121 - protein, 9 aa, Homo Sapiens
NIKLYNNNR

SEQ ID NO: 1020122 - protein, 9 aa, Homo Sapiens
AYMACMIIW

SEQ ID NO: 1020123 - protein, 9 aa, Homo Sapiens
DSFLGEGPG

SEQ ID NO: 1020124 - protein, 9 aa, Homo Sapiens
GPSGPALTS

SEQ ID NO: 1020125 - protein, 9 aa, Homo Sapiens
QPGHANLKP

SEQ ID NO: 1020126 - protein, 9 aa, Homo Sapiens
EMPHHIKPL

SEQ ID NO: 1020127 - protein, 9 aa, Homo Sapiens
IQEIKRLSP

SEQ ID NO: 1020128 - protein, 9 aa, Homo Sapiens
MQSSLRHNA

SEQ ID NO: 1020129 - protein, 9 aa, Homo Sapiens
QKIIKSQAI

SEQ ID NO: 1020130 - protein, 9 aa, Homo Sapiens
LTFQQPPNI

SEQ ID NO: 1020131 - protein, 9 aa, Homo Sapiens
SLAPASPPP

SEQ ID NO: 1020132 - protein, 9 aa, Homo Sapiens
RTVIIQEPQ

SEQ ID NO: 1020133 - protein, 9 aa, Homo Sapiens
PVPDPNNLP

SEQ ID NO: 1020134 - protein, 9 aa, Homo Sapiens
PERSRTLHF

SEQ ID NO: 1020135 - protein, 9 aa, Homo Sapiens
EEWSLLNVA

SEQ ID NO: 1020136 - protein, 9 aa, Homo Sapiens
LKDAKKDAK

SEQ ID NO: 1020137 - protein, 9 aa, Homo Sapiens
TELVTFAQE

SEQ ID NO: 1020138 - protein, 9 aa, Homo Sapiens
SSAAAGLRP

SEQ ID NO: 1020139 - protein, 9 aa, Homo Sapiens
RVRLAPAVP

SEQ ID NO: 1020140 - protein, 9 aa, Homo Sapiens
AYALQKAQR

SEQ ID NO: 1020141 - protein, 9 aa, Homo Sapiens
TSSTEENFT

SEQ ID NO: 1020142 - protein, 9 aa, Homo Sapiens
YIEETCIIP

SEQ ID NO: 1020143 - protein, 9 aa, Homo Sapiens
ASPGPSGPA

SEQ ID NO: 1020144 - protein, 9 aa, Homo Sapiens
VTYAAVKHS

SEQ ID NO: 1020145 - protein, 9 aa, Homo Sapiens
ETQSTSEEL

SEQ ID NO: 1020146 - protein, 9 aa, Homo Sapiens
LNIKNFGAK

SEQ ID NO: 1020147 - protein, 9 aa, Homo Sapiens
VARVNCRMQ

SEQ ID NO: 1020148 - protein, 9 aa, Homo Sapiens
TVGSSSCLH

SEQ ID NO: 1020149 - protein, 9 aa, Homo Sapiens
RTSQKNVRC

SEQ ID NO: 1020150 - protein, 9 aa, Homo Sapiens
LLPTSSTRI

SEQ ID NO: 1020151 - protein, 9 aa, Homo Sapiens
IAWTDRGME

SEQ ID NO: 1020152 - protein, 9 aa, Homo Sapiens
ATVMNKTRA

SEQ ID NO: 1020153 - protein, 9 aa, Homo Sapiens
ESSEGEAEA

SEQ ID NO: 1020154 - protein, 9 aa, Homo Sapiens
MKDSRIMRL

SEQ ID NO: 1020155 - protein, 9 aa, Homo Sapiens
KSTLVQRQR

SEQ ID NO: 1020156 - protein, 9 aa, Homo Sapiens
KPSTAPATP

SEQ ID NO: 1020157 - protein, 9 aa, Homo Sapiens
KEGSTEDAS

SEQ ID NO: 1020158 - protein, 9 aa, Homo Sapiens
KDLNDFIRV

SEQ ID NO: 1020159 - protein, 9 aa, Homo Sapiens
GEQFFPGHS

SEQ ID NO: 1020160 - protein, 9 aa, Homo Sapiens
TRTFYTGQP

SEQ ID NO: 1020161 - protein, 9 aa, Homo Sapiens
PLQDQAGNE

SEQ ID NO: 1020162 - protein, 9 aa, Homo Sapiens
QSPERSRTL

SEQ ID NO: 1020163 - protein, 9 aa, Homo Sapiens
TKPTDPTSQ

SEQ ID NO: 1020164 - protein, 9 aa, Homo Sapiens
TDKEWELIK

SEQ ID NO: 1020165 - protein, 9 aa, Homo Sapiens
FLGEGPGPE

SEQ ID NO: 1020166 - protein, 9 aa, Homo Sapiens
SSVHHSSIL

SEQ ID NO: 1020167 - protein, 9 aa, Homo Sapiens
SLRKNKELF

SEQ ID NO: 1020168 - protein, 9 aa, Homo Sapiens
GQEQGQVCC

SEQ ID NO: 1020169 - protein, 9 aa, Homo Sapiens
MATAFREER

SEQ ID NO: 1020170 - protein, 9 aa, Homo Sapiens
EKLFECSNC

SEQ ID NO: 1020171 - protein, 9 aa, Homo Sapiens
LPPPLSQYS

SEQ ID NO: 1020172 - protein, 9 aa, Homo Sapiens
TPATLESQN

SEQ ID NO: 1020173 - protein, 9 aa, Homo Sapiens
LSICIFPDK

SEQ ID NO: 1020174 - protein, 9 aa, Homo Sapiens
SRLSASQIW

SEQ ID NO: 1020175 - protein, 9 aa, Homo Sapiens
TLNDSSVIV

SEQ ID NO: 1020176 - protein, 9 aa, Homo Sapiens
VCCSADQQE

SEQ ID NO: 1020177 - protein, 9 aa, Homo Sapiens
PAVLSKKTI

SEQ ID NO: 1020178 - protein, 9 aa, Homo Sapiens
KQNFLQGHG

SEQ ID NO: 1020179 - protein, 9 aa, Homo Sapiens
TGIIRIHQM

SEQ ID NO: 1020180 - protein, 9 aa, Homo Sapiens
VSLFVHVLK

SEQ ID NO: 1020181 - protein, 9 aa, Homo Sapiens
EGEIEHLDL

SEQ ID NO: 1020182 - protein, 9 aa, Homo Sapiens
EERAEAAAA

SEQ ID NO: 1020183 - protein, 9 aa, Homo Sapiens
RKKRGADFG

SEQ ID NO: 1020184 - protein, 9 aa, Homo Sapiens
TFYTGQPHL

SEQ ID NO: 1020185 - protein, 9 aa, Homo Sapiens
EFLLESSSA

SEQ ID NO: 1020186 - protein, 9 aa, Homo Sapiens
TSEELCTPA

SEQ ID NO: 1020187 - protein, 9 aa, Homo Sapiens
KRIHIRENF

SEQ ID NO: 1020188 - protein, 9 aa, Homo Sapiens
NHMHLHTRD

SEQ ID NO: 1020189 - protein, 9 aa, Homo Sapiens
MSFKTGKPG

SEQ ID NO: 1020190 - protein, 9 aa, Homo Sapiens
MCQPGYTMK

SEQ ID NO: 1020191 - protein, 9 aa, Homo Sapiens
EGSTEDASQ

SEQ ID NO: 1020192 - protein, 9 aa, Homo Sapiens
LTRIAVAFS

SEQ ID NO: 1020193 - protein, 9 aa, Homo Sapiens
DSDRPIEFS

SEQ ID NO: 1020194 - protein, 9 aa, Homo Sapiens
LKPLERFLK

SEQ ID NO: 1020195 - protein, 9 aa, Homo Sapiens
KKTIRRRET

SEQ ID NO: 1020196 - protein, 9 aa, Homo Sapiens
SVKDQVIDS

SEQ ID NO: 1020197 - protein, 9 aa, Homo Sapiens
RTKLRDKKW

SEQ ID NO: 1020198 - protein, 9 aa, Homo Sapiens
LKCSAKNGS

SEQ ID NO: 1020199 - protein, 9 aa, Homo Sapiens
AEGPRGGLK

SEQ ID NO: 1020200 - protein, 9 aa, Homo Sapiens
NMCSERIEI

SEQ ID NO: 1020201 - protein, 9 aa, Homo Sapiens
FLLILLFYA

SEQ ID NO: 1020202 - protein, 9 aa, Homo Sapiens
DEIREIFLP

SEQ ID NO: 1020203 - protein, 9 aa, Homo Sapiens
AAGLRPMAL

SEQ ID NO: 1020204 - protein, 9 aa, Homo Sapiens
SGWGPCAIP

SEQ ID NO: 1020205 - protein, 9 aa, Homo Sapiens
VFFPDPMPY

SEQ ID NO: 1020206 - protein, 9 aa, Homo Sapiens
TKENVICLG

SEQ ID NO: 1020207 - protein, 9 aa, Homo Sapiens
LSASQIWNL

SEQ ID NO: 1020208 - protein, 9 aa, Homo Sapiens
QNVRGIKKL

SEQ ID NO: 1020209 - protein, 9 aa, Homo Sapiens
VVLSTNYAN

SEQ ID NO: 1020210 - protein, 9 aa, Homo Sapiens
SCEVRPGPE

SEQ ID NO: 1020211 - protein, 9 aa, Homo Sapiens
KRENATVMN

SEQ ID NO: 1020212 - protein, 9 aa, Homo Sapiens
SQDTDSLLS

SEQ ID NO: 1020213 - protein, 9 aa, Homo Sapiens
MQKFPCYIP

SEQ ID NO: 1020214 - protein, 9 aa, Homo Sapiens
MDEEHSGLA

SEQ ID NO: 1020215 - protein, 9 aa, Homo Sapiens
SSRLACHVM

SEQ ID NO: 1020216 - protein, 9 aa, Homo Sapiens
KEYKVVMLG

SEQ ID NO: 1020217 - protein, 9 aa, Homo Sapiens
FPNIKLYNN

SEQ ID NO: 1020218 - protein, 9 aa, Homo Sapiens
RGQSESRSA

SEQ ID NO: 1020219 - protein, 9 aa, Homo Sapiens
VPDLYFDAF

SEQ ID NO: 1020220 - protein, 9 aa, Homo Sapiens
KILFRAGVL

SEQ ID NO: 1020221 - protein, 9 aa, Homo Sapiens
FLPRPFSSD

SEQ ID NO: 1020222 - protein, 9 aa, Homo Sapiens
VIEVSNEVV

SEQ ID NO: 1020223 - protein, 9 aa, Homo Sapiens
LLSKSGRRA

SEQ ID NO: 1020224 - protein, 9 aa, Homo Sapiens
GTVICKWNG

SEQ ID NO: 1020225 - protein, 9 aa, Homo Sapiens
CARHDAPTL

SEQ ID NO: 1020226 - protein, 9 aa, Homo Sapiens
TGTSEDLGS

SEQ ID NO: 1020227 - protein, 9 aa, Homo Sapiens
VITIKNILS

SEQ ID NO: 1020228 - protein, 9 aa, Homo Sapiens
AFTETKENV

SEQ ID NO: 1020229 - protein, 9 aa, Homo Sapiens
GSYSNDKPK

SEQ ID NO: 1020230 - protein, 9 aa, Homo Sapiens
PPKPHASLP

SEQ ID NO: 1020231 - protein, 9 aa, Homo Sapiens
DLASAENLL

SEQ ID NO: 1020232 - protein, 9 aa, Homo Sapiens
EEGQRQGEG

SEQ ID NO: 1020233 - protein, 9 aa, Homo Sapiens
EFRRGRSTV

SEQ ID NO: 1020234 - protein, 9 aa, Homo Sapiens
PKLIFTLEQ

SEQ ID NO: 1020235 - protein, 9 aa, Homo Sapiens
NTKKQNFLQ

SEQ ID NO: 1020236 - protein, 9 aa, Homo Sapiens
CKCPQNILS

SEQ ID NO: 1020237 - protein, 9 aa, Homo Sapiens
DDENGEDVE

SEQ ID NO: 1020238 - protein, 9 aa, Homo Sapiens
DQVIDSRLQ

SEQ ID NO: 1020239 - protein, 9 aa, Homo Sapiens
MSTIRQYPV

SEQ ID NO: 1020240 - protein, 9 aa, Homo Sapiens
VLEDYLNIK

SEQ ID NO: 1020241 - protein, 9 aa, Homo Sapiens
PSASPGPSG

SEQ ID NO: 1020242 - protein, 9 aa, Homo Sapiens
GQELADRPL

SEQ ID NO: 1020243 - protein, 9 aa, Homo Sapiens
PPLHEFMAL

SEQ ID NO: 1020244 - protein, 9 aa, Homo Sapiens
ATYRNFMRQ

SEQ ID NO: 1020245 - protein, 9 aa, Homo Sapiens
LLEGEIEHL

SEQ ID NO: 1020246 - protein, 9 aa, Homo Sapiens
QFFPGHSNC

SEQ ID NO: 1020247 - protein, 9 aa, Homo Sapiens
STLVQRQRI

SEQ ID NO: 1020248 - protein, 9 aa, Homo Sapiens
VSNPGAGSL

SEQ ID NO: 1020249 - protein, 9 aa, Homo Sapiens
IGYSFAVVG

SEQ ID NO: 1020250 - protein, 9 aa, Homo Sapiens
DKKWKMSGK

SEQ ID NO: 1020251 - protein, 9 aa, Homo Sapiens
VQSPERSRT

SEQ ID NO: 1020252 - protein, 9 aa, Homo Sapiens
EGPRGGLKS

SEQ ID NO: 1020253 - protein, 9 aa, Homo Sapiens
SMDPPDLLS

SEQ ID NO: 1020254 - protein, 9 aa, Homo Sapiens
DKEWELIKT

SEQ ID NO: 1020255 - protein, 9 aa, Homo Sapiens
GAPGFPESK

SEQ ID NO: 1020256 - protein, 9 aa, Homo Sapiens
ICSINKLIR

SEQ ID NO: 1020257 - protein, 9 aa, Homo Sapiens
SEDLGSRGP

SEQ ID NO: 1020258 - protein, 9 aa, Homo Sapiens
AHWASERLD

SEQ ID NO: 1020259 - protein, 9 aa, Homo Sapiens
QRALDGTSF

SEQ ID NO: 1020260 - protein, 9 aa, Homo Sapiens
GWGPCAIPE

SEQ ID NO: 1020261 - protein, 9 aa, Homo Sapiens
TNRNHSFYM

SEQ ID NO: 1020262 - protein, 9 aa, Homo Sapiens
ALKQERRAE

SEQ ID NO: 1020263 - protein, 9 aa, Homo Sapiens
TEALVNIAP

SEQ ID NO: 1020264 - protein, 9 aa, Homo Sapiens
GTFSKPCFT

SEQ ID NO: 1020265 - protein, 9 aa, Homo Sapiens
HARQGWAVG

SEQ ID NO: 1020266 - protein, 9 aa, Homo Sapiens
SSLNTALLQ

SEQ ID NO: 1020267 - protein, 9 aa, Homo Sapiens
QARDLASAE

SEQ ID NO: 1020268 - protein, 9 aa, Homo Sapiens
IIRIHQMNS

SEQ ID NO: 1020269 - protein, 9 aa, Homo Sapiens
MPHHIKPLP

SEQ ID NO: 1020270 - protein, 9 aa, Homo Sapiens
VAATTGVPG

SEQ ID NO: 1020271 - protein, 9 aa, Homo Sapiens
REIFLPLSA

SEQ ID NO: 1020272 - protein, 9 aa, Homo Sapiens
TTSTPPINM

SEQ ID NO: 1020273 - protein, 9 aa, Homo Sapiens
PFWEARESA

SEQ ID NO: 1020274 - protein, 9 aa, Homo Sapiens
TMAMKDSRI

SEQ ID NO: 1020275 - protein, 9 aa, Homo Sapiens
LFFLKNPEA

SEQ ID NO: 1020276 - protein, 9 aa, Homo Sapiens
IKLSMSTVT

SEQ ID NO: 1020277 - protein, 9 aa, Homo Sapiens
FYTGQPHLV

SEQ ID NO: 1020278 - protein, 9 aa, Homo Sapiens
IQEGKYEFS

SEQ ID NO: 1020279 - protein, 9 aa, Homo Sapiens
TLCLLLRLG

SEQ ID NO: 1020280 - protein, 9 aa, Homo Sapiens
AHKVAQAKH

SEQ ID NO: 1020281 - protein, 9 aa, Homo Sapiens
SVSEVCVST

SEQ ID NO: 1020282 - protein, 9 aa, Homo Sapiens
AAPSSLNTA

SEQ ID NO: 1020283 - protein, 9 aa, Homo Sapiens
CDEDADEDG

SEQ ID NO: 1020284 - protein, 9 aa, Homo Sapiens
ADQQEEGQR

SEQ ID NO: 1020285 - protein, 9 aa, Homo Sapiens
ESVQCCLMG

SEQ ID NO: 1020286 - protein, 9 aa, Homo Sapiens
LERHIFDFL

SEQ ID NO: 1020287 - protein, 9 aa, Homo Sapiens
QKTPSQHSN

SEQ ID NO: 1020288 - protein, 9 aa, Homo Sapiens
LLWEAGSGG

SEQ ID NO: 1020289 - protein, 9 aa, Homo Sapiens
QIMEHIKAA

SEQ ID NO: 1020290 - protein, 9 aa, Homo Sapiens
LGMRAAQLH

SEQ ID NO: 1020291 - protein, 9 aa, Homo Sapiens
EKVIEFLSP

SEQ ID NO: 1020292 - protein, 9 aa, Homo Sapiens
LFFHLQQER

SEQ ID NO: 1020293 - protein, 9 aa, Homo Sapiens
TVLDMSNNC

SEQ ID NO: 1020294 - protein, 9 aa, Homo Sapiens
LQKTPSQHS

SEQ ID NO: 1020295 - protein, 9 aa, Homo Sapiens
NMKQELTTE

SEQ ID NO: 1020296 - protein, 9 aa, Homo Sapiens
KWKMSGKAR

SEQ ID NO: 1020297 - protein, 9 aa, Homo Sapiens
PSGWGPCAI

SEQ ID NO: 1020298 - protein, 9 aa, Homo Sapiens
GQSKILFRA

SEQ ID NO: 1020299 - protein, 9 aa, Homo Sapiens
NSPMEANSD

SEQ ID NO: 1020300 - protein, 9 aa, Homo Sapiens
SSLVYLLCQ

SEQ ID NO: 1020301 - protein, 9 aa, Homo Sapiens
DSLLSAASS

SEQ ID NO: 1020302 - protein, 9 aa, Homo Sapiens
EIKRLSPED

SEQ ID NO: 1020303 - protein, 9 aa, Homo Sapiens
LLSRRNALY

SEQ ID NO: 1020304 - protein, 9 aa, Homo Sapiens
QKKQKVQRR

SEQ ID NO: 1020305 - protein, 9 aa, Homo Sapiens
QCDDYGSRY

SEQ ID NO: 1020306 - protein, 9 aa, Homo Sapiens
PNGPPGSAG

SEQ ID NO: 1020307 - protein, 9 aa, Homo Sapiens
IYVTVPLAM

SEQ ID NO: 1020308 - protein, 9 aa, Homo Sapiens
REVTRHVIE

SEQ ID NO: 1020309 - protein, 9 aa, Homo Sapiens
QAINTKKQN

SEQ ID NO: 1020310 - protein, 9 aa, Homo Sapiens
DPRVGVVGG

SEQ ID NO: 1020311 - protein, 9 aa, Homo Sapiens
PFSSDPYGG

SEQ ID NO: 1020312 - protein, 9 aa, Homo Sapiens
GFFLCFTSC

SEQ ID NO: 1020313 - protein, 9 aa, Homo Sapiens
FTKPKLIFT

SEQ ID NO: 1020314 - protein, 9 aa, Homo Sapiens
QFEDDVILD

SEQ ID NO: 1020315 - protein, 9 aa, Homo Sapiens
LLFFLKNPE

SEQ ID NO: 1020316 - protein, 9 aa, Homo Sapiens
STNYANSYR

SEQ ID NO: 1020317 - protein, 9 aa, Homo Sapiens
YTGQPHLVP

SEQ ID NO: 1020318 - protein, 9 aa, Homo Sapiens
RKVVSCLSI

SEQ ID NO: 1020319 - protein, 9 aa, Homo Sapiens
MVGPNFCVG

SEQ ID NO: 1020320 - protein, 9 aa, Homo Sapiens
AFREERLKA

SEQ ID NO: 1020321 - protein, 9 aa, Homo Sapiens
RGQALLKKW

SEQ ID NO: 1020322 - protein, 9 aa, Homo Sapiens
VLRKEPPHC

SEQ ID NO: 1020323 - protein, 9 aa, Homo Sapiens
ISIKKFDTK

SEQ ID NO: 1020324 - protein, 9 aa, Homo Sapiens
PPPAAPSSL

SEQ ID NO: 1020325 - protein, 9 aa, Homo Sapiens
TSEDLGSRG

SEQ ID NO: 1020326 - protein, 9 aa, Homo Sapiens
FETKKFYTL

SEQ ID NO: 1020327 - protein, 9 aa, Homo Sapiens
PRPFSSDPY

SEQ ID NO: 1020328 - protein, 9 aa, Homo Sapiens
ILTQKDAQS

SEQ ID NO: 1020329 - protein, 9 aa, Homo Sapiens
FWEARESAL

SEQ ID NO: 1020330 - protein, 9 aa, Homo Sapiens
RTERVWVWT

SEQ ID NO: 1020331 - protein, 9 aa, Homo Sapiens
LPGTKAEKG

SEQ ID NO: 1020332 - protein, 9 aa, Homo Sapiens
LRPSSATCD

SEQ ID NO: 1020333 - protein, 9 aa, Homo Sapiens
GRKQKALST

SEQ ID NO: 1020334 - protein, 9 aa, Homo Sapiens
HQVKKVLIQ

SEQ ID NO: 1020335 - protein, 9 aa, Homo Sapiens
YINAIIGNV

SEQ ID NO: 1020336 - protein, 9 aa, Homo Sapiens
ADPEKTSEE

SEQ ID NO: 1020337 - protein, 9 aa, Homo Sapiens
YALQKAQRD

SEQ ID NO: 1020338 - protein, 9 aa, Homo Sapiens
NRFPNIKLY

SEQ ID NO: 1020339 - protein, 9 aa, Homo Sapiens
SKSRSLDSE

SEQ ID NO: 1020340 - protein, 9 aa, Homo Sapiens
AKYRQAQLA

SEQ ID NO: 1020341 - protein, 9 aa, Homo Sapiens
YKKKKPKKK

SEQ ID NO: 1020342 - protein, 9 aa, Homo Sapiens
TIFLVFVLT

SEQ ID NO: 1020343 - protein, 9 aa, Homo Sapiens
FYILILKSV

SEQ ID NO: 1020344 - protein, 9 aa, Homo Sapiens
LNDSSVIVH

SEQ ID NO: 1020345 - protein, 9 aa, Homo Sapiens
HFLMYFFLG

SEQ ID NO: 1020346 - protein, 9 aa, Homo Sapiens
FHKCEECGK

SEQ ID NO: 1020347 - protein, 9 aa, Homo Sapiens
TCIIPCPSD

SEQ ID NO: 1020348 - protein, 9 aa, Homo Sapiens
KLGEQFFPG

SEQ ID NO: 1020349 - protein, 9 aa, Homo Sapiens
FLMYFFLGN

SEQ ID NO: 1020350 - protein, 9 aa, Homo Sapiens
GDDSVFFPD

SEQ ID NO: 1020351 - protein, 9 aa, Homo Sapiens
APFKVEALS

SEQ ID NO: 1020352 - protein, 9 aa, Homo Sapiens
VMATAFREE

SEQ ID NO: 1020353 - protein, 9 aa, Homo Sapiens
SSGDDSVFF

SEQ ID NO: 1020354 - protein, 9 aa, Homo Sapiens
DKDNSASLK

SEQ ID NO: 1020355 - protein, 9 aa, Homo Sapiens
FIKLIYFLL

SEQ ID NO: 1020356 - protein, 9 aa, Homo Sapiens
PAPPLHEFM

SEQ ID NO: 1020357 - protein, 9 aa, Homo Sapiens
APTLCLLLR

SEQ ID NO: 1020358 - protein, 9 aa, Homo Sapiens
RSPHWDVGS

SEQ ID NO: 1020359 - protein, 9 aa, Homo Sapiens
VVFLILSVT

SEQ ID NO: 1020360 - protein, 9 aa, Homo Sapiens
QGASEADED

SEQ ID NO: 1020361 - protein, 9 aa, Homo Sapiens
KFPCYIPIV

SEQ ID NO: 1020362 - protein, 9 aa, Homo Sapiens
LCSGQEQGQ

SEQ ID NO: 1020363 - protein, 9 aa, Homo Sapiens
NKELFVHGL

SEQ ID NO: 1020364 - protein, 9 aa, Homo Sapiens
HTNKSGSLL

SEQ ID NO: 1020365 - protein, 9 aa, Homo Sapiens
TYAAVKHSR

SEQ ID NO: 1020366 - protein, 9 aa, Homo Sapiens
KATYRNFMR

SEQ ID NO: 1020367 - protein, 9 aa, Homo Sapiens
SRIFPLNKQ

SEQ ID NO: 1020368 - protein, 9 aa, Homo Sapiens
YNLREDALD

SEQ ID NO: 1020369 - protein, 9 aa, Homo Sapiens
HVIEVSNEV

SEQ ID NO: 1020370 - protein, 9 aa, Homo Sapiens
GMRAAQLHH

SEQ ID NO: 1020371 - protein, 9 aa, Homo Sapiens
RLAYMACMI

SEQ ID NO: 1020372 - protein, 9 aa, Homo Sapiens
HRVTKEGST

SEQ ID NO: 1020373 - protein, 9 aa, Homo Sapiens
IAQHQFEDD

SEQ ID NO: 1020374 - protein, 9 aa, Homo Sapiens
STGGSSKSR

SEQ ID NO: 1020375 - protein, 9 aa, Homo Sapiens
DQFGPLNSP

SEQ ID NO: 1020376 - protein, 9 aa, Homo Sapiens
EFSDKDWAH

SEQ ID NO: 1020377 - protein, 9 aa, Homo Sapiens
LTSTLLQSH

SEQ ID NO: 1020378 - protein, 9 aa, Homo Sapiens
YKFHFSDLE

SEQ ID NO: 1020379 - protein, 9 aa, Homo Sapiens
QTPATLESQ

SEQ ID NO: 1020380 - protein, 9 aa, Homo Sapiens
YEFSENEQR

SEQ ID NO: 1020381 - protein, 9 aa, Homo Sapiens
GIFSRARLL

SEQ ID NO: 1020382 - protein, 9 aa, Homo Sapiens
GGYVSFFVP

SEQ ID NO: 1020383 - protein, 9 aa, Homo Sapiens
FHLQQERRF

SEQ ID NO: 1020384 - protein, 9 aa, Homo Sapiens
AQTWLFQAT

SEQ ID NO: 1020385 - protein, 9 aa, Homo Sapiens
VCKCPQNIL

SEQ ID NO: 1020386 - protein, 9 aa, Homo Sapiens
SSSSSGLLD

SEQ ID NO: 1020387 - protein, 9 aa, Homo Sapiens
FFRGWDAYQ

SEQ ID NO: 1020388 - protein, 9 aa, Homo Sapiens
TGRPISWVK

SEQ ID NO: 1020389 - protein, 9 aa, Homo Sapiens
LSQPQPGHA

SEQ ID NO: 1020390 - protein, 9 aa, Homo Sapiens
STLMVFLFT

SEQ ID NO: 1020391 - protein, 9 aa, Homo Sapiens
ASIQKLLSP

SEQ ID NO: 1020392 - protein, 9 aa, Homo Sapiens
KKEERPLPE

SEQ ID NO: 1020393 - protein, 9 aa, Homo Sapiens
SGGSKEYKV

SEQ ID NO: 1020394 - protein, 9 aa, Homo Sapiens
ASSLDQFGP

SEQ ID NO: 1020395 - protein, 9 aa, Homo Sapiens
FSFRVKWLR

SEQ ID NO: 1020396 - protein, 9 aa, Homo Sapiens
KRTERVWVW

SEQ ID NO: 1020397 - protein, 9 aa, Homo Sapiens
KKKKKDPNK

SEQ ID NO: 1020398 - protein, 9 aa, Homo Sapiens
PSLYKKKKP

SEQ ID NO: 1020399 - protein, 9 aa, Homo Sapiens
SFLPRPFSS

SEQ ID NO: 1020400 - protein, 9 aa, Homo Sapiens
GDTDSRFIS

SEQ ID NO: 1020401 - protein, 9 aa, Homo Sapiens
MLGLMRMRE

SEQ ID NO: 1020402 - protein, 9 aa, Homo Sapiens
DAERYLCGA

SEQ ID NO: 1020403 - protein, 9 aa, Homo Sapiens
EIYNVPGIR

SEQ ID NO: 1020404 - protein, 9 aa, Homo Sapiens
IQEPQGIGK

SEQ ID NO: 1020405 - protein, 9 aa, Homo Sapiens
PLERFLKPQ

SEQ ID NO: 1020406 - protein, 9 aa, Homo Sapiens
RDHFGHHVA

SEQ ID NO: 1020407 - protein, 9 aa, Homo Sapiens
NGPPGSAGS

SEQ ID NO: 1020408 - protein, 9 aa, Homo Sapiens
ELYLGNSMD

SEQ ID NO: 1020409 - protein, 9 aa, Homo Sapiens
AAVKHSRPR

SEQ ID NO: 1020410 - protein, 9 aa, Homo Sapiens
PFPLQDQAG

SEQ ID NO: 1020411 - protein, 9 aa, Homo Sapiens
TFDIYKFHF

SEQ ID NO: 1020412 - protein, 9 aa, Homo Sapiens
HLLFFFMYL

SEQ ID NO: 1020413 - protein, 9 aa, Homo Sapiens
KGDELKDAK

SEQ ID NO: 1020414 - protein, 9 aa, Homo Sapiens
SQRSAYGPH

SEQ ID NO: 1020415 - protein, 9 aa, Homo Sapiens
MIFKKLQGI

SEQ ID NO: 1020416 - protein, 9 aa, Homo Sapiens
PRAARVSPR

SEQ ID NO: 1020417 - protein, 9 aa, Homo Sapiens
ILTTNGGQE

SEQ ID NO: 1020418 - protein, 9 aa, Homo Sapiens
SPFWEARES

SEQ ID NO: 1020419 - protein, 9 aa, Homo Sapiens
EREANEFRR

SEQ ID NO: 1020420 - protein, 9 aa, Homo Sapiens
HIKPLPYYS

SEQ ID NO: 1020421 - protein, 9 aa, Homo Sapiens
EVTRHVIEV

SEQ ID NO: 1020422 - protein, 9 aa, Homo Sapiens
ELSGTTTVN

SEQ ID NO: 1020423 - protein, 9 aa, Homo Sapiens
LINSPMEAN

SEQ ID NO: 1020424 - protein, 9 aa, Homo Sapiens
FLLSKSGRR

SEQ ID NO: 1020425 - protein, 9 aa, Homo Sapiens
KKTGNEQKW

SEQ ID NO: 1020426 - protein, 9 aa, Homo Sapiens
VSFLPRPFS

SEQ ID NO: 1020427 - protein, 9 aa, Homo Sapiens
PPFPLQDQA

SEQ ID NO: 1020428 - protein, 9 aa, Homo Sapiens
EDDEEDFSS

SEQ ID NO: 1020429 - protein, 9 aa, Homo Sapiens
NEMLGLMRM

SEQ ID NO: 1020430 - protein, 9 aa, Homo Sapiens
RGLFHKAIM

SEQ ID NO: 1020431 - protein, 9 aa, Homo Sapiens
IFVEGIDFK

SEQ ID NO: 1020432 - protein, 9 aa, Homo Sapiens
LRVAATTGV

SEQ ID NO: 1020433 - protein, 9 aa, Homo Sapiens
SGSSVVEMQ

SEQ ID NO: 1020434 - protein, 9 aa, Homo Sapiens
ETKENVICL

SEQ ID NO: 1020435 - protein, 9 aa, Homo Sapiens
GSLLSAEFS

SEQ ID NO: 1020436 - protein, 9 aa, Homo Sapiens
GNPGVVYFD

SEQ ID NO: 1020437 - protein, 9 aa, Homo Sapiens
NLYFLADDD

SEQ ID NO: 1020438 - protein, 9 aa, Homo Sapiens
IGFSYSLNE

SEQ ID NO: 1020439 - protein, 9 aa, Homo Sapiens
TVVQYLSTL

SEQ ID NO: 1020440 - protein, 9 aa, Homo Sapiens
ALLLYDADI

SEQ ID NO: 1020441 - protein, 9 aa, Homo Sapiens
GSAEAPPLG

SEQ ID NO: 1020442 - protein, 9 aa, Homo Sapiens
YEFSDKDWA

SEQ ID NO: 1020443 - protein, 9 aa, Homo Sapiens
RPDLIIISS

SEQ ID NO: 1020444 - protein, 9 aa, Homo Sapiens
VQYLSTLQE

SEQ ID NO: 1020445 - protein, 9 aa, Homo Sapiens
ELADRPLIA

SEQ ID NO: 1020446 - protein, 9 aa, Homo Sapiens
PRRERGRLS

SEQ ID NO: 1020447 - protein, 9 aa, Homo Sapiens
YYRYNFSQE

SEQ ID NO: 1020448 - protein, 9 aa, Homo Sapiens
RGHHTVILL

SEQ ID NO: 1020449 - protein, 9 aa, Homo Sapiens
QCVEENTLK

SEQ ID NO: 1020450 - protein, 9 aa, Homo Sapiens
HKPEPTDKE

SEQ ID NO: 1020451 - protein, 9 aa, Homo Sapiens
GLLWEAGSG

SEQ ID NO: 1020452 - protein, 9 aa, Homo Sapiens
TATTSTPPI

SEQ ID NO: 1020453 - protein, 9 aa, Homo Sapiens
WPSSYVQAR

SEQ ID NO: 1020454 - protein, 9 aa, Homo Sapiens
ENATVMNKT

SEQ ID NO: 1020455 - protein, 9 aa, Homo Sapiens
IFGEDAMRH

SEQ ID NO: 1020456 - protein, 9 aa, Homo Sapiens
YEYDPGPDD

SEQ ID NO: 1020457 - protein, 9 aa, Homo Sapiens
QKLLSPQEP

SEQ ID NO: 1020458 - protein, 9 aa, Homo Sapiens
NKGDELKDA

SEQ ID NO: 1020459 - protein, 9 aa, Homo Sapiens
GPLPAPHLL

SEQ ID NO: 1020460 - protein, 9 aa, Homo Sapiens
RECEMPHHI

SEQ ID NO: 1020461 - protein, 9 aa, Homo Sapiens
LSATAQKII

SEQ ID NO: 1020462 - protein, 9 aa, Homo Sapiens
RPIVPLFSR

SEQ ID NO: 1020463 - protein, 9 aa, Homo Sapiens
QWKALNKID

SEQ ID NO: 1020464 - protein, 9 aa, Homo Sapiens
RLFFEIGSI

SEQ ID NO: 1020465 - protein, 9 aa, Homo Sapiens
ENFHKCEEC

SEQ ID NO: 1020466 - protein, 9 aa, Homo Sapiens
NHSFYMPLN

SEQ ID NO: 1020467 - protein, 9 aa, Homo Sapiens
KKITREYGL

SEQ ID NO: 1020468 - protein, 9 aa, Homo Sapiens
EEDDEEDFS

SEQ ID NO: 1020469 - protein, 9 aa, Homo Sapiens
SLLQEALVL

SEQ ID NO: 1020470 - protein, 9 aa, Homo Sapiens
LNANRREIL

SEQ ID NO: 1020471 - protein, 9 aa, Homo Sapiens
AQHQFEDDV

SEQ ID NO: 1020472 - protein, 9 aa, Homo Sapiens
ENSLFFRKV

SEQ ID NO: 1020473 - protein, 9 aa, Homo Sapiens
YSFAVVGIN

SEQ ID NO: 1020474 - protein, 9 aa, Homo Sapiens
NCRMQHITG

SEQ ID NO: 1020475 - protein, 9 aa, Homo Sapiens
SQVCIKLSM

SEQ ID NO: 1020476 - protein, 9 aa, Homo Sapiens
TLKCSAKNG

SEQ ID NO: 1020477 - protein, 9 aa, Homo Sapiens
EELCTPASL

SEQ ID NO: 1020478 - protein, 9 aa, Homo Sapiens
HSSCYGGYW

SEQ ID NO: 1020479 - protein, 9 aa, Homo Sapiens
NVRCPWCRG

SEQ ID NO: 1020480 - protein, 9 aa, Homo Sapiens
ETKQRELLH

SEQ ID NO: 1020481 - protein, 9 aa, Homo Sapiens
MPHFLKPLE

SEQ ID NO: 1020482 - protein, 9 aa, Homo Sapiens
GNNRVRLAP

SEQ ID NO: 1020483 - protein, 9 aa, Homo Sapiens
LPPPPPSIL

SEQ ID NO: 1020484 - protein, 9 aa, Homo Sapiens
IYDSKDYSV

SEQ ID NO: 1020485 - protein, 9 aa, Homo Sapiens
PHSGRRTPG

SEQ ID NO: 1020486 - protein, 9 aa, Homo Sapiens
KVQRRERAL

SEQ ID NO: 1020487 - protein, 9 aa, Homo Sapiens
IGINAMLEG

SEQ ID NO: 1020488 - protein, 9 aa, Homo Sapiens
VKGACGFDG

SEQ ID NO: 1020489 - protein, 9 aa, Homo Sapiens
TSRIFPLNK

SEQ ID NO: 1020490 - protein, 9 aa, Homo Sapiens
ALCENPESS

SEQ ID NO: 1020491 - protein, 9 aa, Homo Sapiens
VTVPLAMQS

SEQ ID NO: 1020492 - protein, 9 aa, Homo Sapiens
GACGFDGEK

SEQ ID NO: 1020493 - protein, 9 aa, Homo Sapiens
KCPQNILSP

SEQ ID NO: 1020494 - protein, 9 aa, Homo Sapiens
TRIAVAFSG

SEQ ID NO: 1020495 - protein, 9 aa, Homo Sapiens
PTTFDIYKF

SEQ ID NO: 1020496 - protein, 9 aa, Homo Sapiens
LFQATDHTF

SEQ ID NO: 1020497 - protein, 9 aa, Homo Sapiens
PLQKTPSQH

SEQ ID NO: 1020498 - protein, 9 aa, Homo Sapiens
LFFSTIFLV

SEQ ID NO: 1020499 - protein, 9 aa, Homo Sapiens
SESTGGSSK

SEQ ID NO: 1020500 - protein, 9 aa, Homo Sapiens
KVAQAKHKP

SEQ ID NO: 1020501 - protein, 9 aa, Homo Sapiens
GDMFKKLDS

SEQ ID NO: 1020502 - protein, 9 aa, Homo Sapiens
LAVKKYFQK

SEQ ID NO: 1020503 - protein, 9 aa, Homo Sapiens
LLASFKLIQ

SEQ ID NO: 1020504 - protein, 9 aa, Homo Sapiens
AIGYSFAVV

SEQ ID NO: 1020505 - protein, 9 aa, Homo Sapiens
LMVFLFTIS

SEQ ID NO: 1020506 - protein, 9 aa, Homo Sapiens
LEEWSLLNV

SEQ ID NO: 1020507 - protein, 9 aa, Homo Sapiens
LASAENLLK

SEQ ID NO: 1020508 - protein, 9 aa, Homo Sapiens
VTEERAEAA

SEQ ID NO: 1020509 - protein, 9 aa, Homo Sapiens
GGNEESPFV

SEQ ID NO: 1020510 - protein, 9 aa, Homo Sapiens
KLIQREKPA

SEQ ID NO: 1020511 - protein, 9 aa, Homo Sapiens
PHQAQRIQE

SEQ ID NO: 1020512 - protein, 9 aa, Homo Sapiens
VVARVNCRM

SEQ ID NO: 1020513 - protein, 9 aa, Homo Sapiens
ISDKPKRVR

SEQ ID NO: 1020514 - protein, 9 aa, Homo Sapiens
PISWVKGAP

SEQ ID NO: 1020515 - protein, 9 aa, Homo Sapiens
RQAQLAGVL

SEQ ID NO: 1020516 - protein, 9 aa, Homo Sapiens
EAGGYVSFF

SEQ ID NO: 1020517 - protein, 9 aa, Homo Sapiens
TGTYIGINA

SEQ ID NO: 1020518 - protein, 9 aa, Homo Sapiens
LYFLADDDW

SEQ ID NO: 1020519 - protein, 9 aa, Homo Sapiens
DANIFLVLI

SEQ ID NO: 1020520 - protein, 9 aa, Homo Sapiens
KQLNANRRE

SEQ ID NO: 1020521 - protein, 9 aa, Homo Sapiens
EDAADEEGE

SEQ ID NO: 1020522 - protein, 9 aa, Homo Sapiens
STEENFTKE

SEQ ID NO: 1020523 - protein, 9 aa, Homo Sapiens
AKLGTVICK

SEQ ID NO: 1020524 - protein, 9 aa, Homo Sapiens
KDGFLHETV

SEQ ID NO: 1020525 - protein, 9 aa, Homo Sapiens
PAAPSSLNT

SEQ ID NO: 1020526 - protein, 9 aa, Homo Sapiens
ENGEDVEDE

SEQ ID NO: 1020527 - protein, 9 aa, Homo Sapiens
SKQGRPLNN

SEQ ID NO: 1020528 - protein, 9 aa, Homo Sapiens
AKYGRLNSE

SEQ ID NO: 1020529 - protein, 9 aa, Homo Sapiens
FLLEWNVWG

SEQ ID NO: 1020530 - protein, 9 aa, Homo Sapiens
PEPTDKEWE

SEQ ID NO: 1020531 - protein, 9 aa, Homo Sapiens
SQIWNLNPV

SEQ ID NO: 1020532 - protein, 9 aa, Homo Sapiens
IRKMSSSGR

SEQ ID NO: 1020533 - protein, 9 aa, Homo Sapiens
IGGIFSRAR

SEQ ID NO: 1020534 - protein, 9 aa, Homo Sapiens
ARVNCRMQH

SEQ ID NO: 1020535 - protein, 9 aa, Homo Sapiens
LLFFFMYLY

SEQ ID NO: 1020536 - protein, 9 aa, Homo Sapiens
LWMESVQCC

SEQ ID NO: 1020537 - protein, 9 aa, Homo Sapiens
GKSSLVYLL

SEQ ID NO: 1020538 - protein, 9 aa, Homo Sapiens
PPPPSILCP

SEQ ID NO: 1020539 - protein, 9 aa, Homo Sapiens
SQADPGSAP

SEQ ID NO: 1020540 - protein, 9 aa, Homo Sapiens
PPAAPSSLN

SEQ ID NO: 1020541 - protein, 9 aa, Homo Sapiens
TSASAVTVG

SEQ ID NO: 1020542 - protein, 9 aa, Homo Sapiens
PLPAPHLLF

SEQ ID NO: 1020543 - protein, 9 aa, Homo Sapiens
RSVMATAFR

SEQ ID NO: 1020544 - protein, 9 aa, Homo Sapiens
LVMRSPHWD

SEQ ID NO: 1020545 - protein, 9 aa, Homo Sapiens
GYVSFFVPA

SEQ ID NO: 1020546 - protein, 9 aa, Homo Sapiens
FRRGRSTVT

SEQ ID NO: 1020547 - protein, 9 aa, Homo Sapiens
MSSSGRKQK

SEQ ID NO: 1020548 - protein, 9 aa, Homo Sapiens
KYRQAQLAG

SEQ ID NO: 1020549 - protein, 9 aa, Homo Sapiens
GGIFSRARL

SEQ ID NO: 1020550 - protein, 9 aa, Homo Sapiens
PSRKKRGAD

SEQ ID NO: 1020551 - protein, 9 aa, Homo Sapiens
GGSAEAPPL

SEQ ID NO: 1020552 - protein, 9 aa, Homo Sapiens
ATKVFKYEF

SEQ ID NO: 1020553 - protein, 9 aa, Homo Sapiens
SERLDISNK

SEQ ID NO: 1020554 - protein, 9 aa, Homo Sapiens
ASERLDISN

SEQ ID NO: 1020555 - protein, 9 aa, Homo Sapiens
ADSGALTSP

SEQ ID NO: 1020556 - protein, 9 aa, Homo Sapiens
ASFKLIQRE

SEQ ID NO: 1020557 - protein, 9 aa, Homo Sapiens
CTKAFCCAT

SEQ ID NO: 1020558 - protein, 9 aa, Homo Sapiens
NGPWISTSC

SEQ ID NO: 1020559 - protein, 9 aa, Homo Sapiens
NRVRLAPAV

SEQ ID NO: 1020560 - protein, 9 aa, Homo Sapiens
YNVFVITIK

SEQ ID NO: 1020561 - protein, 9 aa, Homo Sapiens
LLLFFLKNP

SEQ ID NO: 1020562 - protein, 9 aa, Homo Sapiens
SISIKKFDT

SEQ ID NO: 1020563 - protein, 9 aa, Homo Sapiens
SRHDCNLLR

SEQ ID NO: 1020564 - protein, 9 aa, Homo Sapiens
LIKATYRNF

SEQ ID NO: 1020565 - protein, 9 aa, Homo Sapiens
HPAPPLHEF

SEQ ID NO: 1020566 - protein, 9 aa, Homo Sapiens
VFLILSVTW

SEQ ID NO: 1020567 - protein, 9 aa, Homo Sapiens
SSVIVHRDS

SEQ ID NO: 1020568 - protein, 9 aa, Homo Sapiens
VASSLDQFG

SEQ ID NO: 1020569 - protein, 9 aa, Homo Sapiens
LAMQSSLRH

SEQ ID NO: 1020570 - protein, 9 aa, Homo Sapiens
RTSSTEENF

SEQ ID NO: 1020571 - protein, 9 aa, Homo Sapiens
ADDDWETIS

SEQ ID NO: 1020572 - protein, 9 aa, Homo Sapiens
GYEYDPGPD

SEQ ID NO: 1020573 - protein, 9 aa, Homo Sapiens
NDSSVIVHR

SEQ ID NO: 1020574 - protein, 9 aa, Homo Sapiens
ITIKNILSI

SEQ ID NO: 1020575 - protein, 9 aa, Homo Sapiens
DSSLASIQK

SEQ ID NO: 1020576 - protein, 9 aa, Homo Sapiens
ELFESDLDQ

SEQ ID NO: 1020577 - protein, 9 aa, Homo Sapiens
LAPASPPPL

SEQ ID NO: 1020578 - protein, 9 aa, Homo Sapiens
RNGCVKSCV

SEQ ID NO: 1020579 - protein, 9 aa, Homo Sapiens
IFLVLIEIL

SEQ ID NO: 1020580 - protein, 9 aa, Homo Sapiens
SPTNRNHSF

SEQ ID NO: 1020581 - protein, 9 aa, Homo Sapiens
LGEGPGPEE

SEQ ID NO: 1020582 - protein, 9 aa, Homo Sapiens
AEAPPLGPS

SEQ ID NO: 1020583 - protein, 9 aa, Homo Sapiens
VGGSAEAPP

SEQ ID NO: 1020584 - protein, 9 aa, Homo Sapiens
SRRNALYER

SEQ ID NO: 1020585 - protein, 9 aa, Homo Sapiens
NTELVTFAQ

SEQ ID NO: 1020586 - protein, 9 aa, Homo Sapiens
CFTKPKLIF

SEQ ID NO: 1020587 - protein, 9 aa, Homo Sapiens
VGFFLCFTS

SEQ ID NO: 1020588 - protein, 9 aa, Homo Sapiens
QLNANRREI

SEQ ID NO: 1020589 - protein, 9 aa, Homo Sapiens
VCVLERHIF

SEQ ID NO: 1020590 - protein, 9 aa, Homo Sapiens
LFSRSMEIS

SEQ ID NO: 1020591 - protein, 9 aa, Homo Sapiens
AALFIKVGK

SEQ ID NO: 1020592 - protein, 9 aa, Homo Sapiens
WLEDHSFAG

SEQ ID NO: 1020593 - protein, 9 aa, Homo Sapiens
SSLCRHERT

SEQ ID NO: 1020594 - protein, 9 aa, Homo Sapiens
TEDWMESFF

SEQ ID NO: 1020595 - protein, 9 aa, Homo Sapiens
GDELKDAKK

SEQ ID NO: 1020596 - protein, 9 aa, Homo Sapiens
ERGARMGVP

SEQ ID NO: 1020597 - protein, 9 aa, Homo Sapiens
RDSFLGEGP

SEQ ID NO: 1020598 - protein, 9 aa, Homo Sapiens
ESSSAQAAI

SEQ ID NO: 1020599 - protein, 9 aa, Homo Sapiens
PTTFPISDK

SEQ ID NO: 1020600 - protein, 9 aa, Homo Sapiens
SLCLCSLLL

SEQ ID NO: 1020601 - protein, 9 aa, Homo Sapiens
SLILSPMAR

SEQ ID NO: 1020602 - protein, 9 aa, Homo Sapiens
DREKVCLSL

SEQ ID NO: 1020603 - protein, 9 aa, Homo Sapiens
SGNPGVVYF

SEQ ID NO: 1020604 - protein, 9 aa, Homo Sapiens
HHKKPTGII

SEQ ID NO: 1020605 - protein, 9 aa, Homo Sapiens
LIQAINTKK

SEQ ID NO: 1020606 - protein, 9 aa, Homo Sapiens
LLESLDKDN

SEQ ID NO: 1020607 - protein, 9 aa, Homo Sapiens
KKFDTKASV

SEQ ID NO: 1020608 - protein, 9 aa, Homo Sapiens
ARHDAPTLC

SEQ ID NO: 1020609 - protein, 9 aa, Homo Sapiens
QENIHCSDK

SEQ ID NO: 1020610 - protein, 9 aa, Homo Sapiens
EIQQALRER

SEQ ID NO: 1020611 - protein, 9 aa, Homo Sapiens
CLSICIFPD

SEQ ID NO: 1020612 - protein, 9 aa, Homo Sapiens
DGTSFQGMV

SEQ ID NO: 1020613 - protein, 9 aa, Homo Sapiens
NRNHSFYMP

SEQ ID NO: 1020614 - protein, 9 aa, Homo Sapiens
FYTLKVEAA

SEQ ID NO: 1020615 - protein, 9 aa, Homo Sapiens
SSVVGFFLC

SEQ ID NO: 1020616 - protein, 9 aa, Homo Sapiens
ATMAMKDSR

SEQ ID NO: 1020617 - protein, 9 aa, Homo Sapiens
LTSPGTATT

SEQ ID NO: 1020618 - protein, 9 aa, Homo Sapiens
AEAQQGHRP

SEQ ID NO: 1020619 - protein, 9 aa, Homo Sapiens
KLQAPRTQA

SEQ ID NO: 1020620 - protein, 9 aa, Homo Sapiens
KDNSASLKI

SEQ ID NO: 1020621 - protein, 9 aa, Homo Sapiens
STRINMLKL

SEQ ID NO: 1020622 - protein, 9 aa, Homo Sapiens
ASPNKSAYD

SEQ ID NO: 1020623 - protein, 9 aa, Homo Sapiens
KDMGGQMGE

SEQ ID NO: 1020624 - protein, 9 aa, Homo Sapiens
RRERGRLSL

SEQ ID NO: 1020625 - protein, 9 aa, Homo Sapiens
EKLTFDREI

SEQ ID NO: 1020626 - protein, 9 aa, Homo Sapiens
LESQNDFPV

SEQ ID NO: 1020627 - protein, 9 aa, Homo Sapiens
REDVFLANA

SEQ ID NO: 1020628 - protein, 9 aa, Homo Sapiens
LSTNYANSY

SEQ ID NO: 1020629 - protein, 9 aa, Homo Sapiens
NQLTWLEDH

SEQ ID NO: 1020630 - protein, 9 aa, Homo Sapiens
SLKRGDPDW

SEQ ID NO: 1020631 - protein, 9 aa, Homo Sapiens
YGPPFPLQD

SEQ ID NO: 1020632 - protein, 9 aa, Homo Sapiens
RFLLSKSGR

SEQ ID NO: 1020633 - protein, 9 aa, Homo Sapiens
QIGKKIPSF

SEQ ID NO: 1020634 - protein, 9 aa, Homo Sapiens
NIFLVLIEI

SEQ ID NO: 1020635 - protein, 9 aa, Homo Sapiens
LNTELVTFA

SEQ ID NO: 1020636 - protein, 9 aa, Homo Sapiens
NGCVKSCVS

SEQ ID NO: 1020637 - protein, 9 aa, Homo Sapiens
RGDPDWPED

SEQ ID NO: 1020638 - protein, 9 aa, Homo Sapiens
ILHKKKLEQ

SEQ ID NO: 1020639 - protein, 9 aa, Homo Sapiens
GALCENPES

SEQ ID NO: 1020640 - protein, 9 aa, Homo Sapiens
PGSAGSRGD

SEQ ID NO: 1020641 - protein, 9 aa, Homo Sapiens
RLSLKGYGF

SEQ ID NO: 1020642 - protein, 9 aa, Homo Sapiens
NLVPDLYFD

SEQ ID NO: 1020643 - protein, 9 aa, Homo Sapiens
LRNGCVKSC

SEQ ID NO: 1020644 - protein, 9 aa, Homo Sapiens
QATRTFYTG

SEQ ID NO: 1020645 - protein, 9 aa, Homo Sapiens
LDQFGPLNS

SEQ ID NO: 1020646 - protein, 9 aa, Homo Sapiens
TRGGNMCSE

SEQ ID NO: 1020647 - protein, 9 aa, Homo Sapiens
SKILFRAGV

SEQ ID NO: 1020648 - protein, 9 aa, Homo Sapiens
KTPSQHSNI

SEQ ID NO: 1020649 - protein, 9 aa, Homo Sapiens
DYQFIKLIY

SEQ ID NO: 1020650 - protein, 9 aa, Homo Sapiens
EKDVSQKVT

SEQ ID NO: 1020651 - protein, 9 aa, Homo Sapiens
VRPDLIIIS

SEQ ID NO: 1020652 - protein, 9 aa, Homo Sapiens
GNSMDPPDL

SEQ ID NO: 1020653 - protein, 9 aa, Homo Sapiens
FLADDDWET

SEQ ID NO: 1020654 - protein, 9 aa, Homo Sapiens
ISQPDKVSI

SEQ ID NO: 1020655 - protein, 9 aa, Homo Sapiens
AGGYVSFFV

SEQ ID NO: 1020656 - protein, 9 aa, Homo Sapiens
MAKGCQRYM

SEQ ID NO: 1020657 - protein, 9 aa, Homo Sapiens
WMESVQCCL

SEQ ID NO: 1020658 - protein, 9 aa, Homo Sapiens
YQDGFGRLT

SEQ ID NO: 1020659 - protein, 9 aa, Homo Sapiens
IYINAIIGN

SEQ ID NO: 1020660 - protein, 9 aa, Homo Sapiens
VVNTATTST

SEQ ID NO: 1020661 - protein, 9 aa, Homo Sapiens
EKDFVLKIY

SEQ ID NO: 1020662 - protein, 9 aa, Homo Sapiens
VAVKWRVVG

SEQ ID NO: 1020663 - protein, 9 aa, Homo Sapiens
REYGLKHLS

SEQ ID NO: 1020664 - protein, 9 aa, Homo Sapiens
EQHIKAHKV

SEQ ID NO: 1020665 - protein, 9 aa, Homo Sapiens
PRGQALLKK

SEQ ID NO: 1020666 - protein, 9 aa, Homo Sapiens
SLYANLAKA

SEQ ID NO: 1020667 - protein, 9 aa, Homo Sapiens
PGVESFWEK

SEQ ID NO: 1020668 - protein, 9 aa, Homo Sapiens
NTLLESLDK

SEQ ID NO: 1020669 - protein, 9 aa, Homo Sapiens
SSVVEMQGD

SEQ ID NO: 1020670 - protein, 9 aa, Homo Sapiens
EDAGALCEN

SEQ ID NO: 1020671 - protein, 9 aa, Homo Sapiens
HIRENFHKC

SEQ ID NO: 1020672 - protein, 9 aa, Homo Sapiens
SFAVVGINI

SEQ ID NO: 1020673 - protein, 9 aa, Homo Sapiens
FCCATVGRA

SEQ ID NO: 1020674 - protein, 9 aa, Homo Sapiens
GRLTFRNVA

SEQ ID NO: 1020675 - protein, 9 aa, Homo Sapiens
FLKPLERFL

SEQ ID NO: 1020676 - protein, 9 aa, Homo Sapiens
DQRQEITSI

SEQ ID NO: 1020677 - protein, 9 aa, Homo Sapiens
DSREKLLQV

SEQ ID NO: 1020678 - protein, 9 aa, Homo Sapiens
LVQRQRIHS

SEQ ID NO: 1020679 - protein, 9 aa, Homo Sapiens
DTQGVVGTF

SEQ ID NO: 1020680 - protein, 9 aa, Homo Sapiens
RQNESWGPE

SEQ ID NO: 1020681 - protein, 9 aa, Homo Sapiens
KAAGGSEGP

SEQ ID NO: 1020682 - protein, 9 aa, Homo Sapiens
MFFRDRYET

SEQ ID NO: 1020683 - protein, 9 aa, Homo Sapiens
IQISPPPKP

SEQ ID NO: 1020684 - protein, 9 aa, Homo Sapiens
TVLDRVSVI

SEQ ID NO: 1020685 - protein, 9 aa, Homo Sapiens
WTKPTDPTS

SEQ ID NO: 1020686 - protein, 9 aa, Homo Sapiens
VSFFVPACS

SEQ ID NO: 1020687 - protein, 9 aa, Homo Sapiens
PYCRGLPNP

SEQ ID NO: 1020688 - protein, 9 aa, Homo Sapiens
ILILFFYIL

SEQ ID NO: 1020689 - protein, 9 aa, Homo Sapiens
GGLKSREFS

SEQ ID NO: 1020690 - protein, 9 aa, Homo Sapiens
QVCIKLSMS

SEQ ID NO: 1020691 - protein, 9 aa, Homo Sapiens
DGFLHETVL

SEQ ID NO: 1020692 - protein, 9 aa, Homo Sapiens
LVLFLLEWN

SEQ ID NO: 1020693 - protein, 9 aa, Homo Sapiens
KPTTFPISD

SEQ ID NO: 1020694 - protein, 9 aa, Homo Sapiens
SMVPTSAAE

SEQ ID NO: 1020695 - protein, 9 aa, Homo Sapiens
EGFIKKEER

SEQ ID NO: 1020696 - protein, 9 aa, Homo Sapiens
TGVPGQLPR

SEQ ID NO: 1020697 - protein, 9 aa, Homo Sapiens
FRDRYETKQ

SEQ ID NO: 1020698 - protein, 9 aa, Homo Sapiens
VCTKAFCCA

SEQ ID NO: 1020699 - protein, 9 aa, Homo Sapiens
DAADEEGEE

SEQ ID NO: 1020700 - protein, 9 aa, Homo Sapiens
SSTEENFTK

SEQ ID NO: 1020701 - protein, 9 aa, Homo Sapiens
TQSTSEELC

SEQ ID NO: 1020702 - protein, 9 aa, Homo Sapiens
SALAYALQK

SEQ ID NO: 1020703 - protein, 9 aa, Homo Sapiens
GKSQKIKSR

SEQ ID NO: 1020704 - protein, 9 aa, Homo Sapiens
TYIGINAML

SEQ ID NO: 1020705 - protein, 9 aa, Homo Sapiens
LPRPFSSDP

SEQ ID NO: 1020706 - protein, 9 aa, Homo Sapiens
SAEAPPLGP

SEQ ID NO: 1020707 - protein, 9 aa, Homo Sapiens
FWLLLFFLK

SEQ ID NO: 1020708 - protein, 9 aa, Homo Sapiens
AINTKKQNF

SEQ ID NO: 1020709 - protein, 9 aa, Homo Sapiens
WTGGCPFRE

SEQ ID NO: 1020710 - protein, 9 aa, Homo Sapiens
KPTGIIRIH

SEQ ID NO: 1020711 - protein, 9 aa, Homo Sapiens
SSILRAEGI

SEQ ID NO: 1020712 - protein, 9 aa, Homo Sapiens
NAEFTRSNR

SEQ ID NO: 1020713 - protein, 9 aa, Homo Sapiens
LGLPEDNLV

SEQ ID NO: 1020714 - protein, 9 aa, Homo Sapiens
ATTSTPPIN

SEQ ID NO: 1020715 - protein, 9 aa, Homo Sapiens
EEKLTFDRE

SEQ ID NO: 1020716 - protein, 9 aa, Homo Sapiens
AMQSSLRHN

SEQ ID NO: 1020717 - protein, 9 aa, Homo Sapiens
NDRSGSYYC

SEQ ID NO: 1020718 - protein, 9 aa, Homo Sapiens
QLVCVLERH

SEQ ID NO: 1020719 - protein, 9 aa, Homo Sapiens
AAAGLRPMA

SEQ ID NO: 1020720 - protein, 9 aa, Homo Sapiens
QAQRIQEIK

SEQ ID NO: 1020721 - protein, 9 aa, Homo Sapiens
SREKLLQVN

SEQ ID NO: 1020722 - protein, 9 aa, Homo Sapiens
TRDRPYECH

SEQ ID NO: 1020723 - protein, 9 aa, Homo Sapiens
SSATCDTCH

SEQ ID NO: 1020724 - protein, 9 aa, Homo Sapiens
QVASSLDQF

SEQ ID NO: 1020725 - protein, 9 aa, Homo Sapiens
SRGQSESRS

SEQ ID NO: 1020726 - protein, 9 aa, Homo Sapiens
FRPGYEYDP

SEQ ID NO: 1020727 - protein, 9 aa, Homo Sapiens
TKKQNFLQG

SEQ ID NO: 1020728 - protein, 9 aa, Homo Sapiens
GLAGLLELY

SEQ ID NO: 1020729 - protein, 9 aa, Homo Sapiens
RGLQRDPGI

SEQ ID NO: 1020730 - protein, 9 aa, Homo Sapiens
IVAVSYELI

SEQ ID NO: 1020731 - protein, 9 aa, Homo Sapiens
MFDEIREIF

SEQ ID NO: 1020732 - protein, 9 aa, Homo Sapiens
EETCIIPCP

SEQ ID NO: 1020733 - protein, 9 aa, Homo Sapiens
SVMATAFRE

SEQ ID NO: 1020734 - protein, 9 aa, Homo Sapiens
QKVTHRRWY

SEQ ID NO: 1020735 - protein, 9 aa, Homo Sapiens
DDDENGEDV

SEQ ID NO: 1020736 - protein, 9 aa, Homo Sapiens
LFFFMYLYS

SEQ ID NO: 1020737 - protein, 9 aa, Homo Sapiens
GPSASPGPS

SEQ ID NO: 1020738 - protein, 9 aa, Homo Sapiens
GYRYSCCHS

SEQ ID NO: 1020739 - protein, 9 aa, Homo Sapiens
GKYEFSDKD

SEQ ID NO: 1020740 - protein, 9 aa, Homo Sapiens
GRPLNNMKQ

SEQ ID NO: 1020741 - protein, 9 aa, Homo Sapiens
KLYNNNRVK

SEQ ID NO: 1020742 - protein, 9 aa, Homo Sapiens
TLESQNDFP

SEQ ID NO: 1020743 - protein, 9 aa, Homo Sapiens
SSDPYGGRG

SEQ ID NO: 1020744 - protein, 9 aa, Homo Sapiens
PLKKEFQPG

SEQ ID NO: 1020745 - protein, 9 aa, Homo Sapiens
SEELCTPAS

SEQ ID NO: 1020746 - protein, 9 aa, Homo Sapiens
PDWPEDQVL

SEQ ID NO: 1020747 - protein, 9 aa, Homo Sapiens
YFDKNEHWS

SEQ ID NO: 1020748 - protein, 9 aa, Homo Sapiens
YAAVKHSRP

SEQ ID NO: 1020749 - protein, 9 aa, Homo Sapiens
LVNIAPPEC

SEQ ID NO: 1020750 - protein, 9 aa, Homo Sapiens
TLTRPSEFI

SEQ ID NO: 1020751 - protein, 9 aa, Homo Sapiens
SQHSNILDN

SEQ ID NO: 1020752 - protein, 9 aa, Homo Sapiens
LERFLKPQD

SEQ ID NO: 1020753 - protein, 9 aa, Homo Sapiens
MKKLNENIR

SEQ ID NO: 1020754 - protein, 9 aa, Homo Sapiens
ACGFDGEKG

SEQ ID NO: 1020755 - protein, 9 aa, Homo Sapiens
VVQYLSTLQ

SEQ ID NO: 1020756 - protein, 9 aa, Homo Sapiens
TVVQEFSKG

SEQ ID NO: 1020757 - protein, 9 aa, Homo Sapiens
VPLCSGQEQ

SEQ ID NO: 1020758 - protein, 9 aa, Homo Sapiens
SPPPKPHAS

SEQ ID NO: 1020759 - protein, 9 aa, Homo Sapiens
PPARKQKSK

SEQ ID NO: 1020760 - protein, 9 aa, Homo Sapiens
YDPGPDDLH

SEQ ID NO: 1020761 - protein, 9 aa, Homo Sapiens
KIAALFIKV

SEQ ID NO: 1020762 - protein, 9 aa, Homo Sapiens
VEGIDFKTN

SEQ ID NO: 1020763 - protein, 9 aa, Homo Sapiens
KALLLYDAD

SEQ ID NO: 1020764 - protein, 9 aa, Homo Sapiens
VPVVFLILS

SEQ ID NO: 1020765 - protein, 9 aa, Homo Sapiens
VFKYEFSEN

SEQ ID NO: 1020766 - protein, 9 aa, Homo Sapiens
AILILFFYI

SEQ ID NO: 1020767 - protein, 9 aa, Homo Sapiens
SLYHDILGD

SEQ ID NO: 1020768 - protein, 9 aa, Homo Sapiens
AFCCATVGR

SEQ ID NO: 1020769 - protein, 9 aa, Homo Sapiens
VGKSSLVYL

SEQ ID NO: 1020770 - protein, 9 aa, Homo Sapiens
QVKKVLIQD

SEQ ID NO: 1020771 - protein, 9 aa, Homo Sapiens
ERIEIKFQG

SEQ ID NO: 1020772 - protein, 9 aa, Homo Sapiens
VLDMSNNCI

SEQ ID NO: 1020773 - protein, 9 aa, Homo Sapiens
LQQERRFLE

SEQ ID NO: 1020774 - protein, 9 aa, Homo Sapiens
GKSFGRRSH

SEQ ID NO: 1020775 - protein, 9 aa, Homo Sapiens
ESLKIIFGI

SEQ ID NO: 1020776 - protein, 9 aa, Homo Sapiens
RYLRGTHSS

SEQ ID NO: 1020777 - protein, 9 aa, Homo Sapiens
PPSILCPPP

SEQ ID NO: 1020778 - protein, 9 aa, Homo Sapiens
NESWGPEER

SEQ ID NO: 1020779 - protein, 9 aa, Homo Sapiens
SNNCISVQA

SEQ ID NO: 1020780 - protein, 9 aa, Homo Sapiens
PAAEEEDDS

SEQ ID NO: 1020781 - protein, 9 aa, Homo Sapiens
VTVGLKQGK

SEQ ID NO: 1020782 - protein, 9 aa, Homo Sapiens
EWNVWGSWY

SEQ ID NO: 1020783 - protein, 9 aa, Homo Sapiens
GEDAMRHTI

SEQ ID NO: 1020784 - protein, 9 aa, Homo Sapiens
QERRFLEPR

SEQ ID NO: 1020785 - protein, 9 aa, Homo Sapiens
YFLADDDWE

SEQ ID NO: 1020786 - protein, 9 aa, Homo Sapiens
DAQTWLFQA

SEQ ID NO: 1020787 - protein, 9 aa, Homo Sapiens
PPPPPSILC

SEQ ID NO: 1020788 - protein, 9 aa, Homo Sapiens
KQKSKLGNR

SEQ ID NO: 1020789 - protein, 9 aa, Homo Sapiens
RICSINKLI

SEQ ID NO: 1020790 - protein, 9 aa, Homo Sapiens
HTGTSEDLG

SEQ ID NO: 1020791 - protein, 9 aa, Homo Sapiens
GPFISVHPG

SEQ ID NO: 1020792 - protein, 9 aa, Homo Sapiens
RQEITSILG

SEQ ID NO: 1020793 - protein, 9 aa, Homo Sapiens
KEERPLPEK

SEQ ID NO: 1020794 - protein, 9 aa, Homo Sapiens
ERSRTLHFR

SEQ ID NO: 1020795 - protein, 9 aa, Homo Sapiens
TMKLNGSRI

SEQ ID NO: 1020796 - protein, 9 aa, Homo Sapiens
PNFCVGKKI

SEQ ID NO: 1020797 - protein, 9 aa, Homo Sapiens
AMRHTIVLF

SEQ ID NO: 1020798 - protein, 9 aa, Homo Sapiens
VHHSSILRA

SEQ ID NO: 1020799 - protein, 9 aa, Homo Sapiens
KSAYDVKNI

SEQ ID NO: 1020800 - protein, 9 aa, Homo Sapiens
DRYETKQRE

SEQ ID NO: 1020801 - protein, 9 aa, Homo Sapiens
STVLDMSNN

SEQ ID NO: 1020802 - protein, 9 aa, Homo Sapiens
PDLIIISSP

SEQ ID NO: 1020803 - protein, 9 aa, Homo Sapiens
GEIEHLDLL

SEQ ID NO: 1020804 - protein, 9 aa, Homo Sapiens
KSQKIKSRY

SEQ ID NO: 1020805 - protein, 9 aa, Homo Sapiens
YEQWKALNK

SEQ ID NO: 1020806 - protein, 9 aa, Homo Sapiens
VLSKKTIRR

SEQ ID NO: 1020807 - protein, 9 aa, Homo Sapiens
VLDRVSVIA

SEQ ID NO: 1020808 - protein, 9 aa, Homo Sapiens
SASPGPSGP

SEQ ID NO: 1020809 - protein, 9 aa, Homo Sapiens
KASESLKII

SEQ ID NO: 1020810 - protein, 9 aa, Homo Sapiens
PEDNLVLPD

SEQ ID NO: 1020811 - protein, 9 aa, Homo Sapiens
IEHLDLLEC

SEQ ID NO: 1020812 - protein, 9 aa, Homo Sapiens
SLRNGCVKS

SEQ ID NO: 1020813 - protein, 9 aa, Homo Sapiens
PQAVTYAAV

SEQ ID NO: 1020814 - protein, 9 aa, Homo Sapiens
RPSSATCDT

SEQ ID NO: 1020815 - protein, 9 aa, Homo Sapiens
SVIYINAII

SEQ ID NO: 1020816 - protein, 9 aa, Homo Sapiens
VVSCLSICI

SEQ ID NO: 1020817 - protein, 9 aa, Homo Sapiens
EDDDENGED

SEQ ID NO: 1020818 - protein, 9 aa, Homo Sapiens
ADEDGILNE

SEQ ID NO: 1020819 - protein, 9 aa, Homo Sapiens
ERGHHTVIL

SEQ ID NO: 1020820 - protein, 9 aa, Homo Sapiens
SPERSRTLH

SEQ ID NO: 1020821 - protein, 9 aa, Homo Sapiens
KWKIKLQVL

SEQ ID NO: 1020822 - protein, 9 aa, Homo Sapiens
GINAMLEGL

SEQ ID NO: 1020823 - protein, 9 aa, Homo Sapiens
KSLYHDILG

SEQ ID NO: 1020824 - protein, 9 aa, Homo Sapiens
QFRGGPFIS

SEQ ID NO: 1020825 - protein, 9 aa, Homo Sapiens
IKKEERPLP

SEQ ID NO: 1020826 - protein, 9 aa, Homo Sapiens
KVEALSTEV

SEQ ID NO: 1020827 - protein, 9 aa, Homo Sapiens
SGSLLQEAL

SEQ ID NO: 1020828 - protein, 9 aa, Homo Sapiens
LHETVLDRV

SEQ ID NO: 1020829 - protein, 9 aa, Homo Sapiens
EDYLNIKNF

SEQ ID NO: 1020830 - protein, 9 aa, Homo Sapiens
SQKNVRCPW

SEQ ID NO: 1020831 - protein, 9 aa, Homo Sapiens
SSLKMNPAG

SEQ ID NO: 1020832 - protein, 9 aa, Homo Sapiens
PHLLFGRLV

SEQ ID NO: 1020833 - protein, 9 aa, Homo Sapiens
NFHKCEECG

SEQ ID NO: 1020834 - protein, 9 aa, Homo Sapiens
AFVEVTEER

SEQ ID NO: 1020835 - protein, 9 aa, Homo Sapiens
AQAFTETKE

SEQ ID NO: 1020836 - protein, 9 aa, Homo Sapiens
QMGELSGTT

SEQ ID NO: 1020837 - protein, 9 aa, Homo Sapiens
KHWTGGCPF

SEQ ID NO: 1020838 - protein, 9 aa, Homo Sapiens
NCISVQATT

SEQ ID NO: 1020839 - protein, 9 aa, Homo Sapiens
QVKPESSEG

SEQ ID NO: 1020840 - protein, 9 aa, Homo Sapiens
VMRSPHWDV

SEQ ID NO: 1020841 - protein, 9 aa, Homo Sapiens
KKWNLIPEG

SEQ ID NO: 1020842 - protein, 9 aa, Homo Sapiens
CVLERHIFD

SEQ ID NO: 1020843 - protein, 9 aa, Homo Sapiens
AFYGAKPST

SEQ ID NO: 1020844 - protein, 9 aa, Homo Sapiens
EEEDDSDRP

SEQ ID NO: 1020845 - protein, 9 aa, Homo Sapiens
SPNKSAYDV

SEQ ID NO: 1020846 - protein, 9 aa, Homo Sapiens
NKIAALFIK

SEQ ID NO: 1020847 - protein, 9 aa, Homo Sapiens
NYNLREDAL

SEQ ID NO: 1020848 - protein, 9 aa, Homo Sapiens
NLPAQESIL

SEQ ID NO: 1020849 - protein, 9 aa, Homo Sapiens
LLESSSAQA

SEQ ID NO: 1020850 - protein, 9 aa, Homo Sapiens
YLIVQVMGE

SEQ ID NO: 1020851 - protein, 9 aa, Homo Sapiens
TSSTRINML

SEQ ID NO: 1020852 - protein, 9 aa, Homo Sapiens
SLCRHERTH

SEQ ID NO: 1020853 - protein, 9 aa, Homo Sapiens
GKASESLKI

SEQ ID NO: 1020854 - protein, 9 aa, Homo Sapiens
TLMVFLFTI

SEQ ID NO: 1020855 - protein, 9 aa, Homo Sapiens
GGSKEYKVV

SEQ ID NO: 1020856 - protein, 9 aa, Homo Sapiens
FHHRFPCCR

SEQ ID NO: 1020857 - protein, 9 aa, Homo Sapiens
QKITLYLTE

SEQ ID NO: 1020858 - protein, 9 aa, Homo Sapiens
YGAKPSTAP

SEQ ID NO: 1020859 - protein, 9 aa, Homo Sapiens
RNVLRKGLV

SEQ ID NO: 1020860 - protein, 9 aa, Homo Sapiens
GLGESPPNE

SEQ ID NO: 1020861 - protein, 9 aa, Homo Sapiens
EENTLKCSA

SEQ ID NO: 1020862 - protein, 9 aa, Homo Sapiens
QAPRTQAME

SEQ ID NO: 1020863 - protein, 9 aa, Homo Sapiens
WAVGTFLHN

SEQ ID NO: 1020864 - protein, 9 aa, Homo Sapiens
TLGGREKFE

SEQ ID NO: 1020865 - protein, 9 aa, Homo Sapiens
AEPLKKEFQ

SEQ ID NO: 1020866 - protein, 9 aa, Homo Sapiens
SYTEEFSEK

SEQ ID NO: 1020867 - protein, 9 aa, Homo Sapiens
VAVSYELIA

SEQ ID NO: 1020868 - protein, 9 aa, Homo Sapiens
EQFFPGHSN

SEQ ID NO: 1020869 - protein, 9 aa, Homo Sapiens
VCNTRQNES

SEQ ID NO: 1020870 - protein, 9 aa, Homo Sapiens
EANEFRRGR

SEQ ID NO: 1020871 - protein, 9 aa, Homo Sapiens
HTRDRPYEC

SEQ ID NO: 1020872 - protein, 9 aa, Homo Sapiens
QEFSKGTPR

SEQ ID NO: 1020873 - protein, 9 aa, Homo Sapiens
ISYTEEFSE

SEQ ID NO: 1020874 - protein, 9 aa, Homo Sapiens
RERGRLSLY

SEQ ID NO: 1020875 - protein, 9 aa, Homo Sapiens
NNCISVQAT

SEQ ID NO: 1020876 - protein, 9 aa, Homo Sapiens
EPLKKEFQP

SEQ ID NO: 1020877 - protein, 9 aa, Homo Sapiens
EDVFLANAL

SEQ ID NO: 1020878 - protein, 9 aa, Homo Sapiens
FRNVAIEFS

SEQ ID NO: 1020879 - protein, 9 aa, Homo Sapiens
KILRKIPEL

SEQ ID NO: 1020880 - protein, 9 aa, Homo Sapiens
DDYGSRYLG

SEQ ID NO: 1020881 - protein, 9 aa, Homo Sapiens
NYANSYRGF

SEQ ID NO: 1020882 - protein, 9 aa, Homo Sapiens
RGTHSSFAN

SEQ ID NO: 1020883 - protein, 9 aa, Homo Sapiens
LDIYDSKDY

SEQ ID NO: 1020884 - protein, 9 aa, Homo Sapiens
SLFVHVLKT

SEQ ID NO: 1020885 - protein, 9 aa, Homo Sapiens
IGDFGLATM

SEQ ID NO: 1020886 - protein, 9 aa, Homo Sapiens
GRTTFRLPP

SEQ ID NO: 1020887 - protein, 9 aa, Homo Sapiens
AMKSWLRNV

SEQ ID NO: 1020888 - protein, 9 aa, Homo Sapiens
SNPGAGSLA

SEQ ID NO: 1020889 - protein, 9 aa, Homo Sapiens
EITSILGYC

SEQ ID NO: 1020890 - protein, 9 aa, Homo Sapiens
KQPWADPEK

SEQ ID NO: 1020891 - protein, 9 aa, Homo Sapiens
LGFHLLFFF

SEQ ID NO: 1020892 - protein, 9 aa, Homo Sapiens
EIFGEDAMR

SEQ ID NO: 1020893 - protein, 9 aa, Homo Sapiens
HKKPTGIIR

SEQ ID NO: 1020894 - protein, 9 aa, Homo Sapiens
AVVGINITD

SEQ ID NO: 1020895 - protein, 9 aa, Homo Sapiens
FSPPSAARH

SEQ ID NO: 1020896 - protein, 9 aa, Homo Sapiens
IEETCIIPC

SEQ ID NO: 1020897 - protein, 9 aa, Homo Sapiens
EDADEDGIL

SEQ ID NO: 1020898 - protein, 9 aa, Homo Sapiens
TKSQSALAY

SEQ ID NO: 1020899 - protein, 9 aa, Homo Sapiens
VSKPTTFPI

SEQ ID NO: 1020900 - protein, 9 aa, Homo Sapiens
SEPLPLMDL

SEQ ID NO: 1020901 - protein, 9 aa, Homo Sapiens
ALSSAAAGL

SEQ ID NO: 1020902 - protein, 9 aa, Homo Sapiens
HDEDAGALC

SEQ ID NO: 1020903 - protein, 9 aa, Homo Sapiens
LDSEPLPLM

SEQ ID NO: 1020904 - protein, 9 aa, Homo Sapiens
LATGEEIYN

SEQ ID NO: 1020905 - protein, 9 aa, Homo Sapiens
VIPNRIFVE

SEQ ID NO: 1020906 - protein, 9 aa, Homo Sapiens
TNYANSYRG

SEQ ID NO: 1020907 - protein, 9 aa, Homo Sapiens
VLERHIFDF

SEQ ID NO: 1020908 - protein, 9 aa, Homo Sapiens
NTLTRPSEF

SEQ ID NO: 1020909 - protein, 9 aa, Homo Sapiens
CVKSCVSPL

SEQ ID NO: 1020910 - protein, 9 aa, Homo Sapiens
KYFQKITLY

SEQ ID NO: 1020911 - protein, 9 aa, Homo Sapiens
KPPQLQEKK

SEQ ID NO: 1020912 - protein, 9 aa, Homo Sapiens
LLSAEFSGT

SEQ ID NO: 1020913 - protein, 9 aa, Homo Sapiens
KFDTKASVY

SEQ ID NO: 1020914 - protein, 9 aa, Homo Sapiens
EVCVSTTNS

SEQ ID NO: 1020915 - protein, 9 aa, Homo Sapiens
EKFENLLNV

SEQ ID NO: 1020916 - protein, 9 aa, Homo Sapiens
PRTVIIQEP

SEQ ID NO: 1020917 - protein, 9 aa, Homo Sapiens
IYNVPGIRH

SEQ ID NO: 1020918 - protein, 9 aa, Homo Sapiens
DSKDYSVTV

SEQ ID NO: 1020919 - protein, 9 aa, Homo Sapiens
WEAGSGGRE

SEQ ID NO: 1020920 - protein, 9 aa, Homo Sapiens
KPEPTDKEW

SEQ ID NO: 1020921 - protein, 9 aa, Homo Sapiens
QNQELIRDH

SEQ ID NO: 1020922 - protein, 9 aa, Homo Sapiens
LASFKLIQR

SEQ ID NO: 1020923 - protein, 9 aa, Homo Sapiens
FDGEKGDKG

SEQ ID NO: 1020924 - protein, 9 aa, Homo Sapiens
LPTSSTRIN

SEQ ID NO: 1020925 - protein, 9 aa, Homo Sapiens
ANRMQKFPC

SEQ ID NO: 1020926 - protein, 9 aa, Homo Sapiens
KDANKGDEL

SEQ ID NO: 1020927 - protein, 9 aa, Homo Sapiens
FTETKENVI

SEQ ID NO: 1020928 - protein, 9 aa, Homo Sapiens
NSSISIKKF

SEQ ID NO: 1020929 - protein, 9 aa, Homo Sapiens
QTAMMSFKT

SEQ ID NO: 1020930 - protein, 9 aa, Homo Sapiens
MGVPQGRIP

SEQ ID NO: 1020931 - protein, 9 aa, Homo Sapiens
LKMNPAGLE

SEQ ID NO: 1020932 - protein, 9 aa, Homo Sapiens
VRGIKKLDN

SEQ ID NO: 1020933 - protein, 9 aa, Homo Sapiens
MKRTERVWV

SEQ ID NO: 1020934 - protein, 9 aa, Homo Sapiens
LTVVLSTNY

SEQ ID NO: 1020935 - protein, 9 aa, Homo Sapiens
TVILLSEGR

SEQ ID NO: 1020936 - protein, 9 aa, Homo Sapiens
AQKAAGGSE

SEQ ID NO: 1020937 - protein, 9 aa, Homo Sapiens
QQEEGQRQG

SEQ ID NO: 1020938 - protein, 9 aa, Homo Sapiens
AVAFSGNLQ

SEQ ID NO: 1020939 - protein, 9 aa, Homo Sapiens
LCDPPPHNQ

SEQ ID NO: 1020940 - protein, 9 aa, Homo Sapiens
DPVVARVNC

SEQ ID NO: 1020941 - protein, 9 aa, Homo Sapiens
KIYTCNNES

SEQ ID NO: 1020942 - protein, 9 aa, Homo Sapiens
TCSLYANLA

SEQ ID NO: 1020943 - protein, 9 aa, Homo Sapiens
SRVNIQGGN

SEQ ID NO: 1020944 - protein, 9 aa, Homo Sapiens
LGESPPNEL

SEQ ID NO: 1020945 - protein, 9 aa, Homo Sapiens
HCPQVECWT

SEQ ID NO: 1020946 - protein, 9 aa, Homo Sapiens
NLVLPDDVV

SEQ ID NO: 1020947 - protein, 9 aa, Homo Sapiens
NFCSPSRKK

SEQ ID NO: 1020948 - protein, 9 aa, Homo Sapiens
CAPPPAAPS

SEQ ID NO: 1020949 - protein, 9 aa, Homo Sapiens
GTSEDLGSR

SEQ ID NO: 1020950 - protein, 9 aa, Homo Sapiens
TDRGMEFKL

SEQ ID NO: 1020951 - protein, 9 aa, Homo Sapiens
LTQKKQKVQ

SEQ ID NO: 1020952 - protein, 9 aa, Homo Sapiens
VGHARQGWA

SEQ ID NO: 1020953 - protein, 9 aa, Homo Sapiens
LKKWNLIPE

SEQ ID NO: 1020954 - protein, 9 aa, Homo Sapiens
LRKEDAERY

SEQ ID NO: 1020955 - protein, 9 aa, Homo Sapiens
LQFLMDYQF

SEQ ID NO: 1020956 - protein, 9 aa, Homo Sapiens
STSSRLACH

SEQ ID NO: 1020957 - protein, 9 aa, Homo Sapiens
WADPEKTSE

SEQ ID NO: 1020958 - protein, 9 aa, Homo Sapiens
GHHTVILLS

SEQ ID NO: 1020959 - protein, 9 aa, Homo Sapiens
GSLGQVAVK

SEQ ID NO: 1020960 - protein, 9 aa, Homo Sapiens
EKILRKIPE

SEQ ID NO: 1020961 - protein, 9 aa, Homo Sapiens
DFHRVTKEG

SEQ ID NO: 1020962 - protein, 9 aa, Homo Sapiens
RGGPFISVH

SEQ ID NO: 1020963 - protein, 9 aa, Homo Sapiens
IAVAFSGNL

SEQ ID NO: 1020964 - protein, 9 aa, Homo Sapiens
YYYKDTIST

SEQ ID NO: 1020965 - protein, 9 aa, Homo Sapiens
LLNVAQRCL

SEQ ID NO: 1020966 - protein, 9 aa, Homo Sapiens
SYYCECYEG

SEQ ID NO: 1020967 - protein, 9 aa, Homo Sapiens
DWLVRAQKA

SEQ ID NO: 1020968 - protein, 9 aa, Homo Sapiens
DNLVLPDDV

SEQ ID NO: 1020969 - protein, 9 aa, Homo Sapiens
AKALLLYDA

SEQ ID NO: 1020970 - protein, 9 aa, Homo Sapiens
EYDPGPDDL

SEQ ID NO: 1020971 - protein, 9 aa, Homo Sapiens
TNKSGSLLQ

SEQ ID NO: 1020972 - protein, 9 aa, Homo Sapiens
LDQIMEHIK

SEQ ID NO: 1020973 - protein, 9 aa, Homo Sapiens
ERRAEAQQG

SEQ ID NO: 1020974 - protein, 9 aa, Homo Sapiens
YRYNFSQEN

SEQ ID NO: 1020975 - protein, 9 aa, Homo Sapiens
EGPGPEEPE

SEQ ID NO: 1020976 - protein, 9 aa, Homo Sapiens
ASNHASPNK

SEQ ID NO: 1020977 - protein, 9 aa, Homo Sapiens
RDPGIPGPP

SEQ ID NO: 1020978 - protein, 9 aa, Homo Sapiens
STIFLVFVL

SEQ ID NO: 1020979 - protein, 9 aa, Homo Sapiens
STSRIFPLN

SEQ ID NO: 1020980 - protein, 9 aa, Homo Sapiens
GIIRIHQMN

SEQ ID NO: 1020981 - protein, 9 aa, Homo Sapiens
EWSLLNVAQ

SEQ ID NO: 1020982 - protein, 9 aa, Homo Sapiens
TLGKQLNAN

SEQ ID NO: 1020983 - protein, 9 aa, Homo Sapiens
VNTATTSTP

SEQ ID NO: 1020984 - protein, 9 aa, Homo Sapiens
TLAREDVFL

SEQ ID NO: 1020985 - protein, 9 aa, Homo Sapiens
RGNNRVRLA

SEQ ID NO: 1020986 - protein, 9 aa, Homo Sapiens
AGSLAPASP

SEQ ID NO: 1020987 - protein, 9 aa, Homo Sapiens
IFLVFVLTH

SEQ ID NO: 1020988 - protein, 9 aa, Homo Sapiens
VQKLQAPRT

SEQ ID NO: 1020989 - protein, 9 aa, Homo Sapiens
LLYDADIES

SEQ ID NO: 1020990 - protein, 9 aa, Homo Sapiens
RIAVAFSGN

SEQ ID NO: 1020991 - protein, 9 aa, Homo Sapiens
RNALYERAM

SEQ ID NO: 1020992 - protein, 9 aa, Homo Sapiens
NTRQNESWG

SEQ ID NO: 1020993 - protein, 9 aa, Homo Sapiens
KSGSLLQEA

SEQ ID NO: 1020994 - protein, 9 aa, Homo Sapiens
GVKGACGFD

SEQ ID NO: 1020995 - protein, 9 aa, Homo Sapiens
ESWGPEERK

SEQ ID NO: 1020996 - protein, 9 aa, Homo Sapiens
GDPDWPEDQ

SEQ ID NO: 1020997 - protein, 9 aa, Homo Sapiens
FFHLQQERR

SEQ ID NO: 1020998 - protein, 9 aa, Homo Sapiens
ESLDKDNSA

SEQ ID NO: 1020999 - protein, 9 aa, Homo Sapiens
FFYILILKS

SEQ ID NO: 1021000 - protein, 9 aa, Homo Sapiens
QVIDSRLQL

SEQ ID NO: 1021001 - protein, 9 aa, Homo Sapiens
FVEVTEERA

SEQ ID NO: 1021002 - protein, 9 aa, Homo Sapiens
LGTVICKWN

SEQ ID NO: 1021003 - protein, 9 aa, Homo Sapiens
NFCVGKKIG

SEQ ID NO: 1021004 - protein, 9 aa, Homo Sapiens
RDRPYECHL

SEQ ID NO: 1021005 - protein, 9 aa, Homo Sapiens
GSMVPTSAA

SEQ ID NO: 1021006 - protein, 9 aa, Homo Sapiens
NRYVLGMRA

SEQ ID NO: 1021007 - protein, 9 aa, Homo Sapiens
VGQSKILFR

SEQ ID NO: 1021008 - protein, 9 aa, Homo Sapiens
MRSPHWDVG

SEQ ID NO: 1021009 - protein, 9 aa, Homo Sapiens
FISYTEEFS

SEQ ID NO: 1021010 - protein, 9 aa, Homo Sapiens
HDCNLLREQ

SEQ ID NO: 1021011 - protein, 9 aa, Homo Sapiens
GPPGSAGSR

SEQ ID NO: 1021012 - protein, 9 aa, Homo Sapiens
ERRDSFLGE

SEQ ID NO: 1021013 - protein, 9 aa, Homo Sapiens
SSGRKQKAL

SEQ ID NO: 1021014 - protein, 9 aa, Homo Sapiens
PQVKPESSE

SEQ ID NO: 1021015 - protein, 9 aa, Homo Sapiens
EFPKGAIGH

SEQ ID NO: 1021016 - protein, 9 aa, Homo Sapiens
SLLSAASSS

SEQ ID NO: 1021017 - protein, 9 aa, Homo Sapiens
GVAASLCLC

SEQ ID NO: 1021018 - protein, 9 aa, Homo Sapiens
CCLMGFLAM

SEQ ID NO: 1021019 - protein, 9 aa, Homo Sapiens
PTDPTSQRS

SEQ ID NO: 1021020 - protein, 9 aa, Homo Sapiens
KDQVIDSRL

SEQ ID NO: 1021021 - protein, 9 aa, Homo Sapiens
SLQNMKRTE

SEQ ID NO: 1021022 - protein, 9 aa, Homo Sapiens
VILLSEGRD

SEQ ID NO: 1021023 - protein, 9 aa, Homo Sapiens
AELSATAQK

SEQ ID NO: 1021024 - protein, 9 aa, Homo Sapiens
SLTVVLSTN

SEQ ID NO: 1021025 - protein, 9 aa, Homo Sapiens
PTGIIRIHQ

SEQ ID NO: 1021026 - protein, 9 aa, Homo Sapiens
NPQDIISQS

SEQ ID NO: 1021027 - protein, 9 aa, Homo Sapiens
GNAVGGSAE

SEQ ID NO: 1021028 - protein, 9 aa, Homo Sapiens
NWHLPQMFS

SEQ ID NO: 1021029 - protein, 9 aa, Homo Sapiens
WDVGSTDDD

SEQ ID NO: 1021030 - protein, 9 aa, Homo Sapiens
KEWELIKTV

SEQ ID NO: 1021031 - protein, 9 aa, Homo Sapiens
KFYTLKVEA

SEQ ID NO: 1021032 - protein, 9 aa, Homo Sapiens
QSTSEELCT

SEQ ID NO: 1021033 - protein, 9 aa, Homo Sapiens
ANKGDELKD

SEQ ID NO: 1021034 - protein, 9 aa, Homo Sapiens
RNTLTRPSE

SEQ ID NO: 1021035 - protein, 9 aa, Homo Sapiens
IQESVKDQV

SEQ ID NO: 1021036 - protein, 9 aa, Homo Sapiens
CQPGYTMKL

SEQ ID NO: 1021037 - protein, 9 aa, Homo Sapiens
GSAYLIVQV

SEQ ID NO: 1021038 - protein, 9 aa, Homo Sapiens
LDIAENEML

SEQ ID NO: 1021039 - protein, 9 aa, Homo Sapiens
KFHFSDLEC

SEQ ID NO: 1021040 - protein, 9 aa, Homo Sapiens
SAPSQADPG

SEQ ID NO: 1021041 - protein, 9 aa, Homo Sapiens
KVPNESCYP

SEQ ID NO: 1021042 - protein, 9 aa, Homo Sapiens
YILIKATYR

SEQ ID NO: 1021043 - protein, 9 aa, Homo Sapiens
NISQPDKVS

SEQ ID NO: 1021044 - protein, 9 aa, Homo Sapiens
AVGHARQGW

SEQ ID NO: 1021045 - protein, 9 aa, Homo Sapiens
ACMIIWVLA

SEQ ID NO: 1021046 - protein, 9 aa, Homo Sapiens
PSQADPGSA

SEQ ID NO: 1021047 - protein, 9 aa, Homo Sapiens
SNPWPSSYV

SEQ ID NO: 1021048 - protein, 9 aa, Homo Sapiens
VSWYKDGVF

SEQ ID NO: 1021049 - protein, 9 aa, Homo Sapiens
ESVKDQVID

SEQ ID NO: 1021050 - protein, 9 aa, Homo Sapiens
NAVGGSAEA

SEQ ID NO: 1021051 - protein, 9 aa, Homo Sapiens
QEGKYEFSD

SEQ ID NO: 1021052 - protein, 9 aa, Homo Sapiens
TSSMSTIRQ

SEQ ID NO: 1021053 - protein, 9 aa, Homo Sapiens
GAKLGTVIC

SEQ ID NO: 1021054 - protein, 9 aa, Homo Sapiens
ARMGVPQGR

SEQ ID NO: 1021055 - protein, 9 aa, Homo Sapiens
VAKKITREY

SEQ ID NO: 1021056 - protein, 9 aa, Homo Sapiens
RVGVVGGDV

SEQ ID NO: 1021057 - protein, 9 aa, Homo Sapiens
KVWFAAGSG

SEQ ID NO: 1021058 - protein, 9 aa, Homo Sapiens
NGTVVQYLS

SEQ ID NO: 1021059 - protein, 9 aa, Homo Sapiens
KAIGYSFAV

SEQ ID NO: 1021060 - protein, 9 aa, Homo Sapiens
IREIFLPLS

SEQ ID NO: 1021061 - protein, 9 aa, Homo Sapiens
PWPSSYVQA

SEQ ID NO: 1021062 - protein, 9 aa, Homo Sapiens
RAEAQQGHR

SEQ ID NO: 1021063 - protein, 9 aa, Homo Sapiens
LRKLGQLLL

SEQ ID NO: 1021064 - protein, 9 aa, Homo Sapiens
YMKHLDHDP

SEQ ID NO: 1021065 - protein, 9 aa, Homo Sapiens
KKKKPKKKK

SEQ ID NO: 1021066 - protein, 9 aa, Homo Sapiens
GGVGVAASL

SEQ ID NO: 1021067 - protein, 9 aa, Homo Sapiens
SSRHDCNLL

SEQ ID NO: 1021068 - protein, 9 aa, Homo Sapiens
LCPPPPSAS

SEQ ID NO: 1021069 - protein, 9 aa, Homo Sapiens
YHDILGDTS

SEQ ID NO: 1021070 - protein, 9 aa, Homo Sapiens
ILSVTWIGA

SEQ ID NO: 1021071 - protein, 9 aa, Homo Sapiens
CLMGFLAML

SEQ ID NO: 1021072 - protein, 9 aa, Homo Sapiens
DGDMFKKLD

SEQ ID NO: 1021073 - protein, 9 aa, Homo Sapiens
SKPTTFPIS

SEQ ID NO: 1021074 - protein, 9 aa, Homo Sapiens
KKKLEQGTL

SEQ ID NO: 1021075 - protein, 9 aa, Homo Sapiens
PRVGVVGGD

SEQ ID NO: 1021076 - protein, 9 aa, Homo Sapiens
KAFCCATVG

SEQ ID NO: 1021077 - protein, 9 aa, Homo Sapiens
GTYIGINAM

SEQ ID NO: 1021078 - protein, 9 aa, Homo Sapiens
DSEPLPLMD

SEQ ID NO: 1021079 - protein, 9 aa, Homo Sapiens
SGRPTGSLL

SEQ ID NO: 1021080 - protein, 9 aa, Homo Sapiens
DSGALTSPG

SEQ ID NO: 1021081 - protein, 9 aa, Homo Sapiens
DEEHSGLAG

SEQ ID NO: 1021082 - protein, 9 aa, Homo Sapiens
LVCVLERHI

SEQ ID NO: 1021083 - protein, 9 aa, Homo Sapiens
FKKLQGISQ

SEQ ID NO: 1021084 - protein, 9 aa, Homo Sapiens
LAYALQKAQ

SEQ ID NO: 1021085 - protein, 9 aa, Homo Sapiens
SGNLQLIFI

SEQ ID NO: 1021086 - protein, 9 aa, Homo Sapiens
DPQAVTYAA

SEQ ID NO: 1021087 - protein, 9 aa, Homo Sapiens
GVGKSSLVY

SEQ ID NO: 1021088 - protein, 9 aa, Homo Sapiens
ECSCPEEIR

SEQ ID NO: 1021089 - protein, 9 aa, Homo Sapiens
KSFGRRSHL

SEQ ID NO: 1021090 - protein, 9 aa, Homo Sapiens
KRFLLSKSG

SEQ ID NO: 1021091 - protein, 9 aa, Homo Sapiens
DPSTSSRLA

SEQ ID NO: 1021092 - protein, 9 aa, Homo Sapiens
KPKPPQLQE

SEQ ID NO: 1021093 - protein, 9 aa, Homo Sapiens
EALSTEVLG

SEQ ID NO: 1021094 - protein, 9 aa, Homo Sapiens
DEDGILNEQ

SEQ ID NO: 1021095 - protein, 9 aa, Homo Sapiens
VYFDKNEHW

SEQ ID NO: 1021096 - protein, 9 aa, Homo Sapiens
PLFSRSMEI

SEQ ID NO: 1021097 - protein, 9 aa, Homo Sapiens
WPEDQVLMR

SEQ ID NO: 1021098 - protein, 9 aa, Homo Sapiens
EADEDAADE

SEQ ID NO: 1021099 - protein, 9 aa, Homo Sapiens
KDGVFLKDD

SEQ ID NO: 1021100 - protein, 9 aa, Homo Sapiens
PHFLKPLER

SEQ ID NO: 1021101 - protein, 9 aa, Homo Sapiens
PEKILRKIP

SEQ ID NO: 1021102 - protein, 9 aa, Homo Sapiens
PGAGSLAPA

SEQ ID NO: 1021103 - protein, 9 aa, Homo Sapiens
RHTIVLFTH

SEQ ID NO: 1021104 - protein, 9 aa, Homo Sapiens
RVILINSPM

SEQ ID NO: 1021105 - protein, 9 aa, Homo Sapiens
SIGGIFSRA

SEQ ID NO: 1021106 - protein, 9 aa, Homo Sapiens
GSLLQEALV

SEQ ID NO: 1021107 - protein, 9 aa, Homo Sapiens
QPQPGHANL

SEQ ID NO: 1021108 - protein, 9 aa, Homo Sapiens
DWMESFFLS

SEQ ID NO: 1021109 - protein, 9 aa, Homo Sapiens
FSDKDWAHI

SEQ ID NO: 1021110 - protein, 9 aa, Homo Sapiens
SSCLHSHAE

SEQ ID NO: 1021111 - protein, 9 aa, Homo Sapiens
VQCCLMGFL

SEQ ID NO: 1021112 - protein, 9 aa, Homo Sapiens
RFPNIKLYN

SEQ ID NO: 1021113 - protein, 9 aa, Homo Sapiens
ISGSSVVEM

SEQ ID NO: 1021114 - protein, 9 aa, Homo Sapiens
SILRAEGIN

SEQ ID NO: 1021115 - protein, 9 aa, Homo Sapiens
LFFYILILK

SEQ ID NO: 1021116 - protein, 9 aa, Homo Sapiens
GEGPGPEEP

SEQ ID NO: 1021117 - protein, 9 aa, Homo Sapiens
DDKSECSCP

SEQ ID NO: 1021118 - protein, 9 aa, Homo Sapiens
GCQRYMVST

SEQ ID NO: 1021119 - protein, 9 aa, Homo Sapiens
SLLSAEFSG

SEQ ID NO: 1021120 - protein, 9 aa, Homo Sapiens
VLRVAATTG

SEQ ID NO: 1021121 - protein, 9 aa, Homo Sapiens
KITLYLTEK

SEQ ID NO: 1021122 - protein, 9 aa, Homo Sapiens
YRNFMRQSR

SEQ ID NO: 1021123 - protein, 9 aa, Homo Sapiens
SLVYLLCQN

SEQ ID NO: 1021124 - protein, 9 aa, Homo Sapiens
VVGTFSKPC

SEQ ID NO: 1021125 - protein, 9 aa, Homo Sapiens
HGSAYLIVQ

SEQ ID NO: 1021126 - protein, 9 aa, Homo Sapiens
RKQKALSTC

SEQ ID NO: 1021127 - protein, 9 aa, Homo Sapiens
DKSTEDWME

SEQ ID NO: 1021128 - protein, 9 aa, Homo Sapiens
SSSGLLDTI

SEQ ID NO: 1021129 - protein, 9 aa, Homo Sapiens
IIWVLAFFL

SEQ ID NO: 1021130 - protein, 9 aa, Homo Sapiens
PAPHLLFGR

SEQ ID NO: 1021131 - protein, 9 aa, Homo Sapiens
LSLYVQRDI

SEQ ID NO: 1021132 - protein, 9 aa, Homo Sapiens
KIDAGVCEE

SEQ ID NO: 1021133 - protein, 9 aa, Homo Sapiens
SSNLYFLAD

SEQ ID NO: 1021134 - protein, 9 aa, Homo Sapiens
HSSFANGIN

SEQ ID NO: 1021135 - protein, 9 aa, Homo Sapiens
SHFIAWTDR

SEQ ID NO: 1021136 - protein, 9 aa, Homo Sapiens
TKKFYTLKV

SEQ ID NO: 1021137 - protein, 9 aa, Homo Sapiens
QKAAGGSEG

SEQ ID NO: 1021138 - protein, 9 aa, Homo Sapiens
GQSESRSAS

SEQ ID NO: 1021139 - protein, 9 aa, Homo Sapiens
QKSKLGNRH

SEQ ID NO: 1021140 - protein, 9 aa, Homo Sapiens
LRAEGINCN

SEQ ID NO: 1021141 - protein, 9 aa, Homo Sapiens
KKYFQKITL

SEQ ID NO: 1021142 - protein, 9 aa, Homo Sapiens
YCECYEGYT

SEQ ID NO: 1021143 - protein, 9 aa, Homo Sapiens
QMRSQVCIK

SEQ ID NO: 1021144 - protein, 9 aa, Homo Sapiens
GWDAYQDGF

SEQ ID NO: 1021145 - protein, 9 aa, Homo Sapiens
DASRGQSES

SEQ ID NO: 1021146 - protein, 9 aa, Homo Sapiens
GSSVVEMQG

SEQ ID NO: 1021147 - protein, 9 aa, Homo Sapiens
KIPSFFTSV

SEQ ID NO: 1021148 - protein, 9 aa, Homo Sapiens
MREIQISPP

SEQ ID NO: 1021149 - protein, 9 aa, Homo Sapiens
PKVWFAAGS

SEQ ID NO: 1021150 - protein, 9 aa, Homo Sapiens
QGLLKVIQN

SEQ ID NO: 1021151 - protein, 9 aa, Homo Sapiens
KIENLLLDG

SEQ ID NO: 1021152 - protein, 9 aa, Homo Sapiens
AGSAPSQAD

SEQ ID NO: 1021153 - protein, 9 aa, Homo Sapiens
DSVFFPDPM

SEQ ID NO: 1021154 - protein, 9 aa, Homo Sapiens
LLFYAFIVA

SEQ ID NO: 1021155 - protein, 9 aa, Homo Sapiens
CSPSRKKRG

SEQ ID NO: 1021156 - protein, 9 aa, Homo Sapiens
SIKKFDTKA

SEQ ID NO: 1021157 - protein, 9 aa, Homo Sapiens
KIIFGIDVK

SEQ ID NO: 1021158 - protein, 9 aa, Homo Sapiens
LGNSMDPPD

SEQ ID NO: 1021159 - protein, 9 aa, Homo Sapiens
NILTQKDAQ

SEQ ID NO: 1021160 - protein, 9 aa, Homo Sapiens
LLKKWNLIP

SEQ ID NO: 1021161 - protein, 9 aa, Homo Sapiens
TTFDIYKFH

SEQ ID NO: 1021162 - protein, 9 aa, Homo Sapiens
TYTPITSSM

SEQ ID NO: 1021163 - protein, 9 aa, Homo Sapiens
IKVGKNFPP

SEQ ID NO: 1021164 - protein, 9 aa, Homo Sapiens
GNMSRENSL

SEQ ID NO: 1021165 - protein, 9 aa, Homo Sapiens
KAGSESPHS

SEQ ID NO: 1021166 - protein, 9 aa, Homo Sapiens
DEDAGALCE

SEQ ID NO: 1021167 - protein, 9 aa, Homo Sapiens
HETVLDRVS

SEQ ID NO: 1021168 - protein, 9 aa, Homo Sapiens
RLNSEEGDG

SEQ ID NO: 1021169 - protein, 9 aa, Homo Sapiens
YRVGQSKIL

SEQ ID NO: 1021170 - protein, 9 aa, Homo Sapiens
MAKALLLYD

SEQ ID NO: 1021171 - protein, 9 aa, Homo Sapiens
GQFRGGPFI

SEQ ID NO: 1021172 - protein, 9 aa, Homo Sapiens
TRHVIEVSN

SEQ ID NO: 1021173 - protein, 9 aa, Homo Sapiens
YDSKDYSVT

SEQ ID NO: 1021174 - protein, 9 aa, Homo Sapiens
TTRIILTTN

SEQ ID NO: 1021175 - protein, 9 aa, Homo Sapiens
YYCECYEGY

SEQ ID NO: 1021176 - protein, 9 aa, Homo Sapiens
DPRLHFLMY

SEQ ID NO: 1021177 - protein, 9 aa, Homo Sapiens
KKLEQGTLA

SEQ ID NO: 1021178 - protein, 9 aa, Homo Sapiens
QAHWASERL

SEQ ID NO: 1021179 - protein, 9 aa, Homo Sapiens
QPVQLGILN

SEQ ID NO: 1021180 - protein, 9 aa, Homo Sapiens
LNNMKQELT

SEQ ID NO: 1021181 - protein, 9 aa, Homo Sapiens
YQFIKLIYF

SEQ ID NO: 1021182 - protein, 9 aa, Homo Sapiens
NSEEGDGAW

SEQ ID NO: 1021183 - protein, 9 aa, Homo Sapiens
LHKVLHVSL

SEQ ID NO: 1021184 - protein, 9 aa, Homo Sapiens
NKPQKPVSA

SEQ ID NO: 1021185 - protein, 9 aa, Homo Sapiens
SAGLRPSSA

SEQ ID NO: 1021186 - protein, 9 aa, Homo Sapiens
GLRPSSATC

SEQ ID NO: 1021187 - protein, 9 aa, Homo Sapiens
PGPRGLQRD

SEQ ID NO: 1021188 - protein, 9 aa, Homo Sapiens
RALDGTSFQ

SEQ ID NO: 1021189 - protein, 9 aa, Homo Sapiens
YELIATKIH

SEQ ID NO: 1021190 - protein, 9 aa, Homo Sapiens
KRGADFGER

SEQ ID NO: 1021191 - protein, 9 aa, Homo Sapiens
TTVAKKITR

SEQ ID NO: 1021192 - protein, 9 aa, Homo Sapiens
IRDHFGHHV

SEQ ID NO: 1021193 - protein, 9 aa, Homo Sapiens
PQVECWTPA

SEQ ID NO: 1021194 - protein, 9 aa, Homo Sapiens
QNMKRTERV

SEQ ID NO: 1021195 - protein, 9 aa, Homo Sapiens
PSTAPATPA

SEQ ID NO: 1021196 - protein, 9 aa, Homo Sapiens
EPGVAKYRQ

SEQ ID NO: 1021197 - protein, 9 aa, Homo Sapiens
NFSQENIHC

SEQ ID NO: 1021198 - protein, 9 aa, Homo Sapiens
SSISIKKFD

SEQ ID NO: 1021199 - protein, 9 aa, Homo Sapiens
LFVHVLKTN

SEQ ID NO: 1021200 - protein, 9 aa, Homo Sapiens
LGDQRQEIT

SEQ ID NO: 1021201 - protein, 9 aa, Homo Sapiens
KPKLIFTLE

SEQ ID NO: 1021202 - protein, 9 aa, Homo Sapiens
NVWGSWYDR

SEQ ID NO: 1021203 - protein, 9 aa, Homo Sapiens
RGYLATIKG

SEQ ID NO: 1021204 - protein, 9 aa, Homo Sapiens
GIKKLDNYK

SEQ ID NO: 1021205 - protein, 9 aa, Homo Sapiens
PPSIGFSYS

SEQ ID NO: 1021206 - protein, 9 aa, Homo Sapiens
VVYFDKNEH

SEQ ID NO: 1021207 - protein, 9 aa, Homo Sapiens
LTVGSSSCL

SEQ ID NO: 1021208 - protein, 9 aa, Homo Sapiens
LATMKSRWS

SEQ ID NO: 1021209 - protein, 9 aa, Homo Sapiens
TRIILTTNG

SEQ ID NO: 1021210 - protein, 9 aa, Homo Sapiens
NTATTSTPP

SEQ ID NO: 1021211 - protein, 9 aa, Homo Sapiens
QLQEKKEEK

SEQ ID NO: 1021212 - protein, 9 aa, Homo Sapiens
KDTINEKVI

SEQ ID NO: 1021213 - protein, 9 aa, Homo Sapiens
WVPVVFLIL

SEQ ID NO: 1021214 - protein, 9 aa, Homo Sapiens
HQAQRIQEI

SEQ ID NO: 1021215 - protein, 9 aa, Homo Sapiens
EQWKALNKI

SEQ ID NO: 1021216 - protein, 9 aa, Homo Sapiens
IGKKIPSFF

SEQ ID NO: 1021217 - protein, 9 aa, Homo Sapiens
VIIQEPQGI

SEQ ID NO: 1021218 - protein, 9 aa, Homo Sapiens
GRLNSEEGD

SEQ ID NO: 1021219 - protein, 9 aa, Homo Sapiens
SMSTIRQYP

SEQ ID NO: 1021220 - protein, 9 aa, Homo Sapiens
AARVSPRDL

SEQ ID NO: 1021221 - protein, 9 aa, Homo Sapiens
FAMKSWLRN

SEQ ID NO: 1021222 - protein, 9 aa, Homo Sapiens
ILFFSTIFL

SEQ ID NO: 1021223 - protein, 9 aa, Homo Sapiens
FPLQDQAGN

SEQ ID NO: 1021224 - protein, 9 aa, Homo Sapiens
DQQFLNLMK

SEQ ID NO: 1021225 - protein, 9 aa, Homo Sapiens
GYSFAVVGI

SEQ ID NO: 1021226 - protein, 9 aa, Homo Sapiens
IAENEMLGL

SEQ ID NO: 1021227 - protein, 9 aa, Homo Sapiens
CEMPHHIKP

SEQ ID NO: 1021228 - protein, 9 aa, Homo Sapiens
LDFETKKFY

SEQ ID NO: 1021229 - protein, 9 aa, Homo Sapiens
ETCIIPCPS

SEQ ID NO: 1021230 - protein, 9 aa, Homo Sapiens
ENIHCSDKG

SEQ ID NO: 1021231 - protein, 9 aa, Homo Sapiens
AFTYPSSLC

SEQ ID NO: 1021232 - protein, 9 aa, Homo Sapiens
RAARVSPRD

SEQ ID NO: 1021233 - protein, 9 aa, Homo Sapiens
ITREYGLKH

SEQ ID NO: 1021234 - protein, 9 aa, Homo Sapiens
KAHKVAQAK

SEQ ID NO: 1021235 - protein, 9 aa, Homo Sapiens
SGLAGLLEL

SEQ ID NO: 1021236 - protein, 9 aa, Homo Sapiens
CVGKKIGCG

SEQ ID NO: 1021237 - protein, 9 aa, Homo Sapiens
KISGSSVVE

SEQ ID NO: 1021238 - protein, 9 aa, Homo Sapiens
CHSSCYGGY

SEQ ID NO: 1021239 - protein, 9 aa, Homo Sapiens
DFETKKFYT

SEQ ID NO: 1021240 - protein, 9 aa, Homo Sapiens
RDRYETKQR

SEQ ID NO: 1021241 - protein, 9 aa, Homo Sapiens
MESVQCCLM

SEQ ID NO: 1021242 - protein, 9 aa, Homo Sapiens
TLVQRQRIH

SEQ ID NO: 1021243 - protein, 9 aa, Homo Sapiens
LKRFLLSKS

SEQ ID NO: 1021244 - protein, 9 aa, Homo Sapiens
SLGVHLSKV

SEQ ID NO: 1021245 - protein, 9 aa, Homo Sapiens
ESQRFSRRA

SEQ ID NO: 1021246 - protein, 9 aa, Homo Sapiens
SEDFEIMVI

SEQ ID NO: 1021247 - protein, 9 aa, Homo Sapiens
DAAPILFLL

SEQ ID NO: 1021248 - protein, 9 aa, Homo Sapiens
DPYSGHQFL

SEQ ID NO: 1021249 - protein, 9 aa, Homo Sapiens
PFISPVRVS

SEQ ID NO: 1021250 - protein, 9 aa, Homo Sapiens
VSLPELEDW

SEQ ID NO: 1021251 - protein, 9 aa, Homo Sapiens
CSYTSGPGS

SEQ ID NO: 1021252 - protein, 9 aa, Homo Sapiens
GKFTSHIAG

SEQ ID NO: 1021253 - protein, 9 aa, Homo Sapiens
LYKELYHYS

SEQ ID NO: 1021254 - protein, 9 aa, Homo Sapiens
YPVHGFFQR

SEQ ID NO: 1021255 - protein, 9 aa, Homo Sapiens
VPSKHQRIL

SEQ ID NO: 1021256 - protein, 9 aa, Homo Sapiens
LPAHYPLCP

SEQ ID NO: 1021257 - protein, 9 aa, Homo Sapiens
GRIKELLKQ

SEQ ID NO: 1021258 - protein, 9 aa, Homo Sapiens
NWKKVLPLL

SEQ ID NO: 1021259 - protein, 9 aa, Homo Sapiens
KIISFSALT

SEQ ID NO: 1021260 - protein, 9 aa, Homo Sapiens
GVSTLPVSL

SEQ ID NO: 1021261 - protein, 9 aa, Homo Sapiens
LSTFFQESH

SEQ ID NO: 1021262 - protein, 9 aa, Homo Sapiens
AGEEKLPGE

SEQ ID NO: 1021263 - protein, 9 aa, Homo Sapiens
GYPVHGFFQ

SEQ ID NO: 1021264 - protein, 9 aa, Homo Sapiens
KAIYNMMGK

SEQ ID NO: 1021265 - protein, 9 aa, Homo Sapiens
PISESMLER

SEQ ID NO: 1021266 - protein, 9 aa, Homo Sapiens
ILCVCACVV

SEQ ID NO: 1021267 - protein, 9 aa, Homo Sapiens
SSSPPHLSP

SEQ ID NO: 1021268 - protein, 9 aa, Homo Sapiens
RWSGKSNVG

SEQ ID NO: 1021269 - protein, 9 aa, Homo Sapiens
SPEYLTSLQ

SEQ ID NO: 1021270 - protein, 9 aa, Homo Sapiens
SGGVSTLPV

SEQ ID NO: 1021271 - protein, 9 aa, Homo Sapiens
AAGEEKLPG

SEQ ID NO: 1021272 - protein, 9 aa, Homo Sapiens
SSPPHLSPP

SEQ ID NO: 1021273 - protein, 9 aa, Homo Sapiens
EGSNNIMGS

SEQ ID NO: 1021274 - protein, 9 aa, Homo Sapiens
LCVCACVVC

SEQ ID NO: 1021275 - protein, 9 aa, Homo Sapiens
PCCRWSGKS

SEQ ID NO: 1021276 - protein, 9 aa, Homo Sapiens
SQRFSRRAY

SEQ ID NO: 1021277 - protein, 9 aa, Homo Sapiens
DLSTFFQES

SEQ ID NO: 1021278 - protein, 9 aa, Homo Sapiens
PILFLLASP

SEQ ID NO: 1021279 - protein, 9 aa, Homo Sapiens
TDPGAQKMS

SEQ ID NO: 1021280 - protein, 9 aa, Homo Sapiens
FISPVRVSP

SEQ ID NO: 1021281 - protein, 9 aa, Homo Sapiens
QDFLTRWHR

SEQ ID NO: 1021282 - protein, 9 aa, Homo Sapiens
GANGKREKM

SEQ ID NO: 1021283 - protein, 9 aa, Homo Sapiens
EEQEKKKAG

SEQ ID NO: 1021284 - protein, 9 aa, Homo Sapiens
FFQESHITV

SEQ ID NO: 1021285 - protein, 9 aa, Homo Sapiens
LGNTSRRGK

SEQ ID NO: 1021286 - protein, 9 aa, Homo Sapiens
ISLYKELYH

SEQ ID NO: 1021287 - protein, 9 aa, Homo Sapiens
EDDDEEHEE

SEQ ID NO: 1021288 - protein, 9 aa, Homo Sapiens
CCRWSGKSN

SEQ ID NO: 1021289 - protein, 9 aa, Homo Sapiens
SESMLERLS

SEQ ID NO: 1021290 - protein, 9 aa, Homo Sapiens
ESMLERLSK

SEQ ID NO: 1021291 - protein, 9 aa, Homo Sapiens
CVKSFCHKS

SEQ ID NO: 1021292 - protein, 9 aa, Homo Sapiens
ILKVMNFIV

SEQ ID NO: 1021293 - protein, 9 aa, Homo Sapiens
QDYTIRILM

SEQ ID NO: 1021294 - protein, 9 aa, Homo Sapiens
CRWSGKSNV

SEQ ID NO: 1021295 - protein, 9 aa, Homo Sapiens
KGANGKREK

SEQ ID NO: 1021296 - protein, 9 aa, Homo Sapiens
LQGPGNIKE

SEQ ID NO: 1021297 - protein, 9 aa, Homo Sapiens
YSGHQFLFS

SEQ ID NO: 1021298 - protein, 9 aa, Homo Sapiens
LFVYQNVGE

SEQ ID NO: 1021299 - protein, 9 aa, Homo Sapiens
PDPRSGLSV

SEQ ID NO: 1021300 - protein, 9 aa, Homo Sapiens
AVFFICIIL

SEQ ID NO: 1021301 - protein, 9 aa, Homo Sapiens
RPDPRSGLS

SEQ ID NO: 1021302 - protein, 9 aa, Homo Sapiens
PEYLTSLQE

SEQ ID NO: 1021303 - protein, 9 aa, Homo Sapiens
QYYLANPLL

SEQ ID NO: 1021304 - protein, 9 aa, Homo Sapiens
PSKHQRILG

SEQ ID NO: 1021305 - protein, 9 aa, Homo Sapiens
LVEGSNNIM

SEQ ID NO: 1021306 - protein, 9 aa, Homo Sapiens
SRTPFISPV

SEQ ID NO: 1021307 - protein, 9 aa, Homo Sapiens
MAWQVSLPE

SEQ ID NO: 1021308 - protein, 9 aa, Homo Sapiens
SVRAFFAVI

SEQ ID NO: 1021309 - protein, 9 aa, Homo Sapiens
PVLPGKVRE

SEQ ID NO: 1021310 - protein, 9 aa, Homo Sapiens
ASLSHRPDP

SEQ ID NO: 1021311 - protein, 9 aa, Homo Sapiens
HCFPCCRWS

SEQ ID NO: 1021312 - protein, 9 aa, Homo Sapiens
LKQGGLNLS

SEQ ID NO: 1021313 - protein, 9 aa, Homo Sapiens
KPYECNECV

SEQ ID NO: 1021314 - protein, 9 aa, Homo Sapiens
HQFLFSLAP

SEQ ID NO: 1021315 - protein, 9 aa, Homo Sapiens
IMKAIYNMM

SEQ ID NO: 1021316 - protein, 9 aa, Homo Sapiens
EIMVILEGM

SEQ ID NO: 1021317 - protein, 9 aa, Homo Sapiens
IFPSCLFVY

SEQ ID NO: 1021318 - protein, 9 aa, Homo Sapiens
KKAGREQSQ

SEQ ID NO: 1021319 - protein, 9 aa, Homo Sapiens
PRAFSSCSY

SEQ ID NO: 1021320 - protein, 9 aa, Homo Sapiens
DEEHEEEEE

SEQ ID NO: 1021321 - protein, 9 aa, Homo Sapiens
LVSPSLTLC

SEQ ID NO: 1021322 - protein, 9 aa, Homo Sapiens
NGKGSSWCV

SEQ ID NO: 1021323 - protein, 9 aa, Homo Sapiens
ISESMLERL

SEQ ID NO: 1021324 - protein, 9 aa, Homo Sapiens
PHLSPPQYS

SEQ ID NO: 1021325 - protein, 9 aa, Homo Sapiens
SAGSEASFP

SEQ ID NO: 1021326 - protein, 9 aa, Homo Sapiens
IILLITSLG

SEQ ID NO: 1021327 - protein, 9 aa, Homo Sapiens
CLQFNRCGL

SEQ ID NO: 1021328 - protein, 9 aa, Homo Sapiens
EFITLEKNK

SEQ ID NO: 1021329 - protein, 9 aa, Homo Sapiens
TVLNNMKTE

SEQ ID NO: 1021330 - protein, 9 aa, Homo Sapiens
RAYLPGQLP

SEQ ID NO: 1021331 - protein, 9 aa, Homo Sapiens
KLVSPSLTL

SEQ ID NO: 1021332 - protein, 9 aa, Homo Sapiens
GKGSSWCVD

SEQ ID NO: 1021333 - protein, 9 aa, Homo Sapiens
ILFLLASPD

SEQ ID NO: 1021334 - protein, 9 aa, Homo Sapiens
IIVTEGSEI

SEQ ID NO: 1021335 - protein, 9 aa, Homo Sapiens
ESEDFEIMV

SEQ ID NO: 1021336 - protein, 9 aa, Homo Sapiens
NKVGFGEKM

SEQ ID NO: 1021337 - protein, 9 aa, Homo Sapiens
STFFQESHI

SEQ ID NO: 1021338 - protein, 9 aa, Homo Sapiens
GLCVSSQIG

SEQ ID NO: 1021339 - protein, 9 aa, Homo Sapiens
ISTGYATPL

SEQ ID NO: 1021340 - protein, 9 aa, Homo Sapiens
QFNRCGLCV

SEQ ID NO: 1021341 - protein, 9 aa, Homo Sapiens
EIQIQVISF

SEQ ID NO: 1021342 - protein, 9 aa, Homo Sapiens
PVSGILCVC

SEQ ID NO: 1021343 - protein, 9 aa, Homo Sapiens
TLEKNKPTR

SEQ ID NO: 1021344 - protein, 9 aa, Homo Sapiens
LQFNRCGLC

SEQ ID NO: 1021345 - protein, 9 aa, Homo Sapiens
EKMVKEISI

SEQ ID NO: 1021346 - protein, 9 aa, Homo Sapiens
VFISLVGSG

SEQ ID NO: 1021347 - protein, 9 aa, Homo Sapiens
IKELLKQGG

SEQ ID NO: 1021348 - protein, 9 aa, Homo Sapiens
SPSLTLCST

SEQ ID NO: 1021349 - protein, 9 aa, Homo Sapiens
WRTALPAHY

SEQ ID NO: 1021350 - protein, 9 aa, Homo Sapiens
FDYDPKLQM

SEQ ID NO: 1021351 - protein, 9 aa, Homo Sapiens
NRDRLQYYL

SEQ ID NO: 1021352 - protein, 9 aa, Homo Sapiens
MQTDPGAQK

SEQ ID NO: 1021353 - protein, 9 aa, Homo Sapiens
AIQDFLTRW

SEQ ID NO: 1021354 - protein, 9 aa, Homo Sapiens
IVTEGSEIQ

SEQ ID NO: 1021355 - protein, 9 aa, Homo Sapiens
PSCLFVYQN

SEQ ID NO: 1021356 - protein, 9 aa, Homo Sapiens
PAHYPLCPG

SEQ ID NO: 1021357 - protein, 9 aa, Homo Sapiens
PPHLSPPQY

SEQ ID NO: 1021358 - protein, 9 aa, Homo Sapiens
KTLHSKYVN

SEQ ID NO: 1021359 - protein, 9 aa, Homo Sapiens
PPGIVIVEK

SEQ ID NO: 1021360 - protein, 9 aa, Homo Sapiens
FPSCLFVYQ

SEQ ID NO: 1021361 - protein, 9 aa, Homo Sapiens
GRAFHFPKD

SEQ ID NO: 1021362 - protein, 9 aa, Homo Sapiens
FLLASPDPQ

SEQ ID NO: 1021363 - protein, 9 aa, Homo Sapiens
LQYYLANPL

SEQ ID NO: 1021364 - protein, 9 aa, Homo Sapiens
VSLVEGSNN

SEQ ID NO: 1021365 - protein, 9 aa, Homo Sapiens
FQLMDYPVL

SEQ ID NO: 1021366 - protein, 9 aa, Homo Sapiens
CNECVKSFC

SEQ ID NO: 1021367 - protein, 9 aa, Homo Sapiens
TAVFFICII

SEQ ID NO: 1021368 - protein, 9 aa, Homo Sapiens
VNPEYLPRR

SEQ ID NO: 1021369 - protein, 9 aa, Homo Sapiens
WQVSLPELE

SEQ ID NO: 1021370 - protein, 9 aa, Homo Sapiens
TFFQESHIT

SEQ ID NO: 1021371 - protein, 9 aa, Homo Sapiens
SKIMVSVRA

SEQ ID NO: 1021372 - protein, 9 aa, Homo Sapiens
PGRIKELLK

SEQ ID NO: 1021373 - protein, 9 aa, Homo Sapiens
GFFQRDLFN

SEQ ID NO: 1021374 - protein, 9 aa, Homo Sapiens
GGVSTLPVS

SEQ ID NO: 1021375 - protein, 9 aa, Homo Sapiens
KKKAGREQS

SEQ ID NO: 1021376 - protein, 9 aa, Homo Sapiens
NIMGSTNFK

SEQ ID NO: 1021377 - protein, 9 aa, Homo Sapiens
GIVIVEKIT

SEQ ID NO: 1021378 - protein, 9 aa, Homo Sapiens
SLTLCSTPT

SEQ ID NO: 1021379 - protein, 9 aa, Homo Sapiens
SKIISFSAL

SEQ ID NO: 1021380 - protein, 9 aa, Homo Sapiens
RAFSSCSYT

SEQ ID NO: 1021381 - protein, 9 aa, Homo Sapiens
KHQRILGNT

SEQ ID NO: 1021382 - protein, 9 aa, Homo Sapiens
SCSYTSGPG

SEQ ID NO: 1021383 - protein, 9 aa, Homo Sapiens
PTAVFFICI

SEQ ID NO: 1021384 - protein, 9 aa, Homo Sapiens
NAIQDFLTR

SEQ ID NO: 1021385 - protein, 9 aa, Homo Sapiens
AASRDLSTF

SEQ ID NO: 1021386 - protein, 9 aa, Homo Sapiens
SQTAGRTIQ

SEQ ID NO: 1021387 - protein, 9 aa, Homo Sapiens
SEASFPGLP

SEQ ID NO: 1021388 - protein, 9 aa, Homo Sapiens
MKAIYNMMG

SEQ ID NO: 1021389 - protein, 9 aa, Homo Sapiens
SPPHLSPPQ

SEQ ID NO: 1021390 - protein, 9 aa, Homo Sapiens
FEIMVILEG

SEQ ID NO: 1021391 - protein, 9 aa, Homo Sapiens
YATPLHVTS

SEQ ID NO: 1021392 - protein, 9 aa, Homo Sapiens
LMDYPVLAD

SEQ ID NO: 1021393 - protein, 9 aa, Homo Sapiens
FIVDGMGNL

SEQ ID NO: 1021394 - protein, 9 aa, Homo Sapiens
YSSSRTPFI

SEQ ID NO: 1021395 - protein, 9 aa, Homo Sapiens
RSVHNWKKV

SEQ ID NO: 1021396 - protein, 9 aa, Homo Sapiens
AIYNMMGKC

SEQ ID NO: 1021397 - protein, 9 aa, Homo Sapiens
IKEKPTECP

SEQ ID NO: 1021398 - protein, 9 aa, Homo Sapiens
GSEIQIQVI

SEQ ID NO: 1021399 - protein, 9 aa, Homo Sapiens
DDDEEHEEE

SEQ ID NO: 1021400 - protein, 9 aa, Homo Sapiens
RRQLEAQDY

SEQ ID NO: 1021401 - protein, 9 aa, Homo Sapiens
RAFFAVIFL

SEQ ID NO: 1021402 - protein, 9 aa, Homo Sapiens
PGNIKEKPT

SEQ ID NO: 1021403 - protein, 9 aa, Homo Sapiens
FLNPLAYEI

SEQ ID NO: 1021404 - protein, 9 aa, Homo Sapiens
GKREKMGIP

SEQ ID NO: 1021405 - protein, 9 aa, Homo Sapiens
FTSHIAGVY

SEQ ID NO: 1021406 - protein, 9 aa, Homo Sapiens
AAPILFLLA

SEQ ID NO: 1021407 - protein, 9 aa, Homo Sapiens
NECVKSFCH

SEQ ID NO: 1021408 - protein, 9 aa, Homo Sapiens
HQRILGNTS

SEQ ID NO: 1021409 - protein, 9 aa, Homo Sapiens
LSHRPDPRS

SEQ ID NO: 1021410 - protein, 9 aa, Homo Sapiens
EYLTSLQEF

SEQ ID NO: 1021411 - protein, 9 aa, Homo Sapiens
GNIKEKPTE

SEQ ID NO: 1021412 - protein, 9 aa, Homo Sapiens
AHISLYKEL

SEQ ID NO: 1021413 - protein, 9 aa, Homo Sapiens
EQSQTAGRT

SEQ ID NO: 1021414 - protein, 9 aa, Homo Sapiens
SLYKELYHY

SEQ ID NO: 1021415 - protein, 9 aa, Homo Sapiens
GSSWCVDPE

SEQ ID NO: 1021416 - protein, 9 aa, Homo Sapiens
HLSKVRSLT

SEQ ID NO: 1021417 - protein, 9 aa, Homo Sapiens
TAGRTIQCF

SEQ ID NO: 1021418 - protein, 9 aa, Homo Sapiens
AYLPGQLPP

SEQ ID NO: 1021419 - protein, 9 aa, Homo Sapiens
KMSESSSTP

SEQ ID NO: 1021420 - protein, 9 aa, Homo Sapiens
VSLVNPEYL

SEQ ID NO: 1021421 - protein, 9 aa, Homo Sapiens
IQSGGVSTL

SEQ ID NO: 1021422 - protein, 9 aa, Homo Sapiens
IISFSALTF

SEQ ID NO: 1021423 - protein, 9 aa, Homo Sapiens
SVIQSGGVS

SEQ ID NO: 1021424 - protein, 9 aa, Homo Sapiens
ASSSSSEGE

SEQ ID NO: 1021425 - protein, 9 aa, Homo Sapiens
VIVEKITES

SEQ ID NO: 1021426 - protein, 9 aa, Homo Sapiens
HQQQQQQMQ

SEQ ID NO: 1021427 - protein, 9 aa, Homo Sapiens
AVGKFTSHI

SEQ ID NO: 1021428 - protein, 9 aa, Homo Sapiens
ALVSPISES

SEQ ID NO: 1021429 - protein, 9 aa, Homo Sapiens
QASKASSCK

SEQ ID NO: 1021430 - protein, 9 aa, Homo Sapiens
CGLCVSSQI

SEQ ID NO: 1021431 - protein, 9 aa, Homo Sapiens
RVKWQEEEG

SEQ ID NO: 1021432 - protein, 9 aa, Homo Sapiens
YIGRSVHNW

SEQ ID NO: 1021433 - protein, 9 aa, Homo Sapiens
DFEIMVILE

SEQ ID NO: 1021434 - protein, 9 aa, Homo Sapiens
SKASSCKGQ

SEQ ID NO: 1021435 - protein, 9 aa, Homo Sapiens
YPVLADDTL

SEQ ID NO: 1021436 - protein, 9 aa, Homo Sapiens
ANGKREKMG

SEQ ID NO: 1021437 - protein, 9 aa, Homo Sapiens
NLQGPGNIK

SEQ ID NO: 1021438 - protein, 9 aa, Homo Sapiens
TPFISPVRV

SEQ ID NO: 1021439 - protein, 9 aa, Homo Sapiens
AFDYDPKLQ

SEQ ID NO: 1021440 - protein, 9 aa, Homo Sapiens
KNKPTRPVI

SEQ ID NO: 1021441 - protein, 9 aa, Homo Sapiens
LTLCSTPTH

SEQ ID NO: 1021442 - protein, 9 aa, Homo Sapiens
APILFLLAS

SEQ ID NO: 1021443 - protein, 9 aa, Homo Sapiens
VIQSGGVST

SEQ ID NO: 1021444 - protein, 9 aa, Homo Sapiens
IGYPVHGFF

SEQ ID NO: 1021445 - protein, 9 aa, Homo Sapiens
GREQSQTAG

SEQ ID NO: 1021446 - protein, 9 aa, Homo Sapiens
SLSHRPDPR

SEQ ID NO: 1021447 - protein, 9 aa, Homo Sapiens
EDFEIMVIL

SEQ ID NO: 1021448 - protein, 9 aa, Homo Sapiens
SGHQFLFSL

SEQ ID NO: 1021449 - protein, 9 aa, Homo Sapiens
IMVSVRAFF

SEQ ID NO: 1021450 - protein, 9 aa, Homo Sapiens
IVEKITEST

SEQ ID NO: 1021451 - protein, 9 aa, Homo Sapiens
TAHISLYKE

SEQ ID NO: 1021452 - protein, 9 aa, Homo Sapiens
FLTRWHRMR

SEQ ID NO: 1021453 - protein, 9 aa, Homo Sapiens
NGKREKMGI

SEQ ID NO: 1021454 - protein, 9 aa, Homo Sapiens
IHRSLGVHL

SEQ ID NO: 1021455 - protein, 9 aa, Homo Sapiens
LLAPLASAT

SEQ ID NO: 1021456 - protein, 9 aa, Homo Sapiens
AASLSHRPD

SEQ ID NO: 1021457 - protein, 9 aa, Homo Sapiens
AWQVSLPEL

SEQ ID NO: 1021458 - protein, 9 aa, Homo Sapiens
YLTSLQEFS

SEQ ID NO: 1021459 - protein, 9 aa, Homo Sapiens
HRPDPRSGL

SEQ ID NO: 1021460 - protein, 9 aa, Homo Sapiens
VEKITESTA

SEQ ID NO: 1021461 - protein, 9 aa, Homo Sapiens
FSRRAYLPG

SEQ ID NO: 1021462 - protein, 9 aa, Homo Sapiens
VFFICIILL

SEQ ID NO: 1021463 - protein, 9 aa, Homo Sapiens
QFLFSLAPE

SEQ ID NO: 1021464 - protein, 9 aa, Homo Sapiens
VNGKGSSWC

SEQ ID NO: 1021465 - protein, 9 aa, Homo Sapiens
CFPDRNQAA

SEQ ID NO: 1021466 - protein, 9 aa, Homo Sapiens
GPASSSSSE

SEQ ID NO: 1021467 - protein, 9 aa, Homo Sapiens
GSSSPPHLS

SEQ ID NO: 1021468 - protein, 9 aa, Homo Sapiens
SSSRTPFIS

SEQ ID NO: 1021469 - protein, 9 aa, Homo Sapiens
LCSTPTHMS

SEQ ID NO: 1021470 - protein, 9 aa, Homo Sapiens
IMAFDYDPK

SEQ ID NO: 1021471 - protein, 9 aa, Homo Sapiens
LADDTLIQM

SEQ ID NO: 1021472 - protein, 9 aa, Homo Sapiens
EKLPGEYLV

SEQ ID NO: 1021473 - protein, 9 aa, Homo Sapiens
REQVSLVNP

SEQ ID NO: 1021474 - protein, 9 aa, Homo Sapiens
EEHEEEEEE

SEQ ID NO: 1021475 - protein, 9 aa, Homo Sapiens
LEAQDYTIR

SEQ ID NO: 1021476 - protein, 9 aa, Homo Sapiens
KIMVSVRAF

SEQ ID NO: 1021477 - protein, 9 aa, Homo Sapiens
QRILGNTSR

SEQ ID NO: 1021478 - protein, 9 aa, Homo Sapiens
FFTERGKKF

SEQ ID NO: 1021479 - protein, 9 aa, Homo Sapiens
RRAYLPGQL

SEQ ID NO: 1021480 - protein, 9 aa, Homo Sapiens
PVLADDTLI

SEQ ID NO: 1021481 - protein, 9 aa, Homo Sapiens
VIEFITLEK

SEQ ID NO: 1021482 - protein, 9 aa, Homo Sapiens
QLEAQDYTI

SEQ ID NO: 1021483 - protein, 9 aa, Homo Sapiens
EEFGRAFHF

SEQ ID NO: 1021484 - protein, 9 aa, Homo Sapiens
FPKDSPMNP

SEQ ID NO: 1021485 - protein, 9 aa, Homo Sapiens
CIILLITSL

SEQ ID NO: 1021486 - protein, 9 aa, Homo Sapiens
SKHQRILGN

SEQ ID NO: 1021487 - protein, 9 aa, Homo Sapiens
LTSLQEFSP

SEQ ID NO: 1021488 - protein, 9 aa, Homo Sapiens
IMVILEGMV

SEQ ID NO: 1021489 - protein, 9 aa, Homo Sapiens
TSLQEFSPA

SEQ ID NO: 1021490 - protein, 9 aa, Homo Sapiens
PYSSSRTPF

SEQ ID NO: 1021491 - protein, 9 aa, Homo Sapiens
QRFSRRAYL

SEQ ID NO: 1021492 - protein, 9 aa, Homo Sapiens
SNGSSSPPH

SEQ ID NO: 1021493 - protein, 9 aa, Homo Sapiens
QLMDYPVLA

SEQ ID NO: 1021494 - protein, 9 aa, Homo Sapiens
ASRDLSTFF

SEQ ID NO: 1021495 - protein, 9 aa, Homo Sapiens
GAQKMSESS

SEQ ID NO: 1021496 - protein, 9 aa, Homo Sapiens
DTSSISTGY

SEQ ID NO: 1021497 - protein, 9 aa, Homo Sapiens
ICIILLITS

SEQ ID NO: 1021498 - protein, 9 aa, Homo Sapiens
VSPSLTLCS

SEQ ID NO: 1021499 - protein, 9 aa, Homo Sapiens
KAGREQSQT

SEQ ID NO: 1021500 - protein, 9 aa, Homo Sapiens
SGILCVCAC

SEQ ID NO: 1021501 - protein, 9 aa, Homo Sapiens
KVMNFIVDG

SEQ ID NO: 1021502 - protein, 9 aa, Homo Sapiens
PELEDWLQC

SEQ ID NO: 1021503 - protein, 9 aa, Homo Sapiens
GPRAFSSCS

SEQ ID NO: 1021504 - protein, 9 aa, Homo Sapiens
SKYVNGRDR

SEQ ID NO: 1021505 - protein, 9 aa, Homo Sapiens
VMNFIVDGM

SEQ ID NO: 1021506 - protein, 9 aa, Homo Sapiens
YQNVGEATA

SEQ ID NO: 1021507 - protein, 9 aa, Homo Sapiens
MAFDYDPKL

SEQ ID NO: 1021508 - protein, 9 aa, Homo Sapiens
LSSAGSEAS

SEQ ID NO: 1021509 - protein, 9 aa, Homo Sapiens
IYNMMGKCT

SEQ ID NO: 1021510 - protein, 9 aa, Homo Sapiens
VHGFFQRDL

SEQ ID NO: 1021511 - protein, 9 aa, Homo Sapiens
VHNWKKVLP

SEQ ID NO: 1021512 - protein, 9 aa, Homo Sapiens
EKNKPTRPV

SEQ ID NO: 1021513 - protein, 9 aa, Homo Sapiens
SHRPDPRSG

SEQ ID NO: 1021514 - protein, 9 aa, Homo Sapiens
FFFFFFCFL

SEQ ID NO: 1021515 - protein, 9 aa, Homo Sapiens
IVIVEKITE

SEQ ID NO: 1021516 - protein, 9 aa, Homo Sapiens
IQDFLTRWH

SEQ ID NO: 1021517 - protein, 9 aa, Homo Sapiens
REQSQTAGR

SEQ ID NO: 1021518 - protein, 9 aa, Homo Sapiens
SSRTPFISP

SEQ ID NO: 1021519 - protein, 9 aa, Homo Sapiens
YVNGRDRSS

SEQ ID NO: 1021520 - protein, 9 aa, Homo Sapiens
AQKMSESSS

SEQ ID NO: 1021521 - protein, 9 aa, Homo Sapiens
SLVEGSNNI

SEQ ID NO: 1021522 - protein, 9 aa, Homo Sapiens
EKITESTAT

SEQ ID NO: 1021523 - protein, 9 aa, Homo Sapiens
LAPLASATE

SEQ ID NO: 1021524 - protein, 9 aa, Homo Sapiens
VRAFFAVIF

SEQ ID NO: 1021525 - protein, 9 aa, Homo Sapiens
VFSFLNPLA

SEQ ID NO: 1021526 - protein, 9 aa, Homo Sapiens
YQHYQQQQV

SEQ ID NO: 1021527 - protein, 9 aa, Homo Sapiens
ANFTAHISL

SEQ ID NO: 1021528 - protein, 9 aa, Homo Sapiens
QTDPGAQKM

SEQ ID NO: 1021529 - protein, 9 aa, Homo Sapiens
PQASKASSC

SEQ ID NO: 1021530 - protein, 9 aa, Homo Sapiens
AQDYTIRIL

SEQ ID NO: 1021531 - protein, 9 aa, Homo Sapiens
HGFFQRDLF

SEQ ID NO: 1021532 - protein, 9 aa, Homo Sapiens
CLFVYQNVG

SEQ ID NO: 1021533 - protein, 9 aa, Homo Sapiens
LTNAIQDFL

SEQ ID NO: 1021534 - protein, 9 aa, Homo Sapiens
TNAIQDFLT

SEQ ID NO: 1021535 - protein, 9 aa, Homo Sapiens
TPVGIMAFD

SEQ ID NO: 1021536 - protein, 9 aa, Homo Sapiens
SEIQIQVIS

SEQ ID NO: 1021537 - protein, 9 aa, Homo Sapiens
RILGNTSRR

SEQ ID NO: 1021538 - protein, 9 aa, Homo Sapiens
TEGSEIQIQ

SEQ ID NO: 1021539 - protein, 9 aa, Homo Sapiens
FITLEKNKP

SEQ ID NO: 1021540 - protein, 9 aa, Homo Sapiens
LKVMNFIVD

SEQ ID NO: 1021541 - protein, 9 aa, Homo Sapiens
MVILEGMVE

SEQ ID NO: 1021542 - protein, 9 aa, Homo Sapiens
SHSPLLQKN

SEQ ID NO: 1021543 - protein, 9 aa, Homo Sapiens
KGSSWCVDP

SEQ ID NO: 1021544 - protein, 9 aa, Homo Sapiens
CAEDDDEEH

SEQ ID NO: 1021545 - protein, 9 aa, Homo Sapiens
GHQFLFSLA

SEQ ID NO: 1021546 - protein, 9 aa, Homo Sapiens
DRNQAAPFC

SEQ ID NO: 1021547 - protein, 9 aa, Homo Sapiens
ILGNTSRRG

SEQ ID NO: 1021548 - protein, 9 aa, Homo Sapiens
MHQQQQQQM

SEQ ID NO: 1021549 - protein, 9 aa, Homo Sapiens
FISLVGSGG

SEQ ID NO: 1021550 - protein, 9 aa, Homo Sapiens
SGGLGCSIS

SEQ ID NO: 1021551 - protein, 9 aa, Homo Sapiens
YECNECVKS

SEQ ID NO: 1021552 - protein, 9 aa, Homo Sapiens
YNMMGKCTY

SEQ ID NO: 1021553 - protein, 9 aa, Homo Sapiens
PYSGHQFLF

SEQ ID NO: 1021554 - protein, 9 aa, Homo Sapiens
FFQRDLFNG

SEQ ID NO: 1021555 - protein, 9 aa, Homo Sapiens
VTEGSEIQI

SEQ ID NO: 1021556 - protein, 9 aa, Homo Sapiens
PGAQKMSES

SEQ ID NO: 1021557 - protein, 9 aa, Homo Sapiens
PYECNECVK

SEQ ID NO: 1021558 - protein, 9 aa, Homo Sapiens
RAFHFPKDS

SEQ ID NO: 1021559 - protein, 9 aa, Homo Sapiens
ITLEKNKPT

SEQ ID NO: 1021560 - protein, 9 aa, Homo Sapiens
GRSVHNWKK

SEQ ID NO: 1021561 - protein, 9 aa, Homo Sapiens
NFTAHISLY

SEQ ID NO: 1021562 - protein, 9 aa, Homo Sapiens
HEEEEEEEP

SEQ ID NO: 1021563 - protein, 9 aa, Homo Sapiens
LCVSSQIGF

SEQ ID NO: 1021564 - protein, 9 aa, Homo Sapiens
STGYATPLH

SEQ ID NO: 1021565 - protein, 9 aa, Homo Sapiens
VSTLPVSLG

SEQ ID NO: 1021566 - protein, 9 aa, Homo Sapiens
MVSVRAFFA

SEQ ID NO: 1021567 - protein, 9 aa, Homo Sapiens
NNIMGSTNF

SEQ ID NO: 1021568 - protein, 9 aa, Homo Sapiens
SLQEFSPAL

SEQ ID NO: 1021569 - protein, 9 aa, Homo Sapiens
NFIVDGMGN

SEQ ID NO: 1021570 - protein, 9 aa, Homo Sapiens
DDEEHEEEE

SEQ ID NO: 1021571 - protein, 9 aa, Homo Sapiens
VGKFTSHIA

SEQ ID NO: 1021572 - protein, 9 aa, Homo Sapiens
STPQASKAS

SEQ ID NO: 1021573 - protein, 9 aa, Homo Sapiens
REKMGIPGA

SEQ ID NO: 1021574 - protein, 9 aa, Homo Sapiens
GYATPLHVT

SEQ ID NO: 1021575 - protein, 9 aa, Homo Sapiens
KASSCKGQH

SEQ ID NO: 1021576 - protein, 9 aa, Homo Sapiens
NMMGKCTYP

SEQ ID NO: 1021577 - protein, 9 aa, Homo Sapiens
LEKNKPTRP

SEQ ID NO: 1021578 - protein, 9 aa, Homo Sapiens
VYQNVGEAT

SEQ ID NO: 1021579 - protein, 9 aa, Homo Sapiens
TLHSKYVNG

SEQ ID NO: 1021580 - protein, 9 aa, Homo Sapiens
PSLTLCSTP

SEQ ID NO: 1021581 - protein, 9 aa, Homo Sapiens
EHEEEEEEE

SEQ ID NO: 1021582 - protein, 9 aa, Homo Sapiens
LDYLSSAGS

SEQ ID NO: 1021583 - protein, 9 aa, Homo Sapiens
KLPGEYLVR

SEQ ID NO: 1021584 - protein, 9 aa, Homo Sapiens
LESEDFEIM

SEQ ID NO: 1021585 - protein, 9 aa, Homo Sapiens
YIVATVLNN

SEQ ID NO: 1021586 - protein, 9 aa, Homo Sapiens
KVGFGEKMV

SEQ ID NO: 1021587 - protein, 9 aa, Homo Sapiens
CFFFFFFCF

SEQ ID NO: 1021588 - protein, 9 aa, Homo Sapiens
LNSKIISFS

SEQ ID NO: 1021589 - protein, 9 aa, Homo Sapiens
ECVKSFCHK

SEQ ID NO: 1021590 - protein, 9 aa, Homo Sapiens
TSKIMVSVR

SEQ ID NO: 1021591 - protein, 9 aa, Homo Sapiens
EQEKKKAGR

SEQ ID NO: 1021592 - protein, 9 aa, Homo Sapiens
RNKVGFGEK

SEQ ID NO: 1021593 - protein, 9 aa, Homo Sapiens
SLPELEDWL

SEQ ID NO: 1021594 - protein, 9 aa, Homo Sapiens
EAQDYTIRI

SEQ ID NO: 1021595 - protein, 9 aa, Homo Sapiens
ASPEYLTSL

SEQ ID NO: 1021596 - protein, 9 aa, Homo Sapiens
KPGVFSFLN

SEQ ID NO: 1021597 - protein, 9 aa, Homo Sapiens
CVCACVVCT

SEQ ID NO: 1021598 - protein, 9 aa, Homo Sapiens
MDYPVLADD

SEQ ID NO: 1021599 - protein, 9 aa, Homo Sapiens
FLFSLAPEA

SEQ ID NO: 1021600 - protein, 9 aa, Homo Sapiens
QVSLPELED

SEQ ID NO: 1021601 - protein, 9 aa, Homo Sapiens
DYTIRILMC

SEQ ID NO: 1021602 - protein, 9 aa, Homo Sapiens
QCFPDRNQA

SEQ ID NO: 1021603 - protein, 9 aa, Homo Sapiens
LVNPEYLPR

SEQ ID NO: 1021604 - protein, 9 aa, Homo Sapiens
GRTIQCFPD

SEQ ID NO: 1021605 - protein, 9 aa, Homo Sapiens
EDAAPILFL

SEQ ID NO: 1021606 - protein, 9 aa, Homo Sapiens
ISFSALTFL

SEQ ID NO: 1021607 - protein, 9 aa, Homo Sapiens
YLSSAGSEA

SEQ ID NO: 1021608 - protein, 9 aa, Homo Sapiens
FGRAFHFPK

SEQ ID NO: 1021609 - protein, 9 aa, Homo Sapiens
YNLQGPGNI

SEQ ID NO: 1021610 - protein, 9 aa, Homo Sapiens
PAAGEEKLP

SEQ ID NO: 1021611 - protein, 9 aa, Homo Sapiens
SHIAGVYYF

SEQ ID NO: 1021612 - protein, 9 aa, Homo Sapiens
NGSSSPPHL

SEQ ID NO: 1021613 - protein, 9 aa, Homo Sapiens
WILKVMNFI

SEQ ID NO: 1021614 - protein, 9 aa, Homo Sapiens
STLPVSLGA

SEQ ID NO: 1021615 - protein, 9 aa, Homo Sapiens
QTAGRTIQC

SEQ ID NO: 1021616 - protein, 9 aa, Homo Sapiens
FPDRNQAAP

SEQ ID NO: 1021617 - protein, 9 aa, Homo Sapiens
RPAAGEEKL

SEQ ID NO: 1021618 - protein, 9 aa, Homo Sapiens
RQLEAQDYT

SEQ ID NO: 1021619 - protein, 9 aa, Homo Sapiens
QGWRTALPA

SEQ ID NO: 1021620 - protein, 9 aa, Homo Sapiens
IVDGMGNLR

SEQ ID NO: 1021621 - protein, 9 aa, Homo Sapiens
IEFITLEKN

SEQ ID NO: 1021622 - protein, 9 aa, Homo Sapiens
KVNGKGSSW

SEQ ID NO: 1021623 - protein, 9 aa, Homo Sapiens
GIMAFDYDP

SEQ ID NO: 1021624 - protein, 9 aa, Homo Sapiens
NPEYLPRRH

SEQ ID NO: 1021625 - protein, 9 aa, Homo Sapiens
LDIMKAIYN

SEQ ID NO: 1021626 - protein, 9 aa, Homo Sapiens
EKKKAGREQ

SEQ ID NO: 1021627 - protein, 9 aa, Homo Sapiens
WQEEEGLRL

SEQ ID NO: 1021628 - protein, 9 aa, Homo Sapiens
SRDLSTFFQ

SEQ ID NO: 1021629 - protein, 9 aa, Homo Sapiens
ASSCKGQHS

SEQ ID NO: 1021630 - protein, 9 aa, Homo Sapiens
AFHFPKDSP

SEQ ID NO: 1021631 - protein, 9 aa, Homo Sapiens
LPELEDWLQ

SEQ ID NO: 1021632 - protein, 9 aa, Homo Sapiens
PDRNQAAPF

SEQ ID NO: 1021633 - protein, 9 aa, Homo Sapiens
PASSSSSEG

SEQ ID NO: 1021634 - protein, 9 aa, Homo Sapiens
SSCSYTSGP

SEQ ID NO: 1021635 - protein, 9 aa, Homo Sapiens
ALTNAIQDF

SEQ ID NO: 1021636 - protein, 9 aa, Homo Sapiens
LSKVRSLTL

SEQ ID NO: 1021637 - protein, 9 aa, Homo Sapiens
LLKQGGLNL

SEQ ID NO: 1021638 - protein, 9 aa, Homo Sapiens
SLVNPEYLP

SEQ ID NO: 1021639 - protein, 9 aa, Homo Sapiens
NPLAYEIWM

SEQ ID NO: 1021640 - protein, 9 aa, Homo Sapiens
LGVHLSKVR

SEQ ID NO: 1021641 - protein, 9 aa, Homo Sapiens
SISTGYATP

SEQ ID NO: 1021642 - protein, 9 aa, Homo Sapiens
AGRTIQCFP

SEQ ID NO: 1021643 - protein, 9 aa, Homo Sapiens
GVHLSKVRS

SEQ ID NO: 1021644 - protein, 9 aa, Homo Sapiens
QHYQQQQVA

SEQ ID NO: 1021645 - protein, 9 aa, Homo Sapiens
SVHNWKKVL

SEQ ID NO: 1021646 - protein, 9 aa, Homo Sapiens
NRCGLCVSS

SEQ ID NO: 1021647 - protein, 9 aa, Homo Sapiens
ECNECVKSF

SEQ ID NO: 1021648 - protein, 9 aa, Homo Sapiens
SPISESMLE

SEQ ID NO: 1021649 - protein, 9 aa, Homo Sapiens
ISLVGSGGL

SEQ ID NO: 1021650 - protein, 9 aa, Homo Sapiens
ALPAHYPLC

SEQ ID NO: 1021651 - protein, 9 aa, Homo Sapiens
GKVNGKGSS

SEQ ID NO: 1021652 - protein, 9 aa, Homo Sapiens
SSCKGQHSI

SEQ ID NO: 1021653 - protein, 9 aa, Homo Sapiens
QGPGNIKEK

SEQ ID NO: 1021654 - protein, 9 aa, Homo Sapiens
LNPLAYEIW

SEQ ID NO: 1021655 - protein, 9 aa, Homo Sapiens
FHFPKDSPM

SEQ ID NO: 1021656 - protein, 9 aa, Homo Sapiens
EYIGRSVHN

SEQ ID NO: 1021657 - protein, 9 aa, Homo Sapiens
KREKMGIPG

SEQ ID NO: 1021658 - protein, 9 aa, Homo Sapiens
IGRSVHNWK

SEQ ID NO: 1021659 - protein, 9 aa, Homo Sapiens
SGPRAFSSC

SEQ ID NO: 1021660 - protein, 9 aa, Homo Sapiens
EKGANGKRE

SEQ ID NO: 1021661 - protein, 9 aa, Homo Sapiens
AGREQSQTA

SEQ ID NO: 1021662 - protein, 9 aa, Homo Sapiens
SFLNPLAYE

SEQ ID NO: 1021663 - protein, 9 aa, Homo Sapiens
RDRLQYYLA

SEQ ID NO: 1021664 - protein, 9 aa, Homo Sapiens
LVSPISESM

SEQ ID NO: 1021665 - protein, 9 aa, Homo Sapiens
DIMKAIYNM

SEQ ID NO: 1021666 - protein, 9 aa, Homo Sapiens
VNGRDRSSC

SEQ ID NO: 1021667 - protein, 9 aa, Homo Sapiens
SNNIMGSTN

SEQ ID NO: 1021668 - protein, 9 aa, Homo Sapiens
HISLYKELY

SEQ ID NO: 1021669 - protein, 9 aa, Homo Sapiens
DPGAQKMSE

SEQ ID NO: 1021670 - protein, 9 aa, Homo Sapiens
QVSLVNPEY

SEQ ID NO: 1021671 - protein, 9 aa, Homo Sapiens
FVYQNVGEA

SEQ ID NO: 1021672 - protein, 9 aa, Homo Sapiens
EEKLPGEYL

SEQ ID NO: 1021673 - protein, 9 aa, Homo Sapiens
WSGKSNVGT

SEQ ID NO: 1021674 - protein, 9 aa, Homo Sapiens
IVATVLNNM

SEQ ID NO: 1021675 - protein, 9 aa, Homo Sapiens
GSEASFPGL

SEQ ID NO: 1021676 - protein, 9 aa, Homo Sapiens
VKSFCHKSA

SEQ ID NO: 1021677 - protein, 9 aa, Homo Sapiens
SALTFLNNH

SEQ ID NO: 1021678 - protein, 9 aa, Homo Sapiens
LHSKYVNGR

SEQ ID NO: 1021679 - protein, 9 aa, Homo Sapiens
VLPGKVRES

SEQ ID NO: 1021680 - protein, 9 aa, Homo Sapiens
FTAHISLYK

SEQ ID NO: 1021681 - protein, 9 aa, Homo Sapiens
TSSISTGYA

SEQ ID NO: 1021682 - protein, 9 aa, Homo Sapiens
SSWCVDPEY

SEQ ID NO: 1021683 - protein, 9 aa, Homo Sapiens
FNRCGLCVS

SEQ ID NO: 1021684 - protein, 9 aa, Homo Sapiens
GYLLYIVAT

SEQ ID NO: 1021685 - protein, 9 aa, Homo Sapiens
ELLKQGGLN

SEQ ID NO: 1021686 - protein, 9 aa, Homo Sapiens
DFLTRWHRM

SEQ ID NO: 1021687 - protein, 9 aa, Homo Sapiens
TSHIAGVYY

SEQ ID NO: 1021688 - protein, 9 aa, Homo Sapiens
ASKASSCKG

SEQ ID NO: 1021689 - protein, 9 aa, Homo Sapiens
IQCFPDRNQ

SEQ ID NO: 1021690 - protein, 9 aa, Homo Sapiens
LYIVATVLN

SEQ ID NO: 1021691 - protein, 9 aa, Homo Sapiens
VSPISESML

SEQ ID NO: 1021692 - protein, 9 aa, Homo Sapiens
RIKELLKQG

SEQ ID NO: 1021693 - protein, 9 aa, Homo Sapiens
RSLGVHLSK

SEQ ID NO: 1021694 - protein, 9 aa, Homo Sapiens
YQQQQVAGG

SEQ ID NO: 1021695 - protein, 9 aa, Homo Sapiens
TIQCFPDRN

SEQ ID NO: 1021696 - protein, 9 aa, Homo Sapiens
QEEEGLRLV

SEQ ID NO: 1021697 - protein, 9 aa, Homo Sapiens
DYLSSAGSE

SEQ ID NO: 1021698 - protein, 9 aa, Homo Sapiens
VSGILCVCA

SEQ ID NO: 1021699 - protein, 9 aa, Homo Sapiens
GGLGCSISS

SEQ ID NO: 1021700 - protein, 9 aa, Homo Sapiens
VLADDTLIQ

SEQ ID NO: 1021701 - protein, 9 aa, Homo Sapiens
ATVLNNMKT

SEQ ID NO: 1021702 - protein, 9 aa, Homo Sapiens
GEKMVKEIS

SEQ ID NO: 1021703 - protein, 9 aa, Homo Sapiens
CHCFPCCRW

SEQ ID NO: 1021704 - protein, 9 aa, Homo Sapiens
GEEKLPGEY

SEQ ID NO: 1021705 - protein, 9 aa, Homo Sapiens
EGSEIQIQV

SEQ ID NO: 1021706 - protein, 9 aa, Homo Sapiens
REEQEKKKA

SEQ ID NO: 1021707 - protein, 9 aa, Homo Sapiens
SLVGSGGLG

SEQ ID NO: 1021708 - protein, 9 aa, Homo Sapiens
PVGIMAFDY

SEQ ID NO: 1021709 - protein, 9 aa, Homo Sapiens
LFSLAPEAA

SEQ ID NO: 1021710 - protein, 9 aa, Homo Sapiens
AALVSPISE

SEQ ID NO: 1021711 - protein, 9 aa, Homo Sapiens
KFTSHIAGV

SEQ ID NO: 1021712 - protein, 9 aa, Homo Sapiens
TAVGKFTSH

SEQ ID NO: 1021713 - protein, 9 aa, Homo Sapiens
KELLKQGGL

SEQ ID NO: 1021714 - protein, 9 aa, Homo Sapiens
NSKIISFSA

SEQ ID NO: 1021715 - protein, 9 aa, Homo Sapiens
VSVRAFFAV

SEQ ID NO: 1021716 - protein, 9 aa, Homo Sapiens
AEDDDEEHE

SEQ ID NO: 1021717 - protein, 9 aa, Homo Sapiens
GSNNIMGST

SEQ ID NO: 1021718 - protein, 9 aa, Homo Sapiens
LVGSGGLGC

SEQ ID NO: 1021719 - protein, 9 aa, Homo Sapiens
KMVKEISIP

SEQ ID NO: 1021720 - protein, 9 aa, Homo Sapiens
KWQEEEGLR

SEQ ID NO: 1021721 - protein, 9 aa, Homo Sapiens
AHYPLCPGA

SEQ ID NO: 1021722 - protein, 9 aa, Homo Sapiens
FQRDLFNGI

SEQ ID NO: 1021723 - protein, 9 aa, Homo Sapiens
FGEKMVKEI

SEQ ID NO: 1021724 - protein, 9 aa, Homo Sapiens
TPGRIKELL

SEQ ID NO: 1021725 - protein, 9 aa, Homo Sapiens
TALPAHYPL

SEQ ID NO: 1021726 - protein, 9 aa, Homo Sapiens
GFGEKMVKE

SEQ ID NO: 1021727 - protein, 9 aa, Homo Sapiens
HLSPPQYSH

SEQ ID NO: 1021728 - protein, 9 aa, Homo Sapiens
GWRTALPAH

SEQ ID NO: 1021729 - protein, 9 aa, Homo Sapiens
HYQQQQVAG

SEQ ID NO: 1021730 - protein, 9 aa, Homo Sapiens
FFICIILLI

SEQ ID NO: 1021731 - protein, 9 aa, Homo Sapiens
QKMSESSST

SEQ ID NO: 1021732 - protein, 9 aa, Homo Sapiens
MEDAAPILF

SEQ ID NO: 1021733 - protein, 9 aa, Homo Sapiens
DTAVGKFTS

SEQ ID NO: 1021734 - protein, 9 aa, Homo Sapiens
YLLYIVATV

SEQ ID NO: 1021735 - protein, 9 aa, Homo Sapiens
QEKKKAGRE

SEQ ID NO: 1021736 - protein, 9 aa, Homo Sapiens
RTALPAHYP

SEQ ID NO: 1021737 - protein, 9 aa, Homo Sapiens
PVHGFFQRD

SEQ ID NO: 1021738 - protein, 9 aa, Homo Sapiens
QSGGVSTLP

SEQ ID NO: 1021739 - protein, 9 aa, Homo Sapiens
TPQASKASS

SEQ ID NO: 1021740 - protein, 9 aa, Homo Sapiens
SWCVDPEYK

SEQ ID NO: 1021741 - protein, 9 aa, Homo Sapiens
NGRDRSSCV

SEQ ID NO: 1021742 - protein, 9 aa, Homo Sapiens
LLYIVATVL

SEQ ID NO: 1021743 - protein, 9 aa, Homo Sapiens
KYVNGRDRS

SEQ ID NO: 1021744 - protein, 9 aa, Homo Sapiens
RCGLCVSSQ

SEQ ID NO: 1021745 - protein, 9 aa, Homo Sapiens
IPVLPGKVR

SEQ ID NO: 1021746 - protein, 9 aa, Homo Sapiens
EFGRAFHFP

SEQ ID NO: 1021747 - protein, 9 aa, Homo Sapiens
DPRSGLSVS

SEQ ID NO: 1021748 - protein, 9 aa, Homo Sapiens
TGYATPLHV

SEQ ID NO: 1021749 - protein, 9 aa, Homo Sapiens
RRPAAGEEK

SEQ ID NO: 1021750 - protein, 9 aa, Homo Sapiens
VGSGGLGCS

SEQ ID NO: 1021751 - protein, 9 aa, Homo Sapiens
DYPVLADDT

SEQ ID NO: 1021752 - protein, 9 aa, Homo Sapiens
VGIMAFDYD

SEQ ID NO: 1021753 - protein, 9 aa, Homo Sapiens
VEGSNNIMG

SEQ ID NO: 1021754 - protein, 9 aa, Homo Sapiens
FICIILLIT

SEQ ID NO: 1021755 - protein, 9 aa, Homo Sapiens
FPCCRWSGK

SEQ ID NO: 1021756 - protein, 9 aa, Homo Sapiens
EQVSLVNPE

SEQ ID NO: 1021757 - protein, 9 aa, Homo Sapiens
VHLSKVRSL

SEQ ID NO: 1021758 - protein, 9 aa, Homo Sapiens
TLCSTPTHM

SEQ ID NO: 1021759 - protein, 9 aa, Homo Sapiens
GPGNIKEKP

SEQ ID NO: 1021760 - protein, 9 aa, Homo Sapiens
SRRAYLPGQ

SEQ ID NO: 1021761 - protein, 9 aa, Homo Sapiens
KITESTATL

SEQ ID NO: 1021762 - protein, 9 aa, Homo Sapiens
KIIVTEGSE

SEQ ID NO: 1021763 - protein, 9 aa, Homo Sapiens
NIKEKPTEC

SEQ ID NO: 1021764 - protein, 9 aa, Homo Sapiens
VKWQEEEGL

SEQ ID NO: 1021765 - protein, 9 aa, Homo Sapiens
FSALTFLNN

SEQ ID NO: 1021766 - protein, 9 aa, Homo Sapiens
HFPKDSPMN

SEQ ID NO: 1021767 - protein, 9 aa, Homo Sapiens
SSAGSEASF

SEQ ID NO: 1021768 - protein, 9 aa, Homo Sapiens
LFLLASPDP

SEQ ID NO: 1021769 - protein, 9 aa, Homo Sapiens
SFSALTFLN

SEQ ID NO: 1021770 - protein, 9 aa, Homo Sapiens
SCLFVYQNV

SEQ ID NO: 1021771 - protein, 9 aa, Homo Sapiens
YTIRILMCQ

SEQ ID NO: 1021772 - protein, 9 aa, Homo Sapiens
DRLQYYLAN

SEQ ID NO: 1021773 - protein, 9 aa, Homo Sapiens
EKMGIPGAA

SEQ ID NO: 1021774 - protein, 9 aa, Homo Sapiens
HNWKKVLPL

SEQ ID NO: 1021775 - protein, 9 aa, Homo Sapiens
RLQYYLANP

SEQ ID NO: 1021776 - protein, 9 aa, Homo Sapiens
SSISTGYAT

SEQ ID NO: 1021777 - protein, 9 aa, Homo Sapiens
RTPFISPVR

SEQ ID NO: 1021778 - protein, 9 aa, Homo Sapiens
RTIQCFPDR

SEQ ID NO: 1021779 - protein, 9 aa, Homo Sapiens
STPVGIMAF

SEQ ID NO: 1021780 - protein, 9 aa, Homo Sapiens
CFPCCRWSG

SEQ ID NO: 1021781 - protein, 9 aa, Homo Sapiens
GSGGLGCSI

SEQ ID NO: 1021782 - protein, 9 aa, Homo Sapiens
HSKYVNGRD

SEQ ID NO: 1021783 - protein, 9 aa, Homo Sapiens
MNFIVDGMG

SEQ ID NO: 1021784 - protein, 9 aa, Homo Sapiens
FSFLNPLAY

SEQ ID NO: 1021785 - protein, 9 aa, Homo Sapiens
GREQVSLVN

SEQ ID NO: 1021786 - protein, 9 aa, Homo Sapiens
AGSEASFPG

SEQ ID NO: 1021787 - protein, 9 aa, Homo Sapiens
GILCVCACV

SEQ ID NO: 1021788 - protein, 9 aa, Homo Sapiens
PGIVIVEKI

SEQ ID NO: 1021789 - protein, 9 aa, Homo Sapiens
AFSSCSYTS

SEQ ID NO: 1021790 - protein, 9 aa, Homo Sapiens
VGFGEKMVK

SEQ ID NO: 1021791 - protein, 9 aa, Homo Sapiens
VATVLNNMK

SEQ ID NO: 1021792 - protein, 9 aa, Homo Sapiens
LQEFSPALV

SEQ ID NO: 1021793 - protein, 9 aa, Homo Sapiens
RFSRRAYLP

SEQ ID NO: 1021794 - protein, 9 aa, Homo Sapiens
QSQTAGRTI

SEQ ID NO: 1021795 - protein, 9 aa, Homo Sapiens
RDLSTFFQE

SEQ ID NO: 1021796 - protein, 9 aa, Homo Sapiens
FSSCSYTSG

SEQ ID NO: 1021797 - protein, 9 aa, Homo Sapiens
GGSKQERST

SEQ ID NO: 1021798 - protein, 9 aa, Homo Sapiens
SSKTFFYFY

SEQ ID NO: 1021799 - protein, 9 aa, Homo Sapiens
LQNESKTKR

SEQ ID NO: 1021800 - protein, 9 aa, Homo Sapiens
IYNGERPFV

SEQ ID NO: 1021801 - protein, 9 aa, Homo Sapiens
NPALAAFVT

SEQ ID NO: 1021802 - protein, 9 aa, Homo Sapiens
REELAERPK

SEQ ID NO: 1021803 - protein, 9 aa, Homo Sapiens
AEVKKEGEL

SEQ ID NO: 1021804 - protein, 9 aa, Homo Sapiens
ESRAFGLPL

SEQ ID NO: 1021805 - protein, 9 aa, Homo Sapiens
EQEKNDVDV

SEQ ID NO: 1021806 - protein, 9 aa, Homo Sapiens
GNDEKAFDF

SEQ ID NO: 1021807 - protein, 9 aa, Homo Sapiens
AKMDADWTG

SEQ ID NO: 1021808 - protein, 9 aa, Homo Sapiens
LSPFRSSAL

SEQ ID NO: 1021809 - protein, 9 aa, Homo Sapiens
IEPCLEGEE

SEQ ID NO: 1021810 - protein, 9 aa, Homo Sapiens
LYMTKYERA

SEQ ID NO: 1021811 - protein, 9 aa, Homo Sapiens
WDSTNPFSK

SEQ ID NO: 1021812 - protein, 9 aa, Homo Sapiens
PIGQDFVGQ

SEQ ID NO: 1021813 - protein, 9 aa, Homo Sapiens
EKNGLACLA

SEQ ID NO: 1021814 - protein, 9 aa, Homo Sapiens
VDFFRAGPE

SEQ ID NO: 1021815 - protein, 9 aa, Homo Sapiens
MFCAGYYKG

SEQ ID NO: 1021816 - protein, 9 aa, Homo Sapiens
GIRGEAFLF

SEQ ID NO: 1021817 - protein, 9 aa, Homo Sapiens
ELHLTEIRQ

SEQ ID NO: 1021818 - protein, 9 aa, Homo Sapiens
YSSFCSVRA

SEQ ID NO: 1021819 - protein, 9 aa, Homo Sapiens
LGSGGKLSQ

SEQ ID NO: 1021820 - protein, 9 aa, Homo Sapiens
NQKRITTLY

SEQ ID NO: 1021821 - protein, 9 aa, Homo Sapiens
PLRAMWKQH

SEQ ID NO: 1021822 - protein, 9 aa, Homo Sapiens
RALEVSSPR

SEQ ID NO: 1021823 - protein, 9 aa, Homo Sapiens
EKMWEQKVR

SEQ ID NO: 1021824 - protein, 9 aa, Homo Sapiens
SFPQSTVPS

SEQ ID NO: 1021825 - protein, 9 aa, Homo Sapiens
QEIVILSSL

SEQ ID NO: 1021826 - protein, 9 aa, Homo Sapiens
QNESFLDLQ

SEQ ID NO: 1021827 - protein, 9 aa, Homo Sapiens
FSFLLSIFC

SEQ ID NO: 1021828 - protein, 9 aa, Homo Sapiens
VQRKRDMLR

SEQ ID NO: 1021829 - protein, 9 aa, Homo Sapiens
FEFVCESVF

SEQ ID NO: 1021830 - protein, 9 aa, Homo Sapiens
WHYAKKDEA

SEQ ID NO: 1021831 - protein, 9 aa, Homo Sapiens
LYTPMYFLL

SEQ ID NO: 1021832 - protein, 9 aa, Homo Sapiens
RVQGLCLGQ

SEQ ID NO: 1021833 - protein, 9 aa, Homo Sapiens
EQVVPGCFL

SEQ ID NO: 1021834 - protein, 9 aa, Homo Sapiens
ASFVLPSYQ

SEQ ID NO: 1021835 - protein, 9 aa, Homo Sapiens
RQSIRNFQK

SEQ ID NO: 1021836 - protein, 9 aa, Homo Sapiens
LVFFTILPH

SEQ ID NO: 1021837 - protein, 9 aa, Homo Sapiens
KYDLLYQDV

SEQ ID NO: 1021838 - protein, 9 aa, Homo Sapiens
AWGNPSNYN

SEQ ID NO: 1021839 - protein, 9 aa, Homo Sapiens
WEQVVPGCF

SEQ ID NO: 1021840 - protein, 9 aa, Homo Sapiens
PPLSSQRPW

SEQ ID NO: 1021841 - protein, 9 aa, Homo Sapiens
GMNVALQKV

SEQ ID NO: 1021842 - protein, 9 aa, Homo Sapiens
QNLYSNVML

SEQ ID NO: 1021843 - protein, 9 aa, Homo Sapiens
AIANIREET

SEQ ID NO: 1021844 - protein, 9 aa, Homo Sapiens
GMSIFRRIA

SEQ ID NO: 1021845 - protein, 9 aa, Homo Sapiens
FLDLQNLRM

SEQ ID NO: 1021846 - protein, 9 aa, Homo Sapiens
GSAIFFSGD

SEQ ID NO: 1021847 - protein, 9 aa, Homo Sapiens
NVSSIFLNS

SEQ ID NO: 1021848 - protein, 9 aa, Homo Sapiens
KLKFLQRKF

SEQ ID NO: 1021849 - protein, 9 aa, Homo Sapiens
DWAFSEGHS

SEQ ID NO: 1021850 - protein, 9 aa, Homo Sapiens
RKENCINLP

SEQ ID NO: 1021851 - protein, 9 aa, Homo Sapiens
SSGSSSTSS

SEQ ID NO: 1021852 - protein, 9 aa, Homo Sapiens
IRHVYPNGT

SEQ ID NO: 1021853 - protein, 9 aa, Homo Sapiens
DQTVFFFKV

SEQ ID NO: 1021854 - protein, 9 aa, Homo Sapiens
FHFIAVGIF

SEQ ID NO: 1021855 - protein, 9 aa, Homo Sapiens
HLFDRNANY

SEQ ID NO: 1021856 - protein, 9 aa, Homo Sapiens
QWVVISPPL

SEQ ID NO: 1021857 - protein, 9 aa, Homo Sapiens
VSSRVSAVE

SEQ ID NO: 1021858 - protein, 9 aa, Homo Sapiens
TAPPDAPNK

SEQ ID NO: 1021859 - protein, 9 aa, Homo Sapiens
RNKGNEKPR

SEQ ID NO: 1021860 - protein, 9 aa, Homo Sapiens
QNINPFSSQ

SEQ ID NO: 1021861 - protein, 9 aa, Homo Sapiens
SEDLRSFQS

SEQ ID NO: 1021862 - protein, 9 aa, Homo Sapiens
TNGIQNWTM

SEQ ID NO: 1021863 - protein, 9 aa, Homo Sapiens
RAFMNLTLM

SEQ ID NO: 1021864 - protein, 9 aa, Homo Sapiens
NPSNYNNKT

SEQ ID NO: 1021865 - protein, 9 aa, Homo Sapiens
HLSNELHVL

SEQ ID NO: 1021866 - protein, 9 aa, Homo Sapiens
PSFYLSVKQ

SEQ ID NO: 1021867 - protein, 9 aa, Homo Sapiens
RQLREYQKL

SEQ ID NO: 1021868 - protein, 9 aa, Homo Sapiens
EEIKKICRD

SEQ ID NO: 1021869 - protein, 9 aa, Homo Sapiens
RENEIVELK

SEQ ID NO: 1021870 - protein, 9 aa, Homo Sapiens
KMKPKITCP

SEQ ID NO: 1021871 - protein, 9 aa, Homo Sapiens
EILQSKVLL

SEQ ID NO: 1021872 - protein, 9 aa, Homo Sapiens
NVGSLWTAL

SEQ ID NO: 1021873 - protein, 9 aa, Homo Sapiens
LEDVCVAHL

SEQ ID NO: 1021874 - protein, 9 aa, Homo Sapiens
FEVYEDIEV

SEQ ID NO: 1021875 - protein, 9 aa, Homo Sapiens
LLWLQRLER

SEQ ID NO: 1021876 - protein, 9 aa, Homo Sapiens
DNSDDRDES

SEQ ID NO: 1021877 - protein, 9 aa, Homo Sapiens
ENGSELQEE

SEQ ID NO: 1021878 - protein, 9 aa, Homo Sapiens
VYTRLEFLR

SEQ ID NO: 1021879 - protein, 9 aa, Homo Sapiens
ECRVSEKSW

SEQ ID NO: 1021880 - protein, 9 aa, Homo Sapiens
PGSTLIPIN

SEQ ID NO: 1021881 - protein, 9 aa, Homo Sapiens
ITESPELIE

SEQ ID NO: 1021882 - protein, 9 aa, Homo Sapiens
DLNVFPPEL

SEQ ID NO: 1021883 - protein, 9 aa, Homo Sapiens
TKIEEMDSS

SEQ ID NO: 1021884 - protein, 9 aa, Homo Sapiens
ELPPKELQE

SEQ ID NO: 1021885 - protein, 9 aa, Homo Sapiens
DWKKERNKG

SEQ ID NO: 1021886 - protein, 9 aa, Homo Sapiens
SDVRYTEGY

SEQ ID NO: 1021887 - protein, 9 aa, Homo Sapiens
PGLGETPGE

SEQ ID NO: 1021888 - protein, 9 aa, Homo Sapiens
VLSDDVVQY

SEQ ID NO: 1021889 - protein, 9 aa, Homo Sapiens
TVIVQSPRQ

SEQ ID NO: 1021890 - protein, 9 aa, Homo Sapiens
IYTGGKLNK

SEQ ID NO: 1021891 - protein, 9 aa, Homo Sapiens
QPPKNAAWH

SEQ ID NO: 1021892 - protein, 9 aa, Homo Sapiens
HYKEGMSSS

SEQ ID NO: 1021893 - protein, 9 aa, Homo Sapiens
VEFASDYAD

SEQ ID NO: 1021894 - protein, 9 aa, Homo Sapiens
LTLAWNVWA

SEQ ID NO: 1021895 - protein, 9 aa, Homo Sapiens
PVSKSLQEA

SEQ ID NO: 1021896 - protein, 9 aa, Homo Sapiens
YDPHPYRRT

SEQ ID NO: 1021897 - protein, 9 aa, Homo Sapiens
AVARMKGEP

SEQ ID NO: 1021898 - protein, 9 aa, Homo Sapiens
GIKFDTLWQ

SEQ ID NO: 1021899 - protein, 9 aa, Homo Sapiens
CHANSSERA

SEQ ID NO: 1021900 - protein, 9 aa, Homo Sapiens
FSGSGPPIF

SEQ ID NO: 1021901 - protein, 9 aa, Homo Sapiens
RHKNKAKTA

SEQ ID NO: 1021902 - protein, 9 aa, Homo Sapiens
SCNVTKFEL

SEQ ID NO: 1021903 - protein, 9 aa, Homo Sapiens
QEFFILCFG

SEQ ID NO: 1021904 - protein, 9 aa, Homo Sapiens
PLLETFYAT

SEQ ID NO: 1021905 - protein, 9 aa, Homo Sapiens
FDKGRVRLW

SEQ ID NO: 1021906 - protein, 9 aa, Homo Sapiens
DHLKLFLFR

SEQ ID NO: 1021907 - protein, 9 aa, Homo Sapiens
KPCSCLERV

SEQ ID NO: 1021908 - protein, 9 aa, Homo Sapiens
QLEEPAGPE

SEQ ID NO: 1021909 - protein, 9 aa, Homo Sapiens
SPLRQRQNV

SEQ ID NO: 1021910 - protein, 9 aa, Homo Sapiens
GISGLQGLL

SEQ ID NO: 1021911 - protein, 9 aa, Homo Sapiens
QLENGEWTQ

SEQ ID NO: 1021912 - protein, 9 aa, Homo Sapiens
KVSQQGMNV

SEQ ID NO: 1021913 - protein, 9 aa, Homo Sapiens
NIITAALRR

SEQ ID NO: 1021914 - protein, 9 aa, Homo Sapiens
CEQNNDALE

SEQ ID NO: 1021915 - protein, 9 aa, Homo Sapiens
PQAGPPLLS

SEQ ID NO: 1021916 - protein, 9 aa, Homo Sapiens
RICRISDRT

SEQ ID NO: 1021917 - protein, 9 aa, Homo Sapiens
DNVDIFSVQ

SEQ ID NO: 1021918 - protein, 9 aa, Homo Sapiens
SLHVAVVGL

SEQ ID NO: 1021919 - protein, 9 aa, Homo Sapiens
PNMTFTKTF

SEQ ID NO: 1021920 - protein, 9 aa, Homo Sapiens
TVERFYSRF

SEQ ID NO: 1021921 - protein, 9 aa, Homo Sapiens
KRIYTGEKT

SEQ ID NO: 1021922 - protein, 9 aa, Homo Sapiens
VPQQASSPQ

SEQ ID NO: 1021923 - protein, 9 aa, Homo Sapiens
LKLAVLLII

SEQ ID NO: 1021924 - protein, 9 aa, Homo Sapiens
TAPSSGWGL

SEQ ID NO: 1021925 - protein, 9 aa, Homo Sapiens
VLAFPAGHL

SEQ ID NO: 1021926 - protein, 9 aa, Homo Sapiens
VGENMLIIV

SEQ ID NO: 1021927 - protein, 9 aa, Homo Sapiens
RGHTASTAS

SEQ ID NO: 1021928 - protein, 9 aa, Homo Sapiens
RLGSAIFFS

SEQ ID NO: 1021929 - protein, 9 aa, Homo Sapiens
RTNHDDPAF

SEQ ID NO: 1021930 - protein, 9 aa, Homo Sapiens
CRISDRTNY

SEQ ID NO: 1021931 - protein, 9 aa, Homo Sapiens
LSVSVKAML

SEQ ID NO: 1021932 - protein, 9 aa, Homo Sapiens
LENGEWTQG

SEQ ID NO: 1021933 - protein, 9 aa, Homo Sapiens
TRNMICAGE

SEQ ID NO: 1021934 - protein, 9 aa, Homo Sapiens
MYSEISEII

SEQ ID NO: 1021935 - protein, 9 aa, Homo Sapiens
TLDRVLKPK

SEQ ID NO: 1021936 - protein, 9 aa, Homo Sapiens
LFRLPEFVD

SEQ ID NO: 1021937 - protein, 9 aa, Homo Sapiens
LLYIFHYDI

SEQ ID NO: 1021938 - protein, 9 aa, Homo Sapiens
PSQDEDNTI

SEQ ID NO: 1021939 - protein, 9 aa, Homo Sapiens
VLNKKLMKK

SEQ ID NO: 1021940 - protein, 9 aa, Homo Sapiens
EELAERPKA

SEQ ID NO: 1021941 - protein, 9 aa, Homo Sapiens
QDFVGQRTV

SEQ ID NO: 1021942 - protein, 9 aa, Homo Sapiens
VSGSGQSFG

SEQ ID NO: 1021943 - protein, 9 aa, Homo Sapiens
EPGDPWSAS

SEQ ID NO: 1021944 - protein, 9 aa, Homo Sapiens
LDPSVSQRA

SEQ ID NO: 1021945 - protein, 9 aa, Homo Sapiens
LMLVSTSYQ

SEQ ID NO: 1021946 - protein, 9 aa, Homo Sapiens
SGKIKEFFF

SEQ ID NO: 1021947 - protein, 9 aa, Homo Sapiens
TIFRAAAEK

SEQ ID NO: 1021948 - protein, 9 aa, Homo Sapiens
GPPRIAGPQ

SEQ ID NO: 1021949 - protein, 9 aa, Homo Sapiens
LAWVELKDD

SEQ ID NO: 1021950 - protein, 9 aa, Homo Sapiens
FPNSSSYLH

SEQ ID NO: 1021951 - protein, 9 aa, Homo Sapiens
WVPLSPGIK

SEQ ID NO: 1021952 - protein, 9 aa, Homo Sapiens
LFDEVFFSE

SEQ ID NO: 1021953 - protein, 9 aa, Homo Sapiens
VERFYSRFH

SEQ ID NO: 1021954 - protein, 9 aa, Homo Sapiens
FIFTSGRNC

SEQ ID NO: 1021955 - protein, 9 aa, Homo Sapiens
SKTERGLYS

SEQ ID NO: 1021956 - protein, 9 aa, Homo Sapiens
LSPEKFEVL

SEQ ID NO: 1021957 - protein, 9 aa, Homo Sapiens
QTYSWMNLS

SEQ ID NO: 1021958 - protein, 9 aa, Homo Sapiens
TWSFPREVS

SEQ ID NO: 1021959 - protein, 9 aa, Homo Sapiens
DGGFLNNAS

SEQ ID NO: 1021960 - protein, 9 aa, Homo Sapiens
EDISEKPKK

SEQ ID NO: 1021961 - protein, 9 aa, Homo Sapiens
QYLQNESKT

SEQ ID NO: 1021962 - protein, 9 aa, Homo Sapiens
ERSKLLNKT

SEQ ID NO: 1021963 - protein, 9 aa, Homo Sapiens
PYTDVVVHE

SEQ ID NO: 1021964 - protein, 9 aa, Homo Sapiens
TKLARASVD

SEQ ID NO: 1021965 - protein, 9 aa, Homo Sapiens
PGGGDAGET

SEQ ID NO: 1021966 - protein, 9 aa, Homo Sapiens
AFSYPDVKV

SEQ ID NO: 1021967 - protein, 9 aa, Homo Sapiens
AAVEKKEQK

SEQ ID NO: 1021968 - protein, 9 aa, Homo Sapiens
ELLLKINRT

SEQ ID NO: 1021969 - protein, 9 aa, Homo Sapiens
NENYCDFVK

SEQ ID NO: 1021970 - protein, 9 aa, Homo Sapiens
EKEGIFPNS

SEQ ID NO: 1021971 - protein, 9 aa, Homo Sapiens
LRSWRELHL

SEQ ID NO: 1021972 - protein, 9 aa, Homo Sapiens
FVYGQTGSG

SEQ ID NO: 1021973 - protein, 9 aa, Homo Sapiens
APPACQPLM

SEQ ID NO: 1021974 - protein, 9 aa, Homo Sapiens
DNKSHGSRT

SEQ ID NO: 1021975 - protein, 9 aa, Homo Sapiens
CHRSDDPVG

SEQ ID NO: 1021976 - protein, 9 aa, Homo Sapiens
SEIRAEEIS

SEQ ID NO: 1021977 - protein, 9 aa, Homo Sapiens
FNLLVDSLD

SEQ ID NO: 1021978 - protein, 9 aa, Homo Sapiens
DMYPRPARL

SEQ ID NO: 1021979 - protein, 9 aa, Homo Sapiens
GISSERLAS

SEQ ID NO: 1021980 - protein, 9 aa, Homo Sapiens
AYSSFCSVR

SEQ ID NO: 1021981 - protein, 9 aa, Homo Sapiens
GWSGPYGVT

SEQ ID NO: 1021982 - protein, 9 aa, Homo Sapiens
LLSIFCSKY

SEQ ID NO: 1021983 - protein, 9 aa, Homo Sapiens
PEDPRGEAK

SEQ ID NO: 1021984 - protein, 9 aa, Homo Sapiens
AKVKSYRSL

SEQ ID NO: 1021985 - protein, 9 aa, Homo Sapiens
INFPKKACL

SEQ ID NO: 1021986 - protein, 9 aa, Homo Sapiens
QRAAYSPEG

SEQ ID NO: 1021987 - protein, 9 aa, Homo Sapiens
YSEISEIIH

SEQ ID NO: 1021988 - protein, 9 aa, Homo Sapiens
LQGLFYPAR

SEQ ID NO: 1021989 - protein, 9 aa, Homo Sapiens
PERNQDELF

SEQ ID NO: 1021990 - protein, 9 aa, Homo Sapiens
AFGLPLGLS

SEQ ID NO: 1021991 - protein, 9 aa, Homo Sapiens
CRNTIGFFN

SEQ ID NO: 1021992 - protein, 9 aa, Homo Sapiens
FLSSIILFD

SEQ ID NO: 1021993 - protein, 9 aa, Homo Sapiens
TSDSLRLSW

SEQ ID NO: 1021994 - protein, 9 aa, Homo Sapiens
HGESSLASS

SEQ ID NO: 1021995 - protein, 9 aa, Homo Sapiens
KNNWYFVVA

SEQ ID NO: 1021996 - protein, 9 aa, Homo Sapiens
NKHGRAVCC

SEQ ID NO: 1021997 - protein, 9 aa, Homo Sapiens
EAKTWRKVA

SEQ ID NO: 1021998 - protein, 9 aa, Homo Sapiens
VLTLAYSAS

SEQ ID NO: 1021999 - protein, 9 aa, Homo Sapiens
MWEKEKMRR

SEQ ID NO: 1022000 - protein, 9 aa, Homo Sapiens
EQLRAVRML

SEQ ID NO: 1022001 - protein, 9 aa, Homo Sapiens
NTRPLVYVL

SEQ ID NO: 1022002 - protein, 9 aa, Homo Sapiens
SHLYTPMYF

SEQ ID NO: 1022003 - protein, 9 aa, Homo Sapiens
FFKVERDYK

SEQ ID NO: 1022004 - protein, 9 aa, Homo Sapiens
GTRRQSWRS

SEQ ID NO: 1022005 - protein, 9 aa, Homo Sapiens
QKLVGFVLR

SEQ ID NO: 1022006 - protein, 9 aa, Homo Sapiens
GIKVQGDIK

SEQ ID NO: 1022007 - protein, 9 aa, Homo Sapiens
SRKDKSQTE

SEQ ID NO: 1022008 - protein, 9 aa, Homo Sapiens
FRLPEFVDR

SEQ ID NO: 1022009 - protein, 9 aa, Homo Sapiens
KERGYCYKK

SEQ ID NO: 1022010 - protein, 9 aa, Homo Sapiens
KSLASLHPS

SEQ ID NO: 1022011 - protein, 9 aa, Homo Sapiens
TIVTPMLNS

SEQ ID NO: 1022012 - protein, 9 aa, Homo Sapiens
QPAFQLDWP

SEQ ID NO: 1022013 - protein, 9 aa, Homo Sapiens
ERNPTGGSD

SEQ ID NO: 1022014 - protein, 9 aa, Homo Sapiens
EWHHERKHY

SEQ ID NO: 1022015 - protein, 9 aa, Homo Sapiens
SSQRSSSTS

SEQ ID NO: 1022016 - protein, 9 aa, Homo Sapiens
ETPGETVRH

SEQ ID NO: 1022017 - protein, 9 aa, Homo Sapiens
VVAGEFQKP

SEQ ID NO: 1022018 - protein, 9 aa, Homo Sapiens
PFKLMSTFK

SEQ ID NO: 1022019 - protein, 9 aa, Homo Sapiens
LPSPPEISA

SEQ ID NO: 1022020 - protein, 9 aa, Homo Sapiens
KKETVQGPI

SEQ ID NO: 1022021 - protein, 9 aa, Homo Sapiens
QLEFTVHFL

SEQ ID NO: 1022022 - protein, 9 aa, Homo Sapiens
INSFTVLDL

SEQ ID NO: 1022023 - protein, 9 aa, Homo Sapiens
SSEESTVDV

SEQ ID NO: 1022024 - protein, 9 aa, Homo Sapiens
QLASRKDKS

SEQ ID NO: 1022025 - protein, 9 aa, Homo Sapiens
FYGRKNFFI

SEQ ID NO: 1022026 - protein, 9 aa, Homo Sapiens
CIPEGIKFD

SEQ ID NO: 1022027 - protein, 9 aa, Homo Sapiens
NLSASFSTE

SEQ ID NO: 1022028 - protein, 9 aa, Homo Sapiens
RTCKAGVEE

SEQ ID NO: 1022029 - protein, 9 aa, Homo Sapiens
SKAPPPSLS

SEQ ID NO: 1022030 - protein, 9 aa, Homo Sapiens
MQDMNNLLS

SEQ ID NO: 1022031 - protein, 9 aa, Homo Sapiens
LARKARSPL

SEQ ID NO: 1022032 - protein, 9 aa, Homo Sapiens
KDDLQCFYI

SEQ ID NO: 1022033 - protein, 9 aa, Homo Sapiens
MTFDRYVAI

SEQ ID NO: 1022034 - protein, 9 aa, Homo Sapiens
NQRKKRKQK

SEQ ID NO: 1022035 - protein, 9 aa, Homo Sapiens
ATHQKIYNG

SEQ ID NO: 1022036 - protein, 9 aa, Homo Sapiens
RHGLFYYMK

SEQ ID NO: 1022037 - protein, 9 aa, Homo Sapiens
SGFESIQNS

SEQ ID NO: 1022038 - protein, 9 aa, Homo Sapiens
HPGSTLIPI

SEQ ID NO: 1022039 - protein, 9 aa, Homo Sapiens
FGPFMKVKS

SEQ ID NO: 1022040 - protein, 9 aa, Homo Sapiens
KNTMKNQKA

SEQ ID NO: 1022041 - protein, 9 aa, Homo Sapiens
AVSQGDETL

SEQ ID NO: 1022042 - protein, 9 aa, Homo Sapiens
LKMSELLYH

SEQ ID NO: 1022043 - protein, 9 aa, Homo Sapiens
SCFMLILLF

SEQ ID NO: 1022044 - protein, 9 aa, Homo Sapiens
QEKIYTGGK

SEQ ID NO: 1022045 - protein, 9 aa, Homo Sapiens
HVSGSGQSF

SEQ ID NO: 1022046 - protein, 9 aa, Homo Sapiens
CGCNLAEGG

SEQ ID NO: 1022047 - protein, 9 aa, Homo Sapiens
QMLFGIFAW

SEQ ID NO: 1022048 - protein, 9 aa, Homo Sapiens
SLKVCLDFS

SEQ ID NO: 1022049 - protein, 9 aa, Homo Sapiens
IGDNFFDDL

SEQ ID NO: 1022050 - protein, 9 aa, Homo Sapiens
GLPHGPYGE

SEQ ID NO: 1022051 - protein, 9 aa, Homo Sapiens
RLNPKMNII

SEQ ID NO: 1022052 - protein, 9 aa, Homo Sapiens
NWWKDGCFQ

SEQ ID NO: 1022053 - protein, 9 aa, Homo Sapiens
AVATTVLFS

SEQ ID NO: 1022054 - protein, 9 aa, Homo Sapiens
REETFFFKG

SEQ ID NO: 1022055 - protein, 9 aa, Homo Sapiens
STSYQLHTP

SEQ ID NO: 1022056 - protein, 9 aa, Homo Sapiens
QTFRVLRAL

SEQ ID NO: 1022057 - protein, 9 aa, Homo Sapiens
ITNNFGSVA

SEQ ID NO: 1022058 - protein, 9 aa, Homo Sapiens
KRIYSGEKP

SEQ ID NO: 1022059 - protein, 9 aa, Homo Sapiens
VSAENPNPQ

SEQ ID NO: 1022060 - protein, 9 aa, Homo Sapiens
CRRFVHLQW

SEQ ID NO: 1022061 - protein, 9 aa, Homo Sapiens
DLIYVAYNM

SEQ ID NO: 1022062 - protein, 9 aa, Homo Sapiens
KPSNENCNN

SEQ ID NO: 1022063 - protein, 9 aa, Homo Sapiens
KIKNNWYFV

SEQ ID NO: 1022064 - protein, 9 aa, Homo Sapiens
QMCDIKKWD

SEQ ID NO: 1022065 - protein, 9 aa, Homo Sapiens
KRILEFNSK

SEQ ID NO: 1022066 - protein, 9 aa, Homo Sapiens
KKQKNQKNL

SEQ ID NO: 1022067 - protein, 9 aa, Homo Sapiens
EEREQEKND

SEQ ID NO: 1022068 - protein, 9 aa, Homo Sapiens
CLGLTLAWN

SEQ ID NO: 1022069 - protein, 9 aa, Homo Sapiens
TQPSEKIWI

SEQ ID NO: 1022070 - protein, 9 aa, Homo Sapiens
GEYGCSLRL

SEQ ID NO: 1022071 - protein, 9 aa, Homo Sapiens
KDQKKIYNG

SEQ ID NO: 1022072 - protein, 9 aa, Homo Sapiens
GHRDSLHLC

SEQ ID NO: 1022073 - protein, 9 aa, Homo Sapiens
VVFELSVTF

SEQ ID NO: 1022074 - protein, 9 aa, Homo Sapiens
DTDRGGWTV

SEQ ID NO: 1022075 - protein, 9 aa, Homo Sapiens
VGILLEQSL

SEQ ID NO: 1022076 - protein, 9 aa, Homo Sapiens
VLRDYMISA

SEQ ID NO: 1022077 - protein, 9 aa, Homo Sapiens
LFRRFTCII

SEQ ID NO: 1022078 - protein, 9 aa, Homo Sapiens
DFFRAGPEG

SEQ ID NO: 1022079 - protein, 9 aa, Homo Sapiens
QRKLANKSW

SEQ ID NO: 1022080 - protein, 9 aa, Homo Sapiens
CHHLEIQNN

SEQ ID NO: 1022081 - protein, 9 aa, Homo Sapiens
FGYSFRLNE

SEQ ID NO: 1022082 - protein, 9 aa, Homo Sapiens
ASVDAINFY

SEQ ID NO: 1022083 - protein, 9 aa, Homo Sapiens
KLKGRITLT

SEQ ID NO: 1022084 - protein, 9 aa, Homo Sapiens
FVEVSYMEI

SEQ ID NO: 1022085 - protein, 9 aa, Homo Sapiens
SSVLKMINF

SEQ ID NO: 1022086 - protein, 9 aa, Homo Sapiens
DILNTATPG

SEQ ID NO: 1022087 - protein, 9 aa, Homo Sapiens
IETTKVEKK

SEQ ID NO: 1022088 - protein, 9 aa, Homo Sapiens
EIKSKKIKE

SEQ ID NO: 1022089 - protein, 9 aa, Homo Sapiens
NLENIETKN

SEQ ID NO: 1022090 - protein, 9 aa, Homo Sapiens
KGNFFPLEL

SEQ ID NO: 1022091 - protein, 9 aa, Homo Sapiens
VSGIGVTRF

SEQ ID NO: 1022092 - protein, 9 aa, Homo Sapiens
IFRAAAEKL

SEQ ID NO: 1022093 - protein, 9 aa, Homo Sapiens
VLLPQSQEV

SEQ ID NO: 1022094 - protein, 9 aa, Homo Sapiens
GNVKMLGLQ

SEQ ID NO: 1022095 - protein, 9 aa, Homo Sapiens
ILDNNDNAP

SEQ ID NO: 1022096 - protein, 9 aa, Homo Sapiens
IYAVAMQLL

SEQ ID NO: 1022097 - protein, 9 aa, Homo Sapiens
QKQINELEN

SEQ ID NO: 1022098 - protein, 9 aa, Homo Sapiens
PPFRSPERN

SEQ ID NO: 1022099 - protein, 9 aa, Homo Sapiens
LKYCDVDLV

SEQ ID NO: 1022100 - protein, 9 aa, Homo Sapiens
LVTITNNFG

SEQ ID NO: 1022101 - protein, 9 aa, Homo Sapiens
TCRNNILDH

SEQ ID NO: 1022102 - protein, 9 aa, Homo Sapiens
KEKPSNENC

SEQ ID NO: 1022103 - protein, 9 aa, Homo Sapiens
GSAGGKSSS

SEQ ID NO: 1022104 - protein, 9 aa, Homo Sapiens
RVTLFRQML

SEQ ID NO: 1022105 - protein, 9 aa, Homo Sapiens
WVYDGVENS

SEQ ID NO: 1022106 - protein, 9 aa, Homo Sapiens
ATTVIVQSP

SEQ ID NO: 1022107 - protein, 9 aa, Homo Sapiens
PHRPAELGV

SEQ ID NO: 1022108 - protein, 9 aa, Homo Sapiens
EADGLPGPP

SEQ ID NO: 1022109 - protein, 9 aa, Homo Sapiens
SGIGVTRFI

SEQ ID NO: 1022110 - protein, 9 aa, Homo Sapiens
STWIFEGKP

SEQ ID NO: 1022111 - protein, 9 aa, Homo Sapiens
YKLPDGHVI

SEQ ID NO: 1022112 - protein, 9 aa, Homo Sapiens
NFYKFEEMF

SEQ ID NO: 1022113 - protein, 9 aa, Homo Sapiens
PSSSGSLPS

SEQ ID NO: 1022114 - protein, 9 aa, Homo Sapiens
LLKFADNLG

SEQ ID NO: 1022115 - protein, 9 aa, Homo Sapiens
TAKEVILLD

SEQ ID NO: 1022116 - protein, 9 aa, Homo Sapiens
NEKTTLSSA

SEQ ID NO: 1022117 - protein, 9 aa, Homo Sapiens
NPKKSSPFI

SEQ ID NO: 1022118 - protein, 9 aa, Homo Sapiens
LNDLNVFPP

SEQ ID NO: 1022119 - protein, 9 aa, Homo Sapiens
RRFTEHNFS

SEQ ID NO: 1022120 - protein, 9 aa, Homo Sapiens
RELHLTEIR

SEQ ID NO: 1022121 - protein, 9 aa, Homo Sapiens
DRSLSCREA

SEQ ID NO: 1022122 - protein, 9 aa, Homo Sapiens
YFLPENDLA

SEQ ID NO: 1022123 - protein, 9 aa, Homo Sapiens
TPSPPSPNK

SEQ ID NO: 1022124 - protein, 9 aa, Homo Sapiens
VLESQRKSR

SEQ ID NO: 1022125 - protein, 9 aa, Homo Sapiens
SFRKEDCSF

SEQ ID NO: 1022126 - protein, 9 aa, Homo Sapiens
IFYFTVQVH

SEQ ID NO: 1022127 - protein, 9 aa, Homo Sapiens
WATLGNPIS

SEQ ID NO: 1022128 - protein, 9 aa, Homo Sapiens
EVGSEPFYY

SEQ ID NO: 1022129 - protein, 9 aa, Homo Sapiens
FLYPAATAA

SEQ ID NO: 1022130 - protein, 9 aa, Homo Sapiens
PKAVESWNP

SEQ ID NO: 1022131 - protein, 9 aa, Homo Sapiens
ENPNPQGGE

SEQ ID NO: 1022132 - protein, 9 aa, Homo Sapiens
KLALKYLLH

SEQ ID NO: 1022133 - protein, 9 aa, Homo Sapiens
YIDADTNDE

SEQ ID NO: 1022134 - protein, 9 aa, Homo Sapiens
TYPELKEGV

SEQ ID NO: 1022135 - protein, 9 aa, Homo Sapiens
KRSFARLYF

SEQ ID NO: 1022136 - protein, 9 aa, Homo Sapiens
VKNLSASFS

SEQ ID NO: 1022137 - protein, 9 aa, Homo Sapiens
WKYLFNYYY

SEQ ID NO: 1022138 - protein, 9 aa, Homo Sapiens
CSLRLDFTE

SEQ ID NO: 1022139 - protein, 9 aa, Homo Sapiens
TSATQGLLG

SEQ ID NO: 1022140 - protein, 9 aa, Homo Sapiens
NVKMLGLQI

SEQ ID NO: 1022141 - protein, 9 aa, Homo Sapiens
GIGLTPLLG

SEQ ID NO: 1022142 - protein, 9 aa, Homo Sapiens
SLESSPNAP

SEQ ID NO: 1022143 - protein, 9 aa, Homo Sapiens
LRPKPLFYA

SEQ ID NO: 1022144 - protein, 9 aa, Homo Sapiens
FEKHQITLF

SEQ ID NO: 1022145 - protein, 9 aa, Homo Sapiens
QNHGDFDVA

SEQ ID NO: 1022146 - protein, 9 aa, Homo Sapiens
LDETFIVPD

SEQ ID NO: 1022147 - protein, 9 aa, Homo Sapiens
TVLFSATMS

SEQ ID NO: 1022148 - protein, 9 aa, Homo Sapiens
LIQSMHNDA

SEQ ID NO: 1022149 - protein, 9 aa, Homo Sapiens
IPEGRVCAC

SEQ ID NO: 1022150 - protein, 9 aa, Homo Sapiens
QQNLYSNVM

SEQ ID NO: 1022151 - protein, 9 aa, Homo Sapiens
WDYLLERTN

SEQ ID NO: 1022152 - protein, 9 aa, Homo Sapiens
LLQQVRALY

SEQ ID NO: 1022153 - protein, 9 aa, Homo Sapiens
VIGRGHARL

SEQ ID NO: 1022154 - protein, 9 aa, Homo Sapiens
LVLEDQVAQ

SEQ ID NO: 1022155 - protein, 9 aa, Homo Sapiens
EVETSSAGR

SEQ ID NO: 1022156 - protein, 9 aa, Homo Sapiens
RNHLVPSTH

SEQ ID NO: 1022157 - protein, 9 aa, Homo Sapiens
HNTHAPTLQ

SEQ ID NO: 1022158 - protein, 9 aa, Homo Sapiens
LCGSARPKL

SEQ ID NO: 1022159 - protein, 9 aa, Homo Sapiens
YDAGKFAST

SEQ ID NO: 1022160 - protein, 9 aa, Homo Sapiens
WAQLSFPPY

SEQ ID NO: 1022161 - protein, 9 aa, Homo Sapiens
GPPIFQQVL

SEQ ID NO: 1022162 - protein, 9 aa, Homo Sapiens
ADPKVCCNY

SEQ ID NO: 1022163 - protein, 9 aa, Homo Sapiens
FSYCGSRKI

SEQ ID NO: 1022164 - protein, 9 aa, Homo Sapiens
RARIIVAAL

SEQ ID NO: 1022165 - protein, 9 aa, Homo Sapiens
MNWLANVRK

SEQ ID NO: 1022166 - protein, 9 aa, Homo Sapiens
GPGWSGPYG

SEQ ID NO: 1022167 - protein, 9 aa, Homo Sapiens
KAAVLWKLK

SEQ ID NO: 1022168 - protein, 9 aa, Homo Sapiens
FMKVKSEMI

SEQ ID NO: 1022169 - protein, 9 aa, Homo Sapiens
TIFRAKDLS

SEQ ID NO: 1022170 - protein, 9 aa, Homo Sapiens
DVWSTEESM

SEQ ID NO: 1022171 - protein, 9 aa, Homo Sapiens
LKDNRNHLV

SEQ ID NO: 1022172 - protein, 9 aa, Homo Sapiens
VEKIPRDMY

SEQ ID NO: 1022173 - protein, 9 aa, Homo Sapiens
NRLFSPLRQ

SEQ ID NO: 1022174 - protein, 9 aa, Homo Sapiens
REIDWARRA

SEQ ID NO: 1022175 - protein, 9 aa, Homo Sapiens
LAGPVVVLP

SEQ ID NO: 1022176 - protein, 9 aa, Homo Sapiens
TFQNDPNWV

SEQ ID NO: 1022177 - protein, 9 aa, Homo Sapiens
PPFTNYRQP

SEQ ID NO: 1022178 - protein, 9 aa, Homo Sapiens
VLKRKVIKK

SEQ ID NO: 1022179 - protein, 9 aa, Homo Sapiens
CQEIYSHLV

SEQ ID NO: 1022180 - protein, 9 aa, Homo Sapiens
VKMKPKITC

SEQ ID NO: 1022181 - protein, 9 aa, Homo Sapiens
EAHLMAVSL

SEQ ID NO: 1022182 - protein, 9 aa, Homo Sapiens
NCELLWLQR

SEQ ID NO: 1022183 - protein, 9 aa, Homo Sapiens
RFLLDFRRK

SEQ ID NO: 1022184 - protein, 9 aa, Homo Sapiens
QSWRSRQSR

SEQ ID NO: 1022185 - protein, 9 aa, Homo Sapiens
NFLEKLPDC

SEQ ID NO: 1022186 - protein, 9 aa, Homo Sapiens
GQRARIIVA

SEQ ID NO: 1022187 - protein, 9 aa, Homo Sapiens
MGFVAGLAV

SEQ ID NO: 1022188 - protein, 9 aa, Homo Sapiens
LDHINLYVR

SEQ ID NO: 1022189 - protein, 9 aa, Homo Sapiens
IFRNKPSGI

SEQ ID NO: 1022190 - protein, 9 aa, Homo Sapiens
EGVQLSASC

SEQ ID NO: 1022191 - protein, 9 aa, Homo Sapiens
SAYQENPAY

SEQ ID NO: 1022192 - protein, 9 aa, Homo Sapiens
RAKVSEVPR

SEQ ID NO: 1022193 - protein, 9 aa, Homo Sapiens
LLQYLQNES

SEQ ID NO: 1022194 - protein, 9 aa, Homo Sapiens
SKTNRTLHL

SEQ ID NO: 1022195 - protein, 9 aa, Homo Sapiens
LNQTQSKKP

SEQ ID NO: 1022196 - protein, 9 aa, Homo Sapiens
KTASLGLAR

SEQ ID NO: 1022197 - protein, 9 aa, Homo Sapiens
DPINADSLS

SEQ ID NO: 1022198 - protein, 9 aa, Homo Sapiens
LSGTSATQG

SEQ ID NO: 1022199 - protein, 9 aa, Homo Sapiens
RIAGPQGSQ

SEQ ID NO: 1022200 - protein, 9 aa, Homo Sapiens
FTEKMRGKL

SEQ ID NO: 1022201 - protein, 9 aa, Homo Sapiens
KNILFRVCS

SEQ ID NO: 1022202 - protein, 9 aa, Homo Sapiens
SQQNTRPLV

SEQ ID NO: 1022203 - protein, 9 aa, Homo Sapiens
RQSWRSRQS

SEQ ID NO: 1022204 - protein, 9 aa, Homo Sapiens
ATKAVLWKY

SEQ ID NO: 1022205 - protein, 9 aa, Homo Sapiens
KYYGQGSKA

SEQ ID NO: 1022206 - protein, 9 aa, Homo Sapiens
HLKQWRQQM

SEQ ID NO: 1022207 - protein, 9 aa, Homo Sapiens
VDSENCRIV

SEQ ID NO: 1022208 - protein, 9 aa, Homo Sapiens
ELQEEDSLT

SEQ ID NO: 1022209 - protein, 9 aa, Homo Sapiens
QISPASIKL

SEQ ID NO: 1022210 - protein, 9 aa, Homo Sapiens
TFKGWMNII

SEQ ID NO: 1022211 - protein, 9 aa, Homo Sapiens
PFRSPERNQ

SEQ ID NO: 1022212 - protein, 9 aa, Homo Sapiens
LVAGPGRGG

SEQ ID NO: 1022213 - protein, 9 aa, Homo Sapiens
NQTSSGATE

SEQ ID NO: 1022214 - protein, 9 aa, Homo Sapiens
HLACFCKDK

SEQ ID NO: 1022215 - protein, 9 aa, Homo Sapiens
ELRVISCTH

SEQ ID NO: 1022216 - protein, 9 aa, Homo Sapiens
CTVRRFLEI

SEQ ID NO: 1022217 - protein, 9 aa, Homo Sapiens
NDEGQLLYS

SEQ ID NO: 1022218 - protein, 9 aa, Homo Sapiens
TDSSVSLLL

SEQ ID NO: 1022219 - protein, 9 aa, Homo Sapiens
KDLPPAYGS

SEQ ID NO: 1022220 - protein, 9 aa, Homo Sapiens
NLKMKRLAE

SEQ ID NO: 1022221 - protein, 9 aa, Homo Sapiens
VNVMPFASR

SEQ ID NO: 1022222 - protein, 9 aa, Homo Sapiens
NNPDEQMND

SEQ ID NO: 1022223 - protein, 9 aa, Homo Sapiens
NRQNKFLTR

SEQ ID NO: 1022224 - protein, 9 aa, Homo Sapiens
NSVEDVPVE

SEQ ID NO: 1022225 - protein, 9 aa, Homo Sapiens
ILTQNTQAS

SEQ ID NO: 1022226 - protein, 9 aa, Homo Sapiens
LCSTPQRSL

SEQ ID NO: 1022227 - protein, 9 aa, Homo Sapiens
LFQEAERCK

SEQ ID NO: 1022228 - protein, 9 aa, Homo Sapiens
CCNYSLHVA

SEQ ID NO: 1022229 - protein, 9 aa, Homo Sapiens
AIPGSAGSA

SEQ ID NO: 1022230 - protein, 9 aa, Homo Sapiens
ANIVRCDNL

SEQ ID NO: 1022231 - protein, 9 aa, Homo Sapiens
PNKNPEAEL

SEQ ID NO: 1022232 - protein, 9 aa, Homo Sapiens
TEIRSIKEP

SEQ ID NO: 1022233 - protein, 9 aa, Homo Sapiens
KSFTKLARA

SEQ ID NO: 1022234 - protein, 9 aa, Homo Sapiens
ADTNDEGQL

SEQ ID NO: 1022235 - protein, 9 aa, Homo Sapiens
WFYIHSFWK

SEQ ID NO: 1022236 - protein, 9 aa, Homo Sapiens
LEQERLTSG

SEQ ID NO: 1022237 - protein, 9 aa, Homo Sapiens
SKPSRPTKE

SEQ ID NO: 1022238 - protein, 9 aa, Homo Sapiens
PFITIIPGG

SEQ ID NO: 1022239 - protein, 9 aa, Homo Sapiens
RKTFREIIC

SEQ ID NO: 1022240 - protein, 9 aa, Homo Sapiens
EKTMLVEAI

SEQ ID NO: 1022241 - protein, 9 aa, Homo Sapiens
VSFVIPAFH

SEQ ID NO: 1022242 - protein, 9 aa, Homo Sapiens
DTSGNQAVL

SEQ ID NO: 1022243 - protein, 9 aa, Homo Sapiens
LLNDSEHFV

SEQ ID NO: 1022244 - protein, 9 aa, Homo Sapiens
CYFSSGSCR

SEQ ID NO: 1022245 - protein, 9 aa, Homo Sapiens
NSNDVTQGC

SEQ ID NO: 1022246 - protein, 9 aa, Homo Sapiens
ERITVTGNR

SEQ ID NO: 1022247 - protein, 9 aa, Homo Sapiens
NIVIFLNTF

SEQ ID NO: 1022248 - protein, 9 aa, Homo Sapiens
KVSLVMLGS

SEQ ID NO: 1022249 - protein, 9 aa, Homo Sapiens
SLLGSYSPI

SEQ ID NO: 1022250 - protein, 9 aa, Homo Sapiens
CKGGTTTPW

SEQ ID NO: 1022251 - protein, 9 aa, Homo Sapiens
GNLEVSYSH

SEQ ID NO: 1022252 - protein, 9 aa, Homo Sapiens
VKTIHEGTS

SEQ ID NO: 1022253 - protein, 9 aa, Homo Sapiens
FVLLELADT

SEQ ID NO: 1022254 - protein, 9 aa, Homo Sapiens
PVTITVQAD

SEQ ID NO: 1022255 - protein, 9 aa, Homo Sapiens
IIIAIYALL

SEQ ID NO: 1022256 - protein, 9 aa, Homo Sapiens
PKAWHKCEM

SEQ ID NO: 1022257 - protein, 9 aa, Homo Sapiens
DAGPLLKIL

SEQ ID NO: 1022258 - protein, 9 aa, Homo Sapiens
PSLPDYKKT

SEQ ID NO: 1022259 - protein, 9 aa, Homo Sapiens
IIWIVFFFS

SEQ ID NO: 1022260 - protein, 9 aa, Homo Sapiens
LYIFHYDID

SEQ ID NO: 1022261 - protein, 9 aa, Homo Sapiens
LRLRIDLRL

SEQ ID NO: 1022262 - protein, 9 aa, Homo Sapiens
NHFYEQCFK

SEQ ID NO: 1022263 - protein, 9 aa, Homo Sapiens
PLDHINLYV

SEQ ID NO: 1022264 - protein, 9 aa, Homo Sapiens
GYINEDDLP

SEQ ID NO: 1022265 - protein, 9 aa, Homo Sapiens
ILDLGENNL

SEQ ID NO: 1022266 - protein, 9 aa, Homo Sapiens
EANLELLND

SEQ ID NO: 1022267 - protein, 9 aa, Homo Sapiens
HTQPSEKIW

SEQ ID NO: 1022268 - protein, 9 aa, Homo Sapiens
SVVQTVFAM

SEQ ID NO: 1022269 - protein, 9 aa, Homo Sapiens
LIRMCLYYE

SEQ ID NO: 1022270 - protein, 9 aa, Homo Sapiens
ALWAASTVL

SEQ ID NO: 1022271 - protein, 9 aa, Homo Sapiens
VFCWPTLVI

SEQ ID NO: 1022272 - protein, 9 aa, Homo Sapiens
QATHKQRKL

SEQ ID NO: 1022273 - protein, 9 aa, Homo Sapiens
EAQEVLAGL

SEQ ID NO: 1022274 - protein, 9 aa, Homo Sapiens
AGEEVFPRL

SEQ ID NO: 1022275 - protein, 9 aa, Homo Sapiens
MPFITIIPG

SEQ ID NO: 1022276 - protein, 9 aa, Homo Sapiens
LWQELEVFC

SEQ ID NO: 1022277 - protein, 9 aa, Homo Sapiens
SKMYIKSSH

SEQ ID NO: 1022278 - protein, 9 aa, Homo Sapiens
LQVENENYC

SEQ ID NO: 1022279 - protein, 9 aa, Homo Sapiens
AFQEFFILC

SEQ ID NO: 1022280 - protein, 9 aa, Homo Sapiens
ISNSKPSKT

SEQ ID NO: 1022281 - protein, 9 aa, Homo Sapiens
DIPAPRICR

SEQ ID NO: 1022282 - protein, 9 aa, Homo Sapiens
EEEKNIIMA

SEQ ID NO: 1022283 - protein, 9 aa, Homo Sapiens
LKKKCKATC

SEQ ID NO: 1022284 - protein, 9 aa, Homo Sapiens
CMEKGSIKW

SEQ ID NO: 1022285 - protein, 9 aa, Homo Sapiens
SGRPQDDID

SEQ ID NO: 1022286 - protein, 9 aa, Homo Sapiens
KSSANPEKK

SEQ ID NO: 1022287 - protein, 9 aa, Homo Sapiens
LSRKVESLF

SEQ ID NO: 1022288 - protein, 9 aa, Homo Sapiens
EVLKRKVIK

SEQ ID NO: 1022289 - protein, 9 aa, Homo Sapiens
KATISDTNN

SEQ ID NO: 1022290 - protein, 9 aa, Homo Sapiens
QPIQTYSWM

SEQ ID NO: 1022291 - protein, 9 aa, Homo Sapiens
NREELAERP

SEQ ID NO: 1022292 - protein, 9 aa, Homo Sapiens
QERSLQDRL

SEQ ID NO: 1022293 - protein, 9 aa, Homo Sapiens
ELLWLQRLE

SEQ ID NO: 1022294 - protein, 9 aa, Homo Sapiens
LEVSYSHSS

SEQ ID NO: 1022295 - protein, 9 aa, Homo Sapiens
KTFQKFGQW

SEQ ID NO: 1022296 - protein, 9 aa, Homo Sapiens
AAMRESGQA

SEQ ID NO: 1022297 - protein, 9 aa, Homo Sapiens
QSLRVDFFR

SEQ ID NO: 1022298 - protein, 9 aa, Homo Sapiens
DAKSFTKLA

SEQ ID NO: 1022299 - protein, 9 aa, Homo Sapiens
GWMNIIYAA

SEQ ID NO: 1022300 - protein, 9 aa, Homo Sapiens
SFMLFDPSN

SEQ ID NO: 1022301 - protein, 9 aa, Homo Sapiens
DGITRVYKS

SEQ ID NO: 1022302 - protein, 9 aa, Homo Sapiens
LMGWLANSS

SEQ ID NO: 1022303 - protein, 9 aa, Homo Sapiens
AKKVLLFYY

SEQ ID NO: 1022304 - protein, 9 aa, Homo Sapiens
AFHFIAVGI

SEQ ID NO: 1022305 - protein, 9 aa, Homo Sapiens
TAFLGMSIF

SEQ ID NO: 1022306 - protein, 9 aa, Homo Sapiens
VRLWLQAEH

SEQ ID NO: 1022307 - protein, 9 aa, Homo Sapiens
QKNGTLALL

SEQ ID NO: 1022308 - protein, 9 aa, Homo Sapiens
KINSKGLAG

SEQ ID NO: 1022309 - protein, 9 aa, Homo Sapiens
RGAECCLLA

SEQ ID NO: 1022310 - protein, 9 aa, Homo Sapiens
LALAESEDE

SEQ ID NO: 1022311 - protein, 9 aa, Homo Sapiens
PQRMHNRKT

SEQ ID NO: 1022312 - protein, 9 aa, Homo Sapiens
DNRIVLKVI

SEQ ID NO: 1022313 - protein, 9 aa, Homo Sapiens
AFSGSRTTS

SEQ ID NO: 1022314 - protein, 9 aa, Homo Sapiens
SHPNHTENN

SEQ ID NO: 1022315 - protein, 9 aa, Homo Sapiens
GVFHHRGCL

SEQ ID NO: 1022316 - protein, 9 aa, Homo Sapiens
EAVLLLLDL

SEQ ID NO: 1022317 - protein, 9 aa, Homo Sapiens
SDVIGRGHA

SEQ ID NO: 1022318 - protein, 9 aa, Homo Sapiens
ASLGLARKA

SEQ ID NO: 1022319 - protein, 9 aa, Homo Sapiens
RGEAKELGE

SEQ ID NO: 1022320 - protein, 9 aa, Homo Sapiens
EGISAGSST

SEQ ID NO: 1022321 - protein, 9 aa, Homo Sapiens
NSKLVKPGG

SEQ ID NO: 1022322 - protein, 9 aa, Homo Sapiens
HGWNKQLRR

SEQ ID NO: 1022323 - protein, 9 aa, Homo Sapiens
RPDLKNILF

SEQ ID NO: 1022324 - protein, 9 aa, Homo Sapiens
LEKLPDCPC

SEQ ID NO: 1022325 - protein, 9 aa, Homo Sapiens
MVGSPDQNL

SEQ ID NO: 1022326 - protein, 9 aa, Homo Sapiens
IFFSGDDLG

SEQ ID NO: 1022327 - protein, 9 aa, Homo Sapiens
DNPPQFPKS

SEQ ID NO: 1022328 - protein, 9 aa, Homo Sapiens
TKLALKYLL

SEQ ID NO: 1022329 - protein, 9 aa, Homo Sapiens
NSAAAQSLM

SEQ ID NO: 1022330 - protein, 9 aa, Homo Sapiens
EPEINKGGN

SEQ ID NO: 1022331 - protein, 9 aa, Homo Sapiens
LQEIRKFIC

SEQ ID NO: 1022332 - protein, 9 aa, Homo Sapiens
GFAPCSPPS

SEQ ID NO: 1022333 - protein, 9 aa, Homo Sapiens
FAQIRCKLL

SEQ ID NO: 1022334 - protein, 9 aa, Homo Sapiens
EFNSKLGCF

SEQ ID NO: 1022335 - protein, 9 aa, Homo Sapiens
MNATTVIVQ

SEQ ID NO: 1022336 - protein, 9 aa, Homo Sapiens
SARKMTEVL

SEQ ID NO: 1022337 - protein, 9 aa, Homo Sapiens
FLSDNSPVG

SEQ ID NO: 1022338 - protein, 9 aa, Homo Sapiens
KDEGFGDWS

SEQ ID NO: 1022339 - protein, 9 aa, Homo Sapiens
DLRSFQSGD

SEQ ID NO: 1022340 - protein, 9 aa, Homo Sapiens
FFVNHLKMS

SEQ ID NO: 1022341 - protein, 9 aa, Homo Sapiens
SHRNKETFS

SEQ ID NO: 1022342 - protein, 9 aa, Homo Sapiens
VSEVPREEA

SEQ ID NO: 1022343 - protein, 9 aa, Homo Sapiens
SDHWLLWLG

SEQ ID NO: 1022344 - protein, 9 aa, Homo Sapiens
DSFYTPEPD

SEQ ID NO: 1022345 - protein, 9 aa, Homo Sapiens
ECACVYAEN

SEQ ID NO: 1022346 - protein, 9 aa, Homo Sapiens
SHNLEGTVG

SEQ ID NO: 1022347 - protein, 9 aa, Homo Sapiens
QEVGSRGGE

SEQ ID NO: 1022348 - protein, 9 aa, Homo Sapiens
VEMYSEISE

SEQ ID NO: 1022349 - protein, 9 aa, Homo Sapiens
WKHPKITSF

SEQ ID NO: 1022350 - protein, 9 aa, Homo Sapiens
FKVIEAYCT

SEQ ID NO: 1022351 - protein, 9 aa, Homo Sapiens
AQIFFLQGQ

SEQ ID NO: 1022352 - protein, 9 aa, Homo Sapiens
SSCVQGKKT

SEQ ID NO: 1022353 - protein, 9 aa, Homo Sapiens
KKWVKFKRN

SEQ ID NO: 1022354 - protein, 9 aa, Homo Sapiens
FVLPSYQHS

SEQ ID NO: 1022355 - protein, 9 aa, Homo Sapiens
KDACSWSTG

SEQ ID NO: 1022356 - protein, 9 aa, Homo Sapiens
EEEEPSTFP

SEQ ID NO: 1022357 - protein, 9 aa, Homo Sapiens
EDLDDILEF

SEQ ID NO: 1022358 - protein, 9 aa, Homo Sapiens
MSVGENMLI

SEQ ID NO: 1022359 - protein, 9 aa, Homo Sapiens
RNQRKKRKQ

SEQ ID NO: 1022360 - protein, 9 aa, Homo Sapiens
DSSHSGKSV

SEQ ID NO: 1022361 - protein, 9 aa, Homo Sapiens
VIGLLLVLT

SEQ ID NO: 1022362 - protein, 9 aa, Homo Sapiens
ILKNAAEEQ

SEQ ID NO: 1022363 - protein, 9 aa, Homo Sapiens
TTSVRCRGF

SEQ ID NO: 1022364 - protein, 9 aa, Homo Sapiens
SQKLVGFVL

SEQ ID NO: 1022365 - protein, 9 aa, Homo Sapiens
TKVDKAEYM

SEQ ID NO: 1022366 - protein, 9 aa, Homo Sapiens
VTITNNFGS

SEQ ID NO: 1022367 - protein, 9 aa, Homo Sapiens
FFEKLKNSN

SEQ ID NO: 1022368 - protein, 9 aa, Homo Sapiens
TIPMAFSLK

SEQ ID NO: 1022369 - protein, 9 aa, Homo Sapiens
EKAMKNYEK

SEQ ID NO: 1022370 - protein, 9 aa, Homo Sapiens
RLQDSRMTF

SEQ ID NO: 1022371 - protein, 9 aa, Homo Sapiens
QILACGGDG

SEQ ID NO: 1022372 - protein, 9 aa, Homo Sapiens
TESSKDGIT

SEQ ID NO: 1022373 - protein, 9 aa, Homo Sapiens
RRFVHLQWK

SEQ ID NO: 1022374 - protein, 9 aa, Homo Sapiens
LFMMPTMAL

SEQ ID NO: 1022375 - protein, 9 aa, Homo Sapiens
KVFGTCEAH

SEQ ID NO: 1022376 - protein, 9 aa, Homo Sapiens
GSAYGFCTC

SEQ ID NO: 1022377 - protein, 9 aa, Homo Sapiens
FVKRHYFSD

SEQ ID NO: 1022378 - protein, 9 aa, Homo Sapiens
QTFEDQSLS

SEQ ID NO: 1022379 - protein, 9 aa, Homo Sapiens
GFPRACYRA

SEQ ID NO: 1022380 - protein, 9 aa, Homo Sapiens
RFTLRMMET

SEQ ID NO: 1022381 - protein, 9 aa, Homo Sapiens
KMKRLAEEK

SEQ ID NO: 1022382 - protein, 9 aa, Homo Sapiens
TSWHLQPTC

SEQ ID NO: 1022383 - protein, 9 aa, Homo Sapiens
INKTLTEIR

SEQ ID NO: 1022384 - protein, 9 aa, Homo Sapiens
LSASQDRTL

SEQ ID NO: 1022385 - protein, 9 aa, Homo Sapiens
LKFADNLGM

SEQ ID NO: 1022386 - protein, 9 aa, Homo Sapiens
TSDSLASKT

SEQ ID NO: 1022387 - protein, 9 aa, Homo Sapiens
RKNWWKDGC

SEQ ID NO: 1022388 - protein, 9 aa, Homo Sapiens
FFSFSSDFV

SEQ ID NO: 1022389 - protein, 9 aa, Homo Sapiens
GIFCSGSDD

SEQ ID NO: 1022390 - protein, 9 aa, Homo Sapiens
LLLSPPNKP

SEQ ID NO: 1022391 - protein, 9 aa, Homo Sapiens
RRNQSSVDQ

SEQ ID NO: 1022392 - protein, 9 aa, Homo Sapiens
FFYFYNCSS

SEQ ID NO: 1022393 - protein, 9 aa, Homo Sapiens
AERLCSTPQ

SEQ ID NO: 1022394 - protein, 9 aa, Homo Sapiens
KERNKGNEK

SEQ ID NO: 1022395 - protein, 9 aa, Homo Sapiens
GSSTSGSTH

SEQ ID NO: 1022396 - protein, 9 aa, Homo Sapiens
HKMKSPPSA

SEQ ID NO: 1022397 - protein, 9 aa, Homo Sapiens
KLVQHVCAA

SEQ ID NO: 1022398 - protein, 9 aa, Homo Sapiens
LVSHAQQEY

SEQ ID NO: 1022399 - protein, 9 aa, Homo Sapiens
FQMCDIKKW

SEQ ID NO: 1022400 - protein, 9 aa, Homo Sapiens
IAPSATAAA

SEQ ID NO: 1022401 - protein, 9 aa, Homo Sapiens
STLSQSNTF

SEQ ID NO: 1022402 - protein, 9 aa, Homo Sapiens
KTMLVEAIH

SEQ ID NO: 1022403 - protein, 9 aa, Homo Sapiens
FLLDVEHLG

SEQ ID NO: 1022404 - protein, 9 aa, Homo Sapiens
KQKFLELAR

SEQ ID NO: 1022405 - protein, 9 aa, Homo Sapiens
RKKHCVFDA

SEQ ID NO: 1022406 - protein, 9 aa, Homo Sapiens
SVTFNYNLA

SEQ ID NO: 1022407 - protein, 9 aa, Homo Sapiens
LLKWLEDVC

SEQ ID NO: 1022408 - protein, 9 aa, Homo Sapiens
PVLAFPAGH

SEQ ID NO: 1022409 - protein, 9 aa, Homo Sapiens
NLQEAAAGC

SEQ ID NO: 1022410 - protein, 9 aa, Homo Sapiens
IFRRIAGEE

SEQ ID NO: 1022411 - protein, 9 aa, Homo Sapiens
AAHQKKIDK

SEQ ID NO: 1022412 - protein, 9 aa, Homo Sapiens
GCNKIGDVG

SEQ ID NO: 1022413 - protein, 9 aa, Homo Sapiens
FSWPLYSMY

SEQ ID NO: 1022414 - protein, 9 aa, Homo Sapiens
IRNFQKHSP

SEQ ID NO: 1022415 - protein, 9 aa, Homo Sapiens
KPEGSPGEI

SEQ ID NO: 1022416 - protein, 9 aa, Homo Sapiens
PKAQTGSGL

SEQ ID NO: 1022417 - protein, 9 aa, Homo Sapiens
NKHSYLCTA

SEQ ID NO: 1022418 - protein, 9 aa, Homo Sapiens
FRQMLSGAI

SEQ ID NO: 1022419 - protein, 9 aa, Homo Sapiens
LVCCLDFRL

SEQ ID NO: 1022420 - protein, 9 aa, Homo Sapiens
KDVVLNKKL

SEQ ID NO: 1022421 - protein, 9 aa, Homo Sapiens
EESMPTKET

SEQ ID NO: 1022422 - protein, 9 aa, Homo Sapiens
GDIPYRKEI

SEQ ID NO: 1022423 - protein, 9 aa, Homo Sapiens
WTPYNIVIF

SEQ ID NO: 1022424 - protein, 9 aa, Homo Sapiens
YTDDGARPV

SEQ ID NO: 1022425 - protein, 9 aa, Homo Sapiens
SEKLEEKED

SEQ ID NO: 1022426 - protein, 9 aa, Homo Sapiens
NNIKHITAK

SEQ ID NO: 1022427 - protein, 9 aa, Homo Sapiens
HLCRHSANI

SEQ ID NO: 1022428 - protein, 9 aa, Homo Sapiens
SSSHTAIPA

SEQ ID NO: 1022429 - protein, 9 aa, Homo Sapiens
PRAKVSEVP

SEQ ID NO: 1022430 - protein, 9 aa, Homo Sapiens
LLAMTFDRY

SEQ ID NO: 1022431 - protein, 9 aa, Homo Sapiens
PRGAKGCTA

SEQ ID NO: 1022432 - protein, 9 aa, Homo Sapiens
GAGFSIRYK

SEQ ID NO: 1022433 - protein, 9 aa, Homo Sapiens
QAQRDKRME

SEQ ID NO: 1022434 - protein, 9 aa, Homo Sapiens
RRRSLSALA

SEQ ID NO: 1022435 - protein, 9 aa, Homo Sapiens
CPKGATHCY

SEQ ID NO: 1022436 - protein, 9 aa, Homo Sapiens
GDIGPPGPA

SEQ ID NO: 1022437 - protein, 9 aa, Homo Sapiens
SGKEHVLAP

SEQ ID NO: 1022438 - protein, 9 aa, Homo Sapiens
TYKRRAFRK

SEQ ID NO: 1022439 - protein, 9 aa, Homo Sapiens
KLLQLDSLV

SEQ ID NO: 1022440 - protein, 9 aa, Homo Sapiens
DAPNKEEVF

SEQ ID NO: 1022441 - protein, 9 aa, Homo Sapiens
SKRIFIGGG

SEQ ID NO: 1022442 - protein, 9 aa, Homo Sapiens
FLDKVVSVF

SEQ ID NO: 1022443 - protein, 9 aa, Homo Sapiens
LRLSDDEEL

SEQ ID NO: 1022444 - protein, 9 aa, Homo Sapiens
EYGSIFTNA

SEQ ID NO: 1022445 - protein, 9 aa, Homo Sapiens
FSQALISVF

SEQ ID NO: 1022446 - protein, 9 aa, Homo Sapiens
ANDSCSTMS

SEQ ID NO: 1022447 - protein, 9 aa, Homo Sapiens
CHIEGDNLH

SEQ ID NO: 1022448 - protein, 9 aa, Homo Sapiens
LFDRNANYV

SEQ ID NO: 1022449 - protein, 9 aa, Homo Sapiens
MKPKITCPP

SEQ ID NO: 1022450 - protein, 9 aa, Homo Sapiens
RMSPLAWVE

SEQ ID NO: 1022451 - protein, 9 aa, Homo Sapiens
VYRYIATPR

SEQ ID NO: 1022452 - protein, 9 aa, Homo Sapiens
NGYNDLMSK

SEQ ID NO: 1022453 - protein, 9 aa, Homo Sapiens
ECTLRISGT

SEQ ID NO: 1022454 - protein, 9 aa, Homo Sapiens
SWFYIHSFW

SEQ ID NO: 1022455 - protein, 9 aa, Homo Sapiens
MLEAYSSAA

SEQ ID NO: 1022456 - protein, 9 aa, Homo Sapiens
LAMTFDRYV

SEQ ID NO: 1022457 - protein, 9 aa, Homo Sapiens
LSSSITSSG

SEQ ID NO: 1022458 - protein, 9 aa, Homo Sapiens
GPKGSLEFP

SEQ ID NO: 1022459 - protein, 9 aa, Homo Sapiens
HVYPNGTLQ

SEQ ID NO: 1022460 - protein, 9 aa, Homo Sapiens
DSHPTMKDS

SEQ ID NO: 1022461 - protein, 9 aa, Homo Sapiens
GTKGERGKA

SEQ ID NO: 1022462 - protein, 9 aa, Homo Sapiens
PPLSPESPE

SEQ ID NO: 1022463 - protein, 9 aa, Homo Sapiens
QSDVRYTEG

SEQ ID NO: 1022464 - protein, 9 aa, Homo Sapiens
QSPAESRAP

SEQ ID NO: 1022465 - protein, 9 aa, Homo Sapiens
GPLQAQILP

SEQ ID NO: 1022466 - protein, 9 aa, Homo Sapiens
SSVFTNSTY

SEQ ID NO: 1022467 - protein, 9 aa, Homo Sapiens
PSIPQSAPL

SEQ ID NO: 1022468 - protein, 9 aa, Homo Sapiens
VATFKGWMN

SEQ ID NO: 1022469 - protein, 9 aa, Homo Sapiens
PEVLSEPLP

SEQ ID NO: 1022470 - protein, 9 aa, Homo Sapiens
NKCKEATDL

SEQ ID NO: 1022471 - protein, 9 aa, Homo Sapiens
DYTTFDNVG

SEQ ID NO: 1022472 - protein, 9 aa, Homo Sapiens
VAPTKSSKV

SEQ ID NO: 1022473 - protein, 9 aa, Homo Sapiens
PPLTKKETV

SEQ ID NO: 1022474 - protein, 9 aa, Homo Sapiens
QEKNDVDVA

SEQ ID NO: 1022475 - protein, 9 aa, Homo Sapiens
DKVSQQGMN

SEQ ID NO: 1022476 - protein, 9 aa, Homo Sapiens
KVINGTPPA

SEQ ID NO: 1022477 - protein, 9 aa, Homo Sapiens
PIPPWLLNI

SEQ ID NO: 1022478 - protein, 9 aa, Homo Sapiens
PKNAAWHPT

SEQ ID NO: 1022479 - protein, 9 aa, Homo Sapiens
YRHAASYSY

SEQ ID NO: 1022480 - protein, 9 aa, Homo Sapiens
FSILTTHKK

SEQ ID NO: 1022481 - protein, 9 aa, Homo Sapiens
RLVPAAPSG

SEQ ID NO: 1022482 - protein, 9 aa, Homo Sapiens
AGLFSLFQA

SEQ ID NO: 1022483 - protein, 9 aa, Homo Sapiens
LERNPTGGS

SEQ ID NO: 1022484 - protein, 9 aa, Homo Sapiens
IAMSCEKTM

SEQ ID NO: 1022485 - protein, 9 aa, Homo Sapiens
ASSPQAAPQ

SEQ ID NO: 1022486 - protein, 9 aa, Homo Sapiens
KKEGELGGE

SEQ ID NO: 1022487 - protein, 9 aa, Homo Sapiens
SSYSACPLM

SEQ ID NO: 1022488 - protein, 9 aa, Homo Sapiens
LAAFVTFAC

SEQ ID NO: 1022489 - protein, 9 aa, Homo Sapiens
LTPLLGWNS

SEQ ID NO: 1022490 - protein, 9 aa, Homo Sapiens
YITGNNLVK

SEQ ID NO: 1022491 - protein, 9 aa, Homo Sapiens
LYYEEWPTL

SEQ ID NO: 1022492 - protein, 9 aa, Homo Sapiens
LNTATPGNS

SEQ ID NO: 1022493 - protein, 9 aa, Homo Sapiens
KAVAKGNLH

SEQ ID NO: 1022494 - protein, 9 aa, Homo Sapiens
CALPFMGFE

SEQ ID NO: 1022495 - protein, 9 aa, Homo Sapiens
SRCPRGSQA

SEQ ID NO: 1022496 - protein, 9 aa, Homo Sapiens
VTELCYFPA

SEQ ID NO: 1022497 - protein, 9 aa, Homo Sapiens
APTPTSTKS

SEQ ID NO: 1022498 - protein, 9 aa, Homo Sapiens
KQPPMFSLL

SEQ ID NO: 1022499 - protein, 9 aa, Homo Sapiens
IPLLIDYLL

SEQ ID NO: 1022500 - protein, 9 aa, Homo Sapiens
NELHVLIEV

SEQ ID NO: 1022501 - protein, 9 aa, Homo Sapiens
ENHRREQKV

SEQ ID NO: 1022502 - protein, 9 aa, Homo Sapiens
LSHLTEEEK

SEQ ID NO: 1022503 - protein, 9 aa, Homo Sapiens
AWPKMVTEL

SEQ ID NO: 1022504 - protein, 9 aa, Homo Sapiens
DCPNGLDEK

SEQ ID NO: 1022505 - protein, 9 aa, Homo Sapiens
TEHNFSPNV

SEQ ID NO: 1022506 - protein, 9 aa, Homo Sapiens
DRDSDIFRH

SEQ ID NO: 1022507 - protein, 9 aa, Homo Sapiens
FMTASASSP

SEQ ID NO: 1022508 - protein, 9 aa, Homo Sapiens
LSALAIEVF

SEQ ID NO: 1022509 - protein, 9 aa, Homo Sapiens
RQPAFQLDW

SEQ ID NO: 1022510 - protein, 9 aa, Homo Sapiens
QSQGRRRKE

SEQ ID NO: 1022511 - protein, 9 aa, Homo Sapiens
LADSEVELS

SEQ ID NO: 1022512 - protein, 9 aa, Homo Sapiens
WVVISPPLS

SEQ ID NO: 1022513 - protein, 9 aa, Homo Sapiens
VHESRNKPT

SEQ ID NO: 1022514 - protein, 9 aa, Homo Sapiens
LLVDSLDEA

SEQ ID NO: 1022515 - protein, 9 aa, Homo Sapiens
LRKDACSWS

SEQ ID NO: 1022516 - protein, 9 aa, Homo Sapiens
GILLEQSLE

SEQ ID NO: 1022517 - protein, 9 aa, Homo Sapiens
LEETNFLPA

SEQ ID NO: 1022518 - protein, 9 aa, Homo Sapiens
SRREAEWSR

SEQ ID NO: 1022519 - protein, 9 aa, Homo Sapiens
FSFHIGWVI

SEQ ID NO: 1022520 - protein, 9 aa, Homo Sapiens
DIRTRQLTL

SEQ ID NO: 1022521 - protein, 9 aa, Homo Sapiens
VTCKHLVTG

SEQ ID NO: 1022522 - protein, 9 aa, Homo Sapiens
LGMMTGAFI

SEQ ID NO: 1022523 - protein, 9 aa, Homo Sapiens
LSAKKYSVA

SEQ ID NO: 1022524 - protein, 9 aa, Homo Sapiens
HVEPAGGSK

SEQ ID NO: 1022525 - protein, 9 aa, Homo Sapiens
QLILDNLGV

SEQ ID NO: 1022526 - protein, 9 aa, Homo Sapiens
FYHLEVRES

SEQ ID NO: 1022527 - protein, 9 aa, Homo Sapiens
ENEIVELKS

SEQ ID NO: 1022528 - protein, 9 aa, Homo Sapiens
RNKEHQQQQ

SEQ ID NO: 1022529 - protein, 9 aa, Homo Sapiens
DWNKLYRCE

SEQ ID NO: 1022530 - protein, 9 aa, Homo Sapiens
SFFFRSGMG

SEQ ID NO: 1022531 - protein, 9 aa, Homo Sapiens
SLRNKKLKN

SEQ ID NO: 1022532 - protein, 9 aa, Homo Sapiens
YLGMMTGAF

SEQ ID NO: 1022533 - protein, 9 aa, Homo Sapiens
SITDACLLV

SEQ ID NO: 1022534 - protein, 9 aa, Homo Sapiens
LSGGGTTTP

SEQ ID NO: 1022535 - protein, 9 aa, Homo Sapiens
DGLSTFAVG

SEQ ID NO: 1022536 - protein, 9 aa, Homo Sapiens
CAGYYKGGK

SEQ ID NO: 1022537 - protein, 9 aa, Homo Sapiens
NGTKLWTGG

SEQ ID NO: 1022538 - protein, 9 aa, Homo Sapiens
LNLTDESDS

SEQ ID NO: 1022539 - protein, 9 aa, Homo Sapiens
YGCSLRLDF

SEQ ID NO: 1022540 - protein, 9 aa, Homo Sapiens
SCQGLGSRG

SEQ ID NO: 1022541 - protein, 9 aa, Homo Sapiens
LAESEDEVE

SEQ ID NO: 1022542 - protein, 9 aa, Homo Sapiens
TKRTCLGGG

SEQ ID NO: 1022543 - protein, 9 aa, Homo Sapiens
NVLPGAFSL

SEQ ID NO: 1022544 - protein, 9 aa, Homo Sapiens
FLKASDERR

SEQ ID NO: 1022545 - protein, 9 aa, Homo Sapiens
LEGTVGDSR

SEQ ID NO: 1022546 - protein, 9 aa, Homo Sapiens
EVTASAPAA

SEQ ID NO: 1022547 - protein, 9 aa, Homo Sapiens
ERGLYSSYG

SEQ ID NO: 1022548 - protein, 9 aa, Homo Sapiens
FCSLLGRAR

SEQ ID NO: 1022549 - protein, 9 aa, Homo Sapiens
PGTGLLGFH

SEQ ID NO: 1022550 - protein, 9 aa, Homo Sapiens
QIFKVIEAY

SEQ ID NO: 1022551 - protein, 9 aa, Homo Sapiens
HIEGDNLHI

SEQ ID NO: 1022552 - protein, 9 aa, Homo Sapiens
IELEEALNF

SEQ ID NO: 1022553 - protein, 9 aa, Homo Sapiens
SVLAGGFCR

SEQ ID NO: 1022554 - protein, 9 aa, Homo Sapiens
YADSQKMWI

SEQ ID NO: 1022555 - protein, 9 aa, Homo Sapiens
ENCINLPTG

SEQ ID NO: 1022556 - protein, 9 aa, Homo Sapiens
VLEDQVAQS

SEQ ID NO: 1022557 - protein, 9 aa, Homo Sapiens
LKASDERRQ

SEQ ID NO: 1022558 - protein, 9 aa, Homo Sapiens
KIEPSLPSY

SEQ ID NO: 1022559 - protein, 9 aa, Homo Sapiens
GANIVRCDN

SEQ ID NO: 1022560 - protein, 9 aa, Homo Sapiens
RQWVVISPP

SEQ ID NO: 1022561 - protein, 9 aa, Homo Sapiens
LRAMWKQHK

SEQ ID NO: 1022562 - protein, 9 aa, Homo Sapiens
SLRYTNLMN

SEQ ID NO: 1022563 - protein, 9 aa, Homo Sapiens
TFVPGLIPA

SEQ ID NO: 1022564 - protein, 9 aa, Homo Sapiens
VSPPRKGFA

SEQ ID NO: 1022565 - protein, 9 aa, Homo Sapiens
QLYHSDKFR

SEQ ID NO: 1022566 - protein, 9 aa, Homo Sapiens
AGRYFFCME

SEQ ID NO: 1022567 - protein, 9 aa, Homo Sapiens
KKEYFYKYF

SEQ ID NO: 1022568 - protein, 9 aa, Homo Sapiens
RRAFRKERE

SEQ ID NO: 1022569 - protein, 9 aa, Homo Sapiens
FSLGFGQEN

SEQ ID NO: 1022570 - protein, 9 aa, Homo Sapiens
GLFYYMKQP

SEQ ID NO: 1022571 - protein, 9 aa, Homo Sapiens
WRGRQVIGL

SEQ ID NO: 1022572 - protein, 9 aa, Homo Sapiens
RLLIELEEA

SEQ ID NO: 1022573 - protein, 9 aa, Homo Sapiens
YKVITVIES

SEQ ID NO: 1022574 - protein, 9 aa, Homo Sapiens
NRIVLKVIT

SEQ ID NO: 1022575 - protein, 9 aa, Homo Sapiens
VPFYSAICN

SEQ ID NO: 1022576 - protein, 9 aa, Homo Sapiens
PCRNRATCI

SEQ ID NO: 1022577 - protein, 9 aa, Homo Sapiens
ERRNIHKLF

SEQ ID NO: 1022578 - protein, 9 aa, Homo Sapiens
NQGDTWSFP

SEQ ID NO: 1022579 - protein, 9 aa, Homo Sapiens
LALLLQILT

SEQ ID NO: 1022580 - protein, 9 aa, Homo Sapiens
AFHFKLKLQ

SEQ ID NO: 1022581 - protein, 9 aa, Homo Sapiens
AASYMVYMT

SEQ ID NO: 1022582 - protein, 9 aa, Homo Sapiens
TDRGFPRAC

SEQ ID NO: 1022583 - protein, 9 aa, Homo Sapiens
RIYTGEKTY

SEQ ID NO: 1022584 - protein, 9 aa, Homo Sapiens
ITRVYKSLV

SEQ ID NO: 1022585 - protein, 9 aa, Homo Sapiens
LELADTLEL

SEQ ID NO: 1022586 - protein, 9 aa, Homo Sapiens
SPAHTRAHV

SEQ ID NO: 1022587 - protein, 9 aa, Homo Sapiens
AVLTSRLLR

SEQ ID NO: 1022588 - protein, 9 aa, Homo Sapiens
SLPPRLLRY

SEQ ID NO: 1022589 - protein, 9 aa, Homo Sapiens
LGNQQPSWN

SEQ ID NO: 1022590 - protein, 9 aa, Homo Sapiens
EENEGEEEK

SEQ ID NO: 1022591 - protein, 9 aa, Homo Sapiens
LLERVSQAF

SEQ ID NO: 1022592 - protein, 9 aa, Homo Sapiens
KTFFSKVYP

SEQ ID NO: 1022593 - protein, 9 aa, Homo Sapiens
QIQNGSLST

SEQ ID NO: 1022594 - protein, 9 aa, Homo Sapiens
KGPFYGEDV

SEQ ID NO: 1022595 - protein, 9 aa, Homo Sapiens
DIFFVNHLK

SEQ ID NO: 1022596 - protein, 9 aa, Homo Sapiens
KKKMTNSCL

SEQ ID NO: 1022597 - protein, 9 aa, Homo Sapiens
GEEKGPRIK

SEQ ID NO: 1022598 - protein, 9 aa, Homo Sapiens
SASWDLPST

SEQ ID NO: 1022599 - protein, 9 aa, Homo Sapiens
PPAYGSWQV

SEQ ID NO: 1022600 - protein, 9 aa, Homo Sapiens
TRMLMIVLL

SEQ ID NO: 1022601 - protein, 9 aa, Homo Sapiens
VTVQESLCV

SEQ ID NO: 1022602 - protein, 9 aa, Homo Sapiens
VTKFELSGA

SEQ ID NO: 1022603 - protein, 9 aa, Homo Sapiens
DVCLNQGPL

SEQ ID NO: 1022604 - protein, 9 aa, Homo Sapiens
SQDNVHTAA

SEQ ID NO: 1022605 - protein, 9 aa, Homo Sapiens
MVKHIESKT

SEQ ID NO: 1022606 - protein, 9 aa, Homo Sapiens
YKFPDIIII

SEQ ID NO: 1022607 - protein, 9 aa, Homo Sapiens
ISPSNRNPA

SEQ ID NO: 1022608 - protein, 9 aa, Homo Sapiens
GDEGKEGRL

SEQ ID NO: 1022609 - protein, 9 aa, Homo Sapiens
YGLYTDPCG

SEQ ID NO: 1022610 - protein, 9 aa, Homo Sapiens
QASPEGCPE

SEQ ID NO: 1022611 - protein, 9 aa, Homo Sapiens
YSKCLSDEF

SEQ ID NO: 1022612 - protein, 9 aa, Homo Sapiens
WNKLYRCEI

SEQ ID NO: 1022613 - protein, 9 aa, Homo Sapiens
NVLESQRKS

SEQ ID NO: 1022614 - protein, 9 aa, Homo Sapiens
DCPPEATET

SEQ ID NO: 1022615 - protein, 9 aa, Homo Sapiens
YKEGMSSSE

SEQ ID NO: 1022616 - protein, 9 aa, Homo Sapiens
HEKVVERSE

SEQ ID NO: 1022617 - protein, 9 aa, Homo Sapiens
LGRKDVGRP

SEQ ID NO: 1022618 - protein, 9 aa, Homo Sapiens
REQEKNDVD

SEQ ID NO: 1022619 - protein, 9 aa, Homo Sapiens
QNESKTKRN

SEQ ID NO: 1022620 - protein, 9 aa, Homo Sapiens
TEPKVVRTT

SEQ ID NO: 1022621 - protein, 9 aa, Homo Sapiens
ANKHGRAVC

SEQ ID NO: 1022622 - protein, 9 aa, Homo Sapiens
GAFVHKENS

SEQ ID NO: 1022623 - protein, 9 aa, Homo Sapiens
PVYVRDPTS

SEQ ID NO: 1022624 - protein, 9 aa, Homo Sapiens
ESMPTKETG

SEQ ID NO: 1022625 - protein, 9 aa, Homo Sapiens
IEKQLAAIY

SEQ ID NO: 1022626 - protein, 9 aa, Homo Sapiens
KPEPLVAGP

SEQ ID NO: 1022627 - protein, 9 aa, Homo Sapiens
ITILDNNDN

SEQ ID NO: 1022628 - protein, 9 aa, Homo Sapiens
EKSENINLN

SEQ ID NO: 1022629 - protein, 9 aa, Homo Sapiens
YKQPSSGEI

SEQ ID NO: 1022630 - protein, 9 aa, Homo Sapiens
DMNNLLSHY

SEQ ID NO: 1022631 - protein, 9 aa, Homo Sapiens
TVFAMQLPF

SEQ ID NO: 1022632 - protein, 9 aa, Homo Sapiens
QEEDSLTVP

SEQ ID NO: 1022633 - protein, 9 aa, Homo Sapiens
SQAYQGPAT

SEQ ID NO: 1022634 - protein, 9 aa, Homo Sapiens
IPINNISVP

SEQ ID NO: 1022635 - protein, 9 aa, Homo Sapiens
EREIKKSIR

SEQ ID NO: 1022636 - protein, 9 aa, Homo Sapiens
SDERRQEMA

SEQ ID NO: 1022637 - protein, 9 aa, Homo Sapiens
RKVESLFQE

SEQ ID NO: 1022638 - protein, 9 aa, Homo Sapiens
KAQKGNLGK

SEQ ID NO: 1022639 - protein, 9 aa, Homo Sapiens
PIEYLAYWL

SEQ ID NO: 1022640 - protein, 9 aa, Homo Sapiens
MNIIYAAVD

SEQ ID NO: 1022641 - protein, 9 aa, Homo Sapiens
CDKAFHFKL

SEQ ID NO: 1022642 - protein, 9 aa, Homo Sapiens
DKDPVIMRE

SEQ ID NO: 1022643 - protein, 9 aa, Homo Sapiens
RIQSSEGRQ

SEQ ID NO: 1022644 - protein, 9 aa, Homo Sapiens
RQPPFTNYR

SEQ ID NO: 1022645 - protein, 9 aa, Homo Sapiens
HNDATLYTE

SEQ ID NO: 1022646 - protein, 9 aa, Homo Sapiens
GISCINFGA

SEQ ID NO: 1022647 - protein, 9 aa, Homo Sapiens
VGSSDNLSP

SEQ ID NO: 1022648 - protein, 9 aa, Homo Sapiens
PQMLVVLWE

SEQ ID NO: 1022649 - protein, 9 aa, Homo Sapiens
HLDTAKITC

SEQ ID NO: 1022650 - protein, 9 aa, Homo Sapiens
GDTWSFPRE

SEQ ID NO: 1022651 - protein, 9 aa, Homo Sapiens
PERRKFDSG

SEQ ID NO: 1022652 - protein, 9 aa, Homo Sapiens
FKIKNNWYF

SEQ ID NO: 1022653 - protein, 9 aa, Homo Sapiens
WLWVQAALD

SEQ ID NO: 1022654 - protein, 9 aa, Homo Sapiens
ITCPPINVK

SEQ ID NO: 1022655 - protein, 9 aa, Homo Sapiens
PKAAHQKKI

SEQ ID NO: 1022656 - protein, 9 aa, Homo Sapiens
CCDAGRQVR

SEQ ID NO: 1022657 - protein, 9 aa, Homo Sapiens
QYFLQRIQE

SEQ ID NO: 1022658 - protein, 9 aa, Homo Sapiens
IQHGGPPLS

SEQ ID NO: 1022659 - protein, 9 aa, Homo Sapiens
KDQEAFFRH

SEQ ID NO: 1022660 - protein, 9 aa, Homo Sapiens
KNWWKDGCF

SEQ ID NO: 1022661 - protein, 9 aa, Homo Sapiens
CQKSNHMEK

SEQ ID NO: 1022662 - protein, 9 aa, Homo Sapiens
RSENTAEAL

SEQ ID NO: 1022663 - protein, 9 aa, Homo Sapiens
DTIQKEGHM

SEQ ID NO: 1022664 - protein, 9 aa, Homo Sapiens
EAIAIVIGL

SEQ ID NO: 1022665 - protein, 9 aa, Homo Sapiens
RYTEGYEQQ

SEQ ID NO: 1022666 - protein, 9 aa, Homo Sapiens
RKLATPDWA

SEQ ID NO: 1022667 - protein, 9 aa, Homo Sapiens
DILDTAGKE

SEQ ID NO: 1022668 - protein, 9 aa, Homo Sapiens
PTSVSFLKT

SEQ ID NO: 1022669 - protein, 9 aa, Homo Sapiens
VTCDAHHRG

SEQ ID NO: 1022670 - protein, 9 aa, Homo Sapiens
VLFRLPEFV

SEQ ID NO: 1022671 - protein, 9 aa, Homo Sapiens
PKDDSNPAI

SEQ ID NO: 1022672 - protein, 9 aa, Homo Sapiens
VEDISGLSS

SEQ ID NO: 1022673 - protein, 9 aa, Homo Sapiens
SEKITFLFV

SEQ ID NO: 1022674 - protein, 9 aa, Homo Sapiens
EEFPGPKGE

SEQ ID NO: 1022675 - protein, 9 aa, Homo Sapiens
DGCFQSEWV

SEQ ID NO: 1022676 - protein, 9 aa, Homo Sapiens
PRMTCPKGA

SEQ ID NO: 1022677 - protein, 9 aa, Homo Sapiens
SAVPFTALP

SEQ ID NO: 1022678 - protein, 9 aa, Homo Sapiens
PRACYRART

SEQ ID NO: 1022679 - protein, 9 aa, Homo Sapiens
NSKSTRSLV

SEQ ID NO: 1022680 - protein, 9 aa, Homo Sapiens
DSGCYISSE

SEQ ID NO: 1022681 - protein, 9 aa, Homo Sapiens
EMPTTSHRL

SEQ ID NO: 1022682 - protein, 9 aa, Homo Sapiens
PLLSRTSQS

SEQ ID NO: 1022683 - protein, 9 aa, Homo Sapiens
GAYKLPDGH

SEQ ID NO: 1022684 - protein, 9 aa, Homo Sapiens
STTRVTSFE

SEQ ID NO: 1022685 - protein, 9 aa, Homo Sapiens
QQNTRPLVY

SEQ ID NO: 1022686 - protein, 9 aa, Homo Sapiens
SGHPKPHFR

SEQ ID NO: 1022687 - protein, 9 aa, Homo Sapiens
KDQTVFFFK

SEQ ID NO: 1022688 - protein, 9 aa, Homo Sapiens
QELETGRGG

SEQ ID NO: 1022689 - protein, 9 aa, Homo Sapiens
NNGAGHCPN

SEQ ID NO: 1022690 - protein, 9 aa, Homo Sapiens
LLDTKDELS

SEQ ID NO: 1022691 - protein, 9 aa, Homo Sapiens
KLGEVWQRR

SEQ ID NO: 1022692 - protein, 9 aa, Homo Sapiens
VNLPVYVGG

SEQ ID NO: 1022693 - protein, 9 aa, Homo Sapiens
APESLPPLP

SEQ ID NO: 1022694 - protein, 9 aa, Homo Sapiens
GLVRESHLS

SEQ ID NO: 1022695 - protein, 9 aa, Homo Sapiens
SSTTLWALL

SEQ ID NO: 1022696 - protein, 9 aa, Homo Sapiens
ISEIIHMTE

SEQ ID NO: 1022697 - protein, 9 aa, Homo Sapiens
LKGAGSSCL

SEQ ID NO: 1022698 - protein, 9 aa, Homo Sapiens
SLLVSSSSA

SEQ ID NO: 1022699 - protein, 9 aa, Homo Sapiens
PAWATLGNP

SEQ ID NO: 1022700 - protein, 9 aa, Homo Sapiens
QSASAAETS

SEQ ID NO: 1022701 - protein, 9 aa, Homo Sapiens
FDSGVMLPT

SEQ ID NO: 1022702 - protein, 9 aa, Homo Sapiens
KLLKWLEDV

SEQ ID NO: 1022703 - protein, 9 aa, Homo Sapiens
LTTRVYVKM

SEQ ID NO: 1022704 - protein, 9 aa, Homo Sapiens
LRDYMISAK

SEQ ID NO: 1022705 - protein, 9 aa, Homo Sapiens
LELLNDSEH

SEQ ID NO: 1022706 - protein, 9 aa, Homo Sapiens
KLKLQIHRR

SEQ ID NO: 1022707 - protein, 9 aa, Homo Sapiens
TFDNVGSLW

SEQ ID NO: 1022708 - protein, 9 aa, Homo Sapiens
DMGFTCLMQ

SEQ ID NO: 1022709 - protein, 9 aa, Homo Sapiens
AQRDKRMED

SEQ ID NO: 1022710 - protein, 9 aa, Homo Sapiens
AKGCTAPAP

SEQ ID NO: 1022711 - protein, 9 aa, Homo Sapiens
QTPKKGEVQ

SEQ ID NO: 1022712 - protein, 9 aa, Homo Sapiens
CCREDVHNT

SEQ ID NO: 1022713 - protein, 9 aa, Homo Sapiens
EYKNELAKV

SEQ ID NO: 1022714 - protein, 9 aa, Homo Sapiens
LETFYATKS

SEQ ID NO: 1022715 - protein, 9 aa, Homo Sapiens
NFDNFKTQC

SEQ ID NO: 1022716 - protein, 9 aa, Homo Sapiens
DQNLQEAAA

SEQ ID NO: 1022717 - protein, 9 aa, Homo Sapiens
TAKITCVDV

SEQ ID NO: 1022718 - protein, 9 aa, Homo Sapiens
ALTVVLKGA

SEQ ID NO: 1022719 - protein, 9 aa, Homo Sapiens
RKVLVWPTE

SEQ ID NO: 1022720 - protein, 9 aa, Homo Sapiens
IFQQVLQPP

SEQ ID NO: 1022721 - protein, 9 aa, Homo Sapiens
IEIYARDVL

SEQ ID NO: 1022722 - protein, 9 aa, Homo Sapiens
SEVQRKGGV

SEQ ID NO: 1022723 - protein, 9 aa, Homo Sapiens
RRSNFDNFS

SEQ ID NO: 1022724 - protein, 9 aa, Homo Sapiens
LDILDTAGK

SEQ ID NO: 1022725 - protein, 9 aa, Homo Sapiens
TKSSANPEK

SEQ ID NO: 1022726 - protein, 9 aa, Homo Sapiens
WPSLPDYKK

SEQ ID NO: 1022727 - protein, 9 aa, Homo Sapiens
ERSENTAEA

SEQ ID NO: 1022728 - protein, 9 aa, Homo Sapiens
ERVSQAFSY

SEQ ID NO: 1022729 - protein, 9 aa, Homo Sapiens
WKEYLEKFL

SEQ ID NO: 1022730 - protein, 9 aa, Homo Sapiens
ERVNETVGR

SEQ ID NO: 1022731 - protein, 9 aa, Homo Sapiens
SEIIHMTEG

SEQ ID NO: 1022732 - protein, 9 aa, Homo Sapiens
HNGIHGKEE

SEQ ID NO: 1022733 - protein, 9 aa, Homo Sapiens
EKCNAAVEK

SEQ ID NO: 1022734 - protein, 9 aa, Homo Sapiens
VAQLYFFYF

SEQ ID NO: 1022735 - protein, 9 aa, Homo Sapiens
RSWLRLRPQ

SEQ ID NO: 1022736 - protein, 9 aa, Homo Sapiens
HPKPHFRSS

SEQ ID NO: 1022737 - protein, 9 aa, Homo Sapiens
KSKFCHQGL

SEQ ID NO: 1022738 - protein, 9 aa, Homo Sapiens
DYEIQKQIN

SEQ ID NO: 1022739 - protein, 9 aa, Homo Sapiens
INFFSTKTD

SEQ ID NO: 1022740 - protein, 9 aa, Homo Sapiens
ETKNIRLTQ

SEQ ID NO: 1022741 - protein, 9 aa, Homo Sapiens
QKLEEAGTE

SEQ ID NO: 1022742 - protein, 9 aa, Homo Sapiens
QAQTCDSSS

SEQ ID NO: 1022743 - protein, 9 aa, Homo Sapiens
KIWIEIIAL

SEQ ID NO: 1022744 - protein, 9 aa, Homo Sapiens
YRVWKYLFN

SEQ ID NO: 1022745 - protein, 9 aa, Homo Sapiens
MLAPYIFMD

SEQ ID NO: 1022746 - protein, 9 aa, Homo Sapiens
NICVPSVTA

SEQ ID NO: 1022747 - protein, 9 aa, Homo Sapiens
IQQLENGEW

SEQ ID NO: 1022748 - protein, 9 aa, Homo Sapiens
EKITFLFVK

SEQ ID NO: 1022749 - protein, 9 aa, Homo Sapiens
DQNKCKEAT

SEQ ID NO: 1022750 - protein, 9 aa, Homo Sapiens
TASSTRRQE

SEQ ID NO: 1022751 - protein, 9 aa, Homo Sapiens
WLTLEDYKE

SEQ ID NO: 1022752 - protein, 9 aa, Homo Sapiens
FYKVMVSND

SEQ ID NO: 1022753 - protein, 9 aa, Homo Sapiens
TEEEIKKIC

SEQ ID NO: 1022754 - protein, 9 aa, Homo Sapiens
RDPTSTIKP

SEQ ID NO: 1022755 - protein, 9 aa, Homo Sapiens
APAQKPLQP

SEQ ID NO: 1022756 - protein, 9 aa, Homo Sapiens
SIVLGNTYR

SEQ ID NO: 1022757 - protein, 9 aa, Homo Sapiens
QKIYNGERP

SEQ ID NO: 1022758 - protein, 9 aa, Homo Sapiens
GAPGIAVAR

SEQ ID NO: 1022759 - protein, 9 aa, Homo Sapiens
EDDARSYWC

SEQ ID NO: 1022760 - protein, 9 aa, Homo Sapiens
FYLQLRGAE

SEQ ID NO: 1022761 - protein, 9 aa, Homo Sapiens
VGCCSFIGK

SEQ ID NO: 1022762 - protein, 9 aa, Homo Sapiens
FDRDSDIFR

SEQ ID NO: 1022763 - protein, 9 aa, Homo Sapiens
YPMPFITII

SEQ ID NO: 1022764 - protein, 9 aa, Homo Sapiens
PSGCLRNFL

SEQ ID NO: 1022765 - protein, 9 aa, Homo Sapiens
ALRPKPLFY

SEQ ID NO: 1022766 - protein, 9 aa, Homo Sapiens
QEDIPDLLH

SEQ ID NO: 1022767 - protein, 9 aa, Homo Sapiens
KNYEKSKKH

SEQ ID NO: 1022768 - protein, 9 aa, Homo Sapiens
TRFIALYDY

SEQ ID NO: 1022769 - protein, 9 aa, Homo Sapiens
KCRRFVHLQ

SEQ ID NO: 1022770 - protein, 9 aa, Homo Sapiens
EKAEDDVEK

SEQ ID NO: 1022771 - protein, 9 aa, Homo Sapiens
NKKEKSAPS

SEQ ID NO: 1022772 - protein, 9 aa, Homo Sapiens
LNLKDNRNH

SEQ ID NO: 1022773 - protein, 9 aa, Homo Sapiens
TGENSYGCK

SEQ ID NO: 1022774 - protein, 9 aa, Homo Sapiens
SKSLQEANA

SEQ ID NO: 1022775 - protein, 9 aa, Homo Sapiens
LNLHISTLS

SEQ ID NO: 1022776 - protein, 9 aa, Homo Sapiens
NGLDEKNCV

SEQ ID NO: 1022777 - protein, 9 aa, Homo Sapiens
ILFRVCSGE

SEQ ID NO: 1022778 - protein, 9 aa, Homo Sapiens
SKDGITRVY

SEQ ID NO: 1022779 - protein, 9 aa, Homo Sapiens
SDSLRLSWT

SEQ ID NO: 1022780 - protein, 9 aa, Homo Sapiens
CRHQPFTIL

SEQ ID NO: 1022781 - protein, 9 aa, Homo Sapiens
KQPTVKLHE

SEQ ID NO: 1022782 - protein, 9 aa, Homo Sapiens
GPEAGEEVF

SEQ ID NO: 1022783 - protein, 9 aa, Homo Sapiens
IFCSKYHGY

SEQ ID NO: 1022784 - protein, 9 aa, Homo Sapiens
HICGAFLIS

SEQ ID NO: 1022785 - protein, 9 aa, Homo Sapiens
LRERITVTG

SEQ ID NO: 1022786 - protein, 9 aa, Homo Sapiens
RLHERENEI

SEQ ID NO: 1022787 - protein, 9 aa, Homo Sapiens
LQLRGAECC

SEQ ID NO: 1022788 - protein, 9 aa, Homo Sapiens
QGLVRESHL

SEQ ID NO: 1022789 - protein, 9 aa, Homo Sapiens
FCHQGLAYH

SEQ ID NO: 1022790 - protein, 9 aa, Homo Sapiens
GTESIFEND

SEQ ID NO: 1022791 - protein, 9 aa, Homo Sapiens
LFLFRRRWQ

SEQ ID NO: 1022792 - protein, 9 aa, Homo Sapiens
ARVPSNDLL

SEQ ID NO: 1022793 - protein, 9 aa, Homo Sapiens
MSKQSSFYS

SEQ ID NO: 1022794 - protein, 9 aa, Homo Sapiens
INSKGLAGL

SEQ ID NO: 1022795 - protein, 9 aa, Homo Sapiens
PKPLFYAVD

SEQ ID NO: 1022796 - protein, 9 aa, Homo Sapiens
SKTFFYFYN

SEQ ID NO: 1022797 - protein, 9 aa, Homo Sapiens
HMPYTDVVV

SEQ ID NO: 1022798 - protein, 9 aa, Homo Sapiens
APTHPPEHP

SEQ ID NO: 1022799 - protein, 9 aa, Homo Sapiens
IFMDDDFQL

SEQ ID NO: 1022800 - protein, 9 aa, Homo Sapiens
KWWCEIEPC

SEQ ID NO: 1022801 - protein, 9 aa, Homo Sapiens
DNRNHLVPS

SEQ ID NO: 1022802 - protein, 9 aa, Homo Sapiens
MQEAWKKPA

SEQ ID NO: 1022803 - protein, 9 aa, Homo Sapiens
EVQRKRDML

SEQ ID NO: 1022804 - protein, 9 aa, Homo Sapiens
SIPDVICLK

SEQ ID NO: 1022805 - protein, 9 aa, Homo Sapiens
FSAEYLILS

SEQ ID NO: 1022806 - protein, 9 aa, Homo Sapiens
LASVAQQRN

SEQ ID NO: 1022807 - protein, 9 aa, Homo Sapiens
KKSSPFINS

SEQ ID NO: 1022808 - protein, 9 aa, Homo Sapiens
AQNINPFSS

SEQ ID NO: 1022809 - protein, 9 aa, Homo Sapiens
DGETAVCNN

SEQ ID NO: 1022810 - protein, 9 aa, Homo Sapiens
VPSNDLLFS

SEQ ID NO: 1022811 - protein, 9 aa, Homo Sapiens
RFEKLGRKD

SEQ ID NO: 1022812 - protein, 9 aa, Homo Sapiens
KKPTEEEIK

SEQ ID NO: 1022813 - protein, 9 aa, Homo Sapiens
PSPPPNNPD

SEQ ID NO: 1022814 - protein, 9 aa, Homo Sapiens
CSVRAIRID

SEQ ID NO: 1022815 - protein, 9 aa, Homo Sapiens
LCSTSCGGD

SEQ ID NO: 1022816 - protein, 9 aa, Homo Sapiens
TADDDSGGP

SEQ ID NO: 1022817 - protein, 9 aa, Homo Sapiens
AEDWAFSEG

SEQ ID NO: 1022818 - protein, 9 aa, Homo Sapiens
DSSFNLHET

SEQ ID NO: 1022819 - protein, 9 aa, Homo Sapiens
TLVTITNNF

SEQ ID NO: 1022820 - protein, 9 aa, Homo Sapiens
KSHKSSEES

SEQ ID NO: 1022821 - protein, 9 aa, Homo Sapiens
QTSPAHPNV

SEQ ID NO: 1022822 - protein, 9 aa, Homo Sapiens
LGLQIPIKN

SEQ ID NO: 1022823 - protein, 9 aa, Homo Sapiens
LSGAIPPNR

SEQ ID NO: 1022824 - protein, 9 aa, Homo Sapiens
SKPLSDRPI

SEQ ID NO: 1022825 - protein, 9 aa, Homo Sapiens
SSDHYAIES

SEQ ID NO: 1022826 - protein, 9 aa, Homo Sapiens
RSSYLFEVY

SEQ ID NO: 1022827 - protein, 9 aa, Homo Sapiens
AVGTLCHLI

SEQ ID NO: 1022828 - protein, 9 aa, Homo Sapiens
LVDNSDTSS

SEQ ID NO: 1022829 - protein, 9 aa, Homo Sapiens
KTLTEIRSI

SEQ ID NO: 1022830 - protein, 9 aa, Homo Sapiens
DVHNTHAPT

SEQ ID NO: 1022831 - protein, 9 aa, Homo Sapiens
DETGVDFKN

SEQ ID NO: 1022832 - protein, 9 aa, Homo Sapiens
MSVQSLNGN

SEQ ID NO: 1022833 - protein, 9 aa, Homo Sapiens
FRRRWQRSQ

SEQ ID NO: 1022834 - protein, 9 aa, Homo Sapiens
MSCEKTMLV

SEQ ID NO: 1022835 - protein, 9 aa, Homo Sapiens
KSIYPLALR

SEQ ID NO: 1022836 - protein, 9 aa, Homo Sapiens
EVLAGLQRH

SEQ ID NO: 1022837 - protein, 9 aa, Homo Sapiens
QPITPNGQD

SEQ ID NO: 1022838 - protein, 9 aa, Homo Sapiens
KHYNLSAAT

SEQ ID NO: 1022839 - protein, 9 aa, Homo Sapiens
NEGSAKSIY

SEQ ID NO: 1022840 - protein, 9 aa, Homo Sapiens
DFRNPLRKF

SEQ ID NO: 1022841 - protein, 9 aa, Homo Sapiens
IVVRLNLQL

SEQ ID NO: 1022842 - protein, 9 aa, Homo Sapiens
DLSQTFEDQ

SEQ ID NO: 1022843 - protein, 9 aa, Homo Sapiens
REDVHNTHA

SEQ ID NO: 1022844 - protein, 9 aa, Homo Sapiens
RLHLAKDRE

SEQ ID NO: 1022845 - protein, 9 aa, Homo Sapiens
AVSLLSSVA

SEQ ID NO: 1022846 - protein, 9 aa, Homo Sapiens
KPSRPTKEI

SEQ ID NO: 1022847 - protein, 9 aa, Homo Sapiens
EVELSVIGH

SEQ ID NO: 1022848 - protein, 9 aa, Homo Sapiens
FDDLQVVFG

SEQ ID NO: 1022849 - protein, 9 aa, Homo Sapiens
AGSSQAESY

SEQ ID NO: 1022850 - protein, 9 aa, Homo Sapiens
SVSFLKTIF

SEQ ID NO: 1022851 - protein, 9 aa, Homo Sapiens
DCPSKDKDL

SEQ ID NO: 1022852 - protein, 9 aa, Homo Sapiens
NRKVEEEMK

SEQ ID NO: 1022853 - protein, 9 aa, Homo Sapiens
TEKLYKEDD

SEQ ID NO: 1022854 - protein, 9 aa, Homo Sapiens
AVRMLSPFR

SEQ ID NO: 1022855 - protein, 9 aa, Homo Sapiens
DNFSQALIS

SEQ ID NO: 1022856 - protein, 9 aa, Homo Sapiens
IWNKKPRWF

SEQ ID NO: 1022857 - protein, 9 aa, Homo Sapiens
LRNSHMVFA

SEQ ID NO: 1022858 - protein, 9 aa, Homo Sapiens
LHLEAKIRQ

SEQ ID NO: 1022859 - protein, 9 aa, Homo Sapiens
EESSCTRNC

SEQ ID NO: 1022860 - protein, 9 aa, Homo Sapiens
FMDDDFQLN

SEQ ID NO: 1022861 - protein, 9 aa, Homo Sapiens
LWAASTVLF

SEQ ID NO: 1022862 - protein, 9 aa, Homo Sapiens
ERGKAGPPG

SEQ ID NO: 1022863 - protein, 9 aa, Homo Sapiens
CEIEPCLEG

SEQ ID NO: 1022864 - protein, 9 aa, Homo Sapiens
GAILQWKYP

SEQ ID NO: 1022865 - protein, 9 aa, Homo Sapiens
FSSGSCRKV

SEQ ID NO: 1022866 - protein, 9 aa, Homo Sapiens
DIPGHVFTK

SEQ ID NO: 1022867 - protein, 9 aa, Homo Sapiens
ARPKLYDPP

SEQ ID NO: 1022868 - protein, 9 aa, Homo Sapiens
KLYQDSTVL

SEQ ID NO: 1022869 - protein, 9 aa, Homo Sapiens
NLFLAKYRD

SEQ ID NO: 1022870 - protein, 9 aa, Homo Sapiens
DFHTGPKLL

SEQ ID NO: 1022871 - protein, 9 aa, Homo Sapiens
LSPGASDVK

SEQ ID NO: 1022872 - protein, 9 aa, Homo Sapiens
GEEFPGPKG

SEQ ID NO: 1022873 - protein, 9 aa, Homo Sapiens
VPSLLSVPP

SEQ ID NO: 1022874 - protein, 9 aa, Homo Sapiens
FITYRFGSA

SEQ ID NO: 1022875 - protein, 9 aa, Homo Sapiens
NPFSSQNSQ

SEQ ID NO: 1022876 - protein, 9 aa, Homo Sapiens
DISEKPKKP

SEQ ID NO: 1022877 - protein, 9 aa, Homo Sapiens
LSTRANCSN

SEQ ID NO: 1022878 - protein, 9 aa, Homo Sapiens
RRSLSALAI

SEQ ID NO: 1022879 - protein, 9 aa, Homo Sapiens
KCGKTFRHP

SEQ ID NO: 1022880 - protein, 9 aa, Homo Sapiens
GFPLSINAK

SEQ ID NO: 1022881 - protein, 9 aa, Homo Sapiens
KNARVAVAG

SEQ ID NO: 1022882 - protein, 9 aa, Homo Sapiens
LLLHLEAKI

SEQ ID NO: 1022883 - protein, 9 aa, Homo Sapiens
PKPHFRSSS

SEQ ID NO: 1022884 - protein, 9 aa, Homo Sapiens
TKSKLYQDS

SEQ ID NO: 1022885 - protein, 9 aa, Homo Sapiens
SAEPGAAHK

SEQ ID NO: 1022886 - protein, 9 aa, Homo Sapiens
NDFMGAMFF

SEQ ID NO: 1022887 - protein, 9 aa, Homo Sapiens
DFRLHTPMY

SEQ ID NO: 1022888 - protein, 9 aa, Homo Sapiens
FWFQMCDIK

SEQ ID NO: 1022889 - protein, 9 aa, Homo Sapiens
EAPELDKDE

SEQ ID NO: 1022890 - protein, 9 aa, Homo Sapiens
ALSWRPSQG

SEQ ID NO: 1022891 - protein, 9 aa, Homo Sapiens
DSANVEIEW

SEQ ID NO: 1022892 - protein, 9 aa, Homo Sapiens
EIYMTWIKN

SEQ ID NO: 1022893 - protein, 9 aa, Homo Sapiens
YIPKPPGKP

SEQ ID NO: 1022894 - protein, 9 aa, Homo Sapiens
TVLAAHPQL

SEQ ID NO: 1022895 - protein, 9 aa, Homo Sapiens
GVPFYSAIC

SEQ ID NO: 1022896 - protein, 9 aa, Homo Sapiens
THKQRKLAN

SEQ ID NO: 1022897 - protein, 9 aa, Homo Sapiens
KTYPAFLEL

SEQ ID NO: 1022898 - protein, 9 aa, Homo Sapiens
RRNSGSLLV

SEQ ID NO: 1022899 - protein, 9 aa, Homo Sapiens
IYSEDNIQH

SEQ ID NO: 1022900 - protein, 9 aa, Homo Sapiens
FSSQNSQNF

SEQ ID NO: 1022901 - protein, 9 aa, Homo Sapiens
SRKIAHFCC

SEQ ID NO: 1022902 - protein, 9 aa, Homo Sapiens
SLGSLMKSC

SEQ ID NO: 1022903 - protein, 9 aa, Homo Sapiens
LPHKFAFLK

SEQ ID NO: 1022904 - protein, 9 aa, Homo Sapiens
PKEYSQIFQ

SEQ ID NO: 1022905 - protein, 9 aa, Homo Sapiens
DETLCFVLL

SEQ ID NO: 1022906 - protein, 9 aa, Homo Sapiens
VVLWEHGTT

SEQ ID NO: 1022907 - protein, 9 aa, Homo Sapiens
QPAALATSE

SEQ ID NO: 1022908 - protein, 9 aa, Homo Sapiens
ADYAFPPPR

SEQ ID NO: 1022909 - protein, 9 aa, Homo Sapiens
CFMLILLFY

SEQ ID NO: 1022910 - protein, 9 aa, Homo Sapiens
ANLELLNDS

SEQ ID NO: 1022911 - protein, 9 aa, Homo Sapiens
GKAGPPGRG

SEQ ID NO: 1022912 - protein, 9 aa, Homo Sapiens
PTSDSLRLS

SEQ ID NO: 1022913 - protein, 9 aa, Homo Sapiens
LQTFRVLRA

SEQ ID NO: 1022914 - protein, 9 aa, Homo Sapiens
TQEKEETAV

SEQ ID NO: 1022915 - protein, 9 aa, Homo Sapiens
RYTDDGARP

SEQ ID NO: 1022916 - protein, 9 aa, Homo Sapiens
MWNESSLSD

SEQ ID NO: 1022917 - protein, 9 aa, Homo Sapiens
SASFSTEES

SEQ ID NO: 1022918 - protein, 9 aa, Homo Sapiens
FVFFGRVYL

SEQ ID NO: 1022919 - protein, 9 aa, Homo Sapiens
NEAFVALRK

SEQ ID NO: 1022920 - protein, 9 aa, Homo Sapiens
LLNAFQEFF

SEQ ID NO: 1022921 - protein, 9 aa, Homo Sapiens
FPLEWFLLN

SEQ ID NO: 1022922 - protein, 9 aa, Homo Sapiens
CKEATDLLH

SEQ ID NO: 1022923 - protein, 9 aa, Homo Sapiens
ASNVDYKHI

SEQ ID NO: 1022924 - protein, 9 aa, Homo Sapiens
PSWNSEDSS

SEQ ID NO: 1022925 - protein, 9 aa, Homo Sapiens
PPNKPGAFL

SEQ ID NO: 1022926 - protein, 9 aa, Homo Sapiens
GNRKVEEEM

SEQ ID NO: 1022927 - protein, 9 aa, Homo Sapiens
AAAFFRRSE

SEQ ID NO: 1022928 - protein, 9 aa, Homo Sapiens
QNLKLCFLE

SEQ ID NO: 1022929 - protein, 9 aa, Homo Sapiens
PTSPRGQLV

SEQ ID NO: 1022930 - protein, 9 aa, Homo Sapiens
TARLVRAGK

SEQ ID NO: 1022931 - protein, 9 aa, Homo Sapiens
RFVFSEPTA

SEQ ID NO: 1022932 - protein, 9 aa, Homo Sapiens
GETAVCNNG

SEQ ID NO: 1022933 - protein, 9 aa, Homo Sapiens
ANVEIEWVK

SEQ ID NO: 1022934 - protein, 9 aa, Homo Sapiens
DLVLSDDVV

SEQ ID NO: 1022935 - protein, 9 aa, Homo Sapiens
YPELKEGVE

SEQ ID NO: 1022936 - protein, 9 aa, Homo Sapiens
RGEEGLSNY

SEQ ID NO: 1022937 - protein, 9 aa, Homo Sapiens
FNITKSLVY

SEQ ID NO: 1022938 - protein, 9 aa, Homo Sapiens
DDGTSAWGN

SEQ ID NO: 1022939 - protein, 9 aa, Homo Sapiens
LQEAQEVLA

SEQ ID NO: 1022940 - protein, 9 aa, Homo Sapiens
KKRSPLTTR

SEQ ID NO: 1022941 - protein, 9 aa, Homo Sapiens
LNLENIETK

SEQ ID NO: 1022942 - protein, 9 aa, Homo Sapiens
GENSYGCKE

SEQ ID NO: 1022943 - protein, 9 aa, Homo Sapiens
VKKFMHSSS

SEQ ID NO: 1022944 - protein, 9 aa, Homo Sapiens
SSPVFMTAS

SEQ ID NO: 1022945 - protein, 9 aa, Homo Sapiens
QVAYLEKLQ

SEQ ID NO: 1022946 - protein, 9 aa, Homo Sapiens
SWTSVFNDS

SEQ ID NO: 1022947 - protein, 9 aa, Homo Sapiens
FLELARKIK

SEQ ID NO: 1022948 - protein, 9 aa, Homo Sapiens
AGSDSSGKE

SEQ ID NO: 1022949 - protein, 9 aa, Homo Sapiens
GMVKKEFIK

SEQ ID NO: 1022950 - protein, 9 aa, Homo Sapiens
RPAWATLGN

SEQ ID NO: 1022951 - protein, 9 aa, Homo Sapiens
MPHVPFKLM

SEQ ID NO: 1022952 - protein, 9 aa, Homo Sapiens
VSNEYVTKG

SEQ ID NO: 1022953 - protein, 9 aa, Homo Sapiens
QPLPSSPCV

SEQ ID NO: 1022954 - protein, 9 aa, Homo Sapiens
AKHEVKPLR

SEQ ID NO: 1022955 - protein, 9 aa, Homo Sapiens
VLQKMGQEE

SEQ ID NO: 1022956 - protein, 9 aa, Homo Sapiens
NFPKKACLC

SEQ ID NO: 1022957 - protein, 9 aa, Homo Sapiens
ASDVKLVQH

SEQ ID NO: 1022958 - protein, 9 aa, Homo Sapiens
RQLTQELLV

SEQ ID NO: 1022959 - protein, 9 aa, Homo Sapiens
AFLGMSIFR

SEQ ID NO: 1022960 - protein, 9 aa, Homo Sapiens
VHVHAQDGK

SEQ ID NO: 1022961 - protein, 9 aa, Homo Sapiens
LRNFLQRHR

SEQ ID NO: 1022962 - protein, 9 aa, Homo Sapiens
TIGFFNCRC

SEQ ID NO: 1022963 - protein, 9 aa, Homo Sapiens
FLISPNWLV

SEQ ID NO: 1022964 - protein, 9 aa, Homo Sapiens
GSETTTATT

SEQ ID NO: 1022965 - protein, 9 aa, Homo Sapiens
RKVIKKVQH

SEQ ID NO: 1022966 - protein, 9 aa, Homo Sapiens
SFWPSLSSG

SEQ ID NO: 1022967 - protein, 9 aa, Homo Sapiens
EVNGQFEFV

SEQ ID NO: 1022968 - protein, 9 aa, Homo Sapiens
RNPTGGSDE

SEQ ID NO: 1022969 - protein, 9 aa, Homo Sapiens
AFYVAGILH

SEQ ID NO: 1022970 - protein, 9 aa, Homo Sapiens
APSGPGPRP

SEQ ID NO: 1022971 - protein, 9 aa, Homo Sapiens
SSNKNKKEK

SEQ ID NO: 1022972 - protein, 9 aa, Homo Sapiens
TCFVYGQTG

SEQ ID NO: 1022973 - protein, 9 aa, Homo Sapiens
VRHSSDSFY

SEQ ID NO: 1022974 - protein, 9 aa, Homo Sapiens
LDKNPNLEE

SEQ ID NO: 1022975 - protein, 9 aa, Homo Sapiens
EREVGILLE

SEQ ID NO: 1022976 - protein, 9 aa, Homo Sapiens
YNPFDGPNK

SEQ ID NO: 1022977 - protein, 9 aa, Homo Sapiens
DVEILTSIV

SEQ ID NO: 1022978 - protein, 9 aa, Homo Sapiens
DHINLYVRG

SEQ ID NO: 1022979 - protein, 9 aa, Homo Sapiens
GEELRVISC

SEQ ID NO: 1022980 - protein, 9 aa, Homo Sapiens
MLVSTSYQL

SEQ ID NO: 1022981 - protein, 9 aa, Homo Sapiens
YFSLSSVVF

SEQ ID NO: 1022982 - protein, 9 aa, Homo Sapiens
PGASDVKLV

SEQ ID NO: 1022983 - protein, 9 aa, Homo Sapiens
ISSVLAGGF

SEQ ID NO: 1022984 - protein, 9 aa, Homo Sapiens
DALQTEPKV

SEQ ID NO: 1022985 - protein, 9 aa, Homo Sapiens
ALEEDAQIF

SEQ ID NO: 1022986 - protein, 9 aa, Homo Sapiens
TPFQHSHSI

SEQ ID NO: 1022987 - protein, 9 aa, Homo Sapiens
VWDHDPIGQ

SEQ ID NO: 1022988 - protein, 9 aa, Homo Sapiens
GLNLHISTL

SEQ ID NO: 1022989 - protein, 9 aa, Homo Sapiens
TVVLKGATT

SEQ ID NO: 1022990 - protein, 9 aa, Homo Sapiens
ALKGMSQLI

SEQ ID NO: 1022991 - protein, 9 aa, Homo Sapiens
TLAWNVWAQ

SEQ ID NO: 1022992 - protein, 9 aa, Homo Sapiens
SWNQARDLS

SEQ ID NO: 1022993 - protein, 9 aa, Homo Sapiens
WVRNHFYEQ

SEQ ID NO: 1022994 - protein, 9 aa, Homo Sapiens
MGELSSSTS

SEQ ID NO: 1022995 - protein, 9 aa, Homo Sapiens
RACYRARTT

SEQ ID NO: 1022996 - protein, 9 aa, Homo Sapiens
SLGFGQENH

SEQ ID NO: 1022997 - protein, 9 aa, Homo Sapiens
KVRLRQQEE

SEQ ID NO: 1022998 - protein, 9 aa, Homo Sapiens
WKKPAEDCL

SEQ ID NO: 1022999 - protein, 9 aa, Homo Sapiens
DTFPEHVTP

SEQ ID NO: 1023000 - protein, 9 aa, Homo Sapiens
TPRHLVMEM

SEQ ID NO: 1023001 - protein, 9 aa, Homo Sapiens
LMSQVMFKL

SEQ ID NO: 1023002 - protein, 9 aa, Homo Sapiens
AVSQYEKNI

SEQ ID NO: 1023003 - protein, 9 aa, Homo Sapiens
KIRSWPERS

SEQ ID NO: 1023004 - protein, 9 aa, Homo Sapiens
LKRCPNRVK

SEQ ID NO: 1023005 - protein, 9 aa, Homo Sapiens
FTSFGARNR

SEQ ID NO: 1023006 - protein, 9 aa, Homo Sapiens
CTQEEWDFQ

SEQ ID NO: 1023007 - protein, 9 aa, Homo Sapiens
EKNDVDVAL

SEQ ID NO: 1023008 - protein, 9 aa, Homo Sapiens
VVTFDCGNN

SEQ ID NO: 1023009 - protein, 9 aa, Homo Sapiens
LMSVGENML

SEQ ID NO: 1023010 - protein, 9 aa, Homo Sapiens
WPSLSSGVD

SEQ ID NO: 1023011 - protein, 9 aa, Homo Sapiens
GPCRDKEAK

SEQ ID NO: 1023012 - protein, 9 aa, Homo Sapiens
SFSTEESSI

SEQ ID NO: 1023013 - protein, 9 aa, Homo Sapiens
SREIDWARR

SEQ ID NO: 1023014 - protein, 9 aa, Homo Sapiens
RLLDTKDEL

SEQ ID NO: 1023015 - protein, 9 aa, Homo Sapiens
KVCCNYSLH

SEQ ID NO: 1023016 - protein, 9 aa, Homo Sapiens
SKQERSTYV

SEQ ID NO: 1023017 - protein, 9 aa, Homo Sapiens
LLPYRYTDD

SEQ ID NO: 1023018 - protein, 9 aa, Homo Sapiens
SVKAMLNIS

SEQ ID NO: 1023019 - protein, 9 aa, Homo Sapiens
NSFTYFYKG

SEQ ID NO: 1023020 - protein, 9 aa, Homo Sapiens
NWDTAFGHS

SEQ ID NO: 1023021 - protein, 9 aa, Homo Sapiens
GHMPYTDVV

SEQ ID NO: 1023022 - protein, 9 aa, Homo Sapiens
SLLLHLEAK

SEQ ID NO: 1023023 - protein, 9 aa, Homo Sapiens
AAVATTVLF

SEQ ID NO: 1023024 - protein, 9 aa, Homo Sapiens
YEEKCSSDI

SEQ ID NO: 1023025 - protein, 9 aa, Homo Sapiens
NCPPPCHIS

SEQ ID NO: 1023026 - protein, 9 aa, Homo Sapiens
KEPARFTPK

SEQ ID NO: 1023027 - protein, 9 aa, Homo Sapiens
TRENSYQCK

SEQ ID NO: 1023028 - protein, 9 aa, Homo Sapiens
PLEWFLLNK

SEQ ID NO: 1023029 - protein, 9 aa, Homo Sapiens
PRFTLRMME

SEQ ID NO: 1023030 - protein, 9 aa, Homo Sapiens
EDSWDATRA

SEQ ID NO: 1023031 - protein, 9 aa, Homo Sapiens
RVTKDSIPC

SEQ ID NO: 1023032 - protein, 9 aa, Homo Sapiens
SLFQEAERC

SEQ ID NO: 1023033 - protein, 9 aa, Homo Sapiens
HETIFRAKD

SEQ ID NO: 1023034 - protein, 9 aa, Homo Sapiens
VLYRTLSSL

SEQ ID NO: 1023035 - protein, 9 aa, Homo Sapiens
VPNLQILAC

SEQ ID NO: 1023036 - protein, 9 aa, Homo Sapiens
FEGSTLSTP

SEQ ID NO: 1023037 - protein, 9 aa, Homo Sapiens
EKKEQKDFV

SEQ ID NO: 1023038 - protein, 9 aa, Homo Sapiens
LETGRGGDR

SEQ ID NO: 1023039 - protein, 9 aa, Homo Sapiens
SVGDGLSTF

SEQ ID NO: 1023040 - protein, 9 aa, Homo Sapiens
AKSFTKLAR

SEQ ID NO: 1023041 - protein, 9 aa, Homo Sapiens
LVKIFLQKG

SEQ ID NO: 1023042 - protein, 9 aa, Homo Sapiens
ELSVIGHMS

SEQ ID NO: 1023043 - protein, 9 aa, Homo Sapiens
DRKPLHLEG

SEQ ID NO: 1023044 - protein, 9 aa, Homo Sapiens
LAERPKAVE

SEQ ID NO: 1023045 - protein, 9 aa, Homo Sapiens
LRPSSSGSL

SEQ ID NO: 1023046 - protein, 9 aa, Homo Sapiens
PAPTPTSTK

SEQ ID NO: 1023047 - protein, 9 aa, Homo Sapiens
INNISVPQE

SEQ ID NO: 1023048 - protein, 9 aa, Homo Sapiens
IGCNKIGDV

SEQ ID NO: 1023049 - protein, 9 aa, Homo Sapiens
LQIPIKNVE

SEQ ID NO: 1023050 - protein, 9 aa, Homo Sapiens
PGISGLQGL

SEQ ID NO: 1023051 - protein, 9 aa, Homo Sapiens
PFTALPIPP

SEQ ID NO: 1023052 - protein, 9 aa, Homo Sapiens
KKEFIKDGH

SEQ ID NO: 1023053 - protein, 9 aa, Homo Sapiens
SRLGSAIFF

SEQ ID NO: 1023054 - protein, 9 aa, Homo Sapiens
PSEKIWIEI

SEQ ID NO: 1023055 - protein, 9 aa, Homo Sapiens
PLKIKIDPQ

SEQ ID NO: 1023056 - protein, 9 aa, Homo Sapiens
FVAGLAVLV

SEQ ID NO: 1023057 - protein, 9 aa, Homo Sapiens
PPPCHISQP

SEQ ID NO: 1023058 - protein, 9 aa, Homo Sapiens
AEPGAAHKM

SEQ ID NO: 1023059 - protein, 9 aa, Homo Sapiens
PTCRNNILD

SEQ ID NO: 1023060 - protein, 9 aa, Homo Sapiens
GLPLDIKLG

SEQ ID NO: 1023061 - protein, 9 aa, Homo Sapiens
RARGSLTPP

SEQ ID NO: 1023062 - protein, 9 aa, Homo Sapiens
GEQQSARKM

SEQ ID NO: 1023063 - protein, 9 aa, Homo Sapiens
LFQLVERTS

SEQ ID NO: 1023064 - protein, 9 aa, Homo Sapiens
VVHKTQEKE

SEQ ID NO: 1023065 - protein, 9 aa, Homo Sapiens
IVILSSLRP

SEQ ID NO: 1023066 - protein, 9 aa, Homo Sapiens
EEAVLLLLD

SEQ ID NO: 1023067 - protein, 9 aa, Homo Sapiens
QILTQNTQA

SEQ ID NO: 1023068 - protein, 9 aa, Homo Sapiens
LIAVSFCIL

SEQ ID NO: 1023069 - protein, 9 aa, Homo Sapiens
ETIFRAKDL

SEQ ID NO: 1023070 - protein, 9 aa, Homo Sapiens
KIEDENNNY

SEQ ID NO: 1023071 - protein, 9 aa, Homo Sapiens
SAAVSSRVS

SEQ ID NO: 1023072 - protein, 9 aa, Homo Sapiens
LRSPVNLSP

SEQ ID NO: 1023073 - protein, 9 aa, Homo Sapiens
GKSQDNVHT

SEQ ID NO: 1023074 - protein, 9 aa, Homo Sapiens
SPSNRNPAS

SEQ ID NO: 1023075 - protein, 9 aa, Homo Sapiens
PLPQNGGSP

SEQ ID NO: 1023076 - protein, 9 aa, Homo Sapiens
CAATFEKTI

SEQ ID NO: 1023077 - protein, 9 aa, Homo Sapiens
FSFSSDFVK

SEQ ID NO: 1023078 - protein, 9 aa, Homo Sapiens
AVDWKHPKI

SEQ ID NO: 1023079 - protein, 9 aa, Homo Sapiens
AETSGGLRR

SEQ ID NO: 1023080 - protein, 9 aa, Homo Sapiens
PEHPGQQGY

SEQ ID NO: 1023081 - protein, 9 aa, Homo Sapiens
HLFGVTKYI

SEQ ID NO: 1023082 - protein, 9 aa, Homo Sapiens
PHSEDILNT

SEQ ID NO: 1023083 - protein, 9 aa, Homo Sapiens
EFASDYADS

SEQ ID NO: 1023084 - protein, 9 aa, Homo Sapiens
IEPSLPSYR

SEQ ID NO: 1023085 - protein, 9 aa, Homo Sapiens
LEKDKQKNR

SEQ ID NO: 1023086 - protein, 9 aa, Homo Sapiens
LIELEEALN

SEQ ID NO: 1023087 - protein, 9 aa, Homo Sapiens
FYFTVQVHD

SEQ ID NO: 1023088 - protein, 9 aa, Homo Sapiens
LPEMTAPGE

SEQ ID NO: 1023089 - protein, 9 aa, Homo Sapiens
EFLRVALSN

SEQ ID NO: 1023090 - protein, 9 aa, Homo Sapiens
TDEQQKSDS

SEQ ID NO: 1023091 - protein, 9 aa, Homo Sapiens
VAMSHRNKE

SEQ ID NO: 1023092 - protein, 9 aa, Homo Sapiens
DFRLYLRYE

SEQ ID NO: 1023093 - protein, 9 aa, Homo Sapiens
GYRPVGSIS

SEQ ID NO: 1023094 - protein, 9 aa, Homo Sapiens
LDLIYVAYN

SEQ ID NO: 1023095 - protein, 9 aa, Homo Sapiens
SLAKAHARL

SEQ ID NO: 1023096 - protein, 9 aa, Homo Sapiens
FFPLELDNV

SEQ ID NO: 1023097 - protein, 9 aa, Homo Sapiens
EFFGEHCQN

SEQ ID NO: 1023098 - protein, 9 aa, Homo Sapiens
GSTLIPINN

SEQ ID NO: 1023099 - protein, 9 aa, Homo Sapiens
RDSDIFRHI

SEQ ID NO: 1023100 - protein, 9 aa, Homo Sapiens
ELKEGVELL

SEQ ID NO: 1023101 - protein, 9 aa, Homo Sapiens
SYRSLSTSQ

SEQ ID NO: 1023102 - protein, 9 aa, Homo Sapiens
LIGPCRDKE

SEQ ID NO: 1023103 - protein, 9 aa, Homo Sapiens
AKRSQLEEP

SEQ ID NO: 1023104 - protein, 9 aa, Homo Sapiens
FGEENKKKM

SEQ ID NO: 1023105 - protein, 9 aa, Homo Sapiens
FARDCHHLE

SEQ ID NO: 1023106 - protein, 9 aa, Homo Sapiens
NLTLMASWN

SEQ ID NO: 1023107 - protein, 9 aa, Homo Sapiens
VTRFIALYD

SEQ ID NO: 1023108 - protein, 9 aa, Homo Sapiens
KERRNQRKK

SEQ ID NO: 1023109 - protein, 9 aa, Homo Sapiens
MFSPSSLRG

SEQ ID NO: 1023110 - protein, 9 aa, Homo Sapiens
SQDLFSYCS

SEQ ID NO: 1023111 - protein, 9 aa, Homo Sapiens
PYSAESSSP

SEQ ID NO: 1023112 - protein, 9 aa, Homo Sapiens
SKDKDLLNE

SEQ ID NO: 1023113 - protein, 9 aa, Homo Sapiens
RGQKERIRE

SEQ ID NO: 1023114 - protein, 9 aa, Homo Sapiens
VNGQFEFVC

SEQ ID NO: 1023115 - protein, 9 aa, Homo Sapiens
PGNPGLSGS

SEQ ID NO: 1023116 - protein, 9 aa, Homo Sapiens
KLSALEMGG

SEQ ID NO: 1023117 - protein, 9 aa, Homo Sapiens
CREDVHNTH

SEQ ID NO: 1023118 - protein, 9 aa, Homo Sapiens
KIHFGTTGK

SEQ ID NO: 1023119 - protein, 9 aa, Homo Sapiens
LRNKKLKNA

SEQ ID NO: 1023120 - protein, 9 aa, Homo Sapiens
MSHRNKETF

SEQ ID NO: 1023121 - protein, 9 aa, Homo Sapiens
KGGRTETKL

SEQ ID NO: 1023122 - protein, 9 aa, Homo Sapiens
SSVKSAHIL

SEQ ID NO: 1023123 - protein, 9 aa, Homo Sapiens
FRRSEAELL

SEQ ID NO: 1023124 - protein, 9 aa, Homo Sapiens
RNKETFSCR

SEQ ID NO: 1023125 - protein, 9 aa, Homo Sapiens
EFQKPELKA

SEQ ID NO: 1023126 - protein, 9 aa, Homo Sapiens
YRPWIEIAN

SEQ ID NO: 1023127 - protein, 9 aa, Homo Sapiens
YSQLHGWNK

SEQ ID NO: 1023128 - protein, 9 aa, Homo Sapiens
APRICRISD

SEQ ID NO: 1023129 - protein, 9 aa, Homo Sapiens
PMQPLPKSL

SEQ ID NO: 1023130 - protein, 9 aa, Homo Sapiens
PLPKAGFIT

SEQ ID NO: 1023131 - protein, 9 aa, Homo Sapiens
VGSPDQNLQ

SEQ ID NO: 1023132 - protein, 9 aa, Homo Sapiens
RRLIQVGRG

SEQ ID NO: 1023133 - protein, 9 aa, Homo Sapiens
LQNLRMENN

SEQ ID NO: 1023134 - protein, 9 aa, Homo Sapiens
VSITINSHF

SEQ ID NO: 1023135 - protein, 9 aa, Homo Sapiens
RESQKLVGF

SEQ ID NO: 1023136 - protein, 9 aa, Homo Sapiens
RAKDLSVIL

SEQ ID NO: 1023137 - protein, 9 aa, Homo Sapiens
FLTTHTGER

SEQ ID NO: 1023138 - protein, 9 aa, Homo Sapiens
VESLDFRLY

SEQ ID NO: 1023139 - protein, 9 aa, Homo Sapiens
IRYKIFKRG

SEQ ID NO: 1023140 - protein, 9 aa, Homo Sapiens
LLPSKKVIK

SEQ ID NO: 1023141 - protein, 9 aa, Homo Sapiens
ISAKTLVQV

SEQ ID NO: 1023142 - protein, 9 aa, Homo Sapiens
KRSQLEEPA

SEQ ID NO: 1023143 - protein, 9 aa, Homo Sapiens
KEGIFPNSF

SEQ ID NO: 1023144 - protein, 9 aa, Homo Sapiens
DTAFGHSQA

SEQ ID NO: 1023145 - protein, 9 aa, Homo Sapiens
ATSLTIIIL

SEQ ID NO: 1023146 - protein, 9 aa, Homo Sapiens
QLTEDQKQP

SEQ ID NO: 1023147 - protein, 9 aa, Homo Sapiens
DEDGAAPAK

SEQ ID NO: 1023148 - protein, 9 aa, Homo Sapiens
PMMYDAGKF

SEQ ID NO: 1023149 - protein, 9 aa, Homo Sapiens
LRVISCTHR

SEQ ID NO: 1023150 - protein, 9 aa, Homo Sapiens
KNGTLALLP

SEQ ID NO: 1023151 - protein, 9 aa, Homo Sapiens
VFELSVTFN

SEQ ID NO: 1023152 - protein, 9 aa, Homo Sapiens
ESLDFRLYL

SEQ ID NO: 1023153 - protein, 9 aa, Homo Sapiens
ILNSTDCPV

SEQ ID NO: 1023154 - protein, 9 aa, Homo Sapiens
FSHFDGQDF

SEQ ID NO: 1023155 - protein, 9 aa, Homo Sapiens
ILDAKSFTK

SEQ ID NO: 1023156 - protein, 9 aa, Homo Sapiens
CQPLMEPEN

SEQ ID NO: 1023157 - protein, 9 aa, Homo Sapiens
RPYKCLRCG

SEQ ID NO: 1023158 - protein, 9 aa, Homo Sapiens
AAGSMMQNH

SEQ ID NO: 1023159 - protein, 9 aa, Homo Sapiens
QIMFWIQEI

SEQ ID NO: 1023160 - protein, 9 aa, Homo Sapiens
PTFFSFSSD

SEQ ID NO: 1023161 - protein, 9 aa, Homo Sapiens
SVAGCVHGI

SEQ ID NO: 1023162 - protein, 9 aa, Homo Sapiens
KLPDCPCTL

SEQ ID NO: 1023163 - protein, 9 aa, Homo Sapiens
TATQPNFSG

SEQ ID NO: 1023164 - protein, 9 aa, Homo Sapiens
PPAEPAQSP

SEQ ID NO: 1023165 - protein, 9 aa, Homo Sapiens
SGPEFFTVY

SEQ ID NO: 1023166 - protein, 9 aa, Homo Sapiens
EVEREITRE

SEQ ID NO: 1023167 - protein, 9 aa, Homo Sapiens
DKSLLKSKF

SEQ ID NO: 1023168 - protein, 9 aa, Homo Sapiens
SHPTMKDSV

SEQ ID NO: 1023169 - protein, 9 aa, Homo Sapiens
NLEEDQAEE

SEQ ID NO: 1023170 - protein, 9 aa, Homo Sapiens
TPNGHIANR

SEQ ID NO: 1023171 - protein, 9 aa, Homo Sapiens
GFCTCLGAQ

SEQ ID NO: 1023172 - protein, 9 aa, Homo Sapiens
EFNITKSLV

SEQ ID NO: 1023173 - protein, 9 aa, Homo Sapiens
LRKVDKRFQ

SEQ ID NO: 1023174 - protein, 9 aa, Homo Sapiens
PEEEVERSK

SEQ ID NO: 1023175 - protein, 9 aa, Homo Sapiens
SNDVTQGCL

SEQ ID NO: 1023176 - protein, 9 aa, Homo Sapiens
SIFRRIAGE

SEQ ID NO: 1023177 - protein, 9 aa, Homo Sapiens
KHSYLCTAT

SEQ ID NO: 1023178 - protein, 9 aa, Homo Sapiens
QNLQEAAAG

SEQ ID NO: 1023179 - protein, 9 aa, Homo Sapiens
EHWDYLLER

SEQ ID NO: 1023180 - protein, 9 aa, Homo Sapiens
DLRLCPSPG

SEQ ID NO: 1023181 - protein, 9 aa, Homo Sapiens
KDWKKERNK

SEQ ID NO: 1023182 - protein, 9 aa, Homo Sapiens
ESKISQKKI

SEQ ID NO: 1023183 - protein, 9 aa, Homo Sapiens
SAQCEMSEW

SEQ ID NO: 1023184 - protein, 9 aa, Homo Sapiens
SGFFMKMMS

SEQ ID NO: 1023185 - protein, 9 aa, Homo Sapiens
RSAVPFTAL

SEQ ID NO: 1023186 - protein, 9 aa, Homo Sapiens
RIKGEGMGL

SEQ ID NO: 1023187 - protein, 9 aa, Homo Sapiens
LELLLDKIY

SEQ ID NO: 1023188 - protein, 9 aa, Homo Sapiens
NTIGFFNCR

SEQ ID NO: 1023189 - protein, 9 aa, Homo Sapiens
WPQGAHGES

SEQ ID NO: 1023190 - protein, 9 aa, Homo Sapiens
VHLQNNYNL

SEQ ID NO: 1023191 - protein, 9 aa, Homo Sapiens
TASLGLARK

SEQ ID NO: 1023192 - protein, 9 aa, Homo Sapiens
ETSGGLRRC

SEQ ID NO: 1023193 - protein, 9 aa, Homo Sapiens
LLKINRTTR

SEQ ID NO: 1023194 - protein, 9 aa, Homo Sapiens
QTKSKLYQD

SEQ ID NO: 1023195 - protein, 9 aa, Homo Sapiens
ISGTQAEFQ

SEQ ID NO: 1023196 - protein, 9 aa, Homo Sapiens
KCNAAVEKK

SEQ ID NO: 1023197 - protein, 9 aa, Homo Sapiens
VHNTHAPTL

SEQ ID NO: 1023198 - protein, 9 aa, Homo Sapiens
FDIKGIEDI

SEQ ID NO: 1023199 - protein, 9 aa, Homo Sapiens
KPANMENLT

SEQ ID NO: 1023200 - protein, 9 aa, Homo Sapiens
EKHLRKKHC

SEQ ID NO: 1023201 - protein, 9 aa, Homo Sapiens
KLEEMHQRI

SEQ ID NO: 1023202 - protein, 9 aa, Homo Sapiens
KAFATCSLH

SEQ ID NO: 1023203 - protein, 9 aa, Homo Sapiens
ILYLSNNKL

SEQ ID NO: 1023204 - protein, 9 aa, Homo Sapiens
PKEPKGDPG

SEQ ID NO: 1023205 - protein, 9 aa, Homo Sapiens
STRSLVKLQ

SEQ ID NO: 1023206 - protein, 9 aa, Homo Sapiens
RVKKDFLQT

SEQ ID NO: 1023207 - protein, 9 aa, Homo Sapiens
IIQSRGSLV

SEQ ID NO: 1023208 - protein, 9 aa, Homo Sapiens
GRGSNGSGG

SEQ ID NO: 1023209 - protein, 9 aa, Homo Sapiens
SSSGSLPSQ

SEQ ID NO: 1023210 - protein, 9 aa, Homo Sapiens
TRPDLKNIL

SEQ ID NO: 1023211 - protein, 9 aa, Homo Sapiens
LDKIYDTIF

SEQ ID NO: 1023212 - protein, 9 aa, Homo Sapiens
YERLLIELE

SEQ ID NO: 1023213 - protein, 9 aa, Homo Sapiens
LLSKEEPVN

SEQ ID NO: 1023214 - protein, 9 aa, Homo Sapiens
NRATCISSL

SEQ ID NO: 1023215 - protein, 9 aa, Homo Sapiens
RGKLRACRQ

SEQ ID NO: 1023216 - protein, 9 aa, Homo Sapiens
ERRTSPVTF

SEQ ID NO: 1023217 - protein, 9 aa, Homo Sapiens
TQELLVSHA

SEQ ID NO: 1023218 - protein, 9 aa, Homo Sapiens
LEEIKSKKI

SEQ ID NO: 1023219 - protein, 9 aa, Homo Sapiens
TFLFVKVTN

SEQ ID NO: 1023220 - protein, 9 aa, Homo Sapiens
KQERSTYVC

SEQ ID NO: 1023221 - protein, 9 aa, Homo Sapiens
KVTDRANNS

SEQ ID NO: 1023222 - protein, 9 aa, Homo Sapiens
TAVSSSPVF

SEQ ID NO: 1023223 - protein, 9 aa, Homo Sapiens
ISEQEVTAS

SEQ ID NO: 1023224 - protein, 9 aa, Homo Sapiens
EIFRCCWFH

SEQ ID NO: 1023225 - protein, 9 aa, Homo Sapiens
SDSHLYTPM

SEQ ID NO: 1023226 - protein, 9 aa, Homo Sapiens
MSIVLGNTY

SEQ ID NO: 1023227 - protein, 9 aa, Homo Sapiens
ASSVLKMIN

SEQ ID NO: 1023228 - protein, 9 aa, Homo Sapiens
LIIIAIYAL

SEQ ID NO: 1023229 - protein, 9 aa, Homo Sapiens
NEMKEQKYW

SEQ ID NO: 1023230 - protein, 9 aa, Homo Sapiens
IKEKSEEQG

SEQ ID NO: 1023231 - protein, 9 aa, Homo Sapiens
VAYARVPSN

SEQ ID NO: 1023232 - protein, 9 aa, Homo Sapiens
ASDCSRDSR

SEQ ID NO: 1023233 - protein, 9 aa, Homo Sapiens
ITHDNVSSI

SEQ ID NO: 1023234 - protein, 8 aa, Homo Sapiens
GSLTFRDV

SEQ ID NO: 1023235 - protein, 9 aa, Homo Sapiens
PVTFSPHKH

SEQ ID NO: 1023236 - protein, 9 aa, Homo Sapiens
QGSKACTCD

SEQ ID NO: 1023237 - protein, 9 aa, Homo Sapiens
TPEWPIKKK

SEQ ID NO: 1023238 - protein, 9 aa, Homo Sapiens
WDCLPLSQP

SEQ ID NO: 1023239 - protein, 9 aa, Homo Sapiens
NKQEKIYTG

SEQ ID NO: 1023240 - protein, 9 aa, Homo Sapiens
EIGTYDAGI

SEQ ID NO: 1023241 - protein, 9 aa, Homo Sapiens
FFYNVIDCF

SEQ ID NO: 1023242 - protein, 9 aa, Homo Sapiens
RFIALYDYE

SEQ ID NO: 1023243 - protein, 9 aa, Homo Sapiens
EDNTIFKAW

SEQ ID NO: 1023244 - protein, 9 aa, Homo Sapiens
DLPPSQVFL

SEQ ID NO: 1023245 - protein, 9 aa, Homo Sapiens
STQAFLPSS

SEQ ID NO: 1023246 - protein, 9 aa, Homo Sapiens
ATKIEEMDS

SEQ ID NO: 1023247 - protein, 9 aa, Homo Sapiens
VMEMTNKKS

SEQ ID NO: 1023248 - protein, 9 aa, Homo Sapiens
SVNVTPSST

SEQ ID NO: 1023249 - protein, 9 aa, Homo Sapiens
DSNLCSQDE

SEQ ID NO: 1023250 - protein, 9 aa, Homo Sapiens
ARSDGDEEN

SEQ ID NO: 1023251 - protein, 9 aa, Homo Sapiens
IPSLSVEEP

SEQ ID NO: 1023252 - protein, 9 aa, Homo Sapiens
MEPSIPQSA

SEQ ID NO: 1023253 - protein, 9 aa, Homo Sapiens
TVLLKERLT

SEQ ID NO: 1023254 - protein, 9 aa, Homo Sapiens
SYSACPLMQ

SEQ ID NO: 1023255 - protein, 9 aa, Homo Sapiens
PLFCSLLGR

SEQ ID NO: 1023256 - protein, 9 aa, Homo Sapiens
NNNAPEILY

SEQ ID NO: 1023257 - protein, 9 aa, Homo Sapiens
KKRQNHLES

SEQ ID NO: 1023258 - protein, 9 aa, Homo Sapiens
SFLLSIFCS

SEQ ID NO: 1023259 - protein, 9 aa, Homo Sapiens
GLFRRFTCI

SEQ ID NO: 1023260 - protein, 9 aa, Homo Sapiens
ATAATTFTE

SEQ ID NO: 1023261 - protein, 9 aa, Homo Sapiens
LVPNSCTSQ

SEQ ID NO: 1023262 - protein, 9 aa, Homo Sapiens
SHLSLSPAS

SEQ ID NO: 1023263 - protein, 9 aa, Homo Sapiens
YCIPEGIKF

SEQ ID NO: 1023264 - protein, 9 aa, Homo Sapiens
LAEVKKEGE

SEQ ID NO: 1023265 - protein, 9 aa, Homo Sapiens
MRGKLRACR

SEQ ID NO: 1023266 - protein, 9 aa, Homo Sapiens
GGDAGETPG

SEQ ID NO: 1023267 - protein, 9 aa, Homo Sapiens
IPGSAGSAA

SEQ ID NO: 1023268 - protein, 9 aa, Homo Sapiens
RFEEILQEV

SEQ ID NO: 1023269 - protein, 9 aa, Homo Sapiens
RGVPSSSRF

SEQ ID NO: 1023270 - protein, 9 aa, Homo Sapiens
NFLQRHRAR

SEQ ID NO: 1023271 - protein, 9 aa, Homo Sapiens
GRTCKAGVE

SEQ ID NO: 1023272 - protein, 9 aa, Homo Sapiens
CVTTVPGKT

SEQ ID NO: 1023273 - protein, 9 aa, Homo Sapiens
AYSSGSLPE

SEQ ID NO: 1023274 - protein, 9 aa, Homo Sapiens
LSVALKGMS

SEQ ID NO: 1023275 - protein, 9 aa, Homo Sapiens
KLRACRQRR

SEQ ID NO: 1023276 - protein, 9 aa, Homo Sapiens
WIVVNCFTP

SEQ ID NO: 1023277 - protein, 9 aa, Homo Sapiens
DPKGTFQND

SEQ ID NO: 1023278 - protein, 9 aa, Homo Sapiens
GVEAKRLKA

SEQ ID NO: 1023279 - protein, 9 aa, Homo Sapiens
RPKAVESWN

SEQ ID NO: 1023280 - protein, 9 aa, Homo Sapiens
AAWHPTTGA

SEQ ID NO: 1023281 - protein, 9 aa, Homo Sapiens
NVCLAKVKS

SEQ ID NO: 1023282 - protein, 9 aa, Homo Sapiens
LGIKVQGDI

SEQ ID NO: 1023283 - protein, 9 aa, Homo Sapiens
ETFKIKNNW

SEQ ID NO: 1023284 - protein, 9 aa, Homo Sapiens
HAKLLKWLE

SEQ ID NO: 1023285 - protein, 9 aa, Homo Sapiens
EKSLGFSRE

SEQ ID NO: 1023286 - protein, 9 aa, Homo Sapiens
DEANLELLN

SEQ ID NO: 1023287 - protein, 9 aa, Homo Sapiens
EIVKKILEN

SEQ ID NO: 1023288 - protein, 9 aa, Homo Sapiens
AHFAGLLLL

SEQ ID NO: 1023289 - protein, 9 aa, Homo Sapiens
AKIVIQPEP

SEQ ID NO: 1023290 - protein, 9 aa, Homo Sapiens
LSSVVFARG

SEQ ID NO: 1023291 - protein, 9 aa, Homo Sapiens
VMLGSAYNH

SEQ ID NO: 1023292 - protein, 9 aa, Homo Sapiens
LTRARNKEH

SEQ ID NO: 1023293 - protein, 9 aa, Homo Sapiens
VAIPGSAGS

SEQ ID NO: 1023294 - protein, 9 aa, Homo Sapiens
LAGRLQYFL

SEQ ID NO: 1023295 - protein, 9 aa, Homo Sapiens
PGPPRIAGP

SEQ ID NO: 1023296 - protein, 9 aa, Homo Sapiens
LTLIAVSFC

SEQ ID NO: 1023297 - protein, 9 aa, Homo Sapiens
TLRLDLAGQ

SEQ ID NO: 1023298 - protein, 9 aa, Homo Sapiens
ENVLPGAFS

SEQ ID NO: 1023299 - protein, 9 aa, Homo Sapiens
AAAQSLMGM

SEQ ID NO: 1023300 - protein, 9 aa, Homo Sapiens
PSRPTKEIQ

SEQ ID NO: 1023301 - protein, 9 aa, Homo Sapiens
KGGQPITPN

SEQ ID NO: 1023302 - protein, 9 aa, Homo Sapiens
LSFRKEDCS

SEQ ID NO: 1023303 - protein, 9 aa, Homo Sapiens
SLLISARFG

SEQ ID NO: 1023304 - protein, 9 aa, Homo Sapiens
CMDDVELLL

SEQ ID NO: 1023305 - protein, 9 aa, Homo Sapiens
PLSSPPLPH

SEQ ID NO: 1023306 - protein, 9 aa, Homo Sapiens
ISVTRSLRA

SEQ ID NO: 1023307 - protein, 9 aa, Homo Sapiens
CEHELLKKK

SEQ ID NO: 1023308 - protein, 9 aa, Homo Sapiens
RSLSALAIE

SEQ ID NO: 1023309 - protein, 9 aa, Homo Sapiens
EILQEVGSR

SEQ ID NO: 1023310 - protein, 9 aa, Homo Sapiens
KELQESQGL

SEQ ID NO: 1023311 - protein, 9 aa, Homo Sapiens
EKAQKGNLG

SEQ ID NO: 1023312 - protein, 9 aa, Homo Sapiens
RLRIDLRLC

SEQ ID NO: 1023313 - protein, 9 aa, Homo Sapiens
KHITAKINA

SEQ ID NO: 1023314 - protein, 9 aa, Homo Sapiens
LSLSEDGEI

SEQ ID NO: 1023315 - protein, 9 aa, Homo Sapiens
EQLYSRDMV

SEQ ID NO: 1023316 - protein, 9 aa, Homo Sapiens
SFCHRSDDP

SEQ ID NO: 1023317 - protein, 9 aa, Homo Sapiens
AICCPLLYP

SEQ ID NO: 1023318 - protein, 9 aa, Homo Sapiens
IFRAKDLSV

SEQ ID NO: 1023319 - protein, 9 aa, Homo Sapiens
SIYAVAMQL

SEQ ID NO: 1023320 - protein, 9 aa, Homo Sapiens
LGVGFPISI

SEQ ID NO: 1023321 - protein, 9 aa, Homo Sapiens
GKVGLPLDI

SEQ ID NO: 1023322 - protein, 9 aa, Homo Sapiens
HFDGQDFYA

SEQ ID NO: 1023323 - protein, 9 aa, Homo Sapiens
LLNIKYLSP

SEQ ID NO: 1023324 - protein, 9 aa, Homo Sapiens
VTDGKSQDN

SEQ ID NO: 1023325 - protein, 9 aa, Homo Sapiens
TRVGTRRQS

SEQ ID NO: 1023326 - protein, 9 aa, Homo Sapiens
LGTLGTPTV

SEQ ID NO: 1023327 - protein, 9 aa, Homo Sapiens
YQQGTYLLV

SEQ ID NO: 1023328 - protein, 9 aa, Homo Sapiens
RGDRRFEKL

SEQ ID NO: 1023329 - protein, 9 aa, Homo Sapiens
VDVWFRSLA

SEQ ID NO: 1023330 - protein, 9 aa, Homo Sapiens
TVTNYFFVN

SEQ ID NO: 1023331 - protein, 9 aa, Homo Sapiens
NVSLEKIRQ

SEQ ID NO: 1023332 - protein, 9 aa, Homo Sapiens
SRLLRAPQN

SEQ ID NO: 1023333 - protein, 9 aa, Homo Sapiens
RKRVPEPSR

SEQ ID NO: 1023334 - protein, 9 aa, Homo Sapiens
HQYIDADTN

SEQ ID NO: 1023335 - protein, 9 aa, Homo Sapiens
SDEWQMRFD

SEQ ID NO: 1023336 - protein, 9 aa, Homo Sapiens
IGWVILSLA

SEQ ID NO: 1023337 - protein, 9 aa, Homo Sapiens
EIEEMPTTS

SEQ ID NO: 1023338 - protein, 9 aa, Homo Sapiens
PQVSLTATH

SEQ ID NO: 1023339 - protein, 9 aa, Homo Sapiens
GKEEYSAMR

SEQ ID NO: 1023340 - protein, 9 aa, Homo Sapiens
VKSYRSLST

SEQ ID NO: 1023341 - protein, 9 aa, Homo Sapiens
ALEARLEVG

SEQ ID NO: 1023342 - protein, 9 aa, Homo Sapiens
GFYESDVIG

SEQ ID NO: 1023343 - protein, 9 aa, Homo Sapiens
FHHRGCLAS

SEQ ID NO: 1023344 - protein, 9 aa, Homo Sapiens
VFPLEWFLL

SEQ ID NO: 1023345 - protein, 9 aa, Homo Sapiens
LCINCANEK

SEQ ID NO: 1023346 - protein, 9 aa, Homo Sapiens
SQRKSRENK

SEQ ID NO: 1023347 - protein, 9 aa, Homo Sapiens
YQKLMSVKL

SEQ ID NO: 1023348 - protein, 9 aa, Homo Sapiens
DVELLLNVP

SEQ ID NO: 1023349 - protein, 9 aa, Homo Sapiens
PAEPAQSPA

SEQ ID NO: 1023350 - protein, 9 aa, Homo Sapiens
MGSAHPRSW

SEQ ID NO: 1023351 - protein, 9 aa, Homo Sapiens
STFAVGCAS

SEQ ID NO: 1023352 - protein, 9 aa, Homo Sapiens
RQLVKIFLQ

SEQ ID NO: 1023353 - protein, 9 aa, Homo Sapiens
GPPGNPGLS

SEQ ID NO: 1023354 - protein, 9 aa, Homo Sapiens
VRFLVVSPH

SEQ ID NO: 1023355 - protein, 9 aa, Homo Sapiens
TGNDEKAFD

SEQ ID NO: 1023356 - protein, 9 aa, Homo Sapiens
LQNLKLCFL

SEQ ID NO: 1023357 - protein, 9 aa, Homo Sapiens
PAYGSWQVL

SEQ ID NO: 1023358 - protein, 9 aa, Homo Sapiens
SIPKTYSGQ

SEQ ID NO: 1023359 - protein, 9 aa, Homo Sapiens
FPGCSKMYI

SEQ ID NO: 1023360 - protein, 9 aa, Homo Sapiens
ASRQKHLSK

SEQ ID NO: 1023361 - protein, 9 aa, Homo Sapiens
LPQNGGSPC

SEQ ID NO: 1023362 - protein, 9 aa, Homo Sapiens
LFSPLRQRQ

SEQ ID NO: 1023363 - protein, 9 aa, Homo Sapiens
AFSIKGPFY

SEQ ID NO: 1023364 - protein, 9 aa, Homo Sapiens
SQVFLPAKA

SEQ ID NO: 1023365 - protein, 9 aa, Homo Sapiens
ATTFTEPIT

SEQ ID NO: 1023366 - protein, 9 aa, Homo Sapiens
PLQVELMRI

SEQ ID NO: 1023367 - protein, 9 aa, Homo Sapiens
LSESKMVIR

SEQ ID NO: 1023368 - protein, 9 aa, Homo Sapiens
TSPRGQLVG

SEQ ID NO: 1023369 - protein, 9 aa, Homo Sapiens
HESRNKPTS

SEQ ID NO: 1023370 - protein, 9 aa, Homo Sapiens
CVYAENAIR

SEQ ID NO: 1023371 - protein, 9 aa, Homo Sapiens
KKIKEKSEE

SEQ ID NO: 1023372 - protein, 9 aa, Homo Sapiens
YTDVVVHEV

SEQ ID NO: 1023373 - protein, 9 aa, Homo Sapiens
KFAAEKNGL

SEQ ID NO: 1023374 - protein, 9 aa, Homo Sapiens
PKIIRHKNK

SEQ ID NO: 1023375 - protein, 9 aa, Homo Sapiens
DLFSYCSEE

SEQ ID NO: 1023376 - protein, 9 aa, Homo Sapiens
AGGVAVGTL

SEQ ID NO: 1023377 - protein, 9 aa, Homo Sapiens
LLFFFLTFF

SEQ ID NO: 1023378 - protein, 9 aa, Homo Sapiens
NKEHQQQQR

SEQ ID NO: 1023379 - protein, 9 aa, Homo Sapiens
SSENSDNGK

SEQ ID NO: 1023380 - protein, 9 aa, Homo Sapiens
PFSKPPLIS

SEQ ID NO: 1023381 - protein, 9 aa, Homo Sapiens
WKQSVCLIS

SEQ ID NO: 1023382 - protein, 9 aa, Homo Sapiens
SNELHVLIE

SEQ ID NO: 1023383 - protein, 9 aa, Homo Sapiens
TDINRQNKF

SEQ ID NO: 1023384 - protein, 9 aa, Homo Sapiens
KNSNDVTQG

SEQ ID NO: 1023385 - protein, 9 aa, Homo Sapiens
VRMLSPFRS

SEQ ID NO: 1023386 - protein, 9 aa, Homo Sapiens
VGNVRIKFG

SEQ ID NO: 1023387 - protein, 9 aa, Homo Sapiens
VPGLIPAEK

SEQ ID NO: 1023388 - protein, 9 aa, Homo Sapiens
LEEDAQIFK

SEQ ID NO: 1023389 - protein, 9 aa, Homo Sapiens
MPGFLYPAA

SEQ ID NO: 1023390 - protein, 9 aa, Homo Sapiens
VFGASLDYF

SEQ ID NO: 1023391 - protein, 9 aa, Homo Sapiens
WLWEYLLEL

SEQ ID NO: 1023392 - protein, 9 aa, Homo Sapiens
KFLQRKFWA

SEQ ID NO: 1023393 - protein, 9 aa, Homo Sapiens
NETVGREVI

SEQ ID NO: 1023394 - protein, 9 aa, Homo Sapiens
LLRKDACSW

SEQ ID NO: 1023395 - protein, 9 aa, Homo Sapiens
GLPGTGLLG

SEQ ID NO: 1023396 - protein, 9 aa, Homo Sapiens
TEYQESCQG

SEQ ID NO: 1023397 - protein, 9 aa, Homo Sapiens
KKKGGGKGG

SEQ ID NO: 1023398 - protein, 9 aa, Homo Sapiens
IPLDPKGTF

SEQ ID NO: 1023399 - protein, 9 aa, Homo Sapiens
PVHNSEIQV

SEQ ID NO: 1023400 - protein, 9 aa, Homo Sapiens
DSSVKSAHI

SEQ ID NO: 1023401 - protein, 9 aa, Homo Sapiens
LSLRQTLQG

SEQ ID NO: 1023402 - protein, 9 aa, Homo Sapiens
HLSPEKFEV

SEQ ID NO: 1023403 - protein, 9 aa, Homo Sapiens
QKRLAHHQR

SEQ ID NO: 1023404 - protein, 9 aa, Homo Sapiens
CWTNGIQNW

SEQ ID NO: 1023405 - protein, 9 aa, Homo Sapiens
WSFPREVSS

SEQ ID NO: 1023406 - protein, 9 aa, Homo Sapiens
QGLPGTGLL

SEQ ID NO: 1023407 - protein, 9 aa, Homo Sapiens
LDYQIINPT

SEQ ID NO: 1023408 - protein, 9 aa, Homo Sapiens
VSRSASFVL

SEQ ID NO: 1023409 - protein, 9 aa, Homo Sapiens
CPLMQNPQG

SEQ ID NO: 1023410 - protein, 9 aa, Homo Sapiens
LCILYLSNN

SEQ ID NO: 1023411 - protein, 9 aa, Homo Sapiens
ATSEVEALR

SEQ ID NO: 1023412 - protein, 9 aa, Homo Sapiens
ARLYFPDLL

SEQ ID NO: 1023413 - protein, 9 aa, Homo Sapiens
SSLRGGARR

SEQ ID NO: 1023414 - protein, 9 aa, Homo Sapiens
HGSRTSQQE

SEQ ID NO: 1023415 - protein, 9 aa, Homo Sapiens
MAYSSGSLP

SEQ ID NO: 1023416 - protein, 9 aa, Homo Sapiens
CFVYGQTGS

SEQ ID NO: 1023417 - protein, 9 aa, Homo Sapiens
PFQHSHSIQ

SEQ ID NO: 1023418 - protein, 9 aa, Homo Sapiens
RKIRSWPER

SEQ ID NO: 1023419 - protein, 9 aa, Homo Sapiens
VLLSHIFYG

SEQ ID NO: 1023420 - protein, 9 aa, Homo Sapiens
TSAWGNPSN

SEQ ID NO: 1023421 - protein, 9 aa, Homo Sapiens
TFEDQSLSD

SEQ ID NO: 1023422 - protein, 9 aa, Homo Sapiens
SHGSRTSQQ

SEQ ID NO: 1023423 - protein, 9 aa, Homo Sapiens
RPVLNFPTD

SEQ ID NO: 1023424 - protein, 9 aa, Homo Sapiens
PPYVVTLPQ

SEQ ID NO: 1023425 - protein, 9 aa, Homo Sapiens
PVFMTASAS

SEQ ID NO: 1023426 - protein, 9 aa, Homo Sapiens
TMKDSVNVT

SEQ ID NO: 1023427 - protein, 9 aa, Homo Sapiens
SSPGLGETP

SEQ ID NO: 1023428 - protein, 9 aa, Homo Sapiens
IKFDTLWQL

SEQ ID NO: 1023429 - protein, 9 aa, Homo Sapiens
ERLCSTPQR

SEQ ID NO: 1023430 - protein, 9 aa, Homo Sapiens
GRKGFLGRP

SEQ ID NO: 1023431 - protein, 9 aa, Homo Sapiens
PAFQLDWPL

SEQ ID NO: 1023432 - protein, 9 aa, Homo Sapiens
LSNNMCLKV

SEQ ID NO: 1023433 - protein, 9 aa, Homo Sapiens
SENCRIVPY

SEQ ID NO: 1023434 - protein, 9 aa, Homo Sapiens
FEKTIRQKF

SEQ ID NO: 1023435 - protein, 9 aa, Homo Sapiens
VFAMQLPFC

SEQ ID NO: 1023436 - protein, 9 aa, Homo Sapiens
FEEILQEVG

SEQ ID NO: 1023437 - protein, 9 aa, Homo Sapiens
QSFLQRYWV

SEQ ID NO: 1023438 - protein, 9 aa, Homo Sapiens
EAVRDYSLL

SEQ ID NO: 1023439 - protein, 9 aa, Homo Sapiens
PSLSSGVDA

SEQ ID NO: 1023440 - protein, 9 aa, Homo Sapiens
AKLTRARNK

SEQ ID NO: 1023441 - protein, 9 aa, Homo Sapiens
NIHKLFDEV

SEQ ID NO: 1023442 - protein, 9 aa, Homo Sapiens
GSNVAMSHR

SEQ ID NO: 1023443 - protein, 9 aa, Homo Sapiens
CDIVDSHVG

SEQ ID NO: 1023444 - protein, 9 aa, Homo Sapiens
TILLAMTFD

SEQ ID NO: 1023445 - protein, 9 aa, Homo Sapiens
SPDQNLQEA

SEQ ID NO: 1023446 - protein, 9 aa, Homo Sapiens
YNTSEKITF

SEQ ID NO: 1023447 - protein, 9 aa, Homo Sapiens
SGWGLAGSR

SEQ ID NO: 1023448 - protein, 9 aa, Homo Sapiens
SSQPSQRIE

SEQ ID NO: 1023449 - protein, 9 aa, Homo Sapiens
NTDFFAKKI

SEQ ID NO: 1023450 - protein, 9 aa, Homo Sapiens
YRRKRVPEP

SEQ ID NO: 1023451 - protein, 9 aa, Homo Sapiens
VVVSRESQK

SEQ ID NO: 1023452 - protein, 9 aa, Homo Sapiens
NAQNINPFS

SEQ ID NO: 1023453 - protein, 9 aa, Homo Sapiens
VMSIPDVIC

SEQ ID NO: 1023454 - protein, 9 aa, Homo Sapiens
FPCREQRLQ

SEQ ID NO: 1023455 - protein, 9 aa, Homo Sapiens
DCSFSGCLP

SEQ ID NO: 1023456 - protein, 9 aa, Homo Sapiens
NKSLEKFRI

SEQ ID NO: 1023457 - protein, 9 aa, Homo Sapiens
SYQCKECGK

SEQ ID NO: 1023458 - protein, 9 aa, Homo Sapiens
THKRIYSGE

SEQ ID NO: 1023459 - protein, 9 aa, Homo Sapiens
VAVDWKHPK

SEQ ID NO: 1023460 - protein, 9 aa, Homo Sapiens
VQTIFRAAA

SEQ ID NO: 1023461 - protein, 9 aa, Homo Sapiens
PYRKEISYT

SEQ ID NO: 1023462 - protein, 9 aa, Homo Sapiens
YIYTPFGSR

SEQ ID NO: 1023463 - protein, 9 aa, Homo Sapiens
LRPRGAKGC

SEQ ID NO: 1023464 - protein, 9 aa, Homo Sapiens
RSYWCKIQT

SEQ ID NO: 1023465 - protein, 9 aa, Homo Sapiens
STLLRSSGS

SEQ ID NO: 1023466 - protein, 9 aa, Homo Sapiens
GGPPLSPES

SEQ ID NO: 1023467 - protein, 9 aa, Homo Sapiens
GCPESETSC

SEQ ID NO: 1023468 - protein, 9 aa, Homo Sapiens
PPLSSPPLP

SEQ ID NO: 1023469 - protein, 9 aa, Homo Sapiens
LFSYCSEER

SEQ ID NO: 1023470 - protein, 9 aa, Homo Sapiens
EQQSARKMT

SEQ ID NO: 1023471 - protein, 9 aa, Homo Sapiens
VNEGGGSRS

SEQ ID NO: 1023472 - protein, 9 aa, Homo Sapiens
KSAKERRNQ

SEQ ID NO: 1023473 - protein, 9 aa, Homo Sapiens
PAVVAIPGS

SEQ ID NO: 1023474 - protein, 9 aa, Homo Sapiens
GSAHPRSWL

SEQ ID NO: 1023475 - protein, 9 aa, Homo Sapiens
MFFGVSELL

SEQ ID NO: 1023476 - protein, 9 aa, Homo Sapiens
DADWTGLQA

SEQ ID NO: 1023477 - protein, 9 aa, Homo Sapiens
SQPLQTIFR

SEQ ID NO: 1023478 - protein, 9 aa, Homo Sapiens
TFQKFGQWA

SEQ ID NO: 1023479 - protein, 9 aa, Homo Sapiens
RLEGATKRT

SEQ ID NO: 1023480 - protein, 9 aa, Homo Sapiens
SRPGFNCSD

SEQ ID NO: 1023481 - protein, 9 aa, Homo Sapiens
FFCMEKGSI

SEQ ID NO: 1023482 - protein, 9 aa, Homo Sapiens
GAKGCTAPA

SEQ ID NO: 1023483 - protein, 9 aa, Homo Sapiens
LVVAQTFMD

SEQ ID NO: 1023484 - protein, 9 aa, Homo Sapiens
GRNCTCFPC

SEQ ID NO: 1023485 - protein, 9 aa, Homo Sapiens
ENVLKEETE

SEQ ID NO: 1023486 - protein, 9 aa, Homo Sapiens
TVLFMMPTM

SEQ ID NO: 1023487 - protein, 9 aa, Homo Sapiens
VINGTPPAT

SEQ ID NO: 1023488 - protein, 9 aa, Homo Sapiens
FLNNASTEN

SEQ ID NO: 1023489 - protein, 9 aa, Homo Sapiens
GPWRPGTAK

SEQ ID NO: 1023490 - protein, 9 aa, Homo Sapiens
QENHKDTSR

SEQ ID NO: 1023491 - protein, 9 aa, Homo Sapiens
RKGCVDDSG

SEQ ID NO: 1023492 - protein, 9 aa, Homo Sapiens
AGFSIRYKI

SEQ ID NO: 1023493 - protein, 9 aa, Homo Sapiens
NFGAHREAV

SEQ ID NO: 1023494 - protein, 9 aa, Homo Sapiens
MFCQEIYSH

SEQ ID NO: 1023495 - protein, 9 aa, Homo Sapiens
NDSCSTMSQ

SEQ ID NO: 1023496 - protein, 9 aa, Homo Sapiens
FYANIVHAI

SEQ ID NO: 1023497 - protein, 9 aa, Homo Sapiens
SLDFRLYLR

SEQ ID NO: 1023498 - protein, 9 aa, Homo Sapiens
QRISSIKIP

SEQ ID NO: 1023499 - protein, 9 aa, Homo Sapiens
DDYTTFDNV

SEQ ID NO: 1023500 - protein, 9 aa, Homo Sapiens
GLGRVQGLC

SEQ ID NO: 1023501 - protein, 9 aa, Homo Sapiens
GLKIHFNFE

SEQ ID NO: 1023502 - protein, 9 aa, Homo Sapiens
CCSVSSEGC

SEQ ID NO: 1023503 - protein, 9 aa, Homo Sapiens
RLQYFLQRI

SEQ ID NO: 1023504 - protein, 9 aa, Homo Sapiens
VSSPRCLVL

SEQ ID NO: 1023505 - protein, 9 aa, Homo Sapiens
IEGLGFIFL

SEQ ID NO: 1023506 - protein, 9 aa, Homo Sapiens
SFGVLMWKI

SEQ ID NO: 1023507 - protein, 9 aa, Homo Sapiens
SSSSTTLWA

SEQ ID NO: 1023508 - protein, 9 aa, Homo Sapiens
KYKFSQLKG

SEQ ID NO: 1023509 - protein, 9 aa, Homo Sapiens
FVNHLKMSE

SEQ ID NO: 1023510 - protein, 9 aa, Homo Sapiens
HELEDEFVD

SEQ ID NO: 1023511 - protein, 9 aa, Homo Sapiens
MQWGQFLDY

SEQ ID NO: 1023512 - protein, 9 aa, Homo Sapiens
KQLYHSDKF

SEQ ID NO: 1023513 - protein, 9 aa, Homo Sapiens
RVYVKMPPT

SEQ ID NO: 1023514 - protein, 9 aa, Homo Sapiens
RNSGSLLVS

SEQ ID NO: 1023515 - protein, 9 aa, Homo Sapiens
ASKPSRPTK

SEQ ID NO: 1023516 - protein, 9 aa, Homo Sapiens
TTVIVQSPR

SEQ ID NO: 1023517 - protein, 9 aa, Homo Sapiens
WARRADIRE

SEQ ID NO: 1023518 - protein, 9 aa, Homo Sapiens
NVDIFSVQE

SEQ ID NO: 1023519 - protein, 9 aa, Homo Sapiens
KGFLGRPGL

SEQ ID NO: 1023520 - protein, 9 aa, Homo Sapiens
KIDKINGKL

SEQ ID NO: 1023521 - protein, 9 aa, Homo Sapiens
SSVVFARGI

SEQ ID NO: 1023522 - protein, 9 aa, Homo Sapiens
RKEDCSFSG

SEQ ID NO: 1023523 - protein, 9 aa, Homo Sapiens
NYSLHVAVT

SEQ ID NO: 1023524 - protein, 9 aa, Homo Sapiens
KISQKKIKS

SEQ ID NO: 1023525 - protein, 9 aa, Homo Sapiens
LGKMCLGEE

SEQ ID NO: 1023526 - protein, 9 aa, Homo Sapiens
FNSKLGCFE

SEQ ID NO: 1023527 - protein, 9 aa, Homo Sapiens
ARQLVKIFL

SEQ ID NO: 1023528 - protein, 9 aa, Homo Sapiens
SSLRPELFT

SEQ ID NO: 1023529 - protein, 9 aa, Homo Sapiens
AKGNLHQAS

SEQ ID NO: 1023530 - protein, 9 aa, Homo Sapiens
DYEETSIFY

SEQ ID NO: 1023531 - protein, 9 aa, Homo Sapiens
PAPEAPESL

SEQ ID NO: 1023532 - protein, 9 aa, Homo Sapiens
NSKERKLLS

SEQ ID NO: 1023533 - protein, 9 aa, Homo Sapiens
LSWRPSQGP

SEQ ID NO: 1023534 - protein, 9 aa, Homo Sapiens
YEGGSGSGG

SEQ ID NO: 1023535 - protein, 9 aa, Homo Sapiens
AGVEEVLLL

SEQ ID NO: 1023536 - protein, 9 aa, Homo Sapiens
EGSWFYIHS

SEQ ID NO: 1023537 - protein, 9 aa, Homo Sapiens
RSPERNQDE

SEQ ID NO: 1023538 - protein, 9 aa, Homo Sapiens
SASFVLPSY

SEQ ID NO: 1023539 - protein, 9 aa, Homo Sapiens
GGSVAGCVH

SEQ ID NO: 1023540 - protein, 9 aa, Homo Sapiens
KEGEHEEEY

SEQ ID NO: 1023541 - protein, 9 aa, Homo Sapiens
VDPDSIWFL

SEQ ID NO: 1023542 - protein, 9 aa, Homo Sapiens
PVLDSYLLP

SEQ ID NO: 1023543 - protein, 9 aa, Homo Sapiens
NPLPQNGGS

SEQ ID NO: 1023544 - protein, 9 aa, Homo Sapiens
QLSSSITSS

SEQ ID NO: 1023545 - protein, 9 aa, Homo Sapiens
ALSTLDTKK

SEQ ID NO: 1023546 - protein, 9 aa, Homo Sapiens
YNVIDCFSM

SEQ ID NO: 1023547 - protein, 9 aa, Homo Sapiens
VGYEYELCL

SEQ ID NO: 1023548 - protein, 9 aa, Homo Sapiens
LNSKSTRSL

SEQ ID NO: 1023549 - protein, 9 aa, Homo Sapiens
PPMFSLLIS

SEQ ID NO: 1023550 - protein, 9 aa, Homo Sapiens
CEEREQEKN

SEQ ID NO: 1023551 - protein, 9 aa, Homo Sapiens
THPPEHPGQ

SEQ ID NO: 1023552 - protein, 9 aa, Homo Sapiens
TNLDSDVPL

SEQ ID NO: 1023553 - protein, 9 aa, Homo Sapiens
NSFTVLDLI

SEQ ID NO: 1023554 - protein, 9 aa, Homo Sapiens
NINKTLTEI

SEQ ID NO: 1023555 - protein, 9 aa, Homo Sapiens
NISIPKTYS

SEQ ID NO: 1023556 - protein, 9 aa, Homo Sapiens
HCSESASKP

SEQ ID NO: 1023557 - protein, 9 aa, Homo Sapiens
SNGTLAGPV

SEQ ID NO: 1023558 - protein, 9 aa, Homo Sapiens
RRVRPQVSL

SEQ ID NO: 1023559 - protein, 9 aa, Homo Sapiens
LLAMWNESS

SEQ ID NO: 1023560 - protein, 9 aa, Homo Sapiens
EGYEQQRGK

SEQ ID NO: 1023561 - protein, 9 aa, Homo Sapiens
SVSQALEAR

SEQ ID NO: 1023562 - protein, 9 aa, Homo Sapiens
RTYPELKEG

SEQ ID NO: 1023563 - protein, 9 aa, Homo Sapiens
MMNWLANVR

SEQ ID NO: 1023564 - protein, 9 aa, Homo Sapiens
LNSAAAQSL

SEQ ID NO: 1023565 - protein, 9 aa, Homo Sapiens
QESCQGLGS

SEQ ID NO: 1023566 - protein, 9 aa, Homo Sapiens
SWHLQPTCA

SEQ ID NO: 1023567 - protein, 9 aa, Homo Sapiens
KSKLYQDST

SEQ ID NO: 1023568 - protein, 9 aa, Homo Sapiens
KPASVIARG

SEQ ID NO: 1023569 - protein, 9 aa, Homo Sapiens
FGIPIIGPT

SEQ ID NO: 1023570 - protein, 9 aa, Homo Sapiens
SPGDCPPEA

SEQ ID NO: 1023571 - protein, 9 aa, Homo Sapiens
HYIPKPPGK

SEQ ID NO: 1023572 - protein, 9 aa, Homo Sapiens
RGYRVWKYL

SEQ ID NO: 1023573 - protein, 9 aa, Homo Sapiens
KVDPDSIWF

SEQ ID NO: 1023574 - protein, 9 aa, Homo Sapiens
GFSEAEKKE

SEQ ID NO: 1023575 - protein, 9 aa, Homo Sapiens
WDATRAAIT

SEQ ID NO: 1023576 - protein, 9 aa, Homo Sapiens
EPDQLETQT

SEQ ID NO: 1023577 - protein, 9 aa, Homo Sapiens
PRDSSNQED

SEQ ID NO: 1023578 - protein, 9 aa, Homo Sapiens
TCPPINVKI

SEQ ID NO: 1023579 - protein, 9 aa, Homo Sapiens
DTAGKEEYS

SEQ ID NO: 1023580 - protein, 9 aa, Homo Sapiens
TLIAVSFCI

SEQ ID NO: 1023581 - protein, 9 aa, Homo Sapiens
FIQKDDLQC

SEQ ID NO: 1023582 - protein, 9 aa, Homo Sapiens
PLTTRVYVK

SEQ ID NO: 1023583 - protein, 9 aa, Homo Sapiens
NQHQKTHTG

SEQ ID NO: 1023584 - protein, 9 aa, Homo Sapiens
EHIQKLPKN

SEQ ID NO: 1023585 - protein, 9 aa, Homo Sapiens
NLYSNVMLE

SEQ ID NO: 1023586 - protein, 9 aa, Homo Sapiens
GTMECSSSA

SEQ ID NO: 1023587 - protein, 9 aa, Homo Sapiens
ESSEPHPLQ

SEQ ID NO: 1023588 - protein, 9 aa, Homo Sapiens
GWVILSLAY

SEQ ID NO: 1023589 - protein, 9 aa, Homo Sapiens
PNGLDEKNC

SEQ ID NO: 1023590 - protein, 9 aa, Homo Sapiens
FSIRYKIFK

SEQ ID NO: 1023591 - protein, 9 aa, Homo Sapiens
NSSVFTNST

SEQ ID NO: 1023592 - protein, 9 aa, Homo Sapiens
GMRMSPLAW

SEQ ID NO: 1023593 - protein, 9 aa, Homo Sapiens
YLRQWVVIS

SEQ ID NO: 1023594 - protein, 9 aa, Homo Sapiens
TFTEPITVA

SEQ ID NO: 1023595 - protein, 9 aa, Homo Sapiens
EFILLRLTD

SEQ ID NO: 1023596 - protein, 9 aa, Homo Sapiens
NRNPASVEP

SEQ ID NO: 1023597 - protein, 9 aa, Homo Sapiens
DQKKIYNGL

SEQ ID NO: 1023598 - protein, 9 aa, Homo Sapiens
SDIFRHILN

SEQ ID NO: 1023599 - protein, 9 aa, Homo Sapiens
EASNKDILF

SEQ ID NO: 1023600 - protein, 9 aa, Homo Sapiens
KGNLHQAST

SEQ ID NO: 1023601 - protein, 9 aa, Homo Sapiens
KMYIKSSHL

SEQ ID NO: 1023602 - protein, 9 aa, Homo Sapiens
RYIATPRVW

SEQ ID NO: 1023603 - protein, 9 aa, Homo Sapiens
ILLEQSLET

SEQ ID NO: 1023604 - protein, 9 aa, Homo Sapiens
TGLKGFIGF

SEQ ID NO: 1023605 - protein, 9 aa, Homo Sapiens
SSGSSFPVS

SEQ ID NO: 1023606 - protein, 9 aa, Homo Sapiens
ISHQPTSVS

SEQ ID NO: 1023607 - protein, 9 aa, Homo Sapiens
ENSYIRCYY

SEQ ID NO: 1023608 - protein, 9 aa, Homo Sapiens
DWTGLQASD

SEQ ID NO: 1023609 - protein, 9 aa, Homo Sapiens
SHSGKSVVI

SEQ ID NO: 1023610 - protein, 9 aa, Homo Sapiens
PFANEKTTL

SEQ ID NO: 1023611 - protein, 9 aa, Homo Sapiens
KKLAEKDKK

SEQ ID NO: 1023612 - protein, 9 aa, Homo Sapiens
ENEGEEEKE

SEQ ID NO: 1023613 - protein, 9 aa, Homo Sapiens
DQQEPQQLG

SEQ ID NO: 1023614 - protein, 9 aa, Homo Sapiens
VRAQYKEIA

SEQ ID NO: 1023615 - protein, 9 aa, Homo Sapiens
KACLCASSA

SEQ ID NO: 1023616 - protein, 9 aa, Homo Sapiens
PSEVCRRKT

SEQ ID NO: 1023617 - protein, 9 aa, Homo Sapiens
GGIAPSATA

SEQ ID NO: 1023618 - protein, 9 aa, Homo Sapiens
EGTRKREYK

SEQ ID NO: 1023619 - protein, 9 aa, Homo Sapiens
SELRHGLFY

SEQ ID NO: 1023620 - protein, 9 aa, Homo Sapiens
PRKGFAPCS

SEQ ID NO: 1023621 - protein, 9 aa, Homo Sapiens
KLMSTFKNY

SEQ ID NO: 1023622 - protein, 9 aa, Homo Sapiens
FYSDRDTTE

SEQ ID NO: 1023623 - protein, 9 aa, Homo Sapiens
TIQKEGHMR

SEQ ID NO: 1023624 - protein, 9 aa, Homo Sapiens
LGNLSALQT

SEQ ID NO: 1023625 - protein, 9 aa, Homo Sapiens
AIWKYLKKN

SEQ ID NO: 1023626 - protein, 9 aa, Homo Sapiens
GSSDNLSPQ

SEQ ID NO: 1023627 - protein, 9 aa, Homo Sapiens
AGGLLPSGL

SEQ ID NO: 1023628 - protein, 9 aa, Homo Sapiens
QSLNEAFVA

SEQ ID NO: 1023629 - protein, 9 aa, Homo Sapiens
LKNAAEEQK

SEQ ID NO: 1023630 - protein, 9 aa, Homo Sapiens
TNFLPAPAR

SEQ ID NO: 1023631 - protein, 9 aa, Homo Sapiens
ELCLDLTLW

SEQ ID NO: 1023632 - protein, 9 aa, Homo Sapiens
LEFNSKLGC

SEQ ID NO: 1023633 - protein, 9 aa, Homo Sapiens
LEIPHSSSS

SEQ ID NO: 1023634 - protein, 9 aa, Homo Sapiens
SSAQCEMSE

SEQ ID NO: 1023635 - protein, 9 aa, Homo Sapiens
YSFRLNEAS

SEQ ID NO: 1023636 - protein, 9 aa, Homo Sapiens
LLLLLVVDQ

SEQ ID NO: 1023637 - protein, 9 aa, Homo Sapiens
TNNFGSVAR

SEQ ID NO: 1023638 - protein, 9 aa, Homo Sapiens
ESLFQEAER

SEQ ID NO: 1023639 - protein, 9 aa, Homo Sapiens
FSPHKHVSG

SEQ ID NO: 1023640 - protein, 9 aa, Homo Sapiens
WAKPASVIA

SEQ ID NO: 1023641 - protein, 9 aa, Homo Sapiens
KILCSDTWV

SEQ ID NO: 1023642 - protein, 9 aa, Homo Sapiens
NTLLEHKEK

SEQ ID NO: 1023643 - protein, 9 aa, Homo Sapiens
QSTEKEGIF

SEQ ID NO: 1023644 - protein, 9 aa, Homo Sapiens
REITRERSR

SEQ ID NO: 1023645 - protein, 9 aa, Homo Sapiens
HGRAVCCVL

SEQ ID NO: 1023646 - protein, 9 aa, Homo Sapiens
VLQICPLQI

SEQ ID NO: 1023647 - protein, 9 aa, Homo Sapiens
TPSGFFMKM

SEQ ID NO: 1023648 - protein, 9 aa, Homo Sapiens
LGEIFRCCW

SEQ ID NO: 1023649 - protein, 9 aa, Homo Sapiens
DLIQSMHND

SEQ ID NO: 1023650 - protein, 9 aa, Homo Sapiens
GQLVGKEAL

SEQ ID NO: 1023651 - protein, 9 aa, Homo Sapiens
VKQKEKEQI

SEQ ID NO: 1023652 - protein, 9 aa, Homo Sapiens
FTEPITVAP

SEQ ID NO: 1023653 - protein, 9 aa, Homo Sapiens
LIVGSRPGF

SEQ ID NO: 1023654 - protein, 9 aa, Homo Sapiens
VQMKLKFLQ

SEQ ID NO: 1023655 - protein, 9 aa, Homo Sapiens
GPKEPKGDP

SEQ ID NO: 1023656 - protein, 9 aa, Homo Sapiens
QSMHNDATL

SEQ ID NO: 1023657 - protein, 9 aa, Homo Sapiens
ARKMTEVLP

SEQ ID NO: 1023658 - protein, 9 aa, Homo Sapiens
YNDLMSKML

SEQ ID NO: 1023659 - protein, 9 aa, Homo Sapiens
LSDNSPVGE

SEQ ID NO: 1023660 - protein, 9 aa, Homo Sapiens
KPRSSPRSE

SEQ ID NO: 1023661 - protein, 9 aa, Homo Sapiens
SPEGCPESE

SEQ ID NO: 1023662 - protein, 9 aa, Homo Sapiens
FMLKEKPSN

SEQ ID NO: 1023663 - protein, 9 aa, Homo Sapiens
LTEEEKNII

SEQ ID NO: 1023664 - protein, 9 aa, Homo Sapiens
KITFLFVKV

SEQ ID NO: 1023665 - protein, 9 aa, Homo Sapiens
KPGISGLQG

SEQ ID NO: 1023666 - protein, 9 aa, Homo Sapiens
FDSFFLDKV

SEQ ID NO: 1023667 - protein, 9 aa, Homo Sapiens
DFFAKKIIP

SEQ ID NO: 1023668 - protein, 9 aa, Homo Sapiens
GLLGFHFTH

SEQ ID NO: 1023669 - protein, 9 aa, Homo Sapiens
SSERLASGP

SEQ ID NO: 1023670 - protein, 9 aa, Homo Sapiens
VIRAWVSSG

SEQ ID NO: 1023671 - protein, 9 aa, Homo Sapiens
ANNSMEQGE

SEQ ID NO: 1023672 - protein, 9 aa, Homo Sapiens
CLQGLFYPA

SEQ ID NO: 1023673 - protein, 9 aa, Homo Sapiens
RPARLPADT

SEQ ID NO: 1023674 - protein, 9 aa, Homo Sapiens
LKAKMDADW

SEQ ID NO: 1023675 - protein, 9 aa, Homo Sapiens
SSSYLHFST

SEQ ID NO: 1023676 - protein, 9 aa, Homo Sapiens
LNRPFRCKN

SEQ ID NO: 1023677 - protein, 9 aa, Homo Sapiens
FYQQGTYLL

SEQ ID NO: 1023678 - protein, 9 aa, Homo Sapiens
FYDKIRKGC

SEQ ID NO: 1023679 - protein, 9 aa, Homo Sapiens
CHSLRYTNL

SEQ ID NO: 1023680 - protein, 9 aa, Homo Sapiens
PAKIVIQPE

SEQ ID NO: 1023681 - protein, 9 aa, Homo Sapiens
DINRQNKFL

SEQ ID NO: 1023682 - protein, 9 aa, Homo Sapiens
LDFRLYLRY

SEQ ID NO: 1023683 - protein, 9 aa, Homo Sapiens
QLKEHWDYL

SEQ ID NO: 1023684 - protein, 9 aa, Homo Sapiens
TLLARLLYH

SEQ ID NO: 1023685 - protein, 9 aa, Homo Sapiens
NPTGGSDEW

SEQ ID NO: 1023686 - protein, 9 aa, Homo Sapiens
RRKENCINL

SEQ ID NO: 1023687 - protein, 9 aa, Homo Sapiens
MVKKEFIKD

SEQ ID NO: 1023688 - protein, 9 aa, Homo Sapiens
SSGIALFSW

SEQ ID NO: 1023689 - protein, 9 aa, Homo Sapiens
SGCLRNFLQ

SEQ ID NO: 1023690 - protein, 9 aa, Homo Sapiens
LAKAHARLE

SEQ ID NO: 1023691 - protein, 9 aa, Homo Sapiens
SFPNSSSYL

SEQ ID NO: 1023692 - protein, 9 aa, Homo Sapiens
HKLFDEVFF

SEQ ID NO: 1023693 - protein, 9 aa, Homo Sapiens
FPRGPVRPA

SEQ ID NO: 1023694 - protein, 9 aa, Homo Sapiens
TLAYSASWD

SEQ ID NO: 1023695 - protein, 9 aa, Homo Sapiens
SCLERVQPG

SEQ ID NO: 1023696 - protein, 9 aa, Homo Sapiens
PPDAPNKEE

SEQ ID NO: 1023697 - protein, 9 aa, Homo Sapiens
SKQSSFYSD

SEQ ID NO: 1023698 - protein, 9 aa, Homo Sapiens
GDAGETPGE

SEQ ID NO: 1023699 - protein, 9 aa, Homo Sapiens
NSCTSQIEF

SEQ ID NO: 1023700 - protein, 9 aa, Homo Sapiens
LFQLNKNTG

SEQ ID NO: 1023701 - protein, 9 aa, Homo Sapiens
GLQIPIKNV

SEQ ID NO: 1023702 - protein, 9 aa, Homo Sapiens
KKFMHSSSL

SEQ ID NO: 1023703 - protein, 9 aa, Homo Sapiens
EGKPNVFWM

SEQ ID NO: 1023704 - protein, 9 aa, Homo Sapiens
YSEKAQKGN

SEQ ID NO: 1023705 - protein, 9 aa, Homo Sapiens
KAGVEEVLL

SEQ ID NO: 1023706 - protein, 9 aa, Homo Sapiens
TLFRPFGPF

SEQ ID NO: 1023707 - protein, 9 aa, Homo Sapiens
VKIVIDCEQ

SEQ ID NO: 1023708 - protein, 9 aa, Homo Sapiens
IKVQGDIKE

SEQ ID NO: 1023709 - protein, 9 aa, Homo Sapiens
EIEWVKQYA

SEQ ID NO: 1023710 - protein, 9 aa, Homo Sapiens
LSVEEPHKH

SEQ ID NO: 1023711 - protein, 9 aa, Homo Sapiens
WPKMVTELC

SEQ ID NO: 1023712 - protein, 9 aa, Homo Sapiens
VRNVAWAPS

SEQ ID NO: 1023713 - protein, 9 aa, Homo Sapiens
KKMETMLRN

SEQ ID NO: 1023714 - protein, 9 aa, Homo Sapiens
NVIWLWEYL

SEQ ID NO: 1023715 - protein, 9 aa, Homo Sapiens
IEHSSPSSH

SEQ ID NO: 1023716 - protein, 9 aa, Homo Sapiens
LADQLDLIY

SEQ ID NO: 1023717 - protein, 9 aa, Homo Sapiens
ILLVNFFVL

SEQ ID NO: 1023718 - protein, 9 aa, Homo Sapiens
CRKVLVWPT

SEQ ID NO: 1023719 - protein, 9 aa, Homo Sapiens
NIVRCDNLG

SEQ ID NO: 1023720 - protein, 9 aa, Homo Sapiens
DGQDFYAAA

SEQ ID NO: 1023721 - protein, 9 aa, Homo Sapiens
DDSGGPLMS

SEQ ID NO: 1023722 - protein, 9 aa, Homo Sapiens
VIPAFHSNF

SEQ ID NO: 1023723 - protein, 9 aa, Homo Sapiens
ENDLAEEML

SEQ ID NO: 1023724 - protein, 9 aa, Homo Sapiens
RVYYSKCLS

SEQ ID NO: 1023725 - protein, 9 aa, Homo Sapiens
LLLNVPELN

SEQ ID NO: 1023726 - protein, 9 aa, Homo Sapiens
GNVWFLALE

SEQ ID NO: 1023727 - protein, 9 aa, Homo Sapiens
RMFCQEIYS

SEQ ID NO: 1023728 - protein, 9 aa, Homo Sapiens
VAVGTLCHL

SEQ ID NO: 1023729 - protein, 9 aa, Homo Sapiens
CKECGKPFN

SEQ ID NO: 1023730 - protein, 9 aa, Homo Sapiens
DKVKPKILA

SEQ ID NO: 1023731 - protein, 9 aa, Homo Sapiens
PPGRPGLPE

SEQ ID NO: 1023732 - protein, 9 aa, Homo Sapiens
GLKNETLFC

SEQ ID NO: 1023733 - protein, 9 aa, Homo Sapiens
AAFFRRSEA

SEQ ID NO: 1023734 - protein, 9 aa, Homo Sapiens
ISTDIFLVD

SEQ ID NO: 1023735 - protein, 9 aa, Homo Sapiens
TGPQLASRK

SEQ ID NO: 1023736 - protein, 9 aa, Homo Sapiens
VNHLKMSEL

SEQ ID NO: 1023737 - protein, 9 aa, Homo Sapiens
GLLPSQLLD

SEQ ID NO: 1023738 - protein, 9 aa, Homo Sapiens
HEGENFYKF

SEQ ID NO: 1023739 - protein, 9 aa, Homo Sapiens
AYARVPSND

SEQ ID NO: 1023740 - protein, 9 aa, Homo Sapiens
RHQPFTILY

SEQ ID NO: 1023741 - protein, 9 aa, Homo Sapiens
IQHDHLACF

SEQ ID NO: 1023742 - protein, 9 aa, Homo Sapiens
PWTLLCHDM

SEQ ID NO: 1023743 - protein, 9 aa, Homo Sapiens
AWGVQTFSS

SEQ ID NO: 1023744 - protein, 9 aa, Homo Sapiens
GTWKEYLEK

SEQ ID NO: 1023745 - protein, 9 aa, Homo Sapiens
KFDSGVMLP

SEQ ID NO: 1023746 - protein, 9 aa, Homo Sapiens
YEKSKKHRE

SEQ ID NO: 1023747 - protein, 9 aa, Homo Sapiens
SRPRNCIGM

SEQ ID NO: 1023748 - protein, 9 aa, Homo Sapiens
LERVQPGPG

SEQ ID NO: 1023749 - protein, 9 aa, Homo Sapiens
KHPSHLSGP

SEQ ID NO: 1023750 - protein, 9 aa, Homo Sapiens
HPSRHQYGA

SEQ ID NO: 1023751 - protein, 9 aa, Homo Sapiens
LQPLPSSPC

SEQ ID NO: 1023752 - protein, 9 aa, Homo Sapiens
LAICCPLLY

SEQ ID NO: 1023753 - protein, 9 aa, Homo Sapiens
ILSSLRPEL

SEQ ID NO: 1023754 - protein, 9 aa, Homo Sapiens
KVTCKHLVT

SEQ ID NO: 1023755 - protein, 9 aa, Homo Sapiens
SEEEEEEMA

SEQ ID NO: 1023756 - protein, 9 aa, Homo Sapiens
KWDSTNPFS

SEQ ID NO: 1023757 - protein, 9 aa, Homo Sapiens
ISSFWPSLS

SEQ ID NO: 1023758 - protein, 9 aa, Homo Sapiens
DDARSYWCK

SEQ ID NO: 1023759 - protein, 9 aa, Homo Sapiens
DSVNVTPSS

SEQ ID NO: 1023760 - protein, 9 aa, Homo Sapiens
GPFFLTTHT

SEQ ID NO: 1023761 - protein, 9 aa, Homo Sapiens
TSFEGSTLS

SEQ ID NO: 1023762 - protein, 9 aa, Homo Sapiens
STATAATTF

SEQ ID NO: 1023763 - protein, 9 aa, Homo Sapiens
SPLREGIFC

SEQ ID NO: 1023764 - protein, 9 aa, Homo Sapiens
GDNFFDDLQ

SEQ ID NO: 1023765 - protein, 9 aa, Homo Sapiens
CHISQPCVP

SEQ ID NO: 1023766 - protein, 9 aa, Homo Sapiens
CYKGSCFHR

SEQ ID NO: 1023767 - protein, 9 aa, Homo Sapiens
KFIKIHFGT

SEQ ID NO: 1023768 - protein, 9 aa, Homo Sapiens
LKLIRMCLY

SEQ ID NO: 1023769 - protein, 9 aa, Homo Sapiens
IDQVVQTVL

SEQ ID NO: 1023770 - protein, 9 aa, Homo Sapiens
EVSWQLEKS

SEQ ID NO: 1023771 - protein, 9 aa, Homo Sapiens
LEHKEKSEN

SEQ ID NO: 1023772 - protein, 9 aa, Homo Sapiens
GSRPGFNCS

SEQ ID NO: 1023773 - protein, 9 aa, Homo Sapiens
RDSSNQEDV

SEQ ID NO: 1023774 - protein, 9 aa, Homo Sapiens
DACSWSTGM

SEQ ID NO: 1023775 - protein, 9 aa, Homo Sapiens
QRMHNRKTH

SEQ ID NO: 1023776 - protein, 9 aa, Homo Sapiens
RSSDSDVSL

SEQ ID NO: 1023777 - protein, 9 aa, Homo Sapiens
TRPPLSLSE

SEQ ID NO: 1023778 - protein, 9 aa, Homo Sapiens
SSSAQCEMS

SEQ ID NO: 1023779 - protein, 9 aa, Homo Sapiens
LNKKLMKKL

SEQ ID NO: 1023780 - protein, 9 aa, Homo Sapiens
CFLEFDYCK

SEQ ID NO: 1023781 - protein, 9 aa, Homo Sapiens
TFREIICCY

SEQ ID NO: 1023782 - protein, 9 aa, Homo Sapiens
GKATCFVYG

SEQ ID NO: 1023783 - protein, 9 aa, Homo Sapiens
SPSPPVLDS

SEQ ID NO: 1023784 - protein, 9 aa, Homo Sapiens
LKLCFLEFD

SEQ ID NO: 1023785 - protein, 9 aa, Homo Sapiens
SLCWTNGIQ

SEQ ID NO: 1023786 - protein, 9 aa, Homo Sapiens
GCVHGICED

SEQ ID NO: 1023787 - protein, 9 aa, Homo Sapiens
INKGGNRKV

SEQ ID NO: 1023788 - protein, 9 aa, Homo Sapiens
QRLINSRTY

SEQ ID NO: 1023789 - protein, 9 aa, Homo Sapiens
SSSEKGNFF

SEQ ID NO: 1023790 - protein, 9 aa, Homo Sapiens
DRVLKPKTK

SEQ ID NO: 1023791 - protein, 9 aa, Homo Sapiens
IWTRAVAVL

SEQ ID NO: 1023792 - protein, 9 aa, Homo Sapiens
EEMDSSFNL

SEQ ID NO: 1023793 - protein, 9 aa, Homo Sapiens
VQTKSKLYQ

SEQ ID NO: 1023794 - protein, 9 aa, Homo Sapiens
SGKPGISGL

SEQ ID NO: 1023795 - protein, 9 aa, Homo Sapiens
RKKMETMLR

SEQ ID NO: 1023796 - protein, 9 aa, Homo Sapiens
YLGDRRPVS

SEQ ID NO: 1023797 - protein, 9 aa, Homo Sapiens
CSPAHTRAH

SEQ ID NO: 1023798 - protein, 9 aa, Homo Sapiens
KVERDYKPI

SEQ ID NO: 1023799 - protein, 9 aa, Homo Sapiens
AKAFSSDHY

SEQ ID NO: 1023800 - protein, 9 aa, Homo Sapiens
IRKPGKVGL

SEQ ID NO: 1023801 - protein, 9 aa, Homo Sapiens
GSARPKLYD

SEQ ID NO: 1023802 - protein, 9 aa, Homo Sapiens
GGEEWILNS

SEQ ID NO: 1023803 - protein, 9 aa, Homo Sapiens
NASDPKKAP

SEQ ID NO: 1023804 - protein, 9 aa, Homo Sapiens
AEVQRKRDM

SEQ ID NO: 1023805 - protein, 9 aa, Homo Sapiens
QELLVSHAQ

SEQ ID NO: 1023806 - protein, 9 aa, Homo Sapiens
RGLPGEEFP

SEQ ID NO: 1023807 - protein, 9 aa, Homo Sapiens
SGFPRVEPD

SEQ ID NO: 1023808 - protein, 9 aa, Homo Sapiens
HNRKTHVNI

SEQ ID NO: 1023809 - protein, 9 aa, Homo Sapiens
VGDRGPKEP

SEQ ID NO: 1023810 - protein, 9 aa, Homo Sapiens
LFLLDQNNN

SEQ ID NO: 1023811 - protein, 9 aa, Homo Sapiens
SGSGQSFGF

SEQ ID NO: 1023812 - protein, 9 aa, Homo Sapiens
AQKGNLGKD

SEQ ID NO: 1023813 - protein, 9 aa, Homo Sapiens
SWMNLSRRR

SEQ ID NO: 1023814 - protein, 9 aa, Homo Sapiens
ENHKDTSRI

SEQ ID NO: 1023815 - protein, 9 aa, Homo Sapiens
FLEFDYCKI

SEQ ID NO: 1023816 - protein, 9 aa, Homo Sapiens
RGGRGSNGS

SEQ ID NO: 1023817 - protein, 9 aa, Homo Sapiens
DDILEFITN

SEQ ID NO: 1023818 - protein, 9 aa, Homo Sapiens
LKGMSQLIT

SEQ ID NO: 1023819 - protein, 9 aa, Homo Sapiens
FLDRSLDMS

SEQ ID NO: 1023820 - protein, 9 aa, Homo Sapiens
AQTGSGLLP

SEQ ID NO: 1023821 - protein, 9 aa, Homo Sapiens
FKQFSILTT

SEQ ID NO: 1023822 - protein, 9 aa, Homo Sapiens
CQAEFSPAA

SEQ ID NO: 1023823 - protein, 9 aa, Homo Sapiens
EDASFSPLK

SEQ ID NO: 1023824 - protein, 9 aa, Homo Sapiens
DIFLVDNSD

SEQ ID NO: 1023825 - protein, 9 aa, Homo Sapiens
VGAACPLSI

SEQ ID NO: 1023826 - protein, 9 aa, Homo Sapiens
SLSSGVDAA

SEQ ID NO: 1023827 - protein, 9 aa, Homo Sapiens
GTGLLGFHF

SEQ ID NO: 1023828 - protein, 9 aa, Homo Sapiens
MHRECLPLS

SEQ ID NO: 1023829 - protein, 9 aa, Homo Sapiens
VHFSDTFPE

SEQ ID NO: 1023830 - protein, 9 aa, Homo Sapiens
KAFDFFEEQ

SEQ ID NO: 1023831 - protein, 9 aa, Homo Sapiens
AFYQQGTYL

SEQ ID NO: 1023832 - protein, 9 aa, Homo Sapiens
PVEQEKDSE

SEQ ID NO: 1023833 - protein, 9 aa, Homo Sapiens
KTGPQLASR

SEQ ID NO: 1023834 - protein, 9 aa, Homo Sapiens
KQLCILYLS

SEQ ID NO: 1023835 - protein, 9 aa, Homo Sapiens
RANNSMEQG

SEQ ID NO: 1023836 - protein, 9 aa, Homo Sapiens
QSLLSVALK

SEQ ID NO: 1023837 - protein, 9 aa, Homo Sapiens
ITVQADPLD

SEQ ID NO: 1023838 - protein, 9 aa, Homo Sapiens
CFSARQLVK

SEQ ID NO: 1023839 - protein, 9 aa, Homo Sapiens
SKSLERKLA

SEQ ID NO: 1023840 - protein, 9 aa, Homo Sapiens
ACQPLMEPE

SEQ ID NO: 1023841 - protein, 9 aa, Homo Sapiens
SFTYFYKGK

SEQ ID NO: 1023842 - protein, 9 aa, Homo Sapiens
GYYKGGKDT

SEQ ID NO: 1023843 - protein, 9 aa, Homo Sapiens
PGPRPPRFT

SEQ ID NO: 1023844 - protein, 9 aa, Homo Sapiens
TKTFQKFGQ

SEQ ID NO: 1023845 - protein, 9 aa, Homo Sapiens
SIYPLALRP

SEQ ID NO: 1023846 - protein, 9 aa, Homo Sapiens
LSSIDKNLS

SEQ ID NO: 1023847 - protein, 9 aa, Homo Sapiens
QPLMEPENL

SEQ ID NO: 1023848 - protein, 9 aa, Homo Sapiens
RQRQCNNPL

SEQ ID NO: 1023849 - protein, 9 aa, Homo Sapiens
NPAYLRQCL

SEQ ID NO: 1023850 - protein, 9 aa, Homo Sapiens
IQESQVTFH

SEQ ID NO: 1023851 - protein, 9 aa, Homo Sapiens
KGAGSSCLP

SEQ ID NO: 1023852 - protein, 9 aa, Homo Sapiens
REYQKLMSV

SEQ ID NO: 1023853 - protein, 9 aa, Homo Sapiens
GFCIQFQKK

SEQ ID NO: 1023854 - protein, 9 aa, Homo Sapiens
TFGYSFRLN

SEQ ID NO: 1023855 - protein, 9 aa, Homo Sapiens
QHLYEEKCS

SEQ ID NO: 1023856 - protein, 9 aa, Homo Sapiens
GMMHGIVDS

SEQ ID NO: 1023857 - protein, 9 aa, Homo Sapiens
SAKSIYPLA

SEQ ID NO: 1023858 - protein, 9 aa, Homo Sapiens
PSSSSRKSP

SEQ ID NO: 1023859 - protein, 9 aa, Homo Sapiens
PNLEEDQAE

SEQ ID NO: 1023860 - protein, 9 aa, Homo Sapiens
NETDGVEAK

SEQ ID NO: 1023861 - protein, 9 aa, Homo Sapiens
IFRCCWFHP

SEQ ID NO: 1023862 - protein, 9 aa, Homo Sapiens
SALQTFRVL

SEQ ID NO: 1023863 - protein, 9 aa, Homo Sapiens
PSSGEIIFL

SEQ ID NO: 1023864 - protein, 9 aa, Homo Sapiens
ESSLASSQA

SEQ ID NO: 1023865 - protein, 9 aa, Homo Sapiens
ENKDSICKP

SEQ ID NO: 1023866 - protein, 9 aa, Homo Sapiens
KNPKPQEWT

SEQ ID NO: 1023867 - protein, 9 aa, Homo Sapiens
DEGCLRKVD

SEQ ID NO: 1023868 - protein, 9 aa, Homo Sapiens
EKNCVCRAT

SEQ ID NO: 1023869 - protein, 9 aa, Homo Sapiens
MENLTEVIT

SEQ ID NO: 1023870 - protein, 9 aa, Homo Sapiens
FYYLFDGQA

SEQ ID NO: 1023871 - protein, 9 aa, Homo Sapiens
ALLNAFQEF

SEQ ID NO: 1023872 - protein, 9 aa, Homo Sapiens
LFYAVDEEG

SEQ ID NO: 1023873 - protein, 9 aa, Homo Sapiens
MMYDAGKFA

SEQ ID NO: 1023874 - protein, 9 aa, Homo Sapiens
LRKTFREII

SEQ ID NO: 1023875 - protein, 9 aa, Homo Sapiens
DRRFEKLGR

SEQ ID NO: 1023876 - protein, 9 aa, Homo Sapiens
LTMRSYETA

SEQ ID NO: 1023877 - protein, 9 aa, Homo Sapiens
PNNPDEQMN

SEQ ID NO: 1023878 - protein, 9 aa, Homo Sapiens
ETGVDFKND

SEQ ID NO: 1023879 - protein, 9 aa, Homo Sapiens
GVEEVLLLA

SEQ ID NO: 1023880 - protein, 9 aa, Homo Sapiens
ITVNIWYSF

SEQ ID NO: 1023881 - protein, 9 aa, Homo Sapiens
VNCFTPANY

SEQ ID NO: 1023882 - protein, 9 aa, Homo Sapiens
SSFLEKSYE

SEQ ID NO: 1023883 - protein, 9 aa, Homo Sapiens
NIRNINRLV

SEQ ID NO: 1023884 - protein, 9 aa, Homo Sapiens
TVAGSGIAW

SEQ ID NO: 1023885 - protein, 9 aa, Homo Sapiens
FTIEGLGFI

SEQ ID NO: 1023886 - protein, 9 aa, Homo Sapiens
EEKNIIMAV

SEQ ID NO: 1023887 - protein, 9 aa, Homo Sapiens
DSHLYTPMY

SEQ ID NO: 1023888 - protein, 9 aa, Homo Sapiens
TKFIYSEDN

SEQ ID NO: 1023889 - protein, 9 aa, Homo Sapiens
IDWARRADI

SEQ ID NO: 1023890 - protein, 9 aa, Homo Sapiens
AASFPNSSS

SEQ ID NO: 1023891 - protein, 9 aa, Homo Sapiens
YVKIEPSLP

SEQ ID NO: 1023892 - protein, 9 aa, Homo Sapiens
SWDLPSTPC

SEQ ID NO: 1023893 - protein, 9 aa, Homo Sapiens
CNYSLHVAV

SEQ ID NO: 1023894 - protein, 9 aa, Homo Sapiens
NWLKNSNDV

SEQ ID NO: 1023895 - protein, 9 aa, Homo Sapiens
VYMTQYQRK

SEQ ID NO: 1023896 - protein, 9 aa, Homo Sapiens
DDLVLSDDV

SEQ ID NO: 1023897 - protein, 9 aa, Homo Sapiens
DRQSFLQRY

SEQ ID NO: 1023898 - protein, 9 aa, Homo Sapiens
GFWALPKNL

SEQ ID NO: 1023899 - protein, 9 aa, Homo Sapiens
ALFQLVERT

SEQ ID NO: 1023900 - protein, 9 aa, Homo Sapiens
YGLQNNIRS

SEQ ID NO: 1023901 - protein, 9 aa, Homo Sapiens
RVKVSNEYV

SEQ ID NO: 1023902 - protein, 9 aa, Homo Sapiens
SHMVFAQIR

SEQ ID NO: 1023903 - protein, 9 aa, Homo Sapiens
PKVCCNYSL

SEQ ID NO: 1023904 - protein, 9 aa, Homo Sapiens
VLKPKTKRA

SEQ ID NO: 1023905 - protein, 9 aa, Homo Sapiens
QQQEEDRSL

SEQ ID NO: 1023906 - protein, 9 aa, Homo Sapiens
VTIEIYARD

SEQ ID NO: 1023907 - protein, 9 aa, Homo Sapiens
RTRRDESTG

SEQ ID NO: 1023908 - protein, 9 aa, Homo Sapiens
AWVSSGSSS

SEQ ID NO: 1023909 - protein, 9 aa, Homo Sapiens
RVDFFRAGP

SEQ ID NO: 1023910 - protein, 9 aa, Homo Sapiens
KLLEAISEI

SEQ ID NO: 1023911 - protein, 9 aa, Homo Sapiens
AKYAHLSNE

SEQ ID NO: 1023912 - protein, 9 aa, Homo Sapiens
VAGGLLPSG

SEQ ID NO: 1023913 - protein, 9 aa, Homo Sapiens
FASRVILLE

SEQ ID NO: 1023914 - protein, 9 aa, Homo Sapiens
SQPSQRIEG

SEQ ID NO: 1023915 - protein, 9 aa, Homo Sapiens
LVRTYPELK

SEQ ID NO: 1023916 - protein, 9 aa, Homo Sapiens
DDIDSSRAS

SEQ ID NO: 1023917 - protein, 9 aa, Homo Sapiens
LEDYKEPIE

SEQ ID NO: 1023918 - protein, 9 aa, Homo Sapiens
PSPPSPNKE

SEQ ID NO: 1023919 - protein, 9 aa, Homo Sapiens
QPSLFYHLE

SEQ ID NO: 1023920 - protein, 9 aa, Homo Sapiens
QEEEEPSTF

SEQ ID NO: 1023921 - protein, 9 aa, Homo Sapiens
SSSLLDYSF

SEQ ID NO: 1023922 - protein, 9 aa, Homo Sapiens
NLPRAERLC

SEQ ID NO: 1023923 - protein, 9 aa, Homo Sapiens
SQAIASNVD

SEQ ID NO: 1023924 - protein, 9 aa, Homo Sapiens
SPPPNNPDE

SEQ ID NO: 1023925 - protein, 9 aa, Homo Sapiens
NNSGVPCNS

SEQ ID NO: 1023926 - protein, 9 aa, Homo Sapiens
LAYWLYHYR

SEQ ID NO: 1023927 - protein, 9 aa, Homo Sapiens
FLNGSSQKT

SEQ ID NO: 1023928 - protein, 9 aa, Homo Sapiens
RCPNRVKVD

SEQ ID NO: 1023929 - protein, 9 aa, Homo Sapiens
HGWAQLSFP

SEQ ID NO: 1023930 - protein, 9 aa, Homo Sapiens
ISGLQGLLG

SEQ ID NO: 1023931 - protein, 9 aa, Homo Sapiens
DVEKNEERR

SEQ ID NO: 1023932 - protein, 9 aa, Homo Sapiens
KLNQTQSKK

SEQ ID NO: 1023933 - protein, 9 aa, Homo Sapiens
VTFYKVMVS

SEQ ID NO: 1023934 - protein, 9 aa, Homo Sapiens
PLLGWNSKD

SEQ ID NO: 1023935 - protein, 9 aa, Homo Sapiens
TLTTHKRIY

SEQ ID NO: 1023936 - protein, 9 aa, Homo Sapiens
NAQDPGLQR

SEQ ID NO: 1023937 - protein, 9 aa, Homo Sapiens
VTLDDSKWK

SEQ ID NO: 1023938 - protein, 9 aa, Homo Sapiens
RRLHERENE

SEQ ID NO: 1023939 - protein, 9 aa, Homo Sapiens
QLEKSLNCT

SEQ ID NO: 1023940 - protein, 9 aa, Homo Sapiens
IACLCCDAG

SEQ ID NO: 1023941 - protein, 9 aa, Homo Sapiens
GPPGSTGLK

SEQ ID NO: 1023942 - protein, 9 aa, Homo Sapiens
GQGHICGAF

SEQ ID NO: 1023943 - protein, 9 aa, Homo Sapiens
KMFEILLDK

SEQ ID NO: 1023944 - protein, 9 aa, Homo Sapiens
WFRSLAEES

SEQ ID NO: 1023945 - protein, 9 aa, Homo Sapiens
ETSRPSLLG

SEQ ID NO: 1023946 - protein, 9 aa, Homo Sapiens
NMSYFVEVS

SEQ ID NO: 1023947 - protein, 9 aa, Homo Sapiens
NGSGGSWTK

SEQ ID NO: 1023948 - protein, 9 aa, Homo Sapiens
WLANVRKCT

SEQ ID NO: 1023949 - protein, 9 aa, Homo Sapiens
ELSSSTSWH

SEQ ID NO: 1023950 - protein, 9 aa, Homo Sapiens
QTIFRAAAE

SEQ ID NO: 1023951 - protein, 9 aa, Homo Sapiens
GPVVVLPDL

SEQ ID NO: 1023952 - protein, 9 aa, Homo Sapiens
LNQHKKIYT

SEQ ID NO: 1023953 - protein, 9 aa, Homo Sapiens
SNFDNFSQA

SEQ ID NO: 1023954 - protein, 9 aa, Homo Sapiens
FSLFQAQYE

SEQ ID NO: 1023955 - protein, 9 aa, Homo Sapiens
DHELEDEFV

SEQ ID NO: 1023956 - protein, 9 aa, Homo Sapiens
RAQYKEIAQ

SEQ ID NO: 1023957 - protein, 9 aa, Homo Sapiens
KVEKKRQNH

SEQ ID NO: 1023958 - protein, 9 aa, Homo Sapiens
RAFRKEREK

SEQ ID NO: 1023959 - protein, 9 aa, Homo Sapiens
IGLTPLLGW

SEQ ID NO: 1023960 - protein, 9 aa, Homo Sapiens
AYKLPDGHV

SEQ ID NO: 1023961 - protein, 9 aa, Homo Sapiens
NSITDACLL

SEQ ID NO: 1023962 - protein, 9 aa, Homo Sapiens
YTSAMPGFL

SEQ ID NO: 1023963 - protein, 9 aa, Homo Sapiens
DCIYKGGIL

SEQ ID NO: 1023964 - protein, 9 aa, Homo Sapiens
QKFLELARK

SEQ ID NO: 1023965 - protein, 9 aa, Homo Sapiens
EELEAQIFF

SEQ ID NO: 1023966 - protein, 9 aa, Homo Sapiens
NLRRVKEYF

SEQ ID NO: 1023967 - protein, 9 aa, Homo Sapiens
DLAEEMLLK

SEQ ID NO: 1023968 - protein, 9 aa, Homo Sapiens
YLMKNTMKN

SEQ ID NO: 1023969 - protein, 9 aa, Homo Sapiens
RPSLLGSYS

SEQ ID NO: 1023970 - protein, 9 aa, Homo Sapiens
AEKNGLACL

SEQ ID NO: 1023971 - protein, 9 aa, Homo Sapiens
TSSIQPSFC

SEQ ID NO: 1023972 - protein, 9 aa, Homo Sapiens
SNKDILFSR

SEQ ID NO: 1023973 - protein, 9 aa, Homo Sapiens
MTWIKNGEE

SEQ ID NO: 1023974 - protein, 9 aa, Homo Sapiens
TCKHLVTGQ

SEQ ID NO: 1023975 - protein, 9 aa, Homo Sapiens
MTGAFILGG

SEQ ID NO: 1023976 - protein, 9 aa, Homo Sapiens
EVHRFDSSV

SEQ ID NO: 1023977 - protein, 9 aa, Homo Sapiens
GLLKFADNL

SEQ ID NO: 1023978 - protein, 9 aa, Homo Sapiens
LSDRPIKAP

SEQ ID NO: 1023979 - protein, 9 aa, Homo Sapiens
LENKATFSP

SEQ ID NO: 1023980 - protein, 9 aa, Homo Sapiens
QDAMDSKLA

SEQ ID NO: 1023981 - protein, 9 aa, Homo Sapiens
APEAPESLP

SEQ ID NO: 1023982 - protein, 9 aa, Homo Sapiens
LEDEFVDEN

SEQ ID NO: 1023983 - protein, 9 aa, Homo Sapiens
DIDSSRASL

SEQ ID NO: 1023984 - protein, 9 aa, Homo Sapiens
NLELLNDSE

SEQ ID NO: 1023985 - protein, 9 aa, Homo Sapiens
GKPNVFWMT

SEQ ID NO: 1023986 - protein, 9 aa, Homo Sapiens
SSSPQGGPD

SEQ ID NO: 1023987 - protein, 9 aa, Homo Sapiens
GLSAKKYSV

SEQ ID NO: 1023988 - protein, 9 aa, Homo Sapiens
NPGCRHQPF

SEQ ID NO: 1023989 - protein, 9 aa, Homo Sapiens
CPPEATETP

SEQ ID NO: 1023990 - protein, 9 aa, Homo Sapiens
LVFPLEWFL

SEQ ID NO: 1023991 - protein, 9 aa, Homo Sapiens
SPGEISSCI

SEQ ID NO: 1023992 - protein, 9 aa, Homo Sapiens
FLEKSYELP

SEQ ID NO: 1023993 - protein, 9 aa, Homo Sapiens
KRIFIGGGS

SEQ ID NO: 1023994 - protein, 9 aa, Homo Sapiens
EKKRQNHLE

SEQ ID NO: 1023995 - protein, 9 aa, Homo Sapiens
ASSVVAGEF

SEQ ID NO: 1023996 - protein, 9 aa, Homo Sapiens
MGHRSEYWV

SEQ ID NO: 1023997 - protein, 9 aa, Homo Sapiens
LVTIEIYAR

SEQ ID NO: 1023998 - protein, 9 aa, Homo Sapiens
VPLSPGIKC

SEQ ID NO: 1023999 - protein, 9 aa, Homo Sapiens
KQKEKEQIK

SEQ ID NO: 1024000 - protein, 9 aa, Homo Sapiens
YEETSIFYF

SEQ ID NO: 1024001 - protein, 9 aa, Homo Sapiens
CNKIGDVGV

SEQ ID NO: 1024002 - protein, 9 aa, Homo Sapiens
QAEFSPAAS

SEQ ID NO: 1024003 - protein, 9 aa, Homo Sapiens
RNINRLVIG

SEQ ID NO: 1024004 - protein, 9 aa, Homo Sapiens
HVHLQNNYN

SEQ ID NO: 1024005 - protein, 9 aa, Homo Sapiens
KAHARLEDS

SEQ ID NO: 1024006 - protein, 9 aa, Homo Sapiens
EAKRLKAFN

SEQ ID NO: 1024007 - protein, 9 aa, Homo Sapiens
LEKSLNCTV

SEQ ID NO: 1024008 - protein, 9 aa, Homo Sapiens
KEGVELLES

SEQ ID NO: 1024009 - protein, 9 aa, Homo Sapiens
DLAGRLQYF

SEQ ID NO: 1024010 - protein, 9 aa, Homo Sapiens
RIKGGAAGR

SEQ ID NO: 1024011 - protein, 9 aa, Homo Sapiens
ASGYGGIAP

SEQ ID NO: 1024012 - protein, 9 aa, Homo Sapiens
QDPINADSL

SEQ ID NO: 1024013 - protein, 9 aa, Homo Sapiens
RASSSSLLD

SEQ ID NO: 1024014 - protein, 9 aa, Homo Sapiens
YQRASSSSL

SEQ ID NO: 1024015 - protein, 9 aa, Homo Sapiens
NESSLSDAG

SEQ ID NO: 1024016 - protein, 9 aa, Homo Sapiens
GTCRNTIGF

SEQ ID NO: 1024017 - protein, 9 aa, Homo Sapiens
QGRGLVLQK

SEQ ID NO: 1024018 - protein, 9 aa, Homo Sapiens
TDIFLVDNS

SEQ ID NO: 1024019 - protein, 9 aa, Homo Sapiens
EVRAQYKEI

SEQ ID NO: 1024020 - protein, 9 aa, Homo Sapiens
RGLVTLDDS

SEQ ID NO: 1024021 - protein, 9 aa, Homo Sapiens
CKDVVLNKK

SEQ ID NO: 1024022 - protein, 9 aa, Homo Sapiens
YFYLQLRGA

SEQ ID NO: 1024023 - protein, 9 aa, Homo Sapiens
CRRKTKSVP

SEQ ID NO: 1024024 - protein, 9 aa, Homo Sapiens
TLIPINNIS

SEQ ID NO: 1024025 - protein, 9 aa, Homo Sapiens
VLRNGKIFM

SEQ ID NO: 1024026 - protein, 9 aa, Homo Sapiens
EEEIKKICR

SEQ ID NO: 1024027 - protein, 9 aa, Homo Sapiens
VAYLEKLQL

SEQ ID NO: 1024028 - protein, 9 aa, Homo Sapiens
KPGAFLIRP

SEQ ID NO: 1024029 - protein, 9 aa, Homo Sapiens
LEKVLRAPT

SEQ ID NO: 1024030 - protein, 9 aa, Homo Sapiens
VYLMKNTMK

SEQ ID NO: 1024031 - protein, 9 aa, Homo Sapiens
FAVGCASAA

SEQ ID NO: 1024032 - protein, 9 aa, Homo Sapiens
TARKDNVIW

SEQ ID NO: 1024033 - protein, 9 aa, Homo Sapiens
SPSNFCLLF

SEQ ID NO: 1024034 - protein, 9 aa, Homo Sapiens
SSRTTQATH

SEQ ID NO: 1024035 - protein, 9 aa, Homo Sapiens
TQIMFWIQE

SEQ ID NO: 1024036 - protein, 9 aa, Homo Sapiens
ANINKTLTE

SEQ ID NO: 1024037 - protein, 9 aa, Homo Sapiens
RSEYWVASE

SEQ ID NO: 1024038 - protein, 9 aa, Homo Sapiens
HRSEYWVAS

SEQ ID NO: 1024039 - protein, 9 aa, Homo Sapiens
RPPRFTLRM

SEQ ID NO: 1024040 - protein, 9 aa, Homo Sapiens
FFMKMMSMK

SEQ ID NO: 1024041 - protein, 9 aa, Homo Sapiens
GLNDLNVFP

SEQ ID NO: 1024042 - protein, 9 aa, Homo Sapiens
EMTNKKSLK

SEQ ID NO: 1024043 - protein, 9 aa, Homo Sapiens
QTVLSETQD

SEQ ID NO: 1024044 - protein, 9 aa, Homo Sapiens
AKDVCLNQG

SEQ ID NO: 1024045 - protein, 9 aa, Homo Sapiens
VEKKRQNHL

SEQ ID NO: 1024046 - protein, 9 aa, Homo Sapiens
PRLQPSSFP

SEQ ID NO: 1024047 - protein, 9 aa, Homo Sapiens
QHGGPPLSP

SEQ ID NO: 1024048 - protein, 9 aa, Homo Sapiens
EPETSRPSL

SEQ ID NO: 1024049 - protein, 9 aa, Homo Sapiens
MPTTSHRLS

SEQ ID NO: 1024050 - protein, 9 aa, Homo Sapiens
PTHPPEHPG

SEQ ID NO: 1024051 - protein, 9 aa, Homo Sapiens
YSWMNLSRR

SEQ ID NO: 1024052 - protein, 9 aa, Homo Sapiens
IPRASIPVI

SEQ ID NO: 1024053 - protein, 9 aa, Homo Sapiens
CTPSGFFMK

SEQ ID NO: 1024054 - protein, 9 aa, Homo Sapiens
FIKDGHWDI

SEQ ID NO: 1024055 - protein, 9 aa, Homo Sapiens
GTRPPLSLS

SEQ ID NO: 1024056 - protein, 9 aa, Homo Sapiens
EREITRERS

SEQ ID NO: 1024057 - protein, 9 aa, Homo Sapiens
LFLSSIILF

SEQ ID NO: 1024058 - protein, 9 aa, Homo Sapiens
GPLIPSLSV

SEQ ID NO: 1024059 - protein, 9 aa, Homo Sapiens
GTFQNDPNW

SEQ ID NO: 1024060 - protein, 9 aa, Homo Sapiens
SRESQKLVG

SEQ ID NO: 1024061 - protein, 9 aa, Homo Sapiens
LAWGVQTFS

SEQ ID NO: 1024062 - protein, 9 aa, Homo Sapiens
KLEEKEDNE

SEQ ID NO: 1024063 - protein, 9 aa, Homo Sapiens
ETFYATKSR

SEQ ID NO: 1024064 - protein, 9 aa, Homo Sapiens
EAWKKPAED

SEQ ID NO: 1024065 - protein, 9 aa, Homo Sapiens
ILEFNSKLG

SEQ ID NO: 1024066 - protein, 9 aa, Homo Sapiens
GNQLSSSIT

SEQ ID NO: 1024067 - protein, 9 aa, Homo Sapiens
KGRVRLWLQ

SEQ ID NO: 1024068 - protein, 9 aa, Homo Sapiens
ATAAGLLGE

SEQ ID NO: 1024069 - protein, 9 aa, Homo Sapiens
PTEEEIKKI

SEQ ID NO: 1024070 - protein, 9 aa, Homo Sapiens
QQDCQKSNH

SEQ ID NO: 1024071 - protein, 9 aa, Homo Sapiens
LSTSPYNTD

SEQ ID NO: 1024072 - protein, 9 aa, Homo Sapiens
VDKAEYMCP

SEQ ID NO: 1024073 - protein, 9 aa, Homo Sapiens
LKKLLTQYF

SEQ ID NO: 1024074 - protein, 9 aa, Homo Sapiens
QVVQTVLSE

SEQ ID NO: 1024075 - protein, 9 aa, Homo Sapiens
LEDDHELED

SEQ ID NO: 1024076 - protein, 9 aa, Homo Sapiens
VYLYPQDPK

SEQ ID NO: 1024077 - protein, 9 aa, Homo Sapiens
LPGAFSLGG

SEQ ID NO: 1024078 - protein, 9 aa, Homo Sapiens
KEEEGLEEC

SEQ ID NO: 1024079 - protein, 9 aa, Homo Sapiens
LLKSKFCHQ

SEQ ID NO: 1024080 - protein, 9 aa, Homo Sapiens
LIYLLFIHH

SEQ ID NO: 1024081 - protein, 9 aa, Homo Sapiens
DCACLSGFE

SEQ ID NO: 1024082 - protein, 9 aa, Homo Sapiens
ILNLKDNRN

SEQ ID NO: 1024083 - protein, 9 aa, Homo Sapiens
RAMWKQHKA

SEQ ID NO: 1024084 - protein, 9 aa, Homo Sapiens
PFYYLFDGQ

SEQ ID NO: 1024085 - protein, 9 aa, Homo Sapiens
DEKEGEHEE

SEQ ID NO: 1024086 - protein, 9 aa, Homo Sapiens
AINFYDKIR

SEQ ID NO: 1024087 - protein, 9 aa, Homo Sapiens
CGPGEELYL

SEQ ID NO: 1024088 - protein, 9 aa, Homo Sapiens
MGEQQSARK

SEQ ID NO: 1024089 - protein, 9 aa, Homo Sapiens
SFLADQLDL

SEQ ID NO: 1024090 - protein, 9 aa, Homo Sapiens
PGTKGERGK

SEQ ID NO: 1024091 - protein, 9 aa, Homo Sapiens
GPRPPRFTL

SEQ ID NO: 1024092 - protein, 9 aa, Homo Sapiens
ELVLEDQVA

SEQ ID NO: 1024093 - protein, 9 aa, Homo Sapiens
TCKAGVEEV

SEQ ID NO: 1024094 - protein, 9 aa, Homo Sapiens
FTNYRQPPL

SEQ ID NO: 1024095 - protein, 9 aa, Homo Sapiens
SQIFQLHMK

SEQ ID NO: 1024096 - protein, 9 aa, Homo Sapiens
YCGSRKIAH

SEQ ID NO: 1024097 - protein, 9 aa, Homo Sapiens
EHELLKKKC

SEQ ID NO: 1024098 - protein, 9 aa, Homo Sapiens
LSKEEPVNT

SEQ ID NO: 1024099 - protein, 9 aa, Homo Sapiens
WNSEDSSNF

SEQ ID NO: 1024100 - protein, 9 aa, Homo Sapiens
LLPYPSEVC

SEQ ID NO: 1024101 - protein, 9 aa, Homo Sapiens
PVTFFNGYN

SEQ ID NO: 1024102 - protein, 9 aa, Homo Sapiens
RQVIGLFRR

SEQ ID NO: 1024103 - protein, 9 aa, Homo Sapiens
EEDGSQSLS

SEQ ID NO: 1024104 - protein, 9 aa, Homo Sapiens
QDPSFGDPA

SEQ ID NO: 1024105 - protein, 9 aa, Homo Sapiens
TLTQAQTCD

SEQ ID NO: 1024106 - protein, 9 aa, Homo Sapiens
GVLMWKIFT

SEQ ID NO: 1024107 - protein, 9 aa, Homo Sapiens
PSQVFLPAK

SEQ ID NO: 1024108 - protein, 9 aa, Homo Sapiens
AFMNLTLMA

SEQ ID NO: 1024109 - protein, 9 aa, Homo Sapiens
SIFENDPFW

SEQ ID NO: 1024110 - protein, 9 aa, Homo Sapiens
RMEDVIAEL

SEQ ID NO: 1024111 - protein, 9 aa, Homo Sapiens
FSPLRQRQN

SEQ ID NO: 1024112 - protein, 9 aa, Homo Sapiens
QIPPCPGRL

SEQ ID NO: 1024113 - protein, 9 aa, Homo Sapiens
SELPLVVED

SEQ ID NO: 1024114 - protein, 9 aa, Homo Sapiens
NQHKKIYTG

SEQ ID NO: 1024115 - protein, 9 aa, Homo Sapiens
SLCVLVPCT

SEQ ID NO: 1024116 - protein, 9 aa, Homo Sapiens
EVLLGIKVQ

SEQ ID NO: 1024117 - protein, 9 aa, Homo Sapiens
SPKSTVERF

SEQ ID NO: 1024118 - protein, 9 aa, Homo Sapiens
HRNKETFSC

SEQ ID NO: 1024119 - protein, 9 aa, Homo Sapiens
SVFTNSTYT

SEQ ID NO: 1024120 - protein, 9 aa, Homo Sapiens
KRKKMETML

SEQ ID NO: 1024121 - protein, 9 aa, Homo Sapiens
AKAHARLED

SEQ ID NO: 1024122 - protein, 9 aa, Homo Sapiens
TSGISSERL

SEQ ID NO: 1024123 - protein, 9 aa, Homo Sapiens
SPRDSVSVV

SEQ ID NO: 1024124 - protein, 9 aa, Homo Sapiens
SLALLLQIL

SEQ ID NO: 1024125 - protein, 9 aa, Homo Sapiens
RITVTGNRL

SEQ ID NO: 1024126 - protein, 9 aa, Homo Sapiens
TLTEIRSIK

SEQ ID NO: 1024127 - protein, 9 aa, Homo Sapiens
CILYLSNNK

SEQ ID NO: 1024128 - protein, 9 aa, Homo Sapiens
LKMINFFST

SEQ ID NO: 1024129 - protein, 9 aa, Homo Sapiens
FPPELTVHV

SEQ ID NO: 1024130 - protein, 9 aa, Homo Sapiens
GHICGAFLI

SEQ ID NO: 1024131 - protein, 9 aa, Homo Sapiens
PLSTVTEIL

SEQ ID NO: 1024132 - protein, 9 aa, Homo Sapiens
LQEEDSLTV

SEQ ID NO: 1024133 - protein, 9 aa, Homo Sapiens
KEKMRRQEE

SEQ ID NO: 1024134 - protein, 9 aa, Homo Sapiens
ALGPERRKF

SEQ ID NO: 1024135 - protein, 9 aa, Homo Sapiens
AEKLADTVV

SEQ ID NO: 1024136 - protein, 9 aa, Homo Sapiens
FSGNQLSSS

SEQ ID NO: 1024137 - protein, 9 aa, Homo Sapiens
TFSPHKHVS

SEQ ID NO: 1024138 - protein, 9 aa, Homo Sapiens
SEPTADVNY

SEQ ID NO: 1024139 - protein, 9 aa, Homo Sapiens
MADRAKANP

SEQ ID NO: 1024140 - protein, 9 aa, Homo Sapiens
WCEIEPCLE

SEQ ID NO: 1024141 - protein, 9 aa, Homo Sapiens
LGISCINFG

SEQ ID NO: 1024142 - protein, 9 aa, Homo Sapiens
YCNKFCDRE

SEQ ID NO: 1024143 - protein, 9 aa, Homo Sapiens
KNIRLTQIL

SEQ ID NO: 1024144 - protein, 9 aa, Homo Sapiens
LNAYRKVQK

SEQ ID NO: 1024145 - protein, 9 aa, Homo Sapiens
CTEKLYKED

SEQ ID NO: 1024146 - protein, 9 aa, Homo Sapiens
ICGAFLISP

SEQ ID NO: 1024147 - protein, 9 aa, Homo Sapiens
STCAFHFIA

SEQ ID NO: 1024148 - protein, 9 aa, Homo Sapiens
CEIKPPFKP

SEQ ID NO: 1024149 - protein, 9 aa, Homo Sapiens
RVIFGEENK

SEQ ID NO: 1024150 - protein, 9 aa, Homo Sapiens
HLQNNYNLG

SEQ ID NO: 1024151 - protein, 9 aa, Homo Sapiens
GSSCLPSPP

SEQ ID NO: 1024152 - protein, 9 aa, Homo Sapiens
PESRAFGLP

SEQ ID NO: 1024153 - protein, 9 aa, Homo Sapiens
DEVVLLPQS

SEQ ID NO: 1024154 - protein, 9 aa, Homo Sapiens
LKEHWDYLL

SEQ ID NO: 1024155 - protein, 9 aa, Homo Sapiens
KVVRTTTRY

SEQ ID NO: 1024156 - protein, 9 aa, Homo Sapiens
NSSERARFI

SEQ ID NO: 1024157 - protein, 9 aa, Homo Sapiens
HYNGWIWSH

SEQ ID NO: 1024158 - protein, 9 aa, Homo Sapiens
FAPCSPPSV

SEQ ID NO: 1024159 - protein, 9 aa, Homo Sapiens
VSAVEPEPE

SEQ ID NO: 1024160 - protein, 9 aa, Homo Sapiens
CNCELLWLQ

SEQ ID NO: 1024161 - protein, 9 aa, Homo Sapiens
FLGFSSFEK

SEQ ID NO: 1024162 - protein, 9 aa, Homo Sapiens
LDPKGTFQN

SEQ ID NO: 1024163 - protein, 9 aa, Homo Sapiens
SSCCSVSSE

SEQ ID NO: 1024164 - protein, 9 aa, Homo Sapiens
PLDWRPECK

SEQ ID NO: 1024165 - protein, 9 aa, Homo Sapiens
LVLRDYMIS

SEQ ID NO: 1024166 - protein, 9 aa, Homo Sapiens
KSGTNQSSL

SEQ ID NO: 1024167 - protein, 9 aa, Homo Sapiens
ITNICVPSV

SEQ ID NO: 1024168 - protein, 9 aa, Homo Sapiens
ATFEKTIRQ

SEQ ID NO: 1024169 - protein, 9 aa, Homo Sapiens
ASIPVIPDT

SEQ ID NO: 1024170 - protein, 9 aa, Homo Sapiens
SSEGCCGSS

SEQ ID NO: 1024171 - protein, 9 aa, Homo Sapiens
RNANYVQEV

SEQ ID NO: 1024172 - protein, 9 aa, Homo Sapiens
GGDFRNPLR

SEQ ID NO: 1024173 - protein, 9 aa, Homo Sapiens
GASRCPRGS

SEQ ID NO: 1024174 - protein, 9 aa, Homo Sapiens
QSSEGRQKA

SEQ ID NO: 1024175 - protein, 9 aa, Homo Sapiens
IFEGKPNVF

SEQ ID NO: 1024176 - protein, 9 aa, Homo Sapiens
EDDDKWCPK

SEQ ID NO: 1024177 - protein, 9 aa, Homo Sapiens
SFQQLPTCS

SEQ ID NO: 1024178 - protein, 9 aa, Homo Sapiens
YKVCHANSS

SEQ ID NO: 1024179 - protein, 9 aa, Homo Sapiens
RERSRKGSE

SEQ ID NO: 1024180 - protein, 9 aa, Homo Sapiens
AKERRNQRK

SEQ ID NO: 1024181 - protein, 9 aa, Homo Sapiens
MMWEKEKMR

SEQ ID NO: 1024182 - protein, 9 aa, Homo Sapiens
HSEDILNTA

SEQ ID NO: 1024183 - protein, 9 aa, Homo Sapiens
NLGIQHDHL

SEQ ID NO: 1024184 - protein, 9 aa, Homo Sapiens
TGLLGFHFT

SEQ ID NO: 1024185 - protein, 9 aa, Homo Sapiens
SLSTQKLEE

SEQ ID NO: 1024186 - protein, 9 aa, Homo Sapiens
SPPNKPGAF

SEQ ID NO: 1024187 - protein, 9 aa, Homo Sapiens
SENSDNGKE

SEQ ID NO: 1024188 - protein, 9 aa, Homo Sapiens
NFSGGNDGH

SEQ ID NO: 1024189 - protein, 9 aa, Homo Sapiens
GTYDAGIDI

SEQ ID NO: 1024190 - protein, 9 aa, Homo Sapiens
NLDSDVPLQ

SEQ ID NO: 1024191 - protein, 9 aa, Homo Sapiens
EEVSELPLV

SEQ ID NO: 1024192 - protein, 9 aa, Homo Sapiens
SLDGLNLTD

SEQ ID NO: 1024193 - protein, 9 aa, Homo Sapiens
FSTWIFEGK

SEQ ID NO: 1024194 - protein, 9 aa, Homo Sapiens
ATTVLFSAT

SEQ ID NO: 1024195 - protein, 9 aa, Homo Sapiens
DNVATAAGL

SEQ ID NO: 1024196 - protein, 9 aa, Homo Sapiens
KTLRERITV

SEQ ID NO: 1024197 - protein, 9 aa, Homo Sapiens
DDLEREIKK

SEQ ID NO: 1024198 - protein, 9 aa, Homo Sapiens
VDETGVDFK

SEQ ID NO: 1024199 - protein, 9 aa, Homo Sapiens
FRNKPSGIT

SEQ ID NO: 1024200 - protein, 9 aa, Homo Sapiens
QGLFYPARK

SEQ ID NO: 1024201 - protein, 9 aa, Homo Sapiens
MFKLDKFLI

SEQ ID NO: 1024202 - protein, 9 aa, Homo Sapiens
LRKKHCVFD

SEQ ID NO: 1024203 - protein, 9 aa, Homo Sapiens
DGEELRVIS

SEQ ID NO: 1024204 - protein, 9 aa, Homo Sapiens
SSNTSPYFV

SEQ ID NO: 1024205 - protein, 9 aa, Homo Sapiens
NLMQQRISS

SEQ ID NO: 1024206 - protein, 9 aa, Homo Sapiens
KEKEQIKSL

SEQ ID NO: 1024207 - protein, 9 aa, Homo Sapiens
YVLDFGKDA

SEQ ID NO: 1024208 - protein, 9 aa, Homo Sapiens
GKEGRLGIP

SEQ ID NO: 1024209 - protein, 9 aa, Homo Sapiens
KYLKKNRNR

SEQ ID NO: 1024210 - protein, 9 aa, Homo Sapiens
SKPVADGGW

SEQ ID NO: 1024211 - protein, 9 aa, Homo Sapiens
VTSQPQTPV

SEQ ID NO: 1024212 - protein, 9 aa, Homo Sapiens
ALPKNLTVV

SEQ ID NO: 1024213 - protein, 9 aa, Homo Sapiens
LLYFFYNVI

SEQ ID NO: 1024214 - protein, 9 aa, Homo Sapiens
EEAGFSSSP

SEQ ID NO: 1024215 - protein, 9 aa, Homo Sapiens
TLLYIFHYD

SEQ ID NO: 1024216 - protein, 9 aa, Homo Sapiens
LGPMLEAYS

SEQ ID NO: 1024217 - protein, 9 aa, Homo Sapiens
YLEETNFLP

SEQ ID NO: 1024218 - protein, 9 aa, Homo Sapiens
MIGSLELGP

SEQ ID NO: 1024219 - protein, 9 aa, Homo Sapiens
EPLVSITIN

SEQ ID NO: 1024220 - protein, 9 aa, Homo Sapiens
NQGPLENHT

SEQ ID NO: 1024221 - protein, 9 aa, Homo Sapiens
DWAEPRDSS

SEQ ID NO: 1024222 - protein, 9 aa, Homo Sapiens
LGYRRTNHD

SEQ ID NO: 1024223 - protein, 9 aa, Homo Sapiens
QESVTVQES

SEQ ID NO: 1024224 - protein, 9 aa, Homo Sapiens
WHPTTGAQP

SEQ ID NO: 1024225 - protein, 9 aa, Homo Sapiens
HNETKPCNS

SEQ ID NO: 1024226 - protein, 9 aa, Homo Sapiens
DWVPLSPGI

SEQ ID NO: 1024227 - protein, 9 aa, Homo Sapiens
AALATSEVE

SEQ ID NO: 1024228 - protein, 9 aa, Homo Sapiens
NEDDARSYW

SEQ ID NO: 1024229 - protein, 9 aa, Homo Sapiens
IITAALRRA

SEQ ID NO: 1024230 - protein, 9 aa, Homo Sapiens
AGVPFYSAI

SEQ ID NO: 1024231 - protein, 9 aa, Homo Sapiens
EQQKSDSSF

SEQ ID NO: 1024232 - protein, 9 aa, Homo Sapiens
EKTTLSSAE

SEQ ID NO: 1024233 - protein, 9 aa, Homo Sapiens
RVLKPKTKR

SEQ ID NO: 1024234 - protein, 9 aa, Homo Sapiens
SHSELSTRA

SEQ ID NO: 1024235 - protein, 9 aa, Homo Sapiens
STQKLEEAG

SEQ ID NO: 1024236 - protein, 9 aa, Homo Sapiens
RLPEFVDRL

SEQ ID NO: 1024237 - protein, 9 aa, Homo Sapiens
APNKEEVFD

SEQ ID NO: 1024238 - protein, 9 aa, Homo Sapiens
KRITTLYMT

SEQ ID NO: 1024239 - protein, 9 aa, Homo Sapiens
RDHPSRHQY

SEQ ID NO: 1024240 - protein, 9 aa, Homo Sapiens
SVYGLQNNI

SEQ ID NO: 1024241 - protein, 9 aa, Homo Sapiens
MLKEKPSNE

SEQ ID NO: 1024242 - protein, 9 aa, Homo Sapiens
AEDDVEKNE

SEQ ID NO: 1024243 - protein, 9 aa, Homo Sapiens
HFYEQCFKI

SEQ ID NO: 1024244 - protein, 9 aa, Homo Sapiens
SRLYRRKRV

SEQ ID NO: 1024245 - protein, 9 aa, Homo Sapiens
KAGQAEAEG

SEQ ID NO: 1024246 - protein, 9 aa, Homo Sapiens
LCLAIPEGR

SEQ ID NO: 1024247 - protein, 9 aa, Homo Sapiens
IPPFPAKTF

SEQ ID NO: 1024248 - protein, 9 aa, Homo Sapiens
ANSKYIRPQ

SEQ ID NO: 1024249 - protein, 9 aa, Homo Sapiens
VTFHNKERR

SEQ ID NO: 1024250 - protein, 9 aa, Homo Sapiens
KKTHTGENS

SEQ ID NO: 1024251 - protein, 9 aa, Homo Sapiens
AEVRAQYKE

SEQ ID NO: 1024252 - protein, 9 aa, Homo Sapiens
LSGSPGPKG

SEQ ID NO: 1024253 - protein, 9 aa, Homo Sapiens
PFYGEDVSN

SEQ ID NO: 1024254 - protein, 9 aa, Homo Sapiens
EEKMWEQKV

SEQ ID NO: 1024255 - protein, 9 aa, Homo Sapiens
VVISPPLSS

SEQ ID NO: 1024256 - protein, 9 aa, Homo Sapiens
CKAAVLWKL

SEQ ID NO: 1024257 - protein, 9 aa, Homo Sapiens
MWKIFTLGG

SEQ ID NO: 1024258 - protein, 9 aa, Homo Sapiens
CSESASKPK

SEQ ID NO: 1024259 - protein, 9 aa, Homo Sapiens
AENPGCRHQ

SEQ ID NO: 1024260 - protein, 9 aa, Homo Sapiens
PEIYMTWIK

SEQ ID NO: 1024261 - protein, 9 aa, Homo Sapiens
SSEPHPLQD

SEQ ID NO: 1024262 - protein, 9 aa, Homo Sapiens
IEEVSELPL

SEQ ID NO: 1024263 - protein, 9 aa, Homo Sapiens
KVPPVIITE

SEQ ID NO: 1024264 - protein, 9 aa, Homo Sapiens
TVASERVTK

SEQ ID NO: 1024265 - protein, 9 aa, Homo Sapiens
TQKLNQTQS

SEQ ID NO: 1024266 - protein, 9 aa, Homo Sapiens
ERSLQDRLN

SEQ ID NO: 1024267 - protein, 9 aa, Homo Sapiens
SRMEKMTMI

SEQ ID NO: 1024268 - protein, 9 aa, Homo Sapiens
WKYKFSQLK

SEQ ID NO: 1024269 - protein, 9 aa, Homo Sapiens
TKSSKVKAF

SEQ ID NO: 1024270 - protein, 9 aa, Homo Sapiens
GELTMRSYE

SEQ ID NO: 1024271 - protein, 9 aa, Homo Sapiens
NRKTHVNII

SEQ ID NO: 1024272 - protein, 9 aa, Homo Sapiens
RLWLQAEHL

SEQ ID NO: 1024273 - protein, 9 aa, Homo Sapiens
TGVDFKNDV

SEQ ID NO: 1024274 - protein, 9 aa, Homo Sapiens
LGSAIFFSG

SEQ ID NO: 1024275 - protein, 9 aa, Homo Sapiens
AEGAAMRES

SEQ ID NO: 1024276 - protein, 9 aa, Homo Sapiens
LSGGKINSE

SEQ ID NO: 1024277 - protein, 9 aa, Homo Sapiens
SCIDISNNG

SEQ ID NO: 1024278 - protein, 9 aa, Homo Sapiens
LVILKNAAE

SEQ ID NO: 1024279 - protein, 9 aa, Homo Sapiens
SAHPRSWLR

SEQ ID NO: 1024280 - protein, 9 aa, Homo Sapiens
SQGDETLCF

SEQ ID NO: 1024281 - protein, 9 aa, Homo Sapiens
EDQKQPARG

SEQ ID NO: 1024282 - protein, 9 aa, Homo Sapiens
PAGGSKQER

SEQ ID NO: 1024283 - protein, 9 aa, Homo Sapiens
SIPLLIDYL

SEQ ID NO: 1024284 - protein, 9 aa, Homo Sapiens
RAVCCVLER

SEQ ID NO: 1024285 - protein, 9 aa, Homo Sapiens
VERSENTAE

SEQ ID NO: 1024286 - protein, 9 aa, Homo Sapiens
KKKNAMYGN

SEQ ID NO: 1024287 - protein, 9 aa, Homo Sapiens
RRWRGYRVW

SEQ ID NO: 1024288 - protein, 9 aa, Homo Sapiens
VYSPRTSII

SEQ ID NO: 1024289 - protein, 9 aa, Homo Sapiens
KGEKKDRAP

SEQ ID NO: 1024290 - protein, 9 aa, Homo Sapiens
SFPCREQRL

SEQ ID NO: 1024291 - protein, 9 aa, Homo Sapiens
ARKDNVIWL

SEQ ID NO: 1024292 - protein, 9 aa, Homo Sapiens
GEISSCIPC

SEQ ID NO: 1024293 - protein, 9 aa, Homo Sapiens
SVFNDSIIS

SEQ ID NO: 1024294 - protein, 9 aa, Homo Sapiens
KRSPLTTRV

SEQ ID NO: 1024295 - protein, 9 aa, Homo Sapiens
DWKHPKITS

SEQ ID NO: 1024296 - protein, 9 aa, Homo Sapiens
DEDASFSPL

SEQ ID NO: 1024297 - protein, 9 aa, Homo Sapiens
YALPKVING

SEQ ID NO: 1024298 - protein, 9 aa, Homo Sapiens
LLDPSVSQR

SEQ ID NO: 1024299 - protein, 9 aa, Homo Sapiens
GSAKSIYPL

SEQ ID NO: 1024300 - protein, 9 aa, Homo Sapiens
LNLKMKRLA

SEQ ID NO: 1024301 - protein, 9 aa, Homo Sapiens
PSSFPQSTV

SEQ ID NO: 1024302 - protein, 9 aa, Homo Sapiens
PDIIIILQR

SEQ ID NO: 1024303 - protein, 9 aa, Homo Sapiens
SPQPSSSSR

SEQ ID NO: 1024304 - protein, 9 aa, Homo Sapiens
ACLSGFEGQ

SEQ ID NO: 1024305 - protein, 9 aa, Homo Sapiens
YNFVFFGRV

SEQ ID NO: 1024306 - protein, 9 aa, Homo Sapiens
ERDLVNRLK

SEQ ID NO: 1024307 - protein, 9 aa, Homo Sapiens
LPRKKMSSI

SEQ ID NO: 1024308 - protein, 9 aa, Homo Sapiens
EKLGRKDVG

SEQ ID NO: 1024309 - protein, 9 aa, Homo Sapiens
RLSNNMCLK

SEQ ID NO: 1024310 - protein, 9 aa, Homo Sapiens
IKHITAKIN

SEQ ID NO: 1024311 - protein, 9 aa, Homo Sapiens
WIEIANKLP

SEQ ID NO: 1024312 - protein, 9 aa, Homo Sapiens
LLNKPSVGD

SEQ ID NO: 1024313 - protein, 9 aa, Homo Sapiens
PFTNYRQPP

SEQ ID NO: 1024314 - protein, 9 aa, Homo Sapiens
ELHIIQSRG

SEQ ID NO: 1024315 - protein, 9 aa, Homo Sapiens
RYKIFKRGP

SEQ ID NO: 1024316 - protein, 9 aa, Homo Sapiens
VEDVPVEKE

SEQ ID NO: 1024317 - protein, 9 aa, Homo Sapiens
QLRGAECCL

SEQ ID NO: 1024318 - protein, 9 aa, Homo Sapiens
ILEAGAFRE

SEQ ID NO: 1024319 - protein, 9 aa, Homo Sapiens
DKVISVTRS

SEQ ID NO: 1024320 - protein, 9 aa, Homo Sapiens
QWRQQMLFG

SEQ ID NO: 1024321 - protein, 9 aa, Homo Sapiens
SFLDLQNLR

SEQ ID NO: 1024322 - protein, 9 aa, Homo Sapiens
RPQIQYFFS

SEQ ID NO: 1024323 - protein, 9 aa, Homo Sapiens
EQEKAEDDV

SEQ ID NO: 1024324 - protein, 9 aa, Homo Sapiens
TKPCNSVLR

SEQ ID NO: 1024325 - protein, 9 aa, Homo Sapiens
AANSKLVKP

SEQ ID NO: 1024326 - protein, 9 aa, Homo Sapiens
RGLCRAFMN

SEQ ID NO: 1024327 - protein, 9 aa, Homo Sapiens
FGDLKKLLT

SEQ ID NO: 1024328 - protein, 9 aa, Homo Sapiens
FQLDWPLPS

SEQ ID NO: 1024329 - protein, 9 aa, Homo Sapiens
FCIQFQKKS

SEQ ID NO: 1024330 - protein, 9 aa, Homo Sapiens
GLLSGGGTT

SEQ ID NO: 1024331 - protein, 9 aa, Homo Sapiens
ASTVLFMMP

SEQ ID NO: 1024332 - protein, 9 aa, Homo Sapiens
VISDSHLYT

SEQ ID NO: 1024333 - protein, 9 aa, Homo Sapiens
NLSFRKEDC

SEQ ID NO: 1024334 - protein, 9 aa, Homo Sapiens
WLGLIICPI

SEQ ID NO: 1024335 - protein, 9 aa, Homo Sapiens
EKGFCYKGS

SEQ ID NO: 1024336 - protein, 9 aa, Homo Sapiens
PSKTGEEQG

SEQ ID NO: 1024337 - protein, 9 aa, Homo Sapiens
WNVLESQRK

SEQ ID NO: 1024338 - protein, 9 aa, Homo Sapiens
SCTRNCMSF

SEQ ID NO: 1024339 - protein, 9 aa, Homo Sapiens
RAEKAGQAE

SEQ ID NO: 1024340 - protein, 9 aa, Homo Sapiens
ETAVCNNGA

SEQ ID NO: 1024341 - protein, 9 aa, Homo Sapiens
GNLGKDSEE

SEQ ID NO: 1024342 - protein, 9 aa, Homo Sapiens
ASHNLEGTV

SEQ ID NO: 1024343 - protein, 9 aa, Homo Sapiens
CYKKSCHDR

SEQ ID NO: 1024344 - protein, 9 aa, Homo Sapiens
KDNRNHLVP

SEQ ID NO: 1024345 - protein, 9 aa, Homo Sapiens
IIFLIYQGS

SEQ ID NO: 1024346 - protein, 9 aa, Homo Sapiens
MGSAYGFCT

SEQ ID NO: 1024347 - protein, 9 aa, Homo Sapiens
SQQGMNVAL

SEQ ID NO: 1024348 - protein, 9 aa, Homo Sapiens
QNKEVETSS

SEQ ID NO: 1024349 - protein, 9 aa, Homo Sapiens
VSEKSWNQA

SEQ ID NO: 1024350 - protein, 9 aa, Homo Sapiens
RRKTTRMLM

SEQ ID NO: 1024351 - protein, 9 aa, Homo Sapiens
TSCINSFTV

SEQ ID NO: 1024352 - protein, 9 aa, Homo Sapiens
RHLVMEMTN

SEQ ID NO: 1024353 - protein, 9 aa, Homo Sapiens
TSWTSVFND

SEQ ID NO: 1024354 - protein, 9 aa, Homo Sapiens
IVAALDASN

SEQ ID NO: 1024355 - protein, 9 aa, Homo Sapiens
WAASTVLFM

SEQ ID NO: 1024356 - protein, 9 aa, Homo Sapiens
PPSLSSPSR

SEQ ID NO: 1024357 - protein, 9 aa, Homo Sapiens
PNKESLALA

SEQ ID NO: 1024358 - protein, 9 aa, Homo Sapiens
EVAVLVGAV

SEQ ID NO: 1024359 - protein, 9 aa, Homo Sapiens
AWNVWAQDS

SEQ ID NO: 1024360 - protein, 9 aa, Homo Sapiens
PPLDWRPEC

SEQ ID NO: 1024361 - protein, 9 aa, Homo Sapiens
LDSLVLLAN

SEQ ID NO: 1024362 - protein, 9 aa, Homo Sapiens
LVDSVVQTV

SEQ ID NO: 1024363 - protein, 9 aa, Homo Sapiens
PLHLEGGYC

SEQ ID NO: 1024364 - protein, 9 aa, Homo Sapiens
KDKQKNRKN

SEQ ID NO: 1024365 - protein, 9 aa, Homo Sapiens
FLLVLDDVN

SEQ ID NO: 1024366 - protein, 9 aa, Homo Sapiens
TASHNLEGT

SEQ ID NO: 1024367 - protein, 9 aa, Homo Sapiens
SQVTFHNKE

SEQ ID NO: 1024368 - protein, 9 aa, Homo Sapiens
ILPISLEKD

SEQ ID NO: 1024369 - protein, 9 aa, Homo Sapiens
RDSLHLCRH

SEQ ID NO: 1024370 - protein, 9 aa, Homo Sapiens
SLFQAQYED

SEQ ID NO: 1024371 - protein, 9 aa, Homo Sapiens
LAEKDKKLR

SEQ ID NO: 1024372 - protein, 9 aa, Homo Sapiens
KRGFCIQFQ

SEQ ID NO: 1024373 - protein, 9 aa, Homo Sapiens
TFFSFSSDF

SEQ ID NO: 1024374 - protein, 9 aa, Homo Sapiens
QTQTSEPAF

SEQ ID NO: 1024375 - protein, 9 aa, Homo Sapiens
IFGDLKKLL

SEQ ID NO: 1024376 - protein, 9 aa, Homo Sapiens
LTPLQVELM

SEQ ID NO: 1024377 - protein, 9 aa, Homo Sapiens
LLFYYTQYS

SEQ ID NO: 1024378 - protein, 9 aa, Homo Sapiens
SLSDHWLLW

SEQ ID NO: 1024379 - protein, 9 aa, Homo Sapiens
FTGSHSELS

SEQ ID NO: 1024380 - protein, 9 aa, Homo Sapiens
WNQARDLSW

SEQ ID NO: 1024381 - protein, 9 aa, Homo Sapiens
FYAVDEEGE

SEQ ID NO: 1024382 - protein, 9 aa, Homo Sapiens
SSSKSLERK

SEQ ID NO: 1024383 - protein, 9 aa, Homo Sapiens
VELHIIQSR

SEQ ID NO: 1024384 - protein, 9 aa, Homo Sapiens
QNTRPLVYV

SEQ ID NO: 1024385 - protein, 9 aa, Homo Sapiens
QYFFDRDSD

SEQ ID NO: 1024386 - protein, 9 aa, Homo Sapiens
GAHGESSLA

SEQ ID NO: 1024387 - protein, 9 aa, Homo Sapiens
NVWFLALES

SEQ ID NO: 1024388 - protein, 9 aa, Homo Sapiens
NGSGDMYPR

SEQ ID NO: 1024389 - protein, 9 aa, Homo Sapiens
RKREYKNEL

SEQ ID NO: 1024390 - protein, 9 aa, Homo Sapiens
DMDTDRGGW

SEQ ID NO: 1024391 - protein, 9 aa, Homo Sapiens
ACSWSTGMQ

SEQ ID NO: 1024392 - protein, 9 aa, Homo Sapiens
HRREQKVPP

SEQ ID NO: 1024393 - protein, 9 aa, Homo Sapiens
SFLLSLKKK

SEQ ID NO: 1024394 - protein, 9 aa, Homo Sapiens
EYTLGLWKT

SEQ ID NO: 1024395 - protein, 9 aa, Homo Sapiens
GDRRFEKLG

SEQ ID NO: 1024396 - protein, 9 aa, Homo Sapiens
GFISHQPTS

SEQ ID NO: 1024397 - protein, 9 aa, Homo Sapiens
KAEYMCPDG

SEQ ID NO: 1024398 - protein, 9 aa, Homo Sapiens
EECDIVDSH

SEQ ID NO: 1024399 - protein, 9 aa, Homo Sapiens
GQILASVAQ

SEQ ID NO: 1024400 - protein, 9 aa, Homo Sapiens
VQKVSSDGG

SEQ ID NO: 1024401 - protein, 9 aa, Homo Sapiens
EKLEEKEDN

SEQ ID NO: 1024402 - protein, 9 aa, Homo Sapiens
NQECTLRIS

SEQ ID NO: 1024403 - protein, 9 aa, Homo Sapiens
NHGDFDVAL

SEQ ID NO: 1024404 - protein, 9 aa, Homo Sapiens
SKFCHQGLA

SEQ ID NO: 1024405 - protein, 9 aa, Homo Sapiens
LVGKEALCK

SEQ ID NO: 1024406 - protein, 9 aa, Homo Sapiens
YYDPHPYRR

SEQ ID NO: 1024407 - protein, 9 aa, Homo Sapiens
EEDSLTVPT

SEQ ID NO: 1024408 - protein, 9 aa, Homo Sapiens
LQPSYLAKD

SEQ ID NO: 1024409 - protein, 9 aa, Homo Sapiens
RILVSERSK

SEQ ID NO: 1024410 - protein, 9 aa, Homo Sapiens
WDTAFGHSQ

SEQ ID NO: 1024411 - protein, 9 aa, Homo Sapiens
ADNLGMGGT

SEQ ID NO: 1024412 - protein, 9 aa, Homo Sapiens
LFPRLSNNM

SEQ ID NO: 1024413 - protein, 9 aa, Homo Sapiens
LKCSTLGMD

SEQ ID NO: 1024414 - protein, 9 aa, Homo Sapiens
ERKLATPDW

SEQ ID NO: 1024415 - protein, 9 aa, Homo Sapiens
FAFYQQGTY

SEQ ID NO: 1024416 - protein, 9 aa, Homo Sapiens
STVLFMMPT

SEQ ID NO: 1024417 - protein, 9 aa, Homo Sapiens
HKAMGHRSE

SEQ ID NO: 1024418 - protein, 9 aa, Homo Sapiens
SQRAAYSPE

SEQ ID NO: 1024419 - protein, 9 aa, Homo Sapiens
ILLRLTDDP

SEQ ID NO: 1024420 - protein, 9 aa, Homo Sapiens
MGLKIHFNF

SEQ ID NO: 1024421 - protein, 9 aa, Homo Sapiens
LTQKLQEKP

SEQ ID NO: 1024422 - protein, 9 aa, Homo Sapiens
DGYINEDDL

SEQ ID NO: 1024423 - protein, 9 aa, Homo Sapiens
HPDLEVADY

SEQ ID NO: 1024424 - protein, 9 aa, Homo Sapiens
IGSLELGPE

SEQ ID NO: 1024425 - protein, 9 aa, Homo Sapiens
KSLAKAHAR

SEQ ID NO: 1024426 - protein, 9 aa, Homo Sapiens
PLQPLPSSP

SEQ ID NO: 1024427 - protein, 9 aa, Homo Sapiens
TKRKKMETM

SEQ ID NO: 1024428 - protein, 9 aa, Homo Sapiens
FTLETLNIR

SEQ ID NO: 1024429 - protein, 9 aa, Homo Sapiens
VKPLRAMWK

SEQ ID NO: 1024430 - protein, 9 aa, Homo Sapiens
VISCTHRFH

SEQ ID NO: 1024431 - protein, 9 aa, Homo Sapiens
AVCNNGAGH

SEQ ID NO: 1024432 - protein, 9 aa, Homo Sapiens
SEVEASLEI

SEQ ID NO: 1024433 - protein, 9 aa, Homo Sapiens
EGEAGQRLR

SEQ ID NO: 1024434 - protein, 9 aa, Homo Sapiens
SGSPQETVP

SEQ ID NO: 1024435 - protein, 9 aa, Homo Sapiens
GIMAFDRYV

SEQ ID NO: 1024436 - protein, 9 aa, Homo Sapiens
LGFSSFEKH

SEQ ID NO: 1024437 - protein, 9 aa, Homo Sapiens
PTKEIQAVD

SEQ ID NO: 1024438 - protein, 9 aa, Homo Sapiens
IIFSLRNKK

SEQ ID NO: 1024439 - protein, 9 aa, Homo Sapiens
SPNDLSASQ

SEQ ID NO: 1024440 - protein, 9 aa, Homo Sapiens
IFTNAQDPG

SEQ ID NO: 1024441 - protein, 9 aa, Homo Sapiens
SSGATEDYS

SEQ ID NO: 1024442 - protein, 9 aa, Homo Sapiens
ESPCKGGTT

SEQ ID NO: 1024443 - protein, 9 aa, Homo Sapiens
SSPQAAPQP

SEQ ID NO: 1024444 - protein, 9 aa, Homo Sapiens
FAEKLADTV

SEQ ID NO: 1024445 - protein, 9 aa, Homo Sapiens
KSQKKLKNQ

SEQ ID NO: 1024446 - protein, 9 aa, Homo Sapiens
KCVTEYQES

SEQ ID NO: 1024447 - protein, 9 aa, Homo Sapiens
TELLLKINR

SEQ ID NO: 1024448 - protein, 9 aa, Homo Sapiens
EENELVGSN

SEQ ID NO: 1024449 - protein, 9 aa, Homo Sapiens
LRIDLRLCP

SEQ ID NO: 1024450 - protein, 9 aa, Homo Sapiens
SRRAKRTTP

SEQ ID NO: 1024451 - protein, 9 aa, Homo Sapiens
YGSWQVLDA

SEQ ID NO: 1024452 - protein, 9 aa, Homo Sapiens
NDVTQGCLV

SEQ ID NO: 1024453 - protein, 9 aa, Homo Sapiens
FYPSKFIQK

SEQ ID NO: 1024454 - protein, 9 aa, Homo Sapiens
SSFLFTIEG

SEQ ID NO: 1024455 - protein, 9 aa, Homo Sapiens
GNPSNYNNK

SEQ ID NO: 1024456 - protein, 9 aa, Homo Sapiens
VATAAGLLG

SEQ ID NO: 1024457 - protein, 9 aa, Homo Sapiens
NSKGLAGLG

SEQ ID NO: 1024458 - protein, 9 aa, Homo Sapiens
KACGCNLAE

SEQ ID NO: 1024459 - protein, 9 aa, Homo Sapiens
LTVKTIHEG

SEQ ID NO: 1024460 - protein, 9 aa, Homo Sapiens
LLVNFFVLL

SEQ ID NO: 1024461 - protein, 9 aa, Homo Sapiens
SSVSLLLHL

SEQ ID NO: 1024462 - protein, 9 aa, Homo Sapiens
LLAGLFSLF

SEQ ID NO: 1024463 - protein, 9 aa, Homo Sapiens
PCSCLERVQ

SEQ ID NO: 1024464 - protein, 9 aa, Homo Sapiens
GPMLEAYSS

SEQ ID NO: 1024465 - protein, 9 aa, Homo Sapiens
KRKSQKKLK

SEQ ID NO: 1024466 - protein, 9 aa, Homo Sapiens
LFRQMLSGA

SEQ ID NO: 1024467 - protein, 9 aa, Homo Sapiens
PFTCLSLGS

SEQ ID NO: 1024468 - protein, 9 aa, Homo Sapiens
SAIIPQMLV

SEQ ID NO: 1024469 - protein, 9 aa, Homo Sapiens
QHKKIYTGE

SEQ ID NO: 1024470 - protein, 9 aa, Homo Sapiens
GGKINSETV

SEQ ID NO: 1024471 - protein, 9 aa, Homo Sapiens
FGDPAVSAL

SEQ ID NO: 1024472 - protein, 9 aa, Homo Sapiens
TVFGASLDY

SEQ ID NO: 1024473 - protein, 9 aa, Homo Sapiens
REGIFCSGS

SEQ ID NO: 1024474 - protein, 9 aa, Homo Sapiens
TIPIMGFVA

SEQ ID NO: 1024475 - protein, 9 aa, Homo Sapiens
ASFSTEESS

SEQ ID NO: 1024476 - protein, 9 aa, Homo Sapiens
TSPYFVQQR

SEQ ID NO: 1024477 - protein, 9 aa, Homo Sapiens
SAGSAALTP

SEQ ID NO: 1024478 - protein, 9 aa, Homo Sapiens
PTPPDYYSE

SEQ ID NO: 1024479 - protein, 9 aa, Homo Sapiens
RQCNNPLPQ

SEQ ID NO: 1024480 - protein, 9 aa, Homo Sapiens
INSHFLPRA

SEQ ID NO: 1024481 - protein, 9 aa, Homo Sapiens
PGLSGSPGP

SEQ ID NO: 1024482 - protein, 9 aa, Homo Sapiens
TPKKGEVQD

SEQ ID NO: 1024483 - protein, 9 aa, Homo Sapiens
RLNLQLFDE

SEQ ID NO: 1024484 - protein, 9 aa, Homo Sapiens
YGEKMAVVT

SEQ ID NO: 1024485 - protein, 9 aa, Homo Sapiens
STTLWALLP

SEQ ID NO: 1024486 - protein, 9 aa, Homo Sapiens
PKGTFQNDP

SEQ ID NO: 1024487 - protein, 9 aa, Homo Sapiens
ISEDLRSFQ

SEQ ID NO: 1024488 - protein, 9 aa, Homo Sapiens
FQQLPTCSP

SEQ ID NO: 1024489 - protein, 9 aa, Homo Sapiens
ETPWEAEAE

SEQ ID NO: 1024490 - protein, 9 aa, Homo Sapiens
EVKIKKQSN

SEQ ID NO: 1024491 - protein, 9 aa, Homo Sapiens
QLSASCLPP

SEQ ID NO: 1024492 - protein, 9 aa, Homo Sapiens
GGRTETKLA

SEQ ID NO: 1024493 - protein, 9 aa, Homo Sapiens
SKPKRLRAS

SEQ ID NO: 1024494 - protein, 9 aa, Homo Sapiens
LQTFYTHQE

SEQ ID NO: 1024495 - protein, 9 aa, Homo Sapiens
NNASTENQN

SEQ ID NO: 1024496 - protein, 9 aa, Homo Sapiens
RIKFGQNDA

SEQ ID NO: 1024497 - protein, 9 aa, Homo Sapiens
PYFVQQRAG

SEQ ID NO: 1024498 - protein, 9 aa, Homo Sapiens
SPERNQDEL

SEQ ID NO: 1024499 - protein, 9 aa, Homo Sapiens
PFDIKGIED

SEQ ID NO: 1024500 - protein, 9 aa, Homo Sapiens
PNFLEKLPD

SEQ ID NO: 1024501 - protein, 9 aa, Homo Sapiens
GWNKQLRRV

SEQ ID NO: 1024502 - protein, 9 aa, Homo Sapiens
DNVHTAARV

SEQ ID NO: 1024503 - protein, 9 aa, Homo Sapiens
NCANEKLQQ

SEQ ID NO: 1024504 - protein, 9 aa, Homo Sapiens
KIGDVGVQL

SEQ ID NO: 1024505 - protein, 9 aa, Homo Sapiens
LGNPISTKN

SEQ ID NO: 1024506 - protein, 9 aa, Homo Sapiens
LCMDDVELL

SEQ ID NO: 1024507 - protein, 9 aa, Homo Sapiens
PPEPPRIPP

SEQ ID NO: 1024508 - protein, 9 aa, Homo Sapiens
EKKEYFYKY

SEQ ID NO: 1024509 - protein, 9 aa, Homo Sapiens
PWLLNIKYL

SEQ ID NO: 1024510 - protein, 9 aa, Homo Sapiens
CVTEYQESC

SEQ ID NO: 1024511 - protein, 9 aa, Homo Sapiens
KRMEDVIAE

SEQ ID NO: 1024512 - protein, 9 aa, Homo Sapiens
VTATFGYSF

SEQ ID NO: 1024513 - protein, 9 aa, Homo Sapiens
KVYPEKNVM

SEQ ID NO: 1024514 - protein, 9 aa, Homo Sapiens
YEQCFKIAQ

SEQ ID NO: 1024515 - protein, 9 aa, Homo Sapiens
YRRKGCVDD

SEQ ID NO: 1024516 - protein, 9 aa, Homo Sapiens
ANLFLAKYR

SEQ ID NO: 1024517 - protein, 9 aa, Homo Sapiens
YLSNGTLAG

SEQ ID NO: 1024518 - protein, 9 aa, Homo Sapiens
SQISGVKKF

SEQ ID NO: 1024519 - protein, 9 aa, Homo Sapiens
SPKGHIIPQ

SEQ ID NO: 1024520 - protein, 9 aa, Homo Sapiens
STTPAAPGL

SEQ ID NO: 1024521 - protein, 9 aa, Homo Sapiens
PGRPGLPEA

SEQ ID NO: 1024522 - protein, 9 aa, Homo Sapiens
DFMGAMFFG

SEQ ID NO: 1024523 - protein, 9 aa, Homo Sapiens
ILAIQQLEN

SEQ ID NO: 1024524 - protein, 9 aa, Homo Sapiens
SLMMNWLAN

SEQ ID NO: 1024525 - protein, 9 aa, Homo Sapiens
CLPSPPEIS

SEQ ID NO: 1024526 - protein, 9 aa, Homo Sapiens
SQLEEPAGP

SEQ ID NO: 1024527 - protein, 9 aa, Homo Sapiens
SRAFGLPLG

SEQ ID NO: 1024528 - protein, 9 aa, Homo Sapiens
ASLDYFSPR

SEQ ID NO: 1024529 - protein, 9 aa, Homo Sapiens
FFLQGQLND

SEQ ID NO: 1024530 - protein, 9 aa, Homo Sapiens
RQMLSGAIP

SEQ ID NO: 1024531 - protein, 9 aa, Homo Sapiens
EKDSSHSGK

SEQ ID NO: 1024532 - protein, 9 aa, Homo Sapiens
GCFQSEWVG

SEQ ID NO: 1024533 - protein, 9 aa, Homo Sapiens
KIRQDQKLI

SEQ ID NO: 1024534 - protein, 9 aa, Homo Sapiens
HLVTGQPSQ

SEQ ID NO: 1024535 - protein, 9 aa, Homo Sapiens
QLCINCANE

SEQ ID NO: 1024536 - protein, 9 aa, Homo Sapiens
FQDAMDSKL

SEQ ID NO: 1024537 - protein, 9 aa, Homo Sapiens
CLMGWLANS

SEQ ID NO: 1024538 - protein, 9 aa, Homo Sapiens
ANMENLTEV

SEQ ID NO: 1024539 - protein, 9 aa, Homo Sapiens
IYPLALRPW

SEQ ID NO: 1024540 - protein, 9 aa, Homo Sapiens
DKQLCLTAL

SEQ ID NO: 1024541 - protein, 9 aa, Homo Sapiens
PKKPHYIPK

SEQ ID NO: 1024542 - protein, 9 aa, Homo Sapiens
VGKNRINSS

SEQ ID NO: 1024543 - protein, 9 aa, Homo Sapiens
SNLCSQDEI

SEQ ID NO: 1024544 - protein, 9 aa, Homo Sapiens
PYVFGIPII

SEQ ID NO: 1024545 - protein, 9 aa, Homo Sapiens
KAETYGHNG

SEQ ID NO: 1024546 - protein, 9 aa, Homo Sapiens
SFQSGDLSQ

SEQ ID NO: 1024547 - protein, 9 aa, Homo Sapiens
AHCFSHSSP

SEQ ID NO: 1024548 - protein, 9 aa, Homo Sapiens
EKFEVLKDG

SEQ ID NO: 1024549 - protein, 9 aa, Homo Sapiens
GRGLVTLDD

SEQ ID NO: 1024550 - protein, 9 aa, Homo Sapiens
PEPGAPAQK

SEQ ID NO: 1024551 - protein, 9 aa, Homo Sapiens
HNLEGTVGD

SEQ ID NO: 1024552 - protein, 9 aa, Homo Sapiens
YLEKLQLDK

SEQ ID NO: 1024553 - protein, 9 aa, Homo Sapiens
TTVLFSATM

SEQ ID NO: 1024554 - protein, 9 aa, Homo Sapiens
VAKGNLHQA

SEQ ID NO: 1024555 - protein, 9 aa, Homo Sapiens
YPSEVCRRK

SEQ ID NO: 1024556 - protein, 9 aa, Homo Sapiens
CPSKDKDLL

SEQ ID NO: 1024557 - protein, 9 aa, Homo Sapiens
TSLTIIILY

SEQ ID NO: 1024558 - protein, 9 aa, Homo Sapiens
GCSLRLDFT

SEQ ID NO: 1024559 - protein, 9 aa, Homo Sapiens
SSKSLERKL

SEQ ID NO: 1024560 - protein, 9 aa, Homo Sapiens
SSGKEHVLA

SEQ ID NO: 1024561 - protein, 9 aa, Homo Sapiens
IWYSFSVPM

SEQ ID NO: 1024562 - protein, 9 aa, Homo Sapiens
EGCCGSSSG

SEQ ID NO: 1024563 - protein, 9 aa, Homo Sapiens
SRQSIRNFQ

SEQ ID NO: 1024564 - protein, 9 aa, Homo Sapiens
LSASFSTEE

SEQ ID NO: 1024565 - protein, 9 aa, Homo Sapiens
TSEKITFLF

SEQ ID NO: 1024566 - protein, 9 aa, Homo Sapiens
PYRYTDDGA

SEQ ID NO: 1024567 - protein, 9 aa, Homo Sapiens
EPAQSPAES

SEQ ID NO: 1024568 - protein, 9 aa, Homo Sapiens
EIVDIRTRQ

SEQ ID NO: 1024569 - protein, 9 aa, Homo Sapiens
AMGHRSEYW

SEQ ID NO: 1024570 - protein, 9 aa, Homo Sapiens
QGDTWSFPR

SEQ ID NO: 1024571 - protein, 9 aa, Homo Sapiens
LPENDLAEE

SEQ ID NO: 1024572 - protein, 9 aa, Homo Sapiens
KFLTRLKAH

SEQ ID NO: 1024573 - protein, 9 aa, Homo Sapiens
SCGGDFQKR

SEQ ID NO: 1024574 - protein, 9 aa, Homo Sapiens
DLVSARQPL

SEQ ID NO: 1024575 - protein, 9 aa, Homo Sapiens
ICCPLLYPN

SEQ ID NO: 1024576 - protein, 9 aa, Homo Sapiens
PSNFCLLFR

SEQ ID NO: 1024577 - protein, 9 aa, Homo Sapiens
YLKKNRNRN

SEQ ID NO: 1024578 - protein, 9 aa, Homo Sapiens
QVVPGCFLA

SEQ ID NO: 1024579 - protein, 9 aa, Homo Sapiens
AAAGVFHHR

SEQ ID NO: 1024580 - protein, 9 aa, Homo Sapiens
FDSSVKSAH

SEQ ID NO: 1024581 - protein, 9 aa, Homo Sapiens
GIPIIGPTE

SEQ ID NO: 1024582 - protein, 9 aa, Homo Sapiens
TRPLVYVLY

SEQ ID NO: 1024583 - protein, 9 aa, Homo Sapiens
EGMYHCHSG

SEQ ID NO: 1024584 - protein, 9 aa, Homo Sapiens
DRARGSLTP

SEQ ID NO: 1024585 - protein, 9 aa, Homo Sapiens
GELSSSTSW

SEQ ID NO: 1024586 - protein, 9 aa, Homo Sapiens
RVVEPKKAV

SEQ ID NO: 1024587 - protein, 9 aa, Homo Sapiens
GPLLKILCS

SEQ ID NO: 1024588 - protein, 9 aa, Homo Sapiens
LCDMDTDRG

SEQ ID NO: 1024589 - protein, 9 aa, Homo Sapiens
KQFSILTTH

SEQ ID NO: 1024590 - protein, 9 aa, Homo Sapiens
LDSLDGLNL

SEQ ID NO: 1024591 - protein, 9 aa, Homo Sapiens
INEDDLPRS

SEQ ID NO: 1024592 - protein, 9 aa, Homo Sapiens
ATFKGWMNI

SEQ ID NO: 1024593 - protein, 9 aa, Homo Sapiens
PPSPNKESL

SEQ ID NO: 1024594 - protein, 9 aa, Homo Sapiens
KDKKLRLEK

SEQ ID NO: 1024595 - protein, 9 aa, Homo Sapiens
IANIREETF

SEQ ID NO: 1024596 - protein, 9 aa, Homo Sapiens
TDVVVHEVQ

SEQ ID NO: 1024597 - protein, 9 aa, Homo Sapiens
SHKPEPLVA

SEQ ID NO: 1024598 - protein, 9 aa, Homo Sapiens
KLMSVKLAL

SEQ ID NO: 1024599 - protein, 9 aa, Homo Sapiens
GNNLVKGSY

SEQ ID NO: 1024600 - protein, 9 aa, Homo Sapiens
QGLCLGQHG

SEQ ID NO: 1024601 - protein, 9 aa, Homo Sapiens
FVDVYRYIA

SEQ ID NO: 1024602 - protein, 9 aa, Homo Sapiens
TFFSKVYPE

SEQ ID NO: 1024603 - protein, 9 aa, Homo Sapiens
TEKAMKNYE

SEQ ID NO: 1024604 - protein, 9 aa, Homo Sapiens
GPRAKVSEV

SEQ ID NO: 1024605 - protein, 9 aa, Homo Sapiens
TRVYVKMPP

SEQ ID NO: 1024606 - protein, 9 aa, Homo Sapiens
KVKSYRSLS

SEQ ID NO: 1024607 - protein, 9 aa, Homo Sapiens
KALFPNMIS

SEQ ID NO: 1024608 - protein, 9 aa, Homo Sapiens
FSPLKSEDS

SEQ ID NO: 1024609 - protein, 9 aa, Homo Sapiens
AFSEGHSGD

SEQ ID NO: 1024610 - protein, 9 aa, Homo Sapiens
LKNILFRVC

SEQ ID NO: 1024611 - protein, 9 aa, Homo Sapiens
ERENEIVEL

SEQ ID NO: 1024612 - protein, 9 aa, Homo Sapiens
PLSDRPIKA

SEQ ID NO: 1024613 - protein, 9 aa, Homo Sapiens
GNVRIKFGQ

SEQ ID NO: 1024614 - protein, 9 aa, Homo Sapiens
IQATHKQRK

SEQ ID NO: 1024615 - protein, 9 aa, Homo Sapiens
ALEFFNLLV

SEQ ID NO: 1024616 - protein, 9 aa, Homo Sapiens
DARSYWCKI

SEQ ID NO: 1024617 - protein, 9 aa, Homo Sapiens
SHKSSEESG

SEQ ID NO: 1024618 - protein, 9 aa, Homo Sapiens
MSAGGDFRN

SEQ ID NO: 1024619 - protein, 9 aa, Homo Sapiens
EWILNSTDC

SEQ ID NO: 1024620 - protein, 9 aa, Homo Sapiens
AVSSSPVFM

SEQ ID NO: 1024621 - protein, 9 aa, Homo Sapiens
VPSSSRFLL

SEQ ID NO: 1024622 - protein, 9 aa, Homo Sapiens
EIKEEEGLE

SEQ ID NO: 1024623 - protein, 9 aa, Homo Sapiens
QGMVKKEFI

SEQ ID NO: 1024624 - protein, 9 aa, Homo Sapiens
YFFYNVIDC

SEQ ID NO: 1024625 - protein, 9 aa, Homo Sapiens
AMFFGVSEL

SEQ ID NO: 1024626 - protein, 9 aa, Homo Sapiens
GPPLLSRTS

SEQ ID NO: 1024627 - protein, 9 aa, Homo Sapiens
IIGDNFFDD

SEQ ID NO: 1024628 - protein, 9 aa, Homo Sapiens
HINLYVRGG

SEQ ID NO: 1024629 - protein, 9 aa, Homo Sapiens
KLQLDKLRQ

SEQ ID NO: 1024630 - protein, 9 aa, Homo Sapiens
LEIQNNFDY

SEQ ID NO: 1024631 - protein, 9 aa, Homo Sapiens
GLFYPARKV

SEQ ID NO: 1024632 - protein, 9 aa, Homo Sapiens
YQIINPTLK

SEQ ID NO: 1024633 - protein, 9 aa, Homo Sapiens
IETKNIRLT

SEQ ID NO: 1024634 - protein, 9 aa, Homo Sapiens
CPLLYPNIM

SEQ ID NO: 1024635 - protein, 9 aa, Homo Sapiens
RHIQELETG

SEQ ID NO: 1024636 - protein, 9 aa, Homo Sapiens
SGLSSGEVL

SEQ ID NO: 1024637 - protein, 9 aa, Homo Sapiens
TFYATKSRD

SEQ ID NO: 1024638 - protein, 9 aa, Homo Sapiens
VRLNLQLFD

SEQ ID NO: 1024639 - protein, 9 aa, Homo Sapiens
LTITWKFFN

SEQ ID NO: 1024640 - protein, 9 aa, Homo Sapiens
LDFRLHTPM

SEQ ID NO: 1024641 - protein, 9 aa, Homo Sapiens
TLGTPTVLA

SEQ ID NO: 1024642 - protein, 9 aa, Homo Sapiens
ADSYTSRSS

SEQ ID NO: 1024643 - protein, 9 aa, Homo Sapiens
VECACVYAE

SEQ ID NO: 1024644 - protein, 9 aa, Homo Sapiens
CDFVKRHYF

SEQ ID NO: 1024645 - protein, 9 aa, Homo Sapiens
WAEPRDSSN

SEQ ID NO: 1024646 - protein, 9 aa, Homo Sapiens
GLPEADGLP

SEQ ID NO: 1024647 - protein, 9 aa, Homo Sapiens
LKSHKPEPL

SEQ ID NO: 1024648 - protein, 9 aa, Homo Sapiens
PEWPIKKKK

SEQ ID NO: 1024649 - protein, 9 aa, Homo Sapiens
SPSSLRGGA

SEQ ID NO: 1024650 - protein, 9 aa, Homo Sapiens
AKELGEDDE

SEQ ID NO: 1024651 - protein, 9 aa, Homo Sapiens
SPAGLSGTS

SEQ ID NO: 1024652 - protein, 9 aa, Homo Sapiens
GFVAGLAVL

SEQ ID NO: 1024653 - protein, 9 aa, Homo Sapiens
FTEHNFSPN

SEQ ID NO: 1024654 - protein, 9 aa, Homo Sapiens
ITIIPGGLY

SEQ ID NO: 1024655 - protein, 9 aa, Homo Sapiens
WKIFTLGGS

SEQ ID NO: 1024656 - protein, 9 aa, Homo Sapiens
GFPFSKPPL

SEQ ID NO: 1024657 - protein, 9 aa, Homo Sapiens
DQQIQNGSL

SEQ ID NO: 1024658 - protein, 9 aa, Homo Sapiens
RVISCTHRF

SEQ ID NO: 1024659 - protein, 9 aa, Homo Sapiens
HSNFTLDLE

SEQ ID NO: 1024660 - protein, 9 aa, Homo Sapiens
KLKLIRMCL

SEQ ID NO: 1024661 - protein, 9 aa, Homo Sapiens
QEEDRSLSC

SEQ ID NO: 1024662 - protein, 9 aa, Homo Sapiens
RAKFLRLSD

SEQ ID NO: 1024663 - protein, 9 aa, Homo Sapiens
MMTGAFILG

SEQ ID NO: 1024664 - protein, 9 aa, Homo Sapiens
DPALFQLVE

SEQ ID NO: 1024665 - protein, 9 aa, Homo Sapiens
KQWRQQMLF

SEQ ID NO: 1024666 - protein, 9 aa, Homo Sapiens
EARMFCQEI

SEQ ID NO: 1024667 - protein, 9 aa, Homo Sapiens
KQPARGEHK

SEQ ID NO: 1024668 - protein, 9 aa, Homo Sapiens
YYLFIIWNK

SEQ ID NO: 1024669 - protein, 9 aa, Homo Sapiens
PSKDKDLLN

SEQ ID NO: 1024670 - protein, 9 aa, Homo Sapiens
ICHSLRYTN

SEQ ID NO: 1024671 - protein, 9 aa, Homo Sapiens
VQVIRAWVS

SEQ ID NO: 1024672 - protein, 9 aa, Homo Sapiens
EIIHDLSVL

SEQ ID NO: 1024673 - protein, 9 aa, Homo Sapiens
SVQSLNGNS

SEQ ID NO: 1024674 - protein, 9 aa, Homo Sapiens
EKLQEIRKF

SEQ ID NO: 1024675 - protein, 9 aa, Homo Sapiens
LKLQIHRRI

SEQ ID NO: 1024676 - protein, 9 aa, Homo Sapiens
IFWGVRETP

SEQ ID NO: 1024677 - protein, 9 aa, Homo Sapiens
TRKREYKNE

SEQ ID NO: 1024678 - protein, 9 aa, Homo Sapiens
GRRRKENCI

SEQ ID NO: 1024679 - protein, 9 aa, Homo Sapiens
TSGRNCTCF

SEQ ID NO: 1024680 - protein, 9 aa, Homo Sapiens
AKINAILAH

SEQ ID NO: 1024681 - protein, 9 aa, Homo Sapiens
SIILFDCLL

SEQ ID NO: 1024682 - protein, 9 aa, Homo Sapiens
DLNVSMETI

SEQ ID NO: 1024683 - protein, 9 aa, Homo Sapiens
GSTGLKGFI

SEQ ID NO: 1024684 - protein, 9 aa, Homo Sapiens
PHFRSSSAY

SEQ ID NO: 1024685 - protein, 9 aa, Homo Sapiens
ESTGEVLSL

SEQ ID NO: 1024686 - protein, 9 aa, Homo Sapiens
KPITESPEL

SEQ ID NO: 1024687 - protein, 9 aa, Homo Sapiens
YTEGYEQQR

SEQ ID NO: 1024688 - protein, 9 aa, Homo Sapiens
SAVEPEPEL

SEQ ID NO: 1024689 - protein, 9 aa, Homo Sapiens
SEVEALRDQ

SEQ ID NO: 1024690 - protein, 9 aa, Homo Sapiens
HLIGPCRDK

SEQ ID NO: 1024691 - protein, 9 aa, Homo Sapiens
VIGLFRRFT

SEQ ID NO: 1024692 - protein, 9 aa, Homo Sapiens
PRGFWALPK

SEQ ID NO: 1024693 - protein, 9 aa, Homo Sapiens
QRARIIVAA

SEQ ID NO: 1024694 - protein, 9 aa, Homo Sapiens
PRIKGGAAG

SEQ ID NO: 1024695 - protein, 9 aa, Homo Sapiens
TSPAHPNVD

SEQ ID NO: 1024696 - protein, 9 aa, Homo Sapiens
FSEAEKKEY

SEQ ID NO: 1024697 - protein, 9 aa, Homo Sapiens
VGLPLDIKL

SEQ ID NO: 1024698 - protein, 9 aa, Homo Sapiens
SGNKSLEKF

SEQ ID NO: 1024699 - protein, 9 aa, Homo Sapiens
GPAKRSQLE

SEQ ID NO: 1024700 - protein, 9 aa, Homo Sapiens
HISTLSQSN

SEQ ID NO: 1024701 - protein, 9 aa, Homo Sapiens
KQRKLANKS

SEQ ID NO: 1024702 - protein, 9 aa, Homo Sapiens
SLAEVQRKR

SEQ ID NO: 1024703 - protein, 9 aa, Homo Sapiens
TEKEPARFT

SEQ ID NO: 1024704 - protein, 9 aa, Homo Sapiens
EDATHIALC

SEQ ID NO: 1024705 - protein, 9 aa, Homo Sapiens
RYVLEQLYS

SEQ ID NO: 1024706 - protein, 9 aa, Homo Sapiens
FQNDPNWVV

SEQ ID NO: 1024707 - protein, 9 aa, Homo Sapiens
PPSQVFLPA

SEQ ID NO: 1024708 - protein, 9 aa, Homo Sapiens
SIRNFQKHS

SEQ ID NO: 1024709 - protein, 9 aa, Homo Sapiens
SPGLGETPG

SEQ ID NO: 1024710 - protein, 9 aa, Homo Sapiens
WRVHTGENP

SEQ ID NO: 1024711 - protein, 9 aa, Homo Sapiens
AQIFKVIEA

SEQ ID NO: 1024712 - protein, 9 aa, Homo Sapiens
TFLMTVLLT

SEQ ID NO: 1024713 - protein, 9 aa, Homo Sapiens
RSGRPGFAF

SEQ ID NO: 1024714 - protein, 9 aa, Homo Sapiens
QPPFTNYRQ

SEQ ID NO: 1024715 - protein, 9 aa, Homo Sapiens
KKSIRKMPV

SEQ ID NO: 1024716 - protein, 9 aa, Homo Sapiens
EQKVPPVII

SEQ ID NO: 1024717 - protein, 9 aa, Homo Sapiens
YNVDVWFRS

SEQ ID NO: 1024718 - protein, 9 aa, Homo Sapiens
SFFLDKVVS

SEQ ID NO: 1024719 - protein, 9 aa, Homo Sapiens
MWEQKVRLR

SEQ ID NO: 1024720 - protein, 9 aa, Homo Sapiens
LEAQIFFLQ

SEQ ID NO: 1024721 - protein, 9 aa, Homo Sapiens
PPEIYMTWI

SEQ ID NO: 1024722 - protein, 9 aa, Homo Sapiens
WIQERSLQD

SEQ ID NO: 1024723 - protein, 9 aa, Homo Sapiens
IKNGEEIVQ

SEQ ID NO: 1024724 - protein, 9 aa, Homo Sapiens
LHLCRHSAN

SEQ ID NO: 1024725 - protein, 9 aa, Homo Sapiens
QAQILPPRR

SEQ ID NO: 1024726 - protein, 9 aa, Homo Sapiens
SLVLVGACI

SEQ ID NO: 1024727 - protein, 9 aa, Homo Sapiens
SEGASTLAF

SEQ ID NO: 1024728 - protein, 9 aa, Homo Sapiens
RKTTRMLMI

SEQ ID NO: 1024729 - protein, 9 aa, Homo Sapiens
ICLKQEQHV

SEQ ID NO: 1024730 - protein, 9 aa, Homo Sapiens
YKEIAQRSK

SEQ ID NO: 1024731 - protein, 9 aa, Homo Sapiens
WTRAVAVLA

SEQ ID NO: 1024732 - protein, 9 aa, Homo Sapiens
NLGMGGTRT

SEQ ID NO: 1024733 - protein, 9 aa, Homo Sapiens
GPPPLSSPP

SEQ ID NO: 1024734 - protein, 9 aa, Homo Sapiens
FFLNGSSQK

SEQ ID NO: 1024735 - protein, 9 aa, Homo Sapiens
LQPFPGTWK

SEQ ID NO: 1024736 - protein, 9 aa, Homo Sapiens
LLGIKVQGD

SEQ ID NO: 1024737 - protein, 9 aa, Homo Sapiens
ICCTEKLYK

SEQ ID NO: 1024738 - protein, 9 aa, Homo Sapiens
CRVSEKSWN

SEQ ID NO: 1024739 - protein, 9 aa, Homo Sapiens
RAKRTTPNG

SEQ ID NO: 1024740 - protein, 9 aa, Homo Sapiens
ISVGAACPL

SEQ ID NO: 1024741 - protein, 9 aa, Homo Sapiens
PRHLVMEMT

SEQ ID NO: 1024742 - protein, 9 aa, Homo Sapiens
NVIDCFSML

SEQ ID NO: 1024743 - protein, 9 aa, Homo Sapiens
KEVILLDSK

SEQ ID NO: 1024744 - protein, 9 aa, Homo Sapiens
KSLLKSKFC

SEQ ID NO: 1024745 - protein, 9 aa, Homo Sapiens
LPGLREFSS

SEQ ID NO: 1024746 - protein, 9 aa, Homo Sapiens
QPFPGTWKE

SEQ ID NO: 1024747 - protein, 9 aa, Homo Sapiens
IYTGEKTYK

SEQ ID NO: 1024748 - protein, 9 aa, Homo Sapiens
SGNQAVLQI

SEQ ID NO: 1024749 - protein, 9 aa, Homo Sapiens
KAGPPGRGE

SEQ ID NO: 1024750 - protein, 9 aa, Homo Sapiens
SPSLSQHAN

SEQ ID NO: 1024751 - protein, 9 aa, Homo Sapiens
VKKEGELGG

SEQ ID NO: 1024752 - protein, 9 aa, Homo Sapiens
NKAKTADVE

SEQ ID NO: 1024753 - protein, 9 aa, Homo Sapiens
DFLQTFYTH

SEQ ID NO: 1024754 - protein, 9 aa, Homo Sapiens
LTQAQTCDS

SEQ ID NO: 1024755 - protein, 9 aa, Homo Sapiens
GSDEWQMRF

SEQ ID NO: 1024756 - protein, 9 aa, Homo Sapiens
PEFFTVYHY

SEQ ID NO: 1024757 - protein, 9 aa, Homo Sapiens
GNKHSYLCT

SEQ ID NO: 1024758 - protein, 9 aa, Homo Sapiens
KNQKNLNRE

SEQ ID NO: 1024759 - protein, 9 aa, Homo Sapiens
TDFAEKLAD

SEQ ID NO: 1024760 - protein, 9 aa, Homo Sapiens
HQPFTILYR

SEQ ID NO: 1024761 - protein, 9 aa, Homo Sapiens
RNFDNFKTQ

SEQ ID NO: 1024762 - protein, 9 aa, Homo Sapiens
KGNLGKDSE

SEQ ID NO: 1024763 - protein, 9 aa, Homo Sapiens
ARQQQRRAL

SEQ ID NO: 1024764 - protein, 9 aa, Homo Sapiens
AVPSDCPSK

SEQ ID NO: 1024765 - protein, 9 aa, Homo Sapiens
EGRVCACAD

SEQ ID NO: 1024766 - protein, 9 aa, Homo Sapiens
RAERLCSTP

SEQ ID NO: 1024767 - protein, 9 aa, Homo Sapiens
LIHEGENFY

SEQ ID NO: 1024768 - protein, 9 aa, Homo Sapiens
RSQLEEPAG

SEQ ID NO: 1024769 - protein, 9 aa, Homo Sapiens
AATTFTEPI

SEQ ID NO: 1024770 - protein, 9 aa, Homo Sapiens
HLQWKLIHL

SEQ ID NO: 1024771 - protein, 9 aa, Homo Sapiens
WIEIIALSL

SEQ ID NO: 1024772 - protein, 9 aa, Homo Sapiens
CLKQEQHVH

SEQ ID NO: 1024773 - protein, 9 aa, Homo Sapiens
LRNGKIFMK

SEQ ID NO: 1024774 - protein, 9 aa, Homo Sapiens
TATFGYSFR

SEQ ID NO: 1024775 - protein, 9 aa, Homo Sapiens
ARRTFFKCS

SEQ ID NO: 1024776 - protein, 9 aa, Homo Sapiens
YCYKKSCHD

SEQ ID NO: 1024777 - protein, 9 aa, Homo Sapiens
LDLGENNLQ

SEQ ID NO: 1024778 - protein, 9 aa, Homo Sapiens
STEESMPTK

SEQ ID NO: 1024779 - protein, 9 aa, Homo Sapiens
DYLLERTND

SEQ ID NO: 1024780 - protein, 9 aa, Homo Sapiens
TSVSFLKTI

SEQ ID NO: 1024781 - protein, 9 aa, Homo Sapiens
PLQAQILPP

SEQ ID NO: 1024782 - protein, 9 aa, Homo Sapiens
KCKEATDLL

SEQ ID NO: 1024783 - protein, 9 aa, Homo Sapiens
RAEERAPSW

SEQ ID NO: 1024784 - protein, 9 aa, Homo Sapiens
TKEIQAVDT

SEQ ID NO: 1024785 - protein, 9 aa, Homo Sapiens
RTAIEYSTG

SEQ ID NO: 1024786 - protein, 9 aa, Homo Sapiens
QEKKCIMLA

SEQ ID NO: 1024787 - protein, 9 aa, Homo Sapiens
KLQEKPSKW

SEQ ID NO: 1024788 - protein, 9 aa, Homo Sapiens
PDLEVADYA

SEQ ID NO: 1024789 - protein, 9 aa, Homo Sapiens
ILQEVGSRG

SEQ ID NO: 1024790 - protein, 9 aa, Homo Sapiens
CESSEPHPL

SEQ ID NO: 1024791 - protein, 9 aa, Homo Sapiens
NDNPPQFPK

SEQ ID NO: 1024792 - protein, 9 aa, Homo Sapiens
DRRPVSAGL

SEQ ID NO: 1024793 - protein, 9 aa, Homo Sapiens
GNQAVLQIC

SEQ ID NO: 1024794 - protein, 9 aa, Homo Sapiens
TPAPTPTST

SEQ ID NO: 1024795 - protein, 9 aa, Homo Sapiens
GSWFYIHSF

SEQ ID NO: 1024796 - protein, 9 aa, Homo Sapiens
LTTHKRIYS

SEQ ID NO: 1024797 - protein, 9 aa, Homo Sapiens
KYITGNNLV

SEQ ID NO: 1024798 - protein, 9 aa, Homo Sapiens
YKPEGSPGE

SEQ ID NO: 1024799 - protein, 9 aa, Homo Sapiens
ISGLSSGEV

SEQ ID NO: 1024800 - protein, 9 aa, Homo Sapiens
GDRARGSLT

SEQ ID NO: 1024801 - protein, 9 aa, Homo Sapiens
YGHNGIHGK

SEQ ID NO: 1024802 - protein, 9 aa, Homo Sapiens
IGKWWCEIE

SEQ ID NO: 1024803 - protein, 9 aa, Homo Sapiens
VRTYPELKE

SEQ ID NO: 1024804 - protein, 9 aa, Homo Sapiens
RHYFSDYLM

SEQ ID NO: 1024805 - protein, 9 aa, Homo Sapiens
LLSHIFYGR

SEQ ID NO: 1024806 - protein, 9 aa, Homo Sapiens
ISSQLEHAK

SEQ ID NO: 1024807 - protein, 9 aa, Homo Sapiens
SSSENNSGV

SEQ ID NO: 1024808 - protein, 9 aa, Homo Sapiens
NRKRLSEKL

SEQ ID NO: 1024809 - protein, 9 aa, Homo Sapiens
KTERGLYSS

SEQ ID NO: 1024810 - protein, 9 aa, Homo Sapiens
AMTFDRYVA

SEQ ID NO: 1024811 - protein, 9 aa, Homo Sapiens
GPGEELYLS

SEQ ID NO: 1024812 - protein, 9 aa, Homo Sapiens
RPQVSLTAT

SEQ ID NO: 1024813 - protein, 9 aa, Homo Sapiens
SSRSRLYRR

SEQ ID NO: 1024814 - protein, 9 aa, Homo Sapiens
NGKIFMKDP

SEQ ID NO: 1024815 - protein, 9 aa, Homo Sapiens
QDEKSLGFS

SEQ ID NO: 1024816 - protein, 9 aa, Homo Sapiens
ILGLLSGGG

SEQ ID NO: 1024817 - protein, 9 aa, Homo Sapiens
KKCKATCLC

SEQ ID NO: 1024818 - protein, 9 aa, Homo Sapiens
ILRPLSPTK

SEQ ID NO: 1024819 - protein, 9 aa, Homo Sapiens
GGWHYAKKD

SEQ ID NO: 1024820 - protein, 9 aa, Homo Sapiens
DSIFGDLKK

SEQ ID NO: 1024821 - protein, 9 aa, Homo Sapiens
RQQMLFGIF

SEQ ID NO: 1024822 - protein, 9 aa, Homo Sapiens
QAEGAAMRE

SEQ ID NO: 1024823 - protein, 9 aa, Homo Sapiens
YRKEISYTC

SEQ ID NO: 1024824 - protein, 9 aa, Homo Sapiens
GCEVFVEKI

SEQ ID NO: 1024825 - protein, 9 aa, Homo Sapiens
LYPQDPKAG

SEQ ID NO: 1024826 - protein, 9 aa, Homo Sapiens
ILGFSEAEK

SEQ ID NO: 1024827 - protein, 9 aa, Homo Sapiens
NTLLYIFHY

SEQ ID NO: 1024828 - protein, 9 aa, Homo Sapiens
SLSVEEPHK

SEQ ID NO: 1024829 - protein, 9 aa, Homo Sapiens
RNNILDHFL

SEQ ID NO: 1024830 - protein, 9 aa, Homo Sapiens
YLFDGQALL

SEQ ID NO: 1024831 - protein, 9 aa, Homo Sapiens
AAIYAGLRA

SEQ ID NO: 1024832 - protein, 9 aa, Homo Sapiens
GACRIYNFV

SEQ ID NO: 1024833 - protein, 9 aa, Homo Sapiens
SKVERKKNQ

SEQ ID NO: 1024834 - protein, 9 aa, Homo Sapiens
TTTTMTPAP

SEQ ID NO: 1024835 - protein, 9 aa, Homo Sapiens
AFPAGHLPG

SEQ ID NO: 1024836 - protein, 9 aa, Homo Sapiens
LLEKHLRKK

SEQ ID NO: 1024837 - protein, 9 aa, Homo Sapiens
ESSKDGITR

SEQ ID NO: 1024838 - protein, 9 aa, Homo Sapiens
LPISLEKDK

SEQ ID NO: 1024839 - protein, 9 aa, Homo Sapiens
PKTYSGQTE

SEQ ID NO: 1024840 - protein, 9 aa, Homo Sapiens
QSLVFLLDV

SEQ ID NO: 1024841 - protein, 9 aa, Homo Sapiens
ILNTATPGN

SEQ ID NO: 1024842 - protein, 9 aa, Homo Sapiens
SSHTAIPAG

SEQ ID NO: 1024843 - protein, 9 aa, Homo Sapiens
GIGVTRFIA

SEQ ID NO: 1024844 - protein, 9 aa, Homo Sapiens
DSYLLPEEH

SEQ ID NO: 1024845 - protein, 9 aa, Homo Sapiens
KIYNGLNQC

SEQ ID NO: 1024846 - protein, 9 aa, Homo Sapiens
RTSSPMEPS

SEQ ID NO: 1024847 - protein, 9 aa, Homo Sapiens
DKRMEDVIA

SEQ ID NO: 1024848 - protein, 9 aa, Homo Sapiens
FPREVSSHA

SEQ ID NO: 1024849 - protein, 9 aa, Homo Sapiens
LTLNLPTCR

SEQ ID NO: 1024850 - protein, 9 aa, Homo Sapiens
LFRPFGPFM

SEQ ID NO: 1024851 - protein, 9 aa, Homo Sapiens
PEPLVAGPG

SEQ ID NO: 1024852 - protein, 9 aa, Homo Sapiens
IQHLYEEKC

SEQ ID NO: 1024853 - protein, 9 aa, Homo Sapiens
YAFPPPRTA

SEQ ID NO: 1024854 - protein, 9 aa, Homo Sapiens
WLGYVLDFG

SEQ ID NO: 1024855 - protein, 9 aa, Homo Sapiens
REASSQTPK

SEQ ID NO: 1024856 - protein, 9 aa, Homo Sapiens
SQGLPGTGL

SEQ ID NO: 1024857 - protein, 9 aa, Homo Sapiens
KFELSGAMA

SEQ ID NO: 1024858 - protein, 9 aa, Homo Sapiens
LQICPLQIQ

SEQ ID NO: 1024859 - protein, 9 aa, Homo Sapiens
AESSSPQGG

SEQ ID NO: 1024860 - protein, 9 aa, Homo Sapiens
APSWRGLAE

SEQ ID NO: 1024861 - protein, 9 aa, Homo Sapiens
SPHCPVYVR

SEQ ID NO: 1024862 - protein, 9 aa, Homo Sapiens
CKAGVEEVL

SEQ ID NO: 1024863 - protein, 9 aa, Homo Sapiens
GSLTPPLDE

SEQ ID NO: 1024864 - protein, 9 aa, Homo Sapiens
NPPYVVTLP

SEQ ID NO: 1024865 - protein, 9 aa, Homo Sapiens
GPNKNPEAE

SEQ ID NO: 1024866 - protein, 9 aa, Homo Sapiens
MTCPKGATH

SEQ ID NO: 1024867 - protein, 9 aa, Homo Sapiens
TGLELLLDK

SEQ ID NO: 1024868 - protein, 9 aa, Homo Sapiens
WVGKNRINS

SEQ ID NO: 1024869 - protein, 9 aa, Homo Sapiens
TIEGLGFIF

SEQ ID NO: 1024870 - protein, 9 aa, Homo Sapiens
LTTARLVRA

SEQ ID NO: 1024871 - protein, 9 aa, Homo Sapiens
VFHHRGCLA

SEQ ID NO: 1024872 - protein, 9 aa, Homo Sapiens
VSRGSTLPL

SEQ ID NO: 1024873 - protein, 9 aa, Homo Sapiens
SLSSVVFAR

SEQ ID NO: 1024874 - protein, 9 aa, Homo Sapiens
FGVLMWKIF

SEQ ID NO: 1024875 - protein, 9 aa, Homo Sapiens
RIPPFPAKT

SEQ ID NO: 1024876 - protein, 9 aa, Homo Sapiens
CPDQHGHKE

SEQ ID NO: 1024877 - protein, 9 aa, Homo Sapiens
FFVNLAFSD

SEQ ID NO: 1024878 - protein, 9 aa, Homo Sapiens
DLPPAYGSW

SEQ ID NO: 1024879 - protein, 9 aa, Homo Sapiens
TSGAAIWTR

SEQ ID NO: 1024880 - protein, 9 aa, Homo Sapiens
FSVQEKNHT

SEQ ID NO: 1024881 - protein, 9 aa, Homo Sapiens
VLTSRLLRA

SEQ ID NO: 1024882 - protein, 9 aa, Homo Sapiens
SLVMLGSAY

SEQ ID NO: 1024883 - protein, 9 aa, Homo Sapiens
LSSGVDAAY

SEQ ID NO: 1024884 - protein, 9 aa, Homo Sapiens
ACGCNLAEG

SEQ ID NO: 1024885 - protein, 9 aa, Homo Sapiens
LNTLANLFL

SEQ ID NO: 1024886 - protein, 9 aa, Homo Sapiens
QTVFFFKVE

SEQ ID NO: 1024887 - protein, 9 aa, Homo Sapiens
KVCLDFSAE

SEQ ID NO: 1024888 - protein, 9 aa, Homo Sapiens
IDDLNVSME

SEQ ID NO: 1024889 - protein, 9 aa, Homo Sapiens
NKNPEAELP

SEQ ID NO: 1024890 - protein, 9 aa, Homo Sapiens
PVILEKLQS

SEQ ID NO: 1024891 - protein, 9 aa, Homo Sapiens
ESHLSLSPA

SEQ ID NO: 1024892 - protein, 9 aa, Homo Sapiens
EEIKSKKIK

SEQ ID NO: 1024893 - protein, 9 aa, Homo Sapiens
IFYGRKNFF

SEQ ID NO: 1024894 - protein, 9 aa, Homo Sapiens
VEIVDIRTR

SEQ ID NO: 1024895 - protein, 9 aa, Homo Sapiens
LPPEGEAGQ

SEQ ID NO: 1024896 - protein, 9 aa, Homo Sapiens
WGVRETPWE

SEQ ID NO: 1024897 - protein, 9 aa, Homo Sapiens
GSGGNYEGG

SEQ ID NO: 1024898 - protein, 9 aa, Homo Sapiens
EDGAAPAKI

SEQ ID NO: 1024899 - protein, 9 aa, Homo Sapiens
HGGPPLSPE

SEQ ID NO: 1024900 - protein, 9 aa, Homo Sapiens
KKIDKINGK

SEQ ID NO: 1024901 - protein, 9 aa, Homo Sapiens
NTHAPTLQR

SEQ ID NO: 1024902 - protein, 9 aa, Homo Sapiens
IQPSFCHRS

SEQ ID NO: 1024903 - protein, 9 aa, Homo Sapiens
ENLTEVITA

SEQ ID NO: 1024904 - protein, 9 aa, Homo Sapiens
IPEGIKFDT

SEQ ID NO: 1024905 - protein, 9 aa, Homo Sapiens
SFSPLKSED

SEQ ID NO: 1024906 - protein, 9 aa, Homo Sapiens
TSESQDPSF

SEQ ID NO: 1024907 - protein, 9 aa, Homo Sapiens
KPPITHDNV

SEQ ID NO: 1024908 - protein, 9 aa, Homo Sapiens
LSSLIIGPT

SEQ ID NO: 1024909 - protein, 9 aa, Homo Sapiens
RINSSRETR

SEQ ID NO: 1024910 - protein, 9 aa, Homo Sapiens
NVLRNGKIF

SEQ ID NO: 1024911 - protein, 9 aa, Homo Sapiens
STVGSSDNL

SEQ ID NO: 1024912 - protein, 9 aa, Homo Sapiens
DSTNPFSKD

SEQ ID NO: 1024913 - protein, 9 aa, Homo Sapiens
CEEDGSQSL

SEQ ID NO: 1024914 - protein, 9 aa, Homo Sapiens
MGPGWSGPY

SEQ ID NO: 1024915 - protein, 9 aa, Homo Sapiens
LIPDMKEEE

SEQ ID NO: 1024916 - protein, 9 aa, Homo Sapiens
SILTTHKKI

SEQ ID NO: 1024917 - protein, 9 aa, Homo Sapiens
VWFLALESA

SEQ ID NO: 1024918 - protein, 9 aa, Homo Sapiens
ESCQGLGSR

SEQ ID NO: 1024919 - protein, 9 aa, Homo Sapiens
PQSGWLWVQ

SEQ ID NO: 1024920 - protein, 9 aa, Homo Sapiens
SDVKLVQHV

SEQ ID NO: 1024921 - protein, 9 aa, Homo Sapiens
DTATQPNFS

SEQ ID NO: 1024922 - protein, 9 aa, Homo Sapiens
STAKKVLLF

SEQ ID NO: 1024923 - protein, 9 aa, Homo Sapiens
NSRRAKRTT

SEQ ID NO: 1024924 - protein, 9 aa, Homo Sapiens
IFLMSVGEN

SEQ ID NO: 1024925 - protein, 9 aa, Homo Sapiens
TLETLNIRN

SEQ ID NO: 1024926 - protein, 9 aa, Homo Sapiens
SQDEIPPET

SEQ ID NO: 1024927 - protein, 9 aa, Homo Sapiens
IVDIRTRQL

SEQ ID NO: 1024928 - protein, 9 aa, Homo Sapiens
LLVVAQTFM

SEQ ID NO: 1024929 - protein, 9 aa, Homo Sapiens
KINSETVNL

SEQ ID NO: 1024930 - protein, 9 aa, Homo Sapiens
CRIYNFVFF

SEQ ID NO: 1024931 - protein, 9 aa, Homo Sapiens
NRTYMMMFR

SEQ ID NO: 1024932 - protein, 9 aa, Homo Sapiens
AGFSSSPDL

SEQ ID NO: 1024933 - protein, 9 aa, Homo Sapiens
SGLLPSQLL

SEQ ID NO: 1024934 - protein, 9 aa, Homo Sapiens
QVSLTATHS

SEQ ID NO: 1024935 - protein, 9 aa, Homo Sapiens
GLAGSRPES

SEQ ID NO: 1024936 - protein, 9 aa, Homo Sapiens
RDYSLLEGC

SEQ ID NO: 1024937 - protein, 9 aa, Homo Sapiens
ALQEIVILS

SEQ ID NO: 1024938 - protein, 9 aa, Homo Sapiens
SFSYCGSRK

SEQ ID NO: 1024939 - protein, 9 aa, Homo Sapiens
AQSPAESRA

SEQ ID NO: 1024940 - protein, 9 aa, Homo Sapiens
FQLNKNTGE

SEQ ID NO: 1024941 - protein, 9 aa, Homo Sapiens
SSPQGGPDD

SEQ ID NO: 1024942 - protein, 9 aa, Homo Sapiens
DYDLDSTVV

SEQ ID NO: 1024943 - protein, 9 aa, Homo Sapiens
TFTKTFQKF

SEQ ID NO: 1024944 - protein, 9 aa, Homo Sapiens
DSLEKVLRA

SEQ ID NO: 1024945 - protein, 9 aa, Homo Sapiens
TLDYQIINP

SEQ ID NO: 1024946 - protein, 9 aa, Homo Sapiens
YLAKDATSS

SEQ ID NO: 1024947 - protein, 9 aa, Homo Sapiens
ACVYAENAI

SEQ ID NO: 1024948 - protein, 9 aa, Homo Sapiens
FLEKLPDCP

SEQ ID NO: 1024949 - protein, 9 aa, Homo Sapiens
LLSLQEKKC

SEQ ID NO: 1024950 - protein, 9 aa, Homo Sapiens
VLGAYKLPD

SEQ ID NO: 1024951 - protein, 9 aa, Homo Sapiens
HCPVYVRDP

SEQ ID NO: 1024952 - protein, 9 aa, Homo Sapiens
IPVIPDTKP

SEQ ID NO: 1024953 - protein, 9 aa, Homo Sapiens
RMAYSSGSL

SEQ ID NO: 1024954 - protein, 9 aa, Homo Sapiens
QPTVKLHEN

SEQ ID NO: 1024955 - protein, 9 aa, Homo Sapiens
LHLTEIRQY

SEQ ID NO: 1024956 - protein, 9 aa, Homo Sapiens
LLSPPNKPG

SEQ ID NO: 1024957 - protein, 9 aa, Homo Sapiens
WHHERKHYN

SEQ ID NO: 1024958 - protein, 9 aa, Homo Sapiens
VCACPGKDR

SEQ ID NO: 1024959 - protein, 9 aa, Homo Sapiens
ILLKEDSWD

SEQ ID NO: 1024960 - protein, 9 aa, Homo Sapiens
ILGEIFRCC

SEQ ID NO: 1024961 - protein, 9 aa, Homo Sapiens
LNGNSYQGA

SEQ ID NO: 1024962 - protein, 9 aa, Homo Sapiens
IKKICRDEK

SEQ ID NO: 1024963 - protein, 9 aa, Homo Sapiens
CCPLLYPNI

SEQ ID NO: 1024964 - protein, 9 aa, Homo Sapiens
MKNQKAERE

SEQ ID NO: 1024965 - protein, 9 aa, Homo Sapiens
ILQWKYPYT

SEQ ID NO: 1024966 - protein, 9 aa, Homo Sapiens
LGTPTVLAA

SEQ ID NO: 1024967 - protein, 9 aa, Homo Sapiens
LEKYDRHLP

SEQ ID NO: 1024968 - protein, 9 aa, Homo Sapiens
LKENCQAEF

SEQ ID NO: 1024969 - protein, 9 aa, Homo Sapiens
KQVVCLMAY

SEQ ID NO: 1024970 - protein, 9 aa, Homo Sapiens
TAKINAILA

SEQ ID NO: 1024971 - protein, 9 aa, Homo Sapiens
KIYDTIFAG

SEQ ID NO: 1024972 - protein, 9 aa, Homo Sapiens
DSWDATRAA

SEQ ID NO: 1024973 - protein, 9 aa, Homo Sapiens
PGDCPPEAT

SEQ ID NO: 1024974 - protein, 9 aa, Homo Sapiens
FALVCWYGW

SEQ ID NO: 1024975 - protein, 9 aa, Homo Sapiens
DLEVADYAF

SEQ ID NO: 1024976 - protein, 9 aa, Homo Sapiens
IIHLVEVVL

SEQ ID NO: 1024977 - protein, 9 aa, Homo Sapiens
TKKNLEGTL

SEQ ID NO: 1024978 - protein, 9 aa, Homo Sapiens
FLFRRRWQR

SEQ ID NO: 1024979 - protein, 9 aa, Homo Sapiens
KKPAEDCLF

SEQ ID NO: 1024980 - protein, 9 aa, Homo Sapiens
RKLANKSWE

SEQ ID NO: 1024981 - protein, 9 aa, Homo Sapiens
SLDYFSPRD

SEQ ID NO: 1024982 - protein, 9 aa, Homo Sapiens
TNYRQPPLD

SEQ ID NO: 1024983 - protein, 9 aa, Homo Sapiens
GLLGEGCVG

SEQ ID NO: 1024984 - protein, 9 aa, Homo Sapiens
VVRLNLQLF

SEQ ID NO: 1024985 - protein, 9 aa, Homo Sapiens
AAVLWKLKK

SEQ ID NO: 1024986 - protein, 9 aa, Homo Sapiens
VSTSYQLHT

SEQ ID NO: 1024987 - protein, 9 aa, Homo Sapiens
VRCRGFPRG

SEQ ID NO: 1024988 - protein, 9 aa, Homo Sapiens
GFTCLMQAM

SEQ ID NO: 1024989 - protein, 9 aa, Homo Sapiens
VQSLNGNSY

SEQ ID NO: 1024990 - protein, 9 aa, Homo Sapiens
EKPSNENCN

SEQ ID NO: 1024991 - protein, 9 aa, Homo Sapiens
LPSGCLRNF

SEQ ID NO: 1024992 - protein, 9 aa, Homo Sapiens
NLLSHYWIS

SEQ ID NO: 1024993 - protein, 9 aa, Homo Sapiens
TKDELSDIQ

SEQ ID NO: 1024994 - protein, 9 aa, Homo Sapiens
STGEVLSLV

SEQ ID NO: 1024995 - protein, 9 aa, Homo Sapiens
TIEIYARDV

SEQ ID NO: 1024996 - protein, 9 aa, Homo Sapiens
NWIVVNCFT

SEQ ID NO: 1024997 - protein, 9 aa, Homo Sapiens
EYQKLMSVK

SEQ ID NO: 1024998 - protein, 9 aa, Homo Sapiens
EKQLAAIYA

SEQ ID NO: 1024999 - protein, 9 aa, Homo Sapiens
LLGPMLEAY

SEQ ID NO: 1025000 - protein, 9 aa, Homo Sapiens
LSQTFEDQS

SEQ ID NO: 1025001 - protein, 9 aa, Homo Sapiens
KPLRAMWKQ

SEQ ID NO: 1025002 - protein, 9 aa, Homo Sapiens
LTPLKIKID

SEQ ID NO: 1025003 - protein, 9 aa, Homo Sapiens
PNLQILACG

SEQ ID NO: 1025004 - protein, 9 aa, Homo Sapiens
ILEKYDRHL

SEQ ID NO: 1025005 - protein, 9 aa, Homo Sapiens
REKKLQDVG

SEQ ID NO: 1025006 - protein, 9 aa, Homo Sapiens
ENNSGVPCN

SEQ ID NO: 1025007 - protein, 9 aa, Homo Sapiens
FSSGSSSTS

SEQ ID NO: 1025008 - protein, 9 aa, Homo Sapiens
DYYSECQSQ

SEQ ID NO: 1025009 - protein, 9 aa, Homo Sapiens
QEKAEDDVE

SEQ ID NO: 1025010 - protein, 9 aa, Homo Sapiens
DSSNQEEEE

SEQ ID NO: 1025011 - protein, 9 aa, Homo Sapiens
CDLCFRVYY

SEQ ID NO: 1025012 - protein, 9 aa, Homo Sapiens
CPNEFFGEH

SEQ ID NO: 1025013 - protein, 9 aa, Homo Sapiens
QAFSYPDVK

SEQ ID NO: 1025014 - protein, 9 aa, Homo Sapiens
FVNLAFSDA

SEQ ID NO: 1025015 - protein, 9 aa, Homo Sapiens
QTPLFQLNK

SEQ ID NO: 1025016 - protein, 9 aa, Homo Sapiens
ELRKTFREI

SEQ ID NO: 1025017 - protein, 9 aa, Homo Sapiens
HSDWVRNVA

SEQ ID NO: 1025018 - protein, 9 aa, Homo Sapiens
PKVINGTPP

SEQ ID NO: 1025019 - protein, 9 aa, Homo Sapiens
SHLSGPSPF

SEQ ID NO: 1025020 - protein, 9 aa, Homo Sapiens
FCKDVVLNK

SEQ ID NO: 1025021 - protein, 9 aa, Homo Sapiens
VVLNKKLMK

SEQ ID NO: 1025022 - protein, 9 aa, Homo Sapiens
DHLACFCKD

SEQ ID NO: 1025023 - protein, 9 aa, Homo Sapiens
QKILMVRFL

SEQ ID NO: 1025024 - protein, 9 aa, Homo Sapiens
NVMPFASRV

SEQ ID NO: 1025025 - protein, 9 aa, Homo Sapiens
EIDWARRAD

SEQ ID NO: 1025026 - protein, 9 aa, Homo Sapiens
EYELCLDLT

SEQ ID NO: 1025027 - protein, 9 aa, Homo Sapiens
VYLGMMTGA

SEQ ID NO: 1025028 - protein, 9 aa, Homo Sapiens
GAEDWAFSE

SEQ ID NO: 1025029 - protein, 9 aa, Homo Sapiens
AIIPQMLVV

SEQ ID NO: 1025030 - protein, 9 aa, Homo Sapiens
TFSPSPPPN

SEQ ID NO: 1025031 - protein, 9 aa, Homo Sapiens
EKVTQMEGS

SEQ ID NO: 1025032 - protein, 9 aa, Homo Sapiens
GTGYFRLGK

SEQ ID NO: 1025033 - protein, 9 aa, Homo Sapiens
VSFAFYQQG

SEQ ID NO: 1025034 - protein, 9 aa, Homo Sapiens
QKKLKNQRL

SEQ ID NO: 1025035 - protein, 9 aa, Homo Sapiens
CVKQKEKEQ

SEQ ID NO: 1025036 - protein, 9 aa, Homo Sapiens
RGFCIQFQK

SEQ ID NO: 1025037 - protein, 9 aa, Homo Sapiens
ELWVTDPTS

SEQ ID NO: 1025038 - protein, 9 aa, Homo Sapiens
LKWLEDVCV

SEQ ID NO: 1025039 - protein, 9 aa, Homo Sapiens
SIPVIPDTK

SEQ ID NO: 1025040 - protein, 9 aa, Homo Sapiens
AGGFCRAPS

SEQ ID NO: 1025041 - protein, 9 aa, Homo Sapiens
TCRNTIGFF

SEQ ID NO: 1025042 - protein, 9 aa, Homo Sapiens
DYNSGDIFL

SEQ ID NO: 1025043 - protein, 9 aa, Homo Sapiens
VHAQDGKVM

SEQ ID NO: 1025044 - protein, 9 aa, Homo Sapiens
ETTKVEKKR

SEQ ID NO: 1025045 - protein, 9 aa, Homo Sapiens
FLGNVWFLA

SEQ ID NO: 1025046 - protein, 9 aa, Homo Sapiens
YELLDELMN

SEQ ID NO: 1025047 - protein, 9 aa, Homo Sapiens
ITFLFVKVT

SEQ ID NO: 1025048 - protein, 9 aa, Homo Sapiens
SLGLARKAR

SEQ ID NO: 1025049 - protein, 9 aa, Homo Sapiens
LYSSYGRES

SEQ ID NO: 1025050 - protein, 9 aa, Homo Sapiens
SAIYTLRNK

SEQ ID NO: 1025051 - protein, 9 aa, Homo Sapiens
VAVLVGAVI

SEQ ID NO: 1025052 - protein, 9 aa, Homo Sapiens
MKLFVAGGL

SEQ ID NO: 1025053 - protein, 9 aa, Homo Sapiens
EHLIGPCRD

SEQ ID NO: 1025054 - protein, 9 aa, Homo Sapiens
SFHIGWVIL

SEQ ID NO: 1025055 - protein, 9 aa, Homo Sapiens
PQPSSSSRK

SEQ ID NO: 1025056 - protein, 9 aa, Homo Sapiens
RGLYSSYGR

SEQ ID NO: 1025057 - protein, 9 aa, Homo Sapiens
DDEKEGEHE

SEQ ID NO: 1025058 - protein, 9 aa, Homo Sapiens
DKYLEETNF

SEQ ID NO: 1025059 - protein, 9 aa, Homo Sapiens
NNLQDDGVK

SEQ ID NO: 1025060 - protein, 9 aa, Homo Sapiens
AHKHPSHLS

SEQ ID NO: 1025061 - protein, 9 aa, Homo Sapiens
LHLAKDREG

SEQ ID NO: 1025062 - protein, 9 aa, Homo Sapiens
SSPLQPLPS

SEQ ID NO: 1025063 - protein, 9 aa, Homo Sapiens
ERKVTCKHL

SEQ ID NO: 1025064 - protein, 9 aa, Homo Sapiens
DFWFQMCDI

SEQ ID NO: 1025065 - protein, 9 aa, Homo Sapiens
IRTRQLTLQ

SEQ ID NO: 1025066 - protein, 9 aa, Homo Sapiens
KTFREIICC

SEQ ID NO: 1025067 - protein, 9 aa, Homo Sapiens
EPKVVRTTT

SEQ ID NO: 1025068 - protein, 9 aa, Homo Sapiens
GPKLLEVSE

SEQ ID NO: 1025069 - protein, 9 aa, Homo Sapiens
LLSRTSQSY

SEQ ID NO: 1025070 - protein, 9 aa, Homo Sapiens
LVSITINSH

SEQ ID NO: 1025071 - protein, 9 aa, Homo Sapiens
ERLLIELEE

SEQ ID NO: 1025072 - protein, 9 aa, Homo Sapiens
DDHELEDEF

SEQ ID NO: 1025073 - protein, 9 aa, Homo Sapiens
CDIKKWDQF

SEQ ID NO: 1025074 - protein, 9 aa, Homo Sapiens
QDCQKSNHM

SEQ ID NO: 1025075 - protein, 9 aa, Homo Sapiens
LCHLIPSPW

SEQ ID NO: 1025076 - protein, 9 aa, Homo Sapiens
DPSTGPLVQ

SEQ ID NO: 1025077 - protein, 9 aa, Homo Sapiens
KKAVSLLSS

SEQ ID NO: 1025078 - protein, 9 aa, Homo Sapiens
LKLICFLIS

SEQ ID NO: 1025079 - protein, 9 aa, Homo Sapiens
GGNRKVEEE

SEQ ID NO: 1025080 - protein, 9 aa, Homo Sapiens
TFKIKNNWY

SEQ ID NO: 1025081 - protein, 9 aa, Homo Sapiens
TLFRQMLSG

SEQ ID NO: 1025082 - protein, 9 aa, Homo Sapiens
LAKDATSSS

SEQ ID NO: 1025083 - protein, 9 aa, Homo Sapiens
IAVARMKGE

SEQ ID NO: 1025084 - protein, 9 aa, Homo Sapiens
ADRAKANPK

SEQ ID NO: 1025085 - protein, 9 aa, Homo Sapiens
KAERHIQEL

SEQ ID NO: 1025086 - protein, 9 aa, Homo Sapiens
VTSAHFAGL

SEQ ID NO: 1025087 - protein, 9 aa, Homo Sapiens
WRNSKERKL

SEQ ID NO: 1025088 - protein, 9 aa, Homo Sapiens
EVADYAFPP

SEQ ID NO: 1025089 - protein, 9 aa, Homo Sapiens
RVQPGPGSG

SEQ ID NO: 1025090 - protein, 9 aa, Homo Sapiens
YWLYADKIL

SEQ ID NO: 1025091 - protein, 9 aa, Homo Sapiens
PVSAGLFPY

SEQ ID NO: 1025092 - protein, 9 aa, Homo Sapiens
MLRGANIVR

SEQ ID NO: 1025093 - protein, 9 aa, Homo Sapiens
SYGCKECGK

SEQ ID NO: 1025094 - protein, 9 aa, Homo Sapiens
DGKSQDNVH

SEQ ID NO: 1025095 - protein, 9 aa, Homo Sapiens
CGAFLISPN

SEQ ID NO: 1025096 - protein, 9 aa, Homo Sapiens
EKNIAPAEQ

SEQ ID NO: 1025097 - protein, 9 aa, Homo Sapiens
ITINSHFLP

SEQ ID NO: 1025098 - protein, 9 aa, Homo Sapiens
SAFTFQLTG

SEQ ID NO: 1025099 - protein, 9 aa, Homo Sapiens
IQELETGRG

SEQ ID NO: 1025100 - protein, 9 aa, Homo Sapiens
SGLQGLLGP

SEQ ID NO: 1025101 - protein, 9 aa, Homo Sapiens
DNMSYFVEV

SEQ ID NO: 1025102 - protein, 9 aa, Homo Sapiens
RNQDELFNI

SEQ ID NO: 1025103 - protein, 9 aa, Homo Sapiens
RKSRENKTN

SEQ ID NO: 1025104 - protein, 9 aa, Homo Sapiens
LEQLCINCA

SEQ ID NO: 1025105 - protein, 9 aa, Homo Sapiens
EKMEHLIGP

SEQ ID NO: 1025106 - protein, 9 aa, Homo Sapiens
NTPFQHSHS

SEQ ID NO: 1025107 - protein, 9 aa, Homo Sapiens
LDPCRNRAT

SEQ ID NO: 1025108 - protein, 9 aa, Homo Sapiens
RLASGPIEV

SEQ ID NO: 1025109 - protein, 9 aa, Homo Sapiens
GPPPVLAFP

SEQ ID NO: 1025110 - protein, 9 aa, Homo Sapiens
LLTYLCAEY

SEQ ID NO: 1025111 - protein, 9 aa, Homo Sapiens
VKIEPSLPS

SEQ ID NO: 1025112 - protein, 9 aa, Homo Sapiens
ISDSHLYTP

SEQ ID NO: 1025113 - protein, 9 aa, Homo Sapiens
SMENTGKQV

SEQ ID NO: 1025114 - protein, 9 aa, Homo Sapiens
RREPDQLET

SEQ ID NO: 1025115 - protein, 9 aa, Homo Sapiens
RVNETVGRE

SEQ ID NO: 1025116 - protein, 9 aa, Homo Sapiens
SRTTQATHP

SEQ ID NO: 1025117 - protein, 9 aa, Homo Sapiens
FSLLISARF

SEQ ID NO: 1025118 - protein, 9 aa, Homo Sapiens
QKLQEKPSK

SEQ ID NO: 1025119 - protein, 9 aa, Homo Sapiens
EDYKEPIEV

SEQ ID NO: 1025120 - protein, 9 aa, Homo Sapiens
LCNLTITWK

SEQ ID NO: 1025121 - protein, 9 aa, Homo Sapiens
GSIFTNAQD

SEQ ID NO: 1025122 - protein, 9 aa, Homo Sapiens
HKTQEKEET

SEQ ID NO: 1025123 - protein, 9 aa, Homo Sapiens
CAFHFIAVG

SEQ ID NO: 1025124 - protein, 9 aa, Homo Sapiens
QILASVAQQ

SEQ ID NO: 1025125 - protein, 9 aa, Homo Sapiens
ARFTPKILA

SEQ ID NO: 1025126 - protein, 9 aa, Homo Sapiens
KKKVTRNMI

SEQ ID NO: 1025127 - protein, 9 aa, Homo Sapiens
GGPFFLTTH

SEQ ID NO: 1025128 - protein, 9 aa, Homo Sapiens
QIQESQVTF

SEQ ID NO: 1025129 - protein, 9 aa, Homo Sapiens
HCRPRGAEG

SEQ ID NO: 1025130 - protein, 9 aa, Homo Sapiens
LPKPTLWAK

SEQ ID NO: 1025131 - protein, 9 aa, Homo Sapiens
VTRNMICAG

SEQ ID NO: 1025132 - protein, 9 aa, Homo Sapiens
RPPLSLSED

SEQ ID NO: 1025133 - protein, 9 aa, Homo Sapiens
LKRKVIKKV

SEQ ID NO: 1025134 - protein, 9 aa, Homo Sapiens
LEFITNRMI

SEQ ID NO: 1025135 - protein, 9 aa, Homo Sapiens
GFPISITVD

SEQ ID NO: 1025136 - protein, 9 aa, Homo Sapiens
EGMSSSEKP

SEQ ID NO: 1025137 - protein, 9 aa, Homo Sapiens
NKAKDVCLN

SEQ ID NO: 1025138 - protein, 9 aa, Homo Sapiens
QGDETLCFV

SEQ ID NO: 1025139 - protein, 9 aa, Homo Sapiens
SSLIVGSRP

SEQ ID NO: 1025140 - protein, 9 aa, Homo Sapiens
PPGNPGLSG

SEQ ID NO: 1025141 - protein, 9 aa, Homo Sapiens
YVRGGYILP

SEQ ID NO: 1025142 - protein, 9 aa, Homo Sapiens
TSVRCRGFP

SEQ ID NO: 1025143 - protein, 9 aa, Homo Sapiens
DGPNKNPEA

SEQ ID NO: 1025144 - protein, 9 aa, Homo Sapiens
TRSLVKLQG

SEQ ID NO: 1025145 - protein, 9 aa, Homo Sapiens
KKERNKGNE

SEQ ID NO: 1025146 - protein, 9 aa, Homo Sapiens
DVVVHEVQR

SEQ ID NO: 1025147 - protein, 9 aa, Homo Sapiens
PPEHPGQQG

SEQ ID NO: 1025148 - protein, 9 aa, Homo Sapiens
RRLIQVMMM

SEQ ID NO: 1025149 - protein, 9 aa, Homo Sapiens
PQGRGLVLQ

SEQ ID NO: 1025150 - protein, 9 aa, Homo Sapiens
IDCEQNNDA

SEQ ID NO: 1025151 - protein, 9 aa, Homo Sapiens
QVIDSFTKI

SEQ ID NO: 1025152 - protein, 9 aa, Homo Sapiens
EGGGSRSEL

SEQ ID NO: 1025153 - protein, 9 aa, Homo Sapiens
LETLNIRNI

SEQ ID NO: 1025154 - protein, 9 aa, Homo Sapiens
LVMLGSAYN

SEQ ID NO: 1025155 - protein, 9 aa, Homo Sapiens
IHEGENFYK

SEQ ID NO: 1025156 - protein, 9 aa, Homo Sapiens
AMSCEKTML

SEQ ID NO: 1025157 - protein, 9 aa, Homo Sapiens
PTKSSKVKA

SEQ ID NO: 1025158 - protein, 9 aa, Homo Sapiens
SSFCSVRAI

SEQ ID NO: 1025159 - protein, 9 aa, Homo Sapiens
AVIGVTPFA

SEQ ID NO: 1025160 - protein, 9 aa, Homo Sapiens
DPSFGDPAV

SEQ ID NO: 1025161 - protein, 9 aa, Homo Sapiens
SLMGMNLPG

SEQ ID NO: 1025162 - protein, 9 aa, Homo Sapiens
YDGVENSYI

SEQ ID NO: 1025163 - protein, 9 aa, Homo Sapiens
PRLSLPPRL

SEQ ID NO: 1025164 - protein, 9 aa, Homo Sapiens
LSTLDTKKN

SEQ ID NO: 1025165 - protein, 9 aa, Homo Sapiens
HREDKVISV

SEQ ID NO: 1025166 - protein, 9 aa, Homo Sapiens
LFTIEGLGF

SEQ ID NO: 1025167 - protein, 9 aa, Homo Sapiens
TKSLVYGIV

SEQ ID NO: 1025168 - protein, 9 aa, Homo Sapiens
TESIFENDP

SEQ ID NO: 1025169 - protein, 9 aa, Homo Sapiens
IFPNSFYED

SEQ ID NO: 1025170 - protein, 9 aa, Homo Sapiens
PTMKDSVNV

SEQ ID NO: 1025171 - protein, 9 aa, Homo Sapiens
FPNMISRRT

SEQ ID NO: 1025172 - protein, 9 aa, Homo Sapiens
NDNMSYFVE

SEQ ID NO: 1025173 - protein, 9 aa, Homo Sapiens
GLPGPPRIA

SEQ ID NO: 1025174 - protein, 9 aa, Homo Sapiens
NDDIFEEDE

SEQ ID NO: 1025175 - protein, 9 aa, Homo Sapiens
ELLLDKIYD

SEQ ID NO: 1025176 - protein, 9 aa, Homo Sapiens
IWIEIIALS

SEQ ID NO: 1025177 - protein, 9 aa, Homo Sapiens
YRYTDDGAR

SEQ ID NO: 1025178 - protein, 9 aa, Homo Sapiens
WSSWSSCVQ

SEQ ID NO: 1025179 - protein, 9 aa, Homo Sapiens
KVIKEFSNV

SEQ ID NO: 1025180 - protein, 9 aa, Homo Sapiens
GLLLVLTML

SEQ ID NO: 1025181 - protein, 9 aa, Homo Sapiens
RTLRTWDLQ

SEQ ID NO: 1025182 - protein, 9 aa, Homo Sapiens
KITSFVIPE

SEQ ID NO: 1025183 - protein, 9 aa, Homo Sapiens
SNPAIGSIT

SEQ ID NO: 1025184 - protein, 9 aa, Homo Sapiens
FFDRDSDIF

SEQ ID NO: 1025185 - protein, 9 aa, Homo Sapiens
CNLAEGGFF

SEQ ID NO: 1025186 - protein, 9 aa, Homo Sapiens
MILLVNFFV

SEQ ID NO: 1025187 - protein, 9 aa, Homo Sapiens
DFAEKLADT

SEQ ID NO: 1025188 - protein, 9 aa, Homo Sapiens
RNPLRKFKL

SEQ ID NO: 1025189 - protein, 9 aa, Homo Sapiens
DMQDMNNLL

SEQ ID NO: 1025190 - protein, 9 aa, Homo Sapiens
SLNEAFVAL

SEQ ID NO: 1025191 - protein, 9 aa, Homo Sapiens
FSLKRQFRS

SEQ ID NO: 1025192 - protein, 9 aa, Homo Sapiens
EIYSHLVII

SEQ ID NO: 1025193 - protein, 9 aa, Homo Sapiens
RNFQKHSPT

SEQ ID NO: 1025194 - protein, 9 aa, Homo Sapiens
KTKSSANPE

SEQ ID NO: 1025195 - protein, 9 aa, Homo Sapiens
KKNRNRNIM

SEQ ID NO: 1025196 - protein, 9 aa, Homo Sapiens
SQTGNDEKA

SEQ ID NO: 1025197 - protein, 9 aa, Homo Sapiens
PKQKNGTLA

SEQ ID NO: 1025198 - protein, 9 aa, Homo Sapiens
GPSGKPGIS

SEQ ID NO: 1025199 - protein, 9 aa, Homo Sapiens
LHELSGNKS

SEQ ID NO: 1025200 - protein, 9 aa, Homo Sapiens
GPQAGPPLL

SEQ ID NO: 1025201 - protein, 9 aa, Homo Sapiens
NYRQPPLDY

SEQ ID NO: 1025202 - protein, 9 aa, Homo Sapiens
EKAFDFFEE

SEQ ID NO: 1025203 - protein, 9 aa, Homo Sapiens
GSGGGILEA

SEQ ID NO: 1025204 - protein, 9 aa, Homo Sapiens
EYFWEKKVT

SEQ ID NO: 1025205 - protein, 9 aa, Homo Sapiens
LFSLFQAQY

SEQ ID NO: 1025206 - protein, 9 aa, Homo Sapiens
NLYVRGGYI

SEQ ID NO: 1025207 - protein, 9 aa, Homo Sapiens
ESVELHIIQ

SEQ ID NO: 1025208 - protein, 9 aa, Homo Sapiens
FKLDKFLII

SEQ ID NO: 1025209 - protein, 9 aa, Homo Sapiens
KSTRSLVKL

SEQ ID NO: 1025210 - protein, 9 aa, Homo Sapiens
HCCREDVHN

SEQ ID NO: 1025211 - protein, 9 aa, Homo Sapiens
VPSDCPSKD

SEQ ID NO: 1025212 - protein, 9 aa, Homo Sapiens
DSFFLDKVV

SEQ ID NO: 1025213 - protein, 9 aa, Homo Sapiens
FFNLLVDSL

SEQ ID NO: 1025214 - protein, 9 aa, Homo Sapiens
TPGPRPPRF

SEQ ID NO: 1025215 - protein, 9 aa, Homo Sapiens
HEVKPLRAM

SEQ ID NO: 1025216 - protein, 9 aa, Homo Sapiens
KILMVRFLV

SEQ ID NO: 1025217 - protein, 9 aa, Homo Sapiens
TFAVGCASA

SEQ ID NO: 1025218 - protein, 9 aa, Homo Sapiens
INFGAHREA

SEQ ID NO: 1025219 - protein, 9 aa, Homo Sapiens
ENERILRPL

SEQ ID NO: 1025220 - protein, 9 aa, Homo Sapiens
VVNCFTPAN

SEQ ID NO: 1025221 - protein, 9 aa, Homo Sapiens
RKVPNLQIL

SEQ ID NO: 1025222 - protein, 9 aa, Homo Sapiens
IMKILIMFA

SEQ ID NO: 1025223 - protein, 9 aa, Homo Sapiens
EKEGEHEEE

SEQ ID NO: 1025224 - protein, 9 aa, Homo Sapiens
SSGVDAAYE

SEQ ID NO: 1025225 - protein, 9 aa, Homo Sapiens
EPSTFPDLE

SEQ ID NO: 1025226 - protein, 9 aa, Homo Sapiens
VELSVIGHM

SEQ ID NO: 1025227 - protein, 9 aa, Homo Sapiens
TNRTLHLFG

SEQ ID NO: 1025228 - protein, 9 aa, Homo Sapiens
DKQKNRKNL

SEQ ID NO: 1025229 - protein, 9 aa, Homo Sapiens
IHLSPEKFE

SEQ ID NO: 1025230 - protein, 9 aa, Homo Sapiens
GEIIFLIYQ

SEQ ID NO: 1025231 - protein, 9 aa, Homo Sapiens
RGRQVIGLF

SEQ ID NO: 1025232 - protein, 9 aa, Homo Sapiens
MGFTCLMQA

SEQ ID NO: 1025233 - protein, 9 aa, Homo Sapiens
SPSPPPNNP

SEQ ID NO: 1025234 - protein, 9 aa, Homo Sapiens
SEKSWNQAR

SEQ ID NO: 1025235 - protein, 9 aa, Homo Sapiens
ILAVLTSRL

SEQ ID NO: 1025236 - protein, 9 aa, Homo Sapiens
DPKVCCNYS

SEQ ID NO: 1025237 - protein, 9 aa, Homo Sapiens
PARFTPKIL

SEQ ID NO: 1025238 - protein, 9 aa, Homo Sapiens
ILDTAGKEE

SEQ ID NO: 1025239 - protein, 9 aa, Homo Sapiens
KGATHCYDG

SEQ ID NO: 1025240 - protein, 9 aa, Homo Sapiens
EPDRRNQSS

SEQ ID NO: 1025241 - protein, 9 aa, Homo Sapiens
LRYVLEQLY

SEQ ID NO: 1025242 - protein, 9 aa, Homo Sapiens
VQLILDNLG

SEQ ID NO: 1025243 - protein, 9 aa, Homo Sapiens
LYRRKRVPE

SEQ ID NO: 1025244 - protein, 9 aa, Homo Sapiens
FQSGDLSQN

SEQ ID NO: 1025245 - protein, 9 aa, Homo Sapiens
QISGVKKFM

SEQ ID NO: 1025246 - protein, 9 aa, Homo Sapiens
KEINTQIMF

SEQ ID NO: 1025247 - protein, 9 aa, Homo Sapiens
GSSSHTAIP

SEQ ID NO: 1025248 - protein, 9 aa, Homo Sapiens
AEPRDSSNQ

SEQ ID NO: 1025249 - protein, 9 aa, Homo Sapiens
TILDNNDNA

SEQ ID NO: 1025250 - protein, 9 aa, Homo Sapiens
SGIAWTIPS

SEQ ID NO: 1025251 - protein, 9 aa, Homo Sapiens
SSVDQGATG

SEQ ID NO: 1025252 - protein, 9 aa, Homo Sapiens
YEDIEVGTI

SEQ ID NO: 1025253 - protein, 9 aa, Homo Sapiens
VPYVFGIPI

SEQ ID NO: 1025254 - protein, 9 aa, Homo Sapiens
IDSFTKIVK

SEQ ID NO: 1025255 - protein, 9 aa, Homo Sapiens
EKIPRDMYE

SEQ ID NO: 1025256 - protein, 9 aa, Homo Sapiens
TTWQREISR

SEQ ID NO: 1025257 - protein, 9 aa, Homo Sapiens
STNTVASER

SEQ ID NO: 1025258 - protein, 9 aa, Homo Sapiens
THTGENSYG

SEQ ID NO: 1025259 - protein, 9 aa, Homo Sapiens
LEVADYAFP

SEQ ID NO: 1025260 - protein, 9 aa, Homo Sapiens
SPNYLCHLC

SEQ ID NO: 1025261 - protein, 9 aa, Homo Sapiens
EELYLSCGY

SEQ ID NO: 1025262 - protein, 9 aa, Homo Sapiens
PSGDIPYRK

SEQ ID NO: 1025263 - protein, 9 aa, Homo Sapiens
ESLPPLPLS

SEQ ID NO: 1025264 - protein, 9 aa, Homo Sapiens
SLPDYKKTL

SEQ ID NO: 1025265 - protein, 9 aa, Homo Sapiens
VELLLNVPE

SEQ ID NO: 1025266 - protein, 9 aa, Homo Sapiens
CELGLKNET

SEQ ID NO: 1025267 - protein, 9 aa, Homo Sapiens
GFLNNASTE

SEQ ID NO: 1025268 - protein, 9 aa, Homo Sapiens
VIPDTKPYG

SEQ ID NO: 1025269 - protein, 9 aa, Homo Sapiens
FPFSKPPLI

SEQ ID NO: 1025270 - protein, 9 aa, Homo Sapiens
PNSCTSQIE

SEQ ID NO: 1025271 - protein, 9 aa, Homo Sapiens
TTRMLMIVL

SEQ ID NO: 1025272 - protein, 9 aa, Homo Sapiens
EMMWEKEKM

SEQ ID NO: 1025273 - protein, 9 aa, Homo Sapiens
VTASHNLEG

SEQ ID NO: 1025274 - protein, 9 aa, Homo Sapiens
LNEAFVALR

SEQ ID NO: 1025275 - protein, 9 aa, Homo Sapiens
SGVKKFMHS

SEQ ID NO: 1025276 - protein, 9 aa, Homo Sapiens
HYAKKDEAS

SEQ ID NO: 1025277 - protein, 9 aa, Homo Sapiens
NKPGAFLIR

SEQ ID NO: 1025278 - protein, 9 aa, Homo Sapiens
ILTSIVSAG

SEQ ID NO: 1025279 - protein, 9 aa, Homo Sapiens
WGDYKGEKK

SEQ ID NO: 1025280 - protein, 9 aa, Homo Sapiens
VSLVMLGSA

SEQ ID NO: 1025281 - protein, 9 aa, Homo Sapiens
SPESPEDAG

SEQ ID NO: 1025282 - protein, 9 aa, Homo Sapiens
PKNLTVVEG

SEQ ID NO: 1025283 - protein, 9 aa, Homo Sapiens
YARDVLEKL

SEQ ID NO: 1025284 - protein, 9 aa, Homo Sapiens
NEGTRPPLS

SEQ ID NO: 1025285 - protein, 9 aa, Homo Sapiens
LLIELEEAL

SEQ ID NO: 1025286 - protein, 9 aa, Homo Sapiens
ENGNQNRSG

SEQ ID NO: 1025287 - protein, 9 aa, Homo Sapiens
SAAAQSLMG

SEQ ID NO: 1025288 - protein, 9 aa, Homo Sapiens
FSSGDHGLG

SEQ ID NO: 1025289 - protein, 9 aa, Homo Sapiens
YLLQPSYLA

SEQ ID NO: 1025290 - protein, 9 aa, Homo Sapiens
QTGNDEKAF

SEQ ID NO: 1025291 - protein, 9 aa, Homo Sapiens
AISEISSQL

SEQ ID NO: 1025292 - protein, 9 aa, Homo Sapiens
RRSAVPFTA

SEQ ID NO: 1025293 - protein, 9 aa, Homo Sapiens
EVAGGRKDP

SEQ ID NO: 1025294 - protein, 9 aa, Homo Sapiens
LQSLVFLLD

SEQ ID NO: 1025295 - protein, 9 aa, Homo Sapiens
ECLPLSTVT

SEQ ID NO: 1025296 - protein, 9 aa, Homo Sapiens
YFTVQVHDM

SEQ ID NO: 1025297 - protein, 9 aa, Homo Sapiens
LLLVLTMLT

SEQ ID NO: 1025298 - protein, 9 aa, Homo Sapiens
KGGAAGRRR

SEQ ID NO: 1025299 - protein, 9 aa, Homo Sapiens
SSFEKHQIT

SEQ ID NO: 1025300 - protein, 9 aa, Homo Sapiens
ITDACLLVV

SEQ ID NO: 1025301 - protein, 9 aa, Homo Sapiens
HPPEHPGQQ

SEQ ID NO: 1025302 - protein, 9 aa, Homo Sapiens
MLGSAYNHT

SEQ ID NO: 1025303 - protein, 9 aa, Homo Sapiens
GLSGTSATQ

SEQ ID NO: 1025304 - protein, 9 aa, Homo Sapiens
YFSSGSCRK

SEQ ID NO: 1025305 - protein, 9 aa, Homo Sapiens
SQPCVPTCF

SEQ ID NO: 1025306 - protein, 9 aa, Homo Sapiens
FFDDLQVVF

SEQ ID NO: 1025307 - protein, 9 aa, Homo Sapiens
WVQAALDRE

SEQ ID NO: 1025308 - protein, 9 aa, Homo Sapiens
EEDQAEEIS

SEQ ID NO: 1025309 - protein, 9 aa, Homo Sapiens
FCHRSDDPV

SEQ ID NO: 1025310 - protein, 9 aa, Homo Sapiens
HFSDTFPEH

SEQ ID NO: 1025311 - protein, 9 aa, Homo Sapiens
LAEEMLLKH

SEQ ID NO: 1025312 - protein, 9 aa, Homo Sapiens
QLYSRDMVC

SEQ ID NO: 1025313 - protein, 9 aa, Homo Sapiens
FELSVTFNY

SEQ ID NO: 1025314 - protein, 9 aa, Homo Sapiens
LRLTDDPNF

SEQ ID NO: 1025315 - protein, 9 aa, Homo Sapiens
SIQPSFCHR

SEQ ID NO: 1025316 - protein, 9 aa, Homo Sapiens
QRDKRMEDV

SEQ ID NO: 1025317 - protein, 9 aa, Homo Sapiens
FSGSRTTSA

SEQ ID NO: 1025318 - protein, 9 aa, Homo Sapiens
FVEKIPRDM

SEQ ID NO: 1025319 - protein, 9 aa, Homo Sapiens
SRVSAVEPE

SEQ ID NO: 1025320 - protein, 9 aa, Homo Sapiens
HLATHQKIY

SEQ ID NO: 1025321 - protein, 9 aa, Homo Sapiens
CFRVYYSKC

SEQ ID NO: 1025322 - protein, 9 aa, Homo Sapiens
ILLQYLQNE

SEQ ID NO: 1025323 - protein, 9 aa, Homo Sapiens
FPLSINAKC

SEQ ID NO: 1025324 - protein, 9 aa, Homo Sapiens
FPCCQSSRT

SEQ ID NO: 1025325 - protein, 9 aa, Homo Sapiens
CRAFMNLTL

SEQ ID NO: 1025326 - protein, 9 aa, Homo Sapiens
DCSRDSRGH

SEQ ID NO: 1025327 - protein, 9 aa, Homo Sapiens
RPCDLSGPT

SEQ ID NO: 1025328 - protein, 9 aa, Homo Sapiens
TTARLVRAG

SEQ ID NO: 1025329 - protein, 9 aa, Homo Sapiens
QRQCNNPLP

SEQ ID NO: 1025330 - protein, 9 aa, Homo Sapiens
TVIESGLLF

SEQ ID NO: 1025331 - protein, 9 aa, Homo Sapiens
FFGVSELLK

SEQ ID NO: 1025332 - protein, 9 aa, Homo Sapiens
MVSLGFPFS

SEQ ID NO: 1025333 - protein, 9 aa, Homo Sapiens
HLFPRLSNN

SEQ ID NO: 1025334 - protein, 9 aa, Homo Sapiens
AGRQVRMQA

SEQ ID NO: 1025335 - protein, 9 aa, Homo Sapiens
FTNAQDPGL

SEQ ID NO: 1025336 - protein, 9 aa, Homo Sapiens
ISSFYTKNL

SEQ ID NO: 1025337 - protein, 9 aa, Homo Sapiens
LVPAAPSGP

SEQ ID NO: 1025338 - protein, 9 aa, Homo Sapiens
EHGPDGISV

SEQ ID NO: 1025339 - protein, 9 aa, Homo Sapiens
GKLRACRQR

SEQ ID NO: 1025340 - protein, 9 aa, Homo Sapiens
VQCDKDPVI

SEQ ID NO: 1025341 - protein, 9 aa, Homo Sapiens
PQDDIDSSR

SEQ ID NO: 1025342 - protein, 9 aa, Homo Sapiens
ENCQAEFSP

SEQ ID NO: 1025343 - protein, 9 aa, Homo Sapiens
NLEVSYSHS

SEQ ID NO: 1025344 - protein, 9 aa, Homo Sapiens
EEGLEECSK

SEQ ID NO: 1025345 - protein, 9 aa, Homo Sapiens
MDEANLELL

SEQ ID NO: 1025346 - protein, 9 aa, Homo Sapiens
SRSSDSDVS

SEQ ID NO: 1025347 - protein, 9 aa, Homo Sapiens
GVQTFSSGK

SEQ ID NO: 1025348 - protein, 9 aa, Homo Sapiens
RPSPNYLCH

SEQ ID NO: 1025349 - protein, 9 aa, Homo Sapiens
STKSPQPSS

SEQ ID NO: 1025350 - protein, 9 aa, Homo Sapiens
KQISPASIK

SEQ ID NO: 1025351 - protein, 9 aa, Homo Sapiens
THWVYDGVE

SEQ ID NO: 1025352 - protein, 9 aa, Homo Sapiens
FISQWSFFF

SEQ ID NO: 1025353 - protein, 9 aa, Homo Sapiens
INFYDKIRK

SEQ ID NO: 1025354 - protein, 9 aa, Homo Sapiens
RNSKERKLL

SEQ ID NO: 1025355 - protein, 9 aa, Homo Sapiens
KRKVIKKVQ

SEQ ID NO: 1025356 - protein, 9 aa, Homo Sapiens
SHLKKKAVI

SEQ ID NO: 1025357 - protein, 9 aa, Homo Sapiens
EQRLQDSRM

SEQ ID NO: 1025358 - protein, 9 aa, Homo Sapiens
QKQPARGEH

SEQ ID NO: 1025359 - protein, 9 aa, Homo Sapiens
SLTIIILYA

SEQ ID NO: 1025360 - protein, 9 aa, Homo Sapiens
FFAKKIIPS

SEQ ID NO: 1025361 - protein, 9 aa, Homo Sapiens
INRTTRFFT

SEQ ID NO: 1025362 - protein, 9 aa, Homo Sapiens
QRKKRKQKE

SEQ ID NO: 1025363 - protein, 9 aa, Homo Sapiens
VSQRAAYSP

SEQ ID NO: 1025364 - protein, 9 aa, Homo Sapiens
AAETSGGLR

SEQ ID NO: 1025365 - protein, 9 aa, Homo Sapiens
KLTRARNKE

SEQ ID NO: 1025366 - protein, 9 aa, Homo Sapiens
TDHLKLFLF

SEQ ID NO: 1025367 - protein, 9 aa, Homo Sapiens
KLFLFRRRW

SEQ ID NO: 1025368 - protein, 9 aa, Homo Sapiens
SLAPPLTKK

SEQ ID NO: 1025369 - protein, 9 aa, Homo Sapiens
GDRGPKEPK

SEQ ID NO: 1025370 - protein, 9 aa, Homo Sapiens
FITNRMIKS

SEQ ID NO: 1025371 - protein, 9 aa, Homo Sapiens
VLDFGKDAA

SEQ ID NO: 1025372 - protein, 9 aa, Homo Sapiens
SGATEDYSY

SEQ ID NO: 1025373 - protein, 9 aa, Homo Sapiens
LQEVGSRGG

SEQ ID NO: 1025374 - protein, 9 aa, Homo Sapiens
SLTKVDKAE

SEQ ID NO: 1025375 - protein, 9 aa, Homo Sapiens
GALSWRPSQ

SEQ ID NO: 1025376 - protein, 9 aa, Homo Sapiens
RPWIEIANK

SEQ ID NO: 1025377 - protein, 9 aa, Homo Sapiens
GATKRTCLG

SEQ ID NO: 1025378 - protein, 9 aa, Homo Sapiens
WLKNSNDVT

SEQ ID NO: 1025379 - protein, 9 aa, Homo Sapiens
FNQSSKTFF

SEQ ID NO: 1025380 - protein, 9 aa, Homo Sapiens
AYRKVQKVS

SEQ ID NO: 1025381 - protein, 9 aa, Homo Sapiens
RMECESSEP

SEQ ID NO: 1025382 - protein, 9 aa, Homo Sapiens
AVEKKEQKD

SEQ ID NO: 1025383 - protein, 9 aa, Homo Sapiens
GSSGPEFFT

SEQ ID NO: 1025384 - protein, 9 aa, Homo Sapiens
QQAAPSFYL

SEQ ID NO: 1025385 - protein, 9 aa, Homo Sapiens
CNWIVVNCF

SEQ ID NO: 1025386 - protein, 9 aa, Homo Sapiens
NVEIEWVKQ

SEQ ID NO: 1025387 - protein, 9 aa, Homo Sapiens
ARMKGEPGI

SEQ ID NO: 1025388 - protein, 9 aa, Homo Sapiens
SSSPDLGSE

SEQ ID NO: 1025389 - protein, 9 aa, Homo Sapiens
GYGGIAPSA

SEQ ID NO: 1025390 - protein, 9 aa, Homo Sapiens
LSLESSPNA

SEQ ID NO: 1025391 - protein, 9 aa, Homo Sapiens
GKSSSEPWL

SEQ ID NO: 1025392 - protein, 9 aa, Homo Sapiens
PAENPGCRH

SEQ ID NO: 1025393 - protein, 9 aa, Homo Sapiens
EPGAPAQKP

SEQ ID NO: 1025394 - protein, 9 aa, Homo Sapiens
LFVAGGLLP

SEQ ID NO: 1025395 - protein, 9 aa, Homo Sapiens
KLYKEDDMF

SEQ ID NO: 1025396 - protein, 9 aa, Homo Sapiens
VALVTIEIY

SEQ ID NO: 1025397 - protein, 9 aa, Homo Sapiens
LCYPRVKVS

SEQ ID NO: 1025398 - protein, 9 aa, Homo Sapiens
TPNGQDPED

SEQ ID NO: 1025399 - protein, 9 aa, Homo Sapiens
LLGEGCVGQ

SEQ ID NO: 1025400 - protein, 9 aa, Homo Sapiens
AGLSGTSAT

SEQ ID NO: 1025401 - protein, 9 aa, Homo Sapiens
FSSKNPKPQ

SEQ ID NO: 1025402 - protein, 9 aa, Homo Sapiens
MNNLLSHYW

SEQ ID NO: 1025403 - protein, 9 aa, Homo Sapiens
AKDLSVILK

SEQ ID NO: 1025404 - protein, 9 aa, Homo Sapiens
PPKELQESQ

SEQ ID NO: 1025405 - protein, 9 aa, Homo Sapiens
CYISSENSD

SEQ ID NO: 1025406 - protein, 9 aa, Homo Sapiens
GTRKREYKN

SEQ ID NO: 1025407 - protein, 9 aa, Homo Sapiens
SEGISAGSS

SEQ ID NO: 1025408 - protein, 9 aa, Homo Sapiens
GPIPPWLLN

SEQ ID NO: 1025409 - protein, 9 aa, Homo Sapiens
KVSNEYVTK

SEQ ID NO: 1025410 - protein, 9 aa, Homo Sapiens
TMALTTARL

SEQ ID NO: 1025411 - protein, 9 aa, Homo Sapiens
GVGFPISIT

SEQ ID NO: 1025412 - protein, 9 aa, Homo Sapiens
QLHGWNKQL

SEQ ID NO: 1025413 - protein, 9 aa, Homo Sapiens
PSSGWGLAG

SEQ ID NO: 1025414 - protein, 9 aa, Homo Sapiens
LSEPLPEKI

SEQ ID NO: 1025415 - protein, 9 aa, Homo Sapiens
GLSSQPSQR

SEQ ID NO: 1025416 - protein, 9 aa, Homo Sapiens
PAALATSEV

SEQ ID NO: 1025417 - protein, 9 aa, Homo Sapiens
KLARASVDV

SEQ ID NO: 1025418 - protein, 9 aa, Homo Sapiens
ILQSKVLLS

SEQ ID NO: 1025419 - protein, 9 aa, Homo Sapiens
LAVLTSRLL

SEQ ID NO: 1025420 - protein, 9 aa, Homo Sapiens
TRRLLDTKD

SEQ ID NO: 1025421 - protein, 9 aa, Homo Sapiens
FQEAERCKE

SEQ ID NO: 1025422 - protein, 9 aa, Homo Sapiens
ATVASSSFL

SEQ ID NO: 1025423 - protein, 9 aa, Homo Sapiens
ISCINFGAH

SEQ ID NO: 1025424 - protein, 9 aa, Homo Sapiens
LPFMGFEKF

SEQ ID NO: 1025425 - protein, 9 aa, Homo Sapiens
MLSHPNHTE

SEQ ID NO: 1025426 - protein, 9 aa, Homo Sapiens
QDLFSYCSE

SEQ ID NO: 1025427 - protein, 9 aa, Homo Sapiens
QPSWNSEDS

SEQ ID NO: 1025428 - protein, 9 aa, Homo Sapiens
DLGEAAAFF

SEQ ID NO: 1025429 - protein, 9 aa, Homo Sapiens
APLDHINLY

SEQ ID NO: 1025430 - protein, 9 aa, Homo Sapiens
KNDVDVALL

SEQ ID NO: 1025431 - protein, 9 aa, Homo Sapiens
RNFFLNGSS

SEQ ID NO: 1025432 - protein, 9 aa, Homo Sapiens
EEELEAQIF

SEQ ID NO: 1025433 - protein, 9 aa, Homo Sapiens
KQNEEAKTW

SEQ ID NO: 1025434 - protein, 9 aa, Homo Sapiens
CANEKLQQH

SEQ ID NO: 1025435 - protein, 9 aa, Homo Sapiens
GCLRKVDKR

SEQ ID NO: 1025436 - protein, 9 aa, Homo Sapiens
YMGGRYIEM

SEQ ID NO: 1025437 - protein, 9 aa, Homo Sapiens
GHTASTASS

SEQ ID NO: 1025438 - protein, 9 aa, Homo Sapiens
LYERLLIEL

SEQ ID NO: 1025439 - protein, 9 aa, Homo Sapiens
LQSKVLLSK

SEQ ID NO: 1025440 - protein, 9 aa, Homo Sapiens
VAVVSRGST

SEQ ID NO: 1025441 - protein, 9 aa, Homo Sapiens
RPVGSISLW

SEQ ID NO: 1025442 - protein, 9 aa, Homo Sapiens
PVQTIFRAA

SEQ ID NO: 1025443 - protein, 9 aa, Homo Sapiens
TQEEWDFQP

SEQ ID NO: 1025444 - protein, 9 aa, Homo Sapiens
PPCGPGEEL

SEQ ID NO: 1025445 - protein, 9 aa, Homo Sapiens
DSKLAYDDK

SEQ ID NO: 1025446 - protein, 9 aa, Homo Sapiens
TVQADPLDP

SEQ ID NO: 1025447 - protein, 9 aa, Homo Sapiens
DQKQPARGE

SEQ ID NO: 1025448 - protein, 9 aa, Homo Sapiens
ALPKVINGT

SEQ ID NO: 1025449 - protein, 9 aa, Homo Sapiens
MDSKLAYDD

SEQ ID NO: 1025450 - protein, 9 aa, Homo Sapiens
TRAVAVLAG

SEQ ID NO: 1025451 - protein, 9 aa, Homo Sapiens
VRYTEGYEQ

SEQ ID NO: 1025452 - protein, 9 aa, Homo Sapiens
ETCEFNITK

SEQ ID NO: 1025453 - protein, 9 aa, Homo Sapiens
KDVCLNQGP

SEQ ID NO: 1025454 - protein, 9 aa, Homo Sapiens
KPPGKPFKY

SEQ ID NO: 1025455 - protein, 9 aa, Homo Sapiens
SPRTSIILN

SEQ ID NO: 1025456 - protein, 9 aa, Homo Sapiens
SSSKTSDSL

SEQ ID NO: 1025457 - protein, 9 aa, Homo Sapiens
VDLVSARQP

SEQ ID NO: 1025458 - protein, 9 aa, Homo Sapiens
LLIIIAIYA

SEQ ID NO: 1025459 - protein, 9 aa, Homo Sapiens
LNLQLFDEP

SEQ ID NO: 1025460 - protein, 9 aa, Homo Sapiens
QPGRKGFLG

SEQ ID NO: 1025461 - protein, 9 aa, Homo Sapiens
DGAAPAKIV

SEQ ID NO: 1025462 - protein, 9 aa, Homo Sapiens
SQGRRRKEN

SEQ ID NO: 1025463 - protein, 9 aa, Homo Sapiens
LAKVKSYRS

SEQ ID NO: 1025464 - protein, 9 aa, Homo Sapiens
ILFDCLLTP

SEQ ID NO: 1025465 - protein, 9 aa, Homo Sapiens
ILFDCLLTV

SEQ ID NO: 1025466 - protein, 9 aa, Homo Sapiens
SWPERSELV

SEQ ID NO: 1025467 - protein, 9 aa, Homo Sapiens
CRRSAVPFT

SEQ ID NO: 1025468 - protein, 9 aa, Homo Sapiens
NNNTLLYIF

SEQ ID NO: 1025469 - protein, 9 aa, Homo Sapiens
SASKPKRLR

SEQ ID NO: 1025470 - protein, 9 aa, Homo Sapiens
TPTSPRGQL

SEQ ID NO: 1025471 - protein, 9 aa, Homo Sapiens
SDPKKAPPP

SEQ ID NO: 1025472 - protein, 9 aa, Homo Sapiens
KEKSENINL

SEQ ID NO: 1025473 - protein, 9 aa, Homo Sapiens
EQPAALATS

SEQ ID NO: 1025474 - protein, 9 aa, Homo Sapiens
ATETPKCSS

SEQ ID NO: 1025475 - protein, 9 aa, Homo Sapiens
ESPELIEVD

SEQ ID NO: 1025476 - protein, 9 aa, Homo Sapiens
KIKIDPQFQ

SEQ ID NO: 1025477 - protein, 9 aa, Homo Sapiens
YMTWIKNGE

SEQ ID NO: 1025478 - protein, 9 aa, Homo Sapiens
GEFQKPELK

SEQ ID NO: 1025479 - protein, 9 aa, Homo Sapiens
SVRCRGFPR

SEQ ID NO: 1025480 - protein, 9 aa, Homo Sapiens
ESRPLSVSV

SEQ ID NO: 1025481 - protein, 9 aa, Homo Sapiens
CLAKVKSYR

SEQ ID NO: 1025482 - protein, 9 aa, Homo Sapiens
KPLSTCAFH

SEQ ID NO: 1025483 - protein, 9 aa, Homo Sapiens
TYDAGIDIW

SEQ ID NO: 1025484 - protein, 9 aa, Homo Sapiens
PTVKLHENK

SEQ ID NO: 1025485 - protein, 9 aa, Homo Sapiens
SSTRRQETS

SEQ ID NO: 1025486 - protein, 9 aa, Homo Sapiens
EYLAYWLYH

SEQ ID NO: 1025487 - protein, 9 aa, Homo Sapiens
LGFGQENHK

SEQ ID NO: 1025488 - protein, 9 aa, Homo Sapiens
QPLLTVKTI

SEQ ID NO: 1025489 - protein, 9 aa, Homo Sapiens
TLWAKPASV

SEQ ID NO: 1025490 - protein, 9 aa, Homo Sapiens
RPRGAEGQS

SEQ ID NO: 1025491 - protein, 9 aa, Homo Sapiens
LKPKTKRAK

SEQ ID NO: 1025492 - protein, 9 aa, Homo Sapiens
KSSPARNSP

SEQ ID NO: 1025493 - protein, 9 aa, Homo Sapiens
KPKITCPPI

SEQ ID NO: 1025494 - protein, 9 aa, Homo Sapiens
FLELDETFI

SEQ ID NO: 1025495 - protein, 9 aa, Homo Sapiens
PGLPEADGL

SEQ ID NO: 1025496 - protein, 9 aa, Homo Sapiens
VYLGQEMIG

SEQ ID NO: 1025497 - protein, 9 aa, Homo Sapiens
KGHRIEEVS

SEQ ID NO: 1025498 - protein, 9 aa, Homo Sapiens
KIYTGGKLN

SEQ ID NO: 1025499 - protein, 9 aa, Homo Sapiens
YFVQQRAGH

SEQ ID NO: 1025500 - protein, 9 aa, Homo Sapiens
YAVDEEGES

SEQ ID NO: 1025501 - protein, 9 aa, Homo Sapiens
LPKVINGTP

SEQ ID NO: 1025502 - protein, 9 aa, Homo Sapiens
NFLPAPARA

SEQ ID NO: 1025503 - protein, 9 aa, Homo Sapiens
PKVVRTTTR

SEQ ID NO: 1025504 - protein, 9 aa, Homo Sapiens
IYKVCHANS

SEQ ID NO: 1025505 - protein, 9 aa, Homo Sapiens
LSGSCPSFP

SEQ ID NO: 1025506 - protein, 9 aa, Homo Sapiens
LEKLQLDKL

SEQ ID NO: 1025507 - protein, 9 aa, Homo Sapiens
AQRRRSLSA

SEQ ID NO: 1025508 - protein, 9 aa, Homo Sapiens
DWARRADIR

SEQ ID NO: 1025509 - protein, 9 aa, Homo Sapiens
KGWMNIIYA

SEQ ID NO: 1025510 - protein, 9 aa, Homo Sapiens
KGHIIPQGI

SEQ ID NO: 1025511 - protein, 9 aa, Homo Sapiens
ARGEEGLSN

SEQ ID NO: 1025512 - protein, 9 aa, Homo Sapiens
GEKKDRAPG

SEQ ID NO: 1025513 - protein, 9 aa, Homo Sapiens
VGIINDDIF

SEQ ID NO: 1025514 - protein, 9 aa, Homo Sapiens
TAAGLLGEG

SEQ ID NO: 1025515 - protein, 9 aa, Homo Sapiens
KDDSNPAIG

SEQ ID NO: 1025516 - protein, 9 aa, Homo Sapiens
VIMREFFIL

SEQ ID NO: 1025517 - protein, 9 aa, Homo Sapiens
ASAAETSGG

SEQ ID NO: 1025518 - protein, 9 aa, Homo Sapiens
KILDLGENN

SEQ ID NO: 1025519 - protein, 9 aa, Homo Sapiens
EEVAGGRKD

SEQ ID NO: 1025520 - protein, 9 aa, Homo Sapiens
KQLRRVFGN

SEQ ID NO: 1025521 - protein, 9 aa, Homo Sapiens
SSTSWHLQP

SEQ ID NO: 1025522 - protein, 9 aa, Homo Sapiens
LNPKMNIIT

SEQ ID NO: 1025523 - protein, 9 aa, Homo Sapiens
EEWHHERKH

SEQ ID NO: 1025524 - protein, 9 aa, Homo Sapiens
FMKDPSGRS

SEQ ID NO: 1025525 - protein, 9 aa, Homo Sapiens
DKQPKDFPQ

SEQ ID NO: 1025526 - protein, 9 aa, Homo Sapiens
LIDQVVQTV

SEQ ID NO: 1025527 - protein, 9 aa, Homo Sapiens
VWKYLFNYY

SEQ ID NO: 1025528 - protein, 9 aa, Homo Sapiens
ANSSERARF

SEQ ID NO: 1025529 - protein, 9 aa, Homo Sapiens
EERDLVNRL

SEQ ID NO: 1025530 - protein, 9 aa, Homo Sapiens
PSHLSGPSP

SEQ ID NO: 1025531 - protein, 9 aa, Homo Sapiens
MHNRKTHVN

SEQ ID NO: 1025532 - protein, 9 aa, Homo Sapiens
YSSPSLCIA

SEQ ID NO: 1025533 - protein, 9 aa, Homo Sapiens
GLPGEEFPG

SEQ ID NO: 1025534 - protein, 9 aa, Homo Sapiens
AQEDIPDLL

SEQ ID NO: 1025535 - protein, 9 aa, Homo Sapiens
FSPSSLRGG

SEQ ID NO: 1025536 - protein, 9 aa, Homo Sapiens
YTPMYFLLF

SEQ ID NO: 1025537 - protein, 9 aa, Homo Sapiens
CSFIGKDLD

SEQ ID NO: 1025538 - protein, 9 aa, Homo Sapiens
SDKFRAYDW

SEQ ID NO: 1025539 - protein, 9 aa, Homo Sapiens
LGTLRREPD

SEQ ID NO: 1025540 - protein, 9 aa, Homo Sapiens
LTDHKRIYT

SEQ ID NO: 1025541 - protein, 9 aa, Homo Sapiens
LEHIQKLPK

SEQ ID NO: 1025542 - protein, 9 aa, Homo Sapiens
ERNQDELFN

SEQ ID NO: 1025543 - protein, 9 aa, Homo Sapiens
GWAQLSFPP

SEQ ID NO: 1025544 - protein, 9 aa, Homo Sapiens
RGEVLGAYK

SEQ ID NO: 1025545 - protein, 9 aa, Homo Sapiens
PAAPSGPGP

SEQ ID NO: 1025546 - protein, 9 aa, Homo Sapiens
PEVSWQLEK

SEQ ID NO: 1025547 - protein, 9 aa, Homo Sapiens
TAQQNLYSN

SEQ ID NO: 1025548 - protein, 9 aa, Homo Sapiens
YFFVNLAFS

SEQ ID NO: 1025549 - protein, 9 aa, Homo Sapiens
GLLPSGLHG

SEQ ID NO: 1025550 - protein, 9 aa, Homo Sapiens
GDFQKRTVQ

SEQ ID NO: 1025551 - protein, 9 aa, Homo Sapiens
YQPIQTYSW

SEQ ID NO: 1025552 - protein, 9 aa, Homo Sapiens
EVKKEGELG

SEQ ID NO: 1025553 - protein, 9 aa, Homo Sapiens
NMICAGEKE

SEQ ID NO: 1025554 - protein, 9 aa, Homo Sapiens
TTNDNMSYF

SEQ ID NO: 1025555 - protein, 9 aa, Homo Sapiens
FFTILPHKF

SEQ ID NO: 1025556 - protein, 9 aa, Homo Sapiens
AKLLKWLED

SEQ ID NO: 1025557 - protein, 9 aa, Homo Sapiens
MEVNGQFEF

SEQ ID NO: 1025558 - protein, 9 aa, Homo Sapiens
LEFPGFPGA

SEQ ID NO: 1025559 - protein, 9 aa, Homo Sapiens
LCLDLTLWE

SEQ ID NO: 1025560 - protein, 9 aa, Homo Sapiens
GTFSGNQLS

SEQ ID NO: 1025561 - protein, 9 aa, Homo Sapiens
GVSQDLFSY

SEQ ID NO: 1025562 - protein, 9 aa, Homo Sapiens
KKLRLEKEA

SEQ ID NO: 1025563 - protein, 9 aa, Homo Sapiens
TETKLALKY

SEQ ID NO: 1025564 - protein, 9 aa, Homo Sapiens
SEGHSGDFL

SEQ ID NO: 1025565 - protein, 9 aa, Homo Sapiens
ELSTRANCS

SEQ ID NO: 1025566 - protein, 9 aa, Homo Sapiens
SKNPKPQEW

SEQ ID NO: 1025567 - protein, 9 aa, Homo Sapiens
RASIPVIPD

SEQ ID NO: 1025568 - protein, 9 aa, Homo Sapiens
SLEQLCINC

SEQ ID NO: 1025569 - protein, 9 aa, Homo Sapiens
RTTPNGHIA

SEQ ID NO: 1025570 - protein, 9 aa, Homo Sapiens
HQRILVSER

SEQ ID NO: 1025571 - protein, 9 aa, Homo Sapiens
EEILQEVGS

SEQ ID NO: 1025572 - protein, 9 aa, Homo Sapiens
LSASCLPPP

SEQ ID NO: 1025573 - protein, 9 aa, Homo Sapiens
RSPVNLSPE

SEQ ID NO: 1025574 - protein, 9 aa, Homo Sapiens
LLVSSSSAS

SEQ ID NO: 1025575 - protein, 9 aa, Homo Sapiens
PSHVRFVFS

SEQ ID NO: 1025576 - protein, 9 aa, Homo Sapiens
KYAHLSNEL

SEQ ID NO: 1025577 - protein, 9 aa, Homo Sapiens
SLEKDKQKN

SEQ ID NO: 1025578 - protein, 9 aa, Homo Sapiens
EGLDDEKEG

SEQ ID NO: 1025579 - protein, 9 aa, Homo Sapiens
SPLQPLPSS

SEQ ID NO: 1025580 - protein, 9 aa, Homo Sapiens
LDAKSFTKL

SEQ ID NO: 1025581 - protein, 9 aa, Homo Sapiens
VVQTVFAMQ

SEQ ID NO: 1025582 - protein, 9 aa, Homo Sapiens
AVLWKYKFS

SEQ ID NO: 1025583 - protein, 9 aa, Homo Sapiens
KYALPKVIN

SEQ ID NO: 1025584 - protein, 9 aa, Homo Sapiens
LFRVCSGEA

SEQ ID NO: 1025585 - protein, 9 aa, Homo Sapiens
IILYAFILT

SEQ ID NO: 1025586 - protein, 9 aa, Homo Sapiens
EDDHELEDE

SEQ ID NO: 1025587 - protein, 9 aa, Homo Sapiens
QNNIRSHSP

SEQ ID NO: 1025588 - protein, 9 aa, Homo Sapiens
SKLYQDSTV

SEQ ID NO: 1025589 - protein, 9 aa, Homo Sapiens
DLVNRLKVE

SEQ ID NO: 1025590 - protein, 9 aa, Homo Sapiens
EAKYAHLSN

SEQ ID NO: 1025591 - protein, 9 aa, Homo Sapiens
LSPQPLKRK

SEQ ID NO: 1025592 - protein, 9 aa, Homo Sapiens
DSGGPLMSP

SEQ ID NO: 1025593 - protein, 9 aa, Homo Sapiens
SQYEKNIAP

SEQ ID NO: 1025594 - protein, 9 aa, Homo Sapiens
RGPPPLSSP

SEQ ID NO: 1025595 - protein, 9 aa, Homo Sapiens
IQNGSLSTS

SEQ ID NO: 1025596 - protein, 9 aa, Homo Sapiens
EPKGDPGFP

SEQ ID NO: 1025597 - protein, 9 aa, Homo Sapiens
ASLTKVDKA

SEQ ID NO: 1025598 - protein, 9 aa, Homo Sapiens
WFQMCDIKK

SEQ ID NO: 1025599 - protein, 9 aa, Homo Sapiens
TKNIRLTQI

SEQ ID NO: 1025600 - protein, 9 aa, Homo Sapiens
LESSPNAPD

SEQ ID NO: 1025601 - protein, 9 aa, Homo Sapiens
PSSPLPSDM

SEQ ID NO: 1025602 - protein, 9 aa, Homo Sapiens
KGATTQGLR

SEQ ID NO: 1025603 - protein, 9 aa, Homo Sapiens
GDGLSTFAV

SEQ ID NO: 1025604 - protein, 9 aa, Homo Sapiens
ESSCTRNCM

SEQ ID NO: 1025605 - protein, 9 aa, Homo Sapiens
DFDFHTGPK

SEQ ID NO: 1025606 - protein, 9 aa, Homo Sapiens
ILCSDTWVI

SEQ ID NO: 1025607 - protein, 9 aa, Homo Sapiens
KIFMKDPSG

SEQ ID NO: 1025608 - protein, 9 aa, Homo Sapiens
FYPARKVRD

SEQ ID NO: 1025609 - protein, 9 aa, Homo Sapiens
RVSAVEPEP

SEQ ID NO: 1025610 - protein, 9 aa, Homo Sapiens
LNKQEKIYT

SEQ ID NO: 1025611 - protein, 9 aa, Homo Sapiens
NSTDCPVQR

SEQ ID NO: 1025612 - protein, 9 aa, Homo Sapiens
GWIWSHQGP

SEQ ID NO: 1025613 - protein, 9 aa, Homo Sapiens
HSFWKLRSE

SEQ ID NO: 1025614 - protein, 9 aa, Homo Sapiens
LYPAATAAA

SEQ ID NO: 1025615 - protein, 9 aa, Homo Sapiens
TCDSSSYSV

SEQ ID NO: 1025616 - protein, 9 aa, Homo Sapiens
KGGTTTPWS

SEQ ID NO: 1025617 - protein, 9 aa, Homo Sapiens
TQMEGSVDL

SEQ ID NO: 1025618 - protein, 9 aa, Homo Sapiens
SFIGKDLDD

SEQ ID NO: 1025619 - protein, 9 aa, Homo Sapiens
HANMFSHLK

SEQ ID NO: 1025620 - protein, 9 aa, Homo Sapiens
YKKTLEHLC

SEQ ID NO: 1025621 - protein, 9 aa, Homo Sapiens
QIFFLQGQL

SEQ ID NO: 1025622 - protein, 9 aa, Homo Sapiens
IPDMKEEEK

SEQ ID NO: 1025623 - protein, 9 aa, Homo Sapiens
SKLLNKTTW

SEQ ID NO: 1025624 - protein, 9 aa, Homo Sapiens
QWSFFFRSG

SEQ ID NO: 1025625 - protein, 9 aa, Homo Sapiens
CSLHVAVVG

SEQ ID NO: 1025626 - protein, 9 aa, Homo Sapiens
SFEGSTLST

SEQ ID NO: 1025627 - protein, 9 aa, Homo Sapiens
PPVLAFPAG

SEQ ID NO: 1025628 - protein, 9 aa, Homo Sapiens
VRNHFYEQC

SEQ ID NO: 1025629 - protein, 9 aa, Homo Sapiens
YMVYMTQYQ

SEQ ID NO: 1025630 - protein, 9 aa, Homo Sapiens
IFMKDPSGR

SEQ ID NO: 1025631 - protein, 9 aa, Homo Sapiens
ASFSPLKSE

SEQ ID NO: 1025632 - protein, 9 aa, Homo Sapiens
STGEKGFCY

SEQ ID NO: 1025633 - protein, 9 aa, Homo Sapiens
SENNSGVPC

SEQ ID NO: 1025634 - protein, 9 aa, Homo Sapiens
FQQVLQPPP

SEQ ID NO: 1025635 - protein, 9 aa, Homo Sapiens
KGGNRKVEE

SEQ ID NO: 1025636 - protein, 9 aa, Homo Sapiens
PPEATETPK

SEQ ID NO: 1025637 - protein, 9 aa, Homo Sapiens
RFDSSVKSA

SEQ ID NO: 1025638 - protein, 9 aa, Homo Sapiens
FGLPLGLSA

SEQ ID NO: 1025639 - protein, 9 aa, Homo Sapiens
TCLMQAMWK

SEQ ID NO: 1025640 - protein, 9 aa, Homo Sapiens
YLQNESKTK

SEQ ID NO: 1025641 - protein, 9 aa, Homo Sapiens
ILLAMTFDR

SEQ ID NO: 1025642 - protein, 9 aa, Homo Sapiens
AGEFQKPEL

SEQ ID NO: 1025643 - protein, 9 aa, Homo Sapiens
MPYTDVVVH

SEQ ID NO: 1025644 - protein, 9 aa, Homo Sapiens
VLLLLDLPK

SEQ ID NO: 1025645 - protein, 9 aa, Homo Sapiens
YCITDFAEK

SEQ ID NO: 1025646 - protein, 9 aa, Homo Sapiens
MGLNKSAFT

SEQ ID NO: 1025647 - protein, 9 aa, Homo Sapiens
NSGVPCNSL

SEQ ID NO: 1025648 - protein, 9 aa, Homo Sapiens
AVLLIIIAI

SEQ ID NO: 1025649 - protein, 9 aa, Homo Sapiens
STKIAGQIL

SEQ ID NO: 1025650 - protein, 9 aa, Homo Sapiens
EKMRGKLRA

SEQ ID NO: 1025651 - protein, 9 aa, Homo Sapiens
PLAWVELKD

SEQ ID NO: 1025652 - protein, 9 aa, Homo Sapiens
QEAWKKPAE

SEQ ID NO: 1025653 - protein, 9 aa, Homo Sapiens
NTGKQVVCL

SEQ ID NO: 1025654 - protein, 9 aa, Homo Sapiens
TQKLEEAGT

SEQ ID NO: 1025655 - protein, 9 aa, Homo Sapiens
FAGLLLLLV

SEQ ID NO: 1025656 - protein, 9 aa, Homo Sapiens
FGASLDYFS

SEQ ID NO: 1025657 - protein, 9 aa, Homo Sapiens
ETLCFVLLL

SEQ ID NO: 1025658 - protein, 9 aa, Homo Sapiens
KKKSCHRPS

SEQ ID NO: 1025659 - protein, 9 aa, Homo Sapiens
IKEFFFEKL

SEQ ID NO: 1025660 - protein, 9 aa, Homo Sapiens
NWLANVRKC

SEQ ID NO: 1025661 - protein, 9 aa, Homo Sapiens
RQGPKGSLE

SEQ ID NO: 1025662 - protein, 9 aa, Homo Sapiens
ISDTNNALQ

SEQ ID NO: 1025663 - protein, 9 aa, Homo Sapiens
PLSTCAFHF

SEQ ID NO: 1025664 - protein, 9 aa, Homo Sapiens
VHLLYFFYN

SEQ ID NO: 1025665 - protein, 9 aa, Homo Sapiens
RGFPRGPVR

SEQ ID NO: 1025666 - protein, 9 aa, Homo Sapiens
PSWRGLAEP

SEQ ID NO: 1025667 - protein, 9 aa, Homo Sapiens
SSPSRLPGP

SEQ ID NO: 1025668 - protein, 9 aa, Homo Sapiens
EAEWSRVAT

SEQ ID NO: 1025669 - protein, 9 aa, Homo Sapiens
MEHLIGPCR

SEQ ID NO: 1025670 - protein, 9 aa, Homo Sapiens
IEYLAYWLY

SEQ ID NO: 1025671 - protein, 9 aa, Homo Sapiens
SYCSEERPP

SEQ ID NO: 1025672 - protein, 9 aa, Homo Sapiens
GREILLESL

SEQ ID NO: 1025673 - protein, 9 aa, Homo Sapiens
CGGDFQKRT

SEQ ID NO: 1025674 - protein, 9 aa, Homo Sapiens
DLSVLSSKL

SEQ ID NO: 1025675 - protein, 9 aa, Homo Sapiens
SANVEIEWV

SEQ ID NO: 1025676 - protein, 9 aa, Homo Sapiens
ILTTHKKIH

SEQ ID NO: 1025677 - protein, 9 aa, Homo Sapiens
SRQKHLSKD

SEQ ID NO: 1025678 - protein, 9 aa, Homo Sapiens
NALQKNSNP

SEQ ID NO: 1025679 - protein, 9 aa, Homo Sapiens
QIQYFFSFA

SEQ ID NO: 1025680 - protein, 9 aa, Homo Sapiens
VLDSYLLPE

SEQ ID NO: 1025681 - protein, 9 aa, Homo Sapiens
IPGHVFTKG

SEQ ID NO: 1025682 - protein, 9 aa, Homo Sapiens
ARIIVAALD

SEQ ID NO: 1025683 - protein, 9 aa, Homo Sapiens
LAVKTKSSA

SEQ ID NO: 1025684 - protein, 9 aa, Homo Sapiens
GSAYNHTME

SEQ ID NO: 1025685 - protein, 9 aa, Homo Sapiens
PSLPSYRIT

SEQ ID NO: 1025686 - protein, 9 aa, Homo Sapiens
KNKVVVEKG

SEQ ID NO: 1025687 - protein, 9 aa, Homo Sapiens
VAGEFQKPE

SEQ ID NO: 1025688 - protein, 9 aa, Homo Sapiens
QLYFFYFLG

SEQ ID NO: 1025689 - protein, 9 aa, Homo Sapiens
EARRTFFKC

SEQ ID NO: 1025690 - protein, 9 aa, Homo Sapiens
NLTDHKRIY

SEQ ID NO: 1025691 - protein, 9 aa, Homo Sapiens
FSKDFYGTL

SEQ ID NO: 1025692 - protein, 9 aa, Homo Sapiens
PGDEDASFS

SEQ ID NO: 1025693 - protein, 9 aa, Homo Sapiens
DVPVEKENE

SEQ ID NO: 1025694 - protein, 9 aa, Homo Sapiens
YMISAKTLV

SEQ ID NO: 1025695 - protein, 9 aa, Homo Sapiens
KKLQDVGTP

SEQ ID NO: 1025696 - protein, 9 aa, Homo Sapiens
TVYTRLEFL

SEQ ID NO: 1025697 - protein, 9 aa, Homo Sapiens
LGPPGNPGL

SEQ ID NO: 1025698 - protein, 9 aa, Homo Sapiens
EIHLSPEKF

SEQ ID NO: 1025699 - protein, 9 aa, Homo Sapiens
DNFFDDLQV

SEQ ID NO: 1025700 - protein, 9 aa, Homo Sapiens
SEVELSVIG

SEQ ID NO: 1025701 - protein, 9 aa, Homo Sapiens
NDLMSKMLS

SEQ ID NO: 1025702 - protein, 9 aa, Homo Sapiens
HVFTKGMII

SEQ ID NO: 1025703 - protein, 9 aa, Homo Sapiens
GDHANMFSH

SEQ ID NO: 1025704 - protein, 9 aa, Homo Sapiens
NESKTKRNS

SEQ ID NO: 1025705 - protein, 9 aa, Homo Sapiens
ADAYSSFCS

SEQ ID NO: 1025706 - protein, 9 aa, Homo Sapiens
SKISQKKIK

SEQ ID NO: 1025707 - protein, 9 aa, Homo Sapiens
QLVKIFLQK

SEQ ID NO: 1025708 - protein, 9 aa, Homo Sapiens
LTLPVIICV

SEQ ID NO: 1025709 - protein, 9 aa, Homo Sapiens
AAVSQYEKN

SEQ ID NO: 1025710 - protein, 9 aa, Homo Sapiens
AERPKAVES

SEQ ID NO: 1025711 - protein, 9 aa, Homo Sapiens
NQSSVDQGA

SEQ ID NO: 1025712 - protein, 9 aa, Homo Sapiens
AGVQMKLKF

SEQ ID NO: 1025713 - protein, 9 aa, Homo Sapiens
LYRHAASYS

SEQ ID NO: 1025714 - protein, 9 aa, Homo Sapiens
GGGKGGAGA

SEQ ID NO: 1025715 - protein, 9 aa, Homo Sapiens
ARPFDSFFL

SEQ ID NO: 1025716 - protein, 9 aa, Homo Sapiens
LYAFILTSI

SEQ ID NO: 1025717 - protein, 9 aa, Homo Sapiens
TSSAGRVDF

SEQ ID NO: 1025718 - protein, 9 aa, Homo Sapiens
NGNSYQGAQ

SEQ ID NO: 1025719 - protein, 9 aa, Homo Sapiens
PKDMGFTCL

SEQ ID NO: 1025720 - protein, 9 aa, Homo Sapiens
PYMSQQNTR

SEQ ID NO: 1025721 - protein, 9 aa, Homo Sapiens
QTSWTSVFN

SEQ ID NO: 1025722 - protein, 9 aa, Homo Sapiens
NVSMETIQK

SEQ ID NO: 1025723 - protein, 9 aa, Homo Sapiens
EMYSEISEI

SEQ ID NO: 1025724 - protein, 9 aa, Homo Sapiens
AGYYKGGKD

SEQ ID NO: 1025725 - protein, 9 aa, Homo Sapiens
AFVTFACSG

SEQ ID NO: 1025726 - protein, 9 aa, Homo Sapiens
RSLSCREAV

SEQ ID NO: 1025727 - protein, 9 aa, Homo Sapiens
QERLTSGTT

SEQ ID NO: 1025728 - protein, 9 aa, Homo Sapiens
SGNLRPSSS

SEQ ID NO: 1025729 - protein, 9 aa, Homo Sapiens
TDHKRIYTG

SEQ ID NO: 1025730 - protein, 9 aa, Homo Sapiens
FFLDKVVSV

SEQ ID NO: 1025731 - protein, 9 aa, Homo Sapiens
YEEIIHDLS

SEQ ID NO: 1025732 - protein, 9 aa, Homo Sapiens
EMHQRILVS

SEQ ID NO: 1025733 - protein, 9 aa, Homo Sapiens
SLLDYSFQF

SEQ ID NO: 1025734 - protein, 9 aa, Homo Sapiens
FRLYLRYEF

SEQ ID NO: 1025735 - protein, 9 aa, Homo Sapiens
NRSGRPGFA

SEQ ID NO: 1025736 - protein, 9 aa, Homo Sapiens
CEAHLMAVS

SEQ ID NO: 1025737 - protein, 9 aa, Homo Sapiens
DTAQQNLYS

SEQ ID NO: 1025738 - protein, 9 aa, Homo Sapiens
YDKIRKGCV

SEQ ID NO: 1025739 - protein, 9 aa, Homo Sapiens
AGQAEAEGL

SEQ ID NO: 1025740 - protein, 9 aa, Homo Sapiens
PGRKGFLGR

SEQ ID NO: 1025741 - protein, 9 aa, Homo Sapiens
GEAAAFFRR

SEQ ID NO: 1025742 - protein, 9 aa, Homo Sapiens
TLGNPISTK

SEQ ID NO: 1025743 - protein, 9 aa, Homo Sapiens
NPGLSGSPG

SEQ ID NO: 1025744 - protein, 9 aa, Homo Sapiens
LAWNVWAQD

SEQ ID NO: 1025745 - protein, 9 aa, Homo Sapiens
EAKLTRARN

SEQ ID NO: 1025746 - protein, 9 aa, Homo Sapiens
APQAHKHPS

SEQ ID NO: 1025747 - protein, 9 aa, Homo Sapiens
SHSSPRDSV

SEQ ID NO: 1025748 - protein, 9 aa, Homo Sapiens
SLLSVPPGP

SEQ ID NO: 1025749 - protein, 9 aa, Homo Sapiens
PNAQCVKQK

SEQ ID NO: 1025750 - protein, 9 aa, Homo Sapiens
MNLTLMASW

SEQ ID NO: 1025751 - protein, 9 aa, Homo Sapiens
LWGDYKGEK

SEQ ID NO: 1025752 - protein, 9 aa, Homo Sapiens
LYRKVPNLQ

SEQ ID NO: 1025753 - protein, 9 aa, Homo Sapiens
SLPSYRITW

SEQ ID NO: 1025754 - protein, 9 aa, Homo Sapiens
NSPKSTVER

SEQ ID NO: 1025755 - protein, 9 aa, Homo Sapiens
KENCINLPT

SEQ ID NO: 1025756 - protein, 9 aa, Homo Sapiens
LVSTSYQLH

SEQ ID NO: 1025757 - protein, 9 aa, Homo Sapiens
DLQNLRMEN

SEQ ID NO: 1025758 - protein, 9 aa, Homo Sapiens
SPGASRCPR

SEQ ID NO: 1025759 - protein, 9 aa, Homo Sapiens
ISFREKKLQ

SEQ ID NO: 1025760 - protein, 9 aa, Homo Sapiens
PGPLIPSLS

SEQ ID NO: 1025761 - protein, 9 aa, Homo Sapiens
YDCACLSGF

SEQ ID NO: 1025762 - protein, 9 aa, Homo Sapiens
EIRVGIIND

SEQ ID NO: 1025763 - protein, 9 aa, Homo Sapiens
KLLNKTTWQ

SEQ ID NO: 1025764 - protein, 9 aa, Homo Sapiens
NGNISIPKT

SEQ ID NO: 1025765 - protein, 9 aa, Homo Sapiens
IPKPPGKPF

SEQ ID NO: 1025766 - protein, 9 aa, Homo Sapiens
TNKAVAKGN

SEQ ID NO: 1025767 - protein, 9 aa, Homo Sapiens
SGSLPEMTA

SEQ ID NO: 1025768 - protein, 9 aa, Homo Sapiens
PKGSLEFPG

SEQ ID NO: 1025769 - protein, 9 aa, Homo Sapiens
LPTFFSFSS

SEQ ID NO: 1025770 - protein, 9 aa, Homo Sapiens
FVALRKIIP

SEQ ID NO: 1025771 - protein, 9 aa, Homo Sapiens
SAGGDFRNP

SEQ ID NO: 1025772 - protein, 9 aa, Homo Sapiens
KQPLLTVKT

SEQ ID NO: 1025773 - protein, 9 aa, Homo Sapiens
EQCFKIAQL

SEQ ID NO: 1025774 - protein, 9 aa, Homo Sapiens
RQSLLSVAL

SEQ ID NO: 1025775 - protein, 9 aa, Homo Sapiens
GSPGEISSC

SEQ ID NO: 1025776 - protein, 9 aa, Homo Sapiens
EQIELPEVL

SEQ ID NO: 1025777 - protein, 9 aa, Homo Sapiens
GLGETPGET

SEQ ID NO: 1025778 - protein, 9 aa, Homo Sapiens
SSRFGKFIK

SEQ ID NO: 1025779 - protein, 9 aa, Homo Sapiens
NESFLDLQN

SEQ ID NO: 1025780 - protein, 9 aa, Homo Sapiens
KLICFLISF

SEQ ID NO: 1025781 - protein, 9 aa, Homo Sapiens
FLLNKPSVG

SEQ ID NO: 1025782 - protein, 9 aa, Homo Sapiens
IGKDLDDSF

SEQ ID NO: 1025783 - protein, 9 aa, Homo Sapiens
LKEETEKGT

SEQ ID NO: 1025784 - protein, 9 aa, Homo Sapiens
KELGEDDEG

SEQ ID NO: 1025785 - protein, 9 aa, Homo Sapiens
TLKSSQRSS

SEQ ID NO: 1025786 - protein, 9 aa, Homo Sapiens
EFFFEKLKN

SEQ ID NO: 1025787 - protein, 9 aa, Homo Sapiens
IKVPMMYDA

SEQ ID NO: 1025788 - protein, 9 aa, Homo Sapiens
FEGKPNVFW

SEQ ID NO: 1025789 - protein, 9 aa, Homo Sapiens
PKELQESQG

SEQ ID NO: 1025790 - protein, 9 aa, Homo Sapiens
LDDSKWKKH

SEQ ID NO: 1025791 - protein, 9 aa, Homo Sapiens
GHQKRLAHH

SEQ ID NO: 1025792 - protein, 9 aa, Homo Sapiens
KSSPFINST

SEQ ID NO: 1025793 - protein, 9 aa, Homo Sapiens
LLVLDDVNP

SEQ ID NO: 1025794 - protein, 9 aa, Homo Sapiens
PWIEIANKL

SEQ ID NO: 1025795 - protein, 9 aa, Homo Sapiens
RFLVVSPHE

SEQ ID NO: 1025796 - protein, 9 aa, Homo Sapiens
VKGDGNPKK

SEQ ID NO: 1025797 - protein, 9 aa, Homo Sapiens
DYQIINPTL

SEQ ID NO: 1025798 - protein, 9 aa, Homo Sapiens
LILLKEDSW

SEQ ID NO: 1025799 - protein, 9 aa, Homo Sapiens
GGFLNNAST

SEQ ID NO: 1025800 - protein, 9 aa, Homo Sapiens
PPCELGLKN

SEQ ID NO: 1025801 - protein, 9 aa, Homo Sapiens
LLTVKTIHE

SEQ ID NO: 1025802 - protein, 9 aa, Homo Sapiens
PVQPVYLYP

SEQ ID NO: 1025803 - protein, 9 aa, Homo Sapiens
EEISEGAST

SEQ ID NO: 1025804 - protein, 9 aa, Homo Sapiens
FQKFGQWAD

SEQ ID NO: 1025805 - protein, 9 aa, Homo Sapiens
IFHYDIDGP

SEQ ID NO: 1025806 - protein, 9 aa, Homo Sapiens
IRPQIQYFF

SEQ ID NO: 1025807 - protein, 9 aa, Homo Sapiens
LMTVLLTYL

SEQ ID NO: 1025808 - protein, 9 aa, Homo Sapiens
EAFLFALVC

SEQ ID NO: 1025809 - protein, 9 aa, Homo Sapiens
ALQTFRVLR

SEQ ID NO: 1025810 - protein, 9 aa, Homo Sapiens
PPPNNPDEQ

SEQ ID NO: 1025811 - protein, 9 aa, Homo Sapiens
QNNYNLGSF

SEQ ID NO: 1025812 - protein, 9 aa, Homo Sapiens
DSIWFLLNE

SEQ ID NO: 1025813 - protein, 9 aa, Homo Sapiens
AHLSNELHV

SEQ ID NO: 1025814 - protein, 9 aa, Homo Sapiens
YAFSIKGPF

SEQ ID NO: 1025815 - protein, 9 aa, Homo Sapiens
TIFRNKPSG

SEQ ID NO: 1025816 - protein, 9 aa, Homo Sapiens
KEPKGDPGF

SEQ ID NO: 1025817 - protein, 9 aa, Homo Sapiens
PDGISVGAA

SEQ ID NO: 1025818 - protein, 9 aa, Homo Sapiens
FLMSVGENM

SEQ ID NO: 1025819 - protein, 9 aa, Homo Sapiens
DGDEENELV

SEQ ID NO: 1025820 - protein, 9 aa, Homo Sapiens
LNIRNINRL

SEQ ID NO: 1025821 - protein, 9 aa, Homo Sapiens
QKNVECACV

SEQ ID NO: 1025822 - protein, 9 aa, Homo Sapiens
DLQVVFGTM

SEQ ID NO: 1025823 - protein, 9 aa, Homo Sapiens
NLSPQPLKR

SEQ ID NO: 1025824 - protein, 9 aa, Homo Sapiens
MISAKTLVQ

SEQ ID NO: 1025825 - protein, 9 aa, Homo Sapiens
FYLSVKQDD

SEQ ID NO: 1025826 - protein, 9 aa, Homo Sapiens
GRVQGLCLG

SEQ ID NO: 1025827 - protein, 9 aa, Homo Sapiens
QRLERDDDL

SEQ ID NO: 1025828 - protein, 9 aa, Homo Sapiens
KKSPFDIKG

SEQ ID NO: 1025829 - protein, 9 aa, Homo Sapiens
LIAMSCEKT

SEQ ID NO: 1025830 - protein, 9 aa, Homo Sapiens
RVPSLLSVP

SEQ ID NO: 1025831 - protein, 9 aa, Homo Sapiens
SDWAEPRDS

SEQ ID NO: 1025832 - protein, 9 aa, Homo Sapiens
AYPMPFITI

SEQ ID NO: 1025833 - protein, 9 aa, Homo Sapiens
RSFQSGDLS

SEQ ID NO: 1025834 - protein, 9 aa, Homo Sapiens
KYLEETNFL

SEQ ID NO: 1025835 - protein, 9 aa, Homo Sapiens
PTVLAAHPQ

SEQ ID NO: 1025836 - protein, 9 aa, Homo Sapiens
RWRGYRVWK

SEQ ID NO: 1025837 - protein, 9 aa, Homo Sapiens
VCLAKVKSY

SEQ ID NO: 1025838 - protein, 9 aa, Homo Sapiens
DCEQNNDAL

SEQ ID NO: 1025839 - protein, 9 aa, Homo Sapiens
FFYFLGSTE

SEQ ID NO: 1025840 - protein, 9 aa, Homo Sapiens
GLWKTFPGK

SEQ ID NO: 1025841 - protein, 9 aa, Homo Sapiens
VFETNLDSD

SEQ ID NO: 1025842 - protein, 9 aa, Homo Sapiens
TPLKIKIDP

SEQ ID NO: 1025843 - protein, 9 aa, Homo Sapiens
TVLLTYLCA

SEQ ID NO: 1025844 - protein, 9 aa, Homo Sapiens
VLWKYKFSQ

SEQ ID NO: 1025845 - protein, 9 aa, Homo Sapiens
YFRLGKMCL

SEQ ID NO: 1025846 - protein, 9 aa, Homo Sapiens
EENKKKMTN

SEQ ID NO: 1025847 - protein, 9 aa, Homo Sapiens
KEDSWDATR

SEQ ID NO: 1025848 - protein, 9 aa, Homo Sapiens
HQKRLAHHQ

SEQ ID NO: 1025849 - protein, 9 aa, Homo Sapiens
RKKNQELRQ

SEQ ID NO: 1025850 - protein, 9 aa, Homo Sapiens
TASTASSTR

SEQ ID NO: 1025851 - protein, 9 aa, Homo Sapiens
VENENYCDF

SEQ ID NO: 1025852 - protein, 9 aa, Homo Sapiens
GPFYGEDVS

SEQ ID NO: 1025853 - protein, 9 aa, Homo Sapiens
VSKSLQEAN

SEQ ID NO: 1025854 - protein, 9 aa, Homo Sapiens
VAGSGIAWT

SEQ ID NO: 1025855 - protein, 9 aa, Homo Sapiens
GDQQEPQQL

SEQ ID NO: 1025856 - protein, 9 aa, Homo Sapiens
QEPQGRGLV

SEQ ID NO: 1025857 - protein, 9 aa, Homo Sapiens
WLYADKILD

SEQ ID NO: 1025858 - protein, 9 aa, Homo Sapiens
NKNKKEKSA

SEQ ID NO: 1025859 - protein, 9 aa, Homo Sapiens
LQPSSFPQS

SEQ ID NO: 1025860 - protein, 9 aa, Homo Sapiens
NHDDPAFKR

SEQ ID NO: 1025861 - protein, 9 aa, Homo Sapiens
KDMGFTCLM

SEQ ID NO: 1025862 - protein, 9 aa, Homo Sapiens
LDKNSEADK

SEQ ID NO: 1025863 - protein, 9 aa, Homo Sapiens
AVSFCILAM

SEQ ID NO: 1025864 - protein, 9 aa, Homo Sapiens
YRRTAIEYS

SEQ ID NO: 1025865 - protein, 9 aa, Homo Sapiens
VEVVLNGEL

SEQ ID NO: 1025866 - protein, 9 aa, Homo Sapiens
GLKGFIGFP

SEQ ID NO: 1025867 - protein, 9 aa, Homo Sapiens
SQQKEENEE

SEQ ID NO: 1025868 - protein, 9 aa, Homo Sapiens
KILQIGCNK

SEQ ID NO: 1025869 - protein, 9 aa, Homo Sapiens
PGLREFSSG

SEQ ID NO: 1025870 - protein, 9 aa, Homo Sapiens
RYWLYADKI

SEQ ID NO: 1025871 - protein, 9 aa, Homo Sapiens
ANSKLVKPG

SEQ ID NO: 1025872 - protein, 9 aa, Homo Sapiens
EGFMLRGAN

SEQ ID NO: 1025873 - protein, 9 aa, Homo Sapiens
FPKKACLCA

SEQ ID NO: 1025874 - protein, 9 aa, Homo Sapiens
EDTIQKEGH

SEQ ID NO: 1025875 - protein, 9 aa, Homo Sapiens
YSECQSQPA

SEQ ID NO: 1025876 - protein, 9 aa, Homo Sapiens
RLLKKLKGR

SEQ ID NO: 1025877 - protein, 9 aa, Homo Sapiens
SVDQGATGA

SEQ ID NO: 1025878 - protein, 9 aa, Homo Sapiens
FTKGMIIAV

SEQ ID NO: 1025879 - protein, 9 aa, Homo Sapiens
DAGRQVRMQ

SEQ ID NO: 1025880 - protein, 9 aa, Homo Sapiens
NRGQKERIR

SEQ ID NO: 1025881 - protein, 9 aa, Homo Sapiens
FPNSFYEDS

SEQ ID NO: 1025882 - protein, 9 aa, Homo Sapiens
RNVAWAPSI

SEQ ID NO: 1025883 - protein, 9 aa, Homo Sapiens
KEYSQIFQL

SEQ ID NO: 1025884 - protein, 9 aa, Homo Sapiens
PNTCLCPNE

SEQ ID NO: 1025885 - protein, 9 aa, Homo Sapiens
SNVAMSHRN

SEQ ID NO: 1025886 - protein, 9 aa, Homo Sapiens
RTVTNYFFV

SEQ ID NO: 1025887 - protein, 9 aa, Homo Sapiens
CKAIAANSK

SEQ ID NO: 1025888 - protein, 9 aa, Homo Sapiens
SQVMFKLDK

SEQ ID NO: 1025889 - protein, 9 aa, Homo Sapiens
REAEWSRVA

SEQ ID NO: 1025890 - protein, 9 aa, Homo Sapiens
LRVKKDFLQ

SEQ ID NO: 1025891 - protein, 9 aa, Homo Sapiens
EKVVERSEN

SEQ ID NO: 1025892 - protein, 9 aa, Homo Sapiens
SSPMEPSIP

SEQ ID NO: 1025893 - protein, 9 aa, Homo Sapiens
SYFVEVSYM

SEQ ID NO: 1025894 - protein, 9 aa, Homo Sapiens
KSAAKHKFS

SEQ ID NO: 1025895 - protein, 9 aa, Homo Sapiens
PEGIKFDTL

SEQ ID NO: 1025896 - protein, 9 aa, Homo Sapiens
QTSPKQKNG

SEQ ID NO: 1025897 - protein, 9 aa, Homo Sapiens
QDDIDSSRA

SEQ ID NO: 1025898 - protein, 9 aa, Homo Sapiens
WSFFFRSGM

SEQ ID NO: 1025899 - protein, 9 aa, Homo Sapiens
AKFLRLSDD

SEQ ID NO: 1025900 - protein, 9 aa, Homo Sapiens
SGLYERLLI

SEQ ID NO: 1025901 - protein, 9 aa, Homo Sapiens
SRGSTLPLL

SEQ ID NO: 1025902 - protein, 9 aa, Homo Sapiens
LDRSLDMSF

SEQ ID NO: 1025903 - protein, 9 aa, Homo Sapiens
GGILEAGAF

SEQ ID NO: 1025904 - protein, 9 aa, Homo Sapiens
LPKAGFITY

SEQ ID NO: 1025905 - protein, 9 aa, Homo Sapiens
LISNSKPSK

SEQ ID NO: 1025906 - protein, 9 aa, Homo Sapiens
IYFCTFIQT

SEQ ID NO: 1025907 - protein, 9 aa, Homo Sapiens
TGAFILGGL

SEQ ID NO: 1025908 - protein, 9 aa, Homo Sapiens
QESQVTFHN

SEQ ID NO: 1025909 - protein, 9 aa, Homo Sapiens
IPDLLHEDR

SEQ ID NO: 1025910 - protein, 9 aa, Homo Sapiens
SAYGFCTCL

SEQ ID NO: 1025911 - protein, 9 aa, Homo Sapiens
QKVRLRQQE

SEQ ID NO: 1025912 - protein, 9 aa, Homo Sapiens
VFPPELTVH

SEQ ID NO: 1025913 - protein, 9 aa, Homo Sapiens
HKVHESRNK

SEQ ID NO: 1025914 - protein, 9 aa, Homo Sapiens
AMILKRCPN

SEQ ID NO: 1025915 - protein, 9 aa, Homo Sapiens
GRYIEMFRE

SEQ ID NO: 1025916 - protein, 9 aa, Homo Sapiens
HTENNACFP

SEQ ID NO: 1025917 - protein, 9 aa, Homo Sapiens
PLSPGIKCT

SEQ ID NO: 1025918 - protein, 9 aa, Homo Sapiens
MLSGAIPPN

SEQ ID NO: 1025919 - protein, 9 aa, Homo Sapiens
GLDDEKEGE

SEQ ID NO: 1025920 - protein, 9 aa, Homo Sapiens
PFASRVILL

SEQ ID NO: 1025921 - protein, 9 aa, Homo Sapiens
LELARKIKI

SEQ ID NO: 1025922 - protein, 9 aa, Homo Sapiens
ERDHPSRHQ

SEQ ID NO: 1025923 - protein, 9 aa, Homo Sapiens
PPPPAEPAQ

SEQ ID NO: 1025924 - protein, 9 aa, Homo Sapiens
KVVVEKGEF

SEQ ID NO: 1025925 - protein, 9 aa, Homo Sapiens
QGPLQAQIL

SEQ ID NO: 1025926 - protein, 9 aa, Homo Sapiens
QYKEIAQRS

SEQ ID NO: 1025927 - protein, 9 aa, Homo Sapiens
DQEAFFRHQ

SEQ ID NO: 1025928 - protein, 9 aa, Homo Sapiens
SGLLFEIIE

SEQ ID NO: 1025929 - protein, 9 aa, Homo Sapiens
LEFLRVALS

SEQ ID NO: 1025930 - protein, 9 aa, Homo Sapiens
CLDFRLHTP

SEQ ID NO: 1025931 - protein, 9 aa, Homo Sapiens
NAAWHPTTG

SEQ ID NO: 1025932 - protein, 9 aa, Homo Sapiens
AFLPSSPLP

SEQ ID NO: 1025933 - protein, 9 aa, Homo Sapiens
DLDDILEFI

SEQ ID NO: 1025934 - protein, 9 aa, Homo Sapiens
PWRPGTAKE

SEQ ID NO: 1025935 - protein, 9 aa, Homo Sapiens
SVELHIIQS

SEQ ID NO: 1025936 - protein, 9 aa, Homo Sapiens
VIPPLDWRP

SEQ ID NO: 1025937 - protein, 9 aa, Homo Sapiens
RYFFCMEKG

SEQ ID NO: 1025938 - protein, 9 aa, Homo Sapiens
RESGQAGRA

SEQ ID NO: 1025939 - protein, 9 aa, Homo Sapiens
MKYGVLHIY

SEQ ID NO: 1025940 - protein, 9 aa, Homo Sapiens
MVRFLVVSP

SEQ ID NO: 1025941 - protein, 9 aa, Homo Sapiens
ITWKFFNIL

SEQ ID NO: 1025942 - protein, 9 aa, Homo Sapiens
VEVLLGIKV

SEQ ID NO: 1025943 - protein, 9 aa, Homo Sapiens
AMVYSPRTS

SEQ ID NO: 1025944 - protein, 9 aa, Homo Sapiens
YCLQGLFYP

SEQ ID NO: 1025945 - protein, 9 aa, Homo Sapiens
GSLPEMTAP

SEQ ID NO: 1025946 - protein, 9 aa, Homo Sapiens
IWGEYGCSL

SEQ ID NO: 1025947 - protein, 9 aa, Homo Sapiens
HYRPWIEIA

SEQ ID NO: 1025948 - protein, 9 aa, Homo Sapiens
SSVAFGFGT

SEQ ID NO: 1025949 - protein, 9 aa, Homo Sapiens
EDENNNYPI

SEQ ID NO: 1025950 - protein, 9 aa, Homo Sapiens
CLPRSQLEF

SEQ ID NO: 1025951 - protein, 9 aa, Homo Sapiens
RLIQVMMMG

SEQ ID NO: 1025952 - protein, 9 aa, Homo Sapiens
NKESLALAL

SEQ ID NO: 1025953 - protein, 9 aa, Homo Sapiens
EFVLLELAD

SEQ ID NO: 1025954 - protein, 9 aa, Homo Sapiens
SASCLPPPQ

SEQ ID NO: 1025955 - protein, 9 aa, Homo Sapiens
SKKIKEKSE

SEQ ID NO: 1025956 - protein, 9 aa, Homo Sapiens
SLLSSVAFG

SEQ ID NO: 1025957 - protein, 9 aa, Homo Sapiens
HLVMEMTNK

SEQ ID NO: 1025958 - protein, 9 aa, Homo Sapiens
EEWILNSTD

SEQ ID NO: 1025959 - protein, 9 aa, Homo Sapiens
VIDCEQNND

SEQ ID NO: 1025960 - protein, 9 aa, Homo Sapiens
GSWQVLDAT

SEQ ID NO: 1025961 - protein, 9 aa, Homo Sapiens
RNFLQRHRA

SEQ ID NO: 1025962 - protein, 9 aa, Homo Sapiens
KKNQELRQV

SEQ ID NO: 1025963 - protein, 9 aa, Homo Sapiens
KTLLRKPRF

SEQ ID NO: 1025964 - protein, 9 aa, Homo Sapiens
QLDLIYVAY

SEQ ID NO: 1025965 - protein, 9 aa, Homo Sapiens
CDMDTDRGG

SEQ ID NO: 1025966 - protein, 9 aa, Homo Sapiens
KTFFYFYNC

SEQ ID NO: 1025967 - protein, 9 aa, Homo Sapiens
LWAKPASVI

SEQ ID NO: 1025968 - protein, 9 aa, Homo Sapiens
KENCQAEFS

SEQ ID NO: 1025969 - protein, 9 aa, Homo Sapiens
VDFKNDVQR

SEQ ID NO: 1025970 - protein, 9 aa, Homo Sapiens
QNLNEDDAR

SEQ ID NO: 1025971 - protein, 9 aa, Homo Sapiens
NITKSLVYG

SEQ ID NO: 1025972 - protein, 9 aa, Homo Sapiens
SESASKPKR

SEQ ID NO: 1025973 - protein, 9 aa, Homo Sapiens
CIARFRFRA

SEQ ID NO: 1025974 - protein, 9 aa, Homo Sapiens
LGRVQGLCL

SEQ ID NO: 1025975 - protein, 9 aa, Homo Sapiens
TSIFYFTVQ

SEQ ID NO: 1025976 - protein, 9 aa, Homo Sapiens
KMMSMKPAK

SEQ ID NO: 1025977 - protein, 9 aa, Homo Sapiens
NSYGCKECG

SEQ ID NO: 1025978 - protein, 9 aa, Homo Sapiens
ISFLLVLDD

SEQ ID NO: 1025979 - protein, 9 aa, Homo Sapiens
TEFVLLELA

SEQ ID NO: 1025980 - protein, 9 aa, Homo Sapiens
RVQLILDNL

SEQ ID NO: 1025981 - protein, 9 aa, Homo Sapiens
ASYSYDCTK

SEQ ID NO: 1025982 - protein, 9 aa, Homo Sapiens
QQPSWNSED

SEQ ID NO: 1025983 - protein, 9 aa, Homo Sapiens
YNSGDIFLG

SEQ ID NO: 1025984 - protein, 9 aa, Homo Sapiens
GEAGQRLRA

SEQ ID NO: 1025985 - protein, 9 aa, Homo Sapiens
SVSLLLHLE

SEQ ID NO: 1025986 - protein, 9 aa, Homo Sapiens
VYYSKCLSD

SEQ ID NO: 1025987 - protein, 9 aa, Homo Sapiens
GQELTDYLM

SEQ ID NO: 1025988 - protein, 9 aa, Homo Sapiens
PSKKVIKEF

SEQ ID NO: 1025989 - protein, 9 aa, Homo Sapiens
TYRVPSLLS

SEQ ID NO: 1025990 - protein, 9 aa, Homo Sapiens
VDSVVQTVF

SEQ ID NO: 1025991 - protein, 9 aa, Homo Sapiens
DNVSSIFLN

SEQ ID NO: 1025992 - protein, 9 aa, Homo Sapiens
VIDSFTKIV

SEQ ID NO: 1025993 - protein, 9 aa, Homo Sapiens
LKILCSDTW

SEQ ID NO: 1025994 - protein, 9 aa, Homo Sapiens
VLVGACITL

SEQ ID NO: 1025995 - protein, 9 aa, Homo Sapiens
TELCYFPAQ

SEQ ID NO: 1025996 - protein, 9 aa, Homo Sapiens
ETKPCNSVL

SEQ ID NO: 1025997 - protein, 9 aa, Homo Sapiens
DCKIDPALF

SEQ ID NO: 1025998 - protein, 9 aa, Homo Sapiens
KKIYNGLNQ

SEQ ID NO: 1025999 - protein, 9 aa, Homo Sapiens
CLCCDAGRQ

SEQ ID NO: 1026000 - protein, 9 aa, Homo Sapiens
LSLSPASWT

SEQ ID NO: 1026001 - protein, 9 aa, Homo Sapiens
RMTCPKGAT

SEQ ID NO: 1026002 - protein, 9 aa, Homo Sapiens
RKDACSWST

SEQ ID NO: 1026003 - protein, 9 aa, Homo Sapiens
TCPKGATHC

SEQ ID NO: 1026004 - protein, 9 aa, Homo Sapiens
PFSSQNSQN

SEQ ID NO: 1026005 - protein, 9 aa, Homo Sapiens
RSYETASPV

SEQ ID NO: 1026006 - protein, 9 aa, Homo Sapiens
QKSNHMEKG

SEQ ID NO: 1026007 - protein, 9 aa, Homo Sapiens
DLRPRGAKG

SEQ ID NO: 1026008 - protein, 9 aa, Homo Sapiens
LVLSASQDR

SEQ ID NO: 1026009 - protein, 9 aa, Homo Sapiens
KQPKDFPQG

SEQ ID NO: 1026010 - protein, 9 aa, Homo Sapiens
ENMLIIVVL

SEQ ID NO: 1026011 - protein, 9 aa, Homo Sapiens
ASKPKRLRA

SEQ ID NO: 1026012 - protein, 9 aa, Homo Sapiens
ETQKLNQTQ

SEQ ID NO: 1026013 - protein, 9 aa, Homo Sapiens
PMFSLLISA

SEQ ID NO: 1026014 - protein, 9 aa, Homo Sapiens
PITHDNVSS

SEQ ID NO: 1026015 - protein, 9 aa, Homo Sapiens
EKLQSCGVP

SEQ ID NO: 1026016 - protein, 9 aa, Homo Sapiens
QTLVILKNA

SEQ ID NO: 1026017 - protein, 9 aa, Homo Sapiens
VEKGEFTKD

SEQ ID NO: 1026018 - protein, 9 aa, Homo Sapiens
ILYAFILTS

SEQ ID NO: 1026019 - protein, 9 aa, Homo Sapiens
EIIFLIYQG

SEQ ID NO: 1026020 - protein, 9 aa, Homo Sapiens
GSGDMYPRP

SEQ ID NO: 1026021 - protein, 9 aa, Homo Sapiens
AAKHKFSGF

SEQ ID NO: 1026022 - protein, 9 aa, Homo Sapiens
GTLGTPTVL

SEQ ID NO: 1026023 - protein, 9 aa, Homo Sapiens
LIITADDDS

SEQ ID NO: 1026024 - protein, 9 aa, Homo Sapiens
EPACAATFE

SEQ ID NO: 1026025 - protein, 9 aa, Homo Sapiens
FSPSNFCLL

SEQ ID NO: 1026026 - protein, 9 aa, Homo Sapiens
QHDHLACFC

SEQ ID NO: 1026027 - protein, 9 aa, Homo Sapiens
TRQLTLQWE

SEQ ID NO: 1026028 - protein, 9 aa, Homo Sapiens
NIETKNIRL

SEQ ID NO: 1026029 - protein, 9 aa, Homo Sapiens
KPGKVGLPL

SEQ ID NO: 1026030 - protein, 9 aa, Homo Sapiens
DGISVGAAC

SEQ ID NO: 1026031 - protein, 9 aa, Homo Sapiens
NHRREQKVP

SEQ ID NO: 1026032 - protein, 9 aa, Homo Sapiens
NLPTCRNNI

SEQ ID NO: 1026033 - protein, 9 aa, Homo Sapiens
NVLKEETEK

SEQ ID NO: 1026034 - protein, 9 aa, Homo Sapiens
RPSQGPVSF

SEQ ID NO: 1026035 - protein, 9 aa, Homo Sapiens
GCAEPANTS

SEQ ID NO: 1026036 - protein, 9 aa, Homo Sapiens
TLWALLPPT

SEQ ID NO: 1026037 - protein, 9 aa, Homo Sapiens
NARVAVAGE

SEQ ID NO: 1026038 - protein, 9 aa, Homo Sapiens
KIKEFFFEK

SEQ ID NO: 1026039 - protein, 9 aa, Homo Sapiens
QAHKHPSHL

SEQ ID NO: 1026040 - protein, 9 aa, Homo Sapiens
VTFSPHKHV

SEQ ID NO: 1026041 - protein, 9 aa, Homo Sapiens
LCLTALKFV

SEQ ID NO: 1026042 - protein, 9 aa, Homo Sapiens
PKPTLWAKP

SEQ ID NO: 1026043 - protein, 9 aa, Homo Sapiens
REFSSGSSS

SEQ ID NO: 1026044 - protein, 9 aa, Homo Sapiens
QRLLGPMLE

SEQ ID NO: 1026045 - protein, 9 aa, Homo Sapiens
QLSFPPYYY

SEQ ID NO: 1026046 - protein, 9 aa, Homo Sapiens
STASSTRRQ

SEQ ID NO: 1026047 - protein, 9 aa, Homo Sapiens
LKGFIGFPG

SEQ ID NO: 1026048 - protein, 9 aa, Homo Sapiens
DFSAEYLIL

SEQ ID NO: 1026049 - protein, 9 aa, Homo Sapiens
EENVLPGAF

SEQ ID NO: 1026050 - protein, 9 aa, Homo Sapiens
STEKEGIFP

SEQ ID NO: 1026051 - protein, 9 aa, Homo Sapiens
YLWVLGLIY

SEQ ID NO: 1026052 - protein, 9 aa, Homo Sapiens
ELEVFCWPT

SEQ ID NO: 1026053 - protein, 9 aa, Homo Sapiens
HNSVEDVPV

SEQ ID NO: 1026054 - protein, 9 aa, Homo Sapiens
FDGQDFYAA

SEQ ID NO: 1026055 - protein, 9 aa, Homo Sapiens
KKSCHRPSS

SEQ ID NO: 1026056 - protein, 9 aa, Homo Sapiens
LFYPARKVR

SEQ ID NO: 1026057 - protein, 9 aa, Homo Sapiens
DNVGSLWTA

SEQ ID NO: 1026058 - protein, 9 aa, Homo Sapiens
PFGPFMKVK

SEQ ID NO: 1026059 - protein, 9 aa, Homo Sapiens
PSYLAKDAT

SEQ ID NO: 1026060 - protein, 9 aa, Homo Sapiens
WEKKVTGCP

SEQ ID NO: 1026061 - protein, 9 aa, Homo Sapiens
KTEKAMKNY

SEQ ID NO: 1026062 - protein, 9 aa, Homo Sapiens
AKRLKAFNM

SEQ ID NO: 1026063 - protein, 9 aa, Homo Sapiens
VKFKRNFDN

SEQ ID NO: 1026064 - protein, 9 aa, Homo Sapiens
KEETEKGTQ

SEQ ID NO: 1026065 - protein, 9 aa, Homo Sapiens
KTSDSLASK

SEQ ID NO: 1026066 - protein, 9 aa, Homo Sapiens
LVTLDDSKW

SEQ ID NO: 1026067 - protein, 9 aa, Homo Sapiens
FQKPELKAW

SEQ ID NO: 1026068 - protein, 9 aa, Homo Sapiens
EQEKDSEGL

SEQ ID NO: 1026069 - protein, 9 aa, Homo Sapiens
VRIKFGQND

SEQ ID NO: 1026070 - protein, 9 aa, Homo Sapiens
TKVEKKRQN

SEQ ID NO: 1026071 - protein, 9 aa, Homo Sapiens
VKKEFIKDG

SEQ ID NO: 1026072 - protein, 9 aa, Homo Sapiens
YLQLRGAEC

SEQ ID NO: 1026073 - protein, 9 aa, Homo Sapiens
GLGGSKRIF

SEQ ID NO: 1026074 - protein, 9 aa, Homo Sapiens
QLDSLVLLA

SEQ ID NO: 1026075 - protein, 9 aa, Homo Sapiens
EMDSSFNLH

SEQ ID NO: 1026076 - protein, 9 aa, Homo Sapiens
IRQLTQELL

SEQ ID NO: 1026077 - protein, 9 aa, Homo Sapiens
GVLYRTLSS

SEQ ID NO: 1026078 - protein, 9 aa, Homo Sapiens
RRDESTGEV

SEQ ID NO: 1026079 - protein, 9 aa, Homo Sapiens
KVPNLQILA

SEQ ID NO: 1026080 - protein, 9 aa, Homo Sapiens
KLHENKDSI

SEQ ID NO: 1026081 - protein, 9 aa, Homo Sapiens
IESGLLFEI

SEQ ID NO: 1026082 - protein, 9 aa, Homo Sapiens
EAHSDWVRN

SEQ ID NO: 1026083 - protein, 9 aa, Homo Sapiens
FSLSSVVFA

SEQ ID NO: 1026084 - protein, 9 aa, Homo Sapiens
EDKVISVTR

SEQ ID NO: 1026085 - protein, 9 aa, Homo Sapiens
SLKRQFRSQ

SEQ ID NO: 1026086 - protein, 9 aa, Homo Sapiens
EVKPLRAMW

SEQ ID NO: 1026087 - protein, 9 aa, Homo Sapiens
AEPAPSPKG

SEQ ID NO: 1026088 - protein, 9 aa, Homo Sapiens
GLCLGQHGP

SEQ ID NO: 1026089 - protein, 9 aa, Homo Sapiens
MSQQNTRPL

SEQ ID NO: 1026090 - protein, 9 aa, Homo Sapiens
EMIGSLELG

SEQ ID NO: 1026091 - protein, 9 aa, Homo Sapiens
LKEGVELLE

SEQ ID NO: 1026092 - protein, 9 aa, Homo Sapiens
KEIRVGIIN

SEQ ID NO: 1026093 - protein, 9 aa, Homo Sapiens
ELNTLANLF

SEQ ID NO: 1026094 - protein, 9 aa, Homo Sapiens
QVRALYQHY

SEQ ID NO: 1026095 - protein, 9 aa, Homo Sapiens
KLVGFVLRR

SEQ ID NO: 1026096 - protein, 9 aa, Homo Sapiens
NVDYKHILH

SEQ ID NO: 1026097 - protein, 9 aa, Homo Sapiens
DGVEAKRLK

SEQ ID NO: 1026098 - protein, 9 aa, Homo Sapiens
VSVSQALEA

SEQ ID NO: 1026099 - protein, 9 aa, Homo Sapiens
LGMSIFRRI

SEQ ID NO: 1026100 - protein, 9 aa, Homo Sapiens
FFNGYNDLM

SEQ ID NO: 1026101 - protein, 9 aa, Homo Sapiens
QENPAYLRQ

SEQ ID NO: 1026102 - protein, 9 aa, Homo Sapiens
WHKCEMLEL

SEQ ID NO: 1026103 - protein, 9 aa, Homo Sapiens
VNFFVLLSV

SEQ ID NO: 1026104 - protein, 9 aa, Homo Sapiens
WRELHLTEI

SEQ ID NO: 1026105 - protein, 9 aa, Homo Sapiens
EEEVERSKP

SEQ ID NO: 1026106 - protein, 9 aa, Homo Sapiens
ALFPNMISR

SEQ ID NO: 1026107 - protein, 9 aa, Homo Sapiens
VTLFRQMLS

SEQ ID NO: 1026108 - protein, 9 aa, Homo Sapiens
SYSYDCTKY

SEQ ID NO: 1026109 - protein, 9 aa, Homo Sapiens
SFPVSKSLQ

SEQ ID NO: 1026110 - protein, 9 aa, Homo Sapiens
DRTRRDEST

SEQ ID NO: 1026111 - protein, 9 aa, Homo Sapiens
PESGLSAKK

SEQ ID NO: 1026112 - protein, 9 aa, Homo Sapiens
RGAEDWAFS

SEQ ID NO: 1026113 - protein, 9 aa, Homo Sapiens
GEEWILNST

SEQ ID NO: 1026114 - protein, 9 aa, Homo Sapiens
ARVAVAGED

SEQ ID NO: 1026115 - protein, 9 aa, Homo Sapiens
VENSYIRCY

SEQ ID NO: 1026116 - protein, 9 aa, Homo Sapiens
EDLRSFQSG

SEQ ID NO: 1026117 - protein, 9 aa, Homo Sapiens
SSFYTKNLI

SEQ ID NO: 1026118 - protein, 9 aa, Homo Sapiens
GQSFGFGQH

SEQ ID NO: 1026119 - protein, 9 aa, Homo Sapiens
CCQSSRTTQ

SEQ ID NO: 1026120 - protein, 9 aa, Homo Sapiens
ECSPAHTRA

SEQ ID NO: 1026121 - protein, 9 aa, Homo Sapiens
CLRNFLQRH

SEQ ID NO: 1026122 - protein, 9 aa, Homo Sapiens
DSLVLLANR

SEQ ID NO: 1026123 - protein, 9 aa, Homo Sapiens
YLSVKQDDE

SEQ ID NO: 1026124 - protein, 9 aa, Homo Sapiens
ADQLDLIYV

SEQ ID NO: 1026125 - protein, 9 aa, Homo Sapiens
HQYGARQPR

SEQ ID NO: 1026126 - protein, 9 aa, Homo Sapiens
KLDNKSHGS

SEQ ID NO: 1026127 - protein, 9 aa, Homo Sapiens
QEKLGEVWQ

SEQ ID NO: 1026128 - protein, 9 aa, Homo Sapiens
SPELRRQRS

SEQ ID NO: 1026129 - protein, 9 aa, Homo Sapiens
MKVDPDSIW

SEQ ID NO: 1026130 - protein, 9 aa, Homo Sapiens
TECLLLGIM

SEQ ID NO: 1026131 - protein, 9 aa, Homo Sapiens
EHGWAQLSF

SEQ ID NO: 1026132 - protein, 9 aa, Homo Sapiens
LRLNPKMNI

SEQ ID NO: 1026133 - protein, 9 aa, Homo Sapiens
FPPYYYGDS

SEQ ID NO: 1026134 - protein, 9 aa, Homo Sapiens
ISSGIALFS

SEQ ID NO: 1026135 - protein, 9 aa, Homo Sapiens
GVQLSASCL

SEQ ID NO: 1026136 - protein, 9 aa, Homo Sapiens
TLEECDIVD

SEQ ID NO: 1026137 - protein, 9 aa, Homo Sapiens
PTIPIMGFV

SEQ ID NO: 1026138 - protein, 9 aa, Homo Sapiens
GCYISSENS

SEQ ID NO: 1026139 - protein, 9 aa, Homo Sapiens
MFREKNVPT

SEQ ID NO: 1026140 - protein, 9 aa, Homo Sapiens
NRLKVEQAR

SEQ ID NO: 1026141 - protein, 9 aa, Homo Sapiens
RAVAVLAGA

SEQ ID NO: 1026142 - protein, 9 aa, Homo Sapiens
SGKFLIPDM

SEQ ID NO: 1026143 - protein, 9 aa, Homo Sapiens
DSSRSIYAV

SEQ ID NO: 1026144 - protein, 9 aa, Homo Sapiens
SLGFSREAE

SEQ ID NO: 1026145 - protein, 9 aa, Homo Sapiens
KTIHEGTST

SEQ ID NO: 1026146 - protein, 9 aa, Homo Sapiens
FQAQYEDDP

SEQ ID NO: 1026147 - protein, 9 aa, Homo Sapiens
TLTKALFPN

SEQ ID NO: 1026148 - protein, 9 aa, Homo Sapiens
SLRGGARRR

SEQ ID NO: 1026149 - protein, 9 aa, Homo Sapiens
FFFKVERDY

SEQ ID NO: 1026150 - protein, 9 aa, Homo Sapiens
VVAIPGSAG

SEQ ID NO: 1026151 - protein, 9 aa, Homo Sapiens
ADDDSGGPL

SEQ ID NO: 1026152 - protein, 9 aa, Homo Sapiens
SGPGPRPPG

SEQ ID NO: 1026153 - protein, 9 aa, Homo Sapiens
LMNFGFPQT

SEQ ID NO: 1026154 - protein, 9 aa, Homo Sapiens
ELLKKKCKA

SEQ ID NO: 1026155 - protein, 9 aa, Homo Sapiens
IYAGLRAHE

SEQ ID NO: 1026156 - protein, 9 aa, Homo Sapiens
WKKERNKGN

SEQ ID NO: 1026157 - protein, 9 aa, Homo Sapiens
VLAAHPQLA

SEQ ID NO: 1026158 - protein, 9 aa, Homo Sapiens
LITILDNND

SEQ ID NO: 1026159 - protein, 9 aa, Homo Sapiens
EGAAMRESG

SEQ ID NO: 1026160 - protein, 9 aa, Homo Sapiens
LFYYTQYSQ

SEQ ID NO: 1026161 - protein, 9 aa, Homo Sapiens
GEIFRCCWF

SEQ ID NO: 1026162 - protein, 9 aa, Homo Sapiens
GSNGSGGSW

SEQ ID NO: 1026163 - protein, 9 aa, Homo Sapiens
CLCPNEFFG

SEQ ID NO: 1026164 - protein, 9 aa, Homo Sapiens
MFSSKNPKP

SEQ ID NO: 1026165 - protein, 9 aa, Homo Sapiens
QSARKMTEV

SEQ ID NO: 1026166 - protein, 9 aa, Homo Sapiens
GNLRPSSSG

SEQ ID NO: 1026167 - protein, 9 aa, Homo Sapiens
GGRYIEMFR

SEQ ID NO: 1026168 - protein, 9 aa, Homo Sapiens
STSGISSER

SEQ ID NO: 1026169 - protein, 9 aa, Homo Sapiens
QAALDREAQ

SEQ ID NO: 1026170 - protein, 9 aa, Homo Sapiens
AQKPLQPDE

SEQ ID NO: 1026171 - protein, 9 aa, Homo Sapiens
AWHPTTGAQ

SEQ ID NO: 1026172 - protein, 9 aa, Homo Sapiens
ALNLKMKRL

SEQ ID NO: 1026173 - protein, 9 aa, Homo Sapiens
GSGQSFGFG

SEQ ID NO: 1026174 - protein, 9 aa, Homo Sapiens
KSSKVKAFG

SEQ ID NO: 1026175 - protein, 9 aa, Homo Sapiens
ATFVPGLIP

SEQ ID NO: 1026176 - protein, 9 aa, Homo Sapiens
SQELRKTFR

SEQ ID NO: 1026177 - protein, 9 aa, Homo Sapiens
AGKEEYSAM

SEQ ID NO: 1026178 - protein, 9 aa, Homo Sapiens
DDNSDDRDE

SEQ ID NO: 1026179 - protein, 9 aa, Homo Sapiens
KMTMIMKIL

SEQ ID NO: 1026180 - protein, 9 aa, Homo Sapiens
AVSSRVSAV

SEQ ID NO: 1026181 - protein, 9 aa, Homo Sapiens
DSNPAIGSI

SEQ ID NO: 1026182 - protein, 9 aa, Homo Sapiens
KVPMMYDAG

SEQ ID NO: 1026183 - protein, 9 aa, Homo Sapiens
TTWDCLPLS

SEQ ID NO: 1026184 - protein, 9 aa, Homo Sapiens
SSNQEEEEP

SEQ ID NO: 1026185 - protein, 9 aa, Homo Sapiens
LEAISEISS

SEQ ID NO: 1026186 - protein, 9 aa, Homo Sapiens
VPDQEKLGE

SEQ ID NO: 1026187 - protein, 9 aa, Homo Sapiens
AEESSCTRN

SEQ ID NO: 1026188 - protein, 9 aa, Homo Sapiens
MSIPDVICL

SEQ ID NO: 1026189 - protein, 9 aa, Homo Sapiens
QDFYAAAVR

SEQ ID NO: 1026190 - protein, 9 aa, Homo Sapiens
CYPRVKVSN

SEQ ID NO: 1026191 - protein, 9 aa, Homo Sapiens
HIALCTVRR

SEQ ID NO: 1026192 - protein, 9 aa, Homo Sapiens
PHCPVYVRD

SEQ ID NO: 1026193 - protein, 9 aa, Homo Sapiens
EEVFPRLET

SEQ ID NO: 1026194 - protein, 9 aa, Homo Sapiens
PRIPPFPAK

SEQ ID NO: 1026195 - protein, 9 aa, Homo Sapiens
KEPIEVNLF

SEQ ID NO: 1026196 - protein, 9 aa, Homo Sapiens
TKAVLWKYK

SEQ ID NO: 1026197 - protein, 9 aa, Homo Sapiens
TLPRKKMSS

SEQ ID NO: 1026198 - protein, 9 aa, Homo Sapiens
RDKRMEDVI

SEQ ID NO: 1026199 - protein, 9 aa, Homo Sapiens
VPLITAFYV

SEQ ID NO: 1026200 - protein, 9 aa, Homo Sapiens
IINDDIFEE

SEQ ID NO: 1026201 - protein, 9 aa, Homo Sapiens
APSPKGHII

SEQ ID NO: 1026202 - protein, 9 aa, Homo Sapiens
PSIPLLIDY

SEQ ID NO: 1026203 - protein, 9 aa, Homo Sapiens
PEDDLVLSD

SEQ ID NO: 1026204 - protein, 9 aa, Homo Sapiens
LVYRDQNKC

SEQ ID NO: 1026205 - protein, 9 aa, Homo Sapiens
FEKFVQYCP

SEQ ID NO: 1026206 - protein, 9 aa, Homo Sapiens
SQKKLKNQR

SEQ ID NO: 1026207 - protein, 9 aa, Homo Sapiens
NIRSHSPTH

SEQ ID NO: 1026208 - protein, 9 aa, Homo Sapiens
ELEAQIFFL

SEQ ID NO: 1026209 - protein, 9 aa, Homo Sapiens
GLREFSSGS

SEQ ID NO: 1026210 - protein, 9 aa, Homo Sapiens
DVDLVSARQ

SEQ ID NO: 1026211 - protein, 9 aa, Homo Sapiens
TDGKSQDNV

SEQ ID NO: 1026212 - protein, 9 aa, Homo Sapiens
WTNGIQNWT

SEQ ID NO: 1026213 - protein, 9 aa, Homo Sapiens
LTVVLKGAT

SEQ ID NO: 1026214 - protein, 9 aa, Homo Sapiens
QNGNISIPK

SEQ ID NO: 1026215 - protein, 9 aa, Homo Sapiens
AIAHEAKES

SEQ ID NO: 1026216 - protein, 9 aa, Homo Sapiens
EHNFSPNVS

SEQ ID NO: 1026217 - protein, 9 aa, Homo Sapiens
MIMKILIMF

SEQ ID NO: 1026218 - protein, 9 aa, Homo Sapiens
CPNGLDEKN

SEQ ID NO: 1026219 - protein, 9 aa, Homo Sapiens
FITIIPGGL

SEQ ID NO: 1026220 - protein, 9 aa, Homo Sapiens
IPPWLLNIK

SEQ ID NO: 1026221 - protein, 9 aa, Homo Sapiens
HSSPSSHSP

SEQ ID NO: 1026222 - protein, 9 aa, Homo Sapiens
GKIKEFFFE

SEQ ID NO: 1026223 - protein, 9 aa, Homo Sapiens
VFVEKIPRD

SEQ ID NO: 1026224 - protein, 9 aa, Homo Sapiens
GVTRFIALY

SEQ ID NO: 1026225 - protein, 9 aa, Homo Sapiens
FILLRLTDD

SEQ ID NO: 1026226 - protein, 9 aa, Homo Sapiens
YRKVPNLQI

SEQ ID NO: 1026227 - protein, 9 aa, Homo Sapiens
YTRLEFLRV

SEQ ID NO: 1026228 - protein, 9 aa, Homo Sapiens
RRTAIEYST

SEQ ID NO: 1026229 - protein, 9 aa, Homo Sapiens
EKGEFTKDV

SEQ ID NO: 1026230 - protein, 9 aa, Homo Sapiens
VKHIESKTA

SEQ ID NO: 1026231 - protein, 9 aa, Homo Sapiens
GKIFMKDPS

SEQ ID NO: 1026232 - protein, 9 aa, Homo Sapiens
QEKDSEGLG

SEQ ID NO: 1026233 - protein, 9 aa, Homo Sapiens
LQVELMRIL

SEQ ID NO: 1026234 - protein, 9 aa, Homo Sapiens
AVRDYSLLE

SEQ ID NO: 1026235 - protein, 9 aa, Homo Sapiens
KLQEIRKFI

SEQ ID NO: 1026236 - protein, 9 aa, Homo Sapiens
SSRFLLDFR

SEQ ID NO: 1026237 - protein, 9 aa, Homo Sapiens
KFKRNFDNF

SEQ ID NO: 1026238 - protein, 9 aa, Homo Sapiens
RFVHLQWKL

SEQ ID NO: 1026239 - protein, 9 aa, Homo Sapiens
MNVALQKVE

SEQ ID NO: 1026240 - protein, 9 aa, Homo Sapiens
IDKNLSERG

SEQ ID NO: 1026241 - protein, 9 aa, Homo Sapiens
GKYCIPEGI

SEQ ID NO: 1026242 - protein, 9 aa, Homo Sapiens
NRINSSRET

SEQ ID NO: 1026243 - protein, 9 aa, Homo Sapiens
KPHYIPKPP

SEQ ID NO: 1026244 - protein, 9 aa, Homo Sapiens
SGFEGQNCE

SEQ ID NO: 1026245 - protein, 9 aa, Homo Sapiens
PGDLSQTFE

SEQ ID NO: 1026246 - protein, 9 aa, Homo Sapiens
RPGLPEADG

SEQ ID NO: 1026247 - protein, 9 aa, Homo Sapiens
LSSFPNGHA

SEQ ID NO: 1026248 - protein, 9 aa, Homo Sapiens
RPWTLLCHD

SEQ ID NO: 1026249 - protein, 9 aa, Homo Sapiens
FPVEQEKDS

SEQ ID NO: 1026250 - protein, 9 aa, Homo Sapiens
EGIFCSGSD

SEQ ID NO: 1026251 - protein, 9 aa, Homo Sapiens
VDSNLCSQD

SEQ ID NO: 1026252 - protein, 9 aa, Homo Sapiens
PYDEVVLLP

SEQ ID NO: 1026253 - protein, 9 aa, Homo Sapiens
QAEAEGLRA

SEQ ID NO: 1026254 - protein, 9 aa, Homo Sapiens
PCRDKEAKI

SEQ ID NO: 1026255 - protein, 9 aa, Homo Sapiens
PSEVQRKGG

SEQ ID NO: 1026256 - protein, 9 aa, Homo Sapiens
PRGCEVFVE

SEQ ID NO: 1026257 - protein, 9 aa, Homo Sapiens
RASLTKVDK

SEQ ID NO: 1026258 - protein, 9 aa, Homo Sapiens
EVRESFDMA

SEQ ID NO: 1026259 - protein, 9 aa, Homo Sapiens
EGVAVVSRG

SEQ ID NO: 1026260 - protein, 9 aa, Homo Sapiens
AIYAGLRAH

SEQ ID NO: 1026261 - protein, 9 aa, Homo Sapiens
EASLEIPHS

SEQ ID NO: 1026262 - protein, 9 aa, Homo Sapiens
CLPLSTVTE

SEQ ID NO: 1026263 - protein, 9 aa, Homo Sapiens
GFSIRYKIF

SEQ ID NO: 1026264 - protein, 9 aa, Homo Sapiens
VLKEETEKG

SEQ ID NO: 1026265 - protein, 9 aa, Homo Sapiens
KMTEVLPSQ

SEQ ID NO: 1026266 - protein, 9 aa, Homo Sapiens
CPGKDRRTE

SEQ ID NO: 1026267 - protein, 9 aa, Homo Sapiens
SGEIIFLIY

SEQ ID NO: 1026268 - protein, 9 aa, Homo Sapiens
SYLERPSPT

SEQ ID NO: 1026269 - protein, 9 aa, Homo Sapiens
NKSAFTFQL

SEQ ID NO: 1026270 - protein, 9 aa, Homo Sapiens
EGSETTTAT

SEQ ID NO: 1026271 - protein, 9 aa, Homo Sapiens
LLSSVAFGF

SEQ ID NO: 1026272 - protein, 9 aa, Homo Sapiens
KNETLFCLD

SEQ ID NO: 1026273 - protein, 9 aa, Homo Sapiens
SEISEIIHM

SEQ ID NO: 1026274 - protein, 9 aa, Homo Sapiens
YDETSKTFA

SEQ ID NO: 1026275 - protein, 9 aa, Homo Sapiens
TAFYVAGIL

SEQ ID NO: 1026276 - protein, 9 aa, Homo Sapiens
NSAIYTLRN

SEQ ID NO: 1026277 - protein, 9 aa, Homo Sapiens
AEEISEGAS

SEQ ID NO: 1026278 - protein, 9 aa, Homo Sapiens
RMLSPFRSS

SEQ ID NO: 1026279 - protein, 9 aa, Homo Sapiens
VHKENSFTY

SEQ ID NO: 1026280 - protein, 9 aa, Homo Sapiens
SEASNKDIL

SEQ ID NO: 1026281 - protein, 9 aa, Homo Sapiens
VFLPAKALT

SEQ ID NO: 1026282 - protein, 9 aa, Homo Sapiens
QYVRHSSDS

SEQ ID NO: 1026283 - protein, 9 aa, Homo Sapiens
VWSTEESMP

SEQ ID NO: 1026284 - protein, 9 aa, Homo Sapiens
INSETVNLS

SEQ ID NO: 1026285 - protein, 9 aa, Homo Sapiens
KSAFTFQLT

SEQ ID NO: 1026286 - protein, 9 aa, Homo Sapiens
EASSQTPKK

SEQ ID NO: 1026287 - protein, 9 aa, Homo Sapiens
LEFDYCKIK

SEQ ID NO: 1026288 - protein, 9 aa, Homo Sapiens
IKKKKSCHR

SEQ ID NO: 1026289 - protein, 9 aa, Homo Sapiens
EGKDKVKPK

SEQ ID NO: 1026290 - protein, 9 aa, Homo Sapiens
VHSAKNTPF

SEQ ID NO: 1026291 - protein, 9 aa, Homo Sapiens
SHQGPQLLT

SEQ ID NO: 1026292 - protein, 9 aa, Homo Sapiens
KALNLKMKR

SEQ ID NO: 1026293 - protein, 9 aa, Homo Sapiens
GDLRPRGAK

SEQ ID NO: 1026294 - protein, 9 aa, Homo Sapiens
PITPNGQDP

SEQ ID NO: 1026295 - protein, 9 aa, Homo Sapiens
IKQLYHSDK

SEQ ID NO: 1026296 - protein, 9 aa, Homo Sapiens
SEKIWIEII

SEQ ID NO: 1026297 - protein, 9 aa, Homo Sapiens
VRGPPPLSS

SEQ ID NO: 1026298 - protein, 9 aa, Homo Sapiens
PEKFEVLKD

SEQ ID NO: 1026299 - protein, 9 aa, Homo Sapiens
LPLFCSLLG

SEQ ID NO: 1026300 - protein, 9 aa, Homo Sapiens
EQSELRHGL

SEQ ID NO: 1026301 - protein, 9 aa, Homo Sapiens
DCHHLEIQN

SEQ ID NO: 1026302 - protein, 9 aa, Homo Sapiens
WNKQLRRVF

SEQ ID NO: 1026303 - protein, 9 aa, Homo Sapiens
FLLDQNNNA

SEQ ID NO: 1026304 - protein, 9 aa, Homo Sapiens
NPQGGETIV

SEQ ID NO: 1026305 - protein, 9 aa, Homo Sapiens
SQEGKDKVK

SEQ ID NO: 1026306 - protein, 9 aa, Homo Sapiens
ITKSLVYGI

SEQ ID NO: 1026307 - protein, 9 aa, Homo Sapiens
LNRGQKERI

SEQ ID NO: 1026308 - protein, 9 aa, Homo Sapiens
DHDPIGQDF

SEQ ID NO: 1026309 - protein, 9 aa, Homo Sapiens
QMLSGAIPP

SEQ ID NO: 1026310 - protein, 9 aa, Homo Sapiens
GGSDEWQMR

SEQ ID NO: 1026311 - protein, 9 aa, Homo Sapiens
YARPFDSFF

SEQ ID NO: 1026312 - protein, 9 aa, Homo Sapiens
DDNSSVFTN

SEQ ID NO: 1026313 - protein, 9 aa, Homo Sapiens
FLPENDLAE

SEQ ID NO: 1026314 - protein, 9 aa, Homo Sapiens
TTLLARLLY

SEQ ID NO: 1026315 - protein, 9 aa, Homo Sapiens
TLCLAIPEG

SEQ ID NO: 1026316 - protein, 9 aa, Homo Sapiens
EGSAKSIYP

SEQ ID NO: 1026317 - protein, 9 aa, Homo Sapiens
ENSFTYFYK

SEQ ID NO: 1026318 - protein, 9 aa, Homo Sapiens
DQEKLGEVW

SEQ ID NO: 1026319 - protein, 9 aa, Homo Sapiens
NLQDDGVKL

SEQ ID NO: 1026320 - protein, 9 aa, Homo Sapiens
HPRSWLRLR

SEQ ID NO: 1026321 - protein, 9 aa, Homo Sapiens
ACLCCDAGR

SEQ ID NO: 1026322 - protein, 9 aa, Homo Sapiens
MRTVTNYFF

SEQ ID NO: 1026323 - protein, 9 aa, Homo Sapiens
GVSPPRKGF

SEQ ID NO: 1026324 - protein, 9 aa, Homo Sapiens
KLPDGHVIH

SEQ ID NO: 1026325 - protein, 9 aa, Homo Sapiens
QKLPKNPQN

SEQ ID NO: 1026326 - protein, 9 aa, Homo Sapiens
DYSLLEGCF

SEQ ID NO: 1026327 - protein, 9 aa, Homo Sapiens
MTLDYQIIN

SEQ ID NO: 1026328 - protein, 9 aa, Homo Sapiens
HDALEFFNL

SEQ ID NO: 1026329 - protein, 9 aa, Homo Sapiens
GQPGRKGFL

SEQ ID NO: 1026330 - protein, 9 aa, Homo Sapiens
CSPGWSLSI

SEQ ID NO: 1026331 - protein, 9 aa, Homo Sapiens
KYIRPQIQY

SEQ ID NO: 1026332 - protein, 9 aa, Homo Sapiens
ILSLRQTLQ

SEQ ID NO: 1026333 - protein, 9 aa, Homo Sapiens
NTLANLFLA

SEQ ID NO: 1026334 - protein, 9 aa, Homo Sapiens
RPKLYDPPG

SEQ ID NO: 1026335 - protein, 9 aa, Homo Sapiens
PAFSGSRTT

SEQ ID NO: 1026336 - protein, 9 aa, Homo Sapiens
LLKEDSWDA

SEQ ID NO: 1026337 - protein, 9 aa, Homo Sapiens
TSEVEALRD

SEQ ID NO: 1026338 - protein, 9 aa, Homo Sapiens
HARLEDSKL

SEQ ID NO: 1026339 - protein, 9 aa, Homo Sapiens
MYQPIQTYS

SEQ ID NO: 1026340 - protein, 9 aa, Homo Sapiens
AFGHSQAYQ

SEQ ID NO: 1026341 - protein, 9 aa, Homo Sapiens
FEERNFFLN

SEQ ID NO: 1026342 - protein, 9 aa, Homo Sapiens
FHFKLKLQI

SEQ ID NO: 1026343 - protein, 9 aa, Homo Sapiens
ESLCVLVPC

SEQ ID NO: 1026344 - protein, 9 aa, Homo Sapiens
GLPGPPGPG

SEQ ID NO: 1026345 - protein, 9 aa, Homo Sapiens
GRVVEPKKA

SEQ ID NO: 1026346 - protein, 9 aa, Homo Sapiens
SADSYTSRS

SEQ ID NO: 1026347 - protein, 9 aa, Homo Sapiens
KNRINSSRE

SEQ ID NO: 1026348 - protein, 9 aa, Homo Sapiens
LQTIFRNKP

SEQ ID NO: 1026349 - protein, 9 aa, Homo Sapiens
QVMFKLDKF

SEQ ID NO: 1026350 - protein, 9 aa, Homo Sapiens
WWCEIEPCL

SEQ ID NO: 1026351 - protein, 9 aa, Homo Sapiens
KEEVFDERA

SEQ ID NO: 1026352 - protein, 9 aa, Homo Sapiens
CSVSSEGCC

SEQ ID NO: 1026353 - protein, 9 aa, Homo Sapiens
GAPAQKPLQ

SEQ ID NO: 1026354 - protein, 9 aa, Homo Sapiens
SLKEPGDPW

SEQ ID NO: 1026355 - protein, 9 aa, Homo Sapiens
VFTKGMIIA

SEQ ID NO: 1026356 - protein, 9 aa, Homo Sapiens
FVCESVFSE

SEQ ID NO: 1026357 - protein, 9 aa, Homo Sapiens
NPKMNIITA

SEQ ID NO: 1026358 - protein, 9 aa, Homo Sapiens
TKIAGQILA

SEQ ID NO: 1026359 - protein, 9 aa, Homo Sapiens
LWVQAALDR

SEQ ID NO: 1026360 - protein, 9 aa, Homo Sapiens
VCNNGAGHC

SEQ ID NO: 1026361 - protein, 9 aa, Homo Sapiens
VLSAPEGLS

SEQ ID NO: 1026362 - protein, 9 aa, Homo Sapiens
HQQLLEHIQ

SEQ ID NO: 1026363 - protein, 9 aa, Homo Sapiens
FHSNFTLDL

SEQ ID NO: 1026364 - protein, 9 aa, Homo Sapiens
NHLVPSTHY

SEQ ID NO: 1026365 - protein, 9 aa, Homo Sapiens
EGDQQEPQQ

SEQ ID NO: 1026366 - protein, 9 aa, Homo Sapiens
KSPFDIKGI

SEQ ID NO: 1026367 - protein, 9 aa, Homo Sapiens
PAFLELDET

SEQ ID NO: 1026368 - protein, 9 aa, Homo Sapiens
SLLAMWNES

SEQ ID NO: 1026369 - protein, 9 aa, Homo Sapiens
PGCRHQPFT

SEQ ID NO: 1026370 - protein, 9 aa, Homo Sapiens
VSTTRVTSF

SEQ ID NO: 1026371 - protein, 9 aa, Homo Sapiens
TGYFRLGKM

SEQ ID NO: 1026372 - protein, 9 aa, Homo Sapiens
CDLSGPTPS

SEQ ID NO: 1026373 - protein, 9 aa, Homo Sapiens
NGIHGKEEN

SEQ ID NO: 1026374 - protein, 9 aa, Homo Sapiens
HDLSVLSSK

SEQ ID NO: 1026375 - protein, 9 aa, Homo Sapiens
SEPAFSGSR

SEQ ID NO: 1026376 - protein, 9 aa, Homo Sapiens
EVVLNGELV

SEQ ID NO: 1026377 - protein, 9 aa, Homo Sapiens
SPPVLDSYL

SEQ ID NO: 1026378 - protein, 9 aa, Homo Sapiens
AGSMMQNHG

SEQ ID NO: 1026379 - protein, 9 aa, Homo Sapiens
LAKDREGTK

SEQ ID NO: 1026380 - protein, 9 aa, Homo Sapiens
ETNLDSDVP

SEQ ID NO: 1026381 - protein, 9 aa, Homo Sapiens
FFRAGPEGR

SEQ ID NO: 1026382 - protein, 9 aa, Homo Sapiens
QQLGTINAK

SEQ ID NO: 1026383 - protein, 9 aa, Homo Sapiens
RIYNFVFFG

SEQ ID NO: 1026384 - protein, 9 aa, Homo Sapiens
CWSSWSSCV

SEQ ID NO: 1026385 - protein, 9 aa, Homo Sapiens
FCWPTLVIL

SEQ ID NO: 1026386 - protein, 9 aa, Homo Sapiens
NSSNKNKKE

SEQ ID NO: 1026387 - protein, 9 aa, Homo Sapiens
LLSLVLVGA

SEQ ID NO: 1026388 - protein, 9 aa, Homo Sapiens
TPLQVELMR

SEQ ID NO: 1026389 - protein, 9 aa, Homo Sapiens
YGRRLIQVM

SEQ ID NO: 1026390 - protein, 9 aa, Homo Sapiens
ANSSTAHPV

SEQ ID NO: 1026391 - protein, 9 aa, Homo Sapiens
SEKPKKPKQ

SEQ ID NO: 1026392 - protein, 9 aa, Homo Sapiens
SCGVPEGHP

SEQ ID NO: 1026393 - protein, 9 aa, Homo Sapiens
KMEHLIGPC

SEQ ID NO: 1026394 - protein, 9 aa, Homo Sapiens
LLGGPFFLT

SEQ ID NO: 1026395 - protein, 9 aa, Homo Sapiens
LANLFLAKY

SEQ ID NO: 1026396 - protein, 9 aa, Homo Sapiens
SNLMQQRIS

SEQ ID NO: 1026397 - protein, 9 aa, Homo Sapiens
SVFETNLDS

SEQ ID NO: 1026398 - protein, 9 aa, Homo Sapiens
IEVVFELSV

SEQ ID NO: 1026399 - protein, 9 aa, Homo Sapiens
MWVGKNRIN

SEQ ID NO: 1026400 - protein, 9 aa, Homo Sapiens
FVTFACSGH

SEQ ID NO: 1026401 - protein, 9 aa, Homo Sapiens
GGNYEGGSG

SEQ ID NO: 1026402 - protein, 9 aa, Homo Sapiens
LREFSSGSS

SEQ ID NO: 1026403 - protein, 9 aa, Homo Sapiens
NQCSCNVTK

SEQ ID NO: 1026404 - protein, 9 aa, Homo Sapiens
QSGWLWVQA

SEQ ID NO: 1026405 - protein, 9 aa, Homo Sapiens
KEKNARVAV

SEQ ID NO: 1026406 - protein, 9 aa, Homo Sapiens
FVCKACGCN

SEQ ID NO: 1026407 - protein, 9 aa, Homo Sapiens
WGPQAGPPL

SEQ ID NO: 1026408 - protein, 9 aa, Homo Sapiens
SHLTEEEKN

SEQ ID NO: 1026409 - protein, 9 aa, Homo Sapiens
IIPGGLYPS

SEQ ID NO: 1026410 - protein, 9 aa, Homo Sapiens
AKLRLRIDL

SEQ ID NO: 1026411 - protein, 9 aa, Homo Sapiens
NRNHLVPST

SEQ ID NO: 1026412 - protein, 9 aa, Homo Sapiens
IIQQDCQKS

SEQ ID NO: 1026413 - protein, 9 aa, Homo Sapiens
KREYKNELA

SEQ ID NO: 1026414 - protein, 9 aa, Homo Sapiens
KHLSKDTLL

SEQ ID NO: 1026415 - protein, 9 aa, Homo Sapiens
RHGGLSSQP

SEQ ID NO: 1026416 - protein, 9 aa, Homo Sapiens
CNSVLRMQK

SEQ ID NO: 1026417 - protein, 9 aa, Homo Sapiens
PLPKSLASL

SEQ ID NO: 1026418 - protein, 9 aa, Homo Sapiens
KDNVIWLWE

SEQ ID NO: 1026419 - protein, 9 aa, Homo Sapiens
ILLEKHLRK

SEQ ID NO: 1026420 - protein, 9 aa, Homo Sapiens
TGVSQDLFS

SEQ ID NO: 1026421 - protein, 9 aa, Homo Sapiens
FEDQSLSDF

SEQ ID NO: 1026422 - protein, 9 aa, Homo Sapiens
LGIPGLPGL

SEQ ID NO: 1026423 - protein, 9 aa, Homo Sapiens
AGGDFRNPL

SEQ ID NO: 1026424 - protein, 9 aa, Homo Sapiens
KNQKAEREE

SEQ ID NO: 1026425 - protein, 9 aa, Homo Sapiens
EKKVTGCPP

SEQ ID NO: 1026426 - protein, 9 aa, Homo Sapiens
FSSSPDLGS

SEQ ID NO: 1026427 - protein, 9 aa, Homo Sapiens
SPLPKAGFI

SEQ ID NO: 1026428 - protein, 9 aa, Homo Sapiens
EITNICVPS

SEQ ID NO: 1026429 - protein, 9 aa, Homo Sapiens
ELDKDEGFG

SEQ ID NO: 1026430 - protein, 9 aa, Homo Sapiens
SFTKIVKRN

SEQ ID NO: 1026431 - protein, 9 aa, Homo Sapiens
LCRAFMNLT

SEQ ID NO: 1026432 - protein, 9 aa, Homo Sapiens
KIYNGERPF

SEQ ID NO: 1026433 - protein, 9 aa, Homo Sapiens
SKVLLSKEE

SEQ ID NO: 1026434 - protein, 9 aa, Homo Sapiens
LPKAAHQKK

SEQ ID NO: 1026435 - protein, 9 aa, Homo Sapiens
PPILVVLAL

SEQ ID NO: 1026436 - protein, 9 aa, Homo Sapiens
WQQAAPSFY

SEQ ID NO: 1026437 - protein, 9 aa, Homo Sapiens
NWSGGWHYA

SEQ ID NO: 1026438 - protein, 9 aa, Homo Sapiens
PCHISQPCV

SEQ ID NO: 1026439 - protein, 9 aa, Homo Sapiens
VIVQSPRQG

SEQ ID NO: 1026440 - protein, 9 aa, Homo Sapiens
PNKEEVFDE

SEQ ID NO: 1026441 - protein, 9 aa, Homo Sapiens
GLRYWLYAD

SEQ ID NO: 1026442 - protein, 9 aa, Homo Sapiens
PSLSVEEPH

SEQ ID NO: 1026443 - protein, 9 aa, Homo Sapiens
LNAPTHPPE

SEQ ID NO: 1026444 - protein, 9 aa, Homo Sapiens
LYFFYNVID

SEQ ID NO: 1026445 - protein, 9 aa, Homo Sapiens
WILNSTDCP

SEQ ID NO: 1026446 - protein, 9 aa, Homo Sapiens
YFSDYLMGF

SEQ ID NO: 1026447 - protein, 9 aa, Homo Sapiens
MDADWTGLQ

SEQ ID NO: 1026448 - protein, 9 aa, Homo Sapiens
NKQLRRVFG

SEQ ID NO: 1026449 - protein, 9 aa, Homo Sapiens
DEIEEMPTT

SEQ ID NO: 1026450 - protein, 9 aa, Homo Sapiens
ESTILLAMT

SEQ ID NO: 1026451 - protein, 9 aa, Homo Sapiens
PFDSFFLDK

SEQ ID NO: 1026452 - protein, 9 aa, Homo Sapiens
LGLNDLNVF

SEQ ID NO: 1026453 - protein, 9 aa, Homo Sapiens
SFAFYQQGT

SEQ ID NO: 1026454 - protein, 9 aa, Homo Sapiens
PRICRISDR

SEQ ID NO: 1026455 - protein, 9 aa, Homo Sapiens
RLAHHQRHS

SEQ ID NO: 1026456 - protein, 9 aa, Homo Sapiens
PPLYRHAAS

SEQ ID NO: 1026457 - protein, 9 aa, Homo Sapiens
NTQIMFWIQ

SEQ ID NO: 1026458 - protein, 9 aa, Homo Sapiens
QPLVVNLPV

SEQ ID NO: 1026459 - protein, 9 aa, Homo Sapiens
ANQKRITTL

SEQ ID NO: 1026460 - protein, 9 aa, Homo Sapiens
SRALEVSSP

SEQ ID NO: 1026461 - protein, 9 aa, Homo Sapiens
IAANSKLVK

SEQ ID NO: 1026462 - protein, 9 aa, Homo Sapiens
LKSKFCHQG

SEQ ID NO: 1026463 - protein, 9 aa, Homo Sapiens
ADVTFLSHL

SEQ ID NO: 1026464 - protein, 9 aa, Homo Sapiens
LRRFTEHNF

SEQ ID NO: 1026465 - protein, 9 aa, Homo Sapiens
GASGAGSSS

SEQ ID NO: 1026466 - protein, 9 aa, Homo Sapiens
GSKEEDDDK

SEQ ID NO: 1026467 - protein, 9 aa, Homo Sapiens
SCEKTMLVE

SEQ ID NO: 1026468 - protein, 9 aa, Homo Sapiens
YLSNNKLCD

SEQ ID NO: 1026469 - protein, 9 aa, Homo Sapiens
LLKYITGNN

SEQ ID NO: 1026470 - protein, 9 aa, Homo Sapiens
LPQSQEVDW

SEQ ID NO: 1026471 - protein, 9 aa, Homo Sapiens
SDWVRNVAW

SEQ ID NO: 1026472 - protein, 9 aa, Homo Sapiens
SYLLQPSYL

SEQ ID NO: 1026473 - protein, 9 aa, Homo Sapiens
KPAEDCLFL

SEQ ID NO: 1026474 - protein, 9 aa, Homo Sapiens
LYLSNNKLC

SEQ ID NO: 1026475 - protein, 9 aa, Homo Sapiens
ATHKQRKLA

SEQ ID NO: 1026476 - protein, 9 aa, Homo Sapiens
FTSGRNCTC

SEQ ID NO: 1026477 - protein, 9 aa, Homo Sapiens
APPPSLSSP

SEQ ID NO: 1026478 - protein, 9 aa, Homo Sapiens
DSKWKKHRQ

SEQ ID NO: 1026479 - protein, 9 aa, Homo Sapiens
QAFLPSSPL

SEQ ID NO: 1026480 - protein, 9 aa, Homo Sapiens
SWSSCVQGK

SEQ ID NO: 1026481 - protein, 9 aa, Homo Sapiens
FEIKEEEGL

SEQ ID NO: 1026482 - protein, 9 aa, Homo Sapiens
HGGLSSQPS

SEQ ID NO: 1026483 - protein, 9 aa, Homo Sapiens
IQERSLQDR

SEQ ID NO: 1026484 - protein, 9 aa, Homo Sapiens
ILLEAKAFS

SEQ ID NO: 1026485 - protein, 9 aa, Homo Sapiens
KAFKQFSIL

SEQ ID NO: 1026486 - protein, 9 aa, Homo Sapiens
QQGMNVALQ

SEQ ID NO: 1026487 - protein, 9 aa, Homo Sapiens
QEGKDKVKP

SEQ ID NO: 1026488 - protein, 9 aa, Homo Sapiens
SPRGQLVGK

SEQ ID NO: 1026489 - protein, 9 aa, Homo Sapiens
LVVLALAES

SEQ ID NO: 1026490 - protein, 9 aa, Homo Sapiens
AAPSGPGPR

SEQ ID NO: 1026491 - protein, 9 aa, Homo Sapiens
RRRVRPQVS

SEQ ID NO: 1026492 - protein, 9 aa, Homo Sapiens
DSLSSFPNG

SEQ ID NO: 1026493 - protein, 9 aa, Homo Sapiens
APSFYLSVK

SEQ ID NO: 1026494 - protein, 9 aa, Homo Sapiens
RAPAKPRSS

SEQ ID NO: 1026495 - protein, 9 aa, Homo Sapiens
CKFIFTSGR

SEQ ID NO: 1026496 - protein, 9 aa, Homo Sapiens
VPFKLMSTF

SEQ ID NO: 1026497 - protein, 9 aa, Homo Sapiens
KNAMYGNFM

SEQ ID NO: 1026498 - protein, 9 aa, Homo Sapiens
DDDSGGPLM

SEQ ID NO: 1026499 - protein, 9 aa, Homo Sapiens
LSSQRPWTL

SEQ ID NO: 1026500 - protein, 9 aa, Homo Sapiens
IHSFWKLRS

SEQ ID NO: 1026501 - protein, 9 aa, Homo Sapiens
IQKEGHMRW

SEQ ID NO: 1026502 - protein, 9 aa, Homo Sapiens
VLLANRRRY

SEQ ID NO: 1026503 - protein, 9 aa, Homo Sapiens
SQTFEDQSL

SEQ ID NO: 1026504 - protein, 9 aa, Homo Sapiens
SLKYCDVDL

SEQ ID NO: 1026505 - protein, 9 aa, Homo Sapiens
GYHLDTAKI

SEQ ID NO: 1026506 - protein, 9 aa, Homo Sapiens
KLAEKDKKL

SEQ ID NO: 1026507 - protein, 9 aa, Homo Sapiens
HIFYGRKNF

SEQ ID NO: 1026508 - protein, 9 aa, Homo Sapiens
RVSEKSWNQ

SEQ ID NO: 1026509 - protein, 9 aa, Homo Sapiens
PPPVLAFPA

SEQ ID NO: 1026510 - protein, 9 aa, Homo Sapiens
MDCEMYKHR

SEQ ID NO: 1026511 - protein, 9 aa, Homo Sapiens
LIDYLLSTQ

SEQ ID NO: 1026512 - protein, 9 aa, Homo Sapiens
LAIPEGRVC

SEQ ID NO: 1026513 - protein, 9 aa, Homo Sapiens
PGCSKMYIK

SEQ ID NO: 1026514 - protein, 9 aa, Homo Sapiens
YFFYFLGST

SEQ ID NO: 1026515 - protein, 9 aa, Homo Sapiens
RSKLLNKTT

SEQ ID NO: 1026516 - protein, 9 aa, Homo Sapiens
LTELLLKIN

SEQ ID NO: 1026517 - protein, 9 aa, Homo Sapiens
WTLLCHDMM

SEQ ID NO: 1026518 - protein, 9 aa, Homo Sapiens
LICFLISFL

SEQ ID NO: 1026519 - protein, 9 aa, Homo Sapiens
ELMNFGFPQ

SEQ ID NO: 1026520 - protein, 9 aa, Homo Sapiens
STECLLLGI

SEQ ID NO: 1026521 - protein, 9 aa, Homo Sapiens
TSRPSLLGS

SEQ ID NO: 1026522 - protein, 9 aa, Homo Sapiens
CLERVQPGP

SEQ ID NO: 1026523 - protein, 9 aa, Homo Sapiens
ATFGYSFRL

SEQ ID NO: 1026524 - protein, 9 aa, Homo Sapiens
GHSQAYQGP

SEQ ID NO: 1026525 - protein, 9 aa, Homo Sapiens
LFRRRWQRS

SEQ ID NO: 1026526 - protein, 9 aa, Homo Sapiens
DTKKNLEGT

SEQ ID NO: 1026527 - protein, 9 aa, Homo Sapiens
FFSKVYPEK

SEQ ID NO: 1026528 - protein, 9 aa, Homo Sapiens
GNPGLSGSP

SEQ ID NO: 1026529 - protein, 9 aa, Homo Sapiens
VTFFNGYND

SEQ ID NO: 1026530 - protein, 9 aa, Homo Sapiens
SKDFYGTLI

SEQ ID NO: 1026531 - protein, 9 aa, Homo Sapiens
LRSFQSGDL

SEQ ID NO: 1026532 - protein, 9 aa, Homo Sapiens
PDMKEEEKS

SEQ ID NO: 1026533 - protein, 9 aa, Homo Sapiens
PMEPSIPQS

SEQ ID NO: 1026534 - protein, 9 aa, Homo Sapiens
SAAETSGGL

SEQ ID NO: 1026535 - protein, 9 aa, Homo Sapiens
MGFSSGDHG

SEQ ID NO: 1026536 - protein, 9 aa, Homo Sapiens
EGGKATCFV

SEQ ID NO: 1026537 - protein, 9 aa, Homo Sapiens
IPVQPVYLY

SEQ ID NO: 1026538 - protein, 9 aa, Homo Sapiens
PGEISSCIP

SEQ ID NO: 1026539 - protein, 9 aa, Homo Sapiens
AFKQFSILT

SEQ ID NO: 1026540 - protein, 9 aa, Homo Sapiens
EAFFRHQMK

SEQ ID NO: 1026541 - protein, 9 aa, Homo Sapiens
SDSSGKEHV

SEQ ID NO: 1026542 - protein, 9 aa, Homo Sapiens
QWDHVHLQN

SEQ ID NO: 1026543 - protein, 9 aa, Homo Sapiens
ETNFLPAPA

SEQ ID NO: 1026544 - protein, 9 aa, Homo Sapiens
QESLCVLVP

SEQ ID NO: 1026545 - protein, 9 aa, Homo Sapiens
AQAEGAAMR

SEQ ID NO: 1026546 - protein, 9 aa, Homo Sapiens
WLLWLGSHA

SEQ ID NO: 1026547 - protein, 9 aa, Homo Sapiens
WKYALPKVI

SEQ ID NO: 1026548 - protein, 9 aa, Homo Sapiens
DSEVELSVI

SEQ ID NO: 1026549 - protein, 9 aa, Homo Sapiens
EFFNLLVDS

SEQ ID NO: 1026550 - protein, 9 aa, Homo Sapiens
MFWIQEITE

SEQ ID NO: 1026551 - protein, 9 aa, Homo Sapiens
SAKNTPFQH

SEQ ID NO: 1026552 - protein, 9 aa, Homo Sapiens
FCLQSLVFL

SEQ ID NO: 1026553 - protein, 9 aa, Homo Sapiens
LSDHWLLWL

SEQ ID NO: 1026554 - protein, 9 aa, Homo Sapiens
CLTALKFVA

SEQ ID NO: 1026555 - protein, 9 aa, Homo Sapiens
SLLSVALKG

SEQ ID NO: 1026556 - protein, 9 aa, Homo Sapiens
MRESGQAGR

SEQ ID NO: 1026557 - protein, 9 aa, Homo Sapiens
GIKCTQEEV

SEQ ID NO: 1026558 - protein, 9 aa, Homo Sapiens
TRDGGFLNN

SEQ ID NO: 1026559 - protein, 9 aa, Homo Sapiens
LNLPTCRNN

SEQ ID NO: 1026560 - protein, 9 aa, Homo Sapiens
DRSLDMSFM

SEQ ID NO: 1026561 - protein, 9 aa, Homo Sapiens
PDYYSECQS

SEQ ID NO: 1026562 - protein, 9 aa, Homo Sapiens
RGFPRACYR

SEQ ID NO: 1026563 - protein, 9 aa, Homo Sapiens
LSSSTSWHL

SEQ ID NO: 1026564 - protein, 9 aa, Homo Sapiens
KNAAWHPTT

SEQ ID NO: 1026565 - protein, 9 aa, Homo Sapiens
QYCLQGLFY

SEQ ID NO: 1026566 - protein, 9 aa, Homo Sapiens
PGSAGSAAL

SEQ ID NO: 1026567 - protein, 9 aa, Homo Sapiens
ALTTARLVR

SEQ ID NO: 1026568 - protein, 9 aa, Homo Sapiens
ATCSLHVAV

SEQ ID NO: 1026569 - protein, 9 aa, Homo Sapiens
VDMNATTVI

SEQ ID NO: 1026570 - protein, 9 aa, Homo Sapiens
HQKIYNGER

SEQ ID NO: 1026571 - protein, 9 aa, Homo Sapiens
SCCSVSSEG

SEQ ID NO: 1026572 - protein, 9 aa, Homo Sapiens
SKGLAGLGI

SEQ ID NO: 1026573 - protein, 9 aa, Homo Sapiens
EDQVAQSSV

SEQ ID NO: 1026574 - protein, 9 aa, Homo Sapiens
QELEVFCWP

SEQ ID NO: 1026575 - protein, 9 aa, Homo Sapiens
SDNSPVGEG

SEQ ID NO: 1026576 - protein, 9 aa, Homo Sapiens
KKQPLLTVK

SEQ ID NO: 1026577 - protein, 9 aa, Homo Sapiens
RPTKEIQAV

SEQ ID NO: 1026578 - protein, 9 aa, Homo Sapiens
KVSEVPREE

SEQ ID NO: 1026579 - protein, 9 aa, Homo Sapiens
IFCSGSDDG

SEQ ID NO: 1026580 - protein, 9 aa, Homo Sapiens
TVSAENPNP

SEQ ID NO: 1026581 - protein, 9 aa, Homo Sapiens
LEDQVAQSS

SEQ ID NO: 1026582 - protein, 9 aa, Homo Sapiens
ISGVKKFMH

SEQ ID NO: 1026583 - protein, 9 aa, Homo Sapiens
NSSHFSAHW

SEQ ID NO: 1026584 - protein, 9 aa, Homo Sapiens
LSDDVVQYI

SEQ ID NO: 1026585 - protein, 9 aa, Homo Sapiens
EEKCSSDIP

SEQ ID NO: 1026586 - protein, 9 aa, Homo Sapiens
LGFSREAEG

SEQ ID NO: 1026587 - protein, 9 aa, Homo Sapiens
LPKNLTVVE

SEQ ID NO: 1026588 - protein, 9 aa, Homo Sapiens
NCMSFSVLN

SEQ ID NO: 1026589 - protein, 9 aa, Homo Sapiens
VAGCVHGIC

SEQ ID NO: 1026590 - protein, 9 aa, Homo Sapiens
LGIQHDHLA

SEQ ID NO: 1026591 - protein, 9 aa, Homo Sapiens
QVIRAWVSS

SEQ ID NO: 1026592 - protein, 9 aa, Homo Sapiens
LVVNLPVYV

SEQ ID NO: 1026593 - protein, 9 aa, Homo Sapiens
GGKGGAGAD

SEQ ID NO: 1026594 - protein, 9 aa, Homo Sapiens
FNPALAAFV

SEQ ID NO: 1026595 - protein, 9 aa, Homo Sapiens
FRLHTPMYF

SEQ ID NO: 1026596 - protein, 9 aa, Homo Sapiens
GAVIGVTPF

SEQ ID NO: 1026597 - protein, 9 aa, Homo Sapiens
QLLLSPPNK

SEQ ID NO: 1026598 - protein, 9 aa, Homo Sapiens
IWSHQGPQL

SEQ ID NO: 1026599 - protein, 9 aa, Homo Sapiens
LYADKILDD

SEQ ID NO: 1026600 - protein, 9 aa, Homo Sapiens
KEYLEKFLT

SEQ ID NO: 1026601 - protein, 9 aa, Homo Sapiens
WNESSLSDA

SEQ ID NO: 1026602 - protein, 9 aa, Homo Sapiens
LCWTNGIQN

SEQ ID NO: 1026603 - protein, 9 aa, Homo Sapiens
GECKDQKKI

SEQ ID NO: 1026604 - protein, 9 aa, Homo Sapiens
SFLLVLDDV

SEQ ID NO: 1026605 - protein, 9 aa, Homo Sapiens
EPSIPQSAP

SEQ ID NO: 1026606 - protein, 9 aa, Homo Sapiens
LLDKNSEAD

SEQ ID NO: 1026607 - protein, 9 aa, Homo Sapiens
HKFSGFPRV

SEQ ID NO: 1026608 - protein, 9 aa, Homo Sapiens
AGSGIAWTI

SEQ ID NO: 1026609 - protein, 9 aa, Homo Sapiens
GSLLVSSSS

SEQ ID NO: 1026610 - protein, 9 aa, Homo Sapiens
TSGNLEVSY

SEQ ID NO: 1026611 - protein, 9 aa, Homo Sapiens
QGAHGESSL

SEQ ID NO: 1026612 - protein, 9 aa, Homo Sapiens
NNMCLKVKP

SEQ ID NO: 1026613 - protein, 9 aa, Homo Sapiens
VQESLCVLV

SEQ ID NO: 1026614 - protein, 9 aa, Homo Sapiens
VETSSAGRV

SEQ ID NO: 1026615 - protein, 9 aa, Homo Sapiens
LKKKVTRNM

SEQ ID NO: 1026616 - protein, 9 aa, Homo Sapiens
GDRKPLHLE

SEQ ID NO: 1026617 - protein, 9 aa, Homo Sapiens
KDKDLLNEN

SEQ ID NO: 1026618 - protein, 9 aa, Homo Sapiens
KKVTGCPPF

SEQ ID NO: 1026619 - protein, 9 aa, Homo Sapiens
GVLHELSGN

SEQ ID NO: 1026620 - protein, 9 aa, Homo Sapiens
EEPSTFPDL

SEQ ID NO: 1026621 - protein, 9 aa, Homo Sapiens
LFCSLLGRA

SEQ ID NO: 1026622 - protein, 9 aa, Homo Sapiens
IPYRKEISY

SEQ ID NO: 1026623 - protein, 9 aa, Homo Sapiens
FNVSDRQSF

SEQ ID NO: 1026624 - protein, 9 aa, Homo Sapiens
KRCPNRVKV

SEQ ID NO: 1026625 - protein, 9 aa, Homo Sapiens
SSSPVFMTA

SEQ ID NO: 1026626 - protein, 9 aa, Homo Sapiens
SLTQKLQEK

SEQ ID NO: 1026627 - protein, 9 aa, Homo Sapiens
PVLNFPTDK

SEQ ID NO: 1026628 - protein, 9 aa, Homo Sapiens
VGAVIGVTP

SEQ ID NO: 1026629 - protein, 9 aa, Homo Sapiens
LLNVPELNT

SEQ ID NO: 1026630 - protein, 9 aa, Homo Sapiens
CSPLQPHPG

SEQ ID NO: 1026631 - protein, 9 aa, Homo Sapiens
DITVNIWYS

SEQ ID NO: 1026632 - protein, 9 aa, Homo Sapiens
AIAANSKLV

SEQ ID NO: 1026633 - protein, 9 aa, Homo Sapiens
AIQQLENGE

SEQ ID NO: 1026634 - protein, 9 aa, Homo Sapiens
NLHISTLSQ

SEQ ID NO: 1026635 - protein, 9 aa, Homo Sapiens
SCVQGKKTR

SEQ ID NO: 1026636 - protein, 9 aa, Homo Sapiens
RLIQVGRGS

SEQ ID NO: 1026637 - protein, 9 aa, Homo Sapiens
HYDYVDVEI

SEQ ID NO: 1026638 - protein, 9 aa, Homo Sapiens
EGDNLHIQR

SEQ ID NO: 1026639 - protein, 9 aa, Homo Sapiens
AHARLEDSK

SEQ ID NO: 1026640 - protein, 9 aa, Homo Sapiens
PPLSLSEDG

SEQ ID NO: 1026641 - protein, 9 aa, Homo Sapiens
KEFFFEKLK

SEQ ID NO: 1026642 - protein, 9 aa, Homo Sapiens
QTQETQKLN

SEQ ID NO: 1026643 - protein, 9 aa, Homo Sapiens
NMFSHLKKK

SEQ ID NO: 1026644 - protein, 9 aa, Homo Sapiens
PLSVSVKAM

SEQ ID NO: 1026645 - protein, 9 aa, Homo Sapiens
VSDRQSFLQ

SEQ ID NO: 1026646 - protein, 9 aa, Homo Sapiens
PQAHKHPSH

SEQ ID NO: 1026647 - protein, 9 aa, Homo Sapiens
TLAGPVVVL

SEQ ID NO: 1026648 - protein, 9 aa, Homo Sapiens
GVEDISGLS

SEQ ID NO: 1026649 - protein, 9 aa, Homo Sapiens
DDDDDNSDD

SEQ ID NO: 1026650 - protein, 9 aa, Homo Sapiens
KQEKIYTGG

SEQ ID NO: 1026651 - protein, 9 aa, Homo Sapiens
LPSSPLPSD

SEQ ID NO: 1026652 - protein, 9 aa, Homo Sapiens
EEKVTQMEG

SEQ ID NO: 1026653 - protein, 9 aa, Homo Sapiens
RIQHLYEEK

SEQ ID NO: 1026654 - protein, 9 aa, Homo Sapiens
VTDRANNSM

SEQ ID NO: 1026655 - protein, 9 aa, Homo Sapiens
IVIDCEQNN

SEQ ID NO: 1026656 - protein, 9 aa, Homo Sapiens
PEGSPGEIS

SEQ ID NO: 1026657 - protein, 9 aa, Homo Sapiens
KDLDDSFLD

SEQ ID NO: 1026658 - protein, 9 aa, Homo Sapiens
SHIFYGRKN

SEQ ID NO: 1026659 - protein, 9 aa, Homo Sapiens
LELDETFIV

SEQ ID NO: 1026660 - protein, 9 aa, Homo Sapiens
MFEILLDKN

SEQ ID NO: 1026661 - protein, 9 aa, Homo Sapiens
ASERVTKDS

SEQ ID NO: 1026662 - protein, 9 aa, Homo Sapiens
KNLEGTLRR

SEQ ID NO: 1026663 - protein, 9 aa, Homo Sapiens
TQTSPAHPN

SEQ ID NO: 1026664 - protein, 9 aa, Homo Sapiens
SSFNLHETI

SEQ ID NO: 1026665 - protein, 9 aa, Homo Sapiens
LSSPPLPHC

SEQ ID NO: 1026666 - protein, 9 aa, Homo Sapiens
TGPLVQNAA

SEQ ID NO: 1026667 - protein, 9 aa, Homo Sapiens
VSQGDETLC

SEQ ID NO: 1026668 - protein, 9 aa, Homo Sapiens
NYEKSKKHR

SEQ ID NO: 1026669 - protein, 9 aa, Homo Sapiens
MGGRYIEMF

SEQ ID NO: 1026670 - protein, 9 aa, Homo Sapiens
KACTCDSGD

SEQ ID NO: 1026671 - protein, 9 aa, Homo Sapiens
CLSGFEGQN

SEQ ID NO: 1026672 - protein, 9 aa, Homo Sapiens
VTQMEGSVD

SEQ ID NO: 1026673 - protein, 9 aa, Homo Sapiens
SSSSKTSDS

SEQ ID NO: 1026674 - protein, 9 aa, Homo Sapiens
EYQESCQGL

SEQ ID NO: 1026675 - protein, 9 aa, Homo Sapiens
IDISNNGTK

SEQ ID NO: 1026676 - protein, 9 aa, Homo Sapiens
QTCVMWDDL

SEQ ID NO: 1026677 - protein, 9 aa, Homo Sapiens
LAAEAVRDY

SEQ ID NO: 1026678 - protein, 9 aa, Homo Sapiens
VPAAPSGPG

SEQ ID NO: 1026679 - protein, 9 aa, Homo Sapiens
NAPDHTSET

SEQ ID NO: 1026680 - protein, 9 aa, Homo Sapiens
YMSQQNTRP

SEQ ID NO: 1026681 - protein, 9 aa, Homo Sapiens
KGFAPCSPP

SEQ ID NO: 1026682 - protein, 9 aa, Homo Sapiens
RRTNHDDPA

SEQ ID NO: 1026683 - protein, 9 aa, Homo Sapiens
AKPASVIAR

SEQ ID NO: 1026684 - protein, 9 aa, Homo Sapiens
EDRMECESS

SEQ ID NO: 1026685 - protein, 9 aa, Homo Sapiens
NGSELQEED

SEQ ID NO: 1026686 - protein, 9 aa, Homo Sapiens
PCNSVLRMQ

SEQ ID NO: 1026687 - protein, 9 aa, Homo Sapiens
SYGKKKNAM

SEQ ID NO: 1026688 - protein, 9 aa, Homo Sapiens
FFTVYHYNG

SEQ ID NO: 1026689 - protein, 9 aa, Homo Sapiens
SPARNSPAP

SEQ ID NO: 1026690 - protein, 9 aa, Homo Sapiens
GLDEKNCVC

SEQ ID NO: 1026691 - protein, 9 aa, Homo Sapiens
PGKDRRTEE

SEQ ID NO: 1026692 - protein, 9 aa, Homo Sapiens
MVTELCYFP

SEQ ID NO: 1026693 - protein, 9 aa, Homo Sapiens
FLQTFYTHQ

SEQ ID NO: 1026694 - protein, 9 aa, Homo Sapiens
FSSFEKHQI

SEQ ID NO: 1026695 - protein, 9 aa, Homo Sapiens
SESQDPSFG

SEQ ID NO: 1026696 - protein, 9 aa, Homo Sapiens
KNSEADKRE

SEQ ID NO: 1026697 - protein, 9 aa, Homo Sapiens
PPRKGFAPC

SEQ ID NO: 1026698 - protein, 9 aa, Homo Sapiens
AVAPTKSSK

SEQ ID NO: 1026699 - protein, 9 aa, Homo Sapiens
LPTCSPLQP

SEQ ID NO: 1026700 - protein, 9 aa, Homo Sapiens
KNIAPAEQK

SEQ ID NO: 1026701 - protein, 9 aa, Homo Sapiens
CSTPQRSLR

SEQ ID NO: 1026702 - protein, 9 aa, Homo Sapiens
QVVHKTQEK

SEQ ID NO: 1026703 - protein, 9 aa, Homo Sapiens
KLAYDDKNA

SEQ ID NO: 1026704 - protein, 9 aa, Homo Sapiens
SARQLVKIF

SEQ ID NO: 1026705 - protein, 9 aa, Homo Sapiens
GYSFRLNEA

SEQ ID NO: 1026706 - protein, 9 aa, Homo Sapiens
CEKTMLVEA

SEQ ID NO: 1026707 - protein, 9 aa, Homo Sapiens
KFIYSEDNI

SEQ ID NO: 1026708 - protein, 9 aa, Homo Sapiens
TRARNKEHQ

SEQ ID NO: 1026709 - protein, 9 aa, Homo Sapiens
LFYHLEVRE

SEQ ID NO: 1026710 - protein, 9 aa, Homo Sapiens
PFPGTWKEY

SEQ ID NO: 1026711 - protein, 9 aa, Homo Sapiens
FKEINTQIM

SEQ ID NO: 1026712 - protein, 9 aa, Homo Sapiens
RAIAHEAKE

SEQ ID NO: 1026713 - protein, 9 aa, Homo Sapiens
NSGDIFLGV

SEQ ID NO: 1026714 - protein, 9 aa, Homo Sapiens
PHGPYGEKM

SEQ ID NO: 1026715 - protein, 9 aa, Homo Sapiens
GSGLLPSQL

SEQ ID NO: 1026716 - protein, 9 aa, Homo Sapiens
NNGTKLWTG

SEQ ID NO: 1026717 - protein, 9 aa, Homo Sapiens
TCAFHFIAV

SEQ ID NO: 1026718 - protein, 9 aa, Homo Sapiens
GSLSTSPYN

SEQ ID NO: 1026719 - protein, 9 aa, Homo Sapiens
ARNKEHQQQ

SEQ ID NO: 1026720 - protein, 9 aa, Homo Sapiens
PGFPLSINA

SEQ ID NO: 1026721 - protein, 9 aa, Homo Sapiens
GIEDIYEKE

SEQ ID NO: 1026722 - protein, 9 aa, Homo Sapiens
VIICVTTVP

SEQ ID NO: 1026723 - protein, 9 aa, Homo Sapiens
EVVFELSVT

SEQ ID NO: 1026724 - protein, 9 aa, Homo Sapiens
LLRAPQNLF

SEQ ID NO: 1026725 - protein, 9 aa, Homo Sapiens
MTMIMKILI

SEQ ID NO: 1026726 - protein, 9 aa, Homo Sapiens
DLEEKVTQM

SEQ ID NO: 1026727 - protein, 9 aa, Homo Sapiens
ILVVLALAE

SEQ ID NO: 1026728 - protein, 9 aa, Homo Sapiens
GERGLPGEE

SEQ ID NO: 1026729 - protein, 9 aa, Homo Sapiens
SELSTRANC

SEQ ID NO: 1026730 - protein, 9 aa, Homo Sapiens
KINRTTRFF

SEQ ID NO: 1026731 - protein, 9 aa, Homo Sapiens
SGNLEVSYS

SEQ ID NO: 1026732 - protein, 9 aa, Homo Sapiens
ATVPDQEKL

SEQ ID NO: 1026733 - protein, 9 aa, Homo Sapiens
TYDCACLSG

SEQ ID NO: 1026734 - protein, 9 aa, Homo Sapiens
INTQIMFWI

SEQ ID NO: 1026735 - protein, 9 aa, Homo Sapiens
KWIQERSLQ

SEQ ID NO: 1026736 - protein, 9 aa, Homo Sapiens
KIDPALFQL

SEQ ID NO: 1026737 - protein, 9 aa, Homo Sapiens
NATSSSEES

SEQ ID NO: 1026738 - protein, 9 aa, Homo Sapiens
PKKACLCAS

SEQ ID NO: 1026739 - protein, 9 aa, Homo Sapiens
DPYSAESSS

SEQ ID NO: 1026740 - protein, 9 aa, Homo Sapiens
LLKILCSDT

SEQ ID NO: 1026741 - protein, 9 aa, Homo Sapiens
KSQDNVHTA

SEQ ID NO: 1026742 - protein, 9 aa, Homo Sapiens
IILFDCLLT

SEQ ID NO: 1026743 - protein, 9 aa, Homo Sapiens
TLELVLEDQ

SEQ ID NO: 1026744 - protein, 9 aa, Homo Sapiens
STNPFSKDF

SEQ ID NO: 1026745 - protein, 9 aa, Homo Sapiens
RLYLRYEFL

SEQ ID NO: 1026746 - protein, 9 aa, Homo Sapiens
VPNSCTSQI

SEQ ID NO: 1026747 - protein, 9 aa, Homo Sapiens
GDMYPRPAR

SEQ ID NO: 1026748 - protein, 9 aa, Homo Sapiens
VPMMYDAGK

SEQ ID NO: 1026749 - protein, 9 aa, Homo Sapiens
VESLFQEAE

SEQ ID NO: 1026750 - protein, 9 aa, Homo Sapiens
KKWKQSVCL

SEQ ID NO: 1026751 - protein, 9 aa, Homo Sapiens
VGFYESDVI

SEQ ID NO: 1026752 - protein, 9 aa, Homo Sapiens
QELRKTFRE

SEQ ID NO: 1026753 - protein, 9 aa, Homo Sapiens
RAVRMLSPF

SEQ ID NO: 1026754 - protein, 9 aa, Homo Sapiens
QVTSQPQTP

SEQ ID NO: 1026755 - protein, 9 aa, Homo Sapiens
TGSGLLPSQ

SEQ ID NO: 1026756 - protein, 9 aa, Homo Sapiens
RKRGFCIQF

SEQ ID NO: 1026757 - protein, 9 aa, Homo Sapiens
EEEPSTFPD

SEQ ID NO: 1026758 - protein, 9 aa, Homo Sapiens
SGQSFGFGQ

SEQ ID NO: 1026759 - protein, 9 aa, Homo Sapiens
QPNFSGGND

SEQ ID NO: 1026760 - protein, 9 aa, Homo Sapiens
IMFWIQEIT

SEQ ID NO: 1026761 - protein, 9 aa, Homo Sapiens
FLGMSIFRR

SEQ ID NO: 1026762 - protein, 9 aa, Homo Sapiens
QTTLKSSQR

SEQ ID NO: 1026763 - protein, 9 aa, Homo Sapiens
GEIVVRLNL

SEQ ID NO: 1026764 - protein, 9 aa, Homo Sapiens
QPQRMHNRK

SEQ ID NO: 1026765 - protein, 9 aa, Homo Sapiens
VHNSEIQVT

SEQ ID NO: 1026766 - protein, 9 aa, Homo Sapiens
WLSDWVTFY

SEQ ID NO: 1026767 - protein, 9 aa, Homo Sapiens
VPGDLSQTF

SEQ ID NO: 1026768 - protein, 9 aa, Homo Sapiens
VYDGVENSY

SEQ ID NO: 1026769 - protein, 9 aa, Homo Sapiens
QGHICGAFL

SEQ ID NO: 1026770 - protein, 9 aa, Homo Sapiens
ARAASYMVY

SEQ ID NO: 1026771 - protein, 9 aa, Homo Sapiens
EVCRRKTKS

SEQ ID NO: 1026772 - protein, 9 aa, Homo Sapiens
LIIGPTKER

SEQ ID NO: 1026773 - protein, 9 aa, Homo Sapiens
CNKFCDREN

SEQ ID NO: 1026774 - protein, 9 aa, Homo Sapiens
AVISDSHLY

SEQ ID NO: 1026775 - protein, 9 aa, Homo Sapiens
FKCSEIPDE

SEQ ID NO: 1026776 - protein, 9 aa, Homo Sapiens
LSVLSSKLS

SEQ ID NO: 1026777 - protein, 9 aa, Homo Sapiens
VRVCACPGK

SEQ ID NO: 1026778 - protein, 9 aa, Homo Sapiens
WMNIIYAAV

SEQ ID NO: 1026779 - protein, 9 aa, Homo Sapiens
VLNGELVRR

SEQ ID NO: 1026780 - protein, 9 aa, Homo Sapiens
SLTPPLDEI

SEQ ID NO: 1026781 - protein, 9 aa, Homo Sapiens
DYKGEKKDR

SEQ ID NO: 1026782 - protein, 9 aa, Homo Sapiens
GLNLTDESD

SEQ ID NO: 1026783 - protein, 9 aa, Homo Sapiens
FCAGYYKGG

SEQ ID NO: 1026784 - protein, 9 aa, Homo Sapiens
ALPRLSLPP

SEQ ID NO: 1026785 - protein, 9 aa, Homo Sapiens
LKFVAHLIN

SEQ ID NO: 1026786 - protein, 9 aa, Homo Sapiens
LAGGFCRAP

SEQ ID NO: 1026787 - protein, 9 aa, Homo Sapiens
KEEYSAMRD

SEQ ID NO: 1026788 - protein, 9 aa, Homo Sapiens
GLCRAFMNL

SEQ ID NO: 1026789 - protein, 9 aa, Homo Sapiens
ILMVRFLVV

SEQ ID NO: 1026790 - protein, 9 aa, Homo Sapiens
VLHIYGLYT

SEQ ID NO: 1026791 - protein, 9 aa, Homo Sapiens
LVFLLDVEH

SEQ ID NO: 1026792 - protein, 9 aa, Homo Sapiens
KLATPDWAE

SEQ ID NO: 1026793 - protein, 9 aa, Homo Sapiens
FPLELDNVL

SEQ ID NO: 1026794 - protein, 9 aa, Homo Sapiens
DISNNGTKL

SEQ ID NO: 1026795 - protein, 9 aa, Homo Sapiens
TLDTKKNLE

SEQ ID NO: 1026796 - protein, 9 aa, Homo Sapiens
PQASPEGCP

SEQ ID NO: 1026797 - protein, 9 aa, Homo Sapiens
RQGEELPPK

SEQ ID NO: 1026798 - protein, 9 aa, Homo Sapiens
SLGFPFSKP

SEQ ID NO: 1026799 - protein, 9 aa, Homo Sapiens
VWRQEKKIR

SEQ ID NO: 1026800 - protein, 9 aa, Homo Sapiens
QTSSGATED

SEQ ID NO: 1026801 - protein, 9 aa, Homo Sapiens
GESSLASSQ

SEQ ID NO: 1026802 - protein, 9 aa, Homo Sapiens
EFVCESVFS

SEQ ID NO: 1026803 - protein, 9 aa, Homo Sapiens
APEGLSTTP

SEQ ID NO: 1026804 - protein, 9 aa, Homo Sapiens
EKDKQKNRK

SEQ ID NO: 1026805 - protein, 9 aa, Homo Sapiens
HLTEEEKNI

SEQ ID NO: 1026806 - protein, 9 aa, Homo Sapiens
LNKNTGEIS

SEQ ID NO: 1026807 - protein, 9 aa, Homo Sapiens
SAGGKSSSE

SEQ ID NO: 1026808 - protein, 9 aa, Homo Sapiens
MEKMTMIMK

SEQ ID NO: 1026809 - protein, 9 aa, Homo Sapiens
KITCVDVNE

SEQ ID NO: 1026810 - protein, 9 aa, Homo Sapiens
KFLELARKI

SEQ ID NO: 1026811 - protein, 9 aa, Homo Sapiens
VKLVQHVCA

SEQ ID NO: 1026812 - protein, 9 aa, Homo Sapiens
AHPRSWLRL

SEQ ID NO: 1026813 - protein, 9 aa, Homo Sapiens
ASSQTPKKG

SEQ ID NO: 1026814 - protein, 9 aa, Homo Sapiens
QLREYQKLM

SEQ ID NO: 1026815 - protein, 9 aa, Homo Sapiens
LQKVFGTCE

SEQ ID NO: 1026816 - protein, 9 aa, Homo Sapiens
GSISLWLQN

SEQ ID NO: 1026817 - protein, 9 aa, Homo Sapiens
FKRNFDNFK

SEQ ID NO: 1026818 - protein, 9 aa, Homo Sapiens
GAQRRRSLS

SEQ ID NO: 1026819 - protein, 9 aa, Homo Sapiens
QFPCCQSSR

SEQ ID NO: 1026820 - protein, 9 aa, Homo Sapiens
EVSSPRCLV

SEQ ID NO: 1026821 - protein, 9 aa, Homo Sapiens
SSFPVSKSL

SEQ ID NO: 1026822 - protein, 9 aa, Homo Sapiens
SKVTDRANN

SEQ ID NO: 1026823 - protein, 9 aa, Homo Sapiens
RDESTGEVL

SEQ ID NO: 1026824 - protein, 9 aa, Homo Sapiens
AYSASWDLP

SEQ ID NO: 1026825 - protein, 9 aa, Homo Sapiens
SPASIKLSA

SEQ ID NO: 1026826 - protein, 9 aa, Homo Sapiens
GFQDAMDSK

SEQ ID NO: 1026827 - protein, 9 aa, Homo Sapiens
SLRQTLQGL

SEQ ID NO: 1026828 - protein, 9 aa, Homo Sapiens
NNIFEEGDE

SEQ ID NO: 1026829 - protein, 9 aa, Homo Sapiens
VADYAFPPP

SEQ ID NO: 1026830 - protein, 9 aa, Homo Sapiens
DNLGVDAAE

SEQ ID NO: 1026831 - protein, 9 aa, Homo Sapiens
GCLRNFLQR

SEQ ID NO: 1026832 - protein, 9 aa, Homo Sapiens
PEGLSTTPA

SEQ ID NO: 1026833 - protein, 9 aa, Homo Sapiens
SQGMVKKEF

SEQ ID NO: 1026834 - protein, 9 aa, Homo Sapiens
TIIPGGLYP

SEQ ID NO: 1026835 - protein, 9 aa, Homo Sapiens
NVDPCTEES

SEQ ID NO: 1026836 - protein, 9 aa, Homo Sapiens
LLQPSYLAK

SEQ ID NO: 1026837 - protein, 9 aa, Homo Sapiens
HKRIYTGEK

SEQ ID NO: 1026838 - protein, 9 aa, Homo Sapiens
EVFPRLETL

SEQ ID NO: 1026839 - protein, 9 aa, Homo Sapiens
AGPPLLSRT

SEQ ID NO: 1026840 - protein, 9 aa, Homo Sapiens
YTSRSSDSD

SEQ ID NO: 1026841 - protein, 9 aa, Homo Sapiens
KVTRNMICA

SEQ ID NO: 1026842 - protein, 9 aa, Homo Sapiens
KESLALALT

SEQ ID NO: 1026843 - protein, 9 aa, Homo Sapiens
KPNVFWMTG

SEQ ID NO: 1026844 - protein, 9 aa, Homo Sapiens
LTKHKIIYT

SEQ ID NO: 1026845 - protein, 9 aa, Homo Sapiens
CNVTKFELS

SEQ ID NO: 1026846 - protein, 9 aa, Homo Sapiens
ELYLSCGYG

SEQ ID NO: 1026847 - protein, 9 aa, Homo Sapiens
PSTGPLVQN

SEQ ID NO: 1026848 - protein, 9 aa, Homo Sapiens
HIESKTAFQ

SEQ ID NO: 1026849 - protein, 9 aa, Homo Sapiens
GKPGISGLQ

SEQ ID NO: 1026850 - protein, 9 aa, Homo Sapiens
ENKSVFETN

SEQ ID NO: 1026851 - protein, 9 aa, Homo Sapiens
WIFEGKPNV

SEQ ID NO: 1026852 - protein, 9 aa, Homo Sapiens
LGYVLDFGK

SEQ ID NO: 1026853 - protein, 9 aa, Homo Sapiens
LQNKEVETS

SEQ ID NO: 1026854 - protein, 9 aa, Homo Sapiens
EGGSVAGCV

SEQ ID NO: 1026855 - protein, 9 aa, Homo Sapiens
EKKLQDVGT

SEQ ID NO: 1026856 - protein, 9 aa, Homo Sapiens
LIQVGRGSA

SEQ ID NO: 1026857 - protein, 9 aa, Homo Sapiens
DVQLTEDQK

SEQ ID NO: 1026858 - protein, 9 aa, Homo Sapiens
SEAEKKEYF

SEQ ID NO: 1026859 - protein, 9 aa, Homo Sapiens
MQPLPKSLA

SEQ ID NO: 1026860 - protein, 9 aa, Homo Sapiens
EDAQIFKVI

SEQ ID NO: 1026861 - protein, 9 aa, Homo Sapiens
RPEELESEG

SEQ ID NO: 1026862 - protein, 9 aa, Homo Sapiens
LSGFEGQNC

SEQ ID NO: 1026863 - protein, 9 aa, Homo Sapiens
ALLLQILTQ

SEQ ID NO: 1026864 - protein, 9 aa, Homo Sapiens
KSVYGLQNN

SEQ ID NO: 1026865 - protein, 9 aa, Homo Sapiens
EAHVGPGFY

SEQ ID NO: 1026866 - protein, 9 aa, Homo Sapiens
TWKEYLEKF

SEQ ID NO: 1026867 - protein, 9 aa, Homo Sapiens
FSDTFPEHV

SEQ ID NO: 1026868 - protein, 9 aa, Homo Sapiens
SHFSAHWRV

SEQ ID NO: 1026869 - protein, 9 aa, Homo Sapiens
VPPSEVNEG

SEQ ID NO: 1026870 - protein, 9 aa, Homo Sapiens
EGGSGSGGG

SEQ ID NO: 1026871 - protein, 9 aa, Homo Sapiens
RVRPQVSLT

SEQ ID NO: 1026872 - protein, 9 aa, Homo Sapiens
RNDFMGAMF

SEQ ID NO: 1026873 - protein, 9 aa, Homo Sapiens
DESTGEVLS

SEQ ID NO: 1026874 - protein, 9 aa, Homo Sapiens
LNAFQEFFI

SEQ ID NO: 1026875 - protein, 9 aa, Homo Sapiens
SSSEKPAWA

SEQ ID NO: 1026876 - protein, 9 aa, Homo Sapiens
QSLNGNSYQ

SEQ ID NO: 1026877 - protein, 9 aa, Homo Sapiens
TSNLNTDFF

SEQ ID NO: 1026878 - protein, 9 aa, Homo Sapiens
IFLGFSSFE

SEQ ID NO: 1026879 - protein, 9 aa, Homo Sapiens
DSLASKTTT

SEQ ID NO: 1026880 - protein, 9 aa, Homo Sapiens
LWKLKKPFS

SEQ ID NO: 1026881 - protein, 9 aa, Homo Sapiens
VKLHENKDS

SEQ ID NO: 1026882 - protein, 9 aa, Homo Sapiens
AEDISEKPK

SEQ ID NO: 1026883 - protein, 9 aa, Homo Sapiens
SRTYTNGES

SEQ ID NO: 1026884 - protein, 9 aa, Homo Sapiens
GSGPPIFQQ

SEQ ID NO: 1026885 - protein, 9 aa, Homo Sapiens
KRDMLRWKL

SEQ ID NO: 1026886 - protein, 9 aa, Homo Sapiens
WPIKKKKSC

SEQ ID NO: 1026887 - protein, 9 aa, Homo Sapiens
GERGKAGPP

SEQ ID NO: 1026888 - protein, 9 aa, Homo Sapiens
YLTELLLKI

SEQ ID NO: 1026889 - protein, 9 aa, Homo Sapiens
SKSSPARNS

SEQ ID NO: 1026890 - protein, 9 aa, Homo Sapiens
LFYANIVHA

SEQ ID NO: 1026891 - protein, 9 aa, Homo Sapiens
VLLGIKVQG

SEQ ID NO: 1026892 - protein, 9 aa, Homo Sapiens
QKGNLGKDS

SEQ ID NO: 1026893 - protein, 9 aa, Homo Sapiens
QPTIPIMGF

SEQ ID NO: 1026894 - protein, 9 aa, Homo Sapiens
QAGPPLLSR

SEQ ID NO: 1026895 - protein, 9 aa, Homo Sapiens
TIKVPMMYD

SEQ ID NO: 1026896 - protein, 9 aa, Homo Sapiens
TSLAVKTKS

SEQ ID NO: 1026897 - protein, 9 aa, Homo Sapiens
VFLSDNSPV

SEQ ID NO: 1026898 - protein, 9 aa, Homo Sapiens
SSSEESTVD

SEQ ID NO: 1026899 - protein, 9 aa, Homo Sapiens
GPGDRARGS

SEQ ID NO: 1026900 - protein, 9 aa, Homo Sapiens
KGPRIKGGA

SEQ ID NO: 1026901 - protein, 9 aa, Homo Sapiens
YYSECQSQP

SEQ ID NO: 1026902 - protein, 9 aa, Homo Sapiens
LQRLLGPML

SEQ ID NO: 1026903 - protein, 9 aa, Homo Sapiens
LNATSSSEE

SEQ ID NO: 1026904 - protein, 9 aa, Homo Sapiens
GSRRNSGSL

SEQ ID NO: 1026905 - protein, 9 aa, Homo Sapiens
GTLAGPVVV

SEQ ID NO: 1026906 - protein, 9 aa, Homo Sapiens
EITEFILLR

SEQ ID NO: 1026907 - protein, 9 aa, Homo Sapiens
DYAFPPPRT

SEQ ID NO: 1026908 - protein, 9 aa, Homo Sapiens
GAAAGVFHH

SEQ ID NO: 1026909 - protein, 9 aa, Homo Sapiens
NFSQALISV

SEQ ID NO: 1026910 - protein, 9 aa, Homo Sapiens
VFLLDVEHL

SEQ ID NO: 1026911 - protein, 9 aa, Homo Sapiens
LSALQTFRV

SEQ ID NO: 1026912 - protein, 9 aa, Homo Sapiens
VLFIGTDNR

SEQ ID NO: 1026913 - protein, 9 aa, Homo Sapiens
DKGRVRLWL

SEQ ID NO: 1026914 - protein, 9 aa, Homo Sapiens
FARLYFPDL

SEQ ID NO: 1026915 - protein, 9 aa, Homo Sapiens
IPDVICLKQ

SEQ ID NO: 1026916 - protein, 9 aa, Homo Sapiens
IMREFFILS

SEQ ID NO: 1026917 - protein, 9 aa, Homo Sapiens
TINSHFLPR

SEQ ID NO: 1026918 - protein, 9 aa, Homo Sapiens
EQLCINCAN

SEQ ID NO: 1026919 - protein, 9 aa, Homo Sapiens
VEGLDDEKE

SEQ ID NO: 1026920 - protein, 9 aa, Homo Sapiens
CPPINVKII

SEQ ID NO: 1026921 - protein, 9 aa, Homo Sapiens
EKYDRHLPI

SEQ ID NO: 1026922 - protein, 9 aa, Homo Sapiens
TKFELSGAM

SEQ ID NO: 1026923 - protein, 9 aa, Homo Sapiens
KPKRLRASE

SEQ ID NO: 1026924 - protein, 9 aa, Homo Sapiens
QEYGSIFTN

SEQ ID NO: 1026925 - protein, 9 aa, Homo Sapiens
NSGSLLVSS

SEQ ID NO: 1026926 - protein, 9 aa, Homo Sapiens
RMGFSSGDH

SEQ ID NO: 1026927 - protein, 9 aa, Homo Sapiens
QADPLDPCM

SEQ ID NO: 1026928 - protein, 9 aa, Homo Sapiens
IITADDDSG

SEQ ID NO: 1026929 - protein, 9 aa, Homo Sapiens
CFLISFLLS

SEQ ID NO: 1026930 - protein, 9 aa, Homo Sapiens
PSQGPVSFP

SEQ ID NO: 1026931 - protein, 9 aa, Homo Sapiens
PFGSRPRNC

SEQ ID NO: 1026932 - protein, 9 aa, Homo Sapiens
LLKKLKGRI

SEQ ID NO: 1026933 - protein, 9 aa, Homo Sapiens
RMKGEPGIP

SEQ ID NO: 1026934 - protein, 9 aa, Homo Sapiens
EILTSIVSA

SEQ ID NO: 1026935 - protein, 9 aa, Homo Sapiens
GGASGAGSS

SEQ ID NO: 1026936 - protein, 9 aa, Homo Sapiens
EVLGAYKLP

SEQ ID NO: 1026937 - protein, 9 aa, Homo Sapiens
LAIQQLENG

SEQ ID NO: 1026938 - protein, 9 aa, Homo Sapiens
YCDFVKLRD

SEQ ID NO: 1026939 - protein, 9 aa, Homo Sapiens
DPTSDSLRL

SEQ ID NO: 1026940 - protein, 9 aa, Homo Sapiens
DPFNVSDRQ

SEQ ID NO: 1026941 - protein, 9 aa, Homo Sapiens
KPTPPDYYS

SEQ ID NO: 1026942 - protein, 9 aa, Homo Sapiens
YSASWDLPS

SEQ ID NO: 1026943 - protein, 9 aa, Homo Sapiens
KLGNLSALQ

SEQ ID NO: 1026944 - protein, 9 aa, Homo Sapiens
ISTLSQSNT

SEQ ID NO: 1026945 - protein, 9 aa, Homo Sapiens
PCKGGTTTP

SEQ ID NO: 1026946 - protein, 9 aa, Homo Sapiens
LSLGSLMKS

SEQ ID NO: 1026947 - protein, 9 aa, Homo Sapiens
GKFLIPDMK

SEQ ID NO: 1026948 - protein, 9 aa, Homo Sapiens
PGKVGLPLD

SEQ ID NO: 1026949 - protein, 9 aa, Homo Sapiens
AVVSRGSTL

SEQ ID NO: 1026950 - protein, 9 aa, Homo Sapiens
TDDGARPVI

SEQ ID NO: 1026951 - protein, 9 aa, Homo Sapiens
TVGREVIFL

SEQ ID NO: 1026952 - protein, 9 aa, Homo Sapiens
EAGFSSSPD

SEQ ID NO: 1026953 - protein, 9 aa, Homo Sapiens
KTTLSSAEP

SEQ ID NO: 1026954 - protein, 9 aa, Homo Sapiens
GKFIKIHFG

SEQ ID NO: 1026955 - protein, 9 aa, Homo Sapiens
GYVLDFGKD

SEQ ID NO: 1026956 - protein, 9 aa, Homo Sapiens
INWSGGWHY

SEQ ID NO: 1026957 - protein, 9 aa, Homo Sapiens
FGFGQHESR

SEQ ID NO: 1026958 - protein, 9 aa, Homo Sapiens
VGSISLWLQ

SEQ ID NO: 1026959 - protein, 9 aa, Homo Sapiens
AAFVTFACS

SEQ ID NO: 1026960 - protein, 9 aa, Homo Sapiens
PKRLRASEL

SEQ ID NO: 1026961 - protein, 9 aa, Homo Sapiens
ERKLLSSGG

SEQ ID NO: 1026962 - protein, 9 aa, Homo Sapiens
QKKIKSFQG

SEQ ID NO: 1026963 - protein, 9 aa, Homo Sapiens
PDFPDDYNS

SEQ ID NO: 1026964 - protein, 9 aa, Homo Sapiens
FSGEVLFRL

SEQ ID NO: 1026965 - protein, 9 aa, Homo Sapiens
WGNPSNYNN

SEQ ID NO: 1026966 - protein, 9 aa, Homo Sapiens
GNLSALQTF

SEQ ID NO: 1026967 - protein, 9 aa, Homo Sapiens
LEFFNLLVD

SEQ ID NO: 1026968 - protein, 9 aa, Homo Sapiens
TRVTSFEGS

SEQ ID NO: 1026969 - protein, 9 aa, Homo Sapiens
TWIFEGKPN

SEQ ID NO: 1026970 - protein, 9 aa, Homo Sapiens
PAKPRSSPR

SEQ ID NO: 1026971 - protein, 9 aa, Homo Sapiens
DKFRAYDWG

SEQ ID NO: 1026972 - protein, 9 aa, Homo Sapiens
RLSDDEELS

SEQ ID NO: 1026973 - protein, 9 aa, Homo Sapiens
PKMNIITAA

SEQ ID NO: 1026974 - protein, 9 aa, Homo Sapiens
IHEKVVERS

SEQ ID NO: 1026975 - protein, 9 aa, Homo Sapiens
PSSLRGGAR

SEQ ID NO: 1026976 - protein, 9 aa, Homo Sapiens
LQFEERNFF

SEQ ID NO: 1026977 - protein, 9 aa, Homo Sapiens
ARVQTKSKL

SEQ ID NO: 1026978 - protein, 9 aa, Homo Sapiens
FRPFGPFMK

SEQ ID NO: 1026979 - protein, 9 aa, Homo Sapiens
TPLLGWNSK

SEQ ID NO: 1026980 - protein, 9 aa, Homo Sapiens
VKKDFLQTF

SEQ ID NO: 1026981 - protein, 9 aa, Homo Sapiens
DRRNQSSVD

SEQ ID NO: 1026982 - protein, 9 aa, Homo Sapiens
LPQALPRLS

SEQ ID NO: 1026983 - protein, 9 aa, Homo Sapiens
VCLLPSKKV

SEQ ID NO: 1026984 - protein, 9 aa, Homo Sapiens
FLGRPGLDG

SEQ ID NO: 1026985 - protein, 9 aa, Homo Sapiens
GNPKKSSPF

SEQ ID NO: 1026986 - protein, 9 aa, Homo Sapiens
GHVFTKGMI

SEQ ID NO: 1026987 - protein, 9 aa, Homo Sapiens
GTAKEVILL

SEQ ID NO: 1026988 - protein, 9 aa, Homo Sapiens
NFVFFGRVY

SEQ ID NO: 1026989 - protein, 9 aa, Homo Sapiens
PSPNKESLA

SEQ ID NO: 1026990 - protein, 9 aa, Homo Sapiens
LEFTVHFLC

SEQ ID NO: 1026991 - protein, 9 aa, Homo Sapiens
KHKIIYTGE

SEQ ID NO: 1026992 - protein, 9 aa, Homo Sapiens
SDTFPEHVT

SEQ ID NO: 1026993 - protein, 9 aa, Homo Sapiens
SPSLCIARF

SEQ ID NO: 1026994 - protein, 9 aa, Homo Sapiens
HRIEEVSEL

SEQ ID NO: 1026995 - protein, 9 aa, Homo Sapiens
RTETKLALK

SEQ ID NO: 1026996 - protein, 9 aa, Homo Sapiens
VEKENEIKP

SEQ ID NO: 1026997 - protein, 9 aa, Homo Sapiens
SDCPSKDKD

SEQ ID NO: 1026998 - protein, 9 aa, Homo Sapiens
DPVIMREFF

SEQ ID NO: 1026999 - protein, 9 aa, Homo Sapiens
LPYRYTDDG

SEQ ID NO: 1027000 - protein, 9 aa, Homo Sapiens
AVPFTALPI

SEQ ID NO: 1027001 - protein, 9 aa, Homo Sapiens
KKAFATCSL

SEQ ID NO: 1027002 - protein, 9 aa, Homo Sapiens
MPFASRVIL

SEQ ID NO: 1027003 - protein, 9 aa, Homo Sapiens
SDRPIKAPV

SEQ ID NO: 1027004 - protein, 9 aa, Homo Sapiens
DGTSAWGNP

SEQ ID NO: 1027005 - protein, 9 aa, Homo Sapiens
KMDADWTGL

SEQ ID NO: 1027006 - protein, 9 aa, Homo Sapiens
KMLGLQIPI

SEQ ID NO: 1027007 - protein, 9 aa, Homo Sapiens
KMVTELCYF

SEQ ID NO: 1027008 - protein, 9 aa, Homo Sapiens
QKKIYNGLN

SEQ ID NO: 1027009 - protein, 9 aa, Homo Sapiens
AGGSKQERS

SEQ ID NO: 1027010 - protein, 9 aa, Homo Sapiens
EQKYWKQLE

SEQ ID NO: 1027011 - protein, 9 aa, Homo Sapiens
VVERSENTA

SEQ ID NO: 1027012 - protein, 9 aa, Homo Sapiens
LGLTLAWNV

SEQ ID NO: 1027013 - protein, 9 aa, Homo Sapiens
CSLLGRARC

SEQ ID NO: 1027014 - protein, 9 aa, Homo Sapiens
SKSTRSLVK

SEQ ID NO: 1027015 - protein, 9 aa, Homo Sapiens
VVLNGELVR

SEQ ID NO: 1027016 - protein, 9 aa, Homo Sapiens
SQAFSYPDV

SEQ ID NO: 1027017 - protein, 9 aa, Homo Sapiens
EVNEGGGSR

SEQ ID NO: 1027018 - protein, 9 aa, Homo Sapiens
LHLFGVTKY

SEQ ID NO: 1027019 - protein, 9 aa, Homo Sapiens
SSFPQSTVP

SEQ ID NO: 1027020 - protein, 9 aa, Homo Sapiens
ERPYKCLRC

SEQ ID NO: 1027021 - protein, 9 aa, Homo Sapiens
FTILPHKFA

SEQ ID NO: 1027022 - protein, 9 aa, Homo Sapiens
RKDNVIWLW

SEQ ID NO: 1027023 - protein, 9 aa, Homo Sapiens
SATVPDQEK

SEQ ID NO: 1027024 - protein, 9 aa, Homo Sapiens
EIEPCLEGE

SEQ ID NO: 1027025 - protein, 9 aa, Homo Sapiens
LDYDLDSTV

SEQ ID NO: 1027026 - protein, 9 aa, Homo Sapiens
QSIRNFQKH

SEQ ID NO: 1027027 - protein, 9 aa, Homo Sapiens
DRLGYRRTN

SEQ ID NO: 1027028 - protein, 9 aa, Homo Sapiens
AVAIIFYDE

SEQ ID NO: 1027029 - protein, 9 aa, Homo Sapiens
GKNRINSSR

SEQ ID NO: 1027030 - protein, 9 aa, Homo Sapiens
SVSQRAAYS

SEQ ID NO: 1027031 - protein, 9 aa, Homo Sapiens
VLLIIIAIY

SEQ ID NO: 1027032 - protein, 9 aa, Homo Sapiens
VEPKKAVSR

SEQ ID NO: 1027033 - protein, 9 aa, Homo Sapiens
GDQPLVVNL

SEQ ID NO: 1027034 - protein, 9 aa, Homo Sapiens
NKEEVFDER

SEQ ID NO: 1027035 - protein, 9 aa, Homo Sapiens
VSQDLFSYC

SEQ ID NO: 1027036 - protein, 9 aa, Homo Sapiens
DYSATFVPG

SEQ ID NO: 1027037 - protein, 9 aa, Homo Sapiens
VIKKVQHIQ

SEQ ID NO: 1027038 - protein, 9 aa, Homo Sapiens
TMRSYETAS

SEQ ID NO: 1027039 - protein, 9 aa, Homo Sapiens
PFNQSSKTF

SEQ ID NO: 1027040 - protein, 9 aa, Homo Sapiens
RDQNKCKEA

SEQ ID NO: 1027041 - protein, 9 aa, Homo Sapiens
ERHIQELET

SEQ ID NO: 1027042 - protein, 9 aa, Homo Sapiens
QAQVTSQPQ

SEQ ID NO: 1027043 - protein, 9 aa, Homo Sapiens
VYGQTGSGK

SEQ ID NO: 1027044 - protein, 9 aa, Homo Sapiens
IKFGQNDAD

SEQ ID NO: 1027045 - protein, 9 aa, Homo Sapiens
KLFDEVFFS

SEQ ID NO: 1027046 - protein, 9 aa, Homo Sapiens
PEADGLPGP

SEQ ID NO: 1027047 - protein, 9 aa, Homo Sapiens
SFLEKSYEL

SEQ ID NO: 1027048 - protein, 9 aa, Homo Sapiens
ITLTKALFP

SEQ ID NO: 1027049 - protein, 9 aa, Homo Sapiens
PSEVNEGGG

SEQ ID NO: 1027050 - protein, 9 aa, Homo Sapiens
THQKIYNGE

SEQ ID NO: 1027051 - protein, 9 aa, Homo Sapiens
PLLKILCSD

SEQ ID NO: 1027052 - protein, 9 aa, Homo Sapiens
EDNIQHLVD

SEQ ID NO: 1027053 - protein, 9 aa, Homo Sapiens
GMGPGWSGP

SEQ ID NO: 1027054 - protein, 9 aa, Homo Sapiens
DFEIKEEEG

SEQ ID NO: 1027055 - protein, 9 aa, Homo Sapiens
RVRLWLQAE

SEQ ID NO: 1027056 - protein, 9 aa, Homo Sapiens
QMEGSVDLL

SEQ ID NO: 1027057 - protein, 9 aa, Homo Sapiens
VWPSLPDYK

SEQ ID NO: 1027058 - protein, 9 aa, Homo Sapiens
CSSSAQCEM

SEQ ID NO: 1027059 - protein, 9 aa, Homo Sapiens
PGAAHKMKS

SEQ ID NO: 1027060 - protein, 9 aa, Homo Sapiens
HKKIYTGEK

SEQ ID NO: 1027061 - protein, 9 aa, Homo Sapiens
LSSVAFGFG

SEQ ID NO: 1027062 - protein, 9 aa, Homo Sapiens
ELFPVEQEK

SEQ ID NO: 1027063 - protein, 9 aa, Homo Sapiens
LVLLANRRR

SEQ ID NO: 1027064 - protein, 9 aa, Homo Sapiens
VSADGAILQ

SEQ ID NO: 1027065 - protein, 9 aa, Homo Sapiens
ELETGRGGD

SEQ ID NO: 1027066 - protein, 9 aa, Homo Sapiens
GPQLASRKD

SEQ ID NO: 1027067 - protein, 9 aa, Homo Sapiens
RMEKMTMIM

SEQ ID NO: 1027068 - protein, 9 aa, Homo Sapiens
WVKFKRNFD

SEQ ID NO: 1027069 - protein, 9 aa, Homo Sapiens
PVQVIRAWV

SEQ ID NO: 1027070 - protein, 9 aa, Homo Sapiens
PEAGEEVFP

SEQ ID NO: 1027071 - protein, 9 aa, Homo Sapiens
QCNNPLPQN

SEQ ID NO: 1027072 - protein, 9 aa, Homo Sapiens
IQTYSWMNL

SEQ ID NO: 1027073 - protein, 9 aa, Homo Sapiens
KNCVCRATF

SEQ ID NO: 1027074 - protein, 9 aa, Homo Sapiens
WSSYSACPL

SEQ ID NO: 1027075 - protein, 9 aa, Homo Sapiens
LRAKFLRLS

SEQ ID NO: 1027076 - protein, 9 aa, Homo Sapiens
IETFKIKNN

SEQ ID NO: 1027077 - protein, 9 aa, Homo Sapiens
LAGVPFYSA

SEQ ID NO: 1027078 - protein, 9 aa, Homo Sapiens
FSQQKEENE

SEQ ID NO: 1027079 - protein, 9 aa, Homo Sapiens
YGGIAPSAT

SEQ ID NO: 1027080 - protein, 9 aa, Homo Sapiens
NKEVETSSA

SEQ ID NO: 1027081 - protein, 9 aa, Homo Sapiens
SFGNKHSYL

SEQ ID NO: 1027082 - protein, 9 aa, Homo Sapiens
LAEVQRKRD

SEQ ID NO: 1027083 - protein, 9 aa, Homo Sapiens
LDYFSPRDV

SEQ ID NO: 1027084 - protein, 9 aa, Homo Sapiens
TFDCGNNIF

SEQ ID NO: 1027085 - protein, 9 aa, Homo Sapiens
HMFSSKNPK

SEQ ID NO: 1027086 - protein, 9 aa, Homo Sapiens
LKKNRNRNI

SEQ ID NO: 1027087 - protein, 9 aa, Homo Sapiens
SSIKIPLNS

SEQ ID NO: 1027088 - protein, 9 aa, Homo Sapiens
AQTCDSSSY

SEQ ID NO: 1027089 - protein, 9 aa, Homo Sapiens
QVENENYCD

SEQ ID NO: 1027090 - protein, 9 aa, Homo Sapiens
SNNGTKLWT

SEQ ID NO: 1027091 - protein, 9 aa, Homo Sapiens
LAGLFSLFQ

SEQ ID NO: 1027092 - protein, 9 aa, Homo Sapiens
LESQRKSRE

SEQ ID NO: 1027093 - protein, 9 aa, Homo Sapiens
WEKEKMRRQ

SEQ ID NO: 1027094 - protein, 9 aa, Homo Sapiens
TEGYEQQRG

SEQ ID NO: 1027095 - protein, 9 aa, Homo Sapiens
ACLCASSAQ

SEQ ID NO: 1027096 - protein, 9 aa, Homo Sapiens
SGDHGLGSA

SEQ ID NO: 1027097 - protein, 9 aa, Homo Sapiens
VALRKIIPT

SEQ ID NO: 1027098 - protein, 9 aa, Homo Sapiens
FTCLSLGSL

SEQ ID NO: 1027099 - protein, 9 aa, Homo Sapiens
PANMENLTE

SEQ ID NO: 1027100 - protein, 9 aa, Homo Sapiens
SLIITADDD

SEQ ID NO: 1027101 - protein, 9 aa, Homo Sapiens
DQLDLIYVA

SEQ ID NO: 1027102 - protein, 9 aa, Homo Sapiens
DYVDVEILT

SEQ ID NO: 1027103 - protein, 9 aa, Homo Sapiens
WKDGCFQSE

SEQ ID NO: 1027104 - protein, 9 aa, Homo Sapiens
EKLQEAQEV

SEQ ID NO: 1027105 - protein, 9 aa, Homo Sapiens
YLLSTQQPL

SEQ ID NO: 1027106 - protein, 9 aa, Homo Sapiens
PFFLTTHTG

SEQ ID NO: 1027107 - protein, 9 aa, Homo Sapiens
LAPPLTKKE

SEQ ID NO: 1027108 - protein, 9 aa, Homo Sapiens
STILLAMTF

SEQ ID NO: 1027109 - protein, 9 aa, Homo Sapiens
LYLSCGYGT

SEQ ID NO: 1027110 - protein, 9 aa, Homo Sapiens
RSRLYRRKR

SEQ ID NO: 1027111 - protein, 9 aa, Homo Sapiens
SVGENMLII

SEQ ID NO: 1027112 - protein, 9 aa, Homo Sapiens
ILPHKFAFL

SEQ ID NO: 1027113 - protein, 9 aa, Homo Sapiens
HENKDSICK

SEQ ID NO: 1027114 - protein, 9 aa, Homo Sapiens
DSSGKEHVL

SEQ ID NO: 1027115 - protein, 9 aa, Homo Sapiens
PLKKKVTRN

SEQ ID NO: 1027116 - protein, 9 aa, Homo Sapiens
FSPAASKYE

SEQ ID NO: 1027117 - protein, 9 aa, Homo Sapiens
MYDAGKFAS

SEQ ID NO: 1027118 - protein, 9 aa, Homo Sapiens
SSDNLSPQP

SEQ ID NO: 1027119 - protein, 9 aa, Homo Sapiens
ESFLDLQNL

SEQ ID NO: 1027120 - protein, 9 aa, Homo Sapiens
NVSYNVDVW

SEQ ID NO: 1027121 - protein, 9 aa, Homo Sapiens
SQSLRVDFF

SEQ ID NO: 1027122 - protein, 9 aa, Homo Sapiens
EAGAFREGW

SEQ ID NO: 1027123 - protein, 9 aa, Homo Sapiens
CARFVCPLN

SEQ ID NO: 1027124 - protein, 9 aa, Homo Sapiens
NFISQWSFF

SEQ ID NO: 1027125 - protein, 9 aa, Homo Sapiens
SAIFFSGDD

SEQ ID NO: 1027126 - protein, 9 aa, Homo Sapiens
KAPPPSLSS

SEQ ID NO: 1027127 - protein, 9 aa, Homo Sapiens
LLLDKIYDT

SEQ ID NO: 1027128 - protein, 9 aa, Homo Sapiens
DGNPKKSSP

SEQ ID NO: 1027129 - protein, 9 aa, Homo Sapiens
PAGLSGTSA

SEQ ID NO: 1027130 - protein, 9 aa, Homo Sapiens
ALDNVDIFS

SEQ ID NO: 1027131 - protein, 9 aa, Homo Sapiens
AWKKPAEDC

SEQ ID NO: 1027132 - protein, 9 aa, Homo Sapiens
DHYNGWIWS

SEQ ID NO: 1027133 - protein, 9 aa, Homo Sapiens
VSQQGMNVA

SEQ ID NO: 1027134 - protein, 9 aa, Homo Sapiens
QTIFRNKPS

SEQ ID NO: 1027135 - protein, 9 aa, Homo Sapiens
RREAEWSRV

SEQ ID NO: 1027136 - protein, 9 aa, Homo Sapiens
HVHAQDGKV

SEQ ID NO: 1027137 - protein, 9 aa, Homo Sapiens
CLAIPEGRV

SEQ ID NO: 1027138 - protein, 9 aa, Homo Sapiens
GMGLKIHFN

SEQ ID NO: 1027139 - protein, 9 aa, Homo Sapiens
PDQLETQTR

SEQ ID NO: 1027140 - protein, 9 aa, Homo Sapiens
WDHDPIGQD

SEQ ID NO: 1027141 - protein, 9 aa, Homo Sapiens
VISVTRSLR

SEQ ID NO: 1027142 - protein, 9 aa, Homo Sapiens
LPRSQLEFT

SEQ ID NO: 1027143 - protein, 9 aa, Homo Sapiens
SSQTPKKGE

SEQ ID NO: 1027144 - protein, 9 aa, Homo Sapiens
YEKNIAPAE

SEQ ID NO: 1027145 - protein, 9 aa, Homo Sapiens
NQLSSSITS

SEQ ID NO: 1027146 - protein, 9 aa, Homo Sapiens
FCILAMVCG

SEQ ID NO: 1027147 - protein, 9 aa, Homo Sapiens
SNVSLEKIR

SEQ ID NO: 1027148 - protein, 9 aa, Homo Sapiens
RMHNRKTHV

SEQ ID NO: 1027149 - protein, 9 aa, Homo Sapiens
AIWTRAVAV

SEQ ID NO: 1027150 - protein, 9 aa, Homo Sapiens
SNTSPYFVQ

SEQ ID NO: 1027151 - protein, 9 aa, Homo Sapiens
PYVVTLPQE

SEQ ID NO: 1027152 - protein, 9 aa, Homo Sapiens
ISQEGKDKV

SEQ ID NO: 1027153 - protein, 9 aa, Homo Sapiens
YSACPLMQN

SEQ ID NO: 1027154 - protein, 9 aa, Homo Sapiens
KPLFYAVDE

SEQ ID NO: 1027155 - protein, 9 aa, Homo Sapiens
QLCILYLSN

SEQ ID NO: 1027156 - protein, 9 aa, Homo Sapiens
LTALKFVAH

SEQ ID NO: 1027157 - protein, 9 aa, Homo Sapiens
ASGKIKEFF

SEQ ID NO: 1027158 - protein, 9 aa, Homo Sapiens
SRSIYAVAM

SEQ ID NO: 1027159 - protein, 9 aa, Homo Sapiens
NEGEEEKEE

SEQ ID NO: 1027160 - protein, 9 aa, Homo Sapiens
RVSQAFSYP

SEQ ID NO: 1027161 - protein, 9 aa, Homo Sapiens
ILTLEECDI

SEQ ID NO: 1027162 - protein, 9 aa, Homo Sapiens
KIIRHKNKA

SEQ ID NO: 1027163 - protein, 9 aa, Homo Sapiens
EEDDDDDNS

SEQ ID NO: 1027164 - protein, 9 aa, Homo Sapiens
NPGFPLSIN

SEQ ID NO: 1027165 - protein, 9 aa, Homo Sapiens
SQKKIKSFQ

SEQ ID NO: 1027166 - protein, 9 aa, Homo Sapiens
EKNKVVVEK

SEQ ID NO: 1027167 - protein, 9 aa, Homo Sapiens
PDAPNKEEV

SEQ ID NO: 1027168 - protein, 9 aa, Homo Sapiens
ELPLFCSLL

SEQ ID NO: 1027169 - protein, 9 aa, Homo Sapiens
NNLLLRKDA

SEQ ID NO: 1027170 - protein, 9 aa, Homo Sapiens
GLYSSYGRE

SEQ ID NO: 1027171 - protein, 9 aa, Homo Sapiens
FTCLMQAMW

SEQ ID NO: 1027172 - protein, 9 aa, Homo Sapiens
VYGLQNNIR

SEQ ID NO: 1027173 - protein, 9 aa, Homo Sapiens
DKNSEADKR

SEQ ID NO: 1027174 - protein, 9 aa, Homo Sapiens
FREKKLQDV

SEQ ID NO: 1027175 - protein, 9 aa, Homo Sapiens
LTYLCAEYG

SEQ ID NO: 1027176 - protein, 9 aa, Homo Sapiens
SGCYISSEN

SEQ ID NO: 1027177 - protein, 9 aa, Homo Sapiens
MNPVSFGNK

SEQ ID NO: 1027178 - protein, 9 aa, Homo Sapiens
RRKRVPEPS

SEQ ID NO: 1027179 - protein, 9 aa, Homo Sapiens
GDLKKLLTQ

SEQ ID NO: 1027180 - protein, 9 aa, Homo Sapiens
SGEVLFRLP

SEQ ID NO: 1027181 - protein, 9 aa, Homo Sapiens
WTGKYCQQP

SEQ ID NO: 1027182 - protein, 9 aa, Homo Sapiens
VDIRTRQLT

SEQ ID NO: 1027183 - protein, 9 aa, Homo Sapiens
SIRAMIKSL

SEQ ID NO: 1027184 - protein, 9 aa, Homo Sapiens
TMTPAPTPT

SEQ ID NO: 1027185 - protein, 9 aa, Homo Sapiens
SEKAQKGNL

SEQ ID NO: 1027186 - protein, 9 aa, Homo Sapiens
DAMDSKLAY

SEQ ID NO: 1027187 - protein, 9 aa, Homo Sapiens
KNTPFQHSH

SEQ ID NO: 1027188 - protein, 9 aa, Homo Sapiens
YILEKYDRH

SEQ ID NO: 1027189 - protein, 9 aa, Homo Sapiens
RAKANPKGF

SEQ ID NO: 1027190 - protein, 9 aa, Homo Sapiens
LKDQEAFFR

SEQ ID NO: 1027191 - protein, 9 aa, Homo Sapiens
NPKPQEWTL

SEQ ID NO: 1027192 - protein, 9 aa, Homo Sapiens
DAGRYFFCM

SEQ ID NO: 1027193 - protein, 9 aa, Homo Sapiens
RKTGPQLAS

SEQ ID NO: 1027194 - protein, 9 aa, Homo Sapiens
YKGGILVIP

SEQ ID NO: 1027195 - protein, 9 aa, Homo Sapiens
EPQQLGTIN

SEQ ID NO: 1027196 - protein, 9 aa, Homo Sapiens
CEVFVEKIP

SEQ ID NO: 1027197 - protein, 9 aa, Homo Sapiens
HVGPGFYQV

SEQ ID NO: 1027198 - protein, 9 aa, Homo Sapiens
GLEDDHELE

SEQ ID NO: 1027199 - protein, 9 aa, Homo Sapiens
HPKITSFVI

SEQ ID NO: 1027200 - protein, 9 aa, Homo Sapiens
SLNGNSYQG

SEQ ID NO: 1027201 - protein, 9 aa, Homo Sapiens
KWVKFKRNF

SEQ ID NO: 1027202 - protein, 9 aa, Homo Sapiens
LLEAKAFSS

SEQ ID NO: 1027203 - protein, 9 aa, Homo Sapiens
QYIDADTND

SEQ ID NO: 1027204 - protein, 9 aa, Homo Sapiens
KYFSLSSVV

SEQ ID NO: 1027205 - protein, 9 aa, Homo Sapiens
LEWFLLNKP

SEQ ID NO: 1027206 - protein, 9 aa, Homo Sapiens
SNYDKQPKD

SEQ ID NO: 1027207 - protein, 9 aa, Homo Sapiens
VFSEPTADV

SEQ ID NO: 1027208 - protein, 9 aa, Homo Sapiens
LFPVEQEKD

SEQ ID NO: 1027209 - protein, 9 aa, Homo Sapiens
LKSSQRSSS

SEQ ID NO: 1027210 - protein, 9 aa, Homo Sapiens
SVPPGPTLL

SEQ ID NO: 1027211 - protein, 9 aa, Homo Sapiens
PGIRHVYPN

SEQ ID NO: 1027212 - protein, 9 aa, Homo Sapiens
KIKEKSEEQ

SEQ ID NO: 1027213 - protein, 9 aa, Homo Sapiens
ATDINRQNK

SEQ ID NO: 1027214 - protein, 9 aa, Homo Sapiens
SAYNHTMET

SEQ ID NO: 1027215 - protein, 9 aa, Homo Sapiens
KDPVIMREF

SEQ ID NO: 1027216 - protein, 9 aa, Homo Sapiens
NGTMECSSS

SEQ ID NO: 1027217 - protein, 9 aa, Homo Sapiens
LQDSLEKVL

SEQ ID NO: 1027218 - protein, 9 aa, Homo Sapiens
KEHWDYLLE

SEQ ID NO: 1027219 - protein, 9 aa, Homo Sapiens
GPEFFTVYH

SEQ ID NO: 1027220 - protein, 9 aa, Homo Sapiens
VGSRGGEEP

SEQ ID NO: 1027221 - protein, 9 aa, Homo Sapiens
NLGVDAAEG

SEQ ID NO: 1027222 - protein, 9 aa, Homo Sapiens
NSYGRRLIQ

SEQ ID NO: 1027223 - protein, 9 aa, Homo Sapiens
FPEHVTPEL

SEQ ID NO: 1027224 - protein, 9 aa, Homo Sapiens
FGQENHKDT

SEQ ID NO: 1027225 - protein, 9 aa, Homo Sapiens
KTWRKVAGY

SEQ ID NO: 1027226 - protein, 9 aa, Homo Sapiens
SRPCDLSGP

SEQ ID NO: 1027227 - protein, 9 aa, Homo Sapiens
SLAGVPFYS

SEQ ID NO: 1027228 - protein, 9 aa, Homo Sapiens
DDVEKNEER

SEQ ID NO: 1027229 - protein, 9 aa, Homo Sapiens
SSIQPSFCH

SEQ ID NO: 1027230 - protein, 9 aa, Homo Sapiens
PRGAEGQSM

SEQ ID NO: 1027231 - protein, 9 aa, Homo Sapiens
TKGMIIAVL

SEQ ID NO: 1027232 - protein, 9 aa, Homo Sapiens
LDTKKNLEG

SEQ ID NO: 1027233 - protein, 9 aa, Homo Sapiens
AAASGYGGI

SEQ ID NO: 1027234 - protein, 9 aa, Homo Sapiens
SGSGPPIFQ

SEQ ID NO: 1027235 - protein, 9 aa, Homo Sapiens
YKKSCHDRN

SEQ ID NO: 1027236 - protein, 9 aa, Homo Sapiens
QPSSGEIIF

SEQ ID NO: 1027237 - protein, 9 aa, Homo Sapiens
RGKAGPPGR

SEQ ID NO: 1027238 - protein, 9 aa, Homo Sapiens
NIKHITAKI

SEQ ID NO: 1027239 - protein, 9 aa, Homo Sapiens
ERILRPLSP

SEQ ID NO: 1027240 - protein, 9 aa, Homo Sapiens
CNLTITWKF

SEQ ID NO: 1027241 - protein, 9 aa, Homo Sapiens
LIEKQLAAI

SEQ ID NO: 1027242 - protein, 9 aa, Homo Sapiens
AYQENPAYL

SEQ ID NO: 1027243 - protein, 9 aa, Homo Sapiens
SHFDGQDFY

SEQ ID NO: 1027244 - protein, 9 aa, Homo Sapiens
GLELLLDKI

SEQ ID NO: 1027245 - protein, 9 aa, Homo Sapiens
KGDGNPKKS

SEQ ID NO: 1027246 - protein, 9 aa, Homo Sapiens
LGGSKRIFI

SEQ ID NO: 1027247 - protein, 9 aa, Homo Sapiens
KLDKFLIIP

SEQ ID NO: 1027248 - protein, 9 aa, Homo Sapiens
IKKSIRKMP

SEQ ID NO: 1027249 - protein, 9 aa, Homo Sapiens
HGLFYYMKQ

SEQ ID NO: 1027250 - protein, 9 aa, Homo Sapiens
VMFKLDKFL

SEQ ID NO: 1027251 - protein, 9 aa, Homo Sapiens
ATKRTCLGG

SEQ ID NO: 1027252 - protein, 9 aa, Homo Sapiens
VGFPISITV

SEQ ID NO: 1027253 - protein, 9 aa, Homo Sapiens
EGKEGRLGI

SEQ ID NO: 1027254 - protein, 9 aa, Homo Sapiens
DDKWCPKKR

SEQ ID NO: 1027255 - protein, 9 aa, Homo Sapiens
GSLEFPGFP

SEQ ID NO: 1027256 - protein, 9 aa, Homo Sapiens
KKLKNQRLK

SEQ ID NO: 1027257 - protein, 9 aa, Homo Sapiens
QPPMFSLLI

SEQ ID NO: 1027258 - protein, 9 aa, Homo Sapiens
QPKDFPQGK

SEQ ID NO: 1027259 - protein, 9 aa, Homo Sapiens
GSVAGCVHG

SEQ ID NO: 1027260 - protein, 9 aa, Homo Sapiens
FSTEESSIN

SEQ ID NO: 1027261 - protein, 9 aa, Homo Sapiens
SFYSDRDTT

SEQ ID NO: 1027262 - protein, 9 aa, Homo Sapiens
VEKKEQKDF

SEQ ID NO: 1027263 - protein, 9 aa, Homo Sapiens
PSLFYHLEV

SEQ ID NO: 1027264 - protein, 9 aa, Homo Sapiens
MSSSEKPAW

SEQ ID NO: 1027265 - protein, 9 aa, Homo Sapiens
VMPFASRVI

SEQ ID NO: 1027266 - protein, 9 aa, Homo Sapiens
VGSEPFYYL

SEQ ID NO: 1027267 - protein, 9 aa, Homo Sapiens
PGHVFTKGM

SEQ ID NO: 1027268 - protein, 9 aa, Homo Sapiens
VLSETQDPE

SEQ ID NO: 1027269 - protein, 9 aa, Homo Sapiens
QCKECGKPF

SEQ ID NO: 1027270 - protein, 9 aa, Homo Sapiens
SHVRFVFSE

SEQ ID NO: 1027271 - protein, 9 aa, Homo Sapiens
YGIRLHLAK

SEQ ID NO: 1027272 - protein, 9 aa, Homo Sapiens
EDSANVEIE

SEQ ID NO: 1027273 - protein, 9 aa, Homo Sapiens
SWDATRAAI

SEQ ID NO: 1027274 - protein, 9 aa, Homo Sapiens
FTKTFQKFG

SEQ ID NO: 1027275 - protein, 9 aa, Homo Sapiens
KTLPRKKMS

SEQ ID NO: 1027276 - protein, 9 aa, Homo Sapiens
LHIYGLYTD

SEQ ID NO: 1027277 - protein, 9 aa, Homo Sapiens
LATHQKIYN

SEQ ID NO: 1027278 - protein, 9 aa, Homo Sapiens
EHREDKVIS

SEQ ID NO: 1027279 - protein, 9 aa, Homo Sapiens
EISSQLEHA

SEQ ID NO: 1027280 - protein, 9 aa, Homo Sapiens
PSEAPELDK

SEQ ID NO: 1027281 - protein, 9 aa, Homo Sapiens
TNPFSKDFY

SEQ ID NO: 1027282 - protein, 9 aa, Homo Sapiens
QEDSAVYFC

SEQ ID NO: 1027283 - protein, 9 aa, Homo Sapiens
SVLSSKLSP

SEQ ID NO: 1027284 - protein, 9 aa, Homo Sapiens
FSHSSPRDS

SEQ ID NO: 1027285 - protein, 9 aa, Homo Sapiens
ERVQPGPGS

SEQ ID NO: 1027286 - protein, 9 aa, Homo Sapiens
QQSASAAET

SEQ ID NO: 1027287 - protein, 9 aa, Homo Sapiens
KWVHFSDTF

SEQ ID NO: 1027288 - protein, 9 aa, Homo Sapiens
AEIDDLNVS

SEQ ID NO: 1027289 - protein, 9 aa, Homo Sapiens
AYLEKLQLD

SEQ ID NO: 1027290 - protein, 9 aa, Homo Sapiens
RIEEVSELP

SEQ ID NO: 1027291 - protein, 9 aa, Homo Sapiens
GGGDAGETP

SEQ ID NO: 1027292 - protein, 9 aa, Homo Sapiens
ALIAMSCEK

SEQ ID NO: 1027293 - protein, 9 aa, Homo Sapiens
PLREGIFCS

SEQ ID NO: 1027294 - protein, 9 aa, Homo Sapiens
EKCRRFVHL

SEQ ID NO: 1027295 - protein, 9 aa, Homo Sapiens
HQKKIDKIN

SEQ ID NO: 1027296 - protein, 9 aa, Homo Sapiens
QELTDYLMK

SEQ ID NO: 1027297 - protein, 9 aa, Homo Sapiens
HIYGLYTDP

SEQ ID NO: 1027298 - protein, 9 aa, Homo Sapiens
AYYLFIIWN

SEQ ID NO: 1027299 - protein, 9 aa, Homo Sapiens
GKWWCEIEP

SEQ ID NO: 1027300 - protein, 9 aa, Homo Sapiens
LNGELVRRD

SEQ ID NO: 1027301 - protein, 9 aa, Homo Sapiens
DDLNVSMET

SEQ ID NO: 1027302 - protein, 9 aa, Homo Sapiens
YAHLSNELH

SEQ ID NO: 1027303 - protein, 9 aa, Homo Sapiens
NPVSFGNKH

SEQ ID NO: 1027304 - protein, 9 aa, Homo Sapiens
GPTKERTLS

SEQ ID NO: 1027305 - protein, 9 aa, Homo Sapiens
NHKDTSRIP

SEQ ID NO: 1027306 - protein, 9 aa, Homo Sapiens
PPRIAGPQG

SEQ ID NO: 1027307 - protein, 9 aa, Homo Sapiens
RRTFFKCSE

SEQ ID NO: 1027308 - protein, 9 aa, Homo Sapiens
IAICHSLRY

SEQ ID NO: 1027309 - protein, 9 aa, Homo Sapiens
KVQKVSSDG

SEQ ID NO: 1027310 - protein, 9 aa, Homo Sapiens
DELMNFGFP

SEQ ID NO: 1027311 - protein, 9 aa, Homo Sapiens
PTEKEPARF

SEQ ID NO: 1027312 - protein, 9 aa, Homo Sapiens
ILDPCRNRA

SEQ ID NO: 1027313 - protein, 9 aa, Homo Sapiens
FETNLDSDV

SEQ ID NO: 1027314 - protein, 9 aa, Homo Sapiens
EESKISQKK

SEQ ID NO: 1027315 - protein, 9 aa, Homo Sapiens
EGATKRTCL

SEQ ID NO: 1027316 - protein, 9 aa, Homo Sapiens
NPFSKDFYG

SEQ ID NO: 1027317 - protein, 9 aa, Homo Sapiens
QETQKLNQT

SEQ ID NO: 1027318 - protein, 9 aa, Homo Sapiens
YGFCTCLGA

SEQ ID NO: 1027319 - protein, 9 aa, Homo Sapiens
YDPSTGPLV

SEQ ID NO: 1027320 - protein, 9 aa, Homo Sapiens
GAAPAKIVI

SEQ ID NO: 1027321 - protein, 9 aa, Homo Sapiens
EDIPDLLHE

SEQ ID NO: 1027322 - protein, 9 aa, Homo Sapiens
KLYRCEIKP

SEQ ID NO: 1027323 - protein, 9 aa, Homo Sapiens
DTNDEGQLL

SEQ ID NO: 1027324 - protein, 9 aa, Homo Sapiens
GGKLSQTCV

SEQ ID NO: 1027325 - protein, 9 aa, Homo Sapiens
RKMTEVLPS

SEQ ID NO: 1027326 - protein, 9 aa, Homo Sapiens
RKPSKRPSP

SEQ ID NO: 1027327 - protein, 9 aa, Homo Sapiens
SLPPLPLSS

SEQ ID NO: 1027328 - protein, 9 aa, Homo Sapiens
GLISFREKK

SEQ ID NO: 1027329 - protein, 9 aa, Homo Sapiens
AQPMQPLPK

SEQ ID NO: 1027330 - protein, 9 aa, Homo Sapiens
PGAFSLGGP

SEQ ID NO: 1027331 - protein, 9 aa, Homo Sapiens
QKPLQPDEL

SEQ ID NO: 1027332 - protein, 9 aa, Homo Sapiens
KSNHMEKGC

SEQ ID NO: 1027333 - protein, 9 aa, Homo Sapiens
MKEEEKSYQ

SEQ ID NO: 1027334 - protein, 9 aa, Homo Sapiens
PLLTVKTIH

SEQ ID NO: 1027335 - protein, 9 aa, Homo Sapiens
CTLRISGTQ

SEQ ID NO: 1027336 - protein, 9 aa, Homo Sapiens
ISSENSDNG

SEQ ID NO: 1027337 - protein, 9 aa, Homo Sapiens
NRVKVDQTQ

SEQ ID NO: 1027338 - protein, 9 aa, Homo Sapiens
LKNSNDVTQ

SEQ ID NO: 1027339 - protein, 9 aa, Homo Sapiens
QKEKEQIKS

SEQ ID NO: 1027340 - protein, 9 aa, Homo Sapiens
ENSYQCKEC

SEQ ID NO: 1027341 - protein, 9 aa, Homo Sapiens
NETKPCNSV

SEQ ID NO: 1027342 - protein, 9 aa, Homo Sapiens
HQPTSVSFL

SEQ ID NO: 1027343 - protein, 9 aa, Homo Sapiens
PRIAGPQGS

SEQ ID NO: 1027344 - protein, 9 aa, Homo Sapiens
TVLSETQDP

SEQ ID NO: 1027345 - protein, 9 aa, Homo Sapiens
GAVLLEQER

SEQ ID NO: 1027346 - protein, 9 aa, Homo Sapiens
ELCYFPAQR

SEQ ID NO: 1027347 - protein, 9 aa, Homo Sapiens
PINADSLSS

SEQ ID NO: 1027348 - protein, 9 aa, Homo Sapiens
VSAGLFPYN

SEQ ID NO: 1027349 - protein, 9 aa, Homo Sapiens
TATAATTFT

SEQ ID NO: 1027350 - protein, 9 aa, Homo Sapiens
VIFGEENKK

SEQ ID NO: 1027351 - protein, 9 aa, Homo Sapiens
WNAASFPNS

SEQ ID NO: 1027352 - protein, 9 aa, Homo Sapiens
GGFCRAPST

SEQ ID NO: 1027353 - protein, 9 aa, Homo Sapiens
ISNNGTKLW

SEQ ID NO: 1027354 - protein, 9 aa, Homo Sapiens
TLRSEASNK

SEQ ID NO: 1027355 - protein, 9 aa, Homo Sapiens
SLDSLDGLN

SEQ ID NO: 1027356 - protein, 9 aa, Homo Sapiens
NVRIKFGQN

SEQ ID NO: 1027357 - protein, 9 aa, Homo Sapiens
SISLWLQNF

SEQ ID NO: 1027358 - protein, 9 aa, Homo Sapiens
MDTDRGGWT

SEQ ID NO: 1027359 - protein, 9 aa, Homo Sapiens
LDDEKEGEH

SEQ ID NO: 1027360 - protein, 9 aa, Homo Sapiens
KAFSSDHYA

SEQ ID NO: 1027361 - protein, 9 aa, Homo Sapiens
DPHPYRRTA

SEQ ID NO: 1027362 - protein, 9 aa, Homo Sapiens
VKGGQPITP

SEQ ID NO: 1027363 - protein, 9 aa, Homo Sapiens
GKKKGGGKG

SEQ ID NO: 1027364 - protein, 9 aa, Homo Sapiens
PSLCWTNGI

SEQ ID NO: 1027365 - protein, 9 aa, Homo Sapiens
APGPLIPSL

SEQ ID NO: 1027366 - protein, 9 aa, Homo Sapiens
EMFREKNVP

SEQ ID NO: 1027367 - protein, 9 aa, Homo Sapiens
PSLLSVPPG

SEQ ID NO: 1027368 - protein, 9 aa, Homo Sapiens
VGDGLSTFA

SEQ ID NO: 1027369 - protein, 9 aa, Homo Sapiens
IKGIEDIYE

SEQ ID NO: 1027370 - protein, 9 aa, Homo Sapiens
ADSSRSIYA

SEQ ID NO: 1027371 - protein, 9 aa, Homo Sapiens
PIIGPTELF

SEQ ID NO: 1027372 - protein, 9 aa, Homo Sapiens
ELHKVHESR

SEQ ID NO: 1027373 - protein, 9 aa, Homo Sapiens
EESTVDVVL

SEQ ID NO: 1027374 - protein, 9 aa, Homo Sapiens
FNPPYVVTL

SEQ ID NO: 1027375 - protein, 9 aa, Homo Sapiens
PITESPELI

SEQ ID NO: 1027376 - protein, 9 aa, Homo Sapiens
IEVKIKKQS

SEQ ID NO: 1027377 - protein, 9 aa, Homo Sapiens
VVVHEVQRY

SEQ ID NO: 1027378 - protein, 9 aa, Homo Sapiens
SCRKVLVWP

SEQ ID NO: 1027379 - protein, 9 aa, Homo Sapiens
LNFPTDKFM

SEQ ID NO: 1027380 - protein, 9 aa, Homo Sapiens
VCCLDFRLH

SEQ ID NO: 1027381 - protein, 9 aa, Homo Sapiens
PGCFLARFA

SEQ ID NO: 1027382 - protein, 9 aa, Homo Sapiens
STGPLVQNA

SEQ ID NO: 1027383 - protein, 9 aa, Homo Sapiens
CREQRLQDS

SEQ ID NO: 1027384 - protein, 9 aa, Homo Sapiens
KSLERKLAT

SEQ ID NO: 1027385 - protein, 9 aa, Homo Sapiens
MINFFSTKT

SEQ ID NO: 1027386 - protein, 9 aa, Homo Sapiens
VKMLGLQIP

SEQ ID NO: 1027387 - protein, 9 aa, Homo Sapiens
QLGTINAKM

SEQ ID NO: 1027388 - protein, 9 aa, Homo Sapiens
DKNPNLEED

SEQ ID NO: 1027389 - protein, 9 aa, Homo Sapiens
IELPEVLSE

SEQ ID NO: 1027390 - protein, 9 aa, Homo Sapiens
AAGVFHHRG

SEQ ID NO: 1027391 - protein, 9 aa, Homo Sapiens
MYLWVLGLI

SEQ ID NO: 1027392 - protein, 9 aa, Homo Sapiens
DNIQHLVDS

SEQ ID NO: 1027393 - protein, 9 aa, Homo Sapiens
TCLSLGSLM

SEQ ID NO: 1027394 - protein, 9 aa, Homo Sapiens
LSSQPSQRI

SEQ ID NO: 1027395 - protein, 9 aa, Homo Sapiens
MKQPPMFSL

SEQ ID NO: 1027396 - protein, 9 aa, Homo Sapiens
FHYDIDGPM

SEQ ID NO: 1027397 - protein, 9 aa, Homo Sapiens
NTCLCPNEF

SEQ ID NO: 1027398 - protein, 9 aa, Homo Sapiens
VVVEKGEFT

SEQ ID NO: 1027399 - protein, 9 aa, Homo Sapiens
HYFSDYLMG

SEQ ID NO: 1027400 - protein, 9 aa, Homo Sapiens
DMSFMLFDP

SEQ ID NO: 1027401 - protein, 9 aa, Homo Sapiens
FGSVARMCA

SEQ ID NO: 1027402 - protein, 9 aa, Homo Sapiens
IYKGGILVI

SEQ ID NO: 1027403 - protein, 9 aa, Homo Sapiens
RYIAICHSL

SEQ ID NO: 1027404 - protein, 9 aa, Homo Sapiens
SPGASDVKL

SEQ ID NO: 1027405 - protein, 9 aa, Homo Sapiens
LAPYIFMDD

SEQ ID NO: 1027406 - protein, 9 aa, Homo Sapiens
VEIKQKFLE

SEQ ID NO: 1027407 - protein, 9 aa, Homo Sapiens
NMFCAGYYK

SEQ ID NO: 1027408 - protein, 9 aa, Homo Sapiens
IYVKIEPSL

SEQ ID NO: 1027409 - protein, 9 aa, Homo Sapiens
GRPGLPEAD

SEQ ID NO: 1027410 - protein, 9 aa, Homo Sapiens
GIFPNSFYE

SEQ ID NO: 1027411 - protein, 9 aa, Homo Sapiens
KSSLIVGSR

SEQ ID NO: 1027412 - protein, 9 aa, Homo Sapiens
NEDCIYKGG

SEQ ID NO: 1027413 - protein, 9 aa, Homo Sapiens
ISEGASTLA

SEQ ID NO: 1027414 - protein, 9 aa, Homo Sapiens
SSLRSTASD

SEQ ID NO: 1027415 - protein, 9 aa, Homo Sapiens
GYFRLGKMC

SEQ ID NO: 1027416 - protein, 9 aa, Homo Sapiens
FNDSIISAC

SEQ ID NO: 1027417 - protein, 9 aa, Homo Sapiens
LTKVDKAEY

SEQ ID NO: 1027418 - protein, 9 aa, Homo Sapiens
VTLPQEVGS

SEQ ID NO: 1027419 - protein, 9 aa, Homo Sapiens
YKEPIEVNL

SEQ ID NO: 1027420 - protein, 9 aa, Homo Sapiens
VAIIFYDET

SEQ ID NO: 1027421 - protein, 9 aa, Homo Sapiens
FDFHTGPKL

SEQ ID NO: 1027422 - protein, 9 aa, Homo Sapiens
WPFTCLSLG

SEQ ID NO: 1027423 - protein, 9 aa, Homo Sapiens
SEEVAGGRK

SEQ ID NO: 1027424 - protein, 9 aa, Homo Sapiens
PSSSRFLLD

SEQ ID NO: 1027425 - protein, 9 aa, Homo Sapiens
SITVDPARG

SEQ ID NO: 1027426 - protein, 9 aa, Homo Sapiens
RKRDMLRWK

SEQ ID NO: 1027427 - protein, 9 aa, Homo Sapiens
FWPIRQARQ

SEQ ID NO: 1027428 - protein, 9 aa, Homo Sapiens
NDVDVALLP

SEQ ID NO: 1027429 - protein, 9 aa, Homo Sapiens
IQSRGSLVK

SEQ ID NO: 1027430 - protein, 9 aa, Homo Sapiens
LEMLAPYIF

SEQ ID NO: 1027431 - protein, 9 aa, Homo Sapiens
GPYSSPSLC

SEQ ID NO: 1027432 - protein, 9 aa, Homo Sapiens
VVTLPQEVG

SEQ ID NO: 1027433 - protein, 9 aa, Homo Sapiens
FIGTDNRIV

SEQ ID NO: 1027434 - protein, 9 aa, Homo Sapiens
LPLLVPNSC

SEQ ID NO: 1027435 - protein, 9 aa, Homo Sapiens
ELESEGMYH

SEQ ID NO: 1027436 - protein, 9 aa, Homo Sapiens
SVGAACPLS

SEQ ID NO: 1027437 - protein, 9 aa, Homo Sapiens
IPWLGYVLD

SEQ ID NO: 1027438 - protein, 9 aa, Homo Sapiens
ECARFVCPL

SEQ ID NO: 1027439 - protein, 9 aa, Homo Sapiens
MLKDQEAFF

SEQ ID NO: 1027440 - protein, 9 aa, Homo Sapiens
LYEEKCSSD

SEQ ID NO: 1027441 - protein, 9 aa, Homo Sapiens
HLRKKHCVF

SEQ ID NO: 1027442 - protein, 9 aa, Homo Sapiens
RQRLINSRT

SEQ ID NO: 1027443 - protein, 9 aa, Homo Sapiens
VCRRKTKSV

SEQ ID NO: 1027444 - protein, 9 aa, Homo Sapiens
SVDETGVDF

SEQ ID NO: 1027445 - protein, 9 aa, Homo Sapiens
HAASYSYDC

SEQ ID NO: 1027446 - protein, 9 aa, Homo Sapiens
DDYNSGDIF

SEQ ID NO: 1027447 - protein, 9 aa, Homo Sapiens
CLLPSKKVI

SEQ ID NO: 1027448 - protein, 9 aa, Homo Sapiens
FFFEKLKNS

SEQ ID NO: 1027449 - protein, 9 aa, Homo Sapiens
LGDRRPVSA

SEQ ID NO: 1027450 - protein, 9 aa, Homo Sapiens
QMLKDQEAF

SEQ ID NO: 1027451 - protein, 9 aa, Homo Sapiens
NLKDNRNHL

SEQ ID NO: 1027452 - protein, 9 aa, Homo Sapiens
QKYWKQLEE

SEQ ID NO: 1027453 - protein, 9 aa, Homo Sapiens
LCCDAGRQV

SEQ ID NO: 1027454 - protein, 9 aa, Homo Sapiens
AIIFYDETS

SEQ ID NO: 1027455 - protein, 9 aa, Homo Sapiens
LKEDSWDAT

SEQ ID NO: 1027456 - protein, 9 aa, Homo Sapiens
EMYGIRLHL

SEQ ID NO: 1027457 - protein, 9 aa, Homo Sapiens
HLEIQNNFD

SEQ ID NO: 1027458 - protein, 9 aa, Homo Sapiens
HTASTASST

SEQ ID NO: 1027459 - protein, 9 aa, Homo Sapiens
RPLSVSVKA

SEQ ID NO: 1027460 - protein, 9 aa, Homo Sapiens
SSPPLPHCG

SEQ ID NO: 1027461 - protein, 9 aa, Homo Sapiens
PVEKENEIK

SEQ ID NO: 1027462 - protein, 9 aa, Homo Sapiens
LLQILTQNT

SEQ ID NO: 1027463 - protein, 9 aa, Homo Sapiens
IFTSGRNCT

SEQ ID NO: 1027464 - protein, 9 aa, Homo Sapiens
CNAAVEKKE

SEQ ID NO: 1027465 - protein, 9 aa, Homo Sapiens
NERILRPLS

SEQ ID NO: 1027466 - protein, 9 aa, Homo Sapiens
AFRKEREKS

SEQ ID NO: 1027467 - protein, 9 aa, Homo Sapiens
GLYERLLIE

SEQ ID NO: 1027468 - protein, 9 aa, Homo Sapiens
PLFYAVDEE

SEQ ID NO: 1027469 - protein, 9 aa, Homo Sapiens
NINPFSSQN

SEQ ID NO: 1027470 - protein, 9 aa, Homo Sapiens
GDEENELVG

SEQ ID NO: 1027471 - protein, 9 aa, Homo Sapiens
LSTTPAAPG

SEQ ID NO: 1027472 - protein, 9 aa, Homo Sapiens
RLSLPPRLL

SEQ ID NO: 1027473 - protein, 9 aa, Homo Sapiens
ITGNNLVKG

SEQ ID NO: 1027474 - protein, 9 aa, Homo Sapiens
VDGYINEDD

SEQ ID NO: 1027475 - protein, 9 aa, Homo Sapiens
RTYTNGESE

SEQ ID NO: 1027476 - protein, 9 aa, Homo Sapiens
ESGLIQTPY

SEQ ID NO: 1027477 - protein, 9 aa, Homo Sapiens
LSSGEVLET

SEQ ID NO: 1027478 - protein, 9 aa, Homo Sapiens
GRHGGLSSQ

SEQ ID NO: 1027479 - protein, 9 aa, Homo Sapiens
FVEMYSEIS

SEQ ID NO: 1027480 - protein, 9 aa, Homo Sapiens
KSWNQARDL

SEQ ID NO: 1027481 - protein, 9 aa, Homo Sapiens
LISFLLSLK

SEQ ID NO: 1027482 - protein, 9 aa, Homo Sapiens
LTEDQKQPA

SEQ ID NO: 1027483 - protein, 9 aa, Homo Sapiens
SQPQTPVQP

SEQ ID NO: 1027484 - protein, 9 aa, Homo Sapiens
NTMKNQKAE

SEQ ID NO: 1027485 - protein, 9 aa, Homo Sapiens
TVKTIHEGT

SEQ ID NO: 1027486 - protein, 9 aa, Homo Sapiens
EPRDSSNQE

SEQ ID NO: 1027487 - protein, 9 aa, Homo Sapiens
AAHKMKSPP

SEQ ID NO: 1027488 - protein, 9 aa, Homo Sapiens
YFFCMEKGS

SEQ ID NO: 1027489 - protein, 9 aa, Homo Sapiens
EEAKTWRKV

SEQ ID NO: 1027490 - protein, 9 aa, Homo Sapiens
RPKDDSNPA

SEQ ID NO: 1027491 - protein, 9 aa, Homo Sapiens
SKRPSPNYL

SEQ ID NO: 1027492 - protein, 9 aa, Homo Sapiens
IGTYDAGID

SEQ ID NO: 1027493 - protein, 9 aa, Homo Sapiens
VVEPKKAVS

SEQ ID NO: 1027494 - protein, 9 aa, Homo Sapiens
QQRISSIKI

SEQ ID NO: 1027495 - protein, 9 aa, Homo Sapiens
TVNIWYSFS

SEQ ID NO: 1027496 - protein, 9 aa, Homo Sapiens
SGSSFPVSK

SEQ ID NO: 1027497 - protein, 9 aa, Homo Sapiens
QRASSSSLL

SEQ ID NO: 1027498 - protein, 9 aa, Homo Sapiens
YSLLEGCFP

SEQ ID NO: 1027499 - protein, 9 aa, Homo Sapiens
QTFYTHQEL

SEQ ID NO: 1027500 - protein, 9 aa, Homo Sapiens
DDYRRKGCV

SEQ ID NO: 1027501 - protein, 9 aa, Homo Sapiens
YRPVGSISL

SEQ ID NO: 1027502 - protein, 9 aa, Homo Sapiens
LCLGQHGPL

SEQ ID NO: 1027503 - protein, 9 aa, Homo Sapiens
ARGSLTPPL

SEQ ID NO: 1027504 - protein, 9 aa, Homo Sapiens
TTMTPAPTP

SEQ ID NO: 1027505 - protein, 9 aa, Homo Sapiens
IFENDPFWN

SEQ ID NO: 1027506 - protein, 9 aa, Homo Sapiens
AGQELTDYL

SEQ ID NO: 1027507 - protein, 9 aa, Homo Sapiens
KLRLRIDLR

SEQ ID NO: 1027508 - protein, 9 aa, Homo Sapiens
SAAKHKFSG

SEQ ID NO: 1027509 - protein, 9 aa, Homo Sapiens
IYVRPVLNF

SEQ ID NO: 1027510 - protein, 9 aa, Homo Sapiens
SCTHRFHRK

SEQ ID NO: 1027511 - protein, 9 aa, Homo Sapiens
VPFTALPIP

SEQ ID NO: 1027512 - protein, 9 aa, Homo Sapiens
EVQRKGGVW

SEQ ID NO: 1027513 - protein, 9 aa, Homo Sapiens
IICVTTVPG

SEQ ID NO: 1027514 - protein, 9 aa, Homo Sapiens
SSKNPKPQE

SEQ ID NO: 1027515 - protein, 9 aa, Homo Sapiens
ASWDLPSTP

SEQ ID NO: 1027516 - protein, 9 aa, Homo Sapiens
WSGGWHYAK

SEQ ID NO: 1027517 - protein, 9 aa, Homo Sapiens
RVKGGQPIT

SEQ ID NO: 1027518 - protein, 9 aa, Homo Sapiens
KGGAGADEE

SEQ ID NO: 1027519 - protein, 9 aa, Homo Sapiens
PGLNLHIST

SEQ ID NO: 1027520 - protein, 9 aa, Homo Sapiens
PLIPSLSVE

SEQ ID NO: 1027521 - protein, 9 aa, Homo Sapiens
LKINRTTRF

SEQ ID NO: 1027522 - protein, 9 aa, Homo Sapiens
QTVFAMQLP

SEQ ID NO: 1027523 - protein, 9 aa, Homo Sapiens
SSGSCRKVL

SEQ ID NO: 1027524 - protein, 9 aa, Homo Sapiens
SFGDPAVSA

SEQ ID NO: 1027525 - protein, 9 aa, Homo Sapiens
PCELGLKNE

SEQ ID NO: 1027526 - protein, 9 aa, Homo Sapiens
KIDPQFQVV

SEQ ID NO: 1027527 - protein, 9 aa, Homo Sapiens
KTQEKEETA

SEQ ID NO: 1027528 - protein, 9 aa, Homo Sapiens
GHKEQGPKH

SEQ ID NO: 1027529 - protein, 9 aa, Homo Sapiens
FLRVALSNE

SEQ ID NO: 1027530 - protein, 9 aa, Homo Sapiens
GIRHVYPNG

SEQ ID NO: 1027531 - protein, 9 aa, Homo Sapiens
DAGIDIWGG

SEQ ID NO: 1027532 - protein, 9 aa, Homo Sapiens
RPFDSFFLD

SEQ ID NO: 1027533 - protein, 9 aa, Homo Sapiens
ATDEQQKSD

SEQ ID NO: 1027534 - protein, 9 aa, Homo Sapiens
SSQRPWTLL

SEQ ID NO: 1027535 - protein, 9 aa, Homo Sapiens
NFGSVARMC

SEQ ID NO: 1027536 - protein, 9 aa, Homo Sapiens
SRKVESLFQ

SEQ ID NO: 1027537 - protein, 9 aa, Homo Sapiens
CPVYVRDPT

SEQ ID NO: 1027538 - protein, 9 aa, Homo Sapiens
IKGGAAGRR

SEQ ID NO: 1027539 - protein, 9 aa, Homo Sapiens
PEINKGGNR

SEQ ID NO: 1027540 - protein, 9 aa, Homo Sapiens
STVERFYSR

SEQ ID NO: 1027541 - protein, 9 aa, Homo Sapiens
EVGILLEQS

SEQ ID NO: 1027542 - protein, 9 aa, Homo Sapiens
KKPKQEFIS

SEQ ID NO: 1027543 - protein, 9 aa, Homo Sapiens
DRGFPRACY

SEQ ID NO: 1027544 - protein, 9 aa, Homo Sapiens
YIWGEYGCS

SEQ ID NO: 1027545 - protein, 9 aa, Homo Sapiens
GHMFSSKNP

SEQ ID NO: 1027546 - protein, 9 aa, Homo Sapiens
SSVVAGEFQ

SEQ ID NO: 1027547 - protein, 9 aa, Homo Sapiens
ITVIESGLL

SEQ ID NO: 1027548 - protein, 9 aa, Homo Sapiens
VRPVLNFPT

SEQ ID NO: 1027549 - protein, 9 aa, Homo Sapiens
VGECKDQKK

SEQ ID NO: 1027550 - protein, 9 aa, Homo Sapiens
FVIPAFHSN

SEQ ID NO: 1027551 - protein, 9 aa, Homo Sapiens
KTGEEQGLI

SEQ ID NO: 1027552 - protein, 9 aa, Homo Sapiens
ICRISDRTN

SEQ ID NO: 1027553 - protein, 9 aa, Homo Sapiens
HENERILRP

SEQ ID NO: 1027554 - protein, 9 aa, Homo Sapiens
VYPEKNVMM

SEQ ID NO: 1027555 - protein, 9 aa, Homo Sapiens
GWSLSIRAM

SEQ ID NO: 1027556 - protein, 9 aa, Homo Sapiens
HLLYFFYNV

SEQ ID NO: 1027557 - protein, 9 aa, Homo Sapiens
SAIPSEVQR

SEQ ID NO: 1027558 - protein, 9 aa, Homo Sapiens
ASCIDISNN

SEQ ID NO: 1027559 - protein, 9 aa, Homo Sapiens
ESGKKKLSE

SEQ ID NO: 1027560 - protein, 9 aa, Homo Sapiens
YNGERPFVC

SEQ ID NO: 1027561 - protein, 9 aa, Homo Sapiens
SDCSRDSRG

SEQ ID NO: 1027562 - protein, 9 aa, Homo Sapiens
ATISDTNNA

SEQ ID NO: 1027563 - protein, 9 aa, Homo Sapiens
IFIYVRPVL

SEQ ID NO: 1027564 - protein, 9 aa, Homo Sapiens
VVRTTTRYA

SEQ ID NO: 1027565 - protein, 9 aa, Homo Sapiens
LTEIRSIKE

SEQ ID NO: 1027566 - protein, 9 aa, Homo Sapiens
WNKKPRWFR

SEQ ID NO: 1027567 - protein, 9 aa, Homo Sapiens
QLDKLRQSC

SEQ ID NO: 1027568 - protein, 9 aa, Homo Sapiens
TYGHNGIHG

SEQ ID NO: 1027569 - protein, 9 aa, Homo Sapiens
KRTTPNGHI

SEQ ID NO: 1027570 - protein, 9 aa, Homo Sapiens
PSLLGSYSP

SEQ ID NO: 1027571 - protein, 9 aa, Homo Sapiens
LPEPGAPAQ

SEQ ID NO: 1027572 - protein, 9 aa, Homo Sapiens
SSIDKNLSE

SEQ ID NO: 1027573 - protein, 9 aa, Homo Sapiens
EPAPSPKGH

SEQ ID NO: 1027574 - protein, 9 aa, Homo Sapiens
RLGKMCLGE

SEQ ID NO: 1027575 - protein, 9 aa, Homo Sapiens
PSAFVDVYR

SEQ ID NO: 1027576 - protein, 9 aa, Homo Sapiens
RPGGGDAGE

SEQ ID NO: 1027577 - protein, 9 aa, Homo Sapiens
LNKTTWQRE

SEQ ID NO: 1027578 - protein, 9 aa, Homo Sapiens
RGLRYWLYA

SEQ ID NO: 1027579 - protein, 9 aa, Homo Sapiens
QKDDLQCFY

SEQ ID NO: 1027580 - protein, 9 aa, Homo Sapiens
LQSCGVPEG

SEQ ID NO: 1027581 - protein, 9 aa, Homo Sapiens
LREREVGIL

SEQ ID NO: 1027582 - protein, 9 aa, Homo Sapiens
LEAGAFREG

SEQ ID NO: 1027583 - protein, 9 aa, Homo Sapiens
PLLGGPFFL

SEQ ID NO: 1027584 - protein, 9 aa, Homo Sapiens
DVTFLSHLA

SEQ ID NO: 1027585 - protein, 9 aa, Homo Sapiens
SIILNNELL

SEQ ID NO: 1027586 - protein, 9 aa, Homo Sapiens
LSSLRPELF

SEQ ID NO: 1027587 - protein, 9 aa, Homo Sapiens
LLKKKCKAT

SEQ ID NO: 1027588 - protein, 9 aa, Homo Sapiens
DASFSPLKS

SEQ ID NO: 1027589 - protein, 9 aa, Homo Sapiens
TFLSHLAIG

SEQ ID NO: 1027590 - protein, 9 aa, Homo Sapiens
KPCNSVLRM

SEQ ID NO: 1027591 - protein, 9 aa, Homo Sapiens
RVWKYLFNY

SEQ ID NO: 1027592 - protein, 9 aa, Homo Sapiens
QTSGNLEVS

SEQ ID NO: 1027593 - protein, 9 aa, Homo Sapiens
QKRITTLYM

SEQ ID NO: 1027594 - protein, 9 aa, Homo Sapiens
NLNEDDARS

SEQ ID NO: 1027595 - protein, 9 aa, Homo Sapiens
RQEKKIREQ

SEQ ID NO: 1027596 - protein, 9 aa, Homo Sapiens
SSSRKSPLS

SEQ ID NO: 1027597 - protein, 9 aa, Homo Sapiens
SPSRSGTAQ

SEQ ID NO: 1027598 - protein, 9 aa, Homo Sapiens
LFQAQYEDD

SEQ ID NO: 1027599 - protein, 9 aa, Homo Sapiens
LQWKYPYTS

SEQ ID NO: 1027600 - protein, 9 aa, Homo Sapiens
SRSASFVLP

SEQ ID NO: 1027601 - protein, 9 aa, Homo Sapiens
RCPRGSQAP

SEQ ID NO: 1027602 - protein, 9 aa, Homo Sapiens
ADFDFHTGP

SEQ ID NO: 1027603 - protein, 9 aa, Homo Sapiens
LTIIILYAF

SEQ ID NO: 1027604 - protein, 9 aa, Homo Sapiens
TTLKSSQRS

SEQ ID NO: 1027605 - protein, 9 aa, Homo Sapiens
IPPLDWRPE

SEQ ID NO: 1027606 - protein, 9 aa, Homo Sapiens
IIKIEDENN

SEQ ID NO: 1027607 - protein, 9 aa, Homo Sapiens
VVLALAESE

SEQ ID NO: 1027608 - protein, 9 aa, Homo Sapiens
SLSSPSRLP

SEQ ID NO: 1027609 - protein, 9 aa, Homo Sapiens
TITWKFFNI

SEQ ID NO: 1027610 - protein, 9 aa, Homo Sapiens
KYCQQPICL

SEQ ID NO: 1027611 - protein, 9 aa, Homo Sapiens
KIVIQPEPV

SEQ ID NO: 1027612 - protein, 9 aa, Homo Sapiens
IYNFVFFGR

SEQ ID NO: 1027613 - protein, 9 aa, Homo Sapiens
NEIVELKSQ

SEQ ID NO: 1027614 - protein, 9 aa, Homo Sapiens
AAGLLGEGC

SEQ ID NO: 1027615 - protein, 9 aa, Homo Sapiens
KYWKQLEEI

SEQ ID NO: 1027616 - protein, 9 aa, Homo Sapiens
YWLYHYRKT

SEQ ID NO: 1027617 - protein, 9 aa, Homo Sapiens
RCRGFPRGP

SEQ ID NO: 1027618 - protein, 9 aa, Homo Sapiens
PPQFPKSIF

SEQ ID NO: 1027619 - protein, 9 aa, Homo Sapiens
SVTASHNLE

SEQ ID NO: 1027620 - protein, 9 aa, Homo Sapiens
IKPANMENL

SEQ ID NO: 1027621 - protein, 9 aa, Homo Sapiens
KEGHMRWGE

SEQ ID NO: 1027622 - protein, 9 aa, Homo Sapiens
LRCGKAFAD

SEQ ID NO: 1027623 - protein, 9 aa, Homo Sapiens
ITRERSRKG

SEQ ID NO: 1027624 - protein, 9 aa, Homo Sapiens
EVPREEAGI

SEQ ID NO: 1027625 - protein, 9 aa, Homo Sapiens
PPDYYSECQ

SEQ ID NO: 1027626 - protein, 9 aa, Homo Sapiens
KFLIPDMKE

SEQ ID NO: 1027627 - protein, 9 aa, Homo Sapiens
PDYKKTLEH

SEQ ID NO: 1027628 - protein, 9 aa, Homo Sapiens
SRFLLDFRR

SEQ ID NO: 1027629 - protein, 9 aa, Homo Sapiens
KVIKKVQHI

SEQ ID NO: 1027630 - protein, 9 aa, Homo Sapiens
FHTGPKLLE

SEQ ID NO: 1027631 - protein, 9 aa, Homo Sapiens
NNSMEQGEN

SEQ ID NO: 1027632 - protein, 9 aa, Homo Sapiens
GWHYAKKDE

SEQ ID NO: 1027633 - protein, 9 aa, Homo Sapiens
MPSLGREIL

SEQ ID NO: 1027634 - protein, 9 aa, Homo Sapiens
ISAYQENPA

SEQ ID NO: 1027635 - protein, 9 aa, Homo Sapiens
YGQGSKACT

SEQ ID NO: 1027636 - protein, 9 aa, Homo Sapiens
RILEFNSKL

SEQ ID NO: 1027637 - protein, 9 aa, Homo Sapiens
ENFYKFEEM

SEQ ID NO: 1027638 - protein, 9 aa, Homo Sapiens
NVAWAPSIG

SEQ ID NO: 1027639 - protein, 9 aa, Homo Sapiens
YKRRAFRKE

SEQ ID NO: 1027640 - protein, 9 aa, Homo Sapiens
SPRSERQPR

SEQ ID NO: 1027641 - protein, 9 aa, Homo Sapiens
DAGETPGET

SEQ ID NO: 1027642 - protein, 9 aa, Homo Sapiens
AMSHRNKET

SEQ ID NO: 1027643 - protein, 9 aa, Homo Sapiens
NAFQEFFIL

SEQ ID NO: 1027644 - protein, 9 aa, Homo Sapiens
FISHQPTSV

SEQ ID NO: 1027645 - protein, 9 aa, Homo Sapiens
ILKRCPNRV

SEQ ID NO: 1027646 - protein, 9 aa, Homo Sapiens
LYLRYEFLM

SEQ ID NO: 1027647 - protein, 9 aa, Homo Sapiens
MHNDATLYT

SEQ ID NO: 1027648 - protein, 9 aa, Homo Sapiens
KCEMLELLP

SEQ ID NO: 1027649 - protein, 9 aa, Homo Sapiens
KKSQAIASN

SEQ ID NO: 1027650 - protein, 9 aa, Homo Sapiens
LACFCKDKH

SEQ ID NO: 1027651 - protein, 9 aa, Homo Sapiens
LNKSAFTFQ

SEQ ID NO: 1027652 - protein, 9 aa, Homo Sapiens
WRGYRVWKY

SEQ ID NO: 1027653 - protein, 9 aa, Homo Sapiens
FMHSSSLTN

SEQ ID NO: 1027654 - protein, 9 aa, Homo Sapiens
KKACLCASS

SEQ ID NO: 1027655 - protein, 9 aa, Homo Sapiens
LQTSCINSF

SEQ ID NO: 1027656 - protein, 9 aa, Homo Sapiens
IKGPFYGED

SEQ ID NO: 1027657 - protein, 9 aa, Homo Sapiens
YYSKCLSDE

SEQ ID NO: 1027658 - protein, 9 aa, Homo Sapiens
EFFILCFGI

SEQ ID NO: 1027659 - protein, 9 aa, Homo Sapiens
VLRAPTLPD

SEQ ID NO: 1027660 - protein, 9 aa, Homo Sapiens
LSLPPRLLR

SEQ ID NO: 1027661 - protein, 9 aa, Homo Sapiens
WLGPKAWHK

SEQ ID NO: 1027662 - protein, 9 aa, Homo Sapiens
TLLSLVLVG

SEQ ID NO: 1027663 - protein, 9 aa, Homo Sapiens
CDIDEIEEM

SEQ ID NO: 1027664 - protein, 9 aa, Homo Sapiens
EPQTLVILK

SEQ ID NO: 1027665 - protein, 9 aa, Homo Sapiens
TFDRYVAIC

SEQ ID NO: 1027666 - protein, 9 aa, Homo Sapiens
SLQDRLNVI

SEQ ID NO: 1027667 - protein, 9 aa, Homo Sapiens
LRIEVKIKK

SEQ ID NO: 1027668 - protein, 9 aa, Homo Sapiens
VCKACGCNL

SEQ ID NO: 1027669 - protein, 9 aa, Homo Sapiens
ELTMRSYET

SEQ ID NO: 1027670 - protein, 9 aa, Homo Sapiens
KEEDDDKWC

SEQ ID NO: 1027671 - protein, 9 aa, Homo Sapiens
SCLPSPPEI

SEQ ID NO: 1027672 - protein, 9 aa, Homo Sapiens
YTPFGSRPR

SEQ ID NO: 1027673 - protein, 9 aa, Homo Sapiens
PQIQYFFSF

SEQ ID NO: 1027674 - protein, 9 aa, Homo Sapiens
EKSWNQARD

SEQ ID NO: 1027675 - protein, 9 aa, Homo Sapiens
RRRRVRPQV

SEQ ID NO: 1027676 - protein, 9 aa, Homo Sapiens
NIIYAAVDS

SEQ ID NO: 1027677 - protein, 9 aa, Homo Sapiens
KVLLSKEEP

SEQ ID NO: 1027678 - protein, 9 aa, Homo Sapiens
KKGEVQDSE

SEQ ID NO: 1027679 - protein, 9 aa, Homo Sapiens
RTKTLRERI

SEQ ID NO: 1027680 - protein, 9 aa, Homo Sapiens
AGRLQYFLQ

SEQ ID NO: 1027681 - protein, 9 aa, Homo Sapiens
KLGRKDVGR

SEQ ID NO: 1027682 - protein, 9 aa, Homo Sapiens
LGFSEAEKK

SEQ ID NO: 1027683 - protein, 9 aa, Homo Sapiens
LLETFYATK

SEQ ID NO: 1027684 - protein, 9 aa, Homo Sapiens
SAHFAGLLL

SEQ ID NO: 1027685 - protein, 9 aa, Homo Sapiens
PGDRARGSL

SEQ ID NO: 1027686 - protein, 9 aa, Homo Sapiens
RKTKRKKME

SEQ ID NO: 1027687 - protein, 9 aa, Homo Sapiens
PNAISFLLV

SEQ ID NO: 1027688 - protein, 9 aa, Homo Sapiens
VVPGCFLAR

SEQ ID NO: 1027689 - protein, 9 aa, Homo Sapiens
VTFDCGNNI

SEQ ID NO: 1027690 - protein, 9 aa, Homo Sapiens
CFLARFALS

SEQ ID NO: 1027691 - protein, 9 aa, Homo Sapiens
AEWSRVATV

SEQ ID NO: 1027692 - protein, 9 aa, Homo Sapiens
KEIQAVDTQ

SEQ ID NO: 1027693 - protein, 9 aa, Homo Sapiens
DEENELVGS

SEQ ID NO: 1027694 - protein, 9 aa, Homo Sapiens
PGWSGPYGV

SEQ ID NO: 1027695 - protein, 9 aa, Homo Sapiens
GFITYRFGS

SEQ ID NO: 1027696 - protein, 9 aa, Homo Sapiens
GETPGETVR

SEQ ID NO: 1027697 - protein, 9 aa, Homo Sapiens
GIPVQPVYL

SEQ ID NO: 1027698 - protein, 9 aa, Homo Sapiens
ISQKKIKSF

SEQ ID NO: 1027699 - protein, 9 aa, Homo Sapiens
YLCLPRSQL

SEQ ID NO: 1027700 - protein, 9 aa, Homo Sapiens
SRPTKEIQA

SEQ ID NO: 1027701 - protein, 9 aa, Homo Sapiens
EEEKEEEDE

SEQ ID NO: 1027702 - protein, 9 aa, Homo Sapiens
LSRALEVSS

SEQ ID NO: 1027703 - protein, 9 aa, Homo Sapiens
KKPHYIPKP

SEQ ID NO: 1027704 - protein, 9 aa, Homo Sapiens
AQCVKQKEK

SEQ ID NO: 1027705 - protein, 9 aa, Homo Sapiens
VDVEILTSI

SEQ ID NO: 1027706 - protein, 9 aa, Homo Sapiens
SEPWLWPPT

SEQ ID NO: 1027707 - protein, 9 aa, Homo Sapiens
ILPPRRPPG

SEQ ID NO: 1027708 - protein, 9 aa, Homo Sapiens
GILEAGAFR

SEQ ID NO: 1027709 - protein, 9 aa, Homo Sapiens
IKIDPQFQV

SEQ ID NO: 1027710 - protein, 9 aa, Homo Sapiens
SPGWSLSIR

SEQ ID NO: 1027711 - protein, 9 aa, Homo Sapiens
LVTGQPSQD

SEQ ID NO: 1027712 - protein, 9 aa, Homo Sapiens
ISEKPKKPK

SEQ ID NO: 1027713 - protein, 9 aa, Homo Sapiens
WTSVFNDSI

SEQ ID NO: 1027714 - protein, 9 aa, Homo Sapiens
DPDFEIKEE

SEQ ID NO: 1027715 - protein, 9 aa, Homo Sapiens
PKKAPPPAF

SEQ ID NO: 1027716 - protein, 9 aa, Homo Sapiens
ICVSFAFYQ

SEQ ID NO: 1027717 - protein, 9 aa, Homo Sapiens
VGLLSLQEK

SEQ ID NO: 1027718 - protein, 9 aa, Homo Sapiens
CCSFIGKDL

SEQ ID NO: 1027719 - protein, 9 aa, Homo Sapiens
FVHKENSFT

SEQ ID NO: 1027720 - protein, 9 aa, Homo Sapiens
DGKVMEYTT

SEQ ID NO: 1027721 - protein, 9 aa, Homo Sapiens
CLMQAMWKC

SEQ ID NO: 1027722 - protein, 9 aa, Homo Sapiens
AGVFHHRGC

SEQ ID NO: 1027723 - protein, 9 aa, Homo Sapiens
NHTENNACF

SEQ ID NO: 1027724 - protein, 9 aa, Homo Sapiens
CEVHRFDSS

SEQ ID NO: 1027725 - protein, 9 aa, Homo Sapiens
TCLCPNEFF

SEQ ID NO: 1027726 - protein, 9 aa, Homo Sapiens
GDRRPVSAG

SEQ ID NO: 1027727 - protein, 9 aa, Homo Sapiens
RKARSPLLP

SEQ ID NO: 1027728 - protein, 9 aa, Homo Sapiens
LLPSQLLDQ

SEQ ID NO: 1027729 - protein, 9 aa, Homo Sapiens
IKQKFLELA

SEQ ID NO: 1027730 - protein, 9 aa, Homo Sapiens
DFKNDVQRS

SEQ ID NO: 1027731 - protein, 9 aa, Homo Sapiens
SSSTSWHLQ

SEQ ID NO: 1027732 - protein, 9 aa, Homo Sapiens
EARLEVGLE

SEQ ID NO: 1027733 - protein, 9 aa, Homo Sapiens
GKQVVCLMA

SEQ ID NO: 1027734 - protein, 9 aa, Homo Sapiens
VLPGAFSLG

SEQ ID NO: 1027735 - protein, 9 aa, Homo Sapiens
AWTIPSLTS

SEQ ID NO: 1027736 - protein, 9 aa, Homo Sapiens
GFPRGPVRP

SEQ ID NO: 1027737 - protein, 9 aa, Homo Sapiens
QASGNLRPS

SEQ ID NO: 1027738 - protein, 9 aa, Homo Sapiens
SPPLSSPGP

SEQ ID NO: 1027739 - protein, 9 aa, Homo Sapiens
VSLGFPFSK

SEQ ID NO: 1027740 - protein, 9 aa, Homo Sapiens
LPGEEFPGP

SEQ ID NO: 1027741 - protein, 9 aa, Homo Sapiens
HSAKNTPFQ

SEQ ID NO: 1027742 - protein, 9 aa, Homo Sapiens
TDPTSDSLR

SEQ ID NO: 1027743 - protein, 9 aa, Homo Sapiens
TLLEHKEKS

SEQ ID NO: 1027744 - protein, 9 aa, Homo Sapiens
NKDILFSRE

SEQ ID NO: 1027745 - protein, 9 aa, Homo Sapiens
FTKLARASV

SEQ ID NO: 1027746 - protein, 9 aa, Homo Sapiens
IGQDFVGQR

SEQ ID NO: 1027747 - protein, 9 aa, Homo Sapiens
EVERSKPVA

SEQ ID NO: 1027748 - protein, 9 aa, Homo Sapiens
RLPPEGEAG

SEQ ID NO: 1027749 - protein, 9 aa, Homo Sapiens
AKVSEVPRE

SEQ ID NO: 1027750 - protein, 9 aa, Homo Sapiens
YGRKNFFIT

SEQ ID NO: 1027751 - protein, 9 aa, Homo Sapiens
VARMKGEPG

SEQ ID NO: 1027752 - protein, 9 aa, Homo Sapiens
TGNNLVKGS

SEQ ID NO: 1027753 - protein, 9 aa, Homo Sapiens
IEEMPTTSH

SEQ ID NO: 1027754 - protein, 9 aa, Homo Sapiens
AHSDWVRNV

SEQ ID NO: 1027755 - protein, 9 aa, Homo Sapiens
GVKKFMHSS

SEQ ID NO: 1027756 - protein, 9 aa, Homo Sapiens
GDCPPEATE

SEQ ID NO: 1027757 - protein, 9 aa, Homo Sapiens
PGFLYPAAT

SEQ ID NO: 1027758 - protein, 9 aa, Homo Sapiens
QEVTASAPA

SEQ ID NO: 1027759 - protein, 9 aa, Homo Sapiens
GFSSSPDLG

SEQ ID NO: 1027760 - protein, 9 aa, Homo Sapiens
PVSPNLVQG

SEQ ID NO: 1027761 - protein, 9 aa, Homo Sapiens
NKNTGEISI

SEQ ID NO: 1027762 - protein, 9 aa, Homo Sapiens
KFSGFPRVE

SEQ ID NO: 1027763 - protein, 9 aa, Homo Sapiens
IPKTYSGQT

SEQ ID NO: 1027764 - protein, 9 aa, Homo Sapiens
HTGENSYGC

SEQ ID NO: 1027765 - protein, 9 aa, Homo Sapiens
TVASSSFLE

SEQ ID NO: 1027766 - protein, 9 aa, Homo Sapiens
LQILACGGD

SEQ ID NO: 1027767 - protein, 9 aa, Homo Sapiens
EGTVGDSRV

SEQ ID NO: 1027768 - protein, 9 aa, Homo Sapiens
KPTEEEIKK

SEQ ID NO: 1027769 - protein, 9 aa, Homo Sapiens
FPRACYRAR

SEQ ID NO: 1027770 - protein, 9 aa, Homo Sapiens
GQFEFVCES

SEQ ID NO: 1027771 - protein, 9 aa, Homo Sapiens
NKFCDRENS

SEQ ID NO: 1027772 - protein, 9 aa, Homo Sapiens
RHQYGARQP

SEQ ID NO: 1027773 - protein, 9 aa, Homo Sapiens
KRLKAFNMF

SEQ ID NO: 1027774 - protein, 9 aa, Homo Sapiens
FWGVRETPW

SEQ ID NO: 1027775 - protein, 9 aa, Homo Sapiens
AAHCFSHSS

SEQ ID NO: 1027776 - protein, 9 aa, Homo Sapiens
DIPDLLHED

SEQ ID NO: 1027777 - protein, 9 aa, Homo Sapiens
SATQGLLGA

SEQ ID NO: 1027778 - protein, 9 aa, Homo Sapiens
TNDEGQLLY

SEQ ID NO: 1027779 - protein, 9 aa, Homo Sapiens
KVWRQEKKI

SEQ ID NO: 1027780 - protein, 9 aa, Homo Sapiens
KIAGQILAS

SEQ ID NO: 1027781 - protein, 9 aa, Homo Sapiens
FQEFFILCF

SEQ ID NO: 1027782 - protein, 9 aa, Homo Sapiens
GTSATQGLL

SEQ ID NO: 1027783 - protein, 9 aa, Homo Sapiens
ALCTVRRFL

SEQ ID NO: 1027784 - protein, 9 aa, Homo Sapiens
DSVVQTVFA

SEQ ID NO: 1027785 - protein, 9 aa, Homo Sapiens
LQNNYNLGS

SEQ ID NO: 1027786 - protein, 9 aa, Homo Sapiens
PTLWAKPAS

SEQ ID NO: 1027787 - protein, 9 aa, Homo Sapiens
GPGFYQVPF

SEQ ID NO: 1027788 - protein, 9 aa, Homo Sapiens
KKTFFSKVY

SEQ ID NO: 1027789 - protein, 9 aa, Homo Sapiens
GRTETKLAL

SEQ ID NO: 1027790 - protein, 9 aa, Homo Sapiens
KGMIIAVLI

SEQ ID NO: 1027791 - protein, 9 aa, Homo Sapiens
SSEKPAWAK

SEQ ID NO: 1027792 - protein, 9 aa, Homo Sapiens
LNVSMETIQ

SEQ ID NO: 1027793 - protein, 9 aa, Homo Sapiens
VFGTCEAHL

SEQ ID NO: 1027794 - protein, 9 aa, Homo Sapiens
KLQDVGTPA

SEQ ID NO: 1027795 - protein, 9 aa, Homo Sapiens
SSGDHGLGS

SEQ ID NO: 1027796 - protein, 9 aa, Homo Sapiens
VSKTLPRKK

SEQ ID NO: 1027797 - protein, 9 aa, Homo Sapiens
TALKFVAHL

SEQ ID NO: 1027798 - protein, 9 aa, Homo Sapiens
LVLQKMGQE

SEQ ID NO: 1027799 - protein, 9 aa, Homo Sapiens
VCCVLERGE

SEQ ID NO: 1027800 - protein, 9 aa, Homo Sapiens
RLYRRKRVP

SEQ ID NO: 1027801 - protein, 9 aa, Homo Sapiens
DAGKFASTF

SEQ ID NO: 1027802 - protein, 9 aa, Homo Sapiens
KEEEDEEDL

SEQ ID NO: 1027803 - protein, 9 aa, Homo Sapiens
ESISPSNRN

SEQ ID NO: 1027804 - protein, 9 aa, Homo Sapiens
ILQIGCNKI

SEQ ID NO: 1027805 - protein, 9 aa, Homo Sapiens
KHLVTGQPS

SEQ ID NO: 1027806 - protein, 9 aa, Homo Sapiens
PPKNAAWHP

SEQ ID NO: 1027807 - protein, 9 aa, Homo Sapiens
PFDGPNKNP

SEQ ID NO: 1027808 - protein, 9 aa, Homo Sapiens
VILEKLQSC

SEQ ID NO: 1027809 - protein, 9 aa, Homo Sapiens
RISGTQAEF

SEQ ID NO: 1027810 - protein, 9 aa, Homo Sapiens
ENSDNGKED

SEQ ID NO: 1027811 - protein, 9 aa, Homo Sapiens
PEGQRARII

SEQ ID NO: 1027812 - protein, 9 aa, Homo Sapiens
LLSHYWISS

SEQ ID NO: 1027813 - protein, 9 aa, Homo Sapiens
NNLLSHYWI

SEQ ID NO: 1027814 - protein, 9 aa, Homo Sapiens
AKKYSVATH

SEQ ID NO: 1027815 - protein, 9 aa, Homo Sapiens
FTALPIPPS

SEQ ID NO: 1027816 - protein, 9 aa, Homo Sapiens
SPESRAFGL

SEQ ID NO: 1027817 - protein, 9 aa, Homo Sapiens
KHEVKPLRA

SEQ ID NO: 1027818 - protein, 9 aa, Homo Sapiens
ENYCDFVKL

SEQ ID NO: 1027819 - protein, 9 aa, Homo Sapiens
LYDPPGEKM

SEQ ID NO: 1027820 - protein, 9 aa, Homo Sapiens
FDCGNNIFE

SEQ ID NO: 1027821 - protein, 9 aa, Homo Sapiens
LNNASTENQ

SEQ ID NO: 1027822 - protein, 9 aa, Homo Sapiens
IDSSRASLP

SEQ ID NO: 1027823 - protein, 9 aa, Homo Sapiens
NGIQNWTMK

SEQ ID NO: 1027824 - protein, 9 aa, Homo Sapiens
FGKFIKIHF

SEQ ID NO: 1027825 - protein, 9 aa, Homo Sapiens
VILSLAYMM

SEQ ID NO: 1027826 - protein, 9 aa, Homo Sapiens
YDLDSTVVA

SEQ ID NO: 1027827 - protein, 9 aa, Homo Sapiens
STLCLAIPE

SEQ ID NO: 1027828 - protein, 9 aa, Homo Sapiens
AIDYEIQKQ

SEQ ID NO: 1027829 - protein, 9 aa, Homo Sapiens
SSPSSHSPK

SEQ ID NO: 1027830 - protein, 9 aa, Homo Sapiens
FAAEKNGLA

SEQ ID NO: 1027831 - protein, 9 aa, Homo Sapiens
TITVQADPL

SEQ ID NO: 1027832 - protein, 9 aa, Homo Sapiens
YDKEKNARV

SEQ ID NO: 1027833 - protein, 9 aa, Homo Sapiens
EWSRVATVM

SEQ ID NO: 1027834 - protein, 9 aa, Homo Sapiens
PGTVFGASL

SEQ ID NO: 1027835 - protein, 9 aa, Homo Sapiens
YDEVVLLPQ

SEQ ID NO: 1027836 - protein, 9 aa, Homo Sapiens
DIRQPPFTN

SEQ ID NO: 1027837 - protein, 9 aa, Homo Sapiens
LLGSYSPIR

SEQ ID NO: 1027838 - protein, 9 aa, Homo Sapiens
NILFRVCSG

SEQ ID NO: 1027839 - protein, 9 aa, Homo Sapiens
ASRKDKSQT

SEQ ID NO: 1027840 - protein, 9 aa, Homo Sapiens
REEAVLLLL

SEQ ID NO: 1027841 - protein, 9 aa, Homo Sapiens
NVEIVDIRT

SEQ ID NO: 1027842 - protein, 9 aa, Homo Sapiens
PSNDLLFSI

SEQ ID NO: 1027843 - protein, 9 aa, Homo Sapiens
FYAAAVRRP

SEQ ID NO: 1027844 - protein, 9 aa, Homo Sapiens
QSGDLSQNR

SEQ ID NO: 1027845 - protein, 9 aa, Homo Sapiens
GDYSATFVP

SEQ ID NO: 1027846 - protein, 9 aa, Homo Sapiens
YKGGKDTCL

SEQ ID NO: 1027847 - protein, 9 aa, Homo Sapiens
SVGLLSLQE

SEQ ID NO: 1027848 - protein, 9 aa, Homo Sapiens
LVVSRSASF

SEQ ID NO: 1027849 - protein, 9 aa, Homo Sapiens
ASLSTQKLE

SEQ ID NO: 1027850 - protein, 9 aa, Homo Sapiens
KIAHFCCDF

SEQ ID NO: 1027851 - protein, 9 aa, Homo Sapiens
LLVPNSCTS

SEQ ID NO: 1027852 - protein, 9 aa, Homo Sapiens
PSLSSPSRL

SEQ ID NO: 1027853 - protein, 9 aa, Homo Sapiens
QRKGGVWKV

SEQ ID NO: 1027854 - protein, 9 aa, Homo Sapiens
PRGQLVGKE

SEQ ID NO: 1027855 - protein, 9 aa, Homo Sapiens
LRGAECCLL

SEQ ID NO: 1027856 - protein, 9 aa, Homo Sapiens
YSAICNSST

SEQ ID NO: 1027857 - protein, 9 aa, Homo Sapiens
QKVPPVIIT

SEQ ID NO: 1027858 - protein, 9 aa, Homo Sapiens
GVSGIGVTR

SEQ ID NO: 1027859 - protein, 9 aa, Homo Sapiens
PRTSIILNN

SEQ ID NO: 1027860 - protein, 9 aa, Homo Sapiens
PDDYNSGDI

SEQ ID NO: 1027861 - protein, 9 aa, Homo Sapiens
VVSRESQKL

SEQ ID NO: 1027862 - protein, 9 aa, Homo Sapiens
HVPFKLMST

SEQ ID NO: 1027863 - protein, 9 aa, Homo Sapiens
NTLTQAQTC

SEQ ID NO: 1027864 - protein, 9 aa, Homo Sapiens
NLIFDDYRR

SEQ ID NO: 1027865 - protein, 9 aa, Homo Sapiens
SYETASPVA

SEQ ID NO: 1027866 - protein, 9 aa, Homo Sapiens
STLDTKKNL

SEQ ID NO: 1027867 - protein, 9 aa, Homo Sapiens
SNSKPSKTG

SEQ ID NO: 1027868 - protein, 9 aa, Homo Sapiens
LWEQVVPGC

SEQ ID NO: 1027869 - protein, 9 aa, Homo Sapiens
FQHSHSIQH

SEQ ID NO: 1027870 - protein, 9 aa, Homo Sapiens
VLKMINFFS

SEQ ID NO: 1027871 - protein, 9 aa, Homo Sapiens
WIKNGEEIV

SEQ ID NO: 1027872 - protein, 9 aa, Homo Sapiens
QLTQELLVS

SEQ ID NO: 1027873 - protein, 9 aa, Homo Sapiens
LSTCAFHFI

SEQ ID NO: 1027874 - protein, 9 aa, Homo Sapiens
RKGFAPCSP

SEQ ID NO: 1027875 - protein, 9 aa, Homo Sapiens
EEDRSLSCR

SEQ ID NO: 1027876 - protein, 9 aa, Homo Sapiens
NLGISCINF

SEQ ID NO: 1027877 - protein, 9 aa, Homo Sapiens
GEGMGLKIH

SEQ ID NO: 1027878 - protein, 9 aa, Homo Sapiens
FLFALVCWY

SEQ ID NO: 1027879 - protein, 9 aa, Homo Sapiens
GLARKARSP

SEQ ID NO: 1027880 - protein, 9 aa, Homo Sapiens
CPESETSCL

SEQ ID NO: 1027881 - protein, 9 aa, Homo Sapiens
RDLVNRLKV

SEQ ID NO: 1027882 - protein, 9 aa, Homo Sapiens
RLGIPGLPG

SEQ ID NO: 1027883 - protein, 9 aa, Homo Sapiens
MRRKRKSQK

SEQ ID NO: 1027884 - protein, 9 aa, Homo Sapiens
GKKKNAMYG

SEQ ID NO: 1027885 - protein, 9 aa, Homo Sapiens
SLAVKTKSS

SEQ ID NO: 1027886 - protein, 9 aa, Homo Sapiens
SPSSHSPKT

SEQ ID NO: 1027887 - protein, 9 aa, Homo Sapiens
PILVVLALA

SEQ ID NO: 1027888 - protein, 9 aa, Homo Sapiens
CRNNILDHF

SEQ ID NO: 1027889 - protein, 9 aa, Homo Sapiens
VSFCILAMV

SEQ ID NO: 1027890 - protein, 9 aa, Homo Sapiens
HSLRYTNLM

SEQ ID NO: 1027891 - protein, 9 aa, Homo Sapiens
TLRREPDQL

SEQ ID NO: 1027892 - protein, 9 aa, Homo Sapiens
HPNVDPCTE

SEQ ID NO: 1027893 - protein, 9 aa, Homo Sapiens
NDIETFKIK

SEQ ID NO: 1027894 - protein, 9 aa, Homo Sapiens
VDVYRYIAT

SEQ ID NO: 1027895 - protein, 9 aa, Homo Sapiens
MAVSQGDET

SEQ ID NO: 1027896 - protein, 9 aa, Homo Sapiens
DIGPPGPAG

SEQ ID NO: 1027897 - protein, 9 aa, Homo Sapiens
LSLVLVGAC

SEQ ID NO: 1027898 - protein, 9 aa, Homo Sapiens
LFIIWNKKP

SEQ ID NO: 1027899 - protein, 9 aa, Homo Sapiens
KDSSHSGKS

SEQ ID NO: 1027900 - protein, 9 aa, Homo Sapiens
PAQKPLQPD

SEQ ID NO: 1027901 - protein, 9 aa, Homo Sapiens
KAIAANSKL

SEQ ID NO: 1027902 - protein, 9 aa, Homo Sapiens
GTLRREPDQ

SEQ ID NO: 1027903 - protein, 9 aa, Homo Sapiens
EPAGGSKQE

SEQ ID NO: 1027904 - protein, 9 aa, Homo Sapiens
DWVTFYKVM

SEQ ID NO: 1027905 - protein, 9 aa, Homo Sapiens
KSQAIASNV

SEQ ID NO: 1027906 - protein, 9 aa, Homo Sapiens
PKLYDPPGE

SEQ ID NO: 1027907 - protein, 9 aa, Homo Sapiens
RKPLHLEGG

SEQ ID NO: 1027908 - protein, 9 aa, Homo Sapiens
ENSYGCKEC

SEQ ID NO: 1027909 - protein, 9 aa, Homo Sapiens
LVEVVLNGE

SEQ ID NO: 1027910 - protein, 9 aa, Homo Sapiens
MKKTFFSKV

SEQ ID NO: 1027911 - protein, 9 aa, Homo Sapiens
CSTSCGGDF

SEQ ID NO: 1027912 - protein, 9 aa, Homo Sapiens
EISSCIPCP

SEQ ID NO: 1027913 - protein, 9 aa, Homo Sapiens
DFTGSHSEL

SEQ ID NO: 1027914 - protein, 9 aa, Homo Sapiens
QKVFGTCEA

SEQ ID NO: 1027915 - protein, 9 aa, Homo Sapiens
SAHWRVHTG

SEQ ID NO: 1027916 - protein, 9 aa, Homo Sapiens
WLLNIKYLS

SEQ ID NO: 1027917 - protein, 9 aa, Homo Sapiens
TSFGARNRT

SEQ ID NO: 1027918 - protein, 9 aa, Homo Sapiens
EIDDLNVSM

SEQ ID NO: 1027919 - protein, 9 aa, Homo Sapiens
IKNNWYFVV

SEQ ID NO: 1027920 - protein, 9 aa, Homo Sapiens
LLLFFFLTF

SEQ ID NO: 1027921 - protein, 9 aa, Homo Sapiens
SYCGSRKIA

SEQ ID NO: 1027922 - protein, 9 aa, Homo Sapiens
KDKVKPKIL

SEQ ID NO: 1027923 - protein, 9 aa, Homo Sapiens
SNGSGGSWT

SEQ ID NO: 1027924 - protein, 9 aa, Homo Sapiens
GAAIWTRAV

SEQ ID NO: 1027925 - protein, 9 aa, Homo Sapiens
VSRQSIRNF

SEQ ID NO: 1027926 - protein, 9 aa, Homo Sapiens
KGERGKAGP

SEQ ID NO: 1027927 - protein, 9 aa, Homo Sapiens
IDADTNDEG

SEQ ID NO: 1027928 - protein, 9 aa, Homo Sapiens
PAPRICRIS

SEQ ID NO: 1027929 - protein, 9 aa, Homo Sapiens
PIGMRMSPL

SEQ ID NO: 1027930 - protein, 9 aa, Homo Sapiens
ASFPNSSSY

SEQ ID NO: 1027931 - protein, 9 aa, Homo Sapiens
PILGEIFRC

SEQ ID NO: 1027932 - protein, 9 aa, Homo Sapiens
TEIHLSPEK

SEQ ID NO: 1027933 - protein, 9 aa, Homo Sapiens
LTVSAENPN

SEQ ID NO: 1027934 - protein, 9 aa, Homo Sapiens
GVAVVSRGS

SEQ ID NO: 1027935 - protein, 9 aa, Homo Sapiens
FKLMSTFKN

SEQ ID NO: 1027936 - protein, 9 aa, Homo Sapiens
RTFFKCSEI

SEQ ID NO: 1027937 - protein, 9 aa, Homo Sapiens
PAKRSQLEE

SEQ ID NO: 1027938 - protein, 9 aa, Homo Sapiens
ARKARSPLL

SEQ ID NO: 1027939 - protein, 9 aa, Homo Sapiens
SLIIGPTKE

SEQ ID NO: 1027940 - protein, 9 aa, Homo Sapiens
KPQASPEGC

SEQ ID NO: 1027941 - protein, 9 aa, Homo Sapiens
GAMFFGVSE

SEQ ID NO: 1027942 - protein, 9 aa, Homo Sapiens
VGVGNVRIK

SEQ ID NO: 1027943 - protein, 9 aa, Homo Sapiens
VSSEGCCGS

SEQ ID NO: 1027944 - protein, 9 aa, Homo Sapiens
ERKKNQELR

SEQ ID NO: 1027945 - protein, 9 aa, Homo Sapiens
LPDYKKTLE

SEQ ID NO: 1027946 - protein, 9 aa, Homo Sapiens
EGGYCSPAE

SEQ ID NO: 1027947 - protein, 9 aa, Homo Sapiens
FYKFEEMFN

SEQ ID NO: 1027948 - protein, 9 aa, Homo Sapiens
QMYFYLQLR

SEQ ID NO: 1027949 - protein, 9 aa, Homo Sapiens
WWKDGCFQS

SEQ ID NO: 1027950 - protein, 9 aa, Homo Sapiens
AWPFTCLSL

SEQ ID NO: 1027951 - protein, 9 aa, Homo Sapiens
MSQVMFKLD

SEQ ID NO: 1027952 - protein, 9 aa, Homo Sapiens
TTHKRIYSG

SEQ ID NO: 1027953 - protein, 9 aa, Homo Sapiens
GHRSEYWVA

SEQ ID NO: 1027954 - protein, 9 aa, Homo Sapiens
PLYRHAASY

SEQ ID NO: 1027955 - protein, 9 aa, Homo Sapiens
LLEQERLTS

SEQ ID NO: 1027956 - protein, 9 aa, Homo Sapiens
KLRSPVNLS

SEQ ID NO: 1027957 - protein, 9 aa, Homo Sapiens
IKIHFGTTG

SEQ ID NO: 1027958 - protein, 9 aa, Homo Sapiens
KKILENKAT

SEQ ID NO: 1027959 - protein, 9 aa, Homo Sapiens
LCPNEFFGE

SEQ ID NO: 1027960 - protein, 9 aa, Homo Sapiens
DATHIALCT

SEQ ID NO: 1027961 - protein, 9 aa, Homo Sapiens
CKACGCNLA

SEQ ID NO: 1027962 - protein, 9 aa, Homo Sapiens
QKKIDKING

SEQ ID NO: 1027963 - protein, 9 aa, Homo Sapiens
ILTKHKIIY

SEQ ID NO: 1027964 - protein, 9 aa, Homo Sapiens
LSHIFYGRK

SEQ ID NO: 1027965 - protein, 9 aa, Homo Sapiens
TLVILKNAA

SEQ ID NO: 1027966 - protein, 9 aa, Homo Sapiens
FNGYNDLMS

SEQ ID NO: 1027967 - protein, 9 aa, Homo Sapiens
SLASKTTTT

SEQ ID NO: 1027968 - protein, 9 aa, Homo Sapiens
VNDNPPQFP

SEQ ID NO: 1027969 - protein, 9 aa, Homo Sapiens
KEHVLAPPG

SEQ ID NO: 1027970 - protein, 9 aa, Homo Sapiens
ETTWDCLPL

SEQ ID NO: 1027971 - protein, 9 aa, Homo Sapiens
WTIPSLTST

SEQ ID NO: 1027972 - protein, 9 aa, Homo Sapiens
KAKMDADWT

SEQ ID NO: 1027973 - protein, 9 aa, Homo Sapiens
IIGPTKERT

SEQ ID NO: 1027974 - protein, 9 aa, Homo Sapiens
NGRTCKAGV

SEQ ID NO: 1027975 - protein, 9 aa, Homo Sapiens
LRQWVVISP

SEQ ID NO: 1027976 - protein, 9 aa, Homo Sapiens
PYIFMDDDF

SEQ ID NO: 1027977 - protein, 9 aa, Homo Sapiens
TEDQKQPAR

SEQ ID NO: 1027978 - protein, 9 aa, Homo Sapiens
AVAKGNLHQ

SEQ ID NO: 1027979 - protein, 9 aa, Homo Sapiens
REREVGILL

SEQ ID NO: 1027980 - protein, 9 aa, Homo Sapiens
GSPDQNLQE

SEQ ID NO: 1027981 - protein, 9 aa, Homo Sapiens
RSLDMSFML

SEQ ID NO: 1027982 - protein, 9 aa, Homo Sapiens
RHLPIEIKA

SEQ ID NO: 1027983 - protein, 9 aa, Homo Sapiens
MGISTDIFL

SEQ ID NO: 1027984 - protein, 9 aa, Homo Sapiens
MLVVLWEHG

SEQ ID NO: 1027985 - protein, 9 aa, Homo Sapiens
LYRCEIKPP

SEQ ID NO: 1027986 - protein, 9 aa, Homo Sapiens
PPPSLSSPS

SEQ ID NO: 1027987 - protein, 9 aa, Homo Sapiens
IKKWDQFYS

SEQ ID NO: 1027988 - protein, 9 aa, Homo Sapiens
FDQYLAICC

SEQ ID NO: 1027989 - protein, 9 aa, Homo Sapiens
FLQRLLGPM

SEQ ID NO: 1027990 - protein, 9 aa, Homo Sapiens
PQQASSPQA

SEQ ID NO: 1027991 - protein, 9 aa, Homo Sapiens
LREGIFCSG

SEQ ID NO: 1027992 - protein, 9 aa, Homo Sapiens
RRKRGFCIQ

SEQ ID NO: 1027993 - protein, 9 aa, Homo Sapiens
EWDFQPPLC

SEQ ID NO: 1027994 - protein, 9 aa, Homo Sapiens
SPLTTRVYV

SEQ ID NO: 1027995 - protein, 9 aa, Homo Sapiens
GEELYLSCG

SEQ ID NO: 1027996 - protein, 9 aa, Homo Sapiens
ISQPCVPTC

SEQ ID NO: 1027997 - protein, 9 aa, Homo Sapiens
PPLLETFYA

SEQ ID NO: 1027998 - protein, 9 aa, Homo Sapiens
KYDRHLPIE

SEQ ID NO: 1027999 - protein, 9 aa, Homo Sapiens
LGIMAFDRY

SEQ ID NO: 1028000 - protein, 9 aa, Homo Sapiens
DKWCPKKRR

SEQ ID NO: 1028001 - protein, 9 aa, Homo Sapiens
PVSFGNKHS

SEQ ID NO: 1028002 - protein, 9 aa, Homo Sapiens
SSGEVLETT

SEQ ID NO: 1028003 - protein, 9 aa, Homo Sapiens
RGSNGSGGS

SEQ ID NO: 1028004 - protein, 9 aa, Homo Sapiens
TTPNGHIAN

SEQ ID NO: 1028005 - protein, 9 aa, Homo Sapiens
RPLVYVLYA

SEQ ID NO: 1028006 - protein, 9 aa, Homo Sapiens
FSYPDVKVA

SEQ ID NO: 1028007 - protein, 9 aa, Homo Sapiens
SLWLQNFVR

SEQ ID NO: 1028008 - protein, 9 aa, Homo Sapiens
KGSLEFPGF

SEQ ID NO: 1028009 - protein, 9 aa, Homo Sapiens
GIDIWGGEN

SEQ ID NO: 1028010 - protein, 9 aa, Homo Sapiens
SAENPNPQG

SEQ ID NO: 1028011 - protein, 9 aa, Homo Sapiens
IVKKILENK

SEQ ID NO: 1028012 - protein, 9 aa, Homo Sapiens
LDIDDNSSV

SEQ ID NO: 1028013 - protein, 9 aa, Homo Sapiens
AQLYFFYFL

SEQ ID NO: 1028014 - protein, 9 aa, Homo Sapiens
NSDDRDESE

SEQ ID NO: 1028015 - protein, 9 aa, Homo Sapiens
LSNLPTFFS

SEQ ID NO: 1028016 - protein, 9 aa, Homo Sapiens
FTFQLTGFP

SEQ ID NO: 1028017 - protein, 9 aa, Homo Sapiens
NKSGTNQSS

SEQ ID NO: 1028018 - protein, 9 aa, Homo Sapiens
AIAIVIGLL

SEQ ID NO: 1028019 - protein, 9 aa, Homo Sapiens
EEKALNLKM

SEQ ID NO: 1028020 - protein, 9 aa, Homo Sapiens
QELNTLANL

SEQ ID NO: 1028021 - protein, 9 aa, Homo Sapiens
IFFVNHLKM

SEQ ID NO: 1028022 - protein, 9 aa, Homo Sapiens
VLLEQERLT

SEQ ID NO: 1028023 - protein, 9 aa, Homo Sapiens
FRLGKMCLG

SEQ ID NO: 1028024 - protein, 9 aa, Homo Sapiens
KDFLQTFYT

SEQ ID NO: 1028025 - protein, 9 aa, Homo Sapiens
DQNNNAPEI

SEQ ID NO: 1028026 - protein, 9 aa, Homo Sapiens
TISAYQENP

SEQ ID NO: 1028027 - protein, 9 aa, Homo Sapiens
LIQVMMMGS

SEQ ID NO: 1028028 - protein, 9 aa, Homo Sapiens
WSFGVLMWK

SEQ ID NO: 1028029 - protein, 9 aa, Homo Sapiens
IRQDQKLIE

SEQ ID NO: 1028030 - protein, 9 aa, Homo Sapiens
QPPRLPPEG

SEQ ID NO: 1028031 - protein, 9 aa, Homo Sapiens
AMRESGQAG

SEQ ID NO: 1028032 - protein, 9 aa, Homo Sapiens
KLSQTCVMW

SEQ ID NO: 1028033 - protein, 9 aa, Homo Sapiens
IREEAVLLL

SEQ ID NO: 1028034 - protein, 9 aa, Homo Sapiens
IRNINRLVI

SEQ ID NO: 1028035 - protein, 9 aa, Homo Sapiens
KAAHQKKID

SEQ ID NO: 1028036 - protein, 9 aa, Homo Sapiens
PDLKNILFR

SEQ ID NO: 1028037 - protein, 9 aa, Homo Sapiens
EKIYTGGKL

SEQ ID NO: 1028038 - protein, 9 aa, Homo Sapiens
CRHSANINL

SEQ ID NO: 1028039 - protein, 9 aa, Homo Sapiens
GHRIEEVSE

SEQ ID NO: 1028040 - protein, 9 aa, Homo Sapiens
SCNVRDTTL

SEQ ID NO: 1028041 - protein, 9 aa, Homo Sapiens
GVENSYIRC

SEQ ID NO: 1028042 - protein, 9 aa, Homo Sapiens
LSQHANDSC

SEQ ID NO: 1028043 - protein, 9 aa, Homo Sapiens
MLGLQIPIK

SEQ ID NO: 1028044 - protein, 9 aa, Homo Sapiens
VTITVQADP

SEQ ID NO: 1028045 - protein, 9 aa, Homo Sapiens
EKEEEDEED

SEQ ID NO: 1028046 - protein, 9 aa, Homo Sapiens
DPIGQDFVG

SEQ ID NO: 1028047 - protein, 9 aa, Homo Sapiens
GMMTGAFIL

SEQ ID NO: 1028048 - protein, 9 aa, Homo Sapiens
SLSCREAVL

SEQ ID NO: 1028049 - protein, 9 aa, Homo Sapiens
IVWPSLPDY

SEQ ID NO: 1028050 - protein, 9 aa, Homo Sapiens
GNNIFEEGD

SEQ ID NO: 1028051 - protein, 9 aa, Homo Sapiens
TWKFFNILT

SEQ ID NO: 1028052 - protein, 9 aa, Homo Sapiens
VYVPLITAF

SEQ ID NO: 1028053 - protein, 9 aa, Homo Sapiens
FKGGRTETK

SEQ ID NO: 1028054 - protein, 9 aa, Homo Sapiens
EYWVASEGD

SEQ ID NO: 1028055 - protein, 9 aa, Homo Sapiens
AAGVQMKLK

SEQ ID NO: 1028056 - protein, 9 aa, Homo Sapiens
FLRLSDDEE

SEQ ID NO: 1028057 - protein, 9 aa, Homo Sapiens
LGTGYFRLG

SEQ ID NO: 1028058 - protein, 9 aa, Homo Sapiens
KAVLWKYKF

SEQ ID NO: 1028059 - protein, 9 aa, Homo Sapiens
VLLSKEEPV

SEQ ID NO: 1028060 - protein, 9 aa, Homo Sapiens
VRALYQHYS

SEQ ID NO: 1028061 - protein, 9 aa, Homo Sapiens
GEAFLFALV

SEQ ID NO: 1028062 - protein, 9 aa, Homo Sapiens
PRSWLRLRP

SEQ ID NO: 1028063 - protein, 9 aa, Homo Sapiens
RRGGRGSNG

SEQ ID NO: 1028064 - protein, 9 aa, Homo Sapiens
GCFLARFAL

SEQ ID NO: 1028065 - protein, 9 aa, Homo Sapiens
GGGTTTPWS

SEQ ID NO: 1028066 - protein, 9 aa, Homo Sapiens
LSINAKCHK

SEQ ID NO: 1028067 - protein, 9 aa, Homo Sapiens
EGKKKGGGK

SEQ ID NO: 1028068 - protein, 9 aa, Homo Sapiens
LPEDDLVLS

SEQ ID NO: 1028069 - protein, 9 aa, Homo Sapiens
QQIQNGSLS

SEQ ID NO: 1028070 - protein, 9 aa, Homo Sapiens
LILLFYANI

SEQ ID NO: 1028071 - protein, 9 aa, Homo Sapiens
PVIICVTTV

SEQ ID NO: 1028072 - protein, 9 aa, Homo Sapiens
GEVLGAYKL

SEQ ID NO: 1028073 - protein, 9 aa, Homo Sapiens
PLVVNLPVY

SEQ ID NO: 1028074 - protein, 9 aa, Homo Sapiens
LLWLGSHAG

SEQ ID NO: 1028075 - protein, 9 aa, Homo Sapiens
LGSPESRAF

SEQ ID NO: 1028076 - protein, 9 aa, Homo Sapiens
LLDELMNFG

SEQ ID NO: 1028077 - protein, 9 aa, Homo Sapiens
GEYFWEKKV

SEQ ID NO: 1028078 - protein, 9 aa, Homo Sapiens
CLLLGIMAF

SEQ ID NO: 1028079 - protein, 9 aa, Homo Sapiens
GQDFYAAAV

SEQ ID NO: 1028080 - protein, 9 aa, Homo Sapiens
LSLQEKKCI

SEQ ID NO: 1028081 - protein, 9 aa, Homo Sapiens
RTRQLTLQW

SEQ ID NO: 1028082 - protein, 9 aa, Homo Sapiens
LLKERLTEL

SEQ ID NO: 1028083 - protein, 9 aa, Homo Sapiens
PLVAGPGRG

SEQ ID NO: 1028084 - protein, 9 aa, Homo Sapiens
GSIPWLGYV

SEQ ID NO: 1028085 - protein, 9 aa, Homo Sapiens
SGAGSSSHT

SEQ ID NO: 1028086 - protein, 9 aa, Homo Sapiens
VVSRSASFV

SEQ ID NO: 1028087 - protein, 9 aa, Homo Sapiens
LDWPLPSVS

SEQ ID NO: 1028088 - protein, 9 aa, Homo Sapiens
LARLLKKLK

SEQ ID NO: 1028089 - protein, 9 aa, Homo Sapiens
PQLPPLLSC

SEQ ID NO: 1028090 - protein, 9 aa, Homo Sapiens
GSKRIFIGG

SEQ ID NO: 1028091 - protein, 9 aa, Homo Sapiens
EKLQLDKLR

SEQ ID NO: 1028092 - protein, 9 aa, Homo Sapiens
FLMTVLLTY

SEQ ID NO: 1028093 - protein, 9 aa, Homo Sapiens
CLDFSAEYL

SEQ ID NO: 1028094 - protein, 9 aa, Homo Sapiens
LSGNKSLEK

SEQ ID NO: 1028095 - protein, 9 aa, Homo Sapiens
QCSCNVTKF

SEQ ID NO: 1028096 - protein, 9 aa, Homo Sapiens
IKKQSNNDL

SEQ ID NO: 1028097 - protein, 9 aa, Homo Sapiens
VMDEANLEL

SEQ ID NO: 1028098 - protein, 9 aa, Homo Sapiens
EVLFRLPEF

SEQ ID NO: 1028099 - protein, 9 aa, Homo Sapiens
GGSKRIFIG

SEQ ID NO: 1028100 - protein, 9 aa, Homo Sapiens
IDPALFQLV

SEQ ID NO: 1028101 - protein, 9 aa, Homo Sapiens
SSNYDKQPK

SEQ ID NO: 1028102 - protein, 9 aa, Homo Sapiens
QEIRKFICL

SEQ ID NO: 1028103 - protein, 9 aa, Homo Sapiens
LMEPENLDL

SEQ ID NO: 1028104 - protein, 9 aa, Homo Sapiens
LQNNIRSHS

SEQ ID NO: 1028105 - protein, 9 aa, Homo Sapiens
AGPLLKILC

SEQ ID NO: 1028106 - protein, 9 aa, Homo Sapiens
RGAKGCTAP

SEQ ID NO: 1028107 - protein, 9 aa, Homo Sapiens
HAQDGKVME

SEQ ID NO: 1028108 - protein, 9 aa, Homo Sapiens
DTSLAVKTK

SEQ ID NO: 1028109 - protein, 9 aa, Homo Sapiens
SGAVLLEQE

SEQ ID NO: 1028110 - protein, 9 aa, Homo Sapiens
TLCHLIPSP

SEQ ID NO: 1028111 - protein, 9 aa, Homo Sapiens
EKALNLKMK

SEQ ID NO: 1028112 - protein, 9 aa, Homo Sapiens
WVRNVAWAP

SEQ ID NO: 1028113 - protein, 9 aa, Homo Sapiens
YVVTLPQEV

SEQ ID NO: 1028114 - protein, 9 aa, Homo Sapiens
DSENCRIVP

SEQ ID NO: 1028115 - protein, 9 aa, Homo Sapiens
PALFQLVER

SEQ ID NO: 1028116 - protein, 9 aa, Homo Sapiens
EFFSQQKEE

SEQ ID NO: 1028117 - protein, 9 aa, Homo Sapiens
LGLIICPII

SEQ ID NO: 1028118 - protein, 9 aa, Homo Sapiens
DMNATTVIV

SEQ ID NO: 1028119 - protein, 9 aa, Homo Sapiens
PCGPGEELY

SEQ ID NO: 1028120 - protein, 9 aa, Homo Sapiens
AETYGHNGI

SEQ ID NO: 1028121 - protein, 9 aa, Homo Sapiens
EEDDDKWCP

SEQ ID NO: 1028122 - protein, 9 aa, Homo Sapiens
TVKIVIDCE

SEQ ID NO: 1028123 - protein, 9 aa, Homo Sapiens
SLGREILLE

SEQ ID NO: 1028124 - protein, 9 aa, Homo Sapiens
FRRIAGEED

SEQ ID NO: 1028125 - protein, 9 aa, Homo Sapiens
NALCYCNKF

SEQ ID NO: 1028126 - protein, 9 aa, Homo Sapiens
KNLNRETNI

SEQ ID NO: 1028127 - protein, 9 aa, Homo Sapiens
QSSFYSDRD

SEQ ID NO: 1028128 - protein, 9 aa, Homo Sapiens
LLLRKDACS

SEQ ID NO: 1028129 - protein, 9 aa, Homo Sapiens
IGAQRRRSL

SEQ ID NO: 1028130 - protein, 9 aa, Homo Sapiens
LRSTASDCS

SEQ ID NO: 1028131 - protein, 9 aa, Homo Sapiens
QDEDNTIFK

SEQ ID NO: 1028132 - protein, 9 aa, Homo Sapiens
LGAYKLPDG

SEQ ID NO: 1028133 - protein, 9 aa, Homo Sapiens
NKSHGSRTS

SEQ ID NO: 1028134 - protein, 9 aa, Homo Sapiens
IHKLFDEVF

SEQ ID NO: 1028135 - protein, 9 aa, Homo Sapiens
SAKKYSVAT

SEQ ID NO: 1028136 - protein, 9 aa, Homo Sapiens
KRLSEKLEE

SEQ ID NO: 1028137 - protein, 9 aa, Homo Sapiens
KPHFRSSSA

SEQ ID NO: 1028138 - protein, 9 aa, Homo Sapiens
RGFWALPKN

SEQ ID NO: 1028139 - protein, 9 aa, Homo Sapiens
SGGNYEGGS

SEQ ID NO: 1028140 - protein, 9 aa, Homo Sapiens
LASRKDKSQ

SEQ ID NO: 1028141 - protein, 9 aa, Homo Sapiens
SSEKGNFFP

SEQ ID NO: 1028142 - protein, 9 aa, Homo Sapiens
IGLFRRFTC

SEQ ID NO: 1028143 - protein, 9 aa, Homo Sapiens
YVRDPTSTI

SEQ ID NO: 1028144 - protein, 9 aa, Homo Sapiens
CCKFIFTSG

SEQ ID NO: 1028145 - protein, 9 aa, Homo Sapiens
QLDWPLPSV

SEQ ID NO: 1028146 - protein, 9 aa, Homo Sapiens
FLRSWRELH

SEQ ID NO: 1028147 - protein, 9 aa, Homo Sapiens
FKNDVQRSA

SEQ ID NO: 1028148 - protein, 9 aa, Homo Sapiens
ADGAILQWK

SEQ ID NO: 1028149 - protein, 9 aa, Homo Sapiens
RESHLSLSP

SEQ ID NO: 1028150 - protein, 9 aa, Homo Sapiens
ELDETFIVP

SEQ ID NO: 1028151 - protein, 9 aa, Homo Sapiens
RSASFVLPS

SEQ ID NO: 1028152 - protein, 9 aa, Homo Sapiens
SDIPAPRIC

SEQ ID NO: 1028153 - protein, 9 aa, Homo Sapiens
DDGARPVIW

SEQ ID NO: 1028154 - protein, 9 aa, Homo Sapiens
ENIETKNIR

SEQ ID NO: 1028155 - protein, 9 aa, Homo Sapiens
QFSILTTHK

SEQ ID NO: 1028156 - protein, 9 aa, Homo Sapiens
SLEKIRQDQ

SEQ ID NO: 1028157 - protein, 9 aa, Homo Sapiens
FFFRSGMGK

SEQ ID NO: 1028158 - protein, 9 aa, Homo Sapiens
ISSIKIPLN

SEQ ID NO: 1028159 - protein, 9 aa, Homo Sapiens
PNRVKVDQT

SEQ ID NO: 1028160 - protein, 9 aa, Homo Sapiens
LFLAKYRDF

SEQ ID NO: 1028161 - protein, 9 aa, Homo Sapiens
GLIICPIIW

SEQ ID NO: 1028162 - protein, 9 aa, Homo Sapiens
GTSAWGNPS

SEQ ID NO: 1028163 - protein, 9 aa, Homo Sapiens
STLIPINNI

SEQ ID NO: 1028164 - protein, 9 aa, Homo Sapiens
LIPINNISV

SEQ ID NO: 1028165 - protein, 9 aa, Homo Sapiens
WPIRQARQQ

SEQ ID NO: 1028166 - protein, 9 aa, Homo Sapiens
LEEKVTQME

SEQ ID NO: 1028167 - protein, 9 aa, Homo Sapiens
VNIWYSFSV

SEQ ID NO: 1028168 - protein, 9 aa, Homo Sapiens
GISTDIFLV

SEQ ID NO: 1028169 - protein, 9 aa, Homo Sapiens
IEGDNLHIQ

SEQ ID NO: 1028170 - protein, 9 aa, Homo Sapiens
SAFVDVYRY

SEQ ID NO: 1028171 - protein, 9 aa, Homo Sapiens
KLAVLLIII

SEQ ID NO: 1028172 - protein, 9 aa, Homo Sapiens
LLTPLQVEL

SEQ ID NO: 1028173 - protein, 9 aa, Homo Sapiens
LVKSREIDW

SEQ ID NO: 1028174 - protein, 9 aa, Homo Sapiens
SSLASSQAK

SEQ ID NO: 1028175 - protein, 9 aa, Homo Sapiens
NVTKFELSG

SEQ ID NO: 1028176 - protein, 9 aa, Homo Sapiens
VFNDSIISA

SEQ ID NO: 1028177 - protein, 9 aa, Homo Sapiens
ENSSNKNKK

SEQ ID NO: 1028178 - protein, 9 aa, Homo Sapiens
HLKMSELLY

SEQ ID NO: 1028179 - protein, 9 aa, Homo Sapiens
ESIQNSPND

SEQ ID NO: 1028180 - protein, 9 aa, Homo Sapiens
SIDKNLSER

SEQ ID NO: 1028181 - protein, 9 aa, Homo Sapiens
VCLDFSAEY

SEQ ID NO: 1028182 - protein, 9 aa, Homo Sapiens
VKRHYFSDY

SEQ ID NO: 1028183 - protein, 9 aa, Homo Sapiens
TVFFFKVER

SEQ ID NO: 1028184 - protein, 9 aa, Homo Sapiens
GLIYLLFIH

SEQ ID NO: 1028185 - protein, 9 aa, Homo Sapiens
CDKDPVIMR

SEQ ID NO: 1028186 - protein, 9 aa, Homo Sapiens
VIGKWWCEI

SEQ ID NO: 1028187 - protein, 9 aa, Homo Sapiens
STDCPVQRM

SEQ ID NO: 1028188 - protein, 9 aa, Homo Sapiens
SDCKIDPAL

SEQ ID NO: 1028189 - protein, 9 aa, Homo Sapiens
SPRMTCPKG

SEQ ID NO: 1028190 - protein, 9 aa, Homo Sapiens
GYEQQRGKG

SEQ ID NO: 1028191 - protein, 9 aa, Homo Sapiens
SFPPYYYGD

SEQ ID NO: 1028192 - protein, 9 aa, Homo Sapiens
FPAGHLPGG

SEQ ID NO: 1028193 - protein, 9 aa, Homo Sapiens
LDTAKITCV

SEQ ID NO: 1028194 - protein, 9 aa, Homo Sapiens
LKEPGDPWS

SEQ ID NO: 1028195 - protein, 9 aa, Homo Sapiens
KKVIKEFSN

SEQ ID NO: 1028196 - protein, 9 aa, Homo Sapiens
YKGEKKDRA

SEQ ID NO: 1028197 - protein, 9 aa, Homo Sapiens
CKHLVTGQP

SEQ ID NO: 1028198 - protein, 9 aa, Homo Sapiens
PKPPGKPFK

SEQ ID NO: 1028199 - protein, 9 aa, Homo Sapiens
DYKFPDIII

SEQ ID NO: 1028200 - protein, 9 aa, Homo Sapiens
CRGFPRGPV

SEQ ID NO: 1028201 - protein, 9 aa, Homo Sapiens
GSPSRSGTA

SEQ ID NO: 1028202 - protein, 9 aa, Homo Sapiens
RKKWKQSVC

SEQ ID NO: 1028203 - protein, 9 aa, Homo Sapiens
AAQSLMGMN

SEQ ID NO: 1028204 - protein, 9 aa, Homo Sapiens
GPYGEKMAV

SEQ ID NO: 1028205 - protein, 9 aa, Homo Sapiens
EDLIQSMHN

SEQ ID NO: 1028206 - protein, 9 aa, Homo Sapiens
CVSFAFYQQ

SEQ ID NO: 1028207 - protein, 9 aa, Homo Sapiens
NKTTWQREI

SEQ ID NO: 1028208 - protein, 9 aa, Homo Sapiens
LPSKKVIKE

SEQ ID NO: 1028209 - protein, 9 aa, Homo Sapiens
NFSPNVSGS

SEQ ID NO: 1028210 - protein, 9 aa, Homo Sapiens
AKEVILLDS

SEQ ID NO: 1028211 - protein, 9 aa, Homo Sapiens
ASDERRQEM

SEQ ID NO: 1028212 - protein, 9 aa, Homo Sapiens
AHQKKIDKI

SEQ ID NO: 1028213 - protein, 9 aa, Homo Sapiens
SEVNEGGGS

SEQ ID NO: 1028214 - protein, 9 aa, Homo Sapiens
NEGGGSRSE

SEQ ID NO: 1028215 - protein, 9 aa, Homo Sapiens
QDGKVMEYT

SEQ ID NO: 1028216 - protein, 9 aa, Homo Sapiens
RDCHHLEIQ

SEQ ID NO: 1028217 - protein, 9 aa, Homo Sapiens
HLYTPMYFL

SEQ ID NO: 1028218 - protein, 9 aa, Homo Sapiens
KSTVERFYS

SEQ ID NO: 1028219 - protein, 9 aa, Homo Sapiens
DNLSPQPLK

SEQ ID NO: 1028220 - protein, 9 aa, Homo Sapiens
FYNVIDCFS

SEQ ID NO: 1028221 - protein, 9 aa, Homo Sapiens
QQEDSAVYF

SEQ ID NO: 1028222 - protein, 9 aa, Homo Sapiens
MQNHGDFDV

SEQ ID NO: 1028223 - protein, 9 aa, Homo Sapiens
DRNANYVQE

SEQ ID NO: 1028224 - protein, 9 aa, Homo Sapiens
AISFLLVLD

SEQ ID NO: 1028225 - protein, 9 aa, Homo Sapiens
GFEKFVQYC

SEQ ID NO: 1028226 - protein, 9 aa, Homo Sapiens
PYRRTAIEY

SEQ ID NO: 1028227 - protein, 9 aa, Homo Sapiens
TDVNDNPPQ

SEQ ID NO: 1028228 - protein, 9 aa, Homo Sapiens
MYFYLQLRG

SEQ ID NO: 1028229 - protein, 9 aa, Homo Sapiens
TSPKQKNGT

SEQ ID NO: 1028230 - protein, 9 aa, Homo Sapiens
YAKKDEASG

SEQ ID NO: 1028231 - protein, 9 aa, Homo Sapiens
NASTENQNT

SEQ ID NO: 1028232 - protein, 9 aa, Homo Sapiens
VPGIRHVYP

SEQ ID NO: 1028233 - protein, 9 aa, Homo Sapiens
LSGPTPSEP

SEQ ID NO: 1028234 - protein, 9 aa, Homo Sapiens
ACPLMQNPQ

SEQ ID NO: 1028235 - protein, 9 aa, Homo Sapiens
NSHMVFAQI

SEQ ID NO: 1028236 - protein, 9 aa, Homo Sapiens
KFMLKEKPS

SEQ ID NO: 1028237 - protein, 9 aa, Homo Sapiens
KSPQPSSSS

SEQ ID NO: 1028238 - protein, 9 aa, Homo Sapiens
YFVEVSYME

SEQ ID NO: 1028239 - protein, 9 aa, Homo Sapiens
YKCLRCGKA

SEQ ID NO: 1028240 - protein, 9 aa, Homo Sapiens
RMEKINSKG

SEQ ID NO: 1028241 - protein, 9 aa, Homo Sapiens
KPKKPKQEF

SEQ ID NO: 1028242 - protein, 9 aa, Homo Sapiens
PPVQVIRAW

SEQ ID NO: 1028243 - protein, 9 aa, Homo Sapiens
GKDRRTEEE

SEQ ID NO: 1028244 - protein, 9 aa, Homo Sapiens
ENPGCRHQP

SEQ ID NO: 1028245 - protein, 9 aa, Homo Sapiens
LDKFLIIPL

SEQ ID NO: 1028246 - protein, 9 aa, Homo Sapiens
TGEIVVRLN

SEQ ID NO: 1028247 - protein, 9 aa, Homo Sapiens
ASHPNYPYL

SEQ ID NO: 1028248 - protein, 9 aa, Homo Sapiens
LLIDYLLST

SEQ ID NO: 1028249 - protein, 9 aa, Homo Sapiens
ISSERLASG

SEQ ID NO: 1028250 - protein, 9 aa, Homo Sapiens
MAFSLKRQF

SEQ ID NO: 1028251 - protein, 9 aa, Homo Sapiens
AHPNVDPCT

SEQ ID NO: 1028252 - protein, 9 aa, Homo Sapiens
DSEVEASLE

SEQ ID NO: 1028253 - protein, 9 aa, Homo Sapiens
SVTRSLRAR

SEQ ID NO: 1028254 - protein, 9 aa, Homo Sapiens
SWLRLRPQP

SEQ ID NO: 1028255 - protein, 9 aa, Homo Sapiens
GSKQERSTY

SEQ ID NO: 1028256 - protein, 9 aa, Homo Sapiens
LSIRAMIKS

SEQ ID NO: 1028257 - protein, 9 aa, Homo Sapiens
SVDAINFYD

SEQ ID NO: 1028258 - protein, 9 aa, Homo Sapiens
VTNYFFVNL

SEQ ID NO: 1028259 - protein, 9 aa, Homo Sapiens
LLGWNSKDS

SEQ ID NO: 1028260 - protein, 9 aa, Homo Sapiens
TFFKCSEIP

SEQ ID NO: 1028261 - protein, 9 aa, Homo Sapiens
GSRPRNCIG

SEQ ID NO: 1028262 - protein, 9 aa, Homo Sapiens
DTTLLARLL

SEQ ID NO: 1028263 - protein, 9 aa, Homo Sapiens
LLTLPVIIC

SEQ ID NO: 1028264 - protein, 9 aa, Homo Sapiens
PNSYGRRLI

SEQ ID NO: 1028265 - protein, 9 aa, Homo Sapiens
SLRSTASDC

SEQ ID NO: 1028266 - protein, 9 aa, Homo Sapiens
SPPSPNKES

SEQ ID NO: 1028267 - protein, 9 aa, Homo Sapiens
TTKVEKKRQ

SEQ ID NO: 1028268 - protein, 9 aa, Homo Sapiens
QGACRIYNF

SEQ ID NO: 1028269 - protein, 9 aa, Homo Sapiens
TILPHKFAF

SEQ ID NO: 1028270 - protein, 9 aa, Homo Sapiens
SELQEEDSL

SEQ ID NO: 1028271 - protein, 9 aa, Homo Sapiens
SSCTRNCMS

SEQ ID NO: 1028272 - protein, 9 aa, Homo Sapiens
QDLPPSQVF

SEQ ID NO: 1028273 - protein, 9 aa, Homo Sapiens
TSRSSDSDV

SEQ ID NO: 1028274 - protein, 9 aa, Homo Sapiens
SLWQELEVF

SEQ ID NO: 1028275 - protein, 9 aa, Homo Sapiens
SSPRSERQP

SEQ ID NO: 1028276 - protein, 9 aa, Homo Sapiens
IIIILQRSE

SEQ ID NO: 1028277 - protein, 9 aa, Homo Sapiens
LRHGLFYYM

SEQ ID NO: 1028278 - protein, 9 aa, Homo Sapiens
VTFLSHLAI

SEQ ID NO: 1028279 - protein, 9 aa, Homo Sapiens
EGPPPVLAF

SEQ ID NO: 1028280 - protein, 9 aa, Homo Sapiens
KGFIGFPGL

SEQ ID NO: 1028281 - protein, 9 aa, Homo Sapiens
QPTSVSFLK

SEQ ID NO: 1028282 - protein, 9 aa, Homo Sapiens
QDMNNLLSH

SEQ ID NO: 1028283 - protein, 9 aa, Homo Sapiens
MENTGKQVV

SEQ ID NO: 1028284 - protein, 9 aa, Homo Sapiens
NLQILACGG

SEQ ID NO: 1028285 - protein, 9 aa, Homo Sapiens
KYCIPEGIK

SEQ ID NO: 1028286 - protein, 9 aa, Homo Sapiens
RPSSSGSLP

SEQ ID NO: 1028287 - protein, 9 aa, Homo Sapiens
NNALQKNSN

SEQ ID NO: 1028288 - protein, 9 aa, Homo Sapiens
GIFADVTFL

SEQ ID NO: 1028289 - protein, 9 aa, Homo Sapiens
ALYQHYSCR

SEQ ID NO: 1028290 - protein, 9 aa, Homo Sapiens
ANYVQEVKR

SEQ ID NO: 1028291 - protein, 9 aa, Homo Sapiens
MLILLFYAN

SEQ ID NO: 1028292 - protein, 9 aa, Homo Sapiens
YINEDDLPR

SEQ ID NO: 1028293 - protein, 9 aa, Homo Sapiens
VHLQWKLIH

SEQ ID NO: 1028294 - protein, 9 aa, Homo Sapiens
QTEPKVVRT

SEQ ID NO: 1028295 - protein, 9 aa, Homo Sapiens
NNYPIFTEE

SEQ ID NO: 1028296 - protein, 9 aa, Homo Sapiens
LYHSDKFRA

SEQ ID NO: 1028297 - protein, 9 aa, Homo Sapiens
IAVEFASDY

SEQ ID NO: 1028298 - protein, 9 aa, Homo Sapiens
TKKETVQGP

SEQ ID NO: 1028299 - protein, 9 aa, Homo Sapiens
LKTLLSLVL

SEQ ID NO: 1028300 - protein, 9 aa, Homo Sapiens
LQIGCNKIG

SEQ ID NO: 1028301 - protein, 9 aa, Homo Sapiens
VKSLAKAHA

SEQ ID NO: 1028302 - protein, 9 aa, Homo Sapiens
NDATLYTES

SEQ ID NO: 1028303 - protein, 9 aa, Homo Sapiens
SLLKSKFCH

SEQ ID NO: 1028304 - protein, 9 aa, Homo Sapiens
SIKGPFYGE

SEQ ID NO: 1028305 - protein, 9 aa, Homo Sapiens
NADSLSSFP

SEQ ID NO: 1028306 - protein, 9 aa, Homo Sapiens
CCSSSENNS

SEQ ID NO: 1028307 - protein, 9 aa, Homo Sapiens
RNSHMVFAQ

SEQ ID NO: 1028308 - protein, 9 aa, Homo Sapiens
EAPESLPPL

SEQ ID NO: 1028309 - protein, 9 aa, Homo Sapiens
RERITVTGN

SEQ ID NO: 1028310 - protein, 9 aa, Homo Sapiens
YGKKKNAMY

SEQ ID NO: 1028311 - protein, 9 aa, Homo Sapiens
IFADVTFLS

SEQ ID NO: 1028312 - protein, 9 aa, Homo Sapiens
LLLKINRTT

SEQ ID NO: 1028313 - protein, 9 aa, Homo Sapiens
HITAKINAI

SEQ ID NO: 1028314 - protein, 9 aa, Homo Sapiens
CQSSRTTQA

SEQ ID NO: 1028315 - protein, 9 aa, Homo Sapiens
TCSPLQPHP

SEQ ID NO: 1028316 - protein, 9 aa, Homo Sapiens
CSQDEIPPE

SEQ ID NO: 1028317 - protein, 9 aa, Homo Sapiens
NIPVQTIFR

SEQ ID NO: 1028318 - protein, 9 aa, Homo Sapiens
KHAVAIIFY

SEQ ID NO: 1028319 - protein, 9 aa, Homo Sapiens
EIVVRLNLQ

SEQ ID NO: 1028320 - protein, 9 aa, Homo Sapiens
PPGLPGPPR

SEQ ID NO: 1028321 - protein, 9 aa, Homo Sapiens
YEIQKQINE

SEQ ID NO: 1028322 - protein, 9 aa, Homo Sapiens
LSSSPGLGE

SEQ ID NO: 1028323 - protein, 9 aa, Homo Sapiens
ISLWLQNFV

SEQ ID NO: 1028324 - protein, 9 aa, Homo Sapiens
SNNMCLKVK

SEQ ID NO: 1028325 - protein, 9 aa, Homo Sapiens
LRGGARRRG

SEQ ID NO: 1028326 - protein, 9 aa, Homo Sapiens
PAGNQTSSG

SEQ ID NO: 1028327 - protein, 9 aa, Homo Sapiens
ITDFAEKLA

SEQ ID NO: 1028328 - protein, 9 aa, Homo Sapiens
KVMEYTTIL

SEQ ID NO: 1028329 - protein, 9 aa, Homo Sapiens
ACRIYNFVF

SEQ ID NO: 1028330 - protein, 9 aa, Homo Sapiens
HIQELETGR

SEQ ID NO: 1028331 - protein, 9 aa, Homo Sapiens
NANYVQEVK

SEQ ID NO: 1028332 - protein, 9 aa, Homo Sapiens
NSSSYLHFS

SEQ ID NO: 1028333 - protein, 9 aa, Homo Sapiens
SSEPWLWPP

SEQ ID NO: 1028334 - protein, 9 aa, Homo Sapiens
VDMQDMNNL

SEQ ID NO: 1028335 - protein, 9 aa, Homo Sapiens
TLLRSSGSP

SEQ ID NO: 1028336 - protein, 9 aa, Homo Sapiens
NFYDKIRKG

SEQ ID NO: 1028337 - protein, 9 aa, Homo Sapiens
GGTTTPWSL

SEQ ID NO: 1028338 - protein, 9 aa, Homo Sapiens
SEIQVTCDA

SEQ ID NO: 1028339 - protein, 9 aa, Homo Sapiens
NVECACVYA

SEQ ID NO: 1028340 - protein, 9 aa, Homo Sapiens
NDLLFSIVE

SEQ ID NO: 1028341 - protein, 9 aa, Homo Sapiens
LAAIYAGLR

SEQ ID NO: 1028342 - protein, 9 aa, Homo Sapiens
QSLMGMNLP

SEQ ID NO: 1028343 - protein, 9 aa, Homo Sapiens
TTTTTMTPA

SEQ ID NO: 1028344 - protein, 9 aa, Homo Sapiens
NKKKMTNSC

SEQ ID NO: 1028345 - protein, 9 aa, Homo Sapiens
LMQQRISSI

SEQ ID NO: 1028346 - protein, 9 aa, Homo Sapiens
EDILNTATP

SEQ ID NO: 1028347 - protein, 9 aa, Homo Sapiens
SIWFLLNEL

SEQ ID NO: 1028348 - protein, 9 aa, Homo Sapiens
MTVLLTYLC

SEQ ID NO: 1028349 - protein, 9 aa, Homo Sapiens
YDKQPKDFP

SEQ ID NO: 1028350 - protein, 9 aa, Homo Sapiens
PVIPDTKPY

SEQ ID NO: 1028351 - protein, 9 aa, Homo Sapiens
QRLQDSRMT

SEQ ID NO: 1028352 - protein, 9 aa, Homo Sapiens
LVNFFVLLS

SEQ ID NO: 1028353 - protein, 9 aa, Homo Sapiens
SNQEEEEPS

SEQ ID NO: 1028354 - protein, 9 aa, Homo Sapiens
NQDPVSPNL

SEQ ID NO: 1028355 - protein, 9 aa, Homo Sapiens
LDRVLKPKT

SEQ ID NO: 1028356 - protein, 9 aa, Homo Sapiens
RPIKAPVYM

SEQ ID NO: 1028357 - protein, 9 aa, Homo Sapiens
VSSSPVFMT

SEQ ID NO: 1028358 - protein, 9 aa, Homo Sapiens
LHKVHESRN

SEQ ID NO: 1028359 - protein, 9 aa, Homo Sapiens
LSSPSRLPG

SEQ ID NO: 1028360 - protein, 9 aa, Homo Sapiens
RGHMPYTDV

SEQ ID NO: 1028361 - protein, 9 aa, Homo Sapiens
SIPWLGYVL

SEQ ID NO: 1028362 - protein, 9 aa, Homo Sapiens
CSTLGMDCE

SEQ ID NO: 1028363 - protein, 9 aa, Homo Sapiens
PQALPRLSL

SEQ ID NO: 1028364 - protein, 9 aa, Homo Sapiens
IFLRSWREL

SEQ ID NO: 1028365 - protein, 9 aa, Homo Sapiens
NLLVDSLDE

SEQ ID NO: 1028366 - protein, 9 aa, Homo Sapiens
SIPQSAPLT

SEQ ID NO: 1028367 - protein, 9 aa, Homo Sapiens
QIFQLHMKG

SEQ ID NO: 1028368 - protein, 9 aa, Homo Sapiens
DAINFYDKI

SEQ ID NO: 1028369 - protein, 9 aa, Homo Sapiens
HLEGGYCSP

SEQ ID NO: 1028370 - protein, 9 aa, Homo Sapiens
KNKAKTADV

SEQ ID NO: 1028371 - protein, 9 aa, Homo Sapiens
AFTFQLTGF

SEQ ID NO: 1028372 - protein, 9 aa, Homo Sapiens
PGWSLSIRA

SEQ ID NO: 1028373 - protein, 9 aa, Homo Sapiens
RAPSWRGLA

SEQ ID NO: 1028374 - protein, 9 aa, Homo Sapiens
LPVYVGGIP

SEQ ID NO: 1028375 - protein, 9 aa, Homo Sapiens
SMFSPSSLR

SEQ ID NO: 1028376 - protein, 9 aa, Homo Sapiens
SEDILNTAT

SEQ ID NO: 1028377 - protein, 9 aa, Homo Sapiens
VKKILENKA

SEQ ID NO: 1028378 - protein, 9 aa, Homo Sapiens
LDNKSHGSR

SEQ ID NO: 1028379 - protein, 9 aa, Homo Sapiens
RGAEGQSMS

SEQ ID NO: 1028380 - protein, 9 aa, Homo Sapiens
QYGARQPRA

SEQ ID NO: 1028381 - protein, 9 aa, Homo Sapiens
MSYFVEVSY

SEQ ID NO: 1028382 - protein, 9 aa, Homo Sapiens
KKVTRNMIC

SEQ ID NO: 1028383 - protein, 9 aa, Homo Sapiens
CAEPANTSL

SEQ ID NO: 1028384 - protein, 9 aa, Homo Sapiens
SEYWVASEG

SEQ ID NO: 1028385 - protein, 9 aa, Homo Sapiens
NSYQGAQVG

SEQ ID NO: 1028386 - protein, 9 aa, Homo Sapiens
FLPSSPLPS

SEQ ID NO: 1028387 - protein, 9 aa, Homo Sapiens
GYRVWKYLF

SEQ ID NO: 1028388 - protein, 9 aa, Homo Sapiens
SFTKLARAS

SEQ ID NO: 1028389 - protein, 9 aa, Homo Sapiens
GMSSSEKPA

SEQ ID NO: 1028390 - protein, 9 aa, Homo Sapiens
LLSVALKGM

SEQ ID NO: 1028391 - protein, 9 aa, Homo Sapiens
PSLGREILL

SEQ ID NO: 1028392 - protein, 9 aa, Homo Sapiens
ALFLKASDE

SEQ ID NO: 1028393 - protein, 9 aa, Homo Sapiens
SSEESGKKK

SEQ ID NO: 1028394 - protein, 9 aa, Homo Sapiens
KNLTVVEGA

SEQ ID NO: 1028395 - protein, 9 aa, Homo Sapiens
HPNYPYLDE

SEQ ID NO: 1028396 - protein, 9 aa, Homo Sapiens
PALTVVLKG

SEQ ID NO: 1028397 - protein, 9 aa, Homo Sapiens
VEPAGGSKQ

SEQ ID NO: 1028398 - protein, 9 aa, Homo Sapiens
LLLLDLPKG

SEQ ID NO: 1028399 - protein, 9 aa, Homo Sapiens
FKLKLQIHR

SEQ ID NO: 1028400 - protein, 9 aa, Homo Sapiens
EFSPAASKY

SEQ ID NO: 1028401 - protein, 9 aa, Homo Sapiens
SNKNKKEKS

SEQ ID NO: 1028402 - protein, 9 aa, Homo Sapiens
TPALTVVLK

SEQ ID NO: 1028403 - protein, 9 aa, Homo Sapiens
CNVRDTTLL

SEQ ID NO: 1028404 - protein, 9 aa, Homo Sapiens
PHYIPKPPG

SEQ ID NO: 1028405 - protein, 9 aa, Homo Sapiens
YLRYEFLML

SEQ ID NO: 1028406 - protein, 9 aa, Homo Sapiens
CRNRATCIS

SEQ ID NO: 1028407 - protein, 9 aa, Homo Sapiens
RPVSAGLFP

SEQ ID NO: 1028408 - protein, 9 aa, Homo Sapiens
LKIHFNFEL

SEQ ID NO: 1028409 - protein, 9 aa, Homo Sapiens
CFCPDQHGH

SEQ ID NO: 1028410 - protein, 9 aa, Homo Sapiens
GENMLIIVV

SEQ ID NO: 1028411 - protein, 9 aa, Homo Sapiens
EKINSKGLA

SEQ ID NO: 1028412 - protein, 9 aa, Homo Sapiens
SSHSGKSVV

SEQ ID NO: 1028413 - protein, 9 aa, Homo Sapiens
PARGEEGLS

SEQ ID NO: 1028414 - protein, 9 aa, Homo Sapiens
YEYELCLDL

SEQ ID NO: 1028415 - protein, 9 aa, Homo Sapiens
GPDGISVGA

SEQ ID NO: 1028416 - protein, 9 aa, Homo Sapiens
FFRRSEAEL

SEQ ID NO: 1028417 - protein, 9 aa, Homo Sapiens
GLLLLLVVD

SEQ ID NO: 1028418 - protein, 9 aa, Homo Sapiens
NLTDESDSC

SEQ ID NO: 1028419 - protein, 9 aa, Homo Sapiens
FPLPSPAPS

SEQ ID NO: 1028420 - protein, 9 aa, Homo Sapiens
YDYVDVEIL

SEQ ID NO: 1028421 - protein, 9 aa, Homo Sapiens
TYSWMNLSR

SEQ ID NO: 1028422 - protein, 9 aa, Homo Sapiens
FLPAKALTE

SEQ ID NO: 1028423 - protein, 9 aa, Homo Sapiens
NNTLLYIFH

SEQ ID NO: 1028424 - protein, 9 aa, Homo Sapiens
PSKRPSPNY

SEQ ID NO: 1028425 - protein, 9 aa, Homo Sapiens
IIWNKKPRW

SEQ ID NO: 1028426 - protein, 9 aa, Homo Sapiens
TAPPACQPL

SEQ ID NO: 1028427 - protein, 9 aa, Homo Sapiens
LFSWPLYSM

SEQ ID NO: 1028428 - protein, 9 aa, Homo Sapiens
KEFIKDGHW

SEQ ID NO: 1028429 - protein, 9 aa, Homo Sapiens
ACLARLLKK

SEQ ID NO: 1028430 - protein, 9 aa, Homo Sapiens
YLLERTNDK

SEQ ID NO: 1028431 - protein, 9 aa, Homo Sapiens
AEPAQSPAE

SEQ ID NO: 1028432 - protein, 9 aa, Homo Sapiens
PTKERTLSA

SEQ ID NO: 1028433 - protein, 9 aa, Homo Sapiens
HGPYGEKMA

SEQ ID NO: 1028434 - protein, 9 aa, Homo Sapiens
RHGPSQDED

SEQ ID NO: 1028435 - protein, 9 aa, Homo Sapiens
WGQFLDYDL

SEQ ID NO: 1028436 - protein, 9 aa, Homo Sapiens
PRSSPRSER

SEQ ID NO: 1028437 - protein, 9 aa, Homo Sapiens
AQEVLAGLQ

SEQ ID NO: 1028438 - protein, 9 aa, Homo Sapiens
KKYSVATHL

SEQ ID NO: 1028439 - protein, 9 aa, Homo Sapiens
EVLSEPLPE

SEQ ID NO: 1028440 - protein, 9 aa, Homo Sapiens
AVAMQLLQI

SEQ ID NO: 1028441 - protein, 9 aa, Homo Sapiens
VKVSNEYVT

SEQ ID NO: 1028442 - protein, 9 aa, Homo Sapiens
DIKGIEDIY

SEQ ID NO: 1028443 - protein, 9 aa, Homo Sapiens
ASDPKKAPP

SEQ ID NO: 1028444 - protein, 9 aa, Homo Sapiens
KKLKNAINK

SEQ ID NO: 1028445 - protein, 9 aa, Homo Sapiens
TQAFLPSSP

SEQ ID NO: 1028446 - protein, 9 aa, Homo Sapiens
GMCRVIPPL

SEQ ID NO: 1028447 - protein, 9 aa, Homo Sapiens
AGLLLLLVV

SEQ ID NO: 1028448 - protein, 9 aa, Homo Sapiens
IRGEAFLFA

SEQ ID NO: 1028449 - protein, 9 aa, Homo Sapiens
SGTSATQGL

SEQ ID NO: 1028450 - protein, 9 aa, Homo Sapiens
ASRCPRGSQ

SEQ ID NO: 1028451 - protein, 9 aa, Homo Sapiens
EPSLPSYRI

SEQ ID NO: 1028452 - protein, 9 aa, Homo Sapiens
NSLTQKLQE

SEQ ID NO: 1028453 - protein, 9 aa, Homo Sapiens
QQLPTCSPL

SEQ ID NO: 1028454 - protein, 9 aa, Homo Sapiens
PETSRPSLL

SEQ ID NO: 1028455 - protein, 9 aa, Homo Sapiens
FEILLDKNS

SEQ ID NO: 1028456 - protein, 9 aa, Homo Sapiens
GRRLIQVMM

SEQ ID NO: 1028457 - protein, 9 aa, Homo Sapiens
IQSMHNDAT

SEQ ID NO: 1028458 - protein, 9 aa, Homo Sapiens
EWFLLNKPS

SEQ ID NO: 1028459 - protein, 9 aa, Homo Sapiens
KVGLPLDIK

SEQ ID NO: 1028460 - protein, 9 aa, Homo Sapiens
FIYVRPVLN

SEQ ID NO: 1028461 - protein, 9 aa, Homo Sapiens
IPQMLVVLW

SEQ ID NO: 1028462 - protein, 9 aa, Homo Sapiens
ALFSWPLYS

SEQ ID NO: 1028463 - protein, 9 aa, Homo Sapiens
KAVSREDSV

SEQ ID NO: 1028464 - protein, 9 aa, Homo Sapiens
PTGGSDEWQ

SEQ ID NO: 1028465 - protein, 9 aa, Homo Sapiens
SRHQYGARQ

SEQ ID NO: 1028466 - protein, 9 aa, Homo Sapiens
HCFSHSSPR

SEQ ID NO: 1028467 - protein, 9 aa, Homo Sapiens
SQALEARLE

SEQ ID NO: 1028468 - protein, 9 aa, Homo Sapiens
GTVFGASLD

SEQ ID NO: 1028469 - protein, 9 aa, Homo Sapiens
RSWPERSEL

SEQ ID NO: 1028470 - protein, 9 aa, Homo Sapiens
LNQGDTWSF

SEQ ID NO: 1028471 - protein, 9 aa, Homo Sapiens
RNQSSVDQG

SEQ ID NO: 1028472 - protein, 9 aa, Homo Sapiens
MKNTMKNQK

SEQ ID NO: 1028473 - protein, 9 aa, Homo Sapiens
PGEELYLSC

SEQ ID NO: 1028474 - protein, 9 aa, Homo Sapiens
RQQQRRALS

SEQ ID NO: 1028475 - protein, 9 aa, Homo Sapiens
QSCGVPEGH

SEQ ID NO: 1028476 - protein, 9 aa, Homo Sapiens
AKYFSLSSV

SEQ ID NO: 1028477 - protein, 9 aa, Homo Sapiens
HRDSLHLCR

SEQ ID NO: 1028478 - protein, 9 aa, Homo Sapiens
LYFPDLLRM

SEQ ID NO: 1028479 - protein, 9 aa, Homo Sapiens
EERNFFLNG

SEQ ID NO: 1028480 - protein, 9 aa, Homo Sapiens
IEMFREKNV

SEQ ID NO: 1028481 - protein, 9 aa, Homo Sapiens
FPDIIIILQ

SEQ ID NO: 1028482 - protein, 9 aa, Homo Sapiens
KRKIRSWPE

SEQ ID NO: 1028483 - protein, 9 aa, Homo Sapiens
PKKGEVQDS

SEQ ID NO: 1028484 - protein, 9 aa, Homo Sapiens
PLSINAKCH

SEQ ID NO: 1028485 - protein, 9 aa, Homo Sapiens
LPNFLEKLP

SEQ ID NO: 1028486 - protein, 9 aa, Homo Sapiens
PQFPKSIFH

SEQ ID NO: 1028487 - protein, 9 aa, Homo Sapiens
SFYTKNLIV

SEQ ID NO: 1028488 - protein, 9 aa, Homo Sapiens
EPLVAGPGR

SEQ ID NO: 1028489 - protein, 9 aa, Homo Sapiens
AGLLGEGCV

SEQ ID NO: 1028490 - protein, 9 aa, Homo Sapiens
TPYNIVIFL

SEQ ID NO: 1028491 - protein, 9 aa, Homo Sapiens
QGPKGSLEF

SEQ ID NO: 1028492 - protein, 9 aa, Homo Sapiens
SGRNCTCFP

SEQ ID NO: 1028493 - protein, 9 aa, Homo Sapiens
GCCSFIGKD

SEQ ID NO: 1028494 - protein, 9 aa, Homo Sapiens
ESSLSDAGP

SEQ ID NO: 1028495 - protein, 9 aa, Homo Sapiens
ANALCYCNK

SEQ ID NO: 1028496 - protein, 9 aa, Homo Sapiens
KAWHKCEML

SEQ ID NO: 1028497 - protein, 9 aa, Homo Sapiens
SSLNQHQKT

SEQ ID NO: 1028498 - protein, 9 aa, Homo Sapiens
KIFKRGPEC

SEQ ID NO: 1028499 - protein, 9 aa, Homo Sapiens
SFARLYFPD

SEQ ID NO: 1028500 - protein, 9 aa, Homo Sapiens
INADSLSSF

SEQ ID NO: 1028501 - protein, 9 aa, Homo Sapiens
YRDQNKCKE

SEQ ID NO: 1028502 - protein, 9 aa, Homo Sapiens
SDYADSQKM

SEQ ID NO: 1028503 - protein, 9 aa, Homo Sapiens
EVFVEKIPR

SEQ ID NO: 1028504 - protein, 9 aa, Homo Sapiens
IVIFLNTFQ

SEQ ID NO: 1028505 - protein, 9 aa, Homo Sapiens
KMINFFSTK

SEQ ID NO: 1028506 - protein, 9 aa, Homo Sapiens
EIRAEEISE

SEQ ID NO: 1028507 - protein, 9 aa, Homo Sapiens
KEEKALNLK

SEQ ID NO: 1028508 - protein, 9 aa, Homo Sapiens
AKRTTPNGH

SEQ ID NO: 1028509 - protein, 9 aa, Homo Sapiens
VLLKERLTE

SEQ ID NO: 1028510 - protein, 9 aa, Homo Sapiens
MKNYEKSKK

SEQ ID NO: 1028511 - protein, 9 aa, Homo Sapiens
AASTVLFMM

SEQ ID NO: 1028512 - protein, 9 aa, Homo Sapiens
YAVAMQLLQ

SEQ ID NO: 1028513 - protein, 9 aa, Homo Sapiens
ELRHGLFYY

SEQ ID NO: 1028514 - protein, 9 aa, Homo Sapiens
KVDKAEYMC

SEQ ID NO: 1028515 - protein, 9 aa, Homo Sapiens
KKVLLFYYT

SEQ ID NO: 1028516 - protein, 9 aa, Homo Sapiens
AGLLKFADN

SEQ ID NO: 1028517 - protein, 9 aa, Homo Sapiens
LQYFLQRIQ

SEQ ID NO: 1028518 - protein, 9 aa, Homo Sapiens
VEAKRLKAF

SEQ ID NO: 1028519 - protein, 9 aa, Homo Sapiens
KFLRLSDDE

SEQ ID NO: 1028520 - protein, 9 aa, Homo Sapiens
PKLLEVSEP

SEQ ID NO: 1028521 - protein, 9 aa, Homo Sapiens
RNMICAGEK

SEQ ID NO: 1028522 - protein, 9 aa, Homo Sapiens
GGVAVGTLC

SEQ ID NO: 1028523 - protein, 9 aa, Homo Sapiens
KAEIDDLNV

SEQ ID NO: 1028524 - protein, 9 aa, Homo Sapiens
VHEGVAVVS

SEQ ID NO: 1028525 - protein, 9 aa, Homo Sapiens
YVDVEILTS

SEQ ID NO: 1028526 - protein, 9 aa, Homo Sapiens
ANEKTTLSS

SEQ ID NO: 1028527 - protein, 9 aa, Homo Sapiens
WLQRLERDD

SEQ ID NO: 1028528 - protein, 9 aa, Homo Sapiens
DLKKLLTQY

SEQ ID NO: 1028529 - protein, 9 aa, Homo Sapiens
AFFRRSEAE

SEQ ID NO: 1028530 - protein, 9 aa, Homo Sapiens
NCFTPANYF

SEQ ID NO: 1028531 - protein, 9 aa, Homo Sapiens
TMECSSSAQ

SEQ ID NO: 1028532 - protein, 9 aa, Homo Sapiens
SGGKLSQTC

SEQ ID NO: 1028533 - protein, 9 aa, Homo Sapiens
GRVRLWLQA

SEQ ID NO: 1028534 - protein, 9 aa, Homo Sapiens
FSGFPRVEP

SEQ ID NO: 1028535 - protein, 9 aa, Homo Sapiens
DYMISAKTL

SEQ ID NO: 1028536 - protein, 9 aa, Homo Sapiens
KAEDDVEKN

SEQ ID NO: 1028537 - protein, 9 aa, Homo Sapiens
QRILVSERS

SEQ ID NO: 1028538 - protein, 9 aa, Homo Sapiens
YGSIFTNAQ

SEQ ID NO: 1028539 - protein, 9 aa, Homo Sapiens
AVLLLLDLP

SEQ ID NO: 1028540 - protein, 9 aa, Homo Sapiens
REPDQLETQ

SEQ ID NO: 1028541 - protein, 9 aa, Homo Sapiens
KDGITRVYK

SEQ ID NO: 1028542 - protein, 9 aa, Homo Sapiens
SSSEPWLWP

SEQ ID NO: 1028543 - protein, 9 aa, Homo Sapiens
TSSNYDKQP

SEQ ID NO: 1028544 - protein, 9 aa, Homo Sapiens
AELPLFCSL

SEQ ID NO: 1028545 - protein, 9 aa, Homo Sapiens
NSVNVMPFA

SEQ ID NO: 1028546 - protein, 9 aa, Homo Sapiens
HWVYDGVEN

SEQ ID NO: 1028547 - protein, 9 aa, Homo Sapiens
SGGNDGHHR

SEQ ID NO: 1028548 - protein, 9 aa, Homo Sapiens
QSFGFGQHE

SEQ ID NO: 1028549 - protein, 9 aa, Homo Sapiens
DPSVSQRAA

SEQ ID NO: 1028550 - protein, 9 aa, Homo Sapiens
LTKALFPNM

SEQ ID NO: 1028551 - protein, 9 aa, Homo Sapiens
WSHQGPQLL

SEQ ID NO: 1028552 - protein, 9 aa, Homo Sapiens
TITNNFGSV

SEQ ID NO: 1028553 - protein, 9 aa, Homo Sapiens
GCSKMYIKS

SEQ ID NO: 1028554 - protein, 9 aa, Homo Sapiens
KLCFLEFDY

SEQ ID NO: 1028555 - protein, 9 aa, Homo Sapiens
EVSELPLVV

SEQ ID NO: 1028556 - protein, 9 aa, Homo Sapiens
AQFPCCQSS

SEQ ID NO: 1028557 - protein, 9 aa, Homo Sapiens
FLVVSPHED

SEQ ID NO: 1028558 - protein, 9 aa, Homo Sapiens
IQKLPKNPQ

SEQ ID NO: 1028559 - protein, 9 aa, Homo Sapiens
RPAELGVLY

SEQ ID NO: 1028560 - protein, 9 aa, Homo Sapiens
ILMLVSTSY

SEQ ID NO: 1028561 - protein, 9 aa, Homo Sapiens
HKEQGPKHH

SEQ ID NO: 1028562 - protein, 9 aa, Homo Sapiens
EAQIFFLQG

SEQ ID NO: 1028563 - protein, 9 aa, Homo Sapiens
NYEGGSGSG

SEQ ID NO: 1028564 - protein, 9 aa, Homo Sapiens
QTLQGLQLD

SEQ ID NO: 1028565 - protein, 9 aa, Homo Sapiens
QPAGNQTSS

SEQ ID NO: 1028566 - protein, 9 aa, Homo Sapiens
YTKNLIVMG

SEQ ID NO: 1028567 - protein, 9 aa, Homo Sapiens
HFKLKLQIH

SEQ ID NO: 1028568 - protein, 9 aa, Homo Sapiens
PDSIWFLLN

SEQ ID NO: 1028569 - protein, 9 aa, Homo Sapiens
LTKKETVQG

SEQ ID NO: 1028570 - protein, 9 aa, Homo Sapiens
FYVAGILHA

SEQ ID NO: 1028571 - protein, 9 aa, Homo Sapiens
PLVSITINS

SEQ ID NO: 1028572 - protein, 9 aa, Homo Sapiens
HAVAIIFYD

SEQ ID NO: 1028573 - protein, 9 aa, Homo Sapiens
RRNIHKLFD

SEQ ID NO: 1028574 - protein, 9 aa, Homo Sapiens
PPARGEEGL

SEQ ID NO: 1028575 - protein, 9 aa, Homo Sapiens
FFRHQMKSL

SEQ ID NO: 1028576 - protein, 9 aa, Homo Sapiens
GTVKIVIDC

SEQ ID NO: 1028577 - protein, 9 aa, Homo Sapiens
FLPAPARAF

SEQ ID NO: 1028578 - protein, 9 aa, Homo Sapiens
ELKCSTLGM

SEQ ID NO: 1028579 - protein, 9 aa, Homo Sapiens
TRERSRKGS

SEQ ID NO: 1028580 - protein, 9 aa, Homo Sapiens
VKIKKQSNN

SEQ ID NO: 1028581 - protein, 9 aa, Homo Sapiens
LCRRSAVPF

SEQ ID NO: 1028582 - protein, 9 aa, Homo Sapiens
LGQEMIGSL

SEQ ID NO: 1028583 - protein, 9 aa, Homo Sapiens
PSELHKVHE

SEQ ID NO: 1028584 - protein, 9 aa, Homo Sapiens
NQKNLNRET

SEQ ID NO: 1028585 - protein, 9 aa, Homo Sapiens
VSMETIQKS

SEQ ID NO: 1028586 - protein, 9 aa, Homo Sapiens
IVDSENCRI

SEQ ID NO: 1028587 - protein, 9 aa, Homo Sapiens
TKSPQPSSS

SEQ ID NO: 1028588 - protein, 9 aa, Homo Sapiens
CPRGSQAPL

SEQ ID NO: 1028589 - protein, 9 aa, Homo Sapiens
PLMQNPQGT

SEQ ID NO: 1028590 - protein, 9 aa, Homo Sapiens
LSKDTLLSP

SEQ ID NO: 1028591 - protein, 9 aa, Homo Sapiens
MATVASSSF

SEQ ID NO: 1028592 - protein, 9 aa, Homo Sapiens
EPARFTPKI

SEQ ID NO: 1028593 - protein, 9 aa, Homo Sapiens
SSSSRKSPL

SEQ ID NO: 1028594 - protein, 9 aa, Homo Sapiens
ANQDPVSPN

SEQ ID NO: 1028595 - protein, 9 aa, Homo Sapiens
FLADQLDLI

SEQ ID NO: 1028596 - protein, 9 aa, Homo Sapiens
SEFFSQQKE

SEQ ID NO: 1028597 - protein, 9 aa, Homo Sapiens
PQQLGTINA

SEQ ID NO: 1028598 - protein, 9 aa, Homo Sapiens
VAMGSAYGF

SEQ ID NO: 1028599 - protein, 9 aa, Homo Sapiens
CLCASSAQV

SEQ ID NO: 1028600 - protein, 9 aa, Homo Sapiens
TDFFAKKII

SEQ ID NO: 1028601 - protein, 9 aa, Homo Sapiens
QAVLQICPL

SEQ ID NO: 1028602 - protein, 9 aa, Homo Sapiens
IVIGLLLVL

SEQ ID NO: 1028603 - protein, 9 aa, Homo Sapiens
SGIALFSWP

SEQ ID NO: 1028604 - protein, 9 aa, Homo Sapiens
WRGLAEPGS

SEQ ID NO: 1028605 - protein, 9 aa, Homo Sapiens
KENSFTYFY

SEQ ID NO: 1028606 - protein, 9 aa, Homo Sapiens
HKPEPLVAG

SEQ ID NO: 1028607 - protein, 9 aa, Homo Sapiens
HEANEDCIY

SEQ ID NO: 1028608 - protein, 9 aa, Homo Sapiens
EEMMWEKEK

SEQ ID NO: 1028609 - protein, 9 aa, Homo Sapiens
PMAFSLKRQ

SEQ ID NO: 1028610 - protein, 9 aa, Homo Sapiens
LGHQKRLAH

SEQ ID NO: 1028611 - protein, 9 aa, Homo Sapiens
VQLSASCLP

SEQ ID NO: 1028612 - protein, 9 aa, Homo Sapiens
KETVQGPIA

SEQ ID NO: 1028613 - protein, 9 aa, Homo Sapiens
EQLTCTQEE

SEQ ID NO: 1028614 - protein, 9 aa, Homo Sapiens
LKYITGNNL

SEQ ID NO: 1028615 - protein, 9 aa, Homo Sapiens
MIVYLGMMT

SEQ ID NO: 1028616 - protein, 9 aa, Homo Sapiens
IDLRLCPSP

SEQ ID NO: 1028617 - protein, 9 aa, Homo Sapiens
AGPVVVLPD

SEQ ID NO: 1028618 - protein, 9 aa, Homo Sapiens
YIFMDDDFQ

SEQ ID NO: 1028619 - protein, 9 aa, Homo Sapiens
INWNRLFSP

SEQ ID NO: 1028620 - protein, 9 aa, Homo Sapiens
ASAILSLRQ

SEQ ID NO: 1028621 - protein, 9 aa, Homo Sapiens
IDYEIQKQI

SEQ ID NO: 1028622 - protein, 9 aa, Homo Sapiens
THIALCTVR

SEQ ID NO: 1028623 - protein, 9 aa, Homo Sapiens
TNYFFVNLA

SEQ ID NO: 1028624 - protein, 9 aa, Homo Sapiens
IDEIEEMPT

SEQ ID NO: 1028625 - protein, 9 aa, Homo Sapiens
ETKLALKYL

SEQ ID NO: 1028626 - protein, 9 aa, Homo Sapiens
EKKDRAPGE

SEQ ID NO: 1028627 - protein, 9 aa, Homo Sapiens
GVRETPWEA

SEQ ID NO: 1028628 - protein, 9 aa, Homo Sapiens
AGNQTSSGA

SEQ ID NO: 1028629 - protein, 9 aa, Homo Sapiens
EQEVTASAP

SEQ ID NO: 1028630 - protein, 9 aa, Homo Sapiens
DIKKWDQFY

SEQ ID NO: 1028631 - protein, 9 aa, Homo Sapiens
KSREIDWAR

SEQ ID NO: 1028632 - protein, 9 aa, Homo Sapiens
NSSTAHPVV

SEQ ID NO: 1028633 - protein, 9 aa, Homo Sapiens
ISAGSSTSG

SEQ ID NO: 1028634 - protein, 9 aa, Homo Sapiens
YESDVIGRG

SEQ ID NO: 1028635 - protein, 9 aa, Homo Sapiens
LKKLKGRIT

SEQ ID NO: 1028636 - protein, 9 aa, Homo Sapiens
KVLLFYYTQ

SEQ ID NO: 1028637 - protein, 9 aa, Homo Sapiens
SSSPGLGET

SEQ ID NO: 1028638 - protein, 9 aa, Homo Sapiens
VTPMLNSAI

SEQ ID NO: 1028639 - protein, 9 aa, Homo Sapiens
TLGLWKTFP

SEQ ID NO: 1028640 - protein, 9 aa, Homo Sapiens
AKSIYPLAL

SEQ ID NO: 1028641 - protein, 9 aa, Homo Sapiens
PVYLYPQDP

SEQ ID NO: 1028642 - protein, 9 aa, Homo Sapiens
MMHGIVDSE

SEQ ID NO: 1028643 - protein, 9 aa, Homo Sapiens
MTFTKTFQK

SEQ ID NO: 1028644 - protein, 9 aa, Homo Sapiens
LMWKIFTLG

SEQ ID NO: 1028645 - protein, 9 aa, Homo Sapiens
LMGMNLPGQ

SEQ ID NO: 1028646 - protein, 9 aa, Homo Sapiens
AGETPGETV

SEQ ID NO: 1028647 - protein, 9 aa, Homo Sapiens
SSLLDYSFQ

SEQ ID NO: 1028648 - protein, 9 aa, Homo Sapiens
RSFARLYFP

SEQ ID NO: 1028649 - protein, 9 aa, Homo Sapiens
SQGPVSFPG

SEQ ID NO: 1028650 - protein, 9 aa, Homo Sapiens
YARVPSNDL

SEQ ID NO: 1028651 - protein, 9 aa, Homo Sapiens
PYPSEVCRR

SEQ ID NO: 1028652 - protein, 9 aa, Homo Sapiens
KWCPKKRRK

SEQ ID NO: 1028653 - protein, 9 aa, Homo Sapiens
PEGCPESET

SEQ ID NO: 1028654 - protein, 9 aa, Homo Sapiens
ELGTLRREP

SEQ ID NO: 1028655 - protein, 9 aa, Homo Sapiens
TFFNGYNDL

SEQ ID NO: 1028656 - protein, 9 aa, Homo Sapiens
PKYYGQGSK

SEQ ID NO: 1028657 - protein, 9 aa, Homo Sapiens
TNSLTQKLQ

SEQ ID NO: 1028658 - protein, 9 aa, Homo Sapiens
LSTQKLEEA

SEQ ID NO: 1028659 - protein, 9 aa, Homo Sapiens
AAVSSRVSA

SEQ ID NO: 1028660 - protein, 9 aa, Homo Sapiens
LILVCCLDF

SEQ ID NO: 1028661 - protein, 9 aa, Homo Sapiens
LPLSTVTEI

SEQ ID NO: 1028662 - protein, 9 aa, Homo Sapiens
LDEKNCVCR

SEQ ID NO: 1028663 - protein, 9 aa, Homo Sapiens
LEREIKKSI

SEQ ID NO: 1028664 - protein, 9 aa, Homo Sapiens
LQEKKCIML

SEQ ID NO: 1028665 - protein, 9 aa, Homo Sapiens
TQAQTCDSS

SEQ ID NO: 1028666 - protein, 9 aa, Homo Sapiens
DRAKANPKG

SEQ ID NO: 1028667 - protein, 9 aa, Homo Sapiens
DNLGMGGTR

SEQ ID NO: 1028668 - protein, 9 aa, Homo Sapiens
RSKPVADGG

SEQ ID NO: 1028669 - protein, 9 aa, Homo Sapiens
AFVALRKII

SEQ ID NO: 1028670 - protein, 9 aa, Homo Sapiens
LCSDTWVIE

SEQ ID NO: 1028671 - protein, 9 aa, Homo Sapiens
LDNLGVDAA

SEQ ID NO: 1028672 - protein, 9 aa, Homo Sapiens
IGRGHARLV

SEQ ID NO: 1028673 - protein, 9 aa, Homo Sapiens
HELSGNKSL

SEQ ID NO: 1028674 - protein, 9 aa, Homo Sapiens
VATTVLFSA

SEQ ID NO: 1028675 - protein, 9 aa, Homo Sapiens
KWLEDVCVA

SEQ ID NO: 1028676 - protein, 9 aa, Homo Sapiens
LSNNKLCDL

SEQ ID NO: 1028677 - protein, 9 aa, Homo Sapiens
LMKVDPDSI

SEQ ID NO: 1028678 - protein, 9 aa, Homo Sapiens
GSLLAMWNE

SEQ ID NO: 1028679 - protein, 9 aa, Homo Sapiens
VPGCFLARF

SEQ ID NO: 1028680 - protein, 9 aa, Homo Sapiens
IIPQMLVVL

SEQ ID NO: 1028681 - protein, 9 aa, Homo Sapiens
AMGAAAGVF

SEQ ID NO: 1028682 - protein, 9 aa, Homo Sapiens
HGHKEQGPK

SEQ ID NO: 1028683 - protein, 9 aa, Homo Sapiens
IEDENNNYP

SEQ ID NO: 1028684 - protein, 9 aa, Homo Sapiens
LQLDKLRQS

SEQ ID NO: 1028685 - protein, 9 aa, Homo Sapiens
RARRKTTRM

SEQ ID NO: 1028686 - protein, 9 aa, Homo Sapiens
KEENEEEEA

SEQ ID NO: 1028687 - protein, 9 aa, Homo Sapiens
GSPRMTCPK

SEQ ID NO: 1028688 - protein, 9 aa, Homo Sapiens
PLSQPQQEA

SEQ ID NO: 1028689 - protein, 9 aa, Homo Sapiens
TLGMDCEMY

SEQ ID NO: 1028690 - protein, 9 aa, Homo Sapiens
TGGSDEWQM

SEQ ID NO: 1028691 - protein, 9 aa, Homo Sapiens
KIVIDCEQN

SEQ ID NO: 1028692 - protein, 9 aa, Homo Sapiens
QKLNQTQSK

SEQ ID NO: 1028693 - protein, 9 aa, Homo Sapiens
KNIIMAVMD

SEQ ID NO: 1028694 - protein, 9 aa, Homo Sapiens
VFGIPIIGP

SEQ ID NO: 1028695 - protein, 9 aa, Homo Sapiens
NLLTPLKIK

SEQ ID NO: 1028696 - protein, 9 aa, Homo Sapiens
GFFMKMMSM

SEQ ID NO: 1028697 - protein, 9 aa, Homo Sapiens
QVFLPAKAL

SEQ ID NO: 1028698 - protein, 9 aa, Homo Sapiens
MYGIRLHLA

SEQ ID NO: 1028699 - protein, 9 aa, Homo Sapiens
PSLKVCLDF

SEQ ID NO: 1028700 - protein, 9 aa, Homo Sapiens
FFTSFGARN

SEQ ID NO: 1028701 - protein, 9 aa, Homo Sapiens
GIQHDHLAC

SEQ ID NO: 1028702 - protein, 9 aa, Homo Sapiens
LPVIICVTT

SEQ ID NO: 1028703 - protein, 9 aa, Homo Sapiens
VDAINFYDK

SEQ ID NO: 1028704 - protein, 9 aa, Homo Sapiens
NSVLRMQKS

SEQ ID NO: 1028705 - protein, 9 aa, Homo Sapiens
LDDILEFIT

SEQ ID NO: 1028706 - protein, 9 aa, Homo Sapiens
GSQSLSESK

SEQ ID NO: 1028707 - protein, 9 aa, Homo Sapiens
LDSYLLPEE

SEQ ID NO: 1028708 - protein, 9 aa, Homo Sapiens
NLHQASTSS

SEQ ID NO: 1028709 - protein, 9 aa, Homo Sapiens
EVGSRGGEE

SEQ ID NO: 1028710 - protein, 9 aa, Homo Sapiens
KEVETSSAG

SEQ ID NO: 1028711 - protein, 9 aa, Homo Sapiens
PLQTIFRNK

SEQ ID NO: 1028712 - protein, 9 aa, Homo Sapiens
ARSYWCKIQ

SEQ ID NO: 1028713 - protein, 9 aa, Homo Sapiens
GITRVYKSL

SEQ ID NO: 1028714 - protein, 9 aa, Homo Sapiens
VCCNYSLHV

SEQ ID NO: 1028715 - protein, 9 aa, Homo Sapiens
DEQQKSDSS

SEQ ID NO: 1028716 - protein, 9 aa, Homo Sapiens
VEQEKDSEG

SEQ ID NO: 1028717 - protein, 9 aa, Homo Sapiens
DHPSRHQYG

SEQ ID NO: 1028718 - protein, 9 aa, Homo Sapiens
DCSPGWSLS

SEQ ID NO: 1028719 - protein, 9 aa, Homo Sapiens
PDIFFVNHL

SEQ ID NO: 1028720 - protein, 9 aa, Homo Sapiens
EKNIIMAVM

SEQ ID NO: 1028721 - protein, 9 aa, Homo Sapiens
SDDYTTFDN

SEQ ID NO: 1028722 - protein, 9 aa, Homo Sapiens
GHPKPHFRS

SEQ ID NO: 1028723 - protein, 9 aa, Homo Sapiens
ARRKTTRML

SEQ ID NO: 1028724 - protein, 9 aa, Homo Sapiens
SAWGNPSNY

SEQ ID NO: 1028725 - protein, 9 aa, Homo Sapiens
FGNKHSYLC

SEQ ID NO: 1028726 - protein, 9 aa, Homo Sapiens
GSCRKVLVW

SEQ ID NO: 1028727 - protein, 9 aa, Homo Sapiens
QVTFHNKER

SEQ ID NO: 1028728 - protein, 9 aa, Homo Sapiens
AVKTKSSAN

SEQ ID NO: 1028729 - protein, 9 aa, Homo Sapiens
FYEQCFKIA

SEQ ID NO: 1028730 - protein, 9 aa, Homo Sapiens
SEQEVTASA

SEQ ID NO: 1028731 - protein, 9 aa, Homo Sapiens
NIEVVFELS

SEQ ID NO: 1028732 - protein, 9 aa, Homo Sapiens
VKIFLQKGL

SEQ ID NO: 1028733 - protein, 9 aa, Homo Sapiens
RSTASDCSR

SEQ ID NO: 1028734 - protein, 9 aa, Homo Sapiens
SVGYEYELC

SEQ ID NO: 1028735 - protein, 9 aa, Homo Sapiens
EFIKDGHWD

SEQ ID NO: 1028736 - protein, 9 aa, Homo Sapiens
TASAPAACQ

SEQ ID NO: 1028737 - protein, 9 aa, Homo Sapiens
SVTANGADF

SEQ ID NO: 1028738 - protein, 9 aa, Homo Sapiens
VGALSWRPS

SEQ ID NO: 1028739 - protein, 9 aa, Homo Sapiens
IQRIQHLYE

SEQ ID NO: 1028740 - protein, 9 aa, Homo Sapiens
RIFIGGGSC

SEQ ID NO: 1028741 - protein, 9 aa, Homo Sapiens
FMNLTLMAS

SEQ ID NO: 1028742 - protein, 9 aa, Homo Sapiens
ISCTHRFHR

SEQ ID NO: 1028743 - protein, 9 aa, Homo Sapiens
IHLVEVVLN

SEQ ID NO: 1028744 - protein, 9 aa, Homo Sapiens
DKNLSERGQ

SEQ ID NO: 1028745 - protein, 9 aa, Homo Sapiens
LCFLEFDYC

SEQ ID NO: 1028746 - protein, 9 aa, Homo Sapiens
FYTKNLIVM

SEQ ID NO: 1028747 - protein, 9 aa, Homo Sapiens
YYKGGKDTC

SEQ ID NO: 1028748 - protein, 9 aa, Homo Sapiens
SQALISVFQ

SEQ ID NO: 1028749 - protein, 9 aa, Homo Sapiens
LYQDSTVLP

SEQ ID NO: 1028750 - protein, 9 aa, Homo Sapiens
LHVAVVGLF

SEQ ID NO: 1028751 - protein, 9 aa, Homo Sapiens
DVYRYIATP

SEQ ID NO: 1028752 - protein, 9 aa, Homo Sapiens
WKYLKKNRN

SEQ ID NO: 1028753 - protein, 9 aa, Homo Sapiens
PESLPPLPL

SEQ ID NO: 1028754 - protein, 9 aa, Homo Sapiens
HIGWVILSL

SEQ ID NO: 1028755 - protein, 9 aa, Homo Sapiens
DIETFKIKN

SEQ ID NO: 1028756 - protein, 9 aa, Homo Sapiens
GRQVRMQAL

SEQ ID NO: 1028757 - protein, 9 aa, Homo Sapiens
PNEFFGEHC

SEQ ID NO: 1028758 - protein, 9 aa, Homo Sapiens
PRLPPEGEA

SEQ ID NO: 1028759 - protein, 9 aa, Homo Sapiens
SSPLPSDML

SEQ ID NO: 1028760 - protein, 9 aa, Homo Sapiens
TGEKGFCYK

SEQ ID NO: 1028761 - protein, 9 aa, Homo Sapiens
VQTFSSGKY

SEQ ID NO: 1028762 - protein, 9 aa, Homo Sapiens
GLVTLDDSK

SEQ ID NO: 1028763 - protein, 9 aa, Homo Sapiens
SSPSLCIAR

SEQ ID NO: 1028764 - protein, 9 aa, Homo Sapiens
NGWIWSHQG

SEQ ID NO: 1028765 - protein, 9 aa, Homo Sapiens
ARDCHHLEI

SEQ ID NO: 1028766 - protein, 9 aa, Homo Sapiens
AAAQAQVTS

SEQ ID NO: 1028767 - protein, 9 aa, Homo Sapiens
LFYYMKQPL

SEQ ID NO: 1028768 - protein, 9 aa, Homo Sapiens
TIIILYAFI

SEQ ID NO: 1028769 - protein, 9 aa, Homo Sapiens
HERKHYNLS

SEQ ID NO: 1028770 - protein, 9 aa, Homo Sapiens
DGRVVEPKK

SEQ ID NO: 1028771 - protein, 9 aa, Homo Sapiens
TLYMTKYER

SEQ ID NO: 1028772 - protein, 9 aa, Homo Sapiens
LPGPPGPGL

SEQ ID NO: 1028773 - protein, 9 aa, Homo Sapiens
KRRAFRKER

SEQ ID NO: 1028774 - protein, 9 aa, Homo Sapiens
LQTEPKVVR

SEQ ID NO: 1028775 - protein, 9 aa, Homo Sapiens
IGFFNCRCN

SEQ ID NO: 1028776 - protein, 9 aa, Homo Sapiens
PPSSSSTTL

SEQ ID NO: 1028777 - protein, 9 aa, Homo Sapiens
THDNVSSIF

SEQ ID NO: 1028778 - protein, 9 aa, Homo Sapiens
KATCFVYGQ

SEQ ID NO: 1028779 - protein, 9 aa, Homo Sapiens
GNKSLEKFR

SEQ ID NO: 1028780 - protein, 9 aa, Homo Sapiens
VGPGFYQVP

SEQ ID NO: 1028781 - protein, 9 aa, Homo Sapiens
SSTAHPVVF

SEQ ID NO: 1028782 - protein, 9 aa, Homo Sapiens
EKVWRQEKK

SEQ ID NO: 1028783 - protein, 9 aa, Homo Sapiens
MNKSGTNQS

SEQ ID NO: 1028784 - protein, 9 aa, Homo Sapiens
IDWNKLYRC

SEQ ID NO: 1028785 - protein, 9 aa, Homo Sapiens
GLSSGEVLE

SEQ ID NO: 1028786 - protein, 9 aa, Homo Sapiens
PPPLSSPPL

SEQ ID NO: 1028787 - protein, 9 aa, Homo Sapiens
GPFMKVKSE

SEQ ID NO: 1028788 - protein, 9 aa, Homo Sapiens
LELVLEDQV

SEQ ID NO: 1028789 - protein, 9 aa, Homo Sapiens
RREQKVPPV

SEQ ID NO: 1028790 - protein, 9 aa, Homo Sapiens
WVILSLAYM

SEQ ID NO: 1028791 - protein, 9 aa, Homo Sapiens
ILFLSSIIL

SEQ ID NO: 1028792 - protein, 9 aa, Homo Sapiens
NGTLAGPVV

SEQ ID NO: 1028793 - protein, 9 aa, Homo Sapiens
QTFSSGKYY

SEQ ID NO: 1028794 - protein, 9 aa, Homo Sapiens
KQLCLTALK

SEQ ID NO: 1028795 - protein, 9 aa, Homo Sapiens
KKICRDEKE

SEQ ID NO: 1028796 - protein, 9 aa, Homo Sapiens
TCTQEEWDF

SEQ ID NO: 1028797 - protein, 9 aa, Homo Sapiens
SEKGNFFPL

SEQ ID NO: 1028798 - protein, 9 aa, Homo Sapiens
HSQAYQGPA

SEQ ID NO: 1028799 - protein, 9 aa, Homo Sapiens
KVSKVERKK

SEQ ID NO: 1028800 - protein, 9 aa, Homo Sapiens
DLCFRVYYS

SEQ ID NO: 1028801 - protein, 9 aa, Homo Sapiens
RQTLQGLQL

SEQ ID NO: 1028802 - protein, 9 aa, Homo Sapiens
GEEEKEEED

SEQ ID NO: 1028803 - protein, 9 aa, Homo Sapiens
SDPIEYLAY

SEQ ID NO: 1028804 - protein, 9 aa, Homo Sapiens
DGLNLTDES

SEQ ID NO: 1028805 - protein, 9 aa, Homo Sapiens
GKLSQTCVM

SEQ ID NO: 1028806 - protein, 9 aa, Homo Sapiens
AEEMLLKHL

SEQ ID NO: 1028807 - protein, 9 aa, Homo Sapiens
LPQEVGSHG

SEQ ID NO: 1028808 - protein, 9 aa, Homo Sapiens
LMKNTMKNQ

SEQ ID NO: 1028809 - protein, 9 aa, Homo Sapiens
LVNRLKVEQ

SEQ ID NO: 1028810 - protein, 9 aa, Homo Sapiens
QQEPQQLGT

SEQ ID NO: 1028811 - protein, 9 aa, Homo Sapiens
SVSVKAMLN

SEQ ID NO: 1028812 - protein, 9 aa, Homo Sapiens
YSQIFQLHM

SEQ ID NO: 1028813 - protein, 9 aa, Homo Sapiens
SEGMYHCHS

SEQ ID NO: 1028814 - protein, 9 aa, Homo Sapiens
PIKAPVYMP

SEQ ID NO: 1028815 - protein, 9 aa, Homo Sapiens
RRNQRKKRK

SEQ ID NO: 1028816 - protein, 9 aa, Homo Sapiens
RKLLSSGGC

SEQ ID NO: 1028817 - protein, 9 aa, Homo Sapiens
YRLEGATKR

SEQ ID NO: 1028818 - protein, 9 aa, Homo Sapiens
WKLKKPFSI

SEQ ID NO: 1028819 - protein, 9 aa, Homo Sapiens
HKCEMLELL

SEQ ID NO: 1028820 - protein, 9 aa, Homo Sapiens
AHVGPGFYQ

SEQ ID NO: 1028821 - protein, 9 aa, Homo Sapiens
QDPVSPNLV

SEQ ID NO: 1028822 - protein, 9 aa, Homo Sapiens
MKMMSMKPA

SEQ ID NO: 1028823 - protein, 9 aa, Homo Sapiens
YLKRKIRSW

SEQ ID NO: 1028824 - protein, 9 aa, Homo Sapiens
GKVEVLLGI

SEQ ID NO: 1028825 - protein, 9 aa, Homo Sapiens
EIQNNFDYK

SEQ ID NO: 1028826 - protein, 9 aa, Homo Sapiens
KVSSDGGCE

SEQ ID NO: 1028827 - protein, 9 aa, Homo Sapiens
PHETIFRAK

SEQ ID NO: 1028828 - protein, 9 aa, Homo Sapiens
RKFDSGVML

SEQ ID NO: 1028829 - protein, 9 aa, Homo Sapiens
ASSSSLLDY

SEQ ID NO: 1028830 - protein, 9 aa, Homo Sapiens
RHSSDSFYT

SEQ ID NO: 1028831 - protein, 9 aa, Homo Sapiens
GSPESRAFG

SEQ ID NO: 1028832 - protein, 9 aa, Homo Sapiens
HVRFVFSEP

SEQ ID NO: 1028833 - protein, 9 aa, Homo Sapiens
AGASLSTQK

SEQ ID NO: 1028834 - protein, 9 aa, Homo Sapiens
NSEIQVTCD

SEQ ID NO: 1028835 - protein, 9 aa, Homo Sapiens
VLNFPTDKF

SEQ ID NO: 1028836 - protein, 9 aa, Homo Sapiens
DNSPVGEGA

SEQ ID NO: 1028837 - protein, 9 aa, Homo Sapiens
VICLKQEQH

SEQ ID NO: 1028838 - protein, 9 aa, Homo Sapiens
ENKATFSPI

SEQ ID NO: 1028839 - protein, 9 aa, Homo Sapiens
APTKSSKVK

SEQ ID NO: 1028840 - protein, 9 aa, Homo Sapiens
VSYNVDVWF

SEQ ID NO: 1028841 - protein, 9 aa, Homo Sapiens
SPMEPSIPQ

SEQ ID NO: 1028842 - protein, 9 aa, Homo Sapiens
NLIVMGAPG

SEQ ID NO: 1028843 - protein, 9 aa, Homo Sapiens
RRKRKSQKK

SEQ ID NO: 1028844 - protein, 9 aa, Homo Sapiens
EIKKSIRKM

SEQ ID NO: 1028845 - protein, 9 aa, Homo Sapiens
CFTPANYFH

SEQ ID NO: 1028846 - protein, 9 aa, Homo Sapiens
TSPSLCWTN

SEQ ID NO: 1028847 - protein, 9 aa, Homo Sapiens
LKMKRLAEE

SEQ ID NO: 1028848 - protein, 9 aa, Homo Sapiens
KTVDGYINE

SEQ ID NO: 1028849 - protein, 9 aa, Homo Sapiens
GGRKDPMAY

SEQ ID NO: 1028850 - protein, 9 aa, Homo Sapiens
KKGGGKGGA

SEQ ID NO: 1028851 - protein, 9 aa, Homo Sapiens
LRAVRMLSP

SEQ ID NO: 1028852 - protein, 9 aa, Homo Sapiens
RSPLTTRVY

SEQ ID NO: 1028853 - protein, 9 aa, Homo Sapiens
LEYDPRIYF

SEQ ID NO: 1028854 - protein, 9 aa, Homo Sapiens
NSPNDLSAS

SEQ ID NO: 1028855 - protein, 9 aa, Homo Sapiens
PEATETPKC

SEQ ID NO: 1028856 - protein, 9 aa, Homo Sapiens
SSGSLPEMT

SEQ ID NO: 1028857 - protein, 9 aa, Homo Sapiens
PNKPGAFLI

SEQ ID NO: 1028858 - protein, 9 aa, Homo Sapiens
SEKNKVVVE

SEQ ID NO: 1028859 - protein, 9 aa, Homo Sapiens
ECLLLGIMA

SEQ ID NO: 1028860 - protein, 9 aa, Homo Sapiens
MDTLDRVLK

SEQ ID NO: 1028861 - protein, 9 aa, Homo Sapiens
SKLVKPGGA

SEQ ID NO: 1028862 - protein, 9 aa, Homo Sapiens
KNLIVMGAP

SEQ ID NO: 1028863 - protein, 9 aa, Homo Sapiens
GYRRTNHDD

SEQ ID NO: 1028864 - protein, 9 aa, Homo Sapiens
SGGSGGNYE

SEQ ID NO: 1028865 - protein, 9 aa, Homo Sapiens
GCNLAEGGF

SEQ ID NO: 1028866 - protein, 9 aa, Homo Sapiens
PRSQLEFTV

SEQ ID NO: 1028867 - protein, 9 aa, Homo Sapiens
DNRKRLSEK

SEQ ID NO: 1028868 - protein, 9 aa, Homo Sapiens
NFCLLFRSE

SEQ ID NO: 1028869 - protein, 9 aa, Homo Sapiens
SFCSVRAIR

SEQ ID NO: 1028870 - protein, 9 aa, Homo Sapiens
RKGFLGRPG

SEQ ID NO: 1028871 - protein, 9 aa, Homo Sapiens
STYKRRAFR

SEQ ID NO: 1028872 - protein, 9 aa, Homo Sapiens
LGENNLQDD

SEQ ID NO: 1028873 - protein, 9 aa, Homo Sapiens
SQHANDSCS

SEQ ID NO: 1028874 - protein, 9 aa, Homo Sapiens
QASSPQAAP

SEQ ID NO: 1028875 - protein, 9 aa, Homo Sapiens
GHNGIHGKE

SEQ ID NO: 1028876 - protein, 9 aa, Homo Sapiens
PSDCPSKDK

SEQ ID NO: 1028877 - protein, 9 aa, Homo Sapiens
EINTQIMFW

SEQ ID NO: 1028878 - protein, 9 aa, Homo Sapiens
YLAICCPLL

SEQ ID NO: 1028879 - protein, 9 aa, Homo Sapiens
RLINSRTYT

SEQ ID NO: 1028880 - protein, 9 aa, Homo Sapiens
NLCSQDEIP

SEQ ID NO: 1028881 - protein, 9 aa, Homo Sapiens
WKKKQKNQK

SEQ ID NO: 1028882 - protein, 9 aa, Homo Sapiens
LEVRESFDM

SEQ ID NO: 1028883 - protein, 9 aa, Homo Sapiens
GAGSSSHTA

SEQ ID NO: 1028884 - protein, 9 aa, Homo Sapiens
LGPKAWHKC

SEQ ID NO: 1028885 - protein, 9 aa, Homo Sapiens
GSHSELSTR

SEQ ID NO: 1028886 - protein, 9 aa, Homo Sapiens
QQVRALYQH

SEQ ID NO: 1028887 - protein, 9 aa, Homo Sapiens
SDVWSTEES

SEQ ID NO: 1028888 - protein, 9 aa, Homo Sapiens
SKTGEEQGL

SEQ ID NO: 1028889 - protein, 9 aa, Homo Sapiens
GAVDSNLCS

SEQ ID NO: 1028890 - protein, 9 aa, Homo Sapiens
TFEKTIRQK

SEQ ID NO: 1028891 - protein, 9 aa, Homo Sapiens
SNLNTDFFA

SEQ ID NO: 1028892 - protein, 9 aa, Homo Sapiens
VQRKGGVWK

SEQ ID NO: 1028893 - protein, 9 aa, Homo Sapiens
KKKCKATCL

SEQ ID NO: 1028894 - protein, 9 aa, Homo Sapiens
GPESGLSAK

SEQ ID NO: 1028895 - protein, 9 aa, Homo Sapiens
GLTLAWNVW

SEQ ID NO: 1028896 - protein, 9 aa, Homo Sapiens
DAIANIREE

SEQ ID NO: 1028897 - protein, 9 aa, Homo Sapiens
GFCYKGSCF

SEQ ID NO: 1028898 - protein, 9 aa, Homo Sapiens
SAPAACQIL

SEQ ID NO: 1028899 - protein, 9 aa, Homo Sapiens
DHANMFSHL

SEQ ID NO: 1028900 - protein, 9 aa, Homo Sapiens
QEAFFRHQM

SEQ ID NO: 1028901 - protein, 9 aa, Homo Sapiens
VILSSLRPE

SEQ ID NO: 1028902 - protein, 9 aa, Homo Sapiens
SSDSDVSLE

SEQ ID NO: 1028903 - protein, 9 aa, Homo Sapiens
LPLDIKLGA

SEQ ID NO: 1028904 - protein, 9 aa, Homo Sapiens
LHIIQSRGS

SEQ ID NO: 1028905 - protein, 9 aa, Homo Sapiens
NEFFGEHCQ

SEQ ID NO: 1028906 - protein, 9 aa, Homo Sapiens
PKAGFITYR

SEQ ID NO: 1028907 - protein, 9 aa, Homo Sapiens
EKEKMRRQE

SEQ ID NO: 1028908 - protein, 9 aa, Homo Sapiens
GSLAGVPFY

SEQ ID NO: 1028909 - protein, 9 aa, Homo Sapiens
TTLYMTKYE

SEQ ID NO: 1028910 - protein, 9 aa, Homo Sapiens
ATCFVYGQT

SEQ ID NO: 1028911 - protein, 9 aa, Homo Sapiens
LHNETKPCN

SEQ ID NO: 1028912 - protein, 9 aa, Homo Sapiens
LEKLQSCGV

SEQ ID NO: 1028913 - protein, 9 aa, Homo Sapiens
NSMEQGENL

SEQ ID NO: 1028914 - protein, 9 aa, Homo Sapiens
LSPGIKCTQ

SEQ ID NO: 1028915 - protein, 9 aa, Homo Sapiens
IFKVIEAYC

SEQ ID NO: 1028916 - protein, 9 aa, Homo Sapiens
GRRGGRGSN

SEQ ID NO: 1028917 - protein, 9 aa, Homo Sapiens
LQYLQNESK

SEQ ID NO: 1028918 - protein, 9 aa, Homo Sapiens
EEMHQRILV

SEQ ID NO: 1028919 - protein, 9 aa, Homo Sapiens
PQLASRKDK

SEQ ID NO: 1028920 - protein, 9 aa, Homo Sapiens
GSEPFYYLF

SEQ ID NO: 1028921 - protein, 9 aa, Homo Sapiens
TEDSANVEI

SEQ ID NO: 1028922 - protein, 9 aa, Homo Sapiens
CKDQKKIYN

SEQ ID NO: 1028923 - protein, 9 aa, Homo Sapiens
DGAILQWKY

SEQ ID NO: 1028924 - protein, 9 aa, Homo Sapiens
KLKNAINKN

SEQ ID NO: 1028925 - protein, 9 aa, Homo Sapiens
EKLPDCPCT

SEQ ID NO: 1028926 - protein, 9 aa, Homo Sapiens
LPHGPYGEK

SEQ ID NO: 1028927 - protein, 9 aa, Homo Sapiens
RRVQLILDN

SEQ ID NO: 1028928 - protein, 9 aa, Homo Sapiens
PKGHIIPQG

SEQ ID NO: 1028929 - protein, 9 aa, Homo Sapiens
MECSSSAQC

SEQ ID NO: 1028930 - protein, 9 aa, Homo Sapiens
LMMNWLANV

SEQ ID NO: 1028931 - protein, 9 aa, Homo Sapiens
DIIIILQRS

SEQ ID NO: 1028932 - protein, 9 aa, Homo Sapiens
KAFHFKLKL

SEQ ID NO: 1028933 - protein, 9 aa, Homo Sapiens
FDEVFFSEK

SEQ ID NO: 1028934 - protein, 9 aa, Homo Sapiens
AVEFASDYA

SEQ ID NO: 1028935 - protein, 9 aa, Homo Sapiens
MLSPFRSSA

SEQ ID NO: 1028936 - protein, 9 aa, Homo Sapiens
CYCNKFCDR

SEQ ID NO: 1028937 - protein, 9 aa, Homo Sapiens
AFSSDHYAI

SEQ ID NO: 1028938 - protein, 9 aa, Homo Sapiens
TKNLIVMGA

SEQ ID NO: 1028939 - protein, 9 aa, Homo Sapiens
QCFKIAQLI

SEQ ID NO: 1028940 - protein, 9 aa, Homo Sapiens
SSKVKAFGP

SEQ ID NO: 1028941 - protein, 9 aa, Homo Sapiens
TPMLNSAIY

SEQ ID NO: 1028942 - protein, 9 aa, Homo Sapiens
PARNSPAPL

SEQ ID NO: 1028943 - protein, 9 aa, Homo Sapiens
PNPQGGETI

SEQ ID NO: 1028944 - protein, 9 aa, Homo Sapiens
WADPKVCCN

SEQ ID NO: 1028945 - protein, 9 aa, Homo Sapiens
SACPLMQNP

SEQ ID NO: 1028946 - protein, 9 aa, Homo Sapiens
VLMWKIFTL

SEQ ID NO: 1028947 - protein, 9 aa, Homo Sapiens
VPVEKENEI

SEQ ID NO: 1028948 - protein, 9 aa, Homo Sapiens
SRFGKFIKI

SEQ ID NO: 1028949 - protein, 9 aa, Homo Sapiens
CLRKVDKRF

SEQ ID NO: 1028950 - protein, 9 aa, Homo Sapiens
FVHLQWKLI

SEQ ID NO: 1028951 - protein, 9 aa, Homo Sapiens
HHLFPRLSN

SEQ ID NO: 1028952 - protein, 9 aa, Homo Sapiens
ALGVGFPIS

SEQ ID NO: 1028953 - protein, 9 aa, Homo Sapiens
KGFCYKGSC

SEQ ID NO: 1028954 - protein, 9 aa, Homo Sapiens
LEVFCWPTL

SEQ ID NO: 1028955 - protein, 9 aa, Homo Sapiens
QSSRTTQAT

SEQ ID NO: 1028956 - protein, 9 aa, Homo Sapiens
KFPDIIIIL

SEQ ID NO: 1028957 - protein, 9 aa, Homo Sapiens
FVAGGLLPS

SEQ ID NO: 1028958 - protein, 9 aa, Homo Sapiens
MTPAPTPTS

SEQ ID NO: 1028959 - protein, 9 aa, Homo Sapiens
NPISTKNYP

SEQ ID NO: 1028960 - protein, 9 aa, Homo Sapiens
NGRHGGLSS

SEQ ID NO: 1028961 - protein, 9 aa, Homo Sapiens
VSPNLVQGR

SEQ ID NO: 1028962 - protein, 9 aa, Homo Sapiens
DSEEEEEEM

SEQ ID NO: 1028963 - protein, 9 aa, Homo Sapiens
GQEMIGSLE

SEQ ID NO: 1028964 - protein, 9 aa, Homo Sapiens
SQSLSESKM

SEQ ID NO: 1028965 - protein, 9 aa, Homo Sapiens
LSIFCSKYH

SEQ ID NO: 1028966 - protein, 9 aa, Homo Sapiens
RARNKEHQQ

SEQ ID NO: 1028967 - protein, 9 aa, Homo Sapiens
SGSCPSFPL

SEQ ID NO: 1028968 - protein, 9 aa, Homo Sapiens
DEDNTIFKA

SEQ ID NO: 1028969 - protein, 9 aa, Homo Sapiens
ALAESEDEV

SEQ ID NO: 1028970 - protein, 9 aa, Homo Sapiens
RFGKFIKIH

SEQ ID NO: 1028971 - protein, 9 aa, Homo Sapiens
YQTSGNLEV

SEQ ID NO: 1028972 - protein, 9 aa, Homo Sapiens
HKEKSENIN

SEQ ID NO: 1028973 - protein, 9 aa, Homo Sapiens
HEGVAVVSR

SEQ ID NO: 1028974 - protein, 9 aa, Homo Sapiens
IKSKKIKEK

SEQ ID NO: 1028975 - protein, 9 aa, Homo Sapiens
ICVPSVTAN

SEQ ID NO: 1028976 - protein, 9 aa, Homo Sapiens
DSLHLCRHS

SEQ ID NO: 1028977 - protein, 9 aa, Homo Sapiens
SRVATVMYT

SEQ ID NO: 1028978 - protein, 9 aa, Homo Sapiens
ATHIALCTV

SEQ ID NO: 1028979 - protein, 9 aa, Homo Sapiens
DNSSVFTNS

SEQ ID NO: 1028980 - protein, 9 aa, Homo Sapiens
AFLISPNWL

SEQ ID NO: 1028981 - protein, 9 aa, Homo Sapiens
QQLENGEWT

SEQ ID NO: 1028982 - protein, 9 aa, Homo Sapiens
QLPNFLEKL

SEQ ID NO: 1028983 - protein, 9 aa, Homo Sapiens
LPSSLKEPG

SEQ ID NO: 1028984 - protein, 9 aa, Homo Sapiens
LDQNNNAPE

SEQ ID NO: 1028985 - protein, 9 aa, Homo Sapiens
SQGPLQAQI

SEQ ID NO: 1028986 - protein, 9 aa, Homo Sapiens
NSKLGCFEI

SEQ ID NO: 1028987 - protein, 9 aa, Homo Sapiens
DYADSQKMW

SEQ ID NO: 1028988 - protein, 9 aa, Homo Sapiens
HTGPKLLEV

SEQ ID NO: 1028989 - protein, 9 aa, Homo Sapiens
LSNELHVLI

SEQ ID NO: 1028990 - protein, 9 aa, Homo Sapiens
NELVGSNPP

SEQ ID NO: 1028991 - protein, 9 aa, Homo Sapiens
FSPSPPPNN

SEQ ID NO: 1028992 - protein, 9 aa, Homo Sapiens
PMLNSAIYT

SEQ ID NO: 1028993 - protein, 9 aa, Homo Sapiens
LLEHIQKLP

SEQ ID NO: 1028994 - protein, 9 aa, Homo Sapiens
VVQTVLSET

SEQ ID NO: 1028995 - protein, 9 aa, Homo Sapiens
GDGNPKKSS

SEQ ID NO: 1028996 - protein, 9 aa, Homo Sapiens
YLGQEMIGS

SEQ ID NO: 1028997 - protein, 9 aa, Homo Sapiens
ISFLLSLKK

SEQ ID NO: 1028998 - protein, 9 aa, Homo Sapiens
SAESSSPQG

SEQ ID NO: 1028999 - protein, 9 aa, Homo Sapiens
FLLDFRRKV

SEQ ID NO: 1029000 - protein, 9 aa, Homo Sapiens
FYDETSKTF

SEQ ID NO: 1029001 - protein, 9 aa, Homo Sapiens
CSFSGCLPL

SEQ ID NO: 1029002 - protein, 9 aa, Homo Sapiens
TSAHFAGLL

SEQ ID NO: 1029003 - protein, 9 aa, Homo Sapiens
IIAIYALLT

SEQ ID NO: 1029004 - protein, 9 aa, Homo Sapiens
HKQRKLANK

SEQ ID NO: 1029005 - protein, 9 aa, Homo Sapiens
PINNISVPQ

SEQ ID NO: 1029006 - protein, 9 aa, Homo Sapiens
QKSRPCDLS

SEQ ID NO: 1029007 - protein, 9 aa, Homo Sapiens
KEGRLGIPG

SEQ ID NO: 1029008 - protein, 9 aa, Homo Sapiens
GPRIKGGAA

SEQ ID NO: 1029009 - protein, 9 aa, Homo Sapiens
QDNVHTAAR

SEQ ID NO: 1029010 - protein, 9 aa, Homo Sapiens
WSCWSSWSS

SEQ ID NO: 1029011 - protein, 9 aa, Homo Sapiens
HSVGLLSLQ

SEQ ID NO: 1029012 - protein, 9 aa, Homo Sapiens
PIIWIVFFF

SEQ ID NO: 1029013 - protein, 9 aa, Homo Sapiens
QPSSFPQST

SEQ ID NO: 1029014 - protein, 9 aa, Homo Sapiens
STGLKGFIG

SEQ ID NO: 1029015 - protein, 9 aa, Homo Sapiens
LNEDDARSY

SEQ ID NO: 1029016 - protein, 9 aa, Homo Sapiens
EKFVQYCPG

SEQ ID NO: 1029017 - protein, 9 aa, Homo Sapiens
IWLWEYLLE

SEQ ID NO: 1029018 - protein, 9 aa, Homo Sapiens
KMKSPPSAR

SEQ ID NO: 1029019 - protein, 9 aa, Homo Sapiens
WSSCVQGKK

SEQ ID NO: 1029020 - protein, 9 aa, Homo Sapiens
THLFDRNAN

SEQ ID NO: 1029021 - protein, 9 aa, Homo Sapiens
CLRCGKAFA

SEQ ID NO: 1029022 - protein, 9 aa, Homo Sapiens
RIIVAALDA

SEQ ID NO: 1029023 - protein, 9 aa, Homo Sapiens
KCLRCGKAF

SEQ ID NO: 1029024 - protein, 9 aa, Homo Sapiens
AFATCSLHV

SEQ ID NO: 1029025 - protein, 9 aa, Homo Sapiens
EETNFLPAP

SEQ ID NO: 1029026 - protein, 9 aa, Homo Sapiens
SFLFTIEGL

SEQ ID NO: 1029027 - protein, 9 aa, Homo Sapiens
QGEELPPKE

SEQ ID NO: 1029028 - protein, 9 aa, Homo Sapiens
NAAVEKKEQ

SEQ ID NO: 1029029 - protein, 9 aa, Homo Sapiens
ALPLLVPNS

SEQ ID NO: 1029030 - protein, 9 aa, Homo Sapiens
WNVWAQDSE

SEQ ID NO: 1029031 - protein, 9 aa, Homo Sapiens
QEDTIQKEG

SEQ ID NO: 1029032 - protein, 9 aa, Homo Sapiens
VNETVGREV

SEQ ID NO: 1029033 - protein, 9 aa, Homo Sapiens
SWQVLDATP

SEQ ID NO: 1029034 - protein, 9 aa, Homo Sapiens
CPSFPLPSP

SEQ ID NO: 1029035 - protein, 9 aa, Homo Sapiens
PPPAFLTDL

SEQ ID NO: 1029036 - protein, 9 aa, Homo Sapiens
FSREAEGWK

SEQ ID NO: 1029037 - protein, 9 aa, Homo Sapiens
RSLVKLQGT

SEQ ID NO: 1029038 - protein, 9 aa, Homo Sapiens
DQVVQTVLS

SEQ ID NO: 1029039 - protein, 9 aa, Homo Sapiens
ETSIFYFTV

SEQ ID NO: 1029040 - protein, 9 aa, Homo Sapiens
PLLIDYLLS

SEQ ID NO: 1029041 - protein, 9 aa, Homo Sapiens
DFQKRTVQC

SEQ ID NO: 1029042 - protein, 9 aa, Homo Sapiens
PSLCIARFR

SEQ ID NO: 1029043 - protein, 9 aa, Homo Sapiens
RILTLEECD

SEQ ID NO: 1029044 - protein, 9 aa, Homo Sapiens
DIDDNSSVF

SEQ ID NO: 1029045 - protein, 9 aa, Homo Sapiens
SFGARNRTY

SEQ ID NO: 1029046 - protein, 9 aa, Homo Sapiens
KTNRTLHLF

SEQ ID NO: 1029047 - protein, 9 aa, Homo Sapiens
TEKMRGKLR

SEQ ID NO: 1029048 - protein, 9 aa, Homo Sapiens
TFSSGKYYW

SEQ ID NO: 1029049 - protein, 9 aa, Homo Sapiens
HGIVDSENC

SEQ ID NO: 1029050 - protein, 9 aa, Homo Sapiens
LNSTDCPVQ

SEQ ID NO: 1029051 - protein, 9 aa, Homo Sapiens
GCEVHRFDS

SEQ ID NO: 1029052 - protein, 9 aa, Homo Sapiens
HLSLSPASW

SEQ ID NO: 1029053 - protein, 9 aa, Homo Sapiens
LSQTCVMWD

SEQ ID NO: 1029054 - protein, 9 aa, Homo Sapiens
NPILGEIFR

SEQ ID NO: 1029055 - protein, 9 aa, Homo Sapiens
YLAYWLYHY

SEQ ID NO: 1029056 - protein, 9 aa, Homo Sapiens
KAIDYEIQK

SEQ ID NO: 1029057 - protein, 9 aa, Homo Sapiens
DSDIFRHIL

SEQ ID NO: 1029058 - protein, 9 aa, Homo Sapiens
SIFCSKYHG

SEQ ID NO: 1029059 - protein, 9 aa, Homo Sapiens
SFSVPMASV

SEQ ID NO: 1029060 - protein, 9 aa, Homo Sapiens
LELFPVEQE

SEQ ID NO: 1029061 - protein, 9 aa, Homo Sapiens
PFNVSDRQS

SEQ ID NO: 1029062 - protein, 9 aa, Homo Sapiens
AERHIQELE

SEQ ID NO: 1029063 - protein, 9 aa, Homo Sapiens
KLSGTESIF

SEQ ID NO: 1029064 - protein, 9 aa, Homo Sapiens
LLSAQEDIP

SEQ ID NO: 1029065 - protein, 9 aa, Homo Sapiens
EKLYKEDDM

SEQ ID NO: 1029066 - protein, 9 aa, Homo Sapiens
KDRRTEEEN

SEQ ID NO: 1029067 - protein, 9 aa, Homo Sapiens
DRMECESSE

SEQ ID NO: 1029068 - protein, 9 aa, Homo Sapiens
PHLKQWRQQ

SEQ ID NO: 1029069 - protein, 9 aa, Homo Sapiens
SVSSEGCCG

SEQ ID NO: 1029070 - protein, 9 aa, Homo Sapiens
FSAHWRVHT

SEQ ID NO: 1029071 - protein, 9 aa, Homo Sapiens
YLFEVYEDI

SEQ ID NO: 1029072 - protein, 9 aa, Homo Sapiens
SVFLSDNSP

SEQ ID NO: 1029073 - protein, 9 aa, Homo Sapiens
EGMGLKIHF

SEQ ID NO: 1029074 - protein, 9 aa, Homo Sapiens
MVYSPRTSI

SEQ ID NO: 1029075 - protein, 9 aa, Homo Sapiens
RFVCPLNRP

SEQ ID NO: 1029076 - protein, 9 aa, Homo Sapiens
PGAELPLFC

SEQ ID NO: 1029077 - protein, 9 aa, Homo Sapiens
SKDTLLSPD

SEQ ID NO: 1029078 - protein, 9 aa, Homo Sapiens
KVCHANSSE

SEQ ID NO: 1029079 - protein, 9 aa, Homo Sapiens
LSHPNHTEN

SEQ ID NO: 1029080 - protein, 9 aa, Homo Sapiens
GIAPSATAA

SEQ ID NO: 1029081 - protein, 9 aa, Homo Sapiens
LQKNVECAC

SEQ ID NO: 1029082 - protein, 9 aa, Homo Sapiens
FENDPFWNQ

SEQ ID NO: 1029083 - protein, 9 aa, Homo Sapiens
GLSTTPAAP

SEQ ID NO: 1029084 - protein, 9 aa, Homo Sapiens
SPCKGGTTT

SEQ ID NO: 1029085 - protein, 9 aa, Homo Sapiens
FPVSKSLQE

SEQ ID NO: 1029086 - protein, 9 aa, Homo Sapiens
SENTAEALP

SEQ ID NO: 1029087 - protein, 9 aa, Homo Sapiens
FCSGSDDGT

SEQ ID NO: 1029088 - protein, 9 aa, Homo Sapiens
DPIEYLAYW

SEQ ID NO: 1029089 - protein, 9 aa, Homo Sapiens
LLRLTDDPN

SEQ ID NO: 1029090 - protein, 9 aa, Homo Sapiens
GRLGIPGLP

SEQ ID NO: 1029091 - protein, 9 aa, Homo Sapiens
VLFMMPTMA

SEQ ID NO: 1029092 - protein, 9 aa, Homo Sapiens
RDGGFLNNA

SEQ ID NO: 1029093 - protein, 9 aa, Homo Sapiens
DHWLLWLGS

SEQ ID NO: 1029094 - protein, 9 aa, Homo Sapiens
LKEKPSNEN

SEQ ID NO: 1029095 - protein, 9 aa, Homo Sapiens
WRQEKKIRE

SEQ ID NO: 1029096 - protein, 9 aa, Homo Sapiens
LPEFVDRLK

SEQ ID NO: 1029097 - protein, 9 aa, Homo Sapiens
SDNLSPQPL

SEQ ID NO: 1029098 - protein, 9 aa, Homo Sapiens
QYDPSTGPL

SEQ ID NO: 1029099 - protein, 9 aa, Homo Sapiens
SLSALAIEV

SEQ ID NO: 1029100 - protein, 9 aa, Homo Sapiens
FEKLGRKDV

SEQ ID NO: 1029101 - protein, 9 aa, Homo Sapiens
IRQARQQQR

SEQ ID NO: 1029102 - protein, 9 aa, Homo Sapiens
DLAGQELTD

SEQ ID NO: 1029103 - protein, 9 aa, Homo Sapiens
EPAFSGSRT

SEQ ID NO: 1029104 - protein, 9 aa, Homo Sapiens
SWRGLAEPG

SEQ ID NO: 1029105 - protein, 9 aa, Homo Sapiens
GEEVFPRLE

SEQ ID NO: 1029106 - protein, 9 aa, Homo Sapiens
PEPPRIPPF

SEQ ID NO: 1029107 - protein, 9 aa, Homo Sapiens
PSQPLQTIF

SEQ ID NO: 1029108 - protein, 9 aa, Homo Sapiens
SCDFVKRHY

SEQ ID NO: 1029109 - protein, 9 aa, Homo Sapiens
IKAPVYMPH

SEQ ID NO: 1029110 - protein, 9 aa, Homo Sapiens
LRREPDQLE

SEQ ID NO: 1029111 - protein, 9 aa, Homo Sapiens
SSSITSSGH

SEQ ID NO: 1029112 - protein, 9 aa, Homo Sapiens
ANIREETFF

SEQ ID NO: 1029113 - protein, 9 aa, Homo Sapiens
EDDLVLSDD

SEQ ID NO: 1029114 - protein, 9 aa, Homo Sapiens
KKIKSFQGS

SEQ ID NO: 1029115 - protein, 9 aa, Homo Sapiens
RGYCYKKSC

SEQ ID NO: 1029116 - protein, 9 aa, Homo Sapiens
EKAGQAEAE

SEQ ID NO: 1029117 - protein, 9 aa, Homo Sapiens
SNHMEKGCH

SEQ ID NO: 1029118 - protein, 9 aa, Homo Sapiens
PNIPVQTIF

SEQ ID NO: 1029119 - protein, 9 aa, Homo Sapiens
TAFGHSQAY

SEQ ID NO: 1029120 - protein, 9 aa, Homo Sapiens
AQQNLYSNV

SEQ ID NO: 1029121 - protein, 9 aa, Homo Sapiens
WGLAGSRPE

SEQ ID NO: 1029122 - protein, 9 aa, Homo Sapiens
KERKLLSSG

SEQ ID NO: 1029123 - protein, 9 aa, Homo Sapiens
ERVTKDSIP

SEQ ID NO: 1029124 - protein, 9 aa, Homo Sapiens
PEGRVCACA

SEQ ID NO: 1029125 - protein, 9 aa, Homo Sapiens
NEEAKTWRK

SEQ ID NO: 1029126 - protein, 9 aa, Homo Sapiens
ETVGREVIF

SEQ ID NO: 1029127 - protein, 9 aa, Homo Sapiens
GLQNNIRSH

SEQ ID NO: 1029128 - protein, 9 aa, Homo Sapiens
KFIFTSGRN

SEQ ID NO: 1029129 - protein, 9 aa, Homo Sapiens
QKNQKNLNR

SEQ ID NO: 1029130 - protein, 9 aa, Homo Sapiens
LQWKLIHLN

SEQ ID NO: 1029131 - protein, 9 aa, Homo Sapiens
KKDRAPGEK

SEQ ID NO: 1029132 - protein, 9 aa, Homo Sapiens
GPGPAKRSQ

SEQ ID NO: 1029133 - protein, 9 aa, Homo Sapiens
SLDMSFMLF

SEQ ID NO: 1029134 - protein, 9 aa, Homo Sapiens
KTTWQREIS

SEQ ID NO: 1029135 - protein, 9 aa, Homo Sapiens
ACYRARTTN

SEQ ID NO: 1029136 - protein, 9 aa, Homo Sapiens
SAEPAPSPK

SEQ ID NO: 1029137 - protein, 9 aa, Homo Sapiens
NGNQNRSGR

SEQ ID NO: 1029138 - protein, 9 aa, Homo Sapiens
KVKPKILAN

SEQ ID NO: 1029139 - protein, 9 aa, Homo Sapiens
YRRTNHDDP

SEQ ID NO: 1029140 - protein, 9 aa, Homo Sapiens
CEFNITKSL

SEQ ID NO: 1029141 - protein, 9 aa, Homo Sapiens
RLELFPVEQ

SEQ ID NO: 1029142 - protein, 9 aa, Homo Sapiens
KGIEDIYEK

SEQ ID NO: 1029143 - protein, 9 aa, Homo Sapiens
RCEIKPPFK

SEQ ID NO: 1029144 - protein, 9 aa, Homo Sapiens
LQILTQNTQ

SEQ ID NO: 1029145 - protein, 9 aa, Homo Sapiens
KLKKPFSIE

SEQ ID NO: 1029146 - protein, 9 aa, Homo Sapiens
GNFFPLELD

SEQ ID NO: 1029147 - protein, 9 aa, Homo Sapiens
LDLAGQELT

SEQ ID NO: 1029148 - protein, 9 aa, Homo Sapiens
PISLEKDKQ

SEQ ID NO: 1029149 - protein, 9 aa, Homo Sapiens
CCLDFRLHT

SEQ ID NO: 1029150 - protein, 9 aa, Homo Sapiens
EGSPGEISS

SEQ ID NO: 1029151 - protein, 9 aa, Homo Sapiens
HGPSQDEDN

SEQ ID NO: 1029152 - protein, 9 aa, Homo Sapiens
ENNNYPIFT

SEQ ID NO: 1029153 - protein, 9 aa, Homo Sapiens
TSEPAFSGS

SEQ ID NO: 1029154 - protein, 9 aa, Homo Sapiens
VRDTTLLAR

SEQ ID NO: 1029155 - protein, 9 aa, Homo Sapiens
LFEVYEDIE

SEQ ID NO: 1029156 - protein, 9 aa, Homo Sapiens
EFFTVYHYN

SEQ ID NO: 1029157 - protein, 9 aa, Homo Sapiens
AVLWKLKKP

SEQ ID NO: 1029158 - protein, 9 aa, Homo Sapiens
GCRHQPFTI

SEQ ID NO: 1029159 - protein, 9 aa, Homo Sapiens
WDGETAVCN

SEQ ID NO: 1029160 - protein, 9 aa, Homo Sapiens
SVSVSQALE

SEQ ID NO: 1029161 - protein, 9 aa, Homo Sapiens
NKIGDVGVQ

SEQ ID NO: 1029162 - protein, 9 aa, Homo Sapiens
NYCDFVKLR

SEQ ID NO: 1029163 - protein, 9 aa, Homo Sapiens
TVGSSDNLS

SEQ ID NO: 1029164 - protein, 9 aa, Homo Sapiens
WSTEESMPT

SEQ ID NO: 1029165 - protein, 9 aa, Homo Sapiens
LSEKLEEKE

SEQ ID NO: 1029166 - protein, 9 aa, Homo Sapiens
TFHNKERRS

SEQ ID NO: 1029167 - protein, 9 aa, Homo Sapiens
LTLEDYKEP

SEQ ID NO: 1029168 - protein, 9 aa, Homo Sapiens
AYGSWQVLD

SEQ ID NO: 1029169 - protein, 9 aa, Homo Sapiens
LTCTQEEWD

SEQ ID NO: 1029170 - protein, 9 aa, Homo Sapiens
QNKCKEATD

SEQ ID NO: 1029171 - protein, 9 aa, Homo Sapiens
IKGEGMGLK

SEQ ID NO: 1029172 - protein, 9 aa, Homo Sapiens
LPGPPRIAG

SEQ ID NO: 1029173 - protein, 9 aa, Homo Sapiens
WSGPYGVTV

SEQ ID NO: 1029174 - protein, 9 aa, Homo Sapiens
SCTSQIEFS

SEQ ID NO: 1029175 - protein, 9 aa, Homo Sapiens
LILDNLGVD

SEQ ID NO: 1029176 - protein, 9 aa, Homo Sapiens
ENKKKMTNS

SEQ ID NO: 1029177 - protein, 9 aa, Homo Sapiens
AEYTLGLWK

SEQ ID NO: 1029178 - protein, 9 aa, Homo Sapiens
PPEGEAGQR

SEQ ID NO: 1029179 - protein, 9 aa, Homo Sapiens
RECLPLSTV

SEQ ID NO: 1029180 - protein, 9 aa, Homo Sapiens
KTHVNIINV

SEQ ID NO: 1029181 - protein, 9 aa, Homo Sapiens
SIFYFTVQV

SEQ ID NO: 1029182 - protein, 9 aa, Homo Sapiens
DVWFRSLAE

SEQ ID NO: 1029183 - protein, 9 aa, Homo Sapiens
GGLSSQPSQ

SEQ ID NO: 1029184 - protein, 9 aa, Homo Sapiens
IEEMDSSFN

SEQ ID NO: 1029185 - protein, 9 aa, Homo Sapiens
SFWKLRSEG

SEQ ID NO: 1029186 - protein, 9 aa, Homo Sapiens
PAHPNVDPC

SEQ ID NO: 1029187 - protein, 9 aa, Homo Sapiens
LVLVGACIT

SEQ ID NO: 1029188 - protein, 9 aa, Homo Sapiens
GREVIFLGF

SEQ ID NO: 1029189 - protein, 9 aa, Homo Sapiens
LYFFYFLGS

SEQ ID NO: 1029190 - protein, 9 aa, Homo Sapiens
KGTFQNDPN

SEQ ID NO: 1029191 - protein, 9 aa, Homo Sapiens
GSRTSQQER

SEQ ID NO: 1029192 - protein, 9 aa, Homo Sapiens
VIWLWEYLL

SEQ ID NO: 1029193 - protein, 9 aa, Homo Sapiens
HIQKLPKNP

SEQ ID NO: 1029194 - protein, 9 aa, Homo Sapiens
QLPPLLSCG

SEQ ID NO: 1029195 - protein, 9 aa, Homo Sapiens
KEDCSFSGC

SEQ ID NO: 1029196 - protein, 9 aa, Homo Sapiens
QVIGLFRRF

SEQ ID NO: 1029197 - protein, 9 aa, Homo Sapiens
EKMTMIMKI

SEQ ID NO: 1029198 - protein, 9 aa, Homo Sapiens
CCTEKLYKE

SEQ ID NO: 1029199 - protein, 9 aa, Homo Sapiens
QSELRHGLF

SEQ ID NO: 1029200 - protein, 9 aa, Homo Sapiens
KKCGKTFRH

SEQ ID NO: 1029201 - protein, 9 aa, Homo Sapiens
KNRNRNIMA

SEQ ID NO: 1029202 - protein, 9 aa, Homo Sapiens
NNFGSVARM

SEQ ID NO: 1029203 - protein, 9 aa, Homo Sapiens
IKEEEGLEE

SEQ ID NO: 1029204 - protein, 9 aa, Homo Sapiens
WKFFNILTF

SEQ ID NO: 1029205 - protein, 9 aa, Homo Sapiens
NKLYRCEIK

SEQ ID NO: 1029206 - protein, 9 aa, Homo Sapiens
GEGVQLSAS

SEQ ID NO: 1029207 - protein, 9 aa, Homo Sapiens
AGYFLGNVW

SEQ ID NO: 1029208 - protein, 9 aa, Homo Sapiens
WRQQMLFGI

SEQ ID NO: 1029209 - protein, 9 aa, Homo Sapiens
LLLQILTQN

SEQ ID NO: 1029210 - protein, 9 aa, Homo Sapiens
VEREITRER

SEQ ID NO: 1029211 - protein, 9 aa, Homo Sapiens
PLVFFTILP

SEQ ID NO: 1029212 - protein, 9 aa, Homo Sapiens
LENHRREQK

SEQ ID NO: 1029213 - protein, 9 aa, Homo Sapiens
LENSSNKNK

SEQ ID NO: 1029214 - protein, 9 aa, Homo Sapiens
HWDYLLERT

SEQ ID NO: 1029215 - protein, 9 aa, Homo Sapiens
KTMALTTAR

SEQ ID NO: 1029216 - protein, 9 aa, Homo Sapiens
YRKVQKVSS

SEQ ID NO: 1029217 - protein, 9 aa, Homo Sapiens
LHGWNKQLR

SEQ ID NO: 1029218 - protein, 9 aa, Homo Sapiens
YKNELAKVR

SEQ ID NO: 1029219 - protein, 9 aa, Homo Sapiens
ADWTGLQAS

SEQ ID NO: 1029220 - protein, 9 aa, Homo Sapiens
EIEHSSPSS

SEQ ID NO: 1029221 - protein, 9 aa, Homo Sapiens
RLLGPMLEA

SEQ ID NO: 1029222 - protein, 9 aa, Homo Sapiens
ASSTRRQET

SEQ ID NO: 1029223 - protein, 9 aa, Homo Sapiens
KRQFRSQAF

SEQ ID NO: 1029224 - protein, 9 aa, Homo Sapiens
WALPKNLTV

SEQ ID NO: 1029225 - protein, 9 aa, Homo Sapiens
REDSIFGDL

SEQ ID NO: 1029226 - protein, 9 aa, Homo Sapiens
PNSSSYLHF

SEQ ID NO: 1029227 - protein, 9 aa, Homo Sapiens
QHANDSCST

SEQ ID NO: 1029228 - protein, 9 aa, Homo Sapiens
QKVSSDGGC

SEQ ID NO: 1029229 - protein, 9 aa, Homo Sapiens
IRAWVSSGS

SEQ ID NO: 1029230 - protein, 9 aa, Homo Sapiens
SGSLLVSSS

SEQ ID NO: 1029231 - protein, 9 aa, Homo Sapiens
PSVSQRAAY

SEQ ID NO: 1029232 - protein, 9 aa, Homo Sapiens
KKKQKNQKN

SEQ ID NO: 1029233 - protein, 9 aa, Homo Sapiens
QEIYSHLVI

SEQ ID NO: 1029234 - protein, 9 aa, Homo Sapiens
FLLSIFCSK

SEQ ID NO: 1029235 - protein, 9 aa, Homo Sapiens
DGVENSYIR

SEQ ID NO: 1029236 - protein, 9 aa, Homo Sapiens
EHPGQQGYV

SEQ ID NO: 1029237 - protein, 9 aa, Homo Sapiens
VKTKSSANP

SEQ ID NO: 1029238 - protein, 9 aa, Homo Sapiens
ESQDPSFGD

SEQ ID NO: 1029239 - protein, 9 aa, Homo Sapiens
PGIAVARMK

SEQ ID NO: 1029240 - protein, 9 aa, Homo Sapiens
DACLLVVAQ

SEQ ID NO: 1029241 - protein, 9 aa, Homo Sapiens
DMKEEEKSY

SEQ ID NO: 1029242 - protein, 9 aa, Homo Sapiens
KGCTAPAPT

SEQ ID NO: 1029243 - protein, 9 aa, Homo Sapiens
EPFYYLFDG

SEQ ID NO: 1029244 - protein, 9 aa, Homo Sapiens
GSSQAESYL

SEQ ID NO: 1029245 - protein, 9 aa, Homo Sapiens
MDSSFNLHE

SEQ ID NO: 1029246 - protein, 9 aa, Homo Sapiens
RKVDKRFQC

SEQ ID NO: 1029247 - protein, 9 aa, Homo Sapiens
LVMEMTNKK

SEQ ID NO: 1029248 - protein, 9 aa, Homo Sapiens
RETPWEAEA

SEQ ID NO: 1029249 - protein, 9 aa, Homo Sapiens
GQKERIREQ

SEQ ID NO: 1029250 - protein, 9 aa, Homo Sapiens
ALATSEVEA

SEQ ID NO: 1029251 - protein, 9 aa, Homo Sapiens
PLTKKETVQ

SEQ ID NO: 1029252 - protein, 9 aa, Homo Sapiens
LEEMDKPLI

SEQ ID NO: 1029253 - protein, 9 aa, Homo Sapiens
QRRRSLSAL

SEQ ID NO: 1029254 - protein, 9 aa, Homo Sapiens
GAAHKMKSP

SEQ ID NO: 1029255 - protein, 9 aa, Homo Sapiens
QPSFCHRSD

SEQ ID NO: 1029256 - protein, 9 aa, Homo Sapiens
GTDNRIVLK

SEQ ID NO: 1029257 - protein, 9 aa, Homo Sapiens
AQVTSQPQT

SEQ ID NO: 1029258 - protein, 9 aa, Homo Sapiens
FKGWMNIIY

SEQ ID NO: 1029259 - protein, 9 aa, Homo Sapiens
MYPRPARLP

SEQ ID NO: 1029260 - protein, 9 aa, Homo Sapiens
FCSVRAIRI

SEQ ID NO: 1029261 - protein, 9 aa, Homo Sapiens
KEPGDPWSA

SEQ ID NO: 1029262 - protein, 9 aa, Homo Sapiens
TCSLHVAVV

SEQ ID NO: 1029263 - protein, 9 aa, Homo Sapiens
HANDSCSTM

SEQ ID NO: 1029264 - protein, 9 aa, Homo Sapiens
SYGRRLIQV

SEQ ID NO: 1029265 - protein, 9 aa, Homo Sapiens
VIGVTPFAS

SEQ ID NO: 1029266 - protein, 9 aa, Homo Sapiens
LGMDCEMYK

SEQ ID NO: 1029267 - protein, 9 aa, Homo Sapiens
CCVLERGED

SEQ ID NO: 1029268 - protein, 9 aa, Homo Sapiens
RLFSPLRQR

SEQ ID NO: 1029269 - protein, 9 aa, Homo Sapiens
LDFSAEYLI

SEQ ID NO: 1029270 - protein, 9 aa, Homo Sapiens
FLISFLLSL

SEQ ID NO: 1029271 - protein, 9 aa, Homo Sapiens
DENNNYPIF

SEQ ID NO: 1029272 - protein, 9 aa, Homo Sapiens
ERPEELESE

SEQ ID NO: 1029273 - protein, 9 aa, Homo Sapiens
SKTLPRKKM

SEQ ID NO: 1029274 - protein, 9 aa, Homo Sapiens
DRTLRTWDL

SEQ ID NO: 1029275 - protein, 9 aa, Homo Sapiens
YPLALRPWD

SEQ ID NO: 1029276 - protein, 9 aa, Homo Sapiens
VEEEEAGFS

SEQ ID NO: 1029277 - protein, 9 aa, Homo Sapiens
FIGGGSCAI

SEQ ID NO: 1029278 - protein, 9 aa, Homo Sapiens
PGTWKEYLE

SEQ ID NO: 1029279 - protein, 9 aa, Homo Sapiens
APPLTKKET

SEQ ID NO: 1029280 - protein, 9 aa, Homo Sapiens
TQTSEPAFS

SEQ ID NO: 1029281 - protein, 9 aa, Homo Sapiens
VSELPLVVE

SEQ ID NO: 1029282 - protein, 9 aa, Homo Sapiens
RITTLYMTK

SEQ ID NO: 1029283 - protein, 9 aa, Homo Sapiens
DIFSVQEKN

SEQ ID NO: 1029284 - protein, 9 aa, Homo Sapiens
NAKCHKDLP

SEQ ID NO: 1029285 - protein, 9 aa, Homo Sapiens
KQPSSGEII

SEQ ID NO: 1029286 - protein, 9 aa, Homo Sapiens
SVLLSHIFY

SEQ ID NO: 1029287 - protein, 9 aa, Homo Sapiens
DAQIFKVIE

SEQ ID NO: 1029288 - protein, 9 aa, Homo Sapiens
DRANNSMEQ

SEQ ID NO: 1029289 - protein, 9 aa, Homo Sapiens
GAFLISPNW

SEQ ID NO: 1029290 - protein, 9 aa, Homo Sapiens
ERLASGPIE

SEQ ID NO: 1029291 - protein, 9 aa, Homo Sapiens
SMWVGKNRI

SEQ ID NO: 1029292 - protein, 9 aa, Homo Sapiens
PHPYRRTAI

SEQ ID NO: 1029293 - protein, 9 aa, Homo Sapiens
TENNACFPS

SEQ ID NO: 1029294 - protein, 9 aa, Homo Sapiens
CLPLSQPQQ

SEQ ID NO: 1029295 - protein, 9 aa, Homo Sapiens
KQSSFYSDR

SEQ ID NO: 1029296 - protein, 9 aa, Homo Sapiens
SLEIPHSSS

SEQ ID NO: 1029297 - protein, 9 aa, Homo Sapiens
SSTSGSTHI

SEQ ID NO: 1029298 - protein, 9 aa, Homo Sapiens
NPPQFPKSI

SEQ ID NO: 1029299 - protein, 9 aa, Homo Sapiens
AWHKCEMLE

SEQ ID NO: 1029300 - protein, 9 aa, Homo Sapiens
MFSHLKKKA

SEQ ID NO: 1029301 - protein, 9 aa, Homo Sapiens
MHGIVDSEN

SEQ ID NO: 1029302 - protein, 9 aa, Homo Sapiens
IQKDDLQCF

SEQ ID NO: 1029303 - protein, 9 aa, Homo Sapiens
EANEDCIYK

SEQ ID NO: 1029304 - protein, 9 aa, Homo Sapiens
RVGTRRQSW

SEQ ID NO: 1029305 - protein, 9 aa, Homo Sapiens
VCPLNRPFR

SEQ ID NO: 1029306 - protein, 9 aa, Homo Sapiens
VLFSATMSP

SEQ ID NO: 1029307 - protein, 9 aa, Homo Sapiens
TFFYFYNCS

SEQ ID NO: 1029308 - protein, 9 aa, Homo Sapiens
SVALKGMSQ

SEQ ID NO: 1029309 - protein, 9 aa, Homo Sapiens
RYIEMFREK

SEQ ID NO: 1029310 - protein, 9 aa, Homo Sapiens
SSKTSDSLA

SEQ ID NO: 1029311 - protein, 9 aa, Homo Sapiens
RKNEMKEQK

SEQ ID NO: 1029312 - protein, 9 aa, Homo Sapiens
LIICPIIWI

SEQ ID NO: 1029313 - protein, 9 aa, Homo Sapiens
MEKINSKGL

SEQ ID NO: 1029314 - protein, 9 aa, Homo Sapiens
PDQHGHKEQ

SEQ ID NO: 1029315 - protein, 9 aa, Homo Sapiens
MFSLLISAR

SEQ ID NO: 1029316 - protein, 9 aa, Homo Sapiens
PPITHDNVS

SEQ ID NO: 1029317 - protein, 9 aa, Homo Sapiens
TCHIEGDNL

SEQ ID NO: 1029318 - protein, 9 aa, Homo Sapiens
HLGLPHGPY

SEQ ID NO: 1029319 - protein, 9 aa, Homo Sapiens
PRPARLPAD

SEQ ID NO: 1029320 - protein, 9 aa, Homo Sapiens
ARMFCQEIY

SEQ ID NO: 1029321 - protein, 9 aa, Homo Sapiens
REDKVISVT

SEQ ID NO: 1029322 - protein, 9 aa, Homo Sapiens
MVYMTQYQR

SEQ ID NO: 1029323 - protein, 9 aa, Homo Sapiens
FFSQQKEEN

SEQ ID NO: 1029324 - protein, 9 aa, Homo Sapiens
FKVERDYKP

SEQ ID NO: 1029325 - protein, 9 aa, Homo Sapiens
IQSKTERGL

SEQ ID NO: 1029326 - protein, 9 aa, Homo Sapiens
HLYEEKCSS

SEQ ID NO: 1029327 - protein, 9 aa, Homo Sapiens
SFTVLDLIG

SEQ ID NO: 1029328 - protein, 9 aa, Homo Sapiens
GVQMKLKFL

SEQ ID NO: 1029329 - protein, 9 aa, Homo Sapiens
DAYSSFCSV

SEQ ID NO: 1029330 - protein, 9 aa, Homo Sapiens
RDYMISAKT

SEQ ID NO: 1029331 - protein, 9 aa, Homo Sapiens
TGSHSELST

SEQ ID NO: 1029332 - protein, 9 aa, Homo Sapiens
LPPLPLSSL

SEQ ID NO: 1029333 - protein, 9 aa, Homo Sapiens
NLKLCFLEF

SEQ ID NO: 1029334 - protein, 9 aa, Homo Sapiens
PELKEGVEL

SEQ ID NO: 1029335 - protein, 9 aa, Homo Sapiens
KIFLQKGLS

SEQ ID NO: 1029336 - protein, 9 aa, Homo Sapiens
NFCKDVVLN

SEQ ID NO: 1029337 - protein, 9 aa, Homo Sapiens
MRSYETASP

SEQ ID NO: 1029338 - protein, 9 aa, Homo Sapiens
AYWLYHYRK

SEQ ID NO: 1029339 - protein, 9 aa, Homo Sapiens
NVFPPELTV

SEQ ID NO: 1029340 - protein, 9 aa, Homo Sapiens
ECDIVDSHV

SEQ ID NO: 1029341 - protein, 9 aa, Homo Sapiens
SAGLFPYNY

SEQ ID NO: 1029342 - protein, 9 aa, Homo Sapiens
ATSSSEEST

SEQ ID NO: 1029343 - protein, 9 aa, Homo Sapiens
GPRLQPSSF

SEQ ID NO: 1029344 - protein, 9 aa, Homo Sapiens
SYLLPEEHP

SEQ ID NO: 1029345 - protein, 9 aa, Homo Sapiens
WFLALESAD

SEQ ID NO: 1029346 - protein, 9 aa, Homo Sapiens
KKPPITHDN

SEQ ID NO: 1029347 - protein, 9 aa, Homo Sapiens
LLDYSFQFT

SEQ ID NO: 1029348 - protein, 9 aa, Homo Sapiens
LPPAYGSWQ

SEQ ID NO: 1029349 - protein, 9 aa, Homo Sapiens
GIVDSENCR

SEQ ID NO: 1029350 - protein, 9 aa, Homo Sapiens
AGPRAKVSE

SEQ ID NO: 1029351 - protein, 9 aa, Homo Sapiens
NTSPYFVQQ

SEQ ID NO: 1029352 - protein, 9 aa, Homo Sapiens
LWLQAEHLS

SEQ ID NO: 1029353 - protein, 9 aa, Homo Sapiens
AQSLMGMNL

SEQ ID NO: 1029354 - protein, 9 aa, Homo Sapiens
EVSYSHSSC

SEQ ID NO: 1029355 - protein, 9 aa, Homo Sapiens
RKGGVWKVI

SEQ ID NO: 1029356 - protein, 9 aa, Homo Sapiens
EERAPSWRG

SEQ ID NO: 1029357 - protein, 9 aa, Homo Sapiens
HPTMKDSVN

SEQ ID NO: 1029358 - protein, 9 aa, Homo Sapiens
IAWTIPSLT

SEQ ID NO: 1029359 - protein, 9 aa, Homo Sapiens
REQKVPPVI

SEQ ID NO: 1029360 - protein, 9 aa, Homo Sapiens
SRPLSVSVK

SEQ ID NO: 1029361 - protein, 9 aa, Homo Sapiens
AAQAQVTSQ

SEQ ID NO: 1029362 - protein, 9 aa, Homo Sapiens
SKVSKVERK

SEQ ID NO: 1029363 - protein, 9 aa, Homo Sapiens
DDDKWCPKK

SEQ ID NO: 1029364 - protein, 9 aa, Homo Sapiens
KAQTGSGLL

SEQ ID NO: 1029365 - protein, 9 aa, Homo Sapiens
GWTGKYCQQ

SEQ ID NO: 1029366 - protein, 9 aa, Homo Sapiens
DEKAFDFFE

SEQ ID NO: 1029367 - protein, 9 aa, Homo Sapiens
AEAVRDYSL

SEQ ID NO: 1029368 - protein, 9 aa, Homo Sapiens
GPLVQNAAS

SEQ ID NO: 1029369 - protein, 9 aa, Homo Sapiens
IPHSEDILN

SEQ ID NO: 1029370 - protein, 9 aa, Homo Sapiens
SLSTSPYNT

SEQ ID NO: 1029371 - protein, 9 aa, Homo Sapiens
GGQPITPNG

SEQ ID NO: 1029372 - protein, 9 aa, Homo Sapiens
YDRHLPIEI

SEQ ID NO: 1029373 - protein, 9 aa, Homo Sapiens
GERPYKCLR

SEQ ID NO: 1029374 - protein, 9 aa, Homo Sapiens
LKRQFRSQA

SEQ ID NO: 1029375 - protein, 9 aa, Homo Sapiens
PPSEVNEGG

SEQ ID NO: 1029376 - protein, 9 aa, Homo Sapiens
GQPITPNGQ

SEQ ID NO: 1029377 - protein, 9 aa, Homo Sapiens
MTKWIQERS

SEQ ID NO: 1029378 - protein, 9 aa, Homo Sapiens
SNDLLFSIV

SEQ ID NO: 1029379 - protein, 9 aa, Homo Sapiens
APPDAPNKE

SEQ ID NO: 1029380 - protein, 9 aa, Homo Sapiens
DFPDDYNSG

SEQ ID NO: 1029381 - protein, 9 aa, Homo Sapiens
APGIAVARM

SEQ ID NO: 1029382 - protein, 9 aa, Homo Sapiens
AKTMALTTA

SEQ ID NO: 1029383 - protein, 9 aa, Homo Sapiens
SLNQHQKTH

SEQ ID NO: 1029384 - protein, 9 aa, Homo Sapiens
VGTRRQSWR

SEQ ID NO: 1029385 - protein, 9 aa, Homo Sapiens
MMQNHGDFD

SEQ ID NO: 1029386 - protein, 9 aa, Homo Sapiens
LIPSLSVEE

SEQ ID NO: 1029387 - protein, 9 aa, Homo Sapiens
EEMPTTSHR

SEQ ID NO: 1029388 - protein, 9 aa, Homo Sapiens
VSQALEARL

SEQ ID NO: 1029389 - protein, 9 aa, Homo Sapiens
ESGLSAKKY

SEQ ID NO: 1029390 - protein, 9 aa, Homo Sapiens
VYPNGTLQI

SEQ ID NO: 1029391 - protein, 9 aa, Homo Sapiens
ILENKATFS

SEQ ID NO: 1029392 - protein, 9 aa, Homo Sapiens
YHSDKFRAY

SEQ ID NO: 1029393 - protein, 9 aa, Homo Sapiens
KMRGKLRAC

SEQ ID NO: 1029394 - protein, 9 aa, Homo Sapiens
EIQKQINEL

SEQ ID NO: 1029395 - protein, 9 aa, Homo Sapiens
ERAPSWRGL

SEQ ID NO: 1029396 - protein, 9 aa, Homo Sapiens
EEVERSKPV

SEQ ID NO: 1029397 - protein, 9 aa, Homo Sapiens
KVISVTRSL

SEQ ID NO: 1029398 - protein, 9 aa, Homo Sapiens
LLPQSQEVD

SEQ ID NO: 1029399 - protein, 9 aa, Homo Sapiens
RTCLGGGRR

SEQ ID NO: 1029400 - protein, 9 aa, Homo Sapiens
LPDHYRPWI

SEQ ID NO: 1029401 - protein, 9 aa, Homo Sapiens
FHNKERRSK

SEQ ID NO: 1029402 - protein, 9 aa, Homo Sapiens
LWLQRLERD

SEQ ID NO: 1029403 - protein, 9 aa, Homo Sapiens
IGMRMSPLA

SEQ ID NO: 1029404 - protein, 9 aa, Homo Sapiens
PLDPKGTFQ

SEQ ID NO: 1029405 - protein, 9 aa, Homo Sapiens
SGGKINSET

SEQ ID NO: 1029406 - protein, 9 aa, Homo Sapiens
DVKLVQHVC

SEQ ID NO: 1029407 - protein, 9 aa, Homo Sapiens
RLGYRRTNH

SEQ ID NO: 1029408 - protein, 9 aa, Homo Sapiens
ASGNLRPSS

SEQ ID NO: 1029409 - protein, 9 aa, Homo Sapiens
VTEYQESCQ

SEQ ID NO: 1029410 - protein, 9 aa, Homo Sapiens
HPSHLSGPS

SEQ ID NO: 1029411 - protein, 9 aa, Homo Sapiens
PSFPLPSPA

SEQ ID NO: 1029412 - protein, 9 aa, Homo Sapiens
YQHYSCRES

SEQ ID NO: 1029413 - protein, 9 aa, Homo Sapiens
KEIAQRSKA

SEQ ID NO: 1029414 - protein, 9 aa, Homo Sapiens
VTDPTSDSL

SEQ ID NO: 1029415 - protein, 9 aa, Homo Sapiens
SSGPEFFTV

SEQ ID NO: 1029416 - protein, 9 aa, Homo Sapiens
MNFGFPQTT

SEQ ID NO: 1029417 - protein, 9 aa, Homo Sapiens
YKIFKRGPE

SEQ ID NO: 1029418 - protein, 9 aa, Homo Sapiens
EPGAAHKMK

SEQ ID NO: 1029419 - protein, 9 aa, Homo Sapiens
VLKGATTQG

SEQ ID NO: 1029420 - protein, 9 aa, Homo Sapiens
KKLKGRITL

SEQ ID NO: 1029421 - protein, 9 aa, Homo Sapiens
NATTVIVQS

SEQ ID NO: 1029422 - protein, 9 aa, Homo Sapiens
NKGGNRKVE

SEQ ID NO: 1029423 - protein, 9 aa, Homo Sapiens
GVAVGTLCH

SEQ ID NO: 1029424 - protein, 9 aa, Homo Sapiens
SEPFYYLFD

SEQ ID NO: 1029425 - protein, 9 aa, Homo Sapiens
FCYKGSCFH

SEQ ID NO: 1029426 - protein, 9 aa, Homo Sapiens
LPPKELQES

SEQ ID NO: 1029427 - protein, 9 aa, Homo Sapiens
EAGSDSSGK

SEQ ID NO: 1029428 - protein, 9 aa, Homo Sapiens
IDIWGGENL

SEQ ID NO: 1029429 - protein, 9 aa, Homo Sapiens
DISGLSSGE

SEQ ID NO: 1029430 - protein, 9 aa, Homo Sapiens
DMVGSPDQN

SEQ ID NO: 1029431 - protein, 9 aa, Homo Sapiens
EVYEDIEVG

SEQ ID NO: 1029432 - protein, 9 aa, Homo Sapiens
ERNFFLNGS

SEQ ID NO: 1029433 - protein, 9 aa, Homo Sapiens
DTNNALQKN

SEQ ID NO: 1029434 - protein, 9 aa, Homo Sapiens
QPLQTIFRN

SEQ ID NO: 1029435 - protein, 9 aa, Homo Sapiens
EGIKFDTLW

SEQ ID NO: 1029436 - protein, 9 aa, Homo Sapiens
SPNKESLAL

SEQ ID NO: 1029437 - protein, 9 aa, Homo Sapiens
FLLKYITGN

SEQ ID NO: 1029438 - protein, 9 aa, Homo Sapiens
DKKLRLEKE

SEQ ID NO: 1029439 - protein, 9 aa, Homo Sapiens
RPQDDIDSS

SEQ ID NO: 1029440 - protein, 9 aa, Homo Sapiens
FLDYDLDST

SEQ ID NO: 1029441 - protein, 9 aa, Homo Sapiens
HRECLPLST

SEQ ID NO: 1029442 - protein, 9 aa, Homo Sapiens
EYDPRIYFC

SEQ ID NO: 1029443 - protein, 9 aa, Homo Sapiens
PSSPCVGSP

SEQ ID NO: 1029444 - protein, 9 aa, Homo Sapiens
TDRANNSME

SEQ ID NO: 1029445 - protein, 9 aa, Homo Sapiens
IKIEDENNN

SEQ ID NO: 1029446 - protein, 9 aa, Homo Sapiens
IYSHLVIIN

SEQ ID NO: 1029447 - protein, 9 aa, Homo Sapiens
AESYLERPS

SEQ ID NO: 1029448 - protein, 9 aa, Homo Sapiens
SSNQEDVEA

SEQ ID NO: 1029449 - protein, 9 aa, Homo Sapiens
LSGTESIFE

SEQ ID NO: 1029450 - protein, 9 aa, Homo Sapiens
LFTEKMRGK

SEQ ID NO: 1029451 - protein, 9 aa, Homo Sapiens
PGLPGPPRI

SEQ ID NO: 1029452 - protein, 9 aa, Homo Sapiens
EAIWKYLKK

SEQ ID NO: 1029453 - protein, 9 aa, Homo Sapiens
IEIANKLPQ

SEQ ID NO: 1029454 - protein, 9 aa, Homo Sapiens
VLALAESED

SEQ ID NO: 1029455 - protein, 9 aa, Homo Sapiens
LSVTFNYNL

SEQ ID NO: 1029456 - protein, 9 aa, Homo Sapiens
ERNKGNEKP

SEQ ID NO: 1029457 - protein, 9 aa, Homo Sapiens
YQENPAYLR

SEQ ID NO: 1029458 - protein, 9 aa, Homo Sapiens
HVEGLDDEK

SEQ ID NO: 1029459 - protein, 9 aa, Homo Sapiens
EISEIIHMT

SEQ ID NO: 1029460 - protein, 9 aa, Homo Sapiens
YDPRIYFCT

SEQ ID NO: 1029461 - protein, 9 aa, Homo Sapiens
RRKFDSGVM

SEQ ID NO: 1029462 - protein, 9 aa, Homo Sapiens
LRQTLQGLQ

SEQ ID NO: 1029463 - protein, 9 aa, Homo Sapiens
IRHKNKAKT

SEQ ID NO: 1029464 - protein, 9 aa, Homo Sapiens
EETFFFKGP

SEQ ID NO: 1029465 - protein, 9 aa, Homo Sapiens
DLNQHKKIY

SEQ ID NO: 1029466 - protein, 9 aa, Homo Sapiens
SGDIPYRKE

SEQ ID NO: 1029467 - protein, 9 aa, Homo Sapiens
TLANLFLAK

SEQ ID NO: 1029468 - protein, 9 aa, Homo Sapiens
RENSYQCKE

SEQ ID NO: 1029469 - protein, 9 aa, Homo Sapiens
HKNKAKTAD

SEQ ID NO: 1029470 - protein, 9 aa, Homo Sapiens
EILLQYLQN

SEQ ID NO: 1029471 - protein, 9 aa, Homo Sapiens
WLEDVCVAH

SEQ ID NO: 1029472 - protein, 9 aa, Homo Sapiens
LARAEKAGQ

SEQ ID NO: 1029473 - protein, 9 aa, Homo Sapiens
NFGFPQTTD

SEQ ID NO: 1029474 - protein, 9 aa, Homo Sapiens
VLWKLKKPF

SEQ ID NO: 1029475 - protein, 9 aa, Homo Sapiens
NQQPSWNSE

SEQ ID NO: 1029476 - protein, 9 aa, Homo Sapiens
ARLLKKLKG

SEQ ID NO: 1029477 - protein, 9 aa, Homo Sapiens
VDIFSVQEK

SEQ ID NO: 1029478 - protein, 9 aa, Homo Sapiens
ELEDEFVDE

SEQ ID NO: 1029479 - protein, 9 aa, Homo Sapiens
TLLSAQEDI

SEQ ID NO: 1029480 - protein, 9 aa, Homo Sapiens
LRVDFFRAG

SEQ ID NO: 1029481 - protein, 9 aa, Homo Sapiens
GDLSQTFED

SEQ ID NO: 1029482 - protein, 9 aa, Homo Sapiens
AEFSPAASK

SEQ ID NO: 1029483 - protein, 9 aa, Homo Sapiens
HSTLGATDE

SEQ ID NO: 1029484 - protein, 9 aa, Homo Sapiens
QSLSESKMV

SEQ ID NO: 1029485 - protein, 9 aa, Homo Sapiens
FRSPERNQD

SEQ ID NO: 1029486 - protein, 9 aa, Homo Sapiens
PLNRPFRCK

SEQ ID NO: 1029487 - protein, 9 aa, Homo Sapiens
SASSVLKMI

SEQ ID NO: 1029488 - protein, 9 aa, Homo Sapiens
TKALFPNMI

SEQ ID NO: 1029489 - protein, 9 aa, Homo Sapiens
QLLEHIQKL

SEQ ID NO: 1029490 - protein, 9 aa, Homo Sapiens
LLEQSLETT

SEQ ID NO: 1029491 - protein, 9 aa, Homo Sapiens
STDIFLVDN

SEQ ID NO: 1029492 - protein, 9 aa, Homo Sapiens
ADSLSSFPN

SEQ ID NO: 1029493 - protein, 9 aa, Homo Sapiens
VLRGKFAAE

SEQ ID NO: 1029494 - protein, 9 aa, Homo Sapiens
YPRPARLPA

SEQ ID NO: 1029495 - protein, 9 aa, Homo Sapiens
RTSIILNNE

SEQ ID NO: 1029496 - protein, 9 aa, Homo Sapiens
FSGDDLGED

SEQ ID NO: 1029497 - protein, 9 aa, Homo Sapiens
GSDSSGKEH

SEQ ID NO: 1029498 - protein, 9 aa, Homo Sapiens
VAKYFSLSS

SEQ ID NO: 1029499 - protein, 9 aa, Homo Sapiens
VERKKNQEL

SEQ ID NO: 1029500 - protein, 9 aa, Homo Sapiens
LINSRTYTN

SEQ ID NO: 1029501 - protein, 9 aa, Homo Sapiens
GAAMRESGQ

SEQ ID NO: 1029502 - protein, 9 aa, Homo Sapiens
KASDERRQE

SEQ ID NO: 1029503 - protein, 9 aa, Homo Sapiens
PSPKGHIIP

SEQ ID NO: 1029504 - protein, 9 aa, Homo Sapiens
RIEVKIKKQ

SEQ ID NO: 1029505 - protein, 9 aa, Homo Sapiens
FASDYADSQ

SEQ ID NO: 1029506 - protein, 9 aa, Homo Sapiens
KLANKSWED

SEQ ID NO: 1029507 - protein, 9 aa, Homo Sapiens
RSEASNKDI

SEQ ID NO: 1029508 - protein, 9 aa, Homo Sapiens
FGARNRTYM

SEQ ID NO: 1029509 - protein, 9 aa, Homo Sapiens
PCREQRLQD

SEQ ID NO: 1029510 - protein, 9 aa, Homo Sapiens
LFALVCWYG

SEQ ID NO: 1029511 - protein, 9 aa, Homo Sapiens
LREYQKLMS

SEQ ID NO: 1029512 - protein, 9 aa, Homo Sapiens
PSRHQYGAR

SEQ ID NO: 1029513 - protein, 9 aa, Homo Sapiens
GQTSPKQKN

SEQ ID NO: 1029514 - protein, 9 aa, Homo Sapiens
FRAAAEKLF

SEQ ID NO: 1029515 - protein, 9 aa, Homo Sapiens
FYATKSRDA

SEQ ID NO: 1029516 - protein, 9 aa, Homo Sapiens
QEEKMWEQK

SEQ ID NO: 1029517 - protein, 9 aa, Homo Sapiens
DTLDRVLKP

SEQ ID NO: 1029518 - protein, 9 aa, Homo Sapiens
GKGGAGADE

SEQ ID NO: 1029519 - protein, 9 aa, Homo Sapiens
VFPRLETLL

SEQ ID NO: 1029520 - protein, 9 aa, Homo Sapiens
PVPQQASSP

SEQ ID NO: 1029521 - protein, 9 aa, Homo Sapiens
DSLDGLNLT

SEQ ID NO: 1029522 - protein, 9 aa, Homo Sapiens
LHISTLSQS

SEQ ID NO: 1029523 - protein, 9 aa, Homo Sapiens
SITINSHFL

SEQ ID NO: 1029524 - protein, 9 aa, Homo Sapiens
HHERKHYNL

SEQ ID NO: 1029525 - protein, 9 aa, Homo Sapiens
RVAVAGEDG

SEQ ID NO: 1029526 - protein, 9 aa, Homo Sapiens
AFVHKENSF

SEQ ID NO: 1029527 - protein, 9 aa, Homo Sapiens
TRRQSWRSR

SEQ ID NO: 1029528 - protein, 9 aa, Homo Sapiens
NVATAAGLL

SEQ ID NO: 1029529 - protein, 9 aa, Homo Sapiens
NVWAQDSEL

SEQ ID NO: 1029530 - protein, 9 aa, Homo Sapiens
QKLMSVKLA

SEQ ID NO: 1029531 - protein, 9 aa, Homo Sapiens
KLQSCGVPE

SEQ ID NO: 1029532 - protein, 9 aa, Homo Sapiens
EAKELGEDD

SEQ ID NO: 1029533 - protein, 9 aa, Homo Sapiens
PAPSPKGHI

SEQ ID NO: 1029534 - protein, 9 aa, Homo Sapiens
EEGLSNYIC

SEQ ID NO: 1029535 - protein, 9 aa, Homo Sapiens
LTSRLLRAP

SEQ ID NO: 1029536 - protein, 9 aa, Homo Sapiens
HFRSSSAYR

SEQ ID NO: 1029537 - protein, 9 aa, Homo Sapiens
SEVPREEAG

SEQ ID NO: 1029538 - protein, 9 aa, Homo Sapiens
AVRKTKRKK

SEQ ID NO: 1029539 - protein, 9 aa, Homo Sapiens
PVNLSPELR

SEQ ID NO: 1029540 - protein, 9 aa, Homo Sapiens
GFESIQNSP

SEQ ID NO: 1029541 - protein, 9 aa, Homo Sapiens
AIVIGLLLV

SEQ ID NO: 1029542 - protein, 9 aa, Homo Sapiens
MKEQKYWKQ

SEQ ID NO: 1029543 - protein, 9 aa, Homo Sapiens
ELSVTFNYN

SEQ ID NO: 1029544 - protein, 9 aa, Homo Sapiens
HIPPEPPRI

SEQ ID NO: 1029545 - protein, 9 aa, Homo Sapiens
NLTEVITAS

SEQ ID NO: 1029546 - protein, 9 aa, Homo Sapiens
AKTWRKVAG

SEQ ID NO: 1029547 - protein, 9 aa, Homo Sapiens
SCINSFTVL

SEQ ID NO: 1029548 - protein, 9 aa, Homo Sapiens
HKENSFTYF

SEQ ID NO: 1029549 - protein, 9 aa, Homo Sapiens
RKDPMAYGA

SEQ ID NO: 1029550 - protein, 9 aa, Homo Sapiens
EQERLTSGT

SEQ ID NO: 1029551 - protein, 9 aa, Homo Sapiens
SRTSQQERG

SEQ ID NO: 1029552 - protein, 9 aa, Homo Sapiens
ESQRKSREN

SEQ ID NO: 1029553 - protein, 9 aa, Homo Sapiens
SGISSERLA

SEQ ID NO: 1029554 - protein, 9 aa, Homo Sapiens
RIYSGEKPY

SEQ ID NO: 1029555 - protein, 9 aa, Homo Sapiens
GHCRPRGAE

SEQ ID NO: 1029556 - protein, 9 aa, Homo Sapiens
QNNNAPEIL

SEQ ID NO: 1029557 - protein, 9 aa, Homo Sapiens
LDGLNLTDE

SEQ ID NO: 1029558 - protein, 9 aa, Homo Sapiens
AGGKSSSEP

SEQ ID NO: 1029559 - protein, 9 aa, Homo Sapiens
YGRRLIQVG

SEQ ID NO: 1029560 - protein, 9 aa, Homo Sapiens
VSRESQKLV

SEQ ID NO: 1029561 - protein, 9 aa, Homo Sapiens
KAMGHRSEY

SEQ ID NO: 1029562 - protein, 9 aa, Homo Sapiens
KEGELGGEE

SEQ ID NO: 1029563 - protein, 9 aa, Homo Sapiens
IILAIQQLE

SEQ ID NO: 1029564 - protein, 9 aa, Homo Sapiens
RVIPPLDWR

SEQ ID NO: 1029565 - protein, 9 aa, Homo Sapiens
TQETQKLNQ

SEQ ID NO: 1029566 - protein, 9 aa, Homo Sapiens
RDTTLLARL

SEQ ID NO: 1029567 - protein, 9 aa, Homo Sapiens
FYGEDVSNT

SEQ ID NO: 1029568 - protein, 9 aa, Homo Sapiens
TPYPSQHSV

SEQ ID NO: 1029569 - protein, 9 aa, Homo Sapiens
FLIPDMKEE

SEQ ID NO: 1029570 - protein, 9 aa, Homo Sapiens
SLPSSLKEP

SEQ ID NO: 1029571 - protein, 9 aa, Homo Sapiens
EKEPARFTP

SEQ ID NO: 1029572 - protein, 9 aa, Homo Sapiens
CNNGAGHCP

SEQ ID NO: 1029573 - protein, 9 aa, Homo Sapiens
TERGLYSSY

SEQ ID NO: 1029574 - protein, 9 aa, Homo Sapiens
APVPQQASS

SEQ ID NO: 1029575 - protein, 9 aa, Homo Sapiens
IFDDYRRKG

SEQ ID NO: 1029576 - protein, 9 aa, Homo Sapiens
SEGCCGSSS

SEQ ID NO: 1029577 - protein, 9 aa, Homo Sapiens
VYRDQNKCK

SEQ ID NO: 1029578 - protein, 9 aa, Homo Sapiens
SLHLCRHSA

SEQ ID NO: 1029579 - protein, 9 aa, Homo Sapiens
CSSSENNSG

SEQ ID NO: 1029580 - protein, 9 aa, Homo Sapiens
SQTPKKGEV

SEQ ID NO: 1029581 - protein, 9 aa, Homo Sapiens
LCLPRSQLE

SEQ ID NO: 1029582 - protein, 9 aa, Homo Sapiens
LITAFYVAG

SEQ ID NO: 1029583 - protein, 9 aa, Homo Sapiens
QEAQEVLAG

SEQ ID NO: 1029584 - protein, 9 aa, Homo Sapiens
SLSESKMVI

SEQ ID NO: 1029585 - protein, 9 aa, Homo Sapiens
SSFYSDRDT

SEQ ID NO: 1029586 - protein, 9 aa, Homo Sapiens
KKEERDLVN

SEQ ID NO: 1029587 - protein, 9 aa, Homo Sapiens
KQLAAIYAG

SEQ ID NO: 1029588 - protein, 9 aa, Homo Sapiens
FIIWNKKPR

SEQ ID NO: 1029589 - protein, 9 aa, Homo Sapiens
VIFLNTFQE

SEQ ID NO: 1029590 - protein, 9 aa, Homo Sapiens
TNHDDPAFK

SEQ ID NO: 1029591 - protein, 9 aa, Homo Sapiens
AAAVATTVL

SEQ ID NO: 1029592 - protein, 9 aa, Homo Sapiens
PRASIPVIP

SEQ ID NO: 1029593 - protein, 9 aa, Homo Sapiens
ETASPVANR

SEQ ID NO: 1029594 - protein, 9 aa, Homo Sapiens
NNWLKNSND

SEQ ID NO: 1029595 - protein, 9 aa, Homo Sapiens
SVVAGEFQK

SEQ ID NO: 1029596 - protein, 9 aa, Homo Sapiens
LSERGQSQL

SEQ ID NO: 1029597 - protein, 9 aa, Homo Sapiens
CITDFAEKL

SEQ ID NO: 1029598 - protein, 9 aa, Homo Sapiens
RKTHVNIIN

SEQ ID NO: 1029599 - protein, 9 aa, Homo Sapiens
QQMLFGIFA

SEQ ID NO: 1029600 - protein, 9 aa, Homo Sapiens
IFYDETSKT

SEQ ID NO: 1029601 - protein, 9 aa, Homo Sapiens
IKSSHLKAH

SEQ ID NO: 1029602 - protein, 9 aa, Homo Sapiens
RNGKIFMKD

SEQ ID NO: 1029603 - protein, 9 aa, Homo Sapiens
TFPEHVTPE

SEQ ID NO: 1029604 - protein, 9 aa, Homo Sapiens
LSKTNRTLH

SEQ ID NO: 1029605 - protein, 9 aa, Homo Sapiens
TSRLLRAPQ

SEQ ID NO: 1029606 - protein, 9 aa, Homo Sapiens
YHLEVRESF

SEQ ID NO: 1029607 - protein, 9 aa, Homo Sapiens
VWFRSLAEE

SEQ ID NO: 1029608 - protein, 9 aa, Homo Sapiens
TFYKVMVSN

SEQ ID NO: 1029609 - protein, 9 aa, Homo Sapiens
NAMYGNFML

SEQ ID NO: 1029610 - protein, 9 aa, Homo Sapiens
ERGLPGEEF

SEQ ID NO: 1029611 - protein, 9 aa, Homo Sapiens
SPYFVQQRA

SEQ ID NO: 1029612 - protein, 9 aa, Homo Sapiens
FIGKDLDDS

SEQ ID NO: 1029613 - protein, 9 aa, Homo Sapiens
LCTVRRFLE

SEQ ID NO: 1029614 - protein, 9 aa, Homo Sapiens
NRTLHLFGV

SEQ ID NO: 1029615 - protein, 9 aa, Homo Sapiens
DEGKEGRLG

SEQ ID NO: 1029616 - protein, 9 aa, Homo Sapiens
ETSSAGRVD

SEQ ID NO: 1029617 - protein, 9 aa, Homo Sapiens
LMVRFLVVS

SEQ ID NO: 1029618 - protein, 9 aa, Homo Sapiens
FGHSQAYQG

SEQ ID NO: 1029619 - protein, 9 aa, Homo Sapiens
MECESSEPH

SEQ ID NO: 1029620 - protein, 9 aa, Homo Sapiens
IMGFVAGLA

SEQ ID NO: 1029621 - protein, 9 aa, Homo Sapiens
EFITNRMIK

SEQ ID NO: 1029622 - protein, 9 aa, Homo Sapiens
KSRPCDLSG

SEQ ID NO: 1029623 - protein, 9 aa, Homo Sapiens
PAELGVLYR

SEQ ID NO: 1029624 - protein, 9 aa, Homo Sapiens
EGLSTTPAA

SEQ ID NO: 1029625 - protein, 9 aa, Homo Sapiens
TTLWALLPP

SEQ ID NO: 1029626 - protein, 9 aa, Homo Sapiens
KVESLFQEA

SEQ ID NO: 1029627 - protein, 9 aa, Homo Sapiens
LSPELRRQR

SEQ ID NO: 1029628 - protein, 9 aa, Homo Sapiens
ARAEKAGQA

SEQ ID NO: 1029629 - protein, 9 aa, Homo Sapiens
YQESCQGLG

SEQ ID NO: 1029630 - protein, 9 aa, Homo Sapiens
KSSQRSSST

SEQ ID NO: 1029631 - protein, 9 aa, Homo Sapiens
QTSEPAFSG

SEQ ID NO: 1029632 - protein, 9 aa, Homo Sapiens
RNFCKDVVL

SEQ ID NO: 1029633 - protein, 9 aa, Homo Sapiens
PCCQSSRTT

SEQ ID NO: 1029634 - protein, 9 aa, Homo Sapiens
RTSPVTFSP

SEQ ID NO: 1029635 - protein, 9 aa, Homo Sapiens
SDWVTFYKV

SEQ ID NO: 1029636 - protein, 9 aa, Homo Sapiens
CINCANEKL

SEQ ID NO: 1029637 - protein, 9 aa, Homo Sapiens
YIAICHSLR

SEQ ID NO: 1029638 - protein, 9 aa, Homo Sapiens
VLCDMDTDR

SEQ ID NO: 1029639 - protein, 9 aa, Homo Sapiens
QNRSGRPGF

SEQ ID NO: 1029640 - protein, 9 aa, Homo Sapiens
ANMFSHLKK

SEQ ID NO: 1029641 - protein, 9 aa, Homo Sapiens
RGSLTPPLD

SEQ ID NO: 1029642 - protein, 9 aa, Homo Sapiens
GLSNYICMG

SEQ ID NO: 1029643 - protein, 9 aa, Homo Sapiens
IFGEENKKK

SEQ ID NO: 1029644 - protein, 9 aa, Homo Sapiens
GPSQDEDNT

SEQ ID NO: 1029645 - protein, 9 aa, Homo Sapiens
SKFIQKDDL

SEQ ID NO: 1029646 - protein, 9 aa, Homo Sapiens
VLGLIYLLF

SEQ ID NO: 1029647 - protein, 9 aa, Homo Sapiens
KRQNHLESE

SEQ ID NO: 1029648 - protein, 9 aa, Homo Sapiens
KMNIITAAL

SEQ ID NO: 1029649 - protein, 9 aa, Homo Sapiens
DQPLVVNLP

SEQ ID NO: 1029650 - protein, 9 aa, Homo Sapiens
ASSSFLEKS

SEQ ID NO: 1029651 - protein, 9 aa, Homo Sapiens
GIRLHLAKD

SEQ ID NO: 1029652 - protein, 9 aa, Homo Sapiens
SAKTLVQVA

SEQ ID NO: 1029653 - protein, 9 aa, Homo Sapiens
AARAASYMV

SEQ ID NO: 1029654 - protein, 9 aa, Homo Sapiens
LSPPNKPGA

SEQ ID NO: 1029655 - protein, 9 aa, Homo Sapiens
SSRVSAVEP

SEQ ID NO: 1029656 - protein, 9 aa, Homo Sapiens
SRRNSGSLL

SEQ ID NO: 1029657 - protein, 9 aa, Homo Sapiens
STASDCSRD

SEQ ID NO: 1029658 - protein, 9 aa, Homo Sapiens
LVEIKQKFL

SEQ ID NO: 1029659 - protein, 9 aa, Homo Sapiens
IVAKYFSLS

SEQ ID NO: 1029660 - protein, 9 aa, Homo Sapiens
FCTFIQTAS

SEQ ID NO: 1029661 - protein, 9 aa, Homo Sapiens
RKRLSEKLE

SEQ ID NO: 1029662 - protein, 9 aa, Homo Sapiens
VRDYSLLEG

SEQ ID NO: 1029663 - protein, 9 aa, Homo Sapiens
SPNLVQGRI

SEQ ID NO: 1029664 - protein, 9 aa, Homo Sapiens
LAHHQRHSL

SEQ ID NO: 1029665 - protein, 9 aa, Homo Sapiens
RIFWGVRET

SEQ ID NO: 1029666 - protein, 9 aa, Homo Sapiens
LLGFHFTHS

SEQ ID NO: 1029667 - protein, 9 aa, Homo Sapiens
PAQSPAESR

SEQ ID NO: 1029668 - protein, 9 aa, Homo Sapiens
KPKDMGFTC

SEQ ID NO: 1029669 - protein, 9 aa, Homo Sapiens
NYFFVNLAF

SEQ ID NO: 1029670 - protein, 9 aa, Homo Sapiens
DCQKSNHME

SEQ ID NO: 1029671 - protein, 9 aa, Homo Sapiens
TCEFNITKS

SEQ ID NO: 1029672 - protein, 9 aa, Homo Sapiens
ALTLIAVSF

SEQ ID NO: 1029673 - protein, 9 aa, Homo Sapiens
NVRDTTLLA

SEQ ID NO: 1029674 - protein, 9 aa, Homo Sapiens
SGGWHYAKK

SEQ ID NO: 1029675 - protein, 9 aa, Homo Sapiens
RKIAHFCCD

SEQ ID NO: 1029676 - protein, 9 aa, Homo Sapiens
LWKTFPGKM

SEQ ID NO: 1029677 - protein, 9 aa, Homo Sapiens
TSCGGDFQK

SEQ ID NO: 1029678 - protein, 9 aa, Homo Sapiens
NNPLPQNGG

SEQ ID NO: 1029679 - protein, 9 aa, Homo Sapiens
TSVFNDSII

SEQ ID NO: 1029680 - protein, 9 aa, Homo Sapiens
QQASSPQAA

SEQ ID NO: 1029681 - protein, 9 aa, Homo Sapiens
AICHSLRYT

SEQ ID NO: 1029682 - protein, 9 aa, Homo Sapiens
LQAQILPPR

SEQ ID NO: 1029683 - protein, 9 aa, Homo Sapiens
NLSPELRRQ

SEQ ID NO: 1029684 - protein, 9 aa, Homo Sapiens
TTTMTPAPT

SEQ ID NO: 1029685 - protein, 9 aa, Homo Sapiens
NAYRKVQKV

SEQ ID NO: 1029686 - protein, 9 aa, Homo Sapiens
TDACLLVVA

SEQ ID NO: 1029687 - protein, 9 aa, Homo Sapiens
SGTESIFEN

SEQ ID NO: 1029688 - protein, 9 aa, Homo Sapiens
HRFDSSVKS

SEQ ID NO: 1029689 - protein, 9 aa, Homo Sapiens
RSSPRSERQ

SEQ ID NO: 1029690 - protein, 9 aa, Homo Sapiens
VTSFEGSTL

SEQ ID NO: 1029691 - protein, 9 aa, Homo Sapiens
YLYPQDPKA

SEQ ID NO: 1029692 - protein, 9 aa, Homo Sapiens
EEEEAGFSS

SEQ ID NO: 1029693 - protein, 9 aa, Homo Sapiens
VFAQIRCKL

SEQ ID NO: 1029694 - protein, 9 aa, Homo Sapiens
PACAATFEK

SEQ ID NO: 1029695 - protein, 9 aa, Homo Sapiens
HPNHTENNA

SEQ ID NO: 1029696 - protein, 9 aa, Homo Sapiens
ASLEIPHSS

SEQ ID NO: 1029697 - protein, 9 aa, Homo Sapiens
STSGSTHIF

SEQ ID NO: 1029698 - protein, 9 aa, Homo Sapiens
STSCGGDFQ

SEQ ID NO: 1029699 - protein, 9 aa, Homo Sapiens
LGNVWFLAL

SEQ ID NO: 1029700 - protein, 9 aa, Homo Sapiens
CPIIWIVFF

SEQ ID NO: 1029701 - protein, 9 aa, Homo Sapiens
IFIGGGSCA

SEQ ID NO: 1029702 - protein, 9 aa, Homo Sapiens
PDHYRPWIE

SEQ ID NO: 1029703 - protein, 9 aa, Homo Sapiens
ILSLAYMMG

SEQ ID NO: 1029704 - protein, 9 aa, Homo Sapiens
VSVGYEYEL

SEQ ID NO: 1029705 - protein, 9 aa, Homo Sapiens
KLIRMCLYY

SEQ ID NO: 1029706 - protein, 9 aa, Homo Sapiens
TESRPLSVS

SEQ ID NO: 1029707 - protein, 9 aa, Homo Sapiens
VSWQLEKSL

SEQ ID NO: 1029708 - protein, 9 aa, Homo Sapiens
HSELSTRAN

SEQ ID NO: 1029709 - protein, 9 aa, Homo Sapiens
SKVYPEKNV

SEQ ID NO: 1029710 - protein, 9 aa, Homo Sapiens
ATLGNPIST

SEQ ID NO: 1029711 - protein, 9 aa, Homo Sapiens
GKVMEYTTI

SEQ ID NO: 1029712 - protein, 9 aa, Homo Sapiens
NAQCVKQKE

SEQ ID NO: 1029713 - protein, 9 aa, Homo Sapiens
NAISFLLVL

SEQ ID NO: 1029714 - protein, 9 aa, Homo Sapiens
GAELPLFCS

SEQ ID NO: 1029715 - protein, 9 aa, Homo Sapiens
WRPGTAKEV

SEQ ID NO: 1029716 - protein, 9 aa, Homo Sapiens
RFTEHNFSP

SEQ ID NO: 1029717 - protein, 9 aa, Homo Sapiens
LAKTMALTT

SEQ ID NO: 1029718 - protein, 9 aa, Homo Sapiens
GQAEAEGLR

SEQ ID NO: 1029719 - protein, 9 aa, Homo Sapiens
SEAPELDKD

SEQ ID NO: 1029720 - protein, 9 aa, Homo Sapiens
SASQDRTLR

SEQ ID NO: 1029721 - protein, 9 aa, Homo Sapiens
IYGLYTDPC

SEQ ID NO: 1029722 - protein, 9 aa, Homo Sapiens
RKSQKKLKN

SEQ ID NO: 1029723 - protein, 9 aa, Homo Sapiens
TSYQLHTPM

SEQ ID NO: 1029724 - protein, 9 aa, Homo Sapiens
KNELAKVRN

SEQ ID NO: 1029725 - protein, 9 aa, Homo Sapiens
LCYCNKFCD

SEQ ID NO: 1029726 - protein, 9 aa, Homo Sapiens
MDDVELLLN

SEQ ID NO: 1029727 - protein, 9 aa, Homo Sapiens
NLNKQEKIY

SEQ ID NO: 1029728 - protein, 9 aa, Homo Sapiens
QSYGKKKNA

SEQ ID NO: 1029729 - protein, 9 aa, Homo Sapiens
NLRPSSSGS

SEQ ID NO: 1029730 - protein, 9 aa, Homo Sapiens
VLAGLQRHW

SEQ ID NO: 1029731 - protein, 9 aa, Homo Sapiens
EIQVTCDAH

SEQ ID NO: 1029732 - protein, 9 aa, Homo Sapiens
QLTCTQEEW

SEQ ID NO: 1029733 - protein, 9 aa, Homo Sapiens
GAFSLGGPF

SEQ ID NO: 1029734 - protein, 9 aa, Homo Sapiens
VNLSPELRR

SEQ ID NO: 1029735 - protein, 9 aa, Homo Sapiens
DNVIWLWEY

SEQ ID NO: 1029736 - protein, 9 aa, Homo Sapiens
VQTVFAMQL

SEQ ID NO: 1029737 - protein, 9 aa, Homo Sapiens
IAGQILASV

SEQ ID NO: 1029738 - protein, 9 aa, Homo Sapiens
QSSKTFFYF

SEQ ID NO: 1029739 - protein, 9 aa, Homo Sapiens
RIYFCTFIQ

SEQ ID NO: 1029740 - protein, 9 aa, Homo Sapiens
LYRAIAHEA

SEQ ID NO: 1029741 - protein, 9 aa, Homo Sapiens
QEVLAGLQR

SEQ ID NO: 1029742 - protein, 9 aa, Homo Sapiens
FGAHREAVE

SEQ ID NO: 1029743 - protein, 9 aa, Homo Sapiens
VASRQKHLS

SEQ ID NO: 1029744 - protein, 9 aa, Homo Sapiens
IPVQTIFRA

SEQ ID NO: 1029745 - protein, 9 aa, Homo Sapiens
AAEKNGLAC

SEQ ID NO: 1029746 - protein, 9 aa, Homo Sapiens
SFEKHQITL

SEQ ID NO: 1029747 - protein, 9 aa, Homo Sapiens
SLERKLATP

SEQ ID NO: 1029748 - protein, 9 aa, Homo Sapiens
LAGSRPESS

SEQ ID NO: 1029749 - protein, 9 aa, Homo Sapiens
LRLCPSPGT

SEQ ID NO: 1029750 - protein, 9 aa, Homo Sapiens
APYIFMDDD

SEQ ID NO: 1029751 - protein, 9 aa, Homo Sapiens
PLSLSEDGE

SEQ ID NO: 1029752 - protein, 9 aa, Homo Sapiens
AFGIGLTPL

SEQ ID NO: 1029753 - protein, 9 aa, Homo Sapiens
EGCLRKVDK

SEQ ID NO: 1029754 - protein, 9 aa, Homo Sapiens
SKACTCDSG

SEQ ID NO: 1029755 - protein, 9 aa, Homo Sapiens
WSRVATVMY

SEQ ID NO: 1029756 - protein, 9 aa, Homo Sapiens
KDSVNVTPS

SEQ ID NO: 1029757 - protein, 9 aa, Homo Sapiens
NLHIQRNVQ

SEQ ID NO: 1029758 - protein, 9 aa, Homo Sapiens
ADKILDDSF

SEQ ID NO: 1029759 - protein, 9 aa, Homo Sapiens
EELRVISCT

SEQ ID NO: 1029760 - protein, 9 aa, Homo Sapiens
HKHPSHLSG

SEQ ID NO: 1029761 - protein, 9 aa, Homo Sapiens
VRESHLSLS

SEQ ID NO: 1029762 - protein, 9 aa, Homo Sapiens
PGTAKEVIL

SEQ ID NO: 1029763 - protein, 9 aa, Homo Sapiens
YCDVDLVSA

SEQ ID NO: 1029764 - protein, 9 aa, Homo Sapiens
DSSVSLLLH

SEQ ID NO: 1029765 - protein, 9 aa, Homo Sapiens
ESSPNAPDH

SEQ ID NO: 1029766 - protein, 9 aa, Homo Sapiens
AFVDVYRYI

SEQ ID NO: 1029767 - protein, 9 aa, Homo Sapiens
FATCSLHVA

SEQ ID NO: 1029768 - protein, 9 aa, Homo Sapiens
MKLKFLQRK

SEQ ID NO: 1029769 - protein, 9 aa, Homo Sapiens
LKQWRQQML

SEQ ID NO: 1029770 - protein, 9 aa, Homo Sapiens
IASNVDYKH

SEQ ID NO: 1029771 - protein, 9 aa, Homo Sapiens
HELLKKKCK

SEQ ID NO: 1029772 - protein, 9 aa, Homo Sapiens
IPIMGFVAG

SEQ ID NO: 1029773 - protein, 9 aa, Homo Sapiens
LSTFAVGCA

SEQ ID NO: 1029774 - protein, 9 aa, Homo Sapiens
GETCEFNIT

SEQ ID NO: 1029775 - protein, 9 aa, Homo Sapiens
SKYIRPQIQ

SEQ ID NO: 1029776 - protein, 9 aa, Homo Sapiens
CFSHSSPRD

SEQ ID NO: 1029777 - protein, 9 aa, Homo Sapiens
PPGSTGLKG

SEQ ID NO: 1029778 - protein, 9 aa, Homo Sapiens
ESGLLFEII

SEQ ID NO: 1029779 - protein, 9 aa, Homo Sapiens
CCRRKRGFC

SEQ ID NO: 1029780 - protein, 9 aa, Homo Sapiens
FFNPALAAF

SEQ ID NO: 1029781 - protein, 9 aa, Homo Sapiens
SSGSPQETV

SEQ ID NO: 1029782 - protein, 9 aa, Homo Sapiens
AKHKFSGFP

SEQ ID NO: 1029783 - protein, 9 aa, Homo Sapiens
KSENINLNE

SEQ ID NO: 1029784 - protein, 9 aa, Homo Sapiens
ASIKLSALE

SEQ ID NO: 1029785 - protein, 9 aa, Homo Sapiens
FTKIVKRNV

SEQ ID NO: 1029786 - protein, 9 aa, Homo Sapiens
ESLMMNWLA

SEQ ID NO: 1029787 - protein, 9 aa, Homo Sapiens
HIPHSEDIL

SEQ ID NO: 1029788 - protein, 9 aa, Homo Sapiens
ELLVSHAQQ

SEQ ID NO: 1029789 - protein, 9 aa, Homo Sapiens
AVGVGNVRI

SEQ ID NO: 1029790 - protein, 9 aa, Homo Sapiens
SVQEKNHTV

SEQ ID NO: 1029791 - protein, 9 aa, Homo Sapiens
IVTPMLNSA

SEQ ID NO: 1029792 - protein, 9 aa, Homo Sapiens
YPAFLELDE

SEQ ID NO: 1029793 - protein, 9 aa, Homo Sapiens
SHQPTSVSF

SEQ ID NO: 1029794 - protein, 9 aa, Homo Sapiens
FYSAICNSS

SEQ ID NO: 1029795 - protein, 9 aa, Homo Sapiens
PSSLKEPGD

SEQ ID NO: 1029796 - protein, 9 aa, Homo Sapiens
APNSYGRRL

SEQ ID NO: 1029797 - protein, 9 aa, Homo Sapiens
TNTVASERV

SEQ ID NO: 1029798 - protein, 9 aa, Homo Sapiens
KITCPPINV

SEQ ID NO: 1029799 - protein, 9 aa, Homo Sapiens
AIPEGRVCA

SEQ ID NO: 1029800 - protein, 9 aa, Homo Sapiens
VAGGRKDPM

SEQ ID NO: 1029801 - protein, 9 aa, Homo Sapiens
LWKYKFSQL

SEQ ID NO: 1029802 - protein, 9 aa, Homo Sapiens
IFSLRNKKL

SEQ ID NO: 1029803 - protein, 9 aa, Homo Sapiens
QWGQFLDYD

SEQ ID NO: 1029804 - protein, 9 aa, Homo Sapiens
ALAAFVTFA

SEQ ID NO: 1029805 - protein, 9 aa, Homo Sapiens
NCQAEFSPA

SEQ ID NO: 1029806 - protein, 9 aa, Homo Sapiens
LSNGTLAGP

SEQ ID NO: 1029807 - protein, 9 aa, Homo Sapiens
SKKVIKEFS

SEQ ID NO: 1029808 - protein, 9 aa, Homo Sapiens
KDGCFQSEW

SEQ ID NO: 1029809 - protein, 9 aa, Homo Sapiens
YPNGTLQIF

SEQ ID NO: 1029810 - protein, 9 aa, Homo Sapiens
VSVKAMLNI

SEQ ID NO: 1029811 - protein, 9 aa, Homo Sapiens
KLYDPPGEK

SEQ ID NO: 1029812 - protein, 9 aa, Homo Sapiens
PDQEKLGEV

SEQ ID NO: 1029813 - protein, 9 aa, Homo Sapiens
VSQYEKNIA

SEQ ID NO: 1029814 - protein, 9 aa, Homo Sapiens
IQNSPNDLS

SEQ ID NO: 1029815 - protein, 9 aa, Homo Sapiens
SAVRKTKRK

SEQ ID NO: 1029816 - protein, 9 aa, Homo Sapiens
DLSGPTPSE

SEQ ID NO: 1029817 - protein, 9 aa, Homo Sapiens
FLFVKVTNQ

SEQ ID NO: 1029818 - protein, 9 aa, Homo Sapiens
WVTDPTSDS

SEQ ID NO: 1029819 - protein, 9 aa, Homo Sapiens
SGDIFLGVE

SEQ ID NO: 1029820 - protein, 9 aa, Homo Sapiens
SSGEIIFLI

SEQ ID NO: 1029821 - protein, 9 aa, Homo Sapiens
KRKTVDGYI

SEQ ID NO: 1029822 - protein, 9 aa, Homo Sapiens
SLSIRAMIK

SEQ ID NO: 1029823 - protein, 9 aa, Homo Sapiens
EINKGGNRK

SEQ ID NO: 1029824 - protein, 9 aa, Homo Sapiens
ASNKDILFS

SEQ ID NO: 1029825 - protein, 9 aa, Homo Sapiens
HKRIYSGEK

SEQ ID NO: 1029826 - protein, 9 aa, Homo Sapiens
QFEFVCESV

SEQ ID NO: 1029827 - protein, 9 aa, Homo Sapiens
PKKAVSRED

SEQ ID NO: 1029828 - protein, 9 aa, Homo Sapiens
FYFLGSTEC

SEQ ID NO: 1029829 - protein, 9 aa, Homo Sapiens
RGGWTVFQR

SEQ ID NO: 1029830 - protein, 9 aa, Homo Sapiens
PTCSPLQPH

SEQ ID NO: 1029831 - protein, 9 aa, Homo Sapiens
SRQPAFQLD

SEQ ID NO: 1029832 - protein, 9 aa, Homo Sapiens
IVYLGMMTG

SEQ ID NO: 1029833 - protein, 9 aa, Homo Sapiens
DWVRNVAWA

SEQ ID NO: 1029834 - protein, 9 aa, Homo Sapiens
YATKSRDAL

SEQ ID NO: 1029835 - protein, 9 aa, Homo Sapiens
LATSEVEAL

SEQ ID NO: 1029836 - protein, 9 aa, Homo Sapiens
LCYFPAQRG

SEQ ID NO: 1029837 - protein, 9 aa, Homo Sapiens
EDGSQSLSE

SEQ ID NO: 1029838 - protein, 9 aa, Homo Sapiens
AAPSFYLSV

SEQ ID NO: 1029839 - protein, 9 aa, Homo Sapiens
DESPCKGGT

SEQ ID NO: 1029840 - protein, 9 aa, Homo Sapiens
FTVLDLIGP

SEQ ID NO: 1029841 - protein, 9 aa, Homo Sapiens
AFSLKRQFR

SEQ ID NO: 1029842 - protein, 9 aa, Homo Sapiens
NNYNLGSFT

SEQ ID NO: 1029843 - protein, 9 aa, Homo Sapiens
VSLTATHSS

SEQ ID NO: 1029844 - protein, 9 aa, Homo Sapiens
RKHYNLSAA

SEQ ID NO: 1029845 - protein, 9 aa, Homo Sapiens
FMLILLFYA

SEQ ID NO: 1029846 - protein, 9 aa, Homo Sapiens
LKGATTQGL

SEQ ID NO: 1029847 - protein, 9 aa, Homo Sapiens
PISITVDPA

SEQ ID NO: 1029848 - protein, 9 aa, Homo Sapiens
GENFYKFEE

SEQ ID NO: 1029849 - protein, 9 aa, Homo Sapiens
KVEVLLGIK

SEQ ID NO: 1029850 - protein, 9 aa, Homo Sapiens
FCLLFRSEC

SEQ ID NO: 1029851 - protein, 9 aa, Homo Sapiens
DDDNSDDRD

SEQ ID NO: 1029852 - protein, 9 aa, Homo Sapiens
SPEKFEVLK

SEQ ID NO: 1029853 - protein, 9 aa, Homo Sapiens
AEKAGQAEA

SEQ ID NO: 1029854 - protein, 9 aa, Homo Sapiens
QALEARLEV

SEQ ID NO: 1029855 - protein, 9 aa, Homo Sapiens
NHENERILR

SEQ ID NO: 1029856 - protein, 9 aa, Homo Sapiens
FRKEREKSN

SEQ ID NO: 1029857 - protein, 9 aa, Homo Sapiens
MSIFRRIAG

SEQ ID NO: 1029858 - protein, 9 aa, Homo Sapiens
YGMGPGWSG

SEQ ID NO: 1029859 - protein, 9 aa, Homo Sapiens
YADKILDDS

SEQ ID NO: 1029860 - protein, 9 aa, Homo Sapiens
MKDSVNVTP

SEQ ID NO: 1029861 - protein, 9 aa, Homo Sapiens
KEETAVPTS

SEQ ID NO: 1029862 - protein, 9 aa, Homo Sapiens
TTRVYVKMP

SEQ ID NO: 1029863 - protein, 9 aa, Homo Sapiens
DVTQGCLVN

SEQ ID NO: 1029864 - protein, 9 aa, Homo Sapiens
DIVDSHVGM

SEQ ID NO: 1029865 - protein, 9 aa, Homo Sapiens
YNGWIWSHQ

SEQ ID NO: 1029866 - protein, 9 aa, Homo Sapiens
EFSSGSSST

SEQ ID NO: 1029867 - protein, 9 aa, Homo Sapiens
EITRERSRK

SEQ ID NO: 1029868 - protein, 9 aa, Homo Sapiens
SQDRTLRTW

SEQ ID NO: 1029869 - protein, 9 aa, Homo Sapiens
RTLHLFGVT

SEQ ID NO: 1029870 - protein, 9 aa, Homo Sapiens
EFPGFPGAS

SEQ ID NO: 1029871 - protein, 9 aa, Homo Sapiens
VQPVYLYPQ

SEQ ID NO: 1029872 - protein, 9 aa, Homo Sapiens
GSTYKRRAF

SEQ ID NO: 1029873 - protein, 9 aa, Homo Sapiens
QCDKDPVIM

SEQ ID NO: 1029874 - protein, 9 aa, Homo Sapiens
RRKGCVDDS

SEQ ID NO: 1029875 - protein, 9 aa, Homo Sapiens
SPVFMTASA

SEQ ID NO: 1029876 - protein, 9 aa, Homo Sapiens
SGGGILEAG

SEQ ID NO: 1029877 - protein, 9 aa, Homo Sapiens
QPSSSSRKS

SEQ ID NO: 1029878 - protein, 9 aa, Homo Sapiens
ILLFYANIV

SEQ ID NO: 1029879 - protein, 9 aa, Homo Sapiens
VDKRFQCKE

SEQ ID NO: 1029880 - protein, 9 aa, Homo Sapiens
NLPVYVGGI

SEQ ID NO: 1029881 - protein, 9 aa, Homo Sapiens
LKVCLDFSA

SEQ ID NO: 1029882 - protein, 9 aa, Homo Sapiens
LIFDDYRRK

SEQ ID NO: 1029883 - protein, 9 aa, Homo Sapiens
TLAEVKKEG

SEQ ID NO: 1029884 - protein, 9 aa, Homo Sapiens
KVTGCPPFD

SEQ ID NO: 1029885 - protein, 9 aa, Homo Sapiens
LESISPSNR

SEQ ID NO: 1029886 - protein, 9 aa, Homo Sapiens
FREIICCYP

SEQ ID NO: 1029887 - protein, 9 aa, Homo Sapiens
SNNKLCDLP

SEQ ID NO: 1029888 - protein, 9 aa, Homo Sapiens
ASTASSTRR

SEQ ID NO: 1029889 - protein, 9 aa, Homo Sapiens
TQKLQEKPS

SEQ ID NO: 1029890 - protein, 9 aa, Homo Sapiens
FRAKDLSVI

SEQ ID NO: 1029891 - protein, 9 aa, Homo Sapiens
EGEEEKEEE

SEQ ID NO: 1029892 - protein, 9 aa, Homo Sapiens
SKPPLISHL

SEQ ID NO: 1029893 - protein, 9 aa, Homo Sapiens
SFGFGQHES

SEQ ID NO: 1029894 - protein, 9 aa, Homo Sapiens
DVICLKQEQ

SEQ ID NO: 1029895 - protein, 9 aa, Homo Sapiens
YTGGKLNKC

SEQ ID NO: 1029896 - protein, 9 aa, Homo Sapiens
SSDSFYTPE

SEQ ID NO: 1029897 - protein, 9 aa, Homo Sapiens
IVGSRPGFN

SEQ ID NO: 1029898 - protein, 9 aa, Homo Sapiens
AFSLGGPFG

SEQ ID NO: 1029899 - protein, 9 aa, Homo Sapiens
TKGERGKAG

SEQ ID NO: 1029900 - protein, 9 aa, Homo Sapiens
NDLNVFPPE

SEQ ID NO: 1029901 - protein, 9 aa, Homo Sapiens
KHIESKTAF

SEQ ID NO: 1029902 - protein, 9 aa, Homo Sapiens
HLSKDTLLS

SEQ ID NO: 1029903 - protein, 9 aa, Homo Sapiens
GASDVKLVQ

SEQ ID NO: 1029904 - protein, 9 aa, Homo Sapiens
ACPGKDRRT

SEQ ID NO: 1029905 - protein, 9 aa, Homo Sapiens
LLSVPPGPT

SEQ ID NO: 1029906 - protein, 9 aa, Homo Sapiens
QSVCLISLC

SEQ ID NO: 1029907 - protein, 9 aa, Homo Sapiens
GNLHQASTS

SEQ ID NO: 1029908 - protein, 9 aa, Homo Sapiens
SCPSFPLPS

SEQ ID NO: 1029909 - protein, 9 aa, Homo Sapiens
IPAPRICRI

SEQ ID NO: 1029910 - protein, 9 aa, Homo Sapiens
QTPRHLVME

SEQ ID NO: 1029911 - protein, 9 aa, Homo Sapiens
QKNLNRETN

SEQ ID NO: 1029912 - protein, 9 aa, Homo Sapiens
EWPIKKKKS

SEQ ID NO: 1029913 - protein, 9 aa, Homo Sapiens
VSLEKIRQD

SEQ ID NO: 1029914 - protein, 9 aa, Homo Sapiens
GFYQVPFLK

SEQ ID NO: 1029915 - protein, 9 aa, Homo Sapiens
ELAERPKAV

SEQ ID NO: 1029916 - protein, 9 aa, Homo Sapiens
PKKSSPFIN

SEQ ID NO: 1029917 - protein, 9 aa, Homo Sapiens
VEILTSIVS

SEQ ID NO: 1029918 - protein, 9 aa, Homo Sapiens
YYGQGSKAC

SEQ ID NO: 1029919 - protein, 9 aa, Homo Sapiens
WEPNAISFL

SEQ ID NO: 1029920 - protein, 9 aa, Homo Sapiens
QAIASNVDY

SEQ ID NO: 1029921 - protein, 9 aa, Homo Sapiens
VYVRDPTST

SEQ ID NO: 1029922 - protein, 9 aa, Homo Sapiens
EKSLNCTVK

SEQ ID NO: 1029923 - protein, 9 aa, Homo Sapiens
CINFGAHRE

SEQ ID NO: 1029924 - protein, 9 aa, Homo Sapiens
RATCISSLS

SEQ ID NO: 1029925 - protein, 9 aa, Homo Sapiens
SYMVYMTQY

SEQ ID NO: 1029926 - protein, 9 aa, Homo Sapiens
FMGFEKFVQ

SEQ ID NO: 1029927 - protein, 9 aa, Homo Sapiens
IAVSFCILA

SEQ ID NO: 1029928 - protein, 9 aa, Homo Sapiens
AGQILASVA

SEQ ID NO: 1029929 - protein, 9 aa, Homo Sapiens
ALSNLPTFF

SEQ ID NO: 1029930 - protein, 9 aa, Homo Sapiens
FSSDHYAIE

SEQ ID NO: 1029931 - protein, 9 aa, Homo Sapiens
YDAGIDIWG

SEQ ID NO: 1029932 - protein, 9 aa, Homo Sapiens
ISEISSQLE

SEQ ID NO: 1029933 - protein, 9 aa, Homo Sapiens
ESQVTFHNK

SEQ ID NO: 1029934 - protein, 9 aa, Homo Sapiens
VILKNAAEE

SEQ ID NO: 1029935 - protein, 9 aa, Homo Sapiens
GISVGAACP

SEQ ID NO: 1029936 - protein, 9 aa, Homo Sapiens
QYLAICCPL

SEQ ID NO: 1029937 - protein, 9 aa, Homo Sapiens
QTGSGLLPS

SEQ ID NO: 1029938 - protein, 9 aa, Homo Sapiens
DIPYRKEIS

SEQ ID NO: 1029939 - protein, 9 aa, Homo Sapiens
GLFSLFQAQ

SEQ ID NO: 1029940 - protein, 9 aa, Homo Sapiens
MSFMLFDPS

SEQ ID NO: 1029941 - protein, 9 aa, Homo Sapiens
KGEGVQLSA

SEQ ID NO: 1029942 - protein, 9 aa, Homo Sapiens
GSMMQNHGD

SEQ ID NO: 1029943 - protein, 9 aa, Homo Sapiens
AGQEDTIQK

SEQ ID NO: 1029944 - protein, 9 aa, Homo Sapiens
GVGNVRIKF

SEQ ID NO: 1029945 - protein, 9 aa, Homo Sapiens
MHQRILVSE

SEQ ID NO: 1029946 - protein, 9 aa, Homo Sapiens
LLSGGGTTT

SEQ ID NO: 1029947 - protein, 9 aa, Homo Sapiens
NSPVGEGAG

SEQ ID NO: 1029948 - protein, 9 aa, Homo Sapiens
IRARRKTTR

SEQ ID NO: 1029949 - protein, 9 aa, Homo Sapiens
GCEHELLKK

SEQ ID NO: 1029950 - protein, 9 aa, Homo Sapiens
MEDVIAELR

SEQ ID NO: 1029951 - protein, 9 aa, Homo Sapiens
AEKKEYFYK

SEQ ID NO: 1029952 - protein, 9 aa, Homo Sapiens
ISPPLSSPG

SEQ ID NO: 1029953 - protein, 9 aa, Homo Sapiens
SPLAWVELK

SEQ ID NO: 1029954 - protein, 9 aa, Homo Sapiens
IIFYDETSK

SEQ ID NO: 1029955 - protein, 9 aa, Homo Sapiens
GEEGLSNYI

SEQ ID NO: 1029956 - protein, 9 aa, Homo Sapiens
TDNRIVLKV

SEQ ID NO: 1029957 - protein, 9 aa, Homo Sapiens
TESPELIEV

SEQ ID NO: 1029958 - protein, 9 aa, Homo Sapiens
YPARKVRDV

SEQ ID NO: 1029959 - protein, 9 aa, Homo Sapiens
QNSPNDLSA

SEQ ID NO: 1029960 - protein, 9 aa, Homo Sapiens
VCLNQGPLE

SEQ ID NO: 1029961 - protein, 9 aa, Homo Sapiens
LFIGTDNRI

SEQ ID NO: 1029962 - protein, 9 aa, Homo Sapiens
QLRAVRMLS

SEQ ID NO: 1029963 - protein, 9 aa, Homo Sapiens
TTLSSAEPT

SEQ ID NO: 1029964 - protein, 9 aa, Homo Sapiens
IYMTWIKNG

SEQ ID NO: 1029965 - protein, 9 aa, Homo Sapiens
LGLPHGPYG

SEQ ID NO: 1029966 - protein, 9 aa, Homo Sapiens
ASQDRTLRT

SEQ ID NO: 1029967 - protein, 9 aa, Homo Sapiens
TRLEFLRVA

SEQ ID NO: 1029968 - protein, 9 aa, Homo Sapiens
LAVLLIIIA

SEQ ID NO: 1029969 - protein, 9 aa, Homo Sapiens
YFWEKKVTG

SEQ ID NO: 1029970 - protein, 9 aa, Homo Sapiens
PICVSFAFY

SEQ ID NO: 1029971 - protein, 9 aa, Homo Sapiens
PPRLPPEGE

SEQ ID NO: 1029972 - protein, 9 aa, Homo Sapiens
CYRARTTNY

SEQ ID NO: 1029973 - protein, 9 aa, Homo Sapiens
VEKNEERRS

SEQ ID NO: 1029974 - protein, 9 aa, Homo Sapiens
DSFTKIVKR

SEQ ID NO: 1029975 - protein, 9 aa, Homo Sapiens
GLKAKMDAD

SEQ ID NO: 1029976 - protein, 9 aa, Homo Sapiens
FLFTIEGLG

SEQ ID NO: 1029977 - protein, 9 aa, Homo Sapiens
FMLRGANIV

SEQ ID NO: 1029978 - protein, 9 aa, Homo Sapiens
KKAVSREDS

SEQ ID NO: 1029979 - protein, 9 aa, Homo Sapiens
RPFGPFMKV

SEQ ID NO: 1029980 - protein, 9 aa, Homo Sapiens
PNHTENNAC

SEQ ID NO: 1029981 - protein, 9 aa, Homo Sapiens
NAPTHPPEH

SEQ ID NO: 1029982 - protein, 9 aa, Homo Sapiens
SSSRFLLDF

SEQ ID NO: 1029983 - protein, 9 aa, Homo Sapiens
KKNAMYGNF

SEQ ID NO: 1029984 - protein, 9 aa, Homo Sapiens
TLPQEVGSH

SEQ ID NO: 1029985 - protein, 9 aa, Homo Sapiens
QPLPKSLAS

SEQ ID NO: 1029986 - protein, 9 aa, Homo Sapiens
NMENLTEVI

SEQ ID NO: 1029987 - protein, 9 aa, Homo Sapiens
HLVEVVLNG

SEQ ID NO: 1029988 - protein, 9 aa, Homo Sapiens
ARTKTLRER

SEQ ID NO: 1029989 - protein, 9 aa, Homo Sapiens
DCLPLSQPQ

SEQ ID NO: 1029990 - protein, 9 aa, Homo Sapiens
SERLASGPI

SEQ ID NO: 1029991 - protein, 9 aa, Homo Sapiens
NYVQEVKRI

SEQ ID NO: 1029992 - protein, 9 aa, Homo Sapiens
FGSRPRNCI

SEQ ID NO: 1029993 - protein, 9 aa, Homo Sapiens
VFMTASASS

SEQ ID NO: 1029994 - protein, 9 aa, Homo Sapiens
SPRCLVLEC

SEQ ID NO: 1029995 - protein, 9 aa, Homo Sapiens
ERKHYNLSA

SEQ ID NO: 1029996 - protein, 9 aa, Homo Sapiens
VRFVFSEPT

SEQ ID NO: 1029997 - protein, 9 aa, Homo Sapiens
GATDEQQKS

SEQ ID NO: 1029998 - protein, 9 aa, Homo Sapiens
PLITAFYVA

SEQ ID NO: 1029999 - protein, 9 aa, Homo Sapiens
GLLSLQEKK

SEQ ID NO: 1030000 - protein, 9 aa, Homo Sapiens
IPLVFFTIL

SEQ ID NO: 1030001 - protein, 9 aa, Homo Sapiens
KPSKTGEEQ

SEQ ID NO: 1030002 - protein, 9 aa, Homo Sapiens
EAVAPTKSS

SEQ ID NO: 1030003 - protein, 9 aa, Homo Sapiens
EIYARDVLE

SEQ ID NO: 1030004 - protein, 9 aa, Homo Sapiens
ASMFSPSSL

SEQ ID NO: 1030005 - protein, 9 aa, Homo Sapiens
KAKDVCLNQ

SEQ ID NO: 1030006 - protein, 9 aa, Homo Sapiens
GRQVIGLFR

SEQ ID NO: 1030007 - protein, 9 aa, Homo Sapiens
RSIYAVAMQ

SEQ ID NO: 1030008 - protein, 9 aa, Homo Sapiens
VLEQLYSRD

SEQ ID NO: 1030009 - protein, 9 aa, Homo Sapiens
SRPSLLGSY

SEQ ID NO: 1030010 - protein, 9 aa, Homo Sapiens
SDGDEENEL

SEQ ID NO: 1030011 - protein, 9 aa, Homo Sapiens
PNAPDHTSE

SEQ ID NO: 1030012 - protein, 9 aa, Homo Sapiens
FFLTTHTGE

SEQ ID NO: 1030013 - protein, 9 aa, Homo Sapiens
GGKSSSEPW

SEQ ID NO: 1030014 - protein, 9 aa, Homo Sapiens
LGSAYNHTM

SEQ ID NO: 1030015 - protein, 9 aa, Homo Sapiens
KKSHKSSEE

SEQ ID NO: 1030016 - protein, 9 aa, Homo Sapiens
SPLPSDMLT

SEQ ID NO: 1030017 - protein, 9 aa, Homo Sapiens
LCFRVYYSK

SEQ ID NO: 1030018 - protein, 9 aa, Homo Sapiens
ACAATFEKT

SEQ ID NO: 1030019 - protein, 9 aa, Homo Sapiens
KHGRAVCCV

SEQ ID NO: 1030020 - protein, 9 aa, Homo Sapiens
CEGGSVAGC

SEQ ID NO: 1030021 - protein, 9 aa, Homo Sapiens
KPTLWAKPA

SEQ ID NO: 1030022 - protein, 9 aa, Homo Sapiens
LQRLERDDD

SEQ ID NO: 1030023 - protein, 9 aa, Homo Sapiens
VITVIESGL

SEQ ID NO: 1030024 - protein, 9 aa, Homo Sapiens
QLVGKEALC

SEQ ID NO: 1030025 - protein, 9 aa, Homo Sapiens
SGATGKMIF

SEQ ID NO: 1030026 - protein, 9 aa, Homo Sapiens
GLVLQKMGQ

SEQ ID NO: 1030027 - protein, 9 aa, Homo Sapiens
VECSPAHTR

SEQ ID NO: 1030028 - protein, 9 aa, Homo Sapiens
LGLLSGGGT

SEQ ID NO: 1030029 - protein, 9 aa, Homo Sapiens
KNAQNINPF

SEQ ID NO: 1030030 - protein, 9 aa, Homo Sapiens
GIALFSWPL

SEQ ID NO: 1030031 - protein, 9 aa, Homo Sapiens
GATGKMIFL

SEQ ID NO: 1030032 - protein, 9 aa, Homo Sapiens
ATKSRDALT

SEQ ID NO: 1030033 - protein, 9 aa, Homo Sapiens
FESIQNSPN

SEQ ID NO: 1030034 - protein, 9 aa, Homo Sapiens
VHKTQEKEE

SEQ ID NO: 1030035 - protein, 9 aa, Homo Sapiens
TGKYCQQPI

SEQ ID NO: 1030036 - protein, 9 aa, Homo Sapiens
DRYIAICHS

SEQ ID NO: 1030037 - protein, 9 aa, Homo Sapiens
LFCLQSLVF

SEQ ID NO: 1030038 - protein, 9 aa, Homo Sapiens
ISQWSFFFR

SEQ ID NO: 1030039 - protein, 9 aa, Homo Sapiens
LSQPQQEAS

SEQ ID NO: 1030040 - protein, 9 aa, Homo Sapiens
PACQPLMEP

SEQ ID NO: 1030041 - protein, 9 aa, Homo Sapiens
NTVASERVT

SEQ ID NO: 1030042 - protein, 9 aa, Homo Sapiens
GNQNRSGRP

SEQ ID NO: 1030043 - protein, 9 aa, Homo Sapiens
RNTIGFFNC

SEQ ID NO: 1030044 - protein, 9 aa, Homo Sapiens
PSFGDPAVS

SEQ ID NO: 1030045 - protein, 9 aa, Homo Sapiens
ILDNLGVDA

SEQ ID NO: 1030046 - protein, 9 aa, Homo Sapiens
QFLDYDLDS

SEQ ID NO: 1030047 - protein, 9 aa, Homo Sapiens
STSWHLQPT

SEQ ID NO: 1030048 - protein, 9 aa, Homo Sapiens
SLVKLQGTS

SEQ ID NO: 1030049 - protein, 9 aa, Homo Sapiens
LDDLEREIK

SEQ ID NO: 1030050 - protein, 9 aa, Homo Sapiens
SSSSLLDYS

SEQ ID NO: 1030051 - protein, 9 aa, Homo Sapiens
IEWVKQYAI

SEQ ID NO: 1030052 - protein, 9 aa, Homo Sapiens
HHLEIQNNF

SEQ ID NO: 1030053 - protein, 9 aa, Homo Sapiens
SDAGRYFFC

SEQ ID NO: 1030054 - protein, 9 aa, Homo Sapiens
ASYMVYMTQ

SEQ ID NO: 1030055 - protein, 9 aa, Homo Sapiens
AEKDKKLRL

SEQ ID NO: 1030056 - protein, 9 aa, Homo Sapiens
VERSKPVAD

SEQ ID NO: 1030057 - protein, 9 aa, Homo Sapiens
PLSPESPED

SEQ ID NO: 1030058 - protein, 9 aa, Homo Sapiens
EEIIHDLSV

SEQ ID NO: 1030059 - protein, 9 aa, Homo Sapiens
DPRGEAKEL

SEQ ID NO: 1030060 - protein, 9 aa, Homo Sapiens
KLLSSGGCR

SEQ ID NO: 1030061 - protein, 9 aa, Homo Sapiens
FDGPNKNPE

SEQ ID NO: 1030062 - protein, 9 aa, Homo Sapiens
VELMRILRE

SEQ ID NO: 1030063 - protein, 9 aa, Homo Sapiens
TTFTEPITV

SEQ ID NO: 1030064 - protein, 9 aa, Homo Sapiens
TLRERITVT

SEQ ID NO: 1030065 - protein, 9 aa, Homo Sapiens
CLPGWTGKY

SEQ ID NO: 1030066 - protein, 9 aa, Homo Sapiens
VDWKHPKIT

SEQ ID NO: 1030067 - protein, 9 aa, Homo Sapiens
YFLGSTECF

SEQ ID NO: 1030068 - protein, 9 aa, Homo Sapiens
SRSGTAQVY

SEQ ID NO: 1030069 - protein, 9 aa, Homo Sapiens
NQAVLQICP

SEQ ID NO: 1030070 - protein, 9 aa, Homo Sapiens
HHQRHSLLR

SEQ ID NO: 1030071 - protein, 9 aa, Homo Sapiens
AAPAKIVIQ

SEQ ID NO: 1030072 - protein, 9 aa, Homo Sapiens
FYYTQYSQT

SEQ ID NO: 1030073 - protein, 9 aa, Homo Sapiens
FENVLKEET

SEQ ID NO: 1030074 - protein, 9 aa, Homo Sapiens
IPMAFSLKR

SEQ ID NO: 1030075 - protein, 9 aa, Homo Sapiens
SFENVLKEE

SEQ ID NO: 1030076 - protein, 9 aa, Homo Sapiens
SARPKLYDP

SEQ ID NO: 1030077 - protein, 9 aa, Homo Sapiens
PPLLSRTSQ

SEQ ID NO: 1030078 - protein, 9 aa, Homo Sapiens
ASKSSPARN

SEQ ID NO: 1030079 - protein, 9 aa, Homo Sapiens
VQLTEDQKQ

SEQ ID NO: 1030080 - protein, 9 aa, Homo Sapiens
SNENCNNNS

SEQ ID NO: 1030081 - protein, 9 aa, Homo Sapiens
KQKNGTLAL

SEQ ID NO: 1030082 - protein, 9 aa, Homo Sapiens
VCLISLCQR

SEQ ID NO: 1030083 - protein, 9 aa, Homo Sapiens
EKIRQDQKL

SEQ ID NO: 1030084 - protein, 9 aa, Homo Sapiens
LEQLYSRDM

SEQ ID NO: 1030085 - protein, 9 aa, Homo Sapiens
KDLSVILKA

SEQ ID NO: 1030086 - protein, 9 aa, Homo Sapiens
PLFQLNKNT

SEQ ID NO: 1030087 - protein, 9 aa, Homo Sapiens
SWPLYSMYS

SEQ ID NO: 1030088 - protein, 9 aa, Homo Sapiens
QQLLEHIQK

SEQ ID NO: 1030089 - protein, 9 aa, Homo Sapiens
SYNVDVWFR

SEQ ID NO: 1030090 - protein, 9 aa, Homo Sapiens
SWQLEKSLN

SEQ ID NO: 1030091 - protein, 9 aa, Homo Sapiens
SSHFSAHWR

SEQ ID NO: 1030092 - protein, 9 aa, Homo Sapiens
VSSTLLRSS

SEQ ID NO: 1030093 - protein, 9 aa, Homo Sapiens
KHKFSGFPR

SEQ ID NO: 1030094 - protein, 9 aa, Homo Sapiens
EATETPKCS

SEQ ID NO: 1030095 - protein, 9 aa, Homo Sapiens
EEARRTFFK

SEQ ID NO: 1030096 - protein, 9 aa, Homo Sapiens
NVALQKVEN

SEQ ID NO: 1030097 - protein, 9 aa, Homo Sapiens
DKAFHFKLK

SEQ ID NO: 1030098 - protein, 9 aa, Homo Sapiens
IDYLLSTQQ

SEQ ID NO: 1030099 - protein, 9 aa, Homo Sapiens
ASAPAACQI

SEQ ID NO: 1030100 - protein, 9 aa, Homo Sapiens
FSYCSEERP

SEQ ID NO: 1030101 - protein, 9 aa, Homo Sapiens
PYGEKMAVV

SEQ ID NO: 1030102 - protein, 9 aa, Homo Sapiens
SCINFGAHR

SEQ ID NO: 1030103 - protein, 9 aa, Homo Sapiens
NALFLKASD

SEQ ID NO: 1030104 - protein, 9 aa, Homo Sapiens
GQEDTIQKE

SEQ ID NO: 1030105 - protein, 9 aa, Homo Sapiens
PEPLVSITI

SEQ ID NO: 1030106 - protein, 9 aa, Homo Sapiens
NKKLKNAIN

SEQ ID NO: 1030107 - protein, 9 aa, Homo Sapiens
KIKSFQGSS

SEQ ID NO: 1030108 - protein, 9 aa, Homo Sapiens
LDWRPECKL

SEQ ID NO: 1030109 - protein, 9 aa, Homo Sapiens
DADTNDEGQ

SEQ ID NO: 1030110 - protein, 9 aa, Homo Sapiens
KNPNLEEDQ

SEQ ID NO: 1030111 - protein, 9 aa, Homo Sapiens
WSLSIRAMI

SEQ ID NO: 1030112 - protein, 9 aa, Homo Sapiens
MLNSAIYTL

SEQ ID NO: 1030113 - protein, 9 aa, Homo Sapiens
TASDCSRDS

SEQ ID NO: 1030114 - protein, 9 aa, Homo Sapiens
RSCNVRDTT

SEQ ID NO: 1030115 - protein, 9 aa, Homo Sapiens
ELLDELMNF

SEQ ID NO: 1030116 - protein, 9 aa, Homo Sapiens
LLEAISEIS

SEQ ID NO: 1030117 - protein, 9 aa, Homo Sapiens
IPPEPPRIP

SEQ ID NO: 1030118 - protein, 9 aa, Homo Sapiens
LDNVDIFSV

SEQ ID NO: 1030119 - protein, 9 aa, Homo Sapiens
LCIARFRFR

SEQ ID NO: 1030120 - protein, 9 aa, Homo Sapiens
VSKVERKKN

SEQ ID NO: 1030121 - protein, 9 aa, Homo Sapiens
SSLIIGPTK

SEQ ID NO: 1030122 - protein, 9 aa, Homo Sapiens
GRPQDDIDS

SEQ ID NO: 1030123 - protein, 9 aa, Homo Sapiens
PIFQQVLQP

SEQ ID NO: 1030124 - protein, 9 aa, Homo Sapiens
KTHTGENSY

SEQ ID NO: 1030125 - protein, 9 aa, Homo Sapiens
LDMSFMLFD

SEQ ID NO: 1030126 - protein, 9 aa, Homo Sapiens
FAKKIIPSK

SEQ ID NO: 1030127 - protein, 9 aa, Homo Sapiens
VKPCSCLER

SEQ ID NO: 1030128 - protein, 9 aa, Homo Sapiens
EELESEGMY

SEQ ID NO: 1030129 - protein, 9 aa, Homo Sapiens
IKKVQHIQL

SEQ ID NO: 1030130 - protein, 9 aa, Homo Sapiens
YSSGSLPEM

SEQ ID NO: 1030131 - protein, 9 aa, Homo Sapiens
TEEARRTFF

SEQ ID NO: 1030132 - protein, 9 aa, Homo Sapiens
KTTRMLMIV

SEQ ID NO: 1030133 - protein, 9 aa, Homo Sapiens
SYLAKDATS

SEQ ID NO: 1030134 - protein, 9 aa, Homo Sapiens
LSAQEDIPD

SEQ ID NO: 1030135 - protein, 9 aa, Homo Sapiens
SEDNIQHLV

SEQ ID NO: 1030136 - protein, 9 aa, Homo Sapiens
YLFIIWNKK

SEQ ID NO: 1030137 - protein, 9 aa, Homo Sapiens
HDPIGQDFV

SEQ ID NO: 1030138 - protein, 9 aa, Homo Sapiens
WSPLREGIF

SEQ ID NO: 1030139 - protein, 9 aa, Homo Sapiens
FVCPLNRPF

SEQ ID NO: 1030140 - protein, 9 aa, Homo Sapiens
NQNRSGRPG

SEQ ID NO: 1030141 - protein, 9 aa, Homo Sapiens
NFFDDLQVV

SEQ ID NO: 1030142 - protein, 9 aa, Homo Sapiens
ALKFVAHLI

SEQ ID NO: 1030143 - protein, 9 aa, Homo Sapiens
VRPQVSLTA

SEQ ID NO: 1030144 - protein, 9 aa, Homo Sapiens
VCCSSSENN

SEQ ID NO: 1030145 - protein, 9 aa, Homo Sapiens
KWRNSKERK

SEQ ID NO: 1030146 - protein, 9 aa, Homo Sapiens
LQQVRALYQ

SEQ ID NO: 1030147 - protein, 9 aa, Homo Sapiens
FCTCLGAQP

SEQ ID NO: 1030148 - protein, 9 aa, Homo Sapiens
VPSVTANGA

SEQ ID NO: 1030149 - protein, 9 aa, Homo Sapiens
LRYWLYADK

SEQ ID NO: 1030150 - protein, 9 aa, Homo Sapiens
SQRPWTLLC

SEQ ID NO: 1030151 - protein, 9 aa, Homo Sapiens
SPLKSEDSG

SEQ ID NO: 1030152 - protein, 9 aa, Homo Sapiens
SSLKEPGDP

SEQ ID NO: 1030153 - protein, 9 aa, Homo Sapiens
GSSFPVSKS

SEQ ID NO: 1030154 - protein, 9 aa, Homo Sapiens
DAFFSPSNF

SEQ ID NO: 1030155 - protein, 9 aa, Homo Sapiens
TPFGSRPRN

SEQ ID NO: 1030156 - protein, 9 aa, Homo Sapiens
SCWSSWSSC

SEQ ID NO: 1030157 - protein, 9 aa, Homo Sapiens
STLGATDEQ

SEQ ID NO: 1030158 - protein, 9 aa, Homo Sapiens
WRPSQGPVS

SEQ ID NO: 1030159 - protein, 9 aa, Homo Sapiens
GRRLIQVGR

SEQ ID NO: 1030160 - protein, 9 aa, Homo Sapiens
PPRIPPFPA

SEQ ID NO: 1030161 - protein, 9 aa, Homo Sapiens
RKVQKVSSD

SEQ ID NO: 1030162 - protein, 9 aa, Homo Sapiens
LVQNAASLH

SEQ ID NO: 1030163 - protein, 9 aa, Homo Sapiens
KSSSEPWLW

SEQ ID NO: 1030164 - protein, 9 aa, Homo Sapiens
RRQSWRSRQ

SEQ ID NO: 1030165 - protein, 9 aa, Homo Sapiens
TAVCNNGAG

SEQ ID NO: 1030166 - protein, 9 aa, Homo Sapiens
GRGLVLQKM

SEQ ID NO: 1030167 - protein, 9 aa, Homo Sapiens
LPSSPCVGS

SEQ ID NO: 1030168 - protein, 9 aa, Homo Sapiens
IQKQINELE

SEQ ID NO: 1030169 - protein, 9 aa, Homo Sapiens
KCKAAVLWK

SEQ ID NO: 1030170 - protein, 9 aa, Homo Sapiens
FALLNAFQE

SEQ ID NO: 1030171 - protein, 9 aa, Homo Sapiens
MERVNETVG

SEQ ID NO: 1030172 - protein, 9 aa, Homo Sapiens
KAPPPAFLT

SEQ ID NO: 1030173 - protein, 9 aa, Homo Sapiens
PSGFFMKMM

SEQ ID NO: 1030174 - protein, 9 aa, Homo Sapiens
TQPNFSGGN

SEQ ID NO: 1030175 - protein, 9 aa, Homo Sapiens
EAAAFFRRS

SEQ ID NO: 1030176 - protein, 9 aa, Homo Sapiens
MGWLANSST

SEQ ID NO: 1030177 - protein, 9 aa, Homo Sapiens
AWATLGNPI

SEQ ID NO: 1030178 - protein, 9 aa, Homo Sapiens
RVGIINDDI

SEQ ID NO: 1030179 - protein, 9 aa, Homo Sapiens
LKIKIDPQF

SEQ ID NO: 1030180 - protein, 9 aa, Homo Sapiens
GFFNCRCNH

SEQ ID NO: 1030181 - protein, 9 aa, Homo Sapiens
TLDDSKWKK

SEQ ID NO: 1030182 - protein, 9 aa, Homo Sapiens
PPWLLNIKY

SEQ ID NO: 1030183 - protein, 9 aa, Homo Sapiens
IREETFFFK

SEQ ID NO: 1030184 - protein, 9 aa, Homo Sapiens
PRGEAKELG

SEQ ID NO: 1030185 - protein, 9 aa, Homo Sapiens
RGEYFWEKK

SEQ ID NO: 1030186 - protein, 9 aa, Homo Sapiens
VAVAGEDGR

SEQ ID NO: 1030187 - protein, 9 aa, Homo Sapiens
GYFLGNVWF

SEQ ID NO: 1030188 - protein, 9 aa, Homo Sapiens
TSSPMEPSI

SEQ ID NO: 1030189 - protein, 9 aa, Homo Sapiens
ENPAYLRQC

SEQ ID NO: 1030190 - protein, 9 aa, Homo Sapiens
EIKQKFLEL

SEQ ID NO: 1030191 - protein, 9 aa, Homo Sapiens
QKERIREQE

SEQ ID NO: 1030192 - protein, 9 aa, Homo Sapiens
TLEDYKEPI

SEQ ID NO: 1030193 - protein, 9 aa, Homo Sapiens
FSARQLVKI

SEQ ID NO: 1030194 - protein, 9 aa, Homo Sapiens
AAEAVRDYS

SEQ ID NO: 1030195 - protein, 9 aa, Homo Sapiens
GLSTFAVGC

SEQ ID NO: 1030196 - protein, 9 aa, Homo Sapiens
FYQVPFLKQ

SEQ ID NO: 1030197 - protein, 9 aa, Homo Sapiens
YRYIATPRV

SEQ ID NO: 1030198 - protein, 9 aa, Homo Sapiens
TNNALQKNS

SEQ ID NO: 1030199 - protein, 9 aa, Homo Sapiens
SSTLLRSSG

SEQ ID NO: 1030200 - protein, 9 aa, Homo Sapiens
RKTVDGYIN

SEQ ID NO: 1030201 - protein, 9 aa, Homo Sapiens
ARQLREYQK

SEQ ID NO: 1030202 - protein, 9 aa, Homo Sapiens
ILVCCLDFR

SEQ ID NO: 1030203 - protein, 9 aa, Homo Sapiens
GGDFQKRTV

SEQ ID NO: 1030204 - protein, 9 aa, Homo Sapiens
EDCIYKGGI

SEQ ID NO: 1030205 - protein, 9 aa, Homo Sapiens
TVDGYINED

SEQ ID NO: 1030206 - protein, 9 aa, Homo Sapiens
SYQLHTPMY

SEQ ID NO: 1030207 - protein, 9 aa, Homo Sapiens
LNTDFFAKK

SEQ ID NO: 1030208 - protein, 9 aa, Homo Sapiens
SKERKLLSS

SEQ ID NO: 1030209 - protein, 9 aa, Homo Sapiens
ADSEVELSV

SEQ ID NO: 1030210 - protein, 9 aa, Homo Sapiens
HWLLWLGSH

SEQ ID NO: 1030211 - protein, 9 aa, Homo Sapiens
ARNRTYMMM

SEQ ID NO: 1030212 - protein, 9 aa, Homo Sapiens
SERVTKDSI

SEQ ID NO: 1030213 - protein, 9 aa, Homo Sapiens
MQQRISSIK

SEQ ID NO: 1030214 - protein, 9 aa, Homo Sapiens
VEASLEIPH

SEQ ID NO: 1030215 - protein, 9 aa, Homo Sapiens
VISPPLSSP

SEQ ID NO: 1030216 - protein, 9 aa, Homo Sapiens
LHAKLLKWL

SEQ ID NO: 1030217 - protein, 9 aa, Homo Sapiens
SPVTFSPHK

SEQ ID NO: 1030218 - protein, 9 aa, Homo Sapiens
VRDPTSTIK

SEQ ID NO: 1030219 - protein, 9 aa, Homo Sapiens
KQSVCLISL

SEQ ID NO: 1030220 - protein, 9 aa, Homo Sapiens
IFSVQEKNH

SEQ ID NO: 1030221 - protein, 9 aa, Homo Sapiens
DHVHLQNNY

SEQ ID NO: 1030222 - protein, 9 aa, Homo Sapiens
SLSQHANDS

SEQ ID NO: 1030223 - protein, 9 aa, Homo Sapiens
SIRYKIFKR

SEQ ID NO: 1030224 - protein, 9 aa, Homo Sapiens
YRCEIKPPF

SEQ ID NO: 1030225 - protein, 9 aa, Homo Sapiens
TPGLNLHIS

SEQ ID NO: 1030226 - protein, 9 aa, Homo Sapiens
TQSLNEAFV

SEQ ID NO: 1030227 - protein, 9 aa, Homo Sapiens
LGFPFSKPP

SEQ ID NO: 1030228 - protein, 9 aa, Homo Sapiens
QTPYPSQHS

SEQ ID NO: 1030229 - protein, 9 aa, Homo Sapiens
VFFTILPHK

SEQ ID NO: 1030230 - protein, 9 aa, Homo Sapiens
DQVAQSSVI

SEQ ID NO: 1030231 - protein, 9 aa, Homo Sapiens
CLYYEEWPT

SEQ ID NO: 1030232 - protein, 9 aa, Homo Sapiens
RSLQDRLNV

SEQ ID NO: 1030233 - protein, 9 aa, Homo Sapiens
EAGSSQAES

SEQ ID NO: 1030234 - protein, 9 aa, Homo Sapiens
SPPRKGFAP

SEQ ID NO: 1030235 - protein, 9 aa, Homo Sapiens
LPGWTGKYC

SEQ ID NO: 1030236 - protein, 9 aa, Homo Sapiens
VQADPLDPC

SEQ ID NO: 1030237 - protein, 9 aa, Homo Sapiens
HSSDSFYTP

SEQ ID NO: 1030238 - protein, 9 aa, Homo Sapiens
IRAEEISEG

SEQ ID NO: 1030239 - protein, 9 aa, Homo Sapiens
RSWRELHLT

SEQ ID NO: 1030240 - protein, 9 aa, Homo Sapiens
ALCYCNKFC

SEQ ID NO: 1030241 - protein, 9 aa, Homo Sapiens
AGQTSPKQK

SEQ ID NO: 1030242 - protein, 9 aa, Homo Sapiens
SIQNSPNDL

SEQ ID NO: 1030243 - protein, 9 aa, Homo Sapiens
ETEKGTQEI

SEQ ID NO: 1030244 - protein, 9 aa, Homo Sapiens
KTKRKKMET

SEQ ID NO: 1030245 - protein, 9 aa, Homo Sapiens
GNYEGGSGS

SEQ ID NO: 1030246 - protein, 9 aa, Homo Sapiens
HLAKDREGT

SEQ ID NO: 1030247 - protein, 9 aa, Homo Sapiens
LNQGPLENH

SEQ ID NO: 1030248 - protein, 9 aa, Homo Sapiens
VFFFKVERD

SEQ ID NO: 1030249 - protein, 9 aa, Homo Sapiens
DGARPVIWW

SEQ ID NO: 1030250 - protein, 9 aa, Homo Sapiens
KKDFLQTFY

SEQ ID NO: 1030251 - protein, 9 aa, Homo Sapiens
CLQSLVFLL

SEQ ID NO: 1030252 - protein, 9 aa, Homo Sapiens
KASKSSPAR

SEQ ID NO: 1030253 - protein, 9 aa, Homo Sapiens
LLDKIYDTI

SEQ ID NO: 1030254 - protein, 9 aa, Homo Sapiens
LPLSQPQQE

SEQ ID NO: 1030255 - protein, 9 aa, Homo Sapiens
EVFCWPTLV

SEQ ID NO: 1030256 - protein, 9 aa, Homo Sapiens
ILLDKNSEA

SEQ ID NO: 1030257 - protein, 9 aa, Homo Sapiens
DPDSIWFLL

SEQ ID NO: 1030258 - protein, 9 aa, Homo Sapiens
GKAETYGHN

SEQ ID NO: 1030259 - protein, 9 aa, Homo Sapiens
SSKDGITRV

SEQ ID NO: 1030260 - protein, 9 aa, Homo Sapiens
IGLLLVLTM

SEQ ID NO: 1030261 - protein, 9 aa, Homo Sapiens
ESSVFLSDN

SEQ ID NO: 1030262 - protein, 9 aa, Homo Sapiens
PMSKQSSFY

SEQ ID NO: 1030263 - protein, 9 aa, Homo Sapiens
LWVTDPTSD

SEQ ID NO: 1030264 - protein, 9 aa, Homo Sapiens
SVAFGFGTE

SEQ ID NO: 1030265 - protein, 9 aa, Homo Sapiens
LTQELLVSH

SEQ ID NO: 1030266 - protein, 9 aa, Homo Sapiens
IIILYAFIL

SEQ ID NO: 1030267 - protein, 9 aa, Homo Sapiens
ATLAEVKKE

SEQ ID NO: 1030268 - protein, 9 aa, Homo Sapiens
GTCEAHLMA

SEQ ID NO: 1030269 - protein, 9 aa, Homo Sapiens
SNLRIEVKI

SEQ ID NO: 1030270 - protein, 9 aa, Homo Sapiens
APSSGWGLA

SEQ ID NO: 1030271 - protein, 9 aa, Homo Sapiens
QNGSLSTSP

SEQ ID NO: 1030272 - protein, 9 aa, Homo Sapiens
NQSSKTFFY

SEQ ID NO: 1030273 - protein, 9 aa, Homo Sapiens
KEQKYWKQL

SEQ ID NO: 1030274 - protein, 9 aa, Homo Sapiens
ERFYSRFHG

SEQ ID NO: 1030275 - protein, 9 aa, Homo Sapiens
LRLDLAGQE

SEQ ID NO: 1030276 - protein, 9 aa, Homo Sapiens
YVPLITAFY

SEQ ID NO: 1030277 - protein, 9 aa, Homo Sapiens
HSSPRDSVS

SEQ ID NO: 1030278 - protein, 9 aa, Homo Sapiens
RMCLYYEEW

SEQ ID NO: 1030279 - protein, 9 aa, Homo Sapiens
GWLWVQAAL

SEQ ID NO: 1030280 - protein, 9 aa, Homo Sapiens
RLDLAGQEL

SEQ ID NO: 1030281 - protein, 9 aa, Homo Sapiens
RLEFLRVAL

SEQ ID NO: 1030282 - protein, 9 aa, Homo Sapiens
PSPPVLDSY

SEQ ID NO: 1030283 - protein, 9 aa, Homo Sapiens
EDDDDDNSD

SEQ ID NO: 1030284 - protein, 9 aa, Homo Sapiens
CLISLCQRL

SEQ ID NO: 1030285 - protein, 9 aa, Homo Sapiens
SSIILFDCL

SEQ ID NO: 1030286 - protein, 9 aa, Homo Sapiens
LQLDSLVLL

SEQ ID NO: 1030287 - protein, 9 aa, Homo Sapiens
PSGKPGISG

SEQ ID NO: 1030288 - protein, 9 aa, Homo Sapiens
SSRSIYAVA

SEQ ID NO: 1030289 - protein, 9 aa, Homo Sapiens
GSRQPAFQL

SEQ ID NO: 1030290 - protein, 9 aa, Homo Sapiens
KSSEESGKK

SEQ ID NO: 1030291 - protein, 9 aa, Homo Sapiens
GEENKKKMT

SEQ ID NO: 1030292 - protein, 9 aa, Homo Sapiens
DIYVKIEPS

SEQ ID NO: 1030293 - protein, 9 aa, Homo Sapiens
EEWDFQPPL

SEQ ID NO: 1030294 - protein, 9 aa, Homo Sapiens
KFMHSSSLT

SEQ ID NO: 1030295 - protein, 9 aa, Homo Sapiens
DVRYTEGYE

SEQ ID NO: 1030296 - protein, 9 aa, Homo Sapiens
GEVLFRLPE

SEQ ID NO: 1030297 - protein, 9 aa, Homo Sapiens
EQKVRLRQQ

SEQ ID NO: 1030298 - protein, 9 aa, Homo Sapiens
AANALCYCN

SEQ ID NO: 1030299 - protein, 9 aa, Homo Sapiens
WNRLFSPLR

SEQ ID NO: 1030300 - protein, 9 aa, Homo Sapiens
GARNRTYMM

SEQ ID NO: 1030301 - protein, 9 aa, Homo Sapiens
SLSSFPNGH

SEQ ID NO: 1030302 - protein, 9 aa, Homo Sapiens
LEKHLRKKH

SEQ ID NO: 1030303 - protein, 9 aa, Homo Sapiens
EPKKAVSRE

SEQ ID NO: 1030304 - protein, 9 aa, Homo Sapiens
LLISARFGM

SEQ ID NO: 1030305 - protein, 9 aa, Homo Sapiens
DYKEPIEVN

SEQ ID NO: 1030306 - protein, 9 aa, Homo Sapiens
DVIGRGHAR

SEQ ID NO: 1030307 - protein, 9 aa, Homo Sapiens
NLVQGRIVK

SEQ ID NO: 1030308 - protein, 9 aa, Homo Sapiens
NNIRSHSPT

SEQ ID NO: 1030309 - protein, 9 aa, Homo Sapiens
SGLSAKKYS

SEQ ID NO: 1030310 - protein, 9 aa, Homo Sapiens
NSKPSKTGE

SEQ ID NO: 1030311 - protein, 9 aa, Homo Sapiens
RIVLKVITI

SEQ ID NO: 1030312 - protein, 9 aa, Homo Sapiens
EIPHSSSSK

SEQ ID NO: 1030313 - protein, 9 aa, Homo Sapiens
REESLMMNW

SEQ ID NO: 1030314 - protein, 9 aa, Homo Sapiens
IGVTRFIAL

SEQ ID NO: 1030315 - protein, 9 aa, Homo Sapiens
LTLELVLED

SEQ ID NO: 1030316 - protein, 9 aa, Homo Sapiens
RRTSPVTFS

SEQ ID NO: 1030317 - protein, 9 aa, Homo Sapiens
MRMSPLAWV

SEQ ID NO: 1030318 - protein, 9 aa, Homo Sapiens
ELADTLELQ

SEQ ID NO: 1030319 - protein, 9 aa, Homo Sapiens
KPLSDRPIK

SEQ ID NO: 1030320 - protein, 9 aa, Homo Sapiens
PYKCLRCGK

SEQ ID NO: 1030321 - protein, 9 aa, Homo Sapiens
LPGTGLLGF

SEQ ID NO: 1030322 - protein, 9 aa, Homo Sapiens
SDTNNALQK

SEQ ID NO: 1030323 - protein, 9 aa, Homo Sapiens
QAESYLERP

SEQ ID NO: 1030324 - protein, 9 aa, Homo Sapiens
SGTQAEFQT

SEQ ID NO: 1030325 - protein, 9 aa, Homo Sapiens
TVPDQEKLG

SEQ ID NO: 1030326 - protein, 9 aa, Homo Sapiens
ETLNIRNIN

SEQ ID NO: 1030327 - protein, 9 aa, Homo Sapiens
SELHKVHES

SEQ ID NO: 1030328 - protein, 9 aa, Homo Sapiens
KERIREQEE

SEQ ID NO: 1030329 - protein, 9 aa, Homo Sapiens
YSFSVPMAS

SEQ ID NO: 1030330 - protein, 9 aa, Homo Sapiens
CSKYHGYPY

SEQ ID NO: 1030331 - protein, 9 aa, Homo Sapiens
QLLITILDN

SEQ ID NO: 1030332 - protein, 9 aa, Homo Sapiens
RHAASYSYD

SEQ ID NO: 1030333 - protein, 9 aa, Homo Sapiens
QPSEKIWIE

SEQ ID NO: 1030334 - protein, 9 aa, Homo Sapiens
PMYLWVLGL

SEQ ID NO: 1030335 - protein, 9 aa, Homo Sapiens
GFSREAEGW

SEQ ID NO: 1030336 - protein, 9 aa, Homo Sapiens
TVKLHENKD

SEQ ID NO: 1030337 - protein, 9 aa, Homo Sapiens
INAKCHKDL

SEQ ID NO: 1030338 - protein, 9 aa, Homo Sapiens
LVLSDDVVQ

SEQ ID NO: 1030339 - protein, 9 aa, Homo Sapiens
LISFREKKL

SEQ ID NO: 1030340 - protein, 9 aa, Homo Sapiens
DKDEGFGDW

SEQ ID NO: 1030341 - protein, 9 aa, Homo Sapiens
FFNCRCNHG

SEQ ID NO: 1030342 - protein, 9 aa, Homo Sapiens
PSKFIQKDD

SEQ ID NO: 1030343 - protein, 9 aa, Homo Sapiens
NLPTFFSFS

SEQ ID NO: 1030344 - protein, 9 aa, Homo Sapiens
SKTSDSLAS

SEQ ID NO: 1030345 - protein, 9 aa, Homo Sapiens
ICPIIWIVF

SEQ ID NO: 1030346 - protein, 9 aa, Homo Sapiens
RKVTCKHLV

SEQ ID NO: 1030347 - protein, 9 aa, Homo Sapiens
GSGGKLSQT

SEQ ID NO: 1030348 - protein, 9 aa, Homo Sapiens
QQEEDRSLS

SEQ ID NO: 1030349 - protein, 9 aa, Homo Sapiens
EATLAEVKK

SEQ ID NO: 1030350 - protein, 9 aa, Homo Sapiens
SLRLDFTEK

SEQ ID NO: 1030351 - protein, 9 aa, Homo Sapiens
LVSARQPLC

SEQ ID NO: 1030352 - protein, 9 aa, Homo Sapiens
DQHGHKEQG

SEQ ID NO: 1030353 - protein, 9 aa, Homo Sapiens
TSGNQAVLQ

SEQ ID NO: 1030354 - protein, 9 aa, Homo Sapiens
AVGDRGPKE

SEQ ID NO: 1030355 - protein, 9 aa, Homo Sapiens
IHDLSVLSS

SEQ ID NO: 1030356 - protein, 9 aa, Homo Sapiens
RFYSRFHGM

SEQ ID NO: 1030357 - protein, 9 aa, Homo Sapiens
INDDIFEED

SEQ ID NO: 1030358 - protein, 9 aa, Homo Sapiens
DPCRNRATC

SEQ ID NO: 1030359 - protein, 9 aa, Homo Sapiens
TSLAEVQRK

SEQ ID NO: 1030360 - protein, 9 aa, Homo Sapiens
RIDLRLCPS

SEQ ID NO: 1030361 - protein, 9 aa, Homo Sapiens
QSSVDQGAT

SEQ ID NO: 1030362 - protein, 9 aa, Homo Sapiens
EDVPVEKEN

SEQ ID NO: 1030363 - protein, 9 aa, Homo Sapiens
EGIFPNSFY

SEQ ID NO: 1030364 - protein, 9 aa, Homo Sapiens
GKEHVLAPP

SEQ ID NO: 1030365 - protein, 9 aa, Homo Sapiens
AEERAPSWR

SEQ ID NO: 1030366 - protein, 9 aa, Homo Sapiens
GFLYPAATA

SEQ ID NO: 1030367 - protein, 9 aa, Homo Sapiens
NFDNFSQAL

SEQ ID NO: 1030368 - protein, 9 aa, Homo Sapiens
CILDPCRNR

SEQ ID NO: 1030369 - protein, 9 aa, Homo Sapiens
NKTLTEIRS

SEQ ID NO: 1030370 - protein, 9 aa, Homo Sapiens
AVCCVLERG

SEQ ID NO: 1030371 - protein, 9 aa, Homo Sapiens
LQKSRPCDL

SEQ ID NO: 1030372 - protein, 9 aa, Homo Sapiens
PKITSFVIP

SEQ ID NO: 1030373 - protein, 9 aa, Homo Sapiens
SVNVMPFAS

SEQ ID NO: 1030374 - protein, 9 aa, Homo Sapiens
TWIKNGEEI

SEQ ID NO: 1030375 - protein, 9 aa, Homo Sapiens
PIRQARQQQ

SEQ ID NO: 1030376 - protein, 9 aa, Homo Sapiens
HRLVPAAPS

SEQ ID NO: 1030377 - protein, 9 aa, Homo Sapiens
WLGSHAGST

SEQ ID NO: 1030378 - protein, 9 aa, Homo Sapiens
EDCSFSGCL

SEQ ID NO: 1030379 - protein, 9 aa, Homo Sapiens
NIQHLVDSV

SEQ ID NO: 1030380 - protein, 9 aa, Homo Sapiens
WGEYGCSLR

SEQ ID NO: 1030381 - protein, 9 aa, Homo Sapiens
LDTAGKEEY

SEQ ID NO: 1030382 - protein, 9 aa, Homo Sapiens
LMQNPQGTL

SEQ ID NO: 1030383 - protein, 9 aa, Homo Sapiens
GSAGSAALT

SEQ ID NO: 1030384 - protein, 9 aa, Homo Sapiens
DDSKWKKHR

SEQ ID NO: 1030385 - protein, 9 aa, Homo Sapiens
LGATDEQQK

SEQ ID NO: 1030386 - protein, 9 aa, Homo Sapiens
TTRVTSFEG

SEQ ID NO: 1030387 - protein, 9 aa, Homo Sapiens
FLVDNSDTS

SEQ ID NO: 1030388 - protein, 9 aa, Homo Sapiens
LVKLQGTSK

SEQ ID NO: 1030389 - protein, 9 aa, Homo Sapiens
AFHSNFTLD

SEQ ID NO: 1030390 - protein, 9 aa, Homo Sapiens
VNRLKVEQA

SEQ ID NO: 1030391 - protein, 9 aa, Homo Sapiens
SSYLFEVYE

SEQ ID NO: 1030392 - protein, 9 aa, Homo Sapiens
ELGLKNETL

SEQ ID NO: 1030393 - protein, 9 aa, Homo Sapiens
PPCHISQPC

SEQ ID NO: 1030394 - protein, 9 aa, Homo Sapiens
EVRGPPPLS

SEQ ID NO: 1030395 - protein, 9 aa, Homo Sapiens
KLRLEKEAR

SEQ ID NO: 1030396 - protein, 9 aa, Homo Sapiens
GKAFKQFSI

SEQ ID NO: 1030397 - protein, 9 aa, Homo Sapiens
LLLGIMAFD

SEQ ID NO: 1030398 - protein, 9 aa, Homo Sapiens
EAEKKEYFY

SEQ ID NO: 1030399 - protein, 9 aa, Homo Sapiens
EPQGRGLVL

SEQ ID NO: 1030400 - protein, 9 aa, Homo Sapiens
RKPGKVGLP

SEQ ID NO: 1030401 - protein, 9 aa, Homo Sapiens
RPRNCIGMR

SEQ ID NO: 1030402 - protein, 9 aa, Homo Sapiens
EMLAPYIFM

SEQ ID NO: 1030403 - protein, 9 aa, Homo Sapiens
DFVKRHYFS

SEQ ID NO: 1030404 - protein, 9 aa, Homo Sapiens
SGHMFSSKN

SEQ ID NO: 1030405 - protein, 9 aa, Homo Sapiens
ESASKPKRL

SEQ ID NO: 1030406 - protein, 9 aa, Homo Sapiens
LSAPEGLST

SEQ ID NO: 1030407 - protein, 9 aa, Homo Sapiens
PFYSAICNS

SEQ ID NO: 1030408 - protein, 9 aa, Homo Sapiens
PDQNLQEAA

SEQ ID NO: 1030409 - protein, 9 aa, Homo Sapiens
DHYRPWIEI

SEQ ID NO: 1030410 - protein, 9 aa, Homo Sapiens
AMDSKLAYD

SEQ ID NO: 1030411 - protein, 9 aa, Homo Sapiens
GWLANSSTA

SEQ ID NO: 1030412 - protein, 9 aa, Homo Sapiens
AKNTPFQHS

SEQ ID NO: 1030413 - protein, 9 aa, Homo Sapiens
RQKHLSKDT

SEQ ID NO: 1030414 - protein, 9 aa, Homo Sapiens
PNLVQGRIV

SEQ ID NO: 1030415 - protein, 9 aa, Homo Sapiens
TYTNGESEV

SEQ ID NO: 1030416 - protein, 9 aa, Homo Sapiens
RGANIVRCD

SEQ ID NO: 1030417 - protein, 9 aa, Homo Sapiens
PENDLAEEM

SEQ ID NO: 1030418 - protein, 9 aa, Homo Sapiens
YSAESSSPQ

SEQ ID NO: 1030419 - protein, 9 aa, Homo Sapiens
GLTPLLGWN

SEQ ID NO: 1030420 - protein, 9 aa, Homo Sapiens
VVLKGATTQ

SEQ ID NO: 1030421 - protein, 9 aa, Homo Sapiens
EDVHNTHAP

SEQ ID NO: 1030422 - protein, 9 aa, Homo Sapiens
DHKRIYTGE

SEQ ID NO: 1030423 - protein, 9 aa, Homo Sapiens
MILKRCPNR

SEQ ID NO: 1030424 - protein, 9 aa, Homo Sapiens
FPQSTVPSR

SEQ ID NO: 1030425 - protein, 9 aa, Homo Sapiens
EKGNFFPLE

SEQ ID NO: 1030426 - protein, 9 aa, Homo Sapiens
LGEAAAFFR

SEQ ID NO: 1030427 - protein, 9 aa, Homo Sapiens
FVFSEPTAD

SEQ ID NO: 1030428 - protein, 9 aa, Homo Sapiens
SLEKVLRAP

SEQ ID NO: 1030429 - protein, 9 aa, Homo Sapiens
VLLFYYTQY

SEQ ID NO: 1030430 - protein, 9 aa, Homo Sapiens
ATGKMIFLL

SEQ ID NO: 1030431 - protein, 9 aa, Homo Sapiens
PGSTGLKGF

SEQ ID NO: 1030432 - protein, 9 aa, Homo Sapiens
SPAHPNVDP

SEQ ID NO: 1030433 - protein, 9 aa, Homo Sapiens
IKLSALEMG

SEQ ID NO: 1030434 - protein, 9 aa, Homo Sapiens
QDRTLRTWD

SEQ ID NO: 1030435 - protein, 9 aa, Homo Sapiens
VEEVLLLAR

SEQ ID NO: 1030436 - protein, 9 aa, Homo Sapiens
YNIVIFLNT

SEQ ID NO: 1030437 - protein, 9 aa, Homo Sapiens
ASGHPKPHF

SEQ ID NO: 1030438 - protein, 9 aa, Homo Sapiens
TISDTNNAL

SEQ ID NO: 1030439 - protein, 9 aa, Homo Sapiens
QECTLRISG

SEQ ID NO: 1030440 - protein, 9 aa, Homo Sapiens
LAAGSMMQN

SEQ ID NO: 1030441 - protein, 9 aa, Homo Sapiens
TEFILLRLT

SEQ ID NO: 1030442 - protein, 9 aa, Homo Sapiens
RAEEISEGA

SEQ ID NO: 1030443 - protein, 9 aa, Homo Sapiens
WQLEKSLNC

SEQ ID NO: 1030444 - protein, 9 aa, Homo Sapiens
QIELPEVLS

SEQ ID NO: 1030445 - protein, 9 aa, Homo Sapiens
SSFWPSLSS

SEQ ID NO: 1030446 - protein, 9 aa, Homo Sapiens
ARFVCPLNR

SEQ ID NO: 1030447 - protein, 9 aa, Homo Sapiens
ITCVDVNEC

SEQ ID NO: 1030448 - protein, 9 aa, Homo Sapiens
TCEAHLMAV

SEQ ID NO: 1030449 - protein, 9 aa, Homo Sapiens
IQSSEGRQK

SEQ ID NO: 1030450 - protein, 9 aa, Homo Sapiens
AGSSSHTAI

SEQ ID NO: 1030451 - protein, 9 aa, Homo Sapiens
EKGPRIKGG

SEQ ID NO: 1030452 - protein, 9 aa, Homo Sapiens
HFAGLLLLL

SEQ ID NO: 1030453 - protein, 9 aa, Homo Sapiens
QFEERNFFL

SEQ ID NO: 1030454 - protein, 9 aa, Homo Sapiens
YFCTFIQTA

SEQ ID NO: 1030455 - protein, 9 aa, Homo Sapiens
SEESGKKKL

SEQ ID NO: 1030456 - protein, 9 aa, Homo Sapiens
DDDDNSDDR

SEQ ID NO: 1030457 - protein, 9 aa, Homo Sapiens
LSDWVTFYK

SEQ ID NO: 1030458 - protein, 9 aa, Homo Sapiens
ASSFLFTIE

SEQ ID NO: 1030459 - protein, 9 aa, Homo Sapiens
FSKVYPEKN

SEQ ID NO: 1030460 - protein, 9 aa, Homo Sapiens
AIASNVDYK

SEQ ID NO: 1030461 - protein, 9 aa, Homo Sapiens
ELSGNKSLE

SEQ ID NO: 1030462 - protein, 9 aa, Homo Sapiens
DKAEYMCPD

SEQ ID NO: 1030463 - protein, 9 aa, Homo Sapiens
DDKRILEFN

SEQ ID NO: 1030464 - protein, 9 aa, Homo Sapiens
ESQKLVGFV

SEQ ID NO: 1030465 - protein, 9 aa, Homo Sapiens
YPRVKVSNE

SEQ ID NO: 1030466 - protein, 9 aa, Homo Sapiens
SSSLNQHQK

SEQ ID NO: 1030467 - protein, 9 aa, Homo Sapiens
RRAKRTTPN

SEQ ID NO: 1030468 - protein, 9 aa, Homo Sapiens
EGRLGIPGL

SEQ ID NO: 1030469 - protein, 9 aa, Homo Sapiens
NPFDGPNKN

SEQ ID NO: 1030470 - protein, 9 aa, Homo Sapiens
AHKMKSPPS

SEQ ID NO: 1030471 - protein, 9 aa, Homo Sapiens
YLESISPSN

SEQ ID NO: 1030472 - protein, 9 aa, Homo Sapiens
GQENHKDTS

SEQ ID NO: 1030473 - protein, 9 aa, Homo Sapiens
SELLTPLQV

SEQ ID NO: 1030474 - protein, 9 aa, Homo Sapiens
NKFLTRLKA

SEQ ID NO: 1030475 - protein, 9 aa, Homo Sapiens
ITPNGQDPE

SEQ ID NO: 1030476 - protein, 9 aa, Homo Sapiens
WEQKVRLRQ

SEQ ID NO: 1030477 - protein, 9 aa, Homo Sapiens
REVGILLEQ

SEQ ID NO: 1030478 - protein, 9 aa, Homo Sapiens
RPGFNCSDV

SEQ ID NO: 1030479 - protein, 9 aa, Homo Sapiens
SLIVGSRPG

SEQ ID NO: 1030480 - protein, 9 aa, Homo Sapiens
SWRELHLTE

SEQ ID NO: 1030481 - protein, 9 aa, Homo Sapiens
AIFFSGDDL

SEQ ID NO: 1030482 - protein, 9 aa, Homo Sapiens
PPACQPLME

SEQ ID NO: 1030483 - protein, 9 aa, Homo Sapiens
SMHNDATLY

SEQ ID NO: 1030484 - protein, 9 aa, Homo Sapiens
PRPPRFTLR

SEQ ID NO: 1030485 - protein, 9 aa, Homo Sapiens
GGLLPSGLH

SEQ ID NO: 1030486 - protein, 9 aa, Homo Sapiens
CPNRVKVDQ

SEQ ID NO: 1030487 - protein, 9 aa, Homo Sapiens
NFQKHSPTS

SEQ ID NO: 1030488 - protein, 9 aa, Homo Sapiens
PKSLASLHP

SEQ ID NO: 1030489 - protein, 9 aa, Homo Sapiens
YLPSGCLRN

SEQ ID NO: 1030490 - protein, 9 aa, Homo Sapiens
PYPSQHSVL

SEQ ID NO: 1030491 - protein, 9 aa, Homo Sapiens
MCLYYEEWP

SEQ ID NO: 1030492 - protein, 9 aa, Homo Sapiens
SPMSKQSSF

SEQ ID NO: 1030493 - protein, 9 aa, Homo Sapiens
LFDCLLTPP

SEQ ID NO: 1030494 - protein, 9 aa, Homo Sapiens
AQAQVTSQP

SEQ ID NO: 1030495 - protein, 9 aa, Homo Sapiens
FCSKYHGYP

SEQ ID NO: 1030496 - protein, 9 aa, Homo Sapiens
GPYDEVVLL

SEQ ID NO: 1030497 - protein, 9 aa, Homo Sapiens
SVLKMINFF

SEQ ID NO: 1030498 - protein, 9 aa, Homo Sapiens
GWGLAGSRP

SEQ ID NO: 1030499 - protein, 9 aa, Homo Sapiens
KLFVAGGLL

SEQ ID NO: 1030500 - protein, 9 aa, Homo Sapiens
QHGHKEQGP

SEQ ID NO: 1030501 - protein, 9 aa, Homo Sapiens
LPRAERLCS

SEQ ID NO: 1030502 - protein, 9 aa, Homo Sapiens
AFLELDETF

SEQ ID NO: 1030503 - protein, 9 aa, Homo Sapiens
RQNKFLTRL

SEQ ID NO: 1030504 - protein, 9 aa, Homo Sapiens
PGAPAQKPL

SEQ ID NO: 1030505 - protein, 9 aa, Homo Sapiens
GENNLQDDG

SEQ ID NO: 1030506 - protein, 9 aa, Homo Sapiens
PLLVPNSCT

SEQ ID NO: 1030507 - protein, 9 aa, Homo Sapiens
IFLVDNSDT

SEQ ID NO: 1030508 - protein, 9 aa, Homo Sapiens
PKSTVERFY

SEQ ID NO: 1030509 - protein, 9 aa, Homo Sapiens
ECESSEPHP

SEQ ID NO: 1030510 - protein, 9 aa, Homo Sapiens
IAEVRAQYK

SEQ ID NO: 1030511 - protein, 9 aa, Homo Sapiens
SSSTTLWAL

SEQ ID NO: 1030512 - protein, 9 aa, Homo Sapiens
FHIGWVILS

SEQ ID NO: 1030513 - protein, 9 aa, Homo Sapiens
LFPNMISRR

SEQ ID NO: 1030514 - protein, 9 aa, Homo Sapiens
LLITILDNN

SEQ ID NO: 1030515 - protein, 9 aa, Homo Sapiens
NLRAKFLRL

SEQ ID NO: 1030516 - protein, 9 aa, Homo Sapiens
PFMKVKSEM

SEQ ID NO: 1030517 - protein, 9 aa, Homo Sapiens
SKLAYDDKN

SEQ ID NO: 1030518 - protein, 9 aa, Homo Sapiens
QKEENEEEE

SEQ ID NO: 1030519 - protein, 9 aa, Homo Sapiens
PITLTKALF

SEQ ID NO: 1030520 - protein, 9 aa, Homo Sapiens
GKDLDDSFL

SEQ ID NO: 1030521 - protein, 9 aa, Homo Sapiens
RQDQKLIEE

SEQ ID NO: 1030522 - protein, 9 aa, Homo Sapiens
EKLADTVVS

SEQ ID NO: 1030523 - protein, 9 aa, Homo Sapiens
EKEETAVPT

SEQ ID NO: 1030524 - protein, 9 aa, Homo Sapiens
KAVSLLSSV

SEQ ID NO: 1030525 - protein, 9 aa, Homo Sapiens
QEKEETAVP

SEQ ID NO: 1030526 - protein, 9 aa, Homo Sapiens
DENGNQNRS

SEQ ID NO: 1030527 - protein, 9 aa, Homo Sapiens
LSSAEPTEH

SEQ ID NO: 1030528 - protein, 9 aa, Homo Sapiens
CRVIPPLDW

SEQ ID NO: 1030529 - protein, 9 aa, Homo Sapiens
CGSRKIAHF

SEQ ID NO: 1030530 - protein, 9 aa, Homo Sapiens
QVELMRILR

SEQ ID NO: 1030531 - protein, 9 aa, Homo Sapiens
LEGATKRTC

SEQ ID NO: 1030532 - protein, 9 aa, Homo Sapiens
KLADTVVSM

SEQ ID NO: 1030533 - protein, 9 aa, Homo Sapiens
GDETLCFVL

SEQ ID NO: 1030534 - protein, 9 aa, Homo Sapiens
LLRYVLEQL

SEQ ID NO: 1030535 - protein, 9 aa, Homo Sapiens
SFPLPSPAP

SEQ ID NO: 1030536 - protein, 9 aa, Homo Sapiens
RGCEVFVEK

SEQ ID NO: 1030537 - protein, 9 aa, Homo Sapiens
VDEGCLRKV

SEQ ID NO: 1030538 - protein, 9 aa, Homo Sapiens
GGGILEAGA

SEQ ID NO: 1030539 - protein, 9 aa, Homo Sapiens
RNKKLKNAI

SEQ ID NO: 1030540 - protein, 9 aa, Homo Sapiens
DYGMGPGWS

SEQ ID NO: 1030541 - protein, 9 aa, Homo Sapiens
AKITCVDVN

SEQ ID NO: 1030542 - protein, 9 aa, Homo Sapiens
IGTDNRIVL

SEQ ID NO: 1030543 - protein, 9 aa, Homo Sapiens
ENENYCDFV

SEQ ID NO: 1030544 - protein, 9 aa, Homo Sapiens
NQEEEEPST

SEQ ID NO: 1030545 - protein, 9 aa, Homo Sapiens
AMGSAYGFC

SEQ ID NO: 1030546 - protein, 9 aa, Homo Sapiens
FFKCSEIPD

SEQ ID NO: 1030547 - protein, 9 aa, Homo Sapiens
YSEDNIQHL

SEQ ID NO: 1030548 - protein, 9 aa, Homo Sapiens
NPNLEEDQA

SEQ ID NO: 1030549 - protein, 9 aa, Homo Sapiens
VLGNTYRRS

SEQ ID NO: 1030550 - protein, 9 aa, Homo Sapiens
YISQEGKDK

SEQ ID NO: 1030551 - protein, 9 aa, Homo Sapiens
KFCHQGLAY

SEQ ID NO: 1030552 - protein, 9 aa, Homo Sapiens
AYGFCTCLG

SEQ ID NO: 1030553 - protein, 9 aa, Homo Sapiens
SLTEFVLLE

SEQ ID NO: 1030554 - protein, 9 aa, Homo Sapiens
TEEEKNIIM

SEQ ID NO: 1030555 - protein, 9 aa, Homo Sapiens
LHERENEIV

SEQ ID NO: 1030556 - protein, 9 aa, Homo Sapiens
GDEDASFSP

SEQ ID NO: 1030557 - protein, 9 aa, Homo Sapiens
GKFAAEKNG

SEQ ID NO: 1030558 - protein, 9 aa, Homo Sapiens
LGVLYRTLS

SEQ ID NO: 1030559 - protein, 9 aa, Homo Sapiens
NIFEEGDEP

SEQ ID NO: 1030560 - protein, 9 aa, Homo Sapiens
GSKACTCDS

SEQ ID NO: 1030561 - protein, 9 aa, Homo Sapiens
RSNFDNFSQ

SEQ ID NO: 1030562 - protein, 9 aa, Homo Sapiens
KILENKATF

SEQ ID NO: 1030563 - protein, 9 aa, Homo Sapiens
PFMGFEKFV

SEQ ID NO: 1030564 - protein, 9 aa, Homo Sapiens
EKTIRQKFP

SEQ ID NO: 1030565 - protein, 9 aa, Homo Sapiens
LRPLSPTKL

SEQ ID NO: 1030566 - protein, 9 aa, Homo Sapiens
ACILYRAIA

SEQ ID NO: 1030567 - protein, 9 aa, Homo Sapiens
ITEFILLRL

SEQ ID NO: 1030568 - protein, 9 aa, Homo Sapiens
EKVLRAPTL

SEQ ID NO: 1030569 - protein, 9 aa, Homo Sapiens
AATFEKTIR

SEQ ID NO: 1030570 - protein, 9 aa, Homo Sapiens
KNKKEKSAP

SEQ ID NO: 1030571 - protein, 9 aa, Homo Sapiens
DSSNQEDVE

SEQ ID NO: 1030572 - protein, 9 aa, Homo Sapiens
YSATFVPGL

SEQ ID NO: 1030573 - protein, 9 aa, Homo Sapiens
CIDISNNGT

SEQ ID NO: 1030574 - protein, 9 aa, Homo Sapiens
HWRVHTGEN

SEQ ID NO: 1030575 - protein, 9 aa, Homo Sapiens
PSPNYLCHL

SEQ ID NO: 1030576 - protein, 9 aa, Homo Sapiens
TRNCMSFSV

SEQ ID NO: 1030577 - protein, 9 aa, Homo Sapiens
GRLQYFLQR

SEQ ID NO: 1030578 - protein, 9 aa, Homo Sapiens
RRMEKINSK

SEQ ID NO: 1030579 - protein, 9 aa, Homo Sapiens
KQKNQKNLN

SEQ ID NO: 1030580 - protein, 9 aa, Homo Sapiens
VGSRPGFNC

SEQ ID NO: 1030581 - protein, 9 aa, Homo Sapiens
TEKEGIFPN

SEQ ID NO: 1030582 - protein, 9 aa, Homo Sapiens
YRAIAHEAK

SEQ ID NO: 1030583 - protein, 9 aa, Homo Sapiens
EAGEEVFPR

SEQ ID NO: 1030584 - protein, 9 aa, Homo Sapiens
HNSEIQVTC

SEQ ID NO: 1030585 - protein, 9 aa, Homo Sapiens
MGAMFFGVS

SEQ ID NO: 1030586 - protein, 9 aa, Homo Sapiens
MLEEMDKPL

SEQ ID NO: 1030587 - protein, 9 aa, Homo Sapiens
LNIKYLSPL

SEQ ID NO: 1030588 - protein, 9 aa, Homo Sapiens
VYEDIEVGT

SEQ ID NO: 1030589 - protein, 9 aa, Homo Sapiens
KDLEEKVTQ

SEQ ID NO: 1030590 - protein, 9 aa, Homo Sapiens
AFLFALVCW

SEQ ID NO: 1030591 - protein, 9 aa, Homo Sapiens
APPPAFLTD

SEQ ID NO: 1030592 - protein, 9 aa, Homo Sapiens
ASGRPQDDI

SEQ ID NO: 1030593 - protein, 9 aa, Homo Sapiens
EDPRGEAKE

SEQ ID NO: 1030594 - protein, 9 aa, Homo Sapiens
RSQLEFTVH

SEQ ID NO: 1030595 - protein, 9 aa, Homo Sapiens
AGSSCLPSP

SEQ ID NO: 1030596 - protein, 9 aa, Homo Sapiens
IDDNSSVFT

SEQ ID NO: 1030597 - protein, 9 aa, Homo Sapiens
RFTPKILAL

SEQ ID NO: 1030598 - protein, 9 aa, Homo Sapiens
PGASRCPRG

SEQ ID NO: 1030599 - protein, 9 aa, Homo Sapiens
ELLTPLQVE

SEQ ID NO: 1030600 - protein, 9 aa, Homo Sapiens
VVEKGEFTK

SEQ ID NO: 1030601 - protein, 9 aa, Homo Sapiens
FTVYTRLEF

SEQ ID NO: 1030602 - protein, 9 aa, Homo Sapiens
NAASFPNSS

SEQ ID NO: 1030603 - protein, 9 aa, Homo Sapiens
FDAIANIRE

SEQ ID NO: 1030604 - protein, 9 aa, Homo Sapiens
DWLTLEDYK

SEQ ID NO: 1030605 - protein, 9 aa, Homo Sapiens
PLADSEVEL

SEQ ID NO: 1030606 - protein, 9 aa, Homo Sapiens
QEPQQLGTI

SEQ ID NO: 1030607 - protein, 9 aa, Homo Sapiens
IFDKGRVRL

SEQ ID NO: 1030608 - protein, 9 aa, Homo Sapiens
TSPVTFSPH

SEQ ID NO: 1030609 - protein, 9 aa, Homo Sapiens
DKEKNARVA

SEQ ID NO: 1030610 - protein, 9 aa, Homo Sapiens
PALAAFVTF

SEQ ID NO: 1030611 - protein, 9 aa, Homo Sapiens
DDSNPAIGS

SEQ ID NO: 1030612 - protein, 9 aa, Homo Sapiens
YVLEQLYSR

SEQ ID NO: 1030613 - protein, 9 aa, Homo Sapiens
HSLPSSLKE

SEQ ID NO: 1030614 - protein, 9 aa, Homo Sapiens
TAATTFTEP

SEQ ID NO: 1030615 - protein, 9 aa, Homo Sapiens
RNRTYMMMF

SEQ ID NO: 1030616 - protein, 9 aa, Homo Sapiens
TMIMKILIM

SEQ ID NO: 1030617 - protein, 9 aa, Homo Sapiens
SINAKCHKD

SEQ ID NO: 1030618 - protein, 9 aa, Homo Sapiens
EKPKKPKQE

SEQ ID NO: 1030619 - protein, 9 aa, Homo Sapiens
NLNTDFFAK

SEQ ID NO: 1030620 - protein, 9 aa, Homo Sapiens
NLRNSHMVF

SEQ ID NO: 1030621 - protein, 9 aa, Homo Sapiens
ETRRLLDTK

SEQ ID NO: 1030622 - protein, 9 aa, Homo Sapiens
FFSPSNFCL

SEQ ID NO: 1030623 - protein, 9 aa, Homo Sapiens
EDRSLSCRE

SEQ ID NO: 1030624 - protein, 9 aa, Homo Sapiens
LLELADTLE

SEQ ID NO: 1030625 - protein, 9 aa, Homo Sapiens
PTVLLKERL

SEQ ID NO: 1030626 - protein, 9 aa, Homo Sapiens
CDPYSAESS

SEQ ID NO: 1030627 - protein, 9 aa, Homo Sapiens
NSRTYTNGE

SEQ ID NO: 1030628 - protein, 9 aa, Homo Sapiens
KRPSPNYLC

SEQ ID NO: 1030629 - protein, 9 aa, Homo Sapiens
EDSIFGDLK

SEQ ID NO: 1030630 - protein, 9 aa, Homo Sapiens
KIFTLGGSP

SEQ ID NO: 1030631 - protein, 9 aa, Homo Sapiens
SKPSKTGEE

SEQ ID NO: 1030632 - protein, 9 aa, Homo Sapiens
YVRHSSDSF

SEQ ID NO: 1030633 - protein, 9 aa, Homo Sapiens
YETASPVAN

SEQ ID NO: 1030634 - protein, 9 aa, Homo Sapiens
GDNLHIQRN

SEQ ID NO: 1030635 - protein, 9 aa, Homo Sapiens
KRTCLGGGR

SEQ ID NO: 1030636 - protein, 9 aa, Homo Sapiens
SQDPSFGDP

SEQ ID NO: 1030637 - protein, 9 aa, Homo Sapiens
QNLRMENNV

SEQ ID NO: 1030638 - protein, 9 aa, Homo Sapiens
ENHENERIL

SEQ ID NO: 1030639 - protein, 9 aa, Homo Sapiens
RKPVTITVQ

SEQ ID NO: 1030640 - protein, 9 aa, Homo Sapiens
FSLRNKKLK

SEQ ID NO: 1030641 - protein, 9 aa, Homo Sapiens
KGGKDTCLG

SEQ ID NO: 1030642 - protein, 9 aa, Homo Sapiens
ENELVGSNP

SEQ ID NO: 1030643 - protein, 9 aa, Homo Sapiens
KVDKRFQCK

SEQ ID NO: 1030644 - protein, 9 aa, Homo Sapiens
LGLKNETLF

SEQ ID NO: 1030645 - protein, 9 aa, Homo Sapiens
RPKPLFYAV

SEQ ID NO: 1030646 - protein, 9 aa, Homo Sapiens
EPPRIPPFP

SEQ ID NO: 1030647 - protein, 9 aa, Homo Sapiens
RLQPSSFPQ

SEQ ID NO: 1030648 - protein, 9 aa, Homo Sapiens
LPEVLSEPL

SEQ ID NO: 1030649 - protein, 9 aa, Homo Sapiens
TKHKIIYTG

SEQ ID NO: 1030650 - protein, 9 aa, Homo Sapiens
LSTGEKGFC

SEQ ID NO: 1030651 - protein, 9 aa, Homo Sapiens
GGRGSNGSG

SEQ ID NO: 1030652 - protein, 9 aa, Homo Sapiens
ISLEKDKQK

SEQ ID NO: 1030653 - protein, 9 aa, Homo Sapiens
LYVRGGYIL

SEQ ID NO: 1030654 - protein, 9 aa, Homo Sapiens
EILLDKNSE

SEQ ID NO: 1030655 - protein, 9 aa, Homo Sapiens
AILSLRQTL

SEQ ID NO: 1030656 - protein, 9 aa, Homo Sapiens
QRPWTLLCH

SEQ ID NO: 1030657 - protein, 9 aa, Homo Sapiens
NTSEKITFL

SEQ ID NO: 1030658 - protein, 9 aa, Homo Sapiens
NSEDSSNFK

SEQ ID NO: 1030659 - protein, 9 aa, Homo Sapiens
QKHLSKDTL

SEQ ID NO: 1030660 - protein, 9 aa, Homo Sapiens
PGFYQVPFL

SEQ ID NO: 1030661 - protein, 9 aa, Homo Sapiens
EQLKEHWDY

SEQ ID NO: 1030662 - protein, 9 aa, Homo Sapiens
AFFRHQMKS

SEQ ID NO: 1030663 - protein, 9 aa, Homo Sapiens
FPGTWKEYL

SEQ ID NO: 1030664 - protein, 9 aa, Homo Sapiens
LTRAHVECS

SEQ ID NO: 1030665 - protein, 9 aa, Homo Sapiens
GVPSSSRFL

SEQ ID NO: 1030666 - protein, 9 aa, Homo Sapiens
FSLGGPFGC

SEQ ID NO: 1030667 - protein, 9 aa, Homo Sapiens
DTAKITCVD

SEQ ID NO: 1030668 - protein, 9 aa, Homo Sapiens
KGNEKPRAP

SEQ ID NO: 1030669 - protein, 9 aa, Homo Sapiens
RKRKSQKKL

SEQ ID NO: 1030670 - protein, 9 aa, Homo Sapiens
NGQFEFVCE

SEQ ID NO: 1030671 - protein, 9 aa, Homo Sapiens
LRGKFAAEK

SEQ ID NO: 1030672 - protein, 9 aa, Homo Sapiens
LTQNTQASR

SEQ ID NO: 1030673 - protein, 9 aa, Homo Sapiens
DEIVKKILE

SEQ ID NO: 1030674 - protein, 9 aa, Homo Sapiens
TGKQVVCLM

SEQ ID NO: 1030675 - protein, 9 aa, Homo Sapiens
TLRISGTQA

SEQ ID NO: 1030676 - protein, 9 aa, Homo Sapiens
KYGVLHIYG

SEQ ID NO: 1030677 - protein, 9 aa, Homo Sapiens
EKDKKLRLE

SEQ ID NO: 1030678 - protein, 9 aa, Homo Sapiens
FDNVGSLWT

SEQ ID NO: 1030679 - protein, 9 aa, Homo Sapiens
LTSSNYDKQ

SEQ ID NO: 1030680 - protein, 9 aa, Homo Sapiens
LPYPSEVCR

SEQ ID NO: 1030681 - protein, 9 aa, Homo Sapiens
CFQSEWVGP

SEQ ID NO: 1030682 - protein, 9 aa, Homo Sapiens
ASGAGSSSH

SEQ ID NO: 1030683 - protein, 9 aa, Homo Sapiens
VLAGGFCRA

SEQ ID NO: 1030684 - protein, 9 aa, Homo Sapiens
GRAVCCVLE

SEQ ID NO: 1030685 - protein, 9 aa, Homo Sapiens
SATFVPGLI

SEQ ID NO: 1030686 - protein, 9 aa, Homo Sapiens
PHVPFKLMS

SEQ ID NO: 1030687 - protein, 9 aa, Homo Sapiens
LNVFPPELT

SEQ ID NO: 1030688 - protein, 9 aa, Homo Sapiens
PDFEIKEEE

SEQ ID NO: 1030689 - protein, 9 aa, Homo Sapiens
YTTFDNVGS

SEQ ID NO: 1030690 - protein, 9 aa, Homo Sapiens
AIPSEVQRK

SEQ ID NO: 1030691 - protein, 9 aa, Homo Sapiens
LLQLDSLVL

SEQ ID NO: 1030692 - protein, 9 aa, Homo Sapiens
MGFEKFVQY

SEQ ID NO: 1030693 - protein, 9 aa, Homo Sapiens
FVQQRAGHN

SEQ ID NO: 1030694 - protein, 9 aa, Homo Sapiens
QNKFLTRLK

SEQ ID NO: 1030695 - protein, 9 aa, Homo Sapiens
GSGIAWTIP

SEQ ID NO: 1030696 - protein, 9 aa, Homo Sapiens
EESGKKKLS

SEQ ID NO: 1030697 - protein, 9 aa, Homo Sapiens
KDPMAYGAM

SEQ ID NO: 1030698 - protein, 9 aa, Homo Sapiens
SCLPGWTGK

SEQ ID NO: 1030699 - protein, 9 aa, Homo Sapiens
PLPSSPCVG

SEQ ID NO: 1030700 - protein, 9 aa, Homo Sapiens
EKLGEVWQR

SEQ ID NO: 1030701 - protein, 9 aa, Homo Sapiens
SIFTNAQDP

SEQ ID NO: 1030702 - protein, 9 aa, Homo Sapiens
VLVGAVIGV

SEQ ID NO: 1030703 - protein, 9 aa, Homo Sapiens
LCASSAQVL

SEQ ID NO: 1030704 - protein, 9 aa, Homo Sapiens
LPEADGLPG

SEQ ID NO: 1030705 - protein, 9 aa, Homo Sapiens
CRRKRGFCI

SEQ ID NO: 1030706 - protein, 9 aa, Homo Sapiens
SGNQLSSSI

SEQ ID NO: 1030707 - protein, 9 aa, Homo Sapiens
CVPSVTANG

SEQ ID NO: 1030708 - protein, 9 aa, Homo Sapiens
WQKILMVRF

SEQ ID NO: 1030709 - protein, 9 aa, Homo Sapiens
LLRSSGSPQ

SEQ ID NO: 1030710 - protein, 9 aa, Homo Sapiens
QNEEAKTWR

SEQ ID NO: 1030711 - protein, 9 aa, Homo Sapiens
LCRHSANIN

SEQ ID NO: 1030712 - protein, 9 aa, Homo Sapiens
SDYKFPDII

SEQ ID NO: 1030713 - protein, 9 aa, Homo Sapiens
IACILYRAI

SEQ ID NO: 1030714 - protein, 9 aa, Homo Sapiens
SSQAESYLE

SEQ ID NO: 1030715 - protein, 9 aa, Homo Sapiens
RGLVLQKMG

SEQ ID NO: 1030716 - protein, 9 aa, Homo Sapiens
GNPISTKNY

SEQ ID NO: 1030717 - protein, 9 aa, Homo Sapiens
AQILPPRRP

SEQ ID NO: 1030718 - protein, 9 aa, Homo Sapiens
AMWNESSLS

SEQ ID NO: 1030719 - protein, 9 aa, Homo Sapiens
IALCTVRRF

SEQ ID NO: 1030720 - protein, 9 aa, Homo Sapiens
REQRLQDSR

SEQ ID NO: 1030721 - protein, 9 aa, Homo Sapiens
DVPGIRHVY

SEQ ID NO: 1030722 - protein, 9 aa, Homo Sapiens
TSSSEESTV

SEQ ID NO: 1030723 - protein, 9 aa, Homo Sapiens
KVTQMEGSV

SEQ ID NO: 1030724 - protein, 9 aa, Homo Sapiens
LEECDIVDS

SEQ ID NO: 1030725 - protein, 9 aa, Homo Sapiens
NLPGLREFS

SEQ ID NO: 1030726 - protein, 9 aa, Homo Sapiens
RAWVSSGSS

SEQ ID NO: 1030727 - protein, 9 aa, Homo Sapiens
IIHDLSVLS

SEQ ID NO: 1030728 - protein, 9 aa, Homo Sapiens
EEKGPRIKG

SEQ ID NO: 1030729 - protein, 9 aa, Homo Sapiens
DSQTGNDEK

SEQ ID NO: 1030730 - protein, 9 aa, Homo Sapiens
NVSDRQSFL

SEQ ID NO: 1030731 - protein, 9 aa, Homo Sapiens
GGSGGNYEG

SEQ ID NO: 1030732 - protein, 9 aa, Homo Sapiens
PSNENCNNN

SEQ ID NO: 1030733 - protein, 9 aa, Homo Sapiens
NSYQCKECG

SEQ ID NO: 1030734 - protein, 9 aa, Homo Sapiens
SEPHPLQDN

SEQ ID NO: 1030735 - protein, 9 aa, Homo Sapiens
LPTCRNNIL

SEQ ID NO: 1030736 - protein, 9 aa, Homo Sapiens
KSHKPEPLV

SEQ ID NO: 1030737 - protein, 9 aa, Homo Sapiens
KVERKKNQE

SEQ ID NO: 1030738 - protein, 9 aa, Homo Sapiens
FCPDQHGHK

SEQ ID NO: 1030739 - protein, 9 aa, Homo Sapiens
KKEKSAPSR

SEQ ID NO: 1030740 - protein, 9 aa, Homo Sapiens
CILYRAIAH

SEQ ID NO: 1030741 - protein, 9 aa, Homo Sapiens
GLIQTPYPS

SEQ ID NO: 1030742 - protein, 9 aa, Homo Sapiens
ALVTIEIYA

SEQ ID NO: 1030743 - protein, 9 aa, Homo Sapiens
ESEGMYHCH

SEQ ID NO: 1030744 - protein, 9 aa, Homo Sapiens
LNSAIYTLR

SEQ ID NO: 1030745 - protein, 9 aa, Homo Sapiens
LLSGSCPSF

SEQ ID NO: 1030746 - protein, 9 aa, Homo Sapiens
TNDNMSYFV

SEQ ID NO: 1030747 - protein, 9 aa, Homo Sapiens
PDVICLKQE

SEQ ID NO: 1030748 - protein, 9 aa, Homo Sapiens
ITAKINAIL

SEQ ID NO: 1030749 - protein, 9 aa, Homo Sapiens
SGLIQTPYP

SEQ ID NO: 1030750 - protein, 9 aa, Homo Sapiens
EHSSPSSHS

SEQ ID NO: 1030751 - protein, 9 aa, Homo Sapiens
TSAMPGFLY

SEQ ID NO: 1030752 - protein, 9 aa, Homo Sapiens
SGYGGIAPS

SEQ ID NO: 1030753 - protein, 9 aa, Homo Sapiens
LLEHKEKSE

SEQ ID NO: 1030754 - protein, 9 aa, Homo Sapiens
NFFPLELDN

SEQ ID NO: 1030755 - protein, 9 aa, Homo Sapiens
RQARQQQRR

SEQ ID NO: 1030756 - protein, 9 aa, Homo Sapiens
VASSSFLEK

SEQ ID NO: 1030757 - protein, 9 aa, Homo Sapiens
PCDLSGPTP

SEQ ID NO: 1030758 - protein, 9 aa, Homo Sapiens
LGGPFFLTT

SEQ ID NO: 1030759 - protein, 9 aa, Homo Sapiens
TVCLLPSKK

SEQ ID NO: 1030760 - protein, 9 aa, Homo Sapiens
SADGAILQW

SEQ ID NO: 1030761 - protein, 9 aa, Homo Sapiens
MQTTLKSSQ

SEQ ID NO: 1030762 - protein, 9 aa, Homo Sapiens
NVAMSHRNK

SEQ ID NO: 1030763 - protein, 9 aa, Homo Sapiens
FDRNANYVQ

SEQ ID NO: 1030764 - protein, 9 aa, Homo Sapiens
SLQEKKCIM

SEQ ID NO: 1030765 - protein, 9 aa, Homo Sapiens
TLNIRNINR

SEQ ID NO: 1030766 - protein, 9 aa, Homo Sapiens
LRGANIVRC

SEQ ID NO: 1030767 - protein, 9 aa, Homo Sapiens
LKRKIRSWP

SEQ ID NO: 1030768 - protein, 9 aa, Homo Sapiens
SWRPSQGPV

SEQ ID NO: 1030769 - protein, 9 aa, Homo Sapiens
PPRFTLRMM

SEQ ID NO: 1030770 - protein, 9 aa, Homo Sapiens
RLCSTPQRS

SEQ ID NO: 1030771 - protein, 9 aa, Homo Sapiens
QLCLTALKF

SEQ ID NO: 1030772 - protein, 9 aa, Homo Sapiens
FSHLKKKAV

SEQ ID NO: 1030773 - protein, 9 aa, Homo Sapiens
FDNFSQALI

SEQ ID NO: 1030774 - protein, 9 aa, Homo Sapiens
NFFVLLSVV

SEQ ID NO: 1030775 - protein, 9 aa, Homo Sapiens
LDLQNLRME

SEQ ID NO: 1030776 - protein, 9 aa, Homo Sapiens
KKAPPPAFL

SEQ ID NO: 1030777 - protein, 9 aa, Homo Sapiens
LRSSGSPQE

SEQ ID NO: 1030778 - protein, 9 aa, Homo Sapiens
GFMLRGANI

SEQ ID NO: 1030779 - protein, 9 aa, Homo Sapiens
RSSGSPQET

SEQ ID NO: 1030780 - protein, 9 aa, Homo Sapiens
DNLHIQRNV

SEQ ID NO: 1030781 - protein, 9 aa, Homo Sapiens
AVVAIPGSA

SEQ ID NO: 1030782 - protein, 9 aa, Homo Sapiens
TYPAFLELD

SEQ ID NO: 1030783 - protein, 9 aa, Homo Sapiens
YHYKEGMSS

SEQ ID NO: 1030784 - protein, 9 aa, Homo Sapiens
GFSSFEKHQ

SEQ ID NO: 1030785 - protein, 9 aa, Homo Sapiens
EGNVKMLGL

SEQ ID NO: 1030786 - protein, 9 aa, Homo Sapiens
DKRILEFNS

SEQ ID NO: 1030787 - protein, 9 aa, Homo Sapiens
ESTVDVVLP

SEQ ID NO: 1030788 - protein, 9 aa, Homo Sapiens
GNSYQGAQV

SEQ ID NO: 1030789 - protein, 9 aa, Homo Sapiens
WIWSHQGPQ

SEQ ID NO: 1030790 - protein, 9 aa, Homo Sapiens
TLPVIICVT

SEQ ID NO: 1030791 - protein, 9 aa, Homo Sapiens
RLSEKLEEK

SEQ ID NO: 1030792 - protein, 9 aa, Homo Sapiens
AFQLDWPLP

SEQ ID NO: 1030793 - protein, 9 aa, Homo Sapiens
MSPLAWVEL

SEQ ID NO: 1030794 - protein, 9 aa, Homo Sapiens
QPKRSFARL

SEQ ID NO: 1030795 - protein, 9 aa, Homo Sapiens
ITADDDSGG

SEQ ID NO: 1030796 - protein, 9 aa, Homo Sapiens
KSLGFSREA

SEQ ID NO: 1030797 - protein, 9 aa, Homo Sapiens
FSPNVSGSL

SEQ ID NO: 1030798 - protein, 9 aa, Homo Sapiens
GVLHIYGLY

SEQ ID NO: 1030799 - protein, 9 aa, Homo Sapiens
NKGNEKPRA

SEQ ID NO: 1030800 - protein, 9 aa, Homo Sapiens
GDFRNPLRK

SEQ ID NO: 1030801 - protein, 9 aa, Homo Sapiens
RNIHKLFDE

SEQ ID NO: 1030802 - protein, 9 aa, Homo Sapiens
LWVLGLIYL

SEQ ID NO: 1030803 - protein, 9 aa, Homo Sapiens
NLSERGQSQ

SEQ ID NO: 1030804 - protein, 9 aa, Homo Sapiens
PITNSLTQK

SEQ ID NO: 1030805 - protein, 9 aa, Homo Sapiens
SPLQPHPGL

SEQ ID NO: 1030806 - protein, 9 aa, Homo Sapiens
SDRQSFLQR

SEQ ID NO: 1030807 - protein, 9 aa, Homo Sapiens
VIFLMSVGE

SEQ ID NO: 1030808 - protein, 9 aa, Homo Sapiens
LSVIGHMSP

SEQ ID NO: 1030809 - protein, 9 aa, Homo Sapiens
ERSKPVADG

SEQ ID NO: 1030810 - protein, 9 aa, Homo Sapiens
KLVKPGGAQ

SEQ ID NO: 1030811 - protein, 9 aa, Homo Sapiens
SWNVLESQR

SEQ ID NO: 1030812 - protein, 9 aa, Homo Sapiens
LANSSTAHP

SEQ ID NO: 1030813 - protein, 9 aa, Homo Sapiens
SPGIKCTQE

SEQ ID NO: 1030814 - protein, 9 aa, Homo Sapiens
KKHCVFDAA

SEQ ID NO: 1030815 - protein, 9 aa, Homo Sapiens
QGSSGPEFF

SEQ ID NO: 1030816 - protein, 9 aa, Homo Sapiens
YVRPVLNFP

SEQ ID NO: 1030817 - protein, 9 aa, Homo Sapiens
TPSGDIPYR

SEQ ID NO: 1030818 - protein, 9 aa, Homo Sapiens
LEKIRQDQK

SEQ ID NO: 1030819 - protein, 9 aa, Homo Sapiens
PASIKLSAL

SEQ ID NO: 1030820 - protein, 9 aa, Homo Sapiens
GRKDPMAYG

SEQ ID NO: 1030821 - protein, 9 aa, Homo Sapiens
IIGPTELFS

SEQ ID NO: 1030822 - protein, 9 aa, Homo Sapiens
HPYRRTAIE

SEQ ID NO: 1030823 - protein, 9 aa, Homo Sapiens
PPPAEPAQS

SEQ ID NO: 1030824 - protein, 9 aa, Homo Sapiens
KVHESRNKP

SEQ ID NO: 1030825 - protein, 9 aa, Homo Sapiens
VSLLSSVAF

SEQ ID NO: 1030826 - protein, 9 aa, Homo Sapiens
IIREEAVLL

SEQ ID NO: 1030827 - protein, 9 aa, Homo Sapiens
NWNRLFSPL

SEQ ID NO: 1030828 - protein, 9 aa, Homo Sapiens
PFSKDFYGT

SEQ ID NO: 1030829 - protein, 9 aa, Homo Sapiens
LKFLQRKFW

SEQ ID NO: 1030830 - protein, 9 aa, Homo Sapiens
QKEGHMRWG

SEQ ID NO: 1030831 - protein, 9 aa, Homo Sapiens
LGLIYLLFI

SEQ ID NO: 1030832 - protein, 9 aa, Homo Sapiens
KECGKPFNC

SEQ ID NO: 1030833 - protein, 9 aa, Homo Sapiens
LNSVNVMPF

SEQ ID NO: 1030834 - protein, 9 aa, Homo Sapiens
KQINELENG

SEQ ID NO: 1030835 - protein, 9 aa, Homo Sapiens
SMMQNHGDF

SEQ ID NO: 1030836 - protein, 9 aa, Homo Sapiens
DYLLSTQQP

SEQ ID NO: 1030837 - protein, 9 aa, Homo Sapiens
NLGKDSEES

SEQ ID NO: 1030838 - protein, 9 aa, Homo Sapiens
EREQEKNDV

SEQ ID NO: 1030839 - protein, 9 aa, Homo Sapiens
CPLNRPFRC

SEQ ID NO: 1030840 - protein, 9 aa, Homo Sapiens
FWALPKNLT

SEQ ID NO: 1030841 - protein, 9 aa, Homo Sapiens
TYQTSGNLE

SEQ ID NO: 1030842 - protein, 9 aa, Homo Sapiens
SVEDVPVEK

SEQ ID NO: 1030843 - protein, 9 aa, Homo Sapiens
DLGENNLQD

SEQ ID NO: 1030844 - protein, 9 aa, Homo Sapiens
WVLGLIYLL

SEQ ID NO: 1030845 - protein, 9 aa, Homo Sapiens
HERENEIVE

SEQ ID NO: 1030846 - protein, 9 aa, Homo Sapiens
PAFHSNFTL

SEQ ID NO: 1030847 - protein, 9 aa, Homo Sapiens
QKPLSTCAF

SEQ ID NO: 1030848 - protein, 9 aa, Homo Sapiens
GISAGSSTS

SEQ ID NO: 1030849 - protein, 9 aa, Homo Sapiens
CVAQLYFFY

SEQ ID NO: 1030850 - protein, 9 aa, Homo Sapiens
GPERRKFDS

SEQ ID NO: 1030851 - protein, 9 aa, Homo Sapiens
PLSSQRPWT

SEQ ID NO: 1030852 - protein, 9 aa, Homo Sapiens
VSQAFSYPD

SEQ ID NO: 1030853 - protein, 9 aa, Homo Sapiens
EGQRARIIV

SEQ ID NO: 1030854 - protein, 9 aa, Homo Sapiens
QSQSLRVDF

SEQ ID NO: 1030855 - protein, 9 aa, Homo Sapiens
EIVILSSLR

SEQ ID NO: 1030856 - protein, 9 aa, Homo Sapiens
FADNLGMGG

SEQ ID NO: 1030857 - protein, 9 aa, Homo Sapiens
SMPTKETGW

SEQ ID NO: 1030858 - protein, 9 aa, Homo Sapiens
KRLAHHQRH

SEQ ID NO: 1030859 - protein, 9 aa, Homo Sapiens
ESSSPQGGP

SEQ ID NO: 1030860 - protein, 9 aa, Homo Sapiens
LVVLWEHGT

SEQ ID NO: 1030861 - protein, 9 aa, Homo Sapiens
ETDGVEAKR

SEQ ID NO: 1030862 - protein, 9 aa, Homo Sapiens
IVSMENTGK

SEQ ID NO: 1030863 - protein, 9 aa, Homo Sapiens
MYIKSSHLK

SEQ ID NO: 1030864 - protein, 9 aa, Homo Sapiens
LRISGTQAE

SEQ ID NO: 1030865 - protein, 9 aa, Homo Sapiens
NLRIEVKIK

SEQ ID NO: 1030866 - protein, 9 aa, Homo Sapiens
QRKSRENKT

SEQ ID NO: 1030867 - protein, 9 aa, Homo Sapiens
MSPGASRCP

SEQ ID NO: 1030868 - protein, 9 aa, Homo Sapiens
GASLSTQKL

SEQ ID NO: 1030869 - protein, 9 aa, Homo Sapiens
TEAHVGPGF

SEQ ID NO: 1030870 - protein, 9 aa, Homo Sapiens
AGIDIWGGE

SEQ ID NO: 1030871 - protein, 9 aa, Homo Sapiens
WRIFWGVRE

SEQ ID NO: 1030872 - protein, 9 aa, Homo Sapiens
LLTPLKIKI

SEQ ID NO: 1030873 - protein, 9 aa, Homo Sapiens
DQYLAICCP

SEQ ID NO: 1030874 - protein, 9 aa, Homo Sapiens
SSENNSGVP

SEQ ID NO: 1030875 - protein, 9 aa, Homo Sapiens
KAPVPQQAS

SEQ ID NO: 1030876 - protein, 9 aa, Homo Sapiens
IVQSPRQGL

SEQ ID NO: 1030877 - protein, 9 aa, Homo Sapiens
KEERDLVNR

SEQ ID NO: 1030878 - protein, 9 aa, Homo Sapiens
LGETPGETV

SEQ ID NO: 1030879 - protein, 9 aa, Homo Sapiens
VSMENTGKQ

SEQ ID NO: 1030880 - protein, 9 aa, Homo Sapiens
DSYTSRSSD

SEQ ID NO: 1030881 - protein, 9 aa, Homo Sapiens
IWKYLKKNR

SEQ ID NO: 1030882 - protein, 9 aa, Homo Sapiens
NKSVFETNL

SEQ ID NO: 1030883 - protein, 9 aa, Homo Sapiens
NVHTAARVL

SEQ ID NO: 1030884 - protein, 9 aa, Homo Sapiens
KFRAYDWGN

SEQ ID NO: 1030885 - protein, 9 aa, Homo Sapiens
QIRARRKTT

SEQ ID NO: 1030886 - protein, 9 aa, Homo Sapiens
APAKPRSSP

SEQ ID NO: 1030887 - protein, 9 aa, Homo Sapiens
QAAPSFYLS

SEQ ID NO: 1030888 - protein, 9 aa, Homo Sapiens
VLHELSGNK

SEQ ID NO: 1030889 - protein, 9 aa, Homo Sapiens
TPPDYYSEC

SEQ ID NO: 1030890 - protein, 9 aa, Homo Sapiens
LDKDEGFGD

SEQ ID NO: 1030891 - protein, 9 aa, Homo Sapiens
QSRGSLVKQ

SEQ ID NO: 1030892 - protein, 9 aa, Homo Sapiens
EGLGFIFLD

SEQ ID NO: 1030893 - protein, 9 aa, Homo Sapiens
RSDGDEENE

SEQ ID NO: 1030894 - protein, 9 aa, Homo Sapiens
SYTSRSSDS

SEQ ID NO: 1030895 - protein, 9 aa, Homo Sapiens
WAFSEGHSG

SEQ ID NO: 1030896 - protein, 9 aa, Homo Sapiens
GGKATCFVY

SEQ ID NO: 1030897 - protein, 9 aa, Homo Sapiens
SSPARNSPA

SEQ ID NO: 1030898 - protein, 9 aa, Homo Sapiens
KLQEAQEVL

SEQ ID NO: 1030899 - protein, 9 aa, Homo Sapiens
CGNNIFEEG

SEQ ID NO: 1030900 - protein, 9 aa, Homo Sapiens
EISEGASTL

SEQ ID NO: 1030901 - protein, 9 aa, Homo Sapiens
NKAVAKGNL

SEQ ID NO: 1030902 - protein, 9 aa, Homo Sapiens
ERGYCYKKS

SEQ ID NO: 1030903 - protein, 9 aa, Homo Sapiens
FWPSLSSGV

SEQ ID NO: 1030904 - protein, 9 aa, Homo Sapiens
LYQHYSCRE

SEQ ID NO: 1030905 - protein, 9 aa, Homo Sapiens
SSVFLSDNS

SEQ ID NO: 1030906 - protein, 9 aa, Homo Sapiens
TPPCELGLK

SEQ ID NO: 1030907 - protein, 9 aa, Homo Sapiens
FLNTFQEFF

SEQ ID NO: 1030908 - protein, 9 aa, Homo Sapiens
RNCMSFSVL

SEQ ID NO: 1030909 - protein, 9 aa, Homo Sapiens
ELLLNVPEL

SEQ ID NO: 1030910 - protein, 9 aa, Homo Sapiens
LAMWNESSL

SEQ ID NO: 1030911 - protein, 9 aa, Homo Sapiens
IGPTKERTL

SEQ ID NO: 1030912 - protein, 9 aa, Homo Sapiens
LESEGMYHC

SEQ ID NO: 1030913 - protein, 9 aa, Homo Sapiens
AATKAVLWK

SEQ ID NO: 1030914 - protein, 9 aa, Homo Sapiens
KWKQSVCLI

SEQ ID NO: 1030915 - protein, 9 aa, Homo Sapiens
LENIETKNI

SEQ ID NO: 1030916 - protein, 9 aa, Homo Sapiens
KEGMSSSEK

SEQ ID NO: 1030917 - protein, 9 aa, Homo Sapiens
EGCPESETS

SEQ ID NO: 1030918 - protein, 9 aa, Homo Sapiens
ATQPNFSGG

SEQ ID NO: 1030919 - protein, 9 aa, Homo Sapiens
LTEIHLSPE

SEQ ID NO: 1030920 - protein, 9 aa, Homo Sapiens
CTRNCMSFS

SEQ ID NO: 1030921 - protein, 9 aa, Homo Sapiens
AGGRKDPMA

SEQ ID NO: 1030922 - protein, 9 aa, Homo Sapiens
ISITVDPAR

SEQ ID NO: 1030923 - protein, 9 aa, Homo Sapiens
CACVYAENA

SEQ ID NO: 1030924 - protein, 9 aa, Homo Sapiens
IPAFHSNFT

SEQ ID NO: 1030925 - protein, 9 aa, Homo Sapiens
DEKNCVCRA

SEQ ID NO: 1030926 - protein, 9 aa, Homo Sapiens
SFYLSVKQD

SEQ ID NO: 1030927 - protein, 9 aa, Homo Sapiens
GQFLDYDLD

SEQ ID NO: 1030928 - protein, 9 aa, Homo Sapiens
LFSATMSPV

SEQ ID NO: 1030929 - protein, 9 aa, Homo Sapiens
NIKYLSPLL

SEQ ID NO: 1030930 - protein, 9 aa, Homo Sapiens
ICVTTVPGK

SEQ ID NO: 1030931 - protein, 9 aa, Homo Sapiens
RLYFPDLLR

SEQ ID NO: 1030932 - protein, 9 aa, Homo Sapiens
LRAPTLPDT

SEQ ID NO: 1030933 - protein, 9 aa, Homo Sapiens
KLEEAGTEL

SEQ ID NO: 1030934 - protein, 9 aa, Homo Sapiens
GIINDDIFE

SEQ ID NO: 1030935 - protein, 9 aa, Homo Sapiens
IFLNTFQEF

SEQ ID NO: 1030936 - protein, 9 aa, Homo Sapiens
KFADNLGMG

SEQ ID NO: 1030937 - protein, 9 aa, Homo Sapiens
TGPKLLEVS

SEQ ID NO: 1030938 - protein, 9 aa, Homo Sapiens
YFFDRDSDI

SEQ ID NO: 1030939 - protein, 9 aa, Homo Sapiens
RGKFAAEKN

SEQ ID NO: 1030940 - protein, 9 aa, Homo Sapiens
IRSWPERSE

SEQ ID NO: 1030941 - protein, 9 aa, Homo Sapiens
NHLKMSELL

SEQ ID NO: 1030942 - protein, 9 aa, Homo Sapiens
QSKVLLSKE

SEQ ID NO: 1030943 - protein, 9 aa, Homo Sapiens
FPRLETLLQ

SEQ ID NO: 1030944 - protein, 9 aa, Homo Sapiens
REIKKSIRK

SEQ ID NO: 1030945 - protein, 9 aa, Homo Sapiens
EGQSMSEAP

SEQ ID NO: 1030946 - protein, 9 aa, Homo Sapiens
VLSEPLPEK

SEQ ID NO: 1030947 - protein, 9 aa, Homo Sapiens
FSKPPLISH

SEQ ID NO: 1030948 - protein, 9 aa, Homo Sapiens
SQSYGKKKN

SEQ ID NO: 1030949 - protein, 9 aa, Homo Sapiens
APAKIVIQP

SEQ ID NO: 1030950 - protein, 9 aa, Homo Sapiens
PMPFITIIP

SEQ ID NO: 1030951 - protein, 9 aa, Homo Sapiens
YIHSFWKLR

SEQ ID NO: 1030952 - protein, 9 aa, Homo Sapiens
RKGEGVQLS

SEQ ID NO: 1030953 - protein, 9 aa, Homo Sapiens
QYEKNIAPA

SEQ ID NO: 1030954 - protein, 9 aa, Homo Sapiens
GLSGSPGPK

SEQ ID NO: 1030955 - protein, 9 aa, Homo Sapiens
AENPNPQGG

SEQ ID NO: 1030956 - protein, 9 aa, Homo Sapiens
SSSNTSPYF

SEQ ID NO: 1030957 - protein, 9 aa, Homo Sapiens
KKEQKDFVP

SEQ ID NO: 1030958 - protein, 9 aa, Homo Sapiens
SSPRDSVSV

SEQ ID NO: 1030959 - protein, 9 aa, Homo Sapiens
DQGSSGPEF

SEQ ID NO: 1030960 - protein, 9 aa, Homo Sapiens
PKMVTELCY

SEQ ID NO: 1030961 - protein, 9 aa, Homo Sapiens
EDISGLSSG

SEQ ID NO: 1030962 - protein, 9 aa, Homo Sapiens
GAGRMGFSS

SEQ ID NO: 1030963 - protein, 9 aa, Homo Sapiens
QPSYLAKDA

SEQ ID NO: 1030964 - protein, 9 aa, Homo Sapiens
IFFLQGQLN

SEQ ID NO: 1030965 - protein, 9 aa, Homo Sapiens
MNLRRVKEY

SEQ ID NO: 1030966 - protein, 9 aa, Homo Sapiens
MALTTARLV

SEQ ID NO: 1030967 - protein, 9 aa, Homo Sapiens
LERKLATPD

SEQ ID NO: 1030968 - protein, 9 aa, Homo Sapiens
HKSSEESGK

SEQ ID NO: 1030969 - protein, 9 aa, Homo Sapiens
SQWSFFFRS

SEQ ID NO: 1030970 - protein, 9 aa, Homo Sapiens
LEGGYCSPA

SEQ ID NO: 1030971 - protein, 9 aa, Homo Sapiens
PQGAHGESS

SEQ ID NO: 1030972 - protein, 9 aa, Homo Sapiens
YTLGLWKTF

SEQ ID NO: 1030973 - protein, 9 aa, Homo Sapiens
KVITVIESG

SEQ ID NO: 1030974 - protein, 9 aa, Homo Sapiens
GEKGFCYKG

SEQ ID NO: 1030975 - protein, 9 aa, Homo Sapiens
AMKNYEKSK

SEQ ID NO: 1030976 - protein, 9 aa, Homo Sapiens
HNFSPNVSG

SEQ ID NO: 1030977 - protein, 9 aa, Homo Sapiens
SISPSNRNP

SEQ ID NO: 1030978 - protein, 9 aa, Homo Sapiens
TWDCLPLSQ

SEQ ID NO: 1030979 - protein, 9 aa, Homo Sapiens
EAEYTLGLW

SEQ ID NO: 1030980 - protein, 9 aa, Homo Sapiens
ENNACFPSP

SEQ ID NO: 1030981 - protein, 9 aa, Homo Sapiens
LMSTFKNYY

SEQ ID NO: 1030982 - protein, 9 aa, Homo Sapiens
EELPPKELQ

SEQ ID NO: 1030983 - protein, 9 aa, Homo Sapiens
NLAEGGFFV

SEQ ID NO: 1030984 - protein, 9 aa, Homo Sapiens
CLSLGSLMK

SEQ ID NO: 1030985 - protein, 9 aa, Homo Sapiens
LSVPPGPTL

SEQ ID NO: 1030986 - protein, 9 aa, Homo Sapiens
GEELPPKEL

SEQ ID NO: 1030987 - protein, 9 aa, Homo Sapiens
PGIKCTQEE

SEQ ID NO: 1030988 - protein, 9 aa, Homo Sapiens
QTSCINSFT

SEQ ID NO: 1030989 - protein, 9 aa, Homo Sapiens
ELLNDSEHF

SEQ ID NO: 1030990 - protein, 9 aa, Homo Sapiens
QCVKQKEKE

SEQ ID NO: 1030991 - protein, 9 aa, Homo Sapiens
PLVQNAASL

SEQ ID NO: 1030992 - protein, 9 aa, Homo Sapiens
FTPANYFHV

SEQ ID NO: 1030993 - protein, 9 aa, Homo Sapiens
DGSQSLSES

SEQ ID NO: 1030994 - protein, 9 aa, Homo Sapiens
RILRPLSPT

SEQ ID NO: 1030995 - protein, 9 aa, Homo Sapiens
IPSEVQRKG

SEQ ID NO: 1030996 - protein, 9 aa, Homo Sapiens
INNIKHITA

SEQ ID NO: 1030997 - protein, 9 aa, Homo Sapiens
KNLSERGQS

SEQ ID NO: 1030998 - protein, 9 aa, Homo Sapiens
HRPAELGVL

SEQ ID NO: 1030999 - protein, 9 aa, Homo Sapiens
ILEKLQSCG

SEQ ID NO: 1031000 - protein, 9 aa, Homo Sapiens
SAGSSTSGS

SEQ ID NO: 1031001 - protein, 9 aa, Homo Sapiens
NLTITWKFF

SEQ ID NO: 1031002 - protein, 9 aa, Homo Sapiens
RPRGAKGCT

SEQ ID NO: 1031003 - protein, 9 aa, Homo Sapiens
MGAAAGVFH

SEQ ID NO: 1031004 - protein, 9 aa, Homo Sapiens
QIGCNKIGD

SEQ ID NO: 1031005 - protein, 9 aa, Homo Sapiens
SHPNYPYLD

SEQ ID NO: 1031006 - protein, 9 aa, Homo Sapiens
DQLPNFLEK

SEQ ID NO: 1031007 - protein, 9 aa, Homo Sapiens
VLSASQDRT

SEQ ID NO: 1031008 - protein, 9 aa, Homo Sapiens
GTPTVLAAH

SEQ ID NO: 1031009 - protein, 9 aa, Homo Sapiens
EGIFADVTF

SEQ ID NO: 1031010 - protein, 9 aa, Homo Sapiens
RVQTKSKLY

SEQ ID NO: 1031011 - protein, 9 aa, Homo Sapiens
SRSRLYRRK

SEQ ID NO: 1031012 - protein, 9 aa, Homo Sapiens
LRSEASNKD

SEQ ID NO: 1031013 - protein, 9 aa, Homo Sapiens
GFGQENHKD

SEQ ID NO: 1031014 - protein, 9 aa, Homo Sapiens
SLRVDFFRA

SEQ ID NO: 1031015 - protein, 9 aa, Homo Sapiens
EEEDDDDDN

SEQ ID NO: 1031016 - protein, 9 aa, Homo Sapiens
FANEKTTLS

SEQ ID NO: 1031017 - protein, 9 aa, Homo Sapiens
ALEVSSPRC

SEQ ID NO: 1031018 - protein, 9 aa, Homo Sapiens
TKWIQERSL

SEQ ID NO: 1031019 - protein, 9 aa, Homo Sapiens
LAFPAGHLP

SEQ ID NO: 1031020 - protein, 9 aa, Homo Sapiens
DPKKAPPPA

SEQ ID NO: 1031021 - protein, 9 aa, Homo Sapiens
AILQWKYPY

SEQ ID NO: 1031022 - protein, 9 aa, Homo Sapiens
TTFDNVGSL

SEQ ID NO: 1031023 - protein, 9 aa, Homo Sapiens
LFLKASDER

SEQ ID NO: 1031024 - protein, 9 aa, Homo Sapiens
LIQTPYPSQ

SEQ ID NO: 1031025 - protein, 9 aa, Homo Sapiens
FSGGNDGHH

SEQ ID NO: 1031026 - protein, 9 aa, Homo Sapiens
VVLLPQSQE

SEQ ID NO: 1031027 - protein, 9 aa, Homo Sapiens
TDGVEAKRL

SEQ ID NO: 1031028 - protein, 9 aa, Homo Sapiens
ITAFYVAGI

SEQ ID NO: 1031029 - protein, 9 aa, Homo Sapiens
SKEEDDDKW

SEQ ID NO: 1031030 - protein, 9 aa, Homo Sapiens
IQVTCDAHH

SEQ ID NO: 1031031 - protein, 9 aa, Homo Sapiens
GKDKVKPKI

SEQ ID NO: 1031032 - protein, 9 aa, Homo Sapiens
MVFAQIRCK

SEQ ID NO: 1031033 - protein, 9 aa, Homo Sapiens
DTKDELSDI

SEQ ID NO: 1031034 - protein, 9 aa, Homo Sapiens
IRQPPFTNY

SEQ ID NO: 1031035 - protein, 9 aa, Homo Sapiens
LLPSGLHGN

SEQ ID NO: 1031036 - protein, 9 aa, Homo Sapiens
SSPCVGSPG

SEQ ID NO: 1031037 - protein, 9 aa, Homo Sapiens
AHWRVHTGE

SEQ ID NO: 1031038 - protein, 9 aa, Homo Sapiens
LKNETLFCL

SEQ ID NO: 1031039 - protein, 9 aa, Homo Sapiens
SVTVQESLC

SEQ ID NO: 1031040 - protein, 9 aa, Homo Sapiens
GFSSGDHGL

SEQ ID NO: 1031041 - protein, 9 aa, Homo Sapiens
KRNFDNFKT

SEQ ID NO: 1031042 - protein, 9 aa, Homo Sapiens
LGLWKTFPG

SEQ ID NO: 1031043 - protein, 9 aa, Homo Sapiens
SVCLISLCQ

SEQ ID NO: 1031044 - protein, 9 aa, Homo Sapiens
SLKTLLSLV

SEQ ID NO: 1031045 - protein, 9 aa, Homo Sapiens
CDSSSYSVP

SEQ ID NO: 1031046 - protein, 9 aa, Homo Sapiens
FQKHSPTSE

SEQ ID NO: 1031047 - protein, 9 aa, Homo Sapiens
KSYRSLSTS

SEQ ID NO: 1031048 - protein, 9 aa, Homo Sapiens
CSCNVTKFE

SEQ ID NO: 1031049 - protein, 9 aa, Homo Sapiens
GNQQPSWNS

SEQ ID NO: 1031050 - protein, 9 aa, Homo Sapiens
ELGVLYRTL

SEQ ID NO: 1031051 - protein, 9 aa, Homo Sapiens
TAKKVLLFY

SEQ ID NO: 1031052 - protein, 9 aa, Homo Sapiens
GASLDYFSP

SEQ ID NO: 1031053 - protein, 9 aa, Homo Sapiens
WVSSGSSSE

SEQ ID NO: 1031054 - protein, 9 aa, Homo Sapiens
NNAPEILYP

SEQ ID NO: 1031055 - protein, 9 aa, Homo Sapiens
YYLFDGQAL

SEQ ID NO: 1031056 - protein, 9 aa, Homo Sapiens
PYNIVIFLN

SEQ ID NO: 1031057 - protein, 9 aa, Homo Sapiens
QQKEENEEE

SEQ ID NO: 1031058 - protein, 9 aa, Homo Sapiens
NIWYSFSVP

SEQ ID NO: 1031059 - protein, 9 aa, Homo Sapiens
PRVKVSNEY

SEQ ID NO: 1031060 - protein, 9 aa, Homo Sapiens
VIESGLLFE

SEQ ID NO: 1031061 - protein, 9 aa, Homo Sapiens
TPTVLAAHP

SEQ ID NO: 1031062 - protein, 9 aa, Homo Sapiens
PDRRNQSSV

SEQ ID NO: 1031063 - protein, 9 aa, Homo Sapiens
EDDVEKNEE

SEQ ID NO: 1031064 - protein, 9 aa, Homo Sapiens
TRRDESTGE

SEQ ID NO: 1031065 - protein, 9 aa, Homo Sapiens
GSELQEEDS

SEQ ID NO: 1031066 - protein, 9 aa, Homo Sapiens
LTYDCACLS

SEQ ID NO: 1031067 - protein, 9 aa, Homo Sapiens
ESVTVQESL

SEQ ID NO: 1031068 - protein, 9 aa, Homo Sapiens
SLFLLDQNN

SEQ ID NO: 1031069 - protein, 9 aa, Homo Sapiens
CACPGKDRR

SEQ ID NO: 1031070 - protein, 9 aa, Homo Sapiens
TSIILNNEL

SEQ ID NO: 1031071 - protein, 9 aa, Homo Sapiens
QDSLEKVLR

SEQ ID NO: 1031072 - protein, 9 aa, Homo Sapiens
AVLQICPLQ

SEQ ID NO: 1031073 - protein, 9 aa, Homo Sapiens
FYIHSFWKL

SEQ ID NO: 1031074 - protein, 9 aa, Homo Sapiens
LTLAYSASW

SEQ ID NO: 1031075 - protein, 9 aa, Homo Sapiens
LLFYANIVH

SEQ ID NO: 1031076 - protein, 9 aa, Homo Sapiens
TLSSAEPTE

SEQ ID NO: 1031077 - protein, 9 aa, Homo Sapiens
PQTLVILKN

SEQ ID NO: 1031078 - protein, 9 aa, Homo Sapiens
RISSIKIPL

SEQ ID NO: 1031079 - protein, 9 aa, Homo Sapiens
HPTTGAQPP

SEQ ID NO: 1031080 - protein, 9 aa, Homo Sapiens
GKINSETVN

SEQ ID NO: 1031081 - protein, 9 aa, Homo Sapiens
ENTGKQVVC

SEQ ID NO: 1031082 - protein, 9 aa, Homo Sapiens
SECQSQPAV

SEQ ID NO: 1031083 - protein, 9 aa, Homo Sapiens
CLLVVAQTF

SEQ ID NO: 1031084 - protein, 9 aa, Homo Sapiens
SFYTPEPDT

SEQ ID NO: 1031085 - protein, 9 aa, Homo Sapiens
ITNSLTQKL

SEQ ID NO: 1031086 - protein, 9 aa, Homo Sapiens
PMLEAYSSA

SEQ ID NO: 1031087 - protein, 9 aa, Homo Sapiens
SLSGGKINS

SEQ ID NO: 1031088 - protein, 9 aa, Homo Sapiens
FQLHMKGIL

SEQ ID NO: 1031089 - protein, 9 aa, Homo Sapiens
QPVYLYPQD

SEQ ID NO: 1031090 - protein, 9 aa, Homo Sapiens
EGENFYKFE

SEQ ID NO: 1031091 - protein, 9 aa, Homo Sapiens
FCMEKGSIK

SEQ ID NO: 1031092 - protein, 9 aa, Homo Sapiens
KPSKRPSPN

SEQ ID NO: 1031093 - protein, 9 aa, Homo Sapiens
SFRLNEASF

SEQ ID NO: 1031094 - protein, 9 aa, Homo Sapiens
VGREVIFLG

SEQ ID NO: 1031095 - protein, 9 aa, Homo Sapiens
RQSFLQRYW

SEQ ID NO: 1031096 - protein, 9 aa, Homo Sapiens
SPNAPDHTS

SEQ ID NO: 1031097 - protein, 9 aa, Homo Sapiens
MEMTNKKSL

SEQ ID NO: 1031098 - protein, 9 aa, Homo Sapiens
AHGESSLAS

SEQ ID NO: 1031099 - protein, 9 aa, Homo Sapiens
CSKMYIKSS

SEQ ID NO: 1031100 - protein, 9 aa, Homo Sapiens
GAEGQSMSE

SEQ ID NO: 1031101 - protein, 9 aa, Homo Sapiens
SAMPGFLYP

SEQ ID NO: 1031102 - protein, 9 aa, Homo Sapiens
QRRMEKINS

SEQ ID NO: 1031103 - protein, 9 aa, Homo Sapiens
NDSIISACG

SEQ ID NO: 1031104 - protein, 9 aa, Homo Sapiens
RGEAFLFAL

SEQ ID NO: 1031105 - protein, 9 aa, Homo Sapiens
SNVDYKHIL

SEQ ID NO: 1031106 - protein, 9 aa, Homo Sapiens
ETYGHNGIH

SEQ ID NO: 1031107 - protein, 9 aa, Homo Sapiens
DLKNILFRV

SEQ ID NO: 1031108 - protein, 9 aa, Homo Sapiens
ERSRKGSEL

SEQ ID NO: 1031109 - protein, 9 aa, Homo Sapiens
SLGTGYFRL

SEQ ID NO: 1031110 - protein, 9 aa, Homo Sapiens
AQLSFPPYY

SEQ ID NO: 1031111 - protein, 9 aa, Homo Sapiens
QMKLKFLQR

SEQ ID NO: 1031112 - protein, 9 aa, Homo Sapiens
GLNKSAFTF

SEQ ID NO: 1031113 - protein, 9 aa, Homo Sapiens
KSKKIKEKS

SEQ ID NO: 1031114 - protein, 9 aa, Homo Sapiens
QILPPRRPP

SEQ ID NO: 1031115 - protein, 9 aa, Homo Sapiens
PSSSSTTLW

SEQ ID NO: 1031116 - protein, 9 aa, Homo Sapiens
VLDIDDNSS

SEQ ID NO: 1031117 - protein, 9 aa, Homo Sapiens
KNFISQWSF

SEQ ID NO: 1031118 - protein, 9 aa, Homo Sapiens
YQCKECGKP

SEQ ID NO: 1031119 - protein, 9 aa, Homo Sapiens
PGPAKRSQL

SEQ ID NO: 1031120 - protein, 9 aa, Homo Sapiens
ERRLHEREN

SEQ ID NO: 1031121 - protein, 9 aa, Homo Sapiens
LSDDEELSF

SEQ ID NO: 1031122 - protein, 9 aa, Homo Sapiens
RAAYSPEGQ

SEQ ID NO: 1031123 - protein, 9 aa, Homo Sapiens
EYSQIFQLH

SEQ ID NO: 1031124 - protein, 9 aa, Homo Sapiens
VVSRGSTLP

SEQ ID NO: 1031125 - protein, 9 aa, Homo Sapiens
LWALLPPTL

SEQ ID NO: 1031126 - protein, 9 aa, Homo Sapiens
AEGQSMSEA

SEQ ID NO: 1031127 - protein, 9 aa, Homo Sapiens
DVVLNKKLM

SEQ ID NO: 1031128 - protein, 9 aa, Homo Sapiens
IQQDCQKSN

SEQ ID NO: 1031129 - protein, 9 aa, Homo Sapiens
IKCTQEEVD

SEQ ID NO: 1031130 - protein, 9 aa, Homo Sapiens
KDELSDIQS

SEQ ID NO: 1031131 - protein, 9 aa, Homo Sapiens
DCGNNIFEE

SEQ ID NO: 1031132 - protein, 9 aa, Homo Sapiens
FPDDYNSGD

SEQ ID NO: 1031133 - protein, 9 aa, Homo Sapiens
EYGCSLRLD

SEQ ID NO: 1031134 - protein, 9 aa, Homo Sapiens
SASAAETSG

SEQ ID NO: 1031135 - protein, 9 aa, Homo Sapiens
KYCDVDLVS

SEQ ID NO: 1031136 - protein, 9 aa, Homo Sapiens
SIKLSALEM

SEQ ID NO: 1031137 - protein, 9 aa, Homo Sapiens
GYNDLMSKM

SEQ ID NO: 1031138 - protein, 9 aa, Homo Sapiens
CELLWLQRL

SEQ ID NO: 1031139 - protein, 9 aa, Homo Sapiens
PSFCHRSDD

SEQ ID NO: 1031140 - protein, 9 aa, Homo Sapiens
NLSALQTFR

SEQ ID NO: 1031141 - protein, 9 aa, Homo Sapiens
IGDHANMFS

SEQ ID NO: 1031142 - protein, 9 aa, Homo Sapiens
LQEIVILSS

SEQ ID NO: 1031143 - protein, 9 aa, Homo Sapiens
PNYPYLDEY

SEQ ID NO: 1031144 - protein, 9 aa, Homo Sapiens
NKVVVEKGE

SEQ ID NO: 1031145 - protein, 9 aa, Homo Sapiens
CIYKGGILV

SEQ ID NO: 1031146 - protein, 9 aa, Homo Sapiens
IADAYSSFC

SEQ ID NO: 1031147 - protein, 9 aa, Homo Sapiens
CIQFQKKSE

SEQ ID NO: 1031148 - protein, 9 aa, Homo Sapiens
RALYQHYSC

SEQ ID NO: 1031149 - protein, 9 aa, Homo Sapiens
SGGGTTTPW

SEQ ID NO: 1031150 - protein, 9 aa, Homo Sapiens
DRGGWTVFQ

SEQ ID NO: 1031151 - protein, 9 aa, Homo Sapiens
HVYLGQEMI

SEQ ID NO: 1031152 - protein, 9 aa, Homo Sapiens
IIILQRSEH

SEQ ID NO: 1031153 - protein, 9 aa, Homo Sapiens
LKRPKDDSN

SEQ ID NO: 1031154 - protein, 9 aa, Homo Sapiens
EESLMMNWL

SEQ ID NO: 1031155 - protein, 9 aa, Homo Sapiens
LERVSQAFS

SEQ ID NO: 1031156 - protein, 9 aa, Homo Sapiens
QFPKSIFHL

SEQ ID NO: 1031157 - protein, 9 aa, Homo Sapiens
PELDKDEGF

SEQ ID NO: 1031158 - protein, 9 aa, Homo Sapiens
NDEKAFDFF

SEQ ID NO: 1031159 - protein, 9 aa, Homo Sapiens
NLLLRKDAC

SEQ ID NO: 1031160 - protein, 9 aa, Homo Sapiens
DTWSFPREV

SEQ ID NO: 1031161 - protein, 9 aa, Homo Sapiens
SGDMYPRPA

SEQ ID NO: 1031162 - protein, 9 aa, Homo Sapiens
PRLSNNMCL

SEQ ID NO: 1031163 - protein, 9 aa, Homo Sapiens
ESYLERPSP

SEQ ID NO: 1031164 - protein, 9 aa, Homo Sapiens
TVTATFGYS

SEQ ID NO: 1031165 - protein, 9 aa, Homo Sapiens
EKHQITLFV

SEQ ID NO: 1031166 - protein, 9 aa, Homo Sapiens
ICFLISFLL

SEQ ID NO: 1031167 - protein, 9 aa, Homo Sapiens
EEEGLEECS

SEQ ID NO: 1031168 - protein, 9 aa, Homo Sapiens
HSDKFRAYD

SEQ ID NO: 1031169 - protein, 9 aa, Homo Sapiens
RRFEKLGRK

SEQ ID NO: 1031170 - protein, 9 aa, Homo Sapiens
INALFLKAS

SEQ ID NO: 1031171 - protein, 9 aa, Homo Sapiens
GRMGFSSGD

SEQ ID NO: 1031172 - protein, 9 aa, Homo Sapiens
TWRKVAGYF

SEQ ID NO: 1031173 - protein, 9 aa, Homo Sapiens
HGPDGISVG

SEQ ID NO: 1031174 - protein, 9 aa, Homo Sapiens
ISPASIKLS

SEQ ID NO: 1031175 - protein, 9 aa, Homo Sapiens
PSRSGTAQV

SEQ ID NO: 1031176 - protein, 9 aa, Homo Sapiens
PNVDPCTEE

SEQ ID NO: 1031177 - protein, 9 aa, Homo Sapiens
PEGEAGQRL

SEQ ID NO: 1031178 - protein, 9 aa, Homo Sapiens
FGIGLTPLL

SEQ ID NO: 1031179 - protein, 9 aa, Homo Sapiens
RGQLVGKEA

SEQ ID NO: 1031180 - protein, 9 aa, Homo Sapiens
LMHRECLPL

SEQ ID NO: 1031181 - protein, 9 aa, Homo Sapiens
QPMQPLPKS

SEQ ID NO: 1031182 - protein, 9 aa, Homo Sapiens
CKERGYCYK

SEQ ID NO: 1031183 - protein, 9 aa, Homo Sapiens
DQTQETQKL

SEQ ID NO: 1031184 - protein, 9 aa, Homo Sapiens
CRPRGAEGQ

SEQ ID NO: 1031185 - protein, 9 aa, Homo Sapiens
GMDCEMYKH

SEQ ID NO: 1031186 - protein, 9 aa, Homo Sapiens
DRGPKEPKG

SEQ ID NO: 1031187 - protein, 9 aa, Homo Sapiens
MSTFKNYYS

SEQ ID NO: 1031188 - protein, 9 aa, Homo Sapiens
SQAQRDKRM

SEQ ID NO: 1031189 - protein, 9 aa, Homo Sapiens
SYLFEVYED

SEQ ID NO: 1031190 - protein, 9 aa, Homo Sapiens
TNAQDPGLQ

SEQ ID NO: 1031191 - protein, 9 aa, Homo Sapiens
WRKVAGYFK

SEQ ID NO: 1031192 - protein, 9 aa, Homo Sapiens
DEKSLGFSR

SEQ ID NO: 1031193 - protein, 9 aa, Homo Sapiens
ITTLYMTKY

SEQ ID NO: 1031194 - protein, 9 aa, Homo Sapiens
SSVLAGGFC

SEQ ID NO: 1031195 - protein, 9 aa, Homo Sapiens
SSGWGLAGS

SEQ ID NO: 1031196 - protein, 9 aa, Homo Sapiens
IAHEAKESH

SEQ ID NO: 1031197 - protein, 9 aa, Homo Sapiens
SPSLCWTNG

SEQ ID NO: 1031198 - protein, 9 aa, Homo Sapiens
WFLLNKPSV

SEQ ID NO: 1031199 - protein, 9 aa, Homo Sapiens
RLSLESSPN

SEQ ID NO: 1031200 - protein, 9 aa, Homo Sapiens
DVNDNPPQF

SEQ ID NO: 1031201 - protein, 9 aa, Homo Sapiens
REIICCYPL

SEQ ID NO: 1031202 - protein, 9 aa, Homo Sapiens
ARLEDSKLE

SEQ ID NO: 1031203 - protein, 9 aa, Homo Sapiens
PSGPGPRPP

SEQ ID NO: 1031204 - protein, 9 aa, Homo Sapiens
FIKIHFGTT

SEQ ID NO: 1031205 - protein, 9 aa, Homo Sapiens
SPFDIKGIE

SEQ ID NO: 1031206 - protein, 9 aa, Homo Sapiens
PLMEPENLD

SEQ ID NO: 1031207 - protein, 9 aa, Homo Sapiens
DDVELLLNV

SEQ ID NO: 1031208 - protein, 9 aa, Homo Sapiens
PIKKKKSCH

SEQ ID NO: 1031209 - protein, 9 aa, Homo Sapiens
LGPERRKFD

SEQ ID NO: 1031210 - protein, 9 aa, Homo Sapiens
INRQNKFLT

SEQ ID NO: 1031211 - protein, 9 aa, Homo Sapiens
LVGAVIGVT

SEQ ID NO: 1031212 - protein, 9 aa, Homo Sapiens
SSPNAPDHT

SEQ ID NO: 1031213 - protein, 9 aa, Homo Sapiens
GPPLSPESP

SEQ ID NO: 1031214 - protein, 9 aa, Homo Sapiens
SQLEFTVHF

SEQ ID NO: 1031215 - protein, 9 aa, Homo Sapiens
QEMIGSLEL

SEQ ID NO: 1031216 - protein, 9 aa, Homo Sapiens
AGSSTSGST

SEQ ID NO: 1031217 - protein, 9 aa, Homo Sapiens
TSGGLRRCL

SEQ ID NO: 1031218 - protein, 9 aa, Homo Sapiens
SQTCVMWDD

SEQ ID NO: 1031219 - protein, 9 aa, Homo Sapiens
CDAGRQVRM

SEQ ID NO: 1031220 - protein, 9 aa, Homo Sapiens
KMWEQKVRL

SEQ ID NO: 1031221 - protein, 9 aa, Homo Sapiens
EGTRPPLSL

SEQ ID NO: 1031222 - protein, 9 aa, Homo Sapiens
PWLGYVLDF

SEQ ID NO: 1031223 - protein, 9 aa, Homo Sapiens
MPKEYSQIF

SEQ ID NO: 1031224 - protein, 9 aa, Homo Sapiens
ILYRAIAHE

SEQ ID NO: 1031225 - protein, 9 aa, Homo Sapiens
SGAAIWTRA

SEQ ID NO: 1031226 - protein, 9 aa, Homo Sapiens
TVQESLCVL

SEQ ID NO: 1031227 - protein, 9 aa, Homo Sapiens
TLNLPTCRN

SEQ ID NO: 1031228 - protein, 9 aa, Homo Sapiens
SAQEDIPDL

SEQ ID NO: 1031229 - protein, 9 aa, Homo Sapiens
SQDEDNTIF

SEQ ID NO: 1031230 - protein, 9 aa, Homo Sapiens
KTLLSLVLV

SEQ ID NO: 1031231 - protein, 9 aa, Homo Sapiens
EAISEISSQ

SEQ ID NO: 1031232 - protein, 9 aa, Homo Sapiens
IALFSWPLY

SEQ ID NO: 1031233 - protein, 9 aa, Homo Sapiens
EEDAQIFKV

SEQ ID NO: 1031234 - protein, 9 aa, Homo Sapiens
EDWAFSEGH

SEQ ID NO: 1031235 - protein, 9 aa, Homo Sapiens
GFLGRPGLD

SEQ ID NO: 1031236 - protein, 9 aa, Homo Sapiens
SLCIARFRF

SEQ ID NO: 1031237 - protein, 9 aa, Homo Sapiens
IFQLHMKGI

SEQ ID NO: 1031238 - protein, 9 aa, Homo Sapiens
INPFSSQNS

SEQ ID NO: 1031239 - protein, 9 aa, Homo Sapiens
GIAWTIPSL

SEQ ID NO: 1031240 - protein, 9 aa, Homo Sapiens
KAGFITYRF

SEQ ID NO: 1031241 - protein, 9 aa, Homo Sapiens
QLPTCSPLQ

SEQ ID NO: 1031242 - protein, 9 aa, Homo Sapiens
FFVLLSVVC

SEQ ID NO: 1031243 - protein, 9 aa, Homo Sapiens
INLYVRGGY

SEQ ID NO: 1031244 - protein, 9 aa, Homo Sapiens
TKTLRERIT

SEQ ID NO: 1031245 - protein, 9 aa, Homo Sapiens
FRKEDCSFS

SEQ ID NO: 1031246 - protein, 9 aa, Homo Sapiens
VCHANSSER

SEQ ID NO: 1031247 - protein, 9 aa, Homo Sapiens
KKVQHIQLL

SEQ ID NO: 1031248 - protein, 9 aa, Homo Sapiens
SLSEDGEIT

SEQ ID NO: 1031249 - protein, 9 aa, Homo Sapiens
VASERVTKD

SEQ ID NO: 1031250 - protein, 9 aa, Homo Sapiens
PGWTGKYCQ

SEQ ID NO: 1031251 - protein, 9 aa, Homo Sapiens
EDSLTVPTK

SEQ ID NO: 1031252 - protein, 9 aa, Homo Sapiens
SFVIPAFHS

SEQ ID NO: 1031253 - protein, 9 aa, Homo Sapiens
KFFNILTFW

SEQ ID NO: 1031254 - protein, 9 aa, Homo Sapiens
SLIHEGENF

SEQ ID NO: 1031255 - protein, 9 aa, Homo Sapiens
KNEMKEQKY

SEQ ID NO: 1031256 - protein, 9 aa, Homo Sapiens
SFVLPSYQH

SEQ ID NO: 1031257 - protein, 9 aa, Homo Sapiens
FVPGLIPAE

SEQ ID NO: 1031258 - protein, 9 aa, Homo Sapiens
KFIQKDDLQ

SEQ ID NO: 1031259 - protein, 9 aa, Homo Sapiens
ELPEVLSEP

SEQ ID NO: 1031260 - protein, 9 aa, Homo Sapiens
WVHFSDTFP

SEQ ID NO: 1031261 - protein, 9 aa, Homo Sapiens
EGLSNYICM

SEQ ID NO: 1031262 - protein, 9 aa, Homo Sapiens
PRIYFCTFI

SEQ ID NO: 1031263 - protein, 9 aa, Homo Sapiens
YIFHYDIDG

SEQ ID NO: 1031264 - protein, 9 aa, Homo Sapiens
MCDIKKWDQ

SEQ ID NO: 1031265 - protein, 9 aa, Homo Sapiens
KRPKDDSNP

SEQ ID NO: 1031266 - protein, 9 aa, Homo Sapiens
STCHIEGDN

SEQ ID NO: 1031267 - protein, 9 aa, Homo Sapiens
SIFGDLKKL

SEQ ID NO: 1031268 - protein, 9 aa, Homo Sapiens
RGSGGGILE

SEQ ID NO: 1031269 - protein, 9 aa, Homo Sapiens
TSRREAEWS

SEQ ID NO: 1031270 - protein, 9 aa, Homo Sapiens
FMGAMFFGV

SEQ ID NO: 1031271 - protein, 9 aa, Homo Sapiens
ESDVIGRGH

SEQ ID NO: 1031272 - protein, 9 aa, Homo Sapiens
LEAKAFSSD

SEQ ID NO: 1031273 - protein, 9 aa, Homo Sapiens
WPERSELVR

SEQ ID NO: 1031274 - protein, 9 aa, Homo Sapiens
AGCVHGICE

SEQ ID NO: 1031275 - protein, 9 aa, Homo Sapiens
TFSGNQLSS

SEQ ID NO: 1031276 - protein, 9 aa, Homo Sapiens
KKNLEGTLR

SEQ ID NO: 1031277 - protein, 9 aa, Homo Sapiens
KPLHLEGGY

SEQ ID NO: 1031278 - protein, 9 aa, Homo Sapiens
ESRNKPTSL

SEQ ID NO: 1031279 - protein, 9 aa, Homo Sapiens
AHHQRHSLL

SEQ ID NO: 1031280 - protein, 9 aa, Homo Sapiens
LCSQDEIPP

SEQ ID NO: 1031281 - protein, 9 aa, Homo Sapiens
KSHGSRTSQ

SEQ ID NO: 1031282 - protein, 9 aa, Homo Sapiens
FLQRIQELE

SEQ ID NO: 1031283 - protein, 9 aa, Homo Sapiens
WGVQTFSSG

SEQ ID NO: 1031284 - protein, 9 aa, Homo Sapiens
PSLSQHAND

SEQ ID NO: 1031285 - protein, 9 aa, Homo Sapiens
YIEMFREKN

SEQ ID NO: 1031286 - protein, 9 aa, Homo Sapiens
SLVFLLDVE

SEQ ID NO: 1031287 - protein, 9 aa, Homo Sapiens
NGSLSTSPY

SEQ ID NO: 1031288 - protein, 9 aa, Homo Sapiens
EDYGMGPGW

SEQ ID NO: 1031289 - protein, 9 aa, Homo Sapiens
EMKEQKYWK

SEQ ID NO: 1031290 - protein, 9 aa, Homo Sapiens
LSCREAVLH

SEQ ID NO: 1031291 - protein, 9 aa, Homo Sapiens
VLLTYLCAE

SEQ ID NO: 1031292 - protein, 9 aa, Homo Sapiens
WVTFYKVMV

SEQ ID NO: 1031293 - protein, 9 aa, Homo Sapiens
SFREKKLQD

SEQ ID NO: 1031294 - protein, 9 aa, Homo Sapiens
QQSARKMTE

SEQ ID NO: 1031295 - protein, 9 aa, Homo Sapiens
AVLVGAVIG

SEQ ID NO: 1031296 - protein, 9 aa, Homo Sapiens
WYSFSVPMA

SEQ ID NO: 1031297 - protein, 9 aa, Homo Sapiens
RRLLDTKDE

SEQ ID NO: 1031298 - protein, 9 aa, Homo Sapiens
FCQEIYSHL

SEQ ID NO: 1031299 - protein, 9 aa, Homo Sapiens
NLEGTVGDS

SEQ ID NO: 1031300 - protein, 9 aa, Homo Sapiens
TNICVPSVT

SEQ ID NO: 1031301 - protein, 9 aa, Homo Sapiens
AVDSNLCSQ

SEQ ID NO: 1031302 - protein, 9 aa, Homo Sapiens
SGDYSATFV

SEQ ID NO: 1031303 - protein, 9 aa, Homo Sapiens
RNRATCISS

SEQ ID NO: 1031304 - protein, 9 aa, Homo Sapiens
KKSCHDRNE

SEQ ID NO: 1031305 - protein, 9 aa, Homo Sapiens
INCANEKLQ

SEQ ID NO: 1031306 - protein, 9 aa, Homo Sapiens
IDENGNQNR

SEQ ID NO: 1031307 - protein, 9 aa, Homo Sapiens
GSCPSFPLP

SEQ ID NO: 1031308 - protein, 9 aa, Homo Sapiens
KVLRAPTLP

SEQ ID NO: 1031309 - protein, 9 aa, Homo Sapiens
SAPEGLSTT

SEQ ID NO: 1031310 - protein, 9 aa, Homo Sapiens
DPRIYFCTF

SEQ ID NO: 1031311 - protein, 9 aa, Homo Sapiens
SEISSQLEH

SEQ ID NO: 1031312 - protein, 9 aa, Homo Sapiens
HDHLACFCK

SEQ ID NO: 1031313 - protein, 9 aa, Homo Sapiens
GFCRAPSTY

SEQ ID NO: 1031314 - protein, 9 aa, Homo Sapiens
IVLGNTYRR

SEQ ID NO: 1031315 - protein, 9 aa, Homo Sapiens
IGPPGPAGP

SEQ ID NO: 1031316 - protein, 9 aa, Homo Sapiens
TSSGATEDY

SEQ ID NO: 1031317 - protein, 9 aa, Homo Sapiens
PKRSFARLY

SEQ ID NO: 1031318 - protein, 9 aa, Homo Sapiens
LTLEECDIV

SEQ ID NO: 1031319 - protein, 9 aa, Homo Sapiens
SSWSSCVQG

SEQ ID NO: 1031320 - protein, 9 aa, Homo Sapiens
KPLLGGPFF

SEQ ID NO: 1031321 - protein, 9 aa, Homo Sapiens
DPVSPNLVQ

SEQ ID NO: 1031322 - protein, 9 aa, Homo Sapiens
YFLQRIQEL

SEQ ID NO: 1031323 - protein, 9 aa, Homo Sapiens
AKPRSSPRS

SEQ ID NO: 1031324 - protein, 9 aa, Homo Sapiens
KHLRKKHCV

SEQ ID NO: 1031325 - protein, 9 aa, Homo Sapiens
SSCLPSPPE

SEQ ID NO: 1031326 - protein, 9 aa, Homo Sapiens
EVEASLEIP

SEQ ID NO: 1031327 - protein, 9 aa, Homo Sapiens
KKKKSCHRP

SEQ ID NO: 1031328 - protein, 9 aa, Homo Sapiens
CDVDLVSAR

SEQ ID NO: 1031329 - protein, 9 aa, Homo Sapiens
VRETPWEAE

SEQ ID NO: 1031330 - protein, 9 aa, Homo Sapiens
LPRLSLPPR

SEQ ID NO: 1031331 - protein, 9 aa, Homo Sapiens
GPKAWHKCE

SEQ ID NO: 1031332 - protein, 9 aa, Homo Sapiens
TRHGPSQDE

SEQ ID NO: 1031333 - protein, 9 aa, Homo Sapiens
IPIIGPTEL

SEQ ID NO: 1031334 - protein, 9 aa, Homo Sapiens
LGRPGLDGV

SEQ ID NO: 1031335 - protein, 9 aa, Homo Sapiens
AELGVLYRT

SEQ ID NO: 1031336 - protein, 9 aa, Homo Sapiens
LEVSSPRCL

SEQ ID NO: 1031337 - protein, 9 aa, Homo Sapiens
QMLVVLWEH

SEQ ID NO: 1031338 - protein, 9 aa, Homo Sapiens
QVTCDAHHR

SEQ ID NO: 1031339 - protein, 9 aa, Homo Sapiens
DRPIKAPVY

SEQ ID NO: 1031340 - protein, 9 aa, Homo Sapiens
LLHLEAKIR

SEQ ID NO: 1031341 - protein, 9 aa, Homo Sapiens
FTLRMMETK

SEQ ID NO: 1031342 - protein, 9 aa, Homo Sapiens
EETSIFYFT

SEQ ID NO: 1031343 - protein, 9 aa, Homo Sapiens
SLEFPGFPG

SEQ ID NO: 1031344 - protein, 9 aa, Homo Sapiens
PVGSISLWL

SEQ ID NO: 1031345 - protein, 9 aa, Homo Sapiens
PSVTANGAD

SEQ ID NO: 1031346 - protein, 9 aa, Homo Sapiens
EIKKICRDE

SEQ ID NO: 1031347 - protein, 9 aa, Homo Sapiens
LSPLPKAGF

SEQ ID NO: 1031348 - protein, 9 aa, Homo Sapiens
IYARDVLEK

SEQ ID NO: 1031349 - protein, 9 aa, Homo Sapiens
GNQTSSGAT

SEQ ID NO: 1031350 - protein, 9 aa, Homo Sapiens
AQYKEIAQR

SEQ ID NO: 1031351 - protein, 9 aa, Homo Sapiens
WQELEVFCW

SEQ ID NO: 1031352 - protein, 9 aa, Homo Sapiens
VKSREIDWA

SEQ ID NO: 1031353 - protein, 9 aa, Homo Sapiens
NNNYPIFTE

SEQ ID NO: 1031354 - protein, 9 aa, Homo Sapiens
LPKSLASLH

SEQ ID NO: 1031355 - protein, 9 aa, Homo Sapiens
SGPPIFQQV

SEQ ID NO: 1031356 - protein, 9 aa, Homo Sapiens
YHLDTAKIT

SEQ ID NO: 1031357 - protein, 9 aa, Homo Sapiens
REYKNELAK

SEQ ID NO: 1031358 - protein, 9 aa, Homo Sapiens
KNPEAELPL

SEQ ID NO: 1031359 - protein, 9 aa, Homo Sapiens
LLKRPKDDS

SEQ ID NO: 1031360 - protein, 9 aa, Homo Sapiens
SNEYVTKGQ

SEQ ID NO: 1031361 - protein, 9 aa, Homo Sapiens
PSNRNPASV

SEQ ID NO: 1031362 - protein, 9 aa, Homo Sapiens
SSEFFSQQK

SEQ ID NO: 1031363 - protein, 9 aa, Homo Sapiens
AGFITYRFG

SEQ ID NO: 1031364 - protein, 9 aa, Homo Sapiens
QRSSSTSAE

SEQ ID NO: 1031365 - protein, 9 aa, Homo Sapiens
IIRHKNKAK

SEQ ID NO: 1031366 - protein, 9 aa, Homo Sapiens
IPDTKPYGA

SEQ ID NO: 1031367 - protein, 9 aa, Homo Sapiens
RAASYMVYM

SEQ ID NO: 1031368 - protein, 9 aa, Homo Sapiens
DIKPANMEN

SEQ ID NO: 1031369 - protein, 9 aa, Homo Sapiens
QGRRRKENC

SEQ ID NO: 1031370 - protein, 9 aa, Homo Sapiens
QLAAIYAGL

SEQ ID NO: 1031371 - protein, 9 aa, Homo Sapiens
GKYCQQPIC

SEQ ID NO: 1031372 - protein, 9 aa, Homo Sapiens
DIDEIEEMP

SEQ ID NO: 1031373 - protein, 9 aa, Homo Sapiens
ASPEGCPES

SEQ ID NO: 1031374 - protein, 9 aa, Homo Sapiens
QTCDSSSYS

SEQ ID NO: 1031375 - protein, 9 aa, Homo Sapiens
YIKSSHLKA

SEQ ID NO: 1031376 - protein, 9 aa, Homo Sapiens
ERRKFDSGV

SEQ ID NO: 1031377 - protein, 9 aa, Homo Sapiens
APELDKDEG

SEQ ID NO: 1031378 - protein, 9 aa, Homo Sapiens
FSIKGPFYG

SEQ ID NO: 1031379 - protein, 9 aa, Homo Sapiens
VLLELADTL

SEQ ID NO: 1031380 - protein, 9 aa, Homo Sapiens
CSCLERVQP

SEQ ID NO: 1031381 - protein, 9 aa, Homo Sapiens
LTISAYQEN

SEQ ID NO: 1031382 - protein, 9 aa, Homo Sapiens
ENGEWTQGL

SEQ ID NO: 1031383 - protein, 9 aa, Homo Sapiens
KIEEMDSSF

SEQ ID NO: 1031384 - protein, 9 aa, Homo Sapiens
FRNPLRKFK

SEQ ID NO: 1031385 - protein, 9 aa, Homo Sapiens
EKNARVAVA

SEQ ID NO: 1031386 - protein, 9 aa, Homo Sapiens
EETEKGTQE

SEQ ID NO: 1031387 - protein, 9 aa, Homo Sapiens
LLNKTTWQR

SEQ ID NO: 1031388 - protein, 9 aa, Homo Sapiens
QQQRRALSF

SEQ ID NO: 1031389 - protein, 9 aa, Homo Sapiens
RVPSNDLLF

SEQ ID NO: 1031390 - protein, 9 aa, Homo Sapiens
ILASVAQQR

SEQ ID NO: 1031391 - protein, 9 aa, Homo Sapiens
RRPVSAGLF

SEQ ID NO: 1031392 - protein, 9 aa, Homo Sapiens
LSFPPYYYG

SEQ ID NO: 1031393 - protein, 9 aa, Homo Sapiens
FDDYRRKGC

SEQ ID NO: 1031394 - protein, 9 aa, Homo Sapiens
QSKTERGLY

SEQ ID NO: 1031395 - protein, 9 aa, Homo Sapiens
LSTVTEILM

SEQ ID NO: 1031396 - protein, 9 aa, Homo Sapiens
DFYAAAVRR

SEQ ID NO: 1031397 - protein, 9 aa, Homo Sapiens
TPLFQLNKN

SEQ ID NO: 1031398 - protein, 9 aa, Homo Sapiens
QLNKNTGEI

SEQ ID NO: 1031399 - protein, 9 aa, Homo Sapiens
CNNPLPQNG

SEQ ID NO: 1031400 - protein, 9 aa, Homo Sapiens
FWEKKVTGC

SEQ ID NO: 1031401 - protein, 9 aa, Homo Sapiens
EHKEKSENI

SEQ ID NO: 1031402 - protein, 9 aa, Homo Sapiens
RHVYPNGTL

SEQ ID NO: 1031403 - protein, 9 aa, Homo Sapiens
SLSSIDKNL

SEQ ID NO: 1031404 - protein, 9 aa, Homo Sapiens
HANSSERAR

SEQ ID NO: 1031405 - protein, 9 aa, Homo Sapiens
VQAALDREA

SEQ ID NO: 1031406 - protein, 9 aa, Homo Sapiens
HLEVRESFD

SEQ ID NO: 1031407 - protein, 9 aa, Homo Sapiens
LKLFLFRRR

SEQ ID NO: 1031408 - protein, 9 aa, Homo Sapiens
IIVAALDAS

SEQ ID NO: 1031409 - protein, 9 aa, Homo Sapiens
YFLGNVWFL

SEQ ID NO: 1031410 - protein, 9 aa, Homo Sapiens
VEIEWVKQY

SEQ ID NO: 1031411 - protein, 9 aa, Homo Sapiens
KHPKITSFV

SEQ ID NO: 1031412 - protein, 9 aa, Homo Sapiens
TKERTLSAD

SEQ ID NO: 1031413 - protein, 9 aa, Homo Sapiens
KGEGMGLKI

SEQ ID NO: 1031414 - protein, 9 aa, Homo Sapiens
RTLRSEASN

SEQ ID NO: 1031415 - protein, 9 aa, Homo Sapiens
KEAEYTLGL

SEQ ID NO: 1031416 - protein, 9 aa, Homo Sapiens
KAMKNYEKS

SEQ ID NO: 1031417 - protein, 9 aa, Homo Sapiens
YIRPQIQYF

SEQ ID NO: 1031418 - protein, 9 aa, Homo Sapiens
ACLLVVAQT

SEQ ID NO: 1031419 - protein, 9 aa, Homo Sapiens
RGPKEPKGD

SEQ ID NO: 1031420 - protein, 9 aa, Homo Sapiens
SQAESYLER

SEQ ID NO: 1031421 - protein, 9 aa, Homo Sapiens
KGGGKGGAG

SEQ ID NO: 1031422 - protein, 9 aa, Homo Sapiens
VSFGNKHSY

SEQ ID NO: 1031423 - protein, 9 aa, Homo Sapiens
QQYFFDRDS

SEQ ID NO: 1031424 - protein, 9 aa, Homo Sapiens
AASGYGGIA

SEQ ID NO: 1031425 - protein, 9 aa, Homo Sapiens
IGPCRDKEA

SEQ ID NO: 1031426 - protein, 9 aa, Homo Sapiens
SSAGRVDFA

SEQ ID NO: 1031427 - protein, 9 aa, Homo Sapiens
GISSFYTKN

SEQ ID NO: 1031428 - protein, 9 aa, Homo Sapiens
KEIEHSSPS

SEQ ID NO: 1031429 - protein, 9 aa, Homo Sapiens
VQGLCLGQH

SEQ ID NO: 1031430 - protein, 9 aa, Homo Sapiens
VVNLPVYVG

SEQ ID NO: 1031431 - protein, 9 aa, Homo Sapiens
FRVYYSKCL

SEQ ID NO: 1031432 - protein, 9 aa, Homo Sapiens
MCRVIPPLD

SEQ ID NO: 1031433 - protein, 9 aa, Homo Sapiens
EEKVWRQEK

SEQ ID NO: 1031434 - protein, 9 aa, Homo Sapiens
DKIYDTIFA

SEQ ID NO: 1031435 - protein, 9 aa, Homo Sapiens
AASYSYDCT

SEQ ID NO: 1031436 - protein, 9 aa, Homo Sapiens
SAILSLRQT

SEQ ID NO: 1031437 - protein, 9 aa, Homo Sapiens
AVLLEQERL

SEQ ID NO: 1031438 - protein, 9 aa, Homo Sapiens
PIQTYSWMN

SEQ ID NO: 1031439 - protein, 9 aa, Homo Sapiens
DRHLPIEIK

SEQ ID NO: 1031440 - protein, 9 aa, Homo Sapiens
YGVLHIYGL

SEQ ID NO: 1031441 - protein, 9 aa, Homo Sapiens
QARQQQRRA

SEQ ID NO: 1031442 - protein, 9 aa, Homo Sapiens
SPVNLSPEL

SEQ ID NO: 1031443 - protein, 9 aa, Homo Sapiens
SLPEMTAPG

SEQ ID NO: 1031444 - protein, 9 aa, Homo Sapiens
DCEGGSVAG

SEQ ID NO: 1031445 - protein, 9 aa, Homo Sapiens
IRVGIINDD

SEQ ID NO: 1031446 - protein, 9 aa, Homo Sapiens
YPSQHSVLT

SEQ ID NO: 1031447 - protein, 9 aa, Homo Sapiens
EEEAGFSSS

SEQ ID NO: 1031448 - protein, 9 aa, Homo Sapiens
EPNAISFLL

SEQ ID NO: 1031449 - protein, 9 aa, Homo Sapiens
SSPRCLVLE

SEQ ID NO: 1031450 - protein, 9 aa, Homo Sapiens
QAWPFTCLS

SEQ ID NO: 1031451 - protein, 9 aa, Homo Sapiens
CLGQHGPLT

SEQ ID NO: 1031452 - protein, 9 aa, Homo Sapiens
SGWLWVQAA

SEQ ID NO: 1031453 - protein, 9 aa, Homo Sapiens
SNRNPASVE

SEQ ID NO: 1031454 - protein, 9 aa, Homo Sapiens
NFFLNGSSQ

SEQ ID NO: 1031455 - protein, 9 aa, Homo Sapiens
PNFSGGNDG

SEQ ID NO: 1031456 - protein, 9 aa, Homo Sapiens
FIYSEDNIQ

SEQ ID NO: 1031457 - protein, 9 aa, Homo Sapiens
EIRSIKEPV

SEQ ID NO: 1031458 - protein, 9 aa, Homo Sapiens
FPISITVDP

SEQ ID NO: 1031459 - protein, 9 aa, Homo Sapiens
NYDKQPKDF

SEQ ID NO: 1031460 - protein, 9 aa, Homo Sapiens
CACLSGFEG

SEQ ID NO: 1031461 - protein, 9 aa, Homo Sapiens
IYTPFGSRP

SEQ ID NO: 1031462 - protein, 9 aa, Homo Sapiens
DLEREIKKS

SEQ ID NO: 1031463 - protein, 9 aa, Homo Sapiens
LAGQELTDY

SEQ ID NO: 1031464 - protein, 9 aa, Homo Sapiens
SDDVVQYIK

SEQ ID NO: 1031465 - protein, 9 aa, Homo Sapiens
KTYSGQTEH

SEQ ID NO: 1031466 - protein, 9 aa, Homo Sapiens
LHENKDSIC

SEQ ID NO: 1031467 - protein, 9 aa, Homo Sapiens
SEVCRRKTK

SEQ ID NO: 1031468 - protein, 9 aa, Homo Sapiens
PKKPKQEFI

SEQ ID NO: 1031469 - protein, 9 aa, Homo Sapiens
HIIQSRGSL

SEQ ID NO: 1031470 - protein, 9 aa, Homo Sapiens
VALKGMSQL

SEQ ID NO: 1031471 - protein, 9 aa, Homo Sapiens
KSVFETNLD

SEQ ID NO: 1031472 - protein, 9 aa, Homo Sapiens
SQRSSSTSA

SEQ ID NO: 1031473 - protein, 9 aa, Homo Sapiens
HDNVSSIFL

SEQ ID NO: 1031474 - protein, 9 aa, Homo Sapiens
KNVECACVY

SEQ ID NO: 1031475 - protein, 9 aa, Homo Sapiens
RAFGLPLGL

SEQ ID NO: 1031476 - protein, 9 aa, Homo Sapiens
PRAERLCST

SEQ ID NO: 1031477 - protein, 9 aa, Homo Sapiens
SDSLASKTT

SEQ ID NO: 1031478 - protein, 9 aa, Homo Sapiens
DILEFITNR

SEQ ID NO: 1031479 - protein, 9 aa, Homo Sapiens
FTPKILALC

SEQ ID NO: 1031480 - protein, 9 aa, Homo Sapiens
FSEPTADVN

SEQ ID NO: 1031481 - protein, 9 aa, Homo Sapiens
LGLARKARS

SEQ ID NO: 1031482 - protein, 9 aa, Homo Sapiens
CLARLLKKL

SEQ ID NO: 1031483 - protein, 9 aa, Homo Sapiens
LEEMHQRIL

SEQ ID NO: 1031484 - protein, 9 aa, Homo Sapiens
TDRGGWTVF

SEQ ID NO: 1031485 - protein, 9 aa, Homo Sapiens
GYEYELCLD

SEQ ID NO: 1031486 - protein, 9 aa, Homo Sapiens
PPNNPDEQM

SEQ ID NO: 1031487 - protein, 9 aa, Homo Sapiens
ECKDQKKIY

SEQ ID NO: 1031488 - protein, 9 aa, Homo Sapiens
RRRKENCIN

SEQ ID NO: 1031489 - protein, 9 aa, Homo Sapiens
FADVTFLSH

SEQ ID NO: 1031490 - protein, 9 aa, Homo Sapiens
SEESTVDVV

SEQ ID NO: 1031491 - protein, 9 aa, Homo Sapiens
GRYFFCMEK

SEQ ID NO: 1031492 - protein, 9 aa, Homo Sapiens
FFSGDDLGE

SEQ ID NO: 1031493 - protein, 9 aa, Homo Sapiens
RLLRAPQNL

SEQ ID NO: 1031494 - protein, 9 aa, Homo Sapiens
SNFCLLFRS

SEQ ID NO: 1031495 - protein, 9 aa, Homo Sapiens
KCSTLGMDC

SEQ ID NO: 1031496 - protein, 9 aa, Homo Sapiens
GQGSKACTC

SEQ ID NO: 1031497 - protein, 9 aa, Homo Sapiens
ANEDCIYKG

SEQ ID NO: 1031498 - protein, 9 aa, Homo Sapiens
LSPESPEDA

SEQ ID NO: 1031499 - protein, 9 aa, Homo Sapiens
LLDQNNNAP

SEQ ID NO: 1031500 - protein, 9 aa, Homo Sapiens
SQLHGWNKQ

SEQ ID NO: 1031501 - protein, 9 aa, Homo Sapiens
ERRNQRKKR

SEQ ID NO: 1031502 - protein, 9 aa, Homo Sapiens
KNTGEISIA

SEQ ID NO: 1031503 - protein, 9 aa, Homo Sapiens
VTASAPAAC

SEQ ID NO: 1031504 - protein, 9 aa, Homo Sapiens
CTRVGTRRQ

SEQ ID NO: 1031505 - protein, 9 aa, Homo Sapiens
FCRAPSTYG

SEQ ID NO: 1031506 - protein, 9 aa, Homo Sapiens
DYRRKGCVD

SEQ ID NO: 1031507 - protein, 9 aa, Homo Sapiens
NPNPQGGET

SEQ ID NO: 1031508 - protein, 9 aa, Homo Sapiens
GQDFVGQRT

SEQ ID NO: 1031509 - protein, 9 aa, Homo Sapiens
MNIITAALR

SEQ ID NO: 1031510 - protein, 9 aa, Homo Sapiens
TEESMPTKE

SEQ ID NO: 1031511 - protein, 9 aa, Homo Sapiens
SQDEKSLGF

SEQ ID NO: 1031512 - protein, 9 aa, Homo Sapiens
EKIWIEIIA

SEQ ID NO: 1031513 - protein, 9 aa, Homo Sapiens
HFSAHWRVH

SEQ ID NO: 1031514 - protein, 9 aa, Homo Sapiens
LYSRDMVCN

SEQ ID NO: 1031515 - protein, 9 aa, Homo Sapiens
GIAVARMKG

SEQ ID NO: 1031516 - protein, 9 aa, Homo Sapiens
EEKEEEDEE

SEQ ID NO: 1031517 - protein, 9 aa, Homo Sapiens
INGTPPATK

SEQ ID NO: 1031518 - protein, 9 aa, Homo Sapiens
PKGATHCYD

SEQ ID NO: 1031519 - protein, 9 aa, Homo Sapiens
GNISIPKTY

SEQ ID NO: 1031520 - protein, 9 aa, Homo Sapiens
AMPGFLYPA

SEQ ID NO: 1031521 - protein, 9 aa, Homo Sapiens
LSSIILFDC

SEQ ID NO: 1031522 - protein, 9 aa, Homo Sapiens
YSPRTSIIL

SEQ ID NO: 1031523 - protein, 9 aa, Homo Sapiens
PIMGFVAGL

SEQ ID NO: 1031524 - protein, 9 aa, Homo Sapiens
HLKLFLFRR

SEQ ID NO: 1031525 - protein, 9 aa, Homo Sapiens
ESIFENDPF

SEQ ID NO: 1031526 - protein, 9 aa, Homo Sapiens
IDRTRRDES

SEQ ID NO: 1031527 - protein, 9 aa, Homo Sapiens
PPIFQQVLQ

SEQ ID NO: 1031528 - protein, 9 aa, Homo Sapiens
EVVLLPQSQ

SEQ ID NO: 1031529 - protein, 9 aa, Homo Sapiens
ASDYADSQK

SEQ ID NO: 1031530 - protein, 9 aa, Homo Sapiens
TLHLFGVTK

SEQ ID NO: 1031531 - protein, 9 aa, Homo Sapiens
RPGTAKEVI

SEQ ID NO: 1031532 - protein, 9 aa, Homo Sapiens
NSETVNLSI

SEQ ID NO: 1031533 - protein, 9 aa, Homo Sapiens
QEEWDFQPP

SEQ ID NO: 1031534 - protein, 9 aa, Homo Sapiens
IWFLLNELY

SEQ ID NO: 1031535 - protein, 9 aa, Homo Sapiens
GYCYKKSCH

SEQ ID NO: 1031536 - protein, 9 aa, Homo Sapiens
SFPREVSSH

SEQ ID NO: 1031537 - protein, 9 aa, Homo Sapiens
FSMWVGKNR

SEQ ID NO: 1031538 - protein, 9 aa, Homo Sapiens
AFFSPSNFC

SEQ ID NO: 1031539 - protein, 9 aa, Homo Sapiens
YRVPSLLSV

SEQ ID NO: 1031540 - protein, 9 aa, Homo Sapiens
MEEWHHERK

SEQ ID NO: 1031541 - protein, 9 aa, Homo Sapiens
LTEFVLLEL

SEQ ID NO: 1031542 - protein, 9 aa, Homo Sapiens
GVDFKNDVQ

SEQ ID NO: 1031543 - protein, 9 aa, Homo Sapiens
NYILEKYDR

SEQ ID NO: 1031544 - protein, 9 aa, Homo Sapiens
PEELESEGM

SEQ ID NO: 1031545 - protein, 9 aa, Homo Sapiens
ILEFITNRM

SEQ ID NO: 1031546 - protein, 9 aa, Homo Sapiens
RVCACPGKD

SEQ ID NO: 1031547 - protein, 9 aa, Homo Sapiens
LDELMNFGF

SEQ ID NO: 1031548 - protein, 9 aa, Homo Sapiens
CKIDPALFQ

SEQ ID NO: 1031549 - protein, 9 aa, Homo Sapiens
SPKIIRHKN

SEQ ID NO: 1031550 - protein, 9 aa, Homo Sapiens
PGEEFPGPK

SEQ ID NO: 1031551 - protein, 9 aa, Homo Sapiens
ALPFMGFEK

SEQ ID NO: 1031552 - protein, 9 aa, Homo Sapiens
GSRKIAHFC

SEQ ID NO: 1031553 - protein, 9 aa, Homo Sapiens
FYESDVIGR

SEQ ID NO: 1031554 - protein, 9 aa, Homo Sapiens
PVIMREFFI

SEQ ID NO: 1031555 - protein, 9 aa, Homo Sapiens
TSQPQTPVQ

SEQ ID NO: 1031556 - protein, 9 aa, Homo Sapiens
LPEEEVERS

SEQ ID NO: 1031557 - protein, 9 aa, Homo Sapiens
GAGSSCLPS

SEQ ID NO: 1031558 - protein, 9 aa, Homo Sapiens
PYSSPSLCI

SEQ ID NO: 1031559 - protein, 9 aa, Homo Sapiens
TPPARGEEG

SEQ ID NO: 1031560 - protein, 9 aa, Homo Sapiens
QALPRLSLP

SEQ ID NO: 1031561 - protein, 9 aa, Homo Sapiens
VSLLLHLEA

SEQ ID NO: 1031562 - protein, 9 aa, Homo Sapiens
GDYKGEKKD

SEQ ID NO: 1031563 - protein, 9 aa, Homo Sapiens
NDLAEEMLL

SEQ ID NO: 1031564 - protein, 9 aa, Homo Sapiens
SLVLLANRR

SEQ ID NO: 1031565 - protein, 9 aa, Homo Sapiens
LFDCLLTVR

SEQ ID NO: 1031566 - protein, 9 aa, Homo Sapiens
FGTCEAHLM

SEQ ID NO: 1031567 - protein, 9 aa, Homo Sapiens
VGTLCHLIP

SEQ ID NO: 1031568 - protein, 9 aa, Homo Sapiens
EVPPSEVNE

SEQ ID NO: 1031569 - protein, 9 aa, Homo Sapiens
KNLSASFST

SEQ ID NO: 1031570 - protein, 9 aa, Homo Sapiens
LLVSHAQQE

SEQ ID NO: 1031571 - protein, 9 aa, Homo Sapiens
KEPQTLVIL

SEQ ID NO: 1031572 - protein, 9 aa, Homo Sapiens
FMKMMSMKP

SEQ ID NO: 1031573 - protein, 9 aa, Homo Sapiens
SAKERRNQR

SEQ ID NO: 1031574 - protein, 9 aa, Homo Sapiens
LEARLEVGL

SEQ ID NO: 1031575 - protein, 9 aa, Homo Sapiens
LWLSDWVTF

SEQ ID NO: 1031576 - protein, 9 aa, Homo Sapiens
KVVERSENT

SEQ ID NO: 1031577 - protein, 9 aa, Homo Sapiens
INSRTYTNG

SEQ ID NO: 1031578 - protein, 9 aa, Homo Sapiens
CINSFTVLD

SEQ ID NO: 1031579 - protein, 9 aa, Homo Sapiens
QGMNVALQK

SEQ ID NO: 1031580 - protein, 9 aa, Homo Sapiens
SFCILAMVC

SEQ ID NO: 1031581 - protein, 9 aa, Homo Sapiens
VHRFDSSVK

SEQ ID NO: 1031582 - protein, 9 aa, Homo Sapiens
FSEGHSGDF

SEQ ID NO: 1031583 - protein, 9 aa, Homo Sapiens
CLNQGPLEN

SEQ ID NO: 1031584 - protein, 9 aa, Homo Sapiens
YISSENSDN

SEQ ID NO: 1031585 - protein, 9 aa, Homo Sapiens
WDHVHLQNN

SEQ ID NO: 1031586 - protein, 9 aa, Homo Sapiens
EDEFVDENI

SEQ ID NO: 1031587 - protein, 9 aa, Homo Sapiens
KIKKQSNND

SEQ ID NO: 1031588 - protein, 9 aa, Homo Sapiens
DDLQVVFGT

SEQ ID NO: 1031589 - protein, 9 aa, Homo Sapiens
SGSCRKVLV

SEQ ID NO: 1031590 - protein, 9 aa, Homo Sapiens
TMKNQKAER

SEQ ID NO: 1031591 - protein, 9 aa, Homo Sapiens
HMVFAQIRC

SEQ ID NO: 1031592 - protein, 9 aa, Homo Sapiens
GTTTPWSLA

SEQ ID NO: 1031593 - protein, 9 aa, Homo Sapiens
AQDGKVMEY

SEQ ID NO: 1031594 - protein, 9 aa, Homo Sapiens
LWLGSHAGS

SEQ ID NO: 1031595 - protein, 9 aa, Homo Sapiens
FLSHLAIGA

SEQ ID NO: 1031596 - protein, 9 aa, Homo Sapiens
STLGMDCEM

SEQ ID NO: 1031597 - protein, 9 aa, Homo Sapiens
ISIPKTYSG

SEQ ID NO: 1031598 - protein, 9 aa, Homo Sapiens
LHLEGGYCS

SEQ ID NO: 1031599 - protein, 9 aa, Homo Sapiens
LAYSASWDL

SEQ ID NO: 1031600 - protein, 9 aa, Homo Sapiens
RLTDDPNFQ

SEQ ID NO: 1031601 - protein, 9 aa, Homo Sapiens
TAGKEEYSA

SEQ ID NO: 1031602 - protein, 9 aa, Homo Sapiens
GEAKELGED

SEQ ID NO: 1031603 - protein, 9 aa, Homo Sapiens
PPVLDSYLL

SEQ ID NO: 1031604 - protein, 9 aa, Homo Sapiens
EFPGPKGEK

SEQ ID NO: 1031605 - protein, 9 aa, Homo Sapiens
TLGATDEQQ

SEQ ID NO: 1031606 - protein, 9 aa, Homo Sapiens
EAKAFSSDH

SEQ ID NO: 1031607 - protein, 9 aa, Homo Sapiens
LEAVAPTKS

SEQ ID NO: 1031608 - protein, 9 aa, Homo Sapiens
FRSSSAYRK

SEQ ID NO: 1031609 - protein, 9 aa, Homo Sapiens
FPRLSNNMC

SEQ ID NO: 1031610 - protein, 9 aa, Homo Sapiens
NSKYIRPQI

SEQ ID NO: 1031611 - protein, 9 aa, Homo Sapiens
NQDELFNII

SEQ ID NO: 1031612 - protein, 9 aa, Homo Sapiens
PKITCPPIN

SEQ ID NO: 1031613 - protein, 9 aa, Homo Sapiens
STEESSINY

SEQ ID NO: 1031614 - protein, 9 aa, Homo Sapiens
ECSSSAQCE

SEQ ID NO: 1031615 - protein, 9 aa, Homo Sapiens
IVVNCFTPA

SEQ ID NO: 1031616 - protein, 9 aa, Homo Sapiens
VQTVLSETQ

SEQ ID NO: 1031617 - protein, 9 aa, Homo Sapiens
FTESSKDGI

SEQ ID NO: 1031618 - protein, 9 aa, Homo Sapiens
SSERARFIR

SEQ ID NO: 1031619 - protein, 9 aa, Homo Sapiens
YVFGIPIIG

SEQ ID NO: 1031620 - protein, 9 aa, Homo Sapiens
LLLDLPKGE

SEQ ID NO: 1031621 - protein, 9 aa, Homo Sapiens
RVTSFEGST

SEQ ID NO: 1031622 - protein, 9 aa, Homo Sapiens
SDSFYTPEP

SEQ ID NO: 1031623 - protein, 9 aa, Homo Sapiens
EAFVALRKI

SEQ ID NO: 1031624 - protein, 9 aa, Homo Sapiens
QRIQHLYEE

SEQ ID NO: 1031625 - protein, 9 aa, Homo Sapiens
LPPSQVFLP

SEQ ID NO: 1031626 - protein, 9 aa, Homo Sapiens
IQTPYPSQH

SEQ ID NO: 1031627 - protein, 9 aa, Homo Sapiens
NMTFTKTFQ

SEQ ID NO: 1031628 - protein, 9 aa, Homo Sapiens
ILVSERSKD

SEQ ID NO: 1031629 - protein, 9 aa, Homo Sapiens
DYKKTLEHL

SEQ ID NO: 1031630 - protein, 9 aa, Homo Sapiens
MSGAVLLEQ

SEQ ID NO: 1031631 - protein, 9 aa, Homo Sapiens
NKKPRWFRI

SEQ ID NO: 1031632 - protein, 9 aa, Homo Sapiens
SLFYHLEVR

SEQ ID NO: 1031633 - protein, 9 aa, Homo Sapiens
SNLPTFFSF

SEQ ID NO: 1031634 - protein, 9 aa, Homo Sapiens
ARKPSKRPS

SEQ ID NO: 1031635 - protein, 9 aa, Homo Sapiens
VLQVENENY

SEQ ID NO: 1031636 - protein, 9 aa, Homo Sapiens
WLANSSTAH

SEQ ID NO: 1031637 - protein, 9 aa, Homo Sapiens
NIREETFFF

SEQ ID NO: 1031638 - protein, 9 aa, Homo Sapiens
VRKTKRKKM

SEQ ID NO: 1031639 - protein, 9 aa, Homo Sapiens
NVDVWFRSL

SEQ ID NO: 1031640 - protein, 9 aa, Homo Sapiens
YPSKFIQKD

SEQ ID NO: 1031641 - protein, 9 aa, Homo Sapiens
TYLCAEYGW

SEQ ID NO: 1031642 - protein, 9 aa, Homo Sapiens
SWNSEDSSN

SEQ ID NO: 1031643 - protein, 9 aa, Homo Sapiens
LEEDQAEEI

SEQ ID NO: 1031644 - protein, 9 aa, Homo Sapiens
LVRESHLSL

SEQ ID NO: 1031645 - protein, 9 aa, Homo Sapiens
RNHFYEQCF

SEQ ID NO: 1031646 - protein, 9 aa, Homo Sapiens
IRLHLAKDR

SEQ ID NO: 1031647 - protein, 9 aa, Homo Sapiens
ALQTEPKVV

SEQ ID NO: 1031648 - protein, 9 aa, Homo Sapiens
HISQPCVPT

SEQ ID NO: 1031649 - protein, 9 aa, Homo Sapiens
YELCLDLTL

SEQ ID NO: 1031650 - protein, 9 aa, Homo Sapiens
ENNLQDDGV

SEQ ID NO: 1031651 - protein, 9 aa, Homo Sapiens
NNLVKGSYG

SEQ ID NO: 1031652 - protein, 9 aa, Homo Sapiens
LLGIMAFDR

SEQ ID NO: 1031653 - protein, 9 aa, Homo Sapiens
NIAPAEQKI

SEQ ID NO: 1031654 - protein, 9 aa, Homo Sapiens
CPPPCHISQ

SEQ ID NO: 1031655 - protein, 9 aa, Homo Sapiens
AAIWTRAVA

SEQ ID NO: 1031656 - protein, 9 aa, Homo Sapiens
SPKQKNGTL

SEQ ID NO: 1031657 - protein, 9 aa, Homo Sapiens
LDTKDELSD

SEQ ID NO: 1031658 - protein, 9 aa, Homo Sapiens
KRHYFSDYL

SEQ ID NO: 1031659 - protein, 9 aa, Homo Sapiens
DALEFFNLL

SEQ ID NO: 1031660 - protein, 9 aa, Homo Sapiens
RKEISYTCD

SEQ ID NO: 1031661 - protein, 9 aa, Homo Sapiens
LQDSRMTFR

SEQ ID NO: 1031662 - protein, 9 aa, Homo Sapiens
GTLCHLIPS

SEQ ID NO: 1031663 - protein, 9 aa, Homo Sapiens
KLDKNPNLE

SEQ ID NO: 1031664 - protein, 9 aa, Homo Sapiens
IAIVIGLLL

SEQ ID NO: 1031665 - protein, 9 aa, Homo Sapiens
QRKRDMLRW

SEQ ID NO: 1031666 - protein, 9 aa, Homo Sapiens
CGSARPKLY

SEQ ID NO: 1031667 - protein, 9 aa, Homo Sapiens
IRMCLYYEE

SEQ ID NO: 1031668 - protein, 9 aa, Homo Sapiens
AGRMGFSSG

SEQ ID NO: 1031669 - protein, 9 aa, Homo Sapiens
PEAPESLPP

SEQ ID NO: 1031670 - protein, 9 aa, Homo Sapiens
LGREILLES

SEQ ID NO: 1031671 - protein, 9 aa, Homo Sapiens
MINWNRLFS

SEQ ID NO: 1031672 - protein, 9 aa, Homo Sapiens
ERPKAVESW

SEQ ID NO: 1031673 - protein, 9 aa, Homo Sapiens
IICPIIWIV

SEQ ID NO: 1031674 - protein, 9 aa, Homo Sapiens
TFEILLNDS

SEQ ID NO: 1031675 - protein, 9 aa, Homo Sapiens
QVMRLCAAR

SEQ ID NO: 1031676 - protein, 9 aa, Homo Sapiens
RADLFPILI

SEQ ID NO: 1031677 - protein, 9 aa, Homo Sapiens
PLPPGPPPR

SEQ ID NO: 1031678 - protein, 9 aa, Homo Sapiens
SAGGGMNVE

SEQ ID NO: 1031679 - protein, 9 aa, Homo Sapiens
WCRGPVHRV

SEQ ID NO: 1031680 - protein, 9 aa, Homo Sapiens
EDIYIEQQK

SEQ ID NO: 1031681 - protein, 9 aa, Homo Sapiens
SGSLFREAL

SEQ ID NO: 1031682 - protein, 9 aa, Homo Sapiens
QKKGKEKQQ

SEQ ID NO: 1031683 - protein, 9 aa, Homo Sapiens
AKAFRNRLS

SEQ ID NO: 1031684 - protein, 9 aa, Homo Sapiens
QLPMCRNKI

SEQ ID NO: 1031685 - protein, 9 aa, Homo Sapiens
QEGFPGESR

SEQ ID NO: 1031686 - protein, 9 aa, Homo Sapiens
GDMVQLLSP

SEQ ID NO: 1031687 - protein, 9 aa, Homo Sapiens
RNREIEILT

SEQ ID NO: 1031688 - protein, 9 aa, Homo Sapiens
PNGCSGHGG

SEQ ID NO: 1031689 - protein, 9 aa, Homo Sapiens
SEQTLFMTA

SEQ ID NO: 1031690 - protein, 9 aa, Homo Sapiens
DLVSLHRDC

SEQ ID NO: 1031691 - protein, 9 aa, Homo Sapiens
CCINSHSPL

SEQ ID NO: 1031692 - protein, 9 aa, Homo Sapiens
FQFPHGQKG

SEQ ID NO: 1031693 - protein, 9 aa, Homo Sapiens
KFDRVTLGY

SEQ ID NO: 1031694 - protein, 9 aa, Homo Sapiens
ANTEDLETA

SEQ ID NO: 1031695 - protein, 9 aa, Homo Sapiens
RTEILSLKM

SEQ ID NO: 1031696 - protein, 9 aa, Homo Sapiens
TCTKDRIQH

SEQ ID NO: 1031697 - protein, 9 aa, Homo Sapiens
FRAYLIEGL

SEQ ID NO: 1031698 - protein, 9 aa, Homo Sapiens
GTKSPASTA

SEQ ID NO: 1031699 - protein, 9 aa, Homo Sapiens
KDGTASDPS

SEQ ID NO: 1031700 - protein, 9 aa, Homo Sapiens
PKCYVNICK

SEQ ID NO: 1031701 - protein, 9 aa, Homo Sapiens
RFNVISIKI

SEQ ID NO: 1031702 - protein, 9 aa, Homo Sapiens
FEILLNDSG

SEQ ID NO: 1031703 - protein, 9 aa, Homo Sapiens
TQPLDLKCN

SEQ ID NO: 1031704 - protein, 9 aa, Homo Sapiens
NLYNNHRNP

SEQ ID NO: 1031705 - protein, 9 aa, Homo Sapiens
ALNDHYGHR

SEQ ID NO: 1031706 - protein, 9 aa, Homo Sapiens
VTQLMLHGC

SEQ ID NO: 1031707 - protein, 9 aa, Homo Sapiens
TDLQNLELK

SEQ ID NO: 1031708 - protein, 9 aa, Homo Sapiens
HTDEANSEV

SEQ ID NO: 1031709 - protein, 9 aa, Homo Sapiens
PQVYGNNIK

SEQ ID NO: 1031710 - protein, 9 aa, Homo Sapiens
VMKRQVEEA

SEQ ID NO: 1031711 - protein, 9 aa, Homo Sapiens
SPKPSFPGS

SEQ ID NO: 1031712 - protein, 9 aa, Homo Sapiens
GIFLNLRHL

SEQ ID NO: 1031713 - protein, 9 aa, Homo Sapiens
DQAPELPKG

SEQ ID NO: 1031714 - protein, 9 aa, Homo Sapiens
GFYDESTQV

SEQ ID NO: 1031715 - protein, 9 aa, Homo Sapiens
DLQNLELKY

SEQ ID NO: 1031716 - protein, 9 aa, Homo Sapiens
QELGPGQGL

SEQ ID NO: 1031717 - protein, 9 aa, Homo Sapiens
HTNNYKIIK

SEQ ID NO: 1031718 - protein, 9 aa, Homo Sapiens
NSGIFVGFF

SEQ ID NO: 1031719 - protein, 9 aa, Homo Sapiens
LFRMDKEQQ

SEQ ID NO: 1031720 - protein, 9 aa, Homo Sapiens
GPRTSPQGF

SEQ ID NO: 1031721 - protein, 9 aa, Homo Sapiens
EGVQKSKKE

SEQ ID NO: 1031722 - protein, 9 aa, Homo Sapiens
SQLQNSGDP

SEQ ID NO: 1031723 - protein, 9 aa, Homo Sapiens
GEVDRTKFE

SEQ ID NO: 1031724 - protein, 9 aa, Homo Sapiens
PPTLEATQQ

SEQ ID NO: 1031725 - protein, 9 aa, Homo Sapiens
EGTKRMLLY

SEQ ID NO: 1031726 - protein, 9 aa, Homo Sapiens
PDKEDGEPD

SEQ ID NO: 1031727 - protein, 9 aa, Homo Sapiens
QHWLLGAAR

SEQ ID NO: 1031728 - protein, 9 aa, Homo Sapiens
GPTEPKGIS

SEQ ID NO: 1031729 - protein, 9 aa, Homo Sapiens
LTRTAARTA

SEQ ID NO: 1031730 - protein, 9 aa, Homo Sapiens
GEDIKHKET

SEQ ID NO: 1031731 - protein, 9 aa, Homo Sapiens
AGGFLDLKQ

SEQ ID NO: 1031732 - protein, 9 aa, Homo Sapiens
FEGMEIDEA

SEQ ID NO: 1031733 - protein, 9 aa, Homo Sapiens
LSFTEGEII

SEQ ID NO: 1031734 - protein, 9 aa, Homo Sapiens
IVPPDRVFP

SEQ ID NO: 1031735 - protein, 9 aa, Homo Sapiens
GFPRYTIYL

SEQ ID NO: 1031736 - protein, 9 aa, Homo Sapiens
LQHKIVIFM

SEQ ID NO: 1031737 - protein, 9 aa, Homo Sapiens
LAICLPISN

SEQ ID NO: 1031738 - protein, 9 aa, Homo Sapiens
VRPWHREGE

SEQ ID NO: 1031739 - protein, 9 aa, Homo Sapiens
ECGKTFNQG

SEQ ID NO: 1031740 - protein, 9 aa, Homo Sapiens
LAEVAKNCG

SEQ ID NO: 1031741 - protein, 9 aa, Homo Sapiens
SDGFLEKNK

SEQ ID NO: 1031742 - protein, 9 aa, Homo Sapiens
IRSPMARIC

SEQ ID NO: 1031743 - protein, 9 aa, Homo Sapiens
NSRCEQFCK

SEQ ID NO: 1031744 - protein, 9 aa, Homo Sapiens
GFLDLKQTC

SEQ ID NO: 1031745 - protein, 9 aa, Homo Sapiens
FGGPLHCLV

SEQ ID NO: 1031746 - protein, 9 aa, Homo Sapiens
LWKPPPGLA

SEQ ID NO: 1031747 - protein, 9 aa, Homo Sapiens
FPGPFSAGP

SEQ ID NO: 1031748 - protein, 9 aa, Homo Sapiens
TTDLSIQLS

SEQ ID NO: 1031749 - protein, 9 aa, Homo Sapiens
RLESVLQPL

SEQ ID NO: 1031750 - protein, 9 aa, Homo Sapiens
VSFRNRIYV

SEQ ID NO: 1031751 - protein, 9 aa, Homo Sapiens
ECLEGSGNV

SEQ ID NO: 1031752 - protein, 9 aa, Homo Sapiens
DSVTHTTVT

SEQ ID NO: 1031753 - protein, 9 aa, Homo Sapiens
NLLLLAEPK

SEQ ID NO: 1031754 - protein, 9 aa, Homo Sapiens
FGYLLFLFL

SEQ ID NO: 1031755 - protein, 9 aa, Homo Sapiens
FIGLQKTLV

SEQ ID NO: 1031756 - protein, 9 aa, Homo Sapiens
HPPVEGFYA

SEQ ID NO: 1031757 - protein, 9 aa, Homo Sapiens
NFVIFNNTS

SEQ ID NO: 1031758 - protein, 9 aa, Homo Sapiens
QRRGFPRYT

SEQ ID NO: 1031759 - protein, 9 aa, Homo Sapiens
LFTAGTVFD

SEQ ID NO: 1031760 - protein, 9 aa, Homo Sapiens
ANYGKLQEH

SEQ ID NO: 1031761 - protein, 9 aa, Homo Sapiens
EQNLKVYIK

SEQ ID NO: 1031762 - protein, 9 aa, Homo Sapiens
WGGLSGFLS

SEQ ID NO: 1031763 - protein, 9 aa, Homo Sapiens
VLNKHKKIY

SEQ ID NO: 1031764 - protein, 9 aa, Homo Sapiens
QRSSRALPG

SEQ ID NO: 1031765 - protein, 9 aa, Homo Sapiens
NQLLDENET

SEQ ID NO: 1031766 - protein, 9 aa, Homo Sapiens
ITSTTASET

SEQ ID NO: 1031767 - protein, 9 aa, Homo Sapiens
QAFYVQGVW

SEQ ID NO: 1031768 - protein, 9 aa, Homo Sapiens
LERFLDYGY

SEQ ID NO: 1031769 - protein, 9 aa, Homo Sapiens
ERKQNLDPR

SEQ ID NO: 1031770 - protein, 9 aa, Homo Sapiens
SGNFKKWVG

SEQ ID NO: 1031771 - protein, 9 aa, Homo Sapiens
CLEGSGNVS

SEQ ID NO: 1031772 - protein, 9 aa, Homo Sapiens
LEQELAIKA

SEQ ID NO: 1031773 - protein, 9 aa, Homo Sapiens
ISLANVPPG

SEQ ID NO: 1031774 - protein, 9 aa, Homo Sapiens
CINSHSPLI

SEQ ID NO: 1031775 - protein, 9 aa, Homo Sapiens
KNLLPFNED

SEQ ID NO: 1031776 - protein, 9 aa, Homo Sapiens
PQTTFKKPQ

SEQ ID NO: 1031777 - protein, 9 aa, Homo Sapiens
TVESAVHTF

SEQ ID NO: 1031778 - protein, 9 aa, Homo Sapiens
NKIIDHISC

SEQ ID NO: 1031779 - protein, 9 aa, Homo Sapiens
HANFSSAEK

SEQ ID NO: 1031780 - protein, 9 aa, Homo Sapiens
YSCEPGYNL

SEQ ID NO: 1031781 - protein, 9 aa, Homo Sapiens
HLEFHLCHY

SEQ ID NO: 1031782 - protein, 9 aa, Homo Sapiens
VNSSWFIIQ

SEQ ID NO: 1031783 - protein, 9 aa, Homo Sapiens
SIEEGVIST

SEQ ID NO: 1031784 - protein, 9 aa, Homo Sapiens
TQKDRGPVL

SEQ ID NO: 1031785 - protein, 9 aa, Homo Sapiens
SAEVRRRVL

SEQ ID NO: 1031786 - protein, 9 aa, Homo Sapiens
QQLLLVHQG

SEQ ID NO: 1031787 - protein, 9 aa, Homo Sapiens
YTGEKPYEC

SEQ ID NO: 1031788 - protein, 9 aa, Homo Sapiens
ADYAKHKCT

SEQ ID NO: 1031789 - protein, 9 aa, Homo Sapiens
GADKLENNP

SEQ ID NO: 1031790 - protein, 9 aa, Homo Sapiens
VRPFGGHFQ

SEQ ID NO: 1031791 - protein, 9 aa, Homo Sapiens
HLLIKAAQN

SEQ ID NO: 1031792 - protein, 9 aa, Homo Sapiens
PPRWAQGAS

SEQ ID NO: 1031793 - protein, 9 aa, Homo Sapiens
RIDNLYERV

SEQ ID NO: 1031794 - protein, 9 aa, Homo Sapiens
RYGFSPKEL

SEQ ID NO: 1031795 - protein, 9 aa, Homo Sapiens
LDFSVYKKQ

SEQ ID NO: 1031796 - protein, 9 aa, Homo Sapiens
HARYLIFSN

SEQ ID NO: 1031797 - protein, 9 aa, Homo Sapiens
GLFLTSDAP

SEQ ID NO: 1031798 - protein, 9 aa, Homo Sapiens
ENMDLHTTY

SEQ ID NO: 1031799 - protein, 9 aa, Homo Sapiens
SFPAVLSSV

SEQ ID NO: 1031800 - protein, 9 aa, Homo Sapiens
NIWHRRHDY

SEQ ID NO: 1031801 - protein, 9 aa, Homo Sapiens
GQFVNSKRA

SEQ ID NO: 1031802 - protein, 9 aa, Homo Sapiens
FSFFQRSRD

SEQ ID NO: 1031803 - protein, 9 aa, Homo Sapiens
SGITDDNIT

SEQ ID NO: 1031804 - protein, 9 aa, Homo Sapiens
DGLIICKPV

SEQ ID NO: 1031805 - protein, 9 aa, Homo Sapiens
IEFLVLIFS

SEQ ID NO: 1031806 - protein, 9 aa, Homo Sapiens
PMISWMETS

SEQ ID NO: 1031807 - protein, 9 aa, Homo Sapiens
GEYLDWSHW

SEQ ID NO: 1031808 - protein, 9 aa, Homo Sapiens
IAGTQKKAS

SEQ ID NO: 1031809 - protein, 9 aa, Homo Sapiens
QASTKAHPA

SEQ ID NO: 1031810 - protein, 9 aa, Homo Sapiens
KDSQQALKE

SEQ ID NO: 1031811 - protein, 9 aa, Homo Sapiens
KRGSKASTL

SEQ ID NO: 1031812 - protein, 9 aa, Homo Sapiens
LQQSSDRPD

SEQ ID NO: 1031813 - protein, 9 aa, Homo Sapiens
LSMSKDNMS

SEQ ID NO: 1031814 - protein, 9 aa, Homo Sapiens
SDTKLWYCY

SEQ ID NO: 1031815 - protein, 9 aa, Homo Sapiens
IADLTPLLF

SEQ ID NO: 1031816 - protein, 9 aa, Homo Sapiens
KIRTKGKLD

SEQ ID NO: 1031817 - protein, 9 aa, Homo Sapiens
YYAVDKITI

SEQ ID NO: 1031818 - protein, 9 aa, Homo Sapiens
DNLAKKNRE

SEQ ID NO: 1031819 - protein, 9 aa, Homo Sapiens
EGRCSLDTL

SEQ ID NO: 1031820 - protein, 9 aa, Homo Sapiens
YSVLRNHNQ

SEQ ID NO: 1031821 - protein, 9 aa, Homo Sapiens
HLCLKMIII

SEQ ID NO: 1031822 - protein, 9 aa, Homo Sapiens
SFNLKQNVT

SEQ ID NO: 1031823 - protein, 9 aa, Homo Sapiens
VTAADKNHA

SEQ ID NO: 1031824 - protein, 9 aa, Homo Sapiens
LFLFLFALG

SEQ ID NO: 1031825 - protein, 9 aa, Homo Sapiens
IEDTVSFSI

SEQ ID NO: 1031826 - protein, 9 aa, Homo Sapiens
ELEITSDFQ

SEQ ID NO: 1031827 - protein, 9 aa, Homo Sapiens
LWQKIREDL

SEQ ID NO: 1031828 - protein, 9 aa, Homo Sapiens
DRPHEETRP

SEQ ID NO: 1031829 - protein, 9 aa, Homo Sapiens
LIFEGVDTV

SEQ ID NO: 1031830 - protein, 9 aa, Homo Sapiens
SAPEPDISK

SEQ ID NO: 1031831 - protein, 9 aa, Homo Sapiens
FPGESRPKG

SEQ ID NO: 1031832 - protein, 9 aa, Homo Sapiens
STEMEFDLE

SEQ ID NO: 1031833 - protein, 9 aa, Homo Sapiens
VTRLMKVEQ

SEQ ID NO: 1031834 - protein, 9 aa, Homo Sapiens
LMPSPFQGG

SEQ ID NO: 1031835 - protein, 9 aa, Homo Sapiens
EMADNLAKK

SEQ ID NO: 1031836 - protein, 9 aa, Homo Sapiens
PLSLKNEPK

SEQ ID NO: 1031837 - protein, 9 aa, Homo Sapiens
AISCFYGRV

SEQ ID NO: 1031838 - protein, 9 aa, Homo Sapiens
VESFMQLSY

SEQ ID NO: 1031839 - protein, 9 aa, Homo Sapiens
VIKQLAQVH

SEQ ID NO: 1031840 - protein, 9 aa, Homo Sapiens
ARAKEAAPA

SEQ ID NO: 1031841 - protein, 9 aa, Homo Sapiens
FFPTVFVKK

SEQ ID NO: 1031842 - protein, 9 aa, Homo Sapiens
NSPFVLYLL

SEQ ID NO: 1031843 - protein, 9 aa, Homo Sapiens
EIQVGDSHF

SEQ ID NO: 1031844 - protein, 9 aa, Homo Sapiens
SPASFSFMP

SEQ ID NO: 1031845 - protein, 9 aa, Homo Sapiens
WHIGQPNKA

SEQ ID NO: 1031846 - protein, 9 aa, Homo Sapiens
SADPSPGAS

SEQ ID NO: 1031847 - protein, 9 aa, Homo Sapiens
FDSSSDMKK

SEQ ID NO: 1031848 - protein, 9 aa, Homo Sapiens
LSCEKSNLK

SEQ ID NO: 1031849 - protein, 9 aa, Homo Sapiens
QDTQLPFDD

SEQ ID NO: 1031850 - protein, 9 aa, Homo Sapiens
EKPLEEHLT

SEQ ID NO: 1031851 - protein, 9 aa, Homo Sapiens
SRSGEDRGI

SEQ ID NO: 1031852 - protein, 9 aa, Homo Sapiens
WMLNDILQD

SEQ ID NO: 1031853 - protein, 9 aa, Homo Sapiens
LFSYAVGFV

SEQ ID NO: 1031854 - protein, 9 aa, Homo Sapiens
QRNLLERRG

SEQ ID NO: 1031855 - protein, 9 aa, Homo Sapiens
HLESDYQRS

SEQ ID NO: 1031856 - protein, 9 aa, Homo Sapiens
NREKEEEQK

SEQ ID NO: 1031857 - protein, 9 aa, Homo Sapiens
LQLMGLKKK

SEQ ID NO: 1031858 - protein, 9 aa, Homo Sapiens
TSENNSEHQ

SEQ ID NO: 1031859 - protein, 9 aa, Homo Sapiens
CLDVSANQA

SEQ ID NO: 1031860 - protein, 9 aa, Homo Sapiens
FVTPIDCDE

SEQ ID NO: 1031861 - protein, 9 aa, Homo Sapiens
TIVNLDYPV

SEQ ID NO: 1031862 - protein, 9 aa, Homo Sapiens
RLLDLCGCA

SEQ ID NO: 1031863 - protein, 9 aa, Homo Sapiens
GHRSSTARF

SEQ ID NO: 1031864 - protein, 9 aa, Homo Sapiens
YDSEAASAP

SEQ ID NO: 1031865 - protein, 9 aa, Homo Sapiens
FVNDSGAGE

SEQ ID NO: 1031866 - protein, 9 aa, Homo Sapiens
PVGEVNSQF

SEQ ID NO: 1031867 - protein, 9 aa, Homo Sapiens
AANLLASAP

SEQ ID NO: 1031868 - protein, 9 aa, Homo Sapiens
ESDTGFFDE

SEQ ID NO: 1031869 - protein, 9 aa, Homo Sapiens
RTWPVNGRL

SEQ ID NO: 1031870 - protein, 9 aa, Homo Sapiens
SVNSEAFLL

SEQ ID NO: 1031871 - protein, 9 aa, Homo Sapiens
KRMLLYVRK

SEQ ID NO: 1031872 - protein, 9 aa, Homo Sapiens
EIINSFDED

SEQ ID NO: 1031873 - protein, 9 aa, Homo Sapiens
FMAVFYVFL

SEQ ID NO: 1031874 - protein, 9 aa, Homo Sapiens
GFHQGAPES

SEQ ID NO: 1031875 - protein, 9 aa, Homo Sapiens
QSVWVVKGP

SEQ ID NO: 1031876 - protein, 9 aa, Homo Sapiens
AGISHRTVP

SEQ ID NO: 1031877 - protein, 9 aa, Homo Sapiens
MTEIELSGN

SEQ ID NO: 1031878 - protein, 9 aa, Homo Sapiens
QRIKVLNTL

SEQ ID NO: 1031879 - protein, 9 aa, Homo Sapiens
TESNTVLSK

SEQ ID NO: 1031880 - protein, 9 aa, Homo Sapiens
QKRYAAYFA

SEQ ID NO: 1031881 - protein, 9 aa, Homo Sapiens
NISNEVVFD

SEQ ID NO: 1031882 - protein, 9 aa, Homo Sapiens
VSMTSEIER

SEQ ID NO: 1031883 - protein, 9 aa, Homo Sapiens
PHGGNGTWR

SEQ ID NO: 1031884 - protein, 9 aa, Homo Sapiens
LEEIWSYLM

SEQ ID NO: 1031885 - protein, 9 aa, Homo Sapiens
KFEHKLNVS

SEQ ID NO: 1031886 - protein, 9 aa, Homo Sapiens
NTRVEPPQY

SEQ ID NO: 1031887 - protein, 9 aa, Homo Sapiens
FIPKCYVNI

SEQ ID NO: 1031888 - protein, 9 aa, Homo Sapiens
PTPSHLQAE

SEQ ID NO: 1031889 - protein, 9 aa, Homo Sapiens
GLSNPYVKF

SEQ ID NO: 1031890 - protein, 9 aa, Homo Sapiens
WFQNRRIKW

SEQ ID NO: 1031891 - protein, 9 aa, Homo Sapiens
SHLLNVKAT

SEQ ID NO: 1031892 - protein, 9 aa, Homo Sapiens
DGPDARADA

SEQ ID NO: 1031893 - protein, 9 aa, Homo Sapiens
TRSSVVSGV

SEQ ID NO: 1031894 - protein, 9 aa, Homo Sapiens
TCRMTHLLG

SEQ ID NO: 1031895 - protein, 9 aa, Homo Sapiens
EAISAPDSK

SEQ ID NO: 1031896 - protein, 9 aa, Homo Sapiens
SLILSSYDL

SEQ ID NO: 1031897 - protein, 9 aa, Homo Sapiens
RHRQGKVIS

SEQ ID NO: 1031898 - protein, 9 aa, Homo Sapiens
LKRNLQKLR

SEQ ID NO: 1031899 - protein, 9 aa, Homo Sapiens
PARKNEGEW

SEQ ID NO: 1031900 - protein, 9 aa, Homo Sapiens
NAPDPLHED

SEQ ID NO: 1031901 - protein, 9 aa, Homo Sapiens
GVKDGTASD

SEQ ID NO: 1031902 - protein, 9 aa, Homo Sapiens
KQLGIKLVR

SEQ ID NO: 1031903 - protein, 9 aa, Homo Sapiens
TSRFSLTCM

SEQ ID NO: 1031904 - protein, 9 aa, Homo Sapiens
SPHNSGRPI

SEQ ID NO: 1031905 - protein, 9 aa, Homo Sapiens
KDTMTMDAG

SEQ ID NO: 1031906 - protein, 9 aa, Homo Sapiens
VMPNAIVQF

SEQ ID NO: 1031907 - protein, 9 aa, Homo Sapiens
PGPGQSHAQ

SEQ ID NO: 1031908 - protein, 9 aa, Homo Sapiens
SKDDLKEIP

SEQ ID NO: 1031909 - protein, 9 aa, Homo Sapiens
PHEWTHEEQ

SEQ ID NO: 1031910 - protein, 9 aa, Homo Sapiens
PKIYTDPEV

SEQ ID NO: 1031911 - protein, 9 aa, Homo Sapiens
GSSTPEQDD

SEQ ID NO: 1031912 - protein, 9 aa, Homo Sapiens
KSPASTAAL

SEQ ID NO: 1031913 - protein, 9 aa, Homo Sapiens
HSFPHQPTA

SEQ ID NO: 1031914 - protein, 9 aa, Homo Sapiens
INVFEDYIY

SEQ ID NO: 1031915 - protein, 9 aa, Homo Sapiens
IPSAAEKHK

SEQ ID NO: 1031916 - protein, 9 aa, Homo Sapiens
KFLCEALGC

SEQ ID NO: 1031917 - protein, 9 aa, Homo Sapiens
SRTRLYDTV

SEQ ID NO: 1031918 - protein, 9 aa, Homo Sapiens
QDTFELELV

SEQ ID NO: 1031919 - protein, 9 aa, Homo Sapiens
TVRHSFPHQ

SEQ ID NO: 1031920 - protein, 9 aa, Homo Sapiens
PPDRVFPPL

SEQ ID NO: 1031921 - protein, 9 aa, Homo Sapiens
TRARFKLPS

SEQ ID NO: 1031922 - protein, 9 aa, Homo Sapiens
AKSLESEQA

SEQ ID NO: 1031923 - protein, 9 aa, Homo Sapiens
KLADVIILT

SEQ ID NO: 1031924 - protein, 9 aa, Homo Sapiens
LNRTNNSPG

SEQ ID NO: 1031925 - protein, 9 aa, Homo Sapiens
FQGRSYKTT

SEQ ID NO: 1031926 - protein, 9 aa, Homo Sapiens
IDSLLKNCI

SEQ ID NO: 1031927 - protein, 9 aa, Homo Sapiens
SKKAEAIGK

SEQ ID NO: 1031928 - protein, 9 aa, Homo Sapiens
HQELDCTSE

SEQ ID NO: 1031929 - protein, 9 aa, Homo Sapiens
QGASELEQE

SEQ ID NO: 1031930 - protein, 9 aa, Homo Sapiens
KLETDIFQI

SEQ ID NO: 1031931 - protein, 9 aa, Homo Sapiens
KEREDPPIW

SEQ ID NO: 1031932 - protein, 9 aa, Homo Sapiens
EKYTEPLIL

SEQ ID NO: 1031933 - protein, 9 aa, Homo Sapiens
ILVVLLIVF

SEQ ID NO: 1031934 - protein, 9 aa, Homo Sapiens
ASVLAKSGP

SEQ ID NO: 1031935 - protein, 9 aa, Homo Sapiens
LGCATQKDR

SEQ ID NO: 1031936 - protein, 9 aa, Homo Sapiens
QRDENGEFR

SEQ ID NO: 1031937 - protein, 9 aa, Homo Sapiens
RRDDNPLNA

SEQ ID NO: 1031938 - protein, 9 aa, Homo Sapiens
HGRRKPQIL

SEQ ID NO: 1031939 - protein, 9 aa, Homo Sapiens
KIKNLICET

SEQ ID NO: 1031940 - protein, 9 aa, Homo Sapiens
VASRQKPPS

SEQ ID NO: 1031941 - protein, 9 aa, Homo Sapiens
MYFFLRNFF

SEQ ID NO: 1031942 - protein, 9 aa, Homo Sapiens
AASSGNLKQ

SEQ ID NO: 1031943 - protein, 9 aa, Homo Sapiens
QASLPAAAD

SEQ ID NO: 1031944 - protein, 9 aa, Homo Sapiens
RVQMFVSNG

SEQ ID NO: 1031945 - protein, 9 aa, Homo Sapiens
TKALIEEMG

SEQ ID NO: 1031946 - protein, 9 aa, Homo Sapiens
LFAMFGAGI

SEQ ID NO: 1031947 - protein, 9 aa, Homo Sapiens
QIKAQRGRA

SEQ ID NO: 1031948 - protein, 9 aa, Homo Sapiens
YGNNIKPGM

SEQ ID NO: 1031949 - protein, 9 aa, Homo Sapiens
YAPLSGDPS

SEQ ID NO: 1031950 - protein, 9 aa, Homo Sapiens
PPLKIQLFK

SEQ ID NO: 1031951 - protein, 9 aa, Homo Sapiens
LLNLVHLDA

SEQ ID NO: 1031952 - protein, 9 aa, Homo Sapiens
IQLFKIGPP

SEQ ID NO: 1031953 - protein, 9 aa, Homo Sapiens
QRKTLFKED

SEQ ID NO: 1031954 - protein, 9 aa, Homo Sapiens
GIFVGFFSS

SEQ ID NO: 1031955 - protein, 9 aa, Homo Sapiens
ENFVIFNNT

SEQ ID NO: 1031956 - protein, 9 aa, Homo Sapiens
FHGHPTVEA

SEQ ID NO: 1031957 - protein, 9 aa, Homo Sapiens
APDVFHFTP

SEQ ID NO: 1031958 - protein, 9 aa, Homo Sapiens
FLSSQPLLP

SEQ ID NO: 1031959 - protein, 9 aa, Homo Sapiens
ECQPKKEGS

SEQ ID NO: 1031960 - protein, 9 aa, Homo Sapiens
AVSSGKIYN

SEQ ID NO: 1031961 - protein, 9 aa, Homo Sapiens
VIVTAADKN

SEQ ID NO: 1031962 - protein, 9 aa, Homo Sapiens
GKKMHRALH

SEQ ID NO: 1031963 - protein, 9 aa, Homo Sapiens
YRCDSCGKE

SEQ ID NO: 1031964 - protein, 9 aa, Homo Sapiens
PPGPTEPKG

SEQ ID NO: 1031965 - protein, 9 aa, Homo Sapiens
RKFYEGTAD

SEQ ID NO: 1031966 - protein, 9 aa, Homo Sapiens
CCDEGKRVA

SEQ ID NO: 1031967 - protein, 9 aa, Homo Sapiens
RQLEKKEAL

SEQ ID NO: 1031968 - protein, 9 aa, Homo Sapiens
FSLLTSLSN

SEQ ID NO: 1031969 - protein, 9 aa, Homo Sapiens
KAGDTERTQ

SEQ ID NO: 1031970 - protein, 9 aa, Homo Sapiens
VNRKKKTHS

SEQ ID NO: 1031971 - protein, 9 aa, Homo Sapiens
TVCLRGPKV

SEQ ID NO: 1031972 - protein, 9 aa, Homo Sapiens
GSCTCLRAQ

SEQ ID NO: 1031973 - protein, 9 aa, Homo Sapiens
LHPHEWTHE

SEQ ID NO: 1031974 - protein, 9 aa, Homo Sapiens
LKGSLKMVR

SEQ ID NO: 1031975 - protein, 9 aa, Homo Sapiens
DIFQIQGEM

SEQ ID NO: 1031976 - protein, 9 aa, Homo Sapiens
SASHFHTFW

SEQ ID NO: 1031977 - protein, 9 aa, Homo Sapiens
ARFLKNAMW

SEQ ID NO: 1031978 - protein, 9 aa, Homo Sapiens
EAGDNAAEE

SEQ ID NO: 1031979 - protein, 9 aa, Homo Sapiens
VTNPSHSFA

SEQ ID NO: 1031980 - protein, 9 aa, Homo Sapiens
IQTDIGLIY

SEQ ID NO: 1031981 - protein, 9 aa, Homo Sapiens
SILTEAHQD

SEQ ID NO: 1031982 - protein, 9 aa, Homo Sapiens
CPLSEMHVR

SEQ ID NO: 1031983 - protein, 9 aa, Homo Sapiens
EVQSSAKKV

SEQ ID NO: 1031984 - protein, 9 aa, Homo Sapiens
NMDLHTTYK

SEQ ID NO: 1031985 - protein, 9 aa, Homo Sapiens
NIIGDIATS

SEQ ID NO: 1031986 - protein, 9 aa, Homo Sapiens
FNLGRGLER

SEQ ID NO: 1031987 - protein, 9 aa, Homo Sapiens
LAQEVAQKR

SEQ ID NO: 1031988 - protein, 9 aa, Homo Sapiens
PSGKVCVRK

SEQ ID NO: 1031989 - protein, 9 aa, Homo Sapiens
PEGPKSRGG

SEQ ID NO: 1031990 - protein, 9 aa, Homo Sapiens
GSNKRGDNQ

SEQ ID NO: 1031991 - protein, 9 aa, Homo Sapiens
IRDSAKCIW

SEQ ID NO: 1031992 - protein, 9 aa, Homo Sapiens
LQSSSCGYP

SEQ ID NO: 1031993 - protein, 9 aa, Homo Sapiens
IGVVIYTEK

SEQ ID NO: 1031994 - protein, 9 aa, Homo Sapiens
SGWFIAVSS

SEQ ID NO: 1031995 - protein, 9 aa, Homo Sapiens
INPSVISCL

SEQ ID NO: 1031996 - protein, 9 aa, Homo Sapiens
TSSTRHSFF

SEQ ID NO: 1031997 - protein, 9 aa, Homo Sapiens
KVTQLRHGV

SEQ ID NO: 1031998 - protein, 9 aa, Homo Sapiens
NWINPLMRW

SEQ ID NO: 1031999 - protein, 9 aa, Homo Sapiens
MTMDAGRAN

SEQ ID NO: 1032000 - protein, 9 aa, Homo Sapiens
YLSPPSSAH

SEQ ID NO: 1032001 - protein, 9 aa, Homo Sapiens
LGLSSLLWK

SEQ ID NO: 1032002 - protein, 9 aa, Homo Sapiens
NSQEAYQEA

SEQ ID NO: 1032003 - protein, 9 aa, Homo Sapiens
LKVMKRQVE

SEQ ID NO: 1032004 - protein, 9 aa, Homo Sapiens
QDPDFILFN

SEQ ID NO: 1032005 - protein, 9 aa, Homo Sapiens
PQSTHHSLR

SEQ ID NO: 1032006 - protein, 9 aa, Homo Sapiens
KQQFSFHSA

SEQ ID NO: 1032007 - protein, 9 aa, Homo Sapiens
QDGKDLFTQ

SEQ ID NO: 1032008 - protein, 9 aa, Homo Sapiens
RAPLPEDCT

SEQ ID NO: 1032009 - protein, 9 aa, Homo Sapiens
KESPQKAKR

SEQ ID NO: 1032010 - protein, 9 aa, Homo Sapiens
VLRLLNEDH

SEQ ID NO: 1032011 - protein, 9 aa, Homo Sapiens
ICLKAGTWR

SEQ ID NO: 1032012 - protein, 9 aa, Homo Sapiens
PQGPSLFTL

SEQ ID NO: 1032013 - protein, 9 aa, Homo Sapiens
RDFARDDMN

SEQ ID NO: 1032014 - protein, 9 aa, Homo Sapiens
NALHRSGQI

SEQ ID NO: 1032015 - protein, 9 aa, Homo Sapiens
WAPLAGCST

SEQ ID NO: 1032016 - protein, 9 aa, Homo Sapiens
LLEAEECKV

SEQ ID NO: 1032017 - protein, 9 aa, Homo Sapiens
HSPQQEEKN

SEQ ID NO: 1032018 - protein, 9 aa, Homo Sapiens
TVKSEHKTF

SEQ ID NO: 1032019 - protein, 9 aa, Homo Sapiens
RRHQKIKNL

SEQ ID NO: 1032020 - protein, 9 aa, Homo Sapiens
SKEEQERLE

SEQ ID NO: 1032021 - protein, 9 aa, Homo Sapiens
MFATLSSLQ

SEQ ID NO: 1032022 - protein, 9 aa, Homo Sapiens
TLERPMYAV

SEQ ID NO: 1032023 - protein, 9 aa, Homo Sapiens
CERLIKSKI

SEQ ID NO: 1032024 - protein, 9 aa, Homo Sapiens
EKKHFRSGR

SEQ ID NO: 1032025 - protein, 9 aa, Homo Sapiens
VFNEHSAFR

SEQ ID NO: 1032026 - protein, 9 aa, Homo Sapiens
VCQKNCPER

SEQ ID NO: 1032027 - protein, 9 aa, Homo Sapiens
RASPAVALP

SEQ ID NO: 1032028 - protein, 9 aa, Homo Sapiens
SSPARKNEG

SEQ ID NO: 1032029 - protein, 9 aa, Homo Sapiens
SFMQLSYRA

SEQ ID NO: 1032030 - protein, 9 aa, Homo Sapiens
NSALASDFI

SEQ ID NO: 1032031 - protein, 9 aa, Homo Sapiens
DLQRMFSTP

SEQ ID NO: 1032032 - protein, 9 aa, Homo Sapiens
KTPSQKRYA

SEQ ID NO: 1032033 - protein, 9 aa, Homo Sapiens
INRLTRRAS

SEQ ID NO: 1032034 - protein, 9 aa, Homo Sapiens
PPAAFSGFT

SEQ ID NO: 1032035 - protein, 9 aa, Homo Sapiens
KKTVWQLPM

SEQ ID NO: 1032036 - protein, 9 aa, Homo Sapiens
AALTRTAAR

SEQ ID NO: 1032037 - protein, 9 aa, Homo Sapiens
CSLSEEDLN

SEQ ID NO: 1032038 - protein, 9 aa, Homo Sapiens
CDCIIGSKK

SEQ ID NO: 1032039 - protein, 9 aa, Homo Sapiens
LSILTEAHQ

SEQ ID NO: 1032040 - protein, 9 aa, Homo Sapiens
KDRQEMPYI

SEQ ID NO: 1032041 - protein, 9 aa, Homo Sapiens
DFESARQFC

SEQ ID NO: 1032042 - protein, 9 aa, Homo Sapiens
IMQILRILK

SEQ ID NO: 1032043 - protein, 9 aa, Homo Sapiens
IKAAQNEDV

SEQ ID NO: 1032044 - protein, 9 aa, Homo Sapiens
LTLARRDDN

SEQ ID NO: 1032045 - protein, 9 aa, Homo Sapiens
VLKCNISDL

SEQ ID NO: 1032046 - protein, 9 aa, Homo Sapiens
RYAAYFAQV

SEQ ID NO: 1032047 - protein, 9 aa, Homo Sapiens
IQLVTQLML

SEQ ID NO: 1032048 - protein, 9 aa, Homo Sapiens
TEAEVQLFY

SEQ ID NO: 1032049 - protein, 9 aa, Homo Sapiens
KIHCGQLEK

SEQ ID NO: 1032050 - protein, 9 aa, Homo Sapiens
VKEEGFAEE

SEQ ID NO: 1032051 - protein, 9 aa, Homo Sapiens
QTFRVLRAL

SEQ ID NO: 1032052 - protein, 9 aa, Homo Sapiens
KRSILISRR

SEQ ID NO: 1032053 - protein, 9 aa, Homo Sapiens
CLRGQHWLL

SEQ ID NO: 1032054 - protein, 9 aa, Homo Sapiens
DEVSYVLGI

SEQ ID NO: 1032055 - protein, 9 aa, Homo Sapiens
VGYAVGLSN

SEQ ID NO: 1032056 - protein, 9 aa, Homo Sapiens
SPMARICLS

SEQ ID NO: 1032057 - protein, 9 aa, Homo Sapiens
TQKKASTGK

SEQ ID NO: 1032058 - protein, 9 aa, Homo Sapiens
DLVTRLMKV

SEQ ID NO: 1032059 - protein, 9 aa, Homo Sapiens
PRNYKLRED

SEQ ID NO: 1032060 - protein, 9 aa, Homo Sapiens
KGNGSGSRE

SEQ ID NO: 1032061 - protein, 9 aa, Homo Sapiens
AEYKYQLTV

SEQ ID NO: 1032062 - protein, 9 aa, Homo Sapiens
GEGAADAAG

SEQ ID NO: 1032063 - protein, 9 aa, Homo Sapiens
DLEEKLSAS

SEQ ID NO: 1032064 - protein, 9 aa, Homo Sapiens
FHLCHYLDQ

SEQ ID NO: 1032065 - protein, 9 aa, Homo Sapiens
GLTGVKIEL

SEQ ID NO: 1032066 - protein, 9 aa, Homo Sapiens
DLKQTCRMT

SEQ ID NO: 1032067 - protein, 9 aa, Homo Sapiens
PRWAQGASE

SEQ ID NO: 1032068 - protein, 9 aa, Homo Sapiens
SVSVQFRQV

SEQ ID NO: 1032069 - protein, 9 aa, Homo Sapiens
IWPDRKILA

SEQ ID NO: 1032070 - protein, 9 aa, Homo Sapiens
NMAVLLAGD

SEQ ID NO: 1032071 - protein, 9 aa, Homo Sapiens
SFRGADYFL

SEQ ID NO: 1032072 - protein, 9 aa, Homo Sapiens
IFVRLHTNR

SEQ ID NO: 1032073 - protein, 9 aa, Homo Sapiens
VFGSDILIP

SEQ ID NO: 1032074 - protein, 9 aa, Homo Sapiens
GSRSLVGLE

SEQ ID NO: 1032075 - protein, 9 aa, Homo Sapiens
KFEEAKSWV

SEQ ID NO: 1032076 - protein, 9 aa, Homo Sapiens
SRPSFCRTP

SEQ ID NO: 1032077 - protein, 9 aa, Homo Sapiens
IKNSLLKQT

SEQ ID NO: 1032078 - protein, 9 aa, Homo Sapiens
SSFATLPPP

SEQ ID NO: 1032079 - protein, 9 aa, Homo Sapiens
ELTTVMRFL

SEQ ID NO: 1032080 - protein, 9 aa, Homo Sapiens
SHPLPSKIQ

SEQ ID NO: 1032081 - protein, 9 aa, Homo Sapiens
TDIYEKKFE

SEQ ID NO: 1032082 - protein, 9 aa, Homo Sapiens
ETLSVKVPD

SEQ ID NO: 1032083 - protein, 9 aa, Homo Sapiens
HYATNSWDG

SEQ ID NO: 1032084 - protein, 9 aa, Homo Sapiens
PGPTEPKGI

SEQ ID NO: 1032085 - protein, 9 aa, Homo Sapiens
CLHSHGLQD

SEQ ID NO: 1032086 - protein, 9 aa, Homo Sapiens
THSQELMKK

SEQ ID NO: 1032087 - protein, 9 aa, Homo Sapiens
VDSVTHTTV

SEQ ID NO: 1032088 - protein, 9 aa, Homo Sapiens
LKPVSGGLA

SEQ ID NO: 1032089 - protein, 9 aa, Homo Sapiens
DFIGLQKTL

SEQ ID NO: 1032090 - protein, 9 aa, Homo Sapiens
TVVAVFEIS

SEQ ID NO: 1032091 - protein, 9 aa, Homo Sapiens
LTESLRDFS

SEQ ID NO: 1032092 - protein, 9 aa, Homo Sapiens
NIKYRDNTK

SEQ ID NO: 1032093 - protein, 9 aa, Homo Sapiens
ARGGAECPA

SEQ ID NO: 1032094 - protein, 9 aa, Homo Sapiens
STDLENDED

SEQ ID NO: 1032095 - protein, 9 aa, Homo Sapiens
FSGRPLDRL

SEQ ID NO: 1032096 - protein, 9 aa, Homo Sapiens
LVATTMFIL

SEQ ID NO: 1032097 - protein, 9 aa, Homo Sapiens
PSVKGKIHL

SEQ ID NO: 1032098 - protein, 9 aa, Homo Sapiens
RDDGVPPLG

SEQ ID NO: 1032099 - protein, 9 aa, Homo Sapiens
GGFAKSVFF

SEQ ID NO: 1032100 - protein, 9 aa, Homo Sapiens
KNSLLKQTW

SEQ ID NO: 1032101 - protein, 9 aa, Homo Sapiens
GEVPGSSAH

SEQ ID NO: 1032102 - protein, 9 aa, Homo Sapiens
DFVANKLGS

SEQ ID NO: 1032103 - protein, 9 aa, Homo Sapiens
RGANAFEII

SEQ ID NO: 1032104 - protein, 9 aa, Homo Sapiens
VMLFFGACC

SEQ ID NO: 1032105 - protein, 9 aa, Homo Sapiens
ADVFSSVPV

SEQ ID NO: 1032106 - protein, 9 aa, Homo Sapiens
EAEECKVDI

SEQ ID NO: 1032107 - protein, 9 aa, Homo Sapiens
EDYFIDLPR

SEQ ID NO: 1032108 - protein, 9 aa, Homo Sapiens
QQPQAPLAG

SEQ ID NO: 1032109 - protein, 9 aa, Homo Sapiens
DQDLNRAEN

SEQ ID NO: 1032110 - protein, 9 aa, Homo Sapiens
SHKDFFTSK

SEQ ID NO: 1032111 - protein, 9 aa, Homo Sapiens
YEIFQIFYG

SEQ ID NO: 1032112 - protein, 9 aa, Homo Sapiens
EGDGPCLTP

SEQ ID NO: 1032113 - protein, 9 aa, Homo Sapiens
SSSPHLLSF

SEQ ID NO: 1032114 - protein, 9 aa, Homo Sapiens
SVKLVVQYT

SEQ ID NO: 1032115 - protein, 9 aa, Homo Sapiens
VNAPFLSFL

SEQ ID NO: 1032116 - protein, 9 aa, Homo Sapiens
LFVAGCRKF

SEQ ID NO: 1032117 - protein, 9 aa, Homo Sapiens
KRSPTPPGP

SEQ ID NO: 1032118 - protein, 9 aa, Homo Sapiens
WLSTECDFH

SEQ ID NO: 1032119 - protein, 9 aa, Homo Sapiens
LSSLLWKER

SEQ ID NO: 1032120 - protein, 9 aa, Homo Sapiens
FVKKKHYLT

SEQ ID NO: 1032121 - protein, 9 aa, Homo Sapiens
DPHVATRVM

SEQ ID NO: 1032122 - protein, 9 aa, Homo Sapiens
IALTIARAV

SEQ ID NO: 1032123 - protein, 9 aa, Homo Sapiens
NGRLTAPQA

SEQ ID NO: 1032124 - protein, 9 aa, Homo Sapiens
GPSLFTLRA

SEQ ID NO: 1032125 - protein, 9 aa, Homo Sapiens
LYKLVQLIQ

SEQ ID NO: 1032126 - protein, 9 aa, Homo Sapiens
TGEVEPRGF

SEQ ID NO: 1032127 - protein, 9 aa, Homo Sapiens
LERELGSMS

SEQ ID NO: 1032128 - protein, 9 aa, Homo Sapiens
IQALQEKIS

SEQ ID NO: 1032129 - protein, 9 aa, Homo Sapiens
AEEAGVPGG

SEQ ID NO: 1032130 - protein, 9 aa, Homo Sapiens
KEQQIYTEQ

SEQ ID NO: 1032131 - protein, 9 aa, Homo Sapiens
IHLQAYHTQ

SEQ ID NO: 1032132 - protein, 9 aa, Homo Sapiens
LFCERNKIN

SEQ ID NO: 1032133 - protein, 9 aa, Homo Sapiens
LSSVVFWRL

SEQ ID NO: 1032134 - protein, 9 aa, Homo Sapiens
GFGQCLCET

SEQ ID NO: 1032135 - protein, 9 aa, Homo Sapiens
AAFGVQGLG

SEQ ID NO: 1032136 - protein, 9 aa, Homo Sapiens
RLGALTGHW

SEQ ID NO: 1032137 - protein, 9 aa, Homo Sapiens
GESRPKGEI

SEQ ID NO: 1032138 - protein, 9 aa, Homo Sapiens
LKMEVEWTS

SEQ ID NO: 1032139 - protein, 9 aa, Homo Sapiens
ARGVLKCNI

SEQ ID NO: 1032140 - protein, 9 aa, Homo Sapiens
EEKALLQRI

SEQ ID NO: 1032141 - protein, 9 aa, Homo Sapiens
TTMDYRANI

SEQ ID NO: 1032142 - protein, 9 aa, Homo Sapiens
AQNMNHEYM

SEQ ID NO: 1032143 - protein, 9 aa, Homo Sapiens
QLGQTHKPD

SEQ ID NO: 1032144 - protein, 9 aa, Homo Sapiens
NRAVFWIEF

SEQ ID NO: 1032145 - protein, 9 aa, Homo Sapiens
SSENVSTHA

SEQ ID NO: 1032146 - protein, 9 aa, Homo Sapiens
TRLCNLVFS

SEQ ID NO: 1032147 - protein, 9 aa, Homo Sapiens
GGLDRGTTF

SEQ ID NO: 1032148 - protein, 9 aa, Homo Sapiens
IATRVVSSF

SEQ ID NO: 1032149 - protein, 9 aa, Homo Sapiens
HTDQIRKFQ

SEQ ID NO: 1032150 - protein, 9 aa, Homo Sapiens
HENIFSSPR

SEQ ID NO: 1032151 - protein, 9 aa, Homo Sapiens
PSLSAPKGC

SEQ ID NO: 1032152 - protein, 9 aa, Homo Sapiens
IEQQKTIKT

SEQ ID NO: 1032153 - protein, 9 aa, Homo Sapiens
MMAEQTLSR

SEQ ID NO: 1032154 - protein, 9 aa, Homo Sapiens
FISSTKGMF

SEQ ID NO: 1032155 - protein, 9 aa, Homo Sapiens
FGFFTDAQN

SEQ ID NO: 1032156 - protein, 9 aa, Homo Sapiens
KNQCLNCPD

SEQ ID NO: 1032157 - protein, 9 aa, Homo Sapiens
LMLAIPAMA

SEQ ID NO: 1032158 - protein, 9 aa, Homo Sapiens
AIYRFNVIS

SEQ ID NO: 1032159 - protein, 9 aa, Homo Sapiens
YDHQRKQEL

SEQ ID NO: 1032160 - protein, 9 aa, Homo Sapiens
PHEETRPVR

SEQ ID NO: 1032161 - protein, 9 aa, Homo Sapiens
LFMDCGSDG

SEQ ID NO: 1032162 - protein, 9 aa, Homo Sapiens
VSSFNSAHD

SEQ ID NO: 1032163 - protein, 9 aa, Homo Sapiens
TALPAVAPS

SEQ ID NO: 1032164 - protein, 9 aa, Homo Sapiens
IENLLVIVF

SEQ ID NO: 1032165 - protein, 9 aa, Homo Sapiens
TGTQPPEKM

SEQ ID NO: 1032166 - protein, 9 aa, Homo Sapiens
LSVKVPLQR

SEQ ID NO: 1032167 - protein, 9 aa, Homo Sapiens
GADFMESFE

SEQ ID NO: 1032168 - protein, 9 aa, Homo Sapiens
SRIDRHRVM

SEQ ID NO: 1032169 - protein, 9 aa, Homo Sapiens
QMPQVPNKI

SEQ ID NO: 1032170 - protein, 9 aa, Homo Sapiens
ESPKAGEDG

SEQ ID NO: 1032171 - protein, 9 aa, Homo Sapiens
NFCNKIEDY

SEQ ID NO: 1032172 - protein, 9 aa, Homo Sapiens
INRKYKDHL

SEQ ID NO: 1032173 - protein, 9 aa, Homo Sapiens
GAPREATSF

SEQ ID NO: 1032174 - protein, 9 aa, Homo Sapiens
LSPLLARRG

SEQ ID NO: 1032175 - protein, 9 aa, Homo Sapiens
QNELLVFLQ

SEQ ID NO: 1032176 - protein, 9 aa, Homo Sapiens
EKITLCIFV

SEQ ID NO: 1032177 - protein, 9 aa, Homo Sapiens
SRALSPDMD

SEQ ID NO: 1032178 - protein, 9 aa, Homo Sapiens
VDSVHNLLR

SEQ ID NO: 1032179 - protein, 9 aa, Homo Sapiens
KVTPGLTCA

SEQ ID NO: 1032180 - protein, 9 aa, Homo Sapiens
ILKKKFDKG

SEQ ID NO: 1032181 - protein, 9 aa, Homo Sapiens
KRERGVPGE

SEQ ID NO: 1032182 - protein, 9 aa, Homo Sapiens
PKPRSRRTA

SEQ ID NO: 1032183 - protein, 9 aa, Homo Sapiens
YPSELIFVS

SEQ ID NO: 1032184 - protein, 9 aa, Homo Sapiens
LTFSSAVTN

SEQ ID NO: 1032185 - protein, 9 aa, Homo Sapiens
YVGWADKYH

SEQ ID NO: 1032186 - protein, 9 aa, Homo Sapiens
ITEKKHFRS

SEQ ID NO: 1032187 - protein, 9 aa, Homo Sapiens
PEEDSPWGP

SEQ ID NO: 1032188 - protein, 9 aa, Homo Sapiens
KPFKLHPRL

SEQ ID NO: 1032189 - protein, 9 aa, Homo Sapiens
RLVKGLDPS

SEQ ID NO: 1032190 - protein, 9 aa, Homo Sapiens
SMPMEIGTL

SEQ ID NO: 1032191 - protein, 9 aa, Homo Sapiens
RARRTDPGP

SEQ ID NO: 1032192 - protein, 9 aa, Homo Sapiens
VGIVIFLVC

SEQ ID NO: 1032193 - protein, 9 aa, Homo Sapiens
GYGPSNGPS

SEQ ID NO: 1032194 - protein, 9 aa, Homo Sapiens
LGFSSPCPS

SEQ ID NO: 1032195 - protein, 9 aa, Homo Sapiens
EQVLAVISK

SEQ ID NO: 1032196 - protein, 9 aa, Homo Sapiens
TPFPVTDTS

SEQ ID NO: 1032197 - protein, 9 aa, Homo Sapiens
PPQPPQASL

SEQ ID NO: 1032198 - protein, 9 aa, Homo Sapiens
HNKLPGEGI

SEQ ID NO: 1032199 - protein, 9 aa, Homo Sapiens
SPRINEKAG

SEQ ID NO: 1032200 - protein, 9 aa, Homo Sapiens
HTRVKSYIC

SEQ ID NO: 1032201 - protein, 9 aa, Homo Sapiens
FPPTPTCEA

SEQ ID NO: 1032202 - protein, 9 aa, Homo Sapiens
RERWQIKAQ

SEQ ID NO: 1032203 - protein, 9 aa, Homo Sapiens
EQRSLSAFS

SEQ ID NO: 1032204 - protein, 9 aa, Homo Sapiens
KVKVDGPEL

SEQ ID NO: 1032205 - protein, 9 aa, Homo Sapiens
PEKTRSSRR

SEQ ID NO: 1032206 - protein, 9 aa, Homo Sapiens
LIQCLLKKF

SEQ ID NO: 1032207 - protein, 9 aa, Homo Sapiens
KCSRQYNST

SEQ ID NO: 1032208 - protein, 9 aa, Homo Sapiens
RGQHWLLGA

SEQ ID NO: 1032209 - protein, 9 aa, Homo Sapiens
ERKVFPEIQ

SEQ ID NO: 1032210 - protein, 9 aa, Homo Sapiens
AKIQLAVCQ

SEQ ID NO: 1032211 - protein, 9 aa, Homo Sapiens
KKKRKKSRP

SEQ ID NO: 1032212 - protein, 9 aa, Homo Sapiens
KQGGGGGEG

SEQ ID NO: 1032213 - protein, 9 aa, Homo Sapiens
YFLCFCASL

SEQ ID NO: 1032214 - protein, 9 aa, Homo Sapiens
SNQDGGKSK

SEQ ID NO: 1032215 - protein, 9 aa, Homo Sapiens
TCPLVSIPS

SEQ ID NO: 1032216 - protein, 9 aa, Homo Sapiens
PAGTGGPAS

SEQ ID NO: 1032217 - protein, 9 aa, Homo Sapiens
TDLSIQLSS

SEQ ID NO: 1032218 - protein, 9 aa, Homo Sapiens
AGEKLVEVY

SEQ ID NO: 1032219 - protein, 9 aa, Homo Sapiens
LPPSAVTKI

SEQ ID NO: 1032220 - protein, 9 aa, Homo Sapiens
DICSSEVSW

SEQ ID NO: 1032221 - protein, 9 aa, Homo Sapiens
AGCDCIIGS

SEQ ID NO: 1032222 - protein, 9 aa, Homo Sapiens
PALRPAPGH

SEQ ID NO: 1032223 - protein, 9 aa, Homo Sapiens
PQWRELSDF

SEQ ID NO: 1032224 - protein, 9 aa, Homo Sapiens
KYADSSGAS

SEQ ID NO: 1032225 - protein, 9 aa, Homo Sapiens
PYETITFKV

SEQ ID NO: 1032226 - protein, 9 aa, Homo Sapiens
DENGEFRLL

SEQ ID NO: 1032227 - protein, 9 aa, Homo Sapiens
ELWSKTSSL

SEQ ID NO: 1032228 - protein, 9 aa, Homo Sapiens
KKEMKISEL

SEQ ID NO: 1032229 - protein, 9 aa, Homo Sapiens
GKMAAMIEV

SEQ ID NO: 1032230 - protein, 9 aa, Homo Sapiens
ILIRGPQAF

SEQ ID NO: 1032231 - protein, 9 aa, Homo Sapiens
LVLGGEDQW

SEQ ID NO: 1032232 - protein, 9 aa, Homo Sapiens
YGRVIVCDN

SEQ ID NO: 1032233 - protein, 9 aa, Homo Sapiens
EEAVEFCCQ

SEQ ID NO: 1032234 - protein, 9 aa, Homo Sapiens
TSELPLRNL

SEQ ID NO: 1032235 - protein, 9 aa, Homo Sapiens
KVKKMFPHR

SEQ ID NO: 1032236 - protein, 9 aa, Homo Sapiens
DQAPAEASP

SEQ ID NO: 1032237 - protein, 9 aa, Homo Sapiens
KHQKIFKLH

SEQ ID NO: 1032238 - protein, 9 aa, Homo Sapiens
FSFFFDGWE

SEQ ID NO: 1032239 - protein, 9 aa, Homo Sapiens
HVTSKFFLE

SEQ ID NO: 1032240 - protein, 9 aa, Homo Sapiens
NGLSNPYVK

SEQ ID NO: 1032241 - protein, 9 aa, Homo Sapiens
QKGAQDGGV

SEQ ID NO: 1032242 - protein, 9 aa, Homo Sapiens
AFDCYVAIC

SEQ ID NO: 1032243 - protein, 9 aa, Homo Sapiens
PVAPSAVSP

SEQ ID NO: 1032244 - protein, 9 aa, Homo Sapiens
KLRAGQFTG

SEQ ID NO: 1032245 - protein, 9 aa, Homo Sapiens
KGPWGGWGA

SEQ ID NO: 1032246 - protein, 9 aa, Homo Sapiens
MFKKHQLSV

SEQ ID NO: 1032247 - protein, 9 aa, Homo Sapiens
CHTTSRSGH

SEQ ID NO: 1032248 - protein, 9 aa, Homo Sapiens
YKIQRKTLF

SEQ ID NO: 1032249 - protein, 9 aa, Homo Sapiens
RCSLDTLFS

SEQ ID NO: 1032250 - protein, 9 aa, Homo Sapiens
LDPSVLPYD

SEQ ID NO: 1032251 - protein, 9 aa, Homo Sapiens
RNGQSRTIR

SEQ ID NO: 1032252 - protein, 9 aa, Homo Sapiens
FPDCVPCNC

SEQ ID NO: 1032253 - protein, 9 aa, Homo Sapiens
PRYSSFGDA

SEQ ID NO: 1032254 - protein, 9 aa, Homo Sapiens
VKISFSPGS

SEQ ID NO: 1032255 - protein, 9 aa, Homo Sapiens
VSCLQAMSS

SEQ ID NO: 1032256 - protein, 9 aa, Homo Sapiens
EAQVATHTL

SEQ ID NO: 1032257 - protein, 9 aa, Homo Sapiens
EECDTDRDG

SEQ ID NO: 1032258 - protein, 9 aa, Homo Sapiens
KQIFSSLDK

SEQ ID NO: 1032259 - protein, 9 aa, Homo Sapiens
YETQWPSRE

SEQ ID NO: 1032260 - protein, 9 aa, Homo Sapiens
LAEDAVFVL

SEQ ID NO: 1032261 - protein, 9 aa, Homo Sapiens
KAVEVPLKN

SEQ ID NO: 1032262 - protein, 9 aa, Homo Sapiens
HTPAKIQLS

SEQ ID NO: 1032263 - protein, 9 aa, Homo Sapiens
GEEKVDAIF

SEQ ID NO: 1032264 - protein, 9 aa, Homo Sapiens
YKLREDARD

SEQ ID NO: 1032265 - protein, 9 aa, Homo Sapiens
CSLKTHSLE

SEQ ID NO: 1032266 - protein, 9 aa, Homo Sapiens
CRHIEAKRA

SEQ ID NO: 1032267 - protein, 9 aa, Homo Sapiens
PSAIPNNSD

SEQ ID NO: 1032268 - protein, 9 aa, Homo Sapiens
GKDDIVELW

SEQ ID NO: 1032269 - protein, 9 aa, Homo Sapiens
LMGTPVLRD

SEQ ID NO: 1032270 - protein, 9 aa, Homo Sapiens
IVNATNPDL

SEQ ID NO: 1032271 - protein, 9 aa, Homo Sapiens
FKSAVRDSW

SEQ ID NO: 1032272 - protein, 9 aa, Homo Sapiens
EVEEESLMN

SEQ ID NO: 1032273 - protein, 9 aa, Homo Sapiens
YRWDLTLSP

SEQ ID NO: 1032274 - protein, 9 aa, Homo Sapiens
EAFLASDPH

SEQ ID NO: 1032275 - protein, 9 aa, Homo Sapiens
ESGGLGRIS

SEQ ID NO: 1032276 - protein, 9 aa, Homo Sapiens
MLLFQYRYA

SEQ ID NO: 1032277 - protein, 9 aa, Homo Sapiens
ALVCAYDSE

SEQ ID NO: 1032278 - protein, 9 aa, Homo Sapiens
SVWVVKGPK

SEQ ID NO: 1032279 - protein, 9 aa, Homo Sapiens
IEVEHCHSE

SEQ ID NO: 1032280 - protein, 9 aa, Homo Sapiens
ERLIFSGHQ

SEQ ID NO: 1032281 - protein, 9 aa, Homo Sapiens
FLFLFALGC

SEQ ID NO: 1032282 - protein, 9 aa, Homo Sapiens
KRKKSRPES

SEQ ID NO: 1032283 - protein, 9 aa, Homo Sapiens
ETERNDKEQ

SEQ ID NO: 1032284 - protein, 9 aa, Homo Sapiens
VDITEGDKK

SEQ ID NO: 1032285 - protein, 9 aa, Homo Sapiens
FSGWFIAVS

SEQ ID NO: 1032286 - protein, 9 aa, Homo Sapiens
RQGVNMLPL

SEQ ID NO: 1032287 - protein, 9 aa, Homo Sapiens
DGSTCDAID

SEQ ID NO: 1032288 - protein, 9 aa, Homo Sapiens
NLQKAFSKA

SEQ ID NO: 1032289 - protein, 9 aa, Homo Sapiens
RQERQGVNM

SEQ ID NO: 1032290 - protein, 9 aa, Homo Sapiens
KHKETKPQG

SEQ ID NO: 1032291 - protein, 9 aa, Homo Sapiens
TFSEIGKKF

SEQ ID NO: 1032292 - protein, 9 aa, Homo Sapiens
IDGIGKMEL

SEQ ID NO: 1032293 - protein, 9 aa, Homo Sapiens
KDTLKQHGT

SEQ ID NO: 1032294 - protein, 9 aa, Homo Sapiens
DSGPPGIPG

SEQ ID NO: 1032295 - protein, 9 aa, Homo Sapiens
LHLTSVTSE

SEQ ID NO: 1032296 - protein, 9 aa, Homo Sapiens
SEEEGKALK

SEQ ID NO: 1032297 - protein, 9 aa, Homo Sapiens
GQETRKQQE

SEQ ID NO: 1032298 - protein, 9 aa, Homo Sapiens
TFDCSTKVL

SEQ ID NO: 1032299 - protein, 8 aa, Homo Sapiens
QIPVASTP

SEQ ID NO: 1032300 - protein, 9 aa, Homo Sapiens
GGGGGEGSV

SEQ ID NO: 1032301 - protein, 9 aa, Homo Sapiens
EHQVIGYRN

SEQ ID NO: 1032302 - protein, 9 aa, Homo Sapiens
TESLHIVFS

SEQ ID NO: 1032303 - protein, 9 aa, Homo Sapiens
AAVKQFLQV

SEQ ID NO: 1032304 - protein, 9 aa, Homo Sapiens
SGSSSWHGG

SEQ ID NO: 1032305 - protein, 9 aa, Homo Sapiens
AQMSVFHQE

SEQ ID NO: 1032306 - protein, 9 aa, Homo Sapiens
EDARDPRIP

SEQ ID NO: 1032307 - protein, 9 aa, Homo Sapiens
PGAKGKPAV

SEQ ID NO: 1032308 - protein, 9 aa, Homo Sapiens
DQLSLRLKV

SEQ ID NO: 1032309 - protein, 9 aa, Homo Sapiens
DYRANIFLR

SEQ ID NO: 1032310 - protein, 9 aa, Homo Sapiens
HICLMDHLK

SEQ ID NO: 1032311 - protein, 9 aa, Homo Sapiens
LQSLASSGY

SEQ ID NO: 1032312 - protein, 9 aa, Homo Sapiens
FLVCLAICI

SEQ ID NO: 1032313 - protein, 9 aa, Homo Sapiens
TFKKPQSLE

SEQ ID NO: 1032314 - protein, 9 aa, Homo Sapiens
ICLATFPDV

SEQ ID NO: 1032315 - protein, 9 aa, Homo Sapiens
VNGSCVKIS

SEQ ID NO: 1032316 - protein, 9 aa, Homo Sapiens
DDGITGFGQ

SEQ ID NO: 1032317 - protein, 9 aa, Homo Sapiens
FVRLHTNRS

SEQ ID NO: 1032318 - protein, 9 aa, Homo Sapiens
FIIDENTGN

SEQ ID NO: 1032319 - protein, 9 aa, Homo Sapiens
GFSSPCPSI

SEQ ID NO: 1032320 - protein, 9 aa, Homo Sapiens
ASSPHPRGL

SEQ ID NO: 1032321 - protein, 9 aa, Homo Sapiens
CHRGSFFLG

SEQ ID NO: 1032322 - protein, 9 aa, Homo Sapiens
PNAIVQFVG

SEQ ID NO: 1032323 - protein, 9 aa, Homo Sapiens
KMSLTTEQR

SEQ ID NO: 1032324 - protein, 9 aa, Homo Sapiens
SLRDFSAMS

SEQ ID NO: 1032325 - protein, 9 aa, Homo Sapiens
KKYQKTLKK

SEQ ID NO: 1032326 - protein, 9 aa, Homo Sapiens
AVNTATEIK

SEQ ID NO: 1032327 - protein, 9 aa, Homo Sapiens
KHRLAEWGR

SEQ ID NO: 1032328 - protein, 9 aa, Homo Sapiens
RLLSSSERI

SEQ ID NO: 1032329 - protein, 9 aa, Homo Sapiens
QPPVPSLPS

SEQ ID NO: 1032330 - protein, 9 aa, Homo Sapiens
TEKKHFRSG

SEQ ID NO: 1032331 - protein, 9 aa, Homo Sapiens
LLVHQGETE

SEQ ID NO: 1032332 - protein, 9 aa, Homo Sapiens
NGNQTFSGT

SEQ ID NO: 1032333 - protein, 9 aa, Homo Sapiens
TWESLTILA

SEQ ID NO: 1032334 - protein, 9 aa, Homo Sapiens
AGEMAKVQN

SEQ ID NO: 1032335 - protein, 9 aa, Homo Sapiens
RYLCLRYPL

SEQ ID NO: 1032336 - protein, 9 aa, Homo Sapiens
RYNSLSKLR

SEQ ID NO: 1032337 - protein, 9 aa, Homo Sapiens
GDGNIRYYK

SEQ ID NO: 1032338 - protein, 9 aa, Homo Sapiens
QLVEMLRGI

SEQ ID NO: 1032339 - protein, 9 aa, Homo Sapiens
EAMCAWDAW

SEQ ID NO: 1032340 - protein, 9 aa, Homo Sapiens
YFRQRLQKM

SEQ ID NO: 1032341 - protein, 9 aa, Homo Sapiens
AGLFFAPGL

SEQ ID NO: 1032342 - protein, 9 aa, Homo Sapiens
QPLGGPGTA

SEQ ID NO: 1032343 - protein, 9 aa, Homo Sapiens
ELCRHIEAK

SEQ ID NO: 1032344 - protein, 9 aa, Homo Sapiens
LSPRINEKA

SEQ ID NO: 1032345 - protein, 9 aa, Homo Sapiens
ASDFIGLQK

SEQ ID NO: 1032346 - protein, 9 aa, Homo Sapiens
EKPQGPPPQ

SEQ ID NO: 1032347 - protein, 9 aa, Homo Sapiens
FQNRRIKWR

SEQ ID NO: 1032348 - protein, 9 aa, Homo Sapiens
NPDLGAGGS

SEQ ID NO: 1032349 - protein, 9 aa, Homo Sapiens
LFTKHFFEA

SEQ ID NO: 1032350 - protein, 9 aa, Homo Sapiens
DRRRRKLEP

SEQ ID NO: 1032351 - protein, 9 aa, Homo Sapiens
TLCIFVLLS

SEQ ID NO: 1032352 - protein, 9 aa, Homo Sapiens
PGDYLSPPS

SEQ ID NO: 1032353 - protein, 9 aa, Homo Sapiens
TPGLKILST

SEQ ID NO: 1032354 - protein, 9 aa, Homo Sapiens
LRKWYSPIK

SEQ ID NO: 1032355 - protein, 9 aa, Homo Sapiens
YLQLSFWNT

SEQ ID NO: 1032356 - protein, 9 aa, Homo Sapiens
AGKEVGAGG

SEQ ID NO: 1032357 - protein, 9 aa, Homo Sapiens
EDVTLENRS

SEQ ID NO: 1032358 - protein, 9 aa, Homo Sapiens
PPKPRSRRT

SEQ ID NO: 1032359 - protein, 9 aa, Homo Sapiens
KTGPRASRV

SEQ ID NO: 1032360 - protein, 9 aa, Homo Sapiens
VGSKLSAQI

SEQ ID NO: 1032361 - protein, 9 aa, Homo Sapiens
QHSVVVPYE

SEQ ID NO: 1032362 - protein, 9 aa, Homo Sapiens
GLDPSSPAF

SEQ ID NO: 1032363 - protein, 9 aa, Homo Sapiens
FEKKLAGQS

SEQ ID NO: 1032364 - protein, 9 aa, Homo Sapiens
FGIVPNGST

SEQ ID NO: 1032365 - protein, 9 aa, Homo Sapiens
RHGVVLSEN

SEQ ID NO: 1032366 - protein, 9 aa, Homo Sapiens
GPKGLVKPV

SEQ ID NO: 1032367 - protein, 9 aa, Homo Sapiens
VTSKFFLEE

SEQ ID NO: 1032368 - protein, 9 aa, Homo Sapiens
ASLQETSVF

SEQ ID NO: 1032369 - protein, 9 aa, Homo Sapiens
QNMAVLLAG

SEQ ID NO: 1032370 - protein, 9 aa, Homo Sapiens
LQCIRYGFS

SEQ ID NO: 1032371 - protein, 9 aa, Homo Sapiens
CLYESRFSA

SEQ ID NO: 1032372 - protein, 9 aa, Homo Sapiens
LSNPYVKFR

SEQ ID NO: 1032373 - protein, 9 aa, Homo Sapiens
RCYGSYSSS

SEQ ID NO: 1032374 - protein, 9 aa, Homo Sapiens
QTYLVVADP

SEQ ID NO: 1032375 - protein, 9 aa, Homo Sapiens
NNAKVTPGL

SEQ ID NO: 1032376 - protein, 9 aa, Homo Sapiens
SHIKKTEKA

SEQ ID NO: 1032377 - protein, 9 aa, Homo Sapiens
RFRRWATWE

SEQ ID NO: 1032378 - protein, 9 aa, Homo Sapiens
LMLLISLSV

SEQ ID NO: 1032379 - protein, 9 aa, Homo Sapiens
VVLLIVFRK

SEQ ID NO: 1032380 - protein, 9 aa, Homo Sapiens
QIFVISRHE

SEQ ID NO: 1032381 - protein, 9 aa, Homo Sapiens
RRGPEEDSP

SEQ ID NO: 1032382 - protein, 9 aa, Homo Sapiens
KSESLDKEE

SEQ ID NO: 1032383 - protein, 9 aa, Homo Sapiens
CGKGYFADY

SEQ ID NO: 1032384 - protein, 9 aa, Homo Sapiens
LVSRSSPDQ

SEQ ID NO: 1032385 - protein, 9 aa, Homo Sapiens
PGGVSGPFP

SEQ ID NO: 1032386 - protein, 9 aa, Homo Sapiens
AADTDEDGQ

SEQ ID NO: 1032387 - protein, 9 aa, Homo Sapiens
ASDRSGADK

SEQ ID NO: 1032388 - protein, 9 aa, Homo Sapiens
TDANYGKLQ

SEQ ID NO: 1032389 - protein, 9 aa, Homo Sapiens
QGRPPSQDL

SEQ ID NO: 1032390 - protein, 9 aa, Homo Sapiens
CGSPKIASH

SEQ ID NO: 1032391 - protein, 9 aa, Homo Sapiens
KSEAGNEEE

SEQ ID NO: 1032392 - protein, 9 aa, Homo Sapiens
TILFLEFCT

SEQ ID NO: 1032393 - protein, 9 aa, Homo Sapiens
VMSYDCYVA

SEQ ID NO: 1032394 - protein, 9 aa, Homo Sapiens
RGLALTFSS

SEQ ID NO: 1032395 - protein, 9 aa, Homo Sapiens
ENFLLVLGG

SEQ ID NO: 1032396 - protein, 9 aa, Homo Sapiens
FLSLLILSC

SEQ ID NO: 1032397 - protein, 9 aa, Homo Sapiens
AAGKEVGAG

SEQ ID NO: 1032398 - protein, 9 aa, Homo Sapiens
MGNSTDPGL

SEQ ID NO: 1032399 - protein, 9 aa, Homo Sapiens
RQIKDTMTM

SEQ ID NO: 1032400 - protein, 9 aa, Homo Sapiens
IIAPKRLVN

SEQ ID NO: 1032401 - protein, 9 aa, Homo Sapiens
PGQSHAQGG

SEQ ID NO: 1032402 - protein, 9 aa, Homo Sapiens
LPRPLVHPL

SEQ ID NO: 1032403 - protein, 9 aa, Homo Sapiens
KPLNRAVFW

SEQ ID NO: 1032404 - protein, 9 aa, Homo Sapiens
TGLFPQAAS

SEQ ID NO: 1032405 - protein, 9 aa, Homo Sapiens
LAGCSTRDG

SEQ ID NO: 1032406 - protein, 9 aa, Homo Sapiens
IDPISGKIR

SEQ ID NO: 1032407 - protein, 9 aa, Homo Sapiens
LCRKDLSLL

SEQ ID NO: 1032408 - protein, 9 aa, Homo Sapiens
DLLPLFQYS

SEQ ID NO: 1032409 - protein, 9 aa, Homo Sapiens
VLVYDITNE

SEQ ID NO: 1032410 - protein, 9 aa, Homo Sapiens
SGRPLDRLP

SEQ ID NO: 1032411 - protein, 9 aa, Homo Sapiens
VKGKIHLHS

SEQ ID NO: 1032412 - protein, 9 aa, Homo Sapiens
AYDSNNPDV

SEQ ID NO: 1032413 - protein, 9 aa, Homo Sapiens
QFRQVEEKL

SEQ ID NO: 1032414 - protein, 9 aa, Homo Sapiens
NETTCTFNP

SEQ ID NO: 1032415 - protein, 9 aa, Homo Sapiens
TLVQPVGSL

SEQ ID NO: 1032416 - protein, 9 aa, Homo Sapiens
FFSVHYERE

SEQ ID NO: 1032417 - protein, 9 aa, Homo Sapiens
RSGCQGDFG

SEQ ID NO: 1032418 - protein, 9 aa, Homo Sapiens
HFPKPERLL

SEQ ID NO: 1032419 - protein, 9 aa, Homo Sapiens
GLVNDEESS

SEQ ID NO: 1032420 - protein, 9 aa, Homo Sapiens
FPPDSQTPS

SEQ ID NO: 1032421 - protein, 9 aa, Homo Sapiens
EGFWEDPKK

SEQ ID NO: 1032422 - protein, 9 aa, Homo Sapiens
RNSGSDGSL

SEQ ID NO: 1032423 - protein, 9 aa, Homo Sapiens
CVSWNPQVP

SEQ ID NO: 1032424 - protein, 9 aa, Homo Sapiens
HRGLGQYRA

SEQ ID NO: 1032425 - protein, 9 aa, Homo Sapiens
HPHLAPEYT

SEQ ID NO: 1032426 - protein, 9 aa, Homo Sapiens
PRVQMEHKG

SEQ ID NO: 1032427 - protein, 9 aa, Homo Sapiens
SGPGALAAA

SEQ ID NO: 1032428 - protein, 9 aa, Homo Sapiens
KAHKGNGEP

SEQ ID NO: 1032429 - protein, 9 aa, Homo Sapiens
EKGPWGGWG

SEQ ID NO: 1032430 - protein, 9 aa, Homo Sapiens
NSLVYGAKT

SEQ ID NO: 1032431 - protein, 9 aa, Homo Sapiens
ENVNIEEAE

SEQ ID NO: 1032432 - protein, 9 aa, Homo Sapiens
RIATGSFFK

SEQ ID NO: 1032433 - protein, 9 aa, Homo Sapiens
GTQPPEKME

SEQ ID NO: 1032434 - protein, 9 aa, Homo Sapiens
TNKSKSGSC

SEQ ID NO: 1032435 - protein, 9 aa, Homo Sapiens
DDMHTSDTQ

SEQ ID NO: 1032436 - protein, 9 aa, Homo Sapiens
VLMKERNVF

SEQ ID NO: 1032437 - protein, 9 aa, Homo Sapiens
GAGGTLQQQ

SEQ ID NO: 1032438 - protein, 9 aa, Homo Sapiens
FTSDFSKVL

SEQ ID NO: 1032439 - protein, 9 aa, Homo Sapiens
CLISKLVNF

SEQ ID NO: 1032440 - protein, 9 aa, Homo Sapiens
QNGPVHAPL

SEQ ID NO: 1032441 - protein, 9 aa, Homo Sapiens
KKKTPESSL

SEQ ID NO: 1032442 - protein, 9 aa, Homo Sapiens
FYGRVLLAV

SEQ ID NO: 1032443 - protein, 9 aa, Homo Sapiens
AEHSVAAGV

SEQ ID NO: 1032444 - protein, 9 aa, Homo Sapiens
EITVGIETM

SEQ ID NO: 1032445 - protein, 9 aa, Homo Sapiens
PVHRVGYIL

SEQ ID NO: 1032446 - protein, 9 aa, Homo Sapiens
IIIIWSISL

SEQ ID NO: 1032447 - protein, 9 aa, Homo Sapiens
WQESDTVSY

SEQ ID NO: 1032448 - protein, 9 aa, Homo Sapiens
LSERPTAQD

SEQ ID NO: 1032449 - protein, 9 aa, Homo Sapiens
DTLARKTFE

SEQ ID NO: 1032450 - protein, 9 aa, Homo Sapiens
AQAACDWLF

SEQ ID NO: 1032451 - protein, 9 aa, Homo Sapiens
HPFSINVFE

SEQ ID NO: 1032452 - protein, 9 aa, Homo Sapiens
CLESFCDSM

SEQ ID NO: 1032453 - protein, 9 aa, Homo Sapiens
LPSRNIKPP

SEQ ID NO: 1032454 - protein, 9 aa, Homo Sapiens
PAPHLKTSV

SEQ ID NO: 1032455 - protein, 9 aa, Homo Sapiens
GADLPNHRW

SEQ ID NO: 1032456 - protein, 9 aa, Homo Sapiens
RRPNFFPIS

SEQ ID NO: 1032457 - protein, 9 aa, Homo Sapiens
SGQCLGEED

SEQ ID NO: 1032458 - protein, 9 aa, Homo Sapiens
TEVSLLAES

SEQ ID NO: 1032459 - protein, 9 aa, Homo Sapiens
GPRGAVKTG

SEQ ID NO: 1032460 - protein, 9 aa, Homo Sapiens
ADLTPLLFF

SEQ ID NO: 1032461 - protein, 9 aa, Homo Sapiens
YAVGLSNVW

SEQ ID NO: 1032462 - protein, 9 aa, Homo Sapiens
NCLKQYSRE

SEQ ID NO: 1032463 - protein, 9 aa, Homo Sapiens
MAPQGMPGL

SEQ ID NO: 1032464 - protein, 9 aa, Homo Sapiens
KIPTFVTGR

SEQ ID NO: 1032465 - protein, 9 aa, Homo Sapiens
TECDFHPLP

SEQ ID NO: 1032466 - protein, 9 aa, Homo Sapiens
KARRRATQL

SEQ ID NO: 1032467 - protein, 9 aa, Homo Sapiens
IPSHPYGIT

SEQ ID NO: 1032468 - protein, 9 aa, Homo Sapiens
QHLSQRRLY

SEQ ID NO: 1032469 - protein, 9 aa, Homo Sapiens
KQYSREEEF

SEQ ID NO: 1032470 - protein, 9 aa, Homo Sapiens
RKVIYRGEV

SEQ ID NO: 1032471 - protein, 9 aa, Homo Sapiens
NTEDLETAI

SEQ ID NO: 1032472 - protein, 9 aa, Homo Sapiens
PLSGPGALA

SEQ ID NO: 1032473 - protein, 9 aa, Homo Sapiens
VNGIFLNLR

SEQ ID NO: 1032474 - protein, 9 aa, Homo Sapiens
HYHHGYHPS

SEQ ID NO: 1032475 - protein, 9 aa, Homo Sapiens
EKSAISGFS

SEQ ID NO: 1032476 - protein, 9 aa, Homo Sapiens
QKMNTDPMA

SEQ ID NO: 1032477 - protein, 9 aa, Homo Sapiens
HWGRYRPST

SEQ ID NO: 1032478 - protein, 9 aa, Homo Sapiens
YDASLSTYF

SEQ ID NO: 1032479 - protein, 9 aa, Homo Sapiens
ALGFSSPCP

SEQ ID NO: 1032480 - protein, 9 aa, Homo Sapiens
EHFQRRKGL

SEQ ID NO: 1032481 - protein, 9 aa, Homo Sapiens
HEWTHEEQF

SEQ ID NO: 1032482 - protein, 9 aa, Homo Sapiens
SKVLGQLSA

SEQ ID NO: 1032483 - protein, 9 aa, Homo Sapiens
EKLPLVTRE

SEQ ID NO: 1032484 - protein, 9 aa, Homo Sapiens
SRNLHLTSV

SEQ ID NO: 1032485 - protein, 9 aa, Homo Sapiens
IPEPEKKVP

SEQ ID NO: 1032486 - protein, 9 aa, Homo Sapiens
RARFKLPSG

SEQ ID NO: 1032487 - protein, 9 aa, Homo Sapiens
VQVDVKDSQ

SEQ ID NO: 1032488 - protein, 9 aa, Homo Sapiens
TEAPLNPKT

SEQ ID NO: 1032489 - protein, 9 aa, Homo Sapiens
LDASGHKSF

SEQ ID NO: 1032490 - protein, 9 aa, Homo Sapiens
GISHRTVPM

SEQ ID NO: 1032491 - protein, 9 aa, Homo Sapiens
MLLISLSVI

SEQ ID NO: 1032492 - protein, 9 aa, Homo Sapiens
NKSGSLFRE

SEQ ID NO: 1032493 - protein, 9 aa, Homo Sapiens
IMLFCLRLS

SEQ ID NO: 1032494 - protein, 9 aa, Homo Sapiens
SRGSGGNSA

SEQ ID NO: 1032495 - protein, 9 aa, Homo Sapiens
CSSGCNSDH

SEQ ID NO: 1032496 - protein, 9 aa, Homo Sapiens
PDLVLERFL

SEQ ID NO: 1032497 - protein, 9 aa, Homo Sapiens
MISVVHKRV

SEQ ID NO: 1032498 - protein, 9 aa, Homo Sapiens
LVLNDKHLD

SEQ ID NO: 1032499 - protein, 9 aa, Homo Sapiens
GNIGGNETV

SEQ ID NO: 1032500 - protein, 9 aa, Homo Sapiens
KGDVYSYRI

SEQ ID NO: 1032501 - protein, 9 aa, Homo Sapiens
GEIMKTAVM

SEQ ID NO: 1032502 - protein, 9 aa, Homo Sapiens
DEKLFECKE

SEQ ID NO: 1032503 - protein, 9 aa, Homo Sapiens
KEEQHGILV

SEQ ID NO: 1032504 - protein, 9 aa, Homo Sapiens
HVYDRINGV

SEQ ID NO: 1032505 - protein, 9 aa, Homo Sapiens
ARGLQEKNA

SEQ ID NO: 1032506 - protein, 9 aa, Homo Sapiens
DRYFQSLNL

SEQ ID NO: 1032507 - protein, 9 aa, Homo Sapiens
SVSDKSNDL

SEQ ID NO: 1032508 - protein, 9 aa, Homo Sapiens
EGDKKPDYT

SEQ ID NO: 1032509 - protein, 9 aa, Homo Sapiens
ITAWYIEFL

SEQ ID NO: 1032510 - protein, 9 aa, Homo Sapiens
ELSAIDFSF

SEQ ID NO: 1032511 - protein, 9 aa, Homo Sapiens
DFQSPKDDA

SEQ ID NO: 1032512 - protein, 9 aa, Homo Sapiens
SLMHLEKFE

SEQ ID NO: 1032513 - protein, 9 aa, Homo Sapiens
PFFQSGSQE

SEQ ID NO: 1032514 - protein, 9 aa, Homo Sapiens
EDTVSFSIE

SEQ ID NO: 1032515 - protein, 9 aa, Homo Sapiens
GTFLIAVAH

SEQ ID NO: 1032516 - protein, 9 aa, Homo Sapiens
SGEQPMEGF

SEQ ID NO: 1032517 - protein, 9 aa, Homo Sapiens
AGTQKKAST

SEQ ID NO: 1032518 - protein, 9 aa, Homo Sapiens
IGTLYFNAL

SEQ ID NO: 1032519 - protein, 9 aa, Homo Sapiens
LQKEEEVEE

SEQ ID NO: 1032520 - protein, 9 aa, Homo Sapiens
LLILREHHQ

SEQ ID NO: 1032521 - protein, 9 aa, Homo Sapiens
LLDLTDELA

SEQ ID NO: 1032522 - protein, 9 aa, Homo Sapiens
QAYPDPSPE

SEQ ID NO: 1032523 - protein, 9 aa, Homo Sapiens
NPQVPSMMA

SEQ ID NO: 1032524 - protein, 9 aa, Homo Sapiens
GSLLFGPLL

SEQ ID NO: 1032525 - protein, 9 aa, Homo Sapiens
VYDRINGVW

SEQ ID NO: 1032526 - protein, 9 aa, Homo Sapiens
KDRPHEETR

SEQ ID NO: 1032527 - protein, 9 aa, Homo Sapiens
ENRKLAKGC

SEQ ID NO: 1032528 - protein, 9 aa, Homo Sapiens
GVTNPSHSF

SEQ ID NO: 1032529 - protein, 9 aa, Homo Sapiens
EKFIEDYLL

SEQ ID NO: 1032530 - protein, 9 aa, Homo Sapiens
YSGITDDNI

SEQ ID NO: 1032531 - protein, 9 aa, Homo Sapiens
FKPFSNGSL

SEQ ID NO: 1032532 - protein, 9 aa, Homo Sapiens
FPVTDTSSV

SEQ ID NO: 1032533 - protein, 9 aa, Homo Sapiens
FFRRHLPRQ

SEQ ID NO: 1032534 - protein, 9 aa, Homo Sapiens
CCVLMLLIS

SEQ ID NO: 1032535 - protein, 9 aa, Homo Sapiens
KEEKLELQR

SEQ ID NO: 1032536 - protein, 9 aa, Homo Sapiens
LPSRAARES

SEQ ID NO: 1032537 - protein, 9 aa, Homo Sapiens
FSSPCPSIW

SEQ ID NO: 1032538 - protein, 9 aa, Homo Sapiens
TSAVLSMDN

SEQ ID NO: 1032539 - protein, 9 aa, Homo Sapiens
YTMKILDKQ

SEQ ID NO: 1032540 - protein, 9 aa, Homo Sapiens
GINRKYKDH

SEQ ID NO: 1032541 - protein, 9 aa, Homo Sapiens
IEKPFWQNF

SEQ ID NO: 1032542 - protein, 9 aa, Homo Sapiens
RSSRALPGP

SEQ ID NO: 1032543 - protein, 9 aa, Homo Sapiens
DSDLKDAKM

SEQ ID NO: 1032544 - protein, 9 aa, Homo Sapiens
EYTAPHPHL

SEQ ID NO: 1032545 - protein, 9 aa, Homo Sapiens
GAFFLDSPG

SEQ ID NO: 1032546 - protein, 9 aa, Homo Sapiens
YNKPLPPTS

SEQ ID NO: 1032547 - protein, 9 aa, Homo Sapiens
LTPQNLKEE

SEQ ID NO: 1032548 - protein, 9 aa, Homo Sapiens
APLNPKTNR

SEQ ID NO: 1032549 - protein, 9 aa, Homo Sapiens
QTTPMLELG

SEQ ID NO: 1032550 - protein, 9 aa, Homo Sapiens
YYVGWADKY

SEQ ID NO: 1032551 - protein, 9 aa, Homo Sapiens
VPLKYRQET

SEQ ID NO: 1032552 - protein, 9 aa, Homo Sapiens
FEPVLEGDG

SEQ ID NO: 1032553 - protein, 9 aa, Homo Sapiens
FVGVSSGKL

SEQ ID NO: 1032554 - protein, 9 aa, Homo Sapiens
REDARDPRI

SEQ ID NO: 1032555 - protein, 9 aa, Homo Sapiens
AHLPELLNL

SEQ ID NO: 1032556 - protein, 9 aa, Homo Sapiens
AEALLLQLG

SEQ ID NO: 1032557 - protein, 9 aa, Homo Sapiens
EPRGFLGPP

SEQ ID NO: 1032558 - protein, 9 aa, Homo Sapiens
QLELQLEQE

SEQ ID NO: 1032559 - protein, 9 aa, Homo Sapiens
FLIAVAHHL

SEQ ID NO: 1032560 - protein, 9 aa, Homo Sapiens
KFYGNPMHV

SEQ ID NO: 1032561 - protein, 9 aa, Homo Sapiens
DVPMPEKKS

SEQ ID NO: 1032562 - protein, 9 aa, Homo Sapiens
EGSVSAVTK

SEQ ID NO: 1032563 - protein, 9 aa, Homo Sapiens
VGGEKGPGG

SEQ ID NO: 1032564 - protein, 9 aa, Homo Sapiens
KQVQEAKNT

SEQ ID NO: 1032565 - protein, 9 aa, Homo Sapiens
SCPGDYLSP

SEQ ID NO: 1032566 - protein, 9 aa, Homo Sapiens
EGFYAPRRG

SEQ ID NO: 1032567 - protein, 9 aa, Homo Sapiens
IKKTEKAIN

SEQ ID NO: 1032568 - protein, 9 aa, Homo Sapiens
TKDRIQHAL

SEQ ID NO: 1032569 - protein, 9 aa, Homo Sapiens
AEGTAGSWG

SEQ ID NO: 1032570 - protein, 9 aa, Homo Sapiens
SCTFFWPMS

SEQ ID NO: 1032571 - protein, 9 aa, Homo Sapiens
EGKALKEEE

SEQ ID NO: 1032572 - protein, 9 aa, Homo Sapiens
FLGISRGTM

SEQ ID NO: 1032573 - protein, 9 aa, Homo Sapiens
CAKAFRNRL

SEQ ID NO: 1032574 - protein, 9 aa, Homo Sapiens
CDDGITGFG

SEQ ID NO: 1032575 - protein, 9 aa, Homo Sapiens
TISSASRKQ

SEQ ID NO: 1032576 - protein, 9 aa, Homo Sapiens
MGIVLVYDI

SEQ ID NO: 1032577 - protein, 9 aa, Homo Sapiens
IFLKTCQQA

SEQ ID NO: 1032578 - protein, 9 aa, Homo Sapiens
PLVDYLSET

SEQ ID NO: 1032579 - protein, 9 aa, Homo Sapiens
KLSAQIQKP

SEQ ID NO: 1032580 - protein, 9 aa, Homo Sapiens
VTLKEGGLY

SEQ ID NO: 1032581 - protein, 9 aa, Homo Sapiens
VQWEPFSFF

SEQ ID NO: 1032582 - protein, 9 aa, Homo Sapiens
FPSGSALRE

SEQ ID NO: 1032583 - protein, 9 aa, Homo Sapiens
DVGEKPDSE

SEQ ID NO: 1032584 - protein, 9 aa, Homo Sapiens
YLVVADPHS

SEQ ID NO: 1032585 - protein, 9 aa, Homo Sapiens
LVKGLDPSS

SEQ ID NO: 1032586 - protein, 9 aa, Homo Sapiens
TKKTVWQLP

SEQ ID NO: 1032587 - protein, 9 aa, Homo Sapiens
KQFNSFGDD

SEQ ID NO: 1032588 - protein, 9 aa, Homo Sapiens
ADLFPILIR

SEQ ID NO: 1032589 - protein, 9 aa, Homo Sapiens
DRVLDATEI

SEQ ID NO: 1032590 - protein, 9 aa, Homo Sapiens
PEKSEAGNE

SEQ ID NO: 1032591 - protein, 9 aa, Homo Sapiens
GARFESPRL

SEQ ID NO: 1032592 - protein, 9 aa, Homo Sapiens
KETKPQGAS

SEQ ID NO: 1032593 - protein, 9 aa, Homo Sapiens
ALLLQLGYK

SEQ ID NO: 1032594 - protein, 9 aa, Homo Sapiens
AVDKITISG

SEQ ID NO: 1032595 - protein, 9 aa, Homo Sapiens
SLLLAKLAE

SEQ ID NO: 1032596 - protein, 9 aa, Homo Sapiens
KNGALGSPE

SEQ ID NO: 1032597 - protein, 9 aa, Homo Sapiens
LQLEKCCTH

SEQ ID NO: 1032598 - protein, 9 aa, Homo Sapiens
LLFLLAMRA

SEQ ID NO: 1032599 - protein, 9 aa, Homo Sapiens
GHGGQQTTP

SEQ ID NO: 1032600 - protein, 9 aa, Homo Sapiens
QRDVQDSFA

SEQ ID NO: 1032601 - protein, 9 aa, Homo Sapiens
LYPSALILG

SEQ ID NO: 1032602 - protein, 9 aa, Homo Sapiens
ILKMQESIS

SEQ ID NO: 1032603 - protein, 9 aa, Homo Sapiens
LSESAKSLE

SEQ ID NO: 1032604 - protein, 9 aa, Homo Sapiens
QGKFYGNPM

SEQ ID NO: 1032605 - protein, 9 aa, Homo Sapiens
RRQNPSCGS

SEQ ID NO: 1032606 - protein, 9 aa, Homo Sapiens
FPIPHGGNG

SEQ ID NO: 1032607 - protein, 9 aa, Homo Sapiens
MFGAGIAMS

SEQ ID NO: 1032608 - protein, 9 aa, Homo Sapiens
NQRLYEIGE

SEQ ID NO: 1032609 - protein, 9 aa, Homo Sapiens
LPGSCTFFW

SEQ ID NO: 1032610 - protein, 9 aa, Homo Sapiens
PQGFPPRSP

SEQ ID NO: 1032611 - protein, 9 aa, Homo Sapiens
ARGLRPRLA

SEQ ID NO: 1032612 - protein, 9 aa, Homo Sapiens
EPPRPPGLC

SEQ ID NO: 1032613 - protein, 9 aa, Homo Sapiens
ITWVEILLS

SEQ ID NO: 1032614 - protein, 9 aa, Homo Sapiens
LAPQYTGPF

SEQ ID NO: 1032615 - protein, 9 aa, Homo Sapiens
PSEVTSLSS

SEQ ID NO: 1032616 - protein, 9 aa, Homo Sapiens
EMYSKEDEY

SEQ ID NO: 1032617 - protein, 9 aa, Homo Sapiens
PGPPGCSML

SEQ ID NO: 1032618 - protein, 9 aa, Homo Sapiens
SFFKRNPGV

SEQ ID NO: 1032619 - protein, 9 aa, Homo Sapiens
NFTAVTDFI

SEQ ID NO: 1032620 - protein, 9 aa, Homo Sapiens
FLCTFSWLI

SEQ ID NO: 1032621 - protein, 9 aa, Homo Sapiens
ASVNEVARQ

SEQ ID NO: 1032622 - protein, 9 aa, Homo Sapiens
AHLEKKKTP

SEQ ID NO: 1032623 - protein, 9 aa, Homo Sapiens
RSAAESGGL

SEQ ID NO: 1032624 - protein, 9 aa, Homo Sapiens
TFPDVYGFS

SEQ ID NO: 1032625 - protein, 9 aa, Homo Sapiens
PRTSPQGFP

SEQ ID NO: 1032626 - protein, 9 aa, Homo Sapiens
PDLINNALH

SEQ ID NO: 1032627 - protein, 9 aa, Homo Sapiens
PQNENGTWP

SEQ ID NO: 1032628 - protein, 9 aa, Homo Sapiens
LHSHGLQDG

SEQ ID NO: 1032629 - protein, 9 aa, Homo Sapiens
LQDGKDLFT

SEQ ID NO: 1032630 - protein, 9 aa, Homo Sapiens
SKATLSPGW

SEQ ID NO: 1032631 - protein, 9 aa, Homo Sapiens
KPPVYVPPP

SEQ ID NO: 1032632 - protein, 9 aa, Homo Sapiens
NRRIKWRNS

SEQ ID NO: 1032633 - protein, 9 aa, Homo Sapiens
FPEAPFCSV

SEQ ID NO: 1032634 - protein, 9 aa, Homo Sapiens
VPCIFLYVR

SEQ ID NO: 1032635 - protein, 9 aa, Homo Sapiens
ATSTTSRQP

SEQ ID NO: 1032636 - protein, 9 aa, Homo Sapiens
TDIGLIYHS

SEQ ID NO: 1032637 - protein, 9 aa, Homo Sapiens
SVSQSVQGG

SEQ ID NO: 1032638 - protein, 9 aa, Homo Sapiens
QMGERYLGI

SEQ ID NO: 1032639 - protein, 9 aa, Homo Sapiens
SSLLKKLGA

SEQ ID NO: 1032640 - protein, 9 aa, Homo Sapiens
SRSCGPSLA

SEQ ID NO: 1032641 - protein, 9 aa, Homo Sapiens
PRDPCQCVS

SEQ ID NO: 1032642 - protein, 9 aa, Homo Sapiens
ESFLEGFYD

SEQ ID NO: 1032643 - protein, 9 aa, Homo Sapiens
FDLELKKDK

SEQ ID NO: 1032644 - protein, 9 aa, Homo Sapiens
VSIKVSLNH

SEQ ID NO: 1032645 - protein, 9 aa, Homo Sapiens
TRLYDTVSS

SEQ ID NO: 1032646 - protein, 9 aa, Homo Sapiens
PEKKSNPKG

SEQ ID NO: 1032647 - protein, 9 aa, Homo Sapiens
GNHRCSLSE

SEQ ID NO: 1032648 - protein, 9 aa, Homo Sapiens
VNSEAFLLS

SEQ ID NO: 1032649 - protein, 9 aa, Homo Sapiens
QLLACQQKQ

SEQ ID NO: 1032650 - protein, 9 aa, Homo Sapiens
VSRNLHLTS

SEQ ID NO: 1032651 - protein, 9 aa, Homo Sapiens
TEKIERDLH

SEQ ID NO: 1032652 - protein, 9 aa, Homo Sapiens
FQCVGSGTK

SEQ ID NO: 1032653 - protein, 9 aa, Homo Sapiens
VHEPAGPCR

SEQ ID NO: 1032654 - protein, 9 aa, Homo Sapiens
AEETGGEHW

SEQ ID NO: 1032655 - protein, 9 aa, Homo Sapiens
ISSEIFHSS

SEQ ID NO: 1032656 - protein, 9 aa, Homo Sapiens
LGLPGKAES

SEQ ID NO: 1032657 - protein, 9 aa, Homo Sapiens
LSHLLNVKA

SEQ ID NO: 1032658 - protein, 9 aa, Homo Sapiens
NGCSGHGGC

SEQ ID NO: 1032659 - protein, 9 aa, Homo Sapiens
QNFDVFAAD

SEQ ID NO: 1032660 - protein, 9 aa, Homo Sapiens
FRQGLIWVL

SEQ ID NO: 1032661 - protein, 9 aa, Homo Sapiens
EQKDELSFT

SEQ ID NO: 1032662 - protein, 9 aa, Homo Sapiens
TPGLTCAVF

SEQ ID NO: 1032663 - protein, 9 aa, Homo Sapiens
AAEPYETIT

SEQ ID NO: 1032664 - protein, 9 aa, Homo Sapiens
QSDSRFSLE

SEQ ID NO: 1032665 - protein, 9 aa, Homo Sapiens
FKKGPFGKN

SEQ ID NO: 1032666 - protein, 9 aa, Homo Sapiens
GIATRVVSS

SEQ ID NO: 1032667 - protein, 9 aa, Homo Sapiens
TLDGITKEA

SEQ ID NO: 1032668 - protein, 9 aa, Homo Sapiens
KIQRKTLFK

SEQ ID NO: 1032669 - protein, 9 aa, Homo Sapiens
RRRRKLEPP

SEQ ID NO: 1032670 - protein, 9 aa, Homo Sapiens
LLLLGPGFG

SEQ ID NO: 1032671 - protein, 9 aa, Homo Sapiens
PPPSAPPLP

SEQ ID NO: 1032672 - protein, 9 aa, Homo Sapiens
FYRDSEETE

SEQ ID NO: 1032673 - protein, 9 aa, Homo Sapiens
EFVDKQVFE

SEQ ID NO: 1032674 - protein, 9 aa, Homo Sapiens
SVFGSDILI

SEQ ID NO: 1032675 - protein, 9 aa, Homo Sapiens
ENNCPSDDN

SEQ ID NO: 1032676 - protein, 9 aa, Homo Sapiens
RNNVFSVST

SEQ ID NO: 1032677 - protein, 9 aa, Homo Sapiens
FGTGQNDWT

SEQ ID NO: 1032678 - protein, 9 aa, Homo Sapiens
TLSKDDLKE

SEQ ID NO: 1032679 - protein, 9 aa, Homo Sapiens
TVAQKMAKP

SEQ ID NO: 1032680 - protein, 9 aa, Homo Sapiens
KLVVQYTPK

SEQ ID NO: 1032681 - protein, 9 aa, Homo Sapiens
DTVSSTDGE

SEQ ID NO: 1032682 - protein, 9 aa, Homo Sapiens
LRKVIYRGE

SEQ ID NO: 1032683 - protein, 9 aa, Homo Sapiens
FPCTVRWFH

SEQ ID NO: 1032684 - protein, 9 aa, Homo Sapiens
NMMAEQTLS

SEQ ID NO: 1032685 - protein, 9 aa, Homo Sapiens
SGARFESPR

SEQ ID NO: 1032686 - protein, 9 aa, Homo Sapiens
TISFLSCIM

SEQ ID NO: 1032687 - protein, 9 aa, Homo Sapiens
CTFSLLSTF

SEQ ID NO: 1032688 - protein, 9 aa, Homo Sapiens
TQKKEFVTK

SEQ ID NO: 1032689 - protein, 9 aa, Homo Sapiens
YLDWSHWGG

SEQ ID NO: 1032690 - protein, 9 aa, Homo Sapiens
VTLSYVFIL

SEQ ID NO: 1032691 - protein, 9 aa, Homo Sapiens
KNQKTSEMR

SEQ ID NO: 1032692 - protein, 9 aa, Homo Sapiens
NLFAMFGAG

SEQ ID NO: 1032693 - protein, 9 aa, Homo Sapiens
SLGGTREPY

SEQ ID NO: 1032694 - protein, 9 aa, Homo Sapiens
PWVDCLLEK

SEQ ID NO: 1032695 - protein, 9 aa, Homo Sapiens
VIISLSKKE

SEQ ID NO: 1032696 - protein, 9 aa, Homo Sapiens
KATPVSMTS

SEQ ID NO: 1032697 - protein, 9 aa, Homo Sapiens
QMIFTPEKS

SEQ ID NO: 1032698 - protein, 9 aa, Homo Sapiens
INGQVRQGK

SEQ ID NO: 1032699 - protein, 9 aa, Homo Sapiens
IQFLDRRLF

SEQ ID NO: 1032700 - protein, 9 aa, Homo Sapiens
GQDFQCKKT

SEQ ID NO: 1032701 - protein, 9 aa, Homo Sapiens
LVQPVGSLL

SEQ ID NO: 1032702 - protein, 9 aa, Homo Sapiens
PSLFGGLQC

SEQ ID NO: 1032703 - protein, 9 aa, Homo Sapiens
ESWPGHVAL

SEQ ID NO: 1032704 - protein, 9 aa, Homo Sapiens
EMKHKFEEA

SEQ ID NO: 1032705 - protein, 9 aa, Homo Sapiens
CIPLYLMVI

SEQ ID NO: 1032706 - protein, 9 aa, Homo Sapiens
LILKETETV

SEQ ID NO: 1032707 - protein, 9 aa, Homo Sapiens
GILVTGLQS

SEQ ID NO: 1032708 - protein, 9 aa, Homo Sapiens
FKPSLTESD

SEQ ID NO: 1032709 - protein, 9 aa, Homo Sapiens
ARTSRQQKL

SEQ ID NO: 1032710 - protein, 9 aa, Homo Sapiens
SQRIIVGTL

SEQ ID NO: 1032711 - protein, 9 aa, Homo Sapiens
GQEKEHSFW

SEQ ID NO: 1032712 - protein, 9 aa, Homo Sapiens
HLEKFEKNV

SEQ ID NO: 1032713 - protein, 9 aa, Homo Sapiens
THERKGSNK

SEQ ID NO: 1032714 - protein, 9 aa, Homo Sapiens
SSGASSPEQ

SEQ ID NO: 1032715 - protein, 9 aa, Homo Sapiens
PRSRRTAPE

SEQ ID NO: 1032716 - protein, 9 aa, Homo Sapiens
IVTAADKNH

SEQ ID NO: 1032717 - protein, 9 aa, Homo Sapiens
IRPMQKKIL

SEQ ID NO: 1032718 - protein, 9 aa, Homo Sapiens
SGTQQRKVI

SEQ ID NO: 1032719 - protein, 9 aa, Homo Sapiens
VQFVGVSSG

SEQ ID NO: 1032720 - protein, 9 aa, Homo Sapiens
GFEKMSKRS

SEQ ID NO: 1032721 - protein, 9 aa, Homo Sapiens
ELSRIRLEK

SEQ ID NO: 1032722 - protein, 9 aa, Homo Sapiens
ARPCHGNCN

SEQ ID NO: 1032723 - protein, 9 aa, Homo Sapiens
TQQVLMKER

SEQ ID NO: 1032724 - protein, 9 aa, Homo Sapiens
RLSLIEHQR

SEQ ID NO: 1032725 - protein, 9 aa, Homo Sapiens
GRETHEGRE

SEQ ID NO: 1032726 - protein, 9 aa, Homo Sapiens
PASLQPVPP

SEQ ID NO: 1032727 - protein, 9 aa, Homo Sapiens
DFSKVLGQL

SEQ ID NO: 1032728 - protein, 9 aa, Homo Sapiens
SSSKIPTFV

SEQ ID NO: 1032729 - protein, 9 aa, Homo Sapiens
VLQLLFRHF

SEQ ID NO: 1032730 - protein, 9 aa, Homo Sapiens
LCSLKTHSL

SEQ ID NO: 1032731 - protein, 9 aa, Homo Sapiens
LQVETRISS

SEQ ID NO: 1032732 - protein, 9 aa, Homo Sapiens
EINFLKALY

SEQ ID NO: 1032733 - protein, 9 aa, Homo Sapiens
FMKSKSDIE

SEQ ID NO: 1032734 - protein, 9 aa, Homo Sapiens
PREATSFPP

SEQ ID NO: 1032735 - protein, 9 aa, Homo Sapiens
STFLTKRLS

SEQ ID NO: 1032736 - protein, 9 aa, Homo Sapiens
LLPRPLVHP

SEQ ID NO: 1032737 - protein, 9 aa, Homo Sapiens
PAVPASLWK

SEQ ID NO: 1032738 - protein, 9 aa, Homo Sapiens
KYFISLKRN

SEQ ID NO: 1032739 - protein, 9 aa, Homo Sapiens
DARGGAECP

SEQ ID NO: 1032740 - protein, 9 aa, Homo Sapiens
ITWVGIVIF

SEQ ID NO: 1032741 - protein, 9 aa, Homo Sapiens
DPPIWKEKY

SEQ ID NO: 1032742 - protein, 9 aa, Homo Sapiens
TSRTEILSL

SEQ ID NO: 1032743 - protein, 9 aa, Homo Sapiens
HQLSVVHTN

SEQ ID NO: 1032744 - protein, 9 aa, Homo Sapiens
NLLRAFAGP

SEQ ID NO: 1032745 - protein, 9 aa, Homo Sapiens
WEDPKKFAG

SEQ ID NO: 1032746 - protein, 9 aa, Homo Sapiens
ITTASFVCV

SEQ ID NO: 1032747 - protein, 9 aa, Homo Sapiens
EQLFKYQKD

SEQ ID NO: 1032748 - protein, 9 aa, Homo Sapiens
SALGFSSPC

SEQ ID NO: 1032749 - protein, 9 aa, Homo Sapiens
SSRALSPDM

SEQ ID NO: 1032750 - protein, 9 aa, Homo Sapiens
KVSADKPHL

SEQ ID NO: 1032751 - protein, 9 aa, Homo Sapiens
KTGANLFNL

SEQ ID NO: 1032752 - protein, 9 aa, Homo Sapiens
RTPDGRSQE

SEQ ID NO: 1032753 - protein, 9 aa, Homo Sapiens
MAQCLQRYS

SEQ ID NO: 1032754 - protein, 9 aa, Homo Sapiens
LKEQLASLE

SEQ ID NO: 1032755 - protein, 9 aa, Homo Sapiens
NQTTPMLEL

SEQ ID NO: 1032756 - protein, 9 aa, Homo Sapiens
YRANIFLRQ

SEQ ID NO: 1032757 - protein, 9 aa, Homo Sapiens
CTASKITLD

SEQ ID NO: 1032758 - protein, 9 aa, Homo Sapiens
QFQVSARDD

SEQ ID NO: 1032759 - protein, 9 aa, Homo Sapiens
GEEKRCALG

SEQ ID NO: 1032760 - protein, 9 aa, Homo Sapiens
FKAYSPASR

SEQ ID NO: 1032761 - protein, 9 aa, Homo Sapiens
HSAVALEQN

SEQ ID NO: 1032762 - protein, 9 aa, Homo Sapiens
LKNKIQTLA

SEQ ID NO: 1032763 - protein, 9 aa, Homo Sapiens
DDQDMIESL

SEQ ID NO: 1032764 - protein, 9 aa, Homo Sapiens
LSRKRAAPC

SEQ ID NO: 1032765 - protein, 9 aa, Homo Sapiens
LGTENVNIE

SEQ ID NO: 1032766 - protein, 9 aa, Homo Sapiens
ECEENTQHL

SEQ ID NO: 1032767 - protein, 9 aa, Homo Sapiens
KFTEGTVVF

SEQ ID NO: 1032768 - protein, 9 aa, Homo Sapiens
GGKSILIRG

SEQ ID NO: 1032769 - protein, 9 aa, Homo Sapiens
LRNRVCIAE

SEQ ID NO: 1032770 - protein, 9 aa, Homo Sapiens
FFKRNPGVK

SEQ ID NO: 1032771 - protein, 9 aa, Homo Sapiens
VQMEHKGEF

SEQ ID NO: 1032772 - protein, 9 aa, Homo Sapiens
VLRDSWGGT

SEQ ID NO: 1032773 - protein, 9 aa, Homo Sapiens
NGQMCEWPQ

SEQ ID NO: 1032774 - protein, 9 aa, Homo Sapiens
IAISCFYGR

SEQ ID NO: 1032775 - protein, 9 aa, Homo Sapiens
NRASPAVAL

SEQ ID NO: 1032776 - protein, 9 aa, Homo Sapiens
ILLFFDQPD

SEQ ID NO: 1032777 - protein, 9 aa, Homo Sapiens
EFQGQETRK

SEQ ID NO: 1032778 - protein, 9 aa, Homo Sapiens
NQDPDFILF

SEQ ID NO: 1032779 - protein, 9 aa, Homo Sapiens
QPMEGFHQG

SEQ ID NO: 1032780 - protein, 9 aa, Homo Sapiens
ASLQPVPPT

SEQ ID NO: 1032781 - protein, 9 aa, Homo Sapiens
LSSWDYRRT

SEQ ID NO: 1032782 - protein, 9 aa, Homo Sapiens
KPQGPPPPE

SEQ ID NO: 1032783 - protein, 9 aa, Homo Sapiens
ILRCQPSCT

SEQ ID NO: 1032784 - protein, 9 aa, Homo Sapiens
SAEDRVSLS

SEQ ID NO: 1032785 - protein, 9 aa, Homo Sapiens
HINEKKNTE

SEQ ID NO: 1032786 - protein, 9 aa, Homo Sapiens
PEETSIAGN

SEQ ID NO: 1032787 - protein, 9 aa, Homo Sapiens
PRNCGSPKI

SEQ ID NO: 1032788 - protein, 9 aa, Homo Sapiens
DHKLRHRRH

SEQ ID NO: 1032789 - protein, 9 aa, Homo Sapiens
VIDQMLDRN

SEQ ID NO: 1032790 - protein, 9 aa, Homo Sapiens
HLSRVQDFS

SEQ ID NO: 1032791 - protein, 9 aa, Homo Sapiens
LSHPFSINV

SEQ ID NO: 1032792 - protein, 9 aa, Homo Sapiens
VVIYTEKET

SEQ ID NO: 1032793 - protein, 9 aa, Homo Sapiens
CDLVSLHRD

SEQ ID NO: 1032794 - protein, 9 aa, Homo Sapiens
YNTISRIDR

SEQ ID NO: 1032795 - protein, 9 aa, Homo Sapiens
SDFESARQF

SEQ ID NO: 1032796 - protein, 9 aa, Homo Sapiens
KYTEPLILN

SEQ ID NO: 1032797 - protein, 9 aa, Homo Sapiens
PGLKPPVYV

SEQ ID NO: 1032798 - protein, 9 aa, Homo Sapiens
HEMPLGEQD

SEQ ID NO: 1032799 - protein, 9 aa, Homo Sapiens
ETKSFKPVP

SEQ ID NO: 1032800 - protein, 9 aa, Homo Sapiens
DQIYTGEKP

SEQ ID NO: 1032801 - protein, 9 aa, Homo Sapiens
SLESEQAPK

SEQ ID NO: 1032802 - protein, 9 aa, Homo Sapiens
SNKRGDNQD

SEQ ID NO: 1032803 - protein, 9 aa, Homo Sapiens
PGPPEPPRP

SEQ ID NO: 1032804 - protein, 9 aa, Homo Sapiens
FVPCIFLYV

SEQ ID NO: 1032805 - protein, 9 aa, Homo Sapiens
EKEHSFWSD

SEQ ID NO: 1032806 - protein, 9 aa, Homo Sapiens
GEGSVPGIE

SEQ ID NO: 1032807 - protein, 9 aa, Homo Sapiens
PAVLSSVSV

SEQ ID NO: 1032808 - protein, 9 aa, Homo Sapiens
QQYPYLHQQ

SEQ ID NO: 1032809 - protein, 9 aa, Homo Sapiens
GDEVSYVLG

SEQ ID NO: 1032810 - protein, 9 aa, Homo Sapiens
AFERPSLFR

SEQ ID NO: 1032811 - protein, 9 aa, Homo Sapiens
SHLVGEPTT

SEQ ID NO: 1032812 - protein, 9 aa, Homo Sapiens
PITSIFHTF

SEQ ID NO: 1032813 - protein, 9 aa, Homo Sapiens
MDRVGGEKG

SEQ ID NO: 1032814 - protein, 9 aa, Homo Sapiens
YTAPHPHLA

SEQ ID NO: 1032815 - protein, 9 aa, Homo Sapiens
VPNKIIEVL

SEQ ID NO: 1032816 - protein, 9 aa, Homo Sapiens
VFVEQPTSF

SEQ ID NO: 1032817 - protein, 9 aa, Homo Sapiens
FEHSDFESP

SEQ ID NO: 1032818 - protein, 9 aa, Homo Sapiens
ATVLAQLEK

SEQ ID NO: 1032819 - protein, 9 aa, Homo Sapiens
EDCTEKHST

SEQ ID NO: 1032820 - protein, 9 aa, Homo Sapiens
KKEKIELKS

SEQ ID NO: 1032821 - protein, 9 aa, Homo Sapiens
EIRIAPTAP

SEQ ID NO: 1032822 - protein, 9 aa, Homo Sapiens
CGPSLASRS

SEQ ID NO: 1032823 - protein, 9 aa, Homo Sapiens
AKPGTAWLP

SEQ ID NO: 1032824 - protein, 9 aa, Homo Sapiens
SPQRDPKIY

SEQ ID NO: 1032825 - protein, 9 aa, Homo Sapiens
KMLQGKLGG

SEQ ID NO: 1032826 - protein, 9 aa, Homo Sapiens
CMENNCPSD

SEQ ID NO: 1032827 - protein, 9 aa, Homo Sapiens
YERAIYAAS

SEQ ID NO: 1032828 - protein, 9 aa, Homo Sapiens
NKLSFRNKI

SEQ ID NO: 1032829 - protein, 9 aa, Homo Sapiens
QPCRLGGGL

SEQ ID NO: 1032830 - protein, 9 aa, Homo Sapiens
NCNPTQQEA

SEQ ID NO: 1032831 - protein, 9 aa, Homo Sapiens
SMKSADPSP

SEQ ID NO: 1032832 - protein, 9 aa, Homo Sapiens
PDPCKNIFF

SEQ ID NO: 1032833 - protein, 9 aa, Homo Sapiens
QLPQHLQPC

SEQ ID NO: 1032834 - protein, 9 aa, Homo Sapiens
YEGPQLDTW

SEQ ID NO: 1032835 - protein, 9 aa, Homo Sapiens
VFIYVFSVM

SEQ ID NO: 1032836 - protein, 9 aa, Homo Sapiens
ELREGELIN

SEQ ID NO: 1032837 - protein, 9 aa, Homo Sapiens
IKPSAEDRV

SEQ ID NO: 1032838 - protein, 9 aa, Homo Sapiens
LSCIMQTYL

SEQ ID NO: 1032839 - protein, 9 aa, Homo Sapiens
QAAVVFVEQ

SEQ ID NO: 1032840 - protein, 9 aa, Homo Sapiens
SCEMCNFSA

SEQ ID NO: 1032841 - protein, 9 aa, Homo Sapiens
SKAKMIYSK

SEQ ID NO: 1032842 - protein, 9 aa, Homo Sapiens
LSLGFSFSR

SEQ ID NO: 1032843 - protein, 9 aa, Homo Sapiens
PRSDVLRIK

SEQ ID NO: 1032844 - protein, 9 aa, Homo Sapiens
VVWAQEEAP

SEQ ID NO: 1032845 - protein, 9 aa, Homo Sapiens
MKCSRYKVC

SEQ ID NO: 1032846 - protein, 9 aa, Homo Sapiens
RSHGKSHPR

SEQ ID NO: 1032847 - protein, 9 aa, Homo Sapiens
TQGEGKKMH

SEQ ID NO: 1032848 - protein, 9 aa, Homo Sapiens
AEAFLASDP

SEQ ID NO: 1032849 - protein, 9 aa, Homo Sapiens
SSSCGYPGV

SEQ ID NO: 1032850 - protein, 9 aa, Homo Sapiens
LAKSGPVVQ

SEQ ID NO: 1032851 - protein, 9 aa, Homo Sapiens
LENLTFNSK

SEQ ID NO: 1032852 - protein, 9 aa, Homo Sapiens
KPMPKRSPT

SEQ ID NO: 1032853 - protein, 9 aa, Homo Sapiens
ATFNEDAQA

SEQ ID NO: 1032854 - protein, 9 aa, Homo Sapiens
FGNFYTLVV

SEQ ID NO: 1032855 - protein, 9 aa, Homo Sapiens
PPPLCRDAP

SEQ ID NO: 1032856 - protein, 9 aa, Homo Sapiens
ESGILRLVI

SEQ ID NO: 1032857 - protein, 9 aa, Homo Sapiens
PSRLPPEWV

SEQ ID NO: 1032858 - protein, 9 aa, Homo Sapiens
DINGVTLKE

SEQ ID NO: 1032859 - protein, 9 aa, Homo Sapiens
HFSLRACYH

SEQ ID NO: 1032860 - protein, 9 aa, Homo Sapiens
MAFDCYVAI

SEQ ID NO: 1032861 - protein, 9 aa, Homo Sapiens
TKARFLLRD

SEQ ID NO: 1032862 - protein, 9 aa, Homo Sapiens
QCAQNMNHE

SEQ ID NO: 1032863 - protein, 9 aa, Homo Sapiens
EAANINDMD

SEQ ID NO: 1032864 - protein, 9 aa, Homo Sapiens
ELNEKAVIF

SEQ ID NO: 1032865 - protein, 9 aa, Homo Sapiens
DQIRKFQRH

SEQ ID NO: 1032866 - protein, 9 aa, Homo Sapiens
DLFPILIRI

SEQ ID NO: 1032867 - protein, 9 aa, Homo Sapiens
YDFAIMIPS

SEQ ID NO: 1032868 - protein, 9 aa, Homo Sapiens
ISEKVSEAW

SEQ ID NO: 1032869 - protein, 9 aa, Homo Sapiens
DSLMPSPFQ

SEQ ID NO: 1032870 - protein, 9 aa, Homo Sapiens
AGPCRWPLP

SEQ ID NO: 1032871 - protein, 9 aa, Homo Sapiens
RGIRGREIR

SEQ ID NO: 1032872 - protein, 9 aa, Homo Sapiens
RHGELTACM

SEQ ID NO: 1032873 - protein, 9 aa, Homo Sapiens
PSGGTECFW

SEQ ID NO: 1032874 - protein, 9 aa, Homo Sapiens
PDPSPEAAQ

SEQ ID NO: 1032875 - protein, 9 aa, Homo Sapiens
YIEFLVLIF

SEQ ID NO: 1032876 - protein, 9 aa, Homo Sapiens
VEKNQCLNC

SEQ ID NO: 1032877 - protein, 9 aa, Homo Sapiens
RLPDLINNA

SEQ ID NO: 1032878 - protein, 9 aa, Homo Sapiens
NGADLPNHR

SEQ ID NO: 1032879 - protein, 9 aa, Homo Sapiens
NPHWEENTV

SEQ ID NO: 1032880 - protein, 9 aa, Homo Sapiens
MIKGSGLKH

SEQ ID NO: 1032881 - protein, 9 aa, Homo Sapiens
YFKCKKIMI

SEQ ID NO: 1032882 - protein, 9 aa, Homo Sapiens
QYSREEEFM

SEQ ID NO: 1032883 - protein, 9 aa, Homo Sapiens
QEKYSKATL

SEQ ID NO: 1032884 - protein, 9 aa, Homo Sapiens
GCFAPTELS

SEQ ID NO: 1032885 - protein, 9 aa, Homo Sapiens
FNSFGDDEE

SEQ ID NO: 1032886 - protein, 9 aa, Homo Sapiens
AATHLESDY

SEQ ID NO: 1032887 - protein, 9 aa, Homo Sapiens
TTSRSGHCA

SEQ ID NO: 1032888 - protein, 9 aa, Homo Sapiens
KFKSALRRT

SEQ ID NO: 1032889 - protein, 9 aa, Homo Sapiens
VAVFEISDP

SEQ ID NO: 1032890 - protein, 9 aa, Homo Sapiens
CVIDGIGKM

SEQ ID NO: 1032891 - protein, 9 aa, Homo Sapiens
FFSSNTTSL

SEQ ID NO: 1032892 - protein, 9 aa, Homo Sapiens
RAAALPEKT

SEQ ID NO: 1032893 - protein, 9 aa, Homo Sapiens
DNKLYLSIV

SEQ ID NO: 1032894 - protein, 9 aa, Homo Sapiens
LSHATLYWY

SEQ ID NO: 1032895 - protein, 9 aa, Homo Sapiens
PEPDISKEE

SEQ ID NO: 1032896 - protein, 9 aa, Homo Sapiens
PRRGSLKRA

SEQ ID NO: 1032897 - protein, 9 aa, Homo Sapiens
RQMAANLLA

SEQ ID NO: 1032898 - protein, 9 aa, Homo Sapiens
GVSGPFPAQ

SEQ ID NO: 1032899 - protein, 9 aa, Homo Sapiens
FETLAEDAV

SEQ ID NO: 1032900 - protein, 9 aa, Homo Sapiens
GNSSSPSPK

SEQ ID NO: 1032901 - protein, 9 aa, Homo Sapiens
LPELLNLVH

SEQ ID NO: 1032902 - protein, 9 aa, Homo Sapiens
LSALQTFRV

SEQ ID NO: 1032903 - protein, 9 aa, Homo Sapiens
EAGYFTHMV

SEQ ID NO: 1032904 - protein, 9 aa, Homo Sapiens
KAFTQCSHF

SEQ ID NO: 1032905 - protein, 9 aa, Homo Sapiens
SSLQISMYY

SEQ ID NO: 1032906 - protein, 9 aa, Homo Sapiens
AYLIEGLIA

SEQ ID NO: 1032907 - protein, 9 aa, Homo Sapiens
PWGGLSGFL

SEQ ID NO: 1032908 - protein, 9 aa, Homo Sapiens
RPGPPVLAG

SEQ ID NO: 1032909 - protein, 9 aa, Homo Sapiens
PEKQLGIKL

SEQ ID NO: 1032910 - protein, 9 aa, Homo Sapiens
NIAVTPLKR

SEQ ID NO: 1032911 - protein, 9 aa, Homo Sapiens
LQKLGGLPE

SEQ ID NO: 1032912 - protein, 9 aa, Homo Sapiens
TGVDASKVV

SEQ ID NO: 1032913 - protein, 9 aa, Homo Sapiens
DVVCISLAN

SEQ ID NO: 1032914 - protein, 9 aa, Homo Sapiens
SIALVRDLN

SEQ ID NO: 1032915 - protein, 9 aa, Homo Sapiens
ILNATLRNN

SEQ ID NO: 1032916 - protein, 9 aa, Homo Sapiens
NRGISSEIF

SEQ ID NO: 1032917 - protein, 9 aa, Homo Sapiens
RPYHQEPYV

SEQ ID NO: 1032918 - protein, 9 aa, Homo Sapiens
CSRGLAQLF

SEQ ID NO: 1032919 - protein, 9 aa, Homo Sapiens
QDNISVSSS

SEQ ID NO: 1032920 - protein, 9 aa, Homo Sapiens
YYATIPNRI

SEQ ID NO: 1032921 - protein, 9 aa, Homo Sapiens
NRVDLYHEN

SEQ ID NO: 1032922 - protein, 9 aa, Homo Sapiens
SPNRHLYNF

SEQ ID NO: 1032923 - protein, 9 aa, Homo Sapiens
LAFATKQDP

SEQ ID NO: 1032924 - protein, 9 aa, Homo Sapiens
SPHPRGLRI

SEQ ID NO: 1032925 - protein, 9 aa, Homo Sapiens
KKLEVQLQT

SEQ ID NO: 1032926 - protein, 9 aa, Homo Sapiens
EGRERDHKL

SEQ ID NO: 1032927 - protein, 9 aa, Homo Sapiens
SFIVQYKDR

SEQ ID NO: 1032928 - protein, 9 aa, Homo Sapiens
PASFSFMPR

SEQ ID NO: 1032929 - protein, 9 aa, Homo Sapiens
GRDARDSDC

SEQ ID NO: 1032930 - protein, 9 aa, Homo Sapiens
NKIIEVLEF

SEQ ID NO: 1032931 - protein, 9 aa, Homo Sapiens
TNNVLAFGT

SEQ ID NO: 1032932 - protein, 9 aa, Homo Sapiens
LMFKKHQLS

SEQ ID NO: 1032933 - protein, 9 aa, Homo Sapiens
TLQFAYLEN

SEQ ID NO: 1032934 - protein, 9 aa, Homo Sapiens
ETFLGDREK

SEQ ID NO: 1032935 - protein, 9 aa, Homo Sapiens
QRAFARCLP

SEQ ID NO: 1032936 - protein, 9 aa, Homo Sapiens
EFGSLREKD

SEQ ID NO: 1032937 - protein, 9 aa, Homo Sapiens
EVVFDVVSL

SEQ ID NO: 1032938 - protein, 9 aa, Homo Sapiens
NPGKVPAFL

SEQ ID NO: 1032939 - protein, 9 aa, Homo Sapiens
RACCDEGKR

SEQ ID NO: 1032940 - protein, 9 aa, Homo Sapiens
RGGQREEDD

SEQ ID NO: 1032941 - protein, 9 aa, Homo Sapiens
DVIYARQAY

SEQ ID NO: 1032942 - protein, 9 aa, Homo Sapiens
PILFPRFPW

SEQ ID NO: 1032943 - protein, 9 aa, Homo Sapiens
PWTQKKFDR

SEQ ID NO: 1032944 - protein, 9 aa, Homo Sapiens
SYKTTTDCP

SEQ ID NO: 1032945 - protein, 9 aa, Homo Sapiens
SVQNGNLSH

SEQ ID NO: 1032946 - protein, 9 aa, Homo Sapiens
DSSSLLGIL

SEQ ID NO: 1032947 - protein, 9 aa, Homo Sapiens
ARPQIFSVE

SEQ ID NO: 1032948 - protein, 9 aa, Homo Sapiens
FPIKSSLQA

SEQ ID NO: 1032949 - protein, 9 aa, Homo Sapiens
KESGASVNE

SEQ ID NO: 1032950 - protein, 9 aa, Homo Sapiens
FLLSADSSS

SEQ ID NO: 1032951 - protein, 9 aa, Homo Sapiens
LLMGTPVLR

SEQ ID NO: 1032952 - protein, 9 aa, Homo Sapiens
IPRTVPVLK

SEQ ID NO: 1032953 - protein, 9 aa, Homo Sapiens
EEAVMRRLH

SEQ ID NO: 1032954 - protein, 9 aa, Homo Sapiens
EQVCLHDLV

SEQ ID NO: 1032955 - protein, 9 aa, Homo Sapiens
LVVLLIVFR

SEQ ID NO: 1032956 - protein, 9 aa, Homo Sapiens
PNVRPWHRE

SEQ ID NO: 1032957 - protein, 9 aa, Homo Sapiens
AAPPSPPGE

SEQ ID NO: 1032958 - protein, 9 aa, Homo Sapiens
GSEQVQFSR

SEQ ID NO: 1032959 - protein, 9 aa, Homo Sapiens
LFHRMAPEE

SEQ ID NO: 1032960 - protein, 9 aa, Homo Sapiens
SLLFLLAMR

SEQ ID NO: 1032961 - protein, 9 aa, Homo Sapiens
DTQLPFDDS

SEQ ID NO: 1032962 - protein, 9 aa, Homo Sapiens
HKIVIFMFA

SEQ ID NO: 1032963 - protein, 9 aa, Homo Sapiens
PSVVHTGGA

SEQ ID NO: 1032964 - protein, 9 aa, Homo Sapiens
LFCELREGE

SEQ ID NO: 1032965 - protein, 9 aa, Homo Sapiens
GGGYVQLLK

SEQ ID NO: 1032966 - protein, 9 aa, Homo Sapiens
LLSPSQGQS

SEQ ID NO: 1032967 - protein, 9 aa, Homo Sapiens
RTEGFIRLN

SEQ ID NO: 1032968 - protein, 9 aa, Homo Sapiens
CDFHPLPPS

SEQ ID NO: 1032969 - protein, 9 aa, Homo Sapiens
RRAVAALSA

SEQ ID NO: 1032970 - protein, 9 aa, Homo Sapiens
LFAMSPADK

SEQ ID NO: 1032971 - protein, 9 aa, Homo Sapiens
SCFWLLVIF

SEQ ID NO: 1032972 - protein, 9 aa, Homo Sapiens
LEAVTEEQA

SEQ ID NO: 1032973 - protein, 9 aa, Homo Sapiens
QKKEFVTKV

SEQ ID NO: 1032974 - protein, 9 aa, Homo Sapiens
FSFHSAPAL

SEQ ID NO: 1032975 - protein, 9 aa, Homo Sapiens
TCGTGAFDL

SEQ ID NO: 1032976 - protein, 9 aa, Homo Sapiens
LSAQIQKPP

SEQ ID NO: 1032977 - protein, 9 aa, Homo Sapiens
AVLSMDNNR

SEQ ID NO: 1032978 - protein, 9 aa, Homo Sapiens
MTQLFTKHF

SEQ ID NO: 1032979 - protein, 9 aa, Homo Sapiens
FKCKKIMIE

SEQ ID NO: 1032980 - protein, 9 aa, Homo Sapiens
WEVQLEQME

SEQ ID NO: 1032981 - protein, 9 aa, Homo Sapiens
TTCTKDRIQ

SEQ ID NO: 1032982 - protein, 9 aa, Homo Sapiens
EDKDHWDKV

SEQ ID NO: 1032983 - protein, 9 aa, Homo Sapiens
LIFVFINSL

SEQ ID NO: 1032984 - protein, 9 aa, Homo Sapiens
LDQSVWVVK

SEQ ID NO: 1032985 - protein, 9 aa, Homo Sapiens
LSRSLMRTL

SEQ ID NO: 1032986 - protein, 9 aa, Homo Sapiens
FNTEAVGFS

SEQ ID NO: 1032987 - protein, 9 aa, Homo Sapiens
PSGARFESP

SEQ ID NO: 1032988 - protein, 9 aa, Homo Sapiens
PRGLRISPR

SEQ ID NO: 1032989 - protein, 9 aa, Homo Sapiens
LVKPVDVVD

SEQ ID NO: 1032990 - protein, 9 aa, Homo Sapiens
NNSEHQTNV

SEQ ID NO: 1032991 - protein, 9 aa, Homo Sapiens
TKRLSYCKG

SEQ ID NO: 1032992 - protein, 9 aa, Homo Sapiens
LYLMVILIG

SEQ ID NO: 1032993 - protein, 9 aa, Homo Sapiens
CEENTQHLL

SEQ ID NO: 1032994 - protein, 9 aa, Homo Sapiens
YQRLVREIA

SEQ ID NO: 1032995 - protein, 9 aa, Homo Sapiens
QEDLERLGV

SEQ ID NO: 1032996 - protein, 9 aa, Homo Sapiens
TSLSMSKDN

SEQ ID NO: 1032997 - protein, 9 aa, Homo Sapiens
RDRRRRKLE

SEQ ID NO: 1032998 - protein, 9 aa, Homo Sapiens
RLYEIGENI

SEQ ID NO: 1032999 - protein, 9 aa, Homo Sapiens
KKQGQDYRL

SEQ ID NO: 1033000 - protein, 9 aa, Homo Sapiens
FAALLAQFV

SEQ ID NO: 1033001 - protein, 9 aa, Homo Sapiens
PLPLLSRVP

SEQ ID NO: 1033002 - protein, 9 aa, Homo Sapiens
LEKASIEHE

SEQ ID NO: 1033003 - protein, 9 aa, Homo Sapiens
QLEQMESTN

SEQ ID NO: 1033004 - protein, 9 aa, Homo Sapiens
IEEMGMTFS

SEQ ID NO: 1033005 - protein, 9 aa, Homo Sapiens
RQKEKIREQ

SEQ ID NO: 1033006 - protein, 9 aa, Homo Sapiens
SDHPQPIDS

SEQ ID NO: 1033007 - protein, 9 aa, Homo Sapiens
SITQISILT

SEQ ID NO: 1033008 - protein, 9 aa, Homo Sapiens
NSFDEDDVS

SEQ ID NO: 1033009 - protein, 9 aa, Homo Sapiens
YLIEGLIAL

SEQ ID NO: 1033010 - protein, 9 aa, Homo Sapiens
SSNQQVFDW

SEQ ID NO: 1033011 - protein, 9 aa, Homo Sapiens
KFIEADAPK

SEQ ID NO: 1033012 - protein, 9 aa, Homo Sapiens
DALNDKINF

SEQ ID NO: 1033013 - protein, 9 aa, Homo Sapiens
QPRAYSFPV

SEQ ID NO: 1033014 - protein, 9 aa, Homo Sapiens
RANIFLRQK

SEQ ID NO: 1033015 - protein, 9 aa, Homo Sapiens
PGEGIAGLL

SEQ ID NO: 1033016 - protein, 9 aa, Homo Sapiens
MKERNVFCG

SEQ ID NO: 1033017 - protein, 9 aa, Homo Sapiens
HSGSRHHET

SEQ ID NO: 1033018 - protein, 9 aa, Homo Sapiens
LSVGNKRMS

SEQ ID NO: 1033019 - protein, 9 aa, Homo Sapiens
LNVKATGYQ

SEQ ID NO: 1033020 - protein, 9 aa, Homo Sapiens
KPFSNGSLV

SEQ ID NO: 1033021 - protein, 9 aa, Homo Sapiens
TIKNSLLKQ

SEQ ID NO: 1033022 - protein, 9 aa, Homo Sapiens
LSLDQGWTL

SEQ ID NO: 1033023 - protein, 9 aa, Homo Sapiens
LVMDKKNQE

SEQ ID NO: 1033024 - protein, 9 aa, Homo Sapiens
VGSPDKEDG

SEQ ID NO: 1033025 - protein, 9 aa, Homo Sapiens
TCVPAYVNW

SEQ ID NO: 1033026 - protein, 9 aa, Homo Sapiens
NDGARSMAE

SEQ ID NO: 1033027 - protein, 9 aa, Homo Sapiens
FFFFGFFLT

SEQ ID NO: 1033028 - protein, 9 aa, Homo Sapiens
TEIGKRGLN

SEQ ID NO: 1033029 - protein, 9 aa, Homo Sapiens
HPRKRTRSV

SEQ ID NO: 1033030 - protein, 9 aa, Homo Sapiens
LIIVEECQR

SEQ ID NO: 1033031 - protein, 9 aa, Homo Sapiens
KTAFIGTLG

SEQ ID NO: 1033032 - protein, 9 aa, Homo Sapiens
CLDWKPWSK

SEQ ID NO: 1033033 - protein, 9 aa, Homo Sapiens
YRIIAQEII

SEQ ID NO: 1033034 - protein, 9 aa, Homo Sapiens
KKQFNSFGD

SEQ ID NO: 1033035 - protein, 9 aa, Homo Sapiens
SSSPTEHVK

SEQ ID NO: 1033036 - protein, 9 aa, Homo Sapiens
TLFLPHFLE

SEQ ID NO: 1033037 - protein, 9 aa, Homo Sapiens
RGRGIRGRE

SEQ ID NO: 1033038 - protein, 9 aa, Homo Sapiens
SFLAEAENM

SEQ ID NO: 1033039 - protein, 9 aa, Homo Sapiens
LIFVSHPDA

SEQ ID NO: 1033040 - protein, 9 aa, Homo Sapiens
QKDRGPVLL

SEQ ID NO: 1033041 - protein, 9 aa, Homo Sapiens
EESTSVHDS

SEQ ID NO: 1033042 - protein, 9 aa, Homo Sapiens
VAASQDNIS

SEQ ID NO: 1033043 - protein, 9 aa, Homo Sapiens
ILIRILYGR

SEQ ID NO: 1033044 - protein, 9 aa, Homo Sapiens
KQFSCLSLL

SEQ ID NO: 1033045 - protein, 9 aa, Homo Sapiens
SPELHLKPL

SEQ ID NO: 1033046 - protein, 9 aa, Homo Sapiens
SGCNSDHWG

SEQ ID NO: 1033047 - protein, 9 aa, Homo Sapiens
RHLSFFLYR

SEQ ID NO: 1033048 - protein, 9 aa, Homo Sapiens
KFDKGVRKA

SEQ ID NO: 1033049 - protein, 9 aa, Homo Sapiens
TKEPRIRNI

SEQ ID NO: 1033050 - protein, 9 aa, Homo Sapiens
ECLESGAFF

SEQ ID NO: 1033051 - protein, 9 aa, Homo Sapiens
EEMGMTFSS

SEQ ID NO: 1033052 - protein, 9 aa, Homo Sapiens
PNNETLFTI

SEQ ID NO: 1033053 - protein, 9 aa, Homo Sapiens
VKGLDPSSP

SEQ ID NO: 1033054 - protein, 9 aa, Homo Sapiens
KSLPFMLCV

SEQ ID NO: 1033055 - protein, 9 aa, Homo Sapiens
LPYYSAYVP

SEQ ID NO: 1033056 - protein, 9 aa, Homo Sapiens
IQVVEANDN

SEQ ID NO: 1033057 - protein, 9 aa, Homo Sapiens
APSKRALGP

SEQ ID NO: 1033058 - protein, 9 aa, Homo Sapiens
LATVGSDDR

SEQ ID NO: 1033059 - protein, 9 aa, Homo Sapiens
NGYPRYSSF

SEQ ID NO: 1033060 - protein, 9 aa, Homo Sapiens
FATKQDPPD

SEQ ID NO: 1033061 - protein, 9 aa, Homo Sapiens
LPGEGIAGL

SEQ ID NO: 1033062 - protein, 9 aa, Homo Sapiens
LLGKAEVDV

SEQ ID NO: 1033063 - protein, 9 aa, Homo Sapiens
LLGFRSPLS

SEQ ID NO: 1033064 - protein, 9 aa, Homo Sapiens
TTEVSEGLQ

SEQ ID NO: 1033065 - protein, 9 aa, Homo Sapiens
RHLFEKKLA

SEQ ID NO: 1033066 - protein, 9 aa, Homo Sapiens
LEQMESTNL

SEQ ID NO: 1033067 - protein, 9 aa, Homo Sapiens
ARSAAESGG

SEQ ID NO: 1033068 - protein, 9 aa, Homo Sapiens
TIWPDRKIL

SEQ ID NO: 1033069 - protein, 9 aa, Homo Sapiens
TQADSSFAT

SEQ ID NO: 1033070 - protein, 9 aa, Homo Sapiens
AETGQSCPT

SEQ ID NO: 1033071 - protein, 9 aa, Homo Sapiens
GDNAAEEAG

SEQ ID NO: 1033072 - protein, 9 aa, Homo Sapiens
GSSNQQVFD

SEQ ID NO: 1033073 - protein, 9 aa, Homo Sapiens
CVQDKIFRA

SEQ ID NO: 1033074 - protein, 9 aa, Homo Sapiens
DKVKEEMTS

SEQ ID NO: 1033075 - protein, 9 aa, Homo Sapiens
TPSHLQAEP

SEQ ID NO: 1033076 - protein, 9 aa, Homo Sapiens
PAMEPTNGR

SEQ ID NO: 1033077 - protein, 9 aa, Homo Sapiens
DSAKCIWTL

SEQ ID NO: 1033078 - protein, 9 aa, Homo Sapiens
YPVISCAKT

SEQ ID NO: 1033079 - protein, 9 aa, Homo Sapiens
VRHSFPHQP

SEQ ID NO: 1033080 - protein, 9 aa, Homo Sapiens
SSLENLTFN

SEQ ID NO: 1033081 - protein, 9 aa, Homo Sapiens
KLDQQFRKR

SEQ ID NO: 1033082 - protein, 9 aa, Homo Sapiens
VTLVAPKEP

SEQ ID NO: 1033083 - protein, 9 aa, Homo Sapiens
LAIGTLYFN

SEQ ID NO: 1033084 - protein, 9 aa, Homo Sapiens
PPQASLPAA

SEQ ID NO: 1033085 - protein, 9 aa, Homo Sapiens
GRPPSQDLG

SEQ ID NO: 1033086 - protein, 9 aa, Homo Sapiens
SWPGHVALI

SEQ ID NO: 1033087 - protein, 9 aa, Homo Sapiens
IAIRNTESQ

SEQ ID NO: 1033088 - protein, 9 aa, Homo Sapiens
ALTSVAELE

SEQ ID NO: 1033089 - protein, 9 aa, Homo Sapiens
LVFQLGQFT

SEQ ID NO: 1033090 - protein, 9 aa, Homo Sapiens
IGPPGPTEP

SEQ ID NO: 1033091 - protein, 9 aa, Homo Sapiens
SEHKTFKFT

SEQ ID NO: 1033092 - protein, 9 aa, Homo Sapiens
PGPAAPCAD

SEQ ID NO: 1033093 - protein, 9 aa, Homo Sapiens
SRVHSGERL

SEQ ID NO: 1033094 - protein, 9 aa, Homo Sapiens
SPGSEQTLF

SEQ ID NO: 1033095 - protein, 9 aa, Homo Sapiens
IQQLKRNLH

SEQ ID NO: 1033096 - protein, 9 aa, Homo Sapiens
LRPRLAEPY

SEQ ID NO: 1033097 - protein, 9 aa, Homo Sapiens
PHPHLAPEY

SEQ ID NO: 1033098 - protein, 9 aa, Homo Sapiens
AFPITSIFH

SEQ ID NO: 1033099 - protein, 9 aa, Homo Sapiens
AHFCYQNLW

SEQ ID NO: 1033100 - protein, 9 aa, Homo Sapiens
SFNSAHDTD

SEQ ID NO: 1033101 - protein, 9 aa, Homo Sapiens
MNHRDLLQP

SEQ ID NO: 1033102 - protein, 9 aa, Homo Sapiens
KNPEWEKAR

SEQ ID NO: 1033103 - protein, 9 aa, Homo Sapiens
SHLENRARR

SEQ ID NO: 1033104 - protein, 9 aa, Homo Sapiens
GTLAFGLFT

SEQ ID NO: 1033105 - protein, 9 aa, Homo Sapiens
KAFYEGGRC

SEQ ID NO: 1033106 - protein, 9 aa, Homo Sapiens
RKALAIVFF

SEQ ID NO: 1033107 - protein, 9 aa, Homo Sapiens
HKGEFTCHA

SEQ ID NO: 1033108 - protein, 9 aa, Homo Sapiens
SDNGVVVYV

SEQ ID NO: 1033109 - protein, 9 aa, Homo Sapiens
QQLKRNLHF

SEQ ID NO: 1033110 - protein, 9 aa, Homo Sapiens
YRMLFAWAV

SEQ ID NO: 1033111 - protein, 9 aa, Homo Sapiens
QRLYEIGEN

SEQ ID NO: 1033112 - protein, 9 aa, Homo Sapiens
RVAIAALKV

SEQ ID NO: 1033113 - protein, 9 aa, Homo Sapiens
RNTPAKSLE

SEQ ID NO: 1033114 - protein, 9 aa, Homo Sapiens
CVESSLLVP

SEQ ID NO: 1033115 - protein, 9 aa, Homo Sapiens
EHVYDRING

SEQ ID NO: 1033116 - protein, 9 aa, Homo Sapiens
GPFSAGPLA

SEQ ID NO: 1033117 - protein, 9 aa, Homo Sapiens
ETLFTIVGT

SEQ ID NO: 1033118 - protein, 9 aa, Homo Sapiens
HTTVTMRWR

SEQ ID NO: 1033119 - protein, 9 aa, Homo Sapiens
VDDNSSNEK

SEQ ID NO: 1033120 - protein, 9 aa, Homo Sapiens
LGLFLTSDA

SEQ ID NO: 1033121 - protein, 9 aa, Homo Sapiens
KITISGRCQ

SEQ ID NO: 1033122 - protein, 9 aa, Homo Sapiens
LDQEEEAEL

SEQ ID NO: 1033123 - protein, 9 aa, Homo Sapiens
EPLILNLEK

SEQ ID NO: 1033124 - protein, 9 aa, Homo Sapiens
LRYPLSYKA

SEQ ID NO: 1033125 - protein, 9 aa, Homo Sapiens
ATLQFAYLE

SEQ ID NO: 1033126 - protein, 9 aa, Homo Sapiens
SPGTPRKTK

SEQ ID NO: 1033127 - protein, 9 aa, Homo Sapiens
CTEKHSTMP

SEQ ID NO: 1033128 - protein, 9 aa, Homo Sapiens
WPGKDSKHP

SEQ ID NO: 1033129 - protein, 9 aa, Homo Sapiens
KKDTLKQHG

SEQ ID NO: 1033130 - protein, 9 aa, Homo Sapiens
CATQKDRGP

SEQ ID NO: 1033131 - protein, 9 aa, Homo Sapiens
NIIKLSHKK

SEQ ID NO: 1033132 - protein, 9 aa, Homo Sapiens
EGKTSELRT

SEQ ID NO: 1033133 - protein, 9 aa, Homo Sapiens
MQDTQLPFD

SEQ ID NO: 1033134 - protein, 9 aa, Homo Sapiens
HQVIGYRNA

SEQ ID NO: 1033135 - protein, 9 aa, Homo Sapiens
LLYGEPPKF

SEQ ID NO: 1033136 - protein, 9 aa, Homo Sapiens
EKAAKNGAL

SEQ ID NO: 1033137 - protein, 9 aa, Homo Sapiens
RHVALYQAR

SEQ ID NO: 1033138 - protein, 9 aa, Homo Sapiens
GFPGESRPK

SEQ ID NO: 1033139 - protein, 9 aa, Homo Sapiens
KYKLNSEGT

SEQ ID NO: 1033140 - protein, 9 aa, Homo Sapiens
NINIPLLPM

SEQ ID NO: 1033141 - protein, 9 aa, Homo Sapiens
NWIRRNDKV

SEQ ID NO: 1033142 - protein, 9 aa, Homo Sapiens
EAPAQLPCS

SEQ ID NO: 1033143 - protein, 9 aa, Homo Sapiens
LVYWATYLY

SEQ ID NO: 1033144 - protein, 9 aa, Homo Sapiens
NIQELLENT

SEQ ID NO: 1033145 - protein, 9 aa, Homo Sapiens
LLGEVDRTK

SEQ ID NO: 1033146 - protein, 9 aa, Homo Sapiens
FGCFAPTEL

SEQ ID NO: 1033147 - protein, 9 aa, Homo Sapiens
SEVTSLSST

SEQ ID NO: 1033148 - protein, 9 aa, Homo Sapiens
RPSGARFES

SEQ ID NO: 1033149 - protein, 9 aa, Homo Sapiens
TLAFGLFTA

SEQ ID NO: 1033150 - protein, 9 aa, Homo Sapiens
KVQNFLGLK

SEQ ID NO: 1033151 - protein, 9 aa, Homo Sapiens
LNINLKMEV

SEQ ID NO: 1033152 - protein, 9 aa, Homo Sapiens
QRKQELREW

SEQ ID NO: 1033153 - protein, 9 aa, Homo Sapiens
CGKEFSSST

SEQ ID NO: 1033154 - protein, 9 aa, Homo Sapiens
ALVNGKWQE

SEQ ID NO: 1033155 - protein, 9 aa, Homo Sapiens
QYTKEPRIR

SEQ ID NO: 1033156 - protein, 9 aa, Homo Sapiens
QEKNALRKQ

SEQ ID NO: 1033157 - protein, 9 aa, Homo Sapiens
SILRIFSAG

SEQ ID NO: 1033158 - protein, 9 aa, Homo Sapiens
KSALYRRAD

SEQ ID NO: 1033159 - protein, 9 aa, Homo Sapiens
LVGRQDCPT

SEQ ID NO: 1033160 - protein, 9 aa, Homo Sapiens
WSGISKPVR

SEQ ID NO: 1033161 - protein, 9 aa, Homo Sapiens
RPNFFPISE

SEQ ID NO: 1033162 - protein, 9 aa, Homo Sapiens
LECPFSFAM

SEQ ID NO: 1033163 - protein, 9 aa, Homo Sapiens
ISLLQAQVF

SEQ ID NO: 1033164 - protein, 9 aa, Homo Sapiens
TPAKSLEKF

SEQ ID NO: 1033165 - protein, 9 aa, Homo Sapiens
VLNTLESRL

SEQ ID NO: 1033166 - protein, 9 aa, Homo Sapiens
FGLGAVVSQ

SEQ ID NO: 1033167 - protein, 9 aa, Homo Sapiens
SQAQMYLGP

SEQ ID NO: 1033168 - protein, 9 aa, Homo Sapiens
TFFWPMSPG

SEQ ID NO: 1033169 - protein, 9 aa, Homo Sapiens
QRNGSEGNI

SEQ ID NO: 1033170 - protein, 9 aa, Homo Sapiens
NGTIIFIIL

SEQ ID NO: 1033171 - protein, 9 aa, Homo Sapiens
NTPAKSLEK

SEQ ID NO: 1033172 - protein, 9 aa, Homo Sapiens
LPYDSLQTY

SEQ ID NO: 1033173 - protein, 9 aa, Homo Sapiens
SLLSLLDEE

SEQ ID NO: 1033174 - protein, 9 aa, Homo Sapiens
YRTFIFPEE

SEQ ID NO: 1033175 - protein, 9 aa, Homo Sapiens
PPFLNSLVY

SEQ ID NO: 1033176 - protein, 9 aa, Homo Sapiens
HERKGSNKR

SEQ ID NO: 1033177 - protein, 9 aa, Homo Sapiens
YFVPTNTKQ

SEQ ID NO: 1033178 - protein, 9 aa, Homo Sapiens
DNTPVFPMA

SEQ ID NO: 1033179 - protein, 9 aa, Homo Sapiens
RSILISRRH

SEQ ID NO: 1033180 - protein, 9 aa, Homo Sapiens
CLQKFNIME

SEQ ID NO: 1033181 - protein, 9 aa, Homo Sapiens
DGPEGPKSR

SEQ ID NO: 1033182 - protein, 9 aa, Homo Sapiens
SIELDMAVS

SEQ ID NO: 1033183 - protein, 9 aa, Homo Sapiens
AKNCGIAIP

SEQ ID NO: 1033184 - protein, 9 aa, Homo Sapiens
LFPRFPWFR

SEQ ID NO: 1033185 - protein, 9 aa, Homo Sapiens
TLQIKDFLE

SEQ ID NO: 1033186 - protein, 9 aa, Homo Sapiens
NRKVFNEHS

SEQ ID NO: 1033187 - protein, 9 aa, Homo Sapiens
LADVPGQPG

SEQ ID NO: 1033188 - protein, 9 aa, Homo Sapiens
CEERRGAFW

SEQ ID NO: 1033189 - protein, 9 aa, Homo Sapiens
SEIERVRRN

SEQ ID NO: 1033190 - protein, 9 aa, Homo Sapiens
LSNNYQQQQ

SEQ ID NO: 1033191 - protein, 9 aa, Homo Sapiens
SYHDLVPSD

SEQ ID NO: 1033192 - protein, 9 aa, Homo Sapiens
SSFGDASSH

SEQ ID NO: 1033193 - protein, 9 aa, Homo Sapiens
ISNELRDKV

SEQ ID NO: 1033194 - protein, 9 aa, Homo Sapiens
LSRVPPPPP

SEQ ID NO: 1033195 - protein, 9 aa, Homo Sapiens
HRGSFFLGE

SEQ ID NO: 1033196 - protein, 9 aa, Homo Sapiens
SSDGAPLSH

SEQ ID NO: 1033197 - protein, 9 aa, Homo Sapiens
CRRHQKIKN

SEQ ID NO: 1033198 - protein, 9 aa, Homo Sapiens
GIYLCSVGS

SEQ ID NO: 1033199 - protein, 9 aa, Homo Sapiens
DSPAEAFLA

SEQ ID NO: 1033200 - protein, 9 aa, Homo Sapiens
VFINSLYVY

SEQ ID NO: 1033201 - protein, 9 aa, Homo Sapiens
ILDPFAPEP

SEQ ID NO: 1033202 - protein, 9 aa, Homo Sapiens
PRKKIEDPP

SEQ ID NO: 1033203 - protein, 9 aa, Homo Sapiens
ASAICKLMR

SEQ ID NO: 1033204 - protein, 9 aa, Homo Sapiens
EFCCQVQGD

SEQ ID NO: 1033205 - protein, 9 aa, Homo Sapiens
IEGDRGPKG

SEQ ID NO: 1033206 - protein, 9 aa, Homo Sapiens
EESYECSCS

SEQ ID NO: 1033207 - protein, 9 aa, Homo Sapiens
SLLKNCIGD

SEQ ID NO: 1033208 - protein, 9 aa, Homo Sapiens
SKGIHALSE

SEQ ID NO: 1033209 - protein, 9 aa, Homo Sapiens
KMHRALHKA

SEQ ID NO: 1033210 - protein, 9 aa, Homo Sapiens
WIDKGLKYD

SEQ ID NO: 1033211 - protein, 9 aa, Homo Sapiens
RAFARCLPS

SEQ ID NO: 1033212 - protein, 9 aa, Homo Sapiens
LKLQDIMTS

SEQ ID NO: 1033213 - protein, 9 aa, Homo Sapiens
ENGEVGSLL

SEQ ID NO: 1033214 - protein, 9 aa, Homo Sapiens
ATNSWDGVV

SEQ ID NO: 1033215 - protein, 9 aa, Homo Sapiens
FCGGSLISK

SEQ ID NO: 1033216 - protein, 9 aa, Homo Sapiens
ICLVSKGLG

SEQ ID NO: 1033217 - protein, 9 aa, Homo Sapiens
EVNQLLEQN

SEQ ID NO: 1033218 - protein, 9 aa, Homo Sapiens
HKKIYAGKK

SEQ ID NO: 1033219 - protein, 9 aa, Homo Sapiens
KQDPPDAKM

SEQ ID NO: 1033220 - protein, 9 aa, Homo Sapiens
WAKFTALYG

SEQ ID NO: 1033221 - protein, 9 aa, Homo Sapiens
EMGKKGEMG

SEQ ID NO: 1033222 - protein, 9 aa, Homo Sapiens
SHNALSGSS

SEQ ID NO: 1033223 - protein, 9 aa, Homo Sapiens
VFSPAWFSP

SEQ ID NO: 1033224 - protein, 9 aa, Homo Sapiens
NLSIHYKQQ

SEQ ID NO: 1033225 - protein, 9 aa, Homo Sapiens
PLLFFQATD

SEQ ID NO: 1033226 - protein, 9 aa, Homo Sapiens
HSVYKTYEL

SEQ ID NO: 1033227 - protein, 9 aa, Homo Sapiens
QQFRKRCEE

SEQ ID NO: 1033228 - protein, 9 aa, Homo Sapiens
MSVFHQEDL

SEQ ID NO: 1033229 - protein, 9 aa, Homo Sapiens
EKKFEHKLN

SEQ ID NO: 1033230 - protein, 9 aa, Homo Sapiens
QQKNPPPTK

SEQ ID NO: 1033231 - protein, 9 aa, Homo Sapiens
VPTTWEYND

SEQ ID NO: 1033232 - protein, 9 aa, Homo Sapiens
YVRKTFDCS

SEQ ID NO: 1033233 - protein, 9 aa, Homo Sapiens
KLREDARDP

SEQ ID NO: 1033234 - protein, 9 aa, Homo Sapiens
PPPPAASQE

SEQ ID NO: 1033235 - protein, 9 aa, Homo Sapiens
GQSCDLVSL

SEQ ID NO: 1033236 - protein, 9 aa, Homo Sapiens
IIFCYTFIV

SEQ ID NO: 1033237 - protein, 9 aa, Homo Sapiens
GVWQKVSAE

SEQ ID NO: 1033238 - protein, 9 aa, Homo Sapiens
ETTMPLSEA

SEQ ID NO: 1033239 - protein, 9 aa, Homo Sapiens
SRKSSKPRA

SEQ ID NO: 1033240 - protein, 9 aa, Homo Sapiens
PEIQALQEK

SEQ ID NO: 1033241 - protein, 9 aa, Homo Sapiens
FPYLKNGYN

SEQ ID NO: 1033242 - protein, 9 aa, Homo Sapiens
KIQLSLYTY

SEQ ID NO: 1033243 - protein, 9 aa, Homo Sapiens
EVMIKGSGL

SEQ ID NO: 1033244 - protein, 9 aa, Homo Sapiens
EAKPKSKLS

SEQ ID NO: 1033245 - protein, 9 aa, Homo Sapiens
ESEDVKRGS

SEQ ID NO: 1033246 - protein, 9 aa, Homo Sapiens
AGEGSDQKS

SEQ ID NO: 1033247 - protein, 9 aa, Homo Sapiens
TSWQESDTV

SEQ ID NO: 1033248 - protein, 9 aa, Homo Sapiens
HRQGKVISV

SEQ ID NO: 1033249 - protein, 9 aa, Homo Sapiens
CAECLKFKK

SEQ ID NO: 1033250 - protein, 9 aa, Homo Sapiens
FEGVDTVSK

SEQ ID NO: 1033251 - protein, 9 aa, Homo Sapiens
NSSSPSPKE

SEQ ID NO: 1033252 - protein, 9 aa, Homo Sapiens
DISKEELSP

SEQ ID NO: 1033253 - protein, 9 aa, Homo Sapiens
VPVGTAAVP

SEQ ID NO: 1033254 - protein, 9 aa, Homo Sapiens
CLRYYVGWA

SEQ ID NO: 1033255 - protein, 9 aa, Homo Sapiens
DIWLSLSSN

SEQ ID NO: 1033256 - protein, 9 aa, Homo Sapiens
AKYFSGRPL

SEQ ID NO: 1033257 - protein, 9 aa, Homo Sapiens
GLGKHRLAE

SEQ ID NO: 1033258 - protein, 9 aa, Homo Sapiens
WGRYRPSTF

SEQ ID NO: 1033259 - protein, 9 aa, Homo Sapiens
LYEIGENIG

SEQ ID NO: 1033260 - protein, 9 aa, Homo Sapiens
CLKAGTWRS

SEQ ID NO: 1033261 - protein, 9 aa, Homo Sapiens
GESKKEKIE

SEQ ID NO: 1033262 - protein, 9 aa, Homo Sapiens
LLFTELLNG

SEQ ID NO: 1033263 - protein, 9 aa, Homo Sapiens
AAALPEKTR

SEQ ID NO: 1033264 - protein, 9 aa, Homo Sapiens
QDSFPAQFG

SEQ ID NO: 1033265 - protein, 9 aa, Homo Sapiens
NLRRLSFCR

SEQ ID NO: 1033266 - protein, 9 aa, Homo Sapiens
INLRRLSFC

SEQ ID NO: 1033267 - protein, 9 aa, Homo Sapiens
QGMPGLGPI

SEQ ID NO: 1033268 - protein, 9 aa, Homo Sapiens
FAQVMRLCA

SEQ ID NO: 1033269 - protein, 9 aa, Homo Sapiens
EALLLQLGY

SEQ ID NO: 1033270 - protein, 9 aa, Homo Sapiens
IFLVCLAIC

SEQ ID NO: 1033271 - protein, 9 aa, Homo Sapiens
EDKKTRDLV

SEQ ID NO: 1033272 - protein, 9 aa, Homo Sapiens
RQRLQKMGF

SEQ ID NO: 1033273 - protein, 9 aa, Homo Sapiens
VPFPCDETE

SEQ ID NO: 1033274 - protein, 9 aa, Homo Sapiens
MEIFVKRQM

SEQ ID NO: 1033275 - protein, 9 aa, Homo Sapiens
ASRKSSKPR

SEQ ID NO: 1033276 - protein, 9 aa, Homo Sapiens
KEPGGGLFR

SEQ ID NO: 1033277 - protein, 9 aa, Homo Sapiens
VSVLNNMKT

SEQ ID NO: 1033278 - protein, 9 aa, Homo Sapiens
PSGWLYGPS

SEQ ID NO: 1033279 - protein, 9 aa, Homo Sapiens
VFSTNKEFH

SEQ ID NO: 1033280 - protein, 9 aa, Homo Sapiens
LPPTSDLPQ

SEQ ID NO: 1033281 - protein, 9 aa, Homo Sapiens
SLQPVPPTP

SEQ ID NO: 1033282 - protein, 9 aa, Homo Sapiens
CVVSDISAF

SEQ ID NO: 1033283 - protein, 9 aa, Homo Sapiens
SCVKVTGLQ

SEQ ID NO: 1033284 - protein, 9 aa, Homo Sapiens
TGSLQIRYS

SEQ ID NO: 1033285 - protein, 9 aa, Homo Sapiens
YSCEMCNFS

SEQ ID NO: 1033286 - protein, 9 aa, Homo Sapiens
MFILTPLLL

SEQ ID NO: 1033287 - protein, 9 aa, Homo Sapiens
QGPPPCPGK

SEQ ID NO: 1033288 - protein, 9 aa, Homo Sapiens
TVQFSIPQT

SEQ ID NO: 1033289 - protein, 9 aa, Homo Sapiens
CLFSLDKVH

SEQ ID NO: 1033290 - protein, 9 aa, Homo Sapiens
LRYYVGWAD

SEQ ID NO: 1033291 - protein, 9 aa, Homo Sapiens
MGLKKKFQK

SEQ ID NO: 1033292 - protein, 9 aa, Homo Sapiens
PSNGPSYGR

SEQ ID NO: 1033293 - protein, 9 aa, Homo Sapiens
PVADKILQK

SEQ ID NO: 1033294 - protein, 9 aa, Homo Sapiens
EKVPEGSIP

SEQ ID NO: 1033295 - protein, 9 aa, Homo Sapiens
IHTINLRRL

SEQ ID NO: 1033296 - protein, 9 aa, Homo Sapiens
EYCVCKMPC

SEQ ID NO: 1033297 - protein, 9 aa, Homo Sapiens
SENGEVGSL

SEQ ID NO: 1033298 - protein, 9 aa, Homo Sapiens
RVPPPPPLP

SEQ ID NO: 1033299 - protein, 9 aa, Homo Sapiens
EKQVQEAKN

SEQ ID NO: 1033300 - protein, 9 aa, Homo Sapiens
EETGVSHSQ

SEQ ID NO: 1033301 - protein, 9 aa, Homo Sapiens
IICKPVTVH

SEQ ID NO: 1033302 - protein, 9 aa, Homo Sapiens
DPMAQCLQR

SEQ ID NO: 1033303 - protein, 9 aa, Homo Sapiens
DGVTNPSHS

SEQ ID NO: 1033304 - protein, 9 aa, Homo Sapiens
LNDKINFLR

SEQ ID NO: 1033305 - protein, 9 aa, Homo Sapiens
TELQAKLSR

SEQ ID NO: 1033306 - protein, 9 aa, Homo Sapiens
LVHAICTKT

SEQ ID NO: 1033307 - protein, 9 aa, Homo Sapiens
TFYSHFPCT

SEQ ID NO: 1033308 - protein, 9 aa, Homo Sapiens
LGCPDGNLQ

SEQ ID NO: 1033309 - protein, 9 aa, Homo Sapiens
KSKSGSCSS

SEQ ID NO: 1033310 - protein, 9 aa, Homo Sapiens
ARQASLEEA

SEQ ID NO: 1033311 - protein, 9 aa, Homo Sapiens
PSGSALREQ

SEQ ID NO: 1033312 - protein, 9 aa, Homo Sapiens
IINSINKKL

SEQ ID NO: 1033313 - protein, 9 aa, Homo Sapiens
LPIIHNGHH

SEQ ID NO: 1033314 - protein, 9 aa, Homo Sapiens
SEEDLNRQW

SEQ ID NO: 1033315 - protein, 9 aa, Homo Sapiens
GLVKPVDVV

SEQ ID NO: 1033316 - protein, 9 aa, Homo Sapiens
PDPAGPEAG

SEQ ID NO: 1033317 - protein, 9 aa, Homo Sapiens
SAIFFGGLF

SEQ ID NO: 1033318 - protein, 9 aa, Homo Sapiens
GCATQKDRG

SEQ ID NO: 1033319 - protein, 9 aa, Homo Sapiens
PKGCESACR

SEQ ID NO: 1033320 - protein, 9 aa, Homo Sapiens
GRDSFLTCL

SEQ ID NO: 1033321 - protein, 9 aa, Homo Sapiens
SGSRENSTV

SEQ ID NO: 1033322 - protein, 9 aa, Homo Sapiens
AGGLLQPKR

SEQ ID NO: 1033323 - protein, 9 aa, Homo Sapiens
AGGVKPFKL

SEQ ID NO: 1033324 - protein, 9 aa, Homo Sapiens
MFSTPPSLE

SEQ ID NO: 1033325 - protein, 9 aa, Homo Sapiens
TGVKIELLE

SEQ ID NO: 1033326 - protein, 9 aa, Homo Sapiens
LCPRQNGPS

SEQ ID NO: 1033327 - protein, 9 aa, Homo Sapiens
KVYQLVSCP

SEQ ID NO: 1033328 - protein, 9 aa, Homo Sapiens
IPALSQLQN

SEQ ID NO: 1033329 - protein, 9 aa, Homo Sapiens
LMKYHTEAY

SEQ ID NO: 1033330 - protein, 9 aa, Homo Sapiens
VFFGVSEQQ

SEQ ID NO: 1033331 - protein, 9 aa, Homo Sapiens
NDNTPVFPM

SEQ ID NO: 1033332 - protein, 9 aa, Homo Sapiens
SVKGKKAPT

SEQ ID NO: 1033333 - protein, 9 aa, Homo Sapiens
ASQVPVEEI

SEQ ID NO: 1033334 - protein, 9 aa, Homo Sapiens
SPFVLYLLQ

SEQ ID NO: 1033335 - protein, 9 aa, Homo Sapiens
QQVFDWIEA

SEQ ID NO: 1033336 - protein, 9 aa, Homo Sapiens
ILFLEFCTY

SEQ ID NO: 1033337 - protein, 9 aa, Homo Sapiens
ATKQDPPDA

SEQ ID NO: 1033338 - protein, 9 aa, Homo Sapiens
IKTSEYSTV

SEQ ID NO: 1033339 - protein, 9 aa, Homo Sapiens
ILMVMAFDC

SEQ ID NO: 1033340 - protein, 9 aa, Homo Sapiens
QGPKGLVKP

SEQ ID NO: 1033341 - protein, 9 aa, Homo Sapiens
NSDIWLSLS

SEQ ID NO: 1033342 - protein, 9 aa, Homo Sapiens
VMPREASLG

SEQ ID NO: 1033343 - protein, 9 aa, Homo Sapiens
FKEQDLRKH

SEQ ID NO: 1033344 - protein, 9 aa, Homo Sapiens
KGLKYDGPI

SEQ ID NO: 1033345 - protein, 9 aa, Homo Sapiens
ALISVFGSD

SEQ ID NO: 1033346 - protein, 9 aa, Homo Sapiens
SQDKLPVLY

SEQ ID NO: 1033347 - protein, 9 aa, Homo Sapiens
EAFRSQLGD

SEQ ID NO: 1033348 - protein, 9 aa, Homo Sapiens
KTVRHSFPH

SEQ ID NO: 1033349 - protein, 9 aa, Homo Sapiens
DFESPKAGE

SEQ ID NO: 1033350 - protein, 9 aa, Homo Sapiens
LKFGIVPNG

SEQ ID NO: 1033351 - protein, 9 aa, Homo Sapiens
GFFDEKNFD

SEQ ID NO: 1033352 - protein, 9 aa, Homo Sapiens
PGLMLAIPA

SEQ ID NO: 1033353 - protein, 9 aa, Homo Sapiens
KALNKRFRM

SEQ ID NO: 1033354 - protein, 9 aa, Homo Sapiens
RDSPLSQMG

SEQ ID NO: 1033355 - protein, 9 aa, Homo Sapiens
YKFTEGTVV

SEQ ID NO: 1033356 - protein, 9 aa, Homo Sapiens
EATPGRRIR

SEQ ID NO: 1033357 - protein, 9 aa, Homo Sapiens
DEDCSDSFY

SEQ ID NO: 1033358 - protein, 9 aa, Homo Sapiens
ALIEEMGMT

SEQ ID NO: 1033359 - protein, 9 aa, Homo Sapiens
SGGNSAPFQ

SEQ ID NO: 1033360 - protein, 9 aa, Homo Sapiens
SLFCRPVCR

SEQ ID NO: 1033361 - protein, 9 aa, Homo Sapiens
LSGSSSWHG

SEQ ID NO: 1033362 - protein, 9 aa, Homo Sapiens
IIQHENIFS

SEQ ID NO: 1033363 - protein, 9 aa, Homo Sapiens
CFQALKDEF

SEQ ID NO: 1033364 - protein, 9 aa, Homo Sapiens
TEPKGISGH

SEQ ID NO: 1033365 - protein, 9 aa, Homo Sapiens
QELGIRLAA

SEQ ID NO: 1033366 - protein, 9 aa, Homo Sapiens
SIKISMTFF

SEQ ID NO: 1033367 - protein, 9 aa, Homo Sapiens
AVGRVLTRD

SEQ ID NO: 1033368 - protein, 9 aa, Homo Sapiens
LSGCLDSDE

SEQ ID NO: 1033369 - protein, 9 aa, Homo Sapiens
SPVIPLLES

SEQ ID NO: 1033370 - protein, 9 aa, Homo Sapiens
SDFSKVLGQ

SEQ ID NO: 1033371 - protein, 9 aa, Homo Sapiens
VSGPFPAQL

SEQ ID NO: 1033372 - protein, 9 aa, Homo Sapiens
SDKYKLNSE

SEQ ID NO: 1033373 - protein, 9 aa, Homo Sapiens
LIRGNCKNC

SEQ ID NO: 1033374 - protein, 9 aa, Homo Sapiens
ELPALLKTL

SEQ ID NO: 1033375 - protein, 9 aa, Homo Sapiens
RIKVLNTLE

SEQ ID NO: 1033376 - protein, 9 aa, Homo Sapiens
MLKKILKGL

SEQ ID NO: 1033377 - protein, 9 aa, Homo Sapiens
AIPNNSDLT

SEQ ID NO: 1033378 - protein, 9 aa, Homo Sapiens
RNLQKLRSA

SEQ ID NO: 1033379 - protein, 9 aa, Homo Sapiens
LDVSANQAA

SEQ ID NO: 1033380 - protein, 9 aa, Homo Sapiens
KIYQWCGSS

SEQ ID NO: 1033381 - protein, 9 aa, Homo Sapiens
VVKGPKGES

SEQ ID NO: 1033382 - protein, 9 aa, Homo Sapiens
AAQSVLTLC

SEQ ID NO: 1033383 - protein, 9 aa, Homo Sapiens
EFHLCHYLD

SEQ ID NO: 1033384 - protein, 9 aa, Homo Sapiens
NGYTRHRNL

SEQ ID NO: 1033385 - protein, 9 aa, Homo Sapiens
NPLMRWQPE

SEQ ID NO: 1033386 - protein, 9 aa, Homo Sapiens
DHHLVQLGQ

SEQ ID NO: 1033387 - protein, 9 aa, Homo Sapiens
LRDYQDTLL

SEQ ID NO: 1033388 - protein, 9 aa, Homo Sapiens
KFRISGHRK

SEQ ID NO: 1033389 - protein, 9 aa, Homo Sapiens
QMCEWPQPR

SEQ ID NO: 1033390 - protein, 9 aa, Homo Sapiens
GALGSLFSR

SEQ ID NO: 1033391 - protein, 9 aa, Homo Sapiens
VLHHGVCQK

SEQ ID NO: 1033392 - protein, 9 aa, Homo Sapiens
FIRLNSVHC

SEQ ID NO: 1033393 - protein, 9 aa, Homo Sapiens
CEPGYNLRG

SEQ ID NO: 1033394 - protein, 9 aa, Homo Sapiens
DEEDDEDEK

SEQ ID NO: 1033395 - protein, 9 aa, Homo Sapiens
QNLDLLLDT

SEQ ID NO: 1033396 - protein, 9 aa, Homo Sapiens
VGVDARHLS

SEQ ID NO: 1033397 - protein, 9 aa, Homo Sapiens
VDLMTYGRR

SEQ ID NO: 1033398 - protein, 9 aa, Homo Sapiens
AECQPKKEG

SEQ ID NO: 1033399 - protein, 9 aa, Homo Sapiens
LVNGKWQEF

SEQ ID NO: 1033400 - protein, 9 aa, Homo Sapiens
QMIRDPVRG

SEQ ID NO: 1033401 - protein, 9 aa, Homo Sapiens
MNETSALKF

SEQ ID NO: 1033402 - protein, 9 aa, Homo Sapiens
KNQSSTPTF

SEQ ID NO: 1033403 - protein, 9 aa, Homo Sapiens
SSVCLDWKP

SEQ ID NO: 1033404 - protein, 9 aa, Homo Sapiens
TIFEDTINW

SEQ ID NO: 1033405 - protein, 9 aa, Homo Sapiens
KIVIFMFAQ

SEQ ID NO: 1033406 - protein, 9 aa, Homo Sapiens
SLDTLFSVF

SEQ ID NO: 1033407 - protein, 9 aa, Homo Sapiens
EQTLSRPPN

SEQ ID NO: 1033408 - protein, 9 aa, Homo Sapiens
AGFLFCLFS

SEQ ID NO: 1033409 - protein, 9 aa, Homo Sapiens
TPSQKRYAA

SEQ ID NO: 1033410 - protein, 9 aa, Homo Sapiens
TYHVDRSEN

SEQ ID NO: 1033411 - protein, 9 aa, Homo Sapiens
SCIMQTYLH

SEQ ID NO: 1033412 - protein, 9 aa, Homo Sapiens
GLKWNLTNN

SEQ ID NO: 1033413 - protein, 9 aa, Homo Sapiens
RAAYTFNTE

SEQ ID NO: 1033414 - protein, 9 aa, Homo Sapiens
HWRTSELPL

SEQ ID NO: 1033415 - protein, 9 aa, Homo Sapiens
SSSGRAGPF

SEQ ID NO: 1033416 - protein, 9 aa, Homo Sapiens
NMRRPSSLR

SEQ ID NO: 1033417 - protein, 9 aa, Homo Sapiens
AMFGAGIAM

SEQ ID NO: 1033418 - protein, 9 aa, Homo Sapiens
EKTKKHPKS

SEQ ID NO: 1033419 - protein, 9 aa, Homo Sapiens
DSYPSELIF

SEQ ID NO: 1033420 - protein, 9 aa, Homo Sapiens
LKNAMWKKD

SEQ ID NO: 1033421 - protein, 9 aa, Homo Sapiens
GDYDDSAFI

SEQ ID NO: 1033422 - protein, 9 aa, Homo Sapiens
VLKESDNGV

SEQ ID NO: 1033423 - protein, 9 aa, Homo Sapiens
PIEPGTYII

SEQ ID NO: 1033424 - protein, 9 aa, Homo Sapiens
GPQAFWAKC

SEQ ID NO: 1033425 - protein, 9 aa, Homo Sapiens
LEGSGNVSY

SEQ ID NO: 1033426 - protein, 9 aa, Homo Sapiens
VDCLLEKYF

SEQ ID NO: 1033427 - protein, 9 aa, Homo Sapiens
PYILEVSSP

SEQ ID NO: 1033428 - protein, 9 aa, Homo Sapiens
FIMLVATTM

SEQ ID NO: 1033429 - protein, 9 aa, Homo Sapiens
KPRFKPSLT

SEQ ID NO: 1033430 - protein, 9 aa, Homo Sapiens
GKQEKTKKH

SEQ ID NO: 1033431 - protein, 9 aa, Homo Sapiens
RYTVETISI

SEQ ID NO: 1033432 - protein, 9 aa, Homo Sapiens
GLFTAFLAL

SEQ ID NO: 1033433 - protein, 9 aa, Homo Sapiens
AQQVSGPVS

SEQ ID NO: 1033434 - protein, 9 aa, Homo Sapiens
EAPLNPKTN

SEQ ID NO: 1033435 - protein, 9 aa, Homo Sapiens
GLDRGTTFT

SEQ ID NO: 1033436 - protein, 9 aa, Homo Sapiens
QYSFNHLYN

SEQ ID NO: 1033437 - protein, 9 aa, Homo Sapiens
GNSSDDFED

SEQ ID NO: 1033438 - protein, 9 aa, Homo Sapiens
SVIKQLAQV

SEQ ID NO: 1033439 - protein, 9 aa, Homo Sapiens
VLCVQYTKE

SEQ ID NO: 1033440 - protein, 9 aa, Homo Sapiens
LLSTELQAK

SEQ ID NO: 1033441 - protein, 9 aa, Homo Sapiens
QEVQSSAKK

SEQ ID NO: 1033442 - protein, 9 aa, Homo Sapiens
LSGVPSQDN

SEQ ID NO: 1033443 - protein, 9 aa, Homo Sapiens
NQIPQTTFK

SEQ ID NO: 1033444 - protein, 9 aa, Homo Sapiens
LFTAFLALL

SEQ ID NO: 1033445 - protein, 9 aa, Homo Sapiens
NPGTTYKIK

SEQ ID NO: 1033446 - protein, 9 aa, Homo Sapiens
VPAFLLRLA

SEQ ID NO: 1033447 - protein, 9 aa, Homo Sapiens
ASLGAPSRD

SEQ ID NO: 1033448 - protein, 9 aa, Homo Sapiens
IKVTLGDSP

SEQ ID NO: 1033449 - protein, 9 aa, Homo Sapiens
MCEWPQPRG

SEQ ID NO: 1033450 - protein, 9 aa, Homo Sapiens
YKQEGCHTT

SEQ ID NO: 1033451 - protein, 9 aa, Homo Sapiens
GTVANLFVA

SEQ ID NO: 1033452 - protein, 9 aa, Homo Sapiens
PDFRAYLIE

SEQ ID NO: 1033453 - protein, 9 aa, Homo Sapiens
FHQGAPESP

SEQ ID NO: 1033454 - protein, 9 aa, Homo Sapiens
PGEAPSQFP

SEQ ID NO: 1033455 - protein, 9 aa, Homo Sapiens
GNCFSEWDG

SEQ ID NO: 1033456 - protein, 9 aa, Homo Sapiens
RSSTARFSV

SEQ ID NO: 1033457 - protein, 9 aa, Homo Sapiens
YFLRAVRMK

SEQ ID NO: 1033458 - protein, 9 aa, Homo Sapiens
RVLDATEIL

SEQ ID NO: 1033459 - protein, 9 aa, Homo Sapiens
MFEIQNELL

SEQ ID NO: 1033460 - protein, 9 aa, Homo Sapiens
TLTRHKKIY

SEQ ID NO: 1033461 - protein, 9 aa, Homo Sapiens
DPWISHGGP

SEQ ID NO: 1033462 - protein, 9 aa, Homo Sapiens
PKKKTIKRR

SEQ ID NO: 1033463 - protein, 9 aa, Homo Sapiens
PYGFLEEVI

SEQ ID NO: 1033464 - protein, 9 aa, Homo Sapiens
FSYAVGFVH

SEQ ID NO: 1033465 - protein, 9 aa, Homo Sapiens
VPFSSIKNE

SEQ ID NO: 1033466 - protein, 9 aa, Homo Sapiens
PSQDNTRVE

SEQ ID NO: 1033467 - protein, 9 aa, Homo Sapiens
GPGEAPSQF

SEQ ID NO: 1033468 - protein, 9 aa, Homo Sapiens
GEQKKAGLP

SEQ ID NO: 1033469 - protein, 9 aa, Homo Sapiens
AVSFRNRIY

SEQ ID NO: 1033470 - protein, 9 aa, Homo Sapiens
GFIRLNSVH

SEQ ID NO: 1033471 - protein, 9 aa, Homo Sapiens
EPVGISRPP

SEQ ID NO: 1033472 - protein, 9 aa, Homo Sapiens
KCYFPYLKN

SEQ ID NO: 1033473 - protein, 9 aa, Homo Sapiens
RTPALHKSR

SEQ ID NO: 1033474 - protein, 9 aa, Homo Sapiens
RRLFYFLGL

SEQ ID NO: 1033475 - protein, 9 aa, Homo Sapiens
LQDSFPAQF

SEQ ID NO: 1033476 - protein, 9 aa, Homo Sapiens
TVGSDDRFS

SEQ ID NO: 1033477 - protein, 9 aa, Homo Sapiens
TLRFNPIMV

SEQ ID NO: 1033478 - protein, 9 aa, Homo Sapiens
IDGSENNCV

SEQ ID NO: 1033479 - protein, 9 aa, Homo Sapiens
KDNMSSTLL

SEQ ID NO: 1033480 - protein, 9 aa, Homo Sapiens
IGLFETQKK

SEQ ID NO: 1033481 - protein, 9 aa, Homo Sapiens
SKEDFRKYF

SEQ ID NO: 1033482 - protein, 9 aa, Homo Sapiens
PLKYRQETP

SEQ ID NO: 1033483 - protein, 9 aa, Homo Sapiens
GLRTSRTEI

SEQ ID NO: 1033484 - protein, 9 aa, Homo Sapiens
SENVSTHAA

SEQ ID NO: 1033485 - protein, 9 aa, Homo Sapiens
WAPLVDYLS

SEQ ID NO: 1033486 - protein, 9 aa, Homo Sapiens
VYQLVSCPL

SEQ ID NO: 1033487 - protein, 9 aa, Homo Sapiens
AFRNRLSLI

SEQ ID NO: 1033488 - protein, 9 aa, Homo Sapiens
TSFLAEAEN

SEQ ID NO: 1033489 - protein, 9 aa, Homo Sapiens
TTASFVCVP

SEQ ID NO: 1033490 - protein, 9 aa, Homo Sapiens
WGTKGLESH

SEQ ID NO: 1033491 - protein, 9 aa, Homo Sapiens
YTTTLTPKP

SEQ ID NO: 1033492 - protein, 9 aa, Homo Sapiens
VTMKNGFRC

SEQ ID NO: 1033493 - protein, 9 aa, Homo Sapiens
PIIYTKDEN

SEQ ID NO: 1033494 - protein, 9 aa, Homo Sapiens
KMIYSKFIE

SEQ ID NO: 1033495 - protein, 9 aa, Homo Sapiens
KYQKTLKKI

SEQ ID NO: 1033496 - protein, 9 aa, Homo Sapiens
RQASLEEAT

SEQ ID NO: 1033497 - protein, 9 aa, Homo Sapiens
LEVSSPTDT

SEQ ID NO: 1033498 - protein, 9 aa, Homo Sapiens
LQELVMDKK

SEQ ID NO: 1033499 - protein, 9 aa, Homo Sapiens
SRFLMCNLA

SEQ ID NO: 1033500 - protein, 9 aa, Homo Sapiens
LRIFSAGRK

SEQ ID NO: 1033501 - protein, 9 aa, Homo Sapiens
AGLGKMMMK

SEQ ID NO: 1033502 - protein, 9 aa, Homo Sapiens
RPQIFSVEG

SEQ ID NO: 1033503 - protein, 9 aa, Homo Sapiens
MELNEKAVI

SEQ ID NO: 1033504 - protein, 9 aa, Homo Sapiens
EFLKKMSLT

SEQ ID NO: 1033505 - protein, 9 aa, Homo Sapiens
AMDSNGLSN

SEQ ID NO: 1033506 - protein, 9 aa, Homo Sapiens
KTFYDSSSP

SEQ ID NO: 1033507 - protein, 9 aa, Homo Sapiens
RFLPKGIMV

SEQ ID NO: 1033508 - protein, 9 aa, Homo Sapiens
NAIFLKTCQ

SEQ ID NO: 1033509 - protein, 9 aa, Homo Sapiens
SLKRANPPI

SEQ ID NO: 1033510 - protein, 9 aa, Homo Sapiens
PQGMPGLGP

SEQ ID NO: 1033511 - protein, 9 aa, Homo Sapiens
QMPSHLSRV

SEQ ID NO: 1033512 - protein, 9 aa, Homo Sapiens
REGHPDKIC

SEQ ID NO: 1033513 - protein, 9 aa, Homo Sapiens
IFFTSIFIP

SEQ ID NO: 1033514 - protein, 9 aa, Homo Sapiens
FSPAWFSPI

SEQ ID NO: 1033515 - protein, 9 aa, Homo Sapiens
QVDSVHNLL

SEQ ID NO: 1033516 - protein, 9 aa, Homo Sapiens
KYQLTVRPD

SEQ ID NO: 1033517 - protein, 9 aa, Homo Sapiens
LVLDKALDQ

SEQ ID NO: 1033518 - protein, 9 aa, Homo Sapiens
SQGQVHYQL

SEQ ID NO: 1033519 - protein, 9 aa, Homo Sapiens
VSLSTGERK

SEQ ID NO: 1033520 - protein, 9 aa, Homo Sapiens
FGRDSFLTC

SEQ ID NO: 1033521 - protein, 9 aa, Homo Sapiens
RDSEETEKE

SEQ ID NO: 1033522 - protein, 9 aa, Homo Sapiens
PLDQSVWVV

SEQ ID NO: 1033523 - protein, 9 aa, Homo Sapiens
LPRHRNKNT

SEQ ID NO: 1033524 - protein, 9 aa, Homo Sapiens
DAAGAAEAD

SEQ ID NO: 1033525 - protein, 9 aa, Homo Sapiens
QAAFGVQGL

SEQ ID NO: 1033526 - protein, 9 aa, Homo Sapiens
RKVFNEHSA

SEQ ID NO: 1033527 - protein, 9 aa, Homo Sapiens
GGVSGPFPA

SEQ ID NO: 1033528 - protein, 9 aa, Homo Sapiens
VKDCCINSH

SEQ ID NO: 1033529 - protein, 9 aa, Homo Sapiens
LYFIGMAIK

SEQ ID NO: 1033530 - protein, 9 aa, Homo Sapiens
CSTCRQAML

SEQ ID NO: 1033531 - protein, 9 aa, Homo Sapiens
LTFEILLND

SEQ ID NO: 1033532 - protein, 9 aa, Homo Sapiens
PPARKALAI

SEQ ID NO: 1033533 - protein, 9 aa, Homo Sapiens
CKLMRKAEL

SEQ ID NO: 1033534 - protein, 9 aa, Homo Sapiens
GHQGLADVP

SEQ ID NO: 1033535 - protein, 9 aa, Homo Sapiens
FPILIRILY

SEQ ID NO: 1033536 - protein, 9 aa, Homo Sapiens
PSYAPLSGD

SEQ ID NO: 1033537 - protein, 9 aa, Homo Sapiens
EIKGNGSGS

SEQ ID NO: 1033538 - protein, 9 aa, Homo Sapiens
RYKVCIAQD

SEQ ID NO: 1033539 - protein, 9 aa, Homo Sapiens
PAKLSVGFK

SEQ ID NO: 1033540 - protein, 9 aa, Homo Sapiens
GLFRDDDDI

SEQ ID NO: 1033541 - protein, 9 aa, Homo Sapiens
GTPLPVLSE

SEQ ID NO: 1033542 - protein, 9 aa, Homo Sapiens
KTSEMRLYT

SEQ ID NO: 1033543 - protein, 9 aa, Homo Sapiens
RELSPNFYQ

SEQ ID NO: 1033544 - protein, 9 aa, Homo Sapiens
DDEDEKGPW

SEQ ID NO: 1033545 - protein, 9 aa, Homo Sapiens
ALLKTLVSE

SEQ ID NO: 1033546 - protein, 9 aa, Homo Sapiens
PASCSNRVD

SEQ ID NO: 1033547 - protein, 9 aa, Homo Sapiens
ENWINPLMR

SEQ ID NO: 1033548 - protein, 9 aa, Homo Sapiens
VISRHEMPL

SEQ ID NO: 1033549 - protein, 9 aa, Homo Sapiens
RKIRQKLEN

SEQ ID NO: 1033550 - protein, 9 aa, Homo Sapiens
LWAFEAIKQ

SEQ ID NO: 1033551 - protein, 9 aa, Homo Sapiens
VFYVFLHAI

SEQ ID NO: 1033552 - protein, 9 aa, Homo Sapiens
QLSVVHTNT

SEQ ID NO: 1033553 - protein, 9 aa, Homo Sapiens
FFVQEKIPK

SEQ ID NO: 1033554 - protein, 9 aa, Homo Sapiens
MKYHTEAYT

SEQ ID NO: 1033555 - protein, 9 aa, Homo Sapiens
ISIKISMTF

SEQ ID NO: 1033556 - protein, 9 aa, Homo Sapiens
DKDVAQKLG

SEQ ID NO: 1033557 - protein, 9 aa, Homo Sapiens
FNQYVCWPH

SEQ ID NO: 1033558 - protein, 9 aa, Homo Sapiens
RDHKLRHRR

SEQ ID NO: 1033559 - protein, 9 aa, Homo Sapiens
QKDEFLHET

SEQ ID NO: 1033560 - protein, 9 aa, Homo Sapiens
KYLYRRGRR

SEQ ID NO: 1033561 - protein, 9 aa, Homo Sapiens
DGSLSPLLA

SEQ ID NO: 1033562 - protein, 9 aa, Homo Sapiens
TWVEILLSL

SEQ ID NO: 1033563 - protein, 9 aa, Homo Sapiens
FLLRDAVEE

SEQ ID NO: 1033564 - protein, 9 aa, Homo Sapiens
VITWVEILL

SEQ ID NO: 1033565 - protein, 9 aa, Homo Sapiens
IGELAVRRA

SEQ ID NO: 1033566 - protein, 9 aa, Homo Sapiens
LYNFVGNIR

SEQ ID NO: 1033567 - protein, 9 aa, Homo Sapiens
KLGGLPEDF

SEQ ID NO: 1033568 - protein, 9 aa, Homo Sapiens
GSNTFLHLL

SEQ ID NO: 1033569 - protein, 9 aa, Homo Sapiens
NDVGLDNSN

SEQ ID NO: 1033570 - protein, 9 aa, Homo Sapiens
NRHLYNFVG

SEQ ID NO: 1033571 - protein, 9 aa, Homo Sapiens
TDTYNTKIL

SEQ ID NO: 1033572 - protein, 9 aa, Homo Sapiens
GELPSYSCE

SEQ ID NO: 1033573 - protein, 9 aa, Homo Sapiens
TGFFDEKNF

SEQ ID NO: 1033574 - protein, 9 aa, Homo Sapiens
IAVFVAVMK

SEQ ID NO: 1033575 - protein, 9 aa, Homo Sapiens
LGPTEPASP

SEQ ID NO: 1033576 - protein, 9 aa, Homo Sapiens
LVSCPLSDL

SEQ ID NO: 1033577 - protein, 9 aa, Homo Sapiens
VTPIDCDES

SEQ ID NO: 1033578 - protein, 9 aa, Homo Sapiens
TAGTGSSSP

SEQ ID NO: 1033579 - protein, 9 aa, Homo Sapiens
PGLKILSTK

SEQ ID NO: 1033580 - protein, 9 aa, Homo Sapiens
IWYMEYSHQ

SEQ ID NO: 1033581 - protein, 9 aa, Homo Sapiens
HFPSYAPLS

SEQ ID NO: 1033582 - protein, 9 aa, Homo Sapiens
RFESPRLSR

SEQ ID NO: 1033583 - protein, 9 aa, Homo Sapiens
NRSSCFWLL

SEQ ID NO: 1033584 - protein, 9 aa, Homo Sapiens
IIFFVLVIF

SEQ ID NO: 1033585 - protein, 9 aa, Homo Sapiens
IIQKNMERF

SEQ ID NO: 1033586 - protein, 9 aa, Homo Sapiens
QTTFKKPQS

SEQ ID NO: 1033587 - protein, 9 aa, Homo Sapiens
LFLCTFSWL

SEQ ID NO: 1033588 - protein, 9 aa, Homo Sapiens
SKHQKIFKL

SEQ ID NO: 1033589 - protein, 9 aa, Homo Sapiens
TQTEELWSK

SEQ ID NO: 1033590 - protein, 9 aa, Homo Sapiens
TFKYSQGQV

SEQ ID NO: 1033591 - protein, 9 aa, Homo Sapiens
TPSSDASES

SEQ ID NO: 1033592 - protein, 9 aa, Homo Sapiens
CSRSCGPSL

SEQ ID NO: 1033593 - protein, 9 aa, Homo Sapiens
PDPLHEDWK

SEQ ID NO: 1033594 - protein, 9 aa, Homo Sapiens
CLLEKYFMQ

SEQ ID NO: 1033595 - protein, 9 aa, Homo Sapiens
RMQSLSPDS

SEQ ID NO: 1033596 - protein, 9 aa, Homo Sapiens
GQSHAQGGH

SEQ ID NO: 1033597 - protein, 9 aa, Homo Sapiens
NPEFTLQQP

SEQ ID NO: 1033598 - protein, 9 aa, Homo Sapiens
AVTLQFQAR

SEQ ID NO: 1033599 - protein, 9 aa, Homo Sapiens
IVLVYDITN

SEQ ID NO: 1033600 - protein, 9 aa, Homo Sapiens
AFSGFTALP

SEQ ID NO: 1033601 - protein, 9 aa, Homo Sapiens
PLSEATTPE

SEQ ID NO: 1033602 - protein, 9 aa, Homo Sapiens
FEDTINWTD

SEQ ID NO: 1033603 - protein, 9 aa, Homo Sapiens
EPPSSPGSA

SEQ ID NO: 1033604 - protein, 9 aa, Homo Sapiens
MDGSTNFLL

SEQ ID NO: 1033605 - protein, 9 aa, Homo Sapiens
EVSTRARFK

SEQ ID NO: 1033606 - protein, 9 aa, Homo Sapiens
SDYQRSACS

SEQ ID NO: 1033607 - protein, 9 aa, Homo Sapiens
GHRKKKRKK

SEQ ID NO: 1033608 - protein, 9 aa, Homo Sapiens
QSLNLYNNH

SEQ ID NO: 1033609 - protein, 9 aa, Homo Sapiens
QGKEQESLA

SEQ ID NO: 1033610 - protein, 9 aa, Homo Sapiens
HNWIRRNDK

SEQ ID NO: 1033611 - protein, 9 aa, Homo Sapiens
SALCTPSYL

SEQ ID NO: 1033612 - protein, 9 aa, Homo Sapiens
PLKIQLFKI

SEQ ID NO: 1033613 - protein, 9 aa, Homo Sapiens
SSIILRDGN

SEQ ID NO: 1033614 - protein, 9 aa, Homo Sapiens
YLHQQNRTW

SEQ ID NO: 1033615 - protein, 9 aa, Homo Sapiens
NSSACKKSH

SEQ ID NO: 1033616 - protein, 9 aa, Homo Sapiens
YPSALILGG

SEQ ID NO: 1033617 - protein, 9 aa, Homo Sapiens
TLEINGKSF

SEQ ID NO: 1033618 - protein, 9 aa, Homo Sapiens
GPSNGPSYG

SEQ ID NO: 1033619 - protein, 9 aa, Homo Sapiens
SIPLSGCLD

SEQ ID NO: 1033620 - protein, 9 aa, Homo Sapiens
VNTLIHTIN

SEQ ID NO: 1033621 - protein, 9 aa, Homo Sapiens
MGDRLTDEE

SEQ ID NO: 1033622 - protein, 9 aa, Homo Sapiens
KQFLQVHLS

SEQ ID NO: 1033623 - protein, 9 aa, Homo Sapiens
DMIESLFYT

SEQ ID NO: 1033624 - protein, 9 aa, Homo Sapiens
KNALRKQVR

SEQ ID NO: 1033625 - protein, 9 aa, Homo Sapiens
KKAPTTAGF

SEQ ID NO: 1033626 - protein, 9 aa, Homo Sapiens
CGYPGVPPK

SEQ ID NO: 1033627 - protein, 9 aa, Homo Sapiens
RSKQIFSSL

SEQ ID NO: 1033628 - protein, 9 aa, Homo Sapiens
IWVLAATST

SEQ ID NO: 1033629 - protein, 9 aa, Homo Sapiens
VCAYDSEAA

SEQ ID NO: 1033630 - protein, 9 aa, Homo Sapiens
QYYTMKILD

SEQ ID NO: 1033631 - protein, 9 aa, Homo Sapiens
LAFLSAIFF

SEQ ID NO: 1033632 - protein, 9 aa, Homo Sapiens
ETQKKEFVT

SEQ ID NO: 1033633 - protein, 9 aa, Homo Sapiens
QLSILTEAH

SEQ ID NO: 1033634 - protein, 9 aa, Homo Sapiens
YDLRRLLSS

SEQ ID NO: 1033635 - protein, 9 aa, Homo Sapiens
HEGRESCHS

SEQ ID NO: 1033636 - protein, 9 aa, Homo Sapiens
PRIVLMLGF

SEQ ID NO: 1033637 - protein, 9 aa, Homo Sapiens
EMDNEPLVS

SEQ ID NO: 1033638 - protein, 9 aa, Homo Sapiens
NIFSSPREL

SEQ ID NO: 1033639 - protein, 9 aa, Homo Sapiens
APSQFPPLR

SEQ ID NO: 1033640 - protein, 9 aa, Homo Sapiens
FLSELPAVG

SEQ ID NO: 1033641 - protein, 9 aa, Homo Sapiens
VVPLKYRQE

SEQ ID NO: 1033642 - protein, 9 aa, Homo Sapiens
IEKVIGAGE

SEQ ID NO: 1033643 - protein, 9 aa, Homo Sapiens
GRCSLDTLF

SEQ ID NO: 1033644 - protein, 9 aa, Homo Sapiens
ENETTCTFN

SEQ ID NO: 1033645 - protein, 9 aa, Homo Sapiens
ATTCTKDRI

SEQ ID NO: 1033646 - protein, 9 aa, Homo Sapiens
STVVCKQLE

SEQ ID NO: 1033647 - protein, 9 aa, Homo Sapiens
VCRERPAWS

SEQ ID NO: 1033648 - protein, 9 aa, Homo Sapiens
FGSSIALVR

SEQ ID NO: 1033649 - protein, 9 aa, Homo Sapiens
SFTEGEIII

SEQ ID NO: 1033650 - protein, 9 aa, Homo Sapiens
GGRSAQAAC

SEQ ID NO: 1033651 - protein, 9 aa, Homo Sapiens
ILSPRINEK

SEQ ID NO: 1033652 - protein, 9 aa, Homo Sapiens
RTSRQQKLV

SEQ ID NO: 1033653 - protein, 9 aa, Homo Sapiens
DLPKISIPS

SEQ ID NO: 1033654 - protein, 9 aa, Homo Sapiens
IKNKLSPPG

SEQ ID NO: 1033655 - protein, 9 aa, Homo Sapiens
GFVTPIDCD

SEQ ID NO: 1033656 - protein, 9 aa, Homo Sapiens
PVSLGVKQK

SEQ ID NO: 1033657 - protein, 9 aa, Homo Sapiens
KEVKENFVI

SEQ ID NO: 1033658 - protein, 9 aa, Homo Sapiens
TESLRDFSA

SEQ ID NO: 1033659 - protein, 9 aa, Homo Sapiens
SRDPDAQPE

SEQ ID NO: 1033660 - protein, 9 aa, Homo Sapiens
KSSLLKKLG

SEQ ID NO: 1033661 - protein, 9 aa, Homo Sapiens
KMTEIELSG

SEQ ID NO: 1033662 - protein, 9 aa, Homo Sapiens
MEHYDASLS

SEQ ID NO: 1033663 - protein, 9 aa, Homo Sapiens
LCEALGCPD

SEQ ID NO: 1033664 - protein, 9 aa, Homo Sapiens
NTKILIFII

SEQ ID NO: 1033665 - protein, 9 aa, Homo Sapiens
DQNCSNRGH

SEQ ID NO: 1033666 - protein, 9 aa, Homo Sapiens
KFEKVPEGS

SEQ ID NO: 1033667 - protein, 9 aa, Homo Sapiens
PSAPPLPPG

SEQ ID NO: 1033668 - protein, 9 aa, Homo Sapiens
KLWYCYKVF

SEQ ID NO: 1033669 - protein, 9 aa, Homo Sapiens
RAQPVTDLA

SEQ ID NO: 1033670 - protein, 9 aa, Homo Sapiens
HIEAKRATW

SEQ ID NO: 1033671 - protein, 9 aa, Homo Sapiens
RTFTYSLSC

SEQ ID NO: 1033672 - protein, 9 aa, Homo Sapiens
PLEVSQRLE

SEQ ID NO: 1033673 - protein, 9 aa, Homo Sapiens
PEAPENFPQ

SEQ ID NO: 1033674 - protein, 9 aa, Homo Sapiens
KYQKDCQAR

SEQ ID NO: 1033675 - protein, 9 aa, Homo Sapiens
CLSSLQGYI

SEQ ID NO: 1033676 - protein, 9 aa, Homo Sapiens
VPVEEIAIL

SEQ ID NO: 1033677 - protein, 9 aa, Homo Sapiens
GLSSLLWKE

SEQ ID NO: 1033678 - protein, 9 aa, Homo Sapiens
LNPHWEENT

SEQ ID NO: 1033679 - protein, 9 aa, Homo Sapiens
DPAGPEAGD

SEQ ID NO: 1033680 - protein, 9 aa, Homo Sapiens
LIVPPDRVF

SEQ ID NO: 1033681 - protein, 9 aa, Homo Sapiens
IELDMAVSG

SEQ ID NO: 1033682 - protein, 9 aa, Homo Sapiens
WNQKILFKE

SEQ ID NO: 1033683 - protein, 9 aa, Homo Sapiens
PVSMTSEIE

SEQ ID NO: 1033684 - protein, 9 aa, Homo Sapiens
IEKKEMKIS

SEQ ID NO: 1033685 - protein, 9 aa, Homo Sapiens
GLPSETELS

SEQ ID NO: 1033686 - protein, 9 aa, Homo Sapiens
KSFKKYMED

SEQ ID NO: 1033687 - protein, 9 aa, Homo Sapiens
LKKKFQKQK

SEQ ID NO: 1033688 - protein, 9 aa, Homo Sapiens
SSPSSSGRA

SEQ ID NO: 1033689 - protein, 9 aa, Homo Sapiens
SQKSENGEV

SEQ ID NO: 1033690 - protein, 9 aa, Homo Sapiens
MFLQKPMSL

SEQ ID NO: 1033691 - protein, 9 aa, Homo Sapiens
FVKRQMLYV

SEQ ID NO: 1033692 - protein, 9 aa, Homo Sapiens
IDKGLKYDG

SEQ ID NO: 1033693 - protein, 9 aa, Homo Sapiens
TVSASAEVR

SEQ ID NO: 1033694 - protein, 9 aa, Homo Sapiens
ISQKSENGE

SEQ ID NO: 1033695 - protein, 9 aa, Homo Sapiens
EESFNLKQN

SEQ ID NO: 1033696 - protein, 9 aa, Homo Sapiens
CTYDDFSYQ

SEQ ID NO: 1033697 - protein, 9 aa, Homo Sapiens
PVFDFRVTV

SEQ ID NO: 1033698 - protein, 9 aa, Homo Sapiens
SQNGPVHAP

SEQ ID NO: 1033699 - protein, 9 aa, Homo Sapiens
HQKIFKLHA

SEQ ID NO: 1033700 - protein, 9 aa, Homo Sapiens
RAIYAASSG

SEQ ID NO: 1033701 - protein, 9 aa, Homo Sapiens
VSSPGTGTL

SEQ ID NO: 1033702 - protein, 9 aa, Homo Sapiens
QNPRRWGNP

SEQ ID NO: 1033703 - protein, 9 aa, Homo Sapiens
NFSKECEEN

SEQ ID NO: 1033704 - protein, 9 aa, Homo Sapiens
TARRSTASQ

SEQ ID NO: 1033705 - protein, 9 aa, Homo Sapiens
APHLKTSVD

SEQ ID NO: 1033706 - protein, 9 aa, Homo Sapiens
EKMWRQKEK

SEQ ID NO: 1033707 - protein, 9 aa, Homo Sapiens
SRSPTFSGS

SEQ ID NO: 1033708 - protein, 9 aa, Homo Sapiens
TLSSLQGLF

SEQ ID NO: 1033709 - protein, 9 aa, Homo Sapiens
SDFLKSHIK

SEQ ID NO: 1033710 - protein, 9 aa, Homo Sapiens
SELPLRNLR

SEQ ID NO: 1033711 - protein, 9 aa, Homo Sapiens
RSTSNTLWI

SEQ ID NO: 1033712 - protein, 9 aa, Homo Sapiens
PFEICRLAV

SEQ ID NO: 1033713 - protein, 9 aa, Homo Sapiens
RQKPPSAFR

SEQ ID NO: 1033714 - protein, 9 aa, Homo Sapiens
QDVPMPEKK

SEQ ID NO: 1033715 - protein, 9 aa, Homo Sapiens
KQLAQVHNS

SEQ ID NO: 1033716 - protein, 9 aa, Homo Sapiens
EGTKSISIS

SEQ ID NO: 1033717 - protein, 9 aa, Homo Sapiens
SAQAACDWL

SEQ ID NO: 1033718 - protein, 9 aa, Homo Sapiens
LYKYFISLK

SEQ ID NO: 1033719 - protein, 9 aa, Homo Sapiens
DKSTLISQA

SEQ ID NO: 1033720 - protein, 9 aa, Homo Sapiens
QEGCHTTSR

SEQ ID NO: 1033721 - protein, 9 aa, Homo Sapiens
LLDLCGCAR

SEQ ID NO: 1033722 - protein, 9 aa, Homo Sapiens
ALSIKTSFL

SEQ ID NO: 1033723 - protein, 9 aa, Homo Sapiens
KMSKRSLGI

SEQ ID NO: 1033724 - protein, 9 aa, Homo Sapiens
QQGQEKQVQ

SEQ ID NO: 1033725 - protein, 9 aa, Homo Sapiens
APKEPKIVM

SEQ ID NO: 1033726 - protein, 9 aa, Homo Sapiens
QTAELRCKG

SEQ ID NO: 1033727 - protein, 9 aa, Homo Sapiens
NMRKSRSGE

SEQ ID NO: 1033728 - protein, 9 aa, Homo Sapiens
ILIQTDIGL

SEQ ID NO: 1033729 - protein, 9 aa, Homo Sapiens
RPAPGHARS

SEQ ID NO: 1033730 - protein, 9 aa, Homo Sapiens
VGLRTSRTE

SEQ ID NO: 1033731 - protein, 9 aa, Homo Sapiens
YPYLHQQNR

SEQ ID NO: 1033732 - protein, 9 aa, Homo Sapiens
FRLNGFGNF

SEQ ID NO: 1033733 - protein, 9 aa, Homo Sapiens
LGSLFSRAA

SEQ ID NO: 1033734 - protein, 9 aa, Homo Sapiens
TYRKQFLPQ

SEQ ID NO: 1033735 - protein, 9 aa, Homo Sapiens
CNLVFSPAW

SEQ ID NO: 1033736 - protein, 9 aa, Homo Sapiens
RLNSVHCVQ

SEQ ID NO: 1033737 - protein, 9 aa, Homo Sapiens
SQDNTRVEP

SEQ ID NO: 1033738 - protein, 9 aa, Homo Sapiens
YELEITSDF

SEQ ID NO: 1033739 - protein, 9 aa, Homo Sapiens
MMASEKNQS

SEQ ID NO: 1033740 - protein, 9 aa, Homo Sapiens
TTSKPVQIM

SEQ ID NO: 1033741 - protein, 9 aa, Homo Sapiens
LEKFIEDYL

SEQ ID NO: 1033742 - protein, 9 aa, Homo Sapiens
LEKYFMQSD

SEQ ID NO: 1033743 - protein, 9 aa, Homo Sapiens
EEQHGILVT

SEQ ID NO: 1033744 - protein, 9 aa, Homo Sapiens
LNKHKKIYA

SEQ ID NO: 1033745 - protein, 9 aa, Homo Sapiens
FKLLRKMGW

SEQ ID NO: 1033746 - protein, 9 aa, Homo Sapiens
GFHVGQTVG

SEQ ID NO: 1033747 - protein, 9 aa, Homo Sapiens
CSQLVGRQD

SEQ ID NO: 1033748 - protein, 9 aa, Homo Sapiens
GSITQISIL

SEQ ID NO: 1033749 - protein, 9 aa, Homo Sapiens
YLGYTSRFS

SEQ ID NO: 1033750 - protein, 9 aa, Homo Sapiens
KKTKHELHI

SEQ ID NO: 1033751 - protein, 9 aa, Homo Sapiens
LTPISSRPW

SEQ ID NO: 1033752 - protein, 9 aa, Homo Sapiens
AREEWKTLP

SEQ ID NO: 1033753 - protein, 9 aa, Homo Sapiens
NEDIKPFSP

SEQ ID NO: 1033754 - protein, 9 aa, Homo Sapiens
GTIIFIILG

SEQ ID NO: 1033755 - protein, 9 aa, Homo Sapiens
YHPSYAKPR

SEQ ID NO: 1033756 - protein, 9 aa, Homo Sapiens
VKGPVSAAP

SEQ ID NO: 1033757 - protein, 9 aa, Homo Sapiens
LREKDQRKL

SEQ ID NO: 1033758 - protein, 9 aa, Homo Sapiens
EDGPEGPKS

SEQ ID NO: 1033759 - protein, 9 aa, Homo Sapiens
CEALGCPDG

SEQ ID NO: 1033760 - protein, 9 aa, Homo Sapiens
GLRKLSLAG

SEQ ID NO: 1033761 - protein, 9 aa, Homo Sapiens
VGIETMKKV

SEQ ID NO: 1033762 - protein, 9 aa, Homo Sapiens
SEDVKRGSK

SEQ ID NO: 1033763 - protein, 9 aa, Homo Sapiens
LGKYRMLFA

SEQ ID NO: 1033764 - protein, 9 aa, Homo Sapiens
SEIFHSSHQ

SEQ ID NO: 1033765 - protein, 9 aa, Homo Sapiens
DSLHLSQQK

SEQ ID NO: 1033766 - protein, 9 aa, Homo Sapiens
TEPVGISRP

SEQ ID NO: 1033767 - protein, 9 aa, Homo Sapiens
LPSETELSG

SEQ ID NO: 1033768 - protein, 9 aa, Homo Sapiens
VQLANKLSF

SEQ ID NO: 1033769 - protein, 9 aa, Homo Sapiens
LGKHRLAEW

SEQ ID NO: 1033770 - protein, 9 aa, Homo Sapiens
RRLESVLQP

SEQ ID NO: 1033771 - protein, 9 aa, Homo Sapiens
LKPLNCTTI

SEQ ID NO: 1033772 - protein, 9 aa, Homo Sapiens
GLFCERNKI

SEQ ID NO: 1033773 - protein, 9 aa, Homo Sapiens
EELPGERGN

SEQ ID NO: 1033774 - protein, 9 aa, Homo Sapiens
ISVFGSDIL

SEQ ID NO: 1033775 - protein, 9 aa, Homo Sapiens
PLLIHRHEK

SEQ ID NO: 1033776 - protein, 9 aa, Homo Sapiens
GITGFGQCL

SEQ ID NO: 1033777 - protein, 9 aa, Homo Sapiens
IYTEKETRS

SEQ ID NO: 1033778 - protein, 9 aa, Homo Sapiens
CSCLDGFTG

SEQ ID NO: 1033779 - protein, 9 aa, Homo Sapiens
HCGANANPS

SEQ ID NO: 1033780 - protein, 9 aa, Homo Sapiens
VVLMGTKDT

SEQ ID NO: 1033781 - protein, 9 aa, Homo Sapiens
QKQILVNLS

SEQ ID NO: 1033782 - protein, 9 aa, Homo Sapiens
IWIHTPAKI

SEQ ID NO: 1033783 - protein, 9 aa, Homo Sapiens
GSRQERQGV

SEQ ID NO: 1033784 - protein, 9 aa, Homo Sapiens
INYYFCDLF

SEQ ID NO: 1033785 - protein, 9 aa, Homo Sapiens
SNYPEKFEK

SEQ ID NO: 1033786 - protein, 9 aa, Homo Sapiens
VLESKDSPF

SEQ ID NO: 1033787 - protein, 9 aa, Homo Sapiens
WAVSPTEPT

SEQ ID NO: 1033788 - protein, 9 aa, Homo Sapiens
KRLSYCKGN

SEQ ID NO: 1033789 - protein, 9 aa, Homo Sapiens
MRSFSLSAS

SEQ ID NO: 1033790 - protein, 9 aa, Homo Sapiens
CIFLYVRPV

SEQ ID NO: 1033791 - protein, 9 aa, Homo Sapiens
NMAKIHCGQ

SEQ ID NO: 1033792 - protein, 9 aa, Homo Sapiens
KIDGSENNC

SEQ ID NO: 1033793 - protein, 9 aa, Homo Sapiens
QQSQCLQSR

SEQ ID NO: 1033794 - protein, 9 aa, Homo Sapiens
TAVSGSAEV

SEQ ID NO: 1033795 - protein, 9 aa, Homo Sapiens
LLQMVFIYV

SEQ ID NO: 1033796 - protein, 9 aa, Homo Sapiens
KKHPKSLQG

SEQ ID NO: 1033797 - protein, 9 aa, Homo Sapiens
EQETVVCSA

SEQ ID NO: 1033798 - protein, 9 aa, Homo Sapiens
APCADSDLK

SEQ ID NO: 1033799 - protein, 9 aa, Homo Sapiens
ASLEEATQP

SEQ ID NO: 1033800 - protein, 9 aa, Homo Sapiens
VKEGARAPL

SEQ ID NO: 1033801 - protein, 9 aa, Homo Sapiens
PQKAKRPQY

SEQ ID NO: 1033802 - protein, 9 aa, Homo Sapiens
NVEILDIFG

SEQ ID NO: 1033803 - protein, 9 aa, Homo Sapiens
RERDHKLRH

SEQ ID NO: 1033804 - protein, 9 aa, Homo Sapiens
SSNKLHVTD

SEQ ID NO: 1033805 - protein, 9 aa, Homo Sapiens
RATLGEQKK

SEQ ID NO: 1033806 - protein, 9 aa, Homo Sapiens
NNCPSDDNS

SEQ ID NO: 1033807 - protein, 9 aa, Homo Sapiens
DLGKKPQGR

SEQ ID NO: 1033808 - protein, 9 aa, Homo Sapiens
DFRAYLIEG

SEQ ID NO: 1033809 - protein, 9 aa, Homo Sapiens
FVTLSYVFI

SEQ ID NO: 1033810 - protein, 9 aa, Homo Sapiens
QGEGVQKSK

SEQ ID NO: 1033811 - protein, 9 aa, Homo Sapiens
EDVKRGSKA

SEQ ID NO: 1033812 - protein, 9 aa, Homo Sapiens
QLLKDLRND

SEQ ID NO: 1033813 - protein, 9 aa, Homo Sapiens
LSFWNTYAQ

SEQ ID NO: 1033814 - protein, 9 aa, Homo Sapiens
SFAVPFFSQ

SEQ ID NO: 1033815 - protein, 9 aa, Homo Sapiens
TDFLISHKI

SEQ ID NO: 1033816 - protein, 9 aa, Homo Sapiens
TPQDGDVIA

SEQ ID NO: 1033817 - protein, 9 aa, Homo Sapiens
AQCLQRYSW

SEQ ID NO: 1033818 - protein, 9 aa, Homo Sapiens
PSAQQRKKV

SEQ ID NO: 1033819 - protein, 9 aa, Homo Sapiens
HPPPSVVHT

SEQ ID NO: 1033820 - protein, 9 aa, Homo Sapiens
KKAQKDEFL

SEQ ID NO: 1033821 - protein, 9 aa, Homo Sapiens
VLGTENVNI

SEQ ID NO: 1033822 - protein, 9 aa, Homo Sapiens
KGKFHVTSK

SEQ ID NO: 1033823 - protein, 9 aa, Homo Sapiens
EKALNKRFR

SEQ ID NO: 1033824 - protein, 9 aa, Homo Sapiens
LSPDSKAQY

SEQ ID NO: 1033825 - protein, 9 aa, Homo Sapiens
RALGPASAA

SEQ ID NO: 1033826 - protein, 9 aa, Homo Sapiens
VNQLLEQNL

SEQ ID NO: 1033827 - protein, 9 aa, Homo Sapiens
QEDGLSVKQ

SEQ ID NO: 1033828 - protein, 9 aa, Homo Sapiens
SEGLQLHPV

SEQ ID NO: 1033829 - protein, 9 aa, Homo Sapiens
NSQRRVTFE

SEQ ID NO: 1033830 - protein, 9 aa, Homo Sapiens
NKVAQLDPK

SEQ ID NO: 1033831 - protein, 9 aa, Homo Sapiens
SSFSSRKMF

SEQ ID NO: 1033832 - protein, 9 aa, Homo Sapiens
RSPSSQYFL

SEQ ID NO: 1033833 - protein, 9 aa, Homo Sapiens
YGLSNTATT

SEQ ID NO: 1033834 - protein, 9 aa, Homo Sapiens
RCSLSEEDL

SEQ ID NO: 1033835 - protein, 9 aa, Homo Sapiens
PEAFTSILN

SEQ ID NO: 1033836 - protein, 9 aa, Homo Sapiens
PSSHVARPQ

SEQ ID NO: 1033837 - protein, 9 aa, Homo Sapiens
GPGFGLGAV

SEQ ID NO: 1033838 - protein, 9 aa, Homo Sapiens
LCGQPTPCS

SEQ ID NO: 1033839 - protein, 9 aa, Homo Sapiens
KWISPPKPR

SEQ ID NO: 1033840 - protein, 9 aa, Homo Sapiens
RNLVSLGLF

SEQ ID NO: 1033841 - protein, 9 aa, Homo Sapiens
LPGRCKWNK

SEQ ID NO: 1033842 - protein, 9 aa, Homo Sapiens
QVRQGKEQE

SEQ ID NO: 1033843 - protein, 9 aa, Homo Sapiens
QQTTPCLDQ

SEQ ID NO: 1033844 - protein, 9 aa, Homo Sapiens
RGLQRAARP

SEQ ID NO: 1033845 - protein, 9 aa, Homo Sapiens
ELVHASLCR

SEQ ID NO: 1033846 - protein, 9 aa, Homo Sapiens
TALQHLHGS

SEQ ID NO: 1033847 - protein, 9 aa, Homo Sapiens
EFGENEGNP

SEQ ID NO: 1033848 - protein, 9 aa, Homo Sapiens
VVILCSLKT

SEQ ID NO: 1033849 - protein, 9 aa, Homo Sapiens
YHHGYHPSY

SEQ ID NO: 1033850 - protein, 9 aa, Homo Sapiens
KDKKRADFV

SEQ ID NO: 1033851 - protein, 9 aa, Homo Sapiens
LHRDCSKNS

SEQ ID NO: 1033852 - protein, 9 aa, Homo Sapiens
VQEKYSKAT

SEQ ID NO: 1033853 - protein, 9 aa, Homo Sapiens
ILTPEFCQL

SEQ ID NO: 1033854 - protein, 9 aa, Homo Sapiens
LCHRGSFFL

SEQ ID NO: 1033855 - protein, 9 aa, Homo Sapiens
MSIITVCYE

SEQ ID NO: 1033856 - protein, 9 aa, Homo Sapiens
IISYLNLED

SEQ ID NO: 1033857 - protein, 9 aa, Homo Sapiens
GPGTASSPG

SEQ ID NO: 1033858 - protein, 9 aa, Homo Sapiens
KKIYAGKKF

SEQ ID NO: 1033859 - protein, 9 aa, Homo Sapiens
GRGLERLIF

SEQ ID NO: 1033860 - protein, 9 aa, Homo Sapiens
CKSQTLSER

SEQ ID NO: 1033861 - protein, 9 aa, Homo Sapiens
EKDRPHEET

SEQ ID NO: 1033862 - protein, 9 aa, Homo Sapiens
SGILRLVIQ

SEQ ID NO: 1033863 - protein, 9 aa, Homo Sapiens
LEGDGPCLT

SEQ ID NO: 1033864 - protein, 9 aa, Homo Sapiens
NSTDPGLML

SEQ ID NO: 1033865 - protein, 9 aa, Homo Sapiens
SGTQNDVDR

SEQ ID NO: 1033866 - protein, 9 aa, Homo Sapiens
LGEQKKAGL

SEQ ID NO: 1033867 - protein, 9 aa, Homo Sapiens
QRLQKMGFI

SEQ ID NO: 1033868 - protein, 9 aa, Homo Sapiens
LLQNGSAPC

SEQ ID NO: 1033869 - protein, 9 aa, Homo Sapiens
ARQKQILVN

SEQ ID NO: 1033870 - protein, 9 aa, Homo Sapiens
GGETGERLF

SEQ ID NO: 1033871 - protein, 9 aa, Homo Sapiens
KLGAFHITI

SEQ ID NO: 1033872 - protein, 9 aa, Homo Sapiens
LTVYVLGNL

SEQ ID NO: 1033873 - protein, 9 aa, Homo Sapiens
KMLRGIKLL

SEQ ID NO: 1033874 - protein, 9 aa, Homo Sapiens
CRGPVHRVG

SEQ ID NO: 1033875 - protein, 9 aa, Homo Sapiens
PSALCTPSY

SEQ ID NO: 1033876 - protein, 9 aa, Homo Sapiens
SDRSGADKL

SEQ ID NO: 1033877 - protein, 9 aa, Homo Sapiens
SRKAANVLR

SEQ ID NO: 1033878 - protein, 9 aa, Homo Sapiens
DFMESFEVC

SEQ ID NO: 1033879 - protein, 9 aa, Homo Sapiens
PVSAAPARR

SEQ ID NO: 1033880 - protein, 9 aa, Homo Sapiens
FLLILLFYT

SEQ ID NO: 1033881 - protein, 9 aa, Homo Sapiens
AGYFVPTNT

SEQ ID NO: 1033882 - protein, 9 aa, Homo Sapiens
QQWLTPISS

SEQ ID NO: 1033883 - protein, 9 aa, Homo Sapiens
GEASPGSRG

SEQ ID NO: 1033884 - protein, 9 aa, Homo Sapiens
EKKEMKISE

SEQ ID NO: 1033885 - protein, 9 aa, Homo Sapiens
HAGLFFAPG

SEQ ID NO: 1033886 - protein, 9 aa, Homo Sapiens
KTGTQPPEK

SEQ ID NO: 1033887 - protein, 9 aa, Homo Sapiens
AATSITKKC

SEQ ID NO: 1033888 - protein, 9 aa, Homo Sapiens
VRAAQGIRT

SEQ ID NO: 1033889 - protein, 9 aa, Homo Sapiens
HVVMELNEK

SEQ ID NO: 1033890 - protein, 9 aa, Homo Sapiens
GREIRIAPT

SEQ ID NO: 1033891 - protein, 9 aa, Homo Sapiens
QVETRISSR

SEQ ID NO: 1033892 - protein, 9 aa, Homo Sapiens
KSVPTTWEY

SEQ ID NO: 1033893 - protein, 9 aa, Homo Sapiens
TTSRQPIFL

SEQ ID NO: 1033894 - protein, 9 aa, Homo Sapiens
SHLSRVQDF

SEQ ID NO: 1033895 - protein, 9 aa, Homo Sapiens
CTPGLKILS

SEQ ID NO: 1033896 - protein, 9 aa, Homo Sapiens
EKNGTIIFI

SEQ ID NO: 1033897 - protein, 9 aa, Homo Sapiens
VDLLFTELL

SEQ ID NO: 1033898 - protein, 9 aa, Homo Sapiens
PYQRLVREI

SEQ ID NO: 1033899 - protein, 9 aa, Homo Sapiens
QILCYPETG

SEQ ID NO: 1033900 - protein, 9 aa, Homo Sapiens
KSSSLRKME

SEQ ID NO: 1033901 - protein, 9 aa, Homo Sapiens
DSCPTVNFI

SEQ ID NO: 1033902 - protein, 9 aa, Homo Sapiens
LKTSVDKSQ

SEQ ID NO: 1033903 - protein, 9 aa, Homo Sapiens
MKQNPRRWG

SEQ ID NO: 1033904 - protein, 9 aa, Homo Sapiens
RHANFSSAE

SEQ ID NO: 1033905 - protein, 9 aa, Homo Sapiens
VLLDLTDEL

SEQ ID NO: 1033906 - protein, 9 aa, Homo Sapiens
LYIKKYQKT

SEQ ID NO: 1033907 - protein, 9 aa, Homo Sapiens
ILPVGRIEK

SEQ ID NO: 1033908 - protein, 9 aa, Homo Sapiens
ESAVHTFNQ

SEQ ID NO: 1033909 - protein, 9 aa, Homo Sapiens
AQGASELEQ

SEQ ID NO: 1033910 - protein, 9 aa, Homo Sapiens
DSPDSSSLL

SEQ ID NO: 1033911 - protein, 9 aa, Homo Sapiens
PSEFLKKMS

SEQ ID NO: 1033912 - protein, 9 aa, Homo Sapiens
HKACKSQTL

SEQ ID NO: 1033913 - protein, 9 aa, Homo Sapiens
GPKDKKITL

SEQ ID NO: 1033914 - protein, 9 aa, Homo Sapiens
GGHRSSTAR

SEQ ID NO: 1033915 - protein, 9 aa, Homo Sapiens
SHVCNCSTF

SEQ ID NO: 1033916 - protein, 9 aa, Homo Sapiens
MFTSESVRE

SEQ ID NO: 1033917 - protein, 9 aa, Homo Sapiens
GNQRIKVLN

SEQ ID NO: 1033918 - protein, 9 aa, Homo Sapiens
VVREVILKE

SEQ ID NO: 1033919 - protein, 9 aa, Homo Sapiens
PSVKLSTVS

SEQ ID NO: 1033920 - protein, 9 aa, Homo Sapiens
DQEEEAELR

SEQ ID NO: 1033921 - protein, 9 aa, Homo Sapiens
GSTTEVSEG

SEQ ID NO: 1033922 - protein, 9 aa, Homo Sapiens
QIFSSLDKV

SEQ ID NO: 1033923 - protein, 9 aa, Homo Sapiens
ALILGGSGP

SEQ ID NO: 1033924 - protein, 9 aa, Homo Sapiens
FAKIEESTS

SEQ ID NO: 1033925 - protein, 9 aa, Homo Sapiens
HEETRPVRA

SEQ ID NO: 1033926 - protein, 9 aa, Homo Sapiens
MGGFAKSVF

SEQ ID NO: 1033927 - protein, 9 aa, Homo Sapiens
RLFYFLGLR

SEQ ID NO: 1033928 - protein, 9 aa, Homo Sapiens
SGQGPKESG

SEQ ID NO: 1033929 - protein, 9 aa, Homo Sapiens
EKGPKDKKI

SEQ ID NO: 1033930 - protein, 9 aa, Homo Sapiens
YSTQLFCNV

SEQ ID NO: 1033931 - protein, 9 aa, Homo Sapiens
STEEIFNHF

SEQ ID NO: 1033932 - protein, 9 aa, Homo Sapiens
VLVPRHSKY

SEQ ID NO: 1033933 - protein, 9 aa, Homo Sapiens
KKEKEMETL

SEQ ID NO: 1033934 - protein, 9 aa, Homo Sapiens
VAHINEKKN

SEQ ID NO: 1033935 - protein, 9 aa, Homo Sapiens
LIEKKEMKI

SEQ ID NO: 1033936 - protein, 9 aa, Homo Sapiens
SKQIFSSLD

SEQ ID NO: 1033937 - protein, 9 aa, Homo Sapiens
LPCEFHLFF

SEQ ID NO: 1033938 - protein, 9 aa, Homo Sapiens
QSEEQTSDE

SEQ ID NO: 1033939 - protein, 9 aa, Homo Sapiens
LNCPFGFFT

SEQ ID NO: 1033940 - protein, 9 aa, Homo Sapiens
CRFTLSPED

SEQ ID NO: 1033941 - protein, 9 aa, Homo Sapiens
TSLATESNT

SEQ ID NO: 1033942 - protein, 9 aa, Homo Sapiens
SLLSLECTV

SEQ ID NO: 1033943 - protein, 9 aa, Homo Sapiens
LRRRGRFKG

SEQ ID NO: 1033944 - protein, 9 aa, Homo Sapiens
VKRFKTNLH

SEQ ID NO: 1033945 - protein, 9 aa, Homo Sapiens
KKARIAQKG

SEQ ID NO: 1033946 - protein, 9 aa, Homo Sapiens
KLSDDRRYD

SEQ ID NO: 1033947 - protein, 9 aa, Homo Sapiens
SPESPGAPE

SEQ ID NO: 1033948 - protein, 9 aa, Homo Sapiens
LPPILFPRF

SEQ ID NO: 1033949 - protein, 9 aa, Homo Sapiens
AQGLPGPAG

SEQ ID NO: 1033950 - protein, 9 aa, Homo Sapiens
VSCVFIYLR

SEQ ID NO: 1033951 - protein, 9 aa, Homo Sapiens
LRCLRYVWA

SEQ ID NO: 1033952 - protein, 9 aa, Homo Sapiens
IQKNMERFL

SEQ ID NO: 1033953 - protein, 9 aa, Homo Sapiens
PVTCPLVSI

SEQ ID NO: 1033954 - protein, 9 aa, Homo Sapiens
SADKEFPLV

SEQ ID NO: 1033955 - protein, 9 aa, Homo Sapiens
IDATTEPCT

SEQ ID NO: 1033956 - protein, 9 aa, Homo Sapiens
GLEAQREAL

SEQ ID NO: 1033957 - protein, 9 aa, Homo Sapiens
QSTHHSLRT

SEQ ID NO: 1033958 - protein, 9 aa, Homo Sapiens
FTPVSNDMC

SEQ ID NO: 1033959 - protein, 9 aa, Homo Sapiens
KPRSRRTAP

SEQ ID NO: 1033960 - protein, 9 aa, Homo Sapiens
LSTCREIRG

SEQ ID NO: 1033961 - protein, 9 aa, Homo Sapiens
SEACYKCKI

SEQ ID NO: 1033962 - protein, 9 aa, Homo Sapiens
NFTELIVTD

SEQ ID NO: 1033963 - protein, 9 aa, Homo Sapiens
GKGYFADYA

SEQ ID NO: 1033964 - protein, 9 aa, Homo Sapiens
TAALTRTAA

SEQ ID NO: 1033965 - protein, 9 aa, Homo Sapiens
FFPKLLGNP

SEQ ID NO: 1033966 - protein, 9 aa, Homo Sapiens
EKSEAGNEE

SEQ ID NO: 1033967 - protein, 9 aa, Homo Sapiens
KIELLEECI

SEQ ID NO: 1033968 - protein, 9 aa, Homo Sapiens
EEEGRFFKA

SEQ ID NO: 1033969 - protein, 9 aa, Homo Sapiens
PRGKPRFKP

SEQ ID NO: 1033970 - protein, 9 aa, Homo Sapiens
QFVNSKRAL

SEQ ID NO: 1033971 - protein, 9 aa, Homo Sapiens
QLEKSAISG

SEQ ID NO: 1033972 - protein, 9 aa, Homo Sapiens
HRDLLQPLL

SEQ ID NO: 1033973 - protein, 9 aa, Homo Sapiens
ARQLEKKEA

SEQ ID NO: 1033974 - protein, 9 aa, Homo Sapiens
VMSIEKVER

SEQ ID NO: 1033975 - protein, 9 aa, Homo Sapiens
AGKTYIIFF

SEQ ID NO: 1033976 - protein, 9 aa, Homo Sapiens
EEGRFFKAY

SEQ ID NO: 1033977 - protein, 9 aa, Homo Sapiens
EEKAAKNGA

SEQ ID NO: 1033978 - protein, 9 aa, Homo Sapiens
DPSGEETLS

SEQ ID NO: 1033979 - protein, 9 aa, Homo Sapiens
MISPRNCGS

SEQ ID NO: 1033980 - protein, 9 aa, Homo Sapiens
PQNLKEEEF

SEQ ID NO: 1033981 - protein, 9 aa, Homo Sapiens
SAISVHGES

SEQ ID NO: 1033982 - protein, 9 aa, Homo Sapiens
GTGTLTEKK

SEQ ID NO: 1033983 - protein, 9 aa, Homo Sapiens
LPYQRLVRE

SEQ ID NO: 1033984 - protein, 9 aa, Homo Sapiens
LQLEAISAP

SEQ ID NO: 1033985 - protein, 9 aa, Homo Sapiens
SCKQFVIGG

SEQ ID NO: 1033986 - protein, 9 aa, Homo Sapiens
VFSILRIFS

SEQ ID NO: 1033987 - protein, 9 aa, Homo Sapiens
NTLIFSLRN

SEQ ID NO: 1033988 - protein, 9 aa, Homo Sapiens
KGSNKRGDN

SEQ ID NO: 1033989 - protein, 9 aa, Homo Sapiens
VRKTFDCST

SEQ ID NO: 1033990 - protein, 9 aa, Homo Sapiens
KMKCSRYKV

SEQ ID NO: 1033991 - protein, 9 aa, Homo Sapiens
VPSSTKLAR

SEQ ID NO: 1033992 - protein, 9 aa, Homo Sapiens
ATFPDVYGF

SEQ ID NO: 1033993 - protein, 9 aa, Homo Sapiens
NKKLPIHQN

SEQ ID NO: 1033994 - protein, 9 aa, Homo Sapiens
LILGGSGPV

SEQ ID NO: 1033995 - protein, 9 aa, Homo Sapiens
ELRGWADEL

SEQ ID NO: 1033996 - protein, 9 aa, Homo Sapiens
YGPSDMQGL

SEQ ID NO: 1033997 - protein, 9 aa, Homo Sapiens
AIAIRNTES

SEQ ID NO: 1033998 - protein, 9 aa, Homo Sapiens
PKKNRASPA

SEQ ID NO: 1033999 - protein, 9 aa, Homo Sapiens
LDLKQTCRM

SEQ ID NO: 1034000 - protein, 9 aa, Homo Sapiens
PICQGTLRK

SEQ ID NO: 1034001 - protein, 9 aa, Homo Sapiens
LVPPFLNSL

SEQ ID NO: 1034002 - protein, 9 aa, Homo Sapiens
RDPRFFSSP

SEQ ID NO: 1034003 - protein, 9 aa, Homo Sapiens
PRGEVPGSS

SEQ ID NO: 1034004 - protein, 9 aa, Homo Sapiens
YNFFIVLLS

SEQ ID NO: 1034005 - protein, 9 aa, Homo Sapiens
FRVFLGNSH

SEQ ID NO: 1034006 - protein, 9 aa, Homo Sapiens
SRPSGARFE

SEQ ID NO: 1034007 - protein, 9 aa, Homo Sapiens
KGLDPSSPA

SEQ ID NO: 1034008 - protein, 9 aa, Homo Sapiens
EKYGVVREV

SEQ ID NO: 1034009 - protein, 9 aa, Homo Sapiens
SSWDYRWDL

SEQ ID NO: 1034010 - protein, 9 aa, Homo Sapiens
PVVWAQEEA

SEQ ID NO: 1034011 - protein, 9 aa, Homo Sapiens
KKFDRVTLG

SEQ ID NO: 1034012 - protein, 9 aa, Homo Sapiens
NKALKFLNK

SEQ ID NO: 1034013 - protein, 9 aa, Homo Sapiens
SASAICKLM

SEQ ID NO: 1034014 - protein, 9 aa, Homo Sapiens
GGGGEGSVP

SEQ ID NO: 1034015 - protein, 9 aa, Homo Sapiens
TEAYTTFIK

SEQ ID NO: 1034016 - protein, 9 aa, Homo Sapiens
YCPIEPGTY

SEQ ID NO: 1034017 - protein, 9 aa, Homo Sapiens
VVMSYDCYV

SEQ ID NO: 1034018 - protein, 9 aa, Homo Sapiens
MLTLTQGPS

SEQ ID NO: 1034019 - protein, 9 aa, Homo Sapiens
EQGEGVQKS

SEQ ID NO: 1034020 - protein, 9 aa, Homo Sapiens
EIGELAVRR

SEQ ID NO: 1034021 - protein, 9 aa, Homo Sapiens
HSFDDHLSS

SEQ ID NO: 1034022 - protein, 9 aa, Homo Sapiens
HGYHPSYAK

SEQ ID NO: 1034023 - protein, 9 aa, Homo Sapiens
NLVIKQGDF

SEQ ID NO: 1034024 - protein, 9 aa, Homo Sapiens
DSCGKEFSS

SEQ ID NO: 1034025 - protein, 9 aa, Homo Sapiens
EGPASSFTP

SEQ ID NO: 1034026 - protein, 9 aa, Homo Sapiens
KLPSPRISC

SEQ ID NO: 1034027 - protein, 9 aa, Homo Sapiens
AESLISLEK

SEQ ID NO: 1034028 - protein, 9 aa, Homo Sapiens
TCNIKNSRC

SEQ ID NO: 1034029 - protein, 9 aa, Homo Sapiens
GCQGDFGGP

SEQ ID NO: 1034030 - protein, 9 aa, Homo Sapiens
NFPQTPLKG

SEQ ID NO: 1034031 - protein, 9 aa, Homo Sapiens
SASWKEPFP

SEQ ID NO: 1034032 - protein, 9 aa, Homo Sapiens
VRLHTNRSQ

SEQ ID NO: 1034033 - protein, 9 aa, Homo Sapiens
KCRLEQELA

SEQ ID NO: 1034034 - protein, 9 aa, Homo Sapiens
CSSSPSSSG

SEQ ID NO: 1034035 - protein, 9 aa, Homo Sapiens
ARTPPMWIS

SEQ ID NO: 1034036 - protein, 9 aa, Homo Sapiens
NSTTLWEVT

SEQ ID NO: 1034037 - protein, 9 aa, Homo Sapiens
DYAKHKCTA

SEQ ID NO: 1034038 - protein, 9 aa, Homo Sapiens
YKGCSGNFK

SEQ ID NO: 1034039 - protein, 9 aa, Homo Sapiens
VNSKRALFT

SEQ ID NO: 1034040 - protein, 9 aa, Homo Sapiens
ASCWAVQLL

SEQ ID NO: 1034041 - protein, 9 aa, Homo Sapiens
IQVTFFLFY

SEQ ID NO: 1034042 - protein, 9 aa, Homo Sapiens
AVLAAGKEV

SEQ ID NO: 1034043 - protein, 9 aa, Homo Sapiens
AWIRYALGE

SEQ ID NO: 1034044 - protein, 9 aa, Homo Sapiens
RLEKASIEH

SEQ ID NO: 1034045 - protein, 9 aa, Homo Sapiens
VSVRSKQIF

SEQ ID NO: 1034046 - protein, 9 aa, Homo Sapiens
WLPGEDMRG

SEQ ID NO: 1034047 - protein, 9 aa, Homo Sapiens
VLRIKYLYR

SEQ ID NO: 1034048 - protein, 9 aa, Homo Sapiens
SFCRTPAWE

SEQ ID NO: 1034049 - protein, 9 aa, Homo Sapiens
CESHCAEKS

SEQ ID NO: 1034050 - protein, 9 aa, Homo Sapiens
ASSLANSSP

SEQ ID NO: 1034051 - protein, 9 aa, Homo Sapiens
EILYKLVQL

SEQ ID NO: 1034052 - protein, 9 aa, Homo Sapiens
GRPLDRLPK

SEQ ID NO: 1034053 - protein, 9 aa, Homo Sapiens
KIEDYFIDL

SEQ ID NO: 1034054 - protein, 9 aa, Homo Sapiens
AAAQSVLTL

SEQ ID NO: 1034055 - protein, 9 aa, Homo Sapiens
GKIYNIWHR

SEQ ID NO: 1034056 - protein, 9 aa, Homo Sapiens
PQVPNKIIE

SEQ ID NO: 1034057 - protein, 9 aa, Homo Sapiens
KLPAVPASL

SEQ ID NO: 1034058 - protein, 9 aa, Homo Sapiens
SINKKLPIH

SEQ ID NO: 1034059 - protein, 9 aa, Homo Sapiens
KALTRGILY

SEQ ID NO: 1034060 - protein, 9 aa, Homo Sapiens
QKTMASVAS

SEQ ID NO: 1034061 - protein, 9 aa, Homo Sapiens
RSLSAFSAA

SEQ ID NO: 1034062 - protein, 9 aa, Homo Sapiens
LVAPKEPKI

SEQ ID NO: 1034063 - protein, 9 aa, Homo Sapiens
KEPLKEETA

SEQ ID NO: 1034064 - protein, 9 aa, Homo Sapiens
NLYERVLHI

SEQ ID NO: 1034065 - protein, 9 aa, Homo Sapiens
SVKQKRLHS

SEQ ID NO: 1034066 - protein, 9 aa, Homo Sapiens
PLFMDCGSD

SEQ ID NO: 1034067 - protein, 9 aa, Homo Sapiens
MVRKSINQD

SEQ ID NO: 1034068 - protein, 9 aa, Homo Sapiens
SKTSSLFDI

SEQ ID NO: 1034069 - protein, 9 aa, Homo Sapiens
FLWSRMHFF

SEQ ID NO: 1034070 - protein, 9 aa, Homo Sapiens
TTITSTTAS

SEQ ID NO: 1034071 - protein, 9 aa, Homo Sapiens
HHGYHPSYA

SEQ ID NO: 1034072 - protein, 9 aa, Homo Sapiens
PGIYLCSVG

SEQ ID NO: 1034073 - protein, 9 aa, Homo Sapiens
TQESYRAYA

SEQ ID NO: 1034074 - protein, 9 aa, Homo Sapiens
REGSRVWEQ

SEQ ID NO: 1034075 - protein, 9 aa, Homo Sapiens
LAKLLCKIL

SEQ ID NO: 1034076 - protein, 9 aa, Homo Sapiens
RKKLLNALE

SEQ ID NO: 1034077 - protein, 9 aa, Homo Sapiens
DPGLKPPVY

SEQ ID NO: 1034078 - protein, 9 aa, Homo Sapiens
PHWEENTVY

SEQ ID NO: 1034079 - protein, 9 aa, Homo Sapiens
KQLLEEIWS

SEQ ID NO: 1034080 - protein, 9 aa, Homo Sapiens
IGKNNPSLK

SEQ ID NO: 1034081 - protein, 9 aa, Homo Sapiens
RGHSHNALS

SEQ ID NO: 1034082 - protein, 9 aa, Homo Sapiens
ERLFACEEC

SEQ ID NO: 1034083 - protein, 9 aa, Homo Sapiens
RSYKTTTDC

SEQ ID NO: 1034084 - protein, 9 aa, Homo Sapiens
VTLQFQARM

SEQ ID NO: 1034085 - protein, 9 aa, Homo Sapiens
PLAGQPQGP

SEQ ID NO: 1034086 - protein, 9 aa, Homo Sapiens
RQNGPSPKF

SEQ ID NO: 1034087 - protein, 9 aa, Homo Sapiens
MSTLVYADQ

SEQ ID NO: 1034088 - protein, 9 aa, Homo Sapiens
KPWSKGPAE

SEQ ID NO: 1034089 - protein, 9 aa, Homo Sapiens
KLAGQSRAE

SEQ ID NO: 1034090 - protein, 9 aa, Homo Sapiens
HRRIHRGEK

SEQ ID NO: 1034091 - protein, 9 aa, Homo Sapiens
IHQKIYTEE

SEQ ID NO: 1034092 - protein, 9 aa, Homo Sapiens
QIRKFQRHD

SEQ ID NO: 1034093 - protein, 9 aa, Homo Sapiens
KRFPEAPFC

SEQ ID NO: 1034094 - protein, 9 aa, Homo Sapiens
TKCRLEQEL

SEQ ID NO: 1034095 - protein, 9 aa, Homo Sapiens
CQECGKAFE

SEQ ID NO: 1034096 - protein, 9 aa, Homo Sapiens
NKHKKIYAG

SEQ ID NO: 1034097 - protein, 9 aa, Homo Sapiens
GLMLAIPAM

SEQ ID NO: 1034098 - protein, 9 aa, Homo Sapiens
QKKTTSSIS

SEQ ID NO: 1034099 - protein, 9 aa, Homo Sapiens
LGKKPQGRA

SEQ ID NO: 1034100 - protein, 9 aa, Homo Sapiens
SQRRVTFED

SEQ ID NO: 1034101 - protein, 9 aa, Homo Sapiens
LVCAYDSEA

SEQ ID NO: 1034102 - protein, 9 aa, Homo Sapiens
TFSWLIFIF

SEQ ID NO: 1034103 - protein, 9 aa, Homo Sapiens
HALSEGWSA

SEQ ID NO: 1034104 - protein, 9 aa, Homo Sapiens
ETVLAALEA

SEQ ID NO: 1034105 - protein, 9 aa, Homo Sapiens
QELVMDKKN

SEQ ID NO: 1034106 - protein, 9 aa, Homo Sapiens
ENVSTHAAT

SEQ ID NO: 1034107 - protein, 9 aa, Homo Sapiens
GGFLEGPAS

SEQ ID NO: 1034108 - protein, 9 aa, Homo Sapiens
SGRRLVKGL

SEQ ID NO: 1034109 - protein, 9 aa, Homo Sapiens
DENTELYFD

SEQ ID NO: 1034110 - protein, 9 aa, Homo Sapiens
EEKYTEPLI

SEQ ID NO: 1034111 - protein, 9 aa, Homo Sapiens
VNSLCSVIF

SEQ ID NO: 1034112 - protein, 9 aa, Homo Sapiens
HGIPMVGIL

SEQ ID NO: 1034113 - protein, 9 aa, Homo Sapiens
VGLEGTKSI

SEQ ID NO: 1034114 - protein, 9 aa, Homo Sapiens
SVRSKQIFS

SEQ ID NO: 1034115 - protein, 9 aa, Homo Sapiens
DGFLEKNKD

SEQ ID NO: 1034116 - protein, 9 aa, Homo Sapiens
EVDITEGDK

SEQ ID NO: 1034117 - protein, 9 aa, Homo Sapiens
NAAEEAGVP

SEQ ID NO: 1034118 - protein, 9 aa, Homo Sapiens
VTAVEKMTS

SEQ ID NO: 1034119 - protein, 9 aa, Homo Sapiens
LCLRGQHWL

SEQ ID NO: 1034120 - protein, 9 aa, Homo Sapiens
KTNVINYYF

SEQ ID NO: 1034121 - protein, 9 aa, Homo Sapiens
MQRDVQDSF

SEQ ID NO: 1034122 - protein, 9 aa, Homo Sapiens
RDSGPAPPP

SEQ ID NO: 1034123 - protein, 9 aa, Homo Sapiens
YLHHFFFKT

SEQ ID NO: 1034124 - protein, 9 aa, Homo Sapiens
HARAPSALC

SEQ ID NO: 1034125 - protein, 9 aa, Homo Sapiens
GLCLFSLDK

SEQ ID NO: 1034126 - protein, 9 aa, Homo Sapiens
ARSRPQQRY

SEQ ID NO: 1034127 - protein, 9 aa, Homo Sapiens
SEIALTSLS

SEQ ID NO: 1034128 - protein, 9 aa, Homo Sapiens
MHKNPEWEK

SEQ ID NO: 1034129 - protein, 9 aa, Homo Sapiens
MYIKPSAED

SEQ ID NO: 1034130 - protein, 9 aa, Homo Sapiens
CLNIAVTPL

SEQ ID NO: 1034131 - protein, 9 aa, Homo Sapiens
RGEKPYACL

SEQ ID NO: 1034132 - protein, 9 aa, Homo Sapiens
PQQEEKNTI

SEQ ID NO: 1034133 - protein, 9 aa, Homo Sapiens
QDSKGIHAL

SEQ ID NO: 1034134 - protein, 9 aa, Homo Sapiens
YDTVSSTDG

SEQ ID NO: 1034135 - protein, 9 aa, Homo Sapiens
YCSKVFETD

SEQ ID NO: 1034136 - protein, 9 aa, Homo Sapiens
LDTLAYALS

SEQ ID NO: 1034137 - protein, 9 aa, Homo Sapiens
HARGLQEKN

SEQ ID NO: 1034138 - protein, 9 aa, Homo Sapiens
CVPCNCDLR

SEQ ID NO: 1034139 - protein, 9 aa, Homo Sapiens
LGAGGTLQQ

SEQ ID NO: 1034140 - protein, 9 aa, Homo Sapiens
KVVPFSSIK

SEQ ID NO: 1034141 - protein, 9 aa, Homo Sapiens
AGDHLGRAV

SEQ ID NO: 1034142 - protein, 9 aa, Homo Sapiens
GWAPLAGCS

SEQ ID NO: 1034143 - protein, 9 aa, Homo Sapiens
YIQVVEAND

SEQ ID NO: 1034144 - protein, 9 aa, Homo Sapiens
MARICLSSG

SEQ ID NO: 1034145 - protein, 9 aa, Homo Sapiens
LFQAGLGKM

SEQ ID NO: 1034146 - protein, 9 aa, Homo Sapiens
ITLCIFVLL

SEQ ID NO: 1034147 - protein, 9 aa, Homo Sapiens
LTIPLCLAV

SEQ ID NO: 1034148 - protein, 9 aa, Homo Sapiens
ALYIKKYQK

SEQ ID NO: 1034149 - protein, 9 aa, Homo Sapiens
NCVSWNPQV

SEQ ID NO: 1034150 - protein, 9 aa, Homo Sapiens
HFLKKARIA

SEQ ID NO: 1034151 - protein, 9 aa, Homo Sapiens
PCKNIFFKA

SEQ ID NO: 1034152 - protein, 9 aa, Homo Sapiens
NSFYYDVER

SEQ ID NO: 1034153 - protein, 9 aa, Homo Sapiens
SQRRRVAEE

SEQ ID NO: 1034154 - protein, 9 aa, Homo Sapiens
FSQQSGTPG

SEQ ID NO: 1034155 - protein, 9 aa, Homo Sapiens
TQCTNSEES

SEQ ID NO: 1034156 - protein, 9 aa, Homo Sapiens
RFTLSPEDQ

SEQ ID NO: 1034157 - protein, 9 aa, Homo Sapiens
KVAEYKYQL

SEQ ID NO: 1034158 - protein, 9 aa, Homo Sapiens
GGEGSVPGI

SEQ ID NO: 1034159 - protein, 9 aa, Homo Sapiens
QFSIPQTAK

SEQ ID NO: 1034160 - protein, 9 aa, Homo Sapiens
KSFKPVPKP

SEQ ID NO: 1034161 - protein, 9 aa, Homo Sapiens
EFCAAFYLI

SEQ ID NO: 1034162 - protein, 9 aa, Homo Sapiens
GEAKQQFSF

SEQ ID NO: 1034163 - protein, 9 aa, Homo Sapiens
IEKKKDTLK

SEQ ID NO: 1034164 - protein, 9 aa, Homo Sapiens
IQGRWMKQN

SEQ ID NO: 1034165 - protein, 9 aa, Homo Sapiens
STGHATPFP

SEQ ID NO: 1034166 - protein, 9 aa, Homo Sapiens
RPSSSVSLF

SEQ ID NO: 1034167 - protein, 9 aa, Homo Sapiens
CRLEQELAI

SEQ ID NO: 1034168 - protein, 9 aa, Homo Sapiens
RRSRPSFCR

SEQ ID NO: 1034169 - protein, 9 aa, Homo Sapiens
KEQDLRKHG

SEQ ID NO: 1034170 - protein, 9 aa, Homo Sapiens
LLISQDKLP

SEQ ID NO: 1034171 - protein, 9 aa, Homo Sapiens
RPAWSGARR

SEQ ID NO: 1034172 - protein, 9 aa, Homo Sapiens
SLGLFFRRP

SEQ ID NO: 1034173 - protein, 9 aa, Homo Sapiens
ILLFYTRIT

SEQ ID NO: 1034174 - protein, 9 aa, Homo Sapiens
EVSEGLQLH

SEQ ID NO: 1034175 - protein, 9 aa, Homo Sapiens
DASKVVLMG

SEQ ID NO: 1034176 - protein, 9 aa, Homo Sapiens
NEGNPNVHF

SEQ ID NO: 1034177 - protein, 9 aa, Homo Sapiens
DKNDNVSEI

SEQ ID NO: 1034178 - protein, 9 aa, Homo Sapiens
IRGSKHQKI

SEQ ID NO: 1034179 - protein, 9 aa, Homo Sapiens
CRDAPQGRL

SEQ ID NO: 1034180 - protein, 9 aa, Homo Sapiens
PMKKLTTLF

SEQ ID NO: 1034181 - protein, 9 aa, Homo Sapiens
LFLFALGCE

SEQ ID NO: 1034182 - protein, 9 aa, Homo Sapiens
LEFCTYDDF

SEQ ID NO: 1034183 - protein, 9 aa, Homo Sapiens
VNYTTTLTP

SEQ ID NO: 1034184 - protein, 9 aa, Homo Sapiens
GSHAGLFFA

SEQ ID NO: 1034185 - protein, 9 aa, Homo Sapiens
DGEDIKHKE

SEQ ID NO: 1034186 - protein, 9 aa, Homo Sapiens
HHGVCQKNC

SEQ ID NO: 1034187 - protein, 9 aa, Homo Sapiens
GCVNFPPEE

SEQ ID NO: 1034188 - protein, 9 aa, Homo Sapiens
KRADFVANK

SEQ ID NO: 1034189 - protein, 9 aa, Homo Sapiens
MVALGPTEP

SEQ ID NO: 1034190 - protein, 9 aa, Homo Sapiens
KSKLSVKVP

SEQ ID NO: 1034191 - protein, 9 aa, Homo Sapiens
AVTKEAALC

SEQ ID NO: 1034192 - protein, 9 aa, Homo Sapiens
VFGTGQNDW

SEQ ID NO: 1034193 - protein, 9 aa, Homo Sapiens
QHLQRVDAP

SEQ ID NO: 1034194 - protein, 9 aa, Homo Sapiens
TTIYGRVIV

SEQ ID NO: 1034195 - protein, 9 aa, Homo Sapiens
RQQKLVIVE

SEQ ID NO: 1034196 - protein, 9 aa, Homo Sapiens
VYPLKKASG

SEQ ID NO: 1034197 - protein, 9 aa, Homo Sapiens
PLFTETSQT

SEQ ID NO: 1034198 - protein, 9 aa, Homo Sapiens
VGSGTKSPA

SEQ ID NO: 1034199 - protein, 9 aa, Homo Sapiens
SKPVQIMFM

SEQ ID NO: 1034200 - protein, 9 aa, Homo Sapiens
TQKKLPSPR

SEQ ID NO: 1034201 - protein, 9 aa, Homo Sapiens
VSASAEVRR

SEQ ID NO: 1034202 - protein, 9 aa, Homo Sapiens
MPEKKSNPK

SEQ ID NO: 1034203 - protein, 9 aa, Homo Sapiens
FLPHFLEGD

SEQ ID NO: 1034204 - protein, 9 aa, Homo Sapiens
RIYNEISDI

SEQ ID NO: 1034205 - protein, 9 aa, Homo Sapiens
EAYQEAFDI

SEQ ID NO: 1034206 - protein, 9 aa, Homo Sapiens
AVGSHPLPS

SEQ ID NO: 1034207 - protein, 9 aa, Homo Sapiens
TFFLFYLLP

SEQ ID NO: 1034208 - protein, 9 aa, Homo Sapiens
TLAEDAVFV

SEQ ID NO: 1034209 - protein, 9 aa, Homo Sapiens
LEEEAVEFC

SEQ ID NO: 1034210 - protein, 9 aa, Homo Sapiens
TEAHQDELG

SEQ ID NO: 1034211 - protein, 9 aa, Homo Sapiens
SLRNRIVYY

SEQ ID NO: 1034212 - protein, 9 aa, Homo Sapiens
KQGVLTLKI

SEQ ID NO: 1034213 - protein, 9 aa, Homo Sapiens
HINLNQVAI

SEQ ID NO: 1034214 - protein, 9 aa, Homo Sapiens
SDVLRIKYL

SEQ ID NO: 1034215 - protein, 9 aa, Homo Sapiens
KLPLVLIHP

SEQ ID NO: 1034216 - protein, 9 aa, Homo Sapiens
VTCPLVSIP

SEQ ID NO: 1034217 - protein, 9 aa, Homo Sapiens
RGPKVHKKC

SEQ ID NO: 1034218 - protein, 9 aa, Homo Sapiens
LSSVSVSQA

SEQ ID NO: 1034219 - protein, 9 aa, Homo Sapiens
LEITSDFQS

SEQ ID NO: 1034220 - protein, 9 aa, Homo Sapiens
ESLYLVPVI

SEQ ID NO: 1034221 - protein, 9 aa, Homo Sapiens
WAHLTEVNP

SEQ ID NO: 1034222 - protein, 9 aa, Homo Sapiens
LDRGTTFTL

SEQ ID NO: 1034223 - protein, 9 aa, Homo Sapiens
LLKKLGAFH

SEQ ID NO: 1034224 - protein, 9 aa, Homo Sapiens
ALTRTAART

SEQ ID NO: 1034225 - protein, 9 aa, Homo Sapiens
CSRYKVCIA

SEQ ID NO: 1034226 - protein, 9 aa, Homo Sapiens
FRPLPPILF

SEQ ID NO: 1034227 - protein, 9 aa, Homo Sapiens
SDSFYSVFH

SEQ ID NO: 1034228 - protein, 9 aa, Homo Sapiens
LGNLSALQT

SEQ ID NO: 1034229 - protein, 9 aa, Homo Sapiens
GTAWLPGED

SEQ ID NO: 1034230 - protein, 9 aa, Homo Sapiens
ENTELYFDH

SEQ ID NO: 1034231 - protein, 9 aa, Homo Sapiens
QFPETFLGD

SEQ ID NO: 1034232 - protein, 9 aa, Homo Sapiens
PEAASLGAP

SEQ ID NO: 1034233 - protein, 9 aa, Homo Sapiens
SQDLGCYLS

SEQ ID NO: 1034234 - protein, 9 aa, Homo Sapiens
SAKKVTQLR

SEQ ID NO: 1034235 - protein, 9 aa, Homo Sapiens
HLSEEPSKN

SEQ ID NO: 1034236 - protein, 9 aa, Homo Sapiens
TRNPNPFIS

SEQ ID NO: 1034237 - protein, 9 aa, Homo Sapiens
SSVSLFCRP

SEQ ID NO: 1034238 - protein, 9 aa, Homo Sapiens
KKDLAEWLR

SEQ ID NO: 1034239 - protein, 9 aa, Homo Sapiens
EIGENIGEH

SEQ ID NO: 1034240 - protein, 9 aa, Homo Sapiens
ETQLKPKNT

SEQ ID NO: 1034241 - protein, 9 aa, Homo Sapiens
DLYLLFACM

SEQ ID NO: 1034242 - protein, 9 aa, Homo Sapiens
GSLCPRQNG

SEQ ID NO: 1034243 - protein, 9 aa, Homo Sapiens
KYHTEAYTT

SEQ ID NO: 1034244 - protein, 9 aa, Homo Sapiens
NCDLRGTSG

SEQ ID NO: 1034245 - protein, 9 aa, Homo Sapiens
PEKKVQTLP

SEQ ID NO: 1034246 - protein, 9 aa, Homo Sapiens
LMKKSLQTG

SEQ ID NO: 1034247 - protein, 9 aa, Homo Sapiens
SFAFGICIK

SEQ ID NO: 1034248 - protein, 9 aa, Homo Sapiens
EHKGEFTCH

SEQ ID NO: 1034249 - protein, 9 aa, Homo Sapiens
VKGLQRSGW

SEQ ID NO: 1034250 - protein, 9 aa, Homo Sapiens
NPSHSFAFG

SEQ ID NO: 1034251 - protein, 9 aa, Homo Sapiens
TSSDLPTLA

SEQ ID NO: 1034252 - protein, 9 aa, Homo Sapiens
CYEIIAAKI

SEQ ID NO: 1034253 - protein, 9 aa, Homo Sapiens
DSKGIHALS

SEQ ID NO: 1034254 - protein, 9 aa, Homo Sapiens
MPLSEATTP

SEQ ID NO: 1034255 - protein, 9 aa, Homo Sapiens
FPFIAISCF

SEQ ID NO: 1034256 - protein, 9 aa, Homo Sapiens
EEWKTLPAP

SEQ ID NO: 1034257 - protein, 9 aa, Homo Sapiens
GTKRMLLYV

SEQ ID NO: 1034258 - protein, 9 aa, Homo Sapiens
YKLNSEGTL

SEQ ID NO: 1034259 - protein, 9 aa, Homo Sapiens
VQHAPSEFV

SEQ ID NO: 1034260 - protein, 9 aa, Homo Sapiens
GRYRPSTFH

SEQ ID NO: 1034261 - protein, 9 aa, Homo Sapiens
QLAQEVAQK

SEQ ID NO: 1034262 - protein, 9 aa, Homo Sapiens
KQILVNLSM

SEQ ID NO: 1034263 - protein, 9 aa, Homo Sapiens
VFSVSTTGT

SEQ ID NO: 1034264 - protein, 9 aa, Homo Sapiens
HFWNQRWLG

SEQ ID NO: 1034265 - protein, 9 aa, Homo Sapiens
LEKSAISGF

SEQ ID NO: 1034266 - protein, 9 aa, Homo Sapiens
FYAPRRGEF

SEQ ID NO: 1034267 - protein, 9 aa, Homo Sapiens
SSEAVLLDL

SEQ ID NO: 1034268 - protein, 9 aa, Homo Sapiens
LESFLEGFY

SEQ ID NO: 1034269 - protein, 9 aa, Homo Sapiens
EMKQANGQF

SEQ ID NO: 1034270 - protein, 9 aa, Homo Sapiens
PIGPRACCD

SEQ ID NO: 1034271 - protein, 9 aa, Homo Sapiens
CGCARITPA

SEQ ID NO: 1034272 - protein, 9 aa, Homo Sapiens
VQLKTSRSS

SEQ ID NO: 1034273 - protein, 9 aa, Homo Sapiens
WDNQQKNPP

SEQ ID NO: 1034274 - protein, 9 aa, Homo Sapiens
LWPSRTQNP

SEQ ID NO: 1034275 - protein, 9 aa, Homo Sapiens
LENRARRTD

SEQ ID NO: 1034276 - protein, 9 aa, Homo Sapiens
QFSCLSLLS

SEQ ID NO: 1034277 - protein, 9 aa, Homo Sapiens
EAGVPGGAE

SEQ ID NO: 1034278 - protein, 9 aa, Homo Sapiens
SSPHPRGLR

SEQ ID NO: 1034279 - protein, 9 aa, Homo Sapiens
SNGSLVGGF

SEQ ID NO: 1034280 - protein, 9 aa, Homo Sapiens
TLQQQPSAS

SEQ ID NO: 1034281 - protein, 9 aa, Homo Sapiens
TGRWPRSTA

SEQ ID NO: 1034282 - protein, 9 aa, Homo Sapiens
THTTVTMRW

SEQ ID NO: 1034283 - protein, 9 aa, Homo Sapiens
ILTDKSLSS

SEQ ID NO: 1034284 - protein, 9 aa, Homo Sapiens
NLERELGSM

SEQ ID NO: 1034285 - protein, 9 aa, Homo Sapiens
KYSKATLSP

SEQ ID NO: 1034286 - protein, 9 aa, Homo Sapiens
IEPRYHVRR

SEQ ID NO: 1034287 - protein, 9 aa, Homo Sapiens
LFQYRYAYL

SEQ ID NO: 1034288 - protein, 9 aa, Homo Sapiens
STASHLVGE

SEQ ID NO: 1034289 - protein, 9 aa, Homo Sapiens
MIAAASSPS

SEQ ID NO: 1034290 - protein, 9 aa, Homo Sapiens
EEEVEEESL

SEQ ID NO: 1034291 - protein, 9 aa, Homo Sapiens
EEEPPDLSL

SEQ ID NO: 1034292 - protein, 9 aa, Homo Sapiens
NNKAAKIQL

SEQ ID NO: 1034293 - protein, 9 aa, Homo Sapiens
GKEVGAGGG

SEQ ID NO: 1034294 - protein, 9 aa, Homo Sapiens
PSFEKPLEE

SEQ ID NO: 1034295 - protein, 9 aa, Homo Sapiens
KSLQTGDLL

SEQ ID NO: 1034296 - protein, 9 aa, Homo Sapiens
FPRIVLMLG

SEQ ID NO: 1034297 - protein, 9 aa, Homo Sapiens
LSRVQDFSR

SEQ ID NO: 1034298 - protein, 9 aa, Homo Sapiens
WLVELRKVM

SEQ ID NO: 1034299 - protein, 9 aa, Homo Sapiens
GRSQEVGRV

SEQ ID NO: 1034300 - protein, 9 aa, Homo Sapiens
NSWDGVVED

SEQ ID NO: 1034301 - protein, 9 aa, Homo Sapiens
WVQRVLPQS

SEQ ID NO: 1034302 - protein, 9 aa, Homo Sapiens
IALVRDLNQ

SEQ ID NO: 1034303 - protein, 9 aa, Homo Sapiens
VVFVEQGHV

SEQ ID NO: 1034304 - protein, 9 aa, Homo Sapiens
LKCNISDLS

SEQ ID NO: 1034305 - protein, 9 aa, Homo Sapiens
SAQQRKKVF

SEQ ID NO: 1034306 - protein, 9 aa, Homo Sapiens
VLRGACGLQ

SEQ ID NO: 1034307 - protein, 9 aa, Homo Sapiens
EEIINSFDE

SEQ ID NO: 1034308 - protein, 9 aa, Homo Sapiens
TPCLDQNCS

SEQ ID NO: 1034309 - protein, 9 aa, Homo Sapiens
SREKIDLEE

SEQ ID NO: 1034310 - protein, 9 aa, Homo Sapiens
HEYYPYISS

SEQ ID NO: 1034311 - protein, 9 aa, Homo Sapiens
HAAPPSPPG

SEQ ID NO: 1034312 - protein, 9 aa, Homo Sapiens
QRVDAPVLE

SEQ ID NO: 1034313 - protein, 9 aa, Homo Sapiens
KFEQYLHFV

SEQ ID NO: 1034314 - protein, 9 aa, Homo Sapiens
QPHTKPFVF

SEQ ID NO: 1034315 - protein, 9 aa, Homo Sapiens
TSKKKKDKI

SEQ ID NO: 1034316 - protein, 9 aa, Homo Sapiens
IFKLHAKLG

SEQ ID NO: 1034317 - protein, 9 aa, Homo Sapiens
VSGIGLVNF

SEQ ID NO: 1034318 - protein, 9 aa, Homo Sapiens
HVARPQIFS

SEQ ID NO: 1034319 - protein, 9 aa, Homo Sapiens
MIAHLEVFP

SEQ ID NO: 1034320 - protein, 9 aa, Homo Sapiens
GLRISPRST

SEQ ID NO: 1034321 - protein, 9 aa, Homo Sapiens
SVKLSTVSV

SEQ ID NO: 1034322 - protein, 9 aa, Homo Sapiens
TPGYLSSEV

SEQ ID NO: 1034323 - protein, 9 aa, Homo Sapiens
IETKSFKPV

SEQ ID NO: 1034324 - protein, 9 aa, Homo Sapiens
PKISIPSVP

SEQ ID NO: 1034325 - protein, 9 aa, Homo Sapiens
SSEACYKCK

SEQ ID NO: 1034326 - protein, 9 aa, Homo Sapiens
LGQSTEVKV

SEQ ID NO: 1034327 - protein, 9 aa, Homo Sapiens
AEWSMSFFF

SEQ ID NO: 1034328 - protein, 9 aa, Homo Sapiens
GFPLEWIGL

SEQ ID NO: 1034329 - protein, 9 aa, Homo Sapiens
ASDGGAVKE

SEQ ID NO: 1034330 - protein, 9 aa, Homo Sapiens
GISSEIFHS

SEQ ID NO: 1034331 - protein, 9 aa, Homo Sapiens
ENRARRTDP

SEQ ID NO: 1034332 - protein, 9 aa, Homo Sapiens
CKKTGRCLK

SEQ ID NO: 1034333 - protein, 9 aa, Homo Sapiens
RQQGQEKQV

SEQ ID NO: 1034334 - protein, 9 aa, Homo Sapiens
FVNCSLPNE

SEQ ID NO: 1034335 - protein, 9 aa, Homo Sapiens
GQKRASLWP

SEQ ID NO: 1034336 - protein, 9 aa, Homo Sapiens
YYRKPQVWS

SEQ ID NO: 1034337 - protein, 9 aa, Homo Sapiens
MPYIDAVVH

SEQ ID NO: 1034338 - protein, 9 aa, Homo Sapiens
SLPLLKLQD

SEQ ID NO: 1034339 - protein, 9 aa, Homo Sapiens
IDNSQEAYQ

SEQ ID NO: 1034340 - protein, 9 aa, Homo Sapiens
ENREKEEEQ

SEQ ID NO: 1034341 - protein, 9 aa, Homo Sapiens
SQSVSHNLL

SEQ ID NO: 1034342 - protein, 9 aa, Homo Sapiens
APEETSIAG

SEQ ID NO: 1034343 - protein, 9 aa, Homo Sapiens
PLKFGIVPN

SEQ ID NO: 1034344 - protein, 9 aa, Homo Sapiens
AFLLSADSS

SEQ ID NO: 1034345 - protein, 9 aa, Homo Sapiens
FQQLNDEAQ

SEQ ID NO: 1034346 - protein, 9 aa, Homo Sapiens
CNCDLRGTS

SEQ ID NO: 1034347 - protein, 9 aa, Homo Sapiens
KKKDTLKQH

SEQ ID NO: 1034348 - protein, 9 aa, Homo Sapiens
GLALTFSSA

SEQ ID NO: 1034349 - protein, 9 aa, Homo Sapiens
SAICKLMRK

SEQ ID NO: 1034350 - protein, 9 aa, Homo Sapiens
KVICVRKNA

SEQ ID NO: 1034351 - protein, 9 aa, Homo Sapiens
NRSQELQYQ

SEQ ID NO: 1034352 - protein, 9 aa, Homo Sapiens
RYPLSYKAL

SEQ ID NO: 1034353 - protein, 9 aa, Homo Sapiens
WFIIQKNME

SEQ ID NO: 1034354 - protein, 9 aa, Homo Sapiens
VLDKALDQE

SEQ ID NO: 1034355 - protein, 9 aa, Homo Sapiens
GEKITLCIF

SEQ ID NO: 1034356 - protein, 9 aa, Homo Sapiens
DCYVAVCRP

SEQ ID NO: 1034357 - protein, 9 aa, Homo Sapiens
CVLVVSVIK

SEQ ID NO: 1034358 - protein, 9 aa, Homo Sapiens
QNPSCGSDN

SEQ ID NO: 1034359 - protein, 9 aa, Homo Sapiens
EQKDDNDDE

SEQ ID NO: 1034360 - protein, 9 aa, Homo Sapiens
RVWEQGGVP

SEQ ID NO: 1034361 - protein, 9 aa, Homo Sapiens
KTVWQLPMF

SEQ ID NO: 1034362 - protein, 9 aa, Homo Sapiens
FYSVFHMEC

SEQ ID NO: 1034363 - protein, 9 aa, Homo Sapiens
PESVDVDEC

SEQ ID NO: 1034364 - protein, 9 aa, Homo Sapiens
VTDANYGKL

SEQ ID NO: 1034365 - protein, 9 aa, Homo Sapiens
AVPASLWKP

SEQ ID NO: 1034366 - protein, 9 aa, Homo Sapiens
PKDKKITLK

SEQ ID NO: 1034367 - protein, 9 aa, Homo Sapiens
TPDGRSQEV

SEQ ID NO: 1034368 - protein, 9 aa, Homo Sapiens
IKTSFLAEA

SEQ ID NO: 1034369 - protein, 9 aa, Homo Sapiens
NRKKKTHSI

SEQ ID NO: 1034370 - protein, 9 aa, Homo Sapiens
RSLMRTLSK

SEQ ID NO: 1034371 - protein, 9 aa, Homo Sapiens
NPQQPQAPL

SEQ ID NO: 1034372 - protein, 9 aa, Homo Sapiens
WKPWSKGPA

SEQ ID NO: 1034373 - protein, 9 aa, Homo Sapiens
TSLPRDSPL

SEQ ID NO: 1034374 - protein, 9 aa, Homo Sapiens
PFGFFTDAQ

SEQ ID NO: 1034375 - protein, 9 aa, Homo Sapiens
TMDYRANIF

SEQ ID NO: 1034376 - protein, 9 aa, Homo Sapiens
TMIAAASSP

SEQ ID NO: 1034377 - protein, 9 aa, Homo Sapiens
PLKPVSGGL

SEQ ID NO: 1034378 - protein, 9 aa, Homo Sapiens
LPRDSPLSQ

SEQ ID NO: 1034379 - protein, 9 aa, Homo Sapiens
SSSPPRPYH

SEQ ID NO: 1034380 - protein, 9 aa, Homo Sapiens
CLKMIIIIW

SEQ ID NO: 1034381 - protein, 9 aa, Homo Sapiens
KVFMINRYL

SEQ ID NO: 1034382 - protein, 9 aa, Homo Sapiens
PFPVLESKD

SEQ ID NO: 1034383 - protein, 9 aa, Homo Sapiens
WWLNSQSLP

SEQ ID NO: 1034384 - protein, 9 aa, Homo Sapiens
IQTLASEVE

SEQ ID NO: 1034385 - protein, 9 aa, Homo Sapiens
EKAGDTERT

SEQ ID NO: 1034386 - protein, 9 aa, Homo Sapiens
CYHMKADSV

SEQ ID NO: 1034387 - protein, 9 aa, Homo Sapiens
FHTTAPTTV

SEQ ID NO: 1034388 - protein, 9 aa, Homo Sapiens
GDYLVMRKI

SEQ ID NO: 1034389 - protein, 9 aa, Homo Sapiens
EEQDTFELE

SEQ ID NO: 1034390 - protein, 9 aa, Homo Sapiens
IKYLYRRGR

SEQ ID NO: 1034391 - protein, 9 aa, Homo Sapiens
PERTPALHK

SEQ ID NO: 1034392 - protein, 9 aa, Homo Sapiens
LKEPGGGLF

SEQ ID NO: 1034393 - protein, 9 aa, Homo Sapiens
NESPKKKTI

SEQ ID NO: 1034394 - protein, 9 aa, Homo Sapiens
KEGARAPLE

SEQ ID NO: 1034395 - protein, 9 aa, Homo Sapiens
RGTTFTLGA

SEQ ID NO: 1034396 - protein, 9 aa, Homo Sapiens
FLFCLFSGQ

SEQ ID NO: 1034397 - protein, 9 aa, Homo Sapiens
TFSSAVTNG

SEQ ID NO: 1034398 - protein, 9 aa, Homo Sapiens
GSPRYLGGP

SEQ ID NO: 1034399 - protein, 9 aa, Homo Sapiens
TLRNRVCIA

SEQ ID NO: 1034400 - protein, 9 aa, Homo Sapiens
QKKQGQDYR

SEQ ID NO: 1034401 - protein, 9 aa, Homo Sapiens
TAGSWGVFP

SEQ ID NO: 1034402 - protein, 9 aa, Homo Sapiens
NPGIYLCSV

SEQ ID NO: 1034403 - protein, 9 aa, Homo Sapiens
QATFFPSSL

SEQ ID NO: 1034404 - protein, 9 aa, Homo Sapiens
CSSEVSWGD

SEQ ID NO: 1034405 - protein, 9 aa, Homo Sapiens
DPSLPLLKL

SEQ ID NO: 1034406 - protein, 8 aa, Homo Sapiens
ILILQMRK

SEQ ID NO: 1034407 - protein, 9 aa, Homo Sapiens
KNGLSLGFS

SEQ ID NO: 1034408 - protein, 9 aa, Homo Sapiens
LYLLQNGSA

SEQ ID NO: 1034409 - protein, 9 aa, Homo Sapiens
FYADHSRLS

SEQ ID NO: 1034410 - protein, 9 aa, Homo Sapiens
EERRAVAAL

SEQ ID NO: 1034411 - protein, 9 aa, Homo Sapiens
GSPPPARKA

SEQ ID NO: 1034412 - protein, 9 aa, Homo Sapiens
RKLPYQRLV

SEQ ID NO: 1034413 - protein, 9 aa, Homo Sapiens
LGAGDLYLL

SEQ ID NO: 1034414 - protein, 9 aa, Homo Sapiens
GENEGNPNV

SEQ ID NO: 1034415 - protein, 9 aa, Homo Sapiens
CVQYTKEPR

SEQ ID NO: 1034416 - protein, 9 aa, Homo Sapiens
GIVPNGSTE

SEQ ID NO: 1034417 - protein, 9 aa, Homo Sapiens
SNPEFTLQQ

SEQ ID NO: 1034418 - protein, 9 aa, Homo Sapiens
NITHKVLRI

SEQ ID NO: 1034419 - protein, 9 aa, Homo Sapiens
NSETTITST

SEQ ID NO: 1034420 - protein, 9 aa, Homo Sapiens
AQLEKIEKE

SEQ ID NO: 1034421 - protein, 9 aa, Homo Sapiens
VEEQCERLI

SEQ ID NO: 1034422 - protein, 9 aa, Homo Sapiens
TKLWYCYKV

SEQ ID NO: 1034423 - protein, 9 aa, Homo Sapiens
VPPQCSQLV

SEQ ID NO: 1034424 - protein, 9 aa, Homo Sapiens
RQKLRRRKT

SEQ ID NO: 1034425 - protein, 9 aa, Homo Sapiens
QESSIILRD

SEQ ID NO: 1034426 - protein, 9 aa, Homo Sapiens
TTYKIKVVP

SEQ ID NO: 1034427 - protein, 9 aa, Homo Sapiens
GTASDPSGL

SEQ ID NO: 1034428 - protein, 9 aa, Homo Sapiens
ARELSPNFY

SEQ ID NO: 1034429 - protein, 9 aa, Homo Sapiens
KMIIIIWSI

SEQ ID NO: 1034430 - protein, 9 aa, Homo Sapiens
PTIVNLDYP

SEQ ID NO: 1034431 - protein, 9 aa, Homo Sapiens
KASGCPGAD

SEQ ID NO: 1034432 - protein, 9 aa, Homo Sapiens
SPEPPSSPG

SEQ ID NO: 1034433 - protein, 9 aa, Homo Sapiens
HEDVTLENR

SEQ ID NO: 1034434 - protein, 9 aa, Homo Sapiens
YLSIVPKTK

SEQ ID NO: 1034435 - protein, 9 aa, Homo Sapiens
SGVIPNFTE

SEQ ID NO: 1034436 - protein, 9 aa, Homo Sapiens
GRWMKQNPR

SEQ ID NO: 1034437 - protein, 9 aa, Homo Sapiens
LQHPPPSVV

SEQ ID NO: 1034438 - protein, 9 aa, Homo Sapiens
QLLFHGVAY

SEQ ID NO: 1034439 - protein, 9 aa, Homo Sapiens
LNGLLQEIE

SEQ ID NO: 1034440 - protein, 9 aa, Homo Sapiens
VDNGFHGHP

SEQ ID NO: 1034441 - protein, 9 aa, Homo Sapiens
INLKMEVEW

SEQ ID NO: 1034442 - protein, 9 aa, Homo Sapiens
TSTFSIFQG

SEQ ID NO: 1034443 - protein, 9 aa, Homo Sapiens
IPQTTFKKP

SEQ ID NO: 1034444 - protein, 9 aa, Homo Sapiens
SVSCLQAMS

SEQ ID NO: 1034445 - protein, 9 aa, Homo Sapiens
VFNNQENKI

SEQ ID NO: 1034446 - protein, 9 aa, Homo Sapiens
RTLSKLARE

SEQ ID NO: 1034447 - protein, 9 aa, Homo Sapiens
ATHQAPLSS

SEQ ID NO: 1034448 - protein, 9 aa, Homo Sapiens
KKKEKNINR

SEQ ID NO: 1034449 - protein, 9 aa, Homo Sapiens
LTSVAELEL

SEQ ID NO: 1034450 - protein, 9 aa, Homo Sapiens
FFGVSEQQA

SEQ ID NO: 1034451 - protein, 9 aa, Homo Sapiens
LGKAEVDVA

SEQ ID NO: 1034452 - protein, 9 aa, Homo Sapiens
FHPLPPSYR

SEQ ID NO: 1034453 - protein, 9 aa, Homo Sapiens
NTEAVGFSK

SEQ ID NO: 1034454 - protein, 9 aa, Homo Sapiens
SFPVAALPP

SEQ ID NO: 1034455 - protein, 9 aa, Homo Sapiens
YEIGENIGE

SEQ ID NO: 1034456 - protein, 9 aa, Homo Sapiens
EPLKEETAQ

SEQ ID NO: 1034457 - protein, 9 aa, Homo Sapiens
ARGLQRAAR

SEQ ID NO: 1034458 - protein, 9 aa, Homo Sapiens
LIITPRPQN

SEQ ID NO: 1034459 - protein, 9 aa, Homo Sapiens
PQNHGTNLT

SEQ ID NO: 1034460 - protein, 9 aa, Homo Sapiens
YWATYLYRE

SEQ ID NO: 1034461 - protein, 9 aa, Homo Sapiens
LASLEKVRI

SEQ ID NO: 1034462 - protein, 9 aa, Homo Sapiens
STAPKLSDD

SEQ ID NO: 1034463 - protein, 9 aa, Homo Sapiens
DLGTKIYQW

SEQ ID NO: 1034464 - protein, 9 aa, Homo Sapiens
PISSRPWDL

SEQ ID NO: 1034465 - protein, 9 aa, Homo Sapiens
KALKIHLQA

SEQ ID NO: 1034466 - protein, 9 aa, Homo Sapiens
KRLKFKGPM

SEQ ID NO: 1034467 - protein, 9 aa, Homo Sapiens
NIDFLIEHM

SEQ ID NO: 1034468 - protein, 9 aa, Homo Sapiens
DFRVFLGNS

SEQ ID NO: 1034469 - protein, 9 aa, Homo Sapiens
MTQPRLWAN

SEQ ID NO: 1034470 - protein, 9 aa, Homo Sapiens
LAKYFSGRP

SEQ ID NO: 1034471 - protein, 9 aa, Homo Sapiens
SLWPSRTQN

SEQ ID NO: 1034472 - protein, 9 aa, Homo Sapiens
FQCKKTGRC

SEQ ID NO: 1034473 - protein, 9 aa, Homo Sapiens
KNINTPTRL

SEQ ID NO: 1034474 - protein, 9 aa, Homo Sapiens
SHPPVEGFY

SEQ ID NO: 1034475 - protein, 9 aa, Homo Sapiens
LLALTSVAE

SEQ ID NO: 1034476 - protein, 9 aa, Homo Sapiens
SSSDMKKFT

SEQ ID NO: 1034477 - protein, 9 aa, Homo Sapiens
LEMNETSAL

SEQ ID NO: 1034478 - protein, 9 aa, Homo Sapiens
VKTGPRASR

SEQ ID NO: 1034479 - protein, 9 aa, Homo Sapiens
EPDSYPSEL

SEQ ID NO: 1034480 - protein, 9 aa, Homo Sapiens
LGEVDRTKF

SEQ ID NO: 1034481 - protein, 9 aa, Homo Sapiens
PSLKKIKTS

SEQ ID NO: 1034482 - protein, 9 aa, Homo Sapiens
LLDVITWVE

SEQ ID NO: 1034483 - protein, 9 aa, Homo Sapiens
GAHGGPGKM

SEQ ID NO: 1034484 - protein, 9 aa, Homo Sapiens
GRLTAPQAE

SEQ ID NO: 1034485 - protein, 9 aa, Homo Sapiens
YCNPGIYLC

SEQ ID NO: 1034486 - protein, 9 aa, Homo Sapiens
SLIVIMYRR

SEQ ID NO: 1034487 - protein, 9 aa, Homo Sapiens
GGLGKHRLA

SEQ ID NO: 1034488 - protein, 9 aa, Homo Sapiens
LDKEEKLEL

SEQ ID NO: 1034489 - protein, 9 aa, Homo Sapiens
PGKMAAMIE

SEQ ID NO: 1034490 - protein, 9 aa, Homo Sapiens
DLEACLTES

SEQ ID NO: 1034491 - protein, 9 aa, Homo Sapiens
AFATKQDPP

SEQ ID NO: 1034492 - protein, 9 aa, Homo Sapiens
AGFLGRDSG

SEQ ID NO: 1034493 - protein, 9 aa, Homo Sapiens
HGLVNDEES

SEQ ID NO: 1034494 - protein, 9 aa, Homo Sapiens
QLMGLKKKF

SEQ ID NO: 1034495 - protein, 9 aa, Homo Sapiens
LVEVYKEAH

SEQ ID NO: 1034496 - protein, 9 aa, Homo Sapiens
SCLSSLQGY

SEQ ID NO: 1034497 - protein, 9 aa, Homo Sapiens
YSWVCFEWK

SEQ ID NO: 1034498 - protein, 9 aa, Homo Sapiens
HFRRHEKTH

SEQ ID NO: 1034499 - protein, 9 aa, Homo Sapiens
KQVGNGFHV

SEQ ID NO: 1034500 - protein, 9 aa, Homo Sapiens
LYVYHNRPA

SEQ ID NO: 1034501 - protein, 9 aa, Homo Sapiens
ELHICLMDH

SEQ ID NO: 1034502 - protein, 9 aa, Homo Sapiens
RVPGGAEHS

SEQ ID NO: 1034503 - protein, 9 aa, Homo Sapiens
QEKQVQEAK

SEQ ID NO: 1034504 - protein, 9 aa, Homo Sapiens
CYKCKINGL

SEQ ID NO: 1034505 - protein, 9 aa, Homo Sapiens
NEKLKEKLT

SEQ ID NO: 1034506 - protein, 9 aa, Homo Sapiens
LKKAQKDEF

SEQ ID NO: 1034507 - protein, 9 aa, Homo Sapiens
TWPVNGRLT

SEQ ID NO: 1034508 - protein, 9 aa, Homo Sapiens
RTTKNYPNA

SEQ ID NO: 1034509 - protein, 9 aa, Homo Sapiens
DINAREEWK

SEQ ID NO: 1034510 - protein, 9 aa, Homo Sapiens
KNIFFKAFS

SEQ ID NO: 1034511 - protein, 9 aa, Homo Sapiens
HLVGEPTTF

SEQ ID NO: 1034512 - protein, 9 aa, Homo Sapiens
EQAYPDPSP

SEQ ID NO: 1034513 - protein, 9 aa, Homo Sapiens
EFVQGSGAD

SEQ ID NO: 1034514 - protein, 9 aa, Homo Sapiens
TISRIDRHR

SEQ ID NO: 1034515 - protein, 9 aa, Homo Sapiens
DDNPLNARV

SEQ ID NO: 1034516 - protein, 9 aa, Homo Sapiens
FEECDTDRD

SEQ ID NO: 1034517 - protein, 9 aa, Homo Sapiens
EDPPIWKEK

SEQ ID NO: 1034518 - protein, 9 aa, Homo Sapiens
SLSLDQGWT

SEQ ID NO: 1034519 - protein, 9 aa, Homo Sapiens
DRINGVWNL

SEQ ID NO: 1034520 - protein, 9 aa, Homo Sapiens
RIKWRNSKE

SEQ ID NO: 1034521 - protein, 9 aa, Homo Sapiens
LRSASSIMI

SEQ ID NO: 1034522 - protein, 9 aa, Homo Sapiens
ENSETTITS

SEQ ID NO: 1034523 - protein, 9 aa, Homo Sapiens
GQGPKESGA

SEQ ID NO: 1034524 - protein, 9 aa, Homo Sapiens
SDPSGEETL

SEQ ID NO: 1034525 - protein, 9 aa, Homo Sapiens
RGLERLIFS

SEQ ID NO: 1034526 - protein, 9 aa, Homo Sapiens
SHKIEEPKI

SEQ ID NO: 1034527 - protein, 9 aa, Homo Sapiens
LQCYESIGY

SEQ ID NO: 1034528 - protein, 9 aa, Homo Sapiens
MDKEQQIYT

SEQ ID NO: 1034529 - protein, 9 aa, Homo Sapiens
SALQTFRVL

SEQ ID NO: 1034530 - protein, 9 aa, Homo Sapiens
FSLLSTFQA

SEQ ID NO: 1034531 - protein, 9 aa, Homo Sapiens
SKDNMSSTL

SEQ ID NO: 1034532 - protein, 9 aa, Homo Sapiens
FRMDKEQQI

SEQ ID NO: 1034533 - protein, 9 aa, Homo Sapiens
IWLSLSSNL

SEQ ID NO: 1034534 - protein, 9 aa, Homo Sapiens
VQHRRIHRG

SEQ ID NO: 1034535 - protein, 9 aa, Homo Sapiens
EDGLSVKQK

SEQ ID NO: 1034536 - protein, 9 aa, Homo Sapiens
CYVNICKQE

SEQ ID NO: 1034537 - protein, 9 aa, Homo Sapiens
LSPKKNRAS

SEQ ID NO: 1034538 - protein, 9 aa, Homo Sapiens
PSAAEKHKA

SEQ ID NO: 1034539 - protein, 9 aa, Homo Sapiens
DPVPDSPDF

SEQ ID NO: 1034540 - protein, 9 aa, Homo Sapiens
VKIELLEEC

SEQ ID NO: 1034541 - protein, 9 aa, Homo Sapiens
QDSNPEFTL

SEQ ID NO: 1034542 - protein, 9 aa, Homo Sapiens
LTTLFRRVV

SEQ ID NO: 1034543 - protein, 9 aa, Homo Sapiens
TKRRQMAAN

SEQ ID NO: 1034544 - protein, 9 aa, Homo Sapiens
DTYNTKILI

SEQ ID NO: 1034545 - protein, 9 aa, Homo Sapiens
ASLQERLRR

SEQ ID NO: 1034546 - protein, 9 aa, Homo Sapiens
SRVPPPPPL

SEQ ID NO: 1034547 - protein, 9 aa, Homo Sapiens
TLIHTINLR

SEQ ID NO: 1034548 - protein, 9 aa, Homo Sapiens
SRKQGEPLI

SEQ ID NO: 1034549 - protein, 9 aa, Homo Sapiens
DEINIIGDI

SEQ ID NO: 1034550 - protein, 9 aa, Homo Sapiens
NTYAQKEKE

SEQ ID NO: 1034551 - protein, 9 aa, Homo Sapiens
STCAFHLTA

SEQ ID NO: 1034552 - protein, 9 aa, Homo Sapiens
GRAAYTFNT

SEQ ID NO: 1034553 - protein, 9 aa, Homo Sapiens
LVSLGLFFR

SEQ ID NO: 1034554 - protein, 9 aa, Homo Sapiens
EKLKDNLSI

SEQ ID NO: 1034555 - protein, 9 aa, Homo Sapiens
HPHEWTHEE

SEQ ID NO: 1034556 - protein, 9 aa, Homo Sapiens
ENTNVRLNK

SEQ ID NO: 1034557 - protein, 9 aa, Homo Sapiens
APDPLHEDW

SEQ ID NO: 1034558 - protein, 9 aa, Homo Sapiens
CLDGFTGRA

SEQ ID NO: 1034559 - protein, 9 aa, Homo Sapiens
VAVNEKHTL

SEQ ID NO: 1034560 - protein, 9 aa, Homo Sapiens
NSFFQDQAP

SEQ ID NO: 1034561 - protein, 9 aa, Homo Sapiens
LELQLEQET

SEQ ID NO: 1034562 - protein, 9 aa, Homo Sapiens
QMYLGPQLG

SEQ ID NO: 1034563 - protein, 9 aa, Homo Sapiens
MHWAVSPTE

SEQ ID NO: 1034564 - protein, 9 aa, Homo Sapiens
NLELKYLLQ

SEQ ID NO: 1034565 - protein, 9 aa, Homo Sapiens
EYDRCPNKV

SEQ ID NO: 1034566 - protein, 9 aa, Homo Sapiens
EPPVKKNEM

SEQ ID NO: 1034567 - protein, 9 aa, Homo Sapiens
LIRKLPYQR

SEQ ID NO: 1034568 - protein, 9 aa, Homo Sapiens
RQRVFFGVS

SEQ ID NO: 1034569 - protein, 9 aa, Homo Sapiens
SSRALPGPA

SEQ ID NO: 1034570 - protein, 9 aa, Homo Sapiens
MNLHPVPEH

SEQ ID NO: 1034571 - protein, 9 aa, Homo Sapiens
CEWPQPRGQ

SEQ ID NO: 1034572 - protein, 9 aa, Homo Sapiens
TIKRRKIYC

SEQ ID NO: 1034573 - protein, 9 aa, Homo Sapiens
RYYAVDKIT

SEQ ID NO: 1034574 - protein, 9 aa, Homo Sapiens
RLSSADKEF

SEQ ID NO: 1034575 - protein, 9 aa, Homo Sapiens
SGLRKLSLA

SEQ ID NO: 1034576 - protein, 9 aa, Homo Sapiens
MGKARRRAT

SEQ ID NO: 1034577 - protein, 9 aa, Homo Sapiens
QGRSYKTTT

SEQ ID NO: 1034578 - protein, 9 aa, Homo Sapiens
KNKTTVVSL

SEQ ID NO: 1034579 - protein, 9 aa, Homo Sapiens
KKFAGGSAG

SEQ ID NO: 1034580 - protein, 9 aa, Homo Sapiens
VKKLADVII

SEQ ID NO: 1034581 - protein, 9 aa, Homo Sapiens
DCGSDGKLQ

SEQ ID NO: 1034582 - protein, 9 aa, Homo Sapiens
FSSVYKKLT

SEQ ID NO: 1034583 - protein, 9 aa, Homo Sapiens
QDKLPVLYT

SEQ ID NO: 1034584 - protein, 9 aa, Homo Sapiens
RKKKTHSIR

SEQ ID NO: 1034585 - protein, 9 aa, Homo Sapiens
FREALVLQE

SEQ ID NO: 1034586 - protein, 9 aa, Homo Sapiens
RLEQELAIK

SEQ ID NO: 1034587 - protein, 9 aa, Homo Sapiens
SGGFPLEWI

SEQ ID NO: 1034588 - protein, 9 aa, Homo Sapiens
TGVSHSQKF

SEQ ID NO: 1034589 - protein, 9 aa, Homo Sapiens
ASRLGLSSL

SEQ ID NO: 1034590 - protein, 9 aa, Homo Sapiens
LQLAQEVAQ

SEQ ID NO: 1034591 - protein, 9 aa, Homo Sapiens
FPYTRRQNP

SEQ ID NO: 1034592 - protein, 9 aa, Homo Sapiens
PGLWATVES

SEQ ID NO: 1034593 - protein, 9 aa, Homo Sapiens
NSHVFFSVH

SEQ ID NO: 1034594 - protein, 9 aa, Homo Sapiens
GFLSDSQLG

SEQ ID NO: 1034595 - protein, 9 aa, Homo Sapiens
ITQISILTM

SEQ ID NO: 1034596 - protein, 9 aa, Homo Sapiens
FAVPSSTKL

SEQ ID NO: 1034597 - protein, 9 aa, Homo Sapiens
KKSRPESII

SEQ ID NO: 1034598 - protein, 9 aa, Homo Sapiens
NKTLGTFLI

SEQ ID NO: 1034599 - protein, 9 aa, Homo Sapiens
KLKASGIFT

SEQ ID NO: 1034600 - protein, 9 aa, Homo Sapiens
GYFADYAKH

SEQ ID NO: 1034601 - protein, 9 aa, Homo Sapiens
ESENAYNIR

SEQ ID NO: 1034602 - protein, 9 aa, Homo Sapiens
EASVLAKSG

SEQ ID NO: 1034603 - protein, 9 aa, Homo Sapiens
RQGKEQESL

SEQ ID NO: 1034604 - protein, 9 aa, Homo Sapiens
DHARAPSAL

SEQ ID NO: 1034605 - protein, 9 aa, Homo Sapiens
LLTTMGDRL

SEQ ID NO: 1034606 - protein, 9 aa, Homo Sapiens
HSQELMKKS

SEQ ID NO: 1034607 - protein, 9 aa, Homo Sapiens
TLKQHGTCP

SEQ ID NO: 1034608 - protein, 9 aa, Homo Sapiens
NKIEDYFID

SEQ ID NO: 1034609 - protein, 9 aa, Homo Sapiens
TLQKLGGLP

SEQ ID NO: 1034610 - protein, 9 aa, Homo Sapiens
HSKYNPQLS

SEQ ID NO: 1034611 - protein, 9 aa, Homo Sapiens
KSSWDNQQK

SEQ ID NO: 1034612 - protein, 9 aa, Homo Sapiens
NGTWRYLNI

SEQ ID NO: 1034613 - protein, 9 aa, Homo Sapiens
KIQLAVCQQ

SEQ ID NO: 1034614 - protein, 9 aa, Homo Sapiens
KKEQMLEYM

SEQ ID NO: 1034615 - protein, 9 aa, Homo Sapiens
SPQGFPPRS

SEQ ID NO: 1034616 - protein, 9 aa, Homo Sapiens
VCLHDLVQQ

SEQ ID NO: 1034617 - protein, 9 aa, Homo Sapiens
GRGIRGREI

SEQ ID NO: 1034618 - protein, 9 aa, Homo Sapiens
SSDPSLQSA

SEQ ID NO: 1034619 - protein, 9 aa, Homo Sapiens
QLFYQHKAG

SEQ ID NO: 1034620 - protein, 9 aa, Homo Sapiens
CLSSGSLQL

SEQ ID NO: 1034621 - protein, 9 aa, Homo Sapiens
MLLFLCTFS

SEQ ID NO: 1034622 - protein, 9 aa, Homo Sapiens
VNEKHTLLY

SEQ ID NO: 1034623 - protein, 9 aa, Homo Sapiens
PRRGLALTF

SEQ ID NO: 1034624 - protein, 9 aa, Homo Sapiens
ADFDTMTNR

SEQ ID NO: 1034625 - protein, 9 aa, Homo Sapiens
WATVGMGKA

SEQ ID NO: 1034626 - protein, 9 aa, Homo Sapiens
PSHHLSAFE

SEQ ID NO: 1034627 - protein, 9 aa, Homo Sapiens
GTLTEKKST

SEQ ID NO: 1034628 - protein, 9 aa, Homo Sapiens
ARRSTASQS

SEQ ID NO: 1034629 - protein, 9 aa, Homo Sapiens
KKKFDKGVR

SEQ ID NO: 1034630 - protein, 9 aa, Homo Sapiens
RISGHRKTH

SEQ ID NO: 1034631 - protein, 9 aa, Homo Sapiens
SQYSFNHLY

SEQ ID NO: 1034632 - protein, 9 aa, Homo Sapiens
KRQRLWLKR

SEQ ID NO: 1034633 - protein, 9 aa, Homo Sapiens
VQIMFMKKK

SEQ ID NO: 1034634 - protein, 9 aa, Homo Sapiens
YSFNLPLSQ

SEQ ID NO: 1034635 - protein, 9 aa, Homo Sapiens
AAKWRTSDG

SEQ ID NO: 1034636 - protein, 9 aa, Homo Sapiens
SVHDSPGKD

SEQ ID NO: 1034637 - protein, 9 aa, Homo Sapiens
YYSAYVPRT

SEQ ID NO: 1034638 - protein, 9 aa, Homo Sapiens
CKDCGKAFW

SEQ ID NO: 1034639 - protein, 9 aa, Homo Sapiens
KRFKTNLHN

SEQ ID NO: 1034640 - protein, 9 aa, Homo Sapiens
LWNQKILFK

SEQ ID NO: 1034641 - protein, 9 aa, Homo Sapiens
PPSQDLGCY

SEQ ID NO: 1034642 - protein, 9 aa, Homo Sapiens
EELVKEEGF

SEQ ID NO: 1034643 - protein, 9 aa, Homo Sapiens
AKARRQNVT

SEQ ID NO: 1034644 - protein, 9 aa, Homo Sapiens
LYPSGWLYG

SEQ ID NO: 1034645 - protein, 9 aa, Homo Sapiens
PKIPEPEKK

SEQ ID NO: 1034646 - protein, 9 aa, Homo Sapiens
FQYMFATLS

SEQ ID NO: 1034647 - protein, 9 aa, Homo Sapiens
RLKDDALEA

SEQ ID NO: 1034648 - protein, 9 aa, Homo Sapiens
ALGSLFSRA

SEQ ID NO: 1034649 - protein, 9 aa, Homo Sapiens
RDPCQCVSH

SEQ ID NO: 1034650 - protein, 9 aa, Homo Sapiens
HPVGWCKKT

SEQ ID NO: 1034651 - protein, 9 aa, Homo Sapiens
SQFPETFLG

SEQ ID NO: 1034652 - protein, 9 aa, Homo Sapiens
DNHLLIKAA

SEQ ID NO: 1034653 - protein, 9 aa, Homo Sapiens
HQHQEKQEE

SEQ ID NO: 1034654 - protein, 9 aa, Homo Sapiens
LKDNLSIHY

SEQ ID NO: 1034655 - protein, 9 aa, Homo Sapiens
LKMKCSRYK

SEQ ID NO: 1034656 - protein, 9 aa, Homo Sapiens
IPFFLAICL

SEQ ID NO: 1034657 - protein, 9 aa, Homo Sapiens
RRPSSLRKW

SEQ ID NO: 1034658 - protein, 9 aa, Homo Sapiens
TLRKPVTID

SEQ ID NO: 1034659 - protein, 9 aa, Homo Sapiens
WPLPQHAQH

SEQ ID NO: 1034660 - protein, 9 aa, Homo Sapiens
GGWTVIQHC

SEQ ID NO: 1034661 - protein, 9 aa, Homo Sapiens
EENMDLHTT

SEQ ID NO: 1034662 - protein, 9 aa, Homo Sapiens
EDEKGPWGG

SEQ ID NO: 1034663 - protein, 9 aa, Homo Sapiens
RGSLKRANP

SEQ ID NO: 1034664 - protein, 9 aa, Homo Sapiens
LSKLRAGQF

SEQ ID NO: 1034665 - protein, 9 aa, Homo Sapiens
KHFTILDAS

SEQ ID NO: 1034666 - protein, 9 aa, Homo Sapiens
SPGHQGLAD

SEQ ID NO: 1034667 - protein, 9 aa, Homo Sapiens
LPGSLLFGP

SEQ ID NO: 1034668 - protein, 9 aa, Homo Sapiens
VIDQAPAEA

SEQ ID NO: 1034669 - protein, 9 aa, Homo Sapiens
GIAGLLGLG

SEQ ID NO: 1034670 - protein, 9 aa, Homo Sapiens
KILNVGNIG

SEQ ID NO: 1034671 - protein, 9 aa, Homo Sapiens
ARFESPRLS

SEQ ID NO: 1034672 - protein, 9 aa, Homo Sapiens
KKKEKEMET

SEQ ID NO: 1034673 - protein, 9 aa, Homo Sapiens
CVGSGTKSP

SEQ ID NO: 1034674 - protein, 9 aa, Homo Sapiens
VKDINDNTP

SEQ ID NO: 1034675 - protein, 9 aa, Homo Sapiens
LRIYIQVVE

SEQ ID NO: 1034676 - protein, 9 aa, Homo Sapiens
GRERDHKLR

SEQ ID NO: 1034677 - protein, 9 aa, Homo Sapiens
GRDRTCIPS

SEQ ID NO: 1034678 - protein, 9 aa, Homo Sapiens
KRNLQKLRS

SEQ ID NO: 1034679 - protein, 9 aa, Homo Sapiens
LGKMMMKYR

SEQ ID NO: 1034680 - protein, 9 aa, Homo Sapiens
QTTPCLDQN

SEQ ID NO: 1034681 - protein, 9 aa, Homo Sapiens
EDLAALEKN

SEQ ID NO: 1034682 - protein, 9 aa, Homo Sapiens
IRVSHCGAN

SEQ ID NO: 1034683 - protein, 9 aa, Homo Sapiens
SLYLVPVIA

SEQ ID NO: 1034684 - protein, 9 aa, Homo Sapiens
ASTKAHPAR

SEQ ID NO: 1034685 - protein, 9 aa, Homo Sapiens
IRDPVRGWA

SEQ ID NO: 1034686 - protein, 9 aa, Homo Sapiens
ARSTASHLV

SEQ ID NO: 1034687 - protein, 9 aa, Homo Sapiens
LTDEINFLK

SEQ ID NO: 1034688 - protein, 9 aa, Homo Sapiens
SSASRKQGE

SEQ ID NO: 1034689 - protein, 9 aa, Homo Sapiens
FPKPERLLT

SEQ ID NO: 1034690 - protein, 9 aa, Homo Sapiens
RQSWKDKRL

SEQ ID NO: 1034691 - protein, 9 aa, Homo Sapiens
GWMSVCRER

SEQ ID NO: 1034692 - protein, 9 aa, Homo Sapiens
SFSSRKMFC

SEQ ID NO: 1034693 - protein, 9 aa, Homo Sapiens
FPLEWIGLI

SEQ ID NO: 1034694 - protein, 9 aa, Homo Sapiens
ELDCTSEMK

SEQ ID NO: 1034695 - protein, 9 aa, Homo Sapiens
SGERLFACE

SEQ ID NO: 1034696 - protein, 9 aa, Homo Sapiens
GKPLKPVSG

SEQ ID NO: 1034697 - protein, 9 aa, Homo Sapiens
VRPSIVSAS

SEQ ID NO: 1034698 - protein, 9 aa, Homo Sapiens
FFKAYSPAS

SEQ ID NO: 1034699 - protein, 9 aa, Homo Sapiens
KYKDHLSNS

SEQ ID NO: 1034700 - protein, 9 aa, Homo Sapiens
SGCLDSDEQ

SEQ ID NO: 1034701 - protein, 9 aa, Homo Sapiens
TNRSQELQY

SEQ ID NO: 1034702 - protein, 9 aa, Homo Sapiens
NEDAQALKE

SEQ ID NO: 1034703 - protein, 9 aa, Homo Sapiens
TSSKESPQK

SEQ ID NO: 1034704 - protein, 9 aa, Homo Sapiens
KDSIKKMFG

SEQ ID NO: 1034705 - protein, 9 aa, Homo Sapiens
VGDSHFSHS

SEQ ID NO: 1034706 - protein, 9 aa, Homo Sapiens
GSDDRFSFW

SEQ ID NO: 1034707 - protein, 9 aa, Homo Sapiens
SVGFKLLRK

SEQ ID NO: 1034708 - protein, 9 aa, Homo Sapiens
FFFDGWEIS

SEQ ID NO: 1034709 - protein, 9 aa, Homo Sapiens
ERAPIRIWM

SEQ ID NO: 1034710 - protein, 9 aa, Homo Sapiens
YNVIFGWSL

SEQ ID NO: 1034711 - protein, 9 aa, Homo Sapiens
KFPRATRKF

SEQ ID NO: 1034712 - protein, 9 aa, Homo Sapiens
GEAGAQGLP

SEQ ID NO: 1034713 - protein, 9 aa, Homo Sapiens
YTTFIKIQV

SEQ ID NO: 1034714 - protein, 9 aa, Homo Sapiens
DSFPAQFGG

SEQ ID NO: 1034715 - protein, 9 aa, Homo Sapiens
RKSSSLRKM

SEQ ID NO: 1034716 - protein, 9 aa, Homo Sapiens
EVLVIPKKN

SEQ ID NO: 1034717 - protein, 9 aa, Homo Sapiens
NVRPWHREG

SEQ ID NO: 1034718 - protein, 9 aa, Homo Sapiens
SHAAAQSVL

SEQ ID NO: 1034719 - protein, 9 aa, Homo Sapiens
ATLGEQKKA

SEQ ID NO: 1034720 - protein, 9 aa, Homo Sapiens
ERPAWSGAR

SEQ ID NO: 1034721 - protein, 9 aa, Homo Sapiens
QKKILLTCS

SEQ ID NO: 1034722 - protein, 9 aa, Homo Sapiens
WLYGPSDMQ

SEQ ID NO: 1034723 - protein, 9 aa, Homo Sapiens
RYSEAAGPR

SEQ ID NO: 1034724 - protein, 9 aa, Homo Sapiens
SVMYHINLN

SEQ ID NO: 1034725 - protein, 9 aa, Homo Sapiens
PMEGFHQGA

SEQ ID NO: 1034726 - protein, 9 aa, Homo Sapiens
QHLQPCRLG

SEQ ID NO: 1034727 - protein, 9 aa, Homo Sapiens
IVLMLGFVV

SEQ ID NO: 1034728 - protein, 9 aa, Homo Sapiens
FLAICLPIS

SEQ ID NO: 1034729 - protein, 9 aa, Homo Sapiens
EHDSELLFT

SEQ ID NO: 1034730 - protein, 9 aa, Homo Sapiens
SLRSCTGRW

SEQ ID NO: 1034731 - protein, 9 aa, Homo Sapiens
QADNRHVAL

SEQ ID NO: 1034732 - protein, 9 aa, Homo Sapiens
FLTKRLSYC

SEQ ID NO: 1034733 - protein, 9 aa, Homo Sapiens
SSSPSPKEK

SEQ ID NO: 1034734 - protein, 9 aa, Homo Sapiens
ITICVQDKI

SEQ ID NO: 1034735 - protein, 9 aa, Homo Sapiens
HCAEKSNAG

SEQ ID NO: 1034736 - protein, 9 aa, Homo Sapiens
GGFLDLKQT

SEQ ID NO: 1034737 - protein, 9 aa, Homo Sapiens
MEYLFSHHV

SEQ ID NO: 1034738 - protein, 9 aa, Homo Sapiens
RHEMPLGEQ

SEQ ID NO: 1034739 - protein, 9 aa, Homo Sapiens
SLNHGIEDN

SEQ ID NO: 1034740 - protein, 9 aa, Homo Sapiens
CLRGPKVHK

SEQ ID NO: 1034741 - protein, 9 aa, Homo Sapiens
TIAVLLRPA

SEQ ID NO: 1034742 - protein, 9 aa, Homo Sapiens
SLMRTLSKL

SEQ ID NO: 1034743 - protein, 9 aa, Homo Sapiens
ELARQLEKK

SEQ ID NO: 1034744 - protein, 9 aa, Homo Sapiens
AIFLKTCQQ

SEQ ID NO: 1034745 - protein, 9 aa, Homo Sapiens
TKIFLRDYQ

SEQ ID NO: 1034746 - protein, 9 aa, Homo Sapiens
SLSTGERKQ

SEQ ID NO: 1034747 - protein, 9 aa, Homo Sapiens
EKLKEKLTE

SEQ ID NO: 1034748 - protein, 9 aa, Homo Sapiens
NSLCSVIFG

SEQ ID NO: 1034749 - protein, 9 aa, Homo Sapiens
QAPLSSPVP

SEQ ID NO: 1034750 - protein, 9 aa, Homo Sapiens
KGFSDFLKS

SEQ ID NO: 1034751 - protein, 9 aa, Homo Sapiens
DPCKNIFFK

SEQ ID NO: 1034752 - protein, 9 aa, Homo Sapiens
PKRERGVPG

SEQ ID NO: 1034753 - protein, 9 aa, Homo Sapiens
FLGNSHVCN

SEQ ID NO: 1034754 - protein, 9 aa, Homo Sapiens
LIRGPQAFW

SEQ ID NO: 1034755 - protein, 9 aa, Homo Sapiens
ETRKQQEIH

SEQ ID NO: 1034756 - protein, 9 aa, Homo Sapiens
NRVMRYAIA

SEQ ID NO: 1034757 - protein, 9 aa, Homo Sapiens
WEYNDNSCI

SEQ ID NO: 1034758 - protein, 9 aa, Homo Sapiens
KKILKGLDY

SEQ ID NO: 1034759 - protein, 9 aa, Homo Sapiens
EILELKPGT

SEQ ID NO: 1034760 - protein, 9 aa, Homo Sapiens
HKFEEAKSW

SEQ ID NO: 1034761 - protein, 9 aa, Homo Sapiens
MMSSHIKKT

SEQ ID NO: 1034762 - protein, 9 aa, Homo Sapiens
PARSTASHL

SEQ ID NO: 1034763 - protein, 9 aa, Homo Sapiens
FGGHFQGKW

SEQ ID NO: 1034764 - protein, 9 aa, Homo Sapiens
TNGYTRHRN

SEQ ID NO: 1034765 - protein, 9 aa, Homo Sapiens
QMPPQASSF

SEQ ID NO: 1034766 - protein, 9 aa, Homo Sapiens
KSGSLFREA

SEQ ID NO: 1034767 - protein, 9 aa, Homo Sapiens
NQCLNCPDA

SEQ ID NO: 1034768 - protein, 9 aa, Homo Sapiens
TYRTFIFPE

SEQ ID NO: 1034769 - protein, 9 aa, Homo Sapiens
GGWTEERRA

SEQ ID NO: 1034770 - protein, 9 aa, Homo Sapiens
FLRAVRMKI

SEQ ID NO: 1034771 - protein, 9 aa, Homo Sapiens
DCSKLLPTS

SEQ ID NO: 1034772 - protein, 9 aa, Homo Sapiens
LAEQDAFLG

SEQ ID NO: 1034773 - protein, 9 aa, Homo Sapiens
DLIKNKLSP

SEQ ID NO: 1034774 - protein, 9 aa, Homo Sapiens
WINPLMRWQ

SEQ ID NO: 1034775 - protein, 9 aa, Homo Sapiens
SVDKSQSVG

SEQ ID NO: 1034776 - protein, 9 aa, Homo Sapiens
LPPALRPAP

SEQ ID NO: 1034777 - protein, 9 aa, Homo Sapiens
LASSGYASL

SEQ ID NO: 1034778 - protein, 9 aa, Homo Sapiens
NIRYYKVSA

SEQ ID NO: 1034779 - protein, 9 aa, Homo Sapiens
LKEEEFELV

SEQ ID NO: 1034780 - protein, 9 aa, Homo Sapiens
CRTPAWEQQ

SEQ ID NO: 1034781 - protein, 9 aa, Homo Sapiens
VNLIFEGVD

SEQ ID NO: 1034782 - protein, 9 aa, Homo Sapiens
FYSCEPGYN

SEQ ID NO: 1034783 - protein, 9 aa, Homo Sapiens
NVFSVSTTG

SEQ ID NO: 1034784 - protein, 9 aa, Homo Sapiens
KLRSASSIM

SEQ ID NO: 1034785 - protein, 9 aa, Homo Sapiens
GIGKMELFS

SEQ ID NO: 1034786 - protein, 9 aa, Homo Sapiens
IEPGTYIIN

SEQ ID NO: 1034787 - protein, 9 aa, Homo Sapiens
NLQKLRSAS

SEQ ID NO: 1034788 - protein, 9 aa, Homo Sapiens
TNFLLVAAP

SEQ ID NO: 1034789 - protein, 9 aa, Homo Sapiens
EFKPFSNGS

SEQ ID NO: 1034790 - protein, 9 aa, Homo Sapiens
LMGLKKKFQ

SEQ ID NO: 1034791 - protein, 9 aa, Homo Sapiens
PKNTIAMQN

SEQ ID NO: 1034792 - protein, 9 aa, Homo Sapiens
AFDLVCAFI

SEQ ID NO: 1034793 - protein, 9 aa, Homo Sapiens
PYSWVCFEW

SEQ ID NO: 1034794 - protein, 9 aa, Homo Sapiens
SLQSAAYNL

SEQ ID NO: 1034795 - protein, 9 aa, Homo Sapiens
FQYRYAYLL

SEQ ID NO: 1034796 - protein, 9 aa, Homo Sapiens
EAYTTFIKI

SEQ ID NO: 1034797 - protein, 9 aa, Homo Sapiens
GYSTQLFCN

SEQ ID NO: 1034798 - protein, 9 aa, Homo Sapiens
RVKSYICTE

SEQ ID NO: 1034799 - protein, 9 aa, Homo Sapiens
YLVMRKISS

SEQ ID NO: 1034800 - protein, 9 aa, Homo Sapiens
STECDFHPL

SEQ ID NO: 1034801 - protein, 9 aa, Homo Sapiens
PNLRLLDLC

SEQ ID NO: 1034802 - protein, 9 aa, Homo Sapiens
PGHARSRRC

SEQ ID NO: 1034803 - protein, 9 aa, Homo Sapiens
EEEENEGEA

SEQ ID NO: 1034804 - protein, 9 aa, Homo Sapiens
SVFISSTKG

SEQ ID NO: 1034805 - protein, 9 aa, Homo Sapiens
LCMMSSHIK

SEQ ID NO: 1034806 - protein, 9 aa, Homo Sapiens
LKQQMKKGG

SEQ ID NO: 1034807 - protein, 9 aa, Homo Sapiens
SLASSGYAS

SEQ ID NO: 1034808 - protein, 9 aa, Homo Sapiens
SAARLIQNI

SEQ ID NO: 1034809 - protein, 9 aa, Homo Sapiens
VNVQWFLSS

SEQ ID NO: 1034810 - protein, 9 aa, Homo Sapiens
GPEGPKSRG

SEQ ID NO: 1034811 - protein, 9 aa, Homo Sapiens
EDGQVNYEE

SEQ ID NO: 1034812 - protein, 9 aa, Homo Sapiens
ISRGTMRRQ

SEQ ID NO: 1034813 - protein, 9 aa, Homo Sapiens
SESKVYQLV

SEQ ID NO: 1034814 - protein, 9 aa, Homo Sapiens
SIMDNIKYR

SEQ ID NO: 1034815 - protein, 9 aa, Homo Sapiens
IHLHSFKIT

SEQ ID NO: 1034816 - protein, 9 aa, Homo Sapiens
SRNNVFSVS

SEQ ID NO: 1034817 - protein, 9 aa, Homo Sapiens
ARCLPSRAA

SEQ ID NO: 1034818 - protein, 9 aa, Homo Sapiens
ATMLKKILK

SEQ ID NO: 1034819 - protein, 9 aa, Homo Sapiens
RFLDYGYGG

SEQ ID NO: 1034820 - protein, 9 aa, Homo Sapiens
YDSNNPDVE

SEQ ID NO: 1034821 - protein, 9 aa, Homo Sapiens
IQSEEQTSD

SEQ ID NO: 1034822 - protein, 9 aa, Homo Sapiens
FSFLEIFFT

SEQ ID NO: 1034823 - protein, 9 aa, Homo Sapiens
MVMAFDCYV

SEQ ID NO: 1034824 - protein, 9 aa, Homo Sapiens
VISFFLWSR

SEQ ID NO: 1034825 - protein, 9 aa, Homo Sapiens
IGMAIKISC

SEQ ID NO: 1034826 - protein, 9 aa, Homo Sapiens
EGKKMHRAL

SEQ ID NO: 1034827 - protein, 9 aa, Homo Sapiens
RTSDGLMDG

SEQ ID NO: 1034828 - protein, 9 aa, Homo Sapiens
GDFGGPLHC

SEQ ID NO: 1034829 - protein, 9 aa, Homo Sapiens
RRQNVTIFY

SEQ ID NO: 1034830 - protein, 9 aa, Homo Sapiens
VFVNDSGAG

SEQ ID NO: 1034831 - protein, 9 aa, Homo Sapiens
CHSECVADT

SEQ ID NO: 1034832 - protein, 9 aa, Homo Sapiens
SENVHHQFQ

SEQ ID NO: 1034833 - protein, 9 aa, Homo Sapiens
FEQAYPDPS

SEQ ID NO: 1034834 - protein, 9 aa, Homo Sapiens
PLQAAPVPG

SEQ ID NO: 1034835 - protein, 9 aa, Homo Sapiens
EIGKKFGLL

SEQ ID NO: 1034836 - protein, 9 aa, Homo Sapiens
GSSIALVRD

SEQ ID NO: 1034837 - protein, 9 aa, Homo Sapiens
KLRQYKVLV

SEQ ID NO: 1034838 - protein, 9 aa, Homo Sapiens
VMIKGSGLK

SEQ ID NO: 1034839 - protein, 9 aa, Homo Sapiens
GLNAAGKTT

SEQ ID NO: 1034840 - protein, 9 aa, Homo Sapiens
IATSTTSRQ

SEQ ID NO: 1034841 - protein, 9 aa, Homo Sapiens
ANEKEANFH

SEQ ID NO: 1034842 - protein, 9 aa, Homo Sapiens
NKRGDNQDK

SEQ ID NO: 1034843 - protein, 9 aa, Homo Sapiens
LENFSGRTR

SEQ ID NO: 1034844 - protein, 9 aa, Homo Sapiens
LSKPRQSPL

SEQ ID NO: 1034845 - protein, 9 aa, Homo Sapiens
KGAQDGGVG

SEQ ID NO: 1034846 - protein, 9 aa, Homo Sapiens
GSCVKISFS

SEQ ID NO: 1034847 - protein, 9 aa, Homo Sapiens
GDSSQGDNK

SEQ ID NO: 1034848 - protein, 9 aa, Homo Sapiens
YHDVTLRNI

SEQ ID NO: 1034849 - protein, 9 aa, Homo Sapiens
VLVFQLGQF

SEQ ID NO: 1034850 - protein, 9 aa, Homo Sapiens
LDPSSPAFR

SEQ ID NO: 1034851 - protein, 9 aa, Homo Sapiens
QELDCTSEM

SEQ ID NO: 1034852 - protein, 9 aa, Homo Sapiens
YNIWHRRHD

SEQ ID NO: 1034853 - protein, 9 aa, Homo Sapiens
MFPGGLGKH

SEQ ID NO: 1034854 - protein, 9 aa, Homo Sapiens
PLGRDLPQE

SEQ ID NO: 1034855 - protein, 9 aa, Homo Sapiens
IINPSVISC

SEQ ID NO: 1034856 - protein, 9 aa, Homo Sapiens
KECEENTQH

SEQ ID NO: 1034857 - protein, 9 aa, Homo Sapiens
GKAFERPSL

SEQ ID NO: 1034858 - protein, 9 aa, Homo Sapiens
QIKIRNREI

SEQ ID NO: 1034859 - protein, 9 aa, Homo Sapiens
FCAAFYLIV

SEQ ID NO: 1034860 - protein, 9 aa, Homo Sapiens
GAALGSMVD

SEQ ID NO: 1034861 - protein, 9 aa, Homo Sapiens
SDPSLQSAA

SEQ ID NO: 1034862 - protein, 9 aa, Homo Sapiens
TPVFPMAVK

SEQ ID NO: 1034863 - protein, 9 aa, Homo Sapiens
AGVGTEATD

SEQ ID NO: 1034864 - protein, 9 aa, Homo Sapiens
SPARKNEGE

SEQ ID NO: 1034865 - protein, 9 aa, Homo Sapiens
GLPESVDVD

SEQ ID NO: 1034866 - protein, 9 aa, Homo Sapiens
ASDTFSEIG

SEQ ID NO: 1034867 - protein, 9 aa, Homo Sapiens
MRTKQLLEE

SEQ ID NO: 1034868 - protein, 9 aa, Homo Sapiens
NTATTIITV

SEQ ID NO: 1034869 - protein, 9 aa, Homo Sapiens
FLLPRPLVH

SEQ ID NO: 1034870 - protein, 9 aa, Homo Sapiens
KCNISDLSL

SEQ ID NO: 1034871 - protein, 9 aa, Homo Sapiens
LYNNHRNPW

SEQ ID NO: 1034872 - protein, 9 aa, Homo Sapiens
AHGGPGKMA

SEQ ID NO: 1034873 - protein, 9 aa, Homo Sapiens
SWSGISKPV

SEQ ID NO: 1034874 - protein, 9 aa, Homo Sapiens
EGAADAAGA

SEQ ID NO: 1034875 - protein, 9 aa, Homo Sapiens
SPSPKEKGE

SEQ ID NO: 1034876 - protein, 9 aa, Homo Sapiens
LSFTYIALT

SEQ ID NO: 1034877 - protein, 9 aa, Homo Sapiens
PPLKFGIVP

SEQ ID NO: 1034878 - protein, 9 aa, Homo Sapiens
VNLDYPVIS

SEQ ID NO: 1034879 - protein, 9 aa, Homo Sapiens
RSPTFSGSH

SEQ ID NO: 1034880 - protein, 9 aa, Homo Sapiens
SSRKMFCQC

SEQ ID NO: 1034881 - protein, 9 aa, Homo Sapiens
VMTKCRLEQ

SEQ ID NO: 1034882 - protein, 9 aa, Homo Sapiens
DLKFVIPKE

SEQ ID NO: 1034883 - protein, 9 aa, Homo Sapiens
PNRPGVYTC

SEQ ID NO: 1034884 - protein, 9 aa, Homo Sapiens
ALTSALTVY

SEQ ID NO: 1034885 - protein, 9 aa, Homo Sapiens
SSSVSSRAL

SEQ ID NO: 1034886 - protein, 9 aa, Homo Sapiens
LGQFTEEDK

SEQ ID NO: 1034887 - protein, 9 aa, Homo Sapiens
QTCRMTHLL

SEQ ID NO: 1034888 - protein, 9 aa, Homo Sapiens
FFPSSLRNR

SEQ ID NO: 1034889 - protein, 9 aa, Homo Sapiens
SSASAICKL

SEQ ID NO: 1034890 - protein, 9 aa, Homo Sapiens
QRVNTRQKP

SEQ ID NO: 1034891 - protein, 9 aa, Homo Sapiens
LSEMHVRIY

SEQ ID NO: 1034892 - protein, 9 aa, Homo Sapiens
HLQRVDAPV

SEQ ID NO: 1034893 - protein, 9 aa, Homo Sapiens
TVCNDSWDT

SEQ ID NO: 1034894 - protein, 9 aa, Homo Sapiens
CQCVSHGSA

SEQ ID NO: 1034895 - protein, 9 aa, Homo Sapiens
ISDINLDVP

SEQ ID NO: 1034896 - protein, 9 aa, Homo Sapiens
EKTDDDVID

SEQ ID NO: 1034897 - protein, 9 aa, Homo Sapiens
LGGGLPNAR

SEQ ID NO: 1034898 - protein, 9 aa, Homo Sapiens
AYNTAGTGS

SEQ ID NO: 1034899 - protein, 9 aa, Homo Sapiens
GERYLGILL

SEQ ID NO: 1034900 - protein, 9 aa, Homo Sapiens
FSHSSNNPQ

SEQ ID NO: 1034901 - protein, 9 aa, Homo Sapiens
KVGLEMYSK

SEQ ID NO: 1034902 - protein, 9 aa, Homo Sapiens
AAVENVLEL

SEQ ID NO: 1034903 - protein, 9 aa, Homo Sapiens
FDRTLRCPF

SEQ ID NO: 1034904 - protein, 9 aa, Homo Sapiens
QQMIFTPEK

SEQ ID NO: 1034905 - protein, 9 aa, Homo Sapiens
HHFFFKTLH

SEQ ID NO: 1034906 - protein, 9 aa, Homo Sapiens
YNIRLKLTK

SEQ ID NO: 1034907 - protein, 9 aa, Homo Sapiens
EEQDSGGSS

SEQ ID NO: 1034908 - protein, 9 aa, Homo Sapiens
ADFMESFEV

SEQ ID NO: 1034909 - protein, 9 aa, Homo Sapiens
TGLLLFSYA

SEQ ID NO: 1034910 - protein, 9 aa, Homo Sapiens
DIDMDGSTN

SEQ ID NO: 1034911 - protein, 9 aa, Homo Sapiens
PHFLEGDGP

SEQ ID NO: 1034912 - protein, 9 aa, Homo Sapiens
CPIEPGTYI

SEQ ID NO: 1034913 - protein, 9 aa, Homo Sapiens
NPNPFISPD

SEQ ID NO: 1034914 - protein, 9 aa, Homo Sapiens
DTFSEIGKK

SEQ ID NO: 1034915 - protein, 9 aa, Homo Sapiens
LDCTSEMKQ

SEQ ID NO: 1034916 - protein, 9 aa, Homo Sapiens
TQPPEKMEF

SEQ ID NO: 1034917 - protein, 9 aa, Homo Sapiens
FGAGIAMST

SEQ ID NO: 1034918 - protein, 9 aa, Homo Sapiens
CLQAMSSSV

SEQ ID NO: 1034919 - protein, 9 aa, Homo Sapiens
LLEKYFMQS

SEQ ID NO: 1034920 - protein, 9 aa, Homo Sapiens
SHPRKRTRS

SEQ ID NO: 1034921 - protein, 9 aa, Homo Sapiens
LDPFAPEPT

SEQ ID NO: 1034922 - protein, 9 aa, Homo Sapiens
HARSRRCAL

SEQ ID NO: 1034923 - protein, 9 aa, Homo Sapiens
MVYSINLTL

SEQ ID NO: 1034924 - protein, 9 aa, Homo Sapiens
RSCGPSLAS

SEQ ID NO: 1034925 - protein, 9 aa, Homo Sapiens
TKILIFIIV

SEQ ID NO: 1034926 - protein, 9 aa, Homo Sapiens
SAAPARRRL

SEQ ID NO: 1034927 - protein, 9 aa, Homo Sapiens
NKDVKDSIK

SEQ ID NO: 1034928 - protein, 9 aa, Homo Sapiens
SILTMPNDD

SEQ ID NO: 1034929 - protein, 9 aa, Homo Sapiens
SGSALREQK

SEQ ID NO: 1034930 - protein, 9 aa, Homo Sapiens
RMDKEQQIY

SEQ ID NO: 1034931 - protein, 9 aa, Homo Sapiens
TQPRLWANH

SEQ ID NO: 1034932 - protein, 9 aa, Homo Sapiens
YGMTLRCLR

SEQ ID NO: 1034933 - protein, 9 aa, Homo Sapiens
GRTAFILAV

SEQ ID NO: 1034934 - protein, 9 aa, Homo Sapiens
LLLLLVTIA

SEQ ID NO: 1034935 - protein, 9 aa, Homo Sapiens
ETFSSVYKK

SEQ ID NO: 1034936 - protein, 9 aa, Homo Sapiens
YRDPEAASL

SEQ ID NO: 1034937 - protein, 9 aa, Homo Sapiens
GFSFSRPFW

SEQ ID NO: 1034938 - protein, 9 aa, Homo Sapiens
LSLLLLLVT

SEQ ID NO: 1034939 - protein, 9 aa, Homo Sapiens
QMFVSNGSF

SEQ ID NO: 1034940 - protein, 9 aa, Homo Sapiens
KRGLNLSGG

SEQ ID NO: 1034941 - protein, 9 aa, Homo Sapiens
YADQISTPE

SEQ ID NO: 1034942 - protein, 9 aa, Homo Sapiens
TFLTKRLSY

SEQ ID NO: 1034943 - protein, 9 aa, Homo Sapiens
STRHSFFRR

SEQ ID NO: 1034944 - protein, 9 aa, Homo Sapiens
ERLLTRLCP

SEQ ID NO: 1034945 - protein, 9 aa, Homo Sapiens
QKEATPGRR

SEQ ID NO: 1034946 - protein, 9 aa, Homo Sapiens
QLVGRQDCP

SEQ ID NO: 1034947 - protein, 9 aa, Homo Sapiens
KMMMKYRDQ

SEQ ID NO: 1034948 - protein, 9 aa, Homo Sapiens
LWEKPRAIA

SEQ ID NO: 1034949 - protein, 9 aa, Homo Sapiens
VPSMMASAS

SEQ ID NO: 1034950 - protein, 9 aa, Homo Sapiens
PQGHFDSFI

SEQ ID NO: 1034951 - protein, 9 aa, Homo Sapiens
KKSNIDFLI

SEQ ID NO: 1034952 - protein, 9 aa, Homo Sapiens
QCVSPECLE

SEQ ID NO: 1034953 - protein, 9 aa, Homo Sapiens
MASCWAVQL

SEQ ID NO: 1034954 - protein, 9 aa, Homo Sapiens
FCELREGEL

SEQ ID NO: 1034955 - protein, 9 aa, Homo Sapiens
LLAGDPDPS

SEQ ID NO: 1034956 - protein, 9 aa, Homo Sapiens
FVIGGKKLL

SEQ ID NO: 1034957 - protein, 9 aa, Homo Sapiens
SLSKLRAGQ

SEQ ID NO: 1034958 - protein, 9 aa, Homo Sapiens
PRACCDEGK

SEQ ID NO: 1034959 - protein, 9 aa, Homo Sapiens
SDCGFSWPL

SEQ ID NO: 1034960 - protein, 9 aa, Homo Sapiens
FPEELIKKL

SEQ ID NO: 1034961 - protein, 9 aa, Homo Sapiens
AIKISCFTV

SEQ ID NO: 1034962 - protein, 9 aa, Homo Sapiens
KLPYQRLVR

SEQ ID NO: 1034963 - protein, 9 aa, Homo Sapiens
QSRPSGARF

SEQ ID NO: 1034964 - protein, 9 aa, Homo Sapiens
RADARLPPA

SEQ ID NO: 1034965 - protein, 9 aa, Homo Sapiens
LYRRADKKK

SEQ ID NO: 1034966 - protein, 9 aa, Homo Sapiens
ESYRAYAVM

SEQ ID NO: 1034967 - protein, 9 aa, Homo Sapiens
KTLSKDDLK

SEQ ID NO: 1034968 - protein, 9 aa, Homo Sapiens
ADVIILTIF

SEQ ID NO: 1034969 - protein, 9 aa, Homo Sapiens
LNLVHLDAV

SEQ ID NO: 1034970 - protein, 9 aa, Homo Sapiens
YLIINSINK

SEQ ID NO: 1034971 - protein, 9 aa, Homo Sapiens
SCMEHLLQI

SEQ ID NO: 1034972 - protein, 9 aa, Homo Sapiens
DQSDVIYAR

SEQ ID NO: 1034973 - protein, 9 aa, Homo Sapiens
QELMKKSLQ

SEQ ID NO: 1034974 - protein, 9 aa, Homo Sapiens
NWYLYNRMS

SEQ ID NO: 1034975 - protein, 9 aa, Homo Sapiens
FPVAALPPH

SEQ ID NO: 1034976 - protein, 9 aa, Homo Sapiens
LRLVRAAQG

SEQ ID NO: 1034977 - protein, 9 aa, Homo Sapiens
DGQAKPIIY

SEQ ID NO: 1034978 - protein, 9 aa, Homo Sapiens
TARTVFKEE

SEQ ID NO: 1034979 - protein, 9 aa, Homo Sapiens
VLDLLFVTL

SEQ ID NO: 1034980 - protein, 9 aa, Homo Sapiens
THHSLRTPR

SEQ ID NO: 1034981 - protein, 9 aa, Homo Sapiens
PPEKMEFHL

SEQ ID NO: 1034982 - protein, 9 aa, Homo Sapiens
IHTPAKIQL

SEQ ID NO: 1034983 - protein, 9 aa, Homo Sapiens
TEVNPDEEV

SEQ ID NO: 1034984 - protein, 9 aa, Homo Sapiens
RSGYGPSNG

SEQ ID NO: 1034985 - protein, 9 aa, Homo Sapiens
LRNRIVYYI

SEQ ID NO: 1034986 - protein, 9 aa, Homo Sapiens
PFTLQKLGG

SEQ ID NO: 1034987 - protein, 9 aa, Homo Sapiens
VSHNLLDQI

SEQ ID NO: 1034988 - protein, 9 aa, Homo Sapiens
RALFTAVVR

SEQ ID NO: 1034989 - protein, 9 aa, Homo Sapiens
PLSHPSLLS

SEQ ID NO: 1034990 - protein, 9 aa, Homo Sapiens
VYVLGNLTV

SEQ ID NO: 1034991 - protein, 9 aa, Homo Sapiens
ASRQKPPSA

SEQ ID NO: 1034992 - protein, 9 aa, Homo Sapiens
QVPNKIIEV

SEQ ID NO: 1034993 - protein, 9 aa, Homo Sapiens
SKRSLGIKF

SEQ ID NO: 1034994 - protein, 9 aa, Homo Sapiens
EEILYKLVQ

SEQ ID NO: 1034995 - protein, 9 aa, Homo Sapiens
KLEVQLQTV

SEQ ID NO: 1034996 - protein, 9 aa, Homo Sapiens
GSGQGPKES

SEQ ID NO: 1034997 - protein, 9 aa, Homo Sapiens
SSPHLLSFP

SEQ ID NO: 1034998 - protein, 9 aa, Homo Sapiens
RNLLERRGR

SEQ ID NO: 1034999 - protein, 9 aa, Homo Sapiens
VSGGLAGAG

SEQ ID NO: 1035000 - protein, 9 aa, Homo Sapiens
KLSPQLAEK

SEQ ID NO: 1035001 - protein, 9 aa, Homo Sapiens
MSADVVCIS

SEQ ID NO: 1035002 - protein, 9 aa, Homo Sapiens
ARFKLPSGK

SEQ ID NO: 1035003 - protein, 9 aa, Homo Sapiens
LVKTNRREV

SEQ ID NO: 1035004 - protein, 9 aa, Homo Sapiens
AMEPTNGRM

SEQ ID NO: 1035005 - protein, 9 aa, Homo Sapiens
SPLSDQLGC

SEQ ID NO: 1035006 - protein, 9 aa, Homo Sapiens
EGFFVTLDD

SEQ ID NO: 1035007 - protein, 9 aa, Homo Sapiens
VIDGIGKME

SEQ ID NO: 1035008 - protein, 9 aa, Homo Sapiens
VGWCKKTKH

SEQ ID NO: 1035009 - protein, 9 aa, Homo Sapiens
RALSPDMDE

SEQ ID NO: 1035010 - protein, 9 aa, Homo Sapiens
LFSLDKVHA

SEQ ID NO: 1035011 - protein, 9 aa, Homo Sapiens
RARQASLEE

SEQ ID NO: 1035012 - protein, 9 aa, Homo Sapiens
VREGHPDKI

SEQ ID NO: 1035013 - protein, 9 aa, Homo Sapiens
INAVSFRNR

SEQ ID NO: 1035014 - protein, 9 aa, Homo Sapiens
YLADFPKKL

SEQ ID NO: 1035015 - protein, 9 aa, Homo Sapiens
VYWATYLYR

SEQ ID NO: 1035016 - protein, 9 aa, Homo Sapiens
TDDNITHKV

SEQ ID NO: 1035017 - protein, 9 aa, Homo Sapiens
FIIDLGTKI

SEQ ID NO: 1035018 - protein, 9 aa, Homo Sapiens
PRLQADRKF

SEQ ID NO: 1035019 - protein, 9 aa, Homo Sapiens
GLPGKAESL

SEQ ID NO: 1035020 - protein, 9 aa, Homo Sapiens
GFKLQNLDL

SEQ ID NO: 1035021 - protein, 9 aa, Homo Sapiens
GAARGLQRA

SEQ ID NO: 1035022 - protein, 9 aa, Homo Sapiens
VKSESLDKE

SEQ ID NO: 1035023 - protein, 9 aa, Homo Sapiens
KRHLFEKKL

SEQ ID NO: 1035024 - protein, 9 aa, Homo Sapiens
PCYTCVCQR

SEQ ID NO: 1035025 - protein, 9 aa, Homo Sapiens
LESFPAVLS

SEQ ID NO: 1035026 - protein, 9 aa, Homo Sapiens
QFLPQEDPD

SEQ ID NO: 1035027 - protein, 9 aa, Homo Sapiens
ELMKKSLQT

SEQ ID NO: 1035028 - protein, 9 aa, Homo Sapiens
INLNQVAIS

SEQ ID NO: 1035029 - protein, 9 aa, Homo Sapiens
FQSGSQENR

SEQ ID NO: 1035030 - protein, 9 aa, Homo Sapiens
LELREEAVM

SEQ ID NO: 1035031 - protein, 9 aa, Homo Sapiens
DSSGASSPE

SEQ ID NO: 1035032 - protein, 9 aa, Homo Sapiens
TASQSWTSP

SEQ ID NO: 1035033 - protein, 9 aa, Homo Sapiens
WRLIALIGT

SEQ ID NO: 1035034 - protein, 9 aa, Homo Sapiens
QSVSHNLLD

SEQ ID NO: 1035035 - protein, 9 aa, Homo Sapiens
QLSFWNTYA

SEQ ID NO: 1035036 - protein, 9 aa, Homo Sapiens
LLENTNVRL

SEQ ID NO: 1035037 - protein, 9 aa, Homo Sapiens
MSFWSRQRP

SEQ ID NO: 1035038 - protein, 9 aa, Homo Sapiens
RNRIYVVGG

SEQ ID NO: 1035039 - protein, 9 aa, Homo Sapiens
YPLKKASGC

SEQ ID NO: 1035040 - protein, 9 aa, Homo Sapiens
AHFWNQRWL

SEQ ID NO: 1035041 - protein, 9 aa, Homo Sapiens
KVVKVAEYK

SEQ ID NO: 1035042 - protein, 9 aa, Homo Sapiens
IFGCFAPTE

SEQ ID NO: 1035043 - protein, 9 aa, Homo Sapiens
CLKQYSREE

SEQ ID NO: 1035044 - protein, 9 aa, Homo Sapiens
YRRTSDMVG

SEQ ID NO: 1035045 - protein, 9 aa, Homo Sapiens
SCEKSNLKK

SEQ ID NO: 1035046 - protein, 9 aa, Homo Sapiens
KSGVYPLKK

SEQ ID NO: 1035047 - protein, 9 aa, Homo Sapiens
GAAARSRPQ

SEQ ID NO: 1035048 - protein, 9 aa, Homo Sapiens
SKKEKIELK

SEQ ID NO: 1035049 - protein, 9 aa, Homo Sapiens
DVTLRNISR

SEQ ID NO: 1035050 - protein, 9 aa, Homo Sapiens
IRLNSVHCV

SEQ ID NO: 1035051 - protein, 9 aa, Homo Sapiens
FKIGPPFII

SEQ ID NO: 1035052 - protein, 9 aa, Homo Sapiens
MYLGPQLGN

SEQ ID NO: 1035053 - protein, 9 aa, Homo Sapiens
RRIREKLSR

SEQ ID NO: 1035054 - protein, 9 aa, Homo Sapiens
IPNNSDLTL

SEQ ID NO: 1035055 - protein, 9 aa, Homo Sapiens
AVNEKHTLL

SEQ ID NO: 1035056 - protein, 9 aa, Homo Sapiens
VFSSVPVGT

SEQ ID NO: 1035057 - protein, 9 aa, Homo Sapiens
RRGRRLGAL

SEQ ID NO: 1035058 - protein, 9 aa, Homo Sapiens
EVAQKRLQA

SEQ ID NO: 1035059 - protein, 9 aa, Homo Sapiens
LPLVDCFIQ

SEQ ID NO: 1035060 - protein, 9 aa, Homo Sapiens
TNNEVDDMH

SEQ ID NO: 1035061 - protein, 9 aa, Homo Sapiens
GSLFSRAAS

SEQ ID NO: 1035062 - protein, 9 aa, Homo Sapiens
PAPAGAGEG

SEQ ID NO: 1035063 - protein, 9 aa, Homo Sapiens
ADSSFATLP

SEQ ID NO: 1035064 - protein, 9 aa, Homo Sapiens
MDSTFILLF

SEQ ID NO: 1035065 - protein, 9 aa, Homo Sapiens
ARLPYYSAY

SEQ ID NO: 1035066 - protein, 9 aa, Homo Sapiens
NLLPFNEDT

SEQ ID NO: 1035067 - protein, 9 aa, Homo Sapiens
RNCGSPKIA

SEQ ID NO: 1035068 - protein, 9 aa, Homo Sapiens
SRRTAPEIH

SEQ ID NO: 1035069 - protein, 9 aa, Homo Sapiens
KTAGPLCQW

SEQ ID NO: 1035070 - protein, 9 aa, Homo Sapiens
KIKVVPEGP

SEQ ID NO: 1035071 - protein, 9 aa, Homo Sapiens
KPVQIMFMK

SEQ ID NO: 1035072 - protein, 9 aa, Homo Sapiens
TKINSPWRT

SEQ ID NO: 1035073 - protein, 9 aa, Homo Sapiens
QWLTPISSR

SEQ ID NO: 1035074 - protein, 9 aa, Homo Sapiens
YYFCDLFPL

SEQ ID NO: 1035075 - protein, 9 aa, Homo Sapiens
MPSHLSRVQ

SEQ ID NO: 1035076 - protein, 9 aa, Homo Sapiens
CAEDKKTRD

SEQ ID NO: 1035077 - protein, 9 aa, Homo Sapiens
LAQALLEAE

SEQ ID NO: 1035078 - protein, 9 aa, Homo Sapiens
NSSPPSGHS

SEQ ID NO: 1035079 - protein, 9 aa, Homo Sapiens
VEILLSLVC

SEQ ID NO: 1035080 - protein, 9 aa, Homo Sapiens
NLDLLLDTK

SEQ ID NO: 1035081 - protein, 9 aa, Homo Sapiens
QKLKASGIF

SEQ ID NO: 1035082 - protein, 9 aa, Homo Sapiens
WIRYALGEV

SEQ ID NO: 1035083 - protein, 9 aa, Homo Sapiens
IILGLVVTL

SEQ ID NO: 1035084 - protein, 9 aa, Homo Sapiens
FMQLSYRAK

SEQ ID NO: 1035085 - protein, 9 aa, Homo Sapiens
CGWAPLAGC

SEQ ID NO: 1035086 - protein, 9 aa, Homo Sapiens
LEPSLKKIK

SEQ ID NO: 1035087 - protein, 9 aa, Homo Sapiens
EVKENFVIF

SEQ ID NO: 1035088 - protein, 9 aa, Homo Sapiens
WLVTMKNGF

SEQ ID NO: 1035089 - protein, 9 aa, Homo Sapiens
AAEEAGVPG

SEQ ID NO: 1035090 - protein, 9 aa, Homo Sapiens
MGSVNKADY

SEQ ID NO: 1035091 - protein, 9 aa, Homo Sapiens
TIDNSQEAY

SEQ ID NO: 1035092 - protein, 9 aa, Homo Sapiens
FSVLDKVCK

SEQ ID NO: 1035093 - protein, 9 aa, Homo Sapiens
IDGSFEIEN

SEQ ID NO: 1035094 - protein, 9 aa, Homo Sapiens
FYGNPMHVA

SEQ ID NO: 1035095 - protein, 9 aa, Homo Sapiens
CSHFRRHEK

SEQ ID NO: 1035096 - protein, 9 aa, Homo Sapiens
VIILTIFCL

SEQ ID NO: 1035097 - protein, 9 aa, Homo Sapiens
TLQFQARMW

SEQ ID NO: 1035098 - protein, 9 aa, Homo Sapiens
LNTLESRLD

SEQ ID NO: 1035099 - protein, 9 aa, Homo Sapiens
KIEEPKIEV

SEQ ID NO: 1035100 - protein, 9 aa, Homo Sapiens
SQSLPVSPR

SEQ ID NO: 1035101 - protein, 9 aa, Homo Sapiens
FTAVTDFIL

SEQ ID NO: 1035102 - protein, 9 aa, Homo Sapiens
QVSARDDGV

SEQ ID NO: 1035103 - protein, 9 aa, Homo Sapiens
YKSIPYGFL

SEQ ID NO: 1035104 - protein, 9 aa, Homo Sapiens
EKMSHSRKK

SEQ ID NO: 1035105 - protein, 9 aa, Homo Sapiens
VQFRQVEEK

SEQ ID NO: 1035106 - protein, 9 aa, Homo Sapiens
FRSKSLGLG

SEQ ID NO: 1035107 - protein, 9 aa, Homo Sapiens
KVTYCPIEP

SEQ ID NO: 1035108 - protein, 9 aa, Homo Sapiens
TQMPSHLSR

SEQ ID NO: 1035109 - protein, 9 aa, Homo Sapiens
RGQQLMEAA

SEQ ID NO: 1035110 - protein, 9 aa, Homo Sapiens
GEPGQDLLL

SEQ ID NO: 1035111 - protein, 9 aa, Homo Sapiens
YIPNVRPWH

SEQ ID NO: 1035112 - protein, 9 aa, Homo Sapiens
FFFLEVSFT

SEQ ID NO: 1035113 - protein, 9 aa, Homo Sapiens
NEVDDMHTS

SEQ ID NO: 1035114 - protein, 9 aa, Homo Sapiens
SRIRLEKAS

SEQ ID NO: 1035115 - protein, 9 aa, Homo Sapiens
RSQELQYQP

SEQ ID NO: 1035116 - protein, 9 aa, Homo Sapiens
LYLSIVPKT

SEQ ID NO: 1035117 - protein, 9 aa, Homo Sapiens
EGSSNQQVF

SEQ ID NO: 1035118 - protein, 9 aa, Homo Sapiens
KDEFLHETL

SEQ ID NO: 1035119 - protein, 9 aa, Homo Sapiens
VTSTFSIFQ

SEQ ID NO: 1035120 - protein, 9 aa, Homo Sapiens
AKQGGGGGE

SEQ ID NO: 1035121 - protein, 9 aa, Homo Sapiens
DSLLKNCIG

SEQ ID NO: 1035122 - protein, 9 aa, Homo Sapiens
EATQPHKEW

SEQ ID NO: 1035123 - protein, 9 aa, Homo Sapiens
EQHGILVTG

SEQ ID NO: 1035124 - protein, 9 aa, Homo Sapiens
PAPSKRALG

SEQ ID NO: 1035125 - protein, 9 aa, Homo Sapiens
KVDALNDKI

SEQ ID NO: 1035126 - protein, 9 aa, Homo Sapiens
FKYQKDCQA

SEQ ID NO: 1035127 - protein, 9 aa, Homo Sapiens
IAHFFCDFL

SEQ ID NO: 1035128 - protein, 9 aa, Homo Sapiens
QLEKKEALI

SEQ ID NO: 1035129 - protein, 9 aa, Homo Sapiens
RIMQILRIL

SEQ ID NO: 1035130 - protein, 9 aa, Homo Sapiens
ELRKMTEIE

SEQ ID NO: 1035131 - protein, 9 aa, Homo Sapiens
SLHLSQQKD

SEQ ID NO: 1035132 - protein, 9 aa, Homo Sapiens
RTAGDHLGR

SEQ ID NO: 1035133 - protein, 9 aa, Homo Sapiens
LTEVNPDEE

SEQ ID NO: 1035134 - protein, 9 aa, Homo Sapiens
LNPGTTYKI

SEQ ID NO: 1035135 - protein, 9 aa, Homo Sapiens
CVAISIELD

SEQ ID NO: 1035136 - protein, 9 aa, Homo Sapiens
LISQDKLPV

SEQ ID NO: 1035137 - protein, 9 aa, Homo Sapiens
GAEHSVAAG

SEQ ID NO: 1035138 - protein, 9 aa, Homo Sapiens
NPDVESNSS

SEQ ID NO: 1035139 - protein, 9 aa, Homo Sapiens
LGETWESLT

SEQ ID NO: 1035140 - protein, 9 aa, Homo Sapiens
MYRRTSDMV

SEQ ID NO: 1035141 - protein, 9 aa, Homo Sapiens
SGSEQEVKS

SEQ ID NO: 1035142 - protein, 9 aa, Homo Sapiens
KVDAIFCVA

SEQ ID NO: 1035143 - protein, 9 aa, Homo Sapiens
DRHPEAFTS

SEQ ID NO: 1035144 - protein, 9 aa, Homo Sapiens
KKNSHNFCE

SEQ ID NO: 1035145 - protein, 9 aa, Homo Sapiens
GSWGTVCND

SEQ ID NO: 1035146 - protein, 9 aa, Homo Sapiens
FNEHSAFRL

SEQ ID NO: 1035147 - protein, 9 aa, Homo Sapiens
PQVRPFGGH

SEQ ID NO: 1035148 - protein, 9 aa, Homo Sapiens
ETISIEEGV

SEQ ID NO: 1035149 - protein, 9 aa, Homo Sapiens
LLFFDQPDN

SEQ ID NO: 1035150 - protein, 9 aa, Homo Sapiens
LLFYTRITI

SEQ ID NO: 1035151 - protein, 9 aa, Homo Sapiens
KYDHQRKQE

SEQ ID NO: 1035152 - protein, 9 aa, Homo Sapiens
TSPGRKPVD

SEQ ID NO: 1035153 - protein, 9 aa, Homo Sapiens
HDRVVFKSA

SEQ ID NO: 1035154 - protein, 9 aa, Homo Sapiens
SRAPLPEDC

SEQ ID NO: 1035155 - protein, 9 aa, Homo Sapiens
HFCYQNLWS

SEQ ID NO: 1035156 - protein, 9 aa, Homo Sapiens
RYFQSLNLY

SEQ ID NO: 1035157 - protein, 9 aa, Homo Sapiens
PTMIAAASS

SEQ ID NO: 1035158 - protein, 9 aa, Homo Sapiens
SSKIPTFVT

SEQ ID NO: 1035159 - protein, 9 aa, Homo Sapiens
SRPPSRSAV

SEQ ID NO: 1035160 - protein, 9 aa, Homo Sapiens
ASKKLEVQL

SEQ ID NO: 1035161 - protein, 9 aa, Homo Sapiens
GIVLVYDIT

SEQ ID NO: 1035162 - protein, 9 aa, Homo Sapiens
TFLGDREKR

SEQ ID NO: 1035163 - protein, 9 aa, Homo Sapiens
LLGPGFGLG

SEQ ID NO: 1035164 - protein, 9 aa, Homo Sapiens
FVTLDDLAP

SEQ ID NO: 1035165 - protein, 9 aa, Homo Sapiens
FAGTYRCFG

SEQ ID NO: 1035166 - protein, 9 aa, Homo Sapiens
HFDSFIVQY

SEQ ID NO: 1035167 - protein, 9 aa, Homo Sapiens
GEKGEMGKK

SEQ ID NO: 1035168 - protein, 9 aa, Homo Sapiens
QNDWTATDP

SEQ ID NO: 1035169 - protein, 9 aa, Homo Sapiens
ICTKTGANL

SEQ ID NO: 1035170 - protein, 9 aa, Homo Sapiens
FQVSARDDG

SEQ ID NO: 1035171 - protein, 9 aa, Homo Sapiens
RHHETSTHA

SEQ ID NO: 1035172 - protein, 9 aa, Homo Sapiens
QLEKLEALF

SEQ ID NO: 1035173 - protein, 9 aa, Homo Sapiens
PVINRLTRR

SEQ ID NO: 1035174 - protein, 9 aa, Homo Sapiens
ARKALAIVF

SEQ ID NO: 1035175 - protein, 9 aa, Homo Sapiens
ESIGYCWCV

SEQ ID NO: 1035176 - protein, 9 aa, Homo Sapiens
SQQKDSLPV

SEQ ID NO: 1035177 - protein, 9 aa, Homo Sapiens
SGRPIELQI

SEQ ID NO: 1035178 - protein, 9 aa, Homo Sapiens
QFLQVHLSG

SEQ ID NO: 1035179 - protein, 9 aa, Homo Sapiens
SDYKFTEGT

SEQ ID NO: 1035180 - protein, 9 aa, Homo Sapiens
ISQDKLPVL

SEQ ID NO: 1035181 - protein, 9 aa, Homo Sapiens
AYRASLVSR

SEQ ID NO: 1035182 - protein, 9 aa, Homo Sapiens
ADAAGAAEA

SEQ ID NO: 1035183 - protein, 9 aa, Homo Sapiens
YTCVCQRGM

SEQ ID NO: 1035184 - protein, 9 aa, Homo Sapiens
QKMGFIIYG

SEQ ID NO: 1035185 - protein, 9 aa, Homo Sapiens
KKSVPTTWE

SEQ ID NO: 1035186 - protein, 9 aa, Homo Sapiens
INIIKLSHK

SEQ ID NO: 1035187 - protein, 9 aa, Homo Sapiens
QDGYHKSFT

SEQ ID NO: 1035188 - protein, 9 aa, Homo Sapiens
VPSGVIPNF

SEQ ID NO: 1035189 - protein, 9 aa, Homo Sapiens
SALEESSKQ

SEQ ID NO: 1035190 - protein, 9 aa, Homo Sapiens
CVLDSKEQL

SEQ ID NO: 1035191 - protein, 9 aa, Homo Sapiens
KTDDDVIDQ

SEQ ID NO: 1035192 - protein, 9 aa, Homo Sapiens
GLSHPFSIN

SEQ ID NO: 1035193 - protein, 9 aa, Homo Sapiens
VEQPTSFLP

SEQ ID NO: 1035194 - protein, 9 aa, Homo Sapiens
QNENGTWPR

SEQ ID NO: 1035195 - protein, 9 aa, Homo Sapiens
AFIGTLGRS

SEQ ID NO: 1035196 - protein, 9 aa, Homo Sapiens
EPPKFPRAT

SEQ ID NO: 1035197 - protein, 9 aa, Homo Sapiens
QDNTRVEPP

SEQ ID NO: 1035198 - protein, 9 aa, Homo Sapiens
YFSGRPLVQ

SEQ ID NO: 1035199 - protein, 9 aa, Homo Sapiens
PFPCDETEL

SEQ ID NO: 1035200 - protein, 9 aa, Homo Sapiens
FSGRPLVQN

SEQ ID NO: 1035201 - protein, 9 aa, Homo Sapiens
TFNQGSTLI

SEQ ID NO: 1035202 - protein, 9 aa, Homo Sapiens
HFFMAVFYV

SEQ ID NO: 1035203 - protein, 9 aa, Homo Sapiens
RPFNVNLTC

SEQ ID NO: 1035204 - protein, 9 aa, Homo Sapiens
REQGQRSSR

SEQ ID NO: 1035205 - protein, 9 aa, Homo Sapiens
YLLEEGEYL

SEQ ID NO: 1035206 - protein, 9 aa, Homo Sapiens
LLRAFAGPS

SEQ ID NO: 1035207 - protein, 9 aa, Homo Sapiens
IGENIGEHC

SEQ ID NO: 1035208 - protein, 9 aa, Homo Sapiens
TEQYYTMKI

SEQ ID NO: 1035209 - protein, 9 aa, Homo Sapiens
DEDEKGPWG

SEQ ID NO: 1035210 - protein, 9 aa, Homo Sapiens
EIQALQEKI

SEQ ID NO: 1035211 - protein, 9 aa, Homo Sapiens
KMPCNLTRY

SEQ ID NO: 1035212 - protein, 9 aa, Homo Sapiens
HASDTSAVL

SEQ ID NO: 1035213 - protein, 9 aa, Homo Sapiens
GKEQESLAA

SEQ ID NO: 1035214 - protein, 9 aa, Homo Sapiens
LSDPGLKPP

SEQ ID NO: 1035215 - protein, 9 aa, Homo Sapiens
LPTPSHLQA

SEQ ID NO: 1035216 - protein, 9 aa, Homo Sapiens
EGNPNVHFE

SEQ ID NO: 1035217 - protein, 9 aa, Homo Sapiens
NKVFMINRY

SEQ ID NO: 1035218 - protein, 9 aa, Homo Sapiens
AASQDNISV

SEQ ID NO: 1035219 - protein, 9 aa, Homo Sapiens
QTLIVPPDR

SEQ ID NO: 1035220 - protein, 9 aa, Homo Sapiens
PLYHSVYKT

SEQ ID NO: 1035221 - protein, 9 aa, Homo Sapiens
TAATSITKK

SEQ ID NO: 1035222 - protein, 9 aa, Homo Sapiens
YTEPLILNL

SEQ ID NO: 1035223 - protein, 9 aa, Homo Sapiens
HQLLILREH

SEQ ID NO: 1035224 - protein, 9 aa, Homo Sapiens
RDARDSDCG

SEQ ID NO: 1035225 - protein, 9 aa, Homo Sapiens
QTLSRPPNL

SEQ ID NO: 1035226 - protein, 9 aa, Homo Sapiens
NRIYVVGGA

SEQ ID NO: 1035227 - protein, 9 aa, Homo Sapiens
EKALKIHLQ

SEQ ID NO: 1035228 - protein, 9 aa, Homo Sapiens
LCYPETGHY

SEQ ID NO: 1035229 - protein, 9 aa, Homo Sapiens
GKFHVTSKF

SEQ ID NO: 1035230 - protein, 9 aa, Homo Sapiens
GRAEGRAGG

SEQ ID NO: 1035231 - protein, 9 aa, Homo Sapiens
EPKIVMTPS

SEQ ID NO: 1035232 - protein, 9 aa, Homo Sapiens
RDYQDTLLE

SEQ ID NO: 1035233 - protein, 9 aa, Homo Sapiens
NSGSDGSLS

SEQ ID NO: 1035234 - protein, 9 aa, Homo Sapiens
AFAAAARTR

SEQ ID NO: 1035235 - protein, 9 aa, Homo Sapiens
KYGVVREVI

SEQ ID NO: 1035236 - protein, 9 aa, Homo Sapiens
AALKVLEEE

SEQ ID NO: 1035237 - protein, 9 aa, Homo Sapiens
VLMLLISLS

SEQ ID NO: 1035238 - protein, 9 aa, Homo Sapiens
PFWGQEKEH

SEQ ID NO: 1035239 - protein, 9 aa, Homo Sapiens
PTESWPGHV

SEQ ID NO: 1035240 - protein, 9 aa, Homo Sapiens
DLSCEKSNL

SEQ ID NO: 1035241 - protein, 9 aa, Homo Sapiens
KDSVKLVVQ

SEQ ID NO: 1035242 - protein, 9 aa, Homo Sapiens
LAAHTNNYK

SEQ ID NO: 1035243 - protein, 9 aa, Homo Sapiens
SGGTRSSVV

SEQ ID NO: 1035244 - protein, 9 aa, Homo Sapiens
AKLSRTGRS

SEQ ID NO: 1035245 - protein, 9 aa, Homo Sapiens
MWRQKEKIR

SEQ ID NO: 1035246 - protein, 9 aa, Homo Sapiens
IEKVERILD

SEQ ID NO: 1035247 - protein, 9 aa, Homo Sapiens
EMEIFVKRQ

SEQ ID NO: 1035248 - protein, 9 aa, Homo Sapiens
INDNTPVFP

SEQ ID NO: 1035249 - protein, 9 aa, Homo Sapiens
GYAVGLSNV

SEQ ID NO: 1035250 - protein, 9 aa, Homo Sapiens
GESFRSKSL

SEQ ID NO: 1035251 - protein, 9 aa, Homo Sapiens
EWPQPRGQA

SEQ ID NO: 1035252 - protein, 9 aa, Homo Sapiens
QHQEKQEET

SEQ ID NO: 1035253 - protein, 9 aa, Homo Sapiens
SQLGDVGAL

SEQ ID NO: 1035254 - protein, 9 aa, Homo Sapiens
RDVQDSFAP

SEQ ID NO: 1035255 - protein, 9 aa, Homo Sapiens
HWAVSPTEP

SEQ ID NO: 1035256 - protein, 9 aa, Homo Sapiens
RIDRHRVMD

SEQ ID NO: 1035257 - protein, 9 aa, Homo Sapiens
RPCHGNCNP

SEQ ID NO: 1035258 - protein, 9 aa, Homo Sapiens
SRRCALPAL

SEQ ID NO: 1035259 - protein, 9 aa, Homo Sapiens
PLKEETAQL

SEQ ID NO: 1035260 - protein, 9 aa, Homo Sapiens
EQKKEQMLE

SEQ ID NO: 1035261 - protein, 9 aa, Homo Sapiens
DVQDSFAPR

SEQ ID NO: 1035262 - protein, 9 aa, Homo Sapiens
FDTMTNRLL

SEQ ID NO: 1035263 - protein, 9 aa, Homo Sapiens
GKALKEEEK

SEQ ID NO: 1035264 - protein, 9 aa, Homo Sapiens
RKSSKPRAV

SEQ ID NO: 1035265 - protein, 9 aa, Homo Sapiens
SVMDSHAAA

SEQ ID NO: 1035266 - protein, 9 aa, Homo Sapiens
GGGCGWAPL

SEQ ID NO: 1035267 - protein, 9 aa, Homo Sapiens
TPQNLKEEE

SEQ ID NO: 1035268 - protein, 9 aa, Homo Sapiens
KIQKSLDGF

SEQ ID NO: 1035269 - protein, 9 aa, Homo Sapiens
EEDEASGLK

SEQ ID NO: 1035270 - protein, 9 aa, Homo Sapiens
REEDDEHAR

SEQ ID NO: 1035271 - protein, 9 aa, Homo Sapiens
SHIILGLVV

SEQ ID NO: 1035272 - protein, 9 aa, Homo Sapiens
IVIMYRRIG

SEQ ID NO: 1035273 - protein, 9 aa, Homo Sapiens
VFVEQGHVR

SEQ ID NO: 1035274 - protein, 9 aa, Homo Sapiens
YAVDKITIS

SEQ ID NO: 1035275 - protein, 9 aa, Homo Sapiens
VCVIDGIGK

SEQ ID NO: 1035276 - protein, 9 aa, Homo Sapiens
TATTIITVT

SEQ ID NO: 1035277 - protein, 9 aa, Homo Sapiens
HYLHHFFFK

SEQ ID NO: 1035278 - protein, 9 aa, Homo Sapiens
TAFILAVCC

SEQ ID NO: 1035279 - protein, 9 aa, Homo Sapiens
HSIIQSEEQ

SEQ ID NO: 1035280 - protein, 9 aa, Homo Sapiens
EIGTLGTTI

SEQ ID NO: 1035281 - protein, 9 aa, Homo Sapiens
LQEIEATNA

SEQ ID NO: 1035282 - protein, 9 aa, Homo Sapiens
QRVFFGVSE

SEQ ID NO: 1035283 - protein, 9 aa, Homo Sapiens
ESEEFNATK

SEQ ID NO: 1035284 - protein, 9 aa, Homo Sapiens
NQRIKVLNT

SEQ ID NO: 1035285 - protein, 9 aa, Homo Sapiens
PVHYELLTN

SEQ ID NO: 1035286 - protein, 9 aa, Homo Sapiens
EVFANFFNT

SEQ ID NO: 1035287 - protein, 9 aa, Homo Sapiens
SNICGEKKV

SEQ ID NO: 1035288 - protein, 9 aa, Homo Sapiens
SKEQVCLHD

SEQ ID NO: 1035289 - protein, 9 aa, Homo Sapiens
IFHVGRFHK

SEQ ID NO: 1035290 - protein, 9 aa, Homo Sapiens
LNRYSGTQN

SEQ ID NO: 1035291 - protein, 9 aa, Homo Sapiens
VLAAGKEVG

SEQ ID NO: 1035292 - protein, 9 aa, Homo Sapiens
LMKVEQDQR

SEQ ID NO: 1035293 - protein, 9 aa, Homo Sapiens
TFFPSSLRN

SEQ ID NO: 1035294 - protein, 9 aa, Homo Sapiens
YTYPDTPIH

SEQ ID NO: 1035295 - protein, 9 aa, Homo Sapiens
IGLIYHSPG

SEQ ID NO: 1035296 - protein, 9 aa, Homo Sapiens
GCPVSLGVK

SEQ ID NO: 1035297 - protein, 9 aa, Homo Sapiens
VEVTNMIEL

SEQ ID NO: 1035298 - protein, 9 aa, Homo Sapiens
SVFPPDSQT

SEQ ID NO: 1035299 - protein, 9 aa, Homo Sapiens
NINLKMEVE

SEQ ID NO: 1035300 - protein, 9 aa, Homo Sapiens
SFPHQPTAL

SEQ ID NO: 1035301 - protein, 9 aa, Homo Sapiens
RSFSLSASL

SEQ ID NO: 1035302 - protein, 9 aa, Homo Sapiens
IMSTGGGGY

SEQ ID NO: 1035303 - protein, 9 aa, Homo Sapiens
LRRKFGDNY

SEQ ID NO: 1035304 - protein, 9 aa, Homo Sapiens
HIGPPGPTE

SEQ ID NO: 1035305 - protein, 9 aa, Homo Sapiens
QSQEFSGRP

SEQ ID NO: 1035306 - protein, 9 aa, Homo Sapiens
QGIAETPGV

SEQ ID NO: 1035307 - protein, 9 aa, Homo Sapiens
SYECTIKNS

SEQ ID NO: 1035308 - protein, 9 aa, Homo Sapiens
PGIDGIEGD

SEQ ID NO: 1035309 - protein, 9 aa, Homo Sapiens
NMIELEQRL

SEQ ID NO: 1035310 - protein, 9 aa, Homo Sapiens
SSGLRKLSL

SEQ ID NO: 1035311 - protein, 9 aa, Homo Sapiens
VIMYRRIGI

SEQ ID NO: 1035312 - protein, 9 aa, Homo Sapiens
AYLPCRFTL

SEQ ID NO: 1035313 - protein, 9 aa, Homo Sapiens
SMTSEIERV

SEQ ID NO: 1035314 - protein, 9 aa, Homo Sapiens
KVSLNHGIE

SEQ ID NO: 1035315 - protein, 9 aa, Homo Sapiens
EEQKDDNDD

SEQ ID NO: 1035316 - protein, 9 aa, Homo Sapiens
WADELCTMV

SEQ ID NO: 1035317 - protein, 9 aa, Homo Sapiens
RRHFWTILV

SEQ ID NO: 1035318 - protein, 9 aa, Homo Sapiens
AMGIVLVYD

SEQ ID NO: 1035319 - protein, 9 aa, Homo Sapiens
QKNPPPTKK

SEQ ID NO: 1035320 - protein, 9 aa, Homo Sapiens
LISLEKKKE

SEQ ID NO: 1035321 - protein, 9 aa, Homo Sapiens
ITVELGCVN

SEQ ID NO: 1035322 - protein, 9 aa, Homo Sapiens
TLSQFPETF

SEQ ID NO: 1035323 - protein, 9 aa, Homo Sapiens
NTFQHSVVV

SEQ ID NO: 1035324 - protein, 9 aa, Homo Sapiens
NLGRGLERL

SEQ ID NO: 1035325 - protein, 9 aa, Homo Sapiens
DPVRGWAWT

SEQ ID NO: 1035326 - protein, 9 aa, Homo Sapiens
TKQLLEEIW

SEQ ID NO: 1035327 - protein, 9 aa, Homo Sapiens
EKFVSVTKA

SEQ ID NO: 1035328 - protein, 9 aa, Homo Sapiens
YFRERWQIK

SEQ ID NO: 1035329 - protein, 9 aa, Homo Sapiens
AKGQQMLAG

SEQ ID NO: 1035330 - protein, 9 aa, Homo Sapiens
QPAPHLKTS

SEQ ID NO: 1035331 - protein, 9 aa, Homo Sapiens
FIFPEELIK

SEQ ID NO: 1035332 - protein, 9 aa, Homo Sapiens
KQTCRMTHL

SEQ ID NO: 1035333 - protein, 9 aa, Homo Sapiens
RYSSFGDAS

SEQ ID NO: 1035334 - protein, 9 aa, Homo Sapiens
SVGVDARHL

SEQ ID NO: 1035335 - protein, 9 aa, Homo Sapiens
SQNEDIKPF

SEQ ID NO: 1035336 - protein, 9 aa, Homo Sapiens
MVMIDVDGL

SEQ ID NO: 1035337 - protein, 9 aa, Homo Sapiens
GELEFGENE

SEQ ID NO: 1035338 - protein, 9 aa, Homo Sapiens
VQCQDENRK

SEQ ID NO: 1035339 - protein, 9 aa, Homo Sapiens
HNLLRAFAG

SEQ ID NO: 1035340 - protein, 9 aa, Homo Sapiens
ICVCTFSLL

SEQ ID NO: 1035341 - protein, 9 aa, Homo Sapiens
VAPDVFHFT

SEQ ID NO: 1035342 - protein, 9 aa, Homo Sapiens
NEVARQLER

SEQ ID NO: 1035343 - protein, 9 aa, Homo Sapiens
LTVSASAEV

SEQ ID NO: 1035344 - protein, 9 aa, Homo Sapiens
GERGNGRSE

SEQ ID NO: 1035345 - protein, 9 aa, Homo Sapiens
YSLRNKKFK

SEQ ID NO: 1035346 - protein, 9 aa, Homo Sapiens
DKLENNPEM

SEQ ID NO: 1035347 - protein, 9 aa, Homo Sapiens
LSLSSNLGY

SEQ ID NO: 1035348 - protein, 9 aa, Homo Sapiens
APFLGISRG

SEQ ID NO: 1035349 - protein, 9 aa, Homo Sapiens
SENNCVYQS

SEQ ID NO: 1035350 - protein, 9 aa, Homo Sapiens
TNNSPGNWK

SEQ ID NO: 1035351 - protein, 9 aa, Homo Sapiens
GLERLIFSG

SEQ ID NO: 1035352 - protein, 9 aa, Homo Sapiens
NYPLPNPGY

SEQ ID NO: 1035353 - protein, 9 aa, Homo Sapiens
GTPVLRDSW

SEQ ID NO: 1035354 - protein, 9 aa, Homo Sapiens
LKMVRKSIN

SEQ ID NO: 1035355 - protein, 9 aa, Homo Sapiens
TKNYPNAGL

SEQ ID NO: 1035356 - protein, 9 aa, Homo Sapiens
GLPGAKGKP

SEQ ID NO: 1035357 - protein, 9 aa, Homo Sapiens
EKGNANLTK

SEQ ID NO: 1035358 - protein, 9 aa, Homo Sapiens
RAKSLWRPE

SEQ ID NO: 1035359 - protein, 9 aa, Homo Sapiens
DNIAGTQKK

SEQ ID NO: 1035360 - protein, 9 aa, Homo Sapiens
SFFQDQAPT

SEQ ID NO: 1035361 - protein, 9 aa, Homo Sapiens
ISLADYCTQ

SEQ ID NO: 1035362 - protein, 9 aa, Homo Sapiens
EAVEFCCQV

SEQ ID NO: 1035363 - protein, 9 aa, Homo Sapiens
PCRFTLSPE

SEQ ID NO: 1035364 - protein, 9 aa, Homo Sapiens
SVCLDWKPW

SEQ ID NO: 1035365 - protein, 9 aa, Homo Sapiens
RGACGLQPG

SEQ ID NO: 1035366 - protein, 9 aa, Homo Sapiens
LSEMDNEPL

SEQ ID NO: 1035367 - protein, 9 aa, Homo Sapiens
DVSSFSSRK

SEQ ID NO: 1035368 - protein, 9 aa, Homo Sapiens
VPPLKIQLF

SEQ ID NO: 1035369 - protein, 9 aa, Homo Sapiens
DSLNTSENN

SEQ ID NO: 1035370 - protein, 9 aa, Homo Sapiens
IKDTMTMDA

SEQ ID NO: 1035371 - protein, 9 aa, Homo Sapiens
GLSGSQTQP

SEQ ID NO: 1035372 - protein, 9 aa, Homo Sapiens
PNKIIEVLE

SEQ ID NO: 1035373 - protein, 9 aa, Homo Sapiens
AMRANATLL

SEQ ID NO: 1035374 - protein, 9 aa, Homo Sapiens
FFVLFKSLI

SEQ ID NO: 1035375 - protein, 9 aa, Homo Sapiens
KPAVAMPGG

SEQ ID NO: 1035376 - protein, 9 aa, Homo Sapiens
GANANPSDG

SEQ ID NO: 1035377 - protein, 9 aa, Homo Sapiens
TVSVTGRSP

SEQ ID NO: 1035378 - protein, 9 aa, Homo Sapiens
SCGPSLASR

SEQ ID NO: 1035379 - protein, 9 aa, Homo Sapiens
LLVPPFLNS

SEQ ID NO: 1035380 - protein, 9 aa, Homo Sapiens
FFCDFLSLL

SEQ ID NO: 1035381 - protein, 9 aa, Homo Sapiens
GLGKMMMKY

SEQ ID NO: 1035382 - protein, 9 aa, Homo Sapiens
LPNHRWTQT

SEQ ID NO: 1035383 - protein, 9 aa, Homo Sapiens
LILREHHQP

SEQ ID NO: 1035384 - protein, 9 aa, Homo Sapiens
DSPLSQMGS

SEQ ID NO: 1035385 - protein, 9 aa, Homo Sapiens
VIDDEEEEN

SEQ ID NO: 1035386 - protein, 9 aa, Homo Sapiens
SSIQQLKRN

SEQ ID NO: 1035387 - protein, 9 aa, Homo Sapiens
ENFPQTPLK

SEQ ID NO: 1035388 - protein, 9 aa, Homo Sapiens
ARFLLRDAV

SEQ ID NO: 1035389 - protein, 9 aa, Homo Sapiens
LKYNEKFVS

SEQ ID NO: 1035390 - protein, 9 aa, Homo Sapiens
GSGLPESVD

SEQ ID NO: 1035391 - protein, 9 aa, Homo Sapiens
FESARQFCQ

SEQ ID NO: 1035392 - protein, 9 aa, Homo Sapiens
QLQLAQEVA

SEQ ID NO: 1035393 - protein, 9 aa, Homo Sapiens
EKNKDTVYE

SEQ ID NO: 1035394 - protein, 9 aa, Homo Sapiens
AFLLRLATW

SEQ ID NO: 1035395 - protein, 9 aa, Homo Sapiens
KKILLTCSS

SEQ ID NO: 1035396 - protein, 9 aa, Homo Sapiens
EKIPKLRRR

SEQ ID NO: 1035397 - protein, 9 aa, Homo Sapiens
QADDQDMIE

SEQ ID NO: 1035398 - protein, 9 aa, Homo Sapiens
KVPAFLLRL

SEQ ID NO: 1035399 - protein, 9 aa, Homo Sapiens
QREEDDEHA

SEQ ID NO: 1035400 - protein, 9 aa, Homo Sapiens
ALLAQFVNQ

SEQ ID NO: 1035401 - protein, 9 aa, Homo Sapiens
ALCLYESRF

SEQ ID NO: 1035402 - protein, 9 aa, Homo Sapiens
INRYLQRHV

SEQ ID NO: 1035403 - protein, 9 aa, Homo Sapiens
ASTNLQKAF

SEQ ID NO: 1035404 - protein, 9 aa, Homo Sapiens
RRLYPPLST

SEQ ID NO: 1035405 - protein, 9 aa, Homo Sapiens
IAALKVLEE

SEQ ID NO: 1035406 - protein, 9 aa, Homo Sapiens
SLGLGAPEE

SEQ ID NO: 1035407 - protein, 9 aa, Homo Sapiens
EQGQRSSRA

SEQ ID NO: 1035408 - protein, 9 aa, Homo Sapiens
PVRGWAWTR

SEQ ID NO: 1035409 - protein, 9 aa, Homo Sapiens
DLILAAVLH

SEQ ID NO: 1035410 - protein, 9 aa, Homo Sapiens
RERGVPGER

SEQ ID NO: 1035411 - protein, 9 aa, Homo Sapiens
AELEKITGS

SEQ ID NO: 1035412 - protein, 9 aa, Homo Sapiens
EKNTIFKAW

SEQ ID NO: 1035413 - protein, 9 aa, Homo Sapiens
EKKEALISQ

SEQ ID NO: 1035414 - protein, 9 aa, Homo Sapiens
RAPGEASPG

SEQ ID NO: 1035415 - protein, 9 aa, Homo Sapiens
KGPVSAAPA

SEQ ID NO: 1035416 - protein, 9 aa, Homo Sapiens
ECDTDRDGY

SEQ ID NO: 1035417 - protein, 9 aa, Homo Sapiens
LPLIKYFAE

SEQ ID NO: 1035418 - protein, 9 aa, Homo Sapiens
EYLDWSHWG

SEQ ID NO: 1035419 - protein, 9 aa, Homo Sapiens
RKKIEDPPN

SEQ ID NO: 1035420 - protein, 9 aa, Homo Sapiens
PKESGACLH

SEQ ID NO: 1035421 - protein, 9 aa, Homo Sapiens
STNLQKAFS

SEQ ID NO: 1035422 - protein, 9 aa, Homo Sapiens
LGGPLPDFP

SEQ ID NO: 1035423 - protein, 9 aa, Homo Sapiens
ALVQEKYSK

SEQ ID NO: 1035424 - protein, 9 aa, Homo Sapiens
EGRFFKAYS

SEQ ID NO: 1035425 - protein, 9 aa, Homo Sapiens
YLDQLGTAA

SEQ ID NO: 1035426 - protein, 9 aa, Homo Sapiens
KLRHRRHHH

SEQ ID NO: 1035427 - protein, 9 aa, Homo Sapiens
TIKCPLSEM

SEQ ID NO: 1035428 - protein, 9 aa, Homo Sapiens
DLSREELTT

SEQ ID NO: 1035429 - protein, 9 aa, Homo Sapiens
HGELPSYSC

SEQ ID NO: 1035430 - protein, 9 aa, Homo Sapiens
VFTSDFSKV

SEQ ID NO: 1035431 - protein, 9 aa, Homo Sapiens
LQLSFWNTY

SEQ ID NO: 1035432 - protein, 9 aa, Homo Sapiens
ALEKNYEEV

SEQ ID NO: 1035433 - protein, 9 aa, Homo Sapiens
ELPSYSCEM

SEQ ID NO: 1035434 - protein, 9 aa, Homo Sapiens
TALISVFGS

SEQ ID NO: 1035435 - protein, 9 aa, Homo Sapiens
CSCVKVTGL

SEQ ID NO: 1035436 - protein, 9 aa, Homo Sapiens
NRLLDEIIQ

SEQ ID NO: 1035437 - protein, 9 aa, Homo Sapiens
SFMPRVLSK

SEQ ID NO: 1035438 - protein, 9 aa, Homo Sapiens
LAQRHGVVL

SEQ ID NO: 1035439 - protein, 9 aa, Homo Sapiens
AFARCLPSR

SEQ ID NO: 1035440 - protein, 9 aa, Homo Sapiens
TFKVPSREI

SEQ ID NO: 1035441 - protein, 9 aa, Homo Sapiens
GLQDSFPAQ

SEQ ID NO: 1035442 - protein, 9 aa, Homo Sapiens
RPIELQIPT

SEQ ID NO: 1035443 - protein, 9 aa, Homo Sapiens
KYVNRKKKT

SEQ ID NO: 1035444 - protein, 9 aa, Homo Sapiens
SHFPCTVRW

SEQ ID NO: 1035445 - protein, 9 aa, Homo Sapiens
QPPEKMEFH

SEQ ID NO: 1035446 - protein, 9 aa, Homo Sapiens
ETTSKPVQI

SEQ ID NO: 1035447 - protein, 9 aa, Homo Sapiens
KSNDLLYQY

SEQ ID NO: 1035448 - protein, 9 aa, Homo Sapiens
AKLLCKILQ

SEQ ID NO: 1035449 - protein, 9 aa, Homo Sapiens
DIKHKETKP

SEQ ID NO: 1035450 - protein, 9 aa, Homo Sapiens
VKPISLADY

SEQ ID NO: 1035451 - protein, 9 aa, Homo Sapiens
FEIQNELLV

SEQ ID NO: 1035452 - protein, 9 aa, Homo Sapiens
PPLEYVKGL

SEQ ID NO: 1035453 - protein, 9 aa, Homo Sapiens
EKLDQQFRK

SEQ ID NO: 1035454 - protein, 9 aa, Homo Sapiens
LISQAFYVQ

SEQ ID NO: 1035455 - protein, 9 aa, Homo Sapiens
TMTMDAGRA

SEQ ID NO: 1035456 - protein, 9 aa, Homo Sapiens
ISPDAASIV

SEQ ID NO: 1035457 - protein, 9 aa, Homo Sapiens
SCLKYCGDQ

SEQ ID NO: 1035458 - protein, 9 aa, Homo Sapiens
GILLQVEGM

SEQ ID NO: 1035459 - protein, 9 aa, Homo Sapiens
NVFEDYIYG

SEQ ID NO: 1035460 - protein, 9 aa, Homo Sapiens
AARTARRST

SEQ ID NO: 1035461 - protein, 9 aa, Homo Sapiens
IVLLGFRSP

SEQ ID NO: 1035462 - protein, 9 aa, Homo Sapiens
SLFHRMAPE

SEQ ID NO: 1035463 - protein, 9 aa, Homo Sapiens
IPLMFIIFC

SEQ ID NO: 1035464 - protein, 9 aa, Homo Sapiens
TFCLILPLP

SEQ ID NO: 1035465 - protein, 9 aa, Homo Sapiens
GERLFACEE

SEQ ID NO: 1035466 - protein, 9 aa, Homo Sapiens
KKMTIWVDP

SEQ ID NO: 1035467 - protein, 9 aa, Homo Sapiens
TNSWDGVVE

SEQ ID NO: 1035468 - protein, 9 aa, Homo Sapiens
ESTSVHDSP

SEQ ID NO: 1035469 - protein, 9 aa, Homo Sapiens
ESRFSAETV

SEQ ID NO: 1035470 - protein, 9 aa, Homo Sapiens
LLIHRHEKV

SEQ ID NO: 1035471 - protein, 9 aa, Homo Sapiens
EKKNMVDCS

SEQ ID NO: 1035472 - protein, 9 aa, Homo Sapiens
MCIKCSGIH

SEQ ID NO: 1035473 - protein, 9 aa, Homo Sapiens
EPFCPPPIT

SEQ ID NO: 1035474 - protein, 9 aa, Homo Sapiens
CSLDTLFSV

SEQ ID NO: 1035475 - protein, 9 aa, Homo Sapiens
IIDLGTKIY

SEQ ID NO: 1035476 - protein, 9 aa, Homo Sapiens
LQKMGFIIY

SEQ ID NO: 1035477 - protein, 9 aa, Homo Sapiens
RINEKAGDT

SEQ ID NO: 1035478 - protein, 9 aa, Homo Sapiens
VSAVTKEAA

SEQ ID NO: 1035479 - protein, 9 aa, Homo Sapiens
HCDKKFRIS

SEQ ID NO: 1035480 - protein, 9 aa, Homo Sapiens
FLCEALGCP

SEQ ID NO: 1035481 - protein, 9 aa, Homo Sapiens
ESFRSKSLG

SEQ ID NO: 1035482 - protein, 9 aa, Homo Sapiens
RYLIFSNPV

SEQ ID NO: 1035483 - protein, 9 aa, Homo Sapiens
FLQVHLSGA

SEQ ID NO: 1035484 - protein, 9 aa, Homo Sapiens
ILVTGLQSP

SEQ ID NO: 1035485 - protein, 9 aa, Homo Sapiens
HLFFVLFKS

SEQ ID NO: 1035486 - protein, 9 aa, Homo Sapiens
HSECVADTQ

SEQ ID NO: 1035487 - protein, 9 aa, Homo Sapiens
QLATCGHLV

SEQ ID NO: 1035488 - protein, 9 aa, Homo Sapiens
VQLGQTHKP

SEQ ID NO: 1035489 - protein, 9 aa, Homo Sapiens
NVGGGHFIG

SEQ ID NO: 1035490 - protein, 9 aa, Homo Sapiens
RQVEEKLLQ

SEQ ID NO: 1035491 - protein, 9 aa, Homo Sapiens
PWATVGMGK

SEQ ID NO: 1035492 - protein, 9 aa, Homo Sapiens
RGSKHQKIF

SEQ ID NO: 1035493 - protein, 9 aa, Homo Sapiens
KEQLLACQQ

SEQ ID NO: 1035494 - protein, 9 aa, Homo Sapiens
YTYIWWLNS

SEQ ID NO: 1035495 - protein, 9 aa, Homo Sapiens
YETITFKVP

SEQ ID NO: 1035496 - protein, 9 aa, Homo Sapiens
GEKGPKDKK

SEQ ID NO: 1035497 - protein, 9 aa, Homo Sapiens
AGYFTHMVG

SEQ ID NO: 1035498 - protein, 9 aa, Homo Sapiens
MEAAEIDCQ

SEQ ID NO: 1035499 - protein, 9 aa, Homo Sapiens
IGGIHDRQI

SEQ ID NO: 1035500 - protein, 9 aa, Homo Sapiens
NLLERRGRG

SEQ ID NO: 1035501 - protein, 9 aa, Homo Sapiens
NGKSFKKYM

SEQ ID NO: 1035502 - protein, 9 aa, Homo Sapiens
CLAKLLCKI

SEQ ID NO: 1035503 - protein, 9 aa, Homo Sapiens
SHYHHGYHP

SEQ ID NO: 1035504 - protein, 9 aa, Homo Sapiens
RILNKKLLP

SEQ ID NO: 1035505 - protein, 9 aa, Homo Sapiens
VKVKNVLDD

SEQ ID NO: 1035506 - protein, 9 aa, Homo Sapiens
LNSQSLPVS

SEQ ID NO: 1035507 - protein, 9 aa, Homo Sapiens
NARRVHEPA

SEQ ID NO: 1035508 - protein, 9 aa, Homo Sapiens
DKILQKLKC

SEQ ID NO: 1035509 - protein, 9 aa, Homo Sapiens
SSPSPKEKG

SEQ ID NO: 1035510 - protein, 9 aa, Homo Sapiens
LRAAGKTYI

SEQ ID NO: 1035511 - protein, 9 aa, Homo Sapiens
VMRKISSSN

SEQ ID NO: 1035512 - protein, 9 aa, Homo Sapiens
NWALNDHYG

SEQ ID NO: 1035513 - protein, 9 aa, Homo Sapiens
REDLIGMDS

SEQ ID NO: 1035514 - protein, 9 aa, Homo Sapiens
CELREGELI

SEQ ID NO: 1035515 - protein, 9 aa, Homo Sapiens
QMLAGDGMS

SEQ ID NO: 1035516 - protein, 9 aa, Homo Sapiens
ILQKLKCLS

SEQ ID NO: 1035517 - protein, 9 aa, Homo Sapiens
SQKTVQFSI

SEQ ID NO: 1035518 - protein, 9 aa, Homo Sapiens
KSSLQACNK

SEQ ID NO: 1035519 - protein, 9 aa, Homo Sapiens
LPRVQMEHK

SEQ ID NO: 1035520 - protein, 9 aa, Homo Sapiens
LGRVPGLCL

SEQ ID NO: 1035521 - protein, 9 aa, Homo Sapiens
IIQSEEQTS

SEQ ID NO: 1035522 - protein, 9 aa, Homo Sapiens
QQNFDVFAA

SEQ ID NO: 1035523 - protein, 9 aa, Homo Sapiens
SASLQERLR

SEQ ID NO: 1035524 - protein, 9 aa, Homo Sapiens
EKPLLEKFH

SEQ ID NO: 1035525 - protein, 9 aa, Homo Sapiens
SGRFFMLLF

SEQ ID NO: 1035526 - protein, 9 aa, Homo Sapiens
VLDKWTDKE

SEQ ID NO: 1035527 - protein, 9 aa, Homo Sapiens
SSSSHDEAL

SEQ ID NO: 1035528 - protein, 9 aa, Homo Sapiens
SLISKQWVV

SEQ ID NO: 1035529 - protein, 9 aa, Homo Sapiens
GTGSSSPPV

SEQ ID NO: 1035530 - protein, 9 aa, Homo Sapiens
CLILPLPDV

SEQ ID NO: 1035531 - protein, 9 aa, Homo Sapiens
TQKKFDRVT

SEQ ID NO: 1035532 - protein, 9 aa, Homo Sapiens
KPFVFVMKN

SEQ ID NO: 1035533 - protein, 9 aa, Homo Sapiens
GQESSIILR

SEQ ID NO: 1035534 - protein, 9 aa, Homo Sapiens
HLEEEGRFF

SEQ ID NO: 1035535 - protein, 9 aa, Homo Sapiens
KDVAQKLGS

SEQ ID NO: 1035536 - protein, 9 aa, Homo Sapiens
FLFALGCEN

SEQ ID NO: 1035537 - protein, 9 aa, Homo Sapiens
ALEESSKQA

SEQ ID NO: 1035538 - protein, 9 aa, Homo Sapiens
VWVVKGPKG

SEQ ID NO: 1035539 - protein, 9 aa, Homo Sapiens
KINFLRTLN

SEQ ID NO: 1035540 - protein, 9 aa, Homo Sapiens
NFTESIPSS

SEQ ID NO: 1035541 - protein, 9 aa, Homo Sapiens
RLPSEFFQF

SEQ ID NO: 1035542 - protein, 9 aa, Homo Sapiens
PATVESAVH

SEQ ID NO: 1035543 - protein, 9 aa, Homo Sapiens
FAHFCYQNL

SEQ ID NO: 1035544 - protein, 9 aa, Homo Sapiens
LEKDPKAIS

SEQ ID NO: 1035545 - protein, 9 aa, Homo Sapiens
PSILEMNET

SEQ ID NO: 1035546 - protein, 9 aa, Homo Sapiens
AEKLRQYKV

SEQ ID NO: 1035547 - protein, 9 aa, Homo Sapiens
ERYLGILLQ

SEQ ID NO: 1035548 - protein, 9 aa, Homo Sapiens
LFEKKLAGQ

SEQ ID NO: 1035549 - protein, 9 aa, Homo Sapiens
GHLSEEPSK

SEQ ID NO: 1035550 - protein, 9 aa, Homo Sapiens
YMFATLSSL

SEQ ID NO: 1035551 - protein, 9 aa, Homo Sapiens
RLVRAAQGI

SEQ ID NO: 1035552 - protein, 9 aa, Homo Sapiens
ISHRTVPML

SEQ ID NO: 1035553 - protein, 9 aa, Homo Sapiens
VPMPEKKSN

SEQ ID NO: 1035554 - protein, 9 aa, Homo Sapiens
YSLGGTREP

SEQ ID NO: 1035555 - protein, 9 aa, Homo Sapiens
LKPKNTIAM

SEQ ID NO: 1035556 - protein, 9 aa, Homo Sapiens
VSGVLQLLF

SEQ ID NO: 1035557 - protein, 9 aa, Homo Sapiens
LGCPVSLGV

SEQ ID NO: 1035558 - protein, 9 aa, Homo Sapiens
STCRQAMLT

SEQ ID NO: 1035559 - protein, 9 aa, Homo Sapiens
RLGGGLPNA

SEQ ID NO: 1035560 - protein, 9 aa, Homo Sapiens
DLEPSHHLS

SEQ ID NO: 1035561 - protein, 9 aa, Homo Sapiens
FSSLDKVHS

SEQ ID NO: 1035562 - protein, 9 aa, Homo Sapiens
CKTVRHSFP

SEQ ID NO: 1035563 - protein, 9 aa, Homo Sapiens
PERLLTRLC

SEQ ID NO: 1035564 - protein, 9 aa, Homo Sapiens
VQRVLPQSP

SEQ ID NO: 1035565 - protein, 9 aa, Homo Sapiens
TCIPSRLPP

SEQ ID NO: 1035566 - protein, 9 aa, Homo Sapiens
IMFMKKKLH

SEQ ID NO: 1035567 - protein, 9 aa, Homo Sapiens
SVCRERPAW

SEQ ID NO: 1035568 - protein, 9 aa, Homo Sapiens
QKLRRRKTI

SEQ ID NO: 1035569 - protein, 9 aa, Homo Sapiens
DLPGSCTFF

SEQ ID NO: 1035570 - protein, 9 aa, Homo Sapiens
YYYYRKPQV

SEQ ID NO: 1035571 - protein, 9 aa, Homo Sapiens
NMQMPQVPN

SEQ ID NO: 1035572 - protein, 9 aa, Homo Sapiens
LISLSVISV

SEQ ID NO: 1035573 - protein, 9 aa, Homo Sapiens
RVSSNFTGH

SEQ ID NO: 1035574 - protein, 9 aa, Homo Sapiens
SWVCFEWKP

SEQ ID NO: 1035575 - protein, 9 aa, Homo Sapiens
QVTFFLFYL

SEQ ID NO: 1035576 - protein, 9 aa, Homo Sapiens
CVLENSSSL

SEQ ID NO: 1035577 - protein, 9 aa, Homo Sapiens
EMRLYTVRW

SEQ ID NO: 1035578 - protein, 9 aa, Homo Sapiens
DSEAASAPG

SEQ ID NO: 1035579 - protein, 9 aa, Homo Sapiens
VTLRCDPIL

SEQ ID NO: 1035580 - protein, 9 aa, Homo Sapiens
KHHRLHAQK

SEQ ID NO: 1035581 - protein, 9 aa, Homo Sapiens
CLESGAFFL

SEQ ID NO: 1035582 - protein, 9 aa, Homo Sapiens
VEVENFLLV

SEQ ID NO: 1035583 - protein, 9 aa, Homo Sapiens
KSSPEKQLG

SEQ ID NO: 1035584 - protein, 9 aa, Homo Sapiens
TTFTLGAIF

SEQ ID NO: 1035585 - protein, 9 aa, Homo Sapiens
SMESDTGFF

SEQ ID NO: 1035586 - protein, 9 aa, Homo Sapiens
LDWKPWSKG

SEQ ID NO: 1035587 - protein, 9 aa, Homo Sapiens
SSDMKKFTE

SEQ ID NO: 1035588 - protein, 9 aa, Homo Sapiens
NVTFHVILS

SEQ ID NO: 1035589 - protein, 9 aa, Homo Sapiens
ELDDWLVEL

SEQ ID NO: 1035590 - protein, 9 aa, Homo Sapiens
PVIPLLESE

SEQ ID NO: 1035591 - protein, 9 aa, Homo Sapiens
QLKRNLHFP

SEQ ID NO: 1035592 - protein, 9 aa, Homo Sapiens
LTDKSLSSL

SEQ ID NO: 1035593 - protein, 9 aa, Homo Sapiens
WAQEEAPAQ

SEQ ID NO: 1035594 - protein, 9 aa, Homo Sapiens
LDKNDNVSE

SEQ ID NO: 1035595 - protein, 9 aa, Homo Sapiens
NDSWDTNDA

SEQ ID NO: 1035596 - protein, 9 aa, Homo Sapiens
EKFEKLLHQ

SEQ ID NO: 1035597 - protein, 9 aa, Homo Sapiens
EVEWTSCAE

SEQ ID NO: 1035598 - protein, 9 aa, Homo Sapiens
VAKNCGIAI

SEQ ID NO: 1035599 - protein, 9 aa, Homo Sapiens
QMVALGPTE

SEQ ID NO: 1035600 - protein, 9 aa, Homo Sapiens
QVFDWIEAN

SEQ ID NO: 1035601 - protein, 9 aa, Homo Sapiens
EKITGSPKH

SEQ ID NO: 1035602 - protein, 9 aa, Homo Sapiens
GSEQTLFMT

SEQ ID NO: 1035603 - protein, 9 aa, Homo Sapiens
PMTPAFAGT

SEQ ID NO: 1035604 - protein, 9 aa, Homo Sapiens
PYLKNGYNQ

SEQ ID NO: 1035605 - protein, 9 aa, Homo Sapiens
QVLMKERNV

SEQ ID NO: 1035606 - protein, 9 aa, Homo Sapiens
LPEFCAAFY

SEQ ID NO: 1035607 - protein, 9 aa, Homo Sapiens
RFRAKSLWR

SEQ ID NO: 1035608 - protein, 9 aa, Homo Sapiens
GSALREQKK

SEQ ID NO: 1035609 - protein, 9 aa, Homo Sapiens
REEWKTLPA

SEQ ID NO: 1035610 - protein, 9 aa, Homo Sapiens
SRSLMRTLS

SEQ ID NO: 1035611 - protein, 9 aa, Homo Sapiens
SSIIAPKRL

SEQ ID NO: 1035612 - protein, 9 aa, Homo Sapiens
SHAQGGHWL

SEQ ID NO: 1035613 - protein, 9 aa, Homo Sapiens
PCSSSPSSS

SEQ ID NO: 1035614 - protein, 9 aa, Homo Sapiens
RDYQSSLEN

SEQ ID NO: 1035615 - protein, 9 aa, Homo Sapiens
PAASQEATR

SEQ ID NO: 1035616 - protein, 9 aa, Homo Sapiens
MDNIKYRDN

SEQ ID NO: 1035617 - protein, 9 aa, Homo Sapiens
PGQFVNSKR

SEQ ID NO: 1035618 - protein, 9 aa, Homo Sapiens
KPAVGESKK

SEQ ID NO: 1035619 - protein, 9 aa, Homo Sapiens
GLKYDGPIE

SEQ ID NO: 1035620 - protein, 9 aa, Homo Sapiens
MKKRELKAS

SEQ ID NO: 1035621 - protein, 9 aa, Homo Sapiens
QEPERTPAL

SEQ ID NO: 1035622 - protein, 9 aa, Homo Sapiens
EVKDINDNT

SEQ ID NO: 1035623 - protein, 9 aa, Homo Sapiens
AQGGHWLAV

SEQ ID NO: 1035624 - protein, 9 aa, Homo Sapiens
LVDNKLYLS

SEQ ID NO: 1035625 - protein, 9 aa, Homo Sapiens
PLLESELLA

SEQ ID NO: 1035626 - protein, 9 aa, Homo Sapiens
LGTSQLPQH

SEQ ID NO: 1035627 - protein, 9 aa, Homo Sapiens
DLQRNLLER

SEQ ID NO: 1035628 - protein, 9 aa, Homo Sapiens
WGTVCNDSW

SEQ ID NO: 1035629 - protein, 9 aa, Homo Sapiens
SEKNQSSTP

SEQ ID NO: 1035630 - protein, 9 aa, Homo Sapiens
GLQRAARPP

SEQ ID NO: 1035631 - protein, 9 aa, Homo Sapiens
PVSTTVARG

SEQ ID NO: 1035632 - protein, 9 aa, Homo Sapiens
CPDGNLQSL

SEQ ID NO: 1035633 - protein, 9 aa, Homo Sapiens
ESSIILRDG

SEQ ID NO: 1035634 - protein, 9 aa, Homo Sapiens
EYKYQLTVR

SEQ ID NO: 1035635 - protein, 9 aa, Homo Sapiens
HLQPCRLGG

SEQ ID NO: 1035636 - protein, 9 aa, Homo Sapiens
LSSDGAPLS

SEQ ID NO: 1035637 - protein, 9 aa, Homo Sapiens
SLQGNTVRN

SEQ ID NO: 1035638 - protein, 9 aa, Homo Sapiens
PNHRWTQTL

SEQ ID NO: 1035639 - protein, 9 aa, Homo Sapiens
SMGPMTPAF

SEQ ID NO: 1035640 - protein, 9 aa, Homo Sapiens
DNPLNARVA

SEQ ID NO: 1035641 - protein, 9 aa, Homo Sapiens
SGLPSETEL

SEQ ID NO: 1035642 - protein, 9 aa, Homo Sapiens
LSSEAVLLD

SEQ ID NO: 1035643 - protein, 9 aa, Homo Sapiens
ALSEGWSAL

SEQ ID NO: 1035644 - protein, 9 aa, Homo Sapiens
FMPRVLSKR

SEQ ID NO: 1035645 - protein, 9 aa, Homo Sapiens
PKKLSIKYM

SEQ ID NO: 1035646 - protein, 9 aa, Homo Sapiens
NKADYRKDL

SEQ ID NO: 1035647 - protein, 9 aa, Homo Sapiens
EIFVKRQML

SEQ ID NO: 1035648 - protein, 9 aa, Homo Sapiens
GSRLDPAGY

SEQ ID NO: 1035649 - protein, 9 aa, Homo Sapiens
AFSLLTSLS

SEQ ID NO: 1035650 - protein, 9 aa, Homo Sapiens
DAIDGFFND

SEQ ID NO: 1035651 - protein, 9 aa, Homo Sapiens
TLVAPKEPK

SEQ ID NO: 1035652 - protein, 9 aa, Homo Sapiens
FWNQRWLGK

SEQ ID NO: 1035653 - protein, 9 aa, Homo Sapiens
MYFLCFCAS

SEQ ID NO: 1035654 - protein, 9 aa, Homo Sapiens
VSARDDGVP

SEQ ID NO: 1035655 - protein, 9 aa, Homo Sapiens
WRTSELPLR

SEQ ID NO: 1035656 - protein, 9 aa, Homo Sapiens
LHHGVCQKN

SEQ ID NO: 1035657 - protein, 9 aa, Homo Sapiens
LTRDCLSQN

SEQ ID NO: 1035658 - protein, 9 aa, Homo Sapiens
EMSADVVCI

SEQ ID NO: 1035659 - protein, 9 aa, Homo Sapiens
GAFRQGLIW

SEQ ID NO: 1035660 - protein, 9 aa, Homo Sapiens
RCPNKVAQL

SEQ ID NO: 1035661 - protein, 9 aa, Homo Sapiens
DFAHFWNQR

SEQ ID NO: 1035662 - protein, 9 aa, Homo Sapiens
SLLVPIQQE

SEQ ID NO: 1035663 - protein, 9 aa, Homo Sapiens
QNEDIKPFS

SEQ ID NO: 1035664 - protein, 9 aa, Homo Sapiens
LFVTLSYVF

SEQ ID NO: 1035665 - protein, 9 aa, Homo Sapiens
TCVCQRGMF

SEQ ID NO: 1035666 - protein, 9 aa, Homo Sapiens
LYLLFACML

SEQ ID NO: 1035667 - protein, 9 aa, Homo Sapiens
QGKVISVIA

SEQ ID NO: 1035668 - protein, 9 aa, Homo Sapiens
AGKMNHRDL

SEQ ID NO: 1035669 - protein, 9 aa, Homo Sapiens
LESVLQPLA

SEQ ID NO: 1035670 - protein, 9 aa, Homo Sapiens
RRLGALTGH

SEQ ID NO: 1035671 - protein, 9 aa, Homo Sapiens
DCTEKHSTM

SEQ ID NO: 1035672 - protein, 9 aa, Homo Sapiens
LQGKFYGNP

SEQ ID NO: 1035673 - protein, 9 aa, Homo Sapiens
SSEIFHSSH

SEQ ID NO: 1035674 - protein, 9 aa, Homo Sapiens
VANLFVAGT

SEQ ID NO: 1035675 - protein, 9 aa, Homo Sapiens
QKFSKCSIL

SEQ ID NO: 1035676 - protein, 9 aa, Homo Sapiens
YTALISVFG

SEQ ID NO: 1035677 - protein, 9 aa, Homo Sapiens
PPVKKNEMK

SEQ ID NO: 1035678 - protein, 9 aa, Homo Sapiens
LLSLECTVE

SEQ ID NO: 1035679 - protein, 9 aa, Homo Sapiens
TPPVPVFDF

SEQ ID NO: 1035680 - protein, 9 aa, Homo Sapiens
CPSLSAPKG

SEQ ID NO: 1035681 - protein, 9 aa, Homo Sapiens
QCERLIKSK

SEQ ID NO: 1035682 - protein, 9 aa, Homo Sapiens
SGFTALPAV

SEQ ID NO: 1035683 - protein, 9 aa, Homo Sapiens
KRANPPITH

SEQ ID NO: 1035684 - protein, 9 aa, Homo Sapiens
YRNFASCME

SEQ ID NO: 1035685 - protein, 9 aa, Homo Sapiens
KVVLMGTKD

SEQ ID NO: 1035686 - protein, 9 aa, Homo Sapiens
FTILDASGH

SEQ ID NO: 1035687 - protein, 9 aa, Homo Sapiens
SMLCVVSDI

SEQ ID NO: 1035688 - protein, 9 aa, Homo Sapiens
ISNICGEKK

SEQ ID NO: 1035689 - protein, 9 aa, Homo Sapiens
ELGPGQGLV

SEQ ID NO: 1035690 - protein, 9 aa, Homo Sapiens
SAFSLLTSL

SEQ ID NO: 1035691 - protein, 9 aa, Homo Sapiens
VNICKQEIN

SEQ ID NO: 1035692 - protein, 9 aa, Homo Sapiens
FCNGTFNQY

SEQ ID NO: 1035693 - protein, 9 aa, Homo Sapiens
FQRSRDESA

SEQ ID NO: 1035694 - protein, 9 aa, Homo Sapiens
AVMKFIWST

SEQ ID NO: 1035695 - protein, 9 aa, Homo Sapiens
ISRIDRHRV

SEQ ID NO: 1035696 - protein, 9 aa, Homo Sapiens
SPPPARKAL

SEQ ID NO: 1035697 - protein, 9 aa, Homo Sapiens
KINFFNGIW

SEQ ID NO: 1035698 - protein, 9 aa, Homo Sapiens
RQGLIWVLA

SEQ ID NO: 1035699 - protein, 9 aa, Homo Sapiens
SQRLEEMGL

SEQ ID NO: 1035700 - protein, 9 aa, Homo Sapiens
IKQGDFKRH

SEQ ID NO: 1035701 - protein, 9 aa, Homo Sapiens
LQMVFIYVF

SEQ ID NO: 1035702 - protein, 9 aa, Homo Sapiens
HSNSHVFFS

SEQ ID NO: 1035703 - protein, 9 aa, Homo Sapiens
KIQLFKIGP

SEQ ID NO: 1035704 - protein, 9 aa, Homo Sapiens
ASKITLDGI

SEQ ID NO: 1035705 - protein, 9 aa, Homo Sapiens
EKLLLQINL

SEQ ID NO: 1035706 - protein, 9 aa, Homo Sapiens
SFDDHLSSN

SEQ ID NO: 1035707 - protein, 9 aa, Homo Sapiens
FQVAVNEKH

SEQ ID NO: 1035708 - protein, 9 aa, Homo Sapiens
HLSFFLYRS

SEQ ID NO: 1035709 - protein, 9 aa, Homo Sapiens
NTPVFPMAV

SEQ ID NO: 1035710 - protein, 9 aa, Homo Sapiens
GVKLPLVLI

SEQ ID NO: 1035711 - protein, 9 aa, Homo Sapiens
LHLKPLNCT

SEQ ID NO: 1035712 - protein, 9 aa, Homo Sapiens
RNNILFGKE

SEQ ID NO: 1035713 - protein, 9 aa, Homo Sapiens
NFFFLEVSF

SEQ ID NO: 1035714 - protein, 9 aa, Homo Sapiens
QGLADVPGQ

SEQ ID NO: 1035715 - protein, 9 aa, Homo Sapiens
MSVSVQFRQ

SEQ ID NO: 1035716 - protein, 9 aa, Homo Sapiens
MLVATTMFI

SEQ ID NO: 1035717 - protein, 9 aa, Homo Sapiens
SYCKGNVIP

SEQ ID NO: 1035718 - protein, 9 aa, Homo Sapiens
NGPVSICLK

SEQ ID NO: 1035719 - protein, 9 aa, Homo Sapiens
ETQQVLMKE

SEQ ID NO: 1035720 - protein, 9 aa, Homo Sapiens
LQIKDFLEE

SEQ ID NO: 1035721 - protein, 9 aa, Homo Sapiens
DWKPWSKGP

SEQ ID NO: 1035722 - protein, 9 aa, Homo Sapiens
ARHLSFFLY

SEQ ID NO: 1035723 - protein, 9 aa, Homo Sapiens
VVLDLLFVT

SEQ ID NO: 1035724 - protein, 9 aa, Homo Sapiens
ALCKHCHKK

SEQ ID NO: 1035725 - protein, 9 aa, Homo Sapiens
TLFVAGCRK

SEQ ID NO: 1035726 - protein, 9 aa, Homo Sapiens
RGAMGIVLV

SEQ ID NO: 1035727 - protein, 9 aa, Homo Sapiens
AFFVADKVI

SEQ ID NO: 1035728 - protein, 9 aa, Homo Sapiens
QMAQNQTTP

SEQ ID NO: 1035729 - protein, 9 aa, Homo Sapiens
GVSHSQKFS

SEQ ID NO: 1035730 - protein, 9 aa, Homo Sapiens
GKIRTKGKL

SEQ ID NO: 1035731 - protein, 9 aa, Homo Sapiens
WAQMSVFHQ

SEQ ID NO: 1035732 - protein, 9 aa, Homo Sapiens
DLDPSVLPY

SEQ ID NO: 1035733 - protein, 9 aa, Homo Sapiens
VEKMTSKGK

SEQ ID NO: 1035734 - protein, 9 aa, Homo Sapiens
KQWVVSAGH

SEQ ID NO: 1035735 - protein, 9 aa, Homo Sapiens
YPLTQESYR

SEQ ID NO: 1035736 - protein, 9 aa, Homo Sapiens
AYIGGIHDR

SEQ ID NO: 1035737 - protein, 9 aa, Homo Sapiens
NGEVGSLLA

SEQ ID NO: 1035738 - protein, 9 aa, Homo Sapiens
SLPAAADHS

SEQ ID NO: 1035739 - protein, 9 aa, Homo Sapiens
FKEALEPSG

SEQ ID NO: 1035740 - protein, 9 aa, Homo Sapiens
AAHGDEVSY

SEQ ID NO: 1035741 - protein, 9 aa, Homo Sapiens
SAAEKHKAF

SEQ ID NO: 1035742 - protein, 9 aa, Homo Sapiens
GPQGPKGDS

SEQ ID NO: 1035743 - protein, 9 aa, Homo Sapiens
LRNISRQID

SEQ ID NO: 1035744 - protein, 9 aa, Homo Sapiens
AKCIWTLTS

SEQ ID NO: 1035745 - protein, 9 aa, Homo Sapiens
SEENMDLHT

SEQ ID NO: 1035746 - protein, 9 aa, Homo Sapiens
LYERVLHIR

SEQ ID NO: 1035747 - protein, 9 aa, Homo Sapiens
CDPILSHAT

SEQ ID NO: 1035748 - protein, 9 aa, Homo Sapiens
LSTEEIFNH

SEQ ID NO: 1035749 - protein, 9 aa, Homo Sapiens
MLLQQNFDV

SEQ ID NO: 1035750 - protein, 9 aa, Homo Sapiens
DGSFEIENL

SEQ ID NO: 1035751 - protein, 9 aa, Homo Sapiens
LDEINIIGD

SEQ ID NO: 1035752 - protein, 9 aa, Homo Sapiens
HFCDITICV

SEQ ID NO: 1035753 - protein, 9 aa, Homo Sapiens
SSPPRPYHQ

SEQ ID NO: 1035754 - protein, 9 aa, Homo Sapiens
KMEVEWTSC

SEQ ID NO: 1035755 - protein, 9 aa, Homo Sapiens
GYKKPGIAR

SEQ ID NO: 1035756 - protein, 9 aa, Homo Sapiens
RSWGYVLLN

SEQ ID NO: 1035757 - protein, 9 aa, Homo Sapiens
VISKEEQER

SEQ ID NO: 1035758 - protein, 9 aa, Homo Sapiens
QHYHGMCLN

SEQ ID NO: 1035759 - protein, 9 aa, Homo Sapiens
DVTCNIKNS

SEQ ID NO: 1035760 - protein, 9 aa, Homo Sapiens
LGFRSPLSD

SEQ ID NO: 1035761 - protein, 9 aa, Homo Sapiens
RNYKLREDA

SEQ ID NO: 1035762 - protein, 9 aa, Homo Sapiens
YLCLRYPLS

SEQ ID NO: 1035763 - protein, 9 aa, Homo Sapiens
ADSDLKDAK

SEQ ID NO: 1035764 - protein, 9 aa, Homo Sapiens
VDPNNETLF

SEQ ID NO: 1035765 - protein, 9 aa, Homo Sapiens
GRVLTRDCL

SEQ ID NO: 1035766 - protein, 9 aa, Homo Sapiens
EGELEQLDL

SEQ ID NO: 1035767 - protein, 9 aa, Homo Sapiens
SDGAPLSHP

SEQ ID NO: 1035768 - protein, 9 aa, Homo Sapiens
KSADPSPGA

SEQ ID NO: 1035769 - protein, 9 aa, Homo Sapiens
LKESDNGVV

SEQ ID NO: 1035770 - protein, 9 aa, Homo Sapiens
SEESYECSC

SEQ ID NO: 1035771 - protein, 9 aa, Homo Sapiens
FRQSWKDKR

SEQ ID NO: 1035772 - protein, 9 aa, Homo Sapiens
PLAPPGPPE

SEQ ID NO: 1035773 - protein, 9 aa, Homo Sapiens
GKEFSSSTG

SEQ ID NO: 1035774 - protein, 9 aa, Homo Sapiens
LEAMKKDLA

SEQ ID NO: 1035775 - protein, 9 aa, Homo Sapiens
GPKESGACL

SEQ ID NO: 1035776 - protein, 9 aa, Homo Sapiens
PNFYQPGPD

SEQ ID NO: 1035777 - protein, 9 aa, Homo Sapiens
LLQHDQIYT

SEQ ID NO: 1035778 - protein, 9 aa, Homo Sapiens
LQISMYYFL

SEQ ID NO: 1035779 - protein, 9 aa, Homo Sapiens
LESDYQRSA

SEQ ID NO: 1035780 - protein, 9 aa, Homo Sapiens
KCKRHRSRS

SEQ ID NO: 1035781 - protein, 9 aa, Homo Sapiens
TSDGLMDGL

SEQ ID NO: 1035782 - protein, 9 aa, Homo Sapiens
CLKFKKGPF

SEQ ID NO: 1035783 - protein, 9 aa, Homo Sapiens
DPISGKIRT

SEQ ID NO: 1035784 - protein, 9 aa, Homo Sapiens
TSRQQKLVI

SEQ ID NO: 1035785 - protein, 9 aa, Homo Sapiens
IFSSLDKVH

SEQ ID NO: 1035786 - protein, 9 aa, Homo Sapiens
PGSCTFFWP

SEQ ID NO: 1035787 - protein, 9 aa, Homo Sapiens
PACCLAKLL

SEQ ID NO: 1035788 - protein, 9 aa, Homo Sapiens
LTIISYLNL

SEQ ID NO: 1035789 - protein, 9 aa, Homo Sapiens
RVQMEHKGE

SEQ ID NO: 1035790 - protein, 9 aa, Homo Sapiens
KILIFIIVG

SEQ ID NO: 1035791 - protein, 9 aa, Homo Sapiens
LAGEGSDQK

SEQ ID NO: 1035792 - protein, 9 aa, Homo Sapiens
ALVMLFFGA

SEQ ID NO: 1035793 - protein, 9 aa, Homo Sapiens
TIYGRVIVC

SEQ ID NO: 1035794 - protein, 9 aa, Homo Sapiens
LREDARDPR

SEQ ID NO: 1035795 - protein, 9 aa, Homo Sapiens
VMDKKNQEL

SEQ ID NO: 1035796 - protein, 9 aa, Homo Sapiens
ELQAAFEEC

SEQ ID NO: 1035797 - protein, 9 aa, Homo Sapiens
EGPKSRGGP

SEQ ID NO: 1035798 - protein, 9 aa, Homo Sapiens
LIFSLRNPI

SEQ ID NO: 1035799 - protein, 9 aa, Homo Sapiens
DGLLTGHKG

SEQ ID NO: 1035800 - protein, 9 aa, Homo Sapiens
LKKTKALIE

SEQ ID NO: 1035801 - protein, 9 aa, Homo Sapiens
QMNLHPVPE

SEQ ID NO: 1035802 - protein, 9 aa, Homo Sapiens
AECLKFKKG

SEQ ID NO: 1035803 - protein, 9 aa, Homo Sapiens
QSQCLQSRN

SEQ ID NO: 1035804 - protein, 9 aa, Homo Sapiens
PCRLGGGLP

SEQ ID NO: 1035805 - protein, 9 aa, Homo Sapiens
FPDGRFLPK

SEQ ID NO: 1035806 - protein, 9 aa, Homo Sapiens
ENIFSSPRE

SEQ ID NO: 1035807 - protein, 9 aa, Homo Sapiens
GADYFLRAV

SEQ ID NO: 1035808 - protein, 9 aa, Homo Sapiens
PYTYPDTPI

SEQ ID NO: 1035809 - protein, 9 aa, Homo Sapiens
ILQLEKCCT

SEQ ID NO: 1035810 - protein, 9 aa, Homo Sapiens
QELRGWADE

SEQ ID NO: 1035811 - protein, 9 aa, Homo Sapiens
ELPGERGNG

SEQ ID NO: 1035812 - protein, 9 aa, Homo Sapiens
RRVHTEENP

SEQ ID NO: 1035813 - protein, 9 aa, Homo Sapiens
ELLIRKLPY

SEQ ID NO: 1035814 - protein, 9 aa, Homo Sapiens
GSDQKSPAK

SEQ ID NO: 1035815 - protein, 9 aa, Homo Sapiens
VSTAWVDNT

SEQ ID NO: 1035816 - protein, 9 aa, Homo Sapiens
EPGAHLEKK

SEQ ID NO: 1035817 - protein, 9 aa, Homo Sapiens
KEQFECQEL

SEQ ID NO: 1035818 - protein, 9 aa, Homo Sapiens
SCFYGRVLL

SEQ ID NO: 1035819 - protein, 9 aa, Homo Sapiens
IIETSEDIE

SEQ ID NO: 1035820 - protein, 9 aa, Homo Sapiens
FCLRLSSMF

SEQ ID NO: 1035821 - protein, 9 aa, Homo Sapiens
IYTGEKPYE

SEQ ID NO: 1035822 - protein, 9 aa, Homo Sapiens
QYLEAMKKD

SEQ ID NO: 1035823 - protein, 9 aa, Homo Sapiens
LLVPIQQEW

SEQ ID NO: 1035824 - protein, 9 aa, Homo Sapiens
VGNGFHVGQ

SEQ ID NO: 1035825 - protein, 9 aa, Homo Sapiens
GDIITIQTE

SEQ ID NO: 1035826 - protein, 9 aa, Homo Sapiens
STVSVTGRS

SEQ ID NO: 1035827 - protein, 9 aa, Homo Sapiens
RSLELDDWL

SEQ ID NO: 1035828 - protein, 9 aa, Homo Sapiens
CFCASLLRF

SEQ ID NO: 1035829 - protein, 9 aa, Homo Sapiens
LRKPVTIDC

SEQ ID NO: 1035830 - protein, 9 aa, Homo Sapiens
RSCTGRWPR

SEQ ID NO: 1035831 - protein, 9 aa, Homo Sapiens
LMVGLNAAG

SEQ ID NO: 1035832 - protein, 9 aa, Homo Sapiens
LNTSENNSE

SEQ ID NO: 1035833 - protein, 9 aa, Homo Sapiens
STGGGGYVQ

SEQ ID NO: 1035834 - protein, 9 aa, Homo Sapiens
PSPEPPSSP

SEQ ID NO: 1035835 - protein, 9 aa, Homo Sapiens
QFCVSRNLH

SEQ ID NO: 1035836 - protein, 9 aa, Homo Sapiens
CTIKNSLLK

SEQ ID NO: 1035837 - protein, 9 aa, Homo Sapiens
KTVQFSIPQ

SEQ ID NO: 1035838 - protein, 9 aa, Homo Sapiens
DHLNGLLQE

SEQ ID NO: 1035839 - protein, 9 aa, Homo Sapiens
LEEATQPHK

SEQ ID NO: 1035840 - protein, 9 aa, Homo Sapiens
CTDTYNTKI

SEQ ID NO: 1035841 - protein, 9 aa, Homo Sapiens
AKKNREFFN

SEQ ID NO: 1035842 - protein, 9 aa, Homo Sapiens
ASLWKPPPG

SEQ ID NO: 1035843 - protein, 9 aa, Homo Sapiens
CMMSSHIKK

SEQ ID NO: 1035844 - protein, 9 aa, Homo Sapiens
DRRQQGQEK

SEQ ID NO: 1035845 - protein, 9 aa, Homo Sapiens
MSAISVHGE

SEQ ID NO: 1035846 - protein, 9 aa, Homo Sapiens
LQEAGYFTH

SEQ ID NO: 1035847 - protein, 9 aa, Homo Sapiens
QIATMLKKI

SEQ ID NO: 1035848 - protein, 9 aa, Homo Sapiens
LAVRRARVV

SEQ ID NO: 1035849 - protein, 9 aa, Homo Sapiens
AGSKTAGPL

SEQ ID NO: 1035850 - protein, 9 aa, Homo Sapiens
VQWFLSSQP

SEQ ID NO: 1035851 - protein, 9 aa, Homo Sapiens
VHSGERLFA

SEQ ID NO: 1035852 - protein, 9 aa, Homo Sapiens
RGSWGTVCN

SEQ ID NO: 1035853 - protein, 9 aa, Homo Sapiens
DKRLKFKGP

SEQ ID NO: 1035854 - protein, 9 aa, Homo Sapiens
CFLLILLFY

SEQ ID NO: 1035855 - protein, 9 aa, Homo Sapiens
QGLVLLRDL

SEQ ID NO: 1035856 - protein, 9 aa, Homo Sapiens
HHGQERRFT

SEQ ID NO: 1035857 - protein, 9 aa, Homo Sapiens
FRKRCEELR

SEQ ID NO: 1035858 - protein, 9 aa, Homo Sapiens
SFSLSASLQ

SEQ ID NO: 1035859 - protein, 9 aa, Homo Sapiens
VEGFYAPRR

SEQ ID NO: 1035860 - protein, 9 aa, Homo Sapiens
LKSLFCELR

SEQ ID NO: 1035861 - protein, 9 aa, Homo Sapiens
LFAILKKKF

SEQ ID NO: 1035862 - protein, 9 aa, Homo Sapiens
NVTFLGKGG

SEQ ID NO: 1035863 - protein, 9 aa, Homo Sapiens
LDKALDQEE

SEQ ID NO: 1035864 - protein, 9 aa, Homo Sapiens
GTLLLSLES

SEQ ID NO: 1035865 - protein, 9 aa, Homo Sapiens
LLERRGRGR

SEQ ID NO: 1035866 - protein, 9 aa, Homo Sapiens
IKGSGLKHV

SEQ ID NO: 1035867 - protein, 9 aa, Homo Sapiens
APDPAGPEA

SEQ ID NO: 1035868 - protein, 9 aa, Homo Sapiens
FRVSSNFTG

SEQ ID NO: 1035869 - protein, 9 aa, Homo Sapiens
AEPYETITF

SEQ ID NO: 1035870 - protein, 9 aa, Homo Sapiens
PRPYHQEPY

SEQ ID NO: 1035871 - protein, 9 aa, Homo Sapiens
FHCIAEVEN

SEQ ID NO: 1035872 - protein, 9 aa, Homo Sapiens
AFPAFTMSW

SEQ ID NO: 1035873 - protein, 9 aa, Homo Sapiens
SPKKNRASP

SEQ ID NO: 1035874 - protein, 9 aa, Homo Sapiens
GANAFEIIL

SEQ ID NO: 1035875 - protein, 9 aa, Homo Sapiens
GHRGLGQYR

SEQ ID NO: 1035876 - protein, 9 aa, Homo Sapiens
NHLYNTNDI

SEQ ID NO: 1035877 - protein, 9 aa, Homo Sapiens
RPSILEMNE

SEQ ID NO: 1035878 - protein, 9 aa, Homo Sapiens
KQQEIHYKE

SEQ ID NO: 1035879 - protein, 9 aa, Homo Sapiens
SRLAQALLE

SEQ ID NO: 1035880 - protein, 9 aa, Homo Sapiens
FAKDVLDKW

SEQ ID NO: 1035881 - protein, 9 aa, Homo Sapiens
FHEDVTLEN

SEQ ID NO: 1035882 - protein, 9 aa, Homo Sapiens
FATLSSLQG

SEQ ID NO: 1035883 - protein, 9 aa, Homo Sapiens
VRPLGEKGP

SEQ ID NO: 1035884 - protein, 9 aa, Homo Sapiens
KSRVFEPVL

SEQ ID NO: 1035885 - protein, 9 aa, Homo Sapiens
LPQKKTTSS

SEQ ID NO: 1035886 - protein, 9 aa, Homo Sapiens
PAGPEAGDN

SEQ ID NO: 1035887 - protein, 9 aa, Homo Sapiens
CLSDPGLKP

SEQ ID NO: 1035888 - protein, 9 aa, Homo Sapiens
QLLDENETT

SEQ ID NO: 1035889 - protein, 9 aa, Homo Sapiens
RLLQHLQRV

SEQ ID NO: 1035890 - protein, 9 aa, Homo Sapiens
YNISNEVVF

SEQ ID NO: 1035891 - protein, 9 aa, Homo Sapiens
GIFTPVSND

SEQ ID NO: 1035892 - protein, 9 aa, Homo Sapiens
EKMSKRSLG

SEQ ID NO: 1035893 - protein, 9 aa, Homo Sapiens
FLKKMSLTT

SEQ ID NO: 1035894 - protein, 9 aa, Homo Sapiens
LEPSHHLSA

SEQ ID NO: 1035895 - protein, 9 aa, Homo Sapiens
PYEDLKTKI

SEQ ID NO: 1035896 - protein, 9 aa, Homo Sapiens
DSSSDMKKF

SEQ ID NO: 1035897 - protein, 9 aa, Homo Sapiens
LPLQAAPVP

SEQ ID NO: 1035898 - protein, 9 aa, Homo Sapiens
RRGAFWSYQ

SEQ ID NO: 1035899 - protein, 9 aa, Homo Sapiens
LPFMLCVTM

SEQ ID NO: 1035900 - protein, 9 aa, Homo Sapiens
LPNPGYPGG

SEQ ID NO: 1035901 - protein, 9 aa, Homo Sapiens
IALCRKDLS

SEQ ID NO: 1035902 - protein, 9 aa, Homo Sapiens
EAPYILEVS

SEQ ID NO: 1035903 - protein, 9 aa, Homo Sapiens
TPEAPENFP

SEQ ID NO: 1035904 - protein, 9 aa, Homo Sapiens
RNKDVKDSI

SEQ ID NO: 1035905 - protein, 9 aa, Homo Sapiens
STVEGLQAS

SEQ ID NO: 1035906 - protein, 9 aa, Homo Sapiens
FQNWDCNVR

SEQ ID NO: 1035907 - protein, 9 aa, Homo Sapiens
FMDCGSDGK

SEQ ID NO: 1035908 - protein, 9 aa, Homo Sapiens
SCVFIYLRP

SEQ ID NO: 1035909 - protein, 9 aa, Homo Sapiens
SAVTKEAAL

SEQ ID NO: 1035910 - protein, 9 aa, Homo Sapiens
KDFFTSKKK

SEQ ID NO: 1035911 - protein, 9 aa, Homo Sapiens
RNFFFLEVS

SEQ ID NO: 1035912 - protein, 9 aa, Homo Sapiens
YNEKFVSVT

SEQ ID NO: 1035913 - protein, 9 aa, Homo Sapiens
RNRVCIAET

SEQ ID NO: 1035914 - protein, 9 aa, Homo Sapiens
QKPMSLLSL

SEQ ID NO: 1035915 - protein, 9 aa, Homo Sapiens
GVATLERPM

SEQ ID NO: 1035916 - protein, 9 aa, Homo Sapiens
NEDDQDSLL

SEQ ID NO: 1035917 - protein, 9 aa, Homo Sapiens
IPKCYVNIC

SEQ ID NO: 1035918 - protein, 9 aa, Homo Sapiens
APPDLQPPA

SEQ ID NO: 1035919 - protein, 9 aa, Homo Sapiens
EVSWGDFEY

SEQ ID NO: 1035920 - protein, 9 aa, Homo Sapiens
IAPSLFGGL

SEQ ID NO: 1035921 - protein, 9 aa, Homo Sapiens
VCKQLECPF

SEQ ID NO: 1035922 - protein, 9 aa, Homo Sapiens
SHPFSINVF

SEQ ID NO: 1035923 - protein, 9 aa, Homo Sapiens
FFDEKNFDD

SEQ ID NO: 1035924 - protein, 9 aa, Homo Sapiens
NGADFMESF

SEQ ID NO: 1035925 - protein, 9 aa, Homo Sapiens
TRLEKFQNW

SEQ ID NO: 1035926 - protein, 9 aa, Homo Sapiens
GSSAHYGGP

SEQ ID NO: 1035927 - protein, 9 aa, Homo Sapiens
ERFRGFRYS

SEQ ID NO: 1035928 - protein, 9 aa, Homo Sapiens
RNTFQHSVV

SEQ ID NO: 1035929 - protein, 9 aa, Homo Sapiens
IQVGDSHFS

SEQ ID NO: 1035930 - protein, 9 aa, Homo Sapiens
PFPAQLGAP

SEQ ID NO: 1035931 - protein, 9 aa, Homo Sapiens
RHKKIYTGE

SEQ ID NO: 1035932 - protein, 9 aa, Homo Sapiens
EKNQCLNCP

SEQ ID NO: 1035933 - protein, 9 aa, Homo Sapiens
QNGPSPKFQ

SEQ ID NO: 1035934 - protein, 9 aa, Homo Sapiens
CTFFWPMSP

SEQ ID NO: 1035935 - protein, 9 aa, Homo Sapiens
GYLLFLFLF

SEQ ID NO: 1035936 - protein, 9 aa, Homo Sapiens
DRGTTFTLG

SEQ ID NO: 1035937 - protein, 9 aa, Homo Sapiens
RKQVGNGFH

SEQ ID NO: 1035938 - protein, 9 aa, Homo Sapiens
MVGILLFFD

SEQ ID NO: 1035939 - protein, 9 aa, Homo Sapiens
SEKVSEAWL

SEQ ID NO: 1035940 - protein, 9 aa, Homo Sapiens
SVTLSTCRE

SEQ ID NO: 1035941 - protein, 9 aa, Homo Sapiens
TQLPFDDSY

SEQ ID NO: 1035942 - protein, 9 aa, Homo Sapiens
EAQYIMKES

SEQ ID NO: 1035943 - protein, 9 aa, Homo Sapiens
AHGDEVSYV

SEQ ID NO: 1035944 - protein, 9 aa, Homo Sapiens
SSAKKVTQL

SEQ ID NO: 1035945 - protein, 9 aa, Homo Sapiens
QVQFSRTTS

SEQ ID NO: 1035946 - protein, 9 aa, Homo Sapiens
PEKMEFHLI

SEQ ID NO: 1035947 - protein, 9 aa, Homo Sapiens
VAQKLGSTT

SEQ ID NO: 1035948 - protein, 9 aa, Homo Sapiens
PVSICLKAG

SEQ ID NO: 1035949 - protein, 9 aa, Homo Sapiens
GEEEALQSL

SEQ ID NO: 1035950 - protein, 9 aa, Homo Sapiens
DLGCYLSPV

SEQ ID NO: 1035951 - protein, 9 aa, Homo Sapiens
LEAFRSQLG

SEQ ID NO: 1035952 - protein, 9 aa, Homo Sapiens
QMPDSQRRR

SEQ ID NO: 1035953 - protein, 9 aa, Homo Sapiens
FSIFQGKIK

SEQ ID NO: 1035954 - protein, 9 aa, Homo Sapiens
GTAGSWGVF

SEQ ID NO: 1035955 - protein, 9 aa, Homo Sapiens
SQPSPYQVI

SEQ ID NO: 1035956 - protein, 9 aa, Homo Sapiens
IIDHISCEL

SEQ ID NO: 1035957 - protein, 9 aa, Homo Sapiens
VPASLWKPP

SEQ ID NO: 1035958 - protein, 9 aa, Homo Sapiens
IIQVTFFLF

SEQ ID NO: 1035959 - protein, 9 aa, Homo Sapiens
EQREQKKEQ

SEQ ID NO: 1035960 - protein, 9 aa, Homo Sapiens
LAVMSLDCY

SEQ ID NO: 1035961 - protein, 9 aa, Homo Sapiens
GEVNSQFST

SEQ ID NO: 1035962 - protein, 9 aa, Homo Sapiens
WQKVNLIFE

SEQ ID NO: 1035963 - protein, 9 aa, Homo Sapiens
IDQMLDRNC

SEQ ID NO: 1035964 - protein, 9 aa, Homo Sapiens
KASGIFTPV

SEQ ID NO: 1035965 - protein, 9 aa, Homo Sapiens
IIWSISLAN

SEQ ID NO: 1035966 - protein, 9 aa, Homo Sapiens
QDDIATEAY

SEQ ID NO: 1035967 - protein, 9 aa, Homo Sapiens
FCVAGGWAG

SEQ ID NO: 1035968 - protein, 9 aa, Homo Sapiens
FLEEVIPYL

SEQ ID NO: 1035969 - protein, 9 aa, Homo Sapiens
KELQRSVKF

SEQ ID NO: 1035970 - protein, 9 aa, Homo Sapiens
LWSKTSSLF

SEQ ID NO: 1035971 - protein, 9 aa, Homo Sapiens
KRYAAYFAQ

SEQ ID NO: 1035972 - protein, 9 aa, Homo Sapiens
LQEKISISG

SEQ ID NO: 1035973 - protein, 9 aa, Homo Sapiens
GRRKPQILC

SEQ ID NO: 1035974 - protein, 9 aa, Homo Sapiens
FNTLIFSLR

SEQ ID NO: 1035975 - protein, 9 aa, Homo Sapiens
EGFHQGAPE

SEQ ID NO: 1035976 - protein, 9 aa, Homo Sapiens
QVATHTLVD

SEQ ID NO: 1035977 - protein, 9 aa, Homo Sapiens
LPDLINNAL

SEQ ID NO: 1035978 - protein, 9 aa, Homo Sapiens
KPMSLLSLL

SEQ ID NO: 1035979 - protein, 9 aa, Homo Sapiens
ETFSVKQPW

SEQ ID NO: 1035980 - protein, 9 aa, Homo Sapiens
PELVHASLC

SEQ ID NO: 1035981 - protein, 9 aa, Homo Sapiens
KCLRYYVGW

SEQ ID NO: 1035982 - protein, 9 aa, Homo Sapiens
PSEAQILDP

SEQ ID NO: 1035983 - protein, 9 aa, Homo Sapiens
HCGQLEKLK

SEQ ID NO: 1035984 - protein, 9 aa, Homo Sapiens
LPMCRNKII

SEQ ID NO: 1035985 - protein, 9 aa, Homo Sapiens
AVKAVEVPL

SEQ ID NO: 1035986 - protein, 9 aa, Homo Sapiens
TSRQPIFLT

SEQ ID NO: 1035987 - protein, 9 aa, Homo Sapiens
SGEDRGIHP

SEQ ID NO: 1035988 - protein, 9 aa, Homo Sapiens
LHVKYLDFS

SEQ ID NO: 1035989 - protein, 9 aa, Homo Sapiens
VMRRHCHPL

SEQ ID NO: 1035990 - protein, 9 aa, Homo Sapiens
QTEPVGISR

SEQ ID NO: 1035991 - protein, 9 aa, Homo Sapiens
SELFSLLYV

SEQ ID NO: 1035992 - protein, 9 aa, Homo Sapiens
YQDTLLEVQ

SEQ ID NO: 1035993 - protein, 9 aa, Homo Sapiens
IPEKYGVVR

SEQ ID NO: 1035994 - protein, 9 aa, Homo Sapiens
KKKLETDIF

SEQ ID NO: 1035995 - protein, 9 aa, Homo Sapiens
PKTFAPSSS

SEQ ID NO: 1035996 - protein, 9 aa, Homo Sapiens
SLRNPIIYT

SEQ ID NO: 1035997 - protein, 9 aa, Homo Sapiens
YNFIIQVTF

SEQ ID NO: 1035998 - protein, 9 aa, Homo Sapiens
DANYGKLQE

SEQ ID NO: 1035999 - protein, 9 aa, Homo Sapiens
GSPDKEDGE

SEQ ID NO: 1036000 - protein, 9 aa, Homo Sapiens
DGSDTSILP

SEQ ID NO: 1036001 - protein, 9 aa, Homo Sapiens
EANDNPPAF

SEQ ID NO: 1036002 - protein, 9 aa, Homo Sapiens
LQGKLGGIM

SEQ ID NO: 1036003 - protein, 9 aa, Homo Sapiens
GPETEPRTE

SEQ ID NO: 1036004 - protein, 9 aa, Homo Sapiens
SEAQILDPF

SEQ ID NO: 1036005 - protein, 9 aa, Homo Sapiens
IYIQVVEAN

SEQ ID NO: 1036006 - protein, 9 aa, Homo Sapiens
RGGRAPAPD

SEQ ID NO: 1036007 - protein, 9 aa, Homo Sapiens
FFLWSRMHF

SEQ ID NO: 1036008 - protein, 9 aa, Homo Sapiens
KKEALISQL

SEQ ID NO: 1036009 - protein, 9 aa, Homo Sapiens
RQRRGFPRY

SEQ ID NO: 1036010 - protein, 9 aa, Homo Sapiens
LSVYMCYEF

SEQ ID NO: 1036011 - protein, 9 aa, Homo Sapiens
WSPVMPREA

SEQ ID NO: 1036012 - protein, 9 aa, Homo Sapiens
TVIQHCEDG

SEQ ID NO: 1036013 - protein, 9 aa, Homo Sapiens
VPSEAQILD

SEQ ID NO: 1036014 - protein, 9 aa, Homo Sapiens
PRLAEPYVK

SEQ ID NO: 1036015 - protein, 9 aa, Homo Sapiens
SFPPTPTCE

SEQ ID NO: 1036016 - protein, 9 aa, Homo Sapiens
KIPEPEKKV

SEQ ID NO: 1036017 - protein, 9 aa, Homo Sapiens
TYSFNLPLS

SEQ ID NO: 1036018 - protein, 9 aa, Homo Sapiens
TVNFIVSSN

SEQ ID NO: 1036019 - protein, 9 aa, Homo Sapiens
AWDAWIRYA

SEQ ID NO: 1036020 - protein, 9 aa, Homo Sapiens
VDVASFLLK

SEQ ID NO: 1036021 - protein, 9 aa, Homo Sapiens
EWVKAGYKK

SEQ ID NO: 1036022 - protein, 9 aa, Homo Sapiens
IRGNCKNCA

SEQ ID NO: 1036023 - protein, 9 aa, Homo Sapiens
TGGRSAQAA

SEQ ID NO: 1036024 - protein, 9 aa, Homo Sapiens
LQCAQNMNH

SEQ ID NO: 1036025 - protein, 9 aa, Homo Sapiens
KKNMVDCSK

SEQ ID NO: 1036026 - protein, 9 aa, Homo Sapiens
KAFWRGDEL

SEQ ID NO: 1036027 - protein, 9 aa, Homo Sapiens
AEQDAFLGE

SEQ ID NO: 1036028 - protein, 9 aa, Homo Sapiens
DWTSSTIAL

SEQ ID NO: 1036029 - protein, 9 aa, Homo Sapiens
PSGVIPNFT

SEQ ID NO: 1036030 - protein, 9 aa, Homo Sapiens
NRARRTDPG

SEQ ID NO: 1036031 - protein, 9 aa, Homo Sapiens
PMTMHWAVS

SEQ ID NO: 1036032 - protein, 9 aa, Homo Sapiens
ERDPWISHG

SEQ ID NO: 1036033 - protein, 9 aa, Homo Sapiens
EIQNELLVF

SEQ ID NO: 1036034 - protein, 9 aa, Homo Sapiens
FPTVFVKKK

SEQ ID NO: 1036035 - protein, 9 aa, Homo Sapiens
SHPSLLSYI

SEQ ID NO: 1036036 - protein, 9 aa, Homo Sapiens
LPFTLQKLG

SEQ ID NO: 1036037 - protein, 9 aa, Homo Sapiens
QNFLGLKRV

SEQ ID NO: 1036038 - protein, 9 aa, Homo Sapiens
LKQTCRMTH

SEQ ID NO: 1036039 - protein, 9 aa, Homo Sapiens
QLTPTAVSG

SEQ ID NO: 1036040 - protein, 9 aa, Homo Sapiens
SGPAPPPPA

SEQ ID NO: 1036041 - protein, 9 aa, Homo Sapiens
FVAPDVFHF

SEQ ID NO: 1036042 - protein, 9 aa, Homo Sapiens
LNEDHTGTV

SEQ ID NO: 1036043 - protein, 9 aa, Homo Sapiens
YQLVSCPLS

SEQ ID NO: 1036044 - protein, 9 aa, Homo Sapiens
VIPKEKDAC

SEQ ID NO: 1036045 - protein, 9 aa, Homo Sapiens
SLPLQAAPV

SEQ ID NO: 1036046 - protein, 9 aa, Homo Sapiens
TASDVGVKL

SEQ ID NO: 1036047 - protein, 9 aa, Homo Sapiens
PLSQMGSPA

SEQ ID NO: 1036048 - protein, 9 aa, Homo Sapiens
AKLSVGFKL

SEQ ID NO: 1036049 - protein, 9 aa, Homo Sapiens
NHGIEDNFG

SEQ ID NO: 1036050 - protein, 9 aa, Homo Sapiens
KPLKPVSGG

SEQ ID NO: 1036051 - protein, 9 aa, Homo Sapiens
TIQTESTFK

SEQ ID NO: 1036052 - protein, 9 aa, Homo Sapiens
ETRISSRLH

SEQ ID NO: 1036053 - protein, 9 aa, Homo Sapiens
KKRSILISR

SEQ ID NO: 1036054 - protein, 9 aa, Homo Sapiens
QKLGGLPED

SEQ ID NO: 1036055 - protein, 9 aa, Homo Sapiens
RDPVRGWAW

SEQ ID NO: 1036056 - protein, 9 aa, Homo Sapiens
QQKEATPGR

SEQ ID NO: 1036057 - protein, 9 aa, Homo Sapiens
QLLLVHQGE

SEQ ID NO: 1036058 - protein, 9 aa, Homo Sapiens
LCKTNVINY

SEQ ID NO: 1036059 - protein, 9 aa, Homo Sapiens
LFLPHFLEG

SEQ ID NO: 1036060 - protein, 9 aa, Homo Sapiens
DRFSFWDKD

SEQ ID NO: 1036061 - protein, 9 aa, Homo Sapiens
ERFLDYGYG

SEQ ID NO: 1036062 - protein, 9 aa, Homo Sapiens
TCDAIDGFF

SEQ ID NO: 1036063 - protein, 9 aa, Homo Sapiens
RFKPSLTES

SEQ ID NO: 1036064 - protein, 9 aa, Homo Sapiens
IAAASSPSQ

SEQ ID NO: 1036065 - protein, 9 aa, Homo Sapiens
VSRSSPDQG

SEQ ID NO: 1036066 - protein, 9 aa, Homo Sapiens
GCSGHGGCV

SEQ ID NO: 1036067 - protein, 9 aa, Homo Sapiens
LDLPGSCTF

SEQ ID NO: 1036068 - protein, 9 aa, Homo Sapiens
ELGAGGTLQ

SEQ ID NO: 1036069 - protein, 9 aa, Homo Sapiens
IHDRQIPSP

SEQ ID NO: 1036070 - protein, 9 aa, Homo Sapiens
SQVESSLVS

SEQ ID NO: 1036071 - protein, 9 aa, Homo Sapiens
EALYSVLRN

SEQ ID NO: 1036072 - protein, 9 aa, Homo Sapiens
VFANFFNTF

SEQ ID NO: 1036073 - protein, 9 aa, Homo Sapiens
DPSPEAAQA

SEQ ID NO: 1036074 - protein, 9 aa, Homo Sapiens
IATGSFFKR

SEQ ID NO: 1036075 - protein, 9 aa, Homo Sapiens
LKIHLQAYH

SEQ ID NO: 1036076 - protein, 9 aa, Homo Sapiens
LDLCGCARI

SEQ ID NO: 1036077 - protein, 9 aa, Homo Sapiens
DSSVCLDWK

SEQ ID NO: 1036078 - protein, 9 aa, Homo Sapiens
RNFSRVLQA

SEQ ID NO: 1036079 - protein, 9 aa, Homo Sapiens
NRMSYWSDW

SEQ ID NO: 1036080 - protein, 9 aa, Homo Sapiens
SQKFSKCSI

SEQ ID NO: 1036081 - protein, 9 aa, Homo Sapiens
QSLEGKQKA

SEQ ID NO: 1036082 - protein, 9 aa, Homo Sapiens
EKSNLKKPI

SEQ ID NO: 1036083 - protein, 9 aa, Homo Sapiens
RETHEGRES

SEQ ID NO: 1036084 - protein, 9 aa, Homo Sapiens
ETKPQGASL

SEQ ID NO: 1036085 - protein, 9 aa, Homo Sapiens
VCGSCGGSK

SEQ ID NO: 1036086 - protein, 9 aa, Homo Sapiens
NICFHSKWG

SEQ ID NO: 1036087 - protein, 9 aa, Homo Sapiens
DYFKCKKIM

SEQ ID NO: 1036088 - protein, 9 aa, Homo Sapiens
LTFPRIVLM

SEQ ID NO: 1036089 - protein, 9 aa, Homo Sapiens
EKIDGSENN

SEQ ID NO: 1036090 - protein, 9 aa, Homo Sapiens
IVNSLCSVI

SEQ ID NO: 1036091 - protein, 9 aa, Homo Sapiens
VVLCFFVSC

SEQ ID NO: 1036092 - protein, 9 aa, Homo Sapiens
RRCALPALG

SEQ ID NO: 1036093 - protein, 9 aa, Homo Sapiens
QQFQAFCLV

SEQ ID NO: 1036094 - protein, 9 aa, Homo Sapiens
STEASVLAK

SEQ ID NO: 1036095 - protein, 9 aa, Homo Sapiens
FNAPVINRL

SEQ ID NO: 1036096 - protein, 9 aa, Homo Sapiens
SVNKADYRK

SEQ ID NO: 1036097 - protein, 9 aa, Homo Sapiens
LLSSEAVLL

SEQ ID NO: 1036098 - protein, 9 aa, Homo Sapiens
FQIQGEMED

SEQ ID NO: 1036099 - protein, 9 aa, Homo Sapiens
SGVLQLLFR

SEQ ID NO: 1036100 - protein, 9 aa, Homo Sapiens
FASNVGGGH

SEQ ID NO: 1036101 - protein, 9 aa, Homo Sapiens
KEMKISELN

SEQ ID NO: 1036102 - protein, 9 aa, Homo Sapiens
STFSIFQGK

SEQ ID NO: 1036103 - protein, 9 aa, Homo Sapiens
EDCSDSFYS

SEQ ID NO: 1036104 - protein, 9 aa, Homo Sapiens
FVSCVFIYL

SEQ ID NO: 1036105 - protein, 9 aa, Homo Sapiens
SSVYKKLTG

SEQ ID NO: 1036106 - protein, 9 aa, Homo Sapiens
LCSIPLSGC

SEQ ID NO: 1036107 - protein, 9 aa, Homo Sapiens
YTKEPRIRN

SEQ ID NO: 1036108 - protein, 9 aa, Homo Sapiens
SLYVYHNRP

SEQ ID NO: 1036109 - protein, 9 aa, Homo Sapiens
GGLSGFLSD

SEQ ID NO: 1036110 - protein, 9 aa, Homo Sapiens
RVPPTLEAT

SEQ ID NO: 1036111 - protein, 9 aa, Homo Sapiens
LLSELFSLL

SEQ ID NO: 1036112 - protein, 9 aa, Homo Sapiens
RNHRVQMFV

SEQ ID NO: 1036113 - protein, 9 aa, Homo Sapiens
IELSGNRLE

SEQ ID NO: 1036114 - protein, 9 aa, Homo Sapiens
QLKTSRSSN

SEQ ID NO: 1036115 - protein, 9 aa, Homo Sapiens
QKLENRCQE

SEQ ID NO: 1036116 - protein, 9 aa, Homo Sapiens
SVYKKLTGK

SEQ ID NO: 1036117 - protein, 9 aa, Homo Sapiens
PRGAVKTGP

SEQ ID NO: 1036118 - protein, 9 aa, Homo Sapiens
GATPLAPPD

SEQ ID NO: 1036119 - protein, 9 aa, Homo Sapiens
SELEVLKIL

SEQ ID NO: 1036120 - protein, 9 aa, Homo Sapiens
AVKGPVSAA

SEQ ID NO: 1036121 - protein, 9 aa, Homo Sapiens
QKVNLIFEG

SEQ ID NO: 1036122 - protein, 9 aa, Homo Sapiens
KGCESACRE

SEQ ID NO: 1036123 - protein, 9 aa, Homo Sapiens
DGAPLSHPS

SEQ ID NO: 1036124 - protein, 9 aa, Homo Sapiens
LLECMENNC

SEQ ID NO: 1036125 - protein, 9 aa, Homo Sapiens
DLENDEDGN

SEQ ID NO: 1036126 - protein, 9 aa, Homo Sapiens
SLSTDTSWQ

SEQ ID NO: 1036127 - protein, 9 aa, Homo Sapiens
SARDDGVPP

SEQ ID NO: 1036128 - protein, 9 aa, Homo Sapiens
TMLKKILKG

SEQ ID NO: 1036129 - protein, 9 aa, Homo Sapiens
VFWRLIALI

SEQ ID NO: 1036130 - protein, 9 aa, Homo Sapiens
LVLTVSASA

SEQ ID NO: 1036131 - protein, 9 aa, Homo Sapiens
LAGEKLVEV

SEQ ID NO: 1036132 - protein, 9 aa, Homo Sapiens
TYLVVADPH

SEQ ID NO: 1036133 - protein, 9 aa, Homo Sapiens
IFCNGTFNQ

SEQ ID NO: 1036134 - protein, 9 aa, Homo Sapiens
TFIFPEELI

SEQ ID NO: 1036135 - protein, 9 aa, Homo Sapiens
CFYGRVLLA

SEQ ID NO: 1036136 - protein, 9 aa, Homo Sapiens
VEECQRQGA

SEQ ID NO: 1036137 - protein, 9 aa, Homo Sapiens
TFPRIVLML

SEQ ID NO: 1036138 - protein, 9 aa, Homo Sapiens
QFAYLENFS

SEQ ID NO: 1036139 - protein, 9 aa, Homo Sapiens
ATLERPMYA

SEQ ID NO: 1036140 - protein, 9 aa, Homo Sapiens
VFEISDPDS

SEQ ID NO: 1036141 - protein, 9 aa, Homo Sapiens
LGAARGLQR

SEQ ID NO: 1036142 - protein, 9 aa, Homo Sapiens
PIPFFLAIC

SEQ ID NO: 1036143 - protein, 9 aa, Homo Sapiens
NYRNLLLLA

SEQ ID NO: 1036144 - protein, 9 aa, Homo Sapiens
ELVDESGGF

SEQ ID NO: 1036145 - protein, 9 aa, Homo Sapiens
FSGTGILKA

SEQ ID NO: 1036146 - protein, 9 aa, Homo Sapiens
ILSHATLYW

SEQ ID NO: 1036147 - protein, 9 aa, Homo Sapiens
TCRQAMLTL

SEQ ID NO: 1036148 - protein, 9 aa, Homo Sapiens
GFGLGAVVS

SEQ ID NO: 1036149 - protein, 9 aa, Homo Sapiens
YKYQLTVRP

SEQ ID NO: 1036150 - protein, 9 aa, Homo Sapiens
FPAVLSSVS

SEQ ID NO: 1036151 - protein, 9 aa, Homo Sapiens
NKILKQIVK

SEQ ID NO: 1036152 - protein, 9 aa, Homo Sapiens
SKLRAGQFT

SEQ ID NO: 1036153 - protein, 9 aa, Homo Sapiens
PRAQAAVEN

SEQ ID NO: 1036154 - protein, 9 aa, Homo Sapiens
LKTLVSELS

SEQ ID NO: 1036155 - protein, 9 aa, Homo Sapiens
HKAFSTCAF

SEQ ID NO: 1036156 - protein, 9 aa, Homo Sapiens
SVHGESTSG

SEQ ID NO: 1036157 - protein, 9 aa, Homo Sapiens
PPEKPQGPP

SEQ ID NO: 1036158 - protein, 9 aa, Homo Sapiens
CVDMLQDGY

SEQ ID NO: 1036159 - protein, 9 aa, Homo Sapiens
GFAEETLKA

SEQ ID NO: 1036160 - protein, 9 aa, Homo Sapiens
SESVREGHP

SEQ ID NO: 1036161 - protein, 9 aa, Homo Sapiens
KGDSGPPGI

SEQ ID NO: 1036162 - protein, 9 aa, Homo Sapiens
DQMLDRNCD

SEQ ID NO: 1036163 - protein, 9 aa, Homo Sapiens
SILIRGPQA

SEQ ID NO: 1036164 - protein, 9 aa, Homo Sapiens
VFQLGQFTE

SEQ ID NO: 1036165 - protein, 9 aa, Homo Sapiens
QGGGGGEGS

SEQ ID NO: 1036166 - protein, 9 aa, Homo Sapiens
ITEGDKKPD

SEQ ID NO: 1036167 - protein, 9 aa, Homo Sapiens
HTINLRRLS

SEQ ID NO: 1036168 - protein, 9 aa, Homo Sapiens
PCIFLYVRP

SEQ ID NO: 1036169 - protein, 9 aa, Homo Sapiens
AKPIIYTKD

SEQ ID NO: 1036170 - protein, 9 aa, Homo Sapiens
TRHSFFRRH

SEQ ID NO: 1036171 - protein, 9 aa, Homo Sapiens
ESVLQPLAQ

SEQ ID NO: 1036172 - protein, 9 aa, Homo Sapiens
CCLAKLLCK

SEQ ID NO: 1036173 - protein, 9 aa, Homo Sapiens
FPSYAPLSG

SEQ ID NO: 1036174 - protein, 9 aa, Homo Sapiens
PDAKPMPKR

SEQ ID NO: 1036175 - protein, 9 aa, Homo Sapiens
GATTCTKDR

SEQ ID NO: 1036176 - protein, 9 aa, Homo Sapiens
APENFPQTP

SEQ ID NO: 1036177 - protein, 9 aa, Homo Sapiens
RGNGRSEGG

SEQ ID NO: 1036178 - protein, 9 aa, Homo Sapiens
GDSHFSHSA

SEQ ID NO: 1036179 - protein, 9 aa, Homo Sapiens
QTIDNSQEA

SEQ ID NO: 1036180 - protein, 9 aa, Homo Sapiens
NCKNCAQFS

SEQ ID NO: 1036181 - protein, 9 aa, Homo Sapiens
PICLPLVDC

SEQ ID NO: 1036182 - protein, 9 aa, Homo Sapiens
KECGKAFKW

SEQ ID NO: 1036183 - protein, 9 aa, Homo Sapiens
SSHVARPQI

SEQ ID NO: 1036184 - protein, 9 aa, Homo Sapiens
KVTDARNGQ

SEQ ID NO: 1036185 - protein, 9 aa, Homo Sapiens
LTIPSHPYG

SEQ ID NO: 1036186 - protein, 9 aa, Homo Sapiens
VDINAREEW

SEQ ID NO: 1036187 - protein, 9 aa, Homo Sapiens
SSWDNQQKN

SEQ ID NO: 1036188 - protein, 9 aa, Homo Sapiens
AQHLQAAVV

SEQ ID NO: 1036189 - protein, 9 aa, Homo Sapiens
VAFSGWFIA

SEQ ID NO: 1036190 - protein, 9 aa, Homo Sapiens
YESIGYCWC

SEQ ID NO: 1036191 - protein, 9 aa, Homo Sapiens
PPSAVTKIK

SEQ ID NO: 1036192 - protein, 9 aa, Homo Sapiens
LDYLHKNGQ

SEQ ID NO: 1036193 - protein, 9 aa, Homo Sapiens
SHFSHSAVY

SEQ ID NO: 1036194 - protein, 9 aa, Homo Sapiens
MHLEKFEKN

SEQ ID NO: 1036195 - protein, 9 aa, Homo Sapiens
AKMIYSKFI

SEQ ID NO: 1036196 - protein, 9 aa, Homo Sapiens
VFDSSSDMK

SEQ ID NO: 1036197 - protein, 9 aa, Homo Sapiens
GSYSSSPHL

SEQ ID NO: 1036198 - protein, 9 aa, Homo Sapiens
SVKTAFIGT

SEQ ID NO: 1036199 - protein, 9 aa, Homo Sapiens
KPEKAPALS

SEQ ID NO: 1036200 - protein, 9 aa, Homo Sapiens
LKRNLHFPL

SEQ ID NO: 1036201 - protein, 9 aa, Homo Sapiens
IGYRNAEKN

SEQ ID NO: 1036202 - protein, 9 aa, Homo Sapiens
ISKEEQERL

SEQ ID NO: 1036203 - protein, 9 aa, Homo Sapiens
GKSHDQAPE

SEQ ID NO: 1036204 - protein, 9 aa, Homo Sapiens
VCTFSLLST

SEQ ID NO: 1036205 - protein, 9 aa, Homo Sapiens
NSEVLYPNY

SEQ ID NO: 1036206 - protein, 9 aa, Homo Sapiens
FLLRLATWK

SEQ ID NO: 1036207 - protein, 9 aa, Homo Sapiens
APGEASPGS

SEQ ID NO: 1036208 - protein, 9 aa, Homo Sapiens
VMIDVDGLL

SEQ ID NO: 1036209 - protein, 9 aa, Homo Sapiens
EKCCTHNNS

SEQ ID NO: 1036210 - protein, 9 aa, Homo Sapiens
LLEQNLKVY

SEQ ID NO: 1036211 - protein, 9 aa, Homo Sapiens
SFAPRGQRG

SEQ ID NO: 1036212 - protein, 9 aa, Homo Sapiens
APTELSHGS

SEQ ID NO: 1036213 - protein, 9 aa, Homo Sapiens
AKIHCGQLE

SEQ ID NO: 1036214 - protein, 9 aa, Homo Sapiens
RARVVSKGK

SEQ ID NO: 1036215 - protein, 9 aa, Homo Sapiens
YLPCRFTLS

SEQ ID NO: 1036216 - protein, 9 aa, Homo Sapiens
SPGAPEREA

SEQ ID NO: 1036217 - protein, 9 aa, Homo Sapiens
RVGYILHKE

SEQ ID NO: 1036218 - protein, 9 aa, Homo Sapiens
PLDLGGLEA

SEQ ID NO: 1036219 - protein, 9 aa, Homo Sapiens
LQHLQRVDA

SEQ ID NO: 1036220 - protein, 9 aa, Homo Sapiens
TTNHEFVDK

SEQ ID NO: 1036221 - protein, 9 aa, Homo Sapiens
QYPYLHQQN

SEQ ID NO: 1036222 - protein, 9 aa, Homo Sapiens
EPSSGPRKK

SEQ ID NO: 1036223 - protein, 9 aa, Homo Sapiens
VLLNVLFCL

SEQ ID NO: 1036224 - protein, 9 aa, Homo Sapiens
LPVLYTFHM

SEQ ID NO: 1036225 - protein, 9 aa, Homo Sapiens
SHQLLILRE

SEQ ID NO: 1036226 - protein, 9 aa, Homo Sapiens
NVLRGACGL

SEQ ID NO: 1036227 - protein, 9 aa, Homo Sapiens
SEKREENVI

SEQ ID NO: 1036228 - protein, 9 aa, Homo Sapiens
VVESFMQLS

SEQ ID NO: 1036229 - protein, 9 aa, Homo Sapiens
LVLVIRRRA

SEQ ID NO: 1036230 - protein, 9 aa, Homo Sapiens
GKHRLAEWG

SEQ ID NO: 1036231 - protein, 9 aa, Homo Sapiens
SFFFFGFFL

SEQ ID NO: 1036232 - protein, 9 aa, Homo Sapiens
RQLQLAQEV

SEQ ID NO: 1036233 - protein, 9 aa, Homo Sapiens
QCTNSEESY

SEQ ID NO: 1036234 - protein, 9 aa, Homo Sapiens
GPGKMAAMI

SEQ ID NO: 1036235 - protein, 9 aa, Homo Sapiens
PDWLVTMKN

SEQ ID NO: 1036236 - protein, 9 aa, Homo Sapiens
GGGLPNARR

SEQ ID NO: 1036237 - protein, 9 aa, Homo Sapiens
RAQAAVENV

SEQ ID NO: 1036238 - protein, 9 aa, Homo Sapiens
PRSTGLFPQ

SEQ ID NO: 1036239 - protein, 9 aa, Homo Sapiens
KAFERPSLF

SEQ ID NO: 1036240 - protein, 9 aa, Homo Sapiens
NQKRGDKFF

SEQ ID NO: 1036241 - protein, 9 aa, Homo Sapiens
TVETISIEE

SEQ ID NO: 1036242 - protein, 9 aa, Homo Sapiens
EAFSGREKI

SEQ ID NO: 1036243 - protein, 9 aa, Homo Sapiens
LPLFTETSQ

SEQ ID NO: 1036244 - protein, 9 aa, Homo Sapiens
HVFFSVHYE

SEQ ID NO: 1036245 - protein, 9 aa, Homo Sapiens
RQAMLTLTQ

SEQ ID NO: 1036246 - protein, 9 aa, Homo Sapiens
GLVLLRDLE

SEQ ID NO: 1036247 - protein, 9 aa, Homo Sapiens
FLEIFFTSI

SEQ ID NO: 1036248 - protein, 9 aa, Homo Sapiens
GVNYTTTLT

SEQ ID NO: 1036249 - protein, 9 aa, Homo Sapiens
AVRRARVVS

SEQ ID NO: 1036250 - protein, 9 aa, Homo Sapiens
QLQLQAAPG

SEQ ID NO: 1036251 - protein, 9 aa, Homo Sapiens
GRDLPQECS

SEQ ID NO: 1036252 - protein, 9 aa, Homo Sapiens
NEKHTLLYG

SEQ ID NO: 1036253 - protein, 9 aa, Homo Sapiens
LTGLLLFSY

SEQ ID NO: 1036254 - protein, 9 aa, Homo Sapiens
RVPTESWPG

SEQ ID NO: 1036255 - protein, 9 aa, Homo Sapiens
DTFELELVL

SEQ ID NO: 1036256 - protein, 9 aa, Homo Sapiens
DHGFLRTKI

SEQ ID NO: 1036257 - protein, 9 aa, Homo Sapiens
DGRFLPKGI

SEQ ID NO: 1036258 - protein, 9 aa, Homo Sapiens
INGKSFKKY

SEQ ID NO: 1036259 - protein, 9 aa, Homo Sapiens
QDLGCYLSP

SEQ ID NO: 1036260 - protein, 9 aa, Homo Sapiens
PALSQLQNS

SEQ ID NO: 1036261 - protein, 9 aa, Homo Sapiens
AKQQFSFHS

SEQ ID NO: 1036262 - protein, 9 aa, Homo Sapiens
NLGYTYETQ

SEQ ID NO: 1036263 - protein, 9 aa, Homo Sapiens
DYQDTLLEV

SEQ ID NO: 1036264 - protein, 9 aa, Homo Sapiens
FLEGDGPCL

SEQ ID NO: 1036265 - protein, 9 aa, Homo Sapiens
LVVMSYDCY

SEQ ID NO: 1036266 - protein, 9 aa, Homo Sapiens
LKMIIIIWS

SEQ ID NO: 1036267 - protein, 9 aa, Homo Sapiens
FSSIKNESN

SEQ ID NO: 1036268 - protein, 9 aa, Homo Sapiens
ADPSPGASS

SEQ ID NO: 1036269 - protein, 9 aa, Homo Sapiens
ETDSSLQIH

SEQ ID NO: 1036270 - protein, 9 aa, Homo Sapiens
SPAACEERR

SEQ ID NO: 1036271 - protein, 9 aa, Homo Sapiens
SLEKVRIEI

SEQ ID NO: 1036272 - protein, 9 aa, Homo Sapiens
ISRSPTFSG

SEQ ID NO: 1036273 - protein, 9 aa, Homo Sapiens
QWRYREASK

SEQ ID NO: 1036274 - protein, 9 aa, Homo Sapiens
RPMYAVGGH

SEQ ID NO: 1036275 - protein, 9 aa, Homo Sapiens
DDSFNDVGL

SEQ ID NO: 1036276 - protein, 9 aa, Homo Sapiens
ALKEEEKYE

SEQ ID NO: 1036277 - protein, 9 aa, Homo Sapiens
GAFAAAART

SEQ ID NO: 1036278 - protein, 9 aa, Homo Sapiens
TITFKVPSR

SEQ ID NO: 1036279 - protein, 9 aa, Homo Sapiens
YTLLSQNGP

SEQ ID NO: 1036280 - protein, 9 aa, Homo Sapiens
PGIAEVTIW

SEQ ID NO: 1036281 - protein, 9 aa, Homo Sapiens
KKAGLPLGA

SEQ ID NO: 1036282 - protein, 9 aa, Homo Sapiens
KMQESISER

SEQ ID NO: 1036283 - protein, 9 aa, Homo Sapiens
FGWSLFYFS

SEQ ID NO: 1036284 - protein, 9 aa, Homo Sapiens
VMVTSTFSI

SEQ ID NO: 1036285 - protein, 9 aa, Homo Sapiens
SSSERITDN

SEQ ID NO: 1036286 - protein, 9 aa, Homo Sapiens
EVNSQFSTG

SEQ ID NO: 1036287 - protein, 9 aa, Homo Sapiens
PARPLPTPS

SEQ ID NO: 1036288 - protein, 9 aa, Homo Sapiens
TKEAALCAG

SEQ ID NO: 1036289 - protein, 9 aa, Homo Sapiens
VTKEAALCA

SEQ ID NO: 1036290 - protein, 9 aa, Homo Sapiens
GNGSGSREN

SEQ ID NO: 1036291 - protein, 9 aa, Homo Sapiens
GRSYKTTTD

SEQ ID NO: 1036292 - protein, 9 aa, Homo Sapiens
KSENGEVGS

SEQ ID NO: 1036293 - protein, 9 aa, Homo Sapiens
QNRRIKWRN

SEQ ID NO: 1036294 - protein, 9 aa, Homo Sapiens
QREQKKEQM

SEQ ID NO: 1036295 - protein, 9 aa, Homo Sapiens
WGICVCTFS

SEQ ID NO: 1036296 - protein, 9 aa, Homo Sapiens
ALFQAGLGK

SEQ ID NO: 1036297 - protein, 9 aa, Homo Sapiens
APPTGVLSL

SEQ ID NO: 1036298 - protein, 9 aa, Homo Sapiens
GCDCIIGSK

SEQ ID NO: 1036299 - protein, 9 aa, Homo Sapiens
VCLRGPKVH

SEQ ID NO: 1036300 - protein, 9 aa, Homo Sapiens
SDKSNDLLY

SEQ ID NO: 1036301 - protein, 9 aa, Homo Sapiens
ENRSSPSGG

SEQ ID NO: 1036302 - protein, 9 aa, Homo Sapiens
MQRAFARCL

SEQ ID NO: 1036303 - protein, 9 aa, Homo Sapiens
GTEATDTKK

SEQ ID NO: 1036304 - protein, 9 aa, Homo Sapiens
SFSPGSRVI

SEQ ID NO: 1036305 - protein, 9 aa, Homo Sapiens
ELAFATKQD

SEQ ID NO: 1036306 - protein, 9 aa, Homo Sapiens
EMLRGIASG

SEQ ID NO: 1036307 - protein, 9 aa, Homo Sapiens
LALGLGQYQ

SEQ ID NO: 1036308 - protein, 9 aa, Homo Sapiens
ALYYNVIFG

SEQ ID NO: 1036309 - protein, 9 aa, Homo Sapiens
WSKTSSLFD

SEQ ID NO: 1036310 - protein, 9 aa, Homo Sapiens
EDLETAIHH

SEQ ID NO: 1036311 - protein, 9 aa, Homo Sapiens
NFKIQKSLD

SEQ ID NO: 1036312 - protein, 9 aa, Homo Sapiens
GTRSSVVSG

SEQ ID NO: 1036313 - protein, 9 aa, Homo Sapiens
IEEKAAKNG

SEQ ID NO: 1036314 - protein, 9 aa, Homo Sapiens
ETTCTFNPG

SEQ ID NO: 1036315 - protein, 9 aa, Homo Sapiens
PGSRGGRAP

SEQ ID NO: 1036316 - protein, 9 aa, Homo Sapiens
LSDTLPQKK

SEQ ID NO: 1036317 - protein, 9 aa, Homo Sapiens
VKSYICTEY

SEQ ID NO: 1036318 - protein, 9 aa, Homo Sapiens
YLLDQRTIF

SEQ ID NO: 1036319 - protein, 9 aa, Homo Sapiens
LLLLSFTYI

SEQ ID NO: 1036320 - protein, 9 aa, Homo Sapiens
TEMEFDLEL

SEQ ID NO: 1036321 - protein, 9 aa, Homo Sapiens
STLDLDLAQ

SEQ ID NO: 1036322 - protein, 9 aa, Homo Sapiens
YSQYSFNHL

SEQ ID NO: 1036323 - protein, 9 aa, Homo Sapiens
SWNPQVPSM

SEQ ID NO: 1036324 - protein, 9 aa, Homo Sapiens
LKTSRSSNI

SEQ ID NO: 1036325 - protein, 9 aa, Homo Sapiens
SVFNTLIFS

SEQ ID NO: 1036326 - protein, 9 aa, Homo Sapiens
SFWSRQRPK

SEQ ID NO: 1036327 - protein, 9 aa, Homo Sapiens
GQGEAGAET

SEQ ID NO: 1036328 - protein, 9 aa, Homo Sapiens
NTISRIDRH

SEQ ID NO: 1036329 - protein, 9 aa, Homo Sapiens
QFTPYSWVC

SEQ ID NO: 1036330 - protein, 9 aa, Homo Sapiens
ARDDMNFTE

SEQ ID NO: 1036331 - protein, 9 aa, Homo Sapiens
KYPHVQMNL

SEQ ID NO: 1036332 - protein, 9 aa, Homo Sapiens
TKFEQYLHF

SEQ ID NO: 1036333 - protein, 9 aa, Homo Sapiens
FLNLRHLAL

SEQ ID NO: 1036334 - protein, 9 aa, Homo Sapiens
TCREIRGLI

SEQ ID NO: 1036335 - protein, 9 aa, Homo Sapiens
SGKIRTKGK

SEQ ID NO: 1036336 - protein, 9 aa, Homo Sapiens
YTFNTEAVG

SEQ ID NO: 1036337 - protein, 9 aa, Homo Sapiens
WATYLYREP

SEQ ID NO: 1036338 - protein, 9 aa, Homo Sapiens
EPVGRKATS

SEQ ID NO: 1036339 - protein, 9 aa, Homo Sapiens
LQASTKAHP

SEQ ID NO: 1036340 - protein, 9 aa, Homo Sapiens
MNCVWLFIS

SEQ ID NO: 1036341 - protein, 9 aa, Homo Sapiens
LLYGMTLRC

SEQ ID NO: 1036342 - protein, 9 aa, Homo Sapiens
FPLVSEKNK

SEQ ID NO: 1036343 - protein, 9 aa, Homo Sapiens
KGLGQPLGV

SEQ ID NO: 1036344 - protein, 9 aa, Homo Sapiens
KYTCDIYKE

SEQ ID NO: 1036345 - protein, 9 aa, Homo Sapiens
VIYRGEVWG

SEQ ID NO: 1036346 - protein, 9 aa, Homo Sapiens
NHRWTQTLS

SEQ ID NO: 1036347 - protein, 9 aa, Homo Sapiens
IYNEISDIN

SEQ ID NO: 1036348 - protein, 9 aa, Homo Sapiens
PKKEGSRDP

SEQ ID NO: 1036349 - protein, 9 aa, Homo Sapiens
VLMCIKCSG

SEQ ID NO: 1036350 - protein, 9 aa, Homo Sapiens
SPRDFNPQH

SEQ ID NO: 1036351 - protein, 9 aa, Homo Sapiens
KIERDLHRS

SEQ ID NO: 1036352 - protein, 9 aa, Homo Sapiens
GVGQGRSKG

SEQ ID NO: 1036353 - protein, 9 aa, Homo Sapiens
LTSAFPAFT

SEQ ID NO: 1036354 - protein, 9 aa, Homo Sapiens
TLFRRVVKV

SEQ ID NO: 1036355 - protein, 9 aa, Homo Sapiens
PPMISWMET

SEQ ID NO: 1036356 - protein, 9 aa, Homo Sapiens
PFNVNLTCQ

SEQ ID NO: 1036357 - protein, 9 aa, Homo Sapiens
LTACMNVAQ

SEQ ID NO: 1036358 - protein, 9 aa, Homo Sapiens
SIKEVKENF

SEQ ID NO: 1036359 - protein, 9 aa, Homo Sapiens
IIIHTDEAN

SEQ ID NO: 1036360 - protein, 9 aa, Homo Sapiens
KAFRVSSNF

SEQ ID NO: 1036361 - protein, 9 aa, Homo Sapiens
VHYELLTNG

SEQ ID NO: 1036362 - protein, 9 aa, Homo Sapiens
AESEEFNAT

SEQ ID NO: 1036363 - protein, 9 aa, Homo Sapiens
GGNGTWRYL

SEQ ID NO: 1036364 - protein, 9 aa, Homo Sapiens
GPRGEVPGS

SEQ ID NO: 1036365 - protein, 9 aa, Homo Sapiens
KTFDCSTKV

SEQ ID NO: 1036366 - protein, 9 aa, Homo Sapiens
LNLEDIARL

SEQ ID NO: 1036367 - protein, 9 aa, Homo Sapiens
IMDNIKYRD

SEQ ID NO: 1036368 - protein, 9 aa, Homo Sapiens
RYSLGGTRE

SEQ ID NO: 1036369 - protein, 9 aa, Homo Sapiens
KGQQMLAGD

SEQ ID NO: 1036370 - protein, 9 aa, Homo Sapiens
LSLSPKKNR

SEQ ID NO: 1036371 - protein, 9 aa, Homo Sapiens
VSEGLQLHP

SEQ ID NO: 1036372 - protein, 9 aa, Homo Sapiens
IITPRPQNH

SEQ ID NO: 1036373 - protein, 9 aa, Homo Sapiens
FSVKQPWDH

SEQ ID NO: 1036374 - protein, 9 aa, Homo Sapiens
RLYDTVSST

SEQ ID NO: 1036375 - protein, 9 aa, Homo Sapiens
MLLSELFSL

SEQ ID NO: 1036376 - protein, 9 aa, Homo Sapiens
LEKKEALIS

SEQ ID NO: 1036377 - protein, 9 aa, Homo Sapiens
EDDFAVPSS

SEQ ID NO: 1036378 - protein, 9 aa, Homo Sapiens
GVNMLPLKF

SEQ ID NO: 1036379 - protein, 9 aa, Homo Sapiens
QGFPPRSPW

SEQ ID NO: 1036380 - protein, 9 aa, Homo Sapiens
LSLRLKVMK

SEQ ID NO: 1036381 - protein, 9 aa, Homo Sapiens
RTSRTEILS

SEQ ID NO: 1036382 - protein, 9 aa, Homo Sapiens
AFSGWFIAV

SEQ ID NO: 1036383 - protein, 9 aa, Homo Sapiens
NEPLVSESD

SEQ ID NO: 1036384 - protein, 9 aa, Homo Sapiens
QTYSFNLPL

SEQ ID NO: 1036385 - protein, 9 aa, Homo Sapiens
PISGKIRTK

SEQ ID NO: 1036386 - protein, 9 aa, Homo Sapiens
SLSEEDLNR

SEQ ID NO: 1036387 - protein, 9 aa, Homo Sapiens
SRQQKLVIV

SEQ ID NO: 1036388 - protein, 9 aa, Homo Sapiens
SPTYRDCFQ

SEQ ID NO: 1036389 - protein, 9 aa, Homo Sapiens
GLAQLFRGE

SEQ ID NO: 1036390 - protein, 9 aa, Homo Sapiens
INPLMRWQP

SEQ ID NO: 1036391 - protein, 9 aa, Homo Sapiens
LKFVIPKEK

SEQ ID NO: 1036392 - protein, 9 aa, Homo Sapiens
PTYRDCFQA

SEQ ID NO: 1036393 - protein, 9 aa, Homo Sapiens
TSTTSRQPI

SEQ ID NO: 1036394 - protein, 9 aa, Homo Sapiens
RSALGFSSP

SEQ ID NO: 1036395 - protein, 9 aa, Homo Sapiens
HGGPGKMAA

SEQ ID NO: 1036396 - protein, 9 aa, Homo Sapiens
HWPASCSNR

SEQ ID NO: 1036397 - protein, 9 aa, Homo Sapiens
LSLPVAPSA

SEQ ID NO: 1036398 - protein, 9 aa, Homo Sapiens
GCAEEKALL

SEQ ID NO: 1036399 - protein, 9 aa, Homo Sapiens
ISLSKKESS

SEQ ID NO: 1036400 - protein, 9 aa, Homo Sapiens
EQYLEAMKK

SEQ ID NO: 1036401 - protein, 9 aa, Homo Sapiens
GLSNTATTI

SEQ ID NO: 1036402 - protein, 9 aa, Homo Sapiens
KEGERPLPE

SEQ ID NO: 1036403 - protein, 9 aa, Homo Sapiens
RKQGEPLII

SEQ ID NO: 1036404 - protein, 9 aa, Homo Sapiens
FEISDPDSG

SEQ ID NO: 1036405 - protein, 9 aa, Homo Sapiens
QPFPVLESK

SEQ ID NO: 1036406 - protein, 9 aa, Homo Sapiens
PLDEINIIG

SEQ ID NO: 1036407 - protein, 9 aa, Homo Sapiens
WYCYKVFSS

SEQ ID NO: 1036408 - protein, 9 aa, Homo Sapiens
SVLPYDSLQ

SEQ ID NO: 1036409 - protein, 9 aa, Homo Sapiens
THEEQFKQL

SEQ ID NO: 1036410 - protein, 9 aa, Homo Sapiens
GPMSTLVYA

SEQ ID NO: 1036411 - protein, 9 aa, Homo Sapiens
PLPNPGYPG

SEQ ID NO: 1036412 - protein, 9 aa, Homo Sapiens
RVNTRQKPL

SEQ ID NO: 1036413 - protein, 9 aa, Homo Sapiens
RGKASQRHP

SEQ ID NO: 1036414 - protein, 9 aa, Homo Sapiens
DDDVIDQAP

SEQ ID NO: 1036415 - protein, 9 aa, Homo Sapiens
LRACYHMKA

SEQ ID NO: 1036416 - protein, 9 aa, Homo Sapiens
DSVKLVVQY

SEQ ID NO: 1036417 - protein, 9 aa, Homo Sapiens
FYDESTQVQ

SEQ ID NO: 1036418 - protein, 9 aa, Homo Sapiens
KLSIKYMAR

SEQ ID NO: 1036419 - protein, 9 aa, Homo Sapiens
QSAAYNLLC

SEQ ID NO: 1036420 - protein, 9 aa, Homo Sapiens
FAWPDKKSS

SEQ ID NO: 1036421 - protein, 9 aa, Homo Sapiens
SVPSEAQIL

SEQ ID NO: 1036422 - protein, 9 aa, Homo Sapiens
RRGLALTFS

SEQ ID NO: 1036423 - protein, 9 aa, Homo Sapiens
TSDFSKVLG

SEQ ID NO: 1036424 - protein, 9 aa, Homo Sapiens
PEPPRPPGL

SEQ ID NO: 1036425 - protein, 9 aa, Homo Sapiens
YKAQDTLAR

SEQ ID NO: 1036426 - protein, 9 aa, Homo Sapiens
LIAVAHHLG

SEQ ID NO: 1036427 - protein, 9 aa, Homo Sapiens
PKAISVIHR

SEQ ID NO: 1036428 - protein, 9 aa, Homo Sapiens
EVDDMHTSD

SEQ ID NO: 1036429 - protein, 9 aa, Homo Sapiens
YRRIGISLF

SEQ ID NO: 1036430 - protein, 9 aa, Homo Sapiens
IFQIFYGKN

SEQ ID NO: 1036431 - protein, 9 aa, Homo Sapiens
CKKTKHELH

SEQ ID NO: 1036432 - protein, 9 aa, Homo Sapiens
NQQNSSLSL

SEQ ID NO: 1036433 - protein, 9 aa, Homo Sapiens
QGPPPPEKP

SEQ ID NO: 1036434 - protein, 9 aa, Homo Sapiens
FYTLVVSGP

SEQ ID NO: 1036435 - protein, 9 aa, Homo Sapiens
CTNSEESYE

SEQ ID NO: 1036436 - protein, 9 aa, Homo Sapiens
QLEAISAPD

SEQ ID NO: 1036437 - protein, 9 aa, Homo Sapiens
LTEAHQDEL

SEQ ID NO: 1036438 - protein, 9 aa, Homo Sapiens
GAMGIVLVY

SEQ ID NO: 1036439 - protein, 9 aa, Homo Sapiens
RNLRRTRRT

SEQ ID NO: 1036440 - protein, 9 aa, Homo Sapiens
TQMVALGPT

SEQ ID NO: 1036441 - protein, 9 aa, Homo Sapiens
VGLEMYSKE

SEQ ID NO: 1036442 - protein, 9 aa, Homo Sapiens
GHFDSFIVQ

SEQ ID NO: 1036443 - protein, 9 aa, Homo Sapiens
ARDSDCGFS

SEQ ID NO: 1036444 - protein, 9 aa, Homo Sapiens
KRCALGTAG

SEQ ID NO: 1036445 - protein, 9 aa, Homo Sapiens
HETSTHADI

SEQ ID NO: 1036446 - protein, 9 aa, Homo Sapiens
CLDSDEQKI

SEQ ID NO: 1036447 - protein, 9 aa, Homo Sapiens
QRLHDRVVF

SEQ ID NO: 1036448 - protein, 9 aa, Homo Sapiens
NEKALKIHL

SEQ ID NO: 1036449 - protein, 9 aa, Homo Sapiens
VDKQVFEES

SEQ ID NO: 1036450 - protein, 9 aa, Homo Sapiens
TFSSVYKKL

SEQ ID NO: 1036451 - protein, 9 aa, Homo Sapiens
TPEKSEAGN

SEQ ID NO: 1036452 - protein, 9 aa, Homo Sapiens
KPERLLTRL

SEQ ID NO: 1036453 - protein, 9 aa, Homo Sapiens
ATESNTVLS

SEQ ID NO: 1036454 - protein, 9 aa, Homo Sapiens
RGADYFLRA

SEQ ID NO: 1036455 - protein, 9 aa, Homo Sapiens
PEPPSSPGS

SEQ ID NO: 1036456 - protein, 9 aa, Homo Sapiens
DARNGQSRT

SEQ ID NO: 1036457 - protein, 9 aa, Homo Sapiens
PGIEEKAAK

SEQ ID NO: 1036458 - protein, 9 aa, Homo Sapiens
WSPLAGEKL

SEQ ID NO: 1036459 - protein, 9 aa, Homo Sapiens
NLNLVIKQG

SEQ ID NO: 1036460 - protein, 9 aa, Homo Sapiens
SGILTPEFC

SEQ ID NO: 1036461 - protein, 9 aa, Homo Sapiens
VSHSQKFSK

SEQ ID NO: 1036462 - protein, 9 aa, Homo Sapiens
EHHQPITAM

SEQ ID NO: 1036463 - protein, 9 aa, Homo Sapiens
IRYYKVSAD

SEQ ID NO: 1036464 - protein, 9 aa, Homo Sapiens
SRALFRMDK

SEQ ID NO: 1036465 - protein, 9 aa, Homo Sapiens
GRVPGLCLR

SEQ ID NO: 1036466 - protein, 9 aa, Homo Sapiens
FILVVLLIV

SEQ ID NO: 1036467 - protein, 9 aa, Homo Sapiens
LEIHQKIYT

SEQ ID NO: 1036468 - protein, 9 aa, Homo Sapiens
FCLVLFFLV

SEQ ID NO: 1036469 - protein, 9 aa, Homo Sapiens
PVPSLPSRN

SEQ ID NO: 1036470 - protein, 9 aa, Homo Sapiens
VQLFYQHKA

SEQ ID NO: 1036471 - protein, 9 aa, Homo Sapiens
KLTTLFRRV

SEQ ID NO: 1036472 - protein, 9 aa, Homo Sapiens
SSSGLRKLS

SEQ ID NO: 1036473 - protein, 9 aa, Homo Sapiens
SKIQSKDGN

SEQ ID NO: 1036474 - protein, 9 aa, Homo Sapiens
QVLAVISKE

SEQ ID NO: 1036475 - protein, 9 aa, Homo Sapiens
FFIPLMFII

SEQ ID NO: 1036476 - protein, 9 aa, Homo Sapiens
EEPSKNINT

SEQ ID NO: 1036477 - protein, 9 aa, Homo Sapiens
NHRDLLQPL

SEQ ID NO: 1036478 - protein, 9 aa, Homo Sapiens
LRFNPIMVT

SEQ ID NO: 1036479 - protein, 9 aa, Homo Sapiens
INSINKKLP

SEQ ID NO: 1036480 - protein, 9 aa, Homo Sapiens
ASDVGVKLP

SEQ ID NO: 1036481 - protein, 9 aa, Homo Sapiens
QTLASEVEE

SEQ ID NO: 1036482 - protein, 9 aa, Homo Sapiens
LPCHWVRSL

SEQ ID NO: 1036483 - protein, 9 aa, Homo Sapiens
LRLKVMKRQ

SEQ ID NO: 1036484 - protein, 9 aa, Homo Sapiens
HLYNFVGNI

SEQ ID NO: 1036485 - protein, 9 aa, Homo Sapiens
GFWEDPKKF

SEQ ID NO: 1036486 - protein, 9 aa, Homo Sapiens
SLLTSLSNG

SEQ ID NO: 1036487 - protein, 9 aa, Homo Sapiens
YSAFFVADK

SEQ ID NO: 1036488 - protein, 9 aa, Homo Sapiens
VHNLLRAFA

SEQ ID NO: 1036489 - protein, 9 aa, Homo Sapiens
KAPTTAGFS

SEQ ID NO: 1036490 - protein, 9 aa, Homo Sapiens
EKYSKATLS

SEQ ID NO: 1036491 - protein, 9 aa, Homo Sapiens
ASRKQGEPL

SEQ ID NO: 1036492 - protein, 9 aa, Homo Sapiens
RPMTMHWAV

SEQ ID NO: 1036493 - protein, 9 aa, Homo Sapiens
MNFTELIVT

SEQ ID NO: 1036494 - protein, 9 aa, Homo Sapiens
ILLYGMTLR

SEQ ID NO: 1036495 - protein, 9 aa, Homo Sapiens
LGEIMKTAV

SEQ ID NO: 1036496 - protein, 9 aa, Homo Sapiens
QMLDRNCDT

SEQ ID NO: 1036497 - protein, 9 aa, Homo Sapiens
TLGEQKKAG

SEQ ID NO: 1036498 - protein, 9 aa, Homo Sapiens
PAGPCRWPL

SEQ ID NO: 1036499 - protein, 9 aa, Homo Sapiens
EDLKEQLAS

SEQ ID NO: 1036500 - protein, 9 aa, Homo Sapiens
VFARTSRQQ

SEQ ID NO: 1036501 - protein, 9 aa, Homo Sapiens
LAQLEKIEK

SEQ ID NO: 1036502 - protein, 9 aa, Homo Sapiens
MEGFHQGAP

SEQ ID NO: 1036503 - protein, 9 aa, Homo Sapiens
KISELNAKL

SEQ ID NO: 1036504 - protein, 9 aa, Homo Sapiens
FQAGLGKMM

SEQ ID NO: 1036505 - protein, 9 aa, Homo Sapiens
REGELINWV

SEQ ID NO: 1036506 - protein, 9 aa, Homo Sapiens
RNPNPFISP

SEQ ID NO: 1036507 - protein, 9 aa, Homo Sapiens
VQPVGSLLS

SEQ ID NO: 1036508 - protein, 9 aa, Homo Sapiens
ESCHSPVCS

SEQ ID NO: 1036509 - protein, 9 aa, Homo Sapiens
YEDLKTKIN

SEQ ID NO: 1036510 - protein, 9 aa, Homo Sapiens
AGMLIPYTY

SEQ ID NO: 1036511 - protein, 9 aa, Homo Sapiens
FSLRNPIIY

SEQ ID NO: 1036512 - protein, 9 aa, Homo Sapiens
KTFAPSSSV

SEQ ID NO: 1036513 - protein, 9 aa, Homo Sapiens
EPQNENGTW

SEQ ID NO: 1036514 - protein, 9 aa, Homo Sapiens
SVFVNDSGA

SEQ ID NO: 1036515 - protein, 9 aa, Homo Sapiens
FVEQPTSFL

SEQ ID NO: 1036516 - protein, 9 aa, Homo Sapiens
QSPGTPRKT

SEQ ID NO: 1036517 - protein, 9 aa, Homo Sapiens
NSGRPIELQ

SEQ ID NO: 1036518 - protein, 9 aa, Homo Sapiens
RGVLKCNIS

SEQ ID NO: 1036519 - protein, 9 aa, Homo Sapiens
KDVLDKWTD

SEQ ID NO: 1036520 - protein, 9 aa, Homo Sapiens
DCYLAICRP

SEQ ID NO: 1036521 - protein, 9 aa, Homo Sapiens
TDKSLSSLA

SEQ ID NO: 1036522 - protein, 9 aa, Homo Sapiens
TPETTMPLS

SEQ ID NO: 1036523 - protein, 9 aa, Homo Sapiens
QEEEAELRL

SEQ ID NO: 1036524 - protein, 9 aa, Homo Sapiens
TVGIETMKK

SEQ ID NO: 1036525 - protein, 9 aa, Homo Sapiens
SCTGRWPRS

SEQ ID NO: 1036526 - protein, 9 aa, Homo Sapiens
RLIQNIDAT

SEQ ID NO: 1036527 - protein, 9 aa, Homo Sapiens
CTVRWFHRL

SEQ ID NO: 1036528 - protein, 9 aa, Homo Sapiens
SQQSGTPGM

SEQ ID NO: 1036529 - protein, 9 aa, Homo Sapiens
CSGHGGCVN

SEQ ID NO: 1036530 - protein, 9 aa, Homo Sapiens
NLIFEGVDT

SEQ ID NO: 1036531 - protein, 9 aa, Homo Sapiens
VVCDLIKNK

SEQ ID NO: 1036532 - protein, 9 aa, Homo Sapiens
RNDKEQFEC

SEQ ID NO: 1036533 - protein, 9 aa, Homo Sapiens
AKGKFYHFV

SEQ ID NO: 1036534 - protein, 9 aa, Homo Sapiens
IPLCLAVEG

SEQ ID NO: 1036535 - protein, 9 aa, Homo Sapiens
KKMSLTTEQ

SEQ ID NO: 1036536 - protein, 9 aa, Homo Sapiens
HRKLKKRQP

SEQ ID NO: 1036537 - protein, 9 aa, Homo Sapiens
VMKFIWSTR

SEQ ID NO: 1036538 - protein, 9 aa, Homo Sapiens
RKVAPDGPL

SEQ ID NO: 1036539 - protein, 9 aa, Homo Sapiens
AMRNVTFLG

SEQ ID NO: 1036540 - protein, 9 aa, Homo Sapiens
KNDNVSEIA

SEQ ID NO: 1036541 - protein, 9 aa, Homo Sapiens
PKFPYTRRQ

SEQ ID NO: 1036542 - protein, 9 aa, Homo Sapiens
MGEPGQDLL

SEQ ID NO: 1036543 - protein, 9 aa, Homo Sapiens
GVGTEATDT

SEQ ID NO: 1036544 - protein, 9 aa, Homo Sapiens
RHPEAFTSI

SEQ ID NO: 1036545 - protein, 9 aa, Homo Sapiens
RVLTGLLLF

SEQ ID NO: 1036546 - protein, 9 aa, Homo Sapiens
RNDGARSMA

SEQ ID NO: 1036547 - protein, 9 aa, Homo Sapiens
QPEGELMLG

SEQ ID NO: 1036548 - protein, 9 aa, Homo Sapiens
FRISGHRKT

SEQ ID NO: 1036549 - protein, 9 aa, Homo Sapiens
GPQLGNLLQ

SEQ ID NO: 1036550 - protein, 9 aa, Homo Sapiens
QMGTTYGPP

SEQ ID NO: 1036551 - protein, 9 aa, Homo Sapiens
FEGQKRASL

SEQ ID NO: 1036552 - protein, 9 aa, Homo Sapiens
AIAALKVLE

SEQ ID NO: 1036553 - protein, 9 aa, Homo Sapiens
NKIQTLASE

SEQ ID NO: 1036554 - protein, 9 aa, Homo Sapiens
FGGKLSLEL

SEQ ID NO: 1036555 - protein, 9 aa, Homo Sapiens
KALAIVFFG

SEQ ID NO: 1036556 - protein, 9 aa, Homo Sapiens
CNGTFNQYV

SEQ ID NO: 1036557 - protein, 9 aa, Homo Sapiens
RPGVYTCVP

SEQ ID NO: 1036558 - protein, 9 aa, Homo Sapiens
VLTLKIRKP

SEQ ID NO: 1036559 - protein, 9 aa, Homo Sapiens
FLKNAMWKK

SEQ ID NO: 1036560 - protein, 9 aa, Homo Sapiens
QLLEQNLKV

SEQ ID NO: 1036561 - protein, 9 aa, Homo Sapiens
QEIEATNAV

SEQ ID NO: 1036562 - protein, 9 aa, Homo Sapiens
LSTGERKQN

SEQ ID NO: 1036563 - protein, 9 aa, Homo Sapiens
NHGTNLTCQ

SEQ ID NO: 1036564 - protein, 9 aa, Homo Sapiens
WMSVCRERP

SEQ ID NO: 1036565 - protein, 9 aa, Homo Sapiens
GASELEQER

SEQ ID NO: 1036566 - protein, 9 aa, Homo Sapiens
LSFFLYRSG

SEQ ID NO: 1036567 - protein, 9 aa, Homo Sapiens
SRSLVGLEG

SEQ ID NO: 1036568 - protein, 9 aa, Homo Sapiens
DKINFLRTL

SEQ ID NO: 1036569 - protein, 9 aa, Homo Sapiens
DYPPLVSGV

SEQ ID NO: 1036570 - protein, 9 aa, Homo Sapiens
FAIAIRNTE

SEQ ID NO: 1036571 - protein, 9 aa, Homo Sapiens
DYKAFYEGG

SEQ ID NO: 1036572 - protein, 9 aa, Homo Sapiens
PSETELSGQ

SEQ ID NO: 1036573 - protein, 9 aa, Homo Sapiens
SFGRDSFLT

SEQ ID NO: 1036574 - protein, 9 aa, Homo Sapiens
FKLHPRLES

SEQ ID NO: 1036575 - protein, 9 aa, Homo Sapiens
ETHEGRESC

SEQ ID NO: 1036576 - protein, 9 aa, Homo Sapiens
SHSFAFGIC

SEQ ID NO: 1036577 - protein, 9 aa, Homo Sapiens
ANLTKTQLL

SEQ ID NO: 1036578 - protein, 9 aa, Homo Sapiens
EQLTFEILL

SEQ ID NO: 1036579 - protein, 9 aa, Homo Sapiens
LMLHGCLLE

SEQ ID NO: 1036580 - protein, 9 aa, Homo Sapiens
MRRHCHPLD

SEQ ID NO: 1036581 - protein, 9 aa, Homo Sapiens
HEPAGPCRW

SEQ ID NO: 1036582 - protein, 9 aa, Homo Sapiens
QLFKIGPPF

SEQ ID NO: 1036583 - protein, 9 aa, Homo Sapiens
QEIYQKLTR

SEQ ID NO: 1036584 - protein, 9 aa, Homo Sapiens
EKKLAGQSR

SEQ ID NO: 1036585 - protein, 9 aa, Homo Sapiens
ELVLVIRRR

SEQ ID NO: 1036586 - protein, 9 aa, Homo Sapiens
DDRFSFWDK

SEQ ID NO: 1036587 - protein, 9 aa, Homo Sapiens
LSFLPLKIR

SEQ ID NO: 1036588 - protein, 9 aa, Homo Sapiens
GEKPDSENT

SEQ ID NO: 1036589 - protein, 9 aa, Homo Sapiens
AFYEGGRCS

SEQ ID NO: 1036590 - protein, 9 aa, Homo Sapiens
RHQKIKNLI

SEQ ID NO: 1036591 - protein, 9 aa, Homo Sapiens
WEQGGVPPR

SEQ ID NO: 1036592 - protein, 9 aa, Homo Sapiens
PNPFISPDA

SEQ ID NO: 1036593 - protein, 9 aa, Homo Sapiens
GKLSLELLN

SEQ ID NO: 1036594 - protein, 9 aa, Homo Sapiens
TSQYFKDPH

SEQ ID NO: 1036595 - protein, 9 aa, Homo Sapiens
LGEEDEGDD

SEQ ID NO: 1036596 - protein, 9 aa, Homo Sapiens
KFNIMEKNK

SEQ ID NO: 1036597 - protein, 9 aa, Homo Sapiens
QGDFGGPLH

SEQ ID NO: 1036598 - protein, 9 aa, Homo Sapiens
RHEKVIYLD

SEQ ID NO: 1036599 - protein, 9 aa, Homo Sapiens
QAKPIIYTK

SEQ ID NO: 1036600 - protein, 9 aa, Homo Sapiens
GDNYPLPNP

SEQ ID NO: 1036601 - protein, 9 aa, Homo Sapiens
ISLQHKIVI

SEQ ID NO: 1036602 - protein, 9 aa, Homo Sapiens
RQNVTIFYV

SEQ ID NO: 1036603 - protein, 9 aa, Homo Sapiens
ASDTKLWYC

SEQ ID NO: 1036604 - protein, 9 aa, Homo Sapiens
DELGQSTEV

SEQ ID NO: 1036605 - protein, 9 aa, Homo Sapiens
GGGEGSVPG

SEQ ID NO: 1036606 - protein, 9 aa, Homo Sapiens
FRLLSSIVE

SEQ ID NO: 1036607 - protein, 9 aa, Homo Sapiens
QASLEEATQ

SEQ ID NO: 1036608 - protein, 9 aa, Homo Sapiens
MEPTNGRML

SEQ ID NO: 1036609 - protein, 9 aa, Homo Sapiens
LRCPFPHVV

SEQ ID NO: 1036610 - protein, 9 aa, Homo Sapiens
ASCSNRVDL

SEQ ID NO: 1036611 - protein, 9 aa, Homo Sapiens
FQARMWRIR

SEQ ID NO: 1036612 - protein, 9 aa, Homo Sapiens
STPFQVEKN

SEQ ID NO: 1036613 - protein, 9 aa, Homo Sapiens
GKSHPRKRT

SEQ ID NO: 1036614 - protein, 9 aa, Homo Sapiens
QLLEEIWSY

SEQ ID NO: 1036615 - protein, 9 aa, Homo Sapiens
RKVLQGKFY

SEQ ID NO: 1036616 - protein, 9 aa, Homo Sapiens
LVKRFKTNL

SEQ ID NO: 1036617 - protein, 9 aa, Homo Sapiens
KAEVDVASF

SEQ ID NO: 1036618 - protein, 9 aa, Homo Sapiens
DKSLSSLAV

SEQ ID NO: 1036619 - protein, 9 aa, Homo Sapiens
LGFEKMSKR

SEQ ID NO: 1036620 - protein, 9 aa, Homo Sapiens
FSSAVTNGL

SEQ ID NO: 1036621 - protein, 9 aa, Homo Sapiens
TSTLDLDLA

SEQ ID NO: 1036622 - protein, 9 aa, Homo Sapiens
DFLKSHIKT

SEQ ID NO: 1036623 - protein, 9 aa, Homo Sapiens
TKSFKPVPK

SEQ ID NO: 1036624 - protein, 9 aa, Homo Sapiens
CAPGPPGCS

SEQ ID NO: 1036625 - protein, 9 aa, Homo Sapiens
GPSLASRSG

SEQ ID NO: 1036626 - protein, 9 aa, Homo Sapiens
FKTNLHNCV

SEQ ID NO: 1036627 - protein, 9 aa, Homo Sapiens
IQLSLYTYL

SEQ ID NO: 1036628 - protein, 9 aa, Homo Sapiens
VKVVPFSSI

SEQ ID NO: 1036629 - protein, 9 aa, Homo Sapiens
DLHTTYKKD

SEQ ID NO: 1036630 - protein, 9 aa, Homo Sapiens
AIAFAIAIR

SEQ ID NO: 1036631 - protein, 9 aa, Homo Sapiens
SSVSCLQAM

SEQ ID NO: 1036632 - protein, 9 aa, Homo Sapiens
KKLADVIIL

SEQ ID NO: 1036633 - protein, 9 aa, Homo Sapiens
AECPARRAP

SEQ ID NO: 1036634 - protein, 9 aa, Homo Sapiens
IFEGVDTVS

SEQ ID NO: 1036635 - protein, 9 aa, Homo Sapiens
PGEASPGSR

SEQ ID NO: 1036636 - protein, 9 aa, Homo Sapiens
PAFAGTYRC

SEQ ID NO: 1036637 - protein, 9 aa, Homo Sapiens
PQPIDSLLK

SEQ ID NO: 1036638 - protein, 9 aa, Homo Sapiens
QEKLPLVTR

SEQ ID NO: 1036639 - protein, 9 aa, Homo Sapiens
NEKEANFHE

SEQ ID NO: 1036640 - protein, 9 aa, Homo Sapiens
GGHRGLGQY

SEQ ID NO: 1036641 - protein, 9 aa, Homo Sapiens
ASSSKIPTF

SEQ ID NO: 1036642 - protein, 9 aa, Homo Sapiens
FYDSSSPTE

SEQ ID NO: 1036643 - protein, 9 aa, Homo Sapiens
VRKSINQDR

SEQ ID NO: 1036644 - protein, 9 aa, Homo Sapiens
YKLTVSRFL

SEQ ID NO: 1036645 - protein, 9 aa, Homo Sapiens
SMYYFLSNL

SEQ ID NO: 1036646 - protein, 9 aa, Homo Sapiens
ALYSVLRNH

SEQ ID NO: 1036647 - protein, 9 aa, Homo Sapiens
LEVQLQTVI

SEQ ID NO: 1036648 - protein, 9 aa, Homo Sapiens
LCNLVFSPA

SEQ ID NO: 1036649 - protein, 9 aa, Homo Sapiens
KVVCDLIKN

SEQ ID NO: 1036650 - protein, 9 aa, Homo Sapiens
FLPQEDPDV

SEQ ID NO: 1036651 - protein, 9 aa, Homo Sapiens
TGGPASLQP

SEQ ID NO: 1036652 - protein, 9 aa, Homo Sapiens
TRTVQCQDE

SEQ ID NO: 1036653 - protein, 9 aa, Homo Sapiens
NEISDINLD

SEQ ID NO: 1036654 - protein, 9 aa, Homo Sapiens
DAIFCVAGG

SEQ ID NO: 1036655 - protein, 9 aa, Homo Sapiens
LSDSQLGTA

SEQ ID NO: 1036656 - protein, 9 aa, Homo Sapiens
GTLGLFLTS

SEQ ID NO: 1036657 - protein, 9 aa, Homo Sapiens
AVKEGARAP

SEQ ID NO: 1036658 - protein, 9 aa, Homo Sapiens
LEYSDYFKC

SEQ ID NO: 1036659 - protein, 9 aa, Homo Sapiens
LPLLIHRHE

SEQ ID NO: 1036660 - protein, 9 aa, Homo Sapiens
LSYCKGNVI

SEQ ID NO: 1036661 - protein, 9 aa, Homo Sapiens
LNSLVYGAK

SEQ ID NO: 1036662 - protein, 9 aa, Homo Sapiens
SSLRNRIVY

SEQ ID NO: 1036663 - protein, 9 aa, Homo Sapiens
KQAEKLRQY

SEQ ID NO: 1036664 - protein, 9 aa, Homo Sapiens
QCLGEEDEG

SEQ ID NO: 1036665 - protein, 9 aa, Homo Sapiens
GSKHQKIFK

SEQ ID NO: 1036666 - protein, 9 aa, Homo Sapiens
LCHYLDQLG

SEQ ID NO: 1036667 - protein, 9 aa, Homo Sapiens
IQCLLKKFK

SEQ ID NO: 1036668 - protein, 9 aa, Homo Sapiens
EADGPDARA

SEQ ID NO: 1036669 - protein, 9 aa, Homo Sapiens
YIQKVEVTN

SEQ ID NO: 1036670 - protein, 9 aa, Homo Sapiens
LNKSSPEKQ

SEQ ID NO: 1036671 - protein, 9 aa, Homo Sapiens
CQVKMLQGK

SEQ ID NO: 1036672 - protein, 9 aa, Homo Sapiens
SEQLTFEIL

SEQ ID NO: 1036673 - protein, 9 aa, Homo Sapiens
PPIWKEKYS

SEQ ID NO: 1036674 - protein, 9 aa, Homo Sapiens
KRTAGDHLG

SEQ ID NO: 1036675 - protein, 9 aa, Homo Sapiens
NMSSTLLTF

SEQ ID NO: 1036676 - protein, 9 aa, Homo Sapiens
PALLKTLVS

SEQ ID NO: 1036677 - protein, 9 aa, Homo Sapiens
KYRMLFAWA

SEQ ID NO: 1036678 - protein, 9 aa, Homo Sapiens
QAEKLRQYK

SEQ ID NO: 1036679 - protein, 9 aa, Homo Sapiens
EAEVQLFYQ

SEQ ID NO: 1036680 - protein, 9 aa, Homo Sapiens
IVQFVGVSS

SEQ ID NO: 1036681 - protein, 9 aa, Homo Sapiens
VHGESTSGG

SEQ ID NO: 1036682 - protein, 9 aa, Homo Sapiens
LHDRVVFKS

SEQ ID NO: 1036683 - protein, 9 aa, Homo Sapiens
DAPAPSKRA

SEQ ID NO: 1036684 - protein, 9 aa, Homo Sapiens
PMWISTTTT

SEQ ID NO: 1036685 - protein, 9 aa, Homo Sapiens
LITEKKHFR

SEQ ID NO: 1036686 - protein, 9 aa, Homo Sapiens
GNQTFSGTG

SEQ ID NO: 1036687 - protein, 9 aa, Homo Sapiens
PGAHGGPGK

SEQ ID NO: 1036688 - protein, 9 aa, Homo Sapiens
APLSHPSLL

SEQ ID NO: 1036689 - protein, 9 aa, Homo Sapiens
LFFRRPNVI

SEQ ID NO: 1036690 - protein, 9 aa, Homo Sapiens
GSRHHETST

SEQ ID NO: 1036691 - protein, 9 aa, Homo Sapiens
ISNEVVFDV

SEQ ID NO: 1036692 - protein, 9 aa, Homo Sapiens
PNARRVHEP

SEQ ID NO: 1036693 - protein, 9 aa, Homo Sapiens
DGTASDPSG

SEQ ID NO: 1036694 - protein, 9 aa, Homo Sapiens
KKLGLMFDN

SEQ ID NO: 1036695 - protein, 9 aa, Homo Sapiens
LKVLEEENL

SEQ ID NO: 1036696 - protein, 9 aa, Homo Sapiens
IRAADTDED

SEQ ID NO: 1036697 - protein, 9 aa, Homo Sapiens
KEEGTKRML

SEQ ID NO: 1036698 - protein, 9 aa, Homo Sapiens
KVETFSSVY

SEQ ID NO: 1036699 - protein, 9 aa, Homo Sapiens
PKPSFPGSV

SEQ ID NO: 1036700 - protein, 9 aa, Homo Sapiens
ASGHKSFVP

SEQ ID NO: 1036701 - protein, 9 aa, Homo Sapiens
FSGREKIVI

SEQ ID NO: 1036702 - protein, 9 aa, Homo Sapiens
HDRQIPSPD

SEQ ID NO: 1036703 - protein, 9 aa, Homo Sapiens
EHFPSYAPL

SEQ ID NO: 1036704 - protein, 9 aa, Homo Sapiens
VLEAGISHR

SEQ ID NO: 1036705 - protein, 9 aa, Homo Sapiens
QKKFDRVTL

SEQ ID NO: 1036706 - protein, 9 aa, Homo Sapiens
KTQSLEGKQ

SEQ ID NO: 1036707 - protein, 9 aa, Homo Sapiens
AFSTCAFHL

SEQ ID NO: 1036708 - protein, 9 aa, Homo Sapiens
TVSGQCLGE

SEQ ID NO: 1036709 - protein, 9 aa, Homo Sapiens
GDNKLQKLG

SEQ ID NO: 1036710 - protein, 9 aa, Homo Sapiens
AGDNAAEEA

SEQ ID NO: 1036711 - protein, 9 aa, Homo Sapiens
SSCGYPGVP

SEQ ID NO: 1036712 - protein, 9 aa, Homo Sapiens
TAIHHVHSL

SEQ ID NO: 1036713 - protein, 9 aa, Homo Sapiens
EEEQKDDND

SEQ ID NO: 1036714 - protein, 9 aa, Homo Sapiens
PALGTSQLP

SEQ ID NO: 1036715 - protein, 9 aa, Homo Sapiens
IFVISRHEM

SEQ ID NO: 1036716 - protein, 9 aa, Homo Sapiens
DVIDQAPAE

SEQ ID NO: 1036717 - protein, 9 aa, Homo Sapiens
KEGSSNQQV

SEQ ID NO: 1036718 - protein, 9 aa, Homo Sapiens
HFFCDFLSL

SEQ ID NO: 1036719 - protein, 9 aa, Homo Sapiens
GVDASKVVL

SEQ ID NO: 1036720 - protein, 9 aa, Homo Sapiens
GNANLTKTQ

SEQ ID NO: 1036721 - protein, 9 aa, Homo Sapiens
LAKGQQMLA

SEQ ID NO: 1036722 - protein, 9 aa, Homo Sapiens
PDGGPRLQA

SEQ ID NO: 1036723 - protein, 9 aa, Homo Sapiens
GATDLPKIS

SEQ ID NO: 1036724 - protein, 9 aa, Homo Sapiens
TNPSHSFAF

SEQ ID NO: 1036725 - protein, 9 aa, Homo Sapiens
TLVYADQIS

SEQ ID NO: 1036726 - protein, 9 aa, Homo Sapiens
VKQKRLHSS

SEQ ID NO: 1036727 - protein, 9 aa, Homo Sapiens
ANVSQLATC

SEQ ID NO: 1036728 - protein, 9 aa, Homo Sapiens
DEDGQVNYE

SEQ ID NO: 1036729 - protein, 9 aa, Homo Sapiens
ILTEAHQDE

SEQ ID NO: 1036730 - protein, 9 aa, Homo Sapiens
NRLTRRASV

SEQ ID NO: 1036731 - protein, 9 aa, Homo Sapiens
LSLLILSCS

SEQ ID NO: 1036732 - protein, 9 aa, Homo Sapiens
TIISYLNLE

SEQ ID NO: 1036733 - protein, 9 aa, Homo Sapiens
KKLPSPRIS

SEQ ID NO: 1036734 - protein, 9 aa, Homo Sapiens
REEAVMRRL

SEQ ID NO: 1036735 - protein, 9 aa, Homo Sapiens
AVLLAGDPD

SEQ ID NO: 1036736 - protein, 9 aa, Homo Sapiens
TWEIILRCQ

SEQ ID NO: 1036737 - protein, 9 aa, Homo Sapiens
KQFDSLMPS

SEQ ID NO: 1036738 - protein, 9 aa, Homo Sapiens
ADFPKKLSI

SEQ ID NO: 1036739 - protein, 9 aa, Homo Sapiens
EICRLAVPV

SEQ ID NO: 1036740 - protein, 9 aa, Homo Sapiens
QEKIPKLRR

SEQ ID NO: 1036741 - protein, 9 aa, Homo Sapiens
NAESTEMEF

SEQ ID NO: 1036742 - protein, 9 aa, Homo Sapiens
TFNTEAVGF

SEQ ID NO: 1036743 - protein, 9 aa, Homo Sapiens
SGHGGCVNG

SEQ ID NO: 1036744 - protein, 9 aa, Homo Sapiens
VWQKVSAEA

SEQ ID NO: 1036745 - protein, 9 aa, Homo Sapiens
EGQNMAVLL

SEQ ID NO: 1036746 - protein, 9 aa, Homo Sapiens
DPKKFAGGS

SEQ ID NO: 1036747 - protein, 9 aa, Homo Sapiens
LSIQLSSVD

SEQ ID NO: 1036748 - protein, 9 aa, Homo Sapiens
RRKLEPPEQ

SEQ ID NO: 1036749 - protein, 9 aa, Homo Sapiens
TLIFSLRNP

SEQ ID NO: 1036750 - protein, 9 aa, Homo Sapiens
TIPNRIDLV

SEQ ID NO: 1036751 - protein, 9 aa, Homo Sapiens
KEQVCLHDL

SEQ ID NO: 1036752 - protein, 9 aa, Homo Sapiens
GAVKEGARA

SEQ ID NO: 1036753 - protein, 9 aa, Homo Sapiens
WILNATLRN

SEQ ID NO: 1036754 - protein, 9 aa, Homo Sapiens
WRTSDGLMD

SEQ ID NO: 1036755 - protein, 9 aa, Homo Sapiens
ADSSGASSP

SEQ ID NO: 1036756 - protein, 9 aa, Homo Sapiens
GFKLLRKMG

SEQ ID NO: 1036757 - protein, 9 aa, Homo Sapiens
GIAEVTIWP

SEQ ID NO: 1036758 - protein, 9 aa, Homo Sapiens
FYVFLHAIL

SEQ ID NO: 1036759 - protein, 9 aa, Homo Sapiens
KMSHSRKKL

SEQ ID NO: 1036760 - protein, 9 aa, Homo Sapiens
CVWLFISEP

SEQ ID NO: 1036761 - protein, 9 aa, Homo Sapiens
RSTASHLVG

SEQ ID NO: 1036762 - protein, 9 aa, Homo Sapiens
NFIIQVTFF

SEQ ID NO: 1036763 - protein, 9 aa, Homo Sapiens
VVKVAEYKY

SEQ ID NO: 1036764 - protein, 9 aa, Homo Sapiens
RLEKFQNWD

SEQ ID NO: 1036765 - protein, 9 aa, Homo Sapiens
QGYIKAHAG

SEQ ID NO: 1036766 - protein, 9 aa, Homo Sapiens
LARAKEAAP

SEQ ID NO: 1036767 - protein, 9 aa, Homo Sapiens
LASDGGAVK

SEQ ID NO: 1036768 - protein, 9 aa, Homo Sapiens
DQEYCVCKM

SEQ ID NO: 1036769 - protein, 9 aa, Homo Sapiens
LPKISIPSV

SEQ ID NO: 1036770 - protein, 9 aa, Homo Sapiens
QRFDRTLRC

SEQ ID NO: 1036771 - protein, 9 aa, Homo Sapiens
FLLAMRANA

SEQ ID NO: 1036772 - protein, 9 aa, Homo Sapiens
ATYLYREPV

SEQ ID NO: 1036773 - protein, 9 aa, Homo Sapiens
QWFLSSQPL

SEQ ID NO: 1036774 - protein, 9 aa, Homo Sapiens
QETPLKPIP

SEQ ID NO: 1036775 - protein, 9 aa, Homo Sapiens
CLGLVSLLR

SEQ ID NO: 1036776 - protein, 9 aa, Homo Sapiens
LVSGDNYPL

SEQ ID NO: 1036777 - protein, 9 aa, Homo Sapiens
QQMAQNQTT

SEQ ID NO: 1036778 - protein, 9 aa, Homo Sapiens
AGESESEHQ

SEQ ID NO: 1036779 - protein, 9 aa, Homo Sapiens
PFSNGSLVG

SEQ ID NO: 1036780 - protein, 9 aa, Homo Sapiens
CNSETQSRH

SEQ ID NO: 1036781 - protein, 9 aa, Homo Sapiens
EGFIRLNSV

SEQ ID NO: 1036782 - protein, 9 aa, Homo Sapiens
KARGVLKCN

SEQ ID NO: 1036783 - protein, 9 aa, Homo Sapiens
RKRAAPCGA

SEQ ID NO: 1036784 - protein, 9 aa, Homo Sapiens
VTFLGKGGM

SEQ ID NO: 1036785 - protein, 9 aa, Homo Sapiens
GDTVIDPNR

SEQ ID NO: 1036786 - protein, 9 aa, Homo Sapiens
SSPGSADPD

SEQ ID NO: 1036787 - protein, 9 aa, Homo Sapiens
QRHGVVLSE

SEQ ID NO: 1036788 - protein, 9 aa, Homo Sapiens
MENFSKECE

SEQ ID NO: 1036789 - protein, 9 aa, Homo Sapiens
SVHNLLRAF

SEQ ID NO: 1036790 - protein, 9 aa, Homo Sapiens
RLVNLVVKD

SEQ ID NO: 1036791 - protein, 9 aa, Homo Sapiens
KAKMIYSKF

SEQ ID NO: 1036792 - protein, 9 aa, Homo Sapiens
QKDCQARSQ

SEQ ID NO: 1036793 - protein, 9 aa, Homo Sapiens
GWAKFTALY

SEQ ID NO: 1036794 - protein, 9 aa, Homo Sapiens
IQKVEVTNM

SEQ ID NO: 1036795 - protein, 9 aa, Homo Sapiens
TFVLGTENV

SEQ ID NO: 1036796 - protein, 9 aa, Homo Sapiens
GFSDFLKSH

SEQ ID NO: 1036797 - protein, 9 aa, Homo Sapiens
CEDGSLDFQ

SEQ ID NO: 1036798 - protein, 9 aa, Homo Sapiens
TCCLQKFNI

SEQ ID NO: 1036799 - protein, 9 aa, Homo Sapiens
SSAFTSFLL

SEQ ID NO: 1036800 - protein, 9 aa, Homo Sapiens
GRKPVDTGP

SEQ ID NO: 1036801 - protein, 9 aa, Homo Sapiens
SSGKIYNIW

SEQ ID NO: 1036802 - protein, 9 aa, Homo Sapiens
FQSCNTDSC

SEQ ID NO: 1036803 - protein, 9 aa, Homo Sapiens
LEKIEKERD

SEQ ID NO: 1036804 - protein, 9 aa, Homo Sapiens
YPLYHSVYK

SEQ ID NO: 1036805 - protein, 9 aa, Homo Sapiens
PGGFLEGPA

SEQ ID NO: 1036806 - protein, 9 aa, Homo Sapiens
LEKCCTHNN

SEQ ID NO: 1036807 - protein, 9 aa, Homo Sapiens
LTKRLSYCK

SEQ ID NO: 1036808 - protein, 9 aa, Homo Sapiens
AWRYYATIP

SEQ ID NO: 1036809 - protein, 9 aa, Homo Sapiens
EYTALISVF

SEQ ID NO: 1036810 - protein, 9 aa, Homo Sapiens
MKISELNAK

SEQ ID NO: 1036811 - protein, 9 aa, Homo Sapiens
GLGVATLER

SEQ ID NO: 1036812 - protein, 9 aa, Homo Sapiens
DPCQCVSHG

SEQ ID NO: 1036813 - protein, 9 aa, Homo Sapiens
GNGADLPNH

SEQ ID NO: 1036814 - protein, 9 aa, Homo Sapiens
PFLGISRGT

SEQ ID NO: 1036815 - protein, 9 aa, Homo Sapiens
RCSPEKKVQ

SEQ ID NO: 1036816 - protein, 9 aa, Homo Sapiens
HKIEEPKIE

SEQ ID NO: 1036817 - protein, 9 aa, Homo Sapiens
DNSSNEKLK

SEQ ID NO: 1036818 - protein, 9 aa, Homo Sapiens
RKMTEIELS

SEQ ID NO: 1036819 - protein, 9 aa, Homo Sapiens
VSYVLGIPM

SEQ ID NO: 1036820 - protein, 9 aa, Homo Sapiens
AAFYLIVAR

SEQ ID NO: 1036821 - protein, 9 aa, Homo Sapiens
AASLRSCTG

SEQ ID NO: 1036822 - protein, 9 aa, Homo Sapiens
IHSSGGWAK

SEQ ID NO: 1036823 - protein, 9 aa, Homo Sapiens
PRPQNHGTN

SEQ ID NO: 1036824 - protein, 9 aa, Homo Sapiens
KRALGPASA

SEQ ID NO: 1036825 - protein, 9 aa, Homo Sapiens
SLSSNLGYY

SEQ ID NO: 1036826 - protein, 9 aa, Homo Sapiens
NQASDTFSE

SEQ ID NO: 1036827 - protein, 9 aa, Homo Sapiens
QNWSPVMPR

SEQ ID NO: 1036828 - protein, 9 aa, Homo Sapiens
AAWRYYATI

SEQ ID NO: 1036829 - protein, 9 aa, Homo Sapiens
TKQDPPDAK

SEQ ID NO: 1036830 - protein, 9 aa, Homo Sapiens
ARTVFKEEK

SEQ ID NO: 1036831 - protein, 9 aa, Homo Sapiens
TINLRRLSF

SEQ ID NO: 1036832 - protein, 9 aa, Homo Sapiens
CTFSWLIFI

SEQ ID NO: 1036833 - protein, 9 aa, Homo Sapiens
KLPGEGIAG

SEQ ID NO: 1036834 - protein, 9 aa, Homo Sapiens
QNMMAEQTL

SEQ ID NO: 1036835 - protein, 9 aa, Homo Sapiens
WNPQVPSMM

SEQ ID NO: 1036836 - protein, 9 aa, Homo Sapiens
VPDSPDFEV

SEQ ID NO: 1036837 - protein, 9 aa, Homo Sapiens
RLSWSGISK

SEQ ID NO: 1036838 - protein, 9 aa, Homo Sapiens
SGYGPSNGP

SEQ ID NO: 1036839 - protein, 9 aa, Homo Sapiens
GTQNDVDRE

SEQ ID NO: 1036840 - protein, 9 aa, Homo Sapiens
LIPGPGEAP

SEQ ID NO: 1036841 - protein, 9 aa, Homo Sapiens
STSPGRKPV

SEQ ID NO: 1036842 - protein, 9 aa, Homo Sapiens
PTPRGPETE

SEQ ID NO: 1036843 - protein, 9 aa, Homo Sapiens
EVNPDEEVQ

SEQ ID NO: 1036844 - protein, 9 aa, Homo Sapiens
RGLAGPKRE

SEQ ID NO: 1036845 - protein, 9 aa, Homo Sapiens
SFGEEPLAP

SEQ ID NO: 1036846 - protein, 9 aa, Homo Sapiens
HSRSSENVS

SEQ ID NO: 1036847 - protein, 9 aa, Homo Sapiens
HDSELLFTA

SEQ ID NO: 1036848 - protein, 9 aa, Homo Sapiens
FSRTTSPCS

SEQ ID NO: 1036849 - protein, 9 aa, Homo Sapiens
APSALCTPS

SEQ ID NO: 1036850 - protein, 9 aa, Homo Sapiens
NIKNSRCEQ

SEQ ID NO: 1036851 - protein, 9 aa, Homo Sapiens
PMLVSVSQS

SEQ ID NO: 1036852 - protein, 9 aa, Homo Sapiens
CKQFVIGGK

SEQ ID NO: 1036853 - protein, 9 aa, Homo Sapiens
IIHTDEANS

SEQ ID NO: 1036854 - protein, 9 aa, Homo Sapiens
FLRNFFFLE

SEQ ID NO: 1036855 - protein, 9 aa, Homo Sapiens
GSDYKFTEG

SEQ ID NO: 1036856 - protein, 9 aa, Homo Sapiens
VQKSKKEPG

SEQ ID NO: 1036857 - protein, 9 aa, Homo Sapiens
ENKILKQIV

SEQ ID NO: 1036858 - protein, 9 aa, Homo Sapiens
TASFVCVPT

SEQ ID NO: 1036859 - protein, 9 aa, Homo Sapiens
THEYYPYIS

SEQ ID NO: 1036860 - protein, 9 aa, Homo Sapiens
LGVKDGTAS

SEQ ID NO: 1036861 - protein, 9 aa, Homo Sapiens
PYYSAYVPR

SEQ ID NO: 1036862 - protein, 9 aa, Homo Sapiens
VPGLCLRGQ

SEQ ID NO: 1036863 - protein, 9 aa, Homo Sapiens
PTFSGSHKA

SEQ ID NO: 1036864 - protein, 9 aa, Homo Sapiens
MAEQTLSRP

SEQ ID NO: 1036865 - protein, 9 aa, Homo Sapiens
EDRVSLSKG

SEQ ID NO: 1036866 - protein, 9 aa, Homo Sapiens
LPCRFTLSP

SEQ ID NO: 1036867 - protein, 9 aa, Homo Sapiens
VQMNLHPVP

SEQ ID NO: 1036868 - protein, 9 aa, Homo Sapiens
RMLFAWAVR

SEQ ID NO: 1036869 - protein, 9 aa, Homo Sapiens
SRSSPDQGE

SEQ ID NO: 1036870 - protein, 9 aa, Homo Sapiens
YKTYELVEK

SEQ ID NO: 1036871 - protein, 9 aa, Homo Sapiens
DVERCPVKT

SEQ ID NO: 1036872 - protein, 9 aa, Homo Sapiens
SAVALEQNI

SEQ ID NO: 1036873 - protein, 9 aa, Homo Sapiens
GQSTEVKVK

SEQ ID NO: 1036874 - protein, 9 aa, Homo Sapiens
FQALKDEFH

SEQ ID NO: 1036875 - protein, 9 aa, Homo Sapiens
SCLDGFTGR

SEQ ID NO: 1036876 - protein, 9 aa, Homo Sapiens
GPGSRCSPE

SEQ ID NO: 1036877 - protein, 9 aa, Homo Sapiens
EVSLLAESE

SEQ ID NO: 1036878 - protein, 9 aa, Homo Sapiens
CQLIVNKWE

SEQ ID NO: 1036879 - protein, 9 aa, Homo Sapiens
KKEELVARL

SEQ ID NO: 1036880 - protein, 9 aa, Homo Sapiens
QSHAQGGHW

SEQ ID NO: 1036881 - protein, 9 aa, Homo Sapiens
ACYKCKING

SEQ ID NO: 1036882 - protein, 9 aa, Homo Sapiens
GRRLVKGLD

SEQ ID NO: 1036883 - protein, 9 aa, Homo Sapiens
AQLFRGEDS

SEQ ID NO: 1036884 - protein, 9 aa, Homo Sapiens
VGNKRMSAE

SEQ ID NO: 1036885 - protein, 9 aa, Homo Sapiens
VSICLKAGT

SEQ ID NO: 1036886 - protein, 9 aa, Homo Sapiens
DNLGYTYET

SEQ ID NO: 1036887 - protein, 9 aa, Homo Sapiens
LPLPDVPKG

SEQ ID NO: 1036888 - protein, 9 aa, Homo Sapiens
LMRTLSKLA

SEQ ID NO: 1036889 - protein, 9 aa, Homo Sapiens
CYESIGYCW

SEQ ID NO: 1036890 - protein, 9 aa, Homo Sapiens
DVPGQPGTK

SEQ ID NO: 1036891 - protein, 9 aa, Homo Sapiens
GSIPPSTPK

SEQ ID NO: 1036892 - protein, 9 aa, Homo Sapiens
SLNLYNNHR

SEQ ID NO: 1036893 - protein, 9 aa, Homo Sapiens
ALRRKFGDN

SEQ ID NO: 1036894 - protein, 9 aa, Homo Sapiens
RLGRVPGLC

SEQ ID NO: 1036895 - protein, 9 aa, Homo Sapiens
YGSYSSSPH

SEQ ID NO: 1036896 - protein, 9 aa, Homo Sapiens
MTKCRLEQE

SEQ ID NO: 1036897 - protein, 9 aa, Homo Sapiens
RVFFGVSEQ

SEQ ID NO: 1036898 - protein, 9 aa, Homo Sapiens
VLDATEILG

SEQ ID NO: 1036899 - protein, 9 aa, Homo Sapiens
EESSKQARG

SEQ ID NO: 1036900 - protein, 9 aa, Homo Sapiens
KYSQGQVHY

SEQ ID NO: 1036901 - protein, 9 aa, Homo Sapiens
SQDNISVSS

SEQ ID NO: 1036902 - protein, 9 aa, Homo Sapiens
YYNVIFGWS

SEQ ID NO: 1036903 - protein, 9 aa, Homo Sapiens
FSPKELMPP

SEQ ID NO: 1036904 - protein, 9 aa, Homo Sapiens
AVPFFSQQS

SEQ ID NO: 1036905 - protein, 9 aa, Homo Sapiens
SGDNYPLPN

SEQ ID NO: 1036906 - protein, 9 aa, Homo Sapiens
METPMHKNP

SEQ ID NO: 1036907 - protein, 9 aa, Homo Sapiens
NIRLKLTKE

SEQ ID NO: 1036908 - protein, 9 aa, Homo Sapiens
VLPIPVLSN

SEQ ID NO: 1036909 - protein, 9 aa, Homo Sapiens
MNSSACKKS

SEQ ID NO: 1036910 - protein, 9 aa, Homo Sapiens
SILISRRHF

SEQ ID NO: 1036911 - protein, 9 aa, Homo Sapiens
SSQGDNKLQ

SEQ ID NO: 1036912 - protein, 9 aa, Homo Sapiens
LERRGRGRE

SEQ ID NO: 1036913 - protein, 9 aa, Homo Sapiens
ASCEMQIVD

SEQ ID NO: 1036914 - protein, 9 aa, Homo Sapiens
QNIDATTEP

SEQ ID NO: 1036915 - protein, 9 aa, Homo Sapiens
RKQELREWI

SEQ ID NO: 1036916 - protein, 9 aa, Homo Sapiens
TAPHPHLAP

SEQ ID NO: 1036917 - protein, 9 aa, Homo Sapiens
WEPFSFFFD

SEQ ID NO: 1036918 - protein, 9 aa, Homo Sapiens
AEAFSGREK

SEQ ID NO: 1036919 - protein, 9 aa, Homo Sapiens
WFLSSQPLL

SEQ ID NO: 1036920 - protein, 9 aa, Homo Sapiens
LYVRPVSNF

SEQ ID NO: 1036921 - protein, 9 aa, Homo Sapiens
LMFIIFCYT

SEQ ID NO: 1036922 - protein, 9 aa, Homo Sapiens
NLATEKIER

SEQ ID NO: 1036923 - protein, 9 aa, Homo Sapiens
CWHIGQPNK

SEQ ID NO: 1036924 - protein, 9 aa, Homo Sapiens
INVYLKEDI

SEQ ID NO: 1036925 - protein, 9 aa, Homo Sapiens
TPRNYKLRE

SEQ ID NO: 1036926 - protein, 9 aa, Homo Sapiens
SSPTYRDCF

SEQ ID NO: 1036927 - protein, 9 aa, Homo Sapiens
DKITISGRC

SEQ ID NO: 1036928 - protein, 9 aa, Homo Sapiens
LGILLQVEG

SEQ ID NO: 1036929 - protein, 9 aa, Homo Sapiens
NGKWQEFRT

SEQ ID NO: 1036930 - protein, 9 aa, Homo Sapiens
GENIGEHCL

SEQ ID NO: 1036931 - protein, 9 aa, Homo Sapiens
QCAEDKKTR

SEQ ID NO: 1036932 - protein, 9 aa, Homo Sapiens
SLADYCTQP

SEQ ID NO: 1036933 - protein, 9 aa, Homo Sapiens
AKVSVVPKI

SEQ ID NO: 1036934 - protein, 9 aa, Homo Sapiens
RGPEEDSPW

SEQ ID NO: 1036935 - protein, 9 aa, Homo Sapiens
YVFSVMESS

SEQ ID NO: 1036936 - protein, 9 aa, Homo Sapiens
ALFRMDKEQ

SEQ ID NO: 1036937 - protein, 9 aa, Homo Sapiens
GAEVQLQLQ

SEQ ID NO: 1036938 - protein, 9 aa, Homo Sapiens
EIFNHFVQN

SEQ ID NO: 1036939 - protein, 9 aa, Homo Sapiens
QPLDLKCNY

SEQ ID NO: 1036940 - protein, 9 aa, Homo Sapiens
ISVVHKRVP

SEQ ID NO: 1036941 - protein, 9 aa, Homo Sapiens
SQYFKDPHV

SEQ ID NO: 1036942 - protein, 9 aa, Homo Sapiens
SDYLVNGIF

SEQ ID NO: 1036943 - protein, 9 aa, Homo Sapiens
LGLGAPEEP

SEQ ID NO: 1036944 - protein, 9 aa, Homo Sapiens
YREASKKAE

SEQ ID NO: 1036945 - protein, 9 aa, Homo Sapiens
SGADKLENN

SEQ ID NO: 1036946 - protein, 9 aa, Homo Sapiens
LPPGPPPRA

SEQ ID NO: 1036947 - protein, 9 aa, Homo Sapiens
GNSHVCNCS

SEQ ID NO: 1036948 - protein, 9 aa, Homo Sapiens
YIEQQKTIK

SEQ ID NO: 1036949 - protein, 9 aa, Homo Sapiens
NIKPGMFCA

SEQ ID NO: 1036950 - protein, 9 aa, Homo Sapiens
HAAAQSVLT

SEQ ID NO: 1036951 - protein, 9 aa, Homo Sapiens
ATQKDRGPV

SEQ ID NO: 1036952 - protein, 9 aa, Homo Sapiens
STARTVFKE

SEQ ID NO: 1036953 - protein, 9 aa, Homo Sapiens
KESPVIPLL

SEQ ID NO: 1036954 - protein, 9 aa, Homo Sapiens
GYAGNTESQ

SEQ ID NO: 1036955 - protein, 9 aa, Homo Sapiens
VVHTGGANS

SEQ ID NO: 1036956 - protein, 9 aa, Homo Sapiens
NTELYFDHS

SEQ ID NO: 1036957 - protein, 9 aa, Homo Sapiens
KYNLATEKI

SEQ ID NO: 1036958 - protein, 9 aa, Homo Sapiens
PELHLKPLN

SEQ ID NO: 1036959 - protein, 9 aa, Homo Sapiens
GGYVQLLKQ

SEQ ID NO: 1036960 - protein, 9 aa, Homo Sapiens
AANAPDPLH

SEQ ID NO: 1036961 - protein, 9 aa, Homo Sapiens
FLAEAENMA

SEQ ID NO: 1036962 - protein, 9 aa, Homo Sapiens
TIIFIILGV

SEQ ID NO: 1036963 - protein, 9 aa, Homo Sapiens
LCQKTMASV

SEQ ID NO: 1036964 - protein, 9 aa, Homo Sapiens
HPRGLRISP

SEQ ID NO: 1036965 - protein, 9 aa, Homo Sapiens
LASDFIGLQ

SEQ ID NO: 1036966 - protein, 9 aa, Homo Sapiens
CGSGTQQRK

SEQ ID NO: 1036967 - protein, 9 aa, Homo Sapiens
IFIILGVGS

SEQ ID NO: 1036968 - protein, 9 aa, Homo Sapiens
DHLGRAVQT

SEQ ID NO: 1036969 - protein, 9 aa, Homo Sapiens
EVTSLSSTS

SEQ ID NO: 1036970 - protein, 9 aa, Homo Sapiens
QLFNSLGLH

SEQ ID NO: 1036971 - protein, 9 aa, Homo Sapiens
QQLNDEAQY

SEQ ID NO: 1036972 - protein, 9 aa, Homo Sapiens
RKPVTIDCG

SEQ ID NO: 1036973 - protein, 9 aa, Homo Sapiens
ATLRNRVCI

SEQ ID NO: 1036974 - protein, 9 aa, Homo Sapiens
KQPQVYGNN

SEQ ID NO: 1036975 - protein, 9 aa, Homo Sapiens
LNCLKQYSR

SEQ ID NO: 1036976 - protein, 9 aa, Homo Sapiens
NRGHSHNAL

SEQ ID NO: 1036977 - protein, 9 aa, Homo Sapiens
EKKSNPKGV

SEQ ID NO: 1036978 - protein, 9 aa, Homo Sapiens
SGAGESESE

SEQ ID NO: 1036979 - protein, 9 aa, Homo Sapiens
ENATDINDN

SEQ ID NO: 1036980 - protein, 9 aa, Homo Sapiens
RSLGIKFSD

SEQ ID NO: 1036981 - protein, 9 aa, Homo Sapiens
LIINSINKK

SEQ ID NO: 1036982 - protein, 9 aa, Homo Sapiens
TFLGKGGMI

SEQ ID NO: 1036983 - protein, 9 aa, Homo Sapiens
SDYFKCKKI

SEQ ID NO: 1036984 - protein, 9 aa, Homo Sapiens
STELQAKLS

SEQ ID NO: 1036985 - protein, 9 aa, Homo Sapiens
VIEPQNENG

SEQ ID NO: 1036986 - protein, 9 aa, Homo Sapiens
ISRPPSRSA

SEQ ID NO: 1036987 - protein, 9 aa, Homo Sapiens
STLVYADQI

SEQ ID NO: 1036988 - protein, 9 aa, Homo Sapiens
RTQQYPYLH

SEQ ID NO: 1036989 - protein, 9 aa, Homo Sapiens
KADSPAEAF

SEQ ID NO: 1036990 - protein, 9 aa, Homo Sapiens
SVPTTWEYN

SEQ ID NO: 1036991 - protein, 9 aa, Homo Sapiens
LSTVSVTGR

SEQ ID NO: 1036992 - protein, 9 aa, Homo Sapiens
STQADSSFA

SEQ ID NO: 1036993 - protein, 9 aa, Homo Sapiens
ISGKIRTKG

SEQ ID NO: 1036994 - protein, 9 aa, Homo Sapiens
KTFNQGSTL

SEQ ID NO: 1036995 - protein, 9 aa, Homo Sapiens
HRYYAVDKI

SEQ ID NO: 1036996 - protein, 9 aa, Homo Sapiens
VIFLVCLAI

SEQ ID NO: 1036997 - protein, 9 aa, Homo Sapiens
IQTESTFKN

SEQ ID NO: 1036998 - protein, 9 aa, Homo Sapiens
SQVVVQASC

SEQ ID NO: 1036999 - protein, 9 aa, Homo Sapiens
SKRALFTAV

SEQ ID NO: 1037000 - protein, 9 aa, Homo Sapiens
VSANQAAFG

SEQ ID NO: 1037001 - protein, 9 aa, Homo Sapiens
AAVKAVEVP

SEQ ID NO: 1037002 - protein, 9 aa, Homo Sapiens
SSLSQQTLR

SEQ ID NO: 1037003 - protein, 9 aa, Homo Sapiens
RNFTTPQDG

SEQ ID NO: 1037004 - protein, 9 aa, Homo Sapiens
SVLLNSLPL

SEQ ID NO: 1037005 - protein, 9 aa, Homo Sapiens
AYPDPSPEA

SEQ ID NO: 1037006 - protein, 9 aa, Homo Sapiens
TSVDKSQSV

SEQ ID NO: 1037007 - protein, 9 aa, Homo Sapiens
RALPGPAER

SEQ ID NO: 1037008 - protein, 9 aa, Homo Sapiens
FTTIYGRVI

SEQ ID NO: 1037009 - protein, 9 aa, Homo Sapiens
RPLEVSQRL

SEQ ID NO: 1037010 - protein, 9 aa, Homo Sapiens
VLHIRKLLL

SEQ ID NO: 1037011 - protein, 9 aa, Homo Sapiens
LRCDPILSH

SEQ ID NO: 1037012 - protein, 9 aa, Homo Sapiens
SETTITSTT

SEQ ID NO: 1037013 - protein, 9 aa, Homo Sapiens
LARRDDNPL

SEQ ID NO: 1037014 - protein, 9 aa, Homo Sapiens
QYSCRQFSS

SEQ ID NO: 1037015 - protein, 9 aa, Homo Sapiens
VCIAETWLG

SEQ ID NO: 1037016 - protein, 9 aa, Homo Sapiens
KQEKTKKHP

SEQ ID NO: 1037017 - protein, 9 aa, Homo Sapiens
ELREEAVMR

SEQ ID NO: 1037018 - protein, 9 aa, Homo Sapiens
RIVLMLGFV

SEQ ID NO: 1037019 - protein, 9 aa, Homo Sapiens
GTSQLPQHL

SEQ ID NO: 1037020 - protein, 9 aa, Homo Sapiens
MQMPQVPNK

SEQ ID NO: 1037021 - protein, 9 aa, Homo Sapiens
TLEEILYKL

SEQ ID NO: 1037022 - protein, 9 aa, Homo Sapiens
RLGLPGKAE

SEQ ID NO: 1037023 - protein, 9 aa, Homo Sapiens
NGFHGHPTV

SEQ ID NO: 1037024 - protein, 9 aa, Homo Sapiens
YRDNTKEIP

SEQ ID NO: 1037025 - protein, 9 aa, Homo Sapiens
KRFSFFQRS

SEQ ID NO: 1037026 - protein, 9 aa, Homo Sapiens
HQTYSFNLP

SEQ ID NO: 1037027 - protein, 9 aa, Homo Sapiens
FSGFTALPA

SEQ ID NO: 1037028 - protein, 9 aa, Homo Sapiens
SAVHTFNQQ

SEQ ID NO: 1037029 - protein, 9 aa, Homo Sapiens
LSLLEAEAT

SEQ ID NO: 1037030 - protein, 9 aa, Homo Sapiens
NQAAFGVQG

SEQ ID NO: 1037031 - protein, 9 aa, Homo Sapiens
QETSVFISS

SEQ ID NO: 1037032 - protein, 9 aa, Homo Sapiens
IRDARGGAE

SEQ ID NO: 1037033 - protein, 9 aa, Homo Sapiens
KDCQARSQA

SEQ ID NO: 1037034 - protein, 9 aa, Homo Sapiens
GRLPDLINN

SEQ ID NO: 1037035 - protein, 9 aa, Homo Sapiens
RFPIKSSLQ

SEQ ID NO: 1037036 - protein, 9 aa, Homo Sapiens
AAYTFNTEA

SEQ ID NO: 1037037 - protein, 9 aa, Homo Sapiens
TEILSLKMS

SEQ ID NO: 1037038 - protein, 9 aa, Homo Sapiens
TCLKQQMKK

SEQ ID NO: 1037039 - protein, 9 aa, Homo Sapiens
DSNGLSNPY

SEQ ID NO: 1037040 - protein, 9 aa, Homo Sapiens
KNYPNAGLI

SEQ ID NO: 1037041 - protein, 9 aa, Homo Sapiens
ILEVSSPTD

SEQ ID NO: 1037042 - protein, 9 aa, Homo Sapiens
CLDQNCSNR

SEQ ID NO: 1037043 - protein, 9 aa, Homo Sapiens
SHNLLDQIP

SEQ ID NO: 1037044 - protein, 9 aa, Homo Sapiens
GTLQQQPSA

SEQ ID NO: 1037045 - protein, 9 aa, Homo Sapiens
FFRRPNVIT

SEQ ID NO: 1037046 - protein, 9 aa, Homo Sapiens
LPLKIREHA

SEQ ID NO: 1037047 - protein, 9 aa, Homo Sapiens
GARLGLPGK

SEQ ID NO: 1037048 - protein, 9 aa, Homo Sapiens
TFTYSLSCI

SEQ ID NO: 1037049 - protein, 9 aa, Homo Sapiens
LLFVTLSYV

SEQ ID NO: 1037050 - protein, 9 aa, Homo Sapiens
MQSLSPDSK

SEQ ID NO: 1037051 - protein, 9 aa, Homo Sapiens
GLMFDNVVG

SEQ ID NO: 1037052 - protein, 9 aa, Homo Sapiens
ARLGLPGKA

SEQ ID NO: 1037053 - protein, 9 aa, Homo Sapiens
RRGSLKRAN

SEQ ID NO: 1037054 - protein, 9 aa, Homo Sapiens
AVFVAVMKF

SEQ ID NO: 1037055 - protein, 9 aa, Homo Sapiens
HSVKTAFIG

SEQ ID NO: 1037056 - protein, 9 aa, Homo Sapiens
TIPLCLAVE

SEQ ID NO: 1037057 - protein, 9 aa, Homo Sapiens
ATSNNFTHS

SEQ ID NO: 1037058 - protein, 9 aa, Homo Sapiens
ESLRDFSAM

SEQ ID NO: 1037059 - protein, 9 aa, Homo Sapiens
NYGFLSELP

SEQ ID NO: 1037060 - protein, 9 aa, Homo Sapiens
AGGGMNVEI

SEQ ID NO: 1037061 - protein, 9 aa, Homo Sapiens
PAPDPAGPE

SEQ ID NO: 1037062 - protein, 9 aa, Homo Sapiens
KPVDTGPPA

SEQ ID NO: 1037063 - protein, 9 aa, Homo Sapiens
PSRNIKPPF

SEQ ID NO: 1037064 - protein, 9 aa, Homo Sapiens
QQMKKGGDV

SEQ ID NO: 1037065 - protein, 9 aa, Homo Sapiens
AMAGFLFCL

SEQ ID NO: 1037066 - protein, 9 aa, Homo Sapiens
EDLKTKINS

SEQ ID NO: 1037067 - protein, 9 aa, Homo Sapiens
IRLAARGPK

SEQ ID NO: 1037068 - protein, 9 aa, Homo Sapiens
GALVCAYDS

SEQ ID NO: 1037069 - protein, 9 aa, Homo Sapiens
EGDENEDDQ

SEQ ID NO: 1037070 - protein, 9 aa, Homo Sapiens
FPAFTMSWV

SEQ ID NO: 1037071 - protein, 9 aa, Homo Sapiens
KSRSGEDRG

SEQ ID NO: 1037072 - protein, 9 aa, Homo Sapiens
KTKINSPWR

SEQ ID NO: 1037073 - protein, 9 aa, Homo Sapiens
VWLFISEPG

SEQ ID NO: 1037074 - protein, 9 aa, Homo Sapiens
SIKKMFGKN

SEQ ID NO: 1037075 - protein, 9 aa, Homo Sapiens
GNFYTLVVS

SEQ ID NO: 1037076 - protein, 9 aa, Homo Sapiens
VQDSFAPRG

SEQ ID NO: 1037077 - protein, 9 aa, Homo Sapiens
IHTDEANSE

SEQ ID NO: 1037078 - protein, 9 aa, Homo Sapiens
LDDRNTFQH

SEQ ID NO: 1037079 - protein, 9 aa, Homo Sapiens
KRKKKEKEM

SEQ ID NO: 1037080 - protein, 9 aa, Homo Sapiens
CVCKMPCNL

SEQ ID NO: 1037081 - protein, 9 aa, Homo Sapiens
GELARQLEK

SEQ ID NO: 1037082 - protein, 9 aa, Homo Sapiens
FNDVGLDNS

SEQ ID NO: 1037083 - protein, 9 aa, Homo Sapiens
CLPISNPEP

SEQ ID NO: 1037084 - protein, 9 aa, Homo Sapiens
SSPRELEGP

SEQ ID NO: 1037085 - protein, 9 aa, Homo Sapiens
RAYLIEGLI

SEQ ID NO: 1037086 - protein, 9 aa, Homo Sapiens
CSPEKKVQT

SEQ ID NO: 1037087 - protein, 9 aa, Homo Sapiens
EYNDNSCIF

SEQ ID NO: 1037088 - protein, 9 aa, Homo Sapiens
LESKEDFRK

SEQ ID NO: 1037089 - protein, 9 aa, Homo Sapiens
TMKILDKQK

SEQ ID NO: 1037090 - protein, 9 aa, Homo Sapiens
GVQKSKKEP

SEQ ID NO: 1037091 - protein, 9 aa, Homo Sapiens
EMEFDLELK

SEQ ID NO: 1037092 - protein, 9 aa, Homo Sapiens
IELLEECII

SEQ ID NO: 1037093 - protein, 9 aa, Homo Sapiens
APAPDPAGP

SEQ ID NO: 1037094 - protein, 9 aa, Homo Sapiens
GDNYQVVTT

SEQ ID NO: 1037095 - protein, 9 aa, Homo Sapiens
AVLLDLTDE

SEQ ID NO: 1037096 - protein, 9 aa, Homo Sapiens
IFCVAGGWA

SEQ ID NO: 1037097 - protein, 9 aa, Homo Sapiens
FSFSRPFWA

SEQ ID NO: 1037098 - protein, 9 aa, Homo Sapiens
LCRSSDGVF

SEQ ID NO: 1037099 - protein, 9 aa, Homo Sapiens
VGMGKARRR

SEQ ID NO: 1037100 - protein, 9 aa, Homo Sapiens
NKVVCDLIK

SEQ ID NO: 1037101 - protein, 9 aa, Homo Sapiens
SGGSSTPEQ

SEQ ID NO: 1037102 - protein, 9 aa, Homo Sapiens
PETVVAVFE

SEQ ID NO: 1037103 - protein, 9 aa, Homo Sapiens
IETMKKVLD

SEQ ID NO: 1037104 - protein, 9 aa, Homo Sapiens
ILFKEQDLR

SEQ ID NO: 1037105 - protein, 9 aa, Homo Sapiens
EKYFMQSDR

SEQ ID NO: 1037106 - protein, 9 aa, Homo Sapiens
YWEVQLEQM

SEQ ID NO: 1037107 - protein, 9 aa, Homo Sapiens
AIYAASSGN

SEQ ID NO: 1037108 - protein, 9 aa, Homo Sapiens
PPVLAGFPG

SEQ ID NO: 1037109 - protein, 9 aa, Homo Sapiens
YEIIAAKIH

SEQ ID NO: 1037110 - protein, 9 aa, Homo Sapiens
GVGFYSAFF

SEQ ID NO: 1037111 - protein, 9 aa, Homo Sapiens
NSSLQISMY

SEQ ID NO: 1037112 - protein, 9 aa, Homo Sapiens
AFFCNLVLI

SEQ ID NO: 1037113 - protein, 9 aa, Homo Sapiens
GTQKKASTG

SEQ ID NO: 1037114 - protein, 9 aa, Homo Sapiens
MEELPGERG

SEQ ID NO: 1037115 - protein, 9 aa, Homo Sapiens
RSRPQQRYS

SEQ ID NO: 1037116 - protein, 9 aa, Homo Sapiens
LTSLSNGIF

SEQ ID NO: 1037117 - protein, 9 aa, Homo Sapiens
DPILSHATL

SEQ ID NO: 1037118 - protein, 9 aa, Homo Sapiens
LPFKEALEP

SEQ ID NO: 1037119 - protein, 9 aa, Homo Sapiens
PGTTYKIKV

SEQ ID NO: 1037120 - protein, 9 aa, Homo Sapiens
SAQIQKPPS

SEQ ID NO: 1037121 - protein, 9 aa, Homo Sapiens
LHEDWKKEK

SEQ ID NO: 1037122 - protein, 9 aa, Homo Sapiens
AEALYSVLR

SEQ ID NO: 1037123 - protein, 9 aa, Homo Sapiens
DDIRYNLFL

SEQ ID NO: 1037124 - protein, 9 aa, Homo Sapiens
QKPLTPRQI

SEQ ID NO: 1037125 - protein, 9 aa, Homo Sapiens
RWATWELYI

SEQ ID NO: 1037126 - protein, 9 aa, Homo Sapiens
SYASTAPKL

SEQ ID NO: 1037127 - protein, 9 aa, Homo Sapiens
EAFTSILNF

SEQ ID NO: 1037128 - protein, 9 aa, Homo Sapiens
TLEASRKSS

SEQ ID NO: 1037129 - protein, 9 aa, Homo Sapiens
SCHFLKKAR

SEQ ID NO: 1037130 - protein, 9 aa, Homo Sapiens
PVLSEKDMI

SEQ ID NO: 1037131 - protein, 9 aa, Homo Sapiens
HLENRARRT

SEQ ID NO: 1037132 - protein, 9 aa, Homo Sapiens
LREGELINW

SEQ ID NO: 1037133 - protein, 9 aa, Homo Sapiens
GMEYLFSHH

SEQ ID NO: 1037134 - protein, 9 aa, Homo Sapiens
GDLYLLFAC

SEQ ID NO: 1037135 - protein, 9 aa, Homo Sapiens
PKILNVGNI

SEQ ID NO: 1037136 - protein, 9 aa, Homo Sapiens
CRKDLSLLE

SEQ ID NO: 1037137 - protein, 9 aa, Homo Sapiens
AANINDMDE

SEQ ID NO: 1037138 - protein, 9 aa, Homo Sapiens
TELQLMGLK

SEQ ID NO: 1037139 - protein, 9 aa, Homo Sapiens
YERIYNEIS

SEQ ID NO: 1037140 - protein, 9 aa, Homo Sapiens
RNHQTYSFN

SEQ ID NO: 1037141 - protein, 9 aa, Homo Sapiens
KIKTSEYST

SEQ ID NO: 1037142 - protein, 9 aa, Homo Sapiens
KVAQLDPKG

SEQ ID NO: 1037143 - protein, 9 aa, Homo Sapiens
GLTCAVFGL

SEQ ID NO: 1037144 - protein, 9 aa, Homo Sapiens
VEQLELQLE

SEQ ID NO: 1037145 - protein, 9 aa, Homo Sapiens
RACYHMKAD

SEQ ID NO: 1037146 - protein, 9 aa, Homo Sapiens
ESSKQARGG

SEQ ID NO: 1037147 - protein, 9 aa, Homo Sapiens
QSCDLVSLH

SEQ ID NO: 1037148 - protein, 9 aa, Homo Sapiens
DIHPVGWCK

SEQ ID NO: 1037149 - protein, 9 aa, Homo Sapiens
RSSPDQGET

SEQ ID NO: 1037150 - protein, 9 aa, Homo Sapiens
SGSQTQPPL

SEQ ID NO: 1037151 - protein, 9 aa, Homo Sapiens
SEFFQFPHG

SEQ ID NO: 1037152 - protein, 9 aa, Homo Sapiens
IDLGTKIYQ

SEQ ID NO: 1037153 - protein, 9 aa, Homo Sapiens
SDVGEKPDS

SEQ ID NO: 1037154 - protein, 9 aa, Homo Sapiens
GAFDLVCAF

SEQ ID NO: 1037155 - protein, 9 aa, Homo Sapiens
YGFLEEVIP

SEQ ID NO: 1037156 - protein, 9 aa, Homo Sapiens
MKSADPSPG

SEQ ID NO: 1037157 - protein, 9 aa, Homo Sapiens
ECPFSFAMF

SEQ ID NO: 1037158 - protein, 9 aa, Homo Sapiens
FPVLESKDS

SEQ ID NO: 1037159 - protein, 9 aa, Homo Sapiens
ALERLTREG

SEQ ID NO: 1037160 - protein, 9 aa, Homo Sapiens
AFLSAIFFG

SEQ ID NO: 1037161 - protein, 9 aa, Homo Sapiens
RNISRQIDN

SEQ ID NO: 1037162 - protein, 9 aa, Homo Sapiens
MLQDGYHKS

SEQ ID NO: 1037163 - protein, 9 aa, Homo Sapiens
KIKVTLGDS

SEQ ID NO: 1037164 - protein, 9 aa, Homo Sapiens
LFFANEKEA

SEQ ID NO: 1037165 - protein, 9 aa, Homo Sapiens
RAADTDEDG

SEQ ID NO: 1037166 - protein, 9 aa, Homo Sapiens
ITFTTIYGR

SEQ ID NO: 1037167 - protein, 9 aa, Homo Sapiens
ENLLVIVFV

SEQ ID NO: 1037168 - protein, 9 aa, Homo Sapiens
GSFFLGEQS

SEQ ID NO: 1037169 - protein, 9 aa, Homo Sapiens
RWMKQNPRR

SEQ ID NO: 1037170 - protein, 9 aa, Homo Sapiens
RYFRQRLQK

SEQ ID NO: 1037171 - protein, 9 aa, Homo Sapiens
KWLKNNFKI

SEQ ID NO: 1037172 - protein, 9 aa, Homo Sapiens
TLWIKFVSD

SEQ ID NO: 1037173 - protein, 9 aa, Homo Sapiens
TGHWRTSEL

SEQ ID NO: 1037174 - protein, 9 aa, Homo Sapiens
QSGLELREE

SEQ ID NO: 1037175 - protein, 9 aa, Homo Sapiens
VQFSIPQTA

SEQ ID NO: 1037176 - protein, 9 aa, Homo Sapiens
GKAEVDVAS

SEQ ID NO: 1037177 - protein, 9 aa, Homo Sapiens
LNHGIEDNF

SEQ ID NO: 1037178 - protein, 9 aa, Homo Sapiens
APYILEVSS

SEQ ID NO: 1037179 - protein, 9 aa, Homo Sapiens
PSALILGGS

SEQ ID NO: 1037180 - protein, 9 aa, Homo Sapiens
KSQTLSERP

SEQ ID NO: 1037181 - protein, 9 aa, Homo Sapiens
NGSGSRENS

SEQ ID NO: 1037182 - protein, 9 aa, Homo Sapiens
LGPMSTLVY

SEQ ID NO: 1037183 - protein, 9 aa, Homo Sapiens
GKTYIIFFV

SEQ ID NO: 1037184 - protein, 9 aa, Homo Sapiens
MIIIIWSIS

SEQ ID NO: 1037185 - protein, 9 aa, Homo Sapiens
IFVLLSLTV

SEQ ID NO: 1037186 - protein, 9 aa, Homo Sapiens
FIMLFCLRL

SEQ ID NO: 1037187 - protein, 9 aa, Homo Sapiens
YIVVSVLNN

SEQ ID NO: 1037188 - protein, 9 aa, Homo Sapiens
PGSLLFGPL

SEQ ID NO: 1037189 - protein, 9 aa, Homo Sapiens
LLVLGGEDQ

SEQ ID NO: 1037190 - protein, 9 aa, Homo Sapiens
APPSPPGEH

SEQ ID NO: 1037191 - protein, 9 aa, Homo Sapiens
ANAFEIILG

SEQ ID NO: 1037192 - protein, 9 aa, Homo Sapiens
VQGEETQKK

SEQ ID NO: 1037193 - protein, 9 aa, Homo Sapiens
ELDTLAYAL

SEQ ID NO: 1037194 - protein, 9 aa, Homo Sapiens
FEIENLLVI

SEQ ID NO: 1037195 - protein, 9 aa, Homo Sapiens
SVQFRQVEE

SEQ ID NO: 1037196 - protein, 9 aa, Homo Sapiens
GKQELGIRL

SEQ ID NO: 1037197 - protein, 9 aa, Homo Sapiens
QKKLPSPRI

SEQ ID NO: 1037198 - protein, 9 aa, Homo Sapiens
RDSFLTCLA

SEQ ID NO: 1037199 - protein, 9 aa, Homo Sapiens
NSQSLPVSP

SEQ ID NO: 1037200 - protein, 9 aa, Homo Sapiens
SSVPVGTAA

SEQ ID NO: 1037201 - protein, 9 aa, Homo Sapiens
LPEDCTEKH

SEQ ID NO: 1037202 - protein, 9 aa, Homo Sapiens
ALPALGTSQ

SEQ ID NO: 1037203 - protein, 9 aa, Homo Sapiens
PPGCSMLAA

SEQ ID NO: 1037204 - protein, 9 aa, Homo Sapiens
NAVSFRNRI

SEQ ID NO: 1037205 - protein, 9 aa, Homo Sapiens
LVLGAAAEE

SEQ ID NO: 1037206 - protein, 9 aa, Homo Sapiens
VENFLLVLG

SEQ ID NO: 1037207 - protein, 9 aa, Homo Sapiens
IQNELLVFL

SEQ ID NO: 1037208 - protein, 9 aa, Homo Sapiens
AALIRGNCK

SEQ ID NO: 1037209 - protein, 9 aa, Homo Sapiens
WTLTSSGQV

SEQ ID NO: 1037210 - protein, 9 aa, Homo Sapiens
ILLNDSGSA

SEQ ID NO: 1037211 - protein, 9 aa, Homo Sapiens
EKVKKMFPH

SEQ ID NO: 1037212 - protein, 9 aa, Homo Sapiens
PEKYGVVRE

SEQ ID NO: 1037213 - protein, 9 aa, Homo Sapiens
GALTGHWRT

SEQ ID NO: 1037214 - protein, 9 aa, Homo Sapiens
RRQKLRRRK

SEQ ID NO: 1037215 - protein, 9 aa, Homo Sapiens
VQGSGADGP

SEQ ID NO: 1037216 - protein, 9 aa, Homo Sapiens
LSVSQPSPY

SEQ ID NO: 1037217 - protein, 9 aa, Homo Sapiens
GFRSPLSDQ

SEQ ID NO: 1037218 - protein, 9 aa, Homo Sapiens
KLQDIMTSV

SEQ ID NO: 1037219 - protein, 9 aa, Homo Sapiens
IQMIRDPVR

SEQ ID NO: 1037220 - protein, 9 aa, Homo Sapiens
CLKMKCSRY

SEQ ID NO: 1037221 - protein, 9 aa, Homo Sapiens
SNEKLKEKL

SEQ ID NO: 1037222 - protein, 9 aa, Homo Sapiens
SDTFSEIGK

SEQ ID NO: 1037223 - protein, 9 aa, Homo Sapiens
SALREQKKN

SEQ ID NO: 1037224 - protein, 9 aa, Homo Sapiens
LAPPGPPEP

SEQ ID NO: 1037225 - protein, 9 aa, Homo Sapiens
LICRRHQKI

SEQ ID NO: 1037226 - protein, 9 aa, Homo Sapiens
GGPGKMAAM

SEQ ID NO: 1037227 - protein, 9 aa, Homo Sapiens
PMCRNKIID

SEQ ID NO: 1037228 - protein, 9 aa, Homo Sapiens
LETHAAGHS

SEQ ID NO: 1037229 - protein, 9 aa, Homo Sapiens
NLHLTSVTS

SEQ ID NO: 1037230 - protein, 9 aa, Homo Sapiens
GKSILIRGP

SEQ ID NO: 1037231 - protein, 9 aa, Homo Sapiens
SPDSPDSSS

SEQ ID NO: 1037232 - protein, 9 aa, Homo Sapiens
ADNLAKKNR

SEQ ID NO: 1037233 - protein, 9 aa, Homo Sapiens
GGCGWAPLA

SEQ ID NO: 1037234 - protein, 9 aa, Homo Sapiens
VNEVARQLE

SEQ ID NO: 1037235 - protein, 9 aa, Homo Sapiens
MAVLLAGDP

SEQ ID NO: 1037236 - protein, 9 aa, Homo Sapiens
KLSLELLNT

SEQ ID NO: 1037237 - protein, 9 aa, Homo Sapiens
GPVHRVGYI

SEQ ID NO: 1037238 - protein, 9 aa, Homo Sapiens
NPYVKFRLG

SEQ ID NO: 1037239 - protein, 9 aa, Homo Sapiens
GDHLGRAVQ

SEQ ID NO: 1037240 - protein, 9 aa, Homo Sapiens
LKKILKGLD

SEQ ID NO: 1037241 - protein, 9 aa, Homo Sapiens
SSNYPEKFE

SEQ ID NO: 1037242 - protein, 9 aa, Homo Sapiens
QQFSFHSAP

SEQ ID NO: 1037243 - protein, 9 aa, Homo Sapiens
CNVRASPKP

SEQ ID NO: 1037244 - protein, 9 aa, Homo Sapiens
QCSHFRRHE

SEQ ID NO: 1037245 - protein, 9 aa, Homo Sapiens
SFLPLKIRE

SEQ ID NO: 1037246 - protein, 9 aa, Homo Sapiens
LRNLRRTRR

SEQ ID NO: 1037247 - protein, 9 aa, Homo Sapiens
VLSRMFEIQ

SEQ ID NO: 1037248 - protein, 9 aa, Homo Sapiens
ADTDEDGQV

SEQ ID NO: 1037249 - protein, 9 aa, Homo Sapiens
PYTRRQNPS

SEQ ID NO: 1037250 - protein, 9 aa, Homo Sapiens
IFFGGLFLV

SEQ ID NO: 1037251 - protein, 9 aa, Homo Sapiens
RKISSSNSV

SEQ ID NO: 1037252 - protein, 9 aa, Homo Sapiens
LGISRGTMR

SEQ ID NO: 1037253 - protein, 9 aa, Homo Sapiens
FPITSIFHT

SEQ ID NO: 1037254 - protein, 9 aa, Homo Sapiens
GGWQSEAQD

SEQ ID NO: 1037255 - protein, 9 aa, Homo Sapiens
LGVATLERP

SEQ ID NO: 1037256 - protein, 9 aa, Homo Sapiens
HKNPEWEKA

SEQ ID NO: 1037257 - protein, 9 aa, Homo Sapiens
KKTRDLVRL

SEQ ID NO: 1037258 - protein, 9 aa, Homo Sapiens
SVAASQDNI

SEQ ID NO: 1037259 - protein, 9 aa, Homo Sapiens
ELAVRRARV

SEQ ID NO: 1037260 - protein, 9 aa, Homo Sapiens
IKRTAGDHL

SEQ ID NO: 1037261 - protein, 9 aa, Homo Sapiens
QEATRPPSF

SEQ ID NO: 1037262 - protein, 9 aa, Homo Sapiens
TRSQLEKLE

SEQ ID NO: 1037263 - protein, 9 aa, Homo Sapiens
GIAETPGVP

SEQ ID NO: 1037264 - protein, 9 aa, Homo Sapiens
RIKYLYRRG

SEQ ID NO: 1037265 - protein, 9 aa, Homo Sapiens
VVSVLNNMK

SEQ ID NO: 1037266 - protein, 9 aa, Homo Sapiens
TTIAVLLRP

SEQ ID NO: 1037267 - protein, 9 aa, Homo Sapiens
YKLVQLIQE

SEQ ID NO: 1037268 - protein, 9 aa, Homo Sapiens
VGLNAAGKT

SEQ ID NO: 1037269 - protein, 9 aa, Homo Sapiens
NLVSLGLFF

SEQ ID NO: 1037270 - protein, 9 aa, Homo Sapiens
SIMNTLESK

SEQ ID NO: 1037271 - protein, 9 aa, Homo Sapiens
RSRGSGGNS

SEQ ID NO: 1037272 - protein, 9 aa, Homo Sapiens
GHSRSSENV

SEQ ID NO: 1037273 - protein, 9 aa, Homo Sapiens
LVIEPQNEN

SEQ ID NO: 1037274 - protein, 9 aa, Homo Sapiens
KNEGEWDVE

SEQ ID NO: 1037275 - protein, 9 aa, Homo Sapiens
CLAVEGRLE

SEQ ID NO: 1037276 - protein, 9 aa, Homo Sapiens
KTSSLFDIY

SEQ ID NO: 1037277 - protein, 9 aa, Homo Sapiens
KMVRKSINQ

SEQ ID NO: 1037278 - protein, 9 aa, Homo Sapiens
LSEEPSKNI

SEQ ID NO: 1037279 - protein, 9 aa, Homo Sapiens
EEGKALKEE

SEQ ID NO: 1037280 - protein, 9 aa, Homo Sapiens
SFPAQFGGI

SEQ ID NO: 1037281 - protein, 9 aa, Homo Sapiens
PSEFFQFPH

SEQ ID NO: 1037282 - protein, 9 aa, Homo Sapiens
PPNGNQTFS

SEQ ID NO: 1037283 - protein, 9 aa, Homo Sapiens
ETSVSPLHP

SEQ ID NO: 1037284 - protein, 9 aa, Homo Sapiens
MLKQLSILT

SEQ ID NO: 1037285 - protein, 9 aa, Homo Sapiens
APKLSDDRR

SEQ ID NO: 1037286 - protein, 9 aa, Homo Sapiens
YFADYAKHK

SEQ ID NO: 1037287 - protein, 9 aa, Homo Sapiens
EFVDNASMP

SEQ ID NO: 1037288 - protein, 9 aa, Homo Sapiens
MIETKSFKP

SEQ ID NO: 1037289 - protein, 9 aa, Homo Sapiens
LHAQKGAQD

SEQ ID NO: 1037290 - protein, 9 aa, Homo Sapiens
YVEAAVKQF

SEQ ID NO: 1037291 - protein, 9 aa, Homo Sapiens
HQEDLERLG

SEQ ID NO: 1037292 - protein, 9 aa, Homo Sapiens
LAGQPQGPP

SEQ ID NO: 1037293 - protein, 9 aa, Homo Sapiens
NIGGNETVT

SEQ ID NO: 1037294 - protein, 9 aa, Homo Sapiens
HTFWSAFRT

SEQ ID NO: 1037295 - protein, 9 aa, Homo Sapiens
PQAASLRSC

SEQ ID NO: 1037296 - protein, 9 aa, Homo Sapiens
TAWLPGEDM

SEQ ID NO: 1037297 - protein, 9 aa, Homo Sapiens
VLNLNLVIK

SEQ ID NO: 1037298 - protein, 9 aa, Homo Sapiens
LRLSSMFGN

SEQ ID NO: 1037299 - protein, 9 aa, Homo Sapiens
CVGRRMKFQ

SEQ ID NO: 1037300 - protein, 9 aa, Homo Sapiens
KIRKPCPFD

SEQ ID NO: 1037301 - protein, 9 aa, Homo Sapiens
SQQALKELA

SEQ ID NO: 1037302 - protein, 9 aa, Homo Sapiens
PPVPVFDFR

SEQ ID NO: 1037303 - protein, 9 aa, Homo Sapiens
KQRNGSEGN

SEQ ID NO: 1037304 - protein, 9 aa, Homo Sapiens
GYRNAEKNF

SEQ ID NO: 1037305 - protein, 9 aa, Homo Sapiens
QYEALVKTN

SEQ ID NO: 1037306 - protein, 9 aa, Homo Sapiens
LKFKKGPFG

SEQ ID NO: 1037307 - protein, 9 aa, Homo Sapiens
YSLSVGNKR

SEQ ID NO: 1037308 - protein, 9 aa, Homo Sapiens
RAPSALCTP

SEQ ID NO: 1037309 - protein, 9 aa, Homo Sapiens
GVPGGAEAA

SEQ ID NO: 1037310 - protein, 9 aa, Homo Sapiens
QDENRKLAK

SEQ ID NO: 1037311 - protein, 9 aa, Homo Sapiens
NLHPVPEHL

SEQ ID NO: 1037312 - protein, 9 aa, Homo Sapiens
SCTDTYNTK

SEQ ID NO: 1037313 - protein, 9 aa, Homo Sapiens
DPDGEEKRC

SEQ ID NO: 1037314 - protein, 9 aa, Homo Sapiens
INSFDEDDV

SEQ ID NO: 1037315 - protein, 9 aa, Homo Sapiens
NKLQKLGPD

SEQ ID NO: 1037316 - protein, 9 aa, Homo Sapiens
WSAFRTSEG

SEQ ID NO: 1037317 - protein, 9 aa, Homo Sapiens
DPDAQPEGE

SEQ ID NO: 1037318 - protein, 9 aa, Homo Sapiens
ASHLVGEPT

SEQ ID NO: 1037319 - protein, 9 aa, Homo Sapiens
PETCLCVTS

SEQ ID NO: 1037320 - protein, 9 aa, Homo Sapiens
PFPVTDTSS

SEQ ID NO: 1037321 - protein, 9 aa, Homo Sapiens
CKKLGLMFD

SEQ ID NO: 1037322 - protein, 9 aa, Homo Sapiens
DKALDQEEE

SEQ ID NO: 1037323 - protein, 9 aa, Homo Sapiens
SLGAPSRDV

SEQ ID NO: 1037324 - protein, 9 aa, Homo Sapiens
FLDLKQTCR

SEQ ID NO: 1037325 - protein, 9 aa, Homo Sapiens
KGEFTCHAR

SEQ ID NO: 1037326 - protein, 9 aa, Homo Sapiens
LRNKKFKSA

SEQ ID NO: 1037327 - protein, 9 aa, Homo Sapiens
ALTFSSAVT

SEQ ID NO: 1037328 - protein, 9 aa, Homo Sapiens
LVNGIFLNL

SEQ ID NO: 1037329 - protein, 9 aa, Homo Sapiens
RSRRTAPEI

SEQ ID NO: 1037330 - protein, 9 aa, Homo Sapiens
ATRVVSSFN

SEQ ID NO: 1037331 - protein, 9 aa, Homo Sapiens
QLSSVDLEV

SEQ ID NO: 1037332 - protein, 9 aa, Homo Sapiens
LISKQWVVS

SEQ ID NO: 1037333 - protein, 9 aa, Homo Sapiens
LNDHYGHRH

SEQ ID NO: 1037334 - protein, 9 aa, Homo Sapiens
DEEEPPDLS

SEQ ID NO: 1037335 - protein, 9 aa, Homo Sapiens
LSYHDLVPS

SEQ ID NO: 1037336 - protein, 9 aa, Homo Sapiens
SGSQENREH

SEQ ID NO: 1037337 - protein, 9 aa, Homo Sapiens
VPFFSQQSG

SEQ ID NO: 1037338 - protein, 9 aa, Homo Sapiens
NGKGAFFCN

SEQ ID NO: 1037339 - protein, 9 aa, Homo Sapiens
VAVMKFIWS

SEQ ID NO: 1037340 - protein, 9 aa, Homo Sapiens
KPVSGGLAG

SEQ ID NO: 1037341 - protein, 9 aa, Homo Sapiens
DEVLRLLNE

SEQ ID NO: 1037342 - protein, 9 aa, Homo Sapiens
SSLQEPERT

SEQ ID NO: 1037343 - protein, 9 aa, Homo Sapiens
RILMVGLNA

SEQ ID NO: 1037344 - protein, 9 aa, Homo Sapiens
ERDHKLRHR

SEQ ID NO: 1037345 - protein, 9 aa, Homo Sapiens
LFNSLGLHC

SEQ ID NO: 1037346 - protein, 9 aa, Homo Sapiens
AYNIRLKLT

SEQ ID NO: 1037347 - protein, 9 aa, Homo Sapiens
PTNGRMLLQ

SEQ ID NO: 1037348 - protein, 9 aa, Homo Sapiens
QQELEAFRS

SEQ ID NO: 1037349 - protein, 9 aa, Homo Sapiens
QNRGISSEI

SEQ ID NO: 1037350 - protein, 9 aa, Homo Sapiens
SVCGHGGQQ

SEQ ID NO: 1037351 - protein, 9 aa, Homo Sapiens
FANFFNTFL

SEQ ID NO: 1037352 - protein, 9 aa, Homo Sapiens
PDGSDTSIL

SEQ ID NO: 1037353 - protein, 9 aa, Homo Sapiens
SDGLMDGLT

SEQ ID NO: 1037354 - protein, 9 aa, Homo Sapiens
WETQLKPKN

SEQ ID NO: 1037355 - protein, 9 aa, Homo Sapiens
KARFLLRDA

SEQ ID NO: 1037356 - protein, 9 aa, Homo Sapiens
SQEVGRVYV

SEQ ID NO: 1037357 - protein, 9 aa, Homo Sapiens
SSTSEQVPE

SEQ ID NO: 1037358 - protein, 9 aa, Homo Sapiens
MLICRRHQK

SEQ ID NO: 1037359 - protein, 9 aa, Homo Sapiens
TPEFCQLIV

SEQ ID NO: 1037360 - protein, 9 aa, Homo Sapiens
DEKGPWGGW

SEQ ID NO: 1037361 - protein, 9 aa, Homo Sapiens
QTVCLRGPK

SEQ ID NO: 1037362 - protein, 9 aa, Homo Sapiens
RCIHAGCDC

SEQ ID NO: 1037363 - protein, 9 aa, Homo Sapiens
FNHFVQNSQ

SEQ ID NO: 1037364 - protein, 9 aa, Homo Sapiens
VCDLIKNKL

SEQ ID NO: 1037365 - protein, 9 aa, Homo Sapiens
EHSDFESPK

SEQ ID NO: 1037366 - protein, 9 aa, Homo Sapiens
GCSMLAALI

SEQ ID NO: 1037367 - protein, 9 aa, Homo Sapiens
GHATPFPVT

SEQ ID NO: 1037368 - protein, 9 aa, Homo Sapiens
RRHCHPLDL

SEQ ID NO: 1037369 - protein, 9 aa, Homo Sapiens
HDQIYTGEK

SEQ ID NO: 1037370 - protein, 9 aa, Homo Sapiens
CVNFPPEEA

SEQ ID NO: 1037371 - protein, 9 aa, Homo Sapiens
NFAVPMDSG

SEQ ID NO: 1037372 - protein, 9 aa, Homo Sapiens
MAPEETSIA

SEQ ID NO: 1037373 - protein, 9 aa, Homo Sapiens
LCVTMGLDG

SEQ ID NO: 1037374 - protein, 9 aa, Homo Sapiens
LLLMGTPVL

SEQ ID NO: 1037375 - protein, 9 aa, Homo Sapiens
PTEKVKKMF

SEQ ID NO: 1037376 - protein, 9 aa, Homo Sapiens
ELGIRLAAR

SEQ ID NO: 1037377 - protein, 9 aa, Homo Sapiens
VAISIELDM

SEQ ID NO: 1037378 - protein, 9 aa, Homo Sapiens
IVEEYQLSY

SEQ ID NO: 1037379 - protein, 9 aa, Homo Sapiens
LLSFTYIAL

SEQ ID NO: 1037380 - protein, 9 aa, Homo Sapiens
VINRLTRRA

SEQ ID NO: 1037381 - protein, 9 aa, Homo Sapiens
LETDIFQIQ

SEQ ID NO: 1037382 - protein, 9 aa, Homo Sapiens
PRSTARTVF

SEQ ID NO: 1037383 - protein, 9 aa, Homo Sapiens
MVFIYVFSV

SEQ ID NO: 1037384 - protein, 9 aa, Homo Sapiens
ALVLNDKHL

SEQ ID NO: 1037385 - protein, 9 aa, Homo Sapiens
RVFEPVLEG

SEQ ID NO: 1037386 - protein, 9 aa, Homo Sapiens
IFLRDYQDT

SEQ ID NO: 1037387 - protein, 9 aa, Homo Sapiens
SRGGPNGDP

SEQ ID NO: 1037388 - protein, 9 aa, Homo Sapiens
VQMFVSNGS

SEQ ID NO: 1037389 - protein, 9 aa, Homo Sapiens
HSGTAATSI

SEQ ID NO: 1037390 - protein, 9 aa, Homo Sapiens
LRKMTEIEL

SEQ ID NO: 1037391 - protein, 9 aa, Homo Sapiens
GAHLEKKKT

SEQ ID NO: 1037392 - protein, 9 aa, Homo Sapiens
APELPKGMD

SEQ ID NO: 1037393 - protein, 9 aa, Homo Sapiens
ENEGEAEKP

SEQ ID NO: 1037394 - protein, 9 aa, Homo Sapiens
QYFKDPHVA

SEQ ID NO: 1037395 - protein, 9 aa, Homo Sapiens
ATVGSDDRF

SEQ ID NO: 1037396 - protein, 9 aa, Homo Sapiens
SAFRLASDG

SEQ ID NO: 1037397 - protein, 9 aa, Homo Sapiens
SRHHETSTH

SEQ ID NO: 1037398 - protein, 9 aa, Homo Sapiens
RTARRSTAS

SEQ ID NO: 1037399 - protein, 9 aa, Homo Sapiens
YSFPVAALP

SEQ ID NO: 1037400 - protein, 9 aa, Homo Sapiens
CCLQKFNIM

SEQ ID NO: 1037401 - protein, 9 aa, Homo Sapiens
EKNQSSTPT

SEQ ID NO: 1037402 - protein, 9 aa, Homo Sapiens
LRRLLSSSE

SEQ ID NO: 1037403 - protein, 9 aa, Homo Sapiens
TISIEEGVI

SEQ ID NO: 1037404 - protein, 9 aa, Homo Sapiens
KASQRHPFP

SEQ ID NO: 1037405 - protein, 9 aa, Homo Sapiens
GLKKKFQKQ

SEQ ID NO: 1037406 - protein, 9 aa, Homo Sapiens
LPALLKTLV

SEQ ID NO: 1037407 - protein, 9 aa, Homo Sapiens
LTNGYTRHR

SEQ ID NO: 1037408 - protein, 9 aa, Homo Sapiens
VTPGLTCAV

SEQ ID NO: 1037409 - protein, 9 aa, Homo Sapiens
PESFGRDSF

SEQ ID NO: 1037410 - protein, 9 aa, Homo Sapiens
EAFGPSEIL

SEQ ID NO: 1037411 - protein, 9 aa, Homo Sapiens
VFEAFGPSE

SEQ ID NO: 1037412 - protein, 9 aa, Homo Sapiens
ESKEDFRKY

SEQ ID NO: 1037413 - protein, 9 aa, Homo Sapiens
VLGQLSAKK

SEQ ID NO: 1037414 - protein, 9 aa, Homo Sapiens
QITYSAISN

SEQ ID NO: 1037415 - protein, 9 aa, Homo Sapiens
LSSEACYKC

SEQ ID NO: 1037416 - protein, 9 aa, Homo Sapiens
WSGARRGRR

SEQ ID NO: 1037417 - protein, 9 aa, Homo Sapiens
GNLSALQTF

SEQ ID NO: 1037418 - protein, 9 aa, Homo Sapiens
TEASVLAKS

SEQ ID NO: 1037419 - protein, 9 aa, Homo Sapiens
VGSHPLPSK

SEQ ID NO: 1037420 - protein, 9 aa, Homo Sapiens
SQTQPPLCS

SEQ ID NO: 1037421 - protein, 9 aa, Homo Sapiens
EHSVAAGVA

SEQ ID NO: 1037422 - protein, 9 aa, Homo Sapiens
QRVCVIDGI

SEQ ID NO: 1037423 - protein, 9 aa, Homo Sapiens
PFSAGPLAV

SEQ ID NO: 1037424 - protein, 9 aa, Homo Sapiens
FKKPQSLEF

SEQ ID NO: 1037425 - protein, 9 aa, Homo Sapiens
SPWGPWDRR

SEQ ID NO: 1037426 - protein, 9 aa, Homo Sapiens
KFKKGPFGK

SEQ ID NO: 1037427 - protein, 9 aa, Homo Sapiens
EASPGSRGG

SEQ ID NO: 1037428 - protein, 9 aa, Homo Sapiens
SIIQSEEQT

SEQ ID NO: 1037429 - protein, 9 aa, Homo Sapiens
KNNPSLKSR

SEQ ID NO: 1037430 - protein, 9 aa, Homo Sapiens
NPIGPRACC

SEQ ID NO: 1037431 - protein, 9 aa, Homo Sapiens
ISPRSTGLF

SEQ ID NO: 1037432 - protein, 9 aa, Homo Sapiens
TASKITLDG

SEQ ID NO: 1037433 - protein, 9 aa, Homo Sapiens
DKFFPKLLG

SEQ ID NO: 1037434 - protein, 9 aa, Homo Sapiens
STEVKVKNV

SEQ ID NO: 1037435 - protein, 9 aa, Homo Sapiens
AARLIQNID

SEQ ID NO: 1037436 - protein, 9 aa, Homo Sapiens
YARQAYDLQ

SEQ ID NO: 1037437 - protein, 9 aa, Homo Sapiens
EQMESTNLV

SEQ ID NO: 1037438 - protein, 9 aa, Homo Sapiens
ERPMYAVGG

SEQ ID NO: 1037439 - protein, 9 aa, Homo Sapiens
QRKVICVRK

SEQ ID NO: 1037440 - protein, 9 aa, Homo Sapiens
LRYNSLSKL

SEQ ID NO: 1037441 - protein, 9 aa, Homo Sapiens
YYTMKILDK

SEQ ID NO: 1037442 - protein, 9 aa, Homo Sapiens
VDRSENVHH

SEQ ID NO: 1037443 - protein, 9 aa, Homo Sapiens
LGALTGHWR

SEQ ID NO: 1037444 - protein, 9 aa, Homo Sapiens
CDITICVQD

SEQ ID NO: 1037445 - protein, 9 aa, Homo Sapiens
KGEKGPKDK

SEQ ID NO: 1037446 - protein, 9 aa, Homo Sapiens
RIFNTNSFF

SEQ ID NO: 1037447 - protein, 9 aa, Homo Sapiens
VGRVLTRDC

SEQ ID NO: 1037448 - protein, 9 aa, Homo Sapiens
LQAFLDPSK

SEQ ID NO: 1037449 - protein, 9 aa, Homo Sapiens
KKFRISGHR

SEQ ID NO: 1037450 - protein, 9 aa, Homo Sapiens
CNKVFMINR

SEQ ID NO: 1037451 - protein, 9 aa, Homo Sapiens
EETRPVRAV

SEQ ID NO: 1037452 - protein, 9 aa, Homo Sapiens
IYNIWHRRH

SEQ ID NO: 1037453 - protein, 9 aa, Homo Sapiens
MEMKHKFEE

SEQ ID NO: 1037454 - protein, 9 aa, Homo Sapiens
WATWELYIP

SEQ ID NO: 1037455 - protein, 9 aa, Homo Sapiens
DGKDLFTQR

SEQ ID NO: 1037456 - protein, 9 aa, Homo Sapiens
SFLEIFFTS

SEQ ID NO: 1037457 - protein, 9 aa, Homo Sapiens
LRCQPSCTK

SEQ ID NO: 1037458 - protein, 9 aa, Homo Sapiens
TGVDINARE

SEQ ID NO: 1037459 - protein, 9 aa, Homo Sapiens
RATAALTRT

SEQ ID NO: 1037460 - protein, 9 aa, Homo Sapiens
RYYATIPNR

SEQ ID NO: 1037461 - protein, 9 aa, Homo Sapiens
KQKRLHSSA

SEQ ID NO: 1037462 - protein, 9 aa, Homo Sapiens
LVHQGETEL

SEQ ID NO: 1037463 - protein, 9 aa, Homo Sapiens
IITIQTEST

SEQ ID NO: 1037464 - protein, 9 aa, Homo Sapiens
ESLISLEKK

SEQ ID NO: 1037465 - protein, 9 aa, Homo Sapiens
SGGTECFWQ

SEQ ID NO: 1037466 - protein, 9 aa, Homo Sapiens
HKRVPPKEV

SEQ ID NO: 1037467 - protein, 9 aa, Homo Sapiens
QTQPPLCSG

SEQ ID NO: 1037468 - protein, 9 aa, Homo Sapiens
DMVQLLSPS

SEQ ID NO: 1037469 - protein, 9 aa, Homo Sapiens
SRELVLVIR

SEQ ID NO: 1037470 - protein, 9 aa, Homo Sapiens
NSEGTLEIS

SEQ ID NO: 1037471 - protein, 9 aa, Homo Sapiens
DESGGFPLE

SEQ ID NO: 1037472 - protein, 9 aa, Homo Sapiens
LPLQCYESI

SEQ ID NO: 1037473 - protein, 9 aa, Homo Sapiens
NDIDKFYAD

SEQ ID NO: 1037474 - protein, 9 aa, Homo Sapiens
NTFLHLLSS

SEQ ID NO: 1037475 - protein, 9 aa, Homo Sapiens
LLDQRTIFF

SEQ ID NO: 1037476 - protein, 9 aa, Homo Sapiens
PSKRALGPA

SEQ ID NO: 1037477 - protein, 9 aa, Homo Sapiens
QTVSGQCLG

SEQ ID NO: 1037478 - protein, 9 aa, Homo Sapiens
CVKVTGLQN

SEQ ID NO: 1037479 - protein, 9 aa, Homo Sapiens
FYFLGLRDE

SEQ ID NO: 1037480 - protein, 9 aa, Homo Sapiens
TVPQEKLPL

SEQ ID NO: 1037481 - protein, 9 aa, Homo Sapiens
FFQFPHGQK

SEQ ID NO: 1037482 - protein, 9 aa, Homo Sapiens
GEGSDQKSP

SEQ ID NO: 1037483 - protein, 9 aa, Homo Sapiens
GPGQGLVLL

SEQ ID NO: 1037484 - protein, 9 aa, Homo Sapiens
ENEGNPNVH

SEQ ID NO: 1037485 - protein, 9 aa, Homo Sapiens
LENRSSPSG

SEQ ID NO: 1037486 - protein, 9 aa, Homo Sapiens
EIWSYLMHF

SEQ ID NO: 1037487 - protein, 9 aa, Homo Sapiens
ESLHIVFST

SEQ ID NO: 1037488 - protein, 9 aa, Homo Sapiens
NCFSEWDGL

SEQ ID NO: 1037489 - protein, 9 aa, Homo Sapiens
LVRAAQGIR

SEQ ID NO: 1037490 - protein, 9 aa, Homo Sapiens
NGLSLGFSF

SEQ ID NO: 1037491 - protein, 9 aa, Homo Sapiens
QAVRPLGEK

SEQ ID NO: 1037492 - protein, 9 aa, Homo Sapiens
EVVTAVEKM

SEQ ID NO: 1037493 - protein, 9 aa, Homo Sapiens
QHSIIQSEE

SEQ ID NO: 1037494 - protein, 9 aa, Homo Sapiens
LYFYRDSEE

SEQ ID NO: 1037495 - protein, 9 aa, Homo Sapiens
DVTLEASRK

SEQ ID NO: 1037496 - protein, 9 aa, Homo Sapiens
LAFGLFTAF

SEQ ID NO: 1037497 - protein, 9 aa, Homo Sapiens
PKTNREKMT

SEQ ID NO: 1037498 - protein, 9 aa, Homo Sapiens
SMTLQCAQN

SEQ ID NO: 1037499 - protein, 9 aa, Homo Sapiens
FVNSKRALF

SEQ ID NO: 1037500 - protein, 9 aa, Homo Sapiens
DVASFLLKV

SEQ ID NO: 1037501 - protein, 9 aa, Homo Sapiens
QHLQAAVVF

SEQ ID NO: 1037502 - protein, 9 aa, Homo Sapiens
MLCVTMGLD

SEQ ID NO: 1037503 - protein, 9 aa, Homo Sapiens
RYRPSTFHV

SEQ ID NO: 1037504 - protein, 9 aa, Homo Sapiens
VSVAASQDN

SEQ ID NO: 1037505 - protein, 9 aa, Homo Sapiens
RPSTFHVQS

SEQ ID NO: 1037506 - protein, 9 aa, Homo Sapiens
FISPDAASI

SEQ ID NO: 1037507 - protein, 9 aa, Homo Sapiens
YSFNHLYNT

SEQ ID NO: 1037508 - protein, 9 aa, Homo Sapiens
PKQRNGSEG

SEQ ID NO: 1037509 - protein, 9 aa, Homo Sapiens
AAPCADSDL

SEQ ID NO: 1037510 - protein, 9 aa, Homo Sapiens
GIIETSEDI

SEQ ID NO: 1037511 - protein, 9 aa, Homo Sapiens
YYPYISSDG

SEQ ID NO: 1037512 - protein, 9 aa, Homo Sapiens
NQKILFKEQ

SEQ ID NO: 1037513 - protein, 9 aa, Homo Sapiens
NGPVHAPLF

SEQ ID NO: 1037514 - protein, 9 aa, Homo Sapiens
PDKKSSEMV

SEQ ID NO: 1037515 - protein, 9 aa, Homo Sapiens
TKWLKNNFK

SEQ ID NO: 1037516 - protein, 9 aa, Homo Sapiens
VGFYSAFFV

SEQ ID NO: 1037517 - protein, 9 aa, Homo Sapiens
VKDSIKKMF

SEQ ID NO: 1037518 - protein, 9 aa, Homo Sapiens
LLAEQREQK

SEQ ID NO: 1037519 - protein, 9 aa, Homo Sapiens
KTDTLQIKD

SEQ ID NO: 1037520 - protein, 9 aa, Homo Sapiens
QEVPKQRNG

SEQ ID NO: 1037521 - protein, 9 aa, Homo Sapiens
RFGSSIALV

SEQ ID NO: 1037522 - protein, 9 aa, Homo Sapiens
YLLFACMLT

SEQ ID NO: 1037523 - protein, 9 aa, Homo Sapiens
HLSQQKDSL

SEQ ID NO: 1037524 - protein, 9 aa, Homo Sapiens
NTLESKEDF

SEQ ID NO: 1037525 - protein, 9 aa, Homo Sapiens
YRKPQVWSN

SEQ ID NO: 1037526 - protein, 9 aa, Homo Sapiens
KLSHKKMMK

SEQ ID NO: 1037527 - protein, 9 aa, Homo Sapiens
QKDELSFTE

SEQ ID NO: 1037528 - protein, 9 aa, Homo Sapiens
DNAAEEAGV

SEQ ID NO: 1037529 - protein, 9 aa, Homo Sapiens
RLRNKVKVD

SEQ ID NO: 1037530 - protein, 9 aa, Homo Sapiens
ILNVGNIGG

SEQ ID NO: 1037531 - protein, 9 aa, Homo Sapiens
SFEIENLLV

SEQ ID NO: 1037532 - protein, 9 aa, Homo Sapiens
ANVLRGACG

SEQ ID NO: 1037533 - protein, 9 aa, Homo Sapiens
NNPDVESNS

SEQ ID NO: 1037534 - protein, 9 aa, Homo Sapiens
PGYLSSEVL

SEQ ID NO: 1037535 - protein, 9 aa, Homo Sapiens
VARPQIFSV

SEQ ID NO: 1037536 - protein, 9 aa, Homo Sapiens
SCRQFSSPE

SEQ ID NO: 1037537 - protein, 8 aa, Homo Sapiens
ENYNQTST

SEQ ID NO: 1037538 - protein, 9 aa, Homo Sapiens
GDMTEIGKR

SEQ ID NO: 1037539 - protein, 9 aa, Homo Sapiens
KNSRCEQFC

SEQ ID NO: 1037540 - protein, 9 aa, Homo Sapiens
SYDCYVAVC

SEQ ID NO: 1037541 - protein, 9 aa, Homo Sapiens
GPPGPTEPK

SEQ ID NO: 1037542 - protein, 9 aa, Homo Sapiens
LEPSAIPNN

SEQ ID NO: 1037543 - protein, 9 aa, Homo Sapiens
CVCTFSLLS

SEQ ID NO: 1037544 - protein, 9 aa, Homo Sapiens
LFMTAPEGK

SEQ ID NO: 1037545 - protein, 9 aa, Homo Sapiens
VEGLQASTK

SEQ ID NO: 1037546 - protein, 9 aa, Homo Sapiens
DDHLSSNQD

SEQ ID NO: 1037547 - protein, 9 aa, Homo Sapiens
RRTEGFFVT

SEQ ID NO: 1037548 - protein, 9 aa, Homo Sapiens
VPGSSAHYG

SEQ ID NO: 1037549 - protein, 9 aa, Homo Sapiens
VSDISAFRE

SEQ ID NO: 1037550 - protein, 9 aa, Homo Sapiens
PHSIARQKQ

SEQ ID NO: 1037551 - protein, 9 aa, Homo Sapiens
ANQNNLMMP

SEQ ID NO: 1037552 - protein, 9 aa, Homo Sapiens
PKRFRAKSL

SEQ ID NO: 1037553 - protein, 9 aa, Homo Sapiens
DNQQKNPPP

SEQ ID NO: 1037554 - protein, 9 aa, Homo Sapiens
ASCMEHLLQ

SEQ ID NO: 1037555 - protein, 9 aa, Homo Sapiens
RDGAIEFSQ

SEQ ID NO: 1037556 - protein, 9 aa, Homo Sapiens
NGAMRNVTF

SEQ ID NO: 1037557 - protein, 9 aa, Homo Sapiens
TRTAARTAR

SEQ ID NO: 1037558 - protein, 9 aa, Homo Sapiens
RHVVMELNE

SEQ ID NO: 1037559 - protein, 9 aa, Homo Sapiens
CLGEEDEGD

SEQ ID NO: 1037560 - protein, 9 aa, Homo Sapiens
SDPGLKPPV

SEQ ID NO: 1037561 - protein, 9 aa, Homo Sapiens
PGGLGKHRL

SEQ ID NO: 1037562 - protein, 9 aa, Homo Sapiens
VFGYLLFLF

SEQ ID NO: 1037563 - protein, 9 aa, Homo Sapiens
KVFNEHSAF

SEQ ID NO: 1037564 - protein, 9 aa, Homo Sapiens
NCVYQSLYM

SEQ ID NO: 1037565 - protein, 9 aa, Homo Sapiens
EGCHTTSRS

SEQ ID NO: 1037566 - protein, 9 aa, Homo Sapiens
SRGTMRRQK

SEQ ID NO: 1037567 - protein, 9 aa, Homo Sapiens
AQLLFHGVA

SEQ ID NO: 1037568 - protein, 9 aa, Homo Sapiens
NNFKIQKSL

SEQ ID NO: 1037569 - protein, 9 aa, Homo Sapiens
AQKMAKPEK

SEQ ID NO: 1037570 - protein, 9 aa, Homo Sapiens
DLKEQLASL

SEQ ID NO: 1037571 - protein, 9 aa, Homo Sapiens
LSELPAVGG

SEQ ID NO: 1037572 - protein, 9 aa, Homo Sapiens
QCVGSGTKS

SEQ ID NO: 1037573 - protein, 9 aa, Homo Sapiens
LCRDAPQGR

SEQ ID NO: 1037574 - protein, 9 aa, Homo Sapiens
IFFVGCTAQ

SEQ ID NO: 1037575 - protein, 9 aa, Homo Sapiens
PLYLMVILI

SEQ ID NO: 1037576 - protein, 9 aa, Homo Sapiens
CGQLEKLKS

SEQ ID NO: 1037577 - protein, 9 aa, Homo Sapiens
DCVPCNCDL

SEQ ID NO: 1037578 - protein, 9 aa, Homo Sapiens
EALGCPDGN

SEQ ID NO: 1037579 - protein, 9 aa, Homo Sapiens
SSTARFSVR

SEQ ID NO: 1037580 - protein, 9 aa, Homo Sapiens
LAAHSFVDL

SEQ ID NO: 1037581 - protein, 9 aa, Homo Sapiens
SPPRPYHQE

SEQ ID NO: 1037582 - protein, 9 aa, Homo Sapiens
FLSAIFFGG

SEQ ID NO: 1037583 - protein, 9 aa, Homo Sapiens
IPKKNSHNF

SEQ ID NO: 1037584 - protein, 9 aa, Homo Sapiens
TEVKVKNVL

SEQ ID NO: 1037585 - protein, 9 aa, Homo Sapiens
HFLEGDGPC

SEQ ID NO: 1037586 - protein, 9 aa, Homo Sapiens
AVARELSPN

SEQ ID NO: 1037587 - protein, 9 aa, Homo Sapiens
YIALTIARA

SEQ ID NO: 1037588 - protein, 9 aa, Homo Sapiens
EANFHEVTT

SEQ ID NO: 1037589 - protein, 9 aa, Homo Sapiens
RAAKWRTSD

SEQ ID NO: 1037590 - protein, 9 aa, Homo Sapiens
GKKEINIIK

SEQ ID NO: 1037591 - protein, 9 aa, Homo Sapiens
MAQLEKSAI

SEQ ID NO: 1037592 - protein, 9 aa, Homo Sapiens
EETSLATES

SEQ ID NO: 1037593 - protein, 9 aa, Homo Sapiens
FFSSPRDFN

SEQ ID NO: 1037594 - protein, 9 aa, Homo Sapiens
FLPLKIREH

SEQ ID NO: 1037595 - protein, 9 aa, Homo Sapiens
KWGTKGLES

SEQ ID NO: 1037596 - protein, 9 aa, Homo Sapiens
IVMLLFLCT

SEQ ID NO: 1037597 - protein, 9 aa, Homo Sapiens
MRLYTVRWR

SEQ ID NO: 1037598 - protein, 9 aa, Homo Sapiens
GICVCTFSL

SEQ ID NO: 1037599 - protein, 9 aa, Homo Sapiens
VPCNCDLRG

SEQ ID NO: 1037600 - protein, 9 aa, Homo Sapiens
RLWANHRVH

SEQ ID NO: 1037601 - protein, 9 aa, Homo Sapiens
EDRGIHPRS

SEQ ID NO: 1037602 - protein, 9 aa, Homo Sapiens
AAEKHKAFS

SEQ ID NO: 1037603 - protein, 9 aa, Homo Sapiens
MMNVSGVGF

SEQ ID NO: 1037604 - protein, 9 aa, Homo Sapiens
SKDSPFLAE

SEQ ID NO: 1037605 - protein, 9 aa, Homo Sapiens
LKEETAQLT

SEQ ID NO: 1037606 - protein, 9 aa, Homo Sapiens
LTRGILYQD

SEQ ID NO: 1037607 - protein, 9 aa, Homo Sapiens
LCKHCHKKP

SEQ ID NO: 1037608 - protein, 9 aa, Homo Sapiens
ILDASGHKS

SEQ ID NO: 1037609 - protein, 9 aa, Homo Sapiens
HQHNRTTKN

SEQ ID NO: 1037610 - protein, 9 aa, Homo Sapiens
FFVADKVIV

SEQ ID NO: 1037611 - protein, 9 aa, Homo Sapiens
RWAQGASEL

SEQ ID NO: 1037612 - protein, 9 aa, Homo Sapiens
SKKKKDKII

SEQ ID NO: 1037613 - protein, 9 aa, Homo Sapiens
QLASLEKVR

SEQ ID NO: 1037614 - protein, 9 aa, Homo Sapiens
INSSLQISM

SEQ ID NO: 1037615 - protein, 9 aa, Homo Sapiens
EQLASLEKV

SEQ ID NO: 1037616 - protein, 9 aa, Homo Sapiens
VPGIDGIEG

SEQ ID NO: 1037617 - protein, 9 aa, Homo Sapiens
ESFNLKQNV

SEQ ID NO: 1037618 - protein, 9 aa, Homo Sapiens
TAYLPCRFT

SEQ ID NO: 1037619 - protein, 9 aa, Homo Sapiens
SRLGLSSLL

SEQ ID NO: 1037620 - protein, 9 aa, Homo Sapiens
SSAHYGGPS

SEQ ID NO: 1037621 - protein, 9 aa, Homo Sapiens
SHSRELVLV

SEQ ID NO: 1037622 - protein, 9 aa, Homo Sapiens
VSQPSPYQV

SEQ ID NO: 1037623 - protein, 9 aa, Homo Sapiens
AHINEKKNT

SEQ ID NO: 1037624 - protein, 9 aa, Homo Sapiens
SKQSDSRFS

SEQ ID NO: 1037625 - protein, 9 aa, Homo Sapiens
IYGRVIVCD

SEQ ID NO: 1037626 - protein, 9 aa, Homo Sapiens
EEATQPHKE

SEQ ID NO: 1037627 - protein, 9 aa, Homo Sapiens
KNMVDCSKL

SEQ ID NO: 1037628 - protein, 9 aa, Homo Sapiens
DKYKLNSEG

SEQ ID NO: 1037629 - protein, 9 aa, Homo Sapiens
DKESGASVN

SEQ ID NO: 1037630 - protein, 9 aa, Homo Sapiens
PSQDLGCYL

SEQ ID NO: 1037631 - protein, 9 aa, Homo Sapiens
PVIVPELSK

SEQ ID NO: 1037632 - protein, 9 aa, Homo Sapiens
PSSPGSADP

SEQ ID NO: 1037633 - protein, 9 aa, Homo Sapiens
VALGPTEPA

SEQ ID NO: 1037634 - protein, 9 aa, Homo Sapiens
HSQKFSKCS

SEQ ID NO: 1037635 - protein, 9 aa, Homo Sapiens
VDGLLTGHK

SEQ ID NO: 1037636 - protein, 9 aa, Homo Sapiens
AAGMEYLFS

SEQ ID NO: 1037637 - protein, 9 aa, Homo Sapiens
SMVDLMTYG

SEQ ID NO: 1037638 - protein, 9 aa, Homo Sapiens
VGEVNSQFS

SEQ ID NO: 1037639 - protein, 9 aa, Homo Sapiens
LVDCFIQLL

SEQ ID NO: 1037640 - protein, 9 aa, Homo Sapiens
FIAAVKAVE

SEQ ID NO: 1037641 - protein, 9 aa, Homo Sapiens
TSVFISSTK

SEQ ID NO: 1037642 - protein, 9 aa, Homo Sapiens
MRRLITRGG

SEQ ID NO: 1037643 - protein, 9 aa, Homo Sapiens
DSHSLHGLV

SEQ ID NO: 1037644 - protein, 9 aa, Homo Sapiens
LNSLPLQAA

SEQ ID NO: 1037645 - protein, 9 aa, Homo Sapiens
SLQIRYSLG

SEQ ID NO: 1037646 - protein, 9 aa, Homo Sapiens
RFRGFRYSE

SEQ ID NO: 1037647 - protein, 9 aa, Homo Sapiens
SELSSSPPR

SEQ ID NO: 1037648 - protein, 9 aa, Homo Sapiens
IRKLPYQRL

SEQ ID NO: 1037649 - protein, 9 aa, Homo Sapiens
TGNIHATKR

SEQ ID NO: 1037650 - protein, 9 aa, Homo Sapiens
IDEAANIND

SEQ ID NO: 1037651 - protein, 9 aa, Homo Sapiens
GCNKVFMIN

SEQ ID NO: 1037652 - protein, 9 aa, Homo Sapiens
GTKIYQWCG

SEQ ID NO: 1037653 - protein, 9 aa, Homo Sapiens
VRNDGARSM

SEQ ID NO: 1037654 - protein, 9 aa, Homo Sapiens
EIFGCFAPT

SEQ ID NO: 1037655 - protein, 9 aa, Homo Sapiens
EAGAETGQS

SEQ ID NO: 1037656 - protein, 9 aa, Homo Sapiens
VYTCVPAYV

SEQ ID NO: 1037657 - protein, 9 aa, Homo Sapiens
VELGCVNFP

SEQ ID NO: 1037658 - protein, 9 aa, Homo Sapiens
VFVLGLAGA

SEQ ID NO: 1037659 - protein, 9 aa, Homo Sapiens
SESLDKEEK

SEQ ID NO: 1037660 - protein, 9 aa, Homo Sapiens
EAVLLDLTD

SEQ ID NO: 1037661 - protein, 9 aa, Homo Sapiens
RLETHAAGH

SEQ ID NO: 1037662 - protein, 9 aa, Homo Sapiens
KKTHSIRST

SEQ ID NO: 1037663 - protein, 9 aa, Homo Sapiens
PGPFSAGPL

SEQ ID NO: 1037664 - protein, 9 aa, Homo Sapiens
KAFSKALES

SEQ ID NO: 1037665 - protein, 9 aa, Homo Sapiens
RKFQRHDLI

SEQ ID NO: 1037666 - protein, 9 aa, Homo Sapiens
VSVIKQLAQ

SEQ ID NO: 1037667 - protein, 9 aa, Homo Sapiens
TVFVKKKHY

SEQ ID NO: 1037668 - protein, 9 aa, Homo Sapiens
GPRKKIEDP

SEQ ID NO: 1037669 - protein, 9 aa, Homo Sapiens
SSGDMVQLL

SEQ ID NO: 1037670 - protein, 9 aa, Homo Sapiens
GFSPKELMP

SEQ ID NO: 1037671 - protein, 9 aa, Homo Sapiens
LTSALTVYV

SEQ ID NO: 1037672 - protein, 9 aa, Homo Sapiens
REKIVIMDP

SEQ ID NO: 1037673 - protein, 9 aa, Homo Sapiens
NGPSYGRYY

SEQ ID NO: 1037674 - protein, 9 aa, Homo Sapiens
EFSSSTGLI

SEQ ID NO: 1037675 - protein, 9 aa, Homo Sapiens
KERNVFCGT

SEQ ID NO: 1037676 - protein, 9 aa, Homo Sapiens
PPSPEPPSS

SEQ ID NO: 1037677 - protein, 9 aa, Homo Sapiens
FSRVLQAFL

SEQ ID NO: 1037678 - protein, 9 aa, Homo Sapiens
EEYQLSYHD

SEQ ID NO: 1037679 - protein, 9 aa, Homo Sapiens
WEVTVRDLL

SEQ ID NO: 1037680 - protein, 9 aa, Homo Sapiens
GNTVRNDGA

SEQ ID NO: 1037681 - protein, 9 aa, Homo Sapiens
DSFAPRGQR

SEQ ID NO: 1037682 - protein, 9 aa, Homo Sapiens
NHRCSLSEE

SEQ ID NO: 1037683 - protein, 9 aa, Homo Sapiens
EVTLVAPKE

SEQ ID NO: 1037684 - protein, 9 aa, Homo Sapiens
VYADQISTP

SEQ ID NO: 1037685 - protein, 9 aa, Homo Sapiens
KTRSSRRRR

SEQ ID NO: 1037686 - protein, 9 aa, Homo Sapiens
FCYQNLWSS

SEQ ID NO: 1037687 - protein, 9 aa, Homo Sapiens
NGSCVKISF

SEQ ID NO: 1037688 - protein, 9 aa, Homo Sapiens
IARQKQILV

SEQ ID NO: 1037689 - protein, 9 aa, Homo Sapiens
AVEFCCQVQ

SEQ ID NO: 1037690 - protein, 9 aa, Homo Sapiens
VSTGHATPF

SEQ ID NO: 1037691 - protein, 9 aa, Homo Sapiens
RASVFPPDS

SEQ ID NO: 1037692 - protein, 9 aa, Homo Sapiens
FSEAFYEIF

SEQ ID NO: 1037693 - protein, 9 aa, Homo Sapiens
VTMGLDGAE

SEQ ID NO: 1037694 - protein, 9 aa, Homo Sapiens
IYIEQQKTI

SEQ ID NO: 1037695 - protein, 9 aa, Homo Sapiens
LEATDNNDI

SEQ ID NO: 1037696 - protein, 9 aa, Homo Sapiens
HSRKKLLNA

SEQ ID NO: 1037697 - protein, 9 aa, Homo Sapiens
ALQTFRVLR

SEQ ID NO: 1037698 - protein, 9 aa, Homo Sapiens
GMAIKISCF

SEQ ID NO: 1037699 - protein, 9 aa, Homo Sapiens
QKLRSASSI

SEQ ID NO: 1037700 - protein, 9 aa, Homo Sapiens
VESSLLVPI

SEQ ID NO: 1037701 - protein, 9 aa, Homo Sapiens
STGGRSAQA

SEQ ID NO: 1037702 - protein, 9 aa, Homo Sapiens
KPRGKPRFK

SEQ ID NO: 1037703 - protein, 9 aa, Homo Sapiens
MSFFFFGFF

SEQ ID NO: 1037704 - protein, 9 aa, Homo Sapiens
VAPKEPKIV

SEQ ID NO: 1037705 - protein, 9 aa, Homo Sapiens
FTYIALTIA

SEQ ID NO: 1037706 - protein, 9 aa, Homo Sapiens
SLPFKEALE

SEQ ID NO: 1037707 - protein, 9 aa, Homo Sapiens
LLLQINLER

SEQ ID NO: 1037708 - protein, 9 aa, Homo Sapiens
KKSNPKGVE

SEQ ID NO: 1037709 - protein, 9 aa, Homo Sapiens
LHLKYNEKF

SEQ ID NO: 1037710 - protein, 9 aa, Homo Sapiens
SQVPVEEIA

SEQ ID NO: 1037711 - protein, 9 aa, Homo Sapiens
LTNNVLAFG

SEQ ID NO: 1037712 - protein, 9 aa, Homo Sapiens
CMEHLLQIS

SEQ ID NO: 1037713 - protein, 9 aa, Homo Sapiens
KKLETDIFQ

SEQ ID NO: 1037714 - protein, 9 aa, Homo Sapiens
SVNEVARQL

SEQ ID NO: 1037715 - protein, 9 aa, Homo Sapiens
GESTSGGQM

SEQ ID NO: 1037716 - protein, 9 aa, Homo Sapiens
SLFSRAASC

SEQ ID NO: 1037717 - protein, 9 aa, Homo Sapiens
IFNTNSFFQ

SEQ ID NO: 1037718 - protein, 9 aa, Homo Sapiens
CGSDGKLQE

SEQ ID NO: 1037719 - protein, 9 aa, Homo Sapiens
IGKRGLNLS

SEQ ID NO: 1037720 - protein, 9 aa, Homo Sapiens
AGTKARFLL

SEQ ID NO: 1037721 - protein, 9 aa, Homo Sapiens
CFWLLVIFT

SEQ ID NO: 1037722 - protein, 9 aa, Homo Sapiens
PFMLCVTMG

SEQ ID NO: 1037723 - protein, 9 aa, Homo Sapiens
SPEAAQAHG

SEQ ID NO: 1037724 - protein, 9 aa, Homo Sapiens
AWLPGEDMR

SEQ ID NO: 1037725 - protein, 9 aa, Homo Sapiens
MAKPEKAPA

SEQ ID NO: 1037726 - protein, 9 aa, Homo Sapiens
SAVLSMDNN

SEQ ID NO: 1037727 - protein, 9 aa, Homo Sapiens
DLLQHDQIY

SEQ ID NO: 1037728 - protein, 9 aa, Homo Sapiens
YIDAVVHEI

SEQ ID NO: 1037729 - protein, 9 aa, Homo Sapiens
SNFTGHKKR

SEQ ID NO: 1037730 - protein, 9 aa, Homo Sapiens
RSRPSFCRT

SEQ ID NO: 1037731 - protein, 9 aa, Homo Sapiens
GEMGKKGEM

SEQ ID NO: 1037732 - protein, 9 aa, Homo Sapiens
LFFAPGLPC

SEQ ID NO: 1037733 - protein, 9 aa, Homo Sapiens
SWGTVCNDS

SEQ ID NO: 1037734 - protein, 9 aa, Homo Sapiens
GNGFHVGQT

SEQ ID NO: 1037735 - protein, 9 aa, Homo Sapiens
AKSVFFSDV

SEQ ID NO: 1037736 - protein, 9 aa, Homo Sapiens
LDWSHWGGY

SEQ ID NO: 1037737 - protein, 9 aa, Homo Sapiens
VASFLLKVW

SEQ ID NO: 1037738 - protein, 9 aa, Homo Sapiens
VLKIPSAAE

SEQ ID NO: 1037739 - protein, 9 aa, Homo Sapiens
GAPLSHPSL

SEQ ID NO: 1037740 - protein, 9 aa, Homo Sapiens
FESPRLSRK

SEQ ID NO: 1037741 - protein, 9 aa, Homo Sapiens
AWYIEFLVL

SEQ ID NO: 1037742 - protein, 9 aa, Homo Sapiens
LLQINLERE

SEQ ID NO: 1037743 - protein, 9 aa, Homo Sapiens
NCKKLGLMF

SEQ ID NO: 1037744 - protein, 9 aa, Homo Sapiens
SNGPSYGRY

SEQ ID NO: 1037745 - protein, 9 aa, Homo Sapiens
RVTDANYGK

SEQ ID NO: 1037746 - protein, 9 aa, Homo Sapiens
PELSKPRQS

SEQ ID NO: 1037747 - protein, 9 aa, Homo Sapiens
LQNWSPVMP

SEQ ID NO: 1037748 - protein, 9 aa, Homo Sapiens
FQSLNLYNN

SEQ ID NO: 1037749 - protein, 9 aa, Homo Sapiens
EHKTFKFTS

SEQ ID NO: 1037750 - protein, 9 aa, Homo Sapiens
IKIRNREIE

SEQ ID NO: 1037751 - protein, 9 aa, Homo Sapiens
SLPFMLCVT

SEQ ID NO: 1037752 - protein, 9 aa, Homo Sapiens
APVIVPELS

SEQ ID NO: 1037753 - protein, 9 aa, Homo Sapiens
MKFIWSTRR

SEQ ID NO: 1037754 - protein, 9 aa, Homo Sapiens
QWRELSDFE

SEQ ID NO: 1037755 - protein, 9 aa, Homo Sapiens
DCFIQLLKV

SEQ ID NO: 1037756 - protein, 9 aa, Homo Sapiens
RLLLMGTPV

SEQ ID NO: 1037757 - protein, 9 aa, Homo Sapiens
EIFFTSIFI

SEQ ID NO: 1037758 - protein, 9 aa, Homo Sapiens
CQDENRKLA

SEQ ID NO: 1037759 - protein, 9 aa, Homo Sapiens
HSSGDMVQL

SEQ ID NO: 1037760 - protein, 9 aa, Homo Sapiens
DYQSSLENL

SEQ ID NO: 1037761 - protein, 9 aa, Homo Sapiens
SGPPGIPGR

SEQ ID NO: 1037762 - protein, 9 aa, Homo Sapiens
PSTFHVQSW

SEQ ID NO: 1037763 - protein, 9 aa, Homo Sapiens
ATEKIERDL

SEQ ID NO: 1037764 - protein, 9 aa, Homo Sapiens
SSLRKMETF

SEQ ID NO: 1037765 - protein, 9 aa, Homo Sapiens
NYTTTLTPK

SEQ ID NO: 1037766 - protein, 9 aa, Homo Sapiens
QRRVTFEDV

SEQ ID NO: 1037767 - protein, 9 aa, Homo Sapiens
KLEPPEQQE

SEQ ID NO: 1037768 - protein, 9 aa, Homo Sapiens
ATVGMGKAR

SEQ ID NO: 1037769 - protein, 9 aa, Homo Sapiens
RYSGTQNDV

SEQ ID NO: 1037770 - protein, 9 aa, Homo Sapiens
MSKDNMSST

SEQ ID NO: 1037771 - protein, 9 aa, Homo Sapiens
DASGHKSFV

SEQ ID NO: 1037772 - protein, 9 aa, Homo Sapiens
LKQNVTFHV

SEQ ID NO: 1037773 - protein, 9 aa, Homo Sapiens
AGCRDPSLP

SEQ ID NO: 1037774 - protein, 9 aa, Homo Sapiens
VQIFRIMQI

SEQ ID NO: 1037775 - protein, 9 aa, Homo Sapiens
FPGGLGKHR

SEQ ID NO: 1037776 - protein, 9 aa, Homo Sapiens
DGGAVKEGA

SEQ ID NO: 1037777 - protein, 9 aa, Homo Sapiens
PVASRGKAS

SEQ ID NO: 1037778 - protein, 9 aa, Homo Sapiens
IKVDLLFTE

SEQ ID NO: 1037779 - protein, 9 aa, Homo Sapiens
SLPRDSPLS

SEQ ID NO: 1037780 - protein, 9 aa, Homo Sapiens
STHQTYLVV

SEQ ID NO: 1037781 - protein, 9 aa, Homo Sapiens
SGEETLSVK

SEQ ID NO: 1037782 - protein, 9 aa, Homo Sapiens
SFKPVPKPR

SEQ ID NO: 1037783 - protein, 9 aa, Homo Sapiens
ESKDSPFLA

SEQ ID NO: 1037784 - protein, 9 aa, Homo Sapiens
YNLATEKIE

SEQ ID NO: 1037785 - protein, 9 aa, Homo Sapiens
HGSPRYLGG

SEQ ID NO: 1037786 - protein, 9 aa, Homo Sapiens
CRMTHLLGM

SEQ ID NO: 1037787 - protein, 9 aa, Homo Sapiens
FRGADYFLR

SEQ ID NO: 1037788 - protein, 9 aa, Homo Sapiens
AAESGGLGR

SEQ ID NO: 1037789 - protein, 9 aa, Homo Sapiens
KVLKNQMFI

SEQ ID NO: 1037790 - protein, 9 aa, Homo Sapiens
NVSTHAATK

SEQ ID NO: 1037791 - protein, 9 aa, Homo Sapiens
ERWQIKAQR

SEQ ID NO: 1037792 - protein, 9 aa, Homo Sapiens
NENATDIND

SEQ ID NO: 1037793 - protein, 9 aa, Homo Sapiens
KVTGLQNRN

SEQ ID NO: 1037794 - protein, 9 aa, Homo Sapiens
LTQPLDLKC

SEQ ID NO: 1037795 - protein, 9 aa, Homo Sapiens
DGEPFFWQY

SEQ ID NO: 1037796 - protein, 9 aa, Homo Sapiens
KEATPGRRI

SEQ ID NO: 1037797 - protein, 9 aa, Homo Sapiens
KSLSSLAVS

SEQ ID NO: 1037798 - protein, 9 aa, Homo Sapiens
PARRAPGEA

SEQ ID NO: 1037799 - protein, 9 aa, Homo Sapiens
QLKPKNTIA

SEQ ID NO: 1037800 - protein, 9 aa, Homo Sapiens
NPLSLKNEP

SEQ ID NO: 1037801 - protein, 9 aa, Homo Sapiens
ARPLPTPSH

SEQ ID NO: 1037802 - protein, 9 aa, Homo Sapiens
AFAIAIRNT

SEQ ID NO: 1037803 - protein, 9 aa, Homo Sapiens
TFPDGRFLP

SEQ ID NO: 1037804 - protein, 9 aa, Homo Sapiens
HEFVDKQVF

SEQ ID NO: 1037805 - protein, 9 aa, Homo Sapiens
GTAATSITK

SEQ ID NO: 1037806 - protein, 9 aa, Homo Sapiens
NKINFFNGI

SEQ ID NO: 1037807 - protein, 9 aa, Homo Sapiens
LSLKNEPKI

SEQ ID NO: 1037808 - protein, 9 aa, Homo Sapiens
GAKGKPAVA

SEQ ID NO: 1037809 - protein, 9 aa, Homo Sapiens
VEEIAILHQ

SEQ ID NO: 1037810 - protein, 9 aa, Homo Sapiens
RLTREGKTS

SEQ ID NO: 1037811 - protein, 9 aa, Homo Sapiens
KSYICTEYG

SEQ ID NO: 1037812 - protein, 9 aa, Homo Sapiens
TLESKEDFR

SEQ ID NO: 1037813 - protein, 9 aa, Homo Sapiens
CLSVSQPSP

SEQ ID NO: 1037814 - protein, 9 aa, Homo Sapiens
LLAMRANAT

SEQ ID NO: 1037815 - protein, 9 aa, Homo Sapiens
AAEWSMSFF

SEQ ID NO: 1037816 - protein, 9 aa, Homo Sapiens
TILTGMLIE

SEQ ID NO: 1037817 - protein, 9 aa, Homo Sapiens
SEQEVKSDR

SEQ ID NO: 1037818 - protein, 9 aa, Homo Sapiens
SLFREALVL

SEQ ID NO: 1037819 - protein, 9 aa, Homo Sapiens
PSELIFVSH

SEQ ID NO: 1037820 - protein, 9 aa, Homo Sapiens
LSSLQGLFI

SEQ ID NO: 1037821 - protein, 9 aa, Homo Sapiens
SINVFEDYI

SEQ ID NO: 1037822 - protein, 9 aa, Homo Sapiens
FFVGCTAQH

SEQ ID NO: 1037823 - protein, 9 aa, Homo Sapiens
AYSFPVAAL

SEQ ID NO: 1037824 - protein, 9 aa, Homo Sapiens
WEENTVYQE

SEQ ID NO: 1037825 - protein, 9 aa, Homo Sapiens
REVDGEPFF

SEQ ID NO: 1037826 - protein, 9 aa, Homo Sapiens
QKKKEEFMK

SEQ ID NO: 1037827 - protein, 9 aa, Homo Sapiens
GSQENREHN

SEQ ID NO: 1037828 - protein, 9 aa, Homo Sapiens
LSLESGILR

SEQ ID NO: 1037829 - protein, 9 aa, Homo Sapiens
DGNIRYYKV

SEQ ID NO: 1037830 - protein, 9 aa, Homo Sapiens
KQARGGFAE

SEQ ID NO: 1037831 - protein, 9 aa, Homo Sapiens
LITAWYIEF

SEQ ID NO: 1037832 - protein, 9 aa, Homo Sapiens
IWTLTSSGQ

SEQ ID NO: 1037833 - protein, 9 aa, Homo Sapiens
VKYLDFSVY

SEQ ID NO: 1037834 - protein, 9 aa, Homo Sapiens
IILGPLSHC

SEQ ID NO: 1037835 - protein, 9 aa, Homo Sapiens
EKGEMGKKG

SEQ ID NO: 1037836 - protein, 9 aa, Homo Sapiens
RAKPGTAWL

SEQ ID NO: 1037837 - protein, 9 aa, Homo Sapiens
DFLSLLILS

SEQ ID NO: 1037838 - protein, 9 aa, Homo Sapiens
LLFYALILR

SEQ ID NO: 1037839 - protein, 9 aa, Homo Sapiens
GHARSRRCA

SEQ ID NO: 1037840 - protein, 9 aa, Homo Sapiens
VLDSKEQLL

SEQ ID NO: 1037841 - protein, 9 aa, Homo Sapiens
PDAQPEGEL

SEQ ID NO: 1037842 - protein, 9 aa, Homo Sapiens
RVLTYRKQF

SEQ ID NO: 1037843 - protein, 9 aa, Homo Sapiens
GASVNEVAR

SEQ ID NO: 1037844 - protein, 9 aa, Homo Sapiens
FIDGSFEIE

SEQ ID NO: 1037845 - protein, 9 aa, Homo Sapiens
KLPLVTREG

SEQ ID NO: 1037846 - protein, 9 aa, Homo Sapiens
PKKPVGEVN

SEQ ID NO: 1037847 - protein, 9 aa, Homo Sapiens
PNKYIPNVR

SEQ ID NO: 1037848 - protein, 9 aa, Homo Sapiens
REHHQPITA

SEQ ID NO: 1037849 - protein, 9 aa, Homo Sapiens
QYRAAPVGR

SEQ ID NO: 1037850 - protein, 9 aa, Homo Sapiens
FIGTLVQAT

SEQ ID NO: 1037851 - protein, 9 aa, Homo Sapiens
FSLILSSYD

SEQ ID NO: 1037852 - protein, 9 aa, Homo Sapiens
ARRGRRLGA

SEQ ID NO: 1037853 - protein, 9 aa, Homo Sapiens
VIQLVEMLR

SEQ ID NO: 1037854 - protein, 9 aa, Homo Sapiens
KEQLASLEK

SEQ ID NO: 1037855 - protein, 9 aa, Homo Sapiens
AAQGIRTLL

SEQ ID NO: 1037856 - protein, 9 aa, Homo Sapiens
DRRLFYFLG

SEQ ID NO: 1037857 - protein, 9 aa, Homo Sapiens
DYLSPPSSA

SEQ ID NO: 1037858 - protein, 9 aa, Homo Sapiens
KSPELHLKP

SEQ ID NO: 1037859 - protein, 9 aa, Homo Sapiens
KALKFLNKA

SEQ ID NO: 1037860 - protein, 9 aa, Homo Sapiens
RWPLPQHAQ

SEQ ID NO: 1037861 - protein, 9 aa, Homo Sapiens
SHCGANANP

SEQ ID NO: 1037862 - protein, 9 aa, Homo Sapiens
SSEMVKKSE

SEQ ID NO: 1037863 - protein, 9 aa, Homo Sapiens
PVEEIAILH

SEQ ID NO: 1037864 - protein, 9 aa, Homo Sapiens
TPSEFLKKM

SEQ ID NO: 1037865 - protein, 9 aa, Homo Sapiens
GISKPVRPM

SEQ ID NO: 1037866 - protein, 9 aa, Homo Sapiens
DTSAVLSMD

SEQ ID NO: 1037867 - protein, 9 aa, Homo Sapiens
NDIYGAAWI

SEQ ID NO: 1037868 - protein, 9 aa, Homo Sapiens
QAAFEECDT

SEQ ID NO: 1037869 - protein, 9 aa, Homo Sapiens
LQRSGWMSV

SEQ ID NO: 1037870 - protein, 9 aa, Homo Sapiens
KPGYQGIAE

SEQ ID NO: 1037871 - protein, 9 aa, Homo Sapiens
RGFHLRPEP

SEQ ID NO: 1037872 - protein, 9 aa, Homo Sapiens
KQSDSRFSL

SEQ ID NO: 1037873 - protein, 9 aa, Homo Sapiens
CDTDRDGYI

SEQ ID NO: 1037874 - protein, 9 aa, Homo Sapiens
GNGTWRYLN

SEQ ID NO: 1037875 - protein, 9 aa, Homo Sapiens
APCGACLTQ

SEQ ID NO: 1037876 - protein, 9 aa, Homo Sapiens
TTNVAIYTV

SEQ ID NO: 1037877 - protein, 9 aa, Homo Sapiens
GQVRQGKEQ

SEQ ID NO: 1037878 - protein, 9 aa, Homo Sapiens
LLKKFKTIQ

SEQ ID NO: 1037879 - protein, 9 aa, Homo Sapiens
QAATHLESD

SEQ ID NO: 1037880 - protein, 9 aa, Homo Sapiens
NFSRVLQAF

SEQ ID NO: 1037881 - protein, 9 aa, Homo Sapiens
QMEHKGEFT

SEQ ID NO: 1037882 - protein, 9 aa, Homo Sapiens
SGIFVGFFS

SEQ ID NO: 1037883 - protein, 9 aa, Homo Sapiens
TEERRAVAA

SEQ ID NO: 1037884 - protein, 9 aa, Homo Sapiens
SYWSDWPVP

SEQ ID NO: 1037885 - protein, 9 aa, Homo Sapiens
KGKPAVAMP

SEQ ID NO: 1037886 - protein, 9 aa, Homo Sapiens
EGEYLDWSH

SEQ ID NO: 1037887 - protein, 9 aa, Homo Sapiens
YRASLVSRS

SEQ ID NO: 1037888 - protein, 9 aa, Homo Sapiens
PLPSKIQSK

SEQ ID NO: 1037889 - protein, 9 aa, Homo Sapiens
CDFLSLLIL

SEQ ID NO: 1037890 - protein, 9 aa, Homo Sapiens
FVQGSGADG

SEQ ID NO: 1037891 - protein, 9 aa, Homo Sapiens
QVEKNQCLN

SEQ ID NO: 1037892 - protein, 9 aa, Homo Sapiens
PNRVMRYAI

SEQ ID NO: 1037893 - protein, 9 aa, Homo Sapiens
RLPPALRPA

SEQ ID NO: 1037894 - protein, 9 aa, Homo Sapiens
VEAAVKQFL

SEQ ID NO: 1037895 - protein, 9 aa, Homo Sapiens
LSYKALLTR

SEQ ID NO: 1037896 - protein, 9 aa, Homo Sapiens
PGAPEREAE

SEQ ID NO: 1037897 - protein, 9 aa, Homo Sapiens
TPMHKNPEW

SEQ ID NO: 1037898 - protein, 9 aa, Homo Sapiens
RMFEIQNEL

SEQ ID NO: 1037899 - protein, 9 aa, Homo Sapiens
LAKARRQNV

SEQ ID NO: 1037900 - protein, 9 aa, Homo Sapiens
ASLRSCTGR

SEQ ID NO: 1037901 - protein, 9 aa, Homo Sapiens
LEVFPSKAE

SEQ ID NO: 1037902 - protein, 9 aa, Homo Sapiens
RDPSLPLLK

SEQ ID NO: 1037903 - protein, 9 aa, Homo Sapiens
VLAKYFSGR

SEQ ID NO: 1037904 - protein, 9 aa, Homo Sapiens
VKPLNRAVF

SEQ ID NO: 1037905 - protein, 9 aa, Homo Sapiens
ETEPRTESS

SEQ ID NO: 1037906 - protein, 9 aa, Homo Sapiens
KMNHRDLLQ

SEQ ID NO: 1037907 - protein, 9 aa, Homo Sapiens
QSCNTDSCP

SEQ ID NO: 1037908 - protein, 9 aa, Homo Sapiens
TLEATQQPM

SEQ ID NO: 1037909 - protein, 9 aa, Homo Sapiens
LCGCARITP

SEQ ID NO: 1037910 - protein, 9 aa, Homo Sapiens
DKFQVAVNE

SEQ ID NO: 1037911 - protein, 9 aa, Homo Sapiens
FVFVMKNGT

SEQ ID NO: 1037912 - protein, 9 aa, Homo Sapiens
HGNCNPTQQ

SEQ ID NO: 1037913 - protein, 9 aa, Homo Sapiens
NQKTSEMRL

SEQ ID NO: 1037914 - protein, 9 aa, Homo Sapiens
NLDYPVISC

SEQ ID NO: 1037915 - protein, 9 aa, Homo Sapiens
TLDINGVTL

SEQ ID NO: 1037916 - protein, 9 aa, Homo Sapiens
IKWRNSKER

SEQ ID NO: 1037917 - protein, 9 aa, Homo Sapiens
LTVDSVTHT

SEQ ID NO: 1037918 - protein, 9 aa, Homo Sapiens
EHCHSECVA

SEQ ID NO: 1037919 - protein, 9 aa, Homo Sapiens
LLGCPVSLG

SEQ ID NO: 1037920 - protein, 9 aa, Homo Sapiens
GDENEDDQD

SEQ ID NO: 1037921 - protein, 9 aa, Homo Sapiens
SFYYDVERC

SEQ ID NO: 1037922 - protein, 9 aa, Homo Sapiens
LTREGKTSE

SEQ ID NO: 1037923 - protein, 9 aa, Homo Sapiens
PSSSGRAGP

SEQ ID NO: 1037924 - protein, 9 aa, Homo Sapiens
LSNNYSYLI

SEQ ID NO: 1037925 - protein, 9 aa, Homo Sapiens
MAQNQTTPM

SEQ ID NO: 1037926 - protein, 9 aa, Homo Sapiens
EELTQPLDL

SEQ ID NO: 1037927 - protein, 9 aa, Homo Sapiens
SLWKPPPGL

SEQ ID NO: 1037928 - protein, 9 aa, Homo Sapiens
NGIFLNLRH

SEQ ID NO: 1037929 - protein, 9 aa, Homo Sapiens
TSPQGFPPR

SEQ ID NO: 1037930 - protein, 9 aa, Homo Sapiens
EEIAILHQF

SEQ ID NO: 1037931 - protein, 9 aa, Homo Sapiens
DQDMIESLF

SEQ ID NO: 1037932 - protein, 9 aa, Homo Sapiens
PAWSGARRG

SEQ ID NO: 1037933 - protein, 9 aa, Homo Sapiens
VSGDNYPLP

SEQ ID NO: 1037934 - protein, 9 aa, Homo Sapiens
NILWAFEAI

SEQ ID NO: 1037935 - protein, 9 aa, Homo Sapiens
EKFEKNVSV

SEQ ID NO: 1037936 - protein, 9 aa, Homo Sapiens
LPVTCPLVS

SEQ ID NO: 1037937 - protein, 9 aa, Homo Sapiens
KLKCLSGQL

SEQ ID NO: 1037938 - protein, 9 aa, Homo Sapiens
LLYIVVSVL

SEQ ID NO: 1037939 - protein, 9 aa, Homo Sapiens
ALGCPDGNL

SEQ ID NO: 1037940 - protein, 9 aa, Homo Sapiens
PENFPQTPL

SEQ ID NO: 1037941 - protein, 9 aa, Homo Sapiens
ARADARLPP

SEQ ID NO: 1037942 - protein, 9 aa, Homo Sapiens
PWGSCHFLK

SEQ ID NO: 1037943 - protein, 9 aa, Homo Sapiens
GFLSELPAV

SEQ ID NO: 1037944 - protein, 9 aa, Homo Sapiens
KIDLEEKLS

SEQ ID NO: 1037945 - protein, 9 aa, Homo Sapiens
DLSIQLSSV

SEQ ID NO: 1037946 - protein, 9 aa, Homo Sapiens
QNVTFHVIL

SEQ ID NO: 1037947 - protein, 9 aa, Homo Sapiens
QKIFKLHAK

SEQ ID NO: 1037948 - protein, 9 aa, Homo Sapiens
KISFSPGSR

SEQ ID NO: 1037949 - protein, 9 aa, Homo Sapiens
AESTEMEFD

SEQ ID NO: 1037950 - protein, 9 aa, Homo Sapiens
GYLSSEVLR

SEQ ID NO: 1037951 - protein, 9 aa, Homo Sapiens
RAYSFPVAA

SEQ ID NO: 1037952 - protein, 9 aa, Homo Sapiens
RGKDTADRP

SEQ ID NO: 1037953 - protein, 9 aa, Homo Sapiens
TRRQNPSCG

SEQ ID NO: 1037954 - protein, 9 aa, Homo Sapiens
CALPALGTS

SEQ ID NO: 1037955 - protein, 9 aa, Homo Sapiens
NNMRRPSSL

SEQ ID NO: 1037956 - protein, 9 aa, Homo Sapiens
CEKAFCSGS

SEQ ID NO: 1037957 - protein, 9 aa, Homo Sapiens
EFSGRPLDR

SEQ ID NO: 1037958 - protein, 9 aa, Homo Sapiens
LFSVFKYMA

SEQ ID NO: 1037959 - protein, 9 aa, Homo Sapiens
LKAGTWRSL

SEQ ID NO: 1037960 - protein, 9 aa, Homo Sapiens
QIKDFLEET

SEQ ID NO: 1037961 - protein, 9 aa, Homo Sapiens
MRLRFPIKS

SEQ ID NO: 1037962 - protein, 9 aa, Homo Sapiens
MWLRKVIYR

SEQ ID NO: 1037963 - protein, 9 aa, Homo Sapiens
RYYVGWADK

SEQ ID NO: 1037964 - protein, 9 aa, Homo Sapiens
SEFVDNASM

SEQ ID NO: 1037965 - protein, 9 aa, Homo Sapiens
NCPFGFFTD

SEQ ID NO: 1037966 - protein, 9 aa, Homo Sapiens
KCEFVQGSG

SEQ ID NO: 1037967 - protein, 9 aa, Homo Sapiens
TLLLSLESG

SEQ ID NO: 1037968 - protein, 9 aa, Homo Sapiens
RQKPLTPRQ

SEQ ID NO: 1037969 - protein, 9 aa, Homo Sapiens
IIQQLQSLA

SEQ ID NO: 1037970 - protein, 9 aa, Homo Sapiens
ERAIYAASS

SEQ ID NO: 1037971 - protein, 9 aa, Homo Sapiens
REKIDLEEK

SEQ ID NO: 1037972 - protein, 9 aa, Homo Sapiens
AHKGNGEPL

SEQ ID NO: 1037973 - protein, 9 aa, Homo Sapiens
VEEESLMNK

SEQ ID NO: 1037974 - protein, 9 aa, Homo Sapiens
RVHTRVKSY

SEQ ID NO: 1037975 - protein, 9 aa, Homo Sapiens
EKALLQRIQ

SEQ ID NO: 1037976 - protein, 9 aa, Homo Sapiens
LKKASGCPG

SEQ ID NO: 1037977 - protein, 9 aa, Homo Sapiens
EILSLKMSL

SEQ ID NO: 1037978 - protein, 9 aa, Homo Sapiens
KACKSQTLS

SEQ ID NO: 1037979 - protein, 9 aa, Homo Sapiens
QFVNQGFEA

SEQ ID NO: 1037980 - protein, 9 aa, Homo Sapiens
PSSSVSLFC

SEQ ID NO: 1037981 - protein, 9 aa, Homo Sapiens
VKGKKAPTT

SEQ ID NO: 1037982 - protein, 9 aa, Homo Sapiens
PNKVAQLDP

SEQ ID NO: 1037983 - protein, 9 aa, Homo Sapiens
KSNAGVLWP

SEQ ID NO: 1037984 - protein, 9 aa, Homo Sapiens
WISPPKPRV

SEQ ID NO: 1037985 - protein, 9 aa, Homo Sapiens
DFGGPLHCL

SEQ ID NO: 1037986 - protein, 9 aa, Homo Sapiens
GRVIVCDNN

SEQ ID NO: 1037987 - protein, 9 aa, Homo Sapiens
ILNKSSPEK

SEQ ID NO: 1037988 - protein, 9 aa, Homo Sapiens
SPVMPREAS

SEQ ID NO: 1037989 - protein, 9 aa, Homo Sapiens
VIPKKNSHN

SEQ ID NO: 1037990 - protein, 9 aa, Homo Sapiens
LLAKLAEYV

SEQ ID NO: 1037991 - protein, 9 aa, Homo Sapiens
AFSGREKIV

SEQ ID NO: 1037992 - protein, 9 aa, Homo Sapiens
KFHCIAEVE

SEQ ID NO: 1037993 - protein, 9 aa, Homo Sapiens
DTDEDGQVN

SEQ ID NO: 1037994 - protein, 9 aa, Homo Sapiens
DMVGLSYPP

SEQ ID NO: 1037995 - protein, 9 aa, Homo Sapiens
NSLSKLRAG

SEQ ID NO: 1037996 - protein, 9 aa, Homo Sapiens
PPDSQTPSS

SEQ ID NO: 1037997 - protein, 9 aa, Homo Sapiens
SLKNEPKIW

SEQ ID NO: 1037998 - protein, 9 aa, Homo Sapiens
VFISSTKGM

SEQ ID NO: 1037999 - protein, 9 aa, Homo Sapiens
PLLSRVPPP

SEQ ID NO: 1038000 - protein, 9 aa, Homo Sapiens
YIKAHAGEE

SEQ ID NO: 1038001 - protein, 9 aa, Homo Sapiens
PGKDSKHPR

SEQ ID NO: 1038002 - protein, 9 aa, Homo Sapiens
FGGLFLVLI

SEQ ID NO: 1038003 - protein, 9 aa, Homo Sapiens
KVSVVPKIP

SEQ ID NO: 1038004 - protein, 9 aa, Homo Sapiens
LEAEECKVD

SEQ ID NO: 1038005 - protein, 9 aa, Homo Sapiens
DSDCGFSWP

SEQ ID NO: 1038006 - protein, 9 aa, Homo Sapiens
SLSPKKNRA

SEQ ID NO: 1038007 - protein, 9 aa, Homo Sapiens
CASLLRFKV

SEQ ID NO: 1038008 - protein, 9 aa, Homo Sapiens
QSHIILGLV

SEQ ID NO: 1038009 - protein, 9 aa, Homo Sapiens
VAQKRLQAE

SEQ ID NO: 1038010 - protein, 9 aa, Homo Sapiens
RAVIAPSLF

SEQ ID NO: 1038011 - protein, 9 aa, Homo Sapiens
YLFSHHVVH

SEQ ID NO: 1038012 - protein, 9 aa, Homo Sapiens
RRLSWSGIS

SEQ ID NO: 1038013 - protein, 9 aa, Homo Sapiens
PGGAAARSR

SEQ ID NO: 1038014 - protein, 9 aa, Homo Sapiens
SPQKAKRPQ

SEQ ID NO: 1038015 - protein, 9 aa, Homo Sapiens
SKSLGLGAP

SEQ ID NO: 1038016 - protein, 9 aa, Homo Sapiens
KLSTVSVTG

SEQ ID NO: 1038017 - protein, 9 aa, Homo Sapiens
VKLSTVSVT

SEQ ID NO: 1038018 - protein, 9 aa, Homo Sapiens
SGASSPEQP

SEQ ID NO: 1038019 - protein, 9 aa, Homo Sapiens
LLTSLSNGI

SEQ ID NO: 1038020 - protein, 9 aa, Homo Sapiens
AIVQFVGVS

SEQ ID NO: 1038021 - protein, 9 aa, Homo Sapiens
MAANLLASA

SEQ ID NO: 1038022 - protein, 9 aa, Homo Sapiens
PSSGPRKKI

SEQ ID NO: 1038023 - protein, 9 aa, Homo Sapiens
YCTQPGQKC

SEQ ID NO: 1038024 - protein, 9 aa, Homo Sapiens
ALPEKTRSS

SEQ ID NO: 1038025 - protein, 9 aa, Homo Sapiens
DNSQEAYQE

SEQ ID NO: 1038026 - protein, 9 aa, Homo Sapiens
CHGNCNPTQ

SEQ ID NO: 1038027 - protein, 9 aa, Homo Sapiens
KKKKDKIIS

SEQ ID NO: 1038028 - protein, 9 aa, Homo Sapiens
AERLARAKE

SEQ ID NO: 1038029 - protein, 9 aa, Homo Sapiens
YVDLETKKT

SEQ ID NO: 1038030 - protein, 9 aa, Homo Sapiens
PSVLPYDSL

SEQ ID NO: 1038031 - protein, 9 aa, Homo Sapiens
PSAVSPPSV

SEQ ID NO: 1038032 - protein, 9 aa, Homo Sapiens
TSTTASETT

SEQ ID NO: 1038033 - protein, 9 aa, Homo Sapiens
KKHFRSGRI

SEQ ID NO: 1038034 - protein, 9 aa, Homo Sapiens
KKSSLLKKL

SEQ ID NO: 1038035 - protein, 9 aa, Homo Sapiens
VKTAFIGTL

SEQ ID NO: 1038036 - protein, 9 aa, Homo Sapiens
LESGAFFLD

SEQ ID NO: 1038037 - protein, 9 aa, Homo Sapiens
GNFKKWVGA

SEQ ID NO: 1038038 - protein, 9 aa, Homo Sapiens
SDTSAVLSM

SEQ ID NO: 1038039 - protein, 9 aa, Homo Sapiens
VSEQHLSQR

SEQ ID NO: 1038040 - protein, 9 aa, Homo Sapiens
FWNTYAQKE

SEQ ID NO: 1038041 - protein, 9 aa, Homo Sapiens
QTNKMLRGI

SEQ ID NO: 1038042 - protein, 9 aa, Homo Sapiens
LSSTSEQVP

SEQ ID NO: 1038043 - protein, 9 aa, Homo Sapiens
LHGCLLEYV

SEQ ID NO: 1038044 - protein, 9 aa, Homo Sapiens
HLKPLNCTT

SEQ ID NO: 1038045 - protein, 9 aa, Homo Sapiens
QRSGWMSVC

SEQ ID NO: 1038046 - protein, 9 aa, Homo Sapiens
HVQMNLHPV

SEQ ID NO: 1038047 - protein, 9 aa, Homo Sapiens
FDKGVRKAF

SEQ ID NO: 1038048 - protein, 9 aa, Homo Sapiens
QGEGKKMHR

SEQ ID NO: 1038049 - protein, 9 aa, Homo Sapiens
NRYSGTQND

SEQ ID NO: 1038050 - protein, 9 aa, Homo Sapiens
MQLSYRAKK

SEQ ID NO: 1038051 - protein, 9 aa, Homo Sapiens
VVCISLANV

SEQ ID NO: 1038052 - protein, 9 aa, Homo Sapiens
KVLEEENLA

SEQ ID NO: 1038053 - protein, 9 aa, Homo Sapiens
SPSGGTRSS

SEQ ID NO: 1038054 - protein, 9 aa, Homo Sapiens
GITDDNITH

SEQ ID NO: 1038055 - protein, 9 aa, Homo Sapiens
PELGAGGTL

SEQ ID NO: 1038056 - protein, 9 aa, Homo Sapiens
SGREKIVIM

SEQ ID NO: 1038057 - protein, 9 aa, Homo Sapiens
AAFEECDTD

SEQ ID NO: 1038058 - protein, 9 aa, Homo Sapiens
LPLLSRVPP

SEQ ID NO: 1038059 - protein, 9 aa, Homo Sapiens
LQSLALGLG

SEQ ID NO: 1038060 - protein, 9 aa, Homo Sapiens
TNSEESYEC

SEQ ID NO: 1038061 - protein, 9 aa, Homo Sapiens
ICLPLVDCF

SEQ ID NO: 1038062 - protein, 9 aa, Homo Sapiens
NLKKPITEI

SEQ ID NO: 1038063 - protein, 9 aa, Homo Sapiens
TYIALTIAR

SEQ ID NO: 1038064 - protein, 9 aa, Homo Sapiens
PGKCKRHRS

SEQ ID NO: 1038065 - protein, 9 aa, Homo Sapiens
WEKPRAIAL

SEQ ID NO: 1038066 - protein, 9 aa, Homo Sapiens
IRGPQAFWA

SEQ ID NO: 1038067 - protein, 9 aa, Homo Sapiens
LQAKLSRTG

SEQ ID NO: 1038068 - protein, 9 aa, Homo Sapiens
GSGSRENST

SEQ ID NO: 1038069 - protein, 9 aa, Homo Sapiens
ANFSSAEKA

SEQ ID NO: 1038070 - protein, 9 aa, Homo Sapiens
RSPLSDQLG

SEQ ID NO: 1038071 - protein, 9 aa, Homo Sapiens
LKILSTKNS

SEQ ID NO: 1038072 - protein, 9 aa, Homo Sapiens
RESHSRELV

SEQ ID NO: 1038073 - protein, 9 aa, Homo Sapiens
LGRDSGPAP

SEQ ID NO: 1038074 - protein, 9 aa, Homo Sapiens
TMTNRLLDE

SEQ ID NO: 1038075 - protein, 9 aa, Homo Sapiens
IVRPSIVSA

SEQ ID NO: 1038076 - protein, 9 aa, Homo Sapiens
DFPDCVPCN

SEQ ID NO: 1038077 - protein, 9 aa, Homo Sapiens
EEKNTIFKA

SEQ ID NO: 1038078 - protein, 9 aa, Homo Sapiens
KQTNKMLRG

SEQ ID NO: 1038079 - protein, 9 aa, Homo Sapiens
ESGASVNEV

SEQ ID NO: 1038080 - protein, 9 aa, Homo Sapiens
RPHEETRPV

SEQ ID NO: 1038081 - protein, 9 aa, Homo Sapiens
FEVCTNTYA

SEQ ID NO: 1038082 - protein, 9 aa, Homo Sapiens
NGFHVGQTV

SEQ ID NO: 1038083 - protein, 9 aa, Homo Sapiens
IFILVVLLI

SEQ ID NO: 1038084 - protein, 9 aa, Homo Sapiens
KVLGQLSAK

SEQ ID NO: 1038085 - protein, 9 aa, Homo Sapiens
VRKVAPDGP

SEQ ID NO: 1038086 - protein, 9 aa, Homo Sapiens
NTGNIHATK

SEQ ID NO: 1038087 - protein, 9 aa, Homo Sapiens
SQEAYQEAF

SEQ ID NO: 1038088 - protein, 9 aa, Homo Sapiens
AETERNDKE

SEQ ID NO: 1038089 - protein, 9 aa, Homo Sapiens
LGRASCAEG

SEQ ID NO: 1038090 - protein, 9 aa, Homo Sapiens
LRISPRSTG

SEQ ID NO: 1038091 - protein, 9 aa, Homo Sapiens
VTNMIELEQ

SEQ ID NO: 1038092 - protein, 9 aa, Homo Sapiens
QVPGAFAAA

SEQ ID NO: 1038093 - protein, 9 aa, Homo Sapiens
DPMLRRRGR

SEQ ID NO: 1038094 - protein, 9 aa, Homo Sapiens
AVGESKKEK

SEQ ID NO: 1038095 - protein, 9 aa, Homo Sapiens
ATFFPSSLR

SEQ ID NO: 1038096 - protein, 9 aa, Homo Sapiens
LWEVTVRDL

SEQ ID NO: 1038097 - protein, 9 aa, Homo Sapiens
SKNINTPTR

SEQ ID NO: 1038098 - protein, 9 aa, Homo Sapiens
EPVLEGDGH

SEQ ID NO: 1038099 - protein, 9 aa, Homo Sapiens
SKSHVSSEK

SEQ ID NO: 1038100 - protein, 9 aa, Homo Sapiens
VPPFLNSLV

SEQ ID NO: 1038101 - protein, 9 aa, Homo Sapiens
PAFLLRLAT

SEQ ID NO: 1038102 - protein, 9 aa, Homo Sapiens
WRYREASKK

SEQ ID NO: 1038103 - protein, 9 aa, Homo Sapiens
TEELWSKTS

SEQ ID NO: 1038104 - protein, 9 aa, Homo Sapiens
SKVVLMGTK

SEQ ID NO: 1038105 - protein, 9 aa, Homo Sapiens
RGILYQDKN

SEQ ID NO: 1038106 - protein, 9 aa, Homo Sapiens
VIPLLESEL

SEQ ID NO: 1038107 - protein, 9 aa, Homo Sapiens
KIEDTVSFS

SEQ ID NO: 1038108 - protein, 9 aa, Homo Sapiens
ALGSMVDLM

SEQ ID NO: 1038109 - protein, 9 aa, Homo Sapiens
MTEIGKRGL

SEQ ID NO: 1038110 - protein, 9 aa, Homo Sapiens
PVLAGFPGA

SEQ ID NO: 1038111 - protein, 9 aa, Homo Sapiens
LEMYSKEDE

SEQ ID NO: 1038112 - protein, 9 aa, Homo Sapiens
VSVVPKIPE

SEQ ID NO: 1038113 - protein, 9 aa, Homo Sapiens
FLRTKIKVT

SEQ ID NO: 1038114 - protein, 9 aa, Homo Sapiens
NSPGNWKKP

SEQ ID NO: 1038115 - protein, 9 aa, Homo Sapiens
QIPQTTFKK

SEQ ID NO: 1038116 - protein, 9 aa, Homo Sapiens
LEPVGRKAT

SEQ ID NO: 1038117 - protein, 9 aa, Homo Sapiens
DLVLERFLD

SEQ ID NO: 1038118 - protein, 9 aa, Homo Sapiens
TDNNDIYGA

SEQ ID NO: 1038119 - protein, 9 aa, Homo Sapiens
SPGASSPHP

SEQ ID NO: 1038120 - protein, 9 aa, Homo Sapiens
RRLVKGLDP

SEQ ID NO: 1038121 - protein, 9 aa, Homo Sapiens
LTVPQEKLP

SEQ ID NO: 1038122 - protein, 9 aa, Homo Sapiens
NGLLQEIEA

SEQ ID NO: 1038123 - protein, 9 aa, Homo Sapiens
PRINEKAGD

SEQ ID NO: 1038124 - protein, 9 aa, Homo Sapiens
YNGNKNLLP

SEQ ID NO: 1038125 - protein, 9 aa, Homo Sapiens
VARSAAESG

SEQ ID NO: 1038126 - protein, 9 aa, Homo Sapiens
RSDVLRIKY

SEQ ID NO: 1038127 - protein, 9 aa, Homo Sapiens
GMTLRCLRY

SEQ ID NO: 1038128 - protein, 9 aa, Homo Sapiens
VCISLANVP

SEQ ID NO: 1038129 - protein, 9 aa, Homo Sapiens
DIITIQTES

SEQ ID NO: 1038130 - protein, 9 aa, Homo Sapiens
GKVISVIAV

SEQ ID NO: 1038131 - protein, 9 aa, Homo Sapiens
FGLFTAFLA

SEQ ID NO: 1038132 - protein, 9 aa, Homo Sapiens
SLSPLLARR

SEQ ID NO: 1038133 - protein, 9 aa, Homo Sapiens
MIYSKFIEA

SEQ ID NO: 1038134 - protein, 9 aa, Homo Sapiens
LWRPEKLEL

SEQ ID NO: 1038135 - protein, 9 aa, Homo Sapiens
GEQPMEGFH

SEQ ID NO: 1038136 - protein, 9 aa, Homo Sapiens
QMWGRLVGL

SEQ ID NO: 1038137 - protein, 9 aa, Homo Sapiens
LERPMYAVG

SEQ ID NO: 1038138 - protein, 9 aa, Homo Sapiens
PPKTRGFHL

SEQ ID NO: 1038139 - protein, 9 aa, Homo Sapiens
SVISCLKYC

SEQ ID NO: 1038140 - protein, 9 aa, Homo Sapiens
DSLKLLAQR

SEQ ID NO: 1038141 - protein, 9 aa, Homo Sapiens
LSDFESARQ

SEQ ID NO: 1038142 - protein, 9 aa, Homo Sapiens
SCTCLRAQP

SEQ ID NO: 1038143 - protein, 9 aa, Homo Sapiens
FCAPGPPGC

SEQ ID NO: 1038144 - protein, 9 aa, Homo Sapiens
KEPFCPPPI

SEQ ID NO: 1038145 - protein, 9 aa, Homo Sapiens
QYKLTVSRF

SEQ ID NO: 1038146 - protein, 9 aa, Homo Sapiens
SSNFTGHKK

SEQ ID NO: 1038147 - protein, 9 aa, Homo Sapiens
GSSNRNLVT

SEQ ID NO: 1038148 - protein, 9 aa, Homo Sapiens
EQQKTIKTM

SEQ ID NO: 1038149 - protein, 9 aa, Homo Sapiens
MLSRSLMRT

SEQ ID NO: 1038150 - protein, 9 aa, Homo Sapiens
GCRKFYEGT

SEQ ID NO: 1038151 - protein, 9 aa, Homo Sapiens
TETSQTSAP

SEQ ID NO: 1038152 - protein, 9 aa, Homo Sapiens
NDNVSEIAL

SEQ ID NO: 1038153 - protein, 9 aa, Homo Sapiens
QPPNGNQTF

SEQ ID NO: 1038154 - protein, 9 aa, Homo Sapiens
KYIPNVRPW

SEQ ID NO: 1038155 - protein, 9 aa, Homo Sapiens
VATHTLVDP

SEQ ID NO: 1038156 - protein, 9 aa, Homo Sapiens
WVRSLAEVL

SEQ ID NO: 1038157 - protein, 9 aa, Homo Sapiens
FRSQLGDVG

SEQ ID NO: 1038158 - protein, 9 aa, Homo Sapiens
GKTSELRTM

SEQ ID NO: 1038159 - protein, 9 aa, Homo Sapiens
PESPGAPER

SEQ ID NO: 1038160 - protein, 9 aa, Homo Sapiens
FVSNGSFLC

SEQ ID NO: 1038161 - protein, 9 aa, Homo Sapiens
EGSRVWEQG

SEQ ID NO: 1038162 - protein, 9 aa, Homo Sapiens
SQPHTKPFV

SEQ ID NO: 1038163 - protein, 9 aa, Homo Sapiens
PNGYPRYSS

SEQ ID NO: 1038164 - protein, 9 aa, Homo Sapiens
NIFFKAFSY

SEQ ID NO: 1038165 - protein, 9 aa, Homo Sapiens
EELTTVMRF

SEQ ID NO: 1038166 - protein, 9 aa, Homo Sapiens
LKKFKTIQE

SEQ ID NO: 1038167 - protein, 9 aa, Homo Sapiens
WGYVLLNVL

SEQ ID NO: 1038168 - protein, 9 aa, Homo Sapiens
EFDLELKKD

SEQ ID NO: 1038169 - protein, 9 aa, Homo Sapiens
PPKFPRATR

SEQ ID NO: 1038170 - protein, 9 aa, Homo Sapiens
AALPEKTRS

SEQ ID NO: 1038171 - protein, 9 aa, Homo Sapiens
KIIKLLVQK

SEQ ID NO: 1038172 - protein, 9 aa, Homo Sapiens
LDQNCSNRG

SEQ ID NO: 1038173 - protein, 9 aa, Homo Sapiens
SMSFFFFGF

SEQ ID NO: 1038174 - protein, 9 aa, Homo Sapiens
LTSSASAIC

SEQ ID NO: 1038175 - protein, 9 aa, Homo Sapiens
KNYEEVGTD

SEQ ID NO: 1038176 - protein, 9 aa, Homo Sapiens
HIHSVKTAF

SEQ ID NO: 1038177 - protein, 9 aa, Homo Sapiens
IITVCYEII

SEQ ID NO: 1038178 - protein, 9 aa, Homo Sapiens
LDQRTIFFV

SEQ ID NO: 1038179 - protein, 9 aa, Homo Sapiens
LCVTSTLDL

SEQ ID NO: 1038180 - protein, 9 aa, Homo Sapiens
TQQYPYLHQ

SEQ ID NO: 1038181 - protein, 9 aa, Homo Sapiens
NKNVKAAVR

SEQ ID NO: 1038182 - protein, 9 aa, Homo Sapiens
LPLFQYSCR

SEQ ID NO: 1038183 - protein, 9 aa, Homo Sapiens
TYSLSCIRS

SEQ ID NO: 1038184 - protein, 9 aa, Homo Sapiens
YIWWLNSQS

SEQ ID NO: 1038185 - protein, 9 aa, Homo Sapiens
NLVHLDAVP

SEQ ID NO: 1038186 - protein, 9 aa, Homo Sapiens
QIYTGEKPY

SEQ ID NO: 1038187 - protein, 9 aa, Homo Sapiens
IQELLENTN

SEQ ID NO: 1038188 - protein, 9 aa, Homo Sapiens
NNDIYGAAW

SEQ ID NO: 1038189 - protein, 9 aa, Homo Sapiens
DSEETEKEE

SEQ ID NO: 1038190 - protein, 9 aa, Homo Sapiens
APKGCESAC

SEQ ID NO: 1038191 - protein, 9 aa, Homo Sapiens
FSGSHKAVL

SEQ ID NO: 1038192 - protein, 9 aa, Homo Sapiens
SILEMNETS

SEQ ID NO: 1038193 - protein, 9 aa, Homo Sapiens
PFVFVMKNG

SEQ ID NO: 1038194 - protein, 9 aa, Homo Sapiens
PPTGVLSLL

SEQ ID NO: 1038195 - protein, 9 aa, Homo Sapiens
AEAVKGPVS

SEQ ID NO: 1038196 - protein, 9 aa, Homo Sapiens
RKTFDCSTK

SEQ ID NO: 1038197 - protein, 9 aa, Homo Sapiens
TRLMKVEQD

SEQ ID NO: 1038198 - protein, 9 aa, Homo Sapiens
SVAFSGWFI

SEQ ID NO: 1038199 - protein, 9 aa, Homo Sapiens
HHLSAFETE

SEQ ID NO: 1038200 - protein, 9 aa, Homo Sapiens
PGTGTLTEK

SEQ ID NO: 1038201 - protein, 9 aa, Homo Sapiens
VGESKKEKI

SEQ ID NO: 1038202 - protein, 9 aa, Homo Sapiens
QGVLTLKIR

SEQ ID NO: 1038203 - protein, 9 aa, Homo Sapiens
NICKQEINT

SEQ ID NO: 1038204 - protein, 9 aa, Homo Sapiens
TVMRFLTQR

SEQ ID NO: 1038205 - protein, 9 aa, Homo Sapiens
GSQTQPPLC

SEQ ID NO: 1038206 - protein, 9 aa, Homo Sapiens
QKNCPERHV

SEQ ID NO: 1038207 - protein, 9 aa, Homo Sapiens
IFSLRNPII

SEQ ID NO: 1038208 - protein, 9 aa, Homo Sapiens
EAKRATWKG

SEQ ID NO: 1038209 - protein, 9 aa, Homo Sapiens
KLLLQINLE

SEQ ID NO: 1038210 - protein, 9 aa, Homo Sapiens
LKIQLFKIG

SEQ ID NO: 1038211 - protein, 9 aa, Homo Sapiens
VKMLQGKLG

SEQ ID NO: 1038212 - protein, 9 aa, Homo Sapiens
MVFARTSRQ

SEQ ID NO: 1038213 - protein, 9 aa, Homo Sapiens
NRTEGFIRL

SEQ ID NO: 1038214 - protein, 9 aa, Homo Sapiens
FTRPMTMHW

SEQ ID NO: 1038215 - protein, 9 aa, Homo Sapiens
FLGPPHQGP

SEQ ID NO: 1038216 - protein, 9 aa, Homo Sapiens
EGIAGLLGL

SEQ ID NO: 1038217 - protein, 9 aa, Homo Sapiens
CVQLANKLS

SEQ ID NO: 1038218 - protein, 9 aa, Homo Sapiens
EDIKHKETK

SEQ ID NO: 1038219 - protein, 9 aa, Homo Sapiens
ETFRHRAIL

SEQ ID NO: 1038220 - protein, 9 aa, Homo Sapiens
FEHFQRRKG

SEQ ID NO: 1038221 - protein, 9 aa, Homo Sapiens
YFFLRNFFF

SEQ ID NO: 1038222 - protein, 9 aa, Homo Sapiens
VERCPVKTC

SEQ ID NO: 1038223 - protein, 9 aa, Homo Sapiens
IFTPVSNDM

SEQ ID NO: 1038224 - protein, 9 aa, Homo Sapiens
VLQPLAQEL

SEQ ID NO: 1038225 - protein, 9 aa, Homo Sapiens
LKASGIFTP

SEQ ID NO: 1038226 - protein, 9 aa, Homo Sapiens
HLQAYHTQT

SEQ ID NO: 1038227 - protein, 9 aa, Homo Sapiens
KDPHVATRV

SEQ ID NO: 1038228 - protein, 9 aa, Homo Sapiens
FADFDTMTN

SEQ ID NO: 1038229 - protein, 9 aa, Homo Sapiens
SENNSEHQT

SEQ ID NO: 1038230 - protein, 9 aa, Homo Sapiens
NYGKLQEHK

SEQ ID NO: 1038231 - protein, 9 aa, Homo Sapiens
AALTIPSHP

SEQ ID NO: 1038232 - protein, 9 aa, Homo Sapiens
FERPSLFRI

SEQ ID NO: 1038233 - protein, 9 aa, Homo Sapiens
DHLSSNQDG

SEQ ID NO: 1038234 - protein, 9 aa, Homo Sapiens
CFIIDLGTK

SEQ ID NO: 1038235 - protein, 9 aa, Homo Sapiens
PPLYPSALI

SEQ ID NO: 1038236 - protein, 9 aa, Homo Sapiens
EIDEAANIN

SEQ ID NO: 1038237 - protein, 9 aa, Homo Sapiens
YDCYVAVCR

SEQ ID NO: 1038238 - protein, 9 aa, Homo Sapiens
TGQNDWTAT

SEQ ID NO: 1038239 - protein, 9 aa, Homo Sapiens
LSPPSSAHS

SEQ ID NO: 1038240 - protein, 9 aa, Homo Sapiens
HRMAPEETS

SEQ ID NO: 1038241 - protein, 9 aa, Homo Sapiens
TVEGLQAST

SEQ ID NO: 1038242 - protein, 9 aa, Homo Sapiens
KSGSCSSRS

SEQ ID NO: 1038243 - protein, 9 aa, Homo Sapiens
PKKEPLKEE

SEQ ID NO: 1038244 - protein, 9 aa, Homo Sapiens
SSIYFCSVE

SEQ ID NO: 1038245 - protein, 9 aa, Homo Sapiens
DNYPLPNPG

SEQ ID NO: 1038246 - protein, 9 aa, Homo Sapiens
TQSLEGKQK

SEQ ID NO: 1038247 - protein, 9 aa, Homo Sapiens
REDPPIWKE

SEQ ID NO: 1038248 - protein, 9 aa, Homo Sapiens
MIRAADTDE

SEQ ID NO: 1038249 - protein, 9 aa, Homo Sapiens
KSAISGFSS

SEQ ID NO: 1038250 - protein, 9 aa, Homo Sapiens
AKEAAPAAP

SEQ ID NO: 1038251 - protein, 9 aa, Homo Sapiens
KPDSENTPQ

SEQ ID NO: 1038252 - protein, 9 aa, Homo Sapiens
FFFGFFLTY

SEQ ID NO: 1038253 - protein, 9 aa, Homo Sapiens
ERMYRRTSD

SEQ ID NO: 1038254 - protein, 9 aa, Homo Sapiens
SFFLGEQSR

SEQ ID NO: 1038255 - protein, 9 aa, Homo Sapiens
FIVQYKDRD

SEQ ID NO: 1038256 - protein, 9 aa, Homo Sapiens
QTSAPWDPL

SEQ ID NO: 1038257 - protein, 9 aa, Homo Sapiens
RLHTNRSQE

SEQ ID NO: 1038258 - protein, 9 aa, Homo Sapiens
DYRLKSQTV

SEQ ID NO: 1038259 - protein, 9 aa, Homo Sapiens
GVLSLLLLL

SEQ ID NO: 1038260 - protein, 9 aa, Homo Sapiens
GVDARHLSF

SEQ ID NO: 1038261 - protein, 9 aa, Homo Sapiens
PYIDAVVHE

SEQ ID NO: 1038262 - protein, 9 aa, Homo Sapiens
LPHFLEGDG

SEQ ID NO: 1038263 - protein, 9 aa, Homo Sapiens
LLFHGVAYV

SEQ ID NO: 1038264 - protein, 9 aa, Homo Sapiens
RHSPQQEEK

SEQ ID NO: 1038265 - protein, 9 aa, Homo Sapiens
EKPFWQNFK

SEQ ID NO: 1038266 - protein, 9 aa, Homo Sapiens
RSVRTFAQV

SEQ ID NO: 1038267 - protein, 9 aa, Homo Sapiens
SNPVCLEPG

SEQ ID NO: 1038268 - protein, 9 aa, Homo Sapiens
VETFSSVYK

SEQ ID NO: 1038269 - protein, 9 aa, Homo Sapiens
EFKVTDARN

SEQ ID NO: 1038270 - protein, 9 aa, Homo Sapiens
ARDDGVPPL

SEQ ID NO: 1038271 - protein, 9 aa, Homo Sapiens
LKKKFDKGV

SEQ ID NO: 1038272 - protein, 9 aa, Homo Sapiens
YVNRKKKTH

SEQ ID NO: 1038273 - protein, 9 aa, Homo Sapiens
ARSRRCALP

SEQ ID NO: 1038274 - protein, 9 aa, Homo Sapiens
QICKTVRHS

SEQ ID NO: 1038275 - protein, 9 aa, Homo Sapiens
LWYCYKVFS

SEQ ID NO: 1038276 - protein, 9 aa, Homo Sapiens
DFAVPSSTK

SEQ ID NO: 1038277 - protein, 9 aa, Homo Sapiens
TRPMTMHWA

SEQ ID NO: 1038278 - protein, 9 aa, Homo Sapiens
DVSYVKIEK

SEQ ID NO: 1038279 - protein, 9 aa, Homo Sapiens
VLAKSGPVV

SEQ ID NO: 1038280 - protein, 9 aa, Homo Sapiens
AHLEVFPSK

SEQ ID NO: 1038281 - protein, 9 aa, Homo Sapiens
RRAPGEASP

SEQ ID NO: 1038282 - protein, 9 aa, Homo Sapiens
TFSLLSTFQ

SEQ ID NO: 1038283 - protein, 9 aa, Homo Sapiens
RFFMLLFQY

SEQ ID NO: 1038284 - protein, 9 aa, Homo Sapiens
KILLTCSSG

SEQ ID NO: 1038285 - protein, 9 aa, Homo Sapiens
DTKLWYCYK

SEQ ID NO: 1038286 - protein, 9 aa, Homo Sapiens
CSVIFGHEL

SEQ ID NO: 1038287 - protein, 9 aa, Homo Sapiens
YLNLEDIAR

SEQ ID NO: 1038288 - protein, 9 aa, Homo Sapiens
YLYNRMSYW

SEQ ID NO: 1038289 - protein, 9 aa, Homo Sapiens
NTESQFIIP

SEQ ID NO: 1038290 - protein, 9 aa, Homo Sapiens
DGSENNCVY

SEQ ID NO: 1038291 - protein, 9 aa, Homo Sapiens
MASEKNQSS

SEQ ID NO: 1038292 - protein, 9 aa, Homo Sapiens
QVGNGFHVG

SEQ ID NO: 1038293 - protein, 9 aa, Homo Sapiens
FGRPGPPVL

SEQ ID NO: 1038294 - protein, 9 aa, Homo Sapiens
TWSMGVVLY

SEQ ID NO: 1038295 - protein, 9 aa, Homo Sapiens
AGYLLYIVV

SEQ ID NO: 1038296 - protein, 9 aa, Homo Sapiens
LDLKCNYFN

SEQ ID NO: 1038297 - protein, 9 aa, Homo Sapiens
EKGPGGSYY

SEQ ID NO: 1038298 - protein, 9 aa, Homo Sapiens
TVHVPFPCD

SEQ ID NO: 1038299 - protein, 9 aa, Homo Sapiens
VDMLQDGYH

SEQ ID NO: 1038300 - protein, 9 aa, Homo Sapiens
DNENATDIN

SEQ ID NO: 1038301 - protein, 9 aa, Homo Sapiens
PFFLAICLP

SEQ ID NO: 1038302 - protein, 9 aa, Homo Sapiens
GRFFMLLFQ

SEQ ID NO: 1038303 - protein, 9 aa, Homo Sapiens
QHGILVTGL

SEQ ID NO: 1038304 - protein, 9 aa, Homo Sapiens
FTALPAVAP

SEQ ID NO: 1038305 - protein, 9 aa, Homo Sapiens
TLARRDDNP

SEQ ID NO: 1038306 - protein, 9 aa, Homo Sapiens
RNFSFLEIF

SEQ ID NO: 1038307 - protein, 9 aa, Homo Sapiens
FASCMEHLL

SEQ ID NO: 1038308 - protein, 9 aa, Homo Sapiens
LLQQNFDVF

SEQ ID NO: 1038309 - protein, 9 aa, Homo Sapiens
QDICSSEVS

SEQ ID NO: 1038310 - protein, 9 aa, Homo Sapiens
SFFLWSRMH

SEQ ID NO: 1038311 - protein, 9 aa, Homo Sapiens
VSHGSAVTT

SEQ ID NO: 1038312 - protein, 9 aa, Homo Sapiens
KCYVNICKQ

SEQ ID NO: 1038313 - protein, 9 aa, Homo Sapiens
KILSTKNSI

SEQ ID NO: 1038314 - protein, 9 aa, Homo Sapiens
EQELAIKAN

SEQ ID NO: 1038315 - protein, 9 aa, Homo Sapiens
TLARKTFEQ

SEQ ID NO: 1038316 - protein, 9 aa, Homo Sapiens
KNEPKIWVS

SEQ ID NO: 1038317 - protein, 9 aa, Homo Sapiens
NLSTHQTYL

SEQ ID NO: 1038318 - protein, 9 aa, Homo Sapiens
RQRLKDDAL

SEQ ID NO: 1038319 - protein, 9 aa, Homo Sapiens
QNLELKYLL

SEQ ID NO: 1038320 - protein, 9 aa, Homo Sapiens
LPGERGNGR

SEQ ID NO: 1038321 - protein, 9 aa, Homo Sapiens
QEEKNTIFK

SEQ ID NO: 1038322 - protein, 9 aa, Homo Sapiens
NVLAFGTLV

SEQ ID NO: 1038323 - protein, 9 aa, Homo Sapiens
ENLTFNSKP

SEQ ID NO: 1038324 - protein, 9 aa, Homo Sapiens
QAQMYLGPQ

SEQ ID NO: 1038325 - protein, 9 aa, Homo Sapiens
KETLWEKPR

SEQ ID NO: 1038326 - protein, 9 aa, Homo Sapiens
QGQDYRLKS

SEQ ID NO: 1038327 - protein, 9 aa, Homo Sapiens
KLQNLDLLL

SEQ ID NO: 1038328 - protein, 9 aa, Homo Sapiens
TPRGPETEP

SEQ ID NO: 1038329 - protein, 9 aa, Homo Sapiens
HKETKPQGA

SEQ ID NO: 1038330 - protein, 9 aa, Homo Sapiens
FSEIGKKFG

SEQ ID NO: 1038331 - protein, 9 aa, Homo Sapiens
KTSVDKSQS

SEQ ID NO: 1038332 - protein, 9 aa, Homo Sapiens
EPPKTRGFH

SEQ ID NO: 1038333 - protein, 9 aa, Homo Sapiens
DSHAAAQSV

SEQ ID NO: 1038334 - protein, 9 aa, Homo Sapiens
EEALQSLAS

SEQ ID NO: 1038335 - protein, 9 aa, Homo Sapiens
PHARYLIFS

SEQ ID NO: 1038336 - protein, 9 aa, Homo Sapiens
VIGYRNAEK

SEQ ID NO: 1038337 - protein, 9 aa, Homo Sapiens
PDVFHFTPR

SEQ ID NO: 1038338 - protein, 9 aa, Homo Sapiens
HRKKKRKKS

SEQ ID NO: 1038339 - protein, 9 aa, Homo Sapiens
SSEVSWGDF

SEQ ID NO: 1038340 - protein, 9 aa, Homo Sapiens
FSKALESRD

SEQ ID NO: 1038341 - protein, 9 aa, Homo Sapiens
LSSNYPEKF

SEQ ID NO: 1038342 - protein, 9 aa, Homo Sapiens
ACARFLKNA

SEQ ID NO: 1038343 - protein, 9 aa, Homo Sapiens
MKKDLAEWL

SEQ ID NO: 1038344 - protein, 9 aa, Homo Sapiens
EAMKKDLAE

SEQ ID NO: 1038345 - protein, 9 aa, Homo Sapiens
AELRCKGSR

SEQ ID NO: 1038346 - protein, 9 aa, Homo Sapiens
NLHNCVAYI

SEQ ID NO: 1038347 - protein, 9 aa, Homo Sapiens
GPGQSHAQG

SEQ ID NO: 1038348 - protein, 9 aa, Homo Sapiens
SNTFLHLLS

SEQ ID NO: 1038349 - protein, 9 aa, Homo Sapiens
TYTVVGCLG

SEQ ID NO: 1038350 - protein, 9 aa, Homo Sapiens
APREATSFP

SEQ ID NO: 1038351 - protein, 9 aa, Homo Sapiens
EEKLSASEV

SEQ ID NO: 1038352 - protein, 9 aa, Homo Sapiens
PCHWVRSLA

SEQ ID NO: 1038353 - protein, 9 aa, Homo Sapiens
ASSGNLKQL

SEQ ID NO: 1038354 - protein, 9 aa, Homo Sapiens
AGSDYKFTE

SEQ ID NO: 1038355 - protein, 9 aa, Homo Sapiens
FFDGWEISF

SEQ ID NO: 1038356 - protein, 9 aa, Homo Sapiens
CSRTMAGCR

SEQ ID NO: 1038357 - protein, 9 aa, Homo Sapiens
LVVQYTPKV

SEQ ID NO: 1038358 - protein, 9 aa, Homo Sapiens
VQFSRTTSP

SEQ ID NO: 1038359 - protein, 9 aa, Homo Sapiens
PLQNWSPVM

SEQ ID NO: 1038360 - protein, 9 aa, Homo Sapiens
ALNPHWEEN

SEQ ID NO: 1038361 - protein, 9 aa, Homo Sapiens
PWISHGGPF

SEQ ID NO: 1038362 - protein, 9 aa, Homo Sapiens
CISLANVPP

SEQ ID NO: 1038363 - protein, 9 aa, Homo Sapiens
LSSADKEFP

SEQ ID NO: 1038364 - protein, 9 aa, Homo Sapiens
TQLMLHGCL

SEQ ID NO: 1038365 - protein, 9 aa, Homo Sapiens
SGIGLVNFA

SEQ ID NO: 1038366 - protein, 9 aa, Homo Sapiens
SDTSILPGR

SEQ ID NO: 1038367 - protein, 9 aa, Homo Sapiens
FARTSRQQK

SEQ ID NO: 1038368 - protein, 9 aa, Homo Sapiens
RNRLSLIEH

SEQ ID NO: 1038369 - protein, 9 aa, Homo Sapiens
AKVQNFLGL

SEQ ID NO: 1038370 - protein, 9 aa, Homo Sapiens
KEQESLAAA

SEQ ID NO: 1038371 - protein, 9 aa, Homo Sapiens
ATIPNRIDL

SEQ ID NO: 1038372 - protein, 9 aa, Homo Sapiens
LAPPDLQPP

SEQ ID NO: 1038373 - protein, 9 aa, Homo Sapiens
CHYLDQLGT

SEQ ID NO: 1038374 - protein, 9 aa, Homo Sapiens
GVLTLKIRK

SEQ ID NO: 1038375 - protein, 9 aa, Homo Sapiens
IDRVLDATE

SEQ ID NO: 1038376 - protein, 9 aa, Homo Sapiens
CVSRNLHLT

SEQ ID NO: 1038377 - protein, 9 aa, Homo Sapiens
TKTLSKDDL

SEQ ID NO: 1038378 - protein, 9 aa, Homo Sapiens
TSFLPRFLQ

SEQ ID NO: 1038379 - protein, 9 aa, Homo Sapiens
NSSYECTIK

SEQ ID NO: 1038380 - protein, 9 aa, Homo Sapiens
NEKLSPQLA

SEQ ID NO: 1038381 - protein, 9 aa, Homo Sapiens
GEGIAGLLG

SEQ ID NO: 1038382 - protein, 9 aa, Homo Sapiens
PAKIQLSLY

SEQ ID NO: 1038383 - protein, 9 aa, Homo Sapiens
ELQLMGLKK

SEQ ID NO: 1038384 - protein, 9 aa, Homo Sapiens
RPLSPKPSF

SEQ ID NO: 1038385 - protein, 9 aa, Homo Sapiens
NTVRNDGAR

SEQ ID NO: 1038386 - protein, 9 aa, Homo Sapiens
KTYELVEKF

SEQ ID NO: 1038387 - protein, 9 aa, Homo Sapiens
HFTVIQLVE

SEQ ID NO: 1038388 - protein, 9 aa, Homo Sapiens
LQNLDLLLD

SEQ ID NO: 1038389 - protein, 9 aa, Homo Sapiens
SHCAEKSNA

SEQ ID NO: 1038390 - protein, 9 aa, Homo Sapiens
FRQRLQKMG

SEQ ID NO: 1038391 - protein, 9 aa, Homo Sapiens
RWQIKAQRG

SEQ ID NO: 1038392 - protein, 9 aa, Homo Sapiens
SFHTTAPTT

SEQ ID NO: 1038393 - protein, 9 aa, Homo Sapiens
VEFCCQVQG

SEQ ID NO: 1038394 - protein, 9 aa, Homo Sapiens
FPRATRKFS

SEQ ID NO: 1038395 - protein, 9 aa, Homo Sapiens
NLRLLDLCG

SEQ ID NO: 1038396 - protein, 9 aa, Homo Sapiens
MIFTPEKSE

SEQ ID NO: 1038397 - protein, 9 aa, Homo Sapiens
QASSFHTTA

SEQ ID NO: 1038398 - protein, 9 aa, Homo Sapiens
DCSDSFYSV

SEQ ID NO: 1038399 - protein, 9 aa, Homo Sapiens
DTLKQHGTC

SEQ ID NO: 1038400 - protein, 9 aa, Homo Sapiens
ELQELVMDK

SEQ ID NO: 1038401 - protein, 9 aa, Homo Sapiens
NMNCVWLFI

SEQ ID NO: 1038402 - protein, 9 aa, Homo Sapiens
KKGEMGDKG

SEQ ID NO: 1038403 - protein, 9 aa, Homo Sapiens
IQRKTLFKE

SEQ ID NO: 1038404 - protein, 9 aa, Homo Sapiens
QKDSLPVQN

SEQ ID NO: 1038405 - protein, 9 aa, Homo Sapiens
QDSFAPRGQ

SEQ ID NO: 1038406 - protein, 9 aa, Homo Sapiens
TTPQDGDVI

SEQ ID NO: 1038407 - protein, 9 aa, Homo Sapiens
KKMHRALHK

SEQ ID NO: 1038408 - protein, 9 aa, Homo Sapiens
SDKTDSAVN

SEQ ID NO: 1038409 - protein, 9 aa, Homo Sapiens
LVLLRDLEP

SEQ ID NO: 1038410 - protein, 9 aa, Homo Sapiens
SGLELREEA

SEQ ID NO: 1038411 - protein, 9 aa, Homo Sapiens
SPQVRPFGG

SEQ ID NO: 1038412 - protein, 9 aa, Homo Sapiens
QRGQQLMEA

SEQ ID NO: 1038413 - protein, 9 aa, Homo Sapiens
VHASLCRSS

SEQ ID NO: 1038414 - protein, 9 aa, Homo Sapiens
EVTIWPDRK

SEQ ID NO: 1038415 - protein, 9 aa, Homo Sapiens
SVYKKQVET

SEQ ID NO: 1038416 - protein, 9 aa, Homo Sapiens
LAVEGRLES

SEQ ID NO: 1038417 - protein, 9 aa, Homo Sapiens
FVANKLGSF

SEQ ID NO: 1038418 - protein, 9 aa, Homo Sapiens
AEKDRPHEE

SEQ ID NO: 1038419 - protein, 9 aa, Homo Sapiens
DSAFIEPRY

SEQ ID NO: 1038420 - protein, 9 aa, Homo Sapiens
FLKWISPPK

SEQ ID NO: 1038421 - protein, 9 aa, Homo Sapiens
LTSSDLPTL

SEQ ID NO: 1038422 - protein, 9 aa, Homo Sapiens
SSSWHGGLG

SEQ ID NO: 1038423 - protein, 9 aa, Homo Sapiens
CADSDLKDA

SEQ ID NO: 1038424 - protein, 9 aa, Homo Sapiens
GLRFVAPDV

SEQ ID NO: 1038425 - protein, 9 aa, Homo Sapiens
LLAVMSLDC

SEQ ID NO: 1038426 - protein, 9 aa, Homo Sapiens
NVGNIGGNE

SEQ ID NO: 1038427 - protein, 9 aa, Homo Sapiens
DMLQDGYHK

SEQ ID NO: 1038428 - protein, 9 aa, Homo Sapiens
PRDSPLSQM

SEQ ID NO: 1038429 - protein, 9 aa, Homo Sapiens
LAEYVVPGC

SEQ ID NO: 1038430 - protein, 9 aa, Homo Sapiens
WGSCHFLKK

SEQ ID NO: 1038431 - protein, 9 aa, Homo Sapiens
QAMLTLTQG

SEQ ID NO: 1038432 - protein, 9 aa, Homo Sapiens
TLNCPFGFF

SEQ ID NO: 1038433 - protein, 9 aa, Homo Sapiens
TLQQPYDQA

SEQ ID NO: 1038434 - protein, 9 aa, Homo Sapiens
TEPLILNLE

SEQ ID NO: 1038435 - protein, 9 aa, Homo Sapiens
YESRFSAET

SEQ ID NO: 1038436 - protein, 9 aa, Homo Sapiens
SVLRNHNQI

SEQ ID NO: 1038437 - protein, 9 aa, Homo Sapiens
NFLKALYDA

SEQ ID NO: 1038438 - protein, 9 aa, Homo Sapiens
ELHLKPLNC

SEQ ID NO: 1038439 - protein, 9 aa, Homo Sapiens
QRHRQGKVI

SEQ ID NO: 1038440 - protein, 9 aa, Homo Sapiens
VSLLAESEE

SEQ ID NO: 1038441 - protein, 9 aa, Homo Sapiens
FTLRALQEL

SEQ ID NO: 1038442 - protein, 9 aa, Homo Sapiens
LAAGKEVGA

SEQ ID NO: 1038443 - protein, 9 aa, Homo Sapiens
YSGTQNDVD

SEQ ID NO: 1038444 - protein, 9 aa, Homo Sapiens
YHSVYKTYE

SEQ ID NO: 1038445 - protein, 9 aa, Homo Sapiens
GTFNQYVCW

SEQ ID NO: 1038446 - protein, 9 aa, Homo Sapiens
WTHEEQFKQ

SEQ ID NO: 1038447 - protein, 9 aa, Homo Sapiens
CGTGAFDLV

SEQ ID NO: 1038448 - protein, 9 aa, Homo Sapiens
SEMHVRIYL

SEQ ID NO: 1038449 - protein, 9 aa, Homo Sapiens
GWQSEAQDT

SEQ ID NO: 1038450 - protein, 9 aa, Homo Sapiens
VFSTCSSHV

SEQ ID NO: 1038451 - protein, 9 aa, Homo Sapiens
VQAALTIPS

SEQ ID NO: 1038452 - protein, 9 aa, Homo Sapiens
DTSILPGRC

SEQ ID NO: 1038453 - protein, 9 aa, Homo Sapiens
IYRFNVISI

SEQ ID NO: 1038454 - protein, 9 aa, Homo Sapiens
VMLLFLCTF

SEQ ID NO: 1038455 - protein, 9 aa, Homo Sapiens
LESGILRLV

SEQ ID NO: 1038456 - protein, 9 aa, Homo Sapiens
KFQVAVNEK

SEQ ID NO: 1038457 - protein, 9 aa, Homo Sapiens
GEKGPQTLS

SEQ ID NO: 1038458 - protein, 9 aa, Homo Sapiens
TSKFFLEEA

SEQ ID NO: 1038459 - protein, 9 aa, Homo Sapiens
GARRGRRLG

SEQ ID NO: 1038460 - protein, 9 aa, Homo Sapiens
VKTSDQDLN

SEQ ID NO: 1038461 - protein, 9 aa, Homo Sapiens
ISLSVISVS

SEQ ID NO: 1038462 - protein, 9 aa, Homo Sapiens
ATQQPMRAE

SEQ ID NO: 1038463 - protein, 9 aa, Homo Sapiens
ILREHHQPI

SEQ ID NO: 1038464 - protein, 9 aa, Homo Sapiens
SQELMKKSL

SEQ ID NO: 1038465 - protein, 9 aa, Homo Sapiens
DLLFTELLN

SEQ ID NO: 1038466 - protein, 9 aa, Homo Sapiens
PPCPGKPEG

SEQ ID NO: 1038467 - protein, 9 aa, Homo Sapiens
MLIELSAID

SEQ ID NO: 1038468 - protein, 9 aa, Homo Sapiens
SRTTSPCSS

SEQ ID NO: 1038469 - protein, 9 aa, Homo Sapiens
WTSSTIALR

SEQ ID NO: 1038470 - protein, 9 aa, Homo Sapiens
RYREASKKA

SEQ ID NO: 1038471 - protein, 9 aa, Homo Sapiens
PCADSDLKD

SEQ ID NO: 1038472 - protein, 9 aa, Homo Sapiens
GPPPLCRDA

SEQ ID NO: 1038473 - protein, 9 aa, Homo Sapiens
AKTLEEILY

SEQ ID NO: 1038474 - protein, 9 aa, Homo Sapiens
VTIKCPLSE

SEQ ID NO: 1038475 - protein, 9 aa, Homo Sapiens
LSPDMDEMY

SEQ ID NO: 1038476 - protein, 9 aa, Homo Sapiens
FNVISIKIS

SEQ ID NO: 1038477 - protein, 9 aa, Homo Sapiens
KGCSGNFKK

SEQ ID NO: 1038478 - protein, 9 aa, Homo Sapiens
GEMAKVQNF

SEQ ID NO: 1038479 - protein, 9 aa, Homo Sapiens
ATTIITVTD

SEQ ID NO: 1038480 - protein, 9 aa, Homo Sapiens
PEDSSIYFC

SEQ ID NO: 1038481 - protein, 9 aa, Homo Sapiens
CIAETWLGS

SEQ ID NO: 1038482 - protein, 9 aa, Homo Sapiens
EEAPAQLPC

SEQ ID NO: 1038483 - protein, 9 aa, Homo Sapiens
SDFIGLQKT

SEQ ID NO: 1038484 - protein, 9 aa, Homo Sapiens
RAELEKITG

SEQ ID NO: 1038485 - protein, 9 aa, Homo Sapiens
LATFPDVYG

SEQ ID NO: 1038486 - protein, 9 aa, Homo Sapiens
PATHQAPLS

SEQ ID NO: 1038487 - protein, 9 aa, Homo Sapiens
DCTSEMKQA

SEQ ID NO: 1038488 - protein, 9 aa, Homo Sapiens
RPPKPRSRR

SEQ ID NO: 1038489 - protein, 9 aa, Homo Sapiens
EAEGTAGSW

SEQ ID NO: 1038490 - protein, 9 aa, Homo Sapiens
ERLIKSKIQ

SEQ ID NO: 1038491 - protein, 9 aa, Homo Sapiens
SIQLSSVDL

SEQ ID NO: 1038492 - protein, 9 aa, Homo Sapiens
GKGAFFCNL

SEQ ID NO: 1038493 - protein, 9 aa, Homo Sapiens
CIWTLTSSG

SEQ ID NO: 1038494 - protein, 9 aa, Homo Sapiens
SSTRHSFFR

SEQ ID NO: 1038495 - protein, 9 aa, Homo Sapiens
EEGFAEETL

SEQ ID NO: 1038496 - protein, 9 aa, Homo Sapiens
SNTLWIKFV

SEQ ID NO: 1038497 - protein, 9 aa, Homo Sapiens
PEIQLELDR

SEQ ID NO: 1038498 - protein, 9 aa, Homo Sapiens
DVKDSQQAL

SEQ ID NO: 1038499 - protein, 9 aa, Homo Sapiens
YHINLNQVA

SEQ ID NO: 1038500 - protein, 9 aa, Homo Sapiens
EALVKTNRR

SEQ ID NO: 1038501 - protein, 9 aa, Homo Sapiens
NCVWLFISE

SEQ ID NO: 1038502 - protein, 9 aa, Homo Sapiens
DKLPVLYTF

SEQ ID NO: 1038503 - protein, 9 aa, Homo Sapiens
GTVCLSVSQ

SEQ ID NO: 1038504 - protein, 9 aa, Homo Sapiens
RWDLTLSPR

SEQ ID NO: 1038505 - protein, 9 aa, Homo Sapiens
FEKMSKRSL

SEQ ID NO: 1038506 - protein, 9 aa, Homo Sapiens
RWPRSTART

SEQ ID NO: 1038507 - protein, 9 aa, Homo Sapiens
FLTCLAGNV

SEQ ID NO: 1038508 - protein, 9 aa, Homo Sapiens
VKSLMHLEK

SEQ ID NO: 1038509 - protein, 9 aa, Homo Sapiens
AHLTEVNPD

SEQ ID NO: 1038510 - protein, 9 aa, Homo Sapiens
TDEKLFECK

SEQ ID NO: 1038511 - protein, 9 aa, Homo Sapiens
PQGPPPPEK

SEQ ID NO: 1038512 - protein, 9 aa, Homo Sapiens
GLGQYRAAP

SEQ ID NO: 1038513 - protein, 9 aa, Homo Sapiens
SSSLLGILL

SEQ ID NO: 1038514 - protein, 9 aa, Homo Sapiens
ENFSKECEE

SEQ ID NO: 1038515 - protein, 9 aa, Homo Sapiens
FGDNYQVVT

SEQ ID NO: 1038516 - protein, 9 aa, Homo Sapiens
TFNQYVCWP

SEQ ID NO: 1038517 - protein, 9 aa, Homo Sapiens
GVCGSCGGS

SEQ ID NO: 1038518 - protein, 9 aa, Homo Sapiens
PLILNLEKT

SEQ ID NO: 1038519 - protein, 9 aa, Homo Sapiens
RLCMMSSHI

SEQ ID NO: 1038520 - protein, 9 aa, Homo Sapiens
KQKAFYTCA

SEQ ID NO: 1038521 - protein, 9 aa, Homo Sapiens
FESVAFSGW

SEQ ID NO: 1038522 - protein, 9 aa, Homo Sapiens
QLFCNVRAS

SEQ ID NO: 1038523 - protein, 9 aa, Homo Sapiens
QRRKGLPRP

SEQ ID NO: 1038524 - protein, 9 aa, Homo Sapiens
ACLTESLRD

SEQ ID NO: 1038525 - protein, 9 aa, Homo Sapiens
KRVPPKEVQ

SEQ ID NO: 1038526 - protein, 9 aa, Homo Sapiens
PSKRITIFH

SEQ ID NO: 1038527 - protein, 9 aa, Homo Sapiens
FYSAFFVAD

SEQ ID NO: 1038528 - protein, 9 aa, Homo Sapiens
FIFVVISFF

SEQ ID NO: 1038529 - protein, 9 aa, Homo Sapiens
LLGKQADNR

SEQ ID NO: 1038530 - protein, 9 aa, Homo Sapiens
AGHPAPAGA

SEQ ID NO: 1038531 - protein, 9 aa, Homo Sapiens
KYRQETPLK

SEQ ID NO: 1038532 - protein, 9 aa, Homo Sapiens
VSLNHGIED

SEQ ID NO: 1038533 - protein, 9 aa, Homo Sapiens
HLEKKKTPE

SEQ ID NO: 1038534 - protein, 9 aa, Homo Sapiens
EKGGNCGLQ

SEQ ID NO: 1038535 - protein, 9 aa, Homo Sapiens
YVLTRLEKF

SEQ ID NO: 1038536 - protein, 9 aa, Homo Sapiens
KQTIDNSQE

SEQ ID NO: 1038537 - protein, 9 aa, Homo Sapiens
ELSGNRLEK

SEQ ID NO: 1038538 - protein, 9 aa, Homo Sapiens
LRAFAGPSQ

SEQ ID NO: 1038539 - protein, 9 aa, Homo Sapiens
QPRGQAATP

SEQ ID NO: 1038540 - protein, 9 aa, Homo Sapiens
KIKLHSNMF

SEQ ID NO: 1038541 - protein, 9 aa, Homo Sapiens
SLCSVIFGH

SEQ ID NO: 1038542 - protein, 9 aa, Homo Sapiens
AQYIMKESE

SEQ ID NO: 1038543 - protein, 9 aa, Homo Sapiens
IKKYQKTLK

SEQ ID NO: 1038544 - protein, 9 aa, Homo Sapiens
LQRAARPPC

SEQ ID NO: 1038545 - protein, 9 aa, Homo Sapiens
TRVKSYICT

SEQ ID NO: 1038546 - protein, 9 aa, Homo Sapiens
KDQRKLKDI

SEQ ID NO: 1038547 - protein, 9 aa, Homo Sapiens
GEEPLAPQY

SEQ ID NO: 1038548 - protein, 9 aa, Homo Sapiens
AGQESSIIL

SEQ ID NO: 1038549 - protein, 9 aa, Homo Sapiens
TTPMLELGT

SEQ ID NO: 1038550 - protein, 9 aa, Homo Sapiens
LQRSVKFDR

SEQ ID NO: 1038551 - protein, 9 aa, Homo Sapiens
MINRYLQRH

SEQ ID NO: 1038552 - protein, 9 aa, Homo Sapiens
DMDGSTNFL

SEQ ID NO: 1038553 - protein, 9 aa, Homo Sapiens
GGIHDRQIP

SEQ ID NO: 1038554 - protein, 9 aa, Homo Sapiens
YRQETPLKP

SEQ ID NO: 1038555 - protein, 9 aa, Homo Sapiens
NCGIAIPVD

SEQ ID NO: 1038556 - protein, 9 aa, Homo Sapiens
LLEATDNND

SEQ ID NO: 1038557 - protein, 9 aa, Homo Sapiens
PTSSTRHSF

SEQ ID NO: 1038558 - protein, 9 aa, Homo Sapiens
VKENFVIFN

SEQ ID NO: 1038559 - protein, 9 aa, Homo Sapiens
KDLSLLEAE

SEQ ID NO: 1038560 - protein, 9 aa, Homo Sapiens
ALTVYVLGN

SEQ ID NO: 1038561 - protein, 9 aa, Homo Sapiens
RFPEAPFCS

SEQ ID NO: 1038562 - protein, 9 aa, Homo Sapiens
VMDSHAAAQ

SEQ ID NO: 1038563 - protein, 9 aa, Homo Sapiens
AIYTVSATP

SEQ ID NO: 1038564 - protein, 9 aa, Homo Sapiens
KRASLWPSR

SEQ ID NO: 1038565 - protein, 9 aa, Homo Sapiens
KCIWTLTSS

SEQ ID NO: 1038566 - protein, 9 aa, Homo Sapiens
RCLRYVWAM

SEQ ID NO: 1038567 - protein, 9 aa, Homo Sapiens
AYTTFIKIQ

SEQ ID NO: 1038568 - protein, 9 aa, Homo Sapiens
GGSSTPEQD

SEQ ID NO: 1038569 - protein, 9 aa, Homo Sapiens
KIPSAAEKH

SEQ ID NO: 1038570 - protein, 9 aa, Homo Sapiens
KAAKIQLAV

SEQ ID NO: 1038571 - protein, 9 aa, Homo Sapiens
MSLDCYLAI

SEQ ID NO: 1038572 - protein, 9 aa, Homo Sapiens
SLVYGAKTT

SEQ ID NO: 1038573 - protein, 9 aa, Homo Sapiens
YQLSYHDLV

SEQ ID NO: 1038574 - protein, 9 aa, Homo Sapiens
WTVIQHCED

SEQ ID NO: 1038575 - protein, 9 aa, Homo Sapiens
EQLKQAEKL

SEQ ID NO: 1038576 - protein, 9 aa, Homo Sapiens
EPSLKKIKT

SEQ ID NO: 1038577 - protein, 9 aa, Homo Sapiens
KKPGIARCS

SEQ ID NO: 1038578 - protein, 9 aa, Homo Sapiens
FFLEVSFTT

SEQ ID NO: 1038579 - protein, 9 aa, Homo Sapiens
DCSTKVLDF

SEQ ID NO: 1038580 - protein, 9 aa, Homo Sapiens
RNDKVPGAW

SEQ ID NO: 1038581 - protein, 9 aa, Homo Sapiens
KISSSNSVT

SEQ ID NO: 1038582 - protein, 9 aa, Homo Sapiens
GNKRMSAEL

SEQ ID NO: 1038583 - protein, 9 aa, Homo Sapiens
IEESTSVHD

SEQ ID NO: 1038584 - protein, 9 aa, Homo Sapiens
DKQVFEESC

SEQ ID NO: 1038585 - protein, 9 aa, Homo Sapiens
YAGKKFYKC

SEQ ID NO: 1038586 - protein, 9 aa, Homo Sapiens
AKELQRSVK

SEQ ID NO: 1038587 - protein, 9 aa, Homo Sapiens
SRQERQGVN

SEQ ID NO: 1038588 - protein, 9 aa, Homo Sapiens
GSFEIENLL

SEQ ID NO: 1038589 - protein, 9 aa, Homo Sapiens
LTYRKQFLP

SEQ ID NO: 1038590 - protein, 9 aa, Homo Sapiens
AALGSMVDL

SEQ ID NO: 1038591 - protein, 9 aa, Homo Sapiens
ESVQNGNLS

SEQ ID NO: 1038592 - protein, 9 aa, Homo Sapiens
KVCVRKVAP

SEQ ID NO: 1038593 - protein, 9 aa, Homo Sapiens
QSSAKKVTQ

SEQ ID NO: 1038594 - protein, 9 aa, Homo Sapiens
RYGRTAFIL

SEQ ID NO: 1038595 - protein, 9 aa, Homo Sapiens
GSLQIRYSL

SEQ ID NO: 1038596 - protein, 9 aa, Homo Sapiens
MQENKKCTD

SEQ ID NO: 1038597 - protein, 9 aa, Homo Sapiens
EYSDYFKCK

SEQ ID NO: 1038598 - protein, 9 aa, Homo Sapiens
VKLVVQYTP

SEQ ID NO: 1038599 - protein, 9 aa, Homo Sapiens
YSAYVPRTL

SEQ ID NO: 1038600 - protein, 9 aa, Homo Sapiens
LCVQYTKEP

SEQ ID NO: 1038601 - protein, 9 aa, Homo Sapiens
LHKYVNRKK

SEQ ID NO: 1038602 - protein, 9 aa, Homo Sapiens
PGAFAAAAR

SEQ ID NO: 1038603 - protein, 9 aa, Homo Sapiens
QKYDHQRKQ

SEQ ID NO: 1038604 - protein, 9 aa, Homo Sapiens
YDLILAAVL

SEQ ID NO: 1038605 - protein, 9 aa, Homo Sapiens
HHETSTHAD

SEQ ID NO: 1038606 - protein, 9 aa, Homo Sapiens
TFELELVLE

SEQ ID NO: 1038607 - protein, 9 aa, Homo Sapiens
QENRSSCFW

SEQ ID NO: 1038608 - protein, 9 aa, Homo Sapiens
TPPMWISTT

SEQ ID NO: 1038609 - protein, 9 aa, Homo Sapiens
MYRRIGISL

SEQ ID NO: 1038610 - protein, 9 aa, Homo Sapiens
GLCLRGQHW

SEQ ID NO: 1038611 - protein, 9 aa, Homo Sapiens
PTEPASPRS

SEQ ID NO: 1038612 - protein, 9 aa, Homo Sapiens
HFQPRAYSF

SEQ ID NO: 1038613 - protein, 9 aa, Homo Sapiens
KQMGTTYGP

SEQ ID NO: 1038614 - protein, 9 aa, Homo Sapiens
TASHLVGEP

SEQ ID NO: 1038615 - protein, 9 aa, Homo Sapiens
NSQFSTGHA

SEQ ID NO: 1038616 - protein, 9 aa, Homo Sapiens
KLSLAGNLL

SEQ ID NO: 1038617 - protein, 9 aa, Homo Sapiens
VSMPMEIGT

SEQ ID NO: 1038618 - protein, 9 aa, Homo Sapiens
NVKATGYQE

SEQ ID NO: 1038619 - protein, 9 aa, Homo Sapiens
LPFPGPFSA

SEQ ID NO: 1038620 - protein, 9 aa, Homo Sapiens
DDNSSNEKL

SEQ ID NO: 1038621 - protein, 9 aa, Homo Sapiens
PFGGHFQGK

SEQ ID NO: 1038622 - protein, 9 aa, Homo Sapiens
LFCLRLSSM

SEQ ID NO: 1038623 - protein, 9 aa, Homo Sapiens
MEIDEAANI

SEQ ID NO: 1038624 - protein, 9 aa, Homo Sapiens
SLGETWESL

SEQ ID NO: 1038625 - protein, 9 aa, Homo Sapiens
QEKEHSFWS

SEQ ID NO: 1038626 - protein, 9 aa, Homo Sapiens
FRNRLSLIE

SEQ ID NO: 1038627 - protein, 9 aa, Homo Sapiens
HGMCLNIAV

SEQ ID NO: 1038628 - protein, 9 aa, Homo Sapiens
SLCPRQNGP

SEQ ID NO: 1038629 - protein, 9 aa, Homo Sapiens
ESMLCVVSD

SEQ ID NO: 1038630 - protein, 9 aa, Homo Sapiens
VTLSTCREI

SEQ ID NO: 1038631 - protein, 9 aa, Homo Sapiens
RKKKRKKSR

SEQ ID NO: 1038632 - protein, 9 aa, Homo Sapiens
NNIKPGMFC

SEQ ID NO: 1038633 - protein, 9 aa, Homo Sapiens
NYEEVGTDS

SEQ ID NO: 1038634 - protein, 9 aa, Homo Sapiens
ESPQKAKRP

SEQ ID NO: 1038635 - protein, 9 aa, Homo Sapiens
SALTVYVLG

SEQ ID NO: 1038636 - protein, 9 aa, Homo Sapiens
KTPTEKVKK

SEQ ID NO: 1038637 - protein, 9 aa, Homo Sapiens
HSFFRRHLP

SEQ ID NO: 1038638 - protein, 9 aa, Homo Sapiens
QVVPLKYRQ

SEQ ID NO: 1038639 - protein, 9 aa, Homo Sapiens
DLINNALHR

SEQ ID NO: 1038640 - protein, 9 aa, Homo Sapiens
IFLNLRHLA

SEQ ID NO: 1038641 - protein, 9 aa, Homo Sapiens
VSTRARFKL

SEQ ID NO: 1038642 - protein, 9 aa, Homo Sapiens
EPAGPCRWP

SEQ ID NO: 1038643 - protein, 9 aa, Homo Sapiens
PFLNSLVYG

SEQ ID NO: 1038644 - protein, 9 aa, Homo Sapiens
TLRCLRYVW

SEQ ID NO: 1038645 - protein, 9 aa, Homo Sapiens
LIEGLIALV

SEQ ID NO: 1038646 - protein, 9 aa, Homo Sapiens
RTFIFPEEL

SEQ ID NO: 1038647 - protein, 9 aa, Homo Sapiens
CFHSKWGTK

SEQ ID NO: 1038648 - protein, 9 aa, Homo Sapiens
AISVIHRLQ

SEQ ID NO: 1038649 - protein, 9 aa, Homo Sapiens
DYLHKNGQI

SEQ ID NO: 1038650 - protein, 9 aa, Homo Sapiens
VLEPSLKKI

SEQ ID NO: 1038651 - protein, 9 aa, Homo Sapiens
MGGETGERL

SEQ ID NO: 1038652 - protein, 9 aa, Homo Sapiens
ATQMPSHLS

SEQ ID NO: 1038653 - protein, 9 aa, Homo Sapiens
ATEQYYTMK

SEQ ID NO: 1038654 - protein, 9 aa, Homo Sapiens
SVVHKRVPP

SEQ ID NO: 1038655 - protein, 9 aa, Homo Sapiens
GFFIPLMFI

SEQ ID NO: 1038656 - protein, 9 aa, Homo Sapiens
SLLQAQVFN

SEQ ID NO: 1038657 - protein, 9 aa, Homo Sapiens
GERKQNLDP

SEQ ID NO: 1038658 - protein, 9 aa, Homo Sapiens
QKIKNLICE

SEQ ID NO: 1038659 - protein, 9 aa, Homo Sapiens
KIEKVIGAG

SEQ ID NO: 1038660 - protein, 9 aa, Homo Sapiens
QCYESIGYC

SEQ ID NO: 1038661 - protein, 9 aa, Homo Sapiens
CDSMVLGWK

SEQ ID NO: 1038662 - protein, 9 aa, Homo Sapiens
ATPKTFAPS

SEQ ID NO: 1038663 - protein, 9 aa, Homo Sapiens
PDSPDFEVI

SEQ ID NO: 1038664 - protein, 9 aa, Homo Sapiens
NYLPLQCYE

SEQ ID NO: 1038665 - protein, 9 aa, Homo Sapiens
FCNKIEDYF

SEQ ID NO: 1038666 - protein, 9 aa, Homo Sapiens
HCHPLDLGG

SEQ ID NO: 1038667 - protein, 9 aa, Homo Sapiens
NQLLEQNLK

SEQ ID NO: 1038668 - protein, 9 aa, Homo Sapiens
EVKVKNVLD

SEQ ID NO: 1038669 - protein, 9 aa, Homo Sapiens
IDQAPAEAS

SEQ ID NO: 1038670 - protein, 9 aa, Homo Sapiens
PGCSMLAAL

SEQ ID NO: 1038671 - protein, 9 aa, Homo Sapiens
EKTGTQPPE

SEQ ID NO: 1038672 - protein, 9 aa, Homo Sapiens
DGSTNFLLV

SEQ ID NO: 1038673 - protein, 9 aa, Homo Sapiens
KNGFRCMAC

SEQ ID NO: 1038674 - protein, 9 aa, Homo Sapiens
QGPSLFTLR

SEQ ID NO: 1038675 - protein, 9 aa, Homo Sapiens
SFSRPFWAP

SEQ ID NO: 1038676 - protein, 9 aa, Homo Sapiens
IYVFSVMES

SEQ ID NO: 1038677 - protein, 9 aa, Homo Sapiens
CSKTCNSET

SEQ ID NO: 1038678 - protein, 9 aa, Homo Sapiens
NATLRNNIL

SEQ ID NO: 1038679 - protein, 9 aa, Homo Sapiens
SNTATTIIT

SEQ ID NO: 1038680 - protein, 9 aa, Homo Sapiens
PGHQGLADV

SEQ ID NO: 1038681 - protein, 9 aa, Homo Sapiens
CGIAIPVDL

SEQ ID NO: 1038682 - protein, 9 aa, Homo Sapiens
GGSGLPESV

SEQ ID NO: 1038683 - protein, 9 aa, Homo Sapiens
PMPEKKSNP

SEQ ID NO: 1038684 - protein, 9 aa, Homo Sapiens
EQYYTMKIL

SEQ ID NO: 1038685 - protein, 9 aa, Homo Sapiens
RTSPSGGTR

SEQ ID NO: 1038686 - protein, 9 aa, Homo Sapiens
CGTPLPVLS

SEQ ID NO: 1038687 - protein, 9 aa, Homo Sapiens
IDVDGLLTG

SEQ ID NO: 1038688 - protein, 9 aa, Homo Sapiens
GHGGCVNGQ

SEQ ID NO: 1038689 - protein, 9 aa, Homo Sapiens
ASQSWTSPA

SEQ ID NO: 1038690 - protein, 9 aa, Homo Sapiens
SLKMVRKSI

SEQ ID NO: 1038691 - protein, 9 aa, Homo Sapiens
FCPPPITPH

SEQ ID NO: 1038692 - protein, 9 aa, Homo Sapiens
DKCSRQYNS

SEQ ID NO: 1038693 - protein, 9 aa, Homo Sapiens
NIAGTQKKA

SEQ ID NO: 1038694 - protein, 9 aa, Homo Sapiens
LGITTASFV

SEQ ID NO: 1038695 - protein, 9 aa, Homo Sapiens
EMIETKSFK

SEQ ID NO: 1038696 - protein, 9 aa, Homo Sapiens
TAFIGTLGR

SEQ ID NO: 1038697 - protein, 9 aa, Homo Sapiens
LQRHRQGKV

SEQ ID NO: 1038698 - protein, 9 aa, Homo Sapiens
CAYDSEAAS

SEQ ID NO: 1038699 - protein, 9 aa, Homo Sapiens
CFIQLLKVA

SEQ ID NO: 1038700 - protein, 9 aa, Homo Sapiens
RKLEPPEQQ

SEQ ID NO: 1038701 - protein, 9 aa, Homo Sapiens
VKGALGSLF

SEQ ID NO: 1038702 - protein, 9 aa, Homo Sapiens
VTDARNGQS

SEQ ID NO: 1038703 - protein, 9 aa, Homo Sapiens
VCNDSWDTN

SEQ ID NO: 1038704 - protein, 9 aa, Homo Sapiens
ICRRHQKIK

SEQ ID NO: 1038705 - protein, 9 aa, Homo Sapiens
SNTVLSKVS

SEQ ID NO: 1038706 - protein, 9 aa, Homo Sapiens
LSASLQERL

SEQ ID NO: 1038707 - protein, 9 aa, Homo Sapiens
LCTPSYLST

SEQ ID NO: 1038708 - protein, 9 aa, Homo Sapiens
TEVLVIPKK

SEQ ID NO: 1038709 - protein, 9 aa, Homo Sapiens
QGNTVRNDG

SEQ ID NO: 1038710 - protein, 9 aa, Homo Sapiens
ALIRGNCKN

SEQ ID NO: 1038711 - protein, 9 aa, Homo Sapiens
QMSVFHQED

SEQ ID NO: 1038712 - protein, 9 aa, Homo Sapiens
SFRNRIYVV

SEQ ID NO: 1038713 - protein, 9 aa, Homo Sapiens
LHGSPRYLG

SEQ ID NO: 1038714 - protein, 9 aa, Homo Sapiens
HDQAPELPK

SEQ ID NO: 1038715 - protein, 9 aa, Homo Sapiens
GWADELCTM

SEQ ID NO: 1038716 - protein, 9 aa, Homo Sapiens
SPSSQYFLS

SEQ ID NO: 1038717 - protein, 9 aa, Homo Sapiens
YRKQFLPQE

SEQ ID NO: 1038718 - protein, 9 aa, Homo Sapiens
SHQMWGRLV

SEQ ID NO: 1038719 - protein, 9 aa, Homo Sapiens
SAPPLPPGP

SEQ ID NO: 1038720 - protein, 9 aa, Homo Sapiens
KEDGEPDYV

SEQ ID NO: 1038721 - protein, 9 aa, Homo Sapiens
VDAIFCVAG

SEQ ID NO: 1038722 - protein, 9 aa, Homo Sapiens
LYKGCSGNF

SEQ ID NO: 1038723 - protein, 9 aa, Homo Sapiens
GSEQEVKSD

SEQ ID NO: 1038724 - protein, 9 aa, Homo Sapiens
DCIIGSKKK

SEQ ID NO: 1038725 - protein, 9 aa, Homo Sapiens
AISRSPTFS

SEQ ID NO: 1038726 - protein, 9 aa, Homo Sapiens
SSSLQEPER

SEQ ID NO: 1038727 - protein, 9 aa, Homo Sapiens
AQRHGVVLS

SEQ ID NO: 1038728 - protein, 9 aa, Homo Sapiens
GRFLPKGIM

SEQ ID NO: 1038729 - protein, 9 aa, Homo Sapiens
SFNDVGLDN

SEQ ID NO: 1038730 - protein, 9 aa, Homo Sapiens
GQAKPIIYT

SEQ ID NO: 1038731 - protein, 9 aa, Homo Sapiens
GCSRTMAGC

SEQ ID NO: 1038732 - protein, 9 aa, Homo Sapiens
QAQVFNFQR

SEQ ID NO: 1038733 - protein, 9 aa, Homo Sapiens
SDQKSPAKK

SEQ ID NO: 1038734 - protein, 9 aa, Homo Sapiens
GVCQKNCPE

SEQ ID NO: 1038735 - protein, 9 aa, Homo Sapiens
LSGDDLKFV

SEQ ID NO: 1038736 - protein, 9 aa, Homo Sapiens
LPVLSEKDM

SEQ ID NO: 1038737 - protein, 9 aa, Homo Sapiens
AQFVNQGFE

SEQ ID NO: 1038738 - protein, 9 aa, Homo Sapiens
AAGHPAPAG

SEQ ID NO: 1038739 - protein, 9 aa, Homo Sapiens
YIEVEHCHS

SEQ ID NO: 1038740 - protein, 9 aa, Homo Sapiens
FAILKKKFD

SEQ ID NO: 1038741 - protein, 9 aa, Homo Sapiens
IIYTKDENV

SEQ ID NO: 1038742 - protein, 9 aa, Homo Sapiens
LKNQMFIIW

SEQ ID NO: 1038743 - protein, 9 aa, Homo Sapiens
TKPFVFVMK

SEQ ID NO: 1038744 - protein, 9 aa, Homo Sapiens
IWWLNSQSL

SEQ ID NO: 1038745 - protein, 9 aa, Homo Sapiens
RKPVDTGPP

SEQ ID NO: 1038746 - protein, 9 aa, Homo Sapiens
LDKWTDKEK

SEQ ID NO: 1038747 - protein, 9 aa, Homo Sapiens
EVTNMIELE

SEQ ID NO: 1038748 - protein, 9 aa, Homo Sapiens
QPPQASLPA

SEQ ID NO: 1038749 - protein, 9 aa, Homo Sapiens
VVAVFEISD

SEQ ID NO: 1038750 - protein, 9 aa, Homo Sapiens
KVPEGSIPP

SEQ ID NO: 1038751 - protein, 9 aa, Homo Sapiens
PSPGKCKRH

SEQ ID NO: 1038752 - protein, 9 aa, Homo Sapiens
QQEEKNTIF

SEQ ID NO: 1038753 - protein, 9 aa, Homo Sapiens
SFGEPFEIC

SEQ ID NO: 1038754 - protein, 9 aa, Homo Sapiens
GCLDSDEQK

SEQ ID NO: 1038755 - protein, 9 aa, Homo Sapiens
TSEMKQANG

SEQ ID NO: 1038756 - protein, 9 aa, Homo Sapiens
VLQRRQKLR

SEQ ID NO: 1038757 - protein, 9 aa, Homo Sapiens
RGLGVKDGT

SEQ ID NO: 1038758 - protein, 9 aa, Homo Sapiens
EEEEQDTFE

SEQ ID NO: 1038759 - protein, 9 aa, Homo Sapiens
QKSHYHHGY

SEQ ID NO: 1038760 - protein, 9 aa, Homo Sapiens
IKRRKIYCQ

SEQ ID NO: 1038761 - protein, 9 aa, Homo Sapiens
AKRATWKGR

SEQ ID NO: 1038762 - protein, 9 aa, Homo Sapiens
GTTYKIKVV

SEQ ID NO: 1038763 - protein, 9 aa, Homo Sapiens
GVVIYTEKE

SEQ ID NO: 1038764 - protein, 9 aa, Homo Sapiens
ELSDFESAR

SEQ ID NO: 1038765 - protein, 9 aa, Homo Sapiens
EELWSKTSS

SEQ ID NO: 1038766 - protein, 9 aa, Homo Sapiens
WALNDHYGH

SEQ ID NO: 1038767 - protein, 9 aa, Homo Sapiens
FLPKGIMVL

SEQ ID NO: 1038768 - protein, 9 aa, Homo Sapiens
IPNFTESIP

SEQ ID NO: 1038769 - protein, 9 aa, Homo Sapiens
CAQLFNSLG

SEQ ID NO: 1038770 - protein, 9 aa, Homo Sapiens
GFFSSNTTS

SEQ ID NO: 1038771 - protein, 9 aa, Homo Sapiens
TQNDVDREF

SEQ ID NO: 1038772 - protein, 9 aa, Homo Sapiens
GGAECPARR

SEQ ID NO: 1038773 - protein, 9 aa, Homo Sapiens
FVAVMKFIW

SEQ ID NO: 1038774 - protein, 9 aa, Homo Sapiens
EGEGNCFSE

SEQ ID NO: 1038775 - protein, 9 aa, Homo Sapiens
PGPVGSPDK

SEQ ID NO: 1038776 - protein, 9 aa, Homo Sapiens
ESQNEDIKP

SEQ ID NO: 1038777 - protein, 9 aa, Homo Sapiens
SWKDKRLKF

SEQ ID NO: 1038778 - protein, 9 aa, Homo Sapiens
SFATLPPPY

SEQ ID NO: 1038779 - protein, 9 aa, Homo Sapiens
QEFSGRPLD

SEQ ID NO: 1038780 - protein, 9 aa, Homo Sapiens
GSCTFFWPM

SEQ ID NO: 1038781 - protein, 9 aa, Homo Sapiens
GWTVIQHCE

SEQ ID NO: 1038782 - protein, 9 aa, Homo Sapiens
KENWINPLM

SEQ ID NO: 1038783 - protein, 9 aa, Homo Sapiens
VCVRKVAPD

SEQ ID NO: 1038784 - protein, 9 aa, Homo Sapiens
VKENWINPL

SEQ ID NO: 1038785 - protein, 9 aa, Homo Sapiens
LMEAAEIDC

SEQ ID NO: 1038786 - protein, 9 aa, Homo Sapiens
SCAECLKFK

SEQ ID NO: 1038787 - protein, 9 aa, Homo Sapiens
PGVYTCVPA

SEQ ID NO: 1038788 - protein, 9 aa, Homo Sapiens
RTRAVIAPS

SEQ ID NO: 1038789 - protein, 9 aa, Homo Sapiens
FHTFWSAFR

SEQ ID NO: 1038790 - protein, 9 aa, Homo Sapiens
IKFVSDGTV

SEQ ID NO: 1038791 - protein, 9 aa, Homo Sapiens
VLQGKFYGN

SEQ ID NO: 1038792 - protein, 9 aa, Homo Sapiens
SINEELHIC

SEQ ID NO: 1038793 - protein, 9 aa, Homo Sapiens
NAEAFSGRE

SEQ ID NO: 1038794 - protein, 9 aa, Homo Sapiens
NLNPGTTYK

SEQ ID NO: 1038795 - protein, 9 aa, Homo Sapiens
LKALYDAEL

SEQ ID NO: 1038796 - protein, 9 aa, Homo Sapiens
NPTQQEAGG

SEQ ID NO: 1038797 - protein, 9 aa, Homo Sapiens
LDTWLTVNR

SEQ ID NO: 1038798 - protein, 9 aa, Homo Sapiens
IVKSESLDK

SEQ ID NO: 1038799 - protein, 9 aa, Homo Sapiens
PPPAASQEA

SEQ ID NO: 1038800 - protein, 9 aa, Homo Sapiens
ITPRPQNHG

SEQ ID NO: 1038801 - protein, 9 aa, Homo Sapiens
TNNYKIIKL

SEQ ID NO: 1038802 - protein, 9 aa, Homo Sapiens
RLGAGDLYL

SEQ ID NO: 1038803 - protein, 9 aa, Homo Sapiens
PQEHVYDRI

SEQ ID NO: 1038804 - protein, 9 aa, Homo Sapiens
LLQAQVFNF

SEQ ID NO: 1038805 - protein, 9 aa, Homo Sapiens
AAKNGALGS

SEQ ID NO: 1038806 - protein, 9 aa, Homo Sapiens
FLGRDSGPA

SEQ ID NO: 1038807 - protein, 9 aa, Homo Sapiens
LVQTLIVPP

SEQ ID NO: 1038808 - protein, 9 aa, Homo Sapiens
DTGFFDEKN

SEQ ID NO: 1038809 - protein, 9 aa, Homo Sapiens
CSNRVDLYH

SEQ ID NO: 1038810 - protein, 9 aa, Homo Sapiens
ADLPNHRWT

SEQ ID NO: 1038811 - protein, 9 aa, Homo Sapiens
KGNGEPLPV

SEQ ID NO: 1038812 - protein, 9 aa, Homo Sapiens
RGFPRYTIY

SEQ ID NO: 1038813 - protein, 9 aa, Homo Sapiens
PLAKARRQN

SEQ ID NO: 1038814 - protein, 9 aa, Homo Sapiens
RAYAVMCLS

SEQ ID NO: 1038815 - protein, 9 aa, Homo Sapiens
VSSGKIYNI

SEQ ID NO: 1038816 - protein, 9 aa, Homo Sapiens
KHQLSVVHT

SEQ ID NO: 1038817 - protein, 9 aa, Homo Sapiens
PHCDKKFRI

SEQ ID NO: 1038818 - protein, 9 aa, Homo Sapiens
ELSPNFYQP

SEQ ID NO: 1038819 - protein, 9 aa, Homo Sapiens
ISRQIDNIA

SEQ ID NO: 1038820 - protein, 9 aa, Homo Sapiens
SPECLEGSG

SEQ ID NO: 1038821 - protein, 9 aa, Homo Sapiens
PTRNFSRVL

SEQ ID NO: 1038822 - protein, 9 aa, Homo Sapiens
VTLEASRKS

SEQ ID NO: 1038823 - protein, 9 aa, Homo Sapiens
TDIFQIQGE

SEQ ID NO: 1038824 - protein, 9 aa, Homo Sapiens
SFFFDGWEI

SEQ ID NO: 1038825 - protein, 9 aa, Homo Sapiens
ETVVAVFEI

SEQ ID NO: 1038826 - protein, 9 aa, Homo Sapiens
TFSGSHKAV

SEQ ID NO: 1038827 - protein, 9 aa, Homo Sapiens
GTENVNIEE

SEQ ID NO: 1038828 - protein, 9 aa, Homo Sapiens
SRMFEIQNE

SEQ ID NO: 1038829 - protein, 9 aa, Homo Sapiens
ELEFGENEG

SEQ ID NO: 1038830 - protein, 9 aa, Homo Sapiens
KEEEEQTSE

SEQ ID NO: 1038831 - protein, 9 aa, Homo Sapiens
DWLVELRKV

SEQ ID NO: 1038832 - protein, 9 aa, Homo Sapiens
KLYLSIVPK

SEQ ID NO: 1038833 - protein, 9 aa, Homo Sapiens
QSLALGLGQ

SEQ ID NO: 1038834 - protein, 9 aa, Homo Sapiens
LSSNQDGGK

SEQ ID NO: 1038835 - protein, 9 aa, Homo Sapiens
QCIRYGFSP

SEQ ID NO: 1038836 - protein, 9 aa, Homo Sapiens
EKAHKGNGE

SEQ ID NO: 1038837 - protein, 9 aa, Homo Sapiens
DNTRVEPPQ

SEQ ID NO: 1038838 - protein, 9 aa, Homo Sapiens
TIFFVGCTA

SEQ ID NO: 1038839 - protein, 9 aa, Homo Sapiens
KNQQNSSLS

SEQ ID NO: 1038840 - protein, 9 aa, Homo Sapiens
SKQGVLTLK

SEQ ID NO: 1038841 - protein, 9 aa, Homo Sapiens
EATQQPMRA

SEQ ID NO: 1038842 - protein, 9 aa, Homo Sapiens
SSQYFLSNN

SEQ ID NO: 1038843 - protein, 9 aa, Homo Sapiens
LSSQPLLPS

SEQ ID NO: 1038844 - protein, 9 aa, Homo Sapiens
CGLQQSSDR

SEQ ID NO: 1038845 - protein, 9 aa, Homo Sapiens
LRLLDLCGC

SEQ ID NO: 1038846 - protein, 9 aa, Homo Sapiens
FSLSASLQE

SEQ ID NO: 1038847 - protein, 9 aa, Homo Sapiens
GPKSRGGPN

SEQ ID NO: 1038848 - protein, 9 aa, Homo Sapiens
GVLQLLFRH

SEQ ID NO: 1038849 - protein, 9 aa, Homo Sapiens
LRNKVKVDG

SEQ ID NO: 1038850 - protein, 9 aa, Homo Sapiens
DELDTLAYA

SEQ ID NO: 1038851 - protein, 9 aa, Homo Sapiens
FQAATHLES

SEQ ID NO: 1038852 - protein, 9 aa, Homo Sapiens
LVNDEESST

SEQ ID NO: 1038853 - protein, 9 aa, Homo Sapiens
SVPVGTAAV

SEQ ID NO: 1038854 - protein, 9 aa, Homo Sapiens
LAVISKEEQ

SEQ ID NO: 1038855 - protein, 9 aa, Homo Sapiens
SPDAASIVT

SEQ ID NO: 1038856 - protein, 9 aa, Homo Sapiens
KYHRKLKKR

SEQ ID NO: 1038857 - protein, 9 aa, Homo Sapiens
EPKGISGHP

SEQ ID NO: 1038858 - protein, 9 aa, Homo Sapiens
QSAECQPKK

SEQ ID NO: 1038859 - protein, 9 aa, Homo Sapiens
AMLTLTQGP

SEQ ID NO: 1038860 - protein, 9 aa, Homo Sapiens
LATEKIERD

SEQ ID NO: 1038861 - protein, 9 aa, Homo Sapiens
CMTQLFTKH

SEQ ID NO: 1038862 - protein, 9 aa, Homo Sapiens
SAQPHCPQR

SEQ ID NO: 1038863 - protein, 9 aa, Homo Sapiens
MSFAVPFFS

SEQ ID NO: 1038864 - protein, 9 aa, Homo Sapiens
HHGELPSYS

SEQ ID NO: 1038865 - protein, 9 aa, Homo Sapiens
SSHDEALVL

SEQ ID NO: 1038866 - protein, 9 aa, Homo Sapiens
FVCVPTYVG

SEQ ID NO: 1038867 - protein, 9 aa, Homo Sapiens
GDSGPPGIP

SEQ ID NO: 1038868 - protein, 9 aa, Homo Sapiens
SGTLGLFLT

SEQ ID NO: 1038869 - protein, 9 aa, Homo Sapiens
QAALTIPSH

SEQ ID NO: 1038870 - protein, 9 aa, Homo Sapiens
GSGTKSPAS

SEQ ID NO: 1038871 - protein, 9 aa, Homo Sapiens
RFKTNLHNC

SEQ ID NO: 1038872 - protein, 9 aa, Homo Sapiens
LLLVDNGFH

SEQ ID NO: 1038873 - protein, 9 aa, Homo Sapiens
GMNVEILDI

SEQ ID NO: 1038874 - protein, 9 aa, Homo Sapiens
FYYDVERCP

SEQ ID NO: 1038875 - protein, 9 aa, Homo Sapiens
ISIEEGVIS

SEQ ID NO: 1038876 - protein, 9 aa, Homo Sapiens
IINSFDEDD

SEQ ID NO: 1038877 - protein, 9 aa, Homo Sapiens
PLQVPGAFA

SEQ ID NO: 1038878 - protein, 9 aa, Homo Sapiens
FYVQGVWQK

SEQ ID NO: 1038879 - protein, 9 aa, Homo Sapiens
ASKKAEAIG

SEQ ID NO: 1038880 - protein, 9 aa, Homo Sapiens
NISDLSLIC

SEQ ID NO: 1038881 - protein, 9 aa, Homo Sapiens
KWNLTNNVL

SEQ ID NO: 1038882 - protein, 9 aa, Homo Sapiens
KEELSPEVI

SEQ ID NO: 1038883 - protein, 9 aa, Homo Sapiens
RSQLGDVGA

SEQ ID NO: 1038884 - protein, 9 aa, Homo Sapiens
EYKIQRKTL

SEQ ID NO: 1038885 - protein, 9 aa, Homo Sapiens
SCLQAMSSS

SEQ ID NO: 1038886 - protein, 9 aa, Homo Sapiens
NWTDWNTRT

SEQ ID NO: 1038887 - protein, 9 aa, Homo Sapiens
GVYTCVPAY

SEQ ID NO: 1038888 - protein, 9 aa, Homo Sapiens
KTFKFTSEL

SEQ ID NO: 1038889 - protein, 9 aa, Homo Sapiens
QIMFMKKKL

SEQ ID NO: 1038890 - protein, 9 aa, Homo Sapiens
CEAPYILEV

SEQ ID NO: 1038891 - protein, 9 aa, Homo Sapiens
LPQHAQHCG

SEQ ID NO: 1038892 - protein, 9 aa, Homo Sapiens
RTVFKEEKV

SEQ ID NO: 1038893 - protein, 9 aa, Homo Sapiens
MSVMDSHAA

SEQ ID NO: 1038894 - protein, 9 aa, Homo Sapiens
LTFRDGAIE

SEQ ID NO: 1038895 - protein, 9 aa, Homo Sapiens
KSLWRPEKL

SEQ ID NO: 1038896 - protein, 9 aa, Homo Sapiens
GCVNGQCVC

SEQ ID NO: 1038897 - protein, 9 aa, Homo Sapiens
QGLLTFRDG

SEQ ID NO: 1038898 - protein, 9 aa, Homo Sapiens
ANVEEQCER

SEQ ID NO: 1038899 - protein, 9 aa, Homo Sapiens
KLGNLSALQ

SEQ ID NO: 1038900 - protein, 9 aa, Homo Sapiens
EKDKKRADF

SEQ ID NO: 1038901 - protein, 9 aa, Homo Sapiens
LNLVIKQGD

SEQ ID NO: 1038902 - protein, 9 aa, Homo Sapiens
FQRRKGLPR

SEQ ID NO: 1038903 - protein, 9 aa, Homo Sapiens
NTYSRNNVF

SEQ ID NO: 1038904 - protein, 9 aa, Homo Sapiens
EADLDPSVL

SEQ ID NO: 1038905 - protein, 9 aa, Homo Sapiens
AGTLAFGLF

SEQ ID NO: 1038906 - protein, 9 aa, Homo Sapiens
RHSFFRRHL

SEQ ID NO: 1038907 - protein, 9 aa, Homo Sapiens
THLESDYQR

SEQ ID NO: 1038908 - protein, 9 aa, Homo Sapiens
AQGRPPSQD

SEQ ID NO: 1038909 - protein, 9 aa, Homo Sapiens
SYICTEYGK

SEQ ID NO: 1038910 - protein, 9 aa, Homo Sapiens
SGIPCAQLF

SEQ ID NO: 1038911 - protein, 9 aa, Homo Sapiens
RDGGWTEER

SEQ ID NO: 1038912 - protein, 9 aa, Homo Sapiens
IIIWSISLA

SEQ ID NO: 1038913 - protein, 9 aa, Homo Sapiens
ALAHAAPPS

SEQ ID NO: 1038914 - protein, 9 aa, Homo Sapiens
AEQREQKKE

SEQ ID NO: 1038915 - protein, 9 aa, Homo Sapiens
RIIAQEIIL

SEQ ID NO: 1038916 - protein, 9 aa, Homo Sapiens
IRGREIRIA

SEQ ID NO: 1038917 - protein, 9 aa, Homo Sapiens
AQLFNSLGL

SEQ ID NO: 1038918 - protein, 9 aa, Homo Sapiens
QSSSCGYPG

SEQ ID NO: 1038919 - protein, 9 aa, Homo Sapiens
SDGGAVKEG

SEQ ID NO: 1038920 - protein, 9 aa, Homo Sapiens
SVTASSLAN

SEQ ID NO: 1038921 - protein, 9 aa, Homo Sapiens
VVMELNEKA

SEQ ID NO: 1038922 - protein, 9 aa, Homo Sapiens
EQDSGGSST

SEQ ID NO: 1038923 - protein, 9 aa, Homo Sapiens
TERNDKEQF

SEQ ID NO: 1038924 - protein, 9 aa, Homo Sapiens
LADVIILTI

SEQ ID NO: 1038925 - protein, 9 aa, Homo Sapiens
EATLRNRVC

SEQ ID NO: 1038926 - protein, 9 aa, Homo Sapiens
EQKKQGQDY

SEQ ID NO: 1038927 - protein, 9 aa, Homo Sapiens
DSKEQLLAC

SEQ ID NO: 1038928 - protein, 9 aa, Homo Sapiens
LSGFLSDSQ

SEQ ID NO: 1038929 - protein, 9 aa, Homo Sapiens
PVGSPDKED

SEQ ID NO: 1038930 - protein, 9 aa, Homo Sapiens
FHQEDLERL

SEQ ID NO: 1038931 - protein, 9 aa, Homo Sapiens
CFAPTELSH

SEQ ID NO: 1038932 - protein, 9 aa, Homo Sapiens
LYLVPVIAP

SEQ ID NO: 1038933 - protein, 9 aa, Homo Sapiens
VSLGLFFRR

SEQ ID NO: 1038934 - protein, 9 aa, Homo Sapiens
RLTAPQAEL

SEQ ID NO: 1038935 - protein, 9 aa, Homo Sapiens
EHKVETFSS

SEQ ID NO: 1038936 - protein, 9 aa, Homo Sapiens
ESQFIIPSC

SEQ ID NO: 1038937 - protein, 9 aa, Homo Sapiens
EAKILGTQR

SEQ ID NO: 1038938 - protein, 9 aa, Homo Sapiens
QHRRIHRGE

SEQ ID NO: 1038939 - protein, 9 aa, Homo Sapiens
DIDKFYADH

SEQ ID NO: 1038940 - protein, 9 aa, Homo Sapiens
IQEDGLSVK

SEQ ID NO: 1038941 - protein, 9 aa, Homo Sapiens
LLSLESGIL

SEQ ID NO: 1038942 - protein, 9 aa, Homo Sapiens
VRQGKEQES

SEQ ID NO: 1038943 - protein, 9 aa, Homo Sapiens
MAKIHCGQL

SEQ ID NO: 1038944 - protein, 9 aa, Homo Sapiens
GFHLRPEPP

SEQ ID NO: 1038945 - protein, 9 aa, Homo Sapiens
GSTCDAIDG

SEQ ID NO: 1038946 - protein, 9 aa, Homo Sapiens
LQGNTVRND

SEQ ID NO: 1038947 - protein, 9 aa, Homo Sapiens
LRGACGLQP

SEQ ID NO: 1038948 - protein, 9 aa, Homo Sapiens
DSAYDSNNP

SEQ ID NO: 1038949 - protein, 9 aa, Homo Sapiens
YDDSAFIEP

SEQ ID NO: 1038950 - protein, 9 aa, Homo Sapiens
QLSLRLKVM

SEQ ID NO: 1038951 - protein, 9 aa, Homo Sapiens
PSFPGSVLA

SEQ ID NO: 1038952 - protein, 9 aa, Homo Sapiens
SISRNILWA

SEQ ID NO: 1038953 - protein, 9 aa, Homo Sapiens
AVLLRPAQA

SEQ ID NO: 1038954 - protein, 9 aa, Homo Sapiens
LVCAFIRVG

SEQ ID NO: 1038955 - protein, 9 aa, Homo Sapiens
MSKRSLGIK

SEQ ID NO: 1038956 - protein, 9 aa, Homo Sapiens
KKNQELRWM

SEQ ID NO: 1038957 - protein, 9 aa, Homo Sapiens
PSAVTKIKL

SEQ ID NO: 1038958 - protein, 9 aa, Homo Sapiens
QPKKEGSRD

SEQ ID NO: 1038959 - protein, 9 aa, Homo Sapiens
KAAQNEDVD

SEQ ID NO: 1038960 - protein, 9 aa, Homo Sapiens
ILEINEKLS

SEQ ID NO: 1038961 - protein, 9 aa, Homo Sapiens
ASDKTDSAV

SEQ ID NO: 1038962 - protein, 9 aa, Homo Sapiens
QKPPSAFRE

SEQ ID NO: 1038963 - protein, 9 aa, Homo Sapiens
MNKTLGTFL

SEQ ID NO: 1038964 - protein, 9 aa, Homo Sapiens
IVPELSKPR

SEQ ID NO: 1038965 - protein, 9 aa, Homo Sapiens
FWQYPEAVL

SEQ ID NO: 1038966 - protein, 9 aa, Homo Sapiens
LANQNNLMM

SEQ ID NO: 1038967 - protein, 9 aa, Homo Sapiens
KPVDVVDNA

SEQ ID NO: 1038968 - protein, 9 aa, Homo Sapiens
IYTEENPYK

SEQ ID NO: 1038969 - protein, 9 aa, Homo Sapiens
EEQCERLIK

SEQ ID NO: 1038970 - protein, 9 aa, Homo Sapiens
GPQLDTWSM

SEQ ID NO: 1038971 - protein, 9 aa, Homo Sapiens
GYLLYIVVS

SEQ ID NO: 1038972 - protein, 9 aa, Homo Sapiens
DARADARLP

SEQ ID NO: 1038973 - protein, 9 aa, Homo Sapiens
LAQLFRGED

SEQ ID NO: 1038974 - protein, 9 aa, Homo Sapiens
FCVSRNLHL

SEQ ID NO: 1038975 - protein, 9 aa, Homo Sapiens
LCLKMIIII

SEQ ID NO: 1038976 - protein, 9 aa, Homo Sapiens
EPLAPQYTG

SEQ ID NO: 1038977 - protein, 9 aa, Homo Sapiens
QLEKCCTHN

SEQ ID NO: 1038978 - protein, 9 aa, Homo Sapiens
DTMTMDAGR

SEQ ID NO: 1038979 - protein, 9 aa, Homo Sapiens
INLFAMFGA

SEQ ID NO: 1038980 - protein, 9 aa, Homo Sapiens
AEEKALLQR

SEQ ID NO: 1038981 - protein, 9 aa, Homo Sapiens
INIIGDIAT

SEQ ID NO: 1038982 - protein, 9 aa, Homo Sapiens
NFVGNIRLD

SEQ ID NO: 1038983 - protein, 9 aa, Homo Sapiens
KGAFFCNLV

SEQ ID NO: 1038984 - protein, 9 aa, Homo Sapiens
LGSMVDLMT

SEQ ID NO: 1038985 - protein, 9 aa, Homo Sapiens
LGPGFGLGA

SEQ ID NO: 1038986 - protein, 9 aa, Homo Sapiens
SCPSLSAPK

SEQ ID NO: 1038987 - protein, 9 aa, Homo Sapiens
NSEAFLLSA

SEQ ID NO: 1038988 - protein, 9 aa, Homo Sapiens
IRYNLFLSC

SEQ ID NO: 1038989 - protein, 9 aa, Homo Sapiens
FEHKLNVSD

SEQ ID NO: 1038990 - protein, 9 aa, Homo Sapiens
KPFWQNFKH

SEQ ID NO: 1038991 - protein, 9 aa, Homo Sapiens
EEEIINSFD

SEQ ID NO: 1038992 - protein, 9 aa, Homo Sapiens
DKDHWDKVK

SEQ ID NO: 1038993 - protein, 9 aa, Homo Sapiens
TPAFAGTYR

SEQ ID NO: 1038994 - protein, 9 aa, Homo Sapiens
AIVRPSIVS

SEQ ID NO: 1038995 - protein, 9 aa, Homo Sapiens
WGSRQERQG

SEQ ID NO: 1038996 - protein, 9 aa, Homo Sapiens
DVAQKLGST

SEQ ID NO: 1038997 - protein, 9 aa, Homo Sapiens
KLVEVYKEA

SEQ ID NO: 1038998 - protein, 9 aa, Homo Sapiens
PVYPPKNVV

SEQ ID NO: 1038999 - protein, 9 aa, Homo Sapiens
FLQSHIILG

SEQ ID NO: 1039000 - protein, 9 aa, Homo Sapiens
NVKAAVRRL

SEQ ID NO: 1039001 - protein, 9 aa, Homo Sapiens
LGGPGTASS

SEQ ID NO: 1039002 - protein, 9 aa, Homo Sapiens
PLKVGLEMY

SEQ ID NO: 1039003 - protein, 9 aa, Homo Sapiens
YTRRQNPSC

SEQ ID NO: 1039004 - protein, 9 aa, Homo Sapiens
NRTTKNYPN

SEQ ID NO: 1039005 - protein, 9 aa, Homo Sapiens
QIRDARGGA

SEQ ID NO: 1039006 - protein, 9 aa, Homo Sapiens
LGLTGVKIE

SEQ ID NO: 1039007 - protein, 9 aa, Homo Sapiens
FDVFAADIC

SEQ ID NO: 1039008 - protein, 9 aa, Homo Sapiens
NYVRKTFDC

SEQ ID NO: 1039009 - protein, 9 aa, Homo Sapiens
VKVAEYKYQ

SEQ ID NO: 1039010 - protein, 9 aa, Homo Sapiens
KRHMTQPRL

SEQ ID NO: 1039011 - protein, 9 aa, Homo Sapiens
CREIRGLIT

SEQ ID NO: 1039012 - protein, 9 aa, Homo Sapiens
NNPSLKSRS

SEQ ID NO: 1039013 - protein, 9 aa, Homo Sapiens
PRFKPSLTE

SEQ ID NO: 1039014 - protein, 9 aa, Homo Sapiens
DDQDSLLVL

SEQ ID NO: 1039015 - protein, 9 aa, Homo Sapiens
QPIDSLLKN

SEQ ID NO: 1039016 - protein, 9 aa, Homo Sapiens
TYIWWLNSQ

SEQ ID NO: 1039017 - protein, 9 aa, Homo Sapiens
NLTNNVLAF

SEQ ID NO: 1039018 - protein, 9 aa, Homo Sapiens
IFTAGQESS

SEQ ID NO: 1039019 - protein, 9 aa, Homo Sapiens
CSIPLSGCL

SEQ ID NO: 1039020 - protein, 9 aa, Homo Sapiens
WYLYNRMSY

SEQ ID NO: 1039021 - protein, 9 aa, Homo Sapiens
GVIISLSKK

SEQ ID NO: 1039022 - protein, 9 aa, Homo Sapiens
CRVAIAALK

SEQ ID NO: 1039023 - protein, 9 aa, Homo Sapiens
MKVEQDQRI

SEQ ID NO: 1039024 - protein, 9 aa, Homo Sapiens
FSFMPRVLS

SEQ ID NO: 1039025 - protein, 9 aa, Homo Sapiens
QKLTRLKAA

SEQ ID NO: 1039026 - protein, 9 aa, Homo Sapiens
KNTIAMQNI

SEQ ID NO: 1039027 - protein, 9 aa, Homo Sapiens
HNRTTKNYP

SEQ ID NO: 1039028 - protein, 9 aa, Homo Sapiens
SVLCVQYTK

SEQ ID NO: 1039029 - protein, 9 aa, Homo Sapiens
TFTLGAIFI

SEQ ID NO: 1039030 - protein, 9 aa, Homo Sapiens
KQLSILTEA

SEQ ID NO: 1039031 - protein, 9 aa, Homo Sapiens
LTFVLGTEN

SEQ ID NO: 1039032 - protein, 9 aa, Homo Sapiens
IEKMSHSRK

SEQ ID NO: 1039033 - protein, 9 aa, Homo Sapiens
AKTDTLQIK

SEQ ID NO: 1039034 - protein, 9 aa, Homo Sapiens
KFAGGSAGQ

SEQ ID NO: 1039035 - protein, 9 aa, Homo Sapiens
LLFTVFSSS

SEQ ID NO: 1039036 - protein, 9 aa, Homo Sapiens
DRTPDGRSQ

SEQ ID NO: 1039037 - protein, 9 aa, Homo Sapiens
ALQHLHGSH

SEQ ID NO: 1039038 - protein, 9 aa, Homo Sapiens
DKPLKVGLE

SEQ ID NO: 1039039 - protein, 9 aa, Homo Sapiens
CCRPLCGQP

SEQ ID NO: 1039040 - protein, 9 aa, Homo Sapiens
HKKIYTGEK

SEQ ID NO: 1039041 - protein, 9 aa, Homo Sapiens
LSGDPSIES

SEQ ID NO: 1039042 - protein, 9 aa, Homo Sapiens
KEEEFELVV

SEQ ID NO: 1039043 - protein, 9 aa, Homo Sapiens
ATSFPPTPT

SEQ ID NO: 1039044 - protein, 9 aa, Homo Sapiens
LSPNFYQPG

SEQ ID NO: 1039045 - protein, 9 aa, Homo Sapiens
RQETPLKPI

SEQ ID NO: 1039046 - protein, 9 aa, Homo Sapiens
IPYSQYSFN

SEQ ID NO: 1039047 - protein, 9 aa, Homo Sapiens
IFNHFVQNS

SEQ ID NO: 1039048 - protein, 9 aa, Homo Sapiens
YPLSYKALL

SEQ ID NO: 1039049 - protein, 9 aa, Homo Sapiens
KKKTHSIRS

SEQ ID NO: 1039050 - protein, 9 aa, Homo Sapiens
LILSSYDLI

SEQ ID NO: 1039051 - protein, 9 aa, Homo Sapiens
TSLGETWES

SEQ ID NO: 1039052 - protein, 9 aa, Homo Sapiens
LSRMFEIQN

SEQ ID NO: 1039053 - protein, 9 aa, Homo Sapiens
HSPATHQAP

SEQ ID NO: 1039054 - protein, 9 aa, Homo Sapiens
SNEVVFDVV

SEQ ID NO: 1039055 - protein, 9 aa, Homo Sapiens
AMSSSVKTP

SEQ ID NO: 1039056 - protein, 9 aa, Homo Sapiens
ANAGSDYKF

SEQ ID NO: 1039057 - protein, 9 aa, Homo Sapiens
LLACQQKQR

SEQ ID NO: 1039058 - protein, 9 aa, Homo Sapiens
QFLDRRLFY

SEQ ID NO: 1039059 - protein, 9 aa, Homo Sapiens
GYTSRFSLT

SEQ ID NO: 1039060 - protein, 9 aa, Homo Sapiens
RNFASCMEH

SEQ ID NO: 1039061 - protein, 9 aa, Homo Sapiens
VARELSPNF

SEQ ID NO: 1039062 - protein, 9 aa, Homo Sapiens
AVEKMTSKG

SEQ ID NO: 1039063 - protein, 9 aa, Homo Sapiens
AASSPSQPA

SEQ ID NO: 1039064 - protein, 9 aa, Homo Sapiens
AEQLLKDLR

SEQ ID NO: 1039065 - protein, 9 aa, Homo Sapiens
PQASSFHTT

SEQ ID NO: 1039066 - protein, 9 aa, Homo Sapiens
YSSFGDASS

SEQ ID NO: 1039067 - protein, 9 aa, Homo Sapiens
SICLKAGTW

SEQ ID NO: 1039068 - protein, 9 aa, Homo Sapiens
SAPKGCESA

SEQ ID NO: 1039069 - protein, 9 aa, Homo Sapiens
PAFTMSWVP

SEQ ID NO: 1039070 - protein, 9 aa, Homo Sapiens
VVFWRLIAL

SEQ ID NO: 1039071 - protein, 9 aa, Homo Sapiens
VFDFRVTVV

SEQ ID NO: 1039072 - protein, 9 aa, Homo Sapiens
PGASSPHPR

SEQ ID NO: 1039073 - protein, 9 aa, Homo Sapiens
SSPRDFNPQ

SEQ ID NO: 1039074 - protein, 9 aa, Homo Sapiens
VCLDWKPWS

SEQ ID NO: 1039075 - protein, 9 aa, Homo Sapiens
VDDMHTSDT

SEQ ID NO: 1039076 - protein, 9 aa, Homo Sapiens
PIPVLSNNY

SEQ ID NO: 1039077 - protein, 9 aa, Homo Sapiens
DNRHVALYQ

SEQ ID NO: 1039078 - protein, 9 aa, Homo Sapiens
RLHAQKGAQ

SEQ ID NO: 1039079 - protein, 9 aa, Homo Sapiens
HPQPIDSLL

SEQ ID NO: 1039080 - protein, 9 aa, Homo Sapiens
LSSVDLEVQ

SEQ ID NO: 1039081 - protein, 9 aa, Homo Sapiens
SPDKEDGEP

SEQ ID NO: 1039082 - protein, 9 aa, Homo Sapiens
HGDEVSYVL

SEQ ID NO: 1039083 - protein, 9 aa, Homo Sapiens
YLSSEVLRK

SEQ ID NO: 1039084 - protein, 9 aa, Homo Sapiens
SEEPSKNIN

SEQ ID NO: 1039085 - protein, 9 aa, Homo Sapiens
PVGTAAVPS

SEQ ID NO: 1039086 - protein, 9 aa, Homo Sapiens
LRPAPGHAR

SEQ ID NO: 1039087 - protein, 9 aa, Homo Sapiens
NPNKYIPNV

SEQ ID NO: 1039088 - protein, 9 aa, Homo Sapiens
INEKAGDTE

SEQ ID NO: 1039089 - protein, 9 aa, Homo Sapiens
SRGLAQLFR

SEQ ID NO: 1039090 - protein, 9 aa, Homo Sapiens
DARLPPALR

SEQ ID NO: 1039091 - protein, 9 aa, Homo Sapiens
PKKFAGGSA

SEQ ID NO: 1039092 - protein, 9 aa, Homo Sapiens
SEEQTSDEN

SEQ ID NO: 1039093 - protein, 9 aa, Homo Sapiens
LFQYSCRQF

SEQ ID NO: 1039094 - protein, 9 aa, Homo Sapiens
LLEKFHCIA

SEQ ID NO: 1039095 - protein, 9 aa, Homo Sapiens
SPPGEHSGI

SEQ ID NO: 1039096 - protein, 9 aa, Homo Sapiens
LVTMKNGFR

SEQ ID NO: 1039097 - protein, 9 aa, Homo Sapiens
KSNLKKPIT

SEQ ID NO: 1039098 - protein, 9 aa, Homo Sapiens
MLSSVVFWR

SEQ ID NO: 1039099 - protein, 9 aa, Homo Sapiens
VLKNQMFII

SEQ ID NO: 1039100 - protein, 9 aa, Homo Sapiens
LAGDPDPSR

SEQ ID NO: 1039101 - protein, 9 aa, Homo Sapiens
LEKKKTPES

SEQ ID NO: 1039102 - protein, 9 aa, Homo Sapiens
GAGRGGQRE

SEQ ID NO: 1039103 - protein, 9 aa, Homo Sapiens
CSTKVLDFH

SEQ ID NO: 1039104 - protein, 9 aa, Homo Sapiens
MSLLSLLDE

SEQ ID NO: 1039105 - protein, 9 aa, Homo Sapiens
RMKFQSCNT

SEQ ID NO: 1039106 - protein, 9 aa, Homo Sapiens
SEQVQFSRT

SEQ ID NO: 1039107 - protein, 9 aa, Homo Sapiens
GLHPHEWTH

SEQ ID NO: 1039108 - protein, 9 aa, Homo Sapiens
GAIAFAIAI

SEQ ID NO: 1039109 - protein, 9 aa, Homo Sapiens
RLIALIGTS

SEQ ID NO: 1039110 - protein, 9 aa, Homo Sapiens
SSKESPQKA

SEQ ID NO: 1039111 - protein, 9 aa, Homo Sapiens
YRQKCEFVQ

SEQ ID NO: 1039112 - protein, 9 aa, Homo Sapiens
FTSFLLPRP

SEQ ID NO: 1039113 - protein, 9 aa, Homo Sapiens
NLTFNSKPH

SEQ ID NO: 1039114 - protein, 9 aa, Homo Sapiens
GLFPQAASL

SEQ ID NO: 1039115 - protein, 9 aa, Homo Sapiens
SFEHSDFES

SEQ ID NO: 1039116 - protein, 9 aa, Homo Sapiens
IAGLLGLGP

SEQ ID NO: 1039117 - protein, 9 aa, Homo Sapiens
LCLFSLDKV

SEQ ID NO: 1039118 - protein, 9 aa, Homo Sapiens
CYTCVCQRG

SEQ ID NO: 1039119 - protein, 9 aa, Homo Sapiens
SDASESVQN

SEQ ID NO: 1039120 - protein, 9 aa, Homo Sapiens
RRWATWELY

SEQ ID NO: 1039121 - protein, 9 aa, Homo Sapiens
TRVVSSFNS

SEQ ID NO: 1039122 - protein, 9 aa, Homo Sapiens
DCLLEKYFM

SEQ ID NO: 1039123 - protein, 9 aa, Homo Sapiens
KSLFCELRE

SEQ ID NO: 1039124 - protein, 9 aa, Homo Sapiens
QKLGSTTVG

SEQ ID NO: 1039125 - protein, 9 aa, Homo Sapiens
LLESELLAD

SEQ ID NO: 1039126 - protein, 9 aa, Homo Sapiens
EEIWSYLMH

SEQ ID NO: 1039127 - protein, 9 aa, Homo Sapiens
YFQSLNLYN

SEQ ID NO: 1039128 - protein, 9 aa, Homo Sapiens
VLLAGDPDP

SEQ ID NO: 1039129 - protein, 9 aa, Homo Sapiens
TQLKPKNTI

SEQ ID NO: 1039130 - protein, 9 aa, Homo Sapiens
NGVVVYVAP

SEQ ID NO: 1039131 - protein, 9 aa, Homo Sapiens
ICFHSKWGT

SEQ ID NO: 1039132 - protein, 9 aa, Homo Sapiens
ADSPAEAFL

SEQ ID NO: 1039133 - protein, 9 aa, Homo Sapiens
LADYCTQPG

SEQ ID NO: 1039134 - protein, 9 aa, Homo Sapiens
VSYVKIEKV

SEQ ID NO: 1039135 - protein, 9 aa, Homo Sapiens
EHKLNVSDL

SEQ ID NO: 1039136 - protein, 9 aa, Homo Sapiens
IEEGVISTL

SEQ ID NO: 1039137 - protein, 9 aa, Homo Sapiens
FVSVTKALT

SEQ ID NO: 1039138 - protein, 9 aa, Homo Sapiens
SSSPSSSGR

SEQ ID NO: 1039139 - protein, 9 aa, Homo Sapiens
VAPSAVSPP

SEQ ID NO: 1039140 - protein, 9 aa, Homo Sapiens
VDLETKKTV

SEQ ID NO: 1039141 - protein, 9 aa, Homo Sapiens
AGLCLFSLD

SEQ ID NO: 1039142 - protein, 9 aa, Homo Sapiens
VCQRGMFNC

SEQ ID NO: 1039143 - protein, 9 aa, Homo Sapiens
HQRKQELRE

SEQ ID NO: 1039144 - protein, 9 aa, Homo Sapiens
SQTSAPWDP

SEQ ID NO: 1039145 - protein, 9 aa, Homo Sapiens
KDELSFTEG

SEQ ID NO: 1039146 - protein, 9 aa, Homo Sapiens
TPISSRPWD

SEQ ID NO: 1039147 - protein, 9 aa, Homo Sapiens
WPVNGRLTA

SEQ ID NO: 1039148 - protein, 9 aa, Homo Sapiens
GRASVFPPD

SEQ ID NO: 1039149 - protein, 9 aa, Homo Sapiens
APLSGDPSI

SEQ ID NO: 1039150 - protein, 9 aa, Homo Sapiens
VTLRNISRQ

SEQ ID NO: 1039151 - protein, 9 aa, Homo Sapiens
PVGRKATSN

SEQ ID NO: 1039152 - protein, 9 aa, Homo Sapiens
EKLSPQLAE

SEQ ID NO: 1039153 - protein, 9 aa, Homo Sapiens
RLRFPIKSS

SEQ ID NO: 1039154 - protein, 9 aa, Homo Sapiens
DIGLIYHSP

SEQ ID NO: 1039155 - protein, 9 aa, Homo Sapiens
SSGGWAKFT

SEQ ID NO: 1039156 - protein, 9 aa, Homo Sapiens
MDRTPDGRS

SEQ ID NO: 1039157 - protein, 9 aa, Homo Sapiens
MTLRCLRYV

SEQ ID NO: 1039158 - protein, 9 aa, Homo Sapiens
EFCTYDDFS

SEQ ID NO: 1039159 - protein, 9 aa, Homo Sapiens
KDHWDKVKE

SEQ ID NO: 1039160 - protein, 9 aa, Homo Sapiens
EVDVASFLL

SEQ ID NO: 1039161 - protein, 9 aa, Homo Sapiens
IDRHRVMDD

SEQ ID NO: 1039162 - protein, 9 aa, Homo Sapiens
NRPGVYTCV

SEQ ID NO: 1039163 - protein, 9 aa, Homo Sapiens
GGPGTASSP

SEQ ID NO: 1039164 - protein, 9 aa, Homo Sapiens
EQLLKDLRN

SEQ ID NO: 1039165 - protein, 9 aa, Homo Sapiens
PVLRDSWGG

SEQ ID NO: 1039166 - protein, 9 aa, Homo Sapiens
TITSTTASE

SEQ ID NO: 1039167 - protein, 9 aa, Homo Sapiens
SAAESGGLG

SEQ ID NO: 1039168 - protein, 9 aa, Homo Sapiens
VGGFSCSCL

SEQ ID NO: 1039169 - protein, 9 aa, Homo Sapiens
SKGKFHVTS

SEQ ID NO: 1039170 - protein, 9 aa, Homo Sapiens
NPNDDIRYN

SEQ ID NO: 1039171 - protein, 9 aa, Homo Sapiens
SNNYSYLII

SEQ ID NO: 1039172 - protein, 9 aa, Homo Sapiens
NNSQRRVTF

SEQ ID NO: 1039173 - protein, 9 aa, Homo Sapiens
FLSPQRDPK

SEQ ID NO: 1039174 - protein, 9 aa, Homo Sapiens
TARTPPMWI

SEQ ID NO: 1039175 - protein, 9 aa, Homo Sapiens
NFYTLVVSG

SEQ ID NO: 1039176 - protein, 9 aa, Homo Sapiens
MVTSTFSIF

SEQ ID NO: 1039177 - protein, 9 aa, Homo Sapiens
LSQQTLRFN

SEQ ID NO: 1039178 - protein, 9 aa, Homo Sapiens
RTIFFVGCT

SEQ ID NO: 1039179 - protein, 9 aa, Homo Sapiens
PPLVSGVLQ

SEQ ID NO: 1039180 - protein, 9 aa, Homo Sapiens
RGNCKNCAQ

SEQ ID NO: 1039181 - protein, 9 aa, Homo Sapiens
MVDCSKLLP

SEQ ID NO: 1039182 - protein, 9 aa, Homo Sapiens
RKVFPEIQL

SEQ ID NO: 1039183 - protein, 9 aa, Homo Sapiens
NGFGNFYTL

SEQ ID NO: 1039184 - protein, 9 aa, Homo Sapiens
ERRGAFWSY

SEQ ID NO: 1039185 - protein, 9 aa, Homo Sapiens
KNPPPTKKI

SEQ ID NO: 1039186 - protein, 9 aa, Homo Sapiens
PGERGNGRS

SEQ ID NO: 1039187 - protein, 9 aa, Homo Sapiens
KVIYRGEVW

SEQ ID NO: 1039188 - protein, 9 aa, Homo Sapiens
ADVVCISLA

SEQ ID NO: 1039189 - protein, 9 aa, Homo Sapiens
CICLATFPD

SEQ ID NO: 1039190 - protein, 9 aa, Homo Sapiens
TYKIKVVPE

SEQ ID NO: 1039191 - protein, 9 aa, Homo Sapiens
CPNKVAQLD

SEQ ID NO: 1039192 - protein, 9 aa, Homo Sapiens
SCPTVNFIV

SEQ ID NO: 1039193 - protein, 9 aa, Homo Sapiens
EMVFARTSR

SEQ ID NO: 1039194 - protein, 9 aa, Homo Sapiens
PCCRPLCGQ

SEQ ID NO: 1039195 - protein, 9 aa, Homo Sapiens
PPTSDLPQP

SEQ ID NO: 1039196 - protein, 9 aa, Homo Sapiens
NSSSLSLDQ

SEQ ID NO: 1039197 - protein, 9 aa, Homo Sapiens
NKLPGEGIA

SEQ ID NO: 1039198 - protein, 9 aa, Homo Sapiens
ICKTVRHSF

SEQ ID NO: 1039199 - protein, 9 aa, Homo Sapiens
SSTPEQDDL

SEQ ID NO: 1039200 - protein, 9 aa, Homo Sapiens
KEHSFWSDF

SEQ ID NO: 1039201 - protein, 9 aa, Homo Sapiens
AEDKKTRDL

SEQ ID NO: 1039202 - protein, 9 aa, Homo Sapiens
FYTRITISI

SEQ ID NO: 1039203 - protein, 9 aa, Homo Sapiens
PFLSFLPLK

SEQ ID NO: 1039204 - protein, 9 aa, Homo Sapiens
EEEQDTFEL

SEQ ID NO: 1039205 - protein, 9 aa, Homo Sapiens
AEAAGHPAP

SEQ ID NO: 1039206 - protein, 9 aa, Homo Sapiens
TEPRTESSR

SEQ ID NO: 1039207 - protein, 9 aa, Homo Sapiens
SFNHLYNTN

SEQ ID NO: 1039208 - protein, 9 aa, Homo Sapiens
PSTQADSSF

SEQ ID NO: 1039209 - protein, 9 aa, Homo Sapiens
EYQLSYHDL

SEQ ID NO: 1039210 - protein, 9 aa, Homo Sapiens
HPLDLGGLE

SEQ ID NO: 1039211 - protein, 9 aa, Homo Sapiens
CNKIEDYFI

SEQ ID NO: 1039212 - protein, 9 aa, Homo Sapiens
LLPGSLLFG

SEQ ID NO: 1039213 - protein, 9 aa, Homo Sapiens
GGEKGPGGS

SEQ ID NO: 1039214 - protein, 9 aa, Homo Sapiens
AVPRRGSLK

SEQ ID NO: 1039215 - protein, 9 aa, Homo Sapiens
LDQQFRKRC

SEQ ID NO: 1039216 - protein, 9 aa, Homo Sapiens
GTGQNDWTA

SEQ ID NO: 1039217 - protein, 9 aa, Homo Sapiens
SGTAATSIT

SEQ ID NO: 1039218 - protein, 9 aa, Homo Sapiens
CPPPITPHE

SEQ ID NO: 1039219 - protein, 9 aa, Homo Sapiens
AQLEKSAIS

SEQ ID NO: 1039220 - protein, 9 aa, Homo Sapiens
VTFPDGRFL

SEQ ID NO: 1039221 - protein, 9 aa, Homo Sapiens
DFLIEHMIM

SEQ ID NO: 1039222 - protein, 9 aa, Homo Sapiens
LSELFSLLY

SEQ ID NO: 1039223 - protein, 9 aa, Homo Sapiens
DDNITHKVL

SEQ ID NO: 1039224 - protein, 9 aa, Homo Sapiens
GPPVLAGFP

SEQ ID NO: 1039225 - protein, 9 aa, Homo Sapiens
QALQEKISI

SEQ ID NO: 1039226 - protein, 9 aa, Homo Sapiens
YFAHFCYQN

SEQ ID NO: 1039227 - protein, 9 aa, Homo Sapiens
CYGSYSSSP

SEQ ID NO: 1039228 - protein, 9 aa, Homo Sapiens
ETKKTVWQL

SEQ ID NO: 1039229 - protein, 9 aa, Homo Sapiens
SGWLYGPSD

SEQ ID NO: 1039230 - protein, 9 aa, Homo Sapiens
PRATLGEQK

SEQ ID NO: 1039231 - protein, 9 aa, Homo Sapiens
FGSLREKDQ

SEQ ID NO: 1039232 - protein, 9 aa, Homo Sapiens
DDTHQHQEK

SEQ ID NO: 1039233 - protein, 9 aa, Homo Sapiens
AAEALLLQL

SEQ ID NO: 1039234 - protein, 9 aa, Homo Sapiens
VGTVANLFV

SEQ ID NO: 1039235 - protein, 9 aa, Homo Sapiens
TVCLSVSQP

SEQ ID NO: 1039236 - protein, 9 aa, Homo Sapiens
QDWTSSTIA

SEQ ID NO: 1039237 - protein, 9 aa, Homo Sapiens
YAAYFAQVK

SEQ ID NO: 1039238 - protein, 9 aa, Homo Sapiens
GQNDWTATD

SEQ ID NO: 1039239 - protein, 9 aa, Homo Sapiens
VVFKSAVRD

SEQ ID NO: 1039240 - protein, 9 aa, Homo Sapiens
GQQSQCLQS

SEQ ID NO: 1039241 - protein, 9 aa, Homo Sapiens
ETQWPSREF

SEQ ID NO: 1039242 - protein, 9 aa, Homo Sapiens
SSNEKLKEK

SEQ ID NO: 1039243 - protein, 9 aa, Homo Sapiens
HWEENTVYQ

SEQ ID NO: 1039244 - protein, 9 aa, Homo Sapiens
LLTGHKGHT

SEQ ID NO: 1039245 - protein, 9 aa, Homo Sapiens
AQFGGIHFV

SEQ ID NO: 1039246 - protein, 9 aa, Homo Sapiens
SQRHPFPEA

SEQ ID NO: 1039247 - protein, 9 aa, Homo Sapiens
GPFWGQEKE

SEQ ID NO: 1039248 - protein, 9 aa, Homo Sapiens
KDRGPVLLP

SEQ ID NO: 1039249 - protein, 9 aa, Homo Sapiens
FCSVSDKSN

SEQ ID NO: 1039250 - protein, 9 aa, Homo Sapiens
GQREEDDEH

SEQ ID NO: 1039251 - protein, 9 aa, Homo Sapiens
QTESTFKNT

SEQ ID NO: 1039252 - protein, 9 aa, Homo Sapiens
QMANQDPDF

SEQ ID NO: 1039253 - protein, 9 aa, Homo Sapiens
LRVVIDQML

SEQ ID NO: 1039254 - protein, 9 aa, Homo Sapiens
PPKKEPLKE

SEQ ID NO: 1039255 - protein, 9 aa, Homo Sapiens
SALNPHWEE

SEQ ID NO: 1039256 - protein, 9 aa, Homo Sapiens
FMLLFQYRY

SEQ ID NO: 1039257 - protein, 9 aa, Homo Sapiens
RSQLEKLEA

SEQ ID NO: 1039258 - protein, 9 aa, Homo Sapiens
PASLWKPPP

SEQ ID NO: 1039259 - protein, 9 aa, Homo Sapiens
ARICLSSGS

SEQ ID NO: 1039260 - protein, 9 aa, Homo Sapiens
ELSSSPPRP

SEQ ID NO: 1039261 - protein, 9 aa, Homo Sapiens
INEKLSPQL

SEQ ID NO: 1039262 - protein, 9 aa, Homo Sapiens
NLEIHQKIY

SEQ ID NO: 1039263 - protein, 9 aa, Homo Sapiens
YHTFCLILP

SEQ ID NO: 1039264 - protein, 9 aa, Homo Sapiens
ENYRNLLLL

SEQ ID NO: 1039265 - protein, 9 aa, Homo Sapiens
WLKNNFKIQ

SEQ ID NO: 1039266 - protein, 9 aa, Homo Sapiens
QELAIKANT

SEQ ID NO: 1039267 - protein, 9 aa, Homo Sapiens
KGKIHLHSF

SEQ ID NO: 1039268 - protein, 9 aa, Homo Sapiens
VSASWKEPF

SEQ ID NO: 1039269 - protein, 9 aa, Homo Sapiens
APVINRLTR

SEQ ID NO: 1039270 - protein, 9 aa, Homo Sapiens
KALDQEEEA

SEQ ID NO: 1039271 - protein, 9 aa, Homo Sapiens
RTSELPLRN

SEQ ID NO: 1039272 - protein, 9 aa, Homo Sapiens
LLGAARGLQ

SEQ ID NO: 1039273 - protein, 9 aa, Homo Sapiens
LPVGRIEKP

SEQ ID NO: 1039274 - protein, 9 aa, Homo Sapiens
LREQKKNLT

SEQ ID NO: 1039275 - protein, 9 aa, Homo Sapiens
LPKKMTIWV

SEQ ID NO: 1039276 - protein, 9 aa, Homo Sapiens
MAGCRDPSL

SEQ ID NO: 1039277 - protein, 9 aa, Homo Sapiens
FTVAQKMAK

SEQ ID NO: 1039278 - protein, 9 aa, Homo Sapiens
EREAERGSE

SEQ ID NO: 1039279 - protein, 9 aa, Homo Sapiens
LDVITWVEI

SEQ ID NO: 1039280 - protein, 9 aa, Homo Sapiens
STASQSWTS

SEQ ID NO: 1039281 - protein, 9 aa, Homo Sapiens
NTAGTGSSS

SEQ ID NO: 1039282 - protein, 9 aa, Homo Sapiens
IKVLNTLES

SEQ ID NO: 1039283 - protein, 9 aa, Homo Sapiens
RPLQVPGAF

SEQ ID NO: 1039284 - protein, 9 aa, Homo Sapiens
SWDNQQKNP

SEQ ID NO: 1039285 - protein, 9 aa, Homo Sapiens
YTSRFSLTC

SEQ ID NO: 1039286 - protein, 9 aa, Homo Sapiens
RPKILNVGN

SEQ ID NO: 1039287 - protein, 9 aa, Homo Sapiens
DRQIPSPDV

SEQ ID NO: 1039288 - protein, 9 aa, Homo Sapiens
QEEAPAQLP

SEQ ID NO: 1039289 - protein, 9 aa, Homo Sapiens
VNATNPDLG

SEQ ID NO: 1039290 - protein, 9 aa, Homo Sapiens
PAAPCADSD

SEQ ID NO: 1039291 - protein, 9 aa, Homo Sapiens
FPAQFGGIH

SEQ ID NO: 1039292 - protein, 9 aa, Homo Sapiens
MLLYVRKET

SEQ ID NO: 1039293 - protein, 9 aa, Homo Sapiens
DYFIDLPRK

SEQ ID NO: 1039294 - protein, 9 aa, Homo Sapiens
TLWEVTVRD

SEQ ID NO: 1039295 - protein, 9 aa, Homo Sapiens
SLCRSSDGV

SEQ ID NO: 1039296 - protein, 9 aa, Homo Sapiens
SLRYNSLSK

SEQ ID NO: 1039297 - protein, 9 aa, Homo Sapiens
CQGDFGGPL

SEQ ID NO: 1039298 - protein, 9 aa, Homo Sapiens
LRTVKSEHK

SEQ ID NO: 1039299 - protein, 9 aa, Homo Sapiens
IAETPGVPG

SEQ ID NO: 1039300 - protein, 9 aa, Homo Sapiens
LQRMFSTPP

SEQ ID NO: 1039301 - protein, 9 aa, Homo Sapiens
FTETSQTSA

SEQ ID NO: 1039302 - protein, 9 aa, Homo Sapiens
PSVISCLKY

SEQ ID NO: 1039303 - protein, 9 aa, Homo Sapiens
LFREALVLQ

SEQ ID NO: 1039304 - protein, 9 aa, Homo Sapiens
CSKLLPTSL

SEQ ID NO: 1039305 - protein, 9 aa, Homo Sapiens
SVIHRLQLI

SEQ ID NO: 1039306 - protein, 9 aa, Homo Sapiens
ISVIHRLQL

SEQ ID NO: 1039307 - protein, 9 aa, Homo Sapiens
PFCSVSISH

SEQ ID NO: 1039308 - protein, 9 aa, Homo Sapiens
IFVVISFFL

SEQ ID NO: 1039309 - protein, 9 aa, Homo Sapiens
PLERKVFPE

SEQ ID NO: 1039310 - protein, 9 aa, Homo Sapiens
IKCSGIHRS

SEQ ID NO: 1039311 - protein, 9 aa, Homo Sapiens
KEEEKYEDE

SEQ ID NO: 1039312 - protein, 9 aa, Homo Sapiens
VAQLDPKGG

SEQ ID NO: 1039313 - protein, 9 aa, Homo Sapiens
SNKLHVTDP

SEQ ID NO: 1039314 - protein, 9 aa, Homo Sapiens
PYLHQQNRT

SEQ ID NO: 1039315 - protein, 9 aa, Homo Sapiens
HEEQFKQLY

SEQ ID NO: 1039316 - protein, 9 aa, Homo Sapiens
RDPWISHGG

SEQ ID NO: 1039317 - protein, 9 aa, Homo Sapiens
QAMSSSVKT

SEQ ID NO: 1039318 - protein, 9 aa, Homo Sapiens
SIHYKQQID

SEQ ID NO: 1039319 - protein, 9 aa, Homo Sapiens
FTLGAIFIV

SEQ ID NO: 1039320 - protein, 9 aa, Homo Sapiens
TFILLFYAL

SEQ ID NO: 1039321 - protein, 9 aa, Homo Sapiens
ERTPALHKS

SEQ ID NO: 1039322 - protein, 9 aa, Homo Sapiens
FFVTLDDLA

SEQ ID NO: 1039323 - protein, 9 aa, Homo Sapiens
LKTCQQAEC

SEQ ID NO: 1039324 - protein, 9 aa, Homo Sapiens
LCIFVLLSL

SEQ ID NO: 1039325 - protein, 9 aa, Homo Sapiens
QLQNSGDPP

SEQ ID NO: 1039326 - protein, 9 aa, Homo Sapiens
SFVCVPTYV

SEQ ID NO: 1039327 - protein, 9 aa, Homo Sapiens
VGRQDCPTV

SEQ ID NO: 1039328 - protein, 9 aa, Homo Sapiens
TLSPQVRPF

SEQ ID NO: 1039329 - protein, 9 aa, Homo Sapiens
VGILLFFDQ

SEQ ID NO: 1039330 - protein, 9 aa, Homo Sapiens
EMILKMQES

SEQ ID NO: 1039331 - protein, 9 aa, Homo Sapiens
RGSFFLGEQ

SEQ ID NO: 1039332 - protein, 9 aa, Homo Sapiens
EIENLLVIV

SEQ ID NO: 1039333 - protein, 9 aa, Homo Sapiens
SVLAKSGPV

SEQ ID NO: 1039334 - protein, 9 aa, Homo Sapiens
SSLQGYIKA

SEQ ID NO: 1039335 - protein, 9 aa, Homo Sapiens
HRHEKVIYL

SEQ ID NO: 1039336 - protein, 9 aa, Homo Sapiens
KDSLPVQNF

SEQ ID NO: 1039337 - protein, 9 aa, Homo Sapiens
EDDQDSLLV

SEQ ID NO: 1039338 - protein, 9 aa, Homo Sapiens
SSNQYFAHF

SEQ ID NO: 1039339 - protein, 9 aa, Homo Sapiens
LQLEQETVV

SEQ ID NO: 1039340 - protein, 9 aa, Homo Sapiens
ARSSHLENR

SEQ ID NO: 1039341 - protein, 9 aa, Homo Sapiens
TASSLANSS

SEQ ID NO: 1039342 - protein, 9 aa, Homo Sapiens
FLSNNYQQQ

SEQ ID NO: 1039343 - protein, 9 aa, Homo Sapiens
RVLKIPRTV

SEQ ID NO: 1039344 - protein, 9 aa, Homo Sapiens
LEGFYDEST

SEQ ID NO: 1039345 - protein, 9 aa, Homo Sapiens
TNHEFVDKQ

SEQ ID NO: 1039346 - protein, 9 aa, Homo Sapiens
GGKLSLELL

SEQ ID NO: 1039347 - protein, 9 aa, Homo Sapiens
VGISRPPSR

SEQ ID NO: 1039348 - protein, 9 aa, Homo Sapiens
SHYATNSWD

SEQ ID NO: 1039349 - protein, 9 aa, Homo Sapiens
LKVKTSDQD

SEQ ID NO: 1039350 - protein, 9 aa, Homo Sapiens
PQPRGQAAT

SEQ ID NO: 1039351 - protein, 9 aa, Homo Sapiens
SDLPQPHLP

SEQ ID NO: 1039352 - protein, 9 aa, Homo Sapiens
EHTDQIRKF

SEQ ID NO: 1039353 - protein, 9 aa, Homo Sapiens
KSHPRKRTR

SEQ ID NO: 1039354 - protein, 9 aa, Homo Sapiens
INSHSPLIR

SEQ ID NO: 1039355 - protein, 9 aa, Homo Sapiens
PSPKEKGEA

SEQ ID NO: 1039356 - protein, 9 aa, Homo Sapiens
FLPFTLQKL

SEQ ID NO: 1039357 - protein, 9 aa, Homo Sapiens
NDSAYDSNN

SEQ ID NO: 1039358 - protein, 9 aa, Homo Sapiens
FVDNASMPP

SEQ ID NO: 1039359 - protein, 9 aa, Homo Sapiens
ANLFVAGTE

SEQ ID NO: 1039360 - protein, 9 aa, Homo Sapiens
SLAEVLVPD

SEQ ID NO: 1039361 - protein, 9 aa, Homo Sapiens
KNQMFIIWN

SEQ ID NO: 1039362 - protein, 9 aa, Homo Sapiens
LLQPLLENP

SEQ ID NO: 1039363 - protein, 9 aa, Homo Sapiens
LKEGSSNQQ

SEQ ID NO: 1039364 - protein, 9 aa, Homo Sapiens
IGTLGTTIL

SEQ ID NO: 1039365 - protein, 9 aa, Homo Sapiens
VQYTKEPRI

SEQ ID NO: 1039366 - protein, 9 aa, Homo Sapiens
LTPTAVSGS

SEQ ID NO: 1039367 - protein, 9 aa, Homo Sapiens
VARLETHAA

SEQ ID NO: 1039368 - protein, 9 aa, Homo Sapiens
QIKDTMTMD

SEQ ID NO: 1039369 - protein, 9 aa, Homo Sapiens
KFVSVTKAL

SEQ ID NO: 1039370 - protein, 9 aa, Homo Sapiens
QPRLWANHR

SEQ ID NO: 1039371 - protein, 9 aa, Homo Sapiens
KPSFPGSVL

SEQ ID NO: 1039372 - protein, 9 aa, Homo Sapiens
VVQHAPSEF

SEQ ID NO: 1039373 - protein, 9 aa, Homo Sapiens
REAEGTAGS

SEQ ID NO: 1039374 - protein, 9 aa, Homo Sapiens
KLENNPEMK

SEQ ID NO: 1039375 - protein, 9 aa, Homo Sapiens
KFPYTRRQN

SEQ ID NO: 1039376 - protein, 9 aa, Homo Sapiens
SEAFLLSAD

SEQ ID NO: 1039377 - protein, 9 aa, Homo Sapiens
DPNRVMRYA

SEQ ID NO: 1039378 - protein, 9 aa, Homo Sapiens
ILRLVRAAQ

SEQ ID NO: 1039379 - protein, 9 aa, Homo Sapiens
NYPEKFEKL

SEQ ID NO: 1039380 - protein, 9 aa, Homo Sapiens
VLLIDFAHF

SEQ ID NO: 1039381 - protein, 9 aa, Homo Sapiens
DKEDGEPDY

SEQ ID NO: 1039382 - protein, 9 aa, Homo Sapiens
HLKTSVDKS

SEQ ID NO: 1039383 - protein, 9 aa, Homo Sapiens
RLIFSGHQS

SEQ ID NO: 1039384 - protein, 9 aa, Homo Sapiens
NKSSPEKQL

SEQ ID NO: 1039385 - protein, 9 aa, Homo Sapiens
FTYSLSCIR

SEQ ID NO: 1039386 - protein, 9 aa, Homo Sapiens
FARDDMNFT

SEQ ID NO: 1039387 - protein, 9 aa, Homo Sapiens
EKVLKESDN

SEQ ID NO: 1039388 - protein, 9 aa, Homo Sapiens
NQNNLMMPR

SEQ ID NO: 1039389 - protein, 9 aa, Homo Sapiens
QKTSEMRLY

SEQ ID NO: 1039390 - protein, 9 aa, Homo Sapiens
SIIQQLQSL

SEQ ID NO: 1039391 - protein, 9 aa, Homo Sapiens
TPTEKVKKM

SEQ ID NO: 1039392 - protein, 9 aa, Homo Sapiens
GCGWAPLAG

SEQ ID NO: 1039393 - protein, 9 aa, Homo Sapiens
FGDMTEIGK

SEQ ID NO: 1039394 - protein, 9 aa, Homo Sapiens
TRGFHLRPE

SEQ ID NO: 1039395 - protein, 9 aa, Homo Sapiens
WPDRKILAT

SEQ ID NO: 1039396 - protein, 9 aa, Homo Sapiens
FWGQEKEHS

SEQ ID NO: 1039397 - protein, 9 aa, Homo Sapiens
RVIVCDNNK

SEQ ID NO: 1039398 - protein, 9 aa, Homo Sapiens
HAGCDCIIG

SEQ ID NO: 1039399 - protein, 9 aa, Homo Sapiens
KPSFEKPLE

SEQ ID NO: 1039400 - protein, 9 aa, Homo Sapiens
SWQESDTVS

SEQ ID NO: 1039401 - protein, 9 aa, Homo Sapiens
QYPPLKFGI

SEQ ID NO: 1039402 - protein, 9 aa, Homo Sapiens
KSLESEQAP

SEQ ID NO: 1039403 - protein, 9 aa, Homo Sapiens
RVVFKSAVR

SEQ ID NO: 1039404 - protein, 9 aa, Homo Sapiens
QCVSHGSAV

SEQ ID NO: 1039405 - protein, 9 aa, Homo Sapiens
ANMDNENAT

SEQ ID NO: 1039406 - protein, 9 aa, Homo Sapiens
DGRSQEVGR

SEQ ID NO: 1039407 - protein, 9 aa, Homo Sapiens
GTVCNDSWD

SEQ ID NO: 1039408 - protein, 9 aa, Homo Sapiens
KGSGLKHVP

SEQ ID NO: 1039409 - protein, 9 aa, Homo Sapiens
LAAAKPGTS

SEQ ID NO: 1039410 - protein, 9 aa, Homo Sapiens
ASGIFTPVS

SEQ ID NO: 1039411 - protein, 9 aa, Homo Sapiens
YFPYLKNGY

SEQ ID NO: 1039412 - protein, 9 aa, Homo Sapiens
KNCGIAIPV

SEQ ID NO: 1039413 - protein, 9 aa, Homo Sapiens
LIEKKKDTL

SEQ ID NO: 1039414 - protein, 9 aa, Homo Sapiens
FGSNTFLHL

SEQ ID NO: 1039415 - protein, 9 aa, Homo Sapiens
QGQEKQVQE

SEQ ID NO: 1039416 - protein, 9 aa, Homo Sapiens
QKCEFVQGS

SEQ ID NO: 1039417 - protein, 9 aa, Homo Sapiens
QSDVIYARQ

SEQ ID NO: 1039418 - protein, 9 aa, Homo Sapiens
QVRPFGGHF

SEQ ID NO: 1039419 - protein, 9 aa, Homo Sapiens
QSQAQMYLG

SEQ ID NO: 1039420 - protein, 9 aa, Homo Sapiens
ENVHHQFQK

SEQ ID NO: 1039421 - protein, 9 aa, Homo Sapiens
EECQRQGAI

SEQ ID NO: 1039422 - protein, 9 aa, Homo Sapiens
KNQIKIRNR

SEQ ID NO: 1039423 - protein, 9 aa, Homo Sapiens
IAEVTIWPD

SEQ ID NO: 1039424 - protein, 9 aa, Homo Sapiens
CSGNFKKWV

SEQ ID NO: 1039425 - protein, 9 aa, Homo Sapiens
QAERLARAK

SEQ ID NO: 1039426 - protein, 9 aa, Homo Sapiens
KSLMHLEKF

SEQ ID NO: 1039427 - protein, 9 aa, Homo Sapiens
GGGLFRDDD

SEQ ID NO: 1039428 - protein, 9 aa, Homo Sapiens
EAVRAELEK

SEQ ID NO: 1039429 - protein, 9 aa, Homo Sapiens
LRGWADELC

SEQ ID NO: 1039430 - protein, 9 aa, Homo Sapiens
EYVVPGCQT

SEQ ID NO: 1039431 - protein, 9 aa, Homo Sapiens
LLVQTPPAP

SEQ ID NO: 1039432 - protein, 9 aa, Homo Sapiens
FSCSCLDGF

SEQ ID NO: 1039433 - protein, 9 aa, Homo Sapiens
GPVSTTVAR

SEQ ID NO: 1039434 - protein, 9 aa, Homo Sapiens
GAEAAGHPA

SEQ ID NO: 1039435 - protein, 9 aa, Homo Sapiens
PAACEERRG

SEQ ID NO: 1039436 - protein, 9 aa, Homo Sapiens
KKGQQSQCL

SEQ ID NO: 1039437 - protein, 9 aa, Homo Sapiens
NHEFVDKQV

SEQ ID NO: 1039438 - protein, 9 aa, Homo Sapiens
RQPIFLTKE

SEQ ID NO: 1039439 - protein, 9 aa, Homo Sapiens
IAFAIAIRN

SEQ ID NO: 1039440 - protein, 9 aa, Homo Sapiens
ESPGSEQTL

SEQ ID NO: 1039441 - protein, 9 aa, Homo Sapiens
LESFCDSMV

SEQ ID NO: 1039442 - protein, 9 aa, Homo Sapiens
EFPLVSEKN

SEQ ID NO: 1039443 - protein, 9 aa, Homo Sapiens
TVSRFLMCN

SEQ ID NO: 1039444 - protein, 9 aa, Homo Sapiens
WVGIVIFLV

SEQ ID NO: 1039445 - protein, 9 aa, Homo Sapiens
SPSQPAVAL

SEQ ID NO: 1039446 - protein, 9 aa, Homo Sapiens
HSSNNPQDD

SEQ ID NO: 1039447 - protein, 9 aa, Homo Sapiens
ASAEVRRRV

SEQ ID NO: 1039448 - protein, 9 aa, Homo Sapiens
PFFWQYPEA

SEQ ID NO: 1039449 - protein, 9 aa, Homo Sapiens
EQFCVSRNL

SEQ ID NO: 1039450 - protein, 9 aa, Homo Sapiens
HNALSGSSS

SEQ ID NO: 1039451 - protein, 9 aa, Homo Sapiens
LRIQMLLSE

SEQ ID NO: 1039452 - protein, 9 aa, Homo Sapiens
VKQFLQVHL

SEQ ID NO: 1039453 - protein, 9 aa, Homo Sapiens
IFIVNATNP

SEQ ID NO: 1039454 - protein, 9 aa, Homo Sapiens
FIVNATNPD

SEQ ID NO: 1039455 - protein, 9 aa, Homo Sapiens
LEEILYKLV

SEQ ID NO: 1039456 - protein, 9 aa, Homo Sapiens
LAGPKRERG

SEQ ID NO: 1039457 - protein, 9 aa, Homo Sapiens
VGTEATDTK

SEQ ID NO: 1039458 - protein, 9 aa, Homo Sapiens
DVFSSVPVG

SEQ ID NO: 1039459 - protein, 9 aa, Homo Sapiens
MRTLSKLAR

SEQ ID NO: 1039460 - protein, 9 aa, Homo Sapiens
SCVAISIEL

SEQ ID NO: 1039461 - protein, 9 aa, Homo Sapiens
SIKTSFLAE

SEQ ID NO: 1039462 - protein, 9 aa, Homo Sapiens
DPSVLPYDS

SEQ ID NO: 1039463 - protein, 9 aa, Homo Sapiens
KEINIIKLS

SEQ ID NO: 1039464 - protein, 9 aa, Homo Sapiens
HDEALVLND

SEQ ID NO: 1039465 - protein, 9 aa, Homo Sapiens
RGWADELCT

SEQ ID NO: 1039466 - protein, 9 aa, Homo Sapiens
CKYCSKVFE

SEQ ID NO: 1039467 - protein, 9 aa, Homo Sapiens
VAPTDPMLR

SEQ ID NO: 1039468 - protein, 9 aa, Homo Sapiens
EKFHCIAEV

SEQ ID NO: 1039469 - protein, 9 aa, Homo Sapiens
AMCAWDAWI

SEQ ID NO: 1039470 - protein, 9 aa, Homo Sapiens
KQDICSSEV

SEQ ID NO: 1039471 - protein, 9 aa, Homo Sapiens
NAAGKTTIL

SEQ ID NO: 1039472 - protein, 9 aa, Homo Sapiens
IGPRACCDE

SEQ ID NO: 1039473 - protein, 9 aa, Homo Sapiens
LEFGENEGN

SEQ ID NO: 1039474 - protein, 9 aa, Homo Sapiens
FPEIQLELD

SEQ ID NO: 1039475 - protein, 9 aa, Homo Sapiens
TLLSQNGPV

SEQ ID NO: 1039476 - protein, 9 aa, Homo Sapiens
FSKVLGQLS

SEQ ID NO: 1039477 - protein, 9 aa, Homo Sapiens
SCGKEFSSS

SEQ ID NO: 1039478 - protein, 9 aa, Homo Sapiens
ATDLPKISI

SEQ ID NO: 1039479 - protein, 9 aa, Homo Sapiens
QVMSIEKVE

SEQ ID NO: 1039480 - protein, 9 aa, Homo Sapiens
IDFAHFWNQ

SEQ ID NO: 1039481 - protein, 9 aa, Homo Sapiens
GIVIFLVCL

SEQ ID NO: 1039482 - protein, 9 aa, Homo Sapiens
LSSEVLRKD

SEQ ID NO: 1039483 - protein, 9 aa, Homo Sapiens
AIGTLYFNA

SEQ ID NO: 1039484 - protein, 9 aa, Homo Sapiens
KKEEFMKSK

SEQ ID NO: 1039485 - protein, 9 aa, Homo Sapiens
IEAKRATWK

SEQ ID NO: 1039486 - protein, 9 aa, Homo Sapiens
HRVGYILHK

SEQ ID NO: 1039487 - protein, 9 aa, Homo Sapiens
IVNLDYPVI

SEQ ID NO: 1039488 - protein, 9 aa, Homo Sapiens
ASSKSALYR

SEQ ID NO: 1039489 - protein, 9 aa, Homo Sapiens
LFLEFCTYD

SEQ ID NO: 1039490 - protein, 9 aa, Homo Sapiens
LAHAAPPSP

SEQ ID NO: 1039491 - protein, 9 aa, Homo Sapiens
NSETQSRHR

SEQ ID NO: 1039492 - protein, 9 aa, Homo Sapiens
STTLWEVTV

SEQ ID NO: 1039493 - protein, 9 aa, Homo Sapiens
RLDPAGYFV

SEQ ID NO: 1039494 - protein, 9 aa, Homo Sapiens
STTEVSEGL

SEQ ID NO: 1039495 - protein, 9 aa, Homo Sapiens
LNETATTIA

SEQ ID NO: 1039496 - protein, 9 aa, Homo Sapiens
PHINVYLKE

SEQ ID NO: 1039497 - protein, 9 aa, Homo Sapiens
TVDSVTHTT

SEQ ID NO: 1039498 - protein, 9 aa, Homo Sapiens
KITGSPKHV

SEQ ID NO: 1039499 - protein, 9 aa, Homo Sapiens
AICTKTGAN

SEQ ID NO: 1039500 - protein, 9 aa, Homo Sapiens
NTEVMIKGS

SEQ ID NO: 1039501 - protein, 9 aa, Homo Sapiens
LPGAKGKPA

SEQ ID NO: 1039502 - protein, 9 aa, Homo Sapiens
PMHKNPEWE

SEQ ID NO: 1039503 - protein, 9 aa, Homo Sapiens
LHSFKITWD

SEQ ID NO: 1039504 - protein, 9 aa, Homo Sapiens
CIKCSGIHR

SEQ ID NO: 1039505 - protein, 9 aa, Homo Sapiens
KILFKEQDL

SEQ ID NO: 1039506 - protein, 9 aa, Homo Sapiens
DAKPMPKRS

SEQ ID NO: 1039507 - protein, 9 aa, Homo Sapiens
PGPPVLAGF

SEQ ID NO: 1039508 - protein, 9 aa, Homo Sapiens
KATEQYYTM

SEQ ID NO: 1039509 - protein, 9 aa, Homo Sapiens
SLALGLGQY

SEQ ID NO: 1039510 - protein, 9 aa, Homo Sapiens
FSTNKEFHF

SEQ ID NO: 1039511 - protein, 9 aa, Homo Sapiens
YDSTDLEND

SEQ ID NO: 1039512 - protein, 9 aa, Homo Sapiens
ALDQEEEAE

SEQ ID NO: 1039513 - protein, 9 aa, Homo Sapiens
PTAVSGSAE

SEQ ID NO: 1039514 - protein, 9 aa, Homo Sapiens
APGPPGCSM

SEQ ID NO: 1039515 - protein, 9 aa, Homo Sapiens
LFCNVRASP

SEQ ID NO: 1039516 - protein, 9 aa, Homo Sapiens
PRTMKNQQN

SEQ ID NO: 1039517 - protein, 9 aa, Homo Sapiens
VIKQGDFKR

SEQ ID NO: 1039518 - protein, 9 aa, Homo Sapiens
SSSLSLDQG

SEQ ID NO: 1039519 - protein, 9 aa, Homo Sapiens
WRELSDFES

SEQ ID NO: 1039520 - protein, 9 aa, Homo Sapiens
RGEVWGKSP

SEQ ID NO: 1039521 - protein, 9 aa, Homo Sapiens
YQGIAETPG

SEQ ID NO: 1039522 - protein, 9 aa, Homo Sapiens
LVIPKKNSH

SEQ ID NO: 1039523 - protein, 9 aa, Homo Sapiens
QEMILKMQE

SEQ ID NO: 1039524 - protein, 9 aa, Homo Sapiens
GLLLFSYAV

SEQ ID NO: 1039525 - protein, 9 aa, Homo Sapiens
IEKLKDNLS

SEQ ID NO: 1039526 - protein, 9 aa, Homo Sapiens
SDFESPKAG

SEQ ID NO: 1039527 - protein, 9 aa, Homo Sapiens
STDTSWQES

SEQ ID NO: 1039528 - protein, 9 aa, Homo Sapiens
VDYLSETIT

SEQ ID NO: 1039529 - protein, 9 aa, Homo Sapiens
EGERPLPEN

SEQ ID NO: 1039530 - protein, 9 aa, Homo Sapiens
VSGSAEVQG

SEQ ID NO: 1039531 - protein, 9 aa, Homo Sapiens
FFAPGLPCE

SEQ ID NO: 1039532 - protein, 9 aa, Homo Sapiens
GIPMVGILL

SEQ ID NO: 1039533 - protein, 9 aa, Homo Sapiens
LSTECDFHP

SEQ ID NO: 1039534 - protein, 9 aa, Homo Sapiens
LQNSGDPPL

SEQ ID NO: 1039535 - protein, 9 aa, Homo Sapiens
KIRNREIEI

SEQ ID NO: 1039536 - protein, 9 aa, Homo Sapiens
IHCGQLEKL

SEQ ID NO: 1039537 - protein, 9 aa, Homo Sapiens
RIQMLLSEL

SEQ ID NO: 1039538 - protein, 9 aa, Homo Sapiens
EKLEALFAK

SEQ ID NO: 1039539 - protein, 9 aa, Homo Sapiens
MVKSLMHLE

SEQ ID NO: 1039540 - protein, 9 aa, Homo Sapiens
TFSIFQGKI

SEQ ID NO: 1039541 - protein, 9 aa, Homo Sapiens
AVMSLDCYL

SEQ ID NO: 1039542 - protein, 9 aa, Homo Sapiens
TTYRTFIFP

SEQ ID NO: 1039543 - protein, 9 aa, Homo Sapiens
GIFCNGTFN

SEQ ID NO: 1039544 - protein, 9 aa, Homo Sapiens
ELVKEEGFA

SEQ ID NO: 1039545 - protein, 9 aa, Homo Sapiens
AQPEGELML

SEQ ID NO: 1039546 - protein, 9 aa, Homo Sapiens
ARTARRSTA

SEQ ID NO: 1039547 - protein, 9 aa, Homo Sapiens
AVISKEEQE

SEQ ID NO: 1039548 - protein, 9 aa, Homo Sapiens
HKLRHRRHH

SEQ ID NO: 1039549 - protein, 9 aa, Homo Sapiens
PLPEDCTEK

SEQ ID NO: 1039550 - protein, 9 aa, Homo Sapiens
GGPASLQPV

SEQ ID NO: 1039551 - protein, 9 aa, Homo Sapiens
YEANVSQLA

SEQ ID NO: 1039552 - protein, 9 aa, Homo Sapiens
SGSAEVQGM

SEQ ID NO: 1039553 - protein, 9 aa, Homo Sapiens
QYIRPMQKK

SEQ ID NO: 1039554 - protein, 9 aa, Homo Sapiens
PSSPARKNE

SEQ ID NO: 1039555 - protein, 9 aa, Homo Sapiens
RKATSNNFT

SEQ ID NO: 1039556 - protein, 9 aa, Homo Sapiens
NAEKNFHNI

SEQ ID NO: 1039557 - protein, 9 aa, Homo Sapiens
QTLRFNPIM

SEQ ID NO: 1039558 - protein, 9 aa, Homo Sapiens
SQRRLYPPL

SEQ ID NO: 1039559 - protein, 9 aa, Homo Sapiens
RALFRMDKE

SEQ ID NO: 1039560 - protein, 9 aa, Homo Sapiens
DRVGGEKGP

SEQ ID NO: 1039561 - protein, 9 aa, Homo Sapiens
PMSLLSLLD

SEQ ID NO: 1039562 - protein, 9 aa, Homo Sapiens
SKPRQSPLT

SEQ ID NO: 1039563 - protein, 9 aa, Homo Sapiens
VLTRLEKFQ

SEQ ID NO: 1039564 - protein, 9 aa, Homo Sapiens
PEAGDNAAE

SEQ ID NO: 1039565 - protein, 9 aa, Homo Sapiens
ADARLPPAL

SEQ ID NO: 1039566 - protein, 9 aa, Homo Sapiens
GVVREVILK

SEQ ID NO: 1039567 - protein, 9 aa, Homo Sapiens
EFTLQQPYD

SEQ ID NO: 1039568 - protein, 9 aa, Homo Sapiens
RRIATGSFF

SEQ ID NO: 1039569 - protein, 9 aa, Homo Sapiens
LKQYSREEE

SEQ ID NO: 1039570 - protein, 9 aa, Homo Sapiens
NQSQGPPPC

SEQ ID NO: 1039571 - protein, 9 aa, Homo Sapiens
GQPNKALKF

SEQ ID NO: 1039572 - protein, 9 aa, Homo Sapiens
GHSSSGLRK

SEQ ID NO: 1039573 - protein, 9 aa, Homo Sapiens
HLAKGQQML

SEQ ID NO: 1039574 - protein, 9 aa, Homo Sapiens
LFFVLFKSL

SEQ ID NO: 1039575 - protein, 9 aa, Homo Sapiens
RALNRTNNS

SEQ ID NO: 1039576 - protein, 9 aa, Homo Sapiens
KVLNTLESR

SEQ ID NO: 1039577 - protein, 9 aa, Homo Sapiens
TDLENDEDG

SEQ ID NO: 1039578 - protein, 9 aa, Homo Sapiens
PHQHNRTTK

SEQ ID NO: 1039579 - protein, 9 aa, Homo Sapiens
MDFLASLVL

SEQ ID NO: 1039580 - protein, 9 aa, Homo Sapiens
LMKERNVFC

SEQ ID NO: 1039581 - protein, 9 aa, Homo Sapiens
VSVQFRQVE

SEQ ID NO: 1039582 - protein, 9 aa, Homo Sapiens
AQAAVENVL

SEQ ID NO: 1039583 - protein, 9 aa, Homo Sapiens
VTIWPDRKI

SEQ ID NO: 1039584 - protein, 9 aa, Homo Sapiens
VFHFTPRLS

SEQ ID NO: 1039585 - protein, 9 aa, Homo Sapiens
GLLTGHKGH

SEQ ID NO: 1039586 - protein, 9 aa, Homo Sapiens
PLSDQLGCE

SEQ ID NO: 1039587 - protein, 9 aa, Homo Sapiens
FFLDSPGYS

SEQ ID NO: 1039588 - protein, 9 aa, Homo Sapiens
FSSPRDFNP

SEQ ID NO: 1039589 - protein, 9 aa, Homo Sapiens
GGAEHSVAA

SEQ ID NO: 1039590 - protein, 9 aa, Homo Sapiens
VQTLIVPPD

SEQ ID NO: 1039591 - protein, 9 aa, Homo Sapiens
METSVSPLH

SEQ ID NO: 1039592 - protein, 9 aa, Homo Sapiens
MSSHIKKTE

SEQ ID NO: 1039593 - protein, 9 aa, Homo Sapiens
SVSGIGLVN

SEQ ID NO: 1039594 - protein, 9 aa, Homo Sapiens
RICLSSGSL

SEQ ID NO: 1039595 - protein, 9 aa, Homo Sapiens
RGLGQYRAA

SEQ ID NO: 1039596 - protein, 9 aa, Homo Sapiens
SRVLQAFLD

SEQ ID NO: 1039597 - protein, 9 aa, Homo Sapiens
LIYHSPGHT

SEQ ID NO: 1039598 - protein, 9 aa, Homo Sapiens
LIICKPVTV

SEQ ID NO: 1039599 - protein, 9 aa, Homo Sapiens
NEKAVIFIR

SEQ ID NO: 1039600 - protein, 9 aa, Homo Sapiens
KEEKVKGLQ

SEQ ID NO: 1039601 - protein, 9 aa, Homo Sapiens
PFISPDAAS

SEQ ID NO: 1039602 - protein, 9 aa, Homo Sapiens
FRAKSLWRP

SEQ ID NO: 1039603 - protein, 9 aa, Homo Sapiens
YLGPQLGNL

SEQ ID NO: 1039604 - protein, 9 aa, Homo Sapiens
LPSSHVARP

SEQ ID NO: 1039605 - protein, 9 aa, Homo Sapiens
FCDFLSLLI

SEQ ID NO: 1039606 - protein, 9 aa, Homo Sapiens
EQNIEFIRD

SEQ ID NO: 1039607 - protein, 9 aa, Homo Sapiens
LLVVMSYDC

SEQ ID NO: 1039608 - protein, 9 aa, Homo Sapiens
RRVTFEDVT

SEQ ID NO: 1039609 - protein, 9 aa, Homo Sapiens
PTEPKGISG

SEQ ID NO: 1039610 - protein, 9 aa, Homo Sapiens
KKKEEFMKS

SEQ ID NO: 1039611 - protein, 9 aa, Homo Sapiens
ERCPVKTCA

SEQ ID NO: 1039612 - protein, 9 aa, Homo Sapiens
EGFYDESTQ

SEQ ID NO: 1039613 - protein, 9 aa, Homo Sapiens
APLPEDCTE

SEQ ID NO: 1039614 - protein, 9 aa, Homo Sapiens
LFFQATDPV

SEQ ID NO: 1039615 - protein, 9 aa, Homo Sapiens
VKSDRVSIK

SEQ ID NO: 1039616 - protein, 9 aa, Homo Sapiens
KKRADFVAN

SEQ ID NO: 1039617 - protein, 9 aa, Homo Sapiens
HCHSECVAD

SEQ ID NO: 1039618 - protein, 9 aa, Homo Sapiens
VSWGDFEYD

SEQ ID NO: 1039619 - protein, 9 aa, Homo Sapiens
LIKAAQNED

SEQ ID NO: 1039620 - protein, 9 aa, Homo Sapiens
YGPSNGPSY

SEQ ID NO: 1039621 - protein, 9 aa, Homo Sapiens
RVCIAETWL

SEQ ID NO: 1039622 - protein, 9 aa, Homo Sapiens
KKNRASPAV

SEQ ID NO: 1039623 - protein, 9 aa, Homo Sapiens
PVLESKDSP

SEQ ID NO: 1039624 - protein, 9 aa, Homo Sapiens
PKQKKGKEK

SEQ ID NO: 1039625 - protein, 9 aa, Homo Sapiens
EELVARLET

SEQ ID NO: 1039626 - protein, 9 aa, Homo Sapiens
FAPGLPCES

SEQ ID NO: 1039627 - protein, 9 aa, Homo Sapiens
FLNSLVYGA

SEQ ID NO: 1039628 - protein, 9 aa, Homo Sapiens
VATLERPMY

SEQ ID NO: 1039629 - protein, 9 aa, Homo Sapiens
QKVEVTNMI

SEQ ID NO: 1039630 - protein, 9 aa, Homo Sapiens
ENFSGRTRS

SEQ ID NO: 1039631 - protein, 9 aa, Homo Sapiens
FAYLENFSG

SEQ ID NO: 1039632 - protein, 9 aa, Homo Sapiens
TRDCLSQNS

SEQ ID NO: 1039633 - protein, 9 aa, Homo Sapiens
GPGALAAAK

SEQ ID NO: 1039634 - protein, 9 aa, Homo Sapiens
FRHRAILDT

SEQ ID NO: 1039635 - protein, 9 aa, Homo Sapiens
LFHPGGFLE

SEQ ID NO: 1039636 - protein, 9 aa, Homo Sapiens
EGSRGRAEG

SEQ ID NO: 1039637 - protein, 9 aa, Homo Sapiens
ELTACMNVA

SEQ ID NO: 1039638 - protein, 9 aa, Homo Sapiens
DRSGADKLE

SEQ ID NO: 1039639 - protein, 9 aa, Homo Sapiens
SHSRKKLLN

SEQ ID NO: 1039640 - protein, 9 aa, Homo Sapiens
EREDPPIWK

SEQ ID NO: 1039641 - protein, 9 aa, Homo Sapiens
VFVKKKHYL

SEQ ID NO: 1039642 - protein, 9 aa, Homo Sapiens
MKQCVESSL

SEQ ID NO: 1039643 - protein, 9 aa, Homo Sapiens
AGPKRERGV

SEQ ID NO: 1039644 - protein, 9 aa, Homo Sapiens
LVDESGGFP

SEQ ID NO: 1039645 - protein, 9 aa, Homo Sapiens
LRTKIKVTL

SEQ ID NO: 1039646 - protein, 9 aa, Homo Sapiens
FQCVSPECL

SEQ ID NO: 1039647 - protein, 9 aa, Homo Sapiens
EFLVLIFSS

SEQ ID NO: 1039648 - protein, 9 aa, Homo Sapiens
KILKLREEE

SEQ ID NO: 1039649 - protein, 9 aa, Homo Sapiens
KYLDFSVYK

SEQ ID NO: 1039650 - protein, 9 aa, Homo Sapiens
AEHDSELLF

SEQ ID NO: 1039651 - protein, 9 aa, Homo Sapiens
VLAGFPGAK

SEQ ID NO: 1039652 - protein, 9 aa, Homo Sapiens
KGSLKMVRK

SEQ ID NO: 1039653 - protein, 9 aa, Homo Sapiens
KIWFQNRRI

SEQ ID NO: 1039654 - protein, 9 aa, Homo Sapiens
KTLEEILYK

SEQ ID NO: 1039655 - protein, 9 aa, Homo Sapiens
VPSLPSRNI

SEQ ID NO: 1039656 - protein, 9 aa, Homo Sapiens
KKKHYLTAF

SEQ ID NO: 1039657 - protein, 9 aa, Homo Sapiens
FEIILGPLS

SEQ ID NO: 1039658 - protein, 9 aa, Homo Sapiens
NFYQPGPDY

SEQ ID NO: 1039659 - protein, 9 aa, Homo Sapiens
VSHCGANAN

SEQ ID NO: 1039660 - protein, 9 aa, Homo Sapiens
KADYRKDLG

SEQ ID NO: 1039661 - protein, 9 aa, Homo Sapiens
TFWSAFRTS

SEQ ID NO: 1039662 - protein, 9 aa, Homo Sapiens
LELDDWLVE

SEQ ID NO: 1039663 - protein, 9 aa, Homo Sapiens
WVVKGPKGE

SEQ ID NO: 1039664 - protein, 9 aa, Homo Sapiens
VSEIALTSL

SEQ ID NO: 1039665 - protein, 9 aa, Homo Sapiens
LVLERFLDY

SEQ ID NO: 1039666 - protein, 9 aa, Homo Sapiens
FNHLYNTND

SEQ ID NO: 1039667 - protein, 9 aa, Homo Sapiens
VFEPVLEGD

SEQ ID NO: 1039668 - protein, 9 aa, Homo Sapiens
SEKGGNCGL

SEQ ID NO: 1039669 - protein, 9 aa, Homo Sapiens
PKSKLSVKV

SEQ ID NO: 1039670 - protein, 9 aa, Homo Sapiens
DTMTNRLLD

SEQ ID NO: 1039671 - protein, 9 aa, Homo Sapiens
TLFMTAPEG

SEQ ID NO: 1039672 - protein, 9 aa, Homo Sapiens
TFGGFVTPI

SEQ ID NO: 1039673 - protein, 9 aa, Homo Sapiens
PSLKSRSFS

SEQ ID NO: 1039674 - protein, 9 aa, Homo Sapiens
QFVGVSSGK

SEQ ID NO: 1039675 - protein, 9 aa, Homo Sapiens
SGPVSTTVA

SEQ ID NO: 1039676 - protein, 9 aa, Homo Sapiens
QPTSFLPRF

SEQ ID NO: 1039677 - protein, 9 aa, Homo Sapiens
MSTGGGGYV

SEQ ID NO: 1039678 - protein, 9 aa, Homo Sapiens
KYCSKVFET

SEQ ID NO: 1039679 - protein, 9 aa, Homo Sapiens
LKIPSAAEK

SEQ ID NO: 1039680 - protein, 9 aa, Homo Sapiens
ETQKKLPSP

SEQ ID NO: 1039681 - protein, 9 aa, Homo Sapiens
QIRYSLGGT

SEQ ID NO: 1039682 - protein, 9 aa, Homo Sapiens
LQVPGAFAA

SEQ ID NO: 1039683 - protein, 9 aa, Homo Sapiens
LLGCATQKD

SEQ ID NO: 1039684 - protein, 9 aa, Homo Sapiens
LFGGKLSLE

SEQ ID NO: 1039685 - protein, 9 aa, Homo Sapiens
VVVQASCEM

SEQ ID NO: 1039686 - protein, 9 aa, Homo Sapiens
LYYNVIFGW

SEQ ID NO: 1039687 - protein, 9 aa, Homo Sapiens
HLAPEYTGQ

SEQ ID NO: 1039688 - protein, 9 aa, Homo Sapiens
IYEKKFEHK

SEQ ID NO: 1039689 - protein, 9 aa, Homo Sapiens
PKLSDDRRY

SEQ ID NO: 1039690 - protein, 9 aa, Homo Sapiens
SPKAGEDGF

SEQ ID NO: 1039691 - protein, 9 aa, Homo Sapiens
ASKEQVCLH

SEQ ID NO: 1039692 - protein, 9 aa, Homo Sapiens
RIHTDEKLF

SEQ ID NO: 1039693 - protein, 9 aa, Homo Sapiens
SFNLSSNKL

SEQ ID NO: 1039694 - protein, 9 aa, Homo Sapiens
CPAMEPTNG

SEQ ID NO: 1039695 - protein, 9 aa, Homo Sapiens
RRIGISLFR

SEQ ID NO: 1039696 - protein, 9 aa, Homo Sapiens
IPGPGEAPS

SEQ ID NO: 1039697 - protein, 9 aa, Homo Sapiens
PFRPLPPIL

SEQ ID NO: 1039698 - protein, 9 aa, Homo Sapiens
KNVVDLKLH

SEQ ID NO: 1039699 - protein, 9 aa, Homo Sapiens
EVENFLLVL

SEQ ID NO: 1039700 - protein, 9 aa, Homo Sapiens
CDSCGKEFS

SEQ ID NO: 1039701 - protein, 9 aa, Homo Sapiens
RRSGYGPSN

SEQ ID NO: 1039702 - protein, 9 aa, Homo Sapiens
KKNREFFND

SEQ ID NO: 1039703 - protein, 9 aa, Homo Sapiens
RDPILAAHS

SEQ ID NO: 1039704 - protein, 9 aa, Homo Sapiens
MGKKGEMGD

SEQ ID NO: 1039705 - protein, 9 aa, Homo Sapiens
LQAMSSSVK

SEQ ID NO: 1039706 - protein, 9 aa, Homo Sapiens
NLVGTVANL

SEQ ID NO: 1039707 - protein, 9 aa, Homo Sapiens
EKVIGAGEF

SEQ ID NO: 1039708 - protein, 9 aa, Homo Sapiens
INSLYVYHN

SEQ ID NO: 1039709 - protein, 9 aa, Homo Sapiens
PDQSDVIYA

SEQ ID NO: 1039710 - protein, 9 aa, Homo Sapiens
PKVHKKCYL

SEQ ID NO: 1039711 - protein, 9 aa, Homo Sapiens
GNIHATKRL

SEQ ID NO: 1039712 - protein, 9 aa, Homo Sapiens
LTGVKIELL

SEQ ID NO: 1039713 - protein, 9 aa, Homo Sapiens
VFYNCSCVK

SEQ ID NO: 1039714 - protein, 9 aa, Homo Sapiens
SPCCRPLCG

SEQ ID NO: 1039715 - protein, 9 aa, Homo Sapiens
AKNGALGSP

SEQ ID NO: 1039716 - protein, 9 aa, Homo Sapiens
LLIKAAQNE

SEQ ID NO: 1039717 - protein, 9 aa, Homo Sapiens
FLTFVLGTE

SEQ ID NO: 1039718 - protein, 9 aa, Homo Sapiens
PQDDIATEA

SEQ ID NO: 1039719 - protein, 9 aa, Homo Sapiens
KSILIRGPQ

SEQ ID NO: 1039720 - protein, 9 aa, Homo Sapiens
GSGIPCAQL

SEQ ID NO: 1039721 - protein, 9 aa, Homo Sapiens
GRGGQREED

SEQ ID NO: 1039722 - protein, 9 aa, Homo Sapiens
EVAKNCGIA

SEQ ID NO: 1039723 - protein, 9 aa, Homo Sapiens
WLLGAARGL

SEQ ID NO: 1039724 - protein, 9 aa, Homo Sapiens
QQVLMKERN

SEQ ID NO: 1039725 - protein, 9 aa, Homo Sapiens
LKIEDTVSF

SEQ ID NO: 1039726 - protein, 9 aa, Homo Sapiens
QLLSPSQGQ

SEQ ID NO: 1039727 - protein, 9 aa, Homo Sapiens
DQSVWVVKG

SEQ ID NO: 1039728 - protein, 9 aa, Homo Sapiens
AEVQLQLQA

SEQ ID NO: 1039729 - protein, 9 aa, Homo Sapiens
LRQIKDTMT

SEQ ID NO: 1039730 - protein, 9 aa, Homo Sapiens
EKVERILDE

SEQ ID NO: 1039731 - protein, 9 aa, Homo Sapiens
LRNKNVKAA

SEQ ID NO: 1039732 - protein, 9 aa, Homo Sapiens
LQRNLLERR

SEQ ID NO: 1039733 - protein, 9 aa, Homo Sapiens
LPQECSTFS

SEQ ID NO: 1039734 - protein, 9 aa, Homo Sapiens
PIRIWMLND

SEQ ID NO: 1039735 - protein, 9 aa, Homo Sapiens
NGMETPMHK

SEQ ID NO: 1039736 - protein, 9 aa, Homo Sapiens
KMTIWVDPF

SEQ ID NO: 1039737 - protein, 9 aa, Homo Sapiens
LSTHQTYLV

SEQ ID NO: 1039738 - protein, 9 aa, Homo Sapiens
DPKAISVIH

SEQ ID NO: 1039739 - protein, 9 aa, Homo Sapiens
TMGDRLTDE

SEQ ID NO: 1039740 - protein, 9 aa, Homo Sapiens
ENREHNSDS

SEQ ID NO: 1039741 - protein, 9 aa, Homo Sapiens
GQHWLLGAA

SEQ ID NO: 1039742 - protein, 9 aa, Homo Sapiens
GEPFFWQYP

SEQ ID NO: 1039743 - protein, 9 aa, Homo Sapiens
RSRRCALPA

SEQ ID NO: 1039744 - protein, 9 aa, Homo Sapiens
RFSFFQRSR

SEQ ID NO: 1039745 - protein, 9 aa, Homo Sapiens
GDDLKFVIP

SEQ ID NO: 1039746 - protein, 9 aa, Homo Sapiens
LGTAMAGFL

SEQ ID NO: 1039747 - protein, 9 aa, Homo Sapiens
DKSNDLLYQ

SEQ ID NO: 1039748 - protein, 9 aa, Homo Sapiens
KVDGPELKF

SEQ ID NO: 1039749 - protein, 9 aa, Homo Sapiens
DIYEKKFEH

SEQ ID NO: 1039750 - protein, 9 aa, Homo Sapiens
ESVREGHPD

SEQ ID NO: 1039751 - protein, 9 aa, Homo Sapiens
SALILGGSG

SEQ ID NO: 1039752 - protein, 9 aa, Homo Sapiens
VLRNHNQIP

SEQ ID NO: 1039753 - protein, 9 aa, Homo Sapiens
GQQMLAGDG

SEQ ID NO: 1039754 - protein, 9 aa, Homo Sapiens
GVFNNQENK

SEQ ID NO: 1039755 - protein, 9 aa, Homo Sapiens
SVTHTTVTM

SEQ ID NO: 1039756 - protein, 9 aa, Homo Sapiens
LMCIKCSGI

SEQ ID NO: 1039757 - protein, 9 aa, Homo Sapiens
LERDPILAA

SEQ ID NO: 1039758 - protein, 9 aa, Homo Sapiens
PKTQGEGKK

SEQ ID NO: 1039759 - protein, 9 aa, Homo Sapiens
SKLSVKVPL

SEQ ID NO: 1039760 - protein, 9 aa, Homo Sapiens
GVSHYATNS

SEQ ID NO: 1039761 - protein, 9 aa, Homo Sapiens
ATHLESDYQ

SEQ ID NO: 1039762 - protein, 9 aa, Homo Sapiens
GKFYHFVKK

SEQ ID NO: 1039763 - protein, 9 aa, Homo Sapiens
ENSSSLSLD

SEQ ID NO: 1039764 - protein, 9 aa, Homo Sapiens
TPQNAIFLK

SEQ ID NO: 1039765 - protein, 9 aa, Homo Sapiens
MAETERNDK

SEQ ID NO: 1039766 - protein, 9 aa, Homo Sapiens
VTASSLANS

SEQ ID NO: 1039767 - protein, 9 aa, Homo Sapiens
MWISTTTTP

SEQ ID NO: 1039768 - protein, 9 aa, Homo Sapiens
EPERTPALH

SEQ ID NO: 1039769 - protein, 9 aa, Homo Sapiens
ALTIPSHPY

SEQ ID NO: 1039770 - protein, 9 aa, Homo Sapiens
IHALSEGWS

SEQ ID NO: 1039771 - protein, 9 aa, Homo Sapiens
GKQKAFYTC

SEQ ID NO: 1039772 - protein, 9 aa, Homo Sapiens
RSLVGLEGT

SEQ ID NO: 1039773 - protein, 9 aa, Homo Sapiens
ETSLATESN

SEQ ID NO: 1039774 - protein, 9 aa, Homo Sapiens
LTGHWRTSE

SEQ ID NO: 1039775 - protein, 9 aa, Homo Sapiens
AGSWGVFPE

SEQ ID NO: 1039776 - protein, 9 aa, Homo Sapiens
ELEQLDLGK

SEQ ID NO: 1039777 - protein, 9 aa, Homo Sapiens
PGALAAAKP

SEQ ID NO: 1039778 - protein, 9 aa, Homo Sapiens
APSLFGGLQ

SEQ ID NO: 1039779 - protein, 9 aa, Homo Sapiens
TRELAFATK

SEQ ID NO: 1039780 - protein, 9 aa, Homo Sapiens
LLIVFRKKV

SEQ ID NO: 1039781 - protein, 9 aa, Homo Sapiens
RSGWMSVCR

SEQ ID NO: 1039782 - protein, 9 aa, Homo Sapiens
VRSRGSGGN

SEQ ID NO: 1039783 - protein, 9 aa, Homo Sapiens
TWIDKGLKY

SEQ ID NO: 1039784 - protein, 9 aa, Homo Sapiens
IKEGERPLP

SEQ ID NO: 1039785 - protein, 9 aa, Homo Sapiens
GEKGPGGSY

SEQ ID NO: 1039786 - protein, 9 aa, Homo Sapiens
YKYFISLKR

SEQ ID NO: 1039787 - protein, 9 aa, Homo Sapiens
TLAYALSAI

SEQ ID NO: 1039788 - protein, 9 aa, Homo Sapiens
ELTQPLDLK

SEQ ID NO: 1039789 - protein, 9 aa, Homo Sapiens
APQGMPGLG

SEQ ID NO: 1039790 - protein, 9 aa, Homo Sapiens
LIFSNPVCL

SEQ ID NO: 1039791 - protein, 9 aa, Homo Sapiens
LQETSVFIS

SEQ ID NO: 1039792 - protein, 9 aa, Homo Sapiens
NINSSLQIS

SEQ ID NO: 1039793 - protein, 9 aa, Homo Sapiens
TGEAKQQFS

SEQ ID NO: 1039794 - protein, 9 aa, Homo Sapiens
QDFQCKKTG

SEQ ID NO: 1039795 - protein, 9 aa, Homo Sapiens
HRVQMFVSN

SEQ ID NO: 1039796 - protein, 9 aa, Homo Sapiens
PSLFTLRAL

SEQ ID NO: 1039797 - protein, 9 aa, Homo Sapiens
VSLHRDCSK

SEQ ID NO: 1039798 - protein, 9 aa, Homo Sapiens
GQYRAAPVG

SEQ ID NO: 1039799 - protein, 9 aa, Homo Sapiens
SVSLFCRPV

SEQ ID NO: 1039800 - protein, 9 aa, Homo Sapiens
TVSSTDGED

SEQ ID NO: 1039801 - protein, 9 aa, Homo Sapiens
TEIELSGNR

SEQ ID NO: 1039802 - protein, 9 aa, Homo Sapiens
EGNCFSEWD

SEQ ID NO: 1039803 - protein, 9 aa, Homo Sapiens
TESWPGHVA

SEQ ID NO: 1039804 - protein, 9 aa, Homo Sapiens
GILTPEFCQ

SEQ ID NO: 1039805 - protein, 9 aa, Homo Sapiens
FQYSCRQFS

SEQ ID NO: 1039806 - protein, 9 aa, Homo Sapiens
FQVEKNQCL

SEQ ID NO: 1039807 - protein, 9 aa, Homo Sapiens
YGVVREVIL

SEQ ID NO: 1039808 - protein, 9 aa, Homo Sapiens
GGGMNVEIL

SEQ ID NO: 1039809 - protein, 9 aa, Homo Sapiens
CIKPVLCLQ

SEQ ID NO: 1039810 - protein, 9 aa, Homo Sapiens
LRFPIKSSL

SEQ ID NO: 1039811 - protein, 9 aa, Homo Sapiens
FLQKPMSLL

SEQ ID NO: 1039812 - protein, 9 aa, Homo Sapiens
TREGKTSEL

SEQ ID NO: 1039813 - protein, 9 aa, Homo Sapiens
FDLVCAFIR

SEQ ID NO: 1039814 - protein, 9 aa, Homo Sapiens
NITLERPFN

SEQ ID NO: 1039815 - protein, 9 aa, Homo Sapiens
ISHKIEEPK

SEQ ID NO: 1039816 - protein, 9 aa, Homo Sapiens
HQKIYTEEN

SEQ ID NO: 1039817 - protein, 9 aa, Homo Sapiens
IVLLSVYMC

SEQ ID NO: 1039818 - protein, 9 aa, Homo Sapiens
FIIQVTFFL

SEQ ID NO: 1039819 - protein, 9 aa, Homo Sapiens
LLFSYAVGF

SEQ ID NO: 1039820 - protein, 9 aa, Homo Sapiens
SQLPQHLQP

SEQ ID NO: 1039821 - protein, 9 aa, Homo Sapiens
GGKPLKPVS

SEQ ID NO: 1039822 - protein, 9 aa, Homo Sapiens
VPWTQKKFD

SEQ ID NO: 1039823 - protein, 9 aa, Homo Sapiens
MKKLTTLFR

SEQ ID NO: 1039824 - protein, 9 aa, Homo Sapiens
YRAYAVMCL

SEQ ID NO: 1039825 - protein, 9 aa, Homo Sapiens
PQELAGEGS

SEQ ID NO: 1039826 - protein, 9 aa, Homo Sapiens
TLRNNILFG

SEQ ID NO: 1039827 - protein, 9 aa, Homo Sapiens
LLSVYMCYE

SEQ ID NO: 1039828 - protein, 9 aa, Homo Sapiens
QFGGIHFVN

SEQ ID NO: 1039829 - protein, 9 aa, Homo Sapiens
GGLLQPKRQ

SEQ ID NO: 1039830 - protein, 9 aa, Homo Sapiens
RNKIIDHIS

SEQ ID NO: 1039831 - protein, 9 aa, Homo Sapiens
TFSVKQPWD

SEQ ID NO: 1039832 - protein, 9 aa, Homo Sapiens
LLFQYRYAY

SEQ ID NO: 1039833 - protein, 9 aa, Homo Sapiens
VEANDNPPA

SEQ ID NO: 1039834 - protein, 9 aa, Homo Sapiens
VKRFSFFQR

SEQ ID NO: 1039835 - protein, 9 aa, Homo Sapiens
KQQMKKGGD

SEQ ID NO: 1039836 - protein, 9 aa, Homo Sapiens
ALNRTNNSP

SEQ ID NO: 1039837 - protein, 9 aa, Homo Sapiens
SSLPFKEAL

SEQ ID NO: 1039838 - protein, 9 aa, Homo Sapiens
LVMLFFGAC

SEQ ID NO: 1039839 - protein, 9 aa, Homo Sapiens
AAFSGFTAL

SEQ ID NO: 1039840 - protein, 9 aa, Homo Sapiens
CNISDLSLI

SEQ ID NO: 1039841 - protein, 9 aa, Homo Sapiens
EAQREALGL

SEQ ID NO: 1039842 - protein, 9 aa, Homo Sapiens
GEKKVPHFK

SEQ ID NO: 1039843 - protein, 9 aa, Homo Sapiens
TIPSHPYGI

SEQ ID NO: 1039844 - protein, 9 aa, Homo Sapiens
PCHGNCNPT

SEQ ID NO: 1039845 - protein, 9 aa, Homo Sapiens
DNIKYRDNT

SEQ ID NO: 1039846 - protein, 9 aa, Homo Sapiens
GYVQLLKQA

SEQ ID NO: 1039847 - protein, 9 aa, Homo Sapiens
VLQAFLDPS

SEQ ID NO: 1039848 - protein, 9 aa, Homo Sapiens
DSIKKMFGK

SEQ ID NO: 1039849 - protein, 9 aa, Homo Sapiens
TEKVKKMFP

SEQ ID NO: 1039850 - protein, 9 aa, Homo Sapiens
QGGVPPRDL

SEQ ID NO: 1039851 - protein, 9 aa, Homo Sapiens
STGLFPQAA

SEQ ID NO: 1039852 - protein, 9 aa, Homo Sapiens
QLKQAEKLR

SEQ ID NO: 1039853 - protein, 9 aa, Homo Sapiens
PLPPILFPR

SEQ ID NO: 1039854 - protein, 9 aa, Homo Sapiens
NEVVFDVVS

SEQ ID NO: 1039855 - protein, 9 aa, Homo Sapiens
SHSQKFSKC

SEQ ID NO: 1039856 - protein, 9 aa, Homo Sapiens
RSAQAACDW

SEQ ID NO: 1039857 - protein, 9 aa, Homo Sapiens
IRVPPTLEA

SEQ ID NO: 1039858 - protein, 9 aa, Homo Sapiens
LLIRKLPYQ

SEQ ID NO: 1039859 - protein, 9 aa, Homo Sapiens
VARNHQTYS

SEQ ID NO: 1039860 - protein, 9 aa, Homo Sapiens
LILLFYTRI

SEQ ID NO: 1039861 - protein, 9 aa, Homo Sapiens
ESGAFFLDS

SEQ ID NO: 1039862 - protein, 9 aa, Homo Sapiens
QYTLLSQNG

SEQ ID NO: 1039863 - protein, 9 aa, Homo Sapiens
LCLYESRFS

SEQ ID NO: 1039864 - protein, 9 aa, Homo Sapiens
SGNTFKYSQ

SEQ ID NO: 1039865 - protein, 9 aa, Homo Sapiens
LPAAADHSR

SEQ ID NO: 1039866 - protein, 9 aa, Homo Sapiens
PGESRPKGE

SEQ ID NO: 1039867 - protein, 9 aa, Homo Sapiens
LSKKESSNQ

SEQ ID NO: 1039868 - protein, 9 aa, Homo Sapiens
GRCSFSIQM

SEQ ID NO: 1039869 - protein, 9 aa, Homo Sapiens
AKTFYDSSS

SEQ ID NO: 1039870 - protein, 9 aa, Homo Sapiens
SRTEILSLK

SEQ ID NO: 1039871 - protein, 9 aa, Homo Sapiens
TVGMGKARR

SEQ ID NO: 1039872 - protein, 9 aa, Homo Sapiens
TYSGITDDN

SEQ ID NO: 1039873 - protein, 9 aa, Homo Sapiens
VVQASCEMQ

SEQ ID NO: 1039874 - protein, 9 aa, Homo Sapiens
GQQLMEAAE

SEQ ID NO: 1039875 - protein, 9 aa, Homo Sapiens
ESYVDKQMG

SEQ ID NO: 1039876 - protein, 9 aa, Homo Sapiens
LKSHIKTKI

SEQ ID NO: 1039877 - protein, 9 aa, Homo Sapiens
MLITEKKHF

SEQ ID NO: 1039878 - protein, 9 aa, Homo Sapiens
TGERKQNLD

SEQ ID NO: 1039879 - protein, 9 aa, Homo Sapiens
SGGWAKFTA

SEQ ID NO: 1039880 - protein, 9 aa, Homo Sapiens
NGSITQISI

SEQ ID NO: 1039881 - protein, 9 aa, Homo Sapiens
FVLYLLQNG

SEQ ID NO: 1039882 - protein, 9 aa, Homo Sapiens
ITSIFHTFS

SEQ ID NO: 1039883 - protein, 9 aa, Homo Sapiens
RQFGSNTFL

SEQ ID NO: 1039884 - protein, 9 aa, Homo Sapiens
QELAGEGSD

SEQ ID NO: 1039885 - protein, 9 aa, Homo Sapiens
NGRMLLQYI

SEQ ID NO: 1039886 - protein, 9 aa, Homo Sapiens
FRGEDSRRS

SEQ ID NO: 1039887 - protein, 9 aa, Homo Sapiens
DITCLESFC

SEQ ID NO: 1039888 - protein, 9 aa, Homo Sapiens
YVVILCSLK

SEQ ID NO: 1039889 - protein, 9 aa, Homo Sapiens
ADYFLRAVR

SEQ ID NO: 1039890 - protein, 9 aa, Homo Sapiens
KATSNNFTH

SEQ ID NO: 1039891 - protein, 9 aa, Homo Sapiens
LLRDAVEEG

SEQ ID NO: 1039892 - protein, 9 aa, Homo Sapiens
QEDKDHWDK

SEQ ID NO: 1039893 - protein, 9 aa, Homo Sapiens
IFEDTINWT

SEQ ID NO: 1039894 - protein, 9 aa, Homo Sapiens
SDINLDVPH

SEQ ID NO: 1039895 - protein, 9 aa, Homo Sapiens
LKDDALEAV

SEQ ID NO: 1039896 - protein, 9 aa, Homo Sapiens
NYYFCDLFP

SEQ ID NO: 1039897 - protein, 9 aa, Homo Sapiens
KPKNTIAMQ

SEQ ID NO: 1039898 - protein, 9 aa, Homo Sapiens
FCCQVQGDP

SEQ ID NO: 1039899 - protein, 9 aa, Homo Sapiens
RNCEAPYIL

SEQ ID NO: 1039900 - protein, 9 aa, Homo Sapiens
RPPSQDLGC

SEQ ID NO: 1039901 - protein, 9 aa, Homo Sapiens
FFLFYLLPM

SEQ ID NO: 1039902 - protein, 9 aa, Homo Sapiens
SPRYLGGPL

SEQ ID NO: 1039903 - protein, 9 aa, Homo Sapiens
SLEKKKEKN

SEQ ID NO: 1039904 - protein, 9 aa, Homo Sapiens
LAGQTAELR

SEQ ID NO: 1039905 - protein, 9 aa, Homo Sapiens
SPRNCGSPK

SEQ ID NO: 1039906 - protein, 9 aa, Homo Sapiens
KAEHDSELL

SEQ ID NO: 1039907 - protein, 9 aa, Homo Sapiens
ALRLLVQTP

SEQ ID NO: 1039908 - protein, 9 aa, Homo Sapiens
CAFHLTAIT

SEQ ID NO: 1039909 - protein, 9 aa, Homo Sapiens
VQEKYADSS

SEQ ID NO: 1039910 - protein, 9 aa, Homo Sapiens
GPRLQADRK

SEQ ID NO: 1039911 - protein, 9 aa, Homo Sapiens
NNVLAFGTL

SEQ ID NO: 1039912 - protein, 9 aa, Homo Sapiens
QNWALNDHY

SEQ ID NO: 1039913 - protein, 9 aa, Homo Sapiens
WNSAGVGTE

SEQ ID NO: 1039914 - protein, 9 aa, Homo Sapiens
DEASGLKEE

SEQ ID NO: 1039915 - protein, 9 aa, Homo Sapiens
QVPVEEIAI

SEQ ID NO: 1039916 - protein, 9 aa, Homo Sapiens
LCRHIEAKR

SEQ ID NO: 1039917 - protein, 9 aa, Homo Sapiens
FIAISCFYG

SEQ ID NO: 1039918 - protein, 9 aa, Homo Sapiens
EVTSTKYTC

SEQ ID NO: 1039919 - protein, 9 aa, Homo Sapiens
TCDIYKELL

SEQ ID NO: 1039920 - protein, 9 aa, Homo Sapiens
RAARPPCPG

SEQ ID NO: 1039921 - protein, 9 aa, Homo Sapiens
RSTARTVFK

SEQ ID NO: 1039922 - protein, 9 aa, Homo Sapiens
SSLSLDQGW

SEQ ID NO: 1039923 - protein, 9 aa, Homo Sapiens
PPVEGFYAP

SEQ ID NO: 1039924 - protein, 9 aa, Homo Sapiens
VDSHSLHGL

SEQ ID NO: 1039925 - protein, 9 aa, Homo Sapiens
PPKNVVDLK

SEQ ID NO: 1039926 - protein, 9 aa, Homo Sapiens
DEALVLNDK

SEQ ID NO: 1039927 - protein, 9 aa, Homo Sapiens
PGKQEKTKK

SEQ ID NO: 1039928 - protein, 9 aa, Homo Sapiens
KLKEPGGGL

SEQ ID NO: 1039929 - protein, 9 aa, Homo Sapiens
KIEKERDQA

SEQ ID NO: 1039930 - protein, 9 aa, Homo Sapiens
LREEAVMRR

SEQ ID NO: 1039931 - protein, 9 aa, Homo Sapiens
GTASSPGAQ

SEQ ID NO: 1039932 - protein, 9 aa, Homo Sapiens
DKVCKNKTT

SEQ ID NO: 1039933 - protein, 9 aa, Homo Sapiens
CAEEKALLQ

SEQ ID NO: 1039934 - protein, 9 aa, Homo Sapiens
ASGLKEEEE

SEQ ID NO: 1039935 - protein, 9 aa, Homo Sapiens
AEKHKAFST

SEQ ID NO: 1039936 - protein, 9 aa, Homo Sapiens
MSVCRERPA

SEQ ID NO: 1039937 - protein, 9 aa, Homo Sapiens
PMPKRSPTP

SEQ ID NO: 1039938 - protein, 9 aa, Homo Sapiens
KETFSVKQP

SEQ ID NO: 1039939 - protein, 9 aa, Homo Sapiens
QESQSVSHN

SEQ ID NO: 1039940 - protein, 9 aa, Homo Sapiens
YFTHMVGKW

SEQ ID NO: 1039941 - protein, 9 aa, Homo Sapiens
TKYTCDIYK

SEQ ID NO: 1039942 - protein, 9 aa, Homo Sapiens
HQGLADVPG

SEQ ID NO: 1039943 - protein, 9 aa, Homo Sapiens
PNKALKFLN

SEQ ID NO: 1039944 - protein, 9 aa, Homo Sapiens
GKQADNRHV

SEQ ID NO: 1039945 - protein, 9 aa, Homo Sapiens
LGPQLGNLL

SEQ ID NO: 1039946 - protein, 9 aa, Homo Sapiens
HFHTFWSAF

SEQ ID NO: 1039947 - protein, 9 aa, Homo Sapiens
NVSQLATCG

SEQ ID NO: 1039948 - protein, 9 aa, Homo Sapiens
PVGWCKKTK

SEQ ID NO: 1039949 - protein, 9 aa, Homo Sapiens
GPQSTHHSL

SEQ ID NO: 1039950 - protein, 9 aa, Homo Sapiens
DRHGELTAC

SEQ ID NO: 1039951 - protein, 9 aa, Homo Sapiens
GTLRKPVTI

SEQ ID NO: 1039952 - protein, 9 aa, Homo Sapiens
FTIISNTTN

SEQ ID NO: 1039953 - protein, 9 aa, Homo Sapiens
CAEGDDYGQ

SEQ ID NO: 1039954 - protein, 9 aa, Homo Sapiens
GAGLCLFSL

SEQ ID NO: 1039955 - protein, 9 aa, Homo Sapiens
QLQSLALGL

SEQ ID NO: 1039956 - protein, 9 aa, Homo Sapiens
VSLGVKQKL

SEQ ID NO: 1039957 - protein, 9 aa, Homo Sapiens
DITICVQDK

SEQ ID NO: 1039958 - protein, 9 aa, Homo Sapiens
RRRVAEELI

SEQ ID NO: 1039959 - protein, 9 aa, Homo Sapiens
NKVKVDGPE

SEQ ID NO: 1039960 - protein, 9 aa, Homo Sapiens
AEVQLFYQH

SEQ ID NO: 1039961 - protein, 9 aa, Homo Sapiens
SECLESGAF

SEQ ID NO: 1039962 - protein, 9 aa, Homo Sapiens
IDDEEEENE

SEQ ID NO: 1039963 - protein, 9 aa, Homo Sapiens
QKTLKKIEE

SEQ ID NO: 1039964 - protein, 9 aa, Homo Sapiens
EIQLELDRP

SEQ ID NO: 1039965 - protein, 9 aa, Homo Sapiens
DLPNHRWTQ

SEQ ID NO: 1039966 - protein, 9 aa, Homo Sapiens
QPMLVSVSQ

SEQ ID NO: 1039967 - protein, 9 aa, Homo Sapiens
PGATTCTKD

SEQ ID NO: 1039968 - protein, 9 aa, Homo Sapiens
RAFQGRSYK

SEQ ID NO: 1039969 - protein, 9 aa, Homo Sapiens
KAAKNGALG

SEQ ID NO: 1039970 - protein, 9 aa, Homo Sapiens
RLEEMGLIL

SEQ ID NO: 1039971 - protein, 9 aa, Homo Sapiens
GASSPHPRG

SEQ ID NO: 1039972 - protein, 9 aa, Homo Sapiens
EKISISGCK

SEQ ID NO: 1039973 - protein, 9 aa, Homo Sapiens
YQDKNLVVI

SEQ ID NO: 1039974 - protein, 9 aa, Homo Sapiens
YTYETQWPS

SEQ ID NO: 1039975 - protein, 9 aa, Homo Sapiens
QGPKGDSGP

SEQ ID NO: 1039976 - protein, 9 aa, Homo Sapiens
SWCIPLYLM

SEQ ID NO: 1039977 - protein, 9 aa, Homo Sapiens
LLLQLGYKA

SEQ ID NO: 1039978 - protein, 9 aa, Homo Sapiens
RFFSSPRDF

SEQ ID NO: 1039979 - protein, 9 aa, Homo Sapiens
GSLSPLLAR

SEQ ID NO: 1039980 - protein, 9 aa, Homo Sapiens
GKQFDSLMP

SEQ ID NO: 1039981 - protein, 9 aa, Homo Sapiens
FMINRYLQR

SEQ ID NO: 1039982 - protein, 9 aa, Homo Sapiens
GLQASTKAH

SEQ ID NO: 1039983 - protein, 9 aa, Homo Sapiens
QSKSHVSSE

SEQ ID NO: 1039984 - protein, 9 aa, Homo Sapiens
LTPSEFLKK

SEQ ID NO: 1039985 - protein, 9 aa, Homo Sapiens
YLCSVGSYT

SEQ ID NO: 1039986 - protein, 9 aa, Homo Sapiens
KAANVLRGA

SEQ ID NO: 1039987 - protein, 9 aa, Homo Sapiens
TLKEGGLYT

SEQ ID NO: 1039988 - protein, 9 aa, Homo Sapiens
PEAPFCSVS

SEQ ID NO: 1039989 - protein, 9 aa, Homo Sapiens
LLLLLGPGF

SEQ ID NO: 1039990 - protein, 9 aa, Homo Sapiens
TAWYIEFLV

SEQ ID NO: 1039991 - protein, 9 aa, Homo Sapiens
AHTNNYKII

SEQ ID NO: 1039992 - protein, 9 aa, Homo Sapiens
DCGKAFWRG

SEQ ID NO: 1039993 - protein, 9 aa, Homo Sapiens
YQKDCQARS

SEQ ID NO: 1039994 - protein, 9 aa, Homo Sapiens
QMESTNLVK

SEQ ID NO: 1039995 - protein, 9 aa, Homo Sapiens
LQEKNALRK

SEQ ID NO: 1039996 - protein, 9 aa, Homo Sapiens
VLEGDGHWQ

SEQ ID NO: 1039997 - protein, 9 aa, Homo Sapiens
MIRDPVRGW

SEQ ID NO: 1039998 - protein, 9 aa, Homo Sapiens
MLRRRGRFK

SEQ ID NO: 1039999 - protein, 9 aa, Homo Sapiens
DPLHEDWKK

SEQ ID NO: 1040000 - protein, 9 aa, Homo Sapiens
FLDRRLFYF

SEQ ID NO: 1040001 - protein, 9 aa, Homo Sapiens
PPMWISTTT

SEQ ID NO: 1040002 - protein, 9 aa, Homo Sapiens
ATSITKKCE

SEQ ID NO: 1040003 - protein, 9 aa, Homo Sapiens
FCNVRASPK

SEQ ID NO: 1040004 - protein, 9 aa, Homo Sapiens
IKPENFFVN

SEQ ID NO: 1040005 - protein, 9 aa, Homo Sapiens
GELTACMNV

SEQ ID NO: 1040006 - protein, 9 aa, Homo Sapiens
LEINGKSFK

SEQ ID NO: 1040007 - protein, 9 aa, Homo Sapiens
GHSHNALSG

SEQ ID NO: 1040008 - protein, 9 aa, Homo Sapiens
EAAGHPAPA

SEQ ID NO: 1040009 - protein, 9 aa, Homo Sapiens
GLGITTASF

SEQ ID NO: 1040010 - protein, 9 aa, Homo Sapiens
LIELSAIDF

SEQ ID NO: 1040011 - protein, 9 aa, Homo Sapiens
QYEANVSQL

SEQ ID NO: 1040012 - protein, 9 aa, Homo Sapiens
GKTFNQGST

SEQ ID NO: 1040013 - protein, 9 aa, Homo Sapiens
VCLSVSQPS

SEQ ID NO: 1040014 - protein, 9 aa, Homo Sapiens
STKAHPARR

SEQ ID NO: 1040015 - protein, 9 aa, Homo Sapiens
QNLKEEEFE

SEQ ID NO: 1040016 - protein, 9 aa, Homo Sapiens
EEQGEGVQK

SEQ ID NO: 1040017 - protein, 9 aa, Homo Sapiens
PCAQLFNSL

SEQ ID NO: 1040018 - protein, 9 aa, Homo Sapiens
ELLTNGYTR

SEQ ID NO: 1040019 - protein, 9 aa, Homo Sapiens
VSWNPQVPS

SEQ ID NO: 1040020 - protein, 9 aa, Homo Sapiens
DSKHPRCPP

SEQ ID NO: 1040021 - protein, 9 aa, Homo Sapiens
SPLAKARRQ

SEQ ID NO: 1040022 - protein, 9 aa, Homo Sapiens
IESLFYTVI

SEQ ID NO: 1040023 - protein, 9 aa, Homo Sapiens
SLRNKKFKS

SEQ ID NO: 1040024 - protein, 9 aa, Homo Sapiens
ILCSLKTHS

SEQ ID NO: 1040025 - protein, 9 aa, Homo Sapiens
PDGEEKRCA

SEQ ID NO: 1040026 - protein, 9 aa, Homo Sapiens
KLQKLGPDD

SEQ ID NO: 1040027 - protein, 9 aa, Homo Sapiens
ALYRRADKK

SEQ ID NO: 1040028 - protein, 9 aa, Homo Sapiens
VHAICTKTG

SEQ ID NO: 1040029 - protein, 9 aa, Homo Sapiens
ASFVCVPTY

SEQ ID NO: 1040030 - protein, 9 aa, Homo Sapiens
PGKVPAFLL

SEQ ID NO: 1040031 - protein, 9 aa, Homo Sapiens
RVHEPAGPC

SEQ ID NO: 1040032 - protein, 9 aa, Homo Sapiens
SRLPPEWVT

SEQ ID NO: 1040033 - protein, 9 aa, Homo Sapiens
PQMPDSQRR

SEQ ID NO: 1040034 - protein, 9 aa, Homo Sapiens
EAGTKARFL

SEQ ID NO: 1040035 - protein, 9 aa, Homo Sapiens
RSQPHTKPF

SEQ ID NO: 1040036 - protein, 9 aa, Homo Sapiens
SYLNLEDIA

SEQ ID NO: 1040037 - protein, 9 aa, Homo Sapiens
RLARAKEAA

SEQ ID NO: 1040038 - protein, 9 aa, Homo Sapiens
QLDLGKKPQ

SEQ ID NO: 1040039 - protein, 9 aa, Homo Sapiens
TANAGSDYK

SEQ ID NO: 1040040 - protein, 9 aa, Homo Sapiens
NIMISPRNC

SEQ ID NO: 1040041 - protein, 9 aa, Homo Sapiens
QGKLGGIMG

SEQ ID NO: 1040042 - protein, 9 aa, Homo Sapiens
QTGVDASKV

SEQ ID NO: 1040043 - protein, 9 aa, Homo Sapiens
FFGGLFLVL

SEQ ID NO: 1040044 - protein, 9 aa, Homo Sapiens
PGRDARDSD

SEQ ID NO: 1040045 - protein, 9 aa, Homo Sapiens
SCDLVSLHR

SEQ ID NO: 1040046 - protein, 9 aa, Homo Sapiens
NPFISPDAA

SEQ ID NO: 1040047 - protein, 9 aa, Homo Sapiens
DPKIYTDPE

SEQ ID NO: 1040048 - protein, 9 aa, Homo Sapiens
QLMLHGCLL

SEQ ID NO: 1040049 - protein, 9 aa, Homo Sapiens
HRCSLSEED

SEQ ID NO: 1040050 - protein, 9 aa, Homo Sapiens
EVDGEPFFW

SEQ ID NO: 1040051 - protein, 9 aa, Homo Sapiens
LQHDQIYTG

SEQ ID NO: 1040052 - protein, 9 aa, Homo Sapiens
VKIEKVIGA

SEQ ID NO: 1040053 - protein, 9 aa, Homo Sapiens
LLISLSVIS

SEQ ID NO: 1040054 - protein, 9 aa, Homo Sapiens
SRQKPPSAF

SEQ ID NO: 1040055 - protein, 9 aa, Homo Sapiens
IFPEELIKK

SEQ ID NO: 1040056 - protein, 9 aa, Homo Sapiens
GALAAAKPG

SEQ ID NO: 1040057 - protein, 9 aa, Homo Sapiens
GKKAPTTAG

SEQ ID NO: 1040058 - protein, 9 aa, Homo Sapiens
PAAFSGFTA

SEQ ID NO: 1040059 - protein, 9 aa, Homo Sapiens
RRLLSSSER

SEQ ID NO: 1040060 - protein, 9 aa, Homo Sapiens
GLDYLHKNG

SEQ ID NO: 1040061 - protein, 9 aa, Homo Sapiens
KWRTSDGLM

SEQ ID NO: 1040062 - protein, 9 aa, Homo Sapiens
ADLQRMFST

SEQ ID NO: 1040063 - protein, 9 aa, Homo Sapiens
WNTYAQKEK

SEQ ID NO: 1040064 - protein, 9 aa, Homo Sapiens
SPSSSGRAG

SEQ ID NO: 1040065 - protein, 9 aa, Homo Sapiens
YKCKINGLS

SEQ ID NO: 1040066 - protein, 9 aa, Homo Sapiens
TFNEDAQAL

SEQ ID NO: 1040067 - protein, 9 aa, Homo Sapiens
LFTLRALQE

SEQ ID NO: 1040068 - protein, 9 aa, Homo Sapiens
LQRFDRTLR

SEQ ID NO: 1040069 - protein, 9 aa, Homo Sapiens
LLQHLQRVD

SEQ ID NO: 1040070 - protein, 9 aa, Homo Sapiens
VQEKIPKLR

SEQ ID NO: 1040071 - protein, 9 aa, Homo Sapiens
HDVTLRNIS

SEQ ID NO: 1040072 - protein, 9 aa, Homo Sapiens
KQFLPQEDP

SEQ ID NO: 1040073 - protein, 9 aa, Homo Sapiens
VVCKQLECP

SEQ ID NO: 1040074 - protein, 9 aa, Homo Sapiens
SLRNKNVKA

SEQ ID NO: 1040075 - protein, 9 aa, Homo Sapiens
EVSQRLEEM

SEQ ID NO: 1040076 - protein, 9 aa, Homo Sapiens
CPARRAPGE

SEQ ID NO: 1040077 - protein, 9 aa, Homo Sapiens
ICLMDHLKA

SEQ ID NO: 1040078 - protein, 9 aa, Homo Sapiens
WCADRNFTT

SEQ ID NO: 1040079 - protein, 9 aa, Homo Sapiens
YLLFLFLFA

SEQ ID NO: 1040080 - protein, 9 aa, Homo Sapiens
QNSSLSLAV

SEQ ID NO: 1040081 - protein, 9 aa, Homo Sapiens
TLWEKPRAI

SEQ ID NO: 1040082 - protein, 9 aa, Homo Sapiens
LALTSVAEL

SEQ ID NO: 1040083 - protein, 9 aa, Homo Sapiens
LLCKILQRI

SEQ ID NO: 1040084 - protein, 9 aa, Homo Sapiens
MNVEILDIF

SEQ ID NO: 1040085 - protein, 9 aa, Homo Sapiens
PLDRLPKTR

SEQ ID NO: 1040086 - protein, 9 aa, Homo Sapiens
HMTQPRLWA

SEQ ID NO: 1040087 - protein, 9 aa, Homo Sapiens
KYNPQLSLL

SEQ ID NO: 1040088 - protein, 9 aa, Homo Sapiens
IMNTLESKE

SEQ ID NO: 1040089 - protein, 9 aa, Homo Sapiens
WLFISEPGS

SEQ ID NO: 1040090 - protein, 9 aa, Homo Sapiens
SQPLLPSEH

SEQ ID NO: 1040091 - protein, 9 aa, Homo Sapiens
PEREAERGS

SEQ ID NO: 1040092 - protein, 9 aa, Homo Sapiens
ARRVHEPAG

SEQ ID NO: 1040093 - protein, 9 aa, Homo Sapiens
KKTGRCLKR

SEQ ID NO: 1040094 - protein, 9 aa, Homo Sapiens
HHRVHTEEK

SEQ ID NO: 1040095 - protein, 9 aa, Homo Sapiens
TPKTFAPSS

SEQ ID NO: 1040096 - protein, 9 aa, Homo Sapiens
AVRPLGEKG

SEQ ID NO: 1040097 - protein, 9 aa, Homo Sapiens
LVRDLNQDS

SEQ ID NO: 1040098 - protein, 9 aa, Homo Sapiens
NSGDPPLVQ

SEQ ID NO: 1040099 - protein, 9 aa, Homo Sapiens
RELVLVIRR

SEQ ID NO: 1040100 - protein, 9 aa, Homo Sapiens
GGHFIGLAG

SEQ ID NO: 1040101 - protein, 9 aa, Homo Sapiens
TDPMAQCLQ

SEQ ID NO: 1040102 - protein, 9 aa, Homo Sapiens
TSRSGHCAA

SEQ ID NO: 1040103 - protein, 9 aa, Homo Sapiens
QVAVNEKHT

SEQ ID NO: 1040104 - protein, 9 aa, Homo Sapiens
GKASQRHPF

SEQ ID NO: 1040105 - protein, 9 aa, Homo Sapiens
GARLPYYSA

SEQ ID NO: 1040106 - protein, 9 aa, Homo Sapiens
LLVHGGHRS

SEQ ID NO: 1040107 - protein, 9 aa, Homo Sapiens
LEVSQRLEE

SEQ ID NO: 1040108 - protein, 9 aa, Homo Sapiens
TMTEAEVQL

SEQ ID NO: 1040109 - protein, 9 aa, Homo Sapiens
VVHKRVPPK

SEQ ID NO: 1040110 - protein, 9 aa, Homo Sapiens
AEGRAGGGL

SEQ ID NO: 1040111 - protein, 9 aa, Homo Sapiens
TEAVGFSKG

SEQ ID NO: 1040112 - protein, 9 aa, Homo Sapiens
LNGFGNFYT

SEQ ID NO: 1040113 - protein, 9 aa, Homo Sapiens
QRAARPPCP

SEQ ID NO: 1040114 - protein, 9 aa, Homo Sapiens
YQKLTRLKA

SEQ ID NO: 1040115 - protein, 9 aa, Homo Sapiens
LVSESDDGF

SEQ ID NO: 1040116 - protein, 9 aa, Homo Sapiens
WQIKAQRGR

SEQ ID NO: 1040117 - protein, 9 aa, Homo Sapiens
YLGGPLPDF

SEQ ID NO: 1040118 - protein, 9 aa, Homo Sapiens
LERKVFPEI

SEQ ID NO: 1040119 - protein, 9 aa, Homo Sapiens
ITIFEDTIN

SEQ ID NO: 1040120 - protein, 9 aa, Homo Sapiens
SQLEKLEAL

SEQ ID NO: 1040121 - protein, 9 aa, Homo Sapiens
SLSAFSAAS

SEQ ID NO: 1040122 - protein, 9 aa, Homo Sapiens
AFTMSWVPL

SEQ ID NO: 1040123 - protein, 9 aa, Homo Sapiens
ESLTILAVQ

SEQ ID NO: 1040124 - protein, 9 aa, Homo Sapiens
LFKIGPPFI

SEQ ID NO: 1040125 - protein, 9 aa, Homo Sapiens
DELSFTEGE

SEQ ID NO: 1040126 - protein, 9 aa, Homo Sapiens
LEVLKILKL

SEQ ID NO: 1040127 - protein, 9 aa, Homo Sapiens
PEGELMLGG

SEQ ID NO: 1040128 - protein, 9 aa, Homo Sapiens
LCFFVSCVF

SEQ ID NO: 1040129 - protein, 9 aa, Homo Sapiens
YLGILLQVE

SEQ ID NO: 1040130 - protein, 9 aa, Homo Sapiens
ADFVANKLG

SEQ ID NO: 1040131 - protein, 9 aa, Homo Sapiens
KGEMGKKGE

SEQ ID NO: 1040132 - protein, 9 aa, Homo Sapiens
PREPKEPFC

SEQ ID NO: 1040133 - protein, 9 aa, Homo Sapiens
YGFSPKELM

SEQ ID NO: 1040134 - protein, 9 aa, Homo Sapiens
PPGKQEKTK

SEQ ID NO: 1040135 - protein, 9 aa, Homo Sapiens
AVVFVEQGH

SEQ ID NO: 1040136 - protein, 9 aa, Homo Sapiens
ATLRNNILF

SEQ ID NO: 1040137 - protein, 9 aa, Homo Sapiens
DQPVKPLNR

SEQ ID NO: 1040138 - protein, 9 aa, Homo Sapiens
KIEESTSVH

SEQ ID NO: 1040139 - protein, 9 aa, Homo Sapiens
QTFSGTGIL

SEQ ID NO: 1040140 - protein, 9 aa, Homo Sapiens
KFHVTSKFF

SEQ ID NO: 1040141 - protein, 9 aa, Homo Sapiens
RPLCGQPTP

SEQ ID NO: 1040142 - protein, 9 aa, Homo Sapiens
IYQCAEDKK

SEQ ID NO: 1040143 - protein, 9 aa, Homo Sapiens
LGAAAEETG

SEQ ID NO: 1040144 - protein, 9 aa, Homo Sapiens
GLDNSNQSS

SEQ ID NO: 1040145 - protein, 9 aa, Homo Sapiens
GGAAARSRP

SEQ ID NO: 1040146 - protein, 9 aa, Homo Sapiens
KKEPLKEET

SEQ ID NO: 1040147 - protein, 9 aa, Homo Sapiens
SYRIIAQEI

SEQ ID NO: 1040148 - protein, 9 aa, Homo Sapiens
ITCLESFCD

SEQ ID NO: 1040149 - protein, 9 aa, Homo Sapiens
YNRMSYWSD

SEQ ID NO: 1040150 - protein, 9 aa, Homo Sapiens
ASQRHPFPE

SEQ ID NO: 1040151 - protein, 9 aa, Homo Sapiens
YFLSNNYQQ

SEQ ID NO: 1040152 - protein, 9 aa, Homo Sapiens
LKQAEKLRQ

SEQ ID NO: 1040153 - protein, 9 aa, Homo Sapiens
SGLPESVDV

SEQ ID NO: 1040154 - protein, 9 aa, Homo Sapiens
RSSVVSGVP

SEQ ID NO: 1040155 - protein, 9 aa, Homo Sapiens
LPGAEVQLQ

SEQ ID NO: 1040156 - protein, 9 aa, Homo Sapiens
SRYKVCIAQ

SEQ ID NO: 1040157 - protein, 9 aa, Homo Sapiens
RLMKVEQDQ

SEQ ID NO: 1040158 - protein, 9 aa, Homo Sapiens
RDLLQPLLE

SEQ ID NO: 1040159 - protein, 9 aa, Homo Sapiens
SPGAARATA

SEQ ID NO: 1040160 - protein, 9 aa, Homo Sapiens
PCTVRWFHR

SEQ ID NO: 1040161 - protein, 9 aa, Homo Sapiens
VYKSIPYGF

SEQ ID NO: 1040162 - protein, 9 aa, Homo Sapiens
RRGFPRYTI

SEQ ID NO: 1040163 - protein, 9 aa, Homo Sapiens
KLPVLYTFH

SEQ ID NO: 1040164 - protein, 9 aa, Homo Sapiens
NGVNYTTTL

SEQ ID NO: 1040165 - protein, 9 aa, Homo Sapiens
SPKKKTIKR

SEQ ID NO: 1040166 - protein, 9 aa, Homo Sapiens
SHVFFSVHY

SEQ ID NO: 1040167 - protein, 9 aa, Homo Sapiens
VDASKVVLM

SEQ ID NO: 1040168 - protein, 9 aa, Homo Sapiens
SRKQVGNGF

SEQ ID NO: 1040169 - protein, 9 aa, Homo Sapiens
FNEDAQALK

SEQ ID NO: 1040170 - protein, 9 aa, Homo Sapiens
PLCQWSRMA

SEQ ID NO: 1040171 - protein, 9 aa, Homo Sapiens
IKVSLNHGI

SEQ ID NO: 1040172 - protein, 9 aa, Homo Sapiens
LEKFQNWDC

SEQ ID NO: 1040173 - protein, 9 aa, Homo Sapiens
TAELRCKGS

SEQ ID NO: 1040174 - protein, 9 aa, Homo Sapiens
RSTASQSWT

SEQ ID NO: 1040175 - protein, 9 aa, Homo Sapiens
VSKGLGQPL

SEQ ID NO: 1040176 - protein, 9 aa, Homo Sapiens
HTTYKKDYN

SEQ ID NO: 1040177 - protein, 9 aa, Homo Sapiens
TKHFFEAAE

SEQ ID NO: 1040178 - protein, 9 aa, Homo Sapiens
AQVFNFQRE

SEQ ID NO: 1040179 - protein, 9 aa, Homo Sapiens
NGQSRTIRQ

SEQ ID NO: 1040180 - protein, 9 aa, Homo Sapiens
LEQETVVCS

SEQ ID NO: 1040181 - protein, 9 aa, Homo Sapiens
ASFSFMPRV

SEQ ID NO: 1040182 - protein, 9 aa, Homo Sapiens
VGGGHFIGL

SEQ ID NO: 1040183 - protein, 9 aa, Homo Sapiens
VCYEIIAAK

SEQ ID NO: 1040184 - protein, 9 aa, Homo Sapiens
MANQDPDFI

SEQ ID NO: 1040185 - protein, 9 aa, Homo Sapiens
LVARLETHA

SEQ ID NO: 1040186 - protein, 9 aa, Homo Sapiens
ASQDNISVS

SEQ ID NO: 1040187 - protein, 9 aa, Homo Sapiens
WYIEFLVLI

SEQ ID NO: 1040188 - protein, 9 aa, Homo Sapiens
STHHSLRTP

SEQ ID NO: 1040189 - protein, 9 aa, Homo Sapiens
ANSEVLYPN

SEQ ID NO: 1040190 - protein, 9 aa, Homo Sapiens
YPYISSDGE

SEQ ID NO: 1040191 - protein, 9 aa, Homo Sapiens
EPSAIPNNS

SEQ ID NO: 1040192 - protein, 9 aa, Homo Sapiens
GVIPNFTES

SEQ ID NO: 1040193 - protein, 9 aa, Homo Sapiens
EAFYEIFQI

SEQ ID NO: 1040194 - protein, 9 aa, Homo Sapiens
ESVDVDECS

SEQ ID NO: 1040195 - protein, 9 aa, Homo Sapiens
FKLQNLDLL

SEQ ID NO: 1040196 - protein, 9 aa, Homo Sapiens
IYQKLTRLK

SEQ ID NO: 1040197 - protein, 9 aa, Homo Sapiens
GSLKRANPP

SEQ ID NO: 1040198 - protein, 9 aa, Homo Sapiens
ETHERKGSN

SEQ ID NO: 1040199 - protein, 9 aa, Homo Sapiens
GPVSAAPAR

SEQ ID NO: 1040200 - protein, 9 aa, Homo Sapiens
RDFLQSHII

SEQ ID NO: 1040201 - protein, 9 aa, Homo Sapiens
EYYPYISSD

SEQ ID NO: 1040202 - protein, 9 aa, Homo Sapiens
MFVSNGSFL

SEQ ID NO: 1040203 - protein, 9 aa, Homo Sapiens
SLHRDCSKN

SEQ ID NO: 1040204 - protein, 9 aa, Homo Sapiens
LTTYRTFIF

SEQ ID NO: 1040205 - protein, 9 aa, Homo Sapiens
SELEQERRH

SEQ ID NO: 1040206 - protein, 9 aa, Homo Sapiens
NGQVRQGKE

SEQ ID NO: 1040207 - protein, 9 aa, Homo Sapiens
HRRVHTEEN

SEQ ID NO: 1040208 - protein, 9 aa, Homo Sapiens
MKEEGTKRM

SEQ ID NO: 1040209 - protein, 9 aa, Homo Sapiens
ITLERPFNV

SEQ ID NO: 1040210 - protein, 9 aa, Homo Sapiens
NLPATPKTF

SEQ ID NO: 1040211 - protein, 9 aa, Homo Sapiens
LECPALPII

SEQ ID NO: 1040212 - protein, 9 aa, Homo Sapiens
QKKASTGKG

SEQ ID NO: 1040213 - protein, 9 aa, Homo Sapiens
KNITLERPF

SEQ ID NO: 1040214 - protein, 9 aa, Homo Sapiens
AAQNEDVDL

SEQ ID NO: 1040215 - protein, 9 aa, Homo Sapiens
IREDLIGMD

SEQ ID NO: 1040216 - protein, 9 aa, Homo Sapiens
KDDIVELWD

SEQ ID NO: 1040217 - protein, 9 aa, Homo Sapiens
LEGTKSISI

SEQ ID NO: 1040218 - protein, 9 aa, Homo Sapiens
AVEVPLKNQ

SEQ ID NO: 1040219 - protein, 9 aa, Homo Sapiens
EKIERDLHR

SEQ ID NO: 1040220 - protein, 9 aa, Homo Sapiens
VFLGNSHVC

SEQ ID NO: 1040221 - protein, 9 aa, Homo Sapiens
LLFFQATDP

SEQ ID NO: 1040222 - protein, 9 aa, Homo Sapiens
PISEKVSEA

SEQ ID NO: 1040223 - protein, 9 aa, Homo Sapiens
SSSLRKMET

SEQ ID NO: 1040224 - protein, 9 aa, Homo Sapiens
GELEQLDLG

SEQ ID NO: 1040225 - protein, 9 aa, Homo Sapiens
LVVSVIKQL

SEQ ID NO: 1040226 - protein, 9 aa, Homo Sapiens
KNEMKASSC

SEQ ID NO: 1040227 - protein, 9 aa, Homo Sapiens
LKKLGAFHI

SEQ ID NO: 1040228 - protein, 9 aa, Homo Sapiens
YNLFLSCDK

SEQ ID NO: 1040229 - protein, 9 aa, Homo Sapiens
LVHGGHRSS

SEQ ID NO: 1040230 - protein, 9 aa, Homo Sapiens
TFRDGAIEF

SEQ ID NO: 1040231 - protein, 9 aa, Homo Sapiens
IEEPKIEVL

SEQ ID NO: 1040232 - protein, 9 aa, Homo Sapiens
PIKSSLQAC

SEQ ID NO: 1040233 - protein, 9 aa, Homo Sapiens
SSCPGDYLS

SEQ ID NO: 1040234 - protein, 9 aa, Homo Sapiens
YDENTELYF

SEQ ID NO: 1040235 - protein, 9 aa, Homo Sapiens
SHGSAVTTQ

SEQ ID NO: 1040236 - protein, 9 aa, Homo Sapiens
PDARADARL

SEQ ID NO: 1040237 - protein, 9 aa, Homo Sapiens
SSTIALRWT

SEQ ID NO: 1040238 - protein, 9 aa, Homo Sapiens
RRIKWRNSK

SEQ ID NO: 1040239 - protein, 9 aa, Homo Sapiens
LKTKINSPW

SEQ ID NO: 1040240 - protein, 9 aa, Homo Sapiens
PSSDASESV

SEQ ID NO: 1040241 - protein, 9 aa, Homo Sapiens
VQASCEMQI

SEQ ID NO: 1040242 - protein, 9 aa, Homo Sapiens
KNLPATPKT

SEQ ID NO: 1040243 - protein, 9 aa, Homo Sapiens
RKPQILCYP

SEQ ID NO: 1040244 - protein, 9 aa, Homo Sapiens
RPMQKKILL

SEQ ID NO: 1040245 - protein, 9 aa, Homo Sapiens
SLPPSAVTK

SEQ ID NO: 1040246 - protein, 9 aa, Homo Sapiens
PSEILELKP

SEQ ID NO: 1040247 - protein, 9 aa, Homo Sapiens
GDVPKQKKG

SEQ ID NO: 1040248 - protein, 9 aa, Homo Sapiens
SVKGKIHLH

SEQ ID NO: 1040249 - protein, 9 aa, Homo Sapiens
GTGAFDLVC

SEQ ID NO: 1040250 - protein, 9 aa, Homo Sapiens
EEFMKSKSD

SEQ ID NO: 1040251 - protein, 9 aa, Homo Sapiens
AGCRKFYEG

SEQ ID NO: 1040252 - protein, 9 aa, Homo Sapiens
DKEEKLELQ

SEQ ID NO: 1040253 - protein, 9 aa, Homo Sapiens
EDEVFANFF

SEQ ID NO: 1040254 - protein, 9 aa, Homo Sapiens
YCVCKMPCN

SEQ ID NO: 1040255 - protein, 9 aa, Homo Sapiens
HVNSSWFII

SEQ ID NO: 1040256 - protein, 9 aa, Homo Sapiens
FFLGEQSRV

SEQ ID NO: 1040257 - protein, 9 aa, Homo Sapiens
PVLEGDGHW

SEQ ID NO: 1040258 - protein, 9 aa, Homo Sapiens
SPHLLSFPS

SEQ ID NO: 1040259 - protein, 9 aa, Homo Sapiens
NTLIHTINL

SEQ ID NO: 1040260 - protein, 9 aa, Homo Sapiens
VKSEHKTFK

SEQ ID NO: 1040261 - protein, 9 aa, Homo Sapiens
LTVSRFLMC

SEQ ID NO: 1040262 - protein, 9 aa, Homo Sapiens
PHFFMAVFY

SEQ ID NO: 1040263 - protein, 9 aa, Homo Sapiens
ILKKAQKDE

SEQ ID NO: 1040264 - protein, 9 aa, Homo Sapiens
EAQLLFHGV

SEQ ID NO: 1040265 - protein, 9 aa, Homo Sapiens
KMAKPEKAP

SEQ ID NO: 1040266 - protein, 9 aa, Homo Sapiens
NAPVINRLT

SEQ ID NO: 1040267 - protein, 9 aa, Homo Sapiens
KMGFIIYGN

SEQ ID NO: 1040268 - protein, 9 aa, Homo Sapiens
SLVSTAWVD

SEQ ID NO: 1040269 - protein, 9 aa, Homo Sapiens
GLKIEDTVS

SEQ ID NO: 1040270 - protein, 9 aa, Homo Sapiens
CGKAFERPS

SEQ ID NO: 1040271 - protein, 9 aa, Homo Sapiens
LEKKKEKNI

SEQ ID NO: 1040272 - protein, 9 aa, Homo Sapiens
KNKIQTLAS

SEQ ID NO: 1040273 - protein, 9 aa, Homo Sapiens
DQRTIFFVG

SEQ ID NO: 1040274 - protein, 9 aa, Homo Sapiens
TVIDPNRVM

SEQ ID NO: 1040275 - protein, 9 aa, Homo Sapiens
LLTSSDLPT

SEQ ID NO: 1040276 - protein, 9 aa, Homo Sapiens
AVALEQNIE

SEQ ID NO: 1040277 - protein, 9 aa, Homo Sapiens
PVSVAASQD

SEQ ID NO: 1040278 - protein, 9 aa, Homo Sapiens
KVPHFKVAP

SEQ ID NO: 1040279 - protein, 9 aa, Homo Sapiens
PQYEANVSQ

SEQ ID NO: 1040280 - protein, 9 aa, Homo Sapiens
YLENFSGRT

SEQ ID NO: 1040281 - protein, 9 aa, Homo Sapiens
KMNTDPMAQ

SEQ ID NO: 1040282 - protein, 9 aa, Homo Sapiens
AANVLRGAC

SEQ ID NO: 1040283 - protein, 9 aa, Homo Sapiens
RGFRYSEAA

SEQ ID NO: 1040284 - protein, 9 aa, Homo Sapiens
KNMAKIHCG

SEQ ID NO: 1040285 - protein, 9 aa, Homo Sapiens
KLLKEREDP

SEQ ID NO: 1040286 - protein, 9 aa, Homo Sapiens
EFCQLIVNK

SEQ ID NO: 1040287 - protein, 9 aa, Homo Sapiens
SLDKVHAKM

SEQ ID NO: 1040288 - protein, 9 aa, Homo Sapiens
GSLFREALV

SEQ ID NO: 1040289 - protein, 9 aa, Homo Sapiens
TLLYRNINI

SEQ ID NO: 1040290 - protein, 9 aa, Homo Sapiens
CRKSSSLRK

SEQ ID NO: 1040291 - protein, 9 aa, Homo Sapiens
TTKNYPNAG

SEQ ID NO: 1040292 - protein, 9 aa, Homo Sapiens
LLSQNGPVH

SEQ ID NO: 1040293 - protein, 9 aa, Homo Sapiens
VRTFAQVMR

SEQ ID NO: 1040294 - protein, 9 aa, Homo Sapiens
ENKKCTDAF

SEQ ID NO: 1040295 - protein, 9 aa, Homo Sapiens
QEHVYDRIN

SEQ ID NO: 1040296 - protein, 9 aa, Homo Sapiens
DIYIEQQKT

SEQ ID NO: 1040297 - protein, 9 aa, Homo Sapiens
QILDPFAPE

SEQ ID NO: 1040298 - protein, 9 aa, Homo Sapiens
ALEQNIEFI

SEQ ID NO: 1040299 - protein, 9 aa, Homo Sapiens
DNCKKLGLM

SEQ ID NO: 1040300 - protein, 9 aa, Homo Sapiens
LPNARRVHE

SEQ ID NO: 1040301 - protein, 9 aa, Homo Sapiens
TLSYVFILQ

SEQ ID NO: 1040302 - protein, 9 aa, Homo Sapiens
GFLEGPASS

SEQ ID NO: 1040303 - protein, 9 aa, Homo Sapiens
TPAKIQLSL

SEQ ID NO: 1040304 - protein, 9 aa, Homo Sapiens
HLEVFPSKA

SEQ ID NO: 1040305 - protein, 9 aa, Homo Sapiens
KTDSAVNTA

SEQ ID NO: 1040306 - protein, 9 aa, Homo Sapiens
IGAPLFMDC

SEQ ID NO: 1040307 - protein, 9 aa, Homo Sapiens
KQNPRRWGN

SEQ ID NO: 1040308 - protein, 9 aa, Homo Sapiens
KKGPFGKNC

SEQ ID NO: 1040309 - protein, 9 aa, Homo Sapiens
PMARICLSS

SEQ ID NO: 1040310 - protein, 9 aa, Homo Sapiens
LDTLFSVFK

SEQ ID NO: 1040311 - protein, 9 aa, Homo Sapiens
ALEAVTEEQ

SEQ ID NO: 1040312 - protein, 9 aa, Homo Sapiens
AFEECDTDR

SEQ ID NO: 1040313 - protein, 9 aa, Homo Sapiens
HQMWGRLVG

SEQ ID NO: 1040314 - protein, 9 aa, Homo Sapiens
PVMPREASL

SEQ ID NO: 1040315 - protein, 9 aa, Homo Sapiens
VLTRDCLSQ

SEQ ID NO: 1040316 - protein, 9 aa, Homo Sapiens
EIQMIRDPV

SEQ ID NO: 1040317 - protein, 9 aa, Homo Sapiens
VRSKQIFSS

SEQ ID NO: 1040318 - protein, 9 aa, Homo Sapiens
ILLMAFPIT

SEQ ID NO: 1040319 - protein, 9 aa, Homo Sapiens
FQLGQFTEE

SEQ ID NO: 1040320 - protein, 9 aa, Homo Sapiens
FFQQQPPPF

SEQ ID NO: 1040321 - protein, 9 aa, Homo Sapiens
QKRGDKFFP

SEQ ID NO: 1040322 - protein, 9 aa, Homo Sapiens
SDDRFSFWD

SEQ ID NO: 1040323 - protein, 9 aa, Homo Sapiens
GRESSLPFK

SEQ ID NO: 1040324 - protein, 9 aa, Homo Sapiens
PQRDPKIYT

SEQ ID NO: 1040325 - protein, 9 aa, Homo Sapiens
AIGKNNPSL

SEQ ID NO: 1040326 - protein, 9 aa, Homo Sapiens
ALGPTEPAS

SEQ ID NO: 1040327 - protein, 9 aa, Homo Sapiens
SGFLSDSQL

SEQ ID NO: 1040328 - protein, 9 aa, Homo Sapiens
RNLLLLAEP

SEQ ID NO: 1040329 - protein, 9 aa, Homo Sapiens
EFPSGSALR

SEQ ID NO: 1040330 - protein, 9 aa, Homo Sapiens
NGTFNQYVC

SEQ ID NO: 1040331 - protein, 9 aa, Homo Sapiens
LFRRVVKVL

SEQ ID NO: 1040332 - protein, 9 aa, Homo Sapiens
SIPYGFLEE

SEQ ID NO: 1040333 - protein, 9 aa, Homo Sapiens
MSHSRKKLL

SEQ ID NO: 1040334 - protein, 9 aa, Homo Sapiens
IHTDEKLFE

SEQ ID NO: 1040335 - protein, 9 aa, Homo Sapiens
IYTVSATPA

SEQ ID NO: 1040336 - protein, 9 aa, Homo Sapiens
VLKILKLRE

SEQ ID NO: 1040337 - protein, 9 aa, Homo Sapiens
NTIAMQNIP

SEQ ID NO: 1040338 - protein, 9 aa, Homo Sapiens
SLRLKVMKR

SEQ ID NO: 1040339 - protein, 9 aa, Homo Sapiens
DVFHFTPRL

SEQ ID NO: 1040340 - protein, 9 aa, Homo Sapiens
PRTVPVLKM

SEQ ID NO: 1040341 - protein, 9 aa, Homo Sapiens
ANIFLRQKW

SEQ ID NO: 1040342 - protein, 9 aa, Homo Sapiens
RSKSLGLGA

SEQ ID NO: 1040343 - protein, 9 aa, Homo Sapiens
LFSAFMRIR

SEQ ID NO: 1040344 - protein, 9 aa, Homo Sapiens
VADLQRMFS

SEQ ID NO: 1040345 - protein, 9 aa, Homo Sapiens
ETGGEHWKE

SEQ ID NO: 1040346 - protein, 9 aa, Homo Sapiens
AVPWTQKKF

SEQ ID NO: 1040347 - protein, 9 aa, Homo Sapiens
ARATAALTR

SEQ ID NO: 1040348 - protein, 9 aa, Homo Sapiens
KNAAEALLL

SEQ ID NO: 1040349 - protein, 9 aa, Homo Sapiens
SCMGLKIED

SEQ ID NO: 1040350 - protein, 9 aa, Homo Sapiens
HWLLGAARG

SEQ ID NO: 1040351 - protein, 9 aa, Homo Sapiens
MKVLKNQMF

SEQ ID NO: 1040352 - protein, 9 aa, Homo Sapiens
CQGTLRKPV

SEQ ID NO: 1040353 - protein, 9 aa, Homo Sapiens
MPKRSPTPP

SEQ ID NO: 1040354 - protein, 9 aa, Homo Sapiens
REPKEPFCP

SEQ ID NO: 1040355 - protein, 9 aa, Homo Sapiens
VKKNEMKAS

SEQ ID NO: 1040356 - protein, 9 aa, Homo Sapiens
YPPKNVVDL

SEQ ID NO: 1040357 - protein, 9 aa, Homo Sapiens
GVPSQDNTR

SEQ ID NO: 1040358 - protein, 9 aa, Homo Sapiens
SLTILAVQQ

SEQ ID NO: 1040359 - protein, 9 aa, Homo Sapiens
LTAPQAELY

SEQ ID NO: 1040360 - protein, 9 aa, Homo Sapiens
SSLRKWYSP

SEQ ID NO: 1040361 - protein, 9 aa, Homo Sapiens
KGYFADYAK

SEQ ID NO: 1040362 - protein, 9 aa, Homo Sapiens
GLSVKQKRL

SEQ ID NO: 1040363 - protein, 9 aa, Homo Sapiens
LSKQDWTSS

SEQ ID NO: 1040364 - protein, 9 aa, Homo Sapiens
LLEEIWSYL

SEQ ID NO: 1040365 - protein, 9 aa, Homo Sapiens
SSAEKAITV

SEQ ID NO: 1040366 - protein, 9 aa, Homo Sapiens
REGKTSELR

SEQ ID NO: 1040367 - protein, 9 aa, Homo Sapiens
DKEQQIYTE

SEQ ID NO: 1040368 - protein, 9 aa, Homo Sapiens
PQASLPAAA

SEQ ID NO: 1040369 - protein, 9 aa, Homo Sapiens
FEKPLEEHL

SEQ ID NO: 1040370 - protein, 9 aa, Homo Sapiens
PFPIPHGGN

SEQ ID NO: 1040371 - protein, 9 aa, Homo Sapiens
TRVPTESWP

SEQ ID NO: 1040372 - protein, 9 aa, Homo Sapiens
SNNPDVESN

SEQ ID NO: 1040373 - protein, 9 aa, Homo Sapiens
LLLSFTYIA

SEQ ID NO: 1040374 - protein, 9 aa, Homo Sapiens
LHISLQHKI

SEQ ID NO: 1040375 - protein, 9 aa, Homo Sapiens
IFSNPVCLE

SEQ ID NO: 1040376 - protein, 9 aa, Homo Sapiens
LNVGNIGGN

SEQ ID NO: 1040377 - protein, 9 aa, Homo Sapiens
EGSTTEVSE

SEQ ID NO: 1040378 - protein, 9 aa, Homo Sapiens
CKPVTVHSR

SEQ ID NO: 1040379 - protein, 9 aa, Homo Sapiens
SPPLPLLSR

SEQ ID NO: 1040380 - protein, 9 aa, Homo Sapiens
LKNNFKIQK

SEQ ID NO: 1040381 - protein, 9 aa, Homo Sapiens
LAYALSAIG

SEQ ID NO: 1040382 - protein, 9 aa, Homo Sapiens
QTLFMTAPE

SEQ ID NO: 1040383 - protein, 9 aa, Homo Sapiens
LEEKLSASE

SEQ ID NO: 1040384 - protein, 9 aa, Homo Sapiens
VTKIKLHSN

SEQ ID NO: 1040385 - protein, 9 aa, Homo Sapiens
FLEGPASSF

SEQ ID NO: 1040386 - protein, 9 aa, Homo Sapiens
LAALEKNYE

SEQ ID NO: 1040387 - protein, 9 aa, Homo Sapiens
WPDKKSSEM

SEQ ID NO: 1040388 - protein, 9 aa, Homo Sapiens
PETEPRTES

SEQ ID NO: 1040389 - protein, 9 aa, Homo Sapiens
ALGRASCAE

SEQ ID NO: 1040390 - protein, 9 aa, Homo Sapiens
NEKAGDTER

SEQ ID NO: 1040391 - protein, 9 aa, Homo Sapiens
IFGWSLFYF

SEQ ID NO: 1040392 - protein, 9 aa, Homo Sapiens
DSDVGEKPD

SEQ ID NO: 1040393 - protein, 9 aa, Homo Sapiens
ICQGTLRKP

SEQ ID NO: 1040394 - protein, 9 aa, Homo Sapiens
SQNRGISSE

SEQ ID NO: 1040395 - protein, 9 aa, Homo Sapiens
IRNREIEIL

SEQ ID NO: 1040396 - protein, 9 aa, Homo Sapiens
SPPLYPSAL

SEQ ID NO: 1040397 - protein, 9 aa, Homo Sapiens
RAAQGIRTL

SEQ ID NO: 1040398 - protein, 9 aa, Homo Sapiens
NISRQIDNI

SEQ ID NO: 1040399 - protein, 9 aa, Homo Sapiens
QLVSCPLSD

SEQ ID NO: 1040400 - protein, 9 aa, Homo Sapiens
MHQVMSIEK

SEQ ID NO: 1040401 - protein, 9 aa, Homo Sapiens
ESGGFPLEW

SEQ ID NO: 1040402 - protein, 9 aa, Homo Sapiens
RAILDTWLT

SEQ ID NO: 1040403 - protein, 9 aa, Homo Sapiens
IPSRLPPEW

SEQ ID NO: 1040404 - protein, 9 aa, Homo Sapiens
EAGAQGLPG

SEQ ID NO: 1040405 - protein, 9 aa, Homo Sapiens
LDLGGLEAL

SEQ ID NO: 1040406 - protein, 9 aa, Homo Sapiens
TQCSHFRRH

SEQ ID NO: 1040407 - protein, 9 aa, Homo Sapiens
PGTARTPPM

SEQ ID NO: 1040408 - protein, 9 aa, Homo Sapiens
QKKGQQSQC

SEQ ID NO: 1040409 - protein, 9 aa, Homo Sapiens
SMQDTQLPF

SEQ ID NO: 1040410 - protein, 9 aa, Homo Sapiens
KEEQERLEE

SEQ ID NO: 1040411 - protein, 9 aa, Homo Sapiens
RDDNPLNAR

SEQ ID NO: 1040412 - protein, 9 aa, Homo Sapiens
INEKKNTEE

SEQ ID NO: 1040413 - protein, 9 aa, Homo Sapiens
PCSRSCGPS

SEQ ID NO: 1040414 - protein, 9 aa, Homo Sapiens
CKNCAQFSG

SEQ ID NO: 1040415 - protein, 9 aa, Homo Sapiens
PSLQSAAYN

SEQ ID NO: 1040416 - protein, 9 aa, Homo Sapiens
ITIQTESTF

SEQ ID NO: 1040417 - protein, 9 aa, Homo Sapiens
EGKQFDSLM

SEQ ID NO: 1040418 - protein, 9 aa, Homo Sapiens
CLLERDPIL

SEQ ID NO: 1040419 - protein, 9 aa, Homo Sapiens
SHFHTFWSA

SEQ ID NO: 1040420 - protein, 9 aa, Homo Sapiens
MLVSVSQSV

SEQ ID NO: 1040421 - protein, 9 aa, Homo Sapiens
SSPTEHVKT

SEQ ID NO: 1040422 - protein, 9 aa, Homo Sapiens
IPELVHASL

SEQ ID NO: 1040423 - protein, 9 aa, Homo Sapiens
EALVNGKWQ

SEQ ID NO: 1040424 - protein, 9 aa, Homo Sapiens
LNPGKVPAF

SEQ ID NO: 1040425 - protein, 9 aa, Homo Sapiens
TLRCDPILS

SEQ ID NO: 1040426 - protein, 9 aa, Homo Sapiens
VSPECLEGS

SEQ ID NO: 1040427 - protein, 9 aa, Homo Sapiens
LMFDNVVGI

SEQ ID NO: 1040428 - protein, 9 aa, Homo Sapiens
FSYDENTEL

SEQ ID NO: 1040429 - protein, 9 aa, Homo Sapiens
TYSRNNVFS

SEQ ID NO: 1040430 - protein, 9 aa, Homo Sapiens
RKDLSLLEA

SEQ ID NO: 1040431 - protein, 9 aa, Homo Sapiens
LLTFRDGAI

SEQ ID NO: 1040432 - protein, 9 aa, Homo Sapiens
SGRPLVQNF

SEQ ID NO: 1040433 - protein, 9 aa, Homo Sapiens
DNVSEIALT

SEQ ID NO: 1040434 - protein, 9 aa, Homo Sapiens
TEMEIFVKR

SEQ ID NO: 1040435 - protein, 9 aa, Homo Sapiens
CPALPIIHN

SEQ ID NO: 1040436 - protein, 9 aa, Homo Sapiens
PQNAIFLKT

SEQ ID NO: 1040437 - protein, 9 aa, Homo Sapiens
LSVCGHGGQ

SEQ ID NO: 1040438 - protein, 9 aa, Homo Sapiens
ALQEKISIS

SEQ ID NO: 1040439 - protein, 9 aa, Homo Sapiens
QKSENGEVG

SEQ ID NO: 1040440 - protein, 9 aa, Homo Sapiens
DAWIRYALG

SEQ ID NO: 1040441 - protein, 9 aa, Homo Sapiens
LGERTFTYS

SEQ ID NO: 1040442 - protein, 9 aa, Homo Sapiens
SIILRDGNG

SEQ ID NO: 1040443 - protein, 9 aa, Homo Sapiens
SLSKQDWTS

SEQ ID NO: 1040444 - protein, 9 aa, Homo Sapiens
VNTRQKPLT

SEQ ID NO: 1040445 - protein, 9 aa, Homo Sapiens
RCDPILSHA

SEQ ID NO: 1040446 - protein, 9 aa, Homo Sapiens
ARLIQNIDA

SEQ ID NO: 1040447 - protein, 9 aa, Homo Sapiens
KTKALIEEM

SEQ ID NO: 1040448 - protein, 9 aa, Homo Sapiens
SLQGYIKAH

SEQ ID NO: 1040449 - protein, 9 aa, Homo Sapiens
TSSLSQQTL

SEQ ID NO: 1040450 - protein, 9 aa, Homo Sapiens
LSYRAKKFS

SEQ ID NO: 1040451 - protein, 9 aa, Homo Sapiens
LTDEEVDEL

SEQ ID NO: 1040452 - protein, 9 aa, Homo Sapiens
CSMLAALIA

SEQ ID NO: 1040453 - protein, 9 aa, Homo Sapiens
FGENEGNPN

SEQ ID NO: 1040454 - protein, 9 aa, Homo Sapiens
RQGKVISVI

SEQ ID NO: 1040455 - protein, 9 aa, Homo Sapiens
TVMISVVHK

SEQ ID NO: 1040456 - protein, 9 aa, Homo Sapiens
FLDYGYGGD

SEQ ID NO: 1040457 - protein, 9 aa, Homo Sapiens
QGSGQGPKE

SEQ ID NO: 1040458 - protein, 9 aa, Homo Sapiens
LKEEEKYED

SEQ ID NO: 1040459 - protein, 9 aa, Homo Sapiens
NCGLQQSSD

SEQ ID NO: 1040460 - protein, 9 aa, Homo Sapiens
ELEKITGSP

SEQ ID NO: 1040461 - protein, 9 aa, Homo Sapiens
YHVDRSENV

SEQ ID NO: 1040462 - protein, 9 aa, Homo Sapiens
YATNSWDGV

SEQ ID NO: 1040463 - protein, 9 aa, Homo Sapiens
CYFPYLKNG

SEQ ID NO: 1040464 - protein, 9 aa, Homo Sapiens
KNTIFKAWA

SEQ ID NO: 1040465 - protein, 9 aa, Homo Sapiens
YSHQMWGRL

SEQ ID NO: 1040466 - protein, 9 aa, Homo Sapiens
AHRRVHTEE

SEQ ID NO: 1040467 - protein, 9 aa, Homo Sapiens
EATDTKKKK

SEQ ID NO: 1040468 - protein, 9 aa, Homo Sapiens
ISRNILWAF

SEQ ID NO: 1040469 - protein, 9 aa, Homo Sapiens
GAMRNVTFL

SEQ ID NO: 1040470 - protein, 9 aa, Homo Sapiens
ESTEMEFDL

SEQ ID NO: 1040471 - protein, 9 aa, Homo Sapiens
LFISEPGSR

SEQ ID NO: 1040472 - protein, 9 aa, Homo Sapiens
YECTIKNSL

SEQ ID NO: 1040473 - protein, 9 aa, Homo Sapiens
STGERKQNL

SEQ ID NO: 1040474 - protein, 9 aa, Homo Sapiens
PMLRRRGRF

SEQ ID NO: 1040475 - protein, 9 aa, Homo Sapiens
FLKSHIKTK

SEQ ID NO: 1040476 - protein, 9 aa, Homo Sapiens
VNTATEIKD

SEQ ID NO: 1040477 - protein, 9 aa, Homo Sapiens
KITLDGITK

SEQ ID NO: 1040478 - protein, 9 aa, Homo Sapiens
MEHLLQISE

SEQ ID NO: 1040479 - protein, 9 aa, Homo Sapiens
WPASCSNRV

SEQ ID NO: 1040480 - protein, 9 aa, Homo Sapiens
RVPGLCLRG

SEQ ID NO: 1040481 - protein, 9 aa, Homo Sapiens
LNVLFCLFI

SEQ ID NO: 1040482 - protein, 9 aa, Homo Sapiens
SAGPLAVAG

SEQ ID NO: 1040483 - protein, 9 aa, Homo Sapiens
ETSTHADIS

SEQ ID NO: 1040484 - protein, 9 aa, Homo Sapiens
QQTLRFNPI

SEQ ID NO: 1040485 - protein, 9 aa, Homo Sapiens
TLSDKYKLN

SEQ ID NO: 1040486 - protein, 9 aa, Homo Sapiens
MAKYHRKLK

SEQ ID NO: 1040487 - protein, 9 aa, Homo Sapiens
VGNIGGNET

SEQ ID NO: 1040488 - protein, 9 aa, Homo Sapiens
PLDLKCNYF

SEQ ID NO: 1040489 - protein, 9 aa, Homo Sapiens
KKASTGKGR

SEQ ID NO: 1040490 - protein, 9 aa, Homo Sapiens
QLFTKHFFE

SEQ ID NO: 1040491 - protein, 9 aa, Homo Sapiens
NRHVALYQA

SEQ ID NO: 1040492 - protein, 9 aa, Homo Sapiens
IDMDGSTNF

SEQ ID NO: 1040493 - protein, 9 aa, Homo Sapiens
VLPYDSLQT

SEQ ID NO: 1040494 - protein, 9 aa, Homo Sapiens
IYAGKKFYK

SEQ ID NO: 1040495 - protein, 9 aa, Homo Sapiens
VHTRVKSYI

SEQ ID NO: 1040496 - protein, 9 aa, Homo Sapiens
GQTHKPDWN

SEQ ID NO: 1040497 - protein, 9 aa, Homo Sapiens
QCSTCRQAM

SEQ ID NO: 1040498 - protein, 9 aa, Homo Sapiens
TELYFDHST

SEQ ID NO: 1040499 - protein, 9 aa, Homo Sapiens
IVLEAGISH

SEQ ID NO: 1040500 - protein, 9 aa, Homo Sapiens
QYEGPQLDT

SEQ ID NO: 1040501 - protein, 9 aa, Homo Sapiens
TMKNGFRCM

SEQ ID NO: 1040502 - protein, 9 aa, Homo Sapiens
QRSLSAFSA

SEQ ID NO: 1040503 - protein, 9 aa, Homo Sapiens
RKYKDHLSN

SEQ ID NO: 1040504 - protein, 9 aa, Homo Sapiens
SFYSVFHME

SEQ ID NO: 1040505 - protein, 9 aa, Homo Sapiens
YTEENPYKC

SEQ ID NO: 1040506 - protein, 9 aa, Homo Sapiens
RTVKSEHKT

SEQ ID NO: 1040507 - protein, 9 aa, Homo Sapiens
LWIKFVSDG

SEQ ID NO: 1040508 - protein, 9 aa, Homo Sapiens
PLLEAQVAT

SEQ ID NO: 1040509 - protein, 9 aa, Homo Sapiens
YDRINGVWN

SEQ ID NO: 1040510 - protein, 9 aa, Homo Sapiens
GLIICKPVT

SEQ ID NO: 1040511 - protein, 9 aa, Homo Sapiens
GPRACCDEG

SEQ ID NO: 1040512 - protein, 9 aa, Homo Sapiens
GSCSSRSRS

SEQ ID NO: 1040513 - protein, 9 aa, Homo Sapiens
DEHIPESLY

SEQ ID NO: 1040514 - protein, 9 aa, Homo Sapiens
LLEDEVFAN

SEQ ID NO: 1040515 - protein, 9 aa, Homo Sapiens
PRGFLGPPH

SEQ ID NO: 1040516 - protein, 9 aa, Homo Sapiens
AASRLGLSS

SEQ ID NO: 1040517 - protein, 9 aa, Homo Sapiens
SSVSSRALS

SEQ ID NO: 1040518 - protein, 9 aa, Homo Sapiens
GIHDRQIPS

SEQ ID NO: 1040519 - protein, 9 aa, Homo Sapiens
GYHPSYAKP

SEQ ID NO: 1040520 - protein, 9 aa, Homo Sapiens
FRRVVKVLF

SEQ ID NO: 1040521 - protein, 9 aa, Homo Sapiens
SWGVFPEVS

SEQ ID NO: 1040522 - protein, 9 aa, Homo Sapiens
SNQQVFDWI

SEQ ID NO: 1040523 - protein, 9 aa, Homo Sapiens
FGEEPLAPQ

SEQ ID NO: 1040524 - protein, 9 aa, Homo Sapiens
FVNQGFEAV

SEQ ID NO: 1040525 - protein, 9 aa, Homo Sapiens
GEVEPRGFL

SEQ ID NO: 1040526 - protein, 9 aa, Homo Sapiens
DDFEDERVK

SEQ ID NO: 1040527 - protein, 9 aa, Homo Sapiens
ELVMDKKNQ

SEQ ID NO: 1040528 - protein, 9 aa, Homo Sapiens
FFIVLLSVY

SEQ ID NO: 1040529 - protein, 9 aa, Homo Sapiens
HGIEDNFGK

SEQ ID NO: 1040530 - protein, 9 aa, Homo Sapiens
DNGFHGHPT

SEQ ID NO: 1040531 - protein, 9 aa, Homo Sapiens
GNCGLQQSS

SEQ ID NO: 1040532 - protein, 9 aa, Homo Sapiens
ICVDMLQDG

SEQ ID NO: 1040533 - protein, 9 aa, Homo Sapiens
VVSSFNSAH

SEQ ID NO: 1040534 - protein, 9 aa, Homo Sapiens
PIIHNGHHT

SEQ ID NO: 1040535 - protein, 9 aa, Homo Sapiens
PEFCAAFYL

SEQ ID NO: 1040536 - protein, 9 aa, Homo Sapiens
QWEPFSFFF

SEQ ID NO: 1040537 - protein, 9 aa, Homo Sapiens
MCRNKIIDH

SEQ ID NO: 1040538 - protein, 9 aa, Homo Sapiens
KDTVYEEQI

SEQ ID NO: 1040539 - protein, 9 aa, Homo Sapiens
FHLRPEPPE

SEQ ID NO: 1040540 - protein, 9 aa, Homo Sapiens
YKTTTDCPN

SEQ ID NO: 1040541 - protein, 9 aa, Homo Sapiens
VTSTKYTCD

SEQ ID NO: 1040542 - protein, 9 aa, Homo Sapiens
VWAQEEAPA

SEQ ID NO: 1040543 - protein, 9 aa, Homo Sapiens
LEKFEKNVS

SEQ ID NO: 1040544 - protein, 9 aa, Homo Sapiens
SRTMAGCRD

SEQ ID NO: 1040545 - protein, 9 aa, Homo Sapiens
FRQVEEKLL

SEQ ID NO: 1040546 - protein, 9 aa, Homo Sapiens
KKTKALIEE

SEQ ID NO: 1040547 - protein, 9 aa, Homo Sapiens
NLFLSCDKD

SEQ ID NO: 1040548 - protein, 9 aa, Homo Sapiens
LPQQLLLVH

SEQ ID NO: 1040549 - protein, 9 aa, Homo Sapiens
PNFFPISEK

SEQ ID NO: 1040550 - protein, 9 aa, Homo Sapiens
GQRSSRALP

SEQ ID NO: 1040551 - protein, 9 aa, Homo Sapiens
AFTQCSHFR

SEQ ID NO: 1040552 - protein, 9 aa, Homo Sapiens
TTWEYNDNS

SEQ ID NO: 1040553 - protein, 9 aa, Homo Sapiens
LSQNGPVHA

SEQ ID NO: 1040554 - protein, 9 aa, Homo Sapiens
LQEPERTPA

SEQ ID NO: 1040555 - protein, 9 aa, Homo Sapiens
CAEKSNAGV

SEQ ID NO: 1040556 - protein, 9 aa, Homo Sapiens
SWGYVLLNV

SEQ ID NO: 1040557 - protein, 9 aa, Homo Sapiens
SYVKIEKVI

SEQ ID NO: 1040558 - protein, 9 aa, Homo Sapiens
ESQSVSHNL

SEQ ID NO: 1040559 - protein, 9 aa, Homo Sapiens
SDGSLSPLL

SEQ ID NO: 1040560 - protein, 9 aa, Homo Sapiens
GEFRLLSSI

SEQ ID NO: 1040561 - protein, 9 aa, Homo Sapiens
MEIGTLGTT

SEQ ID NO: 1040562 - protein, 9 aa, Homo Sapiens
HRWTQTLSE

SEQ ID NO: 1040563 - protein, 9 aa, Homo Sapiens
PEGSIPPST

SEQ ID NO: 1040564 - protein, 9 aa, Homo Sapiens
LCFCASLLR

SEQ ID NO: 1040565 - protein, 9 aa, Homo Sapiens
SELPAVGGN

SEQ ID NO: 1040566 - protein, 9 aa, Homo Sapiens
PKRSPTPPG

SEQ ID NO: 1040567 - protein, 9 aa, Homo Sapiens
RVAHINEKK

SEQ ID NO: 1040568 - protein, 9 aa, Homo Sapiens
IDLEEKLSA

SEQ ID NO: 1040569 - protein, 9 aa, Homo Sapiens
VKVDGPELK

SEQ ID NO: 1040570 - protein, 9 aa, Homo Sapiens
SHDEALVLN

SEQ ID NO: 1040571 - protein, 9 aa, Homo Sapiens
YFYRDSEET

SEQ ID NO: 1040572 - protein, 9 aa, Homo Sapiens
FISEPGSRI

SEQ ID NO: 1040573 - protein, 9 aa, Homo Sapiens
NIEFIRDSL

SEQ ID NO: 1040574 - protein, 9 aa, Homo Sapiens
DSVHNLLRA

SEQ ID NO: 1040575 - protein, 9 aa, Homo Sapiens
IRIWMLNDI

SEQ ID NO: 1040576 - protein, 9 aa, Homo Sapiens
IFQIQGEME

SEQ ID NO: 1040577 - protein, 9 aa, Homo Sapiens
EIHQKIYTE

SEQ ID NO: 1040578 - protein, 9 aa, Homo Sapiens
RLCQKTMAS

SEQ ID NO: 1040579 - protein, 9 aa, Homo Sapiens
TEENPYKCV

SEQ ID NO: 1040580 - protein, 9 aa, Homo Sapiens
KPRAIALSV

SEQ ID NO: 1040581 - protein, 9 aa, Homo Sapiens
YRDCFQALK

SEQ ID NO: 1040582 - protein, 9 aa, Homo Sapiens
WRGDELTQH

SEQ ID NO: 1040583 - protein, 9 aa, Homo Sapiens
FWEDPKKFA

SEQ ID NO: 1040584 - protein, 9 aa, Homo Sapiens
WEGKQFDSL

SEQ ID NO: 1040585 - protein, 9 aa, Homo Sapiens
HLFEKKLAG

SEQ ID NO: 1040586 - protein, 9 aa, Homo Sapiens
EESENAYNI

SEQ ID NO: 1040587 - protein, 9 aa, Homo Sapiens
KQLECPFSF

SEQ ID NO: 1040588 - protein, 9 aa, Homo Sapiens
FLSDSQLGT

SEQ ID NO: 1040589 - protein, 9 aa, Homo Sapiens
ALVKRFKTN

SEQ ID NO: 1040590 - protein, 9 aa, Homo Sapiens
ILLFYALIL

SEQ ID NO: 1040591 - protein, 9 aa, Homo Sapiens
FRIMQILRI

SEQ ID NO: 1040592 - protein, 9 aa, Homo Sapiens
DNSPFVLYL

SEQ ID NO: 1040593 - protein, 9 aa, Homo Sapiens
VSSRALSPD

SEQ ID NO: 1040594 - protein, 9 aa, Homo Sapiens
RNFTAVTDF

SEQ ID NO: 1040595 - protein, 9 aa, Homo Sapiens
RSPSPGKCK

SEQ ID NO: 1040596 - protein, 9 aa, Homo Sapiens
FAKGKFYHF

SEQ ID NO: 1040597 - protein, 9 aa, Homo Sapiens
GSRGRAEGR

SEQ ID NO: 1040598 - protein, 9 aa, Homo Sapiens
NFAKDVLDK

SEQ ID NO: 1040599 - protein, 9 aa, Homo Sapiens
SQGPPPCPG

SEQ ID NO: 1040600 - protein, 9 aa, Homo Sapiens
RDDMNFTEL

SEQ ID NO: 1040601 - protein, 9 aa, Homo Sapiens
NNPQDDIAT

SEQ ID NO: 1040602 - protein, 9 aa, Homo Sapiens
KILQKLKCL

SEQ ID NO: 1040603 - protein, 9 aa, Homo Sapiens
SAPDSKRQS

SEQ ID NO: 1040604 - protein, 9 aa, Homo Sapiens
TIINPSVIS

SEQ ID NO: 1040605 - protein, 9 aa, Homo Sapiens
KQDWTSSTI

SEQ ID NO: 1040606 - protein, 9 aa, Homo Sapiens
EMPYIDAVV

SEQ ID NO: 1040607 - protein, 9 aa, Homo Sapiens
GSFFKRNPG

SEQ ID NO: 1040608 - protein, 9 aa, Homo Sapiens
LVHASLCRS

SEQ ID NO: 1040609 - protein, 9 aa, Homo Sapiens
TIDPISGKI

SEQ ID NO: 1040610 - protein, 9 aa, Homo Sapiens
ETTMDYRAN

SEQ ID NO: 1040611 - protein, 9 aa, Homo Sapiens
QKAFYTCAS

SEQ ID NO: 1040612 - protein, 9 aa, Homo Sapiens
VYLIINSIN

SEQ ID NO: 1040613 - protein, 9 aa, Homo Sapiens
NTRQKPLTP

SEQ ID NO: 1040614 - protein, 9 aa, Homo Sapiens
AFCSGSDLT

SEQ ID NO: 1040615 - protein, 9 aa, Homo Sapiens
DYLSETITP

SEQ ID NO: 1040616 - protein, 9 aa, Homo Sapiens
PIFIVNATN

SEQ ID NO: 1040617 - protein, 9 aa, Homo Sapiens
QYFAHFCYQ

SEQ ID NO: 1040618 - protein, 9 aa, Homo Sapiens
RKLSLAGNL

SEQ ID NO: 1040619 - protein, 9 aa, Homo Sapiens
LRRGPEEDS

SEQ ID NO: 1040620 - protein, 9 aa, Homo Sapiens
ALSGSSSWH

SEQ ID NO: 1040621 - protein, 9 aa, Homo Sapiens
QEGEGNCFS

SEQ ID NO: 1040622 - protein, 9 aa, Homo Sapiens
IYSKFIEAD

SEQ ID NO: 1040623 - protein, 9 aa, Homo Sapiens
PKFPRATRK

SEQ ID NO: 1040624 - protein, 9 aa, Homo Sapiens
TFLIAVAHH

SEQ ID NO: 1040625 - protein, 9 aa, Homo Sapiens
YIRPMQKKI

SEQ ID NO: 1040626 - protein, 9 aa, Homo Sapiens
GSHPLPSKI

SEQ ID NO: 1040627 - protein, 9 aa, Homo Sapiens
DTINWTDWN

SEQ ID NO: 1040628 - protein, 9 aa, Homo Sapiens
ILISRRHFW

SEQ ID NO: 1040629 - protein, 9 aa, Homo Sapiens
KITLCIFVL

SEQ ID NO: 1040630 - protein, 9 aa, Homo Sapiens
ANFFNTFLS

SEQ ID NO: 1040631 - protein, 9 aa, Homo Sapiens
QKIREDLIG

SEQ ID NO: 1040632 - protein, 9 aa, Homo Sapiens
YLPATVESA

SEQ ID NO: 1040633 - protein, 9 aa, Homo Sapiens
PCPGKPEGP

SEQ ID NO: 1040634 - protein, 9 aa, Homo Sapiens
PDSKAQYTS

SEQ ID NO: 1040635 - protein, 9 aa, Homo Sapiens
GFFVTLDDL

SEQ ID NO: 1040636 - protein, 9 aa, Homo Sapiens
KSTPEAPEN

SEQ ID NO: 1040637 - protein, 9 aa, Homo Sapiens
YFIGMAIKI

SEQ ID NO: 1040638 - protein, 9 aa, Homo Sapiens
KTDEEAQLL

SEQ ID NO: 1040639 - protein, 9 aa, Homo Sapiens
CDETELQGE

SEQ ID NO: 1040640 - protein, 9 aa, Homo Sapiens
SFSFMPRVL

SEQ ID NO: 1040641 - protein, 9 aa, Homo Sapiens
VKAVEVPLK

SEQ ID NO: 1040642 - protein, 9 aa, Homo Sapiens
ILTGMLIEL

SEQ ID NO: 1040643 - protein, 9 aa, Homo Sapiens
AALLAQFVN

SEQ ID NO: 1040644 - protein, 9 aa, Homo Sapiens
KGEKGEMGK

SEQ ID NO: 1040645 - protein, 9 aa, Homo Sapiens
DMNFTELIV

SEQ ID NO: 1040646 - protein, 9 aa, Homo Sapiens
PHLAPEYTG

SEQ ID NO: 1040647 - protein, 9 aa, Homo Sapiens
KIHLHSFKI

SEQ ID NO: 1040648 - protein, 9 aa, Homo Sapiens
STKTLSKDD

SEQ ID NO: 1040649 - protein, 9 aa, Homo Sapiens
MEHKGEFTC

SEQ ID NO: 1040650 - protein, 9 aa, Homo Sapiens
FTLQKLGGL

SEQ ID NO: 1040651 - protein, 9 aa, Homo Sapiens
LSNVWRFPY

SEQ ID NO: 1040652 - protein, 9 aa, Homo Sapiens
EPRTESSRH

SEQ ID NO: 1040653 - protein, 9 aa, Homo Sapiens
YDRCPNKVA

SEQ ID NO: 1040654 - protein, 9 aa, Homo Sapiens
DVIVTAADK

SEQ ID NO: 1040655 - protein, 9 aa, Homo Sapiens
QSHASDTSA

SEQ ID NO: 1040656 - protein, 9 aa, Homo Sapiens
CIFVLLSLT

SEQ ID NO: 1040657 - protein, 9 aa, Homo Sapiens
EACLTESLR

SEQ ID NO: 1040658 - protein, 9 aa, Homo Sapiens
GLAGPKRER

SEQ ID NO: 1040659 - protein, 9 aa, Homo Sapiens
LGTFLIAVA

SEQ ID NO: 1040660 - protein, 9 aa, Homo Sapiens
ASLLRFKVH

SEQ ID NO: 1040661 - protein, 9 aa, Homo Sapiens
VNKADYRKD

SEQ ID NO: 1040662 - protein, 9 aa, Homo Sapiens
SVVFWRLIA

SEQ ID NO: 1040663 - protein, 9 aa, Homo Sapiens
VKTNRREVE

SEQ ID NO: 1040664 - protein, 9 aa, Homo Sapiens
GPASLQPVP

SEQ ID NO: 1040665 - protein, 9 aa, Homo Sapiens
RLFQEVPKQ

SEQ ID NO: 1040666 - protein, 9 aa, Homo Sapiens
LRLLNEDHT

SEQ ID NO: 1040667 - protein, 9 aa, Homo Sapiens
SIEKVERIL

SEQ ID NO: 1040668 - protein, 9 aa, Homo Sapiens
QPQVYGNNI

SEQ ID NO: 1040669 - protein, 9 aa, Homo Sapiens
RSLAEVLVP

SEQ ID NO: 1040670 - protein, 9 aa, Homo Sapiens
DLMTYGRRQ

SEQ ID NO: 1040671 - protein, 9 aa, Homo Sapiens
CPTVNFIVS

SEQ ID NO: 1040672 - protein, 9 aa, Homo Sapiens
SEIGKKFGL

SEQ ID NO: 1040673 - protein, 9 aa, Homo Sapiens
GKMNHRDLL

SEQ ID NO: 1040674 - protein, 9 aa, Homo Sapiens
EPGYNLRGA

SEQ ID NO: 1040675 - protein, 9 aa, Homo Sapiens
VTLSTEEIF

SEQ ID NO: 1040676 - protein, 9 aa, Homo Sapiens
EGLIALVAV

SEQ ID NO: 1040677 - protein, 9 aa, Homo Sapiens
EGGRCSFSI

SEQ ID NO: 1040678 - protein, 9 aa, Homo Sapiens
EKFQNWDCN

SEQ ID NO: 1040679 - protein, 9 aa, Homo Sapiens
VVIDQMLDR

SEQ ID NO: 1040680 - protein, 9 aa, Homo Sapiens
PQAPLAGQP

SEQ ID NO: 1040681 - protein, 9 aa, Homo Sapiens
SLSKKESSN

SEQ ID NO: 1040682 - protein, 9 aa, Homo Sapiens
SIPSVPTFQ

SEQ ID NO: 1040683 - protein, 9 aa, Homo Sapiens
CLRAQPVTD

SEQ ID NO: 1040684 - protein, 9 aa, Homo Sapiens
LLNVKATGY

SEQ ID NO: 1040685 - protein, 9 aa, Homo Sapiens
SNVWRFPYL

SEQ ID NO: 1040686 - protein, 9 aa, Homo Sapiens
PCQCVSHGS

SEQ ID NO: 1040687 - protein, 9 aa, Homo Sapiens
LLNVLFCLF

SEQ ID NO: 1040688 - protein, 9 aa, Homo Sapiens
KALIEEMGM

SEQ ID NO: 1040689 - protein, 9 aa, Homo Sapiens
LFFGACCST

SEQ ID NO: 1040690 - protein, 9 aa, Homo Sapiens
TRKQQEIHY

SEQ ID NO: 1040691 - protein, 9 aa, Homo Sapiens
ECLKFKKGP

SEQ ID NO: 1040692 - protein, 9 aa, Homo Sapiens
DRLTDEEVD

SEQ ID NO: 1040693 - protein, 9 aa, Homo Sapiens
RLCNLVFSP

SEQ ID NO: 1040694 - protein, 9 aa, Homo Sapiens
IAAGMEYLF

SEQ ID NO: 1040695 - protein, 9 aa, Homo Sapiens
TFRHRAILD

SEQ ID NO: 1040696 - protein, 9 aa, Homo Sapiens
TPPPKKEPL

SEQ ID NO: 1040697 - protein, 9 aa, Homo Sapiens
GWTEERRAV

SEQ ID NO: 1040698 - protein, 9 aa, Homo Sapiens
IQQLQSLAL

SEQ ID NO: 1040699 - protein, 9 aa, Homo Sapiens
HGESTSGGQ

SEQ ID NO: 1040700 - protein, 9 aa, Homo Sapiens
VPELSKPRQ

SEQ ID NO: 1040701 - protein, 9 aa, Homo Sapiens
LTYNGNKNL

SEQ ID NO: 1040702 - protein, 9 aa, Homo Sapiens
GSGGNSAPF

SEQ ID NO: 1040703 - protein, 9 aa, Homo Sapiens
FSLDKVHAK

SEQ ID NO: 1040704 - protein, 9 aa, Homo Sapiens
YNCSCVKVT

SEQ ID NO: 1040705 - protein, 9 aa, Homo Sapiens
QEKYADSSG

SEQ ID NO: 1040706 - protein, 9 aa, Homo Sapiens
LQKLKCLSG

SEQ ID NO: 1040707 - protein, 9 aa, Homo Sapiens
DGHEITVGI

SEQ ID NO: 1040708 - protein, 9 aa, Homo Sapiens
KVERILDET

SEQ ID NO: 1040709 - protein, 9 aa, Homo Sapiens
SCSKTCNSE

SEQ ID NO: 1040710 - protein, 9 aa, Homo Sapiens
ADLDPSVLP

SEQ ID NO: 1040711 - protein, 9 aa, Homo Sapiens
ISRHEMPLG

SEQ ID NO: 1040712 - protein, 9 aa, Homo Sapiens
GPLCQWSRM

SEQ ID NO: 1040713 - protein, 9 aa, Homo Sapiens
PILQLEKCC

SEQ ID NO: 1040714 - protein, 9 aa, Homo Sapiens
SLKLLAQRH

SEQ ID NO: 1040715 - protein, 9 aa, Homo Sapiens
GAGESESEH

SEQ ID NO: 1040716 - protein, 9 aa, Homo Sapiens
GTQQRKVIC

SEQ ID NO: 1040717 - protein, 9 aa, Homo Sapiens
YRDSEETEK

SEQ ID NO: 1040718 - protein, 9 aa, Homo Sapiens
ENTVYQEAR

SEQ ID NO: 1040719 - protein, 9 aa, Homo Sapiens
GRESCHSPV

SEQ ID NO: 1040720 - protein, 9 aa, Homo Sapiens
HGFLRTKIK

SEQ ID NO: 1040721 - protein, 9 aa, Homo Sapiens
IVFSILRIF

SEQ ID NO: 1040722 - protein, 9 aa, Homo Sapiens
IIKLSHKKM

SEQ ID NO: 1040723 - protein, 9 aa, Homo Sapiens
SANQAAFGV

SEQ ID NO: 1040724 - protein, 9 aa, Homo Sapiens
LKWNLTNNV

SEQ ID NO: 1040725 - protein, 9 aa, Homo Sapiens
LGSSDPSLQ

SEQ ID NO: 1040726 - protein, 9 aa, Homo Sapiens
GKLQEHKAQ

SEQ ID NO: 1040727 - protein, 9 aa, Homo Sapiens
LSETITPRG

SEQ ID NO: 1040728 - protein, 9 aa, Homo Sapiens
RAPIRIWML

SEQ ID NO: 1040729 - protein, 9 aa, Homo Sapiens
RVVSSFNSA

SEQ ID NO: 1040730 - protein, 9 aa, Homo Sapiens
SLSVGNKRM

SEQ ID NO: 1040731 - protein, 9 aa, Homo Sapiens
TVNGKKQFN

SEQ ID NO: 1040732 - protein, 9 aa, Homo Sapiens
FLAAEQLLK

SEQ ID NO: 1040733 - protein, 9 aa, Homo Sapiens
LSNTATTII

SEQ ID NO: 1040734 - protein, 9 aa, Homo Sapiens
EDAQALKEL

SEQ ID NO: 1040735 - protein, 9 aa, Homo Sapiens
VDKITISGR

SEQ ID NO: 1040736 - protein, 9 aa, Homo Sapiens
RRQQGQEKQ

SEQ ID NO: 1040737 - protein, 9 aa, Homo Sapiens
FLSCIMQTY

SEQ ID NO: 1040738 - protein, 9 aa, Homo Sapiens
GVLMCIKCS

SEQ ID NO: 1040739 - protein, 9 aa, Homo Sapiens
SSLANSSPP

SEQ ID NO: 1040740 - protein, 9 aa, Homo Sapiens
EKAITVLFR

SEQ ID NO: 1040741 - protein, 9 aa, Homo Sapiens
LLFGGKLSL

SEQ ID NO: 1040742 - protein, 9 aa, Homo Sapiens
SQLATCGHL

SEQ ID NO: 1040743 - protein, 9 aa, Homo Sapiens
QVIGYRNAE

SEQ ID NO: 1040744 - protein, 9 aa, Homo Sapiens
PSSQYFLSN

SEQ ID NO: 1040745 - protein, 9 aa, Homo Sapiens
HAICTKTGA

SEQ ID NO: 1040746 - protein, 9 aa, Homo Sapiens
NGSLVGGFV

SEQ ID NO: 1040747 - protein, 9 aa, Homo Sapiens
ISPRNCGSP

SEQ ID NO: 1040748 - protein, 9 aa, Homo Sapiens
CSPHINVYL

SEQ ID NO: 1040749 - protein, 9 aa, Homo Sapiens
DNNDIYGAA

SEQ ID NO: 1040750 - protein, 9 aa, Homo Sapiens
AEYVVPGCQ

SEQ ID NO: 1040751 - protein, 9 aa, Homo Sapiens
LLLVHQGET

SEQ ID NO: 1040752 - protein, 9 aa, Homo Sapiens
TLASEVEEE

SEQ ID NO: 1040753 - protein, 9 aa, Homo Sapiens
EPQGPSLFT

SEQ ID NO: 1040754 - protein, 9 aa, Homo Sapiens
MISWMETSV

SEQ ID NO: 1040755 - protein, 9 aa, Homo Sapiens
KKLTTLFRR

SEQ ID NO: 1040756 - protein, 9 aa, Homo Sapiens
VTSLSSTSE

SEQ ID NO: 1040757 - protein, 9 aa, Homo Sapiens
AQILDPFAP

SEQ ID NO: 1040758 - protein, 9 aa, Homo Sapiens
LENTNVRLN

SEQ ID NO: 1040759 - protein, 9 aa, Homo Sapiens
IKKMFGKNQ

SEQ ID NO: 1040760 - protein, 9 aa, Homo Sapiens
CEFHLFFVL

SEQ ID NO: 1040761 - protein, 9 aa, Homo Sapiens
SHHLSAFET

SEQ ID NO: 1040762 - protein, 9 aa, Homo Sapiens
KSRGGPNGD

SEQ ID NO: 1040763 - protein, 9 aa, Homo Sapiens
FFLRNFFFL

SEQ ID NO: 1040764 - protein, 9 aa, Homo Sapiens
TKYTLLYRN

SEQ ID NO: 1040765 - protein, 9 aa, Homo Sapiens
ESEGDENED

SEQ ID NO: 1040766 - protein, 9 aa, Homo Sapiens
NKKFKSALR

SEQ ID NO: 1040767 - protein, 9 aa, Homo Sapiens
QKSKKEPGV

SEQ ID NO: 1040768 - protein, 9 aa, Homo Sapiens
MPPQASSFH

SEQ ID NO: 1040769 - protein, 9 aa, Homo Sapiens
FSSVPVGTA

SEQ ID NO: 1040770 - protein, 9 aa, Homo Sapiens
LIRILYGRM

SEQ ID NO: 1040771 - protein, 9 aa, Homo Sapiens
PVLVPRHSK

SEQ ID NO: 1040772 - protein, 9 aa, Homo Sapiens
VEKNGTIIF

SEQ ID NO: 1040773 - protein, 9 aa, Homo Sapiens
AAVTLQFQA

SEQ ID NO: 1040774 - protein, 9 aa, Homo Sapiens
EMLSRSLMR

SEQ ID NO: 1040775 - protein, 9 aa, Homo Sapiens
SKHFPKPER

SEQ ID NO: 1040776 - protein, 9 aa, Homo Sapiens
ADHLNGLLQ

SEQ ID NO: 1040777 - protein, 9 aa, Homo Sapiens
FFIMLFCLR

SEQ ID NO: 1040778 - protein, 9 aa, Homo Sapiens
DEESENAYN

SEQ ID NO: 1040779 - protein, 9 aa, Homo Sapiens
GNGEPLPVP

SEQ ID NO: 1040780 - protein, 9 aa, Homo Sapiens
QESISERIK

SEQ ID NO: 1040781 - protein, 9 aa, Homo Sapiens
SNLKKPITE

SEQ ID NO: 1040782 - protein, 9 aa, Homo Sapiens
LQAAPVPGD

SEQ ID NO: 1040783 - protein, 9 aa, Homo Sapiens
SAFIEPRYH

SEQ ID NO: 1040784 - protein, 9 aa, Homo Sapiens
EWSMSFFFF

SEQ ID NO: 1040785 - protein, 9 aa, Homo Sapiens
DFEDERVKR

SEQ ID NO: 1040786 - protein, 9 aa, Homo Sapiens
QRTIFFVGC

SEQ ID NO: 1040787 - protein, 9 aa, Homo Sapiens
VQEHTDQIR

SEQ ID NO: 1040788 - protein, 9 aa, Homo Sapiens
PEKPQGPPP

SEQ ID NO: 1040789 - protein, 9 aa, Homo Sapiens
LQAAFEECD

SEQ ID NO: 1040790 - protein, 9 aa, Homo Sapiens
NSGNTFKYS

SEQ ID NO: 1040791 - protein, 9 aa, Homo Sapiens
CKRHRSRSP

SEQ ID NO: 1040792 - protein, 9 aa, Homo Sapiens
KLKNCSPHI

SEQ ID NO: 1040793 - protein, 9 aa, Homo Sapiens
NSDHWGPHC

SEQ ID NO: 1040794 - protein, 9 aa, Homo Sapiens
IESYVDKQM

SEQ ID NO: 1040795 - protein, 9 aa, Homo Sapiens
ESFGRDSFL

SEQ ID NO: 1040796 - protein, 9 aa, Homo Sapiens
QSLASSGYA

SEQ ID NO: 1040797 - protein, 9 aa, Homo Sapiens
KDLRNDSSD

SEQ ID NO: 1040798 - protein, 9 aa, Homo Sapiens
EWAAVTLQF

SEQ ID NO: 1040799 - protein, 9 aa, Homo Sapiens
NHLLIKAAQ

SEQ ID NO: 1040800 - protein, 9 aa, Homo Sapiens
LTRHKKIYT

SEQ ID NO: 1040801 - protein, 9 aa, Homo Sapiens
TGSFFKRNP

SEQ ID NO: 1040802 - protein, 9 aa, Homo Sapiens
AQNEDVDLV

SEQ ID NO: 1040803 - protein, 9 aa, Homo Sapiens
VDAPAPSKR

SEQ ID NO: 1040804 - protein, 9 aa, Homo Sapiens
CAWDAWIRY

SEQ ID NO: 1040805 - protein, 9 aa, Homo Sapiens
IVIFLVCLA

SEQ ID NO: 1040806 - protein, 9 aa, Homo Sapiens
IPNVRPWHR

SEQ ID NO: 1040807 - protein, 9 aa, Homo Sapiens
VNFAVPMDS

SEQ ID NO: 1040808 - protein, 9 aa, Homo Sapiens
AQREALGLV

SEQ ID NO: 1040809 - protein, 9 aa, Homo Sapiens
PAKSLEKFI

SEQ ID NO: 1040810 - protein, 9 aa, Homo Sapiens
KLAEYVVPG

SEQ ID NO: 1040811 - protein, 9 aa, Homo Sapiens
KYLKKEMNF

SEQ ID NO: 1040812 - protein, 9 aa, Homo Sapiens
KENFVIFNN

SEQ ID NO: 1040813 - protein, 9 aa, Homo Sapiens
YPPLKFGIV

SEQ ID NO: 1040814 - protein, 9 aa, Homo Sapiens
RVHTEENPY

SEQ ID NO: 1040815 - protein, 9 aa, Homo Sapiens
SDQDLNRAE

SEQ ID NO: 1040816 - protein, 9 aa, Homo Sapiens
NEGEAEKPS

SEQ ID NO: 1040817 - protein, 9 aa, Homo Sapiens
EAASLGAPS

SEQ ID NO: 1040818 - protein, 9 aa, Homo Sapiens
GQRVCVIDG

SEQ ID NO: 1040819 - protein, 9 aa, Homo Sapiens
SLATESNTV

SEQ ID NO: 1040820 - protein, 9 aa, Homo Sapiens
YDSSSPTEH

SEQ ID NO: 1040821 - protein, 9 aa, Homo Sapiens
GIYSLSVGN

SEQ ID NO: 1040822 - protein, 9 aa, Homo Sapiens
MFIIFCYTF

SEQ ID NO: 1040823 - protein, 9 aa, Homo Sapiens
YQSSLENLT

SEQ ID NO: 1040824 - protein, 9 aa, Homo Sapiens
TVLAALEAR

SEQ ID NO: 1040825 - protein, 9 aa, Homo Sapiens
KLLCKILQR

SEQ ID NO: 1040826 - protein, 9 aa, Homo Sapiens
PSLPSRNIK

SEQ ID NO: 1040827 - protein, 9 aa, Homo Sapiens
DAVFVLGLA

SEQ ID NO: 1040828 - protein, 9 aa, Homo Sapiens
FLASDPHEL

SEQ ID NO: 1040829 - protein, 9 aa, Homo Sapiens
FGPSEILEL

SEQ ID NO: 1040830 - protein, 9 aa, Homo Sapiens
YIGGIHDRQ

SEQ ID NO: 1040831 - protein, 9 aa, Homo Sapiens
KKFDKGVRK

SEQ ID NO: 1040832 - protein, 9 aa, Homo Sapiens
STFHVQSWY

SEQ ID NO: 1040833 - protein, 9 aa, Homo Sapiens
PTSDLPQPH

SEQ ID NO: 1040834 - protein, 9 aa, Homo Sapiens
KSHYHHGYH

SEQ ID NO: 1040835 - protein, 9 aa, Homo Sapiens
DDVIDQAPA

SEQ ID NO: 1040836 - protein, 9 aa, Homo Sapiens
AHAAPPSPP

SEQ ID NO: 1040837 - protein, 9 aa, Homo Sapiens
INKKLPIHQ

SEQ ID NO: 1040838 - protein, 9 aa, Homo Sapiens
KPLPPTSDL

SEQ ID NO: 1040839 - protein, 9 aa, Homo Sapiens
GKPAVAMPG

SEQ ID NO: 1040840 - protein, 9 aa, Homo Sapiens
HLHGSHRGH

SEQ ID NO: 1040841 - protein, 9 aa, Homo Sapiens
TTFKKPQSL

SEQ ID NO: 1040842 - protein, 9 aa, Homo Sapiens
YRRADKKKR

SEQ ID NO: 1040843 - protein, 9 aa, Homo Sapiens
APLAGCSTR

SEQ ID NO: 1040844 - protein, 9 aa, Homo Sapiens
QCLLKKFKT

SEQ ID NO: 1040845 - protein, 9 aa, Homo Sapiens
HEDWKKEKK

SEQ ID NO: 1040846 - protein, 9 aa, Homo Sapiens
AEDRVSLSK

SEQ ID NO: 1040847 - protein, 9 aa, Homo Sapiens
YPPLVSGVL

SEQ ID NO: 1040848 - protein, 9 aa, Homo Sapiens
WLSLSSNLG

SEQ ID NO: 1040849 - protein, 9 aa, Homo Sapiens
AALVMLFFG

SEQ ID NO: 1040850 - protein, 9 aa, Homo Sapiens
VDLKLHVTT

SEQ ID NO: 1040851 - protein, 9 aa, Homo Sapiens
PGFGLGAVV

SEQ ID NO: 1040852 - protein, 9 aa, Homo Sapiens
LFPILIRIL

SEQ ID NO: 1040853 - protein, 9 aa, Homo Sapiens
SLDCYLAIC

SEQ ID NO: 1040854 - protein, 9 aa, Homo Sapiens
QSPCCRPLC

SEQ ID NO: 1040855 - protein, 9 aa, Homo Sapiens
VTHTTVTMR

SEQ ID NO: 1040856 - protein, 9 aa, Homo Sapiens
ICLSSGSLQ

SEQ ID NO: 1040857 - protein, 9 aa, Homo Sapiens
NQQKNPPPT

SEQ ID NO: 1040858 - protein, 9 aa, Homo Sapiens
SVFHQEDLE

SEQ ID NO: 1040859 - protein, 9 aa, Homo Sapiens
CGSSIQQLK

SEQ ID NO: 1040860 - protein, 9 aa, Homo Sapiens
MYHINLNQV

SEQ ID NO: 1040861 - protein, 9 aa, Homo Sapiens
EAFLLSADS

SEQ ID NO: 1040862 - protein, 9 aa, Homo Sapiens
LSQLQNSGD

SEQ ID NO: 1040863 - protein, 9 aa, Homo Sapiens
RKTLFKEDF

SEQ ID NO: 1040864 - protein, 9 aa, Homo Sapiens
KLENRCQEL

SEQ ID NO: 1040865 - protein, 9 aa, Homo Sapiens
LRFVAPDVF

SEQ ID NO: 1040866 - protein, 9 aa, Homo Sapiens
ILNKKLLPR

SEQ ID NO: 1040867 - protein, 9 aa, Homo Sapiens
KFFPKLLGN

SEQ ID NO: 1040868 - protein, 9 aa, Homo Sapiens
DENSDIWLS

SEQ ID NO: 1040869 - protein, 9 aa, Homo Sapiens
IYAASSGNL

SEQ ID NO: 1040870 - protein, 9 aa, Homo Sapiens
ETLAEDAVF

SEQ ID NO: 1040871 - protein, 9 aa, Homo Sapiens
SFLTCLAGN

SEQ ID NO: 1040872 - protein, 9 aa, Homo Sapiens
IPYGFLEEV

SEQ ID NO: 1040873 - protein, 9 aa, Homo Sapiens
LCTFSWLIF

SEQ ID NO: 1040874 - protein, 9 aa, Homo Sapiens
AKFTALYGD

SEQ ID NO: 1040875 - protein, 9 aa, Homo Sapiens
KKPDYTAYV

SEQ ID NO: 1040876 - protein, 9 aa, Homo Sapiens
LDLTDELAP

SEQ ID NO: 1040877 - protein, 9 aa, Homo Sapiens
HTEAYTTFI

SEQ ID NO: 1040878 - protein, 9 aa, Homo Sapiens
KFYADHSRL

SEQ ID NO: 1040879 - protein, 9 aa, Homo Sapiens
GLQEKNALR

SEQ ID NO: 1040880 - protein, 9 aa, Homo Sapiens
HPLDQSVWV

SEQ ID NO: 1040881 - protein, 9 aa, Homo Sapiens
GMEIDEAAN

SEQ ID NO: 1040882 - protein, 9 aa, Homo Sapiens
LCLRYPLSY

SEQ ID NO: 1040883 - protein, 9 aa, Homo Sapiens
FAIMIPSGG

SEQ ID NO: 1040884 - protein, 9 aa, Homo Sapiens
KDKKITLKV

SEQ ID NO: 1040885 - protein, 9 aa, Homo Sapiens
QPVKPLNRA

SEQ ID NO: 1040886 - protein, 9 aa, Homo Sapiens
LENYRNLLL

SEQ ID NO: 1040887 - protein, 9 aa, Homo Sapiens
TTVMRFLTQ

SEQ ID NO: 1040888 - protein, 9 aa, Homo Sapiens
SRRQRVFFG

SEQ ID NO: 1040889 - protein, 9 aa, Homo Sapiens
YLYREPVLG

SEQ ID NO: 1040890 - protein, 9 aa, Homo Sapiens
DFLASLVLC

SEQ ID NO: 1040891 - protein, 9 aa, Homo Sapiens
FHSGTAATS

SEQ ID NO: 1040892 - protein, 9 aa, Homo Sapiens
KVMKRQVEE

SEQ ID NO: 1040893 - protein, 9 aa, Homo Sapiens
GRDSGPAPP

SEQ ID NO: 1040894 - protein, 9 aa, Homo Sapiens
QHAPSEFVD

SEQ ID NO: 1040895 - protein, 9 aa, Homo Sapiens
EGTAGSWGV

SEQ ID NO: 1040896 - protein, 9 aa, Homo Sapiens
WCKKTKHEL

SEQ ID NO: 1040897 - protein, 9 aa, Homo Sapiens
RSSCFWLLV

SEQ ID NO: 1040898 - protein, 9 aa, Homo Sapiens
AERKIRQKL

SEQ ID NO: 1040899 - protein, 9 aa, Homo Sapiens
FTKHFFEAA

SEQ ID NO: 1040900 - protein, 9 aa, Homo Sapiens
GLKILSTKN

SEQ ID NO: 1040901 - protein, 9 aa, Homo Sapiens
NENGTWPRQ

SEQ ID NO: 1040902 - protein, 9 aa, Homo Sapiens
SLELDDWLV

SEQ ID NO: 1040903 - protein, 9 aa, Homo Sapiens
FSVYKKQVE

SEQ ID NO: 1040904 - protein, 9 aa, Homo Sapiens
FHVGRFHKL

SEQ ID NO: 1040905 - protein, 9 aa, Homo Sapiens
PPALRPAPG

SEQ ID NO: 1040906 - protein, 9 aa, Homo Sapiens
LSSYDLILA

SEQ ID NO: 1040907 - protein, 9 aa, Homo Sapiens
LSGSQTQPP

SEQ ID NO: 1040908 - protein, 9 aa, Homo Sapiens
VLMLGFVVV

SEQ ID NO: 1040909 - protein, 9 aa, Homo Sapiens
RKGLPRPLP

SEQ ID NO: 1040910 - protein, 9 aa, Homo Sapiens
KDINDNTPV

SEQ ID NO: 1040911 - protein, 9 aa, Homo Sapiens
VHVPFPCDE

SEQ ID NO: 1040912 - protein, 9 aa, Homo Sapiens
TVVGCLGLV

SEQ ID NO: 1040913 - protein, 9 aa, Homo Sapiens
DLEYKIQRK

SEQ ID NO: 1040914 - protein, 9 aa, Homo Sapiens
SLQHKIVIF

SEQ ID NO: 1040915 - protein, 9 aa, Homo Sapiens
RPKGEIGDP

SEQ ID NO: 1040916 - protein, 9 aa, Homo Sapiens
GAPEREAER

SEQ ID NO: 1040917 - protein, 9 aa, Homo Sapiens
SKWGTKGLE

SEQ ID NO: 1040918 - protein, 9 aa, Homo Sapiens
KLQEHKAQA

SEQ ID NO: 1040919 - protein, 9 aa, Homo Sapiens
GGMNVEILD

SEQ ID NO: 1040920 - protein, 9 aa, Homo Sapiens
LEARGLRPR

SEQ ID NO: 1040921 - protein, 9 aa, Homo Sapiens
EFEHFQRRK

SEQ ID NO: 1040922 - protein, 9 aa, Homo Sapiens
ILRIFSAGR

SEQ ID NO: 1040923 - protein, 9 aa, Homo Sapiens
KETETVLAA

SEQ ID NO: 1040924 - protein, 9 aa, Homo Sapiens
ASPGSRGGR

SEQ ID NO: 1040925 - protein, 9 aa, Homo Sapiens
TEDLETAIH

SEQ ID NO: 1040926 - protein, 9 aa, Homo Sapiens
QSQKTVQFS

SEQ ID NO: 1040927 - protein, 9 aa, Homo Sapiens
FFCNLVLIY

SEQ ID NO: 1040928 - protein, 9 aa, Homo Sapiens
LFSHHVVHK

SEQ ID NO: 1040929 - protein, 9 aa, Homo Sapiens
VFNTLIFSL

SEQ ID NO: 1040930 - protein, 9 aa, Homo Sapiens
TKRMLLYVR

SEQ ID NO: 1040931 - protein, 9 aa, Homo Sapiens
RTKQLLEEI

SEQ ID NO: 1040932 - protein, 9 aa, Homo Sapiens
EGEWDVEKV

SEQ ID NO: 1040933 - protein, 9 aa, Homo Sapiens
ALSLPVAPS

SEQ ID NO: 1040934 - protein, 9 aa, Homo Sapiens
RGLRISPRS

SEQ ID NO: 1040935 - protein, 9 aa, Homo Sapiens
SWDYRWDLT

SEQ ID NO: 1040936 - protein, 9 aa, Homo Sapiens
FDEDDVSSE

SEQ ID NO: 1040937 - protein, 9 aa, Homo Sapiens
EALRLLVQT

SEQ ID NO: 1040938 - protein, 9 aa, Homo Sapiens
SIPPSTPKF

SEQ ID NO: 1040939 - protein, 9 aa, Homo Sapiens
HVSSEKREE

SEQ ID NO: 1040940 - protein, 9 aa, Homo Sapiens
RYLGGPLPD

SEQ ID NO: 1040941 - protein, 9 aa, Homo Sapiens
VAIAALKVL

SEQ ID NO: 1040942 - protein, 9 aa, Homo Sapiens
TCNSETQSR

SEQ ID NO: 1040943 - protein, 9 aa, Homo Sapiens
NLSSNKLHV

SEQ ID NO: 1040944 - protein, 9 aa, Homo Sapiens
HEITVGIET

SEQ ID NO: 1040945 - protein, 9 aa, Homo Sapiens
SSLVSTAWV

SEQ ID NO: 1040946 - protein, 9 aa, Homo Sapiens
ELQSSSCGY

SEQ ID NO: 1040947 - protein, 9 aa, Homo Sapiens
DKKSSEMVK

SEQ ID NO: 1040948 - protein, 9 aa, Homo Sapiens
YTVVGCLGL

SEQ ID NO: 1040949 - protein, 9 aa, Homo Sapiens
GRFFKAYSP

SEQ ID NO: 1040950 - protein, 9 aa, Homo Sapiens
SIKVSLNHG

SEQ ID NO: 1040951 - protein, 9 aa, Homo Sapiens
LLFGPLLAV

SEQ ID NO: 1040952 - protein, 9 aa, Homo Sapiens
PVPVFDFRV

SEQ ID NO: 1040953 - protein, 9 aa, Homo Sapiens
HISLQHKIV

SEQ ID NO: 1040954 - protein, 9 aa, Homo Sapiens
WDAWIRYAL

SEQ ID NO: 1040955 - protein, 9 aa, Homo Sapiens
CPVSLGVKQ

SEQ ID NO: 1040956 - protein, 9 aa, Homo Sapiens
QREALGLVG

SEQ ID NO: 1040957 - protein, 9 aa, Homo Sapiens
KKKFQKQKY

SEQ ID NO: 1040958 - protein, 9 aa, Homo Sapiens
QGSGADGPR

SEQ ID NO: 1040959 - protein, 9 aa, Homo Sapiens
NDEHIPESL

SEQ ID NO: 1040960 - protein, 9 aa, Homo Sapiens
RSSENVSTH

SEQ ID NO: 1040961 - protein, 9 aa, Homo Sapiens
ALQSLASSG

SEQ ID NO: 1040962 - protein, 9 aa, Homo Sapiens
PGGAEAAGH

SEQ ID NO: 1040963 - protein, 9 aa, Homo Sapiens
GQFTEEDKT

SEQ ID NO: 1040964 - protein, 9 aa, Homo Sapiens
VVFDVVSLC

SEQ ID NO: 1040965 - protein, 9 aa, Homo Sapiens
QQLMEAAEI

SEQ ID NO: 1040966 - protein, 9 aa, Homo Sapiens
DGAIEFSQE

SEQ ID NO: 1040967 - protein, 9 aa, Homo Sapiens
PHLKTSVDK

SEQ ID NO: 1040968 - protein, 9 aa, Homo Sapiens
TLATVGSDD

SEQ ID NO: 1040969 - protein, 9 aa, Homo Sapiens
EEFELVVLL

SEQ ID NO: 1040970 - protein, 9 aa, Homo Sapiens
PGYQGIAET

SEQ ID NO: 1040971 - protein, 9 aa, Homo Sapiens
QVSGPVSTT

SEQ ID NO: 1040972 - protein, 9 aa, Homo Sapiens
FWSAFRTSE

SEQ ID NO: 1040973 - protein, 9 aa, Homo Sapiens
GPKRERGVP

SEQ ID NO: 1040974 - protein, 9 aa, Homo Sapiens
GGNCGLQQS

SEQ ID NO: 1040975 - protein, 9 aa, Homo Sapiens
ARRDDNPLN

SEQ ID NO: 1040976 - protein, 9 aa, Homo Sapiens
GRIEKPFWQ

SEQ ID NO: 1040977 - protein, 9 aa, Homo Sapiens
GSSDPSLQS

SEQ ID NO: 1040978 - protein, 9 aa, Homo Sapiens
YPNNKAAKI

SEQ ID NO: 1040979 - protein, 9 aa, Homo Sapiens
RRMKFQSCN

SEQ ID NO: 1040980 - protein, 9 aa, Homo Sapiens
SPEKKVQTL

SEQ ID NO: 1040981 - protein, 9 aa, Homo Sapiens
SFPGSVLAR

SEQ ID NO: 1040982 - protein, 9 aa, Homo Sapiens
FFSQQSGTP

SEQ ID NO: 1040983 - protein, 9 aa, Homo Sapiens
MLFFGACCS

SEQ ID NO: 1040984 - protein, 9 aa, Homo Sapiens
TGRESSLPF

SEQ ID NO: 1040985 - protein, 9 aa, Homo Sapiens
DSGPAPPPP

SEQ ID NO: 1040986 - protein, 9 aa, Homo Sapiens
SLMPSPFQG

SEQ ID NO: 1040987 - protein, 9 aa, Homo Sapiens
SGCQGDFGG

SEQ ID NO: 1040988 - protein, 9 aa, Homo Sapiens
VLERFLDYG

SEQ ID NO: 1040989 - protein, 9 aa, Homo Sapiens
ASTGGRSAQ

SEQ ID NO: 1040990 - protein, 9 aa, Homo Sapiens
YHTEAYTTF

SEQ ID NO: 1040991 - protein, 9 aa, Homo Sapiens
CSRRQRVFF

SEQ ID NO: 1040992 - protein, 9 aa, Homo Sapiens
LMHLEKFEK

SEQ ID NO: 1040993 - protein, 9 aa, Homo Sapiens
SKRITIFHV

SEQ ID NO: 1040994 - protein, 9 aa, Homo Sapiens
SAVSPPSVP

SEQ ID NO: 1040995 - protein, 9 aa, Homo Sapiens
SKEQLLACQ

SEQ ID NO: 1040996 - protein, 9 aa, Homo Sapiens
ISVHGESTS

SEQ ID NO: 1040997 - protein, 9 aa, Homo Sapiens
LRALGRASC

SEQ ID NO: 1040998 - protein, 9 aa, Homo Sapiens
LQAQVFNFQ

SEQ ID NO: 1040999 - protein, 9 aa, Homo Sapiens
RMSYWSDWP

SEQ ID NO: 1041000 - protein, 9 aa, Homo Sapiens
GKPRFKPSL

SEQ ID NO: 1041001 - protein, 9 aa, Homo Sapiens
DNGVVVYVA

SEQ ID NO: 1041002 - protein, 9 aa, Homo Sapiens
VEMLRGIAS

SEQ ID NO: 1041003 - protein, 9 aa, Homo Sapiens
AQPHCPQRL

SEQ ID NO: 1041004 - protein, 9 aa, Homo Sapiens
VFKEEKVKG

SEQ ID NO: 1041005 - protein, 9 aa, Homo Sapiens
VRGWAWTRA

SEQ ID NO: 1041006 - protein, 9 aa, Homo Sapiens
TPAENGVNY

SEQ ID NO: 1041007 - protein, 9 aa, Homo Sapiens
SQAFYVQGV

SEQ ID NO: 1041008 - protein, 9 aa, Homo Sapiens
TLGLFLTSD

SEQ ID NO: 1041009 - protein, 9 aa, Homo Sapiens
VDKQMGTTY

SEQ ID NO: 1041010 - protein, 9 aa, Homo Sapiens
TMPLSEATT

SEQ ID NO: 1041011 - protein, 9 aa, Homo Sapiens
ETWESLTIL

SEQ ID NO: 1041012 - protein, 9 aa, Homo Sapiens
KQEETEKEE

SEQ ID NO: 1041013 - protein, 9 aa, Homo Sapiens
QSWTSPASW

SEQ ID NO: 1041014 - protein, 9 aa, Homo Sapiens
NNVFSVSTT

SEQ ID NO: 1041015 - protein, 9 aa, Homo Sapiens
PQEKLPLVT

SEQ ID NO: 1041016 - protein, 9 aa, Homo Sapiens
QFSFHSAPA

SEQ ID NO: 1041017 - protein, 9 aa, Homo Sapiens
HLCHYLDQL

SEQ ID NO: 1041018 - protein, 9 aa, Homo Sapiens
CFSEWDGLI

SEQ ID NO: 1041019 - protein, 9 aa, Homo Sapiens
EEDSPWGPW

SEQ ID NO: 1041020 - protein, 9 aa, Homo Sapiens
SMIAHLEVF

SEQ ID NO: 1041021 - protein, 9 aa, Homo Sapiens
EEEGKALKE

SEQ ID NO: 1041022 - protein, 9 aa, Homo Sapiens
AAHLPELLN

SEQ ID NO: 1041023 - protein, 9 aa, Homo Sapiens
GNSTDPGLM

SEQ ID NO: 1041024 - protein, 9 aa, Homo Sapiens
KYRDNTKEI

SEQ ID NO: 1041025 - protein, 9 aa, Homo Sapiens
PLAGCSTRD

SEQ ID NO: 1041026 - protein, 9 aa, Homo Sapiens
SSSVSCLQA

SEQ ID NO: 1041027 - protein, 9 aa, Homo Sapiens
PQQPQAPLA

SEQ ID NO: 1041028 - protein, 9 aa, Homo Sapiens
RTSDMVGLS

SEQ ID NO: 1041029 - protein, 9 aa, Homo Sapiens
GSLREKDQR

SEQ ID NO: 1041030 - protein, 9 aa, Homo Sapiens
LRIKYLYRR

SEQ ID NO: 1041031 - protein, 9 aa, Homo Sapiens
TLFSVFKYM

SEQ ID NO: 1041032 - protein, 9 aa, Homo Sapiens
EVEPRGFLG

SEQ ID NO: 1041033 - protein, 9 aa, Homo Sapiens
TLKIRKPCP

SEQ ID NO: 1041034 - protein, 9 aa, Homo Sapiens
RQNPSCGSD

SEQ ID NO: 1041035 - protein, 9 aa, Homo Sapiens
ERPFNVNLT

SEQ ID NO: 1041036 - protein, 9 aa, Homo Sapiens
HIILGLVVT

SEQ ID NO: 1041037 - protein, 9 aa, Homo Sapiens
NAYNIRLKL

SEQ ID NO: 1041038 - protein, 9 aa, Homo Sapiens
IFSSPRELE

SEQ ID NO: 1041039 - protein, 9 aa, Homo Sapiens
VKETFSVKQ

SEQ ID NO: 1041040 - protein, 9 aa, Homo Sapiens
CHHRVHTEE

SEQ ID NO: 1041041 - protein, 9 aa, Homo Sapiens
GAVKTGPRA

SEQ ID NO: 1041042 - protein, 9 aa, Homo Sapiens
NDKINFLRT

SEQ ID NO: 1041043 - protein, 9 aa, Homo Sapiens
GVTLKEGGL

SEQ ID NO: 1041044 - protein, 9 aa, Homo Sapiens
LINNALHRS

SEQ ID NO: 1041045 - protein, 9 aa, Homo Sapiens
RRVAEELIL

SEQ ID NO: 1041046 - protein, 9 aa, Homo Sapiens
AVENVLELH

SEQ ID NO: 1041047 - protein, 9 aa, Homo Sapiens
RLQADRKFQ

SEQ ID NO: 1041048 - protein, 9 aa, Homo Sapiens
VPRHSKYNP

SEQ ID NO: 1041049 - protein, 9 aa, Homo Sapiens
SHVSSEKRE

SEQ ID NO: 1041050 - protein, 9 aa, Homo Sapiens
AALEKNYEE

SEQ ID NO: 1041051 - protein, 9 aa, Homo Sapiens
PSEENMDLH

SEQ ID NO: 1041052 - protein, 9 aa, Homo Sapiens
SGVPSQDNT

SEQ ID NO: 1041053 - protein, 9 aa, Homo Sapiens
DENRKLAKG

SEQ ID NO: 1041054 - protein, 9 aa, Homo Sapiens
FRNRIYVVG

SEQ ID NO: 1041055 - protein, 9 aa, Homo Sapiens
KLTRLKAAV

SEQ ID NO: 1041056 - protein, 9 aa, Homo Sapiens
PKNVVDLKL

SEQ ID NO: 1041057 - protein, 9 aa, Homo Sapiens
KRFRAKSLW

SEQ ID NO: 1041058 - protein, 9 aa, Homo Sapiens
NPKTNREKM

SEQ ID NO: 1041059 - protein, 9 aa, Homo Sapiens
RGPQAFWAK

SEQ ID NO: 1041060 - protein, 9 aa, Homo Sapiens
NPSVISCLK

SEQ ID NO: 1041061 - protein, 9 aa, Homo Sapiens
TAADKNHAP

SEQ ID NO: 1041062 - protein, 9 aa, Homo Sapiens
HVDRSENVH

SEQ ID NO: 1041063 - protein, 9 aa, Homo Sapiens
TLYFNALFQ

SEQ ID NO: 1041064 - protein, 9 aa, Homo Sapiens
GAETGQSCP

SEQ ID NO: 1041065 - protein, 9 aa, Homo Sapiens
RHLYNFVGN

SEQ ID NO: 1041066 - protein, 9 aa, Homo Sapiens
RKRKKKEKE

SEQ ID NO: 1041067 - protein, 9 aa, Homo Sapiens
VKFDREFWK

SEQ ID NO: 1041068 - protein, 9 aa, Homo Sapiens
HLQAAVVFV

SEQ ID NO: 1041069 - protein, 9 aa, Homo Sapiens
CAQNMNHEY

SEQ ID NO: 1041070 - protein, 9 aa, Homo Sapiens
ELQLEQETV

SEQ ID NO: 1041071 - protein, 9 aa, Homo Sapiens
SPSPGKCKR

SEQ ID NO: 1041072 - protein, 9 aa, Homo Sapiens
PSAEDRVSL

SEQ ID NO: 1041073 - protein, 9 aa, Homo Sapiens
SKRHLFEKK

SEQ ID NO: 1041074 - protein, 9 aa, Homo Sapiens
ALPLLEAQV

SEQ ID NO: 1041075 - protein, 9 aa, Homo Sapiens
QFTEEDKTA

SEQ ID NO: 1041076 - protein, 9 aa, Homo Sapiens
KRPEILTDK

SEQ ID NO: 1041077 - protein, 9 aa, Homo Sapiens
FATLPPPYQ

SEQ ID NO: 1041078 - protein, 9 aa, Homo Sapiens
ESAKSLESE

SEQ ID NO: 1041079 - protein, 9 aa, Homo Sapiens
GLIYHSPGH

SEQ ID NO: 1041080 - protein, 9 aa, Homo Sapiens
KTTTDCPNL

SEQ ID NO: 1041081 - protein, 9 aa, Homo Sapiens
APEREAERG

SEQ ID NO: 1041082 - protein, 9 aa, Homo Sapiens
IFTPEKSEA

SEQ ID NO: 1041083 - protein, 9 aa, Homo Sapiens
VPLSGPGAL

SEQ ID NO: 1041084 - protein, 9 aa, Homo Sapiens
LEACLTESL

SEQ ID NO: 1041085 - protein, 9 aa, Homo Sapiens
LGFSFSRPF

SEQ ID NO: 1041086 - protein, 9 aa, Homo Sapiens
HDQPVKPLN

SEQ ID NO: 1041087 - protein, 9 aa, Homo Sapiens
TGHATPFPV

SEQ ID NO: 1041088 - protein, 9 aa, Homo Sapiens
RMLLYVRKE

SEQ ID NO: 1041089 - protein, 9 aa, Homo Sapiens
DGITGFGQC

SEQ ID NO: 1041090 - protein, 9 aa, Homo Sapiens
SDFQSPKDD

SEQ ID NO: 1041091 - protein, 9 aa, Homo Sapiens
LGQYRAAPV

SEQ ID NO: 1041092 - protein, 9 aa, Homo Sapiens
LADFPKKLS

SEQ ID NO: 1041093 - protein, 9 aa, Homo Sapiens
EEEKGNANL

SEQ ID NO: 1041094 - protein, 9 aa, Homo Sapiens
SSVVFWRLI

SEQ ID NO: 1041095 - protein, 9 aa, Homo Sapiens
QLEQETVVC

SEQ ID NO: 1041096 - protein, 9 aa, Homo Sapiens
GNYGFLSEL

SEQ ID NO: 1041097 - protein, 9 aa, Homo Sapiens
GKDSKHPRC

SEQ ID NO: 1041098 - protein, 9 aa, Homo Sapiens
WASDTKLWY

SEQ ID NO: 1041099 - protein, 9 aa, Homo Sapiens
GSLISKQWV

SEQ ID NO: 1041100 - protein, 9 aa, Homo Sapiens
IRLEKASIE

SEQ ID NO: 1041101 - protein, 9 aa, Homo Sapiens
EELHICLMD

SEQ ID NO: 1041102 - protein, 9 aa, Homo Sapiens
KDFLEETLG

SEQ ID NO: 1041103 - protein, 9 aa, Homo Sapiens
RRTSDMVGL

SEQ ID NO: 1041104 - protein, 9 aa, Homo Sapiens
TNSFFQDQA

SEQ ID NO: 1041105 - protein, 9 aa, Homo Sapiens
EQDAFLGEI

SEQ ID NO: 1041106 - protein, 9 aa, Homo Sapiens
GLSNVWRFP

SEQ ID NO: 1041107 - protein, 9 aa, Homo Sapiens
SSFNSAHDT

SEQ ID NO: 1041108 - protein, 9 aa, Homo Sapiens
ADPDGGPRL

SEQ ID NO: 1041109 - protein, 9 aa, Homo Sapiens
RLLVQTPPA

SEQ ID NO: 1041110 - protein, 9 aa, Homo Sapiens
HSRELVLVI

SEQ ID NO: 1041111 - protein, 9 aa, Homo Sapiens
MGTPVLRDS

SEQ ID NO: 1041112 - protein, 9 aa, Homo Sapiens
RFFKAYSPA

SEQ ID NO: 1041113 - protein, 9 aa, Homo Sapiens
MEVEWTSCA

SEQ ID NO: 1041114 - protein, 9 aa, Homo Sapiens
NKKLLPRHR

SEQ ID NO: 1041115 - protein, 9 aa, Homo Sapiens
KEDFRKYFY

SEQ ID NO: 1041116 - protein, 9 aa, Homo Sapiens
SAKCIWTLT

SEQ ID NO: 1041117 - protein, 9 aa, Homo Sapiens
LSPKPSFPG

SEQ ID NO: 1041118 - protein, 9 aa, Homo Sapiens
RKKSRPESI

SEQ ID NO: 1041119 - protein, 9 aa, Homo Sapiens
EHYDASLST

SEQ ID NO: 1041120 - protein, 9 aa, Homo Sapiens
NFFPISEKV

SEQ ID NO: 1041121 - protein, 9 aa, Homo Sapiens
RELSDFESA

SEQ ID NO: 1041122 - protein, 9 aa, Homo Sapiens
VFFSVHYER

SEQ ID NO: 1041123 - protein, 9 aa, Homo Sapiens
FKPVPKPRV

SEQ ID NO: 1041124 - protein, 9 aa, Homo Sapiens
PRQNGPSPK

SEQ ID NO: 1041125 - protein, 9 aa, Homo Sapiens
FHLFFVLFK

SEQ ID NO: 1041126 - protein, 9 aa, Homo Sapiens
IYCLISKLV

SEQ ID NO: 1041127 - protein, 9 aa, Homo Sapiens
RLQKMGFII

SEQ ID NO: 1041128 - protein, 9 aa, Homo Sapiens
RLKQTNKML

SEQ ID NO: 1041129 - protein, 9 aa, Homo Sapiens
LHGSHRGHF

SEQ ID NO: 1041130 - protein, 9 aa, Homo Sapiens
LVQATNMND

SEQ ID NO: 1041131 - protein, 9 aa, Homo Sapiens
EETQQVLMK

SEQ ID NO: 1041132 - protein, 9 aa, Homo Sapiens
LLFLFLFAL

SEQ ID NO: 1041133 - protein, 9 aa, Homo Sapiens
VGPRGAVKT

SEQ ID NO: 1041134 - protein, 9 aa, Homo Sapiens
ATVESAVHT

SEQ ID NO: 1041135 - protein, 9 aa, Homo Sapiens
TAVEKMTSK

SEQ ID NO: 1041136 - protein, 9 aa, Homo Sapiens
GYIKEGERP

SEQ ID NO: 1041137 - protein, 9 aa, Homo Sapiens
NERLKQTNK

SEQ ID NO: 1041138 - protein, 9 aa, Homo Sapiens
HKTFKFTSE

SEQ ID NO: 1041139 - protein, 9 aa, Homo Sapiens
YFISLKRNL

SEQ ID NO: 1041140 - protein, 9 aa, Homo Sapiens
WKNLPATPK

SEQ ID NO: 1041141 - protein, 9 aa, Homo Sapiens
TIKPENFFV

SEQ ID NO: 1041142 - protein, 9 aa, Homo Sapiens
ILLQVEGML

SEQ ID NO: 1041143 - protein, 9 aa, Homo Sapiens
GMLLQQNFD

SEQ ID NO: 1041144 - protein, 9 aa, Homo Sapiens
LDCYLAICR

SEQ ID NO: 1041145 - protein, 9 aa, Homo Sapiens
AFYEIFQIF

SEQ ID NO: 1041146 - protein, 9 aa, Homo Sapiens
CPRQNGPSP

SEQ ID NO: 1041147 - protein, 9 aa, Homo Sapiens
LQTFRVLRA

SEQ ID NO: 1041148 - protein, 9 aa, Homo Sapiens
FAPTELSHG

SEQ ID NO: 1041149 - protein, 9 aa, Homo Sapiens
VSDKSNDLL

SEQ ID NO: 1041150 - protein, 9 aa, Homo Sapiens
GGLPNARRV

SEQ ID NO: 1041151 - protein, 9 aa, Homo Sapiens
SFLEGFYDE

SEQ ID NO: 1041152 - protein, 9 aa, Homo Sapiens
NSHVCNCST

SEQ ID NO: 1041153 - protein, 9 aa, Homo Sapiens
LPDQSDVIY

SEQ ID NO: 1041154 - protein, 9 aa, Homo Sapiens
IVQYKDRDG

SEQ ID NO: 1041155 - protein, 9 aa, Homo Sapiens
GYNLRGAAS

SEQ ID NO: 1041156 - protein, 9 aa, Homo Sapiens
EINIIGDIA

SEQ ID NO: 1041157 - protein, 9 aa, Homo Sapiens
PLSEMHVRI

SEQ ID NO: 1041158 - protein, 9 aa, Homo Sapiens
VWEQGGVPP

SEQ ID NO: 1041159 - protein, 9 aa, Homo Sapiens
MSYDCYVAV

SEQ ID NO: 1041160 - protein, 9 aa, Homo Sapiens
RTLRCPFPH

SEQ ID NO: 1041161 - protein, 9 aa, Homo Sapiens
RFLKNAMWK

SEQ ID NO: 1041162 - protein, 9 aa, Homo Sapiens
QETRKQQEI

SEQ ID NO: 1041163 - protein, 9 aa, Homo Sapiens
LSEEDLNRQ

SEQ ID NO: 1041164 - protein, 9 aa, Homo Sapiens
MPREASLGT

SEQ ID NO: 1041165 - protein, 9 aa, Homo Sapiens
QASDTFSEI

SEQ ID NO: 1041166 - protein, 9 aa, Homo Sapiens
TATTIAVLL

SEQ ID NO: 1041167 - protein, 9 aa, Homo Sapiens
FTPYSWVCF

SEQ ID NO: 1041168 - protein, 9 aa, Homo Sapiens
PQCSQLVGR

SEQ ID NO: 1041169 - protein, 9 aa, Homo Sapiens
KKVTQLRHG

SEQ ID NO: 1041170 - protein, 9 aa, Homo Sapiens
EGNSSDDFE

SEQ ID NO: 1041171 - protein, 9 aa, Homo Sapiens
KKSSEMVKK

SEQ ID NO: 1041172 - protein, 9 aa, Homo Sapiens
FNTNSFFQD

SEQ ID NO: 1041173 - protein, 9 aa, Homo Sapiens
RNKNVKAAV

SEQ ID NO: 1041174 - protein, 9 aa, Homo Sapiens
NFSFLEIFF

SEQ ID NO: 1041175 - protein, 9 aa, Homo Sapiens
VSRFLMCNL

SEQ ID NO: 1041176 - protein, 9 aa, Homo Sapiens
REALVLQEK

SEQ ID NO: 1041177 - protein, 9 aa, Homo Sapiens
STQLFCNVR

SEQ ID NO: 1041178 - protein, 9 aa, Homo Sapiens
NSEESYECS

SEQ ID NO: 1041179 - protein, 9 aa, Homo Sapiens
FVIFNNTSK

SEQ ID NO: 1041180 - protein, 9 aa, Homo Sapiens
SQRDENGEF

SEQ ID NO: 1041181 - protein, 9 aa, Homo Sapiens
MKFQSCNTD

SEQ ID NO: 1041182 - protein, 9 aa, Homo Sapiens
HGPAGMAPQ

SEQ ID NO: 1041183 - protein, 9 aa, Homo Sapiens
DYDDSAFIE

SEQ ID NO: 1041184 - protein, 9 aa, Homo Sapiens
DQTEPVGIS

SEQ ID NO: 1041185 - protein, 9 aa, Homo Sapiens
NTDPMAQCL

SEQ ID NO: 1041186 - protein, 9 aa, Homo Sapiens
LRTSRTEIL

SEQ ID NO: 1041187 - protein, 9 aa, Homo Sapiens
PCLDQNCSN

SEQ ID NO: 1041188 - protein, 9 aa, Homo Sapiens
YTEKETRSV

SEQ ID NO: 1041189 - protein, 9 aa, Homo Sapiens
VIYARQAYD

SEQ ID NO: 1041190 - protein, 9 aa, Homo Sapiens
GKNNPSLKS

SEQ ID NO: 1041191 - protein, 9 aa, Homo Sapiens
GFRYSEAAG

SEQ ID NO: 1041192 - protein, 9 aa, Homo Sapiens
GPPPCPGKP

SEQ ID NO: 1041193 - protein, 9 aa, Homo Sapiens
DMFLQKPMS

SEQ ID NO: 1041194 - protein, 9 aa, Homo Sapiens
CVSHGSAVT

SEQ ID NO: 1041195 - protein, 9 aa, Homo Sapiens
DYCTQPGQK

SEQ ID NO: 1041196 - protein, 9 aa, Homo Sapiens
FCQLIVNKW

SEQ ID NO: 1041197 - protein, 9 aa, Homo Sapiens
KESSNQASL

SEQ ID NO: 1041198 - protein, 9 aa, Homo Sapiens
KLKKRQPLM

SEQ ID NO: 1041199 - protein, 9 aa, Homo Sapiens
QGEETQKKL

SEQ ID NO: 1041200 - protein, 9 aa, Homo Sapiens
WQKIREDLI

SEQ ID NO: 1041201 - protein, 9 aa, Homo Sapiens
QYMFATLSS

SEQ ID NO: 1041202 - protein, 9 aa, Homo Sapiens
FFTDAQNCE

SEQ ID NO: 1041203 - protein, 9 aa, Homo Sapiens
SAYDSNNPD

SEQ ID NO: 1041204 - protein, 9 aa, Homo Sapiens
PQGPKGDSG

SEQ ID NO: 1041205 - protein, 9 aa, Homo Sapiens
FFMAVFYVF

SEQ ID NO: 1041206 - protein, 9 aa, Homo Sapiens
VGVKLPLVL

SEQ ID NO: 1041207 - protein, 9 aa, Homo Sapiens
SPADKCSRQ

SEQ ID NO: 1041208 - protein, 9 aa, Homo Sapiens
DCCINSHSP

SEQ ID NO: 1041209 - protein, 9 aa, Homo Sapiens
LDGFTGRAC

SEQ ID NO: 1041210 - protein, 9 aa, Homo Sapiens
FFVSCVFIY

SEQ ID NO: 1041211 - protein, 9 aa, Homo Sapiens
DDRNTFQHS

SEQ ID NO: 1041212 - protein, 9 aa, Homo Sapiens
LNAAGKTTI

SEQ ID NO: 1041213 - protein, 9 aa, Homo Sapiens
VRSVMYHIN

SEQ ID NO: 1041214 - protein, 9 aa, Homo Sapiens
NFASCMEHL

SEQ ID NO: 1041215 - protein, 9 aa, Homo Sapiens
EMPLGEQDS

SEQ ID NO: 1041216 - protein, 9 aa, Homo Sapiens
GKMVRSRGS

SEQ ID NO: 1041217 - protein, 9 aa, Homo Sapiens
LDRYGRTAF

SEQ ID NO: 1041218 - protein, 9 aa, Homo Sapiens
ETAYLPCRF

SEQ ID NO: 1041219 - protein, 9 aa, Homo Sapiens
EEPLAPQYT

SEQ ID NO: 1041220 - protein, 9 aa, Homo Sapiens
QCDDGITGF

SEQ ID NO: 1041221 - protein, 9 aa, Homo Sapiens
AFTSFLLPR

SEQ ID NO: 1041222 - protein, 9 aa, Homo Sapiens
TQWPSREFS

SEQ ID NO: 1041223 - protein, 9 aa, Homo Sapiens
ARRQNVTIF

SEQ ID NO: 1041224 - protein, 9 aa, Homo Sapiens
TWLSTECDF

SEQ ID NO: 1041225 - protein, 9 aa, Homo Sapiens
FFWPMSPGR

SEQ ID NO: 1041226 - protein, 9 aa, Homo Sapiens
KKAEAIGKL

SEQ ID NO: 1041227 - protein, 9 aa, Homo Sapiens
MVTRGKDTA

SEQ ID NO: 1041228 - protein, 9 aa, Homo Sapiens
MNSALASDF

SEQ ID NO: 1041229 - protein, 9 aa, Homo Sapiens
LVDNGFHGH

SEQ ID NO: 1041230 - protein, 9 aa, Homo Sapiens
ALGTSQLPQ

SEQ ID NO: 1041231 - protein, 9 aa, Homo Sapiens
NEKFVSVTK

SEQ ID NO: 1041232 - protein, 9 aa, Homo Sapiens
TNLQKAFSK

SEQ ID NO: 1041233 - protein, 9 aa, Homo Sapiens
WVCFEWKPA

SEQ ID NO: 1041234 - protein, 9 aa, Homo Sapiens
NKYIPNVRP

SEQ ID NO: 1041235 - protein, 9 aa, Homo Sapiens
IQNIDATTE

SEQ ID NO: 1041236 - protein, 9 aa, Homo Sapiens
TPFQVEKNQ

SEQ ID NO: 1041237 - protein, 9 aa, Homo Sapiens
IDKFYADHS

SEQ ID NO: 1041238 - protein, 9 aa, Homo Sapiens
GPPEPPRPP

SEQ ID NO: 1041239 - protein, 9 aa, Homo Sapiens
FNLKQNVTF

SEQ ID NO: 1041240 - protein, 9 aa, Homo Sapiens
LQADRKFQE

SEQ ID NO: 1041241 - protein, 9 aa, Homo Sapiens
ETVNGKKQF

SEQ ID NO: 1041242 - protein, 9 aa, Homo Sapiens
VTCNIKNSR

SEQ ID NO: 1041243 - protein, 9 aa, Homo Sapiens
QAASLRSCT

SEQ ID NO: 1041244 - protein, 9 aa, Homo Sapiens
DSPWGPWDR

SEQ ID NO: 1041245 - protein, 9 aa, Homo Sapiens
SAFTSFLLP

SEQ ID NO: 1041246 - protein, 9 aa, Homo Sapiens
GFVTGGKDD

SEQ ID NO: 1041247 - protein, 9 aa, Homo Sapiens
CDAIDGFFN

SEQ ID NO: 1041248 - protein, 9 aa, Homo Sapiens
RADFVANKL

SEQ ID NO: 1041249 - protein, 9 aa, Homo Sapiens
LDSKEQLLA

SEQ ID NO: 1041250 - protein, 9 aa, Homo Sapiens
ALVRDLNQD

SEQ ID NO: 1041251 - protein, 9 aa, Homo Sapiens
KTLGTFLIA

SEQ ID NO: 1041252 - protein, 9 aa, Homo Sapiens
EKEKAHKGN

SEQ ID NO: 1041253 - protein, 9 aa, Homo Sapiens
FYLPLLIHR

SEQ ID NO: 1041254 - protein, 9 aa, Homo Sapiens
TVQCQDENR

SEQ ID NO: 1041255 - protein, 9 aa, Homo Sapiens
ERIYNEISD

SEQ ID NO: 1041256 - protein, 9 aa, Homo Sapiens
EGDRGPKGP

SEQ ID NO: 1041257 - protein, 9 aa, Homo Sapiens
DEFLHETLL

SEQ ID NO: 1041258 - protein, 9 aa, Homo Sapiens
EEGEYLDWS

SEQ ID NO: 1041259 - protein, 9 aa, Homo Sapiens
LLKDLRNDS

SEQ ID NO: 1041260 - protein, 9 aa, Homo Sapiens
TPPMISWME

SEQ ID NO: 1041261 - protein, 9 aa, Homo Sapiens
SADVVCISL

SEQ ID NO: 1041262 - protein, 9 aa, Homo Sapiens
LYIVVSVLN

SEQ ID NO: 1041263 - protein, 9 aa, Homo Sapiens
PRKRTRSVE

SEQ ID NO: 1041264 - protein, 9 aa, Homo Sapiens
EADSDVGEK

SEQ ID NO: 1041265 - protein, 9 aa, Homo Sapiens
KAGTWRSLE

SEQ ID NO: 1041266 - protein, 9 aa, Homo Sapiens
RPSFCRTPA

SEQ ID NO: 1041267 - protein, 9 aa, Homo Sapiens
GLEMYSKED

SEQ ID NO: 1041268 - protein, 9 aa, Homo Sapiens
RNILWAFEA

SEQ ID NO: 1041269 - protein, 9 aa, Homo Sapiens
NDDIRYNLF

SEQ ID NO: 1041270 - protein, 9 aa, Homo Sapiens
ISGHRKTHI

SEQ ID NO: 1041271 - protein, 9 aa, Homo Sapiens
ECGKAFERP

SEQ ID NO: 1041272 - protein, 9 aa, Homo Sapiens
THEGRESCH

SEQ ID NO: 1041273 - protein, 9 aa, Homo Sapiens
LSTKNSIAL

SEQ ID NO: 1041274 - protein, 9 aa, Homo Sapiens
LAKLAEYVV

SEQ ID NO: 1041275 - protein, 9 aa, Homo Sapiens
MKMKVLKNQ

SEQ ID NO: 1041276 - protein, 9 aa, Homo Sapiens
LSAPKGCES

SEQ ID NO: 1041277 - protein, 9 aa, Homo Sapiens
FEDERVKRL

SEQ ID NO: 1041278 - protein, 9 aa, Homo Sapiens
PQLDTWSMG

SEQ ID NO: 1041279 - protein, 9 aa, Homo Sapiens
FSTPPSLEQ

SEQ ID NO: 1041280 - protein, 9 aa, Homo Sapiens
IKISCFTVR

SEQ ID NO: 1041281 - protein, 9 aa, Homo Sapiens
HYNTISRID

SEQ ID NO: 1041282 - protein, 9 aa, Homo Sapiens
QLGQFTEED

SEQ ID NO: 1041283 - protein, 9 aa, Homo Sapiens
NFIVSSNDE

SEQ ID NO: 1041284 - protein, 9 aa, Homo Sapiens
APHPHLAPE

SEQ ID NO: 1041285 - protein, 9 aa, Homo Sapiens
LPSKIQSKD

SEQ ID NO: 1041286 - protein, 9 aa, Homo Sapiens
LTSSTNGEK

SEQ ID NO: 1041287 - protein, 9 aa, Homo Sapiens
RGLAQLFRG

SEQ ID NO: 1041288 - protein, 9 aa, Homo Sapiens
AKIQLSLYT

SEQ ID NO: 1041289 - protein, 9 aa, Homo Sapiens
TSDMVGLSY

SEQ ID NO: 1041290 - protein, 9 aa, Homo Sapiens
HRSSTARFS

SEQ ID NO: 1041291 - protein, 9 aa, Homo Sapiens
DVYSYRIIA

SEQ ID NO: 1041292 - protein, 9 aa, Homo Sapiens
PLGPPPLCR

SEQ ID NO: 1041293 - protein, 9 aa, Homo Sapiens
LAEQREQKK

SEQ ID NO: 1041294 - protein, 9 aa, Homo Sapiens
MTHLLGMNH

SEQ ID NO: 1041295 - protein, 9 aa, Homo Sapiens
GPFPAQLGA

SEQ ID NO: 1041296 - protein, 9 aa, Homo Sapiens
EIGKRGLNL

SEQ ID NO: 1041297 - protein, 9 aa, Homo Sapiens
NNCVYQSLY

SEQ ID NO: 1041298 - protein, 9 aa, Homo Sapiens
HQTYLVVAD

SEQ ID NO: 1041299 - protein, 9 aa, Homo Sapiens
TYRDCFQAL

SEQ ID NO: 1041300 - protein, 9 aa, Homo Sapiens
VCFLLILLF

SEQ ID NO: 1041301 - protein, 9 aa, Homo Sapiens
LFIMEMKHK

SEQ ID NO: 1041302 - protein, 9 aa, Homo Sapiens
AGTGGPASL

SEQ ID NO: 1041303 - protein, 9 aa, Homo Sapiens
TAMAGFLFC

SEQ ID NO: 1041304 - protein, 9 aa, Homo Sapiens
FINSLYVYH

SEQ ID NO: 1041305 - protein, 9 aa, Homo Sapiens
LELLNTGRF

SEQ ID NO: 1041306 - protein, 9 aa, Homo Sapiens
LEKLEALFA

SEQ ID NO: 1041307 - protein, 9 aa, Homo Sapiens
MDSHAAAQS

SEQ ID NO: 1041308 - protein, 9 aa, Homo Sapiens
LNSEGTLEI

SEQ ID NO: 1041309 - protein, 9 aa, Homo Sapiens
VGRKATSNN

SEQ ID NO: 1041310 - protein, 9 aa, Homo Sapiens
LERPFNVNL

SEQ ID NO: 1041311 - protein, 9 aa, Homo Sapiens
KEKIELKSI

SEQ ID NO: 1041312 - protein, 9 aa, Homo Sapiens
KQCVESSLL

SEQ ID NO: 1041313 - protein, 9 aa, Homo Sapiens
ISKEELSPE

SEQ ID NO: 1041314 - protein, 9 aa, Homo Sapiens
RFKLPSGKN

SEQ ID NO: 1041315 - protein, 9 aa, Homo Sapiens
WMQRDVQDS

SEQ ID NO: 1041316 - protein, 9 aa, Homo Sapiens
WCIPLYLMV

SEQ ID NO: 1041317 - protein, 9 aa, Homo Sapiens
GNICFHSKW

SEQ ID NO: 1041318 - protein, 9 aa, Homo Sapiens
PTVFVKKKH

SEQ ID NO: 1041319 - protein, 9 aa, Homo Sapiens
YPRYSSFGD

SEQ ID NO: 1041320 - protein, 9 aa, Homo Sapiens
MSATFNEDA

SEQ ID NO: 1041321 - protein, 9 aa, Homo Sapiens
GSSIQQLKR

SEQ ID NO: 1041322 - protein, 9 aa, Homo Sapiens
ARNHQTYSF

SEQ ID NO: 1041323 - protein, 9 aa, Homo Sapiens
YEKKFEHKL

SEQ ID NO: 1041324 - protein, 9 aa, Homo Sapiens
ATEVSLLAE

SEQ ID NO: 1041325 - protein, 9 aa, Homo Sapiens
GEETQKKLP

SEQ ID NO: 1041326 - protein, 9 aa, Homo Sapiens
KKLGAFHIT

SEQ ID NO: 1041327 - protein, 9 aa, Homo Sapiens
QSSLENLTF

SEQ ID NO: 1041328 - protein, 9 aa, Homo Sapiens
KKPQSLEFL

SEQ ID NO: 1041329 - protein, 9 aa, Homo Sapiens
GLGVKDGTA

SEQ ID NO: 1041330 - protein, 9 aa, Homo Sapiens
TENSETTIT

SEQ ID NO: 1041331 - protein, 9 aa, Homo Sapiens
QINLERELG

SEQ ID NO: 1041332 - protein, 9 aa, Homo Sapiens
TPTAVSGSA

SEQ ID NO: 1041333 - protein, 9 aa, Homo Sapiens
QMLLSELFS

SEQ ID NO: 1041334 - protein, 9 aa, Homo Sapiens
GAFFCNLVL

SEQ ID NO: 1041335 - protein, 9 aa, Homo Sapiens
ETVHVPFPC

SEQ ID NO: 1041336 - protein, 9 aa, Homo Sapiens
RYNLFLSCD

SEQ ID NO: 1041337 - protein, 9 aa, Homo Sapiens
KDCGKAFWR

SEQ ID NO: 1041338 - protein, 9 aa, Homo Sapiens
SLVGGFVYR

SEQ ID NO: 1041339 - protein, 9 aa, Homo Sapiens
PLGGPGTAS

SEQ ID NO: 1041340 - protein, 9 aa, Homo Sapiens
LLSRVPPPP

SEQ ID NO: 1041341 - protein, 9 aa, Homo Sapiens
FFPISEKVS

SEQ ID NO: 1041342 - protein, 9 aa, Homo Sapiens
VDVSSFSSR

SEQ ID NO: 1041343 - protein, 9 aa, Homo Sapiens
PETFLGDRE

SEQ ID NO: 1041344 - protein, 9 aa, Homo Sapiens
SATFNEDAQ

SEQ ID NO: 1041345 - protein, 9 aa, Homo Sapiens
NPSLKSRSF

SEQ ID NO: 1041346 - protein, 9 aa, Homo Sapiens
HGQERRFTI

SEQ ID NO: 1041347 - protein, 9 aa, Homo Sapiens
TSFLLPRPL

SEQ ID NO: 1041348 - protein, 9 aa, Homo Sapiens
FVTGGKDDI

SEQ ID NO: 1041349 - protein, 9 aa, Homo Sapiens
STNKEFHFI

SEQ ID NO: 1041350 - protein, 9 aa, Homo Sapiens
FVDKQVFEE

SEQ ID NO: 1041351 - protein, 9 aa, Homo Sapiens
QLTSSTNGE

SEQ ID NO: 1041352 - protein, 9 aa, Homo Sapiens
ASSFHTTAP

SEQ ID NO: 1041353 - protein, 9 aa, Homo Sapiens
NKAAKIQLA

SEQ ID NO: 1041354 - protein, 9 aa, Homo Sapiens
IPMVGILLF

SEQ ID NO: 1041355 - protein, 9 aa, Homo Sapiens
LEPPKTRGF

SEQ ID NO: 1041356 - protein, 9 aa, Homo Sapiens
LYFNALFQL

SEQ ID NO: 1041357 - protein, 9 aa, Homo Sapiens
SYAPLSGDP

SEQ ID NO: 1041358 - protein, 9 aa, Homo Sapiens
KTLFKEDFI

SEQ ID NO: 1041359 - protein, 9 aa, Homo Sapiens
LSAIFFGGL

SEQ ID NO: 1041360 - protein, 9 aa, Homo Sapiens
FVLGTENVN

SEQ ID NO: 1041361 - protein, 9 aa, Homo Sapiens
SEMDNEPLV

SEQ ID NO: 1041362 - protein, 9 aa, Homo Sapiens
FSSNTTSLI

SEQ ID NO: 1041363 - protein, 9 aa, Homo Sapiens
CYNSTTLWE

SEQ ID NO: 1041364 - protein, 9 aa, Homo Sapiens
RRVHEPAGP

SEQ ID NO: 1041365 - protein, 9 aa, Homo Sapiens
QKLQEAGYF

SEQ ID NO: 1041366 - protein, 9 aa, Homo Sapiens
LAAEQLLKD

SEQ ID NO: 1041367 - protein, 9 aa, Homo Sapiens
HLKYNEKFV

SEQ ID NO: 1041368 - protein, 9 aa, Homo Sapiens
VSTKTLSKD

SEQ ID NO: 1041369 - protein, 9 aa, Homo Sapiens
VLLGCPVSL

SEQ ID NO: 1041370 - protein, 9 aa, Homo Sapiens
DEINFLKAL

SEQ ID NO: 1041371 - protein, 9 aa, Homo Sapiens
FVQEKIPKL

SEQ ID NO: 1041372 - protein, 9 aa, Homo Sapiens
ETQSRHRQI

SEQ ID NO: 1041373 - protein, 9 aa, Homo Sapiens
IFLYVRPVS

SEQ ID NO: 1041374 - protein, 9 aa, Homo Sapiens
FSLRACYHM

SEQ ID NO: 1041375 - protein, 9 aa, Homo Sapiens
DTLAYALSA

SEQ ID NO: 1041376 - protein, 9 aa, Homo Sapiens
NNALHRSGQ

SEQ ID NO: 1041377 - protein, 9 aa, Homo Sapiens
GRRIREKLS

SEQ ID NO: 1041378 - protein, 9 aa, Homo Sapiens
VYPPKNVVD

SEQ ID NO: 1041379 - protein, 9 aa, Homo Sapiens
LDYPVISCA

SEQ ID NO: 1041380 - protein, 9 aa, Homo Sapiens
DWLVTMKNG

SEQ ID NO: 1041381 - protein, 9 aa, Homo Sapiens
KKESSNQAS

SEQ ID NO: 1041382 - protein, 9 aa, Homo Sapiens
SASRKQGEP

SEQ ID NO: 1041383 - protein, 9 aa, Homo Sapiens
ADNRHVALY

SEQ ID NO: 1041384 - protein, 9 aa, Homo Sapiens
CSVSDKSND

SEQ ID NO: 1041385 - protein, 9 aa, Homo Sapiens
GSWGVFPEV

SEQ ID NO: 1041386 - protein, 9 aa, Homo Sapiens
STTVARGGG

SEQ ID NO: 1041387 - protein, 9 aa, Homo Sapiens
YSQGQVHYQ

SEQ ID NO: 1041388 - protein, 9 aa, Homo Sapiens
TSLSNGIFD

SEQ ID NO: 1041389 - protein, 9 aa, Homo Sapiens
GPPGCSMLA

SEQ ID NO: 1041390 - protein, 9 aa, Homo Sapiens
RKFGDNYQV

SEQ ID NO: 1041391 - protein, 9 aa, Homo Sapiens
STTSRQPIF

SEQ ID NO: 1041392 - protein, 9 aa, Homo Sapiens
PKLRRRGLP

SEQ ID NO: 1041393 - protein, 9 aa, Homo Sapiens
GHYNTISRI

SEQ ID NO: 1041394 - protein, 9 aa, Homo Sapiens
LQKFNIMEK

SEQ ID NO: 1041395 - protein, 9 aa, Homo Sapiens
SQSWTSPAS

SEQ ID NO: 1041396 - protein, 9 aa, Homo Sapiens
YAKHKCTAC

SEQ ID NO: 1041397 - protein, 9 aa, Homo Sapiens
FYVDLETKK

SEQ ID NO: 1041398 - protein, 9 aa, Homo Sapiens
VAVLAKYFS

SEQ ID NO: 1041399 - protein, 9 aa, Homo Sapiens
GAECPARRA

SEQ ID NO: 1041400 - protein, 9 aa, Homo Sapiens
LTPEFCQLI

SEQ ID NO: 1041401 - protein, 9 aa, Homo Sapiens
AVLSSVSVS

SEQ ID NO: 1041402 - protein, 9 aa, Homo Sapiens
VNFPPEEAL

SEQ ID NO: 1041403 - protein, 9 aa, Homo Sapiens
IRFRRWATW

SEQ ID NO: 1041404 - protein, 9 aa, Homo Sapiens
TQQRKVICV

SEQ ID NO: 1041405 - protein, 9 aa, Homo Sapiens
RGEVPGSSA

SEQ ID NO: 1041406 - protein, 9 aa, Homo Sapiens
AKPMPKRSP

SEQ ID NO: 1041407 - protein, 9 aa, Homo Sapiens
QDMIESLFY

SEQ ID NO: 1041408 - protein, 9 aa, Homo Sapiens
LFASNVGGG

SEQ ID NO: 1041409 - protein, 9 aa, Homo Sapiens
SSYDLILAA

SEQ ID NO: 1041410 - protein, 9 aa, Homo Sapiens
EFRLLSSIV

SEQ ID NO: 1041411 - protein, 9 aa, Homo Sapiens
VTRGKDTAD

SEQ ID NO: 1041412 - protein, 9 aa, Homo Sapiens
LLLSLESGI

SEQ ID NO: 1041413 - protein, 9 aa, Homo Sapiens
KIHLQAYHT

SEQ ID NO: 1041414 - protein, 9 aa, Homo Sapiens
MSPDSPDSS

SEQ ID NO: 1041415 - protein, 9 aa, Homo Sapiens
KPLTPRQIH

SEQ ID NO: 1041416 - protein, 9 aa, Homo Sapiens
ANKLSFRNK

SEQ ID NO: 1041417 - protein, 9 aa, Homo Sapiens
TDEANSEVL

SEQ ID NO: 1041418 - protein, 9 aa, Homo Sapiens
KSEHKTFKF

SEQ ID NO: 1041419 - protein, 9 aa, Homo Sapiens
PFVLYLLQN

SEQ ID NO: 1041420 - protein, 9 aa, Homo Sapiens
QECGKAFER

SEQ ID NO: 1041421 - protein, 9 aa, Homo Sapiens
AVFYVFLHA

SEQ ID NO: 1041422 - protein, 9 aa, Homo Sapiens
DASESVQNG

SEQ ID NO: 1041423 - protein, 9 aa, Homo Sapiens
EKMTSKGKP

SEQ ID NO: 1041424 - protein, 9 aa, Homo Sapiens
ELFSLLYVF

SEQ ID NO: 1041425 - protein, 9 aa, Homo Sapiens
YLQVETRIS

SEQ ID NO: 1041426 - protein, 9 aa, Homo Sapiens
GSRCSPEKK

SEQ ID NO: 1041427 - protein, 9 aa, Homo Sapiens
YVQLLKQAG

SEQ ID NO: 1041428 - protein, 9 aa, Homo Sapiens
ARLETHAAG

SEQ ID NO: 1041429 - protein, 9 aa, Homo Sapiens
LNLWQKIRE

SEQ ID NO: 1041430 - protein, 9 aa, Homo Sapiens
ENEDDQDSL

SEQ ID NO: 1041431 - protein, 9 aa, Homo Sapiens
CQKTMASVA

SEQ ID NO: 1041432 - protein, 9 aa, Homo Sapiens
FFQRSRDES

SEQ ID NO: 1041433 - protein, 9 aa, Homo Sapiens
LSRSALGFS

SEQ ID NO: 1041434 - protein, 9 aa, Homo Sapiens
LPLLEAQVA

SEQ ID NO: 1041435 - protein, 9 aa, Homo Sapiens
HSSSGLRKL

SEQ ID NO: 1041436 - protein, 9 aa, Homo Sapiens
FIPLMFIIF

SEQ ID NO: 1041437 - protein, 9 aa, Homo Sapiens
PIPHGGNGT

SEQ ID NO: 1041438 - protein, 9 aa, Homo Sapiens
NISDPSGEE

SEQ ID NO: 1041439 - protein, 9 aa, Homo Sapiens
PIELQIPTP

SEQ ID NO: 1041440 - protein, 9 aa, Homo Sapiens
TLISQAFYV

SEQ ID NO: 1041441 - protein, 9 aa, Homo Sapiens
SLNTSENNS

SEQ ID NO: 1041442 - protein, 9 aa, Homo Sapiens
NLKEEEFEL

SEQ ID NO: 1041443 - protein, 9 aa, Homo Sapiens
DSRDRRRRK

SEQ ID NO: 1041444 - protein, 9 aa, Homo Sapiens
TSPSGGTRS

SEQ ID NO: 1041445 - protein, 9 aa, Homo Sapiens
FIGTLGRSR

SEQ ID NO: 1041446 - protein, 9 aa, Homo Sapiens
HGILVTGLQ

SEQ ID NO: 1041447 - protein, 9 aa, Homo Sapiens
LSQQKDSLP

SEQ ID NO: 1041448 - protein, 9 aa, Homo Sapiens
IISLSKKES

SEQ ID NO: 1041449 - protein, 9 aa, Homo Sapiens
SVRTFAQVM

SEQ ID NO: 1041450 - protein, 9 aa, Homo Sapiens
RRSHGKSHP

SEQ ID NO: 1041451 - protein, 9 aa, Homo Sapiens
LCQWSRMAS

SEQ ID NO: 1041452 - protein, 9 aa, Homo Sapiens
SAALVMLFF

SEQ ID NO: 1041453 - protein, 9 aa, Homo Sapiens
VGRIEKPFW

SEQ ID NO: 1041454 - protein, 9 aa, Homo Sapiens
SLSMSKDNM

SEQ ID NO: 1041455 - protein, 9 aa, Homo Sapiens
WDKDVAQKL

SEQ ID NO: 1041456 - protein, 9 aa, Homo Sapiens
FPRYTIYLG

SEQ ID NO: 1041457 - protein, 9 aa, Homo Sapiens
MVDLMTYGR

SEQ ID NO: 1041458 - protein, 9 aa, Homo Sapiens
QRRQKLRRR

SEQ ID NO: 1041459 - protein, 9 aa, Homo Sapiens
HWVRSLAEV

SEQ ID NO: 1041460 - protein, 9 aa, Homo Sapiens
KPGIARCSS

SEQ ID NO: 1041461 - protein, 9 aa, Homo Sapiens
SKAQYTSIY

SEQ ID NO: 1041462 - protein, 9 aa, Homo Sapiens
DCFQALKDE

SEQ ID NO: 1041463 - protein, 9 aa, Homo Sapiens
PRAYSFPVA

SEQ ID NO: 1041464 - protein, 9 aa, Homo Sapiens
KQELREWIE

SEQ ID NO: 1041465 - protein, 9 aa, Homo Sapiens
LLSSNYPEK

SEQ ID NO: 1041466 - protein, 9 aa, Homo Sapiens
LKVGLEMYS

SEQ ID NO: 1041467 - protein, 9 aa, Homo Sapiens
QPVGSLLSL

SEQ ID NO: 1041468 - protein, 9 aa, Homo Sapiens
LIQTDIGLI

SEQ ID NO: 1041469 - protein, 9 aa, Homo Sapiens
DGGPRLQAD

SEQ ID NO: 1041470 - protein, 9 aa, Homo Sapiens
MKHKFEEAK

SEQ ID NO: 1041471 - protein, 9 aa, Homo Sapiens
SSIKNESNY

SEQ ID NO: 1041472 - protein, 9 aa, Homo Sapiens
DSSIYFCSV

SEQ ID NO: 1041473 - protein, 9 aa, Homo Sapiens
RHRAILDTW

SEQ ID NO: 1041474 - protein, 9 aa, Homo Sapiens
KKEFVTKVM

SEQ ID NO: 1041475 - protein, 9 aa, Homo Sapiens
EVEHCHSEC

SEQ ID NO: 1041476 - protein, 9 aa, Homo Sapiens
RGSHAGLFF

SEQ ID NO: 1041477 - protein, 9 aa, Homo Sapiens
YYYRKPQVW

SEQ ID NO: 1041478 - protein, 9 aa, Homo Sapiens
RHSFPHQPT

SEQ ID NO: 1041479 - protein, 9 aa, Homo Sapiens
QLSYHDLVP

SEQ ID NO: 1041480 - protein, 9 aa, Homo Sapiens
LASTGGRSA

SEQ ID NO: 1041481 - protein, 9 aa, Homo Sapiens
AVKQFLQVH

SEQ ID NO: 1041482 - protein, 9 aa, Homo Sapiens
ERNDKEQFE

SEQ ID NO: 1041483 - protein, 9 aa, Homo Sapiens
HLSAFETET

SEQ ID NO: 1041484 - protein, 9 aa, Homo Sapiens
GAPLFMDCG

SEQ ID NO: 1041485 - protein, 9 aa, Homo Sapiens
VKDSQQALK

SEQ ID NO: 1041486 - protein, 9 aa, Homo Sapiens
FFVNCSLPN

SEQ ID NO: 1041487 - protein, 9 aa, Homo Sapiens
SEAAGPREA

SEQ ID NO: 1041488 - protein, 9 aa, Homo Sapiens
HVATRVMWT

SEQ ID NO: 1041489 - protein, 9 aa, Homo Sapiens
WISHGGPFI

SEQ ID NO: 1041490 - protein, 9 aa, Homo Sapiens
YGGHRGLGQ

SEQ ID NO: 1041491 - protein, 9 aa, Homo Sapiens
FMESFEVCT

SEQ ID NO: 1041492 - protein, 9 aa, Homo Sapiens
CKRFPEAPF

SEQ ID NO: 1041493 - protein, 9 aa, Homo Sapiens
KINSPWRTH

SEQ ID NO: 1041494 - protein, 9 aa, Homo Sapiens
KMVRSRGSG

SEQ ID NO: 1041495 - protein, 9 aa, Homo Sapiens
MKNIYCLIS

SEQ ID NO: 1041496 - protein, 9 aa, Homo Sapiens
FCASLLRFK

SEQ ID NO: 1041497 - protein, 9 aa, Homo Sapiens
LQRGQQLME

SEQ ID NO: 1041498 - protein, 9 aa, Homo Sapiens
ENGTWPRQT

SEQ ID NO: 1041499 - protein, 9 aa, Homo Sapiens
SKTCNSETQ

SEQ ID NO: 1041500 - protein, 9 aa, Homo Sapiens
GAGDLYLLF

SEQ ID NO: 1041501 - protein, 9 aa, Homo Sapiens
IQLVEMLRG

SEQ ID NO: 1041502 - protein, 9 aa, Homo Sapiens
ELEAFRSQL

SEQ ID NO: 1041503 - protein, 9 aa, Homo Sapiens
LNIAVTPLK

SEQ ID NO: 1041504 - protein, 9 aa, Homo Sapiens
KSHIKTKIE

SEQ ID NO: 1041505 - protein, 9 aa, Homo Sapiens
KYFMQSDRE

SEQ ID NO: 1041506 - protein, 9 aa, Homo Sapiens
PYSQYSFNH

SEQ ID NO: 1041507 - protein, 9 aa, Homo Sapiens
CRLGGGLPN

SEQ ID NO: 1041508 - protein, 9 aa, Homo Sapiens
SWHGGLGRL

SEQ ID NO: 1041509 - protein, 9 aa, Homo Sapiens
EQLELQLEQ

SEQ ID NO: 1041510 - protein, 9 aa, Homo Sapiens
FSHHVVHKD

SEQ ID NO: 1041511 - protein, 9 aa, Homo Sapiens
LARKTFEQA

SEQ ID NO: 1041512 - protein, 9 aa, Homo Sapiens
HTSDTQWGW

SEQ ID NO: 1041513 - protein, 9 aa, Homo Sapiens
CMGLKIEDT

SEQ ID NO: 1041514 - protein, 9 aa, Homo Sapiens
KEHLAKGQQ

SEQ ID NO: 1041515 - protein, 9 aa, Homo Sapiens
EHLAKGQQM

SEQ ID NO: 1041516 - protein, 9 aa, Homo Sapiens
RSQYEALVK

SEQ ID NO: 1041517 - protein, 9 aa, Homo Sapiens
VSIPSCETP

SEQ ID NO: 1041518 - protein, 9 aa, Homo Sapiens
ASHPPVEGF

SEQ ID NO: 1041519 - protein, 9 aa, Homo Sapiens
CNPTQQEAG

SEQ ID NO: 1041520 - protein, 9 aa, Homo Sapiens
FVAGCRKFY

SEQ ID NO: 1041521 - protein, 9 aa, Homo Sapiens
GEGNCFSEW

SEQ ID NO: 1041522 - protein, 9 aa, Homo Sapiens
RKPQVWSNP

SEQ ID NO: 1041523 - protein, 9 aa, Homo Sapiens
CSDSFYSVF

SEQ ID NO: 1041524 - protein, 9 aa, Homo Sapiens
ASTAPKLSD

SEQ ID NO: 1041525 - protein, 9 aa, Homo Sapiens
FCERNKINF

SEQ ID NO: 1041526 - protein, 9 aa, Homo Sapiens
NAFEIILGP

SEQ ID NO: 1041527 - protein, 9 aa, Homo Sapiens
FRGFRYSEA

SEQ ID NO: 1041528 - protein, 9 aa, Homo Sapiens
FRQTWIDKG

SEQ ID NO: 1041529 - protein, 9 aa, Homo Sapiens
SGSCSSRSR

SEQ ID NO: 1041530 - protein, 9 aa, Homo Sapiens
DVLRIKYLY

SEQ ID NO: 1041531 - protein, 9 aa, Homo Sapiens
LLNDSGSAG

SEQ ID NO: 1041532 - protein, 9 aa, Homo Sapiens
IQLAVCQQR

SEQ ID NO: 1041533 - protein, 9 aa, Homo Sapiens
SFCDSMVLG

SEQ ID NO: 1041534 - protein, 9 aa, Homo Sapiens
RGGAECPAR

SEQ ID NO: 1041535 - protein, 9 aa, Homo Sapiens
KSLSTDTSW

SEQ ID NO: 1041536 - protein, 9 aa, Homo Sapiens
IIALCRKDL

SEQ ID NO: 1041537 - protein, 9 aa, Homo Sapiens
VFPEIQLEL

SEQ ID NO: 1041538 - protein, 9 aa, Homo Sapiens
ISSRLHLKR

SEQ ID NO: 1041539 - protein, 9 aa, Homo Sapiens
ETIDLLALT

SEQ ID NO: 1041540 - protein, 9 aa, Homo Sapiens
LDENETTCT

SEQ ID NO: 1041541 - protein, 9 aa, Homo Sapiens
GKSFKKYME

SEQ ID NO: 1041542 - protein, 9 aa, Homo Sapiens
EVQLFYQHK

SEQ ID NO: 1041543 - protein, 9 aa, Homo Sapiens
SKFIEADAP

SEQ ID NO: 1041544 - protein, 9 aa, Homo Sapiens
MRILMVGLN

SEQ ID NO: 1041545 - protein, 9 aa, Homo Sapiens
MFDNVVGIV

SEQ ID NO: 1041546 - protein, 9 aa, Homo Sapiens
VYKTYELVE

SEQ ID NO: 1041547 - protein, 9 aa, Homo Sapiens
FSVHYEREF

SEQ ID NO: 1041548 - protein, 9 aa, Homo Sapiens
EMSVSVQFR

SEQ ID NO: 1041549 - protein, 9 aa, Homo Sapiens
IFSAGRKHK

SEQ ID NO: 1041550 - protein, 9 aa, Homo Sapiens
PMSTLVYAD

SEQ ID NO: 1041551 - protein, 9 aa, Homo Sapiens
AICLPISNP

SEQ ID NO: 1041552 - protein, 9 aa, Homo Sapiens
IYDSTDLEN

SEQ ID NO: 1041553 - protein, 9 aa, Homo Sapiens
CTKDRIQHA

SEQ ID NO: 1041554 - protein, 9 aa, Homo Sapiens
FAVPFFSQQ

SEQ ID NO: 1041555 - protein, 9 aa, Homo Sapiens
GGFSCSCLD

SEQ ID NO: 1041556 - protein, 9 aa, Homo Sapiens
MASKKLEVQ

SEQ ID NO: 1041557 - protein, 9 aa, Homo Sapiens
LIHTINLRR

SEQ ID NO: 1041558 - protein, 9 aa, Homo Sapiens
SCVQLANKL

SEQ ID NO: 1041559 - protein, 9 aa, Homo Sapiens
RTISFLSCI

SEQ ID NO: 1041560 - protein, 9 aa, Homo Sapiens
GAADAAGAA

SEQ ID NO: 1041561 - protein, 9 aa, Homo Sapiens
ETSEDIERL

SEQ ID NO: 1041562 - protein, 9 aa, Homo Sapiens
RCDSCGKEF

SEQ ID NO: 1041563 - protein, 9 aa, Homo Sapiens
LDPAGYFVP

SEQ ID NO: 1041564 - protein, 9 aa, Homo Sapiens
SLSPDSKAQ

SEQ ID NO: 1041565 - protein, 9 aa, Homo Sapiens
NCSPHINVY

SEQ ID NO: 1041566 - protein, 9 aa, Homo Sapiens
YQCAEDKKT

SEQ ID NO: 1041567 - protein, 9 aa, Homo Sapiens
QHENIFSSP

SEQ ID NO: 1041568 - protein, 9 aa, Homo Sapiens
CLVSKGLGQ

SEQ ID NO: 1041569 - protein, 9 aa, Homo Sapiens
LMMPRPPTL

SEQ ID NO: 1041570 - protein, 9 aa, Homo Sapiens
PLLEATDNN

SEQ ID NO: 1041571 - protein, 9 aa, Homo Sapiens
QISMYYFLS

SEQ ID NO: 1041572 - protein, 9 aa, Homo Sapiens
VLYLLQNGS

SEQ ID NO: 1041573 - protein, 9 aa, Homo Sapiens
SAVTKIKLH

SEQ ID NO: 1041574 - protein, 9 aa, Homo Sapiens
LSRIRLEKA

SEQ ID NO: 1041575 - protein, 9 aa, Homo Sapiens
QVESSLVST

SEQ ID NO: 1041576 - protein, 9 aa, Homo Sapiens
FQPRAYSFP

SEQ ID NO: 1041577 - protein, 9 aa, Homo Sapiens
RIRLEKASI

SEQ ID NO: 1041578 - protein, 9 aa, Homo Sapiens
LLTIISYLN

SEQ ID NO: 1041579 - protein, 9 aa, Homo Sapiens
STFILLFYA

SEQ ID NO: 1041580 - protein, 9 aa, Homo Sapiens
QQKLIIVEE

SEQ ID NO: 1041581 - protein, 9 aa, Homo Sapiens
GLLPGSLLF

SEQ ID NO: 1041582 - protein, 9 aa, Homo Sapiens
TCKVTYCPI

SEQ ID NO: 1041583 - protein, 9 aa, Homo Sapiens
LFRGEDSRR

SEQ ID NO: 1041584 - protein, 9 aa, Homo Sapiens
KTNRREVEQ

SEQ ID NO: 1041585 - protein, 9 aa, Homo Sapiens
EEEAVEFCC

SEQ ID NO: 1041586 - protein, 9 aa, Homo Sapiens
YNTAGTGSS

SEQ ID NO: 1041587 - protein, 9 aa, Homo Sapiens
FTGHKKRKH

SEQ ID NO: 1041588 - protein, 9 aa, Homo Sapiens
KNGQIHRDL

SEQ ID NO: 1041589 - protein, 9 aa, Homo Sapiens
GWCKKTKHE

SEQ ID NO: 1041590 - protein, 9 aa, Homo Sapiens
TRGILYQDK

SEQ ID NO: 1041591 - protein, 9 aa, Homo Sapiens
GERTFTYSL

SEQ ID NO: 1041592 - protein, 9 aa, Homo Sapiens
KPENFFVNC

SEQ ID NO: 1041593 - protein, 9 aa, Homo Sapiens
RLAEPYVKV

SEQ ID NO: 1041594 - protein, 9 aa, Homo Sapiens
DSSFATLPP

SEQ ID NO: 1041595 - protein, 9 aa, Homo Sapiens
FIVSSNDED

SEQ ID NO: 1041596 - protein, 9 aa, Homo Sapiens
RLIKSKIQL

SEQ ID NO: 1041597 - protein, 9 aa, Homo Sapiens
LVSIPSCET

SEQ ID NO: 1041598 - protein, 9 aa, Homo Sapiens
SGLKHVPCV

SEQ ID NO: 1041599 - protein, 9 aa, Homo Sapiens
GRLPSEFFQ

SEQ ID NO: 1041600 - protein, 9 aa, Homo Sapiens
SLRKMETFV

SEQ ID NO: 1041601 - protein, 9 aa, Homo Sapiens
TSTKYTCDI

SEQ ID NO: 1041602 - protein, 9 aa, Homo Sapiens
PILSHATLY

SEQ ID NO: 1041603 - protein, 9 aa, Homo Sapiens
MLEPVGRKA

SEQ ID NO: 1041604 - protein, 9 aa, Homo Sapiens
KEFSSSTGL

SEQ ID NO: 1041605 - protein, 9 aa, Homo Sapiens
TVELGCVNF

SEQ ID NO: 1041606 - protein, 9 aa, Homo Sapiens
LPIPVLSNN

SEQ ID NO: 1041607 - protein, 9 aa, Homo Sapiens
KVCKNKTTV

SEQ ID NO: 1041608 - protein, 9 aa, Homo Sapiens
HSGERLFAC

SEQ ID NO: 1041609 - protein, 9 aa, Homo Sapiens
QENKILKQI

SEQ ID NO: 1041610 - protein, 9 aa, Homo Sapiens
NLKQNVTFH

SEQ ID NO: 1041611 - protein, 9 aa, Homo Sapiens
TSESVREGH

SEQ ID NO: 1041612 - protein, 9 aa, Homo Sapiens
KPLLEKFHC

SEQ ID NO: 1041613 - protein, 9 aa, Homo Sapiens
QLTFEILLN

SEQ ID NO: 1041614 - protein, 9 aa, Homo Sapiens
DNEPLVSES

SEQ ID NO: 1041615 - protein, 9 aa, Homo Sapiens
NVSEIALTS

SEQ ID NO: 1041616 - protein, 9 aa, Homo Sapiens
SSDDFEDER

SEQ ID NO: 1041617 - protein, 9 aa, Homo Sapiens
LLAQFVNQG

SEQ ID NO: 1041618 - protein, 9 aa, Homo Sapiens
CTKTGANLF

SEQ ID NO: 1041619 - protein, 9 aa, Homo Sapiens
GAGIAMSTW

SEQ ID NO: 1041620 - protein, 9 aa, Homo Sapiens
RFTIISNTT

SEQ ID NO: 1041621 - protein, 9 aa, Homo Sapiens
TEVSEGLQL

SEQ ID NO: 1041622 - protein, 9 aa, Homo Sapiens
DRNFTTPQD

SEQ ID NO: 1041623 - protein, 9 aa, Homo Sapiens
KSKKEPGVV

SEQ ID NO: 1041624 - protein, 9 aa, Homo Sapiens
SKRALGPAS

SEQ ID NO: 1041625 - protein, 9 aa, Homo Sapiens
GCRDPSLPY

SEQ ID NO: 1041626 - protein, 9 aa, Homo Sapiens
PKEPKIVMT

SEQ ID NO: 1041627 - protein, 9 aa, Homo Sapiens
AAGKTYIIF

SEQ ID NO: 1041628 - protein, 9 aa, Homo Sapiens
FLYVRPVSN

SEQ ID NO: 1041629 - protein, 9 aa, Homo Sapiens
VLSEKDMIR

SEQ ID NO: 1041630 - protein, 9 aa, Homo Sapiens
EAIGKNNPS

SEQ ID NO: 1041631 - protein, 9 aa, Homo Sapiens
SYSCEMCNF

SEQ ID NO: 1041632 - protein, 9 aa, Homo Sapiens
HSFAFGICI

SEQ ID NO: 1041633 - protein, 9 aa, Homo Sapiens
AKPKSKLSV

SEQ ID NO: 1041634 - protein, 9 aa, Homo Sapiens
NQYVCWPHS

SEQ ID NO: 1041635 - protein, 9 aa, Homo Sapiens
LFPQAASLR

SEQ ID NO: 1041636 - protein, 9 aa, Homo Sapiens
EQPMEGFHQ

SEQ ID NO: 1041637 - protein, 9 aa, Homo Sapiens
SVLQPLAQE

SEQ ID NO: 1041638 - protein, 9 aa, Homo Sapiens
YAVPWTQKK

SEQ ID NO: 1041639 - protein, 9 aa, Homo Sapiens
MRRPSSLRK

SEQ ID NO: 1041640 - protein, 9 aa, Homo Sapiens
YSSSPHLLS

SEQ ID NO: 1041641 - protein, 9 aa, Homo Sapiens
HGGHRSSTA

SEQ ID NO: 1041642 - protein, 9 aa, Homo Sapiens
PSLASRSGS

SEQ ID NO: 1041643 - protein, 9 aa, Homo Sapiens
GYFTHMVGK

SEQ ID NO: 1041644 - protein, 9 aa, Homo Sapiens
TARTQQYPY

SEQ ID NO: 1041645 - protein, 9 aa, Homo Sapiens
PNNKAAKIQ

SEQ ID NO: 1041646 - protein, 9 aa, Homo Sapiens
FIGLFETQK

SEQ ID NO: 1041647 - protein, 9 aa, Homo Sapiens
EQLDLGKKP

SEQ ID NO: 1041648 - protein, 9 aa, Homo Sapiens
NAKVTPGLT

SEQ ID NO: 1041649 - protein, 9 aa, Homo Sapiens
HFSHSAVYL

SEQ ID NO: 1041650 - protein, 9 aa, Homo Sapiens
AEDAVFVLG

SEQ ID NO: 1041651 - protein, 9 aa, Homo Sapiens
RPLDRLPKT

SEQ ID NO: 1041652 - protein, 9 aa, Homo Sapiens
SEWDGLICW

SEQ ID NO: 1041653 - protein, 9 aa, Homo Sapiens
FQEVPKQRN

SEQ ID NO: 1041654 - protein, 9 aa, Homo Sapiens
EKEEEQKDD

SEQ ID NO: 1041655 - protein, 9 aa, Homo Sapiens
GQNMAVLLA

SEQ ID NO: 1041656 - protein, 9 aa, Homo Sapiens
AICKLMRKA

SEQ ID NO: 1041657 - protein, 9 aa, Homo Sapiens
ISPPKPRVS

SEQ ID NO: 1041658 - protein, 9 aa, Homo Sapiens
TDSAVNTAT

SEQ ID NO: 1041659 - protein, 9 aa, Homo Sapiens
RKLKKRQPL

SEQ ID NO: 1041660 - protein, 9 aa, Homo Sapiens
SSVNSEAFL

SEQ ID NO: 1041661 - protein, 9 aa, Homo Sapiens
EDPKKFAGG

SEQ ID NO: 1041662 - protein, 9 aa, Homo Sapiens
PARPPKPRS

SEQ ID NO: 1041663 - protein, 9 aa, Homo Sapiens
EDLIGMDSR

SEQ ID NO: 1041664 - protein, 9 aa, Homo Sapiens
LRKMETFVS

SEQ ID NO: 1041665 - protein, 9 aa, Homo Sapiens
GHFCDITIC

SEQ ID NO: 1041666 - protein, 9 aa, Homo Sapiens
FESPKAGED

SEQ ID NO: 1041667 - protein, 9 aa, Homo Sapiens
MPQVPNKII

SEQ ID NO: 1041668 - protein, 9 aa, Homo Sapiens
SSIALVRDL

SEQ ID NO: 1041669 - protein, 9 aa, Homo Sapiens
QRSVKFDRE

SEQ ID NO: 1041670 - protein, 9 aa, Homo Sapiens
FAMFGAGIA

SEQ ID NO: 1041671 - protein, 9 aa, Homo Sapiens
LCLSDPGLK

SEQ ID NO: 1041672 - protein, 9 aa, Homo Sapiens
WVEKPSFEK

SEQ ID NO: 1041673 - protein, 9 aa, Homo Sapiens
PILIRILYG

SEQ ID NO: 1041674 - protein, 9 aa, Homo Sapiens
FSSAEKAIT

SEQ ID NO: 1041675 - protein, 9 aa, Homo Sapiens
SPDSKAQYT

SEQ ID NO: 1041676 - protein, 9 aa, Homo Sapiens
PEQLFKYQK

SEQ ID NO: 1041677 - protein, 9 aa, Homo Sapiens
ELLNLVHLD

SEQ ID NO: 1041678 - protein, 9 aa, Homo Sapiens
AVSGSAEVQ

SEQ ID NO: 1041679 - protein, 9 aa, Homo Sapiens
IWFQNRRIK

SEQ ID NO: 1041680 - protein, 9 aa, Homo Sapiens
TWEYNDNSC

SEQ ID NO: 1041681 - protein, 9 aa, Homo Sapiens
HPGGFLEGP

SEQ ID NO: 1041682 - protein, 9 aa, Homo Sapiens
LISKLVNFA

SEQ ID NO: 1041683 - protein, 9 aa, Homo Sapiens
VPVVWAQEE

SEQ ID NO: 1041684 - protein, 9 aa, Homo Sapiens
ELITAWYIE

SEQ ID NO: 1041685 - protein, 9 aa, Homo Sapiens
VSVSQSVQG

SEQ ID NO: 1041686 - protein, 9 aa, Homo Sapiens
LYGEPPKFP

SEQ ID NO: 1041687 - protein, 9 aa, Homo Sapiens
LGLFFRRPN

SEQ ID NO: 1041688 - protein, 9 aa, Homo Sapiens
VYWEVQLEQ

SEQ ID NO: 1041689 - protein, 9 aa, Homo Sapiens
PMVGILLFF

SEQ ID NO: 1041690 - protein, 9 aa, Homo Sapiens
LQSAAYNLL

SEQ ID NO: 1041691 - protein, 9 aa, Homo Sapiens
LLPFNEDTT

SEQ ID NO: 1041692 - protein, 9 aa, Homo Sapiens
NTPETTMPL

SEQ ID NO: 1041693 - protein, 9 aa, Homo Sapiens
REALGLVGA

SEQ ID NO: 1041694 - protein, 9 aa, Homo Sapiens
ELSKPRQSP

SEQ ID NO: 1041695 - protein, 9 aa, Homo Sapiens
SPATHQAPL

SEQ ID NO: 1041696 - protein, 9 aa, Homo Sapiens
VETRISSRL

SEQ ID NO: 1041697 - protein, 9 aa, Homo Sapiens
VPGGAEAAG

SEQ ID NO: 1041698 - protein, 9 aa, Homo Sapiens
KSLGLGAPE

SEQ ID NO: 1041699 - protein, 9 aa, Homo Sapiens
ITIFHVGRF

SEQ ID NO: 1041700 - protein, 9 aa, Homo Sapiens
QGHFDSFIV

SEQ ID NO: 1041701 - protein, 9 aa, Homo Sapiens
GDIATSHEN

SEQ ID NO: 1041702 - protein, 9 aa, Homo Sapiens
GAQGLPGPA

SEQ ID NO: 1041703 - protein, 9 aa, Homo Sapiens
PNNSDLTLY

SEQ ID NO: 1041704 - protein, 9 aa, Homo Sapiens
SLSCIRSQP

SEQ ID NO: 1041705 - protein, 9 aa, Homo Sapiens
LYQDKNLVV

SEQ ID NO: 1041706 - protein, 9 aa, Homo Sapiens
TPTIVNLDY

SEQ ID NO: 1041707 - protein, 9 aa, Homo Sapiens
RRQFGSNTF

SEQ ID NO: 1041708 - protein, 9 aa, Homo Sapiens
KCSGIHRSL

SEQ ID NO: 1041709 - protein, 9 aa, Homo Sapiens
SNAGVLWPI

SEQ ID NO: 1041710 - protein, 9 aa, Homo Sapiens
AGAQGLPGP

SEQ ID NO: 1041711 - protein, 9 aa, Homo Sapiens
ISLKRNLQK

SEQ ID NO: 1041712 - protein, 9 aa, Homo Sapiens
DAQALKELI

SEQ ID NO: 1041713 - protein, 9 aa, Homo Sapiens
KTNREKMTQ

SEQ ID NO: 1041714 - protein, 9 aa, Homo Sapiens
TKRHMTQPR

SEQ ID NO: 1041715 - protein, 9 aa, Homo Sapiens
FILAVCCGS

SEQ ID NO: 1041716 - protein, 9 aa, Homo Sapiens
DEANSEVLY

SEQ ID NO: 1041717 - protein, 9 aa, Homo Sapiens
KGPQTLSVR

SEQ ID NO: 1041718 - protein, 9 aa, Homo Sapiens
LSGPGALAA

SEQ ID NO: 1041719 - protein, 9 aa, Homo Sapiens
EAVMRRLHL

SEQ ID NO: 1041720 - protein, 9 aa, Homo Sapiens
RVLHIRKLL

SEQ ID NO: 1041721 - protein, 9 aa, Homo Sapiens
SRVFEPVLE

SEQ ID NO: 1041722 - protein, 9 aa, Homo Sapiens
LSLIEHQRI

SEQ ID NO: 1041723 - protein, 9 aa, Homo Sapiens
DSSSPTEHV

SEQ ID NO: 1041724 - protein, 9 aa, Homo Sapiens
AQKDEFLHE

SEQ ID NO: 1041725 - protein, 9 aa, Homo Sapiens
SDISAFREG

SEQ ID NO: 1041726 - protein, 9 aa, Homo Sapiens
SLWRPEKLE

SEQ ID NO: 1041727 - protein, 9 aa, Homo Sapiens
PVGISRPPS

SEQ ID NO: 1041728 - protein, 9 aa, Homo Sapiens
LQRVDAPVL

SEQ ID NO: 1041729 - protein, 9 aa, Homo Sapiens
SPEKQLGIK

SEQ ID NO: 1041730 - protein, 9 aa, Homo Sapiens
TASQVPVEE

SEQ ID NO: 1041731 - protein, 9 aa, Homo Sapiens
ELLFTAGTV

SEQ ID NO: 1041732 - protein, 9 aa, Homo Sapiens
QGVNMLPLK

SEQ ID NO: 1041733 - protein, 9 aa, Homo Sapiens
LKKPITEIQ

SEQ ID NO: 1041734 - protein, 9 aa, Homo Sapiens
FCDITICVQ

SEQ ID NO: 1041735 - protein, 9 aa, Homo Sapiens
SSPCPSIWD

SEQ ID NO: 1041736 - protein, 9 aa, Homo Sapiens
CLLQMVFIY

SEQ ID NO: 1041737 - protein, 9 aa, Homo Sapiens
VDESGGFPL

SEQ ID NO: 1041738 - protein, 9 aa, Homo Sapiens
AQVMRLCAA

SEQ ID NO: 1041739 - protein, 9 aa, Homo Sapiens
PPSVVHTGG

SEQ ID NO: 1041740 - protein, 9 aa, Homo Sapiens
EKNYEEVGT

SEQ ID NO: 1041741 - protein, 9 aa, Homo Sapiens
TLSTEEIFN

SEQ ID NO: 1041742 - protein, 9 aa, Homo Sapiens
RQKLENRCQ

SEQ ID NO: 1041743 - protein, 9 aa, Homo Sapiens
LRGPKVHKK

SEQ ID NO: 1041744 - protein, 9 aa, Homo Sapiens
VLSLLLLLV

SEQ ID NO: 1041745 - protein, 9 aa, Homo Sapiens
VHKRVPPKE

SEQ ID NO: 1041746 - protein, 9 aa, Homo Sapiens
ESTSGGQMY

SEQ ID NO: 1041747 - protein, 9 aa, Homo Sapiens
PQLTPTAVS

SEQ ID NO: 1041748 - protein, 9 aa, Homo Sapiens
LDRRLFYFL

SEQ ID NO: 1041749 - protein, 9 aa, Homo Sapiens
AVKETFSVK

SEQ ID NO: 1041750 - protein, 9 aa, Homo Sapiens
ENNSEHQTN

SEQ ID NO: 1041751 - protein, 9 aa, Homo Sapiens
RKQQEIHYK

SEQ ID NO: 1041752 - protein, 9 aa, Homo Sapiens
KKNAAEALL

SEQ ID NO: 1041753 - protein, 9 aa, Homo Sapiens
CRERPAWSG

SEQ ID NO: 1041754 - protein, 9 aa, Homo Sapiens
ESELEVLKI

SEQ ID NO: 1041755 - protein, 9 aa, Homo Sapiens
DITEGDKKP

SEQ ID NO: 1041756 - protein, 9 aa, Homo Sapiens
GIRGREIRI

SEQ ID NO: 1041757 - protein, 9 aa, Homo Sapiens
PTTWEYNDN

SEQ ID NO: 1041758 - protein, 9 aa, Homo Sapiens
WESELEVLK

SEQ ID NO: 1041759 - protein, 9 aa, Homo Sapiens
GKCKRHRSR

SEQ ID NO: 1041760 - protein, 9 aa, Homo Sapiens
SEVSTRARF

SEQ ID NO: 1041761 - protein, 9 aa, Homo Sapiens
KGGNCGLQQ

SEQ ID NO: 1041762 - protein, 9 aa, Homo Sapiens
EFLHETLLD

SEQ ID NO: 1041763 - protein, 9 aa, Homo Sapiens
QEMPYIDAV

SEQ ID NO: 1041764 - protein, 9 aa, Homo Sapiens
LDLLFVTLS

SEQ ID NO: 1041765 - protein, 9 aa, Homo Sapiens
CSNRGHSHN

SEQ ID NO: 1041766 - protein, 9 aa, Homo Sapiens
GVKPFKLHP

SEQ ID NO: 1041767 - protein, 9 aa, Homo Sapiens
SPQQEEKNT

SEQ ID NO: 1041768 - protein, 9 aa, Homo Sapiens
EISDINLDV

SEQ ID NO: 1041769 - protein, 9 aa, Homo Sapiens
DYLVMRKIS

SEQ ID NO: 1041770 - protein, 9 aa, Homo Sapiens
LLDENETTC

SEQ ID NO: 1041771 - protein, 9 aa, Homo Sapiens
LFCRPVCRP

SEQ ID NO: 1041772 - protein, 9 aa, Homo Sapiens
LEGKQKAFY

SEQ ID NO: 1041773 - protein, 9 aa, Homo Sapiens
SASAEVRRR

SEQ ID NO: 1041774 - protein, 9 aa, Homo Sapiens
LITRGGWQS

SEQ ID NO: 1041775 - protein, 9 aa, Homo Sapiens
ISKLVNFAT

SEQ ID NO: 1041776 - protein, 9 aa, Homo Sapiens
RIEKPFWQN

SEQ ID NO: 1041777 - protein, 9 aa, Homo Sapiens
MADNLAKKN

SEQ ID NO: 1041778 - protein, 9 aa, Homo Sapiens
FCLILPLPD

SEQ ID NO: 1041779 - protein, 9 aa, Homo Sapiens
KKFKSALRR

SEQ ID NO: 1041780 - protein, 9 aa, Homo Sapiens
GIHALSEGW

SEQ ID NO: 1041781 - protein, 9 aa, Homo Sapiens
YFIDLPRKK

SEQ ID NO: 1041782 - protein, 9 aa, Homo Sapiens
SKECEENTQ

SEQ ID NO: 1041783 - protein, 9 aa, Homo Sapiens
EKRCALGTA

SEQ ID NO: 1041784 - protein, 9 aa, Homo Sapiens
KQKKGKEKQ

SEQ ID NO: 1041785 - protein, 9 aa, Homo Sapiens
APGRDARDS

SEQ ID NO: 1041786 - protein, 9 aa, Homo Sapiens
QTDIGLIYH

SEQ ID NO: 1041787 - protein, 9 aa, Homo Sapiens
TCAFHLTAI

SEQ ID NO: 1041788 - protein, 9 aa, Homo Sapiens
EAGISHRTV

SEQ ID NO: 1041789 - protein, 9 aa, Homo Sapiens
DKKNQELRW

SEQ ID NO: 1041790 - protein, 9 aa, Homo Sapiens
LFKYQKDCQ

SEQ ID NO: 1041791 - protein, 9 aa, Homo Sapiens
ASSPSQPAV

SEQ ID NO: 1041792 - protein, 9 aa, Homo Sapiens
NTNVRLNKM

SEQ ID NO: 1041793 - protein, 9 aa, Homo Sapiens
DASISRNIL

SEQ ID NO: 1041794 - protein, 9 aa, Homo Sapiens
EILLSLVCL

SEQ ID NO: 1041795 - protein, 9 aa, Homo Sapiens
EATRPPSFT

SEQ ID NO: 1041796 - protein, 9 aa, Homo Sapiens
LKQTNKMLR

SEQ ID NO: 1041797 - protein, 9 aa, Homo Sapiens
LLLGPGFGL

SEQ ID NO: 1041798 - protein, 9 aa, Homo Sapiens
PPVPSLPSR

SEQ ID NO: 1041799 - protein, 9 aa, Homo Sapiens
PDGRSQEVG

SEQ ID NO: 1041800 - protein, 9 aa, Homo Sapiens
KEAALCAGW

SEQ ID NO: 1041801 - protein, 9 aa, Homo Sapiens
AYTFNTEAV

SEQ ID NO: 1041802 - protein, 9 aa, Homo Sapiens
MSPADKCSR

SEQ ID NO: 1041803 - protein, 9 aa, Homo Sapiens
VQLEQMEST

SEQ ID NO: 1041804 - protein, 9 aa, Homo Sapiens
TSAFPAFTM

SEQ ID NO: 1041805 - protein, 9 aa, Homo Sapiens
FCTPGLKIL

SEQ ID NO: 1041806 - protein, 9 aa, Homo Sapiens
AVEGRLESA

SEQ ID NO: 1041807 - protein, 9 aa, Homo Sapiens
PPRPYHQEP

SEQ ID NO: 1041808 - protein, 9 aa, Homo Sapiens
LVSKGLGQP

SEQ ID NO: 1041809 - protein, 9 aa, Homo Sapiens
RASCAEGDD

SEQ ID NO: 1041810 - protein, 9 aa, Homo Sapiens
DPESEDVKR

SEQ ID NO: 1041811 - protein, 9 aa, Homo Sapiens
ISYASTAPK

SEQ ID NO: 1041812 - protein, 9 aa, Homo Sapiens
TKIYQWCGS

SEQ ID NO: 1041813 - protein, 9 aa, Homo Sapiens
NAMWKKDKK

SEQ ID NO: 1041814 - protein, 9 aa, Homo Sapiens
SEFLKKMSL

SEQ ID NO: 1041815 - protein, 9 aa, Homo Sapiens
PIDCDESGI

SEQ ID NO: 1041816 - protein, 9 aa, Homo Sapiens
PPAASQEAT

SEQ ID NO: 1041817 - protein, 9 aa, Homo Sapiens
QVYGNNIKP

SEQ ID NO: 1041818 - protein, 9 aa, Homo Sapiens
SKHPRCPPK

SEQ ID NO: 1041819 - protein, 9 aa, Homo Sapiens
LKRANPPIT

SEQ ID NO: 1041820 - protein, 9 aa, Homo Sapiens
NGKKQFNSF

SEQ ID NO: 1041821 - protein, 9 aa, Homo Sapiens
HKGNGEPLP

SEQ ID NO: 1041822 - protein, 9 aa, Homo Sapiens
SYHTFCLIL

SEQ ID NO: 1041823 - protein, 9 aa, Homo Sapiens
LIKDGLIIC

SEQ ID NO: 1041824 - protein, 9 aa, Homo Sapiens
GPAGMAPQG

SEQ ID NO: 1041825 - protein, 9 aa, Homo Sapiens
QGEAGAETG

SEQ ID NO: 1041826 - protein, 9 aa, Homo Sapiens
ELGCVNFPP

SEQ ID NO: 1041827 - protein, 9 aa, Homo Sapiens
YPSGWLYGP

SEQ ID NO: 1041828 - protein, 9 aa, Homo Sapiens
GSDGSLSPL

SEQ ID NO: 1041829 - protein, 9 aa, Homo Sapiens
KHKFEEAKS

SEQ ID NO: 1041830 - protein, 9 aa, Homo Sapiens
EIYQKLTRL

SEQ ID NO: 1041831 - protein, 9 aa, Homo Sapiens
DRQEMPYID

SEQ ID NO: 1041832 - protein, 9 aa, Homo Sapiens
YIKKYQKTL

SEQ ID NO: 1041833 - protein, 9 aa, Homo Sapiens
TFQHSVVVP

SEQ ID NO: 1041834 - protein, 9 aa, Homo Sapiens
SVSMPMEIG

SEQ ID NO: 1041835 - protein, 9 aa, Homo Sapiens
CMNVAQLQL

SEQ ID NO: 1041836 - protein, 9 aa, Homo Sapiens
VRSGCQGDF

SEQ ID NO: 1041837 - protein, 9 aa, Homo Sapiens
PLLEKFHCI

SEQ ID NO: 1041838 - protein, 9 aa, Homo Sapiens
KVLKESDNG

SEQ ID NO: 1041839 - protein, 9 aa, Homo Sapiens
CVTSTLDLD

SEQ ID NO: 1041840 - protein, 9 aa, Homo Sapiens
KEGSRDPAD

SEQ ID NO: 1041841 - protein, 9 aa, Homo Sapiens
HLMFKKHQL

SEQ ID NO: 1041842 - protein, 9 aa, Homo Sapiens
RLITRGGWQ

SEQ ID NO: 1041843 - protein, 9 aa, Homo Sapiens
QKTVQFSIP

SEQ ID NO: 1041844 - protein, 9 aa, Homo Sapiens
LSSSERITD

SEQ ID NO: 1041845 - protein, 9 aa, Homo Sapiens
GWLYGPSDM

SEQ ID NO: 1041846 - protein, 9 aa, Homo Sapiens
AVPSSTKLA

SEQ ID NO: 1041847 - protein, 9 aa, Homo Sapiens
DGIGKMELF

SEQ ID NO: 1041848 - protein, 9 aa, Homo Sapiens
SLEYSDYFK

SEQ ID NO: 1041849 - protein, 9 aa, Homo Sapiens
SGSRHHETS

SEQ ID NO: 1041850 - protein, 9 aa, Homo Sapiens
DLKTKINSP

SEQ ID NO: 1041851 - protein, 9 aa, Homo Sapiens
SHGLQDGKD

SEQ ID NO: 1041852 - protein, 9 aa, Homo Sapiens
RTSPQGFPP

SEQ ID NO: 1041853 - protein, 9 aa, Homo Sapiens
EVGSLLARF

SEQ ID NO: 1041854 - protein, 9 aa, Homo Sapiens
SETITPRGP

SEQ ID NO: 1041855 - protein, 9 aa, Homo Sapiens
NGPSPKFQL

SEQ ID NO: 1041856 - protein, 9 aa, Homo Sapiens
KMWRQKEKI

SEQ ID NO: 1041857 - protein, 9 aa, Homo Sapiens
FKAFSYLSH

SEQ ID NO: 1041858 - protein, 9 aa, Homo Sapiens
PFFSQQSGT

SEQ ID NO: 1041859 - protein, 9 aa, Homo Sapiens
LFHGVAYVN

SEQ ID NO: 1041860 - protein, 9 aa, Homo Sapiens
VLSSVSVSQ

SEQ ID NO: 1041861 - protein, 9 aa, Homo Sapiens
DVLDKWTDK

SEQ ID NO: 1041862 - protein, 9 aa, Homo Sapiens
ALYKYFISL

SEQ ID NO: 1041863 - protein, 9 aa, Homo Sapiens
RAKEAAPAA

SEQ ID NO: 1041864 - protein, 9 aa, Homo Sapiens
FVISRHEMP

SEQ ID NO: 1041865 - protein, 9 aa, Homo Sapiens
ILPGRCKWN

SEQ ID NO: 1041866 - protein, 9 aa, Homo Sapiens
ERPSLFRIH

SEQ ID NO: 1041867 - protein, 9 aa, Homo Sapiens
PKGDSGPPG

SEQ ID NO: 1041868 - protein, 9 aa, Homo Sapiens
IPNRIDLVA

SEQ ID NO: 1041869 - protein, 9 aa, Homo Sapiens
PNRHLYNFV

SEQ ID NO: 1041870 - protein, 9 aa, Homo Sapiens
DSNNPDVES

SEQ ID NO: 1041871 - protein, 9 aa, Homo Sapiens
LPFDDSYQL

SEQ ID NO: 1041872 - protein, 9 aa, Homo Sapiens
APGGVSGPF

SEQ ID NO: 1041873 - protein, 9 aa, Homo Sapiens
NDEAQYIMK

SEQ ID NO: 1041874 - protein, 9 aa, Homo Sapiens
CLPSRAARE

SEQ ID NO: 1041875 - protein, 9 aa, Homo Sapiens
KLSVGFKLL

SEQ ID NO: 1041876 - protein, 9 aa, Homo Sapiens
IWMLNDILQ

SEQ ID NO: 1041877 - protein, 9 aa, Homo Sapiens
LPGKAESLE

SEQ ID NO: 1041878 - protein, 9 aa, Homo Sapiens
FDFRVTVVS

SEQ ID NO: 1041879 - protein, 9 aa, Homo Sapiens
GDYLSPPSS

SEQ ID NO: 1041880 - protein, 9 aa, Homo Sapiens
FVKVVPFSS

SEQ ID NO: 1041881 - protein, 9 aa, Homo Sapiens
VPGAFAAAA

SEQ ID NO: 1041882 - protein, 9 aa, Homo Sapiens
EVPGSSAHY

SEQ ID NO: 1041883 - protein, 9 aa, Homo Sapiens
KNSHNFCED

SEQ ID NO: 1041884 - protein, 9 aa, Homo Sapiens
SYLQLSFWN

SEQ ID NO: 1041885 - protein, 9 aa, Homo Sapiens
VNGRLTAPQ

SEQ ID NO: 1041886 - protein, 9 aa, Homo Sapiens
VRIFNTNSF

SEQ ID NO: 1041887 - protein, 9 aa, Homo Sapiens
MNVSGVGFP

SEQ ID NO: 1041888 - protein, 9 aa, Homo Sapiens
EKNALRKQV

SEQ ID NO: 1041889 - protein, 9 aa, Homo Sapiens
NALRKQVRE

SEQ ID NO: 1041890 - protein, 9 aa, Homo Sapiens
YGRTAFILA

SEQ ID NO: 1041891 - protein, 9 aa, Homo Sapiens
RYKAQDTLA

SEQ ID NO: 1041892 - protein, 9 aa, Homo Sapiens
RGRAEGRAG

SEQ ID NO: 1041893 - protein, 9 aa, Homo Sapiens
WIRRNDKVP

SEQ ID NO: 1041894 - protein, 9 aa, Homo Sapiens
FTMSWVPLL

SEQ ID NO: 1041895 - protein, 9 aa, Homo Sapiens
GNIRYYKVS

SEQ ID NO: 1041896 - protein, 9 aa, Homo Sapiens
RGFLGPPHQ

SEQ ID NO: 1041897 - protein, 9 aa, Homo Sapiens
MAVFYVFLH

SEQ ID NO: 1041898 - protein, 9 aa, Homo Sapiens
MKNGFRCMA

SEQ ID NO: 1041899 - protein, 9 aa, Homo Sapiens
LKIRKPCPF

SEQ ID NO: 1041900 - protein, 9 aa, Homo Sapiens
KRGDKFFPK

SEQ ID NO: 1041901 - protein, 9 aa, Homo Sapiens
PGAHLEKKK

SEQ ID NO: 1041902 - protein, 9 aa, Homo Sapiens
DKKRADFVA

SEQ ID NO: 1041903 - protein, 9 aa, Homo Sapiens
MTNRLLDEI

SEQ ID NO: 1041904 - protein, 9 aa, Homo Sapiens
KRLVNLVVK

SEQ ID NO: 1041905 - protein, 9 aa, Homo Sapiens
IHNWIRRND

SEQ ID NO: 1041906 - protein, 9 aa, Homo Sapiens
FRRWATWEL

SEQ ID NO: 1041907 - protein, 9 aa, Homo Sapiens
IRYGFSPKE

SEQ ID NO: 1041908 - protein, 9 aa, Homo Sapiens
TNSFYYDVE

SEQ ID NO: 1041909 - protein, 9 aa, Homo Sapiens
LLTVDSVTH

SEQ ID NO: 1041910 - protein, 9 aa, Homo Sapiens
RVLQAFLDP

SEQ ID NO: 1041911 - protein, 9 aa, Homo Sapiens
IAPKRLVNL

SEQ ID NO: 1041912 - protein, 9 aa, Homo Sapiens
PPPKKEPLK

SEQ ID NO: 1041913 - protein, 9 aa, Homo Sapiens
YGKLQEHKA

SEQ ID NO: 1041914 - protein, 9 aa, Homo Sapiens
PVQIMFMKK

SEQ ID NO: 1041915 - protein, 9 aa, Homo Sapiens
EETSIAGNQ

SEQ ID NO: 1041916 - protein, 9 aa, Homo Sapiens
NIYCLISKL

SEQ ID NO: 1041917 - protein, 9 aa, Homo Sapiens
RDPEAASLG

SEQ ID NO: 1041918 - protein, 9 aa, Homo Sapiens
LSREELTTV

SEQ ID NO: 1041919 - protein, 9 aa, Homo Sapiens
SSGCNSDHW

SEQ ID NO: 1041920 - protein, 9 aa, Homo Sapiens
FGEPFEICR

SEQ ID NO: 1041921 - protein, 9 aa, Homo Sapiens
AAPCGACLT

SEQ ID NO: 1041922 - protein, 9 aa, Homo Sapiens
GRRMKFQSC

SEQ ID NO: 1041923 - protein, 9 aa, Homo Sapiens
GPLGRDLPQ

SEQ ID NO: 1041924 - protein, 9 aa, Homo Sapiens
FPKLLGNPD

SEQ ID NO: 1041925 - protein, 9 aa, Homo Sapiens
KPVGEVNSQ

SEQ ID NO: 1041926 - protein, 9 aa, Homo Sapiens
NGEFRLLSS

SEQ ID NO: 1041927 - protein, 9 aa, Homo Sapiens
APAGAGEGA

SEQ ID NO: 1041928 - protein, 9 aa, Homo Sapiens
KYLFSAFMR

SEQ ID NO: 1041929 - protein, 9 aa, Homo Sapiens
DARDSDCGF

SEQ ID NO: 1041930 - protein, 9 aa, Homo Sapiens
SQCLQSRNL

SEQ ID NO: 1041931 - protein, 9 aa, Homo Sapiens
NFPPEEALY

SEQ ID NO: 1041932 - protein, 9 aa, Homo Sapiens
DPRFFSSPR

SEQ ID NO: 1041933 - protein, 9 aa, Homo Sapiens
VVTAVEKMT

SEQ ID NO: 1041934 - protein, 9 aa, Homo Sapiens
CGEKKVPHF

SEQ ID NO: 1041935 - protein, 9 aa, Homo Sapiens
IFVFINSLY

SEQ ID NO: 1041936 - protein, 9 aa, Homo Sapiens
LSVKQKRLH

SEQ ID NO: 1041937 - protein, 9 aa, Homo Sapiens
KWQKVNLIF

SEQ ID NO: 1041938 - protein, 9 aa, Homo Sapiens
IGDIATSHE

SEQ ID NO: 1041939 - protein, 9 aa, Homo Sapiens
LETAIHHVH

SEQ ID NO: 1041940 - protein, 9 aa, Homo Sapiens
LILPLPDVP

SEQ ID NO: 1041941 - protein, 9 aa, Homo Sapiens
EVLRLLNED

SEQ ID NO: 1041942 - protein, 9 aa, Homo Sapiens
DYLVNGIFL

SEQ ID NO: 1041943 - protein, 9 aa, Homo Sapiens
TSSASAICK

SEQ ID NO: 1041944 - protein, 9 aa, Homo Sapiens
DGFFNDSLP

SEQ ID NO: 1041945 - protein, 9 aa, Homo Sapiens
VEHCHSECV

SEQ ID NO: 1041946 - protein, 9 aa, Homo Sapiens
VKKMFPHRK

SEQ ID NO: 1041947 - protein, 9 aa, Homo Sapiens
GMETPMHKN

SEQ ID NO: 1041948 - protein, 9 aa, Homo Sapiens
QFSRTTSPC

SEQ ID NO: 1041949 - protein, 9 aa, Homo Sapiens
ASLEYSDYF

SEQ ID NO: 1041950 - protein, 9 aa, Homo Sapiens
ESRPKGEIG

SEQ ID NO: 1041951 - protein, 9 aa, Homo Sapiens
TPYSWVCFE

SEQ ID NO: 1041952 - protein, 9 aa, Homo Sapiens
QVGDSHFSH

SEQ ID NO: 1041953 - protein, 9 aa, Homo Sapiens
EIAILHQFP

SEQ ID NO: 1041954 - protein, 9 aa, Homo Sapiens
KESDNGVVV

SEQ ID NO: 1041955 - protein, 9 aa, Homo Sapiens
LQYTLLSQN

SEQ ID NO: 1041956 - protein, 9 aa, Homo Sapiens
ISFSPGSRV

SEQ ID NO: 1041957 - protein, 9 aa, Homo Sapiens
SHDQAPELP

SEQ ID NO: 1041958 - protein, 9 aa, Homo Sapiens
CYVAVCRPL

SEQ ID NO: 1041959 - protein, 9 aa, Homo Sapiens
ILNRYSGTQ

SEQ ID NO: 1041960 - protein, 9 aa, Homo Sapiens
LKQHGTCPK

SEQ ID NO: 1041961 - protein, 9 aa, Homo Sapiens
ERAAKWRTS

SEQ ID NO: 1041962 - protein, 9 aa, Homo Sapiens
TSDFQSPKD

SEQ ID NO: 1041963 - protein, 9 aa, Homo Sapiens
YLKKEMNFF

SEQ ID NO: 1041964 - protein, 9 aa, Homo Sapiens
LKLLAQRHG

SEQ ID NO: 1041965 - protein, 9 aa, Homo Sapiens
RCALPALGT

SEQ ID NO: 1041966 - protein, 9 aa, Homo Sapiens
VTYCPIEPG

SEQ ID NO: 1041967 - protein, 9 aa, Homo Sapiens
RFLLRDAVE

SEQ ID NO: 1041968 - protein, 9 aa, Homo Sapiens
GGCVNGQCV

SEQ ID NO: 1041969 - protein, 9 aa, Homo Sapiens
PEPQGPSLF

SEQ ID NO: 1041970 - protein, 9 aa, Homo Sapiens
NPQDDIATE

SEQ ID NO: 1041971 - protein, 9 aa, Homo Sapiens
IHAGCDCII

SEQ ID NO: 1041972 - protein, 9 aa, Homo Sapiens
PFQQPMLVS

SEQ ID NO: 1041973 - protein, 9 aa, Homo Sapiens
ICSSEVSWG

SEQ ID NO: 1041974 - protein, 9 aa, Homo Sapiens
PLVSGVLQL

SEQ ID NO: 1041975 - protein, 9 aa, Homo Sapiens
YQKANMDNE

SEQ ID NO: 1041976 - protein, 9 aa, Homo Sapiens
HLPELLNLV

SEQ ID NO: 1041977 - protein, 9 aa, Homo Sapiens
YRLKSQTVQ

SEQ ID NO: 1041978 - protein, 9 aa, Homo Sapiens
WIKFVSDGT

SEQ ID NO: 1041979 - protein, 9 aa, Homo Sapiens
PHVQMNLHP

SEQ ID NO: 1041980 - protein, 9 aa, Homo Sapiens
PISLADYCT

SEQ ID NO: 1041981 - protein, 9 aa, Homo Sapiens
KSRPESIII

SEQ ID NO: 1041982 - protein, 9 aa, Homo Sapiens
NYKLREDAR

SEQ ID NO: 1041983 - protein, 9 aa, Homo Sapiens
MTMHWAVSP

SEQ ID NO: 1041984 - protein, 9 aa, Homo Sapiens
LSTDTSWQE

SEQ ID NO: 1041985 - protein, 9 aa, Homo Sapiens
KVEQDQRIT

SEQ ID NO: 1041986 - protein, 9 aa, Homo Sapiens
LGYTSRFSL

SEQ ID NO: 1041987 - protein, 9 aa, Homo Sapiens
GIPCAQLFN

SEQ ID NO: 1041988 - protein, 9 aa, Homo Sapiens
LVNFAVPMD

SEQ ID NO: 1041989 - protein, 9 aa, Homo Sapiens
IAVLLRPAQ

SEQ ID NO: 1041990 - protein, 9 aa, Homo Sapiens
TCLCVTSTL

SEQ ID NO: 1041991 - protein, 9 aa, Homo Sapiens
FSILRIFSA

SEQ ID NO: 1041992 - protein, 9 aa, Homo Sapiens
QSQVVVQAS

SEQ ID NO: 1041993 - protein, 9 aa, Homo Sapiens
RELAFATKQ

SEQ ID NO: 1041994 - protein, 9 aa, Homo Sapiens
PGAGLCLFS

SEQ ID NO: 1041995 - protein, 9 aa, Homo Sapiens
SHVARPQIF

SEQ ID NO: 1041996 - protein, 9 aa, Homo Sapiens
KNGYNQNYG

SEQ ID NO: 1041997 - protein, 9 aa, Homo Sapiens
DENEDDQDS

SEQ ID NO: 1041998 - protein, 9 aa, Homo Sapiens
GLLTFRDGA

SEQ ID NO: 1041999 - protein, 9 aa, Homo Sapiens
EEAGVPGGA

SEQ ID NO: 1042000 - protein, 9 aa, Homo Sapiens
NHRVQMFVS

SEQ ID NO: 1042001 - protein, 9 aa, Homo Sapiens
FLRDYQDTL

SEQ ID NO: 1042002 - protein, 9 aa, Homo Sapiens
FPCDETELQ

SEQ ID NO: 1042003 - protein, 9 aa, Homo Sapiens
AGMAPQGMP

SEQ ID NO: 1042004 - protein, 9 aa, Homo Sapiens
TLRCPFPHV

SEQ ID NO: 1042005 - protein, 9 aa, Homo Sapiens
CYNISNEVV

SEQ ID NO: 1042006 - protein, 9 aa, Homo Sapiens
ESSLPFKEA

SEQ ID NO: 1042007 - protein, 9 aa, Homo Sapiens
GGWAKFTAL

SEQ ID NO: 1042008 - protein, 9 aa, Homo Sapiens
MKKGGDVTL

SEQ ID NO: 1042009 - protein, 9 aa, Homo Sapiens
DPDGGPRLQ

SEQ ID NO: 1042010 - protein, 9 aa, Homo Sapiens
AAVVFVEQG

SEQ ID NO: 1042011 - protein, 9 aa, Homo Sapiens
AKKNAAEAL

SEQ ID NO: 1042012 - protein, 9 aa, Homo Sapiens
QLPGAEVQL

SEQ ID NO: 1042013 - protein, 9 aa, Homo Sapiens
DAQPEGELM

SEQ ID NO: 1042014 - protein, 9 aa, Homo Sapiens
SFDEDDVSS

SEQ ID NO: 1042015 - protein, 9 aa, Homo Sapiens
SHFRRHEKT

SEQ ID NO: 1042016 - protein, 9 aa, Homo Sapiens
QAPLAGQPQ

SEQ ID NO: 1042017 - protein, 9 aa, Homo Sapiens
VSSNFTGHK

SEQ ID NO: 1042018 - protein, 9 aa, Homo Sapiens
EKGPQTLSV

SEQ ID NO: 1042019 - protein, 9 aa, Homo Sapiens
DLCGCARIT

SEQ ID NO: 1042020 - protein, 9 aa, Homo Sapiens
MDSNGLSNP

SEQ ID NO: 1042021 - protein, 9 aa, Homo Sapiens
RTMKNQQNS

SEQ ID NO: 1042022 - protein, 9 aa, Homo Sapiens
ISAALVMLF

SEQ ID NO: 1042023 - protein, 9 aa, Homo Sapiens
AKVGSKLSA

SEQ ID NO: 1042024 - protein, 9 aa, Homo Sapiens
ELQAKLSRT

SEQ ID NO: 1042025 - protein, 9 aa, Homo Sapiens
AVTKIKLHS

SEQ ID NO: 1042026 - protein, 9 aa, Homo Sapiens
AQALKELIL

SEQ ID NO: 1042027 - protein, 9 aa, Homo Sapiens
FKKYMEDRS

SEQ ID NO: 1042028 - protein, 9 aa, Homo Sapiens
PGYNLRGAA

SEQ ID NO: 1042029 - protein, 9 aa, Homo Sapiens
MAFPITSIF

SEQ ID NO: 1042030 - protein, 9 aa, Homo Sapiens
MGPMTPAFA

SEQ ID NO: 1042031 - protein, 9 aa, Homo Sapiens
ISSASRKQG

SEQ ID NO: 1042032 - protein, 9 aa, Homo Sapiens
SLLAESEEF

SEQ ID NO: 1042033 - protein, 9 aa, Homo Sapiens
LLLAKLAEY

SEQ ID NO: 1042034 - protein, 9 aa, Homo Sapiens
QRVLPQSPG

SEQ ID NO: 1042035 - protein, 9 aa, Homo Sapiens
SDIWLSLSS

SEQ ID NO: 1042036 - protein, 9 aa, Homo Sapiens
YATIPNRID

SEQ ID NO: 1042037 - protein, 9 aa, Homo Sapiens
SEMKQANGQ

SEQ ID NO: 1042038 - protein, 9 aa, Homo Sapiens
TSKPVQIMF

SEQ ID NO: 1042039 - protein, 9 aa, Homo Sapiens
LEKNKDTVY

SEQ ID NO: 1042040 - protein, 9 aa, Homo Sapiens
VLCFFVSCV

SEQ ID NO: 1042041 - protein, 9 aa, Homo Sapiens
EIRAEALVN

SEQ ID NO: 1042042 - protein, 9 aa, Homo Sapiens
TLVQATNMN

SEQ ID NO: 1042043 - protein, 9 aa, Homo Sapiens
LDDWLVELR

SEQ ID NO: 1042044 - protein, 9 aa, Homo Sapiens
CIPSRLPPE

SEQ ID NO: 1042045 - protein, 9 aa, Homo Sapiens
SQEATRPPS

SEQ ID NO: 1042046 - protein, 9 aa, Homo Sapiens
ETETVLAAL

SEQ ID NO: 1042047 - protein, 9 aa, Homo Sapiens
VSCVQLANK

SEQ ID NO: 1042048 - protein, 9 aa, Homo Sapiens
AQDTLARKT

SEQ ID NO: 1042049 - protein, 9 aa, Homo Sapiens
MSQRIIVGT

SEQ ID NO: 1042050 - protein, 9 aa, Homo Sapiens
FSINVFEDY

SEQ ID NO: 1042051 - protein, 9 aa, Homo Sapiens
SGSDGSLSP

SEQ ID NO: 1042052 - protein, 9 aa, Homo Sapiens
KISCFTVRE

SEQ ID NO: 1042053 - protein, 9 aa, Homo Sapiens
AACEERRGA

SEQ ID NO: 1042054 - protein, 9 aa, Homo Sapiens
DRVLKIPRT

SEQ ID NO: 1042055 - protein, 9 aa, Homo Sapiens
ICGEKKVPH

SEQ ID NO: 1042056 - protein, 9 aa, Homo Sapiens
NLVFSPAWF

SEQ ID NO: 1042057 - protein, 9 aa, Homo Sapiens
ICLPISNPE

SEQ ID NO: 1042058 - protein, 9 aa, Homo Sapiens
TLVSELSEH

SEQ ID NO: 1042059 - protein, 9 aa, Homo Sapiens
RASLWPSRT

SEQ ID NO: 1042060 - protein, 9 aa, Homo Sapiens
EKVKGLQRS

SEQ ID NO: 1042061 - protein, 9 aa, Homo Sapiens
SGSFGEEPL

SEQ ID NO: 1042062 - protein, 9 aa, Homo Sapiens
EALVLNDKH

SEQ ID NO: 1042063 - protein, 9 aa, Homo Sapiens
EGQKRASLW

SEQ ID NO: 1042064 - protein, 9 aa, Homo Sapiens
FLEFCTYDD

SEQ ID NO: 1042065 - protein, 9 aa, Homo Sapiens
HSLHGLVND

SEQ ID NO: 1042066 - protein, 9 aa, Homo Sapiens
TLQCAQNMN

SEQ ID NO: 1042067 - protein, 9 aa, Homo Sapiens
MRANATLLI

SEQ ID NO: 1042068 - protein, 9 aa, Homo Sapiens
KGLVKPVDV

SEQ ID NO: 1042069 - protein, 9 aa, Homo Sapiens
EWDKDVAQK

SEQ ID NO: 1042070 - protein, 9 aa, Homo Sapiens
SKLVNFATL

SEQ ID NO: 1042071 - protein, 9 aa, Homo Sapiens
PEEGLEAQR

SEQ ID NO: 1042072 - protein, 9 aa, Homo Sapiens
SRFSLTCMV

SEQ ID NO: 1042073 - protein, 9 aa, Homo Sapiens
TNRLLDEII

SEQ ID NO: 1042074 - protein, 9 aa, Homo Sapiens
TSEIERVRR

SEQ ID NO: 1042075 - protein, 9 aa, Homo Sapiens
ISSDGESHS

SEQ ID NO: 1042076 - protein, 9 aa, Homo Sapiens
IVSASWKEP

SEQ ID NO: 1042077 - protein, 9 aa, Homo Sapiens
GPDCSSGCN

SEQ ID NO: 1042078 - protein, 9 aa, Homo Sapiens
PLEYVKGLP

SEQ ID NO: 1042079 - protein, 9 aa, Homo Sapiens
YSDYFKCKK

SEQ ID NO: 1042080 - protein, 9 aa, Homo Sapiens
FTPEKSEAG

SEQ ID NO: 1042081 - protein, 9 aa, Homo Sapiens
WMKQNPRRW

SEQ ID NO: 1042082 - protein, 9 aa, Homo Sapiens
WVLAATSTL

SEQ ID NO: 1042083 - protein, 9 aa, Homo Sapiens
VLKCLRYYV

SEQ ID NO: 1042084 - protein, 9 aa, Homo Sapiens
KSSKPRAVL

SEQ ID NO: 1042085 - protein, 9 aa, Homo Sapiens
QLFKYQKDC

SEQ ID NO: 1042086 - protein, 9 aa, Homo Sapiens
FNALFQLIP

SEQ ID NO: 1042087 - protein, 9 aa, Homo Sapiens
EGRESCHSP

SEQ ID NO: 1042088 - protein, 9 aa, Homo Sapiens
RKQFLPQED

SEQ ID NO: 1042089 - protein, 9 aa, Homo Sapiens
KKLLPRHRN

SEQ ID NO: 1042090 - protein, 9 aa, Homo Sapiens
SIHIKVDLL

SEQ ID NO: 1042091 - protein, 9 aa, Homo Sapiens
KLSVKVPLQ

SEQ ID NO: 1042092 - protein, 9 aa, Homo Sapiens
LEELTQPLD

SEQ ID NO: 1042093 - protein, 9 aa, Homo Sapiens
KDSKHPRCP

SEQ ID NO: 1042094 - protein, 9 aa, Homo Sapiens
EDAVFVLGL

SEQ ID NO: 1042095 - protein, 9 aa, Homo Sapiens
ENSDIWLSL

SEQ ID NO: 1042096 - protein, 9 aa, Homo Sapiens
DFFTSKKKK

SEQ ID NO: 1042097 - protein, 9 aa, Homo Sapiens
CFFVSCVFI

SEQ ID NO: 1042098 - protein, 9 aa, Homo Sapiens
RCIKPVLCL

SEQ ID NO: 1042099 - protein, 9 aa, Homo Sapiens
MDYRANIFL

SEQ ID NO: 1042100 - protein, 9 aa, Homo Sapiens
CLMDHLKAG

SEQ ID NO: 1042101 - protein, 9 aa, Homo Sapiens
IRILYGRMK

SEQ ID NO: 1042102 - protein, 9 aa, Homo Sapiens
VPPTLEATQ

SEQ ID NO: 1042103 - protein, 9 aa, Homo Sapiens
YFTFIGTLV

SEQ ID NO: 1042104 - protein, 9 aa, Homo Sapiens
SNGLSNPYV

SEQ ID NO: 1042105 - protein, 9 aa, Homo Sapiens
ATWELYIPS

SEQ ID NO: 1042106 - protein, 9 aa, Homo Sapiens
EWTHEEQFK

SEQ ID NO: 1042107 - protein, 9 aa, Homo Sapiens
LDNSNQSSP

SEQ ID NO: 1042108 - protein, 9 aa, Homo Sapiens
ILEMNETSA

SEQ ID NO: 1042109 - protein, 9 aa, Homo Sapiens
HRLAEWGRR

SEQ ID NO: 1042110 - protein, 9 aa, Homo Sapiens
CRDPSLPYL

SEQ ID NO: 1042111 - protein, 9 aa, Homo Sapiens
LKKARIAQK

SEQ ID NO: 1042112 - protein, 9 aa, Homo Sapiens
LDLGKKPQG

SEQ ID NO: 1042113 - protein, 9 aa, Homo Sapiens
QGQETRKQQ

SEQ ID NO: 1042114 - protein, 9 aa, Homo Sapiens
IIDENTGNI

SEQ ID NO: 1042115 - protein, 9 aa, Homo Sapiens
SYVDKQMGT

SEQ ID NO: 1042116 - protein, 9 aa, Homo Sapiens
QLEKIEKER

SEQ ID NO: 1042117 - protein, 9 aa, Homo Sapiens
FNVDVSSFS

SEQ ID NO: 1042118 - protein, 9 aa, Homo Sapiens
NEPKIWVSY

SEQ ID NO: 1042119 - protein, 9 aa, Homo Sapiens
LLAESEEFN

SEQ ID NO: 1042120 - protein, 9 aa, Homo Sapiens
GGGHFIGLA

SEQ ID NO: 1042121 - protein, 9 aa, Homo Sapiens
DAPPLPPPP

SEQ ID NO: 1042122 - protein, 9 aa, Homo Sapiens
QNDVDREFV

SEQ ID NO: 1042123 - protein, 9 aa, Homo Sapiens
PDLQPPAED

SEQ ID NO: 1042124 - protein, 9 aa, Homo Sapiens
VVQYTPKVL

SEQ ID NO: 1042125 - protein, 9 aa, Homo Sapiens
GNTESQFII

SEQ ID NO: 1042126 - protein, 9 aa, Homo Sapiens
PLPFPGPFS

SEQ ID NO: 1042127 - protein, 9 aa, Homo Sapiens
VADKILQKL

SEQ ID NO: 1042128 - protein, 9 aa, Homo Sapiens
VVSDISAFR

SEQ ID NO: 1042129 - protein, 9 aa, Homo Sapiens
MKKFTEIIK

SEQ ID NO: 1042130 - protein, 9 aa, Homo Sapiens
LQQQPSASQ

SEQ ID NO: 1042131 - protein, 9 aa, Homo Sapiens
GPSVKLSTV

SEQ ID NO: 1042132 - protein, 9 aa, Homo Sapiens
TICVQDKIF

SEQ ID NO: 1042133 - protein, 9 aa, Homo Sapiens
GFLRTKIKV

SEQ ID NO: 1042134 - protein, 9 aa, Homo Sapiens
SLENLTFNS

SEQ ID NO: 1042135 - protein, 9 aa, Homo Sapiens
NTNSFFQDQ

SEQ ID NO: 1042136 - protein, 9 aa, Homo Sapiens
GPVGSPDKE

SEQ ID NO: 1042137 - protein, 9 aa, Homo Sapiens
NKPLPPTSD

SEQ ID NO: 1042138 - protein, 9 aa, Homo Sapiens
TLAEVAKNC

SEQ ID NO: 1042139 - protein, 9 aa, Homo Sapiens
MVGYAVGLS

SEQ ID NO: 1042140 - protein, 9 aa, Homo Sapiens
SLLKKLGAF

SEQ ID NO: 1042141 - protein, 9 aa, Homo Sapiens
NSSNEKLKE

SEQ ID NO: 1042142 - protein, 9 aa, Homo Sapiens
AEQLKQAEK

SEQ ID NO: 1042143 - protein, 9 aa, Homo Sapiens
SDDFEDERV

SEQ ID NO: 1042144 - protein, 9 aa, Homo Sapiens
IKNSRCEQF

SEQ ID NO: 1042145 - protein, 9 aa, Homo Sapiens
EYVKGLPLI

SEQ ID NO: 1042146 - protein, 9 aa, Homo Sapiens
IKDFLEETL

SEQ ID NO: 1042147 - protein, 9 aa, Homo Sapiens
PFKLHPRLE

SEQ ID NO: 1042148 - protein, 9 aa, Homo Sapiens
YNTKILIFI

SEQ ID NO: 1042149 - protein, 9 aa, Homo Sapiens
RDRTCIPSR

SEQ ID NO: 1042150 - protein, 9 aa, Homo Sapiens
GYVLLNVLF

SEQ ID NO: 1042151 - protein, 9 aa, Homo Sapiens
RESCHSPVC

SEQ ID NO: 1042152 - protein, 9 aa, Homo Sapiens
SGIFTPVSN

SEQ ID NO: 1042153 - protein, 9 aa, Homo Sapiens
YPLPNPGYP

SEQ ID NO: 1042154 - protein, 9 aa, Homo Sapiens
DKQMGTTYG

SEQ ID NO: 1042155 - protein, 9 aa, Homo Sapiens
AASLGAPSR

SEQ ID NO: 1042156 - protein, 9 aa, Homo Sapiens
RDENGEFRL

SEQ ID NO: 1042157 - protein, 9 aa, Homo Sapiens
EMKMKVLKN

SEQ ID NO: 1042158 - protein, 9 aa, Homo Sapiens
LTQESYRAY

SEQ ID NO: 1042159 - protein, 9 aa, Homo Sapiens
TGMLIELSA

SEQ ID NO: 1042160 - protein, 9 aa, Homo Sapiens
QHNRTTKNY

SEQ ID NO: 1042161 - protein, 9 aa, Homo Sapiens
FEKVPEGSI

SEQ ID NO: 1042162 - protein, 9 aa, Homo Sapiens
PRAIALSVG

SEQ ID NO: 1042163 - protein, 9 aa, Homo Sapiens
VAEYKYQLT

SEQ ID NO: 1042164 - protein, 9 aa, Homo Sapiens
GRSAQAACD

SEQ ID NO: 1042165 - protein, 9 aa, Homo Sapiens
EETLSVKVP

SEQ ID NO: 1042166 - protein, 9 aa, Homo Sapiens
QGGHWLAVR

SEQ ID NO: 1042167 - protein, 9 aa, Homo Sapiens
KKFKTIQEE

SEQ ID NO: 1042168 - protein, 9 aa, Homo Sapiens
MLIPYTYPD

SEQ ID NO: 1042169 - protein, 9 aa, Homo Sapiens
TRHKKIYTG

SEQ ID NO: 1042170 - protein, 9 aa, Homo Sapiens
SPNFYQPGP

SEQ ID NO: 1042171 - protein, 9 aa, Homo Sapiens
HLNGLLQEI

SEQ ID NO: 1042172 - protein, 9 aa, Homo Sapiens
MFQQFQAFC

SEQ ID NO: 1042173 - protein, 9 aa, Homo Sapiens
DNITHKVLR

SEQ ID NO: 1042174 - protein, 9 aa, Homo Sapiens
NRTNNSPGN

SEQ ID NO: 1042175 - protein, 9 aa, Homo Sapiens
QTHKPDWNY

SEQ ID NO: 1042176 - protein, 9 aa, Homo Sapiens
LKMQESISE

SEQ ID NO: 1042177 - protein, 9 aa, Homo Sapiens
IPYTYPDTP

SEQ ID NO: 1042178 - protein, 9 aa, Homo Sapiens
STSEQVPES

SEQ ID NO: 1042179 - protein, 9 aa, Homo Sapiens
ANSSPPSGH

SEQ ID NO: 1042180 - protein, 9 aa, Homo Sapiens
QDELDTLAY

SEQ ID NO: 1042181 - protein, 9 aa, Homo Sapiens
PKQVFVDLN

SEQ ID NO: 1042182 - protein, 9 aa, Homo Sapiens
ATPFPVTDT

SEQ ID NO: 1042183 - protein, 9 aa, Homo Sapiens
LPSYSCEMC

SEQ ID NO: 1042184 - protein, 9 aa, Homo Sapiens
LNDEAQYIM

SEQ ID NO: 1042185 - protein, 9 aa, Homo Sapiens
FAGFLGRDS

SEQ ID NO: 1042186 - protein, 9 aa, Homo Sapiens
QKLIIVEEC

SEQ ID NO: 1042187 - protein, 9 aa, Homo Sapiens
HGVCQKNCP

SEQ ID NO: 1042188 - protein, 9 aa, Homo Sapiens
LKETETVLA

SEQ ID NO: 1042189 - protein, 9 aa, Homo Sapiens
CDIYKELLI

SEQ ID NO: 1042190 - protein, 9 aa, Homo Sapiens
EKNMAKIHC

SEQ ID NO: 1042191 - protein, 9 aa, Homo Sapiens
LVYADQIST

SEQ ID NO: 1042192 - protein, 9 aa, Homo Sapiens
LKKMSLTTE

SEQ ID NO: 1042193 - protein, 9 aa, Homo Sapiens
GLFETQKKE

SEQ ID NO: 1042194 - protein, 9 aa, Homo Sapiens
CQPSCTKAY

SEQ ID NO: 1042195 - protein, 9 aa, Homo Sapiens
FRYSEAAGP

SEQ ID NO: 1042196 - protein, 9 aa, Homo Sapiens
GMCLNIAVT

SEQ ID NO: 1042197 - protein, 9 aa, Homo Sapiens
AGVPGGAEA

SEQ ID NO: 1042198 - protein, 9 aa, Homo Sapiens
GGRCSFSIQ

SEQ ID NO: 1042199 - protein, 9 aa, Homo Sapiens
NFFNTFLSL

SEQ ID NO: 1042200 - protein, 9 aa, Homo Sapiens
MKGLSGSQT

SEQ ID NO: 1042201 - protein, 9 aa, Homo Sapiens
GETGERLFT

SEQ ID NO: 1042202 - protein, 9 aa, Homo Sapiens
LRRLESVLQ

SEQ ID NO: 1042203 - protein, 9 aa, Homo Sapiens
RFCSVSDKS

SEQ ID NO: 1042204 - protein, 9 aa, Homo Sapiens
LGQTHKPDW

SEQ ID NO: 1042205 - protein, 9 aa, Homo Sapiens
VPGGAEHSV

SEQ ID NO: 1042206 - protein, 9 aa, Homo Sapiens
RASGLPSET

SEQ ID NO: 1042207 - protein, 9 aa, Homo Sapiens
VAGCRKFYE

SEQ ID NO: 1042208 - protein, 9 aa, Homo Sapiens
EEDDEDEKG

SEQ ID NO: 1042209 - protein, 9 aa, Homo Sapiens
PKRLVNLVV

SEQ ID NO: 1042210 - protein, 9 aa, Homo Sapiens
FGGFVTPID

SEQ ID NO: 1042211 - protein, 9 aa, Homo Sapiens
ENRSSCFWL

SEQ ID NO: 1042212 - protein, 9 aa, Homo Sapiens
RHMTQPRLW

SEQ ID NO: 1042213 - protein, 9 aa, Homo Sapiens
DVPKQKKGK

SEQ ID NO: 1042214 - protein, 9 aa, Homo Sapiens
YQIYDSTDL

SEQ ID NO: 1042215 - protein, 9 aa, Homo Sapiens
SKESPQKAK

SEQ ID NO: 1042216 - protein, 9 aa, Homo Sapiens
SYDENTELY

SEQ ID NO: 1042217 - protein, 9 aa, Homo Sapiens
LIVNSLCSV

SEQ ID NO: 1042218 - protein, 9 aa, Homo Sapiens
TPCYTCVCQ

SEQ ID NO: 1042219 - protein, 9 aa, Homo Sapiens
RVLTRDCLS

SEQ ID NO: 1042220 - protein, 9 aa, Homo Sapiens
CKMPCNLTR

SEQ ID NO: 1042221 - protein, 9 aa, Homo Sapiens
YEGGRCSFS

SEQ ID NO: 1042222 - protein, 9 aa, Homo Sapiens
ISCFYGRVL

SEQ ID NO: 1042223 - protein, 9 aa, Homo Sapiens
LENSSSLSL

SEQ ID NO: 1042224 - protein, 9 aa, Homo Sapiens
CDKKFRISG

SEQ ID NO: 1042225 - protein, 9 aa, Homo Sapiens
FAEETLKAA

SEQ ID NO: 1042226 - protein, 9 aa, Homo Sapiens
ADDQDMIES

SEQ ID NO: 1042227 - protein, 9 aa, Homo Sapiens
SLLAGQTAE

SEQ ID NO: 1042228 - protein, 9 aa, Homo Sapiens
YKKPGIARC

SEQ ID NO: 1042229 - protein, 9 aa, Homo Sapiens
SPHINVYLK

SEQ ID NO: 1042230 - protein, 9 aa, Homo Sapiens
SVSAVTKEA

SEQ ID NO: 1042231 - protein, 9 aa, Homo Sapiens
RDCFQALKD

SEQ ID NO: 1042232 - protein, 9 aa, Homo Sapiens
KGPKDKKIT

SEQ ID NO: 1042233 - protein, 9 aa, Homo Sapiens
SKKLEVQLQ

SEQ ID NO: 1042234 - protein, 9 aa, Homo Sapiens
DQQFRKRCE

SEQ ID NO: 1042235 - protein, 9 aa, Homo Sapiens
LEDAVKETF

SEQ ID NO: 1042236 - protein, 9 aa, Homo Sapiens
VIGGKKLLL

SEQ ID NO: 1042237 - protein, 9 aa, Homo Sapiens
CGANANPSD

SEQ ID NO: 1042238 - protein, 9 aa, Homo Sapiens
GKRGLNLSG

SEQ ID NO: 1042239 - protein, 9 aa, Homo Sapiens
LRSCTGRWP

SEQ ID NO: 1042240 - protein, 9 aa, Homo Sapiens
SPGSRGGRA

SEQ ID NO: 1042241 - protein, 9 aa, Homo Sapiens
KGLQRSGWM

SEQ ID NO: 1042242 - protein, 9 aa, Homo Sapiens
LDPVPDSPD

SEQ ID NO: 1042243 - protein, 9 aa, Homo Sapiens
EILLNDSGS

SEQ ID NO: 1042244 - protein, 9 aa, Homo Sapiens
TRGKDTADR

SEQ ID NO: 1042245 - protein, 9 aa, Homo Sapiens
EDPDGEEKR

SEQ ID NO: 1042246 - protein, 9 aa, Homo Sapiens
ESDYQRSAC

SEQ ID NO: 1042247 - protein, 9 aa, Homo Sapiens
RKRCEELRV

SEQ ID NO: 1042248 - protein, 9 aa, Homo Sapiens
PVLSNNYSY

SEQ ID NO: 1042249 - protein, 9 aa, Homo Sapiens
GAGEGAADA

SEQ ID NO: 1042250 - protein, 9 aa, Homo Sapiens
TAPKLSDDR

SEQ ID NO: 1042251 - protein, 9 aa, Homo Sapiens
APSEFVDNA

SEQ ID NO: 1042252 - protein, 9 aa, Homo Sapiens
LEFHLCHYL

SEQ ID NO: 1042253 - protein, 9 aa, Homo Sapiens
ETAIHHVHS

SEQ ID NO: 1042254 - protein, 9 aa, Homo Sapiens
QNCSNRGHS

SEQ ID NO: 1042255 - protein, 9 aa, Homo Sapiens
QILVNLSMV

SEQ ID NO: 1042256 - protein, 9 aa, Homo Sapiens
RLAQALLEA

SEQ ID NO: 1042257 - protein, 9 aa, Homo Sapiens
LTPLLFFQA

SEQ ID NO: 1042258 - protein, 9 aa, Homo Sapiens
AGYKKPGIA

SEQ ID NO: 1042259 - protein, 9 aa, Homo Sapiens
NVISIKISM

SEQ ID NO: 1042260 - protein, 9 aa, Homo Sapiens
GFSVDPNNE

SEQ ID NO: 1042261 - protein, 9 aa, Homo Sapiens
KNICVDMLQ

SEQ ID NO: 1042262 - protein, 9 aa, Homo Sapiens
KEMETLGKD

SEQ ID NO: 1042263 - protein, 9 aa, Homo Sapiens
EMKISELNA

SEQ ID NO: 1042264 - protein, 9 aa, Homo Sapiens
KTQGEGKKM

SEQ ID NO: 1042265 - protein, 9 aa, Homo Sapiens
VEVPLKNQE

SEQ ID NO: 1042266 - protein, 9 aa, Homo Sapiens
YSAISNELR

SEQ ID NO: 1042267 - protein, 9 aa, Homo Sapiens
ITRGGWQSE

SEQ ID NO: 1042268 - protein, 9 aa, Homo Sapiens
VLLSVYMCY

SEQ ID NO: 1042269 - protein, 9 aa, Homo Sapiens
EIILRCQPS

SEQ ID NO: 1042270 - protein, 9 aa, Homo Sapiens
EQEVKSDRV

SEQ ID NO: 1042271 - protein, 9 aa, Homo Sapiens
SSSVSLFCR

SEQ ID NO: 1042272 - protein, 9 aa, Homo Sapiens
SSCFWLLVI

SEQ ID NO: 1042273 - protein, 9 aa, Homo Sapiens
FYEIFQIFY

SEQ ID NO: 1042274 - protein, 9 aa, Homo Sapiens
RRIHRGEKP

SEQ ID NO: 1042275 - protein, 9 aa, Homo Sapiens
GSENNCVYQ

SEQ ID NO: 1042276 - protein, 9 aa, Homo Sapiens
VDEVLRLLN

SEQ ID NO: 1042277 - protein, 9 aa, Homo Sapiens
GGPRLQADR

SEQ ID NO: 1042278 - protein, 9 aa, Homo Sapiens
ELAGEGSDQ

SEQ ID NO: 1042279 - protein, 9 aa, Homo Sapiens
GDRLTDEEV

SEQ ID NO: 1042280 - protein, 9 aa, Homo Sapiens
KVDLLFTEL

SEQ ID NO: 1042281 - protein, 9 aa, Homo Sapiens
YELLTNGYT

SEQ ID NO: 1042282 - protein, 9 aa, Homo Sapiens
FMFTSESVR

SEQ ID NO: 1042283 - protein, 9 aa, Homo Sapiens
HQQWLTPIS

SEQ ID NO: 1042284 - protein, 9 aa, Homo Sapiens
FWRLIALIG

SEQ ID NO: 1042285 - protein, 9 aa, Homo Sapiens
SRLDPAGYF

SEQ ID NO: 1042286 - protein, 9 aa, Homo Sapiens
GPAAPCADS

SEQ ID NO: 1042287 - protein, 9 aa, Homo Sapiens
FSSPRELEG

SEQ ID NO: 1042288 - protein, 9 aa, Homo Sapiens
VSHYATNSW

SEQ ID NO: 1042289 - protein, 9 aa, Homo Sapiens
VESAVHTFN

SEQ ID NO: 1042290 - protein, 9 aa, Homo Sapiens
RAHYLHHFF

SEQ ID NO: 1042291 - protein, 9 aa, Homo Sapiens
QQMLAGDGM

SEQ ID NO: 1042292 - protein, 9 aa, Homo Sapiens
KKRTISFLS

SEQ ID NO: 1042293 - protein, 9 aa, Homo Sapiens
RYYKVSADK

SEQ ID NO: 1042294 - protein, 9 aa, Homo Sapiens
GFLFCLFSG

SEQ ID NO: 1042295 - protein, 9 aa, Homo Sapiens
SHASDTSAV

SEQ ID NO: 1042296 - protein, 9 aa, Homo Sapiens
HIGQPNKAL

SEQ ID NO: 1042297 - protein, 9 aa, Homo Sapiens
QHLHGSHRG

SEQ ID NO: 1042298 - protein, 9 aa, Homo Sapiens
IKLSHKKMM

SEQ ID NO: 1042299 - protein, 9 aa, Homo Sapiens
VLVIRRRAV

SEQ ID NO: 1042300 - protein, 9 aa, Homo Sapiens
LIWVLAATS

SEQ ID NO: 1042301 - protein, 9 aa, Homo Sapiens
NNETLFTIV

SEQ ID NO: 1042302 - protein, 9 aa, Homo Sapiens
GSTNFLLVA

SEQ ID NO: 1042303 - protein, 9 aa, Homo Sapiens
GFLGRDSGP

SEQ ID NO: 1042304 - protein, 9 aa, Homo Sapiens
KPSLTESDS

SEQ ID NO: 1042305 - protein, 9 aa, Homo Sapiens
MQAPVASRQ

SEQ ID NO: 1042306 - protein, 9 aa, Homo Sapiens
NKRMSAELT

SEQ ID NO: 1042307 - protein, 9 aa, Homo Sapiens
PKRQRLWLK

SEQ ID NO: 1042308 - protein, 9 aa, Homo Sapiens
LCPAMEPTN

SEQ ID NO: 1042309 - protein, 9 aa, Homo Sapiens
NRNLVTKSE

SEQ ID NO: 1042310 - protein, 9 aa, Homo Sapiens
IYLCSVGSY

SEQ ID NO: 1042311 - protein, 9 aa, Homo Sapiens
ACYHMKADS

SEQ ID NO: 1042312 - protein, 9 aa, Homo Sapiens
KLNSEGTLE

SEQ ID NO: 1042313 - protein, 9 aa, Homo Sapiens
LYGMTLRCL

SEQ ID NO: 1042314 - protein, 9 aa, Homo Sapiens
PLGEKGPQT

SEQ ID NO: 1042315 - protein, 9 aa, Homo Sapiens
RDNTKEIPM

SEQ ID NO: 1042316 - protein, 9 aa, Homo Sapiens
NELSRIRLE

SEQ ID NO: 1042317 - protein, 9 aa, Homo Sapiens
NQPFPVLES

SEQ ID NO: 1042318 - protein, 9 aa, Homo Sapiens
FPKKLSIKY

SEQ ID NO: 1042319 - protein, 9 aa, Homo Sapiens
SLPVAPSAV

SEQ ID NO: 1042320 - protein, 9 aa, Homo Sapiens
LGIRLAARG

SEQ ID NO: 1042321 - protein, 9 aa, Homo Sapiens
AFILAVCCG

SEQ ID NO: 1042322 - protein, 9 aa, Homo Sapiens
SKEELSPEV

SEQ ID NO: 1042323 - protein, 9 aa, Homo Sapiens
KFTALYGDG

SEQ ID NO: 1042324 - protein, 9 aa, Homo Sapiens
AFLASDPHE

SEQ ID NO: 1042325 - protein, 9 aa, Homo Sapiens
RFVAPDVFH

SEQ ID NO: 1042326 - protein, 9 aa, Homo Sapiens
GYQGIAETP

SEQ ID NO: 1042327 - protein, 9 aa, Homo Sapiens
EDIKPFSPK

SEQ ID NO: 1042328 - protein, 9 aa, Homo Sapiens
ELQRSVKFD

SEQ ID NO: 1042329 - protein, 9 aa, Homo Sapiens
EDEGYIKEG

SEQ ID NO: 1042330 - protein, 9 aa, Homo Sapiens
FFKTLHFLL

SEQ ID NO: 1042331 - protein, 9 aa, Homo Sapiens
TPVSMTSEI

SEQ ID NO: 1042332 - protein, 9 aa, Homo Sapiens
MIVKRFSFF

SEQ ID NO: 1042333 - protein, 9 aa, Homo Sapiens
LPSEFFQFP

SEQ ID NO: 1042334 - protein, 9 aa, Homo Sapiens
RAIALSVGG

SEQ ID NO: 1042335 - protein, 9 aa, Homo Sapiens
YPEKFEKLL

SEQ ID NO: 1042336 - protein, 9 aa, Homo Sapiens
MVGLNAAGK

SEQ ID NO: 1042337 - protein, 9 aa, Homo Sapiens
GKKQFNSFG

SEQ ID NO: 1042338 - protein, 9 aa, Homo Sapiens
LVELRKVMS

SEQ ID NO: 1042339 - protein, 9 aa, Homo Sapiens
LGVLMCIKC

SEQ ID NO: 1042340 - protein, 9 aa, Homo Sapiens
DTSWQESDT

SEQ ID NO: 1042341 - protein, 9 aa, Homo Sapiens
YSKATLSPG

SEQ ID NO: 1042342 - protein, 9 aa, Homo Sapiens
EAIHNWIRR

SEQ ID NO: 1042343 - protein, 9 aa, Homo Sapiens
CCQVQGDPQ

SEQ ID NO: 1042344 - protein, 9 aa, Homo Sapiens
MPNAIVQFV

SEQ ID NO: 1042345 - protein, 9 aa, Homo Sapiens
LPLRNLRRT

SEQ ID NO: 1042346 - protein, 9 aa, Homo Sapiens
DGLSVKQKR

SEQ ID NO: 1042347 - protein, 9 aa, Homo Sapiens
VLLIVFRKK

SEQ ID NO: 1042348 - protein, 9 aa, Homo Sapiens
IYSLRNKKF

SEQ ID NO: 1042349 - protein, 9 aa, Homo Sapiens
QPQAPLAGQ

SEQ ID NO: 1042350 - protein, 9 aa, Homo Sapiens
LRNHNQIPT

SEQ ID NO: 1042351 - protein, 9 aa, Homo Sapiens
LLLFSYAVG

SEQ ID NO: 1042352 - protein, 9 aa, Homo Sapiens
IEGINRKYK

SEQ ID NO: 1042353 - protein, 9 aa, Homo Sapiens
TLERPFNVN

SEQ ID NO: 1042354 - protein, 9 aa, Homo Sapiens
KVLQGKFYG

SEQ ID NO: 1042355 - protein, 9 aa, Homo Sapiens
LWATVESQE

SEQ ID NO: 1042356 - protein, 9 aa, Homo Sapiens
GRPSILEMN

SEQ ID NO: 1042357 - protein, 9 aa, Homo Sapiens
SIVSASWKE

SEQ ID NO: 1042358 - protein, 9 aa, Homo Sapiens
KETIDLLAL

SEQ ID NO: 1042359 - protein, 9 aa, Homo Sapiens
LAMRANATL

SEQ ID NO: 1042360 - protein, 9 aa, Homo Sapiens
SQTLSERPT

SEQ ID NO: 1042361 - protein, 9 aa, Homo Sapiens
ARRAPGEAS

SEQ ID NO: 1042362 - protein, 9 aa, Homo Sapiens
YSEAAGPRE

SEQ ID NO: 1042363 - protein, 9 aa, Homo Sapiens
NVRRTEGFF

SEQ ID NO: 1042364 - protein, 9 aa, Homo Sapiens
SQHSIIQSE

SEQ ID NO: 1042365 - protein, 9 aa, Homo Sapiens
LVFSPAWFS

SEQ ID NO: 1042366 - protein, 9 aa, Homo Sapiens
FCDSMVLGW

SEQ ID NO: 1042367 - protein, 9 aa, Homo Sapiens
PPCSSSPSS

SEQ ID NO: 1042368 - protein, 9 aa, Homo Sapiens
SYFTFIGTL

SEQ ID NO: 1042369 - protein, 9 aa, Homo Sapiens
YLIVARKNG

SEQ ID NO: 1042370 - protein, 9 aa, Homo Sapiens
DLPQECSTF

SEQ ID NO: 1042371 - protein, 9 aa, Homo Sapiens
LLPRHRNKN

SEQ ID NO: 1042372 - protein, 9 aa, Homo Sapiens
APPSPEPPS

SEQ ID NO: 1042373 - protein, 9 aa, Homo Sapiens
PTILFLEFC

SEQ ID NO: 1042374 - protein, 9 aa, Homo Sapiens
NSLPLQAAP

SEQ ID NO: 1042375 - protein, 9 aa, Homo Sapiens
AHSPATHQA

SEQ ID NO: 1042376 - protein, 9 aa, Homo Sapiens
LKYRQETPL

SEQ ID NO: 1042377 - protein, 9 aa, Homo Sapiens
TSTHADISR

SEQ ID NO: 1042378 - protein, 9 aa, Homo Sapiens
AQVATHTLV

SEQ ID NO: 1042379 - protein, 9 aa, Homo Sapiens
LQNLELKYL

SEQ ID NO: 1042380 - protein, 9 aa, Homo Sapiens
AMERDPWIS

SEQ ID NO: 1042381 - protein, 9 aa, Homo Sapiens
NLEDIARLC

SEQ ID NO: 1042382 - protein, 9 aa, Homo Sapiens
SLREKDQRK

SEQ ID NO: 1042383 - protein, 9 aa, Homo Sapiens
VNDSGAGES

SEQ ID NO: 1042384 - protein, 9 aa, Homo Sapiens
RIYIQVVEA

SEQ ID NO: 1042385 - protein, 9 aa, Homo Sapiens
ISDPSGEET

SEQ ID NO: 1042386 - protein, 9 aa, Homo Sapiens
PSKIQSKDG

SEQ ID NO: 1042387 - protein, 9 aa, Homo Sapiens
PKKNSHNFC

SEQ ID NO: 1042388 - protein, 9 aa, Homo Sapiens
REATSFPPT

SEQ ID NO: 1042389 - protein, 8 aa, Homo Sapiens
KDEPRSTN

SEQ ID NO: 1042390 - protein, 9 aa, Homo Sapiens
QSTEVKVKN

SEQ ID NO: 1042391 - protein, 9 aa, Homo Sapiens
KKGDIITIQ

SEQ ID NO: 1042392 - protein, 9 aa, Homo Sapiens
CLHDLVQQL

SEQ ID NO: 1042393 - protein, 9 aa, Homo Sapiens
IIGDIATSH

SEQ ID NO: 1042394 - protein, 9 aa, Homo Sapiens
MLQGKLGGI

SEQ ID NO: 1042395 - protein, 9 aa, Homo Sapiens
RGAIAFAIA

SEQ ID NO: 1042396 - protein, 9 aa, Homo Sapiens
GRASGLPSE

SEQ ID NO: 1042397 - protein, 9 aa, Homo Sapiens
AFAGTYRCF

SEQ ID NO: 1042398 - protein, 9 aa, Homo Sapiens
KVSTKTLSK

SEQ ID NO: 1042399 - protein, 9 aa, Homo Sapiens
GGQREEDDE

SEQ ID NO: 1042400 - protein, 9 aa, Homo Sapiens
VETISIEEG

SEQ ID NO: 1042401 - protein, 9 aa, Homo Sapiens
RSSCKQFVI

SEQ ID NO: 1042402 - protein, 9 aa, Homo Sapiens
ETTITSTTA

SEQ ID NO: 1042403 - protein, 9 aa, Homo Sapiens
PPPARKALA

SEQ ID NO: 1042404 - protein, 9 aa, Homo Sapiens
VLTGLLLFS

SEQ ID NO: 1042405 - protein, 9 aa, Homo Sapiens
YSSIIAPKR

SEQ ID NO: 1042406 - protein, 9 aa, Homo Sapiens
FTFIGTLVQ

SEQ ID NO: 1042407 - protein, 9 aa, Homo Sapiens
INWTDWNTR

SEQ ID NO: 1042408 - protein, 9 aa, Homo Sapiens
FHRMAPEET

SEQ ID NO: 1042409 - protein, 9 aa, Homo Sapiens
FFRQSWKDK

SEQ ID NO: 1042410 - protein, 9 aa, Homo Sapiens
CDLIKNKLS

SEQ ID NO: 1042411 - protein, 9 aa, Homo Sapiens
CKNKTTVVS

SEQ ID NO: 1042412 - protein, 9 aa, Homo Sapiens
VLLGFRSPL

SEQ ID NO: 1042413 - protein, 9 aa, Homo Sapiens
QLNDEAQYI

SEQ ID NO: 1042414 - protein, 9 aa, Homo Sapiens
EGFAEETLK

SEQ ID NO: 1042415 - protein, 9 aa, Homo Sapiens
FAHFWNQRW

SEQ ID NO: 1042416 - protein, 9 aa, Homo Sapiens
SLGFSFSRP

SEQ ID NO: 1042417 - protein, 9 aa, Homo Sapiens
QQRKVICVR

SEQ ID NO: 1042418 - protein, 9 aa, Homo Sapiens
QEPGAHLEK

SEQ ID NO: 1042419 - protein, 9 aa, Homo Sapiens
SGPFPAQLG

SEQ ID NO: 1042420 - protein, 9 aa, Homo Sapiens
KQELGIRLA

SEQ ID NO: 1042421 - protein, 9 aa, Homo Sapiens
SLPSRNIKP

SEQ ID NO: 1042422 - protein, 9 aa, Homo Sapiens
FLGKGGMIW

SEQ ID NO: 1042423 - protein, 9 aa, Homo Sapiens
PELLNLVHL

SEQ ID NO: 1042424 - protein, 9 aa, Homo Sapiens
SGHKSFVPN

SEQ ID NO: 1042425 - protein, 9 aa, Homo Sapiens
LHGLVNDEE

SEQ ID NO: 1042426 - protein, 9 aa, Homo Sapiens
EKHKAFSTC

SEQ ID NO: 1042427 - protein, 9 aa, Homo Sapiens
RRKPQILCY

SEQ ID NO: 1042428 - protein, 9 aa, Homo Sapiens
LGNSHVCNC

SEQ ID NO: 1042429 - protein, 9 aa, Homo Sapiens
FSHLGLPKK

SEQ ID NO: 1042430 - protein, 9 aa, Homo Sapiens
GPSEILELK

SEQ ID NO: 1042431 - protein, 9 aa, Homo Sapiens
LKDLRNDSS

SEQ ID NO: 1042432 - protein, 9 aa, Homo Sapiens
GEKLVEVYK

SEQ ID NO: 1042433 - protein, 9 aa, Homo Sapiens
DFLQSHIIL

SEQ ID NO: 1042434 - protein, 9 aa, Homo Sapiens
GLLGCATQK

SEQ ID NO: 1042435 - protein, 9 aa, Homo Sapiens
PNDDIRYNL

SEQ ID NO: 1042436 - protein, 9 aa, Homo Sapiens
KGRLPSEFF

SEQ ID NO: 1042437 - protein, 9 aa, Homo Sapiens
GIRLAARGP

SEQ ID NO: 1042438 - protein, 9 aa, Homo Sapiens
TVCYEIIAA

SEQ ID NO: 1042439 - protein, 9 aa, Homo Sapiens
ACEERRGAF

SEQ ID NO: 1042440 - protein, 9 aa, Homo Sapiens
LPLLKLQDI

SEQ ID NO: 1042441 - protein, 9 aa, Homo Sapiens
FMLCVTMGL

SEQ ID NO: 1042442 - protein, 9 aa, Homo Sapiens
VGRRMKFQS

SEQ ID NO: 1042443 - protein, 9 aa, Homo Sapiens
SQFIIPSCI

SEQ ID NO: 1042444 - protein, 9 aa, Homo Sapiens
EGINRKYKD

SEQ ID NO: 1042445 - protein, 9 aa, Homo Sapiens
MNTLESKED

SEQ ID NO: 1042446 - protein, 9 aa, Homo Sapiens
EHSAFRLAS

SEQ ID NO: 1042447 - protein, 9 aa, Homo Sapiens
PGKQELGIR

SEQ ID NO: 1042448 - protein, 9 aa, Homo Sapiens
PMEIGTLGT

SEQ ID NO: 1042449 - protein, 9 aa, Homo Sapiens
ICKLMRKAE

SEQ ID NO: 1042450 - protein, 9 aa, Homo Sapiens
TDEDGQVNY

SEQ ID NO: 1042451 - protein, 9 aa, Homo Sapiens
ADVPGQPGT

SEQ ID NO: 1042452 - protein, 9 aa, Homo Sapiens
SFHSAPALD

SEQ ID NO: 1042453 - protein, 9 aa, Homo Sapiens
ITWEIILRC

SEQ ID NO: 1042454 - protein, 9 aa, Homo Sapiens
GFLEEVIPY

SEQ ID NO: 1042455 - protein, 9 aa, Homo Sapiens
AKYHRKLKK

SEQ ID NO: 1042456 - protein, 9 aa, Homo Sapiens
LPQSPGTPR

SEQ ID NO: 1042457 - protein, 9 aa, Homo Sapiens
SGAFFLDSP

SEQ ID NO: 1042458 - protein, 9 aa, Homo Sapiens
TPLPVLSEK

SEQ ID NO: 1042459 - protein, 9 aa, Homo Sapiens
KHKKIYAGK

SEQ ID NO: 1042460 - protein, 9 aa, Homo Sapiens
ATPILQLEK

SEQ ID NO: 1042461 - protein, 9 aa, Homo Sapiens
LVIKQGDFK

SEQ ID NO: 1042462 - protein, 9 aa, Homo Sapiens
GRWPRSTAR

SEQ ID NO: 1042463 - protein, 9 aa, Homo Sapiens
HSIARQKQI

SEQ ID NO: 1042464 - protein, 9 aa, Homo Sapiens
FCRTPAWEQ

SEQ ID NO: 1042465 - protein, 9 aa, Homo Sapiens
RGGWQSEAQ

SEQ ID NO: 1042466 - protein, 9 aa, Homo Sapiens
SFTYIALTI

SEQ ID NO: 1042467 - protein, 9 aa, Homo Sapiens
NAIVQFVGV

SEQ ID NO: 1042468 - protein, 9 aa, Homo Sapiens
RCYYYYRKP

SEQ ID NO: 1042469 - protein, 9 aa, Homo Sapiens
FTHMVGKWH

SEQ ID NO: 1042470 - protein, 9 aa, Homo Sapiens
RERPAWSGA

SEQ ID NO: 1042471 - protein, 9 aa, Homo Sapiens
NVLELHCEA

SEQ ID NO: 1042472 - protein, 9 aa, Homo Sapiens
LETKKTVWQ

SEQ ID NO: 1042473 - protein, 9 aa, Homo Sapiens
SFKKYMEDR

SEQ ID NO: 1042474 - protein, 9 aa, Homo Sapiens
SIQQLKRNL

SEQ ID NO: 1042475 - protein, 9 aa, Homo Sapiens
YGNPMHVAV

SEQ ID NO: 1042476 - protein, 9 aa, Homo Sapiens
EKVDAIFCV

SEQ ID NO: 1042477 - protein, 9 aa, Homo Sapiens
RKNEGEWDV

SEQ ID NO: 1042478 - protein, 9 aa, Homo Sapiens
EGLDYLHKN

SEQ ID NO: 1042479 - protein, 9 aa, Homo Sapiens
DPAGYFVPT

SEQ ID NO: 1042480 - protein, 9 aa, Homo Sapiens
PRHSKYNPQ

SEQ ID NO: 1042481 - protein, 9 aa, Homo Sapiens
LFTETSQTS

SEQ ID NO: 1042482 - protein, 9 aa, Homo Sapiens
LSLELLNTG

SEQ ID NO: 1042483 - protein, 9 aa, Homo Sapiens
YEFGSLREK

SEQ ID NO: 1042484 - protein, 9 aa, Homo Sapiens
DRVVFKSAV

SEQ ID NO: 1042485 - protein, 9 aa, Homo Sapiens
TAGPLCQWS

SEQ ID NO: 1042486 - protein, 9 aa, Homo Sapiens
RSSCPGDYL

SEQ ID NO: 1042487 - protein, 9 aa, Homo Sapiens
RTRLYDTVS

SEQ ID NO: 1042488 - protein, 9 aa, Homo Sapiens
YVKIEKVIG

SEQ ID NO: 1042489 - protein, 9 aa, Homo Sapiens
EINGKSFKK

SEQ ID NO: 1042490 - protein, 9 aa, Homo Sapiens
LTLKIRKPC

SEQ ID NO: 1042491 - protein, 9 aa, Homo Sapiens
PFSFFFDGW

SEQ ID NO: 1042492 - protein, 9 aa, Homo Sapiens
DRTLRCPFP

SEQ ID NO: 1042493 - protein, 9 aa, Homo Sapiens
DTVIDPNRV

SEQ ID NO: 1042494 - protein, 9 aa, Homo Sapiens
FSHSAVYLD

SEQ ID NO: 1042495 - protein, 9 aa, Homo Sapiens
LSEATTPET

SEQ ID NO: 1042496 - protein, 9 aa, Homo Sapiens
AGNTESQFI

SEQ ID NO: 1042497 - protein, 9 aa, Homo Sapiens
SSADKEFPL

SEQ ID NO: 1042498 - protein, 9 aa, Homo Sapiens
ALTGHWRTS

SEQ ID NO: 1042499 - protein, 9 aa, Homo Sapiens
YHGMCLNIA

SEQ ID NO: 1042500 - protein, 9 aa, Homo Sapiens
MRKSRSGED

SEQ ID NO: 1042501 - protein, 9 aa, Homo Sapiens
PPSAPPLPP

SEQ ID NO: 1042502 - protein, 9 aa, Homo Sapiens
ILCYPETGH

SEQ ID NO: 1042503 - protein, 9 aa, Homo Sapiens
AFWRGDELT

SEQ ID NO: 1042504 - protein, 9 aa, Homo Sapiens
NDWTATDPK

SEQ ID NO: 1042505 - protein, 9 aa, Homo Sapiens
NYQESQSVS

SEQ ID NO: 1042506 - protein, 9 aa, Homo Sapiens
DDIVELWDD

SEQ ID NO: 1042507 - protein, 9 aa, Homo Sapiens
DSNPEFTLQ

SEQ ID NO: 1042508 - protein, 9 aa, Homo Sapiens
ITYSAISNE

SEQ ID NO: 1042509 - protein, 9 aa, Homo Sapiens
GSFGEEPLA

SEQ ID NO: 1042510 - protein, 9 aa, Homo Sapiens
HSGTLGLFL

SEQ ID NO: 1042511 - protein, 9 aa, Homo Sapiens
LVTGLQSPD

SEQ ID NO: 1042512 - protein, 9 aa, Homo Sapiens
FANEKEANF

SEQ ID NO: 1042513 - protein, 9 aa, Homo Sapiens
SLVSRSSPD

SEQ ID NO: 1042514 - protein, 9 aa, Homo Sapiens
EHIPESLYL

SEQ ID NO: 1042515 - protein, 9 aa, Homo Sapiens
AQKYDHQRK

SEQ ID NO: 1042516 - protein, 9 aa, Homo Sapiens
RLAARGPKD

SEQ ID NO: 1042517 - protein, 9 aa, Homo Sapiens
AGIAMSTWV

SEQ ID NO: 1042518 - protein, 9 aa, Homo Sapiens
RTMTEAEVQ

SEQ ID NO: 1042519 - protein, 9 aa, Homo Sapiens
QESYRAYAV

SEQ ID NO: 1042520 - protein, 9 aa, Homo Sapiens
PLFQYSCRQ

SEQ ID NO: 1042521 - protein, 9 aa, Homo Sapiens
GRRLGALTG

SEQ ID NO: 1042522 - protein, 9 aa, Homo Sapiens
VHGGHRSST

SEQ ID NO: 1042523 - protein, 9 aa, Homo Sapiens
AADAAGAAE

SEQ ID NO: 1042524 - protein, 9 aa, Homo Sapiens
SQENREHNS

SEQ ID NO: 1042525 - protein, 9 aa, Homo Sapiens
VDARHLSFF

SEQ ID NO: 1042526 - protein, 9 aa, Homo Sapiens
RDPKIYTDP

SEQ ID NO: 1042527 - protein, 9 aa, Homo Sapiens
DKGLKYDGP

SEQ ID NO: 1042528 - protein, 9 aa, Homo Sapiens
ERKGSNKRG

SEQ ID NO: 1042529 - protein, 9 aa, Homo Sapiens
FFTSKKKKD

SEQ ID NO: 1042530 - protein, 9 aa, Homo Sapiens
ILVSLSTGE

SEQ ID NO: 1042531 - protein, 9 aa, Homo Sapiens
GCLGLVSLL

SEQ ID NO: 1042532 - protein, 9 aa, Homo Sapiens
EETQKKLPS

SEQ ID NO: 1042533 - protein, 9 aa, Homo Sapiens
RVVIDQMLD

SEQ ID NO: 1042534 - protein, 9 aa, Homo Sapiens
KHFFEAAEI

SEQ ID NO: 1042535 - protein, 9 aa, Homo Sapiens
GGAEAAGHP

SEQ ID NO: 1042536 - protein, 9 aa, Homo Sapiens
EEKVDAIFC

SEQ ID NO: 1042537 - protein, 9 aa, Homo Sapiens
SVLQRRQKL

SEQ ID NO: 1042538 - protein, 9 aa, Homo Sapiens
SSLQGLFIF

SEQ ID NO: 1042539 - protein, 9 aa, Homo Sapiens
QTEELWSKT

SEQ ID NO: 1042540 - protein, 9 aa, Homo Sapiens
LLFLCTFSW

SEQ ID NO: 1042541 - protein, 9 aa, Homo Sapiens
DAAHGDEVS

SEQ ID NO: 1042542 - protein, 9 aa, Homo Sapiens
VISCLKYCG

SEQ ID NO: 1042543 - protein, 9 aa, Homo Sapiens
NDKEQFECQ

SEQ ID NO: 1042544 - protein, 9 aa, Homo Sapiens
SEEEKGNAN

SEQ ID NO: 1042545 - protein, 9 aa, Homo Sapiens
LLDLQRNLL

SEQ ID NO: 1042546 - protein, 9 aa, Homo Sapiens
EQKKAGLPL

SEQ ID NO: 1042547 - protein, 9 aa, Homo Sapiens
SQQTLRFNP

SEQ ID NO: 1042548 - protein, 9 aa, Homo Sapiens
AGMEYLFSH

SEQ ID NO: 1042549 - protein, 9 aa, Homo Sapiens
KESGACLHP

SEQ ID NO: 1042550 - protein, 9 aa, Homo Sapiens
KLHVTDPDT

SEQ ID NO: 1042551 - protein, 9 aa, Homo Sapiens
LLEEGEYLD

SEQ ID NO: 1042552 - protein, 9 aa, Homo Sapiens
KTIKRRKIY

SEQ ID NO: 1042553 - protein, 9 aa, Homo Sapiens
LYRNINIPL

SEQ ID NO: 1042554 - protein, 9 aa, Homo Sapiens
NSEHQTNVT

SEQ ID NO: 1042555 - protein, 9 aa, Homo Sapiens
CLPLVDCFI

SEQ ID NO: 1042556 - protein, 9 aa, Homo Sapiens
KKRELKASV

SEQ ID NO: 1042557 - protein, 9 aa, Homo Sapiens
PQSPGTPRK

SEQ ID NO: 1042558 - protein, 9 aa, Homo Sapiens
IKGNGSGSR

SEQ ID NO: 1042559 - protein, 9 aa, Homo Sapiens
SGKVCVRKV

SEQ ID NO: 1042560 - protein, 9 aa, Homo Sapiens
GEPPKFPRA

SEQ ID NO: 1042561 - protein, 9 aa, Homo Sapiens
GLSGFLSDS

SEQ ID NO: 1042562 - protein, 9 aa, Homo Sapiens
LECMENNCP

SEQ ID NO: 1042563 - protein, 9 aa, Homo Sapiens
QIGSSNRNL

SEQ ID NO: 1042564 - protein, 9 aa, Homo Sapiens
VESTSPGRK

SEQ ID NO: 1042565 - protein, 9 aa, Homo Sapiens
LHTNRSQEL

SEQ ID NO: 1042566 - protein, 9 aa, Homo Sapiens
GHWRTSELP

SEQ ID NO: 1042567 - protein, 9 aa, Homo Sapiens
NICVDMLQD

SEQ ID NO: 1042568 - protein, 9 aa, Homo Sapiens
FKKHQLSVV

SEQ ID NO: 1042569 - protein, 9 aa, Homo Sapiens
FRGANAFEI

SEQ ID NO: 1042570 - protein, 9 aa, Homo Sapiens
WDKVKEEMT

SEQ ID NO: 1042571 - protein, 9 aa, Homo Sapiens
SSGPRKKIE

SEQ ID NO: 1042572 - protein, 9 aa, Homo Sapiens
GMGKARRRA

SEQ ID NO: 1042573 - protein, 9 aa, Homo Sapiens
TCLESFCDS

SEQ ID NO: 1042574 - protein, 9 aa, Homo Sapiens
ATNPDLGAG

SEQ ID NO: 1042575 - protein, 9 aa, Homo Sapiens
PSHSFAFGI

SEQ ID NO: 1042576 - protein, 9 aa, Homo Sapiens
IFVGFFSSN

SEQ ID NO: 1042577 - protein, 9 aa, Homo Sapiens
GPKGDSGPP

SEQ ID NO: 1042578 - protein, 9 aa, Homo Sapiens
VPGGAAARS

SEQ ID NO: 1042579 - protein, 9 aa, Homo Sapiens
RPSSLRKWY

SEQ ID NO: 1042580 - protein, 9 aa, Homo Sapiens
REASKKAEA

SEQ ID NO: 1042581 - protein, 9 aa, Homo Sapiens
KIYTEENPY

SEQ ID NO: 1042582 - protein, 9 aa, Homo Sapiens
SAFPAFTMS

SEQ ID NO: 1042583 - protein, 9 aa, Homo Sapiens
SRGKASQRH

SEQ ID NO: 1042584 - protein, 9 aa, Homo Sapiens
CPSDDNSTF

SEQ ID NO: 1042585 - protein, 9 aa, Homo Sapiens
SSERITDNL

SEQ ID NO: 1042586 - protein, 9 aa, Homo Sapiens
SRSPSPGKC

SEQ ID NO: 1042587 - protein, 9 aa, Homo Sapiens
RPLGEKGPQ

SEQ ID NO: 1042588 - protein, 9 aa, Homo Sapiens
PEKFEKLLH

SEQ ID NO: 1042589 - protein, 9 aa, Homo Sapiens
ERGNGRSEG

SEQ ID NO: 1042590 - protein, 9 aa, Homo Sapiens
DVKDSIKKM

SEQ ID NO: 1042591 - protein, 9 aa, Homo Sapiens
LFETQKKEF

SEQ ID NO: 1042592 - protein, 9 aa, Homo Sapiens
SLFTLRALQ

SEQ ID NO: 1042593 - protein, 9 aa, Homo Sapiens
TENVNIEEA

SEQ ID NO: 1042594 - protein, 9 aa, Homo Sapiens
SEGNSSDDF

SEQ ID NO: 1042595 - protein, 9 aa, Homo Sapiens
PKTRGFHLR

SEQ ID NO: 1042596 - protein, 9 aa, Homo Sapiens
DNISVSSST

SEQ ID NO: 1042597 - protein, 9 aa, Homo Sapiens
SPKELMPPQ

SEQ ID NO: 1042598 - protein, 9 aa, Homo Sapiens
FTDAQNCEI

SEQ ID NO: 1042599 - protein, 9 aa, Homo Sapiens
YTCVPAYVN

SEQ ID NO: 1042600 - protein, 9 aa, Homo Sapiens
SSTKLARIE

SEQ ID NO: 1042601 - protein, 9 aa, Homo Sapiens
LERLTREGK

SEQ ID NO: 1042602 - protein, 9 aa, Homo Sapiens
AQQRKKVFS

SEQ ID NO: 1042603 - protein, 9 aa, Homo Sapiens
FWSRQRPKS

SEQ ID NO: 1042604 - protein, 9 aa, Homo Sapiens
AFSKALESR

SEQ ID NO: 1042605 - protein, 9 aa, Homo Sapiens
LYDTVSSTD

SEQ ID NO: 1042606 - protein, 9 aa, Homo Sapiens
RAEALVNGK

SEQ ID NO: 1042607 - protein, 9 aa, Homo Sapiens
IIHNGHHTS

SEQ ID NO: 1042608 - protein, 9 aa, Homo Sapiens
LKCLRYYVG

SEQ ID NO: 1042609 - protein, 9 aa, Homo Sapiens
DPEAASLGA

SEQ ID NO: 1042610 - protein, 9 aa, Homo Sapiens
KRRQMAANL

SEQ ID NO: 1042611 - protein, 9 aa, Homo Sapiens
ERTFTYSLS

SEQ ID NO: 1042612 - protein, 9 aa, Homo Sapiens
EDIERLAKE

SEQ ID NO: 1042613 - protein, 9 aa, Homo Sapiens
HSKWGTKGL

SEQ ID NO: 1042614 - protein, 9 aa, Homo Sapiens
YLGAEALRL

SEQ ID NO: 1042615 - protein, 9 aa, Homo Sapiens
CTSEMKQAN

SEQ ID NO: 1042616 - protein, 9 aa, Homo Sapiens
LTGMLIELS

SEQ ID NO: 1042617 - protein, 9 aa, Homo Sapiens
QKIYTEENP

SEQ ID NO: 1042618 - protein, 9 aa, Homo Sapiens
PCDETELQG

SEQ ID NO: 1042619 - protein, 9 aa, Homo Sapiens
YSYRIIAQE

SEQ ID NO: 1042620 - protein, 9 aa, Homo Sapiens
CSSVNSEAF

SEQ ID NO: 1042621 - protein, 9 aa, Homo Sapiens
RITIFHVGR

SEQ ID NO: 1042622 - protein, 9 aa, Homo Sapiens
LAVASSSKI

SEQ ID NO: 1042623 - protein, 9 aa, Homo Sapiens
ESHCAEKSN

SEQ ID NO: 1042624 - protein, 9 aa, Homo Sapiens
DRYGRTAFI

SEQ ID NO: 1042625 - protein, 9 aa, Homo Sapiens
ERKIRQKLE

SEQ ID NO: 1042626 - protein, 9 aa, Homo Sapiens
RGAVKTGPR

SEQ ID NO: 1042627 - protein, 9 aa, Homo Sapiens
SKKESSNQA

SEQ ID NO: 1042628 - protein, 9 aa, Homo Sapiens
ESQEETAPP

SEQ ID NO: 1042629 - protein, 9 aa, Homo Sapiens
GKARRRATQ

SEQ ID NO: 1042630 - protein, 9 aa, Homo Sapiens
HYLDQLGTA

SEQ ID NO: 1042631 - protein, 9 aa, Homo Sapiens
YLPLLIHRH

SEQ ID NO: 1042632 - protein, 9 aa, Homo Sapiens
FQAFCLVLF

SEQ ID NO: 1042633 - protein, 9 aa, Homo Sapiens
ATDNNDIYG

SEQ ID NO: 1042634 - protein, 9 aa, Homo Sapiens
LANSSPPSG

SEQ ID NO: 1042635 - protein, 9 aa, Homo Sapiens
YFVKVVPFS

SEQ ID NO: 1042636 - protein, 9 aa, Homo Sapiens
LEGDGHWQG

SEQ ID NO: 1042637 - protein, 9 aa, Homo Sapiens
TFLHLLSSH

SEQ ID NO: 1042638 - protein, 9 aa, Homo Sapiens
STLISQAFY

SEQ ID NO: 1042639 - protein, 9 aa, Homo Sapiens
GIVEEYQLS

SEQ ID NO: 1042640 - protein, 9 aa, Homo Sapiens
ESFEVCTNT

SEQ ID NO: 1042641 - protein, 9 aa, Homo Sapiens
SVSSRALSP

SEQ ID NO: 1042642 - protein, 9 aa, Homo Sapiens
PQKKTTSSI

SEQ ID NO: 1042643 - protein, 9 aa, Homo Sapiens
KLHPRLESP

SEQ ID NO: 1042644 - protein, 9 aa, Homo Sapiens
SVVPKIPEP

SEQ ID NO: 1042645 - protein, 9 aa, Homo Sapiens
LEYKIQRKT

SEQ ID NO: 1042646 - protein, 9 aa, Homo Sapiens
APLVDYLSE

SEQ ID NO: 1042647 - protein, 9 aa, Homo Sapiens
NYQVVTTSS

SEQ ID NO: 1042648 - protein, 9 aa, Homo Sapiens
LEIFFTSIF

SEQ ID NO: 1042649 - protein, 9 aa, Homo Sapiens
YSINLTLRR

SEQ ID NO: 1042650 - protein, 9 aa, Homo Sapiens
SSEKREENV

SEQ ID NO: 1042651 - protein, 9 aa, Homo Sapiens
QKAFSKALE

SEQ ID NO: 1042652 - protein, 9 aa, Homo Sapiens
SVLDKVCKN

SEQ ID NO: 1042653 - protein, 9 aa, Homo Sapiens
SFLSCIMQT

SEQ ID NO: 1042654 - protein, 9 aa, Homo Sapiens
MAKVQNFLG

SEQ ID NO: 1042655 - protein, 9 aa, Homo Sapiens
ASSPGAQRP

SEQ ID NO: 1042656 - protein, 9 aa, Homo Sapiens
EGKQKAFYT

SEQ ID NO: 1042657 - protein, 9 aa, Homo Sapiens
VLAVISKEE

SEQ ID NO: 1042658 - protein, 9 aa, Homo Sapiens
RASLVSRSS

SEQ ID NO: 1042659 - protein, 9 aa, Homo Sapiens
LLILLFYTR

SEQ ID NO: 1042660 - protein, 9 aa, Homo Sapiens
YVLLNVLFC

SEQ ID NO: 1042661 - protein, 9 aa, Homo Sapiens
ENLVGTVAN

SEQ ID NO: 1042662 - protein, 9 aa, Homo Sapiens
LHIVFSTNK

SEQ ID NO: 1042663 - protein, 9 aa, Homo Sapiens
WPQPRGQAA

SEQ ID NO: 1042664 - protein, 9 aa, Homo Sapiens
RMTHLLGMN

SEQ ID NO: 1042665 - protein, 9 aa, Homo Sapiens
EITSDFQSP

SEQ ID NO: 1042666 - protein, 9 aa, Homo Sapiens
KAFSTCAFH

SEQ ID NO: 1042667 - protein, 9 aa, Homo Sapiens
YREPVLGVS

SEQ ID NO: 1042668 - protein, 9 aa, Homo Sapiens
LKILKLREE

SEQ ID NO: 1042669 - protein, 9 aa, Homo Sapiens
KLNINLKME

SEQ ID NO: 1042670 - protein, 9 aa, Homo Sapiens
ISAPDSKRQ

SEQ ID NO: 1042671 - protein, 9 aa, Homo Sapiens
GQSWCIPLY

SEQ ID NO: 1042672 - protein, 9 aa, Homo Sapiens
EKEMETLGK

SEQ ID NO: 1042673 - protein, 9 aa, Homo Sapiens
RACARFLKN

SEQ ID NO: 1042674 - protein, 9 aa, Homo Sapiens
QELLENTNV

SEQ ID NO: 1042675 - protein, 9 aa, Homo Sapiens
APEPDISKE

SEQ ID NO: 1042676 - protein, 9 aa, Homo Sapiens
CSGSDLTRH

SEQ ID NO: 1042677 - protein, 9 aa, Homo Sapiens
TTIITVTDV

SEQ ID NO: 1042678 - protein, 9 aa, Homo Sapiens
QLPFDDSYQ

SEQ ID NO: 1042679 - protein, 9 aa, Homo Sapiens
IDGFFNDSL

SEQ ID NO: 1042680 - protein, 9 aa, Homo Sapiens
TPDWLVTMK

SEQ ID NO: 1042681 - protein, 9 aa, Homo Sapiens
DFSVYKKQV

SEQ ID NO: 1042682 - protein, 9 aa, Homo Sapiens
IYSLSVGNK

SEQ ID NO: 1042683 - protein, 9 aa, Homo Sapiens
QSVLQRRQK

SEQ ID NO: 1042684 - protein, 9 aa, Homo Sapiens
VEEYQLSYH

SEQ ID NO: 1042685 - protein, 9 aa, Homo Sapiens
QNLKVYIKT

SEQ ID NO: 1042686 - protein, 9 aa, Homo Sapiens
SPGTGTLTE

SEQ ID NO: 1042687 - protein, 9 aa, Homo Sapiens
MIPSGGTEC

SEQ ID NO: 1042688 - protein, 9 aa, Homo Sapiens
VDNKLYLSI

SEQ ID NO: 1042689 - protein, 9 aa, Homo Sapiens
NCGSPKIAS

SEQ ID NO: 1042690 - protein, 9 aa, Homo Sapiens
VASSSKIPT

SEQ ID NO: 1042691 - protein, 9 aa, Homo Sapiens
HLLLVDNGF

SEQ ID NO: 1042692 - protein, 9 aa, Homo Sapiens
NNYSYLIID

SEQ ID NO: 1042693 - protein, 9 aa, Homo Sapiens
KNCSPHINV

SEQ ID NO: 1042694 - protein, 9 aa, Homo Sapiens
VAIYTVSAT

SEQ ID NO: 1042695 - protein, 9 aa, Homo Sapiens
FIATSTTSR

SEQ ID NO: 1042696 - protein, 9 aa, Homo Sapiens
RSVKFDREF

SEQ ID NO: 1042697 - protein, 9 aa, Homo Sapiens
ISSRPWDLR

SEQ ID NO: 1042698 - protein, 9 aa, Homo Sapiens
FIIFCYTFI

SEQ ID NO: 1042699 - protein, 9 aa, Homo Sapiens
LCVVSDISA

SEQ ID NO: 1042700 - protein, 9 aa, Homo Sapiens
AMSPADKCS

SEQ ID NO: 1042701 - protein, 9 aa, Homo Sapiens
MLFAWAVRS

SEQ ID NO: 1042702 - protein, 9 aa, Homo Sapiens
LTTMGDRLT

SEQ ID NO: 1042703 - protein, 9 aa, Homo Sapiens
PECLEGSGN

SEQ ID NO: 1042704 - protein, 9 aa, Homo Sapiens
KRATWKGRN

SEQ ID NO: 1042705 - protein, 9 aa, Homo Sapiens
LPNGYPRYS

SEQ ID NO: 1042706 - protein, 9 aa, Homo Sapiens
LESELLADI

SEQ ID NO: 1042707 - protein, 9 aa, Homo Sapiens
LQINLEREL

SEQ ID NO: 1042708 - protein, 9 aa, Homo Sapiens
SAECQPKKE

SEQ ID NO: 1042709 - protein, 9 aa, Homo Sapiens
FIMEMKHKF

SEQ ID NO: 1042710 - protein, 9 aa, Homo Sapiens
FIVLEAGIS

SEQ ID NO: 1042711 - protein, 9 aa, Homo Sapiens
ENGVNYTTT

SEQ ID NO: 1042712 - protein, 9 aa, Homo Sapiens
GAISRSPTF

SEQ ID NO: 1042713 - protein, 9 aa, Homo Sapiens
PICLVSKGL

SEQ ID NO: 1042714 - protein, 9 aa, Homo Sapiens
VVISFFLWS

SEQ ID NO: 1042715 - protein, 9 aa, Homo Sapiens
IVIFMFAQE

SEQ ID NO: 1042716 - protein, 9 aa, Homo Sapiens
DSFNDVGLD

SEQ ID NO: 1042717 - protein, 9 aa, Homo Sapiens
LGTKIYQWC

SEQ ID NO: 1042718 - protein, 9 aa, Homo Sapiens
VFHSGTAAT

SEQ ID NO: 1042719 - protein, 9 aa, Homo Sapiens
LSEGWSALP

SEQ ID NO: 1042720 - protein, 9 aa, Homo Sapiens
SNRGHSHNA

SEQ ID NO: 1042721 - protein, 9 aa, Homo Sapiens
TWSPASFSF

SEQ ID NO: 1042722 - protein, 9 aa, Homo Sapiens
LSPQRDPKI

SEQ ID NO: 1042723 - protein, 9 aa, Homo Sapiens
VSNGSFLCK

SEQ ID NO: 1042724 - protein, 9 aa, Homo Sapiens
IKHKETKPQ

SEQ ID NO: 1042725 - protein, 9 aa, Homo Sapiens
SGKIYNIWH

SEQ ID NO: 1042726 - protein, 9 aa, Homo Sapiens
SEILELKPG

SEQ ID NO: 1042727 - protein, 9 aa, Homo Sapiens
GCHTTSRSG

SEQ ID NO: 1042728 - protein, 9 aa, Homo Sapiens
NPLNARVAL

SEQ ID NO: 1042729 - protein, 9 aa, Homo Sapiens
YFKDPHVAT

SEQ ID NO: 1042730 - protein, 9 aa, Homo Sapiens
PSQKRYAAY

SEQ ID NO: 1042731 - protein, 9 aa, Homo Sapiens
SDMKKFTEI

SEQ ID NO: 1042732 - protein, 9 aa, Homo Sapiens
RTAARTARR

SEQ ID NO: 1042733 - protein, 9 aa, Homo Sapiens
PPGPPEPPR

SEQ ID NO: 1042734 - protein, 9 aa, Homo Sapiens
IDENTGNIH

SEQ ID NO: 1042735 - protein, 9 aa, Homo Sapiens
SHSPLIRVT

SEQ ID NO: 1042736 - protein, 9 aa, Homo Sapiens
AASQEATRP

SEQ ID NO: 1042737 - protein, 9 aa, Homo Sapiens
VYGNNIKPG

SEQ ID NO: 1042738 - protein, 9 aa, Homo Sapiens
PLPVLSEKD

SEQ ID NO: 1042739 - protein, 9 aa, Homo Sapiens
ETITFKVPS

SEQ ID NO: 1042740 - protein, 9 aa, Homo Sapiens
NIHATKRLD

SEQ ID NO: 1042741 - protein, 9 aa, Homo Sapiens
LSDKYKLNS

SEQ ID NO: 1042742 - protein, 9 aa, Homo Sapiens
NCGTPLPVL

SEQ ID NO: 1042743 - protein, 9 aa, Homo Sapiens
LQGYIKAHA

SEQ ID NO: 1042744 - protein, 9 aa, Homo Sapiens
TWVGIVIFL

SEQ ID NO: 1042745 - protein, 9 aa, Homo Sapiens
KCCTHNNSA

SEQ ID NO: 1042746 - protein, 9 aa, Homo Sapiens
KIFKLHAKL

SEQ ID NO: 1042747 - protein, 9 aa, Homo Sapiens
VEWPGKDSK

SEQ ID NO: 1042748 - protein, 9 aa, Homo Sapiens
QRRLYPPLS

SEQ ID NO: 1042749 - protein, 9 aa, Homo Sapiens
VDGEPFFWQ

SEQ ID NO: 1042750 - protein, 9 aa, Homo Sapiens
LQPKRQRLW

SEQ ID NO: 1042751 - protein, 9 aa, Homo Sapiens
LRTPRSLDH

SEQ ID NO: 1042752 - protein, 9 aa, Homo Sapiens
SLHGLVNDE

SEQ ID NO: 1042753 - protein, 9 aa, Homo Sapiens
RAPAPDPAG

SEQ ID NO: 1042754 - protein, 9 aa, Homo Sapiens
SLANSSPPS

SEQ ID NO: 1042755 - protein, 9 aa, Homo Sapiens
FDCSTKVLD

SEQ ID NO: 1042756 - protein, 9 aa, Homo Sapiens
GEVNQLLEQ

SEQ ID NO: 1042757 - protein, 9 aa, Homo Sapiens
EATSFPPTP

SEQ ID NO: 1042758 - protein, 9 aa, Homo Sapiens
PFDDSYQLC

SEQ ID NO: 1042759 - protein, 9 aa, Homo Sapiens
SHSSNNPQD

SEQ ID NO: 1042760 - protein, 9 aa, Homo Sapiens
KDPKAISVI

SEQ ID NO: 1042761 - protein, 9 aa, Homo Sapiens
VDRTKFEQY

SEQ ID NO: 1042762 - protein, 9 aa, Homo Sapiens
IQHENIFSS

SEQ ID NO: 1042763 - protein, 9 aa, Homo Sapiens
ALKVLEEEN

SEQ ID NO: 1042764 - protein, 9 aa, Homo Sapiens
KALYDAELS

SEQ ID NO: 1042765 - protein, 9 aa, Homo Sapiens
QEHTDQIRK

SEQ ID NO: 1042766 - protein, 9 aa, Homo Sapiens
LGCVNFPPE

SEQ ID NO: 1042767 - protein, 9 aa, Homo Sapiens
SEGDENEDD

SEQ ID NO: 1042768 - protein, 9 aa, Homo Sapiens
SLSSTSEQV

SEQ ID NO: 1042769 - protein, 9 aa, Homo Sapiens
WMETSVSPL

SEQ ID NO: 1042770 - protein, 9 aa, Homo Sapiens
GIGLVNFAV

SEQ ID NO: 1042771 - protein, 9 aa, Homo Sapiens
WESLTILAV

SEQ ID NO: 1042772 - protein, 9 aa, Homo Sapiens
TSFPPTPTC

SEQ ID NO: 1042773 - protein, 9 aa, Homo Sapiens
YDESTQVQL

SEQ ID NO: 1042774 - protein, 9 aa, Homo Sapiens
PKEKGEAGD

SEQ ID NO: 1042775 - protein, 9 aa, Homo Sapiens
PLAPQYTGP

SEQ ID NO: 1042776 - protein, 9 aa, Homo Sapiens
LSTELQAKL

SEQ ID NO: 1042777 - protein, 9 aa, Homo Sapiens
DFAIMIPSG

SEQ ID NO: 1042778 - protein, 9 aa, Homo Sapiens
GCNSDHWGP

SEQ ID NO: 1042779 - protein, 9 aa, Homo Sapiens
CLATFPDVY

SEQ ID NO: 1042780 - protein, 9 aa, Homo Sapiens
WPGHVALIA

SEQ ID NO: 1042781 - protein, 9 aa, Homo Sapiens
QSWKDKRLK

SEQ ID NO: 1042782 - protein, 9 aa, Homo Sapiens
NDKSTLISQ

SEQ ID NO: 1042783 - protein, 9 aa, Homo Sapiens
VPTESWPGH

SEQ ID NO: 1042784 - protein, 9 aa, Homo Sapiens
YRFNVISIK

SEQ ID NO: 1042785 - protein, 9 aa, Homo Sapiens
LEKFHCIAE

SEQ ID NO: 1042786 - protein, 9 aa, Homo Sapiens
FPSSLRNRI

SEQ ID NO: 1042787 - protein, 9 aa, Homo Sapiens
QQRKKVFST

SEQ ID NO: 1042788 - protein, 9 aa, Homo Sapiens
TEATDTKKK

SEQ ID NO: 1042789 - protein, 9 aa, Homo Sapiens
AQEVAQKRL

SEQ ID NO: 1042790 - protein, 9 aa, Homo Sapiens
STDPGLMLA

SEQ ID NO: 1042791 - protein, 9 aa, Homo Sapiens
INFLKALYD

SEQ ID NO: 1042792 - protein, 9 aa, Homo Sapiens
QHPPPSVVH

SEQ ID NO: 1042793 - protein, 9 aa, Homo Sapiens
LSAFSAASA

SEQ ID NO: 1042794 - protein, 9 aa, Homo Sapiens
ADRNFTTPQ

SEQ ID NO: 1042795 - protein, 9 aa, Homo Sapiens
SVKVPLQRV

SEQ ID NO: 1042796 - protein, 9 aa, Homo Sapiens
NCSCVKVTG

SEQ ID NO: 1042797 - protein, 9 aa, Homo Sapiens
AIHHVHSLY

SEQ ID NO: 1042798 - protein, 9 aa, Homo Sapiens
GLETDLQNL

SEQ ID NO: 1042799 - protein, 9 aa, Homo Sapiens
WVKAGYKKP

SEQ ID NO: 1042800 - protein, 9 aa, Homo Sapiens
IEDYFIDLP

SEQ ID NO: 1042801 - protein, 9 aa, Homo Sapiens
EKSNAGVLW

SEQ ID NO: 1042802 - protein, 9 aa, Homo Sapiens
SRALPGPAE

SEQ ID NO: 1042803 - protein, 9 aa, Homo Sapiens
CTCLRAQPV

SEQ ID NO: 1042804 - protein, 9 aa, Homo Sapiens
DVDGLLTGH

SEQ ID NO: 1042805 - protein, 9 aa, Homo Sapiens
VGEKPDSEN

SEQ ID NO: 1042806 - protein, 9 aa, Homo Sapiens
DLRRLLSSS

SEQ ID NO: 1042807 - protein, 9 aa, Homo Sapiens
MVQLLSPSQ

SEQ ID NO: 1042808 - protein, 9 aa, Homo Sapiens
LIKNKLSPP

SEQ ID NO: 1042809 - protein, 9 aa, Homo Sapiens
QELEAFRSQ

SEQ ID NO: 1042810 - protein, 9 aa, Homo Sapiens
GKAESLEHQ

SEQ ID NO: 1042811 - protein, 9 aa, Homo Sapiens
LVGLEGTKS

SEQ ID NO: 1042812 - protein, 9 aa, Homo Sapiens
HQKIKNLIC

SEQ ID NO: 1042813 - protein, 9 aa, Homo Sapiens
PTSFLPRFL

SEQ ID NO: 1042814 - protein, 9 aa, Homo Sapiens
ISEEEKGNA

SEQ ID NO: 1042815 - protein, 9 aa, Homo Sapiens
NDSGAGESE

SEQ ID NO: 1042816 - protein, 9 aa, Homo Sapiens
PVKPLNRAV

SEQ ID NO: 1042817 - protein, 9 aa, Homo Sapiens
DIKPFSPKI

SEQ ID NO: 1042818 - protein, 9 aa, Homo Sapiens
QLFRGEDSR

SEQ ID NO: 1042819 - protein, 9 aa, Homo Sapiens
SLRTPRSLD

SEQ ID NO: 1042820 - protein, 9 aa, Homo Sapiens
STAWVDNTV

SEQ ID NO: 1042821 - protein, 9 aa, Homo Sapiens
QKEEEVEEE

SEQ ID NO: 1042822 - protein, 9 aa, Homo Sapiens
FKYSQGQVH

SEQ ID NO: 1042823 - protein, 9 aa, Homo Sapiens
LLERDPILA

SEQ ID NO: 1042824 - protein, 9 aa, Homo Sapiens
IVKRFSFFQ

SEQ ID NO: 1042825 - protein, 9 aa, Homo Sapiens
HHSLRTPRS

SEQ ID NO: 1042826 - protein, 9 aa, Homo Sapiens
ERRFTIISN

SEQ ID NO: 1042827 - protein, 9 aa, Homo Sapiens
AGEGAADAA

SEQ ID NO: 1042828 - protein, 9 aa, Homo Sapiens
HFFFKTLHF

SEQ ID NO: 1042829 - protein, 9 aa, Homo Sapiens
RTKFEQYLH

SEQ ID NO: 1042830 - protein, 9 aa, Homo Sapiens
DDMNFTELI

SEQ ID NO: 1042831 - protein, 9 aa, Homo Sapiens
ALSPDMDEM

SEQ ID NO: 1042832 - protein, 9 aa, Homo Sapiens
SVKFDREFW

SEQ ID NO: 1042833 - protein, 9 aa, Homo Sapiens
KAQRGRATC

SEQ ID NO: 1042834 - protein, 9 aa, Homo Sapiens
RTEGFFVTL

SEQ ID NO: 1042835 - protein, 9 aa, Homo Sapiens
LVVADPHSP

SEQ ID NO: 1042836 - protein, 9 aa, Homo Sapiens
QSQGPPPCP

SEQ ID NO: 1042837 - protein, 9 aa, Homo Sapiens
TLSERPTAQ

SEQ ID NO: 1042838 - protein, 9 aa, Homo Sapiens
PAPGHARSR

SEQ ID NO: 1042839 - protein, 9 aa, Homo Sapiens
GCSGNFKKW

SEQ ID NO: 1042840 - protein, 9 aa, Homo Sapiens
RLLTRLCPS

SEQ ID NO: 1042841 - protein, 9 aa, Homo Sapiens
LLYPSGWLY

SEQ ID NO: 1042842 - protein, 9 aa, Homo Sapiens
LLVDNGFHG

SEQ ID NO: 1042843 - protein, 9 aa, Homo Sapiens
KQVFEESCM

SEQ ID NO: 1042844 - protein, 9 aa, Homo Sapiens
KGLPLIKYF

SEQ ID NO: 1042845 - protein, 9 aa, Homo Sapiens
YGSCTCLRA

SEQ ID NO: 1042846 - protein, 9 aa, Homo Sapiens
IKAQRGRAT

SEQ ID NO: 1042847 - protein, 9 aa, Homo Sapiens
LAALIRGNC

SEQ ID NO: 1042848 - protein, 9 aa, Homo Sapiens
PVEGFYAPR

SEQ ID NO: 1042849 - protein, 9 aa, Homo Sapiens
ANLLASAPA

SEQ ID NO: 1042850 - protein, 9 aa, Homo Sapiens
AVFEISDPD

SEQ ID NO: 1042851 - protein, 9 aa, Homo Sapiens
DFGRPGPPV

SEQ ID NO: 1042852 - protein, 9 aa, Homo Sapiens
ILSTKNSIA

SEQ ID NO: 1042853 - protein, 9 aa, Homo Sapiens
GNASKEQVC

SEQ ID NO: 1042854 - protein, 9 aa, Homo Sapiens
AENGVNYTT

SEQ ID NO: 1042855 - protein, 9 aa, Homo Sapiens
RRQMAANLL

SEQ ID NO: 1042856 - protein, 9 aa, Homo Sapiens
KAISVIHRL

SEQ ID NO: 1042857 - protein, 9 aa, Homo Sapiens
DVSANQAAF

SEQ ID NO: 1042858 - protein, 9 aa, Homo Sapiens
HKVETFSSV

SEQ ID NO: 1042859 - protein, 9 aa, Homo Sapiens
EPTNGRMLL

SEQ ID NO: 1042860 - protein, 9 aa, Homo Sapiens
GSLKMVRKS

SEQ ID NO: 1042861 - protein, 9 aa, Homo Sapiens
TKIKVTLGD

SEQ ID NO: 1042862 - protein, 9 aa, Homo Sapiens
HGELTACMN

SEQ ID NO: 1042863 - protein, 9 aa, Homo Sapiens
KTLVSELSE

SEQ ID NO: 1042864 - protein, 9 aa, Homo Sapiens
DEEEENEGE

SEQ ID NO: 1042865 - protein, 9 aa, Homo Sapiens
HLHSFKITW

SEQ ID NO: 1042866 - protein, 9 aa, Homo Sapiens
QISILTMPN

SEQ ID NO: 1042867 - protein, 9 aa, Homo Sapiens
TETVLAALE

SEQ ID NO: 1042868 - protein, 9 aa, Homo Sapiens
TESQFIIPS

SEQ ID NO: 1042869 - protein, 9 aa, Homo Sapiens
EAERKIRQK

SEQ ID NO: 1042870 - protein, 9 aa, Homo Sapiens
QLQRFDRTL

SEQ ID NO: 1042871 - protein, 9 aa, Homo Sapiens
SASSIMILQ

SEQ ID NO: 1042872 - protein, 9 aa, Homo Sapiens
LFYFLGLRD

SEQ ID NO: 1042873 - protein, 9 aa, Homo Sapiens
ICVQDKIFR

SEQ ID NO: 1042874 - protein, 9 aa, Homo Sapiens
FIYVFSVME

SEQ ID NO: 1042875 - protein, 9 aa, Homo Sapiens
VKRGSKAST

SEQ ID NO: 1042876 - protein, 9 aa, Homo Sapiens
YILEVSSPT

SEQ ID NO: 1042877 - protein, 9 aa, Homo Sapiens
TPITEMEIF

SEQ ID NO: 1042878 - protein, 9 aa, Homo Sapiens
EKPRAIALS

SEQ ID NO: 1042879 - protein, 9 aa, Homo Sapiens
ASRGKASQR

SEQ ID NO: 1042880 - protein, 9 aa, Homo Sapiens
KKVFSTCSS

SEQ ID NO: 1042881 - protein, 9 aa, Homo Sapiens
AKSLEKFIE

SEQ ID NO: 1042882 - protein, 9 aa, Homo Sapiens
GKKGEMGDK

SEQ ID NO: 1042883 - protein, 9 aa, Homo Sapiens
YAASSGNLK

SEQ ID NO: 1042884 - protein, 9 aa, Homo Sapiens
VHTPPVPVF

SEQ ID NO: 1042885 - protein, 9 aa, Homo Sapiens
ALASDFIGL

SEQ ID NO: 1042886 - protein, 9 aa, Homo Sapiens
VEILDIFGF

SEQ ID NO: 1042887 - protein, 9 aa, Homo Sapiens
GLQQSSDRP

SEQ ID NO: 1042888 - protein, 9 aa, Homo Sapiens
LKKEMNFFQ

SEQ ID NO: 1042889 - protein, 9 aa, Homo Sapiens
KNCPERHVA

SEQ ID NO: 1042890 - protein, 9 aa, Homo Sapiens
FLKALYDAE

SEQ ID NO: 1042891 - protein, 9 aa, Homo Sapiens
FLTSDAPFL

SEQ ID NO: 1042892 - protein, 9 aa, Homo Sapiens
VQGPKGLVK

SEQ ID NO: 1042893 - protein, 9 aa, Homo Sapiens
KYFSGRPLV

SEQ ID NO: 1042894 - protein, 9 aa, Homo Sapiens
GKYNLATEK

SEQ ID NO: 1042895 - protein, 9 aa, Homo Sapiens
QGEPLIISD

SEQ ID NO: 1042896 - protein, 9 aa, Homo Sapiens
ISQAFYVQG

SEQ ID NO: 1042897 - protein, 9 aa, Homo Sapiens
SGGLAGAGL

SEQ ID NO: 1042898 - protein, 9 aa, Homo Sapiens
LQSHIILGL

SEQ ID NO: 1042899 - protein, 9 aa, Homo Sapiens
DRNTFQHSV

SEQ ID NO: 1042900 - protein, 9 aa, Homo Sapiens
FTESIPSSP

SEQ ID NO: 1042901 - protein, 9 aa, Homo Sapiens
MDNENATDI

SEQ ID NO: 1042902 - protein, 9 aa, Homo Sapiens
IKVQAALTI

SEQ ID NO: 1042903 - protein, 9 aa, Homo Sapiens
KLQEAGYFT

SEQ ID NO: 1042904 - protein, 9 aa, Homo Sapiens
PGAGRGGQR

SEQ ID NO: 1042905 - protein, 9 aa, Homo Sapiens
AGGTLQQQP

SEQ ID NO: 1042906 - protein, 9 aa, Homo Sapiens
VYSYRIIAQ

SEQ ID NO: 1042907 - protein, 9 aa, Homo Sapiens
SDVGVKLPL

SEQ ID NO: 1042908 - protein, 9 aa, Homo Sapiens
FNVNLTCQF

SEQ ID NO: 1042909 - protein, 9 aa, Homo Sapiens
SLESGILRL

SEQ ID NO: 1042910 - protein, 9 aa, Homo Sapiens
LVPRHSKYN

SEQ ID NO: 1042911 - protein, 9 aa, Homo Sapiens
PGSEQTLFM

SEQ ID NO: 1042912 - protein, 9 aa, Homo Sapiens
VKVTGLQNR

SEQ ID NO: 1042913 - protein, 9 aa, Homo Sapiens
SDTGFFDEK

SEQ ID NO: 1042914 - protein, 9 aa, Homo Sapiens
QAGLGKMMM

SEQ ID NO: 1042915 - protein, 9 aa, Homo Sapiens
PGPGEAPSQ

SEQ ID NO: 1042916 - protein, 9 aa, Homo Sapiens
DVTLENRSS

SEQ ID NO: 1042917 - protein, 9 aa, Homo Sapiens
MPDSQRRRV

SEQ ID NO: 1042918 - protein, 9 aa, Homo Sapiens
EEGSRGRAE

SEQ ID NO: 1042919 - protein, 9 aa, Homo Sapiens
KKIKTSEYS

SEQ ID NO: 1042920 - protein, 9 aa, Homo Sapiens
GLLQEIEAT

SEQ ID NO: 1042921 - protein, 9 aa, Homo Sapiens
TSDQDLNRA

SEQ ID NO: 1042922 - protein, 9 aa, Homo Sapiens
QASCEMQIV

SEQ ID NO: 1042923 - protein, 9 aa, Homo Sapiens
LYESRFSAE

SEQ ID NO: 1042924 - protein, 9 aa, Homo Sapiens
ADKCSRQYN

SEQ ID NO: 1042925 - protein, 9 aa, Homo Sapiens
SSPSQPAVA

SEQ ID NO: 1042926 - protein, 9 aa, Homo Sapiens
SLSQQTLRF

SEQ ID NO: 1042927 - protein, 9 aa, Homo Sapiens
DLTPLLFFQ

SEQ ID NO: 1042928 - protein, 9 aa, Homo Sapiens
FAMSPADKC

SEQ ID NO: 1042929 - protein, 9 aa, Homo Sapiens
EGLQASTKA

SEQ ID NO: 1042930 - protein, 9 aa, Homo Sapiens
YAGNTESQF

SEQ ID NO: 1042931 - protein, 9 aa, Homo Sapiens
SLEEATQPH

SEQ ID NO: 1042932 - protein, 9 aa, Homo Sapiens
KVKTSDQDL

SEQ ID NO: 1042933 - protein, 9 aa, Homo Sapiens
FFQATDPVN

SEQ ID NO: 1042934 - protein, 9 aa, Homo Sapiens
SLSNGIFDL

SEQ ID NO: 1042935 - protein, 9 aa, Homo Sapiens
SQKRYAAYF

SEQ ID NO: 1042936 - protein, 9 aa, Homo Sapiens
EEDLNRQWL

SEQ ID NO: 1042937 - protein, 9 aa, Homo Sapiens
CERNKINFF

SEQ ID NO: 1042938 - protein, 9 aa, Homo Sapiens
KNKDTVYEE

SEQ ID NO: 1042939 - protein, 9 aa, Homo Sapiens
PTLEATQQP

SEQ ID NO: 1042940 - protein, 9 aa, Homo Sapiens
KAKRPQYCS

SEQ ID NO: 1042941 - protein, 9 aa, Homo Sapiens
PLVSESDDG

SEQ ID NO: 1042942 - protein, 9 aa, Homo Sapiens
ELIFVSHPD

SEQ ID NO: 1042943 - protein, 9 aa, Homo Sapiens
SLMAKYHRK

SEQ ID NO: 1042944 - protein, 9 aa, Homo Sapiens
KISIPSVPT

SEQ ID NO: 1042945 - protein, 9 aa, Homo Sapiens
SNVGGGHFI

SEQ ID NO: 1042946 - protein, 9 aa, Homo Sapiens
AAGAAEADG

SEQ ID NO: 1042947 - protein, 9 aa, Homo Sapiens
GYPGVPPKG

SEQ ID NO: 1042948 - protein, 9 aa, Homo Sapiens
GLELREEAV

SEQ ID NO: 1042949 - protein, 9 aa, Homo Sapiens
SHRTVPMLL

SEQ ID NO: 1042950 - protein, 9 aa, Homo Sapiens
QFGSNTFLH

SEQ ID NO: 1042951 - protein, 9 aa, Homo Sapiens
QRMFSTPPS

SEQ ID NO: 1042952 - protein, 9 aa, Homo Sapiens
DVGVKLPLV

SEQ ID NO: 1042953 - protein, 9 aa, Homo Sapiens
YIKEGERPL

SEQ ID NO: 1042954 - protein, 9 aa, Homo Sapiens
GCTASKITL

SEQ ID NO: 1042955 - protein, 9 aa, Homo Sapiens
ENIGEHCLD

SEQ ID NO: 1042956 - protein, 9 aa, Homo Sapiens
RSGADKLEN

SEQ ID NO: 1042957 - protein, 9 aa, Homo Sapiens
KNNFKIQKS

SEQ ID NO: 1042958 - protein, 9 aa, Homo Sapiens
NPRRWGNPA

SEQ ID NO: 1042959 - protein, 9 aa, Homo Sapiens
EKIVIMDPV

SEQ ID NO: 1042960 - protein, 9 aa, Homo Sapiens
YFLQLEAIS

SEQ ID NO: 1042961 - protein, 9 aa, Homo Sapiens
KAQKDEFLH

SEQ ID NO: 1042962 - protein, 9 aa, Homo Sapiens
FQHSVVVPY

SEQ ID NO: 1042963 - protein, 9 aa, Homo Sapiens
RMAPEETSI

SEQ ID NO: 1042964 - protein, 9 aa, Homo Sapiens
LNLYNNHRN

SEQ ID NO: 1042965 - protein, 9 aa, Homo Sapiens
TLSMIAHLE

SEQ ID NO: 1042966 - protein, 9 aa, Homo Sapiens
EEWDKDVAQ

SEQ ID NO: 1042967 - protein, 9 aa, Homo Sapiens
SCEPGYNLR

SEQ ID NO: 1042968 - protein, 9 aa, Homo Sapiens
ELSFTEGEI

SEQ ID NO: 1042969 - protein, 9 aa, Homo Sapiens
DSAVNTATE

SEQ ID NO: 1042970 - protein, 9 aa, Homo Sapiens
GLPNARRVH

SEQ ID NO: 1042971 - protein, 9 aa, Homo Sapiens
VVSVIKQLA

SEQ ID NO: 1042972 - protein, 9 aa, Homo Sapiens
SECVADTQL

SEQ ID NO: 1042973 - protein, 9 aa, Homo Sapiens
KALKEEEKY

SEQ ID NO: 1042974 - protein, 9 aa, Homo Sapiens
LLAEPKPEI

SEQ ID NO: 1042975 - protein, 9 aa, Homo Sapiens
IKSSLQACN

SEQ ID NO: 1042976 - protein, 9 aa, Homo Sapiens
QKDDNDDES

SEQ ID NO: 1042977 - protein, 9 aa, Homo Sapiens
NHQTYSFNL

SEQ ID NO: 1042978 - protein, 9 aa, Homo Sapiens
TGTLTEKKS

SEQ ID NO: 1042979 - protein, 9 aa, Homo Sapiens
AGQTAELRC

SEQ ID NO: 1042980 - protein, 9 aa, Homo Sapiens
NLKMEVEWT

SEQ ID NO: 1042981 - protein, 9 aa, Homo Sapiens
DGEAGAQGL

SEQ ID NO: 1042982 - protein, 9 aa, Homo Sapiens
HRLHAQKGA

SEQ ID NO: 1042983 - protein, 9 aa, Homo Sapiens
LLNEDHTGT

SEQ ID NO: 1042984 - protein, 9 aa, Homo Sapiens
LTCAVFGLG

SEQ ID NO: 1042985 - protein, 9 aa, Homo Sapiens
IHIKVDLLF

SEQ ID NO: 1042986 - protein, 9 aa, Homo Sapiens
DFPKKLSIK

SEQ ID NO: 1042987 - protein, 9 aa, Homo Sapiens
FECKECGKD

SEQ ID NO: 1042988 - protein, 9 aa, Homo Sapiens
PGAEVQLQL

SEQ ID NO: 1042989 - protein, 9 aa, Homo Sapiens
VESSLVSTA

SEQ ID NO: 1042990 - protein, 9 aa, Homo Sapiens
YSKFIEADA

SEQ ID NO: 1042991 - protein, 9 aa, Homo Sapiens
DSSQGDNKL

SEQ ID NO: 1042992 - protein, 9 aa, Homo Sapiens
CVSPECLEG

SEQ ID NO: 1042993 - protein, 9 aa, Homo Sapiens
IKQLAQVHN

SEQ ID NO: 1042994 - protein, 9 aa, Homo Sapiens
TDLPKISIP

SEQ ID NO: 1042995 - protein, 9 aa, Homo Sapiens
AARSRPQQR

SEQ ID NO: 1042996 - protein, 9 aa, Homo Sapiens
LREESQNED

SEQ ID NO: 1042997 - protein, 9 aa, Homo Sapiens
GEVGSLLAR

SEQ ID NO: 1042998 - protein, 9 aa, Homo Sapiens
ADKILQKLK

SEQ ID NO: 1042999 - protein, 9 aa, Homo Sapiens
TFTTIYGRV

SEQ ID NO: 1043000 - protein, 9 aa, Homo Sapiens
VPVFDFRVT

SEQ ID NO: 1043001 - protein, 9 aa, Homo Sapiens
VLTVSASAE

SEQ ID NO: 1043002 - protein, 9 aa, Homo Sapiens
GPKVHKKCY

SEQ ID NO: 1043003 - protein, 9 aa, Homo Sapiens
YVQGVWQKV

SEQ ID NO: 1043004 - protein, 9 aa, Homo Sapiens
GPEAGDNAA

SEQ ID NO: 1043005 - protein, 9 aa, Homo Sapiens
RVDLYHENK

SEQ ID NO: 1043006 - protein, 9 aa, Homo Sapiens
SEAFYEIFQ

SEQ ID NO: 1043007 - protein, 9 aa, Homo Sapiens
PLCRDAPQG

SEQ ID NO: 1043008 - protein, 9 aa, Homo Sapiens
ATPLAPPDL

SEQ ID NO: 1043009 - protein, 9 aa, Homo Sapiens
PSPPGEHSG

SEQ ID NO: 1043010 - protein, 9 aa, Homo Sapiens
FTAFLALLL

SEQ ID NO: 1043011 - protein, 9 aa, Homo Sapiens
QQKDSLPVQ

SEQ ID NO: 1043012 - protein, 9 aa, Homo Sapiens
SNSHVFFSV

SEQ ID NO: 1043013 - protein, 9 aa, Homo Sapiens
ELYFDHSTG

SEQ ID NO: 1043014 - protein, 9 aa, Homo Sapiens
YLVNGIFLN

SEQ ID NO: 1043015 - protein, 9 aa, Homo Sapiens
SVTIKCPLS

SEQ ID NO: 1043016 - protein, 9 aa, Homo Sapiens
SEMRLYTVR

SEQ ID NO: 1043017 - protein, 9 aa, Homo Sapiens
PETTMPLSE

SEQ ID NO: 1043018 - protein, 9 aa, Homo Sapiens
RNGSITQIS

SEQ ID NO: 1043019 - protein, 9 aa, Homo Sapiens
SAIPNNSDL

SEQ ID NO: 1043020 - protein, 9 aa, Homo Sapiens
EQRVNTRQK

SEQ ID NO: 1043021 - protein, 9 aa, Homo Sapiens
WAAVTLQFQ

SEQ ID NO: 1043022 - protein, 9 aa, Homo Sapiens
FPDVYGFSD

SEQ ID NO: 1043023 - protein, 9 aa, Homo Sapiens
PLYKGCSGN

SEQ ID NO: 1043024 - protein, 9 aa, Homo Sapiens
EAPFCSVSI

SEQ ID NO: 1043025 - protein, 9 aa, Homo Sapiens
GQDYRLKSQ

SEQ ID NO: 1043026 - protein, 9 aa, Homo Sapiens
SGPRKKIED

SEQ ID NO: 1043027 - protein, 9 aa, Homo Sapiens
RSQEVGRVY

SEQ ID NO: 1043028 - protein, 9 aa, Homo Sapiens
GVKIELLEE

SEQ ID NO: 1043029 - protein, 9 aa, Homo Sapiens
QPGATTCTK

SEQ ID NO: 1043030 - protein, 9 aa, Homo Sapiens
LLPLFQYSC

SEQ ID NO: 1043031 - protein, 9 aa, Homo Sapiens
DNQLLDENE

SEQ ID NO: 1043032 - protein, 9 aa, Homo Sapiens
RGDKFFPKL

SEQ ID NO: 1043033 - protein, 9 aa, Homo Sapiens
KAGYKKPGI

SEQ ID NO: 1043034 - protein, 9 aa, Homo Sapiens
VESQEETAP

SEQ ID NO: 1043035 - protein, 9 aa, Homo Sapiens
SPGNWKKPS

SEQ ID NO: 1043036 - protein, 9 aa, Homo Sapiens
AARGLQRAA

SEQ ID NO: 1043037 - protein, 9 aa, Homo Sapiens
FYALILRAM

SEQ ID NO: 1043038 - protein, 9 aa, Homo Sapiens
LLAQRHGVV

SEQ ID NO: 1043039 - protein, 9 aa, Homo Sapiens
RRKGLPRPL

SEQ ID NO: 1043040 - protein, 9 aa, Homo Sapiens
GNCNPTQQE

SEQ ID NO: 1043041 - protein, 9 aa, Homo Sapiens
LARQLEKKE

SEQ ID NO: 1043042 - protein, 9 aa, Homo Sapiens
VCFEWKPAS

SEQ ID NO: 1043043 - protein, 9 aa, Homo Sapiens
ETRPVRAVF

SEQ ID NO: 1043044 - protein, 9 aa, Homo Sapiens
VEGSTTEVS

SEQ ID NO: 1043045 - protein, 9 aa, Homo Sapiens
RVFLGNSHV

SEQ ID NO: 1043046 - protein, 9 aa, Homo Sapiens
YLEAMKKDL

SEQ ID NO: 1043047 - protein, 9 aa, Homo Sapiens
TPILQLEKC

SEQ ID NO: 1043048 - protein, 9 aa, Homo Sapiens
EIELSGNRL

SEQ ID NO: 1043049 - protein, 9 aa, Homo Sapiens
RRVAHINEK

SEQ ID NO: 1043050 - protein, 9 aa, Homo Sapiens
TDTLQIKDF

SEQ ID NO: 1043051 - protein, 9 aa, Homo Sapiens
DSGGSSTPE

SEQ ID NO: 1043052 - protein, 9 aa, Homo Sapiens
GLEGTKSIS

SEQ ID NO: 1043053 - protein, 9 aa, Homo Sapiens
VRAELEKIT

SEQ ID NO: 1043054 - protein, 9 aa, Homo Sapiens
HINVYLKED

SEQ ID NO: 1043055 - protein, 9 aa, Homo Sapiens
GNTFKYSQG

SEQ ID NO: 1043056 - protein, 9 aa, Homo Sapiens
EQVQFSRTT

SEQ ID NO: 1043057 - protein, 9 aa, Homo Sapiens
GEGKKMHRA

SEQ ID NO: 1043058 - protein, 9 aa, Homo Sapiens
ERLTREGKT

SEQ ID NO: 1043059 - protein, 9 aa, Homo Sapiens
FWRGDELTQ

SEQ ID NO: 1043060 - protein, 9 aa, Homo Sapiens
GLQDGKDLF

SEQ ID NO: 1043061 - protein, 9 aa, Homo Sapiens
AVASSSKIP

SEQ ID NO: 1043062 - protein, 9 aa, Homo Sapiens
EQGCAEEKA

SEQ ID NO: 1043063 - protein, 9 aa, Homo Sapiens
VLKIPRTVP

SEQ ID NO: 1043064 - protein, 9 aa, Homo Sapiens
GLPLIKYFA

SEQ ID NO: 1043065 - protein, 9 aa, Homo Sapiens
GGGGYVQLL

SEQ ID NO: 1043066 - protein, 9 aa, Homo Sapiens
LHPVPEHLD

SEQ ID NO: 1043067 - protein, 9 aa, Homo Sapiens
CVKISFSPG

SEQ ID NO: 1043068 - protein, 9 aa, Homo Sapiens
QLLANQNNL

SEQ ID NO: 1043069 - protein, 9 aa, Homo Sapiens
EANSEVLYP

SEQ ID NO: 1043070 - protein, 9 aa, Homo Sapiens
IVFSTNKEF

SEQ ID NO: 1043071 - protein, 9 aa, Homo Sapiens
EKKKTPESS

SEQ ID NO: 1043072 - protein, 9 aa, Homo Sapiens
FTVIQLVEM

SEQ ID NO: 1043073 - protein, 9 aa, Homo Sapiens
QLSYRAKKF

SEQ ID NO: 1043074 - protein, 9 aa, Homo Sapiens
DEVFANFFN

SEQ ID NO: 1043075 - protein, 9 aa, Homo Sapiens
SKITLDGIT

SEQ ID NO: 1043076 - protein, 9 aa, Homo Sapiens
GFAKSVFFS

SEQ ID NO: 1043077 - protein, 9 aa, Homo Sapiens
NEGEWDVEK

SEQ ID NO: 1043078 - protein, 9 aa, Homo Sapiens
RARQRRGFP

SEQ ID NO: 1043079 - protein, 9 aa, Homo Sapiens
SNRNLVTKS

SEQ ID NO: 1043080 - protein, 9 aa, Homo Sapiens
SFEKPLEEH

SEQ ID NO: 1043081 - protein, 9 aa, Homo Sapiens
NNYKIIKLL

SEQ ID NO: 1043082 - protein, 9 aa, Homo Sapiens
CKTNVINYY

SEQ ID NO: 1043083 - protein, 9 aa, Homo Sapiens
QEKISISGC

SEQ ID NO: 1043084 - protein, 9 aa, Homo Sapiens
QRRRVAEEL

SEQ ID NO: 1043085 - protein, 9 aa, Homo Sapiens
YSRNNVFSV

SEQ ID NO: 1043086 - protein, 9 aa, Homo Sapiens
ESLDKEEKL

SEQ ID NO: 1043087 - protein, 9 aa, Homo Sapiens
PLAPPDLQP

SEQ ID NO: 1043088 - protein, 9 aa, Homo Sapiens
PRHRNKNTM

SEQ ID NO: 1043089 - protein, 9 aa, Homo Sapiens
IEPQNENGT

SEQ ID NO: 1043090 - protein, 9 aa, Homo Sapiens
GESMLCVVS

SEQ ID NO: 1043091 - protein, 9 aa, Homo Sapiens
ENVLELHCE

SEQ ID NO: 1043092 - protein, 9 aa, Homo Sapiens
GNCKNCAQF

SEQ ID NO: 1043093 - protein, 9 aa, Homo Sapiens
MEIFGCFAP

SEQ ID NO: 1043094 - protein, 9 aa, Homo Sapiens
VSAAPARRR

SEQ ID NO: 1043095 - protein, 9 aa, Homo Sapiens
PTVNFIVSS

SEQ ID NO: 1043096 - protein, 9 aa, Homo Sapiens
GCMTQLFTK

SEQ ID NO: 1043097 - protein, 9 aa, Homo Sapiens
DVITWVEIL

SEQ ID NO: 1043098 - protein, 9 aa, Homo Sapiens
AEQTLSRPP

SEQ ID NO: 1043099 - protein, 9 aa, Homo Sapiens
PAGAGEGAA

SEQ ID NO: 1043100 - protein, 9 aa, Homo Sapiens
LEGPASSFT

SEQ ID NO: 1043101 - protein, 9 aa, Homo Sapiens
SRSSENVST

SEQ ID NO: 1043102 - protein, 9 aa, Homo Sapiens
LALTFSSAV

SEQ ID NO: 1043103 - protein, 9 aa, Homo Sapiens
EIIAAKIHR

SEQ ID NO: 1043104 - protein, 9 aa, Homo Sapiens
KKGKEKQQE

SEQ ID NO: 1043105 - protein, 9 aa, Homo Sapiens
RGPETEPRT

SEQ ID NO: 1043106 - protein, 9 aa, Homo Sapiens
EVLKILKLR

SEQ ID NO: 1043107 - protein, 9 aa, Homo Sapiens
MMQENKKCT

SEQ ID NO: 1043108 - protein, 9 aa, Homo Sapiens
KEELVARLE

SEQ ID NO: 1043109 - protein, 9 aa, Homo Sapiens
DIVELWDDM

SEQ ID NO: 1043110 - protein, 9 aa, Homo Sapiens
DAFLGEIMK

SEQ ID NO: 1043111 - protein, 9 aa, Homo Sapiens
IQHCEDGSL

SEQ ID NO: 1043112 - protein, 9 aa, Homo Sapiens
EPKIWVSYG

SEQ ID NO: 1043113 - protein, 9 aa, Homo Sapiens
YVMVTSTFS

SEQ ID NO: 1043114 - protein, 9 aa, Homo Sapiens
PSSLRKWYS

SEQ ID NO: 1043115 - protein, 9 aa, Homo Sapiens
PLCGQPTPC

SEQ ID NO: 1043116 - protein, 9 aa, Homo Sapiens
AYLVDNKLY

SEQ ID NO: 1043117 - protein, 9 aa, Homo Sapiens
IVVSVLNNM

SEQ ID NO: 1043118 - protein, 9 aa, Homo Sapiens
GGKDDIVEL

SEQ ID NO: 1043119 - protein, 9 aa, Homo Sapiens
MGERYLGIL

SEQ ID NO: 1043120 - protein, 9 aa, Homo Sapiens
VNSQFSTGH

SEQ ID NO: 1043121 - protein, 9 aa, Homo Sapiens
PGSRCSPEK

SEQ ID NO: 1043122 - protein, 9 aa, Homo Sapiens
EKDQRKLKD

SEQ ID NO: 1043123 - protein, 9 aa, Homo Sapiens
DLQPPAEDE

SEQ ID NO: 1043124 - protein, 9 aa, Homo Sapiens
KKLLNALEK

SEQ ID NO: 1043125 - protein, 9 aa, Homo Sapiens
ESVAFSGWF

SEQ ID NO: 1043126 - protein, 9 aa, Homo Sapiens
DKEQFECQE

SEQ ID NO: 1043127 - protein, 9 aa, Homo Sapiens
KTCNSETQS

SEQ ID NO: 1043128 - protein, 9 aa, Homo Sapiens
AEKSNAGVL

SEQ ID NO: 1043129 - protein, 9 aa, Homo Sapiens
HIKKTEKAI

SEQ ID NO: 1043130 - protein, 9 aa, Homo Sapiens
APTDPMLRR

SEQ ID NO: 1043131 - protein, 9 aa, Homo Sapiens
PLNPKTNRE

SEQ ID NO: 1043132 - protein, 9 aa, Homo Sapiens
RMFSTPPSL

SEQ ID NO: 1043133 - protein, 9 aa, Homo Sapiens
EWPGKDSKH

SEQ ID NO: 1043134 - protein, 9 aa, Homo Sapiens
ANAPDPLHE

SEQ ID NO: 1043135 - protein, 9 aa, Homo Sapiens
KFQNWDCNV

SEQ ID NO: 1043136 - protein, 9 aa, Homo Sapiens
EVPKQRNGS

SEQ ID NO: 1043137 - protein, 9 aa, Homo Sapiens
LFSRAASCL

SEQ ID NO: 1043138 - protein, 9 aa, Homo Sapiens
STPPSLEQH

SEQ ID NO: 1043139 - protein, 9 aa, Homo Sapiens
LKEREDPPI

SEQ ID NO: 1043140 - protein, 9 aa, Homo Sapiens
PSFCRTPAW

SEQ ID NO: 1043141 - protein, 9 aa, Homo Sapiens
LRLLVQTPP

SEQ ID NO: 1043142 - protein, 9 aa, Homo Sapiens
GFSYDENTE

SEQ ID NO: 1043143 - protein, 9 aa, Homo Sapiens
GPMTPAFAG

SEQ ID NO: 1043144 - protein, 9 aa, Homo Sapiens
DTLPQKKTT

SEQ ID NO: 1043145 - protein, 9 aa, Homo Sapiens
GTAMAGFLF

SEQ ID NO: 1043146 - protein, 9 aa, Homo Sapiens
KLTVSRFLM

SEQ ID NO: 1043147 - protein, 9 aa, Homo Sapiens
FSTCAFHLT

SEQ ID NO: 1043148 - protein, 9 aa, Homo Sapiens
LQRRQKLRR

SEQ ID NO: 1043149 - protein, 9 aa, Homo Sapiens
AGAGEGAAD

SEQ ID NO: 1043150 - protein, 9 aa, Homo Sapiens
RRNHIDRVL

SEQ ID NO: 1043151 - protein, 9 aa, Homo Sapiens
SLFCELREG

SEQ ID NO: 1043152 - protein, 9 aa, Homo Sapiens
GPPPPEKPQ

SEQ ID NO: 1043153 - protein, 9 aa, Homo Sapiens
FSAGPLAVA

SEQ ID NO: 1043154 - protein, 9 aa, Homo Sapiens
LSPQVRPFG

SEQ ID NO: 1043155 - protein, 9 aa, Homo Sapiens
PLLKLQDIM

SEQ ID NO: 1043156 - protein, 9 aa, Homo Sapiens
NICGEKKVP

SEQ ID NO: 1043157 - protein, 9 aa, Homo Sapiens
TFSGTGILK

SEQ ID NO: 1043158 - protein, 9 aa, Homo Sapiens
SETELSGQA

SEQ ID NO: 1043159 - protein, 9 aa, Homo Sapiens
HFTILDASG

SEQ ID NO: 1043160 - protein, 9 aa, Homo Sapiens
FSNGSLVGG

SEQ ID NO: 1043161 - protein, 9 aa, Homo Sapiens
CLQSRNLKC

SEQ ID NO: 1043162 - protein, 9 aa, Homo Sapiens
VALEQNIEF

SEQ ID NO: 1043163 - protein, 9 aa, Homo Sapiens
TLIVPPDRV

SEQ ID NO: 1043164 - protein, 9 aa, Homo Sapiens
RTVPVLKMD

SEQ ID NO: 1043165 - protein, 9 aa, Homo Sapiens
LGRAVQTLQ

SEQ ID NO: 1043166 - protein, 9 aa, Homo Sapiens
VQYTPKVLE

SEQ ID NO: 1043167 - protein, 9 aa, Homo Sapiens
IIVEECQRQ

SEQ ID NO: 1043168 - protein, 9 aa, Homo Sapiens
NNSDLTLYL

SEQ ID NO: 1043169 - protein, 9 aa, Homo Sapiens
PSSWDYRWD

SEQ ID NO: 1043170 - protein, 9 aa, Homo Sapiens
PKGLVKPVD

SEQ ID NO: 1043171 - protein, 9 aa, Homo Sapiens
VVDLKLHVT

SEQ ID NO: 1043172 - protein, 9 aa, Homo Sapiens
TEVMIKGSG

SEQ ID NO: 1043173 - protein, 9 aa, Homo Sapiens
LPALGTSQL

SEQ ID NO: 1043174 - protein, 9 aa, Homo Sapiens
CAAFYLIVA

SEQ ID NO: 1043175 - protein, 9 aa, Homo Sapiens
CNPGIYLCS

SEQ ID NO: 1043176 - protein, 9 aa, Homo Sapiens
NFFQQQPPP

SEQ ID NO: 1043177 - protein, 9 aa, Homo Sapiens
NEELHICLM

SEQ ID NO: 1043178 - protein, 9 aa, Homo Sapiens
PVSVKGKKA

SEQ ID NO: 1043179 - protein, 9 aa, Homo Sapiens
SSNQDGGKS

SEQ ID NO: 1043180 - protein, 9 aa, Homo Sapiens
QRDPKIYTD

SEQ ID NO: 1043181 - protein, 9 aa, Homo Sapiens
SENAYNIRL

SEQ ID NO: 1043182 - protein, 9 aa, Homo Sapiens
EEVEEESLM

SEQ ID NO: 1043183 - protein, 9 aa, Homo Sapiens
FAAAARTRL

SEQ ID NO: 1043184 - protein, 9 aa, Homo Sapiens
VIYTEKETR

SEQ ID NO: 1043185 - protein, 9 aa, Homo Sapiens
NNSPGNWKK

SEQ ID NO: 1043186 - protein, 9 aa, Homo Sapiens
YTLLYRNIN

SEQ ID NO: 1043187 - protein, 9 aa, Homo Sapiens
ASHFHTFWS

SEQ ID NO: 1043188 - protein, 9 aa, Homo Sapiens
RQKQILVNL

SEQ ID NO: 1043189 - protein, 9 aa, Homo Sapiens
PENFFVNCS

SEQ ID NO: 1043190 - protein, 9 aa, Homo Sapiens
ALAAAKPGT

SEQ ID NO: 1043191 - protein, 9 aa, Homo Sapiens
VVEANDNPP

SEQ ID NO: 1043192 - protein, 9 aa, Homo Sapiens
PIDSLLKNC

SEQ ID NO: 1043193 - protein, 9 aa, Homo Sapiens
GQGLVLLRD

SEQ ID NO: 1043194 - protein, 9 aa, Homo Sapiens
SCSCLDGFT

SEQ ID NO: 1043195 - protein, 9 aa, Homo Sapiens
RAAGKTYII

SEQ ID NO: 1043196 - protein, 9 aa, Homo Sapiens
ARNGQSRTI

SEQ ID NO: 1043197 - protein, 9 aa, Homo Sapiens
NTLWIKFVS

SEQ ID NO: 1043198 - protein, 9 aa, Homo Sapiens
TMKNQQNSS

SEQ ID NO: 1043199 - protein, 9 aa, Homo Sapiens
ETLWEKPRA

SEQ ID NO: 1043200 - protein, 9 aa, Homo Sapiens
NKLYLSIVP

SEQ ID NO: 1043201 - protein, 9 aa, Homo Sapiens
PPILFPRFP

SEQ ID NO: 1043202 - protein, 9 aa, Homo Sapiens
DSQQALKEL

SEQ ID NO: 1043203 - protein, 9 aa, Homo Sapiens
PCRWPLPQH

SEQ ID NO: 1043204 - protein, 9 aa, Homo Sapiens
EGELMLGGT

SEQ ID NO: 1043205 - protein, 9 aa, Homo Sapiens
MILKMQESI

SEQ ID NO: 1043206 - protein, 9 aa, Homo Sapiens
NSHSPLIRV

SEQ ID NO: 1043207 - protein, 9 aa, Homo Sapiens
IKPVLCLQR

SEQ ID NO: 1043208 - protein, 9 aa, Homo Sapiens
IPLLESELL

SEQ ID NO: 1043209 - protein, 9 aa, Homo Sapiens
QQPMLVSVS

SEQ ID NO: 1043210 - protein, 9 aa, Homo Sapiens
YLIFSNPVC

SEQ ID NO: 1043211 - protein, 9 aa, Homo Sapiens
AVIAPSLFG

SEQ ID NO: 1043212 - protein, 9 aa, Homo Sapiens
AQIQKPPSN

SEQ ID NO: 1043213 - protein, 9 aa, Homo Sapiens
SRDRRRRKL

SEQ ID NO: 1043214 - protein, 9 aa, Homo Sapiens
TEGDKKPDY

SEQ ID NO: 1043215 - protein, 9 aa, Homo Sapiens
AFQGRSYKT

SEQ ID NO: 1043216 - protein, 9 aa, Homo Sapiens
LVTRLMKVE

SEQ ID NO: 1043217 - protein, 9 aa, Homo Sapiens
DKKFRISGH

SEQ ID NO: 1043218 - protein, 9 aa, Homo Sapiens
TNKSGSLFR

SEQ ID NO: 1043219 - protein, 9 aa, Homo Sapiens
ECPALPIIH

SEQ ID NO: 1043220 - protein, 9 aa, Homo Sapiens
QENREHNSD

SEQ ID NO: 1043221 - protein, 9 aa, Homo Sapiens
GLSVCGHGG

SEQ ID NO: 1043222 - protein, 9 aa, Homo Sapiens
LQKPMSLLS

SEQ ID NO: 1043223 - protein, 9 aa, Homo Sapiens
LGKQADNRH

SEQ ID NO: 1043224 - protein, 9 aa, Homo Sapiens
LSQFPETFL

SEQ ID NO: 1043225 - protein, 9 aa, Homo Sapiens
NQENKILKQ

SEQ ID NO: 1043226 - protein, 9 aa, Homo Sapiens
ETPGVPGSP

SEQ ID NO: 1043227 - protein, 9 aa, Homo Sapiens
LTRRASVCA

SEQ ID NO: 1043228 - protein, 9 aa, Homo Sapiens
HLLNVKATG

SEQ ID NO: 1043229 - protein, 9 aa, Homo Sapiens
VENVLELHC

SEQ ID NO: 1043230 - protein, 9 aa, Homo Sapiens
AGARLPYYS

SEQ ID NO: 1043231 - protein, 9 aa, Homo Sapiens
NMVDCSKLL

SEQ ID NO: 1043232 - protein, 9 aa, Homo Sapiens
QGQRSSRAL

SEQ ID NO: 1043233 - protein, 9 aa, Homo Sapiens
ARAPSALCT

SEQ ID NO: 1043234 - protein, 9 aa, Homo Sapiens
TAGQESSII

SEQ ID NO: 1043235 - protein, 9 aa, Homo Sapiens
NCPSDDNST

SEQ ID NO: 1043236 - protein, 9 aa, Homo Sapiens
ISYLNLEDI

SEQ ID NO: 1043237 - protein, 9 aa, Homo Sapiens
KAQDTLARK

SEQ ID NO: 1043238 - protein, 9 aa, Homo Sapiens
KDQEYCVCK

SEQ ID NO: 1043239 - protein, 9 aa, Homo Sapiens
FTEGEIIIL

SEQ ID NO: 1043240 - protein, 9 aa, Homo Sapiens
MKNQQNSSL

SEQ ID NO: 1043241 - protein, 9 aa, Homo Sapiens
LQAAVVFVE

SEQ ID NO: 1043242 - protein, 9 aa, Homo Sapiens
DNLYERVLH

SEQ ID NO: 1043243 - protein, 9 aa, Homo Sapiens
KILKGLDYL

SEQ ID NO: 1043244 - protein, 9 aa, Homo Sapiens
ARFGSSIAL

SEQ ID NO: 1043245 - protein, 9 aa, Homo Sapiens
LQQNFDVFA

SEQ ID NO: 1043246 - protein, 9 aa, Homo Sapiens
LKNGYNQNY

SEQ ID NO: 1043247 - protein, 9 aa, Homo Sapiens
PDSQRRRVA

SEQ ID NO: 1043248 - protein, 9 aa, Homo Sapiens
TLGTFLIAV

SEQ ID NO: 1043249 - protein, 9 aa, Homo Sapiens
DDGVPPLGS

SEQ ID NO: 1043250 - protein, 9 aa, Homo Sapiens
LKEGGLYTC

SEQ ID NO: 1043251 - protein, 9 aa, Homo Sapiens
KEEGFAEET

SEQ ID NO: 1043252 - protein, 9 aa, Homo Sapiens
HGKSHPRKR

SEQ ID NO: 1043253 - protein, 9 aa, Homo Sapiens
TMAGCRDPS

SEQ ID NO: 1043254 - protein, 9 aa, Homo Sapiens
LFLTSDAPF

SEQ ID NO: 1043255 - protein, 9 aa, Homo Sapiens
HTRVPTESW

SEQ ID NO: 1043256 - protein, 9 aa, Homo Sapiens
QVVVQASCE

SEQ ID NO: 1043257 - protein, 9 aa, Homo Sapiens
DNEKALKIH

SEQ ID NO: 1043258 - protein, 9 aa, Homo Sapiens
SLVGLEGTK

SEQ ID NO: 1043259 - protein, 9 aa, Homo Sapiens
VQSSAKKVT

SEQ ID NO: 1043260 - protein, 9 aa, Homo Sapiens
LGRDLPQEC

SEQ ID NO: 1043261 - protein, 9 aa, Homo Sapiens
VSSFSSRKM

SEQ ID NO: 1043262 - protein, 9 aa, Homo Sapiens
NFSSAEKAI

SEQ ID NO: 1043263 - protein, 9 aa, Homo Sapiens
HTTSRSGHC

SEQ ID NO: 1043264 - protein, 9 aa, Homo Sapiens
LPQEHVYDR

SEQ ID NO: 1043265 - protein, 9 aa, Homo Sapiens
IILRCQPSC

SEQ ID NO: 1043266 - protein, 9 aa, Homo Sapiens
TSQTSAPWD

SEQ ID NO: 1043267 - protein, 9 aa, Homo Sapiens
ECMENNCPS

SEQ ID NO: 1043268 - protein, 9 aa, Homo Sapiens
TFIPKCYVN

SEQ ID NO: 1043269 - protein, 9 aa, Homo Sapiens
ETPMHKNPE

SEQ ID NO: 1043270 - protein, 9 aa, Homo Sapiens
TGAFDLVCA

SEQ ID NO: 1043271 - protein, 9 aa, Homo Sapiens
MDLHTTYKK

SEQ ID NO: 1043272 - protein, 9 aa, Homo Sapiens
LMSPDSPDS

SEQ ID NO: 1043273 - protein, 9 aa, Homo Sapiens
PLSGCLDSD

SEQ ID NO: 1043274 - protein, 9 aa, Homo Sapiens
KTRGFHLRP

SEQ ID NO: 1043275 - protein, 9 aa, Homo Sapiens
FRARQRRGF

SEQ ID NO: 1043276 - protein, 9 aa, Homo Sapiens
DNKLQKLGP

SEQ ID NO: 1043277 - protein, 9 aa, Homo Sapiens
ILYQDKNLV

SEQ ID NO: 1043278 - protein, 9 aa, Homo Sapiens
CKNIFFKAF

SEQ ID NO: 1043279 - protein, 9 aa, Homo Sapiens
FSDFLKSHI

SEQ ID NO: 1043280 - protein, 9 aa, Homo Sapiens
ISLEKKKEK

SEQ ID NO: 1043281 - protein, 9 aa, Homo Sapiens
YRGEVWGKS

SEQ ID NO: 1043282 - protein, 9 aa, Homo Sapiens
ARPPKPRSR

SEQ ID NO: 1043283 - protein, 9 aa, Homo Sapiens
DNLSIHYKQ

SEQ ID NO: 1043284 - protein, 9 aa, Homo Sapiens
RPEILTDKS

SEQ ID NO: 1043285 - protein, 9 aa, Homo Sapiens
KLLRKMGWK

SEQ ID NO: 1043286 - protein, 9 aa, Homo Sapiens
GILYQDKNL

SEQ ID NO: 1043287 - protein, 9 aa, Homo Sapiens
LVMRKISSS

SEQ ID NO: 1043288 - protein, 9 aa, Homo Sapiens
WPRSTARTV

SEQ ID NO: 1043289 - protein, 9 aa, Homo Sapiens
LSAFETETS

SEQ ID NO: 1043290 - protein, 9 aa, Homo Sapiens
SLDKEEKLE

SEQ ID NO: 1043291 - protein, 9 aa, Homo Sapiens
ADKEFPLVS

SEQ ID NO: 1043292 - protein, 9 aa, Homo Sapiens
WSMSFFFFG

SEQ ID NO: 1043293 - protein, 9 aa, Homo Sapiens
TLENRSSPS

SEQ ID NO: 1043294 - protein, 9 aa, Homo Sapiens
DFQCKKTGR

SEQ ID NO: 1043295 - protein, 9 aa, Homo Sapiens
ELLEECIIF

SEQ ID NO: 1043296 - protein, 9 aa, Homo Sapiens
FDSLMPSPF

SEQ ID NO: 1043297 - protein, 9 aa, Homo Sapiens
QKMAKPEKA

SEQ ID NO: 1043298 - protein, 9 aa, Homo Sapiens
KLEALFAKT

SEQ ID NO: 1043299 - protein, 9 aa, Homo Sapiens
KDLVTRLMK

SEQ ID NO: 1043300 - protein, 9 aa, Homo Sapiens
DLETAIHHV

SEQ ID NO: 1043301 - protein, 9 aa, Homo Sapiens
PKAPFLGIS

SEQ ID NO: 1043302 - protein, 9 aa, Homo Sapiens
GQCLGEEDE

SEQ ID NO: 1043303 - protein, 9 aa, Homo Sapiens
VVPKIPEPE

SEQ ID NO: 1043304 - protein, 9 aa, Homo Sapiens
RIWMLNDIL

SEQ ID NO: 1043305 - protein, 9 aa, Homo Sapiens
ACCLAKLLC

SEQ ID NO: 1043306 - protein, 9 aa, Homo Sapiens
SGDMVQLLS

SEQ ID NO: 1043307 - protein, 9 aa, Homo Sapiens
LHLSQQKDS

SEQ ID NO: 1043308 - protein, 9 aa, Homo Sapiens
RLPCHWVRS

SEQ ID NO: 1043309 - protein, 9 aa, Homo Sapiens
PTGVLSLLL

SEQ ID NO: 1043310 - protein, 9 aa, Homo Sapiens
SLELLNTGR

SEQ ID NO: 1043311 - protein, 9 aa, Homo Sapiens
STPEAPENF

SEQ ID NO: 1043312 - protein, 9 aa, Homo Sapiens
EVAPTDPML

SEQ ID NO: 1043313 - protein, 9 aa, Homo Sapiens
VNFIVSSND

SEQ ID NO: 1043314 - protein, 9 aa, Homo Sapiens
CKQLECPFS

SEQ ID NO: 1043315 - protein, 9 aa, Homo Sapiens
SRRHFWTIL

SEQ ID NO: 1043316 - protein, 9 aa, Homo Sapiens
QNIEFIRDS

SEQ ID NO: 1043317 - protein, 9 aa, Homo Sapiens
SAISNELRD

SEQ ID NO: 1043318 - protein, 9 aa, Homo Sapiens
YFNALFQLI

SEQ ID NO: 1043319 - protein, 9 aa, Homo Sapiens
SELLFTAGT

SEQ ID NO: 1043320 - protein, 9 aa, Homo Sapiens
KKGGDVTLT

SEQ ID NO: 1043321 - protein, 9 aa, Homo Sapiens
SSPEKQLGI

SEQ ID NO: 1043322 - protein, 9 aa, Homo Sapiens
KMKVLKNQM

SEQ ID NO: 1043323 - protein, 9 aa, Homo Sapiens
ASELEQERR

SEQ ID NO: 1043324 - protein, 9 aa, Homo Sapiens
DALEAVTEE

SEQ ID NO: 1043325 - protein, 9 aa, Homo Sapiens
ATTIAVLLR

SEQ ID NO: 1043326 - protein, 9 aa, Homo Sapiens
FTLQQPYDQ

SEQ ID NO: 1043327 - protein, 9 aa, Homo Sapiens
TYETQWPSR

SEQ ID NO: 1043328 - protein, 9 aa, Homo Sapiens
SETQSRHRQ

SEQ ID NO: 1043329 - protein, 9 aa, Homo Sapiens
SMSKDNMSS

SEQ ID NO: 1043330 - protein, 9 aa, Homo Sapiens
GSFNLSSNK

SEQ ID NO: 1043331 - protein, 9 aa, Homo Sapiens
VSALEESSK

SEQ ID NO: 1043332 - protein, 9 aa, Homo Sapiens
PLTQESYRA

SEQ ID NO: 1043333 - protein, 9 aa, Homo Sapiens
PPLCRDAPQ

SEQ ID NO: 1043334 - protein, 9 aa, Homo Sapiens
LGLMFDNVV

SEQ ID NO: 1043335 - protein, 9 aa, Homo Sapiens
KSHDQAPEL

SEQ ID NO: 1043336 - protein, 9 aa, Homo Sapiens
VSTTVARGG

SEQ ID NO: 1043337 - protein, 9 aa, Homo Sapiens
RVHSGERLF

SEQ ID NO: 1043338 - protein, 9 aa, Homo Sapiens
IPKLRRRGL

SEQ ID NO: 1043339 - protein, 9 aa, Homo Sapiens
CNIKNSRCE

SEQ ID NO: 1043340 - protein, 9 aa, Homo Sapiens
GFSCSCLDG

SEQ ID NO: 1043341 - protein, 9 aa, Homo Sapiens
HVPFPCDET

SEQ ID NO: 1043342 - protein, 9 aa, Homo Sapiens
EQGGVPPRD

SEQ ID NO: 1043343 - protein, 9 aa, Homo Sapiens
EKHTLLYGH

SEQ ID NO: 1043344 - protein, 9 aa, Homo Sapiens
RNKKFKSAL

SEQ ID NO: 1043345 - protein, 9 aa, Homo Sapiens
KDDLKEIPA

SEQ ID NO: 1043346 - protein, 9 aa, Homo Sapiens
VHTEENPYK

SEQ ID NO: 1043347 - protein, 9 aa, Homo Sapiens
HLSSNQDGG

SEQ ID NO: 1043348 - protein, 9 aa, Homo Sapiens
QILRILKLA

SEQ ID NO: 1043349 - protein, 9 aa, Homo Sapiens
MLFCLRLSS

SEQ ID NO: 1043350 - protein, 9 aa, Homo Sapiens
ISFFLWSRM

SEQ ID NO: 1043351 - protein, 9 aa, Homo Sapiens
WKDKRLKFK

SEQ ID NO: 1043352 - protein, 9 aa, Homo Sapiens
ECTIKNSLL

SEQ ID NO: 1043353 - protein, 9 aa, Homo Sapiens
SKGLGQPLG

SEQ ID NO: 1043354 - protein, 9 aa, Homo Sapiens
TCHHRVHTE

SEQ ID NO: 1043355 - protein, 9 aa, Homo Sapiens
VKTPTEKVK

SEQ ID NO: 1043356 - protein, 9 aa, Homo Sapiens
NAPFLSFLP

SEQ ID NO: 1043357 - protein, 9 aa, Homo Sapiens
DENETTCTF

SEQ ID NO: 1043358 - protein, 9 aa, Homo Sapiens
EDEASGLKE

SEQ ID NO: 1043359 - protein, 9 aa, Homo Sapiens
VHRVGYILH

SEQ ID NO: 1043360 - protein, 9 aa, Homo Sapiens
KSLEKFIED

SEQ ID NO: 1043361 - protein, 9 aa, Homo Sapiens
WYMEYSHQM

SEQ ID NO: 1043362 - protein, 9 aa, Homo Sapiens
WVEILLSLV

SEQ ID NO: 1043363 - protein, 9 aa, Homo Sapiens
VPSQDNTRV

SEQ ID NO: 1043364 - protein, 9 aa, Homo Sapiens
LKWISPPKP

SEQ ID NO: 1043365 - protein, 9 aa, Homo Sapiens
MLVHAICTK

SEQ ID NO: 1043366 - protein, 9 aa, Homo Sapiens
GTLVQATNM

SEQ ID NO: 1043367 - protein, 9 aa, Homo Sapiens
ETELSGQAS

SEQ ID NO: 1043368 - protein, 9 aa, Homo Sapiens
GSGTQQRKV

SEQ ID NO: 1043369 - protein, 9 aa, Homo Sapiens
AKGKPAVAM

SEQ ID NO: 1043370 - protein, 9 aa, Homo Sapiens
KSNIDFLIE

SEQ ID NO: 1043371 - protein, 9 aa, Homo Sapiens
PLVDCFIQL

SEQ ID NO: 1043372 - protein, 9 aa, Homo Sapiens
NETATTIAV

SEQ ID NO: 1043373 - protein, 9 aa, Homo Sapiens
SPLAGEKLV

SEQ ID NO: 1043374 - protein, 9 aa, Homo Sapiens
AVYGFKLQN

SEQ ID NO: 1043375 - protein, 9 aa, Homo Sapiens
SQYFLSNNY

SEQ ID NO: 1043376 - protein, 9 aa, Homo Sapiens
TTMFILTPL

SEQ ID NO: 1043377 - protein, 9 aa, Homo Sapiens
APVASRQKP

SEQ ID NO: 1043378 - protein, 9 aa, Homo Sapiens
QNSGDPPLV

SEQ ID NO: 1043379 - protein, 9 aa, Homo Sapiens
CKNQIKIRN

SEQ ID NO: 1043380 - protein, 9 aa, Homo Sapiens
QGVWQKVSA

SEQ ID NO: 1043381 - protein, 9 aa, Homo Sapiens
EKTRSSRRR

SEQ ID NO: 1043382 - protein, 9 aa, Homo Sapiens
NFLLVAAPF

SEQ ID NO: 1043383 - protein, 9 aa, Homo Sapiens
WLTPISSRP

SEQ ID NO: 1043384 - protein, 9 aa, Homo Sapiens
EELPALLKT

SEQ ID NO: 1043385 - protein, 9 aa, Homo Sapiens
GLADVPGQP

SEQ ID NO: 1043386 - protein, 9 aa, Homo Sapiens
EPFFWQYPE

SEQ ID NO: 1043387 - protein, 9 aa, Homo Sapiens
VPQEKLPLV

SEQ ID NO: 1043388 - protein, 9 aa, Homo Sapiens
WSPASFSFM

SEQ ID NO: 1043389 - protein, 9 aa, Homo Sapiens
VFNFQRENE

SEQ ID NO: 1043390 - protein, 9 aa, Homo Sapiens
DSQRRRVAE

SEQ ID NO: 1043391 - protein, 9 aa, Homo Sapiens
APSAVSPPS

SEQ ID NO: 1043392 - protein, 9 aa, Homo Sapiens
GFLGPPHQG

SEQ ID NO: 1043393 - protein, 9 aa, Homo Sapiens
NNEVDDMHT

SEQ ID NO: 1043394 - protein, 9 aa, Homo Sapiens
QCSQLVGRQ

SEQ ID NO: 1043395 - protein, 9 aa, Homo Sapiens
SNPYVKFRL

SEQ ID NO: 1043396 - protein, 9 aa, Homo Sapiens
PFQVEKNQC

SEQ ID NO: 1043397 - protein, 9 aa, Homo Sapiens
TFYDSSSPT

SEQ ID NO: 1043398 - protein, 9 aa, Homo Sapiens
KWTDKEKAG

SEQ ID NO: 1043399 - protein, 9 aa, Homo Sapiens
VSCVAISIE

SEQ ID NO: 1043400 - protein, 9 aa, Homo Sapiens
TYNTKILIF

SEQ ID NO: 1043401 - protein, 9 aa, Homo Sapiens
PSGGTRSSV

SEQ ID NO: 1043402 - protein, 9 aa, Homo Sapiens
VFKSAVRDS

SEQ ID NO: 1043403 - protein, 9 aa, Homo Sapiens
AAHTNNYKI

SEQ ID NO: 1043404 - protein, 9 aa, Homo Sapiens
ALTSAFPAF

SEQ ID NO: 1043405 - protein, 9 aa, Homo Sapiens
SLQETSVFI

SEQ ID NO: 1043406 - protein, 9 aa, Homo Sapiens
LEESSKQAR

SEQ ID NO: 1043407 - protein, 9 aa, Homo Sapiens
REEEFMKHN

SEQ ID NO: 1043408 - protein, 9 aa, Homo Sapiens
LSQNRGISS

SEQ ID NO: 1043409 - protein, 9 aa, Homo Sapiens
LRGAIAFAI

SEQ ID NO: 1043410 - protein, 9 aa, Homo Sapiens
SKQWVVSAG

SEQ ID NO: 1043411 - protein, 9 aa, Homo Sapiens
LLEAQVATH

SEQ ID NO: 1043412 - protein, 9 aa, Homo Sapiens
VQLQLQAAP

SEQ ID NO: 1043413 - protein, 9 aa, Homo Sapiens
SLQISMYYF

SEQ ID NO: 1043414 - protein, 9 aa, Homo Sapiens
LLNSLPLQA

SEQ ID NO: 1043415 - protein, 9 aa, Homo Sapiens
SDVIYARQA

SEQ ID NO: 1043416 - protein, 9 aa, Homo Sapiens
LRDPRFFSS

SEQ ID NO: 1043417 - protein, 9 aa, Homo Sapiens
VPEGSIPPS

SEQ ID NO: 1043418 - protein, 9 aa, Homo Sapiens
AKKVTQLRH

SEQ ID NO: 1043419 - protein, 9 aa, Homo Sapiens
KEVGAGGGP

SEQ ID NO: 1043420 - protein, 9 aa, Homo Sapiens
KTLKKIEEE

SEQ ID NO: 1043421 - protein, 9 aa, Homo Sapiens
FDDHLSSNQ

SEQ ID NO: 1043422 - protein, 9 aa, Homo Sapiens
DLPQQLLLV

SEQ ID NO: 1043423 - protein, 9 aa, Homo Sapiens
GEETLSVKV

SEQ ID NO: 1043424 - protein, 9 aa, Homo Sapiens
GTTFTLGAI

SEQ ID NO: 1043425 - protein, 9 aa, Homo Sapiens
RANATLLIT

SEQ ID NO: 1043426 - protein, 9 aa, Homo Sapiens
GLCHRGSFF

SEQ ID NO: 1043427 - protein, 9 aa, Homo Sapiens
YRNINIPLL

SEQ ID NO: 1043428 - protein, 9 aa, Homo Sapiens
SLKRNLQKL

SEQ ID NO: 1043429 - protein, 9 aa, Homo Sapiens
SRPKGEIGD

SEQ ID NO: 1043430 - protein, 9 aa, Homo Sapiens
SCAEGDDYG

SEQ ID NO: 1043431 - protein, 9 aa, Homo Sapiens
DFHPLPPSY

SEQ ID NO: 1043432 - protein, 9 aa, Homo Sapiens
WDLTLSPRL

SEQ ID NO: 1043433 - protein, 9 aa, Homo Sapiens
VEGRLESAL

SEQ ID NO: 1043434 - protein, 9 aa, Homo Sapiens
KPLNCTTIS

SEQ ID NO: 1043435 - protein, 9 aa, Homo Sapiens
PEPPVKKNE

SEQ ID NO: 1043436 - protein, 9 aa, Homo Sapiens
YRNLLLLAE

SEQ ID NO: 1043437 - protein, 9 aa, Homo Sapiens
KFVIPKEKD

SEQ ID NO: 1043438 - protein, 9 aa, Homo Sapiens
AFCLVLFFL

SEQ ID NO: 1043439 - protein, 9 aa, Homo Sapiens
LEQNLKVYI

SEQ ID NO: 1043440 - protein, 9 aa, Homo Sapiens
YKVSADKPH

SEQ ID NO: 1043441 - protein, 9 aa, Homo Sapiens
SSEVLRKDP

SEQ ID NO: 1043442 - protein, 9 aa, Homo Sapiens
ESPKKKTIK

SEQ ID NO: 1043443 - protein, 9 aa, Homo Sapiens
GEDRGIHPR

SEQ ID NO: 1043444 - protein, 9 aa, Homo Sapiens
TWELYIPSG

SEQ ID NO: 1043445 - protein, 9 aa, Homo Sapiens
EDAVKETFS

SEQ ID NO: 1043446 - protein, 9 aa, Homo Sapiens
LFKEQDLRK

SEQ ID NO: 1043447 - protein, 9 aa, Homo Sapiens
PLSPKPSFP

SEQ ID NO: 1043448 - protein, 9 aa, Homo Sapiens
QQLQSLALG

SEQ ID NO: 1043449 - protein, 9 aa, Homo Sapiens
GVDINAREE

SEQ ID NO: 1043450 - protein, 9 aa, Homo Sapiens
DLVCAFIRV

SEQ ID NO: 1043451 - protein, 9 aa, Homo Sapiens
EQTLFMTAP

SEQ ID NO: 1043452 - protein, 9 aa, Homo Sapiens
SAVNTATEI

SEQ ID NO: 1043453 - protein, 9 aa, Homo Sapiens
DPILAAHSF

SEQ ID NO: 1043454 - protein, 9 aa, Homo Sapiens
HRVHTEEKP

SEQ ID NO: 1043455 - protein, 9 aa, Homo Sapiens
CEKPLLEKF

SEQ ID NO: 1043456 - protein, 9 aa, Homo Sapiens
EDDEDEKGP

SEQ ID NO: 1043457 - protein, 9 aa, Homo Sapiens
YRFCSVSDK

SEQ ID NO: 1043458 - protein, 9 aa, Homo Sapiens
GMAPQGMPG

SEQ ID NO: 1043459 - protein, 9 aa, Homo Sapiens
SLSHLLNVK

SEQ ID NO: 1043460 - protein, 9 aa, Homo Sapiens
INGVTLKEG

SEQ ID NO: 1043461 - protein, 9 aa, Homo Sapiens
RTFAQVMRL

SEQ ID NO: 1043462 - protein, 9 aa, Homo Sapiens
LNKKLLPRH

SEQ ID NO: 1043463 - protein, 9 aa, Homo Sapiens
GEGVQKSKK

SEQ ID NO: 1043464 - protein, 9 aa, Homo Sapiens
MIYSLRNKK

SEQ ID NO: 1043465 - protein, 9 aa, Homo Sapiens
SLQEPERTP

SEQ ID NO: 1043466 - protein, 9 aa, Homo Sapiens
AHYLHHFFF

SEQ ID NO: 1043467 - protein, 9 aa, Homo Sapiens
SSVDLEVQA

SEQ ID NO: 1043468 - protein, 9 aa, Homo Sapiens
SEQHLSQRR

SEQ ID NO: 1043469 - protein, 9 aa, Homo Sapiens
PDSSSLLGI

SEQ ID NO: 1043470 - protein, 9 aa, Homo Sapiens
NIDATTEPC

SEQ ID NO: 1043471 - protein, 9 aa, Homo Sapiens
PPSSPGSAD

SEQ ID NO: 1043472 - protein, 9 aa, Homo Sapiens
KPQILCYPE

SEQ ID NO: 1043473 - protein, 9 aa, Homo Sapiens
QEKQEETEK

SEQ ID NO: 1043474 - protein, 9 aa, Homo Sapiens
FCRPVCRPA

SEQ ID NO: 1043475 - protein, 9 aa, Homo Sapiens
SGARRGRRL

SEQ ID NO: 1043476 - protein, 9 aa, Homo Sapiens
FLLVLGGED

SEQ ID NO: 1043477 - protein, 9 aa, Homo Sapiens
LKNEPKIWV

SEQ ID NO: 1043478 - protein, 9 aa, Homo Sapiens
SGTKSPAST

SEQ ID NO: 1043479 - protein, 9 aa, Homo Sapiens
LEEKYTEPL

SEQ ID NO: 1043480 - protein, 9 aa, Homo Sapiens
QKILFKEQD

SEQ ID NO: 1043481 - protein, 9 aa, Homo Sapiens
SCSSRSRSA

SEQ ID NO: 1043482 - protein, 9 aa, Homo Sapiens
EQHLSQRRL

SEQ ID NO: 1043483 - protein, 9 aa, Homo Sapiens
RGAFWSYQL

SEQ ID NO: 1043484 - protein, 9 aa, Homo Sapiens
NLRGAASMR

SEQ ID NO: 1043485 - protein, 9 aa, Homo Sapiens
SDSRFSLEG

SEQ ID NO: 1043486 - protein, 9 aa, Homo Sapiens
NVRASPKPK

SEQ ID NO: 1043487 - protein, 9 aa, Homo Sapiens
PGGGLFRDD

SEQ ID NO: 1043488 - protein, 9 aa, Homo Sapiens
IGGKKLLLF

SEQ ID NO: 1043489 - protein, 9 aa, Homo Sapiens
LSPQLAEKK

SEQ ID NO: 1043490 - protein, 9 aa, Homo Sapiens
APFLSFLPL

SEQ ID NO: 1043491 - protein, 9 aa, Homo Sapiens
TGVLSLLLL

SEQ ID NO: 1043492 - protein, 9 aa, Homo Sapiens
ADYCTQPGQ

SEQ ID NO: 1043493 - protein, 9 aa, Homo Sapiens
SEAVLLDLT

SEQ ID NO: 1043494 - protein, 9 aa, Homo Sapiens
KLKDNLSIH

SEQ ID NO: 1043495 - protein, 9 aa, Homo Sapiens
AILKKKFDK

SEQ ID NO: 1043496 - protein, 9 aa, Homo Sapiens
TDARNGQSR

SEQ ID NO: 1043497 - protein, 9 aa, Homo Sapiens
FFGACCSTQ

SEQ ID NO: 1043498 - protein, 9 aa, Homo Sapiens
YGGKSILIR

SEQ ID NO: 1043499 - protein, 9 aa, Homo Sapiens
QFNSFGDDE

SEQ ID NO: 1043500 - protein, 9 aa, Homo Sapiens
LYNRMSYWS

SEQ ID NO: 1043501 - protein, 9 aa, Homo Sapiens
YVNICKQEI

SEQ ID NO: 1043502 - protein, 9 aa, Homo Sapiens
TLSTCREIR

SEQ ID NO: 1043503 - protein, 9 aa, Homo Sapiens
YPDPSPEAA

SEQ ID NO: 1043504 - protein, 9 aa, Homo Sapiens
TNVINYYFC

SEQ ID NO: 1043505 - protein, 9 aa, Homo Sapiens
LDGITKEAS

SEQ ID NO: 1043506 - protein, 9 aa, Homo Sapiens
FKVTDARNG

SEQ ID NO: 1043507 - protein, 9 aa, Homo Sapiens
CEFVQGSGA

SEQ ID NO: 1043508 - protein, 9 aa, Homo Sapiens
NVIFGWSLF

SEQ ID NO: 1043509 - protein, 9 aa, Homo Sapiens
QSLKNKIQT

SEQ ID NO: 1043510 - protein, 9 aa, Homo Sapiens
REKEEEQKD

SEQ ID NO: 1043511 - protein, 9 aa, Homo Sapiens
ESMESDTGF

SEQ ID NO: 1043512 - protein, 9 aa, Homo Sapiens
REQKKKEEF

SEQ ID NO: 1043513 - protein, 9 aa, Homo Sapiens
CPGKPEGPP

SEQ ID NO: 1043514 - protein, 9 aa, Homo Sapiens
HTPPVPVFD

SEQ ID NO: 1043515 - protein, 9 aa, Homo Sapiens
PHVATRVMW

SEQ ID NO: 1043516 - protein, 9 aa, Homo Sapiens
PFIAISCFY

SEQ ID NO: 1043517 - protein, 9 aa, Homo Sapiens
PSKNINTPT

SEQ ID NO: 1043518 - protein, 9 aa, Homo Sapiens
PVSGGLAGA

SEQ ID NO: 1043519 - protein, 9 aa, Homo Sapiens
LTRLEKFQN

SEQ ID NO: 1043520 - protein, 9 aa, Homo Sapiens
ADGPDARAD

SEQ ID NO: 1043521 - protein, 9 aa, Homo Sapiens
EPGGGLFRD

SEQ ID NO: 1043522 - protein, 9 aa, Homo Sapiens
STKYTCDIY

SEQ ID NO: 1043523 - protein, 9 aa, Homo Sapiens
KKASGCPGA

SEQ ID NO: 1043524 - protein, 9 aa, Homo Sapiens
LPAVPASLW

SEQ ID NO: 1043525 - protein, 9 aa, Homo Sapiens
VYSINLTLR

SEQ ID NO: 1043526 - protein, 9 aa, Homo Sapiens
QHDQIYTGE

SEQ ID NO: 1043527 - protein, 9 aa, Homo Sapiens
CSSRSRSAS

SEQ ID NO: 1043528 - protein, 9 aa, Homo Sapiens
RGLRPRLAE

SEQ ID NO: 1043529 - protein, 9 aa, Homo Sapiens
SNIDFLIEH

SEQ ID NO: 1043530 - protein, 9 aa, Homo Sapiens
QADSSFATL

SEQ ID NO: 1043531 - protein, 9 aa, Homo Sapiens
GRPGPPVLA

SEQ ID NO: 1043532 - protein, 9 aa, Homo Sapiens
HQEKQEETE

SEQ ID NO: 1043533 - protein, 9 aa, Homo Sapiens
AISNELRDK

SEQ ID NO: 1043534 - protein, 9 aa, Homo Sapiens
SRSALGFSS

SEQ ID NO: 1043535 - protein, 9 aa, Homo Sapiens
EYFFDRHPE

SEQ ID NO: 1043536 - protein, 9 aa, Homo Sapiens
RNINIPLLP

SEQ ID NO: 1043537 - protein, 9 aa, Homo Sapiens
SDGQAKPII

SEQ ID NO: 1043538 - protein, 9 aa, Homo Sapiens
PPQASSFHT

SEQ ID NO: 1043539 - protein, 9 aa, Homo Sapiens
GKVPAFLLR

SEQ ID NO: 1043540 - protein, 9 aa, Homo Sapiens
LGAEALRLL

SEQ ID NO: 1043541 - protein, 9 aa, Homo Sapiens
SPAEAFLAS

SEQ ID NO: 1043542 - protein, 9 aa, Homo Sapiens
AFEIILGPL

SEQ ID NO: 1043543 - protein, 9 aa, Homo Sapiens
SGISKPVRP

SEQ ID NO: 1043544 - protein, 9 aa, Homo Sapiens
SLSASLQER

SEQ ID NO: 1043545 - protein, 9 aa, Homo Sapiens
KEKGEAGDA

SEQ ID NO: 1043546 - protein, 9 aa, Homo Sapiens
LQELRGWAD

SEQ ID NO: 1043547 - protein, 9 aa, Homo Sapiens
PMAQCLQRY

SEQ ID NO: 1043548 - protein, 9 aa, Homo Sapiens
PDSPDSSSL

SEQ ID NO: 1043549 - protein, 9 aa, Homo Sapiens
IGQPNKALK

SEQ ID NO: 1043550 - protein, 9 aa, Homo Sapiens
FAKSVFFSD

SEQ ID NO: 1043551 - protein, 9 aa, Homo Sapiens
PRLWANHRV

SEQ ID NO: 1043552 - protein, 9 aa, Homo Sapiens
LGLPKKMTI

SEQ ID NO: 1043553 - protein, 9 aa, Homo Sapiens
INFFNGIWR

SEQ ID NO: 1043554 - protein, 9 aa, Homo Sapiens
VRRTEGFFV

SEQ ID NO: 1043555 - protein, 9 aa, Homo Sapiens
MLHGCLLEY

SEQ ID NO: 1043556 - protein, 9 aa, Homo Sapiens
ESTSPGRKP

SEQ ID NO: 1043557 - protein, 9 aa, Homo Sapiens
ITSDFQSPK

SEQ ID NO: 1043558 - protein, 9 aa, Homo Sapiens
TRAVIAPSL

SEQ ID NO: 1043559 - protein, 9 aa, Homo Sapiens
VPKIPEPEK

SEQ ID NO: 1043560 - protein, 9 aa, Homo Sapiens
HKYVNRKKK

SEQ ID NO: 1043561 - protein, 9 aa, Homo Sapiens
QVFNFQREN

SEQ ID NO: 1043562 - protein, 9 aa, Homo Sapiens
PSHLQAEPE

SEQ ID NO: 1043563 - protein, 9 aa, Homo Sapiens
FVVISFFLW

SEQ ID NO: 1043564 - protein, 9 aa, Homo Sapiens
IDPNRVMRY

SEQ ID NO: 1043565 - protein, 9 aa, Homo Sapiens
ALRRLESVL

SEQ ID NO: 1043566 - protein, 9 aa, Homo Sapiens
FTSKKKKDK

SEQ ID NO: 1043567 - protein, 9 aa, Homo Sapiens
NTSENNSEH

SEQ ID NO: 1043568 - protein, 9 aa, Homo Sapiens
MTSEIERVR

SEQ ID NO: 1043569 - protein, 9 aa, Homo Sapiens
KKSLQTGDL

SEQ ID NO: 1043570 - protein, 9 aa, Homo Sapiens
GYFVPTNTK

SEQ ID NO: 1043571 - protein, 9 aa, Homo Sapiens
ISILTMPND

SEQ ID NO: 1043572 - protein, 9 aa, Homo Sapiens
DPSPGASSP

SEQ ID NO: 1043573 - protein, 9 aa, Homo Sapiens
IKCPLSEMH

SEQ ID NO: 1043574 - protein, 9 aa, Homo Sapiens
PPLPLLSRV

SEQ ID NO: 1043575 - protein, 9 aa, Homo Sapiens
PPKQVFVDL

SEQ ID NO: 1043576 - protein, 9 aa, Homo Sapiens
ITEMEIFVK

SEQ ID NO: 1043577 - protein, 9 aa, Homo Sapiens
GTPGYLSSE

SEQ ID NO: 1043578 - protein, 9 aa, Homo Sapiens
NSLYVYHNR

SEQ ID NO: 1043579 - protein, 9 aa, Homo Sapiens
TDPGLMLAI

SEQ ID NO: 1043580 - protein, 9 aa, Homo Sapiens
NNMNCVWLF

SEQ ID NO: 1043581 - protein, 9 aa, Homo Sapiens
KKKTIKRRK

SEQ ID NO: 1043582 - protein, 9 aa, Homo Sapiens
VKGLPLIKY

SEQ ID NO: 1043583 - protein, 9 aa, Homo Sapiens
VFHQEDLER

SEQ ID NO: 1043584 - protein, 9 aa, Homo Sapiens
YPHVQMNLH

SEQ ID NO: 1043585 - protein, 9 aa, Homo Sapiens
PGSEQVQFS

SEQ ID NO: 1043586 - protein, 9 aa, Homo Sapiens
IELSAIDFS

SEQ ID NO: 1043587 - protein, 9 aa, Homo Sapiens
HGLQDGKDL

SEQ ID NO: 1043588 - protein, 9 aa, Homo Sapiens
LYGPSDMQG

SEQ ID NO: 1043589 - protein, 9 aa, Homo Sapiens
AVGLSNVWR

SEQ ID NO: 1043590 - protein, 9 aa, Homo Sapiens
AKSLWRPEK

SEQ ID NO: 1043591 - protein, 9 aa, Homo Sapiens
GNNIKPGMF

SEQ ID NO: 1043592 - protein, 9 aa, Homo Sapiens
WAQGASELE

SEQ ID NO: 1043593 - protein, 9 aa, Homo Sapiens
RSENVHHQF

SEQ ID NO: 1043594 - protein, 9 aa, Homo Sapiens
DDFAVPSST

SEQ ID NO: 1043595 - protein, 9 aa, Homo Sapiens
KHFPKPERL

SEQ ID NO: 1043596 - protein, 9 aa, Homo Sapiens
DTQCTNSEE

SEQ ID NO: 1043597 - protein, 9 aa, Homo Sapiens
HSSGGWAKF

SEQ ID NO: 1043598 - protein, 9 aa, Homo Sapiens
VLSNNYSYL

SEQ ID NO: 1043599 - protein, 9 aa, Homo Sapiens
QGNYGFLSE

SEQ ID NO: 1043600 - protein, 9 aa, Homo Sapiens
KNIYCLISK

SEQ ID NO: 1043601 - protein, 9 aa, Homo Sapiens
ANANPSDGN

SEQ ID NO: 1043602 - protein, 9 aa, Homo Sapiens
LFYALILRA

SEQ ID NO: 1043603 - protein, 9 aa, Homo Sapiens
SESAKSLES

SEQ ID NO: 1043604 - protein, 9 aa, Homo Sapiens
ERRAVAALS

SEQ ID NO: 1043605 - protein, 9 aa, Homo Sapiens
TDPMLRRRG

SEQ ID NO: 1043606 - protein, 9 aa, Homo Sapiens
AVARNHQTY

SEQ ID NO: 1043607 - protein, 9 aa, Homo Sapiens
IILTIFCLS

SEQ ID NO: 1043608 - protein, 9 aa, Homo Sapiens
SSRPWDLRE

SEQ ID NO: 1043609 - protein, 9 aa, Homo Sapiens
SAHSPATHQ

SEQ ID NO: 1043610 - protein, 9 aa, Homo Sapiens
EAQILDPFA

SEQ ID NO: 1043611 - protein, 9 aa, Homo Sapiens
RTMAGCRDP

SEQ ID NO: 1043612 - protein, 9 aa, Homo Sapiens
EEDPDGEEK

SEQ ID NO: 1043613 - protein, 9 aa, Homo Sapiens
RPSIVSASW

SEQ ID NO: 1043614 - protein, 9 aa, Homo Sapiens
AGPEAGDNA

SEQ ID NO: 1043615 - protein, 9 aa, Homo Sapiens
AFIEPRYHV

SEQ ID NO: 1043616 - protein, 9 aa, Homo Sapiens
LSMIAHLEV

SEQ ID NO: 1043617 - protein, 9 aa, Homo Sapiens
EKPDSENTP

SEQ ID NO: 1043618 - protein, 9 aa, Homo Sapiens
SSLQACNKR

SEQ ID NO: 1043619 - protein, 9 aa, Homo Sapiens
STFESVAFS

SEQ ID NO: 1043620 - protein, 9 aa, Homo Sapiens
INSPWRTHI

SEQ ID NO: 1043621 - protein, 9 aa, Homo Sapiens
DKKITLKVA

SEQ ID NO: 1043622 - protein, 9 aa, Homo Sapiens
LPARSTASH

SEQ ID NO: 1043623 - protein, 9 aa, Homo Sapiens
EARGLRPRL

SEQ ID NO: 1043624 - protein, 9 aa, Homo Sapiens
VILCSLKTH

SEQ ID NO: 1043625 - protein, 9 aa, Homo Sapiens
PPQCSQLVG

SEQ ID NO: 1043626 - protein, 9 aa, Homo Sapiens
LQHLHGSHR

SEQ ID NO: 1043627 - protein, 9 aa, Homo Sapiens
FLPCEFHLF

SEQ ID NO: 1043628 - protein, 9 aa, Homo Sapiens
ILSSYDLIL

SEQ ID NO: 1043629 - protein, 9 aa, Homo Sapiens
EDTINWTDW

SEQ ID NO: 1043630 - protein, 9 aa, Homo Sapiens
ENTGNIHAT

SEQ ID NO: 1043631 - protein, 9 aa, Homo Sapiens
INLERELGS

SEQ ID NO: 1043632 - protein, 9 aa, Homo Sapiens
RHSKYNPQL

SEQ ID NO: 1043633 - protein, 9 aa, Homo Sapiens
LLFTAGTVF

SEQ ID NO: 1043634 - protein, 9 aa, Homo Sapiens
CLKQQMKKG

SEQ ID NO: 1043635 - protein, 9 aa, Homo Sapiens
CTGRWPRST

SEQ ID NO: 1043636 - protein, 9 aa, Homo Sapiens
TSITKKCEK

SEQ ID NO: 1043637 - protein, 9 aa, Homo Sapiens
ERLLQHLQR

SEQ ID NO: 1043638 - protein, 9 aa, Homo Sapiens
TKIKLHSNM

SEQ ID NO: 1043639 - protein, 9 aa, Homo Sapiens
DIRYNLFLS

SEQ ID NO: 1043640 - protein, 9 aa, Homo Sapiens
EMNETSALK

SEQ ID NO: 1043641 - protein, 9 aa, Homo Sapiens
AIFFGGLFL

SEQ ID NO: 1043642 - protein, 9 aa, Homo Sapiens
MEFDLELKK

SEQ ID NO: 1043643 - protein, 9 aa, Homo Sapiens
LFRDDDDIN

SEQ ID NO: 1043644 - protein, 9 aa, Homo Sapiens
GFFTDAQNC

SEQ ID NO: 1043645 - protein, 9 aa, Homo Sapiens
TEEIFNHFV

SEQ ID NO: 1043646 - protein, 9 aa, Homo Sapiens
GITTASFVC

SEQ ID NO: 1043647 - protein, 9 aa, Homo Sapiens
ALAIGTLYF

SEQ ID NO: 1043648 - protein, 9 aa, Homo Sapiens
TDTSWQESD

SEQ ID NO: 1043649 - protein, 9 aa, Homo Sapiens
KLQEIYQKL

SEQ ID NO: 1043650 - protein, 9 aa, Homo Sapiens
AEFPSGSAL

SEQ ID NO: 1043651 - protein, 9 aa, Homo Sapiens
GQERRFTII

SEQ ID NO: 1043652 - protein, 9 aa, Homo Sapiens
SVFFSDVFF

SEQ ID NO: 1043653 - protein, 9 aa, Homo Sapiens
LRNFFFLEV

SEQ ID NO: 1043654 - protein, 9 aa, Homo Sapiens
NLAKKNREF

SEQ ID NO: 1043655 - protein, 9 aa, Homo Sapiens
VIFGWSLFY

SEQ ID NO: 1043656 - protein, 9 aa, Homo Sapiens
EGMEIDEAA

SEQ ID NO: 1043657 - protein, 9 aa, Homo Sapiens
LLAGQTAEL

SEQ ID NO: 1043658 - protein, 9 aa, Homo Sapiens
EINIIKLSH

SEQ ID NO: 1043659 - protein, 9 aa, Homo Sapiens
TFAQVMRLC

SEQ ID NO: 1043660 - protein, 9 aa, Homo Sapiens
DFDTMTNRL

SEQ ID NO: 1043661 - protein, 9 aa, Homo Sapiens
TASSPGAQR

SEQ ID NO: 1043662 - protein, 9 aa, Homo Sapiens
REIRIAPTA

SEQ ID NO: 1043663 - protein, 9 aa, Homo Sapiens
TGSSSPPVN

SEQ ID NO: 1043664 - protein, 9 aa, Homo Sapiens
NSSWFIIQK

SEQ ID NO: 1043665 - protein, 9 aa, Homo Sapiens
LVSCVQLAN

SEQ ID NO: 1043666 - protein, 9 aa, Homo Sapiens
KQNVTFHVI

SEQ ID NO: 1043667 - protein, 9 aa, Homo Sapiens
IFFKAFSYL

SEQ ID NO: 1043668 - protein, 9 aa, Homo Sapiens
VLVVSVIKQ

SEQ ID NO: 1043669 - protein, 9 aa, Homo Sapiens
KSHVSSEKR

SEQ ID NO: 1043670 - protein, 9 aa, Homo Sapiens
LQKAFSKAL

SEQ ID NO: 1043671 - protein, 9 aa, Homo Sapiens
EPFSFFFDG

SEQ ID NO: 1043672 - protein, 9 aa, Homo Sapiens
EEENEGEAE

SEQ ID NO: 1043673 - protein, 9 aa, Homo Sapiens
GFTALPAVA

SEQ ID NO: 1043674 - protein, 9 aa, Homo Sapiens
GMLIPYTYP

SEQ ID NO: 1043675 - protein, 9 aa, Homo Sapiens
KPIIYTKDE

SEQ ID NO: 1043676 - protein, 9 aa, Homo Sapiens
ASLVSRSSP

SEQ ID NO: 1043677 - protein, 9 aa, Homo Sapiens
VQNFLGLKR

SEQ ID NO: 1043678 - protein, 9 aa, Homo Sapiens
ACKSQTLSE

SEQ ID NO: 1043679 - protein, 9 aa, Homo Sapiens
NFLGLKRVV

SEQ ID NO: 1043680 - protein, 9 aa, Homo Sapiens
SSPGAARAT

SEQ ID NO: 1043681 - protein, 9 aa, Homo Sapiens
PGQGEAGAE

SEQ ID NO: 1043682 - protein, 9 aa, Homo Sapiens
ETGERLFTP

SEQ ID NO: 1043683 - protein, 9 aa, Homo Sapiens
EERRGAFWS

SEQ ID NO: 1043684 - protein, 9 aa, Homo Sapiens
ESFMQLSYR

SEQ ID NO: 1043685 - protein, 9 aa, Homo Sapiens
DFLISHKIE

SEQ ID NO: 1043686 - protein, 9 aa, Homo Sapiens
HAQGGHWLA

SEQ ID NO: 1043687 - protein, 9 aa, Homo Sapiens
DNMSSTLLT

SEQ ID NO: 1043688 - protein, 9 aa, Homo Sapiens
CNSDHWGPH

SEQ ID NO: 1043689 - protein, 9 aa, Homo Sapiens
EVSYVLGIP

SEQ ID NO: 1043690 - protein, 9 aa, Homo Sapiens
ERLKQTNKM

SEQ ID NO: 1043691 - protein, 9 aa, Homo Sapiens
ILFPRFPWF

SEQ ID NO: 1043692 - protein, 9 aa, Homo Sapiens
SVKKLADVI

SEQ ID NO: 1043693 - protein, 9 aa, Homo Sapiens
RRKRKKKEK

SEQ ID NO: 1043694 - protein, 9 aa, Homo Sapiens
YLLQNGSAP

SEQ ID NO: 1043695 - protein, 9 aa, Homo Sapiens
AKPEKAPAL

SEQ ID NO: 1043696 - protein, 9 aa, Homo Sapiens
ESHSRELVL

SEQ ID NO: 1043697 - protein, 9 aa, Homo Sapiens
TTMPLSEAT

SEQ ID NO: 1043698 - protein, 9 aa, Homo Sapiens
YISSDGESH

SEQ ID NO: 1043699 - protein, 9 aa, Homo Sapiens
IPCAQLFNS

SEQ ID NO: 1043700 - protein, 9 aa, Homo Sapiens
KQGQDYRLK

SEQ ID NO: 1043701 - protein, 9 aa, Homo Sapiens
FADYAKHKC

SEQ ID NO: 1043702 - protein, 9 aa, Homo Sapiens
TFIGTLVQA

SEQ ID NO: 1043703 - protein, 9 aa, Homo Sapiens
IAHLEVFPS

SEQ ID NO: 1043704 - protein, 9 aa, Homo Sapiens
YSVFHMECE

SEQ ID NO: 1043705 - protein, 9 aa, Homo Sapiens
HTFCLILPL

SEQ ID NO: 1043706 - protein, 9 aa, Homo Sapiens
AWVEKPSFE

SEQ ID NO: 1043707 - protein, 9 aa, Homo Sapiens
LIVIMYRRI

SEQ ID NO: 1043708 - protein, 9 aa, Homo Sapiens
PKKMTIWVD

SEQ ID NO: 1043709 - protein, 9 aa, Homo Sapiens
AKDVLDKWT

SEQ ID NO: 1043710 - protein, 9 aa, Homo Sapiens
SFLPRFLQR

SEQ ID NO: 1043711 - protein, 9 aa, Homo Sapiens
ATYHVDRSE

SEQ ID NO: 1043712 - protein, 9 aa, Homo Sapiens
AAEETGGEH

SEQ ID NO: 1043713 - protein, 9 aa, Homo Sapiens
RISPRSTGL

SEQ ID NO: 1043714 - protein, 9 aa, Homo Sapiens
VLTYTVVGC

SEQ ID NO: 1043715 - protein, 9 aa, Homo Sapiens
MLAVASSSK

SEQ ID NO: 1043716 - protein, 9 aa, Homo Sapiens
ALSQLQNSG

SEQ ID NO: 1043717 - protein, 9 aa, Homo Sapiens
TWGICVCTF

SEQ ID NO: 1043718 - protein, 9 aa, Homo Sapiens
SYDLILAAV

SEQ ID NO: 1043719 - protein, 9 aa, Homo Sapiens
SAKSLESEQ

SEQ ID NO: 1043720 - protein, 9 aa, Homo Sapiens
YQDVPMPEK

SEQ ID NO: 1043721 - protein, 9 aa, Homo Sapiens
LMLGFVVVL

SEQ ID NO: 1043722 - protein, 9 aa, Homo Sapiens
VIVPELSKP

SEQ ID NO: 1043723 - protein, 9 aa, Homo Sapiens
KKHQLSVVH

SEQ ID NO: 1043724 - protein, 9 aa, Homo Sapiens
KILKQIVKH

SEQ ID NO: 1043725 - protein, 9 aa, Homo Sapiens
QSGSQENRE

SEQ ID NO: 1043726 - protein, 9 aa, Homo Sapiens
RDSDCGFSW

SEQ ID NO: 1043727 - protein, 9 aa, Homo Sapiens
KRAAPCGAC

SEQ ID NO: 1043728 - protein, 9 aa, Homo Sapiens
LKEEQHGIL

SEQ ID NO: 1043729 - protein, 9 aa, Homo Sapiens
TNLHNCVAY

SEQ ID NO: 1043730 - protein, 9 aa, Homo Sapiens
QALLEAEEC

SEQ ID NO: 1043731 - protein, 9 aa, Homo Sapiens
YMEYSHQMW

SEQ ID NO: 1043732 - protein, 9 aa, Homo Sapiens
RLKGSLKMV

SEQ ID NO: 1043733 - protein, 9 aa, Homo Sapiens
QGRWMKQNP

SEQ ID NO: 1043734 - protein, 9 aa, Homo Sapiens
HFPCTVRWF

SEQ ID NO: 1043735 - protein, 9 aa, Homo Sapiens
CRPLCGQPT

SEQ ID NO: 1043736 - protein, 9 aa, Homo Sapiens
RMYFLCFCA

SEQ ID NO: 1043737 - protein, 9 aa, Homo Sapiens
KFQSCNTDS

SEQ ID NO: 1043738 - protein, 9 aa, Homo Sapiens
LCSVIFGHE

SEQ ID NO: 1043739 - protein, 9 aa, Homo Sapiens
TLRVVIDQM

SEQ ID NO: 1043740 - protein, 9 aa, Homo Sapiens
GPTEPASPR

SEQ ID NO: 1043741 - protein, 9 aa, Homo Sapiens
MESDTGFFD

SEQ ID NO: 1043742 - protein, 9 aa, Homo Sapiens
YIKPSAEDR

SEQ ID NO: 1043743 - protein, 9 aa, Homo Sapiens
KIEDPPNDL

SEQ ID NO: 1043744 - protein, 9 aa, Homo Sapiens
KEAAPAAPP

SEQ ID NO: 1043745 - protein, 9 aa, Homo Sapiens
TILDASGHK

SEQ ID NO: 1043746 - protein, 9 aa, Homo Sapiens
LLKTLVSEL

SEQ ID NO: 1043747 - protein, 9 aa, Homo Sapiens
MAIKISCFT

SEQ ID NO: 1043748 - protein, 9 aa, Homo Sapiens
YGHSRSSEN

SEQ ID NO: 1043749 - protein, 9 aa, Homo Sapiens
QVVEANDNP

SEQ ID NO: 1043750 - protein, 9 aa, Homo Sapiens
APKRLVNLV

SEQ ID NO: 1043751 - protein, 9 aa, Homo Sapiens
NEHSAFRLA

SEQ ID NO: 1043752 - protein, 9 aa, Homo Sapiens
TSILPGRCK

SEQ ID NO: 1043753 - protein, 9 aa, Homo Sapiens
SYRAKKFSL

SEQ ID NO: 1043754 - protein, 9 aa, Homo Sapiens
LGYAGNTES

SEQ ID NO: 1043755 - protein, 9 aa, Homo Sapiens
QQNSSLSLA

SEQ ID NO: 1043756 - protein, 9 aa, Homo Sapiens
SPTFSGSHK

SEQ ID NO: 1043757 - protein, 9 aa, Homo Sapiens
RINGVWNLS

SEQ ID NO: 1043758 - protein, 9 aa, Homo Sapiens
SFWNTYAQK

SEQ ID NO: 1043759 - protein, 9 aa, Homo Sapiens
SHAGLFFAP

SEQ ID NO: 1043760 - protein, 9 aa, Homo Sapiens
FKLPSGKNI

SEQ ID NO: 1043761 - protein, 9 aa, Homo Sapiens
SRCSPEKKV

SEQ ID NO: 1043762 - protein, 9 aa, Homo Sapiens
ESFPAVLSS

SEQ ID NO: 1043763 - protein, 9 aa, Homo Sapiens
RVSHCGANA

SEQ ID NO: 1043764 - protein, 9 aa, Homo Sapiens
ETDIFQIQG

SEQ ID NO: 1043765 - protein, 9 aa, Homo Sapiens
EKKVQTLPS

SEQ ID NO: 1043766 - protein, 9 aa, Homo Sapiens
GDLEPSHHL

SEQ ID NO: 1043767 - protein, 9 aa, Homo Sapiens
SSHLENRAR

SEQ ID NO: 1043768 - protein, 9 aa, Homo Sapiens
LSIKTSFLA

SEQ ID NO: 1043769 - protein, 9 aa, Homo Sapiens
PPSPPGEHS

SEQ ID NO: 1043770 - protein, 9 aa, Homo Sapiens
SKLQEIYQK

SEQ ID NO: 1043771 - protein, 9 aa, Homo Sapiens
FPISEKVSE

SEQ ID NO: 1043772 - protein, 9 aa, Homo Sapiens
AILDTWLTV

SEQ ID NO: 1043773 - protein, 9 aa, Homo Sapiens
RDPDAQPEG

SEQ ID NO: 1043774 - protein, 9 aa, Homo Sapiens
VKPFKLHPR

SEQ ID NO: 1043775 - protein, 9 aa, Homo Sapiens
RRARVVSKG

SEQ ID NO: 1043776 - protein, 9 aa, Homo Sapiens
CSKVFETDS

SEQ ID NO: 1043777 - protein, 9 aa, Homo Sapiens
RLGLSSLLW

SEQ ID NO: 1043778 - protein, 9 aa, Homo Sapiens
EILTDKSLS

SEQ ID NO: 1043779 - protein, 9 aa, Homo Sapiens
YKIKVVPEG

SEQ ID NO: 1043780 - protein, 9 aa, Homo Sapiens
KIQTLASEV

SEQ ID NO: 1043781 - protein, 9 aa, Homo Sapiens
IHPVGWCKK

SEQ ID NO: 1043782 - protein, 9 aa, Homo Sapiens
DDWLVELRK

SEQ ID NO: 1043783 - protein, 9 aa, Homo Sapiens
KVFETDSSL

SEQ ID NO: 1043784 - protein, 9 aa, Homo Sapiens
LVSTAWVDN

SEQ ID NO: 1043785 - protein, 9 aa, Homo Sapiens
PQHLQPCRL

SEQ ID NO: 1043786 - protein, 9 aa, Homo Sapiens
QAYIGGIHD

SEQ ID NO: 1043787 - protein, 9 aa, Homo Sapiens
NVINYYFCD

SEQ ID NO: 1043788 - protein, 9 aa, Homo Sapiens
KLIVNSLCS

SEQ ID NO: 1043789 - protein, 9 aa, Homo Sapiens
QEVAQKRLQ

SEQ ID NO: 1043790 - protein, 9 aa, Homo Sapiens
EYLFSHHVV

SEQ ID NO: 1043791 - protein, 9 aa, Homo Sapiens
NFFIVLLSV

SEQ ID NO: 1043792 - protein, 9 aa, Homo Sapiens
WVDCLLEKY

SEQ ID NO: 1043793 - protein, 9 aa, Homo Sapiens
RQKCEFVQG

SEQ ID NO: 1043794 - protein, 9 aa, Homo Sapiens
RTCCLQKFN

SEQ ID NO: 1043795 - protein, 9 aa, Homo Sapiens
STCREIRGL

SEQ ID NO: 1043796 - protein, 9 aa, Homo Sapiens
AEKAITVLF

SEQ ID NO: 1043797 - protein, 9 aa, Homo Sapiens
FKDPHVATR

SEQ ID NO: 1043798 - protein, 9 aa, Homo Sapiens
FPAQLGAPA

SEQ ID NO: 1043799 - protein, 9 aa, Homo Sapiens
NAGSDYKFT

SEQ ID NO: 1043800 - protein, 9 aa, Homo Sapiens
IMIPSGGTE

SEQ ID NO: 1043801 - protein, 9 aa, Homo Sapiens
DEAQYIMKE

SEQ ID NO: 1043802 - protein, 9 aa, Homo Sapiens
SLLLLLVTI

SEQ ID NO: 1043803 - protein, 9 aa, Homo Sapiens
DDEEEENEG

SEQ ID NO: 1043804 - protein, 9 aa, Homo Sapiens
PGLCLRGQH

SEQ ID NO: 1043805 - protein, 9 aa, Homo Sapiens
VMAFDCYVA

SEQ ID NO: 1043806 - protein, 9 aa, Homo Sapiens
KVISVIAVS

SEQ ID NO: 1043807 - protein, 9 aa, Homo Sapiens
KPQVWSNPS

SEQ ID NO: 1043808 - protein, 9 aa, Homo Sapiens
EAKQQFSFH

SEQ ID NO: 1043809 - protein, 9 aa, Homo Sapiens
NLNQVAISQ

SEQ ID NO: 1043810 - protein, 9 aa, Homo Sapiens
PLRNLRRTR

SEQ ID NO: 1043811 - protein, 9 aa, Homo Sapiens
EETGGEHWK

SEQ ID NO: 1043812 - protein, 9 aa, Homo Sapiens
GERPLPENE

SEQ ID NO: 1043813 - protein, 9 aa, Homo Sapiens
FTQCSHFRR

SEQ ID NO: 1043814 - protein, 9 aa, Homo Sapiens
VGWADKYHG

SEQ ID NO: 1043815 - protein, 9 aa, Homo Sapiens
SQEFSGRPL

SEQ ID NO: 1043816 - protein, 9 aa, Homo Sapiens
EKQEETEKE

SEQ ID NO: 1043817 - protein, 9 aa, Homo Sapiens
VLVIPKKNS

SEQ ID NO: 1043818 - protein, 9 aa, Homo Sapiens
KLSRTGRSR

SEQ ID NO: 1043819 - protein, 9 aa, Homo Sapiens
VPKQRNGSE

SEQ ID NO: 1043820 - protein, 9 aa, Homo Sapiens
TLTEKKSTL

SEQ ID NO: 1043821 - protein, 9 aa, Homo Sapiens
GFYAPRRGE

SEQ ID NO: 1043822 - protein, 9 aa, Homo Sapiens
NKDTVYEEQ

SEQ ID NO: 1043823 - protein, 9 aa, Homo Sapiens
GFPPRSPWG

SEQ ID NO: 1043824 - protein, 9 aa, Homo Sapiens
VTGGKDDIV

SEQ ID NO: 1043825 - protein, 9 aa, Homo Sapiens
VIDPNRVMR

SEQ ID NO: 1043826 - protein, 9 aa, Homo Sapiens
PGLPGAKGK

SEQ ID NO: 1043827 - protein, 9 aa, Homo Sapiens
NVQWFLSSQ

SEQ ID NO: 1043828 - protein, 9 aa, Homo Sapiens
MKKSLQTGD

SEQ ID NO: 1043829 - protein, 9 aa, Homo Sapiens
SLRACYHMK

SEQ ID NO: 1043830 - protein, 9 aa, Homo Sapiens
GLFFAPGLP

SEQ ID NO: 1043831 - protein, 9 aa, Homo Sapiens
CARFLKNAM

SEQ ID NO: 1043832 - protein, 9 aa, Homo Sapiens
NEKKNTEET

SEQ ID NO: 1043833 - protein, 9 aa, Homo Sapiens
LAKKNREFF

SEQ ID NO: 1043834 - protein, 9 aa, Homo Sapiens
EGSDQKSPA

SEQ ID NO: 1043835 - protein, 9 aa, Homo Sapiens
MTEAEVQLF

SEQ ID NO: 1043836 - protein, 9 aa, Homo Sapiens
DSTDLENDE

SEQ ID NO: 1043837 - protein, 9 aa, Homo Sapiens
VMYHINLNQ

SEQ ID NO: 1043838 - protein, 9 aa, Homo Sapiens
CVLMLLISL

SEQ ID NO: 1043839 - protein, 9 aa, Homo Sapiens
EIILGPLSH

SEQ ID NO: 1043840 - protein, 9 aa, Homo Sapiens
TTLFRRVVK

SEQ ID NO: 1043841 - protein, 9 aa, Homo Sapiens
ATLSSLQGL

SEQ ID NO: 1043842 - protein, 9 aa, Homo Sapiens
ESPGAPERE

SEQ ID NO: 1043843 - protein, 9 aa, Homo Sapiens
KNGTIIFII

SEQ ID NO: 1043844 - protein, 9 aa, Homo Sapiens
CADRNFTTP

SEQ ID NO: 1043845 - protein, 9 aa, Homo Sapiens
PESEDVKRG

SEQ ID NO: 1043846 - protein, 9 aa, Homo Sapiens
HVKENWINP

SEQ ID NO: 1043847 - protein, 9 aa, Homo Sapiens
GVLKCNISD

SEQ ID NO: 1043848 - protein, 9 aa, Homo Sapiens
QTIKPENFF

SEQ ID NO: 1043849 - protein, 9 aa, Homo Sapiens
DNDIDKFYA

SEQ ID NO: 1043850 - protein, 9 aa, Homo Sapiens
QNHGTNLTC

SEQ ID NO: 1043851 - protein, 9 aa, Homo Sapiens
HGGQQTTPC

SEQ ID NO: 1043852 - protein, 9 aa, Homo Sapiens
VAAGMLIPY

SEQ ID NO: 1043853 - protein, 9 aa, Homo Sapiens
ANQAAFGVQ

SEQ ID NO: 1043854 - protein, 9 aa, Homo Sapiens
AFYVQGVWQ

SEQ ID NO: 1043855 - protein, 9 aa, Homo Sapiens
EVKSDRVSI

SEQ ID NO: 1043856 - protein, 9 aa, Homo Sapiens
EGFPGESRP

SEQ ID NO: 1043857 - protein, 9 aa, Homo Sapiens
KILQKEEEV

SEQ ID NO: 1043858 - protein, 9 aa, Homo Sapiens
FLGTAMAGF

SEQ ID NO: 1043859 - protein, 9 aa, Homo Sapiens
KYTLLYRNI

SEQ ID NO: 1043860 - protein, 9 aa, Homo Sapiens
LANKLSFRN

SEQ ID NO: 1043861 - protein, 9 aa, Homo Sapiens
YEALVKTNR

SEQ ID NO: 1043862 - protein, 9 aa, Homo Sapiens
RRRKLEPPE

SEQ ID NO: 1043863 - protein, 9 aa, Homo Sapiens
LPQHLQPCR

SEQ ID NO: 1043864 - protein, 9 aa, Homo Sapiens
LGEKGPQTL

SEQ ID NO: 1043865 - protein, 9 aa, Homo Sapiens
SFRSKSLGL

SEQ ID NO: 1043866 - protein, 9 aa, Homo Sapiens
SQGDNKLQK

SEQ ID NO: 1043867 - protein, 9 aa, Homo Sapiens
VVPFSSIKN

SEQ ID NO: 1043868 - protein, 9 aa, Homo Sapiens
STPEQDDLS

SEQ ID NO: 1043869 - protein, 9 aa, Homo Sapiens
LSSNKLHVT

SEQ ID NO: 1043870 - protein, 9 aa, Homo Sapiens
DPSLQSAAY

SEQ ID NO: 1043871 - protein, 9 aa, Homo Sapiens
EEAQLLFHG

SEQ ID NO: 1043872 - protein, 9 aa, Homo Sapiens
ISKPVRPMT

SEQ ID NO: 1043873 - protein, 9 aa, Homo Sapiens
RKSRSGEDR

SEQ ID NO: 1043874 - protein, 9 aa, Homo Sapiens
EGYIKEGER

SEQ ID NO: 1043875 - protein, 9 aa, Homo Sapiens
QLANKLSFR

SEQ ID NO: 1043876 - protein, 9 aa, Homo Sapiens
ILYKLVQLI

SEQ ID NO: 1043877 - protein, 9 aa, Homo Sapiens
KFGIVPNGS

SEQ ID NO: 1043878 - protein, 9 aa, Homo Sapiens
GGSLISKQW

SEQ ID NO: 1043879 - protein, 9 aa, Homo Sapiens
TAGDHLGRA

SEQ ID NO: 1043880 - protein, 9 aa, Homo Sapiens
FGSDILIPH

SEQ ID NO: 1043881 - protein, 9 aa, Homo Sapiens
PLPPTSDLP

SEQ ID NO: 1043882 - protein, 9 aa, Homo Sapiens
QHKIVIFMF

SEQ ID NO: 1043883 - protein, 9 aa, Homo Sapiens
LHTTYKKDY

SEQ ID NO: 1043884 - protein, 9 aa, Homo Sapiens
FNLSSNKLH

SEQ ID NO: 1043885 - protein, 9 aa, Homo Sapiens
LFYTRITIS

SEQ ID NO: 1043886 - protein, 9 aa, Homo Sapiens
LHHFFFKTL

SEQ ID NO: 1043887 - protein, 9 aa, Homo Sapiens
DRTKFEQYL

SEQ ID NO: 1043888 - protein, 9 aa, Homo Sapiens
SPGKCKRHR

SEQ ID NO: 1043889 - protein, 9 aa, Homo Sapiens
DHQRKQELR

SEQ ID NO: 1043890 - protein, 9 aa, Homo Sapiens
NSDLTLYLV

SEQ ID NO: 1043891 - protein, 9 aa, Homo Sapiens
EKPSFEKPL

SEQ ID NO: 1043892 - protein, 9 aa, Homo Sapiens
VGLDNSNQS

SEQ ID NO: 1043893 - protein, 9 aa, Homo Sapiens
TGGGGYVQL

SEQ ID NO: 1043894 - protein, 9 aa, Homo Sapiens
PVKKNEMKA

SEQ ID NO: 1043895 - protein, 9 aa, Homo Sapiens
YGEPPKFPR

SEQ ID NO: 1043896 - protein, 9 aa, Homo Sapiens
HQVMSIEKV

SEQ ID NO: 1043897 - protein, 9 aa, Homo Sapiens
QDTLARKTF

SEQ ID NO: 1043898 - protein, 9 aa, Homo Sapiens
RTSLPRDSP

SEQ ID NO: 1043899 - protein, 9 aa, Homo Sapiens
KLIIVEECQ

SEQ ID NO: 1043900 - protein, 9 aa, Homo Sapiens
LEDEVFANF

SEQ ID NO: 1043901 - protein, 9 aa, Homo Sapiens
NASKEQVCL

SEQ ID NO: 1043902 - protein, 9 aa, Homo Sapiens
ILDKNDNVS

SEQ ID NO: 1043903 - protein, 9 aa, Homo Sapiens
VMELNEKAV

SEQ ID NO: 1043904 - protein, 9 aa, Homo Sapiens
GKYRMLFAW

SEQ ID NO: 1043905 - protein, 9 aa, Homo Sapiens
EAAVKQFLQ

SEQ ID NO: 1043906 - protein, 9 aa, Homo Sapiens
SSYECTIKN

SEQ ID NO: 1043907 - protein, 9 aa, Homo Sapiens
LSVGFKLLR

SEQ ID NO: 1043908 - protein, 9 aa, Homo Sapiens
NLVLIYLIK

SEQ ID NO: 1043909 - protein, 9 aa, Homo Sapiens
ENNCVYQSL

SEQ ID NO: 1043910 - protein, 9 aa, Homo Sapiens
DLLFVTLSY

SEQ ID NO: 1043911 - protein, 9 aa, Homo Sapiens
IYLADFPKK

SEQ ID NO: 1043912 - protein, 9 aa, Homo Sapiens
SKFFLEEAN

SEQ ID NO: 1043913 - protein, 9 aa, Homo Sapiens
NPDEEVQGE

SEQ ID NO: 1043914 - protein, 9 aa, Homo Sapiens
KLGGIMGQE

SEQ ID NO: 1043915 - protein, 9 aa, Homo Sapiens
ENFFVNCSL

SEQ ID NO: 1043916 - protein, 9 aa, Homo Sapiens
PHNSGRPIE

SEQ ID NO: 1043917 - protein, 9 aa, Homo Sapiens
SHLGLPKKM

SEQ ID NO: 1043918 - protein, 9 aa, Homo Sapiens
EVQLQLQAA

SEQ ID NO: 1043919 - protein, 9 aa, Homo Sapiens
QFRKRCEEL

SEQ ID NO: 1043920 - protein, 9 aa, Homo Sapiens
GPCRWPLPQ

SEQ ID NO: 1043921 - protein, 9 aa, Homo Sapiens
CGQDFQCKK

SEQ ID NO: 1043922 - protein, 9 aa, Homo Sapiens
STCDAIDGF

SEQ ID NO: 1043923 - protein, 9 aa, Homo Sapiens
LEEMGLILG

SEQ ID NO: 1043924 - protein, 9 aa, Homo Sapiens
RSVMYHINL

SEQ ID NO: 1043925 - protein, 9 aa, Homo Sapiens
DGEEKRCAL

SEQ ID NO: 1043926 - protein, 9 aa, Homo Sapiens
DSRFSLEGA

SEQ ID NO: 1043927 - protein, 9 aa, Homo Sapiens
SAHRRVHTE

SEQ ID NO: 1043928 - protein, 9 aa, Homo Sapiens
CHPLDLGGL

SEQ ID NO: 1043929 - protein, 9 aa, Homo Sapiens
DNYQVVTTS

SEQ ID NO: 1043930 - protein, 9 aa, Homo Sapiens
GETWESLTI

SEQ ID NO: 1043931 - protein, 9 aa, Homo Sapiens
PDCVPCNCD

SEQ ID NO: 1043932 - protein, 9 aa, Homo Sapiens
RVGGEKGPG

SEQ ID NO: 1043933 - protein, 9 aa, Homo Sapiens
GRASCAEGD

SEQ ID NO: 1043934 - protein, 9 aa, Homo Sapiens
SRQPIFLTK

SEQ ID NO: 1043935 - protein, 9 aa, Homo Sapiens
HRAILDTWL

SEQ ID NO: 1043936 - protein, 9 aa, Homo Sapiens
EKMEFHLIP

SEQ ID NO: 1043937 - protein, 9 aa, Homo Sapiens
VLTYRKQFL

SEQ ID NO: 1043938 - protein, 9 aa, Homo Sapiens
EIRGLITVS

SEQ ID NO: 1043939 - protein, 9 aa, Homo Sapiens
PLQCYESIG

SEQ ID NO: 1043940 - protein, 9 aa, Homo Sapiens
EKKNTEETL

SEQ ID NO: 1043941 - protein, 9 aa, Homo Sapiens
VCGHGGQQT

SEQ ID NO: 1043942 - protein, 9 aa, Homo Sapiens
KIREDLIGM

SEQ ID NO: 1043943 - protein, 9 aa, Homo Sapiens
HSVAAGVAE

SEQ ID NO: 1043944 - protein, 9 aa, Homo Sapiens
MDCGSDGKL

SEQ ID NO: 1043945 - protein, 9 aa, Homo Sapiens
PGSSAHYGG

SEQ ID NO: 1043946 - protein, 9 aa, Homo Sapiens
RPRLAEPYV

SEQ ID NO: 1043947 - protein, 9 aa, Homo Sapiens
HYELLTNGY

SEQ ID NO: 1043948 - protein, 9 aa, Homo Sapiens
HLVQLGQTH

SEQ ID NO: 1043949 - protein, 9 aa, Homo Sapiens
TQLFTKHFF

SEQ ID NO: 1043950 - protein, 9 aa, Homo Sapiens
CVCQRGMFN

SEQ ID NO: 1043951 - protein, 9 aa, Homo Sapiens
NFLLVLGGE

SEQ ID NO: 1043952 - protein, 9 aa, Homo Sapiens
APPLPPGPP

SEQ ID NO: 1043953 - protein, 9 aa, Homo Sapiens
RIFSAGRKH

SEQ ID NO: 1043954 - protein, 9 aa, Homo Sapiens
TSQLPQHLQ

SEQ ID NO: 1043955 - protein, 9 aa, Homo Sapiens
GKMMMKYRD

SEQ ID NO: 1043956 - protein, 9 aa, Homo Sapiens
GRPIELQIP

SEQ ID NO: 1043957 - protein, 9 aa, Homo Sapiens
PGRRIREKL

SEQ ID NO: 1043958 - protein, 9 aa, Homo Sapiens
RYLPATVES

SEQ ID NO: 1043959 - protein, 9 aa, Homo Sapiens
PVPDSPDFE

SEQ ID NO: 1043960 - protein, 9 aa, Homo Sapiens
DLQELRGWA

SEQ ID NO: 1043961 - protein, 9 aa, Homo Sapiens
NNQENKILK

SEQ ID NO: 1043962 - protein, 9 aa, Homo Sapiens
EALQSLASS

SEQ ID NO: 1043963 - protein, 9 aa, Homo Sapiens
LLANQNNLM

SEQ ID NO: 1043964 - protein, 9 aa, Homo Sapiens
CGKAFWRGD

SEQ ID NO: 1043965 - protein, 9 aa, Homo Sapiens
YSLSCIRSQ

SEQ ID NO: 1043966 - protein, 9 aa, Homo Sapiens
PNFTESIPS

SEQ ID NO: 1043967 - protein, 9 aa, Homo Sapiens
ARGLAGPKR

SEQ ID NO: 1043968 - protein, 9 aa, Homo Sapiens
VALYYNVIF

SEQ ID NO: 1043969 - protein, 9 aa, Homo Sapiens
DDSAFIEPR

SEQ ID NO: 1043970 - protein, 9 aa, Homo Sapiens
FNNQENKIL

SEQ ID NO: 1043971 - protein, 9 aa, Homo Sapiens
STRARFKLP

SEQ ID NO: 1043972 - protein, 9 aa, Homo Sapiens
INAREEWKT

SEQ ID NO: 1043973 - protein, 9 aa, Homo Sapiens
VFMINRYLQ

SEQ ID NO: 1043974 - protein, 9 aa, Homo Sapiens
FTIDPISGK

SEQ ID NO: 1043975 - protein, 9 aa, Homo Sapiens
KSCMGLKIE

SEQ ID NO: 1043976 - protein, 9 aa, Homo Sapiens
ALTRGILYQ

SEQ ID NO: 1043977 - protein, 9 aa, Homo Sapiens
EACYKCKIN

SEQ ID NO: 1043978 - protein, 9 aa, Homo Sapiens
HSLRTPRSL

SEQ ID NO: 1043979 - protein, 9 aa, Homo Sapiens
STSVHDSPG

SEQ ID NO: 1043980 - protein, 9 aa, Homo Sapiens
QERRFTIIS

SEQ ID NO: 1043981 - protein, 9 aa, Homo Sapiens
KKEMNFFQQ

SEQ ID NO: 1043982 - protein, 9 aa, Homo Sapiens
SKYNPQLSL

SEQ ID NO: 1043983 - protein, 9 aa, Homo Sapiens
KVAPDGPLQ

SEQ ID NO: 1043984 - protein, 9 aa, Homo Sapiens
KGLPRPLPL

SEQ ID NO: 1043985 - protein, 9 aa, Homo Sapiens
PTDPMLRRR

SEQ ID NO: 1043986 - protein, 9 aa, Homo Sapiens
VKDGTASDP

SEQ ID NO: 1043987 - protein, 9 aa, Homo Sapiens
AYDSEAASA

SEQ ID NO: 1043988 - protein, 9 aa, Homo Sapiens
SGVYPLKKA

SEQ ID NO: 1043989 - protein, 9 aa, Homo Sapiens
DVKRGSKAS

SEQ ID NO: 1043990 - protein, 9 aa, Homo Sapiens
TRGGWQSEA

SEQ ID NO: 1043991 - protein, 9 aa, Homo Sapiens
IMLVATTMF

SEQ ID NO: 1043992 - protein, 9 aa, Homo Sapiens
IQMLLSELF

SEQ ID NO: 1043993 - protein, 9 aa, Homo Sapiens
KTRDLVRLH

SEQ ID NO: 1043994 - protein, 9 aa, Homo Sapiens
PRFFSSPRD

SEQ ID NO: 1043995 - protein, 9 aa, Homo Sapiens
PSHLSRVQD

SEQ ID NO: 1043996 - protein, 9 aa, Homo Sapiens
SSWFIIQKN

SEQ ID NO: 1043997 - protein, 9 aa, Homo Sapiens
QDSGGSSTP

SEQ ID NO: 1043998 - protein, 9 aa, Homo Sapiens
FCSVSISHV

SEQ ID NO: 1043999 - protein, 9 aa, Homo Sapiens
TASDPSGLP

SEQ ID NO: 1044000 - protein, 9 aa, Homo Sapiens
FHVGQTVGV

SEQ ID NO: 1044001 - protein, 9 aa, Homo Sapiens
KAFCSGSDL

SEQ ID NO: 1044002 - protein, 9 aa, Homo Sapiens
PGTASSPGA

SEQ ID NO: 1044003 - protein, 9 aa, Homo Sapiens
HIDRVLDAT

SEQ ID NO: 1044004 - protein, 9 aa, Homo Sapiens
RPFGGHFQG

SEQ ID NO: 1044005 - protein, 9 aa, Homo Sapiens
TINWTDWNT

SEQ ID NO: 1044006 - protein, 9 aa, Homo Sapiens
ASISRNILW

SEQ ID NO: 1044007 - protein, 9 aa, Homo Sapiens
KPKSKLSVK

SEQ ID NO: 1044008 - protein, 9 aa, Homo Sapiens
AEMIETKSF

SEQ ID NO: 1044009 - protein, 9 aa, Homo Sapiens
PLMFIIFCY

SEQ ID NO: 1044010 - protein, 9 aa, Homo Sapiens
CYYYYRKPQ

SEQ ID NO: 1044011 - protein, 9 aa, Homo Sapiens
AKVDALNDK

SEQ ID NO: 1044012 - protein, 9 aa, Homo Sapiens
VTSTLDLDL

SEQ ID NO: 1044013 - protein, 9 aa, Homo Sapiens
LSNGIFDLF

SEQ ID NO: 1044014 - protein, 9 aa, Homo Sapiens
CIIGSKKKF

SEQ ID NO: 1044015 - protein, 9 aa, Homo Sapiens
KFIWSTRRS

SEQ ID NO: 1044016 - protein, 9 aa, Homo Sapiens
TSVHDSPGK

SEQ ID NO: 1044017 - protein, 9 aa, Homo Sapiens
LNEKAVIFI

SEQ ID NO: 1044018 - protein, 9 aa, Homo Sapiens
EENEGEAEK

SEQ ID NO: 1044019 - protein, 9 aa, Homo Sapiens
QQVSGPVST

SEQ ID NO: 1044020 - protein, 9 aa, Homo Sapiens
PPPPSAPPL

SEQ ID NO: 1044021 - protein, 9 aa, Homo Sapiens
LQTVSGQCL

SEQ ID NO: 1044022 - protein, 9 aa, Homo Sapiens
ATAALTRTA

SEQ ID NO: 1044023 - protein, 9 aa, Homo Sapiens
YNSLSKLRA

SEQ ID NO: 1044024 - protein, 9 aa, Homo Sapiens
ATTMFILTP

SEQ ID NO: 1044025 - protein, 9 aa, Homo Sapiens
RRKFGDNYQ

SEQ ID NO: 1044026 - protein, 9 aa, Homo Sapiens
GCPDGNLQS

SEQ ID NO: 1044027 - protein, 9 aa, Homo Sapiens
GSVNKADYR

SEQ ID NO: 1044028 - protein, 9 aa, Homo Sapiens
ERNKINFFN

SEQ ID NO: 1044029 - protein, 9 aa, Homo Sapiens
MENNCPSDD

SEQ ID NO: 1044030 - protein, 9 aa, Homo Sapiens
ISWMETSVS

SEQ ID NO: 1044031 - protein, 9 aa, Homo Sapiens
MERDPWISH

SEQ ID NO: 1044032 - protein, 9 aa, Homo Sapiens
EVDRTKFEQ

SEQ ID NO: 1044033 - protein, 9 aa, Homo Sapiens
ECDFHPLPP

SEQ ID NO: 1044034 - protein, 9 aa, Homo Sapiens
DGGWTEERR

SEQ ID NO: 1044035 - protein, 9 aa, Homo Sapiens
PSGEETLSV

SEQ ID NO: 1044036 - protein, 9 aa, Homo Sapiens
PLECPALPI

SEQ ID NO: 1044037 - protein, 9 aa, Homo Sapiens
RNHIDRVLD

SEQ ID NO: 1044038 - protein, 9 aa, Homo Sapiens
FLHLLSSHS

SEQ ID NO: 1044039 - protein, 9 aa, Homo Sapiens
PLAGEKLVE

SEQ ID NO: 1044040 - protein, 9 aa, Homo Sapiens
VIQHCEDGS

SEQ ID NO: 1044041 - protein, 9 aa, Homo Sapiens
CVTMGLDGA

SEQ ID NO: 1044042 - protein, 9 aa, Homo Sapiens
HGGCVNGQC

SEQ ID NO: 1044043 - protein, 9 aa, Homo Sapiens
SALASDFIG

SEQ ID NO: 1044044 - protein, 9 aa, Homo Sapiens
MHTSDTQWG

SEQ ID NO: 1044045 - protein, 9 aa, Homo Sapiens
VTFFLFYLL

SEQ ID NO: 1044046 - protein, 9 aa, Homo Sapiens
LDINGVTLK

SEQ ID NO: 1044047 - protein, 9 aa, Homo Sapiens
IPSGGTECF

SEQ ID NO: 1044048 - protein, 9 aa, Homo Sapiens
FYSHFPCTV

SEQ ID NO: 1044049 - protein, 9 aa, Homo Sapiens
YRNAEKNFH

SEQ ID NO: 1044050 - protein, 9 aa, Homo Sapiens
NRYLQRHVK

SEQ ID NO: 1044051 - protein, 9 aa, Homo Sapiens
RLLNEDHTG

SEQ ID NO: 1044052 - protein, 9 aa, Homo Sapiens
RHRYYAVDK

SEQ ID NO: 1044053 - protein, 9 aa, Homo Sapiens
SSGNLKQLL

SEQ ID NO: 1044054 - protein, 9 aa, Homo Sapiens
CKYLFSAFM

SEQ ID NO: 1044055 - protein, 9 aa, Homo Sapiens
ESNTVLSKV

SEQ ID NO: 1044056 - protein, 9 aa, Homo Sapiens
HYHGMCLNI

SEQ ID NO: 1044057 - protein, 9 aa, Homo Sapiens
VYGFKLQNL

SEQ ID NO: 1044058 - protein, 9 aa, Homo Sapiens
RGSPPPARK

SEQ ID NO: 1044059 - protein, 9 aa, Homo Sapiens
NLGVLMCIK

SEQ ID NO: 1044060 - protein, 9 aa, Homo Sapiens
MVRSRGSGG

SEQ ID NO: 1044061 - protein, 9 aa, Homo Sapiens
AIFCVAGGW

SEQ ID NO: 1044062 - protein, 9 aa, Homo Sapiens
HQAPLSSPV

SEQ ID NO: 1044063 - protein, 9 aa, Homo Sapiens
WNLTNNVLA

SEQ ID NO: 1044064 - protein, 9 aa, Homo Sapiens
YADHSRLSV

SEQ ID NO: 1044065 - protein, 9 aa, Homo Sapiens
NFKKWVGAP

SEQ ID NO: 1044066 - protein, 9 aa, Homo Sapiens
IGSSNRNLV

SEQ ID NO: 1044067 - protein, 9 aa, Homo Sapiens
AGAAEADGP

SEQ ID NO: 1044068 - protein, 9 aa, Homo Sapiens
KLGLMFDNV

SEQ ID NO: 1044069 - protein, 9 aa, Homo Sapiens
PLCLAVEGR

SEQ ID NO: 1044070 - protein, 9 aa, Homo Sapiens
PFCPPPITP

SEQ ID NO: 1044071 - protein, 9 aa, Homo Sapiens
VSVARSAAE

SEQ ID NO: 1044072 - protein, 9 aa, Homo Sapiens
VLQRGQQLM

SEQ ID NO: 1044073 - protein, 9 aa, Homo Sapiens
KDGLIICKP

SEQ ID NO: 1044074 - protein, 9 aa, Homo Sapiens
LLQPKRQRL

SEQ ID NO: 1044075 - protein, 9 aa, Homo Sapiens
SSCKQFVIG

SEQ ID NO: 1044076 - protein, 9 aa, Homo Sapiens
TCLRAQPVT

SEQ ID NO: 1044077 - protein, 9 aa, Homo Sapiens
ALRPAPGHA

SEQ ID NO: 1044078 - protein, 9 aa, Homo Sapiens
SIARQKQIL

SEQ ID NO: 1044079 - protein, 9 aa, Homo Sapiens
ARLPPALRP

SEQ ID NO: 1044080 - protein, 9 aa, Homo Sapiens
GLVNFAVPM

SEQ ID NO: 1044081 - protein, 9 aa, Homo Sapiens
EFFQFPHGQ

SEQ ID NO: 1044082 - protein, 9 aa, Homo Sapiens
WGQEKEHSF

SEQ ID NO: 1044083 - protein, 9 aa, Homo Sapiens
NFDVFAADI

SEQ ID NO: 1044084 - protein, 9 aa, Homo Sapiens
NETLFTIVG

SEQ ID NO: 1044085 - protein, 9 aa, Homo Sapiens
YLSDTLPQK

SEQ ID NO: 1044086 - protein, 9 aa, Homo Sapiens
SNRVDLYHE

SEQ ID NO: 1044087 - protein, 9 aa, Homo Sapiens
RQTWIDKGL

SEQ ID NO: 1044088 - protein, 9 aa, Homo Sapiens
DKWTDKEKA

SEQ ID NO: 1044089 - protein, 9 aa, Homo Sapiens
KECEKAFCS

SEQ ID NO: 1044090 - protein, 9 aa, Homo Sapiens
ESSLVSTAW

SEQ ID NO: 1044091 - protein, 9 aa, Homo Sapiens
RLLSRKRAA

SEQ ID NO: 1044092 - protein, 9 aa, Homo Sapiens
RTKIKVTLG

SEQ ID NO: 1044093 - protein, 9 aa, Homo Sapiens
GMLIELSAI

SEQ ID NO: 1044094 - protein, 9 aa, Homo Sapiens
IAEALYSVL

SEQ ID NO: 1044095 - protein, 9 aa, Homo Sapiens
LQFQARMWR

SEQ ID NO: 1044096 - protein, 9 aa, Homo Sapiens
SIPSCETPK

SEQ ID NO: 1044097 - protein, 9 aa, Homo Sapiens
LQTVCLRGP

SEQ ID NO: 1044098 - protein, 9 aa, Homo Sapiens
TYLYREPVL

SEQ ID NO: 1044099 - protein, 9 aa, Homo Sapiens
ELPLRNLRR

SEQ ID NO: 1044100 - protein, 9 aa, Homo Sapiens
APLFMDCGS

SEQ ID NO: 1044101 - protein, 9 aa, Homo Sapiens
QAPELPKGM

SEQ ID NO: 1044102 - protein, 9 aa, Homo Sapiens
YPGVPPKGV

SEQ ID NO: 1044103 - protein, 9 aa, Homo Sapiens
AVLAKYFSG

SEQ ID NO: 1044104 - protein, 9 aa, Homo Sapiens
EEEALQSLA

SEQ ID NO: 1044105 - protein, 9 aa, Homo Sapiens
SAFFVADKV

SEQ ID NO: 1044106 - protein, 9 aa, Homo Sapiens
PLKKASGCP

SEQ ID NO: 1044107 - protein, 9 aa, Homo Sapiens
PQQLLLVHQ

SEQ ID NO: 1044108 - protein, 9 aa, Homo Sapiens
EANVSQLAT

SEQ ID NO: 1044109 - protein, 9 aa, Homo Sapiens
LVQHRRIHR

SEQ ID NO: 1044110 - protein, 9 aa, Homo Sapiens
YLLYIVVSV

SEQ ID NO: 1044111 - protein, 9 aa, Homo Sapiens
GAARATAAL

SEQ ID NO: 1044112 - protein, 9 aa, Homo Sapiens
KEKAHKGNG

SEQ ID NO: 1044113 - protein, 9 aa, Homo Sapiens
FSVSTTGTA

SEQ ID NO: 1044114 - protein, 9 aa, Homo Sapiens
SVARSAAES

SEQ ID NO: 1044115 - protein, 9 aa, Homo Sapiens
FIVLLSVYM

SEQ ID NO: 1044116 - protein, 9 aa, Homo Sapiens
LQPCRLGGG

SEQ ID NO: 1044117 - protein, 9 aa, Homo Sapiens
MNFFQQQPP

SEQ ID NO: 1044118 - protein, 9 aa, Homo Sapiens
LFGPLLAVP

SEQ ID NO: 1044119 - protein, 9 aa, Homo Sapiens
SNQYFAHFC

SEQ ID NO: 1044120 - protein, 9 aa, Homo Sapiens
QPRLRNKVK

SEQ ID NO: 1044121 - protein, 9 aa, Homo Sapiens
KIPKLRRRG

SEQ ID NO: 1044122 - protein, 9 aa, Homo Sapiens
LETDLQNLE

SEQ ID NO: 1044123 - protein, 9 aa, Homo Sapiens
AHHGQERRF

SEQ ID NO: 1044124 - protein, 9 aa, Homo Sapiens
MNTDPMAQC

SEQ ID NO: 1044125 - protein, 9 aa, Homo Sapiens
NTFKYSQGQ

SEQ ID NO: 1044126 - protein, 9 aa, Homo Sapiens
LMAFPITSI

SEQ ID NO: 1044127 - protein, 9 aa, Homo Sapiens
FFQDQAPTC

SEQ ID NO: 1044128 - protein, 9 aa, Homo Sapiens
EVPLKNQEV

SEQ ID NO: 1044129 - protein, 9 aa, Homo Sapiens
YFFDRHPEA

SEQ ID NO: 1044130 - protein, 9 aa, Homo Sapiens
SSHIKKTEK

SEQ ID NO: 1044131 - protein, 9 aa, Homo Sapiens
NFTTPQDGD

SEQ ID NO: 1044132 - protein, 9 aa, Homo Sapiens
LAESEEFNA

SEQ ID NO: 1044133 - protein, 9 aa, Homo Sapiens
LGLETDLQN

SEQ ID NO: 1044134 - protein, 9 aa, Homo Sapiens
GAEALRLLV

SEQ ID NO: 1044135 - protein, 9 aa, Homo Sapiens
KTGRCLKRH

SEQ ID NO: 1044136 - protein, 9 aa, Homo Sapiens
HHRLHAQKG

SEQ ID NO: 1044137 - protein, 9 aa, Homo Sapiens
LMAKYHRKL

SEQ ID NO: 1044138 - protein, 9 aa, Homo Sapiens
TGVSHYATN

SEQ ID NO: 1044139 - protein, 9 aa, Homo Sapiens
KVEVTNMIE

SEQ ID NO: 1044140 - protein, 9 aa, Homo Sapiens
QKLKCLSGQ

SEQ ID NO: 1044141 - protein, 9 aa, Homo Sapiens
FLEGFYDES

SEQ ID NO: 1044142 - protein, 9 aa, Homo Sapiens
IYARQAYDL

SEQ ID NO: 1044143 - protein, 9 aa, Homo Sapiens
RQEMPYIDA

SEQ ID NO: 1044144 - protein, 9 aa, Homo Sapiens
SEVSWGDFE

SEQ ID NO: 1044145 - protein, 9 aa, Homo Sapiens
LLQEIEATN

SEQ ID NO: 1044146 - protein, 9 aa, Homo Sapiens
FSIPQTAKM

SEQ ID NO: 1044147 - protein, 9 aa, Homo Sapiens
RDLQELRGW

SEQ ID NO: 1044148 - protein, 9 aa, Homo Sapiens
SRGGRAPAP

SEQ ID NO: 1044149 - protein, 9 aa, Homo Sapiens
KIYAGKKFY

SEQ ID NO: 1044150 - protein, 9 aa, Homo Sapiens
GYTYETQWP

SEQ ID NO: 1044151 - protein, 9 aa, Homo Sapiens
WRQKEKIRE

SEQ ID NO: 1044152 - protein, 9 aa, Homo Sapiens
FYLIVARKN

SEQ ID NO: 1044153 - protein, 9 aa, Homo Sapiens
PRYLGGPLP

SEQ ID NO: 1044154 - protein, 9 aa, Homo Sapiens
LRAQPVTDL

SEQ ID NO: 1044155 - protein, 9 aa, Homo Sapiens
ELEVLKILK

SEQ ID NO: 1044156 - protein, 9 aa, Homo Sapiens
DHWDKVKEE

SEQ ID NO: 1044157 - protein, 9 aa, Homo Sapiens
VSGQCLGEE

SEQ ID NO: 1044158 - protein, 9 aa, Homo Sapiens
KAIPEKYGV

SEQ ID NO: 1044159 - protein, 9 aa, Homo Sapiens
GWAHLTEVN

SEQ ID NO: 1044160 - protein, 9 aa, Homo Sapiens
VHTGGANSA

SEQ ID NO: 1044161 - protein, 9 aa, Homo Sapiens
VGFKLLRKM

SEQ ID NO: 1044162 - protein, 9 aa, Homo Sapiens
KGYCNPGIY

SEQ ID NO: 1044163 - protein, 9 aa, Homo Sapiens
VEKPSFEKP

SEQ ID NO: 1044164 - protein, 9 aa, Homo Sapiens
KGLSGSQTQ

SEQ ID NO: 1044165 - protein, 9 aa, Homo Sapiens
QFQAFCLVL

SEQ ID NO: 1044166 - protein, 9 aa, Homo Sapiens
SCVKISFSP

SEQ ID NO: 1044167 - protein, 9 aa, Homo Sapiens
YLKNGYNQN

SEQ ID NO: 1044168 - protein, 9 aa, Homo Sapiens
LQDGYHKSF

SEQ ID NO: 1044169 - protein, 9 aa, Homo Sapiens
SELIFVSHP

SEQ ID NO: 1044170 - protein, 9 aa, Homo Sapiens
KNRASPAVA

SEQ ID NO: 1044171 - protein, 9 aa, Homo Sapiens
AQALLEAEE

SEQ ID NO: 1044172 - protein, 9 aa, Homo Sapiens
SKSGSCSSR

SEQ ID NO: 1044173 - protein, 9 aa, Homo Sapiens
NMDNENATD

SEQ ID NO: 1044174 - protein, 9 aa, Homo Sapiens
APLAGQPQG

SEQ ID NO: 1044175 - protein, 9 aa, Homo Sapiens
KLLPRHRNK

SEQ ID NO: 1044176 - protein, 9 aa, Homo Sapiens
ELPKGMDTT

SEQ ID NO: 1044177 - protein, 9 aa, Homo Sapiens
KFDREFWKE

SEQ ID NO: 1044178 - protein, 9 aa, Homo Sapiens
TDQIRKFQR

SEQ ID NO: 1044179 - protein, 9 aa, Homo Sapiens
AKVTPGLTC

SEQ ID NO: 1044180 - protein, 9 aa, Homo Sapiens
IVLNLNLVI

SEQ ID NO: 1044181 - protein, 9 aa, Homo Sapiens
SRKRAAPCG

SEQ ID NO: 1044182 - protein, 9 aa, Homo Sapiens
AMKKDLAEW

SEQ ID NO: 1044183 - protein, 9 aa, Homo Sapiens
DLLALTSVA

SEQ ID NO: 1044184 - protein, 9 aa, Homo Sapiens
FTAGQESSI

SEQ ID NO: 1044185 - protein, 9 aa, Homo Sapiens
SIPQTAKMC

SEQ ID NO: 1044186 - protein, 9 aa, Homo Sapiens
DEAANINDM

SEQ ID NO: 1044187 - protein, 9 aa, Homo Sapiens
MRNFTAVTD

SEQ ID NO: 1044188 - protein, 9 aa, Homo Sapiens
FLASLVLCG

SEQ ID NO: 1044189 - protein, 9 aa, Homo Sapiens
TIFHVGRFH

SEQ ID NO: 1044190 - protein, 9 aa, Homo Sapiens
FHVTSKFFL

SEQ ID NO: 1044191 - protein, 9 aa, Homo Sapiens
LFAWAVRSV

SEQ ID NO: 1044192 - protein, 9 aa, Homo Sapiens
PYISSDGES

SEQ ID NO: 1044193 - protein, 9 aa, Homo Sapiens
KNKLSPPGI

SEQ ID NO: 1044194 - protein, 9 aa, Homo Sapiens
QSTEASVLA

SEQ ID NO: 1044195 - protein, 9 aa, Homo Sapiens
YSCRQFSSP

SEQ ID NO: 1044196 - protein, 9 aa, Homo Sapiens
EKIDLEEKL

SEQ ID NO: 1044197 - protein, 9 aa, Homo Sapiens
EEKGNANLT

SEQ ID NO: 1044198 - protein, 9 aa, Homo Sapiens
LFQEVPKQR

SEQ ID NO: 1044199 - protein, 9 aa, Homo Sapiens
EATDNNDIY

SEQ ID NO: 1044200 - protein, 9 aa, Homo Sapiens
AHWGRYRPS

SEQ ID NO: 1044201 - protein, 9 aa, Homo Sapiens
ADLPQQLLL

SEQ ID NO: 1044202 - protein, 9 aa, Homo Sapiens
GAAEADGPD

SEQ ID NO: 1044203 - protein, 9 aa, Homo Sapiens
VLAALEARL

SEQ ID NO: 1044204 - protein, 9 aa, Homo Sapiens
EVFPSKAER

SEQ ID NO: 1044205 - protein, 9 aa, Homo Sapiens
DLLQPLLEN

SEQ ID NO: 1044206 - protein, 9 aa, Homo Sapiens
CQKNCPERH

SEQ ID NO: 1044207 - protein, 9 aa, Homo Sapiens
GISRGTMRR

SEQ ID NO: 1044208 - protein, 9 aa, Homo Sapiens
AYGSCTCLR

SEQ ID NO: 1044209 - protein, 9 aa, Homo Sapiens
LPATPKTFA

SEQ ID NO: 1044210 - protein, 9 aa, Homo Sapiens
YERVLHIRK

SEQ ID NO: 1044211 - protein, 9 aa, Homo Sapiens
PPPEKPQGP

SEQ ID NO: 1044212 - protein, 9 aa, Homo Sapiens
QGCAEEKAL

SEQ ID NO: 1044213 - protein, 9 aa, Homo Sapiens
RNLHLTSVT

SEQ ID NO: 1044214 - protein, 9 aa, Homo Sapiens
KTKKHPKSL

SEQ ID NO: 1044215 - protein, 9 aa, Homo Sapiens
QEAGYFTHM

SEQ ID NO: 1044216 - protein, 9 aa, Homo Sapiens
SFFRRHLPR

SEQ ID NO: 1044217 - protein, 9 aa, Homo Sapiens
VNGKWQEFR

SEQ ID NO: 1044218 - protein, 9 aa, Homo Sapiens
AGPLCQWSR

SEQ ID NO: 1044219 - protein, 9 aa, Homo Sapiens
WDYRWDLTL

SEQ ID NO: 1044220 - protein, 9 aa, Homo Sapiens
GTKARFLLR

SEQ ID NO: 1044221 - protein, 9 aa, Homo Sapiens
VGSDDRFSF

SEQ ID NO: 1044222 - protein, 9 aa, Homo Sapiens
FQQPMLVSV

SEQ ID NO: 1044223 - protein, 9 aa, Homo Sapiens
MTPAFAGTY

SEQ ID NO: 1044224 - protein, 9 aa, Homo Sapiens
LYLSDTLPQ

SEQ ID NO: 1044225 - protein, 9 aa, Homo Sapiens
YIIFFVLVI

SEQ ID NO: 1044226 - protein, 9 aa, Homo Sapiens
ERVLHIRKL

SEQ ID NO: 1044227 - protein, 9 aa, Homo Sapiens
MSIEKVERI

SEQ ID NO: 1044228 - protein, 9 aa, Homo Sapiens
QRDFLQSHI

SEQ ID NO: 1044229 - protein, 9 aa, Homo Sapiens
RPLPTPSHL

SEQ ID NO: 1044230 - protein, 9 aa, Homo Sapiens
LRAKPGTAW

SEQ ID NO: 1044231 - protein, 9 aa, Homo Sapiens
KYNEKFVSV

SEQ ID NO: 1044232 - protein, 9 aa, Homo Sapiens
SRVWEQGGV

SEQ ID NO: 1044233 - protein, 9 aa, Homo Sapiens
KIIDHISCE

SEQ ID NO: 1044234 - protein, 9 aa, Homo Sapiens
TVLAQLEKI

SEQ ID NO: 1044235 - protein, 9 aa, Homo Sapiens
MRKISSSNS

SEQ ID NO: 1044236 - protein, 9 aa, Homo Sapiens
LSEKDMIRQ

SEQ ID NO: 1044237 - protein, 9 aa, Homo Sapiens
VMEELPGER

SEQ ID NO: 1044238 - protein, 9 aa, Homo Sapiens
APPGPPEPP

SEQ ID NO: 1044239 - protein, 9 aa, Homo Sapiens
SGNQRIKVL

SEQ ID NO: 1044240 - protein, 9 aa, Homo Sapiens
QAKLSRTGR

SEQ ID NO: 1044241 - protein, 9 aa, Homo Sapiens
ALCRKDLSL

SEQ ID NO: 1044242 - protein, 9 aa, Homo Sapiens
TGFGQCLCE

SEQ ID NO: 1044243 - protein, 9 aa, Homo Sapiens
DYPVISCAK

SEQ ID NO: 1044244 - protein, 9 aa, Homo Sapiens
LPESVDVDE

SEQ ID NO: 1044245 - protein, 9 aa, Homo Sapiens
LISRRHFWT

SEQ ID NO: 1044246 - protein, 9 aa, Homo Sapiens
ETCLCVTST

SEQ ID NO: 1044247 - protein, 9 aa, Homo Sapiens
RHCHPLDLG

SEQ ID NO: 1044248 - protein, 9 aa, Homo Sapiens
NFFVNCSLP

SEQ ID NO: 1044249 - protein, 9 aa, Homo Sapiens
GLIWVLAAT

SEQ ID NO: 1044250 - protein, 9 aa, Homo Sapiens
YNFVGNIRL

SEQ ID NO: 1044251 - protein, 9 aa, Homo Sapiens
KFEKLLHQE

SEQ ID NO: 1044252 - protein, 9 aa, Homo Sapiens
MCAWDAWIR

SEQ ID NO: 1044253 - protein, 9 aa, Homo Sapiens
CFEWKPASS

SEQ ID NO: 1044254 - protein, 9 aa, Homo Sapiens
SVVHTGGAN

SEQ ID NO: 1044255 - protein, 9 aa, Homo Sapiens
WELYIPSGE

SEQ ID NO: 1044256 - protein, 9 aa, Homo Sapiens
SPGRKPVDT

SEQ ID NO: 1044257 - protein, 9 aa, Homo Sapiens
KIPRTVPVL

SEQ ID NO: 1044258 - protein, 9 aa, Homo Sapiens
GGVKPFKLH

SEQ ID NO: 1044259 - protein, 9 aa, Homo Sapiens
RSSHLENRA

SEQ ID NO: 1044260 - protein, 9 aa, Homo Sapiens
EFMKSKSDI

SEQ ID NO: 1044261 - protein, 9 aa, Homo Sapiens
SNLYFYRDS

SEQ ID NO: 1044262 - protein, 9 aa, Homo Sapiens
SPEDSSIYF

SEQ ID NO: 1044263 - protein, 9 aa, Homo Sapiens
QMAANLLAS

SEQ ID NO: 1044264 - protein, 9 aa, Homo Sapiens
CPFGFFTDA

SEQ ID NO: 1044265 - protein, 9 aa, Homo Sapiens
FISLKRNLQ

SEQ ID NO: 1044266 - protein, 9 aa, Homo Sapiens
LQIRYSLGG

SEQ ID NO: 1044267 - protein, 9 aa, Homo Sapiens
YGFLSELPA

SEQ ID NO: 1044268 - protein, 9 aa, Homo Sapiens
MIESLFYTV

SEQ ID NO: 1044269 - protein, 9 aa, Homo Sapiens
KQEGCHTTS

SEQ ID NO: 1044270 - protein, 9 aa, Homo Sapiens
NQYFAHFCY

SEQ ID NO: 1044271 - protein, 9 aa, Homo Sapiens
NWSPVMPRE

SEQ ID NO: 1044272 - protein, 9 aa, Homo Sapiens
QAPVASRQK

SEQ ID NO: 1044273 - protein, 9 aa, Homo Sapiens
QGIRTLLFA

SEQ ID NO: 1044274 - protein, 9 aa, Homo Sapiens
YKKSNIDFL

SEQ ID NO: 1044275 - protein, 9 aa, Homo Sapiens
GTLYFNALF

SEQ ID NO: 1044276 - protein, 9 aa, Homo Sapiens
KNREFFNDL

SEQ ID NO: 1044277 - protein, 9 aa, Homo Sapiens
FKRNPGVKE

SEQ ID NO: 1044278 - protein, 9 aa, Homo Sapiens
PPLPPGPPP

SEQ ID NO: 1044279 - protein, 9 aa, Homo Sapiens
SHSLHGLVN

SEQ ID NO: 1044280 - protein, 9 aa, Homo Sapiens
SEAASAPGS

SEQ ID NO: 1044281 - protein, 9 aa, Homo Sapiens
CLRYPLSYK

SEQ ID NO: 1044282 - protein, 9 aa, Homo Sapiens
LERLIFSGH

SEQ ID NO: 1044283 - protein, 9 aa, Homo Sapiens
QLDTWSMGV

SEQ ID NO: 1044284 - protein, 9 aa, Homo Sapiens
KASTGKGRG

SEQ ID NO: 1044285 - protein, 9 aa, Homo Sapiens
KIYNIWHRR

SEQ ID NO: 1044286 - protein, 9 aa, Homo Sapiens
LEEEGRFFK

SEQ ID NO: 1044287 - protein, 9 aa, Homo Sapiens
PNGNQTFSG

SEQ ID NO: 1044288 - protein, 9 aa, Homo Sapiens
LEAQREALG

SEQ ID NO: 1044289 - protein, 9 aa, Homo Sapiens
SCEMQIVDC

SEQ ID NO: 1044290 - protein, 9 aa, Homo Sapiens
GVPGIDGIE

SEQ ID NO: 1044291 - protein, 9 aa, Homo Sapiens
KPGTAWLPG

SEQ ID NO: 1044292 - protein, 9 aa, Homo Sapiens
ILPLPDVPK

SEQ ID NO: 1044293 - protein, 9 aa, Homo Sapiens
QKAKRPQYC

SEQ ID NO: 1044294 - protein, 9 aa, Homo Sapiens
FQIATMLKK

SEQ ID NO: 1044295 - protein, 9 aa, Homo Sapiens
AVFVLGLAG

SEQ ID NO: 1044296 - protein, 9 aa, Homo Sapiens
PSSLRNRIV

SEQ ID NO: 1044297 - protein, 9 aa, Homo Sapiens
ECEKAFCSG

SEQ ID NO: 1044298 - protein, 9 aa, Homo Sapiens
VQGVWQKVS

SEQ ID NO: 1044299 - protein, 9 aa, Homo Sapiens
GNKNLLPFN

SEQ ID NO: 1044300 - protein, 9 aa, Homo Sapiens
DGIEGDRGP

SEQ ID NO: 1044301 - protein, 9 aa, Homo Sapiens
SSGRAGPFS

SEQ ID NO: 1044302 - protein, 9 aa, Homo Sapiens
QKFNIMEKN

SEQ ID NO: 1044303 - protein, 9 aa, Homo Sapiens
SPRSTGLFP

SEQ ID NO: 1044304 - protein, 9 aa, Homo Sapiens
ISFLSCIMQ

SEQ ID NO: 1044305 - protein, 9 aa, Homo Sapiens
KKEGSRDPA

SEQ ID NO: 1044306 - protein, 9 aa, Homo Sapiens
GKFYGNPMH

SEQ ID NO: 1044307 - protein, 9 aa, Homo Sapiens
SHGKSHPRK

SEQ ID NO: 1044308 - protein, 9 aa, Homo Sapiens
DYKFTEGTV

SEQ ID NO: 1044309 - protein, 9 aa, Homo Sapiens
AISVHGEST

SEQ ID NO: 1044310 - protein, 9 aa, Homo Sapiens
FLGDREKRM

SEQ ID NO: 1044311 - protein, 9 aa, Homo Sapiens
DSTFILLFY

SEQ ID NO: 1044312 - protein, 9 aa, Homo Sapiens
ETATTIAVL

SEQ ID NO: 1044313 - protein, 9 aa, Homo Sapiens
IMEMKHKFE

SEQ ID NO: 1044314 - protein, 9 aa, Homo Sapiens
LPLGPPPLC

SEQ ID NO: 1044315 - protein, 9 aa, Homo Sapiens
FYNCSCVKV

SEQ ID NO: 1044316 - protein, 9 aa, Homo Sapiens
GPDARADAR

SEQ ID NO: 1044317 - protein, 9 aa, Homo Sapiens
CPLVSIPSC

SEQ ID NO: 1044318 - protein, 9 aa, Homo Sapiens
FHPGGFLEG

SEQ ID NO: 1044319 - protein, 9 aa, Homo Sapiens
GTLGTTILV

SEQ ID NO: 1044320 - protein, 9 aa, Homo Sapiens
PKSRGGPNG

SEQ ID NO: 1044321 - protein, 9 aa, Homo Sapiens
LSKDDLKEI

SEQ ID NO: 1044322 - protein, 9 aa, Homo Sapiens
GSDTSILPG

SEQ ID NO: 1044323 - protein, 9 aa, Homo Sapiens
TTLWEVTVR

SEQ ID NO: 1044324 - protein, 9 aa, Homo Sapiens
QGLIWVLAA

SEQ ID NO: 1044325 - protein, 9 aa, Homo Sapiens
KKLAGQSRA

SEQ ID NO: 1044326 - protein, 9 aa, Homo Sapiens
VDCFIQLLK

SEQ ID NO: 1044327 - protein, 9 aa, Homo Sapiens
NNILFGKEY

SEQ ID NO: 1044328 - protein, 9 aa, Homo Sapiens
CPGDYLSPP

SEQ ID NO: 1044329 - protein, 9 aa, Homo Sapiens
NSKRALFTA

SEQ ID NO: 1044330 - protein, 9 aa, Homo Sapiens
LEEGEYLDW

SEQ ID NO: 1044331 - protein, 9 aa, Homo Sapiens
SRNIKPPFD

SEQ ID NO: 1044332 - protein, 9 aa, Homo Sapiens
NVDVSSFSS

SEQ ID NO: 1044333 - protein, 9 aa, Homo Sapiens
FVADKVIVT

SEQ ID NO: 1044334 - protein, 9 aa, Homo Sapiens
VVEVENFLL

SEQ ID NO: 1044335 - protein, 9 aa, Homo Sapiens
AAASSPSQP

SEQ ID NO: 1044336 - protein, 9 aa, Homo Sapiens
ELGQSTEVK

SEQ ID NO: 1044337 - protein, 9 aa, Homo Sapiens
TVPVLKMDA

SEQ ID NO: 1044338 - protein, 9 aa, Homo Sapiens
EKLSASEVE

SEQ ID NO: 1044339 - protein, 9 aa, Homo Sapiens
GLRPRLAEP

SEQ ID NO: 1044340 - protein, 9 aa, Homo Sapiens
PAVGESKKE

SEQ ID NO: 1044341 - protein, 9 aa, Homo Sapiens
VLAQLEKIE

SEQ ID NO: 1044342 - protein, 9 aa, Homo Sapiens
AQEEAPAQL

SEQ ID NO: 1044343 - protein, 9 aa, Homo Sapiens
GQEKQVQEA

SEQ ID NO: 1044344 - protein, 9 aa, Homo Sapiens
CWAVQLLLV

SEQ ID NO: 1044345 - protein, 9 aa, Homo Sapiens
FHSKWGTKG

SEQ ID NO: 1044346 - protein, 9 aa, Homo Sapiens
QFDSLMPSP

SEQ ID NO: 1044347 - protein, 9 aa, Homo Sapiens
TLSRPPNLP

SEQ ID NO: 1044348 - protein, 9 aa, Homo Sapiens
QAFCLVLFF

SEQ ID NO: 1044349 - protein, 9 aa, Homo Sapiens
GGRAPAPDP

SEQ ID NO: 1044350 - protein, 9 aa, Homo Sapiens
QNQTTPMLE

SEQ ID NO: 1044351 - protein, 9 aa, Homo Sapiens
HTNRSQELQ

SEQ ID NO: 1044352 - protein, 9 aa, Homo Sapiens
SSLLVPIQQ

SEQ ID NO: 1044353 - protein, 9 aa, Homo Sapiens
GKLGGIMGQ

SEQ ID NO: 1044354 - protein, 9 aa, Homo Sapiens
SQYKLTVSR

SEQ ID NO: 1044355 - protein, 9 aa, Homo Sapiens
EKYADSSGA

SEQ ID NO: 1044356 - protein, 9 aa, Homo Sapiens
SKTAGPLCQ

SEQ ID NO: 1044357 - protein, 9 aa, Homo Sapiens
WLRKVIYRG

SEQ ID NO: 1044358 - protein, 9 aa, Homo Sapiens
LWCRGPVHR

SEQ ID NO: 1044359 - protein, 9 aa, Homo Sapiens
SLLWKERRA

SEQ ID NO: 1044360 - protein, 9 aa, Homo Sapiens
LSSSPPRPY

SEQ ID NO: 1044361 - protein, 9 aa, Homo Sapiens
NLLASAPAA

SEQ ID NO: 1044362 - protein, 9 aa, Homo Sapiens
QTLSERPTA

SEQ ID NO: 1044363 - protein, 9 aa, Homo Sapiens
VRRARVVSK

SEQ ID NO: 1044364 - protein, 9 aa, Homo Sapiens
NDIEGINRK

SEQ ID NO: 1044365 - protein, 9 aa, Homo Sapiens
ILAAHSFVD

SEQ ID NO: 1044366 - protein, 9 aa, Homo Sapiens
TEGEIIILK

SEQ ID NO: 1044367 - protein, 9 aa, Homo Sapiens
PFSSIKNES

SEQ ID NO: 1044368 - protein, 9 aa, Homo Sapiens
KGKFYHFVK

SEQ ID NO: 1044369 - protein, 9 aa, Homo Sapiens
RGISSEIFH

SEQ ID NO: 1044370 - protein, 9 aa, Homo Sapiens
GQMCEWPQP

SEQ ID NO: 1044371 - protein, 9 aa, Homo Sapiens
TMHWAVSPT

SEQ ID NO: 1044372 - protein, 9 aa, Homo Sapiens
WTEERRAVA

SEQ ID NO: 1044373 - protein, 9 aa, Homo Sapiens
GRAPAPDPA

SEQ ID NO: 1044374 - protein, 9 aa, Homo Sapiens
EEPPDLSLD

SEQ ID NO: 1044375 - protein, 9 aa, Homo Sapiens
HGGNGTWRY

SEQ ID NO: 1044376 - protein, 9 aa, Homo Sapiens
IRKFQRHDL

SEQ ID NO: 1044377 - protein, 9 aa, Homo Sapiens
TKTGANLFN

SEQ ID NO: 1044378 - protein, 9 aa, Homo Sapiens
ERDPILAAH

SEQ ID NO: 1044379 - protein, 9 aa, Homo Sapiens
AQKLGSTTV

SEQ ID NO: 1044380 - protein, 9 aa, Homo Sapiens
LLSSEACYK

SEQ ID NO: 1044381 - protein, 9 aa, Homo Sapiens
PLPTPSHLQ

SEQ ID NO: 1044382 - protein, 9 aa, Homo Sapiens
EPSKNINTP

SEQ ID NO: 1044383 - protein, 9 aa, Homo Sapiens
SLSAPKGCE

SEQ ID NO: 1044384 - protein, 9 aa, Homo Sapiens
YLDDRNTFQ

SEQ ID NO: 1044385 - protein, 9 aa, Homo Sapiens
SVSHNLLDQ

SEQ ID NO: 1044386 - protein, 9 aa, Homo Sapiens
RFSLTCMVF

SEQ ID NO: 1044387 - protein, 9 aa, Homo Sapiens
QALSIKTSF

SEQ ID NO: 1044388 - protein, 9 aa, Homo Sapiens
LEASRKSSK

SEQ ID NO: 1044389 - protein, 9 aa, Homo Sapiens
TPLLFFQAT

SEQ ID NO: 1044390 - protein, 9 aa, Homo Sapiens
PPPCPGKPE

SEQ ID NO: 1044391 - protein, 9 aa, Homo Sapiens
PKIWVSYGR

SEQ ID NO: 1044392 - protein, 9 aa, Homo Sapiens
VSQRLEEMG

SEQ ID NO: 1044393 - protein, 9 aa, Homo Sapiens
GGQQTTPCL

SEQ ID NO: 1044394 - protein, 9 aa, Homo Sapiens
VDNDIDKFY

SEQ ID NO: 1044395 - protein, 9 aa, Homo Sapiens
TAARTARRS

SEQ ID NO: 1044396 - protein, 9 aa, Homo Sapiens
KRCEELRVE

SEQ ID NO: 1044397 - protein, 9 aa, Homo Sapiens
LVQEKYSKA

SEQ ID NO: 1044398 - protein, 9 aa, Homo Sapiens
YTCDIYKEL

SEQ ID NO: 1044399 - protein, 9 aa, Homo Sapiens
CGGSLISKQ

SEQ ID NO: 1044400 - protein, 9 aa, Homo Sapiens
IFVKRQMLY

SEQ ID NO: 1044401 - protein, 9 aa, Homo Sapiens
PVNGRLTAP

SEQ ID NO: 1044402 - protein, 9 aa, Homo Sapiens
RYLGILLQV

SEQ ID NO: 1044403 - protein, 9 aa, Homo Sapiens
ASKVVLMGT

SEQ ID NO: 1044404 - protein, 9 aa, Homo Sapiens
HAPSEFVDN

SEQ ID NO: 1044405 - protein, 9 aa, Homo Sapiens
SKPVRPMTW

SEQ ID NO: 1044406 - protein, 9 aa, Homo Sapiens
NVLFCLFIF

SEQ ID NO: 1044407 - protein, 9 aa, Homo Sapiens
VVQIFRIMQ

SEQ ID NO: 1044408 - protein, 9 aa, Homo Sapiens
VPPDRVFPP

SEQ ID NO: 1044409 - protein, 9 aa, Homo Sapiens
KIRQKLENR

SEQ ID NO: 1044410 - protein, 9 aa, Homo Sapiens
LAQFVNQGF

SEQ ID NO: 1044411 - protein, 9 aa, Homo Sapiens
SLGVKQKLL

SEQ ID NO: 1044412 - protein, 9 aa, Homo Sapiens
MAGFLFCLF

SEQ ID NO: 1044413 - protein, 9 aa, Homo Sapiens
TNKMLRGIK

SEQ ID NO: 1044414 - protein, 9 aa, Homo Sapiens
REESQNEDI

SEQ ID NO: 1044415 - protein, 9 aa, Homo Sapiens
TPMLELGTS

SEQ ID NO: 1044416 - protein, 9 aa, Homo Sapiens
AWPDKKSSE

SEQ ID NO: 1044417 - protein, 9 aa, Homo Sapiens
SQSVLQRRQ

SEQ ID NO: 1044418 - protein, 9 aa, Homo Sapiens
LVKEEGFAE

SEQ ID NO: 1044419 - protein, 9 aa, Homo Sapiens
SFEVCTNTY

SEQ ID NO: 1044420 - protein, 9 aa, Homo Sapiens
PLHEDWKKE

SEQ ID NO: 1044421 - protein, 9 aa, Homo Sapiens
RRSTASQSW

SEQ ID NO: 1044422 - protein, 9 aa, Homo Sapiens
FFANEKEAN

SEQ ID NO: 1044423 - protein, 9 aa, Homo Sapiens
DPGLMLAIP

SEQ ID NO: 1044424 - protein, 9 aa, Homo Sapiens
AVKTGPRAS

SEQ ID NO: 1044425 - protein, 9 aa, Homo Sapiens
SREEEFMKH

SEQ ID NO: 1044426 - protein, 9 aa, Homo Sapiens
EVQLEQMES

SEQ ID NO: 1044427 - protein, 9 aa, Homo Sapiens
PFSINVFED

SEQ ID NO: 1044428 - protein, 9 aa, Homo Sapiens
HSHNALSGS

SEQ ID NO: 1044429 - protein, 9 aa, Homo Sapiens
VINYYFCDL

SEQ ID NO: 1044430 - protein, 9 aa, Homo Sapiens
HASLCRSSD

SEQ ID NO: 1044431 - protein, 9 aa, Homo Sapiens
KISISGCKM

SEQ ID NO: 1044432 - protein, 9 aa, Homo Sapiens
IATMLKKIL

SEQ ID NO: 1044433 - protein, 9 aa, Homo Sapiens
AVKDCCINS

SEQ ID NO: 1044434 - protein, 9 aa, Homo Sapiens
KGGDVPKQK

SEQ ID NO: 1044435 - protein, 9 aa, Homo Sapiens
RKKKEKEME

SEQ ID NO: 1044436 - protein, 9 aa, Homo Sapiens
SALYRRADK

SEQ ID NO: 1044437 - protein, 9 aa, Homo Sapiens
KKVPHFKVA

SEQ ID NO: 1044438 - protein, 9 aa, Homo Sapiens
NELRDKVRF

SEQ ID NO: 1044439 - protein, 9 aa, Homo Sapiens
GHPAPAGAG

SEQ ID NO: 1044440 - protein, 9 aa, Homo Sapiens
ASCAEGDDY

SEQ ID NO: 1044441 - protein, 9 aa, Homo Sapiens
YLVDNKLYL

SEQ ID NO: 1044442 - protein, 9 aa, Homo Sapiens
QRRSRPSFC

SEQ ID NO: 1044443 - protein, 9 aa, Homo Sapiens
VCKNKTTVV

SEQ ID NO: 1044444 - protein, 9 aa, Homo Sapiens
ASLPAAADH

SEQ ID NO: 1044445 - protein, 9 aa, Homo Sapiens
YSREEEFMK

SEQ ID NO: 1044446 - protein, 9 aa, Homo Sapiens
GISRPPSRS

SEQ ID NO: 1044447 - protein, 9 aa, Homo Sapiens
MLCVVSDIS

SEQ ID NO: 1044448 - protein, 9 aa, Homo Sapiens
DEEEIINSF

SEQ ID NO: 1044449 - protein, 9 aa, Homo Sapiens
QSDGQAKPI

SEQ ID NO: 1044450 - protein, 9 aa, Homo Sapiens
PTFYSHFPC

SEQ ID NO: 1044451 - protein, 9 aa, Homo Sapiens
KTYIIFFVL

SEQ ID NO: 1044452 - protein, 9 aa, Homo Sapiens
PHTKPFVFV

SEQ ID NO: 1044453 - protein, 9 aa, Homo Sapiens
EASGLKEEE

SEQ ID NO: 1044454 - protein, 9 aa, Homo Sapiens
SCWAVQLLL

SEQ ID NO: 1044455 - protein, 9 aa, Homo Sapiens
PKPERLLTR

SEQ ID NO: 1044456 - protein, 9 aa, Homo Sapiens
KVQAALTIP

SEQ ID NO: 1044457 - protein, 9 aa, Homo Sapiens
FFMLLFQYR

SEQ ID NO: 1044458 - protein, 9 aa, Homo Sapiens
SKQDWTSST

SEQ ID NO: 1044459 - protein, 9 aa, Homo Sapiens
PSYSCEMCN

SEQ ID NO: 1044460 - protein, 9 aa, Homo Sapiens
DKKPDYTAY

SEQ ID NO: 1044461 - protein, 9 aa, Homo Sapiens
AQNQTTPML

SEQ ID NO: 1044462 - protein, 9 aa, Homo Sapiens
AGRGGQREE

SEQ ID NO: 1044463 - protein, 9 aa, Homo Sapiens
QFQQLNDEA

SEQ ID NO: 1044464 - protein, 9 aa, Homo Sapiens
PDGRFLPKG

SEQ ID NO: 1044465 - protein, 9 aa, Homo Sapiens
PDSQTPSST

SEQ ID NO: 1044466 - protein, 9 aa, Homo Sapiens
TTMGDRLTD

SEQ ID NO: 1044467 - protein, 9 aa, Homo Sapiens
PAENGVNYT

SEQ ID NO: 1044468 - protein, 9 aa, Homo Sapiens
KVKEEMTSA

SEQ ID NO: 1044469 - protein, 9 aa, Homo Sapiens
GSRVWEQGG

SEQ ID NO: 1044470 - protein, 9 aa, Homo Sapiens
GLPKKMTIW

SEQ ID NO: 1044471 - protein, 9 aa, Homo Sapiens
FELELVLER

SEQ ID NO: 1044472 - protein, 9 aa, Homo Sapiens
LDKVCKNKT

SEQ ID NO: 1044473 - protein, 9 aa, Homo Sapiens
NGEPLPVPK

SEQ ID NO: 1044474 - protein, 9 aa, Homo Sapiens
RAAPCGACL

SEQ ID NO: 1044475 - protein, 9 aa, Homo Sapiens
ILMVGLNAA

SEQ ID NO: 1044476 - protein, 9 aa, Homo Sapiens
EKKVPHFKV

SEQ ID NO: 1044477 - protein, 9 aa, Homo Sapiens
ITDDNITHK

SEQ ID NO: 1044478 - protein, 9 aa, Homo Sapiens
GREKIVIMD

SEQ ID NO: 1044479 - protein, 9 aa, Homo Sapiens
IQLSSVDLE

SEQ ID NO: 1044480 - protein, 9 aa, Homo Sapiens
ESKVYQLVS

SEQ ID NO: 1044481 - protein, 9 aa, Homo Sapiens
EILDIFGFE

SEQ ID NO: 1044482 - protein, 9 aa, Homo Sapiens
SESVQNGNL

SEQ ID NO: 1044483 - protein, 9 aa, Homo Sapiens
LGVGQGRSK

SEQ ID NO: 1044484 - protein, 9 aa, Homo Sapiens
LLSSSERIT

SEQ ID NO: 1044485 - protein, 9 aa, Homo Sapiens
YKIIKLLVQ

SEQ ID NO: 1044486 - protein, 9 aa, Homo Sapiens
SKLSAQIQK

SEQ ID NO: 1044487 - protein, 9 aa, Homo Sapiens
QGSLCPRQN

SEQ ID NO: 1044488 - protein, 9 aa, Homo Sapiens
DKKTRDLVR

SEQ ID NO: 1044489 - protein, 9 aa, Homo Sapiens
PDSYPSELI

SEQ ID NO: 1044490 - protein, 9 aa, Homo Sapiens
PEILTDKSL

SEQ ID NO: 1044491 - protein, 9 aa, Homo Sapiens
RDSAKCIWT

SEQ ID NO: 1044492 - protein, 9 aa, Homo Sapiens
YDVERCPVK

SEQ ID NO: 1044493 - protein, 9 aa, Homo Sapiens
RGSGGNSAP

SEQ ID NO: 1044494 - protein, 9 aa, Homo Sapiens
LSLIVIMYR

SEQ ID NO: 1044495 - protein, 9 aa, Homo Sapiens
ELLENTNVR

SEQ ID NO: 1044496 - protein, 9 aa, Homo Sapiens
SSFHTTAPT

SEQ ID NO: 1044497 - protein, 9 aa, Homo Sapiens
KGNANLTKT

SEQ ID NO: 1044498 - protein, 9 aa, Homo Sapiens
QRLKDDALE

SEQ ID NO: 1044499 - protein, 9 aa, Homo Sapiens
SRHEMPLGE

SEQ ID NO: 1044500 - protein, 9 aa, Homo Sapiens
EAPSQFPPL

SEQ ID NO: 1044501 - protein, 9 aa, Homo Sapiens
PPEPPRPPG

SEQ ID NO: 1044502 - protein, 9 aa, Homo Sapiens
LISVFGSDI

SEQ ID NO: 1044503 - protein, 9 aa, Homo Sapiens
DKEFPLVSE

SEQ ID NO: 1044504 - protein, 9 aa, Homo Sapiens
KKHYLTAFY

SEQ ID NO: 1044505 - protein, 9 aa, Homo Sapiens
MQILRILKL

SEQ ID NO: 1044506 - protein, 9 aa, Homo Sapiens
QKKEQMLEY

SEQ ID NO: 1044507 - protein, 9 aa, Homo Sapiens
VGSLLSLEC

SEQ ID NO: 1044508 - protein, 9 aa, Homo Sapiens
GDVYSYRII

SEQ ID NO: 1044509 - protein, 9 aa, Homo Sapiens
EGPQLDTWS

SEQ ID NO: 1044510 - protein, 9 aa, Homo Sapiens
EENPYKCVD

SEQ ID NO: 1044511 - protein, 9 aa, Homo Sapiens
NNLMMPRPP

SEQ ID NO: 1044512 - protein, 9 aa, Homo Sapiens
RTNNSPGNW

SEQ ID NO: 1044513 - protein, 9 aa, Homo Sapiens
TMFILTPLL

SEQ ID NO: 1044514 - protein, 9 aa, Homo Sapiens
ILQKEEEVE

SEQ ID NO: 1044515 - protein, 9 aa, Homo Sapiens
SVGNKRMSA

SEQ ID NO: 1044516 - protein, 9 aa, Homo Sapiens
AEALVNGKW

SEQ ID NO: 1044517 - protein, 9 aa, Homo Sapiens
KEMNFFQQQ

SEQ ID NO: 1044518 - protein, 9 aa, Homo Sapiens
AAARSRPQQ

SEQ ID NO: 1044519 - protein, 9 aa, Homo Sapiens
PGTAWLPGE

SEQ ID NO: 1044520 - protein, 9 aa, Homo Sapiens
GGAVKEGAR

SEQ ID NO: 1044521 - protein, 9 aa, Homo Sapiens
KRSLGIKFS

SEQ ID NO: 1044522 - protein, 9 aa, Homo Sapiens
PDCSSGCNS

SEQ ID NO: 1044523 - protein, 9 aa, Homo Sapiens
HLGLPKKMT

SEQ ID NO: 1044524 - protein, 9 aa, Homo Sapiens
LQEIYQKLT

SEQ ID NO: 1044525 - protein, 9 aa, Homo Sapiens
PRAAALPEK

SEQ ID NO: 1044526 - protein, 9 aa, Homo Sapiens
RLTRRASVC

SEQ ID NO: 1044527 - protein, 9 aa, Homo Sapiens
TVYVLGNLT

SEQ ID NO: 1044528 - protein, 9 aa, Homo Sapiens
LNRAVFWIE

SEQ ID NO: 1044529 - protein, 9 aa, Homo Sapiens
ECKYLFSAF

SEQ ID NO: 1044530 - protein, 9 aa, Homo Sapiens
FVLVFQLGQ

SEQ ID NO: 1044531 - protein, 9 aa, Homo Sapiens
VNGKKQFNS

SEQ ID NO: 1044532 - protein, 9 aa, Homo Sapiens
LLTNGYTRH

SEQ ID NO: 1044533 - protein, 9 aa, Homo Sapiens
PADKCSRQY

SEQ ID NO: 1044534 - protein, 9 aa, Homo Sapiens
AVSCVAISI

SEQ ID NO: 1044535 - protein, 9 aa, Homo Sapiens
GGLFRDDDD

SEQ ID NO: 1044536 - protein, 9 aa, Homo Sapiens
MSYWSDWPV

SEQ ID NO: 1044537 - protein, 9 aa, Homo Sapiens
SSNRNLVTK

SEQ ID NO: 1044538 - protein, 9 aa, Homo Sapiens
AAEQLLKDL

SEQ ID NO: 1044539 - protein, 9 aa, Homo Sapiens
CGHGGQQTT

SEQ ID NO: 1044540 - protein, 9 aa, Homo Sapiens
IPHGGNGTW

SEQ ID NO: 1044541 - protein, 9 aa, Homo Sapiens
NREIEILTK

SEQ ID NO: 1044542 - protein, 9 aa, Homo Sapiens
QTHEYYPYI

SEQ ID NO: 1044543 - protein, 9 aa, Homo Sapiens
SYKKSNIDF

SEQ ID NO: 1044544 - protein, 9 aa, Homo Sapiens
FLCFCASLL

SEQ ID NO: 1044545 - protein, 9 aa, Homo Sapiens
LNLNLVIKQ

SEQ ID NO: 1044546 - protein, 9 aa, Homo Sapiens
WTQKKFDRV

SEQ ID NO: 1044547 - protein, 9 aa, Homo Sapiens
LTTVMRFLT

SEQ ID NO: 1044548 - protein, 9 aa, Homo Sapiens
GGTRSSVVS

SEQ ID NO: 1044549 - protein, 9 aa, Homo Sapiens
ESDNGVVVY

SEQ ID NO: 1044550 - protein, 9 aa, Homo Sapiens
KKTIKRRKI

SEQ ID NO: 1044551 - protein, 9 aa, Homo Sapiens
HLSQRRLYP

SEQ ID NO: 1044552 - protein, 9 aa, Homo Sapiens
IDFLIEHMI

SEQ ID NO: 1044553 - protein, 9 aa, Homo Sapiens
QYTPKVLEE

SEQ ID NO: 1044554 - protein, 9 aa, Homo Sapiens
CLLKKFKTI

SEQ ID NO: 1044555 - protein, 9 aa, Homo Sapiens
AGLLPGSLL

SEQ ID NO: 1044556 - protein, 9 aa, Homo Sapiens
KDNLSIHYK

SEQ ID NO: 1044557 - protein, 9 aa, Homo Sapiens
SAGVGTEAT

SEQ ID NO: 1044558 - protein, 9 aa, Homo Sapiens
DLSLLEAEA

SEQ ID NO: 1044559 - protein, 9 aa, Homo Sapiens
DRSENVHHQ

SEQ ID NO: 1044560 - protein, 9 aa, Homo Sapiens
SWMETSVSP

SEQ ID NO: 1044561 - protein, 9 aa, Homo Sapiens
VLPQSPGTP

SEQ ID NO: 1044562 - protein, 9 aa, Homo Sapiens
RNKINFFNG

SEQ ID NO: 1044563 - protein, 9 aa, Homo Sapiens
SAYVPRTLK

SEQ ID NO: 1044564 - protein, 9 aa, Homo Sapiens
ALKIHLQAY

SEQ ID NO: 1044565 - protein, 9 aa, Homo Sapiens
TSSTIALRW

SEQ ID NO: 1044566 - protein, 9 aa, Homo Sapiens
ATPVSMTSE

SEQ ID NO: 1044567 - protein, 9 aa, Homo Sapiens
RAPEPPVKK

SEQ ID NO: 1044568 - protein, 9 aa, Homo Sapiens
VASRGKASQ

SEQ ID NO: 1044569 - protein, 9 aa, Homo Sapiens
YYVMVTSTF

SEQ ID NO: 1044570 - protein, 9 aa, Homo Sapiens
HIRVSHCGA

SEQ ID NO: 1044571 - protein, 9 aa, Homo Sapiens
LYHSVYKTY

SEQ ID NO: 1044572 - protein, 9 aa, Homo Sapiens
LILNLEKTW

SEQ ID NO: 1044573 - protein, 9 aa, Homo Sapiens
DTWSMGVVL

SEQ ID NO: 1044574 - protein, 9 aa, Homo Sapiens
NSSDDFEDE

SEQ ID NO: 1044575 - protein, 9 aa, Homo Sapiens
HKATEQYYT

SEQ ID NO: 1044576 - protein, 9 aa, Homo Sapiens
ALLEAEECK

SEQ ID NO: 1044577 - protein, 9 aa, Homo Sapiens
ENGEFRLLS

SEQ ID NO: 1044578 - protein, 9 aa, Homo Sapiens
SYSSSPHLL

SEQ ID NO: 1044579 - protein, 9 aa, Homo Sapiens
APAPSKRAL

SEQ ID NO: 1044580 - protein, 9 aa, Homo Sapiens
GYIKAHAGE

SEQ ID NO: 1044581 - protein, 9 aa, Homo Sapiens
PGRKPVDTG

SEQ ID NO: 1044582 - protein, 9 aa, Homo Sapiens
DCSSGCNSD

SEQ ID NO: 1044583 - protein, 9 aa, Homo Sapiens
SLSVISVSY

SEQ ID NO: 1044584 - protein, 9 aa, Homo Sapiens
DDLKFVIPK

SEQ ID NO: 1044585 - protein, 9 aa, Homo Sapiens
FRERWQIKA

SEQ ID NO: 1044586 - protein, 9 aa, Homo Sapiens
SVREGHPDK

SEQ ID NO: 1044587 - protein, 9 aa, Homo Sapiens
ADKLENNPE

SEQ ID NO: 1044588 - protein, 9 aa, Homo Sapiens
LNATLRNNI

SEQ ID NO: 1044589 - protein, 9 aa, Homo Sapiens
DPNNETLFT

SEQ ID NO: 1044590 - protein, 9 aa, Homo Sapiens
ILDTWLTVN

SEQ ID NO: 1044591 - protein, 9 aa, Homo Sapiens
NQTFSGTGI

SEQ ID NO: 1044592 - protein, 9 aa, Homo Sapiens
EDSSIYFCS

SEQ ID NO: 1044593 - protein, 9 aa, Homo Sapiens
SHLQAEPEN

SEQ ID NO: 1044594 - protein, 9 aa, Homo Sapiens
ITFKVPSRE

SEQ ID NO: 1044595 - protein, 9 aa, Homo Sapiens
QQLPGAEVQ

SEQ ID NO: 1044596 - protein, 9 aa, Homo Sapiens
CHWVRSLAE

SEQ ID NO: 1044597 - protein, 9 aa, Homo Sapiens
ESPVIPLLE

SEQ ID NO: 1044598 - protein, 9 aa, Homo Sapiens
AHFFCDFLS

SEQ ID NO: 1044599 - protein, 9 aa, Homo Sapiens
FCSGSDLTR

SEQ ID NO: 1044600 - protein, 9 aa, Homo Sapiens
EDSPWGPWD

SEQ ID NO: 1044601 - protein, 9 aa, Homo Sapiens
SPDSSSLLG

SEQ ID NO: 1044602 - protein, 9 aa, Homo Sapiens
QPKRQRLWL

SEQ ID NO: 1044603 - protein, 9 aa, Homo Sapiens
EGRAGGGLQ

SEQ ID NO: 1044604 - protein, 9 aa, Homo Sapiens
MESFEVCTN

SEQ ID NO: 1044605 - protein, 9 aa, Homo Sapiens
ACMNVAQLQ

SEQ ID NO: 1044606 - protein, 9 aa, Homo Sapiens
GWASDTKLW

SEQ ID NO: 1044607 - protein, 9 aa, Homo Sapiens
QCQDENRKL

SEQ ID NO: 1044608 - protein, 9 aa, Homo Sapiens
IDGIEGDRG

SEQ ID NO: 1044609 - protein, 9 aa, Homo Sapiens
SLIPGPGEA

SEQ ID NO: 1044610 - protein, 9 aa, Homo Sapiens
TMENFSKEC

SEQ ID NO: 1044611 - protein, 9 aa, Homo Sapiens
IAAVKAVEV

SEQ ID NO: 1044612 - protein, 9 aa, Homo Sapiens
RLSSMFGNM

SEQ ID NO: 1044613 - protein, 9 aa, Homo Sapiens
RTVQCQDEN

SEQ ID NO: 1044614 - protein, 9 aa, Homo Sapiens
LVTQLMLHG

SEQ ID NO: 1044615 - protein, 9 aa, Homo Sapiens
AQKGAQDGG

SEQ ID NO: 1044616 - protein, 9 aa, Homo Sapiens
SDTLPQKKT

SEQ ID NO: 1044617 - protein, 9 aa, Homo Sapiens
IRYSLGGTR

SEQ ID NO: 1044618 - protein, 9 aa, Homo Sapiens
QTWIDKGLK

SEQ ID NO: 1044619 - protein, 9 aa, Homo Sapiens
PFPGPFSAG

SEQ ID NO: 1044620 - protein, 9 aa, Homo Sapiens
TQISILTMP

SEQ ID NO: 1044621 - protein, 9 aa, Homo Sapiens
QTPQNAIFL

SEQ ID NO: 1044622 - protein, 9 aa, Homo Sapiens
AVFVEQPTS

SEQ ID NO: 1044623 - protein, 9 aa, Homo Sapiens
SNNPQDDIA

SEQ ID NO: 1044624 - protein, 9 aa, Homo Sapiens
FEICRLAVP

SEQ ID NO: 1044625 - protein, 9 aa, Homo Sapiens
SVYKTYELV

SEQ ID NO: 1044626 - protein, 9 aa, Homo Sapiens
TIESYVDKQ

SEQ ID NO: 1044627 - protein, 9 aa, Homo Sapiens
AAAEETGGE

SEQ ID NO: 1044628 - protein, 9 aa, Homo Sapiens
TLPQKKTTS

SEQ ID NO: 1044629 - protein, 9 aa, Homo Sapiens
IHRHEKVIY

SEQ ID NO: 1044630 - protein, 9 aa, Homo Sapiens
EAVKGPVSA

SEQ ID NO: 1044631 - protein, 9 aa, Homo Sapiens
PAQFGGIHF

SEQ ID NO: 1044632 - protein, 9 aa, Homo Sapiens
SGDDLKFVI

SEQ ID NO: 1044633 - protein, 9 aa, Homo Sapiens
RAEGRAGGG

SEQ ID NO: 1044634 - protein, 9 aa, Homo Sapiens
AGAETGQSC

SEQ ID NO: 1044635 - protein, 9 aa, Homo Sapiens
CEKSNLKKP

SEQ ID NO: 1044636 - protein, 9 aa, Homo Sapiens
NATNPDLGA

SEQ ID NO: 1044637 - protein, 9 aa, Homo Sapiens
FKIQKSLDG

SEQ ID NO: 1044638 - protein, 9 aa, Homo Sapiens
PHPRGLRIS

SEQ ID NO: 1044639 - protein, 9 aa, Homo Sapiens
MLQRHRQGK

SEQ ID NO: 1044640 - protein, 9 aa, Homo Sapiens
CLTESLRDF

SEQ ID NO: 1044641 - protein, 9 aa, Homo Sapiens
SPLSESAKS

SEQ ID NO: 1044642 - protein, 9 aa, Homo Sapiens
TRQKPLTPR

SEQ ID NO: 1044643 - protein, 9 aa, Homo Sapiens
SSVSVSQAN

SEQ ID NO: 1044644 - protein, 9 aa, Homo Sapiens
DEEAQLLFH

SEQ ID NO: 1044645 - protein, 9 aa, Homo Sapiens
AAGMLIPYT

SEQ ID NO: 1044646 - protein, 9 aa, Homo Sapiens
EISDPDSGN

SEQ ID NO: 1044647 - protein, 9 aa, Homo Sapiens
QNAIFLKTC

SEQ ID NO: 1044648 - protein, 9 aa, Homo Sapiens
ASLWPSRTQ

SEQ ID NO: 1044649 - protein, 9 aa, Homo Sapiens
TFESVAFSG

SEQ ID NO: 1044650 - protein, 9 aa, Homo Sapiens
KVFPEIQLE

SEQ ID NO: 1044651 - protein, 9 aa, Homo Sapiens
LREHHQPIT

SEQ ID NO: 1044652 - protein, 9 aa, Homo Sapiens
ITVCYEIIA

SEQ ID NO: 1044653 - protein, 9 aa, Homo Sapiens
EPSHHLSAF

SEQ ID NO: 1044654 - protein, 9 aa, Homo Sapiens
GSPLAKARR

SEQ ID NO: 1044655 - protein, 9 aa, Homo Sapiens
TNMIELEQR

SEQ ID NO: 1044656 - protein, 9 aa, Homo Sapiens
SQYEALVKT

SEQ ID NO: 1044657 - protein, 9 aa, Homo Sapiens
EVTVRDLLP

SEQ ID NO: 1044658 - protein, 9 aa, Homo Sapiens
PKSPELHLK

SEQ ID NO: 1044659 - protein, 9 aa, Homo Sapiens
EPKEPFCPP

SEQ ID NO: 1044660 - protein, 9 aa, Homo Sapiens
EESQNEDIK

SEQ ID NO: 1044661 - protein, 9 aa, Homo Sapiens
QEVKSDRVS

SEQ ID NO: 1044662 - protein, 9 aa, Homo Sapiens
ISKQWVVSA

SEQ ID NO: 1044663 - protein, 9 aa, Homo Sapiens
RTPPMWIST

SEQ ID NO: 1044664 - protein, 9 aa, Homo Sapiens
EASRKSSKP

SEQ ID NO: 1044665 - protein, 9 aa, Homo Sapiens
KRNLHFPLY

SEQ ID NO: 1044666 - protein, 9 aa, Homo Sapiens
ALREQKKNL

SEQ ID NO: 1044667 - protein, 9 aa, Homo Sapiens
PALPIIHNG

SEQ ID NO: 1044668 - protein, 9 aa, Homo Sapiens
LVSGVLQLL

SEQ ID NO: 1044669 - protein, 9 aa, Homo Sapiens
DTLFVAGCR

SEQ ID NO: 1044670 - protein, 9 aa, Homo Sapiens
VLLNSLPLQ

SEQ ID NO: 1044671 - protein, 9 aa, Homo Sapiens
RNAEKNFHN

SEQ ID NO: 1044672 - protein, 9 aa, Homo Sapiens
DKFYADHSR

SEQ ID NO: 1044673 - protein, 9 aa, Homo Sapiens
EKLVEVYKE

SEQ ID NO: 1044674 - protein, 9 aa, Homo Sapiens
DAVKETFSV

SEQ ID NO: 1044675 - protein, 9 aa, Homo Sapiens
YRPSTFHVQ

SEQ ID NO: 1044676 - protein, 9 aa, Homo Sapiens
RPQNHGTNL

SEQ ID NO: 1044677 - protein, 9 aa, Homo Sapiens
FFDRHPEAF

SEQ ID NO: 1044678 - protein, 9 aa, Homo Sapiens
LIHRHEKVI

SEQ ID NO: 1044679 - protein, 9 aa, Homo Sapiens
VISIKISMT

SEQ ID NO: 1044680 - protein, 9 aa, Homo Sapiens
GSRGGRAPA

SEQ ID NO: 1044681 - protein, 9 aa, Homo Sapiens
GRKATSNNF

SEQ ID NO: 1044682 - protein, 9 aa, Homo Sapiens
VSGPVSTTV

SEQ ID NO: 1044683 - protein, 9 aa, Homo Sapiens
KSIPYGFLE

SEQ ID NO: 1044684 - protein, 9 aa, Homo Sapiens
PAEAFLASD

SEQ ID NO: 1044685 - protein, 9 aa, Homo Sapiens
LGRGLERLI

SEQ ID NO: 1044686 - protein, 9 aa, Homo Sapiens
VPRRGSLKR

SEQ ID NO: 1044687 - protein, 9 aa, Homo Sapiens
SRFSAETVQ

SEQ ID NO: 1044688 - protein, 9 aa, Homo Sapiens
PKEPFCPPP

SEQ ID NO: 1044689 - protein, 9 aa, Homo Sapiens
PEDCTEKHS

SEQ ID NO: 1044690 - protein, 9 aa, Homo Sapiens
MEYSHQMWG

SEQ ID NO: 1044691 - protein, 9 aa, Homo Sapiens
VMRLCAARL

SEQ ID NO: 1044692 - protein, 9 aa, Homo Sapiens
TSDLPQPHL

SEQ ID NO: 1044693 - protein, 9 aa, Homo Sapiens
GLLQPKRQR

SEQ ID NO: 1044694 - protein, 9 aa, Homo Sapiens
GGFVTPIDC

SEQ ID NO: 1044695 - protein, 9 aa, Homo Sapiens
LIQNIDATT

SEQ ID NO: 1044696 - protein, 9 aa, Homo Sapiens
DYRWDLTLS

SEQ ID NO: 1044697 - protein, 9 aa, Homo Sapiens
QVSFGEPFE

SEQ ID NO: 1044698 - protein, 9 aa, Homo Sapiens
AFRQGLIWV

SEQ ID NO: 1044699 - protein, 9 aa, Homo Sapiens
NQQVFDWIE

SEQ ID NO: 1044700 - protein, 9 aa, Homo Sapiens
LQSTEASVL

SEQ ID NO: 1044701 - protein, 9 aa, Homo Sapiens
AFLGEIMKT

SEQ ID NO: 1044702 - protein, 9 aa, Homo Sapiens
CVRKVAPDG

SEQ ID NO: 1044703 - protein, 9 aa, Homo Sapiens
FEAFGPSEI

SEQ ID NO: 1044704 - protein, 9 aa, Homo Sapiens
SPKEKGEAG

SEQ ID NO: 1044705 - protein, 9 aa, Homo Sapiens
PRLRNKVKV

SEQ ID NO: 1044706 - protein, 9 aa, Homo Sapiens
ILWAFEAIK

SEQ ID NO: 1044707 - protein, 9 aa, Homo Sapiens
GYPRYSSFG

SEQ ID NO: 1044708 - protein, 9 aa, Homo Sapiens
KPLKVGLEM

SEQ ID NO: 1044709 - protein, 9 aa, Homo Sapiens
QIFRIMQIL

SEQ ID NO: 1044710 - protein, 9 aa, Homo Sapiens
SQLVGRQDC

SEQ ID NO: 1044711 - protein, 9 aa, Homo Sapiens
FQSPKDDAA

SEQ ID NO: 1044712 - protein, 9 aa, Homo Sapiens
SLKNKIQTL

SEQ ID NO: 1044713 - protein, 9 aa, Homo Sapiens
TRNFSRVLQ

SEQ ID NO: 1044714 - protein, 9 aa, Homo Sapiens
SSPGTGTLT

SEQ ID NO: 1044715 - protein, 9 aa, Homo Sapiens
ESFCDSMVL

SEQ ID NO: 1044716 - protein, 9 aa, Homo Sapiens
LIPYTYPDT

SEQ ID NO: 1044717 - protein, 9 aa, Homo Sapiens
AFFLDSPGY

SEQ ID NO: 1044718 - protein, 9 aa, Homo Sapiens
VTLENRSSP

SEQ ID NO: 1044719 - protein, 9 aa, Homo Sapiens
GGFPLEWIG

SEQ ID NO: 1044720 - protein, 9 aa, Homo Sapiens
QLLILREHH

SEQ ID NO: 1044721 - protein, 9 aa, Homo Sapiens
HSHGLQDGK

SEQ ID NO: 1044722 - protein, 9 aa, Homo Sapiens
IDLLALTSV

SEQ ID NO: 1044723 - protein, 9 aa, Homo Sapiens
NHSNSHVFF

SEQ ID NO: 1044724 - protein, 9 aa, Homo Sapiens
QKTIKTMLE

SEQ ID NO: 1044725 - protein, 9 aa, Homo Sapiens
ISIHIKVDL

SEQ ID NO: 1044726 - protein, 9 aa, Homo Sapiens
DRCPNKVAQ

SEQ ID NO: 1044727 - protein, 9 aa, Homo Sapiens
AFYLIVARK

SEQ ID NO: 1044728 - protein, 9 aa, Homo Sapiens
TVVCKQLEC

SEQ ID NO: 1044729 - protein, 9 aa, Homo Sapiens
EKLRQYKVL

SEQ ID NO: 1044730 - protein, 9 aa, Homo Sapiens
FFWQYPEAV

SEQ ID NO: 1044731 - protein, 9 aa, Homo Sapiens
TVIQLVEML

SEQ ID NO: 1044732 - protein, 9 aa, Homo Sapiens
KDLAEWLRD

SEQ ID NO: 1044733 - protein, 9 aa, Homo Sapiens
TKSPASTAA

SEQ ID NO: 1044734 - protein, 9 aa, Homo Sapiens
AETPGVPGS

SEQ ID NO: 1044735 - protein, 9 aa, Homo Sapiens
QDAFLGEIM

SEQ ID NO: 1044736 - protein, 9 aa, Homo Sapiens
DSFYSVFHM

SEQ ID NO: 1044737 - protein, 9 aa, Homo Sapiens
GKDTADRPP

SEQ ID NO: 1044738 - protein, 9 aa, Homo Sapiens
EEKMWRQKE

SEQ ID NO: 1044739 - protein, 9 aa, Homo Sapiens
NVVDLKLHV

SEQ ID NO: 1044740 - protein, 9 aa, Homo Sapiens
ETGVSHSQK

SEQ ID NO: 1044741 - protein, 9 aa, Homo Sapiens
KMAAMIEVK

SEQ ID NO: 1044742 - protein, 9 aa, Homo Sapiens
DTLRVVIDQ

SEQ ID NO: 1044743 - protein, 9 aa, Homo Sapiens
YASTAPKLS

SEQ ID NO: 1044744 - protein, 9 aa, Homo Sapiens
FLGEQSRVI

SEQ ID NO: 1044745 - protein, 9 aa, Homo Sapiens
GSLLSLECT

SEQ ID NO: 1044746 - protein, 9 aa, Homo Sapiens
PGGAEHSVA

SEQ ID NO: 1044747 - protein, 9 aa, Homo Sapiens
FVLLSLTVF

SEQ ID NO: 1044748 - protein, 9 aa, Homo Sapiens
FFSDVFFKG

SEQ ID NO: 1044749 - protein, 9 aa, Homo Sapiens
FARCLPSRA

SEQ ID NO: 1044750 - protein, 9 aa, Homo Sapiens
NLFVAGTET

SEQ ID NO: 1044751 - protein, 9 aa, Homo Sapiens
DHLMFKKHQ

SEQ ID NO: 1044752 - protein, 9 aa, Homo Sapiens
AKLAEYVVP

SEQ ID NO: 1044753 - protein, 9 aa, Homo Sapiens
EPFEICRLA

SEQ ID NO: 1044754 - protein, 9 aa, Homo Sapiens
CIHAGCDCI

SEQ ID NO: 1044755 - protein, 9 aa, Homo Sapiens
HPLPSKIQS

SEQ ID NO: 1044756 - protein, 9 aa, Homo Sapiens
LSHPSLLSY

SEQ ID NO: 1044757 - protein, 9 aa, Homo Sapiens
LKIPRTVPV

SEQ ID NO: 1044758 - protein, 9 aa, Homo Sapiens
ISRRHFWTI

SEQ ID NO: 1044759 - protein, 9 aa, Homo Sapiens
GLFFRRPNV

SEQ ID NO: 1044760 - protein, 9 aa, Homo Sapiens
LIVFRKKVF

SEQ ID NO: 1044761 - protein, 9 aa, Homo Sapiens
RPLPPILFP

SEQ ID NO: 1044762 - protein, 9 aa, Homo Sapiens
VKATGYQEL

SEQ ID NO: 1044763 - protein, 9 aa, Homo Sapiens
VGLSNVWRF

SEQ ID NO: 1044764 - protein, 9 aa, Homo Sapiens
SYVLGIPMI

SEQ ID NO: 1044765 - protein, 9 aa, Homo Sapiens
VNPDEEVQG

SEQ ID NO: 1044766 - protein, 9 aa, Homo Sapiens
SKIPTFVTG

SEQ ID NO: 1044767 - protein, 9 aa, Homo Sapiens
QQKTIKTML

SEQ ID NO: 1044768 - protein, 9 aa, Homo Sapiens
KEEEQKDDN

SEQ ID NO: 1044769 - protein, 9 aa, Homo Sapiens
AEVTIWPDR

SEQ ID NO: 1044770 - protein, 9 aa, Homo Sapiens
VQSPCCRPL

SEQ ID NO: 1044771 - protein, 9 aa, Homo Sapiens
LLKEREDPP

SEQ ID NO: 1044772 - protein, 9 aa, Homo Sapiens
GLWATVESQ

SEQ ID NO: 1044773 - protein, 9 aa, Homo Sapiens
NRLSLIEHQ

SEQ ID NO: 1044774 - protein, 9 aa, Homo Sapiens
LKKIKTSEY

SEQ ID NO: 1044775 - protein, 9 aa, Homo Sapiens
RLFACEECG

SEQ ID NO: 1044776 - protein, 9 aa, Homo Sapiens
FTTPQDGDV

SEQ ID NO: 1044777 - protein, 9 aa, Homo Sapiens
TEKETRSVM

SEQ ID NO: 1044778 - protein, 9 aa, Homo Sapiens
QLMEAAEID

SEQ ID NO: 1044779 - protein, 9 aa, Homo Sapiens
QDYRLKSQT

SEQ ID NO: 1044780 - protein, 9 aa, Homo Sapiens
KAPFLGISR

SEQ ID NO: 1044781 - protein, 9 aa, Homo Sapiens
PQVPSMMAS

SEQ ID NO: 1044782 - protein, 9 aa, Homo Sapiens
LYREPVLGV

SEQ ID NO: 1044783 - protein, 9 aa, Homo Sapiens
RLVLTVSAS

SEQ ID NO: 1044784 - protein, 9 aa, Homo Sapiens
NGVTLKEGG

SEQ ID NO: 1044785 - protein, 9 aa, Homo Sapiens
SRHVVMELN

SEQ ID NO: 1044786 - protein, 9 aa, Homo Sapiens
PVTFPDGRF

SEQ ID NO: 1044787 - protein, 9 aa, Homo Sapiens
VMISVVHKR

SEQ ID NO: 1044788 - protein, 9 aa, Homo Sapiens
YRGAMGIVL

SEQ ID NO: 1044789 - protein, 9 aa, Homo Sapiens
AIDGFFNDS

SEQ ID NO: 1044790 - protein, 9 aa, Homo Sapiens
YTVETISIE

SEQ ID NO: 1044791 - protein, 9 aa, Homo Sapiens
AQEMILKMQ

SEQ ID NO: 1044792 - protein, 9 aa, Homo Sapiens
SALCKHCHK

SEQ ID NO: 1044793 - protein, 9 aa, Homo Sapiens
CQRGMFNCT

SEQ ID NO: 1044794 - protein, 9 aa, Homo Sapiens
ECQRQGAIV

SEQ ID NO: 1044795 - protein, 9 aa, Homo Sapiens
GHEITVGIE

SEQ ID NO: 1044796 - protein, 9 aa, Homo Sapiens
RLPYYSAYV

SEQ ID NO: 1044797 - protein, 9 aa, Homo Sapiens
ACCDEGKRV

SEQ ID NO: 1044798 - protein, 9 aa, Homo Sapiens
NLGIIETSE

SEQ ID NO: 1044799 - protein, 9 aa, Homo Sapiens
ATGSFFKRN

SEQ ID NO: 1044800 - protein, 9 aa, Homo Sapiens
AIMIPSGGT

SEQ ID NO: 1044801 - protein, 9 aa, Homo Sapiens
KAESLEHQV

SEQ ID NO: 1044802 - protein, 9 aa, Homo Sapiens
RSTGLFPQA

SEQ ID NO: 1044803 - protein, 9 aa, Homo Sapiens
QEAYQEAFD

SEQ ID NO: 1044804 - protein, 9 aa, Homo Sapiens
HHLVQLGQT

SEQ ID NO: 1044805 - protein, 9 aa, Homo Sapiens
CRNKIIDHI

SEQ ID NO: 1044806 - protein, 9 aa, Homo Sapiens
PITEMEIFV

SEQ ID NO: 1044807 - protein, 9 aa, Homo Sapiens
SSKQARGGF

SEQ ID NO: 1044808 - protein, 9 aa, Homo Sapiens
VSVTGRSPG

SEQ ID NO: 1044809 - protein, 9 aa, Homo Sapiens
NLMMPRPPT

SEQ ID NO: 1044810 - protein, 9 aa, Homo Sapiens
VFETDSSLQ

SEQ ID NO: 1044811 - protein, 9 aa, Homo Sapiens
GKIHLHSFK

SEQ ID NO: 1044812 - protein, 9 aa, Homo Sapiens
LNPKTNREK

SEQ ID NO: 1044813 - protein, 9 aa, Homo Sapiens
NQIKIRNRE

SEQ ID NO: 1044814 - protein, 9 aa, Homo Sapiens
SRGRAEGRA

SEQ ID NO: 1044815 - protein, 9 aa, Homo Sapiens
NKNLLPFNE

SEQ ID NO: 1044816 - protein, 9 aa, Homo Sapiens
FVIPKEKDA

SEQ ID NO: 1044817 - protein, 9 aa, Homo Sapiens
PATPKTFAP

SEQ ID NO: 1044818 - protein, 9 aa, Homo Sapiens
RLHDRVVFK

SEQ ID NO: 1044819 - protein, 9 aa, Homo Sapiens
WEIILRCQP

SEQ ID NO: 1044820 - protein, 9 aa, Homo Sapiens
QIYDSTDLE

SEQ ID NO: 1044821 - protein, 9 aa, Homo Sapiens
LGPLGRDLP

SEQ ID NO: 1044822 - protein, 9 aa, Homo Sapiens
QRKKVFSTC

SEQ ID NO: 1044823 - protein, 9 aa, Homo Sapiens
ASGLPSETE

SEQ ID NO: 1044824 - protein, 9 aa, Homo Sapiens
MIDVDGLLT

SEQ ID NO: 1044825 - protein, 9 aa, Homo Sapiens
IIFIILGVG

SEQ ID NO: 1044826 - protein, 9 aa, Homo Sapiens
FLSFLPLKI

SEQ ID NO: 1044827 - protein, 9 aa, Homo Sapiens
DEGYIKEGE

SEQ ID NO: 1044828 - protein, 9 aa, Homo Sapiens
STSNTLWIK

SEQ ID NO: 1044829 - protein, 9 aa, Homo Sapiens
HLKVKTSDQ

SEQ ID NO: 1044830 - protein, 9 aa, Homo Sapiens
LEKITGSPK

SEQ ID NO: 1044831 - protein, 9 aa, Homo Sapiens
YKVCIAQDS

SEQ ID NO: 1044832 - protein, 9 aa, Homo Sapiens
IQGNYGFLS

SEQ ID NO: 1044833 - protein, 9 aa, Homo Sapiens
LVQVDVKDS

SEQ ID NO: 1044834 - protein, 9 aa, Homo Sapiens
QKKAGLPLG

SEQ ID NO: 1044835 - protein, 9 aa, Homo Sapiens
NKSKSGSCS

SEQ ID NO: 1044836 - protein, 9 aa, Homo Sapiens
LTASDVGVK

SEQ ID NO: 1044837 - protein, 9 aa, Homo Sapiens
VKKKHYLTA

SEQ ID NO: 1044838 - protein, 9 aa, Homo Sapiens
SLEKFIEDY

SEQ ID NO: 1044839 - protein, 9 aa, Homo Sapiens
EPYETITFK

SEQ ID NO: 1044840 - protein, 9 aa, Homo Sapiens
SVSQPSPYQ

SEQ ID NO: 1044841 - protein, 9 aa, Homo Sapiens
GSSSPPVNV

SEQ ID NO: 1044842 - protein, 9 aa, Homo Sapiens
CVPAYVNWI

SEQ ID NO: 1044843 - protein, 9 aa, Homo Sapiens
SLFASNVGG

SEQ ID NO: 1044844 - protein, 9 aa, Homo Sapiens
TEPASPRSL

SEQ ID NO: 1044845 - protein, 9 aa, Homo Sapiens
QGTLRKPVT

SEQ ID NO: 1044846 - protein, 9 aa, Homo Sapiens
DHFSLRACY

SEQ ID NO: 1044847 - protein, 9 aa, Homo Sapiens
AIHNWIRRN

SEQ ID NO: 1044848 - protein, 9 aa, Homo Sapiens
SDMVGLSYP

SEQ ID NO: 1044849 - protein, 9 aa, Homo Sapiens
MCLNIAVTP

SEQ ID NO: 1044850 - protein, 9 aa, Homo Sapiens
ITGFGQCLC

SEQ ID NO: 1044851 - protein, 9 aa, Homo Sapiens
TVFKEEKVK

SEQ ID NO: 1044852 - protein, 9 aa, Homo Sapiens
YVLGNLTVV

SEQ ID NO: 1044853 - protein, 9 aa, Homo Sapiens
PLIQCLLKK

SEQ ID NO: 1044854 - protein, 9 aa, Homo Sapiens
LLLLAEPKP

SEQ ID NO: 1044855 - protein, 9 aa, Homo Sapiens
ICSRRQRVF

SEQ ID NO: 1044856 - protein, 9 aa, Homo Sapiens
VFVAVMKFI

SEQ ID NO: 1044857 - protein, 9 aa, Homo Sapiens
EIFQIFYGK

SEQ ID NO: 1044858 - protein, 9 aa, Homo Sapiens
SFFQRSRDE

SEQ ID NO: 1044859 - protein, 9 aa, Homo Sapiens
AGTPGYLSS

SEQ ID NO: 1044860 - protein, 9 aa, Homo Sapiens
SFLLPRPLV

SEQ ID NO: 1044861 - protein, 9 aa, Homo Sapiens
TTPCLDQNC

SEQ ID NO: 1044862 - protein, 9 aa, Homo Sapiens
RRNDKVPGA

SEQ ID NO: 1044863 - protein, 9 aa, Homo Sapiens
LEQNIEFIR

SEQ ID NO: 1044864 - protein, 9 aa, Homo Sapiens
EEEFELVVL

SEQ ID NO: 1044865 - protein, 9 aa, Homo Sapiens
PLVSIPSCE

SEQ ID NO: 1044866 - protein, 9 aa, Homo Sapiens
INNALHRSG

SEQ ID NO: 1044867 - protein, 9 aa, Homo Sapiens
LIDFAHFWN

SEQ ID NO: 1044868 - protein, 9 aa, Homo Sapiens
DFARDDMNF

SEQ ID NO: 1044869 - protein, 9 aa, Homo Sapiens
LDLQRNLLE

SEQ ID NO: 1044870 - protein, 9 aa, Homo Sapiens
TPRPQNHGT

SEQ ID NO: 1044871 - protein, 9 aa, Homo Sapiens
IHSVKTAFI

SEQ ID NO: 1044872 - protein, 9 aa, Homo Sapiens
VLENSSSLS

SEQ ID NO: 1044873 - protein, 9 aa, Homo Sapiens
KEEEVEEES

SEQ ID NO: 1044874 - protein, 9 aa, Homo Sapiens
LTEKKSTLE

SEQ ID NO: 1044875 - protein, 9 aa, Homo Sapiens
LAPEYTGQT

SEQ ID NO: 1044876 - protein, 9 aa, Homo Sapiens
PGAARATAA

SEQ ID NO: 1044877 - protein, 9 aa, Homo Sapiens
LGPGQGLVL

SEQ ID NO: 1044878 - protein, 9 aa, Homo Sapiens
HTDEKLFEC

SEQ ID NO: 1044879 - protein, 9 aa, Homo Sapiens
GDKKPDYTA

SEQ ID NO: 1044880 - protein, 9 aa, Homo Sapiens
NEDHTGTVE

SEQ ID NO: 1044881 - protein, 9 aa, Homo Sapiens
GAIEFSQEE

SEQ ID NO: 1044882 - protein, 9 aa, Homo Sapiens
AISIELDMA

SEQ ID NO: 1044883 - protein, 9 aa, Homo Sapiens
NLSALQTFR

SEQ ID NO: 1044884 - protein, 9 aa, Homo Sapiens
HLHGSPRYL

SEQ ID NO: 1044885 - protein, 9 aa, Homo Sapiens
TDHFSLRAC

SEQ ID NO: 1044886 - protein, 9 aa, Homo Sapiens
KKFTEIIKQ

SEQ ID NO: 1044887 - protein, 9 aa, Homo Sapiens
LEYVKGLPL

SEQ ID NO: 1044888 - protein, 9 aa, Homo Sapiens
LQQPYDQAH

SEQ ID NO: 1044889 - protein, 9 aa, Homo Sapiens
PRGPETEPR

SEQ ID NO: 1044890 - protein, 9 aa, Homo Sapiens
NRKYKDHLS

SEQ ID NO: 1044891 - protein, 9 aa, Homo Sapiens
PFKEALEPS

SEQ ID NO: 1044892 - protein, 9 aa, Homo Sapiens
QCLQSRNLK

SEQ ID NO: 1044893 - protein, 9 aa, Homo Sapiens
IELQIPTPP

SEQ ID NO: 1044894 - protein, 9 aa, Homo Sapiens
QYFLSNNYQ

SEQ ID NO: 1044895 - protein, 9 aa, Homo Sapiens
SILPGRCKW

SEQ ID NO: 1044896 - protein, 9 aa, Homo Sapiens
DENTGNIHA

SEQ ID NO: 1044897 - protein, 9 aa, Homo Sapiens
GPPICLVSK

SEQ ID NO: 1044898 - protein, 9 aa, Homo Sapiens
IPHFFMAVF

SEQ ID NO: 1044899 - protein, 9 aa, Homo Sapiens
SLISLEKKK

SEQ ID NO: 1044900 - protein, 9 aa, Homo Sapiens
FDCYVAICH

SEQ ID NO: 1044901 - protein, 9 aa, Homo Sapiens
WATVESQEE

SEQ ID NO: 1044902 - protein, 9 aa, Homo Sapiens
GGTLQQQPS

SEQ ID NO: 1044903 - protein, 9 aa, Homo Sapiens
IDAVVHEIQ

SEQ ID NO: 1044904 - protein, 9 aa, Homo Sapiens
DTLQIKDFL

SEQ ID NO: 1044905 - protein, 9 aa, Homo Sapiens
SREELTTVM

SEQ ID NO: 1044906 - protein, 9 aa, Homo Sapiens
INEELHICL

SEQ ID NO: 1044907 - protein, 9 aa, Homo Sapiens
RSPMARICL

SEQ ID NO: 1044908 - protein, 9 aa, Homo Sapiens
AQMYLGPQL

SEQ ID NO: 1044909 - protein, 9 aa, Homo Sapiens
GKAFWRGDE

SEQ ID NO: 1044910 - protein, 9 aa, Homo Sapiens
EQCERLIKS

SEQ ID NO: 1044911 - protein, 9 aa, Homo Sapiens
EKAFCSGSD

SEQ ID NO: 1044912 - protein, 9 aa, Homo Sapiens
QRIIVGTLQ

SEQ ID NO: 1044913 - protein, 9 aa, Homo Sapiens
EGLEAQREA

SEQ ID NO: 1044914 - protein, 9 aa, Homo Sapiens
NETSALKFE

SEQ ID NO: 1044915 - protein, 9 aa, Homo Sapiens
WIHTPAKIQ

SEQ ID NO: 1044916 - protein, 9 aa, Homo Sapiens
EKETRSVMN

SEQ ID NO: 1044917 - protein, 9 aa, Homo Sapiens
HPEAFTSIL

SEQ ID NO: 1044918 - protein, 9 aa, Homo Sapiens
PCNCDLRGT

SEQ ID NO: 1044919 - protein, 9 aa, Homo Sapiens
VGCLGLVSL

SEQ ID NO: 1044920 - protein, 9 aa, Homo Sapiens
ALNDKINFL

SEQ ID NO: 1044921 - protein, 9 aa, Homo Sapiens
QNNLMMPRP

SEQ ID NO: 1044922 - protein, 9 aa, Homo Sapiens
ENIQELLEN

SEQ ID NO: 1044923 - protein, 9 aa, Homo Sapiens
QKKSSLLKK

SEQ ID NO: 1044924 - protein, 9 aa, Homo Sapiens
PILAAHSFV

SEQ ID NO: 1044925 - protein, 9 aa, Homo Sapiens
NLTVPQEKL

SEQ ID NO: 1044926 - protein, 9 aa, Homo Sapiens
KEPKIVMTP

SEQ ID NO: 1044927 - protein, 9 aa, Homo Sapiens
SLASRSGSC

SEQ ID NO: 1044928 - protein, 9 aa, Homo Sapiens
VVGCLGLVS

SEQ ID NO: 1044929 - protein, 9 aa, Homo Sapiens
MGLKIEDTV

SEQ ID NO: 1044930 - protein, 9 aa, Homo Sapiens
ICKPVTVHS

SEQ ID NO: 1044931 - protein, 9 aa, Homo Sapiens
APIRIWMLN

SEQ ID NO: 1044932 - protein, 9 aa, Homo Sapiens
IVEECQRQG

SEQ ID NO: 1044933 - protein, 9 aa, Homo Sapiens
PQPPQASLP

SEQ ID NO: 1044934 - protein, 9 aa, Homo Sapiens
CYLAICRPL

SEQ ID NO: 1044935 - protein, 9 aa, Homo Sapiens
YQKTLKKIE

SEQ ID NO: 1044936 - protein, 9 aa, Homo Sapiens
MQESISERI

SEQ ID NO: 1044937 - protein, 9 aa, Homo Sapiens
LSRPPNLPG

SEQ ID NO: 1044938 - protein, 9 aa, Homo Sapiens
ESSLLVPIQ

SEQ ID NO: 1044939 - protein, 9 aa, Homo Sapiens
VPKQKKGKE

SEQ ID NO: 1044940 - protein, 9 aa, Homo Sapiens
AQIRDARGG

SEQ ID NO: 1044941 - protein, 9 aa, Homo Sapiens
VSFRGADYF

SEQ ID NO: 1044942 - protein, 9 aa, Homo Sapiens
GSVSAVTKE

SEQ ID NO: 1044943 - protein, 9 aa, Homo Sapiens
LLIDFAHFW

SEQ ID NO: 1044944 - protein, 9 aa, Homo Sapiens
SPTEHVKTK

SEQ ID NO: 1044945 - protein, 9 aa, Homo Sapiens
TFLPFTLQK

SEQ ID NO: 1044946 - protein, 9 aa, Homo Sapiens
LQKLRSASS

SEQ ID NO: 1044947 - protein, 9 aa, Homo Sapiens
RKAMERDPW

SEQ ID NO: 1044948 - protein, 9 aa, Homo Sapiens
GSLVGGFVY

SEQ ID NO: 1044949 - protein, 9 aa, Homo Sapiens
VSQLATCGH

SEQ ID NO: 1044950 - protein, 9 aa, Homo Sapiens
GFGNFYTLV

SEQ ID NO: 1044951 - protein, 9 aa, Homo Sapiens
HLTEVNPDE

SEQ ID NO: 1044952 - protein, 9 aa, Homo Sapiens
EQLTSSTNG

SEQ ID NO: 1044953 - protein, 9 aa, Homo Sapiens
NQENRSSCF

SEQ ID NO: 1044954 - protein, 9 aa, Homo Sapiens
FNFQRENEA

SEQ ID NO: 1044955 - protein, 9 aa, Homo Sapiens
MQKKILLTC

SEQ ID NO: 1044956 - protein, 9 aa, Homo Sapiens
QFQARMWRI

SEQ ID NO: 1044957 - protein, 9 aa, Homo Sapiens
LSIHYKQQI

SEQ ID NO: 1044958 - protein, 9 aa, Homo Sapiens
ARQRRGFPR

SEQ ID NO: 1044959 - protein, 9 aa, Homo Sapiens
DDPESEDVK

SEQ ID NO: 1044960 - protein, 9 aa, Homo Sapiens
PSRTRLYDT

SEQ ID NO: 1044961 - protein, 9 aa, Homo Sapiens
DSQTPSSTP

SEQ ID NO: 1044962 - protein, 9 aa, Homo Sapiens
TFTRSQLEK

SEQ ID NO: 1044963 - protein, 9 aa, Homo Sapiens
LLKLQDIMT

SEQ ID NO: 1044964 - protein, 9 aa, Homo Sapiens
AVRAELEKI

SEQ ID NO: 1044965 - protein, 9 aa, Homo Sapiens
FFFKTLHFL

SEQ ID NO: 1044966 - protein, 9 aa, Homo Sapiens
IMYRRIGIS

SEQ ID NO: 1044967 - protein, 9 aa, Homo Sapiens
RKAANVLRG

SEQ ID NO: 1044968 - protein, 9 aa, Homo Sapiens
ISIPSVPTF

SEQ ID NO: 1044969 - protein, 9 aa, Homo Sapiens
AAYFAQVKH

SEQ ID NO: 1044970 - protein, 9 aa, Homo Sapiens
EQLLACQQK

SEQ ID NO: 1044971 - protein, 9 aa, Homo Sapiens
GIEEKAAKN

SEQ ID NO: 1044972 - protein, 9 aa, Homo Sapiens
RLTDEEVDE

SEQ ID NO: 1044973 - protein, 9 aa, Homo Sapiens
FLKTCQQAE

SEQ ID NO: 1044974 - protein, 9 aa, Homo Sapiens
YHRKLKKRQ

SEQ ID NO: 1044975 - protein, 9 aa, Homo Sapiens
VIPNFTESI

SEQ ID NO: 1044976 - protein, 9 aa, Homo Sapiens
EQKKKEEFM

SEQ ID NO: 1044977 - protein, 9 aa, Homo Sapiens
HIPESLYLV

SEQ ID NO: 1044978 - protein, 9 aa, Homo Sapiens
EEKRCALGT

SEQ ID NO: 1044979 - protein, 9 aa, Homo Sapiens
ASDTSAVLS

SEQ ID NO: 1044980 - protein, 9 aa, Homo Sapiens
SLQERLRRK

SEQ ID NO: 1044981 - protein, 9 aa, Homo Sapiens
DVYGFSDGL

SEQ ID NO: 1044982 - protein, 9 aa, Homo Sapiens
VKGEKGPKD

SEQ ID NO: 1044983 - protein, 9 aa, Homo Sapiens
LFLLAMRAN

SEQ ID NO: 1044984 - protein, 9 aa, Homo Sapiens
CHFLKKARI

SEQ ID NO: 1044985 - protein, 9 aa, Homo Sapiens
EVTTNVAIY

SEQ ID NO: 1044986 - protein, 9 aa, Homo Sapiens
LATESNTVL

SEQ ID NO: 1044987 - protein, 9 aa, Homo Sapiens
FQGQETRKQ

SEQ ID NO: 1044988 - protein, 9 aa, Homo Sapiens
KKNEMKASS

SEQ ID NO: 1044989 - protein, 9 aa, Homo Sapiens
SGWMSVCRE

SEQ ID NO: 1044990 - protein, 9 aa, Homo Sapiens
KKIEDPPND

SEQ ID NO: 1044991 - protein, 9 aa, Homo Sapiens
KKEINIIKL

SEQ ID NO: 1044992 - protein, 9 aa, Homo Sapiens
IDCDESGII

SEQ ID NO: 1044993 - protein, 9 aa, Homo Sapiens
VAQKMAKPE

SEQ ID NO: 1044994 - protein, 9 aa, Homo Sapiens
IEGLIALVA

SEQ ID NO: 1044995 - protein, 9 aa, Homo Sapiens
DSGAGESES

SEQ ID NO: 1044996 - protein, 9 aa, Homo Sapiens
ELIEKKEMK

SEQ ID NO: 1044997 - protein, 9 aa, Homo Sapiens
ARKNEGEWD

SEQ ID NO: 1044998 - protein, 9 aa, Homo Sapiens
NAAEALLLQ

SEQ ID NO: 1044999 - protein, 9 aa, Homo Sapiens
KRTISFLSC

SEQ ID NO: 1045000 - protein, 9 aa, Homo Sapiens
GYCNPGIYL

SEQ ID NO: 1045001 - protein, 9 aa, Homo Sapiens
AAEADGPDA

SEQ ID NO: 1045002 - protein, 9 aa, Homo Sapiens
RMYRRTSDM

SEQ ID NO: 1045003 - protein, 9 aa, Homo Sapiens
EEKVKGLQR

SEQ ID NO: 1045004 - protein, 9 aa, Homo Sapiens
KEANFHEVT

SEQ ID NO: 1045005 - protein, 9 aa, Homo Sapiens
THQAPLSSP

SEQ ID NO: 1045006 - protein, 9 aa, Homo Sapiens
SSLLWKERR

SEQ ID NO: 1045007 - protein, 9 aa, Homo Sapiens
TEGFIRLNS

SEQ ID NO: 1045008 - protein, 9 aa, Homo Sapiens
STNFLLVAA

SEQ ID NO: 1045009 - protein, 9 aa, Homo Sapiens
HRYKAQDTL

SEQ ID NO: 1045010 - protein, 9 aa, Homo Sapiens
EFAALLAQF

SEQ ID NO: 1045011 - protein, 9 aa, Homo Sapiens
PGQGLVLLR

SEQ ID NO: 1045012 - protein, 9 aa, Homo Sapiens
SEGRERDHK

SEQ ID NO: 1045013 - protein, 9 aa, Homo Sapiens
SVDPNNETL

SEQ ID NO: 1045014 - protein, 9 aa, Homo Sapiens
IYRGEVWGK

SEQ ID NO: 1045015 - protein, 9 aa, Homo Sapiens
FLTFPRIVL

SEQ ID NO: 1045016 - protein, 9 aa, Homo Sapiens
QFVIGGKKL

SEQ ID NO: 1045017 - protein, 9 aa, Homo Sapiens
IETSEDIER

SEQ ID NO: 1045018 - protein, 9 aa, Homo Sapiens
RLSYCKGNV

SEQ ID NO: 1045019 - protein, 9 aa, Homo Sapiens
TNVAIYTVS

SEQ ID NO: 1045020 - protein, 9 aa, Homo Sapiens
FFTSIFIPR

SEQ ID NO: 1045021 - protein, 9 aa, Homo Sapiens
SKVYQLVSC

SEQ ID NO: 1045022 - protein, 9 aa, Homo Sapiens
LGIIETSED

SEQ ID NO: 1045023 - protein, 9 aa, Homo Sapiens
SPQLAEKKQ

SEQ ID NO: 1045024 - protein, 9 aa, Homo Sapiens
AFSAASAMI

SEQ ID NO: 1045025 - protein, 9 aa, Homo Sapiens
TVANLFVAG

SEQ ID NO: 1045026 - protein, 9 aa, Homo Sapiens
IHRGEKPYA

SEQ ID NO: 1045027 - protein, 9 aa, Homo Sapiens
VDCSKLLPT

SEQ ID NO: 1045028 - protein, 9 aa, Homo Sapiens
KQFVIGGKK

SEQ ID NO: 1045029 - protein, 9 aa, Homo Sapiens
TSEDIERLA

SEQ ID NO: 1045030 - protein, 9 aa, Homo Sapiens
VGFFSSNTT

SEQ ID NO: 1045031 - protein, 9 aa, Homo Sapiens
EKKKDTLKQ

SEQ ID NO: 1045032 - protein, 9 aa, Homo Sapiens
GCYNISNEV

SEQ ID NO: 1045033 - protein, 9 aa, Homo Sapiens
MTLQCAQNM

SEQ ID NO: 1045034 - protein, 9 aa, Homo Sapiens
FYEGGRCSF

SEQ ID NO: 1045035 - protein, 9 aa, Homo Sapiens
RRLITRGGW

SEQ ID NO: 1045036 - protein, 9 aa, Homo Sapiens
GEAGAETGQ

SEQ ID NO: 1045037 - protein, 9 aa, Homo Sapiens
FSAGRKHKA

SEQ ID NO: 1045038 - protein, 9 aa, Homo Sapiens
QRGMFNCTY

SEQ ID NO: 1045039 - protein, 9 aa, Homo Sapiens
PSPGASSPH

SEQ ID NO: 1045040 - protein, 9 aa, Homo Sapiens
RKVICVRKN

SEQ ID NO: 1045041 - protein, 9 aa, Homo Sapiens
QVPSMMASA

SEQ ID NO: 1045042 - protein, 9 aa, Homo Sapiens
GIDGIEGDR

SEQ ID NO: 1045043 - protein, 9 aa, Homo Sapiens
GSKTAGPLC

SEQ ID NO: 1045044 - protein, 9 aa, Homo Sapiens
HCEDGSLDF

SEQ ID NO: 1045045 - protein, 9 aa, Homo Sapiens
AEADGPDAR

SEQ ID NO: 1045046 - protein, 9 aa, Homo Sapiens
GKVCVRKVA

SEQ ID NO: 1045047 - protein, 9 aa, Homo Sapiens
RSGEDRGIH

SEQ ID NO: 1045048 - protein, 9 aa, Homo Sapiens
LGPPPLCRD

SEQ ID NO: 1045049 - protein, 9 aa, Homo Sapiens
GYLGYTSRF

SEQ ID NO: 1045050 - protein, 9 aa, Homo Sapiens
ATVESQEET

SEQ ID NO: 1045051 - protein, 9 aa, Homo Sapiens
PDVYGFSDG

SEQ ID NO: 1045052 - protein, 9 aa, Homo Sapiens
RKCYFPYLK

SEQ ID NO: 1045053 - protein, 9 aa, Homo Sapiens
SCSNRVDLY

SEQ ID NO: 1045054 - protein, 9 aa, Homo Sapiens
FMYIKPSAE

SEQ ID NO: 1045055 - protein, 9 aa, Homo Sapiens
CNDSWDTND

SEQ ID NO: 1045056 - protein, 9 aa, Homo Sapiens
QETTMDYRA

SEQ ID NO: 1045057 - protein, 9 aa, Homo Sapiens
SEMVKKSER

SEQ ID NO: 1045058 - protein, 9 aa, Homo Sapiens
KTSFLAEAE

SEQ ID NO: 1045059 - protein, 9 aa, Homo Sapiens
RVFGTGQND

SEQ ID NO: 1045060 - protein, 9 aa, Homo Sapiens
NSSLSLAVS

SEQ ID NO: 1045061 - protein, 9 aa, Homo Sapiens
CNLVLIYLI

SEQ ID NO: 1045062 - protein, 9 aa, Homo Sapiens
QEQGCAEEK

SEQ ID NO: 1045063 - protein, 9 aa, Homo Sapiens
LGYLGYTSR

SEQ ID NO: 1045064 - protein, 9 aa, Homo Sapiens
SSSPPVNVT

SEQ ID NO: 1045065 - protein, 9 aa, Homo Sapiens
PGLTCAVFG

SEQ ID NO: 1045066 - protein, 9 aa, Homo Sapiens
DTLFSVFKY

SEQ ID NO: 1045067 - protein, 9 aa, Homo Sapiens
LEGLDYLHK

SEQ ID NO: 1045068 - protein, 9 aa, Homo Sapiens
KGALGSLFS

SEQ ID NO: 1045069 - protein, 9 aa, Homo Sapiens
SEETEKEEQ

SEQ ID NO: 1045070 - protein, 9 aa, Homo Sapiens
GIETMKKVL

SEQ ID NO: 1045071 - protein, 9 aa, Homo Sapiens
FVGFFSSNT

SEQ ID NO: 1045072 - protein, 9 aa, Homo Sapiens
KTNLHNCVA

SEQ ID NO: 1045073 - protein, 9 aa, Homo Sapiens
QLGPLGRDL

SEQ ID NO: 1045074 - protein, 9 aa, Homo Sapiens
LTYTVVGCL

SEQ ID NO: 1045075 - protein, 9 aa, Homo Sapiens
QKANMDNEN

SEQ ID NO: 1045076 - protein, 9 aa, Homo Sapiens
QERQGVNML

SEQ ID NO: 1045077 - protein, 9 aa, Homo Sapiens
KTSDQDLNR

SEQ ID NO: 1045078 - protein, 9 aa, Homo Sapiens
SVIFGHELV

SEQ ID NO: 1045079 - protein, 9 aa, Homo Sapiens
LVSLHRDCS

SEQ ID NO: 1045080 - protein, 9 aa, Homo Sapiens
KSTLISQAF

SEQ ID NO: 1045081 - protein, 9 aa, Homo Sapiens
PVGSLLSLE

SEQ ID NO: 1045082 - protein, 9 aa, Homo Sapiens
GILLMAFPI

SEQ ID NO: 1045083 - protein, 9 aa, Homo Sapiens
FKEEKVKGL

SEQ ID NO: 1045084 - protein, 9 aa, Homo Sapiens
LSQRRLYPP

SEQ ID NO: 1045085 - protein, 9 aa, Homo Sapiens
AWSGARRGR

SEQ ID NO: 1045086 - protein, 9 aa, Homo Sapiens
DDSCPTVNF

SEQ ID NO: 1045087 - protein, 9 aa, Homo Sapiens
IDNLYERVL

SEQ ID NO: 1045088 - protein, 9 aa, Homo Sapiens
SLKSRSFSL

SEQ ID NO: 1045089 - protein, 9 aa, Homo Sapiens
KKFEHKLNV

SEQ ID NO: 1045090 - protein, 9 aa, Homo Sapiens
TRISSRLHL

SEQ ID NO: 1045091 - protein, 9 aa, Homo Sapiens
FIIQKNMER

SEQ ID NO: 1045092 - protein, 9 aa, Homo Sapiens
SEMKMKVLK

SEQ ID NO: 1045093 - protein, 9 aa, Homo Sapiens
HPAPAGAGE

SEQ ID NO: 1045094 - protein, 9 aa, Homo Sapiens
GVYPLKKAS

SEQ ID NO: 1045095 - protein, 9 aa, Homo Sapiens
LEAISAPDS

SEQ ID NO: 1045096 - protein, 9 aa, Homo Sapiens
QPNKALKFL

SEQ ID NO: 1045097 - protein, 9 aa, Homo Sapiens
TRVPGGAEH

SEQ ID NO: 1045098 - protein, 9 aa, Homo Sapiens
FLIEHMIML

SEQ ID NO: 1045099 - protein, 9 aa, Homo Sapiens
RCLPSRAAR

SEQ ID NO: 1045100 - protein, 9 aa, Homo Sapiens
AKWRTSDGL

SEQ ID NO: 1045101 - protein, 9 aa, Homo Sapiens
VKPVDVVDN

SEQ ID NO: 1045102 - protein, 9 aa, Homo Sapiens
GFHGHPTVE

SEQ ID NO: 1045103 - protein, 9 aa, Homo Sapiens
SEVLRKDPY

SEQ ID NO: 1045104 - protein, 9 aa, Homo Sapiens
YNLRGAASM

SEQ ID NO: 1045105 - protein, 9 aa, Homo Sapiens
RDLPQECST

SEQ ID NO: 1045106 - protein, 9 aa, Homo Sapiens
NKLHVTDPD

SEQ ID NO: 1045107 - protein, 9 aa, Homo Sapiens
KFKTIQEEE

SEQ ID NO: 1045108 - protein, 9 aa, Homo Sapiens
PDISKEELS

SEQ ID NO: 1045109 - protein, 9 aa, Homo Sapiens
GAAAEETGG

SEQ ID NO: 1045110 - protein, 9 aa, Homo Sapiens
FPGSVLARP

SEQ ID NO: 1045111 - protein, 9 aa, Homo Sapiens
AIPEKYGVV

SEQ ID NO: 1045112 - protein, 9 aa, Homo Sapiens
REELTTVMR

SEQ ID NO: 1045113 - protein, 9 aa, Homo Sapiens
AQGIRTLLF

SEQ ID NO: 1045114 - protein, 9 aa, Homo Sapiens
SKVFETDSS

SEQ ID NO: 1045115 - protein, 9 aa, Homo Sapiens
LVQLGQTHK

SEQ ID NO: 1045116 - protein, 9 aa, Homo Sapiens
EINEKLSPQ

SEQ ID NO: 1045117 - protein, 9 aa, Homo Sapiens
LIEEMGMTF

SEQ ID NO: 1045118 - protein, 9 aa, Homo Sapiens
SLLFGPLLA

SEQ ID NO: 1045119 - protein, 9 aa, Homo Sapiens
PPPSVVHTG

SEQ ID NO: 1045120 - protein, 9 aa, Homo Sapiens
FTRSQLEKL

SEQ ID NO: 1045121 - protein, 9 aa, Homo Sapiens
LHICLMDHL

SEQ ID NO: 1045122 - protein, 9 aa, Homo Sapiens
REQKKEQML

SEQ ID NO: 1045123 - protein, 9 aa, Homo Sapiens
GPEEDSPWG

SEQ ID NO: 1045124 - protein, 9 aa, Homo Sapiens
TVRNDGARS

SEQ ID NO: 1045125 - protein, 9 aa, Homo Sapiens
SLEGKQKAF

SEQ ID NO: 1045126 - protein, 9 aa, Homo Sapiens
TGGKDDIVE

SEQ ID NO: 1045127 - protein, 9 aa, Homo Sapiens
FLKKARIAQ

SEQ ID NO: 1045128 - protein, 9 aa, Homo Sapiens
TYNFFIVLL

SEQ ID NO: 1045129 - protein, 9 aa, Homo Sapiens
FRRHEKTHT

SEQ ID NO: 1045130 - protein, 9 aa, Homo Sapiens
SCGYPGVPP

SEQ ID NO: 1045131 - protein, 9 aa, Homo Sapiens
DGVPPLGSN

SEQ ID NO: 1045132 - protein, 9 aa, Homo Sapiens
CRQAMLTLT

SEQ ID NO: 1045133 - protein, 9 aa, Homo Sapiens
RGLQEKNAL

SEQ ID NO: 1045134 - protein, 9 aa, Homo Sapiens
PTELSHGSN

SEQ ID NO: 1045135 - protein, 9 aa, Homo Sapiens
RLKVMKRQV

SEQ ID NO: 1045136 - protein, 9 aa, Homo Sapiens
PLSGDPSIE

SEQ ID NO: 1045137 - protein, 9 aa, Homo Sapiens
PQILCYPET

SEQ ID NO: 1045138 - protein, 9 aa, Homo Sapiens
HKDFFTSKK

SEQ ID NO: 1045139 - protein, 9 aa, Homo Sapiens
EEIFNHFVQ

SEQ ID NO: 1045140 - protein, 9 aa, Homo Sapiens
ALCTPSYLS

SEQ ID NO: 1045141 - protein, 9 aa, Homo Sapiens
IPESLYLVP

SEQ ID NO: 1045142 - protein, 9 aa, Homo Sapiens
KAMERDPWI

SEQ ID NO: 1045143 - protein, 9 aa, Homo Sapiens
VMSLDCYLA

SEQ ID NO: 1045144 - protein, 9 aa, Homo Sapiens
EKKKEKNIN

SEQ ID NO: 1045145 - protein, 9 aa, Homo Sapiens
SEVTTNVAI

SEQ ID NO: 1045146 - protein, 9 aa, Homo Sapiens
HTKPFVFVM

SEQ ID NO: 1045147 - protein, 9 aa, Homo Sapiens
SEDIERLAK

SEQ ID NO: 1045148 - protein, 9 aa, Homo Sapiens
EKIEKERDQ

SEQ ID NO: 1045149 - protein, 9 aa, Homo Sapiens
QEKTKKHPK

SEQ ID NO: 1045150 - protein, 9 aa, Homo Sapiens
YNEISDINL

SEQ ID NO: 1045151 - protein, 9 aa, Homo Sapiens
KLLAQRHGV

SEQ ID NO: 1045152 - protein, 9 aa, Homo Sapiens
QMVFIYVFS

SEQ ID NO: 1045153 - protein, 9 aa, Homo Sapiens
ISIELDMAV

SEQ ID NO: 1045154 - protein, 9 aa, Homo Sapiens
KAFRNRLSL

SEQ ID NO: 1045155 - protein, 9 aa, Homo Sapiens
FILLFYALI

SEQ ID NO: 1045156 - protein, 9 aa, Homo Sapiens
NALSGSSSW

SEQ ID NO: 1045157 - protein, 9 aa, Homo Sapiens
TPGRRIREK

SEQ ID NO: 1045158 - protein, 9 aa, Homo Sapiens
ENAYNIRLK

SEQ ID NO: 1045159 - protein, 9 aa, Homo Sapiens
KEPRIRNII

SEQ ID NO: 1045160 - protein, 9 aa, Homo Sapiens
KTKIFLRDY

SEQ ID NO: 1045161 - protein, 9 aa, Homo Sapiens
NANLTKTQL

SEQ ID NO: 1045162 - protein, 9 aa, Homo Sapiens
LGAPSRDVL

SEQ ID NO: 1045163 - protein, 9 aa, Homo Sapiens
ESKKEKIEL

SEQ ID NO: 1045164 - protein, 9 aa, Homo Sapiens
KCPLSEMHV

SEQ ID NO: 1045165 - protein, 9 aa, Homo Sapiens
FRSPLSDQL

SEQ ID NO: 1045166 - protein, 9 aa, Homo Sapiens
YNSTTLWEV

SEQ ID NO: 1045167 - protein, 9 aa, Homo Sapiens
EEGLEAQRE

SEQ ID NO: 1045168 - protein, 9 aa, Homo Sapiens
THQTYLVVA

SEQ ID NO: 1045169 - protein, 9 aa, Homo Sapiens
LRNNILFGK

SEQ ID NO: 1045170 - protein, 9 aa, Homo Sapiens
DTHQHQEKQ

SEQ ID NO: 1045171 - protein, 9 aa, Homo Sapiens
QMKKGGDVT

SEQ ID NO: 1045172 - protein, 9 aa, Homo Sapiens
MRNVTFLGK

SEQ ID NO: 1045173 - protein, 9 aa, Homo Sapiens
SKSALYRRA

SEQ ID NO: 1045174 - protein, 9 aa, Homo Sapiens
HIKVDLLFT

SEQ ID NO: 1045175 - protein, 9 aa, Homo Sapiens
PPICLVSKG

SEQ ID NO: 1045176 - protein, 9 aa, Homo Sapiens
RALGRASCA

SEQ ID NO: 1045177 - protein, 9 aa, Homo Sapiens
PTAVLAAGK

SEQ ID NO: 1045178 - protein, 9 aa, Homo Sapiens
CLRLSSMFG

SEQ ID NO: 1045179 - protein, 9 aa, Homo Sapiens
LAGGSGLPE

SEQ ID NO: 1045180 - protein, 9 aa, Homo Sapiens
RPSKRITIF

SEQ ID NO: 1045181 - protein, 9 aa, Homo Sapiens
GGDVPKQKK

SEQ ID NO: 1045182 - protein, 9 aa, Homo Sapiens
FPPRSPWGD

SEQ ID NO: 1045183 - protein, 9 aa, Homo Sapiens
KDCCINSHS

SEQ ID NO: 1045184 - protein, 9 aa, Homo Sapiens
EGSVPGIER

SEQ ID NO: 1045185 - protein, 9 aa, Homo Sapiens
ASLCRSSDG

SEQ ID NO: 1045186 - protein, 9 aa, Homo Sapiens
IPVLSNNYS

SEQ ID NO: 1045187 - protein, 9 aa, Homo Sapiens
GEPFEICRL

SEQ ID NO: 1045188 - protein, 9 aa, Homo Sapiens
FDDSYQLCH

SEQ ID NO: 1045189 - protein, 9 aa, Homo Sapiens
TSESKVYQL

SEQ ID NO: 1045190 - protein, 9 aa, Homo Sapiens
TPVLRDSWG

SEQ ID NO: 1045191 - protein, 9 aa, Homo Sapiens
SRCEQFCKN

SEQ ID NO: 1045192 - protein, 9 aa, Homo Sapiens
VERLLQHLQ

SEQ ID NO: 1045193 - protein, 9 aa, Homo Sapiens
SLKKIKTSE

SEQ ID NO: 1045194 - protein, 9 aa, Homo Sapiens
HSAFRLASD

SEQ ID NO: 1045195 - protein, 9 aa, Homo Sapiens
LVDYLSETI

SEQ ID NO: 1045196 - protein, 9 aa, Homo Sapiens
FETDSSLQI

SEQ ID NO: 1045197 - protein, 9 aa, Homo Sapiens
LMVMAFDCY

SEQ ID NO: 1045198 - protein, 9 aa, Homo Sapiens
AISAPDSKR

SEQ ID NO: 1045199 - protein, 9 aa, Homo Sapiens
KSVFFSDVF

SEQ ID NO: 1045200 - protein, 9 aa, Homo Sapiens
TEGFFVTLD

SEQ ID NO: 1045201 - protein, 9 aa, Homo Sapiens
NLYFYRDSE

SEQ ID NO: 1045202 - protein, 9 aa, Homo Sapiens
KEKEMETLG

SEQ ID NO: 1045203 - protein, 9 aa, Homo Sapiens
PSSTKLARI

SEQ ID NO: 1045204 - protein, 9 aa, Homo Sapiens
SAEKAITVL

SEQ ID NO: 1045205 - protein, 9 aa, Homo Sapiens
EMGSVNKAD

SEQ ID NO: 1045206 - protein, 9 aa, Homo Sapiens
SRPQQRYSF

SEQ ID NO: 1045207 - protein, 9 aa, Homo Sapiens
FPQAASLRS

SEQ ID NO: 1045208 - protein, 9 aa, Homo Sapiens
FIGMAIKIS

SEQ ID NO: 1045209 - protein, 9 aa, Homo Sapiens
VKLPLVLIH

SEQ ID NO: 1045210 - protein, 9 aa, Homo Sapiens
TDEINFLKA

SEQ ID NO: 1045211 - protein, 9 aa, Homo Sapiens
MYLQVETRI

SEQ ID NO: 1045212 - protein, 8 aa, Homo Sapiens
DPGLQQAL

SEQ ID NO: 1045213 - protein, 9 aa, Homo Sapiens
KQADNRHVA

SEQ ID NO: 1045214 - protein, 9 aa, Homo Sapiens
IGLVNFAVP

SEQ ID NO: 1045215 - protein, 9 aa, Homo Sapiens
KLRRRGLPV

SEQ ID NO: 1045216 - protein, 9 aa, Homo Sapiens
LLMAFPITS

SEQ ID NO: 1045217 - protein, 9 aa, Homo Sapiens
LRRVAHINE

SEQ ID NO: 1045218 - protein, 9 aa, Homo Sapiens
ALLISQDKL

SEQ ID NO: 1045219 - protein, 9 aa, Homo Sapiens
YGFKLQNLD

SEQ ID NO: 1045220 - protein, 9 aa, Homo Sapiens
HAQKGAQDG

SEQ ID NO: 1045221 - protein, 9 aa, Homo Sapiens
QGPKESGAC

SEQ ID NO: 1045222 - protein, 9 aa, Homo Sapiens
SVGPRGAVK

SEQ ID NO: 1045223 - protein, 9 aa, Homo Sapiens
QKGDVYSYR

SEQ ID NO: 1045224 - protein, 9 aa, Homo Sapiens
IRQKLENRC

SEQ ID NO: 1045225 - protein, 9 aa, Homo Sapiens
SGLKEEEEQ

SEQ ID NO: 1045226 - protein, 9 aa, Homo Sapiens
SLHIVFSTN

SEQ ID NO: 1045227 - protein, 9 aa, Homo Sapiens
ATPGRRIRE

SEQ ID NO: 1045228 - protein, 9 aa, Homo Sapiens
TNGRMLLQY

SEQ ID NO: 1045229 - protein, 9 aa, Homo Sapiens
GQSKSHVSS

SEQ ID NO: 1045230 - protein, 9 aa, Homo Sapiens
EASKKAEAI

SEQ ID NO: 1045231 - protein, 9 aa, Homo Sapiens
ETGQSCPTG

SEQ ID NO: 1045232 - protein, 9 aa, Homo Sapiens
ESYECSCSE

SEQ ID NO: 1045233 - protein, 9 aa, Homo Sapiens
FETQKKEFV

SEQ ID NO: 1045234 - protein, 9 aa, Homo Sapiens
QLVTQLMLH

SEQ ID NO: 1045235 - protein, 9 aa, Homo Sapiens
GSGLKHVPC

SEQ ID NO: 1045236 - protein, 9 aa, Homo Sapiens
RNKVKVDGP

SEQ ID NO: 1045237 - protein, 9 aa, Homo Sapiens
SKQARGGFA

SEQ ID NO: 1045238 - protein, 9 aa, Homo Sapiens
SSNNPQDDI

SEQ ID NO: 1045239 - protein, 9 aa, Homo Sapiens
EYSHQMWGR

SEQ ID NO: 1045240 - protein, 9 aa, Homo Sapiens
ASLEKVRIE

SEQ ID NO: 1045241 - protein, 9 aa, Homo Sapiens
KQGEPLIIS

SEQ ID NO: 1045242 - protein, 9 aa, Homo Sapiens
ISCLKYCGD

SEQ ID NO: 1045243 - protein, 9 aa, Homo Sapiens
EQPTSFLPR

SEQ ID NO: 1045244 - protein, 9 aa, Homo Sapiens
RKGSNKRGD

SEQ ID NO: 1045245 - protein, 9 aa, Homo Sapiens
FSKECEENT

SEQ ID NO: 1045246 - protein, 9 aa, Homo Sapiens
KDTADRPPA

SEQ ID NO: 1045247 - protein, 9 aa, Homo Sapiens
DKTDSAVNT

SEQ ID NO: 1045248 - protein, 9 aa, Homo Sapiens
YSHFPCTVR

SEQ ID NO: 1045249 - protein, 9 aa, Homo Sapiens
DMKKFTEII

SEQ ID NO: 1045250 - protein, 9 aa, Homo Sapiens
DLFFANEKE

SEQ ID NO: 1045251 - protein, 9 aa, Homo Sapiens
YLPLQCYES

SEQ ID NO: 1045252 - protein, 9 aa, Homo Sapiens
TEDDFAVPS

SEQ ID NO: 1045253 - protein, 9 aa, Homo Sapiens
SYPSELIFV

SEQ ID NO: 1045254 - protein, 9 aa, Homo Sapiens
LFACEECGR

SEQ ID NO: 1045255 - protein, 9 aa, Homo Sapiens
ASNVGGGHF

SEQ ID NO: 1045256 - protein, 9 aa, Homo Sapiens
RRFTIISNT

SEQ ID NO: 1045257 - protein, 9 aa, Homo Sapiens
YYRGAMGIV

SEQ ID NO: 1045258 - protein, 9 aa, Homo Sapiens
SWTSPASWF

SEQ ID NO: 1045259 - protein, 9 aa, Homo Sapiens
SSSHDEALV

SEQ ID NO: 1045260 - protein, 9 aa, Homo Sapiens
QVCLHDLVQ

SEQ ID NO: 1045261 - protein, 9 aa, Homo Sapiens
TSEMRLYTV

SEQ ID NO: 1045262 - protein, 9 aa, Homo Sapiens
NHSGTLGLF

SEQ ID NO: 1045263 - protein, 9 aa, Homo Sapiens
LRGQHWLLG

SEQ ID NO: 1045264 - protein, 9 aa, Homo Sapiens
LPATVESAV

SEQ ID NO: 1045265 - protein, 9 aa, Homo Sapiens
CQPKKEGSR

SEQ ID NO: 1045266 - protein, 9 aa, Homo Sapiens
AARATAALT

SEQ ID NO: 1045267 - protein, 9 aa, Homo Sapiens
SRNILWAFE

SEQ ID NO: 1045268 - protein, 9 aa, Homo Sapiens
FCTYDDFSY

SEQ ID NO: 1045269 - protein, 9 aa, Homo Sapiens
QEYCVCKMP

SEQ ID NO: 1045270 - protein, 9 aa, Homo Sapiens
RVLPQSPGT

SEQ ID NO: 1045271 - protein, 9 aa, Homo Sapiens
KAGGLLQPK

SEQ ID NO: 1045272 - protein, 9 aa, Homo Sapiens
ANQDPDFIL

SEQ ID NO: 1045273 - protein, 9 aa, Homo Sapiens
GLKPPVYVP

SEQ ID NO: 1045274 - protein, 9 aa, Homo Sapiens
KANMDNENA

SEQ ID NO: 1045275 - protein, 9 aa, Homo Sapiens
EENTVYQEA

SEQ ID NO: 1045276 - protein, 9 aa, Homo Sapiens
IPLSGCLDS

SEQ ID NO: 1045277 - protein, 9 aa, Homo Sapiens
FQQFQAFCL

SEQ ID NO: 1045278 - protein, 9 aa, Homo Sapiens
KDVKDSIKK

SEQ ID NO: 1045279 - protein, 9 aa, Homo Sapiens
DSHFSHSAV

SEQ ID NO: 1045280 - protein, 9 aa, Homo Sapiens
FIEPRYHVR

SEQ ID NO: 1045281 - protein, 9 aa, Homo Sapiens
PAGMAPQGM

SEQ ID NO: 1045282 - protein, 9 aa, Homo Sapiens
RRQRVFFGV

SEQ ID NO: 1045283 - protein, 9 aa, Homo Sapiens
VLDKVCKNK

SEQ ID NO: 1045284 - protein, 9 aa, Homo Sapiens
NYKIIKLLV

SEQ ID NO: 1045285 - protein, 9 aa, Homo Sapiens
ISSSNSVTT

SEQ ID NO: 1045286 - protein, 9 aa, Homo Sapiens
KKMFPHRKN

SEQ ID NO: 1045287 - protein, 9 aa, Homo Sapiens
QAAVENVLE

SEQ ID NO: 1045288 - protein, 9 aa, Homo Sapiens
AGTGSSSPP

SEQ ID NO: 1045289 - protein, 9 aa, Homo Sapiens
TQLFCNVRA

SEQ ID NO: 1045290 - protein, 9 aa, Homo Sapiens
IRRNDKVPG

SEQ ID NO: 1045291 - protein, 9 aa, Homo Sapiens
FFQSGSQEN

SEQ ID NO: 1045292 - protein, 9 aa, Homo Sapiens
PSEFVDNAS

SEQ ID NO: 1045293 - protein, 9 aa, Homo Sapiens
CLCVTSTLD

SEQ ID NO: 1045294 - protein, 9 aa, Homo Sapiens
VRSLAEVLV

SEQ ID NO: 1045295 - protein, 9 aa, Homo Sapiens
AYLENFSGR

SEQ ID NO: 1045296 - protein, 9 aa, Homo Sapiens
ETDLQNLEL

SEQ ID NO: 1045297 - protein, 9 aa, Homo Sapiens
KVNLIFEGV

SEQ ID NO: 1045298 - protein, 9 aa, Homo Sapiens
ECPARRAPG

SEQ ID NO: 1045299 - protein, 9 aa, Homo Sapiens
IFRIMQILR

SEQ ID NO: 1045300 - protein, 9 aa, Homo Sapiens
LYSVLRNHN

SEQ ID NO: 1045301 - protein, 9 aa, Homo Sapiens
RSPTPPGPR

SEQ ID NO: 1045302 - protein, 9 aa, Homo Sapiens
NVAIYTVSA

SEQ ID NO: 1045303 - protein, 9 aa, Homo Sapiens
GTARTPPMW

SEQ ID NO: 1045304 - protein, 9 aa, Homo Sapiens
MDNEPLVSE

SEQ ID NO: 1045305 - protein, 9 aa, Homo Sapiens
RNVTFLGKG

SEQ ID NO: 1045306 - protein, 9 aa, Homo Sapiens
ETSQTSAPW

SEQ ID NO: 1045307 - protein, 9 aa, Homo Sapiens
EKQLGIKLV

SEQ ID NO: 1045308 - protein, 9 aa, Homo Sapiens
PGKAESLEH

SEQ ID NO: 1045309 - protein, 9 aa, Homo Sapiens
MDKKNQELR

SEQ ID NO: 1045310 - protein, 9 aa, Homo Sapiens
ITVGIETMK

SEQ ID NO: 1045311 - protein, 9 aa, Homo Sapiens
FSNPVCLEP

SEQ ID NO: 1045312 - protein, 9 aa, Homo Sapiens
KVKGLQRSG

SEQ ID NO: 1045313 - protein, 9 aa, Homo Sapiens
FFLAICLPI

SEQ ID NO: 1045314 - protein, 9 aa, Homo Sapiens
QKRASLWPS

SEQ ID NO: 1045315 - protein, 9 aa, Homo Sapiens
RTCIPSRLP

SEQ ID NO: 1045316 - protein, 9 aa, Homo Sapiens
LPVAPSAVS

SEQ ID NO: 1045317 - protein, 9 aa, Homo Sapiens
ISMYYFLSN

SEQ ID NO: 1045318 - protein, 9 aa, Homo Sapiens
RHIEAKRAT

SEQ ID NO: 1045319 - protein, 9 aa, Homo Sapiens
YLSETITPR

SEQ ID NO: 1045320 - protein, 9 aa, Homo Sapiens
DMTEIGKRG

SEQ ID NO: 1045321 - protein, 9 aa, Homo Sapiens
FPETFLGDR

SEQ ID NO: 1045322 - protein, 9 aa, Homo Sapiens
PEFCQLIVN

SEQ ID NO: 1045323 - protein, 9 aa, Homo Sapiens
PSIVSASWK

SEQ ID NO: 1045324 - protein, 9 aa, Homo Sapiens
DLKCNYFNM

SEQ ID NO: 1045325 - protein, 9 aa, Homo Sapiens
GLSLGFSFS

SEQ ID NO: 1045326 - protein, 9 aa, Homo Sapiens
ESGACLHPL

SEQ ID NO: 1045327 - protein, 9 aa, Homo Sapiens
KALLQRIQA

SEQ ID NO: 1045328 - protein, 9 aa, Homo Sapiens
AEVDVASFL

SEQ ID NO: 1045329 - protein, 9 aa, Homo Sapiens
EEGTKRMLL

SEQ ID NO: 1045330 - protein, 9 aa, Homo Sapiens
YCLISKLVN

SEQ ID NO: 1045331 - protein, 9 aa, Homo Sapiens
KMTSKGKPG

SEQ ID NO: 1045332 - protein, 9 aa, Homo Sapiens
AEALRLLVQ

SEQ ID NO: 1045333 - protein, 9 aa, Homo Sapiens
IGTLVQATN

SEQ ID NO: 1045334 - protein, 9 aa, Homo Sapiens
QEEKMWRQK

SEQ ID NO: 1045335 - protein, 9 aa, Homo Sapiens
GSSSWHGGL

SEQ ID NO: 1045336 - protein, 9 aa, Homo Sapiens
ARYLIFSNP

SEQ ID NO: 1045337 - protein, 9 aa, Homo Sapiens
APGHARSRR

SEQ ID NO: 1045338 - protein, 9 aa, Homo Sapiens
FIILGVGSS

SEQ ID NO: 1045339 - protein, 9 aa, Homo Sapiens
WLNSQSLPV

SEQ ID NO: 1045340 - protein, 9 aa, Homo Sapiens
IKDGLIICK

SEQ ID NO: 1045341 - protein, 9 aa, Homo Sapiens
GSKLSAQIQ

SEQ ID NO: 1045342 - protein, 9 aa, Homo Sapiens
VSLFCRPVC

SEQ ID NO: 1045343 - protein, 9 aa, Homo Sapiens
DARHLSFFL

SEQ ID NO: 1045344 - protein, 9 aa, Homo Sapiens
QVKMLQGKL

SEQ ID NO: 1045345 - protein, 9 aa, Homo Sapiens
NFTGHKKRK

SEQ ID NO: 1045346 - protein, 9 aa, Homo Sapiens
PLSYKALLT

SEQ ID NO: 1045347 - protein, 9 aa, Homo Sapiens
CRWPLPQHA

SEQ ID NO: 1045348 - protein, 9 aa, Homo Sapiens
WRYYATIPN

SEQ ID NO: 1045349 - protein, 9 aa, Homo Sapiens
IRAEALVNG

SEQ ID NO: 1045350 - protein, 9 aa, Homo Sapiens
SKLGKYRML

SEQ ID NO: 1045351 - protein, 9 aa, Homo Sapiens
SGASVNEVA

SEQ ID NO: 1045352 - protein, 9 aa, Homo Sapiens
LLSRKRAAP

SEQ ID NO: 1045353 - protein, 9 aa, Homo Sapiens
EPDISKEEL

SEQ ID NO: 1045354 - protein, 9 aa, Homo Sapiens
VKAGYKKPG

SEQ ID NO: 1045355 - protein, 9 aa, Homo Sapiens
AGDLYLLFA

SEQ ID NO: 1045356 - protein, 9 aa, Homo Sapiens
TPIDCDESG

SEQ ID NO: 1045357 - protein, 9 aa, Homo Sapiens
YVKGLPLIK

SEQ ID NO: 1045358 - protein, 9 aa, Homo Sapiens
HLGRAVQTL

SEQ ID NO: 1045359 - protein, 9 aa, Homo Sapiens
KKLSIKYMA

SEQ ID NO: 1045360 - protein, 9 aa, Homo Sapiens
CIRYGFSPK

SEQ ID NO: 1045361 - protein, 9 aa, Homo Sapiens
GFYSAFFVA

SEQ ID NO: 1045362 - protein, 9 aa, Homo Sapiens
KPISLADYC

SEQ ID NO: 1045363 - protein, 9 aa, Homo Sapiens
RGPVHRVGY

SEQ ID NO: 1045364 - protein, 9 aa, Homo Sapiens
KEFPLVSEK

SEQ ID NO: 1045365 - protein, 9 aa, Homo Sapiens
KEKKNMVDC

SEQ ID NO: 1045366 - protein, 9 aa, Homo Sapiens
DDALEAVTE

SEQ ID NO: 1045367 - protein, 9 aa, Homo Sapiens
ALPIIHNGH

SEQ ID NO: 1045368 - protein, 9 aa, Homo Sapiens
EFHLFFVLF

SEQ ID NO: 1045369 - protein, 9 aa, Homo Sapiens
VDVKDSQQA

SEQ ID NO: 1045370 - protein, 9 aa, Homo Sapiens
LEQLDLGKK

SEQ ID NO: 1045371 - protein, 9 aa, Homo Sapiens
KNVKAAVRR

SEQ ID NO: 1045372 - protein, 9 aa, Homo Sapiens
PLSESAKSL

SEQ ID NO: 1045373 - protein, 9 aa, Homo Sapiens
HATPFPVTD

SEQ ID NO: 1045374 - protein, 9 aa, Homo Sapiens
SSDASESVQ

SEQ ID NO: 1045375 - protein, 9 aa, Homo Sapiens
VTTNVAIYT

SEQ ID NO: 1045376 - protein, 9 aa, Homo Sapiens
NCEAPYILE

SEQ ID NO: 1045377 - protein, 9 aa, Homo Sapiens
ERRNHIDRV

SEQ ID NO: 1045378 - protein, 9 aa, Homo Sapiens
SRKKLLNAL

SEQ ID NO: 1045379 - protein, 9 aa, Homo Sapiens
LRKLSLAGN

SEQ ID NO: 1045380 - protein, 9 aa, Homo Sapiens
DSELLFTAG

SEQ ID NO: 1045381 - protein, 9 aa, Homo Sapiens
FAGGVKPFK

SEQ ID NO: 1045382 - protein, 9 aa, Homo Sapiens
NSINKKLPI

SEQ ID NO: 1045383 - protein, 9 aa, Homo Sapiens
VGMLLQQNF

SEQ ID NO: 1045384 - protein, 9 aa, Homo Sapiens
PARKALAIV

SEQ ID NO: 1045385 - protein, 9 aa, Homo Sapiens
AGQSWCIPL

SEQ ID NO: 1045386 - protein, 9 aa, Homo Sapiens
AFHLTAITV

SEQ ID NO: 1045387 - protein, 9 aa, Homo Sapiens
NAREEWKTL

SEQ ID NO: 1045388 - protein, 9 aa, Homo Sapiens
KIYTDPEVF

SEQ ID NO: 1045389 - protein, 9 aa, Homo Sapiens
LEATQQPMR

SEQ ID NO: 1045390 - protein, 9 aa, Homo Sapiens
MNQENRSSC

SEQ ID NO: 1045391 - protein, 9 aa, Homo Sapiens
LALVQEKYS

SEQ ID NO: 1045392 - protein, 9 aa, Homo Sapiens
APFCSVSIS

SEQ ID NO: 1045393 - protein, 9 aa, Homo Sapiens
AFRVSSNFT

SEQ ID NO: 1045394 - protein, 9 aa, Homo Sapiens
FSVDPNNET

SEQ ID NO: 1045395 - protein, 9 aa, Homo Sapiens
GDKFFPKLL

SEQ ID NO: 1045396 - protein, 9 aa, Homo Sapiens
ASESVQNGN

SEQ ID NO: 1045397 - protein, 9 aa, Homo Sapiens
KLGKYRMLF

SEQ ID NO: 1045398 - protein, 9 aa, Homo Sapiens
RGKPRFKPS

SEQ ID NO: 1045399 - protein, 9 aa, Homo Sapiens
LSLLAGQTA

SEQ ID NO: 1045400 - protein, 9 aa, Homo Sapiens
THQHQEKQE

SEQ ID NO: 1045401 - protein, 9 aa, Homo Sapiens
FATQMPSHL

SEQ ID NO: 1045402 - protein, 9 aa, Homo Sapiens
FLQLEAISA

SEQ ID NO: 1045403 - protein, 9 aa, Homo Sapiens
VSSEKREEN

SEQ ID NO: 1045404 - protein, 9 aa, Homo Sapiens
VQLLSPSQG

SEQ ID NO: 1045405 - protein, 9 aa, Homo Sapiens
EHSFWSDFH

SEQ ID NO: 1045406 - protein, 9 aa, Homo Sapiens
SLFGGLQCP

SEQ ID NO: 1045407 - protein, 9 aa, Homo Sapiens
IMISPRNCG

SEQ ID NO: 1045408 - protein, 9 aa, Homo Sapiens
AAKIQLAVC

SEQ ID NO: 1045409 - protein, 9 aa, Homo Sapiens
ERQGVNMLP

SEQ ID NO: 1045410 - protein, 9 aa, Homo Sapiens
KERAPIRIW

SEQ ID NO: 1045411 - protein, 9 aa, Homo Sapiens
FGQCLCETG

SEQ ID NO: 1045412 - protein, 9 aa, Homo Sapiens
EKEANFHEV

SEQ ID NO: 1045413 - protein, 9 aa, Homo Sapiens
PLPQHAQHC

SEQ ID NO: 1045414 - protein, 9 aa, Homo Sapiens
IKEVKENFV

SEQ ID NO: 1045415 - protein, 9 aa, Homo Sapiens
PPPPEKPQG

SEQ ID NO: 1045416 - protein, 9 aa, Homo Sapiens
AESGGLGRI

SEQ ID NO: 1045417 - protein, 9 aa, Homo Sapiens
FTSESVREG

SEQ ID NO: 1045418 - protein, 9 aa, Homo Sapiens
SNELRDKVR

SEQ ID NO: 1045419 - protein, 9 aa, Homo Sapiens
RVCVIDGIG

SEQ ID NO: 1045420 - protein, 9 aa, Homo Sapiens
KCKINGLSP

SEQ ID NO: 1045421 - protein, 9 aa, Homo Sapiens
TYSAISNEL

SEQ ID NO: 1045422 - protein, 9 aa, Homo Sapiens
TAVLAAGKE

SEQ ID NO: 1045423 - protein, 9 aa, Homo Sapiens
GSCHFLKKA

SEQ ID NO: 1045424 - protein, 9 aa, Homo Sapiens
EMAKVQNFL

SEQ ID NO: 1045425 - protein, 9 aa, Homo Sapiens
ADSDVGEKP

SEQ ID NO: 1045426 - protein, 9 aa, Homo Sapiens
LESKDSPFL

SEQ ID NO: 1045427 - protein, 9 aa, Homo Sapiens
RGRRLGALT

SEQ ID NO: 1045428 - protein, 9 aa, Homo Sapiens
AFGPSEILE

SEQ ID NO: 1045429 - protein, 9 aa, Homo Sapiens
KSSEMVKKS

SEQ ID NO: 1045430 - protein, 9 aa, Homo Sapiens
SYRAYAVMC

SEQ ID NO: 1045431 - protein, 9 aa, Homo Sapiens
ESPNRHLYN

SEQ ID NO: 1045432 - protein, 9 aa, Homo Sapiens
TDEEAQLLF

SEQ ID NO: 1045433 - protein, 9 aa, Homo Sapiens
ASVFPPDSQ

SEQ ID NO: 1045434 - protein, 9 aa, Homo Sapiens
FRDGAIEFS

SEQ ID NO: 1045435 - protein, 9 aa, Homo Sapiens
LEINEKLSP

SEQ ID NO: 1045436 - protein, 9 aa, Homo Sapiens
EEEEEQDTF

SEQ ID NO: 1045437 - protein, 9 aa, Homo Sapiens
ETSVFISST

SEQ ID NO: 1045438 - protein, 9 aa, Homo Sapiens
RISSRLHLK

SEQ ID NO: 1045439 - protein, 9 aa, Homo Sapiens
KKRKKSRPE

SEQ ID NO: 1045440 - protein, 9 aa, Homo Sapiens
KGQQSQCLQ

SEQ ID NO: 1045441 - protein, 9 aa, Homo Sapiens
SAFSAASAM

SEQ ID NO: 1045442 - protein, 9 aa, Homo Sapiens
QENKKCTDA

SEQ ID NO: 1045443 - protein, 9 aa, Homo Sapiens
EQDTFELEL

SEQ ID NO: 1045444 - protein, 9 aa, Homo Sapiens
KRALFTAVV

SEQ ID NO: 1045445 - protein, 9 aa, Homo Sapiens
REKDQRKLK

SEQ ID NO: 1045446 - protein, 9 aa, Homo Sapiens
NGNKNLLPF

SEQ ID NO: 1045447 - protein, 9 aa, Homo Sapiens
LKQLSILTE

SEQ ID NO: 1045448 - protein, 9 aa, Homo Sapiens
FLGEIMKTA

SEQ ID NO: 1045449 - protein, 9 aa, Homo Sapiens
LRVFGTGQN

SEQ ID NO: 1045450 - protein, 9 aa, Homo Sapiens
TSQYKLTVS

SEQ ID NO: 1045451 - protein, 9 aa, Homo Sapiens
AFRSQLGDV

SEQ ID NO: 1045452 - protein, 9 aa, Homo Sapiens
SPDLVLERF

SEQ ID NO: 1045453 - protein, 9 aa, Homo Sapiens
TALRRLESV

SEQ ID NO: 1045454 - protein, 9 aa, Homo Sapiens
KCSRYKVCI

SEQ ID NO: 1045455 - protein, 9 aa, Homo Sapiens
TLRNISRQI

SEQ ID NO: 1045456 - protein, 9 aa, Homo Sapiens
LSWSGISKP

SEQ ID NO: 1045457 - protein, 9 aa, Homo Sapiens
ELVARLETH

SEQ ID NO: 1045458 - protein, 9 aa, Homo Sapiens
SLRKWYSPI

SEQ ID NO: 1045459 - protein, 9 aa, Homo Sapiens
LEAGISHRT

SEQ ID NO: 1045460 - protein, 9 aa, Homo Sapiens
MPMEIGTLG

SEQ ID NO: 1045461 - protein, 9 aa, Homo Sapiens
ARTQQYPYL

SEQ ID NO: 1045462 - protein, 9 aa, Homo Sapiens
APEPPVKKN

SEQ ID NO: 1045463 - protein, 9 aa, Homo Sapiens
RCQPSCTKA

SEQ ID NO: 1045464 - protein, 9 aa, Homo Sapiens
KPSAEDRVS

SEQ ID NO: 1045465 - protein, 9 aa, Homo Sapiens
EEQTSDENG

SEQ ID NO: 1045466 - protein, 9 aa, Homo Sapiens
MEQLTSSTN

SEQ ID NO: 1045467 - protein, 9 aa, Homo Sapiens
SSKSALYRR

SEQ ID NO: 1045468 - protein, 9 aa, Homo Sapiens
VIFILVVLL

SEQ ID NO: 1045469 - protein, 9 aa, Homo Sapiens
YLDFSVYKK

SEQ ID NO: 1045470 - protein, 9 aa, Homo Sapiens
LISHKIEEP

SEQ ID NO: 1045471 - protein, 9 aa, Homo Sapiens
ERLARAKEA

SEQ ID NO: 1045472 - protein, 9 aa, Homo Sapiens
ITLDGITKE

SEQ ID NO: 1045473 - protein, 9 aa, Homo Sapiens
ALVKTNRRE

SEQ ID NO: 1045474 - protein, 9 aa, Homo Sapiens
ILKETETVL

SEQ ID NO: 1045475 - protein, 9 aa, Homo Sapiens
QRLEEMGLI

SEQ ID NO: 1045476 - protein, 9 aa, Homo Sapiens
MNNSQRRVT

SEQ ID NO: 1045477 - protein, 9 aa, Homo Sapiens
DLETKKTVW

SEQ ID NO: 1045478 - protein, 9 aa, Homo Sapiens
QGDNKLQKL

SEQ ID NO: 1045479 - protein, 9 aa, Homo Sapiens
RTAFILAVC

SEQ ID NO: 1045480 - protein, 9 aa, Homo Sapiens
LRTCCLQKF

SEQ ID NO: 1045481 - protein, 9 aa, Homo Sapiens
GELAVRRAR

SEQ ID NO: 1045482 - protein, 9 aa, Homo Sapiens
HSDFESPKA

SEQ ID NO: 1045483 - protein, 9 aa, Homo Sapiens
FSSRKMFCQ

SEQ ID NO: 1045484 - protein, 9 aa, Homo Sapiens
FFKAFSYLS

SEQ ID NO: 1045485 - protein, 9 aa, Homo Sapiens
RGREIRIAP

SEQ ID NO: 1045486 - protein, 9 aa, Homo Sapiens
CGKTFNQGS

SEQ ID NO: 1045487 - protein, 9 aa, Homo Sapiens
PESLYLVPV

SEQ ID NO: 1045488 - protein, 9 aa, Homo Sapiens
ASEKNQSST

SEQ ID NO: 1045489 - protein, 9 aa, Homo Sapiens
DYFLRAVRM

SEQ ID NO: 1045490 - protein, 9 aa, Homo Sapiens
TSLSSTSEQ

SEQ ID NO: 1045491 - protein, 9 aa, Homo Sapiens
SWFIIQKNM

SEQ ID NO: 1045492 - protein, 9 aa, Homo Sapiens
KEEFMKSKS

SEQ ID NO: 1045493 - protein, 9 aa, Homo Sapiens
PVGRIEKPF

SEQ ID NO: 1045494 - protein, 9 aa, Homo Sapiens
HNSGRPIEL

SEQ ID NO: 1045495 - protein, 9 aa, Homo Sapiens
PPGLWATVE

SEQ ID NO: 1045496 - protein, 9 aa, Homo Sapiens
YLFSAFMRI

SEQ ID NO: 1045497 - protein, 9 aa, Homo Sapiens
FSEWDGLIC

SEQ ID NO: 1045498 - protein, 9 aa, Homo Sapiens
EMNFFQQQP

SEQ ID NO: 1045499 - protein, 9 aa, Homo Sapiens
TIDLLALTS

SEQ ID NO: 1045500 - protein, 9 aa, Homo Sapiens
VIGVVIYTE

SEQ ID NO: 1045501 - protein, 9 aa, Homo Sapiens
LLFACMLTA

SEQ ID NO: 1045502 - protein, 9 aa, Homo Sapiens
CINAVSFRN

SEQ ID NO: 1045503 - protein, 9 aa, Homo Sapiens
NHIDRVLDA

SEQ ID NO: 1045504 - protein, 9 aa, Homo Sapiens
DMHTSDTQW

SEQ ID NO: 1045505 - protein, 9 aa, Homo Sapiens
KARRQNVTI

SEQ ID NO: 1045506 - protein, 9 aa, Homo Sapiens
TYIIFFVLV

SEQ ID NO: 1045507 - protein, 9 aa, Homo Sapiens
SIIAPKRLV

SEQ ID NO: 1045508 - protein, 9 aa, Homo Sapiens
DHPQPIDSL

SEQ ID NO: 1045509 - protein, 9 aa, Homo Sapiens
ENELSRIRL

SEQ ID NO: 1045510 - protein, 9 aa, Homo Sapiens
TNREKMTQI

SEQ ID NO: 1045511 - protein, 9 aa, Homo Sapiens
GSMVDLMTY

SEQ ID NO: 1045512 - protein, 9 aa, Homo Sapiens
SSWHGGLGR

SEQ ID NO: 1045513 - protein, 9 aa, Homo Sapiens
GEAPSQFPP

SEQ ID NO: 1045514 - protein, 9 aa, Homo Sapiens
YQESQSVSH

SEQ ID NO: 1045515 - protein, 9 aa, Homo Sapiens
QSWCIPLYL

SEQ ID NO: 1045516 - protein, 9 aa, Homo Sapiens
AEVAKNCGI

SEQ ID NO: 1045517 - protein, 9 aa, Homo Sapiens
TDDDVIDQA

SEQ ID NO: 1045518 - protein, 9 aa, Homo Sapiens
KVGSKLSAQ

SEQ ID NO: 1045519 - protein, 9 aa, Homo Sapiens
RESSLPFKE

SEQ ID NO: 1045520 - protein, 9 aa, Homo Sapiens
EVLLGCPVS

SEQ ID NO: 1045521 - protein, 9 aa, Homo Sapiens
DSKAQYTSI

SEQ ID NO: 1045522 - protein, 9 aa, Homo Sapiens
HIVFSTNKE

SEQ ID NO: 1045523 - protein, 9 aa, Homo Sapiens
PAGYFVPTN

SEQ ID NO: 1045524 - protein, 9 aa, Homo Sapiens
DRTCIPSRL

SEQ ID NO: 1045525 - protein, 9 aa, Homo Sapiens
LKNCSPHIN

SEQ ID NO: 1045526 - protein, 9 aa, Homo Sapiens
FHLTAITVF

SEQ ID NO: 1045527 - protein, 9 aa, Homo Sapiens
NLWQKIRED

SEQ ID NO: 1045528 - protein, 9 aa, Homo Sapiens
FLISHKIEE

SEQ ID NO: 1045529 - protein, 9 aa, Homo Sapiens
LVSLSTGER

SEQ ID NO: 1045530 - protein, 9 aa, Homo Sapiens
LVSVSQSVQ

SEQ ID NO: 1045531 - protein, 9 aa, Homo Sapiens
RDARGGAEC

SEQ ID NO: 1045532 - protein, 9 aa, Homo Sapiens
LVGTVANLF

SEQ ID NO: 1045533 - protein, 9 aa, Homo Sapiens
LLYRNINIP

SEQ ID NO: 1045534 - protein, 9 aa, Homo Sapiens
HWDKVKEEM

SEQ ID NO: 1045535 - protein, 9 aa, Homo Sapiens
LKGFSDFLK

SEQ ID NO: 1045536 - protein, 9 aa, Homo Sapiens
KGIHALSEG

SEQ ID NO: 1045537 - protein, 9 aa, Homo Sapiens
LDTWSMGVV

SEQ ID NO: 1045538 - protein, 9 aa, Homo Sapiens
PLYPSALIL

SEQ ID NO: 1045539 - protein, 9 aa, Homo Sapiens
NKMLRGIKL

SEQ ID NO: 1045540 - protein, 9 aa, Homo Sapiens
HFQRRKGLP

SEQ ID NO: 1045541 - protein, 9 aa, Homo Sapiens
FVFINSLYV

SEQ ID NO: 1045542 - protein, 9 aa, Homo Sapiens
SSQPLLPSE

SEQ ID NO: 1045543 - protein, 9 aa, Homo Sapiens
PEFTLQQPY

SEQ ID NO: 1045544 - protein, 9 aa, Homo Sapiens
LLRTCCLQK

SEQ ID NO: 1045545 - protein, 9 aa, Homo Sapiens
VGTAAVPSG

SEQ ID NO: 1045546 - protein, 9 aa, Homo Sapiens
SIITVCYEI

SEQ ID NO: 1045547 - protein, 9 aa, Homo Sapiens
QDLNRAENG

SEQ ID NO: 1045548 - protein, 9 aa, Homo Sapiens
DSFLTCLAG

SEQ ID NO: 1045549 - protein, 9 aa, Homo Sapiens
RSASSIMIL

SEQ ID NO: 1045550 - protein, 9 aa, Homo Sapiens
DVGLDNSNQ

SEQ ID NO: 1045551 - protein, 9 aa, Homo Sapiens
TPLAPPDLQ

SEQ ID NO: 1045552 - protein, 9 aa, Homo Sapiens
LENDEDGNL

SEQ ID NO: 1045553 - protein, 9 aa, Homo Sapiens
CTCLKQQMK

SEQ ID NO: 1045554 - protein, 9 aa, Homo Sapiens
EAPENFPQT

SEQ ID NO: 1045555 - protein, 9 aa, Homo Sapiens
VCKMPCNLT

SEQ ID NO: 1045556 - protein, 9 aa, Homo Sapiens
LKEEEEQTS

SEQ ID NO: 1045557 - protein, 9 aa, Homo Sapiens
CKVTYCPIE

SEQ ID NO: 1045558 - protein, 9 aa, Homo Sapiens
GILLFFDQP

SEQ ID NO: 1045559 - protein, 9 aa, Homo Sapiens
TSNTLWIKF

SEQ ID NO: 1045560 - protein, 9 aa, Homo Sapiens
YKAFYEGGR

SEQ ID NO: 1045561 - protein, 9 aa, Homo Sapiens
CRKFYEGTA

SEQ ID NO: 1045562 - protein, 9 aa, Homo Sapiens
LSSLQGYIK

SEQ ID NO: 1045563 - protein, 9 aa, Homo Sapiens
REIRGLITV

SEQ ID NO: 1045564 - protein, 9 aa, Homo Sapiens
IPLYLMVIL

SEQ ID NO: 1045565 - protein, 9 aa, Homo Sapiens
KGKKAPTTA

SEQ ID NO: 1045566 - protein, 9 aa, Homo Sapiens
PPDLQPPAE

SEQ ID NO: 1045567 - protein, 9 aa, Homo Sapiens
NSAGVGTEA

SEQ ID NO: 1045568 - protein, 9 aa, Homo Sapiens
VFPPDSQTP

SEQ ID NO: 1045569 - protein, 9 aa, Homo Sapiens
QVDVKDSQQ

SEQ ID NO: 1045570 - protein, 9 aa, Homo Sapiens
KEVVTAVEK

SEQ ID NO: 1045571 - protein, 9 aa, Homo Sapiens
VLGAAAEET

SEQ ID NO: 1045572 - protein, 9 aa, Homo Sapiens
TKKHPKSLQ

SEQ ID NO: 1045573 - protein, 9 aa, Homo Sapiens
AGGSGLPES

SEQ ID NO: 1045574 - protein, 9 aa, Homo Sapiens
TVESQEETA

SEQ ID NO: 1045575 - protein, 9 aa, Homo Sapiens
GIEGDRGPK

SEQ ID NO: 1045576 - protein, 9 aa, Homo Sapiens
GQTAELRCK

SEQ ID NO: 1045577 - protein, 9 aa, Homo Sapiens
TNPDLGAGG

SEQ ID NO: 1045578 - protein, 9 aa, Homo Sapiens
SPAWFSPIM

SEQ ID NO: 1045579 - protein, 9 aa, Homo Sapiens
KRITIFHVG

SEQ ID NO: 1045580 - protein, 9 aa, Homo Sapiens
QSLSPDSKA

SEQ ID NO: 1045581 - protein, 9 aa, Homo Sapiens
PQIFSVEGQ

SEQ ID NO: 1045582 - protein, 9 aa, Homo Sapiens
SGTVCLSVS

SEQ ID NO: 1045583 - protein, 9 aa, Homo Sapiens
LVEMLRGIA

SEQ ID NO: 1045584 - protein, 9 aa, Homo Sapiens
PELPKGMDT

SEQ ID NO: 1045585 - protein, 9 aa, Homo Sapiens
GSLSHLLNV

SEQ ID NO: 1045586 - protein, 9 aa, Homo Sapiens
CNRTEGFIR

SEQ ID NO: 1045587 - protein, 9 aa, Homo Sapiens
FEDIYIEQQ

SEQ ID NO: 1045588 - protein, 9 aa, Homo Sapiens
SPLSQMGSP

SEQ ID NO: 1045589 - protein, 9 aa, Homo Sapiens
TYNGNKNLL

SEQ ID NO: 1045590 - protein, 9 aa, Homo Sapiens
QHCEDGSLD

SEQ ID NO: 1045591 - protein, 9 aa, Homo Sapiens
YADSSGASS

SEQ ID NO: 1045592 - protein, 9 aa, Homo Sapiens
GETAYLPCR

SEQ ID NO: 1045593 - protein, 9 aa, Homo Sapiens
IKYRDNTKE

SEQ ID NO: 1045594 - protein, 9 aa, Homo Sapiens
FDRHPEAFT

SEQ ID NO: 1045595 - protein, 9 aa, Homo Sapiens
KKPVGEVNS

SEQ ID NO: 1045596 - protein, 9 aa, Homo Sapiens
VDALNDKIN

SEQ ID NO: 1045597 - protein, 9 aa, Homo Sapiens
KDDALEAVT

SEQ ID NO: 1045598 - protein, 9 aa, Homo Sapiens
NRVCIAETW

SEQ ID NO: 1045599 - protein, 9 aa, Homo Sapiens
VFFSDVFFK

SEQ ID NO: 1045600 - protein, 9 aa, Homo Sapiens
HVKYLDFSV

SEQ ID NO: 1045601 - protein, 9 aa, Homo Sapiens
QLVQTLIVP

SEQ ID NO: 1045602 - protein, 9 aa, Homo Sapiens
KNAMWKKDK

SEQ ID NO: 1045603 - protein, 9 aa, Homo Sapiens
IVPNGSTEK

SEQ ID NO: 1045604 - protein, 9 aa, Homo Sapiens
LGYTYETQW

SEQ ID NO: 1045605 - protein, 9 aa, Homo Sapiens
AFGLFTAFL

SEQ ID NO: 1045606 - protein, 9 aa, Homo Sapiens
FFHEDVTLE

SEQ ID NO: 1045607 - protein, 9 aa, Homo Sapiens
GQQTTPCLD

SEQ ID NO: 1045608 - protein, 9 aa, Homo Sapiens
NVEEQCERL

SEQ ID NO: 1045609 - protein, 9 aa, Homo Sapiens
GTGGPASLQ

SEQ ID NO: 1045610 - protein, 9 aa, Homo Sapiens
LPEKTRSSR

SEQ ID NO: 1045611 - protein, 9 aa, Homo Sapiens
ASQEATRPP

SEQ ID NO: 1045612 - protein, 9 aa, Homo Sapiens
LPLVTREGD

SEQ ID NO: 1045613 - protein, 9 aa, Homo Sapiens
PSPEAAQAH

SEQ ID NO: 1045614 - protein, 9 aa, Homo Sapiens
ALRQIKDTM

SEQ ID NO: 1045615 - protein, 9 aa, Homo Sapiens
DVIILTIFC

SEQ ID NO: 1045616 - protein, 9 aa, Homo Sapiens
AKIEESTSV

SEQ ID NO: 1045617 - protein, 9 aa, Homo Sapiens
RFDRTLRCP

SEQ ID NO: 1045618 - protein, 9 aa, Homo Sapiens
EPLVSESDD

SEQ ID NO: 1045619 - protein, 9 aa, Homo Sapiens
PKNQKTSEM

SEQ ID NO: 1045620 - protein, 9 aa, Homo Sapiens
GPVSICLKA

SEQ ID NO: 1045621 - protein, 9 aa, Homo Sapiens
KLKEKLTEY

SEQ ID NO: 1045622 - protein, 9 aa, Homo Sapiens
TYCPIEPGT

SEQ ID NO: 1045623 - protein, 9 aa, Homo Sapiens
QCVESSLLV

SEQ ID NO: 1045624 - protein, 9 aa, Homo Sapiens
YYKVSADKP

SEQ ID NO: 1045625 - protein, 9 aa, Homo Sapiens
TSALTVYVL

SEQ ID NO: 1045626 - protein, 9 aa, Homo Sapiens
QLECPFSFA

SEQ ID NO: 1045627 - protein, 9 aa, Homo Sapiens
VSFGEPFEI

SEQ ID NO: 1045628 - protein, 9 aa, Homo Sapiens
VIAPSLFGG

SEQ ID NO: 1045629 - protein, 9 aa, Homo Sapiens
PVASRQKPP

SEQ ID NO: 1045630 - protein, 9 aa, Homo Sapiens
AHVKENWIN

SEQ ID NO: 1045631 - protein, 9 aa, Homo Sapiens
PMQKKILLT

SEQ ID NO: 1045632 - protein, 9 aa, Homo Sapiens
TACMNVAQL

SEQ ID NO: 1045633 - protein, 9 aa, Homo Sapiens
YYDVERCPV

SEQ ID NO: 1045634 - protein, 9 aa, Homo Sapiens
SVEWPGKDS

SEQ ID NO: 1045635 - protein, 9 aa, Homo Sapiens
EGSIPPSTP

SEQ ID NO: 1045636 - protein, 9 aa, Homo Sapiens
CDEGKRVAE

SEQ ID NO: 1045637 - protein, 9 aa, Homo Sapiens
PCEFHLFFV

SEQ ID NO: 1045638 - protein, 9 aa, Homo Sapiens
NCSNRGHSH

SEQ ID NO: 1045639 - protein, 9 aa, Homo Sapiens
PSLPLLKLQ

SEQ ID NO: 1045640 - protein, 9 aa, Homo Sapiens
YVDKQMGTT

SEQ ID NO: 1045641 - protein, 9 aa, Homo Sapiens
KDKRLKFKG

SEQ ID NO: 1045642 - protein, 9 aa, Homo Sapiens
HYDASLSTY

SEQ ID NO: 1045643 - protein, 9 aa, Homo Sapiens
RLNGFGNFY

SEQ ID NO: 1045644 - protein, 9 aa, Homo Sapiens
LKPPVYVPP

SEQ ID NO: 1045645 - protein, 9 aa, Homo Sapiens
PLNRAVFWI

SEQ ID NO: 1045646 - protein, 9 aa, Homo Sapiens
LCLAVEGRL

SEQ ID NO: 1045647 - protein, 9 aa, Homo Sapiens
KGDIITIQT

SEQ ID NO: 1045648 - protein, 9 aa, Homo Sapiens
YPVSVKGKK

SEQ ID NO: 1045649 - protein, 9 aa, Homo Sapiens
VATTMFILT

SEQ ID NO: 1045650 - protein, 9 aa, Homo Sapiens
TIITVTDVN

SEQ ID NO: 1045651 - protein, 9 aa, Homo Sapiens
LEAQVATHT

SEQ ID NO: 1045652 - protein, 9 aa, Homo Sapiens
GLKEEEEQT

SEQ ID NO: 1045653 - protein, 9 aa, Homo Sapiens
QCKKTGRCL

SEQ ID NO: 1045654 - protein, 9 aa, Homo Sapiens
GLQRSGWMS

SEQ ID NO: 1045655 - protein, 9 aa, Homo Sapiens
VSVKGKKAP

SEQ ID NO: 1045656 - protein, 9 aa, Homo Sapiens
DIEGINRKY

SEQ ID NO: 1045657 - protein, 9 aa, Homo Sapiens
LEKNYEEVG

SEQ ID NO: 1045658 - protein, 9 aa, Homo Sapiens
EKDPKAISV

SEQ ID NO: 1045659 - protein, 9 aa, Homo Sapiens
GASSKSALY

SEQ ID NO: 1045660 - protein, 9 aa, Homo Sapiens
DLAALEKNY

SEQ ID NO: 1045661 - protein, 9 aa, Homo Sapiens
KGDTVIDPN

SEQ ID NO: 1045662 - protein, 9 aa, Homo Sapiens
QRVHTRVKS

SEQ ID NO: 1045663 - protein, 9 aa, Homo Sapiens
FQIFYGKNM

SEQ ID NO: 1045664 - protein, 9 aa, Homo Sapiens
NGTWPRQTL

SEQ ID NO: 1045665 - protein, 9 aa, Homo Sapiens
KFGDNYQVV

SEQ ID NO: 1045666 - protein, 9 aa, Homo Sapiens
NVSGVGFPS

SEQ ID NO: 1045667 - protein, 9 aa, Homo Sapiens
KIFLRDYQD

SEQ ID NO: 1045668 - protein, 9 aa, Homo Sapiens
FCNLVLIYL

SEQ ID NO: 1045669 - protein, 9 aa, Homo Sapiens
IVVLCFFVS

SEQ ID NO: 1045670 - protein, 9 aa, Homo Sapiens
LLLAEPKPE

SEQ ID NO: 1045671 - protein, 9 aa, Homo Sapiens
VEPRGFLGP

SEQ ID NO: 1045672 - protein, 9 aa, Homo Sapiens
PSWCDQVLW

SEQ ID NO: 1045673 - protein, 9 aa, Homo Sapiens
GHLGLQLDQ

SEQ ID NO: 1045674 - protein, 9 aa, Homo Sapiens
LMKKNVLDE

SEQ ID NO: 1045675 - protein, 9 aa, Homo Sapiens
PHTLPLSPG

SEQ ID NO: 1045676 - protein, 9 aa, Homo Sapiens
NHKETKEKT

SEQ ID NO: 1045677 - protein, 9 aa, Homo Sapiens
KHISSFRQS

SEQ ID NO: 1045678 - protein, 9 aa, Homo Sapiens
PCKPYEYLA

SEQ ID NO: 1045679 - protein, 9 aa, Homo Sapiens
ILRLFLFSY

SEQ ID NO: 1045680 - protein, 9 aa, Homo Sapiens
DMDLQISLD

SEQ ID NO: 1045681 - protein, 9 aa, Homo Sapiens
QDNQGFALN

SEQ ID NO: 1045682 - protein, 9 aa, Homo Sapiens
IQSIFRVYC

SEQ ID NO: 1045683 - protein, 9 aa, Homo Sapiens
SFIHRFGIH

SEQ ID NO: 1045684 - protein, 9 aa, Homo Sapiens
IFSNFLFDK

SEQ ID NO: 1045685 - protein, 9 aa, Homo Sapiens
AISNHKETK

SEQ ID NO: 1045686 - protein, 9 aa, Homo Sapiens
VLGHLFVRD

SEQ ID NO: 1045687 - protein, 9 aa, Homo Sapiens
PYINQKKAC

SEQ ID NO: 1045688 - protein, 9 aa, Homo Sapiens
TPAATALPP

SEQ ID NO: 1045689 - protein, 9 aa, Homo Sapiens
IVNFLLLLP

SEQ ID NO: 1045690 - protein, 9 aa, Homo Sapiens
SERILSEKE

SEQ ID NO: 1045691 - protein, 9 aa, Homo Sapiens
LEEYSAMRD

SEQ ID NO: 1045692 - protein, 9 aa, Homo Sapiens
FLRIYSLYT

SEQ ID NO: 1045693 - protein, 9 aa, Homo Sapiens
FSITFSLFN

SEQ ID NO: 1045694 - protein, 9 aa, Homo Sapiens
GTERQKSQS

SEQ ID NO: 1045695 - protein, 9 aa, Homo Sapiens
SALNPVIYG

SEQ ID NO: 1045696 - protein, 9 aa, Homo Sapiens
SESENSPVS

SEQ ID NO: 1045697 - protein, 9 aa, Homo Sapiens
IKYKKRSTC

SEQ ID NO: 1045698 - protein, 9 aa, Homo Sapiens
PQIPEGFAD

SEQ ID NO: 1045699 - protein, 9 aa, Homo Sapiens
RFMQVVVSQ

SEQ ID NO: 1045700 - protein, 9 aa, Homo Sapiens
SGHLTQDQM

SEQ ID NO: 1045701 - protein, 9 aa, Homo Sapiens
SYKQDPTLR

SEQ ID NO: 1045702 - protein, 9 aa, Homo Sapiens
LTTINFTRQ

SEQ ID NO: 1045703 - protein, 9 aa, Homo Sapiens
NLPSWCDQV

SEQ ID NO: 1045704 - protein, 9 aa, Homo Sapiens
PFLCIVLFY

SEQ ID NO: 1045705 - protein, 9 aa, Homo Sapiens
IHYSVSAGI

SEQ ID NO: 1045706 - protein, 9 aa, Homo Sapiens
SLAVAQEED

SEQ ID NO: 1045707 - protein, 9 aa, Homo Sapiens
TTPLNHVPS

SEQ ID NO: 1045708 - protein, 9 aa, Homo Sapiens
GPPPNSPCP

SEQ ID NO: 1045709 - protein, 9 aa, Homo Sapiens
DRSNSAEPN

SEQ ID NO: 1045710 - protein, 9 aa, Homo Sapiens
KVPTEKEAT

SEQ ID NO: 1045711 - protein, 9 aa, Homo Sapiens
DILDTAGLE

SEQ ID NO: 1045712 - protein, 9 aa, Homo Sapiens
PESLKGCES

SEQ ID NO: 1045713 - protein, 9 aa, Homo Sapiens
IYSALYNGT

SEQ ID NO: 1045714 - protein, 9 aa, Homo Sapiens
PGNTLEVRK

SEQ ID NO: 1045715 - protein, 9 aa, Homo Sapiens
TRVELVQFS

SEQ ID NO: 1045716 - protein, 9 aa, Homo Sapiens
RVIFSNIFS

SEQ ID NO: 1045717 - protein, 9 aa, Homo Sapiens
SGLFPLFIL

SEQ ID NO: 1045718 - protein, 9 aa, Homo Sapiens
SNSLLTTLS

SEQ ID NO: 1045719 - protein, 9 aa, Homo Sapiens
PVSFPSGST

SEQ ID NO: 1045720 - protein, 9 aa, Homo Sapiens
ERNHSRSRS

SEQ ID NO: 1045721 - protein, 9 aa, Homo Sapiens
DQKALTTFP

SEQ ID NO: 1045722 - protein, 9 aa, Homo Sapiens
LNIKNPDDR

SEQ ID NO: 1045723 - protein, 9 aa, Homo Sapiens
SGEYIPTVF

SEQ ID NO: 1045724 - protein, 9 aa, Homo Sapiens
LPNLVFLDV

SEQ ID NO: 1045725 - protein, 9 aa, Homo Sapiens
CLAGGSGIN

SEQ ID NO: 1045726 - protein, 9 aa, Homo Sapiens
LSPYAVYRF

SEQ ID NO: 1045727 - protein, 9 aa, Homo Sapiens
VLLLQGRLN

SEQ ID NO: 1045728 - protein, 9 aa, Homo Sapiens
DGDNPLLLP

SEQ ID NO: 1045729 - protein, 9 aa, Homo Sapiens
QIDGVSWNS

SEQ ID NO: 1045730 - protein, 9 aa, Homo Sapiens
TNVDPAGNS

SEQ ID NO: 1045731 - protein, 9 aa, Homo Sapiens
AYNPVSISG

SEQ ID NO: 1045732 - protein, 9 aa, Homo Sapiens
KMFLWMVTC

SEQ ID NO: 1045733 - protein, 9 aa, Homo Sapiens
VGVHRLESV

SEQ ID NO: 1045734 - protein, 9 aa, Homo Sapiens
LFSYCKSHV

SEQ ID NO: 1045735 - protein, 9 aa, Homo Sapiens
EGSYYSALS

SEQ ID NO: 1045736 - protein, 9 aa, Homo Sapiens
SEGSSQKGG

SEQ ID NO: 1045737 - protein, 9 aa, Homo Sapiens
RRSFGELAL

SEQ ID NO: 1045738 - protein, 9 aa, Homo Sapiens
ASALRFEDQ

SEQ ID NO: 1045739 - protein, 9 aa, Homo Sapiens
VDPELADCS

SEQ ID NO: 1045740 - protein, 9 aa, Homo Sapiens
LQLDQKALT

SEQ ID NO: 1045741 - protein, 9 aa, Homo Sapiens
PDAEAGSVV

SEQ ID NO: 1045742 - protein, 9 aa, Homo Sapiens
KTLFKVGFI

SEQ ID NO: 1045743 - protein, 9 aa, Homo Sapiens
FKKYILYPA

SEQ ID NO: 1045744 - protein, 9 aa, Homo Sapiens
FASPQNGIP

SEQ ID NO: 1045745 - protein, 9 aa, Homo Sapiens
AGPKPPPVY

SEQ ID NO: 1045746 - protein, 9 aa, Homo Sapiens
VIMGNPKVK

SEQ ID NO: 1045747 - protein, 9 aa, Homo Sapiens
THSKKFQGV

SEQ ID NO: 1045748 - protein, 9 aa, Homo Sapiens
AKTTEPVKV

SEQ ID NO: 1045749 - protein, 9 aa, Homo Sapiens
ITCTWMKFQ

SEQ ID NO: 1045750 - protein, 9 aa, Homo Sapiens
KDNKEDPMS

SEQ ID NO: 1045751 - protein, 9 aa, Homo Sapiens
ASEKIEETM

SEQ ID NO: 1045752 - protein, 9 aa, Homo Sapiens
HGQPYLTQG

SEQ ID NO: 1045753 - protein, 9 aa, Homo Sapiens
HRTIFTFYQ

SEQ ID NO: 1045754 - protein, 9 aa, Homo Sapiens
FVRTEQDKT

SEQ ID NO: 1045755 - protein, 9 aa, Homo Sapiens
NLLRRLATW

SEQ ID NO: 1045756 - protein, 9 aa, Homo Sapiens
VVVPSALNP

SEQ ID NO: 1045757 - protein, 9 aa, Homo Sapiens
QWLNKKFKL

SEQ ID NO: 1045758 - protein, 9 aa, Homo Sapiens
IEGENCRED

SEQ ID NO: 1045759 - protein, 9 aa, Homo Sapiens
PNLVFLDVS

SEQ ID NO: 1045760 - protein, 9 aa, Homo Sapiens
ENCNYLRLW

SEQ ID NO: 1045761 - protein, 9 aa, Homo Sapiens
SEDLRSFQS

SEQ ID NO: 1045762 - protein, 9 aa, Homo Sapiens
SALYNGTNM

SEQ ID NO: 1045763 - protein, 9 aa, Homo Sapiens
PHGPSFTIE

SEQ ID NO: 1045764 - protein, 9 aa, Homo Sapiens
NEAESGYHS

SEQ ID NO: 1045765 - protein, 9 aa, Homo Sapiens
PPQIPEGFA

SEQ ID NO: 1045766 - protein, 9 aa, Homo Sapiens
YSSDAHKRP

SEQ ID NO: 1045767 - protein, 9 aa, Homo Sapiens
TFQEPENDC

SEQ ID NO: 1045768 - protein, 9 aa, Homo Sapiens
WMDYFVFAN

SEQ ID NO: 1045769 - protein, 9 aa, Homo Sapiens
KTPLPQMKN

SEQ ID NO: 1045770 - protein, 9 aa, Homo Sapiens
KILCSSTLG

SEQ ID NO: 1045771 - protein, 9 aa, Homo Sapiens
LIKSFVKTK

SEQ ID NO: 1045772 - protein, 9 aa, Homo Sapiens
SELKLSPQW

SEQ ID NO: 1045773 - protein, 9 aa, Homo Sapiens
NESCRDSLF

SEQ ID NO: 1045774 - protein, 9 aa, Homo Sapiens
RNFLHQDLA

SEQ ID NO: 1045775 - protein, 9 aa, Homo Sapiens
DKKIRKLKN

SEQ ID NO: 1045776 - protein, 9 aa, Homo Sapiens
LKHISSFRQ

SEQ ID NO: 1045777 - protein, 9 aa, Homo Sapiens
EDTSRVQGQ

SEQ ID NO: 1045778 - protein, 9 aa, Homo Sapiens
DNQVPVESL

SEQ ID NO: 1045779 - protein, 9 aa, Homo Sapiens
QYHVTYILD

SEQ ID NO: 1045780 - protein, 9 aa, Homo Sapiens
IFKTLFKVG

SEQ ID NO: 1045781 - protein, 9 aa, Homo Sapiens
WCDQVLWKS

SEQ ID NO: 1045782 - protein, 9 aa, Homo Sapiens
GNSVSYSIH

SEQ ID NO: 1045783 - protein, 9 aa, Homo Sapiens
LLIIMLKMI

SEQ ID NO: 1045784 - protein, 9 aa, Homo Sapiens
RKSSIFIMD

SEQ ID NO: 1045785 - protein, 9 aa, Homo Sapiens
ILDTAGLEE

SEQ ID NO: 1045786 - protein, 9 aa, Homo Sapiens
PQTTGRLEG

SEQ ID NO: 1045787 - protein, 9 aa, Homo Sapiens
EKKLLKCKE

SEQ ID NO: 1045788 - protein, 9 aa, Homo Sapiens
DEIWKYGLK

SEQ ID NO: 1045789 - protein, 9 aa, Homo Sapiens
SIFRVYCFG

SEQ ID NO: 1045790 - protein, 9 aa, Homo Sapiens
YPTTTPHPT

SEQ ID NO: 1045791 - protein, 9 aa, Homo Sapiens
KVMLITKSS

SEQ ID NO: 1045792 - protein, 9 aa, Homo Sapiens
SGQRPAPVR

SEQ ID NO: 1045793 - protein, 9 aa, Homo Sapiens
LQSVHGQPY

SEQ ID NO: 1045794 - protein, 9 aa, Homo Sapiens
NAFSGEYIP

SEQ ID NO: 1045795 - protein, 9 aa, Homo Sapiens
VASSLIFRA

SEQ ID NO: 1045796 - protein, 9 aa, Homo Sapiens
MLRALGIPA

SEQ ID NO: 1045797 - protein, 9 aa, Homo Sapiens
DKSARHLYL

SEQ ID NO: 1045798 - protein, 9 aa, Homo Sapiens
PGGKPERPS

SEQ ID NO: 1045799 - protein, 9 aa, Homo Sapiens
NPFPYHLYY

SEQ ID NO: 1045800 - protein, 9 aa, Homo Sapiens
DEEGSYYSA

SEQ ID NO: 1045801 - protein, 9 aa, Homo Sapiens
PVESLRAIS

SEQ ID NO: 1045802 - protein, 9 aa, Homo Sapiens
HISSFRQSL

SEQ ID NO: 1045803 - protein, 9 aa, Homo Sapiens
ARGGCHGSR

SEQ ID NO: 1045804 - protein, 9 aa, Homo Sapiens
DPSVLGKYQ

SEQ ID NO: 1045805 - protein, 9 aa, Homo Sapiens
TLRKNSELA

SEQ ID NO: 1045806 - protein, 9 aa, Homo Sapiens
CIDTTINKI

SEQ ID NO: 1045807 - protein, 9 aa, Homo Sapiens
ELVIRLRVH

SEQ ID NO: 1045808 - protein, 9 aa, Homo Sapiens
RSQWLNKKF

SEQ ID NO: 1045809 - protein, 9 aa, Homo Sapiens
MPPDAEAGS

SEQ ID NO: 1045810 - protein, 9 aa, Homo Sapiens
RKNSELATE

SEQ ID NO: 1045811 - protein, 9 aa, Homo Sapiens
AQMILQVPA

SEQ ID NO: 1045812 - protein, 9 aa, Homo Sapiens
PDICHKLLG

SEQ ID NO: 1045813 - protein, 9 aa, Homo Sapiens
DPLKSHKLE

SEQ ID NO: 1045814 - protein, 9 aa, Homo Sapiens
FWFLGITFV

SEQ ID NO: 1045815 - protein, 9 aa, Homo Sapiens
YVIGGRNKT

SEQ ID NO: 1045816 - protein, 9 aa, Homo Sapiens
FQKQIQESE

SEQ ID NO: 1045817 - protein, 9 aa, Homo Sapiens
NPRIRPNFK

SEQ ID NO: 1045818 - protein, 9 aa, Homo Sapiens
SPGRAVLGE

SEQ ID NO: 1045819 - protein, 9 aa, Homo Sapiens
QWGDAPSIV

SEQ ID NO: 1045820 - protein, 9 aa, Homo Sapiens
VIRLRVHPL

SEQ ID NO: 1045821 - protein, 9 aa, Homo Sapiens
FDRDGNHFE

SEQ ID NO: 1045822 - protein, 9 aa, Homo Sapiens
RFIPFHLNN

SEQ ID NO: 1045823 - protein, 9 aa, Homo Sapiens
DEKKTLNLL

SEQ ID NO: 1045824 - protein, 9 aa, Homo Sapiens
GDYVSHKIM

SEQ ID NO: 1045825 - protein, 9 aa, Homo Sapiens
VQEEAHYLV

SEQ ID NO: 1045826 - protein, 9 aa, Homo Sapiens
VPNQSSELL

SEQ ID NO: 1045827 - protein, 9 aa, Homo Sapiens
LVDSCTKRY

SEQ ID NO: 1045828 - protein, 9 aa, Homo Sapiens
YKIKPLAFS

SEQ ID NO: 1045829 - protein, 9 aa, Homo Sapiens
ICSDLQRTQ

SEQ ID NO: 1045830 - protein, 9 aa, Homo Sapiens
FIDRFCYNA

SEQ ID NO: 1045831 - protein, 9 aa, Homo Sapiens
ENLDLQSPI

SEQ ID NO: 1045832 - protein, 9 aa, Homo Sapiens
MAGEKWKHG

SEQ ID NO: 1045833 - protein, 9 aa, Homo Sapiens
PEPDICHKL

SEQ ID NO: 1045834 - protein, 9 aa, Homo Sapiens
ESLRAISRT

SEQ ID NO: 1045835 - protein, 9 aa, Homo Sapiens
DKTKVHIIP

SEQ ID NO: 1045836 - protein, 9 aa, Homo Sapiens
SKRENKDLR

SEQ ID NO: 1045837 - protein, 9 aa, Homo Sapiens
TEAFAREVR

SEQ ID NO: 1045838 - protein, 9 aa, Homo Sapiens
DDQESYPVT

SEQ ID NO: 1045839 - protein, 9 aa, Homo Sapiens
IPDIPQIIL

SEQ ID NO: 1045840 - protein, 9 aa, Homo Sapiens
VTSQQEVKV

SEQ ID NO: 1045841 - protein, 9 aa, Homo Sapiens
TLSGGSMFS

SEQ ID NO: 1045842 - protein, 9 aa, Homo Sapiens
GLSHTDVLL

SEQ ID NO: 1045843 - protein, 9 aa, Homo Sapiens
SLVLQVFKI

SEQ ID NO: 1045844 - protein, 9 aa, Homo Sapiens
AILGSGFAL

SEQ ID NO: 1045845 - protein, 9 aa, Homo Sapiens
IKKKFNVSK

SEQ ID NO: 1045846 - protein, 9 aa, Homo Sapiens
GMVARFIPF

SEQ ID NO: 1045847 - protein, 9 aa, Homo Sapiens
NQGFALNFT

SEQ ID NO: 1045848 - protein, 9 aa, Homo Sapiens
WMAAPKNRH

SEQ ID NO: 1045849 - protein, 9 aa, Homo Sapiens
RFCYNANRA

SEQ ID NO: 1045850 - protein, 9 aa, Homo Sapiens
VNCKFGQFS

SEQ ID NO: 1045851 - protein, 9 aa, Homo Sapiens
PIKLSASGE

SEQ ID NO: 1045852 - protein, 9 aa, Homo Sapiens
LSSASVIMG

SEQ ID NO: 1045853 - protein, 9 aa, Homo Sapiens
PKNPCIPKL

SEQ ID NO: 1045854 - protein, 9 aa, Homo Sapiens
FTLPPPFSE

SEQ ID NO: 1045855 - protein, 9 aa, Homo Sapiens
IDNETVFNY

SEQ ID NO: 1045856 - protein, 9 aa, Homo Sapiens
QGASAFLTT

SEQ ID NO: 1045857 - protein, 9 aa, Homo Sapiens
FLIKSFVKT

SEQ ID NO: 1045858 - protein, 9 aa, Homo Sapiens
RPSKPGPPV

SEQ ID NO: 1045859 - protein, 9 aa, Homo Sapiens
PQPFGGPPA

SEQ ID NO: 1045860 - protein, 9 aa, Homo Sapiens
GSVLVLEAI

SEQ ID NO: 1045861 - protein, 9 aa, Homo Sapiens
RLQISQKIS

SEQ ID NO: 1045862 - protein, 9 aa, Homo Sapiens
CHGSRPCSL

SEQ ID NO: 1045863 - protein, 9 aa, Homo Sapiens
IDFDRDGNH

SEQ ID NO: 1045864 - protein, 9 aa, Homo Sapiens
EVGSSMRSL

SEQ ID NO: 1045865 - protein, 9 aa, Homo Sapiens
GPQCQTNTD

SEQ ID NO: 1045866 - protein, 9 aa, Homo Sapiens
IKILCSSTL

SEQ ID NO: 1045867 - protein, 9 aa, Homo Sapiens
IPCKPYEYL

SEQ ID NO: 1045868 - protein, 9 aa, Homo Sapiens
FHADKNGGF

SEQ ID NO: 1045869 - protein, 9 aa, Homo Sapiens
ALPLEREDS

SEQ ID NO: 1045870 - protein, 9 aa, Homo Sapiens
NGGQCQDNQ

SEQ ID NO: 1045871 - protein, 9 aa, Homo Sapiens
NSPCPGPPP

SEQ ID NO: 1045872 - protein, 9 aa, Homo Sapiens
TALPPTPSA

SEQ ID NO: 1045873 - protein, 9 aa, Homo Sapiens
IFSNIFSIY

SEQ ID NO: 1045874 - protein, 9 aa, Homo Sapiens
TVLGHLFVR

SEQ ID NO: 1045875 - protein, 9 aa, Homo Sapiens
FTFYQLEEL

SEQ ID NO: 1045876 - protein, 9 aa, Homo Sapiens
QEVGSSMRS

SEQ ID NO: 1045877 - protein, 9 aa, Homo Sapiens
AFLTTINFT

SEQ ID NO: 1045878 - protein, 9 aa, Homo Sapiens
SFTIEKAIW

SEQ ID NO: 1045879 - protein, 9 aa, Homo Sapiens
RGRKKGEED

SEQ ID NO: 1045880 - protein, 9 aa, Homo Sapiens
AGNSVSYSI

SEQ ID NO: 1045881 - protein, 9 aa, Homo Sapiens
GLQFSGLVP

SEQ ID NO: 1045882 - protein, 9 aa, Homo Sapiens
PEGYETQWG

SEQ ID NO: 1045883 - protein, 9 aa, Homo Sapiens
QIPCQNIFS

SEQ ID NO: 1045884 - protein, 9 aa, Homo Sapiens
RSVAEINQN

SEQ ID NO: 1045885 - protein, 9 aa, Homo Sapiens
KELVRKPQP

SEQ ID NO: 1045886 - protein, 9 aa, Homo Sapiens
ICHKLLGHV

SEQ ID NO: 1045887 - protein, 9 aa, Homo Sapiens
PLSPGTGGP

SEQ ID NO: 1045888 - protein, 9 aa, Homo Sapiens
YRMSNHPDG

SEQ ID NO: 1045889 - protein, 9 aa, Homo Sapiens
VLQVFKIAD

SEQ ID NO: 1045890 - protein, 9 aa, Homo Sapiens
VRSLRYAVF

SEQ ID NO: 1045891 - protein, 9 aa, Homo Sapiens
DLLFIITLP

SEQ ID NO: 1045892 - protein, 9 aa, Homo Sapiens
TKSLAQGDN

SEQ ID NO: 1045893 - protein, 9 aa, Homo Sapiens
GKKVLSANH

SEQ ID NO: 1045894 - protein, 9 aa, Homo Sapiens
NGHLRFSGI

SEQ ID NO: 1045895 - protein, 9 aa, Homo Sapiens
TLEKHSSGT

SEQ ID NO: 1045896 - protein, 9 aa, Homo Sapiens
PPGLCLEAG

SEQ ID NO: 1045897 - protein, 9 aa, Homo Sapiens
EAHYLVEEL

SEQ ID NO: 1045898 - protein, 9 aa, Homo Sapiens
TDKTHSKKF

SEQ ID NO: 1045899 - protein, 9 aa, Homo Sapiens
SQTSLDGPI

SEQ ID NO: 1045900 - protein, 9 aa, Homo Sapiens
SLSNPSLFT

SEQ ID NO: 1045901 - protein, 9 aa, Homo Sapiens
TEKEINNME

SEQ ID NO: 1045902 - protein, 9 aa, Homo Sapiens
GLLRPMEEE

SEQ ID NO: 1045903 - protein, 9 aa, Homo Sapiens
PRSAAHTMS

SEQ ID NO: 1045904 - protein, 9 aa, Homo Sapiens
LAGRKLPDY

SEQ ID NO: 1045905 - protein, 9 aa, Homo Sapiens
LSTANSVIS

SEQ ID NO: 1045906 - protein, 9 aa, Homo Sapiens
CVDPELADC

SEQ ID NO: 1045907 - protein, 9 aa, Homo Sapiens
IIRALHLFP

SEQ ID NO: 1045908 - protein, 9 aa, Homo Sapiens
DIPCYENEL

SEQ ID NO: 1045909 - protein, 9 aa, Homo Sapiens
EASQNVIEL

SEQ ID NO: 1045910 - protein, 9 aa, Homo Sapiens
REASQNVIE

SEQ ID NO: 1045911 - protein, 9 aa, Homo Sapiens
EVRFPGQNT

SEQ ID NO: 1045912 - protein, 9 aa, Homo Sapiens
TTRAIKDLY

SEQ ID NO: 1045913 - protein, 9 aa, Homo Sapiens
MKWLKNDSY

SEQ ID NO: 1045914 - protein, 9 aa, Homo Sapiens
WGDAPSIVG

SEQ ID NO: 1045915 - protein, 9 aa, Homo Sapiens
YVVVPSALN

SEQ ID NO: 1045916 - protein, 9 aa, Homo Sapiens
PLNHVPSAA

SEQ ID NO: 1045917 - protein, 9 aa, Homo Sapiens
FIITLPLWA

SEQ ID NO: 1045918 - protein, 9 aa, Homo Sapiens
QKMKKIRAL

SEQ ID NO: 1045919 - protein, 9 aa, Homo Sapiens
INEDGSLSV

SEQ ID NO: 1045920 - protein, 9 aa, Homo Sapiens
EVSDQRNCG

SEQ ID NO: 1045921 - protein, 9 aa, Homo Sapiens
LRRLATWLK

SEQ ID NO: 1045922 - protein, 9 aa, Homo Sapiens
LIDFDRDGN

SEQ ID NO: 1045923 - protein, 9 aa, Homo Sapiens
FSIYQFHSQ

SEQ ID NO: 1045924 - protein, 9 aa, Homo Sapiens
QSVHGQPYL

SEQ ID NO: 1045925 - protein, 9 aa, Homo Sapiens
LQVFKIADI

SEQ ID NO: 1045926 - protein, 9 aa, Homo Sapiens
ENCREDALR

SEQ ID NO: 1045927 - protein, 9 aa, Homo Sapiens
PVSISGQRY

SEQ ID NO: 1045928 - protein, 9 aa, Homo Sapiens
DILPNLVFL

SEQ ID NO: 1045929 - protein, 9 aa, Homo Sapiens
LGHLFVRDQ

SEQ ID NO: 1045930 - protein, 9 aa, Homo Sapiens
ASSLIFRAI

SEQ ID NO: 1045931 - protein, 9 aa, Homo Sapiens
RIQEVASSL

SEQ ID NO: 1045932 - protein, 9 aa, Homo Sapiens
KICSDLQRT

SEQ ID NO: 1045933 - protein, 9 aa, Homo Sapiens
LFTTNLSGP

SEQ ID NO: 1045934 - protein, 9 aa, Homo Sapiens
FSKQNKTRS

SEQ ID NO: 1045935 - protein, 9 aa, Homo Sapiens
GLPAKTTEP

SEQ ID NO: 1045936 - protein, 9 aa, Homo Sapiens
NSLCKTITG

SEQ ID NO: 1045937 - protein, 9 aa, Homo Sapiens
SKMRRREHE

SEQ ID NO: 1045938 - protein, 9 aa, Homo Sapiens
FLTTINFTR

SEQ ID NO: 1045939 - protein, 9 aa, Homo Sapiens
TGPPPVHPS

SEQ ID NO: 1045940 - protein, 9 aa, Homo Sapiens
SGQRYSWDM

SEQ ID NO: 1045941 - protein, 9 aa, Homo Sapiens
HRGDYVSHK

SEQ ID NO: 1045942 - protein, 9 aa, Homo Sapiens
CRSVAEINQ

SEQ ID NO: 1045943 - protein, 9 aa, Homo Sapiens
ISEDLRSFQ

SEQ ID NO: 1045944 - protein, 9 aa, Homo Sapiens
TRSRALVNT

SEQ ID NO: 1045945 - protein, 9 aa, Homo Sapiens
QLSGEDRKP

SEQ ID NO: 1045946 - protein, 9 aa, Homo Sapiens
VNFLLLLPV

SEQ ID NO: 1045947 - protein, 9 aa, Homo Sapiens
LQFSGLVPD

SEQ ID NO: 1045948 - protein, 9 aa, Homo Sapiens
SLRSLILLD

SEQ ID NO: 1045949 - protein, 9 aa, Homo Sapiens
AQFASPQNG

SEQ ID NO: 1045950 - protein, 9 aa, Homo Sapiens
FAYKIKPLA

SEQ ID NO: 1045951 - protein, 9 aa, Homo Sapiens
NESMRKVML

SEQ ID NO: 1045952 - protein, 9 aa, Homo Sapiens
VPTMAGEKW

SEQ ID NO: 1045953 - protein, 9 aa, Homo Sapiens
KALFTDPAA

SEQ ID NO: 1045954 - protein, 9 aa, Homo Sapiens
EEARPATGT

SEQ ID NO: 1045955 - protein, 9 aa, Homo Sapiens
EDIKVCETQ

SEQ ID NO: 1045956 - protein, 9 aa, Homo Sapiens
FTRSELKLS

SEQ ID NO: 1045957 - protein, 9 aa, Homo Sapiens
GLDSRKLAK

SEQ ID NO: 1045958 - protein, 9 aa, Homo Sapiens
RIRDKDSGN

SEQ ID NO: 1045959 - protein, 9 aa, Homo Sapiens
MRSLRSLIL

SEQ ID NO: 1045960 - protein, 9 aa, Homo Sapiens
NIKRNEMVI

SEQ ID NO: 1045961 - protein, 9 aa, Homo Sapiens
ATGKKSSKS

SEQ ID NO: 1045962 - protein, 9 aa, Homo Sapiens
CREALECEE

SEQ ID NO: 1045963 - protein, 9 aa, Homo Sapiens
SRWLGTQLS

SEQ ID NO: 1045964 - protein, 9 aa, Homo Sapiens
DYVSHKIMH

SEQ ID NO: 1045965 - protein, 9 aa, Homo Sapiens
HSSPGSTGT

SEQ ID NO: 1045966 - protein, 9 aa, Homo Sapiens
GIAVILGEA

SEQ ID NO: 1045967 - protein, 9 aa, Homo Sapiens
EDKFENEGH

SEQ ID NO: 1045968 - protein, 9 aa, Homo Sapiens
KKRSTCMKE

SEQ ID NO: 1045969 - protein, 9 aa, Homo Sapiens
TSGDYDDSA

SEQ ID NO: 1045970 - protein, 9 aa, Homo Sapiens
YRSCGFSYK

SEQ ID NO: 1045971 - protein, 9 aa, Homo Sapiens
GDEKGVWCY

SEQ ID NO: 1045972 - protein, 9 aa, Homo Sapiens
VHIIPDIPQ

SEQ ID NO: 1045973 - protein, 9 aa, Homo Sapiens
VESLRAISR

SEQ ID NO: 1045974 - protein, 9 aa, Homo Sapiens
KTRSKGILL

SEQ ID NO: 1045975 - protein, 9 aa, Homo Sapiens
NDGGLQFSG

SEQ ID NO: 1045976 - protein, 9 aa, Homo Sapiens
SSAPTAEKA

SEQ ID NO: 1045977 - protein, 9 aa, Homo Sapiens
ETKEKTVSE

SEQ ID NO: 1045978 - protein, 9 aa, Homo Sapiens
KKDLNGGSL

SEQ ID NO: 1045979 - protein, 9 aa, Homo Sapiens
APTAEKASI

SEQ ID NO: 1045980 - protein, 9 aa, Homo Sapiens
ELVQFSSRV

SEQ ID NO: 1045981 - protein, 9 aa, Homo Sapiens
KLPDYLMKI

SEQ ID NO: 1045982 - protein, 9 aa, Homo Sapiens
PALAPPLAR

SEQ ID NO: 1045983 - protein, 9 aa, Homo Sapiens
LYVVVPSAL

SEQ ID NO: 1045984 - protein, 9 aa, Homo Sapiens
AVFRIRDKD

SEQ ID NO: 1045985 - protein, 9 aa, Homo Sapiens
LEDLDLFYN

SEQ ID NO: 1045986 - protein, 9 aa, Homo Sapiens
LYNGTNMIE

SEQ ID NO: 1045987 - protein, 9 aa, Homo Sapiens
YLKKSLKII

SEQ ID NO: 1045988 - protein, 9 aa, Homo Sapiens
VHGQPYLTQ

SEQ ID NO: 1045989 - protein, 9 aa, Homo Sapiens
LIELNIKNP

SEQ ID NO: 1045990 - protein, 9 aa, Homo Sapiens
GPSRISAIK

SEQ ID NO: 1045991 - protein, 9 aa, Homo Sapiens
MFCSRSIEV

SEQ ID NO: 1045992 - protein, 9 aa, Homo Sapiens
AGLINDAFS

SEQ ID NO: 1045993 - protein, 9 aa, Homo Sapiens
GDLSSELVD

SEQ ID NO: 1045994 - protein, 9 aa, Homo Sapiens
DFAYKIKPL

SEQ ID NO: 1045995 - protein, 9 aa, Homo Sapiens
SENSPVSQR

SEQ ID NO: 1045996 - protein, 9 aa, Homo Sapiens
LDGPIKQQE

SEQ ID NO: 1045997 - protein, 9 aa, Homo Sapiens
EDRGCPARG

SEQ ID NO: 1045998 - protein, 9 aa, Homo Sapiens
NRNSLVVGT

SEQ ID NO: 1045999 - protein, 9 aa, Homo Sapiens
EEKKEEVTE

SEQ ID NO: 1046000 - protein, 9 aa, Homo Sapiens
RMPPDAEAG

SEQ ID NO: 1046001 - protein, 9 aa, Homo Sapiens
RPVFVQEPD

SEQ ID NO: 1046002 - protein, 9 aa, Homo Sapiens
KISAHRTEF

SEQ ID NO: 1046003 - protein, 9 aa, Homo Sapiens
APAFSEEKA

SEQ ID NO: 1046004 - protein, 9 aa, Homo Sapiens
FLLVGLIGG

SEQ ID NO: 1046005 - protein, 9 aa, Homo Sapiens
SPLLIIMLK

SEQ ID NO: 1046006 - protein, 9 aa, Homo Sapiens
GESFIYSVA

SEQ ID NO: 1046007 - protein, 9 aa, Homo Sapiens
SFQSGDLSQ

SEQ ID NO: 1046008 - protein, 9 aa, Homo Sapiens
FCGPLSPGT

SEQ ID NO: 1046009 - protein, 9 aa, Homo Sapiens
SFLQSVHGQ

SEQ ID NO: 1046010 - protein, 9 aa, Homo Sapiens
SPLPPGGGN

SEQ ID NO: 1046011 - protein, 9 aa, Homo Sapiens
ALPPTPSAQ

SEQ ID NO: 1046012 - protein, 9 aa, Homo Sapiens
PLFLIKSFV

SEQ ID NO: 1046013 - protein, 9 aa, Homo Sapiens
TIFTFYQLE

SEQ ID NO: 1046014 - protein, 9 aa, Homo Sapiens
TMFKKGPTF

SEQ ID NO: 1046015 - protein, 9 aa, Homo Sapiens
AVRRMPPDA

SEQ ID NO: 1046016 - protein, 9 aa, Homo Sapiens
AVTSPSRTS

SEQ ID NO: 1046017 - protein, 9 aa, Homo Sapiens
ASQSQTFSV

SEQ ID NO: 1046018 - protein, 9 aa, Homo Sapiens
VLFTHKKDL

SEQ ID NO: 1046019 - protein, 9 aa, Homo Sapiens
RKVMLITKS

SEQ ID NO: 1046020 - protein, 9 aa, Homo Sapiens
GRRGIFLEG

SEQ ID NO: 1046021 - protein, 9 aa, Homo Sapiens
CLSQIYLAA

SEQ ID NO: 1046022 - protein, 9 aa, Homo Sapiens
LLRRLATWL

SEQ ID NO: 1046023 - protein, 9 aa, Homo Sapiens
GRLEGSSKF

SEQ ID NO: 1046024 - protein, 9 aa, Homo Sapiens
VCGGDNSLC

SEQ ID NO: 1046025 - protein, 9 aa, Homo Sapiens
FVFANNRAA

SEQ ID NO: 1046026 - protein, 9 aa, Homo Sapiens
PSKPGPPVQ

SEQ ID NO: 1046027 - protein, 9 aa, Homo Sapiens
GLFPLFILG

SEQ ID NO: 1046028 - protein, 9 aa, Homo Sapiens
INDAFSLAR

SEQ ID NO: 1046029 - protein, 9 aa, Homo Sapiens
RTMNNKELV

SEQ ID NO: 1046030 - protein, 9 aa, Homo Sapiens
GGKPERPSK

SEQ ID NO: 1046031 - protein, 9 aa, Homo Sapiens
KEIHSAIIK

SEQ ID NO: 1046032 - protein, 9 aa, Homo Sapiens
NTLEVRKSG

SEQ ID NO: 1046033 - protein, 9 aa, Homo Sapiens
VSSLCLKRC

SEQ ID NO: 1046034 - protein, 9 aa, Homo Sapiens
LAGGSGINE

SEQ ID NO: 1046035 - protein, 9 aa, Homo Sapiens
QIYLAAHFP

SEQ ID NO: 1046036 - protein, 9 aa, Homo Sapiens
IIQNLKKNS

SEQ ID NO: 1046037 - protein, 9 aa, Homo Sapiens
LQKAGEPWC

SEQ ID NO: 1046038 - protein, 9 aa, Homo Sapiens
PYPTTTPHP

SEQ ID NO: 1046039 - protein, 9 aa, Homo Sapiens
LIEGENCRE

SEQ ID NO: 1046040 - protein, 9 aa, Homo Sapiens
FYICIISTI

SEQ ID NO: 1046041 - protein, 9 aa, Homo Sapiens
LCHSLQHTK

SEQ ID NO: 1046042 - protein, 9 aa, Homo Sapiens
QCVMEVSDQ

SEQ ID NO: 1046043 - protein, 9 aa, Homo Sapiens
TSQQEVKVK

SEQ ID NO: 1046044 - protein, 9 aa, Homo Sapiens
QLPREVGTS

SEQ ID NO: 1046045 - protein, 9 aa, Homo Sapiens
DNSLCKTIT

SEQ ID NO: 1046046 - protein, 9 aa, Homo Sapiens
LILKLKDLR

SEQ ID NO: 1046047 - protein, 9 aa, Homo Sapiens
ARMASQNFF

SEQ ID NO: 1046048 - protein, 9 aa, Homo Sapiens
MSNHPDGPS

SEQ ID NO: 1046049 - protein, 9 aa, Homo Sapiens
QKEQRQKMK

SEQ ID NO: 1046050 - protein, 9 aa, Homo Sapiens
REDALREAE

SEQ ID NO: 1046051 - protein, 9 aa, Homo Sapiens
PVFSWVITN

SEQ ID NO: 1046052 - protein, 9 aa, Homo Sapiens
EQLPPKVED

SEQ ID NO: 1046053 - protein, 9 aa, Homo Sapiens
RAEALPLER

SEQ ID NO: 1046054 - protein, 9 aa, Homo Sapiens
FTDPAAPNL

SEQ ID NO: 1046055 - protein, 9 aa, Homo Sapiens
PFHSPLHSG

SEQ ID NO: 1046056 - protein, 9 aa, Homo Sapiens
GSPFHSPLH

SEQ ID NO: 1046057 - protein, 9 aa, Homo Sapiens
VWLQCFKKY

SEQ ID NO: 1046058 - protein, 9 aa, Homo Sapiens
NEHFGIVSL

SEQ ID NO: 1046059 - protein, 9 aa, Homo Sapiens
LEKHSSGTP

SEQ ID NO: 1046060 - protein, 9 aa, Homo Sapiens
PKNSYAQGR

SEQ ID NO: 1046061 - protein, 9 aa, Homo Sapiens
SNGAPNGFH

SEQ ID NO: 1046062 - protein, 9 aa, Homo Sapiens
KKNSSYFLG

SEQ ID NO: 1046063 - protein, 9 aa, Homo Sapiens
FADGEPKPK

SEQ ID NO: 1046064 - protein, 9 aa, Homo Sapiens
PLEAGVAGG

SEQ ID NO: 1046065 - protein, 9 aa, Homo Sapiens
AVRSLRYAV

SEQ ID NO: 1046066 - protein, 9 aa, Homo Sapiens
PSRISAIKD

SEQ ID NO: 1046067 - protein, 9 aa, Homo Sapiens
QQEVKVKFP

SEQ ID NO: 1046068 - protein, 9 aa, Homo Sapiens
QRQKMKKIR

SEQ ID NO: 1046069 - protein, 9 aa, Homo Sapiens
HCVLQKKVQ

SEQ ID NO: 1046070 - protein, 9 aa, Homo Sapiens
FTLFLNPVI

SEQ ID NO: 1046071 - protein, 9 aa, Homo Sapiens
GLKAESEAR

SEQ ID NO: 1046072 - protein, 9 aa, Homo Sapiens
YCSASWSSD

SEQ ID NO: 1046073 - protein, 9 aa, Homo Sapiens
DNQGFALNF

SEQ ID NO: 1046074 - protein, 9 aa, Homo Sapiens
AASQILENR

SEQ ID NO: 1046075 - protein, 9 aa, Homo Sapiens
TNTDYCVSA

SEQ ID NO: 1046076 - protein, 9 aa, Homo Sapiens
MEPEKGTPL

SEQ ID NO: 1046077 - protein, 9 aa, Homo Sapiens
KQDESVDYR

SEQ ID NO: 1046078 - protein, 9 aa, Homo Sapiens
TVCPTGPPP

SEQ ID NO: 1046079 - protein, 9 aa, Homo Sapiens
LPVLAELVI

SEQ ID NO: 1046080 - protein, 9 aa, Homo Sapiens
VQPGLLRPM

SEQ ID NO: 1046081 - protein, 9 aa, Homo Sapiens
TGTACLPFY

SEQ ID NO: 1046082 - protein, 9 aa, Homo Sapiens
LGKYQAGFS

SEQ ID NO: 1046083 - protein, 9 aa, Homo Sapiens
EERNHSRSR

SEQ ID NO: 1046084 - protein, 9 aa, Homo Sapiens
VLSLLENSP

SEQ ID NO: 1046085 - protein, 9 aa, Homo Sapiens
VGNYDNRRS

SEQ ID NO: 1046086 - protein, 9 aa, Homo Sapiens
DQSSSSTQL

SEQ ID NO: 1046087 - protein, 9 aa, Homo Sapiens
AEALPLERE

SEQ ID NO: 1046088 - protein, 9 aa, Homo Sapiens
NISDIAEKR

SEQ ID NO: 1046089 - protein, 9 aa, Homo Sapiens
MPFPLGPPC

SEQ ID NO: 1046090 - protein, 9 aa, Homo Sapiens
EATGLSNLG

SEQ ID NO: 1046091 - protein, 9 aa, Homo Sapiens
SLVTGLSET

SEQ ID NO: 1046092 - protein, 9 aa, Homo Sapiens
TANSVISIW

SEQ ID NO: 1046093 - protein, 9 aa, Homo Sapiens
VRPQASPPS

SEQ ID NO: 1046094 - protein, 9 aa, Homo Sapiens
AVYCDDIPC

SEQ ID NO: 1046095 - protein, 9 aa, Homo Sapiens
PTEKEATGL

SEQ ID NO: 1046096 - protein, 9 aa, Homo Sapiens
TGKKSSKSV

SEQ ID NO: 1046097 - protein, 9 aa, Homo Sapiens
LSEIIQFYL

SEQ ID NO: 1046098 - protein, 9 aa, Homo Sapiens
NRLLVSYNP

SEQ ID NO: 1046099 - protein, 9 aa, Homo Sapiens
YMVILVSLQ

SEQ ID NO: 1046100 - protein, 9 aa, Homo Sapiens
TAGLEEYSA

SEQ ID NO: 1046101 - protein, 9 aa, Homo Sapiens
RVSPKNPCI

SEQ ID NO: 1046102 - protein, 9 aa, Homo Sapiens
PQIPHYRVA

SEQ ID NO: 1046103 - protein, 9 aa, Homo Sapiens
CINQQLDTK

SEQ ID NO: 1046104 - protein, 9 aa, Homo Sapiens
DKFENEGHG

SEQ ID NO: 1046105 - protein, 9 aa, Homo Sapiens
NRAGLINDA

SEQ ID NO: 1046106 - protein, 9 aa, Homo Sapiens
TLPLSPGVP

SEQ ID NO: 1046107 - protein, 9 aa, Homo Sapiens
SDLLFIITL

SEQ ID NO: 1046108 - protein, 9 aa, Homo Sapiens
KIRKLKNEL

SEQ ID NO: 1046109 - protein, 9 aa, Homo Sapiens
LQPQIPHYR

SEQ ID NO: 1046110 - protein, 9 aa, Homo Sapiens
MRRREHEFR

SEQ ID NO: 1046111 - protein, 9 aa, Homo Sapiens
LGLDSRKLA

SEQ ID NO: 1046112 - protein, 9 aa, Homo Sapiens
KKVRINEDG

SEQ ID NO: 1046113 - protein, 9 aa, Homo Sapiens
ELLAGEYNT

SEQ ID NO: 1046114 - protein, 9 aa, Homo Sapiens
VVFSYGLGA

SEQ ID NO: 1046115 - protein, 9 aa, Homo Sapiens
ISGQRYSWD

SEQ ID NO: 1046116 - protein, 9 aa, Homo Sapiens
FCYNANRAS

SEQ ID NO: 1046117 - protein, 9 aa, Homo Sapiens
SVLPGEQQR

SEQ ID NO: 1046118 - protein, 9 aa, Homo Sapiens
PGLCLEAGT

SEQ ID NO: 1046119 - protein, 9 aa, Homo Sapiens
LSQIYLAAH

SEQ ID NO: 1046120 - protein, 9 aa, Homo Sapiens
LSNPSLFTT

SEQ ID NO: 1046121 - protein, 9 aa, Homo Sapiens
IHAEPYTRR

SEQ ID NO: 1046122 - protein, 9 aa, Homo Sapiens
LEYMNNVLL

SEQ ID NO: 1046123 - protein, 9 aa, Homo Sapiens
AHSRPSYCS

SEQ ID NO: 1046124 - protein, 9 aa, Homo Sapiens
LLRQKAKFI

SEQ ID NO: 1046125 - protein, 9 aa, Homo Sapiens
KASIFGVSS

SEQ ID NO: 1046126 - protein, 9 aa, Homo Sapiens
NFPHPQQSQ

SEQ ID NO: 1046127 - protein, 9 aa, Homo Sapiens
HYKPHLNLP

SEQ ID NO: 1046128 - protein, 9 aa, Homo Sapiens
PTKSPLPPG

SEQ ID NO: 1046129 - protein, 9 aa, Homo Sapiens
QIPEGFADG

SEQ ID NO: 1046130 - protein, 9 aa, Homo Sapiens
AILESANWE

SEQ ID NO: 1046131 - protein, 9 aa, Homo Sapiens
RSVAFSCIS

SEQ ID NO: 1046132 - protein, 9 aa, Homo Sapiens
GLGSLTSHS

SEQ ID NO: 1046133 - protein, 9 aa, Homo Sapiens
IWWNLQKTC

SEQ ID NO: 1046134 - protein, 9 aa, Homo Sapiens
QSPRQLSGE

SEQ ID NO: 1046135 - protein, 9 aa, Homo Sapiens
FLRTRSRAL

SEQ ID NO: 1046136 - protein, 9 aa, Homo Sapiens
LGSLTSHSL

SEQ ID NO: 1046137 - protein, 9 aa, Homo Sapiens
RRLQTCKEK

SEQ ID NO: 1046138 - protein, 9 aa, Homo Sapiens
SNEHFGIVS

SEQ ID NO: 1046139 - protein, 9 aa, Homo Sapiens
NGPPQMRPY

SEQ ID NO: 1046140 - protein, 9 aa, Homo Sapiens
HKWSQLLSN

SEQ ID NO: 1046141 - protein, 9 aa, Homo Sapiens
HSRPSYCSA

SEQ ID NO: 1046142 - protein, 9 aa, Homo Sapiens
FTTNLSGPS

SEQ ID NO: 1046143 - protein, 9 aa, Homo Sapiens
TLFFGSCIF

SEQ ID NO: 1046144 - protein, 9 aa, Homo Sapiens
RRWIIRALH

SEQ ID NO: 1046145 - protein, 9 aa, Homo Sapiens
FHSSPGSTG

SEQ ID NO: 1046146 - protein, 9 aa, Homo Sapiens
WWNLQKTCY

SEQ ID NO: 1046147 - protein, 9 aa, Homo Sapiens
SALRFEDQI

SEQ ID NO: 1046148 - protein, 9 aa, Homo Sapiens
HLPFCHNDK

SEQ ID NO: 1046149 - protein, 9 aa, Homo Sapiens
IGLSSVRLH

SEQ ID NO: 1046150 - protein, 9 aa, Homo Sapiens
DSTTPLNHV

SEQ ID NO: 1046151 - protein, 9 aa, Homo Sapiens
LLLAAKALF

SEQ ID NO: 1046152 - protein, 9 aa, Homo Sapiens
LRFEDQITV

SEQ ID NO: 1046153 - protein, 9 aa, Homo Sapiens
EQLFFICQI

SEQ ID NO: 1046154 - protein, 9 aa, Homo Sapiens
YVSHKIMHH

SEQ ID NO: 1046155 - protein, 9 aa, Homo Sapiens
LYLCDYHKN

SEQ ID NO: 1046156 - protein, 9 aa, Homo Sapiens
NDFAYKIKP

SEQ ID NO: 1046157 - protein, 9 aa, Homo Sapiens
QPKNSYAQG

SEQ ID NO: 1046158 - protein, 9 aa, Homo Sapiens
FDAIFTLFL

SEQ ID NO: 1046159 - protein, 9 aa, Homo Sapiens
KNGGTEASF

SEQ ID NO: 1046160 - protein, 9 aa, Homo Sapiens
GEQQRPHSE

SEQ ID NO: 1046161 - protein, 9 aa, Homo Sapiens
FFKRSIQEH

SEQ ID NO: 1046162 - protein, 9 aa, Homo Sapiens
FIIQNLKKN

SEQ ID NO: 1046163 - protein, 9 aa, Homo Sapiens
FQGIKKKFN

SEQ ID NO: 1046164 - protein, 9 aa, Homo Sapiens
EAIIGDWVD

SEQ ID NO: 1046165 - protein, 9 aa, Homo Sapiens
ADKTKVHII

SEQ ID NO: 1046166 - protein, 9 aa, Homo Sapiens
SLVHLNEAE

SEQ ID NO: 1046167 - protein, 9 aa, Homo Sapiens
SSLIFRAIS

SEQ ID NO: 1046168 - protein, 9 aa, Homo Sapiens
SSIFIMDEA

SEQ ID NO: 1046169 - protein, 9 aa, Homo Sapiens
QFSGLVPDD

SEQ ID NO: 1046170 - protein, 9 aa, Homo Sapiens
QFSTLKLKS

SEQ ID NO: 1046171 - protein, 9 aa, Homo Sapiens
SQNFFRIEY

SEQ ID NO: 1046172 - protein, 9 aa, Homo Sapiens
LVPLSTLTT

SEQ ID NO: 1046173 - protein, 9 aa, Homo Sapiens
HQPPQLKAL

SEQ ID NO: 1046174 - protein, 9 aa, Homo Sapiens
KEINNMENT

SEQ ID NO: 1046175 - protein, 9 aa, Homo Sapiens
IQEVASSLI

SEQ ID NO: 1046176 - protein, 9 aa, Homo Sapiens
SQWLNKKFK

SEQ ID NO: 1046177 - protein, 9 aa, Homo Sapiens
VILRLFLFS

SEQ ID NO: 1046178 - protein, 9 aa, Homo Sapiens
MFKKGPTFI

SEQ ID NO: 1046179 - protein, 9 aa, Homo Sapiens
KIYHFYCDM

SEQ ID NO: 1046180 - protein, 9 aa, Homo Sapiens
ILENREEAP

SEQ ID NO: 1046181 - protein, 9 aa, Homo Sapiens
YGFSPSSFS

SEQ ID NO: 1046182 - protein, 9 aa, Homo Sapiens
QARREILSP

SEQ ID NO: 1046183 - protein, 9 aa, Homo Sapiens
FEAQMILQV

SEQ ID NO: 1046184 - protein, 9 aa, Homo Sapiens
TEKKLLKCK

SEQ ID NO: 1046185 - protein, 9 aa, Homo Sapiens
TRSERILSE

SEQ ID NO: 1046186 - protein, 9 aa, Homo Sapiens
GQDEIWKYG

SEQ ID NO: 1046187 - protein, 9 aa, Homo Sapiens
DICHKLLGH

SEQ ID NO: 1046188 - protein, 9 aa, Homo Sapiens
SPFHSPLHS

SEQ ID NO: 1046189 - protein, 9 aa, Homo Sapiens
SVAEINQNL

SEQ ID NO: 1046190 - protein, 9 aa, Homo Sapiens
PPFSETQPG

SEQ ID NO: 1046191 - protein, 9 aa, Homo Sapiens
PVFSKQNKT

SEQ ID NO: 1046192 - protein, 9 aa, Homo Sapiens
KKFKLGLDF

SEQ ID NO: 1046193 - protein, 9 aa, Homo Sapiens
VGTSGDYDD

SEQ ID NO: 1046194 - protein, 9 aa, Homo Sapiens
QCQDNQGFA

SEQ ID NO: 1046195 - protein, 9 aa, Homo Sapiens
DRFCYNANR

SEQ ID NO: 1046196 - protein, 9 aa, Homo Sapiens
PPGDSSAAF

SEQ ID NO: 1046197 - protein, 9 aa, Homo Sapiens
KFGQFSTLK

SEQ ID NO: 1046198 - protein, 9 aa, Homo Sapiens
FYNNLHGLP

SEQ ID NO: 1046199 - protein, 9 aa, Homo Sapiens
EIKTLRKNS

SEQ ID NO: 1046200 - protein, 9 aa, Homo Sapiens
FSNIFSIYQ

SEQ ID NO: 1046201 - protein, 9 aa, Homo Sapiens
EKEATGLSN

SEQ ID NO: 1046202 - protein, 9 aa, Homo Sapiens
RSRALVNTA

SEQ ID NO: 1046203 - protein, 9 aa, Homo Sapiens
LHSLAVAQE

SEQ ID NO: 1046204 - protein, 9 aa, Homo Sapiens
REEAPGPDP

SEQ ID NO: 1046205 - protein, 9 aa, Homo Sapiens
NFLLLLPVS

SEQ ID NO: 1046206 - protein, 9 aa, Homo Sapiens
QTNVDPAGN

SEQ ID NO: 1046207 - protein, 9 aa, Homo Sapiens
LDAQQMKIR

SEQ ID NO: 1046208 - protein, 9 aa, Homo Sapiens
LKLSPQWSH

SEQ ID NO: 1046209 - protein, 9 aa, Homo Sapiens
YFVFANNRA

SEQ ID NO: 1046210 - protein, 9 aa, Homo Sapiens
SSSLMLPKV

SEQ ID NO: 1046211 - protein, 9 aa, Homo Sapiens
MGTEINYLC

SEQ ID NO: 1046212 - protein, 9 aa, Homo Sapiens
AVYLQPKNS

SEQ ID NO: 1046213 - protein, 9 aa, Homo Sapiens
DSRKLAKHG

SEQ ID NO: 1046214 - protein, 9 aa, Homo Sapiens
VYLSSAVTS

SEQ ID NO: 1046215 - protein, 9 aa, Homo Sapiens
RPSYCSASW

SEQ ID NO: 1046216 - protein, 9 aa, Homo Sapiens
NSPVSQRKR

SEQ ID NO: 1046217 - protein, 9 aa, Homo Sapiens
KHSFNLLRR

SEQ ID NO: 1046218 - protein, 9 aa, Homo Sapiens
RSLRSLILL

SEQ ID NO: 1046219 - protein, 9 aa, Homo Sapiens
IHTGKRPFK

SEQ ID NO: 1046220 - protein, 9 aa, Homo Sapiens
LLLPRCSIF

SEQ ID NO: 1046221 - protein, 9 aa, Homo Sapiens
QGRLNLGTG

SEQ ID NO: 1046222 - protein, 9 aa, Homo Sapiens
KREARENGS

SEQ ID NO: 1046223 - protein, 9 aa, Homo Sapiens
NNVLLSGEV

SEQ ID NO: 1046224 - protein, 9 aa, Homo Sapiens
KEATGLSNL

SEQ ID NO: 1046225 - protein, 9 aa, Homo Sapiens
PSFTIEKAI

SEQ ID NO: 1046226 - protein, 9 aa, Homo Sapiens
PRASHEKVF

SEQ ID NO: 1046227 - protein, 9 aa, Homo Sapiens
MREVKRHIT

SEQ ID NO: 1046228 - protein, 9 aa, Homo Sapiens
INDFAYKIK

SEQ ID NO: 1046229 - protein, 9 aa, Homo Sapiens
EFTHYKPHL

SEQ ID NO: 1046230 - protein, 9 aa, Homo Sapiens
DLKMKREAR

SEQ ID NO: 1046231 - protein, 9 aa, Homo Sapiens
LVNFLRTRS

SEQ ID NO: 1046232 - protein, 9 aa, Homo Sapiens
KWKHGGDQS

SEQ ID NO: 1046233 - protein, 9 aa, Homo Sapiens
NLDLQSPIK

SEQ ID NO: 1046234 - protein, 9 aa, Homo Sapiens
FYLKSAKLF

SEQ ID NO: 1046235 - protein, 9 aa, Homo Sapiens
SSSEERNHS

SEQ ID NO: 1046236 - protein, 9 aa, Homo Sapiens
PTAEKASIF

SEQ ID NO: 1046237 - protein, 9 aa, Homo Sapiens
QISLDRKTS

SEQ ID NO: 1046238 - protein, 9 aa, Homo Sapiens
YLKSAKLFH

SEQ ID NO: 1046239 - protein, 9 aa, Homo Sapiens
IIFKTLFKV

SEQ ID NO: 1046240 - protein, 9 aa, Homo Sapiens
DTTINKIIN

SEQ ID NO: 1046241 - protein, 9 aa, Homo Sapiens
FLFDKNFRS

SEQ ID NO: 1046242 - protein, 9 aa, Homo Sapiens
LPPKVEDRS

SEQ ID NO: 1046243 - protein, 9 aa, Homo Sapiens
EDLDLFYNN

SEQ ID NO: 1046244 - protein, 9 aa, Homo Sapiens
KEEYEQIPQ

SEQ ID NO: 1046245 - protein, 9 aa, Homo Sapiens
NSITLQQWR

SEQ ID NO: 1046246 - protein, 9 aa, Homo Sapiens
SNTRDPPGL

SEQ ID NO: 1046247 - protein, 9 aa, Homo Sapiens
NWLLEFCSS

SEQ ID NO: 1046248 - protein, 9 aa, Homo Sapiens
ESSNFPHPQ

SEQ ID NO: 1046249 - protein, 9 aa, Homo Sapiens
NEMVIKHPV

SEQ ID NO: 1046250 - protein, 9 aa, Homo Sapiens
SGLGSLTSH

SEQ ID NO: 1046251 - protein, 9 aa, Homo Sapiens
LLLRMAIQQ

SEQ ID NO: 1046252 - protein, 9 aa, Homo Sapiens
PLPPGGGNL

SEQ ID NO: 1046253 - protein, 9 aa, Homo Sapiens
CQNIFSVSR

SEQ ID NO: 1046254 - protein, 9 aa, Homo Sapiens
KVEGNFYSE

SEQ ID NO: 1046255 - protein, 9 aa, Homo Sapiens
IIIGCHAYG

SEQ ID NO: 1046256 - protein, 9 aa, Homo Sapiens
EGYETQWGD

SEQ ID NO: 1046257 - protein, 9 aa, Homo Sapiens
SSASVIMGN

SEQ ID NO: 1046258 - protein, 9 aa, Homo Sapiens
VILVSLQKH

SEQ ID NO: 1046259 - protein, 9 aa, Homo Sapiens
RLIYFLLSF

SEQ ID NO: 1046260 - protein, 9 aa, Homo Sapiens
LQSPIKLSA

SEQ ID NO: 1046261 - protein, 9 aa, Homo Sapiens
RKLCRQWLN

SEQ ID NO: 1046262 - protein, 9 aa, Homo Sapiens
KKLFAPVSF

SEQ ID NO: 1046263 - protein, 9 aa, Homo Sapiens
PAGNSVSYS

SEQ ID NO: 1046264 - protein, 9 aa, Homo Sapiens
QKTCYQIVK

SEQ ID NO: 1046265 - protein, 9 aa, Homo Sapiens
FLSGRLIYF

SEQ ID NO: 1046266 - protein, 9 aa, Homo Sapiens
ISKDLGLDS

SEQ ID NO: 1046267 - protein, 9 aa, Homo Sapiens
SGPPPNSPC

SEQ ID NO: 1046268 - protein, 9 aa, Homo Sapiens
SLCLKRCRS

SEQ ID NO: 1046269 - protein, 9 aa, Homo Sapiens
LRKNSELAT

SEQ ID NO: 1046270 - protein, 9 aa, Homo Sapiens
KGSPQLSDG

SEQ ID NO: 1046271 - protein, 9 aa, Homo Sapiens
FGWMKWLKN

SEQ ID NO: 1046272 - protein, 9 aa, Homo Sapiens
IELNIKNPD

SEQ ID NO: 1046273 - protein, 9 aa, Homo Sapiens
DLGLFFDDS

SEQ ID NO: 1046274 - protein, 9 aa, Homo Sapiens
RLKHISSFR

SEQ ID NO: 1046275 - protein, 9 aa, Homo Sapiens
GKPERPSKP

SEQ ID NO: 1046276 - protein, 9 aa, Homo Sapiens
ALAPPLARA

SEQ ID NO: 1046277 - protein, 9 aa, Homo Sapiens
HADKNGGFH

SEQ ID NO: 1046278 - protein, 9 aa, Homo Sapiens
ADCSATEMS

SEQ ID NO: 1046279 - protein, 9 aa, Homo Sapiens
HYTSIVLTS

SEQ ID NO: 1046280 - protein, 9 aa, Homo Sapiens
NSNSDLRND

SEQ ID NO: 1046281 - protein, 9 aa, Homo Sapiens
KTGYLSSVE

SEQ ID NO: 1046282 - protein, 9 aa, Homo Sapiens
RTRNHDDNK

SEQ ID NO: 1046283 - protein, 9 aa, Homo Sapiens
QSQTFSVQS

SEQ ID NO: 1046284 - protein, 9 aa, Homo Sapiens
VRLHSLYDN

SEQ ID NO: 1046285 - protein, 9 aa, Homo Sapiens
SQWRTRNHD

SEQ ID NO: 1046286 - protein, 9 aa, Homo Sapiens
QHKWSQLLS

SEQ ID NO: 1046287 - protein, 9 aa, Homo Sapiens
LVHLNEAES

SEQ ID NO: 1046288 - protein, 9 aa, Homo Sapiens
FSLSNPSLF

SEQ ID NO: 1046289 - protein, 9 aa, Homo Sapiens
QTSLDGPIK

SEQ ID NO: 1046290 - protein, 9 aa, Homo Sapiens
MKIRWFRSQ

SEQ ID NO: 1046291 - protein, 9 aa, Homo Sapiens
APPLARAVA

SEQ ID NO: 1046292 - protein, 9 aa, Homo Sapiens
RNEPPPPAK

SEQ ID NO: 1046293 - protein, 9 aa, Homo Sapiens
VGIGLWAWN

SEQ ID NO: 1046294 - protein, 9 aa, Homo Sapiens
IPGYKGHQG

SEQ ID NO: 1046295 - protein, 9 aa, Homo Sapiens
LYTDQHGGL

SEQ ID NO: 1046296 - protein, 9 aa, Homo Sapiens
DLILKLKDL

SEQ ID NO: 1046297 - protein, 9 aa, Homo Sapiens
IGLGIKNCV

SEQ ID NO: 1046298 - protein, 9 aa, Homo Sapiens
GSPLILYQF

SEQ ID NO: 1046299 - protein, 9 aa, Homo Sapiens
KRNEMVIKH

SEQ ID NO: 1046300 - protein, 9 aa, Homo Sapiens
SKLVLVTTS

SEQ ID NO: 1046301 - protein, 9 aa, Homo Sapiens
VIQKPITWD

SEQ ID NO: 1046302 - protein, 9 aa, Homo Sapiens
LRLIHYSVS

SEQ ID NO: 1046303 - protein, 9 aa, Homo Sapiens
LGLFFDDSY

SEQ ID NO: 1046304 - protein, 9 aa, Homo Sapiens
KLKDLRKEN

SEQ ID NO: 1046305 - protein, 9 aa, Homo Sapiens
IINWLLEFC

SEQ ID NO: 1046306 - protein, 9 aa, Homo Sapiens
QKSQSGLVW

SEQ ID NO: 1046307 - protein, 9 aa, Homo Sapiens
NERLSCTRE

SEQ ID NO: 1046308 - protein, 9 aa, Homo Sapiens
QCMQHLVSE

SEQ ID NO: 1046309 - protein, 9 aa, Homo Sapiens
MNNVLLSGE

SEQ ID NO: 1046310 - protein, 9 aa, Homo Sapiens
QLRWDRNEP

SEQ ID NO: 1046311 - protein, 9 aa, Homo Sapiens
IDRFCYNAN

SEQ ID NO: 1046312 - protein, 9 aa, Homo Sapiens
SPVSQRKRR

SEQ ID NO: 1046313 - protein, 9 aa, Homo Sapiens
FQQNLFHAD

SEQ ID NO: 1046314 - protein, 9 aa, Homo Sapiens
CWICIPCKP

SEQ ID NO: 1046315 - protein, 9 aa, Homo Sapiens
FLFKSWMSK

SEQ ID NO: 1046316 - protein, 9 aa, Homo Sapiens
SRSSSEERN

SEQ ID NO: 1046317 - protein, 9 aa, Homo Sapiens
KGTPLWRLQ

SEQ ID NO: 1046318 - protein, 9 aa, Homo Sapiens
LLQGRLNLG

SEQ ID NO: 1046319 - protein, 9 aa, Homo Sapiens
GFSYKQDPT

SEQ ID NO: 1046320 - protein, 9 aa, Homo Sapiens
GRGCSDPLY

SEQ ID NO: 1046321 - protein, 9 aa, Homo Sapiens
SYCSASWSS

SEQ ID NO: 1046322 - protein, 9 aa, Homo Sapiens
FKVGFIVGH

SEQ ID NO: 1046323 - protein, 9 aa, Homo Sapiens
TALVLWKPE

SEQ ID NO: 1046324 - protein, 9 aa, Homo Sapiens
CKEKAQALE

SEQ ID NO: 1046325 - protein, 9 aa, Homo Sapiens
AQPALAPPL

SEQ ID NO: 1046326 - protein, 9 aa, Homo Sapiens
LFLIKSFVK

SEQ ID NO: 1046327 - protein, 9 aa, Homo Sapiens
MVSSLCLKR

SEQ ID NO: 1046328 - protein, 9 aa, Homo Sapiens
LRLDLAGRK

SEQ ID NO: 1046329 - protein, 9 aa, Homo Sapiens
HVSDLGLFF

SEQ ID NO: 1046330 - protein, 9 aa, Homo Sapiens
QRNDGGLQF

SEQ ID NO: 1046331 - protein, 9 aa, Homo Sapiens
GLEEYSAMR

SEQ ID NO: 1046332 - protein, 9 aa, Homo Sapiens
LINDAFSLA

SEQ ID NO: 1046333 - protein, 9 aa, Homo Sapiens
FEDQITVYH

SEQ ID NO: 1046334 - protein, 9 aa, Homo Sapiens
QMKIRWFRS

SEQ ID NO: 1046335 - protein, 9 aa, Homo Sapiens
DYFVFANNR

SEQ ID NO: 1046336 - protein, 9 aa, Homo Sapiens
DDIMNDEDK

SEQ ID NO: 1046337 - protein, 9 aa, Homo Sapiens
EGPSVQPGL

SEQ ID NO: 1046338 - protein, 9 aa, Homo Sapiens
LLVSYNPRI

SEQ ID NO: 1046339 - protein, 9 aa, Homo Sapiens
SSLCLNLIP

SEQ ID NO: 1046340 - protein, 9 aa, Homo Sapiens
SGLITRSER

SEQ ID NO: 1046341 - protein, 9 aa, Homo Sapiens
SEKVGLKKR

SEQ ID NO: 1046342 - protein, 9 aa, Homo Sapiens
HSLYDNQIT

SEQ ID NO: 1046343 - protein, 9 aa, Homo Sapiens
GFIDKNNLR

SEQ ID NO: 1046344 - protein, 9 aa, Homo Sapiens
KPIIIGCHA

SEQ ID NO: 1046345 - protein, 9 aa, Homo Sapiens
RRMPPDAEA

SEQ ID NO: 1046346 - protein, 9 aa, Homo Sapiens
GQPPGDSSA

SEQ ID NO: 1046347 - protein, 9 aa, Homo Sapiens
PPPFSETQP

SEQ ID NO: 1046348 - protein, 9 aa, Homo Sapiens
QSRHRAEAL

SEQ ID NO: 1046349 - protein, 9 aa, Homo Sapiens
LMNFWPFGD

SEQ ID NO: 1046350 - protein, 9 aa, Homo Sapiens
LDSPQPFGG

SEQ ID NO: 1046351 - protein, 9 aa, Homo Sapiens
VLSQWRTRN

SEQ ID NO: 1046352 - protein, 9 aa, Homo Sapiens
ESKMRRREH

SEQ ID NO: 1046353 - protein, 9 aa, Homo Sapiens
DLRSFQSGD

SEQ ID NO: 1046354 - protein, 9 aa, Homo Sapiens
SSELVDSCT

SEQ ID NO: 1046355 - protein, 9 aa, Homo Sapiens
PKDSTTPLN

SEQ ID NO: 1046356 - protein, 9 aa, Homo Sapiens
EIWKYGLKA

SEQ ID NO: 1046357 - protein, 9 aa, Homo Sapiens
FLWMVTCIN

SEQ ID NO: 1046358 - protein, 9 aa, Homo Sapiens
FTHKKDLNG

SEQ ID NO: 1046359 - protein, 9 aa, Homo Sapiens
EVASSLIFR

SEQ ID NO: 1046360 - protein, 9 aa, Homo Sapiens
YQFFHEDVT

SEQ ID NO: 1046361 - protein, 9 aa, Homo Sapiens
YCDDIPCYE

SEQ ID NO: 1046362 - protein, 9 aa, Homo Sapiens
EAQMILQVP

SEQ ID NO: 1046363 - protein, 9 aa, Homo Sapiens
EKGVWCYVA

SEQ ID NO: 1046364 - protein, 9 aa, Homo Sapiens
RMYSSDAHK

SEQ ID NO: 1046365 - protein, 9 aa, Homo Sapiens
KYGLKAESE

SEQ ID NO: 1046366 - protein, 9 aa, Homo Sapiens
GDNPLLLPR

SEQ ID NO: 1046367 - protein, 9 aa, Homo Sapiens
APIITGFSD

SEQ ID NO: 1046368 - protein, 9 aa, Homo Sapiens
LGLQLDQKA

SEQ ID NO: 1046369 - protein, 9 aa, Homo Sapiens
SAPTAEKAS

SEQ ID NO: 1046370 - protein, 9 aa, Homo Sapiens
TQLSPYAVY

SEQ ID NO: 1046371 - protein, 9 aa, Homo Sapiens
ARHLYLCDY

SEQ ID NO: 1046372 - protein, 9 aa, Homo Sapiens
REALSQLRK

SEQ ID NO: 1046373 - protein, 9 aa, Homo Sapiens
VRTEQDKTG

SEQ ID NO: 1046374 - protein, 9 aa, Homo Sapiens
PPPVHPSER

SEQ ID NO: 1046375 - protein, 9 aa, Homo Sapiens
YSVSAGITD

SEQ ID NO: 1046376 - protein, 9 aa, Homo Sapiens
WVIWWNLQK

SEQ ID NO: 1046377 - protein, 9 aa, Homo Sapiens
QKKVQKEYG

SEQ ID NO: 1046378 - protein, 9 aa, Homo Sapiens
TPRPEDRGC

SEQ ID NO: 1046379 - protein, 9 aa, Homo Sapiens
PINISDIAE

SEQ ID NO: 1046380 - protein, 9 aa, Homo Sapiens
LTESSNFPH

SEQ ID NO: 1046381 - protein, 9 aa, Homo Sapiens
KPPPVYTNL

SEQ ID NO: 1046382 - protein, 9 aa, Homo Sapiens
PHLNLPLRP

SEQ ID NO: 1046383 - protein, 9 aa, Homo Sapiens
GSVVVTYKV

SEQ ID NO: 1046384 - protein, 9 aa, Homo Sapiens
GPGHPLSGQ

SEQ ID NO: 1046385 - protein, 9 aa, Homo Sapiens
CMQHLVSEE

SEQ ID NO: 1046386 - protein, 9 aa, Homo Sapiens
VILGEAQDA

SEQ ID NO: 1046387 - protein, 9 aa, Homo Sapiens
LNLGTGVVP

SEQ ID NO: 1046388 - protein, 9 aa, Homo Sapiens
KLSTANSVI

SEQ ID NO: 1046389 - protein, 9 aa, Homo Sapiens
ACLTESSNF

SEQ ID NO: 1046390 - protein, 9 aa, Homo Sapiens
ENEGHGGFL

SEQ ID NO: 1046391 - protein, 9 aa, Homo Sapiens
GLITRSERI

SEQ ID NO: 1046392 - protein, 9 aa, Homo Sapiens
WMKWLKNDS

SEQ ID NO: 1046393 - protein, 9 aa, Homo Sapiens
NFFRIEYDT

SEQ ID NO: 1046394 - protein, 9 aa, Homo Sapiens
GIGLPAKTT

SEQ ID NO: 1046395 - protein, 9 aa, Homo Sapiens
SSAAFQGKD

SEQ ID NO: 1046396 - protein, 9 aa, Homo Sapiens
GPKPPPVYT

SEQ ID NO: 1046397 - protein, 9 aa, Homo Sapiens
IPEGFADGE

SEQ ID NO: 1046398 - protein, 9 aa, Homo Sapiens
ASLVTGLSE

SEQ ID NO: 1046399 - protein, 9 aa, Homo Sapiens
EKVFQFPSQ

SEQ ID NO: 1046400 - protein, 9 aa, Homo Sapiens
MQPTTMPYP

SEQ ID NO: 1046401 - protein, 9 aa, Homo Sapiens
ASIIFSNFL

SEQ ID NO: 1046402 - protein, 9 aa, Homo Sapiens
LEQKEGQEM

SEQ ID NO: 1046403 - protein, 9 aa, Homo Sapiens
GTQLSPYAV

SEQ ID NO: 1046404 - protein, 9 aa, Homo Sapiens
PTEAFAREV

SEQ ID NO: 1046405 - protein, 9 aa, Homo Sapiens
LRTMNNKEL

SEQ ID NO: 1046406 - protein, 9 aa, Homo Sapiens
LQNGHLRFS

SEQ ID NO: 1046407 - protein, 9 aa, Homo Sapiens
LYQFFHEDV

SEQ ID NO: 1046408 - protein, 9 aa, Homo Sapiens
SLRAISRTN

SEQ ID NO: 1046409 - protein, 9 aa, Homo Sapiens
EIHSAIIKF

SEQ ID NO: 1046410 - protein, 9 aa, Homo Sapiens
WNLQKTCYQ

SEQ ID NO: 1046411 - protein, 9 aa, Homo Sapiens
EDSRAPCTY

SEQ ID NO: 1046412 - protein, 9 aa, Homo Sapiens
PFLLVGLIG

SEQ ID NO: 1046413 - protein, 9 aa, Homo Sapiens
VQKPCQPGC

SEQ ID NO: 1046414 - protein, 9 aa, Homo Sapiens
LQLRWDRNE

SEQ ID NO: 1046415 - protein, 9 aa, Homo Sapiens
VAGSVLVLE

SEQ ID NO: 1046416 - protein, 9 aa, Homo Sapiens
KPERPSKPG

SEQ ID NO: 1046417 - protein, 9 aa, Homo Sapiens
GFCGPLSPG

SEQ ID NO: 1046418 - protein, 9 aa, Homo Sapiens
LILYQFFHE

SEQ ID NO: 1046419 - protein, 9 aa, Homo Sapiens
DKWSRMFFS

SEQ ID NO: 1046420 - protein, 9 aa, Homo Sapiens
QTCKEKAQA

SEQ ID NO: 1046421 - protein, 9 aa, Homo Sapiens
QINDFAYKI

SEQ ID NO: 1046422 - protein, 9 aa, Homo Sapiens
TAEKASIFG

SEQ ID NO: 1046423 - protein, 9 aa, Homo Sapiens
ASAQFASPQ

SEQ ID NO: 1046424 - protein, 9 aa, Homo Sapiens
NSQENCNYL

SEQ ID NO: 1046425 - protein, 9 aa, Homo Sapiens
KQDPTLRDP

SEQ ID NO: 1046426 - protein, 9 aa, Homo Sapiens
LEQVSGIIE

SEQ ID NO: 1046427 - protein, 9 aa, Homo Sapiens
LVLEAIIGD

SEQ ID NO: 1046428 - protein, 9 aa, Homo Sapiens
EMKEIVLRD

SEQ ID NO: 1046429 - protein, 9 aa, Homo Sapiens
PNSPCPGPP

SEQ ID NO: 1046430 - protein, 9 aa, Homo Sapiens
KSPLPPGGG

SEQ ID NO: 1046431 - protein, 9 aa, Homo Sapiens
MEVSDQRNC

SEQ ID NO: 1046432 - protein, 9 aa, Homo Sapiens
EGTRVELVQ

SEQ ID NO: 1046433 - protein, 9 aa, Homo Sapiens
SSTQLPREV

SEQ ID NO: 1046434 - protein, 9 aa, Homo Sapiens
DFDRDGNHF

SEQ ID NO: 1046435 - protein, 9 aa, Homo Sapiens
QKGSNALCH

SEQ ID NO: 1046436 - protein, 9 aa, Homo Sapiens
QISQKISAH

SEQ ID NO: 1046437 - protein, 9 aa, Homo Sapiens
AYIISFLYG

SEQ ID NO: 1046438 - protein, 9 aa, Homo Sapiens
LNTDASLVT

SEQ ID NO: 1046439 - protein, 9 aa, Homo Sapiens
KERRRGRKK

SEQ ID NO: 1046440 - protein, 9 aa, Homo Sapiens
SLEAMYMQC

SEQ ID NO: 1046441 - protein, 9 aa, Homo Sapiens
QSSSSTQLP

SEQ ID NO: 1046442 - protein, 9 aa, Homo Sapiens
PSVLGKYQA

SEQ ID NO: 1046443 - protein, 9 aa, Homo Sapiens
GEKWKHGGD

SEQ ID NO: 1046444 - protein, 9 aa, Homo Sapiens
QDQMREVKR

SEQ ID NO: 1046445 - protein, 9 aa, Homo Sapiens
SRPCSLAVR

SEQ ID NO: 1046446 - protein, 9 aa, Homo Sapiens
GAPSLMMPN

SEQ ID NO: 1046447 - protein, 9 aa, Homo Sapiens
AATALPPTP

SEQ ID NO: 1046448 - protein, 9 aa, Homo Sapiens
PGAICVQKP

SEQ ID NO: 1046449 - protein, 9 aa, Homo Sapiens
ENKDLRARA

SEQ ID NO: 1046450 - protein, 9 aa, Homo Sapiens
GITFVGIGL

SEQ ID NO: 1046451 - protein, 9 aa, Homo Sapiens
DRSQWLNKK

SEQ ID NO: 1046452 - protein, 9 aa, Homo Sapiens
CYNANRASQ

SEQ ID NO: 1046453 - protein, 9 aa, Homo Sapiens
HSFNLLRRL

SEQ ID NO: 1046454 - protein, 9 aa, Homo Sapiens
PQGASAFLT

SEQ ID NO: 1046455 - protein, 9 aa, Homo Sapiens
ALGKLKVEG

SEQ ID NO: 1046456 - protein, 9 aa, Homo Sapiens
SDLKMKREA

SEQ ID NO: 1046457 - protein, 9 aa, Homo Sapiens
HKLEPPVAG

SEQ ID NO: 1046458 - protein, 9 aa, Homo Sapiens
QKAGEPWCI

SEQ ID NO: 1046459 - protein, 9 aa, Homo Sapiens
VRKICSDLQ

SEQ ID NO: 1046460 - protein, 9 aa, Homo Sapiens
HLTQDQMRE

SEQ ID NO: 1046461 - protein, 9 aa, Homo Sapiens
QDKTGKWNE

SEQ ID NO: 1046462 - protein, 9 aa, Homo Sapiens
SPQNGIPAE

SEQ ID NO: 1046463 - protein, 9 aa, Homo Sapiens
KKVQKEYGK

SEQ ID NO: 1046464 - protein, 9 aa, Homo Sapiens
MFFSITFSL

SEQ ID NO: 1046465 - protein, 9 aa, Homo Sapiens
RFGIHAPHV

SEQ ID NO: 1046466 - protein, 9 aa, Homo Sapiens
IKRNEMVIK

SEQ ID NO: 1046467 - protein, 9 aa, Homo Sapiens
TMLRALGIP

SEQ ID NO: 1046468 - protein, 9 aa, Homo Sapiens
QFFHEDVTL

SEQ ID NO: 1046469 - protein, 9 aa, Homo Sapiens
IDTTINKII

SEQ ID NO: 1046470 - protein, 9 aa, Homo Sapiens
VKKKMILAK

SEQ ID NO: 1046471 - protein, 9 aa, Homo Sapiens
QTSDSQHKW

SEQ ID NO: 1046472 - protein, 9 aa, Homo Sapiens
LKKNSSYFL

SEQ ID NO: 1046473 - protein, 9 aa, Homo Sapiens
LSPGTGGPF

SEQ ID NO: 1046474 - protein, 9 aa, Homo Sapiens
LPREVGTSN

SEQ ID NO: 1046475 - protein, 9 aa, Homo Sapiens
AFAREVRFP

SEQ ID NO: 1046476 - protein, 9 aa, Homo Sapiens
VCWSPLLII

SEQ ID NO: 1046477 - protein, 9 aa, Homo Sapiens
WQQKLSTAN

SEQ ID NO: 1046478 - protein, 9 aa, Homo Sapiens
SHTDVLLYT

SEQ ID NO: 1046479 - protein, 9 aa, Homo Sapiens
STFEDNESC

SEQ ID NO: 1046480 - protein, 9 aa, Homo Sapiens
RRLATWLKE

SEQ ID NO: 1046481 - protein, 9 aa, Homo Sapiens
WRLQQVEKK

SEQ ID NO: 1046482 - protein, 9 aa, Homo Sapiens
QGPGHPLSG

SEQ ID NO: 1046483 - protein, 9 aa, Homo Sapiens
RVQGQARRE

SEQ ID NO: 1046484 - protein, 9 aa, Homo Sapiens
CMVPFRSGH

SEQ ID NO: 1046485 - protein, 9 aa, Homo Sapiens
FIHRFGIHA

SEQ ID NO: 1046486 - protein, 9 aa, Homo Sapiens
DRNEPPPPA

SEQ ID NO: 1046487 - protein, 9 aa, Homo Sapiens
SNSEALCSA

SEQ ID NO: 1046488 - protein, 9 aa, Homo Sapiens
RNDGGLQFS

SEQ ID NO: 1046489 - protein, 9 aa, Homo Sapiens
FLDVSGRKH

SEQ ID NO: 1046490 - protein, 9 aa, Homo Sapiens
SPRQLSGED

SEQ ID NO: 1046491 - protein, 9 aa, Homo Sapiens
DYDDSAMKT

SEQ ID NO: 1046492 - protein, 9 aa, Homo Sapiens
LAELVIRLR

SEQ ID NO: 1046493 - protein, 9 aa, Homo Sapiens
RGCSDPLYP

SEQ ID NO: 1046494 - protein, 9 aa, Homo Sapiens
VVTLFFGSC

SEQ ID NO: 1046495 - protein, 9 aa, Homo Sapiens
TGPQCQTNT

SEQ ID NO: 1046496 - protein, 9 aa, Homo Sapiens
QMILQVPAM

SEQ ID NO: 1046497 - protein, 9 aa, Homo Sapiens
IPPLFLIKS

SEQ ID NO: 1046498 - protein, 9 aa, Homo Sapiens
GEGASEKIE

SEQ ID NO: 1046499 - protein, 9 aa, Homo Sapiens
PIITGFSDD

SEQ ID NO: 1046500 - protein, 9 aa, Homo Sapiens
RSGLITRSE

SEQ ID NO: 1046501 - protein, 9 aa, Homo Sapiens
KNPDDRRRL

SEQ ID NO: 1046502 - protein, 9 aa, Homo Sapiens
YEYGESFIY

SEQ ID NO: 1046503 - protein, 9 aa, Homo Sapiens
RNGGQCQDN

SEQ ID NO: 1046504 - protein, 9 aa, Homo Sapiens
RKLPDYLMK

SEQ ID NO: 1046505 - protein, 9 aa, Homo Sapiens
VVSQSGPST

SEQ ID NO: 1046506 - protein, 9 aa, Homo Sapiens
VRFPGQNTL

SEQ ID NO: 1046507 - protein, 9 aa, Homo Sapiens
KPITKSLAQ

SEQ ID NO: 1046508 - protein, 9 aa, Homo Sapiens
RNPDGDEKG

SEQ ID NO: 1046509 - protein, 9 aa, Homo Sapiens
VGSSMRSLR

SEQ ID NO: 1046510 - protein, 9 aa, Homo Sapiens
NNMENTLKS

SEQ ID NO: 1046511 - protein, 9 aa, Homo Sapiens
RNQVKKKMI

SEQ ID NO: 1046512 - protein, 9 aa, Homo Sapiens
EDEKKTLNL

SEQ ID NO: 1046513 - protein, 9 aa, Homo Sapiens
VLQKKVQKE

SEQ ID NO: 1046514 - protein, 9 aa, Homo Sapiens
SILVLRDSF

SEQ ID NO: 1046515 - protein, 9 aa, Homo Sapiens
YILDLASRR

SEQ ID NO: 1046516 - protein, 9 aa, Homo Sapiens
KAGEPWCIE

SEQ ID NO: 1046517 - protein, 9 aa, Homo Sapiens
PWLHSLAVA

SEQ ID NO: 1046518 - protein, 9 aa, Homo Sapiens
GNGPPQMRP

SEQ ID NO: 1046519 - protein, 9 aa, Homo Sapiens
FKTLFKVGF

SEQ ID NO: 1046520 - protein, 9 aa, Homo Sapiens
EFESKMRRR

SEQ ID NO: 1046521 - protein, 9 aa, Homo Sapiens
ERILSEKEY

SEQ ID NO: 1046522 - protein, 9 aa, Homo Sapiens
SQSGPSTPH

SEQ ID NO: 1046523 - protein, 9 aa, Homo Sapiens
KTKPESLKG

SEQ ID NO: 1046524 - protein, 9 aa, Homo Sapiens
ASAFLTTIN

SEQ ID NO: 1046525 - protein, 9 aa, Homo Sapiens
KFIPHLESE

SEQ ID NO: 1046526 - protein, 9 aa, Homo Sapiens
ESILMKKNV

SEQ ID NO: 1046527 - protein, 9 aa, Homo Sapiens
YLQPKNSYA

SEQ ID NO: 1046528 - protein, 9 aa, Homo Sapiens
DNETVFNYF

SEQ ID NO: 1046529 - protein, 9 aa, Homo Sapiens
LVLVTTSVG

SEQ ID NO: 1046530 - protein, 9 aa, Homo Sapiens
SSFRQSLRL

SEQ ID NO: 1046531 - protein, 9 aa, Homo Sapiens
SPGVPPPQF

SEQ ID NO: 1046532 - protein, 9 aa, Homo Sapiens
VHLNEAESG

SEQ ID NO: 1046533 - protein, 9 aa, Homo Sapiens
RLNLGTGVV

SEQ ID NO: 1046534 - protein, 9 aa, Homo Sapiens
SEALCSASY

SEQ ID NO: 1046535 - protein, 9 aa, Homo Sapiens
YGESFIYSV

SEQ ID NO: 1046536 - protein, 9 aa, Homo Sapiens
FGNLSSASV

SEQ ID NO: 1046537 - protein, 9 aa, Homo Sapiens
EAFAREVRF

SEQ ID NO: 1046538 - protein, 9 aa, Homo Sapiens
EDDEDAPII

SEQ ID NO: 1046539 - protein, 9 aa, Homo Sapiens
SPKNPCIPK

SEQ ID NO: 1046540 - protein, 9 aa, Homo Sapiens
EASFQASGL

SEQ ID NO: 1046541 - protein, 9 aa, Homo Sapiens
GDYDDSAMK

SEQ ID NO: 1046542 - protein, 9 aa, Homo Sapiens
LVTGLSETP

SEQ ID NO: 1046543 - protein, 9 aa, Homo Sapiens
RWIIRALHL

SEQ ID NO: 1046544 - protein, 9 aa, Homo Sapiens
TRSELKLSP

SEQ ID NO: 1046545 - protein, 9 aa, Homo Sapiens
ILVSLQKHS

SEQ ID NO: 1046546 - protein, 9 aa, Homo Sapiens
AAKALFTDP

SEQ ID NO: 1046547 - protein, 9 aa, Homo Sapiens
EINYLCLSP

SEQ ID NO: 1046548 - protein, 9 aa, Homo Sapiens
LARAVAIET

SEQ ID NO: 1046549 - protein, 9 aa, Homo Sapiens
RSGHPEGPP

SEQ ID NO: 1046550 - protein, 9 aa, Homo Sapiens
VKPIIIGCH

SEQ ID NO: 1046551 - protein, 9 aa, Homo Sapiens
NTDASLVTG

SEQ ID NO: 1046552 - protein, 9 aa, Homo Sapiens
KKKFNVSKK

SEQ ID NO: 1046553 - protein, 9 aa, Homo Sapiens
IFTLFLNPV

SEQ ID NO: 1046554 - protein, 9 aa, Homo Sapiens
KVFQFPSQV

SEQ ID NO: 1046555 - protein, 9 aa, Homo Sapiens
QNLKKNSSY

SEQ ID NO: 1046556 - protein, 9 aa, Homo Sapiens
EDQSPRQLS

SEQ ID NO: 1046557 - protein, 9 aa, Homo Sapiens
CVIQKPITW

SEQ ID NO: 1046558 - protein, 9 aa, Homo Sapiens
SQSGLVWRH

SEQ ID NO: 1046559 - protein, 9 aa, Homo Sapiens
NHQPPQLKA

SEQ ID NO: 1046560 - protein, 9 aa, Homo Sapiens
KEKTVSEAL

SEQ ID NO: 1046561 - protein, 9 aa, Homo Sapiens
HSKKFQGVK

SEQ ID NO: 1046562 - protein, 9 aa, Homo Sapiens
TMQPTTMPY

SEQ ID NO: 1046563 - protein, 9 aa, Homo Sapiens
GQFSTLKLK

SEQ ID NO: 1046564 - protein, 9 aa, Homo Sapiens
RMFFSITFS

SEQ ID NO: 1046565 - protein, 9 aa, Homo Sapiens
TPFLCIVLF

SEQ ID NO: 1046566 - protein, 9 aa, Homo Sapiens
NKELVRKPQ

SEQ ID NO: 1046567 - protein, 9 aa, Homo Sapiens
LTQDQMREV

SEQ ID NO: 1046568 - protein, 9 aa, Homo Sapiens
KWSRMFFSI

SEQ ID NO: 1046569 - protein, 9 aa, Homo Sapiens
AESGYHSLC

SEQ ID NO: 1046570 - protein, 9 aa, Homo Sapiens
FHAEIDWER

SEQ ID NO: 1046571 - protein, 9 aa, Homo Sapiens
HRFGIHAPH

SEQ ID NO: 1046572 - protein, 9 aa, Homo Sapiens
SSDAHKRPP

SEQ ID NO: 1046573 - protein, 9 aa, Homo Sapiens
FHLNNKSCR

SEQ ID NO: 1046574 - protein, 9 aa, Homo Sapiens
PSYCSASWS

SEQ ID NO: 1046575 - protein, 9 aa, Homo Sapiens
LNCMVPFRS

SEQ ID NO: 1046576 - protein, 9 aa, Homo Sapiens
PLKSHKLEP

SEQ ID NO: 1046577 - protein, 9 aa, Homo Sapiens
LVFLDVSGR

SEQ ID NO: 1046578 - protein, 9 aa, Homo Sapiens
NTDYCVSAP

SEQ ID NO: 1046579 - protein, 9 aa, Homo Sapiens
LFTHKKDLN

SEQ ID NO: 1046580 - protein, 9 aa, Homo Sapiens
DEIEWQVKS

SEQ ID NO: 1046581 - protein, 9 aa, Homo Sapiens
PLARAVAIE

SEQ ID NO: 1046582 - protein, 9 aa, Homo Sapiens
MKFQKQIQE

SEQ ID NO: 1046583 - protein, 9 aa, Homo Sapiens
RFSGIKTYI

SEQ ID NO: 1046584 - protein, 9 aa, Homo Sapiens
MVARFIPFH

SEQ ID NO: 1046585 - protein, 9 aa, Homo Sapiens
MQLGRKHRT

SEQ ID NO: 1046586 - protein, 9 aa, Homo Sapiens
SGSVVVTYK

SEQ ID NO: 1046587 - protein, 9 aa, Homo Sapiens
IYLSGWKGS

SEQ ID NO: 1046588 - protein, 9 aa, Homo Sapiens
SDQRNCGYP

SEQ ID NO: 1046589 - protein, 9 aa, Homo Sapiens
YAGPKPPPV

SEQ ID NO: 1046590 - protein, 9 aa, Homo Sapiens
LEGRRGIFL

SEQ ID NO: 1046591 - protein, 9 aa, Homo Sapiens
PEGFADGEP

SEQ ID NO: 1046592 - protein, 9 aa, Homo Sapiens
LNHVPSAAA

SEQ ID NO: 1046593 - protein, 9 aa, Homo Sapiens
LLFIITLPL

SEQ ID NO: 1046594 - protein, 9 aa, Homo Sapiens
MVIKHPVMC

SEQ ID NO: 1046595 - protein, 9 aa, Homo Sapiens
LKGCESAVD

SEQ ID NO: 1046596 - protein, 9 aa, Homo Sapiens
CQDNQGFAL

SEQ ID NO: 1046597 - protein, 9 aa, Homo Sapiens
NEIKTLRKN

SEQ ID NO: 1046598 - protein, 9 aa, Homo Sapiens
AHKRPPSPS

SEQ ID NO: 1046599 - protein, 9 aa, Homo Sapiens
PGSPFHSPL

SEQ ID NO: 1046600 - protein, 9 aa, Homo Sapiens
DRVQEEAHY

SEQ ID NO: 1046601 - protein, 9 aa, Homo Sapiens
TIPNEDTYC

SEQ ID NO: 1046602 - protein, 9 aa, Homo Sapiens
ALFTDPAAP

SEQ ID NO: 1046603 - protein, 9 aa, Homo Sapiens
REVRFPGQN

SEQ ID NO: 1046604 - protein, 9 aa, Homo Sapiens
NNQHIKILC

SEQ ID NO: 1046605 - protein, 9 aa, Homo Sapiens
LKDLRKENE

SEQ ID NO: 1046606 - protein, 9 aa, Homo Sapiens
LKSTHPHFV

SEQ ID NO: 1046607 - protein, 9 aa, Homo Sapiens
EINNMENTL

SEQ ID NO: 1046608 - protein, 9 aa, Homo Sapiens
GSPQLSDGL

SEQ ID NO: 1046609 - protein, 9 aa, Homo Sapiens
ENSPVSQRK

SEQ ID NO: 1046610 - protein, 9 aa, Homo Sapiens
ILEQKEGQE

SEQ ID NO: 1046611 - protein, 9 aa, Homo Sapiens
PLLLPRCSI

SEQ ID NO: 1046612 - protein, 9 aa, Homo Sapiens
SAGITDQGE

SEQ ID NO: 1046613 - protein, 9 aa, Homo Sapiens
RANSQENCN

SEQ ID NO: 1046614 - protein, 9 aa, Homo Sapiens
SWGRGCSDP

SEQ ID NO: 1046615 - protein, 9 aa, Homo Sapiens
TLNLLLRMA

SEQ ID NO: 1046616 - protein, 9 aa, Homo Sapiens
GIIENLRHM

SEQ ID NO: 1046617 - protein, 9 aa, Homo Sapiens
QKQGMEKEE

SEQ ID NO: 1046618 - protein, 9 aa, Homo Sapiens
NDKIYHFYC

SEQ ID NO: 1046619 - protein, 9 aa, Homo Sapiens
RNHSRSRSP

SEQ ID NO: 1046620 - protein, 9 aa, Homo Sapiens
EHNDYICPA

SEQ ID NO: 1046621 - protein, 9 aa, Homo Sapiens
RKKGEEDQN

SEQ ID NO: 1046622 - protein, 9 aa, Homo Sapiens
SCISTGIYG

SEQ ID NO: 1046623 - protein, 9 aa, Homo Sapiens
VSHKIMHHQ

SEQ ID NO: 1046624 - protein, 9 aa, Homo Sapiens
MDRAILEQK

SEQ ID NO: 1046625 - protein, 9 aa, Homo Sapiens
TYKVKTTPP

SEQ ID NO: 1046626 - protein, 9 aa, Homo Sapiens
VLFAAGTFQ

SEQ ID NO: 1046627 - protein, 9 aa, Homo Sapiens
ILPNLVFLD

SEQ ID NO: 1046628 - protein, 9 aa, Homo Sapiens
SNFPHPQQS

SEQ ID NO: 1046629 - protein, 9 aa, Homo Sapiens
SASVIMGNP

SEQ ID NO: 1046630 - protein, 9 aa, Homo Sapiens
HVTYILDLA

SEQ ID NO: 1046631 - protein, 9 aa, Homo Sapiens
ILLQKQGME

SEQ ID NO: 1046632 - protein, 9 aa, Homo Sapiens
ALVLWKPED

SEQ ID NO: 1046633 - protein, 9 aa, Homo Sapiens
DPCLRQMFC

SEQ ID NO: 1046634 - protein, 9 aa, Homo Sapiens
DYRPVFVQE

SEQ ID NO: 1046635 - protein, 9 aa, Homo Sapiens
CSASWSSDS

SEQ ID NO: 1046636 - protein, 9 aa, Homo Sapiens
ASILVLRDS

SEQ ID NO: 1046637 - protein, 9 aa, Homo Sapiens
YLQCMQHLV

SEQ ID NO: 1046638 - protein, 9 aa, Homo Sapiens
AYKIKPLAF

SEQ ID NO: 1046639 - protein, 9 aa, Homo Sapiens
NYLPGEHLR

SEQ ID NO: 1046640 - protein, 9 aa, Homo Sapiens
RSRWLGTQL

SEQ ID NO: 1046641 - protein, 9 aa, Homo Sapiens
GTSGDYDDS

SEQ ID NO: 1046642 - protein, 9 aa, Homo Sapiens
GKMIFYLKS

SEQ ID NO: 1046643 - protein, 9 aa, Homo Sapiens
VFQFPSQVQ

SEQ ID NO: 1046644 - protein, 9 aa, Homo Sapiens
QLDQKALTT

SEQ ID NO: 1046645 - protein, 9 aa, Homo Sapiens
IRPCYSPHG

SEQ ID NO: 1046646 - protein, 9 aa, Homo Sapiens
HMVSSLCLK

SEQ ID NO: 1046647 - protein, 9 aa, Homo Sapiens
RLYQRRRWI

SEQ ID NO: 1046648 - protein, 9 aa, Homo Sapiens
SLLENSPVL

SEQ ID NO: 1046649 - protein, 9 aa, Homo Sapiens
DLSSELVDS

SEQ ID NO: 1046650 - protein, 9 aa, Homo Sapiens
LNEAESGYH

SEQ ID NO: 1046651 - protein, 9 aa, Homo Sapiens
PGFCGPLSP

SEQ ID NO: 1046652 - protein, 9 aa, Homo Sapiens
WSVLPGEQQ

SEQ ID NO: 1046653 - protein, 9 aa, Homo Sapiens
FTHYKPHLN

SEQ ID NO: 1046654 - protein, 9 aa, Homo Sapiens
EVEKTMFKK

SEQ ID NO: 1046655 - protein, 9 aa, Homo Sapiens
PLSPGVPPP

SEQ ID NO: 1046656 - protein, 9 aa, Homo Sapiens
QKLSTANSV

SEQ ID NO: 1046657 - protein, 9 aa, Homo Sapiens
KVGFIVGHY

SEQ ID NO: 1046658 - protein, 9 aa, Homo Sapiens
EKKTLNLLL

SEQ ID NO: 1046659 - protein, 9 aa, Homo Sapiens
GEPGIPGYK

SEQ ID NO: 1046660 - protein, 9 aa, Homo Sapiens
GTEINYLCL

SEQ ID NO: 1046661 - protein, 9 aa, Homo Sapiens
PYASAQFAS

SEQ ID NO: 1046662 - protein, 9 aa, Homo Sapiens
EAESGYHSL

SEQ ID NO: 1046663 - protein, 9 aa, Homo Sapiens
QVPVESLRA

SEQ ID NO: 1046664 - protein, 9 aa, Homo Sapiens
ISNHKETKE

SEQ ID NO: 1046665 - protein, 9 aa, Homo Sapiens
LPRCSIFSQ

SEQ ID NO: 1046666 - protein, 9 aa, Homo Sapiens
HTIEVNRCR

SEQ ID NO: 1046667 - protein, 9 aa, Homo Sapiens
GDMDLQISL

SEQ ID NO: 1046668 - protein, 9 aa, Homo Sapiens
VSWNSITLQ

SEQ ID NO: 1046669 - protein, 9 aa, Homo Sapiens
SEIIQFYLE

SEQ ID NO: 1046670 - protein, 9 aa, Homo Sapiens
SNRRLQTCK

SEQ ID NO: 1046671 - protein, 9 aa, Homo Sapiens
FPMNNCPIV

SEQ ID NO: 1046672 - protein, 9 aa, Homo Sapiens
SVSAGITDQ

SEQ ID NO: 1046673 - protein, 9 aa, Homo Sapiens
CPHVSDLGL

SEQ ID NO: 1046674 - protein, 9 aa, Homo Sapiens
YSWRSSGRG

SEQ ID NO: 1046675 - protein, 9 aa, Homo Sapiens
LSQLRKLCR

SEQ ID NO: 1046676 - protein, 9 aa, Homo Sapiens
RIHTGKRPF

SEQ ID NO: 1046677 - protein, 9 aa, Homo Sapiens
SEKIEETMS

SEQ ID NO: 1046678 - protein, 9 aa, Homo Sapiens
GFWYRMSNH

SEQ ID NO: 1046679 - protein, 9 aa, Homo Sapiens
MNDEDKIED

SEQ ID NO: 1046680 - protein, 9 aa, Homo Sapiens
KDILPNLVF

SEQ ID NO: 1046681 - protein, 9 aa, Homo Sapiens
MQHLVSEEQ

SEQ ID NO: 1046682 - protein, 9 aa, Homo Sapiens
QTTGRLEGS

SEQ ID NO: 1046683 - protein, 9 aa, Homo Sapiens
NQVKKKMIL

SEQ ID NO: 1046684 - protein, 9 aa, Homo Sapiens
KEEVTEAIR

SEQ ID NO: 1046685 - protein, 9 aa, Homo Sapiens
PEMKEIVLR

SEQ ID NO: 1046686 - protein, 9 aa, Homo Sapiens
LNRLLVSYN

SEQ ID NO: 1046687 - protein, 9 aa, Homo Sapiens
DTSRVQGQA

SEQ ID NO: 1046688 - protein, 9 aa, Homo Sapiens
AEFTHYKPH

SEQ ID NO: 1046689 - protein, 9 aa, Homo Sapiens
FKFQGIKKK

SEQ ID NO: 1046690 - protein, 9 aa, Homo Sapiens
SVIMGNPKV

SEQ ID NO: 1046691 - protein, 9 aa, Homo Sapiens
LLTTLSGGS

SEQ ID NO: 1046692 - protein, 9 aa, Homo Sapiens
YFLLSFISI

SEQ ID NO: 1046693 - protein, 9 aa, Homo Sapiens
ISAIKDRQE

SEQ ID NO: 1046694 - protein, 9 aa, Homo Sapiens
ATGTACLPF

SEQ ID NO: 1046695 - protein, 9 aa, Homo Sapiens
LECEEEGFS

SEQ ID NO: 1046696 - protein, 9 aa, Homo Sapiens
SVRLHSLYD

SEQ ID NO: 1046697 - protein, 9 aa, Homo Sapiens
DEKGVWCYV

SEQ ID NO: 1046698 - protein, 9 aa, Homo Sapiens
LKALGNQQP

SEQ ID NO: 1046699 - protein, 9 aa, Homo Sapiens
SGWKGSPQL

SEQ ID NO: 1046700 - protein, 9 aa, Homo Sapiens
ISFFALPAA

SEQ ID NO: 1046701 - protein, 9 aa, Homo Sapiens
QKPCQPGCG

SEQ ID NO: 1046702 - protein, 9 aa, Homo Sapiens
LPVILRLFL

SEQ ID NO: 1046703 - protein, 9 aa, Homo Sapiens
YTWKKIMQL

SEQ ID NO: 1046704 - protein, 9 aa, Homo Sapiens
IISFLYGQC

SEQ ID NO: 1046705 - protein, 9 aa, Homo Sapiens
PIKQQESDD

SEQ ID NO: 1046706 - protein, 9 aa, Homo Sapiens
QPPQLKALG

SEQ ID NO: 1046707 - protein, 9 aa, Homo Sapiens
SPEGTRVEL

SEQ ID NO: 1046708 - protein, 9 aa, Homo Sapiens
PGIPGYKGH

SEQ ID NO: 1046709 - protein, 9 aa, Homo Sapiens
NKTGYLSSV

SEQ ID NO: 1046710 - protein, 9 aa, Homo Sapiens
RSAAHTMSR

SEQ ID NO: 1046711 - protein, 9 aa, Homo Sapiens
HLNEAESGY

SEQ ID NO: 1046712 - protein, 9 aa, Homo Sapiens
GPSVQPGLL

SEQ ID NO: 1046713 - protein, 9 aa, Homo Sapiens
GLLRQKAKF

SEQ ID NO: 1046714 - protein, 9 aa, Homo Sapiens
SQHKWSQLL

SEQ ID NO: 1046715 - protein, 9 aa, Homo Sapiens
MREASQNVI

SEQ ID NO: 1046716 - protein, 9 aa, Homo Sapiens
QPGLLRPME

SEQ ID NO: 1046717 - protein, 9 aa, Homo Sapiens
IKYLKKSLK

SEQ ID NO: 1046718 - protein, 9 aa, Homo Sapiens
SWCDQVLWK

SEQ ID NO: 1046719 - protein, 9 aa, Homo Sapiens
SPQGASAFL

SEQ ID NO: 1046720 - protein, 9 aa, Homo Sapiens
DGGLQFSGL

SEQ ID NO: 1046721 - protein, 9 aa, Homo Sapiens
SHKIMHHQR

SEQ ID NO: 1046722 - protein, 9 aa, Homo Sapiens
PTPAATALP

SEQ ID NO: 1046723 - protein, 9 aa, Homo Sapiens
RHRAEALPL

SEQ ID NO: 1046724 - protein, 9 aa, Homo Sapiens
CVCREALEC

SEQ ID NO: 1046725 - protein, 9 aa, Homo Sapiens
GVSWNSITL

SEQ ID NO: 1046726 - protein, 9 aa, Homo Sapiens
GGLQPQIPH

SEQ ID NO: 1046727 - protein, 9 aa, Homo Sapiens
LDPINISDI

SEQ ID NO: 1046728 - protein, 9 aa, Homo Sapiens
QLFFICQIP

SEQ ID NO: 1046729 - protein, 9 aa, Homo Sapiens
LKKVEDKKI

SEQ ID NO: 1046730 - protein, 9 aa, Homo Sapiens
DAQQMKIRW

SEQ ID NO: 1046731 - protein, 9 aa, Homo Sapiens
EEDEEGSYY

SEQ ID NO: 1046732 - protein, 9 aa, Homo Sapiens
MKKNVLDEV

SEQ ID NO: 1046733 - protein, 9 aa, Homo Sapiens
NNNQHIKIL

SEQ ID NO: 1046734 - protein, 9 aa, Homo Sapiens
NPDGDEKGV

SEQ ID NO: 1046735 - protein, 9 aa, Homo Sapiens
EIRNQVKKK

SEQ ID NO: 1046736 - protein, 9 aa, Homo Sapiens
LPLSPGVPP

SEQ ID NO: 1046737 - protein, 9 aa, Homo Sapiens
NSLLTTLSG

SEQ ID NO: 1046738 - protein, 9 aa, Homo Sapiens
GQCQDNQGF

SEQ ID NO: 1046739 - protein, 9 aa, Homo Sapiens
TDGDNPLLL

SEQ ID NO: 1046740 - protein, 9 aa, Homo Sapiens
RDGNHFERV

SEQ ID NO: 1046741 - protein, 9 aa, Homo Sapiens
LHQDLAARN

SEQ ID NO: 1046742 - protein, 9 aa, Homo Sapiens
VKKILLQKQ

SEQ ID NO: 1046743 - protein, 9 aa, Homo Sapiens
ILCSSTLGG

SEQ ID NO: 1046744 - protein, 9 aa, Homo Sapiens
FLQSVHGQP

SEQ ID NO: 1046745 - protein, 9 aa, Homo Sapiens
QKEYGKCLR

SEQ ID NO: 1046746 - protein, 9 aa, Homo Sapiens
LLIEGENCR

SEQ ID NO: 1046747 - protein, 9 aa, Homo Sapiens
AKALFTDPA

SEQ ID NO: 1046748 - protein, 9 aa, Homo Sapiens
NFLHQDLAA

SEQ ID NO: 1046749 - protein, 9 aa, Homo Sapiens
TMNNKELVR

SEQ ID NO: 1046750 - protein, 9 aa, Homo Sapiens
SHEEDEEGS

SEQ ID NO: 1046751 - protein, 9 aa, Homo Sapiens
NEGHGGFLE

SEQ ID NO: 1046752 - protein, 9 aa, Homo Sapiens
SVDYRPVFV

SEQ ID NO: 1046753 - protein, 9 aa, Homo Sapiens
LPLEREDSG

SEQ ID NO: 1046754 - protein, 9 aa, Homo Sapiens
IYSLYTKLQ

SEQ ID NO: 1046755 - protein, 9 aa, Homo Sapiens
HLGLQLDQK

SEQ ID NO: 1046756 - protein, 9 aa, Homo Sapiens
CVMEVSDQR

SEQ ID NO: 1046757 - protein, 9 aa, Homo Sapiens
CVLQKKVQK

SEQ ID NO: 1046758 - protein, 9 aa, Homo Sapiens
FAILESANW

SEQ ID NO: 1046759 - protein, 9 aa, Homo Sapiens
EGFTLDPIN

SEQ ID NO: 1046760 - protein, 9 aa, Homo Sapiens
TLEVRKSGL

SEQ ID NO: 1046761 - protein, 9 aa, Homo Sapiens
LTTMLRALG

SEQ ID NO: 1046762 - protein, 9 aa, Homo Sapiens
PGRAVLGES

SEQ ID NO: 1046763 - protein, 9 aa, Homo Sapiens
DVCPHVSDL

SEQ ID NO: 1046764 - protein, 9 aa, Homo Sapiens
TTGRLEGSS

SEQ ID NO: 1046765 - protein, 9 aa, Homo Sapiens
AAPKNRHTI

SEQ ID NO: 1046766 - protein, 9 aa, Homo Sapiens
LEKFLFKSW

SEQ ID NO: 1046767 - protein, 9 aa, Homo Sapiens
KETKEKTVS

SEQ ID NO: 1046768 - protein, 9 aa, Homo Sapiens
GFEAQMILQ

SEQ ID NO: 1046769 - protein, 9 aa, Homo Sapiens
GFSPSSFSS

SEQ ID NO: 1046770 - protein, 9 aa, Homo Sapiens
ESCRDSLFV

SEQ ID NO: 1046771 - protein, 9 aa, Homo Sapiens
PHYRVAGSS

SEQ ID NO: 1046772 - protein, 9 aa, Homo Sapiens
CGFSYKQDP

SEQ ID NO: 1046773 - protein, 9 aa, Homo Sapiens
SQTFSVQSQ

SEQ ID NO: 1046774 - protein, 9 aa, Homo Sapiens
ASVIMGNPK

SEQ ID NO: 1046775 - protein, 8 aa, Homo Sapiens
DTSTSVTY

SEQ ID NO: 1046776 - protein, 9 aa, Homo Sapiens
CGGTVFSSL

SEQ ID NO: 1046777 - protein, 9 aa, Homo Sapiens
PERPSKPGP

SEQ ID NO: 1046778 - protein, 9 aa, Homo Sapiens
TSSLGKKVL

SEQ ID NO: 1046779 - protein, 9 aa, Homo Sapiens
CSASYTVST

SEQ ID NO: 1046780 - protein, 9 aa, Homo Sapiens
ERDGAPSLM

SEQ ID NO: 1046781 - protein, 9 aa, Homo Sapiens
QVLWKSYPL

SEQ ID NO: 1046782 - protein, 9 aa, Homo Sapiens
SPCPGPPPS

SEQ ID NO: 1046783 - protein, 9 aa, Homo Sapiens
RVIGPSRIS

SEQ ID NO: 1046784 - protein, 9 aa, Homo Sapiens
IENLRHMAL

SEQ ID NO: 1046785 - protein, 9 aa, Homo Sapiens
DQSPRQLSG

SEQ ID NO: 1046786 - protein, 9 aa, Homo Sapiens
CSDLQRTQD

SEQ ID NO: 1046787 - protein, 9 aa, Homo Sapiens
GDSSAAFQG

SEQ ID NO: 1046788 - protein, 9 aa, Homo Sapiens
QCFKKYILY

SEQ ID NO: 1046789 - protein, 9 aa, Homo Sapiens
PHVSDLGLF

SEQ ID NO: 1046790 - protein, 9 aa, Homo Sapiens
SANWEEAEC

SEQ ID NO: 1046791 - protein, 9 aa, Homo Sapiens
MSRRKKGYC

SEQ ID NO: 1046792 - protein, 9 aa, Homo Sapiens
RAGLINDAF

SEQ ID NO: 1046793 - protein, 9 aa, Homo Sapiens
PSILQAGNG

SEQ ID NO: 1046794 - protein, 9 aa, Homo Sapiens
ANSVISIWF

SEQ ID NO: 1046795 - protein, 9 aa, Homo Sapiens
TQNFNAEAV

SEQ ID NO: 1046796 - protein, 9 aa, Homo Sapiens
ESGQPPGDS

SEQ ID NO: 1046797 - protein, 9 aa, Homo Sapiens
AGILTTMLR

SEQ ID NO: 1046798 - protein, 9 aa, Homo Sapiens
LTVEYFLSK

SEQ ID NO: 1046799 - protein, 9 aa, Homo Sapiens
NHVPSAAAQ

SEQ ID NO: 1046800 - protein, 9 aa, Homo Sapiens
EGENCREDA

SEQ ID NO: 1046801 - protein, 9 aa, Homo Sapiens
LAVAQEEDH

SEQ ID NO: 1046802 - protein, 9 aa, Homo Sapiens
DQRNCGYPG

SEQ ID NO: 1046803 - protein, 9 aa, Homo Sapiens
SIQEHNDYI

SEQ ID NO: 1046804 - protein, 9 aa, Homo Sapiens
GSPGRAVLG

SEQ ID NO: 1046805 - protein, 9 aa, Homo Sapiens
ILDLASRRL

SEQ ID NO: 1046806 - protein, 9 aa, Homo Sapiens
DTLGFFSTV

SEQ ID NO: 1046807 - protein, 9 aa, Homo Sapiens
IYSVAVSEV

SEQ ID NO: 1046808 - protein, 9 aa, Homo Sapiens
LDILDTAGL

SEQ ID NO: 1046809 - protein, 9 aa, Homo Sapiens
WVKPIIIGC

SEQ ID NO: 1046810 - protein, 9 aa, Homo Sapiens
ALECEEEGF

SEQ ID NO: 1046811 - protein, 9 aa, Homo Sapiens
LCLNLIPHH

SEQ ID NO: 1046812 - protein, 9 aa, Homo Sapiens
QFASPQNGI

SEQ ID NO: 1046813 - protein, 9 aa, Homo Sapiens
CHNDKIYHF

SEQ ID NO: 1046814 - protein, 9 aa, Homo Sapiens
LNQYPVFSW

SEQ ID NO: 1046815 - protein, 9 aa, Homo Sapiens
RRRGRKKGE

SEQ ID NO: 1046816 - protein, 9 aa, Homo Sapiens
TLGFFSTVF

SEQ ID NO: 1046817 - protein, 9 aa, Homo Sapiens
SNPSLFTTN

SEQ ID NO: 1046818 - protein, 9 aa, Homo Sapiens
KMKKIRALK

SEQ ID NO: 1046819 - protein, 9 aa, Homo Sapiens
VAQEEDHED

SEQ ID NO: 1046820 - protein, 9 aa, Homo Sapiens
KQNKTRSKG

SEQ ID NO: 1046821 - protein, 9 aa, Homo Sapiens
SRALVNTAQ

SEQ ID NO: 1046822 - protein, 9 aa, Homo Sapiens
ITRSERILS

SEQ ID NO: 1046823 - protein, 9 aa, Homo Sapiens
RRTDKTHSK

SEQ ID NO: 1046824 - protein, 9 aa, Homo Sapiens
HFGIVSLEA

SEQ ID NO: 1046825 - protein, 9 aa, Homo Sapiens
SRVQGQARR

SEQ ID NO: 1046826 - protein, 9 aa, Homo Sapiens
DGPIKQQES

SEQ ID NO: 1046827 - protein, 9 aa, Homo Sapiens
AICVQKPCQ

SEQ ID NO: 1046828 - protein, 9 aa, Homo Sapiens
KLEPPVAGP

SEQ ID NO: 1046829 - protein, 9 aa, Homo Sapiens
ERIQEVASS

SEQ ID NO: 1046830 - protein, 9 aa, Homo Sapiens
QLKALGNQQ

SEQ ID NO: 1046831 - protein, 9 aa, Homo Sapiens
ISQKISAHR

SEQ ID NO: 1046832 - protein, 9 aa, Homo Sapiens
ICVQKPCQP

SEQ ID NO: 1046833 - protein, 9 aa, Homo Sapiens
PGGLQPQIP

SEQ ID NO: 1046834 - protein, 9 aa, Homo Sapiens
KCVCREALE

SEQ ID NO: 1046835 - protein, 9 aa, Homo Sapiens
SSGRGSWFV

SEQ ID NO: 1046836 - protein, 9 aa, Homo Sapiens
DCSATEMSG

SEQ ID NO: 1046837 - protein, 9 aa, Homo Sapiens
TQWGDAPSI

SEQ ID NO: 1046838 - protein, 9 aa, Homo Sapiens
LSGGSMFSM

SEQ ID NO: 1046839 - protein, 9 aa, Homo Sapiens
EALECEEEG

SEQ ID NO: 1046840 - protein, 9 aa, Homo Sapiens
GFSRKSLHL

SEQ ID NO: 1046841 - protein, 9 aa, Homo Sapiens
QTAVRSLRY

SEQ ID NO: 1046842 - protein, 9 aa, Homo Sapiens
DKNNLRDTF

SEQ ID NO: 1046843 - protein, 9 aa, Homo Sapiens
SFIYSVAVS

SEQ ID NO: 1046844 - protein, 9 aa, Homo Sapiens
NEDTYCTFN

SEQ ID NO: 1046845 - protein, 9 aa, Homo Sapiens
VSPKNPCIP

SEQ ID NO: 1046846 - protein, 9 aa, Homo Sapiens
FENEGHGGF

SEQ ID NO: 1046847 - protein, 9 aa, Homo Sapiens
LPAAILGSG

SEQ ID NO: 1046848 - protein, 9 aa, Homo Sapiens
LKSHKLEPP

SEQ ID NO: 1046849 - protein, 9 aa, Homo Sapiens
KKTLNLLLR

SEQ ID NO: 1046850 - protein, 9 aa, Homo Sapiens
STLNTDASL

SEQ ID NO: 1046851 - protein, 9 aa, Homo Sapiens
QVSGIIENL

SEQ ID NO: 1046852 - protein, 9 aa, Homo Sapiens
ARGSPGRAV

SEQ ID NO: 1046853 - protein, 9 aa, Homo Sapiens
KNRPVNLKI

SEQ ID NO: 1046854 - protein, 9 aa, Homo Sapiens
SVAFSCIST

SEQ ID NO: 1046855 - protein, 9 aa, Homo Sapiens
KPHLNLPLR

SEQ ID NO: 1046856 - protein, 9 aa, Homo Sapiens
RKSLHLVHQ

SEQ ID NO: 1046857 - protein, 9 aa, Homo Sapiens
RPCYSPHGR

SEQ ID NO: 1046858 - protein, 9 aa, Homo Sapiens
LTLEDLDLF

SEQ ID NO: 1046859 - protein, 9 aa, Homo Sapiens
WLKNDSYKP

SEQ ID NO: 1046860 - protein, 9 aa, Homo Sapiens
ELVRKPQPI

SEQ ID NO: 1046861 - protein, 9 aa, Homo Sapiens
KAFGQASSF

SEQ ID NO: 1046862 - protein, 9 aa, Homo Sapiens
AQTAVRSLR

SEQ ID NO: 1046863 - protein, 9 aa, Homo Sapiens
LGKKVLSAN

SEQ ID NO: 1046864 - protein, 9 aa, Homo Sapiens
QAGNGPPQM

SEQ ID NO: 1046865 - protein, 9 aa, Homo Sapiens
MPTKSPLPP

SEQ ID NO: 1046866 - protein, 9 aa, Homo Sapiens
FGQASSFTK

SEQ ID NO: 1046867 - protein, 9 aa, Homo Sapiens
KQGMEKEEY

SEQ ID NO: 1046868 - protein, 9 aa, Homo Sapiens
LDSKLVLVT

SEQ ID NO: 1046869 - protein, 9 aa, Homo Sapiens
CPTGPPPVH

SEQ ID NO: 1046870 - protein, 9 aa, Homo Sapiens
VLFYICIIS

SEQ ID NO: 1046871 - protein, 9 aa, Homo Sapiens
QNLVQFSRL

SEQ ID NO: 1046872 - protein, 9 aa, Homo Sapiens
AVLFAAGTF

SEQ ID NO: 1046873 - protein, 9 aa, Homo Sapiens
FAREVRFPG

SEQ ID NO: 1046874 - protein, 9 aa, Homo Sapiens
KHSSGTPEA

SEQ ID NO: 1046875 - protein, 9 aa, Homo Sapiens
KKMILAKRF

SEQ ID NO: 1046876 - protein, 9 aa, Homo Sapiens
LFKVGFIVG

SEQ ID NO: 1046877 - protein, 9 aa, Homo Sapiens
NSYAQGRGK

SEQ ID NO: 1046878 - protein, 9 aa, Homo Sapiens
MPVFSKQNK

SEQ ID NO: 1046879 - protein, 9 aa, Homo Sapiens
RINEDGSLS

SEQ ID NO: 1046880 - protein, 9 aa, Homo Sapiens
FQSGDLSQN

SEQ ID NO: 1046881 - protein, 9 aa, Homo Sapiens
IEVEKTMFK

SEQ ID NO: 1046882 - protein, 9 aa, Homo Sapiens
KSLAQGDNT

SEQ ID NO: 1046883 - protein, 9 aa, Homo Sapiens
NLKIHDIFK

SEQ ID NO: 1046884 - protein, 9 aa, Homo Sapiens
EDAPIITGF

SEQ ID NO: 1046885 - protein, 9 aa, Homo Sapiens
TLFLNPVIY

SEQ ID NO: 1046886 - protein, 9 aa, Homo Sapiens
NSLVVGTPS

SEQ ID NO: 1046887 - protein, 9 aa, Homo Sapiens
SQQEVKVKF

SEQ ID NO: 1046888 - protein, 9 aa, Homo Sapiens
HYSVSAGIT

SEQ ID NO: 1046889 - protein, 9 aa, Homo Sapiens
SAAHTMSRR

SEQ ID NO: 1046890 - protein, 9 aa, Homo Sapiens
ESANWEEAE

SEQ ID NO: 1046891 - protein, 9 aa, Homo Sapiens
ASHEKVFQF

SEQ ID NO: 1046892 - protein, 9 aa, Homo Sapiens
VTYILDLAS

SEQ ID NO: 1046893 - protein, 8 aa, Homo Sapiens
ERARDRLH

SEQ ID NO: 1046894 - protein, 9 aa, Homo Sapiens
PFRSGHPEG

SEQ ID NO: 1046895 - protein, 9 aa, Homo Sapiens
EGSSQKGGE

SEQ ID NO: 1046896 - protein, 9 aa, Homo Sapiens
PKVEDRSNS

SEQ ID NO: 1046897 - protein, 9 aa, Homo Sapiens
YNLPSWCDQ

SEQ ID NO: 1046898 - protein, 9 aa, Homo Sapiens
RHTIEVNRC

SEQ ID NO: 1046899 - protein, 9 aa, Homo Sapiens
QKVPTEKEA

SEQ ID NO: 1046900 - protein, 9 aa, Homo Sapiens
TRNHDDNKK

SEQ ID NO: 1046901 - protein, 9 aa, Homo Sapiens
AISTSSLGK

SEQ ID NO: 1046902 - protein, 9 aa, Homo Sapiens
TLNTDASLV

SEQ ID NO: 1046903 - protein, 9 aa, Homo Sapiens
KMILAKRFF

SEQ ID NO: 1046904 - protein, 9 aa, Homo Sapiens
EEGSYYSAL

SEQ ID NO: 1046905 - protein, 9 aa, Homo Sapiens
SYNPRIRPN

SEQ ID NO: 1046906 - protein, 9 aa, Homo Sapiens
GFFSTVFGE

SEQ ID NO: 1046907 - protein, 9 aa, Homo Sapiens
WLGTQLSPY

SEQ ID NO: 1046908 - protein, 9 aa, Homo Sapiens
VLRDSFDDA

SEQ ID NO: 1046909 - protein, 9 aa, Homo Sapiens
CFGQTKPVY

SEQ ID NO: 1046910 - protein, 9 aa, Homo Sapiens
PAKTTEPVK

SEQ ID NO: 1046911 - protein, 9 aa, Homo Sapiens
MTNLKSTHP

SEQ ID NO: 1046912 - protein, 9 aa, Homo Sapiens
TIEKAIWLL

SEQ ID NO: 1046913 - protein, 9 aa, Homo Sapiens
RISASILVL

SEQ ID NO: 1046914 - protein, 9 aa, Homo Sapiens
EALAKPITK

SEQ ID NO: 1046915 - protein, 9 aa, Homo Sapiens
PLVVFSYGL

SEQ ID NO: 1046916 - protein, 9 aa, Homo Sapiens
NKTRSKGIL

SEQ ID NO: 1046917 - protein, 9 aa, Homo Sapiens
LQSRVLSSS

SEQ ID NO: 1046918 - protein, 9 aa, Homo Sapiens
LSGRLIYFL

SEQ ID NO: 1046919 - protein, 9 aa, Homo Sapiens
PSGLGSLTS

SEQ ID NO: 1046920 - protein, 9 aa, Homo Sapiens
FLSKKQYDE

SEQ ID NO: 1046921 - protein, 9 aa, Homo Sapiens
IKNCVSCHD

SEQ ID NO: 1046922 - protein, 9 aa, Homo Sapiens
DSNSLLTTL

SEQ ID NO: 1046923 - protein, 9 aa, Homo Sapiens
RAIKDLYGD

SEQ ID NO: 1046924 - protein, 9 aa, Homo Sapiens
NLSSASVIM

SEQ ID NO: 1046925 - protein, 9 aa, Homo Sapiens
PLFGWMKWL

SEQ ID NO: 1046926 - protein, 9 aa, Homo Sapiens
KKKVRINED

SEQ ID NO: 1046927 - protein, 9 aa, Homo Sapiens
KVGLKKRVV

SEQ ID NO: 1046928 - protein, 9 aa, Homo Sapiens
NCMVPFRSG

SEQ ID NO: 1046929 - protein, 9 aa, Homo Sapiens
ANFAKYGNL

SEQ ID NO: 1046930 - protein, 9 aa, Homo Sapiens
WGRGCSDPL

SEQ ID NO: 1046931 - protein, 9 aa, Homo Sapiens
THYKPHLNL

SEQ ID NO: 1046932 - protein, 9 aa, Homo Sapiens
GPLSPGTGG

SEQ ID NO: 1046933 - protein, 9 aa, Homo Sapiens
SPGTGGPFT

SEQ ID NO: 1046934 - protein, 9 aa, Homo Sapiens
SRMFFSITF

SEQ ID NO: 1046935 - protein, 9 aa, Homo Sapiens
SLLTTLSGG

SEQ ID NO: 1046936 - protein, 9 aa, Homo Sapiens
SNFLGSKRE

SEQ ID NO: 1046937 - protein, 9 aa, Homo Sapiens
GYETQWGDA

SEQ ID NO: 1046938 - protein, 9 aa, Homo Sapiens
AGGLFYNKD

SEQ ID NO: 1046939 - protein, 9 aa, Homo Sapiens
AAPQAPAFS

SEQ ID NO: 1046940 - protein, 9 aa, Homo Sapiens
LQCFKKYIL

SEQ ID NO: 1046941 - protein, 9 aa, Homo Sapiens
GASEKIEET

SEQ ID NO: 1046942 - protein, 9 aa, Homo Sapiens
DPAGNSVSY

SEQ ID NO: 1046943 - protein, 9 aa, Homo Sapiens
LSPGVPPPQ

SEQ ID NO: 1046944 - protein, 9 aa, Homo Sapiens
RMSNHPDGP

SEQ ID NO: 1046945 - protein, 9 aa, Homo Sapiens
SVTPLEAGV

SEQ ID NO: 1046946 - protein, 9 aa, Homo Sapiens
TGLLRQKAK

SEQ ID NO: 1046947 - protein, 9 aa, Homo Sapiens
LCKTITGVF

SEQ ID NO: 1046948 - protein, 9 aa, Homo Sapiens
IFTFYQLEE

SEQ ID NO: 1046949 - protein, 9 aa, Homo Sapiens
IHRFGIHAP

SEQ ID NO: 1046950 - protein, 9 aa, Homo Sapiens
SQNVIELKG

SEQ ID NO: 1046951 - protein, 9 aa, Homo Sapiens
KNNLRDTFA

SEQ ID NO: 1046952 - protein, 9 aa, Homo Sapiens
QMFCSRSIE

SEQ ID NO: 1046953 - protein, 9 aa, Homo Sapiens
LSLLENSPV

SEQ ID NO: 1046954 - protein, 9 aa, Homo Sapiens
QIVNFLLLL

SEQ ID NO: 1046955 - protein, 9 aa, Homo Sapiens
FGIHAPHVV

SEQ ID NO: 1046956 - protein, 9 aa, Homo Sapiens
VRESEQLFF

SEQ ID NO: 1046957 - protein, 9 aa, Homo Sapiens
GYKGHQGQP

SEQ ID NO: 1046958 - protein, 9 aa, Homo Sapiens
KSRLSVGVH

SEQ ID NO: 1046959 - protein, 9 aa, Homo Sapiens
GQASSFTKH

SEQ ID NO: 1046960 - protein, 9 aa, Homo Sapiens
SIKTKEIHS

SEQ ID NO: 1046961 - protein, 9 aa, Homo Sapiens
KDLGLDSRK

SEQ ID NO: 1046962 - protein, 9 aa, Homo Sapiens
SVLVLEAII

SEQ ID NO: 1046963 - protein, 9 aa, Homo Sapiens
KLLGHVPLF

SEQ ID NO: 1046964 - protein, 9 aa, Homo Sapiens
SKKQYDEFE

SEQ ID NO: 1046965 - protein, 9 aa, Homo Sapiens
KSGLYRCQA

SEQ ID NO: 1046966 - protein, 9 aa, Homo Sapiens
NETVFNYFD

SEQ ID NO: 1046967 - protein, 9 aa, Homo Sapiens
GCHAYGDQY

SEQ ID NO: 1046968 - protein, 9 aa, Homo Sapiens
GWKGSPQLS

SEQ ID NO: 1046969 - protein, 9 aa, Homo Sapiens
AFSGEYIPT

SEQ ID NO: 1046970 - protein, 9 aa, Homo Sapiens
LFLFSYCKS

SEQ ID NO: 1046971 - protein, 9 aa, Homo Sapiens
RAVLGESGE

SEQ ID NO: 1046972 - protein, 9 aa, Homo Sapiens
FHYTSIVLT

SEQ ID NO: 1046973 - protein, 9 aa, Homo Sapiens
VEDRSNSAE

SEQ ID NO: 1046974 - protein, 9 aa, Homo Sapiens
IKTKEIHSA

SEQ ID NO: 1046975 - protein, 9 aa, Homo Sapiens
HPLSGQRPA

SEQ ID NO: 1046976 - protein, 9 aa, Homo Sapiens
VLWKPEDSR

SEQ ID NO: 1046977 - protein, 9 aa, Homo Sapiens
PDGDEKGVW

SEQ ID NO: 1046978 - protein, 9 aa, Homo Sapiens
CWSPLLIIM

SEQ ID NO: 1046979 - protein, 9 aa, Homo Sapiens
AHYLVEELR

SEQ ID NO: 1046980 - protein, 9 aa, Homo Sapiens
DKIEDDDED

SEQ ID NO: 1046981 - protein, 9 aa, Homo Sapiens
HLVHQRTHS

SEQ ID NO: 1046982 - protein, 9 aa, Homo Sapiens
VARFIPFHL

SEQ ID NO: 1046983 - protein, 9 aa, Homo Sapiens
RDGAPSLMM

SEQ ID NO: 1046984 - protein, 9 aa, Homo Sapiens
CFKKYILYP

SEQ ID NO: 1046985 - protein, 9 aa, Homo Sapiens
CDQVLWKSY

SEQ ID NO: 1046986 - protein, 9 aa, Homo Sapiens
LQGRLNLGT

SEQ ID NO: 1046987 - protein, 9 aa, Homo Sapiens
FTIEKAIWL

SEQ ID NO: 1046988 - protein, 9 aa, Homo Sapiens
NLDIKYKKR

SEQ ID NO: 1046989 - protein, 9 aa, Homo Sapiens
APVSFPSGS

SEQ ID NO: 1046990 - protein, 9 aa, Homo Sapiens
KRENKDLRA

SEQ ID NO: 1046991 - protein, 9 aa, Homo Sapiens
CQIVNFLLL

SEQ ID NO: 1046992 - protein, 9 aa, Homo Sapiens
PLVRKICSD

SEQ ID NO: 1046993 - protein, 9 aa, Homo Sapiens
SAHSRPSYC

SEQ ID NO: 1046994 - protein, 9 aa, Homo Sapiens
KYGNLNETQ

SEQ ID NO: 1046995 - protein, 9 aa, Homo Sapiens
NIEEKKEEV

SEQ ID NO: 1046996 - protein, 9 aa, Homo Sapiens
NQVPVESLR

SEQ ID NO: 1046997 - protein, 9 aa, Homo Sapiens
IFLEGFVEL

SEQ ID NO: 1046998 - protein, 9 aa, Homo Sapiens
IDGVSWNSI

SEQ ID NO: 1046999 - protein, 9 aa, Homo Sapiens
CIPKLHMLE

SEQ ID NO: 1047000 - protein, 9 aa, Homo Sapiens
HCFHYTSIV

SEQ ID NO: 1047001 - protein, 9 aa, Homo Sapiens
NPVFPMNNC

SEQ ID NO: 1047002 - protein, 9 aa, Homo Sapiens
WKGSSQGRT

SEQ ID NO: 1047003 - protein, 9 aa, Homo Sapiens
NVLLSGEVS

SEQ ID NO: 1047004 - protein, 9 aa, Homo Sapiens
AGSVLVLEA

SEQ ID NO: 1047005 - protein, 9 aa, Homo Sapiens
DRDGNHFER

SEQ ID NO: 1047006 - protein, 9 aa, Homo Sapiens
RLLVSYNPR

SEQ ID NO: 1047007 - protein, 9 aa, Homo Sapiens
TSLELVPLS

SEQ ID NO: 1047008 - protein, 9 aa, Homo Sapiens
AGEPWCIES

SEQ ID NO: 1047009 - protein, 9 aa, Homo Sapiens
PPTPGSPFH

SEQ ID NO: 1047010 - protein, 9 aa, Homo Sapiens
QILENREEA

SEQ ID NO: 1047011 - protein, 9 aa, Homo Sapiens
FMQVVVSQS

SEQ ID NO: 1047012 - protein, 9 aa, Homo Sapiens
SATGKKSSK

SEQ ID NO: 1047013 - protein, 9 aa, Homo Sapiens
AFGQASSFT

SEQ ID NO: 1047014 - protein, 9 aa, Homo Sapiens
VPWLHSLAV

SEQ ID NO: 1047015 - protein, 9 aa, Homo Sapiens
QDESVDYRP

SEQ ID NO: 1047016 - protein, 9 aa, Homo Sapiens
EPEKGTPLW

SEQ ID NO: 1047017 - protein, 9 aa, Homo Sapiens
LPPTPSAQA

SEQ ID NO: 1047018 - protein, 9 aa, Homo Sapiens
EARPATGTA

SEQ ID NO: 1047019 - protein, 9 aa, Homo Sapiens
RENKDLRAR

SEQ ID NO: 1047020 - protein, 9 aa, Homo Sapiens
PFCHNDKIY

SEQ ID NO: 1047021 - protein, 9 aa, Homo Sapiens
YRIPPLFLI

SEQ ID NO: 1047022 - protein, 9 aa, Homo Sapiens
LENSPVLLL

SEQ ID NO: 1047023 - protein, 9 aa, Homo Sapiens
SDPLYPGVY

SEQ ID NO: 1047024 - protein, 9 aa, Homo Sapiens
SDDQESYPV

SEQ ID NO: 1047025 - protein, 9 aa, Homo Sapiens
VIWWNLQKT

SEQ ID NO: 1047026 - protein, 9 aa, Homo Sapiens
KFENEGHGG

SEQ ID NO: 1047027 - protein, 9 aa, Homo Sapiens
TGRLEGSSK

SEQ ID NO: 1047028 - protein, 9 aa, Homo Sapiens
TNIEEKKEE

SEQ ID NO: 1047029 - protein, 9 aa, Homo Sapiens
QAAPQAPAF

SEQ ID NO: 1047030 - protein, 9 aa, Homo Sapiens
YASAQFASP

SEQ ID NO: 1047031 - protein, 9 aa, Homo Sapiens
MLDCISEKV

SEQ ID NO: 1047032 - protein, 9 aa, Homo Sapiens
FIPFHLNNK

SEQ ID NO: 1047033 - protein, 9 aa, Homo Sapiens
VCLAGGSGI

SEQ ID NO: 1047034 - protein, 9 aa, Homo Sapiens
HYLVEELRK

SEQ ID NO: 1047035 - protein, 9 aa, Homo Sapiens
EGHGGFLES

SEQ ID NO: 1047036 - protein, 9 aa, Homo Sapiens
YSPHGRQKF

SEQ ID NO: 1047037 - protein, 9 aa, Homo Sapiens
DEDAPIITG

SEQ ID NO: 1047038 - protein, 9 aa, Homo Sapiens
GSPFLLVGL

SEQ ID NO: 1047039 - protein, 9 aa, Homo Sapiens
VFLDVSGRK

SEQ ID NO: 1047040 - protein, 9 aa, Homo Sapiens
QSGDLSQNR

SEQ ID NO: 1047041 - protein, 9 aa, Homo Sapiens
GNLNETQNN

SEQ ID NO: 1047042 - protein, 9 aa, Homo Sapiens
GFHAEIDWE

SEQ ID NO: 1047043 - protein, 9 aa, Homo Sapiens
LSSSLMLPK

SEQ ID NO: 1047044 - protein, 9 aa, Homo Sapiens
HLIELNIKN

SEQ ID NO: 1047045 - protein, 9 aa, Homo Sapiens
YHVTYILDL

SEQ ID NO: 1047046 - protein, 9 aa, Homo Sapiens
LLEFCSSIM

SEQ ID NO: 1047047 - protein, 9 aa, Homo Sapiens
EYMNNVLLS

SEQ ID NO: 1047048 - protein, 9 aa, Homo Sapiens
SLQKAGEPW

SEQ ID NO: 1047049 - protein, 9 aa, Homo Sapiens
SMRSLRSLI

SEQ ID NO: 1047050 - protein, 9 aa, Homo Sapiens
LIHYSVSAG

SEQ ID NO: 1047051 - protein, 9 aa, Homo Sapiens
PCYSPHGRQ

SEQ ID NO: 1047052 - protein, 9 aa, Homo Sapiens
LSGQRPAPV

SEQ ID NO: 1047053 - protein, 9 aa, Homo Sapiens
MNNCPIVIK

SEQ ID NO: 1047054 - protein, 9 aa, Homo Sapiens
LRKLCRQWL

SEQ ID NO: 1047055 - protein, 9 aa, Homo Sapiens
YPVFSWVIT

SEQ ID NO: 1047056 - protein, 9 aa, Homo Sapiens
DAPIITGFS

SEQ ID NO: 1047057 - protein, 9 aa, Homo Sapiens
IPHYRVAGS

SEQ ID NO: 1047058 - protein, 9 aa, Homo Sapiens
FICQIPLLC

SEQ ID NO: 1047059 - protein, 9 aa, Homo Sapiens
NNCPIVIKT

SEQ ID NO: 1047060 - protein, 9 aa, Homo Sapiens
IKNPDDRRR

SEQ ID NO: 1047061 - protein, 9 aa, Homo Sapiens
QPQIPHYRV

SEQ ID NO: 1047062 - protein, 9 aa, Homo Sapiens
SRKLAKHGV

SEQ ID NO: 1047063 - protein, 9 aa, Homo Sapiens
KIMHHQRRR

SEQ ID NO: 1047064 - protein, 9 aa, Homo Sapiens
PFQANPFPY

SEQ ID NO: 1047065 - protein, 9 aa, Homo Sapiens
PGGVYAGPK

SEQ ID NO: 1047066 - protein, 9 aa, Homo Sapiens
RDINIDNET

SEQ ID NO: 1047067 - protein, 9 aa, Homo Sapiens
ALCHSLQHT

SEQ ID NO: 1047068 - protein, 9 aa, Homo Sapiens
GFKFQGIKK

SEQ ID NO: 1047069 - protein, 9 aa, Homo Sapiens
SSHWLFGHI

SEQ ID NO: 1047070 - protein, 9 aa, Homo Sapiens
LQTSDSQHK

SEQ ID NO: 1047071 - protein, 9 aa, Homo Sapiens
WRTRNHDDN

SEQ ID NO: 1047072 - protein, 9 aa, Homo Sapiens
DQMREVKRH

SEQ ID NO: 1047073 - protein, 9 aa, Homo Sapiens
ASIFGVSST

SEQ ID NO: 1047074 - protein, 9 aa, Homo Sapiens
PAATALPPT

SEQ ID NO: 1047075 - protein, 9 aa, Homo Sapiens
SAIKDRQEM

SEQ ID NO: 1047076 - protein, 9 aa, Homo Sapiens
PITKSLAQG

SEQ ID NO: 1047077 - protein, 9 aa, Homo Sapiens
PCIPKLHML

SEQ ID NO: 1047078 - protein, 9 aa, Homo Sapiens
GKLKVEGNF

SEQ ID NO: 1047079 - protein, 9 aa, Homo Sapiens
PVFPMNNCP

SEQ ID NO: 1047080 - protein, 9 aa, Homo Sapiens
CFHYTSIVL

SEQ ID NO: 1047081 - protein, 9 aa, Homo Sapiens
GCHGSRPCS

SEQ ID NO: 1047082 - protein, 9 aa, Homo Sapiens
IWKYGLKAE

SEQ ID NO: 1047083 - protein, 9 aa, Homo Sapiens
IIENLRHMA

SEQ ID NO: 1047084 - protein, 9 aa, Homo Sapiens
QPGAICVQK

SEQ ID NO: 1047085 - protein, 9 aa, Homo Sapiens
YQAGFSECM

SEQ ID NO: 1047086 - protein, 9 aa, Homo Sapiens
CISEKVGLK

SEQ ID NO: 1047087 - protein, 9 aa, Homo Sapiens
TNLKSTHPH

SEQ ID NO: 1047088 - protein, 9 aa, Homo Sapiens
GFADGEPKP

SEQ ID NO: 1047089 - protein, 9 aa, Homo Sapiens
AIFDAIFTL

SEQ ID NO: 1047090 - protein, 9 aa, Homo Sapiens
IKHPVMCSH

SEQ ID NO: 1047091 - protein, 9 aa, Homo Sapiens
ISTSSLGKK

SEQ ID NO: 1047092 - protein, 9 aa, Homo Sapiens
TCKEKAQAL

SEQ ID NO: 1047093 - protein, 9 aa, Homo Sapiens
SPSRTSLAA

SEQ ID NO: 1047094 - protein, 9 aa, Homo Sapiens
EGRRGIFLE

SEQ ID NO: 1047095 - protein, 9 aa, Homo Sapiens
EKHSSGTPE

SEQ ID NO: 1047096 - protein, 9 aa, Homo Sapiens
VEKTMFKKG

SEQ ID NO: 1047097 - protein, 9 aa, Homo Sapiens
NNIRSVAFS

SEQ ID NO: 1047098 - protein, 9 aa, Homo Sapiens
DLNQYPVFS

SEQ ID NO: 1047099 - protein, 9 aa, Homo Sapiens
TIVLFTHKK

SEQ ID NO: 1047100 - protein, 9 aa, Homo Sapiens
QLGRKHRTR

SEQ ID NO: 1047101 - protein, 9 aa, Homo Sapiens
NSVISIWFE

SEQ ID NO: 1047102 - protein, 9 aa, Homo Sapiens
HKRIHTGKR

SEQ ID NO: 1047103 - protein, 9 aa, Homo Sapiens
PLTVTSQQE

SEQ ID NO: 1047104 - protein, 9 aa, Homo Sapiens
HTLPLSPGV

SEQ ID NO: 1047105 - protein, 9 aa, Homo Sapiens
SSVRLHSLY

SEQ ID NO: 1047106 - protein, 9 aa, Homo Sapiens
FTSLELVPL

SEQ ID NO: 1047107 - protein, 9 aa, Homo Sapiens
WKPEDSRAP

SEQ ID NO: 1047108 - protein, 9 aa, Homo Sapiens
GGHLGLQLD

SEQ ID NO: 1047109 - protein, 9 aa, Homo Sapiens
FVRKSSIFI

SEQ ID NO: 1047110 - protein, 9 aa, Homo Sapiens
ELVPLSTLT

SEQ ID NO: 1047111 - protein, 9 aa, Homo Sapiens
MKLFLVAAM

SEQ ID NO: 1047112 - protein, 9 aa, Homo Sapiens
SPHGRQKFL

SEQ ID NO: 1047113 - protein, 9 aa, Homo Sapiens
LISDLKMKR

SEQ ID NO: 1047114 - protein, 9 aa, Homo Sapiens
FAPVSFPSG

SEQ ID NO: 1047115 - protein, 9 aa, Homo Sapiens
PLFILGWPN

SEQ ID NO: 1047116 - protein, 9 aa, Homo Sapiens
HTEKKLLKC

SEQ ID NO: 1047117 - protein, 9 aa, Homo Sapiens
YSALYNGTN

SEQ ID NO: 1047118 - protein, 9 aa, Homo Sapiens
GGQCQDNQG

SEQ ID NO: 1047119 - protein, 9 aa, Homo Sapiens
FHSPLHSGP

SEQ ID NO: 1047120 - protein, 9 aa, Homo Sapiens
CSDPLYPGV

SEQ ID NO: 1047121 - protein, 9 aa, Homo Sapiens
KTLRKNSEL

SEQ ID NO: 1047122 - protein, 9 aa, Homo Sapiens
NRNFLHQDL

SEQ ID NO: 1047123 - protein, 9 aa, Homo Sapiens
NERIQEVAS

SEQ ID NO: 1047124 - protein, 9 aa, Homo Sapiens
QMKNTMPWK

SEQ ID NO: 1047125 - protein, 9 aa, Homo Sapiens
EDEEGSYYS

SEQ ID NO: 1047126 - protein, 9 aa, Homo Sapiens
LTVTSQQEV

SEQ ID NO: 1047127 - protein, 9 aa, Homo Sapiens
SSMRSLRSL

SEQ ID NO: 1047128 - protein, 9 aa, Homo Sapiens
TDVLLYTDQ

SEQ ID NO: 1047129 - protein, 9 aa, Homo Sapiens
GGLQFSGLV

SEQ ID NO: 1047130 - protein, 9 aa, Homo Sapiens
RRRWIIRAL

SEQ ID NO: 1047131 - protein, 9 aa, Homo Sapiens
ASQNFFRIE

SEQ ID NO: 1047132 - protein, 9 aa, Homo Sapiens
RGIFLEGFV

SEQ ID NO: 1047133 - protein, 9 aa, Homo Sapiens
TSDSQHKWS

SEQ ID NO: 1047134 - protein, 9 aa, Homo Sapiens
KIMQLGRKH

SEQ ID NO: 1047135 - protein, 9 aa, Homo Sapiens
WLHSLAVAQ

SEQ ID NO: 1047136 - protein, 9 aa, Homo Sapiens
SGINEFKFL

SEQ ID NO: 1047137 - protein, 9 aa, Homo Sapiens
DASLVTGLS

SEQ ID NO: 1047138 - protein, 9 aa, Homo Sapiens
SVGVHRLES

SEQ ID NO: 1047139 - protein, 9 aa, Homo Sapiens
VSGIIENLR

SEQ ID NO: 1047140 - protein, 9 aa, Homo Sapiens
ITWDSLSGP

SEQ ID NO: 1047141 - protein, 9 aa, Homo Sapiens
QSIFRVYCF

SEQ ID NO: 1047142 - protein, 9 aa, Homo Sapiens
IWMDYFVFA

SEQ ID NO: 1047143 - protein, 9 aa, Homo Sapiens
DSQHKWSQL

SEQ ID NO: 1047144 - protein, 9 aa, Homo Sapiens
MKEIVLRDW

SEQ ID NO: 1047145 - protein, 9 aa, Homo Sapiens
LDQKALTTF

SEQ ID NO: 1047146 - protein, 9 aa, Homo Sapiens
RFEDQITVY

SEQ ID NO: 1047147 - protein, 9 aa, Homo Sapiens
LCFVLSLLE

SEQ ID NO: 1047148 - protein, 9 aa, Homo Sapiens
EKVGLKKRV

SEQ ID NO: 1047149 - protein, 9 aa, Homo Sapiens
MLITKSSRG

SEQ ID NO: 1047150 - protein, 9 aa, Homo Sapiens
IGCHAYGDQ

SEQ ID NO: 1047151 - protein, 9 aa, Homo Sapiens
PSLMMPNEA

SEQ ID NO: 1047152 - protein, 9 aa, Homo Sapiens
VGFEAQMIL

SEQ ID NO: 1047153 - protein, 9 aa, Homo Sapiens
KMLDCISEK

SEQ ID NO: 1047154 - protein, 9 aa, Homo Sapiens
YLSSAVTSP

SEQ ID NO: 1047155 - protein, 9 aa, Homo Sapiens
ISASILVLR

SEQ ID NO: 1047156 - protein, 9 aa, Homo Sapiens
EFCSSIMYL

SEQ ID NO: 1047157 - protein, 9 aa, Homo Sapiens
LTTTLEKHS

SEQ ID NO: 1047158 - protein, 9 aa, Homo Sapiens
TEQDKTGKW

SEQ ID NO: 1047159 - protein, 9 aa, Homo Sapiens
GGVYAGPKP

SEQ ID NO: 1047160 - protein, 9 aa, Homo Sapiens
KIINYGVSS

SEQ ID NO: 1047161 - protein, 9 aa, Homo Sapiens
SPSSFSSPL

SEQ ID NO: 1047162 - protein, 9 aa, Homo Sapiens
LCLEAGTAP

SEQ ID NO: 1047163 - protein, 9 aa, Homo Sapiens
PFHLNNKSC

SEQ ID NO: 1047164 - protein, 9 aa, Homo Sapiens
KLKSRLSVG

SEQ ID NO: 1047165 - protein, 9 aa, Homo Sapiens
ILYQFFHED

SEQ ID NO: 1047166 - protein, 9 aa, Homo Sapiens
RTEQDKTGK

SEQ ID NO: 1047167 - protein, 9 aa, Homo Sapiens
TTLEKHSSG

SEQ ID NO: 1047168 - protein, 9 aa, Homo Sapiens
TNAFSGEYI

SEQ ID NO: 1047169 - protein, 9 aa, Homo Sapiens
QQMKIRWFR

SEQ ID NO: 1047170 - protein, 9 aa, Homo Sapiens
VPVESLRAI

SEQ ID NO: 1047171 - protein, 9 aa, Homo Sapiens
PEEARPATG

SEQ ID NO: 1047172 - protein, 9 aa, Homo Sapiens
QVKKKMILA

SEQ ID NO: 1047173 - protein, 9 aa, Homo Sapiens
DAEAGSVVL

SEQ ID NO: 1047174 - protein, 9 aa, Homo Sapiens
NSATGKKSS

SEQ ID NO: 1047175 - protein, 9 aa, Homo Sapiens
RSSSEERNH

SEQ ID NO: 1047176 - protein, 9 aa, Homo Sapiens
FFICQIPLL

SEQ ID NO: 1047177 - protein, 9 aa, Homo Sapiens
VLAELVIRL

SEQ ID NO: 1047178 - protein, 9 aa, Homo Sapiens
YTTNAFSGE

SEQ ID NO: 1047179 - protein, 9 aa, Homo Sapiens
LLPRCSIFS

SEQ ID NO: 1047180 - protein, 9 aa, Homo Sapiens
ASSFTKHKR

SEQ ID NO: 1047181 - protein, 9 aa, Homo Sapiens
DLGLDSRKL

SEQ ID NO: 1047182 - protein, 9 aa, Homo Sapiens
DLQISLDRK

SEQ ID NO: 1047183 - protein, 9 aa, Homo Sapiens
NMENTLKSH

SEQ ID NO: 1047184 - protein, 9 aa, Homo Sapiens
SMLCQIVNF

SEQ ID NO: 1047185 - protein, 9 aa, Homo Sapiens
AAILGSGFA

SEQ ID NO: 1047186 - protein, 9 aa, Homo Sapiens
GFTLDPINI

SEQ ID NO: 1047187 - protein, 9 aa, Homo Sapiens
VQLNVCLSQ

SEQ ID NO: 1047188 - protein, 9 aa, Homo Sapiens
QAPAFSEEK

SEQ ID NO: 1047189 - protein, 9 aa, Homo Sapiens
DCRNCCYLW

SEQ ID NO: 1047190 - protein, 9 aa, Homo Sapiens
EQRQKMKKI

SEQ ID NO: 1047191 - protein, 9 aa, Homo Sapiens
NDLANSIWK

SEQ ID NO: 1047192 - protein, 9 aa, Homo Sapiens
LDPLKSHKL

SEQ ID NO: 1047193 - protein, 9 aa, Homo Sapiens
LKLKDLRKE

SEQ ID NO: 1047194 - protein, 9 aa, Homo Sapiens
CTPLVRKIC

SEQ ID NO: 1047195 - protein, 9 aa, Homo Sapiens
WSPLLIIML

SEQ ID NO: 1047196 - protein, 9 aa, Homo Sapiens
RWLGTQLSP

SEQ ID NO: 1047197 - protein, 9 aa, Homo Sapiens
IVLFYICII

SEQ ID NO: 1047198 - protein, 9 aa, Homo Sapiens
QPTTMPYPT

SEQ ID NO: 1047199 - protein, 9 aa, Homo Sapiens
NFAKYGNLN

SEQ ID NO: 1047200 - protein, 9 aa, Homo Sapiens
TTLSGGSMF

SEQ ID NO: 1047201 - protein, 9 aa, Homo Sapiens
CEQSQNSNS

SEQ ID NO: 1047202 - protein, 9 aa, Homo Sapiens
VSFPSGSTE

SEQ ID NO: 1047203 - protein, 9 aa, Homo Sapiens
SSEERNHSR

SEQ ID NO: 1047204 - protein, 9 aa, Homo Sapiens
NLQKTCYQI

SEQ ID NO: 1047205 - protein, 9 aa, Homo Sapiens
LNVCLSQIY

SEQ ID NO: 1047206 - protein, 9 aa, Homo Sapiens
IITLPLWAH

SEQ ID NO: 1047207 - protein, 9 aa, Homo Sapiens
VFTLPPPFS

SEQ ID NO: 1047208 - protein, 9 aa, Homo Sapiens
ERQKSQSGL

SEQ ID NO: 1047209 - protein, 9 aa, Homo Sapiens
QNFNAEAVC

SEQ ID NO: 1047210 - protein, 9 aa, Homo Sapiens
VLLSGEVSN

SEQ ID NO: 1047211 - protein, 9 aa, Homo Sapiens
INISDIAEK

SEQ ID NO: 1047212 - protein, 9 aa, Homo Sapiens
FQKGSNALC

SEQ ID NO: 1047213 - protein, 9 aa, Homo Sapiens
KTGKWNEDE

SEQ ID NO: 1047214 - protein, 9 aa, Homo Sapiens
NNLRDTFAA

SEQ ID NO: 1047215 - protein, 9 aa, Homo Sapiens
CGGDNSLCK

SEQ ID NO: 1047216 - protein, 9 aa, Homo Sapiens
LEFCSSIMY

SEQ ID NO: 1047217 - protein, 9 aa, Homo Sapiens
GVCGGDNSL

SEQ ID NO: 1047218 - protein, 9 aa, Homo Sapiens
HLRFSGIKT

SEQ ID NO: 1047219 - protein, 9 aa, Homo Sapiens
KSSIFIMDE

SEQ ID NO: 1047220 - protein, 9 aa, Homo Sapiens
KGSNALCHS

SEQ ID NO: 1047221 - protein, 9 aa, Homo Sapiens
KGHQGQPGP

SEQ ID NO: 1047222 - protein, 9 aa, Homo Sapiens
LLYTDQHGG

SEQ ID NO: 1047223 - protein, 9 aa, Homo Sapiens
TLLQSRVLS

SEQ ID NO: 1047224 - protein, 9 aa, Homo Sapiens
ELADCSATE

SEQ ID NO: 1047225 - protein, 9 aa, Homo Sapiens
SAVTSPSRT

SEQ ID NO: 1047226 - protein, 9 aa, Homo Sapiens
LSIHAEPYT

SEQ ID NO: 1047227 - protein, 9 aa, Homo Sapiens
NLFHADKNG

SEQ ID NO: 1047228 - protein, 9 aa, Homo Sapiens
CVKKILLQK

SEQ ID NO: 1047229 - protein, 9 aa, Homo Sapiens
SCIFIYVWP

SEQ ID NO: 1047230 - protein, 9 aa, Homo Sapiens
YSLYTKLQS

SEQ ID NO: 1047231 - protein, 9 aa, Homo Sapiens
INKIINYGV

SEQ ID NO: 1047232 - protein, 9 aa, Homo Sapiens
YRDINIDNE

SEQ ID NO: 1047233 - protein, 9 aa, Homo Sapiens
FTTRAIKDL

SEQ ID NO: 1047234 - protein, 9 aa, Homo Sapiens
MKKIRALKK

SEQ ID NO: 1047235 - protein, 9 aa, Homo Sapiens
SYLSLSIHA

SEQ ID NO: 1047236 - protein, 9 aa, Homo Sapiens
NALGKLKVE

SEQ ID NO: 1047237 - protein, 9 aa, Homo Sapiens
FSDDQESYP

SEQ ID NO: 1047238 - protein, 9 aa, Homo Sapiens
LDLASRRLR

SEQ ID NO: 1047239 - protein, 9 aa, Homo Sapiens
KIEETMSVH

SEQ ID NO: 1047240 - protein, 9 aa, Homo Sapiens
HSLVHLNEA

SEQ ID NO: 1047241 - protein, 9 aa, Homo Sapiens
VIGPSRISA

SEQ ID NO: 1047242 - protein, 9 aa, Homo Sapiens
DAHKRPPSP

SEQ ID NO: 1047243 - protein, 9 aa, Homo Sapiens
FDDTLGFFS

SEQ ID NO: 1047244 - protein, 9 aa, Homo Sapiens
FGQFSTLKL

SEQ ID NO: 1047245 - protein, 9 aa, Homo Sapiens
SNHKETKEK

SEQ ID NO: 1047246 - protein, 9 aa, Homo Sapiens
KVCETQIFD

SEQ ID NO: 1047247 - protein, 9 aa, Homo Sapiens
FLLSFISIP

SEQ ID NO: 1047248 - protein, 9 aa, Homo Sapiens
IIPDIPQII

SEQ ID NO: 1047249 - protein, 9 aa, Homo Sapiens
CYENELSLR

SEQ ID NO: 1047250 - protein, 9 aa, Homo Sapiens
PVDSLDSPQ

SEQ ID NO: 1047251 - protein, 9 aa, Homo Sapiens
YDDSAMKTL

SEQ ID NO: 1047252 - protein, 9 aa, Homo Sapiens
QHCFHYTSI

SEQ ID NO: 1047253 - protein, 9 aa, Homo Sapiens
PEKGTPLWR

SEQ ID NO: 1047254 - protein, 9 aa, Homo Sapiens
EALSQLRKL

SEQ ID NO: 1047255 - protein, 9 aa, Homo Sapiens
APKNRHTIE

SEQ ID NO: 1047256 - protein, 9 aa, Homo Sapiens
ESFIYSVAV

SEQ ID NO: 1047257 - protein, 9 aa, Homo Sapiens
VSISGQRYS

SEQ ID NO: 1047258 - protein, 9 aa, Homo Sapiens
AELVIRLRV

SEQ ID NO: 1047259 - protein, 9 aa, Homo Sapiens
GSTGTTLLP

SEQ ID NO: 1047260 - protein, 9 aa, Homo Sapiens
LPPGGGNLG

SEQ ID NO: 1047261 - protein, 9 aa, Homo Sapiens
TLPPPFSET

SEQ ID NO: 1047262 - protein, 9 aa, Homo Sapiens
LRVSPKNPC

SEQ ID NO: 1047263 - protein, 9 aa, Homo Sapiens
KKILLQKQG

SEQ ID NO: 1047264 - protein, 9 aa, Homo Sapiens
GLGIKNCVS

SEQ ID NO: 1047265 - protein, 9 aa, Homo Sapiens
HTMSRRKKG

SEQ ID NO: 1047266 - protein, 9 aa, Homo Sapiens
EERKTSEQV

SEQ ID NO: 1047267 - protein, 9 aa, Homo Sapiens
ATALPPTPS

SEQ ID NO: 1047268 - protein, 9 aa, Homo Sapiens
FPCPSSHWL

SEQ ID NO: 1047269 - protein, 9 aa, Homo Sapiens
VIFSNIFSI

SEQ ID NO: 1047270 - protein, 9 aa, Homo Sapiens
GLQLDQKAL

SEQ ID NO: 1047271 - protein, 9 aa, Homo Sapiens
SNRNFLHQD

SEQ ID NO: 1047272 - protein, 9 aa, Homo Sapiens
QKIWMDYFV

SEQ ID NO: 1047273 - protein, 9 aa, Homo Sapiens
SRVLSSSLM

SEQ ID NO: 1047274 - protein, 9 aa, Homo Sapiens
SNFLFDKNF

SEQ ID NO: 1047275 - protein, 9 aa, Homo Sapiens
VTSYLSLSI

SEQ ID NO: 1047276 - protein, 9 aa, Homo Sapiens
SSCTSANGN

SEQ ID NO: 1047277 - protein, 9 aa, Homo Sapiens
VRNSATGKK

SEQ ID NO: 1047278 - protein, 9 aa, Homo Sapiens
SSSTQLPRE

SEQ ID NO: 1047279 - protein, 9 aa, Homo Sapiens
PLLIIMLKM

SEQ ID NO: 1047280 - protein, 9 aa, Homo Sapiens
CCWICIPCK

SEQ ID NO: 1047281 - protein, 9 aa, Homo Sapiens
LGIKNCVSC

SEQ ID NO: 1047282 - protein, 9 aa, Homo Sapiens
LYVWLQCFK

SEQ ID NO: 1047283 - protein, 9 aa, Homo Sapiens
WDRNEPPPP

SEQ ID NO: 1047284 - protein, 9 aa, Homo Sapiens
PKTKPESLK

SEQ ID NO: 1047285 - protein, 9 aa, Homo Sapiens
VYLQPKNSY

SEQ ID NO: 1047286 - protein, 9 aa, Homo Sapiens
RDKDSGNNG

SEQ ID NO: 1047287 - protein, 9 aa, Homo Sapiens
VQKEYGKCL

SEQ ID NO: 1047288 - protein, 9 aa, Homo Sapiens
LWMVTCINQ

SEQ ID NO: 1047289 - protein, 9 aa, Homo Sapiens
VPLSTLTTT

SEQ ID NO: 1047290 - protein, 9 aa, Homo Sapiens
FGSCIFIYV

SEQ ID NO: 1047291 - protein, 9 aa, Homo Sapiens
NNKELVRKP

SEQ ID NO: 1047292 - protein, 9 aa, Homo Sapiens
NLKKNSSYF

SEQ ID NO: 1047293 - protein, 9 aa, Homo Sapiens
YDRSQWLNK

SEQ ID NO: 1047294 - protein, 9 aa, Homo Sapiens
SLDGPIKQQ

SEQ ID NO: 1047295 - protein, 9 aa, Homo Sapiens
INWLLEFCS

SEQ ID NO: 1047296 - protein, 9 aa, Homo Sapiens
RQTQNFNAE

SEQ ID NO: 1047297 - protein, 9 aa, Homo Sapiens
PIIIGCHAY

SEQ ID NO: 1047298 - protein, 9 aa, Homo Sapiens
LLLQGRLNL

SEQ ID NO: 1047299 - protein, 9 aa, Homo Sapiens
SFLRIYSLY

SEQ ID NO: 1047300 - protein, 9 aa, Homo Sapiens
RRLQISQKI

SEQ ID NO: 1047301 - protein, 9 aa, Homo Sapiens
PNGFHAEID

SEQ ID NO: 1047302 - protein, 9 aa, Homo Sapiens
VCETQIFDY

SEQ ID NO: 1047303 - protein, 9 aa, Homo Sapiens
EMVIKHPVM

SEQ ID NO: 1047304 - protein, 9 aa, Homo Sapiens
QSGPSTPHV

SEQ ID NO: 1047305 - protein, 9 aa, Homo Sapiens
YTSIVLTST

SEQ ID NO: 1047306 - protein, 9 aa, Homo Sapiens
YSVAVSEVQ

SEQ ID NO: 1047307 - protein, 9 aa, Homo Sapiens
ESMRKVMLI

SEQ ID NO: 1047308 - protein, 9 aa, Homo Sapiens
PPLFLIKSF

SEQ ID NO: 1047309 - protein, 9 aa, Homo Sapiens
EEDKFENEG

SEQ ID NO: 1047310 - protein, 9 aa, Homo Sapiens
LSNRNFLHQ

SEQ ID NO: 1047311 - protein, 9 aa, Homo Sapiens
QASSFTKHK

SEQ ID NO: 1047312 - protein, 9 aa, Homo Sapiens
EDQITVYHY

SEQ ID NO: 1047313 - protein, 9 aa, Homo Sapiens
SPGSTGTTL

SEQ ID NO: 1047314 - protein, 9 aa, Homo Sapiens
LSQWRTRNH

SEQ ID NO: 1047315 - protein, 9 aa, Homo Sapiens
QQNLFHADK

SEQ ID NO: 1047316 - protein, 9 aa, Homo Sapiens
IEEKKEEVT

SEQ ID NO: 1047317 - protein, 9 aa, Homo Sapiens
LRLGIAVIL

SEQ ID NO: 1047318 - protein, 9 aa, Homo Sapiens
LFYNKDNKE

SEQ ID NO: 1047319 - protein, 9 aa, Homo Sapiens
RQKMKKIRA

SEQ ID NO: 1047320 - protein, 9 aa, Homo Sapiens
APNGFHAEI

SEQ ID NO: 1047321 - protein, 9 aa, Homo Sapiens
DNPLLLPRC

SEQ ID NO: 1047322 - protein, 9 aa, Homo Sapiens
LGKLKVEGN

SEQ ID NO: 1047323 - protein, 9 aa, Homo Sapiens
LIYGFSPSS

SEQ ID NO: 1047324 - protein, 9 aa, Homo Sapiens
QGQARREIL

SEQ ID NO: 1047325 - protein, 9 aa, Homo Sapiens
TRAIKDLYG

SEQ ID NO: 1047326 - protein, 9 aa, Homo Sapiens
EKGTPLWRL

SEQ ID NO: 1047327 - protein, 9 aa, Homo Sapiens
HKETKEKTV

SEQ ID NO: 1047328 - protein, 9 aa, Homo Sapiens
DIKYKKRST

SEQ ID NO: 1047329 - protein, 9 aa, Homo Sapiens
LRDWSNSSD

SEQ ID NO: 1047330 - protein, 9 aa, Homo Sapiens
CRNCCYLWA

SEQ ID NO: 1047331 - protein, 9 aa, Homo Sapiens
VRVIFSNIF

SEQ ID NO: 1047332 - protein, 9 aa, Homo Sapiens
IEKAIWLLW

SEQ ID NO: 1047333 - protein, 9 aa, Homo Sapiens
LSSVRLHSL

SEQ ID NO: 1047334 - protein, 9 aa, Homo Sapiens
HSAIIKFLG

SEQ ID NO: 1047335 - protein, 9 aa, Homo Sapiens
KILLQKQGM

SEQ ID NO: 1047336 - protein, 9 aa, Homo Sapiens
RGSPGRAVL

SEQ ID NO: 1047337 - protein, 9 aa, Homo Sapiens
TSPSRTSLA

SEQ ID NO: 1047338 - protein, 9 aa, Homo Sapiens
PSALNPVIY

SEQ ID NO: 1047339 - protein, 9 aa, Homo Sapiens
LFKSWMSKH

SEQ ID NO: 1047340 - protein, 9 aa, Homo Sapiens
NFLGSKREN

SEQ ID NO: 1047341 - protein, 9 aa, Homo Sapiens
KKGPTFIKV

SEQ ID NO: 1047342 - protein, 9 aa, Homo Sapiens
SARHLYLCD

SEQ ID NO: 1047343 - protein, 9 aa, Homo Sapiens
SKDLGLDSR

SEQ ID NO: 1047344 - protein, 9 aa, Homo Sapiens
GIHAPHVVP

SEQ ID NO: 1047345 - protein, 9 aa, Homo Sapiens
LDRKTSTDF

SEQ ID NO: 1047346 - protein, 9 aa, Homo Sapiens
TSYLSLSIH

SEQ ID NO: 1047347 - protein, 9 aa, Homo Sapiens
LWRLQQVEK

SEQ ID NO: 1047348 - protein, 9 aa, Homo Sapiens
KTKEIHSAI

SEQ ID NO: 1047349 - protein, 9 aa, Homo Sapiens
GTTLLPDNT

SEQ ID NO: 1047350 - protein, 9 aa, Homo Sapiens
LQISQKISA

SEQ ID NO: 1047351 - protein, 9 aa, Homo Sapiens
IGLPAKTTE

SEQ ID NO: 1047352 - protein, 9 aa, Homo Sapiens
LQQFPCPSS

SEQ ID NO: 1047353 - protein, 9 aa, Homo Sapiens
SASILVLRD

SEQ ID NO: 1047354 - protein, 9 aa, Homo Sapiens
KGSSQGRTK

SEQ ID NO: 1047355 - protein, 9 aa, Homo Sapiens
REALECEEE

SEQ ID NO: 1047356 - protein, 9 aa, Homo Sapiens
NKIINYGVS

SEQ ID NO: 1047357 - protein, 9 aa, Homo Sapiens
TVTIPNEDT

SEQ ID NO: 1047358 - protein, 9 aa, Homo Sapiens
TFQAAATLH

SEQ ID NO: 1047359 - protein, 9 aa, Homo Sapiens
CLRQMFCSR

SEQ ID NO: 1047360 - protein, 9 aa, Homo Sapiens
AEKASIFGV

SEQ ID NO: 1047361 - protein, 9 aa, Homo Sapiens
KLFAPVSFP

SEQ ID NO: 1047362 - protein, 9 aa, Homo Sapiens
LRWDRNEPP

SEQ ID NO: 1047363 - protein, 9 aa, Homo Sapiens
RQKSQSGLV

SEQ ID NO: 1047364 - protein, 9 aa, Homo Sapiens
HRQTQNFNA

SEQ ID NO: 1047365 - protein, 9 aa, Homo Sapiens
SIWKGSSQG

SEQ ID NO: 1047366 - protein, 9 aa, Homo Sapiens
LPPPFSETQ

SEQ ID NO: 1047367 - protein, 9 aa, Homo Sapiens
SVQPGLLRP

SEQ ID NO: 1047368 - protein, 9 aa, Homo Sapiens
NPVSISGQR

SEQ ID NO: 1047369 - protein, 9 aa, Homo Sapiens
TFSVQSQAP

SEQ ID NO: 1047370 - protein, 9 aa, Homo Sapiens
KKVLSANHG

SEQ ID NO: 1047371 - protein, 9 aa, Homo Sapiens
GVAGGVLPR

SEQ ID NO: 1047372 - protein, 9 aa, Homo Sapiens
RGGCHGSRP

SEQ ID NO: 1047373 - protein, 9 aa, Homo Sapiens
NPLLLPRCS

SEQ ID NO: 1047374 - protein, 9 aa, Homo Sapiens
ALYNGTNMI

SEQ ID NO: 1047375 - protein, 9 aa, Homo Sapiens
DSKLVLVTT

SEQ ID NO: 1047376 - protein, 9 aa, Homo Sapiens
DLFYNNLHG

SEQ ID NO: 1047377 - protein, 9 aa, Homo Sapiens
QNLFHADKN

SEQ ID NO: 1047378 - protein, 9 aa, Homo Sapiens
HLYLCDYHK

SEQ ID NO: 1047379 - protein, 9 aa, Homo Sapiens
WMVTCINQQ

SEQ ID NO: 1047380 - protein, 9 aa, Homo Sapiens
LTTLSGGSM

SEQ ID NO: 1047381 - protein, 9 aa, Homo Sapiens
KVEDRSNSA

SEQ ID NO: 1047382 - protein, 9 aa, Homo Sapiens
QSQNSNSDL

SEQ ID NO: 1047383 - protein, 9 aa, Homo Sapiens
CKPYEYLAD

SEQ ID NO: 1047384 - protein, 9 aa, Homo Sapiens
EDLILKLKD

SEQ ID NO: 1047385 - protein, 9 aa, Homo Sapiens
EDTYCTFNF

SEQ ID NO: 1047386 - protein, 9 aa, Homo Sapiens
VELVQFSSR

SEQ ID NO: 1047387 - protein, 9 aa, Homo Sapiens
APSLMMPNE

SEQ ID NO: 1047388 - protein, 9 aa, Homo Sapiens
ILQAGNGPP

SEQ ID NO: 1047389 - protein, 9 aa, Homo Sapiens
LSPQWSHHG

SEQ ID NO: 1047390 - protein, 9 aa, Homo Sapiens
NSEALCSAS

SEQ ID NO: 1047391 - protein, 9 aa, Homo Sapiens
SFSNSEALC

SEQ ID NO: 1047392 - protein, 9 aa, Homo Sapiens
LLAAKALFT

SEQ ID NO: 1047393 - protein, 9 aa, Homo Sapiens
EDNESCRDS

SEQ ID NO: 1047394 - protein, 9 aa, Homo Sapiens
HIIFKTLFK

SEQ ID NO: 1047395 - protein, 9 aa, Homo Sapiens
KRANSQENC

SEQ ID NO: 1047396 - protein, 9 aa, Homo Sapiens
MEDIKVCET

SEQ ID NO: 1047397 - protein, 9 aa, Homo Sapiens
LLQKQGMEK

SEQ ID NO: 1047398 - protein, 9 aa, Homo Sapiens
KVEDKKIRK

SEQ ID NO: 1047399 - protein, 9 aa, Homo Sapiens
LSVGVHRLE

SEQ ID NO: 1047400 - protein, 9 aa, Homo Sapiens
QVFIDRFCY

SEQ ID NO: 1047401 - protein, 9 aa, Homo Sapiens
QEESILMKK

SEQ ID NO: 1047402 - protein, 9 aa, Homo Sapiens
GPSFTIEKA

SEQ ID NO: 1047403 - protein, 9 aa, Homo Sapiens
KNVLDEVAN

SEQ ID NO: 1047404 - protein, 9 aa, Homo Sapiens
SWVITNYES

SEQ ID NO: 1047405 - protein, 9 aa, Homo Sapiens
TLEDLDLFY

SEQ ID NO: 1047406 - protein, 9 aa, Homo Sapiens
PEDSRAPCT

SEQ ID NO: 1047407 - protein, 9 aa, Homo Sapiens
AGNGPPQMR

SEQ ID NO: 1047408 - protein, 9 aa, Homo Sapiens
FGFWYRMSN

SEQ ID NO: 1047409 - protein, 9 aa, Homo Sapiens
SGKNRPVNL

SEQ ID NO: 1047410 - protein, 9 aa, Homo Sapiens
FSEEKAGSA

SEQ ID NO: 1047411 - protein, 9 aa, Homo Sapiens
EYGIGLPAK

SEQ ID NO: 1047412 - protein, 9 aa, Homo Sapiens
MGSPFLLVG

SEQ ID NO: 1047413 - protein, 9 aa, Homo Sapiens
YLMNFWPFG

SEQ ID NO: 1047414 - protein, 9 aa, Homo Sapiens
PSLFTTNLS

SEQ ID NO: 1047415 - protein, 9 aa, Homo Sapiens
LCDYHKNLI

SEQ ID NO: 1047416 - protein, 9 aa, Homo Sapiens
PEDRGCPAR

SEQ ID NO: 1047417 - protein, 9 aa, Homo Sapiens
VYCDDIPCY

SEQ ID NO: 1047418 - protein, 9 aa, Homo Sapiens
LCQIVNFLL

SEQ ID NO: 1047419 - protein, 9 aa, Homo Sapiens
LFPLFILGW

SEQ ID NO: 1047420 - protein, 9 aa, Homo Sapiens
FSYGLGAFR

SEQ ID NO: 1047421 - protein, 9 aa, Homo Sapiens
STLKLKSLK

SEQ ID NO: 1047422 - protein, 9 aa, Homo Sapiens
LPQMKNTMP

SEQ ID NO: 1047423 - protein, 9 aa, Homo Sapiens
EVRKSGLYR

SEQ ID NO: 1047424 - protein, 9 aa, Homo Sapiens
AKPITKSLA

SEQ ID NO: 1047425 - protein, 9 aa, Homo Sapiens
ISEKVGLKK

SEQ ID NO: 1047426 - protein, 9 aa, Homo Sapiens
EAVRRMPPD

SEQ ID NO: 1047427 - protein, 9 aa, Homo Sapiens
EKTMFKKGP

SEQ ID NO: 1047428 - protein, 9 aa, Homo Sapiens
HFGFWYRMS

SEQ ID NO: 1047429 - protein, 9 aa, Homo Sapiens
VLPGEQQRP

SEQ ID NO: 1047430 - protein, 9 aa, Homo Sapiens
RQKAKFIPH

SEQ ID NO: 1047431 - protein, 9 aa, Homo Sapiens
TTTLEKHSS

SEQ ID NO: 1047432 - protein, 9 aa, Homo Sapiens
FESKMRRRE

SEQ ID NO: 1047433 - protein, 8 aa, Homo Sapiens
NLSLVLAA

SEQ ID NO: 1047434 - protein, 9 aa, Homo Sapiens
SILMKKNVL

SEQ ID NO: 1047435 - protein, 9 aa, Homo Sapiens
VTIPNEDTY

SEQ ID NO: 1047436 - protein, 9 aa, Homo Sapiens
SKQNKTRSK

SEQ ID NO: 1047437 - protein, 9 aa, Homo Sapiens
NCPIVIKTD

SEQ ID NO: 1047438 - protein, 9 aa, Homo Sapiens
CPSSHWLFG

SEQ ID NO: 1047439 - protein, 9 aa, Homo Sapiens
LKSRLSVGV

SEQ ID NO: 1047440 - protein, 9 aa, Homo Sapiens
LGFFSTVFG

SEQ ID NO: 1047441 - protein, 9 aa, Homo Sapiens
FQEPENDCR

SEQ ID NO: 1047442 - protein, 9 aa, Homo Sapiens
SVHGQPYLT

SEQ ID NO: 1047443 - protein, 9 aa, Homo Sapiens
TGTTLLPDN

SEQ ID NO: 1047444 - protein, 9 aa, Homo Sapiens
ESLKGCESA

SEQ ID NO: 1047445 - protein, 9 aa, Homo Sapiens
CVNSLEKFL

SEQ ID NO: 1047446 - protein, 9 aa, Homo Sapiens
NRHTIEVNR

SEQ ID NO: 1047447 - protein, 9 aa, Homo Sapiens
FSSLCLNLI

SEQ ID NO: 1047448 - protein, 9 aa, Homo Sapiens
VCPHVSDLG

SEQ ID NO: 1047449 - protein, 9 aa, Homo Sapiens
PGGEGASEK

SEQ ID NO: 1047450 - protein, 9 aa, Homo Sapiens
GSLTSHSLS

SEQ ID NO: 1047451 - protein, 9 aa, Homo Sapiens
VYCFGQTKP

SEQ ID NO: 1047452 - protein, 9 aa, Homo Sapiens
RLIHYSVSA

SEQ ID NO: 1047453 - protein, 9 aa, Homo Sapiens
NDEDKIEDD

SEQ ID NO: 1047454 - protein, 9 aa, Homo Sapiens
NCKFGQFST

SEQ ID NO: 1047455 - protein, 9 aa, Homo Sapiens
MKKKVRINE

SEQ ID NO: 1047456 - protein, 9 aa, Homo Sapiens
SCGFSYKQD

SEQ ID NO: 1047457 - protein, 9 aa, Homo Sapiens
TMAGEKWKH

SEQ ID NO: 1047458 - protein, 9 aa, Homo Sapiens
IVSLEAMYM

SEQ ID NO: 1047459 - protein, 9 aa, Homo Sapiens
QMKNERLSC

SEQ ID NO: 1047460 - protein, 9 aa, Homo Sapiens
PPHTLPLSP

SEQ ID NO: 1047461 - protein, 9 aa, Homo Sapiens
LPGEHLRVC

SEQ ID NO: 1047462 - protein, 9 aa, Homo Sapiens
NIKNPDDRR

SEQ ID NO: 1047463 - protein, 9 aa, Homo Sapiens
DQVLWKSYP

SEQ ID NO: 1047464 - protein, 9 aa, Homo Sapiens
YNPVSISGQ

SEQ ID NO: 1047465 - protein, 9 aa, Homo Sapiens
LPGEQQRPH

SEQ ID NO: 1047466 - protein, 9 aa, Homo Sapiens
GAICVQKPC

SEQ ID NO: 1047467 - protein, 9 aa, Homo Sapiens
CPGPPPSTS

SEQ ID NO: 1047468 - protein, 9 aa, Homo Sapiens
KTTEPVKVS

SEQ ID NO: 1047469 - protein, 9 aa, Homo Sapiens
SYYSALSDV

SEQ ID NO: 1047470 - protein, 9 aa, Homo Sapiens
GLGKMIFYL

SEQ ID NO: 1047471 - protein, 9 aa, Homo Sapiens
PQCQTNTDY

SEQ ID NO: 1047472 - protein, 9 aa, Homo Sapiens
LKIHDIFKG

SEQ ID NO: 1047473 - protein, 9 aa, Homo Sapiens
IRSVAFSCI

SEQ ID NO: 1047474 - protein, 9 aa, Homo Sapiens
FVLSLLENS

SEQ ID NO: 1047475 - protein, 9 aa, Homo Sapiens
DPELADCSA

SEQ ID NO: 1047476 - protein, 9 aa, Homo Sapiens
FIYSVAVSE

SEQ ID NO: 1047477 - protein, 9 aa, Homo Sapiens
RHRTIFTFY

SEQ ID NO: 1047478 - protein, 9 aa, Homo Sapiens
RIYSLYTKL

SEQ ID NO: 1047479 - protein, 9 aa, Homo Sapiens
YLCDYHKNL

SEQ ID NO: 1047480 - protein, 9 aa, Homo Sapiens
FPLGPPCLP

SEQ ID NO: 1047481 - protein, 9 aa, Homo Sapiens
YLTPIKYLK

SEQ ID NO: 1047482 - protein, 9 aa, Homo Sapiens
LRAISRTNE

SEQ ID NO: 1047483 - protein, 9 aa, Homo Sapiens
DPPGLCLEA

SEQ ID NO: 1047484 - protein, 9 aa, Homo Sapiens
YGIGLPAKT

SEQ ID NO: 1047485 - protein, 9 aa, Homo Sapiens
SAYNPVSIS

SEQ ID NO: 1047486 - protein, 9 aa, Homo Sapiens
LLSGEVSNL

SEQ ID NO: 1047487 - protein, 9 aa, Homo Sapiens
KIRHTEKKL

SEQ ID NO: 1047488 - protein, 9 aa, Homo Sapiens
LDLQSPIKL

SEQ ID NO: 1047489 - protein, 9 aa, Homo Sapiens
NYDNRRSFG

SEQ ID NO: 1047490 - protein, 9 aa, Homo Sapiens
LHSLYDNQI

SEQ ID NO: 1047491 - protein, 9 aa, Homo Sapiens
KNSYAQGRG

SEQ ID NO: 1047492 - protein, 9 aa, Homo Sapiens
ESYPVTDIS

SEQ ID NO: 1047493 - protein, 9 aa, Homo Sapiens
RLQTCKEKA

SEQ ID NO: 1047494 - protein, 9 aa, Homo Sapiens
LVLQVFKIA

SEQ ID NO: 1047495 - protein, 9 aa, Homo Sapiens
TPEPDICHK

SEQ ID NO: 1047496 - protein, 9 aa, Homo Sapiens
TTINKIINY

SEQ ID NO: 1047497 - protein, 9 aa, Homo Sapiens
ELNIKNPDD

SEQ ID NO: 1047498 - protein, 9 aa, Homo Sapiens
ADKNGGFHT

SEQ ID NO: 1047499 - protein, 9 aa, Homo Sapiens
KMIFYLKSA

SEQ ID NO: 1047500 - protein, 9 aa, Homo Sapiens
PTMAGEKWK

SEQ ID NO: 1047501 - protein, 9 aa, Homo Sapiens
SMGSPFLLV

SEQ ID NO: 1047502 - protein, 9 aa, Homo Sapiens
KDLNGGSLM

SEQ ID NO: 1047503 - protein, 9 aa, Homo Sapiens
GGTEASFQA

SEQ ID NO: 1047504 - protein, 9 aa, Homo Sapiens
EIIQFYLEE

SEQ ID NO: 1047505 - protein, 9 aa, Homo Sapiens
YCFGQTKPV

SEQ ID NO: 1047506 - protein, 9 aa, Homo Sapiens
ENALGKLKV

SEQ ID NO: 1047507 - protein, 9 aa, Homo Sapiens
LPSILQAGN

SEQ ID NO: 1047508 - protein, 9 aa, Homo Sapiens
PPPHTLPLS

SEQ ID NO: 1047509 - protein, 9 aa, Homo Sapiens
RISAIKDRQ

SEQ ID NO: 1047510 - protein, 9 aa, Homo Sapiens
PWSVLPGEQ

SEQ ID NO: 1047511 - protein, 9 aa, Homo Sapiens
GQARREILS

SEQ ID NO: 1047512 - protein, 9 aa, Homo Sapiens
DKTGKWNED

SEQ ID NO: 1047513 - protein, 9 aa, Homo Sapiens
PSLSLDSKL

SEQ ID NO: 1047514 - protein, 9 aa, Homo Sapiens
IRHTEKKLL

SEQ ID NO: 1047515 - protein, 9 aa, Homo Sapiens
LRQKAKFIP

SEQ ID NO: 1047516 - protein, 9 aa, Homo Sapiens
DEDLILKLK

SEQ ID NO: 1047517 - protein, 9 aa, Homo Sapiens
FLEGFVELL

SEQ ID NO: 1047518 - protein, 9 aa, Homo Sapiens
SVLLLQGRL

SEQ ID NO: 1047519 - protein, 9 aa, Homo Sapiens
AREVRFPGQ

SEQ ID NO: 1047520 - protein, 9 aa, Homo Sapiens
AVAQEEDHE

SEQ ID NO: 1047521 - protein, 9 aa, Homo Sapiens
PCQNIFSVS

SEQ ID NO: 1047522 - protein, 9 aa, Homo Sapiens
NQHIKILCS

SEQ ID NO: 1047523 - protein, 9 aa, Homo Sapiens
WSRMFFSIT

SEQ ID NO: 1047524 - protein, 9 aa, Homo Sapiens
SETQPGPLT

SEQ ID NO: 1047525 - protein, 9 aa, Homo Sapiens
IFRVYCFGQ

SEQ ID NO: 1047526 - protein, 9 aa, Homo Sapiens
GSSMRSLRS

SEQ ID NO: 1047527 - protein, 9 aa, Homo Sapiens
GENCREDAL

SEQ ID NO: 1047528 - protein, 9 aa, Homo Sapiens
VSPEGTRVE

SEQ ID NO: 1047529 - protein, 9 aa, Homo Sapiens
RDGFIDKNN

SEQ ID NO: 1047530 - protein, 9 aa, Homo Sapiens
FQANPFPYH

SEQ ID NO: 1047531 - protein, 9 aa, Homo Sapiens
CLTESSNFP

SEQ ID NO: 1047532 - protein, 9 aa, Homo Sapiens
SSAVTSPSR

SEQ ID NO: 1047533 - protein, 9 aa, Homo Sapiens
LQPKNSYAQ

SEQ ID NO: 1047534 - protein, 9 aa, Homo Sapiens
ILGEAQDAE

SEQ ID NO: 1047535 - protein, 9 aa, Homo Sapiens
LRFSGIKTY

SEQ ID NO: 1047536 - protein, 9 aa, Homo Sapiens
GNTLEVRKS

SEQ ID NO: 1047537 - protein, 9 aa, Homo Sapiens
LSGWKGSPQ

SEQ ID NO: 1047538 - protein, 9 aa, Homo Sapiens
IQVFIDRFC

SEQ ID NO: 1047539 - protein, 9 aa, Homo Sapiens
SCIDTTINK

SEQ ID NO: 1047540 - protein, 9 aa, Homo Sapiens
THKKDLNGG

SEQ ID NO: 1047541 - protein, 9 aa, Homo Sapiens
PTPGSPFHS

SEQ ID NO: 1047542 - protein, 9 aa, Homo Sapiens
IKLSASGED

SEQ ID NO: 1047543 - protein, 9 aa, Homo Sapiens
EPENDCRNC

SEQ ID NO: 1047544 - protein, 9 aa, Homo Sapiens
LQCMQHLVS

SEQ ID NO: 1047545 - protein, 9 aa, Homo Sapiens
VIGGRNKTG

SEQ ID NO: 1047546 - protein, 9 aa, Homo Sapiens
VSAGITDQG

SEQ ID NO: 1047547 - protein, 9 aa, Homo Sapiens
VNFLRTRSR

SEQ ID NO: 1047548 - protein, 9 aa, Homo Sapiens
NFAILESAN

SEQ ID NO: 1047549 - protein, 9 aa, Homo Sapiens
SHKLEPPVA

SEQ ID NO: 1047550 - protein, 9 aa, Homo Sapiens
IAPTVLGHL

SEQ ID NO: 1047551 - protein, 9 aa, Homo Sapiens
SLMMPNEAR

SEQ ID NO: 1047552 - protein, 9 aa, Homo Sapiens
IIQFYLEEV

SEQ ID NO: 1047553 - protein, 9 aa, Homo Sapiens
TPSGLGSLT

SEQ ID NO: 1047554 - protein, 9 aa, Homo Sapiens
LDTAGLEEY

SEQ ID NO: 1047555 - protein, 9 aa, Homo Sapiens
VSLQKHSAE

SEQ ID NO: 1047556 - protein, 9 aa, Homo Sapiens
VSYNPRIRP

SEQ ID NO: 1047557 - protein, 9 aa, Homo Sapiens
LVRKICSDL

SEQ ID NO: 1047558 - protein, 9 aa, Homo Sapiens
EKWKHGGDQ

SEQ ID NO: 1047559 - protein, 9 aa, Homo Sapiens
NDAFSLARA

SEQ ID NO: 1047560 - protein, 9 aa, Homo Sapiens
EGASEKIEE

SEQ ID NO: 1047561 - protein, 9 aa, Homo Sapiens
ESENSPVSQ

SEQ ID NO: 1047562 - protein, 9 aa, Homo Sapiens
TEASFQASG

SEQ ID NO: 1047563 - protein, 9 aa, Homo Sapiens
EHFGIVSLE

SEQ ID NO: 1047564 - protein, 9 aa, Homo Sapiens
NHSRSRSPN

SEQ ID NO: 1047565 - protein, 9 aa, Homo Sapiens
KKGEEDQNP

SEQ ID NO: 1047566 - protein, 9 aa, Homo Sapiens
TAVRSLRYA

SEQ ID NO: 1047567 - protein, 9 aa, Homo Sapiens
VLSSSLMLP

SEQ ID NO: 1047568 - protein, 9 aa, Homo Sapiens
AAHTMSRRK

SEQ ID NO: 1047569 - protein, 9 aa, Homo Sapiens
GIVSLEAMY

SEQ ID NO: 1047570 - protein, 9 aa, Homo Sapiens
FFSTVFGEE

SEQ ID NO: 1047571 - protein, 9 aa, Homo Sapiens
LRVCPGNQP

SEQ ID NO: 1047572 - protein, 9 aa, Homo Sapiens
SSGLFPLFI

SEQ ID NO: 1047573 - protein, 9 aa, Homo Sapiens
QEHNDYICP

SEQ ID NO: 1047574 - protein, 9 aa, Homo Sapiens
DKIYHFYCD

SEQ ID NO: 1047575 - protein, 9 aa, Homo Sapiens
SILQAGNGP

SEQ ID NO: 1047576 - protein, 9 aa, Homo Sapiens
ERPSKPGPP

SEQ ID NO: 1047577 - protein, 9 aa, Homo Sapiens
CQALSEIIQ

SEQ ID NO: 1047578 - protein, 9 aa, Homo Sapiens
GSQTSLDGP

SEQ ID NO: 1047579 - protein, 9 aa, Homo Sapiens
REQMKNERL

SEQ ID NO: 1047580 - protein, 9 aa, Homo Sapiens
RSFQSGDLS

SEQ ID NO: 1047581 - protein, 9 aa, Homo Sapiens
CIPCKPYEY

SEQ ID NO: 1047582 - protein, 9 aa, Homo Sapiens
VCLSQIYLA

SEQ ID NO: 1047583 - protein, 9 aa, Homo Sapiens
SLSIHAEPY

SEQ ID NO: 1047584 - protein, 9 aa, Homo Sapiens
GINEFKFLK

SEQ ID NO: 1047585 - protein, 9 aa, Homo Sapiens
GSNRRLQTC

SEQ ID NO: 1047586 - protein, 9 aa, Homo Sapiens
TLFKVGFIV

SEQ ID NO: 1047587 - protein, 9 aa, Homo Sapiens
LPEEARPAT

SEQ ID NO: 1047588 - protein, 9 aa, Homo Sapiens
LFLNPVIYT

SEQ ID NO: 1047589 - protein, 9 aa, Homo Sapiens
TVFSSLCLN

SEQ ID NO: 1047590 - protein, 9 aa, Homo Sapiens
QTNTDYCVS

SEQ ID NO: 1047591 - protein, 9 aa, Homo Sapiens
YKGHQGQPG

SEQ ID NO: 1047592 - protein, 9 aa, Homo Sapiens
NGAPNGFHA

SEQ ID NO: 1047593 - protein, 9 aa, Homo Sapiens
MAAPKNRHT

SEQ ID NO: 1047594 - protein, 9 aa, Homo Sapiens
GGTVFSSLC

SEQ ID NO: 1047595 - protein, 9 aa, Homo Sapiens
KDSGNNGKT

SEQ ID NO: 1047596 - protein, 9 aa, Homo Sapiens
RNKTGYLSS

SEQ ID NO: 1047597 - protein, 9 aa, Homo Sapiens
EKGDLSSEL

SEQ ID NO: 1047598 - protein, 9 aa, Homo Sapiens
TPIKYLKKS

SEQ ID NO: 1047599 - protein, 9 aa, Homo Sapiens
DAIYSALYN

SEQ ID NO: 1047600 - protein, 9 aa, Homo Sapiens
KKIRALKKM

SEQ ID NO: 1047601 - protein, 9 aa, Homo Sapiens
TCTWMKFQK

SEQ ID NO: 1047602 - protein, 9 aa, Homo Sapiens
GCRSGNRNS

SEQ ID NO: 1047603 - protein, 9 aa, Homo Sapiens
LLENSPVLL

SEQ ID NO: 1047604 - protein, 9 aa, Homo Sapiens
KLVLVTTSV

SEQ ID NO: 1047605 - protein, 9 aa, Homo Sapiens
SQSQTFSVQ

SEQ ID NO: 1047606 - protein, 9 aa, Homo Sapiens
LDIKYKKRS

SEQ ID NO: 1047607 - protein, 9 aa, Homo Sapiens
EDKKIRKLK

SEQ ID NO: 1047608 - protein, 9 aa, Homo Sapiens
RREHEFRLQ

SEQ ID NO: 1047609 - protein, 9 aa, Homo Sapiens
QPYLTQGNE

SEQ ID NO: 1047610 - protein, 9 aa, Homo Sapiens
GEHLRVCPG

SEQ ID NO: 1047611 - protein, 9 aa, Homo Sapiens
DNESCRDSL

SEQ ID NO: 1047612 - protein, 9 aa, Homo Sapiens
SYGLGAFRT

SEQ ID NO: 1047613 - protein, 9 aa, Homo Sapiens
MVTCINQQL

SEQ ID NO: 1047614 - protein, 9 aa, Homo Sapiens
PKPPPVYTN

SEQ ID NO: 1047615 - protein, 9 aa, Homo Sapiens
TFEDNESCR

SEQ ID NO: 1047616 - protein, 9 aa, Homo Sapiens
KKIMQLGRK

SEQ ID NO: 1047617 - protein, 9 aa, Homo Sapiens
SPQLSDGLV

SEQ ID NO: 1047618 - protein, 9 aa, Homo Sapiens
LEFESKMRR

SEQ ID NO: 1047619 - protein, 9 aa, Homo Sapiens
CVGNYDNRR

SEQ ID NO: 1047620 - protein, 9 aa, Homo Sapiens
EKEINNMEN

SEQ ID NO: 1047621 - protein, 9 aa, Homo Sapiens
NDCRNCCYL

SEQ ID NO: 1047622 - protein, 9 aa, Homo Sapiens
RHLYLCDYH

SEQ ID NO: 1047623 - protein, 9 aa, Homo Sapiens
NTRDPPGLC

SEQ ID NO: 1047624 - protein, 9 aa, Homo Sapiens
DVLLYTDQH

SEQ ID NO: 1047625 - protein, 9 aa, Homo Sapiens
PTVLGHLFV

SEQ ID NO: 1047626 - protein, 9 aa, Homo Sapiens
VRINEDGSL

SEQ ID NO: 1047627 - protein, 9 aa, Homo Sapiens
DLQSPIKLS

SEQ ID NO: 1047628 - protein, 9 aa, Homo Sapiens
EYFLSKKQY

SEQ ID NO: 1047629 - protein, 9 aa, Homo Sapiens
LGEAQDAES

SEQ ID NO: 1047630 - protein, 9 aa, Homo Sapiens
KEIVLRDWS

SEQ ID NO: 1047631 - protein, 9 aa, Homo Sapiens
EPDICHKLL

SEQ ID NO: 1047632 - protein, 9 aa, Homo Sapiens
KPESLKGCE

SEQ ID NO: 1047633 - protein, 9 aa, Homo Sapiens
AISDLLFII

SEQ ID NO: 1047634 - protein, 9 aa, Homo Sapiens
VSDQRNCGY

SEQ ID NO: 1047635 - protein, 9 aa, Homo Sapiens
TKPESLKGC

SEQ ID NO: 1047636 - protein, 9 aa, Homo Sapiens
RASHEKVFQ

SEQ ID NO: 1047637 - protein, 9 aa, Homo Sapiens
FWYRMSNHP

SEQ ID NO: 1047638 - protein, 9 aa, Homo Sapiens
GSKRENKDL

SEQ ID NO: 1047639 - protein, 9 aa, Homo Sapiens
ISDLKMKRE

SEQ ID NO: 1047640 - protein, 9 aa, Homo Sapiens
LAAKALFTD

SEQ ID NO: 1047641 - protein, 9 aa, Homo Sapiens
FEDNESCRD

SEQ ID NO: 1047642 - protein, 9 aa, Homo Sapiens
LKVEGNFYS

SEQ ID NO: 1047643 - protein, 9 aa, Homo Sapiens
KDSTTPLNH

SEQ ID NO: 1047644 - protein, 9 aa, Homo Sapiens
IHAPHVVPI

SEQ ID NO: 1047645 - protein, 9 aa, Homo Sapiens
VFTRSELKL

SEQ ID NO: 1047646 - protein, 9 aa, Homo Sapiens
TSRVQGQAR

SEQ ID NO: 1047647 - protein, 9 aa, Homo Sapiens
SLQKHSAEG

SEQ ID NO: 1047648 - protein, 9 aa, Homo Sapiens
FSPSSFSSP

SEQ ID NO: 1047649 - protein, 9 aa, Homo Sapiens
MILQVPAME

SEQ ID NO: 1047650 - protein, 9 aa, Homo Sapiens
HKLLGHVPL

SEQ ID NO: 1047651 - protein, 9 aa, Homo Sapiens
QLNVCLSQI

SEQ ID NO: 1047652 - protein, 9 aa, Homo Sapiens
TFVGIGLWA

SEQ ID NO: 1047653 - protein, 9 aa, Homo Sapiens
PQLDAQQMK

SEQ ID NO: 1047654 - protein, 9 aa, Homo Sapiens
VAGGVLPRL

SEQ ID NO: 1047655 - protein, 9 aa, Homo Sapiens
NMEDIKVCE

SEQ ID NO: 1047656 - protein, 9 aa, Homo Sapiens
DSPQPFGGP

SEQ ID NO: 1047657 - protein, 9 aa, Homo Sapiens
PCPGPPPST

SEQ ID NO: 1047658 - protein, 9 aa, Homo Sapiens
TLDPINISD

SEQ ID NO: 1047659 - protein, 9 aa, Homo Sapiens
STSSLGKKV

SEQ ID NO: 1047660 - protein, 9 aa, Homo Sapiens
AFSEEKAGS

SEQ ID NO: 1047661 - protein, 9 aa, Homo Sapiens
VPSALNPVI

SEQ ID NO: 1047662 - protein, 9 aa, Homo Sapiens
SDCEQSQNS

SEQ ID NO: 1047663 - protein, 9 aa, Homo Sapiens
PAAILGSGF

SEQ ID NO: 1047664 - protein, 9 aa, Homo Sapiens
RPVNLKIHD

SEQ ID NO: 1047665 - protein, 9 aa, Homo Sapiens
LANSIWKGS

SEQ ID NO: 1047666 - protein, 9 aa, Homo Sapiens
KFQGIKKKF

SEQ ID NO: 1047667 - protein, 9 aa, Homo Sapiens
RRREHEFRL

SEQ ID NO: 1047668 - protein, 9 aa, Homo Sapiens
SLKGCESAV

SEQ ID NO: 1047669 - protein, 9 aa, Homo Sapiens
CREDALREA

SEQ ID NO: 1047670 - protein, 9 aa, Homo Sapiens
DCISEKVGL

SEQ ID NO: 1047671 - protein, 9 aa, Homo Sapiens
DESVDYRPV

SEQ ID NO: 1047672 - protein, 9 aa, Homo Sapiens
ALPAAILGS

SEQ ID NO: 1047673 - protein, 9 aa, Homo Sapiens
FSGEYIPTV

SEQ ID NO: 1047674 - protein, 9 aa, Homo Sapiens
PPLARAVAI

SEQ ID NO: 1047675 - protein, 9 aa, Homo Sapiens
GHLRFSGIK

SEQ ID NO: 1047676 - protein, 9 aa, Homo Sapiens
FPYHLYYGT

SEQ ID NO: 1047677 - protein, 9 aa, Homo Sapiens
LFYNNLHGL

SEQ ID NO: 1047678 - protein, 9 aa, Homo Sapiens
RVCPGNQPA

SEQ ID NO: 1047679 - protein, 9 aa, Homo Sapiens
PPQIPCQNI

SEQ ID NO: 1047680 - protein, 9 aa, Homo Sapiens
GLQPQIPHY

SEQ ID NO: 1047681 - protein, 9 aa, Homo Sapiens
KKIRKLKNE

SEQ ID NO: 1047682 - protein, 9 aa, Homo Sapiens
TGKRPFKCK

SEQ ID NO: 1047683 - protein, 9 aa, Homo Sapiens
ITFVGIGLW

SEQ ID NO: 1047684 - protein, 9 aa, Homo Sapiens
LQKHSAEGR

SEQ ID NO: 1047685 - protein, 9 aa, Homo Sapiens
LFIITLPLW

SEQ ID NO: 1047686 - protein, 9 aa, Homo Sapiens
NHFERVGGQ

SEQ ID NO: 1047687 - protein, 9 aa, Homo Sapiens
TESSNFPHP

SEQ ID NO: 1047688 - protein, 9 aa, Homo Sapiens
PTPSGLGSL

SEQ ID NO: 1047689 - protein, 9 aa, Homo Sapiens
GCSDPLYPG

SEQ ID NO: 1047690 - protein, 9 aa, Homo Sapiens
VSNRAGLIN

SEQ ID NO: 1047691 - protein, 9 aa, Homo Sapiens
DPINISDIA

SEQ ID NO: 1047692 - protein, 9 aa, Homo Sapiens
DHRQTQNFN

SEQ ID NO: 1047693 - protein, 9 aa, Homo Sapiens
ASQNVIELK

SEQ ID NO: 1047694 - protein, 9 aa, Homo Sapiens
EQSQNSNSD

SEQ ID NO: 1047695 - protein, 9 aa, Homo Sapiens
GIFLEGFVE

SEQ ID NO: 1047696 - protein, 9 aa, Homo Sapiens
LEAGVAGGV

SEQ ID NO: 1047697 - protein, 9 aa, Homo Sapiens
KMEHMVSSL

SEQ ID NO: 1047698 - protein, 9 aa, Homo Sapiens
QPPTPGSPF

SEQ ID NO: 1047699 - protein, 9 aa, Homo Sapiens
PDPQTPRPE

SEQ ID NO: 1047700 - protein, 9 aa, Homo Sapiens
LPEMKEIVL

SEQ ID NO: 1047701 - protein, 9 aa, Homo Sapiens
NLLLRMAIQ

SEQ ID NO: 1047702 - protein, 9 aa, Homo Sapiens
FLFSYCKSH

SEQ ID NO: 1047703 - protein, 9 aa, Homo Sapiens
TKEIHSAII

SEQ ID NO: 1047704 - protein, 9 aa, Homo Sapiens
QLDAQQMKI

SEQ ID NO: 1047705 - protein, 9 aa, Homo Sapiens
LYGQCLEWQ

SEQ ID NO: 1047706 - protein, 9 aa, Homo Sapiens
LSLSIHAEP

SEQ ID NO: 1047707 - protein, 9 aa, Homo Sapiens
DPQTPRPED

SEQ ID NO: 1047708 - protein, 9 aa, Homo Sapiens
LGCQALSEI

SEQ ID NO: 1047709 - protein, 9 aa, Homo Sapiens
SITFSLFNV

SEQ ID NO: 1047710 - protein, 9 aa, Homo Sapiens
FCSSIMYLT

SEQ ID NO: 1047711 - protein, 9 aa, Homo Sapiens
ANPFPYHLY

SEQ ID NO: 1047712 - protein, 9 aa, Homo Sapiens
RSHSLQKAG

SEQ ID NO: 1047713 - protein, 9 aa, Homo Sapiens
QKAKFIPHL

SEQ ID NO: 1047714 - protein, 9 aa, Homo Sapiens
SFNLLRRLA

SEQ ID NO: 1047715 - protein, 9 aa, Homo Sapiens
NEPPPPAKL

SEQ ID NO: 1047716 - protein, 9 aa, Homo Sapiens
KLSPQWSHH

SEQ ID NO: 1047717 - protein, 9 aa, Homo Sapiens
RSERILSEK

SEQ ID NO: 1047718 - protein, 9 aa, Homo Sapiens
CKFGQFSTL

SEQ ID NO: 1047719 - protein, 9 aa, Homo Sapiens
PGSTGTTLL

SEQ ID NO: 1047720 - protein, 9 aa, Homo Sapiens
EKIEETMSV

SEQ ID NO: 1047721 - protein, 9 aa, Homo Sapiens
KKVEDKKIR

SEQ ID NO: 1047722 - protein, 9 aa, Homo Sapiens
LCSASYTVS

SEQ ID NO: 1047723 - protein, 9 aa, Homo Sapiens
GTEASFQAS

SEQ ID NO: 1047724 - protein, 9 aa, Homo Sapiens
CRSGNRNSL

SEQ ID NO: 1047725 - protein, 9 aa, Homo Sapiens
LSGEDRKPK

SEQ ID NO: 1047726 - protein, 9 aa, Homo Sapiens
KFQKQIQES

SEQ ID NO: 1047727 - protein, 9 aa, Homo Sapiens
PITWDSLSG

SEQ ID NO: 1047728 - protein, 9 aa, Homo Sapiens
AGLEEYSAM

SEQ ID NO: 1047729 - protein, 9 aa, Homo Sapiens
ILKLKDLRK

SEQ ID NO: 1047730 - protein, 9 aa, Homo Sapiens
RRGRKKGEE

SEQ ID NO: 1047731 - protein, 9 aa, Homo Sapiens
ALSEIIQFY

SEQ ID NO: 1047732 - protein, 9 aa, Homo Sapiens
APTVLGHLF

SEQ ID NO: 1047733 - protein, 9 aa, Homo Sapiens
SRKSLHLVH

SEQ ID NO: 1047734 - protein, 9 aa, Homo Sapiens
RLFLFSYCK

SEQ ID NO: 1047735 - protein, 9 aa, Homo Sapiens
KTLNLLLRM

SEQ ID NO: 1047736 - protein, 9 aa, Homo Sapiens
KTKVHIIPD

SEQ ID NO: 1047737 - protein, 9 aa, Homo Sapiens
FAKYGNLNE

SEQ ID NO: 1047738 - protein, 9 aa, Homo Sapiens
EGTERQKSQ

SEQ ID NO: 1047739 - protein, 9 aa, Homo Sapiens
GSLIYGFSP

SEQ ID NO: 1047740 - protein, 9 aa, Homo Sapiens
GGMREASQN

SEQ ID NO: 1047741 - protein, 9 aa, Homo Sapiens
VNTNIEEKK

SEQ ID NO: 1047742 - protein, 9 aa, Homo Sapiens
NKKFKLGLD

SEQ ID NO: 1047743 - protein, 9 aa, Homo Sapiens
SNALCHSLQ

SEQ ID NO: 1047744 - protein, 9 aa, Homo Sapiens
LSGEVSNLF

SEQ ID NO: 1047745 - protein, 9 aa, Homo Sapiens
VVTYKVKTT

SEQ ID NO: 1047746 - protein, 9 aa, Homo Sapiens
ALSQLRKLC

SEQ ID NO: 1047747 - protein, 9 aa, Homo Sapiens
CNYLRLWTP

SEQ ID NO: 1047748 - protein, 9 aa, Homo Sapiens
VRRMPPDAE

SEQ ID NO: 1047749 - protein, 9 aa, Homo Sapiens
LKSAKLFHC

SEQ ID NO: 1047750 - protein, 9 aa, Homo Sapiens
NSIWKGSSQ

SEQ ID NO: 1047751 - protein, 9 aa, Homo Sapiens
PGYYSWRSS

SEQ ID NO: 1047752 - protein, 9 aa, Homo Sapiens
RKNFAILES

SEQ ID NO: 1047753 - protein, 9 aa, Homo Sapiens
IIGCHAYGD

SEQ ID NO: 1047754 - protein, 9 aa, Homo Sapiens
NVIELKGVS

SEQ ID NO: 1047755 - protein, 9 aa, Homo Sapiens
MYSSDAHKR

SEQ ID NO: 1047756 - protein, 9 aa, Homo Sapiens
VMEVSDQRN

SEQ ID NO: 1047757 - protein, 9 aa, Homo Sapiens
KDLRKENEF

SEQ ID NO: 1047758 - protein, 9 aa, Homo Sapiens
HSLAVAQEE

SEQ ID NO: 1047759 - protein, 9 aa, Homo Sapiens
KMKREAREN

SEQ ID NO: 1047760 - protein, 9 aa, Homo Sapiens
YGLKAESEA

SEQ ID NO: 1047761 - protein, 9 aa, Homo Sapiens
WERDGAPSL

SEQ ID NO: 1047762 - protein, 9 aa, Homo Sapiens
TPGSPFHSP

SEQ ID NO: 1047763 - protein, 9 aa, Homo Sapiens
GGCHGSRPC

SEQ ID NO: 1047764 - protein, 9 aa, Homo Sapiens
SQIYLAAHF

SEQ ID NO: 1047765 - protein, 9 aa, Homo Sapiens
FYNKDNKED

SEQ ID NO: 1047766 - protein, 9 aa, Homo Sapiens
GIKNCVSCH

SEQ ID NO: 1047767 - protein, 9 aa, Homo Sapiens
MKNERLSCT

SEQ ID NO: 1047768 - protein, 9 aa, Homo Sapiens
QNGHLRFSG

SEQ ID NO: 1047769 - protein, 9 aa, Homo Sapiens
EESILMKKN

SEQ ID NO: 1047770 - protein, 9 aa, Homo Sapiens
NRPVNLKIH

SEQ ID NO: 1047771 - protein, 9 aa, Homo Sapiens
IKVCETQIF

SEQ ID NO: 1047772 - protein, 9 aa, Homo Sapiens
RLDLAGRKL

SEQ ID NO: 1047773 - protein, 9 aa, Homo Sapiens
DCEQSQNSN

SEQ ID NO: 1047774 - protein, 9 aa, Homo Sapiens
AVILGEAQD

SEQ ID NO: 1047775 - protein, 9 aa, Homo Sapiens
KWLKNDSYK

SEQ ID NO: 1047776 - protein, 9 aa, Homo Sapiens
NKDEIEWQV

SEQ ID NO: 1047777 - protein, 9 aa, Homo Sapiens
RVYCFGQTK

SEQ ID NO: 1047778 - protein, 9 aa, Homo Sapiens
MNNKELVRK

SEQ ID NO: 1047779 - protein, 9 aa, Homo Sapiens
RPQASPPSS

SEQ ID NO: 1047780 - protein, 9 aa, Homo Sapiens
VAGGLFYNK

SEQ ID NO: 1047781 - protein, 9 aa, Homo Sapiens
PGDSSAAFQ

SEQ ID NO: 1047782 - protein, 9 aa, Homo Sapiens
RLEGSSKFP

SEQ ID NO: 1047783 - protein, 9 aa, Homo Sapiens
RGFSRKSLH

SEQ ID NO: 1047784 - protein, 9 aa, Homo Sapiens
AKYGNLNET

SEQ ID NO: 1047785 - protein, 9 aa, Homo Sapiens
LQISLDRKT

SEQ ID NO: 1047786 - protein, 9 aa, Homo Sapiens
VLVLEAIIG

SEQ ID NO: 1047787 - protein, 9 aa, Homo Sapiens
NVPNQSSEL

SEQ ID NO: 1047788 - protein, 9 aa, Homo Sapiens
CYSPHGRQK

SEQ ID NO: 1047789 - protein, 9 aa, Homo Sapiens
FLVAAMLLL

SEQ ID NO: 1047790 - protein, 9 aa, Homo Sapiens
LFFGSCIFI

SEQ ID NO: 1047791 - protein, 9 aa, Homo Sapiens
ACVIQKPIT

SEQ ID NO: 1047792 - protein, 9 aa, Homo Sapiens
KVHIIPDIP

SEQ ID NO: 1047793 - protein, 9 aa, Homo Sapiens
RSGNRNSLV

SEQ ID NO: 1047794 - protein, 9 aa, Homo Sapiens
NGGTEASFQ

SEQ ID NO: 1047795 - protein, 9 aa, Homo Sapiens
VFSWVITNY

SEQ ID NO: 1047796 - protein, 9 aa, Homo Sapiens
SRRKKGYCE

SEQ ID NO: 1047797 - protein, 9 aa, Homo Sapiens
SGQPPGDSS

SEQ ID NO: 1047798 - protein, 9 aa, Homo Sapiens
LDCISEKVG

SEQ ID NO: 1047799 - protein, 9 aa, Homo Sapiens
VVPSALNPV

SEQ ID NO: 1047800 - protein, 9 aa, Homo Sapiens
ILVLRDSFD

SEQ ID NO: 1047801 - protein, 9 aa, Homo Sapiens
HAEIDWERY

SEQ ID NO: 1047802 - protein, 9 aa, Homo Sapiens
QRRRWIIRA

SEQ ID NO: 1047803 - protein, 9 aa, Homo Sapiens
RRGIFLEGF

SEQ ID NO: 1047804 - protein, 9 aa, Homo Sapiens
LENALGKLK

SEQ ID NO: 1047805 - protein, 9 aa, Homo Sapiens
VPPQIPCQN

SEQ ID NO: 1047806 - protein, 9 aa, Homo Sapiens
AGTFQAAAT

SEQ ID NO: 1047807 - protein, 9 aa, Homo Sapiens
QTPRPEDRG

SEQ ID NO: 1047808 - protein, 9 aa, Homo Sapiens
CHAYGDQYR

SEQ ID NO: 1047809 - protein, 9 aa, Homo Sapiens
HKKDLNGGS

SEQ ID NO: 1047810 - protein, 9 aa, Homo Sapiens
VYAGPKPPP

SEQ ID NO: 1047811 - protein, 9 aa, Homo Sapiens
VTYKVKTTP

SEQ ID NO: 1047812 - protein, 9 aa, Homo Sapiens
VLGKYQAGF

SEQ ID NO: 1047813 - protein, 9 aa, Homo Sapiens
GPIKQQESD

SEQ ID NO: 1047814 - protein, 9 aa, Homo Sapiens
QLSPYAVYR

SEQ ID NO: 1047815 - protein, 9 aa, Homo Sapiens
YNPRIRPNF

SEQ ID NO: 1047816 - protein, 9 aa, Homo Sapiens
EGFFTTRAI

SEQ ID NO: 1047817 - protein, 9 aa, Homo Sapiens
DDEDAPIIT

SEQ ID NO: 1047818 - protein, 9 aa, Homo Sapiens
LIIMLKMIF

SEQ ID NO: 1047819 - protein, 9 aa, Homo Sapiens
DSSAAFQGK

SEQ ID NO: 1047820 - protein, 9 aa, Homo Sapiens
FNLLRRLAT

SEQ ID NO: 1047821 - protein, 9 aa, Homo Sapiens
FTKHKRVHE

SEQ ID NO: 1047822 - protein, 9 aa, Homo Sapiens
CSRSIEVFG

SEQ ID NO: 1047823 - protein, 9 aa, Homo Sapiens
LESANWEEA

SEQ ID NO: 1047824 - protein, 9 aa, Homo Sapiens
QVEKKILQK

SEQ ID NO: 1047825 - protein, 9 aa, Homo Sapiens
SAQFASPQN

SEQ ID NO: 1047826 - protein, 9 aa, Homo Sapiens
LLAGEYNTH

SEQ ID NO: 1047827 - protein, 9 aa, Homo Sapiens
EQMKNERLS

SEQ ID NO: 1047828 - protein, 9 aa, Homo Sapiens
QAGFSECMN

SEQ ID NO: 1047829 - protein, 9 aa, Homo Sapiens
LGSKRENKD

SEQ ID NO: 1047830 - protein, 9 aa, Homo Sapiens
LVGLIGGAV

SEQ ID NO: 1047831 - protein, 9 aa, Homo Sapiens
QPALAPPLA

SEQ ID NO: 1047832 - protein, 9 aa, Homo Sapiens
NFLFDKNFR

SEQ ID NO: 1047833 - protein, 9 aa, Homo Sapiens
HLTTTLEKH

SEQ ID NO: 1047834 - protein, 9 aa, Homo Sapiens
AQQMKIRWF

SEQ ID NO: 1047835 - protein, 9 aa, Homo Sapiens
SIHAEPYTR

SEQ ID NO: 1047836 - protein, 9 aa, Homo Sapiens
NPSLFTTNL

SEQ ID NO: 1047837 - protein, 9 aa, Homo Sapiens
VFSSLCLNL

SEQ ID NO: 1047838 - protein, 9 aa, Homo Sapiens
DDIPCYENE

SEQ ID NO: 1047839 - protein, 9 aa, Homo Sapiens
KPEDSRAPC

SEQ ID NO: 1047840 - protein, 9 aa, Homo Sapiens
GRNKTGYLS

SEQ ID NO: 1047841 - protein, 9 aa, Homo Sapiens
VAFSCISTG

SEQ ID NO: 1047842 - protein, 9 aa, Homo Sapiens
NCNYLRLWT

SEQ ID NO: 1047843 - protein, 9 aa, Homo Sapiens
TQDQMREVK

SEQ ID NO: 1047844 - protein, 9 aa, Homo Sapiens
RAILEQKEG

SEQ ID NO: 1047845 - protein, 9 aa, Homo Sapiens
KKNVLDEVA

SEQ ID NO: 1047846 - protein, 9 aa, Homo Sapiens
HQDLAARNC

SEQ ID NO: 1047847 - protein, 9 aa, Homo Sapiens
MLCQIVNFL

SEQ ID NO: 1047848 - protein, 9 aa, Homo Sapiens
FSCISTGIY

SEQ ID NO: 1047849 - protein, 9 aa, Homo Sapiens
FQFPSQVQL

SEQ ID NO: 1047850 - protein, 9 aa, Homo Sapiens
GYYSWRSSG

SEQ ID NO: 1047851 - protein, 9 aa, Homo Sapiens
TMPYPTTTP

SEQ ID NO: 1047852 - protein, 9 aa, Homo Sapiens
HIKILCSST

SEQ ID NO: 1047853 - protein, 9 aa, Homo Sapiens
KNTMPWKCH

SEQ ID NO: 1047854 - protein, 9 aa, Homo Sapiens
SGEDRKPKS

SEQ ID NO: 1047855 - protein, 9 aa, Homo Sapiens
RNSATGKKS

SEQ ID NO: 1047856 - protein, 9 aa, Homo Sapiens
ATYLQCMQH

SEQ ID NO: 1047857 - protein, 9 aa, Homo Sapiens
HEEDEEGSY

SEQ ID NO: 1047858 - protein, 9 aa, Homo Sapiens
QENCNYLRL

SEQ ID NO: 1047859 - protein, 9 aa, Homo Sapiens
LHLVHQRTH

SEQ ID NO: 1047860 - protein, 9 aa, Homo Sapiens
CPIVIKTDV

SEQ ID NO: 1047861 - protein, 9 aa, Homo Sapiens
WLLEFCSSI

SEQ ID NO: 1047862 - protein, 9 aa, Homo Sapiens
QQVEKKILQ

SEQ ID NO: 1047863 - protein, 9 aa, Homo Sapiens
SKKFQGVKT

SEQ ID NO: 1047864 - protein, 9 aa, Homo Sapiens
RKSGLYRCQ

SEQ ID NO: 1047865 - protein, 9 aa, Homo Sapiens
KSLHLVHQR

SEQ ID NO: 1047866 - protein, 9 aa, Homo Sapiens
FSWVITNYE

SEQ ID NO: 1047867 - protein, 9 aa, Homo Sapiens
GVFDDTLGF

SEQ ID NO: 1047868 - protein, 9 aa, Homo Sapiens
LNETQNNST

SEQ ID NO: 1047869 - protein, 9 aa, Homo Sapiens
ILTTMLRAL

SEQ ID NO: 1047870 - protein, 9 aa, Homo Sapiens
KVMPTKSPL

SEQ ID NO: 1047871 - protein, 9 aa, Homo Sapiens
EKKILQKRA

SEQ ID NO: 1047872 - protein, 9 aa, Homo Sapiens
NLNETQNNS

SEQ ID NO: 1047873 - protein, 9 aa, Homo Sapiens
LRLFLFSYC

SEQ ID NO: 1047874 - protein, 9 aa, Homo Sapiens
RVQEEAHYL

SEQ ID NO: 1047875 - protein, 9 aa, Homo Sapiens
CIVLFYICI

SEQ ID NO: 1047876 - protein, 9 aa, Homo Sapiens
PYRIPPLFL

SEQ ID NO: 1047877 - protein, 9 aa, Homo Sapiens
NQNLVQFSR

SEQ ID NO: 1047878 - protein, 9 aa, Homo Sapiens
NIFSVSRPE

SEQ ID NO: 1047879 - protein, 9 aa, Homo Sapiens
DIKVCETQI

SEQ ID NO: 1047880 - protein, 9 aa, Homo Sapiens
YYSWRSSGR

SEQ ID NO: 1047881 - protein, 9 aa, Homo Sapiens
GHLTQDQMR

SEQ ID NO: 1047882 - protein, 9 aa, Homo Sapiens
GCQALSEII

SEQ ID NO: 1047883 - protein, 9 aa, Homo Sapiens
YLSGWKGSP

SEQ ID NO: 1047884 - protein, 9 aa, Homo Sapiens
RVELVQFSS

SEQ ID NO: 1047885 - protein, 9 aa, Homo Sapiens
INQNLVQFS

SEQ ID NO: 1047886 - protein, 9 aa, Homo Sapiens
AFFSDDQES

SEQ ID NO: 1047887 - protein, 9 aa, Homo Sapiens
SHEKVFQFP

SEQ ID NO: 1047888 - protein, 9 aa, Homo Sapiens
SDLGLFFDD

SEQ ID NO: 1047889 - protein, 9 aa, Homo Sapiens
LSTLTTTHL

SEQ ID NO: 1047890 - protein, 9 aa, Homo Sapiens
TPLVRKICS

SEQ ID NO: 1047891 - protein, 9 aa, Homo Sapiens
RSLRYAVFD

SEQ ID NO: 1047892 - protein, 9 aa, Homo Sapiens
SELVDSCTK

SEQ ID NO: 1047893 - protein, 9 aa, Homo Sapiens
YETQWGDAP

SEQ ID NO: 1047894 - protein, 9 aa, Homo Sapiens
TKVHIIPDI

SEQ ID NO: 1047895 - protein, 9 aa, Homo Sapiens
AASQSQTFS

SEQ ID NO: 1047896 - protein, 9 aa, Homo Sapiens
TFQKGSNAL

SEQ ID NO: 1047897 - protein, 9 aa, Homo Sapiens
PQTPRPEDR

SEQ ID NO: 1047898 - protein, 9 aa, Homo Sapiens
VFSYGLGAF

SEQ ID NO: 1047899 - protein, 9 aa, Homo Sapiens
LADCSATEM

SEQ ID NO: 1047900 - protein, 9 aa, Homo Sapiens
VFIDRFCYN

SEQ ID NO: 1047901 - protein, 9 aa, Homo Sapiens
LFGWMKWLK

SEQ ID NO: 1047902 - protein, 9 aa, Homo Sapiens
QDEIWKYGL

SEQ ID NO: 1047903 - protein, 9 aa, Homo Sapiens
EKAIWLLWG

SEQ ID NO: 1047904 - protein, 9 aa, Homo Sapiens
FSETQPGPL

SEQ ID NO: 1047905 - protein, 9 aa, Homo Sapiens
RSELKLSPQ

SEQ ID NO: 1047906 - protein, 9 aa, Homo Sapiens
SPFLLVGLI

SEQ ID NO: 1047907 - protein, 9 aa, Homo Sapiens
KYQAGFSEC

SEQ ID NO: 1047908 - protein, 9 aa, Homo Sapiens
FSGIKTYID

SEQ ID NO: 1047909 - protein, 9 aa, Homo Sapiens
SSEGSSQKG

SEQ ID NO: 1047910 - protein, 9 aa, Homo Sapiens
RHTEKKLLK

SEQ ID NO: 1047911 - protein, 9 aa, Homo Sapiens
KKKMILAKR

SEQ ID NO: 1047912 - protein, 9 aa, Homo Sapiens
LFHADKNGG

SEQ ID NO: 1047913 - protein, 9 aa, Homo Sapiens
LITRSERIL

SEQ ID NO: 1047914 - protein, 9 aa, Homo Sapiens
PPVHPSERP

SEQ ID NO: 1047915 - protein, 9 aa, Homo Sapiens
SFFALPAAI

SEQ ID NO: 1047916 - protein, 9 aa, Homo Sapiens
EQQRPHSEK

SEQ ID NO: 1047917 - protein, 9 aa, Homo Sapiens
PRPEDRGCP

SEQ ID NO: 1047918 - protein, 9 aa, Homo Sapiens
KRIHTGKRP

SEQ ID NO: 1047919 - protein, 9 aa, Homo Sapiens
GKKSSKSVT

SEQ ID NO: 1047920 - protein, 9 aa, Homo Sapiens
KIWMDYFVF

SEQ ID NO: 1047921 - protein, 9 aa, Homo Sapiens
KNSELATEH

SEQ ID NO: 1047922 - protein, 9 aa, Homo Sapiens
YQYHVTYIL

SEQ ID NO: 1047923 - protein, 9 aa, Homo Sapiens
HSLQKAGEP

SEQ ID NO: 1047924 - protein, 9 aa, Homo Sapiens
NCVSCHDSD

SEQ ID NO: 1047925 - protein, 9 aa, Homo Sapiens
EDLRSFQSG

SEQ ID NO: 1047926 - protein, 9 aa, Homo Sapiens
LWKPEDSRA

SEQ ID NO: 1047927 - protein, 9 aa, Homo Sapiens
EYREQMKNE

SEQ ID NO: 1047928 - protein, 9 aa, Homo Sapiens
LFAAGTFQA

SEQ ID NO: 1047929 - protein, 9 aa, Homo Sapiens
WNSITLQQW

SEQ ID NO: 1047930 - protein, 9 aa, Homo Sapiens
MEHMVSSLC

SEQ ID NO: 1047931 - protein, 9 aa, Homo Sapiens
KDEIEWQVK

SEQ ID NO: 1047932 - protein, 9 aa, Homo Sapiens
ERRLQISQK

SEQ ID NO: 1047933 - protein, 9 aa, Homo Sapiens
IVLTSTLAF

SEQ ID NO: 1047934 - protein, 9 aa, Homo Sapiens
TMSRRKKGY

SEQ ID NO: 1047935 - protein, 9 aa, Homo Sapiens
KKILQKRAQ

SEQ ID NO: 1047936 - protein, 9 aa, Homo Sapiens
ANSQENCNY

SEQ ID NO: 1047937 - protein, 9 aa, Homo Sapiens
HTGPQCQTN

SEQ ID NO: 1047938 - protein, 9 aa, Homo Sapiens
SQLRKLCRQ

SEQ ID NO: 1047939 - protein, 9 aa, Homo Sapiens
RLQQVEKKI

SEQ ID NO: 1047940 - protein, 9 aa, Homo Sapiens
SLDSPQPFG

SEQ ID NO: 1047941 - protein, 9 aa, Homo Sapiens
HNDKIYHFY

SEQ ID NO: 1047942 - protein, 9 aa, Homo Sapiens
WLNKKFKLG

SEQ ID NO: 1047943 - protein, 9 aa, Homo Sapiens
KSTHPHFVR

SEQ ID NO: 1047944 - protein, 9 aa, Homo Sapiens
VDYRPVFVQ

SEQ ID NO: 1047945 - protein, 9 aa, Homo Sapiens
QNSNSDLRN

SEQ ID NO: 1047946 - protein, 9 aa, Homo Sapiens
STVYLMNFW

SEQ ID NO: 1047947 - protein, 9 aa, Homo Sapiens
LRQMFCSRS

SEQ ID NO: 1047948 - protein, 9 aa, Homo Sapiens
VEGFFTTRA

SEQ ID NO: 1047949 - protein, 9 aa, Homo Sapiens
RTDKTHSKK

SEQ ID NO: 1047950 - protein, 9 aa, Homo Sapiens
NAQTAVRSL

SEQ ID NO: 1047951 - protein, 9 aa, Homo Sapiens
CQGPGHPLS

SEQ ID NO: 1047952 - protein, 9 aa, Homo Sapiens
CSATEMSGR

SEQ ID NO: 1047953 - protein, 9 aa, Homo Sapiens
PEGTRVELV

SEQ ID NO: 1047954 - protein, 9 aa, Homo Sapiens
TPLPQMKNT

SEQ ID NO: 1047955 - protein, 9 aa, Homo Sapiens
NKNGGTEAS

SEQ ID NO: 1047956 - protein, 9 aa, Homo Sapiens
SLPYINQKK

SEQ ID NO: 1047957 - protein, 9 aa, Homo Sapiens
GLSSVRLHS

SEQ ID NO: 1047958 - protein, 9 aa, Homo Sapiens
STGTTLLPD

SEQ ID NO: 1047959 - protein, 9 aa, Homo Sapiens
RTRSRALVN

SEQ ID NO: 1047960 - protein, 9 aa, Homo Sapiens
SNAYIISFL

SEQ ID NO: 1047961 - protein, 9 aa, Homo Sapiens
FNAEAVCRS

SEQ ID NO: 1047962 - protein, 9 aa, Homo Sapiens
PQASPPSSC

SEQ ID NO: 1047963 - protein, 9 aa, Homo Sapiens
LSKKQYDEF

SEQ ID NO: 1047964 - protein, 9 aa, Homo Sapiens
VTPLEAGVA

SEQ ID NO: 1047965 - protein, 9 aa, Homo Sapiens
SKCVCREAL

SEQ ID NO: 1047966 - protein, 9 aa, Homo Sapiens
SRLSVGVHR

SEQ ID NO: 1047967 - protein, 9 aa, Homo Sapiens
QGIKKKFNV

SEQ ID NO: 1047968 - protein, 9 aa, Homo Sapiens
QVFKIADIV

SEQ ID NO: 1047969 - protein, 9 aa, Homo Sapiens
CVQKPCQPG

SEQ ID NO: 1047970 - protein, 9 aa, Homo Sapiens
IQIDGVSWN

SEQ ID NO: 1047971 - protein, 9 aa, Homo Sapiens
FSTLKLKSL

SEQ ID NO: 1047972 - protein, 9 aa, Homo Sapiens
SGIKTYIDP

SEQ ID NO: 1047973 - protein, 9 aa, Homo Sapiens
PGYKGHQGQ

SEQ ID NO: 1047974 - protein, 9 aa, Homo Sapiens
VNSLEKFLF

SEQ ID NO: 1047975 - protein, 9 aa, Homo Sapiens
GSSQKGGED

SEQ ID NO: 1047976 - protein, 9 aa, Homo Sapiens
PQMKNTMPW

SEQ ID NO: 1047977 - protein, 9 aa, Homo Sapiens
PPQLKALGN

SEQ ID NO: 1047978 - protein, 9 aa, Homo Sapiens
SIIFSNFLF

SEQ ID NO: 1047979 - protein, 9 aa, Homo Sapiens
NPCIPKLHM

SEQ ID NO: 1047980 - protein, 9 aa, Homo Sapiens
YKQDPTLRD

SEQ ID NO: 1047981 - protein, 9 aa, Homo Sapiens
GVYAGPKPP

SEQ ID NO: 1047982 - protein, 9 aa, Homo Sapiens
VDPAGNSVS

SEQ ID NO: 1047983 - protein, 9 aa, Homo Sapiens
NYRDINIDN

SEQ ID NO: 1047984 - protein, 9 aa, Homo Sapiens
NQYPVFSWV

SEQ ID NO: 1047985 - protein, 9 aa, Homo Sapiens
RPKTKPESL

SEQ ID NO: 1047986 - protein, 9 aa, Homo Sapiens
TQLPREVGT

SEQ ID NO: 1047987 - protein, 9 aa, Homo Sapiens
LFILGWPNQ

SEQ ID NO: 1047988 - protein, 9 aa, Homo Sapiens
DSLDSPQPF

SEQ ID NO: 1047989 - protein, 9 aa, Homo Sapiens
VTCINQQLD

SEQ ID NO: 1047990 - protein, 9 aa, Homo Sapiens
INIDNETVF

SEQ ID NO: 1047991 - protein, 9 aa, Homo Sapiens
RGCRSGNRN

SEQ ID NO: 1047992 - protein, 9 aa, Homo Sapiens
DIMNDEDKI

SEQ ID NO: 1047993 - protein, 9 aa, Homo Sapiens
SFLYGQCLE

SEQ ID NO: 1047994 - protein, 9 aa, Homo Sapiens
QKHSAEGRQ

SEQ ID NO: 1047995 - protein, 9 aa, Homo Sapiens
SGPFQANPF

SEQ ID NO: 1047996 - protein, 9 aa, Homo Sapiens
IQKPITWDS

SEQ ID NO: 1047997 - protein, 9 aa, Homo Sapiens
SSLCLKRCR

SEQ ID NO: 1047998 - protein, 9 aa, Homo Sapiens
PLQLRWDRN

SEQ ID NO: 1047999 - protein, 9 aa, Homo Sapiens
GTVFSSLCL

SEQ ID NO: 1048000 - protein, 9 aa, Homo Sapiens
KYPLVVFSY

SEQ ID NO: 1048001 - protein, 9 aa, Homo Sapiens
CETQIFDYR

SEQ ID NO: 1048002 - protein, 9 aa, Homo Sapiens
IPCYENELS

SEQ ID NO: 1048003 - protein, 9 aa, Homo Sapiens
LSSAVTSPS

SEQ ID NO: 1048004 - protein, 9 aa, Homo Sapiens
LEPPVAGPG

SEQ ID NO: 1048005 - protein, 9 aa, Homo Sapiens
KRSHSLQKA

SEQ ID NO: 1048006 - protein, 9 aa, Homo Sapiens
QEPENDCRN

SEQ ID NO: 1048007 - protein, 9 aa, Homo Sapiens
VNLKIHDIF

SEQ ID NO: 1048008 - protein, 9 aa, Homo Sapiens
KIADIVDQM

SEQ ID NO: 1048009 - protein, 9 aa, Homo Sapiens
SVGFEAQMI

SEQ ID NO: 1048010 - protein, 9 aa, Homo Sapiens
QNIFSVSRP

SEQ ID NO: 1048011 - protein, 9 aa, Homo Sapiens
EKKEEVTEA

SEQ ID NO: 1048012 - protein, 9 aa, Homo Sapiens
CTWMKFQKQ

SEQ ID NO: 1048013 - protein, 9 aa, Homo Sapiens
QSPIKLSAS

SEQ ID NO: 1048014 - protein, 9 aa, Homo Sapiens
LEGFVELLG

SEQ ID NO: 1048015 - protein, 9 aa, Homo Sapiens
QKISAHRTE

SEQ ID NO: 1048016 - protein, 9 aa, Homo Sapiens
TKEKTVSEA

SEQ ID NO: 1048017 - protein, 9 aa, Homo Sapiens
RKICSDLQR

SEQ ID NO: 1048018 - protein, 9 aa, Homo Sapiens
ANSIWKGSS

SEQ ID NO: 1048019 - protein, 9 aa, Homo Sapiens
VFDDTLGFF

SEQ ID NO: 1048020 - protein, 9 aa, Homo Sapiens
YKKRSTCMK

SEQ ID NO: 1048021 - protein, 9 aa, Homo Sapiens
ILMKKNVLD

SEQ ID NO: 1048022 - protein, 9 aa, Homo Sapiens
ISSFRQSLR

SEQ ID NO: 1048023 - protein, 9 aa, Homo Sapiens
LFAPVSFPS

SEQ ID NO: 1048024 - protein, 9 aa, Homo Sapiens
LAKPITKSL

SEQ ID NO: 1048025 - protein, 9 aa, Homo Sapiens
HIIPDIPQI

SEQ ID NO: 1048026 - protein, 9 aa, Homo Sapiens
IVLRDWSNS

SEQ ID NO: 1048027 - protein, 9 aa, Homo Sapiens
QNKTRSKGI

SEQ ID NO: 1048028 - protein, 9 aa, Homo Sapiens
NVCLSQIYL

SEQ ID NO: 1048029 - protein, 9 aa, Homo Sapiens
ASQILENRE

SEQ ID NO: 1048030 - protein, 9 aa, Homo Sapiens
NVGTSGDYD

SEQ ID NO: 1048031 - protein, 9 aa, Homo Sapiens
DPLYPGVYA

SEQ ID NO: 1048032 - protein, 9 aa, Homo Sapiens
QHLVSEEQF

SEQ ID NO: 1048033 - protein, 9 aa, Homo Sapiens
NTNIEEKKE

SEQ ID NO: 1048034 - protein, 9 aa, Homo Sapiens
ISYTTNAFS

SEQ ID NO: 1048035 - protein, 9 aa, Homo Sapiens
LEAIIGDWV

SEQ ID NO: 1048036 - protein, 9 aa, Homo Sapiens
ASPQNGIPA

SEQ ID NO: 1048037 - protein, 9 aa, Homo Sapiens
FPHPQQSQH

SEQ ID NO: 1048038 - protein, 9 aa, Homo Sapiens
LDLAGRKLP

SEQ ID NO: 1048039 - protein, 9 aa, Homo Sapiens
LCIVLFYIC

SEQ ID NO: 1048040 - protein, 9 aa, Homo Sapiens
LVLWKPEDS

SEQ ID NO: 1048041 - protein, 9 aa, Homo Sapiens
FILGWPNQS

SEQ ID NO: 1048042 - protein, 9 aa, Homo Sapiens
QRNCGYPGI

SEQ ID NO: 1048043 - protein, 9 aa, Homo Sapiens
MDYFVFANN

SEQ ID NO: 1048044 - protein, 9 aa, Homo Sapiens
VEDKKIRKL

SEQ ID NO: 1048045 - protein, 9 aa, Homo Sapiens
CSSIMYLTK

SEQ ID NO: 1048046 - protein, 9 aa, Homo Sapiens
EQKEGQEMA

SEQ ID NO: 1048047 - protein, 9 aa, Homo Sapiens
PELADCSAT

SEQ ID NO: 1048048 - protein, 9 aa, Homo Sapiens
KGVWCYVAG

SEQ ID NO: 1048049 - protein, 9 aa, Homo Sapiens
TVTSQQEVK

SEQ ID NO: 1048050 - protein, 9 aa, Homo Sapiens
LMMPNEARL

SEQ ID NO: 1048051 - protein, 9 aa, Homo Sapiens
LYVIGGRNK

SEQ ID NO: 1048052 - protein, 9 aa, Homo Sapiens
GLFYNKDNK

SEQ ID NO: 1048053 - protein, 9 aa, Homo Sapiens
LFFICQIPL

SEQ ID NO: 1048054 - protein, 9 aa, Homo Sapiens
TCINQQLDT

SEQ ID NO: 1048055 - protein, 9 aa, Homo Sapiens
ILESANWEE

SEQ ID NO: 1048056 - protein, 9 aa, Homo Sapiens
SFPSGSTED

SEQ ID NO: 1048057 - protein, 9 aa, Homo Sapiens
SYAQGRGKF

SEQ ID NO: 1048058 - protein, 9 aa, Homo Sapiens
YYTWKKIMQ

SEQ ID NO: 1048059 - protein, 9 aa, Homo Sapiens
PGLLRPMEE

SEQ ID NO: 1048060 - protein, 9 aa, Homo Sapiens
LYTKLQSMN

SEQ ID NO: 1048061 - protein, 9 aa, Homo Sapiens
FSNSEALCS

SEQ ID NO: 1048062 - protein, 9 aa, Homo Sapiens
EVKVKFPPN

SEQ ID NO: 1048063 - protein, 9 aa, Homo Sapiens
SQRKRRTSV

SEQ ID NO: 1048064 - protein, 9 aa, Homo Sapiens
VEKKILQKR

SEQ ID NO: 1048065 - protein, 9 aa, Homo Sapiens
TEKEATGLS

SEQ ID NO: 1048066 - protein, 9 aa, Homo Sapiens
KAKFIPHLE

SEQ ID NO: 1048067 - protein, 9 aa, Homo Sapiens
IYFLLSFIS

SEQ ID NO: 1048068 - protein, 9 aa, Homo Sapiens
RPEDRGCPA

SEQ ID NO: 1048069 - protein, 9 aa, Homo Sapiens
GGSGINEFK

SEQ ID NO: 1048070 - protein, 9 aa, Homo Sapiens
FALPAAILG

SEQ ID NO: 1048071 - protein, 9 aa, Homo Sapiens
ETQWGDAPS

SEQ ID NO: 1048072 - protein, 9 aa, Homo Sapiens
GSYYSALSD

SEQ ID NO: 1048073 - protein, 9 aa, Homo Sapiens
AIYSALYNG

SEQ ID NO: 1048074 - protein, 9 aa, Homo Sapiens
DGDEKGVWC

SEQ ID NO: 1048075 - protein, 9 aa, Homo Sapiens
LPSWCDQVL

SEQ ID NO: 1048076 - protein, 9 aa, Homo Sapiens
MRKVMLITK

SEQ ID NO: 1048077 - protein, 9 aa, Homo Sapiens
IEWQVKSPA

SEQ ID NO: 1048078 - protein, 9 aa, Homo Sapiens
EYGESFIYS

SEQ ID NO: 1048079 - protein, 9 aa, Homo Sapiens
EHLRVCPGN

SEQ ID NO: 1048080 - protein, 9 aa, Homo Sapiens
MNKNGGTEA

SEQ ID NO: 1048081 - protein, 9 aa, Homo Sapiens
IGPSRISAI

SEQ ID NO: 1048082 - protein, 9 aa, Homo Sapiens
KSQSGLVWR

SEQ ID NO: 1048083 - protein, 9 aa, Homo Sapiens
SVVVTYKVK

SEQ ID NO: 1048084 - protein, 9 aa, Homo Sapiens
GGDNSLCKT

SEQ ID NO: 1048085 - protein, 9 aa, Homo Sapiens
KIKPLAFST

SEQ ID NO: 1048086 - protein, 9 aa, Homo Sapiens
ISLDRKTST

SEQ ID NO: 1048087 - protein, 9 aa, Homo Sapiens
FSVQSQAPC

SEQ ID NO: 1048088 - protein, 9 aa, Homo Sapiens
SCRDSLFVP

SEQ ID NO: 1048089 - protein, 9 aa, Homo Sapiens
AILEQKEGQ

SEQ ID NO: 1048090 - protein, 9 aa, Homo Sapiens
KFLFKSWMS

SEQ ID NO: 1048091 - protein, 9 aa, Homo Sapiens
GGEGASEKI

SEQ ID NO: 1048092 - protein, 9 aa, Homo Sapiens
QFPCPSSHW

SEQ ID NO: 1048093 - protein, 9 aa, Homo Sapiens
QIPHYRVAG

SEQ ID NO: 1048094 - protein, 9 aa, Homo Sapiens
TKTPLPQMK

SEQ ID NO: 1048095 - protein, 9 aa, Homo Sapiens
VGLIGGAVI

SEQ ID NO: 1048096 - protein, 9 aa, Homo Sapiens
LKMKREARE

SEQ ID NO: 1048097 - protein, 9 aa, Homo Sapiens
PPKVEDRSN

SEQ ID NO: 1048098 - protein, 9 aa, Homo Sapiens
IRNQVKKKM

SEQ ID NO: 1048099 - protein, 9 aa, Homo Sapiens
TPLEAGVAG

SEQ ID NO: 1048100 - protein, 9 aa, Homo Sapiens
HEKVFQFPS

SEQ ID NO: 1048101 - protein, 9 aa, Homo Sapiens
LQKKVQKEY

SEQ ID NO: 1048102 - protein, 9 aa, Homo Sapiens
GGLFYNKDN

SEQ ID NO: 1048103 - protein, 9 aa, Homo Sapiens
VSQRKRRTS

SEQ ID NO: 1048104 - protein, 9 aa, Homo Sapiens
SHLIELNIK

SEQ ID NO: 1048105 - protein, 9 aa, Homo Sapiens
FFTTRAIKD

SEQ ID NO: 1048106 - protein, 9 aa, Homo Sapiens
FIDKNNLRD

SEQ ID NO: 1048107 - protein, 9 aa, Homo Sapiens
IFDAIFTLF

SEQ ID NO: 1048108 - protein, 9 aa, Homo Sapiens
LATYLQCMQ

SEQ ID NO: 1048109 - protein, 9 aa, Homo Sapiens
SLDRKTSTD

SEQ ID NO: 1048110 - protein, 9 aa, Homo Sapiens
KNFAILESA

SEQ ID NO: 1048111 - protein, 9 aa, Homo Sapiens
KSSKSVTVR

SEQ ID NO: 1048112 - protein, 9 aa, Homo Sapiens
QSRVLSSSL

SEQ ID NO: 1048113 - protein, 9 aa, Homo Sapiens
IIFSNFLFD

SEQ ID NO: 1048114 - protein, 9 aa, Homo Sapiens
IAVILGEAQ

SEQ ID NO: 1048115 - protein, 9 aa, Homo Sapiens
TVEYFLSKK

SEQ ID NO: 1048116 - protein, 9 aa, Homo Sapiens
GNYDNRRSF

SEQ ID NO: 1048117 - protein, 9 aa, Homo Sapiens
LTTVTIPNE

SEQ ID NO: 1048118 - protein, 9 aa, Homo Sapiens
KRPFKCKYC

SEQ ID NO: 1048119 - protein, 9 aa, Homo Sapiens
SSELLAGEY

SEQ ID NO: 1048120 - protein, 9 aa, Homo Sapiens
QVVVSQSGP

SEQ ID NO: 1048121 - protein, 9 aa, Homo Sapiens
YFLSKKQYD

SEQ ID NO: 1048122 - protein, 9 aa, Homo Sapiens
INLDIKYKK

SEQ ID NO: 1048123 - protein, 9 aa, Homo Sapiens
SEGTERQKS

SEQ ID NO: 1048124 - protein, 9 aa, Homo Sapiens
SELLAGEYN

SEQ ID NO: 1048125 - protein, 9 aa, Homo Sapiens
LLISDLKMK

SEQ ID NO: 1048126 - protein, 9 aa, Homo Sapiens
DTAGLEEYS

SEQ ID NO: 1048127 - protein, 9 aa, Homo Sapiens
MNMEDIKVC

SEQ ID NO: 1048128 - protein, 9 aa, Homo Sapiens
GHPLSGQRP

SEQ ID NO: 1048129 - protein, 9 aa, Homo Sapiens
LSLDSKLVL

SEQ ID NO: 1048130 - protein, 9 aa, Homo Sapiens
VLLYTDQHG

SEQ ID NO: 1048131 - protein, 9 aa, Homo Sapiens
LKNDSYKPT

SEQ ID NO: 1048132 - protein, 9 aa, Homo Sapiens
LFYICIIST

SEQ ID NO: 1048133 - protein, 9 aa, Homo Sapiens
SLCKTITGV

SEQ ID NO: 1048134 - protein, 9 aa, Homo Sapiens
SWNSITLQQ

SEQ ID NO: 1048135 - protein, 9 aa, Homo Sapiens
KSARHLYLC

SEQ ID NO: 1048136 - protein, 9 aa, Homo Sapiens
VFKIADIVD

SEQ ID NO: 1048137 - protein, 9 aa, Homo Sapiens
LVIRLRVHP

SEQ ID NO: 1048138 - protein, 9 aa, Homo Sapiens
EEAHYLVEE

SEQ ID NO: 1048139 - protein, 9 aa, Homo Sapiens
KPITWDSLS

SEQ ID NO: 1048140 - protein, 9 aa, Homo Sapiens
RVLSSSLML

SEQ ID NO: 1048141 - protein, 9 aa, Homo Sapiens
PLSTLTTTH

SEQ ID NO: 1048142 - protein, 9 aa, Homo Sapiens
YPLVVFSYG

SEQ ID NO: 1048143 - protein, 9 aa, Homo Sapiens
KLKVEGNFY

SEQ ID NO: 1048144 - protein, 9 aa, Homo Sapiens
YLVEELRKT

SEQ ID NO: 1048145 - protein, 9 aa, Homo Sapiens
QEVASSLIF

SEQ ID NO: 1048146 - protein, 9 aa, Homo Sapiens
FPLFILGWP

SEQ ID NO: 1048147 - protein, 9 aa, Homo Sapiens
FLHQDLAAR

SEQ ID NO: 1048148 - protein, 9 aa, Homo Sapiens
PQAPAFSEE

SEQ ID NO: 1048149 - protein, 9 aa, Homo Sapiens
TTMLRALGI

SEQ ID NO: 1048150 - protein, 9 aa, Homo Sapiens
NIRSVAFSC

SEQ ID NO: 1048151 - protein, 9 aa, Homo Sapiens
SLSLDSKLV

SEQ ID NO: 1048152 - protein, 9 aa, Homo Sapiens
HGPSFTIEK

SEQ ID NO: 1048153 - protein, 9 aa, Homo Sapiens
ERLSCTRES

SEQ ID NO: 1048154 - protein, 9 aa, Homo Sapiens
EIVLRDWSN

SEQ ID NO: 1048155 - protein, 9 aa, Homo Sapiens
RPATGTACL

SEQ ID NO: 1048156 - protein, 9 aa, Homo Sapiens
DDTLGFFST

SEQ ID NO: 1048157 - protein, 9 aa, Homo Sapiens
VFRIRDKDS

SEQ ID NO: 1048158 - protein, 9 aa, Homo Sapiens
IPCQNIFSV

SEQ ID NO: 1048159 - protein, 9 aa, Homo Sapiens
SDAHKRPPS

SEQ ID NO: 1048160 - protein, 9 aa, Homo Sapiens
PPNSPCPGP

SEQ ID NO: 1048161 - protein, 9 aa, Homo Sapiens
KVQKEYGKC

SEQ ID NO: 1048162 - protein, 9 aa, Homo Sapiens
TFYQLEELE

SEQ ID NO: 1048163 - protein, 9 aa, Homo Sapiens
NLVFLDVSG

SEQ ID NO: 1048164 - protein, 9 aa, Homo Sapiens
RNSLVVGTP

SEQ ID NO: 1048165 - protein, 9 aa, Homo Sapiens
SLFTTNLSG

SEQ ID NO: 1048166 - protein, 9 aa, Homo Sapiens
PATGTACLP

SEQ ID NO: 1048167 - protein, 9 aa, Homo Sapiens
VAVFRIRDK

SEQ ID NO: 1048168 - protein, 9 aa, Homo Sapiens
SSNFPHPQQ

SEQ ID NO: 1048169 - protein, 9 aa, Homo Sapiens
VVVSQSGPS

SEQ ID NO: 1048170 - protein, 9 aa, Homo Sapiens
ALRFEDQIT

SEQ ID NO: 1048171 - protein, 9 aa, Homo Sapiens
GNHFERVGG

SEQ ID NO: 1048172 - protein, 9 aa, Homo Sapiens
NAYIISFLY

SEQ ID NO: 1048173 - protein, 9 aa, Homo Sapiens
PVHPSERPT

SEQ ID NO: 1048174 - protein, 9 aa, Homo Sapiens
SNVGTSGDY

SEQ ID NO: 1048175 - protein, 9 aa, Homo Sapiens
TEINYLCLS

SEQ ID NO: 1048176 - protein, 9 aa, Homo Sapiens
PPSSCTSAN

SEQ ID NO: 1048177 - protein, 9 aa, Homo Sapiens
ISFLYGQCL

SEQ ID NO: 1048178 - protein, 9 aa, Homo Sapiens
DKDSGNNGK

SEQ ID NO: 1048179 - protein, 9 aa, Homo Sapiens
MENTLKSHF

SEQ ID NO: 1048180 - protein, 9 aa, Homo Sapiens
CQTNTDYCV

SEQ ID NO: 1048181 - protein, 9 aa, Homo Sapiens
DVPTMAGEK

SEQ ID NO: 1048182 - protein, 9 aa, Homo Sapiens
VIKHPVMCS

SEQ ID NO: 1048183 - protein, 9 aa, Homo Sapiens
EDKIEDDDE

SEQ ID NO: 1048184 - protein, 9 aa, Homo Sapiens
DEDKIEDDD

SEQ ID NO: 1048185 - protein, 9 aa, Homo Sapiens
NGFHAEIDW

SEQ ID NO: 1048186 - protein, 9 aa, Homo Sapiens
QFVRTEQDK

SEQ ID NO: 1048187 - protein, 9 aa, Homo Sapiens
HLFVRDQRT

SEQ ID NO: 1048188 - protein, 9 aa, Homo Sapiens
LEGSSKFPV

SEQ ID NO: 1048189 - protein, 9 aa, Homo Sapiens
RNHQPPQLK

SEQ ID NO: 1048190 - protein, 9 aa, Homo Sapiens
PIKYLKKSL

SEQ ID NO: 1048191 - protein, 9 aa, Homo Sapiens
LLVGLIGGA

SEQ ID NO: 1048192 - protein, 9 aa, Homo Sapiens
GNLSSASVI

SEQ ID NO: 1048193 - protein, 9 aa, Homo Sapiens
LGIAVILGE

SEQ ID NO: 1048194 - protein, 9 aa, Homo Sapiens
FSRKSLHLV

SEQ ID NO: 1048195 - protein, 9 aa, Homo Sapiens
LSHTDVLLY

SEQ ID NO: 1048196 - protein, 9 aa, Homo Sapiens
KPYEYLADE

SEQ ID NO: 1048197 - protein, 9 aa, Homo Sapiens
LVLRDSFDD

SEQ ID NO: 1048198 - protein, 9 aa, Homo Sapiens
SYPVTDISD

SEQ ID NO: 1048199 - protein, 9 aa, Homo Sapiens
KKYILYPAL

SEQ ID NO: 1048200 - protein, 9 aa, Homo Sapiens
VSWGRGCSD

SEQ ID NO: 1048201 - protein, 9 aa, Homo Sapiens
KGEEDQNPP

SEQ ID NO: 1048202 - protein, 9 aa, Homo Sapiens
FSGLVPDDT

SEQ ID NO: 1048203 - protein, 9 aa, Homo Sapiens
FLCIVLFYI

SEQ ID NO: 1048204 - protein, 9 aa, Homo Sapiens
SKPGPPVQP

SEQ ID NO: 1048205 - protein, 9 aa, Homo Sapiens
KEQRQKMKK

SEQ ID NO: 1048206 - protein, 9 aa, Homo Sapiens
PFPLGPPCL

SEQ ID NO: 1048207 - protein, 9 aa, Homo Sapiens
NSVSYSIHS

SEQ ID NO: 1048208 - protein, 9 aa, Homo Sapiens
QKEGQEMAT

SEQ ID NO: 1048209 - protein, 9 aa, Homo Sapiens
YIISFLYGQ

SEQ ID NO: 1048210 - protein, 9 aa, Homo Sapiens
KLFLVAAML

SEQ ID NO: 1048211 - protein, 9 aa, Homo Sapiens
TWMKFQKQI

SEQ ID NO: 1048212 - protein, 9 aa, Homo Sapiens
SQILENREE

SEQ ID NO: 1048213 - protein, 9 aa, Homo Sapiens
VFEINKDEI

SEQ ID NO: 1048214 - protein, 9 aa, Homo Sapiens
CRDSLFVPR

SEQ ID NO: 1048215 - protein, 9 aa, Homo Sapiens
ALCSASYTV

SEQ ID NO: 1048216 - protein, 9 aa, Homo Sapiens
SQENCNYLR

SEQ ID NO: 1048217 - protein, 9 aa, Homo Sapiens
YKPHLNLPL

SEQ ID NO: 1048218 - protein, 9 aa, Homo Sapiens
SLRYAVFDL

SEQ ID NO: 1048219 - protein, 9 aa, Homo Sapiens
ELRTMNNKE

SEQ ID NO: 1048220 - protein, 9 aa, Homo Sapiens
YGNLNETQN

SEQ ID NO: 1048221 - protein, 9 aa, Homo Sapiens
YQRRRWIIR

SEQ ID NO: 1048222 - protein, 9 aa, Homo Sapiens
GMREASQNV

SEQ ID NO: 1048223 - protein, 9 aa, Homo Sapiens
KKFNVSKKV

SEQ ID NO: 1048224 - protein, 9 aa, Homo Sapiens
DSSEGSSQK

SEQ ID NO: 1048225 - protein, 9 aa, Homo Sapiens
GRKLPDYLM

SEQ ID NO: 1048226 - protein, 9 aa, Homo Sapiens
GAPNGFHAE

SEQ ID NO: 1048227 - protein, 9 aa, Homo Sapiens
PLPQMKNTM

SEQ ID NO: 1048228 - protein, 9 aa, Homo Sapiens
PPPNSPCPG

SEQ ID NO: 1048229 - protein, 9 aa, Homo Sapiens
EDRSNSAEP

SEQ ID NO: 1048230 - protein, 9 aa, Homo Sapiens
SYTTNAFSG

SEQ ID NO: 1048231 - protein, 9 aa, Homo Sapiens
LVSLQKHSA

SEQ ID NO: 1048232 - protein, 9 aa, Homo Sapiens
YKVKTTPPS

SEQ ID NO: 1048233 - protein, 9 aa, Homo Sapiens
KNPCIPKLH

SEQ ID NO: 1048234 - protein, 9 aa, Homo Sapiens
YLPGEHLRV

SEQ ID NO: 1048235 - protein, 9 aa, Homo Sapiens
STTPLNHVP

SEQ ID NO: 1048236 - protein, 9 aa, Homo Sapiens
PEEDKFENE

SEQ ID NO: 1048237 - protein, 9 aa, Homo Sapiens
LVVFSYGLG

SEQ ID NO: 1048238 - protein, 9 aa, Homo Sapiens
MVEGFFTTR

SEQ ID NO: 1048239 - protein, 9 aa, Homo Sapiens
ITKSLAQGD

SEQ ID NO: 1048240 - protein, 9 aa, Homo Sapiens
LQKTCYQIV

SEQ ID NO: 1048241 - protein, 9 aa, Homo Sapiens
CHKLLGHVP

SEQ ID NO: 1048242 - protein, 9 aa, Homo Sapiens
GIKKKFNVS

SEQ ID NO: 1048243 - protein, 9 aa, Homo Sapiens
LNKKFKLGL

SEQ ID NO: 1048244 - protein, 9 aa, Homo Sapiens
GTFQAAATL

SEQ ID NO: 1048245 - protein, 9 aa, Homo Sapiens
GASAFLTTI

SEQ ID NO: 1048246 - protein, 9 aa, Homo Sapiens
KEGQEMATI

SEQ ID NO: 1048247 - protein, 9 aa, Homo Sapiens
ASVIRPCYS

SEQ ID NO: 1048248 - protein, 9 aa, Homo Sapiens
SHSLQKAGE

SEQ ID NO: 1048249 - protein, 9 aa, Homo Sapiens
PRQLSGEDR

SEQ ID NO: 1048250 - protein, 9 aa, Homo Sapiens
RGSPLILYQ

SEQ ID NO: 1048251 - protein, 9 aa, Homo Sapiens
KRPPSPSLG

SEQ ID NO: 1048252 - protein, 9 aa, Homo Sapiens
DNRRSFGEL

SEQ ID NO: 1048253 - protein, 9 aa, Homo Sapiens
SRISAIKDR

SEQ ID NO: 1048254 - protein, 9 aa, Homo Sapiens
DKTHSKKFQ

SEQ ID NO: 1048255 - protein, 9 aa, Homo Sapiens
FYQLEELEK

SEQ ID NO: 1048256 - protein, 9 aa, Homo Sapiens
FFRIEYDTF

SEQ ID NO: 1048257 - protein, 9 aa, Homo Sapiens
KIRWFRSQT

SEQ ID NO: 1048258 - protein, 9 aa, Homo Sapiens
LCLKRCRSA

SEQ ID NO: 1048259 - protein, 9 aa, Homo Sapiens
IVVTLFFGS

SEQ ID NO: 1048260 - protein, 9 aa, Homo Sapiens
LTSHSLSCR

SEQ ID NO: 1048261 - protein, 9 aa, Homo Sapiens
VQGQARREI

SEQ ID NO: 1048262 - protein, 9 aa, Homo Sapiens
LQAGNGPPQ

SEQ ID NO: 1048263 - protein, 9 aa, Homo Sapiens
TPQTTGRLE

SEQ ID NO: 1048264 - protein, 9 aa, Homo Sapiens
INYLCLSPP

SEQ ID NO: 1048265 - protein, 9 aa, Homo Sapiens
QQFPCPSSH

SEQ ID NO: 1048266 - protein, 9 aa, Homo Sapiens
YNKDNKEDP

SEQ ID NO: 1048267 - protein, 9 aa, Homo Sapiens
KNRHTIEVN

SEQ ID NO: 1048268 - protein, 9 aa, Homo Sapiens
SQNSNSDLR

SEQ ID NO: 1048269 - protein, 9 aa, Homo Sapiens
ARPATGTAC

SEQ ID NO: 1048270 - protein, 9 aa, Homo Sapiens
GHKRIHTGK

SEQ ID NO: 1048271 - protein, 9 aa, Homo Sapiens
LGKMIFYLK

SEQ ID NO: 1048272 - protein, 9 aa, Homo Sapiens
SGNRNSLVV

SEQ ID NO: 1048273 - protein, 9 aa, Homo Sapiens
PLILYQFFH

SEQ ID NO: 1048274 - protein, 9 aa, Homo Sapiens
PWVIWWNLQ

SEQ ID NO: 1048275 - protein, 9 aa, Homo Sapiens
PSSCTSANG

SEQ ID NO: 1048276 - protein, 9 aa, Homo Sapiens
SARGGCHGS

SEQ ID NO: 1048277 - protein, 9 aa, Homo Sapiens
VTSPSRTSL

SEQ ID NO: 1048278 - protein, 9 aa, Homo Sapiens
GRAVLGESG

SEQ ID NO: 1048279 - protein, 9 aa, Homo Sapiens
SPLILYQFF

SEQ ID NO: 1048280 - protein, 9 aa, Homo Sapiens
SAFLTTINF

SEQ ID NO: 1048281 - protein, 9 aa, Homo Sapiens
PQIPCQNIF

SEQ ID NO: 1048282 - protein, 9 aa, Homo Sapiens
SWRSSGRGS

SEQ ID NO: 1048283 - protein, 9 aa, Homo Sapiens
CDDIPCYEN

SEQ ID NO: 1048284 - protein, 9 aa, Homo Sapiens
HLRVCPGNQ

SEQ ID NO: 1048285 - protein, 9 aa, Homo Sapiens
AIFTLFLNP

SEQ ID NO: 1048286 - protein, 9 aa, Homo Sapiens
TIAPTVLGH

SEQ ID NO: 1048287 - protein, 9 aa, Homo Sapiens
NRNHQPPQL

SEQ ID NO: 1048288 - protein, 9 aa, Homo Sapiens
DMKKKVRIN

SEQ ID NO: 1048289 - protein, 9 aa, Homo Sapiens
SFQQNLFHA

SEQ ID NO: 1048290 - protein, 9 aa, Homo Sapiens
LQQVEKKIL

SEQ ID NO: 1048291 - protein, 9 aa, Homo Sapiens
QNVIELKGV

SEQ ID NO: 1048292 - protein, 9 aa, Homo Sapiens
QHIKILCSS

SEQ ID NO: 1048293 - protein, 9 aa, Homo Sapiens
GRLIYFLLS

SEQ ID NO: 1048294 - protein, 9 aa, Homo Sapiens
PNEIKTLRK

SEQ ID NO: 1048295 - protein, 9 aa, Homo Sapiens
RQKVPTEKE

SEQ ID NO: 1048296 - protein, 9 aa, Homo Sapiens
AARMASQNF

SEQ ID NO: 1048297 - protein, 9 aa, Homo Sapiens
NSLEKFLFK

SEQ ID NO: 1048298 - protein, 9 aa, Homo Sapiens
ENSPVLLLD

SEQ ID NO: 1048299 - protein, 9 aa, Homo Sapiens
IKHSFNLLR

SEQ ID NO: 1048300 - protein, 9 aa, Homo Sapiens
SFRQSLRLG

SEQ ID NO: 1048301 - protein, 9 aa, Homo Sapiens
FKIADIVDQ

SEQ ID NO: 1048302 - protein, 9 aa, Homo Sapiens
IQNLKKNSS

SEQ ID NO: 1048303 - protein, 9 aa, Homo Sapiens
NVDPAGNSV

SEQ ID NO: 1048304 - protein, 9 aa, Homo Sapiens
SPPSSCTSA

SEQ ID NO: 1048305 - protein, 9 aa, Homo Sapiens
GKYQAGFSE

SEQ ID NO: 1048306 - protein, 9 aa, Homo Sapiens
QPPQIPEGF

SEQ ID NO: 1048307 - protein, 9 aa, Homo Sapiens
IYGFSPSSF

SEQ ID NO: 1048308 - protein, 9 aa, Homo Sapiens
LPFCHNDKI

SEQ ID NO: 1048309 - protein, 9 aa, Homo Sapiens
QDLAARNCM

SEQ ID NO: 1048310 - protein, 9 aa, Homo Sapiens
VAEINQNLV

SEQ ID NO: 1048311 - protein, 9 aa, Homo Sapiens
IPFHLNNKS

SEQ ID NO: 1048312 - protein, 9 aa, Homo Sapiens
KSVGFEAQM

SEQ ID NO: 1048313 - protein, 9 aa, Homo Sapiens
ILNCMVPFR

SEQ ID NO: 1048314 - protein, 9 aa, Homo Sapiens
VLRDWSNSS

SEQ ID NO: 1048315 - protein, 9 aa, Homo Sapiens
AGRKLPDYL

SEQ ID NO: 1048316 - protein, 9 aa, Homo Sapiens
FCSRSIEVF

SEQ ID NO: 1048317 - protein, 9 aa, Homo Sapiens
YMNNVLLSG

SEQ ID NO: 1048318 - protein, 9 aa, Homo Sapiens
PKNRHTIEV

SEQ ID NO: 1048319 - protein, 9 aa, Homo Sapiens
DGFIDKNNL

SEQ ID NO: 1048320 - protein, 9 aa, Homo Sapiens
KMRRREHEF

SEQ ID NO: 1048321 - protein, 9 aa, Homo Sapiens
LASIIFSNF

SEQ ID NO: 1048322 - protein, 9 aa, Homo Sapiens
IDKNNLRDT

SEQ ID NO: 1048323 - protein, 9 aa, Homo Sapiens
RSFGELALM

SEQ ID NO: 1048324 - protein, 9 aa, Homo Sapiens
PAFSEEKAG

SEQ ID NO: 1048325 - protein, 9 aa, Homo Sapiens
DQITVYHYD

SEQ ID NO: 1048326 - protein, 9 aa, Homo Sapiens
KKQYDEFEI

SEQ ID NO: 1048327 - protein, 9 aa, Homo Sapiens
AHTMSRRKK

SEQ ID NO: 1048328 - protein, 9 aa, Homo Sapiens
VSQSGPSTP

SEQ ID NO: 1048329 - protein, 9 aa, Homo Sapiens
VLEAIIGDW

SEQ ID NO: 1048330 - protein, 9 aa, Homo Sapiens
GKNRPVNLK

SEQ ID NO: 1048331 - protein, 9 aa, Homo Sapiens
SLDSKLVLV

SEQ ID NO: 1048332 - protein, 9 aa, Homo Sapiens
SRHRAEALP

SEQ ID NO: 1048333 - protein, 9 aa, Homo Sapiens
KGDLSSELV

SEQ ID NO: 1048334 - protein, 9 aa, Homo Sapiens
FRSGHPEGP

SEQ ID NO: 1048335 - protein, 9 aa, Homo Sapiens
FRVYCFGQT

SEQ ID NO: 1048336 - protein, 9 aa, Homo Sapiens
QSTVYLMNF

SEQ ID NO: 1048337 - protein, 9 aa, Homo Sapiens
GPFQANPFP

SEQ ID NO: 1048338 - protein, 9 aa, Homo Sapiens
EINQNLVQF

SEQ ID NO: 1048339 - protein, 9 aa, Homo Sapiens
INEFKFLKP

SEQ ID NO: 1048340 - protein, 9 aa, Homo Sapiens
NLKSTHPHF

SEQ ID NO: 1048341 - protein, 9 aa, Homo Sapiens
GLCLEAGTA

SEQ ID NO: 1048342 - protein, 9 aa, Homo Sapiens
LLQSRVLSS

SEQ ID NO: 1048343 - protein, 9 aa, Homo Sapiens
QEVKVKFPP

SEQ ID NO: 1048344 - protein, 9 aa, Homo Sapiens
QYPVFSWVI

SEQ ID NO: 1048345 - protein, 9 aa, Homo Sapiens
NFWPFGDVL

SEQ ID NO: 1048346 - protein, 9 aa, Homo Sapiens
GTRVELVQF

SEQ ID NO: 1048347 - protein, 9 aa, Homo Sapiens
AGEKWKHGG

SEQ ID NO: 1048348 - protein, 9 aa, Homo Sapiens
QPPGDSSAA

SEQ ID NO: 1048349 - protein, 9 aa, Homo Sapiens
MASQNFFRI

SEQ ID NO: 1048350 - protein, 9 aa, Homo Sapiens
FWPFGDVLC

SEQ ID NO: 1048351 - protein, 9 aa, Homo Sapiens
FTLDPINIS

SEQ ID NO: 1048352 - protein, 9 aa, Homo Sapiens
LEVRKSGLY

SEQ ID NO: 1048353 - protein, 9 aa, Homo Sapiens
NCREDALRE

SEQ ID NO: 1048354 - protein, 9 aa, Homo Sapiens
SVLGKYQAG

SEQ ID NO: 1048355 - protein, 9 aa, Homo Sapiens
SLELVPLST

SEQ ID NO: 1048356 - protein, 9 aa, Homo Sapiens
TVYLMNFWP

SEQ ID NO: 1048357 - protein, 9 aa, Homo Sapiens
VCPTGPPPV

SEQ ID NO: 1048358 - protein, 9 aa, Homo Sapiens
RDPPGLCLE

SEQ ID NO: 1048359 - protein, 9 aa, Homo Sapiens
YNGTNMIEI

SEQ ID NO: 1048360 - protein, 9 aa, Homo Sapiens
FSSGLFPLF

SEQ ID NO: 1048361 - protein, 9 aa, Homo Sapiens
SASALRFED

SEQ ID NO: 1048362 - protein, 9 aa, Homo Sapiens
LIGLGIKNC

SEQ ID NO: 1048363 - protein, 9 aa, Homo Sapiens
SMRKVMLIT

SEQ ID NO: 1048364 - protein, 9 aa, Homo Sapiens
PSVQPGLLR

SEQ ID NO: 1048365 - protein, 9 aa, Homo Sapiens
VFPMNNCPI

SEQ ID NO: 1048366 - protein, 9 aa, Homo Sapiens
DRAILEQKE

SEQ ID NO: 1048367 - protein, 9 aa, Homo Sapiens
ENLRHMALD

SEQ ID NO: 1048368 - protein, 9 aa, Homo Sapiens
SLCLNLIPH

SEQ ID NO: 1048369 - protein, 9 aa, Homo Sapiens
FEINKDEIE

SEQ ID NO: 1048370 - protein, 9 aa, Homo Sapiens
STQLPREVG

SEQ ID NO: 1048371 - protein, 9 aa, Homo Sapiens
MQVVVSQSG

SEQ ID NO: 1048372 - protein, 9 aa, Homo Sapiens
SSLGKKVLS

SEQ ID NO: 1048373 - protein, 9 aa, Homo Sapiens
KYLKKSLKI

SEQ ID NO: 1048374 - protein, 9 aa, Homo Sapiens
HTGKRPFKC

SEQ ID NO: 1048375 - protein, 9 aa, Homo Sapiens
PMNNCPIVI

SEQ ID NO: 1048376 - protein, 9 aa, Homo Sapiens
LFTDPAAPN

SEQ ID NO: 1048377 - protein, 9 aa, Homo Sapiens
FLGITFVGI

SEQ ID NO: 1048378 - protein, 9 aa, Homo Sapiens
MVPFRSGHP

SEQ ID NO: 1048379 - protein, 9 aa, Homo Sapiens
QPFGGPPAS

SEQ ID NO: 1048380 - protein, 9 aa, Homo Sapiens
VDSLDSPQP

SEQ ID NO: 1048381 - protein, 9 aa, Homo Sapiens
SIVLTSTLA

SEQ ID NO: 1048382 - protein, 9 aa, Homo Sapiens
ELVDSCTKR

SEQ ID NO: 1048383 - protein, 9 aa, Homo Sapiens
GRLNLGTGV

SEQ ID NO: 1048384 - protein, 9 aa, Homo Sapiens
MEKEEYEQI

SEQ ID NO: 1048385 - protein, 9 aa, Homo Sapiens
LVSYNPRIR

SEQ ID NO: 1048386 - protein, 9 aa, Homo Sapiens
ENREEAPGP

SEQ ID NO: 1048387 - protein, 9 aa, Homo Sapiens
YVWLQCFKK

SEQ ID NO: 1048388 - protein, 9 aa, Homo Sapiens
KRSIQEHND

SEQ ID NO: 1048389 - protein, 9 aa, Homo Sapiens
WYRMSNHPD

SEQ ID NO: 1048390 - protein, 9 aa, Homo Sapiens
KTMFKKGPT

SEQ ID NO: 1048391 - protein, 9 aa, Homo Sapiens
HKRPPSPSL

SEQ ID NO: 1048392 - protein, 9 aa, Homo Sapiens
LGTQLSPYA

SEQ ID NO: 1048393 - protein, 9 aa, Homo Sapiens
KRSTCMKET

SEQ ID NO: 1048394 - protein, 9 aa, Homo Sapiens
MFLWMVTCI

SEQ ID NO: 1048395 - protein, 9 aa, Homo Sapiens
SGRGSWFVQ

SEQ ID NO: 1048396 - protein, 9 aa, Homo Sapiens
SLHLVHQRT

SEQ ID NO: 1048397 - protein, 9 aa, Homo Sapiens
PENDCRNCC

SEQ ID NO: 1048398 - protein, 9 aa, Homo Sapiens
TINKIINYG

SEQ ID NO: 1048399 - protein, 9 aa, Homo Sapiens
STANSVISI

SEQ ID NO: 1048400 - protein, 9 aa, Homo Sapiens
ALQQFPCPS

SEQ ID NO: 1048401 - protein, 9 aa, Homo Sapiens
EAGVAGGVL

SEQ ID NO: 1048402 - protein, 9 aa, Homo Sapiens
PCLRQMFCS

SEQ ID NO: 1048403 - protein, 9 aa, Homo Sapiens
FGIVSLEAM

SEQ ID NO: 1048404 - protein, 9 aa, Homo Sapiens
PTGPPPVHP

SEQ ID NO: 1048405 - protein, 9 aa, Homo Sapiens
QALSEIIQF

SEQ ID NO: 1048406 - protein, 9 aa, Homo Sapiens
PVLAELVIR

SEQ ID NO: 1048407 - protein, 9 aa, Homo Sapiens
KNERLSCTR

SEQ ID NO: 1048408 - protein, 9 aa, Homo Sapiens
YLKKVEDKK

SEQ ID NO: 1048409 - protein, 9 aa, Homo Sapiens
HLNLPLRPG

SEQ ID NO: 1048410 - protein, 9 aa, Homo Sapiens
NRRLQTCKE

SEQ ID NO: 1048411 - protein, 9 aa, Homo Sapiens
TRDPPGLCL

SEQ ID NO: 1048412 - protein, 9 aa, Homo Sapiens
WKYGLKAES

SEQ ID NO: 1048413 - protein, 9 aa, Homo Sapiens
PTTMPYPTT

SEQ ID NO: 1048414 - protein, 9 aa, Homo Sapiens
FSNFLFDKN

SEQ ID NO: 1048415 - protein, 9 aa, Homo Sapiens
RWDRNEPPP

SEQ ID NO: 1048416 - protein, 9 aa, Homo Sapiens
ESVDYRPVF

SEQ ID NO: 1048417 - protein, 9 aa, Homo Sapiens
DLAGRKLPD

SEQ ID NO: 1048418 - protein, 9 aa, Homo Sapiens
LLRPMEEEL

SEQ ID NO: 1048419 - protein, 9 aa, Homo Sapiens
IKLKSRLSV

SEQ ID NO: 1048420 - protein, 9 aa, Homo Sapiens
CRNPDGDEK

SEQ ID NO: 1048421 - protein, 9 aa, Homo Sapiens
QLRKLCRQW

SEQ ID NO: 1048422 - protein, 9 aa, Homo Sapiens
FLPVLAELV

SEQ ID NO: 1048423 - protein, 9 aa, Homo Sapiens
RSSGRGSWF

SEQ ID NO: 1048424 - protein, 9 aa, Homo Sapiens
SPQPFGGPP

SEQ ID NO: 1048425 - protein, 9 aa, Homo Sapiens
SRPSYCSAS

SEQ ID NO: 1048426 - protein, 9 aa, Homo Sapiens
WRSSGRGSW

SEQ ID NO: 1048427 - protein, 9 aa, Homo Sapiens
NLRDTFAAL

SEQ ID NO: 1048428 - protein, 9 aa, Homo Sapiens
TTNAFSGEY

SEQ ID NO: 1048429 - protein, 9 aa, Homo Sapiens
KRLKHISSF

SEQ ID NO: 1048430 - protein, 9 aa, Homo Sapiens
VPTEKEATG

SEQ ID NO: 1048431 - protein, 9 aa, Homo Sapiens
ANLYVVVPS

SEQ ID NO: 1048432 - protein, 9 aa, Homo Sapiens
QTQNFNAEA

SEQ ID NO: 1048433 - protein, 9 aa, Homo Sapiens
ISLPYINQK

SEQ ID NO: 1048434 - protein, 9 aa, Homo Sapiens
TYILDLASR

SEQ ID NO: 1048435 - protein, 9 aa, Homo Sapiens
LKKSLKIIY

SEQ ID NO: 1048436 - protein, 9 aa, Homo Sapiens
GSRPCSLAV

SEQ ID NO: 1048437 - protein, 9 aa, Homo Sapiens
VCREALECE

SEQ ID NO: 1048438 - protein, 9 aa, Homo Sapiens
NRRSFGELA

SEQ ID NO: 1048439 - protein, 9 aa, Homo Sapiens
PGEQQRPHS

SEQ ID NO: 1048440 - protein, 9 aa, Homo Sapiens
PGHPLSGQR

SEQ ID NO: 1048441 - protein, 9 aa, Homo Sapiens
GSGINEFKF

SEQ ID NO: 1048442 - protein, 9 aa, Homo Sapiens
EQDKTGKWN

SEQ ID NO: 1048443 - protein, 9 aa, Homo Sapiens
LYQRRRWII

SEQ ID NO: 1048444 - protein, 9 aa, Homo Sapiens
YTKLQSMNS

SEQ ID NO: 1048445 - protein, 9 aa, Homo Sapiens
SGIIENLRH

SEQ ID NO: 1048446 - protein, 9 aa, Homo Sapiens
QCQTNTDYC

SEQ ID NO: 1048447 - protein, 9 aa, Homo Sapiens
VEYFLSKKQ

SEQ ID NO: 1048448 - protein, 9 aa, Homo Sapiens
YRPVFVQEP

SEQ ID NO: 1048449 - protein, 9 aa, Homo Sapiens
GNRNSLVVG

SEQ ID NO: 1048450 - protein, 9 aa, Homo Sapiens
EINKDEIEW

SEQ ID NO: 1048451 - protein, 9 aa, Homo Sapiens
SPIKLSASG

SEQ ID NO: 1048452 - protein, 9 aa, Homo Sapiens
ICIPCKPYE

SEQ ID NO: 1048453 - protein, 9 aa, Homo Sapiens
KRHKIRHTE

SEQ ID NO: 1048454 - protein, 9 aa, Homo Sapiens
LRYAVFDLM

SEQ ID NO: 1048455 - protein, 9 aa, Homo Sapiens
MKREARENG

SEQ ID NO: 1048456 - protein, 9 aa, Homo Sapiens
GLINDAFSL

SEQ ID NO: 1048457 - protein, 9 aa, Homo Sapiens
KKFQGVKTP

SEQ ID NO: 1048458 - protein, 9 aa, Homo Sapiens
EKFLFKSWM

SEQ ID NO: 1048459 - protein, 9 aa, Homo Sapiens
EHMVSSLCL

SEQ ID NO: 1048460 - protein, 9 aa, Homo Sapiens
RSIQEHNDY

SEQ ID NO: 1048461 - protein, 9 aa, Homo Sapiens
QKQIQESEH

SEQ ID NO: 1048462 - protein, 9 aa, Homo Sapiens
LQINDFAYK

SEQ ID NO: 1048463 - protein, 9 aa, Homo Sapiens
TTVTIPNED

SEQ ID NO: 1048464 - protein, 9 aa, Homo Sapiens
TKSPLPPGG

SEQ ID NO: 1048465 - protein, 9 aa, Homo Sapiens
PNQSSELLA

SEQ ID NO: 1048466 - protein, 9 aa, Homo Sapiens
KNCVSCHDS

SEQ ID NO: 1048467 - protein, 9 aa, Homo Sapiens
PVILRLFLF

SEQ ID NO: 1048468 - protein, 9 aa, Homo Sapiens
LELVPLSTL

SEQ ID NO: 1048469 - protein, 9 aa, Homo Sapiens
LTPIKYLKK

SEQ ID NO: 1048470 - protein, 9 aa, Homo Sapiens
IFYLKSAKL

SEQ ID NO: 1048471 - protein, 9 aa, Homo Sapiens
NKDNKEDPM

SEQ ID NO: 1048472 - protein, 9 aa, Homo Sapiens
GDAPSIVGL

SEQ ID NO: 1048473 - protein, 9 aa, Homo Sapiens
IMLKMIFNQ

SEQ ID NO: 1048474 - protein, 9 aa, Homo Sapiens
DFIIQNLKK

SEQ ID NO: 1048475 - protein, 9 aa, Homo Sapiens
FAAGTFQAA

SEQ ID NO: 1048476 - protein, 9 aa, Homo Sapiens
WFLGITFVG

SEQ ID NO: 1048477 - protein, 9 aa, Homo Sapiens
DGNHFERVG

SEQ ID NO: 1048478 - protein, 9 aa, Homo Sapiens
LRSFQSGDL

SEQ ID NO: 1048479 - protein, 9 aa, Homo Sapiens
DGVSWNSIT

SEQ ID NO: 1048480 - protein, 9 aa, Homo Sapiens
MKNTMPWKC

SEQ ID NO: 1048481 - protein, 9 aa, Homo Sapiens
KIEDDDEDE

SEQ ID NO: 1048482 - protein, 9 aa, Homo Sapiens
AFVRKSSIF

SEQ ID NO: 1048483 - protein, 9 aa, Homo Sapiens
EEERKTSEQ

SEQ ID NO: 1048484 - protein, 9 aa, Homo Sapiens
FSYKQDPTL

SEQ ID NO: 1048485 - protein, 9 aa, Homo Sapiens
PLSGQRPAP

SEQ ID NO: 1048486 - protein, 9 aa, Homo Sapiens
RMASQNFFR

SEQ ID NO: 1048487 - protein, 9 aa, Homo Sapiens
GEDDEDAPI

SEQ ID NO: 1048488 - protein, 9 aa, Homo Sapiens
FVGIGLWAW

SEQ ID NO: 1048489 - protein, 9 aa, Homo Sapiens
LDLFYNNLH

SEQ ID NO: 1048490 - protein, 9 aa, Homo Sapiens
KYKKRSTCM

SEQ ID NO: 1048491 - protein, 9 aa, Homo Sapiens
EGSSKFPVA

SEQ ID NO: 1048492 - protein, 9 aa, Homo Sapiens
IKTLRKNSE

SEQ ID NO: 1048493 - protein, 9 aa, Homo Sapiens
AAGTFQAAA

SEQ ID NO: 1048494 - protein, 9 aa, Homo Sapiens
NGTNMIEII

SEQ ID NO: 1048495 - protein, 9 aa, Homo Sapiens
PVSQRKRRT

SEQ ID NO: 1048496 - protein, 9 aa, Homo Sapiens
PQLKALGNQ

SEQ ID NO: 1048497 - protein, 9 aa, Homo Sapiens
LGITFVGIG

SEQ ID NO: 1048498 - protein, 9 aa, Homo Sapiens
LSSELVDSC

SEQ ID NO: 1048499 - protein, 9 aa, Homo Sapiens
KLCRQWLNP

SEQ ID NO: 1048500 - protein, 9 aa, Homo Sapiens
GDNSLCKTI

SEQ ID NO: 1048501 - protein, 9 aa, Homo Sapiens
SISGQRYSW

SEQ ID NO: 1048502 - protein, 9 aa, Homo Sapiens
LAPPLARAV

SEQ ID NO: 1048503 - protein, 9 aa, Homo Sapiens
SLEKFLFKS

SEQ ID NO: 1048504 - protein, 9 aa, Homo Sapiens
QMREVKRHI

SEQ ID NO: 1048505 - protein, 9 aa, Homo Sapiens
MIFYLKSAK

SEQ ID NO: 1048506 - protein, 9 aa, Homo Sapiens
IMQLGRKHR

SEQ ID NO: 1048507 - protein, 9 aa, Homo Sapiens
PNEDTYCTF

SEQ ID NO: 1048508 - protein, 9 aa, Homo Sapiens
ERRRGRKKG

SEQ ID NO: 1048509 - protein, 9 aa, Homo Sapiens
SSSSTQLPR

SEQ ID NO: 1048510 - protein, 9 aa, Homo Sapiens
FFGSCIFIY

SEQ ID NO: 1048511 - protein, 9 aa, Homo Sapiens
VVVTYKVKT

SEQ ID NO: 1048512 - protein, 9 aa, Homo Sapiens
DQESYPVTD

SEQ ID NO: 1048513 - protein, 9 aa, Homo Sapiens
KVRINEDGS

SEQ ID NO: 1048514 - protein, 9 aa, Homo Sapiens
MNFWPFGDV

SEQ ID NO: 1048515 - protein, 9 aa, Homo Sapiens
NFNAEAVCR

SEQ ID NO: 1048516 - protein, 9 aa, Homo Sapiens
LRIYSLYTK

SEQ ID NO: 1048517 - protein, 9 aa, Homo Sapiens
CVSCHDSDD

SEQ ID NO: 1048518 - protein, 9 aa, Homo Sapiens
SACVIQKPI

SEQ ID NO: 1048519 - protein, 9 aa, Homo Sapiens
YLSLSIHAE

SEQ ID NO: 1048520 - protein, 9 aa, Homo Sapiens
EALPLERED

SEQ ID NO: 1048521 - protein, 9 aa, Homo Sapiens
DLDLFYNNL

SEQ ID NO: 1048522 - protein, 9 aa, Homo Sapiens
LSFIHRFGI

SEQ ID NO: 1048523 - protein, 9 aa, Homo Sapiens
TDASLVTGL

SEQ ID NO: 1048524 - protein, 9 aa, Homo Sapiens
NIDNETVFN

SEQ ID NO: 1048525 - protein, 9 aa, Homo Sapiens
GEEERKTSE

SEQ ID NO: 1048526 - protein, 9 aa, Homo Sapiens
NREEAPGPD

SEQ ID NO: 1048527 - protein, 9 aa, Homo Sapiens
RRHRTIFTF

SEQ ID NO: 1048528 - protein, 9 aa, Homo Sapiens
WIIRALHLF

SEQ ID NO: 1048529 - protein, 9 aa, Homo Sapiens
LMTNLKSTH

SEQ ID NO: 1048530 - protein, 9 aa, Homo Sapiens
PCYENELSL

SEQ ID NO: 1048531 - protein, 9 aa, Homo Sapiens
SQKISAHRT

SEQ ID NO: 1048532 - protein, 9 aa, Homo Sapiens
SNIFSIYQF

SEQ ID NO: 1048533 - protein, 9 aa, Homo Sapiens
AFFKRSIQE

SEQ ID NO: 1048534 - protein, 9 aa, Homo Sapiens
TPLNHVPSA

SEQ ID NO: 1048535 - protein, 9 aa, Homo Sapiens
TSIVLTSTL

SEQ ID NO: 1048536 - protein, 9 aa, Homo Sapiens
ELKLSPQWS

SEQ ID NO: 1048537 - protein, 9 aa, Homo Sapiens
KVKTTPPSL

SEQ ID NO: 1048538 - protein, 9 aa, Homo Sapiens
APQAPAFSE

SEQ ID NO: 1048539 - protein, 9 aa, Homo Sapiens
FFSDDQESY

SEQ ID NO: 1048540 - protein, 9 aa, Homo Sapiens
GWMKWLKND

SEQ ID NO: 1048541 - protein, 9 aa, Homo Sapiens
SEERNHSRS

SEQ ID NO: 1048542 - protein, 9 aa, Homo Sapiens
QQKLSTANS

SEQ ID NO: 1048543 - protein, 9 aa, Homo Sapiens
NLYVVVPSA

SEQ ID NO: 1048544 - protein, 9 aa, Homo Sapiens
IFSIYQFHS

SEQ ID NO: 1048545 - protein, 9 aa, Homo Sapiens
FLGSKRENK

SEQ ID NO: 1048546 - protein, 9 aa, Homo Sapiens
APTPAATAL

SEQ ID NO: 1048547 - protein, 9 aa, Homo Sapiens
NQSSELLAG

SEQ ID NO: 1048548 - protein, 9 aa, Homo Sapiens
PFPYHLYYG

SEQ ID NO: 1048549 - protein, 9 aa, Homo Sapiens
ISDLLFIIT

SEQ ID NO: 1048550 - protein, 9 aa, Homo Sapiens
GKKLFAPVS

SEQ ID NO: 1048551 - protein, 9 aa, Homo Sapiens
EQVSGIIEN

SEQ ID NO: 1048552 - protein, 9 aa, Homo Sapiens
RLSVGVHRL

SEQ ID NO: 1048553 - protein, 9 aa, Homo Sapiens
RQMFCSRSI

SEQ ID NO: 1048554 - protein, 9 aa, Homo Sapiens
VSLEAMYMQ

SEQ ID NO: 1048555 - protein, 9 aa, Homo Sapiens
PFSETQPGP

SEQ ID NO: 1048556 - protein, 9 aa, Homo Sapiens
VHLTTTLEK

SEQ ID NO: 1048557 - protein, 9 aa, Homo Sapiens
QNFFRIEYD

SEQ ID NO: 1048558 - protein, 9 aa, Homo Sapiens
FAGILTTML

SEQ ID NO: 1048559 - protein, 9 aa, Homo Sapiens
FKRSIQEHN

SEQ ID NO: 1048560 - protein, 9 aa, Homo Sapiens
SSDCEQSQN

SEQ ID NO: 1048561 - protein, 9 aa, Homo Sapiens
VMPTKSPLP

SEQ ID NO: 1048562 - protein, 9 aa, Homo Sapiens
EVLSQWRTR

SEQ ID NO: 1048563 - protein, 9 aa, Homo Sapiens
GHLFVRDQR

SEQ ID NO: 1048564 - protein, 9 aa, Homo Sapiens
QAASQSQTF

SEQ ID NO: 1048565 - protein, 9 aa, Homo Sapiens
FLLLLPVSV

SEQ ID NO: 1048566 - protein, 9 aa, Homo Sapiens
SNRAGLIND

SEQ ID NO: 1048567 - protein, 9 aa, Homo Sapiens
PCPSSHWLF

SEQ ID NO: 1048568 - protein, 9 aa, Homo Sapiens
ALAKPITKS

SEQ ID NO: 1048569 - protein, 9 aa, Homo Sapiens
WMKFQKQIQ

SEQ ID NO: 1048570 - protein, 9 aa, Homo Sapiens
AVLGESGEQ

SEQ ID NO: 1048571 - protein, 9 aa, Homo Sapiens
SNHPDGPSY

SEQ ID NO: 1048572 - protein, 9 aa, Homo Sapiens
INNMENTLK

SEQ ID NO: 1048573 - protein, 9 aa, Homo Sapiens
QEEAHYLVE

SEQ ID NO: 1048574 - protein, 9 aa, Homo Sapiens
AGVAGGVLP

SEQ ID NO: 1048575 - protein, 9 aa, Homo Sapiens
VMLITKSSR

SEQ ID NO: 1048576 - protein, 9 aa, Homo Sapiens
LRTRSRALV

SEQ ID NO: 1048577 - protein, 9 aa, Homo Sapiens
KKEEVTEAI

SEQ ID NO: 1048578 - protein, 9 aa, Homo Sapiens
QKPITWDSL

SEQ ID NO: 1048579 - protein, 9 aa, Homo Sapiens
GIPGYKGHQ

SEQ ID NO: 1048580 - protein, 9 aa, Homo Sapiens
INKDEIEWQ

SEQ ID NO: 1048581 - protein, 9 aa, Homo Sapiens
LFLVAAMLL

SEQ ID NO: 1048582 - protein, 9 aa, Homo Sapiens
GPPPVHPSE

SEQ ID NO: 1048583 - protein, 9 aa, Homo Sapiens
SLIYGFSPS

SEQ ID NO: 1048584 - protein, 9 aa, Homo Sapiens
LENREEAPG

SEQ ID NO: 1048585 - protein, 9 aa, Homo Sapiens
GKRPFKCKY

SEQ ID NO: 1048586 - protein, 9 aa, Homo Sapiens
VQKIWMDYF

SEQ ID NO: 1048587 - protein, 9 aa, Homo Sapiens
GSCIFIYVW

SEQ ID NO: 1048588 - protein, 9 aa, Homo Sapiens
SLTSHSLSC

SEQ ID NO: 1048589 - protein, 9 aa, Homo Sapiens
RGDYVSHKI

SEQ ID NO: 1048590 - protein, 9 aa, Homo Sapiens
IHSAIIKFL

SEQ ID NO: 1048591 - protein, 9 aa, Homo Sapiens
FRIRDKDSG

SEQ ID NO: 1048592 - protein, 9 aa, Homo Sapiens
KGSLIYGFS

SEQ ID NO: 1048593 - protein, 9 aa, Homo Sapiens
VFAGILTTM

SEQ ID NO: 1048594 - protein, 9 aa, Homo Sapiens
IVLFTHKKD

SEQ ID NO: 1048595 - protein, 9 aa, Homo Sapiens
KKSLKIIYI

SEQ ID NO: 1048596 - protein, 9 aa, Homo Sapiens
RLGIAVILG

SEQ ID NO: 1048597 - protein, 9 aa, Homo Sapiens
FCHNDKIYH

SEQ ID NO: 1048598 - protein, 9 aa, Homo Sapiens
DAIFTLFLN

SEQ ID NO: 1048599 - protein, 9 aa, Homo Sapiens
IITGFSDDV

SEQ ID NO: 1048600 - protein, 9 aa, Homo Sapiens
NFLRTRSRA

SEQ ID NO: 1048601 - protein, 9 aa, Homo Sapiens
PPDAEAGSV

SEQ ID NO: 1048602 - protein, 9 aa, Homo Sapiens
YDNRRSFGE

SEQ ID NO: 1048603 - protein, 9 aa, Homo Sapiens
SAIIKFLGL

SEQ ID NO: 1048604 - protein, 9 aa, Homo Sapiens
TERQKSQSG

SEQ ID NO: 1048605 - protein, 9 aa, Homo Sapiens
RLHSLYDNQ

SEQ ID NO: 1048606 - protein, 9 aa, Homo Sapiens
VFSKQNKTR

SEQ ID NO: 1048607 - protein, 9 aa, Homo Sapiens
CFVLSLLEN

SEQ ID NO: 1048608 - protein, 9 aa, Homo Sapiens
EIEWQVKSP

SEQ ID NO: 1048609 - protein, 9 aa, Homo Sapiens
VSDLGLFFD

SEQ ID NO: 1048610 - protein, 9 aa, Homo Sapiens
QSSELLAGE

SEQ ID NO: 1048611 - protein, 9 aa, Homo Sapiens
LQKQGMEKE

SEQ ID NO: 1048612 - protein, 9 aa, Homo Sapiens
YGLGAFRTL

SEQ ID NO: 1048613 - protein, 9 aa, Homo Sapiens
WKGSPQLSD

SEQ ID NO: 1048614 - protein, 9 aa, Homo Sapiens
VIRPCYSPH

SEQ ID NO: 1048615 - protein, 9 aa, Homo Sapiens
HTDVLLYTD

SEQ ID NO: 1048616 - protein, 9 aa, Homo Sapiens
HKIMHHQRR

SEQ ID NO: 1048617 - protein, 9 aa, Homo Sapiens
KTHSKKFQG

SEQ ID NO: 1048618 - protein, 9 aa, Homo Sapiens
SLYTKLQSM

SEQ ID NO: 1048619 - protein, 9 aa, Homo Sapiens
NAEAVCRSI

SEQ ID NO: 1048620 - protein, 9 aa, Homo Sapiens
RESEQLFFI

SEQ ID NO: 1048621 - protein, 9 aa, Homo Sapiens
HGSRPCSLA

SEQ ID NO: 1048622 - protein, 9 aa, Homo Sapiens
GILTTMLRA

SEQ ID NO: 1048623 - protein, 9 aa, Homo Sapiens
SGDYDDSAM

SEQ ID NO: 1048624 - protein, 9 aa, Homo Sapiens
GGRNKTGYL

SEQ ID NO: 1048625 - protein, 9 aa, Homo Sapiens
LPAKTTEPV

SEQ ID NO: 1048626 - protein, 9 aa, Homo Sapiens
FFALPAAIL

SEQ ID NO: 1048627 - protein, 9 aa, Homo Sapiens
AKFIPHLES

SEQ ID NO: 1048628 - protein, 9 aa, Homo Sapiens
EPGIPGYKG

SEQ ID NO: 1048629 - protein, 9 aa, Homo Sapiens
MVILVSLQK

SEQ ID NO: 1048630 - protein, 9 aa, Homo Sapiens
VLGESGEQA

SEQ ID NO: 1048631 - protein, 9 aa, Homo Sapiens
TYLQCMQHL

SEQ ID NO: 1048632 - protein, 9 aa, Homo Sapiens
IRDKDSGNN

SEQ ID NO: 1048633 - protein, 9 aa, Homo Sapiens
ESEQLFFIC

SEQ ID NO: 1048634 - protein, 9 aa, Homo Sapiens
LNLLLRMAI

SEQ ID NO: 1048635 - protein, 9 aa, Homo Sapiens
SSPGSTGTT

SEQ ID NO: 1048636 - protein, 9 aa, Homo Sapiens
NALCHSLQH

SEQ ID NO: 1048637 - protein, 9 aa, Homo Sapiens
IMNDEDKIE

SEQ ID NO: 1048638 - protein, 9 aa, Homo Sapiens
VSLVLQVFK

SEQ ID NO: 1048639 - protein, 9 aa, Homo Sapiens
DINIDNETV

SEQ ID NO: 1048640 - protein, 9 aa, Homo Sapiens
LIYFLLSFI

SEQ ID NO: 1048641 - protein, 9 aa, Homo Sapiens
QWRTRNHDD

SEQ ID NO: 1048642 - protein, 9 aa, Homo Sapiens
RNEMVIKHP

SEQ ID NO: 1048643 - protein, 9 aa, Homo Sapiens
AEINQNLVQ

SEQ ID NO: 1048644 - protein, 9 aa, Homo Sapiens
EKEEYEQIP

SEQ ID NO: 1048645 - protein, 9 aa, Homo Sapiens
FFSITFSLF

SEQ ID NO: 1048646 - protein, 9 aa, Homo Sapiens
PSSHWLFGH

SEQ ID NO: 1048647 - protein, 9 aa, Homo Sapiens
KWSQLLSNK

SEQ ID NO: 1048648 - protein, 9 aa, Homo Sapiens
FKKGPTFIK

SEQ ID NO: 1048649 - protein, 9 aa, Homo Sapiens
AFSCISTGI

SEQ ID NO: 1048650 - protein, 9 aa, Homo Sapiens
KNSSYFLGL

SEQ ID NO: 1048651 - protein, 9 aa, Homo Sapiens
KPCQPGCGC

SEQ ID NO: 1048652 - protein, 9 aa, Homo Sapiens
RTIFTFYQL

SEQ ID NO: 1048653 - protein, 9 aa, Homo Sapiens
KSHKLEPPV

SEQ ID NO: 1048654 - protein, 9 aa, Homo Sapiens
FLYGQCLEW

SEQ ID NO: 1048655 - protein, 9 aa, Homo Sapiens
SDSQHKWSQ

SEQ ID NO: 1048656 - protein, 9 aa, Homo Sapiens
SLGKKVLSA

SEQ ID NO: 1048657 - protein, 9 aa, Homo Sapiens
QANPFPYHL

SEQ ID NO: 1048658 - protein, 9 aa, Homo Sapiens
DGAPSLMMP

SEQ ID NO: 1048659 - protein, 9 aa, Homo Sapiens
TWKKIMQLG

SEQ ID NO: 1048660 - protein, 9 aa, Homo Sapiens
RNHDDNKKQ

SEQ ID NO: 1048661 - protein, 9 aa, Homo Sapiens
QESYPVTDI

SEQ ID NO: 1048662 - protein, 9 aa, Homo Sapiens
ARFIPFHLN

SEQ ID NO: 1048663 - protein, 9 aa, Homo Sapiens
GPWSVLPGE

SEQ ID NO: 1048664 - protein, 9 aa, Homo Sapiens
RQLSGEDRK

SEQ ID NO: 1048665 - protein, 9 aa, Homo Sapiens
TTMPYPTTT

SEQ ID NO: 1048666 - protein, 9 aa, Homo Sapiens
VYLMNFWPF

SEQ ID NO: 1048667 - protein, 9 aa, Homo Sapiens
GFFTTRAIK

SEQ ID NO: 1048668 - protein, 9 aa, Homo Sapiens
DLANSIWKG

SEQ ID NO: 1048669 - protein, 9 aa, Homo Sapiens
FQAAATLHR

SEQ ID NO: 1048670 - protein, 9 aa, Homo Sapiens
VPFRSGHPE

SEQ ID NO: 1048671 - protein, 9 aa, Homo Sapiens
AGGSGINEF

SEQ ID NO: 1048672 - protein, 9 aa, Homo Sapiens
CGPLSPGTG

SEQ ID NO: 1048673 - protein, 9 aa, Homo Sapiens
GSNALCHSL

SEQ ID NO: 1048674 - protein, 9 aa, Homo Sapiens
IQEHNDYIC

SEQ ID NO: 1048675 - protein, 9 aa, Homo Sapiens
WKKIMQLGR

SEQ ID NO: 1048676 - protein, 9 aa, Homo Sapiens
EGFADGEPK

SEQ ID NO: 1048677 - protein, 9 aa, Homo Sapiens
DDMKKKVRI

SEQ ID NO: 1048678 - protein, 9 aa, Homo Sapiens
PVNLKIHDI

SEQ ID NO: 1048679 - protein, 9 aa, Homo Sapiens
TSLDGPIKQ

SEQ ID NO: 1048680 - protein, 9 aa, Homo Sapiens
LITKSSRGA

SEQ ID NO: 1048681 - protein, 9 aa, Homo Sapiens
IWKGSSQGR

SEQ ID NO: 1048682 - protein, 9 aa, Homo Sapiens
RSCGFSYKQ

SEQ ID NO: 1048683 - protein, 9 aa, Homo Sapiens
SGRLIYFLL

SEQ ID NO: 1048684 - protein, 9 aa, Homo Sapiens
VRKSGLYRC

SEQ ID NO: 1048685 - protein, 9 aa, Homo Sapiens
IRISASILV

SEQ ID NO: 1048686 - protein, 9 aa, Homo Sapiens
ASPPSSCTS

SEQ ID NO: 1048687 - protein, 9 aa, Homo Sapiens
IPNEDTYCT

SEQ ID NO: 1048688 - protein, 9 aa, Homo Sapiens
KKSSKSVTV

SEQ ID NO: 1048689 - protein, 9 aa, Homo Sapiens
FRQSLRLGG

SEQ ID NO: 1048690 - protein, 9 aa, Homo Sapiens
RIPPLFLIK

SEQ ID NO: 1048691 - protein, 9 aa, Homo Sapiens
VRKSSIFIM

SEQ ID NO: 1048692 - protein, 9 aa, Homo Sapiens
MDLQISLDR

SEQ ID NO: 1048693 - protein, 9 aa, Homo Sapiens
YREQMKNER

SEQ ID NO: 1048694 - protein, 9 aa, Homo Sapiens
MPYPTTTPH

SEQ ID NO: 1048695 - protein, 9 aa, Homo Sapiens
GRKKGEEDQ

SEQ ID NO: 1048696 - protein, 9 aa, Homo Sapiens
HRAEALPLE

SEQ ID NO: 1048697 - protein, 9 aa, Homo Sapiens
WICIPCKPY

SEQ ID NO: 1048698 - protein, 9 aa, Homo Sapiens
QASPPSSCT

SEQ ID NO: 1048699 - protein, 9 aa, Homo Sapiens
VTLFFGSCI

SEQ ID NO: 1048700 - protein, 9 aa, Homo Sapiens
LPYINQKKA

SEQ ID NO: 1048701 - protein, 9 aa, Homo Sapiens
QLPPKVEDR

SEQ ID NO: 1048702 - protein, 9 aa, Homo Sapiens
GQPYLTQGN

SEQ ID NO: 1048703 - protein, 9 aa, Homo Sapiens
WLQCFKKYI

SEQ ID NO: 1048704 - protein, 9 aa, Homo Sapiens
EALCSASYT

SEQ ID NO: 1048705 - protein, 9 aa, Homo Sapiens
IIMLKMIFN

SEQ ID NO: 1048706 - protein, 9 aa, Homo Sapiens
ENDCRNCCY

SEQ ID NO: 1048707 - protein, 9 aa, Homo Sapiens
LQTCKEKAQ

SEQ ID NO: 1048708 - protein, 9 aa, Homo Sapiens
LDSRKLAKH

SEQ ID NO: 1048709 - protein, 9 aa, Homo Sapiens
EKASIFGVS

SEQ ID NO: 1048710 - protein, 9 aa, Homo Sapiens
ASFQASGLS

SEQ ID NO: 1048711 - protein, 9 aa, Homo Sapiens
SVIRPCYSP

SEQ ID NO: 1048712 - protein, 9 aa, Homo Sapiens
QTFSVQSQA

SEQ ID NO: 1048713 - protein, 9 aa, Homo Sapiens
SEQLFFICQ

SEQ ID NO: 1048714 - protein, 9 aa, Homo Sapiens
IGGRNKTGY

SEQ ID NO: 1048715 - protein, 9 aa, Homo Sapiens
PGEHLRVCP

SEQ ID NO: 1048716 - protein, 9 aa, Homo Sapiens
NIFSIYQFH

SEQ ID NO: 1048717 - protein, 9 aa, Homo Sapiens
KKKMHEQEK

SEQ ID NO: 1048718 - protein, 9 aa, Homo Sapiens
ELSVAYNCS

SEQ ID NO: 1048719 - protein, 9 aa, Homo Sapiens
AVRSVDLTS

SEQ ID NO: 1048720 - protein, 9 aa, Homo Sapiens
DPSQACLLV

SEQ ID NO: 1048721 - protein, 9 aa, Homo Sapiens
STSDILEPL

SEQ ID NO: 1048722 - protein, 9 aa, Homo Sapiens
AWGTLGKEE

SEQ ID NO: 1048723 - protein, 9 aa, Homo Sapiens
LESHIRTIT

SEQ ID NO: 1048724 - protein, 9 aa, Homo Sapiens
ALMEVSNLK

SEQ ID NO: 1048725 - protein, 9 aa, Homo Sapiens
ILFFVKPPN

SEQ ID NO: 1048726 - protein, 9 aa, Homo Sapiens
QESTAGSPP

SEQ ID NO: 1048727 - protein, 9 aa, Homo Sapiens
CNIEDSAFF

SEQ ID NO: 1048728 - protein, 9 aa, Homo Sapiens
SSQKEINRK

SEQ ID NO: 1048729 - protein, 9 aa, Homo Sapiens
LRSAASFGF

SEQ ID NO: 1048730 - protein, 9 aa, Homo Sapiens
NSKTEQPAA

SEQ ID NO: 1048731 - protein, 9 aa, Homo Sapiens
CWRSTPDSV

SEQ ID NO: 1048732 - protein, 9 aa, Homo Sapiens
CLSDCILQN

SEQ ID NO: 1048733 - protein, 9 aa, Homo Sapiens
AETPYMMMN

SEQ ID NO: 1048734 - protein, 9 aa, Homo Sapiens
VLLRLSKHE

SEQ ID NO: 1048735 - protein, 9 aa, Homo Sapiens
SAASFLQTT

SEQ ID NO: 1048736 - protein, 9 aa, Homo Sapiens
CLRVEKFLH

SEQ ID NO: 1048737 - protein, 9 aa, Homo Sapiens
VFGGVAQAA

SEQ ID NO: 1048738 - protein, 9 aa, Homo Sapiens
APDFVPCYC

SEQ ID NO: 1048739 - protein, 9 aa, Homo Sapiens
YFKQHMQNQ

SEQ ID NO: 1048740 - protein, 9 aa, Homo Sapiens
VDSRKNCWK

SEQ ID NO: 1048741 - protein, 9 aa, Homo Sapiens
PKQTKSYND

SEQ ID NO: 1048742 - protein, 9 aa, Homo Sapiens
TRNEQAGGG

SEQ ID NO: 1048743 - protein, 9 aa, Homo Sapiens
CGDRANDCG

SEQ ID NO: 1048744 - protein, 9 aa, Homo Sapiens
LTIWLHDPG

SEQ ID NO: 1048745 - protein, 9 aa, Homo Sapiens
LIPVQRTRQ

SEQ ID NO: 1048746 - protein, 9 aa, Homo Sapiens
KEYKAMAPA

SEQ ID NO: 1048747 - protein, 9 aa, Homo Sapiens
DQLEYQKEM

SEQ ID NO: 1048748 - protein, 9 aa, Homo Sapiens
PAGPKTLKA

SEQ ID NO: 1048749 - protein, 9 aa, Homo Sapiens
LMKLREDIT

SEQ ID NO: 1048750 - protein, 9 aa, Homo Sapiens
VGSSMSLIG

SEQ ID NO: 1048751 - protein, 9 aa, Homo Sapiens
PPLRLSVEI

SEQ ID NO: 1048752 - protein, 9 aa, Homo Sapiens
VSFCHCAPC

SEQ ID NO: 1048753 - protein, 9 aa, Homo Sapiens
DLGDCILKL

SEQ ID NO: 1048754 - protein, 9 aa, Homo Sapiens
TAATPGGLY

SEQ ID NO: 1048755 - protein, 9 aa, Homo Sapiens
NDFYCWVCY

SEQ ID NO: 1048756 - protein, 9 aa, Homo Sapiens
TRSENEDEF

SEQ ID NO: 1048757 - protein, 9 aa, Homo Sapiens
EKSEFSAFR

SEQ ID NO: 1048758 - protein, 9 aa, Homo Sapiens
FDTMQSSST

SEQ ID NO: 1048759 - protein, 9 aa, Homo Sapiens
INGVFVDKD

SEQ ID NO: 1048760 - protein, 9 aa, Homo Sapiens
RPGIVSSGN

SEQ ID NO: 1048761 - protein, 9 aa, Homo Sapiens
YRLGSPRSK

SEQ ID NO: 1048762 - protein, 9 aa, Homo Sapiens
EKDYFRLLF

SEQ ID NO: 1048763 - protein, 9 aa, Homo Sapiens
VRTEGGHFL

SEQ ID NO: 1048764 - protein, 9 aa, Homo Sapiens
RQIESTLKE

SEQ ID NO: 1048765 - protein, 9 aa, Homo Sapiens
MEIRRIFSP

SEQ ID NO: 1048766 - protein, 9 aa, Homo Sapiens
EPSKEGQKK

SEQ ID NO: 1048767 - protein, 9 aa, Homo Sapiens
TDAILQTNQ

SEQ ID NO: 1048768 - protein, 9 aa, Homo Sapiens
CGWQKNCQG

SEQ ID NO: 1048769 - protein, 9 aa, Homo Sapiens
EVSFCHCAP

SEQ ID NO: 1048770 - protein, 9 aa, Homo Sapiens
LHVLVMNEN

SEQ ID NO: 1048771 - protein, 9 aa, Homo Sapiens
GLLSPGMTI

SEQ ID NO: 1048772 - protein, 9 aa, Homo Sapiens
KNFHLPSEV

SEQ ID NO: 1048773 - protein, 9 aa, Homo Sapiens
AQRGEGRPG

SEQ ID NO: 1048774 - protein, 9 aa, Homo Sapiens
CTCLAGWRG

SEQ ID NO: 1048775 - protein, 9 aa, Homo Sapiens
RSQITKRKK

SEQ ID NO: 1048776 - protein, 9 aa, Homo Sapiens
ASAIEKSIE

SEQ ID NO: 1048777 - protein, 9 aa, Homo Sapiens
DISLLLNLT

SEQ ID NO: 1048778 - protein, 9 aa, Homo Sapiens
HSKSTFSEP

SEQ ID NO: 1048779 - protein, 9 aa, Homo Sapiens
AHGYQEKVL

SEQ ID NO: 1048780 - protein, 9 aa, Homo Sapiens
VKPLSRVTL

SEQ ID NO: 1048781 - protein, 9 aa, Homo Sapiens
SGNSESLSS

SEQ ID NO: 1048782 - protein, 9 aa, Homo Sapiens
LQSSSPRVP

SEQ ID NO: 1048783 - protein, 9 aa, Homo Sapiens
PVVTHDFLR

SEQ ID NO: 1048784 - protein, 9 aa, Homo Sapiens
PLLVFIFIP

SEQ ID NO: 1048785 - protein, 9 aa, Homo Sapiens
HIKETNDNS

SEQ ID NO: 1048786 - protein, 9 aa, Homo Sapiens
DVVAEAGNK

SEQ ID NO: 1048787 - protein, 9 aa, Homo Sapiens
ALNYRDAER

SEQ ID NO: 1048788 - protein, 9 aa, Homo Sapiens
STPKQTKSY

SEQ ID NO: 1048789 - protein, 9 aa, Homo Sapiens
KASYDLATD

SEQ ID NO: 1048790 - protein, 9 aa, Homo Sapiens
ASTLICQVL

SEQ ID NO: 1048791 - protein, 9 aa, Homo Sapiens
HSRRQPHVV

SEQ ID NO: 1048792 - protein, 9 aa, Homo Sapiens
NNLLVQFKE

SEQ ID NO: 1048793 - protein, 9 aa, Homo Sapiens
LQLNSARLE

SEQ ID NO: 1048794 - protein, 9 aa, Homo Sapiens
LCSDIFEEV

SEQ ID NO: 1048795 - protein, 9 aa, Homo Sapiens
TILVRNIMT

SEQ ID NO: 1048796 - protein, 9 aa, Homo Sapiens
LDLSLNPIN

SEQ ID NO: 1048797 - protein, 9 aa, Homo Sapiens
SSFFIRHLR

SEQ ID NO: 1048798 - protein, 9 aa, Homo Sapiens
KTEHAEKLM

SEQ ID NO: 1048799 - protein, 9 aa, Homo Sapiens
YCTLVRTGP

SEQ ID NO: 1048800 - protein, 9 aa, Homo Sapiens
ESPKSDCND

SEQ ID NO: 1048801 - protein, 9 aa, Homo Sapiens
EKGYEQLKE

SEQ ID NO: 1048802 - protein, 9 aa, Homo Sapiens
QLRYTEEGH

SEQ ID NO: 1048803 - protein, 9 aa, Homo Sapiens
RQNSLRFSA

SEQ ID NO: 1048804 - protein, 9 aa, Homo Sapiens
DVLYFQPPS

SEQ ID NO: 1048805 - protein, 9 aa, Homo Sapiens
SLGTGIMLS

SEQ ID NO: 1048806 - protein, 9 aa, Homo Sapiens
TQINFWKPD

SEQ ID NO: 1048807 - protein, 9 aa, Homo Sapiens
SSSLILYLN

SEQ ID NO: 1048808 - protein, 9 aa, Homo Sapiens
LGIIELILL

SEQ ID NO: 1048809 - protein, 9 aa, Homo Sapiens
GPNPSSKLT

SEQ ID NO: 1048810 - protein, 9 aa, Homo Sapiens
PKEEAKDVS

SEQ ID NO: 1048811 - protein, 9 aa, Homo Sapiens
SDLTQLQLE

SEQ ID NO: 1048812 - protein, 9 aa, Homo Sapiens
PPTYTSTAP

SEQ ID NO: 1048813 - protein, 9 aa, Homo Sapiens
TDKLWRIHC

SEQ ID NO: 1048814 - protein, 9 aa, Homo Sapiens
KSLNPQLLK

SEQ ID NO: 1048815 - protein, 9 aa, Homo Sapiens
ISRTKMKNI

SEQ ID NO: 1048816 - protein, 9 aa, Homo Sapiens
CAMVNSIAW

SEQ ID NO: 1048817 - protein, 9 aa, Homo Sapiens
VGYSFSLVM

SEQ ID NO: 1048818 - protein, 9 aa, Homo Sapiens
AAQARPSLQ

SEQ ID NO: 1048819 - protein, 9 aa, Homo Sapiens
CDLEEEAPP

SEQ ID NO: 1048820 - protein, 9 aa, Homo Sapiens
QMESYSCFF

SEQ ID NO: 1048821 - protein, 9 aa, Homo Sapiens
ATKCVTQYK

SEQ ID NO: 1048822 - protein, 9 aa, Homo Sapiens
GQENNLGEE

SEQ ID NO: 1048823 - protein, 9 aa, Homo Sapiens
KFAYWGVLN

SEQ ID NO: 1048824 - protein, 9 aa, Homo Sapiens
TLLVKASGR

SEQ ID NO: 1048825 - protein, 9 aa, Homo Sapiens
LIIFMVALN

SEQ ID NO: 1048826 - protein, 9 aa, Homo Sapiens
AWQPTSAPP

SEQ ID NO: 1048827 - protein, 9 aa, Homo Sapiens
DVASFTTKI

SEQ ID NO: 1048828 - protein, 9 aa, Homo Sapiens
METGTLEKL

SEQ ID NO: 1048829 - protein, 9 aa, Homo Sapiens
HLILVFRFG

SEQ ID NO: 1048830 - protein, 9 aa, Homo Sapiens
FSRSNSQKP

SEQ ID NO: 1048831 - protein, 9 aa, Homo Sapiens
IFPGAAGGA

SEQ ID NO: 1048832 - protein, 9 aa, Homo Sapiens
SCGSSGYIS

SEQ ID NO: 1048833 - protein, 9 aa, Homo Sapiens
KGEMCSGHS

SEQ ID NO: 1048834 - protein, 9 aa, Homo Sapiens
IYTLRNRNM

SEQ ID NO: 1048835 - protein, 9 aa, Homo Sapiens
PHHCNVIYN

SEQ ID NO: 1048836 - protein, 9 aa, Homo Sapiens
NYLLQKLSC

SEQ ID NO: 1048837 - protein, 9 aa, Homo Sapiens
KGLPEIDFR

SEQ ID NO: 1048838 - protein, 9 aa, Homo Sapiens
QNITISQNN

SEQ ID NO: 1048839 - protein, 9 aa, Homo Sapiens
SQRRKERIS

SEQ ID NO: 1048840 - protein, 9 aa, Homo Sapiens
SASAEGVQK

SEQ ID NO: 1048841 - protein, 9 aa, Homo Sapiens
LVACAREHL

SEQ ID NO: 1048842 - protein, 9 aa, Homo Sapiens
EEITKEPSA

SEQ ID NO: 1048843 - protein, 9 aa, Homo Sapiens
PLVKVLIES

SEQ ID NO: 1048844 - protein, 9 aa, Homo Sapiens
LEFENVQVM

SEQ ID NO: 1048845 - protein, 9 aa, Homo Sapiens
CPDGPRPRY

SEQ ID NO: 1048846 - protein, 9 aa, Homo Sapiens
VGTEETPLH

SEQ ID NO: 1048847 - protein, 9 aa, Homo Sapiens
LGPHYGRPM

SEQ ID NO: 1048848 - protein, 9 aa, Homo Sapiens
QLMGNGFYF

SEQ ID NO: 1048849 - protein, 9 aa, Homo Sapiens
NNNSKMVKF

SEQ ID NO: 1048850 - protein, 9 aa, Homo Sapiens
RHSSTRFHS

SEQ ID NO: 1048851 - protein, 9 aa, Homo Sapiens
ELKELSYRF

SEQ ID NO: 1048852 - protein, 9 aa, Homo Sapiens
YFQVIALIQ

SEQ ID NO: 1048853 - protein, 9 aa, Homo Sapiens
GWPNELTVD

SEQ ID NO: 1048854 - protein, 9 aa, Homo Sapiens
KLSLKCRVD

SEQ ID NO: 1048855 - protein, 9 aa, Homo Sapiens
EIFKGRSGL

SEQ ID NO: 1048856 - protein, 9 aa, Homo Sapiens
NHKRTFKAW

SEQ ID NO: 1048857 - protein, 9 aa, Homo Sapiens
IGHMKVKGE

SEQ ID NO: 1048858 - protein, 9 aa, Homo Sapiens
TKCVTQYKG

SEQ ID NO: 1048859 - protein, 9 aa, Homo Sapiens
SDRKQDIGM

SEQ ID NO: 1048860 - protein, 9 aa, Homo Sapiens
KRFLIVMKG

SEQ ID NO: 1048861 - protein, 9 aa, Homo Sapiens
RRKKCRPII

SEQ ID NO: 1048862 - protein, 9 aa, Homo Sapiens
NSPPRPIRV

SEQ ID NO: 1048863 - protein, 9 aa, Homo Sapiens
AFHCPEIPA

SEQ ID NO: 1048864 - protein, 9 aa, Homo Sapiens
IFIALDDIF

SEQ ID NO: 1048865 - protein, 9 aa, Homo Sapiens
EQLVTYDKE

SEQ ID NO: 1048866 - protein, 9 aa, Homo Sapiens
MSSQPPDPN

SEQ ID NO: 1048867 - protein, 9 aa, Homo Sapiens
LNCSGEHVK

SEQ ID NO: 1048868 - protein, 9 aa, Homo Sapiens
TKFTVSVSE

SEQ ID NO: 1048869 - protein, 9 aa, Homo Sapiens
KLLGCVSKG

SEQ ID NO: 1048870 - protein, 9 aa, Homo Sapiens
EKFINVMKE

SEQ ID NO: 1048871 - protein, 9 aa, Homo Sapiens
LSMQILGMS

SEQ ID NO: 1048872 - protein, 9 aa, Homo Sapiens
TFYPEKISS

SEQ ID NO: 1048873 - protein, 9 aa, Homo Sapiens
KLDSKTGKL

SEQ ID NO: 1048874 - protein, 9 aa, Homo Sapiens
IAPVEFTQE

SEQ ID NO: 1048875 - protein, 9 aa, Homo Sapiens
GHPNPTLPQ

SEQ ID NO: 1048876 - protein, 9 aa, Homo Sapiens
GRIVFLELF

SEQ ID NO: 1048877 - protein, 9 aa, Homo Sapiens
LEISLRRLY

SEQ ID NO: 1048878 - protein, 9 aa, Homo Sapiens
GVPENFNKA

SEQ ID NO: 1048879 - protein, 9 aa, Homo Sapiens
QNHVTGASS

SEQ ID NO: 1048880 - protein, 9 aa, Homo Sapiens
PHGFYQSYI

SEQ ID NO: 1048881 - protein, 9 aa, Homo Sapiens
KTLTFEAAV

SEQ ID NO: 1048882 - protein, 9 aa, Homo Sapiens
CDGCQMFSI

SEQ ID NO: 1048883 - protein, 9 aa, Homo Sapiens
PAFWFNPFS

SEQ ID NO: 1048884 - protein, 9 aa, Homo Sapiens
EASRYHKQP

SEQ ID NO: 1048885 - protein, 9 aa, Homo Sapiens
SKRSPPISL

SEQ ID NO: 1048886 - protein, 9 aa, Homo Sapiens
LQEWNIPFE

SEQ ID NO: 1048887 - protein, 9 aa, Homo Sapiens
NKRKGINVW

SEQ ID NO: 1048888 - protein, 9 aa, Homo Sapiens
QTAVAGPRA

SEQ ID NO: 1048889 - protein, 9 aa, Homo Sapiens
KPQERKNAR

SEQ ID NO: 1048890 - protein, 9 aa, Homo Sapiens
VKSEVSVGL

SEQ ID NO: 1048891 - protein, 9 aa, Homo Sapiens
TSFHTALKL

SEQ ID NO: 1048892 - protein, 9 aa, Homo Sapiens
AAGDILVLV

SEQ ID NO: 1048893 - protein, 9 aa, Homo Sapiens
SERDNLVSR

SEQ ID NO: 1048894 - protein, 9 aa, Homo Sapiens
DTLCFQICG

SEQ ID NO: 1048895 - protein, 9 aa, Homo Sapiens
FQLTGFPGI

SEQ ID NO: 1048896 - protein, 9 aa, Homo Sapiens
SPPQCPRRW

SEQ ID NO: 1048897 - protein, 9 aa, Homo Sapiens
RSMGKGRIC

SEQ ID NO: 1048898 - protein, 9 aa, Homo Sapiens
SPEDSRLWQ

SEQ ID NO: 1048899 - protein, 9 aa, Homo Sapiens
DQDAGACKV

SEQ ID NO: 1048900 - protein, 9 aa, Homo Sapiens
NSEVEVHLD

SEQ ID NO: 1048901 - protein, 9 aa, Homo Sapiens
LVGVQGSLA

SEQ ID NO: 1048902 - protein, 9 aa, Homo Sapiens
YSSPQKTRS

SEQ ID NO: 1048903 - protein, 9 aa, Homo Sapiens
VALEEHFQD

SEQ ID NO: 1048904 - protein, 9 aa, Homo Sapiens
SLLLNLTCS

SEQ ID NO: 1048905 - protein, 9 aa, Homo Sapiens
MNILIHLSK

SEQ ID NO: 1048906 - protein, 9 aa, Homo Sapiens
AQWKDFYYS

SEQ ID NO: 1048907 - protein, 9 aa, Homo Sapiens
PSYGPLDKW

SEQ ID NO: 1048908 - protein, 9 aa, Homo Sapiens
LGFYSCGCI

SEQ ID NO: 1048909 - protein, 9 aa, Homo Sapiens
KRSRKKSYS

SEQ ID NO: 1048910 - protein, 9 aa, Homo Sapiens
PESSGCLEV

SEQ ID NO: 1048911 - protein, 9 aa, Homo Sapiens
KAFFSPSLL

SEQ ID NO: 1048912 - protein, 9 aa, Homo Sapiens
EMNLQICFV

SEQ ID NO: 1048913 - protein, 9 aa, Homo Sapiens
DLRTIYARL

SEQ ID NO: 1048914 - protein, 9 aa, Homo Sapiens
ASSQSMLWL

SEQ ID NO: 1048915 - protein, 9 aa, Homo Sapiens
SCGVTVALK

SEQ ID NO: 1048916 - protein, 9 aa, Homo Sapiens
SPSKSMVAS

SEQ ID NO: 1048917 - protein, 9 aa, Homo Sapiens
RTSTNFLPM

SEQ ID NO: 1048918 - protein, 9 aa, Homo Sapiens
SGDVLCSCP

SEQ ID NO: 1048919 - protein, 9 aa, Homo Sapiens
YGDIPPEIV

SEQ ID NO: 1048920 - protein, 9 aa, Homo Sapiens
RQDENRVPL

SEQ ID NO: 1048921 - protein, 9 aa, Homo Sapiens
EAAHWLARR

SEQ ID NO: 1048922 - protein, 9 aa, Homo Sapiens
KKKLQGKGP

SEQ ID NO: 1048923 - protein, 9 aa, Homo Sapiens
MCRAKTGKY

SEQ ID NO: 1048924 - protein, 9 aa, Homo Sapiens
AGGDGVCSG

SEQ ID NO: 1048925 - protein, 9 aa, Homo Sapiens
ALLQVCCAS

SEQ ID NO: 1048926 - protein, 9 aa, Homo Sapiens
GYGPGETGF

SEQ ID NO: 1048927 - protein, 9 aa, Homo Sapiens
NKVFTPVSC

SEQ ID NO: 1048928 - protein, 9 aa, Homo Sapiens
PCTQHITWN

SEQ ID NO: 1048929 - protein, 9 aa, Homo Sapiens
HGVNTSNMY

SEQ ID NO: 1048930 - protein, 9 aa, Homo Sapiens
LYRELLDGA

SEQ ID NO: 1048931 - protein, 9 aa, Homo Sapiens
IYFSIMLTP

SEQ ID NO: 1048932 - protein, 9 aa, Homo Sapiens
VPFMRQNRT

SEQ ID NO: 1048933 - protein, 9 aa, Homo Sapiens
FLVAFMGNF

SEQ ID NO: 1048934 - protein, 9 aa, Homo Sapiens
VMFEEATEE

SEQ ID NO: 1048935 - protein, 9 aa, Homo Sapiens
CFMDFVCPE

SEQ ID NO: 1048936 - protein, 9 aa, Homo Sapiens
SKEGYLQGN

SEQ ID NO: 1048937 - protein, 9 aa, Homo Sapiens
LTFFPALHK

SEQ ID NO: 1048938 - protein, 9 aa, Homo Sapiens
LSPASSVST

SEQ ID NO: 1048939 - protein, 9 aa, Homo Sapiens
SRSLVEMPT

SEQ ID NO: 1048940 - protein, 9 aa, Homo Sapiens
CTGKKRYWC

SEQ ID NO: 1048941 - protein, 9 aa, Homo Sapiens
QPGKFYLLD

SEQ ID NO: 1048942 - protein, 9 aa, Homo Sapiens
LLTSCYKLT

SEQ ID NO: 1048943 - protein, 9 aa, Homo Sapiens
WLHHLNHKG

SEQ ID NO: 1048944 - protein, 9 aa, Homo Sapiens
MPPGESGPG

SEQ ID NO: 1048945 - protein, 9 aa, Homo Sapiens
FQIIQFMEG

SEQ ID NO: 1048946 - protein, 9 aa, Homo Sapiens
PEGAQGPGP

SEQ ID NO: 1048947 - protein, 9 aa, Homo Sapiens
ESEFSGSPY

SEQ ID NO: 1048948 - protein, 9 aa, Homo Sapiens
FLASLWICS

SEQ ID NO: 1048949 - protein, 9 aa, Homo Sapiens
SPGFSGLSM

SEQ ID NO: 1048950 - protein, 9 aa, Homo Sapiens
SIFSALRTG

SEQ ID NO: 1048951 - protein, 9 aa, Homo Sapiens
NLTPLRTVP

SEQ ID NO: 1048952 - protein, 9 aa, Homo Sapiens
LNNTNIKNS

SEQ ID NO: 1048953 - protein, 9 aa, Homo Sapiens
SSLCSCDIP

SEQ ID NO: 1048954 - protein, 9 aa, Homo Sapiens
LVFIHTLVF

SEQ ID NO: 1048955 - protein, 9 aa, Homo Sapiens
SIKTNVHSP

SEQ ID NO: 1048956 - protein, 9 aa, Homo Sapiens
IIVVVMRNM

SEQ ID NO: 1048957 - protein, 9 aa, Homo Sapiens
CSEKIAGDH

SEQ ID NO: 1048958 - protein, 9 aa, Homo Sapiens
VTAKKIVHR

SEQ ID NO: 1048959 - protein, 9 aa, Homo Sapiens
SVKSPPLPE

SEQ ID NO: 1048960 - protein, 9 aa, Homo Sapiens
AHREYITCV

SEQ ID NO: 1048961 - protein, 9 aa, Homo Sapiens
GKVCPFVHL

SEQ ID NO: 1048962 - protein, 9 aa, Homo Sapiens
PPSGGGGDG

SEQ ID NO: 1048963 - protein, 9 aa, Homo Sapiens
TCSAVNKAG

SEQ ID NO: 1048964 - protein, 9 aa, Homo Sapiens
GDGVCSGCQ

SEQ ID NO: 1048965 - protein, 9 aa, Homo Sapiens
WMLHMAVQD

SEQ ID NO: 1048966 - protein, 9 aa, Homo Sapiens
FLLTFFSYL

SEQ ID NO: 1048967 - protein, 9 aa, Homo Sapiens
VEILSSDGK

SEQ ID NO: 1048968 - protein, 9 aa, Homo Sapiens
VALGLKKKN

SEQ ID NO: 1048969 - protein, 9 aa, Homo Sapiens
FQGTHVVTL

SEQ ID NO: 1048970 - protein, 9 aa, Homo Sapiens
VRKHQFDYG

SEQ ID NO: 1048971 - protein, 9 aa, Homo Sapiens
SARLSPEVP

SEQ ID NO: 1048972 - protein, 9 aa, Homo Sapiens
MQCLMPHLA

SEQ ID NO: 1048973 - protein, 9 aa, Homo Sapiens
SEKQICGMH

SEQ ID NO: 1048974 - protein, 9 aa, Homo Sapiens
HEDLLDVCN

SEQ ID NO: 1048975 - protein, 9 aa, Homo Sapiens
PGFMMTCED

SEQ ID NO: 1048976 - protein, 9 aa, Homo Sapiens
CPSPKVSSS

SEQ ID NO: 1048977 - protein, 9 aa, Homo Sapiens
MGPETPMDG

SEQ ID NO: 1048978 - protein, 9 aa, Homo Sapiens
VTPDKDDHL

SEQ ID NO: 1048979 - protein, 9 aa, Homo Sapiens
GNKGSKEEP

SEQ ID NO: 1048980 - protein, 9 aa, Homo Sapiens
VSGACTCLA

SEQ ID NO: 1048981 - protein, 9 aa, Homo Sapiens
FGARAEEAL

SEQ ID NO: 1048982 - protein, 9 aa, Homo Sapiens
TLKNKEMKI

SEQ ID NO: 1048983 - protein, 9 aa, Homo Sapiens
YVAICTPLY

SEQ ID NO: 1048984 - protein, 9 aa, Homo Sapiens
ADENSCGLE

SEQ ID NO: 1048985 - protein, 9 aa, Homo Sapiens
VRLFVDKNL

SEQ ID NO: 1048986 - protein, 9 aa, Homo Sapiens
AFVTTHMCC

SEQ ID NO: 1048987 - protein, 9 aa, Homo Sapiens
YEQLRQMHT

SEQ ID NO: 1048988 - protein, 9 aa, Homo Sapiens
SENKKADVK

SEQ ID NO: 1048989 - protein, 9 aa, Homo Sapiens
LLTSNYIFF

SEQ ID NO: 1048990 - protein, 9 aa, Homo Sapiens
IIREELCVF

SEQ ID NO: 1048991 - protein, 9 aa, Homo Sapiens
DGGVRVRVV

SEQ ID NO: 1048992 - protein, 9 aa, Homo Sapiens
LGEQLYQQS

SEQ ID NO: 1048993 - protein, 9 aa, Homo Sapiens
NDQIQPIIL

SEQ ID NO: 1048994 - protein, 9 aa, Homo Sapiens
IFEVDSDGD

SEQ ID NO: 1048995 - protein, 9 aa, Homo Sapiens
LFLFHHTKA

SEQ ID NO: 1048996 - protein, 9 aa, Homo Sapiens
PTTMNYSLW

SEQ ID NO: 1048997 - protein, 9 aa, Homo Sapiens
AEARVGFPK

SEQ ID NO: 1048998 - protein, 9 aa, Homo Sapiens
KPPNRLVYP

SEQ ID NO: 1048999 - protein, 9 aa, Homo Sapiens
KDKTYPIKS

SEQ ID NO: 1049000 - protein, 9 aa, Homo Sapiens
KSGEEQQSY

SEQ ID NO: 1049001 - protein, 9 aa, Homo Sapiens
VNLCSNSED

SEQ ID NO: 1049002 - protein, 9 aa, Homo Sapiens
VLTCDTPKE

SEQ ID NO: 1049003 - protein, 9 aa, Homo Sapiens
SCGSNSGQG

SEQ ID NO: 1049004 - protein, 9 aa, Homo Sapiens
MKCESPEPH

SEQ ID NO: 1049005 - protein, 9 aa, Homo Sapiens
EGDWAGRSR

SEQ ID NO: 1049006 - protein, 9 aa, Homo Sapiens
KTKALKHKL

SEQ ID NO: 1049007 - protein, 9 aa, Homo Sapiens
SSGYISSSP

SEQ ID NO: 1049008 - protein, 9 aa, Homo Sapiens
QVCSKCGKG

SEQ ID NO: 1049009 - protein, 9 aa, Homo Sapiens
GEKLYQCKE

SEQ ID NO: 1049010 - protein, 9 aa, Homo Sapiens
ITKEPSACS

SEQ ID NO: 1049011 - protein, 9 aa, Homo Sapiens
INMSTLKYL

SEQ ID NO: 1049012 - protein, 9 aa, Homo Sapiens
NRRQRDWAA

SEQ ID NO: 1049013 - protein, 9 aa, Homo Sapiens
WLLIFFLHD

SEQ ID NO: 1049014 - protein, 9 aa, Homo Sapiens
EFKRAARVS

SEQ ID NO: 1049015 - protein, 9 aa, Homo Sapiens
DSGRFDVSD

SEQ ID NO: 1049016 - protein, 9 aa, Homo Sapiens
IITQLAEVV

SEQ ID NO: 1049017 - protein, 9 aa, Homo Sapiens
WIIAMKDES

SEQ ID NO: 1049018 - protein, 9 aa, Homo Sapiens
QEEVQRPPR

SEQ ID NO: 1049019 - protein, 9 aa, Homo Sapiens
FLLGSTSIK

SEQ ID NO: 1049020 - protein, 9 aa, Homo Sapiens
TSQASHECT

SEQ ID NO: 1049021 - protein, 9 aa, Homo Sapiens
AHAHCRVRG

SEQ ID NO: 1049022 - protein, 9 aa, Homo Sapiens
NPYAGFFKY

SEQ ID NO: 1049023 - protein, 9 aa, Homo Sapiens
KFISLFYLL

SEQ ID NO: 1049024 - protein, 9 aa, Homo Sapiens
SFRVDEAKS

SEQ ID NO: 1049025 - protein, 9 aa, Homo Sapiens
VLRIYPGFL

SEQ ID NO: 1049026 - protein, 9 aa, Homo Sapiens
AEFKDYSTA

SEQ ID NO: 1049027 - protein, 9 aa, Homo Sapiens
LGFPIDPRI

SEQ ID NO: 1049028 - protein, 9 aa, Homo Sapiens
IRSSFFIRH

SEQ ID NO: 1049029 - protein, 9 aa, Homo Sapiens
VIFNIFEGM

SEQ ID NO: 1049030 - protein, 9 aa, Homo Sapiens
GPDVPSTSA

SEQ ID NO: 1049031 - protein, 9 aa, Homo Sapiens
YFSPQELED

SEQ ID NO: 1049032 - protein, 9 aa, Homo Sapiens
EEDRQLIAD

SEQ ID NO: 1049033 - protein, 9 aa, Homo Sapiens
DTENKYFKD

SEQ ID NO: 1049034 - protein, 9 aa, Homo Sapiens
LPRGSILRS

SEQ ID NO: 1049035 - protein, 9 aa, Homo Sapiens
GPGNNVEPP

SEQ ID NO: 1049036 - protein, 9 aa, Homo Sapiens
SFSGQAQLL

SEQ ID NO: 1049037 - protein, 9 aa, Homo Sapiens
VGGGGRFQQ

SEQ ID NO: 1049038 - protein, 9 aa, Homo Sapiens
LRWGGGYKG

SEQ ID NO: 1049039 - protein, 9 aa, Homo Sapiens
EGDEEIKFD

SEQ ID NO: 1049040 - protein, 9 aa, Homo Sapiens
VMCSCLPGK

SEQ ID NO: 1049041 - protein, 9 aa, Homo Sapiens
APLTITLVC

SEQ ID NO: 1049042 - protein, 9 aa, Homo Sapiens
QDNVYFLQY

SEQ ID NO: 1049043 - protein, 9 aa, Homo Sapiens
FSNSSTAFQ

SEQ ID NO: 1049044 - protein, 9 aa, Homo Sapiens
AFVTTNHSS

SEQ ID NO: 1049045 - protein, 9 aa, Homo Sapiens
QSYPSKHNY

SEQ ID NO: 1049046 - protein, 9 aa, Homo Sapiens
MRPPRKPAQ

SEQ ID NO: 1049047 - protein, 9 aa, Homo Sapiens
LCGIDKFRG

SEQ ID NO: 1049048 - protein, 9 aa, Homo Sapiens
WMRPPRKPA

SEQ ID NO: 1049049 - protein, 9 aa, Homo Sapiens
IFTPLLNPF

SEQ ID NO: 1049050 - protein, 9 aa, Homo Sapiens
GTISNVKTN

SEQ ID NO: 1049051 - protein, 9 aa, Homo Sapiens
HILQLFHCL

SEQ ID NO: 1049052 - protein, 9 aa, Homo Sapiens
RLQNGEQDK

SEQ ID NO: 1049053 - protein, 9 aa, Homo Sapiens
DNHVAAIYC

SEQ ID NO: 1049054 - protein, 9 aa, Homo Sapiens
ELPVACLKP

SEQ ID NO: 1049055 - protein, 9 aa, Homo Sapiens
GDIFHSQGT

SEQ ID NO: 1049056 - protein, 9 aa, Homo Sapiens
VLENVSYIK

SEQ ID NO: 1049057 - protein, 9 aa, Homo Sapiens
AILLMDGRI

SEQ ID NO: 1049058 - protein, 9 aa, Homo Sapiens
CGEEGLDYG

SEQ ID NO: 1049059 - protein, 9 aa, Homo Sapiens
NFYDFQFCG

SEQ ID NO: 1049060 - protein, 9 aa, Homo Sapiens
INYLNKVLP

SEQ ID NO: 1049061 - protein, 9 aa, Homo Sapiens
FWWLAVVIR

SEQ ID NO: 1049062 - protein, 9 aa, Homo Sapiens
NKFLDDDIT

SEQ ID NO: 1049063 - protein, 9 aa, Homo Sapiens
AMTAEREVT

SEQ ID NO: 1049064 - protein, 9 aa, Homo Sapiens
VCKDGQWQS

SEQ ID NO: 1049065 - protein, 9 aa, Homo Sapiens
NISHNLHSL

SEQ ID NO: 1049066 - protein, 9 aa, Homo Sapiens
FLGEDVSDS

SEQ ID NO: 1049067 - protein, 9 aa, Homo Sapiens
AIQNKNEIN

SEQ ID NO: 1049068 - protein, 9 aa, Homo Sapiens
RKLVALVLL

SEQ ID NO: 1049069 - protein, 9 aa, Homo Sapiens
IYSGEKPYE

SEQ ID NO: 1049070 - protein, 9 aa, Homo Sapiens
KPALTLSFG

SEQ ID NO: 1049071 - protein, 9 aa, Homo Sapiens
KGRICRGNY

SEQ ID NO: 1049072 - protein, 9 aa, Homo Sapiens
VRIHTGEKL

SEQ ID NO: 1049073 - protein, 9 aa, Homo Sapiens
FSAFVTTNH

SEQ ID NO: 1049074 - protein, 9 aa, Homo Sapiens
LTNFYGDLQ

SEQ ID NO: 1049075 - protein, 9 aa, Homo Sapiens
SAEIMAMNE

SEQ ID NO: 1049076 - protein, 9 aa, Homo Sapiens
IFLVEDAVD

SEQ ID NO: 1049077 - protein, 9 aa, Homo Sapiens
GYSFSLVML

SEQ ID NO: 1049078 - protein, 9 aa, Homo Sapiens
TFDKCLPHT

SEQ ID NO: 1049079 - protein, 9 aa, Homo Sapiens
KHHTLPEVK

SEQ ID NO: 1049080 - protein, 9 aa, Homo Sapiens
TYEQVYKGR

SEQ ID NO: 1049081 - protein, 9 aa, Homo Sapiens
SAFLGDDTL

SEQ ID NO: 1049082 - protein, 9 aa, Homo Sapiens
RRDSKKKSC

SEQ ID NO: 1049083 - protein, 9 aa, Homo Sapiens
TVLSGQTIN

SEQ ID NO: 1049084 - protein, 9 aa, Homo Sapiens
YNNLCVSEI

SEQ ID NO: 1049085 - protein, 8 aa, Homo Sapiens
RAGMKYQG

SEQ ID NO: 1049086 - protein, 9 aa, Homo Sapiens
DDEKSLDDE

SEQ ID NO: 1049087 - protein, 9 aa, Homo Sapiens
SCFTTTPGP

SEQ ID NO: 1049088 - protein, 9 aa, Homo Sapiens
FCMTAYSNV

SEQ ID NO: 1049089 - protein, 9 aa, Homo Sapiens
KIVSSMAQA

SEQ ID NO: 1049090 - protein, 9 aa, Homo Sapiens
RPPRKPAQP

SEQ ID NO: 1049091 - protein, 9 aa, Homo Sapiens
TESTEERRL

SEQ ID NO: 1049092 - protein, 9 aa, Homo Sapiens
ILVSGNADF

SEQ ID NO: 1049093 - protein, 9 aa, Homo Sapiens
VPDLLAGVN

SEQ ID NO: 1049094 - protein, 9 aa, Homo Sapiens
QRLGEGRGG

SEQ ID NO: 1049095 - protein, 9 aa, Homo Sapiens
LDYSVGNLS

SEQ ID NO: 1049096 - protein, 9 aa, Homo Sapiens
YKDGKQLSN

SEQ ID NO: 1049097 - protein, 9 aa, Homo Sapiens
CPLLPFIQT

SEQ ID NO: 1049098 - protein, 9 aa, Homo Sapiens
ILCQVAGHP

SEQ ID NO: 1049099 - protein, 9 aa, Homo Sapiens
VFSGVFMEN

SEQ ID NO: 1049100 - protein, 9 aa, Homo Sapiens
SLKLILSTT

SEQ ID NO: 1049101 - protein, 9 aa, Homo Sapiens
AEPAKENLF

SEQ ID NO: 1049102 - protein, 9 aa, Homo Sapiens
EDCLNEVKA

SEQ ID NO: 1049103 - protein, 9 aa, Homo Sapiens
KNAFSKSKA

SEQ ID NO: 1049104 - protein, 9 aa, Homo Sapiens
SIICGFLLG

SEQ ID NO: 1049105 - protein, 9 aa, Homo Sapiens
AQVSSHTVV

SEQ ID NO: 1049106 - protein, 9 aa, Homo Sapiens
MIIDEPVSA

SEQ ID NO: 1049107 - protein, 9 aa, Homo Sapiens
AVQDLIRAV

SEQ ID NO: 1049108 - protein, 9 aa, Homo Sapiens
PNTLQKAEK

SEQ ID NO: 1049109 - protein, 9 aa, Homo Sapiens
YLHTPMYFL

SEQ ID NO: 1049110 - protein, 9 aa, Homo Sapiens
IKGNSPLRE

SEQ ID NO: 1049111 - protein, 9 aa, Homo Sapiens
DKINIIEQR

SEQ ID NO: 1049112 - protein, 9 aa, Homo Sapiens
KKQYTVRRF

SEQ ID NO: 1049113 - protein, 9 aa, Homo Sapiens
TEKKDDFFS

SEQ ID NO: 1049114 - protein, 9 aa, Homo Sapiens
DASFVSPER

SEQ ID NO: 1049115 - protein, 9 aa, Homo Sapiens
FSAKNDHYC

SEQ ID NO: 1049116 - protein, 9 aa, Homo Sapiens
SSWYDFPWG

SEQ ID NO: 1049117 - protein, 9 aa, Homo Sapiens
LQASPPDDV

SEQ ID NO: 1049118 - protein, 9 aa, Homo Sapiens
EQQSYGEEK

SEQ ID NO: 1049119 - protein, 9 aa, Homo Sapiens
HFCYNVRNL

SEQ ID NO: 1049120 - protein, 9 aa, Homo Sapiens
RHLAVEWGL

SEQ ID NO: 1049121 - protein, 9 aa, Homo Sapiens
NSITVSVCR

SEQ ID NO: 1049122 - protein, 9 aa, Homo Sapiens
FQQGLHWLR

SEQ ID NO: 1049123 - protein, 9 aa, Homo Sapiens
RNLYATVIH

SEQ ID NO: 1049124 - protein, 9 aa, Homo Sapiens
VQVALGNIA

SEQ ID NO: 1049125 - protein, 9 aa, Homo Sapiens
WDLMDQIGE

SEQ ID NO: 1049126 - protein, 9 aa, Homo Sapiens
SGALPGSHT

SEQ ID NO: 1049127 - protein, 9 aa, Homo Sapiens
CLAAKKAQA

SEQ ID NO: 1049128 - protein, 9 aa, Homo Sapiens
TNGYNYAIL

SEQ ID NO: 1049129 - protein, 9 aa, Homo Sapiens
TAPPRVLKI

SEQ ID NO: 1049130 - protein, 9 aa, Homo Sapiens
RHEYGFPGI

SEQ ID NO: 1049131 - protein, 9 aa, Homo Sapiens
VPGPQGPFG

SEQ ID NO: 1049132 - protein, 9 aa, Homo Sapiens
SVKWEYCNL

SEQ ID NO: 1049133 - protein, 9 aa, Homo Sapiens
VVFLYKGLD

SEQ ID NO: 1049134 - protein, 9 aa, Homo Sapiens
NNPGMPQNG

SEQ ID NO: 1049135 - protein, 9 aa, Homo Sapiens
GLTSKNKNG

SEQ ID NO: 1049136 - protein, 9 aa, Homo Sapiens
DTEEEDTEE

SEQ ID NO: 1049137 - protein, 9 aa, Homo Sapiens
KFDLVCGME

SEQ ID NO: 1049138 - protein, 9 aa, Homo Sapiens
PLSSLAGRP

SEQ ID NO: 1049139 - protein, 9 aa, Homo Sapiens
DLFYTQGDS

SEQ ID NO: 1049140 - protein, 9 aa, Homo Sapiens
KSPEKTKSP

SEQ ID NO: 1049141 - protein, 9 aa, Homo Sapiens
NSTTSEKAY

SEQ ID NO: 1049142 - protein, 9 aa, Homo Sapiens
LPCPEPQEA

SEQ ID NO: 1049143 - protein, 9 aa, Homo Sapiens
VCKRGYCLS

SEQ ID NO: 1049144 - protein, 9 aa, Homo Sapiens
TGDEIIFPR

SEQ ID NO: 1049145 - protein, 9 aa, Homo Sapiens
RAFCSNRNF

SEQ ID NO: 1049146 - protein, 9 aa, Homo Sapiens
EQKGEPGLP

SEQ ID NO: 1049147 - protein, 9 aa, Homo Sapiens
ETDKLWRIH

SEQ ID NO: 1049148 - protein, 9 aa, Homo Sapiens
QEREETETI

SEQ ID NO: 1049149 - protein, 9 aa, Homo Sapiens
FGFFHLIRL

SEQ ID NO: 1049150 - protein, 9 aa, Homo Sapiens
MLHPPHHIL

SEQ ID NO: 1049151 - protein, 9 aa, Homo Sapiens
SKFNAEESS

SEQ ID NO: 1049152 - protein, 9 aa, Homo Sapiens
IKSTNEATN

SEQ ID NO: 1049153 - protein, 9 aa, Homo Sapiens
KIFCFQDTG

SEQ ID NO: 1049154 - protein, 9 aa, Homo Sapiens
YTQPPSAFS

SEQ ID NO: 1049155 - protein, 9 aa, Homo Sapiens
WAGRSRKLL

SEQ ID NO: 1049156 - protein, 9 aa, Homo Sapiens
IKKVFYNIG

SEQ ID NO: 1049157 - protein, 9 aa, Homo Sapiens
YNFFIVLFF

SEQ ID NO: 1049158 - protein, 9 aa, Homo Sapiens
GRMQKGINF

SEQ ID NO: 1049159 - protein, 9 aa, Homo Sapiens
ILNDIFYGR

SEQ ID NO: 1049160 - protein, 9 aa, Homo Sapiens
PERTLVVQN

SEQ ID NO: 1049161 - protein, 9 aa, Homo Sapiens
QDKSFGNSL

SEQ ID NO: 1049162 - protein, 9 aa, Homo Sapiens
NLQKEKITQ

SEQ ID NO: 1049163 - protein, 9 aa, Homo Sapiens
EVRIKMVVV

SEQ ID NO: 1049164 - protein, 9 aa, Homo Sapiens
GKFCEGFTR

SEQ ID NO: 1049165 - protein, 9 aa, Homo Sapiens
GPSFPKNDV

SEQ ID NO: 1049166 - protein, 9 aa, Homo Sapiens
TRMVQLVVA

SEQ ID NO: 1049167 - protein, 9 aa, Homo Sapiens
SKNKNGSWG

SEQ ID NO: 1049168 - protein, 9 aa, Homo Sapiens
IALVYVDGH

SEQ ID NO: 1049169 - protein, 9 aa, Homo Sapiens
LSILAPETA

SEQ ID NO: 1049170 - protein, 9 aa, Homo Sapiens
NLQPCGTCS

SEQ ID NO: 1049171 - protein, 9 aa, Homo Sapiens
WDEEDKKNY

SEQ ID NO: 1049172 - protein, 9 aa, Homo Sapiens
EEYEDTMFT

SEQ ID NO: 1049173 - protein, 9 aa, Homo Sapiens
VYCTNLPPT

SEQ ID NO: 1049174 - protein, 9 aa, Homo Sapiens
DESQRVDFP

SEQ ID NO: 1049175 - protein, 9 aa, Homo Sapiens
QAYHWYCKA

SEQ ID NO: 1049176 - protein, 9 aa, Homo Sapiens
KKDVLYFQP

SEQ ID NO: 1049177 - protein, 9 aa, Homo Sapiens
RTCDNPPLS

SEQ ID NO: 1049178 - protein, 9 aa, Homo Sapiens
DESGNLFGG

SEQ ID NO: 1049179 - protein, 9 aa, Homo Sapiens
YFENFPDYC

SEQ ID NO: 1049180 - protein, 9 aa, Homo Sapiens
LENLVQACF

SEQ ID NO: 1049181 - protein, 9 aa, Homo Sapiens
FTAFDGGDP

SEQ ID NO: 1049182 - protein, 9 aa, Homo Sapiens
GSKDTFDDN

SEQ ID NO: 1049183 - protein, 9 aa, Homo Sapiens
VYHVIVPCS

SEQ ID NO: 1049184 - protein, 9 aa, Homo Sapiens
DLGGSERSC

SEQ ID NO: 1049185 - protein, 9 aa, Homo Sapiens
SIPLVLETC

SEQ ID NO: 1049186 - protein, 9 aa, Homo Sapiens
MLLGLGMTV

SEQ ID NO: 1049187 - protein, 9 aa, Homo Sapiens
GRICRGNYP

SEQ ID NO: 1049188 - protein, 9 aa, Homo Sapiens
VCSAETHSL

SEQ ID NO: 1049189 - protein, 9 aa, Homo Sapiens
NGLDEQPGP

SEQ ID NO: 1049190 - protein, 9 aa, Homo Sapiens
DYCVQKGDL

SEQ ID NO: 1049191 - protein, 9 aa, Homo Sapiens
ESSGCLEVP

SEQ ID NO: 1049192 - protein, 9 aa, Homo Sapiens
LGPSAYVSF

SEQ ID NO: 1049193 - protein, 9 aa, Homo Sapiens
KGIGSGSKV

SEQ ID NO: 1049194 - protein, 9 aa, Homo Sapiens
DKNDSLRYS

SEQ ID NO: 1049195 - protein, 9 aa, Homo Sapiens
HYGIIFCEG

SEQ ID NO: 1049196 - protein, 9 aa, Homo Sapiens
EMYDHQGRS

SEQ ID NO: 1049197 - protein, 9 aa, Homo Sapiens
VILRRYENC

SEQ ID NO: 1049198 - protein, 9 aa, Homo Sapiens
KSTAYFSPQ

SEQ ID NO: 1049199 - protein, 9 aa, Homo Sapiens
KNETTESTE

SEQ ID NO: 1049200 - protein, 9 aa, Homo Sapiens
AAVARTDGL

SEQ ID NO: 1049201 - protein, 9 aa, Homo Sapiens
LSLAIFAAE

SEQ ID NO: 1049202 - protein, 9 aa, Homo Sapiens
NTSWNRMIG

SEQ ID NO: 1049203 - protein, 9 aa, Homo Sapiens
MGKTALHIA

SEQ ID NO: 1049204 - protein, 9 aa, Homo Sapiens
TAEREVTME

SEQ ID NO: 1049205 - protein, 9 aa, Homo Sapiens
RYVRENCKL

SEQ ID NO: 1049206 - protein, 9 aa, Homo Sapiens
NSAPSILNG

SEQ ID NO: 1049207 - protein, 9 aa, Homo Sapiens
IFYIEDFAK

SEQ ID NO: 1049208 - protein, 9 aa, Homo Sapiens
TRSYMASER

SEQ ID NO: 1049209 - protein, 9 aa, Homo Sapiens
SIDNYYKLV

SEQ ID NO: 1049210 - protein, 9 aa, Homo Sapiens
CKLKIIKID

SEQ ID NO: 1049211 - protein, 9 aa, Homo Sapiens
NLPADLKAL

SEQ ID NO: 1049212 - protein, 9 aa, Homo Sapiens
QSFENSDKF

SEQ ID NO: 1049213 - protein, 9 aa, Homo Sapiens
CNFSNMWKK

SEQ ID NO: 1049214 - protein, 9 aa, Homo Sapiens
DQTDTEEED

SEQ ID NO: 1049215 - protein, 9 aa, Homo Sapiens
GLQPGTEYC

SEQ ID NO: 1049216 - protein, 9 aa, Homo Sapiens
SSVPHGADY

SEQ ID NO: 1049217 - protein, 9 aa, Homo Sapiens
PPQPTAAHF

SEQ ID NO: 1049218 - protein, 9 aa, Homo Sapiens
DNNLRFMIL

SEQ ID NO: 1049219 - protein, 9 aa, Homo Sapiens
TLAVFSIFS

SEQ ID NO: 1049220 - protein, 9 aa, Homo Sapiens
QAILLMDGR

SEQ ID NO: 1049221 - protein, 9 aa, Homo Sapiens
TQECAMVNS

SEQ ID NO: 1049222 - protein, 9 aa, Homo Sapiens
HQFFAIKSG

SEQ ID NO: 1049223 - protein, 9 aa, Homo Sapiens
TNCITRPPP

SEQ ID NO: 1049224 - protein, 9 aa, Homo Sapiens
AVLPGIYDI

SEQ ID NO: 1049225 - protein, 9 aa, Homo Sapiens
ILIFYGFIV

SEQ ID NO: 1049226 - protein, 9 aa, Homo Sapiens
YNSQAIKKV

SEQ ID NO: 1049227 - protein, 9 aa, Homo Sapiens
MELFQNSGN

SEQ ID NO: 1049228 - protein, 9 aa, Homo Sapiens
DDKIKFWLK

SEQ ID NO: 1049229 - protein, 9 aa, Homo Sapiens
MSSDFRTLL

SEQ ID NO: 1049230 - protein, 9 aa, Homo Sapiens
EMGYFAYWY

SEQ ID NO: 1049231 - protein, 9 aa, Homo Sapiens
DVTSTTFSR

SEQ ID NO: 1049232 - protein, 9 aa, Homo Sapiens
EDEESDSSF

SEQ ID NO: 1049233 - protein, 9 aa, Homo Sapiens
ISIVLFYIR

SEQ ID NO: 1049234 - protein, 9 aa, Homo Sapiens
HTALKLAVD

SEQ ID NO: 1049235 - protein, 9 aa, Homo Sapiens
ESKFNILKI

SEQ ID NO: 1049236 - protein, 9 aa, Homo Sapiens
WSSCIARTV

SEQ ID NO: 1049237 - protein, 9 aa, Homo Sapiens
FDFFLFKVA

SEQ ID NO: 1049238 - protein, 9 aa, Homo Sapiens
DSTTVNYFV

SEQ ID NO: 1049239 - protein, 9 aa, Homo Sapiens
SPEGTRKLA

SEQ ID NO: 1049240 - protein, 9 aa, Homo Sapiens
LVFFGIVVT

SEQ ID NO: 1049241 - protein, 9 aa, Homo Sapiens
KRDQAPFIF

SEQ ID NO: 1049242 - protein, 9 aa, Homo Sapiens
KSLHLEEDP

SEQ ID NO: 1049243 - protein, 9 aa, Homo Sapiens
RGEGAGFIS

SEQ ID NO: 1049244 - protein, 9 aa, Homo Sapiens
GSQDSGKPR

SEQ ID NO: 1049245 - protein, 9 aa, Homo Sapiens
RYALCTLSQ

SEQ ID NO: 1049246 - protein, 9 aa, Homo Sapiens
LAVISDSYL

SEQ ID NO: 1049247 - protein, 9 aa, Homo Sapiens
SLELKNTVC

SEQ ID NO: 1049248 - protein, 9 aa, Homo Sapiens
SSTAFQPLC

SEQ ID NO: 1049249 - protein, 9 aa, Homo Sapiens
GKGRPAKLS

SEQ ID NO: 1049250 - protein, 9 aa, Homo Sapiens
HSVPWWVIQ

SEQ ID NO: 1049251 - protein, 9 aa, Homo Sapiens
KYFFDRDPA

SEQ ID NO: 1049252 - protein, 9 aa, Homo Sapiens
DLVPEDETS

SEQ ID NO: 1049253 - protein, 9 aa, Homo Sapiens
IPSLHLFLF

SEQ ID NO: 1049254 - protein, 9 aa, Homo Sapiens
CETGWTGSS

SEQ ID NO: 1049255 - protein, 9 aa, Homo Sapiens
PNWLVVQVA

SEQ ID NO: 1049256 - protein, 9 aa, Homo Sapiens
CKKSENSIE

SEQ ID NO: 1049257 - protein, 9 aa, Homo Sapiens
EDRQLIADL

SEQ ID NO: 1049258 - protein, 9 aa, Homo Sapiens
MFEGHNTTA

SEQ ID NO: 1049259 - protein, 9 aa, Homo Sapiens
SRTVLQVLT

SEQ ID NO: 1049260 - protein, 9 aa, Homo Sapiens
SYPGRTNAD

SEQ ID NO: 1049261 - protein, 9 aa, Homo Sapiens
DDLPPRPEV

SEQ ID NO: 1049262 - protein, 9 aa, Homo Sapiens
RLGLVEEFL

SEQ ID NO: 1049263 - protein, 9 aa, Homo Sapiens
GKSVNWWAF

SEQ ID NO: 1049264 - protein, 9 aa, Homo Sapiens
RCLRAGGAG

SEQ ID NO: 1049265 - protein, 9 aa, Homo Sapiens
DASLSLLQT

SEQ ID NO: 1049266 - protein, 9 aa, Homo Sapiens
VFSPSFREL

SEQ ID NO: 1049267 - protein, 9 aa, Homo Sapiens
MASLALVGV

SEQ ID NO: 1049268 - protein, 9 aa, Homo Sapiens
CSFHEIPTP

SEQ ID NO: 1049269 - protein, 9 aa, Homo Sapiens
TATLTPSPL

SEQ ID NO: 1049270 - protein, 9 aa, Homo Sapiens
PFSGDIKLS

SEQ ID NO: 1049271 - protein, 9 aa, Homo Sapiens
NRYPSPREK

SEQ ID NO: 1049272 - protein, 9 aa, Homo Sapiens
QAFSLDIGI

SEQ ID NO: 1049273 - protein, 9 aa, Homo Sapiens
LNREEVYTV

SEQ ID NO: 1049274 - protein, 9 aa, Homo Sapiens
HNYPFLGIL

SEQ ID NO: 1049275 - protein, 9 aa, Homo Sapiens
EICARNHML

SEQ ID NO: 1049276 - protein, 9 aa, Homo Sapiens
REKQPSKGA

SEQ ID NO: 1049277 - protein, 9 aa, Homo Sapiens
PRIDYPLEF

SEQ ID NO: 1049278 - protein, 9 aa, Homo Sapiens
PRLIVLPND

SEQ ID NO: 1049279 - protein, 9 aa, Homo Sapiens
NEEQVHLEQ

SEQ ID NO: 1049280 - protein, 9 aa, Homo Sapiens
IPKRNEIKK

SEQ ID NO: 1049281 - protein, 9 aa, Homo Sapiens
PQRQDLSTD

SEQ ID NO: 1049282 - protein, 9 aa, Homo Sapiens
PKAPTFDKC

SEQ ID NO: 1049283 - protein, 9 aa, Homo Sapiens
FIRSSFFIR

SEQ ID NO: 1049284 - protein, 9 aa, Homo Sapiens
ATVETQNPF

SEQ ID NO: 1049285 - protein, 9 aa, Homo Sapiens
QKEQEEKEH

SEQ ID NO: 1049286 - protein, 9 aa, Homo Sapiens
QASSFSKAP

SEQ ID NO: 1049287 - protein, 9 aa, Homo Sapiens
HKEEKSYLW

SEQ ID NO: 1049288 - protein, 9 aa, Homo Sapiens
WVLRMVDGL

SEQ ID NO: 1049289 - protein, 9 aa, Homo Sapiens
DGEWRRLPW

SEQ ID NO: 1049290 - protein, 9 aa, Homo Sapiens
IMGNVLQSF

SEQ ID NO: 1049291 - protein, 9 aa, Homo Sapiens
AKTKEAGNG

SEQ ID NO: 1049292 - protein, 9 aa, Homo Sapiens
VPGLPSRME

SEQ ID NO: 1049293 - protein, 9 aa, Homo Sapiens
YSVKKTFFG

SEQ ID NO: 1049294 - protein, 9 aa, Homo Sapiens
RLIVLPNDV

SEQ ID NO: 1049295 - protein, 9 aa, Homo Sapiens
WASVHLHFF

SEQ ID NO: 1049296 - protein, 9 aa, Homo Sapiens
WLKMNSIVD

SEQ ID NO: 1049297 - protein, 9 aa, Homo Sapiens
VSSLFLFLV

SEQ ID NO: 1049298 - protein, 9 aa, Homo Sapiens
ISLFLAAGL

SEQ ID NO: 1049299 - protein, 9 aa, Homo Sapiens
VDLNGQDCR

SEQ ID NO: 1049300 - protein, 9 aa, Homo Sapiens
LSGLEVVTG

SEQ ID NO: 1049301 - protein, 9 aa, Homo Sapiens
KLDSHLHTL

SEQ ID NO: 1049302 - protein, 9 aa, Homo Sapiens
FAAALMKMS

SEQ ID NO: 1049303 - protein, 9 aa, Homo Sapiens
ITKLQAKHN

SEQ ID NO: 1049304 - protein, 9 aa, Homo Sapiens
ISVPHRPAK

SEQ ID NO: 1049305 - protein, 9 aa, Homo Sapiens
EDAEALGEQ

SEQ ID NO: 1049306 - protein, 9 aa, Homo Sapiens
GRSCHRNCV

SEQ ID NO: 1049307 - protein, 9 aa, Homo Sapiens
TLPRSQSMT

SEQ ID NO: 1049308 - protein, 9 aa, Homo Sapiens
SQDSLSKEL

SEQ ID NO: 1049309 - protein, 9 aa, Homo Sapiens
PGAPIKQAP

SEQ ID NO: 1049310 - protein, 9 aa, Homo Sapiens
FHLHTLQPE

SEQ ID NO: 1049311 - protein, 9 aa, Homo Sapiens
ELYKIGITY

SEQ ID NO: 1049312 - protein, 9 aa, Homo Sapiens
NGPRRLYAF

SEQ ID NO: 1049313 - protein, 9 aa, Homo Sapiens
QCQARKPPE

SEQ ID NO: 1049314 - protein, 9 aa, Homo Sapiens
AIQVQREEE

SEQ ID NO: 1049315 - protein, 9 aa, Homo Sapiens
IWYLDQIKR

SEQ ID NO: 1049316 - protein, 9 aa, Homo Sapiens
NQLVKQLID

SEQ ID NO: 1049317 - protein, 9 aa, Homo Sapiens
LAYLWMKRQ

SEQ ID NO: 1049318 - protein, 9 aa, Homo Sapiens
NKTIYYEPL

SEQ ID NO: 1049319 - protein, 9 aa, Homo Sapiens
GACTCLAGW

SEQ ID NO: 1049320 - protein, 9 aa, Homo Sapiens
FIVKGSCIC

SEQ ID NO: 1049321 - protein, 9 aa, Homo Sapiens
EGELPVACL

SEQ ID NO: 1049322 - protein, 9 aa, Homo Sapiens
GWKSTIYYN

SEQ ID NO: 1049323 - protein, 9 aa, Homo Sapiens
VYEDLEVTG

SEQ ID NO: 1049324 - protein, 9 aa, Homo Sapiens
KPVVELWQK

SEQ ID NO: 1049325 - protein, 9 aa, Homo Sapiens
WIIMKYLGG

SEQ ID NO: 1049326 - protein, 9 aa, Homo Sapiens
LFCQPLTAV

SEQ ID NO: 1049327 - protein, 9 aa, Homo Sapiens
GMYIAEKIH

SEQ ID NO: 1049328 - protein, 9 aa, Homo Sapiens
GFFQGDIWL

SEQ ID NO: 1049329 - protein, 9 aa, Homo Sapiens
SFVLKNFSA

SEQ ID NO: 1049330 - protein, 9 aa, Homo Sapiens
DLASADFPY

SEQ ID NO: 1049331 - protein, 9 aa, Homo Sapiens
SYEKQGLVS

SEQ ID NO: 1049332 - protein, 9 aa, Homo Sapiens
DPRTTMILF

SEQ ID NO: 1049333 - protein, 9 aa, Homo Sapiens
SNSVEKTVS

SEQ ID NO: 1049334 - protein, 9 aa, Homo Sapiens
SSFHSFPQL

SEQ ID NO: 1049335 - protein, 9 aa, Homo Sapiens
SFLLRNPNN

SEQ ID NO: 1049336 - protein, 9 aa, Homo Sapiens
GSRVELANT

SEQ ID NO: 1049337 - protein, 9 aa, Homo Sapiens
DDEFEEFLA

SEQ ID NO: 1049338 - protein, 9 aa, Homo Sapiens
DFIVKPDIP

SEQ ID NO: 1049339 - protein, 9 aa, Homo Sapiens
TCVILGVIF

SEQ ID NO: 1049340 - protein, 9 aa, Homo Sapiens
TKMKNILGH

SEQ ID NO: 1049341 - protein, 9 aa, Homo Sapiens
SVFGGARAA

SEQ ID NO: 1049342 - protein, 9 aa, Homo Sapiens
ELPPGPVLE

SEQ ID NO: 1049343 - protein, 9 aa, Homo Sapiens
APNKDAENE

SEQ ID NO: 1049344 - protein, 9 aa, Homo Sapiens
DEVDKRVYM

SEQ ID NO: 1049345 - protein, 9 aa, Homo Sapiens
LHVKEMYDH

SEQ ID NO: 1049346 - protein, 9 aa, Homo Sapiens
HYTVIIREE

SEQ ID NO: 1049347 - protein, 9 aa, Homo Sapiens
GINIVTANF

SEQ ID NO: 1049348 - protein, 9 aa, Homo Sapiens
SKASSQARS

SEQ ID NO: 1049349 - protein, 9 aa, Homo Sapiens
SSGNKNDEQ

SEQ ID NO: 1049350 - protein, 9 aa, Homo Sapiens
LYFQPPSKP

SEQ ID NO: 1049351 - protein, 9 aa, Homo Sapiens
RWKLVRTAL

SEQ ID NO: 1049352 - protein, 9 aa, Homo Sapiens
AMTEEVAWE

SEQ ID NO: 1049353 - protein, 9 aa, Homo Sapiens
GSTEQAAWR

SEQ ID NO: 1049354 - protein, 9 aa, Homo Sapiens
GLDKILKFV

SEQ ID NO: 1049355 - protein, 9 aa, Homo Sapiens
FVENHKRTF

SEQ ID NO: 1049356 - protein, 9 aa, Homo Sapiens
LSRSKPGES

SEQ ID NO: 1049357 - protein, 9 aa, Homo Sapiens
FCMAISIPN

SEQ ID NO: 1049358 - protein, 9 aa, Homo Sapiens
VPGNPVLAV

SEQ ID NO: 1049359 - protein, 9 aa, Homo Sapiens
KNPCSFKDQ

SEQ ID NO: 1049360 - protein, 9 aa, Homo Sapiens
QPAVTAPIS

SEQ ID NO: 1049361 - protein, 9 aa, Homo Sapiens
LFLIKILLR

SEQ ID NO: 1049362 - protein, 9 aa, Homo Sapiens
TNGSSTTED

SEQ ID NO: 1049363 - protein, 9 aa, Homo Sapiens
FTSIGNGPL

SEQ ID NO: 1049364 - protein, 9 aa, Homo Sapiens
EPGWVDPQT

SEQ ID NO: 1049365 - protein, 9 aa, Homo Sapiens
SFICTECGK

SEQ ID NO: 1049366 - protein, 9 aa, Homo Sapiens
DRPDFYSPA

SEQ ID NO: 1049367 - protein, 9 aa, Homo Sapiens
PLYPARFEK

SEQ ID NO: 1049368 - protein, 9 aa, Homo Sapiens
KRKDLELVL

SEQ ID NO: 1049369 - protein, 9 aa, Homo Sapiens
DFLIFKKSA

SEQ ID NO: 1049370 - protein, 9 aa, Homo Sapiens
ESSPPPAPE

SEQ ID NO: 1049371 - protein, 9 aa, Homo Sapiens
EDPVGRTHF

SEQ ID NO: 1049372 - protein, 9 aa, Homo Sapiens
HKGRGGKCT

SEQ ID NO: 1049373 - protein, 9 aa, Homo Sapiens
KFTVSVSEI

SEQ ID NO: 1049374 - protein, 9 aa, Homo Sapiens
NGHKEGATG

SEQ ID NO: 1049375 - protein, 9 aa, Homo Sapiens
LSWHNDLTQ

SEQ ID NO: 1049376 - protein, 9 aa, Homo Sapiens
AAEVLSISE

SEQ ID NO: 1049377 - protein, 9 aa, Homo Sapiens
EPGDRDVAY

SEQ ID NO: 1049378 - protein, 9 aa, Homo Sapiens
PRLPSYTPP

SEQ ID NO: 1049379 - protein, 9 aa, Homo Sapiens
EGYLQGNVN

SEQ ID NO: 1049380 - protein, 9 aa, Homo Sapiens
TQCNADSLN

SEQ ID NO: 1049381 - protein, 9 aa, Homo Sapiens
GSQIDRNMK

SEQ ID NO: 1049382 - protein, 9 aa, Homo Sapiens
LYLPALLAS

SEQ ID NO: 1049383 - protein, 9 aa, Homo Sapiens
EKYGAFIRS

SEQ ID NO: 1049384 - protein, 9 aa, Homo Sapiens
RMKGDWETM

SEQ ID NO: 1049385 - protein, 9 aa, Homo Sapiens
LFILLGFFQ

SEQ ID NO: 1049386 - protein, 9 aa, Homo Sapiens
QGSPEKARL

SEQ ID NO: 1049387 - protein, 9 aa, Homo Sapiens
LYWGHHFSV

SEQ ID NO: 1049388 - protein, 9 aa, Homo Sapiens
SGRRVTQVM

SEQ ID NO: 1049389 - protein, 9 aa, Homo Sapiens
YNIYSLLKR

SEQ ID NO: 1049390 - protein, 9 aa, Homo Sapiens
ENVQVMTMG

SEQ ID NO: 1049391 - protein, 9 aa, Homo Sapiens
ANLTNFPKN

SEQ ID NO: 1049392 - protein, 9 aa, Homo Sapiens
KKVSKLCYP

SEQ ID NO: 1049393 - protein, 9 aa, Homo Sapiens
RKILQKKEE

SEQ ID NO: 1049394 - protein, 9 aa, Homo Sapiens
LECQCVEEN

SEQ ID NO: 1049395 - protein, 9 aa, Homo Sapiens
TMDTYVNEN

SEQ ID NO: 1049396 - protein, 9 aa, Homo Sapiens
HPPDDDLFQ

SEQ ID NO: 1049397 - protein, 9 aa, Homo Sapiens
FWIYKVPSI

SEQ ID NO: 1049398 - protein, 9 aa, Homo Sapiens
APASPRQLT

SEQ ID NO: 1049399 - protein, 9 aa, Homo Sapiens
RSCHRNCVT

SEQ ID NO: 1049400 - protein, 9 aa, Homo Sapiens
EGALGVAPA

SEQ ID NO: 1049401 - protein, 9 aa, Homo Sapiens
NQQETPVQS

SEQ ID NO: 1049402 - protein, 9 aa, Homo Sapiens
SMVLFIYIE

SEQ ID NO: 1049403 - protein, 9 aa, Homo Sapiens
ATADLDPNC

SEQ ID NO: 1049404 - protein, 9 aa, Homo Sapiens
YTPPPPTVG

SEQ ID NO: 1049405 - protein, 9 aa, Homo Sapiens
FDPQQLFAS

SEQ ID NO: 1049406 - protein, 9 aa, Homo Sapiens
RLCEQNKRL

SEQ ID NO: 1049407 - protein, 9 aa, Homo Sapiens
RHRKIYTGE

SEQ ID NO: 1049408 - protein, 9 aa, Homo Sapiens
PPEDTKSTA

SEQ ID NO: 1049409 - protein, 9 aa, Homo Sapiens
LPPETPSSI

SEQ ID NO: 1049410 - protein, 9 aa, Homo Sapiens
TLPDGPSQP

SEQ ID NO: 1049411 - protein, 9 aa, Homo Sapiens
KLGIISGAL

SEQ ID NO: 1049412 - protein, 9 aa, Homo Sapiens
LCYVALDFK

SEQ ID NO: 1049413 - protein, 9 aa, Homo Sapiens
VASIADRLW

SEQ ID NO: 1049414 - protein, 9 aa, Homo Sapiens
DGHCKGHPN

SEQ ID NO: 1049415 - protein, 9 aa, Homo Sapiens
GDLKTTDFS

SEQ ID NO: 1049416 - protein, 9 aa, Homo Sapiens
EWKSKMEIF

SEQ ID NO: 1049417 - protein, 9 aa, Homo Sapiens
PIHSRTNLI

SEQ ID NO: 1049418 - protein, 9 aa, Homo Sapiens
NLYGTEWDL

SEQ ID NO: 1049419 - protein, 9 aa, Homo Sapiens
FSLVHILLI

SEQ ID NO: 1049420 - protein, 9 aa, Homo Sapiens
TVKNNFRIL

SEQ ID NO: 1049421 - protein, 9 aa, Homo Sapiens
FFFPISVSN

SEQ ID NO: 1049422 - protein, 9 aa, Homo Sapiens
GPELLGSRP

SEQ ID NO: 1049423 - protein, 9 aa, Homo Sapiens
AWDMRRRLR

SEQ ID NO: 1049424 - protein, 9 aa, Homo Sapiens
IILKQSGKN

SEQ ID NO: 1049425 - protein, 9 aa, Homo Sapiens
RERNAGSQI

SEQ ID NO: 1049426 - protein, 9 aa, Homo Sapiens
ILNCESADS

SEQ ID NO: 1049427 - protein, 9 aa, Homo Sapiens
RSYMASERL

SEQ ID NO: 1049428 - protein, 9 aa, Homo Sapiens
HIGKRYLNL

SEQ ID NO: 1049429 - protein, 9 aa, Homo Sapiens
YYTTKGWGA

SEQ ID NO: 1049430 - protein, 9 aa, Homo Sapiens
HEMEARLEK

SEQ ID NO: 1049431 - protein, 9 aa, Homo Sapiens
FNITKDTRL

SEQ ID NO: 1049432 - protein, 9 aa, Homo Sapiens
CKYSHFMHH

SEQ ID NO: 1049433 - protein, 9 aa, Homo Sapiens
DFRTLLLSV

SEQ ID NO: 1049434 - protein, 9 aa, Homo Sapiens
LKLENLLLN

SEQ ID NO: 1049435 - protein, 9 aa, Homo Sapiens
EYQKEMKAN

SEQ ID NO: 1049436 - protein, 9 aa, Homo Sapiens
VSQWSRSAS

SEQ ID NO: 1049437 - protein, 9 aa, Homo Sapiens
HYRLEDISM

SEQ ID NO: 1049438 - protein, 9 aa, Homo Sapiens
LILKFVMIV

SEQ ID NO: 1049439 - protein, 9 aa, Homo Sapiens
WQQRFRAKI

SEQ ID NO: 1049440 - protein, 9 aa, Homo Sapiens
CKLLRRYLT

SEQ ID NO: 1049441 - protein, 9 aa, Homo Sapiens
TWMRPPRKP

SEQ ID NO: 1049442 - protein, 9 aa, Homo Sapiens
AYNCSMAKK

SEQ ID NO: 1049443 - protein, 9 aa, Homo Sapiens
SRVDFGLSE

SEQ ID NO: 1049444 - protein, 9 aa, Homo Sapiens
PKEAKHGTF

SEQ ID NO: 1049445 - protein, 9 aa, Homo Sapiens
VGKNYDVTI

SEQ ID NO: 1049446 - protein, 9 aa, Homo Sapiens
FVSPERDSH

SEQ ID NO: 1049447 - protein, 9 aa, Homo Sapiens
RTYSLITPA

SEQ ID NO: 1049448 - protein, 9 aa, Homo Sapiens
NSYPFDGPG

SEQ ID NO: 1049449 - protein, 9 aa, Homo Sapiens
VDGYEQAAR

SEQ ID NO: 1049450 - protein, 9 aa, Homo Sapiens
KYESPENRK

SEQ ID NO: 1049451 - protein, 9 aa, Homo Sapiens
DQSIMGKFV

SEQ ID NO: 1049452 - protein, 9 aa, Homo Sapiens
LKWKKFSPG

SEQ ID NO: 1049453 - protein, 9 aa, Homo Sapiens
GHSSINGSE

SEQ ID NO: 1049454 - protein, 9 aa, Homo Sapiens
GPERVHRVF

SEQ ID NO: 1049455 - protein, 9 aa, Homo Sapiens
RELTKAGAK

SEQ ID NO: 1049456 - protein, 9 aa, Homo Sapiens
LHDIRKSVN

SEQ ID NO: 1049457 - protein, 9 aa, Homo Sapiens
TSNLTRMLL

SEQ ID NO: 1049458 - protein, 9 aa, Homo Sapiens
EGTSGEQEG

SEQ ID NO: 1049459 - protein, 9 aa, Homo Sapiens
KWLNRNSSA

SEQ ID NO: 1049460 - protein, 9 aa, Homo Sapiens
TIENLTRLL

SEQ ID NO: 1049461 - protein, 9 aa, Homo Sapiens
KNAFLPPGN

SEQ ID NO: 1049462 - protein, 9 aa, Homo Sapiens
TQEKSYKCN

SEQ ID NO: 1049463 - protein, 9 aa, Homo Sapiens
QPPPPQSAR

SEQ ID NO: 1049464 - protein, 9 aa, Homo Sapiens
LPVPRPCLY

SEQ ID NO: 1049465 - protein, 9 aa, Homo Sapiens
REDQIIGMT

SEQ ID NO: 1049466 - protein, 9 aa, Homo Sapiens
LWSLLGSIS

SEQ ID NO: 1049467 - protein, 9 aa, Homo Sapiens
SADVEERFY

SEQ ID NO: 1049468 - protein, 9 aa, Homo Sapiens
KKKKYMLPL

SEQ ID NO: 1049469 - protein, 9 aa, Homo Sapiens
DPVGRTHFM

SEQ ID NO: 1049470 - protein, 9 aa, Homo Sapiens
HLEQQKKHL

SEQ ID NO: 1049471 - protein, 9 aa, Homo Sapiens
KEGGGEMDT

SEQ ID NO: 1049472 - protein, 9 aa, Homo Sapiens
SCIARTVSS

SEQ ID NO: 1049473 - protein, 9 aa, Homo Sapiens
FLFFIAISG

SEQ ID NO: 1049474 - protein, 9 aa, Homo Sapiens
KFTTKIHPS

SEQ ID NO: 1049475 - protein, 9 aa, Homo Sapiens
KLGILDLLN

SEQ ID NO: 1049476 - protein, 9 aa, Homo Sapiens
VSNFGMSRV

SEQ ID NO: 1049477 - protein, 9 aa, Homo Sapiens
LDEQPGPQG

SEQ ID NO: 1049478 - protein, 9 aa, Homo Sapiens
LSSRLQSEM

SEQ ID NO: 1049479 - protein, 9 aa, Homo Sapiens
FLQNPQTFL

SEQ ID NO: 1049480 - protein, 9 aa, Homo Sapiens
VLAEKALDK

SEQ ID NO: 1049481 - protein, 9 aa, Homo Sapiens
WVTVLDPFS

SEQ ID NO: 1049482 - protein, 9 aa, Homo Sapiens
ICYQLRMSK

SEQ ID NO: 1049483 - protein, 9 aa, Homo Sapiens
VTRMSSQPP

SEQ ID NO: 1049484 - protein, 9 aa, Homo Sapiens
SPKVSSSQL

SEQ ID NO: 1049485 - protein, 9 aa, Homo Sapiens
KFINVMKEA

SEQ ID NO: 1049486 - protein, 9 aa, Homo Sapiens
PFKFTIFES

SEQ ID NO: 1049487 - protein, 9 aa, Homo Sapiens
GVQEEIQVL

SEQ ID NO: 1049488 - protein, 9 aa, Homo Sapiens
ARSLETFTP

SEQ ID NO: 1049489 - protein, 9 aa, Homo Sapiens
PTYTSTAPI

SEQ ID NO: 1049490 - protein, 9 aa, Homo Sapiens
VLKNFSALL

SEQ ID NO: 1049491 - protein, 9 aa, Homo Sapiens
RLSKASSQA

SEQ ID NO: 1049492 - protein, 9 aa, Homo Sapiens
ATCNNPGMP

SEQ ID NO: 1049493 - protein, 9 aa, Homo Sapiens
MTEDCLNEV

SEQ ID NO: 1049494 - protein, 9 aa, Homo Sapiens
QTINIVTHR

SEQ ID NO: 1049495 - protein, 9 aa, Homo Sapiens
PCMLGAQGR

SEQ ID NO: 1049496 - protein, 9 aa, Homo Sapiens
AYVSFFFNR

SEQ ID NO: 1049497 - protein, 9 aa, Homo Sapiens
KEVSFCHCA

SEQ ID NO: 1049498 - protein, 9 aa, Homo Sapiens
GAEPLLRNG

SEQ ID NO: 1049499 - protein, 9 aa, Homo Sapiens
IPIVLIFQK

SEQ ID NO: 1049500 - protein, 9 aa, Homo Sapiens
TCYQLRYTE

SEQ ID NO: 1049501 - protein, 9 aa, Homo Sapiens
SGGGGDGPW

SEQ ID NO: 1049502 - protein, 9 aa, Homo Sapiens
KQAVTVFYF

SEQ ID NO: 1049503 - protein, 9 aa, Homo Sapiens
QNPRRVAGT

SEQ ID NO: 1049504 - protein, 9 aa, Homo Sapiens
SLQLPQYPG

SEQ ID NO: 1049505 - protein, 9 aa, Homo Sapiens
NFLPMRPQQ

SEQ ID NO: 1049506 - protein, 9 aa, Homo Sapiens
RAPSHMSSF

SEQ ID NO: 1049507 - protein, 9 aa, Homo Sapiens
VTQVMRDFL

SEQ ID NO: 1049508 - protein, 9 aa, Homo Sapiens
FRKLNEQSS

SEQ ID NO: 1049509 - protein, 9 aa, Homo Sapiens
RNIEDDLKM

SEQ ID NO: 1049510 - protein, 9 aa, Homo Sapiens
TGKKRKGSK

SEQ ID NO: 1049511 - protein, 9 aa, Homo Sapiens
FPKNDVIVA

SEQ ID NO: 1049512 - protein, 9 aa, Homo Sapiens
GYNKFKPQN

SEQ ID NO: 1049513 - protein, 9 aa, Homo Sapiens
NTMLIFIVV

SEQ ID NO: 1049514 - protein, 9 aa, Homo Sapiens
VSNSLQAMK

SEQ ID NO: 1049515 - protein, 9 aa, Homo Sapiens
QDLIRAVFL

SEQ ID NO: 1049516 - protein, 9 aa, Homo Sapiens
HYSIPKEAK

SEQ ID NO: 1049517 - protein, 9 aa, Homo Sapiens
QKVVYLVSQ

SEQ ID NO: 1049518 - protein, 9 aa, Homo Sapiens
MLLLCGIDK

SEQ ID NO: 1049519 - protein, 9 aa, Homo Sapiens
EISRVLSAQ

SEQ ID NO: 1049520 - protein, 9 aa, Homo Sapiens
SVTNTLIMT

SEQ ID NO: 1049521 - protein, 9 aa, Homo Sapiens
PRFWKEMSL

SEQ ID NO: 1049522 - protein, 9 aa, Homo Sapiens
GCVAAPGGH

SEQ ID NO: 1049523 - protein, 9 aa, Homo Sapiens
FKLEMEVLE

SEQ ID NO: 1049524 - protein, 9 aa, Homo Sapiens
DFYSPAYEE

SEQ ID NO: 1049525 - protein, 9 aa, Homo Sapiens
NNSYVRKAL

SEQ ID NO: 1049526 - protein, 9 aa, Homo Sapiens
KSKLAARLQ

SEQ ID NO: 1049527 - protein, 9 aa, Homo Sapiens
PQPQALCQG

SEQ ID NO: 1049528 - protein, 9 aa, Homo Sapiens
NLIRKHTSS

SEQ ID NO: 1049529 - protein, 9 aa, Homo Sapiens
YNKFKPQNC

SEQ ID NO: 1049530 - protein, 9 aa, Homo Sapiens
DNDKNYIHP

SEQ ID NO: 1049531 - protein, 9 aa, Homo Sapiens
KHDNFHGGL

SEQ ID NO: 1049532 - protein, 9 aa, Homo Sapiens
SISKLPEED

SEQ ID NO: 1049533 - protein, 9 aa, Homo Sapiens
GSWARERPR

SEQ ID NO: 1049534 - protein, 9 aa, Homo Sapiens
DCLNEVKAA

SEQ ID NO: 1049535 - protein, 9 aa, Homo Sapiens
LKEIMENPI

SEQ ID NO: 1049536 - protein, 9 aa, Homo Sapiens
EEVRGFWQT

SEQ ID NO: 1049537 - protein, 9 aa, Homo Sapiens
LSKPKKIYT

SEQ ID NO: 1049538 - protein, 9 aa, Homo Sapiens
ASFLQTTDV

SEQ ID NO: 1049539 - protein, 9 aa, Homo Sapiens
KIKMEGIDP

SEQ ID NO: 1049540 - protein, 9 aa, Homo Sapiens
LTNPKPSFT

SEQ ID NO: 1049541 - protein, 9 aa, Homo Sapiens
IRGDNEEWN

SEQ ID NO: 1049542 - protein, 9 aa, Homo Sapiens
KMREIEKVL

SEQ ID NO: 1049543 - protein, 9 aa, Homo Sapiens
YFTVAQNKE

SEQ ID NO: 1049544 - protein, 9 aa, Homo Sapiens
LPSGIEHSM

SEQ ID NO: 1049545 - protein, 9 aa, Homo Sapiens
VSVPTASEV

SEQ ID NO: 1049546 - protein, 9 aa, Homo Sapiens
DTPPSERRN

SEQ ID NO: 1049547 - protein, 9 aa, Homo Sapiens
TLAIKEKVI

SEQ ID NO: 1049548 - protein, 9 aa, Homo Sapiens
VLLIGLPNT

SEQ ID NO: 1049549 - protein, 9 aa, Homo Sapiens
RVSIPWVSG

SEQ ID NO: 1049550 - protein, 9 aa, Homo Sapiens
SLASGDTTC

SEQ ID NO: 1049551 - protein, 9 aa, Homo Sapiens
TFVCPSRES

SEQ ID NO: 1049552 - protein, 9 aa, Homo Sapiens
YSRGLEPRV

SEQ ID NO: 1049553 - protein, 9 aa, Homo Sapiens
FEMWNIINP

SEQ ID NO: 1049554 - protein, 9 aa, Homo Sapiens
PTLLSLLGA

SEQ ID NO: 1049555 - protein, 9 aa, Homo Sapiens
RVRVVIFAF

SEQ ID NO: 1049556 - protein, 9 aa, Homo Sapiens
SYLWSSFFS

SEQ ID NO: 1049557 - protein, 9 aa, Homo Sapiens
KSELFTGIF

SEQ ID NO: 1049558 - protein, 9 aa, Homo Sapiens
NTFCMAISI

SEQ ID NO: 1049559 - protein, 9 aa, Homo Sapiens
AAEKDSGRF

SEQ ID NO: 1049560 - protein, 9 aa, Homo Sapiens
TGNISLFQQ

SEQ ID NO: 1049561 - protein, 9 aa, Homo Sapiens
CRECASGYW

SEQ ID NO: 1049562 - protein, 9 aa, Homo Sapiens
VVEDTYPET

SEQ ID NO: 1049563 - protein, 9 aa, Homo Sapiens
EDTELLSFP

SEQ ID NO: 1049564 - protein, 9 aa, Homo Sapiens
AAGAEPLLR

SEQ ID NO: 1049565 - protein, 9 aa, Homo Sapiens
IQIETVLPA

SEQ ID NO: 1049566 - protein, 9 aa, Homo Sapiens
ARFVSRFCA

SEQ ID NO: 1049567 - protein, 9 aa, Homo Sapiens
RKPPMVVDN

SEQ ID NO: 1049568 - protein, 9 aa, Homo Sapiens
GAPGFPESK

SEQ ID NO: 1049569 - protein, 9 aa, Homo Sapiens
EAEGALGVA

SEQ ID NO: 1049570 - protein, 9 aa, Homo Sapiens
MCQFLTGLY

SEQ ID NO: 1049571 - protein, 9 aa, Homo Sapiens
KKKEFEECL

SEQ ID NO: 1049572 - protein, 9 aa, Homo Sapiens
GGGGGGRKG

SEQ ID NO: 1049573 - protein, 9 aa, Homo Sapiens
DKDMPGSHH

SEQ ID NO: 1049574 - protein, 9 aa, Homo Sapiens
TILLLPAST

SEQ ID NO: 1049575 - protein, 9 aa, Homo Sapiens
DVNHPGRTN

SEQ ID NO: 1049576 - protein, 9 aa, Homo Sapiens
CKTILCLLP

SEQ ID NO: 1049577 - protein, 9 aa, Homo Sapiens
DPCADNLLC

SEQ ID NO: 1049578 - protein, 9 aa, Homo Sapiens
KSSFQIIQF

SEQ ID NO: 1049579 - protein, 9 aa, Homo Sapiens
SEEPSRKNS

SEQ ID NO: 1049580 - protein, 9 aa, Homo Sapiens
DTQENMGFS

SEQ ID NO: 1049581 - protein, 9 aa, Homo Sapiens
NPKNAFLPP

SEQ ID NO: 1049582 - protein, 9 aa, Homo Sapiens
INKEFCVRT

SEQ ID NO: 1049583 - protein, 9 aa, Homo Sapiens
HQGRSYLHI

SEQ ID NO: 1049584 - protein, 9 aa, Homo Sapiens
PERRGEGAE

SEQ ID NO: 1049585 - protein, 9 aa, Homo Sapiens
VKPLEWNTS

SEQ ID NO: 1049586 - protein, 9 aa, Homo Sapiens
CRQSHCGSR

SEQ ID NO: 1049587 - protein, 9 aa, Homo Sapiens
NSCVSGIPA

SEQ ID NO: 1049588 - protein, 9 aa, Homo Sapiens
QSSYLDARD

SEQ ID NO: 1049589 - protein, 9 aa, Homo Sapiens
KEELKIVVI

SEQ ID NO: 1049590 - protein, 9 aa, Homo Sapiens
TGPPFYLKK

SEQ ID NO: 1049591 - protein, 9 aa, Homo Sapiens
SFDEMAKYN

SEQ ID NO: 1049592 - protein, 9 aa, Homo Sapiens
SRHYLDFIN

SEQ ID NO: 1049593 - protein, 9 aa, Homo Sapiens
FTTKIHPSC

SEQ ID NO: 1049594 - protein, 9 aa, Homo Sapiens
SRVELANTS

SEQ ID NO: 1049595 - protein, 9 aa, Homo Sapiens
ASSFSKAPP

SEQ ID NO: 1049596 - protein, 9 aa, Homo Sapiens
LLKEMKRGW

SEQ ID NO: 1049597 - protein, 9 aa, Homo Sapiens
VTLGSTFNE

SEQ ID NO: 1049598 - protein, 9 aa, Homo Sapiens
CDISCNKFL

SEQ ID NO: 1049599 - protein, 9 aa, Homo Sapiens
QEEYHLNPK

SEQ ID NO: 1049600 - protein, 9 aa, Homo Sapiens
IFTLGETRA

SEQ ID NO: 1049601 - protein, 9 aa, Homo Sapiens
FWLTVETSV

SEQ ID NO: 1049602 - protein, 9 aa, Homo Sapiens
HVFASSRWQ

SEQ ID NO: 1049603 - protein, 9 aa, Homo Sapiens
RLPVDKFLF

SEQ ID NO: 1049604 - protein, 9 aa, Homo Sapiens
DCINRLQAA

SEQ ID NO: 1049605 - protein, 9 aa, Homo Sapiens
SVDEFFASV

SEQ ID NO: 1049606 - protein, 9 aa, Homo Sapiens
LAAKKAQAM

SEQ ID NO: 1049607 - protein, 9 aa, Homo Sapiens
FEFLPSFPL

SEQ ID NO: 1049608 - protein, 9 aa, Homo Sapiens
TATLFAPPL

SEQ ID NO: 1049609 - protein, 9 aa, Homo Sapiens
DFPEEDKKK

SEQ ID NO: 1049610 - protein, 9 aa, Homo Sapiens
HFSLFSTFP

SEQ ID NO: 1049611 - protein, 9 aa, Homo Sapiens
DCQVSEWSE

SEQ ID NO: 1049612 - protein, 9 aa, Homo Sapiens
EAKQEKIKM

SEQ ID NO: 1049613 - protein, 9 aa, Homo Sapiens
GEPSISLAL

SEQ ID NO: 1049614 - protein, 9 aa, Homo Sapiens
KLDRPSMGI

SEQ ID NO: 1049615 - protein, 9 aa, Homo Sapiens
TLRFWQLSS

SEQ ID NO: 1049616 - protein, 9 aa, Homo Sapiens
WNSSKKLRV

SEQ ID NO: 1049617 - protein, 9 aa, Homo Sapiens
SHNLHSLLP

SEQ ID NO: 1049618 - protein, 9 aa, Homo Sapiens
FCTPVHLVD

SEQ ID NO: 1049619 - protein, 9 aa, Homo Sapiens
LGEVFNRLD

SEQ ID NO: 1049620 - protein, 9 aa, Homo Sapiens
MVRHKILLP

SEQ ID NO: 1049621 - protein, 9 aa, Homo Sapiens
SSRDFQVTV

SEQ ID NO: 1049622 - protein, 9 aa, Homo Sapiens
NYRLLAKKR

SEQ ID NO: 1049623 - protein, 9 aa, Homo Sapiens
WKDFYYSLK

SEQ ID NO: 1049624 - protein, 9 aa, Homo Sapiens
MFCYSNWLD

SEQ ID NO: 1049625 - protein, 9 aa, Homo Sapiens
DKVTHGYLH

SEQ ID NO: 1049626 - protein, 9 aa, Homo Sapiens
QKRKILDNK

SEQ ID NO: 1049627 - protein, 9 aa, Homo Sapiens
SIQRSIQVT

SEQ ID NO: 1049628 - protein, 9 aa, Homo Sapiens
QYISMHGKQ

SEQ ID NO: 1049629 - protein, 9 aa, Homo Sapiens
LHYSVSEAA

SEQ ID NO: 1049630 - protein, 9 aa, Homo Sapiens
PSPVFLMRA

SEQ ID NO: 1049631 - protein, 9 aa, Homo Sapiens
ASDENHCPL

SEQ ID NO: 1049632 - protein, 9 aa, Homo Sapiens
VASLPNRGR

SEQ ID NO: 1049633 - protein, 9 aa, Homo Sapiens
SSIVGRPRQ

SEQ ID NO: 1049634 - protein, 9 aa, Homo Sapiens
AGTDGYAAV

SEQ ID NO: 1049635 - protein, 9 aa, Homo Sapiens
QTFQHSGIL

SEQ ID NO: 1049636 - protein, 9 aa, Homo Sapiens
TDLRRKSVL

SEQ ID NO: 1049637 - protein, 9 aa, Homo Sapiens
CGAAPPYVY

SEQ ID NO: 1049638 - protein, 9 aa, Homo Sapiens
SHDTDILWL

SEQ ID NO: 1049639 - protein, 9 aa, Homo Sapiens
QDLQREKDA

SEQ ID NO: 1049640 - protein, 9 aa, Homo Sapiens
ASKTGKKRK

SEQ ID NO: 1049641 - protein, 9 aa, Homo Sapiens
LKPFFGGSA

SEQ ID NO: 1049642 - protein, 9 aa, Homo Sapiens
PRQPSPRPT

SEQ ID NO: 1049643 - protein, 9 aa, Homo Sapiens
SLSHSVPAS

SEQ ID NO: 1049644 - protein, 9 aa, Homo Sapiens
FTVAQNKEF

SEQ ID NO: 1049645 - protein, 9 aa, Homo Sapiens
RVTRDNPRT

SEQ ID NO: 1049646 - protein, 9 aa, Homo Sapiens
KKFYVLLGE

SEQ ID NO: 1049647 - protein, 9 aa, Homo Sapiens
DKTYPIKSP

SEQ ID NO: 1049648 - protein, 9 aa, Homo Sapiens
HNDQIQPII

SEQ ID NO: 1049649 - protein, 9 aa, Homo Sapiens
QSLALGIQF

SEQ ID NO: 1049650 - protein, 9 aa, Homo Sapiens
AGRAAPEGA

SEQ ID NO: 1049651 - protein, 9 aa, Homo Sapiens
TLKYLWLNF

SEQ ID NO: 1049652 - protein, 9 aa, Homo Sapiens
ITVNNSGFY

SEQ ID NO: 1049653 - protein, 9 aa, Homo Sapiens
NKQQYKMVI

SEQ ID NO: 1049654 - protein, 9 aa, Homo Sapiens
GKAFMCPCY

SEQ ID NO: 1049655 - protein, 9 aa, Homo Sapiens
LTSQASCVD

SEQ ID NO: 1049656 - protein, 9 aa, Homo Sapiens
HRQQSLALG

SEQ ID NO: 1049657 - protein, 9 aa, Homo Sapiens
SSGHCHSDV

SEQ ID NO: 1049658 - protein, 9 aa, Homo Sapiens
EQEISRVLS

SEQ ID NO: 1049659 - protein, 9 aa, Homo Sapiens
HQSFRSLLH

SEQ ID NO: 1049660 - protein, 9 aa, Homo Sapiens
KSTLDECLS

SEQ ID NO: 1049661 - protein, 9 aa, Homo Sapiens
YEMMMESVK

SEQ ID NO: 1049662 - protein, 9 aa, Homo Sapiens
EDNWMENID

SEQ ID NO: 1049663 - protein, 9 aa, Homo Sapiens
ITDRFRFAI

SEQ ID NO: 1049664 - protein, 9 aa, Homo Sapiens
EDQGVFTQL

SEQ ID NO: 1049665 - protein, 9 aa, Homo Sapiens
TGDTLFQCW

SEQ ID NO: 1049666 - protein, 9 aa, Homo Sapiens
DRAPQTLPF

SEQ ID NO: 1049667 - protein, 9 aa, Homo Sapiens
ATGQNGPRR

SEQ ID NO: 1049668 - protein, 9 aa, Homo Sapiens
VLSAQRSPE

SEQ ID NO: 1049669 - protein, 9 aa, Homo Sapiens
AAFTSGVPD

SEQ ID NO: 1049670 - protein, 9 aa, Homo Sapiens
PLSQDTSGQ

SEQ ID NO: 1049671 - protein, 9 aa, Homo Sapiens
RSFKSQDRK

SEQ ID NO: 1049672 - protein, 9 aa, Homo Sapiens
PEGTSGHSS

SEQ ID NO: 1049673 - protein, 9 aa, Homo Sapiens
DSKWNSSPP

SEQ ID NO: 1049674 - protein, 9 aa, Homo Sapiens
EEVIPDEKF

SEQ ID NO: 1049675 - protein, 9 aa, Homo Sapiens
ERSSGHCHS

SEQ ID NO: 1049676 - protein, 9 aa, Homo Sapiens
HCHSDVATM

SEQ ID NO: 1049677 - protein, 9 aa, Homo Sapiens
DKNAFPPTY

SEQ ID NO: 1049678 - protein, 9 aa, Homo Sapiens
LEEMQPMLQ

SEQ ID NO: 1049679 - protein, 9 aa, Homo Sapiens
QIFRMFPKD

SEQ ID NO: 1049680 - protein, 9 aa, Homo Sapiens
FPSLHDSSP

SEQ ID NO: 1049681 - protein, 9 aa, Homo Sapiens
CPVPSQCVF

SEQ ID NO: 1049682 - protein, 9 aa, Homo Sapiens
SQFHRQTVK

SEQ ID NO: 1049683 - protein, 9 aa, Homo Sapiens
HVSFFWYQQ

SEQ ID NO: 1049684 - protein, 9 aa, Homo Sapiens
TTMILFKML

SEQ ID NO: 1049685 - protein, 9 aa, Homo Sapiens
HEDQTDTEE

SEQ ID NO: 1049686 - protein, 9 aa, Homo Sapiens
MNYVYKERF

SEQ ID NO: 1049687 - protein, 9 aa, Homo Sapiens
YMTLYDKVT

SEQ ID NO: 1049688 - protein, 9 aa, Homo Sapiens
DANEIHKKN

SEQ ID NO: 1049689 - protein, 9 aa, Homo Sapiens
DRFTAICYL

SEQ ID NO: 1049690 - protein, 9 aa, Homo Sapiens
DSMLQEGTF

SEQ ID NO: 1049691 - protein, 9 aa, Homo Sapiens
YTFEFYFLP

SEQ ID NO: 1049692 - protein, 9 aa, Homo Sapiens
EEEDFIVKP

SEQ ID NO: 1049693 - protein, 9 aa, Homo Sapiens
DGLSLLFGW

SEQ ID NO: 1049694 - protein, 9 aa, Homo Sapiens
QENSDGMYQ

SEQ ID NO: 1049695 - protein, 9 aa, Homo Sapiens
EEEVWKVLN

SEQ ID NO: 1049696 - protein, 9 aa, Homo Sapiens
VVYHVIVPC

SEQ ID NO: 1049697 - protein, 9 aa, Homo Sapiens
SLSKELAKL

SEQ ID NO: 1049698 - protein, 9 aa, Homo Sapiens
WLSTECDFH

SEQ ID NO: 1049699 - protein, 9 aa, Homo Sapiens
EDDLKMMWS

SEQ ID NO: 1049700 - protein, 9 aa, Homo Sapiens
EEKQPWAEP

SEQ ID NO: 1049701 - protein, 9 aa, Homo Sapiens
SPGPVSQAF

SEQ ID NO: 1049702 - protein, 9 aa, Homo Sapiens
HTVGTEETP

SEQ ID NO: 1049703 - protein, 9 aa, Homo Sapiens
IGTYDLDTL

SEQ ID NO: 1049704 - protein, 9 aa, Homo Sapiens
KSQKESVLI

SEQ ID NO: 1049705 - protein, 9 aa, Homo Sapiens
EGSGEAEEY

SEQ ID NO: 1049706 - protein, 9 aa, Homo Sapiens
LLTMWYKNL

SEQ ID NO: 1049707 - protein, 9 aa, Homo Sapiens
AFRQLQVYR

SEQ ID NO: 1049708 - protein, 9 aa, Homo Sapiens
SRYHKQPQN

SEQ ID NO: 1049709 - protein, 9 aa, Homo Sapiens
EQLTFEMFE

SEQ ID NO: 1049710 - protein, 9 aa, Homo Sapiens
NNLKPETVY

SEQ ID NO: 1049711 - protein, 9 aa, Homo Sapiens
QFDLLHKYQ

SEQ ID NO: 1049712 - protein, 9 aa, Homo Sapiens
SGYNQGYAG

SEQ ID NO: 1049713 - protein, 9 aa, Homo Sapiens
LSTPAAPKR

SEQ ID NO: 1049714 - protein, 9 aa, Homo Sapiens
LHQVPDAGT

SEQ ID NO: 1049715 - protein, 9 aa, Homo Sapiens
NWVQKKYLV

SEQ ID NO: 1049716 - protein, 9 aa, Homo Sapiens
SDFLMCLFC

SEQ ID NO: 1049717 - protein, 9 aa, Homo Sapiens
SFLVDEEMI

SEQ ID NO: 1049718 - protein, 9 aa, Homo Sapiens
SVTRNPSSS

SEQ ID NO: 1049719 - protein, 9 aa, Homo Sapiens
SISPTTPGE

SEQ ID NO: 1049720 - protein, 9 aa, Homo Sapiens
PKLHHPFQG

SEQ ID NO: 1049721 - protein, 9 aa, Homo Sapiens
QEVKIYFSI

SEQ ID NO: 1049722 - protein, 9 aa, Homo Sapiens
IAKMPGMNS

SEQ ID NO: 1049723 - protein, 9 aa, Homo Sapiens
TQHKRIYTR

SEQ ID NO: 1049724 - protein, 9 aa, Homo Sapiens
GTYNVSTPG

SEQ ID NO: 1049725 - protein, 9 aa, Homo Sapiens
PPMSSIPES

SEQ ID NO: 1049726 - protein, 9 aa, Homo Sapiens
FKYVASMEQ

SEQ ID NO: 1049727 - protein, 9 aa, Homo Sapiens
VCKVSNFGM

SEQ ID NO: 1049728 - protein, 9 aa, Homo Sapiens
LTRNEQAGG

SEQ ID NO: 1049729 - protein, 9 aa, Homo Sapiens
QVEKFINNA

SEQ ID NO: 1049730 - protein, 9 aa, Homo Sapiens
SDTLAIKEK

SEQ ID NO: 1049731 - protein, 9 aa, Homo Sapiens
DNGAYCCTG

SEQ ID NO: 1049732 - protein, 9 aa, Homo Sapiens
QKENRRLSR

SEQ ID NO: 1049733 - protein, 9 aa, Homo Sapiens
GSQEPADRR

SEQ ID NO: 1049734 - protein, 9 aa, Homo Sapiens
VNPPAATVL

SEQ ID NO: 1049735 - protein, 9 aa, Homo Sapiens
QASALTATL

SEQ ID NO: 1049736 - protein, 9 aa, Homo Sapiens
YGEGYSNAQ

SEQ ID NO: 1049737 - protein, 9 aa, Homo Sapiens
QNPAPLECG

SEQ ID NO: 1049738 - protein, 9 aa, Homo Sapiens
VEWGLQNIR

SEQ ID NO: 1049739 - protein, 9 aa, Homo Sapiens
QECVNTPEG

SEQ ID NO: 1049740 - protein, 9 aa, Homo Sapiens
NSYSIDNNE

SEQ ID NO: 1049741 - protein, 9 aa, Homo Sapiens
NLETRDETQ

SEQ ID NO: 1049742 - protein, 9 aa, Homo Sapiens
PPGESGPGG

SEQ ID NO: 1049743 - protein, 9 aa, Homo Sapiens
GIYHINQQI

SEQ ID NO: 1049744 - protein, 9 aa, Homo Sapiens
RHGSNFGHS

SEQ ID NO: 1049745 - protein, 9 aa, Homo Sapiens
RFWQLSSLL

SEQ ID NO: 1049746 - protein, 9 aa, Homo Sapiens
SHSPEPPED

SEQ ID NO: 1049747 - protein, 9 aa, Homo Sapiens
RLWPDSGSF

SEQ ID NO: 1049748 - protein, 9 aa, Homo Sapiens
ENVRVSGWL

SEQ ID NO: 1049749 - protein, 9 aa, Homo Sapiens
FSLTLVRSF

SEQ ID NO: 1049750 - protein, 9 aa, Homo Sapiens
PKTFLNEKA

SEQ ID NO: 1049751 - protein, 9 aa, Homo Sapiens
KRRKFIFVQ

SEQ ID NO: 1049752 - protein, 9 aa, Homo Sapiens
GPQCRECAS

SEQ ID NO: 1049753 - protein, 9 aa, Homo Sapiens
ESRYLLAHF

SEQ ID NO: 1049754 - protein, 9 aa, Homo Sapiens
SSAMKKNKP

SEQ ID NO: 1049755 - protein, 9 aa, Homo Sapiens
MYYSQKAIP

SEQ ID NO: 1049756 - protein, 9 aa, Homo Sapiens
PTRNSSNMA

SEQ ID NO: 1049757 - protein, 9 aa, Homo Sapiens
YHSANQLSI

SEQ ID NO: 1049758 - protein, 9 aa, Homo Sapiens
PVSYTFEFY

SEQ ID NO: 1049759 - protein, 9 aa, Homo Sapiens
YNKVFTPVS

SEQ ID NO: 1049760 - protein, 9 aa, Homo Sapiens
VLSEEKKQQ

SEQ ID NO: 1049761 - protein, 9 aa, Homo Sapiens
KSEKLELQM

SEQ ID NO: 1049762 - protein, 9 aa, Homo Sapiens
PYSLTSQVS

SEQ ID NO: 1049763 - protein, 9 aa, Homo Sapiens
ATDRGMAPD

SEQ ID NO: 1049764 - protein, 9 aa, Homo Sapiens
TEYCLTLYT

SEQ ID NO: 1049765 - protein, 9 aa, Homo Sapiens
AIKEKVIDV

SEQ ID NO: 1049766 - protein, 9 aa, Homo Sapiens
ELKKPEEEF

SEQ ID NO: 1049767 - protein, 9 aa, Homo Sapiens
ATCATPSNA

SEQ ID NO: 1049768 - protein, 9 aa, Homo Sapiens
SKLQELWLR

SEQ ID NO: 1049769 - protein, 9 aa, Homo Sapiens
SGNLFGGSE

SEQ ID NO: 1049770 - protein, 9 aa, Homo Sapiens
VLAGPGGLG

SEQ ID NO: 1049771 - protein, 9 aa, Homo Sapiens
KLKRLDIFP

SEQ ID NO: 1049772 - protein, 9 aa, Homo Sapiens
DEHETKIFK

SEQ ID NO: 1049773 - protein, 9 aa, Homo Sapiens
PAAFCLRCF

SEQ ID NO: 1049774 - protein, 9 aa, Homo Sapiens
YLFDGSCMV

SEQ ID NO: 1049775 - protein, 9 aa, Homo Sapiens
ELQVQNSTL

SEQ ID NO: 1049776 - protein, 9 aa, Homo Sapiens
NSVEKTVSS

SEQ ID NO: 1049777 - protein, 9 aa, Homo Sapiens
GTYFGLAAI

SEQ ID NO: 1049778 - protein, 9 aa, Homo Sapiens
TMMASMLCC

SEQ ID NO: 1049779 - protein, 9 aa, Homo Sapiens
QKPGDYEVS

SEQ ID NO: 1049780 - protein, 9 aa, Homo Sapiens
CYKSENIYE

SEQ ID NO: 1049781 - protein, 9 aa, Homo Sapiens
LKQEHEERL

SEQ ID NO: 1049782 - protein, 9 aa, Homo Sapiens
NKEFCVRTV

SEQ ID NO: 1049783 - protein, 9 aa, Homo Sapiens
MVIKDSPHT

SEQ ID NO: 1049784 - protein, 9 aa, Homo Sapiens
CLRWGGGYK

SEQ ID NO: 1049785 - protein, 9 aa, Homo Sapiens
FRDLASLPE

SEQ ID NO: 1049786 - protein, 9 aa, Homo Sapiens
FLYLFLLPM

SEQ ID NO: 1049787 - protein, 9 aa, Homo Sapiens
IGDDNKNLT

SEQ ID NO: 1049788 - protein, 9 aa, Homo Sapiens
CQVLDAVYY

SEQ ID NO: 1049789 - protein, 9 aa, Homo Sapiens
FHPLPPSYR

SEQ ID NO: 1049790 - protein, 9 aa, Homo Sapiens
EFSSRDFQV

SEQ ID NO: 1049791 - protein, 9 aa, Homo Sapiens
EEGVSCTIR

SEQ ID NO: 1049792 - protein, 9 aa, Homo Sapiens
RALLTRNEQ

SEQ ID NO: 1049793 - protein, 9 aa, Homo Sapiens
GTSVVAQGL

SEQ ID NO: 1049794 - protein, 9 aa, Homo Sapiens
KSISVQKLM

SEQ ID NO: 1049795 - protein, 9 aa, Homo Sapiens
PRLFGARAE

SEQ ID NO: 1049796 - protein, 9 aa, Homo Sapiens
FVCSGEGII

SEQ ID NO: 1049797 - protein, 9 aa, Homo Sapiens
GLADRLGWR

SEQ ID NO: 1049798 - protein, 9 aa, Homo Sapiens
HLNPKTITI

SEQ ID NO: 1049799 - protein, 9 aa, Homo Sapiens
DVPDYAVLE

SEQ ID NO: 1049800 - protein, 9 aa, Homo Sapiens
SHSGLRQLL

SEQ ID NO: 1049801 - protein, 9 aa, Homo Sapiens
DSSFKCSLY

SEQ ID NO: 1049802 - protein, 9 aa, Homo Sapiens
LRCLEKWLN

SEQ ID NO: 1049803 - protein, 9 aa, Homo Sapiens
SDDKDMPGS

SEQ ID NO: 1049804 - protein, 9 aa, Homo Sapiens
SLFQAMQKN

SEQ ID NO: 1049805 - protein, 9 aa, Homo Sapiens
FIDLCLKKS

SEQ ID NO: 1049806 - protein, 9 aa, Homo Sapiens
QKGIPVREK

SEQ ID NO: 1049807 - protein, 9 aa, Homo Sapiens
KVEYLIEFG

SEQ ID NO: 1049808 - protein, 9 aa, Homo Sapiens
GTEKESFIT

SEQ ID NO: 1049809 - protein, 9 aa, Homo Sapiens
SNMAKGWGS

SEQ ID NO: 1049810 - protein, 9 aa, Homo Sapiens
PPARKQKSK

SEQ ID NO: 1049811 - protein, 9 aa, Homo Sapiens
DYPLEFHQR

SEQ ID NO: 1049812 - protein, 9 aa, Homo Sapiens
SEEEGSNKG

SEQ ID NO: 1049813 - protein, 9 aa, Homo Sapiens
SKCSNLYGT

SEQ ID NO: 1049814 - protein, 9 aa, Homo Sapiens
IYCKAGKGR

SEQ ID NO: 1049815 - protein, 9 aa, Homo Sapiens
IEVRANKQE

SEQ ID NO: 1049816 - protein, 9 aa, Homo Sapiens
CTPLYYPNV

SEQ ID NO: 1049817 - protein, 9 aa, Homo Sapiens
QEIKGRNLD

SEQ ID NO: 1049818 - protein, 9 aa, Homo Sapiens
ECIGGSGNG

SEQ ID NO: 1049819 - protein, 9 aa, Homo Sapiens
KVPVPPSKK

SEQ ID NO: 1049820 - protein, 9 aa, Homo Sapiens
SDFESRYVQ

SEQ ID NO: 1049821 - protein, 9 aa, Homo Sapiens
TTPCLTPST

SEQ ID NO: 1049822 - protein, 9 aa, Homo Sapiens
ETEEHFSKA

SEQ ID NO: 1049823 - protein, 9 aa, Homo Sapiens
KKNEPLHKK

SEQ ID NO: 1049824 - protein, 9 aa, Homo Sapiens
TAGLAVHLK

SEQ ID NO: 1049825 - protein, 9 aa, Homo Sapiens
SVWKCLHLT

SEQ ID NO: 1049826 - protein, 9 aa, Homo Sapiens
KKRPVIIYR

SEQ ID NO: 1049827 - protein, 9 aa, Homo Sapiens
IIQLLENFP

SEQ ID NO: 1049828 - protein, 9 aa, Homo Sapiens
WPYSLTSQV

SEQ ID NO: 1049829 - protein, 9 aa, Homo Sapiens
DEEDKKNYP

SEQ ID NO: 1049830 - protein, 9 aa, Homo Sapiens
RTPTRHLFN

SEQ ID NO: 1049831 - protein, 9 aa, Homo Sapiens
KSGTSLLQK

SEQ ID NO: 1049832 - protein, 9 aa, Homo Sapiens
EEIQVLGSL

SEQ ID NO: 1049833 - protein, 9 aa, Homo Sapiens
VPDSIKFEI

SEQ ID NO: 1049834 - protein, 9 aa, Homo Sapiens
GDRANDCGA

SEQ ID NO: 1049835 - protein, 9 aa, Homo Sapiens
LSFGSSFTF

SEQ ID NO: 1049836 - protein, 9 aa, Homo Sapiens
GLEAAPKSP

SEQ ID NO: 1049837 - protein, 9 aa, Homo Sapiens
IFLQEWNIP

SEQ ID NO: 1049838 - protein, 9 aa, Homo Sapiens
LNGKPERCL

SEQ ID NO: 1049839 - protein, 9 aa, Homo Sapiens
VPVPPSKKP

SEQ ID NO: 1049840 - protein, 9 aa, Homo Sapiens
IANKLYALN

SEQ ID NO: 1049841 - protein, 9 aa, Homo Sapiens
QASKHIKSE

SEQ ID NO: 1049842 - protein, 9 aa, Homo Sapiens
SSHLFFHLH

SEQ ID NO: 1049843 - protein, 9 aa, Homo Sapiens
YQDADIYFL

SEQ ID NO: 1049844 - protein, 9 aa, Homo Sapiens
RSEGKKGQV

SEQ ID NO: 1049845 - protein, 9 aa, Homo Sapiens
EVSNSLQAM

SEQ ID NO: 1049846 - protein, 9 aa, Homo Sapiens
VRSSADSLS

SEQ ID NO: 1049847 - protein, 9 aa, Homo Sapiens
EAVTTMTIR

SEQ ID NO: 1049848 - protein, 9 aa, Homo Sapiens
EISHLIKKG

SEQ ID NO: 1049849 - protein, 9 aa, Homo Sapiens
MELRGPELL

SEQ ID NO: 1049850 - protein, 9 aa, Homo Sapiens
DVNTEFLAS

SEQ ID NO: 1049851 - protein, 9 aa, Homo Sapiens
APLPLPFEF

SEQ ID NO: 1049852 - protein, 9 aa, Homo Sapiens
GEAGTDGYA

SEQ ID NO: 1049853 - protein, 9 aa, Homo Sapiens
RSYVESVAQ

SEQ ID NO: 1049854 - protein, 9 aa, Homo Sapiens
EAKYAQSQS

SEQ ID NO: 1049855 - protein, 9 aa, Homo Sapiens
IEIFKGRSG

SEQ ID NO: 1049856 - protein, 9 aa, Homo Sapiens
MASGDRAEG

SEQ ID NO: 1049857 - protein, 9 aa, Homo Sapiens
IKLPRRRFH

SEQ ID NO: 1049858 - protein, 9 aa, Homo Sapiens
HLFRAMCQN

SEQ ID NO: 1049859 - protein, 9 aa, Homo Sapiens
RGPEDVAKR

SEQ ID NO: 1049860 - protein, 9 aa, Homo Sapiens
PGEGGGAAG

SEQ ID NO: 1049861 - protein, 9 aa, Homo Sapiens
KKLTETPPV

SEQ ID NO: 1049862 - protein, 9 aa, Homo Sapiens
IILYTYSRG

SEQ ID NO: 1049863 - protein, 9 aa, Homo Sapiens
AHKVTGSGG

SEQ ID NO: 1049864 - protein, 9 aa, Homo Sapiens
NALDRYRRT

SEQ ID NO: 1049865 - protein, 9 aa, Homo Sapiens
FSYTQIVSS

SEQ ID NO: 1049866 - protein, 9 aa, Homo Sapiens
QKQSSGSRT

SEQ ID NO: 1049867 - protein, 9 aa, Homo Sapiens
RHLVFFGIV

SEQ ID NO: 1049868 - protein, 9 aa, Homo Sapiens
LPGHNGLDE

SEQ ID NO: 1049869 - protein, 9 aa, Homo Sapiens
HFSGYQAAT

SEQ ID NO: 1049870 - protein, 9 aa, Homo Sapiens
THQKIYTGE

SEQ ID NO: 1049871 - protein, 9 aa, Homo Sapiens
IYFLDDPLS

SEQ ID NO: 1049872 - protein, 9 aa, Homo Sapiens
KKGWLSIDG

SEQ ID NO: 1049873 - protein, 9 aa, Homo Sapiens
LYMTLYDKV

SEQ ID NO: 1049874 - protein, 9 aa, Homo Sapiens
YEDLEVTGK

SEQ ID NO: 1049875 - protein, 9 aa, Homo Sapiens
DCRLCRFMG

SEQ ID NO: 1049876 - protein, 9 aa, Homo Sapiens
KLNSEVEVH

SEQ ID NO: 1049877 - protein, 9 aa, Homo Sapiens
SGKELAVAV

SEQ ID NO: 1049878 - protein, 9 aa, Homo Sapiens
PGTEKESFI

SEQ ID NO: 1049879 - protein, 9 aa, Homo Sapiens
FWDSDNKIL

SEQ ID NO: 1049880 - protein, 9 aa, Homo Sapiens
NLFLIKILL

SEQ ID NO: 1049881 - protein, 9 aa, Homo Sapiens
MCRGNNEGF

SEQ ID NO: 1049882 - protein, 9 aa, Homo Sapiens
ASRSLVEMP

SEQ ID NO: 1049883 - protein, 9 aa, Homo Sapiens
TFNHHQQTH

SEQ ID NO: 1049884 - protein, 9 aa, Homo Sapiens
KFILNDALN

SEQ ID NO: 1049885 - protein, 9 aa, Homo Sapiens
ELKIVVILE

SEQ ID NO: 1049886 - protein, 9 aa, Homo Sapiens
IPDNPKASF

SEQ ID NO: 1049887 - protein, 9 aa, Homo Sapiens
HDQEPHGAA

SEQ ID NO: 1049888 - protein, 9 aa, Homo Sapiens
DKDEHMQVV

SEQ ID NO: 1049889 - protein, 9 aa, Homo Sapiens
RPHRCLRGG

SEQ ID NO: 1049890 - protein, 9 aa, Homo Sapiens
HLFVSLYPG

SEQ ID NO: 1049891 - protein, 9 aa, Homo Sapiens
PVENTSNDE

SEQ ID NO: 1049892 - protein, 9 aa, Homo Sapiens
MNATLKNCD

SEQ ID NO: 1049893 - protein, 9 aa, Homo Sapiens
SNPDCQEKP

SEQ ID NO: 1049894 - protein, 9 aa, Homo Sapiens
FSILVRALC

SEQ ID NO: 1049895 - protein, 9 aa, Homo Sapiens
ESDSSFKCS

SEQ ID NO: 1049896 - protein, 9 aa, Homo Sapiens
YIAEKIHNT

SEQ ID NO: 1049897 - protein, 9 aa, Homo Sapiens
KDNKENDEH

SEQ ID NO: 1049898 - protein, 9 aa, Homo Sapiens
AWTLSLSPS

SEQ ID NO: 1049899 - protein, 9 aa, Homo Sapiens
FLFLVLLFV

SEQ ID NO: 1049900 - protein, 9 aa, Homo Sapiens
ISLFQQCYI

SEQ ID NO: 1049901 - protein, 9 aa, Homo Sapiens
FPCIPKSQF

SEQ ID NO: 1049902 - protein, 9 aa, Homo Sapiens
GNPRQSFEI

SEQ ID NO: 1049903 - protein, 9 aa, Homo Sapiens
VMNATLKNC

SEQ ID NO: 1049904 - protein, 9 aa, Homo Sapiens
KTVAIFLKD

SEQ ID NO: 1049905 - protein, 9 aa, Homo Sapiens
SVSEAAKHG

SEQ ID NO: 1049906 - protein, 9 aa, Homo Sapiens
SSSRSCAFS

SEQ ID NO: 1049907 - protein, 9 aa, Homo Sapiens
PFHDPYRQQ

SEQ ID NO: 1049908 - protein, 9 aa, Homo Sapiens
SGFEPASAP

SEQ ID NO: 1049909 - protein, 9 aa, Homo Sapiens
FSLFLHSES

SEQ ID NO: 1049910 - protein, 9 aa, Homo Sapiens
RNWDYLRPP

SEQ ID NO: 1049911 - protein, 9 aa, Homo Sapiens
LELMTEVFC

SEQ ID NO: 1049912 - protein, 9 aa, Homo Sapiens
NHNYPFLGI

SEQ ID NO: 1049913 - protein, 9 aa, Homo Sapiens
VLPPSELFD

SEQ ID NO: 1049914 - protein, 9 aa, Homo Sapiens
SRPRSRISV

SEQ ID NO: 1049915 - protein, 9 aa, Homo Sapiens
SSIKNFLKV

SEQ ID NO: 1049916 - protein, 9 aa, Homo Sapiens
LRPVFVLRQ

SEQ ID NO: 1049917 - protein, 9 aa, Homo Sapiens
QDQCILQLV

SEQ ID NO: 1049918 - protein, 9 aa, Homo Sapiens
QRMTSIICG

SEQ ID NO: 1049919 - protein, 9 aa, Homo Sapiens
DNLLCVKLH

SEQ ID NO: 1049920 - protein, 9 aa, Homo Sapiens
WKVLNLTGV

SEQ ID NO: 1049921 - protein, 9 aa, Homo Sapiens
MGRKKGQGN

SEQ ID NO: 1049922 - protein, 9 aa, Homo Sapiens
KDFSHPNVF

SEQ ID NO: 1049923 - protein, 9 aa, Homo Sapiens
KKESSKNIQ

SEQ ID NO: 1049924 - protein, 9 aa, Homo Sapiens
DFAHFILKQ

SEQ ID NO: 1049925 - protein, 9 aa, Homo Sapiens
TGAALYAAW

SEQ ID NO: 1049926 - protein, 9 aa, Homo Sapiens
PDGSILRII

SEQ ID NO: 1049927 - protein, 9 aa, Homo Sapiens
KSHSQKKDQ

SEQ ID NO: 1049928 - protein, 9 aa, Homo Sapiens
AGRSKAKLR

SEQ ID NO: 1049929 - protein, 9 aa, Homo Sapiens
NCRKVNTHI

SEQ ID NO: 1049930 - protein, 9 aa, Homo Sapiens
AMGKTALHI

SEQ ID NO: 1049931 - protein, 9 aa, Homo Sapiens
MGDEESRES

SEQ ID NO: 1049932 - protein, 9 aa, Homo Sapiens
DISCNKFLD

SEQ ID NO: 1049933 - protein, 9 aa, Homo Sapiens
LKHVSPNAS

SEQ ID NO: 1049934 - protein, 9 aa, Homo Sapiens
ELLGLTKKV

SEQ ID NO: 1049935 - protein, 9 aa, Homo Sapiens
GVNTSNMYP

SEQ ID NO: 1049936 - protein, 9 aa, Homo Sapiens
SALTSEAGL

SEQ ID NO: 1049937 - protein, 9 aa, Homo Sapiens
PWFISPGSM

SEQ ID NO: 1049938 - protein, 9 aa, Homo Sapiens
SALYFSAEC

SEQ ID NO: 1049939 - protein, 9 aa, Homo Sapiens
TLKAQAGPA

SEQ ID NO: 1049940 - protein, 9 aa, Homo Sapiens
RRGFSFENC

SEQ ID NO: 1049941 - protein, 9 aa, Homo Sapiens
QNSTLSEST

SEQ ID NO: 1049942 - protein, 9 aa, Homo Sapiens
EGAQGPGPA

SEQ ID NO: 1049943 - protein, 9 aa, Homo Sapiens
SSCHAFCYT

SEQ ID NO: 1049944 - protein, 9 aa, Homo Sapiens
EFLLGSTSI

SEQ ID NO: 1049945 - protein, 9 aa, Homo Sapiens
KFARAVKVL

SEQ ID NO: 1049946 - protein, 9 aa, Homo Sapiens
KKDNTFCMA

SEQ ID NO: 1049947 - protein, 9 aa, Homo Sapiens
RLMKLREDI

SEQ ID NO: 1049948 - protein, 9 aa, Homo Sapiens
LQGAPLSLY

SEQ ID NO: 1049949 - protein, 9 aa, Homo Sapiens
LLVVLLALL

SEQ ID NO: 1049950 - protein, 9 aa, Homo Sapiens
PPQLSSKMK

SEQ ID NO: 1049951 - protein, 9 aa, Homo Sapiens
EDTLQNPAP

SEQ ID NO: 1049952 - protein, 9 aa, Homo Sapiens
NTIFTPLLN

SEQ ID NO: 1049953 - protein, 9 aa, Homo Sapiens
VALGTGPRE

SEQ ID NO: 1049954 - protein, 9 aa, Homo Sapiens
RFEGNCPDG

SEQ ID NO: 1049955 - protein, 9 aa, Homo Sapiens
VSGLLVGYK

SEQ ID NO: 1049956 - protein, 9 aa, Homo Sapiens
SGSQDSGKP

SEQ ID NO: 1049957 - protein, 9 aa, Homo Sapiens
KMKHIRQAM

SEQ ID NO: 1049958 - protein, 9 aa, Homo Sapiens
RFTCSAVNK

SEQ ID NO: 1049959 - protein, 9 aa, Homo Sapiens
SSHVCCNFS

SEQ ID NO: 1049960 - protein, 9 aa, Homo Sapiens
TLNREEVYT

SEQ ID NO: 1049961 - protein, 9 aa, Homo Sapiens
LSYLPSQVS

SEQ ID NO: 1049962 - protein, 9 aa, Homo Sapiens
VETQNPFFS

SEQ ID NO: 1049963 - protein, 9 aa, Homo Sapiens
YDKVTHGYL

SEQ ID NO: 1049964 - protein, 9 aa, Homo Sapiens
GRHSQKRWE

SEQ ID NO: 1049965 - protein, 9 aa, Homo Sapiens
DLGGSSDLY

SEQ ID NO: 1049966 - protein, 9 aa, Homo Sapiens
YVDGHLYEL

SEQ ID NO: 1049967 - protein, 9 aa, Homo Sapiens
AKPKHKQTD

SEQ ID NO: 1049968 - protein, 9 aa, Homo Sapiens
HSGEKQYQC

SEQ ID NO: 1049969 - protein, 9 aa, Homo Sapiens
HGVKIKKKG

SEQ ID NO: 1049970 - protein, 9 aa, Homo Sapiens
KRPAPPCPA

SEQ ID NO: 1049971 - protein, 9 aa, Homo Sapiens
GKALNPFQT

SEQ ID NO: 1049972 - protein, 9 aa, Homo Sapiens
LMLIFLRNQ

SEQ ID NO: 1049973 - protein, 9 aa, Homo Sapiens
QTGYLDPSS

SEQ ID NO: 1049974 - protein, 9 aa, Homo Sapiens
WHQLAFQHR

SEQ ID NO: 1049975 - protein, 9 aa, Homo Sapiens
QQSVCTGKK

SEQ ID NO: 1049976 - protein, 9 aa, Homo Sapiens
KDVSSYLCT

SEQ ID NO: 1049977 - protein, 9 aa, Homo Sapiens
AGKTSTDLV

SEQ ID NO: 1049978 - protein, 9 aa, Homo Sapiens
SSVLSILQS

SEQ ID NO: 1049979 - protein, 9 aa, Homo Sapiens
WKKVSKLCY

SEQ ID NO: 1049980 - protein, 9 aa, Homo Sapiens
CLDLCGQRQ

SEQ ID NO: 1049981 - protein, 9 aa, Homo Sapiens
NLPSVICQD

SEQ ID NO: 1049982 - protein, 9 aa, Homo Sapiens
EPSTPAQTS

SEQ ID NO: 1049983 - protein, 9 aa, Homo Sapiens
SLDPRSSRD

SEQ ID NO: 1049984 - protein, 9 aa, Homo Sapiens
ENVGLYFWT

SEQ ID NO: 1049985 - protein, 9 aa, Homo Sapiens
QAEKLAADG

SEQ ID NO: 1049986 - protein, 9 aa, Homo Sapiens
KKVDHFFCE

SEQ ID NO: 1049987 - protein, 9 aa, Homo Sapiens
GQITTAAML

SEQ ID NO: 1049988 - protein, 9 aa, Homo Sapiens
LSAASPTIF

SEQ ID NO: 1049989 - protein, 9 aa, Homo Sapiens
AGRESKFNA

SEQ ID NO: 1049990 - protein, 9 aa, Homo Sapiens
DKKKEFEEC

SEQ ID NO: 1049991 - protein, 9 aa, Homo Sapiens
AERDLVRLL

SEQ ID NO: 1049992 - protein, 9 aa, Homo Sapiens
NIIEQRPEL

SEQ ID NO: 1049993 - protein, 9 aa, Homo Sapiens
AFMGNFVMV

SEQ ID NO: 1049994 - protein, 9 aa, Homo Sapiens
SRTNLIDTE

SEQ ID NO: 1049995 - protein, 9 aa, Homo Sapiens
YFLKHLNKE

SEQ ID NO: 1049996 - protein, 9 aa, Homo Sapiens
FYPKRKLLE

SEQ ID NO: 1049997 - protein, 9 aa, Homo Sapiens
ERIEKYGAF

SEQ ID NO: 1049998 - protein, 9 aa, Homo Sapiens
AIVLAEKAL

SEQ ID NO: 1049999 - protein, 9 aa, Homo Sapiens
EEATEEEKL

SEQ ID NO: 1050000 - protein, 9 aa, Homo Sapiens
SVDVKSEVS

SEQ ID NO: 1050001 - protein, 9 aa, Homo Sapiens
IWLGDLLGS

SEQ ID NO: 1050002 - protein, 9 aa, Homo Sapiens
ENIRINGIY

SEQ ID NO: 1050003 - protein, 9 aa, Homo Sapiens
LDISDSPKK

SEQ ID NO: 1050004 - protein, 9 aa, Homo Sapiens
MVNLDCIQK

SEQ ID NO: 1050005 - protein, 9 aa, Homo Sapiens
LGMESDLSL

SEQ ID NO: 1050006 - protein, 9 aa, Homo Sapiens
KKDQERPQV

SEQ ID NO: 1050007 - protein, 9 aa, Homo Sapiens
AIIRSSRSS

SEQ ID NO: 1050008 - protein, 9 aa, Homo Sapiens
KWRQLTKKI

SEQ ID NO: 1050009 - protein, 9 aa, Homo Sapiens
EKQKEQEEK

SEQ ID NO: 1050010 - protein, 9 aa, Homo Sapiens
SLAGEIIEV

SEQ ID NO: 1050011 - protein, 9 aa, Homo Sapiens
GLSLLFGWT

SEQ ID NO: 1050012 - protein, 9 aa, Homo Sapiens
TSCYKLTVP

SEQ ID NO: 1050013 - protein, 9 aa, Homo Sapiens
RSTVSFWMI

SEQ ID NO: 1050014 - protein, 9 aa, Homo Sapiens
IINESYNLT

SEQ ID NO: 1050015 - protein, 9 aa, Homo Sapiens
ITQVYLSHI

SEQ ID NO: 1050016 - protein, 9 aa, Homo Sapiens
RKFRRTNCA

SEQ ID NO: 1050017 - protein, 9 aa, Homo Sapiens
KKAKIAEQV

SEQ ID NO: 1050018 - protein, 9 aa, Homo Sapiens
VSPDSGLAI

SEQ ID NO: 1050019 - protein, 9 aa, Homo Sapiens
QIGEMRMAG

SEQ ID NO: 1050020 - protein, 9 aa, Homo Sapiens
MFLENLVQA

SEQ ID NO: 1050021 - protein, 9 aa, Homo Sapiens
GYNQGYAGS

SEQ ID NO: 1050022 - protein, 9 aa, Homo Sapiens
PVLDNSPPR

SEQ ID NO: 1050023 - protein, 9 aa, Homo Sapiens
APISGFEPA

SEQ ID NO: 1050024 - protein, 9 aa, Homo Sapiens
LFFVKPPNA

SEQ ID NO: 1050025 - protein, 9 aa, Homo Sapiens
PREFQKFPL

SEQ ID NO: 1050026 - protein, 9 aa, Homo Sapiens
KYTEPLLSL

SEQ ID NO: 1050027 - protein, 9 aa, Homo Sapiens
ESDVRAIQP

SEQ ID NO: 1050028 - protein, 9 aa, Homo Sapiens
VLDYSVGNL

SEQ ID NO: 1050029 - protein, 9 aa, Homo Sapiens
RSILHKDIG

SEQ ID NO: 1050030 - protein, 9 aa, Homo Sapiens
FLPPGNFDP

SEQ ID NO: 1050031 - protein, 9 aa, Homo Sapiens
FTRETVFSY

SEQ ID NO: 1050032 - protein, 9 aa, Homo Sapiens
PEADIHQSF

SEQ ID NO: 1050033 - protein, 9 aa, Homo Sapiens
FHTLCDYIY

SEQ ID NO: 1050034 - protein, 9 aa, Homo Sapiens
LGEMGYFAY

SEQ ID NO: 1050035 - protein, 9 aa, Homo Sapiens
LKQHMLIYS

SEQ ID NO: 1050036 - protein, 9 aa, Homo Sapiens
LEELMKLSL

SEQ ID NO: 1050037 - protein, 9 aa, Homo Sapiens
IGKRYLNLG

SEQ ID NO: 1050038 - protein, 9 aa, Homo Sapiens
SFINMSTLK

SEQ ID NO: 1050039 - protein, 9 aa, Homo Sapiens
WKSKMEIFE

SEQ ID NO: 1050040 - protein, 9 aa, Homo Sapiens
KILQSIQRS

SEQ ID NO: 1050041 - protein, 9 aa, Homo Sapiens
LFAVVFSIS

SEQ ID NO: 1050042 - protein, 9 aa, Homo Sapiens
GHKKVDHFF

SEQ ID NO: 1050043 - protein, 9 aa, Homo Sapiens
GTFKLQPMN

SEQ ID NO: 1050044 - protein, 9 aa, Homo Sapiens
SLFGTDYRN

SEQ ID NO: 1050045 - protein, 9 aa, Homo Sapiens
RRRKKFGRG

SEQ ID NO: 1050046 - protein, 9 aa, Homo Sapiens
ELFPGSFRG

SEQ ID NO: 1050047 - protein, 9 aa, Homo Sapiens
RYSVLISWR

SEQ ID NO: 1050048 - protein, 9 aa, Homo Sapiens
APHCSTVEE

SEQ ID NO: 1050049 - protein, 9 aa, Homo Sapiens
IDSLNLGNI

SEQ ID NO: 1050050 - protein, 9 aa, Homo Sapiens
MLIFLVRLP

SEQ ID NO: 1050051 - protein, 9 aa, Homo Sapiens
SPEPPEDTK

SEQ ID NO: 1050052 - protein, 9 aa, Homo Sapiens
PMVVDNLFE

SEQ ID NO: 1050053 - protein, 9 aa, Homo Sapiens
TKLQAKHNL

SEQ ID NO: 1050054 - protein, 9 aa, Homo Sapiens
RKKVPANPE

SEQ ID NO: 1050055 - protein, 9 aa, Homo Sapiens
DVKEEWQDK

SEQ ID NO: 1050056 - protein, 9 aa, Homo Sapiens
CSVSSQVPT

SEQ ID NO: 1050057 - protein, 9 aa, Homo Sapiens
GEKMIEEEV

SEQ ID NO: 1050058 - protein, 9 aa, Homo Sapiens
PSVICQDVE

SEQ ID NO: 1050059 - protein, 9 aa, Homo Sapiens
YTSGFFQTR

SEQ ID NO: 1050060 - protein, 9 aa, Homo Sapiens
ELKKEIANA

SEQ ID NO: 1050061 - protein, 9 aa, Homo Sapiens
AGSLSAAGP

SEQ ID NO: 1050062 - protein, 9 aa, Homo Sapiens
VYFLLPPLI

SEQ ID NO: 1050063 - protein, 9 aa, Homo Sapiens
WVVSAAHFF

SEQ ID NO: 1050064 - protein, 9 aa, Homo Sapiens
ALISRQVPG

SEQ ID NO: 1050065 - protein, 9 aa, Homo Sapiens
QGMTETPMV

SEQ ID NO: 1050066 - protein, 9 aa, Homo Sapiens
VCFGEGLPK

SEQ ID NO: 1050067 - protein, 9 aa, Homo Sapiens
LWEKLRKKI

SEQ ID NO: 1050068 - protein, 9 aa, Homo Sapiens
APSTTTSAF

SEQ ID NO: 1050069 - protein, 9 aa, Homo Sapiens
ARVPSPPPI

SEQ ID NO: 1050070 - protein, 9 aa, Homo Sapiens
TLGPSVAGL

SEQ ID NO: 1050071 - protein, 9 aa, Homo Sapiens
EAVHHLVFT

SEQ ID NO: 1050072 - protein, 9 aa, Homo Sapiens
HSKPPNRLV

SEQ ID NO: 1050073 - protein, 9 aa, Homo Sapiens
MDCTAIHEV

SEQ ID NO: 1050074 - protein, 9 aa, Homo Sapiens
GLSDEEWQL

SEQ ID NO: 1050075 - protein, 9 aa, Homo Sapiens
DCILKLNTE

SEQ ID NO: 1050076 - protein, 9 aa, Homo Sapiens
PPPPGKPQR

SEQ ID NO: 1050077 - protein, 9 aa, Homo Sapiens
PVQRYVPLE

SEQ ID NO: 1050078 - protein, 9 aa, Homo Sapiens
ELSKDIMVY

SEQ ID NO: 1050079 - protein, 9 aa, Homo Sapiens
RPEAGGINF

SEQ ID NO: 1050080 - protein, 9 aa, Homo Sapiens
SGTFFINTK

SEQ ID NO: 1050081 - protein, 9 aa, Homo Sapiens
FEEQDNVYF

SEQ ID NO: 1050082 - protein, 9 aa, Homo Sapiens
QRDWAAEAK

SEQ ID NO: 1050083 - protein, 9 aa, Homo Sapiens
FTCSAVNKA

SEQ ID NO: 1050084 - protein, 9 aa, Homo Sapiens
LCCRTIVFC

SEQ ID NO: 1050085 - protein, 9 aa, Homo Sapiens
YKDPEETEK

SEQ ID NO: 1050086 - protein, 9 aa, Homo Sapiens
LNPFIYTLC

SEQ ID NO: 1050087 - protein, 9 aa, Homo Sapiens
CKSSFFLKL

SEQ ID NO: 1050088 - protein, 9 aa, Homo Sapiens
LRQDLETSF

SEQ ID NO: 1050089 - protein, 9 aa, Homo Sapiens
NLEISGKSL

SEQ ID NO: 1050090 - protein, 9 aa, Homo Sapiens
YSPAYEESL

SEQ ID NO: 1050091 - protein, 9 aa, Homo Sapiens
EGRGGPSRR

SEQ ID NO: 1050092 - protein, 9 aa, Homo Sapiens
VVPSPLVGP

SEQ ID NO: 1050093 - protein, 9 aa, Homo Sapiens
TGIMLSSWA

SEQ ID NO: 1050094 - protein, 9 aa, Homo Sapiens
EQEKAWKLE

SEQ ID NO: 1050095 - protein, 9 aa, Homo Sapiens
TTHAFLASA

SEQ ID NO: 1050096 - protein, 9 aa, Homo Sapiens
YYLLLGLIA

SEQ ID NO: 1050097 - protein, 9 aa, Homo Sapiens
MLKCDGLKM

SEQ ID NO: 1050098 - protein, 9 aa, Homo Sapiens
PPTQKPLPA

SEQ ID NO: 1050099 - protein, 9 aa, Homo Sapiens
KTLKAQAGP

SEQ ID NO: 1050100 - protein, 9 aa, Homo Sapiens
PLLQYLSLL

SEQ ID NO: 1050101 - protein, 9 aa, Homo Sapiens
ETFNPVSLW

SEQ ID NO: 1050102 - protein, 9 aa, Homo Sapiens
DASTLICQV

SEQ ID NO: 1050103 - protein, 9 aa, Homo Sapiens
PFSSHHQRF

SEQ ID NO: 1050104 - protein, 9 aa, Homo Sapiens
IVTLKNGML

SEQ ID NO: 1050105 - protein, 9 aa, Homo Sapiens
HYRTSSKFQ

SEQ ID NO: 1050106 - protein, 9 aa, Homo Sapiens
LLILIFYGF

SEQ ID NO: 1050107 - protein, 9 aa, Homo Sapiens
VSYTFEFYF

SEQ ID NO: 1050108 - protein, 9 aa, Homo Sapiens
SKACKIAKM

SEQ ID NO: 1050109 - protein, 9 aa, Homo Sapiens
AYHWYCKAF

SEQ ID NO: 1050110 - protein, 9 aa, Homo Sapiens
NTKNFDNYF

SEQ ID NO: 1050111 - protein, 9 aa, Homo Sapiens
NLLLRGCKI

SEQ ID NO: 1050112 - protein, 9 aa, Homo Sapiens
APSRMSMKL

SEQ ID NO: 1050113 - protein, 9 aa, Homo Sapiens
KKAQAMCTG

SEQ ID NO: 1050114 - protein, 9 aa, Homo Sapiens
ARFSDGRLC

SEQ ID NO: 1050115 - protein, 9 aa, Homo Sapiens
HGPSNCSNS

SEQ ID NO: 1050116 - protein, 9 aa, Homo Sapiens
TRNPSSSWP

SEQ ID NO: 1050117 - protein, 9 aa, Homo Sapiens
KWNSDDYGG

SEQ ID NO: 1050118 - protein, 9 aa, Homo Sapiens
YVGLEASLL

SEQ ID NO: 1050119 - protein, 9 aa, Homo Sapiens
AFLCRPRRS

SEQ ID NO: 1050120 - protein, 9 aa, Homo Sapiens
FYAAILATI

SEQ ID NO: 1050121 - protein, 9 aa, Homo Sapiens
QPRLGEEFI

SEQ ID NO: 1050122 - protein, 9 aa, Homo Sapiens
KPFAIEGYR

SEQ ID NO: 1050123 - protein, 9 aa, Homo Sapiens
TNPPVPPSE

SEQ ID NO: 1050124 - protein, 9 aa, Homo Sapiens
YLKKYSVAQ

SEQ ID NO: 1050125 - protein, 9 aa, Homo Sapiens
PRFEGNCPD

SEQ ID NO: 1050126 - protein, 9 aa, Homo Sapiens
NQKGIPVRE

SEQ ID NO: 1050127 - protein, 9 aa, Homo Sapiens
MAVQDLIRA

SEQ ID NO: 1050128 - protein, 9 aa, Homo Sapiens
IIILAFYLV

SEQ ID NO: 1050129 - protein, 9 aa, Homo Sapiens
LKTVEKAAA

SEQ ID NO: 1050130 - protein, 9 aa, Homo Sapiens
LCPRMKGDW

SEQ ID NO: 1050131 - protein, 9 aa, Homo Sapiens
LDKGLVNDI

SEQ ID NO: 1050132 - protein, 9 aa, Homo Sapiens
ESALVLGPL

SEQ ID NO: 1050133 - protein, 9 aa, Homo Sapiens
MSHEFKTEE

SEQ ID NO: 1050134 - protein, 9 aa, Homo Sapiens
IELTEKNFR

SEQ ID NO: 1050135 - protein, 9 aa, Homo Sapiens
TDVCFFPEK

SEQ ID NO: 1050136 - protein, 9 aa, Homo Sapiens
VFDSNDADT

SEQ ID NO: 1050137 - protein, 9 aa, Homo Sapiens
EEAVQLKCE

SEQ ID NO: 1050138 - protein, 9 aa, Homo Sapiens
EAEAADDLP

SEQ ID NO: 1050139 - protein, 9 aa, Homo Sapiens
SNAQESKQM

SEQ ID NO: 1050140 - protein, 9 aa, Homo Sapiens
SDGLLTIWL

SEQ ID NO: 1050141 - protein, 9 aa, Homo Sapiens
ENKSVQSSC

SEQ ID NO: 1050142 - protein, 9 aa, Homo Sapiens
GKLAAALAL

SEQ ID NO: 1050143 - protein, 9 aa, Homo Sapiens
VSSQVPTPG

SEQ ID NO: 1050144 - protein, 9 aa, Homo Sapiens
LGLCLVLQP

SEQ ID NO: 1050145 - protein, 9 aa, Homo Sapiens
QEIPKPLQL

SEQ ID NO: 1050146 - protein, 9 aa, Homo Sapiens
SKAGAELFS

SEQ ID NO: 1050147 - protein, 9 aa, Homo Sapiens
AAELGLGAV

SEQ ID NO: 1050148 - protein, 9 aa, Homo Sapiens
VRGEHVMRG

SEQ ID NO: 1050149 - protein, 9 aa, Homo Sapiens
PTKSHLFRA

SEQ ID NO: 1050150 - protein, 9 aa, Homo Sapiens
LTKNFSFLH

SEQ ID NO: 1050151 - protein, 9 aa, Homo Sapiens
NLERVLSQP

SEQ ID NO: 1050152 - protein, 9 aa, Homo Sapiens
NGYIEDAMT

SEQ ID NO: 1050153 - protein, 9 aa, Homo Sapiens
TLQGAPLSL

SEQ ID NO: 1050154 - protein, 9 aa, Homo Sapiens
DEKSLDDET

SEQ ID NO: 1050155 - protein, 9 aa, Homo Sapiens
QKGDLVAIF

SEQ ID NO: 1050156 - protein, 9 aa, Homo Sapiens
KQPQNAIFH

SEQ ID NO: 1050157 - protein, 9 aa, Homo Sapiens
DQAIITPRV

SEQ ID NO: 1050158 - protein, 9 aa, Homo Sapiens
LSPIGHMKV

SEQ ID NO: 1050159 - protein, 9 aa, Homo Sapiens
KNGLFCTFS

SEQ ID NO: 1050160 - protein, 9 aa, Homo Sapiens
QDNPARICK

SEQ ID NO: 1050161 - protein, 9 aa, Homo Sapiens
GFFKYVASM

SEQ ID NO: 1050162 - protein, 9 aa, Homo Sapiens
VSTSLISGE

SEQ ID NO: 1050163 - protein, 9 aa, Homo Sapiens
LKETHERKS

SEQ ID NO: 1050164 - protein, 9 aa, Homo Sapiens
KPDIPELEE

SEQ ID NO: 1050165 - protein, 9 aa, Homo Sapiens
AYGAGCTLE

SEQ ID NO: 1050166 - protein, 9 aa, Homo Sapiens
LQLDENKLK

SEQ ID NO: 1050167 - protein, 9 aa, Homo Sapiens
KGDWETMTN

SEQ ID NO: 1050168 - protein, 9 aa, Homo Sapiens
VKVTLSYKS

SEQ ID NO: 1050169 - protein, 9 aa, Homo Sapiens
SAIGSFRYF

SEQ ID NO: 1050170 - protein, 9 aa, Homo Sapiens
GASGSQDSG

SEQ ID NO: 1050171 - protein, 9 aa, Homo Sapiens
FAYEQKVAL

SEQ ID NO: 1050172 - protein, 9 aa, Homo Sapiens
LRAELQDNA

SEQ ID NO: 1050173 - protein, 9 aa, Homo Sapiens
TLKAELLLL

SEQ ID NO: 1050174 - protein, 9 aa, Homo Sapiens
SCRTAPTNL

SEQ ID NO: 1050175 - protein, 9 aa, Homo Sapiens
NDHSPVFFD

SEQ ID NO: 1050176 - protein, 9 aa, Homo Sapiens
SEINSFISN

SEQ ID NO: 1050177 - protein, 9 aa, Homo Sapiens
PHEVLNFAL

SEQ ID NO: 1050178 - protein, 9 aa, Homo Sapiens
IVYDAWDMR

SEQ ID NO: 1050179 - protein, 9 aa, Homo Sapiens
SSDLYVRVY

SEQ ID NO: 1050180 - protein, 9 aa, Homo Sapiens
WGPEDRKMH

SEQ ID NO: 1050181 - protein, 9 aa, Homo Sapiens
SLHLLKFLN

SEQ ID NO: 1050182 - protein, 9 aa, Homo Sapiens
GKFANLTPL

SEQ ID NO: 1050183 - protein, 9 aa, Homo Sapiens
APLLQKIIL

SEQ ID NO: 1050184 - protein, 9 aa, Homo Sapiens
RAPDFVPCY

SEQ ID NO: 1050185 - protein, 9 aa, Homo Sapiens
ADIYFLDDP

SEQ ID NO: 1050186 - protein, 9 aa, Homo Sapiens
DVRAIQPGP

SEQ ID NO: 1050187 - protein, 9 aa, Homo Sapiens
TTLEKMVPS

SEQ ID NO: 1050188 - protein, 9 aa, Homo Sapiens
VVTICDLII

SEQ ID NO: 1050189 - protein, 9 aa, Homo Sapiens
SLGPHYGRP

SEQ ID NO: 1050190 - protein, 9 aa, Homo Sapiens
RPEPVLDNS

SEQ ID NO: 1050191 - protein, 9 aa, Homo Sapiens
YVESVAQTA

SEQ ID NO: 1050192 - protein, 9 aa, Homo Sapiens
FFCDFLSLL

SEQ ID NO: 1050193 - protein, 9 aa, Homo Sapiens
IENKPPFEF

SEQ ID NO: 1050194 - protein, 9 aa, Homo Sapiens
EDYNQPLFG

SEQ ID NO: 1050195 - protein, 9 aa, Homo Sapiens
CIGGSGNGM

SEQ ID NO: 1050196 - protein, 9 aa, Homo Sapiens
EYIPFAPGN

SEQ ID NO: 1050197 - protein, 9 aa, Homo Sapiens
DKASEEVSN

SEQ ID NO: 1050198 - protein, 9 aa, Homo Sapiens
QLHNTSWNR

SEQ ID NO: 1050199 - protein, 9 aa, Homo Sapiens
SVVDPNDSQ

SEQ ID NO: 1050200 - protein, 9 aa, Homo Sapiens
VQWYKHGSL

SEQ ID NO: 1050201 - protein, 9 aa, Homo Sapiens
TGKWPSLSE

SEQ ID NO: 1050202 - protein, 9 aa, Homo Sapiens
KVDSPRNFN

SEQ ID NO: 1050203 - protein, 9 aa, Homo Sapiens
LATYRASLV

SEQ ID NO: 1050204 - protein, 9 aa, Homo Sapiens
EMGVLTFRN

SEQ ID NO: 1050205 - protein, 9 aa, Homo Sapiens
VLENRTKDF

SEQ ID NO: 1050206 - protein, 9 aa, Homo Sapiens
LSPKVRRLC

SEQ ID NO: 1050207 - protein, 9 aa, Homo Sapiens
HSQKRWERF

SEQ ID NO: 1050208 - protein, 9 aa, Homo Sapiens
GGAGERKKV

SEQ ID NO: 1050209 - protein, 9 aa, Homo Sapiens
SQKAIPAVA

SEQ ID NO: 1050210 - protein, 9 aa, Homo Sapiens
EIMENPIVK

SEQ ID NO: 1050211 - protein, 9 aa, Homo Sapiens
RVDPKMRIR

SEQ ID NO: 1050212 - protein, 9 aa, Homo Sapiens
NTIRIKFTS

SEQ ID NO: 1050213 - protein, 9 aa, Homo Sapiens
KEKQVTYNL

SEQ ID NO: 1050214 - protein, 9 aa, Homo Sapiens
SEEGVSCTI

SEQ ID NO: 1050215 - protein, 9 aa, Homo Sapiens
PSPLEEMQP

SEQ ID NO: 1050216 - protein, 9 aa, Homo Sapiens
ILSSDGKDQ

SEQ ID NO: 1050217 - protein, 9 aa, Homo Sapiens
REKGEAGER

SEQ ID NO: 1050218 - protein, 9 aa, Homo Sapiens
FFFKTTVFS

SEQ ID NO: 1050219 - protein, 9 aa, Homo Sapiens
FGLLPKVAL

SEQ ID NO: 1050220 - protein, 9 aa, Homo Sapiens
EGSYRIHVF

SEQ ID NO: 1050221 - protein, 9 aa, Homo Sapiens
LKWQQRFRA

SEQ ID NO: 1050222 - protein, 9 aa, Homo Sapiens
SALYFFFKD

SEQ ID NO: 1050223 - protein, 9 aa, Homo Sapiens
CVQKGDLVA

SEQ ID NO: 1050224 - protein, 9 aa, Homo Sapiens
GTTDMSSDF

SEQ ID NO: 1050225 - protein, 9 aa, Homo Sapiens
GTVSTILGN

SEQ ID NO: 1050226 - protein, 9 aa, Homo Sapiens
CLAQPAAEL

SEQ ID NO: 1050227 - protein, 9 aa, Homo Sapiens
QNNLTKIVP

SEQ ID NO: 1050228 - protein, 9 aa, Homo Sapiens
KKIQLTPQI

SEQ ID NO: 1050229 - protein, 9 aa, Homo Sapiens
FFKYVASME

SEQ ID NO: 1050230 - protein, 9 aa, Homo Sapiens
LLEPTLRVA

SEQ ID NO: 1050231 - protein, 9 aa, Homo Sapiens
PCPATFPTR

SEQ ID NO: 1050232 - protein, 9 aa, Homo Sapiens
FSINGSRFK

SEQ ID NO: 1050233 - protein, 9 aa, Homo Sapiens
NDITPLHIA

SEQ ID NO: 1050234 - protein, 9 aa, Homo Sapiens
SLEKETKKE

SEQ ID NO: 1050235 - protein, 9 aa, Homo Sapiens
LSFWSSEED

SEQ ID NO: 1050236 - protein, 9 aa, Homo Sapiens
RSPPISLAK

SEQ ID NO: 1050237 - protein, 9 aa, Homo Sapiens
SHSPEHRQT

SEQ ID NO: 1050238 - protein, 9 aa, Homo Sapiens
NVPDLLAGV

SEQ ID NO: 1050239 - protein, 9 aa, Homo Sapiens
FFFKDPIQD

SEQ ID NO: 1050240 - protein, 9 aa, Homo Sapiens
YGPLDKWRV

SEQ ID NO: 1050241 - protein, 9 aa, Homo Sapiens
EVQSKKYKY

SEQ ID NO: 1050242 - protein, 9 aa, Homo Sapiens
NTAFGREHF

SEQ ID NO: 1050243 - protein, 9 aa, Homo Sapiens
VDVELHRHF

SEQ ID NO: 1050244 - protein, 9 aa, Homo Sapiens
RKPLDLEKL

SEQ ID NO: 1050245 - protein, 9 aa, Homo Sapiens
FCSNRNFID

SEQ ID NO: 1050246 - protein, 9 aa, Homo Sapiens
APAGQPIHK

SEQ ID NO: 1050247 - protein, 9 aa, Homo Sapiens
FSGFPRVEP

SEQ ID NO: 1050248 - protein, 9 aa, Homo Sapiens
NASDWDEGA

SEQ ID NO: 1050249 - protein, 9 aa, Homo Sapiens
LNSTTVMEF

SEQ ID NO: 1050250 - protein, 9 aa, Homo Sapiens
PCYVRRHER

SEQ ID NO: 1050251 - protein, 9 aa, Homo Sapiens
DYNQPLFGV

SEQ ID NO: 1050252 - protein, 9 aa, Homo Sapiens
KGAKGTRTL

SEQ ID NO: 1050253 - protein, 9 aa, Homo Sapiens
LSGGRGEDN

SEQ ID NO: 1050254 - protein, 9 aa, Homo Sapiens
DEPGVVSDG

SEQ ID NO: 1050255 - protein, 9 aa, Homo Sapiens
MALVLYYVT

SEQ ID NO: 1050256 - protein, 9 aa, Homo Sapiens
LQSMEDRMK

SEQ ID NO: 1050257 - protein, 9 aa, Homo Sapiens
DTRLAELLA

SEQ ID NO: 1050258 - protein, 9 aa, Homo Sapiens
EIVCKDGQW

SEQ ID NO: 1050259 - protein, 9 aa, Homo Sapiens
CVSCPQRTY

SEQ ID NO: 1050260 - protein, 9 aa, Homo Sapiens
QDDDDGPVS

SEQ ID NO: 1050261 - protein, 9 aa, Homo Sapiens
AFETTLEKM

SEQ ID NO: 1050262 - protein, 9 aa, Homo Sapiens
FVYQAAKTY

SEQ ID NO: 1050263 - protein, 9 aa, Homo Sapiens
KMYVKGMIQ

SEQ ID NO: 1050264 - protein, 9 aa, Homo Sapiens
TSVFSPVER

SEQ ID NO: 1050265 - protein, 9 aa, Homo Sapiens
PRRLYAFGA

SEQ ID NO: 1050266 - protein, 9 aa, Homo Sapiens
KLMGCLGVA

SEQ ID NO: 1050267 - protein, 9 aa, Homo Sapiens
QIVAARRER

SEQ ID NO: 1050268 - protein, 9 aa, Homo Sapiens
EVEHAPAGQ

SEQ ID NO: 1050269 - protein, 9 aa, Homo Sapiens
NNSGFYMCQ

SEQ ID NO: 1050270 - protein, 9 aa, Homo Sapiens
QPPSFLALS

SEQ ID NO: 1050271 - protein, 9 aa, Homo Sapiens
EAIDSLNLG

SEQ ID NO: 1050272 - protein, 9 aa, Homo Sapiens
KIVDGDDLG

SEQ ID NO: 1050273 - protein, 9 aa, Homo Sapiens
WHKFSSDFK

SEQ ID NO: 1050274 - protein, 9 aa, Homo Sapiens
RIKFTSDQA

SEQ ID NO: 1050275 - protein, 9 aa, Homo Sapiens
AETLENDIP

SEQ ID NO: 1050276 - protein, 9 aa, Homo Sapiens
NSRGETSLK

SEQ ID NO: 1050277 - protein, 9 aa, Homo Sapiens
KQEHEERLQ

SEQ ID NO: 1050278 - protein, 9 aa, Homo Sapiens
QTYSTIEPK

SEQ ID NO: 1050279 - protein, 9 aa, Homo Sapiens
HTPILLVSE

SEQ ID NO: 1050280 - protein, 9 aa, Homo Sapiens
CELIGKPLE

SEQ ID NO: 1050281 - protein, 9 aa, Homo Sapiens
GIYFLSSCK

SEQ ID NO: 1050282 - protein, 9 aa, Homo Sapiens
PTPQMAELR

SEQ ID NO: 1050283 - protein, 9 aa, Homo Sapiens
EAGNKTENE

SEQ ID NO: 1050284 - protein, 9 aa, Homo Sapiens
PLADIFDED

SEQ ID NO: 1050285 - protein, 9 aa, Homo Sapiens
GRYSPILKH

SEQ ID NO: 1050286 - protein, 9 aa, Homo Sapiens
INRKNAFSK

SEQ ID NO: 1050287 - protein, 9 aa, Homo Sapiens
DFSVQPPSA

SEQ ID NO: 1050288 - protein, 9 aa, Homo Sapiens
PFAPGNYDV

SEQ ID NO: 1050289 - protein, 9 aa, Homo Sapiens
FQASSFSKA

SEQ ID NO: 1050290 - protein, 9 aa, Homo Sapiens
TSLEPVKRS

SEQ ID NO: 1050291 - protein, 9 aa, Homo Sapiens
KINKDEKSS

SEQ ID NO: 1050292 - protein, 9 aa, Homo Sapiens
VTTMLLGLG

SEQ ID NO: 1050293 - protein, 9 aa, Homo Sapiens
RKAMAVKDI

SEQ ID NO: 1050294 - protein, 9 aa, Homo Sapiens
RLLLLIPFP

SEQ ID NO: 1050295 - protein, 9 aa, Homo Sapiens
GLSKFQNLQ

SEQ ID NO: 1050296 - protein, 9 aa, Homo Sapiens
GGRNKLRQV

SEQ ID NO: 1050297 - protein, 9 aa, Homo Sapiens
RIPLYGSYT

SEQ ID NO: 1050298 - protein, 9 aa, Homo Sapiens
GAKLKIVSS

SEQ ID NO: 1050299 - protein, 9 aa, Homo Sapiens
YQMDKSNQC

SEQ ID NO: 1050300 - protein, 9 aa, Homo Sapiens
EAHCKKYEQ

SEQ ID NO: 1050301 - protein, 9 aa, Homo Sapiens
ELRFETQLR

SEQ ID NO: 1050302 - protein, 9 aa, Homo Sapiens
VKNPCSFKD

SEQ ID NO: 1050303 - protein, 9 aa, Homo Sapiens
ERSYSTEPN

SEQ ID NO: 1050304 - protein, 9 aa, Homo Sapiens
SDPQAGKKL

SEQ ID NO: 1050305 - protein, 9 aa, Homo Sapiens
IFAGFQTRS

SEQ ID NO: 1050306 - protein, 9 aa, Homo Sapiens
SKSALHLSV

SEQ ID NO: 1050307 - protein, 9 aa, Homo Sapiens
EKGKAPQKS

SEQ ID NO: 1050308 - protein, 9 aa, Homo Sapiens
IIFVLAMTM

SEQ ID NO: 1050309 - protein, 9 aa, Homo Sapiens
RPCCCQSNC

SEQ ID NO: 1050310 - protein, 9 aa, Homo Sapiens
HFSPFSGDI

SEQ ID NO: 1050311 - protein, 9 aa, Homo Sapiens
TLPKEVGHL

SEQ ID NO: 1050312 - protein, 9 aa, Homo Sapiens
CLLVLSLDT

SEQ ID NO: 1050313 - protein, 9 aa, Homo Sapiens
SLGVKGFAG

SEQ ID NO: 1050314 - protein, 9 aa, Homo Sapiens
MKKLSSKRP

SEQ ID NO: 1050315 - protein, 9 aa, Homo Sapiens
FQHSGILLD

SEQ ID NO: 1050316 - protein, 9 aa, Homo Sapiens
STYSRKFAK

SEQ ID NO: 1050317 - protein, 9 aa, Homo Sapiens
VLFYMKDVC

SEQ ID NO: 1050318 - protein, 9 aa, Homo Sapiens
LHEEEALPL

SEQ ID NO: 1050319 - protein, 9 aa, Homo Sapiens
LVVKVSARN

SEQ ID NO: 1050320 - protein, 9 aa, Homo Sapiens
VKRWVWSDS

SEQ ID NO: 1050321 - protein, 9 aa, Homo Sapiens
PFVEAFDKL

SEQ ID NO: 1050322 - protein, 9 aa, Homo Sapiens
KKKLDFKKI

SEQ ID NO: 1050323 - protein, 9 aa, Homo Sapiens
ESDRDLEAS

SEQ ID NO: 1050324 - protein, 9 aa, Homo Sapiens
LRVESDVQP

SEQ ID NO: 1050325 - protein, 9 aa, Homo Sapiens
DVCEAKQEK

SEQ ID NO: 1050326 - protein, 9 aa, Homo Sapiens
SGGRGEDNA

SEQ ID NO: 1050327 - protein, 9 aa, Homo Sapiens
ISILFLGLI

SEQ ID NO: 1050328 - protein, 9 aa, Homo Sapiens
RYLSHFCCV

SEQ ID NO: 1050329 - protein, 9 aa, Homo Sapiens
LPVSVPTAS

SEQ ID NO: 1050330 - protein, 9 aa, Homo Sapiens
DDKYTPLPS

SEQ ID NO: 1050331 - protein, 9 aa, Homo Sapiens
RSNSVEKTV

SEQ ID NO: 1050332 - protein, 9 aa, Homo Sapiens
ETVKNNFRI

SEQ ID NO: 1050333 - protein, 9 aa, Homo Sapiens
SFFPDESQR

SEQ ID NO: 1050334 - protein, 9 aa, Homo Sapiens
VNDFPCHHG

SEQ ID NO: 1050335 - protein, 9 aa, Homo Sapiens
TSVVAQGLS

SEQ ID NO: 1050336 - protein, 9 aa, Homo Sapiens
VLETKPLFQ

SEQ ID NO: 1050337 - protein, 9 aa, Homo Sapiens
FFLFAISVT

SEQ ID NO: 1050338 - protein, 9 aa, Homo Sapiens
AEVSKKLHV

SEQ ID NO: 1050339 - protein, 9 aa, Homo Sapiens
FQRLISCCK

SEQ ID NO: 1050340 - protein, 9 aa, Homo Sapiens
NEQSSTRCT

SEQ ID NO: 1050341 - protein, 9 aa, Homo Sapiens
LEYYIINKL

SEQ ID NO: 1050342 - protein, 9 aa, Homo Sapiens
AFTSIGNGP

SEQ ID NO: 1050343 - protein, 9 aa, Homo Sapiens
KISFFERLR

SEQ ID NO: 1050344 - protein, 9 aa, Homo Sapiens
VLNTIFTPL

SEQ ID NO: 1050345 - protein, 9 aa, Homo Sapiens
LPMRPQQPN

SEQ ID NO: 1050346 - protein, 9 aa, Homo Sapiens
QSLALLPRL

SEQ ID NO: 1050347 - protein, 9 aa, Homo Sapiens
LGINLWRGR

SEQ ID NO: 1050348 - protein, 9 aa, Homo Sapiens
QEMLRLLGY

SEQ ID NO: 1050349 - protein, 9 aa, Homo Sapiens
GPHLETLYN

SEQ ID NO: 1050350 - protein, 9 aa, Homo Sapiens
SVFSMFCYS

SEQ ID NO: 1050351 - protein, 9 aa, Homo Sapiens
KNLRVVDAS

SEQ ID NO: 1050352 - protein, 9 aa, Homo Sapiens
ELLGSRPRQ

SEQ ID NO: 1050353 - protein, 9 aa, Homo Sapiens
TSLLSVYLK

SEQ ID NO: 1050354 - protein, 9 aa, Homo Sapiens
IFIVVTFGA

SEQ ID NO: 1050355 - protein, 9 aa, Homo Sapiens
SCKYSPFMK

SEQ ID NO: 1050356 - protein, 9 aa, Homo Sapiens
SESPQGKVL

SEQ ID NO: 1050357 - protein, 9 aa, Homo Sapiens
AVDSQKIDK

SEQ ID NO: 1050358 - protein, 9 aa, Homo Sapiens
MSMKLTSNR

SEQ ID NO: 1050359 - protein, 9 aa, Homo Sapiens
ASFCGWGGA

SEQ ID NO: 1050360 - protein, 9 aa, Homo Sapiens
LYNQVLLFS

SEQ ID NO: 1050361 - protein, 9 aa, Homo Sapiens
DSWRGPSPL

SEQ ID NO: 1050362 - protein, 9 aa, Homo Sapiens
DFLCSDIFE

SEQ ID NO: 1050363 - protein, 9 aa, Homo Sapiens
SSSTPIKDL

SEQ ID NO: 1050364 - protein, 9 aa, Homo Sapiens
VVFRLNGSS

SEQ ID NO: 1050365 - protein, 9 aa, Homo Sapiens
LCGPSIPCM

SEQ ID NO: 1050366 - protein, 9 aa, Homo Sapiens
GHHFSVNWI

SEQ ID NO: 1050367 - protein, 9 aa, Homo Sapiens
WDLGPAQII

SEQ ID NO: 1050368 - protein, 9 aa, Homo Sapiens
AQIRYSILE

SEQ ID NO: 1050369 - protein, 9 aa, Homo Sapiens
QEKKTEAKI

SEQ ID NO: 1050370 - protein, 9 aa, Homo Sapiens
LSLPESQVL

SEQ ID NO: 1050371 - protein, 9 aa, Homo Sapiens
LGLVPREDQ

SEQ ID NO: 1050372 - protein, 9 aa, Homo Sapiens
FYSPAYEES

SEQ ID NO: 1050373 - protein, 9 aa, Homo Sapiens
DKEDGVQDL

SEQ ID NO: 1050374 - protein, 9 aa, Homo Sapiens
GYFLAEGDM

SEQ ID NO: 1050375 - protein, 9 aa, Homo Sapiens
QVPDAGTGE

SEQ ID NO: 1050376 - protein, 9 aa, Homo Sapiens
PGSAASGAS

SEQ ID NO: 1050377 - protein, 9 aa, Homo Sapiens
ELDELFSSR

SEQ ID NO: 1050378 - protein, 9 aa, Homo Sapiens
LTMDTYVNE

SEQ ID NO: 1050379 - protein, 9 aa, Homo Sapiens
ATHSLLTFF

SEQ ID NO: 1050380 - protein, 9 aa, Homo Sapiens
DRKRIYDEK

SEQ ID NO: 1050381 - protein, 9 aa, Homo Sapiens
DITPLHIAS

SEQ ID NO: 1050382 - protein, 9 aa, Homo Sapiens
GHSQCSCGD

SEQ ID NO: 1050383 - protein, 9 aa, Homo Sapiens
KEEEDQEPQ

SEQ ID NO: 1050384 - protein, 9 aa, Homo Sapiens
GSSGGGPRG

SEQ ID NO: 1050385 - protein, 9 aa, Homo Sapiens
TAAHFSATP

SEQ ID NO: 1050386 - protein, 9 aa, Homo Sapiens
CCASPSLAA

SEQ ID NO: 1050387 - protein, 9 aa, Homo Sapiens
MRNMSGRYS

SEQ ID NO: 1050388 - protein, 9 aa, Homo Sapiens
EDRKMHMPF

SEQ ID NO: 1050389 - protein, 9 aa, Homo Sapiens
SQVLLTPVK

SEQ ID NO: 1050390 - protein, 9 aa, Homo Sapiens
SDDEKSLDD

SEQ ID NO: 1050391 - protein, 9 aa, Homo Sapiens
IYTGEKPYT

SEQ ID NO: 1050392 - protein, 9 aa, Homo Sapiens
FLQKAGPGE

SEQ ID NO: 1050393 - protein, 9 aa, Homo Sapiens
QHPHRHHPH

SEQ ID NO: 1050394 - protein, 9 aa, Homo Sapiens
MLWLADLVQ

SEQ ID NO: 1050395 - protein, 9 aa, Homo Sapiens
PPSPRSQGQ

SEQ ID NO: 1050396 - protein, 9 aa, Homo Sapiens
RGLEPRVRL

SEQ ID NO: 1050397 - protein, 9 aa, Homo Sapiens
VDVFLGTVR

SEQ ID NO: 1050398 - protein, 9 aa, Homo Sapiens
IPVREKKTK

SEQ ID NO: 1050399 - protein, 9 aa, Homo Sapiens
TARFSDGRL

SEQ ID NO: 1050400 - protein, 9 aa, Homo Sapiens
QSHCGSRSQ

SEQ ID NO: 1050401 - protein, 9 aa, Homo Sapiens
SLSTTGGSG

SEQ ID NO: 1050402 - protein, 9 aa, Homo Sapiens
QSARSASSS

SEQ ID NO: 1050403 - protein, 9 aa, Homo Sapiens
TWSQEAVFF

SEQ ID NO: 1050404 - protein, 9 aa, Homo Sapiens
KVHSSQGCQ

SEQ ID NO: 1050405 - protein, 9 aa, Homo Sapiens
KKEEEDQEP

SEQ ID NO: 1050406 - protein, 9 aa, Homo Sapiens
SLPSLGPHY

SEQ ID NO: 1050407 - protein, 9 aa, Homo Sapiens
DFCYCKVNF

SEQ ID NO: 1050408 - protein, 9 aa, Homo Sapiens
IWGKDKSWT

SEQ ID NO: 1050409 - protein, 9 aa, Homo Sapiens
AKCQKTVTI

SEQ ID NO: 1050410 - protein, 9 aa, Homo Sapiens
ERHDQRHAE

SEQ ID NO: 1050411 - protein, 9 aa, Homo Sapiens
KANQLVKQL

SEQ ID NO: 1050412 - protein, 9 aa, Homo Sapiens
VSACWVLRM

SEQ ID NO: 1050413 - protein, 9 aa, Homo Sapiens
PIAQNQASV

SEQ ID NO: 1050414 - protein, 9 aa, Homo Sapiens
TQASGYNQG

SEQ ID NO: 1050415 - protein, 9 aa, Homo Sapiens
LEEPVSPNH

SEQ ID NO: 1050416 - protein, 9 aa, Homo Sapiens
GTQDNPARI

SEQ ID NO: 1050417 - protein, 9 aa, Homo Sapiens
GIWYLDQIK

SEQ ID NO: 1050418 - protein, 9 aa, Homo Sapiens
SARSASSST

SEQ ID NO: 1050419 - protein, 9 aa, Homo Sapiens
SKVDFRDAL

SEQ ID NO: 1050420 - protein, 9 aa, Homo Sapiens
FRSPFCEEI

SEQ ID NO: 1050421 - protein, 9 aa, Homo Sapiens
MNYVNRDLA

SEQ ID NO: 1050422 - protein, 9 aa, Homo Sapiens
ATLTPSPLE

SEQ ID NO: 1050423 - protein, 9 aa, Homo Sapiens
ELEATFQSN

SEQ ID NO: 1050424 - protein, 9 aa, Homo Sapiens
ALGLKKKNL

SEQ ID NO: 1050425 - protein, 9 aa, Homo Sapiens
HHISFNWDC

SEQ ID NO: 1050426 - protein, 9 aa, Homo Sapiens
AIGTYDLDT

SEQ ID NO: 1050427 - protein, 9 aa, Homo Sapiens
RNVTRMSSQ

SEQ ID NO: 1050428 - protein, 9 aa, Homo Sapiens
WTVSEGQFD

SEQ ID NO: 1050429 - protein, 9 aa, Homo Sapiens
GRRRKKFGR

SEQ ID NO: 1050430 - protein, 9 aa, Homo Sapiens
FMDGKNVDT

SEQ ID NO: 1050431 - protein, 9 aa, Homo Sapiens
RCELCPYKD

SEQ ID NO: 1050432 - protein, 9 aa, Homo Sapiens
LYVCNECGK

SEQ ID NO: 1050433 - protein, 9 aa, Homo Sapiens
LLTGIADAS

SEQ ID NO: 1050434 - protein, 9 aa, Homo Sapiens
ENSDKFHSP

SEQ ID NO: 1050435 - protein, 9 aa, Homo Sapiens
FLGIGASKL

SEQ ID NO: 1050436 - protein, 9 aa, Homo Sapiens
EEYAATLAK

SEQ ID NO: 1050437 - protein, 9 aa, Homo Sapiens
MSRSQLLQN

SEQ ID NO: 1050438 - protein, 9 aa, Homo Sapiens
YYSQKAIPA

SEQ ID NO: 1050439 - protein, 9 aa, Homo Sapiens
YKTLAESME

SEQ ID NO: 1050440 - protein, 9 aa, Homo Sapiens
QVMSQRAIF

SEQ ID NO: 1050441 - protein, 9 aa, Homo Sapiens
ITQIEIWVM

SEQ ID NO: 1050442 - protein, 9 aa, Homo Sapiens
PEDILKNLA

SEQ ID NO: 1050443 - protein, 9 aa, Homo Sapiens
LKEYKAMAP

SEQ ID NO: 1050444 - protein, 9 aa, Homo Sapiens
DSLGQDMRR

SEQ ID NO: 1050445 - protein, 9 aa, Homo Sapiens
LDNSPPRPI

SEQ ID NO: 1050446 - protein, 9 aa, Homo Sapiens
ANLTPLRTV

SEQ ID NO: 1050447 - protein, 9 aa, Homo Sapiens
SSKMKHIRQ

SEQ ID NO: 1050448 - protein, 9 aa, Homo Sapiens
VSVLNTIFT

SEQ ID NO: 1050449 - protein, 9 aa, Homo Sapiens
LEMEIAIKR

SEQ ID NO: 1050450 - protein, 9 aa, Homo Sapiens
WLALIGGLE

SEQ ID NO: 1050451 - protein, 9 aa, Homo Sapiens
LEEVSSHVE

SEQ ID NO: 1050452 - protein, 9 aa, Homo Sapiens
SENNLLVQF

SEQ ID NO: 1050453 - protein, 9 aa, Homo Sapiens
LAFLLDMVY

SEQ ID NO: 1050454 - protein, 9 aa, Homo Sapiens
NKKADVKNL

SEQ ID NO: 1050455 - protein, 9 aa, Homo Sapiens
CLIDVNTEF

SEQ ID NO: 1050456 - protein, 9 aa, Homo Sapiens
HWKKVSKLC

SEQ ID NO: 1050457 - protein, 9 aa, Homo Sapiens
NCLLSPLAR

SEQ ID NO: 1050458 - protein, 9 aa, Homo Sapiens
KAKRLKLLQ

SEQ ID NO: 1050459 - protein, 9 aa, Homo Sapiens
ILYSFEDIS

SEQ ID NO: 1050460 - protein, 9 aa, Homo Sapiens
PLPSGLSFW

SEQ ID NO: 1050461 - protein, 9 aa, Homo Sapiens
KVMWHLFRR

SEQ ID NO: 1050462 - protein, 9 aa, Homo Sapiens
VSKLNGPVI

SEQ ID NO: 1050463 - protein, 9 aa, Homo Sapiens
RTLSAFFWR

SEQ ID NO: 1050464 - protein, 9 aa, Homo Sapiens
VEMLKCDGL

SEQ ID NO: 1050465 - protein, 9 aa, Homo Sapiens
AAHKKSHKE

SEQ ID NO: 1050466 - protein, 9 aa, Homo Sapiens
LQNIRVNSL

SEQ ID NO: 1050467 - protein, 9 aa, Homo Sapiens
KMGKRGDAA

SEQ ID NO: 1050468 - protein, 9 aa, Homo Sapiens
FINCEANLQ

SEQ ID NO: 1050469 - protein, 9 aa, Homo Sapiens
DWMPDNMNF

SEQ ID NO: 1050470 - protein, 9 aa, Homo Sapiens
GLFSHSGLR

SEQ ID NO: 1050471 - protein, 9 aa, Homo Sapiens
LENMWAIDN

SEQ ID NO: 1050472 - protein, 9 aa, Homo Sapiens
FNVPALFIF

SEQ ID NO: 1050473 - protein, 9 aa, Homo Sapiens
IKEKKDETD

SEQ ID NO: 1050474 - protein, 9 aa, Homo Sapiens
RASCNCPHP

SEQ ID NO: 1050475 - protein, 9 aa, Homo Sapiens
LYECKECEK

SEQ ID NO: 1050476 - protein, 9 aa, Homo Sapiens
LMKMSGPYN

SEQ ID NO: 1050477 - protein, 9 aa, Homo Sapiens
ALYFSAECP

SEQ ID NO: 1050478 - protein, 9 aa, Homo Sapiens
HPILFYQGA

SEQ ID NO: 1050479 - protein, 9 aa, Homo Sapiens
RVIDISIIL

SEQ ID NO: 1050480 - protein, 9 aa, Homo Sapiens
GGVPLYDQN

SEQ ID NO: 1050481 - protein, 9 aa, Homo Sapiens
NPAPLECGQ

SEQ ID NO: 1050482 - protein, 9 aa, Homo Sapiens
HKRIYTREK

SEQ ID NO: 1050483 - protein, 9 aa, Homo Sapiens
SGNGMIKVK

SEQ ID NO: 1050484 - protein, 9 aa, Homo Sapiens
REKNPGQVH

SEQ ID NO: 1050485 - protein, 9 aa, Homo Sapiens
STAQPPELQ

SEQ ID NO: 1050486 - protein, 9 aa, Homo Sapiens
PSKSMVASV

SEQ ID NO: 1050487 - protein, 9 aa, Homo Sapiens
SVLEPPQKH

SEQ ID NO: 1050488 - protein, 9 aa, Homo Sapiens
PGNYDVNIT

SEQ ID NO: 1050489 - protein, 9 aa, Homo Sapiens
PAAPLSTPA

SEQ ID NO: 1050490 - protein, 9 aa, Homo Sapiens
IKRLTFSTG

SEQ ID NO: 1050491 - protein, 9 aa, Homo Sapiens
KGSKEEPGP

SEQ ID NO: 1050492 - protein, 9 aa, Homo Sapiens
NQVCSKCGK

SEQ ID NO: 1050493 - protein, 9 aa, Homo Sapiens
NWLVVQVAK

SEQ ID NO: 1050494 - protein, 9 aa, Homo Sapiens
QVALGNIAS

SEQ ID NO: 1050495 - protein, 9 aa, Homo Sapiens
AFPLIKKTA

SEQ ID NO: 1050496 - protein, 9 aa, Homo Sapiens
TLRLEKMAV

SEQ ID NO: 1050497 - protein, 9 aa, Homo Sapiens
IPKLNEGNQ

SEQ ID NO: 1050498 - protein, 9 aa, Homo Sapiens
DENKLKALG

SEQ ID NO: 1050499 - protein, 9 aa, Homo Sapiens
IIITTKVMT

SEQ ID NO: 1050500 - protein, 9 aa, Homo Sapiens
NSFISNISN

SEQ ID NO: 1050501 - protein, 9 aa, Homo Sapiens
QQRFRAKIP

SEQ ID NO: 1050502 - protein, 9 aa, Homo Sapiens
AYLPKEMTQ

SEQ ID NO: 1050503 - protein, 9 aa, Homo Sapiens
CLYSATPST

SEQ ID NO: 1050504 - protein, 9 aa, Homo Sapiens
CMDRMSGLM

SEQ ID NO: 1050505 - protein, 9 aa, Homo Sapiens
LGLIAVHPF

SEQ ID NO: 1050506 - protein, 9 aa, Homo Sapiens
LREWYAHNR

SEQ ID NO: 1050507 - protein, 9 aa, Homo Sapiens
GFQTRSQML

SEQ ID NO: 1050508 - protein, 9 aa, Homo Sapiens
AGADFLDSP

SEQ ID NO: 1050509 - protein, 9 aa, Homo Sapiens
SSPRVPGLP

SEQ ID NO: 1050510 - protein, 9 aa, Homo Sapiens
NSPLRENSR

SEQ ID NO: 1050511 - protein, 9 aa, Homo Sapiens
RKRKYKLRY

SEQ ID NO: 1050512 - protein, 9 aa, Homo Sapiens
TEISLIGLI

SEQ ID NO: 1050513 - protein, 9 aa, Homo Sapiens
CSDAGRQTD

SEQ ID NO: 1050514 - protein, 9 aa, Homo Sapiens
SRTPSTFPS

SEQ ID NO: 1050515 - protein, 9 aa, Homo Sapiens
IFLASLWIC

SEQ ID NO: 1050516 - protein, 9 aa, Homo Sapiens
SSNTNSEKI

SEQ ID NO: 1050517 - protein, 9 aa, Homo Sapiens
DNMEDLPAP

SEQ ID NO: 1050518 - protein, 9 aa, Homo Sapiens
AAQPRCLRA

SEQ ID NO: 1050519 - protein, 9 aa, Homo Sapiens
PDIPSLGLD

SEQ ID NO: 1050520 - protein, 9 aa, Homo Sapiens
FCGNQKVAN

SEQ ID NO: 1050521 - protein, 9 aa, Homo Sapiens
GQNGPRRLY

SEQ ID NO: 1050522 - protein, 9 aa, Homo Sapiens
FPKKLLRMN

SEQ ID NO: 1050523 - protein, 9 aa, Homo Sapiens
LIFLKEIME

SEQ ID NO: 1050524 - protein, 9 aa, Homo Sapiens
VPSSFSTYH

SEQ ID NO: 1050525 - protein, 9 aa, Homo Sapiens
IRKHTSSGI

SEQ ID NO: 1050526 - protein, 9 aa, Homo Sapiens
YWGHHFSVN

SEQ ID NO: 1050527 - protein, 9 aa, Homo Sapiens
AMETCKDAG

SEQ ID NO: 1050528 - protein, 9 aa, Homo Sapiens
LNKRKGINV

SEQ ID NO: 1050529 - protein, 9 aa, Homo Sapiens
PSYTNTPVS

SEQ ID NO: 1050530 - protein, 9 aa, Homo Sapiens
PGRGHLLVV

SEQ ID NO: 1050531 - protein, 9 aa, Homo Sapiens
ISGMKKEAI

SEQ ID NO: 1050532 - protein, 9 aa, Homo Sapiens
VSEAAKHGT

SEQ ID NO: 1050533 - protein, 9 aa, Homo Sapiens
TKDIDNPPK

SEQ ID NO: 1050534 - protein, 9 aa, Homo Sapiens
QYVFNQGPS

SEQ ID NO: 1050535 - protein, 9 aa, Homo Sapiens
INSKTEQPA

SEQ ID NO: 1050536 - protein, 9 aa, Homo Sapiens
VNIFLCQKW

SEQ ID NO: 1050537 - protein, 9 aa, Homo Sapiens
DCVDQTWNC

SEQ ID NO: 1050538 - protein, 9 aa, Homo Sapiens
SYPCRRYSC

SEQ ID NO: 1050539 - protein, 9 aa, Homo Sapiens
KRKLHIYVW

SEQ ID NO: 1050540 - protein, 9 aa, Homo Sapiens
YVALDFKQE

SEQ ID NO: 1050541 - protein, 9 aa, Homo Sapiens
EILSSDGKD

SEQ ID NO: 1050542 - protein, 9 aa, Homo Sapiens
LLRNPNNKY

SEQ ID NO: 1050543 - protein, 9 aa, Homo Sapiens
FNFGSKEDA

SEQ ID NO: 1050544 - protein, 9 aa, Homo Sapiens
ISSDTRSTV

SEQ ID NO: 1050545 - protein, 9 aa, Homo Sapiens
DLRDVARLG

SEQ ID NO: 1050546 - protein, 9 aa, Homo Sapiens
LKKEQEKAW

SEQ ID NO: 1050547 - protein, 9 aa, Homo Sapiens
LEATFQSNR

SEQ ID NO: 1050548 - protein, 9 aa, Homo Sapiens
EKEMATMKK

SEQ ID NO: 1050549 - protein, 9 aa, Homo Sapiens
PLEDQRNVS

SEQ ID NO: 1050550 - protein, 9 aa, Homo Sapiens
IISLFLIFY

SEQ ID NO: 1050551 - protein, 9 aa, Homo Sapiens
IQGGKHQEN

SEQ ID NO: 1050552 - protein, 9 aa, Homo Sapiens
THHPHFIYN

SEQ ID NO: 1050553 - protein, 9 aa, Homo Sapiens
TPPSERRNK

SEQ ID NO: 1050554 - protein, 9 aa, Homo Sapiens
RKLIFEVDS

SEQ ID NO: 1050555 - protein, 9 aa, Homo Sapiens
YYNKDNKEN

SEQ ID NO: 1050556 - protein, 9 aa, Homo Sapiens
LCVVVAFYA

SEQ ID NO: 1050557 - protein, 9 aa, Homo Sapiens
GNSESLSSK

SEQ ID NO: 1050558 - protein, 9 aa, Homo Sapiens
NLQCFLHKE

SEQ ID NO: 1050559 - protein, 9 aa, Homo Sapiens
APLSQDTSG

SEQ ID NO: 1050560 - protein, 9 aa, Homo Sapiens
SEKRGSSKS

SEQ ID NO: 1050561 - protein, 9 aa, Homo Sapiens
IKWDISGIF

SEQ ID NO: 1050562 - protein, 9 aa, Homo Sapiens
DKYTPLPSN

SEQ ID NO: 1050563 - protein, 9 aa, Homo Sapiens
KQEKIKMEG

SEQ ID NO: 1050564 - protein, 9 aa, Homo Sapiens
LGSSGPPGC

SEQ ID NO: 1050565 - protein, 9 aa, Homo Sapiens
RPRRSHFFL

SEQ ID NO: 1050566 - protein, 9 aa, Homo Sapiens
GARILSGQK

SEQ ID NO: 1050567 - protein, 9 aa, Homo Sapiens
ALNKAAWTS

SEQ ID NO: 1050568 - protein, 9 aa, Homo Sapiens
FWAVVFLLH

SEQ ID NO: 1050569 - protein, 9 aa, Homo Sapiens
LVGFSYNAT

SEQ ID NO: 1050570 - protein, 9 aa, Homo Sapiens
AGTDCSIQD

SEQ ID NO: 1050571 - protein, 9 aa, Homo Sapiens
VLLTPVKSR

SEQ ID NO: 1050572 - protein, 9 aa, Homo Sapiens
SIVLDSMLQ

SEQ ID NO: 1050573 - protein, 9 aa, Homo Sapiens
HGSNFGHSS

SEQ ID NO: 1050574 - protein, 9 aa, Homo Sapiens
QLSLHQRIY

SEQ ID NO: 1050575 - protein, 9 aa, Homo Sapiens
LFSLTLVRS

SEQ ID NO: 1050576 - protein, 9 aa, Homo Sapiens
NKGSKEEPG

SEQ ID NO: 1050577 - protein, 9 aa, Homo Sapiens
SICKQQTNN

SEQ ID NO: 1050578 - protein, 9 aa, Homo Sapiens
PHATADLDP

SEQ ID NO: 1050579 - protein, 9 aa, Homo Sapiens
HQSREKTEH

SEQ ID NO: 1050580 - protein, 9 aa, Homo Sapiens
YTIIISHRA

SEQ ID NO: 1050581 - protein, 9 aa, Homo Sapiens
AIGSFRYFS

SEQ ID NO: 1050582 - protein, 9 aa, Homo Sapiens
KTPRLMKLR

SEQ ID NO: 1050583 - protein, 9 aa, Homo Sapiens
QKHSCVTDS

SEQ ID NO: 1050584 - protein, 9 aa, Homo Sapiens
ALNHFSSRQ

SEQ ID NO: 1050585 - protein, 9 aa, Homo Sapiens
EKVFMARNY

SEQ ID NO: 1050586 - protein, 9 aa, Homo Sapiens
CLPVSNGPF

SEQ ID NO: 1050587 - protein, 9 aa, Homo Sapiens
LNSMGFINC

SEQ ID NO: 1050588 - protein, 9 aa, Homo Sapiens
KSPSTFHDV

SEQ ID NO: 1050589 - protein, 9 aa, Homo Sapiens
QVWLHHLNH

SEQ ID NO: 1050590 - protein, 9 aa, Homo Sapiens
RFYLGLFTD

SEQ ID NO: 1050591 - protein, 9 aa, Homo Sapiens
AGARDHGAA

SEQ ID NO: 1050592 - protein, 9 aa, Homo Sapiens
TVFSSLGLQ

SEQ ID NO: 1050593 - protein, 9 aa, Homo Sapiens
NQRNVTRMS

SEQ ID NO: 1050594 - protein, 9 aa, Homo Sapiens
TPEGLVTPA

SEQ ID NO: 1050595 - protein, 9 aa, Homo Sapiens
RCQELGCYF

SEQ ID NO: 1050596 - protein, 9 aa, Homo Sapiens
ELSIISYEI

SEQ ID NO: 1050597 - protein, 9 aa, Homo Sapiens
PHRHHPHAH

SEQ ID NO: 1050598 - protein, 9 aa, Homo Sapiens
YKNKEDKLK

SEQ ID NO: 1050599 - protein, 9 aa, Homo Sapiens
LIFLRNQIR

SEQ ID NO: 1050600 - protein, 9 aa, Homo Sapiens
YSLTSQVSP

SEQ ID NO: 1050601 - protein, 9 aa, Homo Sapiens
FWKEMSLFS

SEQ ID NO: 1050602 - protein, 9 aa, Homo Sapiens
ACWVLRMVD

SEQ ID NO: 1050603 - protein, 9 aa, Homo Sapiens
YGDIIVTET

SEQ ID NO: 1050604 - protein, 9 aa, Homo Sapiens
KTITILFVK

SEQ ID NO: 1050605 - protein, 9 aa, Homo Sapiens
RCEKPIQNS

SEQ ID NO: 1050606 - protein, 9 aa, Homo Sapiens
GNLPLVKVL

SEQ ID NO: 1050607 - protein, 9 aa, Homo Sapiens
TVLRRSGQM

SEQ ID NO: 1050608 - protein, 9 aa, Homo Sapiens
LVTPATTVH

SEQ ID NO: 1050609 - protein, 9 aa, Homo Sapiens
PPVPPSEDT

SEQ ID NO: 1050610 - protein, 9 aa, Homo Sapiens
TGGPPEENG

SEQ ID NO: 1050611 - protein, 9 aa, Homo Sapiens
VLLYLPALL

SEQ ID NO: 1050612 - protein, 9 aa, Homo Sapiens
ACSDAGRQT

SEQ ID NO: 1050613 - protein, 9 aa, Homo Sapiens
ENERSVLQE

SEQ ID NO: 1050614 - protein, 9 aa, Homo Sapiens
DNFQNRGFM

SEQ ID NO: 1050615 - protein, 9 aa, Homo Sapiens
PSQCVFART

SEQ ID NO: 1050616 - protein, 9 aa, Homo Sapiens
FGNVSSNTN

SEQ ID NO: 1050617 - protein, 9 aa, Homo Sapiens
DYRVNIFLC

SEQ ID NO: 1050618 - protein, 9 aa, Homo Sapiens
AYEQKVALH

SEQ ID NO: 1050619 - protein, 9 aa, Homo Sapiens
PLVGPLQPP

SEQ ID NO: 1050620 - protein, 9 aa, Homo Sapiens
LFLSSSSLS

SEQ ID NO: 1050621 - protein, 9 aa, Homo Sapiens
IQKARLVDV

SEQ ID NO: 1050622 - protein, 9 aa, Homo Sapiens
MNGCRLQFG

SEQ ID NO: 1050623 - protein, 9 aa, Homo Sapiens
PPPGPPGSG

SEQ ID NO: 1050624 - protein, 9 aa, Homo Sapiens
GNCLPVSNG

SEQ ID NO: 1050625 - protein, 9 aa, Homo Sapiens
ADREILKDC

SEQ ID NO: 1050626 - protein, 9 aa, Homo Sapiens
DATREDPFI

SEQ ID NO: 1050627 - protein, 9 aa, Homo Sapiens
IRPKICGLM

SEQ ID NO: 1050628 - protein, 9 aa, Homo Sapiens
DFRTQLETK

SEQ ID NO: 1050629 - protein, 9 aa, Homo Sapiens
LMPRWVPDC

SEQ ID NO: 1050630 - protein, 9 aa, Homo Sapiens
YVNLCSNSE

SEQ ID NO: 1050631 - protein, 9 aa, Homo Sapiens
VLGVKNLRV

SEQ ID NO: 1050632 - protein, 9 aa, Homo Sapiens
SMTVVFDSN

SEQ ID NO: 1050633 - protein, 9 aa, Homo Sapiens
PEPPKTGVS

SEQ ID NO: 1050634 - protein, 9 aa, Homo Sapiens
ALNPFQTSM

SEQ ID NO: 1050635 - protein, 9 aa, Homo Sapiens
FTPLLNPFI

SEQ ID NO: 1050636 - protein, 9 aa, Homo Sapiens
AAKLKLQKL

SEQ ID NO: 1050637 - protein, 9 aa, Homo Sapiens
LRKRRGQAA

SEQ ID NO: 1050638 - protein, 9 aa, Homo Sapiens
MDTYVNENG

SEQ ID NO: 1050639 - protein, 9 aa, Homo Sapiens
EPEKLLDKE

SEQ ID NO: 1050640 - protein, 9 aa, Homo Sapiens
FVCKRGYCL

SEQ ID NO: 1050641 - protein, 9 aa, Homo Sapiens
KLDKKNNAF

SEQ ID NO: 1050642 - protein, 9 aa, Homo Sapiens
KDKSWTGQE

SEQ ID NO: 1050643 - protein, 9 aa, Homo Sapiens
ASLDTFQQM

SEQ ID NO: 1050644 - protein, 9 aa, Homo Sapiens
LEHSSAFYF

SEQ ID NO: 1050645 - protein, 9 aa, Homo Sapiens
HNVCVPKTC

SEQ ID NO: 1050646 - protein, 9 aa, Homo Sapiens
CVKTTGIVE

SEQ ID NO: 1050647 - protein, 9 aa, Homo Sapiens
FPFTSIIQQ

SEQ ID NO: 1050648 - protein, 9 aa, Homo Sapiens
PADWLALIG

SEQ ID NO: 1050649 - protein, 9 aa, Homo Sapiens
SSGSSASKS

SEQ ID NO: 1050650 - protein, 9 aa, Homo Sapiens
DLLNEECKV

SEQ ID NO: 1050651 - protein, 9 aa, Homo Sapiens
CKAREQDPL

SEQ ID NO: 1050652 - protein, 9 aa, Homo Sapiens
FDYGELVYH

SEQ ID NO: 1050653 - protein, 9 aa, Homo Sapiens
NPLSSPSSC

SEQ ID NO: 1050654 - protein, 9 aa, Homo Sapiens
KTYFQVIAL

SEQ ID NO: 1050655 - protein, 9 aa, Homo Sapiens
QTVVLSPLN

SEQ ID NO: 1050656 - protein, 9 aa, Homo Sapiens
LSSIERYDS

SEQ ID NO: 1050657 - protein, 9 aa, Homo Sapiens
RIKKVFYNI

SEQ ID NO: 1050658 - protein, 9 aa, Homo Sapiens
NTRELPIPG

SEQ ID NO: 1050659 - protein, 9 aa, Homo Sapiens
CDAPPNILN

SEQ ID NO: 1050660 - protein, 9 aa, Homo Sapiens
METCKDAGL

SEQ ID NO: 1050661 - protein, 9 aa, Homo Sapiens
ARRKFKKMS

SEQ ID NO: 1050662 - protein, 9 aa, Homo Sapiens
FWLDSKSVV

SEQ ID NO: 1050663 - protein, 9 aa, Homo Sapiens
PGAGPSGLG

SEQ ID NO: 1050664 - protein, 9 aa, Homo Sapiens
KHVSPNASD

SEQ ID NO: 1050665 - protein, 9 aa, Homo Sapiens
PPPHFSPTL

SEQ ID NO: 1050666 - protein, 9 aa, Homo Sapiens
GILHKFVLK

SEQ ID NO: 1050667 - protein, 9 aa, Homo Sapiens
QTNGSSTTE

SEQ ID NO: 1050668 - protein, 9 aa, Homo Sapiens
LLAQSHTRK

SEQ ID NO: 1050669 - protein, 9 aa, Homo Sapiens
CMAISIPNR

SEQ ID NO: 1050670 - protein, 9 aa, Homo Sapiens
FVTTHMCCP

SEQ ID NO: 1050671 - protein, 9 aa, Homo Sapiens
YKCDECSFT

SEQ ID NO: 1050672 - protein, 9 aa, Homo Sapiens
VATPSSAPG

SEQ ID NO: 1050673 - protein, 9 aa, Homo Sapiens
VEKFLHQRD

SEQ ID NO: 1050674 - protein, 9 aa, Homo Sapiens
NVNESWKKF

SEQ ID NO: 1050675 - protein, 9 aa, Homo Sapiens
NIFILNLCF

SEQ ID NO: 1050676 - protein, 9 aa, Homo Sapiens
RLEKEEDRG

SEQ ID NO: 1050677 - protein, 9 aa, Homo Sapiens
EKITQIEIW

SEQ ID NO: 1050678 - protein, 9 aa, Homo Sapiens
TNAEQRGQP

SEQ ID NO: 1050679 - protein, 9 aa, Homo Sapiens
GHFPFSITL

SEQ ID NO: 1050680 - protein, 9 aa, Homo Sapiens
VDVLLQGAV

SEQ ID NO: 1050681 - protein, 9 aa, Homo Sapiens
TTPADWLAL

SEQ ID NO: 1050682 - protein, 9 aa, Homo Sapiens
NEKFINVMK

SEQ ID NO: 1050683 - protein, 9 aa, Homo Sapiens
PHPRVQIGD

SEQ ID NO: 1050684 - protein, 9 aa, Homo Sapiens
GVPPGAGPS

SEQ ID NO: 1050685 - protein, 9 aa, Homo Sapiens
NKHDDKYTP

SEQ ID NO: 1050686 - protein, 9 aa, Homo Sapiens
DNECKKSEN

SEQ ID NO: 1050687 - protein, 9 aa, Homo Sapiens
PERDDPSAS

SEQ ID NO: 1050688 - protein, 9 aa, Homo Sapiens
RKIYTGEKL

SEQ ID NO: 1050689 - protein, 9 aa, Homo Sapiens
RQIVAARRE

SEQ ID NO: 1050690 - protein, 9 aa, Homo Sapiens
LSVPKSTND

SEQ ID NO: 1050691 - protein, 9 aa, Homo Sapiens
IIKIDGQKK

SEQ ID NO: 1050692 - protein, 9 aa, Homo Sapiens
QEEGAGDTH

SEQ ID NO: 1050693 - protein, 9 aa, Homo Sapiens
LHPILFYQG

SEQ ID NO: 1050694 - protein, 9 aa, Homo Sapiens
FQNKMANEN

SEQ ID NO: 1050695 - protein, 9 aa, Homo Sapiens
INNNSKMVK

SEQ ID NO: 1050696 - protein, 9 aa, Homo Sapiens
NRFFRVDTA

SEQ ID NO: 1050697 - protein, 9 aa, Homo Sapiens
QRNVTRMSS

SEQ ID NO: 1050698 - protein, 9 aa, Homo Sapiens
SLCREPGTS

SEQ ID NO: 1050699 - protein, 9 aa, Homo Sapiens
KQSSDSKVK

SEQ ID NO: 1050700 - protein, 9 aa, Homo Sapiens
KRTYSLITP

SEQ ID NO: 1050701 - protein, 9 aa, Homo Sapiens
KEEPLNSED

SEQ ID NO: 1050702 - protein, 9 aa, Homo Sapiens
SGEKSSHSV

SEQ ID NO: 1050703 - protein, 9 aa, Homo Sapiens
NYPFLGILL

SEQ ID NO: 1050704 - protein, 9 aa, Homo Sapiens
ITTAAMLDR

SEQ ID NO: 1050705 - protein, 9 aa, Homo Sapiens
VKGFAGVMV

SEQ ID NO: 1050706 - protein, 9 aa, Homo Sapiens
RPGKNSKNF

SEQ ID NO: 1050707 - protein, 9 aa, Homo Sapiens
GAHGNSYPF

SEQ ID NO: 1050708 - protein, 9 aa, Homo Sapiens
PDSGLAIIR

SEQ ID NO: 1050709 - protein, 9 aa, Homo Sapiens
LAFVIQDQC

SEQ ID NO: 1050710 - protein, 9 aa, Homo Sapiens
DLSTSTLRE

SEQ ID NO: 1050711 - protein, 9 aa, Homo Sapiens
TDNFRDPAK

SEQ ID NO: 1050712 - protein, 9 aa, Homo Sapiens
KIHTPEQGS

SEQ ID NO: 1050713 - protein, 9 aa, Homo Sapiens
TLQKAEKLE

SEQ ID NO: 1050714 - protein, 9 aa, Homo Sapiens
PENFNKAKP

SEQ ID NO: 1050715 - protein, 9 aa, Homo Sapiens
SIFSLKKIQ

SEQ ID NO: 1050716 - protein, 9 aa, Homo Sapiens
LQPLPASQT

SEQ ID NO: 1050717 - protein, 9 aa, Homo Sapiens
KNCQGLGYS

SEQ ID NO: 1050718 - protein, 9 aa, Homo Sapiens
QSMTIMVLL

SEQ ID NO: 1050719 - protein, 9 aa, Homo Sapiens
YLLHMKKVG

SEQ ID NO: 1050720 - protein, 9 aa, Homo Sapiens
GELPVACLK

SEQ ID NO: 1050721 - protein, 9 aa, Homo Sapiens
GLNGKPERC

SEQ ID NO: 1050722 - protein, 9 aa, Homo Sapiens
FRSPAPPKP

SEQ ID NO: 1050723 - protein, 9 aa, Homo Sapiens
ADTGDLLPG

SEQ ID NO: 1050724 - protein, 9 aa, Homo Sapiens
PVALEEHFQ

SEQ ID NO: 1050725 - protein, 9 aa, Homo Sapiens
VMYTVGYSF

SEQ ID NO: 1050726 - protein, 9 aa, Homo Sapiens
TDFSVQPPS

SEQ ID NO: 1050727 - protein, 9 aa, Homo Sapiens
RTGDEIIFP

SEQ ID NO: 1050728 - protein, 9 aa, Homo Sapiens
EPFIRGEGA

SEQ ID NO: 1050729 - protein, 9 aa, Homo Sapiens
SPVHDSYEK

SEQ ID NO: 1050730 - protein, 9 aa, Homo Sapiens
EVQRPPRGS

SEQ ID NO: 1050731 - protein, 9 aa, Homo Sapiens
LGQKSVHCG

SEQ ID NO: 1050732 - protein, 9 aa, Homo Sapiens
NPQTFLCFS

SEQ ID NO: 1050733 - protein, 9 aa, Homo Sapiens
LYAAWIPER

SEQ ID NO: 1050734 - protein, 9 aa, Homo Sapiens
SPRTLLMSV

SEQ ID NO: 1050735 - protein, 9 aa, Homo Sapiens
HFFCDFLSL

SEQ ID NO: 1050736 - protein, 9 aa, Homo Sapiens
RLCAKSPID

SEQ ID NO: 1050737 - protein, 9 aa, Homo Sapiens
LVRITHQDE

SEQ ID NO: 1050738 - protein, 9 aa, Homo Sapiens
ENLIRKHTS

SEQ ID NO: 1050739 - protein, 9 aa, Homo Sapiens
STEFLLGST

SEQ ID NO: 1050740 - protein, 9 aa, Homo Sapiens
DKFGIVAHK

SEQ ID NO: 1050741 - protein, 9 aa, Homo Sapiens
GETEEHFSK

SEQ ID NO: 1050742 - protein, 9 aa, Homo Sapiens
GIPRPSSRS

SEQ ID NO: 1050743 - protein, 9 aa, Homo Sapiens
TGYFTFILY

SEQ ID NO: 1050744 - protein, 9 aa, Homo Sapiens
AAEFWIYKV

SEQ ID NO: 1050745 - protein, 9 aa, Homo Sapiens
CITRPPPSG

SEQ ID NO: 1050746 - protein, 9 aa, Homo Sapiens
VDHSLHEPM

SEQ ID NO: 1050747 - protein, 9 aa, Homo Sapiens
VVQKPGDYE

SEQ ID NO: 1050748 - protein, 9 aa, Homo Sapiens
DLGEMIFLL

SEQ ID NO: 1050749 - protein, 9 aa, Homo Sapiens
PINRRVSFQ

SEQ ID NO: 1050750 - protein, 9 aa, Homo Sapiens
IYPGFLMDK

SEQ ID NO: 1050751 - protein, 9 aa, Homo Sapiens
PPHPHHQQP

SEQ ID NO: 1050752 - protein, 9 aa, Homo Sapiens
PNTATFEAP

SEQ ID NO: 1050753 - protein, 9 aa, Homo Sapiens
IFNIFEGMV

SEQ ID NO: 1050754 - protein, 9 aa, Homo Sapiens
EECSKVFKY

SEQ ID NO: 1050755 - protein, 9 aa, Homo Sapiens
INTVSFYGG

SEQ ID NO: 1050756 - protein, 9 aa, Homo Sapiens
EYLIEFGQW

SEQ ID NO: 1050757 - protein, 9 aa, Homo Sapiens
FSLLACVVQ

SEQ ID NO: 1050758 - protein, 9 aa, Homo Sapiens
QSLNSSRRQ

SEQ ID NO: 1050759 - protein, 9 aa, Homo Sapiens
KEINRKNAF

SEQ ID NO: 1050760 - protein, 9 aa, Homo Sapiens
YTTHGLKLT

SEQ ID NO: 1050761 - protein, 9 aa, Homo Sapiens
DIVMFEEAT

SEQ ID NO: 1050762 - protein, 9 aa, Homo Sapiens
ALEVLRSIA

SEQ ID NO: 1050763 - protein, 9 aa, Homo Sapiens
FSEIQNQEI

SEQ ID NO: 1050764 - protein, 9 aa, Homo Sapiens
EIEKVLTPE

SEQ ID NO: 1050765 - protein, 9 aa, Homo Sapiens
GEDNAWIIT

SEQ ID NO: 1050766 - protein, 9 aa, Homo Sapiens
DENLPSVIC

SEQ ID NO: 1050767 - protein, 9 aa, Homo Sapiens
EGAIHVVEE

SEQ ID NO: 1050768 - protein, 9 aa, Homo Sapiens
TAAEVSKKL

SEQ ID NO: 1050769 - protein, 9 aa, Homo Sapiens
APSTKTKER

SEQ ID NO: 1050770 - protein, 9 aa, Homo Sapiens
QKPLPAPDD

SEQ ID NO: 1050771 - protein, 9 aa, Homo Sapiens
AVYQRIHTG

SEQ ID NO: 1050772 - protein, 9 aa, Homo Sapiens
ILQSVSERL

SEQ ID NO: 1050773 - protein, 9 aa, Homo Sapiens
PRGSILRSL

SEQ ID NO: 1050774 - protein, 9 aa, Homo Sapiens
LRFVDSNGE

SEQ ID NO: 1050775 - protein, 9 aa, Homo Sapiens
ETNFNANDI

SEQ ID NO: 1050776 - protein, 9 aa, Homo Sapiens
LLANLIPPV

SEQ ID NO: 1050777 - protein, 9 aa, Homo Sapiens
RNICDISCN

SEQ ID NO: 1050778 - protein, 9 aa, Homo Sapiens
TPEALLQVC

SEQ ID NO: 1050779 - protein, 9 aa, Homo Sapiens
PLSGAPGPP

SEQ ID NO: 1050780 - protein, 9 aa, Homo Sapiens
PILLSDAAK

SEQ ID NO: 1050781 - protein, 9 aa, Homo Sapiens
VGSLQEKGL

SEQ ID NO: 1050782 - protein, 9 aa, Homo Sapiens
FKFTTQKEY

SEQ ID NO: 1050783 - protein, 9 aa, Homo Sapiens
EAVLLKLHL

SEQ ID NO: 1050784 - protein, 9 aa, Homo Sapiens
LLVFIFIPL

SEQ ID NO: 1050785 - protein, 9 aa, Homo Sapiens
KLNLKEDKN

SEQ ID NO: 1050786 - protein, 9 aa, Homo Sapiens
YSTIEPKPF

SEQ ID NO: 1050787 - protein, 9 aa, Homo Sapiens
SLWNVLGFA

SEQ ID NO: 1050788 - protein, 9 aa, Homo Sapiens
KCLRKRRGQ

SEQ ID NO: 1050789 - protein, 9 aa, Homo Sapiens
YWEVGLFLG

SEQ ID NO: 1050790 - protein, 9 aa, Homo Sapiens
QVSSHTVVA

SEQ ID NO: 1050791 - protein, 9 aa, Homo Sapiens
PVFFDNEMH

SEQ ID NO: 1050792 - protein, 9 aa, Homo Sapiens
EKQKSYTLN

SEQ ID NO: 1050793 - protein, 9 aa, Homo Sapiens
LAANSRFGL

SEQ ID NO: 1050794 - protein, 9 aa, Homo Sapiens
LEIFKEIKS

SEQ ID NO: 1050795 - protein, 9 aa, Homo Sapiens
NKSVQSSCS

SEQ ID NO: 1050796 - protein, 9 aa, Homo Sapiens
PKRNEIKKN

SEQ ID NO: 1050797 - protein, 9 aa, Homo Sapiens
SQEPSLAPP

SEQ ID NO: 1050798 - protein, 9 aa, Homo Sapiens
LVYVDGHLY

SEQ ID NO: 1050799 - protein, 9 aa, Homo Sapiens
KALATYRAS

SEQ ID NO: 1050800 - protein, 9 aa, Homo Sapiens
SLGSALYFF

SEQ ID NO: 1050801 - protein, 9 aa, Homo Sapiens
EAVFFFKKT

SEQ ID NO: 1050802 - protein, 9 aa, Homo Sapiens
HTGDTLFQC

SEQ ID NO: 1050803 - protein, 9 aa, Homo Sapiens
KCPSNKQCL

SEQ ID NO: 1050804 - protein, 9 aa, Homo Sapiens
GYIEDAMTA

SEQ ID NO: 1050805 - protein, 9 aa, Homo Sapiens
PLYLTAEPE

SEQ ID NO: 1050806 - protein, 9 aa, Homo Sapiens
LRNPQPQAL

SEQ ID NO: 1050807 - protein, 9 aa, Homo Sapiens
EPSISLALP

SEQ ID NO: 1050808 - protein, 9 aa, Homo Sapiens
DREILKDCI

SEQ ID NO: 1050809 - protein, 9 aa, Homo Sapiens
QMAVGLFLH

SEQ ID NO: 1050810 - protein, 9 aa, Homo Sapiens
YVVDLLDSI

SEQ ID NO: 1050811 - protein, 9 aa, Homo Sapiens
ILRITSAER

SEQ ID NO: 1050812 - protein, 9 aa, Homo Sapiens
YLKALATYR

SEQ ID NO: 1050813 - protein, 9 aa, Homo Sapiens
GSFRGCGAF

SEQ ID NO: 1050814 - protein, 9 aa, Homo Sapiens
RENCKLLRR

SEQ ID NO: 1050815 - protein, 9 aa, Homo Sapiens
KSSSGKKGA

SEQ ID NO: 1050816 - protein, 9 aa, Homo Sapiens
PEPVLDNSP

SEQ ID NO: 1050817 - protein, 9 aa, Homo Sapiens
KNEASCSPG

SEQ ID NO: 1050818 - protein, 9 aa, Homo Sapiens
ALSRREDKT

SEQ ID NO: 1050819 - protein, 9 aa, Homo Sapiens
KMNSIVDIF

SEQ ID NO: 1050820 - protein, 9 aa, Homo Sapiens
LRFSASNNR

SEQ ID NO: 1050821 - protein, 9 aa, Homo Sapiens
FHRQTVKFL

SEQ ID NO: 1050822 - protein, 9 aa, Homo Sapiens
IDEVHEQTE

SEQ ID NO: 1050823 - protein, 9 aa, Homo Sapiens
GIEKAHHWI

SEQ ID NO: 1050824 - protein, 9 aa, Homo Sapiens
DSNKRVAVI

SEQ ID NO: 1050825 - protein, 9 aa, Homo Sapiens
DCWLATPTQ

SEQ ID NO: 1050826 - protein, 9 aa, Homo Sapiens
SSSFHFLFL

SEQ ID NO: 1050827 - protein, 9 aa, Homo Sapiens
CTEHNECGS

SEQ ID NO: 1050828 - protein, 9 aa, Homo Sapiens
KSLAPNCIV

SEQ ID NO: 1050829 - protein, 9 aa, Homo Sapiens
EDNAWIITF

SEQ ID NO: 1050830 - protein, 9 aa, Homo Sapiens
DFCFLFSSN

SEQ ID NO: 1050831 - protein, 9 aa, Homo Sapiens
TIRAFFVSA

SEQ ID NO: 1050832 - protein, 9 aa, Homo Sapiens
GIHPIRIVD

SEQ ID NO: 1050833 - protein, 9 aa, Homo Sapiens
EFKTEEKLI

SEQ ID NO: 1050834 - protein, 9 aa, Homo Sapiens
LTQQDCSQC

SEQ ID NO: 1050835 - protein, 9 aa, Homo Sapiens
FFLYALVRS

SEQ ID NO: 1050836 - protein, 9 aa, Homo Sapiens
KSISFTGCE

SEQ ID NO: 1050837 - protein, 9 aa, Homo Sapiens
EVHEQTEEM

SEQ ID NO: 1050838 - protein, 9 aa, Homo Sapiens
SKLNGPVIM

SEQ ID NO: 1050839 - protein, 9 aa, Homo Sapiens
ITRPPPSGF

SEQ ID NO: 1050840 - protein, 9 aa, Homo Sapiens
SSLSPVDSQ

SEQ ID NO: 1050841 - protein, 9 aa, Homo Sapiens
MADRVKTQC

SEQ ID NO: 1050842 - protein, 9 aa, Homo Sapiens
ILEPFHKRF

SEQ ID NO: 1050843 - protein, 9 aa, Homo Sapiens
EATEEEKLL

SEQ ID NO: 1050844 - protein, 9 aa, Homo Sapiens
LPCPNFFSH

SEQ ID NO: 1050845 - protein, 9 aa, Homo Sapiens
RAQESPKSD

SEQ ID NO: 1050846 - protein, 9 aa, Homo Sapiens
GIVDLTEII

SEQ ID NO: 1050847 - protein, 9 aa, Homo Sapiens
LFFLDISCS

SEQ ID NO: 1050848 - protein, 9 aa, Homo Sapiens
FLFAISVTT

SEQ ID NO: 1050849 - protein, 9 aa, Homo Sapiens
HLAVYQRIH

SEQ ID NO: 1050850 - protein, 9 aa, Homo Sapiens
FLTSVCVCN

SEQ ID NO: 1050851 - protein, 9 aa, Homo Sapiens
QLLKQEHEE

SEQ ID NO: 1050852 - protein, 9 aa, Homo Sapiens
KKVARHDVR

SEQ ID NO: 1050853 - protein, 9 aa, Homo Sapiens
MFICSKIPI

SEQ ID NO: 1050854 - protein, 9 aa, Homo Sapiens
FDSQKSPIC

SEQ ID NO: 1050855 - protein, 9 aa, Homo Sapiens
EYCLTLYTL

SEQ ID NO: 1050856 - protein, 9 aa, Homo Sapiens
MSTLKYLWL

SEQ ID NO: 1050857 - protein, 9 aa, Homo Sapiens
SISSKAASF

SEQ ID NO: 1050858 - protein, 9 aa, Homo Sapiens
AASTYLNNS

SEQ ID NO: 1050859 - protein, 9 aa, Homo Sapiens
LCLLPDDLE

SEQ ID NO: 1050860 - protein, 9 aa, Homo Sapiens
EFWPVKLND

SEQ ID NO: 1050861 - protein, 9 aa, Homo Sapiens
WEARGGDRE

SEQ ID NO: 1050862 - protein, 9 aa, Homo Sapiens
GVGSLQEKG

SEQ ID NO: 1050863 - protein, 9 aa, Homo Sapiens
NGEILYSFE

SEQ ID NO: 1050864 - protein, 9 aa, Homo Sapiens
RSSVLTTHK

SEQ ID NO: 1050865 - protein, 9 aa, Homo Sapiens
LTAPTSWTL

SEQ ID NO: 1050866 - protein, 9 aa, Homo Sapiens
ISFNWDCEF

SEQ ID NO: 1050867 - protein, 9 aa, Homo Sapiens
NRGLASRIL

SEQ ID NO: 1050868 - protein, 9 aa, Homo Sapiens
LESRYLLAH

SEQ ID NO: 1050869 - protein, 9 aa, Homo Sapiens
GFSQNSNTL

SEQ ID NO: 1050870 - protein, 9 aa, Homo Sapiens
ICKQQTNNQ

SEQ ID NO: 1050871 - protein, 9 aa, Homo Sapiens
LSRVTSVLA

SEQ ID NO: 1050872 - protein, 9 aa, Homo Sapiens
RPGPQQPRG

SEQ ID NO: 1050873 - protein, 9 aa, Homo Sapiens
VYVCASDVT

SEQ ID NO: 1050874 - protein, 9 aa, Homo Sapiens
SLFYTIIIL

SEQ ID NO: 1050875 - protein, 9 aa, Homo Sapiens
DKNLDRMVP

SEQ ID NO: 1050876 - protein, 9 aa, Homo Sapiens
KDGKQLSNS

SEQ ID NO: 1050877 - protein, 9 aa, Homo Sapiens
SGTLLPTDR

SEQ ID NO: 1050878 - protein, 9 aa, Homo Sapiens
QHSGILLDH

SEQ ID NO: 1050879 - protein, 9 aa, Homo Sapiens
KAPRLLLWF

SEQ ID NO: 1050880 - protein, 9 aa, Homo Sapiens
NPSAIMAPF

SEQ ID NO: 1050881 - protein, 9 aa, Homo Sapiens
DPHGKRFLI

SEQ ID NO: 1050882 - protein, 9 aa, Homo Sapiens
TEFYQHQHQ

SEQ ID NO: 1050883 - protein, 9 aa, Homo Sapiens
EGTRKLAPC

SEQ ID NO: 1050884 - protein, 9 aa, Homo Sapiens
FPALHKSLH

SEQ ID NO: 1050885 - protein, 9 aa, Homo Sapiens
YCKAGKGRT

SEQ ID NO: 1050886 - protein, 9 aa, Homo Sapiens
GLNLKVMME

SEQ ID NO: 1050887 - protein, 9 aa, Homo Sapiens
DYKYKQGYQ

SEQ ID NO: 1050888 - protein, 9 aa, Homo Sapiens
SVALLDREA

SEQ ID NO: 1050889 - protein, 9 aa, Homo Sapiens
SPAAPLSVT

SEQ ID NO: 1050890 - protein, 9 aa, Homo Sapiens
LKGVKKEDK

SEQ ID NO: 1050891 - protein, 9 aa, Homo Sapiens
HSQCSCGDC

SEQ ID NO: 1050892 - protein, 9 aa, Homo Sapiens
WKGPQRQDL

SEQ ID NO: 1050893 - protein, 9 aa, Homo Sapiens
AKETPKSSK

SEQ ID NO: 1050894 - protein, 9 aa, Homo Sapiens
CKKAAFSYR

SEQ ID NO: 1050895 - protein, 9 aa, Homo Sapiens
ERMIIKGCE

SEQ ID NO: 1050896 - protein, 9 aa, Homo Sapiens
RQLPSPRTL

SEQ ID NO: 1050897 - protein, 9 aa, Homo Sapiens
YKKRKLAEG

SEQ ID NO: 1050898 - protein, 9 aa, Homo Sapiens
IEKLLEIMT

SEQ ID NO: 1050899 - protein, 9 aa, Homo Sapiens
DTELDEFSD

SEQ ID NO: 1050900 - protein, 9 aa, Homo Sapiens
SGFPGNLGM

SEQ ID NO: 1050901 - protein, 9 aa, Homo Sapiens
ASEEEITTS

SEQ ID NO: 1050902 - protein, 9 aa, Homo Sapiens
MTLVSSSLI

SEQ ID NO: 1050903 - protein, 9 aa, Homo Sapiens
ELVTQRNCN

SEQ ID NO: 1050904 - protein, 9 aa, Homo Sapiens
TEIKEDSDI

SEQ ID NO: 1050905 - protein, 9 aa, Homo Sapiens
SPAQNWTLP

SEQ ID NO: 1050906 - protein, 9 aa, Homo Sapiens
KIITGSFDH

SEQ ID NO: 1050907 - protein, 9 aa, Homo Sapiens
RVFFRRRSC

SEQ ID NO: 1050908 - protein, 9 aa, Homo Sapiens
AQDSFYFED

SEQ ID NO: 1050909 - protein, 9 aa, Homo Sapiens
CQASGDLHY

SEQ ID NO: 1050910 - protein, 9 aa, Homo Sapiens
MLLAECPSC

SEQ ID NO: 1050911 - protein, 9 aa, Homo Sapiens
AFTSGVPDH

SEQ ID NO: 1050912 - protein, 9 aa, Homo Sapiens
LSQTTAKVF

SEQ ID NO: 1050913 - protein, 9 aa, Homo Sapiens
SAVLPSPSK

SEQ ID NO: 1050914 - protein, 9 aa, Homo Sapiens
EWNHIDPRQ

SEQ ID NO: 1050915 - protein, 9 aa, Homo Sapiens
VAYKKEVKH

SEQ ID NO: 1050916 - protein, 9 aa, Homo Sapiens
YIYSLSVFP

SEQ ID NO: 1050917 - protein, 9 aa, Homo Sapiens
GRPGPQQPR

SEQ ID NO: 1050918 - protein, 9 aa, Homo Sapiens
NGEQDKEGA

SEQ ID NO: 1050919 - protein, 9 aa, Homo Sapiens
TIGKAIWLP

SEQ ID NO: 1050920 - protein, 9 aa, Homo Sapiens
NLVSQNINV

SEQ ID NO: 1050921 - protein, 9 aa, Homo Sapiens
QEETTKKEW

SEQ ID NO: 1050922 - protein, 9 aa, Homo Sapiens
TKARIPLYG

SEQ ID NO: 1050923 - protein, 9 aa, Homo Sapiens
RRKKFGRGQ

SEQ ID NO: 1050924 - protein, 9 aa, Homo Sapiens
AFCVDGEWR

SEQ ID NO: 1050925 - protein, 9 aa, Homo Sapiens
TTNEKAILK

SEQ ID NO: 1050926 - protein, 9 aa, Homo Sapiens
ISAIQKARL

SEQ ID NO: 1050927 - protein, 9 aa, Homo Sapiens
GPNDVSSQP

SEQ ID NO: 1050928 - protein, 9 aa, Homo Sapiens
LGIYLSDID

SEQ ID NO: 1050929 - protein, 9 aa, Homo Sapiens
PGELPWGWT

SEQ ID NO: 1050930 - protein, 9 aa, Homo Sapiens
KQFQRTPRG

SEQ ID NO: 1050931 - protein, 9 aa, Homo Sapiens
IAQSSYLDA

SEQ ID NO: 1050932 - protein, 9 aa, Homo Sapiens
IMLRLLLNN

SEQ ID NO: 1050933 - protein, 9 aa, Homo Sapiens
VSIFCSEDS

SEQ ID NO: 1050934 - protein, 9 aa, Homo Sapiens
CPENNIRSC

SEQ ID NO: 1050935 - protein, 9 aa, Homo Sapiens
NKRASQAGM

SEQ ID NO: 1050936 - protein, 9 aa, Homo Sapiens
YSTEPNLSS

SEQ ID NO: 1050937 - protein, 9 aa, Homo Sapiens
EINLKQYPT

SEQ ID NO: 1050938 - protein, 9 aa, Homo Sapiens
DDFSCTEHN

SEQ ID NO: 1050939 - protein, 9 aa, Homo Sapiens
QAQRGEGRP

SEQ ID NO: 1050940 - protein, 9 aa, Homo Sapiens
IVSIEPEEM

SEQ ID NO: 1050941 - protein, 9 aa, Homo Sapiens
AACDFFQDI

SEQ ID NO: 1050942 - protein, 9 aa, Homo Sapiens
MYEVQSKKY

SEQ ID NO: 1050943 - protein, 9 aa, Homo Sapiens
EHGAKLKIV

SEQ ID NO: 1050944 - protein, 9 aa, Homo Sapiens
LQKLSCLGE

SEQ ID NO: 1050945 - protein, 9 aa, Homo Sapiens
EKIKNFMDG

SEQ ID NO: 1050946 - protein, 9 aa, Homo Sapiens
GMPLGATRL

SEQ ID NO: 1050947 - protein, 9 aa, Homo Sapiens
EVPSEEGAA

SEQ ID NO: 1050948 - protein, 9 aa, Homo Sapiens
HCACGWQKN

SEQ ID NO: 1050949 - protein, 9 aa, Homo Sapiens
CADHLLKAH

SEQ ID NO: 1050950 - protein, 9 aa, Homo Sapiens
TRGGGAPFQ

SEQ ID NO: 1050951 - protein, 9 aa, Homo Sapiens
ARLPTTELS

SEQ ID NO: 1050952 - protein, 9 aa, Homo Sapiens
QLLYHSANQ

SEQ ID NO: 1050953 - protein, 9 aa, Homo Sapiens
FRDNRRSKS

SEQ ID NO: 1050954 - protein, 9 aa, Homo Sapiens
PGETGFIPI

SEQ ID NO: 1050955 - protein, 9 aa, Homo Sapiens
QNKKKEKQV

SEQ ID NO: 1050956 - protein, 9 aa, Homo Sapiens
IGIQVTPDK

SEQ ID NO: 1050957 - protein, 9 aa, Homo Sapiens
ALMGSYQRH

SEQ ID NO: 1050958 - protein, 9 aa, Homo Sapiens
KRPVIIYRA

SEQ ID NO: 1050959 - protein, 9 aa, Homo Sapiens
SFLQLIISY

SEQ ID NO: 1050960 - protein, 9 aa, Homo Sapiens
PPPGTRVRV

SEQ ID NO: 1050961 - protein, 9 aa, Homo Sapiens
SFRQSQSNL

SEQ ID NO: 1050962 - protein, 9 aa, Homo Sapiens
TLECQCVEE

SEQ ID NO: 1050963 - protein, 9 aa, Homo Sapiens
GGTAPNLPV

SEQ ID NO: 1050964 - protein, 9 aa, Homo Sapiens
SIKNPLGTQ

SEQ ID NO: 1050965 - protein, 9 aa, Homo Sapiens
NPRQSFEIH

SEQ ID NO: 1050966 - protein, 9 aa, Homo Sapiens
KVHNAKTKP

SEQ ID NO: 1050967 - protein, 9 aa, Homo Sapiens
RKVNTHIHA

SEQ ID NO: 1050968 - protein, 9 aa, Homo Sapiens
VLSVMYRFC

SEQ ID NO: 1050969 - protein, 9 aa, Homo Sapiens
FLRCLEKWL

SEQ ID NO: 1050970 - protein, 9 aa, Homo Sapiens
IHSGGNSDS

SEQ ID NO: 1050971 - protein, 9 aa, Homo Sapiens
PPSERRNKS

SEQ ID NO: 1050972 - protein, 9 aa, Homo Sapiens
ASAEGVQKD

SEQ ID NO: 1050973 - protein, 9 aa, Homo Sapiens
CFGEGLPKA

SEQ ID NO: 1050974 - protein, 9 aa, Homo Sapiens
VVVTAKKIV

SEQ ID NO: 1050975 - protein, 9 aa, Homo Sapiens
FWRQAKVQE

SEQ ID NO: 1050976 - protein, 9 aa, Homo Sapiens
EDKGLDSAE

SEQ ID NO: 1050977 - protein, 9 aa, Homo Sapiens
TKIFKTSYL

SEQ ID NO: 1050978 - protein, 9 aa, Homo Sapiens
VFTSKLFCS

SEQ ID NO: 1050979 - protein, 9 aa, Homo Sapiens
VSSSSDGSI

SEQ ID NO: 1050980 - protein, 9 aa, Homo Sapiens
LVYCTNLPP

SEQ ID NO: 1050981 - protein, 9 aa, Homo Sapiens
HMLIYSGIK

SEQ ID NO: 1050982 - protein, 9 aa, Homo Sapiens
DGAEDGQVK

SEQ ID NO: 1050983 - protein, 9 aa, Homo Sapiens
GNSCFTTTP

SEQ ID NO: 1050984 - protein, 9 aa, Homo Sapiens
PLSNGGRAC

SEQ ID NO: 1050985 - protein, 9 aa, Homo Sapiens
VYNSYSYYP

SEQ ID NO: 1050986 - protein, 9 aa, Homo Sapiens
VDGEVPKLP

SEQ ID NO: 1050987 - protein, 9 aa, Homo Sapiens
EKIKTYFLL

SEQ ID NO: 1050988 - protein, 9 aa, Homo Sapiens
ETPMVAASP

SEQ ID NO: 1050989 - protein, 9 aa, Homo Sapiens
LLTEETDFF

SEQ ID NO: 1050990 - protein, 9 aa, Homo Sapiens
SCTEHNECG

SEQ ID NO: 1050991 - protein, 9 aa, Homo Sapiens
EKKLKSFLK

SEQ ID NO: 1050992 - protein, 9 aa, Homo Sapiens
VPENFNKAK

SEQ ID NO: 1050993 - protein, 9 aa, Homo Sapiens
GDYNFICSA

SEQ ID NO: 1050994 - protein, 9 aa, Homo Sapiens
ALATYRASL

SEQ ID NO: 1050995 - protein, 9 aa, Homo Sapiens
VSIEPEEMR

SEQ ID NO: 1050996 - protein, 9 aa, Homo Sapiens
AHKGRGGKC

SEQ ID NO: 1050997 - protein, 9 aa, Homo Sapiens
LPISGMKKE

SEQ ID NO: 1050998 - protein, 9 aa, Homo Sapiens
DLLDSMNRR

SEQ ID NO: 1050999 - protein, 9 aa, Homo Sapiens
PSYVVDLLD

SEQ ID NO: 1051000 - protein, 9 aa, Homo Sapiens
THTLLSYVY

SEQ ID NO: 1051001 - protein, 9 aa, Homo Sapiens
TERNLTMDT

SEQ ID NO: 1051002 - protein, 9 aa, Homo Sapiens
TIELVTQRN

SEQ ID NO: 1051003 - protein, 9 aa, Homo Sapiens
EASTQESQF

SEQ ID NO: 1051004 - protein, 9 aa, Homo Sapiens
RKAFETCSS

SEQ ID NO: 1051005 - protein, 9 aa, Homo Sapiens
PPELDIFPG

SEQ ID NO: 1051006 - protein, 9 aa, Homo Sapiens
PRSQSMTIM

SEQ ID NO: 1051007 - protein, 9 aa, Homo Sapiens
LLKQEHEER

SEQ ID NO: 1051008 - protein, 9 aa, Homo Sapiens
TLTKHRRIY

SEQ ID NO: 1051009 - protein, 9 aa, Homo Sapiens
FYDFQFCGN

SEQ ID NO: 1051010 - protein, 9 aa, Homo Sapiens
YLPSAMPPV

SEQ ID NO: 1051011 - protein, 9 aa, Homo Sapiens
KETIYYLMK

SEQ ID NO: 1051012 - protein, 9 aa, Homo Sapiens
PHTIPTYTD

SEQ ID NO: 1051013 - protein, 9 aa, Homo Sapiens
VPSSAGEAG

SEQ ID NO: 1051014 - protein, 9 aa, Homo Sapiens
IHTKERPYG

SEQ ID NO: 1051015 - protein, 9 aa, Homo Sapiens
MFFGLAMGT

SEQ ID NO: 1051016 - protein, 9 aa, Homo Sapiens
ERNLTMDTY

SEQ ID NO: 1051017 - protein, 9 aa, Homo Sapiens
DSAQSSKLF

SEQ ID NO: 1051018 - protein, 9 aa, Homo Sapiens
IKKTAAILL

SEQ ID NO: 1051019 - protein, 9 aa, Homo Sapiens
EICKVLDAN

SEQ ID NO: 1051020 - protein, 9 aa, Homo Sapiens
GDLRDVARL

SEQ ID NO: 1051021 - protein, 9 aa, Homo Sapiens
TLMYFSIRH

SEQ ID NO: 1051022 - protein, 9 aa, Homo Sapiens
LVSIPAFYN

SEQ ID NO: 1051023 - protein, 9 aa, Homo Sapiens
MIKEHLPLP

SEQ ID NO: 1051024 - protein, 9 aa, Homo Sapiens
MREIEKVLT

SEQ ID NO: 1051025 - protein, 9 aa, Homo Sapiens
TGILPITEY

SEQ ID NO: 1051026 - protein, 9 aa, Homo Sapiens
MHYSFAFLI

SEQ ID NO: 1051027 - protein, 9 aa, Homo Sapiens
REDKTRTQR

SEQ ID NO: 1051028 - protein, 9 aa, Homo Sapiens
RQQSLALLP

SEQ ID NO: 1051029 - protein, 9 aa, Homo Sapiens
ASLRKASAV

SEQ ID NO: 1051030 - protein, 9 aa, Homo Sapiens
TVLFKLDGG

SEQ ID NO: 1051031 - protein, 9 aa, Homo Sapiens
DVFRDLASL

SEQ ID NO: 1051032 - protein, 9 aa, Homo Sapiens
SKEPEQLRK

SEQ ID NO: 1051033 - protein, 9 aa, Homo Sapiens
EPSLAPPHR

SEQ ID NO: 1051034 - protein, 9 aa, Homo Sapiens
GNGMIKVKN

SEQ ID NO: 1051035 - protein, 9 aa, Homo Sapiens
QTGPILENM

SEQ ID NO: 1051036 - protein, 9 aa, Homo Sapiens
NVKTNVQLL

SEQ ID NO: 1051037 - protein, 9 aa, Homo Sapiens
AGPGETEEH

SEQ ID NO: 1051038 - protein, 9 aa, Homo Sapiens
LSFINEVCM

SEQ ID NO: 1051039 - protein, 9 aa, Homo Sapiens
GFMMTCEDI

SEQ ID NO: 1051040 - protein, 9 aa, Homo Sapiens
IAVGRMQKE

SEQ ID NO: 1051041 - protein, 9 aa, Homo Sapiens
PLLANNSQL

SEQ ID NO: 1051042 - protein, 9 aa, Homo Sapiens
GFARGAHGN

SEQ ID NO: 1051043 - protein, 9 aa, Homo Sapiens
FAIQSIKTN

SEQ ID NO: 1051044 - protein, 9 aa, Homo Sapiens
SNLFFLDIS

SEQ ID NO: 1051045 - protein, 9 aa, Homo Sapiens
QVSRVDPKM

SEQ ID NO: 1051046 - protein, 9 aa, Homo Sapiens
ACLLVLSLD

SEQ ID NO: 1051047 - protein, 9 aa, Homo Sapiens
QELFESSTN

SEQ ID NO: 1051048 - protein, 9 aa, Homo Sapiens
VPDKDTSCS

SEQ ID NO: 1051049 - protein, 9 aa, Homo Sapiens
IPSLGLDPY

SEQ ID NO: 1051050 - protein, 9 aa, Homo Sapiens
KPPGAKDAN

SEQ ID NO: 1051051 - protein, 9 aa, Homo Sapiens
LEWTLPRSQ

SEQ ID NO: 1051052 - protein, 9 aa, Homo Sapiens
LPMGLNGKP

SEQ ID NO: 1051053 - protein, 9 aa, Homo Sapiens
WVIQIPILI

SEQ ID NO: 1051054 - protein, 9 aa, Homo Sapiens
NPLLVFIFI

SEQ ID NO: 1051055 - protein, 9 aa, Homo Sapiens
SSAFYFTEW

SEQ ID NO: 1051056 - protein, 9 aa, Homo Sapiens
ENSCEGMSR

SEQ ID NO: 1051057 - protein, 9 aa, Homo Sapiens
REKPNECKE

SEQ ID NO: 1051058 - protein, 9 aa, Homo Sapiens
GRPFCPYLK

SEQ ID NO: 1051059 - protein, 9 aa, Homo Sapiens
SPDTSVLVF

SEQ ID NO: 1051060 - protein, 9 aa, Homo Sapiens
LSIQQPRLF

SEQ ID NO: 1051061 - protein, 9 aa, Homo Sapiens
RLQSARRLE

SEQ ID NO: 1051062 - protein, 9 aa, Homo Sapiens
LHLEEDPNP

SEQ ID NO: 1051063 - protein, 9 aa, Homo Sapiens
GKFLRKKKE

SEQ ID NO: 1051064 - protein, 9 aa, Homo Sapiens
KEDYNQPLF

SEQ ID NO: 1051065 - protein, 9 aa, Homo Sapiens
RRIEERLYY

SEQ ID NO: 1051066 - protein, 9 aa, Homo Sapiens
EKVLSVRVQ

SEQ ID NO: 1051067 - protein, 9 aa, Homo Sapiens
DEDGCGFCY

SEQ ID NO: 1051068 - protein, 9 aa, Homo Sapiens
SAVLTDDVP

SEQ ID NO: 1051069 - protein, 9 aa, Homo Sapiens
NLKWNSDDY

SEQ ID NO: 1051070 - protein, 9 aa, Homo Sapiens
LVHMQRGIL

SEQ ID NO: 1051071 - protein, 9 aa, Homo Sapiens
HYSSQWIES

SEQ ID NO: 1051072 - protein, 9 aa, Homo Sapiens
SLNGKAIKV

SEQ ID NO: 1051073 - protein, 9 aa, Homo Sapiens
PSQGMKSTY

SEQ ID NO: 1051074 - protein, 9 aa, Homo Sapiens
CTLCEAICP

SEQ ID NO: 1051075 - protein, 9 aa, Homo Sapiens
TDGYAAVCN

SEQ ID NO: 1051076 - protein, 9 aa, Homo Sapiens
KALNPFQTS

SEQ ID NO: 1051077 - protein, 9 aa, Homo Sapiens
LSEATVTLW

SEQ ID NO: 1051078 - protein, 9 aa, Homo Sapiens
QQETREVPS

SEQ ID NO: 1051079 - protein, 9 aa, Homo Sapiens
CGWGGAMLG

SEQ ID NO: 1051080 - protein, 9 aa, Homo Sapiens
SNATDDSAL

SEQ ID NO: 1051081 - protein, 9 aa, Homo Sapiens
VVPYRLGSP

SEQ ID NO: 1051082 - protein, 9 aa, Homo Sapiens
VKEEPLNSE

SEQ ID NO: 1051083 - protein, 9 aa, Homo Sapiens
RLVDPVTHP

SEQ ID NO: 1051084 - protein, 9 aa, Homo Sapiens
TDFFVNKLD

SEQ ID NO: 1051085 - protein, 9 aa, Homo Sapiens
GGKPFSCSL

SEQ ID NO: 1051086 - protein, 9 aa, Homo Sapiens
EVRGGHGCT

SEQ ID NO: 1051087 - protein, 9 aa, Homo Sapiens
YCDNVSLLA

SEQ ID NO: 1051088 - protein, 9 aa, Homo Sapiens
QVELVAKEE

SEQ ID NO: 1051089 - protein, 9 aa, Homo Sapiens
SFYCVCQQG

SEQ ID NO: 1051090 - protein, 9 aa, Homo Sapiens
SNTNSEKIF

SEQ ID NO: 1051091 - protein, 9 aa, Homo Sapiens
VFFGIVVTK

SEQ ID NO: 1051092 - protein, 9 aa, Homo Sapiens
ASPIWYFTM

SEQ ID NO: 1051093 - protein, 9 aa, Homo Sapiens
SPLPVRGEH

SEQ ID NO: 1051094 - protein, 9 aa, Homo Sapiens
GKNMELSFK

SEQ ID NO: 1051095 - protein, 9 aa, Homo Sapiens
VFEANLKTK

SEQ ID NO: 1051096 - protein, 9 aa, Homo Sapiens
LSGQKEGVF

SEQ ID NO: 1051097 - protein, 9 aa, Homo Sapiens
GSTKTSFRE

SEQ ID NO: 1051098 - protein, 9 aa, Homo Sapiens
EGFRCLCHA

SEQ ID NO: 1051099 - protein, 9 aa, Homo Sapiens
DVTFYDVLS

SEQ ID NO: 1051100 - protein, 9 aa, Homo Sapiens
EITSELGDS

SEQ ID NO: 1051101 - protein, 9 aa, Homo Sapiens
VFFFKKTVL

SEQ ID NO: 1051102 - protein, 9 aa, Homo Sapiens
TFKLQPMNF

SEQ ID NO: 1051103 - protein, 9 aa, Homo Sapiens
REDSCNAGL

SEQ ID NO: 1051104 - protein, 9 aa, Homo Sapiens
MKKEAILSH

SEQ ID NO: 1051105 - protein, 9 aa, Homo Sapiens
TDILWLAQL

SEQ ID NO: 1051106 - protein, 9 aa, Homo Sapiens
ERSNSVEKT

SEQ ID NO: 1051107 - protein, 9 aa, Homo Sapiens
VDITDRFRF

SEQ ID NO: 1051108 - protein, 9 aa, Homo Sapiens
FFVSAFPQQ

SEQ ID NO: 1051109 - protein, 9 aa, Homo Sapiens
PKPLQLDFF

SEQ ID NO: 1051110 - protein, 9 aa, Homo Sapiens
KPLDLEKLS

SEQ ID NO: 1051111 - protein, 9 aa, Homo Sapiens
VFFDNEMHL

SEQ ID NO: 1051112 - protein, 9 aa, Homo Sapiens
VGLFLHILE

SEQ ID NO: 1051113 - protein, 9 aa, Homo Sapiens
YKKEVKHLS

SEQ ID NO: 1051114 - protein, 9 aa, Homo Sapiens
PRLMKLRED

SEQ ID NO: 1051115 - protein, 9 aa, Homo Sapiens
KNFDNYFEG

SEQ ID NO: 1051116 - protein, 9 aa, Homo Sapiens
AIFFVGPVS

SEQ ID NO: 1051117 - protein, 9 aa, Homo Sapiens
VSLSELYLQ

SEQ ID NO: 1051118 - protein, 9 aa, Homo Sapiens
SPDYKDHQN

SEQ ID NO: 1051119 - protein, 9 aa, Homo Sapiens
FVIQDQCIL

SEQ ID NO: 1051120 - protein, 9 aa, Homo Sapiens
NISLFQQCY

SEQ ID NO: 1051121 - protein, 9 aa, Homo Sapiens
IEFGQWLHH

SEQ ID NO: 1051122 - protein, 9 aa, Homo Sapiens
SLRKASAVP

SEQ ID NO: 1051123 - protein, 9 aa, Homo Sapiens
FPSLFCKKM

SEQ ID NO: 1051124 - protein, 9 aa, Homo Sapiens
KLPEEDGRS

SEQ ID NO: 1051125 - protein, 9 aa, Homo Sapiens
HHQAVIFNI

SEQ ID NO: 1051126 - protein, 9 aa, Homo Sapiens
KITESTATL

SEQ ID NO: 1051127 - protein, 9 aa, Homo Sapiens
LPLPSELPG

SEQ ID NO: 1051128 - protein, 9 aa, Homo Sapiens
RELERKYAA

SEQ ID NO: 1051129 - protein, 9 aa, Homo Sapiens
EQTDKYFFD

SEQ ID NO: 1051130 - protein, 9 aa, Homo Sapiens
SCTVNLGGA

SEQ ID NO: 1051131 - protein, 9 aa, Homo Sapiens
IVLIFLTKL

SEQ ID NO: 1051132 - protein, 9 aa, Homo Sapiens
MKCLRKRRG

SEQ ID NO: 1051133 - protein, 9 aa, Homo Sapiens
KQPSKGAFS

SEQ ID NO: 1051134 - protein, 9 aa, Homo Sapiens
PSIAVSPST

SEQ ID NO: 1051135 - protein, 9 aa, Homo Sapiens
FCVDGEWRR

SEQ ID NO: 1051136 - protein, 9 aa, Homo Sapiens
QYKMVIEAC

SEQ ID NO: 1051137 - protein, 9 aa, Homo Sapiens
ASNRSSHLT

SEQ ID NO: 1051138 - protein, 9 aa, Homo Sapiens
SFPAPQDTL

SEQ ID NO: 1051139 - protein, 9 aa, Homo Sapiens
FGNFPKPDM

SEQ ID NO: 1051140 - protein, 9 aa, Homo Sapiens
TKNCWTCIG

SEQ ID NO: 1051141 - protein, 9 aa, Homo Sapiens
WHLDHLDLA

SEQ ID NO: 1051142 - protein, 9 aa, Homo Sapiens
FVTTNHSST

SEQ ID NO: 1051143 - protein, 9 aa, Homo Sapiens
ESMYGNFEE

SEQ ID NO: 1051144 - protein, 9 aa, Homo Sapiens
IDDKIRKMQ

SEQ ID NO: 1051145 - protein, 9 aa, Homo Sapiens
AMDTFEGRR

SEQ ID NO: 1051146 - protein, 9 aa, Homo Sapiens
GKISFEKFS

SEQ ID NO: 1051147 - protein, 9 aa, Homo Sapiens
GPGAPIKQA

SEQ ID NO: 1051148 - protein, 9 aa, Homo Sapiens
FFLHLFTET

SEQ ID NO: 1051149 - protein, 9 aa, Homo Sapiens
AADIIFVLA

SEQ ID NO: 1051150 - protein, 9 aa, Homo Sapiens
LVTYDKEGG

SEQ ID NO: 1051151 - protein, 9 aa, Homo Sapiens
QPLSENLPN

SEQ ID NO: 1051152 - protein, 9 aa, Homo Sapiens
ADGKIRIYI

SEQ ID NO: 1051153 - protein, 9 aa, Homo Sapiens
RKLFLGAPA

SEQ ID NO: 1051154 - protein, 9 aa, Homo Sapiens
RPENVFISY

SEQ ID NO: 1051155 - protein, 9 aa, Homo Sapiens
RYNWTYVLA

SEQ ID NO: 1051156 - protein, 9 aa, Homo Sapiens
LAAFPNCSA

SEQ ID NO: 1051157 - protein, 9 aa, Homo Sapiens
NSRFGLLPK

SEQ ID NO: 1051158 - protein, 9 aa, Homo Sapiens
SQYISMHGK

SEQ ID NO: 1051159 - protein, 9 aa, Homo Sapiens
GTQSGCGLL

SEQ ID NO: 1051160 - protein, 9 aa, Homo Sapiens
EYESESGSN

SEQ ID NO: 1051161 - protein, 9 aa, Homo Sapiens
IKGEDGDGE

SEQ ID NO: 1051162 - protein, 9 aa, Homo Sapiens
VSLPGLLIA

SEQ ID NO: 1051163 - protein, 9 aa, Homo Sapiens
PLPAPDDWS

SEQ ID NO: 1051164 - protein, 9 aa, Homo Sapiens
RRGFYHHQK

SEQ ID NO: 1051165 - protein, 9 aa, Homo Sapiens
NSQLQNLPL

SEQ ID NO: 1051166 - protein, 9 aa, Homo Sapiens
SVYFPLGLC

SEQ ID NO: 1051167 - protein, 9 aa, Homo Sapiens
PRSSRDFIQ

SEQ ID NO: 1051168 - protein, 9 aa, Homo Sapiens
HLQGKVKGS

SEQ ID NO: 1051169 - protein, 9 aa, Homo Sapiens
TVSTILGNG

SEQ ID NO: 1051170 - protein, 9 aa, Homo Sapiens
STSLEPVKR

SEQ ID NO: 1051171 - protein, 9 aa, Homo Sapiens
TPRKEGTLP

SEQ ID NO: 1051172 - protein, 9 aa, Homo Sapiens
KRYNWTYVL

SEQ ID NO: 1051173 - protein, 9 aa, Homo Sapiens
VFLMRANTQ

SEQ ID NO: 1051174 - protein, 9 aa, Homo Sapiens
LEHLLCPSS

SEQ ID NO: 1051175 - protein, 9 aa, Homo Sapiens
TSFEELGPA

SEQ ID NO: 1051176 - protein, 9 aa, Homo Sapiens
AVLLIGLPN

SEQ ID NO: 1051177 - protein, 9 aa, Homo Sapiens
CALKAPPSL

SEQ ID NO: 1051178 - protein, 9 aa, Homo Sapiens
REGQRFSLF

SEQ ID NO: 1051179 - protein, 9 aa, Homo Sapiens
CSNRPPRQP

SEQ ID NO: 1051180 - protein, 9 aa, Homo Sapiens
QTRSQMLLG

SEQ ID NO: 1051181 - protein, 9 aa, Homo Sapiens
LLVQFKEGG

SEQ ID NO: 1051182 - protein, 9 aa, Homo Sapiens
QRKERLYLL

SEQ ID NO: 1051183 - protein, 9 aa, Homo Sapiens
LFFLHPILF

SEQ ID NO: 1051184 - protein, 9 aa, Homo Sapiens
NPYLDLIDE

SEQ ID NO: 1051185 - protein, 9 aa, Homo Sapiens
GDRLTLVDC

SEQ ID NO: 1051186 - protein, 9 aa, Homo Sapiens
HKSDNECKK

SEQ ID NO: 1051187 - protein, 9 aa, Homo Sapiens
SSRTDSNKR

SEQ ID NO: 1051188 - protein, 9 aa, Homo Sapiens
SSRKLFLGA

SEQ ID NO: 1051189 - protein, 9 aa, Homo Sapiens
SDVATMLNI

SEQ ID NO: 1051190 - protein, 9 aa, Homo Sapiens
AQLYWKEGK

SEQ ID NO: 1051191 - protein, 9 aa, Homo Sapiens
KSSAMKKNK

SEQ ID NO: 1051192 - protein, 9 aa, Homo Sapiens
MRNDEITQD

SEQ ID NO: 1051193 - protein, 9 aa, Homo Sapiens
RRKAGVQEL

SEQ ID NO: 1051194 - protein, 9 aa, Homo Sapiens
QVLSISLEP

SEQ ID NO: 1051195 - protein, 9 aa, Homo Sapiens
FNNNIAPVE

SEQ ID NO: 1051196 - protein, 9 aa, Homo Sapiens
LGAVASLPN

SEQ ID NO: 1051197 - protein, 9 aa, Homo Sapiens
AVVDASFVS

SEQ ID NO: 1051198 - protein, 9 aa, Homo Sapiens
QKYSPVTPS

SEQ ID NO: 1051199 - protein, 9 aa, Homo Sapiens
AHEKIYSGE

SEQ ID NO: 1051200 - protein, 9 aa, Homo Sapiens
LPGRLCAAA

SEQ ID NO: 1051201 - protein, 9 aa, Homo Sapiens
VPPSKKPEV

SEQ ID NO: 1051202 - protein, 9 aa, Homo Sapiens
ILFFMLVFP

SEQ ID NO: 1051203 - protein, 9 aa, Homo Sapiens
ATEAARRLV

SEQ ID NO: 1051204 - protein, 9 aa, Homo Sapiens
PNKVKYVHN

SEQ ID NO: 1051205 - protein, 9 aa, Homo Sapiens
KEHLPLPAK

SEQ ID NO: 1051206 - protein, 9 aa, Homo Sapiens
CLKRETGES

SEQ ID NO: 1051207 - protein, 9 aa, Homo Sapiens
SDGMYQCGP

SEQ ID NO: 1051208 - protein, 9 aa, Homo Sapiens
MEGDRNVSP

SEQ ID NO: 1051209 - protein, 9 aa, Homo Sapiens
TIFSFSPRL

SEQ ID NO: 1051210 - protein, 9 aa, Homo Sapiens
NEYLKALVF

SEQ ID NO: 1051211 - protein, 9 aa, Homo Sapiens
GEAGCYKIC

SEQ ID NO: 1051212 - protein, 9 aa, Homo Sapiens
EKKSAIPYG

SEQ ID NO: 1051213 - protein, 9 aa, Homo Sapiens
RGFWQTCGE

SEQ ID NO: 1051214 - protein, 9 aa, Homo Sapiens
QLLENFPVG

SEQ ID NO: 1051215 - protein, 9 aa, Homo Sapiens
KQANRSKHE

SEQ ID NO: 1051216 - protein, 9 aa, Homo Sapiens
SETMHGPLF

SEQ ID NO: 1051217 - protein, 9 aa, Homo Sapiens
RAERIAELL

SEQ ID NO: 1051218 - protein, 9 aa, Homo Sapiens
ARSPDYKDH

SEQ ID NO: 1051219 - protein, 9 aa, Homo Sapiens
TLKTPEKSF

SEQ ID NO: 1051220 - protein, 9 aa, Homo Sapiens
VSDNIQIET

SEQ ID NO: 1051221 - protein, 9 aa, Homo Sapiens
YWKEGKDNH

SEQ ID NO: 1051222 - protein, 9 aa, Homo Sapiens
KLQRRLSAS

SEQ ID NO: 1051223 - protein, 9 aa, Homo Sapiens
LMLNHVKNI

SEQ ID NO: 1051224 - protein, 9 aa, Homo Sapiens
SDDESGNLF

SEQ ID NO: 1051225 - protein, 9 aa, Homo Sapiens
DSGYNAWLL

SEQ ID NO: 1051226 - protein, 9 aa, Homo Sapiens
KNLLSHMLH

SEQ ID NO: 1051227 - protein, 9 aa, Homo Sapiens
SLRDEPRSD

SEQ ID NO: 1051228 - protein, 9 aa, Homo Sapiens
MKLKKEEFV

SEQ ID NO: 1051229 - protein, 9 aa, Homo Sapiens
KKDGPVNPP

SEQ ID NO: 1051230 - protein, 9 aa, Homo Sapiens
QYWDILDGT

SEQ ID NO: 1051231 - protein, 9 aa, Homo Sapiens
ISAMENQLR

SEQ ID NO: 1051232 - protein, 9 aa, Homo Sapiens
SEKKSAIPY

SEQ ID NO: 1051233 - protein, 9 aa, Homo Sapiens
FSGYVDNPN

SEQ ID NO: 1051234 - protein, 9 aa, Homo Sapiens
FHLPSEVLY

SEQ ID NO: 1051235 - protein, 9 aa, Homo Sapiens
QSSCSSLSS

SEQ ID NO: 1051236 - protein, 9 aa, Homo Sapiens
SPRRSSSNE

SEQ ID NO: 1051237 - protein, 9 aa, Homo Sapiens
AFRAENEKI

SEQ ID NO: 1051238 - protein, 9 aa, Homo Sapiens
IVFLELFKN

SEQ ID NO: 1051239 - protein, 9 aa, Homo Sapiens
GSNSHVFAS

SEQ ID NO: 1051240 - protein, 9 aa, Homo Sapiens
PSPVPSSFS

SEQ ID NO: 1051241 - protein, 9 aa, Homo Sapiens
IDFLCSDIF

SEQ ID NO: 1051242 - protein, 9 aa, Homo Sapiens
HKNLSPGKP

SEQ ID NO: 1051243 - protein, 9 aa, Homo Sapiens
DNEMHLKIL

SEQ ID NO: 1051244 - protein, 9 aa, Homo Sapiens
YALCTLSQG

SEQ ID NO: 1051245 - protein, 9 aa, Homo Sapiens
IRQQALAQM

SEQ ID NO: 1051246 - protein, 9 aa, Homo Sapiens
SSKACKIAK

SEQ ID NO: 1051247 - protein, 9 aa, Homo Sapiens
ARAASAPTG

SEQ ID NO: 1051248 - protein, 9 aa, Homo Sapiens
DTTAQLYWK

SEQ ID NO: 1051249 - protein, 9 aa, Homo Sapiens
ACYSSTLGG

SEQ ID NO: 1051250 - protein, 9 aa, Homo Sapiens
YSFSLVMLL

SEQ ID NO: 1051251 - protein, 9 aa, Homo Sapiens
MLTSQASCV

SEQ ID NO: 1051252 - protein, 9 aa, Homo Sapiens
VELHRHFLG

SEQ ID NO: 1051253 - protein, 9 aa, Homo Sapiens
FSALLSTGE

SEQ ID NO: 1051254 - protein, 9 aa, Homo Sapiens
LNASDWDEG

SEQ ID NO: 1051255 - protein, 9 aa, Homo Sapiens
PPSEDTELL

SEQ ID NO: 1051256 - protein, 9 aa, Homo Sapiens
ETVYVFQIR

SEQ ID NO: 1051257 - protein, 9 aa, Homo Sapiens
SLTTSRGRS

SEQ ID NO: 1051258 - protein, 9 aa, Homo Sapiens
LAIIRSSRS

SEQ ID NO: 1051259 - protein, 9 aa, Homo Sapiens
LTGMVPESE

SEQ ID NO: 1051260 - protein, 9 aa, Homo Sapiens
GLCLVLQPH

SEQ ID NO: 1051261 - protein, 9 aa, Homo Sapiens
GSLSLCREP

SEQ ID NO: 1051262 - protein, 9 aa, Homo Sapiens
LENFPVGTL

SEQ ID NO: 1051263 - protein, 9 aa, Homo Sapiens
SLTLVRSFW

SEQ ID NO: 1051264 - protein, 9 aa, Homo Sapiens
CGKFFSQKG

SEQ ID NO: 1051265 - protein, 9 aa, Homo Sapiens
RLLNPHSKP

SEQ ID NO: 1051266 - protein, 9 aa, Homo Sapiens
RGQNVEMLM

SEQ ID NO: 1051267 - protein, 9 aa, Homo Sapiens
APLSTPAAP

SEQ ID NO: 1051268 - protein, 9 aa, Homo Sapiens
GPEDRKMHM

SEQ ID NO: 1051269 - protein, 9 aa, Homo Sapiens
SSFHFLFLS

SEQ ID NO: 1051270 - protein, 9 aa, Homo Sapiens
SSVTNTLIM

SEQ ID NO: 1051271 - protein, 9 aa, Homo Sapiens
IVLSNEYQV

SEQ ID NO: 1051272 - protein, 9 aa, Homo Sapiens
KQIDTIFLL

SEQ ID NO: 1051273 - protein, 9 aa, Homo Sapiens
KSSFLESLQ

SEQ ID NO: 1051274 - protein, 9 aa, Homo Sapiens
LQGLLGAPG

SEQ ID NO: 1051275 - protein, 9 aa, Homo Sapiens
KLLRMNSTT

SEQ ID NO: 1051276 - protein, 9 aa, Homo Sapiens
CLIQFISKL

SEQ ID NO: 1051277 - protein, 9 aa, Homo Sapiens
MKKEFQKTK

SEQ ID NO: 1051278 - protein, 9 aa, Homo Sapiens
QMNLGAILK

SEQ ID NO: 1051279 - protein, 9 aa, Homo Sapiens
QKKHLEHPE

SEQ ID NO: 1051280 - protein, 9 aa, Homo Sapiens
DISGIFVAS

SEQ ID NO: 1051281 - protein, 9 aa, Homo Sapiens
QICVPRQGK

SEQ ID NO: 1051282 - protein, 9 aa, Homo Sapiens
MKWNCAFME

SEQ ID NO: 1051283 - protein, 9 aa, Homo Sapiens
PSSTLPRNS

SEQ ID NO: 1051284 - protein, 9 aa, Homo Sapiens
VLSIVVLPQ

SEQ ID NO: 1051285 - protein, 9 aa, Homo Sapiens
APQTLPFAR

SEQ ID NO: 1051286 - protein, 9 aa, Homo Sapiens
KPKVCWSWD

SEQ ID NO: 1051287 - protein, 9 aa, Homo Sapiens
EAWGTLGKE

SEQ ID NO: 1051288 - protein, 9 aa, Homo Sapiens
LSESLSYSR

SEQ ID NO: 1051289 - protein, 9 aa, Homo Sapiens
VGRMQKEID

SEQ ID NO: 1051290 - protein, 9 aa, Homo Sapiens
GNSGGAVSS

SEQ ID NO: 1051291 - protein, 9 aa, Homo Sapiens
AATLGFFFS

SEQ ID NO: 1051292 - protein, 9 aa, Homo Sapiens
DQETMAPSI

SEQ ID NO: 1051293 - protein, 9 aa, Homo Sapiens
LPWTSVFSP

SEQ ID NO: 1051294 - protein, 9 aa, Homo Sapiens
RPTNLRRQS

SEQ ID NO: 1051295 - protein, 9 aa, Homo Sapiens
DIANKLYAL

SEQ ID NO: 1051296 - protein, 9 aa, Homo Sapiens
ETGGVQLCG

SEQ ID NO: 1051297 - protein, 9 aa, Homo Sapiens
RCYFYDGDG

SEQ ID NO: 1051298 - protein, 9 aa, Homo Sapiens
DSRKNCWKF

SEQ ID NO: 1051299 - protein, 9 aa, Homo Sapiens
ASFTTKIKG

SEQ ID NO: 1051300 - protein, 9 aa, Homo Sapiens
TFCMTAYSN

SEQ ID NO: 1051301 - protein, 9 aa, Homo Sapiens
QEKTCRAYL

SEQ ID NO: 1051302 - protein, 9 aa, Homo Sapiens
LPFEFLPSF

SEQ ID NO: 1051303 - protein, 9 aa, Homo Sapiens
IQDQCILQL

SEQ ID NO: 1051304 - protein, 9 aa, Homo Sapiens
PCYCKLYEH

SEQ ID NO: 1051305 - protein, 9 aa, Homo Sapiens
RQVWGFNFG

SEQ ID NO: 1051306 - protein, 9 aa, Homo Sapiens
ELPDYNKIF

SEQ ID NO: 1051307 - protein, 9 aa, Homo Sapiens
HLDGFEGKR

SEQ ID NO: 1051308 - protein, 9 aa, Homo Sapiens
LSKHEPGHE

SEQ ID NO: 1051309 - protein, 9 aa, Homo Sapiens
IPFAPGNYD

SEQ ID NO: 1051310 - protein, 9 aa, Homo Sapiens
RSLETFTPQ

SEQ ID NO: 1051311 - protein, 9 aa, Homo Sapiens
HLATVCKIP

SEQ ID NO: 1051312 - protein, 9 aa, Homo Sapiens
SIADRLWPD

SEQ ID NO: 1051313 - protein, 9 aa, Homo Sapiens
NLCVSEISE

SEQ ID NO: 1051314 - protein, 9 aa, Homo Sapiens
KRKHSTAFS

SEQ ID NO: 1051315 - protein, 9 aa, Homo Sapiens
TPRGIPSSN

SEQ ID NO: 1051316 - protein, 9 aa, Homo Sapiens
LNNSYVRKA

SEQ ID NO: 1051317 - protein, 9 aa, Homo Sapiens
IKEHLPLPA

SEQ ID NO: 1051318 - protein, 9 aa, Homo Sapiens
PQGNKDLKK

SEQ ID NO: 1051319 - protein, 9 aa, Homo Sapiens
ERDDPSASA

SEQ ID NO: 1051320 - protein, 9 aa, Homo Sapiens
GKMREIEKV

SEQ ID NO: 1051321 - protein, 9 aa, Homo Sapiens
SSTRCTLEA

SEQ ID NO: 1051322 - protein, 9 aa, Homo Sapiens
EESSERDAE

SEQ ID NO: 1051323 - protein, 9 aa, Homo Sapiens
LTETLNREE

SEQ ID NO: 1051324 - protein, 9 aa, Homo Sapiens
NPGLDEPPS

SEQ ID NO: 1051325 - protein, 9 aa, Homo Sapiens
LEGGLVATT

SEQ ID NO: 1051326 - protein, 9 aa, Homo Sapiens
LKLSNFLND

SEQ ID NO: 1051327 - protein, 9 aa, Homo Sapiens
LLRTLRSTS

SEQ ID NO: 1051328 - protein, 9 aa, Homo Sapiens
LTLELAGFP

SEQ ID NO: 1051329 - protein, 9 aa, Homo Sapiens
DNMNFSDVK

SEQ ID NO: 1051330 - protein, 9 aa, Homo Sapiens
LLCALHPQD

SEQ ID NO: 1051331 - protein, 9 aa, Homo Sapiens
LEAAPKSPS

SEQ ID NO: 1051332 - protein, 9 aa, Homo Sapiens
NREEVYTVF

SEQ ID NO: 1051333 - protein, 9 aa, Homo Sapiens
GLATSHPNS

SEQ ID NO: 1051334 - protein, 9 aa, Homo Sapiens
YDAWDMRRR

SEQ ID NO: 1051335 - protein, 9 aa, Homo Sapiens
VQNLQKRQA

SEQ ID NO: 1051336 - protein, 9 aa, Homo Sapiens
HQEVNTKLC

SEQ ID NO: 1051337 - protein, 9 aa, Homo Sapiens
FESPFNKQQ

SEQ ID NO: 1051338 - protein, 9 aa, Homo Sapiens
RVLSQPPKS

SEQ ID NO: 1051339 - protein, 9 aa, Homo Sapiens
HETKIFKTS

SEQ ID NO: 1051340 - protein, 9 aa, Homo Sapiens
LVVKIQKNT

SEQ ID NO: 1051341 - protein, 9 aa, Homo Sapiens
FSCSLLQLD

SEQ ID NO: 1051342 - protein, 9 aa, Homo Sapiens
VVMHYSFAF

SEQ ID NO: 1051343 - protein, 9 aa, Homo Sapiens
QINAYLRKT

SEQ ID NO: 1051344 - protein, 9 aa, Homo Sapiens
SNPSLICQK

SEQ ID NO: 1051345 - protein, 9 aa, Homo Sapiens
EARELTKAG

SEQ ID NO: 1051346 - protein, 9 aa, Homo Sapiens
EDTKSTASS

SEQ ID NO: 1051347 - protein, 9 aa, Homo Sapiens
ILRKLEKKK

SEQ ID NO: 1051348 - protein, 9 aa, Homo Sapiens
FHTALKLAV

SEQ ID NO: 1051349 - protein, 9 aa, Homo Sapiens
LQELWLRNN

SEQ ID NO: 1051350 - protein, 9 aa, Homo Sapiens
FFPEKDHSS

SEQ ID NO: 1051351 - protein, 9 aa, Homo Sapiens
CIVYCTMEV

SEQ ID NO: 1051352 - protein, 9 aa, Homo Sapiens
AVFSIFSAL

SEQ ID NO: 1051353 - protein, 9 aa, Homo Sapiens
NLYLARHTR

SEQ ID NO: 1051354 - protein, 9 aa, Homo Sapiens
VEINLKQYP

SEQ ID NO: 1051355 - protein, 9 aa, Homo Sapiens
GLAVHLKAM

SEQ ID NO: 1051356 - protein, 9 aa, Homo Sapiens
EAVTAAEFW

SEQ ID NO: 1051357 - protein, 9 aa, Homo Sapiens
EIKLAKLSD

SEQ ID NO: 1051358 - protein, 9 aa, Homo Sapiens
PDRIGKTTL

SEQ ID NO: 1051359 - protein, 9 aa, Homo Sapiens
IACRSILHK

SEQ ID NO: 1051360 - protein, 9 aa, Homo Sapiens
AVCKDVRID

SEQ ID NO: 1051361 - protein, 9 aa, Homo Sapiens
PSTSAAEAK

SEQ ID NO: 1051362 - protein, 9 aa, Homo Sapiens
YHMYGGGTS

SEQ ID NO: 1051363 - protein, 9 aa, Homo Sapiens
SGDTTCPGP

SEQ ID NO: 1051364 - protein, 9 aa, Homo Sapiens
ALSTSSLDL

SEQ ID NO: 1051365 - protein, 9 aa, Homo Sapiens
ALARETDKL

SEQ ID NO: 1051366 - protein, 9 aa, Homo Sapiens
KKYSSPQKT

SEQ ID NO: 1051367 - protein, 9 aa, Homo Sapiens
RDSGNEMGA

SEQ ID NO: 1051368 - protein, 9 aa, Homo Sapiens
GHYVDVFRD

SEQ ID NO: 1051369 - protein, 9 aa, Homo Sapiens
PEHVVPYRL

SEQ ID NO: 1051370 - protein, 9 aa, Homo Sapiens
RKNAFSKSK

SEQ ID NO: 1051371 - protein, 9 aa, Homo Sapiens
VSEGTQHNP

SEQ ID NO: 1051372 - protein, 9 aa, Homo Sapiens
AVTVFYFYD

SEQ ID NO: 1051373 - protein, 9 aa, Homo Sapiens
PDVFQASKH

SEQ ID NO: 1051374 - protein, 9 aa, Homo Sapiens
TASASAFTT

SEQ ID NO: 1051375 - protein, 9 aa, Homo Sapiens
TDCLSFINE

SEQ ID NO: 1051376 - protein, 9 aa, Homo Sapiens
FLIHLVLLL

SEQ ID NO: 1051377 - protein, 9 aa, Homo Sapiens
PYSTTKVTL

SEQ ID NO: 1051378 - protein, 9 aa, Homo Sapiens
FSRVDDHDS

SEQ ID NO: 1051379 - protein, 9 aa, Homo Sapiens
FPFKELEKR

SEQ ID NO: 1051380 - protein, 9 aa, Homo Sapiens
GTPREQGFP

SEQ ID NO: 1051381 - protein, 9 aa, Homo Sapiens
EETDFFVNK

SEQ ID NO: 1051382 - protein, 9 aa, Homo Sapiens
VLAVHTEGN

SEQ ID NO: 1051383 - protein, 9 aa, Homo Sapiens
KNDEQDSDN

SEQ ID NO: 1051384 - protein, 9 aa, Homo Sapiens
VINNNSKMV

SEQ ID NO: 1051385 - protein, 9 aa, Homo Sapiens
ISSLCSCDI

SEQ ID NO: 1051386 - protein, 9 aa, Homo Sapiens
KFGIVAHKL

SEQ ID NO: 1051387 - protein, 9 aa, Homo Sapiens
EKAYTKRSH

SEQ ID NO: 1051388 - protein, 9 aa, Homo Sapiens
RGEGRPGPQ

SEQ ID NO: 1051389 - protein, 9 aa, Homo Sapiens
SDSSSSSFS

SEQ ID NO: 1051390 - protein, 9 aa, Homo Sapiens
APHGLATSH

SEQ ID NO: 1051391 - protein, 9 aa, Homo Sapiens
QPQKRPPAL

SEQ ID NO: 1051392 - protein, 9 aa, Homo Sapiens
GLERLALSP

SEQ ID NO: 1051393 - protein, 9 aa, Homo Sapiens
TNHIGWMQE

SEQ ID NO: 1051394 - protein, 9 aa, Homo Sapiens
KMELLIMTK

SEQ ID NO: 1051395 - protein, 9 aa, Homo Sapiens
FSRSSVLTT

SEQ ID NO: 1051396 - protein, 9 aa, Homo Sapiens
VHANQTGYL

SEQ ID NO: 1051397 - protein, 9 aa, Homo Sapiens
FYQSYIDYL

SEQ ID NO: 1051398 - protein, 9 aa, Homo Sapiens
KHNLLKQTL

SEQ ID NO: 1051399 - protein, 9 aa, Homo Sapiens
QPWQTMARN

SEQ ID NO: 1051400 - protein, 9 aa, Homo Sapiens
KWKKFSPGH

SEQ ID NO: 1051401 - protein, 9 aa, Homo Sapiens
THHLFVSLY

SEQ ID NO: 1051402 - protein, 9 aa, Homo Sapiens
HLIEKCLKF

SEQ ID NO: 1051403 - protein, 9 aa, Homo Sapiens
VPLEDQRNV

SEQ ID NO: 1051404 - protein, 9 aa, Homo Sapiens
SSQVPTPGF

SEQ ID NO: 1051405 - protein, 9 aa, Homo Sapiens
KKHSITAVV

SEQ ID NO: 1051406 - protein, 9 aa, Homo Sapiens
SCSFHEIPT

SEQ ID NO: 1051407 - protein, 9 aa, Homo Sapiens
PLNPDFQRM

SEQ ID NO: 1051408 - protein, 9 aa, Homo Sapiens
ITPARQRPV

SEQ ID NO: 1051409 - protein, 9 aa, Homo Sapiens
KDIMVYFKQ

SEQ ID NO: 1051410 - protein, 9 aa, Homo Sapiens
MNKTSHTQG

SEQ ID NO: 1051411 - protein, 9 aa, Homo Sapiens
GWNFQPPLC

SEQ ID NO: 1051412 - protein, 9 aa, Homo Sapiens
FNDAEPAKE

SEQ ID NO: 1051413 - protein, 9 aa, Homo Sapiens
QTDPATLLY

SEQ ID NO: 1051414 - protein, 9 aa, Homo Sapiens
IKIHTPEQG

SEQ ID NO: 1051415 - protein, 9 aa, Homo Sapiens
VKGRKAAAM

SEQ ID NO: 1051416 - protein, 9 aa, Homo Sapiens
CFRWPQENK

SEQ ID NO: 1051417 - protein, 9 aa, Homo Sapiens
LEASTQESQ

SEQ ID NO: 1051418 - protein, 9 aa, Homo Sapiens
RWDTTLSTP

SEQ ID NO: 1051419 - protein, 9 aa, Homo Sapiens
FTGDRCTDC

SEQ ID NO: 1051420 - protein, 9 aa, Homo Sapiens
KKKLELQIG

SEQ ID NO: 1051421 - protein, 9 aa, Homo Sapiens
YPKTGEHQP

SEQ ID NO: 1051422 - protein, 9 aa, Homo Sapiens
EESSFGSHL

SEQ ID NO: 1051423 - protein, 9 aa, Homo Sapiens
QIDTIFLLV

SEQ ID NO: 1051424 - protein, 9 aa, Homo Sapiens
IIRLEQDGI

SEQ ID NO: 1051425 - protein, 9 aa, Homo Sapiens
VQSPLPLSS

SEQ ID NO: 1051426 - protein, 9 aa, Homo Sapiens
PSWIFTCLC

SEQ ID NO: 1051427 - protein, 9 aa, Homo Sapiens
GPLMSPLSS

SEQ ID NO: 1051428 - protein, 9 aa, Homo Sapiens
LAQPAAELG

SEQ ID NO: 1051429 - protein, 9 aa, Homo Sapiens
SYKLYWRNL

SEQ ID NO: 1051430 - protein, 9 aa, Homo Sapiens
SPTDPALST

SEQ ID NO: 1051431 - protein, 9 aa, Homo Sapiens
LICKSSFFL

SEQ ID NO: 1051432 - protein, 9 aa, Homo Sapiens
ELEARQNWP

SEQ ID NO: 1051433 - protein, 9 aa, Homo Sapiens
MCSGHSQCS

SEQ ID NO: 1051434 - protein, 9 aa, Homo Sapiens
KNDHYCTLV

SEQ ID NO: 1051435 - protein, 9 aa, Homo Sapiens
ELMIQDKSF

SEQ ID NO: 1051436 - protein, 9 aa, Homo Sapiens
AAPNLADCS

SEQ ID NO: 1051437 - protein, 9 aa, Homo Sapiens
VIDISIILA

SEQ ID NO: 1051438 - protein, 9 aa, Homo Sapiens
VEKVWKVEQ

SEQ ID NO: 1051439 - protein, 9 aa, Homo Sapiens
RVLYHFANH

SEQ ID NO: 1051440 - protein, 9 aa, Homo Sapiens
KNFRRLQAE

SEQ ID NO: 1051441 - protein, 9 aa, Homo Sapiens
YFYEGVCYK

SEQ ID NO: 1051442 - protein, 9 aa, Homo Sapiens
DGCQMFSIN

SEQ ID NO: 1051443 - protein, 9 aa, Homo Sapiens
LVVQVAKAT

SEQ ID NO: 1051444 - protein, 9 aa, Homo Sapiens
EKKEVNFQA

SEQ ID NO: 1051445 - protein, 9 aa, Homo Sapiens
HIFLVEDAV

SEQ ID NO: 1051446 - protein, 9 aa, Homo Sapiens
VHQSPNGTL

SEQ ID NO: 1051447 - protein, 9 aa, Homo Sapiens
LDGAPGSSE

SEQ ID NO: 1051448 - protein, 9 aa, Homo Sapiens
YSPILKHML

SEQ ID NO: 1051449 - protein, 9 aa, Homo Sapiens
SSNTLGINL

SEQ ID NO: 1051450 - protein, 9 aa, Homo Sapiens
ASLGSQESG

SEQ ID NO: 1051451 - protein, 9 aa, Homo Sapiens
TVEDYPKTG

SEQ ID NO: 1051452 - protein, 9 aa, Homo Sapiens
CLPKCPPKC

SEQ ID NO: 1051453 - protein, 9 aa, Homo Sapiens
LKRHMITYS

SEQ ID NO: 1051454 - protein, 9 aa, Homo Sapiens
PCLTPSTAA

SEQ ID NO: 1051455 - protein, 9 aa, Homo Sapiens
GYKGKGKQC

SEQ ID NO: 1051456 - protein, 9 aa, Homo Sapiens
QKKEEAEEE

SEQ ID NO: 1051457 - protein, 9 aa, Homo Sapiens
FELRESSIS

SEQ ID NO: 1051458 - protein, 9 aa, Homo Sapiens
TSPTPSFRS

SEQ ID NO: 1051459 - protein, 9 aa, Homo Sapiens
RKEGHKVVG

SEQ ID NO: 1051460 - protein, 9 aa, Homo Sapiens
HHQQTHTGE

SEQ ID NO: 1051461 - protein, 9 aa, Homo Sapiens
WSQEAVFFF

SEQ ID NO: 1051462 - protein, 9 aa, Homo Sapiens
IPFPYNFYD

SEQ ID NO: 1051463 - protein, 9 aa, Homo Sapiens
MLLISLFLA

SEQ ID NO: 1051464 - protein, 9 aa, Homo Sapiens
ILVQYTGWF

SEQ ID NO: 1051465 - protein, 9 aa, Homo Sapiens
LLKFLNDTM

SEQ ID NO: 1051466 - protein, 9 aa, Homo Sapiens
QSDDDKIIQ

SEQ ID NO: 1051467 - protein, 9 aa, Homo Sapiens
LKPETVYVF

SEQ ID NO: 1051468 - protein, 9 aa, Homo Sapiens
VTRVHFCYN

SEQ ID NO: 1051469 - protein, 9 aa, Homo Sapiens
ENIGGELVY

SEQ ID NO: 1051470 - protein, 9 aa, Homo Sapiens
LFGWTPSRR

SEQ ID NO: 1051471 - protein, 9 aa, Homo Sapiens
PVAKKSSSG

SEQ ID NO: 1051472 - protein, 9 aa, Homo Sapiens
DNPPLSNGG

SEQ ID NO: 1051473 - protein, 9 aa, Homo Sapiens
GFYTSGFFQ

SEQ ID NO: 1051474 - protein, 9 aa, Homo Sapiens
TMKKEFQKT

SEQ ID NO: 1051475 - protein, 9 aa, Homo Sapiens
EEYPLADIF

SEQ ID NO: 1051476 - protein, 9 aa, Homo Sapiens
LDFKKIKSY

SEQ ID NO: 1051477 - protein, 9 aa, Homo Sapiens
VEKAAAPRE

SEQ ID NO: 1051478 - protein, 9 aa, Homo Sapiens
VSDLFSTIK

SEQ ID NO: 1051479 - protein, 9 aa, Homo Sapiens
KDVLYFQPP

SEQ ID NO: 1051480 - protein, 9 aa, Homo Sapiens
LNPHSKPNP

SEQ ID NO: 1051481 - protein, 9 aa, Homo Sapiens
SSQPPDPNT

SEQ ID NO: 1051482 - protein, 9 aa, Homo Sapiens
QNSGEASLP

SEQ ID NO: 1051483 - protein, 9 aa, Homo Sapiens
LIKSDLVEY

SEQ ID NO: 1051484 - protein, 9 aa, Homo Sapiens
RSCGVTVAL

SEQ ID NO: 1051485 - protein, 9 aa, Homo Sapiens
YRDFKPENL

SEQ ID NO: 1051486 - protein, 9 aa, Homo Sapiens
QKNTWASHS

SEQ ID NO: 1051487 - protein, 9 aa, Homo Sapiens
SILHKDIGP

SEQ ID NO: 1051488 - protein, 9 aa, Homo Sapiens
EELEEIEEN

SEQ ID NO: 1051489 - protein, 9 aa, Homo Sapiens
MTEVFCREQ

SEQ ID NO: 1051490 - protein, 9 aa, Homo Sapiens
VQKPGDYEV

SEQ ID NO: 1051491 - protein, 9 aa, Homo Sapiens
YKGHVNNSA

SEQ ID NO: 1051492 - protein, 9 aa, Homo Sapiens
SSTLPRNSP

SEQ ID NO: 1051493 - protein, 9 aa, Homo Sapiens
AMLHPPHHI

SEQ ID NO: 1051494 - protein, 9 aa, Homo Sapiens
VFSVDEFFA

SEQ ID NO: 1051495 - protein, 9 aa, Homo Sapiens
EGSCLLADN

SEQ ID NO: 1051496 - protein, 9 aa, Homo Sapiens
IEENAGLGN

SEQ ID NO: 1051497 - protein, 9 aa, Homo Sapiens
HYSFAFLIY

SEQ ID NO: 1051498 - protein, 9 aa, Homo Sapiens
YLNKRKGIN

SEQ ID NO: 1051499 - protein, 9 aa, Homo Sapiens
EIEENAGLG

SEQ ID NO: 1051500 - protein, 9 aa, Homo Sapiens
RYLSQLDGE

SEQ ID NO: 1051501 - protein, 9 aa, Homo Sapiens
FSLSHSVPA

SEQ ID NO: 1051502 - protein, 9 aa, Homo Sapiens
RNVEKVWKV

SEQ ID NO: 1051503 - protein, 9 aa, Homo Sapiens
QEKVLSVRV

SEQ ID NO: 1051504 - protein, 9 aa, Homo Sapiens
AETIRDMCR

SEQ ID NO: 1051505 - protein, 9 aa, Homo Sapiens
RTEVRSLRV

SEQ ID NO: 1051506 - protein, 9 aa, Homo Sapiens
PFIEKLLEI

SEQ ID NO: 1051507 - protein, 9 aa, Homo Sapiens
SDSDPEKKE

SEQ ID NO: 1051508 - protein, 9 aa, Homo Sapiens
VDFHTEIKE

SEQ ID NO: 1051509 - protein, 9 aa, Homo Sapiens
KGTEISHLI

SEQ ID NO: 1051510 - protein, 9 aa, Homo Sapiens
LASYKLYWR

SEQ ID NO: 1051511 - protein, 9 aa, Homo Sapiens
LDALVKKKK

SEQ ID NO: 1051512 - protein, 9 aa, Homo Sapiens
DSQQSCAFH

SEQ ID NO: 1051513 - protein, 9 aa, Homo Sapiens
CGNEILESN

SEQ ID NO: 1051514 - protein, 9 aa, Homo Sapiens
PVQEEEDKG

SEQ ID NO: 1051515 - protein, 9 aa, Homo Sapiens
SPILLSDAA

SEQ ID NO: 1051516 - protein, 9 aa, Homo Sapiens
AVTTMTIRT

SEQ ID NO: 1051517 - protein, 9 aa, Homo Sapiens
MNRTRIINS

SEQ ID NO: 1051518 - protein, 9 aa, Homo Sapiens
IPPEIVSEP

SEQ ID NO: 1051519 - protein, 9 aa, Homo Sapiens
IFVSHLHTP

SEQ ID NO: 1051520 - protein, 9 aa, Homo Sapiens
DSFFETDTI

SEQ ID NO: 1051521 - protein, 9 aa, Homo Sapiens
RHCGPDLEG

SEQ ID NO: 1051522 - protein, 9 aa, Homo Sapiens
NSCDLEEEA

SEQ ID NO: 1051523 - protein, 9 aa, Homo Sapiens
YQAATYLKW

SEQ ID NO: 1051524 - protein, 9 aa, Homo Sapiens
ILESTEFLL

SEQ ID NO: 1051525 - protein, 9 aa, Homo Sapiens
EEIEENAGL

SEQ ID NO: 1051526 - protein, 9 aa, Homo Sapiens
CQVAGHPHI

SEQ ID NO: 1051527 - protein, 9 aa, Homo Sapiens
LHQRIYTGE

SEQ ID NO: 1051528 - protein, 9 aa, Homo Sapiens
RYRLLEPTL

SEQ ID NO: 1051529 - protein, 9 aa, Homo Sapiens
NLHDDFCYC

SEQ ID NO: 1051530 - protein, 9 aa, Homo Sapiens
TSDILEPLC

SEQ ID NO: 1051531 - protein, 9 aa, Homo Sapiens
DKMSDMDCT

SEQ ID NO: 1051532 - protein, 9 aa, Homo Sapiens
PENGTDNFR

SEQ ID NO: 1051533 - protein, 9 aa, Homo Sapiens
PLSLITSNL

SEQ ID NO: 1051534 - protein, 9 aa, Homo Sapiens
LEEISVTVK

SEQ ID NO: 1051535 - protein, 9 aa, Homo Sapiens
SYVSIIAIF

SEQ ID NO: 1051536 - protein, 9 aa, Homo Sapiens
NFPVGTLLL

SEQ ID NO: 1051537 - protein, 9 aa, Homo Sapiens
SIYNLVPVK

SEQ ID NO: 1051538 - protein, 9 aa, Homo Sapiens
EKLSESLAS

SEQ ID NO: 1051539 - protein, 9 aa, Homo Sapiens
QAQLLRTLR

SEQ ID NO: 1051540 - protein, 9 aa, Homo Sapiens
ATLSWQNFN

SEQ ID NO: 1051541 - protein, 9 aa, Homo Sapiens
MVLFIYIEK

SEQ ID NO: 1051542 - protein, 9 aa, Homo Sapiens
RRIYTGEKP

SEQ ID NO: 1051543 - protein, 9 aa, Homo Sapiens
APTFDKCLP

SEQ ID NO: 1051544 - protein, 9 aa, Homo Sapiens
LIDTELMDA

SEQ ID NO: 1051545 - protein, 9 aa, Homo Sapiens
FRPSKEVHL

SEQ ID NO: 1051546 - protein, 9 aa, Homo Sapiens
VFIHTLVFM

SEQ ID NO: 1051547 - protein, 9 aa, Homo Sapiens
QKQRRQRPG

SEQ ID NO: 1051548 - protein, 9 aa, Homo Sapiens
TRYAQYHHV

SEQ ID NO: 1051549 - protein, 9 aa, Homo Sapiens
SSLSSPAFA

SEQ ID NO: 1051550 - protein, 9 aa, Homo Sapiens
YEKQGLVSS

SEQ ID NO: 1051551 - protein, 9 aa, Homo Sapiens
FMRTWYLVS

SEQ ID NO: 1051552 - protein, 9 aa, Homo Sapiens
NQLNKETDS

SEQ ID NO: 1051553 - protein, 9 aa, Homo Sapiens
GEVKGRKAA

SEQ ID NO: 1051554 - protein, 9 aa, Homo Sapiens
PETVYVFQI

SEQ ID NO: 1051555 - protein, 9 aa, Homo Sapiens
CTKNREWML

SEQ ID NO: 1051556 - protein, 9 aa, Homo Sapiens
RYLNLGGFI

SEQ ID NO: 1051557 - protein, 9 aa, Homo Sapiens
KRLKLLQEE

SEQ ID NO: 1051558 - protein, 9 aa, Homo Sapiens
SRTKMKNIL

SEQ ID NO: 1051559 - protein, 9 aa, Homo Sapiens
LPPSGVKRG

SEQ ID NO: 1051560 - protein, 9 aa, Homo Sapiens
IFFAGCFTQ

SEQ ID NO: 1051561 - protein, 9 aa, Homo Sapiens
KYLWLNFNN

SEQ ID NO: 1051562 - protein, 9 aa, Homo Sapiens
IPLEYTVSH

SEQ ID NO: 1051563 - protein, 9 aa, Homo Sapiens
TKKLTETPP

SEQ ID NO: 1051564 - protein, 9 aa, Homo Sapiens
YLGDPILYD

SEQ ID NO: 1051565 - protein, 9 aa, Homo Sapiens
ALAARQLQD

SEQ ID NO: 1051566 - protein, 9 aa, Homo Sapiens
ISLGISIMI

SEQ ID NO: 1051567 - protein, 9 aa, Homo Sapiens
VLLFLIHLV

SEQ ID NO: 1051568 - protein, 9 aa, Homo Sapiens
ERKKLKLDG

SEQ ID NO: 1051569 - protein, 9 aa, Homo Sapiens
ATLKAELLL

SEQ ID NO: 1051570 - protein, 9 aa, Homo Sapiens
FRQYWDILD

SEQ ID NO: 1051571 - protein, 9 aa, Homo Sapiens
EIILLLLIC

SEQ ID NO: 1051572 - protein, 9 aa, Homo Sapiens
YVVTVVENG

SEQ ID NO: 1051573 - protein, 9 aa, Homo Sapiens
LRADDLVSP

SEQ ID NO: 1051574 - protein, 9 aa, Homo Sapiens
AFCLRCFLA

SEQ ID NO: 1051575 - protein, 9 aa, Homo Sapiens
YVCASDVTI

SEQ ID NO: 1051576 - protein, 9 aa, Homo Sapiens
PKMLMDFFV

SEQ ID NO: 1051577 - protein, 9 aa, Homo Sapiens
TVFSYLEDI

SEQ ID NO: 1051578 - protein, 9 aa, Homo Sapiens
VGLSLWVEY

SEQ ID NO: 1051579 - protein, 9 aa, Homo Sapiens
SMLQEGTFN

SEQ ID NO: 1051580 - protein, 9 aa, Homo Sapiens
PLTITLVCE

SEQ ID NO: 1051581 - protein, 9 aa, Homo Sapiens
NFGMSRVLE

SEQ ID NO: 1051582 - protein, 9 aa, Homo Sapiens
ETGDYCVQK

SEQ ID NO: 1051583 - protein, 9 aa, Homo Sapiens
RSGKLPSPS

SEQ ID NO: 1051584 - protein, 9 aa, Homo Sapiens
DPLAAFPNC

SEQ ID NO: 1051585 - protein, 9 aa, Homo Sapiens
MAAGKFARA

SEQ ID NO: 1051586 - protein, 9 aa, Homo Sapiens
INGNPRQSF

SEQ ID NO: 1051587 - protein, 9 aa, Homo Sapiens
GRPSSCSTQ

SEQ ID NO: 1051588 - protein, 9 aa, Homo Sapiens
KFSAVVRDL

SEQ ID NO: 1051589 - protein, 9 aa, Homo Sapiens
SDDYGGVKK

SEQ ID NO: 1051590 - protein, 9 aa, Homo Sapiens
YWETMSSTV

SEQ ID NO: 1051591 - protein, 9 aa, Homo Sapiens
EMKLQTSPA

SEQ ID NO: 1051592 - protein, 9 aa, Homo Sapiens
RIVFLELFK

SEQ ID NO: 1051593 - protein, 9 aa, Homo Sapiens
LEFLIISNN

SEQ ID NO: 1051594 - protein, 9 aa, Homo Sapiens
VEQEISRVL

SEQ ID NO: 1051595 - protein, 9 aa, Homo Sapiens
KRIYDEKMS

SEQ ID NO: 1051596 - protein, 9 aa, Homo Sapiens
IVMKGAPER

SEQ ID NO: 1051597 - protein, 9 aa, Homo Sapiens
YDHQGRSYL

SEQ ID NO: 1051598 - protein, 9 aa, Homo Sapiens
SLLGVTAEM

SEQ ID NO: 1051599 - protein, 9 aa, Homo Sapiens
IMKTVRILL

SEQ ID NO: 1051600 - protein, 9 aa, Homo Sapiens
LLADNNFVL

SEQ ID NO: 1051601 - protein, 9 aa, Homo Sapiens
FLHLFTETE

SEQ ID NO: 1051602 - protein, 9 aa, Homo Sapiens
SRRQPHVVS

SEQ ID NO: 1051603 - protein, 9 aa, Homo Sapiens
ICSKIPITL

SEQ ID NO: 1051604 - protein, 9 aa, Homo Sapiens
RGFSFENCQ

SEQ ID NO: 1051605 - protein, 9 aa, Homo Sapiens
QRIHTKERP

SEQ ID NO: 1051606 - protein, 9 aa, Homo Sapiens
VLAFLLDMV

SEQ ID NO: 1051607 - protein, 9 aa, Homo Sapiens
EKLELQMAD

SEQ ID NO: 1051608 - protein, 9 aa, Homo Sapiens
MGILRVKQT

SEQ ID NO: 1051609 - protein, 9 aa, Homo Sapiens
EVDKRVYMT

SEQ ID NO: 1051610 - protein, 9 aa, Homo Sapiens
EAGSCGSNS

SEQ ID NO: 1051611 - protein, 9 aa, Homo Sapiens
NKKMYVKGM

SEQ ID NO: 1051612 - protein, 9 aa, Homo Sapiens
KGQKLEYEH

SEQ ID NO: 1051613 - protein, 9 aa, Homo Sapiens
FLNPVVLWK

SEQ ID NO: 1051614 - protein, 9 aa, Homo Sapiens
NEERDDFDP

SEQ ID NO: 1051615 - protein, 9 aa, Homo Sapiens
IAKQTPFSE

SEQ ID NO: 1051616 - protein, 9 aa, Homo Sapiens
PALSTSSLD

SEQ ID NO: 1051617 - protein, 9 aa, Homo Sapiens
EEDLRKELY

SEQ ID NO: 1051618 - protein, 9 aa, Homo Sapiens
RDAVKTVAL

SEQ ID NO: 1051619 - protein, 9 aa, Homo Sapiens
YSLWSQSYE

SEQ ID NO: 1051620 - protein, 9 aa, Homo Sapiens
TQPHSHSNP

SEQ ID NO: 1051621 - protein, 9 aa, Homo Sapiens
DKESYYISE

SEQ ID NO: 1051622 - protein, 9 aa, Homo Sapiens
MIEVVEDTY

SEQ ID NO: 1051623 - protein, 9 aa, Homo Sapiens
QWKDFYYSL

SEQ ID NO: 1051624 - protein, 9 aa, Homo Sapiens
VSLMCEGQR

SEQ ID NO: 1051625 - protein, 9 aa, Homo Sapiens
KLHQQFETF

SEQ ID NO: 1051626 - protein, 9 aa, Homo Sapiens
LCLLKVLQA

SEQ ID NO: 1051627 - protein, 9 aa, Homo Sapiens
DLYRAERIA

SEQ ID NO: 1051628 - protein, 9 aa, Homo Sapiens
TVNNSGFYM

SEQ ID NO: 1051629 - protein, 9 aa, Homo Sapiens
IPASKISSI

SEQ ID NO: 1051630 - protein, 9 aa, Homo Sapiens
SADSLSMSS

SEQ ID NO: 1051631 - protein, 9 aa, Homo Sapiens
VSQESQRRK

SEQ ID NO: 1051632 - protein, 9 aa, Homo Sapiens
FSSLIKHKR

SEQ ID NO: 1051633 - protein, 9 aa, Homo Sapiens
RESSEGGSS

SEQ ID NO: 1051634 - protein, 9 aa, Homo Sapiens
KIDRNSIQL

SEQ ID NO: 1051635 - protein, 9 aa, Homo Sapiens
AAETRNLQL

SEQ ID NO: 1051636 - protein, 9 aa, Homo Sapiens
GLGEPEGSE

SEQ ID NO: 1051637 - protein, 9 aa, Homo Sapiens
ESVEDFLAT

SEQ ID NO: 1051638 - protein, 9 aa, Homo Sapiens
LLLAQLFFC

SEQ ID NO: 1051639 - protein, 9 aa, Homo Sapiens
QHFLSVFLN

SEQ ID NO: 1051640 - protein, 9 aa, Homo Sapiens
EQRFYKSLP

SEQ ID NO: 1051641 - protein, 9 aa, Homo Sapiens
FKPENLILD

SEQ ID NO: 1051642 - protein, 9 aa, Homo Sapiens
SSFFLKLVR

SEQ ID NO: 1051643 - protein, 9 aa, Homo Sapiens
GFGAVTGVG

SEQ ID NO: 1051644 - protein, 9 aa, Homo Sapiens
FINTKRDDD

SEQ ID NO: 1051645 - protein, 9 aa, Homo Sapiens
TTMVSNLVS

SEQ ID NO: 1051646 - protein, 9 aa, Homo Sapiens
AGTGEGVSL

SEQ ID NO: 1051647 - protein, 9 aa, Homo Sapiens
LKAQAGPAA

SEQ ID NO: 1051648 - protein, 9 aa, Homo Sapiens
VLIFLTKLL

SEQ ID NO: 1051649 - protein, 9 aa, Homo Sapiens
RSCAFSQPV

SEQ ID NO: 1051650 - protein, 9 aa, Homo Sapiens
CKQFQRTPR

SEQ ID NO: 1051651 - protein, 9 aa, Homo Sapiens
GKDVPDYAV

SEQ ID NO: 1051652 - protein, 9 aa, Homo Sapiens
TPYMMMNPE

SEQ ID NO: 1051653 - protein, 9 aa, Homo Sapiens
DRDLEASTQ

SEQ ID NO: 1051654 - protein, 9 aa, Homo Sapiens
MNENDNVPI

SEQ ID NO: 1051655 - protein, 9 aa, Homo Sapiens
KHKIIYTGE

SEQ ID NO: 1051656 - protein, 9 aa, Homo Sapiens
LTLSAGNLG

SEQ ID NO: 1051657 - protein, 9 aa, Homo Sapiens
VSPVPPASS

SEQ ID NO: 1051658 - protein, 9 aa, Homo Sapiens
QFYMNRIST

SEQ ID NO: 1051659 - protein, 9 aa, Homo Sapiens
NVQVEFVST

SEQ ID NO: 1051660 - protein, 9 aa, Homo Sapiens
AGLEDIQSR

SEQ ID NO: 1051661 - protein, 9 aa, Homo Sapiens
VSNPAVSSL

SEQ ID NO: 1051662 - protein, 9 aa, Homo Sapiens
LRQIEEIYV

SEQ ID NO: 1051663 - protein, 9 aa, Homo Sapiens
ISCPERLRL

SEQ ID NO: 1051664 - protein, 9 aa, Homo Sapiens
LHTVDLFSD

SEQ ID NO: 1051665 - protein, 9 aa, Homo Sapiens
DSCLLPELA

SEQ ID NO: 1051666 - protein, 9 aa, Homo Sapiens
CASDVTIRR

SEQ ID NO: 1051667 - protein, 9 aa, Homo Sapiens
HDDFCYCKV

SEQ ID NO: 1051668 - protein, 9 aa, Homo Sapiens
GDNEEWNEV

SEQ ID NO: 1051669 - protein, 9 aa, Homo Sapiens
LLLISLVYV

SEQ ID NO: 1051670 - protein, 9 aa, Homo Sapiens
YDLDTLSGP

SEQ ID NO: 1051671 - protein, 9 aa, Homo Sapiens
TTKVTLGST

SEQ ID NO: 1051672 - protein, 9 aa, Homo Sapiens
PGLEHLLCP

SEQ ID NO: 1051673 - protein, 9 aa, Homo Sapiens
LLIHSGGNS

SEQ ID NO: 1051674 - protein, 9 aa, Homo Sapiens
LVNSCVSGI

SEQ ID NO: 1051675 - protein, 9 aa, Homo Sapiens
GLSFWSSEE

SEQ ID NO: 1051676 - protein, 9 aa, Homo Sapiens
GKVKGSPSL

SEQ ID NO: 1051677 - protein, 9 aa, Homo Sapiens
RSKAKLRAE

SEQ ID NO: 1051678 - protein, 9 aa, Homo Sapiens
LGVNVEGAE

SEQ ID NO: 1051679 - protein, 9 aa, Homo Sapiens
NVQFDLLHK

SEQ ID NO: 1051680 - protein, 9 aa, Homo Sapiens
TAFQPLCTG

SEQ ID NO: 1051681 - protein, 9 aa, Homo Sapiens
MMEFFLLEA

SEQ ID NO: 1051682 - protein, 9 aa, Homo Sapiens
GIYLSDIDL

SEQ ID NO: 1051683 - protein, 9 aa, Homo Sapiens
TQKIPKTKA

SEQ ID NO: 1051684 - protein, 9 aa, Homo Sapiens
AAFLPLLVY

SEQ ID NO: 1051685 - protein, 9 aa, Homo Sapiens
LQNPQTFLC

SEQ ID NO: 1051686 - protein, 9 aa, Homo Sapiens
GDSAHKPEN

SEQ ID NO: 1051687 - protein, 9 aa, Homo Sapiens
VNGGRYGTI

SEQ ID NO: 1051688 - protein, 9 aa, Homo Sapiens
LPDYNKIFF

SEQ ID NO: 1051689 - protein, 9 aa, Homo Sapiens
YYIPPHGFY

SEQ ID NO: 1051690 - protein, 9 aa, Homo Sapiens
SVLTLILQP

SEQ ID NO: 1051691 - protein, 9 aa, Homo Sapiens
SPAQLDLFY

SEQ ID NO: 1051692 - protein, 9 aa, Homo Sapiens
YTGEKLYKC

SEQ ID NO: 1051693 - protein, 9 aa, Homo Sapiens
VFQMSSEKG

SEQ ID NO: 1051694 - protein, 9 aa, Homo Sapiens
RRRFHQDAL

SEQ ID NO: 1051695 - protein, 9 aa, Homo Sapiens
TKYMSKGSL

SEQ ID NO: 1051696 - protein, 9 aa, Homo Sapiens
ASLPNRGRP

SEQ ID NO: 1051697 - protein, 9 aa, Homo Sapiens
TICDLIIIL

SEQ ID NO: 1051698 - protein, 9 aa, Homo Sapiens
PQSLYQFFV

SEQ ID NO: 1051699 - protein, 9 aa, Homo Sapiens
SLYYRKMYR

SEQ ID NO: 1051700 - protein, 9 aa, Homo Sapiens
TRDLEEISV

SEQ ID NO: 1051701 - protein, 9 aa, Homo Sapiens
GNNVEPPTI

SEQ ID NO: 1051702 - protein, 9 aa, Homo Sapiens
LIKRLTFST

SEQ ID NO: 1051703 - protein, 9 aa, Homo Sapiens
RTQFGEKNS

SEQ ID NO: 1051704 - protein, 9 aa, Homo Sapiens
TLMGQAEIF

SEQ ID NO: 1051705 - protein, 9 aa, Homo Sapiens
GLLGNNQIY

SEQ ID NO: 1051706 - protein, 9 aa, Homo Sapiens
NLGGFIGYA

SEQ ID NO: 1051707 - protein, 9 aa, Homo Sapiens
TFEGRRNNN

SEQ ID NO: 1051708 - protein, 9 aa, Homo Sapiens
RKTAEHTGK

SEQ ID NO: 1051709 - protein, 9 aa, Homo Sapiens
DLFQDSPEQ

SEQ ID NO: 1051710 - protein, 9 aa, Homo Sapiens
RVPGLPSRM

SEQ ID NO: 1051711 - protein, 9 aa, Homo Sapiens
YSKVLGRPT

SEQ ID NO: 1051712 - protein, 9 aa, Homo Sapiens
SAFVGLFFP

SEQ ID NO: 1051713 - protein, 9 aa, Homo Sapiens
SAGEAGCYK

SEQ ID NO: 1051714 - protein, 9 aa, Homo Sapiens
LLTRNEQAG

SEQ ID NO: 1051715 - protein, 9 aa, Homo Sapiens
RCIACTLCE

SEQ ID NO: 1051716 - protein, 9 aa, Homo Sapiens
KVTLGSTFN

SEQ ID NO: 1051717 - protein, 9 aa, Homo Sapiens
ILELPDKFV

SEQ ID NO: 1051718 - protein, 9 aa, Homo Sapiens
PFFGGSASI

SEQ ID NO: 1051719 - protein, 9 aa, Homo Sapiens
RDIFLTSVC

SEQ ID NO: 1051720 - protein, 9 aa, Homo Sapiens
QWSLDNLFS

SEQ ID NO: 1051721 - protein, 9 aa, Homo Sapiens
KSSIDSESA

SEQ ID NO: 1051722 - protein, 9 aa, Homo Sapiens
SFFETDTIL

SEQ ID NO: 1051723 - protein, 9 aa, Homo Sapiens
SKLFCSLQT

SEQ ID NO: 1051724 - protein, 9 aa, Homo Sapiens
QPVEDQGVF

SEQ ID NO: 1051725 - protein, 9 aa, Homo Sapiens
DPGEAGTDG

SEQ ID NO: 1051726 - protein, 9 aa, Homo Sapiens
RPVFVLRQG

SEQ ID NO: 1051727 - protein, 9 aa, Homo Sapiens
HPIRIVDGY

SEQ ID NO: 1051728 - protein, 9 aa, Homo Sapiens
PSVHVHNNR

SEQ ID NO: 1051729 - protein, 9 aa, Homo Sapiens
KAPPSLSGA

SEQ ID NO: 1051730 - protein, 9 aa, Homo Sapiens
CPSFFISSG

SEQ ID NO: 1051731 - protein, 9 aa, Homo Sapiens
KNKEDKLKD

SEQ ID NO: 1051732 - protein, 9 aa, Homo Sapiens
NIYFRHKIY

SEQ ID NO: 1051733 - protein, 9 aa, Homo Sapiens
MSVNAFRKQ

SEQ ID NO: 1051734 - protein, 9 aa, Homo Sapiens
SEDKLQIYR

SEQ ID NO: 1051735 - protein, 9 aa, Homo Sapiens
EEDPNPSAA

SEQ ID NO: 1051736 - protein, 9 aa, Homo Sapiens
RKSSSGNKN

SEQ ID NO: 1051737 - protein, 9 aa, Homo Sapiens
SEADRDGLW

SEQ ID NO: 1051738 - protein, 9 aa, Homo Sapiens
NSFLSGCCQ

SEQ ID NO: 1051739 - protein, 9 aa, Homo Sapiens
VSSHVEKVF

SEQ ID NO: 1051740 - protein, 9 aa, Homo Sapiens
THSLLTFFC

SEQ ID NO: 1051741 - protein, 9 aa, Homo Sapiens
DSISKLPEE

SEQ ID NO: 1051742 - protein, 9 aa, Homo Sapiens
SIISYEITL

SEQ ID NO: 1051743 - protein, 9 aa, Homo Sapiens
QALHDRELL

SEQ ID NO: 1051744 - protein, 9 aa, Homo Sapiens
MDLLPTSIF

SEQ ID NO: 1051745 - protein, 9 aa, Homo Sapiens
TEPLLSLRD

SEQ ID NO: 1051746 - protein, 9 aa, Homo Sapiens
AQGGGPRNP

SEQ ID NO: 1051747 - protein, 9 aa, Homo Sapiens
ISICKTILC

SEQ ID NO: 1051748 - protein, 9 aa, Homo Sapiens
GENVALPLK

SEQ ID NO: 1051749 - protein, 9 aa, Homo Sapiens
IMRGSSEEG

SEQ ID NO: 1051750 - protein, 9 aa, Homo Sapiens
CRCQQIFMK

SEQ ID NO: 1051751 - protein, 9 aa, Homo Sapiens
QTDKYFFDR

SEQ ID NO: 1051752 - protein, 9 aa, Homo Sapiens
KEGATGDRE

SEQ ID NO: 1051753 - protein, 9 aa, Homo Sapiens
TLEGFASLL

SEQ ID NO: 1051754 - protein, 9 aa, Homo Sapiens
LFLDKVIME

SEQ ID NO: 1051755 - protein, 9 aa, Homo Sapiens
LVLSIVVLP

SEQ ID NO: 1051756 - protein, 9 aa, Homo Sapiens
VALGNIASK

SEQ ID NO: 1051757 - protein, 9 aa, Homo Sapiens
TCMLFFFVS

SEQ ID NO: 1051758 - protein, 9 aa, Homo Sapiens
DMTDCLSFI

SEQ ID NO: 1051759 - protein, 9 aa, Homo Sapiens
LPAFLVSSP

SEQ ID NO: 1051760 - protein, 9 aa, Homo Sapiens
TLTPLNERE

SEQ ID NO: 1051761 - protein, 9 aa, Homo Sapiens
TNALTQTVV

SEQ ID NO: 1051762 - protein, 9 aa, Homo Sapiens
APGSTKTSF

SEQ ID NO: 1051763 - protein, 9 aa, Homo Sapiens
AVIFNIFEG

SEQ ID NO: 1051764 - protein, 9 aa, Homo Sapiens
FLSNLFFLD

SEQ ID NO: 1051765 - protein, 9 aa, Homo Sapiens
TTKKEWSQD

SEQ ID NO: 1051766 - protein, 9 aa, Homo Sapiens
FFGVGQESF

SEQ ID NO: 1051767 - protein, 9 aa, Homo Sapiens
ASMFKGVGL

SEQ ID NO: 1051768 - protein, 9 aa, Homo Sapiens
GRPAQISLV

SEQ ID NO: 1051769 - protein, 9 aa, Homo Sapiens
EDQRNVSMR

SEQ ID NO: 1051770 - protein, 9 aa, Homo Sapiens
EEVSNSLQA

SEQ ID NO: 1051771 - protein, 9 aa, Homo Sapiens
VQAEKLAAD

SEQ ID NO: 1051772 - protein, 9 aa, Homo Sapiens
LLQQVGGGG

SEQ ID NO: 1051773 - protein, 9 aa, Homo Sapiens
TKSGTLLPT

SEQ ID NO: 1051774 - protein, 9 aa, Homo Sapiens
QMDILPNVV

SEQ ID NO: 1051775 - protein, 9 aa, Homo Sapiens
KLYGDIPCE

SEQ ID NO: 1051776 - protein, 9 aa, Homo Sapiens
QELSVAYNC

SEQ ID NO: 1051777 - protein, 9 aa, Homo Sapiens
SPCSNRPPR

SEQ ID NO: 1051778 - protein, 9 aa, Homo Sapiens
RYDTEEKGH

SEQ ID NO: 1051779 - protein, 9 aa, Homo Sapiens
RDQAPFIFT

SEQ ID NO: 1051780 - protein, 9 aa, Homo Sapiens
FSEPQKISA

SEQ ID NO: 1051781 - protein, 9 aa, Homo Sapiens
IFFMGCFAQ

SEQ ID NO: 1051782 - protein, 9 aa, Homo Sapiens
VGLHFCFQT

SEQ ID NO: 1051783 - protein, 9 aa, Homo Sapiens
KYRSAYVTP

SEQ ID NO: 1051784 - protein, 9 aa, Homo Sapiens
EKKAKIAEQ

SEQ ID NO: 1051785 - protein, 9 aa, Homo Sapiens
TIRIKFTSD

SEQ ID NO: 1051786 - protein, 9 aa, Homo Sapiens
MDIHWKKVS

SEQ ID NO: 1051787 - protein, 9 aa, Homo Sapiens
ELANTSCQD

SEQ ID NO: 1051788 - protein, 9 aa, Homo Sapiens
DKAFVRNLY

SEQ ID NO: 1051789 - protein, 9 aa, Homo Sapiens
GNIIHSLIK

SEQ ID NO: 1051790 - protein, 9 aa, Homo Sapiens
TEMEAIQVQ

SEQ ID NO: 1051791 - protein, 9 aa, Homo Sapiens
VPDCAFSRT

SEQ ID NO: 1051792 - protein, 9 aa, Homo Sapiens
GDLHYTTFD

SEQ ID NO: 1051793 - protein, 9 aa, Homo Sapiens
NVMKEAFET

SEQ ID NO: 1051794 - protein, 9 aa, Homo Sapiens
SGQVTEQQQ

SEQ ID NO: 1051795 - protein, 9 aa, Homo Sapiens
REVVSIKKM

SEQ ID NO: 1051796 - protein, 9 aa, Homo Sapiens
FNNIENKPP

SEQ ID NO: 1051797 - protein, 9 aa, Homo Sapiens
SLFHTVIFS

SEQ ID NO: 1051798 - protein, 9 aa, Homo Sapiens
TCDFAQDSF

SEQ ID NO: 1051799 - protein, 9 aa, Homo Sapiens
FWQTCGELM

SEQ ID NO: 1051800 - protein, 9 aa, Homo Sapiens
KVLVELIES

SEQ ID NO: 1051801 - protein, 9 aa, Homo Sapiens
QLSDALLKL

SEQ ID NO: 1051802 - protein, 9 aa, Homo Sapiens
RMYDVLVLK

SEQ ID NO: 1051803 - protein, 9 aa, Homo Sapiens
SRSEYFCQD

SEQ ID NO: 1051804 - protein, 9 aa, Homo Sapiens
NFYGDLQKA

SEQ ID NO: 1051805 - protein, 9 aa, Homo Sapiens
GKDKSLNPQ

SEQ ID NO: 1051806 - protein, 9 aa, Homo Sapiens
TLGINLWRG

SEQ ID NO: 1051807 - protein, 9 aa, Homo Sapiens
PPQHYGEPA

SEQ ID NO: 1051808 - protein, 9 aa, Homo Sapiens
CNLETRDET

SEQ ID NO: 1051809 - protein, 9 aa, Homo Sapiens
YAATLAKNM

SEQ ID NO: 1051810 - protein, 9 aa, Homo Sapiens
DLESSKGSS

SEQ ID NO: 1051811 - protein, 9 aa, Homo Sapiens
SRERNFGVR

SEQ ID NO: 1051812 - protein, 9 aa, Homo Sapiens
GKHQENKVF

SEQ ID NO: 1051813 - protein, 9 aa, Homo Sapiens
MKIPDNPKA

SEQ ID NO: 1051814 - protein, 9 aa, Homo Sapiens
ELMTEVFCR

SEQ ID NO: 1051815 - protein, 9 aa, Homo Sapiens
RAGYAHRQS

SEQ ID NO: 1051816 - protein, 9 aa, Homo Sapiens
HLRELQVQN

SEQ ID NO: 1051817 - protein, 9 aa, Homo Sapiens
LLVGIIRDC

SEQ ID NO: 1051818 - protein, 9 aa, Homo Sapiens
EVKGRKAAA

SEQ ID NO: 1051819 - protein, 9 aa, Homo Sapiens
VTLPCPNFF

SEQ ID NO: 1051820 - protein, 9 aa, Homo Sapiens
RLGLIAVHP

SEQ ID NO: 1051821 - protein, 9 aa, Homo Sapiens
LLQVYWETM

SEQ ID NO: 1051822 - protein, 9 aa, Homo Sapiens
PRPQEKNVW

SEQ ID NO: 1051823 - protein, 9 aa, Homo Sapiens
APTLIFEPY

SEQ ID NO: 1051824 - protein, 9 aa, Homo Sapiens
AVSSLSSPA

SEQ ID NO: 1051825 - protein, 9 aa, Homo Sapiens
YNQPLFGVQ

SEQ ID NO: 1051826 - protein, 9 aa, Homo Sapiens
AERSSLLLL

SEQ ID NO: 1051827 - protein, 9 aa, Homo Sapiens
HPRVQIGDH

SEQ ID NO: 1051828 - protein, 9 aa, Homo Sapiens
HMAVQDLIR

SEQ ID NO: 1051829 - protein, 9 aa, Homo Sapiens
GEPFLPPNT

SEQ ID NO: 1051830 - protein, 9 aa, Homo Sapiens
AALRQEPEG

SEQ ID NO: 1051831 - protein, 9 aa, Homo Sapiens
QLCEVENQY

SEQ ID NO: 1051832 - protein, 9 aa, Homo Sapiens
LGCVSKGLD

SEQ ID NO: 1051833 - protein, 9 aa, Homo Sapiens
IPLCVVVAF

SEQ ID NO: 1051834 - protein, 9 aa, Homo Sapiens
NVRNLIDLD

SEQ ID NO: 1051835 - protein, 9 aa, Homo Sapiens
KSPGCRKIS

SEQ ID NO: 1051836 - protein, 9 aa, Homo Sapiens
LEEEAPPPV

SEQ ID NO: 1051837 - protein, 9 aa, Homo Sapiens
LDLPFSSHH

SEQ ID NO: 1051838 - protein, 9 aa, Homo Sapiens
STDPGKKFL

SEQ ID NO: 1051839 - protein, 9 aa, Homo Sapiens
FNPFSLSKD

SEQ ID NO: 1051840 - protein, 9 aa, Homo Sapiens
LLQMWFIYT

SEQ ID NO: 1051841 - protein, 9 aa, Homo Sapiens
SGEIILCDT

SEQ ID NO: 1051842 - protein, 9 aa, Homo Sapiens
PIPGPILGP

SEQ ID NO: 1051843 - protein, 9 aa, Homo Sapiens
LRNRNMKRG

SEQ ID NO: 1051844 - protein, 9 aa, Homo Sapiens
DSVCLGITS

SEQ ID NO: 1051845 - protein, 9 aa, Homo Sapiens
LLQNVSTVL

SEQ ID NO: 1051846 - protein, 9 aa, Homo Sapiens
YFQQGLHWL

SEQ ID NO: 1051847 - protein, 9 aa, Homo Sapiens
GGIEFSQIY

SEQ ID NO: 1051848 - protein, 9 aa, Homo Sapiens
EEPMEEVQT

SEQ ID NO: 1051849 - protein, 9 aa, Homo Sapiens
FKGRSSKVH

SEQ ID NO: 1051850 - protein, 9 aa, Homo Sapiens
HSTGRSPAS

SEQ ID NO: 1051851 - protein, 9 aa, Homo Sapiens
EARGGDRES

SEQ ID NO: 1051852 - protein, 9 aa, Homo Sapiens
SYLHTPMYF

SEQ ID NO: 1051853 - protein, 9 aa, Homo Sapiens
KQVEKIKNF

SEQ ID NO: 1051854 - protein, 9 aa, Homo Sapiens
TNEPSGDKS

SEQ ID NO: 1051855 - protein, 9 aa, Homo Sapiens
ARLVDVDGH

SEQ ID NO: 1051856 - protein, 9 aa, Homo Sapiens
TPGELPWGW

SEQ ID NO: 1051857 - protein, 9 aa, Homo Sapiens
VQNYCQEPY

SEQ ID NO: 1051858 - protein, 9 aa, Homo Sapiens
NSYVRKALN

SEQ ID NO: 1051859 - protein, 9 aa, Homo Sapiens
VTVFYFYDV

SEQ ID NO: 1051860 - protein, 9 aa, Homo Sapiens
ADGLERLAL

SEQ ID NO: 1051861 - protein, 9 aa, Homo Sapiens
NSLKEDYNQ

SEQ ID NO: 1051862 - protein, 9 aa, Homo Sapiens
NLKKEKNLT

SEQ ID NO: 1051863 - protein, 9 aa, Homo Sapiens
SEPKPTPGA

SEQ ID NO: 1051864 - protein, 9 aa, Homo Sapiens
DEQLTFEMF

SEQ ID NO: 1051865 - protein, 9 aa, Homo Sapiens
LISIVLFYI

SEQ ID NO: 1051866 - protein, 9 aa, Homo Sapiens
SPKKVRKNF

SEQ ID NO: 1051867 - protein, 9 aa, Homo Sapiens
FLRKKKESS

SEQ ID NO: 1051868 - protein, 9 aa, Homo Sapiens
PADENSCGL

SEQ ID NO: 1051869 - protein, 9 aa, Homo Sapiens
DWQRGRILF

SEQ ID NO: 1051870 - protein, 9 aa, Homo Sapiens
QVDFHTEIK

SEQ ID NO: 1051871 - protein, 9 aa, Homo Sapiens
APGAPGFPE

SEQ ID NO: 1051872 - protein, 9 aa, Homo Sapiens
NTDEIHLIE

SEQ ID NO: 1051873 - protein, 9 aa, Homo Sapiens
HYGCAFFIY

SEQ ID NO: 1051874 - protein, 9 aa, Homo Sapiens
YGDLYRAER

SEQ ID NO: 1051875 - protein, 9 aa, Homo Sapiens
SSCSTQNFW

SEQ ID NO: 1051876 - protein, 9 aa, Homo Sapiens
KIVSIEPEE

SEQ ID NO: 1051877 - protein, 9 aa, Homo Sapiens
PTPTGPPTY

SEQ ID NO: 1051878 - protein, 9 aa, Homo Sapiens
SLEPVKRSL

SEQ ID NO: 1051879 - protein, 9 aa, Homo Sapiens
LSDVTSTTF

SEQ ID NO: 1051880 - protein, 9 aa, Homo Sapiens
CSALEFTKK

SEQ ID NO: 1051881 - protein, 9 aa, Homo Sapiens
RIPLEYTVS

SEQ ID NO: 1051882 - protein, 9 aa, Homo Sapiens
VYFPLGLCL

SEQ ID NO: 1051883 - protein, 9 aa, Homo Sapiens
NFIDHQRTH

SEQ ID NO: 1051884 - protein, 9 aa, Homo Sapiens
VIASGVVSL

SEQ ID NO: 1051885 - protein, 9 aa, Homo Sapiens
VFKSLEESS

SEQ ID NO: 1051886 - protein, 9 aa, Homo Sapiens
FFHTLCDYI

SEQ ID NO: 1051887 - protein, 9 aa, Homo Sapiens
APGSGFSSE

SEQ ID NO: 1051888 - protein, 9 aa, Homo Sapiens
GKRQIESTL

SEQ ID NO: 1051889 - protein, 9 aa, Homo Sapiens
KSKDQNVSD

SEQ ID NO: 1051890 - protein, 9 aa, Homo Sapiens
LNFPKKKLE

SEQ ID NO: 1051891 - protein, 9 aa, Homo Sapiens
TLREFTRPE

SEQ ID NO: 1051892 - protein, 9 aa, Homo Sapiens
FIQRMTSII

SEQ ID NO: 1051893 - protein, 9 aa, Homo Sapiens
TIISRLRAI

SEQ ID NO: 1051894 - protein, 9 aa, Homo Sapiens
FFYQLSHFL

SEQ ID NO: 1051895 - protein, 9 aa, Homo Sapiens
KPHECDFCG

SEQ ID NO: 1051896 - protein, 9 aa, Homo Sapiens
GVKVHNAKT

SEQ ID NO: 1051897 - protein, 9 aa, Homo Sapiens
EFYQHQHQH

SEQ ID NO: 1051898 - protein, 9 aa, Homo Sapiens
GHCHSDVAT

SEQ ID NO: 1051899 - protein, 9 aa, Homo Sapiens
FNCGAHLIQ

SEQ ID NO: 1051900 - protein, 9 aa, Homo Sapiens
KWTPPRDSG

SEQ ID NO: 1051901 - protein, 9 aa, Homo Sapiens
GSILRIIVE

SEQ ID NO: 1051902 - protein, 9 aa, Homo Sapiens
LLVTAKGEN

SEQ ID NO: 1051903 - protein, 9 aa, Homo Sapiens
DFLSLLILS

SEQ ID NO: 1051904 - protein, 9 aa, Homo Sapiens
LWPDSGSFW

SEQ ID NO: 1051905 - protein, 9 aa, Homo Sapiens
TKTGMLSRV

SEQ ID NO: 1051906 - protein, 9 aa, Homo Sapiens
HHQKMNTCV

SEQ ID NO: 1051907 - protein, 9 aa, Homo Sapiens
QDSLSKELA

SEQ ID NO: 1051908 - protein, 9 aa, Homo Sapiens
FFASIISLF

SEQ ID NO: 1051909 - protein, 9 aa, Homo Sapiens
RPSNSRPGT

SEQ ID NO: 1051910 - protein, 9 aa, Homo Sapiens
LISRTKMKN

SEQ ID NO: 1051911 - protein, 9 aa, Homo Sapiens
PFCNGDTHR

SEQ ID NO: 1051912 - protein, 9 aa, Homo Sapiens
QFDYGELVY

SEQ ID NO: 1051913 - protein, 9 aa, Homo Sapiens
TKLLGCVSK

SEQ ID NO: 1051914 - protein, 9 aa, Homo Sapiens
GVYVSLCCF

SEQ ID NO: 1051915 - protein, 9 aa, Homo Sapiens
TSNMYPMPN

SEQ ID NO: 1051916 - protein, 9 aa, Homo Sapiens
REGKALNPF

SEQ ID NO: 1051917 - protein, 9 aa, Homo Sapiens
KIQTDANHT

SEQ ID NO: 1051918 - protein, 9 aa, Homo Sapiens
NSEDKLQIY

SEQ ID NO: 1051919 - protein, 9 aa, Homo Sapiens
EKSTMQKLN

SEQ ID NO: 1051920 - protein, 9 aa, Homo Sapiens
AHTDTTNKA

SEQ ID NO: 1051921 - protein, 9 aa, Homo Sapiens
FSTADPQGV

SEQ ID NO: 1051922 - protein, 9 aa, Homo Sapiens
KKEAILSHT

SEQ ID NO: 1051923 - protein, 9 aa, Homo Sapiens
ECKKSENSI

SEQ ID NO: 1051924 - protein, 9 aa, Homo Sapiens
RAFATCFRS

SEQ ID NO: 1051925 - protein, 9 aa, Homo Sapiens
AYNCGEHPI

SEQ ID NO: 1051926 - protein, 9 aa, Homo Sapiens
QQALREELE

SEQ ID NO: 1051927 - protein, 9 aa, Homo Sapiens
PDGVWAYNC

SEQ ID NO: 1051928 - protein, 9 aa, Homo Sapiens
KDANCWHLD

SEQ ID NO: 1051929 - protein, 9 aa, Homo Sapiens
PSESEARSP

SEQ ID NO: 1051930 - protein, 9 aa, Homo Sapiens
NIYNIYSLL

SEQ ID NO: 1051931 - protein, 9 aa, Homo Sapiens
LESNPSVCE

SEQ ID NO: 1051932 - protein, 9 aa, Homo Sapiens
WKCPSNKQC

SEQ ID NO: 1051933 - protein, 9 aa, Homo Sapiens
RQTVEDYPK

SEQ ID NO: 1051934 - protein, 9 aa, Homo Sapiens
FMKVARIGL

SEQ ID NO: 1051935 - protein, 9 aa, Homo Sapiens
LLETKKSLD

SEQ ID NO: 1051936 - protein, 9 aa, Homo Sapiens
RHCSAPENP

SEQ ID NO: 1051937 - protein, 9 aa, Homo Sapiens
QKIDKFMAL

SEQ ID NO: 1051938 - protein, 9 aa, Homo Sapiens
KKEAKDDSK

SEQ ID NO: 1051939 - protein, 9 aa, Homo Sapiens
FSDPSFLRL

SEQ ID NO: 1051940 - protein, 9 aa, Homo Sapiens
AVGLFLHIL

SEQ ID NO: 1051941 - protein, 9 aa, Homo Sapiens
DLEASSEPK

SEQ ID NO: 1051942 - protein, 9 aa, Homo Sapiens
TFQGRDWVP

SEQ ID NO: 1051943 - protein, 9 aa, Homo Sapiens
KLTTIGELD

SEQ ID NO: 1051944 - protein, 9 aa, Homo Sapiens
ESLLTSFLK

SEQ ID NO: 1051945 - protein, 9 aa, Homo Sapiens
ENNIRSCCL

SEQ ID NO: 1051946 - protein, 9 aa, Homo Sapiens
FNFFLRRAV

SEQ ID NO: 1051947 - protein, 9 aa, Homo Sapiens
RTDGLWGLQ

SEQ ID NO: 1051948 - protein, 9 aa, Homo Sapiens
FQVTVDVLD

SEQ ID NO: 1051949 - protein, 9 aa, Homo Sapiens
YVIASGVVS

SEQ ID NO: 1051950 - protein, 9 aa, Homo Sapiens
LKGQKKNKL

SEQ ID NO: 1051951 - protein, 9 aa, Homo Sapiens
LSSSQSLVV

SEQ ID NO: 1051952 - protein, 9 aa, Homo Sapiens
AISTFIPVI

SEQ ID NO: 1051953 - protein, 9 aa, Homo Sapiens
ILLVSENPQ

SEQ ID NO: 1051954 - protein, 9 aa, Homo Sapiens
EEESSKKEE

SEQ ID NO: 1051955 - protein, 9 aa, Homo Sapiens
RERSYELVC

SEQ ID NO: 1051956 - protein, 9 aa, Homo Sapiens
NFSFLHLNS

SEQ ID NO: 1051957 - protein, 9 aa, Homo Sapiens
ALPTVLVTE

SEQ ID NO: 1051958 - protein, 9 aa, Homo Sapiens
ECGKVFNNF

SEQ ID NO: 1051959 - protein, 9 aa, Homo Sapiens
QRGEGRPGP

SEQ ID NO: 1051960 - protein, 9 aa, Homo Sapiens
KGVKKEDKT

SEQ ID NO: 1051961 - protein, 9 aa, Homo Sapiens
EGNVQNLQK

SEQ ID NO: 1051962 - protein, 9 aa, Homo Sapiens
GTTATTELK

SEQ ID NO: 1051963 - protein, 9 aa, Homo Sapiens
NNSQLQNLP

SEQ ID NO: 1051964 - protein, 9 aa, Homo Sapiens
GQVPHSLEI

SEQ ID NO: 1051965 - protein, 9 aa, Homo Sapiens
CPEYKCVCD

SEQ ID NO: 1051966 - protein, 9 aa, Homo Sapiens
ARMIHSLSE

SEQ ID NO: 1051967 - protein, 9 aa, Homo Sapiens
RDQKQRRQR

SEQ ID NO: 1051968 - protein, 9 aa, Homo Sapiens
GGSCDPRKA

SEQ ID NO: 1051969 - protein, 9 aa, Homo Sapiens
NPTMCLEVT

SEQ ID NO: 1051970 - protein, 9 aa, Homo Sapiens
MFSGDFTQS

SEQ ID NO: 1051971 - protein, 9 aa, Homo Sapiens
VDDVMRIFG

SEQ ID NO: 1051972 - protein, 9 aa, Homo Sapiens
TDFLEDPNF

SEQ ID NO: 1051973 - protein, 9 aa, Homo Sapiens
PRSGKLPSP

SEQ ID NO: 1051974 - protein, 9 aa, Homo Sapiens
FFLAFMAYD

SEQ ID NO: 1051975 - protein, 9 aa, Homo Sapiens
SVDSGTIKA

SEQ ID NO: 1051976 - protein, 9 aa, Homo Sapiens
RGSLRADDL

SEQ ID NO: 1051977 - protein, 9 aa, Homo Sapiens
GTKTTSTTL

SEQ ID NO: 1051978 - protein, 9 aa, Homo Sapiens
FIKSTNEAT

SEQ ID NO: 1051979 - protein, 9 aa, Homo Sapiens
AGKFARAVK

SEQ ID NO: 1051980 - protein, 9 aa, Homo Sapiens
DGNIYVLKV

SEQ ID NO: 1051981 - protein, 9 aa, Homo Sapiens
FHDPYRQQS

SEQ ID NO: 1051982 - protein, 9 aa, Homo Sapiens
SPGRGHLLV

SEQ ID NO: 1051983 - protein, 9 aa, Homo Sapiens
KMQAFFGLT

SEQ ID NO: 1051984 - protein, 9 aa, Homo Sapiens
SHPNSDSMR

SEQ ID NO: 1051985 - protein, 9 aa, Homo Sapiens
EKARLSSSP

SEQ ID NO: 1051986 - protein, 9 aa, Homo Sapiens
LQLLKQEHE

SEQ ID NO: 1051987 - protein, 9 aa, Homo Sapiens
APPARLPTT

SEQ ID NO: 1051988 - protein, 9 aa, Homo Sapiens
SATRMVQLV

SEQ ID NO: 1051989 - protein, 9 aa, Homo Sapiens
ILDGTDCHR

SEQ ID NO: 1051990 - protein, 9 aa, Homo Sapiens
STFVCPSRE

SEQ ID NO: 1051991 - protein, 9 aa, Homo Sapiens
ALLLPLVIP

SEQ ID NO: 1051992 - protein, 9 aa, Homo Sapiens
PYGKSVNWW

SEQ ID NO: 1051993 - protein, 9 aa, Homo Sapiens
AEGVQKDPP

SEQ ID NO: 1051994 - protein, 9 aa, Homo Sapiens
ETTLEKMVP

SEQ ID NO: 1051995 - protein, 9 aa, Homo Sapiens
SPFNKQQYK

SEQ ID NO: 1051996 - protein, 9 aa, Homo Sapiens
HPSQGMKST

SEQ ID NO: 1051997 - protein, 9 aa, Homo Sapiens
VNWIALVVI

SEQ ID NO: 1051998 - protein, 9 aa, Homo Sapiens
QKIILDQLE

SEQ ID NO: 1051999 - protein, 9 aa, Homo Sapiens
AVEIKVESS

SEQ ID NO: 1052000 - protein, 9 aa, Homo Sapiens
KGTLSVMKD

SEQ ID NO: 1052001 - protein, 9 aa, Homo Sapiens
VCEEVIDFS

SEQ ID NO: 1052002 - protein, 9 aa, Homo Sapiens
PAMYSFLET

SEQ ID NO: 1052003 - protein, 9 aa, Homo Sapiens
KPLQLDFFD

SEQ ID NO: 1052004 - protein, 9 aa, Homo Sapiens
VQGEQIQLK

SEQ ID NO: 1052005 - protein, 9 aa, Homo Sapiens
MGNGFYFLA

SEQ ID NO: 1052006 - protein, 9 aa, Homo Sapiens
AGLAVHLKA

SEQ ID NO: 1052007 - protein, 9 aa, Homo Sapiens
AVDPDCRLC

SEQ ID NO: 1052008 - protein, 9 aa, Homo Sapiens
LLLSRERNF

SEQ ID NO: 1052009 - protein, 9 aa, Homo Sapiens
QEGWNFQPP

SEQ ID NO: 1052010 - protein, 9 aa, Homo Sapiens
DIWTQKENI

SEQ ID NO: 1052011 - protein, 9 aa, Homo Sapiens
SEKDEPTYI

SEQ ID NO: 1052012 - protein, 9 aa, Homo Sapiens
LPFSSHHQR

SEQ ID NO: 1052013 - protein, 9 aa, Homo Sapiens
KKKDGPVNP

SEQ ID NO: 1052014 - protein, 9 aa, Homo Sapiens
WMSYVSIIA

SEQ ID NO: 1052015 - protein, 9 aa, Homo Sapiens
GDRPPHIIY

SEQ ID NO: 1052016 - protein, 9 aa, Homo Sapiens
LEPPQKHRI

SEQ ID NO: 1052017 - protein, 9 aa, Homo Sapiens
LFLFLVLLF

SEQ ID NO: 1052018 - protein, 9 aa, Homo Sapiens
FKLDSKTGK

SEQ ID NO: 1052019 - protein, 9 aa, Homo Sapiens
LSLMAAGKF

SEQ ID NO: 1052020 - protein, 9 aa, Homo Sapiens
PPAEIPSYL

SEQ ID NO: 1052021 - protein, 9 aa, Homo Sapiens
SKVLGRPTT

SEQ ID NO: 1052022 - protein, 9 aa, Homo Sapiens
DGLTTLRNE

SEQ ID NO: 1052023 - protein, 9 aa, Homo Sapiens
LRPHQSELE

SEQ ID NO: 1052024 - protein, 9 aa, Homo Sapiens
QRFSLFLHS

SEQ ID NO: 1052025 - protein, 9 aa, Homo Sapiens
QGLPCPEPQ

SEQ ID NO: 1052026 - protein, 9 aa, Homo Sapiens
NKGAKGSRK

SEQ ID NO: 1052027 - protein, 9 aa, Homo Sapiens
GLYVELHSE

SEQ ID NO: 1052028 - protein, 9 aa, Homo Sapiens
YNQGYAGST

SEQ ID NO: 1052029 - protein, 9 aa, Homo Sapiens
GPVAKKSSS

SEQ ID NO: 1052030 - protein, 9 aa, Homo Sapiens
NKKNNIAEI

SEQ ID NO: 1052031 - protein, 9 aa, Homo Sapiens
PGERREKGE

SEQ ID NO: 1052032 - protein, 9 aa, Homo Sapiens
LLLLSRERN

SEQ ID NO: 1052033 - protein, 9 aa, Homo Sapiens
NENDNVPIC

SEQ ID NO: 1052034 - protein, 9 aa, Homo Sapiens
VGEPSISLA

SEQ ID NO: 1052035 - protein, 9 aa, Homo Sapiens
QPHVPFILG

SEQ ID NO: 1052036 - protein, 9 aa, Homo Sapiens
IYGDIPPEI

SEQ ID NO: 1052037 - protein, 9 aa, Homo Sapiens
KADGPNDVS

SEQ ID NO: 1052038 - protein, 9 aa, Homo Sapiens
VRKSDQRSP

SEQ ID NO: 1052039 - protein, 9 aa, Homo Sapiens
CKIRNTDTC

SEQ ID NO: 1052040 - protein, 9 aa, Homo Sapiens
LTLFLISLM

SEQ ID NO: 1052041 - protein, 9 aa, Homo Sapiens
WLFFFLWPL

SEQ ID NO: 1052042 - protein, 9 aa, Homo Sapiens
VHDVNHPGR

SEQ ID NO: 1052043 - protein, 9 aa, Homo Sapiens
CTLVRTGPS

SEQ ID NO: 1052044 - protein, 9 aa, Homo Sapiens
SHCGSRSQS

SEQ ID NO: 1052045 - protein, 9 aa, Homo Sapiens
LGDCILKLN

SEQ ID NO: 1052046 - protein, 9 aa, Homo Sapiens
LITYNKGRN

SEQ ID NO: 1052047 - protein, 9 aa, Homo Sapiens
HPSYTNTPV

SEQ ID NO: 1052048 - protein, 9 aa, Homo Sapiens
PDSFSFLDS

SEQ ID NO: 1052049 - protein, 9 aa, Homo Sapiens
KQTSSLPEP

SEQ ID NO: 1052050 - protein, 9 aa, Homo Sapiens
IQTIMLFIM

SEQ ID NO: 1052051 - protein, 9 aa, Homo Sapiens
VVYSIFYAT

SEQ ID NO: 1052052 - protein, 9 aa, Homo Sapiens
KIQLQKDPG

SEQ ID NO: 1052053 - protein, 9 aa, Homo Sapiens
TLLSYVYFL

SEQ ID NO: 1052054 - protein, 9 aa, Homo Sapiens
EDDEFEEFL

SEQ ID NO: 1052055 - protein, 9 aa, Homo Sapiens
TAYFSPQEL

SEQ ID NO: 1052056 - protein, 9 aa, Homo Sapiens
SFLESLQTA

SEQ ID NO: 1052057 - protein, 9 aa, Homo Sapiens
EAARRLVST

SEQ ID NO: 1052058 - protein, 9 aa, Homo Sapiens
DGKQLSNSY

SEQ ID NO: 1052059 - protein, 9 aa, Homo Sapiens
IIEQPLYSL

SEQ ID NO: 1052060 - protein, 9 aa, Homo Sapiens
GQLHYSIPK

SEQ ID NO: 1052061 - protein, 9 aa, Homo Sapiens
TTDVISVCK

SEQ ID NO: 1052062 - protein, 9 aa, Homo Sapiens
VSSSLILYL

SEQ ID NO: 1052063 - protein, 9 aa, Homo Sapiens
KHIPLYKWE

SEQ ID NO: 1052064 - protein, 9 aa, Homo Sapiens
AKYNLPATI

SEQ ID NO: 1052065 - protein, 9 aa, Homo Sapiens
GSSDPLETR

SEQ ID NO: 1052066 - protein, 9 aa, Homo Sapiens
LMDFFVERK

SEQ ID NO: 1052067 - protein, 9 aa, Homo Sapiens
TPAQTSLAA

SEQ ID NO: 1052068 - protein, 9 aa, Homo Sapiens
QKAREKNPG

SEQ ID NO: 1052069 - protein, 9 aa, Homo Sapiens
RRPNLDSAN

SEQ ID NO: 1052070 - protein, 9 aa, Homo Sapiens
DVKNGECFC

SEQ ID NO: 1052071 - protein, 9 aa, Homo Sapiens
VARLGVASL

SEQ ID NO: 1052072 - protein, 9 aa, Homo Sapiens
LSHFCCVHR

SEQ ID NO: 1052073 - protein, 9 aa, Homo Sapiens
EELELEGGE

SEQ ID NO: 1052074 - protein, 9 aa, Homo Sapiens
NLKVMMEAY

SEQ ID NO: 1052075 - protein, 9 aa, Homo Sapiens
ITSELGDSG

SEQ ID NO: 1052076 - protein, 9 aa, Homo Sapiens
LKFLNDTMH

SEQ ID NO: 1052077 - protein, 9 aa, Homo Sapiens
GGSGNGMIK

SEQ ID NO: 1052078 - protein, 9 aa, Homo Sapiens
DCSIQDPVR

SEQ ID NO: 1052079 - protein, 9 aa, Homo Sapiens
FIYIEKQLH

SEQ ID NO: 1052080 - protein, 9 aa, Homo Sapiens
CTLTAHKGR

SEQ ID NO: 1052081 - protein, 9 aa, Homo Sapiens
SVSMSLRVY

SEQ ID NO: 1052082 - protein, 9 aa, Homo Sapiens
LTHQSLAGE

SEQ ID NO: 1052083 - protein, 9 aa, Homo Sapiens
QEAFRNLVS

SEQ ID NO: 1052084 - protein, 9 aa, Homo Sapiens
YCTSSACKT

SEQ ID NO: 1052085 - protein, 9 aa, Homo Sapiens
EISLRRLYL

SEQ ID NO: 1052086 - protein, 9 aa, Homo Sapiens
TSEFKRAAR

SEQ ID NO: 1052087 - protein, 9 aa, Homo Sapiens
MGSLGEMGY

SEQ ID NO: 1052088 - protein, 9 aa, Homo Sapiens
SSTRIQDNV

SEQ ID NO: 1052089 - protein, 9 aa, Homo Sapiens
AIGSLRPPS

SEQ ID NO: 1052090 - protein, 9 aa, Homo Sapiens
RANSWDGEA

SEQ ID NO: 1052091 - protein, 9 aa, Homo Sapiens
RMIEVVEDT

SEQ ID NO: 1052092 - protein, 9 aa, Homo Sapiens
NNLGEEKNG

SEQ ID NO: 1052093 - protein, 9 aa, Homo Sapiens
LVRRLLLLI

SEQ ID NO: 1052094 - protein, 9 aa, Homo Sapiens
SYALVSLFF

SEQ ID NO: 1052095 - protein, 9 aa, Homo Sapiens
SWTTNNVVQ

SEQ ID NO: 1052096 - protein, 9 aa, Homo Sapiens
AVSSMSYYQ

SEQ ID NO: 1052097 - protein, 9 aa, Homo Sapiens
TNLIDTELM

SEQ ID NO: 1052098 - protein, 9 aa, Homo Sapiens
VVFQMSSEK

SEQ ID NO: 1052099 - protein, 9 aa, Homo Sapiens
TSADTIRAF

SEQ ID NO: 1052100 - protein, 9 aa, Homo Sapiens
SPVPPASST

SEQ ID NO: 1052101 - protein, 9 aa, Homo Sapiens
HSSTRFHSA

SEQ ID NO: 1052102 - protein, 9 aa, Homo Sapiens
HLIEVRLTQ

SEQ ID NO: 1052103 - protein, 9 aa, Homo Sapiens
LQLPQYPGL

SEQ ID NO: 1052104 - protein, 9 aa, Homo Sapiens
EMCSGHSQC

SEQ ID NO: 1052105 - protein, 9 aa, Homo Sapiens
SEDTPRGHP

SEQ ID NO: 1052106 - protein, 9 aa, Homo Sapiens
SAEACPETR

SEQ ID NO: 1052107 - protein, 9 aa, Homo Sapiens
TPAKKKMEL

SEQ ID NO: 1052108 - protein, 9 aa, Homo Sapiens
STDLLQHEA

SEQ ID NO: 1052109 - protein, 9 aa, Homo Sapiens
SDERSPSAS

SEQ ID NO: 1052110 - protein, 9 aa, Homo Sapiens
MAVGLFLHI

SEQ ID NO: 1052111 - protein, 9 aa, Homo Sapiens
ETEKAAGEV

SEQ ID NO: 1052112 - protein, 9 aa, Homo Sapiens
VQEKIPKLR

SEQ ID NO: 1052113 - protein, 9 aa, Homo Sapiens
QLLSSENNL

SEQ ID NO: 1052114 - protein, 9 aa, Homo Sapiens
RKKEEEAKK

SEQ ID NO: 1052115 - protein, 9 aa, Homo Sapiens
CGVTVALKL

SEQ ID NO: 1052116 - protein, 9 aa, Homo Sapiens
QGPFGQPGY

SEQ ID NO: 1052117 - protein, 9 aa, Homo Sapiens
EEIYVGLEA

SEQ ID NO: 1052118 - protein, 9 aa, Homo Sapiens
SVCLGITSG

SEQ ID NO: 1052119 - protein, 9 aa, Homo Sapiens
PGIKSPIII

SEQ ID NO: 1052120 - protein, 9 aa, Homo Sapiens
TLSAGNLGG

SEQ ID NO: 1052121 - protein, 9 aa, Homo Sapiens
SNSLQAMKE

SEQ ID NO: 1052122 - protein, 9 aa, Homo Sapiens
PFMKSLGNK

SEQ ID NO: 1052123 - protein, 9 aa, Homo Sapiens
MGQPQALMG

SEQ ID NO: 1052124 - protein, 9 aa, Homo Sapiens
DSANVAVLP

SEQ ID NO: 1052125 - protein, 9 aa, Homo Sapiens
TGGFRSDLD

SEQ ID NO: 1052126 - protein, 9 aa, Homo Sapiens
SKKLGKTLE

SEQ ID NO: 1052127 - protein, 9 aa, Homo Sapiens
LVKGAKGTR

SEQ ID NO: 1052128 - protein, 9 aa, Homo Sapiens
YIIRGDNEE

SEQ ID NO: 1052129 - protein, 9 aa, Homo Sapiens
SGFFQTRMG

SEQ ID NO: 1052130 - protein, 9 aa, Homo Sapiens
NGVKYKSEL

SEQ ID NO: 1052131 - protein, 9 aa, Homo Sapiens
ESAEARVGF

SEQ ID NO: 1052132 - protein, 9 aa, Homo Sapiens
LFKVAFSRG

SEQ ID NO: 1052133 - protein, 9 aa, Homo Sapiens
CNETCAKER

SEQ ID NO: 1052134 - protein, 9 aa, Homo Sapiens
PKTGIIRTA

SEQ ID NO: 1052135 - protein, 9 aa, Homo Sapiens
QKLMGCLGV

SEQ ID NO: 1052136 - protein, 9 aa, Homo Sapiens
WLEHSSAFY

SEQ ID NO: 1052137 - protein, 9 aa, Homo Sapiens
ESGSNSWER

SEQ ID NO: 1052138 - protein, 9 aa, Homo Sapiens
WYKNLSGLR

SEQ ID NO: 1052139 - protein, 9 aa, Homo Sapiens
KEDGVQDLL

SEQ ID NO: 1052140 - protein, 9 aa, Homo Sapiens
ENGSSGFRF

SEQ ID NO: 1052141 - protein, 9 aa, Homo Sapiens
IYTREKPYK

SEQ ID NO: 1052142 - protein, 9 aa, Homo Sapiens
GYVISLAGA

SEQ ID NO: 1052143 - protein, 9 aa, Homo Sapiens
EARVGFPKV

SEQ ID NO: 1052144 - protein, 9 aa, Homo Sapiens
QIKREQYIT

SEQ ID NO: 1052145 - protein, 9 aa, Homo Sapiens
PYMMMNPET

SEQ ID NO: 1052146 - protein, 9 aa, Homo Sapiens
NPGMPQNGT

SEQ ID NO: 1052147 - protein, 9 aa, Homo Sapiens
SDALYAAFL

SEQ ID NO: 1052148 - protein, 9 aa, Homo Sapiens
PQQLFGRLS

SEQ ID NO: 1052149 - protein, 9 aa, Homo Sapiens
EQAGGGGGG

SEQ ID NO: 1052150 - protein, 9 aa, Homo Sapiens
RCPPKCLPK

SEQ ID NO: 1052151 - protein, 9 aa, Homo Sapiens
GPFWDSDNK

SEQ ID NO: 1052152 - protein, 9 aa, Homo Sapiens
ASGKELAVA

SEQ ID NO: 1052153 - protein, 9 aa, Homo Sapiens
DREKQPSKG

SEQ ID NO: 1052154 - protein, 9 aa, Homo Sapiens
PSIPCMLGA

SEQ ID NO: 1052155 - protein, 9 aa, Homo Sapiens
EDPNPSAAP

SEQ ID NO: 1052156 - protein, 9 aa, Homo Sapiens
NPIIYTLKN

SEQ ID NO: 1052157 - protein, 9 aa, Homo Sapiens
AEPFQDLRL

SEQ ID NO: 1052158 - protein, 9 aa, Homo Sapiens
VYVLSEEKK

SEQ ID NO: 1052159 - protein, 9 aa, Homo Sapiens
SKNPERELG

SEQ ID NO: 1052160 - protein, 9 aa, Homo Sapiens
FLRLHLRIH

SEQ ID NO: 1052161 - protein, 9 aa, Homo Sapiens
QGKVKGSPS

SEQ ID NO: 1052162 - protein, 9 aa, Homo Sapiens
ERTADQADQ

SEQ ID NO: 1052163 - protein, 9 aa, Homo Sapiens
SNSEDKLQI

SEQ ID NO: 1052164 - protein, 9 aa, Homo Sapiens
SVKKTFFGV

SEQ ID NO: 1052165 - protein, 9 aa, Homo Sapiens
DKSLNPQLL

SEQ ID NO: 1052166 - protein, 9 aa, Homo Sapiens
WARYDTEEK

SEQ ID NO: 1052167 - protein, 9 aa, Homo Sapiens
HSCVTDSEP

SEQ ID NO: 1052168 - protein, 9 aa, Homo Sapiens
KDSAQEIAT

SEQ ID NO: 1052169 - protein, 9 aa, Homo Sapiens
NPDTQRQRT

SEQ ID NO: 1052170 - protein, 9 aa, Homo Sapiens
HKCSKCSNL

SEQ ID NO: 1052171 - protein, 9 aa, Homo Sapiens
DAERDLVRL

SEQ ID NO: 1052172 - protein, 9 aa, Homo Sapiens
TEALDSIFL

SEQ ID NO: 1052173 - protein, 9 aa, Homo Sapiens
LYSATPSTP

SEQ ID NO: 1052174 - protein, 9 aa, Homo Sapiens
EYEDTMFTM

SEQ ID NO: 1052175 - protein, 9 aa, Homo Sapiens
QPRCLRAGG

SEQ ID NO: 1052176 - protein, 9 aa, Homo Sapiens
EKALDKAQE

SEQ ID NO: 1052177 - protein, 9 aa, Homo Sapiens
GTGIMLSSW

SEQ ID NO: 1052178 - protein, 9 aa, Homo Sapiens
GRTHFMDFL

SEQ ID NO: 1052179 - protein, 9 aa, Homo Sapiens
NQMNLGAIL

SEQ ID NO: 1052180 - protein, 9 aa, Homo Sapiens
SPPEDRPGE

SEQ ID NO: 1052181 - protein, 9 aa, Homo Sapiens
AMKWNCAFM

SEQ ID NO: 1052182 - protein, 9 aa, Homo Sapiens
SPTTPGELP

SEQ ID NO: 1052183 - protein, 9 aa, Homo Sapiens
ALVCAYNPE

SEQ ID NO: 1052184 - protein, 9 aa, Homo Sapiens
HERKSSDKR

SEQ ID NO: 1052185 - protein, 9 aa, Homo Sapiens
EQNLERVLS

SEQ ID NO: 1052186 - protein, 9 aa, Homo Sapiens
QNKRLREQQ

SEQ ID NO: 1052187 - protein, 9 aa, Homo Sapiens
HCNVIYNVN

SEQ ID NO: 1052188 - protein, 9 aa, Homo Sapiens
KPIQNSHYG

SEQ ID NO: 1052189 - protein, 9 aa, Homo Sapiens
FLAGKAGDQ

SEQ ID NO: 1052190 - protein, 9 aa, Homo Sapiens
CRQEVNECN

SEQ ID NO: 1052191 - protein, 9 aa, Homo Sapiens
LEDNEDSRR

SEQ ID NO: 1052192 - protein, 9 aa, Homo Sapiens
IDLCLKKST

SEQ ID NO: 1052193 - protein, 9 aa, Homo Sapiens
SVQKLMGCL

SEQ ID NO: 1052194 - protein, 9 aa, Homo Sapiens
SLWVEYEFR

SEQ ID NO: 1052195 - protein, 9 aa, Homo Sapiens
EMMMESVKA

SEQ ID NO: 1052196 - protein, 9 aa, Homo Sapiens
KEPQKHSCV

SEQ ID NO: 1052197 - protein, 9 aa, Homo Sapiens
FGFGSGSGF

SEQ ID NO: 1052198 - protein, 9 aa, Homo Sapiens
GAAQPRCLR

SEQ ID NO: 1052199 - protein, 9 aa, Homo Sapiens
PFDPQQLFA

SEQ ID NO: 1052200 - protein, 9 aa, Homo Sapiens
DELFSSRDS

SEQ ID NO: 1052201 - protein, 9 aa, Homo Sapiens
DGSDLISTN

SEQ ID NO: 1052202 - protein, 9 aa, Homo Sapiens
QQSLALGIQ

SEQ ID NO: 1052203 - protein, 9 aa, Homo Sapiens
HWGACPLPS

SEQ ID NO: 1052204 - protein, 9 aa, Homo Sapiens
PSLEWETKA

SEQ ID NO: 1052205 - protein, 9 aa, Homo Sapiens
GRKKGQGNS

SEQ ID NO: 1052206 - protein, 9 aa, Homo Sapiens
PKPVKPFLF

SEQ ID NO: 1052207 - protein, 9 aa, Homo Sapiens
EKKTEAKIA

SEQ ID NO: 1052208 - protein, 9 aa, Homo Sapiens
NAWLLYELQ

SEQ ID NO: 1052209 - protein, 9 aa, Homo Sapiens
KNPKKSRQE

SEQ ID NO: 1052210 - protein, 9 aa, Homo Sapiens
QRSPGIFTD

SEQ ID NO: 1052211 - protein, 9 aa, Homo Sapiens
LSDIDLTYI

SEQ ID NO: 1052212 - protein, 9 aa, Homo Sapiens
FSVEPKTGI

SEQ ID NO: 1052213 - protein, 9 aa, Homo Sapiens
KKVTKAKRL

SEQ ID NO: 1052214 - protein, 9 aa, Homo Sapiens
QVQNSTLSE

SEQ ID NO: 1052215 - protein, 9 aa, Homo Sapiens
ILKQNFRDL

SEQ ID NO: 1052216 - protein, 9 aa, Homo Sapiens
YKSLPLAMK

SEQ ID NO: 1052217 - protein, 9 aa, Homo Sapiens
PFYISVLED

SEQ ID NO: 1052218 - protein, 9 aa, Homo Sapiens
RTKMKNILG

SEQ ID NO: 1052219 - protein, 9 aa, Homo Sapiens
NAPLLQKII

SEQ ID NO: 1052220 - protein, 9 aa, Homo Sapiens
VYILDNDTV

SEQ ID NO: 1052221 - protein, 9 aa, Homo Sapiens
AAALVFGGV

SEQ ID NO: 1052222 - protein, 9 aa, Homo Sapiens
SCKAEEGLN

SEQ ID NO: 1052223 - protein, 9 aa, Homo Sapiens
PLYDQNHVT

SEQ ID NO: 1052224 - protein, 9 aa, Homo Sapiens
VHILLIKRL

SEQ ID NO: 1052225 - protein, 9 aa, Homo Sapiens
LNPINFIQP

SEQ ID NO: 1052226 - protein, 9 aa, Homo Sapiens
IMDLYGQPK

SEQ ID NO: 1052227 - protein, 9 aa, Homo Sapiens
NFPDYCIRD

SEQ ID NO: 1052228 - protein, 9 aa, Homo Sapiens
VTYDKEGGG

SEQ ID NO: 1052229 - protein, 9 aa, Homo Sapiens
GLLTIWLHD

SEQ ID NO: 1052230 - protein, 9 aa, Homo Sapiens
AIYPTPVEL

SEQ ID NO: 1052231 - protein, 9 aa, Homo Sapiens
HPREFQKFP

SEQ ID NO: 1052232 - protein, 9 aa, Homo Sapiens
APETAGESL

SEQ ID NO: 1052233 - protein, 9 aa, Homo Sapiens
KAMGDEESR

SEQ ID NO: 1052234 - protein, 9 aa, Homo Sapiens
WKEMSLFSS

SEQ ID NO: 1052235 - protein, 9 aa, Homo Sapiens
CNHPSWIFT

SEQ ID NO: 1052236 - protein, 9 aa, Homo Sapiens
EKQRRKDKT

SEQ ID NO: 1052237 - protein, 9 aa, Homo Sapiens
YRTCDNPPL

SEQ ID NO: 1052238 - protein, 9 aa, Homo Sapiens
GHPCLDLCG

SEQ ID NO: 1052239 - protein, 9 aa, Homo Sapiens
GLLPRVPWF

SEQ ID NO: 1052240 - protein, 9 aa, Homo Sapiens
VNECNLPEW

SEQ ID NO: 1052241 - protein, 9 aa, Homo Sapiens
YYGQGFPFF

SEQ ID NO: 1052242 - protein, 9 aa, Homo Sapiens
VKNLRVVDA

SEQ ID NO: 1052243 - protein, 9 aa, Homo Sapiens
LMCLFCQPL

SEQ ID NO: 1052244 - protein, 9 aa, Homo Sapiens
IMKYLGGGS

SEQ ID NO: 1052245 - protein, 9 aa, Homo Sapiens
WPSLSETPT

SEQ ID NO: 1052246 - protein, 9 aa, Homo Sapiens
VGSNQRQSI

SEQ ID NO: 1052247 - protein, 9 aa, Homo Sapiens
PWQTMARNR

SEQ ID NO: 1052248 - protein, 9 aa, Homo Sapiens
PSSGPGQAL

SEQ ID NO: 1052249 - protein, 9 aa, Homo Sapiens
QKEINRKNA

SEQ ID NO: 1052250 - protein, 9 aa, Homo Sapiens
DSGKPRVGK

SEQ ID NO: 1052251 - protein, 9 aa, Homo Sapiens
LISGESKDL

SEQ ID NO: 1052252 - protein, 9 aa, Homo Sapiens
ARWDTTLST

SEQ ID NO: 1052253 - protein, 9 aa, Homo Sapiens
AHRQSYGPF

SEQ ID NO: 1052254 - protein, 9 aa, Homo Sapiens
FMMTCEDID

SEQ ID NO: 1052255 - protein, 9 aa, Homo Sapiens
GESGELDFL

SEQ ID NO: 1052256 - protein, 9 aa, Homo Sapiens
KSDGPFWDS

SEQ ID NO: 1052257 - protein, 9 aa, Homo Sapiens
PLRLSVEIT

SEQ ID NO: 1052258 - protein, 9 aa, Homo Sapiens
RDETIQVKE

SEQ ID NO: 1052259 - protein, 9 aa, Homo Sapiens
PKLPPPLWA

SEQ ID NO: 1052260 - protein, 9 aa, Homo Sapiens
NATVVGLSL

SEQ ID NO: 1052261 - protein, 9 aa, Homo Sapiens
PPPAGRPKV

SEQ ID NO: 1052262 - protein, 9 aa, Homo Sapiens
NKEELGQLQ

SEQ ID NO: 1052263 - protein, 9 aa, Homo Sapiens
KSIISAIVH

SEQ ID NO: 1052264 - protein, 9 aa, Homo Sapiens
NDKNYIHPT

SEQ ID NO: 1052265 - protein, 9 aa, Homo Sapiens
LTAHKGRGG

SEQ ID NO: 1052266 - protein, 9 aa, Homo Sapiens
QENKVFMRK

SEQ ID NO: 1052267 - protein, 9 aa, Homo Sapiens
QGLLSPGMT

SEQ ID NO: 1052268 - protein, 9 aa, Homo Sapiens
NLRPIFKSK

SEQ ID NO: 1052269 - protein, 9 aa, Homo Sapiens
ELLDESKMF

SEQ ID NO: 1052270 - protein, 9 aa, Homo Sapiens
ENSHPPHPH

SEQ ID NO: 1052271 - protein, 9 aa, Homo Sapiens
FGNLQINAY

SEQ ID NO: 1052272 - protein, 9 aa, Homo Sapiens
DLHYTTFDG

SEQ ID NO: 1052273 - protein, 9 aa, Homo Sapiens
EPFQDLRLE

SEQ ID NO: 1052274 - protein, 9 aa, Homo Sapiens
TPNPRLQSA

SEQ ID NO: 1052275 - protein, 9 aa, Homo Sapiens
FFLKLVRDK

SEQ ID NO: 1052276 - protein, 9 aa, Homo Sapiens
GSDLISTNA

SEQ ID NO: 1052277 - protein, 9 aa, Homo Sapiens
LSKDIMVYF

SEQ ID NO: 1052278 - protein, 9 aa, Homo Sapiens
QKRWERFVH

SEQ ID NO: 1052279 - protein, 9 aa, Homo Sapiens
GLTNPKPSF

SEQ ID NO: 1052280 - protein, 9 aa, Homo Sapiens
EKIAGDHSE

SEQ ID NO: 1052281 - protein, 9 aa, Homo Sapiens
FLESLQTAV

SEQ ID NO: 1052282 - protein, 9 aa, Homo Sapiens
PFLLILIFY

SEQ ID NO: 1052283 - protein, 9 aa, Homo Sapiens
HSTAFSEAS

SEQ ID NO: 1052284 - protein, 9 aa, Homo Sapiens
EVKKYLDVI

SEQ ID NO: 1052285 - protein, 9 aa, Homo Sapiens
SEPMDKNCY

SEQ ID NO: 1052286 - protein, 9 aa, Homo Sapiens
RFWKEMSLF

SEQ ID NO: 1052287 - protein, 9 aa, Homo Sapiens
RKQDIGMPK

SEQ ID NO: 1052288 - protein, 9 aa, Homo Sapiens
YEKLTMLNR

SEQ ID NO: 1052289 - protein, 9 aa, Homo Sapiens
KAWKLEVGE

SEQ ID NO: 1052290 - protein, 9 aa, Homo Sapiens
KDKCVPRSQ

SEQ ID NO: 1052291 - protein, 9 aa, Homo Sapiens
IFVLAMTMS

SEQ ID NO: 1052292 - protein, 9 aa, Homo Sapiens
SFNNIENKP

SEQ ID NO: 1052293 - protein, 9 aa, Homo Sapiens
GSRPRKEWE

SEQ ID NO: 1052294 - protein, 9 aa, Homo Sapiens
KHQNQDTEN

SEQ ID NO: 1052295 - protein, 9 aa, Homo Sapiens
PVDKFLFVF

SEQ ID NO: 1052296 - protein, 9 aa, Homo Sapiens
GDALNHTTE

SEQ ID NO: 1052297 - protein, 9 aa, Homo Sapiens
TCSATEAAR

SEQ ID NO: 1052298 - protein, 9 aa, Homo Sapiens
SSTRFHSAR

SEQ ID NO: 1052299 - protein, 9 aa, Homo Sapiens
MGNVLQSFS

SEQ ID NO: 1052300 - protein, 9 aa, Homo Sapiens
EIKGEDGDG

SEQ ID NO: 1052301 - protein, 9 aa, Homo Sapiens
RTNLIDTEL

SEQ ID NO: 1052302 - protein, 9 aa, Homo Sapiens
FKLDGGLNI

SEQ ID NO: 1052303 - protein, 9 aa, Homo Sapiens
KTSFREKGQ

SEQ ID NO: 1052304 - protein, 9 aa, Homo Sapiens
QWFVYQAAK

SEQ ID NO: 1052305 - protein, 9 aa, Homo Sapiens
FLSALFFSE

SEQ ID NO: 1052306 - protein, 9 aa, Homo Sapiens
AFSLDIGIC

SEQ ID NO: 1052307 - protein, 9 aa, Homo Sapiens
EISYSSIRL

SEQ ID NO: 1052308 - protein, 9 aa, Homo Sapiens
EGKRNKLQP

SEQ ID NO: 1052309 - protein, 9 aa, Homo Sapiens
QSPSSVRLS

SEQ ID NO: 1052310 - protein, 9 aa, Homo Sapiens
GLEHSSNPS

SEQ ID NO: 1052311 - protein, 9 aa, Homo Sapiens
LSSCKAEEG

SEQ ID NO: 1052312 - protein, 9 aa, Homo Sapiens
EIFSVALLD

SEQ ID NO: 1052313 - protein, 9 aa, Homo Sapiens
LKQYPTPYP

SEQ ID NO: 1052314 - protein, 9 aa, Homo Sapiens
NTATFEAPF

SEQ ID NO: 1052315 - protein, 9 aa, Homo Sapiens
FGVYVSLCC

SEQ ID NO: 1052316 - protein, 9 aa, Homo Sapiens
YVEMKWFHK

SEQ ID NO: 1052317 - protein, 9 aa, Homo Sapiens
KPLNYEKQK

SEQ ID NO: 1052318 - protein, 9 aa, Homo Sapiens
NNPDTQRQR

SEQ ID NO: 1052319 - protein, 9 aa, Homo Sapiens
VTHDFLRSE

SEQ ID NO: 1052320 - protein, 9 aa, Homo Sapiens
HKTRNHLRL

SEQ ID NO: 1052321 - protein, 9 aa, Homo Sapiens
ARTLSAFFW

SEQ ID NO: 1052322 - protein, 9 aa, Homo Sapiens
EEGAGDTHN

SEQ ID NO: 1052323 - protein, 9 aa, Homo Sapiens
RFPGFPGAN

SEQ ID NO: 1052324 - protein, 9 aa, Homo Sapiens
RIEKYGAFI

SEQ ID NO: 1052325 - protein, 9 aa, Homo Sapiens
ETRAQSVTQ

SEQ ID NO: 1052326 - protein, 9 aa, Homo Sapiens
SQNGHKEGA

SEQ ID NO: 1052327 - protein, 9 aa, Homo Sapiens
TGRSPASAS

SEQ ID NO: 1052328 - protein, 9 aa, Homo Sapiens
LFQTSHKDL

SEQ ID NO: 1052329 - protein, 9 aa, Homo Sapiens
CCVCKSCQG

SEQ ID NO: 1052330 - protein, 9 aa, Homo Sapiens
FMGNFVMVL

SEQ ID NO: 1052331 - protein, 9 aa, Homo Sapiens
CRKNCLKLM

SEQ ID NO: 1052332 - protein, 9 aa, Homo Sapiens
LQCFLHKEE

SEQ ID NO: 1052333 - protein, 9 aa, Homo Sapiens
YDFPWGNAG

SEQ ID NO: 1052334 - protein, 9 aa, Homo Sapiens
VDSTLAPLT

SEQ ID NO: 1052335 - protein, 9 aa, Homo Sapiens
NKFDLVCGM

SEQ ID NO: 1052336 - protein, 9 aa, Homo Sapiens
TQSFDSGSV

SEQ ID NO: 1052337 - protein, 9 aa, Homo Sapiens
FYGRDSGNE

SEQ ID NO: 1052338 - protein, 9 aa, Homo Sapiens
ATLGFFFSD

SEQ ID NO: 1052339 - protein, 9 aa, Homo Sapiens
SKDHKYSYQ

SEQ ID NO: 1052340 - protein, 9 aa, Homo Sapiens
VSLLALSCS

SEQ ID NO: 1052341 - protein, 9 aa, Homo Sapiens
PSTTHAFLA

SEQ ID NO: 1052342 - protein, 9 aa, Homo Sapiens
NLRLPGSSN

SEQ ID NO: 1052343 - protein, 9 aa, Homo Sapiens
AVHPFGLSL

SEQ ID NO: 1052344 - protein, 9 aa, Homo Sapiens
GQMQSVGSQ

SEQ ID NO: 1052345 - protein, 9 aa, Homo Sapiens
KQICGMHRE

SEQ ID NO: 1052346 - protein, 9 aa, Homo Sapiens
SFLDSEMCK

SEQ ID NO: 1052347 - protein, 9 aa, Homo Sapiens
MVPPLNFTM

SEQ ID NO: 1052348 - protein, 9 aa, Homo Sapiens
LKFITFSDG

SEQ ID NO: 1052349 - protein, 9 aa, Homo Sapiens
LAVFSIFSA

SEQ ID NO: 1052350 - protein, 9 aa, Homo Sapiens
SVLVQSKDD

SEQ ID NO: 1052351 - protein, 9 aa, Homo Sapiens
FSDAIYLAR

SEQ ID NO: 1052352 - protein, 9 aa, Homo Sapiens
FAASDENHC

SEQ ID NO: 1052353 - protein, 9 aa, Homo Sapiens
PAQISLVAQ

SEQ ID NO: 1052354 - protein, 9 aa, Homo Sapiens
IAGPGAEGP

SEQ ID NO: 1052355 - protein, 9 aa, Homo Sapiens
QEMIIEIFK

SEQ ID NO: 1052356 - protein, 9 aa, Homo Sapiens
SEKIAGDHS

SEQ ID NO: 1052357 - protein, 9 aa, Homo Sapiens
VREKGYEQL

SEQ ID NO: 1052358 - protein, 9 aa, Homo Sapiens
TPSNARGQR

SEQ ID NO: 1052359 - protein, 9 aa, Homo Sapiens
SHLLPEPPK

SEQ ID NO: 1052360 - protein, 9 aa, Homo Sapiens
TPPQLSSKM

SEQ ID NO: 1052361 - protein, 9 aa, Homo Sapiens
QAATYLKWC

SEQ ID NO: 1052362 - protein, 9 aa, Homo Sapiens
VSPNHLPVG

SEQ ID NO: 1052363 - protein, 9 aa, Homo Sapiens
FQGRDWVPL

SEQ ID NO: 1052364 - protein, 9 aa, Homo Sapiens
ELSYRFLGE

SEQ ID NO: 1052365 - protein, 9 aa, Homo Sapiens
RYAQYHHVS

SEQ ID NO: 1052366 - protein, 9 aa, Homo Sapiens
SLWKIDVIL

SEQ ID NO: 1052367 - protein, 9 aa, Homo Sapiens
FFHLHTLQP

SEQ ID NO: 1052368 - protein, 9 aa, Homo Sapiens
PSSCMQLGV

SEQ ID NO: 1052369 - protein, 9 aa, Homo Sapiens
DQNHYNFNP

SEQ ID NO: 1052370 - protein, 9 aa, Homo Sapiens
VDFQKNPKK

SEQ ID NO: 1052371 - protein, 9 aa, Homo Sapiens
VELWEKASG

SEQ ID NO: 1052372 - protein, 9 aa, Homo Sapiens
DDTPPSERR

SEQ ID NO: 1052373 - protein, 9 aa, Homo Sapiens
SYDTIIMEE

SEQ ID NO: 1052374 - protein, 9 aa, Homo Sapiens
LISSLCSCD

SEQ ID NO: 1052375 - protein, 9 aa, Homo Sapiens
SFLKSLNEG

SEQ ID NO: 1052376 - protein, 9 aa, Homo Sapiens
YRIGLPQNS

SEQ ID NO: 1052377 - protein, 9 aa, Homo Sapiens
PTPVELSQR

SEQ ID NO: 1052378 - protein, 9 aa, Homo Sapiens
PAVTAPISG

SEQ ID NO: 1052379 - protein, 9 aa, Homo Sapiens
LIKKTAAIL

SEQ ID NO: 1052380 - protein, 9 aa, Homo Sapiens
FLPMRPQQP

SEQ ID NO: 1052381 - protein, 9 aa, Homo Sapiens
SKPFISLGI

SEQ ID NO: 1052382 - protein, 9 aa, Homo Sapiens
TALAEQISR

SEQ ID NO: 1052383 - protein, 9 aa, Homo Sapiens
IPAYEMMME

SEQ ID NO: 1052384 - protein, 9 aa, Homo Sapiens
PGLLITLVL

SEQ ID NO: 1052385 - protein, 9 aa, Homo Sapiens
ETETIENLT

SEQ ID NO: 1052386 - protein, 9 aa, Homo Sapiens
NISIYLPSA

SEQ ID NO: 1052387 - protein, 9 aa, Homo Sapiens
GAKNLLSHM

SEQ ID NO: 1052388 - protein, 9 aa, Homo Sapiens
FDGSCMVEE

SEQ ID NO: 1052389 - protein, 9 aa, Homo Sapiens
TALMEVSNL

SEQ ID NO: 1052390 - protein, 9 aa, Homo Sapiens
NGYNYAILA

SEQ ID NO: 1052391 - protein, 9 aa, Homo Sapiens
SLEKSSNLV

SEQ ID NO: 1052392 - protein, 9 aa, Homo Sapiens
LVIRATNRP

SEQ ID NO: 1052393 - protein, 9 aa, Homo Sapiens
HSRVILTSF

SEQ ID NO: 1052394 - protein, 9 aa, Homo Sapiens
KGKIVMYKI

SEQ ID NO: 1052395 - protein, 9 aa, Homo Sapiens
VPSVYCTSS

SEQ ID NO: 1052396 - protein, 9 aa, Homo Sapiens
KCPENNIRS

SEQ ID NO: 1052397 - protein, 9 aa, Homo Sapiens
CSLLQLDQW

SEQ ID NO: 1052398 - protein, 9 aa, Homo Sapiens
VYSIFYATS

SEQ ID NO: 1052399 - protein, 9 aa, Homo Sapiens
GRDSGNEMG

SEQ ID NO: 1052400 - protein, 9 aa, Homo Sapiens
KEEEAKKRA

SEQ ID NO: 1052401 - protein, 9 aa, Homo Sapiens
IKFWLKMNS

SEQ ID NO: 1052402 - protein, 9 aa, Homo Sapiens
HIDFYPNGE

SEQ ID NO: 1052403 - protein, 9 aa, Homo Sapiens
MTKWGEWDE

SEQ ID NO: 1052404 - protein, 9 aa, Homo Sapiens
GCVSTSLIS

SEQ ID NO: 1052405 - protein, 9 aa, Homo Sapiens
AEALGEQLY

SEQ ID NO: 1052406 - protein, 9 aa, Homo Sapiens
SLTGNPVIT

SEQ ID NO: 1052407 - protein, 9 aa, Homo Sapiens
LQSAAEVKK

SEQ ID NO: 1052408 - protein, 9 aa, Homo Sapiens
IAVSPSTAI

SEQ ID NO: 1052409 - protein, 9 aa, Homo Sapiens
DECSRTSIL

SEQ ID NO: 1052410 - protein, 9 aa, Homo Sapiens
MDPSVKWEY

SEQ ID NO: 1052411 - protein, 9 aa, Homo Sapiens
RAYTMDVIT

SEQ ID NO: 1052412 - protein, 9 aa, Homo Sapiens
EEEESSKKE

SEQ ID NO: 1052413 - protein, 9 aa, Homo Sapiens
IQVTPDKDD

SEQ ID NO: 1052414 - protein, 9 aa, Homo Sapiens
VYFKQHMQN

SEQ ID NO: 1052415 - protein, 9 aa, Homo Sapiens
RYWDIMKYF

SEQ ID NO: 1052416 - protein, 9 aa, Homo Sapiens
EDKINIIEQ

SEQ ID NO: 1052417 - protein, 9 aa, Homo Sapiens
GYQEKVLSV

SEQ ID NO: 1052418 - protein, 9 aa, Homo Sapiens
SPSGMLTCR

SEQ ID NO: 1052419 - protein, 9 aa, Homo Sapiens
IIYNSQAIK

SEQ ID NO: 1052420 - protein, 9 aa, Homo Sapiens
KALILHAGE

SEQ ID NO: 1052421 - protein, 9 aa, Homo Sapiens
SVTSNPRHL

SEQ ID NO: 1052422 - protein, 9 aa, Homo Sapiens
TVHFTFEAV

SEQ ID NO: 1052423 - protein, 9 aa, Homo Sapiens
ERDDFDPEA

SEQ ID NO: 1052424 - protein, 9 aa, Homo Sapiens
DIGICFIEL

SEQ ID NO: 1052425 - protein, 9 aa, Homo Sapiens
NWDYLRPPS

SEQ ID NO: 1052426 - protein, 9 aa, Homo Sapiens
GTDCGGDAL

SEQ ID NO: 1052427 - protein, 9 aa, Homo Sapiens
FARTLNKQG

SEQ ID NO: 1052428 - protein, 9 aa, Homo Sapiens
HELKFRGSF

SEQ ID NO: 1052429 - protein, 9 aa, Homo Sapiens
SMCRGNNEG

SEQ ID NO: 1052430 - protein, 9 aa, Homo Sapiens
SLPPRVCLK

SEQ ID NO: 1052431 - protein, 9 aa, Homo Sapiens
KMSDMDCTA

SEQ ID NO: 1052432 - protein, 9 aa, Homo Sapiens
ENQKITLYS

SEQ ID NO: 1052433 - protein, 9 aa, Homo Sapiens
GNEILESNE

SEQ ID NO: 1052434 - protein, 9 aa, Homo Sapiens
RKKKESSKN

SEQ ID NO: 1052435 - protein, 9 aa, Homo Sapiens
RAGGAGQRF

SEQ ID NO: 1052436 - protein, 9 aa, Homo Sapiens
ELHVLVMNE

SEQ ID NO: 1052437 - protein, 9 aa, Homo Sapiens
YGIIFCEGC

SEQ ID NO: 1052438 - protein, 9 aa, Homo Sapiens
KKESLVEGE

SEQ ID NO: 1052439 - protein, 9 aa, Homo Sapiens
TSLGTVFVP

SEQ ID NO: 1052440 - protein, 9 aa, Homo Sapiens
LLPLVIPGD

SEQ ID NO: 1052441 - protein, 9 aa, Homo Sapiens
QPHSHSNPD

SEQ ID NO: 1052442 - protein, 9 aa, Homo Sapiens
GPEGNVQNL

SEQ ID NO: 1052443 - protein, 9 aa, Homo Sapiens
EASFCGWGG

SEQ ID NO: 1052444 - protein, 9 aa, Homo Sapiens
NVTRMSSQP

SEQ ID NO: 1052445 - protein, 9 aa, Homo Sapiens
TSENLYLMG

SEQ ID NO: 1052446 - protein, 9 aa, Homo Sapiens
TEDDFGLVK

SEQ ID NO: 1052447 - protein, 9 aa, Homo Sapiens
LSVAYNCSM

SEQ ID NO: 1052448 - protein, 9 aa, Homo Sapiens
CGPSIPCML

SEQ ID NO: 1052449 - protein, 9 aa, Homo Sapiens
FGNCLPVSN

SEQ ID NO: 1052450 - protein, 9 aa, Homo Sapiens
HLFRRYMAS

SEQ ID NO: 1052451 - protein, 9 aa, Homo Sapiens
GRDLGPFNP

SEQ ID NO: 1052452 - protein, 9 aa, Homo Sapiens
ALYFFFKDP

SEQ ID NO: 1052453 - protein, 9 aa, Homo Sapiens
AAPKSPSRE

SEQ ID NO: 1052454 - protein, 9 aa, Homo Sapiens
GGPRQPSPR

SEQ ID NO: 1052455 - protein, 9 aa, Homo Sapiens
RVNYSRGLE

SEQ ID NO: 1052456 - protein, 9 aa, Homo Sapiens
PISGFEPAS

SEQ ID NO: 1052457 - protein, 9 aa, Homo Sapiens
WRVSVTPRE

SEQ ID NO: 1052458 - protein, 9 aa, Homo Sapiens
PAPQDTLLP

SEQ ID NO: 1052459 - protein, 9 aa, Homo Sapiens
FHILQLFHC

SEQ ID NO: 1052460 - protein, 9 aa, Homo Sapiens
EVRHYSSQW

SEQ ID NO: 1052461 - protein, 9 aa, Homo Sapiens
QITTAAMLD

SEQ ID NO: 1052462 - protein, 9 aa, Homo Sapiens
GFPSSSPSD

SEQ ID NO: 1052463 - protein, 9 aa, Homo Sapiens
LSKLEGHTC

SEQ ID NO: 1052464 - protein, 9 aa, Homo Sapiens
SEICISVSW

SEQ ID NO: 1052465 - protein, 9 aa, Homo Sapiens
AVVVRVDTD

SEQ ID NO: 1052466 - protein, 9 aa, Homo Sapiens
RDLASLPEK

SEQ ID NO: 1052467 - protein, 9 aa, Homo Sapiens
AEPINDSSE

SEQ ID NO: 1052468 - protein, 9 aa, Homo Sapiens
EEPVSPNHL

SEQ ID NO: 1052469 - protein, 9 aa, Homo Sapiens
ISFEKFSAV

SEQ ID NO: 1052470 - protein, 9 aa, Homo Sapiens
VKGSPSLRW

SEQ ID NO: 1052471 - protein, 9 aa, Homo Sapiens
DILWLAQLR

SEQ ID NO: 1052472 - protein, 9 aa, Homo Sapiens
SKGAFSENN

SEQ ID NO: 1052473 - protein, 9 aa, Homo Sapiens
EVGDSRTVL

SEQ ID NO: 1052474 - protein, 9 aa, Homo Sapiens
KEKITQIEI

SEQ ID NO: 1052475 - protein, 9 aa, Homo Sapiens
DCRIVLKSL

SEQ ID NO: 1052476 - protein, 9 aa, Homo Sapiens
PPTPSPGFS

SEQ ID NO: 1052477 - protein, 9 aa, Homo Sapiens
VRHLKQIGN

SEQ ID NO: 1052478 - protein, 9 aa, Homo Sapiens
WADPGEAGT

SEQ ID NO: 1052479 - protein, 9 aa, Homo Sapiens
EMNKVMELK

SEQ ID NO: 1052480 - protein, 9 aa, Homo Sapiens
ALGVAPALP

SEQ ID NO: 1052481 - protein, 9 aa, Homo Sapiens
CVPRQGKQY

SEQ ID NO: 1052482 - protein, 9 aa, Homo Sapiens
GMALSQGHL

SEQ ID NO: 1052483 - protein, 9 aa, Homo Sapiens
RPSLQLPQY

SEQ ID NO: 1052484 - protein, 9 aa, Homo Sapiens
STQNFWFRP

SEQ ID NO: 1052485 - protein, 9 aa, Homo Sapiens
SVPWLLIFF

SEQ ID NO: 1052486 - protein, 9 aa, Homo Sapiens
LLVAMSWVF

SEQ ID NO: 1052487 - protein, 9 aa, Homo Sapiens
MANENQPVK

SEQ ID NO: 1052488 - protein, 9 aa, Homo Sapiens
RKSDQRSPG

SEQ ID NO: 1052489 - protein, 9 aa, Homo Sapiens
TSLMLKWTP

SEQ ID NO: 1052490 - protein, 9 aa, Homo Sapiens
ICPYKCNVC

SEQ ID NO: 1052491 - protein, 9 aa, Homo Sapiens
CSLHSTFVC

SEQ ID NO: 1052492 - protein, 9 aa, Homo Sapiens
ENNLLVQFK

SEQ ID NO: 1052493 - protein, 9 aa, Homo Sapiens
KFLGRPMCT

SEQ ID NO: 1052494 - protein, 9 aa, Homo Sapiens
PWRPGIVSS

SEQ ID NO: 1052495 - protein, 9 aa, Homo Sapiens
TMCQFLTGL

SEQ ID NO: 1052496 - protein, 9 aa, Homo Sapiens
HDSYEKQGL

SEQ ID NO: 1052497 - protein, 9 aa, Homo Sapiens
SDYTALLVD

SEQ ID NO: 1052498 - protein, 9 aa, Homo Sapiens
RLGEEFIRG

SEQ ID NO: 1052499 - protein, 9 aa, Homo Sapiens
GARQEGGGG

SEQ ID NO: 1052500 - protein, 9 aa, Homo Sapiens
LLERISDQG

SEQ ID NO: 1052501 - protein, 9 aa, Homo Sapiens
PGHNGLDEQ

SEQ ID NO: 1052502 - protein, 9 aa, Homo Sapiens
SKGSSDELA

SEQ ID NO: 1052503 - protein, 9 aa, Homo Sapiens
SNRVSIPWV

SEQ ID NO: 1052504 - protein, 9 aa, Homo Sapiens
QPSKGAFSE

SEQ ID NO: 1052505 - protein, 9 aa, Homo Sapiens
TLDSISKLP

SEQ ID NO: 1052506 - protein, 9 aa, Homo Sapiens
PRAVFSSIV

SEQ ID NO: 1052507 - protein, 9 aa, Homo Sapiens
IYVPAEQIQ

SEQ ID NO: 1052508 - protein, 9 aa, Homo Sapiens
EQLLTWKET

SEQ ID NO: 1052509 - protein, 9 aa, Homo Sapiens
TYSLITPAR

SEQ ID NO: 1052510 - protein, 9 aa, Homo Sapiens
RCKYSHFMH

SEQ ID NO: 1052511 - protein, 9 aa, Homo Sapiens
CSCPGRYLR

SEQ ID NO: 1052512 - protein, 9 aa, Homo Sapiens
QQATAIIKE

SEQ ID NO: 1052513 - protein, 9 aa, Homo Sapiens
PLPPPPDLF

SEQ ID NO: 1052514 - protein, 9 aa, Homo Sapiens
PAIGNICCA

SEQ ID NO: 1052515 - protein, 9 aa, Homo Sapiens
LDGFMAQKK

SEQ ID NO: 1052516 - protein, 9 aa, Homo Sapiens
SVPTASEVS

SEQ ID NO: 1052517 - protein, 9 aa, Homo Sapiens
PASIVPFMR

SEQ ID NO: 1052518 - protein, 9 aa, Homo Sapiens
VLSVRVQSG

SEQ ID NO: 1052519 - protein, 9 aa, Homo Sapiens
WCDVTGHLL

SEQ ID NO: 1052520 - protein, 9 aa, Homo Sapiens
FMNSRMQLA

SEQ ID NO: 1052521 - protein, 9 aa, Homo Sapiens
VISVFYTHI

SEQ ID NO: 1052522 - protein, 9 aa, Homo Sapiens
NFICSALEF

SEQ ID NO: 1052523 - protein, 9 aa, Homo Sapiens
SGFNSKSEK

SEQ ID NO: 1052524 - protein, 9 aa, Homo Sapiens
IEKVLTPEM

SEQ ID NO: 1052525 - protein, 9 aa, Homo Sapiens
QKLNSRLAS

SEQ ID NO: 1052526 - protein, 9 aa, Homo Sapiens
AVSAAALVF

SEQ ID NO: 1052527 - protein, 9 aa, Homo Sapiens
KASSQARSD

SEQ ID NO: 1052528 - protein, 9 aa, Homo Sapiens
EFWKKTARM

SEQ ID NO: 1052529 - protein, 9 aa, Homo Sapiens
WFSVFYVYG

SEQ ID NO: 1052530 - protein, 9 aa, Homo Sapiens
DTIFLLVTA

SEQ ID NO: 1052531 - protein, 9 aa, Homo Sapiens
INLKDFFRA

SEQ ID NO: 1052532 - protein, 9 aa, Homo Sapiens
VLLMEKDQV

SEQ ID NO: 1052533 - protein, 9 aa, Homo Sapiens
SRAIFFVGP

SEQ ID NO: 1052534 - protein, 9 aa, Homo Sapiens
ELVDMMEFF

SEQ ID NO: 1052535 - protein, 9 aa, Homo Sapiens
PELRRTEHR

SEQ ID NO: 1052536 - protein, 9 aa, Homo Sapiens
EAAAVPAAV

SEQ ID NO: 1052537 - protein, 9 aa, Homo Sapiens
EGKALNPFQ

SEQ ID NO: 1052538 - protein, 9 aa, Homo Sapiens
QPLCTGDEN

SEQ ID NO: 1052539 - protein, 9 aa, Homo Sapiens
CSIDLGKDD

SEQ ID NO: 1052540 - protein, 9 aa, Homo Sapiens
VQSLPPKNP

SEQ ID NO: 1052541 - protein, 9 aa, Homo Sapiens
SWVFFWISQ

SEQ ID NO: 1052542 - protein, 9 aa, Homo Sapiens
KSTMQKLNS

SEQ ID NO: 1052543 - protein, 9 aa, Homo Sapiens
QKEELDKKV

SEQ ID NO: 1052544 - protein, 9 aa, Homo Sapiens
ACGWQKNCQ

SEQ ID NO: 1052545 - protein, 9 aa, Homo Sapiens
MLHMAVQDL

SEQ ID NO: 1052546 - protein, 9 aa, Homo Sapiens
ENKKADVKN

SEQ ID NO: 1052547 - protein, 9 aa, Homo Sapiens
QAAFTSGVP

SEQ ID NO: 1052548 - protein, 9 aa, Homo Sapiens
AQSSKLFTH

SEQ ID NO: 1052549 - protein, 9 aa, Homo Sapiens
LGGFIGYAP

SEQ ID NO: 1052550 - protein, 9 aa, Homo Sapiens
VSAKKSASL

SEQ ID NO: 1052551 - protein, 9 aa, Homo Sapiens
EDVTSKLDK

SEQ ID NO: 1052552 - protein, 9 aa, Homo Sapiens
NESYNLTEL

SEQ ID NO: 1052553 - protein, 9 aa, Homo Sapiens
LISLFLAAG

SEQ ID NO: 1052554 - protein, 9 aa, Homo Sapiens
SITPPSYVV

SEQ ID NO: 1052555 - protein, 9 aa, Homo Sapiens
TIELTEKNF

SEQ ID NO: 1052556 - protein, 9 aa, Homo Sapiens
SRQNSGEAS

SEQ ID NO: 1052557 - protein, 9 aa, Homo Sapiens
HAVVVRVDT

SEQ ID NO: 1052558 - protein, 9 aa, Homo Sapiens
SKFYQAIND

SEQ ID NO: 1052559 - protein, 9 aa, Homo Sapiens
SYVNLCSNS

SEQ ID NO: 1052560 - protein, 9 aa, Homo Sapiens
QILGMSPQL

SEQ ID NO: 1052561 - protein, 9 aa, Homo Sapiens
FRNVALEFS

SEQ ID NO: 1052562 - protein, 9 aa, Homo Sapiens
LIFFLHDSV

SEQ ID NO: 1052563 - protein, 9 aa, Homo Sapiens
LLNKWENVK

SEQ ID NO: 1052564 - protein, 9 aa, Homo Sapiens
IVANFFLAN

SEQ ID NO: 1052565 - protein, 9 aa, Homo Sapiens
SRDFQVTVD

SEQ ID NO: 1052566 - protein, 9 aa, Homo Sapiens
ARDAASQES

SEQ ID NO: 1052567 - protein, 9 aa, Homo Sapiens
LLPGRDYID

SEQ ID NO: 1052568 - protein, 9 aa, Homo Sapiens
YAQSQSHSS

SEQ ID NO: 1052569 - protein, 9 aa, Homo Sapiens
KVNPLACLP

SEQ ID NO: 1052570 - protein, 9 aa, Homo Sapiens
KRGDAASHL

SEQ ID NO: 1052571 - protein, 9 aa, Homo Sapiens
PQFLRKKVL

SEQ ID NO: 1052572 - protein, 9 aa, Homo Sapiens
DFLSSLRPA

SEQ ID NO: 1052573 - protein, 9 aa, Homo Sapiens
LGVLKELRD

SEQ ID NO: 1052574 - protein, 9 aa, Homo Sapiens
LLPTSIFLA

SEQ ID NO: 1052575 - protein, 9 aa, Homo Sapiens
GDCAISPPQ

SEQ ID NO: 1052576 - protein, 9 aa, Homo Sapiens
CRPCCCQSN

SEQ ID NO: 1052577 - protein, 9 aa, Homo Sapiens
LSGPHLETL

SEQ ID NO: 1052578 - protein, 9 aa, Homo Sapiens
GTAAPTLIF

SEQ ID NO: 1052579 - protein, 9 aa, Homo Sapiens
VCCNFSNMW

SEQ ID NO: 1052580 - protein, 9 aa, Homo Sapiens
VDSDSDPEK

SEQ ID NO: 1052581 - protein, 9 aa, Homo Sapiens
YKDHQNESF

SEQ ID NO: 1052582 - protein, 9 aa, Homo Sapiens
ACDDLIKEK

SEQ ID NO: 1052583 - protein, 9 aa, Homo Sapiens
WYFTMQVRE

SEQ ID NO: 1052584 - protein, 9 aa, Homo Sapiens
SETFNPVSL

SEQ ID NO: 1052585 - protein, 9 aa, Homo Sapiens
GRNKLRQVL

SEQ ID NO: 1052586 - protein, 9 aa, Homo Sapiens
KFHQQMHRD

SEQ ID NO: 1052587 - protein, 9 aa, Homo Sapiens
CLELERLKP

SEQ ID NO: 1052588 - protein, 9 aa, Homo Sapiens
PSSLVDSTL

SEQ ID NO: 1052589 - protein, 9 aa, Homo Sapiens
QFFLFAISV

SEQ ID NO: 1052590 - protein, 9 aa, Homo Sapiens
MSEFLSIPA

SEQ ID NO: 1052591 - protein, 9 aa, Homo Sapiens
KVKGSPSLR

SEQ ID NO: 1052592 - protein, 9 aa, Homo Sapiens
RSRKKSYSV

SEQ ID NO: 1052593 - protein, 9 aa, Homo Sapiens
LLYLIVVDH

SEQ ID NO: 1052594 - protein, 9 aa, Homo Sapiens
CTNALGFYS

SEQ ID NO: 1052595 - protein, 9 aa, Homo Sapiens
VLCSCPGRY

SEQ ID NO: 1052596 - protein, 9 aa, Homo Sapiens
DFFRAYTMD

SEQ ID NO: 1052597 - protein, 9 aa, Homo Sapiens
ALHLSVPKS

SEQ ID NO: 1052598 - protein, 9 aa, Homo Sapiens
PQTRVLGVK

SEQ ID NO: 1052599 - protein, 9 aa, Homo Sapiens
LDLGGMPNT

SEQ ID NO: 1052600 - protein, 9 aa, Homo Sapiens
LLPGCRRIS

SEQ ID NO: 1052601 - protein, 9 aa, Homo Sapiens
AEKALDKAQ

SEQ ID NO: 1052602 - protein, 9 aa, Homo Sapiens
QSIVLDSML

SEQ ID NO: 1052603 - protein, 9 aa, Homo Sapiens
KATEGAIHV

SEQ ID NO: 1052604 - protein, 9 aa, Homo Sapiens
KLSSCNLET

SEQ ID NO: 1052605 - protein, 9 aa, Homo Sapiens
YDSVKTSIQ

SEQ ID NO: 1052606 - protein, 9 aa, Homo Sapiens
TVSVFSMFC

SEQ ID NO: 1052607 - protein, 9 aa, Homo Sapiens
GHGVNTSNM

SEQ ID NO: 1052608 - protein, 9 aa, Homo Sapiens
GPRQPSPRP

SEQ ID NO: 1052609 - protein, 9 aa, Homo Sapiens
PNYPVIQWF

SEQ ID NO: 1052610 - protein, 9 aa, Homo Sapiens
IVMFEEATE

SEQ ID NO: 1052611 - protein, 9 aa, Homo Sapiens
VAAIYCKAG

SEQ ID NO: 1052612 - protein, 9 aa, Homo Sapiens
LEESSFGSH

SEQ ID NO: 1052613 - protein, 9 aa, Homo Sapiens
TDTTAQLYW

SEQ ID NO: 1052614 - protein, 9 aa, Homo Sapiens
GDRESSEGG

SEQ ID NO: 1052615 - protein, 9 aa, Homo Sapiens
AMIFALFPK

SEQ ID NO: 1052616 - protein, 9 aa, Homo Sapiens
ILRAELQDN

SEQ ID NO: 1052617 - protein, 9 aa, Homo Sapiens
KTVSSILSR

SEQ ID NO: 1052618 - protein, 9 aa, Homo Sapiens
NLGIIELIL

SEQ ID NO: 1052619 - protein, 9 aa, Homo Sapiens
GFFLGIGAS

SEQ ID NO: 1052620 - protein, 9 aa, Homo Sapiens
DFLDSPPRP

SEQ ID NO: 1052621 - protein, 9 aa, Homo Sapiens
PAQPLSENL

SEQ ID NO: 1052622 - protein, 9 aa, Homo Sapiens
SLLSGLEVV

SEQ ID NO: 1052623 - protein, 9 aa, Homo Sapiens
SQSNLTSLL

SEQ ID NO: 1052624 - protein, 9 aa, Homo Sapiens
FIWKFQRTP

SEQ ID NO: 1052625 - protein, 9 aa, Homo Sapiens
RKKKYSSPQ

SEQ ID NO: 1052626 - protein, 9 aa, Homo Sapiens
LEDISMAHH

SEQ ID NO: 1052627 - protein, 9 aa, Homo Sapiens
DNRRSKSIE

SEQ ID NO: 1052628 - protein, 9 aa, Homo Sapiens
PWDISVATN

SEQ ID NO: 1052629 - protein, 9 aa, Homo Sapiens
GIIELILLD

SEQ ID NO: 1052630 - protein, 9 aa, Homo Sapiens
GFFQNKNIE

SEQ ID NO: 1052631 - protein, 9 aa, Homo Sapiens
LMESTTIEL

SEQ ID NO: 1052632 - protein, 9 aa, Homo Sapiens
DEDTLQNPA

SEQ ID NO: 1052633 - protein, 9 aa, Homo Sapiens
KRNKLQPGS

SEQ ID NO: 1052634 - protein, 9 aa, Homo Sapiens
LHRADPDYN

SEQ ID NO: 1052635 - protein, 9 aa, Homo Sapiens
DSSIYFCSV

SEQ ID NO: 1052636 - protein, 9 aa, Homo Sapiens
ELDEFSDFD

SEQ ID NO: 1052637 - protein, 9 aa, Homo Sapiens
ATAPPRVLK

SEQ ID NO: 1052638 - protein, 9 aa, Homo Sapiens
FQSCVITKD

SEQ ID NO: 1052639 - protein, 9 aa, Homo Sapiens
EPSGDKSLS

SEQ ID NO: 1052640 - protein, 9 aa, Homo Sapiens
ENKPPFEFV

SEQ ID NO: 1052641 - protein, 9 aa, Homo Sapiens
VPTASEVSE

SEQ ID NO: 1052642 - protein, 9 aa, Homo Sapiens
LFLAAGLMH

SEQ ID NO: 1052643 - protein, 9 aa, Homo Sapiens
KDVRIDTIL

SEQ ID NO: 1052644 - protein, 9 aa, Homo Sapiens
IKKYRYNPM

SEQ ID NO: 1052645 - protein, 9 aa, Homo Sapiens
SKAPERRVV

SEQ ID NO: 1052646 - protein, 9 aa, Homo Sapiens
YLAEMNYVN

SEQ ID NO: 1052647 - protein, 9 aa, Homo Sapiens
QVRTETKGQ

SEQ ID NO: 1052648 - protein, 8 aa, Homo Sapiens
KFTTLLFL

SEQ ID NO: 1052649 - protein, 9 aa, Homo Sapiens
SRESDSSPK

SEQ ID NO: 1052650 - protein, 9 aa, Homo Sapiens
RKMTETQMM

SEQ ID NO: 1052651 - protein, 9 aa, Homo Sapiens
PLPVLDYSV

SEQ ID NO: 1052652 - protein, 9 aa, Homo Sapiens
KETDSVKSP

SEQ ID NO: 1052653 - protein, 9 aa, Homo Sapiens
LLTQNWVQK

SEQ ID NO: 1052654 - protein, 9 aa, Homo Sapiens
GLQASPPDD

SEQ ID NO: 1052655 - protein, 9 aa, Homo Sapiens
PQKHSCVTD

SEQ ID NO: 1052656 - protein, 9 aa, Homo Sapiens
SACKTHSRF

SEQ ID NO: 1052657 - protein, 9 aa, Homo Sapiens
YVDITDRFR

SEQ ID NO: 1052658 - protein, 9 aa, Homo Sapiens
TYAFVTHPP

SEQ ID NO: 1052659 - protein, 9 aa, Homo Sapiens
AFLPLLVYY

SEQ ID NO: 1052660 - protein, 9 aa, Homo Sapiens
FNHHQQTHT

SEQ ID NO: 1052661 - protein, 9 aa, Homo Sapiens
SFSLVMLLV

SEQ ID NO: 1052662 - protein, 9 aa, Homo Sapiens
SFKSQDRKS

SEQ ID NO: 1052663 - protein, 9 aa, Homo Sapiens
SFFFCVAEM

SEQ ID NO: 1052664 - protein, 9 aa, Homo Sapiens
QQLFASVMT

SEQ ID NO: 1052665 - protein, 9 aa, Homo Sapiens
FEYLSKLQE

SEQ ID NO: 1052666 - protein, 9 aa, Homo Sapiens
LGLLRLWPV

SEQ ID NO: 1052667 - protein, 9 aa, Homo Sapiens
SNLNVSKES

SEQ ID NO: 1052668 - protein, 9 aa, Homo Sapiens
LRKPPGAKD

SEQ ID NO: 1052669 - protein, 9 aa, Homo Sapiens
ATEALDSIF

SEQ ID NO: 1052670 - protein, 9 aa, Homo Sapiens
NLQKTVSAK

SEQ ID NO: 1052671 - protein, 9 aa, Homo Sapiens
LLGLSKFQN

SEQ ID NO: 1052672 - protein, 9 aa, Homo Sapiens
RYSCAVVNI

SEQ ID NO: 1052673 - protein, 9 aa, Homo Sapiens
ENYLMLIIN

SEQ ID NO: 1052674 - protein, 9 aa, Homo Sapiens
YGFPGILEF

SEQ ID NO: 1052675 - protein, 9 aa, Homo Sapiens
ISVLVQSKD

SEQ ID NO: 1052676 - protein, 9 aa, Homo Sapiens
QRAVFGQLA

SEQ ID NO: 1052677 - protein, 9 aa, Homo Sapiens
KKIPSESEA

SEQ ID NO: 1052678 - protein, 9 aa, Homo Sapiens
GHTNYIYSL

SEQ ID NO: 1052679 - protein, 9 aa, Homo Sapiens
YSQQLKGLR

SEQ ID NO: 1052680 - protein, 9 aa, Homo Sapiens
GALLSPGTK

SEQ ID NO: 1052681 - protein, 9 aa, Homo Sapiens
VAKEERVVE

SEQ ID NO: 1052682 - protein, 9 aa, Homo Sapiens
RKICCNCKC

SEQ ID NO: 1052683 - protein, 9 aa, Homo Sapiens
RKGSKGCKR

SEQ ID NO: 1052684 - protein, 9 aa, Homo Sapiens
HCDVNKDEK

SEQ ID NO: 1052685 - protein, 9 aa, Homo Sapiens
KQHMLIYSG

SEQ ID NO: 1052686 - protein, 9 aa, Homo Sapiens
TWGEGDLGR

SEQ ID NO: 1052687 - protein, 9 aa, Homo Sapiens
EQAYHWYCK

SEQ ID NO: 1052688 - protein, 9 aa, Homo Sapiens
MVLMTSELG

SEQ ID NO: 1052689 - protein, 9 aa, Homo Sapiens
GEVFNRLDF

SEQ ID NO: 1052690 - protein, 9 aa, Homo Sapiens
EPEEMRRLE

SEQ ID NO: 1052691 - protein, 9 aa, Homo Sapiens
KKRKRKYKL

SEQ ID NO: 1052692 - protein, 9 aa, Homo Sapiens
QQMDILPNV

SEQ ID NO: 1052693 - protein, 9 aa, Homo Sapiens
ILLLNPFIY

SEQ ID NO: 1052694 - protein, 9 aa, Homo Sapiens
RPLHEEEAL

SEQ ID NO: 1052695 - protein, 9 aa, Homo Sapiens
MRVLAVRLK

SEQ ID NO: 1052696 - protein, 9 aa, Homo Sapiens
HGFHLATVC

SEQ ID NO: 1052697 - protein, 9 aa, Homo Sapiens
GSGFSSEEN

SEQ ID NO: 1052698 - protein, 9 aa, Homo Sapiens
YRIIPPTSK

SEQ ID NO: 1052699 - protein, 9 aa, Homo Sapiens
LQTNQTLTE

SEQ ID NO: 1052700 - protein, 9 aa, Homo Sapiens
NLKQHMLIY

SEQ ID NO: 1052701 - protein, 9 aa, Homo Sapiens
KMVSIFCSE

SEQ ID NO: 1052702 - protein, 9 aa, Homo Sapiens
EEFLSYLPS

SEQ ID NO: 1052703 - protein, 9 aa, Homo Sapiens
LAIKEKVID

SEQ ID NO: 1052704 - protein, 9 aa, Homo Sapiens
PINPKKYLG

SEQ ID NO: 1052705 - protein, 9 aa, Homo Sapiens
FPRGLEYTV

SEQ ID NO: 1052706 - protein, 9 aa, Homo Sapiens
LISQKLSSI

SEQ ID NO: 1052707 - protein, 9 aa, Homo Sapiens
PVGMDIHWK

SEQ ID NO: 1052708 - protein, 9 aa, Homo Sapiens
DSRKYPELV

SEQ ID NO: 1052709 - protein, 9 aa, Homo Sapiens
LEYTVSHDF

SEQ ID NO: 1052710 - protein, 9 aa, Homo Sapiens
CGVSYVVQK

SEQ ID NO: 1052711 - protein, 9 aa, Homo Sapiens
DAILQTNQT

SEQ ID NO: 1052712 - protein, 9 aa, Homo Sapiens
SSDTGPTLE

SEQ ID NO: 1052713 - protein, 9 aa, Homo Sapiens
LIFLTKLLN

SEQ ID NO: 1052714 - protein, 9 aa, Homo Sapiens
GAGDPRGPR

SEQ ID NO: 1052715 - protein, 9 aa, Homo Sapiens
RFLIVMKGA

SEQ ID NO: 1052716 - protein, 9 aa, Homo Sapiens
HFLSVFLNN

SEQ ID NO: 1052717 - protein, 9 aa, Homo Sapiens
VPSPPPIAL

SEQ ID NO: 1052718 - protein, 9 aa, Homo Sapiens
RGVGEAVPG

SEQ ID NO: 1052719 - protein, 9 aa, Homo Sapiens
SECKIQFFL

SEQ ID NO: 1052720 - protein, 9 aa, Homo Sapiens
EVNECNLPE

SEQ ID NO: 1052721 - protein, 9 aa, Homo Sapiens
TGICPQNIT

SEQ ID NO: 1052722 - protein, 9 aa, Homo Sapiens
EESVFEKAL

SEQ ID NO: 1052723 - protein, 9 aa, Homo Sapiens
LSESLASKL

SEQ ID NO: 1052724 - protein, 9 aa, Homo Sapiens
HYGRPMVPE

SEQ ID NO: 1052725 - protein, 9 aa, Homo Sapiens
AGEIIEVKD

SEQ ID NO: 1052726 - protein, 9 aa, Homo Sapiens
MAAQGFPSS

SEQ ID NO: 1052727 - protein, 9 aa, Homo Sapiens
PCKTCEGNA

SEQ ID NO: 1052728 - protein, 9 aa, Homo Sapiens
ETSAEACPE

SEQ ID NO: 1052729 - protein, 9 aa, Homo Sapiens
SLGEMGYFA

SEQ ID NO: 1052730 - protein, 9 aa, Homo Sapiens
IKNFMDGKN

SEQ ID NO: 1052731 - protein, 9 aa, Homo Sapiens
RPWDREAST

SEQ ID NO: 1052732 - protein, 9 aa, Homo Sapiens
LPLPAKSTL

SEQ ID NO: 1052733 - protein, 9 aa, Homo Sapiens
WLDSKSVVE

SEQ ID NO: 1052734 - protein, 9 aa, Homo Sapiens
RLRDKANQL

SEQ ID NO: 1052735 - protein, 9 aa, Homo Sapiens
PNPTMCLEV

SEQ ID NO: 1052736 - protein, 9 aa, Homo Sapiens
WDILDGTDC

SEQ ID NO: 1052737 - protein, 9 aa, Homo Sapiens
GPPFYLKKY

SEQ ID NO: 1052738 - protein, 9 aa, Homo Sapiens
MGNYLLQKL

SEQ ID NO: 1052739 - protein, 9 aa, Homo Sapiens
CAKKEPQKH

SEQ ID NO: 1052740 - protein, 9 aa, Homo Sapiens
RSSSNEQGL

SEQ ID NO: 1052741 - protein, 9 aa, Homo Sapiens
GFPFFLRNK

SEQ ID NO: 1052742 - protein, 9 aa, Homo Sapiens
TDGLWGLQK

SEQ ID NO: 1052743 - protein, 9 aa, Homo Sapiens
QLALFVNLL

SEQ ID NO: 1052744 - protein, 9 aa, Homo Sapiens
DKPQNFQIR

SEQ ID NO: 1052745 - protein, 9 aa, Homo Sapiens
KLNEGNQIV

SEQ ID NO: 1052746 - protein, 9 aa, Homo Sapiens
DSPLTEKKD

SEQ ID NO: 1052747 - protein, 9 aa, Homo Sapiens
ELFQKAREK

SEQ ID NO: 1052748 - protein, 9 aa, Homo Sapiens
SGLEVVTGS

SEQ ID NO: 1052749 - protein, 9 aa, Homo Sapiens
VLETCKETF

SEQ ID NO: 1052750 - protein, 9 aa, Homo Sapiens
FLELFKNGN

SEQ ID NO: 1052751 - protein, 9 aa, Homo Sapiens
SALRTGAYM

SEQ ID NO: 1052752 - protein, 9 aa, Homo Sapiens
RYREDRLKA

SEQ ID NO: 1052753 - protein, 9 aa, Homo Sapiens
QTDLRRKSV

SEQ ID NO: 1052754 - protein, 9 aa, Homo Sapiens
GQLLMIRQQ

SEQ ID NO: 1052755 - protein, 9 aa, Homo Sapiens
MDILPNVVS

SEQ ID NO: 1052756 - protein, 9 aa, Homo Sapiens
IFEEKKSAR

SEQ ID NO: 1052757 - protein, 9 aa, Homo Sapiens
EYMETGTLE

SEQ ID NO: 1052758 - protein, 9 aa, Homo Sapiens
KNKLGPETF

SEQ ID NO: 1052759 - protein, 9 aa, Homo Sapiens
FSYLLLHAS

SEQ ID NO: 1052760 - protein, 9 aa, Homo Sapiens
STHLIEVRL

SEQ ID NO: 1052761 - protein, 9 aa, Homo Sapiens
MKGDWETMT

SEQ ID NO: 1052762 - protein, 9 aa, Homo Sapiens
HAPAGQPIH

SEQ ID NO: 1052763 - protein, 9 aa, Homo Sapiens
LVRTALMEV

SEQ ID NO: 1052764 - protein, 9 aa, Homo Sapiens
FINAFVTTH

SEQ ID NO: 1052765 - protein, 9 aa, Homo Sapiens
AALEAHCKK

SEQ ID NO: 1052766 - protein, 9 aa, Homo Sapiens
LFYTQGDSL

SEQ ID NO: 1052767 - protein, 9 aa, Homo Sapiens
QKKGWLSID

SEQ ID NO: 1052768 - protein, 9 aa, Homo Sapiens
FLRSELPDS

SEQ ID NO: 1052769 - protein, 9 aa, Homo Sapiens
EEKQKEQEE

SEQ ID NO: 1052770 - protein, 9 aa, Homo Sapiens
KETHERKSS

SEQ ID NO: 1052771 - protein, 9 aa, Homo Sapiens
SEIEDQSIM

SEQ ID NO: 1052772 - protein, 9 aa, Homo Sapiens
MCSCLPGKV

SEQ ID NO: 1052773 - protein, 9 aa, Homo Sapiens
QVMTMGNDT

SEQ ID NO: 1052774 - protein, 9 aa, Homo Sapiens
SLTSQVSPS

SEQ ID NO: 1052775 - protein, 9 aa, Homo Sapiens
CLFCQPLTA

SEQ ID NO: 1052776 - protein, 9 aa, Homo Sapiens
EPLLRNGDQ

SEQ ID NO: 1052777 - protein, 9 aa, Homo Sapiens
ADRDGLWDA

SEQ ID NO: 1052778 - protein, 9 aa, Homo Sapiens
KSHLFRAMC

SEQ ID NO: 1052779 - protein, 9 aa, Homo Sapiens
CKDQGNFFF

SEQ ID NO: 1052780 - protein, 9 aa, Homo Sapiens
DKILKFVAR

SEQ ID NO: 1052781 - protein, 9 aa, Homo Sapiens
QKIVSIEPE

SEQ ID NO: 1052782 - protein, 9 aa, Homo Sapiens
ENEATAKVK

SEQ ID NO: 1052783 - protein, 9 aa, Homo Sapiens
AASSLGPLT

SEQ ID NO: 1052784 - protein, 9 aa, Homo Sapiens
PAGRSKAKL

SEQ ID NO: 1052785 - protein, 9 aa, Homo Sapiens
LESSKGSSD

SEQ ID NO: 1052786 - protein, 9 aa, Homo Sapiens
KNLIEVRAN

SEQ ID NO: 1052787 - protein, 9 aa, Homo Sapiens
NLYFYKDPE

SEQ ID NO: 1052788 - protein, 9 aa, Homo Sapiens
CFLHKEEKS

SEQ ID NO: 1052789 - protein, 9 aa, Homo Sapiens
LGTGIMLSS

SEQ ID NO: 1052790 - protein, 9 aa, Homo Sapiens
CCTGYKESC

SEQ ID NO: 1052791 - protein, 9 aa, Homo Sapiens
STTPPGLPP

SEQ ID NO: 1052792 - protein, 9 aa, Homo Sapiens
QCSYYTTKG

SEQ ID NO: 1052793 - protein, 9 aa, Homo Sapiens
EIQSFNLET

SEQ ID NO: 1052794 - protein, 9 aa, Homo Sapiens
DTLRFWQLS

SEQ ID NO: 1052795 - protein, 9 aa, Homo Sapiens
VSMSLRVYV

SEQ ID NO: 1052796 - protein, 9 aa, Homo Sapiens
DKIYLIGRD

SEQ ID NO: 1052797 - protein, 9 aa, Homo Sapiens
KFPIYFQGK

SEQ ID NO: 1052798 - protein, 9 aa, Homo Sapiens
RRLYAFGAE

SEQ ID NO: 1052799 - protein, 9 aa, Homo Sapiens
HTLSSSYHN

SEQ ID NO: 1052800 - protein, 9 aa, Homo Sapiens
LNSNAVVIM

SEQ ID NO: 1052801 - protein, 9 aa, Homo Sapiens
YGGHELSHP

SEQ ID NO: 1052802 - protein, 9 aa, Homo Sapiens
KFRGQFVMK

SEQ ID NO: 1052803 - protein, 9 aa, Homo Sapiens
ACTLCEAIC

SEQ ID NO: 1052804 - protein, 9 aa, Homo Sapiens
FRERNAGSQ

SEQ ID NO: 1052805 - protein, 9 aa, Homo Sapiens
HVVEEVVKE

SEQ ID NO: 1052806 - protein, 9 aa, Homo Sapiens
DSGLAIIRS

SEQ ID NO: 1052807 - protein, 9 aa, Homo Sapiens
EQTKPLRRA

SEQ ID NO: 1052808 - protein, 9 aa, Homo Sapiens
IQTDANHTT

SEQ ID NO: 1052809 - protein, 9 aa, Homo Sapiens
PPISLAKVD

SEQ ID NO: 1052810 - protein, 9 aa, Homo Sapiens
HILLIKRLT

SEQ ID NO: 1052811 - protein, 9 aa, Homo Sapiens
FFLHPILFY

SEQ ID NO: 1052812 - protein, 9 aa, Homo Sapiens
SSKNKFSLI

SEQ ID NO: 1052813 - protein, 9 aa, Homo Sapiens
LFFFLWPLE

SEQ ID NO: 1052814 - protein, 9 aa, Homo Sapiens
LSNPFLVLS

SEQ ID NO: 1052815 - protein, 9 aa, Homo Sapiens
GRNGTPREQ

SEQ ID NO: 1052816 - protein, 9 aa, Homo Sapiens
KFISEITIS

SEQ ID NO: 1052817 - protein, 9 aa, Homo Sapiens
PKVMAGFFR

SEQ ID NO: 1052818 - protein, 9 aa, Homo Sapiens
RDLEASTQE

SEQ ID NO: 1052819 - protein, 9 aa, Homo Sapiens
QPFKFTIFE

SEQ ID NO: 1052820 - protein, 9 aa, Homo Sapiens
VQYFQQGLH

SEQ ID NO: 1052821 - protein, 9 aa, Homo Sapiens
SIKLDNLNS

SEQ ID NO: 1052822 - protein, 9 aa, Homo Sapiens
QTWLSFQGP

SEQ ID NO: 1052823 - protein, 9 aa, Homo Sapiens
VSYVVQKPG

SEQ ID NO: 1052824 - protein, 9 aa, Homo Sapiens
GEIFSVALL

SEQ ID NO: 1052825 - protein, 9 aa, Homo Sapiens
ERVVEVNQY

SEQ ID NO: 1052826 - protein, 9 aa, Homo Sapiens
ELSSRSPPE

SEQ ID NO: 1052827 - protein, 9 aa, Homo Sapiens
SCMDRMSGL

SEQ ID NO: 1052828 - protein, 9 aa, Homo Sapiens
IHSLIKSDL

SEQ ID NO: 1052829 - protein, 9 aa, Homo Sapiens
QDLRTIYAR

SEQ ID NO: 1052830 - protein, 9 aa, Homo Sapiens
GNNQIYPKT

SEQ ID NO: 1052831 - protein, 9 aa, Homo Sapiens
EKGHITYQE

SEQ ID NO: 1052832 - protein, 9 aa, Homo Sapiens
LPPSPRSQG

SEQ ID NO: 1052833 - protein, 9 aa, Homo Sapiens
SYSRIVSSS

SEQ ID NO: 1052834 - protein, 9 aa, Homo Sapiens
HGENVALPL

SEQ ID NO: 1052835 - protein, 9 aa, Homo Sapiens
CNLYLLEEG

SEQ ID NO: 1052836 - protein, 9 aa, Homo Sapiens
SNQRQSITS

SEQ ID NO: 1052837 - protein, 9 aa, Homo Sapiens
GIFVCEKGS

SEQ ID NO: 1052838 - protein, 9 aa, Homo Sapiens
YNFICSALE

SEQ ID NO: 1052839 - protein, 9 aa, Homo Sapiens
LLENFPVGT

SEQ ID NO: 1052840 - protein, 9 aa, Homo Sapiens
PGPLYPARF

SEQ ID NO: 1052841 - protein, 9 aa, Homo Sapiens
GWMQEFLNE

SEQ ID NO: 1052842 - protein, 9 aa, Homo Sapiens
VLFYIRIFS

SEQ ID NO: 1052843 - protein, 9 aa, Homo Sapiens
SKKYKYEVE

SEQ ID NO: 1052844 - protein, 9 aa, Homo Sapiens
LAQLFIKHK

SEQ ID NO: 1052845 - protein, 9 aa, Homo Sapiens
ENMWAIDNV

SEQ ID NO: 1052846 - protein, 9 aa, Homo Sapiens
SSIYNLVPV

SEQ ID NO: 1052847 - protein, 9 aa, Homo Sapiens
PFSGHTGRE

SEQ ID NO: 1052848 - protein, 9 aa, Homo Sapiens
YKILEKFKP

SEQ ID NO: 1052849 - protein, 9 aa, Homo Sapiens
AGGTAPNLP

SEQ ID NO: 1052850 - protein, 9 aa, Homo Sapiens
ACKVNPLAC

SEQ ID NO: 1052851 - protein, 9 aa, Homo Sapiens
DTFALEFLI

SEQ ID NO: 1052852 - protein, 9 aa, Homo Sapiens
THLIEVRLT

SEQ ID NO: 1052853 - protein, 9 aa, Homo Sapiens
LYYRKMYRD

SEQ ID NO: 1052854 - protein, 9 aa, Homo Sapiens
DQIQPIILV

SEQ ID NO: 1052855 - protein, 9 aa, Homo Sapiens
MISVFVLAS

SEQ ID NO: 1052856 - protein, 9 aa, Homo Sapiens
RSYELVCSA

SEQ ID NO: 1052857 - protein, 9 aa, Homo Sapiens
IDNYYKLVT

SEQ ID NO: 1052858 - protein, 9 aa, Homo Sapiens
VMWHLFRRY

SEQ ID NO: 1052859 - protein, 9 aa, Homo Sapiens
AFFVSAFPQ

SEQ ID NO: 1052860 - protein, 9 aa, Homo Sapiens
QGFLYARNQ

SEQ ID NO: 1052861 - protein, 9 aa, Homo Sapiens
RLATKGCEN

SEQ ID NO: 1052862 - protein, 9 aa, Homo Sapiens
RMHPFRDNR

SEQ ID NO: 1052863 - protein, 9 aa, Homo Sapiens
VFIKHNNTL

SEQ ID NO: 1052864 - protein, 9 aa, Homo Sapiens
TFQAILLMD

SEQ ID NO: 1052865 - protein, 9 aa, Homo Sapiens
DFFVNKLDP

SEQ ID NO: 1052866 - protein, 9 aa, Homo Sapiens
INVMKEAFE

SEQ ID NO: 1052867 - protein, 9 aa, Homo Sapiens
SVAYNCSMA

SEQ ID NO: 1052868 - protein, 9 aa, Homo Sapiens
SEEKQPWAE

SEQ ID NO: 1052869 - protein, 9 aa, Homo Sapiens
VVVMRNMSG

SEQ ID NO: 1052870 - protein, 9 aa, Homo Sapiens
EEDFIVKPD

SEQ ID NO: 1052871 - protein, 9 aa, Homo Sapiens
FVLKNFSAL

SEQ ID NO: 1052872 - protein, 9 aa, Homo Sapiens
DSQMLAFNP

SEQ ID NO: 1052873 - protein, 9 aa, Homo Sapiens
QNWVQKKYL

SEQ ID NO: 1052874 - protein, 9 aa, Homo Sapiens
ETPMDGGSI

SEQ ID NO: 1052875 - protein, 9 aa, Homo Sapiens
FKCRQMYYA

SEQ ID NO: 1052876 - protein, 9 aa, Homo Sapiens
SFWSSEEDK

SEQ ID NO: 1052877 - protein, 9 aa, Homo Sapiens
AVASLPNRG

SEQ ID NO: 1052878 - protein, 9 aa, Homo Sapiens
LVSACWVLR

SEQ ID NO: 1052879 - protein, 9 aa, Homo Sapiens
QGLQVLATK

SEQ ID NO: 1052880 - protein, 9 aa, Homo Sapiens
NGENKQPGC

SEQ ID NO: 1052881 - protein, 9 aa, Homo Sapiens
LIISYGYIV

SEQ ID NO: 1052882 - protein, 9 aa, Homo Sapiens
LQDLQREKD

SEQ ID NO: 1052883 - protein, 9 aa, Homo Sapiens
WDQFYSKVL

SEQ ID NO: 1052884 - protein, 9 aa, Homo Sapiens
QVKQEASFL

SEQ ID NO: 1052885 - protein, 9 aa, Homo Sapiens
FGVGQESFG

SEQ ID NO: 1052886 - protein, 9 aa, Homo Sapiens
KPRIDYPLE

SEQ ID NO: 1052887 - protein, 9 aa, Homo Sapiens
SLLTGIADA

SEQ ID NO: 1052888 - protein, 9 aa, Homo Sapiens
LSSDGKDQF

SEQ ID NO: 1052889 - protein, 9 aa, Homo Sapiens
FALFPKPRK

SEQ ID NO: 1052890 - protein, 9 aa, Homo Sapiens
FHSARSKKR

SEQ ID NO: 1052891 - protein, 9 aa, Homo Sapiens
WGPEAEPTL

SEQ ID NO: 1052892 - protein, 9 aa, Homo Sapiens
YMMMNPETK

SEQ ID NO: 1052893 - protein, 9 aa, Homo Sapiens
KRWTRELSA

SEQ ID NO: 1052894 - protein, 9 aa, Homo Sapiens
LTMLNRVVM

SEQ ID NO: 1052895 - protein, 9 aa, Homo Sapiens
YKWEVVENT

SEQ ID NO: 1052896 - protein, 9 aa, Homo Sapiens
SFVSPERDS

SEQ ID NO: 1052897 - protein, 9 aa, Homo Sapiens
NKAGTVSTS

SEQ ID NO: 1052898 - protein, 9 aa, Homo Sapiens
SGGLLQTYA

SEQ ID NO: 1052899 - protein, 9 aa, Homo Sapiens
IKMVVVGIC

SEQ ID NO: 1052900 - protein, 9 aa, Homo Sapiens
CTLLVYCTN

SEQ ID NO: 1052901 - protein, 9 aa, Homo Sapiens
SSEKGQAKA

SEQ ID NO: 1052902 - protein, 9 aa, Homo Sapiens
KDASRFLSL

SEQ ID NO: 1052903 - protein, 9 aa, Homo Sapiens
AIAETLEND

SEQ ID NO: 1052904 - protein, 9 aa, Homo Sapiens
FPAPQDTLL

SEQ ID NO: 1052905 - protein, 9 aa, Homo Sapiens
PSLPAILPT

SEQ ID NO: 1052906 - protein, 9 aa, Homo Sapiens
CQGLPCPEP

SEQ ID NO: 1052907 - protein, 9 aa, Homo Sapiens
NLHSLLPEV

SEQ ID NO: 1052908 - protein, 9 aa, Homo Sapiens
SQSCRQSHC

SEQ ID NO: 1052909 - protein, 9 aa, Homo Sapiens
KVNPKNAFL

SEQ ID NO: 1052910 - protein, 9 aa, Homo Sapiens
PQQCQQKYS

SEQ ID NO: 1052911 - protein, 9 aa, Homo Sapiens
NKENDEHEA

SEQ ID NO: 1052912 - protein, 9 aa, Homo Sapiens
TLPQPRTLP

SEQ ID NO: 1052913 - protein, 9 aa, Homo Sapiens
DGSILRIIV

SEQ ID NO: 1052914 - protein, 9 aa, Homo Sapiens
STFNHHQQT

SEQ ID NO: 1052915 - protein, 9 aa, Homo Sapiens
GPSAYVSFF

SEQ ID NO: 1052916 - protein, 9 aa, Homo Sapiens
LSLYISINS

SEQ ID NO: 1052917 - protein, 9 aa, Homo Sapiens
QLKCEYACC

SEQ ID NO: 1052918 - protein, 9 aa, Homo Sapiens
WKHLVYKMP

SEQ ID NO: 1052919 - protein, 9 aa, Homo Sapiens
AMQKNLIVR

SEQ ID NO: 1052920 - protein, 9 aa, Homo Sapiens
VTPCTTSVS

SEQ ID NO: 1052921 - protein, 9 aa, Homo Sapiens
SSACKTHSR

SEQ ID NO: 1052922 - protein, 9 aa, Homo Sapiens
KVVGVFTVP

SEQ ID NO: 1052923 - protein, 9 aa, Homo Sapiens
FYNQKEGHF

SEQ ID NO: 1052924 - protein, 9 aa, Homo Sapiens
QAFLREQRA

SEQ ID NO: 1052925 - protein, 9 aa, Homo Sapiens
DIFPGAAGG

SEQ ID NO: 1052926 - protein, 9 aa, Homo Sapiens
GCLGLVPRE

SEQ ID NO: 1052927 - protein, 9 aa, Homo Sapiens
LLKFITFSD

SEQ ID NO: 1052928 - protein, 9 aa, Homo Sapiens
EVRSLRVES

SEQ ID NO: 1052929 - protein, 9 aa, Homo Sapiens
YKIGITYYL

SEQ ID NO: 1052930 - protein, 9 aa, Homo Sapiens
IFFKEQVPM

SEQ ID NO: 1052931 - protein, 9 aa, Homo Sapiens
KKLLRMNST

SEQ ID NO: 1052932 - protein, 9 aa, Homo Sapiens
TLPCPNFFS

SEQ ID NO: 1052933 - protein, 9 aa, Homo Sapiens
QNWTLPQPR

SEQ ID NO: 1052934 - protein, 9 aa, Homo Sapiens
NNQSPTNST

SEQ ID NO: 1052935 - protein, 9 aa, Homo Sapiens
ALRQEPEGL

SEQ ID NO: 1052936 - protein, 9 aa, Homo Sapiens
LSHIAWTEA

SEQ ID NO: 1052937 - protein, 9 aa, Homo Sapiens
MLLKLKKKA

SEQ ID NO: 1052938 - protein, 9 aa, Homo Sapiens
QPCPPDTQE

SEQ ID NO: 1052939 - protein, 9 aa, Homo Sapiens
MARNRGAWS

SEQ ID NO: 1052940 - protein, 9 aa, Homo Sapiens
ESVAQTAVA

SEQ ID NO: 1052941 - protein, 9 aa, Homo Sapiens
SAMGGLEIS

SEQ ID NO: 1052942 - protein, 9 aa, Homo Sapiens
KAEEGLNFP

SEQ ID NO: 1052943 - protein, 9 aa, Homo Sapiens
ARLSSSPQH

SEQ ID NO: 1052944 - protein, 9 aa, Homo Sapiens
GQKGRPGAP

SEQ ID NO: 1052945 - protein, 9 aa, Homo Sapiens
MGTNKRASQ

SEQ ID NO: 1052946 - protein, 9 aa, Homo Sapiens
KGLQPGKFY

SEQ ID NO: 1052947 - protein, 9 aa, Homo Sapiens
QIFMKNHFC

SEQ ID NO: 1052948 - protein, 9 aa, Homo Sapiens
VMAIYKQSQ

SEQ ID NO: 1052949 - protein, 9 aa, Homo Sapiens
GSYRIHVFH

SEQ ID NO: 1052950 - protein, 9 aa, Homo Sapiens
LWADPGEAG

SEQ ID NO: 1052951 - protein, 9 aa, Homo Sapiens
SVSSTKSKK

SEQ ID NO: 1052952 - protein, 9 aa, Homo Sapiens
ALNSEINSF

SEQ ID NO: 1052953 - protein, 9 aa, Homo Sapiens
LSSENNLLV

SEQ ID NO: 1052954 - protein, 9 aa, Homo Sapiens
SKDLTQQDC

SEQ ID NO: 1052955 - protein, 9 aa, Homo Sapiens
GQVLSISLE

SEQ ID NO: 1052956 - protein, 9 aa, Homo Sapiens
KRKRLTASR

SEQ ID NO: 1052957 - protein, 9 aa, Homo Sapiens
QSVDSGTIK

SEQ ID NO: 1052958 - protein, 9 aa, Homo Sapiens
LELSCDKLP

SEQ ID NO: 1052959 - protein, 9 aa, Homo Sapiens
SLGLLRLWP

SEQ ID NO: 1052960 - protein, 9 aa, Homo Sapiens
ESLELKNTV

SEQ ID NO: 1052961 - protein, 9 aa, Homo Sapiens
FIYTLQGIE

SEQ ID NO: 1052962 - protein, 9 aa, Homo Sapiens
IIMEEMPVG

SEQ ID NO: 1052963 - protein, 9 aa, Homo Sapiens
DHSPVFFDN

SEQ ID NO: 1052964 - protein, 9 aa, Homo Sapiens
VVVVTAKKI

SEQ ID NO: 1052965 - protein, 9 aa, Homo Sapiens
FLRTLYNAE

SEQ ID NO: 1052966 - protein, 9 aa, Homo Sapiens
AAGGFDTEL

SEQ ID NO: 1052967 - protein, 9 aa, Homo Sapiens
PPTSGCLGL

SEQ ID NO: 1052968 - protein, 9 aa, Homo Sapiens
GVVSDGLPS

SEQ ID NO: 1052969 - protein, 9 aa, Homo Sapiens
SIPQWNNNA

SEQ ID NO: 1052970 - protein, 9 aa, Homo Sapiens
KKFGRGQRI

SEQ ID NO: 1052971 - protein, 9 aa, Homo Sapiens
PTQKIPKTK

SEQ ID NO: 1052972 - protein, 9 aa, Homo Sapiens
MWHLFRRYM

SEQ ID NO: 1052973 - protein, 9 aa, Homo Sapiens
TSDTTMVSN

SEQ ID NO: 1052974 - protein, 9 aa, Homo Sapiens
QLELVKRLE

SEQ ID NO: 1052975 - protein, 9 aa, Homo Sapiens
ALLTDGSTG

SEQ ID NO: 1052976 - protein, 9 aa, Homo Sapiens
INYRLLAKK

SEQ ID NO: 1052977 - protein, 9 aa, Homo Sapiens
RTPALPKPW

SEQ ID NO: 1052978 - protein, 9 aa, Homo Sapiens
EKELITWRV

SEQ ID NO: 1052979 - protein, 9 aa, Homo Sapiens
YPLADIFDE

SEQ ID NO: 1052980 - protein, 9 aa, Homo Sapiens
LGRLGHGDS

SEQ ID NO: 1052981 - protein, 9 aa, Homo Sapiens
LLAHFSPLV

SEQ ID NO: 1052982 - protein, 9 aa, Homo Sapiens
AKVWSRTAY

SEQ ID NO: 1052983 - protein, 9 aa, Homo Sapiens
KFTRETVFS

SEQ ID NO: 1052984 - protein, 9 aa, Homo Sapiens
SNYIFFMGC

SEQ ID NO: 1052985 - protein, 9 aa, Homo Sapiens
PALPKPWPG

SEQ ID NO: 1052986 - protein, 9 aa, Homo Sapiens
FDDLIFVEE

SEQ ID NO: 1052987 - protein, 9 aa, Homo Sapiens
YLRKPLIRE

SEQ ID NO: 1052988 - protein, 9 aa, Homo Sapiens
VLYHFANHV

SEQ ID NO: 1052989 - protein, 9 aa, Homo Sapiens
ETVFSYLED

SEQ ID NO: 1052990 - protein, 9 aa, Homo Sapiens
TEEEDTEEE

SEQ ID NO: 1052991 - protein, 9 aa, Homo Sapiens
GGGRFQQIQ

SEQ ID NO: 1052992 - protein, 9 aa, Homo Sapiens
SELAWTSHL

SEQ ID NO: 1052993 - protein, 9 aa, Homo Sapiens
EGFASLLTG

SEQ ID NO: 1052994 - protein, 9 aa, Homo Sapiens
DSVKTSIQR

SEQ ID NO: 1052995 - protein, 9 aa, Homo Sapiens
RWVPDCAFS

SEQ ID NO: 1052996 - protein, 9 aa, Homo Sapiens
RQQAQRGEG

SEQ ID NO: 1052997 - protein, 9 aa, Homo Sapiens
GIKRDQAPF

SEQ ID NO: 1052998 - protein, 9 aa, Homo Sapiens
CTLGEVFNR

SEQ ID NO: 1052999 - protein, 9 aa, Homo Sapiens
TGLCKLCGQ

SEQ ID NO: 1053000 - protein, 9 aa, Homo Sapiens
WNSSPPACE

SEQ ID NO: 1053001 - protein, 9 aa, Homo Sapiens
PGNNVEPPT

SEQ ID NO: 1053002 - protein, 9 aa, Homo Sapiens
TKVQAKICK

SEQ ID NO: 1053003 - protein, 9 aa, Homo Sapiens
GSPGRPGPL

SEQ ID NO: 1053004 - protein, 9 aa, Homo Sapiens
ISTRYAQYH

SEQ ID NO: 1053005 - protein, 9 aa, Homo Sapiens
NSSPPACEP

SEQ ID NO: 1053006 - protein, 9 aa, Homo Sapiens
IFMQAVLSL

SEQ ID NO: 1053007 - protein, 9 aa, Homo Sapiens
PNILNANLL

SEQ ID NO: 1053008 - protein, 9 aa, Homo Sapiens
EYEDGLSLL

SEQ ID NO: 1053009 - protein, 9 aa, Homo Sapiens
KNCWTCIGD

SEQ ID NO: 1053010 - protein, 9 aa, Homo Sapiens
ANKTSLGTV

SEQ ID NO: 1053011 - protein, 9 aa, Homo Sapiens
SNRNFIDHQ

SEQ ID NO: 1053012 - protein, 9 aa, Homo Sapiens
LQLLRRIPN

SEQ ID NO: 1053013 - protein, 9 aa, Homo Sapiens
KQEASFLVD

SEQ ID NO: 1053014 - protein, 9 aa, Homo Sapiens
SPPQRTPVG

SEQ ID NO: 1053015 - protein, 9 aa, Homo Sapiens
GRFDVSDIG

SEQ ID NO: 1053016 - protein, 9 aa, Homo Sapiens
LQPCGTCSG

SEQ ID NO: 1053017 - protein, 9 aa, Homo Sapiens
QVQREEERT

SEQ ID NO: 1053018 - protein, 9 aa, Homo Sapiens
IINSKTEQP

SEQ ID NO: 1053019 - protein, 9 aa, Homo Sapiens
YNYAILAYA

SEQ ID NO: 1053020 - protein, 9 aa, Homo Sapiens
TQRQRTPGE

SEQ ID NO: 1053021 - protein, 9 aa, Homo Sapiens
SRISVLLSE

SEQ ID NO: 1053022 - protein, 9 aa, Homo Sapiens
DGDDLGIFK

SEQ ID NO: 1053023 - protein, 9 aa, Homo Sapiens
LLVSGVLAS

SEQ ID NO: 1053024 - protein, 9 aa, Homo Sapiens
FGQPGYCDP

SEQ ID NO: 1053025 - protein, 9 aa, Homo Sapiens
MLCCHEACG

SEQ ID NO: 1053026 - protein, 9 aa, Homo Sapiens
TSHLDPRKG

SEQ ID NO: 1053027 - protein, 9 aa, Homo Sapiens
ISCRSTRNL

SEQ ID NO: 1053028 - protein, 9 aa, Homo Sapiens
IFAAESQAS

SEQ ID NO: 1053029 - protein, 9 aa, Homo Sapiens
NRKNAFSKS

SEQ ID NO: 1053030 - protein, 9 aa, Homo Sapiens
LPVIGLDKI

SEQ ID NO: 1053031 - protein, 9 aa, Homo Sapiens
SNEYQVVTS

SEQ ID NO: 1053032 - protein, 9 aa, Homo Sapiens
KCQKTVTIS

SEQ ID NO: 1053033 - protein, 9 aa, Homo Sapiens
VYVDGHLYE

SEQ ID NO: 1053034 - protein, 9 aa, Homo Sapiens
SPCKTCEGN

SEQ ID NO: 1053035 - protein, 9 aa, Homo Sapiens
RRAKETPKS

SEQ ID NO: 1053036 - protein, 9 aa, Homo Sapiens
VENGLIIVA

SEQ ID NO: 1053037 - protein, 9 aa, Homo Sapiens
SRDKFIQEL

SEQ ID NO: 1053038 - protein, 9 aa, Homo Sapiens
LIHLSKDDW

SEQ ID NO: 1053039 - protein, 9 aa, Homo Sapiens
LFVNLLLLI

SEQ ID NO: 1053040 - protein, 9 aa, Homo Sapiens
GALGVAPAL

SEQ ID NO: 1053041 - protein, 9 aa, Homo Sapiens
FIALDDIFF

SEQ ID NO: 1053042 - protein, 9 aa, Homo Sapiens
ILLLLSRER

SEQ ID NO: 1053043 - protein, 9 aa, Homo Sapiens
FDEFDSHAQ

SEQ ID NO: 1053044 - protein, 9 aa, Homo Sapiens
PQKGIQAEE

SEQ ID NO: 1053045 - protein, 9 aa, Homo Sapiens
FPASTDLLQ

SEQ ID NO: 1053046 - protein, 9 aa, Homo Sapiens
CGEHPIFVN

SEQ ID NO: 1053047 - protein, 9 aa, Homo Sapiens
ATREDPFIE

SEQ ID NO: 1053048 - protein, 9 aa, Homo Sapiens
RPFCPYLKA

SEQ ID NO: 1053049 - protein, 9 aa, Homo Sapiens
LRNSYSIDN

SEQ ID NO: 1053050 - protein, 9 aa, Homo Sapiens
SKQSTPKQT

SEQ ID NO: 1053051 - protein, 9 aa, Homo Sapiens
FLVEDAVDG

SEQ ID NO: 1053052 - protein, 9 aa, Homo Sapiens
IISNNGLVT

SEQ ID NO: 1053053 - protein, 9 aa, Homo Sapiens
YPFLGILLW

SEQ ID NO: 1053054 - protein, 9 aa, Homo Sapiens
TAKKICYQL

SEQ ID NO: 1053055 - protein, 9 aa, Homo Sapiens
LLPSGFMSF

SEQ ID NO: 1053056 - protein, 9 aa, Homo Sapiens
VQEEMSDCL

SEQ ID NO: 1053057 - protein, 9 aa, Homo Sapiens
QDASLSLLQ

SEQ ID NO: 1053058 - protein, 9 aa, Homo Sapiens
PKENEAKPS

SEQ ID NO: 1053059 - protein, 9 aa, Homo Sapiens
DNLFSKEGR

SEQ ID NO: 1053060 - protein, 9 aa, Homo Sapiens
ATLWNRSTP

SEQ ID NO: 1053061 - protein, 9 aa, Homo Sapiens
EKYTAEPIN

SEQ ID NO: 1053062 - protein, 9 aa, Homo Sapiens
DNVQFDLLH

SEQ ID NO: 1053063 - protein, 9 aa, Homo Sapiens
SLIKSDLVE

SEQ ID NO: 1053064 - protein, 9 aa, Homo Sapiens
AFLIYLKPK

SEQ ID NO: 1053065 - protein, 9 aa, Homo Sapiens
FYTIIILLL

SEQ ID NO: 1053066 - protein, 9 aa, Homo Sapiens
KLSLEELLL

SEQ ID NO: 1053067 - protein, 9 aa, Homo Sapiens
ATPGGLYVE

SEQ ID NO: 1053068 - protein, 9 aa, Homo Sapiens
ASKRPSKDE

SEQ ID NO: 1053069 - protein, 9 aa, Homo Sapiens
KWGEWDECS

SEQ ID NO: 1053070 - protein, 9 aa, Homo Sapiens
AREDDSFLL

SEQ ID NO: 1053071 - protein, 9 aa, Homo Sapiens
CNSNSQISC

SEQ ID NO: 1053072 - protein, 9 aa, Homo Sapiens
DYLVHMQRG

SEQ ID NO: 1053073 - protein, 9 aa, Homo Sapiens
FNSKSEKRG

SEQ ID NO: 1053074 - protein, 9 aa, Homo Sapiens
KGYFAKVKL

SEQ ID NO: 1053075 - protein, 9 aa, Homo Sapiens
DTWVNQVVL

SEQ ID NO: 1053076 - protein, 9 aa, Homo Sapiens
ILKGQKKNK

SEQ ID NO: 1053077 - protein, 9 aa, Homo Sapiens
SRDIFLTSV

SEQ ID NO: 1053078 - protein, 9 aa, Homo Sapiens
RMKCESPEP

SEQ ID NO: 1053079 - protein, 9 aa, Homo Sapiens
NLNSKKLTY

SEQ ID NO: 1053080 - protein, 9 aa, Homo Sapiens
AVLQLLKQE

SEQ ID NO: 1053081 - protein, 9 aa, Homo Sapiens
KMNTCVTLC

SEQ ID NO: 1053082 - protein, 9 aa, Homo Sapiens
IPWDISVAT

SEQ ID NO: 1053083 - protein, 9 aa, Homo Sapiens
VFVKPLEWN

SEQ ID NO: 1053084 - protein, 9 aa, Homo Sapiens
RTSSKFQLD

SEQ ID NO: 1053085 - protein, 9 aa, Homo Sapiens
ALGFYSCGC

SEQ ID NO: 1053086 - protein, 9 aa, Homo Sapiens
RNLEISGKS

SEQ ID NO: 1053087 - protein, 9 aa, Homo Sapiens
DMRRLRQEL

SEQ ID NO: 1053088 - protein, 9 aa, Homo Sapiens
RDCLIQFIS

SEQ ID NO: 1053089 - protein, 9 aa, Homo Sapiens
TAAMLDRES

SEQ ID NO: 1053090 - protein, 9 aa, Homo Sapiens
AAAAASVSS

SEQ ID NO: 1053091 - protein, 9 aa, Homo Sapiens
KFTKKLRNS

SEQ ID NO: 1053092 - protein, 9 aa, Homo Sapiens
TKPTPNPRL

SEQ ID NO: 1053093 - protein, 9 aa, Homo Sapiens
RFGLLPKVA

SEQ ID NO: 1053094 - protein, 9 aa, Homo Sapiens
PLLRNGDQW

SEQ ID NO: 1053095 - protein, 9 aa, Homo Sapiens
ILFYQGAAF

SEQ ID NO: 1053096 - protein, 9 aa, Homo Sapiens
MNLGAILKG

SEQ ID NO: 1053097 - protein, 9 aa, Homo Sapiens
HMQRGILFV

SEQ ID NO: 1053098 - protein, 9 aa, Homo Sapiens
DMSSDFRTL

SEQ ID NO: 1053099 - protein, 9 aa, Homo Sapiens
VTALPSSAL

SEQ ID NO: 1053100 - protein, 9 aa, Homo Sapiens
NAKCQKTVT

SEQ ID NO: 1053101 - protein, 9 aa, Homo Sapiens
IFFAGCTAQ

SEQ ID NO: 1053102 - protein, 9 aa, Homo Sapiens
NTRSFSSDY

SEQ ID NO: 1053103 - protein, 9 aa, Homo Sapiens
CLTPSTAAP

SEQ ID NO: 1053104 - protein, 9 aa, Homo Sapiens
SSLVDSTLA

SEQ ID NO: 1053105 - protein, 9 aa, Homo Sapiens
FHQQMHRDE

SEQ ID NO: 1053106 - protein, 9 aa, Homo Sapiens
NDLTQYVIS

SEQ ID NO: 1053107 - protein, 9 aa, Homo Sapiens
ANVAVLPGI

SEQ ID NO: 1053108 - protein, 9 aa, Homo Sapiens
CGRPRGAPG

SEQ ID NO: 1053109 - protein, 9 aa, Homo Sapiens
CGGDALNHT

SEQ ID NO: 1053110 - protein, 9 aa, Homo Sapiens
VLASAVLTD

SEQ ID NO: 1053111 - protein, 9 aa, Homo Sapiens
KNFERAKAV

SEQ ID NO: 1053112 - protein, 9 aa, Homo Sapiens
TLILQPQHH

SEQ ID NO: 1053113 - protein, 9 aa, Homo Sapiens
RGGSCDPRK

SEQ ID NO: 1053114 - protein, 9 aa, Homo Sapiens
TLYNAELSQ

SEQ ID NO: 1053115 - protein, 9 aa, Homo Sapiens
RSAYVTPCT

SEQ ID NO: 1053116 - protein, 9 aa, Homo Sapiens
NPLSVLKQV

SEQ ID NO: 1053117 - protein, 9 aa, Homo Sapiens
EVCQQSGEI

SEQ ID NO: 1053118 - protein, 9 aa, Homo Sapiens
LEAHCKKYE

SEQ ID NO: 1053119 - protein, 9 aa, Homo Sapiens
DAYGAGCTL

SEQ ID NO: 1053120 - protein, 9 aa, Homo Sapiens
VLIFQKPFC

SEQ ID NO: 1053121 - protein, 9 aa, Homo Sapiens
SFSLLEEKM

SEQ ID NO: 1053122 - protein, 9 aa, Homo Sapiens
MVVDNLFED

SEQ ID NO: 1053123 - protein, 9 aa, Homo Sapiens
MKWFHKNLS

SEQ ID NO: 1053124 - protein, 9 aa, Homo Sapiens
HTGKGRPAK

SEQ ID NO: 1053125 - protein, 9 aa, Homo Sapiens
EFAYEQKVA

SEQ ID NO: 1053126 - protein, 9 aa, Homo Sapiens
RLYLLRKYA

SEQ ID NO: 1053127 - protein, 9 aa, Homo Sapiens
SLVGKNYDV

SEQ ID NO: 1053128 - protein, 9 aa, Homo Sapiens
IYHINQQIF

SEQ ID NO: 1053129 - protein, 9 aa, Homo Sapiens
IGSDIANKL

SEQ ID NO: 1053130 - protein, 9 aa, Homo Sapiens
YKLRYRKRP

SEQ ID NO: 1053131 - protein, 9 aa, Homo Sapiens
CLKCGNIVV

SEQ ID NO: 1053132 - protein, 9 aa, Homo Sapiens
LLEFVSVPG

SEQ ID NO: 1053133 - protein, 9 aa, Homo Sapiens
FEANLKTKC

SEQ ID NO: 1053134 - protein, 9 aa, Homo Sapiens
LPTLREFTR

SEQ ID NO: 1053135 - protein, 9 aa, Homo Sapiens
GYQMDKSNQ

SEQ ID NO: 1053136 - protein, 9 aa, Homo Sapiens
ENGLIIVAI

SEQ ID NO: 1053137 - protein, 9 aa, Homo Sapiens
SSQSMLWLA

SEQ ID NO: 1053138 - protein, 9 aa, Homo Sapiens
PVPSSFSTY

SEQ ID NO: 1053139 - protein, 9 aa, Homo Sapiens
EKGSCPQEN

SEQ ID NO: 1053140 - protein, 9 aa, Homo Sapiens
SVSVDWAPF

SEQ ID NO: 1053141 - protein, 9 aa, Homo Sapiens
NYSYAAFCE

SEQ ID NO: 1053142 - protein, 9 aa, Homo Sapiens
VTTSENLYL

SEQ ID NO: 1053143 - protein, 9 aa, Homo Sapiens
VMIAIEGGH

SEQ ID NO: 1053144 - protein, 9 aa, Homo Sapiens
TFQQVQKHT

SEQ ID NO: 1053145 - protein, 9 aa, Homo Sapiens
KTEATRGRG

SEQ ID NO: 1053146 - protein, 9 aa, Homo Sapiens
PALEDSSLS

SEQ ID NO: 1053147 - protein, 9 aa, Homo Sapiens
GQGRSPRSG

SEQ ID NO: 1053148 - protein, 9 aa, Homo Sapiens
RVELANTSC

SEQ ID NO: 1053149 - protein, 9 aa, Homo Sapiens
LSAFFWRMV

SEQ ID NO: 1053150 - protein, 9 aa, Homo Sapiens
MPEKKDLRS

SEQ ID NO: 1053151 - protein, 9 aa, Homo Sapiens
EVRANKQEA

SEQ ID NO: 1053152 - protein, 9 aa, Homo Sapiens
NGQDCRIVL

SEQ ID NO: 1053153 - protein, 9 aa, Homo Sapiens
DQFYSKVLG

SEQ ID NO: 1053154 - protein, 9 aa, Homo Sapiens
CVTQYKGHV

SEQ ID NO: 1053155 - protein, 9 aa, Homo Sapiens
YRAILGSVE

SEQ ID NO: 1053156 - protein, 9 aa, Homo Sapiens
ARLRDKANQ

SEQ ID NO: 1053157 - protein, 9 aa, Homo Sapiens
LTEETDFFV

SEQ ID NO: 1053158 - protein, 9 aa, Homo Sapiens
KKQLELVKR

SEQ ID NO: 1053159 - protein, 9 aa, Homo Sapiens
KELEDLLER

SEQ ID NO: 1053160 - protein, 9 aa, Homo Sapiens
YFQPPSKPI

SEQ ID NO: 1053161 - protein, 9 aa, Homo Sapiens
HLLEGLVGV

SEQ ID NO: 1053162 - protein, 9 aa, Homo Sapiens
TPALPKPWP

SEQ ID NO: 1053163 - protein, 9 aa, Homo Sapiens
PQGREVSIE

SEQ ID NO: 1053164 - protein, 9 aa, Homo Sapiens
LQALHDREL

SEQ ID NO: 1053165 - protein, 9 aa, Homo Sapiens
EGNSEKALQ

SEQ ID NO: 1053166 - protein, 9 aa, Homo Sapiens
MQKNLIVRE

SEQ ID NO: 1053167 - protein, 9 aa, Homo Sapiens
YIGLGHIYL

SEQ ID NO: 1053168 - protein, 9 aa, Homo Sapiens
TVETSVPLL

SEQ ID NO: 1053169 - protein, 9 aa, Homo Sapiens
CEVENQYQG

SEQ ID NO: 1053170 - protein, 9 aa, Homo Sapiens
YQHGFHLAT

SEQ ID NO: 1053171 - protein, 9 aa, Homo Sapiens
LFINRIFYI

SEQ ID NO: 1053172 - protein, 9 aa, Homo Sapiens
DLVYFENFP

SEQ ID NO: 1053173 - protein, 9 aa, Homo Sapiens
NLTCCVHNI

SEQ ID NO: 1053174 - protein, 9 aa, Homo Sapiens
PKKLLRMNS

SEQ ID NO: 1053175 - protein, 9 aa, Homo Sapiens
YYLMKSSFI

SEQ ID NO: 1053176 - protein, 9 aa, Homo Sapiens
PGKNSKNFE

SEQ ID NO: 1053177 - protein, 9 aa, Homo Sapiens
VGMDIHWKK

SEQ ID NO: 1053178 - protein, 9 aa, Homo Sapiens
DAMDTFEGR

SEQ ID NO: 1053179 - protein, 9 aa, Homo Sapiens
GTVLSGQTI

SEQ ID NO: 1053180 - protein, 9 aa, Homo Sapiens
MTAEREVTM

SEQ ID NO: 1053181 - protein, 9 aa, Homo Sapiens
NRLMDTARI

SEQ ID NO: 1053182 - protein, 9 aa, Homo Sapiens
RRALLRPVF

SEQ ID NO: 1053183 - protein, 9 aa, Homo Sapiens
KRCPKIREE

SEQ ID NO: 1053184 - protein, 9 aa, Homo Sapiens
KIRVIDISI

SEQ ID NO: 1053185 - protein, 9 aa, Homo Sapiens
KIKFWLKMN

SEQ ID NO: 1053186 - protein, 9 aa, Homo Sapiens
IWRQKKKMH

SEQ ID NO: 1053187 - protein, 9 aa, Homo Sapiens
WKLASMFKG

SEQ ID NO: 1053188 - protein, 9 aa, Homo Sapiens
LENDIPETE

SEQ ID NO: 1053189 - protein, 9 aa, Homo Sapiens
DDDLFQDSP

SEQ ID NO: 1053190 - protein, 9 aa, Homo Sapiens
EATVTLWMS

SEQ ID NO: 1053191 - protein, 9 aa, Homo Sapiens
LSDLEKEKL

SEQ ID NO: 1053192 - protein, 9 aa, Homo Sapiens
LPQKRDRLP

SEQ ID NO: 1053193 - protein, 9 aa, Homo Sapiens
RLKAELEAR

SEQ ID NO: 1053194 - protein, 9 aa, Homo Sapiens
TKRDDDYAG

SEQ ID NO: 1053195 - protein, 9 aa, Homo Sapiens
FSSRQPIYM

SEQ ID NO: 1053196 - protein, 9 aa, Homo Sapiens
VSKGLDIES

SEQ ID NO: 1053197 - protein, 9 aa, Homo Sapiens
SLYSQQLKG

SEQ ID NO: 1053198 - protein, 9 aa, Homo Sapiens
LRLWTDFCF

SEQ ID NO: 1053199 - protein, 9 aa, Homo Sapiens
PPPDLFPKM

SEQ ID NO: 1053200 - protein, 9 aa, Homo Sapiens
TPDSVCLGI

SEQ ID NO: 1053201 - protein, 9 aa, Homo Sapiens
QEVWYILAS

SEQ ID NO: 1053202 - protein, 9 aa, Homo Sapiens
RQKIVSIEP

SEQ ID NO: 1053203 - protein, 9 aa, Homo Sapiens
LCGLWLWLC

SEQ ID NO: 1053204 - protein, 9 aa, Homo Sapiens
IIIQGGKHQ

SEQ ID NO: 1053205 - protein, 9 aa, Homo Sapiens
LTIFRIKSK

SEQ ID NO: 1053206 - protein, 9 aa, Homo Sapiens
PLLNCAKDM

SEQ ID NO: 1053207 - protein, 9 aa, Homo Sapiens
LLGFPIDPR

SEQ ID NO: 1053208 - protein, 9 aa, Homo Sapiens
LTSVHKKQS

SEQ ID NO: 1053209 - protein, 9 aa, Homo Sapiens
VDLTLLSLK

SEQ ID NO: 1053210 - protein, 9 aa, Homo Sapiens
ERLRLVGSE

SEQ ID NO: 1053211 - protein, 9 aa, Homo Sapiens
VQKHLTTPS

SEQ ID NO: 1053212 - protein, 9 aa, Homo Sapiens
FFVYMCYEF

SEQ ID NO: 1053213 - protein, 9 aa, Homo Sapiens
QEKIKMEGI

SEQ ID NO: 1053214 - protein, 9 aa, Homo Sapiens
KSLDNRNWP

SEQ ID NO: 1053215 - protein, 9 aa, Homo Sapiens
VALNVEFYT

SEQ ID NO: 1053216 - protein, 9 aa, Homo Sapiens
YQRTLLEFW

SEQ ID NO: 1053217 - protein, 9 aa, Homo Sapiens
IYTGEKLYK

SEQ ID NO: 1053218 - protein, 9 aa, Homo Sapiens
KKKKVTKAK

SEQ ID NO: 1053219 - protein, 9 aa, Homo Sapiens
NECKKSENS

SEQ ID NO: 1053220 - protein, 9 aa, Homo Sapiens
DSHQNQWTV

SEQ ID NO: 1053221 - protein, 9 aa, Homo Sapiens
KFHSFSTNI

SEQ ID NO: 1053222 - protein, 9 aa, Homo Sapiens
NFERAKAVR

SEQ ID NO: 1053223 - protein, 9 aa, Homo Sapiens
MHLLFSLTL

SEQ ID NO: 1053224 - protein, 9 aa, Homo Sapiens
ENKLKALGM

SEQ ID NO: 1053225 - protein, 9 aa, Homo Sapiens
RQASSQSML

SEQ ID NO: 1053226 - protein, 9 aa, Homo Sapiens
MLFFFVSVI

SEQ ID NO: 1053227 - protein, 9 aa, Homo Sapiens
EVSIEGMIV

SEQ ID NO: 1053228 - protein, 9 aa, Homo Sapiens
DIIFVLAMT

SEQ ID NO: 1053229 - protein, 9 aa, Homo Sapiens
YFNNNIAPV

SEQ ID NO: 1053230 - protein, 9 aa, Homo Sapiens
NAEVERLRE

SEQ ID NO: 1053231 - protein, 9 aa, Homo Sapiens
RRTNCAYVV

SEQ ID NO: 1053232 - protein, 9 aa, Homo Sapiens
RFNQEEGAG

SEQ ID NO: 1053233 - protein, 9 aa, Homo Sapiens
CTAIHEVME

SEQ ID NO: 1053234 - protein, 9 aa, Homo Sapiens
GEEYESESG

SEQ ID NO: 1053235 - protein, 9 aa, Homo Sapiens
RDMCRAKTG

SEQ ID NO: 1053236 - protein, 9 aa, Homo Sapiens
KFLGFVVTP

SEQ ID NO: 1053237 - protein, 9 aa, Homo Sapiens
CYKLTVPRF

SEQ ID NO: 1053238 - protein, 9 aa, Homo Sapiens
YTPKFVKGR

SEQ ID NO: 1053239 - protein, 9 aa, Homo Sapiens
QTDTEEEDT

SEQ ID NO: 1053240 - protein, 9 aa, Homo Sapiens
KDLTQQDCS

SEQ ID NO: 1053241 - protein, 9 aa, Homo Sapiens
SDSRKYPEL

SEQ ID NO: 1053242 - protein, 9 aa, Homo Sapiens
NEIKKNKTS

SEQ ID NO: 1053243 - protein, 9 aa, Homo Sapiens
KPASNWGPY

SEQ ID NO: 1053244 - protein, 9 aa, Homo Sapiens
LLDSMNRRI

SEQ ID NO: 1053245 - protein, 9 aa, Homo Sapiens
RKEWEMWHP

SEQ ID NO: 1053246 - protein, 9 aa, Homo Sapiens
NPNNKYEPF

SEQ ID NO: 1053247 - protein, 9 aa, Homo Sapiens
WHNDLTQYV

SEQ ID NO: 1053248 - protein, 9 aa, Homo Sapiens
LPLGIFYIE

SEQ ID NO: 1053249 - protein, 9 aa, Homo Sapiens
VWSDSTKSK

SEQ ID NO: 1053250 - protein, 9 aa, Homo Sapiens
GAGTKTTST

SEQ ID NO: 1053251 - protein, 9 aa, Homo Sapiens
ESRLLAYLP

SEQ ID NO: 1053252 - protein, 9 aa, Homo Sapiens
FILLGLSKF

SEQ ID NO: 1053253 - protein, 9 aa, Homo Sapiens
IKQAPAPSQ

SEQ ID NO: 1053254 - protein, 9 aa, Homo Sapiens
EPINVQVEF

SEQ ID NO: 1053255 - protein, 9 aa, Homo Sapiens
ISLKEEETE

SEQ ID NO: 1053256 - protein, 9 aa, Homo Sapiens
VLRMVDGLL

SEQ ID NO: 1053257 - protein, 9 aa, Homo Sapiens
PITEPGMVL

SEQ ID NO: 1053258 - protein, 9 aa, Homo Sapiens
LPSGLLLPG

SEQ ID NO: 1053259 - protein, 9 aa, Homo Sapiens
DHKYSYQAP

SEQ ID NO: 1053260 - protein, 9 aa, Homo Sapiens
DRCTDCLCP

SEQ ID NO: 1053261 - protein, 9 aa, Homo Sapiens
HSLLTFFCV

SEQ ID NO: 1053262 - protein, 9 aa, Homo Sapiens
AGFPSVPLV

SEQ ID NO: 1053263 - protein, 9 aa, Homo Sapiens
SRTDSNKRV

SEQ ID NO: 1053264 - protein, 9 aa, Homo Sapiens
GLHLWSSCI

SEQ ID NO: 1053265 - protein, 9 aa, Homo Sapiens
AMLLISLFL

SEQ ID NO: 1053266 - protein, 9 aa, Homo Sapiens
QKVEVNCKW

SEQ ID NO: 1053267 - protein, 9 aa, Homo Sapiens
QTPVTAYNL

SEQ ID NO: 1053268 - protein, 9 aa, Homo Sapiens
PHCSTVEED

SEQ ID NO: 1053269 - protein, 9 aa, Homo Sapiens
EFDSHAQHL

SEQ ID NO: 1053270 - protein, 9 aa, Homo Sapiens
GGPRVFFYQ

SEQ ID NO: 1053271 - protein, 9 aa, Homo Sapiens
LTKKVARHD

SEQ ID NO: 1053272 - protein, 9 aa, Homo Sapiens
LRIYPGFLM

SEQ ID NO: 1053273 - protein, 9 aa, Homo Sapiens
KGRIVFLEL

SEQ ID NO: 1053274 - protein, 9 aa, Homo Sapiens
LLRLSKHEP

SEQ ID NO: 1053275 - protein, 9 aa, Homo Sapiens
DFPCHHGKG

SEQ ID NO: 1053276 - protein, 9 aa, Homo Sapiens
QINFWKPDS

SEQ ID NO: 1053277 - protein, 9 aa, Homo Sapiens
STEERRLWP

SEQ ID NO: 1053278 - protein, 9 aa, Homo Sapiens
WYLVSIPAF

SEQ ID NO: 1053279 - protein, 9 aa, Homo Sapiens
PSVYCTSSA

SEQ ID NO: 1053280 - protein, 9 aa, Homo Sapiens
VVDASFVSP

SEQ ID NO: 1053281 - protein, 9 aa, Homo Sapiens
SWYDFPWGN

SEQ ID NO: 1053282 - protein, 9 aa, Homo Sapiens
DKFVVLALA

SEQ ID NO: 1053283 - protein, 9 aa, Homo Sapiens
YRRTALILA

SEQ ID NO: 1053284 - protein, 9 aa, Homo Sapiens
KNEPLHKKE

SEQ ID NO: 1053285 - protein, 9 aa, Homo Sapiens
DPLNETVVR

SEQ ID NO: 1053286 - protein, 9 aa, Homo Sapiens
GQDMRRLRQ

SEQ ID NO: 1053287 - protein, 9 aa, Homo Sapiens
LHYTTFDGR

SEQ ID NO: 1053288 - protein, 9 aa, Homo Sapiens
FSDLGKHCS

SEQ ID NO: 1053289 - protein, 9 aa, Homo Sapiens
QKRDRLPSC

SEQ ID NO: 1053290 - protein, 9 aa, Homo Sapiens
KELERVILY

SEQ ID NO: 1053291 - protein, 9 aa, Homo Sapiens
SIQDPVRNL

SEQ ID NO: 1053292 - protein, 9 aa, Homo Sapiens
QPFCNGDTH

SEQ ID NO: 1053293 - protein, 9 aa, Homo Sapiens
FPARVPSPP

SEQ ID NO: 1053294 - protein, 9 aa, Homo Sapiens
FLSLFWRQI

SEQ ID NO: 1053295 - protein, 9 aa, Homo Sapiens
LAEGDMVWW

SEQ ID NO: 1053296 - protein, 9 aa, Homo Sapiens
TQQSSVAAT

SEQ ID NO: 1053297 - protein, 9 aa, Homo Sapiens
AYNLYSHTS

SEQ ID NO: 1053298 - protein, 9 aa, Homo Sapiens
KAAFSYRHY

SEQ ID NO: 1053299 - protein, 9 aa, Homo Sapiens
TETTANTLF

SEQ ID NO: 1053300 - protein, 9 aa, Homo Sapiens
QDADIYFLD

SEQ ID NO: 1053301 - protein, 9 aa, Homo Sapiens
LPPGNFDPW

SEQ ID NO: 1053302 - protein, 9 aa, Homo Sapiens
EYACCLQCL

SEQ ID NO: 1053303 - protein, 9 aa, Homo Sapiens
PRLFFPSIK

SEQ ID NO: 1053304 - protein, 9 aa, Homo Sapiens
LTHHPHFIY

SEQ ID NO: 1053305 - protein, 9 aa, Homo Sapiens
KDDFFSLQA

SEQ ID NO: 1053306 - protein, 9 aa, Homo Sapiens
WLGDLLGSM

SEQ ID NO: 1053307 - protein, 9 aa, Homo Sapiens
TPYTRYHPI

SEQ ID NO: 1053308 - protein, 9 aa, Homo Sapiens
SAYVTPCTT

SEQ ID NO: 1053309 - protein, 9 aa, Homo Sapiens
GPGRELFYN

SEQ ID NO: 1053310 - protein, 9 aa, Homo Sapiens
HETLPKEVG

SEQ ID NO: 1053311 - protein, 9 aa, Homo Sapiens
STISKEGYL

SEQ ID NO: 1053312 - protein, 9 aa, Homo Sapiens
GDFNFWLDS

SEQ ID NO: 1053313 - protein, 9 aa, Homo Sapiens
DECIGGSGN

SEQ ID NO: 1053314 - protein, 9 aa, Homo Sapiens
QASQREDDI

SEQ ID NO: 1053315 - protein, 9 aa, Homo Sapiens
PSRGRHGSN

SEQ ID NO: 1053316 - protein, 9 aa, Homo Sapiens
SFRSLLHTL

SEQ ID NO: 1053317 - protein, 9 aa, Homo Sapiens
PTSIFLASL

SEQ ID NO: 1053318 - protein, 9 aa, Homo Sapiens
ILWFEARKI

SEQ ID NO: 1053319 - protein, 9 aa, Homo Sapiens
DAEPMKKLS

SEQ ID NO: 1053320 - protein, 9 aa, Homo Sapiens
YVLYADREI

SEQ ID NO: 1053321 - protein, 9 aa, Homo Sapiens
KEDQLEYQK

SEQ ID NO: 1053322 - protein, 9 aa, Homo Sapiens
KDEHMQVVD

SEQ ID NO: 1053323 - protein, 9 aa, Homo Sapiens
SLAPPHRRR

SEQ ID NO: 1053324 - protein, 9 aa, Homo Sapiens
LKLEKLDIS

SEQ ID NO: 1053325 - protein, 9 aa, Homo Sapiens
GLRQDLETS

SEQ ID NO: 1053326 - protein, 9 aa, Homo Sapiens
HVLCNHPSW

SEQ ID NO: 1053327 - protein, 9 aa, Homo Sapiens
IVEFFRPSK

SEQ ID NO: 1053328 - protein, 9 aa, Homo Sapiens
LTFYDNVQF

SEQ ID NO: 1053329 - protein, 9 aa, Homo Sapiens
EKSSFQIIQ

SEQ ID NO: 1053330 - protein, 9 aa, Homo Sapiens
FASEEKQPW

SEQ ID NO: 1053331 - protein, 9 aa, Homo Sapiens
ELSLEDKSP

SEQ ID NO: 1053332 - protein, 9 aa, Homo Sapiens
AHGNSYPFD

SEQ ID NO: 1053333 - protein, 9 aa, Homo Sapiens
RKGLLGQRR

SEQ ID NO: 1053334 - protein, 9 aa, Homo Sapiens
EKSLDDETV

SEQ ID NO: 1053335 - protein, 9 aa, Homo Sapiens
NWREKGYVT

SEQ ID NO: 1053336 - protein, 9 aa, Homo Sapiens
YKSELTGSS

SEQ ID NO: 1053337 - protein, 9 aa, Homo Sapiens
VLVHAGWCC

SEQ ID NO: 1053338 - protein, 9 aa, Homo Sapiens
QQVDNNLRF

SEQ ID NO: 1053339 - protein, 9 aa, Homo Sapiens
MDCNRFFRV

SEQ ID NO: 1053340 - protein, 9 aa, Homo Sapiens
MAGFFRGDK

SEQ ID NO: 1053341 - protein, 9 aa, Homo Sapiens
RHIPGVVKV

SEQ ID NO: 1053342 - protein, 9 aa, Homo Sapiens
LKLHLDEDY

SEQ ID NO: 1053343 - protein, 9 aa, Homo Sapiens
SVCEFVLSK

SEQ ID NO: 1053344 - protein, 9 aa, Homo Sapiens
FLGATECFF

SEQ ID NO: 1053345 - protein, 9 aa, Homo Sapiens
QLQDLRTIY

SEQ ID NO: 1053346 - protein, 9 aa, Homo Sapiens
QLRGSLSLC

SEQ ID NO: 1053347 - protein, 9 aa, Homo Sapiens
VSECQEMHR

SEQ ID NO: 1053348 - protein, 9 aa, Homo Sapiens
CNGQVDGNK

SEQ ID NO: 1053349 - protein, 9 aa, Homo Sapiens
LRQMEIRRI

SEQ ID NO: 1053350 - protein, 9 aa, Homo Sapiens
AADDLPPRP

SEQ ID NO: 1053351 - protein, 9 aa, Homo Sapiens
SPPEVFSAF

SEQ ID NO: 1053352 - protein, 9 aa, Homo Sapiens
PSRMSMKLT

SEQ ID NO: 1053353 - protein, 9 aa, Homo Sapiens
FFLANPTTS

SEQ ID NO: 1053354 - protein, 9 aa, Homo Sapiens
SMEHLVQYF

SEQ ID NO: 1053355 - protein, 9 aa, Homo Sapiens
KHTDQIWKF

SEQ ID NO: 1053356 - protein, 9 aa, Homo Sapiens
CGNIVVYHV

SEQ ID NO: 1053357 - protein, 9 aa, Homo Sapiens
LLASEEEIT

SEQ ID NO: 1053358 - protein, 9 aa, Homo Sapiens
SETPTGLAD

SEQ ID NO: 1053359 - protein, 9 aa, Homo Sapiens
AYWGVLNSP

SEQ ID NO: 1053360 - protein, 9 aa, Homo Sapiens
RMIGELISK

SEQ ID NO: 1053361 - protein, 9 aa, Homo Sapiens
SELGDSGVF

SEQ ID NO: 1053362 - protein, 9 aa, Homo Sapiens
WTYSNTRCD

SEQ ID NO: 1053363 - protein, 9 aa, Homo Sapiens
SEESKIQTD

SEQ ID NO: 1053364 - protein, 9 aa, Homo Sapiens
YHPGNSCFT

SEQ ID NO: 1053365 - protein, 9 aa, Homo Sapiens
CSCRMKGFS

SEQ ID NO: 1053366 - protein, 9 aa, Homo Sapiens
FTAICYLLR

SEQ ID NO: 1053367 - protein, 9 aa, Homo Sapiens
IPAEVHIVK

SEQ ID NO: 1053368 - protein, 9 aa, Homo Sapiens
TPKPSPALV

SEQ ID NO: 1053369 - protein, 9 aa, Homo Sapiens
KLSSKRPLV

SEQ ID NO: 1053370 - protein, 9 aa, Homo Sapiens
ASEVSEESH

SEQ ID NO: 1053371 - protein, 9 aa, Homo Sapiens
NLKGTEISH

SEQ ID NO: 1053372 - protein, 9 aa, Homo Sapiens
GAGDTHNSY

SEQ ID NO: 1053373 - protein, 9 aa, Homo Sapiens
GLNSFERDS

SEQ ID NO: 1053374 - protein, 9 aa, Homo Sapiens
SPGPAPPYG

SEQ ID NO: 1053375 - protein, 9 aa, Homo Sapiens
INFVKRKIR

SEQ ID NO: 1053376 - protein, 9 aa, Homo Sapiens
FHGGQYRCY

SEQ ID NO: 1053377 - protein, 9 aa, Homo Sapiens
AAKHKFSGF

SEQ ID NO: 1053378 - protein, 9 aa, Homo Sapiens
EWRRLPWWE

SEQ ID NO: 1053379 - protein, 9 aa, Homo Sapiens
CKPGYKGKG

SEQ ID NO: 1053380 - protein, 9 aa, Homo Sapiens
GQPIHKGKS

SEQ ID NO: 1053381 - protein, 9 aa, Homo Sapiens
LYFSAECPD

SEQ ID NO: 1053382 - protein, 9 aa, Homo Sapiens
SDIKQSSDS

SEQ ID NO: 1053383 - protein, 9 aa, Homo Sapiens
TFPLLPHYI

SEQ ID NO: 1053384 - protein, 9 aa, Homo Sapiens
GPWVLPMGL

SEQ ID NO: 1053385 - protein, 9 aa, Homo Sapiens
PGESSEIFK

SEQ ID NO: 1053386 - protein, 9 aa, Homo Sapiens
GCGFCYKIA

SEQ ID NO: 1053387 - protein, 9 aa, Homo Sapiens
PRVLKIFGA

SEQ ID NO: 1053388 - protein, 9 aa, Homo Sapiens
YVYFLLPPL

SEQ ID NO: 1053389 - protein, 9 aa, Homo Sapiens
FVGLFFPTV

SEQ ID NO: 1053390 - protein, 9 aa, Homo Sapiens
ATKAPRLLL

SEQ ID NO: 1053391 - protein, 9 aa, Homo Sapiens
SQKNVAPGI

SEQ ID NO: 1053392 - protein, 9 aa, Homo Sapiens
DYCFAREDQ

SEQ ID NO: 1053393 - protein, 9 aa, Homo Sapiens
PQQLFASVM

SEQ ID NO: 1053394 - protein, 9 aa, Homo Sapiens
MVDSRKNCW

SEQ ID NO: 1053395 - protein, 9 aa, Homo Sapiens
KPSAVDSQK

SEQ ID NO: 1053396 - protein, 9 aa, Homo Sapiens
IFYKNGLFC

SEQ ID NO: 1053397 - protein, 9 aa, Homo Sapiens
CSIQDPVRN

SEQ ID NO: 1053398 - protein, 9 aa, Homo Sapiens
GPFGQPGYC

SEQ ID NO: 1053399 - protein, 9 aa, Homo Sapiens
CGEAFPAST

SEQ ID NO: 1053400 - protein, 9 aa, Homo Sapiens
DIPCELIGK

SEQ ID NO: 1053401 - protein, 9 aa, Homo Sapiens
AARYWDIMK

SEQ ID NO: 1053402 - protein, 9 aa, Homo Sapiens
SSGAGLWLH

SEQ ID NO: 1053403 - protein, 9 aa, Homo Sapiens
QQVQKHTDQ

SEQ ID NO: 1053404 - protein, 9 aa, Homo Sapiens
FVRKILQKK

SEQ ID NO: 1053405 - protein, 9 aa, Homo Sapiens
KNLTFKLEV

SEQ ID NO: 1053406 - protein, 9 aa, Homo Sapiens
LPKCPPVSS

SEQ ID NO: 1053407 - protein, 9 aa, Homo Sapiens
SIGNGPLSS

SEQ ID NO: 1053408 - protein, 9 aa, Homo Sapiens
HYGEPAENQ

SEQ ID NO: 1053409 - protein, 9 aa, Homo Sapiens
AVQMFFGLA

SEQ ID NO: 1053410 - protein, 9 aa, Homo Sapiens
YSLWKIDVI

SEQ ID NO: 1053411 - protein, 9 aa, Homo Sapiens
GLKSLAPNC

SEQ ID NO: 1053412 - protein, 9 aa, Homo Sapiens
PTGPPTYTS

SEQ ID NO: 1053413 - protein, 9 aa, Homo Sapiens
KHKFSGFPR

SEQ ID NO: 1053414 - protein, 9 aa, Homo Sapiens
SLSPIGHMK

SEQ ID NO: 1053415 - protein, 9 aa, Homo Sapiens
EPSLLSPKV

SEQ ID NO: 1053416 - protein, 9 aa, Homo Sapiens
TKTLEKIAE

SEQ ID NO: 1053417 - protein, 9 aa, Homo Sapiens
ELPPELDIF

SEQ ID NO: 1053418 - protein, 9 aa, Homo Sapiens
DFHPLPPSY

SEQ ID NO: 1053419 - protein, 9 aa, Homo Sapiens
CHLRKEGHK

SEQ ID NO: 1053420 - protein, 9 aa, Homo Sapiens
KKKKLQGKG

SEQ ID NO: 1053421 - protein, 9 aa, Homo Sapiens
TSPQTVAPL

SEQ ID NO: 1053422 - protein, 9 aa, Homo Sapiens
PNKDAENED

SEQ ID NO: 1053423 - protein, 9 aa, Homo Sapiens
VWHVHSLWV

SEQ ID NO: 1053424 - protein, 9 aa, Homo Sapiens
HHILHQTVT

SEQ ID NO: 1053425 - protein, 9 aa, Homo Sapiens
TKWGEWDEC

SEQ ID NO: 1053426 - protein, 9 aa, Homo Sapiens
SAASFGFFH

SEQ ID NO: 1053427 - protein, 9 aa, Homo Sapiens
LRFWQLSSL

SEQ ID NO: 1053428 - protein, 9 aa, Homo Sapiens
GLEDIQSRI

SEQ ID NO: 1053429 - protein, 9 aa, Homo Sapiens
LVRALCNGD

SEQ ID NO: 1053430 - protein, 9 aa, Homo Sapiens
LTASRSLVE

SEQ ID NO: 1053431 - protein, 9 aa, Homo Sapiens
SQLWADPGE

SEQ ID NO: 1053432 - protein, 9 aa, Homo Sapiens
REDPFIEKL

SEQ ID NO: 1053433 - protein, 9 aa, Homo Sapiens
QVAKAEEWL

SEQ ID NO: 1053434 - protein, 9 aa, Homo Sapiens
TDYHIFLVE

SEQ ID NO: 1053435 - protein, 9 aa, Homo Sapiens
DKRVYMTWV

SEQ ID NO: 1053436 - protein, 9 aa, Homo Sapiens
GQNPTLLSL

SEQ ID NO: 1053437 - protein, 9 aa, Homo Sapiens
GEAEEYEDT

SEQ ID NO: 1053438 - protein, 9 aa, Homo Sapiens
LRLEKMAVE

SEQ ID NO: 1053439 - protein, 9 aa, Homo Sapiens
PTLGARRKK

SEQ ID NO: 1053440 - protein, 9 aa, Homo Sapiens
TMAITSRHY

SEQ ID NO: 1053441 - protein, 9 aa, Homo Sapiens
LTSPPVSCL

SEQ ID NO: 1053442 - protein, 9 aa, Homo Sapiens
GPQRQDLST

SEQ ID NO: 1053443 - protein, 9 aa, Homo Sapiens
ITLFKKKAG

SEQ ID NO: 1053444 - protein, 9 aa, Homo Sapiens
EAFPASTDL

SEQ ID NO: 1053445 - protein, 9 aa, Homo Sapiens
QLSIKQAQT

SEQ ID NO: 1053446 - protein, 9 aa, Homo Sapiens
ISYEITLLS

SEQ ID NO: 1053447 - protein, 9 aa, Homo Sapiens
SGSSLSSSP

SEQ ID NO: 1053448 - protein, 9 aa, Homo Sapiens
TVSTRSSKA

SEQ ID NO: 1053449 - protein, 9 aa, Homo Sapiens
PSEDTELLS

SEQ ID NO: 1053450 - protein, 9 aa, Homo Sapiens
INPLSSPSS

SEQ ID NO: 1053451 - protein, 9 aa, Homo Sapiens
GKRMRVVHK

SEQ ID NO: 1053452 - protein, 9 aa, Homo Sapiens
EKFDPQNSR

SEQ ID NO: 1053453 - protein, 9 aa, Homo Sapiens
FPKPRKNVA

SEQ ID NO: 1053454 - protein, 9 aa, Homo Sapiens
GFFRGDKVI

SEQ ID NO: 1053455 - protein, 9 aa, Homo Sapiens
QRTYYHGQT

SEQ ID NO: 1053456 - protein, 9 aa, Homo Sapiens
APPSPERTA

SEQ ID NO: 1053457 - protein, 9 aa, Homo Sapiens
PKCLPKCPP

SEQ ID NO: 1053458 - protein, 9 aa, Homo Sapiens
CKPASNWGP

SEQ ID NO: 1053459 - protein, 9 aa, Homo Sapiens
VLLTSCYKL

SEQ ID NO: 1053460 - protein, 9 aa, Homo Sapiens
VYGDIIVTE

SEQ ID NO: 1053461 - protein, 9 aa, Homo Sapiens
EERDDFDPE

SEQ ID NO: 1053462 - protein, 9 aa, Homo Sapiens
LTSETVFTK

SEQ ID NO: 1053463 - protein, 9 aa, Homo Sapiens
MYVSLTLFL

SEQ ID NO: 1053464 - protein, 9 aa, Homo Sapiens
SQGHLTFRD

SEQ ID NO: 1053465 - protein, 9 aa, Homo Sapiens
PLSDTPETV

SEQ ID NO: 1053466 - protein, 9 aa, Homo Sapiens
PSVVGVTSS

SEQ ID NO: 1053467 - protein, 9 aa, Homo Sapiens
GSKVDFRDA

SEQ ID NO: 1053468 - protein, 9 aa, Homo Sapiens
KKYLVYRQV

SEQ ID NO: 1053469 - protein, 9 aa, Homo Sapiens
MYISILFLG

SEQ ID NO: 1053470 - protein, 9 aa, Homo Sapiens
LTFFSYLLL

SEQ ID NO: 1053471 - protein, 9 aa, Homo Sapiens
PCIPKSQFL

SEQ ID NO: 1053472 - protein, 9 aa, Homo Sapiens
KKELEDLLE

SEQ ID NO: 1053473 - protein, 9 aa, Homo Sapiens
VNTHIHAAA

SEQ ID NO: 1053474 - protein, 9 aa, Homo Sapiens
SRSKPGESE

SEQ ID NO: 1053475 - protein, 9 aa, Homo Sapiens
NSVFGGARA

SEQ ID NO: 1053476 - protein, 9 aa, Homo Sapiens
VLSKLEGHT

SEQ ID NO: 1053477 - protein, 9 aa, Homo Sapiens
NGELAPLRT

SEQ ID NO: 1053478 - protein, 9 aa, Homo Sapiens
VNGYIEDAM

SEQ ID NO: 1053479 - protein, 9 aa, Homo Sapiens
RVLLYLPAL

SEQ ID NO: 1053480 - protein, 9 aa, Homo Sapiens
KGRPAKLSY

SEQ ID NO: 1053481 - protein, 9 aa, Homo Sapiens
NNFVLIGSF

SEQ ID NO: 1053482 - protein, 9 aa, Homo Sapiens
TRSSKALIL

SEQ ID NO: 1053483 - protein, 9 aa, Homo Sapiens
VSIKKMEDT

SEQ ID NO: 1053484 - protein, 9 aa, Homo Sapiens
KPVSPNSSL

SEQ ID NO: 1053485 - protein, 9 aa, Homo Sapiens
LPVLDYSVG

SEQ ID NO: 1053486 - protein, 9 aa, Homo Sapiens
NKKKEKQVT

SEQ ID NO: 1053487 - protein, 9 aa, Homo Sapiens
SCAFSQPVR

SEQ ID NO: 1053488 - protein, 9 aa, Homo Sapiens
EKTIFFAGC

SEQ ID NO: 1053489 - protein, 9 aa, Homo Sapiens
ESTEERRLW

SEQ ID NO: 1053490 - protein, 9 aa, Homo Sapiens
SASINQISG

SEQ ID NO: 1053491 - protein, 9 aa, Homo Sapiens
LPNKVKYVH

SEQ ID NO: 1053492 - protein, 9 aa, Homo Sapiens
HNKDKLNLK

SEQ ID NO: 1053493 - protein, 9 aa, Homo Sapiens
SEKALQAII

SEQ ID NO: 1053494 - protein, 9 aa, Homo Sapiens
STRSSKALI

SEQ ID NO: 1053495 - protein, 9 aa, Homo Sapiens
IESFFPDES

SEQ ID NO: 1053496 - protein, 9 aa, Homo Sapiens
SARNLDTGT

SEQ ID NO: 1053497 - protein, 9 aa, Homo Sapiens
EKSSHSVTT

SEQ ID NO: 1053498 - protein, 9 aa, Homo Sapiens
RVEKFLHQR

SEQ ID NO: 1053499 - protein, 9 aa, Homo Sapiens
LEFHQRPGY

SEQ ID NO: 1053500 - protein, 9 aa, Homo Sapiens
FCKKMSVGY

SEQ ID NO: 1053501 - protein, 9 aa, Homo Sapiens
ITVRGRPAQ

SEQ ID NO: 1053502 - protein, 9 aa, Homo Sapiens
DCLSFINEV

SEQ ID NO: 1053503 - protein, 9 aa, Homo Sapiens
VQSKKYKYE

SEQ ID NO: 1053504 - protein, 9 aa, Homo Sapiens
QRAIFFAGC

SEQ ID NO: 1053505 - protein, 9 aa, Homo Sapiens
VFRQYWDIL

SEQ ID NO: 1053506 - protein, 9 aa, Homo Sapiens
PGIQLKLDR

SEQ ID NO: 1053507 - protein, 9 aa, Homo Sapiens
LSISPEMLA

SEQ ID NO: 1053508 - protein, 9 aa, Homo Sapiens
REGYSHDSL

SEQ ID NO: 1053509 - protein, 9 aa, Homo Sapiens
VIRATNRPD

SEQ ID NO: 1053510 - protein, 9 aa, Homo Sapiens
LEIPDEVKL

SEQ ID NO: 1053511 - protein, 9 aa, Homo Sapiens
MKMSGPYNS

SEQ ID NO: 1053512 - protein, 9 aa, Homo Sapiens
VLSISEDTP

SEQ ID NO: 1053513 - protein, 9 aa, Homo Sapiens
SKMEIFEEK

SEQ ID NO: 1053514 - protein, 9 aa, Homo Sapiens
LFDGSCMVE

SEQ ID NO: 1053515 - protein, 9 aa, Homo Sapiens
SLDDSSNKT

SEQ ID NO: 1053516 - protein, 9 aa, Homo Sapiens
SNSSTAFQP

SEQ ID NO: 1053517 - protein, 9 aa, Homo Sapiens
YRELRLFKH

SEQ ID NO: 1053518 - protein, 9 aa, Homo Sapiens
LVTRLSDGN

SEQ ID NO: 1053519 - protein, 9 aa, Homo Sapiens
FIRHLRSHS

SEQ ID NO: 1053520 - protein, 9 aa, Homo Sapiens
GCKIRNTDT

SEQ ID NO: 1053521 - protein, 9 aa, Homo Sapiens
LWEKASGKL

SEQ ID NO: 1053522 - protein, 9 aa, Homo Sapiens
FQDSPEQEA

SEQ ID NO: 1053523 - protein, 9 aa, Homo Sapiens
PDFYSPAYE

SEQ ID NO: 1053524 - protein, 9 aa, Homo Sapiens
KYKQGYQKQ

SEQ ID NO: 1053525 - protein, 9 aa, Homo Sapiens
MWFIYTLQG

SEQ ID NO: 1053526 - protein, 9 aa, Homo Sapiens
VAASTERTL

SEQ ID NO: 1053527 - protein, 9 aa, Homo Sapiens
ELIQLLKLH

SEQ ID NO: 1053528 - protein, 9 aa, Homo Sapiens
IGVTYKNKE

SEQ ID NO: 1053529 - protein, 9 aa, Homo Sapiens
KFSIELNQQ

SEQ ID NO: 1053530 - protein, 9 aa, Homo Sapiens
LLYELQPAA

SEQ ID NO: 1053531 - protein, 9 aa, Homo Sapiens
CKLNQEVWY

SEQ ID NO: 1053532 - protein, 9 aa, Homo Sapiens
DRELLRLNL

SEQ ID NO: 1053533 - protein, 9 aa, Homo Sapiens
DDLKMMWSM

SEQ ID NO: 1053534 - protein, 9 aa, Homo Sapiens
FSLVMLLVA

SEQ ID NO: 1053535 - protein, 9 aa, Homo Sapiens
GDLLDSMNR

SEQ ID NO: 1053536 - protein, 9 aa, Homo Sapiens
EGYSNAQES

SEQ ID NO: 1053537 - protein, 9 aa, Homo Sapiens
CVDQTWNCG

SEQ ID NO: 1053538 - protein, 9 aa, Homo Sapiens
PPAQITWHL

SEQ ID NO: 1053539 - protein, 9 aa, Homo Sapiens
FYFTEWELV

SEQ ID NO: 1053540 - protein, 9 aa, Homo Sapiens
MEYFVQKAD

SEQ ID NO: 1053541 - protein, 9 aa, Homo Sapiens
DPRAGSTPL

SEQ ID NO: 1053542 - protein, 9 aa, Homo Sapiens
LVFIFIPLF

SEQ ID NO: 1053543 - protein, 9 aa, Homo Sapiens
FHLATVCKI

SEQ ID NO: 1053544 - protein, 9 aa, Homo Sapiens
SKFDDLIFV

SEQ ID NO: 1053545 - protein, 9 aa, Homo Sapiens
NFHLPSEVL

SEQ ID NO: 1053546 - protein, 9 aa, Homo Sapiens
DADIYFLDD

SEQ ID NO: 1053547 - protein, 9 aa, Homo Sapiens
QKQANRSKH

SEQ ID NO: 1053548 - protein, 9 aa, Homo Sapiens
HGKPQERKN

SEQ ID NO: 1053549 - protein, 9 aa, Homo Sapiens
GHKEGATGD

SEQ ID NO: 1053550 - protein, 9 aa, Homo Sapiens
SDFTEPEKL

SEQ ID NO: 1053551 - protein, 9 aa, Homo Sapiens
EDLLDVCNE

SEQ ID NO: 1053552 - protein, 9 aa, Homo Sapiens
FTRLDGFMA

SEQ ID NO: 1053553 - protein, 9 aa, Homo Sapiens
CNSIPLVLE

SEQ ID NO: 1053554 - protein, 9 aa, Homo Sapiens
AEHTGKGRP

SEQ ID NO: 1053555 - protein, 9 aa, Homo Sapiens
KPLSRVTLL

SEQ ID NO: 1053556 - protein, 9 aa, Homo Sapiens
LLILSRIVG

SEQ ID NO: 1053557 - protein, 9 aa, Homo Sapiens
TPGATSSSL

SEQ ID NO: 1053558 - protein, 9 aa, Homo Sapiens
SRTLGPSVA

SEQ ID NO: 1053559 - protein, 9 aa, Homo Sapiens
SSALRPHQS

SEQ ID NO: 1053560 - protein, 9 aa, Homo Sapiens
FRTLLLSVC

SEQ ID NO: 1053561 - protein, 9 aa, Homo Sapiens
FVPCYCKLY

SEQ ID NO: 1053562 - protein, 9 aa, Homo Sapiens
CTPKCLPKC

SEQ ID NO: 1053563 - protein, 9 aa, Homo Sapiens
YSVGNLSFN

SEQ ID NO: 1053564 - protein, 9 aa, Homo Sapiens
FSKPFISLG

SEQ ID NO: 1053565 - protein, 9 aa, Homo Sapiens
CRANSWDGE

SEQ ID NO: 1053566 - protein, 9 aa, Homo Sapiens
EKKELEDLL

SEQ ID NO: 1053567 - protein, 9 aa, Homo Sapiens
VFRDLASLP

SEQ ID NO: 1053568 - protein, 9 aa, Homo Sapiens
GLTKKVARH

SEQ ID NO: 1053569 - protein, 9 aa, Homo Sapiens
GGGGGRKGL

SEQ ID NO: 1053570 - protein, 9 aa, Homo Sapiens
HKVTGSGGA

SEQ ID NO: 1053571 - protein, 9 aa, Homo Sapiens
SVVAQGLSR

SEQ ID NO: 1053572 - protein, 9 aa, Homo Sapiens
KLIFEVDSD

SEQ ID NO: 1053573 - protein, 9 aa, Homo Sapiens
QEFFRHNKP

SEQ ID NO: 1053574 - protein, 9 aa, Homo Sapiens
DLHGVKIKK

SEQ ID NO: 1053575 - protein, 9 aa, Homo Sapiens
AAFCLRCFL

SEQ ID NO: 1053576 - protein, 9 aa, Homo Sapiens
VGLFSHSGL

SEQ ID NO: 1053577 - protein, 9 aa, Homo Sapiens
RARRQQAQR

SEQ ID NO: 1053578 - protein, 9 aa, Homo Sapiens
PDLFPKMPY

SEQ ID NO: 1053579 - protein, 9 aa, Homo Sapiens
EAAPKSPSR

SEQ ID NO: 1053580 - protein, 9 aa, Homo Sapiens
LSKAYPFSL

SEQ ID NO: 1053581 - protein, 9 aa, Homo Sapiens
PNSSHLFFH

SEQ ID NO: 1053582 - protein, 9 aa, Homo Sapiens
TSPPVSCLP

SEQ ID NO: 1053583 - protein, 9 aa, Homo Sapiens
ALGTGPRET

SEQ ID NO: 1053584 - protein, 9 aa, Homo Sapiens
CLLILKFVM

SEQ ID NO: 1053585 - protein, 9 aa, Homo Sapiens
EGKTCQILH

SEQ ID NO: 1053586 - protein, 9 aa, Homo Sapiens
EEVWKVLNL

SEQ ID NO: 1053587 - protein, 9 aa, Homo Sapiens
ITLYSQASG

SEQ ID NO: 1053588 - protein, 9 aa, Homo Sapiens
LDDIFAFLV

SEQ ID NO: 1053589 - protein, 9 aa, Homo Sapiens
GYEQLKEEL

SEQ ID NO: 1053590 - protein, 9 aa, Homo Sapiens
HITWNGLLL

SEQ ID NO: 1053591 - protein, 9 aa, Homo Sapiens
KEKAEEERK

SEQ ID NO: 1053592 - protein, 9 aa, Homo Sapiens
QGRSPRSGS

SEQ ID NO: 1053593 - protein, 9 aa, Homo Sapiens
YFEGAQLSV

SEQ ID NO: 1053594 - protein, 9 aa, Homo Sapiens
SKQTLKTPE

SEQ ID NO: 1053595 - protein, 9 aa, Homo Sapiens
VRPSNSRPG

SEQ ID NO: 1053596 - protein, 9 aa, Homo Sapiens
QSCVITKDC

SEQ ID NO: 1053597 - protein, 9 aa, Homo Sapiens
AAGKFARAV

SEQ ID NO: 1053598 - protein, 9 aa, Homo Sapiens
ASCTVNLGG

SEQ ID NO: 1053599 - protein, 9 aa, Homo Sapiens
MADAMDTFE

SEQ ID NO: 1053600 - protein, 9 aa, Homo Sapiens
FILYLETPK

SEQ ID NO: 1053601 - protein, 9 aa, Homo Sapiens
YYRKMYRDM

SEQ ID NO: 1053602 - protein, 9 aa, Homo Sapiens
GPCEFALVV

SEQ ID NO: 1053603 - protein, 9 aa, Homo Sapiens
AHNRYPSPR

SEQ ID NO: 1053604 - protein, 9 aa, Homo Sapiens
RQRVCFGEG

SEQ ID NO: 1053605 - protein, 9 aa, Homo Sapiens
SAHKPENPE

SEQ ID NO: 1053606 - protein, 9 aa, Homo Sapiens
DSNGELAPL

SEQ ID NO: 1053607 - protein, 9 aa, Homo Sapiens
ADRLITLFK

SEQ ID NO: 1053608 - protein, 9 aa, Homo Sapiens
HATADLDPN

SEQ ID NO: 1053609 - protein, 9 aa, Homo Sapiens
FSAQYQIKK

SEQ ID NO: 1053610 - protein, 9 aa, Homo Sapiens
QSFDSGSVR

SEQ ID NO: 1053611 - protein, 9 aa, Homo Sapiens
ELMKLSLEE

SEQ ID NO: 1053612 - protein, 9 aa, Homo Sapiens
STPDSVCLG

SEQ ID NO: 1053613 - protein, 9 aa, Homo Sapiens
EGLNLKVMM

SEQ ID NO: 1053614 - protein, 9 aa, Homo Sapiens
GMTETPMVA

SEQ ID NO: 1053615 - protein, 9 aa, Homo Sapiens
FRQSQSNLT

SEQ ID NO: 1053616 - protein, 9 aa, Homo Sapiens
ASQREDDIA

SEQ ID NO: 1053617 - protein, 9 aa, Homo Sapiens
VSVTRNPSS

SEQ ID NO: 1053618 - protein, 9 aa, Homo Sapiens
GEVIIEIST

SEQ ID NO: 1053619 - protein, 9 aa, Homo Sapiens
KNLAGKTST

SEQ ID NO: 1053620 - protein, 9 aa, Homo Sapiens
PFIRGEGAG

SEQ ID NO: 1053621 - protein, 9 aa, Homo Sapiens
VKVYNYYET

SEQ ID NO: 1053622 - protein, 9 aa, Homo Sapiens
MPEVWHVHS

SEQ ID NO: 1053623 - protein, 9 aa, Homo Sapiens
WYDFPWGNA

SEQ ID NO: 1053624 - protein, 9 aa, Homo Sapiens
RRPAWPSTL

SEQ ID NO: 1053625 - protein, 9 aa, Homo Sapiens
ERPSLVCHE

SEQ ID NO: 1053626 - protein, 9 aa, Homo Sapiens
TLQFPFKEL

SEQ ID NO: 1053627 - protein, 9 aa, Homo Sapiens
INKFDLVCG

SEQ ID NO: 1053628 - protein, 9 aa, Homo Sapiens
QKGRWGPED

SEQ ID NO: 1053629 - protein, 9 aa, Homo Sapiens
KTSHTQGSL

SEQ ID NO: 1053630 - protein, 9 aa, Homo Sapiens
DRESSEGGS

SEQ ID NO: 1053631 - protein, 9 aa, Homo Sapiens
KNLIVREHG

SEQ ID NO: 1053632 - protein, 9 aa, Homo Sapiens
FHALRKKID

SEQ ID NO: 1053633 - protein, 9 aa, Homo Sapiens
TCGEAFPAS

SEQ ID NO: 1053634 - protein, 9 aa, Homo Sapiens
FQRMPMQQS

SEQ ID NO: 1053635 - protein, 9 aa, Homo Sapiens
LDVCNETCA

SEQ ID NO: 1053636 - protein, 9 aa, Homo Sapiens
VVYGDIIVT

SEQ ID NO: 1053637 - protein, 9 aa, Homo Sapiens
DPKKSQKES

SEQ ID NO: 1053638 - protein, 9 aa, Homo Sapiens
KGKQCEDID

SEQ ID NO: 1053639 - protein, 9 aa, Homo Sapiens
CKYSPFMKS

SEQ ID NO: 1053640 - protein, 9 aa, Homo Sapiens
HLESRYLLA

SEQ ID NO: 1053641 - protein, 9 aa, Homo Sapiens
EIKKCNLYL

SEQ ID NO: 1053642 - protein, 9 aa, Homo Sapiens
KASEEVSNS

SEQ ID NO: 1053643 - protein, 9 aa, Homo Sapiens
LQRHRKIYT

SEQ ID NO: 1053644 - protein, 9 aa, Homo Sapiens
FYKDPEETE

SEQ ID NO: 1053645 - protein, 9 aa, Homo Sapiens
FVATPSSAP

SEQ ID NO: 1053646 - protein, 9 aa, Homo Sapiens
PENVFISYK

SEQ ID NO: 1053647 - protein, 9 aa, Homo Sapiens
EMTLRLEKM

SEQ ID NO: 1053648 - protein, 9 aa, Homo Sapiens
VTAPISGFE

SEQ ID NO: 1053649 - protein, 9 aa, Homo Sapiens
LSFCGNQKV

SEQ ID NO: 1053650 - protein, 9 aa, Homo Sapiens
NVCETKSCV

SEQ ID NO: 1053651 - protein, 9 aa, Homo Sapiens
YEQYLTILS

SEQ ID NO: 1053652 - protein, 9 aa, Homo Sapiens
RNVALEFSL

SEQ ID NO: 1053653 - protein, 9 aa, Homo Sapiens
LFFREMNVD

SEQ ID NO: 1053654 - protein, 9 aa, Homo Sapiens
RDLEEISVT

SEQ ID NO: 1053655 - protein, 9 aa, Homo Sapiens
LELHIPLFF

SEQ ID NO: 1053656 - protein, 9 aa, Homo Sapiens
KNYPSLELD

SEQ ID NO: 1053657 - protein, 9 aa, Homo Sapiens
LVFLKLACA

SEQ ID NO: 1053658 - protein, 9 aa, Homo Sapiens
SNSYNLEKI

SEQ ID NO: 1053659 - protein, 9 aa, Homo Sapiens
IGITYYLLL

SEQ ID NO: 1053660 - protein, 9 aa, Homo Sapiens
DSEIIMMNY

SEQ ID NO: 1053661 - protein, 9 aa, Homo Sapiens
LLSLKSEND

SEQ ID NO: 1053662 - protein, 9 aa, Homo Sapiens
TYDLDTLSG

SEQ ID NO: 1053663 - protein, 9 aa, Homo Sapiens
FVSHLHTPM

SEQ ID NO: 1053664 - protein, 9 aa, Homo Sapiens
QDKSLHLEE

SEQ ID NO: 1053665 - protein, 9 aa, Homo Sapiens
VTSTNKESK

SEQ ID NO: 1053666 - protein, 9 aa, Homo Sapiens
MVNSIAWSP

SEQ ID NO: 1053667 - protein, 9 aa, Homo Sapiens
LSKELAKLR

SEQ ID NO: 1053668 - protein, 9 aa, Homo Sapiens
AEREAQAFL

SEQ ID NO: 1053669 - protein, 9 aa, Homo Sapiens
NLNSNAVVI

SEQ ID NO: 1053670 - protein, 9 aa, Homo Sapiens
VLPPSALTS

SEQ ID NO: 1053671 - protein, 9 aa, Homo Sapiens
CDNFQNRGF

SEQ ID NO: 1053672 - protein, 9 aa, Homo Sapiens
FYISVLEDN

SEQ ID NO: 1053673 - protein, 9 aa, Homo Sapiens
ITSNLTRML

SEQ ID NO: 1053674 - protein, 9 aa, Homo Sapiens
QTYAFVTHP

SEQ ID NO: 1053675 - protein, 9 aa, Homo Sapiens
KKDANEIHK

SEQ ID NO: 1053676 - protein, 9 aa, Homo Sapiens
QRSKLQSQE

SEQ ID NO: 1053677 - protein, 9 aa, Homo Sapiens
NFLDGLGPA

SEQ ID NO: 1053678 - protein, 9 aa, Homo Sapiens
NSSCSLEKE

SEQ ID NO: 1053679 - protein, 9 aa, Homo Sapiens
EKAAAPREG

SEQ ID NO: 1053680 - protein, 9 aa, Homo Sapiens
TRFPGFPGA

SEQ ID NO: 1053681 - protein, 9 aa, Homo Sapiens
LSCDKLPPE

SEQ ID NO: 1053682 - protein, 9 aa, Homo Sapiens
QSQSNLTSL

SEQ ID NO: 1053683 - protein, 9 aa, Homo Sapiens
SDALLKLGR

SEQ ID NO: 1053684 - protein, 9 aa, Homo Sapiens
ADCINRLQA

SEQ ID NO: 1053685 - protein, 9 aa, Homo Sapiens
SQVMDLPTA

SEQ ID NO: 1053686 - protein, 9 aa, Homo Sapiens
FSGDIGSSL

SEQ ID NO: 1053687 - protein, 9 aa, Homo Sapiens
EYIIRGDNE

SEQ ID NO: 1053688 - protein, 9 aa, Homo Sapiens
EKPICLTHL

SEQ ID NO: 1053689 - protein, 9 aa, Homo Sapiens
PILTSVHKK

SEQ ID NO: 1053690 - protein, 9 aa, Homo Sapiens
SHSQKKDQE

SEQ ID NO: 1053691 - protein, 9 aa, Homo Sapiens
SHSNPDCQE

SEQ ID NO: 1053692 - protein, 9 aa, Homo Sapiens
RKNCWKFFM

SEQ ID NO: 1053693 - protein, 9 aa, Homo Sapiens
DLIVTLKNG

SEQ ID NO: 1053694 - protein, 9 aa, Homo Sapiens
AYNSTDGLA

SEQ ID NO: 1053695 - protein, 9 aa, Homo Sapiens
KTLENLSRS

SEQ ID NO: 1053696 - protein, 9 aa, Homo Sapiens
EFLAEDWAG

SEQ ID NO: 1053697 - protein, 9 aa, Homo Sapiens
LWSQVLAFA

SEQ ID NO: 1053698 - protein, 9 aa, Homo Sapiens
GYYGQGFPF

SEQ ID NO: 1053699 - protein, 9 aa, Homo Sapiens
SVFEKALMS

SEQ ID NO: 1053700 - protein, 9 aa, Homo Sapiens
QSREKPNEC

SEQ ID NO: 1053701 - protein, 9 aa, Homo Sapiens
TCTQEGWNF

SEQ ID NO: 1053702 - protein, 9 aa, Homo Sapiens
ASLALVGVT

SEQ ID NO: 1053703 - protein, 9 aa, Homo Sapiens
LLSDKPQNF

SEQ ID NO: 1053704 - protein, 9 aa, Homo Sapiens
QELAEKLEM

SEQ ID NO: 1053705 - protein, 9 aa, Homo Sapiens
SSRRPRFKD

SEQ ID NO: 1053706 - protein, 9 aa, Homo Sapiens
HQKMNTCVT

SEQ ID NO: 1053707 - protein, 9 aa, Homo Sapiens
QTLSLLSGL

SEQ ID NO: 1053708 - protein, 9 aa, Homo Sapiens
DSPKKVRKN

SEQ ID NO: 1053709 - protein, 9 aa, Homo Sapiens
ACPLPSGLL

SEQ ID NO: 1053710 - protein, 9 aa, Homo Sapiens
TEERRLWPG

SEQ ID NO: 1053711 - protein, 9 aa, Homo Sapiens
NANAAAWIF

SEQ ID NO: 1053712 - protein, 9 aa, Homo Sapiens
LQFHILQLF

SEQ ID NO: 1053713 - protein, 9 aa, Homo Sapiens
ENRVPLGVN

SEQ ID NO: 1053714 - protein, 9 aa, Homo Sapiens
VAVLPGIYD

SEQ ID NO: 1053715 - protein, 9 aa, Homo Sapiens
EGNTIRIKF

SEQ ID NO: 1053716 - protein, 9 aa, Homo Sapiens
PPEDTAIGS

SEQ ID NO: 1053717 - protein, 9 aa, Homo Sapiens
TLERLVDPV

SEQ ID NO: 1053718 - protein, 9 aa, Homo Sapiens
TCDNPPLSN

SEQ ID NO: 1053719 - protein, 9 aa, Homo Sapiens
WQTFSILVR

SEQ ID NO: 1053720 - protein, 9 aa, Homo Sapiens
LSVISVFYT

SEQ ID NO: 1053721 - protein, 9 aa, Homo Sapiens
TNTLIMTSK

SEQ ID NO: 1053722 - protein, 9 aa, Homo Sapiens
LNSNSVVLQ

SEQ ID NO: 1053723 - protein, 9 aa, Homo Sapiens
KEGVFGWVT

SEQ ID NO: 1053724 - protein, 9 aa, Homo Sapiens
VLDPRTTMI

SEQ ID NO: 1053725 - protein, 9 aa, Homo Sapiens
RLYQKSAMK

SEQ ID NO: 1053726 - protein, 9 aa, Homo Sapiens
AHGLNLQNY

SEQ ID NO: 1053727 - protein, 9 aa, Homo Sapiens
TDFCFLFSS

SEQ ID NO: 1053728 - protein, 9 aa, Homo Sapiens
NSSIPCMIS

SEQ ID NO: 1053729 - protein, 9 aa, Homo Sapiens
AFSNQTYST

SEQ ID NO: 1053730 - protein, 9 aa, Homo Sapiens
GNICCAQFS

SEQ ID NO: 1053731 - protein, 9 aa, Homo Sapiens
DIISLKEEE

SEQ ID NO: 1053732 - protein, 9 aa, Homo Sapiens
LCGIGETPI

SEQ ID NO: 1053733 - protein, 9 aa, Homo Sapiens
TWHLDLGGM

SEQ ID NO: 1053734 - protein, 9 aa, Homo Sapiens
LIQSLNSSR

SEQ ID NO: 1053735 - protein, 9 aa, Homo Sapiens
KIIYSVEKP

SEQ ID NO: 1053736 - protein, 9 aa, Homo Sapiens
RVLVIRATN

SEQ ID NO: 1053737 - protein, 9 aa, Homo Sapiens
LDMLEPEQT

SEQ ID NO: 1053738 - protein, 9 aa, Homo Sapiens
DIEGAAGGL

SEQ ID NO: 1053739 - protein, 9 aa, Homo Sapiens
GQRNRVESL

SEQ ID NO: 1053740 - protein, 9 aa, Homo Sapiens
CFKCRQMYY

SEQ ID NO: 1053741 - protein, 9 aa, Homo Sapiens
VIKDSPHTI

SEQ ID NO: 1053742 - protein, 9 aa, Homo Sapiens
EQPLYSLPP

SEQ ID NO: 1053743 - protein, 9 aa, Homo Sapiens
KRKKMSLVK

SEQ ID NO: 1053744 - protein, 9 aa, Homo Sapiens
VKEHYQDFR

SEQ ID NO: 1053745 - protein, 9 aa, Homo Sapiens
TFHDVSVPQ

SEQ ID NO: 1053746 - protein, 9 aa, Homo Sapiens
TLRAWPASG

SEQ ID NO: 1053747 - protein, 9 aa, Homo Sapiens
LLNCAKDMN

SEQ ID NO: 1053748 - protein, 9 aa, Homo Sapiens
DLQHFLSVF

SEQ ID NO: 1053749 - protein, 9 aa, Homo Sapiens
FYTSGFFQT

SEQ ID NO: 1053750 - protein, 9 aa, Homo Sapiens
YTFQQVQKH

SEQ ID NO: 1053751 - protein, 9 aa, Homo Sapiens
GEFDTMQSS

SEQ ID NO: 1053752 - protein, 9 aa, Homo Sapiens
GRPSQEPSL

SEQ ID NO: 1053753 - protein, 9 aa, Homo Sapiens
GEERCIACT

SEQ ID NO: 1053754 - protein, 9 aa, Homo Sapiens
GEKNSQLWA

SEQ ID NO: 1053755 - protein, 9 aa, Homo Sapiens
SPLTTLPPE

SEQ ID NO: 1053756 - protein, 9 aa, Homo Sapiens
VFLYKGLDG

SEQ ID NO: 1053757 - protein, 9 aa, Homo Sapiens
HKPENPEDT

SEQ ID NO: 1053758 - protein, 9 aa, Homo Sapiens
PETPMDGGS

SEQ ID NO: 1053759 - protein, 9 aa, Homo Sapiens
LQQVGGGGR

SEQ ID NO: 1053760 - protein, 9 aa, Homo Sapiens
QQDVLRTCV

SEQ ID NO: 1053761 - protein, 9 aa, Homo Sapiens
KEMSLFSSS

SEQ ID NO: 1053762 - protein, 9 aa, Homo Sapiens
FKKSASLMV

SEQ ID NO: 1053763 - protein, 9 aa, Homo Sapiens
SKVHSSQGC

SEQ ID NO: 1053764 - protein, 9 aa, Homo Sapiens
RARKAMAVK

SEQ ID NO: 1053765 - protein, 9 aa, Homo Sapiens
AQSSAAIIT

SEQ ID NO: 1053766 - protein, 9 aa, Homo Sapiens
NHRQQSLAL

SEQ ID NO: 1053767 - protein, 9 aa, Homo Sapiens
TLIVDGEQT

SEQ ID NO: 1053768 - protein, 9 aa, Homo Sapiens
NYYKLVTTK

SEQ ID NO: 1053769 - protein, 9 aa, Homo Sapiens
KRSRERSSR

SEQ ID NO: 1053770 - protein, 9 aa, Homo Sapiens
QAEREAQAF

SEQ ID NO: 1053771 - protein, 9 aa, Homo Sapiens
NGQRREQQE

SEQ ID NO: 1053772 - protein, 9 aa, Homo Sapiens
GRLEEPVSP

SEQ ID NO: 1053773 - protein, 9 aa, Homo Sapiens
LQPGKFYLL

SEQ ID NO: 1053774 - protein, 9 aa, Homo Sapiens
QPTPQMAEL

SEQ ID NO: 1053775 - protein, 9 aa, Homo Sapiens
LDPYVSIAC

SEQ ID NO: 1053776 - protein, 9 aa, Homo Sapiens
NQTLTEKEK

SEQ ID NO: 1053777 - protein, 9 aa, Homo Sapiens
TRIINSKTE

SEQ ID NO: 1053778 - protein, 9 aa, Homo Sapiens
LPSSALRPH

SEQ ID NO: 1053779 - protein, 9 aa, Homo Sapiens
REPKEEAKD

SEQ ID NO: 1053780 - protein, 9 aa, Homo Sapiens
LEFGNMEDT

SEQ ID NO: 1053781 - protein, 9 aa, Homo Sapiens
WKETCGHRD

SEQ ID NO: 1053782 - protein, 9 aa, Homo Sapiens
LYGQPKPVK

SEQ ID NO: 1053783 - protein, 9 aa, Homo Sapiens
QNMAVYVEG

SEQ ID NO: 1053784 - protein, 9 aa, Homo Sapiens
KEERKTSGQ

SEQ ID NO: 1053785 - protein, 9 aa, Homo Sapiens
PKDSPAHKV

SEQ ID NO: 1053786 - protein, 9 aa, Homo Sapiens
EINRKNAFS

SEQ ID NO: 1053787 - protein, 9 aa, Homo Sapiens
LKIVSSMAQ

SEQ ID NO: 1053788 - protein, 9 aa, Homo Sapiens
MDFQVGKKF

SEQ ID NO: 1053789 - protein, 9 aa, Homo Sapiens
EENDPETKN

SEQ ID NO: 1053790 - protein, 9 aa, Homo Sapiens
WKPVVELWQ

SEQ ID NO: 1053791 - protein, 9 aa, Homo Sapiens
QSCRQSHCG

SEQ ID NO: 1053792 - protein, 9 aa, Homo Sapiens
VEPKTGIIR

SEQ ID NO: 1053793 - protein, 9 aa, Homo Sapiens
DNIHRAWRT

SEQ ID NO: 1053794 - protein, 9 aa, Homo Sapiens
EKTFTISVT

SEQ ID NO: 1053795 - protein, 9 aa, Homo Sapiens
KLKLDGEKE

SEQ ID NO: 1053796 - protein, 9 aa, Homo Sapiens
WISAMENQL

SEQ ID NO: 1053797 - protein, 9 aa, Homo Sapiens
RLSKHEPGH

SEQ ID NO: 1053798 - protein, 9 aa, Homo Sapiens
TYFQVIALI

SEQ ID NO: 1053799 - protein, 9 aa, Homo Sapiens
FSIWHKFSS

SEQ ID NO: 1053800 - protein, 9 aa, Homo Sapiens
MASERLQGT

SEQ ID NO: 1053801 - protein, 9 aa, Homo Sapiens
LFSTFPLLP

SEQ ID NO: 1053802 - protein, 9 aa, Homo Sapiens
QDENRVPLG

SEQ ID NO: 1053803 - protein, 9 aa, Homo Sapiens
HRRCKYSHF

SEQ ID NO: 1053804 - protein, 9 aa, Homo Sapiens
LKLKKKASL

SEQ ID NO: 1053805 - protein, 9 aa, Homo Sapiens
KGTKNCWTC

SEQ ID NO: 1053806 - protein, 9 aa, Homo Sapiens
ILYPALLTD

SEQ ID NO: 1053807 - protein, 9 aa, Homo Sapiens
DKEKAEEER

SEQ ID NO: 1053808 - protein, 9 aa, Homo Sapiens
QSAAEVKKP

SEQ ID NO: 1053809 - protein, 9 aa, Homo Sapiens
ITPRVRSHL

SEQ ID NO: 1053810 - protein, 9 aa, Homo Sapiens
VCICFKGYA

SEQ ID NO: 1053811 - protein, 9 aa, Homo Sapiens
QTEKYNLAI

SEQ ID NO: 1053812 - protein, 9 aa, Homo Sapiens
PKCPENNIR

SEQ ID NO: 1053813 - protein, 9 aa, Homo Sapiens
VLAWLGMES

SEQ ID NO: 1053814 - protein, 9 aa, Homo Sapiens
HTLMYFSIR

SEQ ID NO: 1053815 - protein, 9 aa, Homo Sapiens
LEAMIFALF

SEQ ID NO: 1053816 - protein, 9 aa, Homo Sapiens
SKRPSKDEM

SEQ ID NO: 1053817 - protein, 9 aa, Homo Sapiens
FAQDSFYFE

SEQ ID NO: 1053818 - protein, 9 aa, Homo Sapiens
TDDSALWVS

SEQ ID NO: 1053819 - protein, 9 aa, Homo Sapiens
FNNLEQLCI

SEQ ID NO: 1053820 - protein, 9 aa, Homo Sapiens
QRRQRVCFG

SEQ ID NO: 1053821 - protein, 9 aa, Homo Sapiens
KLNNTNIKN

SEQ ID NO: 1053822 - protein, 9 aa, Homo Sapiens
AAPPSPERT

SEQ ID NO: 1053823 - protein, 9 aa, Homo Sapiens
SFRGCGAFL

SEQ ID NO: 1053824 - protein, 9 aa, Homo Sapiens
KFKKYVLGD

SEQ ID NO: 1053825 - protein, 9 aa, Homo Sapiens
LCEVENQYQ

SEQ ID NO: 1053826 - protein, 9 aa, Homo Sapiens
LVLQPHVPF

SEQ ID NO: 1053827 - protein, 9 aa, Homo Sapiens
IVVFQMSSE

SEQ ID NO: 1053828 - protein, 9 aa, Homo Sapiens
DVCFFPEKD

SEQ ID NO: 1053829 - protein, 9 aa, Homo Sapiens
YAAFCECLR

SEQ ID NO: 1053830 - protein, 9 aa, Homo Sapiens
LPLLRQTTA

SEQ ID NO: 1053831 - protein, 9 aa, Homo Sapiens
KVSTDKEDG

SEQ ID NO: 1053832 - protein, 9 aa, Homo Sapiens
PNYHTPLYL

SEQ ID NO: 1053833 - protein, 9 aa, Homo Sapiens
YRELLDGAP

SEQ ID NO: 1053834 - protein, 9 aa, Homo Sapiens
FETFNVLAM

SEQ ID NO: 1053835 - protein, 9 aa, Homo Sapiens
AIIVVVMRN

SEQ ID NO: 1053836 - protein, 9 aa, Homo Sapiens
ECSRTSILN

SEQ ID NO: 1053837 - protein, 9 aa, Homo Sapiens
QTISCPERL

SEQ ID NO: 1053838 - protein, 9 aa, Homo Sapiens
PPRKPAQPP

SEQ ID NO: 1053839 - protein, 9 aa, Homo Sapiens
ETGSSDPLE

SEQ ID NO: 1053840 - protein, 9 aa, Homo Sapiens
ILEPLCSDS

SEQ ID NO: 1053841 - protein, 9 aa, Homo Sapiens
LRCVNHRQQ

SEQ ID NO: 1053842 - protein, 9 aa, Homo Sapiens
DSALEVLRS

SEQ ID NO: 1053843 - protein, 9 aa, Homo Sapiens
NTKRDDDYA

SEQ ID NO: 1053844 - protein, 9 aa, Homo Sapiens
FINNASSVS

SEQ ID NO: 1053845 - protein, 9 aa, Homo Sapiens
EDQTDTEEE

SEQ ID NO: 1053846 - protein, 9 aa, Homo Sapiens
ISYSSIRLF

SEQ ID NO: 1053847 - protein, 9 aa, Homo Sapiens
KIDTVLPNK

SEQ ID NO: 1053848 - protein, 9 aa, Homo Sapiens
RQYKHLDGF

SEQ ID NO: 1053849 - protein, 9 aa, Homo Sapiens
TVSVSEICI

SEQ ID NO: 1053850 - protein, 9 aa, Homo Sapiens
HFCCVHRGA

SEQ ID NO: 1053851 - protein, 9 aa, Homo Sapiens
IQYALNDEI

SEQ ID NO: 1053852 - protein, 9 aa, Homo Sapiens
LEARQNWPQ

SEQ ID NO: 1053853 - protein, 9 aa, Homo Sapiens
HMYGGGTSL

SEQ ID NO: 1053854 - protein, 9 aa, Homo Sapiens
CFRSPFCEE

SEQ ID NO: 1053855 - protein, 9 aa, Homo Sapiens
EDSSIYFCS

SEQ ID NO: 1053856 - protein, 9 aa, Homo Sapiens
ECAMVNSIA

SEQ ID NO: 1053857 - protein, 9 aa, Homo Sapiens
NPSVCEFVL

SEQ ID NO: 1053858 - protein, 9 aa, Homo Sapiens
TLIFEPYEP

SEQ ID NO: 1053859 - protein, 9 aa, Homo Sapiens
KLFMKRLPS

SEQ ID NO: 1053860 - protein, 9 aa, Homo Sapiens
CRTIVFCTP

SEQ ID NO: 1053861 - protein, 9 aa, Homo Sapiens
CHGLRQDLE

SEQ ID NO: 1053862 - protein, 9 aa, Homo Sapiens
RCLTPKPSP

SEQ ID NO: 1053863 - protein, 9 aa, Homo Sapiens
TGPPTYTST

SEQ ID NO: 1053864 - protein, 9 aa, Homo Sapiens
IHQSFRSLL

SEQ ID NO: 1053865 - protein, 9 aa, Homo Sapiens
SGDLHYTTF

SEQ ID NO: 1053866 - protein, 9 aa, Homo Sapiens
EKARSPDYK

SEQ ID NO: 1053867 - protein, 9 aa, Homo Sapiens
ICLIDVNTE

SEQ ID NO: 1053868 - protein, 9 aa, Homo Sapiens
RFSKDHKYS

SEQ ID NO: 1053869 - protein, 9 aa, Homo Sapiens
LPSPRTLLM

SEQ ID NO: 1053870 - protein, 9 aa, Homo Sapiens
GKELAVAVA

SEQ ID NO: 1053871 - protein, 9 aa, Homo Sapiens
RHSKPPNRL

SEQ ID NO: 1053872 - protein, 9 aa, Homo Sapiens
IDRKVCNDQ

SEQ ID NO: 1053873 - protein, 9 aa, Homo Sapiens
EPFLPPNTL

SEQ ID NO: 1053874 - protein, 9 aa, Homo Sapiens
LNLGGFIGY

SEQ ID NO: 1053875 - protein, 9 aa, Homo Sapiens
MTVLFKLDG

SEQ ID NO: 1053876 - protein, 9 aa, Homo Sapiens
DPATLLYLV

SEQ ID NO: 1053877 - protein, 9 aa, Homo Sapiens
DRKMHMPFQ

SEQ ID NO: 1053878 - protein, 9 aa, Homo Sapiens
KFSAVPDSI

SEQ ID NO: 1053879 - protein, 9 aa, Homo Sapiens
QITWHLDLG

SEQ ID NO: 1053880 - protein, 9 aa, Homo Sapiens
ANQLVKQLI

SEQ ID NO: 1053881 - protein, 9 aa, Homo Sapiens
LGAPGSGFS

SEQ ID NO: 1053882 - protein, 9 aa, Homo Sapiens
GLFLGASVL

SEQ ID NO: 1053883 - protein, 9 aa, Homo Sapiens
WLENERSVL

SEQ ID NO: 1053884 - protein, 9 aa, Homo Sapiens
SQSGPGAPI

SEQ ID NO: 1053885 - protein, 9 aa, Homo Sapiens
RPDFYSPAY

SEQ ID NO: 1053886 - protein, 9 aa, Homo Sapiens
NYTFQQVQK

SEQ ID NO: 1053887 - protein, 9 aa, Homo Sapiens
DWETMTNDY

SEQ ID NO: 1053888 - protein, 9 aa, Homo Sapiens
EERVVEVNQ

SEQ ID NO: 1053889 - protein, 9 aa, Homo Sapiens
FCVIVCNKK

SEQ ID NO: 1053890 - protein, 9 aa, Homo Sapiens
PRSVVFRLN

SEQ ID NO: 1053891 - protein, 9 aa, Homo Sapiens
LPLPFEFLP

SEQ ID NO: 1053892 - protein, 9 aa, Homo Sapiens
PEKEEEEAV

SEQ ID NO: 1053893 - protein, 9 aa, Homo Sapiens
VQLKCEYAC

SEQ ID NO: 1053894 - protein, 9 aa, Homo Sapiens
KNPYLDLID

SEQ ID NO: 1053895 - protein, 9 aa, Homo Sapiens
VGTRSYMAS

SEQ ID NO: 1053896 - protein, 9 aa, Homo Sapiens
ELTKAGAKK

SEQ ID NO: 1053897 - protein, 9 aa, Homo Sapiens
IDVASFTTK

SEQ ID NO: 1053898 - protein, 9 aa, Homo Sapiens
GAVSSMSYY

SEQ ID NO: 1053899 - protein, 9 aa, Homo Sapiens
SMFCYSNWL

SEQ ID NO: 1053900 - protein, 9 aa, Homo Sapiens
NRIFYISAD

SEQ ID NO: 1053901 - protein, 9 aa, Homo Sapiens
QPKCPENNI

SEQ ID NO: 1053902 - protein, 9 aa, Homo Sapiens
PDTQRQRTP

SEQ ID NO: 1053903 - protein, 9 aa, Homo Sapiens
FPLLENPVI

SEQ ID NO: 1053904 - protein, 9 aa, Homo Sapiens
RVRPTVLMS

SEQ ID NO: 1053905 - protein, 9 aa, Homo Sapiens
EMIIEIFKG

SEQ ID NO: 1053906 - protein, 9 aa, Homo Sapiens
SFLALSLSP

SEQ ID NO: 1053907 - protein, 9 aa, Homo Sapiens
RPPHIIYVP

SEQ ID NO: 1053908 - protein, 9 aa, Homo Sapiens
CALKLSLKC

SEQ ID NO: 1053909 - protein, 9 aa, Homo Sapiens
EAIKKQYTV

SEQ ID NO: 1053910 - protein, 9 aa, Homo Sapiens
IQELFESST

SEQ ID NO: 1053911 - protein, 9 aa, Homo Sapiens
ALVVVVPPR

SEQ ID NO: 1053912 - protein, 9 aa, Homo Sapiens
IRKMQAFFG

SEQ ID NO: 1053913 - protein, 9 aa, Homo Sapiens
TQNWVQKKY

SEQ ID NO: 1053914 - protein, 9 aa, Homo Sapiens
DPNFLEAID

SEQ ID NO: 1053915 - protein, 9 aa, Homo Sapiens
SFDGVPGSD

SEQ ID NO: 1053916 - protein, 9 aa, Homo Sapiens
CEGFTRTLK

SEQ ID NO: 1053917 - protein, 9 aa, Homo Sapiens
GKRYLNLGG

SEQ ID NO: 1053918 - protein, 9 aa, Homo Sapiens
VLYCFVSKT

SEQ ID NO: 1053919 - protein, 9 aa, Homo Sapiens
IKELSLEDK

SEQ ID NO: 1053920 - protein, 9 aa, Homo Sapiens
DALNKAAWT

SEQ ID NO: 1053921 - protein, 9 aa, Homo Sapiens
QEWNIPFEQ

SEQ ID NO: 1053922 - protein, 9 aa, Homo Sapiens
SIQQPRLFG

SEQ ID NO: 1053923 - protein, 9 aa, Homo Sapiens
LLSSPVEIK

SEQ ID NO: 1053924 - protein, 9 aa, Homo Sapiens
PSLVCHELH

SEQ ID NO: 1053925 - protein, 9 aa, Homo Sapiens
INLKQYPTP

SEQ ID NO: 1053926 - protein, 9 aa, Homo Sapiens
AQYQIKKQI

SEQ ID NO: 1053927 - protein, 9 aa, Homo Sapiens
HLLCPSSPS

SEQ ID NO: 1053928 - protein, 9 aa, Homo Sapiens
FQVIALIQN

SEQ ID NO: 1053929 - protein, 9 aa, Homo Sapiens
MYDHQGRSY

SEQ ID NO: 1053930 - protein, 9 aa, Homo Sapiens
DAENEDEDK

SEQ ID NO: 1053931 - protein, 9 aa, Homo Sapiens
GKTGGFRSD

SEQ ID NO: 1053932 - protein, 9 aa, Homo Sapiens
NRNFIDHQR

SEQ ID NO: 1053933 - protein, 9 aa, Homo Sapiens
ARSEADRDG

SEQ ID NO: 1053934 - protein, 9 aa, Homo Sapiens
SVTRVMYCV

SEQ ID NO: 1053935 - protein, 9 aa, Homo Sapiens
AKVQEEMSD

SEQ ID NO: 1053936 - protein, 9 aa, Homo Sapiens
SNMERVSFS

SEQ ID NO: 1053937 - protein, 9 aa, Homo Sapiens
AVRGNNTHN

SEQ ID NO: 1053938 - protein, 9 aa, Homo Sapiens
ADRLGWRQC

SEQ ID NO: 1053939 - protein, 9 aa, Homo Sapiens
ICFKGYAGA

SEQ ID NO: 1053940 - protein, 9 aa, Homo Sapiens
LEDSCLLPE

SEQ ID NO: 1053941 - protein, 9 aa, Homo Sapiens
YSATPSTPQ

SEQ ID NO: 1053942 - protein, 9 aa, Homo Sapiens
EEKEIQSFN

SEQ ID NO: 1053943 - protein, 9 aa, Homo Sapiens
SSRSPPEML

SEQ ID NO: 1053944 - protein, 9 aa, Homo Sapiens
PDSIPQWNN

SEQ ID NO: 1053945 - protein, 9 aa, Homo Sapiens
GFGFGSGSG

SEQ ID NO: 1053946 - protein, 9 aa, Homo Sapiens
SIPKEAKHG

SEQ ID NO: 1053947 - protein, 9 aa, Homo Sapiens
PAIVKVYNY

SEQ ID NO: 1053948 - protein, 9 aa, Homo Sapiens
QLHYSIPKE

SEQ ID NO: 1053949 - protein, 9 aa, Homo Sapiens
ELRESSISG

SEQ ID NO: 1053950 - protein, 9 aa, Homo Sapiens
CKSCQGKKK

SEQ ID NO: 1053951 - protein, 9 aa, Homo Sapiens
ATAIIKEVH

SEQ ID NO: 1053952 - protein, 9 aa, Homo Sapiens
PPPQSARSA

SEQ ID NO: 1053953 - protein, 9 aa, Homo Sapiens
GPGETGFIP

SEQ ID NO: 1053954 - protein, 9 aa, Homo Sapiens
LRKRTYSLI

SEQ ID NO: 1053955 - protein, 9 aa, Homo Sapiens
LLLLKLKFG

SEQ ID NO: 1053956 - protein, 9 aa, Homo Sapiens
ETIYYLMKS

SEQ ID NO: 1053957 - protein, 9 aa, Homo Sapiens
VVGLSLWVE

SEQ ID NO: 1053958 - protein, 9 aa, Homo Sapiens
EYYIINKLH

SEQ ID NO: 1053959 - protein, 9 aa, Homo Sapiens
SSRDSNVFI

SEQ ID NO: 1053960 - protein, 9 aa, Homo Sapiens
ACEPSLLSP

SEQ ID NO: 1053961 - protein, 9 aa, Homo Sapiens
KKWLLSDVI

SEQ ID NO: 1053962 - protein, 9 aa, Homo Sapiens
NQEVWYILA

SEQ ID NO: 1053963 - protein, 9 aa, Homo Sapiens
VSLLGVTAE

SEQ ID NO: 1053964 - protein, 9 aa, Homo Sapiens
IKFCGEEGL

SEQ ID NO: 1053965 - protein, 9 aa, Homo Sapiens
EEAIKKQYT

SEQ ID NO: 1053966 - protein, 9 aa, Homo Sapiens
ESKKYRKLQ

SEQ ID NO: 1053967 - protein, 9 aa, Homo Sapiens
PGEVDNMED

SEQ ID NO: 1053968 - protein, 9 aa, Homo Sapiens
CFQICGAAP

SEQ ID NO: 1053969 - protein, 9 aa, Homo Sapiens
VTNGYNYAI

SEQ ID NO: 1053970 - protein, 9 aa, Homo Sapiens
CLPKCPPVS

SEQ ID NO: 1053971 - protein, 9 aa, Homo Sapiens
DLKTTDFSV

SEQ ID NO: 1053972 - protein, 9 aa, Homo Sapiens
QLIADLVVS

SEQ ID NO: 1053973 - protein, 9 aa, Homo Sapiens
MKGFSLFLA

SEQ ID NO: 1053974 - protein, 9 aa, Homo Sapiens
KPLISRTKM

SEQ ID NO: 1053975 - protein, 9 aa, Homo Sapiens
QHNPLSQEA

SEQ ID NO: 1053976 - protein, 9 aa, Homo Sapiens
EHRQTARRT

SEQ ID NO: 1053977 - protein, 9 aa, Homo Sapiens
LWDFLRQIV

SEQ ID NO: 1053978 - protein, 9 aa, Homo Sapiens
VENTSNDES

SEQ ID NO: 1053979 - protein, 9 aa, Homo Sapiens
EKLLDKELD

SEQ ID NO: 1053980 - protein, 9 aa, Homo Sapiens
EAEARPHRC

SEQ ID NO: 1053981 - protein, 9 aa, Homo Sapiens
VEERFYLGL

SEQ ID NO: 1053982 - protein, 9 aa, Homo Sapiens
MYGNFEEAF

SEQ ID NO: 1053983 - protein, 9 aa, Homo Sapiens
AVSWTTNNV

SEQ ID NO: 1053984 - protein, 9 aa, Homo Sapiens
VTDSLMLNH

SEQ ID NO: 1053985 - protein, 9 aa, Homo Sapiens
TVVRLYQKS

SEQ ID NO: 1053986 - protein, 9 aa, Homo Sapiens
QQLKGLRWE

SEQ ID NO: 1053987 - protein, 9 aa, Homo Sapiens
DSIKFEIGE

SEQ ID NO: 1053988 - protein, 9 aa, Homo Sapiens
SILQSVSER

SEQ ID NO: 1053989 - protein, 9 aa, Homo Sapiens
VLEIFKEIK

SEQ ID NO: 1053990 - protein, 9 aa, Homo Sapiens
TALFLFAHK

SEQ ID NO: 1053991 - protein, 9 aa, Homo Sapiens
ILDNKLTET

SEQ ID NO: 1053992 - protein, 9 aa, Homo Sapiens
SPSLCLRVR

SEQ ID NO: 1053993 - protein, 9 aa, Homo Sapiens
LSKASSQAR

SEQ ID NO: 1053994 - protein, 9 aa, Homo Sapiens
KNKEMKISM

SEQ ID NO: 1053995 - protein, 9 aa, Homo Sapiens
SEIFKFTTQ

SEQ ID NO: 1053996 - protein, 9 aa, Homo Sapiens
KFCEGFTRT

SEQ ID NO: 1053997 - protein, 9 aa, Homo Sapiens
FEGSKLKVS

SEQ ID NO: 1053998 - protein, 9 aa, Homo Sapiens
KQAWFTYNN

SEQ ID NO: 1053999 - protein, 9 aa, Homo Sapiens
LEQVAYKKE

SEQ ID NO: 1054000 - protein, 9 aa, Homo Sapiens
GVLPAGGVI

SEQ ID NO: 1054001 - protein, 9 aa, Homo Sapiens
LSTTGGSGY

SEQ ID NO: 1054002 - protein, 9 aa, Homo Sapiens
KLSGDVLCS

SEQ ID NO: 1054003 - protein, 9 aa, Homo Sapiens
TLCFQICGA

SEQ ID NO: 1054004 - protein, 9 aa, Homo Sapiens
LGAGTKTTS

SEQ ID NO: 1054005 - protein, 9 aa, Homo Sapiens
TCDGCQMFS

SEQ ID NO: 1054006 - protein, 9 aa, Homo Sapiens
GYLDPSSRY

SEQ ID NO: 1054007 - protein, 9 aa, Homo Sapiens
LMLIFLVRL

SEQ ID NO: 1054008 - protein, 9 aa, Homo Sapiens
LHYSIPKEA

SEQ ID NO: 1054009 - protein, 9 aa, Homo Sapiens
LCETGWTGS

SEQ ID NO: 1054010 - protein, 9 aa, Homo Sapiens
VHYGCAFFI

SEQ ID NO: 1054011 - protein, 9 aa, Homo Sapiens
VLSPLNFCG

SEQ ID NO: 1054012 - protein, 9 aa, Homo Sapiens
AVGRMQKEI

SEQ ID NO: 1054013 - protein, 9 aa, Homo Sapiens
DNYFEGAQL

SEQ ID NO: 1054014 - protein, 9 aa, Homo Sapiens
CHSDVATML

SEQ ID NO: 1054015 - protein, 9 aa, Homo Sapiens
ENCEKAYTK

SEQ ID NO: 1054016 - protein, 9 aa, Homo Sapiens
IYTLQGIES

SEQ ID NO: 1054017 - protein, 9 aa, Homo Sapiens
TRVHFCYNV

SEQ ID NO: 1054018 - protein, 9 aa, Homo Sapiens
LKIWDLNSG

SEQ ID NO: 1054019 - protein, 9 aa, Homo Sapiens
PWWVIQIPI

SEQ ID NO: 1054020 - protein, 9 aa, Homo Sapiens
VKVSARNLD

SEQ ID NO: 1054021 - protein, 9 aa, Homo Sapiens
SFDNNGTAT

SEQ ID NO: 1054022 - protein, 9 aa, Homo Sapiens
LLNPHSKPN

SEQ ID NO: 1054023 - protein, 9 aa, Homo Sapiens
PWYFLSEAT

SEQ ID NO: 1054024 - protein, 9 aa, Homo Sapiens
LPELAISGK

SEQ ID NO: 1054025 - protein, 9 aa, Homo Sapiens
GSLVCKALS

SEQ ID NO: 1054026 - protein, 9 aa, Homo Sapiens
KIYTGEKLY

SEQ ID NO: 1054027 - protein, 9 aa, Homo Sapiens
KVASKKTFQ

SEQ ID NO: 1054028 - protein, 9 aa, Homo Sapiens
MISFVPVAY

SEQ ID NO: 1054029 - protein, 9 aa, Homo Sapiens
PVPSQCVFA

SEQ ID NO: 1054030 - protein, 9 aa, Homo Sapiens
EYGVYLEDS

SEQ ID NO: 1054031 - protein, 9 aa, Homo Sapiens
VGIPRPSSR

SEQ ID NO: 1054032 - protein, 9 aa, Homo Sapiens
CLTPKPSPA

SEQ ID NO: 1054033 - protein, 9 aa, Homo Sapiens
AMYSFLETE

SEQ ID NO: 1054034 - protein, 9 aa, Homo Sapiens
INSKQMESY

SEQ ID NO: 1054035 - protein, 9 aa, Homo Sapiens
ARRQQAQRG

SEQ ID NO: 1054036 - protein, 9 aa, Homo Sapiens
SWKKFLRKK

SEQ ID NO: 1054037 - protein, 9 aa, Homo Sapiens
EEMNILIHL

SEQ ID NO: 1054038 - protein, 9 aa, Homo Sapiens
SSRLQSEMN

SEQ ID NO: 1054039 - protein, 9 aa, Homo Sapiens
FFQNKNIEV

SEQ ID NO: 1054040 - protein, 9 aa, Homo Sapiens
TTEISLIGL

SEQ ID NO: 1054041 - protein, 9 aa, Homo Sapiens
SCSSLSSDS

SEQ ID NO: 1054042 - protein, 9 aa, Homo Sapiens
EEIKFDIYT

SEQ ID NO: 1054043 - protein, 9 aa, Homo Sapiens
QIIGMTVIQ

SEQ ID NO: 1054044 - protein, 9 aa, Homo Sapiens
ADTVRSSAD

SEQ ID NO: 1054045 - protein, 9 aa, Homo Sapiens
HSSNPSAIM

SEQ ID NO: 1054046 - protein, 9 aa, Homo Sapiens
IYYLMKSSF

SEQ ID NO: 1054047 - protein, 9 aa, Homo Sapiens
WTINGLMLP

SEQ ID NO: 1054048 - protein, 9 aa, Homo Sapiens
CGSPLLCAL

SEQ ID NO: 1054049 - protein, 9 aa, Homo Sapiens
GFWQTCGEL

SEQ ID NO: 1054050 - protein, 9 aa, Homo Sapiens
ENPNWLVVQ

SEQ ID NO: 1054051 - protein, 9 aa, Homo Sapiens
SVTDINSGI

SEQ ID NO: 1054052 - protein, 9 aa, Homo Sapiens
GHSPQIIFF

SEQ ID NO: 1054053 - protein, 9 aa, Homo Sapiens
EQYLTILSE

SEQ ID NO: 1054054 - protein, 9 aa, Homo Sapiens
SGPGAPIKQ

SEQ ID NO: 1054055 - protein, 9 aa, Homo Sapiens
QEPSLAPPH

SEQ ID NO: 1054056 - protein, 9 aa, Homo Sapiens
CAASPSGML

SEQ ID NO: 1054057 - protein, 9 aa, Homo Sapiens
IFSLLACVV

SEQ ID NO: 1054058 - protein, 9 aa, Homo Sapiens
AVASNMRND

SEQ ID NO: 1054059 - protein, 9 aa, Homo Sapiens
FRTQLETKV

SEQ ID NO: 1054060 - protein, 9 aa, Homo Sapiens
VDCAPPQHY

SEQ ID NO: 1054061 - protein, 9 aa, Homo Sapiens
AEEKEIQSF

SEQ ID NO: 1054062 - protein, 9 aa, Homo Sapiens
SAAVETANL

SEQ ID NO: 1054063 - protein, 9 aa, Homo Sapiens
LSLKCRVDL

SEQ ID NO: 1054064 - protein, 9 aa, Homo Sapiens
FYISADRMF

SEQ ID NO: 1054065 - protein, 9 aa, Homo Sapiens
GAVFYSCKA

SEQ ID NO: 1054066 - protein, 9 aa, Homo Sapiens
GSGNGMIKV

SEQ ID NO: 1054067 - protein, 9 aa, Homo Sapiens
PVFLMRANT

SEQ ID NO: 1054068 - protein, 9 aa, Homo Sapiens
RFATTSYSC

SEQ ID NO: 1054069 - protein, 9 aa, Homo Sapiens
VSFQGGQTY

SEQ ID NO: 1054070 - protein, 9 aa, Homo Sapiens
EKQPSKGAF

SEQ ID NO: 1054071 - protein, 9 aa, Homo Sapiens
DGASPIWYF

SEQ ID NO: 1054072 - protein, 9 aa, Homo Sapiens
VPKLSPEME

SEQ ID NO: 1054073 - protein, 9 aa, Homo Sapiens
IKLDNLNSK

SEQ ID NO: 1054074 - protein, 9 aa, Homo Sapiens
AKVVSAHGL

SEQ ID NO: 1054075 - protein, 9 aa, Homo Sapiens
LSPILLSDA

SEQ ID NO: 1054076 - protein, 9 aa, Homo Sapiens
DNFHGGLDA

SEQ ID NO: 1054077 - protein, 9 aa, Homo Sapiens
ARVVMWREM

SEQ ID NO: 1054078 - protein, 9 aa, Homo Sapiens
GRPKVLVEL

SEQ ID NO: 1054079 - protein, 9 aa, Homo Sapiens
VRIDTILIQ

SEQ ID NO: 1054080 - protein, 9 aa, Homo Sapiens
ASLLTGIAD

SEQ ID NO: 1054081 - protein, 9 aa, Homo Sapiens
LVCNDENSC

SEQ ID NO: 1054082 - protein, 9 aa, Homo Sapiens
DFKPENLIL

SEQ ID NO: 1054083 - protein, 9 aa, Homo Sapiens
GNVLQSFSD

SEQ ID NO: 1054084 - protein, 9 aa, Homo Sapiens
FLQYSIQTA

SEQ ID NO: 1054085 - protein, 9 aa, Homo Sapiens
LPGRNGTPR

SEQ ID NO: 1054086 - protein, 9 aa, Homo Sapiens
LFIQRMTSI

SEQ ID NO: 1054087 - protein, 9 aa, Homo Sapiens
AAPHGLATS

SEQ ID NO: 1054088 - protein, 9 aa, Homo Sapiens
TQDNPARIC

SEQ ID NO: 1054089 - protein, 9 aa, Homo Sapiens
AELCCGLSE

SEQ ID NO: 1054090 - protein, 9 aa, Homo Sapiens
EYITCVILG

SEQ ID NO: 1054091 - protein, 9 aa, Homo Sapiens
PCEQISKVL

SEQ ID NO: 1054092 - protein, 9 aa, Homo Sapiens
ETFTPQHHI

SEQ ID NO: 1054093 - protein, 9 aa, Homo Sapiens
WGGGYKGEN

SEQ ID NO: 1054094 - protein, 9 aa, Homo Sapiens
RVHFCYNVR

SEQ ID NO: 1054095 - protein, 9 aa, Homo Sapiens
RFGIVLSNE

SEQ ID NO: 1054096 - protein, 9 aa, Homo Sapiens
WEVVENTHN

SEQ ID NO: 1054097 - protein, 9 aa, Homo Sapiens
VKYKSELTG

SEQ ID NO: 1054098 - protein, 9 aa, Homo Sapiens
SQMLAFNPR

SEQ ID NO: 1054099 - protein, 9 aa, Homo Sapiens
LLQTYAFVT

SEQ ID NO: 1054100 - protein, 9 aa, Homo Sapiens
PCPNFFSHF

SEQ ID NO: 1054101 - protein, 9 aa, Homo Sapiens
WVWSDSTKS

SEQ ID NO: 1054102 - protein, 9 aa, Homo Sapiens
FASSRWQET

SEQ ID NO: 1054103 - protein, 9 aa, Homo Sapiens
SSLPGFSQN

SEQ ID NO: 1054104 - protein, 9 aa, Homo Sapiens
PPSLSGASG

SEQ ID NO: 1054105 - protein, 9 aa, Homo Sapiens
SAEFGDSVV

SEQ ID NO: 1054106 - protein, 9 aa, Homo Sapiens
APAAPLSTP

SEQ ID NO: 1054107 - protein, 9 aa, Homo Sapiens
PKMHLLFSL

SEQ ID NO: 1054108 - protein, 9 aa, Homo Sapiens
IGEMRMAGT

SEQ ID NO: 1054109 - protein, 9 aa, Homo Sapiens
LNKETDSVK

SEQ ID NO: 1054110 - protein, 9 aa, Homo Sapiens
AGNKTENEN

SEQ ID NO: 1054111 - protein, 9 aa, Homo Sapiens
DLEKLSESL

SEQ ID NO: 1054112 - protein, 9 aa, Homo Sapiens
YGEPAENQD

SEQ ID NO: 1054113 - protein, 9 aa, Homo Sapiens
ENAIIIVIV

SEQ ID NO: 1054114 - protein, 9 aa, Homo Sapiens
LLFSESPQG

SEQ ID NO: 1054115 - protein, 9 aa, Homo Sapiens
VNYSRGLEP

SEQ ID NO: 1054116 - protein, 9 aa, Homo Sapiens
DIFHSQGTN

SEQ ID NO: 1054117 - protein, 9 aa, Homo Sapiens
FREAAVLQK

SEQ ID NO: 1054118 - protein, 9 aa, Homo Sapiens
PVFVWMKRM

SEQ ID NO: 1054119 - protein, 9 aa, Homo Sapiens
FFIVLFFVY

SEQ ID NO: 1054120 - protein, 9 aa, Homo Sapiens
LVSVYNSYS

SEQ ID NO: 1054121 - protein, 9 aa, Homo Sapiens
NIQGMTETP

SEQ ID NO: 1054122 - protein, 9 aa, Homo Sapiens
AGGLLHALI

SEQ ID NO: 1054123 - protein, 9 aa, Homo Sapiens
KEMKANYRE

SEQ ID NO: 1054124 - protein, 9 aa, Homo Sapiens
NKPVNAESQ

SEQ ID NO: 1054125 - protein, 9 aa, Homo Sapiens
SQEPADRRR

SEQ ID NO: 1054126 - protein, 9 aa, Homo Sapiens
IRNMFLENL

SEQ ID NO: 1054127 - protein, 9 aa, Homo Sapiens
PRRSSSNEQ

SEQ ID NO: 1054128 - protein, 9 aa, Homo Sapiens
HGPCHSRSD

SEQ ID NO: 1054129 - protein, 9 aa, Homo Sapiens
KVKQRLGEG

SEQ ID NO: 1054130 - protein, 9 aa, Homo Sapiens
LMALLYQAR

SEQ ID NO: 1054131 - protein, 9 aa, Homo Sapiens
PSLIPVQRT

SEQ ID NO: 1054132 - protein, 9 aa, Homo Sapiens
KKLHVAAET

SEQ ID NO: 1054133 - protein, 9 aa, Homo Sapiens
FSISVVAIT

SEQ ID NO: 1054134 - protein, 9 aa, Homo Sapiens
LKNFSALLS

SEQ ID NO: 1054135 - protein, 9 aa, Homo Sapiens
LVLLFVAVR

SEQ ID NO: 1054136 - protein, 9 aa, Homo Sapiens
WVDPQTWLS

SEQ ID NO: 1054137 - protein, 9 aa, Homo Sapiens
TNLPPTSII

SEQ ID NO: 1054138 - protein, 9 aa, Homo Sapiens
ADGFEPGFM

SEQ ID NO: 1054139 - protein, 9 aa, Homo Sapiens
NKWISAMEN

SEQ ID NO: 1054140 - protein, 9 aa, Homo Sapiens
PLGPSSCMQ

SEQ ID NO: 1054141 - protein, 9 aa, Homo Sapiens
REIEKVLTP

SEQ ID NO: 1054142 - protein, 9 aa, Homo Sapiens
KISKINKDE

SEQ ID NO: 1054143 - protein, 9 aa, Homo Sapiens
NFWKPDSVT

SEQ ID NO: 1054144 - protein, 9 aa, Homo Sapiens
LLDESKMFQ

SEQ ID NO: 1054145 - protein, 9 aa, Homo Sapiens
SQKKDQERP

SEQ ID NO: 1054146 - protein, 9 aa, Homo Sapiens
SGGGPRGPM

SEQ ID NO: 1054147 - protein, 9 aa, Homo Sapiens
YKGENLMKI

SEQ ID NO: 1054148 - protein, 9 aa, Homo Sapiens
QEKAWKLEV

SEQ ID NO: 1054149 - protein, 9 aa, Homo Sapiens
CVCISFGLW

SEQ ID NO: 1054150 - protein, 9 aa, Homo Sapiens
SSNKTIYYE

SEQ ID NO: 1054151 - protein, 9 aa, Homo Sapiens
HEQHPHRHH

SEQ ID NO: 1054152 - protein, 9 aa, Homo Sapiens
DPYRQQSLA

SEQ ID NO: 1054153 - protein, 9 aa, Homo Sapiens
VLAACDFFQ

SEQ ID NO: 1054154 - protein, 9 aa, Homo Sapiens
CPCTDNLDD

SEQ ID NO: 1054155 - protein, 9 aa, Homo Sapiens
ETLVAFRGH

SEQ ID NO: 1054156 - protein, 9 aa, Homo Sapiens
HDRELLRLN

SEQ ID NO: 1054157 - protein, 9 aa, Homo Sapiens
SEKGKAPQK

SEQ ID NO: 1054158 - protein, 9 aa, Homo Sapiens
KGRRKAFET

SEQ ID NO: 1054159 - protein, 9 aa, Homo Sapiens
IIVNVPSSL

SEQ ID NO: 1054160 - protein, 9 aa, Homo Sapiens
NKENMPSYF

SEQ ID NO: 1054161 - protein, 9 aa, Homo Sapiens
NLEQLCINF

SEQ ID NO: 1054162 - protein, 9 aa, Homo Sapiens
SLESNPSVC

SEQ ID NO: 1054163 - protein, 9 aa, Homo Sapiens
LCLRVRARA

SEQ ID NO: 1054164 - protein, 9 aa, Homo Sapiens
KDVPDYAVL

SEQ ID NO: 1054165 - protein, 9 aa, Homo Sapiens
EIQSFFFLT

SEQ ID NO: 1054166 - protein, 9 aa, Homo Sapiens
DWDAFPGND

SEQ ID NO: 1054167 - protein, 9 aa, Homo Sapiens
PVLENVSYI

SEQ ID NO: 1054168 - protein, 9 aa, Homo Sapiens
LSEGLFMLS

SEQ ID NO: 1054169 - protein, 9 aa, Homo Sapiens
RESRLLAYL

SEQ ID NO: 1054170 - protein, 9 aa, Homo Sapiens
VFSMFCYSN

SEQ ID NO: 1054171 - protein, 9 aa, Homo Sapiens
ELPKTFLNE

SEQ ID NO: 1054172 - protein, 9 aa, Homo Sapiens
TPLYYPNVM

SEQ ID NO: 1054173 - protein, 9 aa, Homo Sapiens
ASVSSTKSK

SEQ ID NO: 1054174 - protein, 9 aa, Homo Sapiens
SFTWGASPL

SEQ ID NO: 1054175 - protein, 9 aa, Homo Sapiens
DLCCRTIVF

SEQ ID NO: 1054176 - protein, 9 aa, Homo Sapiens
DKDLPRPLP

SEQ ID NO: 1054177 - protein, 9 aa, Homo Sapiens
SNGPFNNST

SEQ ID NO: 1054178 - protein, 9 aa, Homo Sapiens
GREHFPYGP

SEQ ID NO: 1054179 - protein, 9 aa, Homo Sapiens
GELDFLKAN

SEQ ID NO: 1054180 - protein, 9 aa, Homo Sapiens
NICCAQFSE

SEQ ID NO: 1054181 - protein, 9 aa, Homo Sapiens
KPLRRAPKT

SEQ ID NO: 1054182 - protein, 9 aa, Homo Sapiens
PKPDMCVGE

SEQ ID NO: 1054183 - protein, 9 aa, Homo Sapiens
RFHSARSKK

SEQ ID NO: 1054184 - protein, 9 aa, Homo Sapiens
GYYEEYQGS

SEQ ID NO: 1054185 - protein, 9 aa, Homo Sapiens
EPEKPSKNP

SEQ ID NO: 1054186 - protein, 9 aa, Homo Sapiens
PKPAGPRQN

SEQ ID NO: 1054187 - protein, 9 aa, Homo Sapiens
SAPEENSRK

SEQ ID NO: 1054188 - protein, 9 aa, Homo Sapiens
SPLDIEGAA

SEQ ID NO: 1054189 - protein, 9 aa, Homo Sapiens
IVNVPSSLQ

SEQ ID NO: 1054190 - protein, 9 aa, Homo Sapiens
QRDKNAFPP

SEQ ID NO: 1054191 - protein, 9 aa, Homo Sapiens
SAIEKSIEI

SEQ ID NO: 1054192 - protein, 9 aa, Homo Sapiens
CGAVFYSCK

SEQ ID NO: 1054193 - protein, 9 aa, Homo Sapiens
PTLKRILKR

SEQ ID NO: 1054194 - protein, 9 aa, Homo Sapiens
RQTFYSNNQ

SEQ ID NO: 1054195 - protein, 9 aa, Homo Sapiens
NPHSKPNPK

SEQ ID NO: 1054196 - protein, 9 aa, Homo Sapiens
HFTIELTEK

SEQ ID NO: 1054197 - protein, 9 aa, Homo Sapiens
SFFIRHLRS

SEQ ID NO: 1054198 - protein, 9 aa, Homo Sapiens
DIFFTPECV

SEQ ID NO: 1054199 - protein, 9 aa, Homo Sapiens
QDNAVYECQ

SEQ ID NO: 1054200 - protein, 9 aa, Homo Sapiens
PPQQRCVTP

SEQ ID NO: 1054201 - protein, 9 aa, Homo Sapiens
INDSSEEFV

SEQ ID NO: 1054202 - protein, 9 aa, Homo Sapiens
KLAALRQEP

SEQ ID NO: 1054203 - protein, 9 aa, Homo Sapiens
CLMEGSAFL

SEQ ID NO: 1054204 - protein, 9 aa, Homo Sapiens
HQQMHRDEK

SEQ ID NO: 1054205 - protein, 9 aa, Homo Sapiens
RSATRMVQL

SEQ ID NO: 1054206 - protein, 9 aa, Homo Sapiens
CHLAQVSSH

SEQ ID NO: 1054207 - protein, 9 aa, Homo Sapiens
SNLVCKVSN

SEQ ID NO: 1054208 - protein, 9 aa, Homo Sapiens
SDFAFSPPS

SEQ ID NO: 1054209 - protein, 9 aa, Homo Sapiens
PGIRGPKEQ

SEQ ID NO: 1054210 - protein, 9 aa, Homo Sapiens
ALTQTVVLS

SEQ ID NO: 1054211 - protein, 9 aa, Homo Sapiens
SYLPADTVH

SEQ ID NO: 1054212 - protein, 9 aa, Homo Sapiens
GARAASAPT

SEQ ID NO: 1054213 - protein, 9 aa, Homo Sapiens
SLFLHSESK

SEQ ID NO: 1054214 - protein, 9 aa, Homo Sapiens
SEFKRAARV

SEQ ID NO: 1054215 - protein, 9 aa, Homo Sapiens
NLTKIVPLF

SEQ ID NO: 1054216 - protein, 9 aa, Homo Sapiens
QGEQIQLKG

SEQ ID NO: 1054217 - protein, 9 aa, Homo Sapiens
RIHTKERPY

SEQ ID NO: 1054218 - protein, 9 aa, Homo Sapiens
TAFSEASFL

SEQ ID NO: 1054219 - protein, 9 aa, Homo Sapiens
ITVDVRDKF

SEQ ID NO: 1054220 - protein, 9 aa, Homo Sapiens
ESSIQPTGN

SEQ ID NO: 1054221 - protein, 9 aa, Homo Sapiens
SIKIHTPEQ

SEQ ID NO: 1054222 - protein, 9 aa, Homo Sapiens
SLILIMGIL

SEQ ID NO: 1054223 - protein, 9 aa, Homo Sapiens
PARWDTTLS

SEQ ID NO: 1054224 - protein, 9 aa, Homo Sapiens
GVADELPNM

SEQ ID NO: 1054225 - protein, 9 aa, Homo Sapiens
TALPSSALR

SEQ ID NO: 1054226 - protein, 9 aa, Homo Sapiens
ISLPTLREF

SEQ ID NO: 1054227 - protein, 9 aa, Homo Sapiens
NRRVSFQQC

SEQ ID NO: 1054228 - protein, 9 aa, Homo Sapiens
GKRFLIVMK

SEQ ID NO: 1054229 - protein, 9 aa, Homo Sapiens
SLEDKSPEY

SEQ ID NO: 1054230 - protein, 9 aa, Homo Sapiens
QKSKLGNRH

SEQ ID NO: 1054231 - protein, 9 aa, Homo Sapiens
TTELKKLDF

SEQ ID NO: 1054232 - protein, 9 aa, Homo Sapiens
PAQLDLFYT

SEQ ID NO: 1054233 - protein, 9 aa, Homo Sapiens
GHCKGHPNP

SEQ ID NO: 1054234 - protein, 9 aa, Homo Sapiens
SAIAQSSYL

SEQ ID NO: 1054235 - protein, 9 aa, Homo Sapiens
IISYGYIVS

SEQ ID NO: 1054236 - protein, 9 aa, Homo Sapiens
FPYNFYDFQ

SEQ ID NO: 1054237 - protein, 9 aa, Homo Sapiens
QEEKIKTYF

SEQ ID NO: 1054238 - protein, 9 aa, Homo Sapiens
AIWLGDLLG

SEQ ID NO: 1054239 - protein, 9 aa, Homo Sapiens
YAVLEMKAN

SEQ ID NO: 1054240 - protein, 9 aa, Homo Sapiens
NFPKKKLEL

SEQ ID NO: 1054241 - protein, 9 aa, Homo Sapiens
EKFINNASS

SEQ ID NO: 1054242 - protein, 9 aa, Homo Sapiens
QISKEYGVY

SEQ ID NO: 1054243 - protein, 9 aa, Homo Sapiens
SVYFLPVAQ

SEQ ID NO: 1054244 - protein, 9 aa, Homo Sapiens
PGLQASPPD

SEQ ID NO: 1054245 - protein, 9 aa, Homo Sapiens
QMLTSQASC

SEQ ID NO: 1054246 - protein, 9 aa, Homo Sapiens
REHFPYGPS

SEQ ID NO: 1054247 - protein, 9 aa, Homo Sapiens
QVAYKKEVK

SEQ ID NO: 1054248 - protein, 9 aa, Homo Sapiens
ISLVYVDSQ

SEQ ID NO: 1054249 - protein, 9 aa, Homo Sapiens
DTDCVDQTW

SEQ ID NO: 1054250 - protein, 9 aa, Homo Sapiens
DYFPVILKK

SEQ ID NO: 1054251 - protein, 9 aa, Homo Sapiens
MIRQQALAQ

SEQ ID NO: 1054252 - protein, 9 aa, Homo Sapiens
GEGYSNAQE

SEQ ID NO: 1054253 - protein, 9 aa, Homo Sapiens
SLIGDHQDE

SEQ ID NO: 1054254 - protein, 9 aa, Homo Sapiens
VKSTAYFSP

SEQ ID NO: 1054255 - protein, 9 aa, Homo Sapiens
SSKLFTHKR

SEQ ID NO: 1054256 - protein, 9 aa, Homo Sapiens
ISDGAKNLL

SEQ ID NO: 1054257 - protein, 9 aa, Homo Sapiens
RRKFKKMSN

SEQ ID NO: 1054258 - protein, 9 aa, Homo Sapiens
LFVDKNLDR

SEQ ID NO: 1054259 - protein, 9 aa, Homo Sapiens
ESQRVDFPG

SEQ ID NO: 1054260 - protein, 9 aa, Homo Sapiens
SRLRAIQLT

SEQ ID NO: 1054261 - protein, 9 aa, Homo Sapiens
SLPVIGLDK

SEQ ID NO: 1054262 - protein, 9 aa, Homo Sapiens
TAHKGRGGK

SEQ ID NO: 1054263 - protein, 9 aa, Homo Sapiens
GQGLKFPIY

SEQ ID NO: 1054264 - protein, 9 aa, Homo Sapiens
MDLGDCILK

SEQ ID NO: 1054265 - protein, 9 aa, Homo Sapiens
APVEFTQEN

SEQ ID NO: 1054266 - protein, 9 aa, Homo Sapiens
NSMGFINCE

SEQ ID NO: 1054267 - protein, 9 aa, Homo Sapiens
SSKKEEEDQ

SEQ ID NO: 1054268 - protein, 9 aa, Homo Sapiens
GLLPKVALA

SEQ ID NO: 1054269 - protein, 9 aa, Homo Sapiens
YCLTLYTLL

SEQ ID NO: 1054270 - protein, 9 aa, Homo Sapiens
VEASDEPHE

SEQ ID NO: 1054271 - protein, 9 aa, Homo Sapiens
GFYQSYIDY

SEQ ID NO: 1054272 - protein, 9 aa, Homo Sapiens
KLPPEEELQ

SEQ ID NO: 1054273 - protein, 9 aa, Homo Sapiens
FQGDIWLLA

SEQ ID NO: 1054274 - protein, 9 aa, Homo Sapiens
LTCTQEGWN

SEQ ID NO: 1054275 - protein, 9 aa, Homo Sapiens
PSFTWGASP

SEQ ID NO: 1054276 - protein, 9 aa, Homo Sapiens
YLVQQLEQA

SEQ ID NO: 1054277 - protein, 9 aa, Homo Sapiens
GGGTSLLSV

SEQ ID NO: 1054278 - protein, 9 aa, Homo Sapiens
DKSWTGQEL

SEQ ID NO: 1054279 - protein, 9 aa, Homo Sapiens
DLEKEKLQR

SEQ ID NO: 1054280 - protein, 9 aa, Homo Sapiens
QEKNVWEEM

SEQ ID NO: 1054281 - protein, 9 aa, Homo Sapiens
FLVQNKTTS

SEQ ID NO: 1054282 - protein, 9 aa, Homo Sapiens
PPGKPQRPP

SEQ ID NO: 1054283 - protein, 9 aa, Homo Sapiens
LLICKSSFF

SEQ ID NO: 1054284 - protein, 9 aa, Homo Sapiens
HIVILFTRK

SEQ ID NO: 1054285 - protein, 9 aa, Homo Sapiens
CTSHTSQAS

SEQ ID NO: 1054286 - protein, 9 aa, Homo Sapiens
HFLGEDCIY

SEQ ID NO: 1054287 - protein, 9 aa, Homo Sapiens
LSGAPGPPA

SEQ ID NO: 1054288 - protein, 9 aa, Homo Sapiens
LFSKEGRQL

SEQ ID NO: 1054289 - protein, 9 aa, Homo Sapiens
RELLRLNLL

SEQ ID NO: 1054290 - protein, 9 aa, Homo Sapiens
KLQKQEKTC

SEQ ID NO: 1054291 - protein, 9 aa, Homo Sapiens
LTAKLNPGP

SEQ ID NO: 1054292 - protein, 9 aa, Homo Sapiens
RMNSTTSEK

SEQ ID NO: 1054293 - protein, 9 aa, Homo Sapiens
IYTGNISLF

SEQ ID NO: 1054294 - protein, 9 aa, Homo Sapiens
KCSKCSNLY

SEQ ID NO: 1054295 - protein, 9 aa, Homo Sapiens
RRSSSNEQG

SEQ ID NO: 1054296 - protein, 9 aa, Homo Sapiens
LIRPKICGL

SEQ ID NO: 1054297 - protein, 9 aa, Homo Sapiens
LCSSFQEST

SEQ ID NO: 1054298 - protein, 9 aa, Homo Sapiens
TISKEGYLQ

SEQ ID NO: 1054299 - protein, 9 aa, Homo Sapiens
ARGSLRADD

SEQ ID NO: 1054300 - protein, 9 aa, Homo Sapiens
NQAFSKRNK

SEQ ID NO: 1054301 - protein, 9 aa, Homo Sapiens
LAMAYNRFI

SEQ ID NO: 1054302 - protein, 9 aa, Homo Sapiens
SSVLTTHKR

SEQ ID NO: 1054303 - protein, 9 aa, Homo Sapiens
EPKAPTFDK

SEQ ID NO: 1054304 - protein, 9 aa, Homo Sapiens
ALSPGHSPL

SEQ ID NO: 1054305 - protein, 9 aa, Homo Sapiens
PPKNETTES

SEQ ID NO: 1054306 - protein, 9 aa, Homo Sapiens
HQSPNGTLL

SEQ ID NO: 1054307 - protein, 9 aa, Homo Sapiens
WSRTAYLFS

SEQ ID NO: 1054308 - protein, 9 aa, Homo Sapiens
PHLAQAGAT

SEQ ID NO: 1054309 - protein, 9 aa, Homo Sapiens
IQPTGNMPN

SEQ ID NO: 1054310 - protein, 9 aa, Homo Sapiens
PAAVPDDLA

SEQ ID NO: 1054311 - protein, 9 aa, Homo Sapiens
PSSVRLSPA

SEQ ID NO: 1054312 - protein, 9 aa, Homo Sapiens
LPAGGVIGE

SEQ ID NO: 1054313 - protein, 9 aa, Homo Sapiens
QVKEHYQDF

SEQ ID NO: 1054314 - protein, 9 aa, Homo Sapiens
SLPAILPTN

SEQ ID NO: 1054315 - protein, 9 aa, Homo Sapiens
EEKNGYVTC

SEQ ID NO: 1054316 - protein, 9 aa, Homo Sapiens
VDKRVYMTW

SEQ ID NO: 1054317 - protein, 9 aa, Homo Sapiens
PPPPQSARS

SEQ ID NO: 1054318 - protein, 9 aa, Homo Sapiens
VSSSQLNRI

SEQ ID NO: 1054319 - protein, 9 aa, Homo Sapiens
STPAQTSLA

SEQ ID NO: 1054320 - protein, 9 aa, Homo Sapiens
WREDLTHAL

SEQ ID NO: 1054321 - protein, 9 aa, Homo Sapiens
NSRPGTMRH

SEQ ID NO: 1054322 - protein, 9 aa, Homo Sapiens
EKLTMLNRV

SEQ ID NO: 1054323 - protein, 9 aa, Homo Sapiens
ISIASQCPI

SEQ ID NO: 1054324 - protein, 9 aa, Homo Sapiens
CFRLLLLHR

SEQ ID NO: 1054325 - protein, 9 aa, Homo Sapiens
EITVDVRDK

SEQ ID NO: 1054326 - protein, 9 aa, Homo Sapiens
PVFLNPVVL

SEQ ID NO: 1054327 - protein, 9 aa, Homo Sapiens
GLFLHILES

SEQ ID NO: 1054328 - protein, 9 aa, Homo Sapiens
EGHKVVGVF

SEQ ID NO: 1054329 - protein, 9 aa, Homo Sapiens
KSASLMVDR

SEQ ID NO: 1054330 - protein, 9 aa, Homo Sapiens
PGYVLSKDK

SEQ ID NO: 1054331 - protein, 9 aa, Homo Sapiens
PNVFSLLGI

SEQ ID NO: 1054332 - protein, 9 aa, Homo Sapiens
KIRNPAIQN

SEQ ID NO: 1054333 - protein, 9 aa, Homo Sapiens
LDAVQSLPP

SEQ ID NO: 1054334 - protein, 9 aa, Homo Sapiens
GWPETLERL

SEQ ID NO: 1054335 - protein, 9 aa, Homo Sapiens
TKTTSTTLR

SEQ ID NO: 1054336 - protein, 9 aa, Homo Sapiens
LSGQTINIV

SEQ ID NO: 1054337 - protein, 9 aa, Homo Sapiens
LSKLQELWL

SEQ ID NO: 1054338 - protein, 9 aa, Homo Sapiens
EEGKDVPDY

SEQ ID NO: 1054339 - protein, 9 aa, Homo Sapiens
HLDPRKGSG

SEQ ID NO: 1054340 - protein, 9 aa, Homo Sapiens
AAIITQLAE

SEQ ID NO: 1054341 - protein, 9 aa, Homo Sapiens
YQHNDQIQP

SEQ ID NO: 1054342 - protein, 9 aa, Homo Sapiens
SIKSKKKRS

SEQ ID NO: 1054343 - protein, 9 aa, Homo Sapiens
QLLMIRQQA

SEQ ID NO: 1054344 - protein, 9 aa, Homo Sapiens
LQEKKTEAK

SEQ ID NO: 1054345 - protein, 9 aa, Homo Sapiens
LYAVGGRNK

SEQ ID NO: 1054346 - protein, 9 aa, Homo Sapiens
RIYTGEKPH

SEQ ID NO: 1054347 - protein, 9 aa, Homo Sapiens
KRDDDYAGF

SEQ ID NO: 1054348 - protein, 9 aa, Homo Sapiens
LEDIQSRIG

SEQ ID NO: 1054349 - protein, 9 aa, Homo Sapiens
RIVYDAWDM

SEQ ID NO: 1054350 - protein, 9 aa, Homo Sapiens
IAELRFETQ

SEQ ID NO: 1054351 - protein, 9 aa, Homo Sapiens
VAQGLSRPL

SEQ ID NO: 1054352 - protein, 9 aa, Homo Sapiens
VVLGTFKLQ

SEQ ID NO: 1054353 - protein, 9 aa, Homo Sapiens
FSLLEEKMP

SEQ ID NO: 1054354 - protein, 9 aa, Homo Sapiens
HTQEKSYKC

SEQ ID NO: 1054355 - protein, 9 aa, Homo Sapiens
SHQNQWTVC

SEQ ID NO: 1054356 - protein, 9 aa, Homo Sapiens
AVINNNSKM

SEQ ID NO: 1054357 - protein, 9 aa, Homo Sapiens
KTASSLTTS

SEQ ID NO: 1054358 - protein, 9 aa, Homo Sapiens
REVPSEEGA

SEQ ID NO: 1054359 - protein, 9 aa, Homo Sapiens
HDTERNLTM

SEQ ID NO: 1054360 - protein, 9 aa, Homo Sapiens
DYELLIQKF

SEQ ID NO: 1054361 - protein, 9 aa, Homo Sapiens
LSKDKCVPR

SEQ ID NO: 1054362 - protein, 9 aa, Homo Sapiens
IAYNAIFFT

SEQ ID NO: 1054363 - protein, 9 aa, Homo Sapiens
TALYEAWAA

SEQ ID NO: 1054364 - protein, 9 aa, Homo Sapiens
LVYKMPIKK

SEQ ID NO: 1054365 - protein, 9 aa, Homo Sapiens
VRGQNVEML

SEQ ID NO: 1054366 - protein, 9 aa, Homo Sapiens
ATPSSAPGV

SEQ ID NO: 1054367 - protein, 9 aa, Homo Sapiens
NWYVDGVKV

SEQ ID NO: 1054368 - protein, 9 aa, Homo Sapiens
FGWFIKSTN

SEQ ID NO: 1054369 - protein, 9 aa, Homo Sapiens
LHDDFCYCK

SEQ ID NO: 1054370 - protein, 9 aa, Homo Sapiens
SDWDEGANG

SEQ ID NO: 1054371 - protein, 9 aa, Homo Sapiens
PNDVSSQPL

SEQ ID NO: 1054372 - protein, 9 aa, Homo Sapiens
ELPRGSILR

SEQ ID NO: 1054373 - protein, 9 aa, Homo Sapiens
AASVSSTKS

SEQ ID NO: 1054374 - protein, 9 aa, Homo Sapiens
WQRGRILFF

SEQ ID NO: 1054375 - protein, 9 aa, Homo Sapiens
SSNPSAIMA

SEQ ID NO: 1054376 - protein, 9 aa, Homo Sapiens
IEHSMHMIS

SEQ ID NO: 1054377 - protein, 9 aa, Homo Sapiens
KVALHCALI

SEQ ID NO: 1054378 - protein, 9 aa, Homo Sapiens
RVKSTAYFS

SEQ ID NO: 1054379 - protein, 9 aa, Homo Sapiens
SQGADLETY

SEQ ID NO: 1054380 - protein, 9 aa, Homo Sapiens
ILVFRFGPH

SEQ ID NO: 1054381 - protein, 9 aa, Homo Sapiens
EMLMLNAYK

SEQ ID NO: 1054382 - protein, 9 aa, Homo Sapiens
SDGRLCSSV

SEQ ID NO: 1054383 - protein, 9 aa, Homo Sapiens
TKDTRLAEL

SEQ ID NO: 1054384 - protein, 9 aa, Homo Sapiens
EECGKASNR

SEQ ID NO: 1054385 - protein, 9 aa, Homo Sapiens
PGPPGSGSS

SEQ ID NO: 1054386 - protein, 9 aa, Homo Sapiens
AYTWTNLTC

SEQ ID NO: 1054387 - protein, 9 aa, Homo Sapiens
ALLPSPGSA

SEQ ID NO: 1054388 - protein, 9 aa, Homo Sapiens
STRFPGFPG

SEQ ID NO: 1054389 - protein, 9 aa, Homo Sapiens
HFSSRQPIY

SEQ ID NO: 1054390 - protein, 9 aa, Homo Sapiens
RGGHGCTSP

SEQ ID NO: 1054391 - protein, 9 aa, Homo Sapiens
TEDCLNEVK

SEQ ID NO: 1054392 - protein, 9 aa, Homo Sapiens
MPRWVPDCA

SEQ ID NO: 1054393 - protein, 9 aa, Homo Sapiens
REETETIEN

SEQ ID NO: 1054394 - protein, 9 aa, Homo Sapiens
TIFFAGCFT

SEQ ID NO: 1054395 - protein, 9 aa, Homo Sapiens
PLSLYISIN

SEQ ID NO: 1054396 - protein, 9 aa, Homo Sapiens
PFNKQQYKM

SEQ ID NO: 1054397 - protein, 9 aa, Homo Sapiens
HISFNWDCE

SEQ ID NO: 1054398 - protein, 9 aa, Homo Sapiens
LTDKEKAEE

SEQ ID NO: 1054399 - protein, 9 aa, Homo Sapiens
NFVELGDFI

SEQ ID NO: 1054400 - protein, 9 aa, Homo Sapiens
EKGLAWEEL

SEQ ID NO: 1054401 - protein, 9 aa, Homo Sapiens
MFSINGSRF

SEQ ID NO: 1054402 - protein, 9 aa, Homo Sapiens
TAKAVQHFY

SEQ ID NO: 1054403 - protein, 9 aa, Homo Sapiens
SKAIYVNRT

SEQ ID NO: 1054404 - protein, 9 aa, Homo Sapiens
RRGGPLMFR

SEQ ID NO: 1054405 - protein, 9 aa, Homo Sapiens
KREQYITNK

SEQ ID NO: 1054406 - protein, 9 aa, Homo Sapiens
VVFFGFLLL

SEQ ID NO: 1054407 - protein, 9 aa, Homo Sapiens
IGKAIWLPW

SEQ ID NO: 1054408 - protein, 9 aa, Homo Sapiens
EFKDYSTAM

SEQ ID NO: 1054409 - protein, 9 aa, Homo Sapiens
LLILKFVMI

SEQ ID NO: 1054410 - protein, 9 aa, Homo Sapiens
REQGFPGPR

SEQ ID NO: 1054411 - protein, 9 aa, Homo Sapiens
VDPKMRIRF

SEQ ID NO: 1054412 - protein, 9 aa, Homo Sapiens
KDANEIHKK

SEQ ID NO: 1054413 - protein, 9 aa, Homo Sapiens
SPEMLASYQ

SEQ ID NO: 1054414 - protein, 9 aa, Homo Sapiens
PAGDGKKHS

SEQ ID NO: 1054415 - protein, 9 aa, Homo Sapiens
DKSFGNSLL

SEQ ID NO: 1054416 - protein, 9 aa, Homo Sapiens
QKDPPELSP

SEQ ID NO: 1054417 - protein, 9 aa, Homo Sapiens
PVAQYIRAA

SEQ ID NO: 1054418 - protein, 9 aa, Homo Sapiens
HFCFQTESR

SEQ ID NO: 1054419 - protein, 9 aa, Homo Sapiens
CQFLTGLYF

SEQ ID NO: 1054420 - protein, 9 aa, Homo Sapiens
YHLNPKTIT

SEQ ID NO: 1054421 - protein, 9 aa, Homo Sapiens
FFCDLSRFI

SEQ ID NO: 1054422 - protein, 9 aa, Homo Sapiens
RLVKGAKGT

SEQ ID NO: 1054423 - protein, 9 aa, Homo Sapiens
VWKVEQKHE

SEQ ID NO: 1054424 - protein, 9 aa, Homo Sapiens
SSCIARTVS

SEQ ID NO: 1054425 - protein, 9 aa, Homo Sapiens
VWAYNCGEH

SEQ ID NO: 1054426 - protein, 9 aa, Homo Sapiens
QLEYQKEMK

SEQ ID NO: 1054427 - protein, 9 aa, Homo Sapiens
FVSLYPGTT

SEQ ID NO: 1054428 - protein, 9 aa, Homo Sapiens
KLNEQSSTR

SEQ ID NO: 1054429 - protein, 9 aa, Homo Sapiens
VKNEASCSP

SEQ ID NO: 1054430 - protein, 9 aa, Homo Sapiens
YENCGHENL

SEQ ID NO: 1054431 - protein, 9 aa, Homo Sapiens
TNNVVQNFY

SEQ ID NO: 1054432 - protein, 9 aa, Homo Sapiens
FGLAMGTTE

SEQ ID NO: 1054433 - protein, 9 aa, Homo Sapiens
EEEQTKPLR

SEQ ID NO: 1054434 - protein, 9 aa, Homo Sapiens
ATEGAIHVV

SEQ ID NO: 1054435 - protein, 9 aa, Homo Sapiens
GFPSVPLVI

SEQ ID NO: 1054436 - protein, 9 aa, Homo Sapiens
QPVETGGVQ

SEQ ID NO: 1054437 - protein, 9 aa, Homo Sapiens
WQTMARNRG

SEQ ID NO: 1054438 - protein, 9 aa, Homo Sapiens
PPHFSPTLR

SEQ ID NO: 1054439 - protein, 9 aa, Homo Sapiens
AHKPENPED

SEQ ID NO: 1054440 - protein, 9 aa, Homo Sapiens
PYSVVQGEQ

SEQ ID NO: 1054441 - protein, 9 aa, Homo Sapiens
TSEKIFCFQ

SEQ ID NO: 1054442 - protein, 9 aa, Homo Sapiens
LSLLGAEVC

SEQ ID NO: 1054443 - protein, 9 aa, Homo Sapiens
ILSEGLFML

SEQ ID NO: 1054444 - protein, 9 aa, Homo Sapiens
HIYKKRKLA

SEQ ID NO: 1054445 - protein, 9 aa, Homo Sapiens
FRLLLLHRA

SEQ ID NO: 1054446 - protein, 9 aa, Homo Sapiens
MRCARFVSR

SEQ ID NO: 1054447 - protein, 9 aa, Homo Sapiens
LLGFFQNKN

SEQ ID NO: 1054448 - protein, 9 aa, Homo Sapiens
NGFVSPPPF

SEQ ID NO: 1054449 - protein, 9 aa, Homo Sapiens
NSKYQLLYH

SEQ ID NO: 1054450 - protein, 9 aa, Homo Sapiens
LCKLCGQLN

SEQ ID NO: 1054451 - protein, 9 aa, Homo Sapiens
EVDDVMRIF

SEQ ID NO: 1054452 - protein, 9 aa, Homo Sapiens
GAEDGQVKE

SEQ ID NO: 1054453 - protein, 9 aa, Homo Sapiens
FYLLVTPMV

SEQ ID NO: 1054454 - protein, 9 aa, Homo Sapiens
TRNLYATVI

SEQ ID NO: 1054455 - protein, 9 aa, Homo Sapiens
KALMSPDTR

SEQ ID NO: 1054456 - protein, 9 aa, Homo Sapiens
YQIKKQIEL

SEQ ID NO: 1054457 - protein, 9 aa, Homo Sapiens
AFVIQDQCI

SEQ ID NO: 1054458 - protein, 9 aa, Homo Sapiens
LPLVIPGDP

SEQ ID NO: 1054459 - protein, 9 aa, Homo Sapiens
PSTFHDVSV

SEQ ID NO: 1054460 - protein, 9 aa, Homo Sapiens
FCYKIAVRI

SEQ ID NO: 1054461 - protein, 9 aa, Homo Sapiens
GMKLEAIDS

SEQ ID NO: 1054462 - protein, 9 aa, Homo Sapiens
HHNYQNWRM

SEQ ID NO: 1054463 - protein, 9 aa, Homo Sapiens
KHSITAVVG

SEQ ID NO: 1054464 - protein, 9 aa, Homo Sapiens
AASFLQTTD

SEQ ID NO: 1054465 - protein, 9 aa, Homo Sapiens
EHLPLPAKS

SEQ ID NO: 1054466 - protein, 9 aa, Homo Sapiens
NPLGTQDNP

SEQ ID NO: 1054467 - protein, 9 aa, Homo Sapiens
SSEIFKFTT

SEQ ID NO: 1054468 - protein, 9 aa, Homo Sapiens
NLYSHTSIW

SEQ ID NO: 1054469 - protein, 9 aa, Homo Sapiens
LAVVIRIKV

SEQ ID NO: 1054470 - protein, 9 aa, Homo Sapiens
GAAKPALTL

SEQ ID NO: 1054471 - protein, 9 aa, Homo Sapiens
WFIYTLQGI

SEQ ID NO: 1054472 - protein, 9 aa, Homo Sapiens
QDTLLPTVL

SEQ ID NO: 1054473 - protein, 9 aa, Homo Sapiens
NDGATCAMK

SEQ ID NO: 1054474 - protein, 9 aa, Homo Sapiens
SESGSNSWE

SEQ ID NO: 1054475 - protein, 9 aa, Homo Sapiens
EKTEHAEKL

SEQ ID NO: 1054476 - protein, 9 aa, Homo Sapiens
TWIGAALLI

SEQ ID NO: 1054477 - protein, 9 aa, Homo Sapiens
ISLIGLIPS

SEQ ID NO: 1054478 - protein, 9 aa, Homo Sapiens
DDSSNKTIY

SEQ ID NO: 1054479 - protein, 9 aa, Homo Sapiens
SVDLNGQDC

SEQ ID NO: 1054480 - protein, 9 aa, Homo Sapiens
PSLGPHYGR

SEQ ID NO: 1054481 - protein, 9 aa, Homo Sapiens
ISKEGYLQG

SEQ ID NO: 1054482 - protein, 9 aa, Homo Sapiens
YTLKNKEMK

SEQ ID NO: 1054483 - protein, 9 aa, Homo Sapiens
PGSPEPKGS

SEQ ID NO: 1054484 - protein, 9 aa, Homo Sapiens
RAFFVSAFP

SEQ ID NO: 1054485 - protein, 9 aa, Homo Sapiens
VNQNKFLCY

SEQ ID NO: 1054486 - protein, 9 aa, Homo Sapiens
LEKEKLQRE

SEQ ID NO: 1054487 - protein, 9 aa, Homo Sapiens
GKAFSDPSF

SEQ ID NO: 1054488 - protein, 9 aa, Homo Sapiens
DAEALGEQL

SEQ ID NO: 1054489 - protein, 9 aa, Homo Sapiens
LGSLAFVIQ

SEQ ID NO: 1054490 - protein, 9 aa, Homo Sapiens
VEPILTSVH

SEQ ID NO: 1054491 - protein, 9 aa, Homo Sapiens
SNVKTNVQL

SEQ ID NO: 1054492 - protein, 9 aa, Homo Sapiens
QEASFLVDE

SEQ ID NO: 1054493 - protein, 9 aa, Homo Sapiens
SSPNRVTRD

SEQ ID NO: 1054494 - protein, 9 aa, Homo Sapiens
CAMKWNCAF

SEQ ID NO: 1054495 - protein, 9 aa, Homo Sapiens
SLQERGGSC

SEQ ID NO: 1054496 - protein, 9 aa, Homo Sapiens
STSEKIFCF

SEQ ID NO: 1054497 - protein, 9 aa, Homo Sapiens
PENRKSTMF

SEQ ID NO: 1054498 - protein, 9 aa, Homo Sapiens
ASKKTFQIG

SEQ ID NO: 1054499 - protein, 9 aa, Homo Sapiens
RDEQLTFEM

SEQ ID NO: 1054500 - protein, 9 aa, Homo Sapiens
LRRKSVLGK

SEQ ID NO: 1054501 - protein, 9 aa, Homo Sapiens
NSQLWADPG

SEQ ID NO: 1054502 - protein, 9 aa, Homo Sapiens
RGYCLSSRS

SEQ ID NO: 1054503 - protein, 9 aa, Homo Sapiens
GQTQSVVFL

SEQ ID NO: 1054504 - protein, 9 aa, Homo Sapiens
FYHHQKMNT

SEQ ID NO: 1054505 - protein, 9 aa, Homo Sapiens
LTELISSLC

SEQ ID NO: 1054506 - protein, 9 aa, Homo Sapiens
SVISVFYTH

SEQ ID NO: 1054507 - protein, 9 aa, Homo Sapiens
NMTLVSSSL

SEQ ID NO: 1054508 - protein, 9 aa, Homo Sapiens
SVPWWVIQI

SEQ ID NO: 1054509 - protein, 9 aa, Homo Sapiens
IYLVTLIEN

SEQ ID NO: 1054510 - protein, 9 aa, Homo Sapiens
AEMNYVNRD

SEQ ID NO: 1054511 - protein, 9 aa, Homo Sapiens
PCPEPQEAC

SEQ ID NO: 1054512 - protein, 9 aa, Homo Sapiens
QEGTSGEQE

SEQ ID NO: 1054513 - protein, 9 aa, Homo Sapiens
YREPQKGIQ

SEQ ID NO: 1054514 - protein, 9 aa, Homo Sapiens
FSNMWKKSK

SEQ ID NO: 1054515 - protein, 9 aa, Homo Sapiens
GQVDGNKLL

SEQ ID NO: 1054516 - protein, 9 aa, Homo Sapiens
NQSSQVMDL

SEQ ID NO: 1054517 - protein, 9 aa, Homo Sapiens
FFWISQAAV

SEQ ID NO: 1054518 - protein, 9 aa, Homo Sapiens
LLLPPPPAK

SEQ ID NO: 1054519 - protein, 9 aa, Homo Sapiens
SLSLLQTQG

SEQ ID NO: 1054520 - protein, 9 aa, Homo Sapiens
KEGTLPTPV

SEQ ID NO: 1054521 - protein, 9 aa, Homo Sapiens
PGLDVWGGK

SEQ ID NO: 1054522 - protein, 9 aa, Homo Sapiens
KQTDYRRWK

SEQ ID NO: 1054523 - protein, 9 aa, Homo Sapiens
LNPIIYTLK

SEQ ID NO: 1054524 - protein, 9 aa, Homo Sapiens
KTIFFAGCF

SEQ ID NO: 1054525 - protein, 9 aa, Homo Sapiens
YIRNQQRWT

SEQ ID NO: 1054526 - protein, 9 aa, Homo Sapiens
AIEQLAVMD

SEQ ID NO: 1054527 - protein, 9 aa, Homo Sapiens
SLMAAGKFA

SEQ ID NO: 1054528 - protein, 9 aa, Homo Sapiens
VARTDGLWG

SEQ ID NO: 1054529 - protein, 9 aa, Homo Sapiens
NTAPLTRVP

SEQ ID NO: 1054530 - protein, 9 aa, Homo Sapiens
YVCHYCHEE

SEQ ID NO: 1054531 - protein, 9 aa, Homo Sapiens
LGLKKSSFL

SEQ ID NO: 1054532 - protein, 9 aa, Homo Sapiens
FQAILLMDG

SEQ ID NO: 1054533 - protein, 9 aa, Homo Sapiens
MEQLLTWKE

SEQ ID NO: 1054534 - protein, 9 aa, Homo Sapiens
FVGPVSPNR

SEQ ID NO: 1054535 - protein, 9 aa, Homo Sapiens
TFYSNNQSP

SEQ ID NO: 1054536 - protein, 9 aa, Homo Sapiens
NGQITTAAM

SEQ ID NO: 1054537 - protein, 9 aa, Homo Sapiens
GLHYGIIFC

SEQ ID NO: 1054538 - protein, 9 aa, Homo Sapiens
DFNNLEQLC

SEQ ID NO: 1054539 - protein, 9 aa, Homo Sapiens
SSPPACEPN

SEQ ID NO: 1054540 - protein, 9 aa, Homo Sapiens
IYLNTQQSS

SEQ ID NO: 1054541 - protein, 9 aa, Homo Sapiens
SLPESQVLL

SEQ ID NO: 1054542 - protein, 9 aa, Homo Sapiens
STNKESKKY

SEQ ID NO: 1054543 - protein, 9 aa, Homo Sapiens
YGGGGYYEE

SEQ ID NO: 1054544 - protein, 9 aa, Homo Sapiens
CNKHLHMFT

SEQ ID NO: 1054545 - protein, 9 aa, Homo Sapiens
ETRPQHYPP

SEQ ID NO: 1054546 - protein, 9 aa, Homo Sapiens
KLAVDQREI

SEQ ID NO: 1054547 - protein, 9 aa, Homo Sapiens
EQQKKHLEH

SEQ ID NO: 1054548 - protein, 9 aa, Homo Sapiens
YVHMFLLAQ

SEQ ID NO: 1054549 - protein, 9 aa, Homo Sapiens
RWVWSDSTK

SEQ ID NO: 1054550 - protein, 9 aa, Homo Sapiens
GADYELLIQ

SEQ ID NO: 1054551 - protein, 9 aa, Homo Sapiens
AAESQASES

SEQ ID NO: 1054552 - protein, 9 aa, Homo Sapiens
IIFVSHLHT

SEQ ID NO: 1054553 - protein, 9 aa, Homo Sapiens
KSKMEIFEE

SEQ ID NO: 1054554 - protein, 9 aa, Homo Sapiens
PVSPNSSLF

SEQ ID NO: 1054555 - protein, 9 aa, Homo Sapiens
STFIPVISQ

SEQ ID NO: 1054556 - protein, 9 aa, Homo Sapiens
DSLHLLKFL

SEQ ID NO: 1054557 - protein, 9 aa, Homo Sapiens
YDKEGGGEM

SEQ ID NO: 1054558 - protein, 9 aa, Homo Sapiens
GNIVVYHVI

SEQ ID NO: 1054559 - protein, 9 aa, Homo Sapiens
TPSFMLILK

SEQ ID NO: 1054560 - protein, 9 aa, Homo Sapiens
EGQKKGWLS

SEQ ID NO: 1054561 - protein, 9 aa, Homo Sapiens
FMSFDNNGT

SEQ ID NO: 1054562 - protein, 9 aa, Homo Sapiens
KISICKTIL

SEQ ID NO: 1054563 - protein, 9 aa, Homo Sapiens
SICKTILCL

SEQ ID NO: 1054564 - protein, 9 aa, Homo Sapiens
DCNIEDSAF

SEQ ID NO: 1054565 - protein, 9 aa, Homo Sapiens
SIFLASLWI

SEQ ID NO: 1054566 - protein, 9 aa, Homo Sapiens
TAAEFWIYK

SEQ ID NO: 1054567 - protein, 9 aa, Homo Sapiens
FILKQKSQC

SEQ ID NO: 1054568 - protein, 9 aa, Homo Sapiens
EPILTSVHK

SEQ ID NO: 1054569 - protein, 9 aa, Homo Sapiens
LLYLPALLA

SEQ ID NO: 1054570 - protein, 9 aa, Homo Sapiens
IEERLYYLI

SEQ ID NO: 1054571 - protein, 9 aa, Homo Sapiens
LGCYFYEGV

SEQ ID NO: 1054572 - protein, 9 aa, Homo Sapiens
GGDALNHTT

SEQ ID NO: 1054573 - protein, 9 aa, Homo Sapiens
TKDKESYYI

SEQ ID NO: 1054574 - protein, 9 aa, Homo Sapiens
EGQRFSLFL

SEQ ID NO: 1054575 - protein, 9 aa, Homo Sapiens
SDGASPIWY

SEQ ID NO: 1054576 - protein, 9 aa, Homo Sapiens
VNGVCICFK

SEQ ID NO: 1054577 - protein, 9 aa, Homo Sapiens
ETGTLEKLL

SEQ ID NO: 1054578 - protein, 9 aa, Homo Sapiens
AEIENSLED

SEQ ID NO: 1054579 - protein, 9 aa, Homo Sapiens
PQVIMGPET

SEQ ID NO: 1054580 - protein, 9 aa, Homo Sapiens
FLFLYLFLL

SEQ ID NO: 1054581 - protein, 9 aa, Homo Sapiens
NLIAHEKIY

SEQ ID NO: 1054582 - protein, 9 aa, Homo Sapiens
GVKFKSVTI

SEQ ID NO: 1054583 - protein, 9 aa, Homo Sapiens
SCHRNCVTT

SEQ ID NO: 1054584 - protein, 9 aa, Homo Sapiens
TPADWLALI

SEQ ID NO: 1054585 - protein, 9 aa, Homo Sapiens
ATLAKNMEL

SEQ ID NO: 1054586 - protein, 9 aa, Homo Sapiens
QFHRQTVKF

SEQ ID NO: 1054587 - protein, 9 aa, Homo Sapiens
YKSENIYEG

SEQ ID NO: 1054588 - protein, 9 aa, Homo Sapiens
RIFYISADR

SEQ ID NO: 1054589 - protein, 9 aa, Homo Sapiens
MEDLPAPNN

SEQ ID NO: 1054590 - protein, 9 aa, Homo Sapiens
RIYIFLNGN

SEQ ID NO: 1054591 - protein, 9 aa, Homo Sapiens
VLLFSESPQ

SEQ ID NO: 1054592 - protein, 9 aa, Homo Sapiens
WNSDDYGGV

SEQ ID NO: 1054593 - protein, 9 aa, Homo Sapiens
LPARRHRHS

SEQ ID NO: 1054594 - protein, 9 aa, Homo Sapiens
RNDEITQDE

SEQ ID NO: 1054595 - protein, 9 aa, Homo Sapiens
IMKYFDLKR

SEQ ID NO: 1054596 - protein, 9 aa, Homo Sapiens
QNLERAALP

SEQ ID NO: 1054597 - protein, 9 aa, Homo Sapiens
IALDDIFFT

SEQ ID NO: 1054598 - protein, 9 aa, Homo Sapiens
EDGTPEGLV

SEQ ID NO: 1054599 - protein, 9 aa, Homo Sapiens
KSRKKSKDQ

SEQ ID NO: 1054600 - protein, 9 aa, Homo Sapiens
KHQFDYGEL

SEQ ID NO: 1054601 - protein, 9 aa, Homo Sapiens
TQDDKERIE

SEQ ID NO: 1054602 - protein, 9 aa, Homo Sapiens
CLCPDGFYG

SEQ ID NO: 1054603 - protein, 9 aa, Homo Sapiens
IWHQLAFQH

SEQ ID NO: 1054604 - protein, 9 aa, Homo Sapiens
ETEIILLMA

SEQ ID NO: 1054605 - protein, 9 aa, Homo Sapiens
TILGNGSSL

SEQ ID NO: 1054606 - protein, 9 aa, Homo Sapiens
HNNTLLVKA

SEQ ID NO: 1054607 - protein, 9 aa, Homo Sapiens
GFDTELDEF

SEQ ID NO: 1054608 - protein, 9 aa, Homo Sapiens
PSGFMSFDN

SEQ ID NO: 1054609 - protein, 9 aa, Homo Sapiens
AQLLRTLRS

SEQ ID NO: 1054610 - protein, 9 aa, Homo Sapiens
NKTSLGTVF

SEQ ID NO: 1054611 - protein, 9 aa, Homo Sapiens
SGEKQYQCK

SEQ ID NO: 1054612 - protein, 9 aa, Homo Sapiens
FSDPQAGKK

SEQ ID NO: 1054613 - protein, 9 aa, Homo Sapiens
YDLDALNKA

SEQ ID NO: 1054614 - protein, 9 aa, Homo Sapiens
LGIKKYRYN

SEQ ID NO: 1054615 - protein, 9 aa, Homo Sapiens
WVNQVVLFA

SEQ ID NO: 1054616 - protein, 9 aa, Homo Sapiens
GKRGDAASH

SEQ ID NO: 1054617 - protein, 9 aa, Homo Sapiens
KRPRTAGLA

SEQ ID NO: 1054618 - protein, 9 aa, Homo Sapiens
LLNVGSQEA

SEQ ID NO: 1054619 - protein, 9 aa, Homo Sapiens
TISQNNLTK

SEQ ID NO: 1054620 - protein, 9 aa, Homo Sapiens
ILASLDTFQ

SEQ ID NO: 1054621 - protein, 9 aa, Homo Sapiens
RHQCQARKP

SEQ ID NO: 1054622 - protein, 9 aa, Homo Sapiens
GGGRKGLLG

SEQ ID NO: 1054623 - protein, 9 aa, Homo Sapiens
AKFAYWGVL

SEQ ID NO: 1054624 - protein, 9 aa, Homo Sapiens
CCNCKCGQE

SEQ ID NO: 1054625 - protein, 9 aa, Homo Sapiens
FATTSYSCP

SEQ ID NO: 1054626 - protein, 9 aa, Homo Sapiens
RGEPFIRGE

SEQ ID NO: 1054627 - protein, 9 aa, Homo Sapiens
IIIDEVHEQ

SEQ ID NO: 1054628 - protein, 9 aa, Homo Sapiens
STNFLPMRP

SEQ ID NO: 1054629 - protein, 9 aa, Homo Sapiens
NEPSGDKSL

SEQ ID NO: 1054630 - protein, 9 aa, Homo Sapiens
DFLRTLYNA

SEQ ID NO: 1054631 - protein, 9 aa, Homo Sapiens
IKDSVFKSC

SEQ ID NO: 1054632 - protein, 9 aa, Homo Sapiens
VSLYPGTTY

SEQ ID NO: 1054633 - protein, 9 aa, Homo Sapiens
KYLGGGSAL

SEQ ID NO: 1054634 - protein, 9 aa, Homo Sapiens
THFMDFLGK

SEQ ID NO: 1054635 - protein, 9 aa, Homo Sapiens
YSVSMSLRV

SEQ ID NO: 1054636 - protein, 9 aa, Homo Sapiens
CQLDKGLVN

SEQ ID NO: 1054637 - protein, 9 aa, Homo Sapiens
LGQDMRRLR

SEQ ID NO: 1054638 - protein, 9 aa, Homo Sapiens
GEKSSHSVT

SEQ ID NO: 1054639 - protein, 9 aa, Homo Sapiens
LGETWNSFL

SEQ ID NO: 1054640 - protein, 9 aa, Homo Sapiens
QGAPRAPTK

SEQ ID NO: 1054641 - protein, 9 aa, Homo Sapiens
SQIYYDRFS

SEQ ID NO: 1054642 - protein, 9 aa, Homo Sapiens
GKKRKGSKG

SEQ ID NO: 1054643 - protein, 9 aa, Homo Sapiens
TLGLKKSSF

SEQ ID NO: 1054644 - protein, 9 aa, Homo Sapiens
LFVLLTSCY

SEQ ID NO: 1054645 - protein, 9 aa, Homo Sapiens
EVEVHLDCE

SEQ ID NO: 1054646 - protein, 9 aa, Homo Sapiens
KAREFMELL

SEQ ID NO: 1054647 - protein, 9 aa, Homo Sapiens
PPEDRPGEG

SEQ ID NO: 1054648 - protein, 9 aa, Homo Sapiens
KVQSREKSF

SEQ ID NO: 1054649 - protein, 9 aa, Homo Sapiens
GINWAQWKD

SEQ ID NO: 1054650 - protein, 9 aa, Homo Sapiens
YKGKGKQCE

SEQ ID NO: 1054651 - protein, 9 aa, Homo Sapiens
LTETPPVKE

SEQ ID NO: 1054652 - protein, 9 aa, Homo Sapiens
NSYTMILQA

SEQ ID NO: 1054653 - protein, 9 aa, Homo Sapiens
SHLESRYLL

SEQ ID NO: 1054654 - protein, 9 aa, Homo Sapiens
KLKLQKLDK

SEQ ID NO: 1054655 - protein, 9 aa, Homo Sapiens
AKVFFNKPD

SEQ ID NO: 1054656 - protein, 9 aa, Homo Sapiens
ADELPNMLV

SEQ ID NO: 1054657 - protein, 9 aa, Homo Sapiens
LYQCKECGK

SEQ ID NO: 1054658 - protein, 9 aa, Homo Sapiens
IENIYFRHK

SEQ ID NO: 1054659 - protein, 9 aa, Homo Sapiens
MDLYGQPKP

SEQ ID NO: 1054660 - protein, 9 aa, Homo Sapiens
ESLSPIGHM

SEQ ID NO: 1054661 - protein, 9 aa, Homo Sapiens
ASGGTGFFL

SEQ ID NO: 1054662 - protein, 9 aa, Homo Sapiens
ANSRFGLLP

SEQ ID NO: 1054663 - protein, 9 aa, Homo Sapiens
GATCATPSN

SEQ ID NO: 1054664 - protein, 9 aa, Homo Sapiens
NNFRILFNN

SEQ ID NO: 1054665 - protein, 9 aa, Homo Sapiens
AFFDCYDPE

SEQ ID NO: 1054666 - protein, 9 aa, Homo Sapiens
WPQENKNET

SEQ ID NO: 1054667 - protein, 9 aa, Homo Sapiens
RMKGFSLFL

SEQ ID NO: 1054668 - protein, 9 aa, Homo Sapiens
FAPSRMSMK

SEQ ID NO: 1054669 - protein, 9 aa, Homo Sapiens
NQSPTNSTG

SEQ ID NO: 1054670 - protein, 9 aa, Homo Sapiens
IGKELSTPV

SEQ ID NO: 1054671 - protein, 9 aa, Homo Sapiens
LRDVARLGV

SEQ ID NO: 1054672 - protein, 9 aa, Homo Sapiens
LFFIAISGQ

SEQ ID NO: 1054673 - protein, 9 aa, Homo Sapiens
EVGLFLGAS

SEQ ID NO: 1054674 - protein, 9 aa, Homo Sapiens
KEMKRGWEF

SEQ ID NO: 1054675 - protein, 9 aa, Homo Sapiens
VVAQGLSRP

SEQ ID NO: 1054676 - protein, 9 aa, Homo Sapiens
SRKKSYSVY

SEQ ID NO: 1054677 - protein, 9 aa, Homo Sapiens
EAPLSPTIK

SEQ ID NO: 1054678 - protein, 9 aa, Homo Sapiens
KEDGITWTL

SEQ ID NO: 1054679 - protein, 9 aa, Homo Sapiens
RRSGQMQSV

SEQ ID NO: 1054680 - protein, 9 aa, Homo Sapiens
PKKRFGIPM

SEQ ID NO: 1054681 - protein, 9 aa, Homo Sapiens
LLTFFSYLL

SEQ ID NO: 1054682 - protein, 9 aa, Homo Sapiens
QELWLRNNP

SEQ ID NO: 1054683 - protein, 9 aa, Homo Sapiens
GAELAARRR

SEQ ID NO: 1054684 - protein, 9 aa, Homo Sapiens
GEGAGFISG

SEQ ID NO: 1054685 - protein, 9 aa, Homo Sapiens
MQILGMSPQ

SEQ ID NO: 1054686 - protein, 9 aa, Homo Sapiens
IGGSGNGMI

SEQ ID NO: 1054687 - protein, 9 aa, Homo Sapiens
KKEPQKHSC

SEQ ID NO: 1054688 - protein, 9 aa, Homo Sapiens
SLMCEGQRL

SEQ ID NO: 1054689 - protein, 9 aa, Homo Sapiens
IQPGPRQTS

SEQ ID NO: 1054690 - protein, 9 aa, Homo Sapiens
KGVMLKNDD

SEQ ID NO: 1054691 - protein, 9 aa, Homo Sapiens
NKHIYKKRK

SEQ ID NO: 1054692 - protein, 9 aa, Homo Sapiens
VFSIFSALR

SEQ ID NO: 1054693 - protein, 9 aa, Homo Sapiens
SRKLLKPRS

SEQ ID NO: 1054694 - protein, 9 aa, Homo Sapiens
ELPDKFVVL

SEQ ID NO: 1054695 - protein, 9 aa, Homo Sapiens
DTTNSGEKS

SEQ ID NO: 1054696 - protein, 9 aa, Homo Sapiens
FPKPDMCVG

SEQ ID NO: 1054697 - protein, 9 aa, Homo Sapiens
VVAKPKHKQ

SEQ ID NO: 1054698 - protein, 9 aa, Homo Sapiens
EPALEFPTC

SEQ ID NO: 1054699 - protein, 9 aa, Homo Sapiens
SSSPRVPGL

SEQ ID NO: 1054700 - protein, 9 aa, Homo Sapiens
NFDIFYNVT

SEQ ID NO: 1054701 - protein, 9 aa, Homo Sapiens
RLVDVDGHL

SEQ ID NO: 1054702 - protein, 9 aa, Homo Sapiens
CAFSQPVRA

SEQ ID NO: 1054703 - protein, 9 aa, Homo Sapiens
HRSRGVGEA

SEQ ID NO: 1054704 - protein, 9 aa, Homo Sapiens
SRKFAKEVG

SEQ ID NO: 1054705 - protein, 9 aa, Homo Sapiens
RGNNEGFAM

SEQ ID NO: 1054706 - protein, 9 aa, Homo Sapiens
RTLYNAELS

SEQ ID NO: 1054707 - protein, 9 aa, Homo Sapiens
YTNTPVSAP

SEQ ID NO: 1054708 - protein, 9 aa, Homo Sapiens
TPLYLTAEP

SEQ ID NO: 1054709 - protein, 9 aa, Homo Sapiens
LCFSDLVFA

SEQ ID NO: 1054710 - protein, 9 aa, Homo Sapiens
DLCAQDNPI

SEQ ID NO: 1054711 - protein, 9 aa, Homo Sapiens
QQTHTGEKS

SEQ ID NO: 1054712 - protein, 9 aa, Homo Sapiens
DDIFAFLVQ

SEQ ID NO: 1054713 - protein, 9 aa, Homo Sapiens
QKLQDLQRE

SEQ ID NO: 1054714 - protein, 9 aa, Homo Sapiens
EHPSQGMKS

SEQ ID NO: 1054715 - protein, 9 aa, Homo Sapiens
NIPFPYNFY

SEQ ID NO: 1054716 - protein, 9 aa, Homo Sapiens
SRHSARLSP

SEQ ID NO: 1054717 - protein, 9 aa, Homo Sapiens
RNYWRGLFA

SEQ ID NO: 1054718 - protein, 9 aa, Homo Sapiens
RWVVSAAHF

SEQ ID NO: 1054719 - protein, 9 aa, Homo Sapiens
QVFLYSEKD

SEQ ID NO: 1054720 - protein, 9 aa, Homo Sapiens
LENVSYIKQ

SEQ ID NO: 1054721 - protein, 9 aa, Homo Sapiens
LLRGCKIRN

SEQ ID NO: 1054722 - protein, 9 aa, Homo Sapiens
CDFFQDITL

SEQ ID NO: 1054723 - protein, 9 aa, Homo Sapiens
LMAAGKFAR

SEQ ID NO: 1054724 - protein, 9 aa, Homo Sapiens
TDVSVIIKF

SEQ ID NO: 1054725 - protein, 9 aa, Homo Sapiens
NKNETLHNR

SEQ ID NO: 1054726 - protein, 9 aa, Homo Sapiens
EDETGPPFY

SEQ ID NO: 1054727 - protein, 9 aa, Homo Sapiens
VVENGLIIV

SEQ ID NO: 1054728 - protein, 9 aa, Homo Sapiens
ELKFRGSFT

SEQ ID NO: 1054729 - protein, 9 aa, Homo Sapiens
KKEPSVKAN

SEQ ID NO: 1054730 - protein, 9 aa, Homo Sapiens
FPVGTLLLD

SEQ ID NO: 1054731 - protein, 9 aa, Homo Sapiens
VASSLKNMD

SEQ ID NO: 1054732 - protein, 9 aa, Homo Sapiens
QPPSAFSLD

SEQ ID NO: 1054733 - protein, 9 aa, Homo Sapiens
HPIDYYWWL

SEQ ID NO: 1054734 - protein, 9 aa, Homo Sapiens
KDSITRRQR

SEQ ID NO: 1054735 - protein, 9 aa, Homo Sapiens
EFENVQVMT

SEQ ID NO: 1054736 - protein, 9 aa, Homo Sapiens
NFFSHFSSE

SEQ ID NO: 1054737 - protein, 9 aa, Homo Sapiens
SHGPCHSRS

SEQ ID NO: 1054738 - protein, 9 aa, Homo Sapiens
LEELLLRWV

SEQ ID NO: 1054739 - protein, 9 aa, Homo Sapiens
IGNGEVKGR

SEQ ID NO: 1054740 - protein, 9 aa, Homo Sapiens
DRANDCGAL

SEQ ID NO: 1054741 - protein, 9 aa, Homo Sapiens
YIVTKYMSK

SEQ ID NO: 1054742 - protein, 9 aa, Homo Sapiens
SSADSLSTS

SEQ ID NO: 1054743 - protein, 9 aa, Homo Sapiens
IEISTRACE

SEQ ID NO: 1054744 - protein, 9 aa, Homo Sapiens
SYQCHGLRQ

SEQ ID NO: 1054745 - protein, 9 aa, Homo Sapiens
PSNARGQRV

SEQ ID NO: 1054746 - protein, 9 aa, Homo Sapiens
TEELEETKS

SEQ ID NO: 1054747 - protein, 9 aa, Homo Sapiens
KLQELWLRN

SEQ ID NO: 1054748 - protein, 9 aa, Homo Sapiens
KTSTDLVQL

SEQ ID NO: 1054749 - protein, 9 aa, Homo Sapiens
TFMFEGHNT

SEQ ID NO: 1054750 - protein, 9 aa, Homo Sapiens
DKIRKMQAF

SEQ ID NO: 1054751 - protein, 9 aa, Homo Sapiens
INKDEKSST

SEQ ID NO: 1054752 - protein, 9 aa, Homo Sapiens
HAENKPIKN

SEQ ID NO: 1054753 - protein, 9 aa, Homo Sapiens
RSDSRKYPE

SEQ ID NO: 1054754 - protein, 9 aa, Homo Sapiens
PKPTPGAAK

SEQ ID NO: 1054755 - protein, 9 aa, Homo Sapiens
CCRTIVFCT

SEQ ID NO: 1054756 - protein, 9 aa, Homo Sapiens
EESRESDSS

SEQ ID NO: 1054757 - protein, 9 aa, Homo Sapiens
IYLIGRDLG

SEQ ID NO: 1054758 - protein, 9 aa, Homo Sapiens
AALSLLLPP

SEQ ID NO: 1054759 - protein, 9 aa, Homo Sapiens
EVVEDTYPE

SEQ ID NO: 1054760 - protein, 9 aa, Homo Sapiens
QAVTVFYFY

SEQ ID NO: 1054761 - protein, 9 aa, Homo Sapiens
LATLGEKMI

SEQ ID NO: 1054762 - protein, 9 aa, Homo Sapiens
EASFLVDEE

SEQ ID NO: 1054763 - protein, 9 aa, Homo Sapiens
ESIMTEDCL

SEQ ID NO: 1054764 - protein, 9 aa, Homo Sapiens
STYLNNSYV

SEQ ID NO: 1054765 - protein, 9 aa, Homo Sapiens
GYKLGIISG

SEQ ID NO: 1054766 - protein, 9 aa, Homo Sapiens
LSLAYNKIT

SEQ ID NO: 1054767 - protein, 9 aa, Homo Sapiens
ELFEMWNII

SEQ ID NO: 1054768 - protein, 9 aa, Homo Sapiens
QPRLFGARA

SEQ ID NO: 1054769 - protein, 9 aa, Homo Sapiens
GGAIKELSL

SEQ ID NO: 1054770 - protein, 9 aa, Homo Sapiens
YWVVSNRVS

SEQ ID NO: 1054771 - protein, 9 aa, Homo Sapiens
SSRTPSTFP

SEQ ID NO: 1054772 - protein, 9 aa, Homo Sapiens
HSRSDLKET

SEQ ID NO: 1054773 - protein, 9 aa, Homo Sapiens
RVPQHVPVR

SEQ ID NO: 1054774 - protein, 9 aa, Homo Sapiens
LCRANSWDG

SEQ ID NO: 1054775 - protein, 9 aa, Homo Sapiens
FAKEVGEKL

SEQ ID NO: 1054776 - protein, 9 aa, Homo Sapiens
DSKKKSCFE

SEQ ID NO: 1054777 - protein, 9 aa, Homo Sapiens
KYFPYLVFI

SEQ ID NO: 1054778 - protein, 9 aa, Homo Sapiens
KDDEEKKKK

SEQ ID NO: 1054779 - protein, 9 aa, Homo Sapiens
CWVCYREGQ

SEQ ID NO: 1054780 - protein, 9 aa, Homo Sapiens
SNVVPSPLV

SEQ ID NO: 1054781 - protein, 9 aa, Homo Sapiens
PVLYCFVSK

SEQ ID NO: 1054782 - protein, 9 aa, Homo Sapiens
ELCPYKDGA

SEQ ID NO: 1054783 - protein, 9 aa, Homo Sapiens
QPCGTCSGA

SEQ ID NO: 1054784 - protein, 9 aa, Homo Sapiens
QISTGKDKS

SEQ ID NO: 1054785 - protein, 9 aa, Homo Sapiens
FQAMQKNLI

SEQ ID NO: 1054786 - protein, 9 aa, Homo Sapiens
VPSYGPLDK

SEQ ID NO: 1054787 - protein, 9 aa, Homo Sapiens
WTNLTCCVH

SEQ ID NO: 1054788 - protein, 9 aa, Homo Sapiens
ELWQKDSFQ

SEQ ID NO: 1054789 - protein, 9 aa, Homo Sapiens
SPPDDVDYA

SEQ ID NO: 1054790 - protein, 9 aa, Homo Sapiens
HIMASVWKC

SEQ ID NO: 1054791 - protein, 9 aa, Homo Sapiens
RETHILCQV

SEQ ID NO: 1054792 - protein, 9 aa, Homo Sapiens
LTATLFAPP

SEQ ID NO: 1054793 - protein, 9 aa, Homo Sapiens
CPETRAQPS

SEQ ID NO: 1054794 - protein, 9 aa, Homo Sapiens
FNAEESSLQ

SEQ ID NO: 1054795 - protein, 9 aa, Homo Sapiens
ALHDRELLR

SEQ ID NO: 1054796 - protein, 9 aa, Homo Sapiens
PQCPRRWLP

SEQ ID NO: 1054797 - protein, 9 aa, Homo Sapiens
YFGTYFGLA

SEQ ID NO: 1054798 - protein, 9 aa, Homo Sapiens
GASSGSSAS

SEQ ID NO: 1054799 - protein, 9 aa, Homo Sapiens
GQAGRAAPE

SEQ ID NO: 1054800 - protein, 9 aa, Homo Sapiens
MSAASFLQT

SEQ ID NO: 1054801 - protein, 9 aa, Homo Sapiens
IAEKIHNTG

SEQ ID NO: 1054802 - protein, 9 aa, Homo Sapiens
LKNLAEELP

SEQ ID NO: 1054803 - protein, 9 aa, Homo Sapiens
AVRNYWRGL

SEQ ID NO: 1054804 - protein, 9 aa, Homo Sapiens
SQESQRRKE

SEQ ID NO: 1054805 - protein, 9 aa, Homo Sapiens
FSDLVFACL

SEQ ID NO: 1054806 - protein, 9 aa, Homo Sapiens
RGGYISKTN

SEQ ID NO: 1054807 - protein, 9 aa, Homo Sapiens
WLFPKRCPK

SEQ ID NO: 1054808 - protein, 9 aa, Homo Sapiens
SEEFLSYLP

SEQ ID NO: 1054809 - protein, 9 aa, Homo Sapiens
YLHKNFRVE

SEQ ID NO: 1054810 - protein, 9 aa, Homo Sapiens
LEVDVFLGT

SEQ ID NO: 1054811 - protein, 9 aa, Homo Sapiens
SLLSPKVRR

SEQ ID NO: 1054812 - protein, 9 aa, Homo Sapiens
MGGLEISLR

SEQ ID NO: 1054813 - protein, 9 aa, Homo Sapiens
GWVDPQTWL

SEQ ID NO: 1054814 - protein, 9 aa, Homo Sapiens
LPIFTLSQR

SEQ ID NO: 1054815 - protein, 9 aa, Homo Sapiens
VKVLIESGA

SEQ ID NO: 1054816 - protein, 9 aa, Homo Sapiens
LSLKSENDK

SEQ ID NO: 1054817 - protein, 9 aa, Homo Sapiens
DCTAIHEVM

SEQ ID NO: 1054818 - protein, 9 aa, Homo Sapiens
EFGNMEDTR

SEQ ID NO: 1054819 - protein, 9 aa, Homo Sapiens
EADQPITEP

SEQ ID NO: 1054820 - protein, 9 aa, Homo Sapiens
FAADIIFVL

SEQ ID NO: 1054821 - protein, 9 aa, Homo Sapiens
FSPQELEDV

SEQ ID NO: 1054822 - protein, 9 aa, Homo Sapiens
PGGAGERKK

SEQ ID NO: 1054823 - protein, 9 aa, Homo Sapiens
EKFSIELNQ

SEQ ID NO: 1054824 - protein, 9 aa, Homo Sapiens
ISRQVPGMC

SEQ ID NO: 1054825 - protein, 9 aa, Homo Sapiens
AIGNICCAQ

SEQ ID NO: 1054826 - protein, 9 aa, Homo Sapiens
SSNSSASGS

SEQ ID NO: 1054827 - protein, 9 aa, Homo Sapiens
FPKNGTFVV

SEQ ID NO: 1054828 - protein, 9 aa, Homo Sapiens
EVPKLPPPL

SEQ ID NO: 1054829 - protein, 9 aa, Homo Sapiens
PQKRPPALS

SEQ ID NO: 1054830 - protein, 9 aa, Homo Sapiens
DSVAASTER

SEQ ID NO: 1054831 - protein, 9 aa, Homo Sapiens
HPDVSANFH

SEQ ID NO: 1054832 - protein, 9 aa, Homo Sapiens
HLAVRSVDL

SEQ ID NO: 1054833 - protein, 9 aa, Homo Sapiens
TAEEKLCRL

SEQ ID NO: 1054834 - protein, 9 aa, Homo Sapiens
HCSAPENPI

SEQ ID NO: 1054835 - protein, 9 aa, Homo Sapiens
KGGRRRKKF

SEQ ID NO: 1054836 - protein, 9 aa, Homo Sapiens
LSGAIPGPR

SEQ ID NO: 1054837 - protein, 9 aa, Homo Sapiens
KTPPTPQPF

SEQ ID NO: 1054838 - protein, 9 aa, Homo Sapiens
EAWLENERS

SEQ ID NO: 1054839 - protein, 9 aa, Homo Sapiens
QPGYVLSKD

SEQ ID NO: 1054840 - protein, 9 aa, Homo Sapiens
EMSPLDMLE

SEQ ID NO: 1054841 - protein, 9 aa, Homo Sapiens
TVFSVDEFF

SEQ ID NO: 1054842 - protein, 9 aa, Homo Sapiens
VDMMEFFLL

SEQ ID NO: 1054843 - protein, 9 aa, Homo Sapiens
APQDTLLPT

SEQ ID NO: 1054844 - protein, 9 aa, Homo Sapiens
VLPGIYDIY

SEQ ID NO: 1054845 - protein, 9 aa, Homo Sapiens
PPRVLKIFG

SEQ ID NO: 1054846 - protein, 9 aa, Homo Sapiens
INFIQPGAF

SEQ ID NO: 1054847 - protein, 9 aa, Homo Sapiens
IASGVVSLL

SEQ ID NO: 1054848 - protein, 9 aa, Homo Sapiens
CGAHLIQHQ

SEQ ID NO: 1054849 - protein, 9 aa, Homo Sapiens
QAPFIFTSE

SEQ ID NO: 1054850 - protein, 9 aa, Homo Sapiens
KEMYDHQGR

SEQ ID NO: 1054851 - protein, 9 aa, Homo Sapiens
LFVFYTVCT

SEQ ID NO: 1054852 - protein, 9 aa, Homo Sapiens
GKEERKTSG

SEQ ID NO: 1054853 - protein, 9 aa, Homo Sapiens
GADIPWDIS

SEQ ID NO: 1054854 - protein, 9 aa, Homo Sapiens
LFSSSLAGP

SEQ ID NO: 1054855 - protein, 9 aa, Homo Sapiens
GLEIPDEVK

SEQ ID NO: 1054856 - protein, 9 aa, Homo Sapiens
THQSLAGEI

SEQ ID NO: 1054857 - protein, 9 aa, Homo Sapiens
ASLSLLQTQ

SEQ ID NO: 1054858 - protein, 9 aa, Homo Sapiens
GLVNDIKKK

SEQ ID NO: 1054859 - protein, 9 aa, Homo Sapiens
PLLVSVTSN

SEQ ID NO: 1054860 - protein, 9 aa, Homo Sapiens
TSWGGEKRG

SEQ ID NO: 1054861 - protein, 9 aa, Homo Sapiens
CDTPKEDGI

SEQ ID NO: 1054862 - protein, 9 aa, Homo Sapiens
TWEAMETCK

SEQ ID NO: 1054863 - protein, 9 aa, Homo Sapiens
LNICINGEC

SEQ ID NO: 1054864 - protein, 9 aa, Homo Sapiens
LAIERMIIK

SEQ ID NO: 1054865 - protein, 9 aa, Homo Sapiens
MDYNKVFTP

SEQ ID NO: 1054866 - protein, 9 aa, Homo Sapiens
MIECWNEFS

SEQ ID NO: 1054867 - protein, 9 aa, Homo Sapiens
ARNQAGEIQ

SEQ ID NO: 1054868 - protein, 9 aa, Homo Sapiens
SVNLTYSAN

SEQ ID NO: 1054869 - protein, 9 aa, Homo Sapiens
LQVQNSTLS

SEQ ID NO: 1054870 - protein, 9 aa, Homo Sapiens
GGLDEPGVV

SEQ ID NO: 1054871 - protein, 9 aa, Homo Sapiens
VSWRTVFSS

SEQ ID NO: 1054872 - protein, 9 aa, Homo Sapiens
WYKDDEEKK

SEQ ID NO: 1054873 - protein, 9 aa, Homo Sapiens
AEDGQVKEE

SEQ ID NO: 1054874 - protein, 9 aa, Homo Sapiens
AQLSGPGNN

SEQ ID NO: 1054875 - protein, 9 aa, Homo Sapiens
NFPKPDMCV

SEQ ID NO: 1054876 - protein, 9 aa, Homo Sapiens
KLTGICPQN

SEQ ID NO: 1054877 - protein, 9 aa, Homo Sapiens
HKFFQRCGH

SEQ ID NO: 1054878 - protein, 9 aa, Homo Sapiens
LTDWLFPKR

SEQ ID NO: 1054879 - protein, 9 aa, Homo Sapiens
DRLDCGRPR

SEQ ID NO: 1054880 - protein, 9 aa, Homo Sapiens
KDCQVSEWS

SEQ ID NO: 1054881 - protein, 9 aa, Homo Sapiens
DTLLPTVLT

SEQ ID NO: 1054882 - protein, 9 aa, Homo Sapiens
NYENCEKAY

SEQ ID NO: 1054883 - protein, 9 aa, Homo Sapiens
NIAELRFET

SEQ ID NO: 1054884 - protein, 9 aa, Homo Sapiens
YVSDNIQIE

SEQ ID NO: 1054885 - protein, 9 aa, Homo Sapiens
GGGYYEEYQ

SEQ ID NO: 1054886 - protein, 9 aa, Homo Sapiens
LALFVNLLL

SEQ ID NO: 1054887 - protein, 9 aa, Homo Sapiens
VLEKAEFLR

SEQ ID NO: 1054888 - protein, 9 aa, Homo Sapiens
KRWPQPVFL

SEQ ID NO: 1054889 - protein, 9 aa, Homo Sapiens
APRAVFSSI

SEQ ID NO: 1054890 - protein, 9 aa, Homo Sapiens
LNYRDAERD

SEQ ID NO: 1054891 - protein, 9 aa, Homo Sapiens
PLSPEKEEE

SEQ ID NO: 1054892 - protein, 9 aa, Homo Sapiens
DRCFARHCV

SEQ ID NO: 1054893 - protein, 9 aa, Homo Sapiens
RNYGLTDKE

SEQ ID NO: 1054894 - protein, 9 aa, Homo Sapiens
IFRTEGPIA

SEQ ID NO: 1054895 - protein, 9 aa, Homo Sapiens
EEDKKNYPS

SEQ ID NO: 1054896 - protein, 9 aa, Homo Sapiens
SENEDEFRN

SEQ ID NO: 1054897 - protein, 9 aa, Homo Sapiens
ASSLKNMDM

SEQ ID NO: 1054898 - protein, 9 aa, Homo Sapiens
PEEDKKKEF

SEQ ID NO: 1054899 - protein, 9 aa, Homo Sapiens
IMEYFVQKA

SEQ ID NO: 1054900 - protein, 9 aa, Homo Sapiens
CQWFVYQAA

SEQ ID NO: 1054901 - protein, 9 aa, Homo Sapiens
KTFYPEKIS

SEQ ID NO: 1054902 - protein, 9 aa, Homo Sapiens
YTGWFSVFY

SEQ ID NO: 1054903 - protein, 9 aa, Homo Sapiens
LAHFSPLVF

SEQ ID NO: 1054904 - protein, 9 aa, Homo Sapiens
LISVIIFVS

SEQ ID NO: 1054905 - protein, 9 aa, Homo Sapiens
TGCEIQSFF

SEQ ID NO: 1054906 - protein, 9 aa, Homo Sapiens
PSGLGGPRP

SEQ ID NO: 1054907 - protein, 9 aa, Homo Sapiens
DTYLLHMKK

SEQ ID NO: 1054908 - protein, 9 aa, Homo Sapiens
FNDASPTYS

SEQ ID NO: 1054909 - protein, 9 aa, Homo Sapiens
LNKAAWTSA

SEQ ID NO: 1054910 - protein, 9 aa, Homo Sapiens
EFLWSLLGS

SEQ ID NO: 1054911 - protein, 9 aa, Homo Sapiens
VKGISEQEE

SEQ ID NO: 1054912 - protein, 9 aa, Homo Sapiens
DWIIAMKDE

SEQ ID NO: 1054913 - protein, 9 aa, Homo Sapiens
RPLGPSSCM

SEQ ID NO: 1054914 - protein, 9 aa, Homo Sapiens
TMVSNLVSQ

SEQ ID NO: 1054915 - protein, 9 aa, Homo Sapiens
LLFSLTLVR

SEQ ID NO: 1054916 - protein, 9 aa, Homo Sapiens
SPEGTSGHS

SEQ ID NO: 1054917 - protein, 9 aa, Homo Sapiens
NSYSYYPYL

SEQ ID NO: 1054918 - protein, 9 aa, Homo Sapiens
VMEYMETGT

SEQ ID NO: 1054919 - protein, 9 aa, Homo Sapiens
KNSTRWSTT

SEQ ID NO: 1054920 - protein, 9 aa, Homo Sapiens
YTREKPYKC

SEQ ID NO: 1054921 - protein, 9 aa, Homo Sapiens
SFTFQAILL

SEQ ID NO: 1054922 - protein, 9 aa, Homo Sapiens
PASASLSLQ

SEQ ID NO: 1054923 - protein, 9 aa, Homo Sapiens
PGRYSPILK

SEQ ID NO: 1054924 - protein, 9 aa, Homo Sapiens
AKTYGRNKI

SEQ ID NO: 1054925 - protein, 9 aa, Homo Sapiens
WAAEAKERE

SEQ ID NO: 1054926 - protein, 9 aa, Homo Sapiens
SVFLNNKKN

SEQ ID NO: 1054927 - protein, 9 aa, Homo Sapiens
LVKRLEKQR

SEQ ID NO: 1054928 - protein, 9 aa, Homo Sapiens
DLFSTIKEE

SEQ ID NO: 1054929 - protein, 9 aa, Homo Sapiens
LWSSCIART

SEQ ID NO: 1054930 - protein, 9 aa, Homo Sapiens
LICQKLDKS

SEQ ID NO: 1054931 - protein, 9 aa, Homo Sapiens
SVLSILQSV

SEQ ID NO: 1054932 - protein, 9 aa, Homo Sapiens
TSGEQEGLQ

SEQ ID NO: 1054933 - protein, 9 aa, Homo Sapiens
TTFSRVDDH

SEQ ID NO: 1054934 - protein, 9 aa, Homo Sapiens
TAYSNVTMV

SEQ ID NO: 1054935 - protein, 9 aa, Homo Sapiens
YPFSLSHSV

SEQ ID NO: 1054936 - protein, 9 aa, Homo Sapiens
RRHHQFFEP

SEQ ID NO: 1054937 - protein, 9 aa, Homo Sapiens
LYADREILK

SEQ ID NO: 1054938 - protein, 9 aa, Homo Sapiens
PEMESFGSL

SEQ ID NO: 1054939 - protein, 9 aa, Homo Sapiens
SLRNVLVVF

SEQ ID NO: 1054940 - protein, 9 aa, Homo Sapiens
DLEEISVTV

SEQ ID NO: 1054941 - protein, 9 aa, Homo Sapiens
VNWREKGYV

SEQ ID NO: 1054942 - protein, 9 aa, Homo Sapiens
SLNLGNICV

SEQ ID NO: 1054943 - protein, 9 aa, Homo Sapiens
LHFWRKICC

SEQ ID NO: 1054944 - protein, 9 aa, Homo Sapiens
KEVGHLSFN

SEQ ID NO: 1054945 - protein, 9 aa, Homo Sapiens
LKRALHNAK

SEQ ID NO: 1054946 - protein, 9 aa, Homo Sapiens
VDNMEDLPA

SEQ ID NO: 1054947 - protein, 9 aa, Homo Sapiens
FVCPSRESL

SEQ ID NO: 1054948 - protein, 9 aa, Homo Sapiens
GDQDAGACK

SEQ ID NO: 1054949 - protein, 9 aa, Homo Sapiens
ENRGLASRI

SEQ ID NO: 1054950 - protein, 9 aa, Homo Sapiens
KPPMVVDNL

SEQ ID NO: 1054951 - protein, 9 aa, Homo Sapiens
STTTSAFVE

SEQ ID NO: 1054952 - protein, 9 aa, Homo Sapiens
PPGPPGSGS

SEQ ID NO: 1054953 - protein, 9 aa, Homo Sapiens
KPGDYEVSI

SEQ ID NO: 1054954 - protein, 9 aa, Homo Sapiens
RCTDCLCPD

SEQ ID NO: 1054955 - protein, 9 aa, Homo Sapiens
GKGKGKKKR

SEQ ID NO: 1054956 - protein, 9 aa, Homo Sapiens
KEFEECLEK

SEQ ID NO: 1054957 - protein, 9 aa, Homo Sapiens
KPICLTHLS

SEQ ID NO: 1054958 - protein, 9 aa, Homo Sapiens
QVFHALRKK

SEQ ID NO: 1054959 - protein, 9 aa, Homo Sapiens
SCNKFLDDD

SEQ ID NO: 1054960 - protein, 9 aa, Homo Sapiens
QKVLFRFCV

SEQ ID NO: 1054961 - protein, 9 aa, Homo Sapiens
LLGVSFQGG

SEQ ID NO: 1054962 - protein, 9 aa, Homo Sapiens
IFFTWDIND

SEQ ID NO: 1054963 - protein, 9 aa, Homo Sapiens
FAAQARPSL

SEQ ID NO: 1054964 - protein, 9 aa, Homo Sapiens
GKELSTPVT

SEQ ID NO: 1054965 - protein, 9 aa, Homo Sapiens
GRLCSSVCT

SEQ ID NO: 1054966 - protein, 9 aa, Homo Sapiens
LERVILYPT

SEQ ID NO: 1054967 - protein, 9 aa, Homo Sapiens
EDQLEYQKE

SEQ ID NO: 1054968 - protein, 9 aa, Homo Sapiens
LSDFFYPKR

SEQ ID NO: 1054969 - protein, 9 aa, Homo Sapiens
QMFFGLAMG

SEQ ID NO: 1054970 - protein, 9 aa, Homo Sapiens
VSANFHSLD

SEQ ID NO: 1054971 - protein, 9 aa, Homo Sapiens
QVTPDKDDH

SEQ ID NO: 1054972 - protein, 9 aa, Homo Sapiens
FDRIINESY

SEQ ID NO: 1054973 - protein, 9 aa, Homo Sapiens
RILIDKSEK

SEQ ID NO: 1054974 - protein, 9 aa, Homo Sapiens
DDKNDSLRY

SEQ ID NO: 1054975 - protein, 9 aa, Homo Sapiens
ITYSEKRPY

SEQ ID NO: 1054976 - protein, 9 aa, Homo Sapiens
CVNSLKEDY

SEQ ID NO: 1054977 - protein, 9 aa, Homo Sapiens
TRKGPPVSP

SEQ ID NO: 1054978 - protein, 9 aa, Homo Sapiens
KWEYCNLTQ

SEQ ID NO: 1054979 - protein, 9 aa, Homo Sapiens
DNPAKVQNY

SEQ ID NO: 1054980 - protein, 9 aa, Homo Sapiens
ANEKTTPSS

SEQ ID NO: 1054981 - protein, 9 aa, Homo Sapiens
AYRDVPRPI

SEQ ID NO: 1054982 - protein, 9 aa, Homo Sapiens
PGNLGMKGE

SEQ ID NO: 1054983 - protein, 9 aa, Homo Sapiens
HEQTEEMDF

SEQ ID NO: 1054984 - protein, 9 aa, Homo Sapiens
FLGEDCIYP

SEQ ID NO: 1054985 - protein, 9 aa, Homo Sapiens
LLTKSGTLL

SEQ ID NO: 1054986 - protein, 9 aa, Homo Sapiens
WNLQKTVSA

SEQ ID NO: 1054987 - protein, 9 aa, Homo Sapiens
GNGPLSSDI

SEQ ID NO: 1054988 - protein, 9 aa, Homo Sapiens
TSNGVADEL

SEQ ID NO: 1054989 - protein, 9 aa, Homo Sapiens
APGNYDVNI

SEQ ID NO: 1054990 - protein, 9 aa, Homo Sapiens
CVSGIPADV

SEQ ID NO: 1054991 - protein, 9 aa, Homo Sapiens
LNGKFANFI

SEQ ID NO: 1054992 - protein, 9 aa, Homo Sapiens
VSTTPPGLP

SEQ ID NO: 1054993 - protein, 9 aa, Homo Sapiens
TSLKLILST

SEQ ID NO: 1054994 - protein, 9 aa, Homo Sapiens
DSDINQLYH

SEQ ID NO: 1054995 - protein, 9 aa, Homo Sapiens
KPSTASSVP

SEQ ID NO: 1054996 - protein, 9 aa, Homo Sapiens
PPNYHTPLY

SEQ ID NO: 1054997 - protein, 9 aa, Homo Sapiens
NTLIMTSKT

SEQ ID NO: 1054998 - protein, 9 aa, Homo Sapiens
NGFYFLAGE

SEQ ID NO: 1054999 - protein, 9 aa, Homo Sapiens
PLIKLQRRL

SEQ ID NO: 1055000 - protein, 9 aa, Homo Sapiens
MVYFKQHMQ

SEQ ID NO: 1055001 - protein, 9 aa, Homo Sapiens
ILDLLNEEC

SEQ ID NO: 1055002 - protein, 9 aa, Homo Sapiens
GSQCSLEKS

SEQ ID NO: 1055003 - protein, 9 aa, Homo Sapiens
WVYILDNDT

SEQ ID NO: 1055004 - protein, 9 aa, Homo Sapiens
SKGIIYRDF

SEQ ID NO: 1055005 - protein, 9 aa, Homo Sapiens
VTTHMCCPS

SEQ ID NO: 1055006 - protein, 9 aa, Homo Sapiens
SQIDRNMKD

SEQ ID NO: 1055007 - protein, 9 aa, Homo Sapiens
EQVYKGRHV

SEQ ID NO: 1055008 - protein, 9 aa, Homo Sapiens
SRKYPELVL

SEQ ID NO: 1055009 - protein, 9 aa, Homo Sapiens
QTRTLLDDK

SEQ ID NO: 1055010 - protein, 9 aa, Homo Sapiens
VDSPRNFNI

SEQ ID NO: 1055011 - protein, 9 aa, Homo Sapiens
IRAALEAHC

SEQ ID NO: 1055012 - protein, 9 aa, Homo Sapiens
NDLVYFENF

SEQ ID NO: 1055013 - protein, 9 aa, Homo Sapiens
EKLYQCKEC

SEQ ID NO: 1055014 - protein, 9 aa, Homo Sapiens
SICTNALGF

SEQ ID NO: 1055015 - protein, 9 aa, Homo Sapiens
LFKLDGGLN

SEQ ID NO: 1055016 - protein, 9 aa, Homo Sapiens
HSARLSPEV

SEQ ID NO: 1055017 - protein, 9 aa, Homo Sapiens
LPVAQYIRA

SEQ ID NO: 1055018 - protein, 9 aa, Homo Sapiens
NILNANLLL

SEQ ID NO: 1055019 - protein, 9 aa, Homo Sapiens
IAIEGGHAP

SEQ ID NO: 1055020 - protein, 9 aa, Homo Sapiens
VYCTSSACK

SEQ ID NO: 1055021 - protein, 9 aa, Homo Sapiens
VEGKTCQIL

SEQ ID NO: 1055022 - protein, 9 aa, Homo Sapiens
NQLYHIMMC

SEQ ID NO: 1055023 - protein, 9 aa, Homo Sapiens
SSLGPLTDN

SEQ ID NO: 1055024 - protein, 9 aa, Homo Sapiens
TYLNKRKGI

SEQ ID NO: 1055025 - protein, 9 aa, Homo Sapiens
RIINSKTEQ

SEQ ID NO: 1055026 - protein, 9 aa, Homo Sapiens
FLGSVQICV

SEQ ID NO: 1055027 - protein, 9 aa, Homo Sapiens
VKKEPSVKA

SEQ ID NO: 1055028 - protein, 9 aa, Homo Sapiens
YSTYSRKFA

SEQ ID NO: 1055029 - protein, 9 aa, Homo Sapiens
HQVPDAGTG

SEQ ID NO: 1055030 - protein, 9 aa, Homo Sapiens
WEPPRKEQS

SEQ ID NO: 1055031 - protein, 9 aa, Homo Sapiens
AFLSGGRGE

SEQ ID NO: 1055032 - protein, 9 aa, Homo Sapiens
DLCGPSIPC

SEQ ID NO: 1055033 - protein, 9 aa, Homo Sapiens
LSRREDKTR

SEQ ID NO: 1055034 - protein, 9 aa, Homo Sapiens
FDNNGTATP

SEQ ID NO: 1055035 - protein, 9 aa, Homo Sapiens
VPHSLEILY

SEQ ID NO: 1055036 - protein, 9 aa, Homo Sapiens
APTESTEER

SEQ ID NO: 1055037 - protein, 9 aa, Homo Sapiens
TSGDKIITG

SEQ ID NO: 1055038 - protein, 9 aa, Homo Sapiens
TPCLTPSTA

SEQ ID NO: 1055039 - protein, 9 aa, Homo Sapiens
FFWEKSSFQ

SEQ ID NO: 1055040 - protein, 9 aa, Homo Sapiens
RNLVSVTRV

SEQ ID NO: 1055041 - protein, 9 aa, Homo Sapiens
HHQFFEPAP

SEQ ID NO: 1055042 - protein, 9 aa, Homo Sapiens
SAFFDCYDP

SEQ ID NO: 1055043 - protein, 9 aa, Homo Sapiens
NCCNKHLHM

SEQ ID NO: 1055044 - protein, 9 aa, Homo Sapiens
NKGVALLNT

SEQ ID NO: 1055045 - protein, 9 aa, Homo Sapiens
RHSQVGQKQ

SEQ ID NO: 1055046 - protein, 9 aa, Homo Sapiens
SLRQRFNRW

SEQ ID NO: 1055047 - protein, 9 aa, Homo Sapiens
VIGLDKILK

SEQ ID NO: 1055048 - protein, 9 aa, Homo Sapiens
SEGQFDSFV

SEQ ID NO: 1055049 - protein, 9 aa, Homo Sapiens
KSVQSSCSS

SEQ ID NO: 1055050 - protein, 9 aa, Homo Sapiens
CHAFCYTCR

SEQ ID NO: 1055051 - protein, 9 aa, Homo Sapiens
LSPGTKAVS

SEQ ID NO: 1055052 - protein, 9 aa, Homo Sapiens
SISFTGCEI

SEQ ID NO: 1055053 - protein, 9 aa, Homo Sapiens
QCLMPHLAQ

SEQ ID NO: 1055054 - protein, 9 aa, Homo Sapiens
PRQKIVSIE

SEQ ID NO: 1055055 - protein, 9 aa, Homo Sapiens
MTSELGDSL

SEQ ID NO: 1055056 - protein, 9 aa, Homo Sapiens
ETLENDIPE

SEQ ID NO: 1055057 - protein, 9 aa, Homo Sapiens
KVVSAHGLN

SEQ ID NO: 1055058 - protein, 9 aa, Homo Sapiens
QRGAMGKTA

SEQ ID NO: 1055059 - protein, 9 aa, Homo Sapiens
IEGNSEKAL

SEQ ID NO: 1055060 - protein, 9 aa, Homo Sapiens
IKKKGNPED

SEQ ID NO: 1055061 - protein, 9 aa, Homo Sapiens
IIYSDCWLA

SEQ ID NO: 1055062 - protein, 9 aa, Homo Sapiens
YNSVFFLYA

SEQ ID NO: 1055063 - protein, 9 aa, Homo Sapiens
NSHYGQSER

SEQ ID NO: 1055064 - protein, 9 aa, Homo Sapiens
LDGTDCHRK

SEQ ID NO: 1055065 - protein, 9 aa, Homo Sapiens
GAPAWQPTS

SEQ ID NO: 1055066 - protein, 9 aa, Homo Sapiens
TPKFKRKSI

SEQ ID NO: 1055067 - protein, 9 aa, Homo Sapiens
RLSPEVPGQ

SEQ ID NO: 1055068 - protein, 9 aa, Homo Sapiens
KKLFKCKKC

SEQ ID NO: 1055069 - protein, 9 aa, Homo Sapiens
RVLGVKNLR

SEQ ID NO: 1055070 - protein, 9 aa, Homo Sapiens
FHKNLSPGK

SEQ ID NO: 1055071 - protein, 9 aa, Homo Sapiens
QENKNETLH

SEQ ID NO: 1055072 - protein, 9 aa, Homo Sapiens
QFQRTPRGI

SEQ ID NO: 1055073 - protein, 9 aa, Homo Sapiens
FLKYFGTYF

SEQ ID NO: 1055074 - protein, 9 aa, Homo Sapiens
QKGINFVKR

SEQ ID NO: 1055075 - protein, 9 aa, Homo Sapiens
FFVQEKIPK

SEQ ID NO: 1055076 - protein, 9 aa, Homo Sapiens
LKKEKNLTK

SEQ ID NO: 1055077 - protein, 9 aa, Homo Sapiens
QGMKSTYLD

SEQ ID NO: 1055078 - protein, 9 aa, Homo Sapiens
AFWFNPFSL

SEQ ID NO: 1055079 - protein, 9 aa, Homo Sapiens
SQCVFARTL

SEQ ID NO: 1055080 - protein, 9 aa, Homo Sapiens
PEEITKEPS

SEQ ID NO: 1055081 - protein, 9 aa, Homo Sapiens
YFLSNLFFL

SEQ ID NO: 1055082 - protein, 9 aa, Homo Sapiens
SVCTGKKRY

SEQ ID NO: 1055083 - protein, 9 aa, Homo Sapiens
EAPFGLDLL

SEQ ID NO: 1055084 - protein, 9 aa, Homo Sapiens
EVLEQRYRL

SEQ ID NO: 1055085 - protein, 9 aa, Homo Sapiens
PRTSSPNRV

SEQ ID NO: 1055086 - protein, 9 aa, Homo Sapiens
KDTRLAELL

SEQ ID NO: 1055087 - protein, 9 aa, Homo Sapiens
KEIVCKDGQ

SEQ ID NO: 1055088 - protein, 9 aa, Homo Sapiens
VAIFLKDDY

SEQ ID NO: 1055089 - protein, 9 aa, Homo Sapiens
NISDGAKNL

SEQ ID NO: 1055090 - protein, 9 aa, Homo Sapiens
EPIYIVTKY

SEQ ID NO: 1055091 - protein, 9 aa, Homo Sapiens
AQGFPSSSP

SEQ ID NO: 1055092 - protein, 9 aa, Homo Sapiens
MYVVTVVEN

SEQ ID NO: 1055093 - protein, 9 aa, Homo Sapiens
AANSRFGLL

SEQ ID NO: 1055094 - protein, 9 aa, Homo Sapiens
SLLIHSGGN

SEQ ID NO: 1055095 - protein, 9 aa, Homo Sapiens
QIVANFFLA

SEQ ID NO: 1055096 - protein, 9 aa, Homo Sapiens
LQLEVEEAV

SEQ ID NO: 1055097 - protein, 9 aa, Homo Sapiens
FVSVIYKKF

SEQ ID NO: 1055098 - protein, 9 aa, Homo Sapiens
GRHGSNFGH

SEQ ID NO: 1055099 - protein, 9 aa, Homo Sapiens
INSFISNIS

SEQ ID NO: 1055100 - protein, 9 aa, Homo Sapiens
TGEELLEGR

SEQ ID NO: 1055101 - protein, 9 aa, Homo Sapiens
KHMNKTSHT

SEQ ID NO: 1055102 - protein, 9 aa, Homo Sapiens
WQQHQGLLS

SEQ ID NO: 1055103 - protein, 9 aa, Homo Sapiens
EILLWEIFT

SEQ ID NO: 1055104 - protein, 9 aa, Homo Sapiens
TLKNAEVKI

SEQ ID NO: 1055105 - protein, 9 aa, Homo Sapiens
EACTLTAHK

SEQ ID NO: 1055106 - protein, 9 aa, Homo Sapiens
RRCKYSHFM

SEQ ID NO: 1055107 - protein, 9 aa, Homo Sapiens
IIIITTKVM

SEQ ID NO: 1055108 - protein, 9 aa, Homo Sapiens
TLNISHNLH

SEQ ID NO: 1055109 - protein, 9 aa, Homo Sapiens
SSDIDDVST

SEQ ID NO: 1055110 - protein, 9 aa, Homo Sapiens
KTLIVDGEQ

SEQ ID NO: 1055111 - protein, 9 aa, Homo Sapiens
SHVEKVFMA

SEQ ID NO: 1055112 - protein, 9 aa, Homo Sapiens
EELMKLSLE

SEQ ID NO: 1055113 - protein, 9 aa, Homo Sapiens
KLDGGLNIE

SEQ ID NO: 1055114 - protein, 9 aa, Homo Sapiens
HVSPNASDS

SEQ ID NO: 1055115 - protein, 9 aa, Homo Sapiens
SNFLDGLGP

SEQ ID NO: 1055116 - protein, 9 aa, Homo Sapiens
PQPTPQMAE

SEQ ID NO: 1055117 - protein, 9 aa, Homo Sapiens
KNYKILEKF

SEQ ID NO: 1055118 - protein, 9 aa, Homo Sapiens
GGTGFFLGI

SEQ ID NO: 1055119 - protein, 9 aa, Homo Sapiens
KDFEGSKLK

SEQ ID NO: 1055120 - protein, 9 aa, Homo Sapiens
KNEDCFGMW

SEQ ID NO: 1055121 - protein, 9 aa, Homo Sapiens
ESTTIELVT

SEQ ID NO: 1055122 - protein, 9 aa, Homo Sapiens
NYFTVAQNK

SEQ ID NO: 1055123 - protein, 9 aa, Homo Sapiens
LATKGCENV

SEQ ID NO: 1055124 - protein, 9 aa, Homo Sapiens
EHFPYGPSP

SEQ ID NO: 1055125 - protein, 9 aa, Homo Sapiens
RGDNEEWNE

SEQ ID NO: 1055126 - protein, 9 aa, Homo Sapiens
FQKNPKKSR

SEQ ID NO: 1055127 - protein, 9 aa, Homo Sapiens
AISPPQCPR

SEQ ID NO: 1055128 - protein, 9 aa, Homo Sapiens
RPDCWAGSA

SEQ ID NO: 1055129 - protein, 9 aa, Homo Sapiens
DLEYYIINK

SEQ ID NO: 1055130 - protein, 9 aa, Homo Sapiens
YGSDEHNVC

SEQ ID NO: 1055131 - protein, 9 aa, Homo Sapiens
LYFLKHLNK

SEQ ID NO: 1055132 - protein, 9 aa, Homo Sapiens
AWEALLSFV

SEQ ID NO: 1055133 - protein, 9 aa, Homo Sapiens
TCNNSSKNK

SEQ ID NO: 1055134 - protein, 9 aa, Homo Sapiens
SFLKSVEHV

SEQ ID NO: 1055135 - protein, 9 aa, Homo Sapiens
FLHDSVYFP

SEQ ID NO: 1055136 - protein, 9 aa, Homo Sapiens
IPRPSSRSA

SEQ ID NO: 1055137 - protein, 9 aa, Homo Sapiens
ADQPITEPG

SEQ ID NO: 1055138 - protein, 9 aa, Homo Sapiens
KLRKKIRSF

SEQ ID NO: 1055139 - protein, 9 aa, Homo Sapiens
LQRAVFGQL

SEQ ID NO: 1055140 - protein, 9 aa, Homo Sapiens
PGKPQRPPP

SEQ ID NO: 1055141 - protein, 9 aa, Homo Sapiens
VPQSMAFAL

SEQ ID NO: 1055142 - protein, 9 aa, Homo Sapiens
TYDKEGGGE

SEQ ID NO: 1055143 - protein, 9 aa, Homo Sapiens
ELSSIKNFL

SEQ ID NO: 1055144 - protein, 9 aa, Homo Sapiens
AASFGFFHL

SEQ ID NO: 1055145 - protein, 9 aa, Homo Sapiens
PIFKSKTDL

SEQ ID NO: 1055146 - protein, 9 aa, Homo Sapiens
QACLLVLSL

SEQ ID NO: 1055147 - protein, 9 aa, Homo Sapiens
VSPNSSLFG

SEQ ID NO: 1055148 - protein, 9 aa, Homo Sapiens
SPICLVQRM

SEQ ID NO: 1055149 - protein, 9 aa, Homo Sapiens
LCQVAGHPH

SEQ ID NO: 1055150 - protein, 9 aa, Homo Sapiens
WKFQRTPGD

SEQ ID NO: 1055151 - protein, 9 aa, Homo Sapiens
NFRDPAKNI

SEQ ID NO: 1055152 - protein, 9 aa, Homo Sapiens
QLRQMHTAN

SEQ ID NO: 1055153 - protein, 9 aa, Homo Sapiens
IDSESALVL

SEQ ID NO: 1055154 - protein, 9 aa, Homo Sapiens
EIVKRKDLE

SEQ ID NO: 1055155 - protein, 9 aa, Homo Sapiens
RPPALSGTQ

SEQ ID NO: 1055156 - protein, 9 aa, Homo Sapiens
PNRVTRDNP

SEQ ID NO: 1055157 - protein, 9 aa, Homo Sapiens
DGVCSGCQG

SEQ ID NO: 1055158 - protein, 9 aa, Homo Sapiens
DPLLVSVTR

SEQ ID NO: 1055159 - protein, 9 aa, Homo Sapiens
DPLLVSVTS

SEQ ID NO: 1055160 - protein, 9 aa, Homo Sapiens
RYFSRSNSQ

SEQ ID NO: 1055161 - protein, 9 aa, Homo Sapiens
TLEGGLVAT

SEQ ID NO: 1055162 - protein, 9 aa, Homo Sapiens
KLHHDMPLQ

SEQ ID NO: 1055163 - protein, 9 aa, Homo Sapiens
DPRQKEELD

SEQ ID NO: 1055164 - protein, 9 aa, Homo Sapiens
FAHKLHPQE

SEQ ID NO: 1055165 - protein, 9 aa, Homo Sapiens
EFSSRRPRF

SEQ ID NO: 1055166 - protein, 9 aa, Homo Sapiens
LAVRLKTPT

SEQ ID NO: 1055167 - protein, 9 aa, Homo Sapiens
IFYAKTFKE

SEQ ID NO: 1055168 - protein, 9 aa, Homo Sapiens
PRVPWFISP

SEQ ID NO: 1055169 - protein, 9 aa, Homo Sapiens
VNFTPQNDI

SEQ ID NO: 1055170 - protein, 9 aa, Homo Sapiens
SDTRSTVSF

SEQ ID NO: 1055171 - protein, 9 aa, Homo Sapiens
VCGNEILES

SEQ ID NO: 1055172 - protein, 9 aa, Homo Sapiens
MAPSIKSKK

SEQ ID NO: 1055173 - protein, 9 aa, Homo Sapiens
FSVQPPSAD

SEQ ID NO: 1055174 - protein, 9 aa, Homo Sapiens
ERKTEATRG

SEQ ID NO: 1055175 - protein, 9 aa, Homo Sapiens
RGAMGKTAL

SEQ ID NO: 1055176 - protein, 9 aa, Homo Sapiens
RELFYNQKE

SEQ ID NO: 1055177 - protein, 9 aa, Homo Sapiens
TTMNYSLWS

SEQ ID NO: 1055178 - protein, 9 aa, Homo Sapiens
AVPSLIPVQ

SEQ ID NO: 1055179 - protein, 9 aa, Homo Sapiens
IVDLTEIIL

SEQ ID NO: 1055180 - protein, 9 aa, Homo Sapiens
HSPVFFDNE

SEQ ID NO: 1055181 - protein, 9 aa, Homo Sapiens
TQPRLGEEF

SEQ ID NO: 1055182 - protein, 9 aa, Homo Sapiens
LSLRDEPRS

SEQ ID NO: 1055183 - protein, 9 aa, Homo Sapiens
HNNRPASNV

SEQ ID NO: 1055184 - protein, 9 aa, Homo Sapiens
APAWQPTSA

SEQ ID NO: 1055185 - protein, 9 aa, Homo Sapiens
PLGIFYIED

SEQ ID NO: 1055186 - protein, 9 aa, Homo Sapiens
PTTEPSVNL

SEQ ID NO: 1055187 - protein, 9 aa, Homo Sapiens
PHPIWGKDK

SEQ ID NO: 1055188 - protein, 9 aa, Homo Sapiens
SYKCEECSK

SEQ ID NO: 1055189 - protein, 9 aa, Homo Sapiens
KNFWWLAVV

SEQ ID NO: 1055190 - protein, 9 aa, Homo Sapiens
TREEEAVLS

SEQ ID NO: 1055191 - protein, 9 aa, Homo Sapiens
KPLIRENQP

SEQ ID NO: 1055192 - protein, 9 aa, Homo Sapiens
LPNHIMASV

SEQ ID NO: 1055193 - protein, 9 aa, Homo Sapiens
GRARRQQAQ

SEQ ID NO: 1055194 - protein, 9 aa, Homo Sapiens
GTGFFLGIG

SEQ ID NO: 1055195 - protein, 9 aa, Homo Sapiens
ETIENLTRL

SEQ ID NO: 1055196 - protein, 9 aa, Homo Sapiens
VKNGGTSMM

SEQ ID NO: 1055197 - protein, 9 aa, Homo Sapiens
GPVTFIWKF

SEQ ID NO: 1055198 - protein, 9 aa, Homo Sapiens
LVEEFLLLG

SEQ ID NO: 1055199 - protein, 9 aa, Homo Sapiens
VQMFFGLAM

SEQ ID NO: 1055200 - protein, 9 aa, Homo Sapiens
RYKAPRVNG

SEQ ID NO: 1055201 - protein, 9 aa, Homo Sapiens
QNSSCSLEK

SEQ ID NO: 1055202 - protein, 9 aa, Homo Sapiens
SNLYGTEWD

SEQ ID NO: 1055203 - protein, 9 aa, Homo Sapiens
VFPGIQLKL

SEQ ID NO: 1055204 - protein, 9 aa, Homo Sapiens
QENGFSTNE

SEQ ID NO: 1055205 - protein, 9 aa, Homo Sapiens
SFSFLDSEM

SEQ ID NO: 1055206 - protein, 9 aa, Homo Sapiens
QTDYRRWKS

SEQ ID NO: 1055207 - protein, 9 aa, Homo Sapiens
FTLSQRARR

SEQ ID NO: 1055208 - protein, 9 aa, Homo Sapiens
ELFTGIFFS

SEQ ID NO: 1055209 - protein, 9 aa, Homo Sapiens
LGPSVAGLE

SEQ ID NO: 1055210 - protein, 9 aa, Homo Sapiens
LTSLHIVDF

SEQ ID NO: 1055211 - protein, 9 aa, Homo Sapiens
KRDQKQRRQ

SEQ ID NO: 1055212 - protein, 9 aa, Homo Sapiens
VSPVHDSYE

SEQ ID NO: 1055213 - protein, 9 aa, Homo Sapiens
LVGKNYDVT

SEQ ID NO: 1055214 - protein, 9 aa, Homo Sapiens
IAYSDLEYY

SEQ ID NO: 1055215 - protein, 9 aa, Homo Sapiens
AEEKMRKKE

SEQ ID NO: 1055216 - protein, 9 aa, Homo Sapiens
QVPSSAGEA

SEQ ID NO: 1055217 - protein, 9 aa, Homo Sapiens
QNPQTFLCF

SEQ ID NO: 1055218 - protein, 9 aa, Homo Sapiens
FYPAIGNIC

SEQ ID NO: 1055219 - protein, 9 aa, Homo Sapiens
LLANNSQLQ

SEQ ID NO: 1055220 - protein, 9 aa, Homo Sapiens
HPEDNWMEN

SEQ ID NO: 1055221 - protein, 9 aa, Homo Sapiens
ALPHLTLGP

SEQ ID NO: 1055222 - protein, 9 aa, Homo Sapiens
YALQIVANF

SEQ ID NO: 1055223 - protein, 9 aa, Homo Sapiens
LGHIYLGTF

SEQ ID NO: 1055224 - protein, 9 aa, Homo Sapiens
DRASPALST

SEQ ID NO: 1055225 - protein, 9 aa, Homo Sapiens
STRWSTTAG

SEQ ID NO: 1055226 - protein, 9 aa, Homo Sapiens
KCVTQYKGH

SEQ ID NO: 1055227 - protein, 9 aa, Homo Sapiens
TSFREKGQG

SEQ ID NO: 1055228 - protein, 9 aa, Homo Sapiens
IYSLSVFPN

SEQ ID NO: 1055229 - protein, 9 aa, Homo Sapiens
FIRYLSHFC

SEQ ID NO: 1055230 - protein, 9 aa, Homo Sapiens
TGMLSRVTS

SEQ ID NO: 1055231 - protein, 9 aa, Homo Sapiens
LIFYGFIVN

SEQ ID NO: 1055232 - protein, 9 aa, Homo Sapiens
WGVLNSPVK

SEQ ID NO: 1055233 - protein, 9 aa, Homo Sapiens
GYHSSLPNS

SEQ ID NO: 1055234 - protein, 9 aa, Homo Sapiens
AVIEGNSEK

SEQ ID NO: 1055235 - protein, 9 aa, Homo Sapiens
LRKEGHKVV

SEQ ID NO: 1055236 - protein, 9 aa, Homo Sapiens
MIKFCGEEG

SEQ ID NO: 1055237 - protein, 9 aa, Homo Sapiens
FILNLCFSD

SEQ ID NO: 1055238 - protein, 9 aa, Homo Sapiens
SLKCRVDLL

SEQ ID NO: 1055239 - protein, 9 aa, Homo Sapiens
RQTVKFLGF

SEQ ID NO: 1055240 - protein, 9 aa, Homo Sapiens
PKEELKIVV

SEQ ID NO: 1055241 - protein, 9 aa, Homo Sapiens
SLIDDKIRK

SEQ ID NO: 1055242 - protein, 9 aa, Homo Sapiens
SSFQIIQFM

SEQ ID NO: 1055243 - protein, 9 aa, Homo Sapiens
KYMSKGSLL

SEQ ID NO: 1055244 - protein, 9 aa, Homo Sapiens
TLLSLLGAE

SEQ ID NO: 1055245 - protein, 9 aa, Homo Sapiens
EIRLPIFTL

SEQ ID NO: 1055246 - protein, 9 aa, Homo Sapiens
FSYLEDIPD

SEQ ID NO: 1055247 - protein, 9 aa, Homo Sapiens
ILRIIVELG

SEQ ID NO: 1055248 - protein, 9 aa, Homo Sapiens
CFFFKTTVF

SEQ ID NO: 1055249 - protein, 9 aa, Homo Sapiens
VQRLSPASS

SEQ ID NO: 1055250 - protein, 9 aa, Homo Sapiens
ECVNTPEGF

SEQ ID NO: 1055251 - protein, 9 aa, Homo Sapiens
PHPTPPQQR

SEQ ID NO: 1055252 - protein, 9 aa, Homo Sapiens
LTLILQPQH

SEQ ID NO: 1055253 - protein, 9 aa, Homo Sapiens
ISLALPALE

SEQ ID NO: 1055254 - protein, 9 aa, Homo Sapiens
EASSEPKPT

SEQ ID NO: 1055255 - protein, 9 aa, Homo Sapiens
TSAEACPET

SEQ ID NO: 1055256 - protein, 9 aa, Homo Sapiens
FTIELTEKN

SEQ ID NO: 1055257 - protein, 9 aa, Homo Sapiens
VTAAEFWIY

SEQ ID NO: 1055258 - protein, 9 aa, Homo Sapiens
QSIQRSIQV

SEQ ID NO: 1055259 - protein, 9 aa, Homo Sapiens
DILRKLEKK

SEQ ID NO: 1055260 - protein, 9 aa, Homo Sapiens
QLTKKIQLT

SEQ ID NO: 1055261 - protein, 9 aa, Homo Sapiens
DNPINPKKY

SEQ ID NO: 1055262 - protein, 9 aa, Homo Sapiens
INNLKPETV

SEQ ID NO: 1055263 - protein, 9 aa, Homo Sapiens
KMVVVGICH

SEQ ID NO: 1055264 - protein, 9 aa, Homo Sapiens
EDPRLFFPS

SEQ ID NO: 1055265 - protein, 9 aa, Homo Sapiens
FTFILYLET

SEQ ID NO: 1055266 - protein, 9 aa, Homo Sapiens
YVVQKPGDY

SEQ ID NO: 1055267 - protein, 9 aa, Homo Sapiens
LGTFKLQPM

SEQ ID NO: 1055268 - protein, 9 aa, Homo Sapiens
TELIQLLKL

SEQ ID NO: 1055269 - protein, 9 aa, Homo Sapiens
PIPGDGSCQ

SEQ ID NO: 1055270 - protein, 9 aa, Homo Sapiens
NAYLRKTTE

SEQ ID NO: 1055271 - protein, 9 aa, Homo Sapiens
AGGFDTELD

SEQ ID NO: 1055272 - protein, 9 aa, Homo Sapiens
LLGCVSKGL

SEQ ID NO: 1055273 - protein, 9 aa, Homo Sapiens
SSLFGTDYR

SEQ ID NO: 1055274 - protein, 9 aa, Homo Sapiens
DDNHVAAIY

SEQ ID NO: 1055275 - protein, 9 aa, Homo Sapiens
TRNLQLNSA

SEQ ID NO: 1055276 - protein, 9 aa, Homo Sapiens
HVHNNRPAS

SEQ ID NO: 1055277 - protein, 9 aa, Homo Sapiens
ELTQEFPRE

SEQ ID NO: 1055278 - protein, 9 aa, Homo Sapiens
HKSRKKSKD

SEQ ID NO: 1055279 - protein, 9 aa, Homo Sapiens
IICGFLLGF

SEQ ID NO: 1055280 - protein, 9 aa, Homo Sapiens
KNTIVLEKA

SEQ ID NO: 1055281 - protein, 9 aa, Homo Sapiens
TLRNETLVA

SEQ ID NO: 1055282 - protein, 9 aa, Homo Sapiens
ASGVVSLLG

SEQ ID NO: 1055283 - protein, 9 aa, Homo Sapiens
HWNSSKKLR

SEQ ID NO: 1055284 - protein, 9 aa, Homo Sapiens
CDADSKWNS

SEQ ID NO: 1055285 - protein, 9 aa, Homo Sapiens
QVGKKFEED

SEQ ID NO: 1055286 - protein, 9 aa, Homo Sapiens
KFFSQKGTL

SEQ ID NO: 1055287 - protein, 9 aa, Homo Sapiens
NVLQSFSDA

SEQ ID NO: 1055288 - protein, 9 aa, Homo Sapiens
SLFYTPKFV

SEQ ID NO: 1055289 - protein, 9 aa, Homo Sapiens
PAPAPAAPL

SEQ ID NO: 1055290 - protein, 9 aa, Homo Sapiens
FSQGADLET

SEQ ID NO: 1055291 - protein, 9 aa, Homo Sapiens
TVLDPFSGH

SEQ ID NO: 1055292 - protein, 9 aa, Homo Sapiens
AQTSLAAPI

SEQ ID NO: 1055293 - protein, 9 aa, Homo Sapiens
IDLGKDDME

SEQ ID NO: 1055294 - protein, 9 aa, Homo Sapiens
IAHEKIYSG

SEQ ID NO: 1055295 - protein, 9 aa, Homo Sapiens
EDKTRTQRS

SEQ ID NO: 1055296 - protein, 9 aa, Homo Sapiens
HLNSTTPTA

SEQ ID NO: 1055297 - protein, 9 aa, Homo Sapiens
LIKKVTWTI

SEQ ID NO: 1055298 - protein, 9 aa, Homo Sapiens
PVFVLRQGL

SEQ ID NO: 1055299 - protein, 9 aa, Homo Sapiens
SRGETSLKL

SEQ ID NO: 1055300 - protein, 9 aa, Homo Sapiens
LWSSFFSPT

SEQ ID NO: 1055301 - protein, 9 aa, Homo Sapiens
AELLLLKLK

SEQ ID NO: 1055302 - protein, 9 aa, Homo Sapiens
EETEKAAGE

SEQ ID NO: 1055303 - protein, 9 aa, Homo Sapiens
IKKQIELKS

SEQ ID NO: 1055304 - protein, 9 aa, Homo Sapiens
PVLDYSVGN

SEQ ID NO: 1055305 - protein, 9 aa, Homo Sapiens
TPPEDTAIG

SEQ ID NO: 1055306 - protein, 9 aa, Homo Sapiens
TSIFLQEWN

SEQ ID NO: 1055307 - protein, 9 aa, Homo Sapiens
RDKFIQELF

SEQ ID NO: 1055308 - protein, 9 aa, Homo Sapiens
VFHALRKKI

SEQ ID NO: 1055309 - protein, 9 aa, Homo Sapiens
LFKCKKCGK

SEQ ID NO: 1055310 - protein, 9 aa, Homo Sapiens
QMGTNKRAS

SEQ ID NO: 1055311 - protein, 9 aa, Homo Sapiens
LQSTPPAAF

SEQ ID NO: 1055312 - protein, 9 aa, Homo Sapiens
TRVPQHVPV

SEQ ID NO: 1055313 - protein, 9 aa, Homo Sapiens
EEGLRKVKK

SEQ ID NO: 1055314 - protein, 9 aa, Homo Sapiens
DIFPVVCTV

SEQ ID NO: 1055315 - protein, 9 aa, Homo Sapiens
HFPFSITLV

SEQ ID NO: 1055316 - protein, 9 aa, Homo Sapiens
PEVTHQKRW

SEQ ID NO: 1055317 - protein, 9 aa, Homo Sapiens
SEITISDIL

SEQ ID NO: 1055318 - protein, 9 aa, Homo Sapiens
LIFVEEEGA

SEQ ID NO: 1055319 - protein, 9 aa, Homo Sapiens
YVSLTLFLI

SEQ ID NO: 1055320 - protein, 9 aa, Homo Sapiens
PRNVVYSIF

SEQ ID NO: 1055321 - protein, 9 aa, Homo Sapiens
LYNAELSQM

SEQ ID NO: 1055322 - protein, 9 aa, Homo Sapiens
NLLSGAIPG

SEQ ID NO: 1055323 - protein, 9 aa, Homo Sapiens
NPNWLVVQV

SEQ ID NO: 1055324 - protein, 9 aa, Homo Sapiens
DSYEKQGLV

SEQ ID NO: 1055325 - protein, 9 aa, Homo Sapiens
PLNIIYNSQ

SEQ ID NO: 1055326 - protein, 9 aa, Homo Sapiens
QYFHPAELG

SEQ ID NO: 1055327 - protein, 9 aa, Homo Sapiens
SIIVNVPSS

SEQ ID NO: 1055328 - protein, 9 aa, Homo Sapiens
EWKKQLELV

SEQ ID NO: 1055329 - protein, 9 aa, Homo Sapiens
SLSGPHLET

SEQ ID NO: 1055330 - protein, 9 aa, Homo Sapiens
IQNSHYGQS

SEQ ID NO: 1055331 - protein, 9 aa, Homo Sapiens
QEAKFVFVK

SEQ ID NO: 1055332 - protein, 9 aa, Homo Sapiens
TFFCVCTGP

SEQ ID NO: 1055333 - protein, 9 aa, Homo Sapiens
VEYLIEFGQ

SEQ ID NO: 1055334 - protein, 9 aa, Homo Sapiens
FYSCGCIAG

SEQ ID NO: 1055335 - protein, 9 aa, Homo Sapiens
SSHVEKVFM

SEQ ID NO: 1055336 - protein, 9 aa, Homo Sapiens
SVYCTSSAC

SEQ ID NO: 1055337 - protein, 9 aa, Homo Sapiens
LECDAPPNI

SEQ ID NO: 1055338 - protein, 9 aa, Homo Sapiens
TIGKGYFAK

SEQ ID NO: 1055339 - protein, 9 aa, Homo Sapiens
LVLYYVTGF

SEQ ID NO: 1055340 - protein, 9 aa, Homo Sapiens
AFCFLFNLS

SEQ ID NO: 1055341 - protein, 9 aa, Homo Sapiens
KNRTYAEIN

SEQ ID NO: 1055342 - protein, 9 aa, Homo Sapiens
GRILFFVKP

SEQ ID NO: 1055343 - protein, 9 aa, Homo Sapiens
IYTLKNKEM

SEQ ID NO: 1055344 - protein, 9 aa, Homo Sapiens
FNILKINEN

SEQ ID NO: 1055345 - protein, 9 aa, Homo Sapiens
RKHYRTSSK

SEQ ID NO: 1055346 - protein, 9 aa, Homo Sapiens
DLFTKTASS

SEQ ID NO: 1055347 - protein, 9 aa, Homo Sapiens
SKIPITLDH

SEQ ID NO: 1055348 - protein, 9 aa, Homo Sapiens
LASEEEITT

SEQ ID NO: 1055349 - protein, 9 aa, Homo Sapiens
LELQEKKTE

SEQ ID NO: 1055350 - protein, 9 aa, Homo Sapiens
NKGTLSVMK

SEQ ID NO: 1055351 - protein, 9 aa, Homo Sapiens
GTAERPSLV

SEQ ID NO: 1055352 - protein, 9 aa, Homo Sapiens
SHEQHPHRH

SEQ ID NO: 1055353 - protein, 9 aa, Homo Sapiens
AASTERTLR

SEQ ID NO: 1055354 - protein, 9 aa, Homo Sapiens
ELSKNSDIK

SEQ ID NO: 1055355 - protein, 9 aa, Homo Sapiens
FFLLEAQNY

SEQ ID NO: 1055356 - protein, 9 aa, Homo Sapiens
RNPSSSWPS

SEQ ID NO: 1055357 - protein, 9 aa, Homo Sapiens
HFFCDISLL

SEQ ID NO: 1055358 - protein, 9 aa, Homo Sapiens
PALEFPTCC

SEQ ID NO: 1055359 - protein, 9 aa, Homo Sapiens
VTQYKGHVN

SEQ ID NO: 1055360 - protein, 9 aa, Homo Sapiens
FSKSHSQKK

SEQ ID NO: 1055361 - protein, 9 aa, Homo Sapiens
ELLRQMEIR

SEQ ID NO: 1055362 - protein, 9 aa, Homo Sapiens
SGIYHINQQ

SEQ ID NO: 1055363 - protein, 9 aa, Homo Sapiens
RKPAQPPRE

SEQ ID NO: 1055364 - protein, 9 aa, Homo Sapiens
QLIISYGYI

SEQ ID NO: 1055365 - protein, 9 aa, Homo Sapiens
NSGNTDIEG

SEQ ID NO: 1055366 - protein, 9 aa, Homo Sapiens
IILDQLEAE

SEQ ID NO: 1055367 - protein, 9 aa, Homo Sapiens
SLRLSWTVS

SEQ ID NO: 1055368 - protein, 9 aa, Homo Sapiens
LGMCLELER

SEQ ID NO: 1055369 - protein, 9 aa, Homo Sapiens
YCQEPYYQA

SEQ ID NO: 1055370 - protein, 9 aa, Homo Sapiens
TSHTSQASH

SEQ ID NO: 1055371 - protein, 9 aa, Homo Sapiens
FFPISVSNV

SEQ ID NO: 1055372 - protein, 9 aa, Homo Sapiens
TQSVVFLYK

SEQ ID NO: 1055373 - protein, 9 aa, Homo Sapiens
QGMPDHLFP

SEQ ID NO: 1055374 - protein, 9 aa, Homo Sapiens
SVAAVARTD

SEQ ID NO: 1055375 - protein, 9 aa, Homo Sapiens
SVPHRPAKL

SEQ ID NO: 1055376 - protein, 9 aa, Homo Sapiens
DFCGKAFCH

SEQ ID NO: 1055377 - protein, 9 aa, Homo Sapiens
DSVYFPLGL

SEQ ID NO: 1055378 - protein, 9 aa, Homo Sapiens
LILIFYGFI

SEQ ID NO: 1055379 - protein, 9 aa, Homo Sapiens
YEEQTDKYF

SEQ ID NO: 1055380 - protein, 9 aa, Homo Sapiens
LKALATYRA

SEQ ID NO: 1055381 - protein, 9 aa, Homo Sapiens
PSPGFSGLS

SEQ ID NO: 1055382 - protein, 9 aa, Homo Sapiens
FLRNQIRVA

SEQ ID NO: 1055383 - protein, 9 aa, Homo Sapiens
KEFYPTFDP

SEQ ID NO: 1055384 - protein, 9 aa, Homo Sapiens
KMFQSEVAR

SEQ ID NO: 1055385 - protein, 9 aa, Homo Sapiens
SGAIPGPRA

SEQ ID NO: 1055386 - protein, 9 aa, Homo Sapiens
TCLAGWRGT

SEQ ID NO: 1055387 - protein, 9 aa, Homo Sapiens
PAPAAPLST

SEQ ID NO: 1055388 - protein, 9 aa, Homo Sapiens
KEEAKDVSS

SEQ ID NO: 1055389 - protein, 9 aa, Homo Sapiens
SVIIKFLGE

SEQ ID NO: 1055390 - protein, 9 aa, Homo Sapiens
VQNGIVSSS

SEQ ID NO: 1055391 - protein, 9 aa, Homo Sapiens
HDADRHCGP

SEQ ID NO: 1055392 - protein, 9 aa, Homo Sapiens
QKKNLKEMA

SEQ ID NO: 1055393 - protein, 9 aa, Homo Sapiens
ELAEKLEME

SEQ ID NO: 1055394 - protein, 9 aa, Homo Sapiens
AKMGKRGDA

SEQ ID NO: 1055395 - protein, 9 aa, Homo Sapiens
TCDTPKEDG

SEQ ID NO: 1055396 - protein, 9 aa, Homo Sapiens
AGFFKYVAS

SEQ ID NO: 1055397 - protein, 9 aa, Homo Sapiens
KLECDAPPN

SEQ ID NO: 1055398 - protein, 9 aa, Homo Sapiens
KTTVFSGVF

SEQ ID NO: 1055399 - protein, 9 aa, Homo Sapiens
KNGYCPNYP

SEQ ID NO: 1055400 - protein, 9 aa, Homo Sapiens
PAEVHIVKN

SEQ ID NO: 1055401 - protein, 9 aa, Homo Sapiens
LEGLVGVQG

SEQ ID NO: 1055402 - protein, 9 aa, Homo Sapiens
VNYFVLFEV

SEQ ID NO: 1055403 - protein, 9 aa, Homo Sapiens
SLDPGSQCS

SEQ ID NO: 1055404 - protein, 9 aa, Homo Sapiens
LRLSVEITG

SEQ ID NO: 1055405 - protein, 9 aa, Homo Sapiens
SEQAFSLDI

SEQ ID NO: 1055406 - protein, 9 aa, Homo Sapiens
QSVCTGKKR

SEQ ID NO: 1055407 - protein, 9 aa, Homo Sapiens
FLIVMKGAP

SEQ ID NO: 1055408 - protein, 9 aa, Homo Sapiens
VNTAPLTRV

SEQ ID NO: 1055409 - protein, 9 aa, Homo Sapiens
NGGRYGTIK

SEQ ID NO: 1055410 - protein, 9 aa, Homo Sapiens
FSELGLIPI

SEQ ID NO: 1055411 - protein, 9 aa, Homo Sapiens
SYVLEEVLW

SEQ ID NO: 1055412 - protein, 9 aa, Homo Sapiens
VTEEGLRKV

SEQ ID NO: 1055413 - protein, 9 aa, Homo Sapiens
LLLMLIFLV

SEQ ID NO: 1055414 - protein, 9 aa, Homo Sapiens
ENLPADLKA

SEQ ID NO: 1055415 - protein, 9 aa, Homo Sapiens
PEYKCVCDP

SEQ ID NO: 1055416 - protein, 9 aa, Homo Sapiens
LPKEVGHLS

SEQ ID NO: 1055417 - protein, 9 aa, Homo Sapiens
GEHVKLEED

SEQ ID NO: 1055418 - protein, 9 aa, Homo Sapiens
GMSVNAFRK

SEQ ID NO: 1055419 - protein, 9 aa, Homo Sapiens
IRAEPFQDL

SEQ ID NO: 1055420 - protein, 9 aa, Homo Sapiens
EPMDKNCYE

SEQ ID NO: 1055421 - protein, 9 aa, Homo Sapiens
PVNPPAATV

SEQ ID NO: 1055422 - protein, 9 aa, Homo Sapiens
ASALHFPFT

SEQ ID NO: 1055423 - protein, 9 aa, Homo Sapiens
LIMGILRVK

SEQ ID NO: 1055424 - protein, 9 aa, Homo Sapiens
ILKQSGKNQ

SEQ ID NO: 1055425 - protein, 9 aa, Homo Sapiens
DDPSASAAW

SEQ ID NO: 1055426 - protein, 9 aa, Homo Sapiens
QREKDALHS

SEQ ID NO: 1055427 - protein, 9 aa, Homo Sapiens
EENLPADLK

SEQ ID NO: 1055428 - protein, 9 aa, Homo Sapiens
WMKRQKSGG

SEQ ID NO: 1055429 - protein, 9 aa, Homo Sapiens
SHMSSFHSF

SEQ ID NO: 1055430 - protein, 9 aa, Homo Sapiens
PFSELGLIP

SEQ ID NO: 1055431 - protein, 9 aa, Homo Sapiens
QEKKAKIAE

SEQ ID NO: 1055432 - protein, 9 aa, Homo Sapiens
VFCREQQHV

SEQ ID NO: 1055433 - protein, 9 aa, Homo Sapiens
PPGSPEPKG

SEQ ID NO: 1055434 - protein, 9 aa, Homo Sapiens
LRRYENCGH

SEQ ID NO: 1055435 - protein, 9 aa, Homo Sapiens
ALHFPFTSI

SEQ ID NO: 1055436 - protein, 9 aa, Homo Sapiens
QTVKFLGFV

SEQ ID NO: 1055437 - protein, 9 aa, Homo Sapiens
QREGYSHDS

SEQ ID NO: 1055438 - protein, 9 aa, Homo Sapiens
SPPPAPEIS

SEQ ID NO: 1055439 - protein, 9 aa, Homo Sapiens
SSPAAPLSV

SEQ ID NO: 1055440 - protein, 9 aa, Homo Sapiens
VGVTSSPAA

SEQ ID NO: 1055441 - protein, 9 aa, Homo Sapiens
CRAKTGKYS

SEQ ID NO: 1055442 - protein, 9 aa, Homo Sapiens
MCEGQRLKK

SEQ ID NO: 1055443 - protein, 9 aa, Homo Sapiens
NVMVNTDPV

SEQ ID NO: 1055444 - protein, 9 aa, Homo Sapiens
LFLGLITID

SEQ ID NO: 1055445 - protein, 9 aa, Homo Sapiens
VLISVIIFV

SEQ ID NO: 1055446 - protein, 9 aa, Homo Sapiens
YVSIIAIFL

SEQ ID NO: 1055447 - protein, 9 aa, Homo Sapiens
SSRQPIYMS

SEQ ID NO: 1055448 - protein, 9 aa, Homo Sapiens
FYCDNVSLL

SEQ ID NO: 1055449 - protein, 9 aa, Homo Sapiens
SWRGPSPLF

SEQ ID NO: 1055450 - protein, 9 aa, Homo Sapiens
LPNHILFLT

SEQ ID NO: 1055451 - protein, 9 aa, Homo Sapiens
VAIGTYDLD

SEQ ID NO: 1055452 - protein, 9 aa, Homo Sapiens
PNSSLFGTD

SEQ ID NO: 1055453 - protein, 9 aa, Homo Sapiens
SSHRSSVSS

SEQ ID NO: 1055454 - protein, 9 aa, Homo Sapiens
LLEELHHQR

SEQ ID NO: 1055455 - protein, 9 aa, Homo Sapiens
NSNSVVLQL

SEQ ID NO: 1055456 - protein, 9 aa, Homo Sapiens
SPEKTKSPL

SEQ ID NO: 1055457 - protein, 9 aa, Homo Sapiens
ERSFKSQDR

SEQ ID NO: 1055458 - protein, 9 aa, Homo Sapiens
IYRAILGSV

SEQ ID NO: 1055459 - protein, 9 aa, Homo Sapiens
RDCLQDPGE

SEQ ID NO: 1055460 - protein, 9 aa, Homo Sapiens
VPALFIFMQ

SEQ ID NO: 1055461 - protein, 9 aa, Homo Sapiens
VLITKTLEK

SEQ ID NO: 1055462 - protein, 9 aa, Homo Sapiens
TADLDPNCM

SEQ ID NO: 1055463 - protein, 9 aa, Homo Sapiens
RIIKYKFIL

SEQ ID NO: 1055464 - protein, 9 aa, Homo Sapiens
QIPILISII

SEQ ID NO: 1055465 - protein, 9 aa, Homo Sapiens
LSLFWRQIR

SEQ ID NO: 1055466 - protein, 9 aa, Homo Sapiens
LSETPTGLA

SEQ ID NO: 1055467 - protein, 9 aa, Homo Sapiens
RLFGARAEE

SEQ ID NO: 1055468 - protein, 9 aa, Homo Sapiens
FNQKIRDRW

SEQ ID NO: 1055469 - protein, 9 aa, Homo Sapiens
KAAWTSAHS

SEQ ID NO: 1055470 - protein, 9 aa, Homo Sapiens
IFVEEEGAV

SEQ ID NO: 1055471 - protein, 9 aa, Homo Sapiens
HLWSSCIAR

SEQ ID NO: 1055472 - protein, 9 aa, Homo Sapiens
FINRIFYIS

SEQ ID NO: 1055473 - protein, 9 aa, Homo Sapiens
GNYKVDSPR

SEQ ID NO: 1055474 - protein, 9 aa, Homo Sapiens
VIIREELCV

SEQ ID NO: 1055475 - protein, 9 aa, Homo Sapiens
CSGHSQCSC

SEQ ID NO: 1055476 - protein, 9 aa, Homo Sapiens
KQKSKLGNR

SEQ ID NO: 1055477 - protein, 9 aa, Homo Sapiens
PFFLRNKVF

SEQ ID NO: 1055478 - protein, 9 aa, Homo Sapiens
DVELHRHFL

SEQ ID NO: 1055479 - protein, 9 aa, Homo Sapiens
GQSVDSGTI

SEQ ID NO: 1055480 - protein, 9 aa, Homo Sapiens
KHSCVTDSE

SEQ ID NO: 1055481 - protein, 9 aa, Homo Sapiens
SRTARSEAD

SEQ ID NO: 1055482 - protein, 9 aa, Homo Sapiens
GKGRICRGN

SEQ ID NO: 1055483 - protein, 9 aa, Homo Sapiens
DFQVGKKFE

SEQ ID NO: 1055484 - protein, 9 aa, Homo Sapiens
TWREDLTHA

SEQ ID NO: 1055485 - protein, 9 aa, Homo Sapiens
GGGGRKGLL

SEQ ID NO: 1055486 - protein, 9 aa, Homo Sapiens
VMKEAFETF

SEQ ID NO: 1055487 - protein, 9 aa, Homo Sapiens
DVKSEVSVG

SEQ ID NO: 1055488 - protein, 9 aa, Homo Sapiens
SILNGFDHR

SEQ ID NO: 1055489 - protein, 9 aa, Homo Sapiens
LIEKCLKFV

SEQ ID NO: 1055490 - protein, 9 aa, Homo Sapiens
IHSRTNLID

SEQ ID NO: 1055491 - protein, 9 aa, Homo Sapiens
YFRHKIYKL

SEQ ID NO: 1055492 - protein, 9 aa, Homo Sapiens
TSTMALVLY

SEQ ID NO: 1055493 - protein, 9 aa, Homo Sapiens
IQRMTSIIC

SEQ ID NO: 1055494 - protein, 9 aa, Homo Sapiens
EQTEEMDFL

SEQ ID NO: 1055495 - protein, 9 aa, Homo Sapiens
KIPITLDHG

SEQ ID NO: 1055496 - protein, 9 aa, Homo Sapiens
NFVKRKIRE

SEQ ID NO: 1055497 - protein, 9 aa, Homo Sapiens
EKLCRANSW

SEQ ID NO: 1055498 - protein, 9 aa, Homo Sapiens
LEEHFQDDD

SEQ ID NO: 1055499 - protein, 9 aa, Homo Sapiens
CKERDLWKC

SEQ ID NO: 1055500 - protein, 9 aa, Homo Sapiens
PHHQQPPPQ

SEQ ID NO: 1055501 - protein, 9 aa, Homo Sapiens
KVMMEAYPG

SEQ ID NO: 1055502 - protein, 9 aa, Homo Sapiens
SNTRCDAGW

SEQ ID NO: 1055503 - protein, 9 aa, Homo Sapiens
CEFALVVVV

SEQ ID NO: 1055504 - protein, 9 aa, Homo Sapiens
HVAAIYCKA

SEQ ID NO: 1055505 - protein, 9 aa, Homo Sapiens
SQKRWERFV

SEQ ID NO: 1055506 - protein, 9 aa, Homo Sapiens
PNCIVYCTM

SEQ ID NO: 1055507 - protein, 9 aa, Homo Sapiens
RGCKIRNTD

SEQ ID NO: 1055508 - protein, 9 aa, Homo Sapiens
SLVCHELHR

SEQ ID NO: 1055509 - protein, 9 aa, Homo Sapiens
TPVVQWYKH

SEQ ID NO: 1055510 - protein, 9 aa, Homo Sapiens
LSDALLKLG

SEQ ID NO: 1055511 - protein, 9 aa, Homo Sapiens
YYREPQKGI

SEQ ID NO: 1055512 - protein, 9 aa, Homo Sapiens
SIMTEDCLN

SEQ ID NO: 1055513 - protein, 9 aa, Homo Sapiens
PFSCSLLQL

SEQ ID NO: 1055514 - protein, 9 aa, Homo Sapiens
KSCQGKKKK

SEQ ID NO: 1055515 - protein, 9 aa, Homo Sapiens
AGCTLECQC

SEQ ID NO: 1055516 - protein, 9 aa, Homo Sapiens
ETSLVGKNY

SEQ ID NO: 1055517 - protein, 9 aa, Homo Sapiens
LRLSWTVSE

SEQ ID NO: 1055518 - protein, 9 aa, Homo Sapiens
DLCGQRQDL

SEQ ID NO: 1055519 - protein, 9 aa, Homo Sapiens
RRVQVSFLY

SEQ ID NO: 1055520 - protein, 9 aa, Homo Sapiens
HKKEAKDDS

SEQ ID NO: 1055521 - protein, 9 aa, Homo Sapiens
VMYVSLTLF

SEQ ID NO: 1055522 - protein, 9 aa, Homo Sapiens
HCVIFYKNG

SEQ ID NO: 1055523 - protein, 9 aa, Homo Sapiens
PEPKGSPGF

SEQ ID NO: 1055524 - protein, 9 aa, Homo Sapiens
GGHFLLHSP

SEQ ID NO: 1055525 - protein, 9 aa, Homo Sapiens
PNLDSANPT

SEQ ID NO: 1055526 - protein, 9 aa, Homo Sapiens
EFQKFPLPP

SEQ ID NO: 1055527 - protein, 9 aa, Homo Sapiens
KKSASLMVD

SEQ ID NO: 1055528 - protein, 9 aa, Homo Sapiens
GTYEQVYKG

SEQ ID NO: 1055529 - protein, 9 aa, Homo Sapiens
SVVFRLNGS

SEQ ID NO: 1055530 - protein, 9 aa, Homo Sapiens
KAGRPFCPY

SEQ ID NO: 1055531 - protein, 9 aa, Homo Sapiens
ELPWGWTQT

SEQ ID NO: 1055532 - protein, 9 aa, Homo Sapiens
KILQKKEEA

SEQ ID NO: 1055533 - protein, 9 aa, Homo Sapiens
LIFQKPFCG

SEQ ID NO: 1055534 - protein, 9 aa, Homo Sapiens
LPREVRGGH

SEQ ID NO: 1055535 - protein, 9 aa, Homo Sapiens
KVFFNKPDS

SEQ ID NO: 1055536 - protein, 9 aa, Homo Sapiens
QCFLHKEEK

SEQ ID NO: 1055537 - protein, 9 aa, Homo Sapiens
SEAAKHGTF

SEQ ID NO: 1055538 - protein, 9 aa, Homo Sapiens
EVLRSIASE

SEQ ID NO: 1055539 - protein, 9 aa, Homo Sapiens
RKDKTYPIK

SEQ ID NO: 1055540 - protein, 9 aa, Homo Sapiens
HGLNLQNYI

SEQ ID NO: 1055541 - protein, 9 aa, Homo Sapiens
LWQKDSFQE

SEQ ID NO: 1055542 - protein, 9 aa, Homo Sapiens
EFLIISNNG

SEQ ID NO: 1055543 - protein, 9 aa, Homo Sapiens
YEQLKEELA

SEQ ID NO: 1055544 - protein, 9 aa, Homo Sapiens
NRGFMNRVN

SEQ ID NO: 1055545 - protein, 9 aa, Homo Sapiens
RVESDVQPQ

SEQ ID NO: 1055546 - protein, 9 aa, Homo Sapiens
NERSVLQET

SEQ ID NO: 1055547 - protein, 9 aa, Homo Sapiens
EIDRNKHIY

SEQ ID NO: 1055548 - protein, 9 aa, Homo Sapiens
ARYLSQLDG

SEQ ID NO: 1055549 - protein, 9 aa, Homo Sapiens
FVGEICQDY

SEQ ID NO: 1055550 - protein, 9 aa, Homo Sapiens
GKFISLFYL

SEQ ID NO: 1055551 - protein, 9 aa, Homo Sapiens
PYAGFFKYV

SEQ ID NO: 1055552 - protein, 9 aa, Homo Sapiens
NVRVSGWLQ

SEQ ID NO: 1055553 - protein, 9 aa, Homo Sapiens
AIYCKAGKG

SEQ ID NO: 1055554 - protein, 9 aa, Homo Sapiens
SPSSCLMTK

SEQ ID NO: 1055555 - protein, 9 aa, Homo Sapiens
TMYISILFL

SEQ ID NO: 1055556 - protein, 9 aa, Homo Sapiens
SSFNNIENK

SEQ ID NO: 1055557 - protein, 9 aa, Homo Sapiens
NKYEPFWED

SEQ ID NO: 1055558 - protein, 9 aa, Homo Sapiens
SPGTKAVST

SEQ ID NO: 1055559 - protein, 9 aa, Homo Sapiens
QCCPEYKCV

SEQ ID NO: 1055560 - protein, 9 aa, Homo Sapiens
LLVLSLDTL

SEQ ID NO: 1055561 - protein, 9 aa, Homo Sapiens
ALRKKIDMK

SEQ ID NO: 1055562 - protein, 9 aa, Homo Sapiens
CYSSTLGGQ

SEQ ID NO: 1055563 - protein, 9 aa, Homo Sapiens
GNMPNTSIN

SEQ ID NO: 1055564 - protein, 9 aa, Homo Sapiens
ISCNKFLDD

SEQ ID NO: 1055565 - protein, 9 aa, Homo Sapiens
GAQSLSTTG

SEQ ID NO: 1055566 - protein, 9 aa, Homo Sapiens
LWARYDTEE

SEQ ID NO: 1055567 - protein, 9 aa, Homo Sapiens
IQKVEVNCK

SEQ ID NO: 1055568 - protein, 9 aa, Homo Sapiens
QAVEPILTS

SEQ ID NO: 1055569 - protein, 9 aa, Homo Sapiens
GGSNSHVFA

SEQ ID NO: 1055570 - protein, 9 aa, Homo Sapiens
PPTSAFHFS

SEQ ID NO: 1055571 - protein, 9 aa, Homo Sapiens
NMKRGLQKM

SEQ ID NO: 1055572 - protein, 9 aa, Homo Sapiens
DSLEEPMEE

SEQ ID NO: 1055573 - protein, 9 aa, Homo Sapiens
NLQLNSARL

SEQ ID NO: 1055574 - protein, 9 aa, Homo Sapiens
AKKRSLINK

SEQ ID NO: 1055575 - protein, 9 aa, Homo Sapiens
PSPSKSMVA

SEQ ID NO: 1055576 - protein, 9 aa, Homo Sapiens
VILTSFDGV

SEQ ID NO: 1055577 - protein, 9 aa, Homo Sapiens
LPTARPTEP

SEQ ID NO: 1055578 - protein, 9 aa, Homo Sapiens
LKDENLPSV

SEQ ID NO: 1055579 - protein, 9 aa, Homo Sapiens
YLLCVPDKD

SEQ ID NO: 1055580 - protein, 9 aa, Homo Sapiens
KNRRQRDWA

SEQ ID NO: 1055581 - protein, 9 aa, Homo Sapiens
FAFLIYLKP

SEQ ID NO: 1055582 - protein, 9 aa, Homo Sapiens
CSGEHVKLE

SEQ ID NO: 1055583 - protein, 9 aa, Homo Sapiens
VRRRPNLDS

SEQ ID NO: 1055584 - protein, 9 aa, Homo Sapiens
GHIYLGTFA

SEQ ID NO: 1055585 - protein, 9 aa, Homo Sapiens
FLLDGYNKF

SEQ ID NO: 1055586 - protein, 9 aa, Homo Sapiens
AEACPETRA

SEQ ID NO: 1055587 - protein, 9 aa, Homo Sapiens
YQCHGLRQD

SEQ ID NO: 1055588 - protein, 9 aa, Homo Sapiens
CTVNLGGAN

SEQ ID NO: 1055589 - protein, 9 aa, Homo Sapiens
LFHHTKANN

SEQ ID NO: 1055590 - protein, 9 aa, Homo Sapiens
SRREDKTRT

SEQ ID NO: 1055591 - protein, 9 aa, Homo Sapiens
FNVLAMYVA

SEQ ID NO: 1055592 - protein, 9 aa, Homo Sapiens
PKLYGDIPC

SEQ ID NO: 1055593 - protein, 9 aa, Homo Sapiens
TRTLLDDKN

SEQ ID NO: 1055594 - protein, 9 aa, Homo Sapiens
EDKTFYPEK

SEQ ID NO: 1055595 - protein, 9 aa, Homo Sapiens
SRSPPEMLE

SEQ ID NO: 1055596 - protein, 9 aa, Homo Sapiens
LSPKRASCN

SEQ ID NO: 1055597 - protein, 9 aa, Homo Sapiens
EIQVLGSLS

SEQ ID NO: 1055598 - protein, 9 aa, Homo Sapiens
EPLLSLRDE

SEQ ID NO: 1055599 - protein, 9 aa, Homo Sapiens
YFSSETFNP

SEQ ID NO: 1055600 - protein, 9 aa, Homo Sapiens
VYFLQYSIQ

SEQ ID NO: 1055601 - protein, 9 aa, Homo Sapiens
LPLLHTPIL

SEQ ID NO: 1055602 - protein, 9 aa, Homo Sapiens
ALDLPFSSH

SEQ ID NO: 1055603 - protein, 9 aa, Homo Sapiens
GDGKKHSIT

SEQ ID NO: 1055604 - protein, 9 aa, Homo Sapiens
EIDYVKNKM

SEQ ID NO: 1055605 - protein, 9 aa, Homo Sapiens
SHAQHLLVL

SEQ ID NO: 1055606 - protein, 9 aa, Homo Sapiens
KLSCENIRI

SEQ ID NO: 1055607 - protein, 9 aa, Homo Sapiens
FFRPSKEVH

SEQ ID NO: 1055608 - protein, 9 aa, Homo Sapiens
NFMDGKNVD

SEQ ID NO: 1055609 - protein, 9 aa, Homo Sapiens
TEAARRLVS

SEQ ID NO: 1055610 - protein, 9 aa, Homo Sapiens
IFKEIKSSE

SEQ ID NO: 1055611 - protein, 9 aa, Homo Sapiens
LDIFPGAAG

SEQ ID NO: 1055612 - protein, 9 aa, Homo Sapiens
VDGDDLGIF

SEQ ID NO: 1055613 - protein, 9 aa, Homo Sapiens
FTETEIILL

SEQ ID NO: 1055614 - protein, 9 aa, Homo Sapiens
WILMLLLST

SEQ ID NO: 1055615 - protein, 9 aa, Homo Sapiens
IRKSVNWRE

SEQ ID NO: 1055616 - protein, 9 aa, Homo Sapiens
DVTIRRREE

SEQ ID NO: 1055617 - protein, 9 aa, Homo Sapiens
ASFFFSTQA

SEQ ID NO: 1055618 - protein, 9 aa, Homo Sapiens
SEGNTIRIK

SEQ ID NO: 1055619 - protein, 9 aa, Homo Sapiens
LQSIQRSIQ

SEQ ID NO: 1055620 - protein, 9 aa, Homo Sapiens
TQNMAVYVE

SEQ ID NO: 1055621 - protein, 9 aa, Homo Sapiens
TTNSGEKSS

SEQ ID NO: 1055622 - protein, 9 aa, Homo Sapiens
VSVIIKFLG

SEQ ID NO: 1055623 - protein, 9 aa, Homo Sapiens
GGFDTELDE

SEQ ID NO: 1055624 - protein, 9 aa, Homo Sapiens
AIIARSLET

SEQ ID NO: 1055625 - protein, 9 aa, Homo Sapiens
GNYDVNITY

SEQ ID NO: 1055626 - protein, 9 aa, Homo Sapiens
AKKSSSGKK

SEQ ID NO: 1055627 - protein, 9 aa, Homo Sapiens
GPVSPFHGG

SEQ ID NO: 1055628 - protein, 9 aa, Homo Sapiens
LSGTQVHQQ

SEQ ID NO: 1055629 - protein, 9 aa, Homo Sapiens
CGNQKVANF

SEQ ID NO: 1055630 - protein, 9 aa, Homo Sapiens
VDVKSEVSV

SEQ ID NO: 1055631 - protein, 9 aa, Homo Sapiens
MLRSRLGQK

SEQ ID NO: 1055632 - protein, 9 aa, Homo Sapiens
DRGNLPDDL

SEQ ID NO: 1055633 - protein, 9 aa, Homo Sapiens
TFRNVALEF

SEQ ID NO: 1055634 - protein, 9 aa, Homo Sapiens
PPTISLTAP

SEQ ID NO: 1055635 - protein, 9 aa, Homo Sapiens
QTVAPLSQD

SEQ ID NO: 1055636 - protein, 9 aa, Homo Sapiens
QQLRGSLSL

SEQ ID NO: 1055637 - protein, 9 aa, Homo Sapiens
EKMIEEEVE

SEQ ID NO: 1055638 - protein, 9 aa, Homo Sapiens
SAVNKAGTV

SEQ ID NO: 1055639 - protein, 9 aa, Homo Sapiens
RGPLNPDFQ

SEQ ID NO: 1055640 - protein, 9 aa, Homo Sapiens
NFTPQNDIT

SEQ ID NO: 1055641 - protein, 9 aa, Homo Sapiens
RPTVLMSLW

SEQ ID NO: 1055642 - protein, 9 aa, Homo Sapiens
SGINIVTAN

SEQ ID NO: 1055643 - protein, 9 aa, Homo Sapiens
YLLAHFSPL

SEQ ID NO: 1055644 - protein, 9 aa, Homo Sapiens
KYLQKFISE

SEQ ID NO: 1055645 - protein, 9 aa, Homo Sapiens
TMARNRGAW

SEQ ID NO: 1055646 - protein, 9 aa, Homo Sapiens
CGHKKVDHF

SEQ ID NO: 1055647 - protein, 9 aa, Homo Sapiens
TASALHFPF

SEQ ID NO: 1055648 - protein, 9 aa, Homo Sapiens
FQGFRFGTV

SEQ ID NO: 1055649 - protein, 9 aa, Homo Sapiens
ALTSEAGLS

SEQ ID NO: 1055650 - protein, 9 aa, Homo Sapiens
WMQEFLNEE

SEQ ID NO: 1055651 - protein, 9 aa, Homo Sapiens
AWLLYELQP

SEQ ID NO: 1055652 - protein, 9 aa, Homo Sapiens
DHTKPRRKP

SEQ ID NO: 1055653 - protein, 9 aa, Homo Sapiens
FLCSDIFEE

SEQ ID NO: 1055654 - protein, 9 aa, Homo Sapiens
SNARGQRVK

SEQ ID NO: 1055655 - protein, 9 aa, Homo Sapiens
EFWIYKVPS

SEQ ID NO: 1055656 - protein, 9 aa, Homo Sapiens
QNGIVSSSS

SEQ ID NO: 1055657 - protein, 9 aa, Homo Sapiens
IKGCEILLD

SEQ ID NO: 1055658 - protein, 9 aa, Homo Sapiens
NPELSAFHC

SEQ ID NO: 1055659 - protein, 9 aa, Homo Sapiens
SPIGHMKVK

SEQ ID NO: 1055660 - protein, 9 aa, Homo Sapiens
TTMTIRTKP

SEQ ID NO: 1055661 - protein, 9 aa, Homo Sapiens
SFYFEDFSN

SEQ ID NO: 1055662 - protein, 9 aa, Homo Sapiens
DENSCEGMS

SEQ ID NO: 1055663 - protein, 9 aa, Homo Sapiens
ARRHHQFFE

SEQ ID NO: 1055664 - protein, 9 aa, Homo Sapiens
EIIFPRGLE

SEQ ID NO: 1055665 - protein, 9 aa, Homo Sapiens
HSPEHRQTA

SEQ ID NO: 1055666 - protein, 9 aa, Homo Sapiens
GKTSTDLVQ

SEQ ID NO: 1055667 - protein, 9 aa, Homo Sapiens
NFRILFNNA

SEQ ID NO: 1055668 - protein, 9 aa, Homo Sapiens
TPEKSFTRS

SEQ ID NO: 1055669 - protein, 9 aa, Homo Sapiens
AFPGTSSAV

SEQ ID NO: 1055670 - protein, 9 aa, Homo Sapiens
EQVWKRDQK

SEQ ID NO: 1055671 - protein, 9 aa, Homo Sapiens
GEKQYQCKV

SEQ ID NO: 1055672 - protein, 9 aa, Homo Sapiens
GYSHDSLPC

SEQ ID NO: 1055673 - protein, 9 aa, Homo Sapiens
GDFTQSFDS

SEQ ID NO: 1055674 - protein, 9 aa, Homo Sapiens
PGEAGTDGY

SEQ ID NO: 1055675 - protein, 9 aa, Homo Sapiens
KDEKSSTEQ

SEQ ID NO: 1055676 - protein, 9 aa, Homo Sapiens
VGLFFPTVC

SEQ ID NO: 1055677 - protein, 9 aa, Homo Sapiens
PLFQTSHKD

SEQ ID NO: 1055678 - protein, 9 aa, Homo Sapiens
GGKNMELSF

SEQ ID NO: 1055679 - protein, 9 aa, Homo Sapiens
PEKAHAHCR

SEQ ID NO: 1055680 - protein, 9 aa, Homo Sapiens
GGTSLLSVY

SEQ ID NO: 1055681 - protein, 9 aa, Homo Sapiens
FFLRCLEKW

SEQ ID NO: 1055682 - protein, 9 aa, Homo Sapiens
HEKQRRKDK

SEQ ID NO: 1055683 - protein, 9 aa, Homo Sapiens
SVHLHFFFA

SEQ ID NO: 1055684 - protein, 9 aa, Homo Sapiens
NKDLKKHVL

SEQ ID NO: 1055685 - protein, 9 aa, Homo Sapiens
GEGFRCLCH

SEQ ID NO: 1055686 - protein, 9 aa, Homo Sapiens
DVLRTCVKT

SEQ ID NO: 1055687 - protein, 9 aa, Homo Sapiens
NLQRHRKIY

SEQ ID NO: 1055688 - protein, 9 aa, Homo Sapiens
RMSSTRIQD

SEQ ID NO: 1055689 - protein, 9 aa, Homo Sapiens
HCKGHPNPT

SEQ ID NO: 1055690 - protein, 9 aa, Homo Sapiens
WHLFRRYMA

SEQ ID NO: 1055691 - protein, 9 aa, Homo Sapiens
GNLKGTEIS

SEQ ID NO: 1055692 - protein, 9 aa, Homo Sapiens
LRKITDQEH

SEQ ID NO: 1055693 - protein, 9 aa, Homo Sapiens
VINKEFCVR

SEQ ID NO: 1055694 - protein, 9 aa, Homo Sapiens
AEAERSSLL

SEQ ID NO: 1055695 - protein, 9 aa, Homo Sapiens
YKQGYQKQL

SEQ ID NO: 1055696 - protein, 9 aa, Homo Sapiens
KVQAKICKM

SEQ ID NO: 1055697 - protein, 9 aa, Homo Sapiens
QVWGFNFGS

SEQ ID NO: 1055698 - protein, 9 aa, Homo Sapiens
VISLPTLRE

SEQ ID NO: 1055699 - protein, 9 aa, Homo Sapiens
KLASGCDGL

SEQ ID NO: 1055700 - protein, 9 aa, Homo Sapiens
MDPKKSQKE

SEQ ID NO: 1055701 - protein, 9 aa, Homo Sapiens
VEDQGVFTQ

SEQ ID NO: 1055702 - protein, 9 aa, Homo Sapiens
LKIRNPAIQ

SEQ ID NO: 1055703 - protein, 9 aa, Homo Sapiens
TDPATLLYL

SEQ ID NO: 1055704 - protein, 9 aa, Homo Sapiens
CELSRAGAL

SEQ ID NO: 1055705 - protein, 9 aa, Homo Sapiens
QRMPAILVN

SEQ ID NO: 1055706 - protein, 9 aa, Homo Sapiens
YSCPCTDNL

SEQ ID NO: 1055707 - protein, 9 aa, Homo Sapiens
YNAWLLYEL

SEQ ID NO: 1055708 - protein, 9 aa, Homo Sapiens
DREASTLQV

SEQ ID NO: 1055709 - protein, 9 aa, Homo Sapiens
DDDKIIQLV

SEQ ID NO: 1055710 - protein, 9 aa, Homo Sapiens
SGPEGNVQN

SEQ ID NO: 1055711 - protein, 9 aa, Homo Sapiens
LSTDYHIFL

SEQ ID NO: 1055712 - protein, 9 aa, Homo Sapiens
PGVCYPVLT

SEQ ID NO: 1055713 - protein, 9 aa, Homo Sapiens
SIAATCNNP

SEQ ID NO: 1055714 - protein, 9 aa, Homo Sapiens
LRKKIRSFV

SEQ ID NO: 1055715 - protein, 9 aa, Homo Sapiens
TISLTAPTS

SEQ ID NO: 1055716 - protein, 9 aa, Homo Sapiens
YLGTFALIG

SEQ ID NO: 1055717 - protein, 9 aa, Homo Sapiens
FGIVAHKLG

SEQ ID NO: 1055718 - protein, 9 aa, Homo Sapiens
HVHSLWVCV

SEQ ID NO: 1055719 - protein, 9 aa, Homo Sapiens
TFGRGDTDL

SEQ ID NO: 1055720 - protein, 9 aa, Homo Sapiens
LHRHFLGED

SEQ ID NO: 1055721 - protein, 9 aa, Homo Sapiens
TSQASCVDG

SEQ ID NO: 1055722 - protein, 9 aa, Homo Sapiens
ESPFSSHAQ

SEQ ID NO: 1055723 - protein, 9 aa, Homo Sapiens
GITYYLLLG

SEQ ID NO: 1055724 - protein, 9 aa, Homo Sapiens
EDEVKKYLD

SEQ ID NO: 1055725 - protein, 9 aa, Homo Sapiens
LAGVNCSFE

SEQ ID NO: 1055726 - protein, 9 aa, Homo Sapiens
VTRLSDGNI

SEQ ID NO: 1055727 - protein, 9 aa, Homo Sapiens
NPRLQSARR

SEQ ID NO: 1055728 - protein, 9 aa, Homo Sapiens
FSGEASVNL

SEQ ID NO: 1055729 - protein, 9 aa, Homo Sapiens
TFEAPFGLD

SEQ ID NO: 1055730 - protein, 9 aa, Homo Sapiens
RLISCCKPA

SEQ ID NO: 1055731 - protein, 9 aa, Homo Sapiens
KMVGSNQRQ

SEQ ID NO: 1055732 - protein, 9 aa, Homo Sapiens
GCRKISVLV

SEQ ID NO: 1055733 - protein, 9 aa, Homo Sapiens
QNFNDASPT

SEQ ID NO: 1055734 - protein, 9 aa, Homo Sapiens
PHPIDGPPG

SEQ ID NO: 1055735 - protein, 9 aa, Homo Sapiens
LVYRIIPPT

SEQ ID NO: 1055736 - protein, 9 aa, Homo Sapiens
ASIFSLKKI

SEQ ID NO: 1055737 - protein, 9 aa, Homo Sapiens
LFLIFYYSK

SEQ ID NO: 1055738 - protein, 9 aa, Homo Sapiens
KLDFKKIKS

SEQ ID NO: 1055739 - protein, 9 aa, Homo Sapiens
DLQREKDAL

SEQ ID NO: 1055740 - protein, 9 aa, Homo Sapiens
LDESKMFQS

SEQ ID NO: 1055741 - protein, 9 aa, Homo Sapiens
TSSSADSEK

SEQ ID NO: 1055742 - protein, 9 aa, Homo Sapiens
EPMKKLSSK

SEQ ID NO: 1055743 - protein, 9 aa, Homo Sapiens
YRLLAKKRK

SEQ ID NO: 1055744 - protein, 9 aa, Homo Sapiens
CIQKVEVNC

SEQ ID NO: 1055745 - protein, 9 aa, Homo Sapiens
LFFVYMCYE

SEQ ID NO: 1055746 - protein, 9 aa, Homo Sapiens
SKSFTVAEL

SEQ ID NO: 1055747 - protein, 9 aa, Homo Sapiens
SKTNEELLR

SEQ ID NO: 1055748 - protein, 9 aa, Homo Sapiens
SHEFKTEEK

SEQ ID NO: 1055749 - protein, 9 aa, Homo Sapiens
MSPLDMLEP

SEQ ID NO: 1055750 - protein, 9 aa, Homo Sapiens
DILEPLCSD

SEQ ID NO: 1055751 - protein, 9 aa, Homo Sapiens
SCHAFCYTC

SEQ ID NO: 1055752 - protein, 9 aa, Homo Sapiens
CQPPAEIPS

SEQ ID NO: 1055753 - protein, 9 aa, Homo Sapiens
AAVVDASFV

SEQ ID NO: 1055754 - protein, 9 aa, Homo Sapiens
FHFRVAAPN

SEQ ID NO: 1055755 - protein, 9 aa, Homo Sapiens
GFSGLSMDL

SEQ ID NO: 1055756 - protein, 9 aa, Homo Sapiens
SNLTRMLLP

SEQ ID NO: 1055757 - protein, 9 aa, Homo Sapiens
EIDFRGGPA

SEQ ID NO: 1055758 - protein, 9 aa, Homo Sapiens
VKNNFRILF

SEQ ID NO: 1055759 - protein, 9 aa, Homo Sapiens
NYFVLFEVI

SEQ ID NO: 1055760 - protein, 9 aa, Homo Sapiens
IEVPPQFLR

SEQ ID NO: 1055761 - protein, 9 aa, Homo Sapiens
GIKKYRYNP

SEQ ID NO: 1055762 - protein, 9 aa, Homo Sapiens
IINSKQMES

SEQ ID NO: 1055763 - protein, 9 aa, Homo Sapiens
KMAMSHEFK

SEQ ID NO: 1055764 - protein, 9 aa, Homo Sapiens
VTLIENAII

SEQ ID NO: 1055765 - protein, 9 aa, Homo Sapiens
ARKTEAREL

SEQ ID NO: 1055766 - protein, 9 aa, Homo Sapiens
LYLVQQLEQ

SEQ ID NO: 1055767 - protein, 9 aa, Homo Sapiens
KGYFLAEGD

SEQ ID NO: 1055768 - protein, 9 aa, Homo Sapiens
NIIHSLIKS

SEQ ID NO: 1055769 - protein, 9 aa, Homo Sapiens
TIFLLVTAK

SEQ ID NO: 1055770 - protein, 9 aa, Homo Sapiens
SKKKSCFEL

SEQ ID NO: 1055771 - protein, 9 aa, Homo Sapiens
SQKNTIVLE

SEQ ID NO: 1055772 - protein, 9 aa, Homo Sapiens
ETDTILESP

SEQ ID NO: 1055773 - protein, 9 aa, Homo Sapiens
KETCGHRDP

SEQ ID NO: 1055774 - protein, 9 aa, Homo Sapiens
FKGKIVMYK

SEQ ID NO: 1055775 - protein, 9 aa, Homo Sapiens
MEAIQVQRE

SEQ ID NO: 1055776 - protein, 9 aa, Homo Sapiens
AERPSLVCH

SEQ ID NO: 1055777 - protein, 9 aa, Homo Sapiens
QSPNGTLLI

SEQ ID NO: 1055778 - protein, 9 aa, Homo Sapiens
RNVVYSIFY

SEQ ID NO: 1055779 - protein, 9 aa, Homo Sapiens
QYLSLLFFR

SEQ ID NO: 1055780 - protein, 9 aa, Homo Sapiens
NGSRPRKEW

SEQ ID NO: 1055781 - protein, 9 aa, Homo Sapiens
PKPGSEKWV

SEQ ID NO: 1055782 - protein, 9 aa, Homo Sapiens
TILSEGLFM

SEQ ID NO: 1055783 - protein, 9 aa, Homo Sapiens
SLPPKNPFY

SEQ ID NO: 1055784 - protein, 9 aa, Homo Sapiens
ECGKASNRS

SEQ ID NO: 1055785 - protein, 9 aa, Homo Sapiens
LKKEIANAT

SEQ ID NO: 1055786 - protein, 9 aa, Homo Sapiens
SLGSQESGL

SEQ ID NO: 1055787 - protein, 9 aa, Homo Sapiens
SMKLKKEEF

SEQ ID NO: 1055788 - protein, 9 aa, Homo Sapiens
RGMAPDSKT

SEQ ID NO: 1055789 - protein, 9 aa, Homo Sapiens
FLFSSSLAG

SEQ ID NO: 1055790 - protein, 9 aa, Homo Sapiens
WLFFLHPIL

SEQ ID NO: 1055791 - protein, 9 aa, Homo Sapiens
SQNNLTKIV

SEQ ID NO: 1055792 - protein, 9 aa, Homo Sapiens
KKFSPGHVI

SEQ ID NO: 1055793 - protein, 9 aa, Homo Sapiens
LAALRQEPE

SEQ ID NO: 1055794 - protein, 9 aa, Homo Sapiens
ESSKKEEED

SEQ ID NO: 1055795 - protein, 9 aa, Homo Sapiens
TPVTAYNLY

SEQ ID NO: 1055796 - protein, 9 aa, Homo Sapiens
DTSVLVFTW

SEQ ID NO: 1055797 - protein, 9 aa, Homo Sapiens
SLPQPTPQM

SEQ ID NO: 1055798 - protein, 9 aa, Homo Sapiens
RAIQPGPRQ

SEQ ID NO: 1055799 - protein, 9 aa, Homo Sapiens
RANDCGALK

SEQ ID NO: 1055800 - protein, 9 aa, Homo Sapiens
MMREICKVL

SEQ ID NO: 1055801 - protein, 9 aa, Homo Sapiens
VSVYNSYSY

SEQ ID NO: 1055802 - protein, 9 aa, Homo Sapiens
PLVPDSIKF

SEQ ID NO: 1055803 - protein, 9 aa, Homo Sapiens
EYNEIVKRK

SEQ ID NO: 1055804 - protein, 9 aa, Homo Sapiens
YVYKERFPK

SEQ ID NO: 1055805 - protein, 9 aa, Homo Sapiens
LLTIWLHDP

SEQ ID NO: 1055806 - protein, 9 aa, Homo Sapiens
FILLLLSRE

SEQ ID NO: 1055807 - protein, 9 aa, Homo Sapiens
LGVSFQGGQ

SEQ ID NO: 1055808 - protein, 9 aa, Homo Sapiens
AKLGALYRT

SEQ ID NO: 1055809 - protein, 9 aa, Homo Sapiens
TQENMGFSC

SEQ ID NO: 1055810 - protein, 9 aa, Homo Sapiens
VIMKKFYVL

SEQ ID NO: 1055811 - protein, 9 aa, Homo Sapiens
GSGSKVDFR

SEQ ID NO: 1055812 - protein, 9 aa, Homo Sapiens
IKSPIIIIT

SEQ ID NO: 1055813 - protein, 9 aa, Homo Sapiens
ASIISLFLI

SEQ ID NO: 1055814 - protein, 9 aa, Homo Sapiens
NLWEKLRKK

SEQ ID NO: 1055815 - protein, 9 aa, Homo Sapiens
LDPRTTMIL

SEQ ID NO: 1055816 - protein, 9 aa, Homo Sapiens
SWHNDLTQY

SEQ ID NO: 1055817 - protein, 9 aa, Homo Sapiens
LGESGELDF

SEQ ID NO: 1055818 - protein, 9 aa, Homo Sapiens
EKIPKLRRR

SEQ ID NO: 1055819 - protein, 9 aa, Homo Sapiens
RVCSSCHAF

SEQ ID NO: 1055820 - protein, 9 aa, Homo Sapiens
PTPNPRLQS

SEQ ID NO: 1055821 - protein, 9 aa, Homo Sapiens
FIALVYVDG

SEQ ID NO: 1055822 - protein, 9 aa, Homo Sapiens
LRKLIFEVD

SEQ ID NO: 1055823 - protein, 9 aa, Homo Sapiens
RFTAICYLL

SEQ ID NO: 1055824 - protein, 9 aa, Homo Sapiens
KADSPRHRL

SEQ ID NO: 1055825 - protein, 9 aa, Homo Sapiens
TDTTNKALG

SEQ ID NO: 1055826 - protein, 9 aa, Homo Sapiens
LHLQGKVKG

SEQ ID NO: 1055827 - protein, 9 aa, Homo Sapiens
SVDWAPFLL

SEQ ID NO: 1055828 - protein, 9 aa, Homo Sapiens
EKLYVCNEC

SEQ ID NO: 1055829 - protein, 9 aa, Homo Sapiens
LVVFFGFLL

SEQ ID NO: 1055830 - protein, 9 aa, Homo Sapiens
YNVRNLIDL

SEQ ID NO: 1055831 - protein, 9 aa, Homo Sapiens
SGLTSKNKN

SEQ ID NO: 1055832 - protein, 9 aa, Homo Sapiens
RQSRSFTCN

SEQ ID NO: 1055833 - protein, 9 aa, Homo Sapiens
QCTKVEKDF

SEQ ID NO: 1055834 - protein, 9 aa, Homo Sapiens
AEKLEMEIA

SEQ ID NO: 1055835 - protein, 9 aa, Homo Sapiens
ACTLTAHKG

SEQ ID NO: 1055836 - protein, 9 aa, Homo Sapiens
EDILKNLAE

SEQ ID NO: 1055837 - protein, 9 aa, Homo Sapiens
ALLYQARKK

SEQ ID NO: 1055838 - protein, 9 aa, Homo Sapiens
KFSGPSFPK

SEQ ID NO: 1055839 - protein, 9 aa, Homo Sapiens
ILSGQKEGV

SEQ ID NO: 1055840 - protein, 9 aa, Homo Sapiens
NTLQKAEKL

SEQ ID NO: 1055841 - protein, 9 aa, Homo Sapiens
NEQAGGGGG

SEQ ID NO: 1055842 - protein, 9 aa, Homo Sapiens
TTCQASGDL

SEQ ID NO: 1055843 - protein, 9 aa, Homo Sapiens
WLEGEINTY

SEQ ID NO: 1055844 - protein, 9 aa, Homo Sapiens
GFQTFQHSG

SEQ ID NO: 1055845 - protein, 9 aa, Homo Sapiens
DLTLLSLKS

SEQ ID NO: 1055846 - protein, 9 aa, Homo Sapiens
GFELTFCLK

SEQ ID NO: 1055847 - protein, 9 aa, Homo Sapiens
EEYQNKKKE

SEQ ID NO: 1055848 - protein, 9 aa, Homo Sapiens
CFVPYNSVF

SEQ ID NO: 1055849 - protein, 9 aa, Homo Sapiens
NSLTEAVLL

SEQ ID NO: 1055850 - protein, 9 aa, Homo Sapiens
AGKFLFYQR

SEQ ID NO: 1055851 - protein, 9 aa, Homo Sapiens
YTMDPSVKW

SEQ ID NO: 1055852 - protein, 9 aa, Homo Sapiens
PHTSEFKRA

SEQ ID NO: 1055853 - protein, 9 aa, Homo Sapiens
DISLTGNPV

SEQ ID NO: 1055854 - protein, 9 aa, Homo Sapiens
EERCIACTL

SEQ ID NO: 1055855 - protein, 9 aa, Homo Sapiens
NAFLPPGNF

SEQ ID NO: 1055856 - protein, 9 aa, Homo Sapiens
HIRAEPFQD

SEQ ID NO: 1055857 - protein, 9 aa, Homo Sapiens
VLPAGGVIG

SEQ ID NO: 1055858 - protein, 9 aa, Homo Sapiens
CFLFNLSSI

SEQ ID NO: 1055859 - protein, 9 aa, Homo Sapiens
DSAFFDCYD

SEQ ID NO: 1055860 - protein, 9 aa, Homo Sapiens
RKFKKMSNR

SEQ ID NO: 1055861 - protein, 9 aa, Homo Sapiens
KVWKVEQKH

SEQ ID NO: 1055862 - protein, 9 aa, Homo Sapiens
SFTDVVTTN

SEQ ID NO: 1055863 - protein, 9 aa, Homo Sapiens
PESQVLLTP

SEQ ID NO: 1055864 - protein, 9 aa, Homo Sapiens
QGREVSIEG

SEQ ID NO: 1055865 - protein, 9 aa, Homo Sapiens
GNKTENENE

SEQ ID NO: 1055866 - protein, 9 aa, Homo Sapiens
TSRSKERSF

SEQ ID NO: 1055867 - protein, 9 aa, Homo Sapiens
SKAYPFSLS

SEQ ID NO: 1055868 - protein, 9 aa, Homo Sapiens
GAGIKDANC

SEQ ID NO: 1055869 - protein, 9 aa, Homo Sapiens
NCKPADENS

SEQ ID NO: 1055870 - protein, 9 aa, Homo Sapiens
FFWRMVEEQ

SEQ ID NO: 1055871 - protein, 9 aa, Homo Sapiens
KNLLKLEKL

SEQ ID NO: 1055872 - protein, 9 aa, Homo Sapiens
FNWYVDGVK

SEQ ID NO: 1055873 - protein, 9 aa, Homo Sapiens
ISKVLLMEK

SEQ ID NO: 1055874 - protein, 9 aa, Homo Sapiens
CEECSEKIA

SEQ ID NO: 1055875 - protein, 9 aa, Homo Sapiens
GFPGILEFF

SEQ ID NO: 1055876 - protein, 9 aa, Homo Sapiens
LDSHLHTLM

SEQ ID NO: 1055877 - protein, 9 aa, Homo Sapiens
LTQNWVQKK

SEQ ID NO: 1055878 - protein, 9 aa, Homo Sapiens
DYEEQTDKY

SEQ ID NO: 1055879 - protein, 9 aa, Homo Sapiens
GNQVEKFIN

SEQ ID NO: 1055880 - protein, 9 aa, Homo Sapiens
SGCLGLVPR

SEQ ID NO: 1055881 - protein, 9 aa, Homo Sapiens
TLYDKVTHG

SEQ ID NO: 1055882 - protein, 9 aa, Homo Sapiens
CSAETHSLP

SEQ ID NO: 1055883 - protein, 9 aa, Homo Sapiens
IEDQSIMGK

SEQ ID NO: 1055884 - protein, 9 aa, Homo Sapiens
VSSLSSPAF

SEQ ID NO: 1055885 - protein, 9 aa, Homo Sapiens
RAETPYMMM

SEQ ID NO: 1055886 - protein, 9 aa, Homo Sapiens
RQRDEQLTF

SEQ ID NO: 1055887 - protein, 9 aa, Homo Sapiens
LKQIGNVKK

SEQ ID NO: 1055888 - protein, 9 aa, Homo Sapiens
DLETCVIQE

SEQ ID NO: 1055889 - protein, 9 aa, Homo Sapiens
SKSKSPSLL

SEQ ID NO: 1055890 - protein, 9 aa, Homo Sapiens
KFYLLDVYV

SEQ ID NO: 1055891 - protein, 9 aa, Homo Sapiens
QIGNVKKLG

SEQ ID NO: 1055892 - protein, 9 aa, Homo Sapiens
KFLWAGVVV

SEQ ID NO: 1055893 - protein, 9 aa, Homo Sapiens
RGSSRAIFF

SEQ ID NO: 1055894 - protein, 9 aa, Homo Sapiens
LTNFPKNGT

SEQ ID NO: 1055895 - protein, 9 aa, Homo Sapiens
YDDTLVYRI

SEQ ID NO: 1055896 - protein, 9 aa, Homo Sapiens
GSAEPALEF

SEQ ID NO: 1055897 - protein, 9 aa, Homo Sapiens
AESLSPIGH

SEQ ID NO: 1055898 - protein, 9 aa, Homo Sapiens
AEDGWRSFS

SEQ ID NO: 1055899 - protein, 9 aa, Homo Sapiens
QPAVFSPSF

SEQ ID NO: 1055900 - protein, 9 aa, Homo Sapiens
LPAILPTNA

SEQ ID NO: 1055901 - protein, 9 aa, Homo Sapiens
LLTKPKVCW

SEQ ID NO: 1055902 - protein, 9 aa, Homo Sapiens
MALSQGHLT

SEQ ID NO: 1055903 - protein, 9 aa, Homo Sapiens
RYVPLEDQR

SEQ ID NO: 1055904 - protein, 9 aa, Homo Sapiens
KKSLDNRNW

SEQ ID NO: 1055905 - protein, 9 aa, Homo Sapiens
ISVVAITAN

SEQ ID NO: 1055906 - protein, 9 aa, Homo Sapiens
VTVLDPFSG

SEQ ID NO: 1055907 - protein, 9 aa, Homo Sapiens
QQSYGEEKA

SEQ ID NO: 1055908 - protein, 9 aa, Homo Sapiens
TCILSPKRA

SEQ ID NO: 1055909 - protein, 9 aa, Homo Sapiens
MTFRRQVKN

SEQ ID NO: 1055910 - protein, 9 aa, Homo Sapiens
KFKKTSICK

SEQ ID NO: 1055911 - protein, 9 aa, Homo Sapiens
ILNGGVYVN

SEQ ID NO: 1055912 - protein, 9 aa, Homo Sapiens
LKKSTLDEC

SEQ ID NO: 1055913 - protein, 9 aa, Homo Sapiens
FMGNMLCGI

SEQ ID NO: 1055914 - protein, 9 aa, Homo Sapiens
TELQALLFF

SEQ ID NO: 1055915 - protein, 9 aa, Homo Sapiens
KPLFQTSHK

SEQ ID NO: 1055916 - protein, 9 aa, Homo Sapiens
HMNKTSHTQ

SEQ ID NO: 1055917 - protein, 9 aa, Homo Sapiens
RKSTMFHAT

SEQ ID NO: 1055918 - protein, 9 aa, Homo Sapiens
EILYQSADC

SEQ ID NO: 1055919 - protein, 9 aa, Homo Sapiens
NLTRMLLPP

SEQ ID NO: 1055920 - protein, 9 aa, Homo Sapiens
FFRRRSCPS

SEQ ID NO: 1055921 - protein, 9 aa, Homo Sapiens
LSLSPSICG

SEQ ID NO: 1055922 - protein, 9 aa, Homo Sapiens
DWCLRVEKF

SEQ ID NO: 1055923 - protein, 9 aa, Homo Sapiens
QRTHTQEKS

SEQ ID NO: 1055924 - protein, 9 aa, Homo Sapiens
SLSMQILGM

SEQ ID NO: 1055925 - protein, 9 aa, Homo Sapiens
MLKSFQGTH

SEQ ID NO: 1055926 - protein, 9 aa, Homo Sapiens
NEIVKRKDL

SEQ ID NO: 1055927 - protein, 9 aa, Homo Sapiens
SSCMQLGVM

SEQ ID NO: 1055928 - protein, 9 aa, Homo Sapiens
QFYSKVLGR

SEQ ID NO: 1055929 - protein, 9 aa, Homo Sapiens
DIFAFLVQN

SEQ ID NO: 1055930 - protein, 9 aa, Homo Sapiens
DCHFGTPLL

SEQ ID NO: 1055931 - protein, 9 aa, Homo Sapiens
GFSTNEPSG

SEQ ID NO: 1055932 - protein, 9 aa, Homo Sapiens
ISSKAASFF

SEQ ID NO: 1055933 - protein, 9 aa, Homo Sapiens
MCYTTHGLK

SEQ ID NO: 1055934 - protein, 9 aa, Homo Sapiens
NDFLIFKKS

SEQ ID NO: 1055935 - protein, 9 aa, Homo Sapiens
SNLVSQNIN

SEQ ID NO: 1055936 - protein, 9 aa, Homo Sapiens
GFNSKSEKR

SEQ ID NO: 1055937 - protein, 9 aa, Homo Sapiens
TQKENISLF

SEQ ID NO: 1055938 - protein, 9 aa, Homo Sapiens
TAGAGIKDA

SEQ ID NO: 1055939 - protein, 9 aa, Homo Sapiens
FKKKAGHDQ

SEQ ID NO: 1055940 - protein, 9 aa, Homo Sapiens
DFYCWVCYR

SEQ ID NO: 1055941 - protein, 9 aa, Homo Sapiens
EDKELERVI

SEQ ID NO: 1055942 - protein, 9 aa, Homo Sapiens
ASEEKQPWA

SEQ ID NO: 1055943 - protein, 9 aa, Homo Sapiens
RSTFNHHQQ

SEQ ID NO: 1055944 - protein, 9 aa, Homo Sapiens
RGQKGRPGA

SEQ ID NO: 1055945 - protein, 9 aa, Homo Sapiens
LRNVLVVFF

SEQ ID NO: 1055946 - protein, 9 aa, Homo Sapiens
RESDSSPKT

SEQ ID NO: 1055947 - protein, 9 aa, Homo Sapiens
SSEKQICGM

SEQ ID NO: 1055948 - protein, 9 aa, Homo Sapiens
MAMNEEQVH

SEQ ID NO: 1055949 - protein, 9 aa, Homo Sapiens
SVEKTVSSI

SEQ ID NO: 1055950 - protein, 9 aa, Homo Sapiens
DEFEEFLAE

SEQ ID NO: 1055951 - protein, 9 aa, Homo Sapiens
YVFNQGPSV

SEQ ID NO: 1055952 - protein, 9 aa, Homo Sapiens
GVSLQYVFN

SEQ ID NO: 1055953 - protein, 9 aa, Homo Sapiens
AFCVIVCNK

SEQ ID NO: 1055954 - protein, 9 aa, Homo Sapiens
RLDCGRPRG

SEQ ID NO: 1055955 - protein, 9 aa, Homo Sapiens
DGLEIPDEV

SEQ ID NO: 1055956 - protein, 9 aa, Homo Sapiens
APFPCIPKS

SEQ ID NO: 1055957 - protein, 9 aa, Homo Sapiens
LIDKSEKLE

SEQ ID NO: 1055958 - protein, 9 aa, Homo Sapiens
EIEVKLYNL

SEQ ID NO: 1055959 - protein, 9 aa, Homo Sapiens
TPKEDGITW

SEQ ID NO: 1055960 - protein, 9 aa, Homo Sapiens
IASKRERVK

SEQ ID NO: 1055961 - protein, 9 aa, Homo Sapiens
FFLTELISS

SEQ ID NO: 1055962 - protein, 9 aa, Homo Sapiens
EQKLQDLQR

SEQ ID NO: 1055963 - protein, 9 aa, Homo Sapiens
YEQVYKGRH

SEQ ID NO: 1055964 - protein, 9 aa, Homo Sapiens
VFTRLDGFM

SEQ ID NO: 1055965 - protein, 9 aa, Homo Sapiens
SKFQLDVAS

SEQ ID NO: 1055966 - protein, 9 aa, Homo Sapiens
TQPSSGPGQ

SEQ ID NO: 1055967 - protein, 9 aa, Homo Sapiens
FSLDEIAGP

SEQ ID NO: 1055968 - protein, 9 aa, Homo Sapiens
LIDDKIRKM

SEQ ID NO: 1055969 - protein, 9 aa, Homo Sapiens
PVGPYFSSE

SEQ ID NO: 1055970 - protein, 9 aa, Homo Sapiens
KTGEHQPLK

SEQ ID NO: 1055971 - protein, 9 aa, Homo Sapiens
LLHTPILLV

SEQ ID NO: 1055972 - protein, 9 aa, Homo Sapiens
TETLNREEV

SEQ ID NO: 1055973 - protein, 9 aa, Homo Sapiens
RGQLEERMI

SEQ ID NO: 1055974 - protein, 9 aa, Homo Sapiens
QSPTNSTGM

SEQ ID NO: 1055975 - protein, 9 aa, Homo Sapiens
WPASGHFHL

SEQ ID NO: 1055976 - protein, 9 aa, Homo Sapiens
PYSLLRPEN

SEQ ID NO: 1055977 - protein, 9 aa, Homo Sapiens
LDLASADFP

SEQ ID NO: 1055978 - protein, 9 aa, Homo Sapiens
KEHYQDFRT

SEQ ID NO: 1055979 - protein, 9 aa, Homo Sapiens
KIPKTKALK

SEQ ID NO: 1055980 - protein, 9 aa, Homo Sapiens
MRKSSSGNK

SEQ ID NO: 1055981 - protein, 9 aa, Homo Sapiens
TVVLEGPDR

SEQ ID NO: 1055982 - protein, 9 aa, Homo Sapiens
LTPKPSPAL

SEQ ID NO: 1055983 - protein, 9 aa, Homo Sapiens
LWKCPSNKQ

SEQ ID NO: 1055984 - protein, 9 aa, Homo Sapiens
KNNFRILFN

SEQ ID NO: 1055985 - protein, 9 aa, Homo Sapiens
LQPGTEYCL

SEQ ID NO: 1055986 - protein, 9 aa, Homo Sapiens
LEGPDRIGK

SEQ ID NO: 1055987 - protein, 9 aa, Homo Sapiens
WPAPSTKTK

SEQ ID NO: 1055988 - protein, 9 aa, Homo Sapiens
WKYNRGRQK

SEQ ID NO: 1055989 - protein, 9 aa, Homo Sapiens
RGGRARRQQ

SEQ ID NO: 1055990 - protein, 9 aa, Homo Sapiens
PNYSYAAFC

SEQ ID NO: 1055991 - protein, 9 aa, Homo Sapiens
DLLGAGTKT

SEQ ID NO: 1055992 - protein, 9 aa, Homo Sapiens
QDSWRGPSP

SEQ ID NO: 1055993 - protein, 9 aa, Homo Sapiens
PPQKVLFRF

SEQ ID NO: 1055994 - protein, 9 aa, Homo Sapiens
SPNGTLLIY

SEQ ID NO: 1055995 - protein, 9 aa, Homo Sapiens
PRNPDGHSM

SEQ ID NO: 1055996 - protein, 9 aa, Homo Sapiens
QQPRGQLDS

SEQ ID NO: 1055997 - protein, 9 aa, Homo Sapiens
DKELERVIL

SEQ ID NO: 1055998 - protein, 9 aa, Homo Sapiens
FNKAKPIGF

SEQ ID NO: 1055999 - protein, 9 aa, Homo Sapiens
AEEWLFFFL

SEQ ID NO: 1056000 - protein, 9 aa, Homo Sapiens
RMPAILVNI

SEQ ID NO: 1056001 - protein, 9 aa, Homo Sapiens
EVSVGLEPI

SEQ ID NO: 1056002 - protein, 9 aa, Homo Sapiens
PPFYLKKYS

SEQ ID NO: 1056003 - protein, 9 aa, Homo Sapiens
NYMAKFAYW

SEQ ID NO: 1056004 - protein, 9 aa, Homo Sapiens
PRLQSARRL

SEQ ID NO: 1056005 - protein, 9 aa, Homo Sapiens
LYQFKKNPY

SEQ ID NO: 1056006 - protein, 9 aa, Homo Sapiens
IHWKKVSKL

SEQ ID NO: 1056007 - protein, 9 aa, Homo Sapiens
LNPVVLWKF

SEQ ID NO: 1056008 - protein, 9 aa, Homo Sapiens
CINRLQAAL

SEQ ID NO: 1056009 - protein, 9 aa, Homo Sapiens
DSESALVLG

SEQ ID NO: 1056010 - protein, 9 aa, Homo Sapiens
NILIHLSKD

SEQ ID NO: 1056011 - protein, 9 aa, Homo Sapiens
GNNFYVFPG

SEQ ID NO: 1056012 - protein, 9 aa, Homo Sapiens
TVVENGLII

SEQ ID NO: 1056013 - protein, 9 aa, Homo Sapiens
VCYPVLTPN

SEQ ID NO: 1056014 - protein, 9 aa, Homo Sapiens
QANHVSRED

SEQ ID NO: 1056015 - protein, 9 aa, Homo Sapiens
SGNKNDEQD

SEQ ID NO: 1056016 - protein, 9 aa, Homo Sapiens
DLPTARPTE

SEQ ID NO: 1056017 - protein, 9 aa, Homo Sapiens
LAEKLEMEI

SEQ ID NO: 1056018 - protein, 9 aa, Homo Sapiens
FQKPFCGPN

SEQ ID NO: 1056019 - protein, 9 aa, Homo Sapiens
QRSIQVTMV

SEQ ID NO: 1056020 - protein, 9 aa, Homo Sapiens
SKPGVQEEI

SEQ ID NO: 1056021 - protein, 9 aa, Homo Sapiens
RLFFPSIKP

SEQ ID NO: 1056022 - protein, 9 aa, Homo Sapiens
ARSRLITTS

SEQ ID NO: 1056023 - protein, 9 aa, Homo Sapiens
KGLLGQRRP

SEQ ID NO: 1056024 - protein, 9 aa, Homo Sapiens
LFFHTLCDY

SEQ ID NO: 1056025 - protein, 9 aa, Homo Sapiens
NIGGELVYV

SEQ ID NO: 1056026 - protein, 9 aa, Homo Sapiens
TFQHSGILL

SEQ ID NO: 1056027 - protein, 9 aa, Homo Sapiens
PRVFFYQLS

SEQ ID NO: 1056028 - protein, 9 aa, Homo Sapiens
KKKESSKNI

SEQ ID NO: 1056029 - protein, 9 aa, Homo Sapiens
EGAELAARR

SEQ ID NO: 1056030 - protein, 9 aa, Homo Sapiens
PPASPTIIS

SEQ ID NO: 1056031 - protein, 9 aa, Homo Sapiens
WPSTNLFLI

SEQ ID NO: 1056032 - protein, 9 aa, Homo Sapiens
RQRFNRWNE

SEQ ID NO: 1056033 - protein, 9 aa, Homo Sapiens
MEEMPVGTK

SEQ ID NO: 1056034 - protein, 9 aa, Homo Sapiens
HQQPWRPGI

SEQ ID NO: 1056035 - protein, 9 aa, Homo Sapiens
TELISSLCS

SEQ ID NO: 1056036 - protein, 9 aa, Homo Sapiens
SNKGAKGSR

SEQ ID NO: 1056037 - protein, 9 aa, Homo Sapiens
DEELLGQRN

SEQ ID NO: 1056038 - protein, 9 aa, Homo Sapiens
DLGPAQIIS

SEQ ID NO: 1056039 - protein, 9 aa, Homo Sapiens
VTDVKSASK

SEQ ID NO: 1056040 - protein, 9 aa, Homo Sapiens
RKWRQLTKK

SEQ ID NO: 1056041 - protein, 9 aa, Homo Sapiens
LSPTIKEKV

SEQ ID NO: 1056042 - protein, 9 aa, Homo Sapiens
ETKSKLAAR

SEQ ID NO: 1056043 - protein, 9 aa, Homo Sapiens
WLAVVIRIK

SEQ ID NO: 1056044 - protein, 9 aa, Homo Sapiens
LPADLKALQ

SEQ ID NO: 1056045 - protein, 9 aa, Homo Sapiens
HHDPEHWPN

SEQ ID NO: 1056046 - protein, 9 aa, Homo Sapiens
ETVVRLYQK

SEQ ID NO: 1056047 - protein, 9 aa, Homo Sapiens
TNDLSDYTA

SEQ ID NO: 1056048 - protein, 9 aa, Homo Sapiens
REHQDRLLE

SEQ ID NO: 1056049 - protein, 9 aa, Homo Sapiens
GEQDKEGAD

SEQ ID NO: 1056050 - protein, 9 aa, Homo Sapiens
TMILFKMLT

SEQ ID NO: 1056051 - protein, 9 aa, Homo Sapiens
AQSPCSVSS

SEQ ID NO: 1056052 - protein, 9 aa, Homo Sapiens
KMLMDFFVE

SEQ ID NO: 1056053 - protein, 9 aa, Homo Sapiens
HECLAAKKA

SEQ ID NO: 1056054 - protein, 9 aa, Homo Sapiens
GIQVTPDKD

SEQ ID NO: 1056055 - protein, 9 aa, Homo Sapiens
SIDLGKDDM

SEQ ID NO: 1056056 - protein, 9 aa, Homo Sapiens
DFTVKIWDI

SEQ ID NO: 1056057 - protein, 9 aa, Homo Sapiens
QSRPEACSD

SEQ ID NO: 1056058 - protein, 9 aa, Homo Sapiens
VFLGTVRED

SEQ ID NO: 1056059 - protein, 9 aa, Homo Sapiens
LHFIALVYV

SEQ ID NO: 1056060 - protein, 9 aa, Homo Sapiens
KICKMKVTK

SEQ ID NO: 1056061 - protein, 9 aa, Homo Sapiens
DSTLAPLTR

SEQ ID NO: 1056062 - protein, 9 aa, Homo Sapiens
STLPREVRG

SEQ ID NO: 1056063 - protein, 9 aa, Homo Sapiens
NQNKFLCYA

SEQ ID NO: 1056064 - protein, 9 aa, Homo Sapiens
IGNQVEKFI

SEQ ID NO: 1056065 - protein, 9 aa, Homo Sapiens
AYPFSLSHS

SEQ ID NO: 1056066 - protein, 9 aa, Homo Sapiens
KKLGGREGL

SEQ ID NO: 1056067 - protein, 9 aa, Homo Sapiens
NFQIRVQVI

SEQ ID NO: 1056068 - protein, 9 aa, Homo Sapiens
DLDALNKAA

SEQ ID NO: 1056069 - protein, 9 aa, Homo Sapiens
EQLRQMHTA

SEQ ID NO: 1056070 - protein, 9 aa, Homo Sapiens
FFKDPIQDG

SEQ ID NO: 1056071 - protein, 9 aa, Homo Sapiens
FSSETFNPV

SEQ ID NO: 1056072 - protein, 9 aa, Homo Sapiens
SVICQDVEN

SEQ ID NO: 1056073 - protein, 9 aa, Homo Sapiens
LKLHQQFET

SEQ ID NO: 1056074 - protein, 9 aa, Homo Sapiens
SLCCFHQDS

SEQ ID NO: 1056075 - protein, 9 aa, Homo Sapiens
LTFTKDKES

SEQ ID NO: 1056076 - protein, 9 aa, Homo Sapiens
SIFLAGKAG

SEQ ID NO: 1056077 - protein, 9 aa, Homo Sapiens
VIDFSKPFI

SEQ ID NO: 1056078 - protein, 9 aa, Homo Sapiens
DRPGEGGGA

SEQ ID NO: 1056079 - protein, 9 aa, Homo Sapiens
NAVYECQAI

SEQ ID NO: 1056080 - protein, 9 aa, Homo Sapiens
PKYRVKKWL

SEQ ID NO: 1056081 - protein, 9 aa, Homo Sapiens
PSPERTADQ

SEQ ID NO: 1056082 - protein, 9 aa, Homo Sapiens
TYTSTAPIA

SEQ ID NO: 1056083 - protein, 9 aa, Homo Sapiens
TMKIPDNPK

SEQ ID NO: 1056084 - protein, 9 aa, Homo Sapiens
NRPLIKLQR

SEQ ID NO: 1056085 - protein, 9 aa, Homo Sapiens
VLYYVTGFF

SEQ ID NO: 1056086 - protein, 9 aa, Homo Sapiens
SSVSSSSDG

SEQ ID NO: 1056087 - protein, 9 aa, Homo Sapiens
ASGDLHYTT

SEQ ID NO: 1056088 - protein, 9 aa, Homo Sapiens
LAGPGGLGN

SEQ ID NO: 1056089 - protein, 9 aa, Homo Sapiens
EKTVSSILS

SEQ ID NO: 1056090 - protein, 9 aa, Homo Sapiens
KKEWSQDFK

SEQ ID NO: 1056091 - protein, 9 aa, Homo Sapiens
SPPSGGGGD

SEQ ID NO: 1056092 - protein, 9 aa, Homo Sapiens
ILLIKRLTF

SEQ ID NO: 1056093 - protein, 9 aa, Homo Sapiens
KPKKIYTGE

SEQ ID NO: 1056094 - protein, 9 aa, Homo Sapiens
PWTSVFSPV

SEQ ID NO: 1056095 - protein, 9 aa, Homo Sapiens
WDIMKYFDL

SEQ ID NO: 1056096 - protein, 9 aa, Homo Sapiens
HREFMGSAC

SEQ ID NO: 1056097 - protein, 9 aa, Homo Sapiens
FLKVAAISE

SEQ ID NO: 1056098 - protein, 9 aa, Homo Sapiens
KLCDEFERI

SEQ ID NO: 1056099 - protein, 9 aa, Homo Sapiens
KTVEKAAAP

SEQ ID NO: 1056100 - protein, 9 aa, Homo Sapiens
LMTEVFCRE

SEQ ID NO: 1056101 - protein, 9 aa, Homo Sapiens
AGRPFCPYL

SEQ ID NO: 1056102 - protein, 9 aa, Homo Sapiens
KKEIANATA

SEQ ID NO: 1056103 - protein, 9 aa, Homo Sapiens
GIKDANCWH

SEQ ID NO: 1056104 - protein, 9 aa, Homo Sapiens
KILLPGRDY

SEQ ID NO: 1056105 - protein, 9 aa, Homo Sapiens
DSHAQHLLV

SEQ ID NO: 1056106 - protein, 9 aa, Homo Sapiens
QTLPDGPSQ

SEQ ID NO: 1056107 - protein, 9 aa, Homo Sapiens
VLEGPDRIG

SEQ ID NO: 1056108 - protein, 9 aa, Homo Sapiens
KTHHQAVIF

SEQ ID NO: 1056109 - protein, 9 aa, Homo Sapiens
LVMIAIEGG

SEQ ID NO: 1056110 - protein, 9 aa, Homo Sapiens
HWNKMLAYP

SEQ ID NO: 1056111 - protein, 9 aa, Homo Sapiens
LIPIVLIFQ

SEQ ID NO: 1056112 - protein, 9 aa, Homo Sapiens
TTPGELPWG

SEQ ID NO: 1056113 - protein, 9 aa, Homo Sapiens
YMETGTLEK

SEQ ID NO: 1056114 - protein, 9 aa, Homo Sapiens
LVLFYMKDV

SEQ ID NO: 1056115 - protein, 9 aa, Homo Sapiens
KDSPAHKVT

SEQ ID NO: 1056116 - protein, 9 aa, Homo Sapiens
IYPTPVELS

SEQ ID NO: 1056117 - protein, 9 aa, Homo Sapiens
RRKRRKFIF

SEQ ID NO: 1056118 - protein, 9 aa, Homo Sapiens
NCGHENLHL

SEQ ID NO: 1056119 - protein, 9 aa, Homo Sapiens
FKYESPENR

SEQ ID NO: 1056120 - protein, 9 aa, Homo Sapiens
YDQNHVTGA

SEQ ID NO: 1056121 - protein, 9 aa, Homo Sapiens
ISTNAEQRG

SEQ ID NO: 1056122 - protein, 9 aa, Homo Sapiens
RFDELKIRN

SEQ ID NO: 1056123 - protein, 9 aa, Homo Sapiens
NVVQNFYNP

SEQ ID NO: 1056124 - protein, 9 aa, Homo Sapiens
TLEKIAEKC

SEQ ID NO: 1056125 - protein, 9 aa, Homo Sapiens
EDFAHFILK

SEQ ID NO: 1056126 - protein, 9 aa, Homo Sapiens
DMNGKSLNG

SEQ ID NO: 1056127 - protein, 9 aa, Homo Sapiens
HGNSYPFDG

SEQ ID NO: 1056128 - protein, 9 aa, Homo Sapiens
AKLSDFESR

SEQ ID NO: 1056129 - protein, 9 aa, Homo Sapiens
DCAPPQHYG

SEQ ID NO: 1056130 - protein, 9 aa, Homo Sapiens
SGHSSINGS

SEQ ID NO: 1056131 - protein, 9 aa, Homo Sapiens
FKRAARVSP

SEQ ID NO: 1056132 - protein, 9 aa, Homo Sapiens
ISFVPVAYD

SEQ ID NO: 1056133 - protein, 9 aa, Homo Sapiens
SPLSGAPGP

SEQ ID NO: 1056134 - protein, 9 aa, Homo Sapiens
EKLEMEIAI

SEQ ID NO: 1056135 - protein, 9 aa, Homo Sapiens
EWTLPRSQS

SEQ ID NO: 1056136 - protein, 9 aa, Homo Sapiens
TQVMRDFLH

SEQ ID NO: 1056137 - protein, 9 aa, Homo Sapiens
CLLSPEDSR

SEQ ID NO: 1056138 - protein, 9 aa, Homo Sapiens
KPAQPPREE

SEQ ID NO: 1056139 - protein, 9 aa, Homo Sapiens
SGVKRGSYY

SEQ ID NO: 1056140 - protein, 9 aa, Homo Sapiens
SCRMKGFSL

SEQ ID NO: 1056141 - protein, 9 aa, Homo Sapiens
GLDEQPGPQ

SEQ ID NO: 1056142 - protein, 9 aa, Homo Sapiens
ECQEMHREF

SEQ ID NO: 1056143 - protein, 9 aa, Homo Sapiens
YEVQSKKYK

SEQ ID NO: 1056144 - protein, 9 aa, Homo Sapiens
PVSQAFPGT

SEQ ID NO: 1056145 - protein, 9 aa, Homo Sapiens
SLEDFFSQG

SEQ ID NO: 1056146 - protein, 9 aa, Homo Sapiens
KNSKYQLLY

SEQ ID NO: 1056147 - protein, 9 aa, Homo Sapiens
YSEKRPYNC

SEQ ID NO: 1056148 - protein, 9 aa, Homo Sapiens
ESDLSLIIL

SEQ ID NO: 1056149 - protein, 9 aa, Homo Sapiens
KLSPEMESF

SEQ ID NO: 1056150 - protein, 9 aa, Homo Sapiens
PEPPEDTKS

SEQ ID NO: 1056151 - protein, 9 aa, Homo Sapiens
KGSCPQENC

SEQ ID NO: 1056152 - protein, 9 aa, Homo Sapiens
PPPPQAQAE

SEQ ID NO: 1056153 - protein, 9 aa, Homo Sapiens
YNRGRQKDD

SEQ ID NO: 1056154 - protein, 9 aa, Homo Sapiens
ISGHVSFFW

SEQ ID NO: 1056155 - protein, 9 aa, Homo Sapiens
SLEMKISFF

SEQ ID NO: 1056156 - protein, 9 aa, Homo Sapiens
RRAIEQLAV

SEQ ID NO: 1056157 - protein, 9 aa, Homo Sapiens
AKFVFVKPL

SEQ ID NO: 1056158 - protein, 9 aa, Homo Sapiens
KGLAWEELA

SEQ ID NO: 1056159 - protein, 9 aa, Homo Sapiens
PKADGPNDV

SEQ ID NO: 1056160 - protein, 9 aa, Homo Sapiens
HKYSYQAPL

SEQ ID NO: 1056161 - protein, 9 aa, Homo Sapiens
ISEQEEKIK

SEQ ID NO: 1056162 - protein, 9 aa, Homo Sapiens
MAKGWGSRA

SEQ ID NO: 1056163 - protein, 9 aa, Homo Sapiens
VSWIKGNSP

SEQ ID NO: 1056164 - protein, 9 aa, Homo Sapiens
GKMLELPKT

SEQ ID NO: 1056165 - protein, 9 aa, Homo Sapiens
AMRRLGLVE

SEQ ID NO: 1056166 - protein, 9 aa, Homo Sapiens
NSLQAMKEI

SEQ ID NO: 1056167 - protein, 9 aa, Homo Sapiens
SSSNTLGIN

SEQ ID NO: 1056168 - protein, 9 aa, Homo Sapiens
RILFFVKPP

SEQ ID NO: 1056169 - protein, 9 aa, Homo Sapiens
TKTLKHVSP

SEQ ID NO: 1056170 - protein, 9 aa, Homo Sapiens
TLSGLTSKN

SEQ ID NO: 1056171 - protein, 9 aa, Homo Sapiens
AEREVTMET

SEQ ID NO: 1056172 - protein, 9 aa, Homo Sapiens
LNGGVYVNQ

SEQ ID NO: 1056173 - protein, 9 aa, Homo Sapiens
IKEVHGNDV

SEQ ID NO: 1056174 - protein, 9 aa, Homo Sapiens
LTPSPLEEM

SEQ ID NO: 1056175 - protein, 9 aa, Homo Sapiens
QKSPICLVQ

SEQ ID NO: 1056176 - protein, 9 aa, Homo Sapiens
CAPNKDAEN

SEQ ID NO: 1056177 - protein, 9 aa, Homo Sapiens
FCVAEMYIP

SEQ ID NO: 1056178 - protein, 9 aa, Homo Sapiens
KEDEVKKYL

SEQ ID NO: 1056179 - protein, 9 aa, Homo Sapiens
VERKKLKLD

SEQ ID NO: 1056180 - protein, 9 aa, Homo Sapiens
TKEAGNGQP

SEQ ID NO: 1056181 - protein, 9 aa, Homo Sapiens
EPEGSELPP

SEQ ID NO: 1056182 - protein, 9 aa, Homo Sapiens
CRPRRKKCR

SEQ ID NO: 1056183 - protein, 9 aa, Homo Sapiens
GLLVGYKLG

SEQ ID NO: 1056184 - protein, 9 aa, Homo Sapiens
EEAGSCGSN

SEQ ID NO: 1056185 - protein, 9 aa, Homo Sapiens
THMCCPSRS

SEQ ID NO: 1056186 - protein, 9 aa, Homo Sapiens
GQKKGWLSI

SEQ ID NO: 1056187 - protein, 9 aa, Homo Sapiens
SCLMTKWGE

SEQ ID NO: 1056188 - protein, 9 aa, Homo Sapiens
RERNFGVRL

SEQ ID NO: 1056189 - protein, 9 aa, Homo Sapiens
TLWNRSTPS

SEQ ID NO: 1056190 - protein, 9 aa, Homo Sapiens
SQASCVDGF

SEQ ID NO: 1056191 - protein, 9 aa, Homo Sapiens
FYQAINDAH

SEQ ID NO: 1056192 - protein, 9 aa, Homo Sapiens
IEEIYVGLE

SEQ ID NO: 1056193 - protein, 9 aa, Homo Sapiens
LGNGLRSLY

SEQ ID NO: 1056194 - protein, 9 aa, Homo Sapiens
DFKKIKSYH

SEQ ID NO: 1056195 - protein, 9 aa, Homo Sapiens
SSDTRSTVS

SEQ ID NO: 1056196 - protein, 9 aa, Homo Sapiens
IVSSATLWN

SEQ ID NO: 1056197 - protein, 9 aa, Homo Sapiens
FETTLEKMV

SEQ ID NO: 1056198 - protein, 9 aa, Homo Sapiens
CTLSQGTLQ

SEQ ID NO: 1056199 - protein, 9 aa, Homo Sapiens
IDEKFKECL

SEQ ID NO: 1056200 - protein, 9 aa, Homo Sapiens
LWKPLPQKR

SEQ ID NO: 1056201 - protein, 9 aa, Homo Sapiens
KASAASASL

SEQ ID NO: 1056202 - protein, 9 aa, Homo Sapiens
EKFLFLYLF

SEQ ID NO: 1056203 - protein, 9 aa, Homo Sapiens
ERVILYPTS

SEQ ID NO: 1056204 - protein, 9 aa, Homo Sapiens
DSHPSYTNT

SEQ ID NO: 1056205 - protein, 9 aa, Homo Sapiens
IVDLLKNLN

SEQ ID NO: 1056206 - protein, 9 aa, Homo Sapiens
ELQPLPASQ

SEQ ID NO: 1056207 - protein, 9 aa, Homo Sapiens
QARWILMLL

SEQ ID NO: 1056208 - protein, 9 aa, Homo Sapiens
SSLKNMDMN

SEQ ID NO: 1056209 - protein, 9 aa, Homo Sapiens
VSLFFFRKL

SEQ ID NO: 1056210 - protein, 9 aa, Homo Sapiens
CRRSCYLTE

SEQ ID NO: 1056211 - protein, 9 aa, Homo Sapiens
TDCSIQDPV

SEQ ID NO: 1056212 - protein, 9 aa, Homo Sapiens
YTGNISLFQ

SEQ ID NO: 1056213 - protein, 9 aa, Homo Sapiens
KNCLKLMKY

SEQ ID NO: 1056214 - protein, 9 aa, Homo Sapiens
PLGLCLVLQ

SEQ ID NO: 1056215 - protein, 9 aa, Homo Sapiens
VQNLERAAL

SEQ ID NO: 1056216 - protein, 9 aa, Homo Sapiens
VDCSLLPKL

SEQ ID NO: 1056217 - protein, 9 aa, Homo Sapiens
GIIFCEGCK

SEQ ID NO: 1056218 - protein, 9 aa, Homo Sapiens
DERSPSAST

SEQ ID NO: 1056219 - protein, 9 aa, Homo Sapiens
YDTEEKGHI

SEQ ID NO: 1056220 - protein, 9 aa, Homo Sapiens
FSITLVLRL

SEQ ID NO: 1056221 - protein, 9 aa, Homo Sapiens
LVLVFGLLF

SEQ ID NO: 1056222 - protein, 9 aa, Homo Sapiens
GEGRLCAKS

SEQ ID NO: 1056223 - protein, 9 aa, Homo Sapiens
WNGLLLTAS

SEQ ID NO: 1056224 - protein, 9 aa, Homo Sapiens
TCAMKWNCA

SEQ ID NO: 1056225 - protein, 9 aa, Homo Sapiens
KELPHFKLV

SEQ ID NO: 1056226 - protein, 9 aa, Homo Sapiens
GLKFPIYFQ

SEQ ID NO: 1056227 - protein, 9 aa, Homo Sapiens
DLCLKKSTL

SEQ ID NO: 1056228 - protein, 9 aa, Homo Sapiens
KYRVKKWLL

SEQ ID NO: 1056229 - protein, 9 aa, Homo Sapiens
REPQKGIQA

SEQ ID NO: 1056230 - protein, 9 aa, Homo Sapiens
PGPLGSSGP

SEQ ID NO: 1056231 - protein, 9 aa, Homo Sapiens
EGYSTLSIS

SEQ ID NO: 1056232 - protein, 9 aa, Homo Sapiens
TKPCHDQEP

SEQ ID NO: 1056233 - protein, 9 aa, Homo Sapiens
DLIKEKKDE

SEQ ID NO: 1056234 - protein, 9 aa, Homo Sapiens
ISHLIKKGV

SEQ ID NO: 1056235 - protein, 9 aa, Homo Sapiens
SRKKSKDQN

SEQ ID NO: 1056236 - protein, 9 aa, Homo Sapiens
SGAGLGVWA

SEQ ID NO: 1056237 - protein, 9 aa, Homo Sapiens
AAPPPEQEE

SEQ ID NO: 1056238 - protein, 9 aa, Homo Sapiens
PQNDITPLH

SEQ ID NO: 1056239 - protein, 9 aa, Homo Sapiens
WQDKDLPRP

SEQ ID NO: 1056240 - protein, 9 aa, Homo Sapiens
DEESVFEKA

SEQ ID NO: 1056241 - protein, 9 aa, Homo Sapiens
PSAYVSFFF

SEQ ID NO: 1056242 - protein, 9 aa, Homo Sapiens
SLEDPVTGD

SEQ ID NO: 1056243 - protein, 9 aa, Homo Sapiens
NVALEFSLE

SEQ ID NO: 1056244 - protein, 9 aa, Homo Sapiens
PLSPTIKEK

SEQ ID NO: 1056245 - protein, 9 aa, Homo Sapiens
STRFHSARS

SEQ ID NO: 1056246 - protein, 9 aa, Homo Sapiens
KGSTRFPGF

SEQ ID NO: 1056247 - protein, 9 aa, Homo Sapiens
SYAAFCECL

SEQ ID NO: 1056248 - protein, 9 aa, Homo Sapiens
YSVEKPYKC

SEQ ID NO: 1056249 - protein, 9 aa, Homo Sapiens
FLDDPLSAV

SEQ ID NO: 1056250 - protein, 9 aa, Homo Sapiens
DFEDITSMN

SEQ ID NO: 1056251 - protein, 9 aa, Homo Sapiens
MSSEKGQAK

SEQ ID NO: 1056252 - protein, 9 aa, Homo Sapiens
DKNSFLREV

SEQ ID NO: 1056253 - protein, 9 aa, Homo Sapiens
RQFLSSEKQ

SEQ ID NO: 1056254 - protein, 9 aa, Homo Sapiens
VIYNVNNGI

SEQ ID NO: 1056255 - protein, 9 aa, Homo Sapiens
TARSEADRD

SEQ ID NO: 1056256 - protein, 9 aa, Homo Sapiens
MFKELPHFK

SEQ ID NO: 1056257 - protein, 9 aa, Homo Sapiens
CRKISVLVQ

SEQ ID NO: 1056258 - protein, 9 aa, Homo Sapiens
GPQVIMGPE

SEQ ID NO: 1056259 - protein, 9 aa, Homo Sapiens
TIKDYPDDA

SEQ ID NO: 1056260 - protein, 9 aa, Homo Sapiens
LDSIFLAGK

SEQ ID NO: 1056261 - protein, 9 aa, Homo Sapiens
AGGCNFNFF

SEQ ID NO: 1056262 - protein, 9 aa, Homo Sapiens
EEPPRQANH

SEQ ID NO: 1056263 - protein, 9 aa, Homo Sapiens
NCSAPLVPC

SEQ ID NO: 1056264 - protein, 9 aa, Homo Sapiens
RRQRDWAAE

SEQ ID NO: 1056265 - protein, 9 aa, Homo Sapiens
CEFVLSKGD

SEQ ID NO: 1056266 - protein, 9 aa, Homo Sapiens
HVPFILGLP

SEQ ID NO: 1056267 - protein, 9 aa, Homo Sapiens
VHIVKNGGT

SEQ ID NO: 1056268 - protein, 9 aa, Homo Sapiens
IMKKFYVLL

SEQ ID NO: 1056269 - protein, 9 aa, Homo Sapiens
DNTPAKKKM

SEQ ID NO: 1056270 - protein, 9 aa, Homo Sapiens
MIWRSKAGA

SEQ ID NO: 1056271 - protein, 9 aa, Homo Sapiens
NNLEQLCIN

SEQ ID NO: 1056272 - protein, 9 aa, Homo Sapiens
GNSPLRENS

SEQ ID NO: 1056273 - protein, 9 aa, Homo Sapiens
GLLITLVLD

SEQ ID NO: 1056274 - protein, 9 aa, Homo Sapiens
IFHSQGTNG

SEQ ID NO: 1056275 - protein, 9 aa, Homo Sapiens
KFLGEEVPQ

SEQ ID NO: 1056276 - protein, 9 aa, Homo Sapiens
EAKDVSSYL

SEQ ID NO: 1056277 - protein, 9 aa, Homo Sapiens
GKVFNNFST

SEQ ID NO: 1056278 - protein, 9 aa, Homo Sapiens
EYAATLAKN

SEQ ID NO: 1056279 - protein, 9 aa, Homo Sapiens
INTKRDDDY

SEQ ID NO: 1056280 - protein, 9 aa, Homo Sapiens
ISKTNEELL

SEQ ID NO: 1056281 - protein, 9 aa, Homo Sapiens
SGCGLLVIV

SEQ ID NO: 1056282 - protein, 9 aa, Homo Sapiens
KPPEQLPQH

SEQ ID NO: 1056283 - protein, 9 aa, Homo Sapiens
GAVTGVGIC

SEQ ID NO: 1056284 - protein, 9 aa, Homo Sapiens
QQRMPAILV

SEQ ID NO: 1056285 - protein, 9 aa, Homo Sapiens
FLVLLFVAV

SEQ ID NO: 1056286 - protein, 9 aa, Homo Sapiens
FGGARAASA

SEQ ID NO: 1056287 - protein, 9 aa, Homo Sapiens
AGRPKVLVE

SEQ ID NO: 1056288 - protein, 9 aa, Homo Sapiens
PKKSRQEIN

SEQ ID NO: 1056289 - protein, 9 aa, Homo Sapiens
TREVPSEEG

SEQ ID NO: 1056290 - protein, 9 aa, Homo Sapiens
IKTNVHSPL

SEQ ID NO: 1056291 - protein, 9 aa, Homo Sapiens
VQSSCSSLS

SEQ ID NO: 1056292 - protein, 9 aa, Homo Sapiens
MEDTRKLDK

SEQ ID NO: 1056293 - protein, 9 aa, Homo Sapiens
NPVQEEEDK

SEQ ID NO: 1056294 - protein, 9 aa, Homo Sapiens
EVVSIKKME

SEQ ID NO: 1056295 - protein, 9 aa, Homo Sapiens
FCQPLTAVY

SEQ ID NO: 1056296 - protein, 9 aa, Homo Sapiens
NVSSNTNSE

SEQ ID NO: 1056297 - protein, 9 aa, Homo Sapiens
QSLRQRFNR

SEQ ID NO: 1056298 - protein, 9 aa, Homo Sapiens
GGVIGEPTS

SEQ ID NO: 1056299 - protein, 9 aa, Homo Sapiens
PNEMMREIC

SEQ ID NO: 1056300 - protein, 9 aa, Homo Sapiens
CGEEKTLTF

SEQ ID NO: 1056301 - protein, 9 aa, Homo Sapiens
QFFEPAPAP

SEQ ID NO: 1056302 - protein, 9 aa, Homo Sapiens
DARQVWGFN

SEQ ID NO: 1056303 - protein, 9 aa, Homo Sapiens
RGSSEEGVS

SEQ ID NO: 1056304 - protein, 9 aa, Homo Sapiens
LVDCSLLPK

SEQ ID NO: 1056305 - protein, 9 aa, Homo Sapiens
GVKIKKKGN

SEQ ID NO: 1056306 - protein, 9 aa, Homo Sapiens
ERMQCLMPH

SEQ ID NO: 1056307 - protein, 9 aa, Homo Sapiens
LKNAEVKIA

SEQ ID NO: 1056308 - protein, 9 aa, Homo Sapiens
LQPHVPFIL

SEQ ID NO: 1056309 - protein, 9 aa, Homo Sapiens
KNYIHPTES

SEQ ID NO: 1056310 - protein, 9 aa, Homo Sapiens
TYLFDGSCM

SEQ ID NO: 1056311 - protein, 9 aa, Homo Sapiens
VWGFNFGSK

SEQ ID NO: 1056312 - protein, 9 aa, Homo Sapiens
QNHYNFNPV

SEQ ID NO: 1056313 - protein, 9 aa, Homo Sapiens
RQMYYAPTD

SEQ ID NO: 1056314 - protein, 9 aa, Homo Sapiens
EKISSMVLS

SEQ ID NO: 1056315 - protein, 9 aa, Homo Sapiens
CLVLQPHVP

SEQ ID NO: 1056316 - protein, 9 aa, Homo Sapiens
GTSENSAFC

SEQ ID NO: 1056317 - protein, 9 aa, Homo Sapiens
ISVLLSEED

SEQ ID NO: 1056318 - protein, 9 aa, Homo Sapiens
VFSSLGLQF

SEQ ID NO: 1056319 - protein, 9 aa, Homo Sapiens
EGNQIVLIN

SEQ ID NO: 1056320 - protein, 9 aa, Homo Sapiens
LDDYVVPLD

SEQ ID NO: 1056321 - protein, 9 aa, Homo Sapiens
FLLAQSHTR

SEQ ID NO: 1056322 - protein, 9 aa, Homo Sapiens
PVGEHSPHP

SEQ ID NO: 1056323 - protein, 9 aa, Homo Sapiens
TQAIAETLE

SEQ ID NO: 1056324 - protein, 9 aa, Homo Sapiens
FCFQTESRL

SEQ ID NO: 1056325 - protein, 9 aa, Homo Sapiens
DRMSGLMQP

SEQ ID NO: 1056326 - protein, 9 aa, Homo Sapiens
PVTEEGLRK

SEQ ID NO: 1056327 - protein, 9 aa, Homo Sapiens
LHDSVYFPL

SEQ ID NO: 1056328 - protein, 9 aa, Homo Sapiens
VVGVTSSPA

SEQ ID NO: 1056329 - protein, 9 aa, Homo Sapiens
GSSGFPGNL

SEQ ID NO: 1056330 - protein, 9 aa, Homo Sapiens
KRINTMLIF

SEQ ID NO: 1056331 - protein, 9 aa, Homo Sapiens
RILELPDKF

SEQ ID NO: 1056332 - protein, 9 aa, Homo Sapiens
RWPQPVFLN

SEQ ID NO: 1056333 - protein, 9 aa, Homo Sapiens
KIFSKTYLK

SEQ ID NO: 1056334 - protein, 9 aa, Homo Sapiens
KFNAEESSL

SEQ ID NO: 1056335 - protein, 9 aa, Homo Sapiens
TGWFSVFYV

SEQ ID NO: 1056336 - protein, 9 aa, Homo Sapiens
EKKDNTFCM

SEQ ID NO: 1056337 - protein, 9 aa, Homo Sapiens
LGILLWLKG

SEQ ID NO: 1056338 - protein, 9 aa, Homo Sapiens
LQSDQNTIH

SEQ ID NO: 1056339 - protein, 9 aa, Homo Sapiens
SIVVLPQPA

SEQ ID NO: 1056340 - protein, 9 aa, Homo Sapiens
WGPGLLITL

SEQ ID NO: 1056341 - protein, 9 aa, Homo Sapiens
KTGKLTTIG

SEQ ID NO: 1056342 - protein, 9 aa, Homo Sapiens
KQSTPKQTK

SEQ ID NO: 1056343 - protein, 9 aa, Homo Sapiens
QVLNPLLVF

SEQ ID NO: 1056344 - protein, 9 aa, Homo Sapiens
SSPPPAPEI

SEQ ID NO: 1056345 - protein, 9 aa, Homo Sapiens
KNPYLHPCV

SEQ ID NO: 1056346 - protein, 9 aa, Homo Sapiens
AFFSIWHKF

SEQ ID NO: 1056347 - protein, 9 aa, Homo Sapiens
KDFNLATKI

SEQ ID NO: 1056348 - protein, 9 aa, Homo Sapiens
ENLLLNKWE

SEQ ID NO: 1056349 - protein, 9 aa, Homo Sapiens
NLTNFPKNG

SEQ ID NO: 1056350 - protein, 9 aa, Homo Sapiens
LKALQREIR

SEQ ID NO: 1056351 - protein, 9 aa, Homo Sapiens
SLFQQCYIF

SEQ ID NO: 1056352 - protein, 9 aa, Homo Sapiens
PLQAVEPIL

SEQ ID NO: 1056353 - protein, 9 aa, Homo Sapiens
LLISLFLAA

SEQ ID NO: 1056354 - protein, 9 aa, Homo Sapiens
LGKKKEGEE

SEQ ID NO: 1056355 - protein, 9 aa, Homo Sapiens
PISLAKVDA

SEQ ID NO: 1056356 - protein, 9 aa, Homo Sapiens
LTKHRRIYT

SEQ ID NO: 1056357 - protein, 9 aa, Homo Sapiens
EPGFMMTCE

SEQ ID NO: 1056358 - protein, 9 aa, Homo Sapiens
RGEHVMRGT

SEQ ID NO: 1056359 - protein, 9 aa, Homo Sapiens
QLEVEEAVQ

SEQ ID NO: 1056360 - protein, 9 aa, Homo Sapiens
SGVVSLLGV

SEQ ID NO: 1056361 - protein, 9 aa, Homo Sapiens
TRIQDNVDQ

SEQ ID NO: 1056362 - protein, 9 aa, Homo Sapiens
GSFYCVCQQ

SEQ ID NO: 1056363 - protein, 9 aa, Homo Sapiens
ENHKRTFKA

SEQ ID NO: 1056364 - protein, 9 aa, Homo Sapiens
FHSFSTNIA

SEQ ID NO: 1056365 - protein, 9 aa, Homo Sapiens
VKGSCICNG

SEQ ID NO: 1056366 - protein, 9 aa, Homo Sapiens
SSSGNKNDE

SEQ ID NO: 1056367 - protein, 9 aa, Homo Sapiens
NNEGFAMEQ

SEQ ID NO: 1056368 - protein, 9 aa, Homo Sapiens
TYSSIGDLL

SEQ ID NO: 1056369 - protein, 9 aa, Homo Sapiens
EKPSKNPER

SEQ ID NO: 1056370 - protein, 9 aa, Homo Sapiens
KDASTLICQ

SEQ ID NO: 1056371 - protein, 9 aa, Homo Sapiens
PLLHTPILL

SEQ ID NO: 1056372 - protein, 9 aa, Homo Sapiens
LKRENPNWL

SEQ ID NO: 1056373 - protein, 9 aa, Homo Sapiens
AWTSHLESG

SEQ ID NO: 1056374 - protein, 9 aa, Homo Sapiens
LWLADLVQS

SEQ ID NO: 1056375 - protein, 9 aa, Homo Sapiens
ADNLLCVKL

SEQ ID NO: 1056376 - protein, 9 aa, Homo Sapiens
VAIIARSLE

SEQ ID NO: 1056377 - protein, 9 aa, Homo Sapiens
KELFEMWNI

SEQ ID NO: 1056378 - protein, 9 aa, Homo Sapiens
ELGEGELPV

SEQ ID NO: 1056379 - protein, 9 aa, Homo Sapiens
ESTEFLLGS

SEQ ID NO: 1056380 - protein, 9 aa, Homo Sapiens
SINGSRFKC

SEQ ID NO: 1056381 - protein, 9 aa, Homo Sapiens
IVVAAVPSL

SEQ ID NO: 1056382 - protein, 9 aa, Homo Sapiens
PEGTRKLAP

SEQ ID NO: 1056383 - protein, 9 aa, Homo Sapiens
PLEEMQPML

SEQ ID NO: 1056384 - protein, 9 aa, Homo Sapiens
TVTTPADWL

SEQ ID NO: 1056385 - protein, 9 aa, Homo Sapiens
KRGYCLSSR

SEQ ID NO: 1056386 - protein, 9 aa, Homo Sapiens
QYLTILSEG

SEQ ID NO: 1056387 - protein, 9 aa, Homo Sapiens
SRFIKLACI

SEQ ID NO: 1056388 - protein, 9 aa, Homo Sapiens
LNEECKVPK

SEQ ID NO: 1056389 - protein, 9 aa, Homo Sapiens
SIEILGSGS

SEQ ID NO: 1056390 - protein, 9 aa, Homo Sapiens
RKVVDHPKK

SEQ ID NO: 1056391 - protein, 9 aa, Homo Sapiens
RGPSPLFQQ

SEQ ID NO: 1056392 - protein, 9 aa, Homo Sapiens
LQYFLDQFY

SEQ ID NO: 1056393 - protein, 9 aa, Homo Sapiens
PTGKWPSLS

SEQ ID NO: 1056394 - protein, 9 aa, Homo Sapiens
VPLGVNVEG

SEQ ID NO: 1056395 - protein, 9 aa, Homo Sapiens
ENEDEFRNM

SEQ ID NO: 1056396 - protein, 9 aa, Homo Sapiens
KLLESHIRT

SEQ ID NO: 1056397 - protein, 9 aa, Homo Sapiens
RKSVLGKAT

SEQ ID NO: 1056398 - protein, 9 aa, Homo Sapiens
PSLAPPHRR

SEQ ID NO: 1056399 - protein, 9 aa, Homo Sapiens
PEEEFDSHG

SEQ ID NO: 1056400 - protein, 9 aa, Homo Sapiens
EKVLTPEML

SEQ ID NO: 1056401 - protein, 9 aa, Homo Sapiens
RISVLLSEE

SEQ ID NO: 1056402 - protein, 9 aa, Homo Sapiens
VREKKTKKE

SEQ ID NO: 1056403 - protein, 9 aa, Homo Sapiens
VAFYAAILA

SEQ ID NO: 1056404 - protein, 9 aa, Homo Sapiens
CGKTFTCFS

SEQ ID NO: 1056405 - protein, 9 aa, Homo Sapiens
TNIQGMTET

SEQ ID NO: 1056406 - protein, 9 aa, Homo Sapiens
IRDMCRAKT

SEQ ID NO: 1056407 - protein, 9 aa, Homo Sapiens
KVCNCYEFL

SEQ ID NO: 1056408 - protein, 9 aa, Homo Sapiens
SERLQGTHY

SEQ ID NO: 1056409 - protein, 9 aa, Homo Sapiens
RGGPLMFRG

SEQ ID NO: 1056410 - protein, 9 aa, Homo Sapiens
ATWMRPPRK

SEQ ID NO: 1056411 - protein, 9 aa, Homo Sapiens
LVFGGVAQA

SEQ ID NO: 1056412 - protein, 9 aa, Homo Sapiens
GPSLEWETK

SEQ ID NO: 1056413 - protein, 9 aa, Homo Sapiens
ESGMALSQG

SEQ ID NO: 1056414 - protein, 9 aa, Homo Sapiens
TSIAATCNN

SEQ ID NO: 1056415 - protein, 9 aa, Homo Sapiens
YEVRIKMVV

SEQ ID NO: 1056416 - protein, 9 aa, Homo Sapiens
YDLATDPLV

SEQ ID NO: 1056417 - protein, 9 aa, Homo Sapiens
CGSRSQSSS

SEQ ID NO: 1056418 - protein, 9 aa, Homo Sapiens
KRFAADIIF

SEQ ID NO: 1056419 - protein, 9 aa, Homo Sapiens
ANENQPVKS

SEQ ID NO: 1056420 - protein, 9 aa, Homo Sapiens
GIVLSNEYQ

SEQ ID NO: 1056421 - protein, 9 aa, Homo Sapiens
LREFTRPEE

SEQ ID NO: 1056422 - protein, 9 aa, Homo Sapiens
FKGLPEIDF

SEQ ID NO: 1056423 - protein, 9 aa, Homo Sapiens
AATYLKWCE

SEQ ID NO: 1056424 - protein, 9 aa, Homo Sapiens
TMNYSLWSQ

SEQ ID NO: 1056425 - protein, 9 aa, Homo Sapiens
YPTFDPLIN

SEQ ID NO: 1056426 - protein, 9 aa, Homo Sapiens
EQNKRLREQ

SEQ ID NO: 1056427 - protein, 9 aa, Homo Sapiens
DVFLGTVRE

SEQ ID NO: 1056428 - protein, 9 aa, Homo Sapiens
SIILAEAIR

SEQ ID NO: 1056429 - protein, 9 aa, Homo Sapiens
IGSLRPPSA

SEQ ID NO: 1056430 - protein, 9 aa, Homo Sapiens
MLMLNAYKP

SEQ ID NO: 1056431 - protein, 9 aa, Homo Sapiens
KTHPICLFL

SEQ ID NO: 1056432 - protein, 9 aa, Homo Sapiens
NRVSIPWVS

SEQ ID NO: 1056433 - protein, 9 aa, Homo Sapiens
AWIPERFFP

SEQ ID NO: 1056434 - protein, 9 aa, Homo Sapiens
KVSARNLDT

SEQ ID NO: 1056435 - protein, 9 aa, Homo Sapiens
FARHCVCIS

SEQ ID NO: 1056436 - protein, 9 aa, Homo Sapiens
RTAGLAVHL

SEQ ID NO: 1056437 - protein, 9 aa, Homo Sapiens
SFFLKLVRD

SEQ ID NO: 1056438 - protein, 9 aa, Homo Sapiens
VQREEERTQ

SEQ ID NO: 1056439 - protein, 9 aa, Homo Sapiens
LGPAPIPGP

SEQ ID NO: 1056440 - protein, 9 aa, Homo Sapiens
DYVNCGYVT

SEQ ID NO: 1056441 - protein, 9 aa, Homo Sapiens
SAAALVFGG

SEQ ID NO: 1056442 - protein, 9 aa, Homo Sapiens
KYKFILNDA

SEQ ID NO: 1056443 - protein, 9 aa, Homo Sapiens
RKKIRSFVA

SEQ ID NO: 1056444 - protein, 9 aa, Homo Sapiens
TATTELKKL

SEQ ID NO: 1056445 - protein, 9 aa, Homo Sapiens
FKNLLKLEK

SEQ ID NO: 1056446 - protein, 9 aa, Homo Sapiens
YTLYQFKKN

SEQ ID NO: 1056447 - protein, 9 aa, Homo Sapiens
IVLETKPLF

SEQ ID NO: 1056448 - protein, 9 aa, Homo Sapiens
SDCWLATPT

SEQ ID NO: 1056449 - protein, 9 aa, Homo Sapiens
FLGRPMCTL

SEQ ID NO: 1056450 - protein, 9 aa, Homo Sapiens
TKVEKDFNL

SEQ ID NO: 1056451 - protein, 9 aa, Homo Sapiens
PERRVVVAG

SEQ ID NO: 1056452 - protein, 9 aa, Homo Sapiens
KKVQNLERA

SEQ ID NO: 1056453 - protein, 9 aa, Homo Sapiens
PAQIISFST

SEQ ID NO: 1056454 - protein, 9 aa, Homo Sapiens
SEKWVYVNE

SEQ ID NO: 1056455 - protein, 9 aa, Homo Sapiens
ISEPMDKNC

SEQ ID NO: 1056456 - protein, 9 aa, Homo Sapiens
FRFAILYSR

SEQ ID NO: 1056457 - protein, 9 aa, Homo Sapiens
TNLVFILDG

SEQ ID NO: 1056458 - protein, 9 aa, Homo Sapiens
CNLPEWCNG

SEQ ID NO: 1056459 - protein, 9 aa, Homo Sapiens
KRKEENARQ

SEQ ID NO: 1056460 - protein, 9 aa, Homo Sapiens
ELGLIPIYW

SEQ ID NO: 1056461 - protein, 9 aa, Homo Sapiens
ISLLLNLTC

SEQ ID NO: 1056462 - protein, 9 aa, Homo Sapiens
FMQHFSEAF

SEQ ID NO: 1056463 - protein, 9 aa, Homo Sapiens
LCSCPGRYL

SEQ ID NO: 1056464 - protein, 9 aa, Homo Sapiens
GGSAGSLSA

SEQ ID NO: 1056465 - protein, 9 aa, Homo Sapiens
CEQISKVLL

SEQ ID NO: 1056466 - protein, 9 aa, Homo Sapiens
KKEQEKAWK

SEQ ID NO: 1056467 - protein, 9 aa, Homo Sapiens
SWMSYVSII

SEQ ID NO: 1056468 - protein, 9 aa, Homo Sapiens
HDDKYTPLP

SEQ ID NO: 1056469 - protein, 9 aa, Homo Sapiens
HHLNHKGEA

SEQ ID NO: 1056470 - protein, 9 aa, Homo Sapiens
HFLFLSSSS

SEQ ID NO: 1056471 - protein, 9 aa, Homo Sapiens
SRDFIQCFL

SEQ ID NO: 1056472 - protein, 9 aa, Homo Sapiens
LELPDKFVV

SEQ ID NO: 1056473 - protein, 9 aa, Homo Sapiens
CDFCGKAFC

SEQ ID NO: 1056474 - protein, 9 aa, Homo Sapiens
FLIFKKSAS

SEQ ID NO: 1056475 - protein, 9 aa, Homo Sapiens
DGIPASKIS

SEQ ID NO: 1056476 - protein, 9 aa, Homo Sapiens
IIVLVMIAI

SEQ ID NO: 1056477 - protein, 9 aa, Homo Sapiens
LLKRHEKSH

SEQ ID NO: 1056478 - protein, 9 aa, Homo Sapiens
ENLPNHILF

SEQ ID NO: 1056479 - protein, 9 aa, Homo Sapiens
FMKNHFCKC

SEQ ID NO: 1056480 - protein, 9 aa, Homo Sapiens
MREICKVLD

SEQ ID NO: 1056481 - protein, 9 aa, Homo Sapiens
ILQPQHHGT

SEQ ID NO: 1056482 - protein, 9 aa, Homo Sapiens
VNTEFLASF

SEQ ID NO: 1056483 - protein, 9 aa, Homo Sapiens
PSYFKFKEY

SEQ ID NO: 1056484 - protein, 9 aa, Homo Sapiens
LQKIRDHCA

SEQ ID NO: 1056485 - protein, 9 aa, Homo Sapiens
FKKMSNRRN

SEQ ID NO: 1056486 - protein, 9 aa, Homo Sapiens
EGGHFLLHS

SEQ ID NO: 1056487 - protein, 9 aa, Homo Sapiens
TLLDDKNDS

SEQ ID NO: 1056488 - protein, 9 aa, Homo Sapiens
KFKRKSIHS

SEQ ID NO: 1056489 - protein, 9 aa, Homo Sapiens
PINDSSEEF

SEQ ID NO: 1056490 - protein, 9 aa, Homo Sapiens
CNNPGMPQN

SEQ ID NO: 1056491 - protein, 9 aa, Homo Sapiens
EKQICGMHR

SEQ ID NO: 1056492 - protein, 9 aa, Homo Sapiens
DFHTEIKED

SEQ ID NO: 1056493 - protein, 9 aa, Homo Sapiens
KFQNLQILF

SEQ ID NO: 1056494 - protein, 9 aa, Homo Sapiens
ISPPQCPRR

SEQ ID NO: 1056495 - protein, 9 aa, Homo Sapiens
FKKYVLGDL

SEQ ID NO: 1056496 - protein, 9 aa, Homo Sapiens
AGSQIDRNM

SEQ ID NO: 1056497 - protein, 9 aa, Homo Sapiens
LEPLCSDSS

SEQ ID NO: 1056498 - protein, 9 aa, Homo Sapiens
PTESTEERR

SEQ ID NO: 1056499 - protein, 9 aa, Homo Sapiens
KFSGIVSKG

SEQ ID NO: 1056500 - protein, 9 aa, Homo Sapiens
KNFSALLST

SEQ ID NO: 1056501 - protein, 9 aa, Homo Sapiens
LGLKKKNLY

SEQ ID NO: 1056502 - protein, 9 aa, Homo Sapiens
LKSLAPNCI

SEQ ID NO: 1056503 - protein, 9 aa, Homo Sapiens
RVHRVFFRR

SEQ ID NO: 1056504 - protein, 9 aa, Homo Sapiens
MNSTTSEKA

SEQ ID NO: 1056505 - protein, 9 aa, Homo Sapiens
IENAIIIVI

SEQ ID NO: 1056506 - protein, 9 aa, Homo Sapiens
SPLDMLEPE

SEQ ID NO: 1056507 - protein, 9 aa, Homo Sapiens
PTASEVSEE

SEQ ID NO: 1056508 - protein, 9 aa, Homo Sapiens
NDEITQDEN

SEQ ID NO: 1056509 - protein, 9 aa, Homo Sapiens
KTKEAGNGQ

SEQ ID NO: 1056510 - protein, 9 aa, Homo Sapiens
PRQNPRRVA

SEQ ID NO: 1056511 - protein, 9 aa, Homo Sapiens
SDYLELHIP

SEQ ID NO: 1056512 - protein, 9 aa, Homo Sapiens
EIDLIFLKE

SEQ ID NO: 1056513 - protein, 9 aa, Homo Sapiens
VFFWEKSSF

SEQ ID NO: 1056514 - protein, 9 aa, Homo Sapiens
EEEAVLSRP

SEQ ID NO: 1056515 - protein, 9 aa, Homo Sapiens
ASPSGMLTC

SEQ ID NO: 1056516 - protein, 9 aa, Homo Sapiens
RDLLQVYWE

SEQ ID NO: 1056517 - protein, 9 aa, Homo Sapiens
KIWDLNSGQ

SEQ ID NO: 1056518 - protein, 9 aa, Homo Sapiens
GQKKNKLGP

SEQ ID NO: 1056519 - protein, 9 aa, Homo Sapiens
EVLSISEDT

SEQ ID NO: 1056520 - protein, 9 aa, Homo Sapiens
SPLVPDSIK

SEQ ID NO: 1056521 - protein, 9 aa, Homo Sapiens
TPGGLYVEL

SEQ ID NO: 1056522 - protein, 9 aa, Homo Sapiens
ELFDHLFFH

SEQ ID NO: 1056523 - protein, 9 aa, Homo Sapiens
EIIMMNYVY

SEQ ID NO: 1056524 - protein, 9 aa, Homo Sapiens
VLTLILQPQ

SEQ ID NO: 1056525 - protein, 9 aa, Homo Sapiens
LEKFSIELN

SEQ ID NO: 1056526 - protein, 9 aa, Homo Sapiens
LGWRQCLLI

SEQ ID NO: 1056527 - protein, 9 aa, Homo Sapiens
FQICGAAPP

SEQ ID NO: 1056528 - protein, 9 aa, Homo Sapiens
SETREQALR

SEQ ID NO: 1056529 - protein, 9 aa, Homo Sapiens
VCWRSTPDS

SEQ ID NO: 1056530 - protein, 9 aa, Homo Sapiens
KLGTTATTE

SEQ ID NO: 1056531 - protein, 9 aa, Homo Sapiens
REWYAHNRY

SEQ ID NO: 1056532 - protein, 9 aa, Homo Sapiens
WEASFCGWG

SEQ ID NO: 1056533 - protein, 9 aa, Homo Sapiens
MYYAPTDCA

SEQ ID NO: 1056534 - protein, 9 aa, Homo Sapiens
LPNDVLQIL

SEQ ID NO: 1056535 - protein, 9 aa, Homo Sapiens
WQKNCQGLG

SEQ ID NO: 1056536 - protein, 9 aa, Homo Sapiens
ALIQSLNSS

SEQ ID NO: 1056537 - protein, 9 aa, Homo Sapiens
YISKPTSRV

SEQ ID NO: 1056538 - protein, 9 aa, Homo Sapiens
SGMLTCRCP

SEQ ID NO: 1056539 - protein, 9 aa, Homo Sapiens
RGAGDPRGP

SEQ ID NO: 1056540 - protein, 9 aa, Homo Sapiens
LRRIPNPTM

SEQ ID NO: 1056541 - protein, 9 aa, Homo Sapiens
LILQPQHHG

SEQ ID NO: 1056542 - protein, 9 aa, Homo Sapiens
SYQAPLVAF

SEQ ID NO: 1056543 - protein, 9 aa, Homo Sapiens
KCTFVTDSL

SEQ ID NO: 1056544 - protein, 9 aa, Homo Sapiens
AEIFYAKTF

SEQ ID NO: 1056545 - protein, 9 aa, Homo Sapiens
RIQVLFMYG

SEQ ID NO: 1056546 - protein, 9 aa, Homo Sapiens
LDSRPLHEE

SEQ ID NO: 1056547 - protein, 9 aa, Homo Sapiens
RKPPGAKDA

SEQ ID NO: 1056548 - protein, 9 aa, Homo Sapiens
QAPPQKVLF

SEQ ID NO: 1056549 - protein, 9 aa, Homo Sapiens
NGNPRQSFE

SEQ ID NO: 1056550 - protein, 9 aa, Homo Sapiens
KGQKKNKLG

SEQ ID NO: 1056551 - protein, 9 aa, Homo Sapiens
WRSEGKKGQ

SEQ ID NO: 1056552 - protein, 9 aa, Homo Sapiens
ARFGMASGD

SEQ ID NO: 1056553 - protein, 9 aa, Homo Sapiens
LWMKRQKSG

SEQ ID NO: 1056554 - protein, 9 aa, Homo Sapiens
RINTMLIFI

SEQ ID NO: 1056555 - protein, 9 aa, Homo Sapiens
TLFWAVVFL

SEQ ID NO: 1056556 - protein, 9 aa, Homo Sapiens
MTVVFDSND

SEQ ID NO: 1056557 - protein, 9 aa, Homo Sapiens
GNMEDTRKL

SEQ ID NO: 1056558 - protein, 9 aa, Homo Sapiens
ISGIFVASV

SEQ ID NO: 1056559 - protein, 9 aa, Homo Sapiens
KTCSATEAA

SEQ ID NO: 1056560 - protein, 9 aa, Homo Sapiens
ERFYLGLFT

SEQ ID NO: 1056561 - protein, 9 aa, Homo Sapiens
ITMKIFSKT

SEQ ID NO: 1056562 - protein, 9 aa, Homo Sapiens
CSTQNFWFR

SEQ ID NO: 1056563 - protein, 9 aa, Homo Sapiens
PMEEVQTLY

SEQ ID NO: 1056564 - protein, 9 aa, Homo Sapiens
CSSLASGDT

SEQ ID NO: 1056565 - protein, 9 aa, Homo Sapiens
VEEADQPIT

SEQ ID NO: 1056566 - protein, 9 aa, Homo Sapiens
FGIVVTKPD

SEQ ID NO: 1056567 - protein, 9 aa, Homo Sapiens
MSSFHSFPQ

SEQ ID NO: 1056568 - protein, 9 aa, Homo Sapiens
LLQVCCASP

SEQ ID NO: 1056569 - protein, 9 aa, Homo Sapiens
FRKQSSDEE

SEQ ID NO: 1056570 - protein, 9 aa, Homo Sapiens
EAGGINFNE

SEQ ID NO: 1056571 - protein, 9 aa, Homo Sapiens
LARDKDGKE

SEQ ID NO: 1056572 - protein, 9 aa, Homo Sapiens
SKPKKIYTG

SEQ ID NO: 1056573 - protein, 9 aa, Homo Sapiens
RKKSKDQNV

SEQ ID NO: 1056574 - protein, 9 aa, Homo Sapiens
LYLARHTRI

SEQ ID NO: 1056575 - protein, 9 aa, Homo Sapiens
ISGESKDLA

SEQ ID NO: 1056576 - protein, 9 aa, Homo Sapiens
VNSLKEDYN

SEQ ID NO: 1056577 - protein, 9 aa, Homo Sapiens
NKTSHTQGS

SEQ ID NO: 1056578 - protein, 9 aa, Homo Sapiens
KVTHGYLHS

SEQ ID NO: 1056579 - protein, 9 aa, Homo Sapiens
ELFSSRDSN

SEQ ID NO: 1056580 - protein, 9 aa, Homo Sapiens
LENERSVLQ

SEQ ID NO: 1056581 - protein, 9 aa, Homo Sapiens
VLVMIAIEG

SEQ ID NO: 1056582 - protein, 9 aa, Homo Sapiens
HEFKTEEKL

SEQ ID NO: 1056583 - protein, 9 aa, Homo Sapiens
NEKLGTTAT

SEQ ID NO: 1056584 - protein, 9 aa, Homo Sapiens
AQPRCLRAG

SEQ ID NO: 1056585 - protein, 9 aa, Homo Sapiens
VRYALCTLS

SEQ ID NO: 1056586 - protein, 9 aa, Homo Sapiens
RAKLLNVGS

SEQ ID NO: 1056587 - protein, 9 aa, Homo Sapiens
CGKGFNCGA

SEQ ID NO: 1056588 - protein, 9 aa, Homo Sapiens
ECGSPLLCA

SEQ ID NO: 1056589 - protein, 9 aa, Homo Sapiens
DAFPGNDSL

SEQ ID NO: 1056590 - protein, 9 aa, Homo Sapiens
EGKQVFLYS

SEQ ID NO: 1056591 - protein, 9 aa, Homo Sapiens
CLRAGGAGQ

SEQ ID NO: 1056592 - protein, 9 aa, Homo Sapiens
RCFARHCVC

SEQ ID NO: 1056593 - protein, 9 aa, Homo Sapiens
INIAELRFE

SEQ ID NO: 1056594 - protein, 9 aa, Homo Sapiens
IKHNNTLLV

SEQ ID NO: 1056595 - protein, 9 aa, Homo Sapiens
HGFHPLSPL

SEQ ID NO: 1056596 - protein, 9 aa, Homo Sapiens
DTQEIKGRN

SEQ ID NO: 1056597 - protein, 9 aa, Homo Sapiens
TEEVAWEAL

SEQ ID NO: 1056598 - protein, 9 aa, Homo Sapiens
GEILYSFED

SEQ ID NO: 1056599 - protein, 9 aa, Homo Sapiens
SVDKNGNQK

SEQ ID NO: 1056600 - protein, 9 aa, Homo Sapiens
AQDASLSLL

SEQ ID NO: 1056601 - protein, 9 aa, Homo Sapiens
VRRLLLLIP

SEQ ID NO: 1056602 - protein, 9 aa, Homo Sapiens
ATLGEKMIE

SEQ ID NO: 1056603 - protein, 9 aa, Homo Sapiens
FMGTISNVK

SEQ ID NO: 1056604 - protein, 9 aa, Homo Sapiens
ETQNPFFSP

SEQ ID NO: 1056605 - protein, 9 aa, Homo Sapiens
APLFGVLSN

SEQ ID NO: 1056606 - protein, 9 aa, Homo Sapiens
PKNGTFVVN

SEQ ID NO: 1056607 - protein, 9 aa, Homo Sapiens
SPERTADQA

SEQ ID NO: 1056608 - protein, 9 aa, Homo Sapiens
IFYGFIVNT

SEQ ID NO: 1056609 - protein, 9 aa, Homo Sapiens
FSGDIKLSV

SEQ ID NO: 1056610 - protein, 9 aa, Homo Sapiens
LEEVLWGYR

SEQ ID NO: 1056611 - protein, 9 aa, Homo Sapiens
IRNPAIQND

SEQ ID NO: 1056612 - protein, 9 aa, Homo Sapiens
ICNGHADQC

SEQ ID NO: 1056613 - protein, 9 aa, Homo Sapiens
SQEIPKPLQ

SEQ ID NO: 1056614 - protein, 9 aa, Homo Sapiens
EILEGPSLE

SEQ ID NO: 1056615 - protein, 9 aa, Homo Sapiens
NMPSYFKFK

SEQ ID NO: 1056616 - protein, 9 aa, Homo Sapiens
ILKQKSQCL

SEQ ID NO: 1056617 - protein, 9 aa, Homo Sapiens
VDGNKLLAP

SEQ ID NO: 1056618 - protein, 9 aa, Homo Sapiens
HFSPTLRLL

SEQ ID NO: 1056619 - protein, 9 aa, Homo Sapiens
SVLVFTWQV

SEQ ID NO: 1056620 - protein, 9 aa, Homo Sapiens
VYLSHIAWT

SEQ ID NO: 1056621 - protein, 9 aa, Homo Sapiens
NNYENVEAG

SEQ ID NO: 1056622 - protein, 9 aa, Homo Sapiens
RYFQRDKNA

SEQ ID NO: 1056623 - protein, 9 aa, Homo Sapiens
QKVALHCAL

SEQ ID NO: 1056624 - protein, 9 aa, Homo Sapiens
FYSCKADEH

SEQ ID NO: 1056625 - protein, 9 aa, Homo Sapiens
IEQRPELLT

SEQ ID NO: 1056626 - protein, 9 aa, Homo Sapiens
FSSLGLQFV

SEQ ID NO: 1056627 - protein, 9 aa, Homo Sapiens
FHFLFLSSS

SEQ ID NO: 1056628 - protein, 9 aa, Homo Sapiens
IVLVMIAIE

SEQ ID NO: 1056629 - protein, 9 aa, Homo Sapiens
RRETHILCQ

SEQ ID NO: 1056630 - protein, 9 aa, Homo Sapiens
PTVLVTEEH

SEQ ID NO: 1056631 - protein, 9 aa, Homo Sapiens
NFPKNGTFV

SEQ ID NO: 1056632 - protein, 9 aa, Homo Sapiens
TGGSGYKND

SEQ ID NO: 1056633 - protein, 9 aa, Homo Sapiens
RKKFGRGQR

SEQ ID NO: 1056634 - protein, 9 aa, Homo Sapiens
RYTNLIRPK

SEQ ID NO: 1056635 - protein, 9 aa, Homo Sapiens
TDCGGDALN

SEQ ID NO: 1056636 - protein, 9 aa, Homo Sapiens
ILEGPSLEW

SEQ ID NO: 1056637 - protein, 9 aa, Homo Sapiens
PPELQPLPA

SEQ ID NO: 1056638 - protein, 9 aa, Homo Sapiens
ILDAVNGYI

SEQ ID NO: 1056639 - protein, 9 aa, Homo Sapiens
PCRRYSCAV

SEQ ID NO: 1056640 - protein, 9 aa, Homo Sapiens
CKLCGQLNT

SEQ ID NO: 1056641 - protein, 9 aa, Homo Sapiens
IKKNKTSVS

SEQ ID NO: 1056642 - protein, 9 aa, Homo Sapiens
GPCHSRSDL

SEQ ID NO: 1056643 - protein, 9 aa, Homo Sapiens
DGFEPGFMM

SEQ ID NO: 1056644 - protein, 9 aa, Homo Sapiens
LPLHQVPDA

SEQ ID NO: 1056645 - protein, 9 aa, Homo Sapiens
FHSQGTNGT

SEQ ID NO: 1056646 - protein, 9 aa, Homo Sapiens
MYDVLVLKG

SEQ ID NO: 1056647 - protein, 9 aa, Homo Sapiens
KSAAKHKFS

SEQ ID NO: 1056648 - protein, 9 aa, Homo Sapiens
AEFWIYKVP

SEQ ID NO: 1056649 - protein, 9 aa, Homo Sapiens
QVPGMCFAF

SEQ ID NO: 1056650 - protein, 9 aa, Homo Sapiens
SESLSYSRI

SEQ ID NO: 1056651 - protein, 9 aa, Homo Sapiens
TKEGKRNKL

SEQ ID NO: 1056652 - protein, 9 aa, Homo Sapiens
ELVAKEERV

SEQ ID NO: 1056653 - protein, 9 aa, Homo Sapiens
ISLFYLLVT

SEQ ID NO: 1056654 - protein, 9 aa, Homo Sapiens
HGPATPRKE

SEQ ID NO: 1056655 - protein, 9 aa, Homo Sapiens
DRQLIADLV

SEQ ID NO: 1056656 - protein, 9 aa, Homo Sapiens
IIYRAILGS

SEQ ID NO: 1056657 - protein, 9 aa, Homo Sapiens
SHKLSSCNL

SEQ ID NO: 1056658 - protein, 9 aa, Homo Sapiens
KEDKLKDWE

SEQ ID NO: 1056659 - protein, 9 aa, Homo Sapiens
ALVYVDGHL

SEQ ID NO: 1056660 - protein, 9 aa, Homo Sapiens
VPLLNRPFD

SEQ ID NO: 1056661 - protein, 9 aa, Homo Sapiens
DSLNLGNIC

SEQ ID NO: 1056662 - protein, 9 aa, Homo Sapiens
RPTPPPFPG

SEQ ID NO: 1056663 - protein, 9 aa, Homo Sapiens
SIAVSPSTA

SEQ ID NO: 1056664 - protein, 9 aa, Homo Sapiens
YSFEDISTS

SEQ ID NO: 1056665 - protein, 9 aa, Homo Sapiens
GAALLILSR

SEQ ID NO: 1056666 - protein, 9 aa, Homo Sapiens
GSPEPKGSP

SEQ ID NO: 1056667 - protein, 9 aa, Homo Sapiens
ASAASASLR

SEQ ID NO: 1056668 - protein, 9 aa, Homo Sapiens
EPKTGIIRT

SEQ ID NO: 1056669 - protein, 9 aa, Homo Sapiens
FIAISGQVT

SEQ ID NO: 1056670 - protein, 9 aa, Homo Sapiens
ILQTNQTLT

SEQ ID NO: 1056671 - protein, 9 aa, Homo Sapiens
PEMSPLDML

SEQ ID NO: 1056672 - protein, 9 aa, Homo Sapiens
RTMKIPDNP

SEQ ID NO: 1056673 - protein, 9 aa, Homo Sapiens
KKEFQKTKD

SEQ ID NO: 1056674 - protein, 9 aa, Homo Sapiens
KDEDEDGSG

SEQ ID NO: 1056675 - protein, 9 aa, Homo Sapiens
FGFELTFCL

SEQ ID NO: 1056676 - protein, 9 aa, Homo Sapiens
KAGAELFSL

SEQ ID NO: 1056677 - protein, 9 aa, Homo Sapiens
LGRHSQKRW

SEQ ID NO: 1056678 - protein, 9 aa, Homo Sapiens
DADRHCGPD

SEQ ID NO: 1056679 - protein, 9 aa, Homo Sapiens
CFVADNKKM

SEQ ID NO: 1056680 - protein, 9 aa, Homo Sapiens
DGRLCSSVC

SEQ ID NO: 1056681 - protein, 9 aa, Homo Sapiens
SDCILQNQL

SEQ ID NO: 1056682 - protein, 9 aa, Homo Sapiens
HQENKVFMR

SEQ ID NO: 1056683 - protein, 9 aa, Homo Sapiens
LTLMALLYQ

SEQ ID NO: 1056684 - protein, 9 aa, Homo Sapiens
AKAFRQLQV

SEQ ID NO: 1056685 - protein, 9 aa, Homo Sapiens
LSTPSPKEQ

SEQ ID NO: 1056686 - protein, 9 aa, Homo Sapiens
NSSLFGTDY

SEQ ID NO: 1056687 - protein, 9 aa, Homo Sapiens
INTMLIFIV

SEQ ID NO: 1056688 - protein, 9 aa, Homo Sapiens
TEKYNLAIK

SEQ ID NO: 1056689 - protein, 9 aa, Homo Sapiens
YSTTKVTLG

SEQ ID NO: 1056690 - protein, 9 aa, Homo Sapiens
PSPLTTLPP

SEQ ID NO: 1056691 - protein, 9 aa, Homo Sapiens
IGLDKILKF

SEQ ID NO: 1056692 - protein, 9 aa, Homo Sapiens
DPPTSAFHF

SEQ ID NO: 1056693 - protein, 9 aa, Homo Sapiens
IISYEITLL

SEQ ID NO: 1056694 - protein, 9 aa, Homo Sapiens
KDEKIQKSE

SEQ ID NO: 1056695 - protein, 9 aa, Homo Sapiens
GIIFSYTQI

SEQ ID NO: 1056696 - protein, 9 aa, Homo Sapiens
PCLYSATPS

SEQ ID NO: 1056697 - protein, 9 aa, Homo Sapiens
VKRLEKQRE

SEQ ID NO: 1056698 - protein, 9 aa, Homo Sapiens
AAALMKMSG

SEQ ID NO: 1056699 - protein, 9 aa, Homo Sapiens
TDRGMAPDS

SEQ ID NO: 1056700 - protein, 9 aa, Homo Sapiens
NSSHLFFHL

SEQ ID NO: 1056701 - protein, 9 aa, Homo Sapiens
DGKISFEKF

SEQ ID NO: 1056702 - protein, 9 aa, Homo Sapiens
QPQNAIFHQ

SEQ ID NO: 1056703 - protein, 9 aa, Homo Sapiens
AVTGVGICS

SEQ ID NO: 1056704 - protein, 9 aa, Homo Sapiens
KWISAMENQ

SEQ ID NO: 1056705 - protein, 9 aa, Homo Sapiens
NYIYSLSVF

SEQ ID NO: 1056706 - protein, 9 aa, Homo Sapiens
ISKRMFKEL

SEQ ID NO: 1056707 - protein, 9 aa, Homo Sapiens
SKLTSNRRT

SEQ ID NO: 1056708 - protein, 9 aa, Homo Sapiens
LDNIHRAWR

SEQ ID NO: 1056709 - protein, 9 aa, Homo Sapiens
IVSDLFSTI

SEQ ID NO: 1056710 - protein, 9 aa, Homo Sapiens
AAEVSKKLH

SEQ ID NO: 1056711 - protein, 9 aa, Homo Sapiens
RVPWFISPG

SEQ ID NO: 1056712 - protein, 9 aa, Homo Sapiens
AHKLGHVVG

SEQ ID NO: 1056713 - protein, 9 aa, Homo Sapiens
LHETLPKEV

SEQ ID NO: 1056714 - protein, 9 aa, Homo Sapiens
RDKDGKELS

SEQ ID NO: 1056715 - protein, 9 aa, Homo Sapiens
NECNLPEWC

SEQ ID NO: 1056716 - protein, 9 aa, Homo Sapiens
CYPVLTPNL

SEQ ID NO: 1056717 - protein, 9 aa, Homo Sapiens
CSEPLKLMG

SEQ ID NO: 1056718 - protein, 9 aa, Homo Sapiens
QQRCVTPFH

SEQ ID NO: 1056719 - protein, 9 aa, Homo Sapiens
PFLVGLHFC

SEQ ID NO: 1056720 - protein, 9 aa, Homo Sapiens
RIGNGEVKG

SEQ ID NO: 1056721 - protein, 9 aa, Homo Sapiens
IKETNDNSK

SEQ ID NO: 1056722 - protein, 9 aa, Homo Sapiens
GDILVLVFG

SEQ ID NO: 1056723 - protein, 9 aa, Homo Sapiens
DQEPHGAAT

SEQ ID NO: 1056724 - protein, 9 aa, Homo Sapiens
RTYLFDGSC

SEQ ID NO: 1056725 - protein, 9 aa, Homo Sapiens
LSNEYQVVT

SEQ ID NO: 1056726 - protein, 9 aa, Homo Sapiens
FWRMVEEQL

SEQ ID NO: 1056727 - protein, 9 aa, Homo Sapiens
GMLSRVTSV

SEQ ID NO: 1056728 - protein, 9 aa, Homo Sapiens
FAFLVQNKT

SEQ ID NO: 1056729 - protein, 9 aa, Homo Sapiens
LLEKFSIEL

SEQ ID NO: 1056730 - protein, 9 aa, Homo Sapiens
LSLCREPGT

SEQ ID NO: 1056731 - protein, 9 aa, Homo Sapiens
KMANENQPV

SEQ ID NO: 1056732 - protein, 9 aa, Homo Sapiens
RVVHKTRNH

SEQ ID NO: 1056733 - protein, 9 aa, Homo Sapiens
GPPGTPGLQ

SEQ ID NO: 1056734 - protein, 9 aa, Homo Sapiens
RGCASTRVI

SEQ ID NO: 1056735 - protein, 9 aa, Homo Sapiens
NQIRVAIIL

SEQ ID NO: 1056736 - protein, 9 aa, Homo Sapiens
QILKGQSLR

SEQ ID NO: 1056737 - protein, 9 aa, Homo Sapiens
LAEQISRNH

SEQ ID NO: 1056738 - protein, 9 aa, Homo Sapiens
NDQNHYNFN

SEQ ID NO: 1056739 - protein, 9 aa, Homo Sapiens
QTNVMVNTD

SEQ ID NO: 1056740 - protein, 9 aa, Homo Sapiens
DLLDVCNET

SEQ ID NO: 1056741 - protein, 9 aa, Homo Sapiens
ENSCGLESE

SEQ ID NO: 1056742 - protein, 9 aa, Homo Sapiens
PSSRSAVLR

SEQ ID NO: 1056743 - protein, 9 aa, Homo Sapiens
VLEEVLWGY

SEQ ID NO: 1056744 - protein, 9 aa, Homo Sapiens
RHAENKPIK

SEQ ID NO: 1056745 - protein, 9 aa, Homo Sapiens
NGSWARERP

SEQ ID NO: 1056746 - protein, 9 aa, Homo Sapiens
PPAGDGKKH

SEQ ID NO: 1056747 - protein, 9 aa, Homo Sapiens
MPSYFKFKE

SEQ ID NO: 1056748 - protein, 9 aa, Homo Sapiens
DVLLQGAVG

SEQ ID NO: 1056749 - protein, 9 aa, Homo Sapiens
RILLETKKS

SEQ ID NO: 1056750 - protein, 9 aa, Homo Sapiens
SILFLGLIT

SEQ ID NO: 1056751 - protein, 9 aa, Homo Sapiens
RLPIFTLSQ

SEQ ID NO: 1056752 - protein, 9 aa, Homo Sapiens
LSNSYNLEK

SEQ ID NO: 1056753 - protein, 9 aa, Homo Sapiens
DSYLHTPMY

SEQ ID NO: 1056754 - protein, 9 aa, Homo Sapiens
SREKPNECK

SEQ ID NO: 1056755 - protein, 9 aa, Homo Sapiens
RKNSTRWST

SEQ ID NO: 1056756 - protein, 9 aa, Homo Sapiens
ERVLSQPPK

SEQ ID NO: 1056757 - protein, 9 aa, Homo Sapiens
YLAFLCRPR

SEQ ID NO: 1056758 - protein, 9 aa, Homo Sapiens
SGPDVPSTS

SEQ ID NO: 1056759 - protein, 9 aa, Homo Sapiens
QENLKRLKD

SEQ ID NO: 1056760 - protein, 9 aa, Homo Sapiens
VFYTHILLT

SEQ ID NO: 1056761 - protein, 9 aa, Homo Sapiens
DVLQILDVQ

SEQ ID NO: 1056762 - protein, 9 aa, Homo Sapiens
ERRVVVAGL

SEQ ID NO: 1056763 - protein, 9 aa, Homo Sapiens
RNPQPQALC

SEQ ID NO: 1056764 - protein, 9 aa, Homo Sapiens
MFETFNVLA

SEQ ID NO: 1056765 - protein, 9 aa, Homo Sapiens
LSQRARRLL

SEQ ID NO: 1056766 - protein, 9 aa, Homo Sapiens
MEVAKHHSP

SEQ ID NO: 1056767 - protein, 9 aa, Homo Sapiens
ESGLEQSSF

SEQ ID NO: 1056768 - protein, 9 aa, Homo Sapiens
VFARTLNKQ

SEQ ID NO: 1056769 - protein, 9 aa, Homo Sapiens
PFARGGRAR

SEQ ID NO: 1056770 - protein, 9 aa, Homo Sapiens
QNQDTENKY

SEQ ID NO: 1056771 - protein, 9 aa, Homo Sapiens
LAVYQRIHT

SEQ ID NO: 1056772 - protein, 9 aa, Homo Sapiens
LKVIHWNSS

SEQ ID NO: 1056773 - protein, 9 aa, Homo Sapiens
SQEALKDYD

SEQ ID NO: 1056774 - protein, 9 aa, Homo Sapiens
PGKFYLLDV

SEQ ID NO: 1056775 - protein, 9 aa, Homo Sapiens
LKNGMLAEK

SEQ ID NO: 1056776 - protein, 9 aa, Homo Sapiens
GDIVMFEEA

SEQ ID NO: 1056777 - protein, 9 aa, Homo Sapiens
DDESGNLFG

SEQ ID NO: 1056778 - protein, 9 aa, Homo Sapiens
EQEVDDVMR

SEQ ID NO: 1056779 - protein, 9 aa, Homo Sapiens
SLNICINGE

SEQ ID NO: 1056780 - protein, 9 aa, Homo Sapiens
KLWIIMKYL

SEQ ID NO: 1056781 - protein, 9 aa, Homo Sapiens
SVEDFLATV

SEQ ID NO: 1056782 - protein, 9 aa, Homo Sapiens
QTEMEGEKK

SEQ ID NO: 1056783 - protein, 9 aa, Homo Sapiens
HPELRRTEH

SEQ ID NO: 1056784 - protein, 9 aa, Homo Sapiens
PSCNGQVDG

SEQ ID NO: 1056785 - protein, 9 aa, Homo Sapiens
LDQIKREQY

SEQ ID NO: 1056786 - protein, 9 aa, Homo Sapiens
ATAASGALP

SEQ ID NO: 1056787 - protein, 9 aa, Homo Sapiens
EEIAYNAIF

SEQ ID NO: 1056788 - protein, 9 aa, Homo Sapiens
SFKCSLYAD

SEQ ID NO: 1056789 - protein, 9 aa, Homo Sapiens
GQGFPFFLR

SEQ ID NO: 1056790 - protein, 9 aa, Homo Sapiens
LLLLHRADP

SEQ ID NO: 1056791 - protein, 9 aa, Homo Sapiens
LSYSRIVSS

SEQ ID NO: 1056792 - protein, 9 aa, Homo Sapiens
CTQPEPTGN

SEQ ID NO: 1056793 - protein, 9 aa, Homo Sapiens
ADSQFSNFL

SEQ ID NO: 1056794 - protein, 9 aa, Homo Sapiens
DFATSFEEL

SEQ ID NO: 1056795 - protein, 9 aa, Homo Sapiens
LEEPTTEPS

SEQ ID NO: 1056796 - protein, 9 aa, Homo Sapiens
VLAMYVAIQ

SEQ ID NO: 1056797 - protein, 9 aa, Homo Sapiens
FIQELFESS

SEQ ID NO: 1056798 - protein, 9 aa, Homo Sapiens
NVLAMYVAI

SEQ ID NO: 1056799 - protein, 9 aa, Homo Sapiens
FPKKKLELQ

SEQ ID NO: 1056800 - protein, 9 aa, Homo Sapiens
GEGVSLQYV

SEQ ID NO: 1056801 - protein, 9 aa, Homo Sapiens
HPNIWSHCS

SEQ ID NO: 1056802 - protein, 9 aa, Homo Sapiens
QKSYTLNIE

SEQ ID NO: 1056803 - protein, 9 aa, Homo Sapiens
TFHSKSTFS

SEQ ID NO: 1056804 - protein, 9 aa, Homo Sapiens
AFLREQRAA

SEQ ID NO: 1056805 - protein, 9 aa, Homo Sapiens
TSILNCESA

SEQ ID NO: 1056806 - protein, 9 aa, Homo Sapiens
IRYSILEEL

SEQ ID NO: 1056807 - protein, 9 aa, Homo Sapiens
ESGPGGCPR

SEQ ID NO: 1056808 - protein, 9 aa, Homo Sapiens
GKTVAIFLK

SEQ ID NO: 1056809 - protein, 9 aa, Homo Sapiens
YSEKDEPTY

SEQ ID NO: 1056810 - protein, 9 aa, Homo Sapiens
ISRTLGPSV

SEQ ID NO: 1056811 - protein, 9 aa, Homo Sapiens
NKQEAVFEN

SEQ ID NO: 1056812 - protein, 9 aa, Homo Sapiens
FYLKKYSVA

SEQ ID NO: 1056813 - protein, 9 aa, Homo Sapiens
VKEKKHPES

SEQ ID NO: 1056814 - protein, 9 aa, Homo Sapiens
AETRNLQLN

SEQ ID NO: 1056815 - protein, 9 aa, Homo Sapiens
TLQPAVFSP

SEQ ID NO: 1056816 - protein, 9 aa, Homo Sapiens
FCVRTVCAH

SEQ ID NO: 1056817 - protein, 9 aa, Homo Sapiens
KANGLLNFD

SEQ ID NO: 1056818 - protein, 9 aa, Homo Sapiens
AWPASGHFH

SEQ ID NO: 1056819 - protein, 9 aa, Homo Sapiens
FWQLSSLLP

SEQ ID NO: 1056820 - protein, 9 aa, Homo Sapiens
ALLILSRIV

SEQ ID NO: 1056821 - protein, 9 aa, Homo Sapiens
SGIIFSYTQ

SEQ ID NO: 1056822 - protein, 9 aa, Homo Sapiens
SSPQREGYS

SEQ ID NO: 1056823 - protein, 9 aa, Homo Sapiens
HQKIYTGEK

SEQ ID NO: 1056824 - protein, 9 aa, Homo Sapiens
NVINNQQET

SEQ ID NO: 1056825 - protein, 9 aa, Homo Sapiens
QVLFMYGKQ

SEQ ID NO: 1056826 - protein, 9 aa, Homo Sapiens
QCRECASGY

SEQ ID NO: 1056827 - protein, 9 aa, Homo Sapiens
QRQDLSTDS

SEQ ID NO: 1056828 - protein, 9 aa, Homo Sapiens
SDLEKEKLQ

SEQ ID NO: 1056829 - protein, 9 aa, Homo Sapiens
WNQMNLGAI

SEQ ID NO: 1056830 - protein, 9 aa, Homo Sapiens
DYNKVFTPV

SEQ ID NO: 1056831 - protein, 9 aa, Homo Sapiens
YTSTAPIAE

SEQ ID NO: 1056832 - protein, 9 aa, Homo Sapiens
IRCYKSENI

SEQ ID NO: 1056833 - protein, 9 aa, Homo Sapiens
KAKELLSRT

SEQ ID NO: 1056834 - protein, 9 aa, Homo Sapiens
AKGRRKAFE

SEQ ID NO: 1056835 - protein, 9 aa, Homo Sapiens
VFYFYDVTR

SEQ ID NO: 1056836 - protein, 9 aa, Homo Sapiens
ILYQSADCS

SEQ ID NO: 1056837 - protein, 9 aa, Homo Sapiens
VRHKILLPG

SEQ ID NO: 1056838 - protein, 9 aa, Homo Sapiens
YLPVLDTAI

SEQ ID NO: 1056839 - protein, 9 aa, Homo Sapiens
YYKDGKQLS

SEQ ID NO: 1056840 - protein, 9 aa, Homo Sapiens
KRKVKEEVE

SEQ ID NO: 1056841 - protein, 9 aa, Homo Sapiens
YFSRSNSQK

SEQ ID NO: 1056842 - protein, 9 aa, Homo Sapiens
FDHLFFHYE

SEQ ID NO: 1056843 - protein, 9 aa, Homo Sapiens
EKEEEEAVA

SEQ ID NO: 1056844 - protein, 9 aa, Homo Sapiens
ALEDKELER

SEQ ID NO: 1056845 - protein, 9 aa, Homo Sapiens
NEGDRGNLP

SEQ ID NO: 1056846 - protein, 9 aa, Homo Sapiens
LSVFPNCRD

SEQ ID NO: 1056847 - protein, 9 aa, Homo Sapiens
DKDGKELSD

SEQ ID NO: 1056848 - protein, 9 aa, Homo Sapiens
SAFRAENEK

SEQ ID NO: 1056849 - protein, 9 aa, Homo Sapiens
QCRCQQIFM

SEQ ID NO: 1056850 - protein, 9 aa, Homo Sapiens
YTVIIREEL

SEQ ID NO: 1056851 - protein, 9 aa, Homo Sapiens
GAIKELSLE

SEQ ID NO: 1056852 - protein, 9 aa, Homo Sapiens
SFFFSTQAH

SEQ ID NO: 1056853 - protein, 9 aa, Homo Sapiens
NEREDTDLT

SEQ ID NO: 1056854 - protein, 9 aa, Homo Sapiens
FEARKISLY

SEQ ID NO: 1056855 - protein, 9 aa, Homo Sapiens
LSSPSSCNN

SEQ ID NO: 1056856 - protein, 9 aa, Homo Sapiens
ALCQLQKEN

SEQ ID NO: 1056857 - protein, 9 aa, Homo Sapiens
HPHFIYNSH

SEQ ID NO: 1056858 - protein, 9 aa, Homo Sapiens
GETSAEACP

SEQ ID NO: 1056859 - protein, 9 aa, Homo Sapiens
NLYATVIHD

SEQ ID NO: 1056860 - protein, 9 aa, Homo Sapiens
MADSFFETD

SEQ ID NO: 1056861 - protein, 9 aa, Homo Sapiens
PAQITWHLD

SEQ ID NO: 1056862 - protein, 9 aa, Homo Sapiens
LETKPLFQT

SEQ ID NO: 1056863 - protein, 9 aa, Homo Sapiens
VKIKKKGNP

SEQ ID NO: 1056864 - protein, 9 aa, Homo Sapiens
EKLRKKIRS

SEQ ID NO: 1056865 - protein, 9 aa, Homo Sapiens
GPEAEPTLG

SEQ ID NO: 1056866 - protein, 9 aa, Homo Sapiens
ERNAGSQID

SEQ ID NO: 1056867 - protein, 9 aa, Homo Sapiens
TLSAFFWRM

SEQ ID NO: 1056868 - protein, 9 aa, Homo Sapiens
KKGNPEDFV

SEQ ID NO: 1056869 - protein, 9 aa, Homo Sapiens
ILLNGVKYK

SEQ ID NO: 1056870 - protein, 9 aa, Homo Sapiens
DKTRTQRSR

SEQ ID NO: 1056871 - protein, 9 aa, Homo Sapiens
QAIQLSIKQ

SEQ ID NO: 1056872 - protein, 9 aa, Homo Sapiens
TMAPSIKSK

SEQ ID NO: 1056873 - protein, 9 aa, Homo Sapiens
SPGSAASGA

SEQ ID NO: 1056874 - protein, 9 aa, Homo Sapiens
HNRYPSPRE

SEQ ID NO: 1056875 - protein, 9 aa, Homo Sapiens
LNVGSQEAL

SEQ ID NO: 1056876 - protein, 9 aa, Homo Sapiens
PFIKLRRSK

SEQ ID NO: 1056877 - protein, 9 aa, Homo Sapiens
LFLGAPAAT

SEQ ID NO: 1056878 - protein, 9 aa, Homo Sapiens
VEFVSTGFH

SEQ ID NO: 1056879 - protein, 9 aa, Homo Sapiens
VDLTEIILL

SEQ ID NO: 1056880 - protein, 9 aa, Homo Sapiens
TLHTVDLFS

SEQ ID NO: 1056881 - protein, 9 aa, Homo Sapiens
GHLLEVPQR

SEQ ID NO: 1056882 - protein, 9 aa, Homo Sapiens
SSSGKKGAT

SEQ ID NO: 1056883 - protein, 9 aa, Homo Sapiens
PLFWRQAKV

SEQ ID NO: 1056884 - protein, 9 aa, Homo Sapiens
AFLPPGNFD

SEQ ID NO: 1056885 - protein, 9 aa, Homo Sapiens
LRKASAVPA

SEQ ID NO: 1056886 - protein, 9 aa, Homo Sapiens
PDKDTSCST

SEQ ID NO: 1056887 - protein, 9 aa, Homo Sapiens
LLADLPLPS

SEQ ID NO: 1056888 - protein, 9 aa, Homo Sapiens
SRPGTMRHP

SEQ ID NO: 1056889 - protein, 9 aa, Homo Sapiens
LNALDRYRR

SEQ ID NO: 1056890 - protein, 9 aa, Homo Sapiens
PPRVCLKPQ

SEQ ID NO: 1056891 - protein, 9 aa, Homo Sapiens
FSPVEREIL

SEQ ID NO: 1056892 - protein, 9 aa, Homo Sapiens
WTQKENISL

SEQ ID NO: 1056893 - protein, 9 aa, Homo Sapiens
CEKGSCPQE

SEQ ID NO: 1056894 - protein, 9 aa, Homo Sapiens
IHVFHHGTG

SEQ ID NO: 1056895 - protein, 9 aa, Homo Sapiens
AKHNLLKQT

SEQ ID NO: 1056896 - protein, 9 aa, Homo Sapiens
HLHFFFAVG

SEQ ID NO: 1056897 - protein, 9 aa, Homo Sapiens
YAGALLDKD

SEQ ID NO: 1056898 - protein, 9 aa, Homo Sapiens
GPRNPDGHS

SEQ ID NO: 1056899 - protein, 9 aa, Homo Sapiens
LNIIYNSQA

SEQ ID NO: 1056900 - protein, 9 aa, Homo Sapiens
FPFFLRNKV

SEQ ID NO: 1056901 - protein, 9 aa, Homo Sapiens
SMLCCHEAC

SEQ ID NO: 1056902 - protein, 9 aa, Homo Sapiens
VKENGYVQS

SEQ ID NO: 1056903 - protein, 9 aa, Homo Sapiens
CPPGLEHLL

SEQ ID NO: 1056904 - protein, 9 aa, Homo Sapiens
PVFGVTLFG

SEQ ID NO: 1056905 - protein, 9 aa, Homo Sapiens
HKRTFKAWE

SEQ ID NO: 1056906 - protein, 9 aa, Homo Sapiens
LNEGNQIVL

SEQ ID NO: 1056907 - protein, 9 aa, Homo Sapiens
DEKFDPQNS

SEQ ID NO: 1056908 - protein, 9 aa, Homo Sapiens
LTKPKVCWS

SEQ ID NO: 1056909 - protein, 9 aa, Homo Sapiens
GDEEIKFDI

SEQ ID NO: 1056910 - protein, 9 aa, Homo Sapiens
LKQSGKNQG

SEQ ID NO: 1056911 - protein, 9 aa, Homo Sapiens
LDLLNEECK

SEQ ID NO: 1056912 - protein, 9 aa, Homo Sapiens
KYYREPQKG

SEQ ID NO: 1056913 - protein, 9 aa, Homo Sapiens
EHNVCVPKT

SEQ ID NO: 1056914 - protein, 9 aa, Homo Sapiens
RLITTSASR

SEQ ID NO: 1056915 - protein, 9 aa, Homo Sapiens
PPQSARSAS

SEQ ID NO: 1056916 - protein, 9 aa, Homo Sapiens
SASAFTTTT

SEQ ID NO: 1056917 - protein, 9 aa, Homo Sapiens
ADIIFVLAM

SEQ ID NO: 1056918 - protein, 9 aa, Homo Sapiens
HFSPLKIWD

SEQ ID NO: 1056919 - protein, 9 aa, Homo Sapiens
SEGLFMLSL

SEQ ID NO: 1056920 - protein, 9 aa, Homo Sapiens
ETRTYLFDG

SEQ ID NO: 1056921 - protein, 9 aa, Homo Sapiens
CDECSFTCK

SEQ ID NO: 1056922 - protein, 9 aa, Homo Sapiens
IVKPDIPEL

SEQ ID NO: 1056923 - protein, 9 aa, Homo Sapiens
FSSIVGRPR

SEQ ID NO: 1056924 - protein, 9 aa, Homo Sapiens
NIPYSVVQG

SEQ ID NO: 1056925 - protein, 9 aa, Homo Sapiens
RQSQSNLTS

SEQ ID NO: 1056926 - protein, 9 aa, Homo Sapiens
MRGSSEEGV

SEQ ID NO: 1056927 - protein, 9 aa, Homo Sapiens
MEIEVKLYN

SEQ ID NO: 1056928 - protein, 9 aa, Homo Sapiens
LYKGLDGSL

SEQ ID NO: 1056929 - protein, 9 aa, Homo Sapiens
NHMSIKIHT

SEQ ID NO: 1056930 - protein, 9 aa, Homo Sapiens
GISEQEEKI

SEQ ID NO: 1056931 - protein, 9 aa, Homo Sapiens
IKEDSDIAF

SEQ ID NO: 1056932 - protein, 9 aa, Homo Sapiens
RCLEKWLNR

SEQ ID NO: 1056933 - protein, 9 aa, Homo Sapiens
SNFGHSSSY

SEQ ID NO: 1056934 - protein, 9 aa, Homo Sapiens
SLYISINSD

SEQ ID NO: 1056935 - protein, 9 aa, Homo Sapiens
TLPFARGGR

SEQ ID NO: 1056936 - protein, 9 aa, Homo Sapiens
PIYIVTKYM

SEQ ID NO: 1056937 - protein, 9 aa, Homo Sapiens
DIFYGRDSG

SEQ ID NO: 1056938 - protein, 9 aa, Homo Sapiens
AFCKNCCNK

SEQ ID NO: 1056939 - protein, 9 aa, Homo Sapiens
FANLTPLRT

SEQ ID NO: 1056940 - protein, 9 aa, Homo Sapiens
GRILIDKSE

SEQ ID NO: 1056941 - protein, 9 aa, Homo Sapiens
SHPPHPHHQ

SEQ ID NO: 1056942 - protein, 9 aa, Homo Sapiens
PQEKNVWEE

SEQ ID NO: 1056943 - protein, 9 aa, Homo Sapiens
NLIRPKICG

SEQ ID NO: 1056944 - protein, 9 aa, Homo Sapiens
ASKQAVTVF

SEQ ID NO: 1056945 - protein, 9 aa, Homo Sapiens
CLKPQRYRN

SEQ ID NO: 1056946 - protein, 9 aa, Homo Sapiens
SPVTPSPPC

SEQ ID NO: 1056947 - protein, 9 aa, Homo Sapiens
SACWVLRMV

SEQ ID NO: 1056948 - protein, 9 aa, Homo Sapiens
VYSTYSRKF

SEQ ID NO: 1056949 - protein, 9 aa, Homo Sapiens
CGFCYKIAV

SEQ ID NO: 1056950 - protein, 9 aa, Homo Sapiens
VSRKFRRTN

SEQ ID NO: 1056951 - protein, 9 aa, Homo Sapiens
LADLPLPSE

SEQ ID NO: 1056952 - protein, 9 aa, Homo Sapiens
SSRRERERS

SEQ ID NO: 1056953 - protein, 9 aa, Homo Sapiens
QGPLAYRDV

SEQ ID NO: 1056954 - protein, 9 aa, Homo Sapiens
DRFQVNDFP

SEQ ID NO: 1056955 - protein, 9 aa, Homo Sapiens
VRHYSSQWI

SEQ ID NO: 1056956 - protein, 9 aa, Homo Sapiens
RRVSFQQCL

SEQ ID NO: 1056957 - protein, 9 aa, Homo Sapiens
MAAPPSPER

SEQ ID NO: 1056958 - protein, 9 aa, Homo Sapiens
VSRHSARLS

SEQ ID NO: 1056959 - protein, 9 aa, Homo Sapiens
FDELKIRNP

SEQ ID NO: 1056960 - protein, 9 aa, Homo Sapiens
TYSRGQIIY

SEQ ID NO: 1056961 - protein, 9 aa, Homo Sapiens
EMKRGWEFR

SEQ ID NO: 1056962 - protein, 9 aa, Homo Sapiens
NNLCVSEIS

SEQ ID NO: 1056963 - protein, 9 aa, Homo Sapiens
NEAKPSTAS

SEQ ID NO: 1056964 - protein, 9 aa, Homo Sapiens
GTPGLQGLL

SEQ ID NO: 1056965 - protein, 9 aa, Homo Sapiens
IFKSKTDLP

SEQ ID NO: 1056966 - protein, 9 aa, Homo Sapiens
ERTLRLYDR

SEQ ID NO: 1056967 - protein, 9 aa, Homo Sapiens
DFTEPEKLL

SEQ ID NO: 1056968 - protein, 9 aa, Homo Sapiens
INFNECENV

SEQ ID NO: 1056969 - protein, 9 aa, Homo Sapiens
FLMGSLGEM

SEQ ID NO: 1056970 - protein, 9 aa, Homo Sapiens
EDSSISFSA

SEQ ID NO: 1056971 - protein, 9 aa, Homo Sapiens
PALPAFLVS

SEQ ID NO: 1056972 - protein, 9 aa, Homo Sapiens
ALLPEPLNV

SEQ ID NO: 1056973 - protein, 9 aa, Homo Sapiens
TQCQGLPCP

SEQ ID NO: 1056974 - protein, 9 aa, Homo Sapiens
SIAWSPESM

SEQ ID NO: 1056975 - protein, 9 aa, Homo Sapiens
LTQAIAETL

SEQ ID NO: 1056976 - protein, 9 aa, Homo Sapiens
IIKKVQNLE

SEQ ID NO: 1056977 - protein, 9 aa, Homo Sapiens
QYQGNPLRG

SEQ ID NO: 1056978 - protein, 9 aa, Homo Sapiens
NMKSSQYIS

SEQ ID NO: 1056979 - protein, 9 aa, Homo Sapiens
KGRPGAPGP

SEQ ID NO: 1056980 - protein, 9 aa, Homo Sapiens
YTEEGHQDW

SEQ ID NO: 1056981 - protein, 9 aa, Homo Sapiens
AMARSRLIT

SEQ ID NO: 1056982 - protein, 9 aa, Homo Sapiens
AVYVEGKTC

SEQ ID NO: 1056983 - protein, 9 aa, Homo Sapiens
CTRSENEDE

SEQ ID NO: 1056984 - protein, 9 aa, Homo Sapiens
PELLVGFSY

SEQ ID NO: 1056985 - protein, 9 aa, Homo Sapiens
FVCPEKCRC

SEQ ID NO: 1056986 - protein, 9 aa, Homo Sapiens
SYVYFLLPP

SEQ ID NO: 1056987 - protein, 9 aa, Homo Sapiens
NSWDGEAGR

SEQ ID NO: 1056988 - protein, 9 aa, Homo Sapiens
KDWCLRVEK

SEQ ID NO: 1056989 - protein, 9 aa, Homo Sapiens
KGVALLNTS

SEQ ID NO: 1056990 - protein, 9 aa, Homo Sapiens
TWTNLTCCV

SEQ ID NO: 1056991 - protein, 9 aa, Homo Sapiens
QNDLLGYPK

SEQ ID NO: 1056992 - protein, 9 aa, Homo Sapiens
IVRRTIFLL

SEQ ID NO: 1056993 - protein, 9 aa, Homo Sapiens
PSFPKNDVI

SEQ ID NO: 1056994 - protein, 9 aa, Homo Sapiens
VRKILQKKE

SEQ ID NO: 1056995 - protein, 9 aa, Homo Sapiens
IKKMAMSHE

SEQ ID NO: 1056996 - protein, 9 aa, Homo Sapiens
PAYEMMMES

SEQ ID NO: 1056997 - protein, 9 aa, Homo Sapiens
LHDYGMLLL

SEQ ID NO: 1056998 - protein, 9 aa, Homo Sapiens
AQLPKEELK

SEQ ID NO: 1056999 - protein, 9 aa, Homo Sapiens
PPGTAERPS

SEQ ID NO: 1057000 - protein, 9 aa, Homo Sapiens
LKYFGTYFG

SEQ ID NO: 1057001 - protein, 9 aa, Homo Sapiens
ASDCGEEKT

SEQ ID NO: 1057002 - protein, 9 aa, Homo Sapiens
CVIDTIVFI

SEQ ID NO: 1057003 - protein, 9 aa, Homo Sapiens
TEEEVWKVL

SEQ ID NO: 1057004 - protein, 9 aa, Homo Sapiens
YSGIKPFQC

SEQ ID NO: 1057005 - protein, 9 aa, Homo Sapiens
HKQPQNAIF

SEQ ID NO: 1057006 - protein, 9 aa, Homo Sapiens
SSIYFCSVE

SEQ ID NO: 1057007 - protein, 9 aa, Homo Sapiens
IFSVALLDR

SEQ ID NO: 1057008 - protein, 9 aa, Homo Sapiens
DKKNNAFPC

SEQ ID NO: 1057009 - protein, 9 aa, Homo Sapiens
LYGRLLWSQ

SEQ ID NO: 1057010 - protein, 9 aa, Homo Sapiens
CKDGQWQSL

SEQ ID NO: 1057011 - protein, 9 aa, Homo Sapiens
YVELHSECV

SEQ ID NO: 1057012 - protein, 9 aa, Homo Sapiens
MEYMETGTL

SEQ ID NO: 1057013 - protein, 9 aa, Homo Sapiens
SVVLGTFKL

SEQ ID NO: 1057014 - protein, 9 aa, Homo Sapiens
WRPGIVSSG

SEQ ID NO: 1057015 - protein, 9 aa, Homo Sapiens
RHMITYSEK

SEQ ID NO: 1057016 - protein, 9 aa, Homo Sapiens
QDAGACKVN

SEQ ID NO: 1057017 - protein, 9 aa, Homo Sapiens
ENMPSYFKF

SEQ ID NO: 1057018 - protein, 9 aa, Homo Sapiens
FSYNATTGR

SEQ ID NO: 1057019 - protein, 9 aa, Homo Sapiens
ELERVILYP

SEQ ID NO: 1057020 - protein, 9 aa, Homo Sapiens
TRIIYCNSN

SEQ ID NO: 1057021 - protein, 9 aa, Homo Sapiens
TASPLPARR

SEQ ID NO: 1057022 - protein, 9 aa, Homo Sapiens
LKELSYRFL

SEQ ID NO: 1057023 - protein, 9 aa, Homo Sapiens
IIFSYTQIV

SEQ ID NO: 1057024 - protein, 9 aa, Homo Sapiens
EVLAFLLDM

SEQ ID NO: 1057025 - protein, 9 aa, Homo Sapiens
HCRDTDCVD

SEQ ID NO: 1057026 - protein, 9 aa, Homo Sapiens
ASPLPARRH

SEQ ID NO: 1057027 - protein, 9 aa, Homo Sapiens
ELGDSGVFG

SEQ ID NO: 1057028 - protein, 9 aa, Homo Sapiens
NGMIKVKNQ

SEQ ID NO: 1057029 - protein, 9 aa, Homo Sapiens
VEDYPKTGE

SEQ ID NO: 1057030 - protein, 9 aa, Homo Sapiens
LHKSLHSED

SEQ ID NO: 1057031 - protein, 9 aa, Homo Sapiens
LFFFRKLRL

SEQ ID NO: 1057032 - protein, 9 aa, Homo Sapiens
DSGVFGNHS

SEQ ID NO: 1057033 - protein, 9 aa, Homo Sapiens
GTGGPPEEN

SEQ ID NO: 1057034 - protein, 9 aa, Homo Sapiens
FVSKTTHRD

SEQ ID NO: 1057035 - protein, 9 aa, Homo Sapiens
TRSTVSFWM

SEQ ID NO: 1057036 - protein, 9 aa, Homo Sapiens
NSKNFERAK

SEQ ID NO: 1057037 - protein, 9 aa, Homo Sapiens
ISVNPGLDE

SEQ ID NO: 1057038 - protein, 9 aa, Homo Sapiens
GGNSDSREK

SEQ ID NO: 1057039 - protein, 9 aa, Homo Sapiens
KFANLTPLR

SEQ ID NO: 1057040 - protein, 9 aa, Homo Sapiens
NEMMREICK

SEQ ID NO: 1057041 - protein, 9 aa, Homo Sapiens
ELVGNGTYE

SEQ ID NO: 1057042 - protein, 9 aa, Homo Sapiens
LTAKKICYQ

SEQ ID NO: 1057043 - protein, 9 aa, Homo Sapiens
VMDLPTARP

SEQ ID NO: 1057044 - protein, 9 aa, Homo Sapiens
KVPGSENKK

SEQ ID NO: 1057045 - protein, 9 aa, Homo Sapiens
YQNKKKEKQ

SEQ ID NO: 1057046 - protein, 9 aa, Homo Sapiens
KYKSMKLKK

SEQ ID NO: 1057047 - protein, 9 aa, Homo Sapiens
PDTSVLVFT

SEQ ID NO: 1057048 - protein, 9 aa, Homo Sapiens
VRVVIFAFS

SEQ ID NO: 1057049 - protein, 9 aa, Homo Sapiens
TMLLGLGMT

SEQ ID NO: 1057050 - protein, 9 aa, Homo Sapiens
ENSDGMYQC

SEQ ID NO: 1057051 - protein, 9 aa, Homo Sapiens
APPRVLKIF

SEQ ID NO: 1057052 - protein, 9 aa, Homo Sapiens
QSPCSVSSQ

SEQ ID NO: 1057053 - protein, 9 aa, Homo Sapiens
NLFEDMKDG

SEQ ID NO: 1057054 - protein, 9 aa, Homo Sapiens
ALNVEFYTL

SEQ ID NO: 1057055 - protein, 9 aa, Homo Sapiens
VFFGFLLLF

SEQ ID NO: 1057056 - protein, 9 aa, Homo Sapiens
TLLLAQLFF

SEQ ID NO: 1057057 - protein, 9 aa, Homo Sapiens
AYLRKTTEY

SEQ ID NO: 1057058 - protein, 9 aa, Homo Sapiens
AYKKEVKHL

SEQ ID NO: 1057059 - protein, 9 aa, Homo Sapiens
TDSNKRVAV

SEQ ID NO: 1057060 - protein, 9 aa, Homo Sapiens
ECFMDFVCP

SEQ ID NO: 1057061 - protein, 9 aa, Homo Sapiens
GQWQSLPRC

SEQ ID NO: 1057062 - protein, 9 aa, Homo Sapiens
HKFSGFPRV

SEQ ID NO: 1057063 - protein, 9 aa, Homo Sapiens
LRITSAERR

SEQ ID NO: 1057064 - protein, 9 aa, Homo Sapiens
IMDFQVGKK

SEQ ID NO: 1057065 - protein, 9 aa, Homo Sapiens
QCSCSFHEI

SEQ ID NO: 1057066 - protein, 9 aa, Homo Sapiens
CMTAYSNVT

SEQ ID NO: 1057067 - protein, 9 aa, Homo Sapiens
HGYQEKVLS

SEQ ID NO: 1057068 - protein, 9 aa, Homo Sapiens
PAKAFRQLQ

SEQ ID NO: 1057069 - protein, 9 aa, Homo Sapiens
SHKIQHFFC

SEQ ID NO: 1057070 - protein, 9 aa, Homo Sapiens
SFEDISTSR

SEQ ID NO: 1057071 - protein, 9 aa, Homo Sapiens
LFADQHNNI

SEQ ID NO: 1057072 - protein, 9 aa, Homo Sapiens
SVYNSYSYY

SEQ ID NO: 1057073 - protein, 9 aa, Homo Sapiens
SPSSCNNNP

SEQ ID NO: 1057074 - protein, 9 aa, Homo Sapiens
NRFIAICNP

SEQ ID NO: 1057075 - protein, 9 aa, Homo Sapiens
GTCSGAYHL

SEQ ID NO: 1057076 - protein, 9 aa, Homo Sapiens
GHFLLHSPT

SEQ ID NO: 1057077 - protein, 9 aa, Homo Sapiens
KQKSYTLNI

SEQ ID NO: 1057078 - protein, 9 aa, Homo Sapiens
SFSDAIYLA

SEQ ID NO: 1057079 - protein, 9 aa, Homo Sapiens
LTKSGTLLP

SEQ ID NO: 1057080 - protein, 9 aa, Homo Sapiens
RCARFVSRF

SEQ ID NO: 1057081 - protein, 9 aa, Homo Sapiens
TTIELVTQR

SEQ ID NO: 1057082 - protein, 9 aa, Homo Sapiens
YQGIMKTVR

SEQ ID NO: 1057083 - protein, 9 aa, Homo Sapiens
PTAAHFSAT

SEQ ID NO: 1057084 - protein, 9 aa, Homo Sapiens
TKAKRLKLL

SEQ ID NO: 1057085 - protein, 9 aa, Homo Sapiens
RQQALAQMQ

SEQ ID NO: 1057086 - protein, 9 aa, Homo Sapiens
ARIGLTKPL

SEQ ID NO: 1057087 - protein, 9 aa, Homo Sapiens
ILQLFHCLH

SEQ ID NO: 1057088 - protein, 9 aa, Homo Sapiens
TSVVNLIIR

SEQ ID NO: 1057089 - protein, 9 aa, Homo Sapiens
GWEFRIIFD

SEQ ID NO: 1057090 - protein, 9 aa, Homo Sapiens
IREHQDRLL

SEQ ID NO: 1057091 - protein, 9 aa, Homo Sapiens
KISFEKFSA

SEQ ID NO: 1057092 - protein, 9 aa, Homo Sapiens
NPDGHSMSL

SEQ ID NO: 1057093 - protein, 9 aa, Homo Sapiens
TKHDNFHGG

SEQ ID NO: 1057094 - protein, 9 aa, Homo Sapiens
APAPAAPLS

SEQ ID NO: 1057095 - protein, 9 aa, Homo Sapiens
NWAQWKDFY

SEQ ID NO: 1057096 - protein, 9 aa, Homo Sapiens
VGATCATPS

SEQ ID NO: 1057097 - protein, 9 aa, Homo Sapiens
DLLQQVGGG

SEQ ID NO: 1057098 - protein, 9 aa, Homo Sapiens
EESQDSLSK

SEQ ID NO: 1057099 - protein, 9 aa, Homo Sapiens
RGKFLRKKK

SEQ ID NO: 1057100 - protein, 9 aa, Homo Sapiens
FIVVTFGAC

SEQ ID NO: 1057101 - protein, 9 aa, Homo Sapiens
PFLGILLWL

SEQ ID NO: 1057102 - protein, 9 aa, Homo Sapiens
DKYLRKPLI

SEQ ID NO: 1057103 - protein, 9 aa, Homo Sapiens
RNTEDIPLV

SEQ ID NO: 1057104 - protein, 9 aa, Homo Sapiens
KQRLGEGRG

SEQ ID NO: 1057105 - protein, 9 aa, Homo Sapiens
SLLLDDYVV

SEQ ID NO: 1057106 - protein, 9 aa, Homo Sapiens
LYSLPPAPG

SEQ ID NO: 1057107 - protein, 9 aa, Homo Sapiens
LDGGSAGSL

SEQ ID NO: 1057108 - protein, 9 aa, Homo Sapiens
LTSNRRTSD

SEQ ID NO: 1057109 - protein, 9 aa, Homo Sapiens
NECGSGQHN

SEQ ID NO: 1057110 - protein, 9 aa, Homo Sapiens
GGYKGENLM

SEQ ID NO: 1057111 - protein, 9 aa, Homo Sapiens
LLTDGSTGV

SEQ ID NO: 1057112 - protein, 9 aa, Homo Sapiens
NSVFFLYAL

SEQ ID NO: 1057113 - protein, 9 aa, Homo Sapiens
PQGLGRSCH

SEQ ID NO: 1057114 - protein, 9 aa, Homo Sapiens
NKFKPQNCP

SEQ ID NO: 1057115 - protein, 9 aa, Homo Sapiens
GSCICNGHA

SEQ ID NO: 1057116 - protein, 9 aa, Homo Sapiens
FCFLFNLSS

SEQ ID NO: 1057117 - protein, 9 aa, Homo Sapiens
KNSFLREVE

SEQ ID NO: 1057118 - protein, 9 aa, Homo Sapiens
LAKKRKEEN

SEQ ID NO: 1057119 - protein, 9 aa, Homo Sapiens
DRLWPDSGS

SEQ ID NO: 1057120 - protein, 9 aa, Homo Sapiens
AMGDEESRE

SEQ ID NO: 1057121 - protein, 9 aa, Homo Sapiens
TETKGQKLE

SEQ ID NO: 1057122 - protein, 9 aa, Homo Sapiens
AAWIPERFF

SEQ ID NO: 1057123 - protein, 9 aa, Homo Sapiens
DIMKYFDLK

SEQ ID NO: 1057124 - protein, 9 aa, Homo Sapiens
EKKLFKCKK

SEQ ID NO: 1057125 - protein, 9 aa, Homo Sapiens
ICPQNITST

SEQ ID NO: 1057126 - protein, 9 aa, Homo Sapiens
LCQLQKENR

SEQ ID NO: 1057127 - protein, 9 aa, Homo Sapiens
FMYGKQAGF

SEQ ID NO: 1057128 - protein, 9 aa, Homo Sapiens
GDKIITGSF

SEQ ID NO: 1057129 - protein, 9 aa, Homo Sapiens
VSKTTHRDL

SEQ ID NO: 1057130 - protein, 9 aa, Homo Sapiens
STTEDKPVE

SEQ ID NO: 1057131 - protein, 9 aa, Homo Sapiens
AEQISRNHS

SEQ ID NO: 1057132 - protein, 9 aa, Homo Sapiens
GHKVVGVFT

SEQ ID NO: 1057133 - protein, 9 aa, Homo Sapiens
PEENGKPGE

SEQ ID NO: 1057134 - protein, 9 aa, Homo Sapiens
TFALEFLII

SEQ ID NO: 1057135 - protein, 9 aa, Homo Sapiens
YCCTGYKES

SEQ ID NO: 1057136 - protein, 9 aa, Homo Sapiens
KLCGQLNTT

SEQ ID NO: 1057137 - protein, 9 aa, Homo Sapiens
IHSGEKQYQ

SEQ ID NO: 1057138 - protein, 9 aa, Homo Sapiens
CKVNPLACL

SEQ ID NO: 1057139 - protein, 9 aa, Homo Sapiens
CSLEKSSNL

SEQ ID NO: 1057140 - protein, 9 aa, Homo Sapiens
FSGVFMENL

SEQ ID NO: 1057141 - protein, 9 aa, Homo Sapiens
ENSLEDPVT

SEQ ID NO: 1057142 - protein, 9 aa, Homo Sapiens
TEGSFYCVC

SEQ ID NO: 1057143 - protein, 9 aa, Homo Sapiens
AKWKGPQRQ

SEQ ID NO: 1057144 - protein, 9 aa, Homo Sapiens
NIWSHCSEP

SEQ ID NO: 1057145 - protein, 9 aa, Homo Sapiens
EDSAFFDCY

SEQ ID NO: 1057146 - protein, 9 aa, Homo Sapiens
SSCLMTKWG

SEQ ID NO: 1057147 - protein, 9 aa, Homo Sapiens
QPTGNMPNT

SEQ ID NO: 1057148 - protein, 9 aa, Homo Sapiens
KQRRKDKTY

SEQ ID NO: 1057149 - protein, 9 aa, Homo Sapiens
VKQRLGEGR

SEQ ID NO: 1057150 - protein, 9 aa, Homo Sapiens
NTSNMYPMP

SEQ ID NO: 1057151 - protein, 9 aa, Homo Sapiens
ISQKGTKNC

SEQ ID NO: 1057152 - protein, 9 aa, Homo Sapiens
IVAHKLGHV

SEQ ID NO: 1057153 - protein, 9 aa, Homo Sapiens
AKDVSSYLC

SEQ ID NO: 1057154 - protein, 9 aa, Homo Sapiens
VQEMTLRLE

SEQ ID NO: 1057155 - protein, 9 aa, Homo Sapiens
NYPVIQWFW

SEQ ID NO: 1057156 - protein, 9 aa, Homo Sapiens
GKGKKKRKV

SEQ ID NO: 1057157 - protein, 9 aa, Homo Sapiens
IGSGSKVDF

SEQ ID NO: 1057158 - protein, 9 aa, Homo Sapiens
PRMGRKKGQ

SEQ ID NO: 1057159 - protein, 9 aa, Homo Sapiens
PFSLSKDCS

SEQ ID NO: 1057160 - protein, 9 aa, Homo Sapiens
EKPIQNSHY

SEQ ID NO: 1057161 - protein, 9 aa, Homo Sapiens
VRTETKGQK

SEQ ID NO: 1057162 - protein, 9 aa, Homo Sapiens
RRVVVAGLP

SEQ ID NO: 1057163 - protein, 9 aa, Homo Sapiens
CETKSCVAA

SEQ ID NO: 1057164 - protein, 9 aa, Homo Sapiens
DPQTWLSFQ

SEQ ID NO: 1057165 - protein, 9 aa, Homo Sapiens
QQHQGLLSP

SEQ ID NO: 1057166 - protein, 9 aa, Homo Sapiens
RGSLSLCRE

SEQ ID NO: 1057167 - protein, 9 aa, Homo Sapiens
SRIKKVFYN

SEQ ID NO: 1057168 - protein, 9 aa, Homo Sapiens
PAPAMYSFL

SEQ ID NO: 1057169 - protein, 9 aa, Homo Sapiens
FVLAMTMSG

SEQ ID NO: 1057170 - protein, 9 aa, Homo Sapiens
PPLPPTISL

SEQ ID NO: 1057171 - protein, 9 aa, Homo Sapiens
ILGNGSSLS

SEQ ID NO: 1057172 - protein, 9 aa, Homo Sapiens
VMHYSFAFL

SEQ ID NO: 1057173 - protein, 9 aa, Homo Sapiens
EKFLHQRDK

SEQ ID NO: 1057174 - protein, 9 aa, Homo Sapiens
LKRLKDSIT

SEQ ID NO: 1057175 - protein, 9 aa, Homo Sapiens
KITLYSQAS

SEQ ID NO: 1057176 - protein, 9 aa, Homo Sapiens
LHKFVLKRR

SEQ ID NO: 1057177 - protein, 9 aa, Homo Sapiens
SYPSKHNYV

SEQ ID NO: 1057178 - protein, 9 aa, Homo Sapiens
SGELDFLKA

SEQ ID NO: 1057179 - protein, 9 aa, Homo Sapiens
RQLQDLRTI

SEQ ID NO: 1057180 - protein, 9 aa, Homo Sapiens
TILVVKIQK

SEQ ID NO: 1057181 - protein, 9 aa, Homo Sapiens
GRLLWSQVL

SEQ ID NO: 1057182 - protein, 9 aa, Homo Sapiens
KELEKRTIS

SEQ ID NO: 1057183 - protein, 9 aa, Homo Sapiens
PVSFQAAFT

SEQ ID NO: 1057184 - protein, 9 aa, Homo Sapiens
KLQTSPACQ

SEQ ID NO: 1057185 - protein, 9 aa, Homo Sapiens
IMTSKTITM

SEQ ID NO: 1057186 - protein, 9 aa, Homo Sapiens
KAKLRAERR

SEQ ID NO: 1057187 - protein, 9 aa, Homo Sapiens
MWNIINPMG

SEQ ID NO: 1057188 - protein, 9 aa, Homo Sapiens
YVPAEQIQQ

SEQ ID NO: 1057189 - protein, 9 aa, Homo Sapiens
AAVPSLIPV

SEQ ID NO: 1057190 - protein, 9 aa, Homo Sapiens
PEDTAIGSL

SEQ ID NO: 1057191 - protein, 9 aa, Homo Sapiens
CDISLLLNL

SEQ ID NO: 1057192 - protein, 9 aa, Homo Sapiens
GGRYGTIKD

SEQ ID NO: 1057193 - protein, 9 aa, Homo Sapiens
EEKGHITYQ

SEQ ID NO: 1057194 - protein, 9 aa, Homo Sapiens
GETRAQSVT

SEQ ID NO: 1057195 - protein, 9 aa, Homo Sapiens
KKLSSKRPL

SEQ ID NO: 1057196 - protein, 9 aa, Homo Sapiens
TSGFFQTRM

SEQ ID NO: 1057197 - protein, 9 aa, Homo Sapiens
SLCLRVRAR

SEQ ID NO: 1057198 - protein, 9 aa, Homo Sapiens
LLGSRPRQP

SEQ ID NO: 1057199 - protein, 9 aa, Homo Sapiens
FPTCCLLWR

SEQ ID NO: 1057200 - protein, 9 aa, Homo Sapiens
SSKGSSDEL

SEQ ID NO: 1057201 - protein, 9 aa, Homo Sapiens
AELGLGAVV

SEQ ID NO: 1057202 - protein, 9 aa, Homo Sapiens
ELVKRLEKQ

SEQ ID NO: 1057203 - protein, 9 aa, Homo Sapiens
ADFTVKIWD

SEQ ID NO: 1057204 - protein, 9 aa, Homo Sapiens
SALEVLRSI

SEQ ID NO: 1057205 - protein, 9 aa, Homo Sapiens
NQVVLFATC

SEQ ID NO: 1057206 - protein, 9 aa, Homo Sapiens
NTPVSAPRT

SEQ ID NO: 1057207 - protein, 9 aa, Homo Sapiens
VVSQWSRSA

SEQ ID NO: 1057208 - protein, 9 aa, Homo Sapiens
SRLPPSPRS

SEQ ID NO: 1057209 - protein, 9 aa, Homo Sapiens
SSHTVVARS

SEQ ID NO: 1057210 - protein, 9 aa, Homo Sapiens
VRNTVQENE

SEQ ID NO: 1057211 - protein, 9 aa, Homo Sapiens
LPPNTLQKA

SEQ ID NO: 1057212 - protein, 9 aa, Homo Sapiens
ANLKTKCDL

SEQ ID NO: 1057213 - protein, 9 aa, Homo Sapiens
CSGCQGDSG

SEQ ID NO: 1057214 - protein, 9 aa, Homo Sapiens
CCQSSCCRP

SEQ ID NO: 1057215 - protein, 9 aa, Homo Sapiens
KYFDLKRHE

SEQ ID NO: 1057216 - protein, 9 aa, Homo Sapiens
QGASGSQDS

SEQ ID NO: 1057217 - protein, 9 aa, Homo Sapiens
EEAVHHLVF

SEQ ID NO: 1057218 - protein, 9 aa, Homo Sapiens
GRRKAFETC

SEQ ID NO: 1057219 - protein, 9 aa, Homo Sapiens
SIMLTPKFL

SEQ ID NO: 1057220 - protein, 9 aa, Homo Sapiens
LLVACAREH

SEQ ID NO: 1057221 - protein, 9 aa, Homo Sapiens
VRAWLEGEI

SEQ ID NO: 1057222 - protein, 9 aa, Homo Sapiens
KNAEVKIAI

SEQ ID NO: 1057223 - protein, 9 aa, Homo Sapiens
GKELFEMWN

SEQ ID NO: 1057224 - protein, 9 aa, Homo Sapiens
RNFNIAGTV

SEQ ID NO: 1057225 - protein, 9 aa, Homo Sapiens
PQSRPEACS

SEQ ID NO: 1057226 - protein, 9 aa, Homo Sapiens
VSNLVSQNI

SEQ ID NO: 1057227 - protein, 9 aa, Homo Sapiens
VLGTFKLQP

SEQ ID NO: 1057228 - protein, 9 aa, Homo Sapiens
WYAHNRYPS

SEQ ID NO: 1057229 - protein, 9 aa, Homo Sapiens
LNPKTITIL

SEQ ID NO: 1057230 - protein, 9 aa, Homo Sapiens
PCSVSSQVP

SEQ ID NO: 1057231 - protein, 9 aa, Homo Sapiens
SHRSSVSSS

SEQ ID NO: 1057232 - protein, 9 aa, Homo Sapiens
RDAERDLVR

SEQ ID NO: 1057233 - protein, 9 aa, Homo Sapiens
LDKILKFVA

SEQ ID NO: 1057234 - protein, 9 aa, Homo Sapiens
TFGGIKRDQ

SEQ ID NO: 1057235 - protein, 9 aa, Homo Sapiens
CILSPKRAS

SEQ ID NO: 1057236 - protein, 9 aa, Homo Sapiens
LAQVSSHTV

SEQ ID NO: 1057237 - protein, 9 aa, Homo Sapiens
MTPKFKRKS

SEQ ID NO: 1057238 - protein, 9 aa, Homo Sapiens
PHGADYELL

SEQ ID NO: 1057239 - protein, 9 aa, Homo Sapiens
IFPRGLEYT

SEQ ID NO: 1057240 - protein, 9 aa, Homo Sapiens
TSTNCITRP

SEQ ID NO: 1057241 - protein, 9 aa, Homo Sapiens
ITLVCEEVI

SEQ ID NO: 1057242 - protein, 9 aa, Homo Sapiens
LLRNGDQWH

SEQ ID NO: 1057243 - protein, 9 aa, Homo Sapiens
SPGIKSPII

SEQ ID NO: 1057244 - protein, 9 aa, Homo Sapiens
CILQNQLEK

SEQ ID NO: 1057245 - protein, 9 aa, Homo Sapiens
EACPETRAQ

SEQ ID NO: 1057246 - protein, 9 aa, Homo Sapiens
YTIIILLLN

SEQ ID NO: 1057247 - protein, 9 aa, Homo Sapiens
PLGVNVEGA

SEQ ID NO: 1057248 - protein, 9 aa, Homo Sapiens
IFLRNQIRV

SEQ ID NO: 1057249 - protein, 9 aa, Homo Sapiens
DGISETREQ

SEQ ID NO: 1057250 - protein, 9 aa, Homo Sapiens
TGQNGPRRL

SEQ ID NO: 1057251 - protein, 9 aa, Homo Sapiens
ENRKSTMFH

SEQ ID NO: 1057252 - protein, 9 aa, Homo Sapiens
SWDGEAGRA

SEQ ID NO: 1057253 - protein, 9 aa, Homo Sapiens
EDPFIEKLL

SEQ ID NO: 1057254 - protein, 9 aa, Homo Sapiens
ISLAKVDAT

SEQ ID NO: 1057255 - protein, 9 aa, Homo Sapiens
LGSTFNENT

SEQ ID NO: 1057256 - protein, 9 aa, Homo Sapiens
CFSSLIKHK

SEQ ID NO: 1057257 - protein, 9 aa, Homo Sapiens
PVGIPRPSS

SEQ ID NO: 1057258 - protein, 9 aa, Homo Sapiens
ANNSQLQNL

SEQ ID NO: 1057259 - protein, 9 aa, Homo Sapiens
SGGAVSSMS

SEQ ID NO: 1057260 - protein, 9 aa, Homo Sapiens
SSSQSLVVH

SEQ ID NO: 1057261 - protein, 9 aa, Homo Sapiens
KGIPVREKK

SEQ ID NO: 1057262 - protein, 9 aa, Homo Sapiens
GSLQEKGLA

SEQ ID NO: 1057263 - protein, 9 aa, Homo Sapiens
YFQRDKNAF

SEQ ID NO: 1057264 - protein, 9 aa, Homo Sapiens
FCNGDTHRT

SEQ ID NO: 1057265 - protein, 9 aa, Homo Sapiens
KSEQAFSLD

SEQ ID NO: 1057266 - protein, 9 aa, Homo Sapiens
APPGLQASP

SEQ ID NO: 1057267 - protein, 9 aa, Homo Sapiens
KQLELVKRL

SEQ ID NO: 1057268 - protein, 9 aa, Homo Sapiens
KKVRKNFQK

SEQ ID NO: 1057269 - protein, 9 aa, Homo Sapiens
NMFLENLVQ

SEQ ID NO: 1057270 - protein, 9 aa, Homo Sapiens
GKSLNGKAI

SEQ ID NO: 1057271 - protein, 9 aa, Homo Sapiens
ETLNREEVY

SEQ ID NO: 1057272 - protein, 9 aa, Homo Sapiens
PAPSTKTKE

SEQ ID NO: 1057273 - protein, 9 aa, Homo Sapiens
LSSLRPALF

SEQ ID NO: 1057274 - protein, 9 aa, Homo Sapiens
SSTPIKDLD

SEQ ID NO: 1057275 - protein, 9 aa, Homo Sapiens
QVSRDIFLT

SEQ ID NO: 1057276 - protein, 9 aa, Homo Sapiens
SGLLKWQQR

SEQ ID NO: 1057277 - protein, 9 aa, Homo Sapiens
LHLFTETEI

SEQ ID NO: 1057278 - protein, 9 aa, Homo Sapiens
AKRVAIVRA

SEQ ID NO: 1057279 - protein, 9 aa, Homo Sapiens
YNVSTPGAT

SEQ ID NO: 1057280 - protein, 9 aa, Homo Sapiens
VQENEATAK

SEQ ID NO: 1057281 - protein, 9 aa, Homo Sapiens
RPPPSGFQM

SEQ ID NO: 1057282 - protein, 9 aa, Homo Sapiens
PPPLPAKAF

SEQ ID NO: 1057283 - protein, 9 aa, Homo Sapiens
EHQDRLLEL

SEQ ID NO: 1057284 - protein, 9 aa, Homo Sapiens
PAGQPIHKG

SEQ ID NO: 1057285 - protein, 9 aa, Homo Sapiens
GSSGSTEQA

SEQ ID NO: 1057286 - protein, 9 aa, Homo Sapiens
TKPLRRAPK

SEQ ID NO: 1057287 - protein, 9 aa, Homo Sapiens
EVKKEPSVK

SEQ ID NO: 1057288 - protein, 9 aa, Homo Sapiens
MIGLSDFFY

SEQ ID NO: 1057289 - protein, 9 aa, Homo Sapiens
LCRPRRSHF

SEQ ID NO: 1057290 - protein, 9 aa, Homo Sapiens
FFLGIGASK

SEQ ID NO: 1057291 - protein, 9 aa, Homo Sapiens
TKSPLKEDA

SEQ ID NO: 1057292 - protein, 9 aa, Homo Sapiens
SIISLFLIF

SEQ ID NO: 1057293 - protein, 9 aa, Homo Sapiens
QEEIQVLGS

SEQ ID NO: 1057294 - protein, 9 aa, Homo Sapiens
RPRKEWEMW

SEQ ID NO: 1057295 - protein, 9 aa, Homo Sapiens
DGQVKEEPL

SEQ ID NO: 1057296 - protein, 9 aa, Homo Sapiens
VSRDIFLTS

SEQ ID NO: 1057297 - protein, 9 aa, Homo Sapiens
GTRTLLFAL

SEQ ID NO: 1057298 - protein, 9 aa, Homo Sapiens
NPIFRFSSL

SEQ ID NO: 1057299 - protein, 9 aa, Homo Sapiens
KLTRVTVVD

SEQ ID NO: 1057300 - protein, 9 aa, Homo Sapiens
LSQDTSGQQ

SEQ ID NO: 1057301 - protein, 9 aa, Homo Sapiens
LPACEPSLL

SEQ ID NO: 1057302 - protein, 9 aa, Homo Sapiens
GKKKEGEEE

SEQ ID NO: 1057303 - protein, 9 aa, Homo Sapiens
TQKPLPAPD

SEQ ID NO: 1057304 - protein, 9 aa, Homo Sapiens
AVLVHAGWC

SEQ ID NO: 1057305 - protein, 9 aa, Homo Sapiens
LEFWKKTAR

SEQ ID NO: 1057306 - protein, 9 aa, Homo Sapiens
KNFMDGKNV

SEQ ID NO: 1057307 - protein, 9 aa, Homo Sapiens
QDPQGREVS

SEQ ID NO: 1057308 - protein, 9 aa, Homo Sapiens
EMMREICKV

SEQ ID NO: 1057309 - protein, 9 aa, Homo Sapiens
RSHHRFQRR

SEQ ID NO: 1057310 - protein, 9 aa, Homo Sapiens
LEDKNSFLR

SEQ ID NO: 1057311 - protein, 9 aa, Homo Sapiens
ERRNKAFST

SEQ ID NO: 1057312 - protein, 9 aa, Homo Sapiens
FSSEENEES

SEQ ID NO: 1057313 - protein, 9 aa, Homo Sapiens
DLGKDDMEF

SEQ ID NO: 1057314 - protein, 9 aa, Homo Sapiens
HLEPPKTGV

SEQ ID NO: 1057315 - protein, 9 aa, Homo Sapiens
TMDQKFLWA

SEQ ID NO: 1057316 - protein, 9 aa, Homo Sapiens
ILKFVMIVV

SEQ ID NO: 1057317 - protein, 9 aa, Homo Sapiens
YQEKVLSVR

SEQ ID NO: 1057318 - protein, 9 aa, Homo Sapiens
SIGDLLDSM

SEQ ID NO: 1057319 - protein, 9 aa, Homo Sapiens
SLQESVEDF

SEQ ID NO: 1057320 - protein, 9 aa, Homo Sapiens
FAIKSGQQA

SEQ ID NO: 1057321 - protein, 9 aa, Homo Sapiens
APRAPTKKL

SEQ ID NO: 1057322 - protein, 9 aa, Homo Sapiens
SDSLGQDMR

SEQ ID NO: 1057323 - protein, 9 aa, Homo Sapiens
PQEKRYEVP

SEQ ID NO: 1057324 - protein, 9 aa, Homo Sapiens
PSTKTKERV

SEQ ID NO: 1057325 - protein, 9 aa, Homo Sapiens
LRTVPDSEA

SEQ ID NO: 1057326 - protein, 9 aa, Homo Sapiens
QSYGPFLER

SEQ ID NO: 1057327 - protein, 9 aa, Homo Sapiens
TLRNRNMKR

SEQ ID NO: 1057328 - protein, 9 aa, Homo Sapiens
LRVVVVTAK

SEQ ID NO: 1057329 - protein, 9 aa, Homo Sapiens
EMEARLEKE

SEQ ID NO: 1057330 - protein, 9 aa, Homo Sapiens
WEKLRKKIR

SEQ ID NO: 1057331 - protein, 9 aa, Homo Sapiens
STAFSEASF

SEQ ID NO: 1057332 - protein, 9 aa, Homo Sapiens
GIVSSGNTC

SEQ ID NO: 1057333 - protein, 9 aa, Homo Sapiens
FPELFSEIF

SEQ ID NO: 1057334 - protein, 9 aa, Homo Sapiens
QIETVLPAE

SEQ ID NO: 1057335 - protein, 9 aa, Homo Sapiens
ALSQGHLTF

SEQ ID NO: 1057336 - protein, 9 aa, Homo Sapiens
LGMVDSRKN

SEQ ID NO: 1057337 - protein, 9 aa, Homo Sapiens
YFYKDPEET

SEQ ID NO: 1057338 - protein, 9 aa, Homo Sapiens
RVGAKSPLD

SEQ ID NO: 1057339 - protein, 9 aa, Homo Sapiens
RDFLVDNAE

SEQ ID NO: 1057340 - protein, 9 aa, Homo Sapiens
LNPGPLYPA

SEQ ID NO: 1057341 - protein, 9 aa, Homo Sapiens
PLDLEKLSE

SEQ ID NO: 1057342 - protein, 9 aa, Homo Sapiens
TSETVFTKK

SEQ ID NO: 1057343 - protein, 9 aa, Homo Sapiens
RSCSSLASG

SEQ ID NO: 1057344 - protein, 9 aa, Homo Sapiens
LCGQRQDLL

SEQ ID NO: 1057345 - protein, 9 aa, Homo Sapiens
WRAPDFVPC

SEQ ID NO: 1057346 - protein, 9 aa, Homo Sapiens
SLRVYVPLI

SEQ ID NO: 1057347 - protein, 9 aa, Homo Sapiens
SNTLGINLW

SEQ ID NO: 1057348 - protein, 9 aa, Homo Sapiens
SYAGGLLHA

SEQ ID NO: 1057349 - protein, 9 aa, Homo Sapiens
CSAVNKAGT

SEQ ID NO: 1057350 - protein, 9 aa, Homo Sapiens
CPYKCNVCN

SEQ ID NO: 1057351 - protein, 9 aa, Homo Sapiens
DAGTGEGVS

SEQ ID NO: 1057352 - protein, 9 aa, Homo Sapiens
ADDTPPSER

SEQ ID NO: 1057353 - protein, 9 aa, Homo Sapiens
NRMHPFRDN

SEQ ID NO: 1057354 - protein, 9 aa, Homo Sapiens
ICDLIIILA

SEQ ID NO: 1057355 - protein, 9 aa, Homo Sapiens
WTSFPELFS

SEQ ID NO: 1057356 - protein, 9 aa, Homo Sapiens
SIRLFDPAV

SEQ ID NO: 1057357 - protein, 9 aa, Homo Sapiens
NCEKAYTKR

SEQ ID NO: 1057358 - protein, 9 aa, Homo Sapiens
DEALISRQV

SEQ ID NO: 1057359 - protein, 9 aa, Homo Sapiens
QPVFLNPVV

SEQ ID NO: 1057360 - protein, 9 aa, Homo Sapiens
QQETPVQSV

SEQ ID NO: 1057361 - protein, 9 aa, Homo Sapiens
VFVDKDEHM

SEQ ID NO: 1057362 - protein, 9 aa, Homo Sapiens
SKYQLVLEE

SEQ ID NO: 1057363 - protein, 9 aa, Homo Sapiens
FSATPVPVT

SEQ ID NO: 1057364 - protein, 9 aa, Homo Sapiens
FPEKDHSSK

SEQ ID NO: 1057365 - protein, 9 aa, Homo Sapiens
GLLRLWPVF

SEQ ID NO: 1057366 - protein, 9 aa, Homo Sapiens
PESKGEPGD

SEQ ID NO: 1057367 - protein, 9 aa, Homo Sapiens
SALTATLFA

SEQ ID NO: 1057368 - protein, 9 aa, Homo Sapiens
EELGPATPM

SEQ ID NO: 1057369 - protein, 9 aa, Homo Sapiens
FLFLTIYLV

SEQ ID NO: 1057370 - protein, 9 aa, Homo Sapiens
KSVTIKDSV

SEQ ID NO: 1057371 - protein, 9 aa, Homo Sapiens
VLRRSGQMQ

SEQ ID NO: 1057372 - protein, 9 aa, Homo Sapiens
WGTLGKEER

SEQ ID NO: 1057373 - protein, 9 aa, Homo Sapiens
AALLPEPLN

SEQ ID NO: 1057374 - protein, 9 aa, Homo Sapiens
DYKDHQNES

SEQ ID NO: 1057375 - protein, 9 aa, Homo Sapiens
GRTLNCSGE

SEQ ID NO: 1057376 - protein, 9 aa, Homo Sapiens
KCDECSFTC

SEQ ID NO: 1057377 - protein, 9 aa, Homo Sapiens
KEGEEEKGE

SEQ ID NO: 1057378 - protein, 9 aa, Homo Sapiens
EFLKIKVST

SEQ ID NO: 1057379 - protein, 9 aa, Homo Sapiens
TSFLKSVEH

SEQ ID NO: 1057380 - protein, 9 aa, Homo Sapiens
TEFLLGSTS

SEQ ID NO: 1057381 - protein, 9 aa, Homo Sapiens
KDFKLEMEV

SEQ ID NO: 1057382 - protein, 9 aa, Homo Sapiens
QRNRVESLK

SEQ ID NO: 1057383 - protein, 9 aa, Homo Sapiens
IECWNEFSS

SEQ ID NO: 1057384 - protein, 9 aa, Homo Sapiens
SVNWREKGY

SEQ ID NO: 1057385 - protein, 9 aa, Homo Sapiens
NLLTSNYIF

SEQ ID NO: 1057386 - protein, 9 aa, Homo Sapiens
DYNFICSAL

SEQ ID NO: 1057387 - protein, 9 aa, Homo Sapiens
SAAIITQLA

SEQ ID NO: 1057388 - protein, 9 aa, Homo Sapiens
RTSYVLEEV

SEQ ID NO: 1057389 - protein, 9 aa, Homo Sapiens
QSSVAATLY

SEQ ID NO: 1057390 - protein, 9 aa, Homo Sapiens
PSDLESSKG

SEQ ID NO: 1057391 - protein, 9 aa, Homo Sapiens
SKLWIIMKY

SEQ ID NO: 1057392 - protein, 9 aa, Homo Sapiens
MYSFLETEL

SEQ ID NO: 1057393 - protein, 9 aa, Homo Sapiens
EGSNKGAKG

SEQ ID NO: 1057394 - protein, 9 aa, Homo Sapiens
SFCGNQKVA

SEQ ID NO: 1057395 - protein, 9 aa, Homo Sapiens
CKTCEGNAT

SEQ ID NO: 1057396 - protein, 9 aa, Homo Sapiens
RKSGEEQQS

SEQ ID NO: 1057397 - protein, 9 aa, Homo Sapiens
MMESVKAGV

SEQ ID NO: 1057398 - protein, 9 aa, Homo Sapiens
GFPGIEKAH

SEQ ID NO: 1057399 - protein, 9 aa, Homo Sapiens
ENISMVLFI

SEQ ID NO: 1057400 - protein, 9 aa, Homo Sapiens
LSDEEWQLV

SEQ ID NO: 1057401 - protein, 9 aa, Homo Sapiens
IQLSIKQAQ

SEQ ID NO: 1057402 - protein, 9 aa, Homo Sapiens
HSTFVCPSR

SEQ ID NO: 1057403 - protein, 9 aa, Homo Sapiens
EKKDDFFSL

SEQ ID NO: 1057404 - protein, 9 aa, Homo Sapiens
KDENLPSVI

SEQ ID NO: 1057405 - protein, 9 aa, Homo Sapiens
KQIGNVKKL

SEQ ID NO: 1057406 - protein, 9 aa, Homo Sapiens
SLGLQFVFG

SEQ ID NO: 1057407 - protein, 9 aa, Homo Sapiens
SDYEQLRQM

SEQ ID NO: 1057408 - protein, 9 aa, Homo Sapiens
FKSVTIKDS

SEQ ID NO: 1057409 - protein, 9 aa, Homo Sapiens
RLGSPRSKR

SEQ ID NO: 1057410 - protein, 9 aa, Homo Sapiens
WRQCLLISL

SEQ ID NO: 1057411 - protein, 9 aa, Homo Sapiens
ALHKSLHSE

SEQ ID NO: 1057412 - protein, 9 aa, Homo Sapiens
SEQIANFSS

SEQ ID NO: 1057413 - protein, 9 aa, Homo Sapiens
KAELEARQN

SEQ ID NO: 1057414 - protein, 9 aa, Homo Sapiens
MDLSTSTLR

SEQ ID NO: 1057415 - protein, 9 aa, Homo Sapiens
MKTYLNKRK

SEQ ID NO: 1057416 - protein, 9 aa, Homo Sapiens
GECGSPLLC

SEQ ID NO: 1057417 - protein, 9 aa, Homo Sapiens
RPSLVCHEL

SEQ ID NO: 1057418 - protein, 9 aa, Homo Sapiens
CHECLAAKK

SEQ ID NO: 1057419 - protein, 9 aa, Homo Sapiens
NQLRSDDPG

SEQ ID NO: 1057420 - protein, 9 aa, Homo Sapiens
KYVASMEQL

SEQ ID NO: 1057421 - protein, 9 aa, Homo Sapiens
PNHIMASVW

SEQ ID NO: 1057422 - protein, 9 aa, Homo Sapiens
HILCQVAGH

SEQ ID NO: 1057423 - protein, 9 aa, Homo Sapiens
GKPQRPPPQ

SEQ ID NO: 1057424 - protein, 9 aa, Homo Sapiens
PSLLKRHEK

SEQ ID NO: 1057425 - protein, 9 aa, Homo Sapiens
SCSTQNFWF

SEQ ID NO: 1057426 - protein, 9 aa, Homo Sapiens
LSPEKEEEE

SEQ ID NO: 1057427 - protein, 9 aa, Homo Sapiens
PGKKFLGRP

SEQ ID NO: 1057428 - protein, 9 aa, Homo Sapiens
PALTLSFGS

SEQ ID NO: 1057429 - protein, 9 aa, Homo Sapiens
VKKWLLSDV

SEQ ID NO: 1057430 - protein, 9 aa, Homo Sapiens
LHKTLRKIT

SEQ ID NO: 1057431 - protein, 9 aa, Homo Sapiens
SYIKQPAGA

SEQ ID NO: 1057432 - protein, 9 aa, Homo Sapiens
ERQYLPSGI

SEQ ID NO: 1057433 - protein, 9 aa, Homo Sapiens
EHVVPYRLG

SEQ ID NO: 1057434 - protein, 9 aa, Homo Sapiens
GYNMTVLFK

SEQ ID NO: 1057435 - protein, 9 aa, Homo Sapiens
IRAQDASLS

SEQ ID NO: 1057436 - protein, 9 aa, Homo Sapiens
IQSFNLETA

SEQ ID NO: 1057437 - protein, 9 aa, Homo Sapiens
IGSFRYFSR

SEQ ID NO: 1057438 - protein, 9 aa, Homo Sapiens
SMEDRMKCE

SEQ ID NO: 1057439 - protein, 9 aa, Homo Sapiens
SSFSTYHAI

SEQ ID NO: 1057440 - protein, 9 aa, Homo Sapiens
YQHQHQHQH

SEQ ID NO: 1057441 - protein, 9 aa, Homo Sapiens
VSEAAHWLA

SEQ ID NO: 1057442 - protein, 9 aa, Homo Sapiens
VVRLYQKSA

SEQ ID NO: 1057443 - protein, 9 aa, Homo Sapiens
KRKGSKGCK

SEQ ID NO: 1057444 - protein, 9 aa, Homo Sapiens
VPSPLVGPL

SEQ ID NO: 1057445 - protein, 9 aa, Homo Sapiens
RNTVQENEA

SEQ ID NO: 1057446 - protein, 9 aa, Homo Sapiens
DWLALIGGL

SEQ ID NO: 1057447 - protein, 9 aa, Homo Sapiens
LTKLLNNFF

SEQ ID NO: 1057448 - protein, 9 aa, Homo Sapiens
LGWPNELTV

SEQ ID NO: 1057449 - protein, 9 aa, Homo Sapiens
GGRDSAQSS

SEQ ID NO: 1057450 - protein, 9 aa, Homo Sapiens
VTWIGAALL

SEQ ID NO: 1057451 - protein, 9 aa, Homo Sapiens
CHYCHEEND

SEQ ID NO: 1057452 - protein, 9 aa, Homo Sapiens
APGGQALPH

SEQ ID NO: 1057453 - protein, 9 aa, Homo Sapiens
VARYFQRDK

SEQ ID NO: 1057454 - protein, 9 aa, Homo Sapiens
HGPLFQEGK

SEQ ID NO: 1057455 - protein, 9 aa, Homo Sapiens
LCLVLQPHV

SEQ ID NO: 1057456 - protein, 9 aa, Homo Sapiens
KNETLHNRT

SEQ ID NO: 1057457 - protein, 9 aa, Homo Sapiens
LGMSPQLQY

SEQ ID NO: 1057458 - protein, 9 aa, Homo Sapiens
ICKTILCLL

SEQ ID NO: 1057459 - protein, 9 aa, Homo Sapiens
LLDREAGSP

SEQ ID NO: 1057460 - protein, 9 aa, Homo Sapiens
QHNDQIQPI

SEQ ID NO: 1057461 - protein, 9 aa, Homo Sapiens
DQKFLWAGV

SEQ ID NO: 1057462 - protein, 9 aa, Homo Sapiens
LFNMTLVSS

SEQ ID NO: 1057463 - protein, 9 aa, Homo Sapiens
GGTSHLDPR

SEQ ID NO: 1057464 - protein, 9 aa, Homo Sapiens
FHHGTGKWY

SEQ ID NO: 1057465 - protein, 9 aa, Homo Sapiens
TSTNFLPMR

SEQ ID NO: 1057466 - protein, 9 aa, Homo Sapiens
TRKRSDSRK

SEQ ID NO: 1057467 - protein, 9 aa, Homo Sapiens
MTMGNDTSP

SEQ ID NO: 1057468 - protein, 9 aa, Homo Sapiens
FTSIIQQSS

SEQ ID NO: 1057469 - protein, 9 aa, Homo Sapiens
NTPEGFRCE

SEQ ID NO: 1057470 - protein, 9 aa, Homo Sapiens
LSSKMKHIR

SEQ ID NO: 1057471 - protein, 9 aa, Homo Sapiens
LTTPCLTPS

SEQ ID NO: 1057472 - protein, 9 aa, Homo Sapiens
AFFWRMVEE

SEQ ID NO: 1057473 - protein, 9 aa, Homo Sapiens
QSKGVMLKN

SEQ ID NO: 1057474 - protein, 9 aa, Homo Sapiens
DLLAGVNCS

SEQ ID NO: 1057475 - protein, 9 aa, Homo Sapiens
NESWKKFLR

SEQ ID NO: 1057476 - protein, 9 aa, Homo Sapiens
LGLDPYVSI

SEQ ID NO: 1057477 - protein, 9 aa, Homo Sapiens
SLVHILLIK

SEQ ID NO: 1057478 - protein, 9 aa, Homo Sapiens
ILKHMLVDD

SEQ ID NO: 1057479 - protein, 9 aa, Homo Sapiens
KRPSKDEMA

SEQ ID NO: 1057480 - protein, 9 aa, Homo Sapiens
QNVINNQQE

SEQ ID NO: 1057481 - protein, 9 aa, Homo Sapiens
VAQTAVAGP

SEQ ID NO: 1057482 - protein, 9 aa, Homo Sapiens
TLYSQASGR

SEQ ID NO: 1057483 - protein, 9 aa, Homo Sapiens
KEEDRGQQL

SEQ ID NO: 1057484 - protein, 9 aa, Homo Sapiens
NDLLGYPKT

SEQ ID NO: 1057485 - protein, 9 aa, Homo Sapiens
AQAASGKEL

SEQ ID NO: 1057486 - protein, 9 aa, Homo Sapiens
SCRQSHCGS

SEQ ID NO: 1057487 - protein, 9 aa, Homo Sapiens
NKWENVKIS

SEQ ID NO: 1057488 - protein, 9 aa, Homo Sapiens
KTWSQEAVF

SEQ ID NO: 1057489 - protein, 9 aa, Homo Sapiens
MDRMSGLMQ

SEQ ID NO: 1057490 - protein, 9 aa, Homo Sapiens
NKLTETISA

SEQ ID NO: 1057491 - protein, 9 aa, Homo Sapiens
NQIVLINGR

SEQ ID NO: 1057492 - protein, 9 aa, Homo Sapiens
DNPKASFEN

SEQ ID NO: 1057493 - protein, 9 aa, Homo Sapiens
DCGRPRGAP

SEQ ID NO: 1057494 - protein, 9 aa, Homo Sapiens
FTQSFDSGS

SEQ ID NO: 1057495 - protein, 9 aa, Homo Sapiens
CEMLVFLKL

SEQ ID NO: 1057496 - protein, 9 aa, Homo Sapiens
GIDTDPKLK

SEQ ID NO: 1057497 - protein, 9 aa, Homo Sapiens
TQVPGNPVL

SEQ ID NO: 1057498 - protein, 9 aa, Homo Sapiens
KAYPFSLSH

SEQ ID NO: 1057499 - protein, 9 aa, Homo Sapiens
KLGKTLENL

SEQ ID NO: 1057500 - protein, 9 aa, Homo Sapiens
SNSVVLQLL

SEQ ID NO: 1057501 - protein, 9 aa, Homo Sapiens
LSDAAKPFS

SEQ ID NO: 1057502 - protein, 9 aa, Homo Sapiens
EELKIVVIL

SEQ ID NO: 1057503 - protein, 9 aa, Homo Sapiens
SQLLQNVST

SEQ ID NO: 1057504 - protein, 9 aa, Homo Sapiens
FGGIKRDQA

SEQ ID NO: 1057505 - protein, 9 aa, Homo Sapiens
SSQKNVAPG

SEQ ID NO: 1057506 - protein, 9 aa, Homo Sapiens
PQPFCNGDT

SEQ ID NO: 1057507 - protein, 9 aa, Homo Sapiens
PPDLFPKMP

SEQ ID NO: 1057508 - protein, 9 aa, Homo Sapiens
AVETANLSP

SEQ ID NO: 1057509 - protein, 9 aa, Homo Sapiens
ELCCGLSEL

SEQ ID NO: 1057510 - protein, 9 aa, Homo Sapiens
GLDPYVSIA

SEQ ID NO: 1057511 - protein, 9 aa, Homo Sapiens
LTCDTPKED

SEQ ID NO: 1057512 - protein, 9 aa, Homo Sapiens
TGVLLFLIH

SEQ ID NO: 1057513 - protein, 9 aa, Homo Sapiens
AEGALGVAP

SEQ ID NO: 1057514 - protein, 9 aa, Homo Sapiens
FRHKIYKLS

SEQ ID NO: 1057515 - protein, 9 aa, Homo Sapiens
IIKFLGEEV

SEQ ID NO: 1057516 - protein, 9 aa, Homo Sapiens
DRIFAGFQT

SEQ ID NO: 1057517 - protein, 9 aa, Homo Sapiens
GEHSPHPRV

SEQ ID NO: 1057518 - protein, 9 aa, Homo Sapiens
RMIIKGCEI

SEQ ID NO: 1057519 - protein, 9 aa, Homo Sapiens
TWNGLLLTA

SEQ ID NO: 1057520 - protein, 9 aa, Homo Sapiens
TLTKHKIIY

SEQ ID NO: 1057521 - protein, 9 aa, Homo Sapiens
KYVPSYGPL

SEQ ID NO: 1057522 - protein, 9 aa, Homo Sapiens
SLFYLLVTP

SEQ ID NO: 1057523 - protein, 9 aa, Homo Sapiens
SPQIIFFFL

SEQ ID NO: 1057524 - protein, 9 aa, Homo Sapiens
CRGNNEGFA

SEQ ID NO: 1057525 - protein, 9 aa, Homo Sapiens
AMKDESVLR

SEQ ID NO: 1057526 - protein, 9 aa, Homo Sapiens
YLDLIDEDI

SEQ ID NO: 1057527 - protein, 9 aa, Homo Sapiens
PSENFIWEP

SEQ ID NO: 1057528 - protein, 9 aa, Homo Sapiens
INAFVTTHM

SEQ ID NO: 1057529 - protein, 9 aa, Homo Sapiens
RPIFKSKTD

SEQ ID NO: 1057530 - protein, 9 aa, Homo Sapiens
WEFRIIFDC

SEQ ID NO: 1057531 - protein, 9 aa, Homo Sapiens
TINIVTHRA

SEQ ID NO: 1057532 - protein, 9 aa, Homo Sapiens
YQDFRTQLE

SEQ ID NO: 1057533 - protein, 9 aa, Homo Sapiens
APPNILNAN

SEQ ID NO: 1057534 - protein, 9 aa, Homo Sapiens
AKRGITEYN

SEQ ID NO: 1057535 - protein, 9 aa, Homo Sapiens
FGRLSVDVN

SEQ ID NO: 1057536 - protein, 9 aa, Homo Sapiens
MIQDKSFGN

SEQ ID NO: 1057537 - protein, 9 aa, Homo Sapiens
KMLAYPRKP

SEQ ID NO: 1057538 - protein, 9 aa, Homo Sapiens
REASTLQVL

SEQ ID NO: 1057539 - protein, 9 aa, Homo Sapiens
MAKYNLPAT

SEQ ID NO: 1057540 - protein, 9 aa, Homo Sapiens
RQSASVPLP

SEQ ID NO: 1057541 - protein, 9 aa, Homo Sapiens
IKLQRRLSA

SEQ ID NO: 1057542 - protein, 9 aa, Homo Sapiens
YVFMGNMLC

SEQ ID NO: 1057543 - protein, 9 aa, Homo Sapiens
DVRAWLEGE

SEQ ID NO: 1057544 - protein, 9 aa, Homo Sapiens
CYIILYTYS

SEQ ID NO: 1057545 - protein, 9 aa, Homo Sapiens
VFGGARAAS

SEQ ID NO: 1057546 - protein, 9 aa, Homo Sapiens
LTCRCPTGF

SEQ ID NO: 1057547 - protein, 9 aa, Homo Sapiens
ALVFGGVAQ

SEQ ID NO: 1057548 - protein, 9 aa, Homo Sapiens
AFKGLPEID

SEQ ID NO: 1057549 - protein, 9 aa, Homo Sapiens
NLVSKHMNK

SEQ ID NO: 1057550 - protein, 9 aa, Homo Sapiens
SRSKERSFK

SEQ ID NO: 1057551 - protein, 9 aa, Homo Sapiens
LEEDPNPSA

SEQ ID NO: 1057552 - protein, 9 aa, Homo Sapiens
PDYAVLEMK

SEQ ID NO: 1057553 - protein, 9 aa, Homo Sapiens
QGQSRGLLR

SEQ ID NO: 1057554 - protein, 9 aa, Homo Sapiens
SQLNRISSV

SEQ ID NO: 1057555 - protein, 9 aa, Homo Sapiens
FCDFLSLLI

SEQ ID NO: 1057556 - protein, 9 aa, Homo Sapiens
GLVDGEVPK

SEQ ID NO: 1057557 - protein, 9 aa, Homo Sapiens
IDPRIQMLL

SEQ ID NO: 1057558 - protein, 9 aa, Homo Sapiens
KVVDHPKKR

SEQ ID NO: 1057559 - protein, 9 aa, Homo Sapiens
PLPLPFEFL

SEQ ID NO: 1057560 - protein, 9 aa, Homo Sapiens
FSESPQGKV

SEQ ID NO: 1057561 - protein, 9 aa, Homo Sapiens
LLYQARKKT

SEQ ID NO: 1057562 - protein, 9 aa, Homo Sapiens
VVLQLLNPL

SEQ ID NO: 1057563 - protein, 9 aa, Homo Sapiens
LISCCKPAS

SEQ ID NO: 1057564 - protein, 9 aa, Homo Sapiens
PQTVAPLSQ

SEQ ID NO: 1057565 - protein, 9 aa, Homo Sapiens
GPRQNPRRV

SEQ ID NO: 1057566 - protein, 9 aa, Homo Sapiens
SSEPKAPAP

SEQ ID NO: 1057567 - protein, 9 aa, Homo Sapiens
EKLCRLKLL

SEQ ID NO: 1057568 - protein, 9 aa, Homo Sapiens
RDKANQLVK

SEQ ID NO: 1057569 - protein, 9 aa, Homo Sapiens
EAEPTLGAR

SEQ ID NO: 1057570 - protein, 9 aa, Homo Sapiens
GVFASEEKQ

SEQ ID NO: 1057571 - protein, 9 aa, Homo Sapiens
VCQQSGEII

SEQ ID NO: 1057572 - protein, 9 aa, Homo Sapiens
FKSQDRKSE

SEQ ID NO: 1057573 - protein, 9 aa, Homo Sapiens
YLQKFISEI

SEQ ID NO: 1057574 - protein, 9 aa, Homo Sapiens
QDEKSPSTF

SEQ ID NO: 1057575 - protein, 9 aa, Homo Sapiens
DDKDMPGSH

SEQ ID NO: 1057576 - protein, 9 aa, Homo Sapiens
SAAKHKFSG

SEQ ID NO: 1057577 - protein, 9 aa, Homo Sapiens
QEDKATLEN

SEQ ID NO: 1057578 - protein, 9 aa, Homo Sapiens
NQSREKPNE

SEQ ID NO: 1057579 - protein, 9 aa, Homo Sapiens
LYVRVYLLP

SEQ ID NO: 1057580 - protein, 9 aa, Homo Sapiens
EGYSHDSLP

SEQ ID NO: 1057581 - protein, 9 aa, Homo Sapiens
AELEARQNW

SEQ ID NO: 1057582 - protein, 9 aa, Homo Sapiens
RVLSAQRSP

SEQ ID NO: 1057583 - protein, 9 aa, Homo Sapiens
LSDCILQNQ

SEQ ID NO: 1057584 - protein, 9 aa, Homo Sapiens
EVVQRLSPA

SEQ ID NO: 1057585 - protein, 9 aa, Homo Sapiens
PSVSWIKGN

SEQ ID NO: 1057586 - protein, 9 aa, Homo Sapiens
MRKLVALVL

SEQ ID NO: 1057587 - protein, 9 aa, Homo Sapiens
SVVNLIIRL

SEQ ID NO: 1057588 - protein, 9 aa, Homo Sapiens
FSGQAQLLR

SEQ ID NO: 1057589 - protein, 9 aa, Homo Sapiens
EDLPAPNNN

SEQ ID NO: 1057590 - protein, 9 aa, Homo Sapiens
WLWLCLLKV

SEQ ID NO: 1057591 - protein, 9 aa, Homo Sapiens
KKKASLTLA

SEQ ID NO: 1057592 - protein, 9 aa, Homo Sapiens
FSPSFRELP

SEQ ID NO: 1057593 - protein, 9 aa, Homo Sapiens
PGSENKKAD

SEQ ID NO: 1057594 - protein, 9 aa, Homo Sapiens
TASEVSEES

SEQ ID NO: 1057595 - protein, 9 aa, Homo Sapiens
TLGARRKKK

SEQ ID NO: 1057596 - protein, 9 aa, Homo Sapiens
VCNETCAKE

SEQ ID NO: 1057597 - protein, 9 aa, Homo Sapiens
GDPILYDPQ

SEQ ID NO: 1057598 - protein, 9 aa, Homo Sapiens
ELTEKNFRR

SEQ ID NO: 1057599 - protein, 9 aa, Homo Sapiens
VNEYCFAWV

SEQ ID NO: 1057600 - protein, 9 aa, Homo Sapiens
NGAYCCTGY

SEQ ID NO: 1057601 - protein, 9 aa, Homo Sapiens
VSPNASDSE

SEQ ID NO: 1057602 - protein, 9 aa, Homo Sapiens
FQGGQTYEM

SEQ ID NO: 1057603 - protein, 9 aa, Homo Sapiens
NVEKVWKVE

SEQ ID NO: 1057604 - protein, 9 aa, Homo Sapiens
FGIVLSNEY

SEQ ID NO: 1057605 - protein, 9 aa, Homo Sapiens
CVFARTLNK

SEQ ID NO: 1057606 - protein, 9 aa, Homo Sapiens
GYLFGNFPK

SEQ ID NO: 1057607 - protein, 9 aa, Homo Sapiens
KHLTTPSST

SEQ ID NO: 1057608 - protein, 9 aa, Homo Sapiens
AGIQEGTSG

SEQ ID NO: 1057609 - protein, 9 aa, Homo Sapiens
SLFSSSSTT

SEQ ID NO: 1057610 - protein, 9 aa, Homo Sapiens
IPLFADQHN

SEQ ID NO: 1057611 - protein, 9 aa, Homo Sapiens
EKSIEILGS

SEQ ID NO: 1057612 - protein, 9 aa, Homo Sapiens
LQKTIGKGY

SEQ ID NO: 1057613 - protein, 9 aa, Homo Sapiens
PPKPGSEKW

SEQ ID NO: 1057614 - protein, 9 aa, Homo Sapiens
CSATEAARR

SEQ ID NO: 1057615 - protein, 9 aa, Homo Sapiens
DTIKHQNQD

SEQ ID NO: 1057616 - protein, 9 aa, Homo Sapiens
PLLEMPEKK

SEQ ID NO: 1057617 - protein, 9 aa, Homo Sapiens
QKIPKTKAL

SEQ ID NO: 1057618 - protein, 9 aa, Homo Sapiens
HKEGATGDR

SEQ ID NO: 1057619 - protein, 9 aa, Homo Sapiens
ELTPSSQSK

SEQ ID NO: 1057620 - protein, 9 aa, Homo Sapiens
GAMGKTALH

SEQ ID NO: 1057621 - protein, 9 aa, Homo Sapiens
LSENLPNHI

SEQ ID NO: 1057622 - protein, 9 aa, Homo Sapiens
GKGKQCEDI

SEQ ID NO: 1057623 - protein, 9 aa, Homo Sapiens
NESDVRAIQ

SEQ ID NO: 1057624 - protein, 9 aa, Homo Sapiens
LELYGTGLR

SEQ ID NO: 1057625 - protein, 9 aa, Homo Sapiens
SLLEFVSVP

SEQ ID NO: 1057626 - protein, 9 aa, Homo Sapiens
VHQRGAMGK

SEQ ID NO: 1057627 - protein, 9 aa, Homo Sapiens
SDILEPLCS

SEQ ID NO: 1057628 - protein, 9 aa, Homo Sapiens
PSGGGGDGP

SEQ ID NO: 1057629 - protein, 9 aa, Homo Sapiens
PRTMKIPDN

SEQ ID NO: 1057630 - protein, 9 aa, Homo Sapiens
SCEGMSRHA

SEQ ID NO: 1057631 - protein, 8 aa, Homo Sapiens
ELTPGAQQ

SEQ ID NO: 1057632 - protein, 9 aa, Homo Sapiens
DYEQLRQMH

SEQ ID NO: 1057633 - protein, 9 aa, Homo Sapiens
VQQSVCTGK

SEQ ID NO: 1057634 - protein, 9 aa, Homo Sapiens
LEELHHQRP

SEQ ID NO: 1057635 - protein, 9 aa, Homo Sapiens
PPEENGKPG

SEQ ID NO: 1057636 - protein, 9 aa, Homo Sapiens
KTSICKQQT

SEQ ID NO: 1057637 - protein, 9 aa, Homo Sapiens
FAIEGYRIG

SEQ ID NO: 1057638 - protein, 9 aa, Homo Sapiens
GSSMSLIGD

SEQ ID NO: 1057639 - protein, 9 aa, Homo Sapiens
NTPAKKKME

SEQ ID NO: 1057640 - protein, 9 aa, Homo Sapiens
DVMRIFGGV

SEQ ID NO: 1057641 - protein, 9 aa, Homo Sapiens
SIFLSNGQR

SEQ ID NO: 1057642 - protein, 9 aa, Homo Sapiens
GAFKGLPEI

SEQ ID NO: 1057643 - protein, 9 aa, Homo Sapiens
PPEIVSEPL

SEQ ID NO: 1057644 - protein, 9 aa, Homo Sapiens
ASSQARSDD

SEQ ID NO: 1057645 - protein, 9 aa, Homo Sapiens
QGLNHMSIK

SEQ ID NO: 1057646 - protein, 9 aa, Homo Sapiens
PPEQEEVQR

SEQ ID NO: 1057647 - protein, 9 aa, Homo Sapiens
FTESAEARV

SEQ ID NO: 1057648 - protein, 9 aa, Homo Sapiens
LLNGVKYKS

SEQ ID NO: 1057649 - protein, 9 aa, Homo Sapiens
KESKKYRKL

SEQ ID NO: 1057650 - protein, 9 aa, Homo Sapiens
KKEEEAKKR

SEQ ID NO: 1057651 - protein, 9 aa, Homo Sapiens
KLAPCILAP

SEQ ID NO: 1057652 - protein, 9 aa, Homo Sapiens
DQPITEPGM

SEQ ID NO: 1057653 - protein, 9 aa, Homo Sapiens
EPGVVSDGL

SEQ ID NO: 1057654 - protein, 9 aa, Homo Sapiens
HCPLSAASN

SEQ ID NO: 1057655 - protein, 9 aa, Homo Sapiens
SEIFDALES

SEQ ID NO: 1057656 - protein, 9 aa, Homo Sapiens
IFSLKKIQL

SEQ ID NO: 1057657 - protein, 9 aa, Homo Sapiens
AHKLHPQET

SEQ ID NO: 1057658 - protein, 9 aa, Homo Sapiens
ASAVLTDDV

SEQ ID NO: 1057659 - protein, 9 aa, Homo Sapiens
SGEAEEYED

SEQ ID NO: 1057660 - protein, 9 aa, Homo Sapiens
KIVVILEGM

SEQ ID NO: 1057661 - protein, 9 aa, Homo Sapiens
LKSITPPSY

SEQ ID NO: 1057662 - protein, 9 aa, Homo Sapiens
RLKRNQKKE

SEQ ID NO: 1057663 - protein, 9 aa, Homo Sapiens
IIEIFKGRS

SEQ ID NO: 1057664 - protein, 9 aa, Homo Sapiens
TWNSSAVLL

SEQ ID NO: 1057665 - protein, 9 aa, Homo Sapiens
QSGPGAPIK

SEQ ID NO: 1057666 - protein, 9 aa, Homo Sapiens
DNKLTETIS

SEQ ID NO: 1057667 - protein, 9 aa, Homo Sapiens
ALLNTSVAP

SEQ ID NO: 1057668 - protein, 9 aa, Homo Sapiens
GQAEIFYAK

SEQ ID NO: 1057669 - protein, 9 aa, Homo Sapiens
LSPHPRHLQ

SEQ ID NO: 1057670 - protein, 9 aa, Homo Sapiens
TLTGMVPES

SEQ ID NO: 1057671 - protein, 9 aa, Homo Sapiens
VLNTLAELC

SEQ ID NO: 1057672 - protein, 9 aa, Homo Sapiens
NNHIEVQAE

SEQ ID NO: 1057673 - protein, 9 aa, Homo Sapiens
KFSLILEKN

SEQ ID NO: 1057674 - protein, 9 aa, Homo Sapiens
RMFKELPHF

SEQ ID NO: 1057675 - protein, 9 aa, Homo Sapiens
VNAFRKQSS

SEQ ID NO: 1057676 - protein, 9 aa, Homo Sapiens
KSTFSEPQK

SEQ ID NO: 1057677 - protein, 9 aa, Homo Sapiens
PGHSPLSGA

SEQ ID NO: 1057678 - protein, 9 aa, Homo Sapiens
DLLQVYWET

SEQ ID NO: 1057679 - protein, 9 aa, Homo Sapiens
EGDLGRLGH

SEQ ID NO: 1057680 - protein, 9 aa, Homo Sapiens
KLHPQETVF

SEQ ID NO: 1057681 - protein, 9 aa, Homo Sapiens
PHYGRPMVP

SEQ ID NO: 1057682 - protein, 9 aa, Homo Sapiens
PRQKEELDK

SEQ ID NO: 1057683 - protein, 9 aa, Homo Sapiens
NKNDEQDSD

SEQ ID NO: 1057684 - protein, 9 aa, Homo Sapiens
MMMESVKAG

SEQ ID NO: 1057685 - protein, 9 aa, Homo Sapiens
IIKYKFILN

SEQ ID NO: 1057686 - protein, 9 aa, Homo Sapiens
ETREVPSEE

SEQ ID NO: 1057687 - protein, 9 aa, Homo Sapiens
WKPLPQKRD

SEQ ID NO: 1057688 - protein, 9 aa, Homo Sapiens
SKSMVASVM

SEQ ID NO: 1057689 - protein, 9 aa, Homo Sapiens
LIKEKKDET

SEQ ID NO: 1057690 - protein, 9 aa, Homo Sapiens
YGQGFPFFL

SEQ ID NO: 1057691 - protein, 9 aa, Homo Sapiens
YGTIKDYPD

SEQ ID NO: 1057692 - protein, 9 aa, Homo Sapiens
QSRDRLDCG

SEQ ID NO: 1057693 - protein, 9 aa, Homo Sapiens
AWLENERSV

SEQ ID NO: 1057694 - protein, 9 aa, Homo Sapiens
APPPEQEEV

SEQ ID NO: 1057695 - protein, 9 aa, Homo Sapiens
VVVRVDTDG

SEQ ID NO: 1057696 - protein, 9 aa, Homo Sapiens
IRLEQDGII

SEQ ID NO: 1057697 - protein, 9 aa, Homo Sapiens
SGESKDLAG

SEQ ID NO: 1057698 - protein, 9 aa, Homo Sapiens
EAADDLPPR

SEQ ID NO: 1057699 - protein, 9 aa, Homo Sapiens
AQDNPINPK

SEQ ID NO: 1057700 - protein, 9 aa, Homo Sapiens
HTEIKEDSD

SEQ ID NO: 1057701 - protein, 9 aa, Homo Sapiens
PEDNWMENI

SEQ ID NO: 1057702 - protein, 9 aa, Homo Sapiens
DLTQQDCSQ

SEQ ID NO: 1057703 - protein, 9 aa, Homo Sapiens
SETVFTKKT

SEQ ID NO: 1057704 - protein, 9 aa, Homo Sapiens
EQDPTTFAR

SEQ ID NO: 1057705 - protein, 9 aa, Homo Sapiens
YADREILKD

SEQ ID NO: 1057706 - protein, 9 aa, Homo Sapiens
TVFTKKTIF

SEQ ID NO: 1057707 - protein, 9 aa, Homo Sapiens
PAGLERDLV

SEQ ID NO: 1057708 - protein, 9 aa, Homo Sapiens
EHVMRGTAF

SEQ ID NO: 1057709 - protein, 9 aa, Homo Sapiens
CGKAFMCPC

SEQ ID NO: 1057710 - protein, 9 aa, Homo Sapiens
NKTAANIRG

SEQ ID NO: 1057711 - protein, 9 aa, Homo Sapiens
FSSGNFAKH

SEQ ID NO: 1057712 - protein, 9 aa, Homo Sapiens
GVSFQGGQT

SEQ ID NO: 1057713 - protein, 9 aa, Homo Sapiens
GPATPRKEG

SEQ ID NO: 1057714 - protein, 9 aa, Homo Sapiens
RDSLHLLKF

SEQ ID NO: 1057715 - protein, 9 aa, Homo Sapiens
LPHLTLGPV

SEQ ID NO: 1057716 - protein, 9 aa, Homo Sapiens
SQTTAKVFF

SEQ ID NO: 1057717 - protein, 9 aa, Homo Sapiens
KLEAIDSLN

SEQ ID NO: 1057718 - protein, 9 aa, Homo Sapiens
LFYLLVTPM

SEQ ID NO: 1057719 - protein, 9 aa, Homo Sapiens
FYPTFDPLI

SEQ ID NO: 1057720 - protein, 9 aa, Homo Sapiens
GPSIPCMLG

SEQ ID NO: 1057721 - protein, 9 aa, Homo Sapiens
RVNEYCFAW

SEQ ID NO: 1057722 - protein, 9 aa, Homo Sapiens
WVQKKYLVY

SEQ ID NO: 1057723 - protein, 9 aa, Homo Sapiens
DMQPNSNLN

SEQ ID NO: 1057724 - protein, 9 aa, Homo Sapiens
DRRRSAWPL

SEQ ID NO: 1057725 - protein, 9 aa, Homo Sapiens
FVFYTVCTP

SEQ ID NO: 1057726 - protein, 9 aa, Homo Sapiens
EEMHLLEGL

SEQ ID NO: 1057727 - protein, 9 aa, Homo Sapiens
ETPYMMMNP

SEQ ID NO: 1057728 - protein, 9 aa, Homo Sapiens
IIEISTRAC

SEQ ID NO: 1057729 - protein, 9 aa, Homo Sapiens
EAREDPILV

SEQ ID NO: 1057730 - protein, 9 aa, Homo Sapiens
SIEPEEMRR

SEQ ID NO: 1057731 - protein, 9 aa, Homo Sapiens
GQGNNFYVF

SEQ ID NO: 1057732 - protein, 9 aa, Homo Sapiens
PSKGAFSEN

SEQ ID NO: 1057733 - protein, 9 aa, Homo Sapiens
QVASSLKNM

SEQ ID NO: 1057734 - protein, 9 aa, Homo Sapiens
LKFVMIVVF

SEQ ID NO: 1057735 - protein, 9 aa, Homo Sapiens
GSDEHNVCV

SEQ ID NO: 1057736 - protein, 9 aa, Homo Sapiens
FQMSSEKGQ

SEQ ID NO: 1057737 - protein, 9 aa, Homo Sapiens
EVEAEGALG

SEQ ID NO: 1057738 - protein, 9 aa, Homo Sapiens
SQITKRKKM

SEQ ID NO: 1057739 - protein, 9 aa, Homo Sapiens
QCSIDLGKD

SEQ ID NO: 1057740 - protein, 9 aa, Homo Sapiens
EVAKHHSPV

SEQ ID NO: 1057741 - protein, 9 aa, Homo Sapiens
KIYFSIMLT

SEQ ID NO: 1057742 - protein, 9 aa, Homo Sapiens
RNRNMKRGL

SEQ ID NO: 1057743 - protein, 9 aa, Homo Sapiens
NMSTLKYLW

SEQ ID NO: 1057744 - protein, 9 aa, Homo Sapiens
KCVSCPQRT

SEQ ID NO: 1057745 - protein, 9 aa, Homo Sapiens
GSQEALKDY

SEQ ID NO: 1057746 - protein, 9 aa, Homo Sapiens
GSLRPPSAP

SEQ ID NO: 1057747 - protein, 9 aa, Homo Sapiens
QSFFFCVAE

SEQ ID NO: 1057748 - protein, 9 aa, Homo Sapiens
VLCSCRMKG

SEQ ID NO: 1057749 - protein, 9 aa, Homo Sapiens
DLIFLKEIM

SEQ ID NO: 1057750 - protein, 9 aa, Homo Sapiens
LQPQHHGTS

SEQ ID NO: 1057751 - protein, 9 aa, Homo Sapiens
SSLGLQFVF

SEQ ID NO: 1057752 - protein, 9 aa, Homo Sapiens
RTAPTNLVF

SEQ ID NO: 1057753 - protein, 9 aa, Homo Sapiens
HTVDLFSDD

SEQ ID NO: 1057754 - protein, 9 aa, Homo Sapiens
EKITESTAT

SEQ ID NO: 1057755 - protein, 9 aa, Homo Sapiens
KDKSLNPQL

SEQ ID NO: 1057756 - protein, 9 aa, Homo Sapiens
GISETREQA

SEQ ID NO: 1057757 - protein, 9 aa, Homo Sapiens
AEFGDSVVQ

SEQ ID NO: 1057758 - protein, 9 aa, Homo Sapiens
TQIVSSVMK

SEQ ID NO: 1057759 - protein, 9 aa, Homo Sapiens
PGHRCWVYI

SEQ ID NO: 1057760 - protein, 9 aa, Homo Sapiens
LHLNLKKEK

SEQ ID NO: 1057761 - protein, 9 aa, Homo Sapiens
PSKNPEREL

SEQ ID NO: 1057762 - protein, 9 aa, Homo Sapiens
TNTPVSAPR

SEQ ID NO: 1057763 - protein, 9 aa, Homo Sapiens
FEKALMSPD

SEQ ID NO: 1057764 - protein, 9 aa, Homo Sapiens
ERRLWPGPR

SEQ ID NO: 1057765 - protein, 9 aa, Homo Sapiens
YVPLEDQRN

SEQ ID NO: 1057766 - protein, 9 aa, Homo Sapiens
FSMFCYSNW

SEQ ID NO: 1057767 - protein, 9 aa, Homo Sapiens
LDALNKAAW

SEQ ID NO: 1057768 - protein, 9 aa, Homo Sapiens
APEAWLENE

SEQ ID NO: 1057769 - protein, 9 aa, Homo Sapiens
NNGEILYSF

SEQ ID NO: 1057770 - protein, 9 aa, Homo Sapiens
VLNGKFANF

SEQ ID NO: 1057771 - protein, 9 aa, Homo Sapiens
GCNFNFFLR

SEQ ID NO: 1057772 - protein, 9 aa, Homo Sapiens
NIFLCQKWN

SEQ ID NO: 1057773 - protein, 9 aa, Homo Sapiens
KSGTLLPTD

SEQ ID NO: 1057774 - protein, 9 aa, Homo Sapiens
LKNTVCQFT

SEQ ID NO: 1057775 - protein, 9 aa, Homo Sapiens
LRDEPRSDE

SEQ ID NO: 1057776 - protein, 9 aa, Homo Sapiens
LATVCKIPS

SEQ ID NO: 1057777 - protein, 9 aa, Homo Sapiens
YNLPATIDF

SEQ ID NO: 1057778 - protein, 9 aa, Homo Sapiens
TRTYLFDGS

SEQ ID NO: 1057779 - protein, 9 aa, Homo Sapiens
ENSDEFKLF

SEQ ID NO: 1057780 - protein, 9 aa, Homo Sapiens
ERMIVTAYE

SEQ ID NO: 1057781 - protein, 9 aa, Homo Sapiens
LDDKNDSLR

SEQ ID NO: 1057782 - protein, 9 aa, Homo Sapiens
PRVRSHLAA

SEQ ID NO: 1057783 - protein, 9 aa, Homo Sapiens
SAFFWRMVE

SEQ ID NO: 1057784 - protein, 9 aa, Homo Sapiens
RSQSMTIMV

SEQ ID NO: 1057785 - protein, 9 aa, Homo Sapiens
NPEAASAPG

SEQ ID NO: 1057786 - protein, 9 aa, Homo Sapiens
AGKKLFGLD

SEQ ID NO: 1057787 - protein, 9 aa, Homo Sapiens
PSGVKRGSY

SEQ ID NO: 1057788 - protein, 9 aa, Homo Sapiens
YILLTIFRI

SEQ ID NO: 1057789 - protein, 9 aa, Homo Sapiens
IIGDENYLM

SEQ ID NO: 1057790 - protein, 9 aa, Homo Sapiens
TLRKITDQE

SEQ ID NO: 1057791 - protein, 9 aa, Homo Sapiens
PPEMSPLDM

SEQ ID NO: 1057792 - protein, 9 aa, Homo Sapiens
LFFMLVFPV

SEQ ID NO: 1057793 - protein, 9 aa, Homo Sapiens
PSSVFTSKL

SEQ ID NO: 1057794 - protein, 9 aa, Homo Sapiens
PPGLEHLLC

SEQ ID NO: 1057795 - protein, 9 aa, Homo Sapiens
QSDQNTIHK

SEQ ID NO: 1057796 - protein, 9 aa, Homo Sapiens
AGAEPLLRN

SEQ ID NO: 1057797 - protein, 9 aa, Homo Sapiens
DSALWVSAE

SEQ ID NO: 1057798 - protein, 9 aa, Homo Sapiens
KPVQGPLAY

SEQ ID NO: 1057799 - protein, 9 aa, Homo Sapiens
SPEKARLSS

SEQ ID NO: 1057800 - protein, 9 aa, Homo Sapiens
IDYPLEFHQ

SEQ ID NO: 1057801 - protein, 9 aa, Homo Sapiens
VRVRVVIFA

SEQ ID NO: 1057802 - protein, 9 aa, Homo Sapiens
SIPCMLGAQ

SEQ ID NO: 1057803 - protein, 9 aa, Homo Sapiens
SGVTNGYNY

SEQ ID NO: 1057804 - protein, 9 aa, Homo Sapiens
QKHRICVCV

SEQ ID NO: 1057805 - protein, 9 aa, Homo Sapiens
PRDEDTLQN

SEQ ID NO: 1057806 - protein, 9 aa, Homo Sapiens
GTDNFRDPA

SEQ ID NO: 1057807 - protein, 9 aa, Homo Sapiens
ADIHQSFRS

SEQ ID NO: 1057808 - protein, 9 aa, Homo Sapiens
LYSQQLKGL

SEQ ID NO: 1057809 - protein, 9 aa, Homo Sapiens
RATSPTPSF

SEQ ID NO: 1057810 - protein, 9 aa, Homo Sapiens
NGQVDGNKL

SEQ ID NO: 1057811 - protein, 9 aa, Homo Sapiens
SLLTSFLKS

SEQ ID NO: 1057812 - protein, 9 aa, Homo Sapiens
DKNYIHPTE

SEQ ID NO: 1057813 - protein, 9 aa, Homo Sapiens
FDGLHLWSS

SEQ ID NO: 1057814 - protein, 9 aa, Homo Sapiens
LIEYLHKNF

SEQ ID NO: 1057815 - protein, 9 aa, Homo Sapiens
LATSHPNSD

SEQ ID NO: 1057816 - protein, 9 aa, Homo Sapiens
CGTCSGAYH

SEQ ID NO: 1057817 - protein, 9 aa, Homo Sapiens
LTQVPGNPV

SEQ ID NO: 1057818 - protein, 9 aa, Homo Sapiens
KDGQWQSLP

SEQ ID NO: 1057819 - protein, 9 aa, Homo Sapiens
IMQTLHPDV

SEQ ID NO: 1057820 - protein, 9 aa, Homo Sapiens
RTALMEVSN

SEQ ID NO: 1057821 - protein, 9 aa, Homo Sapiens
EGNCPDGPR

SEQ ID NO: 1057822 - protein, 9 aa, Homo Sapiens
FQVNDFPCH

SEQ ID NO: 1057823 - protein, 9 aa, Homo Sapiens
IENSLEDPV

SEQ ID NO: 1057824 - protein, 9 aa, Homo Sapiens
RKLNEQSST

SEQ ID NO: 1057825 - protein, 9 aa, Homo Sapiens
TFQIGESFE

SEQ ID NO: 1057826 - protein, 9 aa, Homo Sapiens
IAGVAPFVE

SEQ ID NO: 1057827 - protein, 9 aa, Homo Sapiens
ASTERTLRL

SEQ ID NO: 1057828 - protein, 9 aa, Homo Sapiens
VSTISKEGY

SEQ ID NO: 1057829 - protein, 9 aa, Homo Sapiens
NKDAENEDE

SEQ ID NO: 1057830 - protein, 9 aa, Homo Sapiens
GSFTFQAIL

SEQ ID NO: 1057831 - protein, 9 aa, Homo Sapiens
WSFEILLWE

SEQ ID NO: 1057832 - protein, 9 aa, Homo Sapiens
EREAQAFLR

SEQ ID NO: 1057833 - protein, 9 aa, Homo Sapiens
WSDSTKSKN

SEQ ID NO: 1057834 - protein, 9 aa, Homo Sapiens
SFSGEASVN

SEQ ID NO: 1057835 - protein, 9 aa, Homo Sapiens
SKDKCVPRS

SEQ ID NO: 1057836 - protein, 9 aa, Homo Sapiens
TSLISGESK

SEQ ID NO: 1057837 - protein, 9 aa, Homo Sapiens
GFLYARNQA

SEQ ID NO: 1057838 - protein, 9 aa, Homo Sapiens
THTGICPYK

SEQ ID NO: 1057839 - protein, 9 aa, Homo Sapiens
ILTKHKIIY

SEQ ID NO: 1057840 - protein, 9 aa, Homo Sapiens
ASSSRSCAF

SEQ ID NO: 1057841 - protein, 9 aa, Homo Sapiens
YGPGETGFI

SEQ ID NO: 1057842 - protein, 9 aa, Homo Sapiens
ITKDTRLAE

SEQ ID NO: 1057843 - protein, 9 aa, Homo Sapiens
IDEPVSAAP

SEQ ID NO: 1057844 - protein, 9 aa, Homo Sapiens
ADADSQQSC

SEQ ID NO: 1057845 - protein, 9 aa, Homo Sapiens
MGKGRICRG

SEQ ID NO: 1057846 - protein, 9 aa, Homo Sapiens
YSWDLGPAQ

SEQ ID NO: 1057847 - protein, 9 aa, Homo Sapiens
IMAYLQQKQ

SEQ ID NO: 1057848 - protein, 9 aa, Homo Sapiens
VETSVPLLP

SEQ ID NO: 1057849 - protein, 9 aa, Homo Sapiens
QMLKSFQGT

SEQ ID NO: 1057850 - protein, 9 aa, Homo Sapiens
KIGDDNKNL

SEQ ID NO: 1057851 - protein, 9 aa, Homo Sapiens
FYMKDVCYV

SEQ ID NO: 1057852 - protein, 9 aa, Homo Sapiens
SAVKRWVWS

SEQ ID NO: 1057853 - protein, 9 aa, Homo Sapiens
FFPALHKSL

SEQ ID NO: 1057854 - protein, 9 aa, Homo Sapiens
YRFLGEDVS

SEQ ID NO: 1057855 - protein, 9 aa, Homo Sapiens
GQNVEMLML

SEQ ID NO: 1057856 - protein, 9 aa, Homo Sapiens
GKNYDVTIQ

SEQ ID NO: 1057857 - protein, 9 aa, Homo Sapiens
SDISTRYAQ

SEQ ID NO: 1057858 - protein, 9 aa, Homo Sapiens
RDSKKKSCF

SEQ ID NO: 1057859 - protein, 9 aa, Homo Sapiens
VGIRYRIAV

SEQ ID NO: 1057860 - protein, 9 aa, Homo Sapiens
RASQAGMTA

SEQ ID NO: 1057861 - protein, 9 aa, Homo Sapiens
MDFFVERKI

SEQ ID NO: 1057862 - protein, 9 aa, Homo Sapiens
GVLKELRDQ

SEQ ID NO: 1057863 - protein, 9 aa, Homo Sapiens
RIYDEKMSE

SEQ ID NO: 1057864 - protein, 9 aa, Homo Sapiens
KKNNIAEIK

SEQ ID NO: 1057865 - protein, 9 aa, Homo Sapiens
QKNLIVREH

SEQ ID NO: 1057866 - protein, 9 aa, Homo Sapiens
DLFDEFDSH

SEQ ID NO: 1057867 - protein, 9 aa, Homo Sapiens
VRGGHGCTS

SEQ ID NO: 1057868 - protein, 9 aa, Homo Sapiens
YVPSYGPLD

SEQ ID NO: 1057869 - protein, 9 aa, Homo Sapiens
EMWNIINPM

SEQ ID NO: 1057870 - protein, 9 aa, Homo Sapiens
TPADTGDLL

SEQ ID NO: 1057871 - protein, 9 aa, Homo Sapiens
ELRLFKHLK

SEQ ID NO: 1057872 - protein, 9 aa, Homo Sapiens
SDNIQIETV

SEQ ID NO: 1057873 - protein, 9 aa, Homo Sapiens
VDSQKIDKF

SEQ ID NO: 1057874 - protein, 9 aa, Homo Sapiens
WTYDSVKTS

SEQ ID NO: 1057875 - protein, 9 aa, Homo Sapiens
NRRSKSIEE

SEQ ID NO: 1057876 - protein, 9 aa, Homo Sapiens
VQQKVQKKI

SEQ ID NO: 1057877 - protein, 9 aa, Homo Sapiens
LPDHFSPFS

SEQ ID NO: 1057878 - protein, 9 aa, Homo Sapiens
WSNPSLICQ

SEQ ID NO: 1057879 - protein, 9 aa, Homo Sapiens
PICLFLDKV

SEQ ID NO: 1057880 - protein, 9 aa, Homo Sapiens
NGTLLIYNL

SEQ ID NO: 1057881 - protein, 9 aa, Homo Sapiens
EYKIVDGDD

SEQ ID NO: 1057882 - protein, 9 aa, Homo Sapiens
FADQHNNIA

SEQ ID NO: 1057883 - protein, 9 aa, Homo Sapiens
LHFPFTSII

SEQ ID NO: 1057884 - protein, 9 aa, Homo Sapiens
CLSSRSHTL

SEQ ID NO: 1057885 - protein, 9 aa, Homo Sapiens
QCQQKYSPV

SEQ ID NO: 1057886 - protein, 9 aa, Homo Sapiens
WARERPRLG

SEQ ID NO: 1057887 - protein, 9 aa, Homo Sapiens
LEDKELERV

SEQ ID NO: 1057888 - protein, 9 aa, Homo Sapiens
TLSWQNFND

SEQ ID NO: 1057889 - protein, 9 aa, Homo Sapiens
RCHECLAAK

SEQ ID NO: 1057890 - protein, 9 aa, Homo Sapiens
QGMVLSFMQ

SEQ ID NO: 1057891 - protein, 9 aa, Homo Sapiens
EAFRAQAGR

SEQ ID NO: 1057892 - protein, 9 aa, Homo Sapiens
QVLLDVRAW

SEQ ID NO: 1057893 - protein, 9 aa, Homo Sapiens
QSESSDIDD

SEQ ID NO: 1057894 - protein, 9 aa, Homo Sapiens
PTRHLFNGS

SEQ ID NO: 1057895 - protein, 9 aa, Homo Sapiens
SYSSIRLFD

SEQ ID NO: 1057896 - protein, 9 aa, Homo Sapiens
PCLDLCGQR

SEQ ID NO: 1057897 - protein, 9 aa, Homo Sapiens
SKKTFQIGE

SEQ ID NO: 1057898 - protein, 9 aa, Homo Sapiens
YGCAFFIYL

SEQ ID NO: 1057899 - protein, 9 aa, Homo Sapiens
PREQGFPGP

SEQ ID NO: 1057900 - protein, 9 aa, Homo Sapiens
HSLWVCVDN

SEQ ID NO: 1057901 - protein, 9 aa, Homo Sapiens
AGEAGCYKI

SEQ ID NO: 1057902 - protein, 9 aa, Homo Sapiens
KSFLKSLNE

SEQ ID NO: 1057903 - protein, 9 aa, Homo Sapiens
SENLYLMGM

SEQ ID NO: 1057904 - protein, 9 aa, Homo Sapiens
AKENLFIGV

SEQ ID NO: 1057905 - protein, 9 aa, Homo Sapiens
DKKNYPSLE

SEQ ID NO: 1057906 - protein, 9 aa, Homo Sapiens
LGETRAQSV

SEQ ID NO: 1057907 - protein, 9 aa, Homo Sapiens
IGLGHIYLG

SEQ ID NO: 1057908 - protein, 9 aa, Homo Sapiens
VLMELFQNS

SEQ ID NO: 1057909 - protein, 9 aa, Homo Sapiens
AQYIRAALS

SEQ ID NO: 1057910 - protein, 9 aa, Homo Sapiens
VLTFRNVAL

SEQ ID NO: 1057911 - protein, 9 aa, Homo Sapiens
VCEKGSCPQ

SEQ ID NO: 1057912 - protein, 9 aa, Homo Sapiens
DDYEEQTDK

SEQ ID NO: 1057913 - protein, 9 aa, Homo Sapiens
FEPAPAPGA

SEQ ID NO: 1057914 - protein, 9 aa, Homo Sapiens
EYSVVLGTF

SEQ ID NO: 1057915 - protein, 9 aa, Homo Sapiens
AQSLELYGT

SEQ ID NO: 1057916 - protein, 9 aa, Homo Sapiens
VLMTSELGD

SEQ ID NO: 1057917 - protein, 9 aa, Homo Sapiens
VEEDRQLIA

SEQ ID NO: 1057918 - protein, 9 aa, Homo Sapiens
IEDDLKMMW

SEQ ID NO: 1057919 - protein, 9 aa, Homo Sapiens
CKRGYCLSS

SEQ ID NO: 1057920 - protein, 9 aa, Homo Sapiens
CEEVIPDEK

SEQ ID NO: 1057921 - protein, 9 aa, Homo Sapiens
PLLQKIILD

SEQ ID NO: 1057922 - protein, 9 aa, Homo Sapiens
VELVAKEER

SEQ ID NO: 1057923 - protein, 9 aa, Homo Sapiens
KHIVILFTR

SEQ ID NO: 1057924 - protein, 9 aa, Homo Sapiens
LAFLCRPRR

SEQ ID NO: 1057925 - protein, 9 aa, Homo Sapiens
LNDEIMLRL

SEQ ID NO: 1057926 - protein, 9 aa, Homo Sapiens
KHGSLICQA

SEQ ID NO: 1057927 - protein, 9 aa, Homo Sapiens
FDGVPGSDY

SEQ ID NO: 1057928 - protein, 9 aa, Homo Sapiens
TLMALLYQA

SEQ ID NO: 1057929 - protein, 9 aa, Homo Sapiens
RFQNNPLSV

SEQ ID NO: 1057930 - protein, 9 aa, Homo Sapiens
KVESSSLAD

SEQ ID NO: 1057931 - protein, 9 aa, Homo Sapiens
QAMTAEREV

SEQ ID NO: 1057932 - protein, 9 aa, Homo Sapiens
SHLDPRKGS

SEQ ID NO: 1057933 - protein, 9 aa, Homo Sapiens
SPIIIITTK

SEQ ID NO: 1057934 - protein, 9 aa, Homo Sapiens
VYQDADIYF

SEQ ID NO: 1057935 - protein, 9 aa, Homo Sapiens
SRLQSEMNL

SEQ ID NO: 1057936 - protein, 9 aa, Homo Sapiens
LFFCADHII

SEQ ID NO: 1057937 - protein, 9 aa, Homo Sapiens
LRNETLVAF

SEQ ID NO: 1057938 - protein, 9 aa, Homo Sapiens
HEPGHETPM

SEQ ID NO: 1057939 - protein, 9 aa, Homo Sapiens
FYYQHNDQI

SEQ ID NO: 1057940 - protein, 9 aa, Homo Sapiens
DEPHEVLNF

SEQ ID NO: 1057941 - protein, 9 aa, Homo Sapiens
TAKPAAPLF

SEQ ID NO: 1057942 - protein, 9 aa, Homo Sapiens
CVVVAFYAA

SEQ ID NO: 1057943 - protein, 9 aa, Homo Sapiens
PDHTKPRRK

SEQ ID NO: 1057944 - protein, 9 aa, Homo Sapiens
ARYDTEEKG

SEQ ID NO: 1057945 - protein, 9 aa, Homo Sapiens
GSCGSNSGQ

SEQ ID NO: 1057946 - protein, 9 aa, Homo Sapiens
YQAAKTYGR

SEQ ID NO: 1057947 - protein, 9 aa, Homo Sapiens
QKHLTTPSS

SEQ ID NO: 1057948 - protein, 9 aa, Homo Sapiens
GDAGRESKF

SEQ ID NO: 1057949 - protein, 9 aa, Homo Sapiens
LRGCKIRNT

SEQ ID NO: 1057950 - protein, 9 aa, Homo Sapiens
EPTTEPSVN

SEQ ID NO: 1057951 - protein, 9 aa, Homo Sapiens
GNTMCQFLT

SEQ ID NO: 1057952 - protein, 9 aa, Homo Sapiens
LVPPRGLGA

SEQ ID NO: 1057953 - protein, 9 aa, Homo Sapiens
MYRFCTKNR

SEQ ID NO: 1057954 - protein, 9 aa, Homo Sapiens
TTEPSVNLT

SEQ ID NO: 1057955 - protein, 9 aa, Homo Sapiens
PTLGNLLSG

SEQ ID NO: 1057956 - protein, 9 aa, Homo Sapiens
VCGAVFYSC

SEQ ID NO: 1057957 - protein, 9 aa, Homo Sapiens
PDCAFSRTK

SEQ ID NO: 1057958 - protein, 9 aa, Homo Sapiens
NWRMYDVLV

SEQ ID NO: 1057959 - protein, 9 aa, Homo Sapiens
WAQWKDFYY

SEQ ID NO: 1057960 - protein, 9 aa, Homo Sapiens
LAEMNYVNR

SEQ ID NO: 1057961 - protein, 9 aa, Homo Sapiens
NKVMELKKE

SEQ ID NO: 1057962 - protein, 9 aa, Homo Sapiens
FNKENMPSY

SEQ ID NO: 1057963 - protein, 9 aa, Homo Sapiens
PQVAVDVLL

SEQ ID NO: 1057964 - protein, 9 aa, Homo Sapiens
SDLFSTIKE

SEQ ID NO: 1057965 - protein, 9 aa, Homo Sapiens
FIYNSHTAY

SEQ ID NO: 1057966 - protein, 9 aa, Homo Sapiens
VDKNLDRMV

SEQ ID NO: 1057967 - protein, 9 aa, Homo Sapiens
PQALCQGSG

SEQ ID NO: 1057968 - protein, 9 aa, Homo Sapiens
GWCCHDGHY

SEQ ID NO: 1057969 - protein, 9 aa, Homo Sapiens
SYSYYPYLY

SEQ ID NO: 1057970 - protein, 9 aa, Homo Sapiens
LPSLPAILP

SEQ ID NO: 1057971 - protein, 9 aa, Homo Sapiens
SSGNFAKHI

SEQ ID NO: 1057972 - protein, 9 aa, Homo Sapiens
FIEKLLEIM

SEQ ID NO: 1057973 - protein, 9 aa, Homo Sapiens
GVLASAVLT

SEQ ID NO: 1057974 - protein, 9 aa, Homo Sapiens
EGFWKSEVA

SEQ ID NO: 1057975 - protein, 9 aa, Homo Sapiens
KKMYVKGMI

SEQ ID NO: 1057976 - protein, 9 aa, Homo Sapiens
ICYLLRYTV

SEQ ID NO: 1057977 - protein, 9 aa, Homo Sapiens
AQLPQEKKA

SEQ ID NO: 1057978 - protein, 9 aa, Homo Sapiens
IIELILLDS

SEQ ID NO: 1057979 - protein, 9 aa, Homo Sapiens
AGPKTLKAQ

SEQ ID NO: 1057980 - protein, 9 aa, Homo Sapiens
LGGLTQVPG

SEQ ID NO: 1057981 - protein, 9 aa, Homo Sapiens
PDHLFPLLE

SEQ ID NO: 1057982 - protein, 9 aa, Homo Sapiens
RQEGGGGAE

SEQ ID NO: 1057983 - protein, 9 aa, Homo Sapiens
YLTILSEGL

SEQ ID NO: 1057984 - protein, 9 aa, Homo Sapiens
VNHPGRTNS

SEQ ID NO: 1057985 - protein, 9 aa, Homo Sapiens
ARQVWGFNF

SEQ ID NO: 1057986 - protein, 9 aa, Homo Sapiens
GEGRGGPSR

SEQ ID NO: 1057987 - protein, 9 aa, Homo Sapiens
LNEQSSTRC

SEQ ID NO: 1057988 - protein, 9 aa, Homo Sapiens
WAAIFIAQV

SEQ ID NO: 1057989 - protein, 9 aa, Homo Sapiens
TPSSQSKGV

SEQ ID NO: 1057990 - protein, 9 aa, Homo Sapiens
FDEMAKYNL

SEQ ID NO: 1057991 - protein, 9 aa, Homo Sapiens
VIFSLLNPV

SEQ ID NO: 1057992 - protein, 9 aa, Homo Sapiens
LLAYLPKEM

SEQ ID NO: 1057993 - protein, 9 aa, Homo Sapiens
FKSKTDLPE

SEQ ID NO: 1057994 - protein, 9 aa, Homo Sapiens
FLKIKVSTK

SEQ ID NO: 1057995 - protein, 9 aa, Homo Sapiens
TLFQCWLCS

SEQ ID NO: 1057996 - protein, 9 aa, Homo Sapiens
ISTRACEGQ

SEQ ID NO: 1057997 - protein, 9 aa, Homo Sapiens
YLESDRDLE

SEQ ID NO: 1057998 - protein, 9 aa, Homo Sapiens
FKDQTPLQL

SEQ ID NO: 1057999 - protein, 9 aa, Homo Sapiens
SVQVFHALR

SEQ ID NO: 1058000 - protein, 9 aa, Homo Sapiens
GPAQIISFS

SEQ ID NO: 1058001 - protein, 9 aa, Homo Sapiens
DHDADRHCG

SEQ ID NO: 1058002 - protein, 9 aa, Homo Sapiens
VIMGPETPM

SEQ ID NO: 1058003 - protein, 9 aa, Homo Sapiens
PPSGVKRGS

SEQ ID NO: 1058004 - protein, 9 aa, Homo Sapiens
PTIISRLRA

SEQ ID NO: 1058005 - protein, 9 aa, Homo Sapiens
KNSDIKQSS

SEQ ID NO: 1058006 - protein, 9 aa, Homo Sapiens
VVGSSMSLI

SEQ ID NO: 1058007 - protein, 9 aa, Homo Sapiens
MATMKKEFQ

SEQ ID NO: 1058008 - protein, 9 aa, Homo Sapiens
DLLGSMTQK

SEQ ID NO: 1058009 - protein, 9 aa, Homo Sapiens
QERLCEQNK

SEQ ID NO: 1058010 - protein, 9 aa, Homo Sapiens
LVKVLIESG

SEQ ID NO: 1058011 - protein, 9 aa, Homo Sapiens
NLPATIDFI

SEQ ID NO: 1058012 - protein, 9 aa, Homo Sapiens
RHRRCKYSH

SEQ ID NO: 1058013 - protein, 9 aa, Homo Sapiens
IQMESLVDQ

SEQ ID NO: 1058014 - protein, 9 aa, Homo Sapiens
VGEHSPHPR

SEQ ID NO: 1058015 - protein, 9 aa, Homo Sapiens
RAELQDNAV

SEQ ID NO: 1058016 - protein, 9 aa, Homo Sapiens
IHLSKDDWR

SEQ ID NO: 1058017 - protein, 9 aa, Homo Sapiens
RVSVTPREK

SEQ ID NO: 1058018 - protein, 9 aa, Homo Sapiens
DILENQFMN

SEQ ID NO: 1058019 - protein, 9 aa, Homo Sapiens
FPQSLYQFF

SEQ ID NO: 1058020 - protein, 9 aa, Homo Sapiens
VCASDVTIR

SEQ ID NO: 1058021 - protein, 9 aa, Homo Sapiens
TKNFDNYFE

SEQ ID NO: 1058022 - protein, 9 aa, Homo Sapiens
SCNGQVDGN

SEQ ID NO: 1058023 - protein, 9 aa, Homo Sapiens
LMFRGVGDQ

SEQ ID NO: 1058024 - protein, 9 aa, Homo Sapiens
DGQWQSLPR

SEQ ID NO: 1058025 - protein, 9 aa, Homo Sapiens
PPGTPGLQG

SEQ ID NO: 1058026 - protein, 9 aa, Homo Sapiens
VADNKKMYV

SEQ ID NO: 1058027 - protein, 9 aa, Homo Sapiens
LLAGVNCSF

SEQ ID NO: 1058028 - protein, 9 aa, Homo Sapiens
FASLLTGIA

SEQ ID NO: 1058029 - protein, 9 aa, Homo Sapiens
FSLSKDCSL

SEQ ID NO: 1058030 - protein, 9 aa, Homo Sapiens
HVVPYRLGS

SEQ ID NO: 1058031 - protein, 9 aa, Homo Sapiens
KVTGSGGAY

SEQ ID NO: 1058032 - protein, 9 aa, Homo Sapiens
GEMGYFAYW

SEQ ID NO: 1058033 - protein, 9 aa, Homo Sapiens
DCFGMWIEY

SEQ ID NO: 1058034 - protein, 9 aa, Homo Sapiens
VIINIAELR

SEQ ID NO: 1058035 - protein, 9 aa, Homo Sapiens
PRVPGLPSR

SEQ ID NO: 1058036 - protein, 9 aa, Homo Sapiens
SLEELLLRW

SEQ ID NO: 1058037 - protein, 9 aa, Homo Sapiens
CLNTEGSFY

SEQ ID NO: 1058038 - protein, 9 aa, Homo Sapiens
GLTTLRNET

SEQ ID NO: 1058039 - protein, 9 aa, Homo Sapiens
PKNPFYDSS

SEQ ID NO: 1058040 - protein, 9 aa, Homo Sapiens
VIDTIVFIA

SEQ ID NO: 1058041 - protein, 9 aa, Homo Sapiens
VPDAGTGEG

SEQ ID NO: 1058042 - protein, 9 aa, Homo Sapiens
LFQAMQKNL

SEQ ID NO: 1058043 - protein, 9 aa, Homo Sapiens
QLHCRCPGS

SEQ ID NO: 1058044 - protein, 9 aa, Homo Sapiens
VQKGDLVAI

SEQ ID NO: 1058045 - protein, 9 aa, Homo Sapiens
AAPLSTPAA

SEQ ID NO: 1058046 - protein, 9 aa, Homo Sapiens
IQELSVAYN

SEQ ID NO: 1058047 - protein, 9 aa, Homo Sapiens
LLMEKDQVE

SEQ ID NO: 1058048 - protein, 9 aa, Homo Sapiens
PEENSRKMT

SEQ ID NO: 1058049 - protein, 9 aa, Homo Sapiens
EIWRQKKKM

SEQ ID NO: 1058050 - protein, 9 aa, Homo Sapiens
NTVSFYGGH

SEQ ID NO: 1058051 - protein, 9 aa, Homo Sapiens
HAKTKEAGN

SEQ ID NO: 1058052 - protein, 9 aa, Homo Sapiens
KKAAFSYRH

SEQ ID NO: 1058053 - protein, 9 aa, Homo Sapiens
TANTLFWAV

SEQ ID NO: 1058054 - protein, 9 aa, Homo Sapiens
TLGEVFNRL

SEQ ID NO: 1058055 - protein, 9 aa, Homo Sapiens
PNKTAANIR

SEQ ID NO: 1058056 - protein, 9 aa, Homo Sapiens
GTMNGCRLQ

SEQ ID NO: 1058057 - protein, 9 aa, Homo Sapiens
WSSFFSPTS

SEQ ID NO: 1058058 - protein, 9 aa, Homo Sapiens
LMYFSIRHL

SEQ ID NO: 1058059 - protein, 9 aa, Homo Sapiens
ILKGQSLRQ

SEQ ID NO: 1058060 - protein, 9 aa, Homo Sapiens
DPALSTPAP

SEQ ID NO: 1058061 - protein, 9 aa, Homo Sapiens
VKNGECFCA

SEQ ID NO: 1058062 - protein, 9 aa, Homo Sapiens
SVMKDSAQE

SEQ ID NO: 1058063 - protein, 9 aa, Homo Sapiens
IISAIVHYS

SEQ ID NO: 1058064 - protein, 9 aa, Homo Sapiens
TKDCQVSEW

SEQ ID NO: 1058065 - protein, 9 aa, Homo Sapiens
LEVLRSIAS

SEQ ID NO: 1058066 - protein, 9 aa, Homo Sapiens
IYTLKNAEV

SEQ ID NO: 1058067 - protein, 9 aa, Homo Sapiens
RRRSAWPLA

SEQ ID NO: 1058068 - protein, 9 aa, Homo Sapiens
RLYYLITTY

SEQ ID NO: 1058069 - protein, 9 aa, Homo Sapiens
AVELWEKAS

SEQ ID NO: 1058070 - protein, 9 aa, Homo Sapiens
IYSDCWLAT

SEQ ID NO: 1058071 - protein, 9 aa, Homo Sapiens
LFKKKAGHD

SEQ ID NO: 1058072 - protein, 9 aa, Homo Sapiens
LGEEKNGYV

SEQ ID NO: 1058073 - protein, 9 aa, Homo Sapiens
DISTRYAQY

SEQ ID NO: 1058074 - protein, 9 aa, Homo Sapiens
SPAHKVTGS

SEQ ID NO: 1058075 - protein, 9 aa, Homo Sapiens
MKRQKSGGN

SEQ ID NO: 1058076 - protein, 9 aa, Homo Sapiens
TQPPSAFSL

SEQ ID NO: 1058077 - protein, 9 aa, Homo Sapiens
VRIKMVVVG

SEQ ID NO: 1058078 - protein, 9 aa, Homo Sapiens
QTLPFARGG

SEQ ID NO: 1058079 - protein, 9 aa, Homo Sapiens
AALMKMSGP

SEQ ID NO: 1058080 - protein, 9 aa, Homo Sapiens
RPAQISLVA

SEQ ID NO: 1058081 - protein, 9 aa, Homo Sapiens
HFWRKICCN

SEQ ID NO: 1058082 - protein, 9 aa, Homo Sapiens
AASEPVVYG

SEQ ID NO: 1058083 - protein, 9 aa, Homo Sapiens
LVLAWLGME

SEQ ID NO: 1058084 - protein, 9 aa, Homo Sapiens
DCAISPPQC

SEQ ID NO: 1058085 - protein, 9 aa, Homo Sapiens
FFRVDTAKL

SEQ ID NO: 1058086 - protein, 9 aa, Homo Sapiens
VLPNDVLQI

SEQ ID NO: 1058087 - protein, 9 aa, Homo Sapiens
FRNRLMDTA

SEQ ID NO: 1058088 - protein, 9 aa, Homo Sapiens
VEKVFMARN

SEQ ID NO: 1058089 - protein, 9 aa, Homo Sapiens
NKMLAYPRK

SEQ ID NO: 1058090 - protein, 9 aa, Homo Sapiens
YAVGGRNKL

SEQ ID NO: 1058091 - protein, 9 aa, Homo Sapiens
RIPAYEMMM

SEQ ID NO: 1058092 - protein, 9 aa, Homo Sapiens
RDLVPEDET

SEQ ID NO: 1058093 - protein, 9 aa, Homo Sapiens
MEFSDLGKH

SEQ ID NO: 1058094 - protein, 9 aa, Homo Sapiens
DYSTAMDTE

SEQ ID NO: 1058095 - protein, 9 aa, Homo Sapiens
IILAEAIRR

SEQ ID NO: 1058096 - protein, 9 aa, Homo Sapiens
SLSSSQSLV

SEQ ID NO: 1058097 - protein, 9 aa, Homo Sapiens
VTSNPRHLH

SEQ ID NO: 1058098 - protein, 9 aa, Homo Sapiens
EEPTTEPSV

SEQ ID NO: 1058099 - protein, 9 aa, Homo Sapiens
DSGGSLVCK

SEQ ID NO: 1058100 - protein, 9 aa, Homo Sapiens
NSRKMTETQ

SEQ ID NO: 1058101 - protein, 9 aa, Homo Sapiens
EEIWRQKKK

SEQ ID NO: 1058102 - protein, 9 aa, Homo Sapiens
SAKKSASLD

SEQ ID NO: 1058103 - protein, 9 aa, Homo Sapiens
LMPHLAQAG

SEQ ID NO: 1058104 - protein, 9 aa, Homo Sapiens
CGKVFNNFS

SEQ ID NO: 1058105 - protein, 9 aa, Homo Sapiens
QVPQSMAFA

SEQ ID NO: 1058106 - protein, 9 aa, Homo Sapiens
TPSENFIWE

SEQ ID NO: 1058107 - protein, 9 aa, Homo Sapiens
CLSPILLSD

SEQ ID NO: 1058108 - protein, 9 aa, Homo Sapiens
PVSPNHLPV

SEQ ID NO: 1058109 - protein, 9 aa, Homo Sapiens
VSTRSSKAL

SEQ ID NO: 1058110 - protein, 9 aa, Homo Sapiens
ESLVDQDPD

SEQ ID NO: 1058111 - protein, 9 aa, Homo Sapiens
LQMRVLAVR

SEQ ID NO: 1058112 - protein, 9 aa, Homo Sapiens
RTTMILFKM

SEQ ID NO: 1058113 - protein, 9 aa, Homo Sapiens
KKEEFVTLK

SEQ ID NO: 1058114 - protein, 9 aa, Homo Sapiens
YTEPLLSLR

SEQ ID NO: 1058115 - protein, 9 aa, Homo Sapiens
KGENLMKIL

SEQ ID NO: 1058116 - protein, 9 aa, Homo Sapiens
CCHDGHYFS

SEQ ID NO: 1058117 - protein, 9 aa, Homo Sapiens
HIGTMNGCR

SEQ ID NO: 1058118 - protein, 9 aa, Homo Sapiens
KEVYEDLEV

SEQ ID NO: 1058119 - protein, 9 aa, Homo Sapiens
LGKEERKTS

SEQ ID NO: 1058120 - protein, 9 aa, Homo Sapiens
TRGQLEERM

SEQ ID NO: 1058121 - protein, 9 aa, Homo Sapiens
VVFSISVVA

SEQ ID NO: 1058122 - protein, 9 aa, Homo Sapiens
QKNPKKSRQ

SEQ ID NO: 1058123 - protein, 9 aa, Homo Sapiens
NTYSSIGDL

SEQ ID NO: 1058124 - protein, 9 aa, Homo Sapiens
SLAIFAAES

SEQ ID NO: 1058125 - protein, 9 aa, Homo Sapiens
IKFEIGEAL

SEQ ID NO: 1058126 - protein, 9 aa, Homo Sapiens
LLEFGNMED

SEQ ID NO: 1058127 - protein, 9 aa, Homo Sapiens
FSDTYLPVL

SEQ ID NO: 1058128 - protein, 9 aa, Homo Sapiens
VCCQSSCCR

SEQ ID NO: 1058129 - protein, 9 aa, Homo Sapiens
EKIPVFVWM

SEQ ID NO: 1058130 - protein, 9 aa, Homo Sapiens
DSIPQWNNN

SEQ ID NO: 1058131 - protein, 9 aa, Homo Sapiens
PKTLKAQAG

SEQ ID NO: 1058132 - protein, 9 aa, Homo Sapiens
NLAPASPRQ

SEQ ID NO: 1058133 - protein, 9 aa, Homo Sapiens
RKILDNKLT

SEQ ID NO: 1058134 - protein, 9 aa, Homo Sapiens
VKNPYLDLI

SEQ ID NO: 1058135 - protein, 9 aa, Homo Sapiens
LTEAVLLKL

SEQ ID NO: 1058136 - protein, 9 aa, Homo Sapiens
ARGAHGNSY

SEQ ID NO: 1058137 - protein, 9 aa, Homo Sapiens
PLNYEKQKS

SEQ ID NO: 1058138 - protein, 9 aa, Homo Sapiens
SILGNSCDL

SEQ ID NO: 1058139 - protein, 9 aa, Homo Sapiens
LIRKHTSSG

SEQ ID NO: 1058140 - protein, 9 aa, Homo Sapiens
NDNSKRYYV

SEQ ID NO: 1058141 - protein, 9 aa, Homo Sapiens
GSDIANKLY

SEQ ID NO: 1058142 - protein, 9 aa, Homo Sapiens
AALARETDK

SEQ ID NO: 1058143 - protein, 9 aa, Homo Sapiens
YISADRMFE

SEQ ID NO: 1058144 - protein, 9 aa, Homo Sapiens
ETGPPFYLK

SEQ ID NO: 1058145 - protein, 9 aa, Homo Sapiens
FSKDHKYSY

SEQ ID NO: 1058146 - protein, 9 aa, Homo Sapiens
KFWKHLVYK

SEQ ID NO: 1058147 - protein, 9 aa, Homo Sapiens
PEEVRGFWQ

SEQ ID NO: 1058148 - protein, 9 aa, Homo Sapiens
HHRFQRRPD

SEQ ID NO: 1058149 - protein, 9 aa, Homo Sapiens
RPAKLGALY

SEQ ID NO: 1058150 - protein, 9 aa, Homo Sapiens
FCPYLKAFG

SEQ ID NO: 1058151 - protein, 9 aa, Homo Sapiens
VALLNTSVA

SEQ ID NO: 1058152 - protein, 9 aa, Homo Sapiens
RFQASSFSK

SEQ ID NO: 1058153 - protein, 9 aa, Homo Sapiens
GGLGNGLRS

SEQ ID NO: 1058154 - protein, 9 aa, Homo Sapiens
LSCENIRIN

SEQ ID NO: 1058155 - protein, 9 aa, Homo Sapiens
EEPIYIVTK

SEQ ID NO: 1058156 - protein, 9 aa, Homo Sapiens
ELFKNGNDF

SEQ ID NO: 1058157 - protein, 9 aa, Homo Sapiens
DWAGRSRKL

SEQ ID NO: 1058158 - protein, 9 aa, Homo Sapiens
GSELPPGPV

SEQ ID NO: 1058159 - protein, 9 aa, Homo Sapiens
PSDDKDMPG

SEQ ID NO: 1058160 - protein, 9 aa, Homo Sapiens
TAPTNLVFI

SEQ ID NO: 1058161 - protein, 9 aa, Homo Sapiens
PHAGARDHG

SEQ ID NO: 1058162 - protein, 9 aa, Homo Sapiens
SEYIIRGDN

SEQ ID NO: 1058163 - protein, 9 aa, Homo Sapiens
VSKHMNKTS

SEQ ID NO: 1058164 - protein, 9 aa, Homo Sapiens
RTRIINSKT

SEQ ID NO: 1058165 - protein, 9 aa, Homo Sapiens
YMAKFAYWG

SEQ ID NO: 1058166 - protein, 9 aa, Homo Sapiens
RPKASYDLA

SEQ ID NO: 1058167 - protein, 9 aa, Homo Sapiens
RVYVINKEF

SEQ ID NO: 1058168 - protein, 9 aa, Homo Sapiens
KSPLDIEGA

SEQ ID NO: 1058169 - protein, 9 aa, Homo Sapiens
GKNWEYIQD

SEQ ID NO: 1058170 - protein, 9 aa, Homo Sapiens
KACKIAKMP

SEQ ID NO: 1058171 - protein, 9 aa, Homo Sapiens
KEDKNQLQQ

SEQ ID NO: 1058172 - protein, 9 aa, Homo Sapiens
RLKPASHSG

SEQ ID NO: 1058173 - protein, 9 aa, Homo Sapiens
ILIHLSKDD

SEQ ID NO: 1058174 - protein, 9 aa, Homo Sapiens
GDLLGSMTQ

SEQ ID NO: 1058175 - protein, 9 aa, Homo Sapiens
EKKKKYMLP

SEQ ID NO: 1058176 - protein, 9 aa, Homo Sapiens
NITSTLHHL

SEQ ID NO: 1058177 - protein, 9 aa, Homo Sapiens
EQKVALHCA

SEQ ID NO: 1058178 - protein, 9 aa, Homo Sapiens
SRKNSTRWS

SEQ ID NO: 1058179 - protein, 9 aa, Homo Sapiens
RLEDISMAH

SEQ ID NO: 1058180 - protein, 9 aa, Homo Sapiens
KQAQTVAEQ

SEQ ID NO: 1058181 - protein, 9 aa, Homo Sapiens
LKKEEFVTL

SEQ ID NO: 1058182 - protein, 9 aa, Homo Sapiens
CCGHFSPLK

SEQ ID NO: 1058183 - protein, 9 aa, Homo Sapiens
YGELVYHAL

SEQ ID NO: 1058184 - protein, 9 aa, Homo Sapiens
LNLKVMMEA

SEQ ID NO: 1058185 - protein, 9 aa, Homo Sapiens
MEHLVQYFQ

SEQ ID NO: 1058186 - protein, 9 aa, Homo Sapiens
LVHAGWCCH

SEQ ID NO: 1058187 - protein, 9 aa, Homo Sapiens
AAHFFSHRD

SEQ ID NO: 1058188 - protein, 9 aa, Homo Sapiens
MLRVNEYCF

SEQ ID NO: 1058189 - protein, 9 aa, Homo Sapiens
IMGKFVKVE

SEQ ID NO: 1058190 - protein, 9 aa, Homo Sapiens
KHLEQQKKH

SEQ ID NO: 1058191 - protein, 9 aa, Homo Sapiens
AIMKSIISA

SEQ ID NO: 1058192 - protein, 9 aa, Homo Sapiens
ALSLLLPPP

SEQ ID NO: 1058193 - protein, 9 aa, Homo Sapiens
EKKDLRSSN

SEQ ID NO: 1058194 - protein, 9 aa, Homo Sapiens
KFVMIVVFG

SEQ ID NO: 1058195 - protein, 9 aa, Homo Sapiens
SGDFTQSFD

SEQ ID NO: 1058196 - protein, 9 aa, Homo Sapiens
TDLPWTSVF

SEQ ID NO: 1058197 - protein, 9 aa, Homo Sapiens
ESSRVDFGL

SEQ ID NO: 1058198 - protein, 9 aa, Homo Sapiens
FPGAAGGAE

SEQ ID NO: 1058199 - protein, 9 aa, Homo Sapiens
DFYPNGENK

SEQ ID NO: 1058200 - protein, 9 aa, Homo Sapiens
SKHMNKTSH

SEQ ID NO: 1058201 - protein, 9 aa, Homo Sapiens
VEIKVESSS

SEQ ID NO: 1058202 - protein, 9 aa, Homo Sapiens
SSKSALHLS

SEQ ID NO: 1058203 - protein, 9 aa, Homo Sapiens
TIINSKQME

SEQ ID NO: 1058204 - protein, 9 aa, Homo Sapiens
RFGMASGDR

SEQ ID NO: 1058205 - protein, 9 aa, Homo Sapiens
DYLELHIPL

SEQ ID NO: 1058206 - protein, 9 aa, Homo Sapiens
PLLRQTTAK

SEQ ID NO: 1058207 - protein, 9 aa, Homo Sapiens
TWLSTECDF

SEQ ID NO: 1058208 - protein, 9 aa, Homo Sapiens
FSPPSGGGG

SEQ ID NO: 1058209 - protein, 9 aa, Homo Sapiens
ILETNFNAN

SEQ ID NO: 1058210 - protein, 9 aa, Homo Sapiens
EASTLQVLG

SEQ ID NO: 1058211 - protein, 9 aa, Homo Sapiens
YDPQEKRYE

SEQ ID NO: 1058212 - protein, 9 aa, Homo Sapiens
MCPCYVRRH

SEQ ID NO: 1058213 - protein, 9 aa, Homo Sapiens
QESQRRKER

SEQ ID NO: 1058214 - protein, 9 aa, Homo Sapiens
ITSRHYLDF

SEQ ID NO: 1058215 - protein, 9 aa, Homo Sapiens
YIIQLLENF

SEQ ID NO: 1058216 - protein, 9 aa, Homo Sapiens
FSSRDSNVF

SEQ ID NO: 1058217 - protein, 9 aa, Homo Sapiens
RKERISDNR

SEQ ID NO: 1058218 - protein, 9 aa, Homo Sapiens
QDCRIVLKS

SEQ ID NO: 1058219 - protein, 9 aa, Homo Sapiens
NTEFLASFS

SEQ ID NO: 1058220 - protein, 9 aa, Homo Sapiens
TLGEKMIEE

SEQ ID NO: 1058221 - protein, 9 aa, Homo Sapiens
RPSKEVHLA

SEQ ID NO: 1058222 - protein, 9 aa, Homo Sapiens
WFHKNLSPG

SEQ ID NO: 1058223 - protein, 9 aa, Homo Sapiens
ILRASPSKA

SEQ ID NO: 1058224 - protein, 9 aa, Homo Sapiens
KASMKFHQQ

SEQ ID NO: 1058225 - protein, 9 aa, Homo Sapiens
ERDLWKCPS

SEQ ID NO: 1058226 - protein, 9 aa, Homo Sapiens
DRNVSPVPP

SEQ ID NO: 1058227 - protein, 9 aa, Homo Sapiens
FTIKWDISG

SEQ ID NO: 1058228 - protein, 9 aa, Homo Sapiens
SSGPGQALQ

SEQ ID NO: 1058229 - protein, 9 aa, Homo Sapiens
GAPIKQAPA

SEQ ID NO: 1058230 - protein, 9 aa, Homo Sapiens
LNRVVMAGN

SEQ ID NO: 1058231 - protein, 9 aa, Homo Sapiens
HIIYVPAEQ

SEQ ID NO: 1058232 - protein, 9 aa, Homo Sapiens
GQTINIVTH

SEQ ID NO: 1058233 - protein, 9 aa, Homo Sapiens
DVTYFSFDY

SEQ ID NO: 1058234 - protein, 9 aa, Homo Sapiens
SESSWYDFP

SEQ ID NO: 1058235 - protein, 9 aa, Homo Sapiens
WKSEVAAYL

SEQ ID NO: 1058236 - protein, 9 aa, Homo Sapiens
SPALSTSSL

SEQ ID NO: 1058237 - protein, 9 aa, Homo Sapiens
LLDDYVVPL

SEQ ID NO: 1058238 - protein, 9 aa, Homo Sapiens
CLLSPLARE

SEQ ID NO: 1058239 - protein, 9 aa, Homo Sapiens
QAVLKFTTK

SEQ ID NO: 1058240 - protein, 9 aa, Homo Sapiens
DQNTIHKNL

SEQ ID NO: 1058241 - protein, 9 aa, Homo Sapiens
REKTEHAEK

SEQ ID NO: 1058242 - protein, 9 aa, Homo Sapiens
RLFVDKNLD

SEQ ID NO: 1058243 - protein, 9 aa, Homo Sapiens
GDDNKNLTF

SEQ ID NO: 1058244 - protein, 9 aa, Homo Sapiens
PQQRCVTPF

SEQ ID NO: 1058245 - protein, 9 aa, Homo Sapiens
ALVKKKKLQ

SEQ ID NO: 1058246 - protein, 9 aa, Homo Sapiens
RKKSYSVYV

SEQ ID NO: 1058247 - protein, 9 aa, Homo Sapiens
LQQMDILPN

SEQ ID NO: 1058248 - protein, 9 aa, Homo Sapiens
LYLTAEPEV

SEQ ID NO: 1058249 - protein, 9 aa, Homo Sapiens
TLQALHDRE

SEQ ID NO: 1058250 - protein, 9 aa, Homo Sapiens
KCRVDLLFL

SEQ ID NO: 1058251 - protein, 9 aa, Homo Sapiens
LKQKSQCLH

SEQ ID NO: 1058252 - protein, 9 aa, Homo Sapiens
QVYWETMSS

SEQ ID NO: 1058253 - protein, 9 aa, Homo Sapiens
TYNVSTPGA

SEQ ID NO: 1058254 - protein, 9 aa, Homo Sapiens
IFFLHDSVY

SEQ ID NO: 1058255 - protein, 9 aa, Homo Sapiens
ASGYNQGYA

SEQ ID NO: 1058256 - protein, 9 aa, Homo Sapiens
KLTETISAQ

SEQ ID NO: 1058257 - protein, 9 aa, Homo Sapiens
LLVGFSYNA

SEQ ID NO: 1058258 - protein, 9 aa, Homo Sapiens
SSITGILPI

SEQ ID NO: 1058259 - protein, 9 aa, Homo Sapiens
NGTYEQVYK

SEQ ID NO: 1058260 - protein, 9 aa, Homo Sapiens
KLTETPPVK

SEQ ID NO: 1058261 - protein, 9 aa, Homo Sapiens
KEKKHPESN

SEQ ID NO: 1058262 - protein, 9 aa, Homo Sapiens
FMLVFPVFG

SEQ ID NO: 1058263 - protein, 9 aa, Homo Sapiens
QLDLFYTQG

SEQ ID NO: 1058264 - protein, 9 aa, Homo Sapiens
QYQGIMKTV

SEQ ID NO: 1058265 - protein, 9 aa, Homo Sapiens
KLDISKNSL

SEQ ID NO: 1058266 - protein, 9 aa, Homo Sapiens
CRTAPTNLV

SEQ ID NO: 1058267 - protein, 9 aa, Homo Sapiens
SGQKEGVFG

SEQ ID NO: 1058268 - protein, 9 aa, Homo Sapiens
CATWEAMET

SEQ ID NO: 1058269 - protein, 9 aa, Homo Sapiens
IVKRKDLEL

SEQ ID NO: 1058270 - protein, 9 aa, Homo Sapiens
STKTSFREK

SEQ ID NO: 1058271 - protein, 9 aa, Homo Sapiens
LLGSMTQKS

SEQ ID NO: 1058272 - protein, 9 aa, Homo Sapiens
AGFQTRSQM

SEQ ID NO: 1058273 - protein, 9 aa, Homo Sapiens
KKNKLGPET

SEQ ID NO: 1058274 - protein, 9 aa, Homo Sapiens
EIKSSELEE

SEQ ID NO: 1058275 - protein, 9 aa, Homo Sapiens
WEAMETCKD

SEQ ID NO: 1058276 - protein, 9 aa, Homo Sapiens
NVSPVPPAS

SEQ ID NO: 1058277 - protein, 9 aa, Homo Sapiens
QVIIGDENY

SEQ ID NO: 1058278 - protein, 9 aa, Homo Sapiens
ATLFAPPLS

SEQ ID NO: 1058279 - protein, 9 aa, Homo Sapiens
MEIAIKRAD

SEQ ID NO: 1058280 - protein, 9 aa, Homo Sapiens
WRTVFSSLG

SEQ ID NO: 1058281 - protein, 9 aa, Homo Sapiens
PELAISGKL

SEQ ID NO: 1058282 - protein, 9 aa, Homo Sapiens
RKKGQGNSD

SEQ ID NO: 1058283 - protein, 9 aa, Homo Sapiens
SKFNILKIN

SEQ ID NO: 1058284 - protein, 9 aa, Homo Sapiens
GGDVTFYDV

SEQ ID NO: 1058285 - protein, 9 aa, Homo Sapiens
AVTAAEFWI

SEQ ID NO: 1058286 - protein, 9 aa, Homo Sapiens
IVSEKTIFF

SEQ ID NO: 1058287 - protein, 9 aa, Homo Sapiens
PLTEKKDDF

SEQ ID NO: 1058288 - protein, 9 aa, Homo Sapiens
YSTLSISPE

SEQ ID NO: 1058289 - protein, 9 aa, Homo Sapiens
MALLYQARK

SEQ ID NO: 1058290 - protein, 9 aa, Homo Sapiens
FTMEVAKHH

SEQ ID NO: 1058291 - protein, 9 aa, Homo Sapiens
PEKLLDKEL

SEQ ID NO: 1058292 - protein, 9 aa, Homo Sapiens
DAHTDTTNK

SEQ ID NO: 1058293 - protein, 9 aa, Homo Sapiens
PLLVSVTRN

SEQ ID NO: 1058294 - protein, 9 aa, Homo Sapiens
RVAIVRAGV

SEQ ID NO: 1058295 - protein, 9 aa, Homo Sapiens
ILTSFDGVP

SEQ ID NO: 1058296 - protein, 9 aa, Homo Sapiens
FQPVETGGV

SEQ ID NO: 1058297 - protein, 9 aa, Homo Sapiens
QSLGTGIML

SEQ ID NO: 1058298 - protein, 9 aa, Homo Sapiens
SRTPTRHLF

SEQ ID NO: 1058299 - protein, 9 aa, Homo Sapiens
KDFFRAYTM

SEQ ID NO: 1058300 - protein, 9 aa, Homo Sapiens
LRGSLSLCR

SEQ ID NO: 1058301 - protein, 9 aa, Homo Sapiens
YGAGCTLEC

SEQ ID NO: 1058302 - protein, 9 aa, Homo Sapiens
EDGVQDLLL

SEQ ID NO: 1058303 - protein, 9 aa, Homo Sapiens
RYGTIKDYP

SEQ ID NO: 1058304 - protein, 9 aa, Homo Sapiens
EFSDLGKHC

SEQ ID NO: 1058305 - protein, 9 aa, Homo Sapiens
LDDIFFTPE

SEQ ID NO: 1058306 - protein, 9 aa, Homo Sapiens
SAAEVKKPG

SEQ ID NO: 1058307 - protein, 9 aa, Homo Sapiens
KGNEGPPGS

SEQ ID NO: 1058308 - protein, 9 aa, Homo Sapiens
TNNSFFCPV

SEQ ID NO: 1058309 - protein, 9 aa, Homo Sapiens
ATTSYSCPC

SEQ ID NO: 1058310 - protein, 9 aa, Homo Sapiens
DAIVLAEKA

SEQ ID NO: 1058311 - protein, 9 aa, Homo Sapiens
EKRGSSKSG

SEQ ID NO: 1058312 - protein, 9 aa, Homo Sapiens
KNAFPPTYV

SEQ ID NO: 1058313 - protein, 9 aa, Homo Sapiens
VIQDQCILQ

SEQ ID NO: 1058314 - protein, 9 aa, Homo Sapiens
FTQMDLGDC

SEQ ID NO: 1058315 - protein, 9 aa, Homo Sapiens
FIVLFFVYM

SEQ ID NO: 1058316 - protein, 9 aa, Homo Sapiens
LFLLPMPLL

SEQ ID NO: 1058317 - protein, 9 aa, Homo Sapiens
SLQMGTNKR

SEQ ID NO: 1058318 - protein, 9 aa, Homo Sapiens
DEIMLRLLL

SEQ ID NO: 1058319 - protein, 9 aa, Homo Sapiens
NYRDAERDL

SEQ ID NO: 1058320 - protein, 9 aa, Homo Sapiens
DPISGHVSF

SEQ ID NO: 1058321 - protein, 9 aa, Homo Sapiens
HTGEELLEG

SEQ ID NO: 1058322 - protein, 9 aa, Homo Sapiens
EVFCREQQH

SEQ ID NO: 1058323 - protein, 9 aa, Homo Sapiens
FSNIQEIEA

SEQ ID NO: 1058324 - protein, 9 aa, Homo Sapiens
PRLENVGLY

SEQ ID NO: 1058325 - protein, 9 aa, Homo Sapiens
ILRRYENCG

SEQ ID NO: 1058326 - protein, 9 aa, Homo Sapiens
AGTKTTSTT

SEQ ID NO: 1058327 - protein, 9 aa, Homo Sapiens
KWLLSDVIS

SEQ ID NO: 1058328 - protein, 9 aa, Homo Sapiens
VHRFGKHLF

SEQ ID NO: 1058329 - protein, 9 aa, Homo Sapiens
FEEATEEEK

SEQ ID NO: 1058330 - protein, 9 aa, Homo Sapiens
KRTFKAWEG

SEQ ID NO: 1058331 - protein, 9 aa, Homo Sapiens
VSVCRRKAG

SEQ ID NO: 1058332 - protein, 9 aa, Homo Sapiens
RESSISGAG

SEQ ID NO: 1058333 - protein, 9 aa, Homo Sapiens
DVLCSCPGR

SEQ ID NO: 1058334 - protein, 9 aa, Homo Sapiens
QKVEYLIEF

SEQ ID NO: 1058335 - protein, 9 aa, Homo Sapiens
NADSLNICI

SEQ ID NO: 1058336 - protein, 9 aa, Homo Sapiens
GLSSGFGFG

SEQ ID NO: 1058337 - protein, 9 aa, Homo Sapiens
IIYCNSNSQ

SEQ ID NO: 1058338 - protein, 9 aa, Homo Sapiens
KKVPVPPSK

SEQ ID NO: 1058339 - protein, 9 aa, Homo Sapiens
LKRNQKKEK

SEQ ID NO: 1058340 - protein, 9 aa, Homo Sapiens
FNKGVALLN

SEQ ID NO: 1058341 - protein, 9 aa, Homo Sapiens
YVNQNKFLC

SEQ ID NO: 1058342 - protein, 9 aa, Homo Sapiens
TAFGREHFP

SEQ ID NO: 1058343 - protein, 9 aa, Homo Sapiens
LPGFSQNSN

SEQ ID NO: 1058344 - protein, 9 aa, Homo Sapiens
DQWKIDRNS

SEQ ID NO: 1058345 - protein, 9 aa, Homo Sapiens
LIEVRANKQ

SEQ ID NO: 1058346 - protein, 9 aa, Homo Sapiens
FEEFLAEDW

SEQ ID NO: 1058347 - protein, 9 aa, Homo Sapiens
PNIWSHCSE

SEQ ID NO: 1058348 - protein, 9 aa, Homo Sapiens
TCMMTPKFK

SEQ ID NO: 1058349 - protein, 9 aa, Homo Sapiens
IVSEPLEDL

SEQ ID NO: 1058350 - protein, 9 aa, Homo Sapiens
YSLLRPENV

SEQ ID NO: 1058351 - protein, 9 aa, Homo Sapiens
AAIYCKAGK

SEQ ID NO: 1058352 - protein, 9 aa, Homo Sapiens
CWTCIGDLN

SEQ ID NO: 1058353 - protein, 9 aa, Homo Sapiens
GRSSKVHSS

SEQ ID NO: 1058354 - protein, 9 aa, Homo Sapiens
GNQIVLING

SEQ ID NO: 1058355 - protein, 9 aa, Homo Sapiens
REKSFICTE

SEQ ID NO: 1058356 - protein, 9 aa, Homo Sapiens
VIKNLHDDF

SEQ ID NO: 1058357 - protein, 9 aa, Homo Sapiens
EKMSELSNL

SEQ ID NO: 1058358 - protein, 9 aa, Homo Sapiens
PPTLGNLLS

SEQ ID NO: 1058359 - protein, 9 aa, Homo Sapiens
PSTTTSAFV

SEQ ID NO: 1058360 - protein, 9 aa, Homo Sapiens
LHYTVIIRE

SEQ ID NO: 1058361 - protein, 9 aa, Homo Sapiens
WTLPQPRTL

SEQ ID NO: 1058362 - protein, 9 aa, Homo Sapiens
IYTLCNKEV

SEQ ID NO: 1058363 - protein, 9 aa, Homo Sapiens
KSENIYEGQ

SEQ ID NO: 1058364 - protein, 9 aa, Homo Sapiens
TDRFRFAIL

SEQ ID NO: 1058365 - protein, 9 aa, Homo Sapiens
EPEGLVGAD

SEQ ID NO: 1058366 - protein, 9 aa, Homo Sapiens
RNETLVAFR

SEQ ID NO: 1058367 - protein, 9 aa, Homo Sapiens
GEPEGSELP

SEQ ID NO: 1058368 - protein, 9 aa, Homo Sapiens
SSKALILHA

SEQ ID NO: 1058369 - protein, 9 aa, Homo Sapiens
KKYRKLQTH

SEQ ID NO: 1058370 - protein, 9 aa, Homo Sapiens
AYVTPCTTS

SEQ ID NO: 1058371 - protein, 9 aa, Homo Sapiens
IWSNPSLIC

SEQ ID NO: 1058372 - protein, 9 aa, Homo Sapiens
GVKGFAGVM

SEQ ID NO: 1058373 - protein, 9 aa, Homo Sapiens
ISKLPEEDG

SEQ ID NO: 1058374 - protein, 9 aa, Homo Sapiens
KLSKAYPFS

SEQ ID NO: 1058375 - protein, 9 aa, Homo Sapiens
TPSTFPSLH

SEQ ID NO: 1058376 - protein, 9 aa, Homo Sapiens
SYLPSQVSS

SEQ ID NO: 1058377 - protein, 9 aa, Homo Sapiens
DENRVPLGV

SEQ ID NO: 1058378 - protein, 9 aa, Homo Sapiens
ELDIFPGAA

SEQ ID NO: 1058379 - protein, 9 aa, Homo Sapiens
SSCSSLSSD

SEQ ID NO: 1058380 - protein, 9 aa, Homo Sapiens
DSANPTTWL

SEQ ID NO: 1058381 - protein, 9 aa, Homo Sapiens
ANKQEAVFE

SEQ ID NO: 1058382 - protein, 9 aa, Homo Sapiens
TNALGFYSC

SEQ ID NO: 1058383 - protein, 9 aa, Homo Sapiens
DLLGYPKTK

SEQ ID NO: 1058384 - protein, 9 aa, Homo Sapiens
GRKKKYSSP

SEQ ID NO: 1058385 - protein, 9 aa, Homo Sapiens
TCQASGDLH

SEQ ID NO: 1058386 - protein, 9 aa, Homo Sapiens
MQKEIDYVK

SEQ ID NO: 1058387 - protein, 9 aa, Homo Sapiens
YWNETLKEY

SEQ ID NO: 1058388 - protein, 9 aa, Homo Sapiens
TLGNLLSGA

SEQ ID NO: 1058389 - protein, 9 aa, Homo Sapiens
KNCWKFFMA

SEQ ID NO: 1058390 - protein, 9 aa, Homo Sapiens
GGTSFLQLI

SEQ ID NO: 1058391 - protein, 9 aa, Homo Sapiens
ISFFERLRS

SEQ ID NO: 1058392 - protein, 9 aa, Homo Sapiens
LNISHNLHS

SEQ ID NO: 1058393 - protein, 9 aa, Homo Sapiens
DEKIQKSEL

SEQ ID NO: 1058394 - protein, 9 aa, Homo Sapiens
LYRAERIAE

SEQ ID NO: 1058395 - protein, 9 aa, Homo Sapiens
KEIKSSELE

SEQ ID NO: 1058396 - protein, 9 aa, Homo Sapiens
IAATCNNPG

SEQ ID NO: 1058397 - protein, 9 aa, Homo Sapiens
LFTGIFFSA

SEQ ID NO: 1058398 - protein, 9 aa, Homo Sapiens
TQGQTNVMV

SEQ ID NO: 1058399 - protein, 9 aa, Homo Sapiens
KSFSIFLSN

SEQ ID NO: 1058400 - protein, 9 aa, Homo Sapiens
LYYVTGFFI

SEQ ID NO: 1058401 - protein, 9 aa, Homo Sapiens
VLFIYIEKQ

SEQ ID NO: 1058402 - protein, 9 aa, Homo Sapiens
NSRMQLAKL

SEQ ID NO: 1058403 - protein, 9 aa, Homo Sapiens
PPGLQASPP

SEQ ID NO: 1058404 - protein, 9 aa, Homo Sapiens
GMLLLCGID

SEQ ID NO: 1058405 - protein, 9 aa, Homo Sapiens
NALGFYSCG

SEQ ID NO: 1058406 - protein, 9 aa, Homo Sapiens
WGIRCYKSE

SEQ ID NO: 1058407 - protein, 9 aa, Homo Sapiens
KTSIQRAVQ

SEQ ID NO: 1058408 - protein, 9 aa, Homo Sapiens
ECKKAVELW

SEQ ID NO: 1058409 - protein, 9 aa, Homo Sapiens
TPRSGKLPS

SEQ ID NO: 1058410 - protein, 9 aa, Homo Sapiens
TPKVMAGFF

SEQ ID NO: 1058411 - protein, 9 aa, Homo Sapiens
DLPWTSVFS

SEQ ID NO: 1058412 - protein, 9 aa, Homo Sapiens
SHLFRAMCQ

SEQ ID NO: 1058413 - protein, 9 aa, Homo Sapiens
AFGREHFPY

SEQ ID NO: 1058414 - protein, 9 aa, Homo Sapiens
VLGLDNIHR

SEQ ID NO: 1058415 - protein, 9 aa, Homo Sapiens
HEKIYSGEK

SEQ ID NO: 1058416 - protein, 9 aa, Homo Sapiens
AMENQLRSD

SEQ ID NO: 1058417 - protein, 9 aa, Homo Sapiens
VNTPEGFRC

SEQ ID NO: 1058418 - protein, 9 aa, Homo Sapiens
VWQTFSILV

SEQ ID NO: 1058419 - protein, 9 aa, Homo Sapiens
LKFTTKIHP

SEQ ID NO: 1058420 - protein, 9 aa, Homo Sapiens
NRTRIINSK

SEQ ID NO: 1058421 - protein, 9 aa, Homo Sapiens
GVIGEPTSL

SEQ ID NO: 1058422 - protein, 9 aa, Homo Sapiens
YCFVSKTTH

SEQ ID NO: 1058423 - protein, 9 aa, Homo Sapiens
KGYEQLKEE

SEQ ID NO: 1058424 - protein, 9 aa, Homo Sapiens
STTIELVTQ

SEQ ID NO: 1058425 - protein, 9 aa, Homo Sapiens
RRLGLVEEF

SEQ ID NO: 1058426 - protein, 9 aa, Homo Sapiens
FFSHRDLRT

SEQ ID NO: 1058427 - protein, 9 aa, Homo Sapiens
SSLPEPKPV

SEQ ID NO: 1058428 - protein, 9 aa, Homo Sapiens
MLEPEQTFF

SEQ ID NO: 1058429 - protein, 9 aa, Homo Sapiens
KKKEKQVTY

SEQ ID NO: 1058430 - protein, 9 aa, Homo Sapiens
PPTPQPFCN

SEQ ID NO: 1058431 - protein, 9 aa, Homo Sapiens
QALCQGSGS

SEQ ID NO: 1058432 - protein, 9 aa, Homo Sapiens
SSKVHSSQG

SEQ ID NO: 1058433 - protein, 9 aa, Homo Sapiens
RFDVSDIGS

SEQ ID NO: 1058434 - protein, 9 aa, Homo Sapiens
GGAPFQRGT

SEQ ID NO: 1058435 - protein, 9 aa, Homo Sapiens
EHFQDDDDG

SEQ ID NO: 1058436 - protein, 9 aa, Homo Sapiens
FFSPTSSFS

SEQ ID NO: 1058437 - protein, 9 aa, Homo Sapiens
STLFLGKVC

SEQ ID NO: 1058438 - protein, 9 aa, Homo Sapiens
FTSGVPDHA

SEQ ID NO: 1058439 - protein, 9 aa, Homo Sapiens
WTTGVLLFL

SEQ ID NO: 1058440 - protein, 9 aa, Homo Sapiens
LLTSFLKSV

SEQ ID NO: 1058441 - protein, 9 aa, Homo Sapiens
CKPADENSC

SEQ ID NO: 1058442 - protein, 9 aa, Homo Sapiens
CLLADNNFV

SEQ ID NO: 1058443 - protein, 9 aa, Homo Sapiens
AFKQASQRE

SEQ ID NO: 1058444 - protein, 9 aa, Homo Sapiens
VEMKWFHKN

SEQ ID NO: 1058445 - protein, 9 aa, Homo Sapiens
TEFDVKNFH

SEQ ID NO: 1058446 - protein, 9 aa, Homo Sapiens
ETSLKLILS

SEQ ID NO: 1058447 - protein, 9 aa, Homo Sapiens
PWDREASTL

SEQ ID NO: 1058448 - protein, 9 aa, Homo Sapiens
INQQIFRMF

SEQ ID NO: 1058449 - protein, 9 aa, Homo Sapiens
LKKPHECDF

SEQ ID NO: 1058450 - protein, 9 aa, Homo Sapiens
QGVFTQLLA

SEQ ID NO: 1058451 - protein, 9 aa, Homo Sapiens
LLQYLSLLF

SEQ ID NO: 1058452 - protein, 9 aa, Homo Sapiens
LRARFGMAS

SEQ ID NO: 1058453 - protein, 9 aa, Homo Sapiens
HLAQVSSHT

SEQ ID NO: 1058454 - protein, 9 aa, Homo Sapiens
QTQSVVFLY

SEQ ID NO: 1058455 - protein, 9 aa, Homo Sapiens
KKVPANPEA

SEQ ID NO: 1058456 - protein, 9 aa, Homo Sapiens
SREKTEHAE

SEQ ID NO: 1058457 - protein, 9 aa, Homo Sapiens
DPRIQMLLF

SEQ ID NO: 1058458 - protein, 9 aa, Homo Sapiens
FLLSTCPGV

SEQ ID NO: 1058459 - protein, 9 aa, Homo Sapiens
GIGSGSKVD

SEQ ID NO: 1058460 - protein, 9 aa, Homo Sapiens
NVVYSIFYA

SEQ ID NO: 1058461 - protein, 9 aa, Homo Sapiens
QTARRTPPG

SEQ ID NO: 1058462 - protein, 9 aa, Homo Sapiens
VDKFLFVFY

SEQ ID NO: 1058463 - protein, 9 aa, Homo Sapiens
ACPLAEDSP

SEQ ID NO: 1058464 - protein, 9 aa, Homo Sapiens
YSSQWIESQ

SEQ ID NO: 1058465 - protein, 9 aa, Homo Sapiens
TVKFLGFVV

SEQ ID NO: 1058466 - protein, 9 aa, Homo Sapiens
TVREDVVVE

SEQ ID NO: 1058467 - protein, 9 aa, Homo Sapiens
DLNGQDCRI

SEQ ID NO: 1058468 - protein, 9 aa, Homo Sapiens
FDQGFLYAR

SEQ ID NO: 1058469 - protein, 9 aa, Homo Sapiens
GNISLFQQC

SEQ ID NO: 1058470 - protein, 9 aa, Homo Sapiens
NLFFLDISC

SEQ ID NO: 1058471 - protein, 9 aa, Homo Sapiens
FVSFKGKIV

SEQ ID NO: 1058472 - protein, 9 aa, Homo Sapiens
AVSESWPYS

SEQ ID NO: 1058473 - protein, 9 aa, Homo Sapiens
EHSPHPRVQ

SEQ ID NO: 1058474 - protein, 9 aa, Homo Sapiens
TLREAEEEP

SEQ ID NO: 1058475 - protein, 9 aa, Homo Sapiens
FENSDKFHS

SEQ ID NO: 1058476 - protein, 9 aa, Homo Sapiens
TFSILVRAL

SEQ ID NO: 1058477 - protein, 9 aa, Homo Sapiens
SFAAALMKM

SEQ ID NO: 1058478 - protein, 9 aa, Homo Sapiens
HLSFCSSHK

SEQ ID NO: 1058479 - protein, 9 aa, Homo Sapiens
FISLFYLLV

SEQ ID NO: 1058480 - protein, 9 aa, Homo Sapiens
YVLEIFKEI

SEQ ID NO: 1058481 - protein, 9 aa, Homo Sapiens
TPLAEDVQV

SEQ ID NO: 1058482 - protein, 9 aa, Homo Sapiens
QEPEGLVGA

SEQ ID NO: 1058483 - protein, 9 aa, Homo Sapiens
QKEVSFCHC

SEQ ID NO: 1058484 - protein, 9 aa, Homo Sapiens
TAIIKEVHG

SEQ ID NO: 1058485 - protein, 9 aa, Homo Sapiens
FYGGHELSH

SEQ ID NO: 1058486 - protein, 9 aa, Homo Sapiens
SLHLFLFTS

SEQ ID NO: 1058487 - protein, 9 aa, Homo Sapiens
KPADENSCG

SEQ ID NO: 1058488 - protein, 9 aa, Homo Sapiens
RKHQFDYGE

SEQ ID NO: 1058489 - protein, 9 aa, Homo Sapiens
SQAIKKVAD

SEQ ID NO: 1058490 - protein, 9 aa, Homo Sapiens
VNETSLMLK

SEQ ID NO: 1058491 - protein, 9 aa, Homo Sapiens
LSTSEKIFC

SEQ ID NO: 1058492 - protein, 9 aa, Homo Sapiens
IGDENYLML

SEQ ID NO: 1058493 - protein, 9 aa, Homo Sapiens
SVLCSCRMK

SEQ ID NO: 1058494 - protein, 9 aa, Homo Sapiens
EYLKALATY

SEQ ID NO: 1058495 - protein, 9 aa, Homo Sapiens
QRLLCSSFQ

SEQ ID NO: 1058496 - protein, 9 aa, Homo Sapiens
GAPRAPTKK

SEQ ID NO: 1058497 - protein, 9 aa, Homo Sapiens
DTTMVSNLV

SEQ ID NO: 1058498 - protein, 9 aa, Homo Sapiens
LVGLHFCFQ

SEQ ID NO: 1058499 - protein, 9 aa, Homo Sapiens
LLPFIQTIM

SEQ ID NO: 1058500 - protein, 9 aa, Homo Sapiens
NEFSSRRPR

SEQ ID NO: 1058501 - protein, 9 aa, Homo Sapiens
LALTLQNIG

SEQ ID NO: 1058502 - protein, 9 aa, Homo Sapiens
IKEFYPTFD

SEQ ID NO: 1058503 - protein, 9 aa, Homo Sapiens
FWRKICCNC

SEQ ID NO: 1058504 - protein, 9 aa, Homo Sapiens
SVATNTPSG

SEQ ID NO: 1058505 - protein, 9 aa, Homo Sapiens
FHSFPQLAR

SEQ ID NO: 1058506 - protein, 9 aa, Homo Sapiens
SLPNRGRPT

SEQ ID NO: 1058507 - protein, 9 aa, Homo Sapiens
YCWVCYREG

SEQ ID NO: 1058508 - protein, 9 aa, Homo Sapiens
NSCGLESEC

SEQ ID NO: 1058509 - protein, 9 aa, Homo Sapiens
CCVHRGADF

SEQ ID NO: 1058510 - protein, 9 aa, Homo Sapiens
PSPRTLLMS

SEQ ID NO: 1058511 - protein, 9 aa, Homo Sapiens
IPVFVWMKR

SEQ ID NO: 1058512 - protein, 9 aa, Homo Sapiens
IAATVHDVN

SEQ ID NO: 1058513 - protein, 9 aa, Homo Sapiens
PGLPGPRDP

SEQ ID NO: 1058514 - protein, 9 aa, Homo Sapiens
PELFSEIFD

SEQ ID NO: 1058515 - protein, 9 aa, Homo Sapiens
RKFSLDEIA

SEQ ID NO: 1058516 - protein, 9 aa, Homo Sapiens
LSFCSSHKI

SEQ ID NO: 1058517 - protein, 9 aa, Homo Sapiens
LFPVAHVLI

SEQ ID NO: 1058518 - protein, 9 aa, Homo Sapiens
ILKGVKKED

SEQ ID NO: 1058519 - protein, 9 aa, Homo Sapiens
INRIFYISA

SEQ ID NO: 1058520 - protein, 9 aa, Homo Sapiens
LFQEGKTNY

SEQ ID NO: 1058521 - protein, 9 aa, Homo Sapiens
DGPVNPPAA

SEQ ID NO: 1058522 - protein, 9 aa, Homo Sapiens
LMADAMDTF

SEQ ID NO: 1058523 - protein, 9 aa, Homo Sapiens
TYLLHMKKV

SEQ ID NO: 1058524 - protein, 9 aa, Homo Sapiens
IDELDELFS

SEQ ID NO: 1058525 - protein, 9 aa, Homo Sapiens
TQEIKGRNL

SEQ ID NO: 1058526 - protein, 9 aa, Homo Sapiens
LFIFMQAVL

SEQ ID NO: 1058527 - protein, 9 aa, Homo Sapiens
NIRSCCLAE

SEQ ID NO: 1058528 - protein, 9 aa, Homo Sapiens
VQEEIQVLG

SEQ ID NO: 1058529 - protein, 9 aa, Homo Sapiens
PWHLDHLDL

SEQ ID NO: 1058530 - protein, 9 aa, Homo Sapiens
MIEEEVEAL

SEQ ID NO: 1058531 - protein, 9 aa, Homo Sapiens
KDPRCLTPK

SEQ ID NO: 1058532 - protein, 9 aa, Homo Sapiens
TSTTFSRVD

SEQ ID NO: 1058533 - protein, 9 aa, Homo Sapiens
GEQEGLQEG

SEQ ID NO: 1058534 - protein, 9 aa, Homo Sapiens
YRQQSLALL

SEQ ID NO: 1058535 - protein, 9 aa, Homo Sapiens
TNLIRPKIC

SEQ ID NO: 1058536 - protein, 9 aa, Homo Sapiens
QKNTIVLEK

SEQ ID NO: 1058537 - protein, 9 aa, Homo Sapiens
KKEFEECLE

SEQ ID NO: 1058538 - protein, 9 aa, Homo Sapiens
VVTVVENGL

SEQ ID NO: 1058539 - protein, 9 aa, Homo Sapiens
TIRDMCRAK

SEQ ID NO: 1058540 - protein, 9 aa, Homo Sapiens
SKERSFKSQ

SEQ ID NO: 1058541 - protein, 9 aa, Homo Sapiens
GAVAHACYS

SEQ ID NO: 1058542 - protein, 9 aa, Homo Sapiens
LQSDDDKII

SEQ ID NO: 1058543 - protein, 9 aa, Homo Sapiens
TLENLSRSI

SEQ ID NO: 1058544 - protein, 9 aa, Homo Sapiens
KKEKQVTYN

SEQ ID NO: 1058545 - protein, 9 aa, Homo Sapiens
QERGGSCDP

SEQ ID NO: 1058546 - protein, 9 aa, Homo Sapiens
GDCILKLNT

SEQ ID NO: 1058547 - protein, 9 aa, Homo Sapiens
KIPSESEAR

SEQ ID NO: 1058548 - protein, 9 aa, Homo Sapiens
WEAWGTLGK

SEQ ID NO: 1058549 - protein, 9 aa, Homo Sapiens
ASFLVDEEM

SEQ ID NO: 1058550 - protein, 9 aa, Homo Sapiens
QQSLALLPR

SEQ ID NO: 1058551 - protein, 9 aa, Homo Sapiens
MSNLYFYKD

SEQ ID NO: 1058552 - protein, 9 aa, Homo Sapiens
VQVSRDIFL

SEQ ID NO: 1058553 - protein, 9 aa, Homo Sapiens
PKTGEHQPL

SEQ ID NO: 1058554 - protein, 9 aa, Homo Sapiens
SAEARVGFP

SEQ ID NO: 1058555 - protein, 9 aa, Homo Sapiens
LAFTSIGNG

SEQ ID NO: 1058556 - protein, 9 aa, Homo Sapiens
VSTDKEDGV

SEQ ID NO: 1058557 - protein, 9 aa, Homo Sapiens
PDKFVVLAL

SEQ ID NO: 1058558 - protein, 9 aa, Homo Sapiens
AIDSLNLGN

SEQ ID NO: 1058559 - protein, 9 aa, Homo Sapiens
RTYRELRLF

SEQ ID NO: 1058560 - protein, 9 aa, Homo Sapiens
INPKKYLGS

SEQ ID NO: 1058561 - protein, 9 aa, Homo Sapiens
CNRFFRVDT

SEQ ID NO: 1058562 - protein, 9 aa, Homo Sapiens
SERRNKSGI

SEQ ID NO: 1058563 - protein, 9 aa, Homo Sapiens
DIHWKKVSK

SEQ ID NO: 1058564 - protein, 9 aa, Homo Sapiens
KRSPPISLA

SEQ ID NO: 1058565 - protein, 9 aa, Homo Sapiens
HDPKLHHPF

SEQ ID NO: 1058566 - protein, 9 aa, Homo Sapiens
HLLEVPQRT

SEQ ID NO: 1058567 - protein, 9 aa, Homo Sapiens
AAPGGHLGS

SEQ ID NO: 1058568 - protein, 9 aa, Homo Sapiens
GGYYEEYQG

SEQ ID NO: 1058569 - protein, 9 aa, Homo Sapiens
PYKDGALKR

SEQ ID NO: 1058570 - protein, 9 aa, Homo Sapiens
CFTMEVAKH

SEQ ID NO: 1058571 - protein, 9 aa, Homo Sapiens
KSLPLAMKR

SEQ ID NO: 1058572 - protein, 9 aa, Homo Sapiens
GLDNIHRAW

SEQ ID NO: 1058573 - protein, 9 aa, Homo Sapiens
RSGSQSSGW

SEQ ID NO: 1058574 - protein, 9 aa, Homo Sapiens
NMAVYVEGK

SEQ ID NO: 1058575 - protein, 9 aa, Homo Sapiens
SGEASLPGE

SEQ ID NO: 1058576 - protein, 9 aa, Homo Sapiens
EEKKQQEHQ

SEQ ID NO: 1058577 - protein, 9 aa, Homo Sapiens
VTANFVELG

SEQ ID NO: 1058578 - protein, 9 aa, Homo Sapiens
ENLFIGVEV

SEQ ID NO: 1058579 - protein, 9 aa, Homo Sapiens
LPPARKQKS

SEQ ID NO: 1058580 - protein, 9 aa, Homo Sapiens
AFQPLCTGD

SEQ ID NO: 1058581 - protein, 9 aa, Homo Sapiens
NLPVSLPES

SEQ ID NO: 1058582 - protein, 9 aa, Homo Sapiens
QKGRPGAPG

SEQ ID NO: 1058583 - protein, 9 aa, Homo Sapiens
RLSSSPQHL

SEQ ID NO: 1058584 - protein, 9 aa, Homo Sapiens
YKVFCHTAG

SEQ ID NO: 1058585 - protein, 9 aa, Homo Sapiens
CDVTGHLLE

SEQ ID NO: 1058586 - protein, 9 aa, Homo Sapiens
YNKDNKEND

SEQ ID NO: 1058587 - protein, 9 aa, Homo Sapiens
GRESKFNAE

SEQ ID NO: 1058588 - protein, 9 aa, Homo Sapiens
LEKLSESLA

SEQ ID NO: 1058589 - protein, 9 aa, Homo Sapiens
QVRTSYVLE

SEQ ID NO: 1058590 - protein, 9 aa, Homo Sapiens
HECDFCGKA

SEQ ID NO: 1058591 - protein, 9 aa, Homo Sapiens
MMTPKFKRK

SEQ ID NO: 1058592 - protein, 9 aa, Homo Sapiens
REKGYEQLK

SEQ ID NO: 1058593 - protein, 9 aa, Homo Sapiens
TSTYDAHDG

SEQ ID NO: 1058594 - protein, 9 aa, Homo Sapiens
GNVQNLQKR

SEQ ID NO: 1058595 - protein, 9 aa, Homo Sapiens
FRLNGSSLH

SEQ ID NO: 1058596 - protein, 9 aa, Homo Sapiens
SLENGSSGF

SEQ ID NO: 1058597 - protein, 9 aa, Homo Sapiens
VSEGQFDSF

SEQ ID NO: 1058598 - protein, 9 aa, Homo Sapiens
ELGLGAVVR

SEQ ID NO: 1058599 - protein, 9 aa, Homo Sapiens
GILHETLPK

SEQ ID NO: 1058600 - protein, 9 aa, Homo Sapiens
THHQAVIFN

SEQ ID NO: 1058601 - protein, 9 aa, Homo Sapiens
MEDAEALGE

SEQ ID NO: 1058602 - protein, 9 aa, Homo Sapiens
YLSLLFFRE

SEQ ID NO: 1058603 - protein, 9 aa, Homo Sapiens
EIETVKNNF

SEQ ID NO: 1058604 - protein, 9 aa, Homo Sapiens
LDAEPMKKL

SEQ ID NO: 1058605 - protein, 9 aa, Homo Sapiens
GRTMAITSR

SEQ ID NO: 1058606 - protein, 9 aa, Homo Sapiens
KLPSPSPTS

SEQ ID NO: 1058607 - protein, 9 aa, Homo Sapiens
SEKIFCFQD

SEQ ID NO: 1058608 - protein, 9 aa, Homo Sapiens
FPIDMQPNS

SEQ ID NO: 1058609 - protein, 9 aa, Homo Sapiens
EIFEEKKSA

SEQ ID NO: 1058610 - protein, 9 aa, Homo Sapiens
LSVMKDSAQ

SEQ ID NO: 1058611 - protein, 9 aa, Homo Sapiens
LAKLSDFES

SEQ ID NO: 1058612 - protein, 9 aa, Homo Sapiens
AADGGPRVF

SEQ ID NO: 1058613 - protein, 9 aa, Homo Sapiens
RQLTKKIQL

SEQ ID NO: 1058614 - protein, 9 aa, Homo Sapiens
YISVLEDNE

SEQ ID NO: 1058615 - protein, 9 aa, Homo Sapiens
NGCRLQFGV

SEQ ID NO: 1058616 - protein, 9 aa, Homo Sapiens
TFTESAEAR

SEQ ID NO: 1058617 - protein, 9 aa, Homo Sapiens
GFHLSSLYL

SEQ ID NO: 1058618 - protein, 9 aa, Homo Sapiens
GRYGTIKDY

SEQ ID NO: 1058619 - protein, 9 aa, Homo Sapiens
KIFSLLACV

SEQ ID NO: 1058620 - protein, 9 aa, Homo Sapiens
ETSLMLKWT

SEQ ID NO: 1058621 - protein, 9 aa, Homo Sapiens
KHSTAFSEA

SEQ ID NO: 1058622 - protein, 9 aa, Homo Sapiens
KLPPPLWAP

SEQ ID NO: 1058623 - protein, 9 aa, Homo Sapiens
SLVYVDSQL

SEQ ID NO: 1058624 - protein, 9 aa, Homo Sapiens
PTRGQLEER

SEQ ID NO: 1058625 - protein, 9 aa, Homo Sapiens
RQLGCPSFF

SEQ ID NO: 1058626 - protein, 9 aa, Homo Sapiens
GVSEAAHWL

SEQ ID NO: 1058627 - protein, 9 aa, Homo Sapiens
NTEGSFYCV

SEQ ID NO: 1058628 - protein, 9 aa, Homo Sapiens
SQKGTKNCW

SEQ ID NO: 1058629 - protein, 9 aa, Homo Sapiens
PPQCPRRWL

SEQ ID NO: 1058630 - protein, 9 aa, Homo Sapiens
PNLPVSLPE

SEQ ID NO: 1058631 - protein, 9 aa, Homo Sapiens
TPPGLPPPP

SEQ ID NO: 1058632 - protein, 9 aa, Homo Sapiens
RQPSPRPTP

SEQ ID NO: 1058633 - protein, 9 aa, Homo Sapiens
WFKGRSSKV

SEQ ID NO: 1058634 - protein, 9 aa, Homo Sapiens
IRNQQRWTL

SEQ ID NO: 1058635 - protein, 9 aa, Homo Sapiens
YWDILDGTD

SEQ ID NO: 1058636 - protein, 9 aa, Homo Sapiens
SLITPARQR

SEQ ID NO: 1058637 - protein, 9 aa, Homo Sapiens
DVWGGKNME

SEQ ID NO: 1058638 - protein, 9 aa, Homo Sapiens
WFIKSTNEA

SEQ ID NO: 1058639 - protein, 9 aa, Homo Sapiens
RVDEAKSLC

SEQ ID NO: 1058640 - protein, 9 aa, Homo Sapiens
VDLTSLHIV

SEQ ID NO: 1058641 - protein, 9 aa, Homo Sapiens
THERKSSDK

SEQ ID NO: 1058642 - protein, 9 aa, Homo Sapiens
ALGFYTSGF

SEQ ID NO: 1058643 - protein, 9 aa, Homo Sapiens
KLADADSQQ

SEQ ID NO: 1058644 - protein, 9 aa, Homo Sapiens
RAIFFVGPV

SEQ ID NO: 1058645 - protein, 9 aa, Homo Sapiens
LPKYRVKKW

SEQ ID NO: 1058646 - protein, 9 aa, Homo Sapiens
EIMAMNEEQ

SEQ ID NO: 1058647 - protein, 9 aa, Homo Sapiens
INFWKPDSV

SEQ ID NO: 1058648 - protein, 9 aa, Homo Sapiens
NPFIYTLCN

SEQ ID NO: 1058649 - protein, 9 aa, Homo Sapiens
GDVLCSCPG

SEQ ID NO: 1058650 - protein, 9 aa, Homo Sapiens
SIISAIVHY

SEQ ID NO: 1058651 - protein, 9 aa, Homo Sapiens
GAKGTRTLL

SEQ ID NO: 1058652 - protein, 9 aa, Homo Sapiens
VLIGSDIAN

SEQ ID NO: 1058653 - protein, 9 aa, Homo Sapiens
LHHPFQGFR

SEQ ID NO: 1058654 - protein, 9 aa, Homo Sapiens
SLNPQLLKM

SEQ ID NO: 1058655 - protein, 9 aa, Homo Sapiens
VPWWVIQIP

SEQ ID NO: 1058656 - protein, 9 aa, Homo Sapiens
KCDPSDQNL

SEQ ID NO: 1058657 - protein, 9 aa, Homo Sapiens
IQRSKLQSQ

SEQ ID NO: 1058658 - protein, 9 aa, Homo Sapiens
RKKLKLDGE

SEQ ID NO: 1058659 - protein, 9 aa, Homo Sapiens
HEQLVTYDK

SEQ ID NO: 1058660 - protein, 9 aa, Homo Sapiens
SFFCDLSRF

SEQ ID NO: 1058661 - protein, 9 aa, Homo Sapiens
PAKKKMELL

SEQ ID NO: 1058662 - protein, 9 aa, Homo Sapiens
KNCYEQMKA

SEQ ID NO: 1058663 - protein, 9 aa, Homo Sapiens
NIINPMGLL

SEQ ID NO: 1058664 - protein, 9 aa, Homo Sapiens
GPRVFFYQL

SEQ ID NO: 1058665 - protein, 9 aa, Homo Sapiens
TPLNEREDT

SEQ ID NO: 1058666 - protein, 9 aa, Homo Sapiens
LINPLSSPS

SEQ ID NO: 1058667 - protein, 9 aa, Homo Sapiens
HVLVMNEND

SEQ ID NO: 1058668 - protein, 9 aa, Homo Sapiens
EFSAFRAEN

SEQ ID NO: 1058669 - protein, 9 aa, Homo Sapiens
KLSNFLNDS

SEQ ID NO: 1058670 - protein, 9 aa, Homo Sapiens
ERKYAANKF

SEQ ID NO: 1058671 - protein, 9 aa, Homo Sapiens
SLETFTPQH

SEQ ID NO: 1058672 - protein, 9 aa, Homo Sapiens
SVAQTAVAG

SEQ ID NO: 1058673 - protein, 9 aa, Homo Sapiens
NDENSCEGM

SEQ ID NO: 1058674 - protein, 9 aa, Homo Sapiens
IKSRIQVLF

SEQ ID NO: 1058675 - protein, 9 aa, Homo Sapiens
PFSLSHSVP

SEQ ID NO: 1058676 - protein, 9 aa, Homo Sapiens
MEFFLLEAQ

SEQ ID NO: 1058677 - protein, 9 aa, Homo Sapiens
DGGSAGSLS

SEQ ID NO: 1058678 - protein, 9 aa, Homo Sapiens
VMKDSAQEI

SEQ ID NO: 1058679 - protein, 9 aa, Homo Sapiens
EPPEDTKST

SEQ ID NO: 1058680 - protein, 9 aa, Homo Sapiens
SRPGKCLPD

SEQ ID NO: 1058681 - protein, 9 aa, Homo Sapiens
FLPPARKQK

SEQ ID NO: 1058682 - protein, 9 aa, Homo Sapiens
PKEVGHLSF

SEQ ID NO: 1058683 - protein, 9 aa, Homo Sapiens
TVISLPTLR

SEQ ID NO: 1058684 - protein, 9 aa, Homo Sapiens
KELSTPVTF

SEQ ID NO: 1058685 - protein, 9 aa, Homo Sapiens
TKPLFQTSH

SEQ ID NO: 1058686 - protein, 9 aa, Homo Sapiens
AIPPLRLSV

SEQ ID NO: 1058687 - protein, 9 aa, Homo Sapiens
CSGAYHLSC

SEQ ID NO: 1058688 - protein, 9 aa, Homo Sapiens
GVARLVLSK

SEQ ID NO: 1058689 - protein, 9 aa, Homo Sapiens
TSVLVFTWQ

SEQ ID NO: 1058690 - protein, 9 aa, Homo Sapiens
LASGCDGLE

SEQ ID NO: 1058691 - protein, 9 aa, Homo Sapiens
FVVETAGPG

SEQ ID NO: 1058692 - protein, 9 aa, Homo Sapiens
RTYLGDPIL

SEQ ID NO: 1058693 - protein, 9 aa, Homo Sapiens
CGKGTYSLG

SEQ ID NO: 1058694 - protein, 9 aa, Homo Sapiens
LPLVKVLIE

SEQ ID NO: 1058695 - protein, 9 aa, Homo Sapiens
SVLTTHKRM

SEQ ID NO: 1058696 - protein, 9 aa, Homo Sapiens
PPSPLTTLP

SEQ ID NO: 1058697 - protein, 9 aa, Homo Sapiens
RVIMSVNNS

SEQ ID NO: 1058698 - protein, 9 aa, Homo Sapiens
SLAYNKITK

SEQ ID NO: 1058699 - protein, 9 aa, Homo Sapiens
IGWMQEFLN

SEQ ID NO: 1058700 - protein, 9 aa, Homo Sapiens
FGAVTGVGI

SEQ ID NO: 1058701 - protein, 9 aa, Homo Sapiens
TIVLEKAEF

SEQ ID NO: 1058702 - protein, 9 aa, Homo Sapiens
DLFSDDDLP

SEQ ID NO: 1058703 - protein, 9 aa, Homo Sapiens
ALFPKPRKN

SEQ ID NO: 1058704 - protein, 9 aa, Homo Sapiens
LRYTIIISH

SEQ ID NO: 1058705 - protein, 9 aa, Homo Sapiens
PEQSKNELV

SEQ ID NO: 1058706 - protein, 9 aa, Homo Sapiens
WELSSIKNF

SEQ ID NO: 1058707 - protein, 9 aa, Homo Sapiens
SSLILYLND

SEQ ID NO: 1058708 - protein, 9 aa, Homo Sapiens
WDYDTPAEI

SEQ ID NO: 1058709 - protein, 9 aa, Homo Sapiens
AAVPAAVPD

SEQ ID NO: 1058710 - protein, 9 aa, Homo Sapiens
KDTQGQTNV

SEQ ID NO: 1058711 - protein, 9 aa, Homo Sapiens
QCLLSPEDS

SEQ ID NO: 1058712 - protein, 9 aa, Homo Sapiens
IYDPQEKRY

SEQ ID NO: 1058713 - protein, 9 aa, Homo Sapiens
DPTTFARRA

SEQ ID NO: 1058714 - protein, 9 aa, Homo Sapiens
IGKGYFAKV

SEQ ID NO: 1058715 - protein, 9 aa, Homo Sapiens
NSSKNKFSL

SEQ ID NO: 1058716 - protein, 9 aa, Homo Sapiens
GACKVNPLA

SEQ ID NO: 1058717 - protein, 9 aa, Homo Sapiens
AQSLSTTGG

SEQ ID NO: 1058718 - protein, 9 aa, Homo Sapiens
SPVPSSFST

SEQ ID NO: 1058719 - protein, 9 aa, Homo Sapiens
KLHGPSNCS

SEQ ID NO: 1058720 - protein, 9 aa, Homo Sapiens
QDPTTFARR

SEQ ID NO: 1058721 - protein, 9 aa, Homo Sapiens
KWNCAFMEI

SEQ ID NO: 1058722 - protein, 9 aa, Homo Sapiens
NSEINSFIS

SEQ ID NO: 1058723 - protein, 9 aa, Homo Sapiens
LGQRNRVES

SEQ ID NO: 1058724 - protein, 9 aa, Homo Sapiens
PSLCLRVRA

SEQ ID NO: 1058725 - protein, 9 aa, Homo Sapiens
FSMCRGNNE

SEQ ID NO: 1058726 - protein, 9 aa, Homo Sapiens
EDLAADCIN

SEQ ID NO: 1058727 - protein, 9 aa, Homo Sapiens
SKEGRQLTY

SEQ ID NO: 1058728 - protein, 9 aa, Homo Sapiens
NKLRQVLPT

SEQ ID NO: 1058729 - protein, 9 aa, Homo Sapiens
TNQTLTEKE

SEQ ID NO: 1058730 - protein, 9 aa, Homo Sapiens
TEGPIAQNQ

SEQ ID NO: 1058731 - protein, 9 aa, Homo Sapiens
QPTSAPPAP

SEQ ID NO: 1058732 - protein, 9 aa, Homo Sapiens
IDVTYFSFD

SEQ ID NO: 1058733 - protein, 9 aa, Homo Sapiens
RSKVQEMTL

SEQ ID NO: 1058734 - protein, 9 aa, Homo Sapiens
SKSSHLAVY

SEQ ID NO: 1058735 - protein, 9 aa, Homo Sapiens
IHWNSSKKL

SEQ ID NO: 1058736 - protein, 9 aa, Homo Sapiens
SHRSRGVGE

SEQ ID NO: 1058737 - protein, 9 aa, Homo Sapiens
SSQNGHKEG

SEQ ID NO: 1058738 - protein, 9 aa, Homo Sapiens
QSPTQPSSG

SEQ ID NO: 1058739 - protein, 9 aa, Homo Sapiens
KARLVDVDG

SEQ ID NO: 1058740 - protein, 9 aa, Homo Sapiens
ALHNAKCQK

SEQ ID NO: 1058741 - protein, 9 aa, Homo Sapiens
EPQKHSCVT

SEQ ID NO: 1058742 - protein, 9 aa, Homo Sapiens
VTWREDLTH

SEQ ID NO: 1058743 - protein, 9 aa, Homo Sapiens
PLGTQDNPA

SEQ ID NO: 1058744 - protein, 9 aa, Homo Sapiens
FIFVQKKRR

SEQ ID NO: 1058745 - protein, 9 aa, Homo Sapiens
AEARPHRCL

SEQ ID NO: 1058746 - protein, 9 aa, Homo Sapiens
EERSQTVMC

SEQ ID NO: 1058747 - protein, 9 aa, Homo Sapiens
SKKLHVAAE

SEQ ID NO: 1058748 - protein, 9 aa, Homo Sapiens
ISVTDINSG

SEQ ID NO: 1058749 - protein, 9 aa, Homo Sapiens
KGHPNPTLP

SEQ ID NO: 1058750 - protein, 9 aa, Homo Sapiens
DQIKREQYI

SEQ ID NO: 1058751 - protein, 9 aa, Homo Sapiens
ALYAAWIPE

SEQ ID NO: 1058752 - protein, 9 aa, Homo Sapiens
VASEEFLSY

SEQ ID NO: 1058753 - protein, 9 aa, Homo Sapiens
NEFSSRDFQ

SEQ ID NO: 1058754 - protein, 9 aa, Homo Sapiens
FQDSKFYQA

SEQ ID NO: 1058755 - protein, 9 aa, Homo Sapiens
FRILFNNAV

SEQ ID NO: 1058756 - protein, 9 aa, Homo Sapiens
KKSHKESHK

SEQ ID NO: 1058757 - protein, 9 aa, Homo Sapiens
ASYDLATDP

SEQ ID NO: 1058758 - protein, 9 aa, Homo Sapiens
LDSKTGKLT

SEQ ID NO: 1058759 - protein, 9 aa, Homo Sapiens
TLLYLVQQL

SEQ ID NO: 1058760 - protein, 9 aa, Homo Sapiens
GETGFIPIP

SEQ ID NO: 1058761 - protein, 9 aa, Homo Sapiens
PIEVRHYSS

SEQ ID NO: 1058762 - protein, 9 aa, Homo Sapiens
ENGFSTNEP

SEQ ID NO: 1058763 - protein, 9 aa, Homo Sapiens
FPESKGEPG

SEQ ID NO: 1058764 - protein, 9 aa, Homo Sapiens
HFLLHSPTF

SEQ ID NO: 1058765 - protein, 9 aa, Homo Sapiens
PENPIFRFS

SEQ ID NO: 1058766 - protein, 9 aa, Homo Sapiens
SDPSQACLL

SEQ ID NO: 1058767 - protein, 9 aa, Homo Sapiens
CAKDMNLVK

SEQ ID NO: 1058768 - protein, 9 aa, Homo Sapiens
NPPLSNGGR

SEQ ID NO: 1058769 - protein, 9 aa, Homo Sapiens
EQEEVQRPP

SEQ ID NO: 1058770 - protein, 9 aa, Homo Sapiens
GHGENVALP

SEQ ID NO: 1058771 - protein, 9 aa, Homo Sapiens
YSNNQSPTN

SEQ ID NO: 1058772 - protein, 9 aa, Homo Sapiens
SLFLAAGLM

SEQ ID NO: 1058773 - protein, 9 aa, Homo Sapiens
CDFAQDSFY

SEQ ID NO: 1058774 - protein, 9 aa, Homo Sapiens
DCGEEKTLT

SEQ ID NO: 1058775 - protein, 9 aa, Homo Sapiens
VRITHQDEE

SEQ ID NO: 1058776 - protein, 9 aa, Homo Sapiens
ALYEAWAAI

SEQ ID NO: 1058777 - protein, 9 aa, Homo Sapiens
FSIFSALRT

SEQ ID NO: 1058778 - protein, 9 aa, Homo Sapiens
LPADGLERL

SEQ ID NO: 1058779 - protein, 9 aa, Homo Sapiens
SVFYTHILL

SEQ ID NO: 1058780 - protein, 9 aa, Homo Sapiens
FLATVKVVL

SEQ ID NO: 1058781 - protein, 9 aa, Homo Sapiens
GWQKNCQGL

SEQ ID NO: 1058782 - protein, 9 aa, Homo Sapiens
EKMRKKEEE

SEQ ID NO: 1058783 - protein, 9 aa, Homo Sapiens
RPLIKLQRR

SEQ ID NO: 1058784 - protein, 9 aa, Homo Sapiens
GGLEISLRR

SEQ ID NO: 1058785 - protein, 9 aa, Homo Sapiens
PVSCLPSQG

SEQ ID NO: 1058786 - protein, 9 aa, Homo Sapiens
KRHRRCKYS

SEQ ID NO: 1058787 - protein, 9 aa, Homo Sapiens
SDSSFKCSL

SEQ ID NO: 1058788 - protein, 9 aa, Homo Sapiens
VAKRGITEY

SEQ ID NO: 1058789 - protein, 9 aa, Homo Sapiens
GLSWHNDLT

SEQ ID NO: 1058790 - protein, 9 aa, Homo Sapiens
NRCAAWEEK

SEQ ID NO: 1058791 - protein, 9 aa, Homo Sapiens
EDPILVPPR

SEQ ID NO: 1058792 - protein, 9 aa, Homo Sapiens
TRLDGFMAQ

SEQ ID NO: 1058793 - protein, 9 aa, Homo Sapiens
PSGLLLPGY

SEQ ID NO: 1058794 - protein, 9 aa, Homo Sapiens
SPEMESFGS

SEQ ID NO: 1058795 - protein, 9 aa, Homo Sapiens
EFLKYFGTY

SEQ ID NO: 1058796 - protein, 9 aa, Homo Sapiens
KKKSCFELT

SEQ ID NO: 1058797 - protein, 9 aa, Homo Sapiens
RLVLSKLEG

SEQ ID NO: 1058798 - protein, 9 aa, Homo Sapiens
LPFARGGRA

SEQ ID NO: 1058799 - protein, 9 aa, Homo Sapiens
NQKLHHDMP

SEQ ID NO: 1058800 - protein, 9 aa, Homo Sapiens
GVVKVTLSY

SEQ ID NO: 1058801 - protein, 9 aa, Homo Sapiens
VFMGNMLCG

SEQ ID NO: 1058802 - protein, 9 aa, Homo Sapiens
ARIPLYGSY

SEQ ID NO: 1058803 - protein, 9 aa, Homo Sapiens
SPQREGYSH

SEQ ID NO: 1058804 - protein, 9 aa, Homo Sapiens
KGRWGPEDR

SEQ ID NO: 1058805 - protein, 9 aa, Homo Sapiens
VETANLSPS

SEQ ID NO: 1058806 - protein, 9 aa, Homo Sapiens
VYQAAKTYG

SEQ ID NO: 1058807 - protein, 9 aa, Homo Sapiens
GTPEGLVTP

SEQ ID NO: 1058808 - protein, 9 aa, Homo Sapiens
KYAQSQSHS

SEQ ID NO: 1058809 - protein, 9 aa, Homo Sapiens
LGILDLLNE

SEQ ID NO: 1058810 - protein, 9 aa, Homo Sapiens
ENRTKDFKL

SEQ ID NO: 1058811 - protein, 9 aa, Homo Sapiens
TINGLMLPT

SEQ ID NO: 1058812 - protein, 9 aa, Homo Sapiens
EHLKKEQEK

SEQ ID NO: 1058813 - protein, 9 aa, Homo Sapiens
TTRVLDKAD

SEQ ID NO: 1058814 - protein, 9 aa, Homo Sapiens
WDTTLSTPS

SEQ ID NO: 1058815 - protein, 9 aa, Homo Sapiens
KTSGEGRLC

SEQ ID NO: 1058816 - protein, 9 aa, Homo Sapiens
QPIHKGKSK

SEQ ID NO: 1058817 - protein, 9 aa, Homo Sapiens
LSPEMESFG

SEQ ID NO: 1058818 - protein, 9 aa, Homo Sapiens
KVQEEMSDC

SEQ ID NO: 1058819 - protein, 9 aa, Homo Sapiens
SPRQLTTPR

SEQ ID NO: 1058820 - protein, 9 aa, Homo Sapiens
TAPNLPVSL

SEQ ID NO: 1058821 - protein, 9 aa, Homo Sapiens
YQRLFGQLL

SEQ ID NO: 1058822 - protein, 9 aa, Homo Sapiens
FFQRCGHLD

SEQ ID NO: 1058823 - protein, 9 aa, Homo Sapiens
LRELERKYA

SEQ ID NO: 1058824 - protein, 9 aa, Homo Sapiens
GLDEPPSVN

SEQ ID NO: 1058825 - protein, 9 aa, Homo Sapiens
QLQKENRRL

SEQ ID NO: 1058826 - protein, 9 aa, Homo Sapiens
FLTGLYFIG

SEQ ID NO: 1058827 - protein, 9 aa, Homo Sapiens
IAFQPVETG

SEQ ID NO: 1058828 - protein, 9 aa, Homo Sapiens
KLFGLDTLQ

SEQ ID NO: 1058829 - protein, 9 aa, Homo Sapiens
NQSSSVLSI

SEQ ID NO: 1058830 - protein, 9 aa, Homo Sapiens
AERRNKAFS

SEQ ID NO: 1058831 - protein, 9 aa, Homo Sapiens
AIIKEVHGN

SEQ ID NO: 1058832 - protein, 9 aa, Homo Sapiens
DVTGHLLEV

SEQ ID NO: 1058833 - protein, 9 aa, Homo Sapiens
KLKYPKGAG

SEQ ID NO: 1058834 - protein, 9 aa, Homo Sapiens
TGIFFSASY

SEQ ID NO: 1058835 - protein, 9 aa, Homo Sapiens
MTHTLSSSY

SEQ ID NO: 1058836 - protein, 9 aa, Homo Sapiens
DTMMASMLC

SEQ ID NO: 1058837 - protein, 9 aa, Homo Sapiens
DGGEVGDSR

SEQ ID NO: 1058838 - protein, 9 aa, Homo Sapiens
PLVCGAVFY

SEQ ID NO: 1058839 - protein, 9 aa, Homo Sapiens
TIQMESLVD

SEQ ID NO: 1058840 - protein, 9 aa, Homo Sapiens
KKNKTSVSA

SEQ ID NO: 1058841 - protein, 9 aa, Homo Sapiens
WSGPGLENR

SEQ ID NO: 1058842 - protein, 9 aa, Homo Sapiens
WGFNFGSKE

SEQ ID NO: 1058843 - protein, 9 aa, Homo Sapiens
IFSLLNPVI

SEQ ID NO: 1058844 - protein, 9 aa, Homo Sapiens
QEMHREFMG

SEQ ID NO: 1058845 - protein, 9 aa, Homo Sapiens
YEAWAAIFI

SEQ ID NO: 1058846 - protein, 9 aa, Homo Sapiens
FVEEEGAVS

SEQ ID NO: 1058847 - protein, 9 aa, Homo Sapiens
GALVVWSHN

SEQ ID NO: 1058848 - protein, 9 aa, Homo Sapiens
CNDQNHYNF

SEQ ID NO: 1058849 - protein, 9 aa, Homo Sapiens
MLKWTPPRD

SEQ ID NO: 1058850 - protein, 9 aa, Homo Sapiens
KCGNIVVYH

SEQ ID NO: 1058851 - protein, 9 aa, Homo Sapiens
YAPTDCATI

SEQ ID NO: 1058852 - protein, 9 aa, Homo Sapiens
DPRFQASSF

SEQ ID NO: 1058853 - protein, 9 aa, Homo Sapiens
CENIRINGI

SEQ ID NO: 1058854 - protein, 9 aa, Homo Sapiens
VLEPPQKHR

SEQ ID NO: 1058855 - protein, 9 aa, Homo Sapiens
RLYRLEGFW

SEQ ID NO: 1058856 - protein, 9 aa, Homo Sapiens
PLHYTVIIR

SEQ ID NO: 1058857 - protein, 9 aa, Homo Sapiens
YAILAYAFA

SEQ ID NO: 1058858 - protein, 9 aa, Homo Sapiens
ASVPLPPGL

SEQ ID NO: 1058859 - protein, 9 aa, Homo Sapiens
MELMIQDKS

SEQ ID NO: 1058860 - protein, 9 aa, Homo Sapiens
LQQALREEL

SEQ ID NO: 1058861 - protein, 9 aa, Homo Sapiens
MKLREDITL

SEQ ID NO: 1058862 - protein, 9 aa, Homo Sapiens
VLRSIASET

SEQ ID NO: 1058863 - protein, 9 aa, Homo Sapiens
YFYDGDGVC

SEQ ID NO: 1058864 - protein, 9 aa, Homo Sapiens
DPGKKFLGR

SEQ ID NO: 1058865 - protein, 9 aa, Homo Sapiens
DLLFLFSSS

SEQ ID NO: 1058866 - protein, 9 aa, Homo Sapiens
QDPGEGFRC

SEQ ID NO: 1058867 - protein, 9 aa, Homo Sapiens
KDTSCSTIY

SEQ ID NO: 1058868 - protein, 9 aa, Homo Sapiens
VDGVKVHNA

SEQ ID NO: 1058869 - protein, 9 aa, Homo Sapiens
KYAANKFIT

SEQ ID NO: 1058870 - protein, 9 aa, Homo Sapiens
GGAPAWQPT

SEQ ID NO: 1058871 - protein, 9 aa, Homo Sapiens
KTFTCFSSL

SEQ ID NO: 1058872 - protein, 9 aa, Homo Sapiens
KIKVSTKKM

SEQ ID NO: 1058873 - protein, 9 aa, Homo Sapiens
DVQQKVQKK

SEQ ID NO: 1058874 - protein, 9 aa, Homo Sapiens
QPSPRPTPP

SEQ ID NO: 1058875 - protein, 9 aa, Homo Sapiens
PPLPPLSDT

SEQ ID NO: 1058876 - protein, 9 aa, Homo Sapiens
QASCVDGFE

SEQ ID NO: 1058877 - protein, 9 aa, Homo Sapiens
VRPQQLFGR

SEQ ID NO: 1058878 - protein, 9 aa, Homo Sapiens
NGPFNNSTG

SEQ ID NO: 1058879 - protein, 9 aa, Homo Sapiens
GKTLENLSR

SEQ ID NO: 1058880 - protein, 9 aa, Homo Sapiens
RGHLLVVLL

SEQ ID NO: 1058881 - protein, 9 aa, Homo Sapiens
EGIVDLTEI

SEQ ID NO: 1058882 - protein, 9 aa, Homo Sapiens
HLDLASADF

SEQ ID NO: 1058883 - protein, 9 aa, Homo Sapiens
SKNELVMEI

SEQ ID NO: 1058884 - protein, 9 aa, Homo Sapiens
EPTLDSISK

SEQ ID NO: 1058885 - protein, 9 aa, Homo Sapiens
PFMRQNRTR

SEQ ID NO: 1058886 - protein, 9 aa, Homo Sapiens
NDAEPAKEN

SEQ ID NO: 1058887 - protein, 9 aa, Homo Sapiens
IGKTYFQVI

SEQ ID NO: 1058888 - protein, 9 aa, Homo Sapiens
WYKHGSLIC

SEQ ID NO: 1058889 - protein, 9 aa, Homo Sapiens
RVHQSPNGT

SEQ ID NO: 1058890 - protein, 9 aa, Homo Sapiens
FLHLNSRDS

SEQ ID NO: 1058891 - protein, 9 aa, Homo Sapiens
GVYVNQNKF

SEQ ID NO: 1058892 - protein, 9 aa, Homo Sapiens
VVMWREMGV

SEQ ID NO: 1058893 - protein, 9 aa, Homo Sapiens
CRFGYQMDK

SEQ ID NO: 1058894 - protein, 9 aa, Homo Sapiens
LDKKNNAFP

SEQ ID NO: 1058895 - protein, 9 aa, Homo Sapiens
SRVDPKMRI

SEQ ID NO: 1058896 - protein, 9 aa, Homo Sapiens
VFHHGTGKW

SEQ ID NO: 1058897 - protein, 9 aa, Homo Sapiens
WTDFCFLFS

SEQ ID NO: 1058898 - protein, 9 aa, Homo Sapiens
LEPAIREHQ

SEQ ID NO: 1058899 - protein, 9 aa, Homo Sapiens
SPAAAEHSP

SEQ ID NO: 1058900 - protein, 9 aa, Homo Sapiens
FYQRLFGQL

SEQ ID NO: 1058901 - protein, 9 aa, Homo Sapiens
SREQRFYKS

SEQ ID NO: 1058902 - protein, 9 aa, Homo Sapiens
KAGTVSTSC

SEQ ID NO: 1058903 - protein, 9 aa, Homo Sapiens
ATFQSNRYP

SEQ ID NO: 1058904 - protein, 9 aa, Homo Sapiens
EYLAFLCRP

SEQ ID NO: 1058905 - protein, 9 aa, Homo Sapiens
SIKNFLKVA

SEQ ID NO: 1058906 - protein, 9 aa, Homo Sapiens
RADPDYNCT

SEQ ID NO: 1058907 - protein, 9 aa, Homo Sapiens
KQQATAIIK

SEQ ID NO: 1058908 - protein, 9 aa, Homo Sapiens
YDTPAEICA

SEQ ID NO: 1058909 - protein, 9 aa, Homo Sapiens
NVYFLQYSI

SEQ ID NO: 1058910 - protein, 9 aa, Homo Sapiens
NYQHGFHLA

SEQ ID NO: 1058911 - protein, 9 aa, Homo Sapiens
NTFTESAEA

SEQ ID NO: 1058912 - protein, 9 aa, Homo Sapiens
ATSTAASSL

SEQ ID NO: 1058913 - protein, 9 aa, Homo Sapiens
LLINQSFFF

SEQ ID NO: 1058914 - protein, 9 aa, Homo Sapiens
ALLKLGRLS

SEQ ID NO: 1058915 - protein, 9 aa, Homo Sapiens
AMAVKDIIS

SEQ ID NO: 1058916 - protein, 9 aa, Homo Sapiens
LTFCLKRET

SEQ ID NO: 1058917 - protein, 9 aa, Homo Sapiens
SQPPKSSEV

SEQ ID NO: 1058918 - protein, 9 aa, Homo Sapiens
LCSIKLDNL

SEQ ID NO: 1058919 - protein, 9 aa, Homo Sapiens
DFTQSFDSG

SEQ ID NO: 1058920 - protein, 9 aa, Homo Sapiens
YLVHMQRGI

SEQ ID NO: 1058921 - protein, 9 aa, Homo Sapiens
DCFFRNRLM

SEQ ID NO: 1058922 - protein, 9 aa, Homo Sapiens
VVSIKKMED

SEQ ID NO: 1058923 - protein, 9 aa, Homo Sapiens
WEEKELITW

SEQ ID NO: 1058924 - protein, 9 aa, Homo Sapiens
PKTGVSHLS

SEQ ID NO: 1058925 - protein, 9 aa, Homo Sapiens
VGDSRTVLQ

SEQ ID NO: 1058926 - protein, 9 aa, Homo Sapiens
FQAMTAERE

SEQ ID NO: 1058927 - protein, 9 aa, Homo Sapiens
PKTGVSHLY

SEQ ID NO: 1058928 - protein, 9 aa, Homo Sapiens
KNLAEELPQ

SEQ ID NO: 1058929 - protein, 9 aa, Homo Sapiens
PFPYNFYDF

SEQ ID NO: 1058930 - protein, 9 aa, Homo Sapiens
VTGHLLEVP

SEQ ID NO: 1058931 - protein, 9 aa, Homo Sapiens
ADRHCGPDL

SEQ ID NO: 1058932 - protein, 9 aa, Homo Sapiens
DMMEFFLLE

SEQ ID NO: 1058933 - protein, 9 aa, Homo Sapiens
KARSPDYKD

SEQ ID NO: 1058934 - protein, 9 aa, Homo Sapiens
SSSSCSGPP

SEQ ID NO: 1058935 - protein, 9 aa, Homo Sapiens
EFILRASPS

SEQ ID NO: 1058936 - protein, 9 aa, Homo Sapiens
VIFAFSLHS

SEQ ID NO: 1058937 - protein, 9 aa, Homo Sapiens
ERKNARSQK

SEQ ID NO: 1058938 - protein, 9 aa, Homo Sapiens
AHFFCDFLS

SEQ ID NO: 1058939 - protein, 9 aa, Homo Sapiens
TLIMTSKTI

SEQ ID NO: 1058940 - protein, 9 aa, Homo Sapiens
YEDGLSLLF

SEQ ID NO: 1058941 - protein, 9 aa, Homo Sapiens
FIYTLCNKE

SEQ ID NO: 1058942 - protein, 9 aa, Homo Sapiens
KEKVMLCIQ

SEQ ID NO: 1058943 - protein, 9 aa, Homo Sapiens
QSYGEEKAV

SEQ ID NO: 1058944 - protein, 9 aa, Homo Sapiens
VLFEVISHS

SEQ ID NO: 1058945 - protein, 9 aa, Homo Sapiens
KGPQRQDLS

SEQ ID NO: 1058946 - protein, 9 aa, Homo Sapiens
VEFFRPSKE

SEQ ID NO: 1058947 - protein, 9 aa, Homo Sapiens
LVLSLDTLD

SEQ ID NO: 1058948 - protein, 9 aa, Homo Sapiens
EKIKMEGID

SEQ ID NO: 1058949 - protein, 9 aa, Homo Sapiens
EGHDSKEPE

SEQ ID NO: 1058950 - protein, 9 aa, Homo Sapiens
EGSKLKVSL

SEQ ID NO: 1058951 - protein, 9 aa, Homo Sapiens
LFRRYMASR

SEQ ID NO: 1058952 - protein, 9 aa, Homo Sapiens
TSTLREAEE

SEQ ID NO: 1058953 - protein, 9 aa, Homo Sapiens
HFIALVYVD

SEQ ID NO: 1058954 - protein, 9 aa, Homo Sapiens
YSRIVSSSS

SEQ ID NO: 1058955 - protein, 9 aa, Homo Sapiens
MTSTYDAHD

SEQ ID NO: 1058956 - protein, 9 aa, Homo Sapiens
LDNKLTETI

SEQ ID NO: 1058957 - protein, 9 aa, Homo Sapiens
LGNNQIYPK

SEQ ID NO: 1058958 - protein, 9 aa, Homo Sapiens
SVDLTSLHI

SEQ ID NO: 1058959 - protein, 9 aa, Homo Sapiens
PSKKPEVPP

SEQ ID NO: 1058960 - protein, 9 aa, Homo Sapiens
AAQGFPSSS

SEQ ID NO: 1058961 - protein, 9 aa, Homo Sapiens
AALLILSRI

SEQ ID NO: 1058962 - protein, 9 aa, Homo Sapiens
SKKQKKIPS

SEQ ID NO: 1058963 - protein, 9 aa, Homo Sapiens
RGIHPIRIV

SEQ ID NO: 1058964 - protein, 9 aa, Homo Sapiens
IFLKEIMEN

SEQ ID NO: 1058965 - protein, 9 aa, Homo Sapiens
NLYLLEEGP

SEQ ID NO: 1058966 - protein, 9 aa, Homo Sapiens
ESKFNAEES

SEQ ID NO: 1058967 - protein, 9 aa, Homo Sapiens
KRLDIFPVV

SEQ ID NO: 1058968 - protein, 9 aa, Homo Sapiens
ATAQTLRAW

SEQ ID NO: 1058969 - protein, 9 aa, Homo Sapiens
LFGNFPKPD

SEQ ID NO: 1058970 - protein, 9 aa, Homo Sapiens
IEPEEMRRL

SEQ ID NO: 1058971 - protein, 9 aa, Homo Sapiens
RMSGLMQPP

SEQ ID NO: 1058972 - protein, 9 aa, Homo Sapiens
LPGPRDPMG

SEQ ID NO: 1058973 - protein, 9 aa, Homo Sapiens
KFLRKKEAS

SEQ ID NO: 1058974 - protein, 9 aa, Homo Sapiens
NCGYVTAYG

SEQ ID NO: 1058975 - protein, 9 aa, Homo Sapiens
SVQICVPRQ

SEQ ID NO: 1058976 - protein, 9 aa, Homo Sapiens
PGGLYVELH

SEQ ID NO: 1058977 - protein, 9 aa, Homo Sapiens
VFSAFVTTN

SEQ ID NO: 1058978 - protein, 9 aa, Homo Sapiens
YPDVFQASK

SEQ ID NO: 1058979 - protein, 9 aa, Homo Sapiens
TSSGILSMA

SEQ ID NO: 1058980 - protein, 9 aa, Homo Sapiens
EWQKVEYLI

SEQ ID NO: 1058981 - protein, 9 aa, Homo Sapiens
KDLPRPLPE

SEQ ID NO: 1058982 - protein, 9 aa, Homo Sapiens
ILLSDAAKP

SEQ ID NO: 1058983 - protein, 9 aa, Homo Sapiens
VGFGNVSSN

SEQ ID NO: 1058984 - protein, 9 aa, Homo Sapiens
PHFIYNSHT

SEQ ID NO: 1058985 - protein, 9 aa, Homo Sapiens
TIIHHHISF

SEQ ID NO: 1058986 - protein, 9 aa, Homo Sapiens
KFKPQNCPE

SEQ ID NO: 1058987 - protein, 9 aa, Homo Sapiens
LCAQDNPIN

SEQ ID NO: 1058988 - protein, 9 aa, Homo Sapiens
ASFSGEASV

SEQ ID NO: 1058989 - protein, 9 aa, Homo Sapiens
AIVRAGVSG

SEQ ID NO: 1058990 - protein, 9 aa, Homo Sapiens
ALGETWNSF

SEQ ID NO: 1058991 - protein, 9 aa, Homo Sapiens
KDPEETEKE

SEQ ID NO: 1058992 - protein, 9 aa, Homo Sapiens
PRPCLYSAT

SEQ ID NO: 1058993 - protein, 9 aa, Homo Sapiens
GNTSTAEEK

SEQ ID NO: 1058994 - protein, 9 aa, Homo Sapiens
EQVLDPRTT

SEQ ID NO: 1058995 - protein, 9 aa, Homo Sapiens
IYYNLCFLD

SEQ ID NO: 1058996 - protein, 9 aa, Homo Sapiens
INRPLIKLQ

SEQ ID NO: 1058997 - protein, 9 aa, Homo Sapiens
EMSLFSSSS

SEQ ID NO: 1058998 - protein, 9 aa, Homo Sapiens
CLLQMWFIY

SEQ ID NO: 1058999 - protein, 9 aa, Homo Sapiens
GSTPLAEDV

SEQ ID NO: 1059000 - protein, 9 aa, Homo Sapiens
VNKDEKIQK

SEQ ID NO: 1059001 - protein, 9 aa, Homo Sapiens
NLDCIQKVE

SEQ ID NO: 1059002 - protein, 9 aa, Homo Sapiens
QEVDDVMRI

SEQ ID NO: 1059003 - protein, 9 aa, Homo Sapiens
PSSQSKGVM

SEQ ID NO: 1059004 - protein, 9 aa, Homo Sapiens
TYTQASGYN

SEQ ID NO: 1059005 - protein, 9 aa, Homo Sapiens
AVHHLVFTA

SEQ ID NO: 1059006 - protein, 9 aa, Homo Sapiens
QEAVFFFKK

SEQ ID NO: 1059007 - protein, 9 aa, Homo Sapiens
RAQSLELYG

SEQ ID NO: 1059008 - protein, 9 aa, Homo Sapiens
AEKDSGRFD

SEQ ID NO: 1059009 - protein, 9 aa, Homo Sapiens
DKKAGRPFC

SEQ ID NO: 1059010 - protein, 9 aa, Homo Sapiens
IFALFPKPR

SEQ ID NO: 1059011 - protein, 9 aa, Homo Sapiens
VKRGSYYEY

SEQ ID NO: 1059012 - protein, 9 aa, Homo Sapiens
RQANHVSRE

SEQ ID NO: 1059013 - protein, 9 aa, Homo Sapiens
ELGPATPMF

SEQ ID NO: 1059014 - protein, 9 aa, Homo Sapiens
LMGSLGEMG

SEQ ID NO: 1059015 - protein, 9 aa, Homo Sapiens
QGKKKKHDP

SEQ ID NO: 1059016 - protein, 9 aa, Homo Sapiens
GHLGSFNSD

SEQ ID NO: 1059017 - protein, 9 aa, Homo Sapiens
YSTAMDTEP

SEQ ID NO: 1059018 - protein, 9 aa, Homo Sapiens
AMVNSIAWS

SEQ ID NO: 1059019 - protein, 9 aa, Homo Sapiens
PEVKKEPSV

SEQ ID NO: 1059020 - protein, 9 aa, Homo Sapiens
AFPGNDSLG

SEQ ID NO: 1059021 - protein, 9 aa, Homo Sapiens
MYLFLSALF

SEQ ID NO: 1059022 - protein, 9 aa, Homo Sapiens
PINFIQPGA

SEQ ID NO: 1059023 - protein, 9 aa, Homo Sapiens
VFLNPVVLW

SEQ ID NO: 1059024 - protein, 9 aa, Homo Sapiens
ENDFLIFKK

SEQ ID NO: 1059025 - protein, 9 aa, Homo Sapiens
SSRVDFGLS

SEQ ID NO: 1059026 - protein, 9 aa, Homo Sapiens
FLGDDTLLG

SEQ ID NO: 1059027 - protein, 9 aa, Homo Sapiens
VRSLRVESD

SEQ ID NO: 1059028 - protein, 9 aa, Homo Sapiens
ESIDVASFT

SEQ ID NO: 1059029 - protein, 9 aa, Homo Sapiens
SRSLSSNPS

SEQ ID NO: 1059030 - protein, 9 aa, Homo Sapiens
ASDWDEGAN

SEQ ID NO: 1059031 - protein, 9 aa, Homo Sapiens
GNGYGPGET

SEQ ID NO: 1059032 - protein, 9 aa, Homo Sapiens
SKLAARLQE

SEQ ID NO: 1059033 - protein, 9 aa, Homo Sapiens
HPICLFLDK

SEQ ID NO: 1059034 - protein, 9 aa, Homo Sapiens
LQSYWEVGL

SEQ ID NO: 1059035 - protein, 9 aa, Homo Sapiens
MAEAERSSL

SEQ ID NO: 1059036 - protein, 9 aa, Homo Sapiens
KDNGAYCCT

SEQ ID NO: 1059037 - protein, 9 aa, Homo Sapiens
SQKSPICLV

SEQ ID NO: 1059038 - protein, 9 aa, Homo Sapiens
DTKSTASSP

SEQ ID NO: 1059039 - protein, 9 aa, Homo Sapiens
LRIHSGEKQ

SEQ ID NO: 1059040 - protein, 9 aa, Homo Sapiens
ENVFISYKT

SEQ ID NO: 1059041 - protein, 9 aa, Homo Sapiens
DLEASTQES

SEQ ID NO: 1059042 - protein, 9 aa, Homo Sapiens
SPLLCALHP

SEQ ID NO: 1059043 - protein, 9 aa, Homo Sapiens
ASTLQVLGA

SEQ ID NO: 1059044 - protein, 9 aa, Homo Sapiens
MISEPMDKN

SEQ ID NO: 1059045 - protein, 9 aa, Homo Sapiens
MESYSCFFR

SEQ ID NO: 1059046 - protein, 9 aa, Homo Sapiens
VPSQCVFAR

SEQ ID NO: 1059047 - protein, 9 aa, Homo Sapiens
TVAPLSQDT

SEQ ID NO: 1059048 - protein, 9 aa, Homo Sapiens
FIQELVRIT

SEQ ID NO: 1059049 - protein, 9 aa, Homo Sapiens
GDDLGIFKI

SEQ ID NO: 1059050 - protein, 9 aa, Homo Sapiens
SSQARSDDL

SEQ ID NO: 1059051 - protein, 9 aa, Homo Sapiens
LLAEVLAFL

SEQ ID NO: 1059052 - protein, 9 aa, Homo Sapiens
KLQDLQREK

SEQ ID NO: 1059053 - protein, 9 aa, Homo Sapiens
PADRRRSAW

SEQ ID NO: 1059054 - protein, 9 aa, Homo Sapiens
FGHYVDVFR

SEQ ID NO: 1059055 - protein, 9 aa, Homo Sapiens
PHVPFILGL

SEQ ID NO: 1059056 - protein, 9 aa, Homo Sapiens
TSKNKNGSW

SEQ ID NO: 1059057 - protein, 9 aa, Homo Sapiens
KESLVEGEK

SEQ ID NO: 1059058 - protein, 9 aa, Homo Sapiens
LHAKTGQSV

SEQ ID NO: 1059059 - protein, 9 aa, Homo Sapiens
SSADSEKGK

SEQ ID NO: 1059060 - protein, 9 aa, Homo Sapiens
FSSRRPRFK

SEQ ID NO: 1059061 - protein, 9 aa, Homo Sapiens
ERRAQESPK

SEQ ID NO: 1059062 - protein, 9 aa, Homo Sapiens
NENQPVKSS

SEQ ID NO: 1059063 - protein, 9 aa, Homo Sapiens
SESLSSKPN

SEQ ID NO: 1059064 - protein, 9 aa, Homo Sapiens
LENQFMNSR

SEQ ID NO: 1059065 - protein, 9 aa, Homo Sapiens
LFCSLQTPD

SEQ ID NO: 1059066 - protein, 9 aa, Homo Sapiens
PMKKLSSKR

SEQ ID NO: 1059067 - protein, 9 aa, Homo Sapiens
WIYKVPSIH

SEQ ID NO: 1059068 - protein, 9 aa, Homo Sapiens
PSYTPPPPT

SEQ ID NO: 1059069 - protein, 9 aa, Homo Sapiens
CKKYRSAYV

SEQ ID NO: 1059070 - protein, 9 aa, Homo Sapiens
QLAAVSRIV

SEQ ID NO: 1059071 - protein, 9 aa, Homo Sapiens
VLSISLEPG

SEQ ID NO: 1059072 - protein, 9 aa, Homo Sapiens
PAPPARLPT

SEQ ID NO: 1059073 - protein, 9 aa, Homo Sapiens
YSLSVFPNC

SEQ ID NO: 1059074 - protein, 9 aa, Homo Sapiens
GGDRASPAL

SEQ ID NO: 1059075 - protein, 9 aa, Homo Sapiens
QKVQKKIDT

SEQ ID NO: 1059076 - protein, 9 aa, Homo Sapiens
SRCYFYDGD

SEQ ID NO: 1059077 - protein, 9 aa, Homo Sapiens
AYNKITKED

SEQ ID NO: 1059078 - protein, 9 aa, Homo Sapiens
VTTPADWLA

SEQ ID NO: 1059079 - protein, 9 aa, Homo Sapiens
AFYFTEWEL

SEQ ID NO: 1059080 - protein, 9 aa, Homo Sapiens
KQLSNSYNL

SEQ ID NO: 1059081 - protein, 9 aa, Homo Sapiens
RKSSDKRGD

SEQ ID NO: 1059082 - protein, 9 aa, Homo Sapiens
FCFLFSSNS

SEQ ID NO: 1059083 - protein, 9 aa, Homo Sapiens
FLIKILLRA

SEQ ID NO: 1059084 - protein, 9 aa, Homo Sapiens
TSGCLGLVP

SEQ ID NO: 1059085 - protein, 9 aa, Homo Sapiens
GDTDLGHSR

SEQ ID NO: 1059086 - protein, 9 aa, Homo Sapiens
FFVVETAGP

SEQ ID NO: 1059087 - protein, 9 aa, Homo Sapiens
ECWNEFSSR

SEQ ID NO: 1059088 - protein, 9 aa, Homo Sapiens
KIHPSCVTR

SEQ ID NO: 1059089 - protein, 9 aa, Homo Sapiens
EPPQKHRIC

SEQ ID NO: 1059090 - protein, 9 aa, Homo Sapiens
SGEEYESES

SEQ ID NO: 1059091 - protein, 9 aa, Homo Sapiens
QETREVPSE

SEQ ID NO: 1059092 - protein, 9 aa, Homo Sapiens
MAYLQQKQA

SEQ ID NO: 1059093 - protein, 9 aa, Homo Sapiens
RRPWDREAS

SEQ ID NO: 1059094 - protein, 9 aa, Homo Sapiens
SCLSPILLS

SEQ ID NO: 1059095 - protein, 9 aa, Homo Sapiens
FLRKKEASP

SEQ ID NO: 1059096 - protein, 9 aa, Homo Sapiens
DLPPRPEVD

SEQ ID NO: 1059097 - protein, 9 aa, Homo Sapiens
NLFTHQKIY

SEQ ID NO: 1059098 - protein, 9 aa, Homo Sapiens
KPGSEKWVY

SEQ ID NO: 1059099 - protein, 9 aa, Homo Sapiens
IAWTEACQV

SEQ ID NO: 1059100 - protein, 9 aa, Homo Sapiens
SLFFFRKLR

SEQ ID NO: 1059101 - protein, 9 aa, Homo Sapiens
VQNEEITAH

SEQ ID NO: 1059102 - protein, 9 aa, Homo Sapiens
KILEPFHKR

SEQ ID NO: 1059103 - protein, 9 aa, Homo Sapiens
FSIFLSNGQ

SEQ ID NO: 1059104 - protein, 9 aa, Homo Sapiens
FAVYSLWKI

SEQ ID NO: 1059105 - protein, 9 aa, Homo Sapiens
QRFRAKIPG

SEQ ID NO: 1059106 - protein, 9 aa, Homo Sapiens
EILESNEEC

SEQ ID NO: 1059107 - protein, 9 aa, Homo Sapiens
MKKVGSGRG

SEQ ID NO: 1059108 - protein, 9 aa, Homo Sapiens
FKRKSIHSR

SEQ ID NO: 1059109 - protein, 9 aa, Homo Sapiens
GKIRIYIFL

SEQ ID NO: 1059110 - protein, 9 aa, Homo Sapiens
FGIWQQVDN

SEQ ID NO: 1059111 - protein, 9 aa, Homo Sapiens
SFFFNRFDC

SEQ ID NO: 1059112 - protein, 9 aa, Homo Sapiens
VSRFCADHP

SEQ ID NO: 1059113 - protein, 9 aa, Homo Sapiens
KPWPGRGGP

SEQ ID NO: 1059114 - protein, 9 aa, Homo Sapiens
SADTIRAFF

SEQ ID NO: 1059115 - protein, 9 aa, Homo Sapiens
VSFKGKIVM

SEQ ID NO: 1059116 - protein, 9 aa, Homo Sapiens
DYCEVCQQS

SEQ ID NO: 1059117 - protein, 9 aa, Homo Sapiens
RIHVFHHGT

SEQ ID NO: 1059118 - protein, 9 aa, Homo Sapiens
QCKDQGNFF

SEQ ID NO: 1059119 - protein, 9 aa, Homo Sapiens
HKLHTGEKL

SEQ ID NO: 1059120 - protein, 9 aa, Homo Sapiens
IHSLSEKKS

SEQ ID NO: 1059121 - protein, 9 aa, Homo Sapiens
FFCADHIIP

SEQ ID NO: 1059122 - protein, 9 aa, Homo Sapiens
DDLFFHTLC

SEQ ID NO: 1059123 - protein, 9 aa, Homo Sapiens
VDPDCRLCR

SEQ ID NO: 1059124 - protein, 9 aa, Homo Sapiens
SWEAGHGEN

SEQ ID NO: 1059125 - protein, 9 aa, Homo Sapiens
YNMTVLFKL

SEQ ID NO: 1059126 - protein, 9 aa, Homo Sapiens
VGNGTYEQV

SEQ ID NO: 1059127 - protein, 9 aa, Homo Sapiens
KQLSDLEKE

SEQ ID NO: 1059128 - protein, 9 aa, Homo Sapiens
SDVTIRRRE

SEQ ID NO: 1059129 - protein, 9 aa, Homo Sapiens
GPGLLITLV

SEQ ID NO: 1059130 - protein, 9 aa, Homo Sapiens
PVSNGPFNN

SEQ ID NO: 1059131 - protein, 9 aa, Homo Sapiens
AGALVVWSH

SEQ ID NO: 1059132 - protein, 9 aa, Homo Sapiens
FASIISLFL

SEQ ID NO: 1059133 - protein, 9 aa, Homo Sapiens
ILRSATRMV

SEQ ID NO: 1059134 - protein, 9 aa, Homo Sapiens
FTKDKESYY

SEQ ID NO: 1059135 - protein, 9 aa, Homo Sapiens
IFMVALNVE

SEQ ID NO: 1059136 - protein, 9 aa, Homo Sapiens
VCAGGDGVC

SEQ ID NO: 1059137 - protein, 9 aa, Homo Sapiens
NSIIIEQPL

SEQ ID NO: 1059138 - protein, 9 aa, Homo Sapiens
SKPPNRLVY

SEQ ID NO: 1059139 - protein, 9 aa, Homo Sapiens
NPSLICQKL

SEQ ID NO: 1059140 - protein, 9 aa, Homo Sapiens
AQESPKSDC

SEQ ID NO: 1059141 - protein, 9 aa, Homo Sapiens
THTLSSSYH

SEQ ID NO: 1059142 - protein, 9 aa, Homo Sapiens
CQSSCCRPC

SEQ ID NO: 1059143 - protein, 9 aa, Homo Sapiens
TSAIPPLRL

SEQ ID NO: 1059144 - protein, 9 aa, Homo Sapiens
IVHYGCAFF

SEQ ID NO: 1059145 - protein, 9 aa, Homo Sapiens
RFRAKIPGL

SEQ ID NO: 1059146 - protein, 9 aa, Homo Sapiens
VAKKSSSGK

SEQ ID NO: 1059147 - protein, 9 aa, Homo Sapiens
GIIYRDFKP

SEQ ID NO: 1059148 - protein, 9 aa, Homo Sapiens
AQTLRAWPA

SEQ ID NO: 1059149 - protein, 9 aa, Homo Sapiens
LPEAYLKEN

SEQ ID NO: 1059150 - protein, 9 aa, Homo Sapiens
EVIPDEKFD

SEQ ID NO: 1059151 - protein, 9 aa, Homo Sapiens
PPDTQENMG

SEQ ID NO: 1059152 - protein, 9 aa, Homo Sapiens
ALTLQNIGA

SEQ ID NO: 1059153 - protein, 9 aa, Homo Sapiens
LLRQMEIRR

SEQ ID NO: 1059154 - protein, 9 aa, Homo Sapiens
GFQDSKFYQ

SEQ ID NO: 1059155 - protein, 9 aa, Homo Sapiens
ATFEIKKCN

SEQ ID NO: 1059156 - protein, 9 aa, Homo Sapiens
IACTLCEAI

SEQ ID NO: 1059157 - protein, 9 aa, Homo Sapiens
CCRPCCCQS

SEQ ID NO: 1059158 - protein, 9 aa, Homo Sapiens
KCEYACCLQ

SEQ ID NO: 1059159 - protein, 9 aa, Homo Sapiens
VRENCKLLR

SEQ ID NO: 1059160 - protein, 9 aa, Homo Sapiens
KRKRSRKKS

SEQ ID NO: 1059161 - protein, 9 aa, Homo Sapiens
PFGVYVSLC

SEQ ID NO: 1059162 - protein, 9 aa, Homo Sapiens
GDSGGSLVC

SEQ ID NO: 1059163 - protein, 9 aa, Homo Sapiens
QNFWFRPAD

SEQ ID NO: 1059164 - protein, 9 aa, Homo Sapiens
KNLDRMVPI

SEQ ID NO: 1059165 - protein, 9 aa, Homo Sapiens
REKLRYRED

SEQ ID NO: 1059166 - protein, 9 aa, Homo Sapiens
FRIGNGEVK

SEQ ID NO: 1059167 - protein, 9 aa, Homo Sapiens
VSTSSDERS

SEQ ID NO: 1059168 - protein, 9 aa, Homo Sapiens
RSLRVESDV

SEQ ID NO: 1059169 - protein, 9 aa, Homo Sapiens
IFLSNGQRR

SEQ ID NO: 1059170 - protein, 9 aa, Homo Sapiens
GMVVLVRRL

SEQ ID NO: 1059171 - protein, 9 aa, Homo Sapiens
PGGQALPHL

SEQ ID NO: 1059172 - protein, 9 aa, Homo Sapiens
SAMARSRLI

SEQ ID NO: 1059173 - protein, 9 aa, Homo Sapiens
YSDLEYYII

SEQ ID NO: 1059174 - protein, 9 aa, Homo Sapiens
ILRVKQTCQ

SEQ ID NO: 1059175 - protein, 9 aa, Homo Sapiens
KIHNTGLLS

SEQ ID NO: 1059176 - protein, 9 aa, Homo Sapiens
TIIMEEMPV

SEQ ID NO: 1059177 - protein, 9 aa, Homo Sapiens
QGLSWHNDL

SEQ ID NO: 1059178 - protein, 9 aa, Homo Sapiens
AMNEEQVHL

SEQ ID NO: 1059179 - protein, 9 aa, Homo Sapiens
SDVRAIQPG

SEQ ID NO: 1059180 - protein, 9 aa, Homo Sapiens
EWLFFFLWP

SEQ ID NO: 1059181 - protein, 9 aa, Homo Sapiens
EWVTLPCPN

SEQ ID NO: 1059182 - protein, 9 aa, Homo Sapiens
LHLNSTTPT

SEQ ID NO: 1059183 - protein, 9 aa, Homo Sapiens
LINKFDLVC

SEQ ID NO: 1059184 - protein, 9 aa, Homo Sapiens
EGKKGQVLE

SEQ ID NO: 1059185 - protein, 9 aa, Homo Sapiens
FKLELQEKK

SEQ ID NO: 1059186 - protein, 9 aa, Homo Sapiens
IDDVSTPSG

SEQ ID NO: 1059187 - protein, 9 aa, Homo Sapiens
LLGAEVCLS

SEQ ID NO: 1059188 - protein, 9 aa, Homo Sapiens
GKFYLLDVY

SEQ ID NO: 1059189 - protein, 9 aa, Homo Sapiens
GINRPLIKL

SEQ ID NO: 1059190 - protein, 9 aa, Homo Sapiens
YQFKKNPYL

SEQ ID NO: 1059191 - protein, 9 aa, Homo Sapiens
KGINVWKCF

SEQ ID NO: 1059192 - protein, 9 aa, Homo Sapiens
ISVLEDNED

SEQ ID NO: 1059193 - protein, 9 aa, Homo Sapiens
MPLLNCAKD

SEQ ID NO: 1059194 - protein, 9 aa, Homo Sapiens
ISKPTSRVG

SEQ ID NO: 1059195 - protein, 9 aa, Homo Sapiens
LPWGLVFNN

SEQ ID NO: 1059196 - protein, 9 aa, Homo Sapiens
AWGPEAEPT

SEQ ID NO: 1059197 - protein, 9 aa, Homo Sapiens
MCGDRANDC

SEQ ID NO: 1059198 - protein, 9 aa, Homo Sapiens
TKIFSLLAC

SEQ ID NO: 1059199 - protein, 9 aa, Homo Sapiens
EQFSDRKQD

SEQ ID NO: 1059200 - protein, 9 aa, Homo Sapiens
SDQSESSDI

SEQ ID NO: 1059201 - protein, 9 aa, Homo Sapiens
RVVVVTAKK

SEQ ID NO: 1059202 - protein, 9 aa, Homo Sapiens
AATAASGAL

SEQ ID NO: 1059203 - protein, 9 aa, Homo Sapiens
IRLNASDWD

SEQ ID NO: 1059204 - protein, 9 aa, Homo Sapiens
RIDYPLEFH

SEQ ID NO: 1059205 - protein, 9 aa, Homo Sapiens
PLMSPLSSR

SEQ ID NO: 1059206 - protein, 9 aa, Homo Sapiens
YCVCQQGFS

SEQ ID NO: 1059207 - protein, 9 aa, Homo Sapiens
IKSQERKTE

SEQ ID NO: 1059208 - protein, 9 aa, Homo Sapiens
PVKRSLETS

SEQ ID NO: 1059209 - protein, 9 aa, Homo Sapiens
NYQNWRMYD

SEQ ID NO: 1059210 - protein, 9 aa, Homo Sapiens
SDQETMAPS

SEQ ID NO: 1059211 - protein, 9 aa, Homo Sapiens
GNLQINAYL

SEQ ID NO: 1059212 - protein, 9 aa, Homo Sapiens
HFLPNKVKY

SEQ ID NO: 1059213 - protein, 9 aa, Homo Sapiens
SGFYMCQAH

SEQ ID NO: 1059214 - protein, 9 aa, Homo Sapiens
YAHNRYPSP

SEQ ID NO: 1059215 - protein, 9 aa, Homo Sapiens
YKNGYCPNY

SEQ ID NO: 1059216 - protein, 9 aa, Homo Sapiens
QRGRILFFV

SEQ ID NO: 1059217 - protein, 9 aa, Homo Sapiens
FPLLPHYIP

SEQ ID NO: 1059218 - protein, 9 aa, Homo Sapiens
KEGYLQGNV

SEQ ID NO: 1059219 - protein, 9 aa, Homo Sapiens
KGIIYRDFK

SEQ ID NO: 1059220 - protein, 9 aa, Homo Sapiens
HTVIFSLLN

SEQ ID NO: 1059221 - protein, 9 aa, Homo Sapiens
PGATSSSLE

SEQ ID NO: 1059222 - protein, 9 aa, Homo Sapiens
NVGSQEALK

SEQ ID NO: 1059223 - protein, 9 aa, Homo Sapiens
EAAVLQKIR

SEQ ID NO: 1059224 - protein, 9 aa, Homo Sapiens
KKHPESNQK

SEQ ID NO: 1059225 - protein, 9 aa, Homo Sapiens
IDTIVFIAS

SEQ ID NO: 1059226 - protein, 9 aa, Homo Sapiens
LWVSAEHLW

SEQ ID NO: 1059227 - protein, 9 aa, Homo Sapiens
KRMFKELPH

SEQ ID NO: 1059228 - protein, 9 aa, Homo Sapiens
KKEDEVKKY

SEQ ID NO: 1059229 - protein, 9 aa, Homo Sapiens
IDFYPNGEN

SEQ ID NO: 1059230 - protein, 9 aa, Homo Sapiens
TEETDFFVN

SEQ ID NO: 1059231 - protein, 9 aa, Homo Sapiens
VPEDETSNS

SEQ ID NO: 1059232 - protein, 9 aa, Homo Sapiens
LRSPFIKLR

SEQ ID NO: 1059233 - protein, 9 aa, Homo Sapiens
STMQKLNSR

SEQ ID NO: 1059234 - protein, 9 aa, Homo Sapiens
LFCKKMSVG

SEQ ID NO: 1059235 - protein, 9 aa, Homo Sapiens
FRLLFQESP

SEQ ID NO: 1059236 - protein, 9 aa, Homo Sapiens
FQRCGHLDG

SEQ ID NO: 1059237 - protein, 9 aa, Homo Sapiens
DFYPAIGNI

SEQ ID NO: 1059238 - protein, 9 aa, Homo Sapiens
TPPAAFCLR

SEQ ID NO: 1059239 - protein, 9 aa, Homo Sapiens
LFDRIINES

SEQ ID NO: 1059240 - protein, 9 aa, Homo Sapiens
RQKEELDKK

SEQ ID NO: 1059241 - protein, 9 aa, Homo Sapiens
ALMKMSGPY

SEQ ID NO: 1059242 - protein, 9 aa, Homo Sapiens
FLVDEEMIM

SEQ ID NO: 1059243 - protein, 9 aa, Homo Sapiens
TSTNKESKK

SEQ ID NO: 1059244 - protein, 9 aa, Homo Sapiens
HPIWGKDKS

SEQ ID NO: 1059245 - protein, 9 aa, Homo Sapiens
GKFARAVKV

SEQ ID NO: 1059246 - protein, 9 aa, Homo Sapiens
DTYPETLGR

SEQ ID NO: 1059247 - protein, 9 aa, Homo Sapiens
DEVKKYLDV

SEQ ID NO: 1059248 - protein, 9 aa, Homo Sapiens
RGNNTHNNY

SEQ ID NO: 1059249 - protein, 9 aa, Homo Sapiens
PPYLRTEFY

SEQ ID NO: 1059250 - protein, 9 aa, Homo Sapiens
NRGRQKDDY

SEQ ID NO: 1059251 - protein, 9 aa, Homo Sapiens
FLAEDWAGL

SEQ ID NO: 1059252 - protein, 9 aa, Homo Sapiens
LDLIDEDIL

SEQ ID NO: 1059253 - protein, 9 aa, Homo Sapiens
LVDEEMIML

SEQ ID NO: 1059254 - protein, 9 aa, Homo Sapiens
GNVKKLGKW

SEQ ID NO: 1059255 - protein, 9 aa, Homo Sapiens
DIWLLADDM

SEQ ID NO: 1059256 - protein, 9 aa, Homo Sapiens
YKEDAPHCS

SEQ ID NO: 1059257 - protein, 9 aa, Homo Sapiens
DPRCLTPKP

SEQ ID NO: 1059258 - protein, 9 aa, Homo Sapiens
YSFPARVPS

SEQ ID NO: 1059259 - protein, 9 aa, Homo Sapiens
ALTATLFAP

SEQ ID NO: 1059260 - protein, 9 aa, Homo Sapiens
VSTGLCKLC

SEQ ID NO: 1059261 - protein, 9 aa, Homo Sapiens
EIQNQEIDE

SEQ ID NO: 1059262 - protein, 9 aa, Homo Sapiens
KSPSLLKNK

SEQ ID NO: 1059263 - protein, 9 aa, Homo Sapiens
QSRGLLRSS

SEQ ID NO: 1059264 - protein, 9 aa, Homo Sapiens
KQYTVRRFR

SEQ ID NO: 1059265 - protein, 9 aa, Homo Sapiens
MPLCGHKKV

SEQ ID NO: 1059266 - protein, 9 aa, Homo Sapiens
FDSNDADTT

SEQ ID NO: 1059267 - protein, 9 aa, Homo Sapiens
HQCQARKPP

SEQ ID NO: 1059268 - protein, 9 aa, Homo Sapiens
EYQNKKKEK

SEQ ID NO: 1059269 - protein, 9 aa, Homo Sapiens
TTLSTPSPK

SEQ ID NO: 1059270 - protein, 9 aa, Homo Sapiens
PLISRTKMK

SEQ ID NO: 1059271 - protein, 9 aa, Homo Sapiens
LPPKNPFYD

SEQ ID NO: 1059272 - protein, 9 aa, Homo Sapiens
LATDPLVSL

SEQ ID NO: 1059273 - protein, 9 aa, Homo Sapiens
VSYSLNGKN

SEQ ID NO: 1059274 - protein, 9 aa, Homo Sapiens
LVDSTLAPL

SEQ ID NO: 1059275 - protein, 9 aa, Homo Sapiens
RAGSTPLAE

SEQ ID NO: 1059276 - protein, 9 aa, Homo Sapiens
ENGDSLEEP

SEQ ID NO: 1059277 - protein, 9 aa, Homo Sapiens
PMESLLLDD

SEQ ID NO: 1059278 - protein, 9 aa, Homo Sapiens
AKLKIVSSM

SEQ ID NO: 1059279 - protein, 9 aa, Homo Sapiens
ANQTGYLDP

SEQ ID NO: 1059280 - protein, 9 aa, Homo Sapiens
NCGAHLIQH

SEQ ID NO: 1059281 - protein, 9 aa, Homo Sapiens
SLSYSRIVS

SEQ ID NO: 1059282 - protein, 9 aa, Homo Sapiens
VLCNHPSWI

SEQ ID NO: 1059283 - protein, 9 aa, Homo Sapiens
IKVSTKKMY

SEQ ID NO: 1059284 - protein, 9 aa, Homo Sapiens
LSPSICGHL

SEQ ID NO: 1059285 - protein, 9 aa, Homo Sapiens
RMIHSLSEK

SEQ ID NO: 1059286 - protein, 9 aa, Homo Sapiens
DKGLVNDIK

SEQ ID NO: 1059287 - protein, 9 aa, Homo Sapiens
NPINPKKYL

SEQ ID NO: 1059288 - protein, 9 aa, Homo Sapiens
CWNEFSSRR

SEQ ID NO: 1059289 - protein, 9 aa, Homo Sapiens
YLFLSALFF

SEQ ID NO: 1059290 - protein, 9 aa, Homo Sapiens
NKNEINYLN

SEQ ID NO: 1059291 - protein, 9 aa, Homo Sapiens
AFATCFRSP

SEQ ID NO: 1059292 - protein, 9 aa, Homo Sapiens
IHVVEEVVK

SEQ ID NO: 1059293 - protein, 9 aa, Homo Sapiens
GIKGERGQK

SEQ ID NO: 1059294 - protein, 9 aa, Homo Sapiens
MPTREEEAV

SEQ ID NO: 1059295 - protein, 9 aa, Homo Sapiens
EKAWKLEVG

SEQ ID NO: 1059296 - protein, 9 aa, Homo Sapiens
CEECSKVFK

SEQ ID NO: 1059297 - protein, 9 aa, Homo Sapiens
QCHGLRQDL

SEQ ID NO: 1059298 - protein, 9 aa, Homo Sapiens
ISGAGLGVW

SEQ ID NO: 1059299 - protein, 9 aa, Homo Sapiens
DLTSLHIVD

SEQ ID NO: 1059300 - protein, 9 aa, Homo Sapiens
ADFSFRVDE

SEQ ID NO: 1059301 - protein, 9 aa, Homo Sapiens
VDSGTIKAK

SEQ ID NO: 1059302 - protein, 9 aa, Homo Sapiens
LQKVVYLVS

SEQ ID NO: 1059303 - protein, 9 aa, Homo Sapiens
YRAERIAEL

SEQ ID NO: 1059304 - protein, 9 aa, Homo Sapiens
LEPPKTGVS

SEQ ID NO: 1059305 - protein, 9 aa, Homo Sapiens
QRFYKSLPL

SEQ ID NO: 1059306 - protein, 9 aa, Homo Sapiens
LLSPLARED

SEQ ID NO: 1059307 - protein, 9 aa, Homo Sapiens
EEGHQDWKV

SEQ ID NO: 1059308 - protein, 9 aa, Homo Sapiens
LERSYSTEP

SEQ ID NO: 1059309 - protein, 9 aa, Homo Sapiens
RVRCELCPY

SEQ ID NO: 1059310 - protein, 9 aa, Homo Sapiens
GEASLPGED

SEQ ID NO: 1059311 - protein, 9 aa, Homo Sapiens
CYFYDGDGV

SEQ ID NO: 1059312 - protein, 9 aa, Homo Sapiens
DLYGQPKPV

SEQ ID NO: 1059313 - protein, 9 aa, Homo Sapiens
YFRLLFQES

SEQ ID NO: 1059314 - protein, 9 aa, Homo Sapiens
NTNIKNSEK

SEQ ID NO: 1059315 - protein, 9 aa, Homo Sapiens
LDGNGRGDI

SEQ ID NO: 1059316 - protein, 9 aa, Homo Sapiens
NHKGEATVH

SEQ ID NO: 1059317 - protein, 9 aa, Homo Sapiens
SKAFSRSSV

SEQ ID NO: 1059318 - protein, 9 aa, Homo Sapiens
NKTTEISLI

SEQ ID NO: 1059319 - protein, 9 aa, Homo Sapiens
TASRSLVEM

SEQ ID NO: 1059320 - protein, 9 aa, Homo Sapiens
SFQESTAGS

SEQ ID NO: 1059321 - protein, 9 aa, Homo Sapiens
EIMEYFVQK

SEQ ID NO: 1059322 - protein, 9 aa, Homo Sapiens
RHHQFFEPA

SEQ ID NO: 1059323 - protein, 9 aa, Homo Sapiens
LPDKFVVLA

SEQ ID NO: 1059324 - protein, 9 aa, Homo Sapiens
MRKDSSGAG

SEQ ID NO: 1059325 - protein, 9 aa, Homo Sapiens
KTKSPLKED

SEQ ID NO: 1059326 - protein, 9 aa, Homo Sapiens
TEAVLLKLH

SEQ ID NO: 1059327 - protein, 9 aa, Homo Sapiens
SLFSTFPLL

SEQ ID NO: 1059328 - protein, 9 aa, Homo Sapiens
AGQPIHKGK

SEQ ID NO: 1059329 - protein, 9 aa, Homo Sapiens
TFRRQVKNF

SEQ ID NO: 1059330 - protein, 9 aa, Homo Sapiens
LNGKAIKVA

SEQ ID NO: 1059331 - protein, 9 aa, Homo Sapiens
KQGYQKQLG

SEQ ID NO: 1059332 - protein, 9 aa, Homo Sapiens
SISPEMLAS

SEQ ID NO: 1059333 - protein, 9 aa, Homo Sapiens
FLSSLRPAL

SEQ ID NO: 1059334 - protein, 9 aa, Homo Sapiens
GLLGVLKEL

SEQ ID NO: 1059335 - protein, 9 aa, Homo Sapiens
TLSSSYHND

SEQ ID NO: 1059336 - protein, 9 aa, Homo Sapiens
LAESMEIEV

SEQ ID NO: 1059337 - protein, 9 aa, Homo Sapiens
LTTLRNETL

SEQ ID NO: 1059338 - protein, 9 aa, Homo Sapiens
INAYLRKTT

SEQ ID NO: 1059339 - protein, 9 aa, Homo Sapiens
SQVASSLKN

SEQ ID NO: 1059340 - protein, 9 aa, Homo Sapiens
EKKESLVEG

SEQ ID NO: 1059341 - protein, 9 aa, Homo Sapiens
GQPWQTMAR

SEQ ID NO: 1059342 - protein, 9 aa, Homo Sapiens
ISCKKAAFS

SEQ ID NO: 1059343 - protein, 9 aa, Homo Sapiens
KPQVFKSLE

SEQ ID NO: 1059344 - protein, 9 aa, Homo Sapiens
VPPTFQGRD

SEQ ID NO: 1059345 - protein, 9 aa, Homo Sapiens
YWRGLFAAT

SEQ ID NO: 1059346 - protein, 9 aa, Homo Sapiens
QAAEEFLWS

SEQ ID NO: 1059347 - protein, 9 aa, Homo Sapiens
VAVDVLLQG

SEQ ID NO: 1059348 - protein, 9 aa, Homo Sapiens
AWMLHMAVQ

SEQ ID NO: 1059349 - protein, 9 aa, Homo Sapiens
KVEQKHEAE

SEQ ID NO: 1059350 - protein, 9 aa, Homo Sapiens
CMLFFFVSV

SEQ ID NO: 1059351 - protein, 9 aa, Homo Sapiens
SFTCKSSLK

SEQ ID NO: 1059352 - protein, 9 aa, Homo Sapiens
SQCPIAGNS

SEQ ID NO: 1059353 - protein, 9 aa, Homo Sapiens
PPQAQAEGP

SEQ ID NO: 1059354 - protein, 9 aa, Homo Sapiens
EGLVTPATT

SEQ ID NO: 1059355 - protein, 9 aa, Homo Sapiens
MGNFVMVLL

SEQ ID NO: 1059356 - protein, 9 aa, Homo Sapiens
SNPSAIMAP

SEQ ID NO: 1059357 - protein, 9 aa, Homo Sapiens
PNNKYEPFW

SEQ ID NO: 1059358 - protein, 9 aa, Homo Sapiens
NLPPTSIII

SEQ ID NO: 1059359 - protein, 9 aa, Homo Sapiens
DILKNLAEE

SEQ ID NO: 1059360 - protein, 9 aa, Homo Sapiens
MVGEPSISL

SEQ ID NO: 1059361 - protein, 9 aa, Homo Sapiens
FVSRHSARL

SEQ ID NO: 1059362 - protein, 9 aa, Homo Sapiens
LGNPPPHFS

SEQ ID NO: 1059363 - protein, 9 aa, Homo Sapiens
GKKKRKVKE

SEQ ID NO: 1059364 - protein, 9 aa, Homo Sapiens
ENCKLLRRY

SEQ ID NO: 1059365 - protein, 9 aa, Homo Sapiens
GCQMFSING

SEQ ID NO: 1059366 - protein, 9 aa, Homo Sapiens
NERMSSTRI

SEQ ID NO: 1059367 - protein, 9 aa, Homo Sapiens
SAFPLIKKT

SEQ ID NO: 1059368 - protein, 9 aa, Homo Sapiens
QSPLPLSSL

SEQ ID NO: 1059369 - protein, 9 aa, Homo Sapiens
LKLDRPSMG

SEQ ID NO: 1059370 - protein, 9 aa, Homo Sapiens
RSKAKELLS

SEQ ID NO: 1059371 - protein, 9 aa, Homo Sapiens
LQMLKSFQG

SEQ ID NO: 1059372 - protein, 9 aa, Homo Sapiens
KTSLGTVFV

SEQ ID NO: 1059373 - protein, 9 aa, Homo Sapiens
RTGIEVPPQ

SEQ ID NO: 1059374 - protein, 9 aa, Homo Sapiens
HSHEQHPHR

SEQ ID NO: 1059375 - protein, 9 aa, Homo Sapiens
YREDRLKAQ

SEQ ID NO: 1059376 - protein, 9 aa, Homo Sapiens
RSVDLTSLH

SEQ ID NO: 1059377 - protein, 9 aa, Homo Sapiens
LTEKKDDFF

SEQ ID NO: 1059378 - protein, 9 aa, Homo Sapiens
HEENDPETK

SEQ ID NO: 1059379 - protein, 9 aa, Homo Sapiens
STMALVLYY

SEQ ID NO: 1059380 - protein, 9 aa, Homo Sapiens
LSISLEPGD

SEQ ID NO: 1059381 - protein, 9 aa, Homo Sapiens
DGCGFCYKI

SEQ ID NO: 1059382 - protein, 9 aa, Homo Sapiens
RFYKSLPLA

SEQ ID NO: 1059383 - protein, 9 aa, Homo Sapiens
KAILESTEF

SEQ ID NO: 1059384 - protein, 9 aa, Homo Sapiens
KDNTPAKKK

SEQ ID NO: 1059385 - protein, 9 aa, Homo Sapiens
FQQVQKHTD

SEQ ID NO: 1059386 - protein, 9 aa, Homo Sapiens
RAARVSPIS

SEQ ID NO: 1059387 - protein, 9 aa, Homo Sapiens
NDIKKKLCY

SEQ ID NO: 1059388 - protein, 9 aa, Homo Sapiens
PRPTQKIPK

SEQ ID NO: 1059389 - protein, 9 aa, Homo Sapiens
LFKNGNDFF

SEQ ID NO: 1059390 - protein, 9 aa, Homo Sapiens
NFSTLMKHK

SEQ ID NO: 1059391 - protein, 9 aa, Homo Sapiens
MLTCRCPTG

SEQ ID NO: 1059392 - protein, 9 aa, Homo Sapiens
LFLFSSSLA

SEQ ID NO: 1059393 - protein, 9 aa, Homo Sapiens
GLNLQNYIL

SEQ ID NO: 1059394 - protein, 9 aa, Homo Sapiens
LIISNNGLV

SEQ ID NO: 1059395 - protein, 9 aa, Homo Sapiens
TQMDLGDCI

SEQ ID NO: 1059396 - protein, 9 aa, Homo Sapiens
DFVPCYCKL

SEQ ID NO: 1059397 - protein, 9 aa, Homo Sapiens
EEKELITWR

SEQ ID NO: 1059398 - protein, 9 aa, Homo Sapiens
LLPPPPAKK

SEQ ID NO: 1059399 - protein, 9 aa, Homo Sapiens
KKTFFGVGQ

SEQ ID NO: 1059400 - protein, 9 aa, Homo Sapiens
EDFLATVKV

SEQ ID NO: 1059401 - protein, 9 aa, Homo Sapiens
QVLATKAPR

SEQ ID NO: 1059402 - protein, 9 aa, Homo Sapiens
GFHFVCSGE

SEQ ID NO: 1059403 - protein, 9 aa, Homo Sapiens
LLRPENVFI

SEQ ID NO: 1059404 - protein, 9 aa, Homo Sapiens
EFCVRTVCA

SEQ ID NO: 1059405 - protein, 9 aa, Homo Sapiens
QDITDVCFF

SEQ ID NO: 1059406 - protein, 9 aa, Homo Sapiens
FHFSGLQAH

SEQ ID NO: 1059407 - protein, 9 aa, Homo Sapiens
ETKGQKLEY

SEQ ID NO: 1059408 - protein, 9 aa, Homo Sapiens
TLKKKNEDC

SEQ ID NO: 1059409 - protein, 9 aa, Homo Sapiens
AVCEESSPP

SEQ ID NO: 1059410 - protein, 9 aa, Homo Sapiens
LGILLFLAK

SEQ ID NO: 1059411 - protein, 9 aa, Homo Sapiens
LETLYNNST

SEQ ID NO: 1059412 - protein, 9 aa, Homo Sapiens
EILYSFEDI

SEQ ID NO: 1059413 - protein, 9 aa, Homo Sapiens
PRRRFHQDA

SEQ ID NO: 1059414 - protein, 9 aa, Homo Sapiens
KMSLVKEKK

SEQ ID NO: 1059415 - protein, 9 aa, Homo Sapiens
ELVRITHQD

SEQ ID NO: 1059416 - protein, 9 aa, Homo Sapiens
NQNISIYLP

SEQ ID NO: 1059417 - protein, 9 aa, Homo Sapiens
LEEAEEEAF

SEQ ID NO: 1059418 - protein, 9 aa, Homo Sapiens
PDSVCLGIT

SEQ ID NO: 1059419 - protein, 9 aa, Homo Sapiens
QSASVPLPP

SEQ ID NO: 1059420 - protein, 9 aa, Homo Sapiens
IFSFSPRLE

SEQ ID NO: 1059421 - protein, 9 aa, Homo Sapiens
SAFVTTNHS

SEQ ID NO: 1059422 - protein, 9 aa, Homo Sapiens
PSKEGQKKG

SEQ ID NO: 1059423 - protein, 9 aa, Homo Sapiens
VSTPGATSS

SEQ ID NO: 1059424 - protein, 9 aa, Homo Sapiens
EPVSPNHLP

SEQ ID NO: 1059425 - protein, 9 aa, Homo Sapiens
DVFQASKHI

SEQ ID NO: 1059426 - protein, 9 aa, Homo Sapiens
GGSIQVPQS

SEQ ID NO: 1059427 - protein, 9 aa, Homo Sapiens
ARPSLQLPQ

SEQ ID NO: 1059428 - protein, 9 aa, Homo Sapiens
RLPPSPRSQ

SEQ ID NO: 1059429 - protein, 9 aa, Homo Sapiens
HAQHLLVLG

SEQ ID NO: 1059430 - protein, 9 aa, Homo Sapiens
DFQKNPKKS

SEQ ID NO: 1059431 - protein, 9 aa, Homo Sapiens
SNPSVCEFV

SEQ ID NO: 1059432 - protein, 9 aa, Homo Sapiens
ELRGHFPFS

SEQ ID NO: 1059433 - protein, 9 aa, Homo Sapiens
GSSTTEDKP

SEQ ID NO: 1059434 - protein, 9 aa, Homo Sapiens
SGMPLGATR

SEQ ID NO: 1059435 - protein, 9 aa, Homo Sapiens
ISPEMLASY

SEQ ID NO: 1059436 - protein, 9 aa, Homo Sapiens
FANFIKEFV

SEQ ID NO: 1059437 - protein, 9 aa, Homo Sapiens
MQEFILRAS

SEQ ID NO: 1059438 - protein, 9 aa, Homo Sapiens
TLKEYKAMA

SEQ ID NO: 1059439 - protein, 9 aa, Homo Sapiens
RDGRKKKYS

SEQ ID NO: 1059440 - protein, 9 aa, Homo Sapiens
GCDGLEIPD

SEQ ID NO: 1059441 - protein, 9 aa, Homo Sapiens
IDEDILYHL

SEQ ID NO: 1059442 - protein, 9 aa, Homo Sapiens
SCYLTEYSY

SEQ ID NO: 1059443 - protein, 9 aa, Homo Sapiens
APRMGRKKG

SEQ ID NO: 1059444 - protein, 9 aa, Homo Sapiens
RGLFAATFS

SEQ ID NO: 1059445 - protein, 9 aa, Homo Sapiens
WPETLERLV

SEQ ID NO: 1059446 - protein, 9 aa, Homo Sapiens
QSSSTPIKD

SEQ ID NO: 1059447 - protein, 9 aa, Homo Sapiens
LGDPILYDP

SEQ ID NO: 1059448 - protein, 9 aa, Homo Sapiens
NLGAILKGV

SEQ ID NO: 1059449 - protein, 9 aa, Homo Sapiens
FRYFSRSNS

SEQ ID NO: 1059450 - protein, 9 aa, Homo Sapiens
NLLKQTLGE

SEQ ID NO: 1059451 - protein, 9 aa, Homo Sapiens
NIQIETVLP

SEQ ID NO: 1059452 - protein, 9 aa, Homo Sapiens
PVGRTHFMD

SEQ ID NO: 1059453 - protein, 9 aa, Homo Sapiens
AAEVKKPGE

SEQ ID NO: 1059454 - protein, 9 aa, Homo Sapiens
LPSPSPTSP

SEQ ID NO: 1059455 - protein, 9 aa, Homo Sapiens
PDFVPCYCK

SEQ ID NO: 1059456 - protein, 9 aa, Homo Sapiens
DKGLDSAEG

SEQ ID NO: 1059457 - protein, 9 aa, Homo Sapiens
PEGNVQNLQ

SEQ ID NO: 1059458 - protein, 9 aa, Homo Sapiens
VKRSLETSS

SEQ ID NO: 1059459 - protein, 9 aa, Homo Sapiens
RLEQEVDDV

SEQ ID NO: 1059460 - protein, 9 aa, Homo Sapiens
FLTELISSL

SEQ ID NO: 1059461 - protein, 9 aa, Homo Sapiens
GTRVRVMAI

SEQ ID NO: 1059462 - protein, 9 aa, Homo Sapiens
MASVWKCLH

SEQ ID NO: 1059463 - protein, 9 aa, Homo Sapiens
ESSDIDDVS

SEQ ID NO: 1059464 - protein, 9 aa, Homo Sapiens
SLMLKWTPP

SEQ ID NO: 1059465 - protein, 9 aa, Homo Sapiens
EDTYPETLG

SEQ ID NO: 1059466 - protein, 9 aa, Homo Sapiens
GKKFLGRPM

SEQ ID NO: 1059467 - protein, 9 aa, Homo Sapiens
AGLLGVLKE

SEQ ID NO: 1059468 - protein, 9 aa, Homo Sapiens
TIQVKENGY

SEQ ID NO: 1059469 - protein, 9 aa, Homo Sapiens
EQYFHPAEL

SEQ ID NO: 1059470 - protein, 9 aa, Homo Sapiens
WIPERFFPG

SEQ ID NO: 1059471 - protein, 9 aa, Homo Sapiens
KERPYGCSQ

SEQ ID NO: 1059472 - protein, 9 aa, Homo Sapiens
AYVLEIFKE

SEQ ID NO: 1059473 - protein, 9 aa, Homo Sapiens
REKKTKKEQ

SEQ ID NO: 1059474 - protein, 9 aa, Homo Sapiens
AVLPSPSKS

SEQ ID NO: 1059475 - protein, 9 aa, Homo Sapiens
ILYTITIFG

SEQ ID NO: 1059476 - protein, 9 aa, Homo Sapiens
QAGKKLFGL

SEQ ID NO: 1059477 - protein, 9 aa, Homo Sapiens
RYTEEGHQD

SEQ ID NO: 1059478 - protein, 9 aa, Homo Sapiens
QGWILDGIS

SEQ ID NO: 1059479 - protein, 9 aa, Homo Sapiens
PTLDSISKL

SEQ ID NO: 1059480 - protein, 9 aa, Homo Sapiens
LLQLDENKL

SEQ ID NO: 1059481 - protein, 9 aa, Homo Sapiens
LVALKLSNF

SEQ ID NO: 1059482 - protein, 9 aa, Homo Sapiens
AFSQPVRAA

SEQ ID NO: 1059483 - protein, 9 aa, Homo Sapiens
TICLIDVNT

SEQ ID NO: 1059484 - protein, 9 aa, Homo Sapiens
LFQCWLCSA

SEQ ID NO: 1059485 - protein, 9 aa, Homo Sapiens
CRRKAGVQE

SEQ ID NO: 1059486 - protein, 9 aa, Homo Sapiens
LSAAGPGFP

SEQ ID NO: 1059487 - protein, 9 aa, Homo Sapiens
NEPLHKKEA

SEQ ID NO: 1059488 - protein, 9 aa, Homo Sapiens
PEKARLSSS

SEQ ID NO: 1059489 - protein, 9 aa, Homo Sapiens
ILDGISETR

SEQ ID NO: 1059490 - protein, 9 aa, Homo Sapiens
VTLLANLIP

SEQ ID NO: 1059491 - protein, 9 aa, Homo Sapiens
AGCYKICSC

SEQ ID NO: 1059492 - protein, 9 aa, Homo Sapiens
HLKKEQEKA

SEQ ID NO: 1059493 - protein, 9 aa, Homo Sapiens
IMKSIISAI

SEQ ID NO: 1059494 - protein, 9 aa, Homo Sapiens
QNTIHKNLC

SEQ ID NO: 1059495 - protein, 9 aa, Homo Sapiens
AKPAAPLFG

SEQ ID NO: 1059496 - protein, 9 aa, Homo Sapiens
GRDHWNKML

SEQ ID NO: 1059497 - protein, 9 aa, Homo Sapiens
GEEKTLTFE

SEQ ID NO: 1059498 - protein, 9 aa, Homo Sapiens
KPSIAVSPS

SEQ ID NO: 1059499 - protein, 9 aa, Homo Sapiens
LELKNTVCQ

SEQ ID NO: 1059500 - protein, 9 aa, Homo Sapiens
PPPLPPLSD

SEQ ID NO: 1059501 - protein, 9 aa, Homo Sapiens
AKNLLSHML

SEQ ID NO: 1059502 - protein, 9 aa, Homo Sapiens
GIWQQVDNN

SEQ ID NO: 1059503 - protein, 9 aa, Homo Sapiens
GFSDYLELH

SEQ ID NO: 1059504 - protein, 9 aa, Homo Sapiens
GIWSNPSLI

SEQ ID NO: 1059505 - protein, 9 aa, Homo Sapiens
HRFQRRPDF

SEQ ID NO: 1059506 - protein, 9 aa, Homo Sapiens
PHIRAEPFQ

SEQ ID NO: 1059507 - protein, 9 aa, Homo Sapiens
AFHFSGLQA

SEQ ID NO: 1059508 - protein, 9 aa, Homo Sapiens
SFSKAPPPS

SEQ ID NO: 1059509 - protein, 9 aa, Homo Sapiens
TQQDVLRTC

SEQ ID NO: 1059510 - protein, 9 aa, Homo Sapiens
EKEIQSFNL

SEQ ID NO: 1059511 - protein, 9 aa, Homo Sapiens
SLVLFYMKD

SEQ ID NO: 1059512 - protein, 9 aa, Homo Sapiens
PRRKKCRPI

SEQ ID NO: 1059513 - protein, 9 aa, Homo Sapiens
KMYYSQKAI

SEQ ID NO: 1059514 - protein, 9 aa, Homo Sapiens
LSEGFHFVC

SEQ ID NO: 1059515 - protein, 9 aa, Homo Sapiens
SSATLWNRS

SEQ ID NO: 1059516 - protein, 9 aa, Homo Sapiens
PKCTPKCLP

SEQ ID NO: 1059517 - protein, 9 aa, Homo Sapiens
FFDNEMHLK

SEQ ID NO: 1059518 - protein, 9 aa, Homo Sapiens
FVLLTSCYK

SEQ ID NO: 1059519 - protein, 9 aa, Homo Sapiens
LEMRKDSSG

SEQ ID NO: 1059520 - protein, 9 aa, Homo Sapiens
SHPNVFSLL

SEQ ID NO: 1059521 - protein, 9 aa, Homo Sapiens
RFQRRPDFS

SEQ ID NO: 1059522 - protein, 9 aa, Homo Sapiens
GDEIIFPRG

SEQ ID NO: 1059523 - protein, 9 aa, Homo Sapiens
GPSGLGGPR

SEQ ID NO: 1059524 - protein, 9 aa, Homo Sapiens
AKLRAERRA

SEQ ID NO: 1059525 - protein, 9 aa, Homo Sapiens
SAFHFSGLQ

SEQ ID NO: 1059526 - protein, 9 aa, Homo Sapiens
SLEMRKDSS

SEQ ID NO: 1059527 - protein, 9 aa, Homo Sapiens
SAAYNSTDG

SEQ ID NO: 1059528 - protein, 9 aa, Homo Sapiens
STDLVQLWQ

SEQ ID NO: 1059529 - protein, 9 aa, Homo Sapiens
PSPLFQQQR

SEQ ID NO: 1059530 - protein, 9 aa, Homo Sapiens
PPSKKPEVP

SEQ ID NO: 1059531 - protein, 9 aa, Homo Sapiens
GWCKAREQD

SEQ ID NO: 1059532 - protein, 9 aa, Homo Sapiens
DTLAIKEKV

SEQ ID NO: 1059533 - protein, 9 aa, Homo Sapiens
FLFLFHHTK

SEQ ID NO: 1059534 - protein, 9 aa, Homo Sapiens
SRCCYSLEN

SEQ ID NO: 1059535 - protein, 9 aa, Homo Sapiens
TTTKDILFM

SEQ ID NO: 1059536 - protein, 9 aa, Homo Sapiens
FSKEGRQLT

SEQ ID NO: 1059537 - protein, 9 aa, Homo Sapiens
PVIIYRAIL

SEQ ID NO: 1059538 - protein, 9 aa, Homo Sapiens
DQGFLYARN

SEQ ID NO: 1059539 - protein, 9 aa, Homo Sapiens
EPAIREHQD

SEQ ID NO: 1059540 - protein, 9 aa, Homo Sapiens
AKHHSPVSW

SEQ ID NO: 1059541 - protein, 9 aa, Homo Sapiens
DTCMMTPKF

SEQ ID NO: 1059542 - protein, 9 aa, Homo Sapiens
NNLGWPNEL

SEQ ID NO: 1059543 - protein, 9 aa, Homo Sapiens
SSAAIITQL

SEQ ID NO: 1059544 - protein, 9 aa, Homo Sapiens
LLQKIILDQ

SEQ ID NO: 1059545 - protein, 9 aa, Homo Sapiens
FARGGRARR

SEQ ID NO: 1059546 - protein, 9 aa, Homo Sapiens
VDLLKNLNS

SEQ ID NO: 1059547 - protein, 9 aa, Homo Sapiens
TKTASSLTT

SEQ ID NO: 1059548 - protein, 9 aa, Homo Sapiens
AFVRNLYLA

SEQ ID NO: 1059549 - protein, 9 aa, Homo Sapiens
RTLGPSVAG

SEQ ID NO: 1059550 - protein, 9 aa, Homo Sapiens
SYMASERLQ

SEQ ID NO: 1059551 - protein, 9 aa, Homo Sapiens
RLTQDPAKP

SEQ ID NO: 1059552 - protein, 9 aa, Homo Sapiens
VEEFLLLGR

SEQ ID NO: 1059553 - protein, 9 aa, Homo Sapiens
SATEAARRL

SEQ ID NO: 1059554 - protein, 9 aa, Homo Sapiens
GETWNSFLS

SEQ ID NO: 1059555 - protein, 9 aa, Homo Sapiens
FMFEGHNTT

SEQ ID NO: 1059556 - protein, 9 aa, Homo Sapiens
AGPSGLGGP

SEQ ID NO: 1059557 - protein, 9 aa, Homo Sapiens
PGVRPSNSR

SEQ ID NO: 1059558 - protein, 9 aa, Homo Sapiens
SSMSLIGDH

SEQ ID NO: 1059559 - protein, 9 aa, Homo Sapiens
TEEGLRKVK

SEQ ID NO: 1059560 - protein, 9 aa, Homo Sapiens
FYDNVQFDL

SEQ ID NO: 1059561 - protein, 9 aa, Homo Sapiens
IVLAEKALD

SEQ ID NO: 1059562 - protein, 9 aa, Homo Sapiens
SRSDLKETG

SEQ ID NO: 1059563 - protein, 9 aa, Homo Sapiens
GELSIISYE

SEQ ID NO: 1059564 - protein, 9 aa, Homo Sapiens
QVLAACDFF

SEQ ID NO: 1059565 - protein, 9 aa, Homo Sapiens
SSTTEDKPV

SEQ ID NO: 1059566 - protein, 9 aa, Homo Sapiens
GILAITMKI

SEQ ID NO: 1059567 - protein, 9 aa, Homo Sapiens
PAKVQNYCQ

SEQ ID NO: 1059568 - protein, 9 aa, Homo Sapiens
QDDKERIEK

SEQ ID NO: 1059569 - protein, 9 aa, Homo Sapiens
LILSYAGGL

SEQ ID NO: 1059570 - protein, 9 aa, Homo Sapiens
DGLHLWSSC

SEQ ID NO: 1059571 - protein, 9 aa, Homo Sapiens
LILVFRFGP

SEQ ID NO: 1059572 - protein, 9 aa, Homo Sapiens
EIRAQDASL

SEQ ID NO: 1059573 - protein, 9 aa, Homo Sapiens
LTFFCVCTG

SEQ ID NO: 1059574 - protein, 9 aa, Homo Sapiens
HHCRDTDCV

SEQ ID NO: 1059575 - protein, 9 aa, Homo Sapiens
IKKCNLYLL

SEQ ID NO: 1059576 - protein, 9 aa, Homo Sapiens
DDKIRKMQA

SEQ ID NO: 1059577 - protein, 9 aa, Homo Sapiens
QGYQKQLGH

SEQ ID NO: 1059578 - protein, 9 aa, Homo Sapiens
ADRLWPDSG

SEQ ID NO: 1059579 - protein, 9 aa, Homo Sapiens
LCEQNKRLR

SEQ ID NO: 1059580 - protein, 9 aa, Homo Sapiens
GLFFPTVCE

SEQ ID NO: 1059581 - protein, 9 aa, Homo Sapiens
TVFYFYDVT

SEQ ID NO: 1059582 - protein, 9 aa, Homo Sapiens
RELRLFKHL

SEQ ID NO: 1059583 - protein, 9 aa, Homo Sapiens
IFYGVFASE

SEQ ID NO: 1059584 - protein, 9 aa, Homo Sapiens
ILKINENAD

SEQ ID NO: 1059585 - protein, 9 aa, Homo Sapiens
MMMNPETKA

SEQ ID NO: 1059586 - protein, 9 aa, Homo Sapiens
EAGCYKICS

SEQ ID NO: 1059587 - protein, 9 aa, Homo Sapiens
ILIDKSEKL

SEQ ID NO: 1059588 - protein, 9 aa, Homo Sapiens
LQYVFNQGP

SEQ ID NO: 1059589 - protein, 9 aa, Homo Sapiens
CTSSACKTH

SEQ ID NO: 1059590 - protein, 9 aa, Homo Sapiens
LLFLIHLVL

SEQ ID NO: 1059591 - protein, 9 aa, Homo Sapiens
FVPYNSVFF

SEQ ID NO: 1059592 - protein, 9 aa, Homo Sapiens
KNSGNSESL

SEQ ID NO: 1059593 - protein, 9 aa, Homo Sapiens
EFVCKRGYC

SEQ ID NO: 1059594 - protein, 9 aa, Homo Sapiens
GISCRSTRN

SEQ ID NO: 1059595 - protein, 9 aa, Homo Sapiens
KLLSDKPQN

SEQ ID NO: 1059596 - protein, 9 aa, Homo Sapiens
VNSCVSGIP

SEQ ID NO: 1059597 - protein, 9 aa, Homo Sapiens
RPAPPCPAT

SEQ ID NO: 1059598 - protein, 9 aa, Homo Sapiens
GFVATPSSA

SEQ ID NO: 1059599 - protein, 9 aa, Homo Sapiens
DSKFYQAIN

SEQ ID NO: 1059600 - protein, 9 aa, Homo Sapiens
ASSLTTSRG

SEQ ID NO: 1059601 - protein, 9 aa, Homo Sapiens
HDFLRSELP

SEQ ID NO: 1059602 - protein, 9 aa, Homo Sapiens
APSHMSSFH

SEQ ID NO: 1059603 - protein, 9 aa, Homo Sapiens
VFLNNKKNG

SEQ ID NO: 1059604 - protein, 9 aa, Homo Sapiens
ARVLVIRAT

SEQ ID NO: 1059605 - protein, 9 aa, Homo Sapiens
LSSSPQHLN

SEQ ID NO: 1059606 - protein, 9 aa, Homo Sapiens
AAIWLGDLL

SEQ ID NO: 1059607 - protein, 9 aa, Homo Sapiens
HARYLSQLD

SEQ ID NO: 1059608 - protein, 9 aa, Homo Sapiens
VSLCCFHQD

SEQ ID NO: 1059609 - protein, 9 aa, Homo Sapiens
MTYYQEVLQ

SEQ ID NO: 1059610 - protein, 9 aa, Homo Sapiens
LLFGWTPSR

SEQ ID NO: 1059611 - protein, 9 aa, Homo Sapiens
CADGFEPGF

SEQ ID NO: 1059612 - protein, 9 aa, Homo Sapiens
DEMAKYNLP

SEQ ID NO: 1059613 - protein, 9 aa, Homo Sapiens
QRPPPQGGN

SEQ ID NO: 1059614 - protein, 9 aa, Homo Sapiens
APAMYSFLE

SEQ ID NO: 1059615 - protein, 9 aa, Homo Sapiens
SPEKEEEEA

SEQ ID NO: 1059616 - protein, 9 aa, Homo Sapiens
ESSERDAED

SEQ ID NO: 1059617 - protein, 9 aa, Homo Sapiens
GDIPCELIG

SEQ ID NO: 1059618 - protein, 9 aa, Homo Sapiens
IDKSEKLEL

SEQ ID NO: 1059619 - protein, 9 aa, Homo Sapiens
PKVMWHLFR

SEQ ID NO: 1059620 - protein, 9 aa, Homo Sapiens
QSMLWLADL

SEQ ID NO: 1059621 - protein, 9 aa, Homo Sapiens
LVGPLQPPF

SEQ ID NO: 1059622 - protein, 9 aa, Homo Sapiens
FVKPLEWNT

SEQ ID NO: 1059623 - protein, 9 aa, Homo Sapiens
IPKEAKHGT

SEQ ID NO: 1059624 - protein, 9 aa, Homo Sapiens
QAWNVPDLL

SEQ ID NO: 1059625 - protein, 9 aa, Homo Sapiens
SSIDSESAL

SEQ ID NO: 1059626 - protein, 9 aa, Homo Sapiens
QTTAKVFFN

SEQ ID NO: 1059627 - protein, 9 aa, Homo Sapiens
GGGAPFQRG

SEQ ID NO: 1059628 - protein, 9 aa, Homo Sapiens
TAAAAAASV

SEQ ID NO: 1059629 - protein, 9 aa, Homo Sapiens
YLSHIAWTE

SEQ ID NO: 1059630 - protein, 9 aa, Homo Sapiens
SVCRRKAGV

SEQ ID NO: 1059631 - protein, 9 aa, Homo Sapiens
KIDVTYFSF

SEQ ID NO: 1059632 - protein, 9 aa, Homo Sapiens
WFLGSVQIC

SEQ ID NO: 1059633 - protein, 9 aa, Homo Sapiens
VPEESPFSS

SEQ ID NO: 1059634 - protein, 9 aa, Homo Sapiens
TFVTDSLML

SEQ ID NO: 1059635 - protein, 9 aa, Homo Sapiens
ENQFMNSRM

SEQ ID NO: 1059636 - protein, 9 aa, Homo Sapiens
RCWVYILDN

SEQ ID NO: 1059637 - protein, 9 aa, Homo Sapiens
SKEYGVYLE

SEQ ID NO: 1059638 - protein, 9 aa, Homo Sapiens
QKGIQAEEV

SEQ ID NO: 1059639 - protein, 9 aa, Homo Sapiens
QVIMGPETP

SEQ ID NO: 1059640 - protein, 9 aa, Homo Sapiens
DGLERLALS

SEQ ID NO: 1059641 - protein, 9 aa, Homo Sapiens
KQKKIPSES

SEQ ID NO: 1059642 - protein, 9 aa, Homo Sapiens
SPAGPKTLK

SEQ ID NO: 1059643 - protein, 9 aa, Homo Sapiens
KAKYYREPQ

SEQ ID NO: 1059644 - protein, 9 aa, Homo Sapiens
WSLLGSISC

SEQ ID NO: 1059645 - protein, 9 aa, Homo Sapiens
KAIWLPWGL

SEQ ID NO: 1059646 - protein, 9 aa, Homo Sapiens
DLIIILAFY

SEQ ID NO: 1059647 - protein, 9 aa, Homo Sapiens
WDGEAGRAG

SEQ ID NO: 1059648 - protein, 9 aa, Homo Sapiens
LIFKKSASL

SEQ ID NO: 1059649 - protein, 9 aa, Homo Sapiens
IILLLNPFI

SEQ ID NO: 1059650 - protein, 9 aa, Homo Sapiens
QRLISCCKP

SEQ ID NO: 1059651 - protein, 9 aa, Homo Sapiens
GHDSKEPEQ

SEQ ID NO: 1059652 - protein, 9 aa, Homo Sapiens
EDKATLENK

SEQ ID NO: 1059653 - protein, 9 aa, Homo Sapiens
CRSILHKDI

SEQ ID NO: 1059654 - protein, 9 aa, Homo Sapiens
FCKNCCNKH

SEQ ID NO: 1059655 - protein, 9 aa, Homo Sapiens
WNIPFEQLE

SEQ ID NO: 1059656 - protein, 9 aa, Homo Sapiens
SIYLPSAMP

SEQ ID NO: 1059657 - protein, 9 aa, Homo Sapiens
EERMIVTAY

SEQ ID NO: 1059658 - protein, 9 aa, Homo Sapiens
NQSFFFCVA

SEQ ID NO: 1059659 - protein, 9 aa, Homo Sapiens
IMAMNEEQV

SEQ ID NO: 1059660 - protein, 9 aa, Homo Sapiens
TYSEKRPYN

SEQ ID NO: 1059661 - protein, 9 aa, Homo Sapiens
RVPLGVNVE

SEQ ID NO: 1059662 - protein, 9 aa, Homo Sapiens
FSTNEPSGD

SEQ ID NO: 1059663 - protein, 9 aa, Homo Sapiens
WYVDGVKVH

SEQ ID NO: 1059664 - protein, 9 aa, Homo Sapiens
SSEEGVSCT

SEQ ID NO: 1059665 - protein, 9 aa, Homo Sapiens
ALYAAFLPL

SEQ ID NO: 1059666 - protein, 9 aa, Homo Sapiens
KCLSDCILQ

SEQ ID NO: 1059667 - protein, 9 aa, Homo Sapiens
GSNKGAKGS

SEQ ID NO: 1059668 - protein, 9 aa, Homo Sapiens
GNITRSKAK

SEQ ID NO: 1059669 - protein, 9 aa, Homo Sapiens
DTGDLLPGH

SEQ ID NO: 1059670 - protein, 9 aa, Homo Sapiens
SEKSDGPFW

SEQ ID NO: 1059671 - protein, 9 aa, Homo Sapiens
DLGSPSDDK

SEQ ID NO: 1059672 - protein, 9 aa, Homo Sapiens
GFIQELVRI

SEQ ID NO: 1059673 - protein, 9 aa, Homo Sapiens
TMDPSVKWE

SEQ ID NO: 1059674 - protein, 9 aa, Homo Sapiens
FPEEDKKKE

SEQ ID NO: 1059675 - protein, 9 aa, Homo Sapiens
FVEAFDKLM

SEQ ID NO: 1059676 - protein, 9 aa, Homo Sapiens
QTIMLFIMF

SEQ ID NO: 1059677 - protein, 9 aa, Homo Sapiens
VIIGDENYL

SEQ ID NO: 1059678 - protein, 9 aa, Homo Sapiens
AGPPGTPGL

SEQ ID NO: 1059679 - protein, 9 aa, Homo Sapiens
QNSHYGQSE

SEQ ID NO: 1059680 - protein, 9 aa, Homo Sapiens
VKNFHLPSE

SEQ ID NO: 1059681 - protein, 9 aa, Homo Sapiens
LYSEKDEPT

SEQ ID NO: 1059682 - protein, 9 aa, Homo Sapiens
PTDYVEILS

SEQ ID NO: 1059683 - protein, 9 aa, Homo Sapiens
ENQYQGNPL

SEQ ID NO: 1059684 - protein, 9 aa, Homo Sapiens
FFPTVCELC

SEQ ID NO: 1059685 - protein, 9 aa, Homo Sapiens
PWLLIFFLH

SEQ ID NO: 1059686 - protein, 9 aa, Homo Sapiens
AYNPEAASA

SEQ ID NO: 1059687 - protein, 9 aa, Homo Sapiens
NCEANLQAL

SEQ ID NO: 1059688 - protein, 9 aa, Homo Sapiens
ALREKLRYR

SEQ ID NO: 1059689 - protein, 9 aa, Homo Sapiens
SGMKKEAIL

SEQ ID NO: 1059690 - protein, 9 aa, Homo Sapiens
FCSSHKIQH

SEQ ID NO: 1059691 - protein, 9 aa, Homo Sapiens
GPQGPFGQP

SEQ ID NO: 1059692 - protein, 9 aa, Homo Sapiens
SSSRIKKVF

SEQ ID NO: 1059693 - protein, 9 aa, Homo Sapiens
SINLKDFFR

SEQ ID NO: 1059694 - protein, 9 aa, Homo Sapiens
YFKFKEYCP

SEQ ID NO: 1059695 - protein, 9 aa, Homo Sapiens
VWGGKNMEL

SEQ ID NO: 1059696 - protein, 9 aa, Homo Sapiens
NGQLLMIRQ

SEQ ID NO: 1059697 - protein, 9 aa, Homo Sapiens
IAMFICSKI

SEQ ID NO: 1059698 - protein, 9 aa, Homo Sapiens
LLLKFITFS

SEQ ID NO: 1059699 - protein, 9 aa, Homo Sapiens
GESSEIFKF

SEQ ID NO: 1059700 - protein, 9 aa, Homo Sapiens
WPNPETFNP

SEQ ID NO: 1059701 - protein, 9 aa, Homo Sapiens
SDRYGGGGY

SEQ ID NO: 1059702 - protein, 9 aa, Homo Sapiens
ILLWLKGML

SEQ ID NO: 1059703 - protein, 9 aa, Homo Sapiens
LNTQQSSVA

SEQ ID NO: 1059704 - protein, 9 aa, Homo Sapiens
RIGLTKPLK

SEQ ID NO: 1059705 - protein, 9 aa, Homo Sapiens
RSRGVGEAV

SEQ ID NO: 1059706 - protein, 9 aa, Homo Sapiens
LETCKETFN

SEQ ID NO: 1059707 - protein, 9 aa, Homo Sapiens
VQSYPSKHN

SEQ ID NO: 1059708 - protein, 9 aa, Homo Sapiens
ASLYSPSST

SEQ ID NO: 1059709 - protein, 9 aa, Homo Sapiens
SMHGKQIRG

SEQ ID NO: 1059710 - protein, 9 aa, Homo Sapiens
PQGPFGQPG

SEQ ID NO: 1059711 - protein, 9 aa, Homo Sapiens
VVGICHTDD

SEQ ID NO: 1059712 - protein, 9 aa, Homo Sapiens
GIKSPIIII

SEQ ID NO: 1059713 - protein, 9 aa, Homo Sapiens
FFINTKRDD

SEQ ID NO: 1059714 - protein, 9 aa, Homo Sapiens
MQGMVLSFM

SEQ ID NO: 1059715 - protein, 9 aa, Homo Sapiens
HSPEPPEDT

SEQ ID NO: 1059716 - protein, 9 aa, Homo Sapiens
YSNVTMVNF

SEQ ID NO: 1059717 - protein, 9 aa, Homo Sapiens
TVFVPQRKL

SEQ ID NO: 1059718 - protein, 9 aa, Homo Sapiens
LYTDDEDKD

SEQ ID NO: 1059719 - protein, 9 aa, Homo Sapiens
VWKLASMFK

SEQ ID NO: 1059720 - protein, 9 aa, Homo Sapiens
KKNNAFPCQ

SEQ ID NO: 1059721 - protein, 9 aa, Homo Sapiens
LLMLIFLVR

SEQ ID NO: 1059722 - protein, 9 aa, Homo Sapiens
PIDMQPNSN

SEQ ID NO: 1059723 - protein, 9 aa, Homo Sapiens
GEGDLGRLG

SEQ ID NO: 1059724 - protein, 9 aa, Homo Sapiens
LLISLVYVD

SEQ ID NO: 1059725 - protein, 9 aa, Homo Sapiens
QPKHLEQQK

SEQ ID NO: 1059726 - protein, 9 aa, Homo Sapiens
EVDNMEDLP

SEQ ID NO: 1059727 - protein, 9 aa, Homo Sapiens
KMHLLFSLT

SEQ ID NO: 1059728 - protein, 9 aa, Homo Sapiens
LHLTKHDNF

SEQ ID NO: 1059729 - protein, 9 aa, Homo Sapiens
KWPPTASPL

SEQ ID NO: 1059730 - protein, 9 aa, Homo Sapiens
KFINNASSV

SEQ ID NO: 1059731 - protein, 9 aa, Homo Sapiens
EDLEVTGKN

SEQ ID NO: 1059732 - protein, 9 aa, Homo Sapiens
KYSPVTPSP

SEQ ID NO: 1059733 - protein, 9 aa, Homo Sapiens
QVVLFATCV

SEQ ID NO: 1059734 - protein, 9 aa, Homo Sapiens
SLLFGWTPS

SEQ ID NO: 1059735 - protein, 9 aa, Homo Sapiens
LTEIILLLL

SEQ ID NO: 1059736 - protein, 9 aa, Homo Sapiens
DVKCLSDCI

SEQ ID NO: 1059737 - protein, 9 aa, Homo Sapiens
SEEKKQQEH

SEQ ID NO: 1059738 - protein, 9 aa, Homo Sapiens
ETMHGPLFQ

SEQ ID NO: 1059739 - protein, 9 aa, Homo Sapiens
LKMNSIVDI

SEQ ID NO: 1059740 - protein, 9 aa, Homo Sapiens
TQIEIWVMH

SEQ ID NO: 1059741 - protein, 9 aa, Homo Sapiens
EIHLIEKCL

SEQ ID NO: 1059742 - protein, 9 aa, Homo Sapiens
DPILYDPQI

SEQ ID NO: 1059743 - protein, 9 aa, Homo Sapiens
ETSLECTVC

SEQ ID NO: 1059744 - protein, 9 aa, Homo Sapiens
PQRTPVGIR

SEQ ID NO: 1059745 - protein, 9 aa, Homo Sapiens
YKDGALKRT

SEQ ID NO: 1059746 - protein, 9 aa, Homo Sapiens
ESWDEEDKK

SEQ ID NO: 1059747 - protein, 9 aa, Homo Sapiens
RSSALYFSA

SEQ ID NO: 1059748 - protein, 9 aa, Homo Sapiens
ERPRLGPSW

SEQ ID NO: 1059749 - protein, 9 aa, Homo Sapiens
HTSEFKRAA

SEQ ID NO: 1059750 - protein, 9 aa, Homo Sapiens
PQMLTSQAS

SEQ ID NO: 1059751 - protein, 9 aa, Homo Sapiens
EEETEKAAG

SEQ ID NO: 1059752 - protein, 9 aa, Homo Sapiens
GRGHLLVVL

SEQ ID NO: 1059753 - protein, 9 aa, Homo Sapiens
LLLPLVIPG

SEQ ID NO: 1059754 - protein, 9 aa, Homo Sapiens
WWVIQIPIL

SEQ ID NO: 1059755 - protein, 9 aa, Homo Sapiens
SGLLLPGYL

SEQ ID NO: 1059756 - protein, 9 aa, Homo Sapiens
VRMKGLNSF

SEQ ID NO: 1059757 - protein, 9 aa, Homo Sapiens
GMASGDRAE

SEQ ID NO: 1059758 - protein, 9 aa, Homo Sapiens
EACSDAGRQ

SEQ ID NO: 1059759 - protein, 9 aa, Homo Sapiens
YTHMDYNKV

SEQ ID NO: 1059760 - protein, 9 aa, Homo Sapiens
GSSASKSFT

SEQ ID NO: 1059761 - protein, 9 aa, Homo Sapiens
YLRKTTEYD

SEQ ID NO: 1059762 - protein, 9 aa, Homo Sapiens
IPCMISFVP

SEQ ID NO: 1059763 - protein, 9 aa, Homo Sapiens
EILYPALLT

SEQ ID NO: 1059764 - protein, 9 aa, Homo Sapiens
ISMHGKQIR

SEQ ID NO: 1059765 - protein, 9 aa, Homo Sapiens
RGHFPFSIT

SEQ ID NO: 1059766 - protein, 9 aa, Homo Sapiens
AIHVVEEVV

SEQ ID NO: 1059767 - protein, 9 aa, Homo Sapiens
HVRKHQFDY

SEQ ID NO: 1059768 - protein, 9 aa, Homo Sapiens
FFSNIQEIE

SEQ ID NO: 1059769 - protein, 9 aa, Homo Sapiens
LPRHEYGFP

SEQ ID NO: 1059770 - protein, 9 aa, Homo Sapiens
TIRRREEAY

SEQ ID NO: 1059771 - protein, 9 aa, Homo Sapiens
GPLYPARFE

SEQ ID NO: 1059772 - protein, 9 aa, Homo Sapiens
RMQCLMPHL

SEQ ID NO: 1059773 - protein, 9 aa, Homo Sapiens
LQTPVTAYN

SEQ ID NO: 1059774 - protein, 9 aa, Homo Sapiens
WHLDLGGMP

SEQ ID NO: 1059775 - protein, 9 aa, Homo Sapiens
VLPSLPAIL

SEQ ID NO: 1059776 - protein, 9 aa, Homo Sapiens
SGGNSDSRE

SEQ ID NO: 1059777 - protein, 9 aa, Homo Sapiens
KATDRGMAP

SEQ ID NO: 1059778 - protein, 9 aa, Homo Sapiens
GRPEVTTML

SEQ ID NO: 1059779 - protein, 9 aa, Homo Sapiens
FLLPMPLLS

SEQ ID NO: 1059780 - protein, 9 aa, Homo Sapiens
ISHRACIIL

SEQ ID NO: 1059781 - protein, 9 aa, Homo Sapiens
GKHLFPVAH

SEQ ID NO: 1059782 - protein, 9 aa, Homo Sapiens
VLVIRATNR

SEQ ID NO: 1059783 - protein, 9 aa, Homo Sapiens
PSLHLFLFT

SEQ ID NO: 1059784 - protein, 9 aa, Homo Sapiens
LAKNMELTY

SEQ ID NO: 1059785 - protein, 9 aa, Homo Sapiens
WVFFWISQA

SEQ ID NO: 1059786 - protein, 9 aa, Homo Sapiens
DVEERFYLG

SEQ ID NO: 1059787 - protein, 9 aa, Homo Sapiens
TIKHQNQDT

SEQ ID NO: 1059788 - protein, 9 aa, Homo Sapiens
IVLEKAEFL

SEQ ID NO: 1059789 - protein, 9 aa, Homo Sapiens
LYSKTMTST

SEQ ID NO: 1059790 - protein, 9 aa, Homo Sapiens
DILGRHSQK

SEQ ID NO: 1059791 - protein, 9 aa, Homo Sapiens
FFLRRAVRF

SEQ ID NO: 1059792 - protein, 9 aa, Homo Sapiens
ALEEHFQDD

SEQ ID NO: 1059793 - protein, 9 aa, Homo Sapiens
EECSEKIAG

SEQ ID NO: 1059794 - protein, 9 aa, Homo Sapiens
TVHDVNHPG

SEQ ID NO: 1059795 - protein, 9 aa, Homo Sapiens
TETPMVAAS

SEQ ID NO: 1059796 - protein, 9 aa, Homo Sapiens
EAGHGENVA

SEQ ID NO: 1059797 - protein, 9 aa, Homo Sapiens
FFFNRFDCF

SEQ ID NO: 1059798 - protein, 9 aa, Homo Sapiens
LKLDGEKET

SEQ ID NO: 1059799 - protein, 9 aa, Homo Sapiens
NMRNDEITQ

SEQ ID NO: 1059800 - protein, 9 aa, Homo Sapiens
TPRLMKLRE

SEQ ID NO: 1059801 - protein, 9 aa, Homo Sapiens
CYKIAVRIK

SEQ ID NO: 1059802 - protein, 9 aa, Homo Sapiens
AAPEGAQGP

SEQ ID NO: 1059803 - protein, 9 aa, Homo Sapiens
IVCNKKNNI

SEQ ID NO: 1059804 - protein, 9 aa, Homo Sapiens
TTPPGLPPP

SEQ ID NO: 1059805 - protein, 9 aa, Homo Sapiens
LETKKSLDN

SEQ ID NO: 1059806 - protein, 9 aa, Homo Sapiens
LKSFQGTHV

SEQ ID NO: 1059807 - protein, 9 aa, Homo Sapiens
YRDAERDLV

SEQ ID NO: 1059808 - protein, 9 aa, Homo Sapiens
DPFIEKLLE

SEQ ID NO: 1059809 - protein, 9 aa, Homo Sapiens
GQLDSRPLH

SEQ ID NO: 1059810 - protein, 9 aa, Homo Sapiens
EESSPPPAP

SEQ ID NO: 1059811 - protein, 9 aa, Homo Sapiens
GLGNGLRSL

SEQ ID NO: 1059812 - protein, 9 aa, Homo Sapiens
AQPPELQPL

SEQ ID NO: 1059813 - protein, 9 aa, Homo Sapiens
CERVLVALK

SEQ ID NO: 1059814 - protein, 9 aa, Homo Sapiens
TPFSELGLI

SEQ ID NO: 1059815 - protein, 9 aa, Homo Sapiens
YTTKGWGAQ

SEQ ID NO: 1059816 - protein, 9 aa, Homo Sapiens
ATCFRSPFC

SEQ ID NO: 1059817 - protein, 9 aa, Homo Sapiens
NICINGECK

SEQ ID NO: 1059818 - protein, 9 aa, Homo Sapiens
CLLKVLQAQ

SEQ ID NO: 1059819 - protein, 9 aa, Homo Sapiens
FGYQMDKSN

SEQ ID NO: 1059820 - protein, 9 aa, Homo Sapiens
ISGFEPASA

SEQ ID NO: 1059821 - protein, 9 aa, Homo Sapiens
THMDYNKVF

SEQ ID NO: 1059822 - protein, 9 aa, Homo Sapiens
ILLGFFQNK

SEQ ID NO: 1059823 - protein, 9 aa, Homo Sapiens
NSDIKQSSD

SEQ ID NO: 1059824 - protein, 9 aa, Homo Sapiens
EEQQSYGEE

SEQ ID NO: 1059825 - protein, 9 aa, Homo Sapiens
DGPCEFALV

SEQ ID NO: 1059826 - protein, 9 aa, Homo Sapiens
KISSMVLSK

SEQ ID NO: 1059827 - protein, 9 aa, Homo Sapiens
PMGLNGKPE

SEQ ID NO: 1059828 - protein, 9 aa, Homo Sapiens
KDCHLAQVS

SEQ ID NO: 1059829 - protein, 9 aa, Homo Sapiens
LAKVVLLCW

SEQ ID NO: 1059830 - protein, 9 aa, Homo Sapiens
LGYPKTKAF

SEQ ID NO: 1059831 - protein, 9 aa, Homo Sapiens
IDPRQKEEL

SEQ ID NO: 1059832 - protein, 9 aa, Homo Sapiens
TVFSGVFME

SEQ ID NO: 1059833 - protein, 9 aa, Homo Sapiens
DGKKHSITA

SEQ ID NO: 1059834 - protein, 9 aa, Homo Sapiens
LLHSPTFSW

SEQ ID NO: 1059835 - protein, 9 aa, Homo Sapiens
APNYSYAAF

SEQ ID NO: 1059836 - protein, 9 aa, Homo Sapiens
FQNLQILFF

SEQ ID NO: 1059837 - protein, 9 aa, Homo Sapiens
PFFSPPSPM

SEQ ID NO: 1059838 - protein, 9 aa, Homo Sapiens
FWFNPFSLS

SEQ ID NO: 1059839 - protein, 9 aa, Homo Sapiens
KAFRQLQVY

SEQ ID NO: 1059840 - protein, 9 aa, Homo Sapiens
FFPDESQRV

SEQ ID NO: 1059841 - protein, 9 aa, Homo Sapiens
PTREEEAVL

SEQ ID NO: 1059842 - protein, 9 aa, Homo Sapiens
SPFMKSLGN

SEQ ID NO: 1059843 - protein, 9 aa, Homo Sapiens
SVGFGNVSS

SEQ ID NO: 1059844 - protein, 9 aa, Homo Sapiens
CLAAGDILV

SEQ ID NO: 1059845 - protein, 9 aa, Homo Sapiens
TLPLLRQTT

SEQ ID NO: 1059846 - protein, 9 aa, Homo Sapiens
DRCQELGCY

SEQ ID NO: 1059847 - protein, 9 aa, Homo Sapiens
VSSNTNSEK

SEQ ID NO: 1059848 - protein, 9 aa, Homo Sapiens
RKMQAFFGL

SEQ ID NO: 1059849 - protein, 9 aa, Homo Sapiens
MSFDNNGTA

SEQ ID NO: 1059850 - protein, 9 aa, Homo Sapiens
HHPHFIYNS

SEQ ID NO: 1059851 - protein, 9 aa, Homo Sapiens
TMYVLYADR

SEQ ID NO: 1059852 - protein, 9 aa, Homo Sapiens
AIAFQPVET

SEQ ID NO: 1059853 - protein, 9 aa, Homo Sapiens
SRVILTSFD

SEQ ID NO: 1059854 - protein, 9 aa, Homo Sapiens
FLREQRAAH

SEQ ID NO: 1059855 - protein, 9 aa, Homo Sapiens
RELFPGSFR

SEQ ID NO: 1059856 - protein, 9 aa, Homo Sapiens
ASASLSLQR

SEQ ID NO: 1059857 - protein, 9 aa, Homo Sapiens
KEIMENPIV

SEQ ID NO: 1059858 - protein, 9 aa, Homo Sapiens
SDGCQDIST

SEQ ID NO: 1059859 - protein, 9 aa, Homo Sapiens
QEEEDKGLD

SEQ ID NO: 1059860 - protein, 9 aa, Homo Sapiens
GDTLFQCWL

SEQ ID NO: 1059861 - protein, 9 aa, Homo Sapiens
GNSDSREKP

SEQ ID NO: 1059862 - protein, 9 aa, Homo Sapiens
DSDSDPEKK

SEQ ID NO: 1059863 - protein, 9 aa, Homo Sapiens
RWILMLLLS

SEQ ID NO: 1059864 - protein, 9 aa, Homo Sapiens
QVEFVSTGF

SEQ ID NO: 1059865 - protein, 9 aa, Homo Sapiens
RLLWSQVLA

SEQ ID NO: 1059866 - protein, 9 aa, Homo Sapiens
SCSLLQLDQ

SEQ ID NO: 1059867 - protein, 9 aa, Homo Sapiens
QIESTLKEG

SEQ ID NO: 1059868 - protein, 9 aa, Homo Sapiens
KPKHKQTDY

SEQ ID NO: 1059869 - protein, 9 aa, Homo Sapiens
NFSNMWKKS

SEQ ID NO: 1059870 - protein, 9 aa, Homo Sapiens
HTLLLAQLF

SEQ ID NO: 1059871 - protein, 9 aa, Homo Sapiens
EAEEEAFRA

SEQ ID NO: 1059872 - protein, 9 aa, Homo Sapiens
KLTMLNRVV

SEQ ID NO: 1059873 - protein, 9 aa, Homo Sapiens
ANFVELGDF

SEQ ID NO: 1059874 - protein, 9 aa, Homo Sapiens
EEMPVGTKL

SEQ ID NO: 1059875 - protein, 9 aa, Homo Sapiens
LGLVEEFLL

SEQ ID NO: 1059876 - protein, 9 aa, Homo Sapiens
KKIYSRGEL

SEQ ID NO: 1059877 - protein, 9 aa, Homo Sapiens
IDTIFLLVT

SEQ ID NO: 1059878 - protein, 9 aa, Homo Sapiens
EKCCPNVCE

SEQ ID NO: 1059879 - protein, 9 aa, Homo Sapiens
LVVVVPPRS

SEQ ID NO: 1059880 - protein, 9 aa, Homo Sapiens
QYKHLDGFE

SEQ ID NO: 1059881 - protein, 9 aa, Homo Sapiens
LKKHVLQSS

SEQ ID NO: 1059882 - protein, 9 aa, Homo Sapiens
ISNVKTNVQ

SEQ ID NO: 1059883 - protein, 9 aa, Homo Sapiens
CMISFVPVA

SEQ ID NO: 1059884 - protein, 9 aa, Homo Sapiens
SLAPNCIVY

SEQ ID NO: 1059885 - protein, 9 aa, Homo Sapiens
NTSTAEEKL

SEQ ID NO: 1059886 - protein, 9 aa, Homo Sapiens
NNFYVFPGV

SEQ ID NO: 1059887 - protein, 9 aa, Homo Sapiens
ILGNSCDLE

SEQ ID NO: 1059888 - protein, 9 aa, Homo Sapiens
IKEKVMLCI

SEQ ID NO: 1059889 - protein, 9 aa, Homo Sapiens
YSGEKPYEC

SEQ ID NO: 1059890 - protein, 9 aa, Homo Sapiens
LLSGAIPGP

SEQ ID NO: 1059891 - protein, 9 aa, Homo Sapiens
VFASEEKQP

SEQ ID NO: 1059892 - protein, 9 aa, Homo Sapiens
KQYQCKVCP

SEQ ID NO: 1059893 - protein, 9 aa, Homo Sapiens
EKGQAKAVS

SEQ ID NO: 1059894 - protein, 9 aa, Homo Sapiens
WLPKYRVKK

SEQ ID NO: 1059895 - protein, 9 aa, Homo Sapiens
LYKWEVVEN

SEQ ID NO: 1059896 - protein, 9 aa, Homo Sapiens
PVACLKPAL

SEQ ID NO: 1059897 - protein, 9 aa, Homo Sapiens
EERRLWPGP

SEQ ID NO: 1059898 - protein, 9 aa, Homo Sapiens
HLGSFNSDL

SEQ ID NO: 1059899 - protein, 9 aa, Homo Sapiens
ESSEIFKFT

SEQ ID NO: 1059900 - protein, 9 aa, Homo Sapiens
LLFFREMNV

SEQ ID NO: 1059901 - protein, 9 aa, Homo Sapiens
CDDLIKEKK

SEQ ID NO: 1059902 - protein, 9 aa, Homo Sapiens
MEIFEEKKS

SEQ ID NO: 1059903 - protein, 9 aa, Homo Sapiens
EHWPNPETF

SEQ ID NO: 1059904 - protein, 9 aa, Homo Sapiens
KGYAGADCS

SEQ ID NO: 1059905 - protein, 9 aa, Homo Sapiens
LRKKIDMKT

SEQ ID NO: 1059906 - protein, 9 aa, Homo Sapiens
HLDLGGMPN

SEQ ID NO: 1059907 - protein, 9 aa, Homo Sapiens
KATLENKWP

SEQ ID NO: 1059908 - protein, 9 aa, Homo Sapiens
VSCLPSQGE

SEQ ID NO: 1059909 - protein, 9 aa, Homo Sapiens
SDIDDVSTP

SEQ ID NO: 1059910 - protein, 9 aa, Homo Sapiens
EEEAFRAQA

SEQ ID NO: 1059911 - protein, 9 aa, Homo Sapiens
SGIPADVWT

SEQ ID NO: 1059912 - protein, 9 aa, Homo Sapiens
PSALTSEAG

SEQ ID NO: 1059913 - protein, 9 aa, Homo Sapiens
GKDWCLRVE

SEQ ID NO: 1059914 - protein, 9 aa, Homo Sapiens
CCESLELKN

SEQ ID NO: 1059915 - protein, 9 aa, Homo Sapiens
TLLMSVCLG

SEQ ID NO: 1059916 - protein, 9 aa, Homo Sapiens
PHGLATSHP

SEQ ID NO: 1059917 - protein, 9 aa, Homo Sapiens
QGIMKTVRI

SEQ ID NO: 1059918 - protein, 9 aa, Homo Sapiens
QTKSYNDMQ

SEQ ID NO: 1059919 - protein, 9 aa, Homo Sapiens
TPSDLESSK

SEQ ID NO: 1059920 - protein, 9 aa, Homo Sapiens
HLLFSLTLV

SEQ ID NO: 1059921 - protein, 9 aa, Homo Sapiens
QQLFGRLSV

SEQ ID NO: 1059922 - protein, 9 aa, Homo Sapiens
KTVRYALCT

SEQ ID NO: 1059923 - protein, 9 aa, Homo Sapiens
GVSHDTDIL

SEQ ID NO: 1059924 - protein, 9 aa, Homo Sapiens
IPSESEARS

SEQ ID NO: 1059925 - protein, 9 aa, Homo Sapiens
LPPPPDLFP

SEQ ID NO: 1059926 - protein, 9 aa, Homo Sapiens
FVMKHHTLP

SEQ ID NO: 1059927 - protein, 9 aa, Homo Sapiens
KSPRRSSSN

SEQ ID NO: 1059928 - protein, 9 aa, Homo Sapiens
DSQKIDKFM

SEQ ID NO: 1059929 - protein, 9 aa, Homo Sapiens
RARFGMASG

SEQ ID NO: 1059930 - protein, 9 aa, Homo Sapiens
AGSTPLAED

SEQ ID NO: 1059931 - protein, 9 aa, Homo Sapiens
ADSKWNSSP

SEQ ID NO: 1059932 - protein, 9 aa, Homo Sapiens
GRNWDYLRP

SEQ ID NO: 1059933 - protein, 9 aa, Homo Sapiens
LLTLMALLY

SEQ ID NO: 1059934 - protein, 9 aa, Homo Sapiens
VKQEASFLV

SEQ ID NO: 1059935 - protein, 9 aa, Homo Sapiens
RGQFVMKHH

SEQ ID NO: 1059936 - protein, 9 aa, Homo Sapiens
ILENQFMNS

SEQ ID NO: 1059937 - protein, 9 aa, Homo Sapiens
DWDEGANGA

SEQ ID NO: 1059938 - protein, 9 aa, Homo Sapiens
KRGITEYNN

SEQ ID NO: 1059939 - protein, 9 aa, Homo Sapiens
VVSAHGLNL

SEQ ID NO: 1059940 - protein, 9 aa, Homo Sapiens
LQVDFHTEI

SEQ ID NO: 1059941 - protein, 9 aa, Homo Sapiens
PAFLVSSPC

SEQ ID NO: 1059942 - protein, 9 aa, Homo Sapiens
EPDILETNF

SEQ ID NO: 1059943 - protein, 9 aa, Homo Sapiens
GEVPKLPPP

SEQ ID NO: 1059944 - protein, 9 aa, Homo Sapiens
LEKARSPDY

SEQ ID NO: 1059945 - protein, 9 aa, Homo Sapiens
TVVFDSNDA

SEQ ID NO: 1059946 - protein, 9 aa, Homo Sapiens
DMLEPEQTF

SEQ ID NO: 1059947 - protein, 9 aa, Homo Sapiens
PTPSPGFSG

SEQ ID NO: 1059948 - protein, 9 aa, Homo Sapiens
SSEENEESR

SEQ ID NO: 1059949 - protein, 9 aa, Homo Sapiens
TSIFLASLW

SEQ ID NO: 1059950 - protein, 9 aa, Homo Sapiens
GRDSAQSSK

SEQ ID NO: 1059951 - protein, 9 aa, Homo Sapiens
RSHTGDTLF

SEQ ID NO: 1059952 - protein, 9 aa, Homo Sapiens
LLAVISDSY

SEQ ID NO: 1059953 - protein, 9 aa, Homo Sapiens
YELVCSAET

SEQ ID NO: 1059954 - protein, 9 aa, Homo Sapiens
FLETELKNP

SEQ ID NO: 1059955 - protein, 9 aa, Homo Sapiens
DPYVSIACC

SEQ ID NO: 1059956 - protein, 9 aa, Homo Sapiens
LSDTLAIKE

SEQ ID NO: 1059957 - protein, 9 aa, Homo Sapiens
CAPPQHYGE

SEQ ID NO: 1059958 - protein, 9 aa, Homo Sapiens
STFPLLPHY

SEQ ID NO: 1059959 - protein, 9 aa, Homo Sapiens
HNLGLLTKS

SEQ ID NO: 1059960 - protein, 9 aa, Homo Sapiens
PVSEGTQHN

SEQ ID NO: 1059961 - protein, 9 aa, Homo Sapiens
WKVEQKHEA

SEQ ID NO: 1059962 - protein, 9 aa, Homo Sapiens
PNSRPGKCL

SEQ ID NO: 1059963 - protein, 9 aa, Homo Sapiens
HRGGTSHLD

SEQ ID NO: 1059964 - protein, 9 aa, Homo Sapiens
VSEVNIYNI

SEQ ID NO: 1059965 - protein, 9 aa, Homo Sapiens
IVKGSCICN

SEQ ID NO: 1059966 - protein, 9 aa, Homo Sapiens
TRPPPSGFQ

SEQ ID NO: 1059967 - protein, 9 aa, Homo Sapiens
DKRQNSLRF

SEQ ID NO: 1059968 - protein, 9 aa, Homo Sapiens
SLISGESKD

SEQ ID NO: 1059969 - protein, 9 aa, Homo Sapiens
SLTEAVLLK

SEQ ID NO: 1059970 - protein, 9 aa, Homo Sapiens
CEQVWKRDQ

SEQ ID NO: 1059971 - protein, 9 aa, Homo Sapiens
APERDDPSA

SEQ ID NO: 1059972 - protein, 9 aa, Homo Sapiens
PTTPGELPW

SEQ ID NO: 1059973 - protein, 9 aa, Homo Sapiens
VVDHPKKRF

SEQ ID NO: 1059974 - protein, 9 aa, Homo Sapiens
MQSSSTPIK

SEQ ID NO: 1059975 - protein, 9 aa, Homo Sapiens
HPHHQQPPP

SEQ ID NO: 1059976 - protein, 9 aa, Homo Sapiens
WLCFTMEVA

SEQ ID NO: 1059977 - protein, 9 aa, Homo Sapiens
KPRRKPELV

SEQ ID NO: 1059978 - protein, 9 aa, Homo Sapiens
SIQRAVQVY

SEQ ID NO: 1059979 - protein, 9 aa, Homo Sapiens
PPEVFSAFV

SEQ ID NO: 1059980 - protein, 9 aa, Homo Sapiens
ALSGTQVHQ

SEQ ID NO: 1059981 - protein, 9 aa, Homo Sapiens
VVLNTLAEL

SEQ ID NO: 1059982 - protein, 9 aa, Homo Sapiens
PSELPGGDD

SEQ ID NO: 1059983 - protein, 9 aa, Homo Sapiens
RKRTYSLIT

SEQ ID NO: 1059984 - protein, 9 aa, Homo Sapiens
IIRGDNEEW

SEQ ID NO: 1059985 - protein, 9 aa, Homo Sapiens
APSIKSKKK

SEQ ID NO: 1059986 - protein, 9 aa, Homo Sapiens
EKNSQLWAD

SEQ ID NO: 1059987 - protein, 9 aa, Homo Sapiens
LRTEFYQHQ

SEQ ID NO: 1059988 - protein, 9 aa, Homo Sapiens
FFFAVGTLL

SEQ ID NO: 1059989 - protein, 9 aa, Homo Sapiens
SSSADSEKG

SEQ ID NO: 1059990 - protein, 9 aa, Homo Sapiens
RRQRVCFGE

SEQ ID NO: 1059991 - protein, 9 aa, Homo Sapiens
WKLVRTALM

SEQ ID NO: 1059992 - protein, 9 aa, Homo Sapiens
CEKAYTKRS

SEQ ID NO: 1059993 - protein, 9 aa, Homo Sapiens
LDYLVHMQR

SEQ ID NO: 1059994 - protein, 9 aa, Homo Sapiens
ENSRKMTET

SEQ ID NO: 1059995 - protein, 9 aa, Homo Sapiens
GTNKRASQA

SEQ ID NO: 1059996 - protein, 9 aa, Homo Sapiens
LAWLGMESD

SEQ ID NO: 1059997 - protein, 9 aa, Homo Sapiens
SFCSSHKIQ

SEQ ID NO: 1059998 - protein, 9 aa, Homo Sapiens
QICGAAPPY

SEQ ID NO: 1059999 - protein, 9 aa, Homo Sapiens
LSPEVPGQK

SEQ ID NO: 1060000 - protein, 9 aa, Homo Sapiens
YLQQKQANR

SEQ ID NO: 1060001 - protein, 9 aa, Homo Sapiens
KFDIYTLFF

SEQ ID NO: 1060002 - protein, 9 aa, Homo Sapiens
VKLNDTGSY

SEQ ID NO: 1060003 - protein, 9 aa, Homo Sapiens
IFLKDDYFV

SEQ ID NO: 1060004 - protein, 9 aa, Homo Sapiens
LGVKNLRVV

SEQ ID NO: 1060005 - protein, 9 aa, Homo Sapiens
IGAALLILS

SEQ ID NO: 1060006 - protein, 9 aa, Homo Sapiens
VVESRLRKP

SEQ ID NO: 1060007 - protein, 9 aa, Homo Sapiens
KVLFRFCVV

SEQ ID NO: 1060008 - protein, 9 aa, Homo Sapiens
YYLITTYLK

SEQ ID NO: 1060009 - protein, 9 aa, Homo Sapiens
LEASSEPKP

SEQ ID NO: 1060010 - protein, 9 aa, Homo Sapiens
IVDGDDLGI

SEQ ID NO: 1060011 - protein, 9 aa, Homo Sapiens
GSCDPRKAL

SEQ ID NO: 1060012 - protein, 9 aa, Homo Sapiens
GVTGYFTFI

SEQ ID NO: 1060013 - protein, 9 aa, Homo Sapiens
AKLNPGPLY

SEQ ID NO: 1060014 - protein, 9 aa, Homo Sapiens
IDISIILAE

SEQ ID NO: 1060015 - protein, 9 aa, Homo Sapiens
SPGVRPSNS

SEQ ID NO: 1060016 - protein, 9 aa, Homo Sapiens
SILAPETAG

SEQ ID NO: 1060017 - protein, 9 aa, Homo Sapiens
ASLYSQQLK

SEQ ID NO: 1060018 - protein, 9 aa, Homo Sapiens
FTRTLKLCN

SEQ ID NO: 1060019 - protein, 9 aa, Homo Sapiens
ASPPDDVDY

SEQ ID NO: 1060020 - protein, 9 aa, Homo Sapiens
LSTSTLREA

SEQ ID NO: 1060021 - protein, 9 aa, Homo Sapiens
EQLSDALLK

SEQ ID NO: 1060022 - protein, 9 aa, Homo Sapiens
YAHRQSYGP

SEQ ID NO: 1060023 - protein, 9 aa, Homo Sapiens
ARLSPEVPG

SEQ ID NO: 1060024 - protein, 9 aa, Homo Sapiens
KQSSGSRTS

SEQ ID NO: 1060025 - protein, 9 aa, Homo Sapiens
TTPAPSTTT

SEQ ID NO: 1060026 - protein, 9 aa, Homo Sapiens
SGLAIIRSS

SEQ ID NO: 1060027 - protein, 9 aa, Homo Sapiens
SAAEAKAAE

SEQ ID NO: 1060028 - protein, 9 aa, Homo Sapiens
YTIINGNPR

SEQ ID NO: 1060029 - protein, 9 aa, Homo Sapiens
YKAPRVNGA

SEQ ID NO: 1060030 - protein, 9 aa, Homo Sapiens
VHFCYNVRN

SEQ ID NO: 1060031 - protein, 9 aa, Homo Sapiens
VIEFSGDIF

SEQ ID NO: 1060032 - protein, 9 aa, Homo Sapiens
KIRDHCAER

SEQ ID NO: 1060033 - protein, 9 aa, Homo Sapiens
LPGSSGGGP

SEQ ID NO: 1060034 - protein, 9 aa, Homo Sapiens
FYKSLPLAM

SEQ ID NO: 1060035 - protein, 9 aa, Homo Sapiens
PPAPPARLP

SEQ ID NO: 1060036 - protein, 9 aa, Homo Sapiens
ALEFPTCCL

SEQ ID NO: 1060037 - protein, 9 aa, Homo Sapiens
CSLNFPKKK

SEQ ID NO: 1060038 - protein, 9 aa, Homo Sapiens
TPPPPTVGL

SEQ ID NO: 1060039 - protein, 9 aa, Homo Sapiens
EFIRGHTLI

SEQ ID NO: 1060040 - protein, 9 aa, Homo Sapiens
ARPHRCLRG

SEQ ID NO: 1060041 - protein, 9 aa, Homo Sapiens
SQRAIFFAG

SEQ ID NO: 1060042 - protein, 9 aa, Homo Sapiens
IMASVWKCL

SEQ ID NO: 1060043 - protein, 9 aa, Homo Sapiens
FYDVLSMLS

SEQ ID NO: 1060044 - protein, 9 aa, Homo Sapiens
LSELYLQCN

SEQ ID NO: 1060045 - protein, 9 aa, Homo Sapiens
VLATKAPRL

SEQ ID NO: 1060046 - protein, 9 aa, Homo Sapiens
FRGVGDQRR

SEQ ID NO: 1060047 - protein, 9 aa, Homo Sapiens
IVEKITEST

SEQ ID NO: 1060048 - protein, 9 aa, Homo Sapiens
TDMSSDFRT

SEQ ID NO: 1060049 - protein, 9 aa, Homo Sapiens
TLLANLIPP

SEQ ID NO: 1060050 - protein, 9 aa, Homo Sapiens
QPRSSRWPV

SEQ ID NO: 1060051 - protein, 9 aa, Homo Sapiens
LLKLHLDED

SEQ ID NO: 1060052 - protein, 9 aa, Homo Sapiens
DPSASAAWS

SEQ ID NO: 1060053 - protein, 9 aa, Homo Sapiens
ISVLEPPQK

SEQ ID NO: 1060054 - protein, 9 aa, Homo Sapiens
VEKTVSSIL

SEQ ID NO: 1060055 - protein, 9 aa, Homo Sapiens
AQLFIKHKR

SEQ ID NO: 1060056 - protein, 9 aa, Homo Sapiens
QLFIKHKRK

SEQ ID NO: 1060057 - protein, 9 aa, Homo Sapiens
GFNFGSKED

SEQ ID NO: 1060058 - protein, 9 aa, Homo Sapiens
LEGFASLLT

SEQ ID NO: 1060059 - protein, 9 aa, Homo Sapiens
EICISVSWI

SEQ ID NO: 1060060 - protein, 9 aa, Homo Sapiens
QECAMVNSI

SEQ ID NO: 1060061 - protein, 9 aa, Homo Sapiens
TVLVTEEHV

SEQ ID NO: 1060062 - protein, 9 aa, Homo Sapiens
AIFAAESQA

SEQ ID NO: 1060063 - protein, 9 aa, Homo Sapiens
WYCKAFDVE

SEQ ID NO: 1060064 - protein, 9 aa, Homo Sapiens
VDLFSDDDL

SEQ ID NO: 1060065 - protein, 9 aa, Homo Sapiens
LAQSHTRKI

SEQ ID NO: 1060066 - protein, 9 aa, Homo Sapiens
NKYGDLYRA

SEQ ID NO: 1060067 - protein, 9 aa, Homo Sapiens
IKEKVIDVD

SEQ ID NO: 1060068 - protein, 9 aa, Homo Sapiens
HIVKNGGTS

SEQ ID NO: 1060069 - protein, 9 aa, Homo Sapiens
RQRTPGEKN

SEQ ID NO: 1060070 - protein, 9 aa, Homo Sapiens
GGPPEENGK

SEQ ID NO: 1060071 - protein, 9 aa, Homo Sapiens
YVLLGEASY

SEQ ID NO: 1060072 - protein, 9 aa, Homo Sapiens
QLYGRLLWS

SEQ ID NO: 1060073 - protein, 9 aa, Homo Sapiens
QTEEMDFLL

SEQ ID NO: 1060074 - protein, 9 aa, Homo Sapiens
NITVNNSGF

SEQ ID NO: 1060075 - protein, 9 aa, Homo Sapiens
GEKILEPFH

SEQ ID NO: 1060076 - protein, 9 aa, Homo Sapiens
PSSVTNTLI

SEQ ID NO: 1060077 - protein, 9 aa, Homo Sapiens
WFTYNNLCV

SEQ ID NO: 1060078 - protein, 9 aa, Homo Sapiens
RSPGIFTDI

SEQ ID NO: 1060079 - protein, 9 aa, Homo Sapiens
IQVKENGYV

SEQ ID NO: 1060080 - protein, 9 aa, Homo Sapiens
VYQRIHTGE

SEQ ID NO: 1060081 - protein, 9 aa, Homo Sapiens
EPLHKKEAK

SEQ ID NO: 1060082 - protein, 9 aa, Homo Sapiens
STRNLYATV

SEQ ID NO: 1060083 - protein, 9 aa, Homo Sapiens
ENQPVKSSK

SEQ ID NO: 1060084 - protein, 9 aa, Homo Sapiens
VADDTPPSE

SEQ ID NO: 1060085 - protein, 9 aa, Homo Sapiens
QEKRYEVPV

SEQ ID NO: 1060086 - protein, 9 aa, Homo Sapiens
ALGNIASKR

SEQ ID NO: 1060087 - protein, 9 aa, Homo Sapiens
KHRICVCVR

SEQ ID NO: 1060088 - protein, 9 aa, Homo Sapiens
RQTARRTPP

SEQ ID NO: 1060089 - protein, 9 aa, Homo Sapiens
ITISQNNLT

SEQ ID NO: 1060090 - protein, 9 aa, Homo Sapiens
ASSSQNGHK

SEQ ID NO: 1060091 - protein, 9 aa, Homo Sapiens
GQVKEEPLN

SEQ ID NO: 1060092 - protein, 9 aa, Homo Sapiens
MRKKEEEAK

SEQ ID NO: 1060093 - protein, 9 aa, Homo Sapiens
SYEITLLSP

SEQ ID NO: 1060094 - protein, 9 aa, Homo Sapiens
GLEHLLCPS

SEQ ID NO: 1060095 - protein, 9 aa, Homo Sapiens
TAPLTRVPQ

SEQ ID NO: 1060096 - protein, 9 aa, Homo Sapiens
ARDHGAAHE

SEQ ID NO: 1060097 - protein, 9 aa, Homo Sapiens
DEQPGPQGP

SEQ ID NO: 1060098 - protein, 9 aa, Homo Sapiens
LFFSETCYT

SEQ ID NO: 1060099 - protein, 9 aa, Homo Sapiens
DLIRNMFLE

SEQ ID NO: 1060100 - protein, 9 aa, Homo Sapiens
CMLGAQGRA

SEQ ID NO: 1060101 - protein, 9 aa, Homo Sapiens
CFFPEKDHS

SEQ ID NO: 1060102 - protein, 9 aa, Homo Sapiens
FENFPDYCI

SEQ ID NO: 1060103 - protein, 9 aa, Homo Sapiens
QTVMCSCLP

SEQ ID NO: 1060104 - protein, 9 aa, Homo Sapiens
LGYVISLAG

SEQ ID NO: 1060105 - protein, 9 aa, Homo Sapiens
HLGIKKYRY

SEQ ID NO: 1060106 - protein, 9 aa, Homo Sapiens
NLLCVKLHN

SEQ ID NO: 1060107 - protein, 9 aa, Homo Sapiens
SPTIKEKVM

SEQ ID NO: 1060108 - protein, 9 aa, Homo Sapiens
AGALLDKDV

SEQ ID NO: 1060109 - protein, 9 aa, Homo Sapiens
RITHQDEEV

SEQ ID NO: 1060110 - protein, 9 aa, Homo Sapiens
WDRKMYYSQ

SEQ ID NO: 1060111 - protein, 9 aa, Homo Sapiens
AAFSYRHYC

SEQ ID NO: 1060112 - protein, 9 aa, Homo Sapiens
KKIDTVLPN

SEQ ID NO: 1060113 - protein, 9 aa, Homo Sapiens
CASGYWGLP

SEQ ID NO: 1060114 - protein, 9 aa, Homo Sapiens
NKIFFKEQV

SEQ ID NO: 1060115 - protein, 9 aa, Homo Sapiens
PTSGCLGLV

SEQ ID NO: 1060116 - protein, 9 aa, Homo Sapiens
IVIVEKITE

SEQ ID NO: 1060117 - protein, 9 aa, Homo Sapiens
KERLYLLRK

SEQ ID NO: 1060118 - protein, 9 aa, Homo Sapiens
VRGNNTHNN

SEQ ID NO: 1060119 - protein, 9 aa, Homo Sapiens
RQQSLALGI

SEQ ID NO: 1060120 - protein, 9 aa, Homo Sapiens
CAAWEEKEL

SEQ ID NO: 1060121 - protein, 9 aa, Homo Sapiens
DCLIQFISK

SEQ ID NO: 1060122 - protein, 9 aa, Homo Sapiens
CPNSSHLFF

SEQ ID NO: 1060123 - protein, 9 aa, Homo Sapiens
EKVIDVDHG

SEQ ID NO: 1060124 - protein, 9 aa, Homo Sapiens
NNTRELPIP

SEQ ID NO: 1060125 - protein, 9 aa, Homo Sapiens
RSLINKFDL

SEQ ID NO: 1060126 - protein, 9 aa, Homo Sapiens
KAFVRNLYL

SEQ ID NO: 1060127 - protein, 9 aa, Homo Sapiens
KYKSELTGS

SEQ ID NO: 1060128 - protein, 9 aa, Homo Sapiens
AIYVNRTYD

SEQ ID NO: 1060129 - protein, 9 aa, Homo Sapiens
IVFIASIAV

SEQ ID NO: 1060130 - protein, 9 aa, Homo Sapiens
FHEIPTPSV

SEQ ID NO: 1060131 - protein, 9 aa, Homo Sapiens
LRRAPKTLS

SEQ ID NO: 1060132 - protein, 9 aa, Homo Sapiens
GVYKGLHLN

SEQ ID NO: 1060133 - protein, 9 aa, Homo Sapiens
LTWRSEGKK

SEQ ID NO: 1060134 - protein, 9 aa, Homo Sapiens
RSRISVLLS

SEQ ID NO: 1060135 - protein, 9 aa, Homo Sapiens
ETLPKEVGH

SEQ ID NO: 1060136 - protein, 9 aa, Homo Sapiens
EDISMAHHF

SEQ ID NO: 1060137 - protein, 9 aa, Homo Sapiens
TIRTKPSTR

SEQ ID NO: 1060138 - protein, 9 aa, Homo Sapiens
DARRKFKKM

SEQ ID NO: 1060139 - protein, 9 aa, Homo Sapiens
GSEEEGSNK

SEQ ID NO: 1060140 - protein, 9 aa, Homo Sapiens
FSNQTYSTI

SEQ ID NO: 1060141 - protein, 9 aa, Homo Sapiens
RDHGAAHEG

SEQ ID NO: 1060142 - protein, 9 aa, Homo Sapiens
GLQSDQNTI

SEQ ID NO: 1060143 - protein, 9 aa, Homo Sapiens
VLVMNENDN

SEQ ID NO: 1060144 - protein, 9 aa, Homo Sapiens
GPSSCMQLG

SEQ ID NO: 1060145 - protein, 9 aa, Homo Sapiens
YLPPSGVKR

SEQ ID NO: 1060146 - protein, 9 aa, Homo Sapiens
ISPTTPGEL

SEQ ID NO: 1060147 - protein, 9 aa, Homo Sapiens
SYKTVDQWK

SEQ ID NO: 1060148 - protein, 9 aa, Homo Sapiens
GKNSKNFER

SEQ ID NO: 1060149 - protein, 9 aa, Homo Sapiens
AAMLDRESL

SEQ ID NO: 1060150 - protein, 9 aa, Homo Sapiens
REGMYIAEK

SEQ ID NO: 1060151 - protein, 9 aa, Homo Sapiens
SAASGASAK

SEQ ID NO: 1060152 - protein, 9 aa, Homo Sapiens
PKLQMRVLA

SEQ ID NO: 1060153 - protein, 9 aa, Homo Sapiens
QPPAEIPSY

SEQ ID NO: 1060154 - protein, 9 aa, Homo Sapiens
PHYRLEDIS

SEQ ID NO: 1060155 - protein, 9 aa, Homo Sapiens
EISTRACEG

SEQ ID NO: 1060156 - protein, 9 aa, Homo Sapiens
PRTTMILFK

SEQ ID NO: 1060157 - protein, 9 aa, Homo Sapiens
TRTLLFALM

SEQ ID NO: 1060158 - protein, 9 aa, Homo Sapiens
RDAASQESK

SEQ ID NO: 1060159 - protein, 9 aa, Homo Sapiens
RIKSQERKT

SEQ ID NO: 1060160 - protein, 9 aa, Homo Sapiens
PERVHRVFF

SEQ ID NO: 1060161 - protein, 9 aa, Homo Sapiens
EMKISFFER

SEQ ID NO: 1060162 - protein, 9 aa, Homo Sapiens
FYAKTFKEK

SEQ ID NO: 1060163 - protein, 9 aa, Homo Sapiens
HPIDGPPGG

SEQ ID NO: 1060164 - protein, 9 aa, Homo Sapiens
KSGFNSKSE

SEQ ID NO: 1060165 - protein, 9 aa, Homo Sapiens
PIIIITTKV

SEQ ID NO: 1060166 - protein, 9 aa, Homo Sapiens
QKFISEITI

SEQ ID NO: 1060167 - protein, 9 aa, Homo Sapiens
ITYNKGRNW

SEQ ID NO: 1060168 - protein, 9 aa, Homo Sapiens
ALLRPVFVL

SEQ ID NO: 1060169 - protein, 9 aa, Homo Sapiens
ETKPLFQTS

SEQ ID NO: 1060170 - protein, 9 aa, Homo Sapiens
FPGSFRGCG

SEQ ID NO: 1060171 - protein, 9 aa, Homo Sapiens
ESMTVVFDS

SEQ ID NO: 1060172 - protein, 9 aa, Homo Sapiens
VENQYQGNP

SEQ ID NO: 1060173 - protein, 9 aa, Homo Sapiens
GFGNVSSNT

SEQ ID NO: 1060174 - protein, 9 aa, Homo Sapiens
YSILEELEK

SEQ ID NO: 1060175 - protein, 9 aa, Homo Sapiens
SSCKAEEGL

SEQ ID NO: 1060176 - protein, 9 aa, Homo Sapiens
ARETDKLWR

SEQ ID NO: 1060177 - protein, 9 aa, Homo Sapiens
PLRYTIIIS

SEQ ID NO: 1060178 - protein, 9 aa, Homo Sapiens
VLSKDKCVP

SEQ ID NO: 1060179 - protein, 9 aa, Homo Sapiens
RSTPDSVCL

SEQ ID NO: 1060180 - protein, 9 aa, Homo Sapiens
ILLLPASTH

SEQ ID NO: 1060181 - protein, 9 aa, Homo Sapiens
RQAEIENSL

SEQ ID NO: 1060182 - protein, 9 aa, Homo Sapiens
EFPTCCLLW

SEQ ID NO: 1060183 - protein, 9 aa, Homo Sapiens
RFCTKNREW

SEQ ID NO: 1060184 - protein, 9 aa, Homo Sapiens
YLLLHASRK

SEQ ID NO: 1060185 - protein, 9 aa, Homo Sapiens
AFQPVETGG

SEQ ID NO: 1060186 - protein, 9 aa, Homo Sapiens
ILVVKIQKN

SEQ ID NO: 1060187 - protein, 9 aa, Homo Sapiens
KKTFQIGES

SEQ ID NO: 1060188 - protein, 9 aa, Homo Sapiens
DDPCADNLL

SEQ ID NO: 1060189 - protein, 9 aa, Homo Sapiens
YLSQLDGEA

SEQ ID NO: 1060190 - protein, 9 aa, Homo Sapiens
TARLRDKAN

SEQ ID NO: 1060191 - protein, 9 aa, Homo Sapiens
SHHRFQRRP

SEQ ID NO: 1060192 - protein, 9 aa, Homo Sapiens
QLPKEELKI

SEQ ID NO: 1060193 - protein, 9 aa, Homo Sapiens
EGLVGVQGS

SEQ ID NO: 1060194 - protein, 9 aa, Homo Sapiens
KNPLGTQDN

SEQ ID NO: 1060195 - protein, 9 aa, Homo Sapiens
RVSFSTADP

SEQ ID NO: 1060196 - protein, 9 aa, Homo Sapiens
SDLISTNAE

SEQ ID NO: 1060197 - protein, 9 aa, Homo Sapiens
PYNFYDFQF

SEQ ID NO: 1060198 - protein, 9 aa, Homo Sapiens
TKMVGSNQR

SEQ ID NO: 1060199 - protein, 9 aa, Homo Sapiens
YFLDQFYMN

SEQ ID NO: 1060200 - protein, 9 aa, Homo Sapiens
NIVTEDDFG

SEQ ID NO: 1060201 - protein, 9 aa, Homo Sapiens
GNFEEAFDH

SEQ ID NO: 1060202 - protein, 9 aa, Homo Sapiens
CSRTSILNC

SEQ ID NO: 1060203 - protein, 9 aa, Homo Sapiens
KENMPSYFK

SEQ ID NO: 1060204 - protein, 9 aa, Homo Sapiens
AAQIRYSIL

SEQ ID NO: 1060205 - protein, 9 aa, Homo Sapiens
IFFLHLFTE

SEQ ID NO: 1060206 - protein, 9 aa, Homo Sapiens
LKYLWLNFN

SEQ ID NO: 1060207 - protein, 9 aa, Homo Sapiens
KKKQTTKKL

SEQ ID NO: 1060208 - protein, 9 aa, Homo Sapiens
SKLFTHKRT

SEQ ID NO: 1060209 - protein, 9 aa, Homo Sapiens
SAAHFFSHR

SEQ ID NO: 1060210 - protein, 9 aa, Homo Sapiens
VIIYKVFCH

SEQ ID NO: 1060211 - protein, 9 aa, Homo Sapiens
ETHILCQVA

SEQ ID NO: 1060212 - protein, 9 aa, Homo Sapiens
DQIVMIIDE

SEQ ID NO: 1060213 - protein, 9 aa, Homo Sapiens
KYLRKPLIR

SEQ ID NO: 1060214 - protein, 9 aa, Homo Sapiens
LTDVWTYSN

SEQ ID NO: 1060215 - protein, 9 aa, Homo Sapiens
GGRTMAITS

SEQ ID NO: 1060216 - protein, 9 aa, Homo Sapiens
SNPAVSSLS

SEQ ID NO: 1060217 - protein, 9 aa, Homo Sapiens
EDGCGFCYK

SEQ ID NO: 1060218 - protein, 9 aa, Homo Sapiens
SALHLSVPK

SEQ ID NO: 1060219 - protein, 9 aa, Homo Sapiens
FSSHAQATK

SEQ ID NO: 1060220 - protein, 9 aa, Homo Sapiens
TGICPYKCN

SEQ ID NO: 1060221 - protein, 9 aa, Homo Sapiens
FCDISLLLN

SEQ ID NO: 1060222 - protein, 9 aa, Homo Sapiens
IQAVEIKVE

SEQ ID NO: 1060223 - protein, 9 aa, Homo Sapiens
KTVRILLYE

SEQ ID NO: 1060224 - protein, 9 aa, Homo Sapiens
MGFINCEAN

SEQ ID NO: 1060225 - protein, 9 aa, Homo Sapiens
QHYGEPAEN

SEQ ID NO: 1060226 - protein, 9 aa, Homo Sapiens
ASGCDGLEI

SEQ ID NO: 1060227 - protein, 9 aa, Homo Sapiens
ESYSCFFRE

SEQ ID NO: 1060228 - protein, 9 aa, Homo Sapiens
SNPFLVLSI

SEQ ID NO: 1060229 - protein, 9 aa, Homo Sapiens
PQEKKAKIA

SEQ ID NO: 1060230 - protein, 9 aa, Homo Sapiens
ILAPETAGE

SEQ ID NO: 1060231 - protein, 9 aa, Homo Sapiens
AEICARNHM

SEQ ID NO: 1060232 - protein, 9 aa, Homo Sapiens
ENDEHEAGG

SEQ ID NO: 1060233 - protein, 9 aa, Homo Sapiens
RVLITKTLE

SEQ ID NO: 1060234 - protein, 9 aa, Homo Sapiens
ATASASAFT

SEQ ID NO: 1060235 - protein, 9 aa, Homo Sapiens
SGYISSSPT

SEQ ID NO: 1060236 - protein, 9 aa, Homo Sapiens
MGQAEIFYA

SEQ ID NO: 1060237 - protein, 9 aa, Homo Sapiens
QVDGNKLLA

SEQ ID NO: 1060238 - protein, 9 aa, Homo Sapiens
SESSDIDDV

SEQ ID NO: 1060239 - protein, 9 aa, Homo Sapiens
LDWDAFPGN

SEQ ID NO: 1060240 - protein, 9 aa, Homo Sapiens
TISCPERLR

SEQ ID NO: 1060241 - protein, 9 aa, Homo Sapiens
PIWYFTMQV

SEQ ID NO: 1060242 - protein, 9 aa, Homo Sapiens
FCHTAGLKP

SEQ ID NO: 1060243 - protein, 9 aa, Homo Sapiens
QEPADRRRS

SEQ ID NO: 1060244 - protein, 9 aa, Homo Sapiens
SDSYLHTPM

SEQ ID NO: 1060245 - protein, 9 aa, Homo Sapiens
CQSLGTGIM

SEQ ID NO: 1060246 - protein, 9 aa, Homo Sapiens
YAGEKILEP

SEQ ID NO: 1060247 - protein, 9 aa, Homo Sapiens
KIMAYLQQK

SEQ ID NO: 1060248 - protein, 9 aa, Homo Sapiens
LRMVDGLLL

SEQ ID NO: 1060249 - protein, 9 aa, Homo Sapiens
QDVLRTCVK

SEQ ID NO: 1060250 - protein, 9 aa, Homo Sapiens
EERIENIYF

SEQ ID NO: 1060251 - protein, 9 aa, Homo Sapiens
LRQAEIENS

SEQ ID NO: 1060252 - protein, 9 aa, Homo Sapiens
ILENMWAID

SEQ ID NO: 1060253 - protein, 9 aa, Homo Sapiens
ILHETLPKE

SEQ ID NO: 1060254 - protein, 9 aa, Homo Sapiens
TPDKDDHLL

SEQ ID NO: 1060255 - protein, 9 aa, Homo Sapiens
ARNIEDDLK

SEQ ID NO: 1060256 - protein, 9 aa, Homo Sapiens
PGRLCAAAL

SEQ ID NO: 1060257 - protein, 9 aa, Homo Sapiens
EEPGPAGSD

SEQ ID NO: 1060258 - protein, 9 aa, Homo Sapiens
SGMALSQGH

SEQ ID NO: 1060259 - protein, 9 aa, Homo Sapiens
NAFVTTHMC

SEQ ID NO: 1060260 - protein, 9 aa, Homo Sapiens
VKPDIPELE

SEQ ID NO: 1060261 - protein, 9 aa, Homo Sapiens
EAMETCKDA

SEQ ID NO: 1060262 - protein, 9 aa, Homo Sapiens
EAIQVQREE

SEQ ID NO: 1060263 - protein, 9 aa, Homo Sapiens
DEAKSLCKM

SEQ ID NO: 1060264 - protein, 9 aa, Homo Sapiens
MDTFEGRRN

SEQ ID NO: 1060265 - protein, 9 aa, Homo Sapiens
LTPLNERED

SEQ ID NO: 1060266 - protein, 9 aa, Homo Sapiens
DMIKEALEK

SEQ ID NO: 1060267 - protein, 9 aa, Homo Sapiens
GGHLGSFNS

SEQ ID NO: 1060268 - protein, 9 aa, Homo Sapiens
TRKRHRRCK

SEQ ID NO: 1060269 - protein, 9 aa, Homo Sapiens
TGDYCVQKG

SEQ ID NO: 1060270 - protein, 9 aa, Homo Sapiens
EDRPGEGGG

SEQ ID NO: 1060271 - protein, 9 aa, Homo Sapiens
DRPPHIIYV

SEQ ID NO: 1060272 - protein, 9 aa, Homo Sapiens
AYNAIFFTW

SEQ ID NO: 1060273 - protein, 9 aa, Homo Sapiens
FLSIPASLN

SEQ ID NO: 1060274 - protein, 9 aa, Homo Sapiens
PPSALTSEA

SEQ ID NO: 1060275 - protein, 9 aa, Homo Sapiens
AILPTNAMG

SEQ ID NO: 1060276 - protein, 9 aa, Homo Sapiens
FPVVCTVEQ

SEQ ID NO: 1060277 - protein, 9 aa, Homo Sapiens
QVFKSLEES

SEQ ID NO: 1060278 - protein, 9 aa, Homo Sapiens
FVWMKRMRQ

SEQ ID NO: 1060279 - protein, 9 aa, Homo Sapiens
LMSLWNVLG

SEQ ID NO: 1060280 - protein, 9 aa, Homo Sapiens
DTLVYRIIP

SEQ ID NO: 1060281 - protein, 9 aa, Homo Sapiens
SHDSLPCLA

SEQ ID NO: 1060282 - protein, 9 aa, Homo Sapiens
TTQINFWKP

SEQ ID NO: 1060283 - protein, 9 aa, Homo Sapiens
GNLLSGAIP

SEQ ID NO: 1060284 - protein, 9 aa, Homo Sapiens
HQRGAMGKT

SEQ ID NO: 1060285 - protein, 9 aa, Homo Sapiens
ALEPRRGFS

SEQ ID NO: 1060286 - protein, 9 aa, Homo Sapiens
LRTLYNAEL

SEQ ID NO: 1060287 - protein, 9 aa, Homo Sapiens
VSSATLWNR

SEQ ID NO: 1060288 - protein, 9 aa, Homo Sapiens
SQGMKSTYL

SEQ ID NO: 1060289 - protein, 9 aa, Homo Sapiens
YVLSEEKKQ

SEQ ID NO: 1060290 - protein, 9 aa, Homo Sapiens
LQLIISYGY

SEQ ID NO: 1060291 - protein, 9 aa, Homo Sapiens
GPGETEEHF

SEQ ID NO: 1060292 - protein, 9 aa, Homo Sapiens
TPSSAPGVN

SEQ ID NO: 1060293 - protein, 9 aa, Homo Sapiens
EIKGRNLDS

SEQ ID NO: 1060294 - protein, 9 aa, Homo Sapiens
TQHITWNGL

SEQ ID NO: 1060295 - protein, 9 aa, Homo Sapiens
VPGIGKELS

SEQ ID NO: 1060296 - protein, 9 aa, Homo Sapiens
HSSAFYFTE

SEQ ID NO: 1060297 - protein, 9 aa, Homo Sapiens
ESPENRKST

SEQ ID NO: 1060298 - protein, 9 aa, Homo Sapiens
SQESGLEQS

SEQ ID NO: 1060299 - protein, 9 aa, Homo Sapiens
WLVVQVAKA

SEQ ID NO: 1060300 - protein, 9 aa, Homo Sapiens
SVNFTPQND

SEQ ID NO: 1060301 - protein, 9 aa, Homo Sapiens
ILLTLMALL

SEQ ID NO: 1060302 - protein, 9 aa, Homo Sapiens
YEDTMFTMV

SEQ ID NO: 1060303 - protein, 9 aa, Homo Sapiens
TVLMSLWNV

SEQ ID NO: 1060304 - protein, 9 aa, Homo Sapiens
SKDTTPAPS

SEQ ID NO: 1060305 - protein, 9 aa, Homo Sapiens
TGPRNVVYS

SEQ ID NO: 1060306 - protein, 9 aa, Homo Sapiens
PAEICARNH

SEQ ID NO: 1060307 - protein, 9 aa, Homo Sapiens
RHCVCISFG

SEQ ID NO: 1060308 - protein, 9 aa, Homo Sapiens
DRFRFAILY

SEQ ID NO: 1060309 - protein, 9 aa, Homo Sapiens
CVNHRQQSL

SEQ ID NO: 1060310 - protein, 9 aa, Homo Sapiens
DAGACKVNP

SEQ ID NO: 1060311 - protein, 9 aa, Homo Sapiens
GSNQRQSIT

SEQ ID NO: 1060312 - protein, 9 aa, Homo Sapiens
MSIKIHTPE

SEQ ID NO: 1060313 - protein, 9 aa, Homo Sapiens
AQECVNTPE

SEQ ID NO: 1060314 - protein, 9 aa, Homo Sapiens
LVCGAVFYS

SEQ ID NO: 1060315 - protein, 9 aa, Homo Sapiens
SLQEKGLAW

SEQ ID NO: 1060316 - protein, 9 aa, Homo Sapiens
FLSVFLNNK

SEQ ID NO: 1060317 - protein, 9 aa, Homo Sapiens
RKFAKEVGE

SEQ ID NO: 1060318 - protein, 9 aa, Homo Sapiens
SVPLPPGLA

SEQ ID NO: 1060319 - protein, 9 aa, Homo Sapiens
FLGTVREDV

SEQ ID NO: 1060320 - protein, 9 aa, Homo Sapiens
WETMTNDYV

SEQ ID NO: 1060321 - protein, 9 aa, Homo Sapiens
PICLTHLSE

SEQ ID NO: 1060322 - protein, 9 aa, Homo Sapiens
AEAEFKDYS

SEQ ID NO: 1060323 - protein, 9 aa, Homo Sapiens
QVPHSLEIL

SEQ ID NO: 1060324 - protein, 9 aa, Homo Sapiens
LMDQIGEMR

SEQ ID NO: 1060325 - protein, 9 aa, Homo Sapiens
QALAGADFL

SEQ ID NO: 1060326 - protein, 9 aa, Homo Sapiens
PEILYPALL

SEQ ID NO: 1060327 - protein, 9 aa, Homo Sapiens
YIPPHGFYQ

SEQ ID NO: 1060328 - protein, 9 aa, Homo Sapiens
QEEKIKEFY

SEQ ID NO: 1060329 - protein, 9 aa, Homo Sapiens
EVRLTQDPA

SEQ ID NO: 1060330 - protein, 9 aa, Homo Sapiens
ISVFYTHIL

SEQ ID NO: 1060331 - protein, 9 aa, Homo Sapiens
RKPPEQLPQ

SEQ ID NO: 1060332 - protein, 9 aa, Homo Sapiens
YTWTNLTCC

SEQ ID NO: 1060333 - protein, 9 aa, Homo Sapiens
QMGQPQALM

SEQ ID NO: 1060334 - protein, 9 aa, Homo Sapiens
SGHGVNTSN

SEQ ID NO: 1060335 - protein, 9 aa, Homo Sapiens
AGALVCAYN

SEQ ID NO: 1060336 - protein, 9 aa, Homo Sapiens
SLSVFPNCR

SEQ ID NO: 1060337 - protein, 9 aa, Homo Sapiens
QVNDFPCHH

SEQ ID NO: 1060338 - protein, 9 aa, Homo Sapiens
LAADCINRL

SEQ ID NO: 1060339 - protein, 9 aa, Homo Sapiens
VCNDQNHYN

SEQ ID NO: 1060340 - protein, 9 aa, Homo Sapiens
RNEQAGGGG

SEQ ID NO: 1060341 - protein, 9 aa, Homo Sapiens
EEKKKKYML

SEQ ID NO: 1060342 - protein, 9 aa, Homo Sapiens
LIADLVVSK

SEQ ID NO: 1060343 - protein, 9 aa, Homo Sapiens
FLPISGMKK

SEQ ID NO: 1060344 - protein, 9 aa, Homo Sapiens
SFRSPAPPK

SEQ ID NO: 1060345 - protein, 9 aa, Homo Sapiens
QGGGPRNPD

SEQ ID NO: 1060346 - protein, 9 aa, Homo Sapiens
LVYFENFPD

SEQ ID NO: 1060347 - protein, 9 aa, Homo Sapiens
HPEEVRGFW

SEQ ID NO: 1060348 - protein, 9 aa, Homo Sapiens
ALPLLANNS

SEQ ID NO: 1060349 - protein, 9 aa, Homo Sapiens
RKRSRKKSY

SEQ ID NO: 1060350 - protein, 9 aa, Homo Sapiens
EGWNFQPPL

SEQ ID NO: 1060351 - protein, 9 aa, Homo Sapiens
DDSALWVSA

SEQ ID NO: 1060352 - protein, 9 aa, Homo Sapiens
RSSRTDSNK

SEQ ID NO: 1060353 - protein, 9 aa, Homo Sapiens
YKMPIKKKE

SEQ ID NO: 1060354 - protein, 9 aa, Homo Sapiens
DKSNQCVDV

SEQ ID NO: 1060355 - protein, 9 aa, Homo Sapiens
VYTQPPSAF

SEQ ID NO: 1060356 - protein, 9 aa, Homo Sapiens
CPPDTQENM

SEQ ID NO: 1060357 - protein, 9 aa, Homo Sapiens
EPKEEAKDV

SEQ ID NO: 1060358 - protein, 9 aa, Homo Sapiens
VLQSFSDAI

SEQ ID NO: 1060359 - protein, 9 aa, Homo Sapiens
KENEAKPST

SEQ ID NO: 1060360 - protein, 9 aa, Homo Sapiens
RVLAVRLKT

SEQ ID NO: 1060361 - protein, 9 aa, Homo Sapiens
WVMYVSLTL

SEQ ID NO: 1060362 - protein, 9 aa, Homo Sapiens
TSMNTRSFS

SEQ ID NO: 1060363 - protein, 9 aa, Homo Sapiens
IEFSGDIFH

SEQ ID NO: 1060364 - protein, 9 aa, Homo Sapiens
TKGQKLEYE

SEQ ID NO: 1060365 - protein, 9 aa, Homo Sapiens
TPYSLLRPE

SEQ ID NO: 1060366 - protein, 9 aa, Homo Sapiens
KLNQEVWYI

SEQ ID NO: 1060367 - protein, 9 aa, Homo Sapiens
KVQKKIDTV

SEQ ID NO: 1060368 - protein, 9 aa, Homo Sapiens
GRQKDDYCE

SEQ ID NO: 1060369 - protein, 9 aa, Homo Sapiens
QKKKMHEQE

SEQ ID NO: 1060370 - protein, 9 aa, Homo Sapiens
DGDRLTLVD

SEQ ID NO: 1060371 - protein, 9 aa, Homo Sapiens
ALPKPWPGR

SEQ ID NO: 1060372 - protein, 9 aa, Homo Sapiens
KAASFFFST

SEQ ID NO: 1060373 - protein, 9 aa, Homo Sapiens
LPKPWPGRG

SEQ ID NO: 1060374 - protein, 9 aa, Homo Sapiens
TLFILLGFF

SEQ ID NO: 1060375 - protein, 9 aa, Homo Sapiens
PGSFRGCGA

SEQ ID NO: 1060376 - protein, 9 aa, Homo Sapiens
PEAEPTLGA

SEQ ID NO: 1060377 - protein, 9 aa, Homo Sapiens
ILLMDGRII

SEQ ID NO: 1060378 - protein, 9 aa, Homo Sapiens
PFSSHAQAT

SEQ ID NO: 1060379 - protein, 9 aa, Homo Sapiens
VCVPKTCPS

SEQ ID NO: 1060380 - protein, 9 aa, Homo Sapiens
AATVHDVNH

SEQ ID NO: 1060381 - protein, 9 aa, Homo Sapiens
VAVINNNSK

SEQ ID NO: 1060382 - protein, 9 aa, Homo Sapiens
AASQESKYQ

SEQ ID NO: 1060383 - protein, 9 aa, Homo Sapiens
LTLVDCSLL

SEQ ID NO: 1060384 - protein, 9 aa, Homo Sapiens
GPIQAVEIK

SEQ ID NO: 1060385 - protein, 9 aa, Homo Sapiens
GGAVSSMSY

SEQ ID NO: 1060386 - protein, 9 aa, Homo Sapiens
IFCEGCKGF

SEQ ID NO: 1060387 - protein, 9 aa, Homo Sapiens
GEAFPASTD

SEQ ID NO: 1060388 - protein, 9 aa, Homo Sapiens
QESKKLGKT

SEQ ID NO: 1060389 - protein, 9 aa, Homo Sapiens
EAVPGAVLE

SEQ ID NO: 1060390 - protein, 9 aa, Homo Sapiens
PVLEQYFHP

SEQ ID NO: 1060391 - protein, 9 aa, Homo Sapiens
NMEDTRKLD

SEQ ID NO: 1060392 - protein, 9 aa, Homo Sapiens
CNNSSKNKF

SEQ ID NO: 1060393 - protein, 9 aa, Homo Sapiens
RTETKGQKL

SEQ ID NO: 1060394 - protein, 9 aa, Homo Sapiens
FSLLGICLR

SEQ ID NO: 1060395 - protein, 9 aa, Homo Sapiens
STRCTLEAG

SEQ ID NO: 1060396 - protein, 9 aa, Homo Sapiens
GDRNVSPVP

SEQ ID NO: 1060397 - protein, 9 aa, Homo Sapiens
IQDPVRNLH

SEQ ID NO: 1060398 - protein, 9 aa, Homo Sapiens
SKKLRVKNK

SEQ ID NO: 1060399 - protein, 9 aa, Homo Sapiens
CGVKYVPSY

SEQ ID NO: 1060400 - protein, 9 aa, Homo Sapiens
QLPSPRTLL

SEQ ID NO: 1060401 - protein, 9 aa, Homo Sapiens
FLVRLPFIK

SEQ ID NO: 1060402 - protein, 9 aa, Homo Sapiens
LADRLGWRQ

SEQ ID NO: 1060403 - protein, 9 aa, Homo Sapiens
EKQGLVSSR

SEQ ID NO: 1060404 - protein, 9 aa, Homo Sapiens
ELSAFHCPE

SEQ ID NO: 1060405 - protein, 9 aa, Homo Sapiens
LKENIGGEL

SEQ ID NO: 1060406 - protein, 9 aa, Homo Sapiens
LVPLLNRPF

SEQ ID NO: 1060407 - protein, 9 aa, Homo Sapiens
HFFSHRDLR

SEQ ID NO: 1060408 - protein, 9 aa, Homo Sapiens
AKELLSRTG

SEQ ID NO: 1060409 - protein, 9 aa, Homo Sapiens
CRQMYYAPT

SEQ ID NO: 1060410 - protein, 9 aa, Homo Sapiens
KTTEISLIG

SEQ ID NO: 1060411 - protein, 9 aa, Homo Sapiens
FFAGCFTQC

SEQ ID NO: 1060412 - protein, 9 aa, Homo Sapiens
GQEMIIEIF

SEQ ID NO: 1060413 - protein, 9 aa, Homo Sapiens
MTLYDKVTH

SEQ ID NO: 1060414 - protein, 9 aa, Homo Sapiens
GIRGPKEQK

SEQ ID NO: 1060415 - protein, 9 aa, Homo Sapiens
AEVLAFLLD

SEQ ID NO: 1060416 - protein, 9 aa, Homo Sapiens
STLQVLGAL

SEQ ID NO: 1060417 - protein, 9 aa, Homo Sapiens
KEFDKDYQK

SEQ ID NO: 1060418 - protein, 9 aa, Homo Sapiens
FFFCVAEMY

SEQ ID NO: 1060419 - protein, 9 aa, Homo Sapiens
CKRNLEISG

SEQ ID NO: 1060420 - protein, 9 aa, Homo Sapiens
FQNRGFMNR

SEQ ID NO: 1060421 - protein, 9 aa, Homo Sapiens
CGSNSGQGA

SEQ ID NO: 1060422 - protein, 9 aa, Homo Sapiens
KYTPLPSNK

SEQ ID NO: 1060423 - protein, 9 aa, Homo Sapiens
YLSHFCCVH

SEQ ID NO: 1060424 - protein, 9 aa, Homo Sapiens
VALKLSNFL

SEQ ID NO: 1060425 - protein, 9 aa, Homo Sapiens
TKKLRNSYS

SEQ ID NO: 1060426 - protein, 9 aa, Homo Sapiens
ERSSRRERE

SEQ ID NO: 1060427 - protein, 9 aa, Homo Sapiens
KDQGNFFFP

SEQ ID NO: 1060428 - protein, 9 aa, Homo Sapiens
LTPLRTVPD

SEQ ID NO: 1060429 - protein, 9 aa, Homo Sapiens
QRTPRGIPS

SEQ ID NO: 1060430 - protein, 9 aa, Homo Sapiens
VRPTVLMSL

SEQ ID NO: 1060431 - protein, 9 aa, Homo Sapiens
TLVCEEVID

SEQ ID NO: 1060432 - protein, 9 aa, Homo Sapiens
SFRYFSRSN

SEQ ID NO: 1060433 - protein, 9 aa, Homo Sapiens
FAGFQTRSQ

SEQ ID NO: 1060434 - protein, 9 aa, Homo Sapiens
KYSPFMKSL

SEQ ID NO: 1060435 - protein, 9 aa, Homo Sapiens
LVAKEERVV

SEQ ID NO: 1060436 - protein, 9 aa, Homo Sapiens
PSGIEHSMH

SEQ ID NO: 1060437 - protein, 9 aa, Homo Sapiens
QRYRLLEPT

SEQ ID NO: 1060438 - protein, 9 aa, Homo Sapiens
SGSSASKSF

SEQ ID NO: 1060439 - protein, 9 aa, Homo Sapiens
LFSESPQGK

SEQ ID NO: 1060440 - protein, 9 aa, Homo Sapiens
ASTTQINFW

SEQ ID NO: 1060441 - protein, 9 aa, Homo Sapiens
HEYGFPGIL

SEQ ID NO: 1060442 - protein, 9 aa, Homo Sapiens
SVIMRGSSE

SEQ ID NO: 1060443 - protein, 9 aa, Homo Sapiens
IIYTLKNAE

SEQ ID NO: 1060444 - protein, 9 aa, Homo Sapiens
STKMVGSNQ

SEQ ID NO: 1060445 - protein, 9 aa, Homo Sapiens
TPAPSTTTS

SEQ ID NO: 1060446 - protein, 9 aa, Homo Sapiens
IKNSEKVYS

SEQ ID NO: 1060447 - protein, 9 aa, Homo Sapiens
FVVLLILYT

SEQ ID NO: 1060448 - protein, 9 aa, Homo Sapiens
HQLYGRLLW

SEQ ID NO: 1060449 - protein, 9 aa, Homo Sapiens
HLNKEELGQ

SEQ ID NO: 1060450 - protein, 9 aa, Homo Sapiens
RSLVEMPTA

SEQ ID NO: 1060451 - protein, 9 aa, Homo Sapiens
SHLFFHLHT

SEQ ID NO: 1060452 - protein, 9 aa, Homo Sapiens
TASIFSLKK

SEQ ID NO: 1060453 - protein, 9 aa, Homo Sapiens
IADLVVSKM

SEQ ID NO: 1060454 - protein, 9 aa, Homo Sapiens
VYVINKEFC

SEQ ID NO: 1060455 - protein, 9 aa, Homo Sapiens
FYMCQAHNS

SEQ ID NO: 1060456 - protein, 9 aa, Homo Sapiens
KKYRSAYVT

SEQ ID NO: 1060457 - protein, 9 aa, Homo Sapiens
GPPGSPEPK

SEQ ID NO: 1060458 - protein, 9 aa, Homo Sapiens
ICGAAPPYV

SEQ ID NO: 1060459 - protein, 9 aa, Homo Sapiens
QFFAIKSGQ

SEQ ID NO: 1060460 - protein, 9 aa, Homo Sapiens
DFKLEMEVL

SEQ ID NO: 1060461 - protein, 9 aa, Homo Sapiens
EESPFSSHA

SEQ ID NO: 1060462 - protein, 9 aa, Homo Sapiens
LLEMPEKKD

SEQ ID NO: 1060463 - protein, 9 aa, Homo Sapiens
KEEWQDKDL

SEQ ID NO: 1060464 - protein, 9 aa, Homo Sapiens
VPWFISPGS

SEQ ID NO: 1060465 - protein, 9 aa, Homo Sapiens
RKVKKDTRP

SEQ ID NO: 1060466 - protein, 9 aa, Homo Sapiens
EILGSGSNP

SEQ ID NO: 1060467 - protein, 9 aa, Homo Sapiens
ESKKLGKTL

SEQ ID NO: 1060468 - protein, 9 aa, Homo Sapiens
GRGEDNAWI

SEQ ID NO: 1060469 - protein, 9 aa, Homo Sapiens
TAYNLYSHT

SEQ ID NO: 1060470 - protein, 9 aa, Homo Sapiens
SLIPVQRTR

SEQ ID NO: 1060471 - protein, 9 aa, Homo Sapiens
IFYISADRM

SEQ ID NO: 1060472 - protein, 9 aa, Homo Sapiens
QKRWTRELS

SEQ ID NO: 1060473 - protein, 9 aa, Homo Sapiens
SAGNLGGSI

SEQ ID NO: 1060474 - protein, 9 aa, Homo Sapiens
YLIGRDLGP

SEQ ID NO: 1060475 - protein, 9 aa, Homo Sapiens
QTHTGEKSS

SEQ ID NO: 1060476 - protein, 9 aa, Homo Sapiens
GENKQPGCP

SEQ ID NO: 1060477 - protein, 9 aa, Homo Sapiens
LWIIMKYLG

SEQ ID NO: 1060478 - protein, 9 aa, Homo Sapiens
LHLEPPKTG

SEQ ID NO: 1060479 - protein, 9 aa, Homo Sapiens
SDVWSFEIL

SEQ ID NO: 1060480 - protein, 9 aa, Homo Sapiens
TVNYFVLFE

SEQ ID NO: 1060481 - protein, 9 aa, Homo Sapiens
EKTKSPLKE

SEQ ID NO: 1060482 - protein, 9 aa, Homo Sapiens
KGFAGVMVR

SEQ ID NO: 1060483 - protein, 9 aa, Homo Sapiens
LYLFLLPMP

SEQ ID NO: 1060484 - protein, 9 aa, Homo Sapiens
LLDGAPGSS

SEQ ID NO: 1060485 - protein, 9 aa, Homo Sapiens
LTIQMESLV

SEQ ID NO: 1060486 - protein, 9 aa, Homo Sapiens
VPPQFLRKK

SEQ ID NO: 1060487 - protein, 9 aa, Homo Sapiens
ARKAMAVKD

SEQ ID NO: 1060488 - protein, 9 aa, Homo Sapiens
SSVAATLYV

SEQ ID NO: 1060489 - protein, 9 aa, Homo Sapiens
NVQNLQKRQ

SEQ ID NO: 1060490 - protein, 9 aa, Homo Sapiens
EPEEITKEP

SEQ ID NO: 1060491 - protein, 9 aa, Homo Sapiens
IHHHISFNW

SEQ ID NO: 1060492 - protein, 9 aa, Homo Sapiens
GRREQCLLS

SEQ ID NO: 1060493 - protein, 9 aa, Homo Sapiens
WLARRLYHL

SEQ ID NO: 1060494 - protein, 9 aa, Homo Sapiens
ESGEEYESE

SEQ ID NO: 1060495 - protein, 9 aa, Homo Sapiens
KAFMCPCYV

SEQ ID NO: 1060496 - protein, 9 aa, Homo Sapiens
LFPGDSDIN

SEQ ID NO: 1060497 - protein, 9 aa, Homo Sapiens
EIDFLCSDI

SEQ ID NO: 1060498 - protein, 9 aa, Homo Sapiens
GVPGPQGPF

SEQ ID NO: 1060499 - protein, 9 aa, Homo Sapiens
NLGGSIYAN

SEQ ID NO: 1060500 - protein, 9 aa, Homo Sapiens
AGRSRKLLK

SEQ ID NO: 1060501 - protein, 9 aa, Homo Sapiens
LDKDVFQGK

SEQ ID NO: 1060502 - protein, 9 aa, Homo Sapiens
LYGTGLRAL

SEQ ID NO: 1060503 - protein, 9 aa, Homo Sapiens
IEIDFLCSD

SEQ ID NO: 1060504 - protein, 9 aa, Homo Sapiens
EDAPHCSTV

SEQ ID NO: 1060505 - protein, 9 aa, Homo Sapiens
IQYQGIMKT

SEQ ID NO: 1060506 - protein, 9 aa, Homo Sapiens
IDTELMDAD

SEQ ID NO: 1060507 - protein, 9 aa, Homo Sapiens
DVWTYSNTR

SEQ ID NO: 1060508 - protein, 9 aa, Homo Sapiens
LYGSYTEMD

SEQ ID NO: 1060509 - protein, 9 aa, Homo Sapiens
NEITSELGD

SEQ ID NO: 1060510 - protein, 9 aa, Homo Sapiens
CTQEGWNFQ

SEQ ID NO: 1060511 - protein, 9 aa, Homo Sapiens
GNSYPFDGP

SEQ ID NO: 1060512 - protein, 9 aa, Homo Sapiens
TDDEDKDED

SEQ ID NO: 1060513 - protein, 9 aa, Homo Sapiens
SIDSESALV

SEQ ID NO: 1060514 - protein, 9 aa, Homo Sapiens
VWKVLNLTG

SEQ ID NO: 1060515 - protein, 9 aa, Homo Sapiens
QNRGFMNRV

SEQ ID NO: 1060516 - protein, 9 aa, Homo Sapiens
KDIISRVRG

SEQ ID NO: 1060517 - protein, 9 aa, Homo Sapiens
ELAGFPSVP

SEQ ID NO: 1060518 - protein, 9 aa, Homo Sapiens
FHSRQYKHL

SEQ ID NO: 1060519 - protein, 9 aa, Homo Sapiens
LLYLVQQLE

SEQ ID NO: 1060520 - protein, 9 aa, Homo Sapiens
APLTRVPQH

SEQ ID NO: 1060521 - protein, 9 aa, Homo Sapiens
PELDIFPGA

SEQ ID NO: 1060522 - protein, 9 aa, Homo Sapiens
SFFSPTSSF

SEQ ID NO: 1060523 - protein, 9 aa, Homo Sapiens
EMLKCDGLK

SEQ ID NO: 1060524 - protein, 9 aa, Homo Sapiens
HPKKRFGIP

SEQ ID NO: 1060525 - protein, 9 aa, Homo Sapiens
SKIQTDANH

SEQ ID NO: 1060526 - protein, 9 aa, Homo Sapiens
DPMGSEGVQ

SEQ ID NO: 1060527 - protein, 9 aa, Homo Sapiens
NNTLLVKAS

SEQ ID NO: 1060528 - protein, 9 aa, Homo Sapiens
AVPDSIPQW

SEQ ID NO: 1060529 - protein, 9 aa, Homo Sapiens
LMGSYQRHY

SEQ ID NO: 1060530 - protein, 9 aa, Homo Sapiens
EGGIEFSQI

SEQ ID NO: 1060531 - protein, 9 aa, Homo Sapiens
DPKLKYPKG

SEQ ID NO: 1060532 - protein, 9 aa, Homo Sapiens
TWVNQVVLF

SEQ ID NO: 1060533 - protein, 9 aa, Homo Sapiens
FLKHLNKEE

SEQ ID NO: 1060534 - protein, 9 aa, Homo Sapiens
EPINDSSEE

SEQ ID NO: 1060535 - protein, 9 aa, Homo Sapiens
QQMHRDEKP

SEQ ID NO: 1060536 - protein, 9 aa, Homo Sapiens
WRQAKVQEE

SEQ ID NO: 1060537 - protein, 9 aa, Homo Sapiens
LEVIFTLGE

SEQ ID NO: 1060538 - protein, 9 aa, Homo Sapiens
MPDHLFPLL

SEQ ID NO: 1060539 - protein, 9 aa, Homo Sapiens
GAKSPLDIE

SEQ ID NO: 1060540 - protein, 9 aa, Homo Sapiens
EPTLGARRK

SEQ ID NO: 1060541 - protein, 9 aa, Homo Sapiens
LLVYCTNLP

SEQ ID NO: 1060542 - protein, 9 aa, Homo Sapiens
SLPTLREFT

SEQ ID NO: 1060543 - protein, 9 aa, Homo Sapiens
CTDCLCPDG

SEQ ID NO: 1060544 - protein, 9 aa, Homo Sapiens
SQMVLMTSE

SEQ ID NO: 1060545 - protein, 9 aa, Homo Sapiens
TDVKSASKR

SEQ ID NO: 1060546 - protein, 9 aa, Homo Sapiens
SSYLDARDK

SEQ ID NO: 1060547 - protein, 9 aa, Homo Sapiens
DPFSGHTGR

SEQ ID NO: 1060548 - protein, 9 aa, Homo Sapiens
GGVCLNEGV

SEQ ID NO: 1060549 - protein, 9 aa, Homo Sapiens
KIIKIDGQK

SEQ ID NO: 1060550 - protein, 9 aa, Homo Sapiens
FRRYMASRL

SEQ ID NO: 1060551 - protein, 9 aa, Homo Sapiens
ALRMTHTLS

SEQ ID NO: 1060552 - protein, 9 aa, Homo Sapiens
RNKLQPGSK

SEQ ID NO: 1060553 - protein, 9 aa, Homo Sapiens
DTDLGHSRD

SEQ ID NO: 1060554 - protein, 9 aa, Homo Sapiens
VSTILGNGS

SEQ ID NO: 1060555 - protein, 9 aa, Homo Sapiens
VLFRFCVVM

SEQ ID NO: 1060556 - protein, 9 aa, Homo Sapiens
WLGNPPPHF

SEQ ID NO: 1060557 - protein, 9 aa, Homo Sapiens
PSHMSSFHS

SEQ ID NO: 1060558 - protein, 9 aa, Homo Sapiens
EIMLRLLLN

SEQ ID NO: 1060559 - protein, 9 aa, Homo Sapiens
VPDYAVLEM

SEQ ID NO: 1060560 - protein, 9 aa, Homo Sapiens
DGPFWDSDN

SEQ ID NO: 1060561 - protein, 9 aa, Homo Sapiens
VTSSPAAPL

SEQ ID NO: 1060562 - protein, 9 aa, Homo Sapiens
AKEERVVEV

SEQ ID NO: 1060563 - protein, 9 aa, Homo Sapiens
QYFQQGLHW

SEQ ID NO: 1060564 - protein, 9 aa, Homo Sapiens
VHHLVFTAF

SEQ ID NO: 1060565 - protein, 9 aa, Homo Sapiens
VLMSLWNVL

SEQ ID NO: 1060566 - protein, 9 aa, Homo Sapiens
NGGVYVNQN

SEQ ID NO: 1060567 - protein, 9 aa, Homo Sapiens
PSVSLPGLL

SEQ ID NO: 1060568 - protein, 9 aa, Homo Sapiens
PFHGGQYRC

SEQ ID NO: 1060569 - protein, 9 aa, Homo Sapiens
ICTNALGFY

SEQ ID NO: 1060570 - protein, 9 aa, Homo Sapiens
PFGQPGYCD

SEQ ID NO: 1060571 - protein, 9 aa, Homo Sapiens
SELYLQCNM

SEQ ID NO: 1060572 - protein, 9 aa, Homo Sapiens
PEDRKMHMP

SEQ ID NO: 1060573 - protein, 9 aa, Homo Sapiens
SGLHLTKHD

SEQ ID NO: 1060574 - protein, 9 aa, Homo Sapiens
RMTHTLSSS

SEQ ID NO: 1060575 - protein, 9 aa, Homo Sapiens
QEGGGGAES

SEQ ID NO: 1060576 - protein, 9 aa, Homo Sapiens
EQTLPDGPS

SEQ ID NO: 1060577 - protein, 9 aa, Homo Sapiens
NVVPSPLVG

SEQ ID NO: 1060578 - protein, 9 aa, Homo Sapiens
NGKFANFIK

SEQ ID NO: 1060579 - protein, 9 aa, Homo Sapiens
KRLKDSITR

SEQ ID NO: 1060580 - protein, 9 aa, Homo Sapiens
DSPHTIPTY

SEQ ID NO: 1060581 - protein, 9 aa, Homo Sapiens
DEKSPSTFH

SEQ ID NO: 1060582 - protein, 9 aa, Homo Sapiens
PGSGSSLSS

SEQ ID NO: 1060583 - protein, 9 aa, Homo Sapiens
KRWVWSDST

SEQ ID NO: 1060584 - protein, 9 aa, Homo Sapiens
DQRSPGIFT

SEQ ID NO: 1060585 - protein, 9 aa, Homo Sapiens
PPHGFYQSY

SEQ ID NO: 1060586 - protein, 9 aa, Homo Sapiens
EWGLQNIRV

SEQ ID NO: 1060587 - protein, 9 aa, Homo Sapiens
KYSSPQKTR

SEQ ID NO: 1060588 - protein, 9 aa, Homo Sapiens
HSGLRQLLF

SEQ ID NO: 1060589 - protein, 9 aa, Homo Sapiens
KMSNRRNES

SEQ ID NO: 1060590 - protein, 9 aa, Homo Sapiens
LGGSERSCG

SEQ ID NO: 1060591 - protein, 9 aa, Homo Sapiens
AILKGVAAG

SEQ ID NO: 1060592 - protein, 9 aa, Homo Sapiens
EFQKEVSFC

SEQ ID NO: 1060593 - protein, 9 aa, Homo Sapiens
LETNFNAND

SEQ ID NO: 1060594 - protein, 9 aa, Homo Sapiens
LRKELYFCC

SEQ ID NO: 1060595 - protein, 9 aa, Homo Sapiens
LSNGGRACG

SEQ ID NO: 1060596 - protein, 9 aa, Homo Sapiens
PLEFHQRPG

SEQ ID NO: 1060597 - protein, 9 aa, Homo Sapiens
FSGYQAATY

SEQ ID NO: 1060598 - protein, 9 aa, Homo Sapiens
KPFISLGIS

SEQ ID NO: 1060599 - protein, 9 aa, Homo Sapiens
VHFTFEAVE

SEQ ID NO: 1060600 - protein, 9 aa, Homo Sapiens
PSAHSSRKL

SEQ ID NO: 1060601 - protein, 9 aa, Homo Sapiens
QSGEIILCD

SEQ ID NO: 1060602 - protein, 9 aa, Homo Sapiens
LNHMSIKIH

SEQ ID NO: 1060603 - protein, 9 aa, Homo Sapiens
LKVMMEAYP

SEQ ID NO: 1060604 - protein, 9 aa, Homo Sapiens
TLELAGFPS

SEQ ID NO: 1060605 - protein, 9 aa, Homo Sapiens
VGQKQSSGS

SEQ ID NO: 1060606 - protein, 9 aa, Homo Sapiens
DKIKFWLKM

SEQ ID NO: 1060607 - protein, 9 aa, Homo Sapiens
DLKKHVLQS

SEQ ID NO: 1060608 - protein, 9 aa, Homo Sapiens
DMIKEHLPL

SEQ ID NO: 1060609 - protein, 9 aa, Homo Sapiens
VIYLVTLIE

SEQ ID NO: 1060610 - protein, 9 aa, Homo Sapiens
FNLETAMSV

SEQ ID NO: 1060611 - protein, 9 aa, Homo Sapiens
FEDITSMNT

SEQ ID NO: 1060612 - protein, 9 aa, Homo Sapiens
LKNKEMKIS

SEQ ID NO: 1060613 - protein, 9 aa, Homo Sapiens
PPLPAKAFR

SEQ ID NO: 1060614 - protein, 9 aa, Homo Sapiens
CEAKQEKIK

SEQ ID NO: 1060615 - protein, 9 aa, Homo Sapiens
IFKFTTQKE

SEQ ID NO: 1060616 - protein, 9 aa, Homo Sapiens
NGIVSSSSC

SEQ ID NO: 1060617 - protein, 9 aa, Homo Sapiens
LENVGLYFW

SEQ ID NO: 1060618 - protein, 9 aa, Homo Sapiens
VFYSCKADE

SEQ ID NO: 1060619 - protein, 9 aa, Homo Sapiens
GNTIRIKFT

SEQ ID NO: 1060620 - protein, 9 aa, Homo Sapiens
LFAATFSAF

SEQ ID NO: 1060621 - protein, 9 aa, Homo Sapiens
FPYLVFIHT

SEQ ID NO: 1060622 - protein, 9 aa, Homo Sapiens
VDYVNCGYV

SEQ ID NO: 1060623 - protein, 9 aa, Homo Sapiens
TVGYSFSLV

SEQ ID NO: 1060624 - protein, 9 aa, Homo Sapiens
SSAFPLIKK

SEQ ID NO: 1060625 - protein, 9 aa, Homo Sapiens
PVCGNEILE

SEQ ID NO: 1060626 - protein, 9 aa, Homo Sapiens
VWSFEILLW

SEQ ID NO: 1060627 - protein, 9 aa, Homo Sapiens
PSTFPSLHD

SEQ ID NO: 1060628 - protein, 9 aa, Homo Sapiens
IKKVQNLER

SEQ ID NO: 1060629 - protein, 9 aa, Homo Sapiens
KVFNNFSTL

SEQ ID NO: 1060630 - protein, 9 aa, Homo Sapiens
SSGFPGNLG

SEQ ID NO: 1060631 - protein, 9 aa, Homo Sapiens
KARIPLYGS

SEQ ID NO: 1060632 - protein, 9 aa, Homo Sapiens
FSKAPPPSL

SEQ ID NO: 1060633 - protein, 9 aa, Homo Sapiens
TFFGVGQES

SEQ ID NO: 1060634 - protein, 9 aa, Homo Sapiens
KFLNDTMHR

SEQ ID NO: 1060635 - protein, 9 aa, Homo Sapiens
NYFEGAQLS

SEQ ID NO: 1060636 - protein, 9 aa, Homo Sapiens
VRAETPYMM

SEQ ID NO: 1060637 - protein, 9 aa, Homo Sapiens
GFSYNATTG

SEQ ID NO: 1060638 - protein, 9 aa, Homo Sapiens
LVSSSLILY

SEQ ID NO: 1060639 - protein, 9 aa, Homo Sapiens
ANSAPSILN

SEQ ID NO: 1060640 - protein, 9 aa, Homo Sapiens
ELHIPLFFV

SEQ ID NO: 1060641 - protein, 9 aa, Homo Sapiens
DGNGRGDIC

SEQ ID NO: 1060642 - protein, 9 aa, Homo Sapiens
WKKFLRKKE

SEQ ID NO: 1060643 - protein, 9 aa, Homo Sapiens
RLFINRIFY

SEQ ID NO: 1060644 - protein, 9 aa, Homo Sapiens
DRHCGPDLE

SEQ ID NO: 1060645 - protein, 9 aa, Homo Sapiens
MAALWASLR

SEQ ID NO: 1060646 - protein, 9 aa, Homo Sapiens
EHLVQYFQQ

SEQ ID NO: 1060647 - protein, 9 aa, Homo Sapiens
ALLTRNEQA

SEQ ID NO: 1060648 - protein, 9 aa, Homo Sapiens
STGRSPASA

SEQ ID NO: 1060649 - protein, 9 aa, Homo Sapiens
FCADHLLKA

SEQ ID NO: 1060650 - protein, 9 aa, Homo Sapiens
MIIEIFKGR

SEQ ID NO: 1060651 - protein, 9 aa, Homo Sapiens
MELSSRSPP

SEQ ID NO: 1060652 - protein, 9 aa, Homo Sapiens
KIIFYRLYS

SEQ ID NO: 1060653 - protein, 9 aa, Homo Sapiens
SFNWDCEFI

SEQ ID NO: 1060654 - protein, 9 aa, Homo Sapiens
KKPLNYEKQ

SEQ ID NO: 1060655 - protein, 9 aa, Homo Sapiens
ISRLRAIQL

SEQ ID NO: 1060656 - protein, 9 aa, Homo Sapiens
FISEITISD

SEQ ID NO: 1060657 - protein, 9 aa, Homo Sapiens
SPLSSRSLS

SEQ ID NO: 1060658 - protein, 9 aa, Homo Sapiens
RVVIFAFSL

SEQ ID NO: 1060659 - protein, 9 aa, Homo Sapiens
NRTKDFKLE

SEQ ID NO: 1060660 - protein, 9 aa, Homo Sapiens
NLKTKCDLW

SEQ ID NO: 1060661 - protein, 9 aa, Homo Sapiens
KKSYSVYVY

SEQ ID NO: 1060662 - protein, 9 aa, Homo Sapiens
SYKLCTRSE

SEQ ID NO: 1060663 - protein, 9 aa, Homo Sapiens
SCDKLPPEE

SEQ ID NO: 1060664 - protein, 9 aa, Homo Sapiens
NEYCFAWVE

SEQ ID NO: 1060665 - protein, 9 aa, Homo Sapiens
RCYKSENIY

SEQ ID NO: 1060666 - protein, 9 aa, Homo Sapiens
LLFFLFLTI

SEQ ID NO: 1060667 - protein, 9 aa, Homo Sapiens
GRAAPEGAQ

SEQ ID NO: 1060668 - protein, 9 aa, Homo Sapiens
GPIPGPILG

SEQ ID NO: 1060669 - protein, 9 aa, Homo Sapiens
HLTTPSSTA

SEQ ID NO: 1060670 - protein, 9 aa, Homo Sapiens
SPIWYFTMQ

SEQ ID NO: 1060671 - protein, 9 aa, Homo Sapiens
SRTEVRSLR

SEQ ID NO: 1060672 - protein, 9 aa, Homo Sapiens
CQLCEVENQ

SEQ ID NO: 1060673 - protein, 9 aa, Homo Sapiens
TLLSLKSEN

SEQ ID NO: 1060674 - protein, 9 aa, Homo Sapiens
SNLYFYKDP

SEQ ID NO: 1060675 - protein, 9 aa, Homo Sapiens
SSAPGVNES

SEQ ID NO: 1060676 - protein, 9 aa, Homo Sapiens
TKERVGKEV

SEQ ID NO: 1060677 - protein, 9 aa, Homo Sapiens
ATMKKEFQK

SEQ ID NO: 1060678 - protein, 9 aa, Homo Sapiens
VESKFNILK

SEQ ID NO: 1060679 - protein, 9 aa, Homo Sapiens
AAVPDDLAL

SEQ ID NO: 1060680 - protein, 9 aa, Homo Sapiens
LRYTEEGHQ

SEQ ID NO: 1060681 - protein, 9 aa, Homo Sapiens
CFSDLVFAC

SEQ ID NO: 1060682 - protein, 9 aa, Homo Sapiens
REKKELEDL

SEQ ID NO: 1060683 - protein, 9 aa, Homo Sapiens
ASASLRKAS

SEQ ID NO: 1060684 - protein, 9 aa, Homo Sapiens
SQASHECTE

SEQ ID NO: 1060685 - protein, 9 aa, Homo Sapiens
IGNGPLSSD

SEQ ID NO: 1060686 - protein, 9 aa, Homo Sapiens
DEDISRTLG

SEQ ID NO: 1060687 - protein, 9 aa, Homo Sapiens
DVTSKLDKK

SEQ ID NO: 1060688 - protein, 9 aa, Homo Sapiens
GNLFGGSET

SEQ ID NO: 1060689 - protein, 9 aa, Homo Sapiens
DLGIFKISV

SEQ ID NO: 1060690 - protein, 9 aa, Homo Sapiens
STIAAPHPI

SEQ ID NO: 1060691 - protein, 9 aa, Homo Sapiens
GLTDKEKAE

SEQ ID NO: 1060692 - protein, 9 aa, Homo Sapiens
RQIEEIYVG

SEQ ID NO: 1060693 - protein, 9 aa, Homo Sapiens
CTFVTDSLM

SEQ ID NO: 1060694 - protein, 9 aa, Homo Sapiens
YRDVPRPIL

SEQ ID NO: 1060695 - protein, 9 aa, Homo Sapiens
TGQGRSPRS

SEQ ID NO: 1060696 - protein, 9 aa, Homo Sapiens
ENGQLLMIR

SEQ ID NO: 1060697 - protein, 9 aa, Homo Sapiens
IPVTTSENL

SEQ ID NO: 1060698 - protein, 9 aa, Homo Sapiens
GSQESGLEQ

SEQ ID NO: 1060699 - protein, 9 aa, Homo Sapiens
EFFRPSKEV

SEQ ID NO: 1060700 - protein, 9 aa, Homo Sapiens
VPWLLIFFL

SEQ ID NO: 1060701 - protein, 9 aa, Homo Sapiens
LMLNAYKPK

SEQ ID NO: 1060702 - protein, 9 aa, Homo Sapiens
PPQRTPVGI

SEQ ID NO: 1060703 - protein, 9 aa, Homo Sapiens
EKLKTVEKA

SEQ ID NO: 1060704 - protein, 9 aa, Homo Sapiens
DNISDGAKN

SEQ ID NO: 1060705 - protein, 9 aa, Homo Sapiens
KEKLNSEVE

SEQ ID NO: 1060706 - protein, 9 aa, Homo Sapiens
LRSHTGDTL

SEQ ID NO: 1060707 - protein, 9 aa, Homo Sapiens
DLSESLSYS

SEQ ID NO: 1060708 - protein, 9 aa, Homo Sapiens
GALLLPLVI

SEQ ID NO: 1060709 - protein, 9 aa, Homo Sapiens
ISETREQAL

SEQ ID NO: 1060710 - protein, 9 aa, Homo Sapiens
TVSSILSRT

SEQ ID NO: 1060711 - protein, 9 aa, Homo Sapiens
YSCKADEHR

SEQ ID NO: 1060712 - protein, 9 aa, Homo Sapiens
VKEMYDHQG

SEQ ID NO: 1060713 - protein, 9 aa, Homo Sapiens
DGWKSTIYY

SEQ ID NO: 1060714 - protein, 9 aa, Homo Sapiens
SQCSLEKSS

SEQ ID NO: 1060715 - protein, 9 aa, Homo Sapiens
WDFLRQIVA

SEQ ID NO: 1060716 - protein, 9 aa, Homo Sapiens
IGMVVLVRR

SEQ ID NO: 1060717 - protein, 9 aa, Homo Sapiens
HKLHPQETV

SEQ ID NO: 1060718 - protein, 9 aa, Homo Sapiens
NPQPQALCQ

SEQ ID NO: 1060719 - protein, 9 aa, Homo Sapiens
MLELPKTFL

SEQ ID NO: 1060720 - protein, 9 aa, Homo Sapiens
DQGVFTQLL

SEQ ID NO: 1060721 - protein, 9 aa, Homo Sapiens
NPFSLSKDC

SEQ ID NO: 1060722 - protein, 9 aa, Homo Sapiens
KFTTQKEYS

SEQ ID NO: 1060723 - protein, 9 aa, Homo Sapiens
GPPVSPLPK

SEQ ID NO: 1060724 - protein, 9 aa, Homo Sapiens
IVVDHSLHE

SEQ ID NO: 1060725 - protein, 9 aa, Homo Sapiens
FQRRPDFSY

SEQ ID NO: 1060726 - protein, 9 aa, Homo Sapiens
GMKKEAILS

SEQ ID NO: 1060727 - protein, 9 aa, Homo Sapiens
AYLKENIGG

SEQ ID NO: 1060728 - protein, 9 aa, Homo Sapiens
IVDGYEQAA

SEQ ID NO: 1060729 - protein, 9 aa, Homo Sapiens
WVTLPCPNF

SEQ ID NO: 1060730 - protein, 9 aa, Homo Sapiens
LLPELAISG

SEQ ID NO: 1060731 - protein, 9 aa, Homo Sapiens
QHITWNGLL

SEQ ID NO: 1060732 - protein, 9 aa, Homo Sapiens
ESKMFQSEV

SEQ ID NO: 1060733 - protein, 9 aa, Homo Sapiens
VCGKFFSQK

SEQ ID NO: 1060734 - protein, 9 aa, Homo Sapiens
SATTRHPEL

SEQ ID NO: 1060735 - protein, 9 aa, Homo Sapiens
NKEFAYEQK

SEQ ID NO: 1060736 - protein, 9 aa, Homo Sapiens
NSCFTTTPG

SEQ ID NO: 1060737 - protein, 9 aa, Homo Sapiens
DDGNSEIME

SEQ ID NO: 1060738 - protein, 9 aa, Homo Sapiens
KTGIIRTAL

SEQ ID NO: 1060739 - protein, 9 aa, Homo Sapiens
EDKKAGRPF

SEQ ID NO: 1060740 - protein, 9 aa, Homo Sapiens
LCNKEVRET

SEQ ID NO: 1060741 - protein, 9 aa, Homo Sapiens
FKHLKHENV

SEQ ID NO: 1060742 - protein, 9 aa, Homo Sapiens
SGRIVYDAW

SEQ ID NO: 1060743 - protein, 9 aa, Homo Sapiens
DGAPGSSEA

SEQ ID NO: 1060744 - protein, 9 aa, Homo Sapiens
PTVLMSLWN

SEQ ID NO: 1060745 - protein, 9 aa, Homo Sapiens
TISVTDINS

SEQ ID NO: 1060746 - protein, 9 aa, Homo Sapiens
FLQTTDVIS

SEQ ID NO: 1060747 - protein, 9 aa, Homo Sapiens
LRIIVELGA

SEQ ID NO: 1060748 - protein, 9 aa, Homo Sapiens
CFAREDQII

SEQ ID NO: 1060749 - protein, 9 aa, Homo Sapiens
RLVPLLNRP

SEQ ID NO: 1060750 - protein, 9 aa, Homo Sapiens
PGTKAVSTE

SEQ ID NO: 1060751 - protein, 9 aa, Homo Sapiens
VCPFVHLSV

SEQ ID NO: 1060752 - protein, 9 aa, Homo Sapiens
RTITSIVKK

SEQ ID NO: 1060753 - protein, 9 aa, Homo Sapiens
SSFKCSLYA

SEQ ID NO: 1060754 - protein, 9 aa, Homo Sapiens
KNGECFCAD

SEQ ID NO: 1060755 - protein, 9 aa, Homo Sapiens
KNMELTYLN

SEQ ID NO: 1060756 - protein, 9 aa, Homo Sapiens
EIKFDIYTL

SEQ ID NO: 1060757 - protein, 9 aa, Homo Sapiens
SPNRVTRDN

SEQ ID NO: 1060758 - protein, 9 aa, Homo Sapiens
DFQRMPMQQ

SEQ ID NO: 1060759 - protein, 9 aa, Homo Sapiens
GKDFEGSKL

SEQ ID NO: 1060760 - protein, 9 aa, Homo Sapiens
VFGDFNFWL

SEQ ID NO: 1060761 - protein, 9 aa, Homo Sapiens
TYLNNSYVR

SEQ ID NO: 1060762 - protein, 9 aa, Homo Sapiens
EQISRNHSS

SEQ ID NO: 1060763 - protein, 9 aa, Homo Sapiens
LCQKWNDPR

SEQ ID NO: 1060764 - protein, 9 aa, Homo Sapiens
TNSYTMILQ

SEQ ID NO: 1060765 - protein, 9 aa, Homo Sapiens
AWLEHSSAF

SEQ ID NO: 1060766 - protein, 9 aa, Homo Sapiens
NGKAIKVAQ

SEQ ID NO: 1060767 - protein, 9 aa, Homo Sapiens
KSEFSAFRA

SEQ ID NO: 1060768 - protein, 9 aa, Homo Sapiens
RYHKQPQNA

SEQ ID NO: 1060769 - protein, 9 aa, Homo Sapiens
KKRKVKEEV

SEQ ID NO: 1060770 - protein, 9 aa, Homo Sapiens
ALKLAVDQR

SEQ ID NO: 1060771 - protein, 9 aa, Homo Sapiens
VPCIFVYTQ

SEQ ID NO: 1060772 - protein, 9 aa, Homo Sapiens
GYCLSSRSH

SEQ ID NO: 1060773 - protein, 9 aa, Homo Sapiens
INESYNLTE

SEQ ID NO: 1060774 - protein, 9 aa, Homo Sapiens
RSQLLQNVS

SEQ ID NO: 1060775 - protein, 9 aa, Homo Sapiens
CSFTCKSSL

SEQ ID NO: 1060776 - protein, 9 aa, Homo Sapiens
QWQSLPRCV

SEQ ID NO: 1060777 - protein, 9 aa, Homo Sapiens
FFVIIYSDC

SEQ ID NO: 1060778 - protein, 9 aa, Homo Sapiens
KSEVSVGLE

SEQ ID NO: 1060779 - protein, 9 aa, Homo Sapiens
QRDPRAGST

SEQ ID NO: 1060780 - protein, 9 aa, Homo Sapiens
IKDANCWHL

SEQ ID NO: 1060781 - protein, 9 aa, Homo Sapiens
KHHCRDTDC

SEQ ID NO: 1060782 - protein, 9 aa, Homo Sapiens
AKGWGSRAR

SEQ ID NO: 1060783 - protein, 9 aa, Homo Sapiens
YHIFLVEDA

SEQ ID NO: 1060784 - protein, 9 aa, Homo Sapiens
HPRPQEKNV

SEQ ID NO: 1060785 - protein, 9 aa, Homo Sapiens
WTSVFSPVE

SEQ ID NO: 1060786 - protein, 9 aa, Homo Sapiens
YTWGEGDLG

SEQ ID NO: 1060787 - protein, 9 aa, Homo Sapiens
SRRKEVDMI

SEQ ID NO: 1060788 - protein, 9 aa, Homo Sapiens
TALSETRDL

SEQ ID NO: 1060789 - protein, 9 aa, Homo Sapiens
SISVVAITA

SEQ ID NO: 1060790 - protein, 9 aa, Homo Sapiens
IIFYRLYSL

SEQ ID NO: 1060791 - protein, 9 aa, Homo Sapiens
PDILETNFN

SEQ ID NO: 1060792 - protein, 9 aa, Homo Sapiens
DGLLTIWLH

SEQ ID NO: 1060793 - protein, 9 aa, Homo Sapiens
IPVALGLKK

SEQ ID NO: 1060794 - protein, 9 aa, Homo Sapiens
QNNPLSVLK

SEQ ID NO: 1060795 - protein, 9 aa, Homo Sapiens
CKNCCNKHL

SEQ ID NO: 1060796 - protein, 9 aa, Homo Sapiens
HPESNQKSE

SEQ ID NO: 1060797 - protein, 9 aa, Homo Sapiens
LPAPAMYSF

SEQ ID NO: 1060798 - protein, 9 aa, Homo Sapiens
HDTDILWLA

SEQ ID NO: 1060799 - protein, 9 aa, Homo Sapiens
YYEEYQGSL

SEQ ID NO: 1060800 - protein, 9 aa, Homo Sapiens
DTMQSSSTP

SEQ ID NO: 1060801 - protein, 9 aa, Homo Sapiens
GDENYLMLI

SEQ ID NO: 1060802 - protein, 9 aa, Homo Sapiens
FVRNLYLAR

SEQ ID NO: 1060803 - protein, 9 aa, Homo Sapiens
NPPKNETTE

SEQ ID NO: 1060804 - protein, 9 aa, Homo Sapiens
FSEVFFSNI

SEQ ID NO: 1060805 - protein, 9 aa, Homo Sapiens
RGRQKDDYC

SEQ ID NO: 1060806 - protein, 9 aa, Homo Sapiens
TLIAYSDLE

SEQ ID NO: 1060807 - protein, 9 aa, Homo Sapiens
FVESKFNIL

SEQ ID NO: 1060808 - protein, 9 aa, Homo Sapiens
VLEQYFHPA

SEQ ID NO: 1060809 - protein, 9 aa, Homo Sapiens
IISRLRAIQ

SEQ ID NO: 1060810 - protein, 9 aa, Homo Sapiens
DFLVDNAEV

SEQ ID NO: 1060811 - protein, 9 aa, Homo Sapiens
HRALLTRNE

SEQ ID NO: 1060812 - protein, 9 aa, Homo Sapiens
LVLETCKET

SEQ ID NO: 1060813 - protein, 9 aa, Homo Sapiens
STRIIYCNS

SEQ ID NO: 1060814 - protein, 9 aa, Homo Sapiens
KRSDSRKYP

SEQ ID NO: 1060815 - protein, 9 aa, Homo Sapiens
DSRTVLQVL

SEQ ID NO: 1060816 - protein, 9 aa, Homo Sapiens
LHLLKFLND

SEQ ID NO: 1060817 - protein, 9 aa, Homo Sapiens
AALVFGGVA

SEQ ID NO: 1060818 - protein, 9 aa, Homo Sapiens
NLKEDKNQL

SEQ ID NO: 1060819 - protein, 9 aa, Homo Sapiens
APFQRGTPG

SEQ ID NO: 1060820 - protein, 9 aa, Homo Sapiens
AVVIRIKVT

SEQ ID NO: 1060821 - protein, 9 aa, Homo Sapiens
LAMYVAIQA

SEQ ID NO: 1060822 - protein, 9 aa, Homo Sapiens
LVSLFFFRK

SEQ ID NO: 1060823 - protein, 9 aa, Homo Sapiens
SWTTGVLLF

SEQ ID NO: 1060824 - protein, 9 aa, Homo Sapiens
LERKYAANK

SEQ ID NO: 1060825 - protein, 9 aa, Homo Sapiens
MKKFYVLLG

SEQ ID NO: 1060826 - protein, 9 aa, Homo Sapiens
SSETSLVGK

SEQ ID NO: 1060827 - protein, 9 aa, Homo Sapiens
SKEGQKKGW

SEQ ID NO: 1060828 - protein, 9 aa, Homo Sapiens
NVAHVLLEE

SEQ ID NO: 1060829 - protein, 9 aa, Homo Sapiens
RSKPGESEV

SEQ ID NO: 1060830 - protein, 9 aa, Homo Sapiens
AFHLLQQMD

SEQ ID NO: 1060831 - protein, 9 aa, Homo Sapiens
CEVCQQSGE

SEQ ID NO: 1060832 - protein, 9 aa, Homo Sapiens
LGEMIFLLP

SEQ ID NO: 1060833 - protein, 9 aa, Homo Sapiens
ALEDSSLSP

SEQ ID NO: 1060834 - protein, 9 aa, Homo Sapiens
PLDMLEPEQ

SEQ ID NO: 1060835 - protein, 9 aa, Homo Sapiens
KYSHFMHHH

SEQ ID NO: 1060836 - protein, 9 aa, Homo Sapiens
FSTIKEEDT

SEQ ID NO: 1060837 - protein, 9 aa, Homo Sapiens
ICCNCKCGQ

SEQ ID NO: 1060838 - protein, 9 aa, Homo Sapiens
KRGWEFRII

SEQ ID NO: 1060839 - protein, 9 aa, Homo Sapiens
FSQEIPKPL

SEQ ID NO: 1060840 - protein, 9 aa, Homo Sapiens
AIKELSLED

SEQ ID NO: 1060841 - protein, 9 aa, Homo Sapiens
PRKEGTLPT

SEQ ID NO: 1060842 - protein, 9 aa, Homo Sapiens
LADLDWDAF

SEQ ID NO: 1060843 - protein, 9 aa, Homo Sapiens
HRQTVKFLG

SEQ ID NO: 1060844 - protein, 9 aa, Homo Sapiens
VCSSCHAFC

SEQ ID NO: 1060845 - protein, 9 aa, Homo Sapiens
KLRNSYSID

SEQ ID NO: 1060846 - protein, 9 aa, Homo Sapiens
YLLRYTVIM

SEQ ID NO: 1060847 - protein, 9 aa, Homo Sapiens
QRHAENKPI

SEQ ID NO: 1060848 - protein, 9 aa, Homo Sapiens
LEDQRNVSM

SEQ ID NO: 1060849 - protein, 9 aa, Homo Sapiens
NVWEEMDAN

SEQ ID NO: 1060850 - protein, 9 aa, Homo Sapiens
SKLQSQEWG

SEQ ID NO: 1060851 - protein, 9 aa, Homo Sapiens
YEKKDNTFC

SEQ ID NO: 1060852 - protein, 9 aa, Homo Sapiens
AKPALTLSF

SEQ ID NO: 1060853 - protein, 9 aa, Homo Sapiens
SQARSDDLT

SEQ ID NO: 1060854 - protein, 9 aa, Homo Sapiens
NKVKYVHNG

SEQ ID NO: 1060855 - protein, 9 aa, Homo Sapiens
SGSDSSSEP

SEQ ID NO: 1060856 - protein, 9 aa, Homo Sapiens
KDNTFCMAI

SEQ ID NO: 1060857 - protein, 9 aa, Homo Sapiens
PFTSIIQQS

SEQ ID NO: 1060858 - protein, 9 aa, Homo Sapiens
KDTTPAPST

SEQ ID NO: 1060859 - protein, 9 aa, Homo Sapiens
LDPSSRYDA

SEQ ID NO: 1060860 - protein, 9 aa, Homo Sapiens
GLGVWKLAS

SEQ ID NO: 1060861 - protein, 9 aa, Homo Sapiens
SGPGQALQN

SEQ ID NO: 1060862 - protein, 9 aa, Homo Sapiens
KCESPEPHP

SEQ ID NO: 1060863 - protein, 9 aa, Homo Sapiens
KTRNHLRLV

SEQ ID NO: 1060864 - protein, 9 aa, Homo Sapiens
SDPLETRPQ

SEQ ID NO: 1060865 - protein, 9 aa, Homo Sapiens
PRCLRAGGA

SEQ ID NO: 1060866 - protein, 9 aa, Homo Sapiens
TTDMSSDFR

SEQ ID NO: 1060867 - protein, 9 aa, Homo Sapiens
QMYYAPTDC

SEQ ID NO: 1060868 - protein, 9 aa, Homo Sapiens
TRHPELRRT

SEQ ID NO: 1060869 - protein, 9 aa, Homo Sapiens
ERNEKQTSS

SEQ ID NO: 1060870 - protein, 9 aa, Homo Sapiens
PLPLSSLAG

SEQ ID NO: 1060871 - protein, 9 aa, Homo Sapiens
FLHQSREKT

SEQ ID NO: 1060872 - protein, 9 aa, Homo Sapiens
KWEVVENTH

SEQ ID NO: 1060873 - protein, 9 aa, Homo Sapiens
LYYQTEKYN

SEQ ID NO: 1060874 - protein, 9 aa, Homo Sapiens
KESFITPLV

SEQ ID NO: 1060875 - protein, 9 aa, Homo Sapiens
ELGCYFYEG

SEQ ID NO: 1060876 - protein, 9 aa, Homo Sapiens
TVVGLSLWV

SEQ ID NO: 1060877 - protein, 9 aa, Homo Sapiens
YVSLCCFHQ

SEQ ID NO: 1060878 - protein, 9 aa, Homo Sapiens
GAGERKKVP

SEQ ID NO: 1060879 - protein, 9 aa, Homo Sapiens
VTNTLIMTS

SEQ ID NO: 1060880 - protein, 9 aa, Homo Sapiens
REVSIEGMI

SEQ ID NO: 1060881 - protein, 9 aa, Homo Sapiens
NSGGAVSSM

SEQ ID NO: 1060882 - protein, 9 aa, Homo Sapiens
SQKLSSIYN

SEQ ID NO: 1060883 - protein, 9 aa, Homo Sapiens
LKTPEKSFT

SEQ ID NO: 1060884 - protein, 9 aa, Homo Sapiens
NKDKLNLKE

SEQ ID NO: 1060885 - protein, 9 aa, Homo Sapiens
TLSVMKDSA

SEQ ID NO: 1060886 - protein, 9 aa, Homo Sapiens
GETSLKLIL

SEQ ID NO: 1060887 - protein, 9 aa, Homo Sapiens
PTASPLPAR

SEQ ID NO: 1060888 - protein, 9 aa, Homo Sapiens
KYKLRYRKR

SEQ ID NO: 1060889 - protein, 9 aa, Homo Sapiens
QNRCAAWEE

SEQ ID NO: 1060890 - protein, 9 aa, Homo Sapiens
FGFGARIPL

SEQ ID NO: 1060891 - protein, 9 aa, Homo Sapiens
SLLFFREMN

SEQ ID NO: 1060892 - protein, 9 aa, Homo Sapiens
LLSLRDEPR

SEQ ID NO: 1060893 - protein, 9 aa, Homo Sapiens
DNAEVERLR

SEQ ID NO: 1060894 - protein, 9 aa, Homo Sapiens
SQTVMCSCL

SEQ ID NO: 1060895 - protein, 9 aa, Homo Sapiens
ECDFCGKAF

SEQ ID NO: 1060896 - protein, 9 aa, Homo Sapiens
NQEEGAGDT

SEQ ID NO: 1060897 - protein, 9 aa, Homo Sapiens
EQCLLSPED

SEQ ID NO: 1060898 - protein, 9 aa, Homo Sapiens
QNFQIRVQV

SEQ ID NO: 1060899 - protein, 9 aa, Homo Sapiens
WKYRLKAEL

SEQ ID NO: 1060900 - protein, 9 aa, Homo Sapiens
RVTLLANLI

SEQ ID NO: 1060901 - protein, 9 aa, Homo Sapiens
RTSILNCES

SEQ ID NO: 1060902 - protein, 9 aa, Homo Sapiens
SCENIRING

SEQ ID NO: 1060903 - protein, 9 aa, Homo Sapiens
CFTTTPGPV

SEQ ID NO: 1060904 - protein, 9 aa, Homo Sapiens
EVLNFALSS

SEQ ID NO: 1060905 - protein, 9 aa, Homo Sapiens
CYTMDPSVK

SEQ ID NO: 1060906 - protein, 9 aa, Homo Sapiens
AIQSIKTNV

SEQ ID NO: 1060907 - protein, 9 aa, Homo Sapiens
CNKFLDDDI

SEQ ID NO: 1060908 - protein, 9 aa, Homo Sapiens
CNCYEFLNG

SEQ ID NO: 1060909 - protein, 9 aa, Homo Sapiens
SKWNSSPPA

SEQ ID NO: 1060910 - protein, 9 aa, Homo Sapiens
WDREASTLQ

SEQ ID NO: 1060911 - protein, 9 aa, Homo Sapiens
LIGSDIANK

SEQ ID NO: 1060912 - protein, 9 aa, Homo Sapiens
KDDHLLSPT

SEQ ID NO: 1060913 - protein, 9 aa, Homo Sapiens
GGSSDLYVR

SEQ ID NO: 1060914 - protein, 9 aa, Homo Sapiens
GRRGGPLMF

SEQ ID NO: 1060915 - protein, 9 aa, Homo Sapiens
LRGHFPFSI

SEQ ID NO: 1060916 - protein, 9 aa, Homo Sapiens
AQPFKFTIF

SEQ ID NO: 1060917 - protein, 9 aa, Homo Sapiens
QKALDLPFS

SEQ ID NO: 1060918 - protein, 9 aa, Homo Sapiens
LLKWQQRFR

SEQ ID NO: 1060919 - protein, 9 aa, Homo Sapiens
DDIFFTPEC

SEQ ID NO: 1060920 - protein, 9 aa, Homo Sapiens
DIDDVSTPS

SEQ ID NO: 1060921 - protein, 9 aa, Homo Sapiens
FVRLFVDKN

SEQ ID NO: 1060922 - protein, 9 aa, Homo Sapiens
PEGSELPPG

SEQ ID NO: 1060923 - protein, 9 aa, Homo Sapiens
QQKKHLEHP

SEQ ID NO: 1060924 - protein, 9 aa, Homo Sapiens
FSQIYYDRF

SEQ ID NO: 1060925 - protein, 9 aa, Homo Sapiens
FLIPIVLIF

SEQ ID NO: 1060926 - protein, 9 aa, Homo Sapiens
KKHVLQSSL

SEQ ID NO: 1060927 - protein, 9 aa, Homo Sapiens
CDNPPLSNG

SEQ ID NO: 1060928 - protein, 9 aa, Homo Sapiens
IFNQKIRDR

SEQ ID NO: 1060929 - protein, 9 aa, Homo Sapiens
TFYDVLSML

SEQ ID NO: 1060930 - protein, 9 aa, Homo Sapiens
PEQEEVQRP

SEQ ID NO: 1060931 - protein, 9 aa, Homo Sapiens
LCLKKSTLD

SEQ ID NO: 1060932 - protein, 9 aa, Homo Sapiens
WPFDFFLFK

SEQ ID NO: 1060933 - protein, 9 aa, Homo Sapiens
YFLHQSREK

SEQ ID NO: 1060934 - protein, 9 aa, Homo Sapiens
KGDIVMFEE

SEQ ID NO: 1060935 - protein, 9 aa, Homo Sapiens
WILDGISET

SEQ ID NO: 1060936 - protein, 9 aa, Homo Sapiens
FSQPVRAAC

SEQ ID NO: 1060937 - protein, 9 aa, Homo Sapiens
VGIIRDCLI

SEQ ID NO: 1060938 - protein, 9 aa, Homo Sapiens
ISLTAPTSW

SEQ ID NO: 1060939 - protein, 9 aa, Homo Sapiens
FQPLCTGDE

SEQ ID NO: 1060940 - protein, 9 aa, Homo Sapiens
VCLNEGVCS

SEQ ID NO: 1060941 - protein, 9 aa, Homo Sapiens
NSKQMESYS

SEQ ID NO: 1060942 - protein, 9 aa, Homo Sapiens
GHRVHQSPN

SEQ ID NO: 1060943 - protein, 9 aa, Homo Sapiens
VSYIKQPAG

SEQ ID NO: 1060944 - protein, 9 aa, Homo Sapiens
LTCCVHNII

SEQ ID NO: 1060945 - protein, 9 aa, Homo Sapiens
AGPRQNPRR

SEQ ID NO: 1060946 - protein, 9 aa, Homo Sapiens
SCPSQPPSF

SEQ ID NO: 1060947 - protein, 9 aa, Homo Sapiens
QRPELLTNE

SEQ ID NO: 1060948 - protein, 9 aa, Homo Sapiens
CAKSPIDCE

SEQ ID NO: 1060949 - protein, 9 aa, Homo Sapiens
SWPSTNLFL

SEQ ID NO: 1060950 - protein, 9 aa, Homo Sapiens
NEEITAHKH

SEQ ID NO: 1060951 - protein, 9 aa, Homo Sapiens
QQAQRGEGR

SEQ ID NO: 1060952 - protein, 9 aa, Homo Sapiens
DIMLLKLKK

SEQ ID NO: 1060953 - protein, 9 aa, Homo Sapiens
EVNTKLCDE

SEQ ID NO: 1060954 - protein, 9 aa, Homo Sapiens
GSLPPRVCL

SEQ ID NO: 1060955 - protein, 9 aa, Homo Sapiens
LPKEELKIV

SEQ ID NO: 1060956 - protein, 9 aa, Homo Sapiens
GMDIHWKKV

SEQ ID NO: 1060957 - protein, 9 aa, Homo Sapiens
VFFWISQAA

SEQ ID NO: 1060958 - protein, 9 aa, Homo Sapiens
QAMQKNLIV

SEQ ID NO: 1060959 - protein, 9 aa, Homo Sapiens
VAAVARTDG

SEQ ID NO: 1060960 - protein, 9 aa, Homo Sapiens
LPDPQNISF

SEQ ID NO: 1060961 - protein, 9 aa, Homo Sapiens
IGLTKPLKE

SEQ ID NO: 1060962 - protein, 9 aa, Homo Sapiens
EGSAFLGDD

SEQ ID NO: 1060963 - protein, 9 aa, Homo Sapiens
KDMPGSHHD

SEQ ID NO: 1060964 - protein, 9 aa, Homo Sapiens
YSPSSTLPR

SEQ ID NO: 1060965 - protein, 9 aa, Homo Sapiens
ISKINKDEK

SEQ ID NO: 1060966 - protein, 9 aa, Homo Sapiens
DCLCPDGFY

SEQ ID NO: 1060967 - protein, 9 aa, Homo Sapiens
FFSEVFFSN

SEQ ID NO: 1060968 - protein, 9 aa, Homo Sapiens
SIKFEIGEA

SEQ ID NO: 1060969 - protein, 9 aa, Homo Sapiens
PLVIPGDPP

SEQ ID NO: 1060970 - protein, 9 aa, Homo Sapiens
RTPSDLESS

SEQ ID NO: 1060971 - protein, 9 aa, Homo Sapiens
QIVMIIDEP

SEQ ID NO: 1060972 - protein, 9 aa, Homo Sapiens
SPRPTPPPF

SEQ ID NO: 1060973 - protein, 9 aa, Homo Sapiens
ILDDLFFHT

SEQ ID NO: 1060974 - protein, 9 aa, Homo Sapiens
VFSPVEREI

SEQ ID NO: 1060975 - protein, 9 aa, Homo Sapiens
KTALHIAAL

SEQ ID NO: 1060976 - protein, 9 aa, Homo Sapiens
KKIRSFVAY

SEQ ID NO: 1060977 - protein, 9 aa, Homo Sapiens
PRSGSQSSG

SEQ ID NO: 1060978 - protein, 9 aa, Homo Sapiens
TGKTVAIFL

SEQ ID NO: 1060979 - protein, 9 aa, Homo Sapiens
TEPEKLLDK

SEQ ID NO: 1060980 - protein, 9 aa, Homo Sapiens
DECSFTCKS

SEQ ID NO: 1060981 - protein, 9 aa, Homo Sapiens
GRWGPEDRK

SEQ ID NO: 1060982 - protein, 9 aa, Homo Sapiens
GEQTVLQLW

SEQ ID NO: 1060983 - protein, 9 aa, Homo Sapiens
PKNAFLPPG

SEQ ID NO: 1060984 - protein, 9 aa, Homo Sapiens
AISAIQKAR

SEQ ID NO: 1060985 - protein, 9 aa, Homo Sapiens
KAFIRSSFF

SEQ ID NO: 1060986 - protein, 9 aa, Homo Sapiens
QSIKTNVHS

SEQ ID NO: 1060987 - protein, 9 aa, Homo Sapiens
SKVDATQGQ

SEQ ID NO: 1060988 - protein, 9 aa, Homo Sapiens
KSAMKHIVI

SEQ ID NO: 1060989 - protein, 9 aa, Homo Sapiens
VGRTHFMDF

SEQ ID NO: 1060990 - protein, 9 aa, Homo Sapiens
HPFQGFRFG

SEQ ID NO: 1060991 - protein, 9 aa, Homo Sapiens
YYQTEKYNL

SEQ ID NO: 1060992 - protein, 9 aa, Homo Sapiens
WFNPFSLSK

SEQ ID NO: 1060993 - protein, 9 aa, Homo Sapiens
KSNQCVDVD

SEQ ID NO: 1060994 - protein, 9 aa, Homo Sapiens
AAISTFIPV

SEQ ID NO: 1060995 - protein, 9 aa, Homo Sapiens
LFSSSSTTH

SEQ ID NO: 1060996 - protein, 9 aa, Homo Sapiens
EEVSVENGF

SEQ ID NO: 1060997 - protein, 9 aa, Homo Sapiens
ERLKPASHS

SEQ ID NO: 1060998 - protein, 9 aa, Homo Sapiens
TFEMFEADL

SEQ ID NO: 1060999 - protein, 9 aa, Homo Sapiens
SRTGDEIIF

SEQ ID NO: 1061000 - protein, 9 aa, Homo Sapiens
SAGGTAPNL

SEQ ID NO: 1061001 - protein, 9 aa, Homo Sapiens
KDGPVNPPA

SEQ ID NO: 1061002 - protein, 9 aa, Homo Sapiens
QELVRITHQ

SEQ ID NO: 1061003 - protein, 9 aa, Homo Sapiens
MLILKGVKK

SEQ ID NO: 1061004 - protein, 9 aa, Homo Sapiens
GEGGGAAGG

SEQ ID NO: 1061005 - protein, 9 aa, Homo Sapiens
NETLKEYKA

SEQ ID NO: 1061006 - protein, 9 aa, Homo Sapiens
QKEKITQIE

SEQ ID NO: 1061007 - protein, 9 aa, Homo Sapiens
SIPCMISFV

SEQ ID NO: 1061008 - protein, 9 aa, Homo Sapiens
NSLRFSASN

SEQ ID NO: 1061009 - protein, 9 aa, Homo Sapiens
PHGPATPRK

SEQ ID NO: 1061010 - protein, 9 aa, Homo Sapiens
KEEEEAVAD

SEQ ID NO: 1061011 - protein, 9 aa, Homo Sapiens
NIEDDLKMM

SEQ ID NO: 1061012 - protein, 9 aa, Homo Sapiens
VDATQGQSR

SEQ ID NO: 1061013 - protein, 9 aa, Homo Sapiens
KHPESNQKS

SEQ ID NO: 1061014 - protein, 9 aa, Homo Sapiens
EALREKLRY

SEQ ID NO: 1061015 - protein, 9 aa, Homo Sapiens
DNEEWNEVL

SEQ ID NO: 1061016 - protein, 9 aa, Homo Sapiens
ASCKYSPFM

SEQ ID NO: 1061017 - protein, 9 aa, Homo Sapiens
IGRDLGPFN

SEQ ID NO: 1061018 - protein, 9 aa, Homo Sapiens
ATLKNCDLP

SEQ ID NO: 1061019 - protein, 9 aa, Homo Sapiens
IIISHRACI

SEQ ID NO: 1061020 - protein, 9 aa, Homo Sapiens
CNYQHGFHL

SEQ ID NO: 1061021 - protein, 9 aa, Homo Sapiens
PCMISFVPV

SEQ ID NO: 1061022 - protein, 9 aa, Homo Sapiens
SHLESGWEE

SEQ ID NO: 1061023 - protein, 9 aa, Homo Sapiens
RILKGQKKN

SEQ ID NO: 1061024 - protein, 9 aa, Homo Sapiens
LALPALEAS

SEQ ID NO: 1061025 - protein, 9 aa, Homo Sapiens
QTSLSMQIL

SEQ ID NO: 1061026 - protein, 9 aa, Homo Sapiens
LIMTSKTIT

SEQ ID NO: 1061027 - protein, 9 aa, Homo Sapiens
HLNLKKEKN

SEQ ID NO: 1061028 - protein, 9 aa, Homo Sapiens
NSDSREKPM

SEQ ID NO: 1061029 - protein, 9 aa, Homo Sapiens
DRRPLGPSS

SEQ ID NO: 1061030 - protein, 9 aa, Homo Sapiens
ETANLSPSL

SEQ ID NO: 1061031 - protein, 9 aa, Homo Sapiens
QARRHHQFF

SEQ ID NO: 1061032 - protein, 9 aa, Homo Sapiens
PGPQQPRGQ

SEQ ID NO: 1061033 - protein, 9 aa, Homo Sapiens
ALKLSNFLN

SEQ ID NO: 1061034 - protein, 9 aa, Homo Sapiens
IVTANFVEL

SEQ ID NO: 1061035 - protein, 9 aa, Homo Sapiens
SAASASLRK

SEQ ID NO: 1061036 - protein, 9 aa, Homo Sapiens
ISRNTEDIP

SEQ ID NO: 1061037 - protein, 9 aa, Homo Sapiens
QRIYTGEKP

SEQ ID NO: 1061038 - protein, 9 aa, Homo Sapiens
EREDTDLTF

SEQ ID NO: 1061039 - protein, 9 aa, Homo Sapiens
SSHAQATKI

SEQ ID NO: 1061040 - protein, 9 aa, Homo Sapiens
LYVELHSEC

SEQ ID NO: 1061041 - protein, 9 aa, Homo Sapiens
TEGQPWQTM

SEQ ID NO: 1061042 - protein, 9 aa, Homo Sapiens
RGFYHHQKM

SEQ ID NO: 1061043 - protein, 9 aa, Homo Sapiens
LLQQMDILP

SEQ ID NO: 1061044 - protein, 9 aa, Homo Sapiens
SENSAFCFL

SEQ ID NO: 1061045 - protein, 9 aa, Homo Sapiens
PLNFTMNAA

SEQ ID NO: 1061046 - protein, 9 aa, Homo Sapiens
YREGQVLCC

SEQ ID NO: 1061047 - protein, 9 aa, Homo Sapiens
HLDHLDLAS

SEQ ID NO: 1061048 - protein, 9 aa, Homo Sapiens
CDNVSLLAL

SEQ ID NO: 1061049 - protein, 9 aa, Homo Sapiens
QEVNECNLP

SEQ ID NO: 1061050 - protein, 9 aa, Homo Sapiens
FQNNPLSVL

SEQ ID NO: 1061051 - protein, 9 aa, Homo Sapiens
ELTFCLKRE

SEQ ID NO: 1061052 - protein, 9 aa, Homo Sapiens
PPPSTTHAF

SEQ ID NO: 1061053 - protein, 9 aa, Homo Sapiens
GSDSSSEPK

SEQ ID NO: 1061054 - protein, 9 aa, Homo Sapiens
KKDLRSSNE

SEQ ID NO: 1061055 - protein, 9 aa, Homo Sapiens
CSDIFEEVL

SEQ ID NO: 1061056 - protein, 9 aa, Homo Sapiens
TNPKPSFTW

SEQ ID NO: 1061057 - protein, 9 aa, Homo Sapiens
LFYQRLFGQ

SEQ ID NO: 1061058 - protein, 9 aa, Homo Sapiens
DYPKTGEHQ

SEQ ID NO: 1061059 - protein, 9 aa, Homo Sapiens
SGFPRVEPD

SEQ ID NO: 1061060 - protein, 9 aa, Homo Sapiens
WTTNNVVQN

SEQ ID NO: 1061061 - protein, 9 aa, Homo Sapiens
NFQNRGFMN

SEQ ID NO: 1061062 - protein, 9 aa, Homo Sapiens
PQTLPFARG

SEQ ID NO: 1061063 - protein, 9 aa, Homo Sapiens
ISGQVTEQQ

SEQ ID NO: 1061064 - protein, 9 aa, Homo Sapiens
ISTKMVGSN

SEQ ID NO: 1061065 - protein, 9 aa, Homo Sapiens
MVVLVRRLL

SEQ ID NO: 1061066 - protein, 9 aa, Homo Sapiens
AVNKAGTVS

SEQ ID NO: 1061067 - protein, 9 aa, Homo Sapiens
KELSYRFLG

SEQ ID NO: 1061068 - protein, 9 aa, Homo Sapiens
RGPELLGSR

SEQ ID NO: 1061069 - protein, 9 aa, Homo Sapiens
VAPFVEAFD

SEQ ID NO: 1061070 - protein, 9 aa, Homo Sapiens
AHVLLEELH

SEQ ID NO: 1061071 - protein, 9 aa, Homo Sapiens
PSMGTQSGC

SEQ ID NO: 1061072 - protein, 9 aa, Homo Sapiens
MKLQTSPAC

SEQ ID NO: 1061073 - protein, 9 aa, Homo Sapiens
WLTVETSVP

SEQ ID NO: 1061074 - protein, 9 aa, Homo Sapiens
EDVAKRGIT

SEQ ID NO: 1061075 - protein, 9 aa, Homo Sapiens
ILPTNAMGL

SEQ ID NO: 1061076 - protein, 9 aa, Homo Sapiens
QYLPSGIEH

SEQ ID NO: 1061077 - protein, 9 aa, Homo Sapiens
FLDSPPRPL

SEQ ID NO: 1061078 - protein, 9 aa, Homo Sapiens
NGNGYGPGE

SEQ ID NO: 1061079 - protein, 9 aa, Homo Sapiens
HIYLGTFAL

SEQ ID NO: 1061080 - protein, 9 aa, Homo Sapiens
VCYREGQVL

SEQ ID NO: 1061081 - protein, 9 aa, Homo Sapiens
LYAAFLPLL

SEQ ID NO: 1061082 - protein, 9 aa, Homo Sapiens
GAPLSLYIS

SEQ ID NO: 1061083 - protein, 9 aa, Homo Sapiens
TISNVKTNV

SEQ ID NO: 1061084 - protein, 9 aa, Homo Sapiens
PTQKPLPAP

SEQ ID NO: 1061085 - protein, 9 aa, Homo Sapiens
PPLNFTMNA

SEQ ID NO: 1061086 - protein, 9 aa, Homo Sapiens
KFWLKMNSI

SEQ ID NO: 1061087 - protein, 9 aa, Homo Sapiens
GARDHGAAH

SEQ ID NO: 1061088 - protein, 9 aa, Homo Sapiens
RREPKEEAK

SEQ ID NO: 1061089 - protein, 9 aa, Homo Sapiens
PQNFQIRVQ

SEQ ID NO: 1061090 - protein, 9 aa, Homo Sapiens
VHMFLLAQS

SEQ ID NO: 1061091 - protein, 9 aa, Homo Sapiens
WNFQPPLCK

SEQ ID NO: 1061092 - protein, 9 aa, Homo Sapiens
SNSRPGTMR

SEQ ID NO: 1061093 - protein, 9 aa, Homo Sapiens
TVAQNKEFD

SEQ ID NO: 1061094 - protein, 9 aa, Homo Sapiens
SGIVSDLFS

SEQ ID NO: 1061095 - protein, 9 aa, Homo Sapiens
LIFIVVTFG

SEQ ID NO: 1061096 - protein, 9 aa, Homo Sapiens
ETIRDMCRA

SEQ ID NO: 1061097 - protein, 9 aa, Homo Sapiens
GSSCDTQAV

SEQ ID NO: 1061098 - protein, 9 aa, Homo Sapiens
AGEKILEPF

SEQ ID NO: 1061099 - protein, 9 aa, Homo Sapiens
VRNLYLARH

SEQ ID NO: 1061100 - protein, 9 aa, Homo Sapiens
SFQIIQFME

SEQ ID NO: 1061101 - protein, 9 aa, Homo Sapiens
RIIPPTSKT

SEQ ID NO: 1061102 - protein, 9 aa, Homo Sapiens
LEEIEENAG

SEQ ID NO: 1061103 - protein, 9 aa, Homo Sapiens
VLQLLKQEH

SEQ ID NO: 1061104 - protein, 9 aa, Homo Sapiens
LKNEKFINV

SEQ ID NO: 1061105 - protein, 9 aa, Homo Sapiens
EQSSTRCTL

SEQ ID NO: 1061106 - protein, 9 aa, Homo Sapiens
ETPVQSVMV

SEQ ID NO: 1061107 - protein, 9 aa, Homo Sapiens
TAEPINDSS

SEQ ID NO: 1061108 - protein, 9 aa, Homo Sapiens
SPSTFHDVS

SEQ ID NO: 1061109 - protein, 9 aa, Homo Sapiens
QRLKKRKTT

SEQ ID NO: 1061110 - protein, 9 aa, Homo Sapiens
LPNMLVYRK

SEQ ID NO: 1061111 - protein, 9 aa, Homo Sapiens
PGETEEHFS

SEQ ID NO: 1061112 - protein, 9 aa, Homo Sapiens
LPKCPPKCP

SEQ ID NO: 1061113 - protein, 9 aa, Homo Sapiens
HQVRTETKG

SEQ ID NO: 1061114 - protein, 9 aa, Homo Sapiens
FPGNDSLGD

SEQ ID NO: 1061115 - protein, 9 aa, Homo Sapiens
FFKTTVFSG

SEQ ID NO: 1061116 - protein, 9 aa, Homo Sapiens
ARVTWREDL

SEQ ID NO: 1061117 - protein, 9 aa, Homo Sapiens
LHAQLHCRC

SEQ ID NO: 1061118 - protein, 9 aa, Homo Sapiens
FSNFLDGLG

SEQ ID NO: 1061119 - protein, 9 aa, Homo Sapiens
ERRGEGAEL

SEQ ID NO: 1061120 - protein, 9 aa, Homo Sapiens
EQPGPQGPK

SEQ ID NO: 1061121 - protein, 9 aa, Homo Sapiens
NYSRGLEPR

SEQ ID NO: 1061122 - protein, 9 aa, Homo Sapiens
AGVAPFVEA

SEQ ID NO: 1061123 - protein, 9 aa, Homo Sapiens
TNDNSKRYY

SEQ ID NO: 1061124 - protein, 9 aa, Homo Sapiens
FLDQFYMNR

SEQ ID NO: 1061125 - protein, 9 aa, Homo Sapiens
RGDAASHLF

SEQ ID NO: 1061126 - protein, 9 aa, Homo Sapiens
MSLFSSSST

SEQ ID NO: 1061127 - protein, 9 aa, Homo Sapiens
DIFLTSVCV

SEQ ID NO: 1061128 - protein, 9 aa, Homo Sapiens
KLELQEKKT

SEQ ID NO: 1061129 - protein, 9 aa, Homo Sapiens
LFGWFIKST

SEQ ID NO: 1061130 - protein, 9 aa, Homo Sapiens
VYDAWDMRR

SEQ ID NO: 1061131 - protein, 9 aa, Homo Sapiens
ADNNFVLIG

SEQ ID NO: 1061132 - protein, 9 aa, Homo Sapiens
LRNGDQWHE

SEQ ID NO: 1061133 - protein, 9 aa, Homo Sapiens
LGFFFSDRR

SEQ ID NO: 1061134 - protein, 9 aa, Homo Sapiens
KKSSSGKKG

SEQ ID NO: 1061135 - protein, 9 aa, Homo Sapiens
PARLPTTEL

SEQ ID NO: 1061136 - protein, 9 aa, Homo Sapiens
TNLFLIKIL

SEQ ID NO: 1061137 - protein, 9 aa, Homo Sapiens
RKGPPVSPL

SEQ ID NO: 1061138 - protein, 9 aa, Homo Sapiens
VGECGSPLL

SEQ ID NO: 1061139 - protein, 9 aa, Homo Sapiens
GFINCEANL

SEQ ID NO: 1061140 - protein, 9 aa, Homo Sapiens
GFMSFDNNG

SEQ ID NO: 1061141 - protein, 9 aa, Homo Sapiens
SLGTVFVPQ

SEQ ID NO: 1061142 - protein, 9 aa, Homo Sapiens
SSCSGPPPP

SEQ ID NO: 1061143 - protein, 9 aa, Homo Sapiens
KIRDRWQVE

SEQ ID NO: 1061144 - protein, 9 aa, Homo Sapiens
GKPQERKNA

SEQ ID NO: 1061145 - protein, 9 aa, Homo Sapiens
RDFQVTVDV

SEQ ID NO: 1061146 - protein, 9 aa, Homo Sapiens
DKIITGSFD

SEQ ID NO: 1061147 - protein, 9 aa, Homo Sapiens
IVVYHVIVP

SEQ ID NO: 1061148 - protein, 9 aa, Homo Sapiens
QPDHDADRH

SEQ ID NO: 1061149 - protein, 9 aa, Homo Sapiens
PCELIGKPL

SEQ ID NO: 1061150 - protein, 9 aa, Homo Sapiens
ETILLLPAS

SEQ ID NO: 1061151 - protein, 9 aa, Homo Sapiens
KKASLTLAV

SEQ ID NO: 1061152 - protein, 9 aa, Homo Sapiens
ISRNHSSIV

SEQ ID NO: 1061153 - protein, 9 aa, Homo Sapiens
EDLLERISD

SEQ ID NO: 1061154 - protein, 9 aa, Homo Sapiens
FEFYFLPNP

SEQ ID NO: 1061155 - protein, 9 aa, Homo Sapiens
AMRAGPHAT

SEQ ID NO: 1061156 - protein, 9 aa, Homo Sapiens
WRSKAGAEL

SEQ ID NO: 1061157 - protein, 9 aa, Homo Sapiens
ILQNQLEKL

SEQ ID NO: 1061158 - protein, 9 aa, Homo Sapiens
NFWWLAVVI

SEQ ID NO: 1061159 - protein, 9 aa, Homo Sapiens
ILNLCFSDL

SEQ ID NO: 1061160 - protein, 9 aa, Homo Sapiens
RNLYLARHT

SEQ ID NO: 1061161 - protein, 9 aa, Homo Sapiens
VVSVLNTIF

SEQ ID NO: 1061162 - protein, 9 aa, Homo Sapiens
PTQPSSGPG

SEQ ID NO: 1061163 - protein, 9 aa, Homo Sapiens
GSCLLADNN

SEQ ID NO: 1061164 - protein, 9 aa, Homo Sapiens
NQKITLYSQ

SEQ ID NO: 1061165 - protein, 9 aa, Homo Sapiens
FIFMQAVLS

SEQ ID NO: 1061166 - protein, 9 aa, Homo Sapiens
EMAKYNLPA

SEQ ID NO: 1061167 - protein, 9 aa, Homo Sapiens
LDGDRLTLV

SEQ ID NO: 1061168 - protein, 9 aa, Homo Sapiens
GNSEIMEYF

SEQ ID NO: 1061169 - protein, 9 aa, Homo Sapiens
SSSKSALHL

SEQ ID NO: 1061170 - protein, 9 aa, Homo Sapiens
IPGIRGPKE

SEQ ID NO: 1061171 - protein, 9 aa, Homo Sapiens
SNQKSENNQ

SEQ ID NO: 1061172 - protein, 9 aa, Homo Sapiens
KNLNSNAVV

SEQ ID NO: 1061173 - protein, 9 aa, Homo Sapiens
LRPIFKSKT

SEQ ID NO: 1061174 - protein, 9 aa, Homo Sapiens
TSAERRNKA

SEQ ID NO: 1061175 - protein, 9 aa, Homo Sapiens
FQNKNIEVL

SEQ ID NO: 1061176 - protein, 9 aa, Homo Sapiens
GLEDLAADC

SEQ ID NO: 1061177 - protein, 9 aa, Homo Sapiens
LRVLYHFAN

SEQ ID NO: 1061178 - protein, 9 aa, Homo Sapiens
HHHISFNWD

SEQ ID NO: 1061179 - protein, 9 aa, Homo Sapiens
SKTTHRDLA

SEQ ID NO: 1061180 - protein, 9 aa, Homo Sapiens
MDIWTQKEN

SEQ ID NO: 1061181 - protein, 9 aa, Homo Sapiens
PRVCLKPQR

SEQ ID NO: 1061182 - protein, 9 aa, Homo Sapiens
TEETPLHLA

SEQ ID NO: 1061183 - protein, 9 aa, Homo Sapiens
EHYQDFRTQ

SEQ ID NO: 1061184 - protein, 9 aa, Homo Sapiens
SDRDLEAST

SEQ ID NO: 1061185 - protein, 9 aa, Homo Sapiens
TEVFCREQQ

SEQ ID NO: 1061186 - protein, 9 aa, Homo Sapiens
GFYHHQKMN

SEQ ID NO: 1061187 - protein, 9 aa, Homo Sapiens
YRQTKPCHD

SEQ ID NO: 1061188 - protein, 9 aa, Homo Sapiens
HSKPNPKNN

SEQ ID NO: 1061189 - protein, 9 aa, Homo Sapiens
PLAYRDVPR

SEQ ID NO: 1061190 - protein, 9 aa, Homo Sapiens
KVILRRYEN

SEQ ID NO: 1061191 - protein, 9 aa, Homo Sapiens
SISLEPGDR

SEQ ID NO: 1061192 - protein, 9 aa, Homo Sapiens
EREEAIKKQ

SEQ ID NO: 1061193 - protein, 9 aa, Homo Sapiens
YGKISYPGR

SEQ ID NO: 1061194 - protein, 9 aa, Homo Sapiens
AFLASASLR

SEQ ID NO: 1061195 - protein, 9 aa, Homo Sapiens
NIAPVEFTQ

SEQ ID NO: 1061196 - protein, 9 aa, Homo Sapiens
SSVRLSPAA

SEQ ID NO: 1061197 - protein, 9 aa, Homo Sapiens
LLKLHQQFE

SEQ ID NO: 1061198 - protein, 9 aa, Homo Sapiens
STECDFHPL

SEQ ID NO: 1061199 - protein, 9 aa, Homo Sapiens
FFCEMLVFL

SEQ ID NO: 1061200 - protein, 9 aa, Homo Sapiens
TNIAFNILN

SEQ ID NO: 1061201 - protein, 9 aa, Homo Sapiens
NRVTRDNPR

SEQ ID NO: 1061202 - protein, 9 aa, Homo Sapiens
SKAASFFFS

SEQ ID NO: 1061203 - protein, 9 aa, Homo Sapiens
SADTVRSSA

SEQ ID NO: 1061204 - protein, 9 aa, Homo Sapiens
LCCGLSELI

SEQ ID NO: 1061205 - protein, 9 aa, Homo Sapiens
RDLGPFNPG

SEQ ID NO: 1061206 - protein, 9 aa, Homo Sapiens
YKVKQRLGE

SEQ ID NO: 1061207 - protein, 9 aa, Homo Sapiens
YSYQAPLVA

SEQ ID NO: 1061208 - protein, 9 aa, Homo Sapiens
ERSCGVTVA

SEQ ID NO: 1061209 - protein, 9 aa, Homo Sapiens
LFVVLLILY

SEQ ID NO: 1061210 - protein, 9 aa, Homo Sapiens
IKSSIDSES

SEQ ID NO: 1061211 - protein, 9 aa, Homo Sapiens
LRMNSTTSE

SEQ ID NO: 1061212 - protein, 9 aa, Homo Sapiens
HPTKSHLFR

SEQ ID NO: 1061213 - protein, 9 aa, Homo Sapiens
DCHLAQVSS

SEQ ID NO: 1061214 - protein, 9 aa, Homo Sapiens
KIAGDHSEW

SEQ ID NO: 1061215 - protein, 9 aa, Homo Sapiens
LILIMGILR

SEQ ID NO: 1061216 - protein, 9 aa, Homo Sapiens
HHLVFTAFD

SEQ ID NO: 1061217 - protein, 9 aa, Homo Sapiens
AVKDIISRV

SEQ ID NO: 1061218 - protein, 9 aa, Homo Sapiens
NQCSIDLGK

SEQ ID NO: 1061219 - protein, 9 aa, Homo Sapiens
CRVRGGHWR

SEQ ID NO: 1061220 - protein, 9 aa, Homo Sapiens
FARGAHGNS

SEQ ID NO: 1061221 - protein, 9 aa, Homo Sapiens
MGVSHDTDI

SEQ ID NO: 1061222 - protein, 9 aa, Homo Sapiens
LLVTRLSDG

SEQ ID NO: 1061223 - protein, 9 aa, Homo Sapiens
MRGAGDPRG

SEQ ID NO: 1061224 - protein, 9 aa, Homo Sapiens
LSDFTEPEK

SEQ ID NO: 1061225 - protein, 9 aa, Homo Sapiens
DLDGNGRGD

SEQ ID NO: 1061226 - protein, 9 aa, Homo Sapiens
PTNLRRQSR

SEQ ID NO: 1061227 - protein, 9 aa, Homo Sapiens
DGRKKKYSS

SEQ ID NO: 1061228 - protein, 9 aa, Homo Sapiens
IPDEKFDPQ

SEQ ID NO: 1061229 - protein, 9 aa, Homo Sapiens
IFILNLCFS

SEQ ID NO: 1061230 - protein, 9 aa, Homo Sapiens
IRDRWQVEE

SEQ ID NO: 1061231 - protein, 9 aa, Homo Sapiens
SDGNIYVLK

SEQ ID NO: 1061232 - protein, 9 aa, Homo Sapiens
KHYRTSSKF

SEQ ID NO: 1061233 - protein, 9 aa, Homo Sapiens
VAINTVSFY

SEQ ID NO: 1061234 - protein, 9 aa, Homo Sapiens
RPRRKKCRP

SEQ ID NO: 1061235 - protein, 9 aa, Homo Sapiens
LFPKMPYEP

SEQ ID NO: 1061236 - protein, 9 aa, Homo Sapiens
NPFAPSRMS

SEQ ID NO: 1061237 - protein, 9 aa, Homo Sapiens
GFYFLAGEP

SEQ ID NO: 1061238 - protein, 9 aa, Homo Sapiens
TMLIFIVVT

SEQ ID NO: 1061239 - protein, 9 aa, Homo Sapiens
APENPIFRF

SEQ ID NO: 1061240 - protein, 9 aa, Homo Sapiens
LCSCRMKGF

SEQ ID NO: 1061241 - protein, 9 aa, Homo Sapiens
RSAASFGFF

SEQ ID NO: 1061242 - protein, 9 aa, Homo Sapiens
GDLLPGHGA

SEQ ID NO: 1061243 - protein, 9 aa, Homo Sapiens
DQRHAENKP

SEQ ID NO: 1061244 - protein, 9 aa, Homo Sapiens
LEDLLERIS

SEQ ID NO: 1061245 - protein, 9 aa, Homo Sapiens
EDRMKCESP

SEQ ID NO: 1061246 - protein, 9 aa, Homo Sapiens
LDLGGSSDL

SEQ ID NO: 1061247 - protein, 9 aa, Homo Sapiens
ETLERLVDP

SEQ ID NO: 1061248 - protein, 9 aa, Homo Sapiens
QTFSILVRA

SEQ ID NO: 1061249 - protein, 9 aa, Homo Sapiens
LMDCNRFFR

SEQ ID NO: 1061250 - protein, 9 aa, Homo Sapiens
EWFDGKDFE

SEQ ID NO: 1061251 - protein, 9 aa, Homo Sapiens
KEKLQRELQ

SEQ ID NO: 1061252 - protein, 9 aa, Homo Sapiens
YKHLDGFEG

SEQ ID NO: 1061253 - protein, 9 aa, Homo Sapiens
YNKIFFKEQ

SEQ ID NO: 1061254 - protein, 9 aa, Homo Sapiens
QSFNLETAM

SEQ ID NO: 1061255 - protein, 9 aa, Homo Sapiens
VVLLALLGT

SEQ ID NO: 1061256 - protein, 9 aa, Homo Sapiens
VRNIMTYYQ

SEQ ID NO: 1061257 - protein, 9 aa, Homo Sapiens
GEGKTGGFR

SEQ ID NO: 1061258 - protein, 9 aa, Homo Sapiens
PADLKALQR

SEQ ID NO: 1061259 - protein, 9 aa, Homo Sapiens
MHLLEGLVG

SEQ ID NO: 1061260 - protein, 9 aa, Homo Sapiens
AKGMSLGVK

SEQ ID NO: 1061261 - protein, 9 aa, Homo Sapiens
RSCYLTEYS

SEQ ID NO: 1061262 - protein, 9 aa, Homo Sapiens
QVLPPSELF

SEQ ID NO: 1061263 - protein, 9 aa, Homo Sapiens
IVDGEQTVL

SEQ ID NO: 1061264 - protein, 9 aa, Homo Sapiens
SMYVVTVVE

SEQ ID NO: 1061265 - protein, 9 aa, Homo Sapiens
SSQSLVVHD

SEQ ID NO: 1061266 - protein, 9 aa, Homo Sapiens
KIQFFLFAI

SEQ ID NO: 1061267 - protein, 9 aa, Homo Sapiens
SFHSFPQLA

SEQ ID NO: 1061268 - protein, 9 aa, Homo Sapiens
VLSNEYQVV

SEQ ID NO: 1061269 - protein, 9 aa, Homo Sapiens
HIGWMQEFL

SEQ ID NO: 1061270 - protein, 9 aa, Homo Sapiens
IFSERDNLV

SEQ ID NO: 1061271 - protein, 9 aa, Homo Sapiens
REICKVLDA

SEQ ID NO: 1061272 - protein, 9 aa, Homo Sapiens
RTVFSSLGL

SEQ ID NO: 1061273 - protein, 9 aa, Homo Sapiens
TRSKAKELL

SEQ ID NO: 1061274 - protein, 9 aa, Homo Sapiens
SQEAVFFFK

SEQ ID NO: 1061275 - protein, 9 aa, Homo Sapiens
SAQYQIKKQ

SEQ ID NO: 1061276 - protein, 9 aa, Homo Sapiens
FLWSLLGSI

SEQ ID NO: 1061277 - protein, 9 aa, Homo Sapiens
LLLPASTHR

SEQ ID NO: 1061278 - protein, 9 aa, Homo Sapiens
QPKLQMRVL

SEQ ID NO: 1061279 - protein, 9 aa, Homo Sapiens
GILLWLKGM

SEQ ID NO: 1061280 - protein, 9 aa, Homo Sapiens
GHKFFQRCG

SEQ ID NO: 1061281 - protein, 9 aa, Homo Sapiens
KKVTWTING

SEQ ID NO: 1061282 - protein, 9 aa, Homo Sapiens
WIGAALLIL

SEQ ID NO: 1061283 - protein, 9 aa, Homo Sapiens
SSIQPTGNM

SEQ ID NO: 1061284 - protein, 9 aa, Homo Sapiens
INQAFSKRN

SEQ ID NO: 1061285 - protein, 9 aa, Homo Sapiens
GPRRLYAFG

SEQ ID NO: 1061286 - protein, 9 aa, Homo Sapiens
REKDALHSE

SEQ ID NO: 1061287 - protein, 9 aa, Homo Sapiens
ENFIWEPPR

SEQ ID NO: 1061288 - protein, 9 aa, Homo Sapiens
GKFANFIKE

SEQ ID NO: 1061289 - protein, 9 aa, Homo Sapiens
SLTLFLISL

SEQ ID NO: 1061290 - protein, 9 aa, Homo Sapiens
QKAIPAVAR

SEQ ID NO: 1061291 - protein, 9 aa, Homo Sapiens
DTDFLEDPN

SEQ ID NO: 1061292 - protein, 9 aa, Homo Sapiens
FSPTLRLLE

SEQ ID NO: 1061293 - protein, 9 aa, Homo Sapiens
ASGALPGSH

SEQ ID NO: 1061294 - protein, 9 aa, Homo Sapiens
SYWEVGLFL

SEQ ID NO: 1061295 - protein, 9 aa, Homo Sapiens
NKAKPIGFT

SEQ ID NO: 1061296 - protein, 9 aa, Homo Sapiens
NQQRWTLGL

SEQ ID NO: 1061297 - protein, 9 aa, Homo Sapiens
LRRDSKKKS

SEQ ID NO: 1061298 - protein, 9 aa, Homo Sapiens
GKFLFYQRL

SEQ ID NO: 1061299 - protein, 9 aa, Homo Sapiens
SKQAVTVFY

SEQ ID NO: 1061300 - protein, 9 aa, Homo Sapiens
TRRETHILC

SEQ ID NO: 1061301 - protein, 9 aa, Homo Sapiens
LEFVSVPGT

SEQ ID NO: 1061302 - protein, 9 aa, Homo Sapiens
AKKIVHRYY

SEQ ID NO: 1061303 - protein, 9 aa, Homo Sapiens
HALRKKIDM

SEQ ID NO: 1061304 - protein, 9 aa, Homo Sapiens
MSQGLSWHN

SEQ ID NO: 1061305 - protein, 9 aa, Homo Sapiens
SHVFASSRW

SEQ ID NO: 1061306 - protein, 9 aa, Homo Sapiens
EKSIDNYYK

SEQ ID NO: 1061307 - protein, 9 aa, Homo Sapiens
LPVRGEHVM

SEQ ID NO: 1061308 - protein, 9 aa, Homo Sapiens
HNNYENVEA

SEQ ID NO: 1061309 - protein, 9 aa, Homo Sapiens
RATAPPRVL

SEQ ID NO: 1061310 - protein, 9 aa, Homo Sapiens
SSQKNTIVL

SEQ ID NO: 1061311 - protein, 9 aa, Homo Sapiens
MKKIYSRGE

SEQ ID NO: 1061312 - protein, 9 aa, Homo Sapiens
LQERGGSCD

SEQ ID NO: 1061313 - protein, 9 aa, Homo Sapiens
RFFRVDTAK

SEQ ID NO: 1061314 - protein, 9 aa, Homo Sapiens
LSYRFLGED

SEQ ID NO: 1061315 - protein, 9 aa, Homo Sapiens
CRDTDCVDQ

SEQ ID NO: 1061316 - protein, 9 aa, Homo Sapiens
ARKPPEQLP

SEQ ID NO: 1061317 - protein, 9 aa, Homo Sapiens
APPCPATFP

SEQ ID NO: 1061318 - protein, 9 aa, Homo Sapiens
LYTYSRGQI

SEQ ID NO: 1061319 - protein, 9 aa, Homo Sapiens
LLMSVCLGR

SEQ ID NO: 1061320 - protein, 9 aa, Homo Sapiens
PEAVTTMTI

SEQ ID NO: 1061321 - protein, 9 aa, Homo Sapiens
AKNMELTYL

SEQ ID NO: 1061322 - protein, 9 aa, Homo Sapiens
GALLDKDVF

SEQ ID NO: 1061323 - protein, 9 aa, Homo Sapiens
KISSILEKG

SEQ ID NO: 1061324 - protein, 9 aa, Homo Sapiens
SMSEFLSIP

SEQ ID NO: 1061325 - protein, 9 aa, Homo Sapiens
YTLQGIESG

SEQ ID NO: 1061326 - protein, 9 aa, Homo Sapiens
PGRNGTPRE

SEQ ID NO: 1061327 - protein, 9 aa, Homo Sapiens
AEELPQPRK

SEQ ID NO: 1061328 - protein, 9 aa, Homo Sapiens
VSSHTVVAR

SEQ ID NO: 1061329 - protein, 9 aa, Homo Sapiens
IIYKVFCHT

SEQ ID NO: 1061330 - protein, 9 aa, Homo Sapiens
IFLTSVCVC

SEQ ID NO: 1061331 - protein, 9 aa, Homo Sapiens
PAASLGSQE

SEQ ID NO: 1061332 - protein, 9 aa, Homo Sapiens
YRLKAELEA

SEQ ID NO: 1061333 - protein, 9 aa, Homo Sapiens
SDGPFWDSD

SEQ ID NO: 1061334 - protein, 9 aa, Homo Sapiens
YKFKKYVLG

SEQ ID NO: 1061335 - protein, 9 aa, Homo Sapiens
FSVALLDRE

SEQ ID NO: 1061336 - protein, 9 aa, Homo Sapiens
LSALFFSET

SEQ ID NO: 1061337 - protein, 9 aa, Homo Sapiens
KSQERKTEA

SEQ ID NO: 1061338 - protein, 9 aa, Homo Sapiens
SFVPVAYDT

SEQ ID NO: 1061339 - protein, 9 aa, Homo Sapiens
ESFGSLYTQ

SEQ ID NO: 1061340 - protein, 9 aa, Homo Sapiens
KDGKELSDE

SEQ ID NO: 1061341 - protein, 9 aa, Homo Sapiens
CAFSRTKDS

SEQ ID NO: 1061342 - protein, 9 aa, Homo Sapiens
RELPIPGDG

SEQ ID NO: 1061343 - protein, 9 aa, Homo Sapiens
EAEEYEDTM

SEQ ID NO: 1061344 - protein, 9 aa, Homo Sapiens
GTSGHSSIN

SEQ ID NO: 1061345 - protein, 9 aa, Homo Sapiens
SIKKMEDTS

SEQ ID NO: 1061346 - protein, 9 aa, Homo Sapiens
VLVVFFGFL

SEQ ID NO: 1061347 - protein, 9 aa, Homo Sapiens
WEQTLPDGP

SEQ ID NO: 1061348 - protein, 9 aa, Homo Sapiens
VGGLRYKAP

SEQ ID NO: 1061349 - protein, 9 aa, Homo Sapiens
KALDLPFSS

SEQ ID NO: 1061350 - protein, 9 aa, Homo Sapiens
CFAWVEADG

SEQ ID NO: 1061351 - protein, 9 aa, Homo Sapiens
IKQAQTVAE

SEQ ID NO: 1061352 - protein, 9 aa, Homo Sapiens
TSICKQQTN

SEQ ID NO: 1061353 - protein, 9 aa, Homo Sapiens
SGEEQQSYG

SEQ ID NO: 1061354 - protein, 9 aa, Homo Sapiens
AEIRAQDAS

SEQ ID NO: 1061355 - protein, 9 aa, Homo Sapiens
KELAVAVAE

SEQ ID NO: 1061356 - protein, 9 aa, Homo Sapiens
SKNFERAKA

SEQ ID NO: 1061357 - protein, 9 aa, Homo Sapiens
TTAKPAAPL

SEQ ID NO: 1061358 - protein, 9 aa, Homo Sapiens
KSENSIEDI

SEQ ID NO: 1061359 - protein, 9 aa, Homo Sapiens
GSAFLGDDT

SEQ ID NO: 1061360 - protein, 9 aa, Homo Sapiens
VFFYQLSHF

SEQ ID NO: 1061361 - protein, 9 aa, Homo Sapiens
SSKAASFFF

SEQ ID NO: 1061362 - protein, 9 aa, Homo Sapiens
GVTNGYNYA

SEQ ID NO: 1061363 - protein, 9 aa, Homo Sapiens
PPLPSGLSF

SEQ ID NO: 1061364 - protein, 9 aa, Homo Sapiens
GYVLSKDKC

SEQ ID NO: 1061365 - protein, 9 aa, Homo Sapiens
HPPEDPRLF

SEQ ID NO: 1061366 - protein, 9 aa, Homo Sapiens
EVSVENGFV

SEQ ID NO: 1061367 - protein, 9 aa, Homo Sapiens
LQNGEQDKE

SEQ ID NO: 1061368 - protein, 9 aa, Homo Sapiens
KKSTLDECL

SEQ ID NO: 1061369 - protein, 9 aa, Homo Sapiens
SKPTSRVGL

SEQ ID NO: 1061370 - protein, 9 aa, Homo Sapiens
MLVFLKLAC

SEQ ID NO: 1061371 - protein, 9 aa, Homo Sapiens
LSRPLPSTA

SEQ ID NO: 1061372 - protein, 9 aa, Homo Sapiens
FPKRCPKIR

SEQ ID NO: 1061373 - protein, 9 aa, Homo Sapiens
IFFSASYRE

SEQ ID NO: 1061374 - protein, 9 aa, Homo Sapiens
SDQRSPGIF

SEQ ID NO: 1061375 - protein, 9 aa, Homo Sapiens
VCHYCHEEN

SEQ ID NO: 1061376 - protein, 9 aa, Homo Sapiens
GEVDNMEDL

SEQ ID NO: 1061377 - protein, 9 aa, Homo Sapiens
QWKIDRNSI

SEQ ID NO: 1061378 - protein, 9 aa, Homo Sapiens
NEYQVVTSL

SEQ ID NO: 1061379 - protein, 9 aa, Homo Sapiens
ALPLHQVPD

SEQ ID NO: 1061380 - protein, 9 aa, Homo Sapiens
YSLENGSSG

SEQ ID NO: 1061381 - protein, 9 aa, Homo Sapiens
LLKNKLSHT

SEQ ID NO: 1061382 - protein, 9 aa, Homo Sapiens
KPCHDQEPH

SEQ ID NO: 1061383 - protein, 9 aa, Homo Sapiens
RDEDTLQNP

SEQ ID NO: 1061384 - protein, 9 aa, Homo Sapiens
APNCIVYCT

SEQ ID NO: 1061385 - protein, 9 aa, Homo Sapiens
LEPGDRDVA

SEQ ID NO: 1061386 - protein, 9 aa, Homo Sapiens
CYVALDFKQ

SEQ ID NO: 1061387 - protein, 9 aa, Homo Sapiens
HDPEHWPNP

SEQ ID NO: 1061388 - protein, 9 aa, Homo Sapiens
KCGKGTYSL

SEQ ID NO: 1061389 - protein, 9 aa, Homo Sapiens
KEWSQDFKD

SEQ ID NO: 1061390 - protein, 9 aa, Homo Sapiens
EAKSLCKMY

SEQ ID NO: 1061391 - protein, 9 aa, Homo Sapiens
QNLERVLSQ

SEQ ID NO: 1061392 - protein, 9 aa, Homo Sapiens
LVDMMEFFL

SEQ ID NO: 1061393 - protein, 9 aa, Homo Sapiens
EDFFSQGAD

SEQ ID NO: 1061394 - protein, 9 aa, Homo Sapiens
ELERLKPAS

SEQ ID NO: 1061395 - protein, 9 aa, Homo Sapiens
LAAGDILVL

SEQ ID NO: 1061396 - protein, 9 aa, Homo Sapiens
YRSAYVTPC

SEQ ID NO: 1061397 - protein, 9 aa, Homo Sapiens
GHMKVKGEA

SEQ ID NO: 1061398 - protein, 9 aa, Homo Sapiens
LREDITLWG

SEQ ID NO: 1061399 - protein, 9 aa, Homo Sapiens
IPLYKWEVV

SEQ ID NO: 1061400 - protein, 9 aa, Homo Sapiens
DCILQNQLE

SEQ ID NO: 1061401 - protein, 9 aa, Homo Sapiens
CENQKITLY

SEQ ID NO: 1061402 - protein, 9 aa, Homo Sapiens
PLFADQHNN

SEQ ID NO: 1061403 - protein, 9 aa, Homo Sapiens
SVQSSCSSL

SEQ ID NO: 1061404 - protein, 9 aa, Homo Sapiens
LILKGVKKE

SEQ ID NO: 1061405 - protein, 9 aa, Homo Sapiens
LQAVEPILT

SEQ ID NO: 1061406 - protein, 9 aa, Homo Sapiens
CLNEGVCSV

SEQ ID NO: 1061407 - protein, 9 aa, Homo Sapiens
PEIVSEPLE

SEQ ID NO: 1061408 - protein, 9 aa, Homo Sapiens
RSRERSSRR

SEQ ID NO: 1061409 - protein, 9 aa, Homo Sapiens
YISKTNEEL

SEQ ID NO: 1061410 - protein, 9 aa, Homo Sapiens
GSIQVPQSM

SEQ ID NO: 1061411 - protein, 9 aa, Homo Sapiens
PPGIVIVEK

SEQ ID NO: 1061412 - protein, 9 aa, Homo Sapiens
KTLAESMEI

SEQ ID NO: 1061413 - protein, 9 aa, Homo Sapiens
GICPQNITS

SEQ ID NO: 1061414 - protein, 9 aa, Homo Sapiens
VISLAGAQK

SEQ ID NO: 1061415 - protein, 9 aa, Homo Sapiens
NNRPASNVV

SEQ ID NO: 1061416 - protein, 9 aa, Homo Sapiens
TDLGHSRDS

SEQ ID NO: 1061417 - protein, 9 aa, Homo Sapiens
FIAMFICSK

SEQ ID NO: 1061418 - protein, 9 aa, Homo Sapiens
LSLNPINFI

SEQ ID NO: 1061419 - protein, 9 aa, Homo Sapiens
HEKSHLGIK

SEQ ID NO: 1061420 - protein, 9 aa, Homo Sapiens
WNIINPMGL

SEQ ID NO: 1061421 - protein, 9 aa, Homo Sapiens
ELFYNQKEG

SEQ ID NO: 1061422 - protein, 9 aa, Homo Sapiens
EIAGPGAEG

SEQ ID NO: 1061423 - protein, 9 aa, Homo Sapiens
CSSCHAFCY

SEQ ID NO: 1061424 - protein, 9 aa, Homo Sapiens
GGRFQQIQV

SEQ ID NO: 1061425 - protein, 9 aa, Homo Sapiens
SLEESSFGS

SEQ ID NO: 1061426 - protein, 9 aa, Homo Sapiens
MRTWYLVSI

SEQ ID NO: 1061427 - protein, 9 aa, Homo Sapiens
FESCDRIKE

SEQ ID NO: 1061428 - protein, 9 aa, Homo Sapiens
FQIGESFEE

SEQ ID NO: 1061429 - protein, 9 aa, Homo Sapiens
YLWSSFFSP

SEQ ID NO: 1061430 - protein, 9 aa, Homo Sapiens
DNNFVLIGS

SEQ ID NO: 1061431 - protein, 9 aa, Homo Sapiens
KKLKSFLKS

SEQ ID NO: 1061432 - protein, 9 aa, Homo Sapiens
KDKESYYIS

SEQ ID NO: 1061433 - protein, 9 aa, Homo Sapiens
FCYSNWLDK

SEQ ID NO: 1061434 - protein, 9 aa, Homo Sapiens
ARSKAIYVN

SEQ ID NO: 1061435 - protein, 9 aa, Homo Sapiens
YHPTKSHLF

SEQ ID NO: 1061436 - protein, 9 aa, Homo Sapiens
TNEATNITP

SEQ ID NO: 1061437 - protein, 9 aa, Homo Sapiens
SGAYHLSCL

SEQ ID NO: 1061438 - protein, 9 aa, Homo Sapiens
MFRGVGDQR

SEQ ID NO: 1061439 - protein, 9 aa, Homo Sapiens
IFFVGPVSP

SEQ ID NO: 1061440 - protein, 9 aa, Homo Sapiens
VLDKADSPR

SEQ ID NO: 1061441 - protein, 9 aa, Homo Sapiens
QGDSGGSLV

SEQ ID NO: 1061442 - protein, 9 aa, Homo Sapiens
EKIYSGEKP

SEQ ID NO: 1061443 - protein, 9 aa, Homo Sapiens
DILDGTDCH

SEQ ID NO: 1061444 - protein, 9 aa, Homo Sapiens
KKNYPSLEL

SEQ ID NO: 1061445 - protein, 9 aa, Homo Sapiens
LASGDTTCP

SEQ ID NO: 1061446 - protein, 9 aa, Homo Sapiens
HSNPDCQEK

SEQ ID NO: 1061447 - protein, 9 aa, Homo Sapiens
VIMRGSSEE

SEQ ID NO: 1061448 - protein, 9 aa, Homo Sapiens
KMRIRFTSP

SEQ ID NO: 1061449 - protein, 9 aa, Homo Sapiens
LSPLAREDD

SEQ ID NO: 1061450 - protein, 9 aa, Homo Sapiens
PRWVPDCAF

SEQ ID NO: 1061451 - protein, 9 aa, Homo Sapiens
TMTSTYDAH

SEQ ID NO: 1061452 - protein, 9 aa, Homo Sapiens
KTKCDLWHL

SEQ ID NO: 1061453 - protein, 9 aa, Homo Sapiens
RPKPAGPRQ

SEQ ID NO: 1061454 - protein, 9 aa, Homo Sapiens
WEVGLFLGA

SEQ ID NO: 1061455 - protein, 9 aa, Homo Sapiens
HKVVGVFTV

SEQ ID NO: 1061456 - protein, 9 aa, Homo Sapiens
ATKARIPLY

SEQ ID NO: 1061457 - protein, 9 aa, Homo Sapiens
NPPVPPSED

SEQ ID NO: 1061458 - protein, 9 aa, Homo Sapiens
LLRPVFVLR

SEQ ID NO: 1061459 - protein, 9 aa, Homo Sapiens
TFFPALHKS

SEQ ID NO: 1061460 - protein, 9 aa, Homo Sapiens
SSYLWSSFF

SEQ ID NO: 1061461 - protein, 9 aa, Homo Sapiens
KTGKKRKGS

SEQ ID NO: 1061462 - protein, 9 aa, Homo Sapiens
DYDTPAEIC

SEQ ID NO: 1061463 - protein, 9 aa, Homo Sapiens
FPYGPSPLG

SEQ ID NO: 1061464 - protein, 9 aa, Homo Sapiens
KDFYYSLKR

SEQ ID NO: 1061465 - protein, 9 aa, Homo Sapiens
FGKHLFPVA

SEQ ID NO: 1061466 - protein, 9 aa, Homo Sapiens
NFIWEPPRK

SEQ ID NO: 1061467 - protein, 9 aa, Homo Sapiens
DYFRLLFQE

SEQ ID NO: 1061468 - protein, 9 aa, Homo Sapiens
IVKNGGTSM

SEQ ID NO: 1061469 - protein, 9 aa, Homo Sapiens
LGSALYFFF

SEQ ID NO: 1061470 - protein, 9 aa, Homo Sapiens
LDIGICFIE

SEQ ID NO: 1061471 - protein, 9 aa, Homo Sapiens
SYVESVAQT

SEQ ID NO: 1061472 - protein, 9 aa, Homo Sapiens
NSSAVLLIG

SEQ ID NO: 1061473 - protein, 9 aa, Homo Sapiens
EHLLCPSSP

SEQ ID NO: 1061474 - protein, 9 aa, Homo Sapiens
IDRNKHIYK

SEQ ID NO: 1061475 - protein, 9 aa, Homo Sapiens
SCDPRKALA

SEQ ID NO: 1061476 - protein, 9 aa, Homo Sapiens
KLYQCKECG

SEQ ID NO: 1061477 - protein, 9 aa, Homo Sapiens
RSSRRERER

SEQ ID NO: 1061478 - protein, 9 aa, Homo Sapiens
GRRVTQVMR

SEQ ID NO: 1061479 - protein, 9 aa, Homo Sapiens
KHVLQSSLS

SEQ ID NO: 1061480 - protein, 9 aa, Homo Sapiens
FFVGPVSPN

SEQ ID NO: 1061481 - protein, 9 aa, Homo Sapiens
AGGINFNEC

SEQ ID NO: 1061482 - protein, 9 aa, Homo Sapiens
GGGGRFQQI

SEQ ID NO: 1061483 - protein, 9 aa, Homo Sapiens
SRYLLAHFS

SEQ ID NO: 1061484 - protein, 9 aa, Homo Sapiens
LICQVLDAV

SEQ ID NO: 1061485 - protein, 9 aa, Homo Sapiens
QKTVSAKKS

SEQ ID NO: 1061486 - protein, 9 aa, Homo Sapiens
VSPLPVRGE

SEQ ID NO: 1061487 - protein, 9 aa, Homo Sapiens
EKSPSTFHD

SEQ ID NO: 1061488 - protein, 9 aa, Homo Sapiens
QVYVLSEEK

SEQ ID NO: 1061489 - protein, 9 aa, Homo Sapiens
SSLASGDTT

SEQ ID NO: 1061490 - protein, 9 aa, Homo Sapiens
AQSGSDSSS

SEQ ID NO: 1061491 - protein, 9 aa, Homo Sapiens
LAGWRGTFC

SEQ ID NO: 1061492 - protein, 9 aa, Homo Sapiens
GCEIQSFFF

SEQ ID NO: 1061493 - protein, 9 aa, Homo Sapiens
ASGSQDSGK

SEQ ID NO: 1061494 - protein, 9 aa, Homo Sapiens
ARIPLEYTV

SEQ ID NO: 1061495 - protein, 9 aa, Homo Sapiens
RYSSSLLEF

SEQ ID NO: 1061496 - protein, 9 aa, Homo Sapiens
IKIDGQKKW

SEQ ID NO: 1061497 - protein, 9 aa, Homo Sapiens
GVIAGVAPF

SEQ ID NO: 1061498 - protein, 9 aa, Homo Sapiens
GTYDLDTLS

SEQ ID NO: 1061499 - protein, 9 aa, Homo Sapiens
VVPPTFQGR

SEQ ID NO: 1061500 - protein, 9 aa, Homo Sapiens
RLWDFLRQI

SEQ ID NO: 1061501 - protein, 9 aa, Homo Sapiens
LVDNAEVER

SEQ ID NO: 1061502 - protein, 9 aa, Homo Sapiens
DEDKDEDED

SEQ ID NO: 1061503 - protein, 9 aa, Homo Sapiens
LIVTLKNGM

SEQ ID NO: 1061504 - protein, 9 aa, Homo Sapiens
KKFLGRPMC

SEQ ID NO: 1061505 - protein, 9 aa, Homo Sapiens
QIIFFFLAL

SEQ ID NO: 1061506 - protein, 9 aa, Homo Sapiens
NAIFFTWDI

SEQ ID NO: 1061507 - protein, 9 aa, Homo Sapiens
FETCSSHLT

SEQ ID NO: 1061508 - protein, 9 aa, Homo Sapiens
AVARTDGLW

SEQ ID NO: 1061509 - protein, 9 aa, Homo Sapiens
NSCEGMSRH

SEQ ID NO: 1061510 - protein, 9 aa, Homo Sapiens
TGYLDPSSR

SEQ ID NO: 1061511 - protein, 9 aa, Homo Sapiens
AVYSLWKID

SEQ ID NO: 1061512 - protein, 9 aa, Homo Sapiens
VHNNRPASN

SEQ ID NO: 1061513 - protein, 9 aa, Homo Sapiens
RCEECGKAS

SEQ ID NO: 1061514 - protein, 9 aa, Homo Sapiens
GLGHIYLGT

SEQ ID NO: 1061515 - protein, 9 aa, Homo Sapiens
KLLLFSSVI

SEQ ID NO: 1061516 - protein, 9 aa, Homo Sapiens
SENLPNHIL

SEQ ID NO: 1061517 - protein, 9 aa, Homo Sapiens
NLFSKEGRQ

SEQ ID NO: 1061518 - protein, 9 aa, Homo Sapiens
PSSVPHGAD

SEQ ID NO: 1061519 - protein, 9 aa, Homo Sapiens
SSSDTGPTL

SEQ ID NO: 1061520 - protein, 9 aa, Homo Sapiens
HQLAFQHRP

SEQ ID NO: 1061521 - protein, 9 aa, Homo Sapiens
RFMGTISNV

SEQ ID NO: 1061522 - protein, 9 aa, Homo Sapiens
SFKDQTPLQ

SEQ ID NO: 1061523 - protein, 9 aa, Homo Sapiens
TTRHPELRR

SEQ ID NO: 1061524 - protein, 9 aa, Homo Sapiens
VDNLFEDMK

SEQ ID NO: 1061525 - protein, 9 aa, Homo Sapiens
SNMYPMPNT

SEQ ID NO: 1061526 - protein, 9 aa, Homo Sapiens
AAVETANLS

SEQ ID NO: 1061527 - protein, 9 aa, Homo Sapiens
LPPELDIFP

SEQ ID NO: 1061528 - protein, 9 aa, Homo Sapiens
SALHFPFTS

SEQ ID NO: 1061529 - protein, 9 aa, Homo Sapiens
QEHGAKLKI

SEQ ID NO: 1061530 - protein, 9 aa, Homo Sapiens
PYPGTEKES

SEQ ID NO: 1061531 - protein, 9 aa, Homo Sapiens
LDKADSPRH

SEQ ID NO: 1061532 - protein, 9 aa, Homo Sapiens
TIWLHDPGA

SEQ ID NO: 1061533 - protein, 9 aa, Homo Sapiens
PLSENLPNH

SEQ ID NO: 1061534 - protein, 9 aa, Homo Sapiens
FYIRIFSTV

SEQ ID NO: 1061535 - protein, 9 aa, Homo Sapiens
KNGGTSMMV

SEQ ID NO: 1061536 - protein, 9 aa, Homo Sapiens
GEAEARPHR

SEQ ID NO: 1061537 - protein, 9 aa, Homo Sapiens
LSKNSDIKQ

SEQ ID NO: 1061538 - protein, 9 aa, Homo Sapiens
PRLGEEFIR

SEQ ID NO: 1061539 - protein, 9 aa, Homo Sapiens
EKAHAHCRV

SEQ ID NO: 1061540 - protein, 9 aa, Homo Sapiens
RYSILEELE

SEQ ID NO: 1061541 - protein, 9 aa, Homo Sapiens
PEAREDPIL

SEQ ID NO: 1061542 - protein, 9 aa, Homo Sapiens
YQLLYHSAN

SEQ ID NO: 1061543 - protein, 9 aa, Homo Sapiens
MSLSSSQSL

SEQ ID NO: 1061544 - protein, 9 aa, Homo Sapiens
AMGGLEISL

SEQ ID NO: 1061545 - protein, 9 aa, Homo Sapiens
TKKRKRKYK

SEQ ID NO: 1061546 - protein, 9 aa, Homo Sapiens
LRTCVKTTG

SEQ ID NO: 1061547 - protein, 9 aa, Homo Sapiens
PSASAAWSP

SEQ ID NO: 1061548 - protein, 9 aa, Homo Sapiens
CSKVFKYLC

SEQ ID NO: 1061549 - protein, 9 aa, Homo Sapiens
SERSCGVTV

SEQ ID NO: 1061550 - protein, 9 aa, Homo Sapiens
TKRKKMSLV

SEQ ID NO: 1061551 - protein, 9 aa, Homo Sapiens
NSLEDPVTG

SEQ ID NO: 1061552 - protein, 9 aa, Homo Sapiens
KEYGVYLED

SEQ ID NO: 1061553 - protein, 9 aa, Homo Sapiens
SNNHIEVQA

SEQ ID NO: 1061554 - protein, 9 aa, Homo Sapiens
VGRMQKGIN

SEQ ID NO: 1061555 - protein, 9 aa, Homo Sapiens
ADLPLPSEL

SEQ ID NO: 1061556 - protein, 9 aa, Homo Sapiens
RKYAANKFI

SEQ ID NO: 1061557 - protein, 9 aa, Homo Sapiens
KKKRKVKEE

SEQ ID NO: 1061558 - protein, 9 aa, Homo Sapiens
LENSDEFKL

SEQ ID NO: 1061559 - protein, 9 aa, Homo Sapiens
SRKNCWKFF

SEQ ID NO: 1061560 - protein, 9 aa, Homo Sapiens
TYAEINQAF

SEQ ID NO: 1061561 - protein, 9 aa, Homo Sapiens
QLFHCLHES

SEQ ID NO: 1061562 - protein, 9 aa, Homo Sapiens
YSFLETELK

SEQ ID NO: 1061563 - protein, 9 aa, Homo Sapiens
TSSLPEPKP

SEQ ID NO: 1061564 - protein, 9 aa, Homo Sapiens
KLILSTTGY

SEQ ID NO: 1061565 - protein, 9 aa, Homo Sapiens
SGLRQLLFS

SEQ ID NO: 1061566 - protein, 9 aa, Homo Sapiens
NWEYIQDPR

SEQ ID NO: 1061567 - protein, 9 aa, Homo Sapiens
QFSDRKQDI

SEQ ID NO: 1061568 - protein, 9 aa, Homo Sapiens
RVIINIAEL

SEQ ID NO: 1061569 - protein, 9 aa, Homo Sapiens
AALEDKNSF

SEQ ID NO: 1061570 - protein, 9 aa, Homo Sapiens
SRLITTSAS

SEQ ID NO: 1061571 - protein, 9 aa, Homo Sapiens
GTIKDYPDD

SEQ ID NO: 1061572 - protein, 9 aa, Homo Sapiens
GICPYKCNV

SEQ ID NO: 1061573 - protein, 9 aa, Homo Sapiens
PLQAKMGKR

SEQ ID NO: 1061574 - protein, 9 aa, Homo Sapiens
DAPHCSTVE

SEQ ID NO: 1061575 - protein, 9 aa, Homo Sapiens
GNQKLHHDM

SEQ ID NO: 1061576 - protein, 9 aa, Homo Sapiens
GNADFTVKI

SEQ ID NO: 1061577 - protein, 9 aa, Homo Sapiens
WRSFSLLEE

SEQ ID NO: 1061578 - protein, 9 aa, Homo Sapiens
AEPTLGARR

SEQ ID NO: 1061579 - protein, 9 aa, Homo Sapiens
LRSATRMVQ

SEQ ID NO: 1061580 - protein, 9 aa, Homo Sapiens
VEDTYPETL

SEQ ID NO: 1061581 - protein, 9 aa, Homo Sapiens
KNGTFVVNI

SEQ ID NO: 1061582 - protein, 9 aa, Homo Sapiens
IPVQQSVCT

SEQ ID NO: 1061583 - protein, 9 aa, Homo Sapiens
ENEAKPSTA

SEQ ID NO: 1061584 - protein, 9 aa, Homo Sapiens
EEPSRKNST

SEQ ID NO: 1061585 - protein, 9 aa, Homo Sapiens
FMVALNVEF

SEQ ID NO: 1061586 - protein, 9 aa, Homo Sapiens
TAKLNPGPL

SEQ ID NO: 1061587 - protein, 9 aa, Homo Sapiens
IIQGGKHQE

SEQ ID NO: 1061588 - protein, 9 aa, Homo Sapiens
NYWRGLFAA

SEQ ID NO: 1061589 - protein, 9 aa, Homo Sapiens
QVMRDFLHA

SEQ ID NO: 1061590 - protein, 9 aa, Homo Sapiens
PGSPGPAGS

SEQ ID NO: 1061591 - protein, 9 aa, Homo Sapiens
IRYLSHFCC

SEQ ID NO: 1061592 - protein, 9 aa, Homo Sapiens
LETFTPQHH

SEQ ID NO: 1061593 - protein, 9 aa, Homo Sapiens
GLIAVHPFG

SEQ ID NO: 1061594 - protein, 9 aa, Homo Sapiens
QSKNELVME

SEQ ID NO: 1061595 - protein, 9 aa, Homo Sapiens
IYCNSNSQI

SEQ ID NO: 1061596 - protein, 9 aa, Homo Sapiens
GTSGEQEGL

SEQ ID NO: 1061597 - protein, 9 aa, Homo Sapiens
DKANQLVKQ

SEQ ID NO: 1061598 - protein, 9 aa, Homo Sapiens
PQQPRGQLD

SEQ ID NO: 1061599 - protein, 9 aa, Homo Sapiens
WWLAVVIRI

SEQ ID NO: 1061600 - protein, 9 aa, Homo Sapiens
NEKAILKQN

SEQ ID NO: 1061601 - protein, 9 aa, Homo Sapiens
YNSYSYYPY

SEQ ID NO: 1061602 - protein, 9 aa, Homo Sapiens
ICDISCNKF

SEQ ID NO: 1061603 - protein, 9 aa, Homo Sapiens
HKLGHVVGF

SEQ ID NO: 1061604 - protein, 9 aa, Homo Sapiens
PHLETLYNN

SEQ ID NO: 1061605 - protein, 9 aa, Homo Sapiens
KGLRWENGL

SEQ ID NO: 1061606 - protein, 9 aa, Homo Sapiens
RSKAGAELF

SEQ ID NO: 1061607 - protein, 9 aa, Homo Sapiens
QDDPCADNL

SEQ ID NO: 1061608 - protein, 9 aa, Homo Sapiens
TLEKLLASE

SEQ ID NO: 1061609 - protein, 9 aa, Homo Sapiens
TRYHPIDYY

SEQ ID NO: 1061610 - protein, 9 aa, Homo Sapiens
PSQPPSFLA

SEQ ID NO: 1061611 - protein, 9 aa, Homo Sapiens
KTDYIFSER

SEQ ID NO: 1061612 - protein, 9 aa, Homo Sapiens
FWPVKLNDT

SEQ ID NO: 1061613 - protein, 9 aa, Homo Sapiens
KHQENKVFM

SEQ ID NO: 1061614 - protein, 9 aa, Homo Sapiens
PERLRLVGS

SEQ ID NO: 1061615 - protein, 9 aa, Homo Sapiens
AFSYRHYCT

SEQ ID NO: 1061616 - protein, 9 aa, Homo Sapiens
VIIEISTRA

SEQ ID NO: 1061617 - protein, 9 aa, Homo Sapiens
KCKRNLEIS

SEQ ID NO: 1061618 - protein, 9 aa, Homo Sapiens
SKKYRKLQT

SEQ ID NO: 1061619 - protein, 9 aa, Homo Sapiens
PNGTLLIYN

SEQ ID NO: 1061620 - protein, 9 aa, Homo Sapiens
SQPPPPQSA

SEQ ID NO: 1061621 - protein, 9 aa, Homo Sapiens
GPLNPDFQR

SEQ ID NO: 1061622 - protein, 9 aa, Homo Sapiens
NFQPPLCKD

SEQ ID NO: 1061623 - protein, 9 aa, Homo Sapiens
LKVSTDKED

SEQ ID NO: 1061624 - protein, 9 aa, Homo Sapiens
PQVFKSLEE

SEQ ID NO: 1061625 - protein, 9 aa, Homo Sapiens
YIKQPAGAS

SEQ ID NO: 1061626 - protein, 9 aa, Homo Sapiens
LEHSSNPSA

SEQ ID NO: 1061627 - protein, 9 aa, Homo Sapiens
CVITKDCQV

SEQ ID NO: 1061628 - protein, 9 aa, Homo Sapiens
PFQGFRFGT

SEQ ID NO: 1061629 - protein, 9 aa, Homo Sapiens
KIKKKGNPE

SEQ ID NO: 1061630 - protein, 9 aa, Homo Sapiens
RFVDSNGEL

SEQ ID NO: 1061631 - protein, 9 aa, Homo Sapiens
EGYRIGLPQ

SEQ ID NO: 1061632 - protein, 9 aa, Homo Sapiens
SFEKFSAVV

SEQ ID NO: 1061633 - protein, 9 aa, Homo Sapiens
YRLEDISMA

SEQ ID NO: 1061634 - protein, 9 aa, Homo Sapiens
LPPRPEVDL

SEQ ID NO: 1061635 - protein, 9 aa, Homo Sapiens
KLTSNRRTS

SEQ ID NO: 1061636 - protein, 9 aa, Homo Sapiens
SWTVSEGQF

SEQ ID NO: 1061637 - protein, 9 aa, Homo Sapiens
LELEGGETP

SEQ ID NO: 1061638 - protein, 9 aa, Homo Sapiens
RNMSGRYSP

SEQ ID NO: 1061639 - protein, 9 aa, Homo Sapiens
ETWNSFLSG

SEQ ID NO: 1061640 - protein, 9 aa, Homo Sapiens
RELQVQNST

SEQ ID NO: 1061641 - protein, 9 aa, Homo Sapiens
TVQENEATA

SEQ ID NO: 1061642 - protein, 9 aa, Homo Sapiens
HAQLHCRCP

SEQ ID NO: 1061643 - protein, 9 aa, Homo Sapiens
SSEESKIQT

SEQ ID NO: 1061644 - protein, 9 aa, Homo Sapiens
IIMMNYVYK

SEQ ID NO: 1061645 - protein, 9 aa, Homo Sapiens
SDVSSQKNV

SEQ ID NO: 1061646 - protein, 9 aa, Homo Sapiens
KPEEEFDSH

SEQ ID NO: 1061647 - protein, 9 aa, Homo Sapiens
KVFYNIGTM

SEQ ID NO: 1061648 - protein, 9 aa, Homo Sapiens
NSFLREVES

SEQ ID NO: 1061649 - protein, 9 aa, Homo Sapiens
LFPKPRKNV

SEQ ID NO: 1061650 - protein, 9 aa, Homo Sapiens
EVERKKLKL

SEQ ID NO: 1061651 - protein, 9 aa, Homo Sapiens
RQNSGEASL

SEQ ID NO: 1061652 - protein, 9 aa, Homo Sapiens
EAYLKENIG

SEQ ID NO: 1061653 - protein, 9 aa, Homo Sapiens
KLKIIKIDG

SEQ ID NO: 1061654 - protein, 9 aa, Homo Sapiens
QKITLYSQA

SEQ ID NO: 1061655 - protein, 9 aa, Homo Sapiens
LHMAVQDLI

SEQ ID NO: 1061656 - protein, 9 aa, Homo Sapiens
HKLSSCNLE

SEQ ID NO: 1061657 - protein, 9 aa, Homo Sapiens
KMPIKKKEM

SEQ ID NO: 1061658 - protein, 9 aa, Homo Sapiens
CKMKVTKKV

SEQ ID NO: 1061659 - protein, 9 aa, Homo Sapiens
NVFSLLGIC

SEQ ID NO: 1061660 - protein, 9 aa, Homo Sapiens
NCSNSVSSL

SEQ ID NO: 1061661 - protein, 9 aa, Homo Sapiens
KVRKNFQKT

SEQ ID NO: 1061662 - protein, 9 aa, Homo Sapiens
SKDTFDDNS

SEQ ID NO: 1061663 - protein, 9 aa, Homo Sapiens
LKWTPPRDS

SEQ ID NO: 1061664 - protein, 9 aa, Homo Sapiens
FCGEEGLDY

SEQ ID NO: 1061665 - protein, 9 aa, Homo Sapiens
RSIQVTMVI

SEQ ID NO: 1061666 - protein, 9 aa, Homo Sapiens
HWYCKAFDV

SEQ ID NO: 1061667 - protein, 9 aa, Homo Sapiens
LLHMKKVGS

SEQ ID NO: 1061668 - protein, 9 aa, Homo Sapiens
AVYKCDECS

SEQ ID NO: 1061669 - protein, 9 aa, Homo Sapiens
PFCPYLKAF

SEQ ID NO: 1061670 - protein, 9 aa, Homo Sapiens
DDKIIQLVV

SEQ ID NO: 1061671 - protein, 9 aa, Homo Sapiens
HGLKLTRVT

SEQ ID NO: 1061672 - protein, 9 aa, Homo Sapiens
PQRTYYHGQ

SEQ ID NO: 1061673 - protein, 9 aa, Homo Sapiens
EEFLWSLLG

SEQ ID NO: 1061674 - protein, 9 aa, Homo Sapiens
IYSLEMKIS

SEQ ID NO: 1061675 - protein, 9 aa, Homo Sapiens
LQDNAVYEC

SEQ ID NO: 1061676 - protein, 9 aa, Homo Sapiens
VTHQKRWTR

SEQ ID NO: 1061677 - protein, 9 aa, Homo Sapiens
LFNGSLVDG

SEQ ID NO: 1061678 - protein, 9 aa, Homo Sapiens
CKQQTNNQT

SEQ ID NO: 1061679 - protein, 9 aa, Homo Sapiens
LQGDSAHKP

SEQ ID NO: 1061680 - protein, 9 aa, Homo Sapiens
AYLWMKRQK

SEQ ID NO: 1061681 - protein, 9 aa, Homo Sapiens
SLPGFSQNS

SEQ ID NO: 1061682 - protein, 9 aa, Homo Sapiens
GYVTAYGPG

SEQ ID NO: 1061683 - protein, 9 aa, Homo Sapiens
TKNLAGKTS

SEQ ID NO: 1061684 - protein, 9 aa, Homo Sapiens
EGAGFISGL

SEQ ID NO: 1061685 - protein, 9 aa, Homo Sapiens
TYFGLAAIS

SEQ ID NO: 1061686 - protein, 9 aa, Homo Sapiens
RVLKIFGAG

SEQ ID NO: 1061687 - protein, 9 aa, Homo Sapiens
VGYKLGIIS

SEQ ID NO: 1061688 - protein, 9 aa, Homo Sapiens
GFSSEENEE

SEQ ID NO: 1061689 - protein, 9 aa, Homo Sapiens
QLSGPGNNV

SEQ ID NO: 1061690 - protein, 9 aa, Homo Sapiens
GLGKKKEGE

SEQ ID NO: 1061691 - protein, 9 aa, Homo Sapiens
IAISGQVTE

SEQ ID NO: 1061692 - protein, 9 aa, Homo Sapiens
FDSANVAVL

SEQ ID NO: 1061693 - protein, 9 aa, Homo Sapiens
LGEEFIRGH

SEQ ID NO: 1061694 - protein, 9 aa, Homo Sapiens
TGPILENMW

SEQ ID NO: 1061695 - protein, 9 aa, Homo Sapiens
LESTEFLLG

SEQ ID NO: 1061696 - protein, 9 aa, Homo Sapiens
NPSVSLPGL

SEQ ID NO: 1061697 - protein, 9 aa, Homo Sapiens
VELTQEFPR

SEQ ID NO: 1061698 - protein, 9 aa, Homo Sapiens
LINQSFFFC

SEQ ID NO: 1061699 - protein, 9 aa, Homo Sapiens
VFQNKMANE

SEQ ID NO: 1061700 - protein, 9 aa, Homo Sapiens
RQSLGQGLK

SEQ ID NO: 1061701 - protein, 9 aa, Homo Sapiens
YQLRYTEEG

SEQ ID NO: 1061702 - protein, 9 aa, Homo Sapiens
SGSLPPRVC

SEQ ID NO: 1061703 - protein, 9 aa, Homo Sapiens
VCTGKKRYW

SEQ ID NO: 1061704 - protein, 9 aa, Homo Sapiens
SGPGLENRG

SEQ ID NO: 1061705 - protein, 9 aa, Homo Sapiens
FKKIKSYHV

SEQ ID NO: 1061706 - protein, 9 aa, Homo Sapiens
ASTAQPPEL

SEQ ID NO: 1061707 - protein, 9 aa, Homo Sapiens
STNCITRPP

SEQ ID NO: 1061708 - protein, 9 aa, Homo Sapiens
KRMRVVHKT

SEQ ID NO: 1061709 - protein, 9 aa, Homo Sapiens
LSSRSPPEM

SEQ ID NO: 1061710 - protein, 9 aa, Homo Sapiens
FGEGLPKAD

SEQ ID NO: 1061711 - protein, 9 aa, Homo Sapiens
AIFFAGCTA

SEQ ID NO: 1061712 - protein, 9 aa, Homo Sapiens
YKCVCDPVS

SEQ ID NO: 1061713 - protein, 9 aa, Homo Sapiens
IVTKYMSKG

SEQ ID NO: 1061714 - protein, 9 aa, Homo Sapiens
SEATVTLWM

SEQ ID NO: 1061715 - protein, 9 aa, Homo Sapiens
MKDESVLRE

SEQ ID NO: 1061716 - protein, 9 aa, Homo Sapiens
PKNETTEST

SEQ ID NO: 1061717 - protein, 9 aa, Homo Sapiens
AVNGYIEDA

SEQ ID NO: 1061718 - protein, 9 aa, Homo Sapiens
IESSIQPTG

SEQ ID NO: 1061719 - protein, 9 aa, Homo Sapiens
DPEHWPNPE

SEQ ID NO: 1061720 - protein, 9 aa, Homo Sapiens
PIDPRIQML

SEQ ID NO: 1061721 - protein, 9 aa, Homo Sapiens
AAVLQKIRD

SEQ ID NO: 1061722 - protein, 9 aa, Homo Sapiens
PPNTLQKAE

SEQ ID NO: 1061723 - protein, 9 aa, Homo Sapiens
GYPFGVYVS

SEQ ID NO: 1061724 - protein, 9 aa, Homo Sapiens
FRVEGLFRV

SEQ ID NO: 1061725 - protein, 9 aa, Homo Sapiens
VVHKTRNHL

SEQ ID NO: 1061726 - protein, 9 aa, Homo Sapiens
LAGADFLDS

SEQ ID NO: 1061727 - protein, 9 aa, Homo Sapiens
STPPAAFCL

SEQ ID NO: 1061728 - protein, 9 aa, Homo Sapiens
GIVIVEKIT

SEQ ID NO: 1061729 - protein, 9 aa, Homo Sapiens
FGSGSGFGF

SEQ ID NO: 1061730 - protein, 9 aa, Homo Sapiens
LLLICKSSF

SEQ ID NO: 1061731 - protein, 9 aa, Homo Sapiens
NYLVSSGLG

SEQ ID NO: 1061732 - protein, 9 aa, Homo Sapiens
LGPAQIISF

SEQ ID NO: 1061733 - protein, 9 aa, Homo Sapiens
LNGQDCRIV

SEQ ID NO: 1061734 - protein, 9 aa, Homo Sapiens
FLSGGRGED

SEQ ID NO: 1061735 - protein, 9 aa, Homo Sapiens
LVQYTGWFS

SEQ ID NO: 1061736 - protein, 9 aa, Homo Sapiens
HSLSEKKSA

SEQ ID NO: 1061737 - protein, 9 aa, Homo Sapiens
MLSRSKPGE

SEQ ID NO: 1061738 - protein, 9 aa, Homo Sapiens
PKANGLLNF

SEQ ID NO: 1061739 - protein, 9 aa, Homo Sapiens
PSSLPGFSQ

SEQ ID NO: 1061740 - protein, 9 aa, Homo Sapiens
SERDAEDKT

SEQ ID NO: 1061741 - protein, 9 aa, Homo Sapiens
EKTLTFEAA

SEQ ID NO: 1061742 - protein, 9 aa, Homo Sapiens
LMLRVNEYC

SEQ ID NO: 1061743 - protein, 9 aa, Homo Sapiens
ICLFLDKVI

SEQ ID NO: 1061744 - protein, 9 aa, Homo Sapiens
NKITKEDAV

SEQ ID NO: 1061745 - protein, 9 aa, Homo Sapiens
EQRYRLLEP

SEQ ID NO: 1061746 - protein, 9 aa, Homo Sapiens
YPKANGLLN

SEQ ID NO: 1061747 - protein, 9 aa, Homo Sapiens
VCSGEGIIN

SEQ ID NO: 1061748 - protein, 9 aa, Homo Sapiens
IILLLLICQ

SEQ ID NO: 1061749 - protein, 9 aa, Homo Sapiens
SLKETIYYL

SEQ ID NO: 1061750 - protein, 9 aa, Homo Sapiens
GTLLGVSFQ

SEQ ID NO: 1061751 - protein, 9 aa, Homo Sapiens
FATCFRSPF

SEQ ID NO: 1061752 - protein, 9 aa, Homo Sapiens
YGVFASEEK

SEQ ID NO: 1061753 - protein, 9 aa, Homo Sapiens
LFLYLFLLP

SEQ ID NO: 1061754 - protein, 9 aa, Homo Sapiens
MTLRLEKMA

SEQ ID NO: 1061755 - protein, 9 aa, Homo Sapiens
QALPHLTLG

SEQ ID NO: 1061756 - protein, 9 aa, Homo Sapiens
LRIPSLHLF

SEQ ID NO: 1061757 - protein, 9 aa, Homo Sapiens
AENEDEDKD

SEQ ID NO: 1061758 - protein, 9 aa, Homo Sapiens
LSPPQRTPV

SEQ ID NO: 1061759 - protein, 9 aa, Homo Sapiens
LVMNENDNV

SEQ ID NO: 1061760 - protein, 9 aa, Homo Sapiens
ESFFPDESQ

SEQ ID NO: 1061761 - protein, 9 aa, Homo Sapiens
TFEQDPTTF

SEQ ID NO: 1061762 - protein, 9 aa, Homo Sapiens
HLFFHLHTL

SEQ ID NO: 1061763 - protein, 9 aa, Homo Sapiens
VRAIQPGPR

SEQ ID NO: 1061764 - protein, 9 aa, Homo Sapiens
QQSCAFHDC

SEQ ID NO: 1061765 - protein, 9 aa, Homo Sapiens
GLWLWLCLL

SEQ ID NO: 1061766 - protein, 9 aa, Homo Sapiens
LREAEEEPL

SEQ ID NO: 1061767 - protein, 9 aa, Homo Sapiens
VKFLGFVVT

SEQ ID NO: 1061768 - protein, 9 aa, Homo Sapiens
AKKRKEENA

SEQ ID NO: 1061769 - protein, 9 aa, Homo Sapiens
NKAAWTSAH

SEQ ID NO: 1061770 - protein, 9 aa, Homo Sapiens
IFSYTQIVS

SEQ ID NO: 1061771 - protein, 9 aa, Homo Sapiens
SIFYATSFL

SEQ ID NO: 1061772 - protein, 9 aa, Homo Sapiens
SLLRPENVF

SEQ ID NO: 1061773 - protein, 9 aa, Homo Sapiens
MESFGSLYT

SEQ ID NO: 1061774 - protein, 9 aa, Homo Sapiens
EKSDGPFWD

SEQ ID NO: 1061775 - protein, 9 aa, Homo Sapiens
RGFSAQYQI

SEQ ID NO: 1061776 - protein, 9 aa, Homo Sapiens
ASKSFTVAE

SEQ ID NO: 1061777 - protein, 9 aa, Homo Sapiens
FAYWGVLNS

SEQ ID NO: 1061778 - protein, 9 aa, Homo Sapiens
GVLLFLIHL

SEQ ID NO: 1061779 - protein, 9 aa, Homo Sapiens
FMCPCYVRR

SEQ ID NO: 1061780 - protein, 9 aa, Homo Sapiens
SFQGGQTYE

SEQ ID NO: 1061781 - protein, 9 aa, Homo Sapiens
LTPSSQSKG

SEQ ID NO: 1061782 - protein, 9 aa, Homo Sapiens
GQGPPGSPE

SEQ ID NO: 1061783 - protein, 9 aa, Homo Sapiens
MLNRVVMAG

SEQ ID NO: 1061784 - protein, 9 aa, Homo Sapiens
SALEFTKKF

SEQ ID NO: 1061785 - protein, 9 aa, Homo Sapiens
KTILCLLPD

SEQ ID NO: 1061786 - protein, 9 aa, Homo Sapiens
INNQQETPV

SEQ ID NO: 1061787 - protein, 9 aa, Homo Sapiens
DFAFSPPSG

SEQ ID NO: 1061788 - protein, 9 aa, Homo Sapiens
VGSQEALKD

SEQ ID NO: 1061789 - protein, 9 aa, Homo Sapiens
AALALTLQN

SEQ ID NO: 1061790 - protein, 9 aa, Homo Sapiens
PESEFSGSP

SEQ ID NO: 1061791 - protein, 9 aa, Homo Sapiens
PGLDEPPSV

SEQ ID NO: 1061792 - protein, 9 aa, Homo Sapiens
AFETCSSHL

SEQ ID NO: 1061793 - protein, 9 aa, Homo Sapiens
ISVIIFVSH

SEQ ID NO: 1061794 - protein, 9 aa, Homo Sapiens
CKIAKMPGM

SEQ ID NO: 1061795 - protein, 9 aa, Homo Sapiens
SGGALNHFS

SEQ ID NO: 1061796 - protein, 9 aa, Homo Sapiens
TYNNLCVSE

SEQ ID NO: 1061797 - protein, 9 aa, Homo Sapiens
PRGQLDSRP

SEQ ID NO: 1061798 - protein, 9 aa, Homo Sapiens
QRVCFGEGL

SEQ ID NO: 1061799 - protein, 9 aa, Homo Sapiens
RLSDGNIYV

SEQ ID NO: 1061800 - protein, 9 aa, Homo Sapiens
QVQKHTDQI

SEQ ID NO: 1061801 - protein, 9 aa, Homo Sapiens
LAKKKTKIF

SEQ ID NO: 1061802 - protein, 9 aa, Homo Sapiens
TYPETLGRL

SEQ ID NO: 1061803 - protein, 9 aa, Homo Sapiens
QTSLAAPII

SEQ ID NO: 1061804 - protein, 9 aa, Homo Sapiens
RESKFNAEE

SEQ ID NO: 1061805 - protein, 9 aa, Homo Sapiens
MCLELERLK

SEQ ID NO: 1061806 - protein, 9 aa, Homo Sapiens
QAKMGKRGD

SEQ ID NO: 1061807 - protein, 9 aa, Homo Sapiens
VQKKIDTVL

SEQ ID NO: 1061808 - protein, 9 aa, Homo Sapiens
IEVRLTQDP

SEQ ID NO: 1061809 - protein, 9 aa, Homo Sapiens
TNVMVNTDP

SEQ ID NO: 1061810 - protein, 9 aa, Homo Sapiens
LFFLFLTIY

SEQ ID NO: 1061811 - protein, 9 aa, Homo Sapiens
LYEKKLKSF

SEQ ID NO: 1061812 - protein, 9 aa, Homo Sapiens
ADEDISRTL

SEQ ID NO: 1061813 - protein, 9 aa, Homo Sapiens
VNESWKKFL

SEQ ID NO: 1061814 - protein, 9 aa, Homo Sapiens
GSNSGQGAP

SEQ ID NO: 1061815 - protein, 9 aa, Homo Sapiens
LVRNIMTYY

SEQ ID NO: 1061816 - protein, 9 aa, Homo Sapiens
GTVREDVVV

SEQ ID NO: 1061817 - protein, 9 aa, Homo Sapiens
YQRIHTGEK

SEQ ID NO: 1061818 - protein, 9 aa, Homo Sapiens
RLSEGFHFV

SEQ ID NO: 1061819 - protein, 9 aa, Homo Sapiens
ISEITISDI

SEQ ID NO: 1061820 - protein, 9 aa, Homo Sapiens
FQQCLSGVC

SEQ ID NO: 1061821 - protein, 9 aa, Homo Sapiens
RNFIDHQRT

SEQ ID NO: 1061822 - protein, 9 aa, Homo Sapiens
TKLLNNFFK

SEQ ID NO: 1061823 - protein, 9 aa, Homo Sapiens
IADLGEMIF

SEQ ID NO: 1061824 - protein, 9 aa, Homo Sapiens
IPGLPGPRD

SEQ ID NO: 1061825 - protein, 9 aa, Homo Sapiens
KKNLYLSCV

SEQ ID NO: 1061826 - protein, 9 aa, Homo Sapiens
RMNESSGLV

SEQ ID NO: 1061827 - protein, 9 aa, Homo Sapiens
EEDKKKEFE

SEQ ID NO: 1061828 - protein, 9 aa, Homo Sapiens
AQLFFCADH

SEQ ID NO: 1061829 - protein, 9 aa, Homo Sapiens
ITSMNTRSF

SEQ ID NO: 1061830 - protein, 9 aa, Homo Sapiens
QGGKHQENK

SEQ ID NO: 1061831 - protein, 9 aa, Homo Sapiens
QQKQANRSK

SEQ ID NO: 1061832 - protein, 9 aa, Homo Sapiens
CAVQMFFGL

SEQ ID NO: 1061833 - protein, 9 aa, Homo Sapiens
QLKGLRWEN

SEQ ID NO: 1061834 - protein, 9 aa, Homo Sapiens
VVQRLSPAS

SEQ ID NO: 1061835 - protein, 9 aa, Homo Sapiens
PYRLGSPRS

SEQ ID NO: 1061836 - protein, 9 aa, Homo Sapiens
GLGRDHWNK

SEQ ID NO: 1061837 - protein, 9 aa, Homo Sapiens
DTFQQMWIS

SEQ ID NO: 1061838 - protein, 9 aa, Homo Sapiens
LKSFLKSLN

SEQ ID NO: 1061839 - protein, 9 aa, Homo Sapiens
LFFFVSVIY

SEQ ID NO: 1061840 - protein, 9 aa, Homo Sapiens
AVPDDLALL

SEQ ID NO: 1061841 - protein, 9 aa, Homo Sapiens
RSGQMQSVG

SEQ ID NO: 1061842 - protein, 9 aa, Homo Sapiens
DDKYLRKPL

SEQ ID NO: 1061843 - protein, 9 aa, Homo Sapiens
LAELCCGLS

SEQ ID NO: 1061844 - protein, 9 aa, Homo Sapiens
VIVHYGCAF

SEQ ID NO: 1061845 - protein, 9 aa, Homo Sapiens
VSWTTNNVV

SEQ ID NO: 1061846 - protein, 9 aa, Homo Sapiens
LPPHAGARD

SEQ ID NO: 1061847 - protein, 9 aa, Homo Sapiens
IQNQEIDEK

SEQ ID NO: 1061848 - protein, 9 aa, Homo Sapiens
KTFQIGESF

SEQ ID NO: 1061849 - protein, 9 aa, Homo Sapiens
FYFLAGEPR

SEQ ID NO: 1061850 - protein, 9 aa, Homo Sapiens
VIPGDPPAP

SEQ ID NO: 1061851 - protein, 9 aa, Homo Sapiens
LFSGDIGSS

SEQ ID NO: 1061852 - protein, 9 aa, Homo Sapiens
CVIFYKNGL

SEQ ID NO: 1061853 - protein, 9 aa, Homo Sapiens
PVETGGVQL

SEQ ID NO: 1061854 - protein, 9 aa, Homo Sapiens
GDLYRAERI

SEQ ID NO: 1061855 - protein, 9 aa, Homo Sapiens
FSVNWIALV

SEQ ID NO: 1061856 - protein, 9 aa, Homo Sapiens
SSSQNGHKE

SEQ ID NO: 1061857 - protein, 9 aa, Homo Sapiens
DKTFYPEKI

SEQ ID NO: 1061858 - protein, 9 aa, Homo Sapiens
SSPVEIKGE

SEQ ID NO: 1061859 - protein, 9 aa, Homo Sapiens
YIFSERDNL

SEQ ID NO: 1061860 - protein, 9 aa, Homo Sapiens
HPSWIFTCL

SEQ ID NO: 1061861 - protein, 9 aa, Homo Sapiens
QKEIDYVKN

SEQ ID NO: 1061862 - protein, 9 aa, Homo Sapiens
RSTRNLYAT

SEQ ID NO: 1061863 - protein, 9 aa, Homo Sapiens
YNCSMAKKR

SEQ ID NO: 1061864 - protein, 9 aa, Homo Sapiens
SDRRARTPF

SEQ ID NO: 1061865 - protein, 9 aa, Homo Sapiens
LAFHLLQQM

SEQ ID NO: 1061866 - protein, 9 aa, Homo Sapiens
KPQNFQIRV

SEQ ID NO: 1061867 - protein, 9 aa, Homo Sapiens
MDKSNQCVD

SEQ ID NO: 1061868 - protein, 9 aa, Homo Sapiens
LPAKAFRQL

SEQ ID NO: 1061869 - protein, 9 aa, Homo Sapiens
KKFLRKKEA

SEQ ID NO: 1061870 - protein, 9 aa, Homo Sapiens
GKKFEEDLT

SEQ ID NO: 1061871 - protein, 9 aa, Homo Sapiens
LEAAKLKLQ

SEQ ID NO: 1061872 - protein, 9 aa, Homo Sapiens
CESRDKFIQ

SEQ ID NO: 1061873 - protein, 9 aa, Homo Sapiens
LKTKCDLWH

SEQ ID NO: 1061874 - protein, 9 aa, Homo Sapiens
VVSAAHFFS

SEQ ID NO: 1061875 - protein, 9 aa, Homo Sapiens
SIKQAQTVA

SEQ ID NO: 1061876 - protein, 9 aa, Homo Sapiens
GLERDLVPE

SEQ ID NO: 1061877 - protein, 9 aa, Homo Sapiens
RLGWRQCLL

SEQ ID NO: 1061878 - protein, 9 aa, Homo Sapiens
EYLSKLQEL

SEQ ID NO: 1061879 - protein, 9 aa, Homo Sapiens
QKTIGKGYF

SEQ ID NO: 1061880 - protein, 9 aa, Homo Sapiens
IWQQVDNNL

SEQ ID NO: 1061881 - protein, 9 aa, Homo Sapiens
IAAPHPIDG

SEQ ID NO: 1061882 - protein, 9 aa, Homo Sapiens
GTLSVMKDS

SEQ ID NO: 1061883 - protein, 9 aa, Homo Sapiens
SIQVTMVIE

SEQ ID NO: 1061884 - protein, 9 aa, Homo Sapiens
PASTDLLQH

SEQ ID NO: 1061885 - protein, 9 aa, Homo Sapiens
QIVSSVMKI

SEQ ID NO: 1061886 - protein, 9 aa, Homo Sapiens
AHFFSHRDL

SEQ ID NO: 1061887 - protein, 9 aa, Homo Sapiens
YSLEMKISF

SEQ ID NO: 1061888 - protein, 9 aa, Homo Sapiens
SCPCTDNLD

SEQ ID NO: 1061889 - protein, 9 aa, Homo Sapiens
LPVACLKPA

SEQ ID NO: 1061890 - protein, 9 aa, Homo Sapiens
YVNRDLAAR

SEQ ID NO: 1061891 - protein, 9 aa, Homo Sapiens
IQEGTSGEQ

SEQ ID NO: 1061892 - protein, 9 aa, Homo Sapiens
TNQNISIYL

SEQ ID NO: 1061893 - protein, 9 aa, Homo Sapiens
ISMVLFIYI

SEQ ID NO: 1061894 - protein, 9 aa, Homo Sapiens
LLLLIGSLY

SEQ ID NO: 1061895 - protein, 9 aa, Homo Sapiens
ALPTRQSAS

SEQ ID NO: 1061896 - protein, 9 aa, Homo Sapiens
LRQEPEGLV

SEQ ID NO: 1061897 - protein, 9 aa, Homo Sapiens
KENRRLSRE

SEQ ID NO: 1061898 - protein, 9 aa, Homo Sapiens
APFLLSTCP

SEQ ID NO: 1061899 - protein, 9 aa, Homo Sapiens
KAFETCSSH

SEQ ID NO: 1061900 - protein, 9 aa, Homo Sapiens
IYFLSSCKA

SEQ ID NO: 1061901 - protein, 9 aa, Homo Sapiens
EKIKEFYPT

SEQ ID NO: 1061902 - protein, 9 aa, Homo Sapiens
LFLGASVLA

SEQ ID NO: 1061903 - protein, 9 aa, Homo Sapiens
GEGELPVAC

SEQ ID NO: 1061904 - protein, 9 aa, Homo Sapiens
PNCSAPLVP

SEQ ID NO: 1061905 - protein, 9 aa, Homo Sapiens
VIYIRNQQR

SEQ ID NO: 1061906 - protein, 9 aa, Homo Sapiens
CGQRQDLLP

SEQ ID NO: 1061907 - protein, 9 aa, Homo Sapiens
QCVFARTLN

SEQ ID NO: 1061908 - protein, 9 aa, Homo Sapiens
DFFQDITLS

SEQ ID NO: 1061909 - protein, 9 aa, Homo Sapiens
FKQASQRED

SEQ ID NO: 1061910 - protein, 9 aa, Homo Sapiens
GYISKTNEE

SEQ ID NO: 1061911 - protein, 9 aa, Homo Sapiens
QHELKFRGS

SEQ ID NO: 1061912 - protein, 9 aa, Homo Sapiens
WHAVDPDCR

SEQ ID NO: 1061913 - protein, 9 aa, Homo Sapiens
SPENRKSTM

SEQ ID NO: 1061914 - protein, 9 aa, Homo Sapiens
AARQLQDLR

SEQ ID NO: 1061915 - protein, 9 aa, Homo Sapiens
GHSPLSGAP

SEQ ID NO: 1061916 - protein, 9 aa, Homo Sapiens
LFYNQKEGH

SEQ ID NO: 1061917 - protein, 9 aa, Homo Sapiens
LHYGIIFCE

SEQ ID NO: 1061918 - protein, 9 aa, Homo Sapiens
DESKMFQSE

SEQ ID NO: 1061919 - protein, 9 aa, Homo Sapiens
ETKIFKTSY

SEQ ID NO: 1061920 - protein, 9 aa, Homo Sapiens
HMDYNKVFT

SEQ ID NO: 1061921 - protein, 9 aa, Homo Sapiens
RMQKEIDYV

SEQ ID NO: 1061922 - protein, 9 aa, Homo Sapiens
NSGEKSSHS

SEQ ID NO: 1061923 - protein, 9 aa, Homo Sapiens
CRQLGCPSF

SEQ ID NO: 1061924 - protein, 9 aa, Homo Sapiens
VSVFSMFCY

SEQ ID NO: 1061925 - protein, 9 aa, Homo Sapiens
QPGPRQTSE

SEQ ID NO: 1061926 - protein, 9 aa, Homo Sapiens
ASTDLLQHE

SEQ ID NO: 1061927 - protein, 9 aa, Homo Sapiens
HVEEDRQLI

SEQ ID NO: 1061928 - protein, 9 aa, Homo Sapiens
VLLEELHHQ

SEQ ID NO: 1061929 - protein, 9 aa, Homo Sapiens
RPRLGPSWK

SEQ ID NO: 1061930 - protein, 9 aa, Homo Sapiens
KNPGQVHPR

SEQ ID NO: 1061931 - protein, 9 aa, Homo Sapiens
KTQPHSHSN

SEQ ID NO: 1061932 - protein, 9 aa, Homo Sapiens
STILGNGSS

SEQ ID NO: 1061933 - protein, 9 aa, Homo Sapiens
GGSEEEGSN

SEQ ID NO: 1061934 - protein, 9 aa, Homo Sapiens
RTWNSSAVL

SEQ ID NO: 1061935 - protein, 9 aa, Homo Sapiens
PGFPESKGE

SEQ ID NO: 1061936 - protein, 9 aa, Homo Sapiens
SRIVSSSSL

SEQ ID NO: 1061937 - protein, 9 aa, Homo Sapiens
YSLITPARQ

SEQ ID NO: 1061938 - protein, 9 aa, Homo Sapiens
YCLSSRSHT

SEQ ID NO: 1061939 - protein, 9 aa, Homo Sapiens
PLCGHKKVD

SEQ ID NO: 1061940 - protein, 9 aa, Homo Sapiens
QMVLMTSEL

SEQ ID NO: 1061941 - protein, 9 aa, Homo Sapiens
GEKLYVCNE

SEQ ID NO: 1061942 - protein, 9 aa, Homo Sapiens
IDTILIQTN

SEQ ID NO: 1061943 - protein, 9 aa, Homo Sapiens
FGEKNSQLW

SEQ ID NO: 1061944 - protein, 9 aa, Homo Sapiens
FVYKSGTTL

SEQ ID NO: 1061945 - protein, 9 aa, Homo Sapiens
EKDSGRFDV

SEQ ID NO: 1061946 - protein, 9 aa, Homo Sapiens
LPPSMGTQS

SEQ ID NO: 1061947 - protein, 9 aa, Homo Sapiens
LELHVLVMN

SEQ ID NO: 1061948 - protein, 9 aa, Homo Sapiens
PSPGSAASG

SEQ ID NO: 1061949 - protein, 9 aa, Homo Sapiens
EELEETKSK

SEQ ID NO: 1061950 - protein, 9 aa, Homo Sapiens
HIPLYKWEV

SEQ ID NO: 1061951 - protein, 9 aa, Homo Sapiens
VAPFPCIPK

SEQ ID NO: 1061952 - protein, 9 aa, Homo Sapiens
LQSFSDAIY

SEQ ID NO: 1061953 - protein, 9 aa, Homo Sapiens
HTSSGILSM

SEQ ID NO: 1061954 - protein, 9 aa, Homo Sapiens
KEMATMKKE

SEQ ID NO: 1061955 - protein, 9 aa, Homo Sapiens
CQQKYSPVT

SEQ ID NO: 1061956 - protein, 9 aa, Homo Sapiens
GPTLEGGLV

SEQ ID NO: 1061957 - protein, 9 aa, Homo Sapiens
TLSISPEML

SEQ ID NO: 1061958 - protein, 9 aa, Homo Sapiens
GLTLSAGNL

SEQ ID NO: 1061959 - protein, 9 aa, Homo Sapiens
DEFDSHAQH

SEQ ID NO: 1061960 - protein, 9 aa, Homo Sapiens
ADSFFETDT

SEQ ID NO: 1061961 - protein, 9 aa, Homo Sapiens
LDNLNSKKL

SEQ ID NO: 1061962 - protein, 9 aa, Homo Sapiens
GLNHMSIKI

SEQ ID NO: 1061963 - protein, 9 aa, Homo Sapiens
FCYCKVNFI

SEQ ID NO: 1061964 - protein, 9 aa, Homo Sapiens
AASASLRKA

SEQ ID NO: 1061965 - protein, 9 aa, Homo Sapiens
GKQLSNSYN

SEQ ID NO: 1061966 - protein, 9 aa, Homo Sapiens
LSNLFFLDI

SEQ ID NO: 1061967 - protein, 9 aa, Homo Sapiens
SLSSRLQSE

SEQ ID NO: 1061968 - protein, 9 aa, Homo Sapiens
SICGHLSPQ

SEQ ID NO: 1061969 - protein, 9 aa, Homo Sapiens
YLFLLPMPL

SEQ ID NO: 1061970 - protein, 9 aa, Homo Sapiens
PGIVIVEKI

SEQ ID NO: 1061971 - protein, 9 aa, Homo Sapiens
DYHIFLVED

SEQ ID NO: 1061972 - protein, 9 aa, Homo Sapiens
RKRRGQAAA

SEQ ID NO: 1061973 - protein, 9 aa, Homo Sapiens
RGAFKGLPE

SEQ ID NO: 1061974 - protein, 9 aa, Homo Sapiens
LKTDYIFSE

SEQ ID NO: 1061975 - protein, 9 aa, Homo Sapiens
FVLEISRNT

SEQ ID NO: 1061976 - protein, 9 aa, Homo Sapiens
EVQAEKLAA

SEQ ID NO: 1061977 - protein, 9 aa, Homo Sapiens
RAPTKKLGG

SEQ ID NO: 1061978 - protein, 9 aa, Homo Sapiens
YGRLLWSQV

SEQ ID NO: 1061979 - protein, 9 aa, Homo Sapiens
FPGDSDINQ

SEQ ID NO: 1061980 - protein, 9 aa, Homo Sapiens
LDELFSSRD

SEQ ID NO: 1061981 - protein, 9 aa, Homo Sapiens
EVTPLSPEK

SEQ ID NO: 1061982 - protein, 9 aa, Homo Sapiens
LPSELPGGD

SEQ ID NO: 1061983 - protein, 9 aa, Homo Sapiens
HLEEDPNPS

SEQ ID NO: 1061984 - protein, 9 aa, Homo Sapiens
GIQEGTSGE

SEQ ID NO: 1061985 - protein, 9 aa, Homo Sapiens
GPPASIVPF

SEQ ID NO: 1061986 - protein, 9 aa, Homo Sapiens
PSVKANGLP

SEQ ID NO: 1061987 - protein, 9 aa, Homo Sapiens
PLVLETCKE

SEQ ID NO: 1061988 - protein, 9 aa, Homo Sapiens
SQPKENEAK

SEQ ID NO: 1061989 - protein, 9 aa, Homo Sapiens
DFYNCRKVN

SEQ ID NO: 1061990 - protein, 9 aa, Homo Sapiens
YFTMYISIL

SEQ ID NO: 1061991 - protein, 9 aa, Homo Sapiens
FPDESQRVD

SEQ ID NO: 1061992 - protein, 9 aa, Homo Sapiens
TLQSDDDKI

SEQ ID NO: 1061993 - protein, 9 aa, Homo Sapiens
GFTIKWDIS

SEQ ID NO: 1061994 - protein, 9 aa, Homo Sapiens
TKLKRLDIF

SEQ ID NO: 1061995 - protein, 9 aa, Homo Sapiens
LPRVPWFIS

SEQ ID NO: 1061996 - protein, 9 aa, Homo Sapiens
QLFASVMTD

SEQ ID NO: 1061997 - protein, 9 aa, Homo Sapiens
NTQQSSVAA

SEQ ID NO: 1061998 - protein, 9 aa, Homo Sapiens
VVVAFYAAI

SEQ ID NO: 1061999 - protein, 9 aa, Homo Sapiens
KKEGEEEKG

SEQ ID NO: 1062000 - protein, 9 aa, Homo Sapiens
PQCRECASG

SEQ ID NO: 1062001 - protein, 9 aa, Homo Sapiens
FGFVATPSS

SEQ ID NO: 1062002 - protein, 9 aa, Homo Sapiens
ILGMSPQLQ

SEQ ID NO: 1062003 - protein, 9 aa, Homo Sapiens
SLNFPKKKL

SEQ ID NO: 1062004 - protein, 9 aa, Homo Sapiens
PAILVNIHS

SEQ ID NO: 1062005 - protein, 9 aa, Homo Sapiens
TGEGVSLQY

SEQ ID NO: 1062006 - protein, 9 aa, Homo Sapiens
GLEPRVRLF

SEQ ID NO: 1062007 - protein, 9 aa, Homo Sapiens
KRGSYYEYF

SEQ ID NO: 1062008 - protein, 9 aa, Homo Sapiens
EDTAIGSLR

SEQ ID NO: 1062009 - protein, 9 aa, Homo Sapiens
VNLLLLIGS

SEQ ID NO: 1062010 - protein, 9 aa, Homo Sapiens
KFITFSDGC

SEQ ID NO: 1062011 - protein, 9 aa, Homo Sapiens
QNSLRFSAS

SEQ ID NO: 1062012 - protein, 9 aa, Homo Sapiens
GKDKSWTGQ

SEQ ID NO: 1062013 - protein, 9 aa, Homo Sapiens
GAQGGGPRN

SEQ ID NO: 1062014 - protein, 9 aa, Homo Sapiens
NFLKVAAIS

SEQ ID NO: 1062015 - protein, 9 aa, Homo Sapiens
FPWGNAGEL

SEQ ID NO: 1062016 - protein, 9 aa, Homo Sapiens
EENAGLGNG

SEQ ID NO: 1062017 - protein, 9 aa, Homo Sapiens
KTVDQWKID

SEQ ID NO: 1062018 - protein, 9 aa, Homo Sapiens
KVLTPEMLM

SEQ ID NO: 1062019 - protein, 9 aa, Homo Sapiens
ICRGNYPGP

SEQ ID NO: 1062020 - protein, 9 aa, Homo Sapiens
LYPGQGNNF

SEQ ID NO: 1062021 - protein, 9 aa, Homo Sapiens
DKFSAVPDS

SEQ ID NO: 1062022 - protein, 9 aa, Homo Sapiens
SIIAIFLFV

SEQ ID NO: 1062023 - protein, 9 aa, Homo Sapiens
KTVALNAPS

SEQ ID NO: 1062024 - protein, 9 aa, Homo Sapiens
QAIAETLEN

SEQ ID NO: 1062025 - protein, 9 aa, Homo Sapiens
FSDDDLPHD

SEQ ID NO: 1062026 - protein, 9 aa, Homo Sapiens
ARQLQDLRT

SEQ ID NO: 1062027 - protein, 9 aa, Homo Sapiens
FRSDLDNLP

SEQ ID NO: 1062028 - protein, 9 aa, Homo Sapiens
MEARLEKEE

SEQ ID NO: 1062029 - protein, 9 aa, Homo Sapiens
EDCFGMWIE

SEQ ID NO: 1062030 - protein, 9 aa, Homo Sapiens
VIVLIFLTK

SEQ ID NO: 1062031 - protein, 9 aa, Homo Sapiens
LSYVYFLLP

SEQ ID NO: 1062032 - protein, 9 aa, Homo Sapiens
LSQLDGEAR

SEQ ID NO: 1062033 - protein, 9 aa, Homo Sapiens
PAKKDVLYF

SEQ ID NO: 1062034 - protein, 9 aa, Homo Sapiens
APALPAFLV

SEQ ID NO: 1062035 - protein, 9 aa, Homo Sapiens
EWQDKDLPR

SEQ ID NO: 1062036 - protein, 9 aa, Homo Sapiens
NTSNDESSI

SEQ ID NO: 1062037 - protein, 9 aa, Homo Sapiens
ESGNLFGGS

SEQ ID NO: 1062038 - protein, 9 aa, Homo Sapiens
GEKKESLVE

SEQ ID NO: 1062039 - protein, 9 aa, Homo Sapiens
LYWKEGKDN

SEQ ID NO: 1062040 - protein, 9 aa, Homo Sapiens
HDNFHGGLD

SEQ ID NO: 1062041 - protein, 9 aa, Homo Sapiens
NLPNHILFL

SEQ ID NO: 1062042 - protein, 9 aa, Homo Sapiens
DISVATNTP

SEQ ID NO: 1062043 - protein, 9 aa, Homo Sapiens
QCSLEKSSN

SEQ ID NO: 1062044 - protein, 9 aa, Homo Sapiens
EGTSGHSSI

SEQ ID NO: 1062045 - protein, 9 aa, Homo Sapiens
TETIENLTR

SEQ ID NO: 1062046 - protein, 9 aa, Homo Sapiens
APPQKVLFR

SEQ ID NO: 1062047 - protein, 9 aa, Homo Sapiens
KIDKFMALV

SEQ ID NO: 1062048 - protein, 9 aa, Homo Sapiens
RYPSPREKR

SEQ ID NO: 1062049 - protein, 9 aa, Homo Sapiens
RIGKTTLLR

SEQ ID NO: 1062050 - protein, 9 aa, Homo Sapiens
MTSIICGFL

SEQ ID NO: 1062051 - protein, 9 aa, Homo Sapiens
LHKEEKSYL

SEQ ID NO: 1062052 - protein, 9 aa, Homo Sapiens
SDLRFVDSN

SEQ ID NO: 1062053 - protein, 9 aa, Homo Sapiens
VLFVLLTSC

SEQ ID NO: 1062054 - protein, 9 aa, Homo Sapiens
EVAWEALLS

SEQ ID NO: 1062055 - protein, 9 aa, Homo Sapiens
PLCVVVAFY

SEQ ID NO: 1062056 - protein, 9 aa, Homo Sapiens
VDRPDFYSP

SEQ ID NO: 1062057 - protein, 9 aa, Homo Sapiens
GKQVFLYSE

SEQ ID NO: 1062058 - protein, 9 aa, Homo Sapiens
HLETLYNNS

SEQ ID NO: 1062059 - protein, 9 aa, Homo Sapiens
ECRPRRKKC

SEQ ID NO: 1062060 - protein, 9 aa, Homo Sapiens
MSYVSIIAI

SEQ ID NO: 1062061 - protein, 9 aa, Homo Sapiens
FLSSCKAEE

SEQ ID NO: 1062062 - protein, 9 aa, Homo Sapiens
LANTSCQDG

SEQ ID NO: 1062063 - protein, 9 aa, Homo Sapiens
SEGKKGQVL

SEQ ID NO: 1062064 - protein, 9 aa, Homo Sapiens
DLSRFIKLA

SEQ ID NO: 1062065 - protein, 9 aa, Homo Sapiens
LVTQRNCNL

SEQ ID NO: 1062066 - protein, 9 aa, Homo Sapiens
LKEDKNQLQ

SEQ ID NO: 1062067 - protein, 9 aa, Homo Sapiens
EAGTDGYAA

SEQ ID NO: 1062068 - protein, 9 aa, Homo Sapiens
ARILSGQKE

SEQ ID NO: 1062069 - protein, 9 aa, Homo Sapiens
IEEEVEALM

SEQ ID NO: 1062070 - protein, 9 aa, Homo Sapiens
GSSEEGVSC

SEQ ID NO: 1062071 - protein, 9 aa, Homo Sapiens
VDGEQTVLQ

SEQ ID NO: 1062072 - protein, 9 aa, Homo Sapiens
LDAVNGYIE

SEQ ID NO: 1062073 - protein, 9 aa, Homo Sapiens
PPQKHRICV

SEQ ID NO: 1062074 - protein, 9 aa, Homo Sapiens
TELDEFSDF

SEQ ID NO: 1062075 - protein, 9 aa, Homo Sapiens
LRKHYRTSS

SEQ ID NO: 1062076 - protein, 9 aa, Homo Sapiens
LTRVPQHVP

SEQ ID NO: 1062077 - protein, 9 aa, Homo Sapiens
SELGDSLLA

SEQ ID NO: 1062078 - protein, 9 aa, Homo Sapiens
IFKGRSGLG

SEQ ID NO: 1062079 - protein, 9 aa, Homo Sapiens
HPLHYTVII

SEQ ID NO: 1062080 - protein, 9 aa, Homo Sapiens
TEDKPVESM

SEQ ID NO: 1062081 - protein, 9 aa, Homo Sapiens
CPPKCLPKC

SEQ ID NO: 1062082 - protein, 9 aa, Homo Sapiens
WDISVATNT

SEQ ID NO: 1062083 - protein, 9 aa, Homo Sapiens
DNSPPRPIR

SEQ ID NO: 1062084 - protein, 9 aa, Homo Sapiens
THILCQVAG

SEQ ID NO: 1062085 - protein, 9 aa, Homo Sapiens
PVEDNDKNY

SEQ ID NO: 1062086 - protein, 9 aa, Homo Sapiens
ITHQDEEVF

SEQ ID NO: 1062087 - protein, 9 aa, Homo Sapiens
CEKPIQNSH

SEQ ID NO: 1062088 - protein, 9 aa, Homo Sapiens
PSEEGAACG

SEQ ID NO: 1062089 - protein, 9 aa, Homo Sapiens
KLWRIHCLQ

SEQ ID NO: 1062090 - protein, 9 aa, Homo Sapiens
PRFMGTISN

SEQ ID NO: 1062091 - protein, 9 aa, Homo Sapiens
REDTDLTFF

SEQ ID NO: 1062092 - protein, 9 aa, Homo Sapiens
EADRDGLWD

SEQ ID NO: 1062093 - protein, 9 aa, Homo Sapiens
GPRFEGNCP

SEQ ID NO: 1062094 - protein, 9 aa, Homo Sapiens
LVVWSHNGR

SEQ ID NO: 1062095 - protein, 9 aa, Homo Sapiens
FEEKKSARA

SEQ ID NO: 1062096 - protein, 9 aa, Homo Sapiens
FHEDLLDVC

SEQ ID NO: 1062097 - protein, 9 aa, Homo Sapiens
LQALLFFLF

SEQ ID NO: 1062098 - protein, 9 aa, Homo Sapiens
WFDGKDFEG

SEQ ID NO: 1062099 - protein, 9 aa, Homo Sapiens
SRGCASTRV

SEQ ID NO: 1062100 - protein, 9 aa, Homo Sapiens
TVSFYGGHE

SEQ ID NO: 1062101 - protein, 9 aa, Homo Sapiens
RQSIVLDSM

SEQ ID NO: 1062102 - protein, 9 aa, Homo Sapiens
HQNQDTENK

SEQ ID NO: 1062103 - protein, 9 aa, Homo Sapiens
IKFTSDQAR

SEQ ID NO: 1062104 - protein, 9 aa, Homo Sapiens
LITLFKKKA

SEQ ID NO: 1062105 - protein, 9 aa, Homo Sapiens
PPHAGARDH

SEQ ID NO: 1062106 - protein, 9 aa, Homo Sapiens
PFDFFLFKV

SEQ ID NO: 1062107 - protein, 9 aa, Homo Sapiens
TVGECGSPL

SEQ ID NO: 1062108 - protein, 9 aa, Homo Sapiens
VCGSLFYTP

SEQ ID NO: 1062109 - protein, 9 aa, Homo Sapiens
STPRSGKLP

SEQ ID NO: 1062110 - protein, 9 aa, Homo Sapiens
RSSRDFIQC

SEQ ID NO: 1062111 - protein, 9 aa, Homo Sapiens
RLSWTVSEG

SEQ ID NO: 1062112 - protein, 9 aa, Homo Sapiens
GFWLTVETS

SEQ ID NO: 1062113 - protein, 9 aa, Homo Sapiens
LNSEINSFI

SEQ ID NO: 1062114 - protein, 9 aa, Homo Sapiens
VSSMSYYQR

SEQ ID NO: 1062115 - protein, 9 aa, Homo Sapiens
MKYFDLKRH

SEQ ID NO: 1062116 - protein, 9 aa, Homo Sapiens
KTMTSTYDA

SEQ ID NO: 1062117 - protein, 9 aa, Homo Sapiens
AWLGMESDL

SEQ ID NO: 1062118 - protein, 9 aa, Homo Sapiens
PFVVPPTFQ

SEQ ID NO: 1062119 - protein, 9 aa, Homo Sapiens
GREPKAPTF

SEQ ID NO: 1062120 - protein, 9 aa, Homo Sapiens
NLFGGSETN

SEQ ID NO: 1062121 - protein, 9 aa, Homo Sapiens
LNIVTEDDF

SEQ ID NO: 1062122 - protein, 9 aa, Homo Sapiens
KLLNVGSQE

SEQ ID NO: 1062123 - protein, 9 aa, Homo Sapiens
TLSTPSPKE

SEQ ID NO: 1062124 - protein, 9 aa, Homo Sapiens
KNFSFLHLN

SEQ ID NO: 1062125 - protein, 9 aa, Homo Sapiens
MAKFAYWGV

SEQ ID NO: 1062126 - protein, 9 aa, Homo Sapiens
AGSCGSNSG

SEQ ID NO: 1062127 - protein, 9 aa, Homo Sapiens
YFPYLVFIH

SEQ ID NO: 1062128 - protein, 9 aa, Homo Sapiens
AIQLSIKQA

SEQ ID NO: 1062129 - protein, 9 aa, Homo Sapiens
VFSISVVAI

SEQ ID NO: 1062130 - protein, 9 aa, Homo Sapiens
VWYILASSI

SEQ ID NO: 1062131 - protein, 9 aa, Homo Sapiens
ENKPIKNEL

SEQ ID NO: 1062132 - protein, 9 aa, Homo Sapiens
YTLKNAEVK

SEQ ID NO: 1062133 - protein, 9 aa, Homo Sapiens
FFMGCFAQM

SEQ ID NO: 1062134 - protein, 9 aa, Homo Sapiens
KKDDFFSLQ

SEQ ID NO: 1062135 - protein, 9 aa, Homo Sapiens
MQEFLNEEN

SEQ ID NO: 1062136 - protein, 9 aa, Homo Sapiens
SVDFQKNPK

SEQ ID NO: 1062137 - protein, 9 aa, Homo Sapiens
SLNGKNWEY

SEQ ID NO: 1062138 - protein, 9 aa, Homo Sapiens
MTSWGGEKR

SEQ ID NO: 1062139 - protein, 9 aa, Homo Sapiens
VDQWKIDRN

SEQ ID NO: 1062140 - protein, 9 aa, Homo Sapiens
RKKCRPIIC

SEQ ID NO: 1062141 - protein, 9 aa, Homo Sapiens
LNTEGSFYC

SEQ ID NO: 1062142 - protein, 9 aa, Homo Sapiens
IEVRHYSSQ

SEQ ID NO: 1062143 - protein, 9 aa, Homo Sapiens
RRQPHVVSQ

SEQ ID NO: 1062144 - protein, 9 aa, Homo Sapiens
RSYNKLQKQ

SEQ ID NO: 1062145 - protein, 9 aa, Homo Sapiens
TVDVRDKFS

SEQ ID NO: 1062146 - protein, 9 aa, Homo Sapiens
FSGLSMDLV

SEQ ID NO: 1062147 - protein, 9 aa, Homo Sapiens
GGSERSCGV

SEQ ID NO: 1062148 - protein, 9 aa, Homo Sapiens
YQCGPASVQ

SEQ ID NO: 1062149 - protein, 9 aa, Homo Sapiens
TLKNCDLPA

SEQ ID NO: 1062150 - protein, 9 aa, Homo Sapiens
NCALKLSLK

SEQ ID NO: 1062151 - protein, 9 aa, Homo Sapiens
FIRGHTLIK

SEQ ID NO: 1062152 - protein, 9 aa, Homo Sapiens
SIFCSEDSS

SEQ ID NO: 1062153 - protein, 9 aa, Homo Sapiens
DSSNKTIYY

SEQ ID NO: 1062154 - protein, 9 aa, Homo Sapiens
DGVKVHNAK

SEQ ID NO: 1062155 - protein, 9 aa, Homo Sapiens
FLPPNTLQK

SEQ ID NO: 1062156 - protein, 9 aa, Homo Sapiens
NLQINAYLR

SEQ ID NO: 1062157 - protein, 9 aa, Homo Sapiens
PPQFLRKKV

SEQ ID NO: 1062158 - protein, 9 aa, Homo Sapiens
QERRAQESP

SEQ ID NO: 1062159 - protein, 9 aa, Homo Sapiens
KPAIVKVYN

SEQ ID NO: 1062160 - protein, 9 aa, Homo Sapiens
NEECKVPKG

SEQ ID NO: 1062161 - protein, 9 aa, Homo Sapiens
HSPLSGAPG

SEQ ID NO: 1062162 - protein, 9 aa, Homo Sapiens
FGFQTFQHS

SEQ ID NO: 1062163 - protein, 9 aa, Homo Sapiens
KKEVNFQAD

SEQ ID NO: 1062164 - protein, 9 aa, Homo Sapiens
RMKGLNSFE

SEQ ID NO: 1062165 - protein, 9 aa, Homo Sapiens
FTGCEIQSF

SEQ ID NO: 1062166 - protein, 9 aa, Homo Sapiens
CSQCQEWLI

SEQ ID NO: 1062167 - protein, 9 aa, Homo Sapiens
PGSQCSLEK

SEQ ID NO: 1062168 - protein, 9 aa, Homo Sapiens
PGVVKVTLS

SEQ ID NO: 1062169 - protein, 9 aa, Homo Sapiens
FLCRPRRSH

SEQ ID NO: 1062170 - protein, 9 aa, Homo Sapiens
YGQPKPVKP

SEQ ID NO: 1062171 - protein, 9 aa, Homo Sapiens
PLLLPGRLC

SEQ ID NO: 1062172 - protein, 9 aa, Homo Sapiens
TRETVFSYL

SEQ ID NO: 1062173 - protein, 9 aa, Homo Sapiens
VRDKFSGIV

SEQ ID NO: 1062174 - protein, 9 aa, Homo Sapiens
ADDLVSPDA

SEQ ID NO: 1062175 - protein, 9 aa, Homo Sapiens
FFSASYREQ

SEQ ID NO: 1062176 - protein, 9 aa, Homo Sapiens
PDVSANFHS

SEQ ID NO: 1062177 - protein, 9 aa, Homo Sapiens
RKRHRRCKY

SEQ ID NO: 1062178 - protein, 9 aa, Homo Sapiens
EGEKKESLV

SEQ ID NO: 1062179 - protein, 9 aa, Homo Sapiens
IPPNYHTPL

SEQ ID NO: 1062180 - protein, 9 aa, Homo Sapiens
SPFSGDIKL

SEQ ID NO: 1062181 - protein, 9 aa, Homo Sapiens
RGGGAPFQR

SEQ ID NO: 1062182 - protein, 9 aa, Homo Sapiens
VARIGLTKP

SEQ ID NO: 1062183 - protein, 9 aa, Homo Sapiens
FFISSGVVN

SEQ ID NO: 1062184 - protein, 9 aa, Homo Sapiens
KIQALPTVL

SEQ ID NO: 1062185 - protein, 9 aa, Homo Sapiens
FSALRTGAY

SEQ ID NO: 1062186 - protein, 9 aa, Homo Sapiens
QNGHKEGAT

SEQ ID NO: 1062187 - protein, 9 aa, Homo Sapiens
EWNIPFEQL

SEQ ID NO: 1062188 - protein, 9 aa, Homo Sapiens
SKSHSQKKD

SEQ ID NO: 1062189 - protein, 9 aa, Homo Sapiens
ALKDENLPS

SEQ ID NO: 1062190 - protein, 9 aa, Homo Sapiens
VEKFINNAS

SEQ ID NO: 1062191 - protein, 9 aa, Homo Sapiens
GKDDMEFGE

SEQ ID NO: 1062192 - protein, 9 aa, Homo Sapiens
CSYYTTKGW

SEQ ID NO: 1062193 - protein, 9 aa, Homo Sapiens
GTGEGVSLQ

SEQ ID NO: 1062194 - protein, 9 aa, Homo Sapiens
TFEAVELQD

SEQ ID NO: 1062195 - protein, 9 aa, Homo Sapiens
EGSFYCVCQ

SEQ ID NO: 1062196 - protein, 9 aa, Homo Sapiens
LSSIKNFLK

SEQ ID NO: 1062197 - protein, 9 aa, Homo Sapiens
IQRSIQVTM

SEQ ID NO: 1062198 - protein, 9 aa, Homo Sapiens
PLPVRGEHV

SEQ ID NO: 1062199 - protein, 9 aa, Homo Sapiens
LKRILKRKC

SEQ ID NO: 1062200 - protein, 9 aa, Homo Sapiens
IIRDCLIQF

SEQ ID NO: 1062201 - protein, 9 aa, Homo Sapiens
GGLLQTYAF

SEQ ID NO: 1062202 - protein, 9 aa, Homo Sapiens
ICKMKVTKK

SEQ ID NO: 1062203 - protein, 9 aa, Homo Sapiens
YDGDGVCEE

SEQ ID NO: 1062204 - protein, 9 aa, Homo Sapiens
FSIELNQQL

SEQ ID NO: 1062205 - protein, 9 aa, Homo Sapiens
FSCTEHNEC

SEQ ID NO: 1062206 - protein, 9 aa, Homo Sapiens
IYVGLEASL

SEQ ID NO: 1062207 - protein, 9 aa, Homo Sapiens
SRSSVLTTH

SEQ ID NO: 1062208 - protein, 9 aa, Homo Sapiens
QFDSPKRGW

SEQ ID NO: 1062209 - protein, 9 aa, Homo Sapiens
LIVDGEQTV

SEQ ID NO: 1062210 - protein, 9 aa, Homo Sapiens
GTKAVSTEC

SEQ ID NO: 1062211 - protein, 9 aa, Homo Sapiens
VPDSIPQWN

SEQ ID NO: 1062212 - protein, 9 aa, Homo Sapiens
FTCFSSLIK

SEQ ID NO: 1062213 - protein, 9 aa, Homo Sapiens
HVVSQWSRS

SEQ ID NO: 1062214 - protein, 9 aa, Homo Sapiens
DPQNISFRR

SEQ ID NO: 1062215 - protein, 9 aa, Homo Sapiens
KLEMEIAIK

SEQ ID NO: 1062216 - protein, 9 aa, Homo Sapiens
VTWTINGLM

SEQ ID NO: 1062217 - protein, 9 aa, Homo Sapiens
QHVLCNHPS

SEQ ID NO: 1062218 - protein, 9 aa, Homo Sapiens
THDFLRSEL

SEQ ID NO: 1062219 - protein, 9 aa, Homo Sapiens
ESLQMAVGL

SEQ ID NO: 1062220 - protein, 9 aa, Homo Sapiens
PPDDDLFQD

SEQ ID NO: 1062221 - protein, 9 aa, Homo Sapiens
CKVSNFGMS

SEQ ID NO: 1062222 - protein, 9 aa, Homo Sapiens
ATSPTPSFR

SEQ ID NO: 1062223 - protein, 9 aa, Homo Sapiens
QEKSYKCNE

SEQ ID NO: 1062224 - protein, 9 aa, Homo Sapiens
YCTLGEVFN

SEQ ID NO: 1062225 - protein, 9 aa, Homo Sapiens
LKCDGLKMD

SEQ ID NO: 1062226 - protein, 9 aa, Homo Sapiens
RGRILFFVK

SEQ ID NO: 1062227 - protein, 9 aa, Homo Sapiens
GNLGGSIYA

SEQ ID NO: 1062228 - protein, 9 aa, Homo Sapiens
PAKLGALYR

SEQ ID NO: 1062229 - protein, 9 aa, Homo Sapiens
LLCVPDKDT

SEQ ID NO: 1062230 - protein, 9 aa, Homo Sapiens
IPQNDLLGY

SEQ ID NO: 1062231 - protein, 9 aa, Homo Sapiens
GIFYIEDFA

SEQ ID NO: 1062232 - protein, 9 aa, Homo Sapiens
GLQGLLGAP

SEQ ID NO: 1062233 - protein, 9 aa, Homo Sapiens
YHKQPQNAI

SEQ ID NO: 1062234 - protein, 9 aa, Homo Sapiens
FFWYQQALG

SEQ ID NO: 1062235 - protein, 9 aa, Homo Sapiens
DTTLSTPSP

SEQ ID NO: 1062236 - protein, 9 aa, Homo Sapiens
HAFLASASL

SEQ ID NO: 1062237 - protein, 9 aa, Homo Sapiens
FWSSEEDKE

SEQ ID NO: 1062238 - protein, 9 aa, Homo Sapiens
KTYPIKSPT

SEQ ID NO: 1062239 - protein, 9 aa, Homo Sapiens
PKLSPEMES

SEQ ID NO: 1062240 - protein, 9 aa, Homo Sapiens
GVKNLRVVD

SEQ ID NO: 1062241 - protein, 9 aa, Homo Sapiens
EGSELPPGP

SEQ ID NO: 1062242 - protein, 9 aa, Homo Sapiens
KKEEAEEES

SEQ ID NO: 1062243 - protein, 9 aa, Homo Sapiens
FCFQDTGLL

SEQ ID NO: 1062244 - protein, 9 aa, Homo Sapiens
CPNVCETKS

SEQ ID NO: 1062245 - protein, 9 aa, Homo Sapiens
DSIFLAGKA

SEQ ID NO: 1062246 - protein, 9 aa, Homo Sapiens
VSTKKMYEI

SEQ ID NO: 1062247 - protein, 9 aa, Homo Sapiens
SPFSSHAQA

SEQ ID NO: 1062248 - protein, 9 aa, Homo Sapiens
CYSNWLDKL

SEQ ID NO: 1062249 - protein, 9 aa, Homo Sapiens
SEMNLQICF

SEQ ID NO: 1062250 - protein, 9 aa, Homo Sapiens
VCEAKQEKI

SEQ ID NO: 1062251 - protein, 9 aa, Homo Sapiens
DTQRQRTPG

SEQ ID NO: 1062252 - protein, 9 aa, Homo Sapiens
PTPPQQRCV

SEQ ID NO: 1062253 - protein, 9 aa, Homo Sapiens
GAPGGQALP

SEQ ID NO: 1062254 - protein, 9 aa, Homo Sapiens
PARVTWRED

SEQ ID NO: 1062255 - protein, 9 aa, Homo Sapiens
KEVERKKLK

SEQ ID NO: 1062256 - protein, 9 aa, Homo Sapiens
AEPALEFPT

SEQ ID NO: 1062257 - protein, 9 aa, Homo Sapiens
TSYVLEEVL

SEQ ID NO: 1062258 - protein, 9 aa, Homo Sapiens
SVLSILAPE

SEQ ID NO: 1062259 - protein, 9 aa, Homo Sapiens
VELVDMMEF

SEQ ID NO: 1062260 - protein, 9 aa, Homo Sapiens
PQKRDRLPS

SEQ ID NO: 1062261 - protein, 9 aa, Homo Sapiens
KLLNNFFKD

SEQ ID NO: 1062262 - protein, 9 aa, Homo Sapiens
GEAVPGAVL

SEQ ID NO: 1062263 - protein, 9 aa, Homo Sapiens
TGSSCDTQA

SEQ ID NO: 1062264 - protein, 9 aa, Homo Sapiens
VSLQERGGS

SEQ ID NO: 1062265 - protein, 9 aa, Homo Sapiens
ESRLRKPPG

SEQ ID NO: 1062266 - protein, 9 aa, Homo Sapiens
LTSCYKLTV

SEQ ID NO: 1062267 - protein, 9 aa, Homo Sapiens
ICLVQRMGR

SEQ ID NO: 1062268 - protein, 9 aa, Homo Sapiens
IMFETFNVL

SEQ ID NO: 1062269 - protein, 9 aa, Homo Sapiens
FLIYLKPKG

SEQ ID NO: 1062270 - protein, 9 aa, Homo Sapiens
KISYPGRTN

SEQ ID NO: 1062271 - protein, 9 aa, Homo Sapiens
NTELIQLLK

SEQ ID NO: 1062272 - protein, 9 aa, Homo Sapiens
PKTKALKHK

SEQ ID NO: 1062273 - protein, 9 aa, Homo Sapiens
YSPGPAPPY

SEQ ID NO: 1062274 - protein, 9 aa, Homo Sapiens
FASVLTGKL

SEQ ID NO: 1062275 - protein, 9 aa, Homo Sapiens
EIYVGLEAS

SEQ ID NO: 1062276 - protein, 9 aa, Homo Sapiens
HMSIKIHTP

SEQ ID NO: 1062277 - protein, 9 aa, Homo Sapiens
TLLVTRLSD

SEQ ID NO: 1062278 - protein, 9 aa, Homo Sapiens
RDNRRSKSI

SEQ ID NO: 1062279 - protein, 9 aa, Homo Sapiens
SCKKAAFSY

SEQ ID NO: 1062280 - protein, 9 aa, Homo Sapiens
RKNARSQKN

SEQ ID NO: 1062281 - protein, 9 aa, Homo Sapiens
RLYAFGAER

SEQ ID NO: 1062282 - protein, 9 aa, Homo Sapiens
GNGFYFLAG

SEQ ID NO: 1062283 - protein, 9 aa, Homo Sapiens
AFVGLFFPT

SEQ ID NO: 1062284 - protein, 9 aa, Homo Sapiens
TCVIQEVGV

SEQ ID NO: 1062285 - protein, 9 aa, Homo Sapiens
NYDVNITYG

SEQ ID NO: 1062286 - protein, 9 aa, Homo Sapiens
AVLKFTTKI

SEQ ID NO: 1062287 - protein, 9 aa, Homo Sapiens
ALGEQLYQQ

SEQ ID NO: 1062288 - protein, 9 aa, Homo Sapiens
LITKTLEKI

SEQ ID NO: 1062289 - protein, 9 aa, Homo Sapiens
FQTFQHSGI

SEQ ID NO: 1062290 - protein, 9 aa, Homo Sapiens
NPLSQEAEL

SEQ ID NO: 1062291 - protein, 9 aa, Homo Sapiens
NLSKPKKIY

SEQ ID NO: 1062292 - protein, 9 aa, Homo Sapiens
AFDMADRVK

SEQ ID NO: 1062293 - protein, 9 aa, Homo Sapiens
HVQRDAVKT

SEQ ID NO: 1062294 - protein, 9 aa, Homo Sapiens
PREVRGGHG

SEQ ID NO: 1062295 - protein, 9 aa, Homo Sapiens
KLELQIGNA

SEQ ID NO: 1062296 - protein, 9 aa, Homo Sapiens
ESVIGKTYF

SEQ ID NO: 1062297 - protein, 9 aa, Homo Sapiens
DNVYFLQYS

SEQ ID NO: 1062298 - protein, 9 aa, Homo Sapiens
QGNNFYVFP

SEQ ID NO: 1062299 - protein, 9 aa, Homo Sapiens
ELEEIEENA

SEQ ID NO: 1062300 - protein, 9 aa, Homo Sapiens
KARLSSSPQ

SEQ ID NO: 1062301 - protein, 9 aa, Homo Sapiens
CRMKGFSLF

SEQ ID NO: 1062302 - protein, 9 aa, Homo Sapiens
SYLDARDKN

SEQ ID NO: 1062303 - protein, 9 aa, Homo Sapiens
EESSKKEEE

SEQ ID NO: 1062304 - protein, 9 aa, Homo Sapiens
MPHLAQAGA

SEQ ID NO: 1062305 - protein, 9 aa, Homo Sapiens
LQNSSCSLE

SEQ ID NO: 1062306 - protein, 9 aa, Homo Sapiens
KDKLNLKED

SEQ ID NO: 1062307 - protein, 9 aa, Homo Sapiens
KFLFYQRLF

SEQ ID NO: 1062308 - protein, 9 aa, Homo Sapiens
DPSVKWEYC

SEQ ID NO: 1062309 - protein, 9 aa, Homo Sapiens
DESFRQSQS

SEQ ID NO: 1062310 - protein, 9 aa, Homo Sapiens
DIHQSFRSL

SEQ ID NO: 1062311 - protein, 9 aa, Homo Sapiens
PNLRPIFKS

SEQ ID NO: 1062312 - protein, 9 aa, Homo Sapiens
LSDTPETVQ

SEQ ID NO: 1062313 - protein, 9 aa, Homo Sapiens
EQLKEELAK

SEQ ID NO: 1062314 - protein, 9 aa, Homo Sapiens
LLAQLFFCA

SEQ ID NO: 1062315 - protein, 9 aa, Homo Sapiens
QSSKLFTHK

SEQ ID NO: 1062316 - protein, 9 aa, Homo Sapiens
QTVHFTFEA

SEQ ID NO: 1062317 - protein, 9 aa, Homo Sapiens
LSLEDKSPE

SEQ ID NO: 1062318 - protein, 9 aa, Homo Sapiens
LAGFPSVPL

SEQ ID NO: 1062319 - protein, 9 aa, Homo Sapiens
LNTLAELCC

SEQ ID NO: 1062320 - protein, 9 aa, Homo Sapiens
HKGSIIVNV

SEQ ID NO: 1062321 - protein, 9 aa, Homo Sapiens
TSLLQKVVY

SEQ ID NO: 1062322 - protein, 9 aa, Homo Sapiens
RPCLYSATP

SEQ ID NO: 1062323 - protein, 9 aa, Homo Sapiens
WLPAYKFKK

SEQ ID NO: 1062324 - protein, 9 aa, Homo Sapiens
RRYENCGHE

SEQ ID NO: 1062325 - protein, 9 aa, Homo Sapiens
FLDKVIMEM

SEQ ID NO: 1062326 - protein, 9 aa, Homo Sapiens
PPPPPQAQA

SEQ ID NO: 1062327 - protein, 9 aa, Homo Sapiens
LNTIFTPLL

SEQ ID NO: 1062328 - protein, 9 aa, Homo Sapiens
DLVNSCVSG

SEQ ID NO: 1062329 - protein, 9 aa, Homo Sapiens
CAFFIYLRP

SEQ ID NO: 1062330 - protein, 9 aa, Homo Sapiens
HRCWVYILD

SEQ ID NO: 1062331 - protein, 9 aa, Homo Sapiens
SPEHRQTAR

SEQ ID NO: 1062332 - protein, 9 aa, Homo Sapiens
DFLMCLFCQ

SEQ ID NO: 1062333 - protein, 9 aa, Homo Sapiens
LAAVSRIVA

SEQ ID NO: 1062334 - protein, 9 aa, Homo Sapiens
YKIVDGDDL

SEQ ID NO: 1062335 - protein, 9 aa, Homo Sapiens
VLFMYGKQA

SEQ ID NO: 1062336 - protein, 9 aa, Homo Sapiens
RRRTPALPK

SEQ ID NO: 1062337 - protein, 9 aa, Homo Sapiens
SKRMFKELP

SEQ ID NO: 1062338 - protein, 9 aa, Homo Sapiens
DNKENDEHE

SEQ ID NO: 1062339 - protein, 9 aa, Homo Sapiens
HRVHQSPNG

SEQ ID NO: 1062340 - protein, 9 aa, Homo Sapiens
SGYNAWLLY

SEQ ID NO: 1062341 - protein, 9 aa, Homo Sapiens
AKLLNVGSQ

SEQ ID NO: 1062342 - protein, 9 aa, Homo Sapiens
CSSHKIQHF

SEQ ID NO: 1062343 - protein, 9 aa, Homo Sapiens
ASINNLKPE

SEQ ID NO: 1062344 - protein, 9 aa, Homo Sapiens
SKPGESEVD

SEQ ID NO: 1062345 - protein, 9 aa, Homo Sapiens
MESTTIELV

SEQ ID NO: 1062346 - protein, 9 aa, Homo Sapiens
VPDDLALLK

SEQ ID NO: 1062347 - protein, 9 aa, Homo Sapiens
FLLLGFPID

SEQ ID NO: 1062348 - protein, 9 aa, Homo Sapiens
YLTEYSYGT

SEQ ID NO: 1062349 - protein, 9 aa, Homo Sapiens
VLKELRDQR

SEQ ID NO: 1062350 - protein, 9 aa, Homo Sapiens
GNNTRELPI

SEQ ID NO: 1062351 - protein, 9 aa, Homo Sapiens
RMRVVHKTR

SEQ ID NO: 1062352 - protein, 9 aa, Homo Sapiens
CKKMSVGYA

SEQ ID NO: 1062353 - protein, 9 aa, Homo Sapiens
TSFPELFSE

SEQ ID NO: 1062354 - protein, 9 aa, Homo Sapiens
LKQLSDLEK

SEQ ID NO: 1062355 - protein, 9 aa, Homo Sapiens
TDVWTYSNT

SEQ ID NO: 1062356 - protein, 9 aa, Homo Sapiens
SSGILSMAN

SEQ ID NO: 1062357 - protein, 9 aa, Homo Sapiens
VPAGRSKAK

SEQ ID NO: 1062358 - protein, 9 aa, Homo Sapiens
SSPAQNWTL

SEQ ID NO: 1062359 - protein, 9 aa, Homo Sapiens
AFYAAILAT

SEQ ID NO: 1062360 - protein, 9 aa, Homo Sapiens
SGYWGLPEQ

SEQ ID NO: 1062361 - protein, 9 aa, Homo Sapiens
YHWYCKAFD

SEQ ID NO: 1062362 - protein, 9 aa, Homo Sapiens
VSIIAIFLF

SEQ ID NO: 1062363 - protein, 9 aa, Homo Sapiens
VDFGLSERL

SEQ ID NO: 1062364 - protein, 9 aa, Homo Sapiens
CYREGQVLC

SEQ ID NO: 1062365 - protein, 9 aa, Homo Sapiens
MLDRESLYT

SEQ ID NO: 1062366 - protein, 9 aa, Homo Sapiens
ELSKIIFYR

SEQ ID NO: 1062367 - protein, 9 aa, Homo Sapiens
YQPYGKSVN

SEQ ID NO: 1062368 - protein, 9 aa, Homo Sapiens
PPALSGTQV

SEQ ID NO: 1062369 - protein, 9 aa, Homo Sapiens
SFNLETAMS

SEQ ID NO: 1062370 - protein, 9 aa, Homo Sapiens
FNNFSTLMK

SEQ ID NO: 1062371 - protein, 9 aa, Homo Sapiens
CNVCGKFFS

SEQ ID NO: 1062372 - protein, 9 aa, Homo Sapiens
ECDAPPNIL

SEQ ID NO: 1062373 - protein, 9 aa, Homo Sapiens
LIAHEKIYS

SEQ ID NO: 1062374 - protein, 9 aa, Homo Sapiens
LGEKMIEEE

SEQ ID NO: 1062375 - protein, 9 aa, Homo Sapiens
KVFTPVSCL

SEQ ID NO: 1062376 - protein, 9 aa, Homo Sapiens
ATALIQSLN

SEQ ID NO: 1062377 - protein, 9 aa, Homo Sapiens
PDPQNISFR

SEQ ID NO: 1062378 - protein, 9 aa, Homo Sapiens
IGNICCAQF

SEQ ID NO: 1062379 - protein, 9 aa, Homo Sapiens
AEEFLWSLL

SEQ ID NO: 1062380 - protein, 9 aa, Homo Sapiens
LLHRADPDY

SEQ ID NO: 1062381 - protein, 9 aa, Homo Sapiens
YLQCNMKFM

SEQ ID NO: 1062382 - protein, 9 aa, Homo Sapiens
SLPGLLIAT

SEQ ID NO: 1062383 - protein, 9 aa, Homo Sapiens
PPVSCLPSQ

SEQ ID NO: 1062384 - protein, 9 aa, Homo Sapiens
QPKPVKPFL

SEQ ID NO: 1062385 - protein, 9 aa, Homo Sapiens
ELEKRTISR

SEQ ID NO: 1062386 - protein, 9 aa, Homo Sapiens
ATLLYLVQQ

SEQ ID NO: 1062387 - protein, 9 aa, Homo Sapiens
QELGCYFYE

SEQ ID NO: 1062388 - protein, 9 aa, Homo Sapiens
GLRKVKKDT

SEQ ID NO: 1062389 - protein, 9 aa, Homo Sapiens
LGEPEGSEL

SEQ ID NO: 1062390 - protein, 9 aa, Homo Sapiens
PRPTPPPFP

SEQ ID NO: 1062391 - protein, 9 aa, Homo Sapiens
KMSGPYNSS

SEQ ID NO: 1062392 - protein, 9 aa, Homo Sapiens
LLLGFPIDP

SEQ ID NO: 1062393 - protein, 9 aa, Homo Sapiens
QRTLLEFWK

SEQ ID NO: 1062394 - protein, 9 aa, Homo Sapiens
EEWQLVLNV

SEQ ID NO: 1062395 - protein, 9 aa, Homo Sapiens
GGEVGDSRT

SEQ ID NO: 1062396 - protein, 9 aa, Homo Sapiens
SDEEWQLVL

SEQ ID NO: 1062397 - protein, 9 aa, Homo Sapiens
FEEKQKEQE

SEQ ID NO: 1062398 - protein, 9 aa, Homo Sapiens
VDKNGNQKL

SEQ ID NO: 1062399 - protein, 9 aa, Homo Sapiens
LEPRRGFSF

SEQ ID NO: 1062400 - protein, 9 aa, Homo Sapiens
GDWETMTND

SEQ ID NO: 1062401 - protein, 9 aa, Homo Sapiens
QARPSLQLP

SEQ ID NO: 1062402 - protein, 9 aa, Homo Sapiens
LIALLTKPK

SEQ ID NO: 1062403 - protein, 9 aa, Homo Sapiens
APSILNGFD

SEQ ID NO: 1062404 - protein, 9 aa, Homo Sapiens
TSIQRAVQV

SEQ ID NO: 1062405 - protein, 9 aa, Homo Sapiens
SVADDTPPS

SEQ ID NO: 1062406 - protein, 9 aa, Homo Sapiens
ASVLGLDNI

SEQ ID NO: 1062407 - protein, 9 aa, Homo Sapiens
VDFRDALGS

SEQ ID NO: 1062408 - protein, 9 aa, Homo Sapiens
LRTNHIGWM

SEQ ID NO: 1062409 - protein, 9 aa, Homo Sapiens
GAPELLVGF

SEQ ID NO: 1062410 - protein, 9 aa, Homo Sapiens
KQEKTCRAY

SEQ ID NO: 1062411 - protein, 9 aa, Homo Sapiens
PPPTPSPGF

SEQ ID NO: 1062412 - protein, 9 aa, Homo Sapiens
GSAGSLSAA

SEQ ID NO: 1062413 - protein, 9 aa, Homo Sapiens
GLSERLGSW

SEQ ID NO: 1062414 - protein, 9 aa, Homo Sapiens
NGSSTTEDK

SEQ ID NO: 1062415 - protein, 9 aa, Homo Sapiens
CDFLSLLIL

SEQ ID NO: 1062416 - protein, 9 aa, Homo Sapiens
RRVTQVMRD

SEQ ID NO: 1062417 - protein, 9 aa, Homo Sapiens
ASPVENTSN

SEQ ID NO: 1062418 - protein, 9 aa, Homo Sapiens
HGSLICQAA

SEQ ID NO: 1062419 - protein, 9 aa, Homo Sapiens
QKKYLVYRQ

SEQ ID NO: 1062420 - protein, 9 aa, Homo Sapiens
LFSHSGLRQ

SEQ ID NO: 1062421 - protein, 9 aa, Homo Sapiens
KPENPEDTY

SEQ ID NO: 1062422 - protein, 9 aa, Homo Sapiens
TFTISVTDI

SEQ ID NO: 1062423 - protein, 9 aa, Homo Sapiens
PLRTVPDSE

SEQ ID NO: 1062424 - protein, 9 aa, Homo Sapiens
TAPISGFEP

SEQ ID NO: 1062425 - protein, 9 aa, Homo Sapiens
LEQRYRLLE

SEQ ID NO: 1062426 - protein, 9 aa, Homo Sapiens
WNHIDPRQK

SEQ ID NO: 1062427 - protein, 9 aa, Homo Sapiens
HLHTLMYFS

SEQ ID NO: 1062428 - protein, 9 aa, Homo Sapiens
SRGQIIYTW

SEQ ID NO: 1062429 - protein, 9 aa, Homo Sapiens
IIHHHISFN

SEQ ID NO: 1062430 - protein, 9 aa, Homo Sapiens
SSENNLLVQ

SEQ ID NO: 1062431 - protein, 9 aa, Homo Sapiens
PLHKKEAKD

SEQ ID NO: 1062432 - protein, 9 aa, Homo Sapiens
YFFFKDPIQ

SEQ ID NO: 1062433 - protein, 9 aa, Homo Sapiens
TFTPMSLSS

SEQ ID NO: 1062434 - protein, 9 aa, Homo Sapiens
PADTGDLLP

SEQ ID NO: 1062435 - protein, 9 aa, Homo Sapiens
SEGTQHNPL

SEQ ID NO: 1062436 - protein, 9 aa, Homo Sapiens
RMSSQPPDP

SEQ ID NO: 1062437 - protein, 9 aa, Homo Sapiens
LGTQDNPAR

SEQ ID NO: 1062438 - protein, 9 aa, Homo Sapiens
LQKAGPGET

SEQ ID NO: 1062439 - protein, 9 aa, Homo Sapiens
TSRHYLDFI

SEQ ID NO: 1062440 - protein, 9 aa, Homo Sapiens
ETGWTGSSC

SEQ ID NO: 1062441 - protein, 9 aa, Homo Sapiens
SEVNIYNIY

SEQ ID NO: 1062442 - protein, 9 aa, Homo Sapiens
WVIYIRNQQ

SEQ ID NO: 1062443 - protein, 9 aa, Homo Sapiens
TYDSVKTSI

SEQ ID NO: 1062444 - protein, 9 aa, Homo Sapiens
LFMYGKQAG

SEQ ID NO: 1062445 - protein, 9 aa, Homo Sapiens
FLIFYYSKK

SEQ ID NO: 1062446 - protein, 9 aa, Homo Sapiens
RSRLITTSA

SEQ ID NO: 1062447 - protein, 9 aa, Homo Sapiens
KLYVCNECG

SEQ ID NO: 1062448 - protein, 9 aa, Homo Sapiens
IESTLKEGN

SEQ ID NO: 1062449 - protein, 9 aa, Homo Sapiens
GNLGMKGEA

SEQ ID NO: 1062450 - protein, 9 aa, Homo Sapiens
EEWQDKDLP

SEQ ID NO: 1062451 - protein, 9 aa, Homo Sapiens
TQTVVLSPL

SEQ ID NO: 1062452 - protein, 9 aa, Homo Sapiens
DETIQVKEN

SEQ ID NO: 1062453 - protein, 9 aa, Homo Sapiens
VQICVPRQG

SEQ ID NO: 1062454 - protein, 9 aa, Homo Sapiens
PLPARRHRH

SEQ ID NO: 1062455 - protein, 9 aa, Homo Sapiens
KVWSRTAYL

SEQ ID NO: 1062456 - protein, 9 aa, Homo Sapiens
MFEEATEEE

SEQ ID NO: 1062457 - protein, 9 aa, Homo Sapiens
SDLYVRVYL

SEQ ID NO: 1062458 - protein, 9 aa, Homo Sapiens
LLFLFSSSL

SEQ ID NO: 1062459 - protein, 9 aa, Homo Sapiens
PACEPSLLS

SEQ ID NO: 1062460 - protein, 9 aa, Homo Sapiens
KVYNYYETD

SEQ ID NO: 1062461 - protein, 9 aa, Homo Sapiens
YESESGSNS

SEQ ID NO: 1062462 - protein, 9 aa, Homo Sapiens
IEVQAEKLA

SEQ ID NO: 1062463 - protein, 9 aa, Homo Sapiens
VFIDLCLKK

SEQ ID NO: 1062464 - protein, 9 aa, Homo Sapiens
SYFKFKEYC

SEQ ID NO: 1062465 - protein, 9 aa, Homo Sapiens
RVCLKPQRY

SEQ ID NO: 1062466 - protein, 9 aa, Homo Sapiens
LAQLFFCAD

SEQ ID NO: 1062467 - protein, 9 aa, Homo Sapiens
QFFSEVFFS

SEQ ID NO: 1062468 - protein, 9 aa, Homo Sapiens
SLITSNLTR

SEQ ID NO: 1062469 - protein, 9 aa, Homo Sapiens
SREKSFICT

SEQ ID NO: 1062470 - protein, 9 aa, Homo Sapiens
PTFQGRDWV

SEQ ID NO: 1062471 - protein, 9 aa, Homo Sapiens
RHYSSQWIE

SEQ ID NO: 1062472 - protein, 9 aa, Homo Sapiens
DKFSGIVSK

SEQ ID NO: 1062473 - protein, 9 aa, Homo Sapiens
LPDGPSQPD

SEQ ID NO: 1062474 - protein, 9 aa, Homo Sapiens
PILYDPQIT

SEQ ID NO: 1062475 - protein, 9 aa, Homo Sapiens
FLNNKKNGN

SEQ ID NO: 1062476 - protein, 9 aa, Homo Sapiens
HVSTSSDER

SEQ ID NO: 1062477 - protein, 9 aa, Homo Sapiens
PRAPTKKLG

SEQ ID NO: 1062478 - protein, 9 aa, Homo Sapiens
DRNKHIYKK

SEQ ID NO: 1062479 - protein, 9 aa, Homo Sapiens
SLSETPTGL

SEQ ID NO: 1062480 - protein, 9 aa, Homo Sapiens
SNRPPRQPL

SEQ ID NO: 1062481 - protein, 9 aa, Homo Sapiens
ELSRAGALV

SEQ ID NO: 1062482 - protein, 9 aa, Homo Sapiens
YVLEEVLWG

SEQ ID NO: 1062483 - protein, 9 aa, Homo Sapiens
DTQCQGLPC

SEQ ID NO: 1062484 - protein, 9 aa, Homo Sapiens
LTRMLLPPR

SEQ ID NO: 1062485 - protein, 9 aa, Homo Sapiens
VVTAKKIVH

SEQ ID NO: 1062486 - protein, 9 aa, Homo Sapiens
RHSARLSPE

SEQ ID NO: 1062487 - protein, 9 aa, Homo Sapiens
NQQIFRMFP

SEQ ID NO: 1062488 - protein, 9 aa, Homo Sapiens
QKENISLFA

SEQ ID NO: 1062489 - protein, 9 aa, Homo Sapiens
RSIASETHV

SEQ ID NO: 1062490 - protein, 9 aa, Homo Sapiens
PTLTGMVPE

SEQ ID NO: 1062491 - protein, 9 aa, Homo Sapiens
GFEIFDFNN

SEQ ID NO: 1062492 - protein, 9 aa, Homo Sapiens
FINVMKEAF

SEQ ID NO: 1062493 - protein, 9 aa, Homo Sapiens
VMKHHTLPE

SEQ ID NO: 1062494 - protein, 9 aa, Homo Sapiens
VNLGGANMA

SEQ ID NO: 1062495 - protein, 9 aa, Homo Sapiens
LNPDFQRMP

SEQ ID NO: 1062496 - protein, 9 aa, Homo Sapiens
RVLVALKLS

SEQ ID NO: 1062497 - protein, 9 aa, Homo Sapiens
LSIWHQLAF

SEQ ID NO: 1062498 - protein, 9 aa, Homo Sapiens
HLRKEGHKV

SEQ ID NO: 1062499 - protein, 9 aa, Homo Sapiens
EGRPGPQQP

SEQ ID NO: 1062500 - protein, 9 aa, Homo Sapiens
GIMLSSWAT

SEQ ID NO: 1062501 - protein, 9 aa, Homo Sapiens
VDRRPLGPS

SEQ ID NO: 1062502 - protein, 9 aa, Homo Sapiens
SLSSPAFAI

SEQ ID NO: 1062503 - protein, 9 aa, Homo Sapiens
SLMDCNRFF

SEQ ID NO: 1062504 - protein, 9 aa, Homo Sapiens
QIVYMGWCK

SEQ ID NO: 1062505 - protein, 9 aa, Homo Sapiens
KLPRRRFHQ

SEQ ID NO: 1062506 - protein, 9 aa, Homo Sapiens
PYSPGPAPP

SEQ ID NO: 1062507 - protein, 9 aa, Homo Sapiens
KLQAKHNLL

SEQ ID NO: 1062508 - protein, 9 aa, Homo Sapiens
PIDGPPGGS

SEQ ID NO: 1062509 - protein, 9 aa, Homo Sapiens
EDTTNSGEK

SEQ ID NO: 1062510 - protein, 9 aa, Homo Sapiens
FRGLQSDQN

SEQ ID NO: 1062511 - protein, 9 aa, Homo Sapiens
DKSLHLEED

SEQ ID NO: 1062512 - protein, 9 aa, Homo Sapiens
YTALLVDII

SEQ ID NO: 1062513 - protein, 9 aa, Homo Sapiens
LTEYSYGTC

SEQ ID NO: 1062514 - protein, 9 aa, Homo Sapiens
HAGARDHGA

SEQ ID NO: 1062515 - protein, 9 aa, Homo Sapiens
NNTNIKNSE

SEQ ID NO: 1062516 - protein, 9 aa, Homo Sapiens
SPHTIPTYT

SEQ ID NO: 1062517 - protein, 9 aa, Homo Sapiens
NPPTQKPLP

SEQ ID NO: 1062518 - protein, 9 aa, Homo Sapiens
YNLAIKDLK

SEQ ID NO: 1062519 - protein, 9 aa, Homo Sapiens
LFFPSIKPD

SEQ ID NO: 1062520 - protein, 9 aa, Homo Sapiens
PFLVLSIVV

SEQ ID NO: 1062521 - protein, 9 aa, Homo Sapiens
GRSKAKLRA

SEQ ID NO: 1062522 - protein, 9 aa, Homo Sapiens
WGKDKSWTG

SEQ ID NO: 1062523 - protein, 9 aa, Homo Sapiens
KTGGFRSDL

SEQ ID NO: 1062524 - protein, 9 aa, Homo Sapiens
MHTANLPHV

SEQ ID NO: 1062525 - protein, 9 aa, Homo Sapiens
RLPTTELSS

SEQ ID NO: 1062526 - protein, 9 aa, Homo Sapiens
RVQVSFLYR

SEQ ID NO: 1062527 - protein, 9 aa, Homo Sapiens
IAQNQASVL

SEQ ID NO: 1062528 - protein, 9 aa, Homo Sapiens
LYSQASGRD

SEQ ID NO: 1062529 - protein, 9 aa, Homo Sapiens
SPVENTSND

SEQ ID NO: 1062530 - protein, 9 aa, Homo Sapiens
DIKQSSDSK

SEQ ID NO: 1062531 - protein, 9 aa, Homo Sapiens
IMGPETPMD

SEQ ID NO: 1062532 - protein, 9 aa, Homo Sapiens
ECSKVFKYL

SEQ ID NO: 1062533 - protein, 9 aa, Homo Sapiens
HFIYNSHTA

SEQ ID NO: 1062534 - protein, 9 aa, Homo Sapiens
EGFRCECWV

SEQ ID NO: 1062535 - protein, 9 aa, Homo Sapiens
QTMARNRGA

SEQ ID NO: 1062536 - protein, 9 aa, Homo Sapiens
FIRGEGAGF

SEQ ID NO: 1062537 - protein, 9 aa, Homo Sapiens
EAYTWTNLT

SEQ ID NO: 1062538 - protein, 9 aa, Homo Sapiens
YALVSLFFF

SEQ ID NO: 1062539 - protein, 9 aa, Homo Sapiens
FMKSLGNKF

SEQ ID NO: 1062540 - protein, 9 aa, Homo Sapiens
VFILLLLSR

SEQ ID NO: 1062541 - protein, 9 aa, Homo Sapiens
KDQERPQVT

SEQ ID NO: 1062542 - protein, 9 aa, Homo Sapiens
LHGVKIKKK

SEQ ID NO: 1062543 - protein, 9 aa, Homo Sapiens
PAGSRVELA

SEQ ID NO: 1062544 - protein, 9 aa, Homo Sapiens
NAGGCNFNF

SEQ ID NO: 1062545 - protein, 9 aa, Homo Sapiens
GADFLDSPP

SEQ ID NO: 1062546 - protein, 9 aa, Homo Sapiens
GIPVREKKT

SEQ ID NO: 1062547 - protein, 9 aa, Homo Sapiens
ALQIVANFF

SEQ ID NO: 1062548 - protein, 9 aa, Homo Sapiens
MEGSAFLGD

SEQ ID NO: 1062549 - protein, 9 aa, Homo Sapiens
VGMCGDRAN

SEQ ID NO: 1062550 - protein, 9 aa, Homo Sapiens
PVVSTISKE

SEQ ID NO: 1062551 - protein, 9 aa, Homo Sapiens
LASTTQINF

SEQ ID NO: 1062552 - protein, 9 aa, Homo Sapiens
IIEQRPELL

SEQ ID NO: 1062553 - protein, 9 aa, Homo Sapiens
LYRLEGFWK

SEQ ID NO: 1062554 - protein, 9 aa, Homo Sapiens
AWAAIFIAQ

SEQ ID NO: 1062555 - protein, 9 aa, Homo Sapiens
KEQFSDRKQ

SEQ ID NO: 1062556 - protein, 9 aa, Homo Sapiens
LAEVLAFLL

SEQ ID NO: 1062557 - protein, 9 aa, Homo Sapiens
CKAFDVEPS

SEQ ID NO: 1062558 - protein, 9 aa, Homo Sapiens
YISSSPTLS

SEQ ID NO: 1062559 - protein, 9 aa, Homo Sapiens
INGLMLPTD

SEQ ID NO: 1062560 - protein, 9 aa, Homo Sapiens
QLLRRIPNP

SEQ ID NO: 1062561 - protein, 9 aa, Homo Sapiens
DNVSLLALS

SEQ ID NO: 1062562 - protein, 9 aa, Homo Sapiens
NASMSEFLS

SEQ ID NO: 1062563 - protein, 9 aa, Homo Sapiens
DHPHHCNVI

SEQ ID NO: 1062564 - protein, 9 aa, Homo Sapiens
VCRRKAGVQ

SEQ ID NO: 1062565 - protein, 9 aa, Homo Sapiens
ILIMGILRV

SEQ ID NO: 1062566 - protein, 9 aa, Homo Sapiens
WRGLFAATF

SEQ ID NO: 1062567 - protein, 9 aa, Homo Sapiens
KILEKFKPS

SEQ ID NO: 1062568 - protein, 9 aa, Homo Sapiens
EELHHQRPK

SEQ ID NO: 1062569 - protein, 9 aa, Homo Sapiens
ADEELLGQR

SEQ ID NO: 1062570 - protein, 9 aa, Homo Sapiens
GPGGLGNGL

SEQ ID NO: 1062571 - protein, 9 aa, Homo Sapiens
TRFHSARSK

SEQ ID NO: 1062572 - protein, 9 aa, Homo Sapiens
ENYRHLVFF

SEQ ID NO: 1062573 - protein, 9 aa, Homo Sapiens
PLPAKSTLI

SEQ ID NO: 1062574 - protein, 9 aa, Homo Sapiens
NPPAATVLP

SEQ ID NO: 1062575 - protein, 9 aa, Homo Sapiens
FYVFPGVAL

SEQ ID NO: 1062576 - protein, 9 aa, Homo Sapiens
RDLVRLLSD

SEQ ID NO: 1062577 - protein, 9 aa, Homo Sapiens
DHPKKRFGI

SEQ ID NO: 1062578 - protein, 9 aa, Homo Sapiens
GNGEVKGRK

SEQ ID NO: 1062579 - protein, 9 aa, Homo Sapiens
SPHPRHLQQ

SEQ ID NO: 1062580 - protein, 9 aa, Homo Sapiens
NEQGLSYSS

SEQ ID NO: 1062581 - protein, 9 aa, Homo Sapiens
LEKMVPSFC

SEQ ID NO: 1062582 - protein, 9 aa, Homo Sapiens
LNPFQTSMS

SEQ ID NO: 1062583 - protein, 9 aa, Homo Sapiens
FVSPPPFKQ

SEQ ID NO: 1062584 - protein, 9 aa, Homo Sapiens
HQRIYTGEK

SEQ ID NO: 1062585 - protein, 9 aa, Homo Sapiens
KDIDNPPKN

SEQ ID NO: 1062586 - protein, 9 aa, Homo Sapiens
RGDTDLGHS

SEQ ID NO: 1062587 - protein, 9 aa, Homo Sapiens
FLLVTAKGE

SEQ ID NO: 1062588 - protein, 9 aa, Homo Sapiens
SAIPPLRLS

SEQ ID NO: 1062589 - protein, 9 aa, Homo Sapiens
GNSEKALQA

SEQ ID NO: 1062590 - protein, 9 aa, Homo Sapiens
ITFSDGCQD

SEQ ID NO: 1062591 - protein, 9 aa, Homo Sapiens
ECSFTCKSS

SEQ ID NO: 1062592 - protein, 9 aa, Homo Sapiens
LRKSGEEQQ

SEQ ID NO: 1062593 - protein, 9 aa, Homo Sapiens
TCNNPGMPQ

SEQ ID NO: 1062594 - protein, 9 aa, Homo Sapiens
EEDGTPEGL

SEQ ID NO: 1062595 - protein, 9 aa, Homo Sapiens
FILLGFFQN

SEQ ID NO: 1062596 - protein, 9 aa, Homo Sapiens
KEFAYEQKV

SEQ ID NO: 1062597 - protein, 9 aa, Homo Sapiens
VYMGWCKAR

SEQ ID NO: 1062598 - protein, 9 aa, Homo Sapiens
PTLIFEPYE

SEQ ID NO: 1062599 - protein, 9 aa, Homo Sapiens
STAFQPLCT

SEQ ID NO: 1062600 - protein, 9 aa, Homo Sapiens
TPLSPEKEE

SEQ ID NO: 1062601 - protein, 9 aa, Homo Sapiens
QKLAALRQE

SEQ ID NO: 1062602 - protein, 9 aa, Homo Sapiens
KQEDKATLE

SEQ ID NO: 1062603 - protein, 9 aa, Homo Sapiens
RKKMSLVKE

SEQ ID NO: 1062604 - protein, 9 aa, Homo Sapiens
GNKDLKKHV

SEQ ID NO: 1062605 - protein, 9 aa, Homo Sapiens
RPRQARWIL

SEQ ID NO: 1062606 - protein, 9 aa, Homo Sapiens
FFSPPSPMG

SEQ ID NO: 1062607 - protein, 9 aa, Homo Sapiens
SLAKVDATA

SEQ ID NO: 1062608 - protein, 9 aa, Homo Sapiens
DLFPKMPYE

SEQ ID NO: 1062609 - protein, 9 aa, Homo Sapiens
AFIRSSFFI

SEQ ID NO: 1062610 - protein, 9 aa, Homo Sapiens
TLKHVSPNA

SEQ ID NO: 1062611 - protein, 9 aa, Homo Sapiens
YLLVTPMVN

SEQ ID NO: 1062612 - protein, 9 aa, Homo Sapiens
LKIKVSTKK

SEQ ID NO: 1062613 - protein, 9 aa, Homo Sapiens
ELRGPELLG

SEQ ID NO: 1062614 - protein, 9 aa, Homo Sapiens
YKTVDQWKI

SEQ ID NO: 1062615 - protein, 9 aa, Homo Sapiens
KEGADEAAE

SEQ ID NO: 1062616 - protein, 9 aa, Homo Sapiens
ENCGHENLH

SEQ ID NO: 1062617 - protein, 9 aa, Homo Sapiens
PQTFLCFSE

SEQ ID NO: 1062618 - protein, 9 aa, Homo Sapiens
EDYPKTGEH

SEQ ID NO: 1062619 - protein, 9 aa, Homo Sapiens
QPRGQLDSR

SEQ ID NO: 1062620 - protein, 9 aa, Homo Sapiens
AFRNLVSVT

SEQ ID NO: 1062621 - protein, 9 aa, Homo Sapiens
SMGTQSGCG

SEQ ID NO: 1062622 - protein, 9 aa, Homo Sapiens
AAQSPCSVS

SEQ ID NO: 1062623 - protein, 9 aa, Homo Sapiens
RNGTPREQG

SEQ ID NO: 1062624 - protein, 9 aa, Homo Sapiens
QPLRVLYHF

SEQ ID NO: 1062625 - protein, 9 aa, Homo Sapiens
LSAFHCPEI

SEQ ID NO: 1062626 - protein, 9 aa, Homo Sapiens
DFLKANMEE

SEQ ID NO: 1062627 - protein, 9 aa, Homo Sapiens
FRVAAPNLA

SEQ ID NO: 1062628 - protein, 9 aa, Homo Sapiens
EATFQSNRY

SEQ ID NO: 1062629 - protein, 9 aa, Homo Sapiens
FSVFYVYGS

SEQ ID NO: 1062630 - protein, 9 aa, Homo Sapiens
VNLDCIQKV

SEQ ID NO: 1062631 - protein, 9 aa, Homo Sapiens
TFILYLETP

SEQ ID NO: 1062632 - protein, 9 aa, Homo Sapiens
IQALPTVLV

SEQ ID NO: 1062633 - protein, 9 aa, Homo Sapiens
VQRYVPLED

SEQ ID NO: 1062634 - protein, 9 aa, Homo Sapiens
DRYRRTALI

SEQ ID NO: 1062635 - protein, 9 aa, Homo Sapiens
PEDSSIYFC

SEQ ID NO: 1062636 - protein, 9 aa, Homo Sapiens
GVIIYKVFC

SEQ ID NO: 1062637 - protein, 9 aa, Homo Sapiens
LPSVICQDV

SEQ ID NO: 1062638 - protein, 9 aa, Homo Sapiens
RPSSCSTQN

SEQ ID NO: 1062639 - protein, 9 aa, Homo Sapiens
CQQSGEIIL

SEQ ID NO: 1062640 - protein, 9 aa, Homo Sapiens
EANLKTKCD

SEQ ID NO: 1062641 - protein, 9 aa, Homo Sapiens
DGKIRIYIF

SEQ ID NO: 1062642 - protein, 9 aa, Homo Sapiens
LEFWPVKLN

SEQ ID NO: 1062643 - protein, 9 aa, Homo Sapiens
TLKNGMLAE

SEQ ID NO: 1062644 - protein, 9 aa, Homo Sapiens
DLPFSSHHQ

SEQ ID NO: 1062645 - protein, 9 aa, Homo Sapiens
GVLRIYPGF

SEQ ID NO: 1062646 - protein, 9 aa, Homo Sapiens
EHTGKGRPA

SEQ ID NO: 1062647 - protein, 9 aa, Homo Sapiens
LSDISTRYA

SEQ ID NO: 1062648 - protein, 9 aa, Homo Sapiens
SRKFRRTNC

SEQ ID NO: 1062649 - protein, 9 aa, Homo Sapiens
PGPRDPMGS

SEQ ID NO: 1062650 - protein, 9 aa, Homo Sapiens
FFLFKVAFS

SEQ ID NO: 1062651 - protein, 9 aa, Homo Sapiens
KSVNWWAFG

SEQ ID NO: 1062652 - protein, 9 aa, Homo Sapiens
DPGEGFRCL

SEQ ID NO: 1062653 - protein, 9 aa, Homo Sapiens
VDTDGGLIF

SEQ ID NO: 1062654 - protein, 9 aa, Homo Sapiens
SPLAREDDS

SEQ ID NO: 1062655 - protein, 9 aa, Homo Sapiens
QKGTKNCWT

SEQ ID NO: 1062656 - protein, 9 aa, Homo Sapiens
LSAGNLGGS

SEQ ID NO: 1062657 - protein, 9 aa, Homo Sapiens
NDSSEEFVN

SEQ ID NO: 1062658 - protein, 9 aa, Homo Sapiens
VSVGLEPIS

SEQ ID NO: 1062659 - protein, 9 aa, Homo Sapiens
NSVVLQLLN

SEQ ID NO: 1062660 - protein, 9 aa, Homo Sapiens
TLHPDVSAN

SEQ ID NO: 1062661 - protein, 9 aa, Homo Sapiens
TCFSSLIKH

SEQ ID NO: 1062662 - protein, 9 aa, Homo Sapiens
VPCYCKLYE

SEQ ID NO: 1062663 - protein, 9 aa, Homo Sapiens
FLLILIFYG

SEQ ID NO: 1062664 - protein, 9 aa, Homo Sapiens
ECNLPEWCN

SEQ ID NO: 1062665 - protein, 9 aa, Homo Sapiens
PKVLVELIE

SEQ ID NO: 1062666 - protein, 9 aa, Homo Sapiens
LQEVEMLKC

SEQ ID NO: 1062667 - protein, 9 aa, Homo Sapiens
KDPPELSPI

SEQ ID NO: 1062668 - protein, 9 aa, Homo Sapiens
LTSEAGLSL

SEQ ID NO: 1062669 - protein, 9 aa, Homo Sapiens
RKDSSGAGL

SEQ ID NO: 1062670 - protein, 9 aa, Homo Sapiens
HLLKFLNDT

SEQ ID NO: 1062671 - protein, 9 aa, Homo Sapiens
GDSRTVLQV

SEQ ID NO: 1062672 - protein, 9 aa, Homo Sapiens
LLQLDQWMW

SEQ ID NO: 1062673 - protein, 9 aa, Homo Sapiens
HQFFEPAPA

SEQ ID NO: 1062674 - protein, 9 aa, Homo Sapiens
LSQPPKSSE

SEQ ID NO: 1062675 - protein, 9 aa, Homo Sapiens
DGYNKFKPQ

SEQ ID NO: 1062676 - protein, 9 aa, Homo Sapiens
SWDEEDKKN

SEQ ID NO: 1062677 - protein, 9 aa, Homo Sapiens
NDASPTYSY

SEQ ID NO: 1062678 - protein, 9 aa, Homo Sapiens
SSIGDLLDS

SEQ ID NO: 1062679 - protein, 9 aa, Homo Sapiens
LSLLLPPPP

SEQ ID NO: 1062680 - protein, 9 aa, Homo Sapiens
RGNLPLVKV

SEQ ID NO: 1062681 - protein, 9 aa, Homo Sapiens
DCSQCQEWL

SEQ ID NO: 1062682 - protein, 9 aa, Homo Sapiens
VPMESLLLD

SEQ ID NO: 1062683 - protein, 9 aa, Homo Sapiens
NQDTENKYF

SEQ ID NO: 1062684 - protein, 9 aa, Homo Sapiens
PREKIVLNF

SEQ ID NO: 1062685 - protein, 9 aa, Homo Sapiens
SDLGKHCSE

SEQ ID NO: 1062686 - protein, 9 aa, Homo Sapiens
GARIPLEYT

SEQ ID NO: 1062687 - protein, 9 aa, Homo Sapiens
SPRSQGQRW

SEQ ID NO: 1062688 - protein, 9 aa, Homo Sapiens
AMSWVFFWI

SEQ ID NO: 1062689 - protein, 9 aa, Homo Sapiens
FCYNVRNLI

SEQ ID NO: 1062690 - protein, 9 aa, Homo Sapiens
LKAPPSLSG

SEQ ID NO: 1062691 - protein, 9 aa, Homo Sapiens
LKGLRWENG

SEQ ID NO: 1062692 - protein, 9 aa, Homo Sapiens
ARGGRARRQ

SEQ ID NO: 1062693 - protein, 9 aa, Homo Sapiens
FLGEEVPQD

SEQ ID NO: 1062694 - protein, 9 aa, Homo Sapiens
KKLGKTLEN

SEQ ID NO: 1062695 - protein, 9 aa, Homo Sapiens
LHFCFQTES

SEQ ID NO: 1062696 - protein, 9 aa, Homo Sapiens
SQESKYQLV

SEQ ID NO: 1062697 - protein, 9 aa, Homo Sapiens
HNGSWARER

SEQ ID NO: 1062698 - protein, 9 aa, Homo Sapiens
VLVALKLSN

SEQ ID NO: 1062699 - protein, 9 aa, Homo Sapiens
GFPIDPRIQ

SEQ ID NO: 1062700 - protein, 9 aa, Homo Sapiens
YPGTEKESF

SEQ ID NO: 1062701 - protein, 9 aa, Homo Sapiens
KIAKMPGMN

SEQ ID NO: 1062702 - protein, 9 aa, Homo Sapiens
HSFSTNIAF

SEQ ID NO: 1062703 - protein, 9 aa, Homo Sapiens
FGNMEDTRK

SEQ ID NO: 1062704 - protein, 9 aa, Homo Sapiens
FYPEKISSM

SEQ ID NO: 1062705 - protein, 9 aa, Homo Sapiens
KFIFVQKKR

SEQ ID NO: 1062706 - protein, 9 aa, Homo Sapiens
NNIENKPPF

SEQ ID NO: 1062707 - protein, 9 aa, Homo Sapiens
MAEAEFKDY

SEQ ID NO: 1062708 - protein, 9 aa, Homo Sapiens
FSAFRAENE

SEQ ID NO: 1062709 - protein, 9 aa, Homo Sapiens
FKIYDPQEK

SEQ ID NO: 1062710 - protein, 9 aa, Homo Sapiens
LQKQEKTCR

SEQ ID NO: 1062711 - protein, 9 aa, Homo Sapiens
DSRPLHEEE

SEQ ID NO: 1062712 - protein, 9 aa, Homo Sapiens
RIIKKVQNL

SEQ ID NO: 1062713 - protein, 9 aa, Homo Sapiens
SLFLFLVLL

SEQ ID NO: 1062714 - protein, 9 aa, Homo Sapiens
LLTWKETCG

SEQ ID NO: 1062715 - protein, 9 aa, Homo Sapiens
TTDFSVQPP

SEQ ID NO: 1062716 - protein, 9 aa, Homo Sapiens
FGREHFPYG

SEQ ID NO: 1062717 - protein, 9 aa, Homo Sapiens
PEQEETTKK

SEQ ID NO: 1062718 - protein, 9 aa, Homo Sapiens
EINSFISNI

SEQ ID NO: 1062719 - protein, 9 aa, Homo Sapiens
YGMLLLCGI

SEQ ID NO: 1062720 - protein, 9 aa, Homo Sapiens
GKFFSQKGT

SEQ ID NO: 1062721 - protein, 9 aa, Homo Sapiens
YRHLVFFGI

SEQ ID NO: 1062722 - protein, 9 aa, Homo Sapiens
TAASGALPG

SEQ ID NO: 1062723 - protein, 9 aa, Homo Sapiens
AQESKQMYC

SEQ ID NO: 1062724 - protein, 9 aa, Homo Sapiens
SLYQFFVVE

SEQ ID NO: 1062725 - protein, 9 aa, Homo Sapiens
PQAQAEGPS

SEQ ID NO: 1062726 - protein, 9 aa, Homo Sapiens
RANKQEAVF

SEQ ID NO: 1062727 - protein, 9 aa, Homo Sapiens
QASGYNQGY

SEQ ID NO: 1062728 - protein, 9 aa, Homo Sapiens
QSQSHSSSC

SEQ ID NO: 1062729 - protein, 9 aa, Homo Sapiens
YQVLAACDF

SEQ ID NO: 1062730 - protein, 9 aa, Homo Sapiens
FSTYHAIIG

SEQ ID NO: 1062731 - protein, 9 aa, Homo Sapiens
GYSNAQESK

SEQ ID NO: 1062732 - protein, 9 aa, Homo Sapiens
IQKNTWASH

SEQ ID NO: 1062733 - protein, 9 aa, Homo Sapiens
NEIHKKNLL

SEQ ID NO: 1062734 - protein, 9 aa, Homo Sapiens
ELWEKASGK

SEQ ID NO: 1062735 - protein, 9 aa, Homo Sapiens
LEETKSKLA

SEQ ID NO: 1062736 - protein, 9 aa, Homo Sapiens
CKMADSFFE

SEQ ID NO: 1062737 - protein, 9 aa, Homo Sapiens
VSFYGGHEL

SEQ ID NO: 1062738 - protein, 9 aa, Homo Sapiens
QQEVKIYFS

SEQ ID NO: 1062739 - protein, 9 aa, Homo Sapiens
TFFINTKRD

SEQ ID NO: 1062740 - protein, 9 aa, Homo Sapiens
LIFLVRLPF

SEQ ID NO: 1062741 - protein, 9 aa, Homo Sapiens
YLRTEFYQH

SEQ ID NO: 1062742 - protein, 9 aa, Homo Sapiens
LTRKRSDSR

SEQ ID NO: 1062743 - protein, 9 aa, Homo Sapiens
ANECLLILK

SEQ ID NO: 1062744 - protein, 9 aa, Homo Sapiens
DPILVPPRG

SEQ ID NO: 1062745 - protein, 9 aa, Homo Sapiens
KVEKDFNLA

SEQ ID NO: 1062746 - protein, 9 aa, Homo Sapiens
PLNETVVRL

SEQ ID NO: 1062747 - protein, 9 aa, Homo Sapiens
NKFKKTSIC

SEQ ID NO: 1062748 - protein, 9 aa, Homo Sapiens
LGEGRGGPS

SEQ ID NO: 1062749 - protein, 9 aa, Homo Sapiens
TNSGEKSSH

SEQ ID NO: 1062750 - protein, 9 aa, Homo Sapiens
YLVSIPAFY

SEQ ID NO: 1062751 - protein, 9 aa, Homo Sapiens
PQAGKKLFG

SEQ ID NO: 1062752 - protein, 9 aa, Homo Sapiens
SLFLIFYYS

SEQ ID NO: 1062753 - protein, 9 aa, Homo Sapiens
QQRWTLGLL

SEQ ID NO: 1062754 - protein, 9 aa, Homo Sapiens
INIVTHRAQ

SEQ ID NO: 1062755 - protein, 9 aa, Homo Sapiens
ESLSYSRIV

SEQ ID NO: 1062756 - protein, 9 aa, Homo Sapiens
LISLVYVDS

SEQ ID NO: 1062757 - protein, 9 aa, Homo Sapiens
RKRRKFIFV

SEQ ID NO: 1062758 - protein, 9 aa, Homo Sapiens
VGMSVNAFR

SEQ ID NO: 1062759 - protein, 9 aa, Homo Sapiens
LEILYQSAD

SEQ ID NO: 1062760 - protein, 9 aa, Homo Sapiens
YLCEECSEK

SEQ ID NO: 1062761 - protein, 9 aa, Homo Sapiens
DFQVTVDVL

SEQ ID NO: 1062762 - protein, 9 aa, Homo Sapiens
PERTADQAD

SEQ ID NO: 1062763 - protein, 9 aa, Homo Sapiens
QAWFTYNNL

SEQ ID NO: 1062764 - protein, 9 aa, Homo Sapiens
PEACSDAGR

SEQ ID NO: 1062765 - protein, 9 aa, Homo Sapiens
LSSGFGFGS

SEQ ID NO: 1062766 - protein, 9 aa, Homo Sapiens
LRQLLFSLV

SEQ ID NO: 1062767 - protein, 9 aa, Homo Sapiens
PHSHSNPDC

SEQ ID NO: 1062768 - protein, 9 aa, Homo Sapiens
EEYLAFLCR

SEQ ID NO: 1062769 - protein, 9 aa, Homo Sapiens
WCLRVEKFL

SEQ ID NO: 1062770 - protein, 9 aa, Homo Sapiens
PEDPRLFFP

SEQ ID NO: 1062771 - protein, 9 aa, Homo Sapiens
VDPQTWLSF

SEQ ID NO: 1062772 - protein, 9 aa, Homo Sapiens
GINLWRGRR

SEQ ID NO: 1062773 - protein, 9 aa, Homo Sapiens
HQSLAGEII

SEQ ID NO: 1062774 - protein, 9 aa, Homo Sapiens
KKTSICKQQ

SEQ ID NO: 1062775 - protein, 9 aa, Homo Sapiens
NSEQIANFS

SEQ ID NO: 1062776 - protein, 9 aa, Homo Sapiens
ILCLLPDDL

SEQ ID NO: 1062777 - protein, 9 aa, Homo Sapiens
LEKETKKEN

SEQ ID NO: 1062778 - protein, 9 aa, Homo Sapiens
LKTHPICLF

SEQ ID NO: 1062779 - protein, 9 aa, Homo Sapiens
FPVAHVLIG

SEQ ID NO: 1062780 - protein, 9 aa, Homo Sapiens
KSIDNYYKL

SEQ ID NO: 1062781 - protein, 9 aa, Homo Sapiens
QAVIFNIFE

SEQ ID NO: 1062782 - protein, 9 aa, Homo Sapiens
AQLRKLIFE

SEQ ID NO: 1062783 - protein, 9 aa, Homo Sapiens
FKCSLYADS

SEQ ID NO: 1062784 - protein, 9 aa, Homo Sapiens
DYGMLLLCG

SEQ ID NO: 1062785 - protein, 9 aa, Homo Sapiens
PSVCEFVLS

SEQ ID NO: 1062786 - protein, 9 aa, Homo Sapiens
GFSAQYQIK

SEQ ID NO: 1062787 - protein, 9 aa, Homo Sapiens
EDGWRSFSL

SEQ ID NO: 1062788 - protein, 9 aa, Homo Sapiens
FIVKPDIPE

SEQ ID NO: 1062789 - protein, 9 aa, Homo Sapiens
THGLKLTRV

SEQ ID NO: 1062790 - protein, 9 aa, Homo Sapiens
SEQEEKIKT

SEQ ID NO: 1062791 - protein, 9 aa, Homo Sapiens
CLAGWRGTF

SEQ ID NO: 1062792 - protein, 9 aa, Homo Sapiens
FYLGLFTDR

SEQ ID NO: 1062793 - protein, 9 aa, Homo Sapiens
KVANFYCDI

SEQ ID NO: 1062794 - protein, 9 aa, Homo Sapiens
MSSIPESSG

SEQ ID NO: 1062795 - protein, 9 aa, Homo Sapiens
EFVSVPGTL

SEQ ID NO: 1062796 - protein, 9 aa, Homo Sapiens
YSRKFAKEV

SEQ ID NO: 1062797 - protein, 9 aa, Homo Sapiens
QQKYSPVTP

SEQ ID NO: 1062798 - protein, 9 aa, Homo Sapiens
LKEDYNQPL

SEQ ID NO: 1062799 - protein, 9 aa, Homo Sapiens
PRQLTTPRT

SEQ ID NO: 1062800 - protein, 9 aa, Homo Sapiens
RTIVFCTPV

SEQ ID NO: 1062801 - protein, 9 aa, Homo Sapiens
MAQLPQEKK

SEQ ID NO: 1062802 - protein, 9 aa, Homo Sapiens
KRSLINKFD

SEQ ID NO: 1062803 - protein, 9 aa, Homo Sapiens
PLPAKAFRQ

SEQ ID NO: 1062804 - protein, 9 aa, Homo Sapiens
ATVDETILL

SEQ ID NO: 1062805 - protein, 9 aa, Homo Sapiens
ENTSNDESS

SEQ ID NO: 1062806 - protein, 9 aa, Homo Sapiens
LNVIFLVNS

SEQ ID NO: 1062807 - protein, 9 aa, Homo Sapiens
YQTEKYNLA

SEQ ID NO: 1062808 - protein, 9 aa, Homo Sapiens
KIILDQLEA

SEQ ID NO: 1062809 - protein, 9 aa, Homo Sapiens
CSLGLLRLW

SEQ ID NO: 1062810 - protein, 9 aa, Homo Sapiens
SDTGPTLEG

SEQ ID NO: 1062811 - protein, 9 aa, Homo Sapiens
KKVGSGRGK

SEQ ID NO: 1062812 - protein, 9 aa, Homo Sapiens
SCPQENCII

SEQ ID NO: 1062813 - protein, 9 aa, Homo Sapiens
SLPTTMNYS

SEQ ID NO: 1062814 - protein, 9 aa, Homo Sapiens
ANAPLLQKI

SEQ ID NO: 1062815 - protein, 9 aa, Homo Sapiens
LSGASGGHW

SEQ ID NO: 1062816 - protein, 9 aa, Homo Sapiens
AFMKVARIG

SEQ ID NO: 1062817 - protein, 9 aa, Homo Sapiens
GPETPMDGG

SEQ ID NO: 1062818 - protein, 9 aa, Homo Sapiens
QLVTYDKEG

SEQ ID NO: 1062819 - protein, 9 aa, Homo Sapiens
IVFMRTWYL

SEQ ID NO: 1062820 - protein, 9 aa, Homo Sapiens
LGPATPMFF

SEQ ID NO: 1062821 - protein, 9 aa, Homo Sapiens
SIWHKFSSD

SEQ ID NO: 1062822 - protein, 9 aa, Homo Sapiens
WSLDNLFSK

SEQ ID NO: 1062823 - protein, 9 aa, Homo Sapiens
SAVDSQKID

SEQ ID NO: 1062824 - protein, 9 aa, Homo Sapiens
PIWGKDKSW

SEQ ID NO: 1062825 - protein, 9 aa, Homo Sapiens
YGRPMVPEA

SEQ ID NO: 1062826 - protein, 9 aa, Homo Sapiens
RIPNPTMCL

SEQ ID NO: 1062827 - protein, 9 aa, Homo Sapiens
TGQSVDSGT

SEQ ID NO: 1062828 - protein, 9 aa, Homo Sapiens
SWIKGNSPL

SEQ ID NO: 1062829 - protein, 9 aa, Homo Sapiens
RDTDCVDQT

SEQ ID NO: 1062830 - protein, 9 aa, Homo Sapiens
QAGRAAPEG

SEQ ID NO: 1062831 - protein, 9 aa, Homo Sapiens
RVVVAGLPV

SEQ ID NO: 1062832 - protein, 9 aa, Homo Sapiens
LKIVVILEG

SEQ ID NO: 1062833 - protein, 9 aa, Homo Sapiens
GPLFQEGKT

SEQ ID NO: 1062834 - protein, 9 aa, Homo Sapiens
KHLVYKMPI

SEQ ID NO: 1062835 - protein, 9 aa, Homo Sapiens
KDSSGAGLW

SEQ ID NO: 1062836 - protein, 9 aa, Homo Sapiens
SAIVHYSPD

SEQ ID NO: 1062837 - protein, 9 aa, Homo Sapiens
SFLHLNSRD

SEQ ID NO: 1062838 - protein, 9 aa, Homo Sapiens
QNVEMLMLN

SEQ ID NO: 1062839 - protein, 9 aa, Homo Sapiens
SLKEEETEK

SEQ ID NO: 1062840 - protein, 9 aa, Homo Sapiens
DPNDSQMLA

SEQ ID NO: 1062841 - protein, 9 aa, Homo Sapiens
KVDLTLLSL

SEQ ID NO: 1062842 - protein, 9 aa, Homo Sapiens
NVEMLMLNA

SEQ ID NO: 1062843 - protein, 9 aa, Homo Sapiens
YNEIVKRKD

SEQ ID NO: 1062844 - protein, 9 aa, Homo Sapiens
NSLEDFFSQ

SEQ ID NO: 1062845 - protein, 9 aa, Homo Sapiens
KFAKEVGEK

SEQ ID NO: 1062846 - protein, 9 aa, Homo Sapiens
KVQEMTLRL

SEQ ID NO: 1062847 - protein, 9 aa, Homo Sapiens
EQVAYKKEV

SEQ ID NO: 1062848 - protein, 9 aa, Homo Sapiens
NMLCGIGET

SEQ ID NO: 1062849 - protein, 9 aa, Homo Sapiens
GLKKKNLYL

SEQ ID NO: 1062850 - protein, 9 aa, Homo Sapiens
PLETRPQHY

SEQ ID NO: 1062851 - protein, 9 aa, Homo Sapiens
NRTNDLSDY

SEQ ID NO: 1062852 - protein, 9 aa, Homo Sapiens
RFVSRFCAD

SEQ ID NO: 1062853 - protein, 9 aa, Homo Sapiens
LPGLLIATS

SEQ ID NO: 1062854 - protein, 9 aa, Homo Sapiens
DLKALQREI

SEQ ID NO: 1062855 - protein, 9 aa, Homo Sapiens
NIIYNSQAI

SEQ ID NO: 1062856 - protein, 9 aa, Homo Sapiens
KVLNLTGVY

SEQ ID NO: 1062857 - protein, 9 aa, Homo Sapiens
IKQPAGASP

SEQ ID NO: 1062858 - protein, 9 aa, Homo Sapiens
ETKKSLDNR

SEQ ID NO: 1062859 - protein, 9 aa, Homo Sapiens
KNQSREKPN

SEQ ID NO: 1062860 - protein, 9 aa, Homo Sapiens
NVHSPLKYR

SEQ ID NO: 1062861 - protein, 9 aa, Homo Sapiens
REASLYSPS

SEQ ID NO: 1062862 - protein, 9 aa, Homo Sapiens
NRVPLGVNV

SEQ ID NO: 1062863 - protein, 9 aa, Homo Sapiens
TAKWKGPQR

SEQ ID NO: 1062864 - protein, 9 aa, Homo Sapiens
AVSTTPPGL

SEQ ID NO: 1062865 - protein, 9 aa, Homo Sapiens
LFPLLENPV

SEQ ID NO: 1062866 - protein, 9 aa, Homo Sapiens
TTSENLYLM

SEQ ID NO: 1062867 - protein, 9 aa, Homo Sapiens
EEPEKPSKN

SEQ ID NO: 1062868 - protein, 9 aa, Homo Sapiens
VVPVEDNDK

SEQ ID NO: 1062869 - protein, 9 aa, Homo Sapiens
SGSTEQAAW

SEQ ID NO: 1062870 - protein, 9 aa, Homo Sapiens
IYTGEKPHE

SEQ ID NO: 1062871 - protein, 9 aa, Homo Sapiens
LQAKMGKRG

SEQ ID NO: 1062872 - protein, 9 aa, Homo Sapiens
LKHDSEMKL

SEQ ID NO: 1062873 - protein, 9 aa, Homo Sapiens
EFLSYLPSQ

SEQ ID NO: 1062874 - protein, 9 aa, Homo Sapiens
HHLFVSLYP

SEQ ID NO: 1062875 - protein, 9 aa, Homo Sapiens
SKTGKKRKG

SEQ ID NO: 1062876 - protein, 9 aa, Homo Sapiens
QALLFFLFL

SEQ ID NO: 1062877 - protein, 9 aa, Homo Sapiens
IINGNPRQS

SEQ ID NO: 1062878 - protein, 9 aa, Homo Sapiens
ISVATNTPS

SEQ ID NO: 1062879 - protein, 9 aa, Homo Sapiens
QVEINLKQY

SEQ ID NO: 1062880 - protein, 9 aa, Homo Sapiens
FPLGLCLVL

SEQ ID NO: 1062881 - protein, 9 aa, Homo Sapiens
AASPTIFSF

SEQ ID NO: 1062882 - protein, 9 aa, Homo Sapiens
RKRSRERSS

SEQ ID NO: 1062883 - protein, 9 aa, Homo Sapiens
HSPHPRVQI

SEQ ID NO: 1062884 - protein, 9 aa, Homo Sapiens
DRRAKETPK

SEQ ID NO: 1062885 - protein, 9 aa, Homo Sapiens
EKDASTLIC

SEQ ID NO: 1062886 - protein, 9 aa, Homo Sapiens
IDVNTEFLA

SEQ ID NO: 1062887 - protein, 9 aa, Homo Sapiens
TYYLLLGLI

SEQ ID NO: 1062888 - protein, 9 aa, Homo Sapiens
ESPFNKQQY

SEQ ID NO: 1062889 - protein, 9 aa, Homo Sapiens
DMCRAKTGK

SEQ ID NO: 1062890 - protein, 9 aa, Homo Sapiens
SSAFVGLFF

SEQ ID NO: 1062891 - protein, 9 aa, Homo Sapiens
KKKGNPEDF

SEQ ID NO: 1062892 - protein, 9 aa, Homo Sapiens
DPSFLRLHL

SEQ ID NO: 1062893 - protein, 9 aa, Homo Sapiens
PTRQSASVP

SEQ ID NO: 1062894 - protein, 9 aa, Homo Sapiens
KNVWEEMDA

SEQ ID NO: 1062895 - protein, 9 aa, Homo Sapiens
PEHWPNPET

SEQ ID NO: 1062896 - protein, 9 aa, Homo Sapiens
NHCPLSAAS

SEQ ID NO: 1062897 - protein, 9 aa, Homo Sapiens
STLKEGNDI

SEQ ID NO: 1062898 - protein, 9 aa, Homo Sapiens
ILYTDDEDK

SEQ ID NO: 1062899 - protein, 9 aa, Homo Sapiens
QEEIWRQKK

SEQ ID NO: 1062900 - protein, 9 aa, Homo Sapiens
KLENLLLNK

SEQ ID NO: 1062901 - protein, 9 aa, Homo Sapiens
LKHLNKEEL

SEQ ID NO: 1062902 - protein, 9 aa, Homo Sapiens
FNTSGDKII

SEQ ID NO: 1062903 - protein, 9 aa, Homo Sapiens
LLPGHGASA

SEQ ID NO: 1062904 - protein, 9 aa, Homo Sapiens
GGEAEARPH

SEQ ID NO: 1062905 - protein, 9 aa, Homo Sapiens
PPKTGVSHL

SEQ ID NO: 1062906 - protein, 9 aa, Homo Sapiens
LQTYAFVTH

SEQ ID NO: 1062907 - protein, 9 aa, Homo Sapiens
FCCVHRGAD

SEQ ID NO: 1062908 - protein, 9 aa, Homo Sapiens
PRRPAWPST

SEQ ID NO: 1062909 - protein, 9 aa, Homo Sapiens
FAHFILKQK

SEQ ID NO: 1062910 - protein, 9 aa, Homo Sapiens
GPRETSLEC

SEQ ID NO: 1062911 - protein, 9 aa, Homo Sapiens
DGGPRVFFY

SEQ ID NO: 1062912 - protein, 9 aa, Homo Sapiens
VCNCYEFLN

SEQ ID NO: 1062913 - protein, 9 aa, Homo Sapiens
NSDKFHSPA

SEQ ID NO: 1062914 - protein, 9 aa, Homo Sapiens
WSDDESGNL

SEQ ID NO: 1062915 - protein, 9 aa, Homo Sapiens
SSDKRGDNQ

SEQ ID NO: 1062916 - protein, 9 aa, Homo Sapiens
QPQALCQGS

SEQ ID NO: 1062917 - protein, 9 aa, Homo Sapiens
HLHKTLRKI

SEQ ID NO: 1062918 - protein, 9 aa, Homo Sapiens
GLQGDSAHK

SEQ ID NO: 1062919 - protein, 9 aa, Homo Sapiens
SYELVCSAE

SEQ ID NO: 1062920 - protein, 9 aa, Homo Sapiens
AESMEIEVK

SEQ ID NO: 1062921 - protein, 9 aa, Homo Sapiens
TLFLGKVCP

SEQ ID NO: 1062922 - protein, 9 aa, Homo Sapiens
IKGRNLDSL

SEQ ID NO: 1062923 - protein, 9 aa, Homo Sapiens
LKNLNSNAV

SEQ ID NO: 1062924 - protein, 9 aa, Homo Sapiens
KKAFEEKQK

SEQ ID NO: 1062925 - protein, 9 aa, Homo Sapiens
VSPCSNRPP

SEQ ID NO: 1062926 - protein, 9 aa, Homo Sapiens
MRANTQDTK

SEQ ID NO: 1062927 - protein, 9 aa, Homo Sapiens
KGARQEGGG

SEQ ID NO: 1062928 - protein, 9 aa, Homo Sapiens
IVPFMRQNR

SEQ ID NO: 1062929 - protein, 9 aa, Homo Sapiens
KFTSDQARA

SEQ ID NO: 1062930 - protein, 9 aa, Homo Sapiens
NFTMNAASV

SEQ ID NO: 1062931 - protein, 9 aa, Homo Sapiens
FTPMSLSSS

SEQ ID NO: 1062932 - protein, 9 aa, Homo Sapiens
SILRIIVEL

SEQ ID NO: 1062933 - protein, 9 aa, Homo Sapiens
TLKRILKRK

SEQ ID NO: 1062934 - protein, 9 aa, Homo Sapiens
HTIPTYTDA

SEQ ID NO: 1062935 - protein, 9 aa, Homo Sapiens
FICTECGKA

SEQ ID NO: 1062936 - protein, 9 aa, Homo Sapiens
PVTTSENLY

SEQ ID NO: 1062937 - protein, 9 aa, Homo Sapiens
YHSSLPNSR

SEQ ID NO: 1062938 - protein, 9 aa, Homo Sapiens
LEKSEFSAF

SEQ ID NO: 1062939 - protein, 9 aa, Homo Sapiens
QGAPLSLYI

SEQ ID NO: 1062940 - protein, 9 aa, Homo Sapiens
FTWGASPLG

SEQ ID NO: 1062941 - protein, 9 aa, Homo Sapiens
EEQTKPLRR

SEQ ID NO: 1062942 - protein, 9 aa, Homo Sapiens
RLRKPPGAK

SEQ ID NO: 1062943 - protein, 9 aa, Homo Sapiens
LSNMERVSF

SEQ ID NO: 1062944 - protein, 9 aa, Homo Sapiens
ASRYHKQPQ

SEQ ID NO: 1062945 - protein, 9 aa, Homo Sapiens
FDTELDEFS

SEQ ID NO: 1062946 - protein, 9 aa, Homo Sapiens
MHGPLFQEG

SEQ ID NO: 1062947 - protein, 9 aa, Homo Sapiens
IHVQRDAVK

SEQ ID NO: 1062948 - protein, 9 aa, Homo Sapiens
TAPKMLMDF

SEQ ID NO: 1062949 - protein, 9 aa, Homo Sapiens
GLVTPATTV

SEQ ID NO: 1062950 - protein, 9 aa, Homo Sapiens
GFWKSEVAA

SEQ ID NO: 1062951 - protein, 9 aa, Homo Sapiens
EDGQVKEEP

SEQ ID NO: 1062952 - protein, 9 aa, Homo Sapiens
RMMEDAEAL

SEQ ID NO: 1062953 - protein, 9 aa, Homo Sapiens
YYQHNDQIQ

SEQ ID NO: 1062954 - protein, 9 aa, Homo Sapiens
LLCPSSPSP

SEQ ID NO: 1062955 - protein, 9 aa, Homo Sapiens
QNKNEINYL

SEQ ID NO: 1062956 - protein, 9 aa, Homo Sapiens
PMSRSQLLQ

SEQ ID NO: 1062957 - protein, 9 aa, Homo Sapiens
NNSKMVKFL

SEQ ID NO: 1062958 - protein, 9 aa, Homo Sapiens
PSLGLDPYV

SEQ ID NO: 1062959 - protein, 9 aa, Homo Sapiens
ERDAEDKTP

SEQ ID NO: 1062960 - protein, 9 aa, Homo Sapiens
SFLRLHLRI

SEQ ID NO: 1062961 - protein, 9 aa, Homo Sapiens
YPKRKLLES

SEQ ID NO: 1062962 - protein, 9 aa, Homo Sapiens
ASKHIKSEQ

SEQ ID NO: 1062963 - protein, 9 aa, Homo Sapiens
RDRWQVEEA

SEQ ID NO: 1062964 - protein, 9 aa, Homo Sapiens
RDSAQSSKL

SEQ ID NO: 1062965 - protein, 9 aa, Homo Sapiens
LSPGHSPLS

SEQ ID NO: 1062966 - protein, 9 aa, Homo Sapiens
LEDPVGRTH

SEQ ID NO: 1062967 - protein, 9 aa, Homo Sapiens
TVRYALCTL

SEQ ID NO: 1062968 - protein, 9 aa, Homo Sapiens
NGVADELPN

SEQ ID NO: 1062969 - protein, 9 aa, Homo Sapiens
GKTYFQVIA

SEQ ID NO: 1062970 - protein, 9 aa, Homo Sapiens
TSSPNRVTR

SEQ ID NO: 1062971 - protein, 9 aa, Homo Sapiens
QSCAFHDCQ

SEQ ID NO: 1062972 - protein, 9 aa, Homo Sapiens
CACGWQKNC

SEQ ID NO: 1062973 - protein, 9 aa, Homo Sapiens
SESALVLGP

SEQ ID NO: 1062974 - protein, 9 aa, Homo Sapiens
ADYELLIQK

SEQ ID NO: 1062975 - protein, 9 aa, Homo Sapiens
KHEKSHLGI

SEQ ID NO: 1062976 - protein, 9 aa, Homo Sapiens
RGGVPLYDQ

SEQ ID NO: 1062977 - protein, 9 aa, Homo Sapiens
KGRGGKCTE

SEQ ID NO: 1062978 - protein, 9 aa, Homo Sapiens
TTHGLKLTR

SEQ ID NO: 1062979 - protein, 9 aa, Homo Sapiens
NPAKVQNYC

SEQ ID NO: 1062980 - protein, 9 aa, Homo Sapiens
VLLQGAVGP

SEQ ID NO: 1062981 - protein, 9 aa, Homo Sapiens
KTENENEDN

SEQ ID NO: 1062982 - protein, 9 aa, Homo Sapiens
NMERVSFST

SEQ ID NO: 1062983 - protein, 9 aa, Homo Sapiens
SCCKPASNW

SEQ ID NO: 1062984 - protein, 9 aa, Homo Sapiens
LKRLDIFPV

SEQ ID NO: 1062985 - protein, 9 aa, Homo Sapiens
LPTNAMGLP

SEQ ID NO: 1062986 - protein, 9 aa, Homo Sapiens
RRFHQDALE

SEQ ID NO: 1062987 - protein, 9 aa, Homo Sapiens
LELFKNGND

SEQ ID NO: 1062988 - protein, 9 aa, Homo Sapiens
EAKFVFVKP

SEQ ID NO: 1062989 - protein, 9 aa, Homo Sapiens
NSGQGAPPH

SEQ ID NO: 1062990 - protein, 9 aa, Homo Sapiens
ASLVQKHLT

SEQ ID NO: 1062991 - protein, 9 aa, Homo Sapiens
FRQLQVYRS

SEQ ID NO: 1062992 - protein, 9 aa, Homo Sapiens
QMDKSNQCV

SEQ ID NO: 1062993 - protein, 9 aa, Homo Sapiens
QNASMSEFL

SEQ ID NO: 1062994 - protein, 9 aa, Homo Sapiens
EADRLITLF

SEQ ID NO: 1062995 - protein, 9 aa, Homo Sapiens
PSPPPIALA

SEQ ID NO: 1062996 - protein, 9 aa, Homo Sapiens
RLLILSYAG

SEQ ID NO: 1062997 - protein, 9 aa, Homo Sapiens
NNKYEPFWE

SEQ ID NO: 1062998 - protein, 9 aa, Homo Sapiens
VGFFQGDIW

SEQ ID NO: 1062999 - protein, 9 aa, Homo Sapiens
HRCLRGGRA

SEQ ID NO: 1063000 - protein, 9 aa, Homo Sapiens
CDFHPLPPS

SEQ ID NO: 1063001 - protein, 9 aa, Homo Sapiens
CRLQFGVAV

SEQ ID NO: 1063002 - protein, 9 aa, Homo Sapiens
TPREKIVLN

SEQ ID NO: 1063003 - protein, 9 aa, Homo Sapiens
AALWASLRL

SEQ ID NO: 1063004 - protein, 9 aa, Homo Sapiens
RSENEDEFR

SEQ ID NO: 1063005 - protein, 9 aa, Homo Sapiens
GDQIVMIID

SEQ ID NO: 1063006 - protein, 9 aa, Homo Sapiens
QQRRALLRP

SEQ ID NO: 1063007 - protein, 9 aa, Homo Sapiens
LAELLALES

SEQ ID NO: 1063008 - protein, 9 aa, Homo Sapiens
SAIQKARLV

SEQ ID NO: 1063009 - protein, 9 aa, Homo Sapiens
KVKKDTRPM

SEQ ID NO: 1063010 - protein, 9 aa, Homo Sapiens
DLHFIALVY

SEQ ID NO: 1063011 - protein, 9 aa, Homo Sapiens
TKPRRKPEL

SEQ ID NO: 1063012 - protein, 9 aa, Homo Sapiens
TKHKIIYSV

SEQ ID NO: 1063013 - protein, 9 aa, Homo Sapiens
EDITSMNTR

SEQ ID NO: 1063014 - protein, 9 aa, Homo Sapiens
TPSPGFSGL

SEQ ID NO: 1063015 - protein, 9 aa, Homo Sapiens
MKGKLLLFS

SEQ ID NO: 1063016 - protein, 9 aa, Homo Sapiens
DKLNLKEDK

SEQ ID NO: 1063017 - protein, 9 aa, Homo Sapiens
SALSRREDK

SEQ ID NO: 1063018 - protein, 9 aa, Homo Sapiens
IWLPWGLVF

SEQ ID NO: 1063019 - protein, 9 aa, Homo Sapiens
IRATNRPDS

SEQ ID NO: 1063020 - protein, 9 aa, Homo Sapiens
HVRTHTGIC

SEQ ID NO: 1063021 - protein, 9 aa, Homo Sapiens
DQVSRVDPK

SEQ ID NO: 1063022 - protein, 9 aa, Homo Sapiens
KDHKYSYQA

SEQ ID NO: 1063023 - protein, 9 aa, Homo Sapiens
GGRSSALYF

SEQ ID NO: 1063024 - protein, 9 aa, Homo Sapiens
TSENSAFCF

SEQ ID NO: 1063025 - protein, 9 aa, Homo Sapiens
IQNKNEINY

SEQ ID NO: 1063026 - protein, 9 aa, Homo Sapiens
RECASGYWG

SEQ ID NO: 1063027 - protein, 9 aa, Homo Sapiens
GSSPEGTRK

SEQ ID NO: 1063028 - protein, 9 aa, Homo Sapiens
DRLTLVDCS

SEQ ID NO: 1063029 - protein, 9 aa, Homo Sapiens
TGMVPESEF

SEQ ID NO: 1063030 - protein, 9 aa, Homo Sapiens
QSSSPRVPG

SEQ ID NO: 1063031 - protein, 9 aa, Homo Sapiens
LSNGQRREQ

SEQ ID NO: 1063032 - protein, 9 aa, Homo Sapiens
QYTGWFSVF

SEQ ID NO: 1063033 - protein, 9 aa, Homo Sapiens
CTKVEKDFN

SEQ ID NO: 1063034 - protein, 9 aa, Homo Sapiens
TPILLVSEN

SEQ ID NO: 1063035 - protein, 9 aa, Homo Sapiens
REILKDCIS

SEQ ID NO: 1063036 - protein, 9 aa, Homo Sapiens
IQDKSFGNS

SEQ ID NO: 1063037 - protein, 9 aa, Homo Sapiens
CLLPELAIS

SEQ ID NO: 1063038 - protein, 9 aa, Homo Sapiens
KEAKHGTFV

SEQ ID NO: 1063039 - protein, 9 aa, Homo Sapiens
PSSCLMTKW

SEQ ID NO: 1063040 - protein, 9 aa, Homo Sapiens
NLVSVTRVM

SEQ ID NO: 1063041 - protein, 9 aa, Homo Sapiens
EDKDEDEDG

SEQ ID NO: 1063042 - protein, 9 aa, Homo Sapiens
LCFQICGAA

SEQ ID NO: 1063043 - protein, 9 aa, Homo Sapiens
QASGDLHYT

SEQ ID NO: 1063044 - protein, 9 aa, Homo Sapiens
HSSINGSET

SEQ ID NO: 1063045 - protein, 9 aa, Homo Sapiens
QEIDEKFKE

SEQ ID NO: 1063046 - protein, 9 aa, Homo Sapiens
WHVHSLWVC

SEQ ID NO: 1063047 - protein, 9 aa, Homo Sapiens
LSSCNLETR

SEQ ID NO: 1063048 - protein, 9 aa, Homo Sapiens
GVCICFKGY

SEQ ID NO: 1063049 - protein, 9 aa, Homo Sapiens
NKRLREQQK

SEQ ID NO: 1063050 - protein, 9 aa, Homo Sapiens
QDRLLELLQ

SEQ ID NO: 1063051 - protein, 9 aa, Homo Sapiens
SLRFSASNN

SEQ ID NO: 1063052 - protein, 9 aa, Homo Sapiens
KHKQTDYRR

SEQ ID NO: 1063053 - protein, 9 aa, Homo Sapiens
MNYSLWSQS

SEQ ID NO: 1063054 - protein, 9 aa, Homo Sapiens
TGNPVITAS

SEQ ID NO: 1063055 - protein, 9 aa, Homo Sapiens
LHTPILLVS

SEQ ID NO: 1063056 - protein, 9 aa, Homo Sapiens
TDEIHLIEK

SEQ ID NO: 1063057 - protein, 9 aa, Homo Sapiens
LMELFQNSG

SEQ ID NO: 1063058 - protein, 9 aa, Homo Sapiens
ETCSSHLTV

SEQ ID NO: 1063059 - protein, 9 aa, Homo Sapiens
CYQLRMSKA

SEQ ID NO: 1063060 - protein, 9 aa, Homo Sapiens
RFGYQMDKS

SEQ ID NO: 1063061 - protein, 9 aa, Homo Sapiens
YPCRRYSCA

SEQ ID NO: 1063062 - protein, 9 aa, Homo Sapiens
FGLSSGFGF

SEQ ID NO: 1063063 - protein, 9 aa, Homo Sapiens
VEDNDKNYI

SEQ ID NO: 1063064 - protein, 9 aa, Homo Sapiens
THTGEKLYQ

SEQ ID NO: 1063065 - protein, 9 aa, Homo Sapiens
KRDRLPSCK

SEQ ID NO: 1063066 - protein, 9 aa, Homo Sapiens
ETDSVKSPP

SEQ ID NO: 1063067 - protein, 9 aa, Homo Sapiens
RRKEVDMIK

SEQ ID NO: 1063068 - protein, 9 aa, Homo Sapiens
AWLEGEINT

SEQ ID NO: 1063069 - protein, 9 aa, Homo Sapiens
RSKAIYVNR

SEQ ID NO: 1063070 - protein, 9 aa, Homo Sapiens
KAVSTECTQ

SEQ ID NO: 1063071 - protein, 9 aa, Homo Sapiens
FYSNNQSPT

SEQ ID NO: 1063072 - protein, 9 aa, Homo Sapiens
SHARYLSQL

SEQ ID NO: 1063073 - protein, 9 aa, Homo Sapiens
QRDEQLTFE

SEQ ID NO: 1063074 - protein, 9 aa, Homo Sapiens
QTTKKLTET

SEQ ID NO: 1063075 - protein, 9 aa, Homo Sapiens
QNPFFSPPS

SEQ ID NO: 1063076 - protein, 9 aa, Homo Sapiens
RREQLSDAL

SEQ ID NO: 1063077 - protein, 9 aa, Homo Sapiens
GQKQSSGSR

SEQ ID NO: 1063078 - protein, 9 aa, Homo Sapiens
NIEDSAFFD

SEQ ID NO: 1063079 - protein, 9 aa, Homo Sapiens
CECRPRRKK

SEQ ID NO: 1063080 - protein, 9 aa, Homo Sapiens
WLLADDMKT

SEQ ID NO: 1063081 - protein, 9 aa, Homo Sapiens
TSSKFQLDV

SEQ ID NO: 1063082 - protein, 9 aa, Homo Sapiens
QSGSDSSSE

SEQ ID NO: 1063083 - protein, 9 aa, Homo Sapiens
IGESMYGNF

SEQ ID NO: 1063084 - protein, 9 aa, Homo Sapiens
GGSSGSTEQ

SEQ ID NO: 1063085 - protein, 9 aa, Homo Sapiens
ATCAMKWNC

SEQ ID NO: 1063086 - protein, 9 aa, Homo Sapiens
STARVVMWR

SEQ ID NO: 1063087 - protein, 9 aa, Homo Sapiens
EKNFRRLQA

SEQ ID NO: 1063088 - protein, 9 aa, Homo Sapiens
KKMHEQEKI

SEQ ID NO: 1063089 - protein, 9 aa, Homo Sapiens
QSSAAIITQ

SEQ ID NO: 1063090 - protein, 9 aa, Homo Sapiens
SDDDKIIQL

SEQ ID NO: 1063091 - protein, 9 aa, Homo Sapiens
TQNPFFSPP

SEQ ID NO: 1063092 - protein, 9 aa, Homo Sapiens
EEITTSKQS

SEQ ID NO: 1063093 - protein, 9 aa, Homo Sapiens
ISLFLIFYY

SEQ ID NO: 1063094 - protein, 9 aa, Homo Sapiens
QLWADPGEA

SEQ ID NO: 1063095 - protein, 9 aa, Homo Sapiens
RKNCLKLMK

SEQ ID NO: 1063096 - protein, 9 aa, Homo Sapiens
AKKICYQLR

SEQ ID NO: 1063097 - protein, 9 aa, Homo Sapiens
EKKQQEHQP

SEQ ID NO: 1063098 - protein, 9 aa, Homo Sapiens
PPAGRPKVL

SEQ ID NO: 1063099 - protein, 9 aa, Homo Sapiens
FCSLHSTFV

SEQ ID NO: 1063100 - protein, 9 aa, Homo Sapiens
ALLFFLFLT

SEQ ID NO: 1063101 - protein, 9 aa, Homo Sapiens
LASADFPYN

SEQ ID NO: 1063102 - protein, 9 aa, Homo Sapiens
SCSSLASGD

SEQ ID NO: 1063103 - protein, 9 aa, Homo Sapiens
LSQGHLTFR

SEQ ID NO: 1063104 - protein, 9 aa, Homo Sapiens
IQSIKTNVH

SEQ ID NO: 1063105 - protein, 9 aa, Homo Sapiens
RAWPASGHF

SEQ ID NO: 1063106 - protein, 9 aa, Homo Sapiens
RKFIFVQKK

SEQ ID NO: 1063107 - protein, 9 aa, Homo Sapiens
HMKKVGSGR

SEQ ID NO: 1063108 - protein, 9 aa, Homo Sapiens
SQAFPGTSS

SEQ ID NO: 1063109 - protein, 9 aa, Homo Sapiens
YVTAYGPGL

SEQ ID NO: 1063110 - protein, 9 aa, Homo Sapiens
ENSAFCFLF

SEQ ID NO: 1063111 - protein, 9 aa, Homo Sapiens
TTANTLFWA

SEQ ID NO: 1063112 - protein, 9 aa, Homo Sapiens
LFMKRLPSN

SEQ ID NO: 1063113 - protein, 9 aa, Homo Sapiens
FGARIPLEY

SEQ ID NO: 1063114 - protein, 9 aa, Homo Sapiens
DPQGREVSI

SEQ ID NO: 1063115 - protein, 9 aa, Homo Sapiens
FFFLALTST

SEQ ID NO: 1063116 - protein, 9 aa, Homo Sapiens
RLLEPTLRV

SEQ ID NO: 1063117 - protein, 9 aa, Homo Sapiens
EEKIKEFYP

SEQ ID NO: 1063118 - protein, 9 aa, Homo Sapiens
GLAIIRSSR

SEQ ID NO: 1063119 - protein, 9 aa, Homo Sapiens
FIHTLVFML

SEQ ID NO: 1063120 - protein, 9 aa, Homo Sapiens
QTFYSNNQS

SEQ ID NO: 1063121 - protein, 9 aa, Homo Sapiens
RSPFIKLRR

SEQ ID NO: 1063122 - protein, 9 aa, Homo Sapiens
SEIIMMNYV

SEQ ID NO: 1063123 - protein, 9 aa, Homo Sapiens
LPEPPKTGV

SEQ ID NO: 1063124 - protein, 9 aa, Homo Sapiens
IMLSSWATS

SEQ ID NO: 1063125 - protein, 9 aa, Homo Sapiens
TSAALSLLL

SEQ ID NO: 1063126 - protein, 9 aa, Homo Sapiens
PDAGTGEGV

SEQ ID NO: 1063127 - protein, 9 aa, Homo Sapiens
GVCLNEGVC

SEQ ID NO: 1063128 - protein, 9 aa, Homo Sapiens
VYVDITDRF

SEQ ID NO: 1063129 - protein, 9 aa, Homo Sapiens
DDLIKEKKD

SEQ ID NO: 1063130 - protein, 9 aa, Homo Sapiens
PSQPDPVSA

SEQ ID NO: 1063131 - protein, 9 aa, Homo Sapiens
EVKSPEKTK

SEQ ID NO: 1063132 - protein, 9 aa, Homo Sapiens
DTLFQCWLC

SEQ ID NO: 1063133 - protein, 9 aa, Homo Sapiens
LLYHSANQL

SEQ ID NO: 1063134 - protein, 9 aa, Homo Sapiens
VLDNSPPRP

SEQ ID NO: 1063135 - protein, 9 aa, Homo Sapiens
SVSSQVPTP

SEQ ID NO: 1063136 - protein, 9 aa, Homo Sapiens
GLPMSRSQL

SEQ ID NO: 1063137 - protein, 9 aa, Homo Sapiens
WQKVEYLIE

SEQ ID NO: 1063138 - protein, 9 aa, Homo Sapiens
SPLPARRHR

SEQ ID NO: 1063139 - protein, 9 aa, Homo Sapiens
LRLWPVFSP

SEQ ID NO: 1063140 - protein, 9 aa, Homo Sapiens
NKNLTFKLE

SEQ ID NO: 1063141 - protein, 9 aa, Homo Sapiens
ILDDIFAFL

SEQ ID NO: 1063142 - protein, 9 aa, Homo Sapiens
REQLSDALL

SEQ ID NO: 1063143 - protein, 9 aa, Homo Sapiens
SFDYQNCTM

SEQ ID NO: 1063144 - protein, 9 aa, Homo Sapiens
ATARVLVIR

SEQ ID NO: 1063145 - protein, 9 aa, Homo Sapiens
FEGRRNNNE

SEQ ID NO: 1063146 - protein, 9 aa, Homo Sapiens
FFMLVFPVF

SEQ ID NO: 1063147 - protein, 9 aa, Homo Sapiens
RLWTDFCFL

SEQ ID NO: 1063148 - protein, 9 aa, Homo Sapiens
DEHMQVVDL

SEQ ID NO: 1063149 - protein, 9 aa, Homo Sapiens
DESVLREGT

SEQ ID NO: 1063150 - protein, 9 aa, Homo Sapiens
YNKITKEDA

SEQ ID NO: 1063151 - protein, 9 aa, Homo Sapiens
LDLIRNMFL

SEQ ID NO: 1063152 - protein, 9 aa, Homo Sapiens
PNGENKQPG

SEQ ID NO: 1063153 - protein, 9 aa, Homo Sapiens
AKDRRAKET

SEQ ID NO: 1063154 - protein, 9 aa, Homo Sapiens
SQALAGADF

SEQ ID NO: 1063155 - protein, 9 aa, Homo Sapiens
SFHEIPTPS

SEQ ID NO: 1063156 - protein, 9 aa, Homo Sapiens
ASDVTIRRR

SEQ ID NO: 1063157 - protein, 9 aa, Homo Sapiens
HKRKLHIYV

SEQ ID NO: 1063158 - protein, 9 aa, Homo Sapiens
VIAGVAPFV

SEQ ID NO: 1063159 - protein, 9 aa, Homo Sapiens
SFQAAFTSG

SEQ ID NO: 1063160 - protein, 9 aa, Homo Sapiens
KRVAVIADE

SEQ ID NO: 1063161 - protein, 9 aa, Homo Sapiens
IYNSQAIKK

SEQ ID NO: 1063162 - protein, 9 aa, Homo Sapiens
DAPERDDPS

SEQ ID NO: 1063163 - protein, 9 aa, Homo Sapiens
PAQTSLAAP

SEQ ID NO: 1063164 - protein, 9 aa, Homo Sapiens
RVRVMAIYK

SEQ ID NO: 1063165 - protein, 9 aa, Homo Sapiens
VRTALMEVS

SEQ ID NO: 1063166 - protein, 9 aa, Homo Sapiens
AILESTEFL

SEQ ID NO: 1063167 - protein, 9 aa, Homo Sapiens
GIEHSMHMI

SEQ ID NO: 1063168 - protein, 9 aa, Homo Sapiens
LKDNGAYCC

SEQ ID NO: 1063169 - protein, 9 aa, Homo Sapiens
QKKIPSESE

SEQ ID NO: 1063170 - protein, 9 aa, Homo Sapiens
GKGFNCGAH

SEQ ID NO: 1063171 - protein, 9 aa, Homo Sapiens
YGNFEEAFD

SEQ ID NO: 1063172 - protein, 9 aa, Homo Sapiens
KFDPQNSRL

SEQ ID NO: 1063173 - protein, 9 aa, Homo Sapiens
NYKVDSPRN

SEQ ID NO: 1063174 - protein, 9 aa, Homo Sapiens
ISTGKDKSL

SEQ ID NO: 1063175 - protein, 9 aa, Homo Sapiens
CGSSGYISS

SEQ ID NO: 1063176 - protein, 9 aa, Homo Sapiens
LKNMDMNPE

SEQ ID NO: 1063177 - protein, 9 aa, Homo Sapiens
EIFYAKTFK

SEQ ID NO: 1063178 - protein, 9 aa, Homo Sapiens
YGKSVNWWA

SEQ ID NO: 1063179 - protein, 9 aa, Homo Sapiens
GSVQICVPR

SEQ ID NO: 1063180 - protein, 9 aa, Homo Sapiens
TGPTLEGGL

SEQ ID NO: 1063181 - protein, 9 aa, Homo Sapiens
TCSGAYHLS

SEQ ID NO: 1063182 - protein, 9 aa, Homo Sapiens
FRNLVSVTR

SEQ ID NO: 1063183 - protein, 9 aa, Homo Sapiens
LREELELEG

SEQ ID NO: 1063184 - protein, 9 aa, Homo Sapiens
TLLVYCTNL

SEQ ID NO: 1063185 - protein, 9 aa, Homo Sapiens
TNFPKNGTF

SEQ ID NO: 1063186 - protein, 9 aa, Homo Sapiens
QSLAGEIIE

SEQ ID NO: 1063187 - protein, 9 aa, Homo Sapiens
PPRQANHVS

SEQ ID NO: 1063188 - protein, 9 aa, Homo Sapiens
LDARDKNSA

SEQ ID NO: 1063189 - protein, 9 aa, Homo Sapiens
PTAGAGIKD

SEQ ID NO: 1063190 - protein, 9 aa, Homo Sapiens
VKTSIQRAV

SEQ ID NO: 1063191 - protein, 9 aa, Homo Sapiens
FGNTMCQFL

SEQ ID NO: 1063192 - protein, 9 aa, Homo Sapiens
KFYQAINDA

SEQ ID NO: 1063193 - protein, 9 aa, Homo Sapiens
GEGRPGPQQ

SEQ ID NO: 1063194 - protein, 9 aa, Homo Sapiens
KTVSAKKSA

SEQ ID NO: 1063195 - protein, 9 aa, Homo Sapiens
VFNNFSTLM

SEQ ID NO: 1063196 - protein, 9 aa, Homo Sapiens
WDSDNKILP

SEQ ID NO: 1063197 - protein, 9 aa, Homo Sapiens
SPARVTWRE

SEQ ID NO: 1063198 - protein, 9 aa, Homo Sapiens
SLGQGLKFP

SEQ ID NO: 1063199 - protein, 9 aa, Homo Sapiens
ARLEKEEDR

SEQ ID NO: 1063200 - protein, 9 aa, Homo Sapiens
RLGQKSVHC

SEQ ID NO: 1063201 - protein, 9 aa, Homo Sapiens
LMGNGFYFL

SEQ ID NO: 1063202 - protein, 9 aa, Homo Sapiens
LMEGSAFLG

SEQ ID NO: 1063203 - protein, 9 aa, Homo Sapiens
EARKISLYS

SEQ ID NO: 1063204 - protein, 9 aa, Homo Sapiens
SDIANKLYA

SEQ ID NO: 1063205 - protein, 9 aa, Homo Sapiens
KPKNNKDVA

SEQ ID NO: 1063206 - protein, 9 aa, Homo Sapiens
EVRGFWQTC

SEQ ID NO: 1063207 - protein, 9 aa, Homo Sapiens
ILLYLIVVD

SEQ ID NO: 1063208 - protein, 9 aa, Homo Sapiens
KLREDITLW

SEQ ID NO: 1063209 - protein, 9 aa, Homo Sapiens
FKNRRQRDW

SEQ ID NO: 1063210 - protein, 9 aa, Homo Sapiens
EISLIGLIP

SEQ ID NO: 1063211 - protein, 9 aa, Homo Sapiens
IFTLSQRAR

SEQ ID NO: 1063212 - protein, 9 aa, Homo Sapiens
KTRTQRSRM

SEQ ID NO: 1063213 - protein, 9 aa, Homo Sapiens
WPPTASPLP

SEQ ID NO: 1063214 - protein, 9 aa, Homo Sapiens
TQHNPLSQE

SEQ ID NO: 1063215 - protein, 9 aa, Homo Sapiens
KHDDKYTPL

SEQ ID NO: 1063216 - protein, 9 aa, Homo Sapiens
NFWLDSKSV

SEQ ID NO: 1063217 - protein, 9 aa, Homo Sapiens
RRGPDGSIL

SEQ ID NO: 1063218 - protein, 9 aa, Homo Sapiens
KIQHFFCDT

SEQ ID NO: 1063219 - protein, 9 aa, Homo Sapiens
SFGFQTFQH

SEQ ID NO: 1063220 - protein, 9 aa, Homo Sapiens
YYNLCFLDS

SEQ ID NO: 1063221 - protein, 9 aa, Homo Sapiens
EEEDTEEEE

SEQ ID NO: 1063222 - protein, 9 aa, Homo Sapiens
GWCDVTGHL

SEQ ID NO: 1063223 - protein, 9 aa, Homo Sapiens
SLFCKKMSV

SEQ ID NO: 1063224 - protein, 9 aa, Homo Sapiens
CKKAVELWE

SEQ ID NO: 1063225 - protein, 9 aa, Homo Sapiens
EHSSNPSAI

SEQ ID NO: 1063226 - protein, 9 aa, Homo Sapiens
YSPFMKSLG

SEQ ID NO: 1063227 - protein, 9 aa, Homo Sapiens
TSNNHIEVQ

SEQ ID NO: 1063228 - protein, 9 aa, Homo Sapiens
LYFYKDPEE

SEQ ID NO: 1063229 - protein, 9 aa, Homo Sapiens
ILVNIHSMN

SEQ ID NO: 1063230 - protein, 9 aa, Homo Sapiens
HKKVDHFFC

SEQ ID NO: 1063231 - protein, 9 aa, Homo Sapiens
LFFHLHTLQ

SEQ ID NO: 1063232 - protein, 9 aa, Homo Sapiens
LDLFYTQGD

SEQ ID NO: 1063233 - protein, 9 aa, Homo Sapiens
VCKDVRIDT

SEQ ID NO: 1063234 - protein, 9 aa, Homo Sapiens
DLIFVEEEG

SEQ ID NO: 1063235 - protein, 9 aa, Homo Sapiens
FSHSGLRQL

SEQ ID NO: 1063236 - protein, 9 aa, Homo Sapiens
SRGRGGYIS

SEQ ID NO: 1063237 - protein, 9 aa, Homo Sapiens
DLWKPLPQK

SEQ ID NO: 1063238 - protein, 9 aa, Homo Sapiens
EKMVPSFCS

SEQ ID NO: 1063239 - protein, 9 aa, Homo Sapiens
CCNKHLHMF

SEQ ID NO: 1063240 - protein, 9 aa, Homo Sapiens
KPLPQKRDR

SEQ ID NO: 1063241 - protein, 9 aa, Homo Sapiens
RVTSVLAGL

SEQ ID NO: 1063242 - protein, 9 aa, Homo Sapiens
SPASSVSTL

SEQ ID NO: 1063243 - protein, 9 aa, Homo Sapiens
LESDRDLEA

SEQ ID NO: 1063244 - protein, 9 aa, Homo Sapiens
WNRSTPSAK

SEQ ID NO: 1063245 - protein, 9 aa, Homo Sapiens
ETNDNSKRY

SEQ ID NO: 1063246 - protein, 9 aa, Homo Sapiens
CPNFFSHFS

SEQ ID NO: 1063247 - protein, 9 aa, Homo Sapiens
KSQPPPPQS

SEQ ID NO: 1063248 - protein, 9 aa, Homo Sapiens
SLAFVIQDQ

SEQ ID NO: 1063249 - protein, 9 aa, Homo Sapiens
PDCRLCRFM

SEQ ID NO: 1063250 - protein, 9 aa, Homo Sapiens
FVADNKKMY

SEQ ID NO: 1063251 - protein, 9 aa, Homo Sapiens
ALRPHQSEL

SEQ ID NO: 1063252 - protein, 9 aa, Homo Sapiens
LIIRLEQDG

SEQ ID NO: 1063253 - protein, 9 aa, Homo Sapiens
GVFTQLLAP

SEQ ID NO: 1063254 - protein, 9 aa, Homo Sapiens
KLYECKECE

SEQ ID NO: 1063255 - protein, 9 aa, Homo Sapiens
GSCPQENCI

SEQ ID NO: 1063256 - protein, 9 aa, Homo Sapiens
NDHYCTLVR

SEQ ID NO: 1063257 - protein, 9 aa, Homo Sapiens
KVVLLCWIK

SEQ ID NO: 1063258 - protein, 9 aa, Homo Sapiens
CPATFPTRQ

SEQ ID NO: 1063259 - protein, 9 aa, Homo Sapiens
HNNIAHMKA

SEQ ID NO: 1063260 - protein, 9 aa, Homo Sapiens
CEQNKRLRE

SEQ ID NO: 1063261 - protein, 9 aa, Homo Sapiens
VAIMKSIIS

SEQ ID NO: 1063262 - protein, 9 aa, Homo Sapiens
LCSNSEDKL

SEQ ID NO: 1063263 - protein, 9 aa, Homo Sapiens
KHKRKLHIY

SEQ ID NO: 1063264 - protein, 9 aa, Homo Sapiens
PEALLQVCC

SEQ ID NO: 1063265 - protein, 9 aa, Homo Sapiens
SVVAITANL

SEQ ID NO: 1063266 - protein, 9 aa, Homo Sapiens
NAELSQMQS

SEQ ID NO: 1063267 - protein, 9 aa, Homo Sapiens
KWKYNRGRQ

SEQ ID NO: 1063268 - protein, 9 aa, Homo Sapiens
SHKGSIIVN

SEQ ID NO: 1063269 - protein, 9 aa, Homo Sapiens
KVMELKKEI

SEQ ID NO: 1063270 - protein, 9 aa, Homo Sapiens
IQLKLDRPS

SEQ ID NO: 1063271 - protein, 9 aa, Homo Sapiens
MLIFLRNQI

SEQ ID NO: 1063272 - protein, 9 aa, Homo Sapiens
AFCYTCRGG

SEQ ID NO: 1063273 - protein, 9 aa, Homo Sapiens
PDAIVLAEK

SEQ ID NO: 1063274 - protein, 9 aa, Homo Sapiens
AVSPSTAIE

SEQ ID NO: 1063275 - protein, 9 aa, Homo Sapiens
YLNTQQSSV

SEQ ID NO: 1063276 - protein, 9 aa, Homo Sapiens
LFTKTASSL

SEQ ID NO: 1063277 - protein, 9 aa, Homo Sapiens
VDVFRDLAS

SEQ ID NO: 1063278 - protein, 9 aa, Homo Sapiens
DFIVKGSCI

SEQ ID NO: 1063279 - protein, 9 aa, Homo Sapiens
DPLETRPQH

SEQ ID NO: 1063280 - protein, 9 aa, Homo Sapiens
REDDSFLLE

SEQ ID NO: 1063281 - protein, 9 aa, Homo Sapiens
FQQMNDLET

SEQ ID NO: 1063282 - protein, 9 aa, Homo Sapiens
KFEEDLTGI

SEQ ID NO: 1063283 - protein, 9 aa, Homo Sapiens
NCLKLMKYL

SEQ ID NO: 1063284 - protein, 9 aa, Homo Sapiens
NWTLPQPRT

SEQ ID NO: 1063285 - protein, 9 aa, Homo Sapiens
HGKRFLIVM

SEQ ID NO: 1063286 - protein, 9 aa, Homo Sapiens
KVARHDVRE

SEQ ID NO: 1063287 - protein, 9 aa, Homo Sapiens
CEPSLLSPK

SEQ ID NO: 1063288 - protein, 9 aa, Homo Sapiens
GWILDGISE

SEQ ID NO: 1063289 - protein, 9 aa, Homo Sapiens
YSRGQIIYT

SEQ ID NO: 1063290 - protein, 9 aa, Homo Sapiens
SVTWIGAAL

SEQ ID NO: 1063291 - protein, 9 aa, Homo Sapiens
MDFLSSLRP

SEQ ID NO: 1063292 - protein, 9 aa, Homo Sapiens
ASCVDGFEE

SEQ ID NO: 1063293 - protein, 9 aa, Homo Sapiens
WPVFSPLHS

SEQ ID NO: 1063294 - protein, 9 aa, Homo Sapiens
GTSLLSVYL

SEQ ID NO: 1063295 - protein, 9 aa, Homo Sapiens
KDAENEDED

SEQ ID NO: 1063296 - protein, 9 aa, Homo Sapiens
YFSYPCRRY

SEQ ID NO: 1063297 - protein, 9 aa, Homo Sapiens
QDCFFRNRL

SEQ ID NO: 1063298 - protein, 9 aa, Homo Sapiens
DVCNETCAK

SEQ ID NO: 1063299 - protein, 9 aa, Homo Sapiens
PQPRSSRWP

SEQ ID NO: 1063300 - protein, 9 aa, Homo Sapiens
DVLLLARDK

SEQ ID NO: 1063301 - protein, 9 aa, Homo Sapiens
LVSVTRNPS

SEQ ID NO: 1063302 - protein, 9 aa, Homo Sapiens
PLYKWEVVE

SEQ ID NO: 1063303 - protein, 9 aa, Homo Sapiens
MKDSAQEIA

SEQ ID NO: 1063304 - protein, 9 aa, Homo Sapiens
CVIVCNKKN

SEQ ID NO: 1063305 - protein, 9 aa, Homo Sapiens
ETMSSTVTF

SEQ ID NO: 1063306 - protein, 9 aa, Homo Sapiens
KPGYKGKGK

SEQ ID NO: 1063307 - protein, 9 aa, Homo Sapiens
TRQSASVPL

SEQ ID NO: 1063308 - protein, 9 aa, Homo Sapiens
QAQAEGPSV

SEQ ID NO: 1063309 - protein, 9 aa, Homo Sapiens
DDLFQDSPE

SEQ ID NO: 1063310 - protein, 9 aa, Homo Sapiens
PAMTEEVAW

SEQ ID NO: 1063311 - protein, 9 aa, Homo Sapiens
YYPNVMNMR

SEQ ID NO: 1063312 - protein, 9 aa, Homo Sapiens
HKKNLLKAL

SEQ ID NO: 1063313 - protein, 9 aa, Homo Sapiens
FFKEQVPMP

SEQ ID NO: 1063314 - protein, 9 aa, Homo Sapiens
FFEPAPAPG

SEQ ID NO: 1063315 - protein, 9 aa, Homo Sapiens
TQNFWFRPA

SEQ ID NO: 1063316 - protein, 9 aa, Homo Sapiens
CWVYILDND

SEQ ID NO: 1063317 - protein, 9 aa, Homo Sapiens
AQLHCRCPG

SEQ ID NO: 1063318 - protein, 9 aa, Homo Sapiens
YTNLIRPKI

SEQ ID NO: 1063319 - protein, 9 aa, Homo Sapiens
RANLTNFPK

SEQ ID NO: 1063320 - protein, 9 aa, Homo Sapiens
NIASKRERV

SEQ ID NO: 1063321 - protein, 9 aa, Homo Sapiens
SSGSTEQAA

SEQ ID NO: 1063322 - protein, 9 aa, Homo Sapiens
LLWSQVLAF

SEQ ID NO: 1063323 - protein, 9 aa, Homo Sapiens
KLRYRKRPF

SEQ ID NO: 1063324 - protein, 9 aa, Homo Sapiens
SDTTMVSNL

SEQ ID NO: 1063325 - protein, 9 aa, Homo Sapiens
ETCKDAGLV

SEQ ID NO: 1063326 - protein, 9 aa, Homo Sapiens
YECNVCGKF

SEQ ID NO: 1063327 - protein, 9 aa, Homo Sapiens
LPTRGQLEE

SEQ ID NO: 1063328 - protein, 9 aa, Homo Sapiens
RQTTAKAVQ

SEQ ID NO: 1063329 - protein, 9 aa, Homo Sapiens
KTKIFSLLA

SEQ ID NO: 1063330 - protein, 9 aa, Homo Sapiens
RGAHGNSYP

SEQ ID NO: 1063331 - protein, 9 aa, Homo Sapiens
QLLQLDENK

SEQ ID NO: 1063332 - protein, 9 aa, Homo Sapiens
SALLSTGEF

SEQ ID NO: 1063333 - protein, 9 aa, Homo Sapiens
ASKRERVKI

SEQ ID NO: 1063334 - protein, 9 aa, Homo Sapiens
RDGPCEFAL

SEQ ID NO: 1063335 - protein, 9 aa, Homo Sapiens
KGFSLFLAM

SEQ ID NO: 1063336 - protein, 9 aa, Homo Sapiens
QFRERNAGS

SEQ ID NO: 1063337 - protein, 9 aa, Homo Sapiens
SEAAHWLAR

SEQ ID NO: 1063338 - protein, 9 aa, Homo Sapiens
NATKARIPL

SEQ ID NO: 1063339 - protein, 9 aa, Homo Sapiens
HLFPVAHVL

SEQ ID NO: 1063340 - protein, 9 aa, Homo Sapiens
PQIIFFFLA

SEQ ID NO: 1063341 - protein, 9 aa, Homo Sapiens
LLVTPMVNP

SEQ ID NO: 1063342 - protein, 9 aa, Homo Sapiens
TSGHSSING

SEQ ID NO: 1063343 - protein, 9 aa, Homo Sapiens
SKSTFSEPQ

SEQ ID NO: 1063344 - protein, 9 aa, Homo Sapiens
TLSDVWSFE

SEQ ID NO: 1063345 - protein, 9 aa, Homo Sapiens
RWGGGYKGE

SEQ ID NO: 1063346 - protein, 9 aa, Homo Sapiens
CKDVRIDTI

SEQ ID NO: 1063347 - protein, 9 aa, Homo Sapiens
IIILLLNPF

SEQ ID NO: 1063348 - protein, 9 aa, Homo Sapiens
QKKIDTVLP

SEQ ID NO: 1063349 - protein, 9 aa, Homo Sapiens
FMLILKGVK

SEQ ID NO: 1063350 - protein, 9 aa, Homo Sapiens
NLLSHMLHM

SEQ ID NO: 1063351 - protein, 9 aa, Homo Sapiens
ERIENIYFR

SEQ ID NO: 1063352 - protein, 9 aa, Homo Sapiens
STAEEKLCR

SEQ ID NO: 1063353 - protein, 9 aa, Homo Sapiens
FYSKVLGRP

SEQ ID NO: 1063354 - protein, 9 aa, Homo Sapiens
RRLLLLIPF

SEQ ID NO: 1063355 - protein, 9 aa, Homo Sapiens
DKYFFDRDP

SEQ ID NO: 1063356 - protein, 9 aa, Homo Sapiens
RFSMCRGNN

SEQ ID NO: 1063357 - protein, 9 aa, Homo Sapiens
FQTSHKDLD

SEQ ID NO: 1063358 - protein, 9 aa, Homo Sapiens
KGQVLECSL

SEQ ID NO: 1063359 - protein, 9 aa, Homo Sapiens
PSRKNSTRW

SEQ ID NO: 1063360 - protein, 9 aa, Homo Sapiens
FLIISNNGL

SEQ ID NO: 1063361 - protein, 9 aa, Homo Sapiens
PRTLLMSVC

SEQ ID NO: 1063362 - protein, 9 aa, Homo Sapiens
CVAAPGGHL

SEQ ID NO: 1063363 - protein, 9 aa, Homo Sapiens
EFSGDIFHS

SEQ ID NO: 1063364 - protein, 9 aa, Homo Sapiens
DWAPFLLST

SEQ ID NO: 1063365 - protein, 9 aa, Homo Sapiens
SPSRESVVH

SEQ ID NO: 1063366 - protein, 9 aa, Homo Sapiens
TSSPAAPLS

SEQ ID NO: 1063367 - protein, 9 aa, Homo Sapiens
ADNKKMYVK

SEQ ID NO: 1063368 - protein, 9 aa, Homo Sapiens
RLWPVFSPL

SEQ ID NO: 1063369 - protein, 9 aa, Homo Sapiens
ASRFLSLFW

SEQ ID NO: 1063370 - protein, 9 aa, Homo Sapiens
ASGYWGLPE

SEQ ID NO: 1063371 - protein, 9 aa, Homo Sapiens
YKHGSLICQ

SEQ ID NO: 1063372 - protein, 9 aa, Homo Sapiens
CTNLPPTSI

SEQ ID NO: 1063373 - protein, 9 aa, Homo Sapiens
ESQRRKERI

SEQ ID NO: 1063374 - protein, 9 aa, Homo Sapiens
PSPKVSSSQ

SEQ ID NO: 1063375 - protein, 9 aa, Homo Sapiens
STYDAHDGS

SEQ ID NO: 1063376 - protein, 9 aa, Homo Sapiens
NPVITASYL

SEQ ID NO: 1063377 - protein, 9 aa, Homo Sapiens
SKHEPGHET

SEQ ID NO: 1063378 - protein, 9 aa, Homo Sapiens
EEGSNKGAK

SEQ ID NO: 1063379 - protein, 9 aa, Homo Sapiens
KTFFGVGQE

SEQ ID NO: 1063380 - protein, 9 aa, Homo Sapiens
HWGEEGHDS

SEQ ID NO: 1063381 - protein, 9 aa, Homo Sapiens
RADDLVSPD

SEQ ID NO: 1063382 - protein, 9 aa, Homo Sapiens
LEWETKAQA

SEQ ID NO: 1063383 - protein, 9 aa, Homo Sapiens
ELSQRMLFN

SEQ ID NO: 1063384 - protein, 9 aa, Homo Sapiens
FLREVESAK

SEQ ID NO: 1063385 - protein, 9 aa, Homo Sapiens
VCKSCQGKK

SEQ ID NO: 1063386 - protein, 9 aa, Homo Sapiens
TIKEKVMLC

SEQ ID NO: 1063387 - protein, 9 aa, Homo Sapiens
VRCTSHTSQ

SEQ ID NO: 1063388 - protein, 9 aa, Homo Sapiens
KHLNKEELG

SEQ ID NO: 1063389 - protein, 9 aa, Homo Sapiens
EFYFLPNPY

SEQ ID NO: 1063390 - protein, 9 aa, Homo Sapiens
RLLFQESPE

SEQ ID NO: 1063391 - protein, 9 aa, Homo Sapiens
PAKENLFIG

SEQ ID NO: 1063392 - protein, 9 aa, Homo Sapiens
SVKTSIQRA

SEQ ID NO: 1063393 - protein, 9 aa, Homo Sapiens
NKALGEKLY

SEQ ID NO: 1063394 - protein, 9 aa, Homo Sapiens
EWHAVDPDC

SEQ ID NO: 1063395 - protein, 9 aa, Homo Sapiens
TWYLVSIPA

SEQ ID NO: 1063396 - protein, 9 aa, Homo Sapiens
ETSVPLLPK

SEQ ID NO: 1063397 - protein, 9 aa, Homo Sapiens
FTMYISILF

SEQ ID NO: 1063398 - protein, 9 aa, Homo Sapiens
DTPKEDGIT

SEQ ID NO: 1063399 - protein, 9 aa, Homo Sapiens
EDISRTLGP

SEQ ID NO: 1063400 - protein, 9 aa, Homo Sapiens
VKCLSDCIL

SEQ ID NO: 1063401 - protein, 9 aa, Homo Sapiens
NVCVPKTCP

SEQ ID NO: 1063402 - protein, 9 aa, Homo Sapiens
KCPFDPQQL

SEQ ID NO: 1063403 - protein, 9 aa, Homo Sapiens
QNSGNTDIE

SEQ ID NO: 1063404 - protein, 9 aa, Homo Sapiens
FGVGSLQEK

SEQ ID NO: 1063405 - protein, 9 aa, Homo Sapiens
LVSGVLASA

SEQ ID NO: 1063406 - protein, 9 aa, Homo Sapiens
FLHPILFYQ

SEQ ID NO: 1063407 - protein, 9 aa, Homo Sapiens
RRQSIVLDS

SEQ ID NO: 1063408 - protein, 9 aa, Homo Sapiens
VPSLIPVQR

SEQ ID NO: 1063409 - protein, 9 aa, Homo Sapiens
WETMSSTVT

SEQ ID NO: 1063410 - protein, 9 aa, Homo Sapiens
LLRKYAVKA

SEQ ID NO: 1063411 - protein, 9 aa, Homo Sapiens
SQVGQKQSS

SEQ ID NO: 1063412 - protein, 9 aa, Homo Sapiens
EWYAHNRYP

SEQ ID NO: 1063413 - protein, 9 aa, Homo Sapiens
KSTNEATNI

SEQ ID NO: 1063414 - protein, 9 aa, Homo Sapiens
LHLWSSCIA

SEQ ID NO: 1063415 - protein, 9 aa, Homo Sapiens
QSLDALVKK

SEQ ID NO: 1063416 - protein, 9 aa, Homo Sapiens
LYQARKKTF

SEQ ID NO: 1063417 - protein, 9 aa, Homo Sapiens
EMEGEKKES

SEQ ID NO: 1063418 - protein, 9 aa, Homo Sapiens
SFENSDKFH

SEQ ID NO: 1063419 - protein, 9 aa, Homo Sapiens
SVENGFVSP

SEQ ID NO: 1063420 - protein, 9 aa, Homo Sapiens
NMYPMPNTL

SEQ ID NO: 1063421 - protein, 9 aa, Homo Sapiens
FCPLPGSSG

SEQ ID NO: 1063422 - protein, 9 aa, Homo Sapiens
NCWTCIGDL

SEQ ID NO: 1063423 - protein, 9 aa, Homo Sapiens
FMQAVLSLY

SEQ ID NO: 1063424 - protein, 9 aa, Homo Sapiens
RHRLVPLLN

SEQ ID NO: 1063425 - protein, 9 aa, Homo Sapiens
DSFFCDLSR

SEQ ID NO: 1063426 - protein, 9 aa, Homo Sapiens
DEIIFPRGL

SEQ ID NO: 1063427 - protein, 9 aa, Homo Sapiens
TGWTGSSCD

SEQ ID NO: 1063428 - protein, 9 aa, Homo Sapiens
SHPEDNWME

SEQ ID NO: 1063429 - protein, 9 aa, Homo Sapiens
MGLNGKPER

SEQ ID NO: 1063430 - protein, 9 aa, Homo Sapiens
TQLHLNLKK

SEQ ID NO: 1063431 - protein, 9 aa, Homo Sapiens
AKKKMELLI

SEQ ID NO: 1063432 - protein, 9 aa, Homo Sapiens
QTKPCHDQE

SEQ ID NO: 1063433 - protein, 9 aa, Homo Sapiens
LPPEEELQR

SEQ ID NO: 1063434 - protein, 9 aa, Homo Sapiens
QDCSQCQEW

SEQ ID NO: 1063435 - protein, 9 aa, Homo Sapiens
TTATTELKK

SEQ ID NO: 1063436 - protein, 9 aa, Homo Sapiens
PSSALRPHQ

SEQ ID NO: 1063437 - protein, 9 aa, Homo Sapiens
SPTPSFRSP

SEQ ID NO: 1063438 - protein, 9 aa, Homo Sapiens
TTVNYFVLF

SEQ ID NO: 1063439 - protein, 9 aa, Homo Sapiens
HELLRQMEI

SEQ ID NO: 1063440 - protein, 9 aa, Homo Sapiens
DSLSKELAK

SEQ ID NO: 1063441 - protein, 9 aa, Homo Sapiens
KYNLAIKDL

SEQ ID NO: 1063442 - protein, 9 aa, Homo Sapiens
DETILLLPA

SEQ ID NO: 1063443 - protein, 9 aa, Homo Sapiens
GPHATADLD

SEQ ID NO: 1063444 - protein, 9 aa, Homo Sapiens
PQDTLLPTV

SEQ ID NO: 1063445 - protein, 9 aa, Homo Sapiens
LRESRLLAY

SEQ ID NO: 1063446 - protein, 9 aa, Homo Sapiens
LPGCRRISH

SEQ ID NO: 1063447 - protein, 9 aa, Homo Sapiens
CQARKPPEQ

SEQ ID NO: 1063448 - protein, 9 aa, Homo Sapiens
SFEELGPAT

SEQ ID NO: 1063449 - protein, 9 aa, Homo Sapiens
AYCCTGYKE

SEQ ID NO: 1063450 - protein, 9 aa, Homo Sapiens
HFQDDDDGP

SEQ ID NO: 1063451 - protein, 9 aa, Homo Sapiens
ETDFFVNKL

SEQ ID NO: 1063452 - protein, 9 aa, Homo Sapiens
SSGGGPRGP

SEQ ID NO: 1063453 - protein, 9 aa, Homo Sapiens
FLVGLHFCF

SEQ ID NO: 1063454 - protein, 9 aa, Homo Sapiens
EKQEDKATL

SEQ ID NO: 1063455 - protein, 9 aa, Homo Sapiens
SAGSLSAAG

SEQ ID NO: 1063456 - protein, 9 aa, Homo Sapiens
LFWRQAKVQ

SEQ ID NO: 1063457 - protein, 9 aa, Homo Sapiens
QRDAVKTVA

SEQ ID NO: 1063458 - protein, 9 aa, Homo Sapiens
DSKTGKLTT

SEQ ID NO: 1063459 - protein, 9 aa, Homo Sapiens
HAFCYTCRG

SEQ ID NO: 1063460 - protein, 9 aa, Homo Sapiens
LDCGRPRGA

SEQ ID NO: 1063461 - protein, 9 aa, Homo Sapiens
FHQDALEGG

SEQ ID NO: 1063462 - protein, 9 aa, Homo Sapiens
GSTRFPGFP

SEQ ID NO: 1063463 - protein, 9 aa, Homo Sapiens
NFFFPISVS

SEQ ID NO: 1063464 - protein, 9 aa, Homo Sapiens
SRGRHGSNF

SEQ ID NO: 1063465 - protein, 9 aa, Homo Sapiens
KKEKLKGPP

SEQ ID NO: 1063466 - protein, 9 aa, Homo Sapiens
LPTSIFLAS

SEQ ID NO: 1063467 - protein, 9 aa, Homo Sapiens
DSLNICING

SEQ ID NO: 1063468 - protein, 9 aa, Homo Sapiens
TKDILFMKE

SEQ ID NO: 1063469 - protein, 9 aa, Homo Sapiens
FSCMDRMSG

SEQ ID NO: 1063470 - protein, 9 aa, Homo Sapiens
LWLWLCLLK

SEQ ID NO: 1063471 - protein, 9 aa, Homo Sapiens
SSCGSSGYI

SEQ ID NO: 1063472 - protein, 9 aa, Homo Sapiens
PSFRSPAPP

SEQ ID NO: 1063473 - protein, 9 aa, Homo Sapiens
QMRVLAVRL

SEQ ID NO: 1063474 - protein, 9 aa, Homo Sapiens
PGSTKTSFR

SEQ ID NO: 1063475 - protein, 9 aa, Homo Sapiens
NLIEVRANK

SEQ ID NO: 1063476 - protein, 9 aa, Homo Sapiens
LFSEIFDAL

SEQ ID NO: 1063477 - protein, 9 aa, Homo Sapiens
RQKKKMHEQ

SEQ ID NO: 1063478 - protein, 9 aa, Homo Sapiens
QPITEPGMV

SEQ ID NO: 1063479 - protein, 9 aa, Homo Sapiens
GATECFFLA

SEQ ID NO: 1063480 - protein, 9 aa, Homo Sapiens
LAFDMADRV

SEQ ID NO: 1063481 - protein, 9 aa, Homo Sapiens
CGHFSPLKI

SEQ ID NO: 1063482 - protein, 9 aa, Homo Sapiens
GDLGRLGHG

SEQ ID NO: 1063483 - protein, 9 aa, Homo Sapiens
SMGKGRICR

SEQ ID NO: 1063484 - protein, 9 aa, Homo Sapiens
NFIKEFVII

SEQ ID NO: 1063485 - protein, 9 aa, Homo Sapiens
SFLQTTDVI

SEQ ID NO: 1063486 - protein, 9 aa, Homo Sapiens
IQLLENFPV

SEQ ID NO: 1063487 - protein, 9 aa, Homo Sapiens
ANFSSGNFA

SEQ ID NO: 1063488 - protein, 9 aa, Homo Sapiens
PMSLSSSQS

SEQ ID NO: 1063489 - protein, 9 aa, Homo Sapiens
AQSQSHSSS

SEQ ID NO: 1063490 - protein, 9 aa, Homo Sapiens
CFFLAFMAY

SEQ ID NO: 1063491 - protein, 9 aa, Homo Sapiens
KPFFGGSAS

SEQ ID NO: 1063492 - protein, 9 aa, Homo Sapiens
EQEEKIKTY

SEQ ID NO: 1063493 - protein, 9 aa, Homo Sapiens
MFQSEVARR

SEQ ID NO: 1063494 - protein, 9 aa, Homo Sapiens
NTVQENEAT

SEQ ID NO: 1063495 - protein, 9 aa, Homo Sapiens
CPLPVLDYS

SEQ ID NO: 1063496 - protein, 9 aa, Homo Sapiens
ATSAIPPLR

SEQ ID NO: 1063497 - protein, 9 aa, Homo Sapiens
HPCLDLCGQ

SEQ ID NO: 1063498 - protein, 9 aa, Homo Sapiens
KIIQLVVQS

SEQ ID NO: 1063499 - protein, 9 aa, Homo Sapiens
QKMNTCVTL

SEQ ID NO: 1063500 - protein, 9 aa, Homo Sapiens
KAIYVNRTY

SEQ ID NO: 1063501 - protein, 9 aa, Homo Sapiens
WNSFLSGCC

SEQ ID NO: 1063502 - protein, 9 aa, Homo Sapiens
RKEGTLPTP

SEQ ID NO: 1063503 - protein, 9 aa, Homo Sapiens
RGVPENFNK

SEQ ID NO: 1063504 - protein, 9 aa, Homo Sapiens
KEEKCCRKN

SEQ ID NO: 1063505 - protein, 9 aa, Homo Sapiens
KFANFIKEF

SEQ ID NO: 1063506 - protein, 9 aa, Homo Sapiens
AEKIHNTGL

SEQ ID NO: 1063507 - protein, 9 aa, Homo Sapiens
ASALTATLF

SEQ ID NO: 1063508 - protein, 9 aa, Homo Sapiens
RRKAFETCS

SEQ ID NO: 1063509 - protein, 9 aa, Homo Sapiens
FPIEVRHYS

SEQ ID NO: 1063510 - protein, 9 aa, Homo Sapiens
TPTRHLFNG

SEQ ID NO: 1063511 - protein, 9 aa, Homo Sapiens
PQPVFLNPV

SEQ ID NO: 1063512 - protein, 9 aa, Homo Sapiens
PPGAGPSGL

SEQ ID NO: 1063513 - protein, 9 aa, Homo Sapiens
INIVTANFV

SEQ ID NO: 1063514 - protein, 9 aa, Homo Sapiens
FTGIFFSAS

SEQ ID NO: 1063515 - protein, 9 aa, Homo Sapiens
APHPIDGPP

SEQ ID NO: 1063516 - protein, 9 aa, Homo Sapiens
QQSSVAATL

SEQ ID NO: 1063517 - protein, 9 aa, Homo Sapiens
LQRRLSASR

SEQ ID NO: 1063518 - protein, 9 aa, Homo Sapiens
HNKPVNAES

SEQ ID NO: 1063519 - protein, 9 aa, Homo Sapiens
DCAFSRTKD

SEQ ID NO: 1063520 - protein, 9 aa, Homo Sapiens
NSIAWSPES

SEQ ID NO: 1063521 - protein, 9 aa, Homo Sapiens
EQDNVYFLQ

SEQ ID NO: 1063522 - protein, 9 aa, Homo Sapiens
HNTSWNRMI

SEQ ID NO: 1063523 - protein, 9 aa, Homo Sapiens
SASLSLQRL

SEQ ID NO: 1063524 - protein, 9 aa, Homo Sapiens
NYHTPLYLT

SEQ ID NO: 1063525 - protein, 9 aa, Homo Sapiens
PAEIPSYLP

SEQ ID NO: 1063526 - protein, 9 aa, Homo Sapiens
GATHSLLTF

SEQ ID NO: 1063527 - protein, 9 aa, Homo Sapiens
IKQSSDSKV

SEQ ID NO: 1063528 - protein, 9 aa, Homo Sapiens
NVGLYFWTM

SEQ ID NO: 1063529 - protein, 9 aa, Homo Sapiens
PNDVLQILD

SEQ ID NO: 1063530 - protein, 9 aa, Homo Sapiens
YLELHIPLF

SEQ ID NO: 1063531 - protein, 9 aa, Homo Sapiens
VGFSYNATT

SEQ ID NO: 1063532 - protein, 9 aa, Homo Sapiens
FLMDKAFDP

SEQ ID NO: 1063533 - protein, 9 aa, Homo Sapiens
LNEGDRGNL

SEQ ID NO: 1063534 - protein, 9 aa, Homo Sapiens
TSELGDSGV

SEQ ID NO: 1063535 - protein, 9 aa, Homo Sapiens
NATLKNCDL

SEQ ID NO: 1063536 - protein, 9 aa, Homo Sapiens
CSSLSSDSP

SEQ ID NO: 1063537 - protein, 9 aa, Homo Sapiens
KGKKKRKVK

SEQ ID NO: 1063538 - protein, 9 aa, Homo Sapiens
QDSFYFEDF

SEQ ID NO: 1063539 - protein, 9 aa, Homo Sapiens
RYAGALLDK

SEQ ID NO: 1063540 - protein, 9 aa, Homo Sapiens
SAVASNMRN

SEQ ID NO: 1063541 - protein, 9 aa, Homo Sapiens
NYYETDESV

SEQ ID NO: 1063542 - protein, 9 aa, Homo Sapiens
NTFVENHKR

SEQ ID NO: 1063543 - protein, 9 aa, Homo Sapiens
FMRIIKYKF

SEQ ID NO: 1063544 - protein, 9 aa, Homo Sapiens
DTTPAPSTT

SEQ ID NO: 1063545 - protein, 9 aa, Homo Sapiens
AGPHATADL

SEQ ID NO: 1063546 - protein, 9 aa, Homo Sapiens
PLIKKTAAI

SEQ ID NO: 1063547 - protein, 9 aa, Homo Sapiens
YTGQGRSPR

SEQ ID NO: 1063548 - protein, 9 aa, Homo Sapiens
NLAEELPQP

SEQ ID NO: 1063549 - protein, 9 aa, Homo Sapiens
FLSYLPSQV

SEQ ID NO: 1063550 - protein, 9 aa, Homo Sapiens
ADSEKGKAP

SEQ ID NO: 1063551 - protein, 9 aa, Homo Sapiens
MRPEVTHQK

SEQ ID NO: 1063552 - protein, 9 aa, Homo Sapiens
ENYLVSSGL

SEQ ID NO: 1063553 - protein, 9 aa, Homo Sapiens
MKISFFERL

SEQ ID NO: 1063554 - protein, 9 aa, Homo Sapiens
CCKPASNWG

SEQ ID NO: 1063555 - protein, 9 aa, Homo Sapiens
NGGDVTFYD

SEQ ID NO: 1063556 - protein, 9 aa, Homo Sapiens
RTYYHGQTE

SEQ ID NO: 1063557 - protein, 9 aa, Homo Sapiens
TLCNKEVRE

SEQ ID NO: 1063558 - protein, 9 aa, Homo Sapiens
CLKNFWWLA

SEQ ID NO: 1063559 - protein, 9 aa, Homo Sapiens
FSVDEFFAS

SEQ ID NO: 1063560 - protein, 9 aa, Homo Sapiens
IWRSKAGAE

SEQ ID NO: 1063561 - protein, 9 aa, Homo Sapiens
KLKIVSSMA

SEQ ID NO: 1063562 - protein, 9 aa, Homo Sapiens
LAEDWAGLD

SEQ ID NO: 1063563 - protein, 9 aa, Homo Sapiens
FCECLRRVF

SEQ ID NO: 1063564 - protein, 9 aa, Homo Sapiens
LMLQYISKP

SEQ ID NO: 1063565 - protein, 9 aa, Homo Sapiens
TIYYNLCFL

SEQ ID NO: 1063566 - protein, 9 aa, Homo Sapiens
SAHSSRKLF

SEQ ID NO: 1063567 - protein, 9 aa, Homo Sapiens
KTPEKSFTR

SEQ ID NO: 1063568 - protein, 9 aa, Homo Sapiens
SGRFDVSDI

SEQ ID NO: 1063569 - protein, 9 aa, Homo Sapiens
ASTRVIMSV

SEQ ID NO: 1063570 - protein, 9 aa, Homo Sapiens
VTPLSPEKE

SEQ ID NO: 1063571 - protein, 9 aa, Homo Sapiens
QENMGFSCR

SEQ ID NO: 1063572 - protein, 9 aa, Homo Sapiens
IVSSGNTCE

SEQ ID NO: 1063573 - protein, 9 aa, Homo Sapiens
LETRPQHYP

SEQ ID NO: 1063574 - protein, 9 aa, Homo Sapiens
IRAFFVSAF

SEQ ID NO: 1063575 - protein, 9 aa, Homo Sapiens
HLFLFTSNS

SEQ ID NO: 1063576 - protein, 9 aa, Homo Sapiens
CKGHPNPTL

SEQ ID NO: 1063577 - protein, 9 aa, Homo Sapiens
RNKHIYKKR

SEQ ID NO: 1063578 - protein, 9 aa, Homo Sapiens
VFMRTWYLV

SEQ ID NO: 1063579 - protein, 9 aa, Homo Sapiens
LYSPSSTLP

SEQ ID NO: 1063580 - protein, 9 aa, Homo Sapiens
FPLIKKTAA

SEQ ID NO: 1063581 - protein, 9 aa, Homo Sapiens
KRKRKYKLR

SEQ ID NO: 1063582 - protein, 9 aa, Homo Sapiens
CSCSFHEIP

SEQ ID NO: 1063583 - protein, 9 aa, Homo Sapiens
YFVLFEVIS

SEQ ID NO: 1063584 - protein, 9 aa, Homo Sapiens
AYKFSGPSF

SEQ ID NO: 1063585 - protein, 9 aa, Homo Sapiens
VGAKSPLDI

SEQ ID NO: 1063586 - protein, 9 aa, Homo Sapiens
PKQIDTIFL

SEQ ID NO: 1063587 - protein, 9 aa, Homo Sapiens
KIYDPQEKR

SEQ ID NO: 1063588 - protein, 9 aa, Homo Sapiens
QRQRTPGEK

SEQ ID NO: 1063589 - protein, 9 aa, Homo Sapiens
SLYSPSSTL

SEQ ID NO: 1063590 - protein, 9 aa, Homo Sapiens
VPAAVPDDL

SEQ ID NO: 1063591 - protein, 9 aa, Homo Sapiens
AYFSPQELE

SEQ ID NO: 1063592 - protein, 9 aa, Homo Sapiens
NMAKGWGSR

SEQ ID NO: 1063593 - protein, 9 aa, Homo Sapiens
VADELPNML

SEQ ID NO: 1063594 - protein, 9 aa, Homo Sapiens
PGLQGLLGA

SEQ ID NO: 1063595 - protein, 9 aa, Homo Sapiens
TEIILLLLI

SEQ ID NO: 1063596 - protein, 9 aa, Homo Sapiens
IWHKFSSDF

SEQ ID NO: 1063597 - protein, 9 aa, Homo Sapiens
STGKDKSLN

SEQ ID NO: 1063598 - protein, 9 aa, Homo Sapiens
ARYFQRDKN

SEQ ID NO: 1063599 - protein, 9 aa, Homo Sapiens
IKFDIYTLF

SEQ ID NO: 1063600 - protein, 9 aa, Homo Sapiens
HSRTNLIDT

SEQ ID NO: 1063601 - protein, 9 aa, Homo Sapiens
NFFLANPTT

SEQ ID NO: 1063602 - protein, 9 aa, Homo Sapiens
FCSEDSSIS

SEQ ID NO: 1063603 - protein, 9 aa, Homo Sapiens
SSIPCMISF

SEQ ID NO: 1063604 - protein, 9 aa, Homo Sapiens
VKIYFSIML

SEQ ID NO: 1063605 - protein, 9 aa, Homo Sapiens
GVGEAVPGA

SEQ ID NO: 1063606 - protein, 9 aa, Homo Sapiens
QEEPEKPSK

SEQ ID NO: 1063607 - protein, 9 aa, Homo Sapiens
TLFSGDIGS

SEQ ID NO: 1063608 - protein, 9 aa, Homo Sapiens
LPTVLVTEE

SEQ ID NO: 1063609 - protein, 9 aa, Homo Sapiens
LGSFTFQAI

SEQ ID NO: 1063610 - protein, 9 aa, Homo Sapiens
ERVHRVFFR

SEQ ID NO: 1063611 - protein, 9 aa, Homo Sapiens
LLRRYLTSE

SEQ ID NO: 1063612 - protein, 9 aa, Homo Sapiens
DILFMKEDI

SEQ ID NO: 1063613 - protein, 9 aa, Homo Sapiens
YDTIIMEEM

SEQ ID NO: 1063614 - protein, 9 aa, Homo Sapiens
KGSCICNGH

SEQ ID NO: 1063615 - protein, 9 aa, Homo Sapiens
IKKQYTVRR

SEQ ID NO: 1063616 - protein, 9 aa, Homo Sapiens
SAHREYITC

SEQ ID NO: 1063617 - protein, 9 aa, Homo Sapiens
RATEEEVWK

SEQ ID NO: 1063618 - protein, 9 aa, Homo Sapiens
APGVPGERR

SEQ ID NO: 1063619 - protein, 9 aa, Homo Sapiens
KERVGKEVV

SEQ ID NO: 1063620 - protein, 9 aa, Homo Sapiens
MIHSLSEKK

SEQ ID NO: 1063621 - protein, 9 aa, Homo Sapiens
GGCNFNFFL

SEQ ID NO: 1063622 - protein, 9 aa, Homo Sapiens
PEKISSMVL

SEQ ID NO: 1063623 - protein, 9 aa, Homo Sapiens
SKYQLLYHS

SEQ ID NO: 1063624 - protein, 9 aa, Homo Sapiens
PPSYVVDLL

SEQ ID NO: 1063625 - protein, 9 aa, Homo Sapiens
FGRGDTDLG

SEQ ID NO: 1063626 - protein, 9 aa, Homo Sapiens
QSKKYKYEV

SEQ ID NO: 1063627 - protein, 9 aa, Homo Sapiens
SDEESVFEK

SEQ ID NO: 1063628 - protein, 9 aa, Homo Sapiens
PQNDLLGYP

SEQ ID NO: 1063629 - protein, 9 aa, Homo Sapiens
VFRFGPHDQ

SEQ ID NO: 1063630 - protein, 9 aa, Homo Sapiens
LNCESADST

SEQ ID NO: 1063631 - protein, 9 aa, Homo Sapiens
KRPPALSGT

SEQ ID NO: 1063632 - protein, 9 aa, Homo Sapiens
SSSKACKIA

SEQ ID NO: 1063633 - protein, 9 aa, Homo Sapiens
MRLGGLTQV

SEQ ID NO: 1063634 - protein, 9 aa, Homo Sapiens
ILLFLAKVV

SEQ ID NO: 1063635 - protein, 9 aa, Homo Sapiens
LAAALALTL

SEQ ID NO: 1063636 - protein, 9 aa, Homo Sapiens
EIKVESSSL

SEQ ID NO: 1063637 - protein, 9 aa, Homo Sapiens
GGFRSDLDN

SEQ ID NO: 1063638 - protein, 9 aa, Homo Sapiens
TRATAPPRV

SEQ ID NO: 1063639 - protein, 9 aa, Homo Sapiens
KESYYISEV

SEQ ID NO: 1063640 - protein, 9 aa, Homo Sapiens
SSSQLNRIS

SEQ ID NO: 1063641 - protein, 9 aa, Homo Sapiens
TLSQRARRL

SEQ ID NO: 1063642 - protein, 9 aa, Homo Sapiens
GRGDTDLGH

SEQ ID NO: 1063643 - protein, 9 aa, Homo Sapiens
AHACYSSTL

SEQ ID NO: 1063644 - protein, 9 aa, Homo Sapiens
HTSQASHEC

SEQ ID NO: 1063645 - protein, 9 aa, Homo Sapiens
PCSNRPPRQ

SEQ ID NO: 1063646 - protein, 9 aa, Homo Sapiens
FFDCYDPET

SEQ ID NO: 1063647 - protein, 9 aa, Homo Sapiens
YPENGTDNF

SEQ ID NO: 1063648 - protein, 9 aa, Homo Sapiens
EDTDLTFFS

SEQ ID NO: 1063649 - protein, 9 aa, Homo Sapiens
RTFEQDPTT

SEQ ID NO: 1063650 - protein, 9 aa, Homo Sapiens
PHECDFCGK

SEQ ID NO: 1063651 - protein, 9 aa, Homo Sapiens
STSTLREAE

SEQ ID NO: 1063652 - protein, 9 aa, Homo Sapiens
ITYYLLLGL

SEQ ID NO: 1063653 - protein, 9 aa, Homo Sapiens
QKHTDQIWK

SEQ ID NO: 1063654 - protein, 9 aa, Homo Sapiens
NFMRIIKYK

SEQ ID NO: 1063655 - protein, 9 aa, Homo Sapiens
GSLRADDLV

SEQ ID NO: 1063656 - protein, 9 aa, Homo Sapiens
GAALYAAWI

SEQ ID NO: 1063657 - protein, 9 aa, Homo Sapiens
DKDTSCSTI

SEQ ID NO: 1063658 - protein, 9 aa, Homo Sapiens
PEAWLENER

SEQ ID NO: 1063659 - protein, 9 aa, Homo Sapiens
TLCEAICPA

SEQ ID NO: 1063660 - protein, 9 aa, Homo Sapiens
PDTQENMGF

SEQ ID NO: 1063661 - protein, 9 aa, Homo Sapiens
VKTVALNAP

SEQ ID NO: 1063662 - protein, 9 aa, Homo Sapiens
DHQEVNTKL

SEQ ID NO: 1063663 - protein, 9 aa, Homo Sapiens
EKDFNLATK

SEQ ID NO: 1063664 - protein, 9 aa, Homo Sapiens
VTKAKRLKL

SEQ ID NO: 1063665 - protein, 9 aa, Homo Sapiens
CENVRVSGW

SEQ ID NO: 1063666 - protein, 9 aa, Homo Sapiens
TQGQSRGLL

SEQ ID NO: 1063667 - protein, 9 aa, Homo Sapiens
WRRLPWWET

SEQ ID NO: 1063668 - protein, 9 aa, Homo Sapiens
TVAIFLKDD

SEQ ID NO: 1063669 - protein, 9 aa, Homo Sapiens
YIEDAMTAF

SEQ ID NO: 1063670 - protein, 9 aa, Homo Sapiens
SPSLLKNKL

SEQ ID NO: 1063671 - protein, 9 aa, Homo Sapiens
GLSDFFYPK

SEQ ID NO: 1063672 - protein, 9 aa, Homo Sapiens
VGKKFEEDL

SEQ ID NO: 1063673 - protein, 9 aa, Homo Sapiens
LKETIYYLM

SEQ ID NO: 1063674 - protein, 9 aa, Homo Sapiens
FTTTPGPVI

SEQ ID NO: 1063675 - protein, 9 aa, Homo Sapiens
GRFGIVLSN

SEQ ID NO: 1063676 - protein, 9 aa, Homo Sapiens
IENLTRLLL

SEQ ID NO: 1063677 - protein, 9 aa, Homo Sapiens
SKVASKKTF

SEQ ID NO: 1063678 - protein, 9 aa, Homo Sapiens
SKSEKRGSS

SEQ ID NO: 1063679 - protein, 9 aa, Homo Sapiens
AFSRSSVLT

SEQ ID NO: 1063680 - protein, 9 aa, Homo Sapiens
SEPVVYGDI

SEQ ID NO: 1063681 - protein, 9 aa, Homo Sapiens
LATSAIPPL

SEQ ID NO: 1063682 - protein, 9 aa, Homo Sapiens
EVFNRLDFS

SEQ ID NO: 1063683 - protein, 9 aa, Homo Sapiens
HNECGSGQH

SEQ ID NO: 1063684 - protein, 9 aa, Homo Sapiens
DEESRESDS
